United States Patent 7,943,754 (BIOINFORMATICALLY DETECTABLE GROUP OF NOVEL REGULATORY BACTERIAL AND BACTERIAL ASSOCIATED OLIGONUCLEOTIDES AND USES THEREOF) - sequence listing, part 68

SEQ ID NO: 2445815 - RNA, 18 nt, Bordetella pertussis
caguugcgucuccagcgc

SEQ ID NO: 2445816 - RNA, 14 nt, Bordetella pertussis
caguugcuggccca

SEQ ID NO: 2445817 - RNA, 17 nt, Bordetella pertussis
caguugcuggcccagga

SEQ ID NO: 2445818 - RNA, 14 nt, Bordetella pertussis
caguugggcgcgcc

SEQ ID NO: 2445819 - RNA, 20 nt, Bordetella pertussis
caguugggcgcgcccagccc

SEQ ID NO: 2445820 - RNA, 22 nt, Bordetella pertussis
caguugggcgcgcccagccccg

SEQ ID NO: 2445821 - RNA, 20 nt, Bordetella pertussis
cauaaggcuucucgaccagg

SEQ ID NO: 2445822 - RNA, 20 nt, Bordetella pertussis
cauacaacgaguaccugcug

SEQ ID NO: 2445823 - RNA, 15 nt, Bordetella pertussis
cauacaaggcgcggc

SEQ ID NO: 2445824 - RNA, 17 nt, Bordetella pertussis
cauacauccucgaugcc

SEQ ID NO: 2445825 - RNA, 15 nt, Bordetella pertussis
cauaccagcccggcg

SEQ ID NO: 2445826 - RNA, 14 nt, Bordetella pertussis
cauacccauggcca

SEQ ID NO: 2445827 - RNA, 23 nt, Bordetella pertussis
cauacccauggccaaugaccgac

SEQ ID NO: 2445828 - RNA, 20 nt, Bordetella pertussis
cauaccgaucuacgacgccu

SEQ ID NO: 2445829 - RNA, 13 nt, Bordetella pertussis
cauaccggccgcg

SEQ ID NO: 2445830 - RNA, 21 nt, Bordetella pertussis
cauacgacacgucaucguggc

SEQ ID NO: 2445831 - RNA, 23 nt, Bordetella pertussis
cauacgacacgucaucguggccg

SEQ ID NO: 2445832 - RNA, 21 nt, Bordetella pertussis
cauacgcggguucgacgccgg

SEQ ID NO: 2445833 - RNA, 21 nt, Bordetella pertussis
cauacggacgagcgcagcaag

SEQ ID NO: 2445834 - RNA, 14 nt, Bordetella pertussis
cauacugcaugaug

SEQ ID NO: 2445835 - RNA, 16 nt, Bordetella pertussis
cauagacgccgaccgc

SEQ ID NO: 2445836 - RNA, 18 nt, Bordetella pertussis
cauagaucuccggcgccu

SEQ ID NO: 2445837 - RNA, 17 nt, Bordetella pertussis
cauagaugccgaacagc

SEQ ID NO: 2445838 - RNA, 13 nt, Bordetella pertussis
cauagcccggcgc

SEQ ID NO: 2445839 - RNA, 14 nt, Bordetella pertussis
cauagcccggcgcg

SEQ ID NO: 2445840 - RNA, 21 nt, Bordetella pertussis
cauagcgccgcucgacgucgc

SEQ ID NO: 2445841 - RNA, 12 nt, Bordetella pertussis
cauagcgccggu

SEQ ID NO: 2445842 - RNA, 14 nt, Bordetella pertussis
cauagcgcuggaac

SEQ ID NO: 2445843 - RNA, 21 nt, Bordetella pertussis
cauagcggccggcgcgcgcga

SEQ ID NO: 2445844 - RNA, 20 nt, Bordetella pertussis
caggucggccagcgugccgg

SEQ ID NO: 2445845 - RNA, 21 nt, Bordetella pertussis
caggucggccagcgugccggu

SEQ ID NO: 2445846 - RNA, 21 nt, Bordetella pertussis
caggucggcgaugcgcggggc

SEQ ID NO: 2445847 - RNA, 19 nt, Bordetella pertussis
caggucggcgcccacgccg

SEQ ID NO: 2445848 - RNA, 14 nt, Bordetella pertussis
caggucggcgcggc

SEQ ID NO: 2445849 - RNA, 16 nt, Bordetella pertussis
caggucggcgcggggc

SEQ ID NO: 2445850 - RNA, 14 nt, Bordetella pertussis
caggucggcggcca

SEQ ID NO: 2445851 - RNA, 18 nt, Bordetella pertussis
caggucggcggccagcgc

SEQ ID NO: 2445852 - RNA, 21 nt, Bordetella pertussis
caggucggcggccagcgcgca

SEQ ID NO: 2445853 - RNA, 13 nt, Bordetella pertussis
caggucggcgucg

SEQ ID NO: 2445854 - RNA, 23 nt, Bordetella pertussis
caggucgggauaguccagcaccg

SEQ ID NO: 2445855 - RNA, 22 nt, Bordetella pertussis
caggucgggcacgaucaccgcc

SEQ ID NO: 2445856 - RNA, 23 nt, Bordetella pertussis
caggucgggcacgaucaccgccg

SEQ ID NO: 2445857 - RNA, 14 nt, Bordetella pertussis
caggucggucgccu

SEQ ID NO: 2445858 - RNA, 19 nt, Bordetella pertussis
caggucguagaccgccgcg

SEQ ID NO: 2445859 - RNA, 21 nt, Bordetella pertussis
caggucgucguagcgggcggc

SEQ ID NO: 2445860 - RNA, 17 nt, Bordetella pertussis
caggucguggcccagcc

SEQ ID NO: 2445861 - RNA, 19 nt, Bordetella pertussis
caggucguggcccagccgg

SEQ ID NO: 2445862 - RNA, 15 nt, Bordetella pertussis
caggucguggccgug

SEQ ID NO: 2445863 - RNA, 17 nt, Bordetella pertussis
caggucguugcgcgaag

SEQ ID NO: 2445864 - RNA, 20 nt, Bordetella pertussis
caggucguugcgcgaagcgg

SEQ ID NO: 2445865 - RNA, 13 nt, Bordetella pertussis
caggucugcacga

SEQ ID NO: 2445866 - RNA, 15 nt, Bordetella pertussis
caggucuucgggcgu

SEQ ID NO: 2445867 - RNA, 16 nt, Bordetella pertussis
caggugaaacagcagc

SEQ ID NO: 2445868 - RNA, 19 nt, Bordetella pertussis
caggugaugcgcgcggcca

SEQ ID NO: 2445869 - RNA, 21 nt, Bordetella pertussis
caggugaugcgcgcggccagc

SEQ ID NO: 2445870 - RNA, 15 nt, Bordetella pertussis
caggugcacggugga

SEQ ID NO: 2445871 - RNA, 20 nt, Bordetella pertussis
caggugcaggguuggcgcgc

SEQ ID NO: 2445872 - RNA, 22 nt, Bordetella pertussis
caggugcaggguuggcgcgccg

SEQ ID NO: 2445873 - RNA, 16 nt, Bordetella pertussis
caggugccccacgccg

SEQ ID NO: 2445874 - RNA, 21 nt, Bordetella pertussis
caggugccccacgccgaugcc

SEQ ID NO: 2445875 - RNA, 18 nt, Bordetella pertussis
caggugccugucccagcg

SEQ ID NO: 2445876 - RNA, 18 nt, Bordetella pertussis
caggugcgccagcacggc

SEQ ID NO: 2445877 - RNA, 15 nt, Bordetella pertussis
caggugcgccaugcg

SEQ ID NO: 2445878 - RNA, 16 nt, Bordetella pertussis
caggugcgcggcgcgc

SEQ ID NO: 2445879 - RNA, 17 nt, Bordetella pertussis
caggugcgcggcgcgcc

SEQ ID NO: 2445880 - RNA, 19 nt, Bordetella pertussis
caggugcgcggcgcgccgu

SEQ ID NO: 2445881 - RNA, 17 nt, Bordetella pertussis
caggugcggccgcagcg

SEQ ID NO: 2445882 - RNA, 14 nt, Bordetella pertussis
caggugcgggccgc

SEQ ID NO: 2445883 - RNA, 20 nt, Bordetella pertussis
caggugcgucacgcacagca

SEQ ID NO: 2445884 - RNA, 15 nt, Bordetella pertussis
caggugcuugcggcu

SEQ ID NO: 2445885 - RNA, 23 nt, Bordetella pertussis
cagguggacagcgccagcccgcu

SEQ ID NO: 2445886 - RNA, 20 nt, Bordetella pertussis
cagguggcgcuguccggcgc

SEQ ID NO: 2445887 - RNA, 23 nt, Bordetella pertussis
cagguggcgcuguccggcgcucg

SEQ ID NO: 2445888 - RNA, 19 nt, Bordetella pertussis
cagguggcggacaggcccu

SEQ ID NO: 2445889 - RNA, 14 nt, Bordetella pertussis
cagguggcggcggc

SEQ ID NO: 2445890 - RNA, 15 nt, Bordetella pertussis
cagguggcggcggca

SEQ ID NO: 2445891 - RNA, 14 nt, Bordetella pertussis
caggugggccaggu

SEQ ID NO: 2445892 - RNA, 16 nt, Bordetella pertussis
caggugggccgagccc

SEQ ID NO: 2445893 - RNA, 19 nt, Bordetella pertussis
caggugggccgagcccgcg

SEQ ID NO: 2445894 - RNA, 14 nt, Bordetella pertussis
caggugggcgcgcu

SEQ ID NO: 2445895 - RNA, 20 nt, Bordetella pertussis
caggugggcgcgcucagcgc

SEQ ID NO: 2445896 - RNA, 15 nt, Bordetella pertussis
cagguggggcagcag

SEQ ID NO: 2445897 - RNA, 22 nt, Bordetella pertussis
cagguggggcagcaggccggcg

SEQ ID NO: 2445898 - RNA, 23 nt, Bordetella pertussis
cagguggggcagcaggccggcgg

SEQ ID NO: 2445899 - RNA, 19 nt, Bordetella pertussis
caggugugccagccgcugg

SEQ ID NO: 2445900 - RNA, 17 nt, Bordetella pertussis
cagguguucgcgcacca

SEQ ID NO: 2445901 - RNA, 20 nt, Bordetella pertussis
cagguguucgcgcaccagcg

SEQ ID NO: 2445902 - RNA, 22 nt, Bordetella pertussis
cagguguucgcgcaccagcgga

SEQ ID NO: 2445903 - RNA, 21 nt, Bordetella pertussis
cagguuagccagugccucagg

SEQ ID NO: 2445904 - RNA, 16 nt, Bordetella pertussis
cagguucaucagccgg

SEQ ID NO: 2445905 - RNA, 19 nt, Bordetella pertussis
cagguucaucgagaacacg

SEQ ID NO: 2445906 - RNA, 23 nt, Bordetella pertussis
cagguucaugaccaucgcgcacu

SEQ ID NO: 2445907 - RNA, 17 nt, Bordetella pertussis
cagguucgccuggcggg

SEQ ID NO: 2445908 - RNA, 21 nt, Bordetella pertussis
cagguucugcgcguccuggcg

SEQ ID NO: 2445909 - RNA, 17 nt, Bordetella pertussis
cagguugaagccgacgg

SEQ ID NO: 2445910 - RNA, 17 nt, Bordetella pertussis
cagguugagucuggaga

SEQ ID NO: 2445911 - RNA, 18 nt, Bordetella pertussis
cagguugagucuggagau

SEQ ID NO: 2445912 - RNA, 22 nt, Bordetella pertussis
cagguugagucuggagaugggu

SEQ ID NO: 2445913 - RNA, 19 nt, Bordetella pertussis
cagguugcgccggcucagc

SEQ ID NO: 2445914 - RNA, 22 nt, Bordetella pertussis
cagguugcgguaguucagcagc

SEQ ID NO: 2445915 - RNA, 14 nt, Bordetella pertussis
cagguuggccgcga

SEQ ID NO: 2445916 - RNA, 19 nt, Bordetella pertussis
cagguuggcgauggcgucg

SEQ ID NO: 2445917 - RNA, 17 nt, Bordetella pertussis
cagguugggcaccacca

SEQ ID NO: 2445918 - RNA, 21 nt, Bordetella pertussis
cagguugggcaccaccaccgc

SEQ ID NO: 2445919 - RNA, 16 nt, Bordetella pertussis
cagguuguccagcgcg

SEQ ID NO: 2445920 - RNA, 19 nt, Bordetella pertussis
cagguuguccagcgcgccc

SEQ ID NO: 2445921 - RNA, 20 nt, Bordetella pertussis
cagguuguccagcgcgccca

SEQ ID NO: 2445922 - RNA, 14 nt, Bordetella pertussis
cagguugucgcgcg

SEQ ID NO: 2445923 - RNA, 23 nt, Bordetella pertussis
cagguugucgcgcgagaccagcg

SEQ ID NO: 2445924 - RNA, 17 nt, Bordetella pertussis
cagguugugguucauga

SEQ ID NO: 2445925 - RNA, 23 nt, Bordetella pertussis
cagguuuuccacagccaggccga

SEQ ID NO: 2445926 - RNA, 14 nt, Bordetella pertussis
caguacaccggcgu

SEQ ID NO: 2445927 - RNA, 14 nt, Bordetella pertussis
caguacaggcgcgu

SEQ ID NO: 2445928 - RNA, 13 nt, Bordetella pertussis
caguacaggcugc

SEQ ID NO: 2445929 - RNA, 19 nt, Bordetella pertussis
caguacaggcugccgucgu

SEQ ID NO: 2445930 - RNA, 21 nt, Bordetella pertussis
caguacaggcugccgucgucg

SEQ ID NO: 2445931 - RNA, 13 nt, Bordetella pertussis
caguacgaugccg

SEQ ID NO: 2445932 - RNA, 17 nt, Bordetella pertussis
caguacguacgcccggc

SEQ ID NO: 2445933 - RNA, 18 nt, Bordetella pertussis
caguacguacgcccggcc

SEQ ID NO: 2445934 - RNA, 18 nt, Bordetella pertussis
caguacuuguugcgugcc

SEQ ID NO: 2445935 - RNA, 12 nt, Bordetella pertussis
caguagcgccgg

SEQ ID NO: 2445936 - RNA, 20 nt, Bordetella pertussis
caguagcgccggcuugcgcc

SEQ ID NO: 2445937 - RNA, 21 nt, Bordetella pertussis
caguagcgccggcuugcgcca

SEQ ID NO: 2445938 - RNA, 19 nt, Bordetella pertussis
caguagcguugcaguucgg

SEQ ID NO: 2445939 - RNA, 19 nt, Bordetella pertussis
caguaucccggccaggcgc

SEQ ID NO: 2445940 - RNA, 23 nt, Bordetella pertussis
caguaugggcugucgcaacagcc

SEQ ID NO: 2445941 - RNA, 18 nt, Bordetella pertussis
caguauggugaccggcgu

SEQ ID NO: 2445942 - RNA, 20 nt, Bordetella pertussis
caguauggugaccggcguga

SEQ ID NO: 2445943 - RNA, 21 nt, Bordetella pertussis
cagucauggaucgacugcccc

SEQ ID NO: 2445944 - RNA, 16 nt, Bordetella pertussis
caguccaaggaaagcc

SEQ ID NO: 2445945 - RNA, 23 nt, Bordetella pertussis
caguccaccuugaguugcggguc

SEQ ID NO: 2445946 - RNA, 16 nt, Bordetella pertussis
caguccagcgcgccgc

SEQ ID NO: 2445947 - RNA, 17 nt, Bordetella pertussis
caguccagcgcgccgcg

SEQ ID NO: 2445948 - RNA, 18 nt, Bordetella pertussis
caguccagcgcgccgcga

SEQ ID NO: 2445949 - RNA, 18 nt, Bordetella pertussis
caguccagcgucggcgua

SEQ ID NO: 2445950 - RNA, 16 nt, Bordetella pertussis
caguccagcguggagc

SEQ ID NO: 2445951 - RNA, 19 nt, Bordetella pertussis
caguccagcuggcccuggc

SEQ ID NO: 2445952 - RNA, 13 nt, Bordetella pertussis
caguccaggccgg

SEQ ID NO: 2445953 - RNA, 15 nt, Bordetella pertussis
caguccaggccggcc

SEQ ID NO: 2445954 - RNA, 22 nt, Bordetella pertussis
caguccaggccggccugcaaug

SEQ ID NO: 2445955 - RNA, 13 nt, Bordetella pertussis
caguccagggugu

SEQ ID NO: 2445956 - RNA, 14 nt, Bordetella pertussis
caguccaggguguc

SEQ ID NO: 2445957 - RNA, 22 nt, Bordetella pertussis
cagucccaggaucaccgccgcg

SEQ ID NO: 2445958 - RNA, 11 nt, Bordetella pertussis
caccaccggca

SEQ ID NO: 2445959 - RNA, 15 nt, Bordetella pertussis
caccaccggcaaggc

SEQ ID NO: 2445960 - RNA, 17 nt, Bordetella pertussis
caccaccggcaaggccg

SEQ ID NO: 2445961 - RNA, 18 nt, Bordetella pertussis
caccaccggcacgccggc

SEQ ID NO: 2445962 - RNA, 14 nt, Bordetella pertussis
caccaccgucucga

SEQ ID NO: 2445963 - RNA, 21 nt, Bordetella pertussis
caccaccgucucgaacgccgc

SEQ ID NO: 2445964 - RNA, 19 nt, Bordetella pertussis
caccaccuccaccgccagc

SEQ ID NO: 2445965 - RNA, 13 nt, Bordetella pertussis
caccaccucggcc

SEQ ID NO: 2445966 - RNA, 17 nt, Bordetella pertussis
caccaccucggccucgc

SEQ ID NO: 2445967 - RNA, 22 nt, Bordetella pertussis
caccaccucggccucgcuggcg

SEQ ID NO: 2445968 - RNA, 18 nt, Bordetella pertussis
caccacgaccggcucggg

SEQ ID NO: 2445969 - RNA, 17 nt, Bordetella pertussis
caccacgaugucggcgc

SEQ ID NO: 2445970 - RNA, 18 nt, Bordetella pertussis
caccacgaugucggcgca

SEQ ID NO: 2445971 - RNA, 19 nt, Bordetella pertussis
caccacgcccaucugccag

SEQ ID NO: 2445972 - RNA, 15 nt, Bordetella pertussis
caccacgcccgcgcc

SEQ ID NO: 2445973 - RNA, 16 nt, Bordetella pertussis
caccacgcccgcgccg

SEQ ID NO: 2445974 - RNA, 20 nt, Bordetella pertussis
caccacgccgcccagcgcgu

SEQ ID NO: 2445975 - RNA, 17 nt, Bordetella pertussis
caccacgcgcaccagcu

SEQ ID NO: 2445976 - RNA, 22 nt, Bordetella pertussis
caccacgcuggcuucgucgccg

SEQ ID NO: 2445977 - RNA, 19 nt, Bordetella pertussis
caccacggcaucggcgccg

SEQ ID NO: 2445978 - RNA, 15 nt, Bordetella pertussis
caccacggcgcgcgc

SEQ ID NO: 2445979 - RNA, 23 nt, Bordetella pertussis
caccacggcgcggaugccgucca

SEQ ID NO: 2445980 - RNA, 14 nt, Bordetella pertussis
caccacggcggcca

SEQ ID NO: 2445981 - RNA, 15 nt, Bordetella pertussis
caccacggcggccag

SEQ ID NO: 2445982 - RNA, 12 nt, Bordetella pertussis
caccacggcggg

SEQ ID NO: 2445983 - RNA, 20 nt, Bordetella pertussis
caccacggcgggaucgggca

SEQ ID NO: 2445984 - RNA, 23 nt, Bordetella pertussis
caccacgggcacgauggccgcgc

SEQ ID NO: 2445985 - RNA, 19 nt, Bordetella pertussis
caccacgggcucgcugacc

SEQ ID NO: 2445986 - RNA, 18 nt, Bordetella pertussis
caccacguccuggggcgc

SEQ ID NO: 2445987 - RNA, 17 nt, Bordetella pertussis
caccacgucgcggcugg

SEQ ID NO: 2445988 - RNA, 18 nt, Bordetella pertussis
caccacgucgcggcuggg

SEQ ID NO: 2445989 - RNA, 19 nt, Bordetella pertussis
caccacgucgcggcugggc

SEQ ID NO: 2445990 - RNA, 18 nt, Bordetella pertussis
caccacugcaaggcccgc

SEQ ID NO: 2445991 - RNA, 12 nt, Bordetella pertussis
caccagcaagcc

SEQ ID NO: 2445992 - RNA, 20 nt, Bordetella pertussis
caccagcaagccggcggucc

SEQ ID NO: 2445993 - RNA, 23 nt, Bordetella pertussis
caccagcaagccggcggucccga

SEQ ID NO: 2445994 - RNA, 18 nt, Bordetella pertussis
caccagcacaucgacguc

SEQ ID NO: 2445995 - RNA, 20 nt, Bordetella pertussis
caccagcacaucgacgucgg

SEQ ID NO: 2445996 - RNA, 14 nt, Bordetella pertussis
caccagcaccaugc

SEQ ID NO: 2445997 - RNA, 13 nt, Bordetella pertussis
caccagcaccgcc

SEQ ID NO: 2445998 - RNA, 14 nt, Bordetella pertussis
caccagcaccgcca

SEQ ID NO: 2445999 - RNA, 17 nt, Bordetella pertussis
caccagcaccggcagcg

SEQ ID NO: 2446000 - RNA, 14 nt, Bordetella pertussis
caccagcagcccca

SEQ ID NO: 2446001 - RNA, 15 nt, Bordetella pertussis
caccagcagccccag

SEQ ID NO: 2446002 - RNA, 13 nt, Bordetella pertussis
caccagcagcgcc

SEQ ID NO: 2446003 - RNA, 14 nt, Bordetella pertussis
caccagcagcgcca

SEQ ID NO: 2446004 - RNA, 15 nt, Bordetella pertussis
caccagcagcgccag

SEQ ID NO: 2446005 - RNA, 16 nt, Bordetella pertussis
caccagcagcgccagg

SEQ ID NO: 2446006 - RNA, 17 nt, Bordetella pertussis
caccagcagcgccagga

SEQ ID NO: 2446007 - RNA, 12 nt, Bordetella pertussis
caccagcaggau

SEQ ID NO: 2446008 - RNA, 14 nt, Bordetella pertussis
caccagcaggaugg

SEQ ID NO: 2446009 - RNA, 13 nt, Bordetella pertussis
caccagcaggccg

SEQ ID NO: 2446010 - RNA, 14 nt, Bordetella pertussis
caccagcaggccgg

SEQ ID NO: 2446011 - RNA, 14 nt, Bordetella pertussis
caccagcaggcggc

SEQ ID NO: 2446012 - RNA, 15 nt, Bordetella pertussis
caccagcaggcggcc

SEQ ID NO: 2446013 - RNA, 20 nt, Bordetella pertussis
caccagcaugcgcgucucca

SEQ ID NO: 2446014 - RNA, 13 nt, Bordetella pertussis
caccagcaugucg

SEQ ID NO: 2446015 - RNA, 23 nt, Bordetella pertussis
caccagccaaaucaacgaucuag

SEQ ID NO: 2446016 - RNA, 23 nt, Bordetella pertussis
caccagccauucgauggcggcgc

SEQ ID NO: 2446017 - RNA, 14 nt, Bordetella pertussis
caccagcccgcccg

SEQ ID NO: 2446018 - RNA, 15 nt, Bordetella pertussis
caccagcccgcccgc

SEQ ID NO: 2446019 - RNA, 15 nt, Bordetella pertussis
caccagccgcccggc

SEQ ID NO: 2446020 - RNA, 13 nt, Bordetella pertussis
caccagccggccg

SEQ ID NO: 2446021 - RNA, 14 nt, Bordetella pertussis
caccagccggccgc

SEQ ID NO: 2446022 - RNA, 17 nt, Bordetella pertussis
caccagccggccgccga

SEQ ID NO: 2446023 - RNA, 16 nt, Bordetella pertussis
caccagccgggcggcc

SEQ ID NO: 2446024 - RNA, 19 nt, Bordetella pertussis
caccagccugaugcgcaga

SEQ ID NO: 2446025 - RNA, 15 nt, Bordetella pertussis
caccagcgaggcggc

SEQ ID NO: 2446026 - RNA, 16 nt, Bordetella pertussis
caccagcgaggcggca

SEQ ID NO: 2446027 - RNA, 20 nt, Bordetella pertussis
caccagcgcauugccgccgc

SEQ ID NO: 2446028 - RNA, 22 nt, Bordetella pertussis
caccagcgccaggaacagcgcc

SEQ ID NO: 2446029 - RNA, 15 nt, Bordetella pertussis
caccagcgccgacgg

SEQ ID NO: 2446030 - RNA, 13 nt, Bordetella pertussis
caccagcgcgcca

SEQ ID NO: 2446031 - RNA, 16 nt, Bordetella pertussis
caggacgacaggcaug

SEQ ID NO: 2446032 - RNA, 18 nt, Bordetella pertussis
caggacgacaggcaugca

SEQ ID NO: 2446033 - RNA, 15 nt, Bordetella pertussis
caggacgccggcgcc

SEQ ID NO: 2446034 - RNA, 23 nt, Bordetella pertussis
caggacggcaucuguccgcgccg

SEQ ID NO: 2446035 - RNA, 14 nt, Bordetella pertussis
caggacggcgccgu

SEQ ID NO: 2446036 - RNA, 16 nt, Bordetella pertussis
caggacggggaacagg

SEQ ID NO: 2446037 - RNA, 21 nt, Bordetella pertussis
caggacggggaacaggcgcgc

SEQ ID NO: 2446038 - RNA, 23 nt, Bordetella pertussis
caggacggggaacaggcgcgcca

SEQ ID NO: 2446039 - RNA, 23 nt, Bordetella pertussis
caggacggugucgcugacuucgc

SEQ ID NO: 2446040 - RNA, 16 nt, Bordetella pertussis
caggacguccaggccu

SEQ ID NO: 2446041 - RNA, 22 nt, Bordetella pertussis
caggacuucgucgaucauggcg

SEQ ID NO: 2446042 - RNA, 14 nt, Bordetella pertussis
caggagacuggcag

SEQ ID NO: 2446043 - RNA, 16 nt, Bordetella pertussis
caggagcaacuggggc

SEQ ID NO: 2446044 - RNA, 14 nt, Bordetella pertussis
caggagcucguccc

SEQ ID NO: 2446045 - RNA, 15 nt, Bordetella pertussis
caggaggcgcgggca

SEQ ID NO: 2446046 - RNA, 20 nt, Bordetella pertussis
caggaguucccagcgcgcga

SEQ ID NO: 2446047 - RNA, 14 nt, Bordetella pertussis
caggaucaggccgg

SEQ ID NO: 2446048 - RNA, 13 nt, Bordetella pertussis
caggauccccagc

SEQ ID NO: 2446049 - RNA, 14 nt, Bordetella pertussis
caggauccccagca

SEQ ID NO: 2446050 - RNA, 23 nt, Bordetella pertussis
caggaucgaaggcagcgcggccg

SEQ ID NO: 2446051 - RNA, 16 nt, Bordetella pertussis
caggaucgcggccagc

SEQ ID NO: 2446052 - RNA, 19 nt, Bordetella pertussis
caggaucgcggccagccgg

SEQ ID NO: 2446053 - RNA, 19 nt, Bordetella pertussis
caggaucgcggccagcggc

SEQ ID NO: 2446054 - RNA, 19 nt, Bordetella pertussis
caggaucgucgucaugaug

SEQ ID NO: 2446055 - RNA, 20 nt, Bordetella pertussis
caggaugaacaucggcagcg

SEQ ID NO: 2446056 - RNA, 17 nt, Bordetella pertussis
caggaugaagaccacgu

SEQ ID NO: 2446057 - RNA, 15 nt, Bordetella pertussis
caggaugaggcgccg

SEQ ID NO: 2446058 - RNA, 17 nt, Bordetella pertussis
caggaugaugcagcaca

SEQ ID NO: 2446059 - RNA, 18 nt, Bordetella pertussis
caggaugaugcagcacac

SEQ ID NO: 2446060 - RNA, 13 nt, Bordetella pertussis
caggaugcccggg

SEQ ID NO: 2446061 - RNA, 15 nt, Bordetella pertussis
caggaugcccggggu

SEQ ID NO: 2446062 - RNA, 23 nt, Bordetella pertussis
caggaugcccuggguggcggggc

SEQ ID NO: 2446063 - RNA, 14 nt, Bordetella pertussis
caggaugccgccuu

SEQ ID NO: 2446064 - RNA, 14 nt, Bordetella pertussis
caggaugcgcaccg

SEQ ID NO: 2446065 - RNA, 18 nt, Bordetella pertussis
caggaugcgcaccggcca

SEQ ID NO: 2446066 - RNA, 20 nt, Bordetella pertussis
caggaugcgcaccggccagg

SEQ ID NO: 2446067 - RNA, 15 nt, Bordetella pertussis
caggaugcgcauggg

SEQ ID NO: 2446068 - RNA, 14 nt, Bordetella pertussis
caggaugcgcgaca

SEQ ID NO: 2446069 - RNA, 14 nt, Bordetella pertussis
caggaugcgcggca

SEQ ID NO: 2446070 - RNA, 16 nt, Bordetella pertussis
caggaugcgcuggccg

SEQ ID NO: 2446071 - RNA, 20 nt, Bordetella pertussis
caggaugcgcuggccggccg

SEQ ID NO: 2446072 - RNA, 16 nt, Bordetella pertussis
caggccaugcugggcc

SEQ ID NO: 2446073 - RNA, 18 nt, Bordetella pertussis
caggccauugcuggcgcg

SEQ ID NO: 2446074 - RNA, 16 nt, Bordetella pertussis
caggcccaccagggac

SEQ ID NO: 2446075 - RNA, 16 nt, Bordetella pertussis
caggcccaccagggcc

SEQ ID NO: 2446076 - RNA, 23 nt, Bordetella pertussis
caggcccaccagggccagcuuga

SEQ ID NO: 2446077 - RNA, 13 nt, Bordetella pertussis
caggcccaccgca

SEQ ID NO: 2446078 - RNA, 17 nt, Bordetella pertussis
caggcccaccgcaucgc

SEQ ID NO: 2446079 - RNA, 21 nt, Bordetella pertussis
caggcccaccggcaugccguc

SEQ ID NO: 2446080 - RNA, 13 nt, Bordetella pertussis
caggcccacgccg

SEQ ID NO: 2446081 - RNA, 14 nt, Bordetella pertussis
caggcccacgccgc

SEQ ID NO: 2446082 - RNA, 15 nt, Bordetella pertussis
caggcccacgccgcc

SEQ ID NO: 2446083 - RNA, 16 nt, Bordetella pertussis
caggcccacgccgcgu

SEQ ID NO: 2446084 - RNA, 16 nt, Bordetella pertussis
caggcccacggcaucg

SEQ ID NO: 2446085 - RNA, 19 nt, Bordetella pertussis
caggcccacggcaucgccg

SEQ ID NO: 2446086 - RNA, 15 nt, Bordetella pertussis
caggcccacggcgcc

SEQ ID NO: 2446087 - RNA, 16 nt, Bordetella pertussis
caggcccacggcgcca

SEQ ID NO: 2446088 - RNA, 19 nt, Bordetella pertussis
caggcccagcacgaugagc

SEQ ID NO: 2446089 - RNA, 15 nt, Bordetella pertussis
caggcccagcacgcg

SEQ ID NO: 2446090 - RNA, 20 nt, Bordetella pertussis
caggcccagcacgcgcgcca

SEQ ID NO: 2446091 - RNA, 20 nt, Bordetella pertussis
caggcccagcaucaggcccg

SEQ ID NO: 2446092 - RNA, 16 nt, Bordetella pertussis
caggcccagccagccc

SEQ ID NO: 2446093 - RNA, 13 nt, Bordetella pertussis
caggcccagcccg

SEQ ID NO: 2446094 - RNA, 13 nt, Bordetella pertussis
caggcccagcgcc

SEQ ID NO: 2446095 - RNA, 14 nt, Bordetella pertussis
caggcccagcgcca

SEQ ID NO: 2446096 - RNA, 16 nt, Bordetella pertussis
caggcccagcgccagc

SEQ ID NO: 2446097 - RNA, 18 nt, Bordetella pertussis
caggcccagcgccagcag

SEQ ID NO: 2446098 - RNA, 16 nt, Bordetella pertussis
caggcccagcgcgcca

SEQ ID NO: 2446099 - RNA, 22 nt, Bordetella pertussis
caggcccagcuugaacaggcag

SEQ ID NO: 2446100 - RNA, 12 nt, Bordetella pertussis
caggcccaggcg

SEQ ID NO: 2446101 - RNA, 16 nt, Bordetella pertussis
caggcccaggcgaccc

SEQ ID NO: 2446102 - RNA, 13 nt, Bordetella pertussis
caggcccagggcc

SEQ ID NO: 2446103 - RNA, 14 nt, Bordetella pertussis
caggcccagggcca

SEQ ID NO: 2446104 - RNA, 16 nt, Bordetella pertussis
caggcccagggccagg

SEQ ID NO: 2446105 - RNA, 17 nt, Bordetella pertussis
caggcccagggccaggu

SEQ ID NO: 2446106 - RNA, 14 nt, Bordetella pertussis
caggcccagggcga

SEQ ID NO: 2446107 - RNA, 21 nt, Bordetella pertussis
caggcccagggcgaugcggua

SEQ ID NO: 2446108 - RNA, 20 nt, Bordetella pertussis
caggcccaguucggcgcgcg

SEQ ID NO: 2446109 - RNA, 13 nt, Bordetella pertussis
caggcccaguuga

SEQ ID NO: 2446110 - RNA, 21 nt, Bordetella pertussis
caggcccauaugccgccggcc

SEQ ID NO: 2446111 - RNA, 22 nt, Bordetella pertussis
caggcccaugaaggcggccagc

SEQ ID NO: 2446112 - RNA, 23 nt, Bordetella pertussis
caggcccaugaaggcggccagca

SEQ ID NO: 2446113 - RNA, 14 nt, Bordetella pertussis
caggcccaugccgc

SEQ ID NO: 2446114 - RNA, 17 nt, Bordetella pertussis
caggcccaugccgcccg

SEQ ID NO: 2446115 - RNA, 18 nt, Bordetella pertussis
caggcccaugccgcggac

SEQ ID NO: 2446116 - RNA, 13 nt, Bordetella pertussis
caggcccauggcg

SEQ ID NO: 2446117 - RNA, 14 nt, Bordetella pertussis
caggcccauggcgu

SEQ ID NO: 2446118 - RNA, 15 nt, Bordetella pertussis
caggccccgccgggc

SEQ ID NO: 2446119 - RNA, 22 nt, Bordetella pertussis
caggccccgccgggccgcgccc

SEQ ID NO: 2446120 - RNA, 12 nt, Bordetella pertussis
caggccccggcc

SEQ ID NO: 2446121 - RNA, 23 nt, Bordetella pertussis
caggccccggcccggcgggccgg

SEQ ID NO: 2446122 - RNA, 14 nt, Bordetella pertussis
caggccccggccgg

SEQ ID NO: 2446123 - RNA, 20 nt, Bordetella pertussis
caggcccgaaacgcgcagca

SEQ ID NO: 2446124 - RNA, 17 nt, Bordetella pertussis
caggcccgccagggcca

SEQ ID NO: 2446125 - RNA, 15 nt, Bordetella pertussis
caggcccgcgcggcc

SEQ ID NO: 2446126 - RNA, 19 nt, Bordetella pertussis
caggcccgcgcggccagcg

SEQ ID NO: 2446127 - RNA, 21 nt, Bordetella pertussis
caggcccgcgcggccagcgcc

SEQ ID NO: 2446128 - RNA, 23 nt, Bordetella pertussis
caggcccgcgcggccagcgccgg

SEQ ID NO: 2446129 - RNA, 13 nt, Bordetella pertussis
caggcccgcggcc

SEQ ID NO: 2446130 - RNA, 16 nt, Bordetella pertussis
caggcccgcggccgcg

SEQ ID NO: 2446131 - RNA, 14 nt, Bordetella pertussis
caggcccgcggcgc

SEQ ID NO: 2446132 - RNA, 17 nt, Bordetella pertussis
caggcccgcggcgccag

SEQ ID NO: 2446133 - RNA, 14 nt, Bordetella pertussis
caggcccggccgca

SEQ ID NO: 2446134 - RNA, 23 nt, Bordetella pertussis
caggcccggccgcagggcgugcg

SEQ ID NO: 2446135 - RNA, 13 nt, Bordetella pertussis
caggcccggcgcg

SEQ ID NO: 2446136 - RNA, 15 nt, Bordetella pertussis
caggcccggcgcgca

SEQ ID NO: 2446137 - RNA, 17 nt, Bordetella pertussis
caggcccgggcgccugc

SEQ ID NO: 2446138 - RNA, 19 nt, Bordetella pertussis
caggcccgggcgccugcgc

SEQ ID NO: 2446139 - RNA, 16 nt, Bordetella pertussis
caggcccuccggcgcc

SEQ ID NO: 2446140 - RNA, 17 nt, Bordetella pertussis
caggcccuccggcgcca

SEQ ID NO: 2446141 - RNA, 20 nt, Bordetella pertussis
caggcccuccggcgccagca

SEQ ID NO: 2446142 - RNA, 16 nt, Bordetella pertussis
caggcccugccgccuc

SEQ ID NO: 2446143 - RNA, 21 nt, Bordetella pertussis
caggcccugcgcguugagcag

SEQ ID NO: 2446144 - RNA, 14 nt, Bordetella pertussis
caggcccuggcggc

SEQ ID NO: 2446145 - RNA, 17 nt, Bordetella pertussis
caggcccuggcggcgca

SEQ ID NO: 2446146 - RNA, 15 nt, Bordetella pertussis
caggcccuggcuggc

SEQ ID NO: 2446147 - RNA, 19 nt, Bordetella pertussis
caggcccuggcuggccagc

SEQ ID NO: 2446148 - RNA, 14 nt, Bordetella pertussis
cauagcugcgccaa

SEQ ID NO: 2446149 - RNA, 17 nt, Bordetella pertussis
cauaggcaucgaccagc

SEQ ID NO: 2446150 - RNA, 14 nt, Bordetella pertussis
cauaggccagcgcc

SEQ ID NO: 2446151 - RNA, 20 nt, Bordetella pertussis
cauaggcuucgcccgccacc

SEQ ID NO: 2446152 - RNA, 19 nt, Bordetella pertussis
cauagggcgacugcagcag

SEQ ID NO: 2446153 - RNA, 13 nt, Bordetella pertussis
cauauccacgcca

SEQ ID NO: 2446154 - RNA, 19 nt, Bordetella pertussis
cauauccacgccacuggcc

SEQ ID NO: 2446155 - RNA, 17 nt, Bordetella pertussis
cauaucgaacucgaucc

SEQ ID NO: 2446156 - RNA, 21 nt, Bordetella pertussis
cauaucggugccccauuuuuu

SEQ ID NO: 2446157 - RNA, 17 nt, Bordetella pertussis
cauaucgucgcugcggc

SEQ ID NO: 2446158 - RNA, 13 nt, Bordetella pertussis
cauaugcgcgaag

SEQ ID NO: 2446159 - RNA, 13 nt, Bordetella pertussis
cauauucacagcc

SEQ ID NO: 2446160 - RNA, 17 nt, Bordetella pertussis
cauauugaugcagcacg

SEQ ID NO: 2446161 - RNA, 23 nt, Bordetella pertussis
cauauugaugcagcacgucggcg

SEQ ID NO: 2446162 - RNA, 21 nt, Bordetella pertussis
caucaacgacaaagccuccgc

SEQ ID NO: 2446163 - RNA, 20 nt, Bordetella pertussis
caucaacgggccgcugguca

SEQ ID NO: 2446164 - RNA, 14 nt, Bordetella pertussis
caucaacguggcgu

SEQ ID NO: 2446165 - RNA, 14 nt, Bordetella pertussis
caucaagagcaccg

SEQ ID NO: 2446166 - RNA, 13 nt, Bordetella pertussis
caucacaucgcua

SEQ ID NO: 2446167 - RNA, 20 nt, Bordetella pertussis
caucaccaagggcgccgggc

SEQ ID NO: 2446168 - RNA, 22 nt, Bordetella pertussis
caucaccaagggcgccgggcgg

SEQ ID NO: 2446169 - RNA, 19 nt, Bordetella pertussis
caucaccagcagguggcgc

SEQ ID NO: 2446170 - RNA, 18 nt, Bordetella pertussis
caucaccagcucgcggcc

SEQ ID NO: 2446171 - RNA, 12 nt, Bordetella pertussis
caucaccagggu

SEQ ID NO: 2446172 - RNA, 11 nt, Bordetella pertussis
caucaccaugg

SEQ ID NO: 2446173 - RNA, 14 nt, Bordetella pertussis
caucaccauggccg

SEQ ID NO: 2446174 - RNA, 17 nt, Bordetella pertussis
caucaccuucccgcuuu

SEQ ID NO: 2446175 - RNA, 13 nt, Bordetella pertussis
caucacgagcagg

SEQ ID NO: 2446176 - RNA, 21 nt, Bordetella pertussis
caucacgcggucgaugcgcac

SEQ ID NO: 2446177 - RNA, 18 nt, Bordetella pertussis
caucacgcuggccgcgcc

SEQ ID NO: 2446178 - RNA, 13 nt, Bordetella pertussis
caucacgggcgcc

SEQ ID NO: 2446179 - RNA, 14 nt, Bordetella pertussis
caucacgggcgcca

SEQ ID NO: 2446180 - RNA, 18 nt, Bordetella pertussis
caucacgggcgccagcag

SEQ ID NO: 2446181 - RNA, 22 nt, Bordetella pertussis
caucacggugucgaugggcccg

SEQ ID NO: 2446182 - RNA, 13 nt, Bordetella pertussis
caucagcgcgccc

SEQ ID NO: 2446183 - RNA, 18 nt, Bordetella pertussis
caucagcgcgcccgcuuc

SEQ ID NO: 2446184 - RNA, 17 nt, Bordetella pertussis
caucagcgcgcgcagcc

SEQ ID NO: 2446185 - RNA, 16 nt, Bordetella pertussis
caucagcggcagcacg

SEQ ID NO: 2446186 - RNA, 18 nt, Bordetella pertussis
caucagcggcagcacgau

SEQ ID NO: 2446187 - RNA, 19 nt, Bordetella pertussis
caucgagaaaccagccgcc

SEQ ID NO: 2446188 - RNA, 21 nt, Bordetella pertussis
caucgagaaaccagccgccgc

SEQ ID NO: 2446189 - RNA, 16 nt, Bordetella pertussis
caucgagcaccgccuc

SEQ ID NO: 2446190 - RNA, 15 nt, Bordetella pertussis
caucgagcgccuggg

SEQ ID NO: 2446191 - RNA, 19 nt, Bordetella pertussis
caucgagcgccugggcggc

SEQ ID NO: 2446192 - RNA, 20 nt, Bordetella pertussis
caucgagcgccugggcggcc

SEQ ID NO: 2446193 - RNA, 14 nt, Bordetella pertussis
caucgagcuccugc

SEQ ID NO: 2446194 - RNA, 20 nt, Bordetella pertussis
caucgaggcaaucagcccca

SEQ ID NO: 2446195 - RNA, 21 nt, Bordetella pertussis
caucgagggcgucaucggcgc

SEQ ID NO: 2446196 - RNA, 23 nt, Bordetella pertussis
caucgagggcgucaucggcgcgc

SEQ ID NO: 2446197 - RNA, 16 nt, Bordetella pertussis
caucgauaugggcggc

SEQ ID NO: 2446198 - RNA, 15 nt, Bordetella pertussis
caucgaucagcgcgc

SEQ ID NO: 2446199 - RNA, 16 nt, Bordetella pertussis
caucgaucagcgcgcc

SEQ ID NO: 2446200 - RNA, 17 nt, Bordetella pertussis
caucgaucagcgcgccg

SEQ ID NO: 2446201 - RNA, 18 nt, Bordetella pertussis
caucgaucagcgcgccgu

SEQ ID NO: 2446202 - RNA, 16 nt, Bordetella pertussis
caucgaucucggccuc

SEQ ID NO: 2446203 - RNA, 23 nt, Bordetella pertussis
caucgaugcgccgcaccagcgcc

SEQ ID NO: 2446204 - RNA, 18 nt, Bordetella pertussis
caucgaugugcaugccgu

SEQ ID NO: 2446205 - RNA, 16 nt, Bordetella pertussis
caucgauguggccuac

SEQ ID NO: 2446206 - RNA, 18 nt, Bordetella pertussis
caucgauuucucgcugcu

SEQ ID NO: 2446207 - RNA, 20 nt, Bordetella pertussis
caucgauuucucgcugcuga

SEQ ID NO: 2446208 - RNA, 14 nt, Bordetella pertussis
caucgccaugccgg

SEQ ID NO: 2446209 - RNA, 17 nt, Bordetella pertussis
caucgccaugccggccc

SEQ ID NO: 2446210 - RNA, 18 nt, Bordetella pertussis
caucgccaugccggcccc

SEQ ID NO: 2446211 - RNA, 13 nt, Bordetella pertussis
caucgccaugcug

SEQ ID NO: 2446212 - RNA, 14 nt, Bordetella pertussis
caucgccaugcugc

SEQ ID NO: 2446213 - RNA, 19 nt, Bordetella pertussis
caucgcccauugcggcggg

SEQ ID NO: 2446214 - RNA, 13 nt, Bordetella pertussis
caucgcccggcag

SEQ ID NO: 2446215 - RNA, 14 nt, Bordetella pertussis
caucgcccggcagg

SEQ ID NO: 2446216 - RNA, 18 nt, Bordetella pertussis
caucgcccggcaggucga

SEQ ID NO: 2446217 - RNA, 14 nt, Bordetella pertussis
caucgcccgugcuu

SEQ ID NO: 2446218 - RNA, 13 nt, Bordetella pertussis
caucgcccugcuc

SEQ ID NO: 2446219 - RNA, 15 nt, Bordetella pertussis
caucgcccugcucga

SEQ ID NO: 2446220 - RNA, 20 nt, Bordetella pertussis
caucgcccugcucgaucugg

SEQ ID NO: 2446221 - RNA, 14 nt, Bordetella pertussis
caucgccgaacagg

SEQ ID NO: 2446222 - RNA, 12 nt, Bordetella pertussis
caucgccgccag

SEQ ID NO: 2446223 - RNA, 13 nt, Bordetella pertussis
caucgccgccagc

SEQ ID NO: 2446224 - RNA, 16 nt, Bordetella pertussis
caucgccgccagcuug

SEQ ID NO: 2446225 - RNA, 17 nt, Bordetella pertussis
caucgccgccagcuugg

SEQ ID NO: 2446226 - RNA, 19 nt, Bordetella pertussis
caucgccgccgccgggcug

SEQ ID NO: 2446227 - RNA, 13 nt, Bordetella pertussis
caucgccgccugc

SEQ ID NO: 2446228 - RNA, 18 nt, Bordetella pertussis
caucgccgcugcgcagca

SEQ ID NO: 2446229 - RNA, 13 nt, Bordetella pertussis
caucgccggcggc

SEQ ID NO: 2446230 - RNA, 20 nt, Bordetella pertussis
caucgccugcacgaccugcg

SEQ ID NO: 2446231 - RNA, 13 nt, Bordetella pertussis
caucgcgaccccg

SEQ ID NO: 2446232 - RNA, 17 nt, Bordetella pertussis
caucgcgaugcgcagca

SEQ ID NO: 2446233 - RNA, 19 nt, Bordetella pertussis
caucgcgcaagggccaguc

SEQ ID NO: 2446234 - RNA, 13 nt, Bordetella pertussis
caucgcgcauggc

SEQ ID NO: 2446235 - RNA, 15 nt, Bordetella pertussis
caucgcgcauggcga

SEQ ID NO: 2446236 - RNA, 19 nt, Bordetella pertussis
caucgcgccuucggcgcgc

SEQ ID NO: 2446237 - RNA, 14 nt, Bordetella pertussis
caucgcgcgccgcc

SEQ ID NO: 2446238 - RNA, 16 nt, Bordetella pertussis
caucgcgcgcgccggc

SEQ ID NO: 2446239 - RNA, 22 nt, Bordetella pertussis
caucgcgcgcgccggcaucggc

SEQ ID NO: 2446240 - RNA, 14 nt, Bordetella pertussis
caucgcgcugacga

SEQ ID NO: 2446241 - RNA, 19 nt, Bordetella pertussis
caucgcgcugacgaaaugc

SEQ ID NO: 2446242 - RNA, 13 nt, Bordetella pertussis
caucgcgcuggcg

SEQ ID NO: 2446243 - RNA, 16 nt, Bordetella pertussis
caucgcgcuggcgcgc

SEQ ID NO: 2446244 - RNA, 17 nt, Bordetella pertussis
caucgcgcuggcgcgcg

SEQ ID NO: 2446245 - RNA, 18 nt, Bordetella pertussis
caucgcgcuggcgcgcga

SEQ ID NO: 2446246 - RNA, 15 nt, Bordetella pertussis
caucgcgcuggcggu

SEQ ID NO: 2446247 - RNA, 18 nt, Bordetella pertussis
caucgcgcuggcgguggc

SEQ ID NO: 2446248 - RNA, 14 nt, Bordetella pertussis
caucgcggcagccc

SEQ ID NO: 2446249 - RNA, 19 nt, Bordetella pertussis
caucgcggcagcccggcac

SEQ ID NO: 2446250 - RNA, 22 nt, Bordetella pertussis
caucgcgguccugaccggcggc

SEQ ID NO: 2446251 - RNA, 17 nt, Bordetella pertussis
caucgcguccaggccca

SEQ ID NO: 2446252 - RNA, 19 nt, Bordetella pertussis
caucgcguccaggcccagc

SEQ ID NO: 2446253 - RNA, 15 nt, Bordetella pertussis
caucgcuaugcagcu

SEQ ID NO: 2446254 - RNA, 20 nt, Bordetella pertussis
caucgcuaugcagcugcgcc

SEQ ID NO: 2446255 - RNA, 20 nt, Bordetella pertussis
caucgcugguaugcacgaug

SEQ ID NO: 2446256 - RNA, 17 nt, Bordetella pertussis
caucgcuuccuugguca

SEQ ID NO: 2446257 - RNA, 15 nt, Bordetella pertussis
caucggcacccagcc

SEQ ID NO: 2446258 - RNA, 17 nt, Bordetella pertussis
caucggcacccagccgg

SEQ ID NO: 2446259 - RNA, 18 nt, Bordetella pertussis
caucggcacgggucaggc

SEQ ID NO: 2446260 - RNA, 14 nt, Bordetella pertussis
caucggcaggccgg

SEQ ID NO: 2446261 - RNA, 15 nt, Bordetella pertussis
caucggcaggccggc

SEQ ID NO: 2446262 - RNA, 16 nt, Bordetella pertussis
caucggcaggccggcg

SEQ ID NO: 2446263 - RNA, 17 nt, Bordetella pertussis
caucggcaggccggcgc

SEQ ID NO: 2446264 - RNA, 19 nt, Bordetella pertussis
caucggcaggccggcgcgc

SEQ ID NO: 2446265 - RNA, 20 nt, Bordetella pertussis
caugacguccagcgccacca

SEQ ID NO: 2446266 - RNA, 20 nt, Bordetella pertussis
caugacgucgacguugcgcg

SEQ ID NO: 2446267 - RNA, 17 nt, Bordetella pertussis
caugacguucuccagcg

SEQ ID NO: 2446268 - RNA, 20 nt, Bordetella pertussis
caugacguucuccagcgccg

SEQ ID NO: 2446269 - RNA, 21 nt, Bordetella pertussis
caugaggaacggcaccagccg

SEQ ID NO: 2446270 - RNA, 22 nt, Bordetella pertussis
caugaggaacggcaccagccgg

SEQ ID NO: 2446271 - RNA, 14 nt, Bordetella pertussis
caugaggcggcggu

SEQ ID NO: 2446272 - RNA, 21 nt, Bordetella pertussis
caugaggcggcgguaccaggc

SEQ ID NO: 2446273 - RNA, 18 nt, Bordetella pertussis
caugauacccauggccgu

SEQ ID NO: 2446274 - RNA, 14 nt, Bordetella pertussis
caugaucaggccga

SEQ ID NO: 2446275 - RNA, 16 nt, Bordetella pertussis
caugaucaggccgaac

SEQ ID NO: 2446276 - RNA, 15 nt, Bordetella pertussis
caugaucccgcgccu

SEQ ID NO: 2446277 - RNA, 21 nt, Bordetella pertussis
caugaucgccggcaacguggu

SEQ ID NO: 2446278 - RNA, 23 nt, Bordetella pertussis
caugaucgccggcaacguggugc

SEQ ID NO: 2446279 - RNA, 19 nt, Bordetella pertussis
caugaucuggccgaccagc

SEQ ID NO: 2446280 - RNA, 12 nt, Bordetella pertussis
caugaugcccag

SEQ ID NO: 2446281 - RNA, 22 nt, Bordetella pertussis
caugaugcccagcgccagggcc

SEQ ID NO: 2446282 - RNA, 21 nt, Bordetella pertussis
caugaugcgcugggccaggcc

SEQ ID NO: 2446283 - RNA, 15 nt, Bordetella pertussis
caugaugcugccggg

SEQ ID NO: 2446284 - RNA, 17 nt, Bordetella pertussis
caugaugcugccgggca

SEQ ID NO: 2446285 - RNA, 13 nt, Bordetella pertussis
caugauggccggc

SEQ ID NO: 2446286 - RNA, 19 nt, Bordetella pertussis
caugauggccggccugccg

SEQ ID NO: 2446287 - RNA, 16 nt, Bordetella pertussis
caugauggugcugccg

SEQ ID NO: 2446288 - RNA, 18 nt, Bordetella pertussis
caugauguagcccauguu

SEQ ID NO: 2446289 - RNA, 19 nt, Bordetella pertussis
caugaugucgcgggcccgc

SEQ ID NO: 2446290 - RNA, 14 nt, Bordetella pertussis
caugauuccaccuu

SEQ ID NO: 2446291 - RNA, 21 nt, Bordetella pertussis
caugauuccugucgcgcugcu

SEQ ID NO: 2446292 - RNA, 16 nt, Bordetella pertussis
caugcaagacaggccg

SEQ ID NO: 2446293 - RNA, 14 nt, Bordetella pertussis
caugcaccagcaca

SEQ ID NO: 2446294 - RNA, 14 nt, Bordetella pertussis
caugcaccaggcgu

SEQ ID NO: 2446295 - RNA, 19 nt, Bordetella pertussis
caugcacgacuacggcgga

SEQ ID NO: 2446296 - RNA, 22 nt, Bordetella pertussis
caugcacgacuacggcggacug

SEQ ID NO: 2446297 - RNA, 22 nt, Bordetella pertussis
caugcacgauauuggcgucggc

SEQ ID NO: 2446298 - RNA, 21 nt, Bordetella pertussis
caugcacgggccauggaugcg

SEQ ID NO: 2446299 - RNA, 14 nt, Bordetella pertussis
caugcagaacaggg

SEQ ID NO: 2446300 - RNA, 17 nt, Bordetella pertussis
caugcagaacagggugc

SEQ ID NO: 2446301 - RNA, 21 nt, Bordetella pertussis
caugcagaacagggugccgcc

SEQ ID NO: 2446302 - RNA, 20 nt, Bordetella pertussis
caugcagcuggauggccugc

SEQ ID NO: 2446303 - RNA, 13 nt, Bordetella pertussis
caugcagguccug

SEQ ID NO: 2446304 - RNA, 17 nt, Bordetella pertussis
caugcaguacaggcgcg

SEQ ID NO: 2446305 - RNA, 18 nt, Bordetella pertussis
caugccaccacaaggaug

SEQ ID NO: 2446306 - RNA, 12 nt, Bordetella pertussis
caugcccaggcc

SEQ ID NO: 2446307 - RNA, 14 nt, Bordetella pertussis
caugcccaggccca

SEQ ID NO: 2446308 - RNA, 16 nt, Bordetella pertussis
caugcccaggcccagu

SEQ ID NO: 2446309 - RNA, 19 nt, Bordetella pertussis
caugcccaggcccaguucg

SEQ ID NO: 2446310 - RNA, 17 nt, Bordetella pertussis
caugcccaugccgccau

SEQ ID NO: 2446311 - RNA, 22 nt, Bordetella pertussis
caugcccauuuccaccacgcgg

SEQ ID NO: 2446312 - RNA, 22 nt, Bordetella pertussis
caugccccauccagcggacggg

SEQ ID NO: 2446313 - RNA, 20 nt, Bordetella pertussis
caugcccgaccgcaugggcg

SEQ ID NO: 2446314 - RNA, 19 nt, Bordetella pertussis
caugcccgccggcacccgg

SEQ ID NO: 2446315 - RNA, 20 nt, Bordetella pertussis
caugcccgccggcacccggc

SEQ ID NO: 2446316 - RNA, 23 nt, Bordetella pertussis
caugcccgccggcacccggcuca

SEQ ID NO: 2446317 - RNA, 15 nt, Bordetella pertussis
caugcccggccacca

SEQ ID NO: 2446318 - RNA, 17 nt, Bordetella pertussis
caugcccggccaccagc

SEQ ID NO: 2446319 - RNA, 18 nt, Bordetella pertussis
caugcccggccaccagcg

SEQ ID NO: 2446320 - RNA, 20 nt, Bordetella pertussis
caugcccuccucggccaggu

SEQ ID NO: 2446321 - RNA, 17 nt, Bordetella pertussis
caugccgaacagcaugg

SEQ ID NO: 2446322 - RNA, 18 nt, Bordetella pertussis
caugccgaccaccagcac

SEQ ID NO: 2446323 - RNA, 22 nt, Bordetella pertussis
caugccgacggauucgcccagg

SEQ ID NO: 2446324 - RNA, 17 nt, Bordetella pertussis
caugccgaucagcgggc

SEQ ID NO: 2446325 - RNA, 15 nt, Bordetella pertussis
caugccgauggcggu

SEQ ID NO: 2446326 - RNA, 23 nt, Bordetella pertussis
caugccgauguuguuggccgcca

SEQ ID NO: 2446327 - RNA, 19 nt, Bordetella pertussis
caugccgccaugcagcugg

SEQ ID NO: 2446328 - RNA, 14 nt, Bordetella pertussis
caugccgcccgcca

SEQ ID NO: 2446329 - RNA, 16 nt, Bordetella pertussis
caugccgcgcgccuua

SEQ ID NO: 2446330 - RNA, 13 nt, Bordetella pertussis
caugccgcgcgcg

SEQ ID NO: 2446331 - RNA, 14 nt, Bordetella pertussis
caugccgcgcgcgc

SEQ ID NO: 2446332 - RNA, 16 nt, Bordetella pertussis
caugccgcgcgcgcag

SEQ ID NO: 2446333 - RNA, 17 nt, Bordetella pertussis
caugccgcgcgcgcaga

SEQ ID NO: 2446334 - RNA, 18 nt, Bordetella pertussis
caugccgcggacccaggc

SEQ ID NO: 2446335 - RNA, 19 nt, Bordetella pertussis
caugccgcggacccaggcc

SEQ ID NO: 2446336 - RNA, 24 nt, Bordetella pertussis
caugccgcggacccaggccucggc

SEQ ID NO: 2446337 - RNA, 14 nt, Bordetella pertussis
caugccgcgguggc

SEQ ID NO: 2446338 - RNA, 21 nt, Bordetella pertussis
caugccgcugaccagcacgau

SEQ ID NO: 2446339 - RNA, 18 nt, Bordetella pertussis
caugccggaacaggcgcc

SEQ ID NO: 2446340 - RNA, 16 nt, Bordetella pertussis
caugccggacaagccc

SEQ ID NO: 2446341 - RNA, 15 nt, Bordetella pertussis
caugccggacgcggg

SEQ ID NO: 2446342 - RNA, 21 nt, Bordetella pertussis
caugccggcauaggcggcgca

SEQ ID NO: 2446343 - RNA, 18 nt, Bordetella pertussis
caugccguccacgcccag

SEQ ID NO: 2446344 - RNA, 20 nt, Bordetella pertussis
caugccguccacgcccagcg

SEQ ID NO: 2446345 - RNA, 22 nt, Bordetella pertussis
caugccguccacgcccagcgcc

SEQ ID NO: 2446346 - RNA, 23 nt, Bordetella pertussis
caugccguccacgcccagcgccg

SEQ ID NO: 2446347 - RNA, 14 nt, Bordetella pertussis
caugccgucgcgca

SEQ ID NO: 2446348 - RNA, 22 nt, Bordetella pertussis
caugccgucgcgcaccaccugg

SEQ ID NO: 2446349 - RNA, 20 nt, Bordetella pertussis
caugccgucgcgcucggacg

SEQ ID NO: 2446350 - RNA, 12 nt, Bordetella pertussis
caugccgugcca

SEQ ID NO: 2446351 - RNA, 19 nt, Bordetella pertussis
caugccuugcgcgacagca

SEQ ID NO: 2446352 - RNA, 16 nt, Bordetella pertussis
caugcgaaagccggcc

SEQ ID NO: 2446353 - RNA, 19 nt, Bordetella pertussis
caugcgaaagccggccucc

SEQ ID NO: 2446354 - RNA, 18 nt, Bordetella pertussis
caugcgaaagcggccagc

SEQ ID NO: 2446355 - RNA, 22 nt, Bordetella pertussis
caugcgaagaauuggccgucca

SEQ ID NO: 2446356 - RNA, 17 nt, Bordetella pertussis
caugcgaaugaucucgc

SEQ ID NO: 2446357 - RNA, 21 nt, Bordetella pertussis
caugcgaaugaucucgcgcuu

SEQ ID NO: 2446358 - RNA, 13 nt, Bordetella pertussis
caugcgacagccc

SEQ ID NO: 2446359 - RNA, 23 nt, Bordetella pertussis
caugcgauacagcuuggcgcgcg

SEQ ID NO: 2446360 - RNA, 16 nt, Bordetella pertussis
caugcgauagcgggcc

SEQ ID NO: 2446361 - RNA, 17 nt, Bordetella pertussis
caugcgauagcgggccu

SEQ ID NO: 2446362 - RNA, 16 nt, Bordetella pertussis
caugcgauccagggcg

SEQ ID NO: 2446363 - RNA, 16 nt, Bordetella pertussis
caugcgcaccaccgcc

SEQ ID NO: 2446364 - RNA, 16 nt, Bordetella pertussis
caugcgcaccuugucg

SEQ ID NO: 2446365 - RNA, 19 nt, Bordetella pertussis
caugcgcacggacagcccg

SEQ ID NO: 2446366 - RNA, 14 nt, Bordetella pertussis
caugcgcagcaaca

SEQ ID NO: 2446367 - RNA, 20 nt, Bordetella pertussis
caugcgcaucgcgaccgcca

SEQ ID NO: 2446368 - RNA, 14 nt, Bordetella pertussis
caugcgcaugcugg

SEQ ID NO: 2446369 - RNA, 15 nt, Bordetella pertussis
caugcgcaugcugga

SEQ ID NO: 2446370 - RNA, 18 nt, Bordetella pertussis
caugcgcauggccagcgc

SEQ ID NO: 2446371 - RNA, 19 nt, Bordetella pertussis
caugcgcauggccagcgcg

SEQ ID NO: 2446372 - RNA, 14 nt, Bordetella pertussis
caugcgccagccag

SEQ ID NO: 2446373 - RNA, 15 nt, Bordetella pertussis
caugcgccagcgccu

SEQ ID NO: 2446374 - RNA, 18 nt, Bordetella pertussis
caugcgccagcgccuggg

SEQ ID NO: 2446375 - RNA, 14 nt, Bordetella pertussis
caugcgcccggcca

SEQ ID NO: 2446376 - RNA, 15 nt, Bordetella pertussis
caugcgccgcaccag

SEQ ID NO: 2446377 - RNA, 19 nt, Bordetella pertussis
caugcgccgcaccagcggc

SEQ ID NO: 2446378 - RNA, 16 nt, Bordetella pertussis
caugcgccggcccggc

SEQ ID NO: 2446379 - RNA, 18 nt, Bordetella pertussis
caugcgccguccucaggc

SEQ ID NO: 2446380 - RNA, 15 nt, Bordetella pertussis
caugcgccugcgcca

SEQ ID NO: 2446381 - RNA, 11 nt, Bordetella pertussis
caugcgcgaac

SEQ ID NO: 2446382 - RNA, 14 nt, Bordetella pertussis
caugcgcgaacgcg

SEQ ID NO: 2446383 - RNA, 19 nt, Bordetella pertussis
caugcgcgaacgcgcgccg

SEQ ID NO: 2446384 - RNA, 21 nt, Bordetella pertussis
caugcgcgaacgcgcgccggc

SEQ ID NO: 2446385 - RNA, 22 nt, Bordetella pertussis
caugcgcgaacgcgcgccggcc

SEQ ID NO: 2446386 - RNA, 20 nt, Bordetella pertussis
caugcgcggcgggacggcca

SEQ ID NO: 2446387 - RNA, 21 nt, Bordetella pertussis
caugcgcggcgggacggccau

SEQ ID NO: 2446388 - RNA, 15 nt, Bordetella pertussis
caugcgcgguugggc

SEQ ID NO: 2446389 - RNA, 19 nt, Bordetella pertussis
caugcgcgucuccagcgcc

SEQ ID NO: 2446390 - RNA, 20 nt, Bordetella pertussis
caugcgcgucuccagcgccg

SEQ ID NO: 2446391 - RNA, 21 nt, Bordetella pertussis
caugcgcgucuccagcgccgg

SEQ ID NO: 2446392 - RNA, 14 nt, Bordetella pertussis
caugcgcugcuggc

SEQ ID NO: 2446393 - RNA, 14 nt, Bordetella pertussis
caugcgcugggcau

SEQ ID NO: 2446394 - RNA, 16 nt, Bordetella pertussis
caugcgcuggucgcgc

SEQ ID NO: 2446395 - RNA, 17 nt, Bordetella pertussis
caugcgcuggucgcgca

SEQ ID NO: 2446396 - RNA, 21 nt, Bordetella pertussis
caugcgcuggucgcgcagcac

SEQ ID NO: 2446397 - RNA, 15 nt, Bordetella pertussis
caugcgcuuggaccc

SEQ ID NO: 2446398 - RNA, 18 nt, Bordetella pertussis
caugcgcuuggaccccgu

SEQ ID NO: 2446399 - RNA, 16 nt, Bordetella pertussis
caugcgcuugucgccg

SEQ ID NO: 2446400 - RNA, 18 nt, Bordetella pertussis
caugcgcuugucgccgcu

SEQ ID NO: 2446401 - RNA, 20 nt, Bordetella pertussis
caugcgcuugucgccgcugc

SEQ ID NO: 2446402 - RNA, 20 nt, Bordetella pertussis
caugcggacgccagcccugg

SEQ ID NO: 2446403 - RNA, 17 nt, Bordetella pertussis
caugcggaugaacgacc

SEQ ID NO: 2446404 - RNA, 21 nt, Bordetella pertussis
caugcggaugaacgaccagca

SEQ ID NO: 2446405 - RNA, 22 nt, Bordetella pertussis
caugcggcacaaccuggcgcgc

SEQ ID NO: 2446406 - RNA, 16 nt, Bordetella pertussis
caugcggcccgcgcug

SEQ ID NO: 2446407 - RNA, 19 nt, Bordetella pertussis
caugcggccgucgccgccc

SEQ ID NO: 2446408 - RNA, 14 nt, Bordetella pertussis
caugcggcguccug

SEQ ID NO: 2446409 - RNA, 15 nt, Bordetella pertussis
caugcggcuggccga

SEQ ID NO: 2446410 - RNA, 20 nt, Bordetella pertussis
caugcggcuggccgaucacc

SEQ ID NO: 2446411 - RNA, 18 nt, Bordetella pertussis
caugcgggacaggcgcca

SEQ ID NO: 2446412 - RNA, 13 nt, Bordetella pertussis
caugcggggacag

SEQ ID NO: 2446413 - RNA, 15 nt, Bordetella pertussis
caugcggggacaggc

SEQ ID NO: 2446414 - RNA, 17 nt, Bordetella pertussis
caugcggggacaggcac

SEQ ID NO: 2446415 - RNA, 20 nt, Bordetella pertussis
caugcggggacaggcacucc

SEQ ID NO: 2446416 - RNA, 22 nt, Bordetella pertussis
caugcggggacaggcacuccgg

SEQ ID NO: 2446417 - RNA, 14 nt, Bordetella pertussis
caugcgggucaggc

SEQ ID NO: 2446418 - RNA, 15 nt, Bordetella pertussis
caugcgggucaggcc

SEQ ID NO: 2446419 - RNA, 18 nt, Bordetella pertussis
caugcgggucaggccgcc

SEQ ID NO: 2446420 - RNA, 18 nt, Bordetella pertussis
caugcggucgaugaccuc

SEQ ID NO: 2446421 - RNA, 15 nt, Bordetella pertussis
caugcggugcgcccu

SEQ ID NO: 2446422 - RNA, 16 nt, Bordetella pertussis
caugcggugcgccgcg

SEQ ID NO: 2446423 - RNA, 20 nt, Bordetella pertussis
caugcgguuucucagcgcgc

SEQ ID NO: 2446424 - RNA, 22 nt, Bordetella pertussis
caugcgguuucucagcgcgcuu

SEQ ID NO: 2446425 - RNA, 13 nt, Bordetella pertussis
caugcgucgaacg

SEQ ID NO: 2446426 - RNA, 19 nt, Bordetella pertussis
caugcgucgaacggccggg

SEQ ID NO: 2446427 - RNA, 18 nt, Bordetella pertussis
caugcgugaagcccaugg

SEQ ID NO: 2446428 - RNA, 20 nt, Bordetella pertussis
caugcgugaagcccauggcg

SEQ ID NO: 2446429 - RNA, 14 nt, Bordetella pertussis
caugcguucggcca

SEQ ID NO: 2446430 - RNA, 16 nt, Bordetella pertussis
caugcguucggccagc

SEQ ID NO: 2446431 - RNA, 14 nt, Bordetella pertussis
caugcucagcagca

SEQ ID NO: 2446432 - RNA, 18 nt, Bordetella pertussis
caugcucgcgcacagcgc

SEQ ID NO: 2446433 - RNA, 17 nt, Bordetella pertussis
caugcucguccaucgcc

SEQ ID NO: 2446434 - RNA, 20 nt, Bordetella pertussis
caugcucuggcacaccagcg

SEQ ID NO: 2446435 - RNA, 21 nt, Bordetella pertussis
caugcucuggcacaccagcgc

SEQ ID NO: 2446436 - RNA, 18 nt, Bordetella pertussis
caugcugaauugcgggcc

SEQ ID NO: 2446437 - RNA, 16 nt, Bordetella pertussis
caugcugcgacagcag

SEQ ID NO: 2446438 - RNA, 19 nt, Bordetella pertussis
caugcugcgacagcagggc

SEQ ID NO: 2446439 - RNA, 18 nt, Bordetella pertussis
caugcugcguaggcaggg

SEQ ID NO: 2446440 - RNA, 19 nt, Bordetella pertussis
caugcuggcccagcugggc

SEQ ID NO: 2446441 - RNA, 22 nt, Bordetella pertussis
caugcuggcccagcugggcggc

SEQ ID NO: 2446442 - RNA, 12 nt, Bordetella pertussis
caugcuggccgc

SEQ ID NO: 2446443 - RNA, 17 nt, Bordetella pertussis
caugcuggccgccgcgc

SEQ ID NO: 2446444 - RNA, 22 nt, Bordetella pertussis
caugcuggucaucuacagcgcc

SEQ ID NO: 2446445 - RNA, 17 nt, Bordetella pertussis
caugcugucgcucauga

SEQ ID NO: 2446446 - RNA, 21 nt, Bordetella pertussis
caugcuugccauaggccagcg

SEQ ID NO: 2446447 - RNA, 19 nt, Bordetella pertussis
cauggaaccgguuggccag

SEQ ID NO: 2446448 - RNA, 14 nt, Bordetella pertussis
cauggacagcaccg

SEQ ID NO: 2446449 - RNA, 22 nt, Bordetella pertussis
cauggacagcaccgacaggccg

SEQ ID NO: 2446450 - RNA, 17 nt, Bordetella pertussis
cauggacgagggccggc

SEQ ID NO: 2446451 - RNA, 21 nt, Bordetella pertussis
cauggacgagggccggcgcca

SEQ ID NO: 2446452 - RNA, 15 nt, Bordetella pertussis
cauggacgccgccgc

SEQ ID NO: 2446453 - RNA, 17 nt, Bordetella pertussis
cauggacugcaggcgcu

SEQ ID NO: 2446454 - RNA, 15 nt, Bordetella pertussis
cauggagaccggcgc

SEQ ID NO: 2446455 - RNA, 14 nt, Bordetella pertussis
cauggagcuggggc

SEQ ID NO: 2446456 - RNA, 15 nt, Bordetella pertussis
cauggagcuggggcc

SEQ ID NO: 2446457 - RNA, 22 nt, Bordetella pertussis
cauggagcuggggccgcgcgcc

SEQ ID NO: 2446458 - RNA, 12 nt, Bordetella pertussis
cauggaggcgca

SEQ ID NO: 2446459 - RNA, 19 nt, Bordetella pertussis
cauggaggcgcagcgcggc

SEQ ID NO: 2446460 - RNA, 14 nt, Bordetella pertussis
cauggaggggcgca

SEQ ID NO: 2446461 - RNA, 16 nt, Bordetella pertussis
cauggcacagcgcggc

SEQ ID NO: 2446462 - RNA, 14 nt, Bordetella pertussis
cauggcacaggcca

SEQ ID NO: 2446463 - RNA, 15 nt, Bordetella pertussis
cauggcacaggccau

SEQ ID NO: 2446464 - RNA, 23 nt, Bordetella pertussis
cauggcagcucgcuaacaagggu

SEQ ID NO: 2446465 - RNA, 11 nt, Bordetella pertussis
cauggcagggc

SEQ ID NO: 2446466 - RNA, 17 nt, Bordetella pertussis
cauggcagggcgccgcg

SEQ ID NO: 2446467 - RNA, 18 nt, Bordetella pertussis
cauggcagggcgccgcgc

SEQ ID NO: 2446468 - RNA, 22 nt, Bordetella pertussis
cauggcaguacguacgcccggc

SEQ ID NO: 2446469 - RNA, 17 nt, Bordetella pertussis
cauggcaugagcgccuc

SEQ ID NO: 2446470 - RNA, 12 nt, Bordetella pertussis
cauggcaugcac

SEQ ID NO: 2446471 - RNA, 16 nt, Bordetella pertussis
cauggcaugcaccgcg

SEQ ID NO: 2446472 - RNA, 21 nt, Bordetella pertussis
cauggccaaugaccgacgccg

SEQ ID NO: 2446473 - RNA, 22 nt, Bordetella pertussis
cauggccaaugaccgacgccgu

SEQ ID NO: 2446474 - RNA, 13 nt, Bordetella pertussis
cauggccagggcc

SEQ ID NO: 2446475 - RNA, 16 nt, Bordetella pertussis
cauggccagggccgau

SEQ ID NO: 2446476 - RNA, 19 nt, Bordetella pertussis
cauggccagguacaggccg

SEQ ID NO: 2446477 - RNA, 22 nt, Bordetella pertussis
cauggccagguacaggccgccg

SEQ ID NO: 2446478 - RNA, 13 nt, Bordetella pertussis
cauggccagucug

SEQ ID NO: 2446479 - RNA, 14 nt, Bordetella pertussis
cauggcccggcucg

SEQ ID NO: 2446480 - RNA, 14 nt, Bordetella pertussis
cauggccgacagcg

SEQ ID NO: 2446481 - RNA, 17 nt, Bordetella pertussis
cauggccgacagcgucg

SEQ ID NO: 2446482 - RNA, 17 nt, Bordetella pertussis
cauggccgcgcccagcg

SEQ ID NO: 2446483 - RNA, 21 nt, Bordetella pertussis
cauggccgcgcccagcgcggc

SEQ ID NO: 2446484 - RNA, 22 nt, Bordetella pertussis
cauggccgcgcccagcgcggcc

SEQ ID NO: 2446485 - RNA, 16 nt, Bordetella pertussis
cauggccgcgcggcgc

SEQ ID NO: 2446486 - RNA, 17 nt, Bordetella pertussis
cauggccggcaggucga

SEQ ID NO: 2446487 - RNA, 16 nt, Bordetella pertussis
cauggccggccgccgg

SEQ ID NO: 2446488 - RNA, 21 nt, Bordetella pertussis
cauggccggccgccgggccgc

SEQ ID NO: 2446489 - RNA, 19 nt, Bordetella pertussis
cauggccgguucgaugacc

SEQ ID NO: 2446490 - RNA, 23 nt, Bordetella pertussis
cauggccgugcgcccgacgcugu

SEQ ID NO: 2446491 - RNA, 22 nt, Bordetella pertussis
cauggccucgucgaccacgccg

SEQ ID NO: 2446492 - RNA, 14 nt, Bordetella pertussis
cauggccuggccca

SEQ ID NO: 2446493 - RNA, 17 nt, Bordetella pertussis
cauggccuggcccagcu

SEQ ID NO: 2446494 - RNA, 22 nt, Bordetella pertussis
caucggcaggccggcgcgcgcg

SEQ ID NO: 2446495 - RNA, 21 nt, Bordetella pertussis
caucggccagcauacccugcg

SEQ ID NO: 2446496 - RNA, 23 nt, Bordetella pertussis
caucggccggcggucgcgcuggc

SEQ ID NO: 2446497 - RNA, 17 nt, Bordetella pertussis
caucggccugcaccggc

SEQ ID NO: 2446498 - RNA, 19 nt, Bordetella pertussis
caucggccugcaccggcgc

SEQ ID NO: 2446499 - RNA, 14 nt, Bordetella pertussis
caucggcgccaagc

SEQ ID NO: 2446500 - RNA, 21 nt, Bordetella pertussis
caucggcgccaagcggcaggc

SEQ ID NO: 2446501 - RNA, 13 nt, Bordetella pertussis
caucggcgccgcg

SEQ ID NO: 2446502 - RNA, 13 nt, Bordetella pertussis
caucggcgccggc

SEQ ID NO: 2446503 - RNA, 13 nt, Bordetella pertussis
caucggcgcgcgc

SEQ ID NO: 2446504 - RNA, 16 nt, Bordetella pertussis
caucggcgcgcgcugc

SEQ ID NO: 2446505 - RNA, 19 nt, Bordetella pertussis
caucggcguaccaggcagc

SEQ ID NO: 2446506 - RNA, 22 nt, Bordetella pertussis
caucggcguaccaggcagccgg

SEQ ID NO: 2446507 - RNA, 23 nt, Bordetella pertussis
caucggcuggcgcaagacgcggc

SEQ ID NO: 2446508 - RNA, 20 nt, Bordetella pertussis
caucgggauccgugcggcgc

SEQ ID NO: 2446509 - RNA, 15 nt, Bordetella pertussis
caucgggcagggcuu

SEQ ID NO: 2446510 - RNA, 18 nt, Bordetella pertussis
caucgggcagggcuucca

SEQ ID NO: 2446511 - RNA, 19 nt, Bordetella pertussis
caucgggcagggcuuccag

SEQ ID NO: 2446512 - RNA, 14 nt, Bordetella pertussis
caucgggccggcgg

SEQ ID NO: 2446513 - RNA, 16 nt, Bordetella pertussis
caucgggccggcggca

SEQ ID NO: 2446514 - RNA, 22 nt, Bordetella pertussis
caucggggggcaggcuggaagu

SEQ ID NO: 2446515 - RNA, 22 nt, Bordetella pertussis
caucggggucgaucgcaucgcg

SEQ ID NO: 2446516 - RNA, 20 nt, Bordetella pertussis
caucgggguuccacagcgcc

SEQ ID NO: 2446517 - RNA, 22 nt, Bordetella pertussis
caucgggugcggcgccugcguc

SEQ ID NO: 2446518 - RNA, 14 nt, Bordetella pertussis
caucggucaacgcc

SEQ ID NO: 2446519 - RNA, 16 nt, Bordetella pertussis
caucggugcggccggu

SEQ ID NO: 2446520 - RNA, 18 nt, Bordetella pertussis
caucggugcggccggugg

SEQ ID NO: 2446521 - RNA, 19 nt, Bordetella pertussis
cagggggacuggcacccgc

SEQ ID NO: 2446522 - RNA, 18 nt, Bordetella pertussis
cagggggucgaucauggc

SEQ ID NO: 2446523 - RNA, 20 nt, Bordetella pertussis
cagggggucuggcaccugcc

SEQ ID NO: 2446524 - RNA, 19 nt, Bordetella pertussis
cagggucaaggcgcggccg

SEQ ID NO: 2446525 - RNA, 23 nt, Bordetella pertussis
cagggucaaggcgcggccgucgu

SEQ ID NO: 2446526 - RNA, 14 nt, Bordetella pertussis
cagggucagcccgc

SEQ ID NO: 2446527 - RNA, 15 nt, Bordetella pertussis
cagggucagcccgcc

SEQ ID NO: 2446528 - RNA, 21 nt, Bordetella pertussis
cagggucagggugucgccggg

SEQ ID NO: 2446529 - RNA, 20 nt, Bordetella pertussis
caggguccagguggcccgca

SEQ ID NO: 2446530 - RNA, 18 nt, Bordetella pertussis
cagggucgagaccagcag

SEQ ID NO: 2446531 - RNA, 21 nt, Bordetella pertussis
cagggucgagaccagcagcgg

SEQ ID NO: 2446532 - RNA, 15 nt, Bordetella pertussis
cagggucgguugcag

SEQ ID NO: 2446533 - RNA, 14 nt, Bordetella pertussis
cagggucucggcca

SEQ ID NO: 2446534 - RNA, 13 nt, Bordetella pertussis
cagggucugcagg

SEQ ID NO: 2446535 - RNA, 16 nt, Bordetella pertussis
cagggugacgggcugg

SEQ ID NO: 2446536 - RNA, 19 nt, Bordetella pertussis
cagggugacgggcugggcc

SEQ ID NO: 2446537 - RNA, 16 nt, Bordetella pertussis
cagggugccccgccgg

SEQ ID NO: 2446538 - RNA, 14 nt, Bordetella pertussis
cagggugccgcccu

SEQ ID NO: 2446539 - RNA, 15 nt, Bordetella pertussis
cagggugccgcccuu

SEQ ID NO: 2446540 - RNA, 17 nt, Bordetella pertussis
cagggugccuguccccg

SEQ ID NO: 2446541 - RNA, 22 nt, Bordetella pertussis
cagggugcuguucaggcgcucg

SEQ ID NO: 2446542 - RNA, 17 nt, Bordetella pertussis
caggguggcaucgugga

SEQ ID NO: 2446543 - RNA, 12 nt, Bordetella pertussis
caggguggccac

SEQ ID NO: 2446544 - RNA, 16 nt, Bordetella pertussis
caggguggccaguucc

SEQ ID NO: 2446545 - RNA, 12 nt, Bordetella pertussis
caggguggccgc

SEQ ID NO: 2446546 - RNA, 16 nt, Bordetella pertussis
caggguggcgcccagg

SEQ ID NO: 2446547 - RNA, 15 nt, Bordetella pertussis
caggguggcgccggc

SEQ ID NO: 2446548 - RNA, 17 nt, Bordetella pertussis
caggguggcgccggcca

SEQ ID NO: 2446549 - RNA, 20 nt, Bordetella pertussis
caggguggcgccggccaccg

SEQ ID NO: 2446550 - RNA, 23 nt, Bordetella pertussis
cagggugguggccucguaucgcc

SEQ ID NO: 2446551 - RNA, 22 nt, Bordetella pertussis
caggguguagaccugcgggccg

SEQ ID NO: 2446552 - RNA, 20 nt, Bordetella pertussis
caggguguccuggucggcgc

SEQ ID NO: 2446553 - RNA, 24 nt, Bordetella pertussis
caggguguccuggucggcgcggca

SEQ ID NO: 2446554 - RNA, 14 nt, Bordetella pertussis
cagggugucggcca

SEQ ID NO: 2446555 - RNA, 22 nt, Bordetella pertussis
caggguucggugccuguccccg

SEQ ID NO: 2446556 - RNA, 16 nt, Bordetella pertussis
caggguuggcgcgccg

SEQ ID NO: 2446557 - RNA, 17 nt, Bordetella pertussis
caggguuggcgcgccgu

SEQ ID NO: 2446558 - RNA, 21 nt, Bordetella pertussis
caggguuuccucgccgacgaa

SEQ ID NO: 2446559 - RNA, 21 nt, Bordetella pertussis
caggguuucguggucgugcug

SEQ ID NO: 2446560 - RNA, 20 nt, Bordetella pertussis
caggguuugcuggcgcagca

SEQ ID NO: 2446561 - RNA, 16 nt, Bordetella pertussis
cagguacaggccgccg

SEQ ID NO: 2446562 - RNA, 18 nt, Bordetella pertussis
cagguacaucauccccag

SEQ ID NO: 2446563 - RNA, 23 nt, Bordetella pertussis
cagguacccccagcggcgcaccg

SEQ ID NO: 2446564 - RNA, 17 nt, Bordetella pertussis
cagguagaccacgcgcu

SEQ ID NO: 2446565 - RNA, 23 nt, Bordetella pertussis
cagguagaccacgcgcugcgcgc

SEQ ID NO: 2446566 - RNA, 16 nt, Bordetella pertussis
cagguagaucagccgc

SEQ ID NO: 2446567 - RNA, 20 nt, Bordetella pertussis
cagguagaucagccgcugca

SEQ ID NO: 2446568 - RNA, 22 nt, Bordetella pertussis
cagguagaucagccgcugcagc

SEQ ID NO: 2446569 - RNA, 15 nt, Bordetella pertussis
cagguagcgccucgc

SEQ ID NO: 2446570 - RNA, 21 nt, Bordetella pertussis
cagguagcgccucgcaucggc

SEQ ID NO: 2446571 - RNA, 23 nt, Bordetella pertussis
cagguagcgccucgcaucggccu

SEQ ID NO: 2446572 - RNA, 18 nt, Bordetella pertussis
cagguagcggucgccgcg

SEQ ID NO: 2446573 - RNA, 15 nt, Bordetella pertussis
cagguaggccggcgc

SEQ ID NO: 2446574 - RNA, 19 nt, Bordetella pertussis
cagguaggcgccgguccag

SEQ ID NO: 2446575 - RNA, 21 nt, Bordetella pertussis
cagguaggcgccgguccagcg

SEQ ID NO: 2446576 - RNA, 22 nt, Bordetella pertussis
cagguaggcgccgguccagcgc

SEQ ID NO: 2446577 - RNA, 15 nt, Bordetella pertussis
cagguagggcagcag

SEQ ID NO: 2446578 - RNA, 17 nt, Bordetella pertussis
cagguagggcagcaggu

SEQ ID NO: 2446579 - RNA, 17 nt, Bordetella pertussis
cagguagucggucaccg

SEQ ID NO: 2446580 - RNA, 23 nt, Bordetella pertussis
cagguagucgucgaaggcgcgcu

SEQ ID NO: 2446581 - RNA, 21 nt, Bordetella pertussis
cagguauuccgccgucagcuc

SEQ ID NO: 2446582 - RNA, 23 nt, Bordetella pertussis
cagguauucgggaugggccaccc

SEQ ID NO: 2446583 - RNA, 20 nt, Bordetella pertussis
cagguauugcggggcggcgu

SEQ ID NO: 2446584 - RNA, 16 nt, Bordetella pertussis
caggucaucaccaggg

SEQ ID NO: 2446585 - RNA, 16 nt, Bordetella pertussis
caggucaucgccaggc

SEQ ID NO: 2446586 - RNA, 16 nt, Bordetella pertussis
cagguccacauccgcg

SEQ ID NO: 2446587 - RNA, 21 nt, Bordetella pertussis
cagguccacauccgcgcugcu

SEQ ID NO: 2446588 - RNA, 16 nt, Bordetella pertussis
cagguccaccgccacg

SEQ ID NO: 2446589 - RNA, 13 nt, Bordetella pertussis
cagguccagcgcc

SEQ ID NO: 2446590 - RNA, 14 nt, Bordetella pertussis
cagguccagcgcca

SEQ ID NO: 2446591 - RNA, 14 nt, Bordetella pertussis
cagguccaggccug

SEQ ID NO: 2446592 - RNA, 19 nt, Bordetella pertussis
cagguccaugaacgccgcg

SEQ ID NO: 2446593 - RNA, 21 nt, Bordetella pertussis
cagguccaugaacgccgcgcc

SEQ ID NO: 2446594 - RNA, 15 nt, Bordetella pertussis
cagguccgaaccgac

SEQ ID NO: 2446595 - RNA, 21 nt, Bordetella pertussis
cagguccgccggcacgcgcgg

SEQ ID NO: 2446596 - RNA, 16 nt, Bordetella pertussis
cagguccggucgcgcg

SEQ ID NO: 2446597 - RNA, 16 nt, Bordetella pertussis
cagguccugcacgcgg

SEQ ID NO: 2446598 - RNA, 14 nt, Bordetella pertussis
cagguccugcgcca

SEQ ID NO: 2446599 - RNA, 12 nt, Bordetella pertussis
cagguccuggcg

SEQ ID NO: 2446600 - RNA, 14 nt, Bordetella pertussis
cagguccuggcggc

SEQ ID NO: 2446601 - RNA, 17 nt, Bordetella pertussis
caggucgaagcacugca

SEQ ID NO: 2446602 - RNA, 22 nt, Bordetella pertussis
caggucgaagcacugcaggcca

SEQ ID NO: 2446603 - RNA, 15 nt, Bordetella pertussis
caggucgaccugcuu

SEQ ID NO: 2446604 - RNA, 21 nt, Bordetella pertussis
caggucgaccugcuugcccag

SEQ ID NO: 2446605 - RNA, 22 nt, Bordetella pertussis
caggucgaccugcuugcccagc

SEQ ID NO: 2446606 - RNA, 20 nt, Bordetella pertussis
caggucgaguugguagcgca

SEQ ID NO: 2446607 - RNA, 16 nt, Bordetella pertussis
caggucgaugcccucc

SEQ ID NO: 2446608 - RNA, 19 nt, Bordetella pertussis
caggucgaugcccucccag

SEQ ID NO: 2446609 - RNA, 17 nt, Bordetella pertussis
caggucgaugccggcgg

SEQ ID NO: 2446610 - RNA, 14 nt, Bordetella pertussis
caggucgccagcag

SEQ ID NO: 2446611 - RNA, 15 nt, Bordetella pertussis
caggucgccagcagg

SEQ ID NO: 2446612 - RNA, 16 nt, Bordetella pertussis
caggucgccagcaggc

SEQ ID NO: 2446613 - RNA, 18 nt, Bordetella pertussis
caggucgccagcaggccc

SEQ ID NO: 2446614 - RNA, 14 nt, Bordetella pertussis
caggucgccgccgc

SEQ ID NO: 2446615 - RNA, 20 nt, Bordetella pertussis
caggucgccguacucgccgg

SEQ ID NO: 2446616 - RNA, 15 nt, Bordetella pertussis
caggucgcgcacgcu

SEQ ID NO: 2446617 - RNA, 17 nt, Bordetella pertussis
caggucgcgcacgcugg

SEQ ID NO: 2446618 - RNA, 15 nt, Bordetella pertussis
caggucgcgcgacgu

SEQ ID NO: 2446619 - RNA, 17 nt, Bordetella pertussis
caggucgcggugcgcca

SEQ ID NO: 2446620 - RNA, 18 nt, Bordetella pertussis
caggucgcggugcgccac

SEQ ID NO: 2446621 - RNA, 14 nt, Bordetella pertussis
caggucgcugccca

SEQ ID NO: 2446622 - RNA, 16 nt, Bordetella pertussis
caggucgcugcccagc

SEQ ID NO: 2446623 - RNA, 17 nt, Bordetella pertussis
caggucggacgcgccgg

SEQ ID NO: 2446624 - RNA, 13 nt, Bordetella pertussis
caggucggagucg

SEQ ID NO: 2446625 - RNA, 16 nt, Bordetella pertussis
caggucggagucggcg

SEQ ID NO: 2446626 - RNA, 19 nt, Bordetella pertussis
caggucggagucggcgccg

SEQ ID NO: 2446627 - RNA, 21 nt, Bordetella pertussis
caggucggagucggcgccgcg

SEQ ID NO: 2446628 - RNA, 14 nt, Bordetella pertussis
caggucggccaccg

SEQ ID NO: 2446629 - RNA, 17 nt, Bordetella pertussis
caggucggccaccgccg

SEQ ID NO: 2446630 - RNA, 13 nt, Bordetella pertussis
caggucggccagc

SEQ ID NO: 2446631 - RNA, 19 nt, Bordetella pertussis
cauggccugggugcgguag

SEQ ID NO: 2446632 - RNA, 16 nt, Bordetella pertussis
cauggcgcaugacggg

SEQ ID NO: 2446633 - RNA, 12 nt, Bordetella pertussis
cauggcgccagc

SEQ ID NO: 2446634 - RNA, 22 nt, Bordetella pertussis
cauggcgccaugcgacagcccg

SEQ ID NO: 2446635 - RNA, 23 nt, Bordetella pertussis
cauggcgccaugcgacagcccgg

SEQ ID NO: 2446636 - RNA, 19 nt, Bordetella pertussis
cauggcgcccacggccgca

SEQ ID NO: 2446637 - RNA, 14 nt, Bordetella pertussis
cauggcgccgcgcc

SEQ ID NO: 2446638 - RNA, 14 nt, Bordetella pertussis
cauggcgccggcgg

SEQ ID NO: 2446639 - RNA, 16 nt, Bordetella pertussis
cauggcgcgccggccg

SEQ ID NO: 2446640 - RNA, 11 nt, Bordetella pertussis
cauggcgcgcg

SEQ ID NO: 2446641 - RNA, 13 nt, Bordetella pertussis
cauggcgcgcgcc

SEQ ID NO: 2446642 - RNA, 14 nt, Bordetella pertussis
cauggcgcgcgcca

SEQ ID NO: 2446643 - RNA, 17 nt, Bordetella pertussis
cauggcgcgcgccagcg

SEQ ID NO: 2446644 - RNA, 17 nt, Bordetella pertussis
cauggcgcgcgccgcgc

SEQ ID NO: 2446645 - RNA, 19 nt, Bordetella pertussis
cauggcgcgugcgcgcgcc

SEQ ID NO: 2446646 - RNA, 20 nt, Bordetella pertussis
cauggcgcgugcgcgcgcca

SEQ ID NO: 2446647 - RNA, 11 nt, Bordetella pertussis
cauggcgcugg

SEQ ID NO: 2446648 - RNA, 18 nt, Bordetella pertussis
cauggcgcuggcaggcgc

SEQ ID NO: 2446649 - RNA, 21 nt, Bordetella pertussis
cauggcgcuggcaggcgccuu

SEQ ID NO: 2446650 - RNA, 22 nt, Bordetella pertussis
cauggcgcuguuggccggcgcg

SEQ ID NO: 2446651 - RNA, 13 nt, Bordetella pertussis
cauggcggccagc

SEQ ID NO: 2446652 - RNA, 16 nt, Bordetella pertussis
cauggcggccaggcgc

SEQ ID NO: 2446653 - RNA, 17 nt, Bordetella pertussis
cauggcggccaggcgcg

SEQ ID NO: 2446654 - RNA, 19 nt, Bordetella pertussis
cauggcggccaggcgcgcc

SEQ ID NO: 2446655 - RNA, 21 nt, Bordetella pertussis
cauggcggcccuguucgcgcg

SEQ ID NO: 2446656 - RNA, 14 nt, Bordetella pertussis
cauggcggccgccg

SEQ ID NO: 2446657 - RNA, 15 nt, Bordetella pertussis
cauggcggccggcgu

SEQ ID NO: 2446658 - RNA, 22 nt, Bordetella pertussis
cauggcggcggccacgaccggc

SEQ ID NO: 2446659 - RNA, 21 nt, Bordetella pertussis
cauggcggugaaggcgcccgg

SEQ ID NO: 2446660 - RNA, 22 nt, Bordetella pertussis
cauggcggugaaggcgcccggg

SEQ ID NO: 2446661 - RNA, 16 nt, Bordetella pertussis
cauggcgguggccagc

SEQ ID NO: 2446662 - RNA, 15 nt, Bordetella pertussis
cauggcguaggccuc

SEQ ID NO: 2446663 - RNA, 20 nt, Bordetella pertussis
cauggcgucgaaacgcugcg

SEQ ID NO: 2446664 - RNA, 16 nt, Bordetella pertussis
cauggcgucggccacg

SEQ ID NO: 2446665 - RNA, 23 nt, Bordetella pertussis
cauggcgucggccacgucgccca

SEQ ID NO: 2446666 - RNA, 16 nt, Bordetella pertussis
cauggcgucguccagc

SEQ ID NO: 2446667 - RNA, 18 nt, Bordetella pertussis
cauggcgucugcccgugc

SEQ ID NO: 2446668 - RNA, 16 nt, Bordetella pertussis
cauggcuggucccugc

SEQ ID NO: 2446669 - RNA, 14 nt, Bordetella pertussis
caugggcaagccga

SEQ ID NO: 2446670 - RNA, 18 nt, Bordetella pertussis
caugggcacauacagcgg

SEQ ID NO: 2446671 - RNA, 23 nt, Bordetella pertussis
caugggcacauacagcggagccg

SEQ ID NO: 2446672 - RNA, 12 nt, Bordetella pertussis
caugggccaggc

SEQ ID NO: 2446673 - RNA, 14 nt, Bordetella pertussis
caugggccaggcgc

SEQ ID NO: 2446674 - RNA, 19 nt, Bordetella pertussis
caugggccccaagagggcu

SEQ ID NO: 2446675 - RNA, 17 nt, Bordetella pertussis
caugggcccgggcgcgc

SEQ ID NO: 2446676 - RNA, 15 nt, Bordetella pertussis
caugggccugggcgc

SEQ ID NO: 2446677 - RNA, 20 nt, Bordetella pertussis
caugggcgaagccacggccc

SEQ ID NO: 2446678 - RNA, 12 nt, Bordetella pertussis
caugggcgcagg

SEQ ID NO: 2446679 - RNA, 16 nt, Bordetella pertussis
caugggcgcaggccgc

SEQ ID NO: 2446680 - RNA, 17 nt, Bordetella pertussis
caugggcgcaggccgcc

SEQ ID NO: 2446681 - RNA, 22 nt, Bordetella pertussis
caugggcgccgagggccgcgcg

SEQ ID NO: 2446682 - RNA, 13 nt, Bordetella pertussis
caugggcgcgccc

SEQ ID NO: 2446683 - RNA, 13 nt, Bordetella pertussis
caugggcggcccg

SEQ ID NO: 2446684 - RNA, 14 nt, Bordetella pertussis
caugggcggcccgc

SEQ ID NO: 2446685 - RNA, 15 nt, Bordetella pertussis
caugggcggcccggc

SEQ ID NO: 2446686 - RNA, 17 nt, Bordetella pertussis
caugggcggcccggcca

SEQ ID NO: 2446687 - RNA, 21 nt, Bordetella pertussis
caugggcgucgucgccgucgc

SEQ ID NO: 2446688 - RNA, 16 nt, Bordetella pertussis
caugggcgugccgcgc

SEQ ID NO: 2446689 - RNA, 19 nt, Bordetella pertussis
caugggcucgcgcgagccc

SEQ ID NO: 2446690 - RNA, 18 nt, Bordetella pertussis
cauggggacuggcacccg

SEQ ID NO: 2446691 - RNA, 19 nt, Bordetella pertussis
cauggggcaggcgcagcgg

SEQ ID NO: 2446692 - RNA, 15 nt, Bordetella pertussis
caugggggcuggcgc

SEQ ID NO: 2446693 - RNA, 23 nt, Bordetella pertussis
caugggguugacguuguccaggc

SEQ ID NO: 2446694 - RNA, 17 nt, Bordetella pertussis
caugguagcgguccagc

SEQ ID NO: 2446695 - RNA, 14 nt, Bordetella pertussis
cauggucgaccagc

SEQ ID NO: 2446696 - RNA, 18 nt, Bordetella pertussis
cauggucgaccagcagcc

SEQ ID NO: 2446697 - RNA, 15 nt, Bordetella pertussis
cauggucgaugaagu

SEQ ID NO: 2446698 - RNA, 14 nt, Bordetella pertussis
cauggucgccucga

SEQ ID NO: 2446699 - RNA, 15 nt, Bordetella pertussis
cauggucgcgaccac

SEQ ID NO: 2446700 - RNA, 20 nt, Bordetella pertussis
cauggucgcgaccaccguga

SEQ ID NO: 2446701 - RNA, 20 nt, Bordetella pertussis
cauggucgcgaugcgucagg

SEQ ID NO: 2446702 - RNA, 16 nt, Bordetella pertussis
cauggucucguccacc

SEQ ID NO: 2446703 - RNA, 18 nt, Bordetella pertussis
cauggugaacggccccgc

SEQ ID NO: 2446704 - RNA, 18 nt, Bordetella pertussis
cauggugagggccacgcg

SEQ ID NO: 2446705 - RNA, 18 nt, Bordetella pertussis
cauggugccgcgcaggcc

SEQ ID NO: 2446706 - RNA, 19 nt, Bordetella pertussis
cauggugccgcgcaggccc

SEQ ID NO: 2446707 - RNA, 16 nt, Bordetella pertussis
cauggugggcaugacg

SEQ ID NO: 2446708 - RNA, 21 nt, Bordetella pertussis
caugguguaccgggccgacgc

SEQ ID NO: 2446709 - RNA, 19 nt, Bordetella pertussis
cauguaaggcgcaugccac

SEQ ID NO: 2446710 - RNA, 14 nt, Bordetella pertussis
cauguacucggcca

SEQ ID NO: 2446711 - RNA, 17 nt, Bordetella pertussis
cauguacucggccaggc

SEQ ID NO: 2446712 - RNA, 19 nt, Bordetella pertussis
cauguagaacgccaggguc

SEQ ID NO: 2446713 - RNA, 20 nt, Bordetella pertussis
cauguagaacgccagggucu

SEQ ID NO: 2446714 - RNA, 21 nt, Bordetella pertussis
cauguagaacgccagggucug

SEQ ID NO: 2446715 - RNA, 17 nt, Bordetella pertussis
cauguagauggccgccu

SEQ ID NO: 2446716 - RNA, 15 nt, Bordetella pertussis
cauguagcggccgcc

SEQ ID NO: 2446717 - RNA, 12 nt, Bordetella pertussis
cauguagucguc

SEQ ID NO: 2446718 - RNA, 21 nt, Bordetella pertussis
cauguagucgucgcuggccca

SEQ ID NO: 2446719 - RNA, 16 nt, Bordetella pertussis
cauguauaacguggcg

SEQ ID NO: 2446720 - RNA, 20 nt, Bordetella pertussis
cauguauaacguggcgcgca

SEQ ID NO: 2446721 - RNA, 22 nt, Bordetella pertussis
cauguauaacguggcgcgcacc

SEQ ID NO: 2446722 - RNA, 14 nt, Bordetella pertussis
caugucagcgccug

SEQ ID NO: 2446723 - RNA, 17 nt, Bordetella pertussis
caugucagcgccuggcu

SEQ ID NO: 2446724 - RNA, 23 nt, Bordetella pertussis
cauguccagacccgaaucucccg

SEQ ID NO: 2446725 - RNA, 18 nt, Bordetella pertussis
cauguccagcgccaggcc

SEQ ID NO: 2446726 - RNA, 21 nt, Bordetella pertussis
cauguccagcgccaggccgcg

SEQ ID NO: 2446727 - RNA, 21 nt, Bordetella pertussis
cauguccagguagcgccucgc

SEQ ID NO: 2446728 - RNA, 11 nt, Bordetella pertussis
caugucccagc

SEQ ID NO: 2446729 - RNA, 16 nt, Bordetella pertussis
caugucccgaggcgcc

SEQ ID NO: 2446730 - RNA, 17 nt, Bordetella pertussis
caugucccgaggcgccc

SEQ ID NO: 2446731 - RNA, 14 nt, Bordetella pertussis
cauguccgagucga

SEQ ID NO: 2446732 - RNA, 19 nt, Bordetella pertussis
cauguccgccacgccggcc

SEQ ID NO: 2446733 - RNA, 23 nt, Bordetella pertussis
cauguccgccacgccggccacga

SEQ ID NO: 2446734 - RNA, 20 nt, Bordetella pertussis
cauguccguaucgcggccga

SEQ ID NO: 2446735 - RNA, 22 nt, Bordetella pertussis
cauguccugcagguccugguag

SEQ ID NO: 2446736 - RNA, 16 nt, Bordetella pertussis
caugucgaugccguac

SEQ ID NO: 2446737 - RNA, 22 nt, Bordetella pertussis
caugucgcggcccacggccagc

SEQ ID NO: 2446738 - RNA, 20 nt, Bordetella pertussis
caugucgcgggugcgggcaa

SEQ ID NO: 2446739 - RNA, 22 nt, Bordetella pertussis
caugucgcgggugcgggcaaac

SEQ ID NO: 2446740 - RNA, 23 nt, Bordetella pertussis
caugucgcgggugcgggcaaacg

SEQ ID NO: 2446741 - RNA, 16 nt, Bordetella pertussis
caugucguacaggccg

SEQ ID NO: 2446742 - RNA, 20 nt, Bordetella pertussis
caugucguccucggccacgu

SEQ ID NO: 2446743 - RNA, 16 nt, Bordetella pertussis
caugugcguuuuuucg

SEQ ID NO: 2446744 - RNA, 15 nt, Bordetella pertussis
cauguggggacaggc

SEQ ID NO: 2446745 - RNA, 14 nt, Bordetella pertussis
cauguucacgccca

SEQ ID NO: 2446746 - RNA, 15 nt, Bordetella pertussis
ccacgagaagccgau

SEQ ID NO: 2446747 - RNA, 11 nt, Bordetella pertussis
ccacgagcagu

SEQ ID NO: 2446748 - RNA, 20 nt, Bordetella pertussis
ccacgagcaguacacgcgca

SEQ ID NO: 2446749 - RNA, 15 nt, Bordetella pertussis
ccacgagcugcagcc

SEQ ID NO: 2446750 - RNA, 18 nt, Bordetella pertussis
ccacgagcugcagcccgg

SEQ ID NO: 2446751 - RNA, 19 nt, Bordetella pertussis
ccacgagcugcagcccggc

SEQ ID NO: 2446752 - RNA, 18 nt, Bordetella pertussis
ccacgaucaccacgcccg

SEQ ID NO: 2446753 - RNA, 19 nt, Bordetella pertussis
ccacgaucaccacgcccgc

SEQ ID NO: 2446754 - RNA, 23 nt, Bordetella pertussis
ccacgaucaccacgcccgcgccg

SEQ ID NO: 2446755 - RNA, 18 nt, Bordetella pertussis
ccacgaucaucaggauga

SEQ ID NO: 2446756 - RNA, 23 nt, Bordetella pertussis
ccacgaugcgggcaucgcccugc

SEQ ID NO: 2446757 - RNA, 18 nt, Bordetella pertussis
ccacgauggccggcgcga

SEQ ID NO: 2446758 - RNA, 13 nt, Bordetella pertussis
ccacgauggcgca

SEQ ID NO: 2446759 - RNA, 21 nt, Bordetella pertussis
ccacgauguugcgcaggcugu

SEQ ID NO: 2446760 - RNA, 15 nt, Bordetella pertussis
ccacgcacaccgccc

SEQ ID NO: 2446761 - RNA, 16 nt, Bordetella pertussis
ccacgcacaccgcccg

SEQ ID NO: 2446762 - RNA, 20 nt, Bordetella pertussis
ccacgcacaugaugcccagc

SEQ ID NO: 2446763 - RNA, 22 nt, Bordetella pertussis
ccacgcagaaauggaugcgcgc

SEQ ID NO: 2446764 - RNA, 20 nt, Bordetella pertussis
ccacgcagaaggcgaacugg

SEQ ID NO: 2446765 - RNA, 16 nt, Bordetella pertussis
ccacgcaggcgggcgc

SEQ ID NO: 2446766 - RNA, 22 nt, Bordetella pertussis
ccacgcaggcgggcgccgcgcc

SEQ ID NO: 2446767 - RNA, 13 nt, Bordetella pertussis
ccacgccacuggc

SEQ ID NO: 2446768 - RNA, 12 nt, Bordetella pertussis
ccacgccagcgg

SEQ ID NO: 2446769 - RNA, 17 nt, Bordetella pertussis
ccacgccagcggcgagc

SEQ ID NO: 2446770 - RNA, 15 nt, Bordetella pertussis
ccacgcccagcgccg

SEQ ID NO: 2446771 - RNA, 17 nt, Bordetella pertussis
ccacgcccagcgccggc

SEQ ID NO: 2446772 - RNA, 15 nt, Bordetella pertussis
ccacgcccaucuaug

SEQ ID NO: 2446773 - RNA, 17 nt, Bordetella pertussis
ccacgcccaucugccag

SEQ ID NO: 2446774 - RNA, 14 nt, Bordetella pertussis
ccacgcccgcgccg

SEQ ID NO: 2446775 - RNA, 23 nt, Bordetella pertussis
ccacgcccgucccgacccccggc

SEQ ID NO: 2446776 - RNA, 13 nt, Bordetella pertussis
ccacgcccuggca

SEQ ID NO: 2446777 - RNA, 15 nt, Bordetella pertussis
ccacgcccuggcugg

SEQ ID NO: 2446778 - RNA, 16 nt, Bordetella pertussis
ccacgccgaugcacag

SEQ ID NO: 2446779 - RNA, 19 nt, Bordetella pertussis
ccacgccgaugcacaggua

SEQ ID NO: 2446780 - RNA, 16 nt, Bordetella pertussis
ccacgccgaugccgcg

SEQ ID NO: 2446781 - RNA, 18 nt, Bordetella pertussis
ccacgccgaugccgcgca

SEQ ID NO: 2446782 - RNA, 13 nt, Bordetella pertussis
ccacgccgccggc

SEQ ID NO: 2446783 - RNA, 15 nt, Bordetella pertussis
ccacgccgccggcca

SEQ ID NO: 2446784 - RNA, 16 nt, Bordetella pertussis
ccacgccgccggccag

SEQ ID NO: 2446785 - RNA, 14 nt, Bordetella pertussis
ccacgccgccuggc

SEQ ID NO: 2446786 - RNA, 11 nt, Bordetella pertussis
ccacgccgcug

SEQ ID NO: 2446787 - RNA, 12 nt, Bordetella pertussis
ccacgccgcuga

SEQ ID NO: 2446788 - RNA, 14 nt, Bordetella pertussis
ccacgccgcugaug

SEQ ID NO: 2446789 - RNA, 13 nt, Bordetella pertussis
ccacgccggccac

SEQ ID NO: 2446790 - RNA, 21 nt, Bordetella pertussis
ccacgccggccacgaacggcg

SEQ ID NO: 2446791 - RNA, 13 nt, Bordetella pertussis
ccacgccggccgc

SEQ ID NO: 2446792 - RNA, 15 nt, Bordetella pertussis
ccacgccggccgccu

SEQ ID NO: 2446793 - RNA, 16 nt, Bordetella pertussis
ccacgccggccgccug

SEQ ID NO: 2446794 - RNA, 14 nt, Bordetella pertussis
ccacgccggccggg

SEQ ID NO: 2446795 - RNA, 17 nt, Bordetella pertussis
ccacgccggcgcgccgg

SEQ ID NO: 2446796 - RNA, 16 nt, Bordetella pertussis
ccacgccguggcgcaa

SEQ ID NO: 2446797 - RNA, 13 nt, Bordetella pertussis
ccacgccuggccg

SEQ ID NO: 2446798 - RNA, 16 nt, Bordetella pertussis
ccacgccuggccgcgc

SEQ ID NO: 2446799 - RNA, 16 nt, Bordetella pertussis
ccacgccuuccggccc

SEQ ID NO: 2446800 - RNA, 17 nt, Bordetella pertussis
ccacgccuucgagcacc

SEQ ID NO: 2446801 - RNA, 18 nt, Bordetella pertussis
ccacgccuucggcgcgcg

SEQ ID NO: 2446802 - RNA, 21 nt, Bordetella pertussis
ccacgccuucggcgcgcgccg

SEQ ID NO: 2446803 - RNA, 18 nt, Bordetella pertussis
ccacgccuuguucgcgcg

SEQ ID NO: 2446804 - RNA, 20 nt, Bordetella pertussis
ccacgccuuguucgcgcgcg

SEQ ID NO: 2446805 - RNA, 18 nt, Bordetella pertussis
ccacgcgagcccgcguca

SEQ ID NO: 2446806 - RNA, 19 nt, Bordetella pertussis
ccacgcgaugcgggucugg

SEQ ID NO: 2446807 - RNA, 16 nt, Bordetella pertussis
ccacgcgcaacgccgc

SEQ ID NO: 2446808 - RNA, 19 nt, Bordetella pertussis
ccacgcgcaacgccgccac

SEQ ID NO: 2446809 - RNA, 23 nt, Bordetella pertussis
ccacgcgcacauuggaguagugg

SEQ ID NO: 2446810 - RNA, 20 nt, Bordetella pertussis
ccacgcgcacgacgucgcgc

SEQ ID NO: 2446811 - RNA, 18 nt, Bordetella pertussis
ccacgcgcacggccagca

SEQ ID NO: 2446812 - RNA, 12 nt, Bordetella pertussis
ccacgcgccgcc

SEQ ID NO: 2446813 - RNA, 14 nt, Bordetella pertussis
ccacgcgccgccag

SEQ ID NO: 2446814 - RNA, 16 nt, Bordetella pertussis
ccacgcgccgccaggc

SEQ ID NO: 2446815 - RNA, 13 nt, Bordetella pertussis
ccacgcgccgccc

SEQ ID NO: 2446816 - RNA, 16 nt, Bordetella pertussis
ccacgcgccgcccggg

SEQ ID NO: 2446817 - RNA, 19 nt, Bordetella pertussis
ccacgcgccgcccgggccg

SEQ ID NO: 2446818 - RNA, 23 nt, Bordetella pertussis
ccacgcgccgugcagacggcggc

SEQ ID NO: 2446819 - RNA, 20 nt, Bordetella pertussis
ccacgcgcgauccgcgccag

SEQ ID NO: 2446820 - RNA, 21 nt, Bordetella pertussis
ccacgcgcgauccgcgccagg

SEQ ID NO: 2446821 - RNA, 19 nt, Bordetella pertussis
ccacgcgcgcgccgccggc

SEQ ID NO: 2446822 - RNA, 21 nt, Bordetella pertussis
ccacgcgcgcuggcgcccggc

SEQ ID NO: 2446823 - RNA, 13 nt, Bordetella pertussis
ccacgcgcuccug

SEQ ID NO: 2446824 - RNA, 15 nt, Bordetella pertussis
ccacgcgcugcgcgc

SEQ ID NO: 2446825 - RNA, 11 nt, Bordetella pertussis
ccacgcgcugu

SEQ ID NO: 2446826 - RNA, 17 nt, Bordetella pertussis
ccacgcgcuguugcugg

SEQ ID NO: 2446827 - RNA, 18 nt, Bordetella pertussis
ccacgcgcuugcgcgcca

SEQ ID NO: 2446828 - RNA, 17 nt, Bordetella pertussis
ccacgcggccguggcgg

SEQ ID NO: 2446829 - RNA, 22 nt, Bordetella pertussis
ccacgcggccguggcggccugc

SEQ ID NO: 2446830 - RNA, 16 nt, Bordetella pertussis
ccacgcggcgcugcug

SEQ ID NO: 2446831 - RNA, 17 nt, Bordetella pertussis
ccacgcgggccggccgu

SEQ ID NO: 2446832 - RNA, 15 nt, Bordetella pertussis
ccacgcggguggugc

SEQ ID NO: 2446833 - RNA, 18 nt, Bordetella pertussis
ccacgcgguccagccccu

SEQ ID NO: 2446834 - RNA, 13 nt, Bordetella pertussis
ccacgcgguuggg

SEQ ID NO: 2446835 - RNA, 13 nt, Bordetella pertussis
ccacgcguccccg

SEQ ID NO: 2446836 - RNA, 15 nt, Bordetella pertussis
ccacgcucuggagcc

SEQ ID NO: 2446837 - RNA, 17 nt, Bordetella pertussis
ccacgcugcccugcugc

SEQ ID NO: 2446838 - RNA, 18 nt, Bordetella pertussis
ccacgcugcccugcugcu

SEQ ID NO: 2446839 - RNA, 23 nt, Bordetella pertussis
ccacgcugcccugcugcugcagc

SEQ ID NO: 2446840 - RNA, 15 nt, Bordetella pertussis
ccacgcugcgcccgc

SEQ ID NO: 2446841 - RNA, 16 nt, Bordetella pertussis
ccacgcuggccgcgcu

SEQ ID NO: 2446842 - RNA, 18 nt, Bordetella pertussis
ccacgcuggccgcgcugg

SEQ ID NO: 2446843 - RNA, 18 nt, Bordetella pertussis
ccacgcugggccagaccg

SEQ ID NO: 2446844 - RNA, 23 nt, Bordetella pertussis
ccacgcuguuuucggccgacucg

SEQ ID NO: 2446845 - RNA, 17 nt, Bordetella pertussis
ccacggcaaaagccggg

SEQ ID NO: 2446846 - RNA, 21 nt, Bordetella pertussis
ccacggcaaugucgcaggccg

SEQ ID NO: 2446847 - RNA, 13 nt, Bordetella pertussis
ccacggcaucgcc

SEQ ID NO: 2446848 - RNA, 15 nt, Bordetella pertussis
ccacggcaucgccgc

SEQ ID NO: 2446849 - RNA, 16 nt, Bordetella pertussis
ccacggcaucgccgcg

SEQ ID NO: 2446850 - RNA, 17 nt, Bordetella pertussis
ccacggcaucgccgcgg

SEQ ID NO: 2446851 - RNA, 15 nt, Bordetella pertussis
ccacggcaucggcca

SEQ ID NO: 2446852 - RNA, 13 nt, Bordetella pertussis
ccacggcauggcc

SEQ ID NO: 2446853 - RNA, 16 nt, Bordetella pertussis
ccacggcauggccagc

SEQ ID NO: 2446854 - RNA, 18 nt, Bordetella pertussis
ccacggccacgucggucg

SEQ ID NO: 2446855 - RNA, 16 nt, Bordetella pertussis
ccacggccagcacuuu

SEQ ID NO: 2446856 - RNA, 14 nt, Bordetella pertussis
ccacggccagcagc

SEQ ID NO: 2446857 - RNA, 15 nt, Bordetella pertussis
ccacggccagcagca

SEQ ID NO: 2446858 - RNA, 16 nt, Bordetella pertussis
ccacggccagcagcac

SEQ ID NO: 2446859 - RNA, 15 nt, Bordetella pertussis
ccacggcccgccagg

SEQ ID NO: 2446860 - RNA, 11 nt, Bordetella pertussis
ccacggccggc

SEQ ID NO: 2446861 - RNA, 13 nt, Bordetella pertussis
ccacggccggcag

SEQ ID NO: 2446862 - RNA, 20 nt, Bordetella pertussis
ccaccaggaacgccagcagc

SEQ ID NO: 2446863 - RNA, 13 nt, Bordetella pertussis
ccaccaggcccag

SEQ ID NO: 2446864 - RNA, 14 nt, Bordetella pertussis
ccaccaggcccagg

SEQ ID NO: 2446865 - RNA, 12 nt, Bordetella pertussis
ccaccaggccgc

SEQ ID NO: 2446866 - RNA, 13 nt, Bordetella pertussis
ccaccaggccgcc

SEQ ID NO: 2446867 - RNA, 14 nt, Bordetella pertussis
ccaccaggccggcc

SEQ ID NO: 2446868 - RNA, 21 nt, Bordetella pertussis
ccaccaggccggccagggcca

SEQ ID NO: 2446869 - RNA, 14 nt, Bordetella pertussis
ccaccaggccgucg

SEQ ID NO: 2446870 - RNA, 17 nt, Bordetella pertussis
ccaccaggccgucggcc

SEQ ID NO: 2446871 - RNA, 14 nt, Bordetella pertussis
ccaccaggcgcgcg

SEQ ID NO: 2446872 - RNA, 16 nt, Bordetella pertussis
ccaccaggcgcgcgcc

SEQ ID NO: 2446873 - RNA, 22 nt, Bordetella pertussis
ccaccagggaccaauacgccgc

SEQ ID NO: 2446874 - RNA, 18 nt, Bordetella pertussis
ccaccagggccagcuuga

SEQ ID NO: 2446875 - RNA, 20 nt, Bordetella pertussis
ccaccagggccagcuugacg

SEQ ID NO: 2446876 - RNA, 15 nt, Bordetella pertussis
ccaccagggcccgga

SEQ ID NO: 2446877 - RNA, 17 nt, Bordetella pertussis
ccaccagggcccggacg

SEQ ID NO: 2446878 - RNA, 21 nt, Bordetella pertussis
ccaccagggcccggacgcggc

SEQ ID NO: 2446879 - RNA, 13 nt, Bordetella pertussis
ccaccagggcgcc

SEQ ID NO: 2446880 - RNA, 23 nt, Bordetella pertussis
ccaccagggugccgccuucgccg

SEQ ID NO: 2446881 - RNA, 23 nt, Bordetella pertussis
ccaccaggucguacagcgccugc

SEQ ID NO: 2446882 - RNA, 16 nt, Bordetella pertussis
ccaccagugcgccggc

SEQ ID NO: 2446883 - RNA, 19 nt, Bordetella pertussis
ccaccagugcgccggcggc

SEQ ID NO: 2446884 - RNA, 17 nt, Bordetella pertussis
ccaccaucagccagccg

SEQ ID NO: 2446885 - RNA, 21 nt, Bordetella pertussis
ccaccaucagccagccgcuug

SEQ ID NO: 2446886 - RNA, 15 nt, Bordetella pertussis
ccaccauccugcccc

SEQ ID NO: 2446887 - RNA, 19 nt, Bordetella pertussis
ccaccaugagcacgcccca

SEQ ID NO: 2446888 - RNA, 22 nt, Bordetella pertussis
ccaccaugccuugcgcgacagc

SEQ ID NO: 2446889 - RNA, 14 nt, Bordetella pertussis
ccaccaugucccug

SEQ ID NO: 2446890 - RNA, 18 nt, Bordetella pertussis
ccacccagcucagcggau

SEQ ID NO: 2446891 - RNA, 22 nt, Bordetella pertussis
ccacccaggcggcaggcgccgc

SEQ ID NO: 2446892 - RNA, 13 nt, Bordetella pertussis
ccacccccagcag

SEQ ID NO: 2446893 - RNA, 15 nt, Bordetella pertussis
ccacccccagcagca

SEQ ID NO: 2446894 - RNA, 16 nt, Bordetella pertussis
ccacccccagcagcau

SEQ ID NO: 2446895 - RNA, 15 nt, Bordetella pertussis
ccacccccgggcgca

SEQ ID NO: 2446896 - RNA, 14 nt, Bordetella pertussis
ccaccccgccgcug

SEQ ID NO: 2446897 - RNA, 23 nt, Bordetella pertussis
ccaccccgguguaggcgggcagc

SEQ ID NO: 2446898 - RNA, 14 nt, Bordetella pertussis
ccaccccguugcag

SEQ ID NO: 2446899 - RNA, 20 nt, Bordetella pertussis
ccacccgacagcucggacgg

SEQ ID NO: 2446900 - RNA, 14 nt, Bordetella pertussis
ccacccgcacgccg

SEQ ID NO: 2446901 - RNA, 15 nt, Bordetella pertussis
ccacccgcacgccgg

SEQ ID NO: 2446902 - RNA, 19 nt, Bordetella pertussis
ccacccgcauugaucgauc

SEQ ID NO: 2446903 - RNA, 13 nt, Bordetella pertussis
ccacccgccgccg

SEQ ID NO: 2446904 - RNA, 15 nt, Bordetella pertussis
ccacccgccgccggc

SEQ ID NO: 2446905 - RNA, 13 nt, Bordetella pertussis
ccacccggcacgc

SEQ ID NO: 2446906 - RNA, 19 nt, Bordetella pertussis
ccacccuucgcgcugcaga

SEQ ID NO: 2446907 - RNA, 21 nt, Bordetella pertussis
ccaccgacaagccggucgacc

SEQ ID NO: 2446908 - RNA, 16 nt, Bordetella pertussis
ccaccgacaugaccgc

SEQ ID NO: 2446909 - RNA, 20 nt, Bordetella pertussis
ccaccgacaugaccgcgucc

SEQ ID NO: 2446910 - RNA, 22 nt, Bordetella pertussis
ccaccgacaugaccgcguccgc

SEQ ID NO: 2446911 - RNA, 22 nt, Bordetella pertussis
ccaccgauccgaugaugcccag

SEQ ID NO: 2446912 - RNA, 19 nt, Bordetella pertussis
ccaccgcaucgcgcagcgu

SEQ ID NO: 2446913 - RNA, 18 nt, Bordetella pertussis
ccaccgccacgucauagg

SEQ ID NO: 2446914 - RNA, 15 nt, Bordetella pertussis
ccaccgccagcccgg

SEQ ID NO: 2446915 - RNA, 12 nt, Bordetella pertussis
ccaccgcccagg

SEQ ID NO: 2446916 - RNA, 18 nt, Bordetella pertussis
ccaccgcccaggcgcagc

SEQ ID NO: 2446917 - RNA, 19 nt, Bordetella pertussis
ccaccgcccaggcgcagcc

SEQ ID NO: 2446918 - RNA, 11 nt, Bordetella pertussis
ccaccgcccgc

SEQ ID NO: 2446919 - RNA, 19 nt, Bordetella pertussis
ccaccgccgaugccgccau

SEQ ID NO: 2446920 - RNA, 21 nt, Bordetella pertussis
ccaccgccgaugccgccauca

SEQ ID NO: 2446921 - RNA, 18 nt, Bordetella pertussis
ccaccgccgcccgccagg

SEQ ID NO: 2446922 - RNA, 17 nt, Bordetella pertussis
ccaccgccguggccggc

SEQ ID NO: 2446923 - RNA, 16 nt, Bordetella pertussis
ccaccgcgccgcccac

SEQ ID NO: 2446924 - RNA, 21 nt, Bordetella pertussis
ccaccgcgccgcccacgccgc

SEQ ID NO: 2446925 - RNA, 22 nt, Bordetella pertussis
ccaccgcggugccgcgcgcggc

SEQ ID NO: 2446926 - RNA, 13 nt, Bordetella pertussis
ccaccggcaagcc

SEQ ID NO: 2446927 - RNA, 18 nt, Bordetella pertussis
ccaccggcaagccuugcg

SEQ ID NO: 2446928 - RNA, 22 nt, Bordetella pertussis
ccaccggcaagccuugcggccc

SEQ ID NO: 2446929 - RNA, 20 nt, Bordetella pertussis
ccaccggcaaggccgcgaac

SEQ ID NO: 2446930 - RNA, 22 nt, Bordetella pertussis
ccaccggcaugccguccacgcc

SEQ ID NO: 2446931 - RNA, 17 nt, Bordetella pertussis
ccaccggcgcgcgcaug

SEQ ID NO: 2446932 - RNA, 14 nt, Bordetella pertussis
ccaccggcgucacc

SEQ ID NO: 2446933 - RNA, 13 nt, Bordetella pertussis
ccaccgggacagg

SEQ ID NO: 2446934 - RNA, 14 nt, Bordetella pertussis
ccaccgggccggcc

SEQ ID NO: 2446935 - RNA, 15 nt, Bordetella pertussis
ccaccgggccggccu

SEQ ID NO: 2446936 - RNA, 17 nt, Bordetella pertussis
ccaccgggccggccugc

SEQ ID NO: 2446937 - RNA, 21 nt, Bordetella pertussis
ccaccggucgccguccaggcg

SEQ ID NO: 2446938 - RNA, 18 nt, Bordetella pertussis
ccaccgguugcagcgcgc

SEQ ID NO: 2446939 - RNA, 22 nt, Bordetella pertussis
ccaccgguugcagcgcgccagg

SEQ ID NO: 2446940 - RNA, 20 nt, Bordetella pertussis
ccaccgucucgaacgccgcg

SEQ ID NO: 2446941 - RNA, 17 nt, Bordetella pertussis
ccaccgucucgcccaug

SEQ ID NO: 2446942 - RNA, 21 nt, Bordetella pertussis
ccaccgugauauagaccagca

SEQ ID NO: 2446943 - RNA, 18 nt, Bordetella pertussis
ccaccuccaccgccagcc

SEQ ID NO: 2446944 - RNA, 21 nt, Bordetella pertussis
ccaccuccaccgccagcccgg

SEQ ID NO: 2446945 - RNA, 18 nt, Bordetella pertussis
ccaccucgucguccagcg

SEQ ID NO: 2446946 - RNA, 17 nt, Bordetella pertussis
ccaccucuucagcccgg

SEQ ID NO: 2446947 - RNA, 19 nt, Bordetella pertussis
ccaccucuucagcccggcg

SEQ ID NO: 2446948 - RNA, 16 nt, Bordetella pertussis
ccaccugcaccgccgc

SEQ ID NO: 2446949 - RNA, 24 nt, Bordetella pertussis
ccaccugcucggugagcggcacga

SEQ ID NO: 2446950 - RNA, 16 nt, Bordetella pertussis
ccaccuggcagccgau

SEQ ID NO: 2446951 - RNA, 20 nt, Bordetella pertussis
ccaccuggccacaagcggcc

SEQ ID NO: 2446952 - RNA, 15 nt, Bordetella pertussis
ccaccuggcgcccgg

SEQ ID NO: 2446953 - RNA, 19 nt, Bordetella pertussis
ccaccuggcgcccggcggc

SEQ ID NO: 2446954 - RNA, 16 nt, Bordetella pertussis
ccaccuggcggugcgc

SEQ ID NO: 2446955 - RNA, 21 nt, Bordetella pertussis
ccaccuggcugaacaggccuu

SEQ ID NO: 2446956 - RNA, 14 nt, Bordetella pertussis
ccaccugggccgcc

SEQ ID NO: 2446957 - RNA, 16 nt, Bordetella pertussis
ccaccugggccgccug

SEQ ID NO: 2446958 - RNA, 15 nt, Bordetella pertussis
ccaccuuccugcugg

SEQ ID NO: 2446959 - RNA, 13 nt, Bordetella pertussis
ccaccuugacgcg

SEQ ID NO: 2446960 - RNA, 17 nt, Bordetella pertussis
ccaccuugacgcgcagg

SEQ ID NO: 2446961 - RNA, 15 nt, Bordetella pertussis
ccaccuugcgcgcga

SEQ ID NO: 2446962 - RNA, 15 nt, Bordetella pertussis
ccacgaaacccagga

SEQ ID NO: 2446963 - RNA, 14 nt, Bordetella pertussis
ccacgaacgccacg

SEQ ID NO: 2446964 - RNA, 22 nt, Bordetella pertussis
ccacgaacgcgauuuccuugcg

SEQ ID NO: 2446965 - RNA, 14 nt, Bordetella pertussis
ccacgaagcaggug

SEQ ID NO: 2446966 - RNA, 22 nt, Bordetella pertussis
ccacgaagcaggugaugcgcgc

SEQ ID NO: 2446967 - RNA, 21 nt, Bordetella pertussis
ccacgaagcgcagcaccgcgc

SEQ ID NO: 2446968 - RNA, 13 nt, Bordetella pertussis
ccacgaaggcgau

SEQ ID NO: 2446969 - RNA, 22 nt, Bordetella pertussis
ccacgaaggcgaucugcggcgu

SEQ ID NO: 2446970 - RNA, 13 nt, Bordetella pertussis
ccacgaaggcgcc

SEQ ID NO: 2446971 - RNA, 14 nt, Bordetella pertussis
ccacgaaggcgccg

SEQ ID NO: 2446972 - RNA, 17 nt, Bordetella pertussis
ccacgaauuccucgccg

SEQ ID NO: 2446973 - RNA, 23 nt, Bordetella pertussis
ccacgaauuccucgccgcccagc

SEQ ID NO: 2446974 - RNA, 18 nt, Bordetella pertussis
ccacgaccuuggcggccg

SEQ ID NO: 2446975 - RNA, 19 nt, Bordetella pertussis
ccagacgcagaccacgccg

SEQ ID NO: 2446976 - RNA, 13 nt, Bordetella pertussis
ccagacggccagc

SEQ ID NO: 2446977 - RNA, 23 nt, Bordetella pertussis
ccagagcgggauggucgcggccg

SEQ ID NO: 2446978 - RNA, 19 nt, Bordetella pertussis
ccagagcuggggcgucccg

SEQ ID NO: 2446979 - RNA, 21 nt, Bordetella pertussis
ccagagucugccuggcgaaca

SEQ ID NO: 2446980 - RNA, 22 nt, Bordetella pertussis
ccagauaaggcgggugucccag

SEQ ID NO: 2446981 - RNA, 23 nt, Bordetella pertussis
ccagauaaggcgggugucccagc

SEQ ID NO: 2446982 - RNA, 21 nt, Bordetella pertussis
ccagauccgguaugccugcca

SEQ ID NO: 2446983 - RNA, 12 nt, Bordetella pertussis
ccagaucgacca

SEQ ID NO: 2446984 - RNA, 19 nt, Bordetella pertussis
ccagaucgauaccgucgcg

SEQ ID NO: 2446985 - RNA, 15 nt, Bordetella pertussis
ccagaucgccugggg

SEQ ID NO: 2446986 - RNA, 24 nt, Bordetella pertussis
ccagaucguugaucucgcccagca

SEQ ID NO: 2446987 - RNA, 16 nt, Bordetella pertussis
ccagaucucgcguccg

SEQ ID NO: 2446988 - RNA, 21 nt, Bordetella pertussis
ccagaucucgcguccggugcg

SEQ ID NO: 2446989 - RNA, 14 nt, Bordetella pertussis
ccagaugcgcagca

SEQ ID NO: 2446990 - RNA, 17 nt, Bordetella pertussis
ccagaugcgcagcaggc

SEQ ID NO: 2446991 - RNA, 18 nt, Bordetella pertussis
ccagaugcgcagcaggcg

SEQ ID NO: 2446992 - RNA, 14 nt, Bordetella pertussis
ccagaugcgccgca

SEQ ID NO: 2446993 - RNA, 15 nt, Bordetella pertussis
ccagaugcgccgcac

SEQ ID NO: 2446994 - RNA, 16 nt, Bordetella pertussis
ccagaugcgccgcacg

SEQ ID NO: 2446995 - RNA, 20 nt, Bordetella pertussis
ccagaugcgccgcacgucgg

SEQ ID NO: 2446996 - RNA, 18 nt, Bordetella pertussis
ccagcaaaugggccgcag

SEQ ID NO: 2446997 - RNA, 23 nt, Bordetella pertussis
ccagcaaaugggccgcagcgaac

SEQ ID NO: 2446998 - RNA, 12 nt, Bordetella pertussis
ccagcaagccga

SEQ ID NO: 2446999 - RNA, 16 nt, Bordetella pertussis
ccagcaagccggcggu

SEQ ID NO: 2447000 - RNA, 14 nt, Bordetella pertussis
ccagcaagcgcgcc

SEQ ID NO: 2447001 - RNA, 14 nt, Bordetella pertussis
ccagcaagcgcucg

SEQ ID NO: 2447002 - RNA, 16 nt, Bordetella pertussis
ccagcaagcgcucggc

SEQ ID NO: 2447003 - RNA, 17 nt, Bordetella pertussis
ccagcaagcgcucggcc

SEQ ID NO: 2447004 - RNA, 18 nt, Bordetella pertussis
ccagcaaggcggcaaacc

SEQ ID NO: 2447005 - RNA, 23 nt, Bordetella pertussis
ccagcaaggcggcaaacccggcg

SEQ ID NO: 2447006 - RNA, 16 nt, Bordetella pertussis
ccagcaaggcgucggc

SEQ ID NO: 2447007 - RNA, 18 nt, Bordetella pertussis
ccagcaaggcgucggcca

SEQ ID NO: 2447008 - RNA, 22 nt, Bordetella pertussis
ccagcaauuaugcguggccgcc

SEQ ID NO: 2447009 - RNA, 23 nt, Bordetella pertussis
ccagcaauucguugaucuggccg

SEQ ID NO: 2447010 - RNA, 18 nt, Bordetella pertussis
ccagcacauacgccgccg

SEQ ID NO: 2447011 - RNA, 23 nt, Bordetella pertussis
ccagcacaucgacgucggccucg

SEQ ID NO: 2447012 - RNA, 17 nt, Bordetella pertussis
ccagcaccacggcaucg

SEQ ID NO: 2447013 - RNA, 21 nt, Bordetella pertussis
ccagcaccacggcaucggcgc

SEQ ID NO: 2447014 - RNA, 15 nt, Bordetella pertussis
ccagcaccagcgccu

SEQ ID NO: 2447015 - RNA, 18 nt, Bordetella pertussis
ccagcaccagcgccugcc

SEQ ID NO: 2447016 - RNA, 14 nt, Bordetella pertussis
ccagcaccaggccg

SEQ ID NO: 2447017 - RNA, 18 nt, Bordetella pertussis
ccagcaccagggcgcgca

SEQ ID NO: 2447018 - RNA, 14 nt, Bordetella pertussis
ccagcaccaugccg

SEQ ID NO: 2447019 - RNA, 21 nt, Bordetella pertussis
ccagcaccccgucggcucagu

SEQ ID NO: 2447020 - RNA, 21 nt, Bordetella pertussis
ccagcaccgagcugccgccuu

SEQ ID NO: 2447021 - RNA, 15 nt, Bordetella pertussis
ccagcaccgaugcgc

SEQ ID NO: 2447022 - RNA, 13 nt, Bordetella pertussis
ccagcaccgccac

SEQ ID NO: 2447023 - RNA, 13 nt, Bordetella pertussis
ccagcaccgccgc

SEQ ID NO: 2447024 - RNA, 13 nt, Bordetella pertussis
ccagcaccggcac

SEQ ID NO: 2447025 - RNA, 19 nt, Bordetella pertussis
ccagcaccggcacgcgcca

SEQ ID NO: 2447026 - RNA, 22 nt, Bordetella pertussis
ccagcaccggcacgcgccaggc

SEQ ID NO: 2447027 - RNA, 14 nt, Bordetella pertussis
ccagcaccggcagc

SEQ ID NO: 2447028 - RNA, 14 nt, Bordetella pertussis
ccagcaccggcccg

SEQ ID NO: 2447029 - RNA, 16 nt, Bordetella pertussis
ccagcaccggccgccg

SEQ ID NO: 2447030 - RNA, 18 nt, Bordetella pertussis
ccagcaccggccgccgca

SEQ ID NO: 2447031 - RNA, 22 nt, Bordetella pertussis
ccagcaccggcugccagggccg

SEQ ID NO: 2447032 - RNA, 15 nt, Bordetella pertussis
ccagcaccugcaccg

SEQ ID NO: 2447033 - RNA, 18 nt, Bordetella pertussis
ccagcaccugcaccgaag

SEQ ID NO: 2447034 - RNA, 15 nt, Bordetella pertussis
ccagcaccugcaggc

SEQ ID NO: 2447035 - RNA, 16 nt, Bordetella pertussis
ccagcaccugcaggcc

SEQ ID NO: 2447036 - RNA, 20 nt, Bordetella pertussis
ccagcaccugcaggccgccg

SEQ ID NO: 2447037 - RNA, 21 nt, Bordetella pertussis
ccagcaccugcaggccgccgg

SEQ ID NO: 2447038 - RNA, 13 nt, Bordetella pertussis
ccagcaccugcuu

SEQ ID NO: 2447039 - RNA, 15 nt, Bordetella pertussis
ccagcacgaaccagu

SEQ ID NO: 2447040 - RNA, 22 nt, Bordetella pertussis
ccagcacgaagggcagcagcag

SEQ ID NO: 2447041 - RNA, 20 nt, Bordetella pertussis
ccagcacgacgacggccggc

SEQ ID NO: 2447042 - RNA, 22 nt, Bordetella pertussis
ccagcacgacgacggccggcgc

SEQ ID NO: 2447043 - RNA, 23 nt, Bordetella pertussis
ccagcacgacgacggccggcgcg

SEQ ID NO: 2447044 - RNA, 16 nt, Bordetella pertussis
ccagcacgauccagcc

SEQ ID NO: 2447045 - RNA, 17 nt, Bordetella pertussis
ccagcacgauccagccg

SEQ ID NO: 2447046 - RNA, 18 nt, Bordetella pertussis
ccagcacgauggucagcg

SEQ ID NO: 2447047 - RNA, 19 nt, Bordetella pertussis
ccagcacgauggucagcgg

SEQ ID NO: 2447048 - RNA, 20 nt, Bordetella pertussis
ccagcacgauggucagcggc

SEQ ID NO: 2447049 - RNA, 21 nt, Bordetella pertussis
ccagcacgauggucagcggca

SEQ ID NO: 2447050 - RNA, 13 nt, Bordetella pertussis
ccagcacgccauu

SEQ ID NO: 2447051 - RNA, 15 nt, Bordetella pertussis
ccagcacgccggcgg

SEQ ID NO: 2447052 - RNA, 16 nt, Bordetella pertussis
ccagcacgccggcggg

SEQ ID NO: 2447053 - RNA, 17 nt, Bordetella pertussis
ccagcacgccggcgggc

SEQ ID NO: 2447054 - RNA, 23 nt, Bordetella pertussis
ccagcacgccuugcucgaccagg

SEQ ID NO: 2447055 - RNA, 12 nt, Bordetella pertussis
ccagcacgcgcg

SEQ ID NO: 2447056 - RNA, 15 nt, Bordetella pertussis
ccagcacgcgcgcca

SEQ ID NO: 2447057 - RNA, 13 nt, Bordetella pertussis
ccagcacgcggcg

SEQ ID NO: 2447058 - RNA, 15 nt, Bordetella pertussis
ccagcacgcggcgca

SEQ ID NO: 2447059 - RNA, 13 nt, Bordetella pertussis
ccagcacggccgc

SEQ ID NO: 2447060 - RNA, 14 nt, Bordetella pertussis
ccagcacggccgcg

SEQ ID NO: 2447061 - RNA, 17 nt, Bordetella pertussis
ccagcacggccgcggcc

SEQ ID NO: 2447062 - RNA, 18 nt, Bordetella pertussis
ccagcacggccgcggccg

SEQ ID NO: 2447063 - RNA, 15 nt, Bordetella pertussis
ccagcacggcgagga

SEQ ID NO: 2447064 - RNA, 17 nt, Bordetella pertussis
ccagcacggcgcacacc

SEQ ID NO: 2447065 - RNA, 17 nt, Bordetella pertussis
ccagcacgguggcgccc

SEQ ID NO: 2447066 - RNA, 20 nt, Bordetella pertussis
ccagcacgguggcgcccggc

SEQ ID NO: 2447067 - RNA, 22 nt, Bordetella pertussis
ccagcacgguggcgcccggcgg

SEQ ID NO: 2447068 - RNA, 22 nt, Bordetella pertussis
ccagcacguaaucgaagccggg

SEQ ID NO: 2447069 - RNA, 16 nt, Bordetella pertussis
ccagcagaaugccgcc

SEQ ID NO: 2447070 - RNA, 19 nt, Bordetella pertussis
ccagcagauaccggcaugg

SEQ ID NO: 2447071 - RNA, 15 nt, Bordetella pertussis
ccagcagaucgcggc

SEQ ID NO: 2447072 - RNA, 18 nt, Bordetella pertussis
ccagcagaucgcggcggg

SEQ ID NO: 2447073 - RNA, 17 nt, Bordetella pertussis
ccagcagcaccgugccg

SEQ ID NO: 2447074 - RNA, 21 nt, Bordetella pertussis
ccagcagcaccgugccggcgu

SEQ ID NO: 2447075 - RNA, 13 nt, Bordetella pertussis
ccagcagcacgau

SEQ ID NO: 2447076 - RNA, 21 nt, Bordetella pertussis
ccagcagcacgaucgcggcgc

SEQ ID NO: 2447077 - RNA, 14 nt, Bordetella pertussis
ccagcagcacgccc

SEQ ID NO: 2447078 - RNA, 12 nt, Bordetella pertussis
ccagcagcacgu

SEQ ID NO: 2447079 - RNA, 12 nt, Bordetella pertussis
ccagcagcagcg

SEQ ID NO: 2447080 - RNA, 15 nt, Bordetella pertussis
ccagcagcagcgagc

SEQ ID NO: 2447081 - RNA, 17 nt, Bordetella pertussis
ccagcagcagcgccgcg

SEQ ID NO: 2447082 - RNA, 21 nt, Bordetella pertussis
ccagcagcagcgccgcgccgc

SEQ ID NO: 2447083 - RNA, 23 nt, Bordetella pertussis
ccagcagcaggaacaggcugcgc

SEQ ID NO: 2447084 - RNA, 12 nt, Bordetella pertussis
ccagcagcaugc

SEQ ID NO: 2447085 - RNA, 18 nt, Bordetella pertussis
ccagcagcaugccgcggu

SEQ ID NO: 2447086 - RNA, 16 nt, Bordetella pertussis
ccagcagcauggcggg

SEQ ID NO: 2447087 - RNA, 13 nt, Bordetella pertussis
ccagcagccccag

SEQ ID NO: 2447088 - RNA, 14 nt, Bordetella pertussis
ccagcagccccagc

SEQ ID NO: 2447089 - RNA, 21 nt, Bordetella pertussis
ccagcagccccagcguccagg

SEQ ID NO: 2447090 - RNA, 19 nt, Bordetella pertussis
ccagcggcgcagccggccg

SEQ ID NO: 2447091 - RNA, 21 nt, Bordetella pertussis
ccagcggcgcagccggccggu

SEQ ID NO: 2447092 - RNA, 14 nt, Bordetella pertussis
ccagcggcgccagc

SEQ ID NO: 2447093 - RNA, 14 nt, Bordetella pertussis
ccagcggcgccgac

SEQ ID NO: 2447094 - RNA, 22 nt, Bordetella pertussis
ccagcggcgccggaucggccgg

SEQ ID NO: 2447095 - RNA, 23 nt, Bordetella pertussis
ccagcggcgccggaucggccggc

SEQ ID NO: 2447096 - RNA, 17 nt, Bordetella pertussis
ccagcggcgcgacgcgc

SEQ ID NO: 2447097 - RNA, 19 nt, Bordetella pertussis
ccagcggcgcgacgcgcuu

SEQ ID NO: 2447098 - RNA, 23 nt, Bordetella pertussis
ccagcggcgcgacgcgcuugacg

SEQ ID NO: 2447099 - RNA, 13 nt, Bordetella pertussis
ccagcggcgcggc

SEQ ID NO: 2447100 - RNA, 15 nt, Bordetella pertussis
ccagcggcgcggcgc

SEQ ID NO: 2447101 - RNA, 19 nt, Bordetella pertussis
ccagcggcgcuuaccgcgc

SEQ ID NO: 2447102 - RNA, 21 nt, Bordetella pertussis
ccagcggcgcuuaccgcgccg

SEQ ID NO: 2447103 - RNA, 23 nt, Bordetella pertussis
ccagcggcgcuuaccgcgccggc

SEQ ID NO: 2447104 - RNA, 19 nt, Bordetella pertussis
ccagcggcgugaugcccag

SEQ ID NO: 2447105 - RNA, 22 nt, Bordetella pertussis
ccagcggcgugaugcccaggcc

SEQ ID NO: 2447106 - RNA, 18 nt, Bordetella pertussis
ccagcggcgugcggccca

SEQ ID NO: 2447107 - RNA, 20 nt, Bordetella pertussis
ccagcggcgugcggcccagc

SEQ ID NO: 2447108 - RNA, 21 nt, Bordetella pertussis
ccagcggcgugcggcccagcc

SEQ ID NO: 2447109 - RNA, 22 nt, Bordetella pertussis
ccagcggcgugcggcccagccg

SEQ ID NO: 2447110 - RNA, 18 nt, Bordetella pertussis
ccagcggcguggcggcca

SEQ ID NO: 2447111 - RNA, 21 nt, Bordetella pertussis
ccagcggcguggcggccaggc

SEQ ID NO: 2447112 - RNA, 22 nt, Bordetella pertussis
ccagcggcguggcggccaggcc

SEQ ID NO: 2447113 - RNA, 23 nt, Bordetella pertussis
ccagcggcguggcggccaggccg

SEQ ID NO: 2447114 - RNA, 21 nt, Bordetella pertussis
ccagcggcugcuugagcagcc

SEQ ID NO: 2447115 - RNA, 24 nt, Bordetella pertussis
ccagcggcugcuugagcagccacu

SEQ ID NO: 2447116 - RNA, 14 nt, Bordetella pertussis
ccagcggcuggcca

SEQ ID NO: 2447117 - RNA, 19 nt, Bordetella pertussis
ccagcggcuggccacuggc

SEQ ID NO: 2447118 - RNA, 14 nt, Bordetella pertussis
ccagcggcuggcgc

SEQ ID NO: 2447119 - RNA, 15 nt, Bordetella pertussis
ccagcggcuggcggu

SEQ ID NO: 2447120 - RNA, 14 nt, Bordetella pertussis
ccagcgggagccug

SEQ ID NO: 2447121 - RNA, 14 nt, Bordetella pertussis
ccagcggggacagg

SEQ ID NO: 2447122 - RNA, 15 nt, Bordetella pertussis
ccagcggggacaggc

SEQ ID NO: 2447123 - RNA, 19 nt, Bordetella pertussis
ccagcggggccgugacgug

SEQ ID NO: 2447124 - RNA, 16 nt, Bordetella pertussis
ccagcgguacgccgaa

SEQ ID NO: 2447125 - RNA, 18 nt, Bordetella pertussis
ccagcgguucgucggcgc

SEQ ID NO: 2447126 - RNA, 15 nt, Bordetella pertussis
ccagcgguugcgcca

SEQ ID NO: 2447127 - RNA, 17 nt, Bordetella pertussis
ccagcgguugcgccagc

SEQ ID NO: 2447128 - RNA, 17 nt, Bordetella pertussis
ccagcguaucgccgccg

SEQ ID NO: 2447129 - RNA, 18 nt, Bordetella pertussis
ccagcguaucgccgccgc

SEQ ID NO: 2447130 - RNA, 21 nt, Bordetella pertussis
ccagcguaucgccgccgccgg

SEQ ID NO: 2447131 - RNA, 22 nt, Bordetella pertussis
ccagcguauuccccuucucggc

SEQ ID NO: 2447132 - RNA, 13 nt, Bordetella pertussis
ccagcgucagcgc

SEQ ID NO: 2447133 - RNA, 16 nt, Bordetella pertussis
ccagcgucaggcuggg

SEQ ID NO: 2447134 - RNA, 21 nt, Bordetella pertussis
ccagcgucauggccuggccca

SEQ ID NO: 2447135 - RNA, 15 nt, Bordetella pertussis
ccagcguccaggcgg

SEQ ID NO: 2447136 - RNA, 16 nt, Bordetella pertussis
ccagcguccaggcggc

SEQ ID NO: 2447137 - RNA, 18 nt, Bordetella pertussis
ccagcguccaggcggcca

SEQ ID NO: 2447138 - RNA, 22 nt, Bordetella pertussis
ccagcgucggcguaaggccgcc

SEQ ID NO: 2447139 - RNA, 23 nt, Bordetella pertussis
ccagcgucggcguaaggccgccg

SEQ ID NO: 2447140 - RNA, 14 nt, Bordetella pertussis
ccagcgugcccagc

SEQ ID NO: 2447141 - RNA, 16 nt, Bordetella pertussis
ccagcgugcccagcga

SEQ ID NO: 2447142 - RNA, 18 nt, Bordetella pertussis
ccagcgugcccagcgaga

SEQ ID NO: 2447143 - RNA, 19 nt, Bordetella pertussis
ccagcguggagcugcucac

SEQ ID NO: 2447144 - RNA, 16 nt, Bordetella pertussis
ccagcguggccgaggu

SEQ ID NO: 2447145 - RNA, 20 nt, Bordetella pertussis
ccagcguggccgaggugccc

SEQ ID NO: 2447146 - RNA, 15 nt, Bordetella pertussis
ccagcguggcgcagu

SEQ ID NO: 2447147 - RNA, 17 nt, Bordetella pertussis
ccagcguguaggcggcc

SEQ ID NO: 2447148 - RNA, 20 nt, Bordetella pertussis
ccagcguguaggcggccggc

SEQ ID NO: 2447149 - RNA, 13 nt, Bordetella pertussis
ccagcguucgcgc

SEQ ID NO: 2447150 - RNA, 22 nt, Bordetella pertussis
ccagcguucgcgcuugcggccg

SEQ ID NO: 2447151 - RNA, 17 nt, Bordetella pertussis
ccagcucagcagcgcca

SEQ ID NO: 2447152 - RNA, 18 nt, Bordetella pertussis
ccagcucagcagcgccag

SEQ ID NO: 2447153 - RNA, 21 nt, Bordetella pertussis
ccagcucagcggauaauggcc

SEQ ID NO: 2447154 - RNA, 22 nt, Bordetella pertussis
ccagcucauggcacagcgcggc

SEQ ID NO: 2447155 - RNA, 23 nt, Bordetella pertussis
ccagcucauggcacagcgcggcg

SEQ ID NO: 2447156 - RNA, 14 nt, Bordetella pertussis
ccagcuccaccggg

SEQ ID NO: 2447157 - RNA, 16 nt, Bordetella pertussis
ccagcuccaccgggcu

SEQ ID NO: 2447158 - RNA, 21 nt, Bordetella pertussis
ccagcuccacgcacaccgccc

SEQ ID NO: 2447159 - RNA, 16 nt, Bordetella pertussis
ccagcuccagccgcag

SEQ ID NO: 2447160 - RNA, 16 nt, Bordetella pertussis
ccagcuccagcgcgcc

SEQ ID NO: 2447161 - RNA, 18 nt, Bordetella pertussis
ccagcuccagcgcgccga

SEQ ID NO: 2447162 - RNA, 15 nt, Bordetella pertussis
ccagcuccagcuggc

SEQ ID NO: 2447163 - RNA, 20 nt, Bordetella pertussis
ccagcuccagcuggcgcacc

SEQ ID NO: 2447164 - RNA, 23 nt, Bordetella pertussis
ccagcuccagcuggcgcaccagg

SEQ ID NO: 2447165 - RNA, 14 nt, Bordetella pertussis
ccagcuccaggugc

SEQ ID NO: 2447166 - RNA, 15 nt, Bordetella pertussis
ccagcuccccgggcg

SEQ ID NO: 2447167 - RNA, 14 nt, Bordetella pertussis
ccagcuccggcggc

SEQ ID NO: 2447168 - RNA, 15 nt, Bordetella pertussis
ccagcuccggcggca

SEQ ID NO: 2447169 - RNA, 15 nt, Bordetella pertussis
ccagcucgacgccau

SEQ ID NO: 2447170 - RNA, 17 nt, Bordetella pertussis
ccagcucgacgccaucu

SEQ ID NO: 2447171 - RNA, 13 nt, Bordetella pertussis
ccagcucgacgcg

SEQ ID NO: 2447172 - RNA, 17 nt, Bordetella pertussis
ccagcucgcgcagcagg

SEQ ID NO: 2447173 - RNA, 14 nt, Bordetella pertussis
ccagcucgcggccc

SEQ ID NO: 2447174 - RNA, 22 nt, Bordetella pertussis
ccagcucgcggcccuggucguc

SEQ ID NO: 2447175 - RNA, 17 nt, Bordetella pertussis
ccagcucggcgaugcgc

SEQ ID NO: 2447176 - RNA, 17 nt, Bordetella pertussis
ccagcucggcggccgcc

SEQ ID NO: 2447177 - RNA, 14 nt, Bordetella pertussis
ccagcucggcggcg

SEQ ID NO: 2447178 - RNA, 20 nt, Bordetella pertussis
ccagcucgguggucaacggc

SEQ ID NO: 2447179 - RNA, 14 nt, Bordetella pertussis
ccagcucguccagg

SEQ ID NO: 2447180 - RNA, 15 nt, Bordetella pertussis
ccagcucguccaggu

SEQ ID NO: 2447181 - RNA, 15 nt, Bordetella pertussis
ccagcucugcucugu

SEQ ID NO: 2447182 - RNA, 18 nt, Bordetella pertussis
ccagcucugguccaggcg

SEQ ID NO: 2447183 - RNA, 19 nt, Bordetella pertussis
ccagcucugguccaggcgg

SEQ ID NO: 2447184 - RNA, 14 nt, Bordetella pertussis
ccagcugaccucgc

SEQ ID NO: 2447185 - RNA, 16 nt, Bordetella pertussis
ccagcugaccucgccc

SEQ ID NO: 2447186 - RNA, 18 nt, Bordetella pertussis
ccagcugaccucgcccag

SEQ ID NO: 2447187 - RNA, 24 nt, Bordetella pertussis
ccagcugaccucgcccaggccggg

SEQ ID NO: 2447188 - RNA, 20 nt, Bordetella pertussis
ccagcugcaguaugcaaccg

SEQ ID NO: 2447189 - RNA, 14 nt, Bordetella pertussis
ccagcugcaugcgc

SEQ ID NO: 2447190 - RNA, 23 nt, Bordetella pertussis
ccagcugcaugcgcacggacagc

SEQ ID NO: 2447191 - RNA, 17 nt, Bordetella pertussis
ccagcugcgcagcgacu

SEQ ID NO: 2447192 - RNA, 15 nt, Bordetella pertussis
ccagcugcgcgcgag

SEQ ID NO: 2447193 - RNA, 14 nt, Bordetella pertussis
ccagcugcguggcg

SEQ ID NO: 2447194 - RNA, 23 nt, Bordetella pertussis
ccagcugcguggcgacgcgcugc

SEQ ID NO: 2447195 - RNA, 16 nt, Bordetella pertussis
ccagcugcuucaguuc

SEQ ID NO: 2447196 - RNA, 22 nt, Bordetella pertussis
ccagcugcuucaguuccaggcg

SEQ ID NO: 2447197 - RNA, 15 nt, Bordetella pertussis
ccagcuggaccgccu

SEQ ID NO: 2447198 - RNA, 18 nt, Bordetella pertussis
ccagcuggcgcaccaggc

SEQ ID NO: 2447199 - RNA, 20 nt, Bordetella pertussis
ccagcuggcgcaccaggcug

SEQ ID NO: 2447200 - RNA, 22 nt, Bordetella pertussis
ccagcuggcgcaccaggcuggg

SEQ ID NO: 2447201 - RNA, 14 nt, Bordetella pertussis
ccagcuggcgcccc

SEQ ID NO: 2447202 - RNA, 16 nt, Bordetella pertussis
ccagcuggcgccccuu

SEQ ID NO: 2447203 - RNA, 17 nt, Bordetella pertussis
ccagcuggcgccccuuc

SEQ ID NO: 2447204 - RNA, 23 nt, Bordetella pertussis
ccagcuggcgcguggccgccacg

SEQ ID NO: 2447205 - RNA, 17 nt, Bordetella pertussis
ccagcuggcggcgcagc

SEQ ID NO: 2447206 - RNA, 19 nt, Bordetella pertussis
ccagcuggcggcgcagcac

SEQ ID NO: 2447207 - RNA, 22 nt, Bordetella pertussis
ccagcugggaggcgugcugcac

SEQ ID NO: 2447208 - RNA, 12 nt, Bordetella pertussis
ccagcugggcca

SEQ ID NO: 2447209 - RNA, 18 nt, Bordetella pertussis
ccagcugggccacagggc

SEQ ID NO: 2447210 - RNA, 19 nt, Bordetella pertussis
ccagcugggcggcgugacc

SEQ ID NO: 2447211 - RNA, 21 nt, Bordetella pertussis
ccagcugggcguuguugcccc

SEQ ID NO: 2447212 - RNA, 20 nt, Bordetella pertussis
ccagcuguccaagcgcgugg

SEQ ID NO: 2447213 - RNA, 15 nt, Bordetella pertussis
ccagcuucgggcccu

SEQ ID NO: 2447214 - RNA, 14 nt, Bordetella pertussis
ccagcuucugcgcc

SEQ ID NO: 2447215 - RNA, 17 nt, Bordetella pertussis
ccagcuucugcgccugc

SEQ ID NO: 2447216 - RNA, 20 nt, Bordetella pertussis
ccagcuucugcgccugcugg

SEQ ID NO: 2447217 - RNA, 16 nt, Bordetella pertussis
ccagcuugaacaggca

SEQ ID NO: 2447218 - RNA, 13 nt, Bordetella pertussis
ccagcuugaccgc

SEQ ID NO: 2447219 - RNA, 24 nt, Bordetella pertussis
ccagcuugaccuugagcacgcugg

SEQ ID NO: 2447220 - RNA, 16 nt, Bordetella pertussis
ccagcuugacguccag

SEQ ID NO: 2447221 - RNA, 16 nt, Bordetella pertussis
ccagcuugaugccgcc

SEQ ID NO: 2447222 - RNA, 17 nt, Bordetella pertussis
ccagcuugaugccgccg

SEQ ID NO: 2447223 - RNA, 13 nt, Bordetella pertussis
ccagcuugcaaaa

SEQ ID NO: 2447224 - RNA, 15 nt, Bordetella pertussis
ccagcuugccgcuca

SEQ ID NO: 2447225 - RNA, 15 nt, Bordetella pertussis
ccagcuugcgcgccg

SEQ ID NO: 2447226 - RNA, 17 nt, Bordetella pertussis
ccagcuugcgcgccgca

SEQ ID NO: 2447227 - RNA, 15 nt, Bordetella pertussis
ccagcuuggacagcg

SEQ ID NO: 2447228 - RNA, 13 nt, Bordetella pertussis
ccagcuuggccug

SEQ ID NO: 2447229 - RNA, 20 nt, Bordetella pertussis
ccagcuuguagcggccaucg

SEQ ID NO: 2447230 - RNA, 18 nt, Bordetella pertussis
ccagcuugucggccgcgc

SEQ ID NO: 2447231 - RNA, 21 nt, Bordetella pertussis
ccagcuugucggccgcgcgca

SEQ ID NO: 2447232 - RNA, 24 nt, Bordetella pertussis
ccagcuugucggccgcgcgcauca

SEQ ID NO: 2447233 - RNA, 18 nt, Bordetella pertussis
ccaggaaaaccggcgccu

SEQ ID NO: 2447234 - RNA, 20 nt, Bordetella pertussis
ccaggaaaaccggcgccugg

SEQ ID NO: 2447235 - RNA, 21 nt, Bordetella pertussis
ccaggaaaaccggcgccuggc

SEQ ID NO: 2447236 - RNA, 20 nt, Bordetella pertussis
ccaggaaaaccuccuccgcg

SEQ ID NO: 2447237 - RNA, 22 nt, Bordetella pertussis
ccaggaaaagccgccuucgggc

SEQ ID NO: 2447238 - RNA, 21 nt, Bordetella pertussis
ccaggaaaccgaccugaucgc

SEQ ID NO: 2447239 - RNA, 16 nt, Bordetella pertussis
ccaggaaagaggccag

SEQ ID NO: 2447240 - RNA, 20 nt, Bordetella pertussis
ccaggaaagaggccaggccc

SEQ ID NO: 2447241 - RNA, 15 nt, Bordetella pertussis
ccaggaaagcgccgc

SEQ ID NO: 2447242 - RNA, 17 nt, Bordetella pertussis
ccaggaaagcgccgccg

SEQ ID NO: 2447243 - RNA, 18 nt, Bordetella pertussis
ccaggaaagcgccgccgc

SEQ ID NO: 2447244 - RNA, 21 nt, Bordetella pertussis
ccaggaaagcgccgccgccgg

SEQ ID NO: 2447245 - RNA, 22 nt, Bordetella pertussis
ccaggaaagcgccgccgccggu

SEQ ID NO: 2447246 - RNA, 15 nt, Bordetella pertussis
ccaggaacagcgccg

SEQ ID NO: 2447247 - RNA, 20 nt, Bordetella pertussis
ccaggaacagcgccggcagc

SEQ ID NO: 2447248 - RNA, 16 nt, Bordetella pertussis
ccaggaacgccagcag

SEQ ID NO: 2447249 - RNA, 21 nt, Bordetella pertussis
ccaggaagagcuggcgcugcu

SEQ ID NO: 2447250 - RNA, 18 nt, Bordetella pertussis
ccaggaagaucggcccgg

SEQ ID NO: 2447251 - RNA, 19 nt, Bordetella pertussis
ccaggaagcagcccagcac

SEQ ID NO: 2447252 - RNA, 15 nt, Bordetella pertussis
ccaggaagcgcgccg

SEQ ID NO: 2447253 - RNA, 19 nt, Bordetella pertussis
ccaggaagcgcgccgcgcg

SEQ ID NO: 2447254 - RNA, 22 nt, Bordetella pertussis
ccaggaagcgcgccgcgcgcac

SEQ ID NO: 2447255 - RNA, 15 nt, Bordetella pertussis
ccaggaagcgcgccu

SEQ ID NO: 2447256 - RNA, 17 nt, Bordetella pertussis
ccaggaagcgcgccugc

SEQ ID NO: 2447257 - RNA, 17 nt, Bordetella pertussis
ccaggaagcggcgcacc

SEQ ID NO: 2447258 - RNA, 18 nt, Bordetella pertussis
ccaggaagcgggccugcc

SEQ ID NO: 2447259 - RNA, 17 nt, Bordetella pertussis
ccaggaaguugcccacc

SEQ ID NO: 2447260 - RNA, 16 nt, Bordetella pertussis
ccaggaccaggaugau

SEQ ID NO: 2447261 - RNA, 18 nt, Bordetella pertussis
ccaggaccuguacuggcu

SEQ ID NO: 2447262 - RNA, 23 nt, Bordetella pertussis
ccaggacgacaggcaugcagcau

SEQ ID NO: 2447263 - RNA, 22 nt, Bordetella pertussis
ccaggacgcgaagaucccgccg

SEQ ID NO: 2447264 - RNA, 12 nt, Bordetella pertussis
ccaggacggugu

SEQ ID NO: 2447265 - RNA, 17 nt, Bordetella pertussis
ccaggacguccaggccu

SEQ ID NO: 2447266 - RNA, 22 nt, Bordetella pertussis
ccaggacuucgucgaucauggc

SEQ ID NO: 2447267 - RNA, 20 nt, Bordetella pertussis
ccaggagcaacuggggcgcu

SEQ ID NO: 2447268 - RNA, 13 nt, Bordetella pertussis
ccaggagcucguc

SEQ ID NO: 2447269 - RNA, 20 nt, Bordetella pertussis
ccaggaguucccagcgcgcg

SEQ ID NO: 2447270 - RNA, 14 nt, Bordetella pertussis
ccaggaucaccgcc

SEQ ID NO: 2447271 - RNA, 19 nt, Bordetella pertussis
ccaggaucaccgccgcgcc

SEQ ID NO: 2447272 - RNA, 20 nt, Bordetella pertussis
ccaggaucaccgccgcgccg

SEQ ID NO: 2447273 - RNA, 15 nt, Bordetella pertussis
ccaggauccccagca

SEQ ID NO: 2447274 - RNA, 13 nt, Bordetella pertussis
ccaggaucgcggc

SEQ ID NO: 2447275 - RNA, 19 nt, Bordetella pertussis
ccaggaucgcggccagccg

SEQ ID NO: 2447276 - RNA, 14 nt, Bordetella pertussis
ccaggaugagcgcc

SEQ ID NO: 2447277 - RNA, 16 nt, Bordetella pertussis
ccaggaugagcgccug

SEQ ID NO: 2447278 - RNA, 18 nt, Bordetella pertussis
ccaggaugagcgccugca

SEQ ID NO: 2447279 - RNA, 14 nt, Bordetella pertussis
ccaggaugaugcag

SEQ ID NO: 2447280 - RNA, 21 nt, Bordetella pertussis
ccaggaugcccuuggcggcga

SEQ ID NO: 2447281 - RNA, 13 nt, Bordetella pertussis
ccaggaugcgcac

SEQ ID NO: 2447282 - RNA, 15 nt, Bordetella pertussis
ccaggaugcgcaccg

SEQ ID NO: 2447283 - RNA, 18 nt, Bordetella pertussis
ccaggaugcgcaccggcc

SEQ ID NO: 2447284 - RNA, 19 nt, Bordetella pertussis
ccaggaugcgcaccggcca

SEQ ID NO: 2447285 - RNA, 23 nt, Bordetella pertussis
ccaggaugcgcaccggccagggg

SEQ ID NO: 2447286 - RNA, 15 nt, Bordetella pertussis
ccaggaugcgcgaca

SEQ ID NO: 2447287 - RNA, 22 nt, Bordetella pertussis
ccaggaugcgcgacaccgugcg

SEQ ID NO: 2447288 - RNA, 23 nt, Bordetella pertussis
ccaggauggagagggccugguca

SEQ ID NO: 2447289 - RNA, 13 nt, Bordetella pertussis
ccaggauggcgcc

SEQ ID NO: 2447290 - RNA, 16 nt, Bordetella pertussis
ccaggauggcgccagc

SEQ ID NO: 2447291 - RNA, 18 nt, Bordetella pertussis
ccaggauggcgccagccc

SEQ ID NO: 2447292 - RNA, 22 nt, Bordetella pertussis
ccaggauggcgccagcccgccc

SEQ ID NO: 2447293 - RNA, 21 nt, Bordetella pertussis
ccaggauuucauggcaucggc

SEQ ID NO: 2447294 - RNA, 17 nt, Bordetella pertussis
ccaggcaaaggcccagg

SEQ ID NO: 2447295 - RNA, 18 nt, Bordetella pertussis
ccaggcaaaggcccaggc

SEQ ID NO: 2447296 - RNA, 20 nt, Bordetella pertussis
ccaggcaaugcgcaggcccg

SEQ ID NO: 2447297 - RNA, 12 nt, Bordetella pertussis
ccaggcagccgg

SEQ ID NO: 2447298 - RNA, 17 nt, Bordetella pertussis
ccaggcagccggccccg

SEQ ID NO: 2447299 - RNA, 19 nt, Bordetella pertussis
ccaggcauucccgcccagc

SEQ ID NO: 2447300 - RNA, 22 nt, Bordetella pertussis
ccaggcauucccgcccagcgac

SEQ ID NO: 2447301 - RNA, 16 nt, Bordetella pertussis
ccaggcauucucggac

SEQ ID NO: 2447302 - RNA, 23 nt, Bordetella pertussis
ccaggcauucucggacaggucgg

SEQ ID NO: 2447303 - RNA, 15 nt, Bordetella pertussis
ccaggccacccgccg

SEQ ID NO: 2447304 - RNA, 16 nt, Bordetella pertussis
ccaggccaccgcggcg

SEQ ID NO: 2447305 - RNA, 15 nt, Bordetella pertussis
ccaggccaccgcggu

SEQ ID NO: 2447306 - RNA, 19 nt, Bordetella pertussis
ccaggccaccgcggugccg

SEQ ID NO: 2447307 - RNA, 19 nt, Bordetella pertussis
ccagccgucgcgcugcaau

SEQ ID NO: 2447308 - RNA, 14 nt, Bordetella pertussis
ccagccgucggcau

SEQ ID NO: 2447309 - RNA, 15 nt, Bordetella pertussis
ccagccgucggcaug

SEQ ID NO: 2447310 - RNA, 16 nt, Bordetella pertussis
ccagccgucggcaugg

SEQ ID NO: 2447311 - RNA, 18 nt, Bordetella pertussis
ccagccguucaucagcgc

SEQ ID NO: 2447312 - RNA, 22 nt, Bordetella pertussis
ccagccguucaucagcgcgcgc

SEQ ID NO: 2447313 - RNA, 20 nt, Bordetella pertussis
ccagccguugcgccagcggc

SEQ ID NO: 2447314 - RNA, 17 nt, Bordetella pertussis
ccagccguuggcgccca

SEQ ID NO: 2447315 - RNA, 18 nt, Bordetella pertussis
ccagccguuggcgcccag

SEQ ID NO: 2447316 - RNA, 20 nt, Bordetella pertussis
ccagccguuggcgcccagcg

SEQ ID NO: 2447317 - RNA, 23 nt, Bordetella pertussis
ccagccguuggcgcccagcgcca

SEQ ID NO: 2447318 - RNA, 17 nt, Bordetella pertussis
ccagccugaugcgcaga

SEQ ID NO: 2447319 - RNA, 19 nt, Bordetella pertussis
ccagccugcccgggcagca

SEQ ID NO: 2447320 - RNA, 14 nt, Bordetella pertussis
ccagccugccgcgg

SEQ ID NO: 2447321 - RNA, 15 nt, Bordetella pertussis
ccagccugccgcggc

SEQ ID NO: 2447322 - RNA, 19 nt, Bordetella pertussis
ccagccugccgcggccgcc

SEQ ID NO: 2447323 - RNA, 20 nt, Bordetella pertussis
ccagccugccgcggccgccc

SEQ ID NO: 2447324 - RNA, 16 nt, Bordetella pertussis
ccagccuggccuugcg

SEQ ID NO: 2447325 - RNA, 17 nt, Bordetella pertussis
ccagccuggccuugcgc

SEQ ID NO: 2447326 - RNA, 12 nt, Bordetella pertussis
ccagccuggcgc

SEQ ID NO: 2447327 - RNA, 14 nt, Bordetella pertussis
ccagccuggcgcca

SEQ ID NO: 2447328 - RNA, 16 nt, Bordetella pertussis
ccagccugugcgccau

SEQ ID NO: 2447329 - RNA, 19 nt, Bordetella pertussis
ccagcgacgacuugaucag

SEQ ID NO: 2447330 - RNA, 20 nt, Bordetella pertussis
ccagcgacgacuugaucagg

SEQ ID NO: 2447331 - RNA, 16 nt, Bordetella pertussis
ccagcgacuccggccg

SEQ ID NO: 2447332 - RNA, 21 nt, Bordetella pertussis
ccagcgacuccggccgggcca

SEQ ID NO: 2447333 - RNA, 17 nt, Bordetella pertussis
ccagcgacucggucagc

SEQ ID NO: 2447334 - RNA, 16 nt, Bordetella pertussis
ccagcgagaccuugug

SEQ ID NO: 2447335 - RNA, 17 nt, Bordetella pertussis
ccagcgagaucagcacc

SEQ ID NO: 2447336 - RNA, 14 nt, Bordetella pertussis
ccagcgagccggcc

SEQ ID NO: 2447337 - RNA, 15 nt, Bordetella pertussis
ccagcgagccggcca

SEQ ID NO: 2447338 - RNA, 18 nt, Bordetella pertussis
ccagcgagcgaaagccgu

SEQ ID NO: 2447339 - RNA, 17 nt, Bordetella pertussis
ccagcgagcggggcugg

SEQ ID NO: 2447340 - RNA, 23 nt, Bordetella pertussis
ccaucgcgucgacggugcgcgcc

SEQ ID NO: 2447341 - RNA, 22 nt, Bordetella pertussis
ccaucggcgccaagcggcaggc

SEQ ID NO: 2447342 - RNA, 13 nt, Bordetella pertussis
ccaucggcgcgcg

SEQ ID NO: 2447343 - RNA, 14 nt, Bordetella pertussis
ccaucgucguagcg

SEQ ID NO: 2447344 - RNA, 19 nt, Bordetella pertussis
ccaucgucguagcgccagc

SEQ ID NO: 2447345 - RNA, 16 nt, Bordetella pertussis
ccaucgugcgcgaucu

SEQ ID NO: 2447346 - RNA, 20 nt, Bordetella pertussis
ccaucgugcgcgaucuugcc

SEQ ID NO: 2447347 - RNA, 21 nt, Bordetella pertussis
ccaucguugccugggugcugg

SEQ ID NO: 2447348 - RNA, 18 nt, Bordetella pertussis
ccaucuacgugcuggacc

SEQ ID NO: 2447349 - RNA, 23 nt, Bordetella pertussis
ccaucuacgugcuggacccgcug

SEQ ID NO: 2447350 - RNA, 12 nt, Bordetella pertussis
ccaucucgcgcg

SEQ ID NO: 2447351 - RNA, 22 nt, Bordetella pertussis
ccaucucgucggucaugcccau

SEQ ID NO: 2447352 - RNA, 12 nt, Bordetella pertussis
ccaucugcugcg

SEQ ID NO: 2447353 - RNA, 17 nt, Bordetella pertussis
ccaucuggaccgcgcgc

SEQ ID NO: 2447354 - RNA, 18 nt, Bordetella pertussis
ccaucuggaccgcgcgcg

SEQ ID NO: 2447355 - RNA, 16 nt, Bordetella pertussis
ccaucuguacggccgg

SEQ ID NO: 2447356 - RNA, 22 nt, Bordetella pertussis
ccaucuguacggccggcuccgc

SEQ ID NO: 2447357 - RNA, 14 nt, Bordetella pertussis
ccaucuugccggcc

SEQ ID NO: 2447358 - RNA, 17 nt, Bordetella pertussis
ccaugaaagcgaacagg

SEQ ID NO: 2447359 - RNA, 19 nt, Bordetella pertussis
ccaugaaagcgaacagggc

SEQ ID NO: 2447360 - RNA, 21 nt, Bordetella pertussis
ccaugaaagcgaacagggcgc

SEQ ID NO: 2447361 - RNA, 20 nt, Bordetella pertussis
ccaugaacaggcacgacgcg

SEQ ID NO: 2447362 - RNA, 14 nt, Bordetella pertussis
ccaugaacgccgcg

SEQ ID NO: 2447363 - RNA, 18 nt, Bordetella pertussis
ccaugaacgccgcgcccg

SEQ ID NO: 2447364 - RNA, 19 nt, Bordetella pertussis
ccaugaacgccgcgcccgc

SEQ ID NO: 2447365 - RNA, 16 nt, Bordetella pertussis
ccaugaacgcuugacg

SEQ ID NO: 2447366 - RNA, 23 nt, Bordetella pertussis
ccaugaacgcuugacggccagga

SEQ ID NO: 2447367 - RNA, 14 nt, Bordetella pertussis
ccaugaaggcggcc

SEQ ID NO: 2447368 - RNA, 19 nt, Bordetella pertussis
ccaugacaugcgggccucg

SEQ ID NO: 2447369 - RNA, 20 nt, Bordetella pertussis
ccaugacaugcgggccucga

SEQ ID NO: 2447370 - RNA, 19 nt, Bordetella pertussis
ccaugaccaugccggccug

SEQ ID NO: 2447371 - RNA, 15 nt, Bordetella pertussis
ccaugacgaccuugc

SEQ ID NO: 2447372 - RNA, 16 nt, Bordetella pertussis
ccaugacgaccuugcg

SEQ ID NO: 2447373 - RNA, 19 nt, Bordetella pertussis
ccaugacgaccuugcggcc

SEQ ID NO: 2447374 - RNA, 22 nt, Bordetella pertussis
ccaugacgaccuugcggccgcg

SEQ ID NO: 2447375 - RNA, 21 nt, Bordetella pertussis
ccaugacgggaauccgcugcg

SEQ ID NO: 2447376 - RNA, 16 nt, Bordetella pertussis
ccaugacguccagcgc

SEQ ID NO: 2447377 - RNA, 17 nt, Bordetella pertussis
ccaugacguccagcgcc

SEQ ID NO: 2447378 - RNA, 19 nt, Bordetella pertussis
ccaugacguccagcgccac

SEQ ID NO: 2447379 - RNA, 21 nt, Bordetella pertussis
ccaugacguccagcgccacca

SEQ ID NO: 2447380 - RNA, 19 nt, Bordetella pertussis
ccaugaggaacggcaccag

SEQ ID NO: 2447381 - RNA, 21 nt, Bordetella pertussis
ccaugaggaacggcaccagcc

SEQ ID NO: 2447382 - RNA, 20 nt, Bordetella pertussis
ccaugaucagggccgugccc

SEQ ID NO: 2447383 - RNA, 23 nt, Bordetella pertussis
ccaugaucucgggcgaggucagc

SEQ ID NO: 2447384 - RNA, 15 nt, Bordetella pertussis
ccaugauggccgcgc

SEQ ID NO: 2447385 - RNA, 19 nt, Bordetella pertussis
ccaugauggccgcgcgcag

SEQ ID NO: 2447386 - RNA, 17 nt, Bordetella pertussis
ccaugaugucgcgcgcc

SEQ ID NO: 2447387 - RNA, 18 nt, Bordetella pertussis
ccaugaugucgcgcgccu

SEQ ID NO: 2447388 - RNA, 18 nt, Bordetella pertussis
ccaugauuccaccuugcc

SEQ ID NO: 2447389 - RNA, 17 nt, Bordetella pertussis
ccaugcaacacgaccag

SEQ ID NO: 2447390 - RNA, 22 nt, Bordetella pertussis
ccaugcaacacgaccagcaggc

SEQ ID NO: 2447391 - RNA, 14 nt, Bordetella pertussis
ccaugcaccagcac

SEQ ID NO: 2447392 - RNA, 18 nt, Bordetella pertussis
ccaugcacgggccaugga

SEQ ID NO: 2447393 - RNA, 14 nt, Bordetella pertussis
ccaugcccaggccc

SEQ ID NO: 2447394 - RNA, 16 nt, Bordetella pertussis
ccaugcccaggcccag

SEQ ID NO: 2447395 - RNA, 17 nt, Bordetella pertussis
ccaugccgaugccgcag

SEQ ID NO: 2447396 - RNA, 18 nt, Bordetella pertussis
ccaugccgaugccgcagu

SEQ ID NO: 2447397 - RNA, 16 nt, Bordetella pertussis
ccaugccgauggcggu

SEQ ID NO: 2447398 - RNA, 17 nt, Bordetella pertussis
ccaugccgcccaugccg

SEQ ID NO: 2447399 - RNA, 22 nt, Bordetella pertussis
ccaugccgcccaugccgccggg

SEQ ID NO: 2447400 - RNA, 13 nt, Bordetella pertussis
ccaugccgcccgc

SEQ ID NO: 2447401 - RNA, 14 nt, Bordetella pertussis
ccaugccgcccgcc

SEQ ID NO: 2447402 - RNA, 12 nt, Bordetella pertussis
ccaugccgcgcc

SEQ ID NO: 2447403 - RNA, 14 nt, Bordetella pertussis
ccaugccgcgcccg

SEQ ID NO: 2447404 - RNA, 14 nt, Bordetella pertussis
ccaugccgcgcgcc

SEQ ID NO: 2447405 - RNA, 23 nt, Bordetella pertussis
ccaugccgcggacccaggccucg

SEQ ID NO: 2447406 - RNA, 15 nt, Bordetella pertussis
ccaugccggaacagg

SEQ ID NO: 2447407 - RNA, 14 nt, Bordetella pertussis
ccaugccggccugc

SEQ ID NO: 2447408 - RNA, 21 nt, Bordetella pertussis
ccaugccggguugcaggaugc

SEQ ID NO: 2447409 - RNA, 16 nt, Bordetella pertussis
ccaugccguccugcug

SEQ ID NO: 2447410 - RNA, 17 nt, Bordetella pertussis
ccaugccgucgcgcacc

SEQ ID NO: 2447411 - RNA, 13 nt, Bordetella pertussis
ccaugccgucugg

SEQ ID NO: 2447412 - RNA, 20 nt, Bordetella pertussis
ccaugccgucuggcggcagc

SEQ ID NO: 2447413 - RNA, 17 nt, Bordetella pertussis
ccaugccuugcgcgaca

SEQ ID NO: 2447414 - RNA, 19 nt, Bordetella pertussis
ccaugcgaaagcggccagc

SEQ ID NO: 2447415 - RNA, 20 nt, Bordetella pertussis
ccaugcgaaugaucucgcgc

SEQ ID NO: 2447416 - RNA, 22 nt, Bordetella pertussis
ccaugcgaaugaucucgcgcuu

SEQ ID NO: 2447417 - RNA, 23 nt, Bordetella pertussis
ccaugcgauagcgggccugcagc

SEQ ID NO: 2447418 - RNA, 21 nt, Bordetella pertussis
ccaugcgauaggcgaagcgcg

SEQ ID NO: 2447419 - RNA, 16 nt, Bordetella pertussis
ccaugcgauccagggc

SEQ ID NO: 2447420 - RNA, 21 nt, Bordetella pertussis
ccaugcgauccagggcgauca

SEQ ID NO: 2447421 - RNA, 18 nt, Bordetella pertussis
ccaugcgcaccaccgccg

SEQ ID NO: 2447422 - RNA, 19 nt, Bordetella pertussis
ccaugcgcaccaccgccga

SEQ ID NO: 2447423 - RNA, 13 nt, Bordetella pertussis
ccaugcgcaccag

SEQ ID NO: 2447424 - RNA, 18 nt, Bordetella pertussis
ccaugcgcaccaggcgcu

SEQ ID NO: 2447425 - RNA, 20 nt, Bordetella pertussis
ccaugcgcaccaggcgcucg

SEQ ID NO: 2447426 - RNA, 17 nt, Bordetella pertussis
ccaugcgcacucgaccg

SEQ ID NO: 2447427 - RNA, 12 nt, Bordetella pertussis
ccaugcgcaugg

SEQ ID NO: 2447428 - RNA, 14 nt, Bordetella pertussis
ccaugcgcauggcc

SEQ ID NO: 2447429 - RNA, 18 nt, Bordetella pertussis
ccaugcgcauggccagca

SEQ ID NO: 2447430 - RNA, 22 nt, Bordetella pertussis
ccaugcgcauggccagcgcgca

SEQ ID NO: 2447431 - RNA, 23 nt, Bordetella pertussis
ccaugcgcauggccagcgcgcag

SEQ ID NO: 2447432 - RNA, 13 nt, Bordetella pertussis
ccaugcgccagca

SEQ ID NO: 2447433 - RNA, 12 nt, Bordetella pertussis
ccaugcgcccgg

SEQ ID NO: 2447434 - RNA, 17 nt, Bordetella pertussis
ccaugcgcccggccacc

SEQ ID NO: 2447435 - RNA, 22 nt, Bordetella pertussis
ccaugcgcgagggcaucagcgc

SEQ ID NO: 2447436 - RNA, 13 nt, Bordetella pertussis
ccaugcgcggcac

SEQ ID NO: 2447437 - RNA, 21 nt, Bordetella pertussis
ccaugcgcgguugggcgcaca

SEQ ID NO: 2447438 - RNA, 16 nt, Bordetella pertussis
ccaugcgcugcgccuu

SEQ ID NO: 2447439 - RNA, 15 nt, Bordetella pertussis
ccaugcgcuggcgca

SEQ ID NO: 2447440 - RNA, 19 nt, Bordetella pertussis
ccaugcgcuggcgcaagga

SEQ ID NO: 2447441 - RNA, 17 nt, Bordetella pertussis
ccaugcgcugggcaugg

SEQ ID NO: 2447442 - RNA, 18 nt, Bordetella pertussis
ccaugcgcuuggaccccg

SEQ ID NO: 2447443 - RNA, 15 nt, Bordetella pertussis
ccaugcggacgccag

SEQ ID NO: 2447444 - RNA, 19 nt, Bordetella pertussis
ccaugcggacgccagcccu

SEQ ID NO: 2447445 - RNA, 22 nt, Bordetella pertussis
ccaugcggccgucgccgcccau

SEQ ID NO: 2447446 - RNA, 22 nt, Bordetella pertussis
ccaugcggcggcgggcggccgg

SEQ ID NO: 2447447 - RNA, 16 nt, Bordetella pertussis
ccaugcggcuggccga

SEQ ID NO: 2447448 - RNA, 13 nt, Bordetella pertussis
ccaugcggggaca

SEQ ID NO: 2447449 - RNA, 22 nt, Bordetella pertussis
ccaugcggggacaggcacuccg

SEQ ID NO: 2447450 - RNA, 18 nt, Bordetella pertussis
ccaugcggggacuggcac

SEQ ID NO: 2447451 - RNA, 20 nt, Bordetella pertussis
ccaugcggggacuggcacca

SEQ ID NO: 2447452 - RNA, 22 nt, Bordetella pertussis
ccauuggugcgcacaucgcccg

SEQ ID NO: 2447453 - RNA, 17 nt, Bordetella pertussis
ccauuucgauggccagg

SEQ ID NO: 2447454 - RNA, 14 nt, Bordetella pertussis
ccauuucgugcgug

SEQ ID NO: 2447455 - RNA, 18 nt, Bordetella pertussis
ccauuuguugggccaccu

SEQ ID NO: 2447456 - RNA, 22 nt, Bordetella pertussis
cccaaaaaaaaaccccgccagg

SEQ ID NO: 2447457 - RNA, 14 nt, Bordetella pertussis
cccaacccaggucg

SEQ ID NO: 2447458 - RNA, 17 nt, Bordetella pertussis
cccaacccggcgaggcc

SEQ ID NO: 2447459 - RNA, 21 nt, Bordetella pertussis
cccaacccggcgaggccgccc

SEQ ID NO: 2447460 - RNA, 14 nt, Bordetella pertussis
cccaacgcggccag

SEQ ID NO: 2447461 - RNA, 15 nt, Bordetella pertussis
cccaacgcggccagc

SEQ ID NO: 2447462 - RNA, 13 nt, Bordetella pertussis
cccaacgcggcgu

SEQ ID NO: 2447463 - RNA, 16 nt, Bordetella pertussis
cccaacgcggcgucga

SEQ ID NO: 2447464 - RNA, 14 nt, Bordetella pertussis
cccaacggccuucg

SEQ ID NO: 2447465 - RNA, 14 nt, Bordetella pertussis
cccaacggcgcacc

SEQ ID NO: 2447466 - RNA, 18 nt, Bordetella pertussis
cccaacggggacgggcgc

SEQ ID NO: 2447467 - RNA, 19 nt, Bordetella pertussis
cccaacggggacgggcgcc

SEQ ID NO: 2447468 - RNA, 16 nt, Bordetella pertussis
cccaagcccguggcgg

SEQ ID NO: 2447469 - RNA, 22 nt, Bordetella pertussis
cccaaggccccgcgacccagaa

SEQ ID NO: 2447470 - RNA, 20 nt, Bordetella pertussis
cccaauccgaucagcacgau

SEQ ID NO: 2447471 - RNA, 20 nt, Bordetella pertussis
cccaaucgggcagcacgcgc

SEQ ID NO: 2447472 - RNA, 22 nt, Bordetella pertussis
cccaaucgggcagcacgcgcac

SEQ ID NO: 2447473 - RNA, 15 nt, Bordetella pertussis
cccaauuggccgccc

SEQ ID NO: 2447474 - RNA, 13 nt, Bordetella pertussis
cccacaccaucaa

SEQ ID NO: 2447475 - RNA, 19 nt, Bordetella pertussis
cccacacuuggccggcgau

SEQ ID NO: 2447476 - RNA, 21 nt, Bordetella pertussis
cccacagcagcgcgccgccga

SEQ ID NO: 2447477 - RNA, 14 nt, Bordetella pertussis
cccacagcgccccc

SEQ ID NO: 2447478 - RNA, 15 nt, Bordetella pertussis
cccagaucgauccag

SEQ ID NO: 2447479 - RNA, 18 nt, Bordetella pertussis
cccagaucugccgcaaug

SEQ ID NO: 2447480 - RNA, 18 nt, Bordetella pertussis
cccagaugccggucagga

SEQ ID NO: 2447481 - RNA, 21 nt, Bordetella pertussis
cccagaugccggucaggaugc

SEQ ID NO: 2447482 - RNA, 14 nt, Bordetella pertussis
cccagauggcgccu

SEQ ID NO: 2447483 - RNA, 19 nt, Bordetella pertussis
cccagcaagccgaucaacc

SEQ ID NO: 2447484 - RNA, 22 nt, Bordetella pertussis
cccagcaauuaugcguggccgc

SEQ ID NO: 2447485 - RNA, 23 nt, Bordetella pertussis
cccagcaauuaugcguggccgcc

SEQ ID NO: 2447486 - RNA, 22 nt, Bordetella pertussis
cccagcaauucguugaucuggc

SEQ ID NO: 2447487 - RNA, 23 nt, Bordetella pertussis
cccagcacauagcgcaagcccgu

SEQ ID NO: 2447488 - RNA, 15 nt, Bordetella pertussis
cccagcaccacggca

SEQ ID NO: 2447489 - RNA, 20 nt, Bordetella pertussis
cccagcaccgagcugccgcc

SEQ ID NO: 2447490 - RNA, 12 nt, Bordetella pertussis
cccagcaccgcc

SEQ ID NO: 2447491 - RNA, 13 nt, Bordetella pertussis
cccagcaccgcca

SEQ ID NO: 2447492 - RNA, 16 nt, Bordetella pertussis
cccagcaccgccgcca

SEQ ID NO: 2447493 - RNA, 18 nt, Bordetella pertussis
cccagcaccucgacgcag

SEQ ID NO: 2447494 - RNA, 15 nt, Bordetella pertussis
cccagcaccugcagg

SEQ ID NO: 2447495 - RNA, 19 nt, Bordetella pertussis
cccagcaccugcaggccgc

SEQ ID NO: 2447496 - RNA, 18 nt, Bordetella pertussis
cccagcacgaagggcagc

SEQ ID NO: 2447497 - RNA, 16 nt, Bordetella pertussis
cccagcacgacgaaga

SEQ ID NO: 2447498 - RNA, 23 nt, Bordetella pertussis
cccagcgucagcugggcaugcac

SEQ ID NO: 2447499 - RNA, 16 nt, Bordetella pertussis
cccagcguccaggcgg

SEQ ID NO: 2447500 - RNA, 19 nt, Bordetella pertussis
cccagcguccaggcggcca

SEQ ID NO: 2447501 - RNA, 24 nt, Bordetella pertussis
cccagcguccaggcggccaucgcc

SEQ ID NO: 2447502 - RNA, 13 nt, Bordetella pertussis
cccagcguggcgg

SEQ ID NO: 2447503 - RNA, 17 nt, Bordetella pertussis
cccagcguguaggcggc

SEQ ID NO: 2447504 - RNA, 20 nt, Bordetella pertussis
cccagcguguaggcggccgg

SEQ ID NO: 2447505 - RNA, 22 nt, Bordetella pertussis
cccagcguguaggcggccggcu

SEQ ID NO: 2447506 - RNA, 17 nt, Bordetella pertussis
cccagcuccagcuggcg

SEQ ID NO: 2447507 - RNA, 17 nt, Bordetella pertussis
cccagcucugguccagg

SEQ ID NO: 2447508 - RNA, 19 nt, Bordetella pertussis
cccagcucugguccaggcg

SEQ ID NO: 2447509 - RNA, 13 nt, Bordetella pertussis
cccagcuggcgcc

SEQ ID NO: 2447510 - RNA, 14 nt, Bordetella pertussis
cccagcuggcgccc

SEQ ID NO: 2447511 - RNA, 17 nt, Bordetella pertussis
cccagcuggcgccccuu

SEQ ID NO: 2447512 - RNA, 18 nt, Bordetella pertussis
cccagcuggcgccccuuc

SEQ ID NO: 2447513 - RNA, 15 nt, Bordetella pertussis
cccagcugggccaca

SEQ ID NO: 2447514 - RNA, 16 nt, Bordetella pertussis
cccagcugggccacag

SEQ ID NO: 2447515 - RNA, 18 nt, Bordetella pertussis
cccagcugggcggcguga

SEQ ID NO: 2447516 - RNA, 20 nt, Bordetella pertussis
cccagcuguccaagcgcgug

SEQ ID NO: 2447517 - RNA, 15 nt, Bordetella pertussis
cccagcuugucggcc

SEQ ID NO: 2447518 - RNA, 20 nt, Bordetella pertussis
cccagcuugucggccgcgcg

SEQ ID NO: 2447519 - RNA, 17 nt, Bordetella pertussis
cccaggaaaccgaccug

SEQ ID NO: 2447520 - RNA, 21 nt, Bordetella pertussis
cccaggaacuugaacggcgcg

SEQ ID NO: 2447521 - RNA, 23 nt, Bordetella pertussis
cccaggaacuugaacggcgcggc

SEQ ID NO: 2447522 - RNA, 14 nt, Bordetella pertussis
cccaggaucaccgc

SEQ ID NO: 2447523 - RNA, 16 nt, Bordetella pertussis
cccaggaucaccgccg

SEQ ID NO: 2447524 - RNA, 21 nt, Bordetella pertussis
cccaggaucaccgccgcgccg

SEQ ID NO: 2447525 - RNA, 20 nt, Bordetella pertussis
cccaggaugcccuuggcggc

SEQ ID NO: 2447526 - RNA, 16 nt, Bordetella pertussis
cccaggaugcgcaccg

SEQ ID NO: 2447527 - RNA, 15 nt, Bordetella pertussis
cccaggauggcgcca

SEQ ID NO: 2447528 - RNA, 17 nt, Bordetella pertussis
cccaggauggcgccagc

SEQ ID NO: 2447529 - RNA, 22 nt, Bordetella pertussis
cccaggauggcgccagcccgcc

SEQ ID NO: 2447530 - RNA, 17 nt, Bordetella pertussis
cccaggcaaugcgcagg

SEQ ID NO: 2447531 - RNA, 15 nt, Bordetella pertussis
cccaggcaggcgggc

SEQ ID NO: 2447532 - RNA, 17 nt, Bordetella pertussis
cccaggccagcgccgcg

SEQ ID NO: 2447533 - RNA, 19 nt, Bordetella pertussis
cccaggccagcgccgcggc

SEQ ID NO: 2447534 - RNA, 21 nt, Bordetella pertussis
cccaggccagcgccgcggccg

SEQ ID NO: 2447535 - RNA, 14 nt, Bordetella pertussis
cccaggccagcugc

SEQ ID NO: 2447536 - RNA, 17 nt, Bordetella pertussis
cccaggcccaccgcauc

SEQ ID NO: 2447537 - RNA, 15 nt, Bordetella pertussis
cccaggcccacgccg

SEQ ID NO: 2447538 - RNA, 18 nt, Bordetella pertussis
cccaggcccagcgcgcca

SEQ ID NO: 2447539 - RNA, 20 nt, Bordetella pertussis
cccaggcccauaugccgccg

SEQ ID NO: 2447540 - RNA, 12 nt, Bordetella pertussis
cccaggcccggc

SEQ ID NO: 2447541 - RNA, 14 nt, Bordetella pertussis
cccaggcccggccg

SEQ ID NO: 2447542 - RNA, 19 nt, Bordetella pertussis
cccaggccgaaccacagca

SEQ ID NO: 2447543 - RNA, 19 nt, Bordetella pertussis
cccaggccgaagccaccgu

SEQ ID NO: 2447544 - RNA, 18 nt, Bordetella pertussis
cccaggccgaucagcgga

SEQ ID NO: 2447545 - RNA, 12 nt, Bordetella pertussis
cccaggccgccg

SEQ ID NO: 2447546 - RNA, 16 nt, Bordetella pertussis
cccaggccgccggcgg

SEQ ID NO: 2447547 - RNA, 23 nt, Bordetella pertussis
cccaggccgcuuucgaccagcga

SEQ ID NO: 2447548 - RNA, 13 nt, Bordetella pertussis
cccaggccggcgc

SEQ ID NO: 2447549 - RNA, 17 nt, Bordetella pertussis
cccaggccggcgccagc

SEQ ID NO: 2447550 - RNA, 19 nt, Bordetella pertussis
cccaggccggcgccagccg

SEQ ID NO: 2447551 - RNA, 14 nt, Bordetella pertussis
cccaggccggcgcg

SEQ ID NO: 2447552 - RNA, 15 nt, Bordetella pertussis
cccaggccggcgcgc

SEQ ID NO: 2447553 - RNA, 16 nt, Bordetella pertussis
cccaggccggcucgcc

SEQ ID NO: 2447554 - RNA, 15 nt, Bordetella pertussis
cccaggccguggcgc

SEQ ID NO: 2447555 - RNA, 19 nt, Bordetella pertussis
cccaggccguggcgcacca

SEQ ID NO: 2447556 - RNA, 14 nt, Bordetella pertussis
cccaggccucggcu

SEQ ID NO: 2447557 - RNA, 16 nt, Bordetella pertussis
cccaggcgacccagca

SEQ ID NO: 2447558 - RNA, 16 nt, Bordetella pertussis
cccaggcgaggcuggc

SEQ ID NO: 2447559 - RNA, 18 nt, Bordetella pertussis
cccaggcgaggcuggcgc

SEQ ID NO: 2447560 - RNA, 22 nt, Bordetella pertussis
cccaggcgaggcuggcgcccac

SEQ ID NO: 2447561 - RNA, 18 nt, Bordetella pertussis
cccaggcgaugcccagcg

SEQ ID NO: 2447562 - RNA, 23 nt, Bordetella pertussis
cccaggcgaugcccagcgccgcc

SEQ ID NO: 2447563 - RNA, 13 nt, Bordetella pertussis
cccaggcgcagcc

SEQ ID NO: 2447564 - RNA, 15 nt, Bordetella pertussis
cccaggcgcagccca

SEQ ID NO: 2447565 - RNA, 17 nt, Bordetella pertussis
cccaggcgcgcuggcgc

SEQ ID NO: 2447566 - RNA, 14 nt, Bordetella pertussis
cccaggcgcucagc

SEQ ID NO: 2447567 - RNA, 20 nt, Bordetella pertussis
cccaggcgcucagccgugcc

SEQ ID NO: 2447568 - RNA, 21 nt, Bordetella pertussis
cccaggcgcucagccgugccg

SEQ ID NO: 2447569 - RNA, 16 nt, Bordetella pertussis
cccaggcggcaggcgc

SEQ ID NO: 2447570 - RNA, 21 nt, Bordetella pertussis
cccaggcggcaggcgccgccg

SEQ ID NO: 2447571 - RNA, 15 nt, Bordetella pertussis
cccaggcggcccagc

SEQ ID NO: 2447572 - RNA, 16 nt, Bordetella pertussis
cccaggcggcccagcg

SEQ ID NO: 2447573 - RNA, 16 nt, Bordetella pertussis
cccaggcgggccaggu

SEQ ID NO: 2447574 - RNA, 16 nt, Bordetella pertussis
cccaggcgggcgugcu

SEQ ID NO: 2447575 - RNA, 17 nt, Bordetella pertussis
cccaggcgggcuggcgu

SEQ ID NO: 2447576 - RNA, 19 nt, Bordetella pertussis
cccaggcguccaggcugcc

SEQ ID NO: 2447577 - RNA, 22 nt, Bordetella pertussis
cccaggcgucggcggcccacag

SEQ ID NO: 2447578 - RNA, 17 nt, Bordetella pertussis
cccaggcgugaacgccc

SEQ ID NO: 2447579 - RNA, 19 nt, Bordetella pertussis
cccaggcgugaacgccccg

SEQ ID NO: 2447580 - RNA, 16 nt, Bordetella pertussis
cccaggcugggccaga

SEQ ID NO: 2447581 - RNA, 18 nt, Bordetella pertussis
cccagggcagcggccaga

SEQ ID NO: 2447582 - RNA, 19 nt, Bordetella pertussis
cccagggcagcggccagau

SEQ ID NO: 2447583 - RNA, 15 nt, Bordetella pertussis
cccagggccgcgccg

SEQ ID NO: 2447584 - RNA, 13 nt, Bordetella pertussis
cccaggggacggc

SEQ ID NO: 2447585 - RNA, 15 nt, Bordetella pertussis
cccaggggccggcgc

SEQ ID NO: 2447586 - RNA, 21 nt, Bordetella pertussis
cccagguacaucauccccagc

SEQ ID NO: 2447587 - RNA, 22 nt, Bordetella pertussis
cccagguacaucauccccagcg

SEQ ID NO: 2447588 - RNA, 18 nt, Bordetella pertussis
cccagguaucggccagca

SEQ ID NO: 2447589 - RNA, 20 nt, Bordetella pertussis
cccaggucaucgccaggcgc

SEQ ID NO: 2447590 - RNA, 22 nt, Bordetella pertussis
cccagguccgaaccgaccgcca

SEQ ID NO: 2447591 - RNA, 12 nt, Bordetella pertussis
cccagguccgcc

SEQ ID NO: 2447592 - RNA, 13 nt, Bordetella pertussis
cccagguccgccg

SEQ ID NO: 2447593 - RNA, 15 nt, Bordetella pertussis
cccaggucgccgccg

SEQ ID NO: 2447594 - RNA, 12 nt, Bordetella pertussis
cccaggugccgg

SEQ ID NO: 2447595 - RNA, 14 nt, Bordetella pertussis
cccaggugccggug

SEQ ID NO: 2447596 - RNA, 16 nt, Bordetella pertussis
cccagguugaaggccg

SEQ ID NO: 2447597 - RNA, 19 nt, Bordetella pertussis
cccagguugaaggccgcga

SEQ ID NO: 2447598 - RNA, 15 nt, Bordetella pertussis
cccagguugcggccg

SEQ ID NO: 2447599 - RNA, 16 nt, Bordetella pertussis
cccagguugcggccgc

SEQ ID NO: 2447600 - RNA, 17 nt, Bordetella pertussis
cccagguugcggccgcc

SEQ ID NO: 2447601 - RNA, 18 nt, Bordetella pertussis
cccagguugcggccgcca

SEQ ID NO: 2447602 - RNA, 16 nt, Bordetella pertussis
cccaguccaggccggc

SEQ ID NO: 2447603 - RNA, 16 nt, Bordetella pertussis
cccaguccggcagcac

SEQ ID NO: 2447604 - RNA, 13 nt, Bordetella pertussis
cccagucgccgcg

SEQ ID NO: 2447605 - RNA, 14 nt, Bordetella pertussis
cccagucgccgcgc

SEQ ID NO: 2447606 - RNA, 17 nt, Bordetella pertussis
cccagucgcugcucgac

SEQ ID NO: 2447607 - RNA, 18 nt, Bordetella pertussis
cccagucguccagcacgc

SEQ ID NO: 2447608 - RNA, 21 nt, Bordetella pertussis
cccagucguccagcacgcggc

SEQ ID NO: 2447609 - RNA, 22 nt, Bordetella pertussis
cccagucguccagcacgcggcg

SEQ ID NO: 2447610 - RNA, 23 nt, Bordetella pertussis
cccagucguccagcacgcggcgc

SEQ ID NO: 2447611 - RNA, 16 nt, Bordetella pertussis
cccaguuccacgcggc

SEQ ID NO: 2447612 - RNA, 23 nt, Bordetella pertussis
cccaguuccacgcggccguggcg

SEQ ID NO: 2447613 - RNA, 17 nt, Bordetella pertussis
cccccgauccccugccc

SEQ ID NO: 2447614 - RNA, 19 nt, Bordetella pertussis
cccccgauccccugcccgc

SEQ ID NO: 2447615 - RNA, 14 nt, Bordetella pertussis
cccccgcgccgcgc

SEQ ID NO: 2447616 - RNA, 18 nt, Bordetella pertussis
cccccgcgcugcgcccgc

SEQ ID NO: 2447617 - RNA, 13 nt, Bordetella pertussis
cccccgcggggac

SEQ ID NO: 2447618 - RNA, 21 nt, Bordetella pertussis
cccccgcgguggggcaguuga

SEQ ID NO: 2447619 - RNA, 16 nt, Bordetella pertussis
cccccgggcgcaagcg

SEQ ID NO: 2447620 - RNA, 19 nt, Bordetella pertussis
cccccguaggcggcccagg

SEQ ID NO: 2447621 - RNA, 21 nt, Bordetella pertussis
cccccguaggcggcccaggcg

SEQ ID NO: 2447622 - RNA, 12 nt, Bordetella pertussis
cccccucggccu

SEQ ID NO: 2447623 - RNA, 16 nt, Bordetella pertussis
cccccugaccggcggc

SEQ ID NO: 2447624 - RNA, 20 nt, Bordetella pertussis
cccccugcggggacaggcac

SEQ ID NO: 2447625 - RNA, 23 nt, Bordetella pertussis
cccccugcggggacaggcacccu

SEQ ID NO: 2447626 - RNA, 21 nt, Bordetella pertussis
ccccgaaacucaccgccgccc

SEQ ID NO: 2447627 - RNA, 16 nt, Bordetella pertussis
ccccgaacggggacug

SEQ ID NO: 2447628 - RNA, 20 nt, Bordetella pertussis
ccccgaacggggacuggcac

SEQ ID NO: 2447629 - RNA, 21 nt, Bordetella pertussis
ccccgaacggggacuggcacc

SEQ ID NO: 2447630 - RNA, 13 nt, Bordetella pertussis
ccccgaagcacag

SEQ ID NO: 2447631 - RNA, 16 nt, Bordetella pertussis
ccccgaaggccgcgcc

SEQ ID NO: 2447632 - RNA, 13 nt, Bordetella pertussis
ccccgaccgagcc

SEQ ID NO: 2447633 - RNA, 14 nt, Bordetella pertussis
ccccgaccgagcca

SEQ ID NO: 2447634 - RNA, 17 nt, Bordetella pertussis
ccccgacgcgcuuccag

SEQ ID NO: 2447635 - RNA, 20 nt, Bordetella pertussis
ccccgagauaggcggccagg

SEQ ID NO: 2447636 - RNA, 21 nt, Bordetella pertussis
ccccgagauaggcggccaggc

SEQ ID NO: 2447637 - RNA, 22 nt, Bordetella pertussis
ccccgagauaggcggccaggcu

SEQ ID NO: 2447638 - RNA, 21 nt, Bordetella pertussis
ccccgaggccaccuuggccaa

SEQ ID NO: 2447639 - RNA, 14 nt, Bordetella pertussis
ccccgagggcgcgg

SEQ ID NO: 2447640 - RNA, 21 nt, Bordetella pertussis
ccccgagggcgcggcgccgcu

SEQ ID NO: 2447641 - RNA, 21 nt, Bordetella pertussis
ccccgagggggcuuuuugccu

SEQ ID NO: 2447642 - RNA, 21 nt, Bordetella pertussis
ccccgaucagcaagggcccca

SEQ ID NO: 2447643 - RNA, 22 nt, Bordetella pertussis
ccccgaucagcaagggccccag

SEQ ID NO: 2447644 - RNA, 13 nt, Bordetella pertussis
ccccgaucggcgc

SEQ ID NO: 2447645 - RNA, 22 nt, Bordetella pertussis
ccccgaucgggagccucuggaa

SEQ ID NO: 2447646 - RNA, 21 nt, Bordetella pertussis
ccccgcaagggggacuggcac

SEQ ID NO: 2447647 - RNA, 17 nt, Bordetella pertussis
ccccgcacggggacagg

SEQ ID NO: 2447648 - RNA, 20 nt, Bordetella pertussis
ccccgcacggggacuggcac

SEQ ID NO: 2447649 - RNA, 15 nt, Bordetella pertussis
ccccgcagggacagg

SEQ ID NO: 2447650 - RNA, 17 nt, Bordetella pertussis
ccccgcagggacaggcu

SEQ ID NO: 2447651 - RNA, 15 nt, Bordetella pertussis
ccccgcagggcccgc

SEQ ID NO: 2447652 - RNA, 14 nt, Bordetella pertussis
ccccgccgggccgc

SEQ ID NO: 2447653 - RNA, 15 nt, Bordetella pertussis
ccccgccugcgccag

SEQ ID NO: 2447654 - RNA, 13 nt, Bordetella pertussis
ccccgcgcggggg

SEQ ID NO: 2447655 - RNA, 18 nt, Bordetella pertussis
ccccgcgcugcgcccgcu

SEQ ID NO: 2447656 - RNA, 22 nt, Bordetella pertussis
ccccgcggaggugucgccgccc

SEQ ID NO: 2447657 - RNA, 23 nt, Bordetella pertussis
ccccgcggaggugucgccgccca

SEQ ID NO: 2447658 - RNA, 13 nt, Bordetella pertussis
ccccgcggggaca

SEQ ID NO: 2447659 - RNA, 15 nt, Bordetella pertussis
ccccgcggggacagg

SEQ ID NO: 2447660 - RNA, 17 nt, Bordetella pertussis
ccccgcggggacaggca

SEQ ID NO: 2447661 - RNA, 23 nt, Bordetella pertussis
ccccgcggggacaggcacccugu

SEQ ID NO: 2447662 - RNA, 14 nt, Bordetella pertussis
ccccgcgguggggc

SEQ ID NO: 2447663 - RNA, 16 nt, Bordetella pertussis
ccccgcgucggacgcg

SEQ ID NO: 2447664 - RNA, 17 nt, Bordetella pertussis
ccccgcgugccuguccc

SEQ ID NO: 2447665 - RNA, 12 nt, Bordetella pertussis
ccccgcuggccg

SEQ ID NO: 2447666 - RNA, 21 nt, Bordetella pertussis
ccccgcuggccgucgccgccc

SEQ ID NO: 2447667 - RNA, 20 nt, Bordetella pertussis
ccccgcugggacaggcacac

SEQ ID NO: 2447668 - RNA, 22 nt, Bordetella pertussis
ccccggcaccaucgccgccugc

SEQ ID NO: 2447669 - RNA, 23 nt, Bordetella pertussis
ccccggcagcgucaauccgccgc

SEQ ID NO: 2447670 - RNA, 17 nt, Bordetella pertussis
ccccggcccgcgccggg

SEQ ID NO: 2447671 - RNA, 13 nt, Bordetella pertussis
ccccggcccggcg

SEQ ID NO: 2447672 - RNA, 16 nt, Bordetella pertussis
ccccggcccggcgggc

SEQ ID NO: 2447673 - RNA, 14 nt, Bordetella pertussis
ccccggcgcgcagc

SEQ ID NO: 2447674 - RNA, 18 nt, Bordetella pertussis
ccccggcgcgcagcgccu

SEQ ID NO: 2447675 - RNA, 23 nt, Bordetella pertussis
ccccggcgcgcagcgccugcagg

SEQ ID NO: 2447676 - RNA, 12 nt, Bordetella pertussis
ccccggcgcgcc

SEQ ID NO: 2447677 - RNA, 16 nt, Bordetella pertussis
ccccggcgcggcgcgc

SEQ ID NO: 2447678 - RNA, 14 nt, Bordetella pertussis
ccccgggcgcaagc

SEQ ID NO: 2447679 - RNA, 22 nt, Bordetella pertussis
ccccgggcgggcacaacccgcc

SEQ ID NO: 2447680 - RNA, 18 nt, Bordetella pertussis
ccccgguagucgccggcu

SEQ ID NO: 2447681 - RNA, 22 nt, Bordetella pertussis
ccccgguagucgccggcuucca

SEQ ID NO: 2447682 - RNA, 12 nt, Bordetella pertussis
ccccggucagca

SEQ ID NO: 2447683 - RNA, 20 nt, Bordetella pertussis
ccccgguguaggcgggcagc

SEQ ID NO: 2447684 - RNA, 13 nt, Bordetella pertussis
ccccguagcgcau

SEQ ID NO: 2447685 - RNA, 16 nt, Bordetella pertussis
ccccgucaucgccgcg

SEQ ID NO: 2447686 - RNA, 13 nt, Bordetella pertussis
ccccgucgaccgc

SEQ ID NO: 2447687 - RNA, 14 nt, Bordetella pertussis
ccccgucggccguc

SEQ ID NO: 2447688 - RNA, 15 nt, Bordetella pertussis
ccccgucggccgucu

SEQ ID NO: 2447689 - RNA, 17 nt, Bordetella pertussis
ccccgucggccgucugg

SEQ ID NO: 2447690 - RNA, 15 nt, Bordetella pertussis
ccccgucgggacagg

SEQ ID NO: 2447691 - RNA, 18 nt, Bordetella pertussis
ccccgugcggggaccggc

SEQ ID NO: 2447692 - RNA, 18 nt, Bordetella pertussis
ccccguggggacaggcac

SEQ ID NO: 2447693 - RNA, 19 nt, Bordetella pertussis
ccccguggggacgagcucc

SEQ ID NO: 2447694 - RNA, 17 nt, Bordetella pertussis
ccccguggucgccagca

SEQ ID NO: 2447695 - RNA, 20 nt, Bordetella pertussis
ccccguucggggacaggcac

SEQ ID NO: 2447696 - RNA, 15 nt, Bordetella pertussis
ccccguugcagccca

SEQ ID NO: 2447697 - RNA, 22 nt, Bordetella pertussis
ccccguugcagcccagcgcgau

SEQ ID NO: 2447698 - RNA, 16 nt, Bordetella pertussis
ccccguugucgccgcg

SEQ ID NO: 2447699 - RNA, 22 nt, Bordetella pertussis
ccccguugucgccgcggccggc

SEQ ID NO: 2447700 - RNA, 23 nt, Bordetella pertussis
ccccguuguugcauucccggacc

SEQ ID NO: 2447701 - RNA, 15 nt, Bordetella pertussis
ccccuagcgccgcgc

SEQ ID NO: 2447702 - RNA, 17 nt, Bordetella pertussis
ccccuccggcgccgccu

SEQ ID NO: 2447703 - RNA, 19 nt, Bordetella pertussis
ccccuccggcgccgccucg

SEQ ID NO: 2447704 - RNA, 13 nt, Bordetella pertussis
ccccucggccugc

SEQ ID NO: 2447705 - RNA, 13 nt, Bordetella pertussis
ccccucggcgggc

SEQ ID NO: 2447706 - RNA, 16 nt, Bordetella pertussis
ccccucuucucguccg

SEQ ID NO: 2447707 - RNA, 14 nt, Bordetella pertussis
ccccugcccgccug

SEQ ID NO: 2447708 - RNA, 15 nt, Bordetella pertussis
ccccugcgggccgcu

SEQ ID NO: 2447709 - RNA, 16 nt, Bordetella pertussis
ccccugcggggacagg

SEQ ID NO: 2447710 - RNA, 19 nt, Bordetella pertussis
ccccugcggggacaggcac

SEQ ID NO: 2447711 - RNA, 14 nt, Bordetella pertussis
ccccuuccacccgc

SEQ ID NO: 2447712 - RNA, 17 nt, Bordetella pertussis
cccgaaacccagaucgc

SEQ ID NO: 2447713 - RNA, 15 nt, Bordetella pertussis
cccgaaacgcgcagc

SEQ ID NO: 2447714 - RNA, 16 nt, Bordetella pertussis
cccgaaacgcgcagca

SEQ ID NO: 2447715 - RNA, 16 nt, Bordetella pertussis
cccgaaacucaccgcc

SEQ ID NO: 2447716 - RNA, 20 nt, Bordetella pertussis
cccgaaacucaccgccgccc

SEQ ID NO: 2447717 - RNA, 22 nt, Bordetella pertussis
cccgaacggcccauccaucugg

SEQ ID NO: 2447718 - RNA, 21 nt, Bordetella pertussis
cccgaagauuuccucgcgcac

SEQ ID NO: 2447719 - RNA, 20 nt, Bordetella pertussis
cccgaagcgcagcaccaggu

SEQ ID NO: 2447720 - RNA, 21 nt, Bordetella pertussis
cccgaagcgcagcaccagguc

SEQ ID NO: 2447721 - RNA, 13 nt, Bordetella pertussis
cccgaaggccgcg

SEQ ID NO: 2447722 - RNA, 18 nt, Bordetella pertussis
cccgaaggcgcggccggg

SEQ ID NO: 2447723 - RNA, 20 nt, Bordetella pertussis
cccgaaggcgcggccgggcu

SEQ ID NO: 2447724 - RNA, 15 nt, Bordetella pertussis
cccgaaggggacugg

SEQ ID NO: 2447725 - RNA, 22 nt, Bordetella pertussis
cccgaaggggacuggcucccgc

SEQ ID NO: 2447726 - RNA, 16 nt, Bordetella pertussis
cccgaagguggcccga

SEQ ID NO: 2447727 - RNA, 21 nt, Bordetella pertussis
cccgaaggugggcgaaccgcg

SEQ ID NO: 2447728 - RNA, 18 nt, Bordetella pertussis
cccgacaccuggacccgc

SEQ ID NO: 2447729 - RNA, 15 nt, Bordetella pertussis
cccgacagcgccccg

SEQ ID NO: 2447730 - RNA, 21 nt, Bordetella pertussis
cccgacccccggcccgcgccg

SEQ ID NO: 2447731 - RNA, 20 nt, Bordetella pertussis
cccgacccuguacaagcgca

SEQ ID NO: 2447732 - RNA, 23 nt, Bordetella pertussis
cccgaccgagccacaccguuccc

SEQ ID NO: 2447733 - RNA, 21 nt, Bordetella pertussis
cccgaccgcaugggcgccgag

SEQ ID NO: 2447734 - RNA, 13 nt, Bordetella pertussis
cccgaccugcugg

SEQ ID NO: 2447735 - RNA, 19 nt, Bordetella pertussis
cccgaccugcuggcgcgca

SEQ ID NO: 2447736 - RNA, 19 nt, Bordetella pertussis
cccgacgaggagccggcgg

SEQ ID NO: 2447737 - RNA, 15 nt, Bordetella pertussis
cccgacgaggccgag

SEQ ID NO: 2447738 - RNA, 16 nt, Bordetella pertussis
cccgacgccgcgcgcg

SEQ ID NO: 2447739 - RNA, 19 nt, Bordetella pertussis
cccgacggccagcgcgacg

SEQ ID NO: 2447740 - RNA, 14 nt, Bordetella pertussis
cccgacggcgcgcc

SEQ ID NO: 2447741 - RNA, 16 nt, Bordetella pertussis
cccgacggcgcgcccg

SEQ ID NO: 2447742 - RNA, 15 nt, Bordetella pertussis
cccgacggggacagg

SEQ ID NO: 2447743 - RNA, 23 nt, Bordetella pertussis
cccgacgguaucucagcgcgccg

SEQ ID NO: 2447744 - RNA, 23 nt, Bordetella pertussis
cccgagaagggcuugaccagggc

SEQ ID NO: 2447745 - RNA, 15 nt, Bordetella pertussis
cccgagaccgcccgc

SEQ ID NO: 2447746 - RNA, 20 nt, Bordetella pertussis
cccgagauaggcggccaggc

SEQ ID NO: 2447747 - RNA, 18 nt, Bordetella pertussis
cccgagauggcgcaggcg

SEQ ID NO: 2447748 - RNA, 22 nt, Bordetella pertussis
cccgagauggcgcaggcgcgcg

SEQ ID NO: 2447749 - RNA, 22 nt, Bordetella pertussis
cccgagcccuggcuuggccgaa

SEQ ID NO: 2447750 - RNA, 12 nt, Bordetella pertussis
cccgagcgcgac

SEQ ID NO: 2447751 - RNA, 19 nt, Bordetella pertussis
cccgagcgcgacagcacca

SEQ ID NO: 2447752 - RNA, 15 nt, Bordetella pertussis
cccgagcgcucccgc

SEQ ID NO: 2447753 - RNA, 17 nt, Bordetella pertussis
cccgagcgcucccgcca

SEQ ID NO: 2447754 - RNA, 21 nt, Bordetella pertussis
cccgagcgggcaugggcccca

SEQ ID NO: 2447755 - RNA, 13 nt, Bordetella pertussis
cccgaggcgcgca

SEQ ID NO: 2447756 - RNA, 17 nt, Bordetella pertussis
cccgaggcgcgcagcac

SEQ ID NO: 2447757 - RNA, 20 nt, Bordetella pertussis
cccgaggcgcgcagcacgcc

SEQ ID NO: 2447758 - RNA, 18 nt, Bordetella pertussis
cccgagggcgcggcgccg

SEQ ID NO: 2447759 - RNA, 15 nt, Bordetella pertussis
cccgagggcgcgucg

SEQ ID NO: 2447760 - RNA, 20 nt, Bordetella pertussis
cccgaguccuugacgccgcc

SEQ ID NO: 2447761 - RNA, 22 nt, Bordetella pertussis
cccgaguccuugacgccgccga

SEQ ID NO: 2447762 - RNA, 19 nt, Bordetella pertussis
cccgauacaaggugccugu

SEQ ID NO: 2447763 - RNA, 19 nt, Bordetella pertussis
cccgauacgacacgccgcg

SEQ ID NO: 2447764 - RNA, 17 nt, Bordetella pertussis
cccgauagccgcgcgcc

SEQ ID NO: 2447765 - RNA, 20 nt, Bordetella pertussis
cccgauaugcagccgcacca

SEQ ID NO: 2447766 - RNA, 22 nt, Bordetella pertussis
cccgauaugcagccgcaccagc

SEQ ID NO: 2447767 - RNA, 17 nt, Bordetella pertussis
cccgauaugccaaggau

SEQ ID NO: 2447768 - RNA, 22 nt, Bordetella pertussis
cccgaucagcaagggccccagc

SEQ ID NO: 2447769 - RNA, 18 nt, Bordetella pertussis
cccgauccccugcccgcc

SEQ ID NO: 2447770 - RNA, 14 nt, Bordetella pertussis
cccgaucgacggcc

SEQ ID NO: 2447771 - RNA, 16 nt, Bordetella pertussis
cccgaucggccggccg

SEQ ID NO: 2447772 - RNA, 14 nt, Bordetella pertussis
cccgaucggcgccg

SEQ ID NO: 2447773 - RNA, 19 nt, Bordetella pertussis
cccgaugccgauacgucgc

SEQ ID NO: 2447774 - RNA, 14 nt, Bordetella pertussis
cccgaugccgccau

SEQ ID NO: 2447775 - RNA, 15 nt, Bordetella pertussis
cccgaugccuuggug

SEQ ID NO: 2447776 - RNA, 17 nt, Bordetella pertussis
cccgaugcgccucggcg

SEQ ID NO: 2447777 - RNA, 18 nt, Bordetella pertussis
cccgaugcucgccggcgc

SEQ ID NO: 2447778 - RNA, 20 nt, Bordetella pertussis
cccgaugcucgccggcgccg

SEQ ID NO: 2447779 - RNA, 23 nt, Bordetella pertussis
cccgaugcucgccggcgccgccc

SEQ ID NO: 2447780 - RNA, 13 nt, Bordetella pertussis
cccgauggcgggg

SEQ ID NO: 2447781 - RNA, 20 nt, Bordetella pertussis
cccgauggucacacugucgc

SEQ ID NO: 2447782 - RNA, 14 nt, Bordetella pertussis
cccgauuucggagc

SEQ ID NO: 2447783 - RNA, 16 nt, Bordetella pertussis
cccgcaaaaccgggcc

SEQ ID NO: 2447784 - RNA, 23 nt, Bordetella pertussis
cccgcaaacuguccguggccaag

SEQ ID NO: 2447785 - RNA, 15 nt, Bordetella pertussis
cccgcaacgccgccc

SEQ ID NO: 2447786 - RNA, 16 nt, Bordetella pertussis
cccgcaacgccgcccg

SEQ ID NO: 2447787 - RNA, 18 nt, Bordetella pertussis
cccgcaacgggccggccg

SEQ ID NO: 2447788 - RNA, 20 nt, Bordetella pertussis
cccgcaagauuucauggcgu

SEQ ID NO: 2447789 - RNA, 14 nt, Bordetella pertussis
cccgcaccgaccag

SEQ ID NO: 2447790 - RNA, 14 nt, Bordetella pertussis
cccgcaccgggcaa

SEQ ID NO: 2447791 - RNA, 14 nt, Bordetella pertussis
cccgcaccgggcgg

SEQ ID NO: 2447792 - RNA, 17 nt, Bordetella pertussis
cccgcaccugaacaccg

SEQ ID NO: 2447793 - RNA, 22 nt, Bordetella pertussis
cccgcaccugaacaccggcgcg

SEQ ID NO: 2447794 - RNA, 14 nt, Bordetella pertussis
cccgcacgccggcc

SEQ ID NO: 2447795 - RNA, 15 nt, Bordetella pertussis
cccgcacgccggccu

SEQ ID NO: 2447796 - RNA, 22 nt, Bordetella pertussis
cccgcacgccggccugcgccag

SEQ ID NO: 2447797 - RNA, 22 nt, Bordetella pertussis
cccgcacgggccgacggccucg

SEQ ID NO: 2447798 - RNA, 22 nt, Bordetella pertussis
cccgcacggggacaggcacgcg

SEQ ID NO: 2447799 - RNA, 23 nt, Bordetella pertussis
cccgcacggggacuggcaccggc

SEQ ID NO: 2447800 - RNA, 15 nt, Bordetella pertussis
cccgcaggagcaugc

SEQ ID NO: 2447801 - RNA, 22 nt, Bordetella pertussis
cccgcaggcauugcgccagccg

SEQ ID NO: 2447802 - RNA, 23 nt, Bordetella pertussis
cccgcaggcauugcgccagccgu

SEQ ID NO: 2447803 - RNA, 13 nt, Bordetella pertussis
cccgcaggcccac

SEQ ID NO: 2447804 - RNA, 14 nt, Bordetella pertussis
cccgcaggcccaca

SEQ ID NO: 2447805 - RNA, 20 nt, Bordetella pertussis
cccgcaggccguuggccgcg

SEQ ID NO: 2447806 - RNA, 21 nt, Bordetella pertussis
cccgcaggcggcggccuccag

SEQ ID NO: 2447807 - RNA, 12 nt, Bordetella pertussis
cccgcagggaca

SEQ ID NO: 2447808 - RNA, 17 nt, Bordetella pertussis
cccgcagggacaggcuc

SEQ ID NO: 2447809 - RNA, 20 nt, Bordetella pertussis
cccgcagggacaggcuccga

SEQ ID NO: 2447810 - RNA, 21 nt, Bordetella pertussis
cccgcaguacccggugcagcg

SEQ ID NO: 2447811 - RNA, 20 nt, Bordetella pertussis
cccgcauagacgccgaccgc

SEQ ID NO: 2447812 - RNA, 13 nt, Bordetella pertussis
cccgcauccuuca

SEQ ID NO: 2447813 - RNA, 13 nt, Bordetella pertussis
cccgcaucgcgcg

SEQ ID NO: 2447814 - RNA, 15 nt, Bordetella pertussis
cccgcaucgcgcgcc

SEQ ID NO: 2447815 - RNA, 13 nt, Bordetella pertussis
cccgcaucggcgu

SEQ ID NO: 2447816 - RNA, 21 nt, Bordetella pertussis
cccgcaucggcguaccaggca

SEQ ID NO: 2447817 - RNA, 19 nt, Bordetella pertussis
cccgcauggaccgccgccg

SEQ ID NO: 2447818 - RNA, 20 nt, Bordetella pertussis
cccgcauggagaccggcgcc

SEQ ID NO: 2447819 - RNA, 18 nt, Bordetella pertussis
cccgcaugucccagcgcu

SEQ ID NO: 2447820 - RNA, 18 nt, Bordetella pertussis
cccgcauugaucgaucag

SEQ ID NO: 2447821 - RNA, 22 nt, Bordetella pertussis
cccgcauugaucgaucagccag

SEQ ID NO: 2447822 - RNA, 21 nt, Bordetella pertussis
cccgccaauugcuugccuguc

SEQ ID NO: 2447823 - RNA, 22 nt, Bordetella pertussis
cccgccacagauuggccaccag

SEQ ID NO: 2447824 - RNA, 14 nt, Bordetella pertussis
cccgccaccacgcg

SEQ ID NO: 2447825 - RNA, 19 nt, Bordetella pertussis
cccgccaccacgcgcacca

SEQ ID NO: 2447826 - RNA, 14 nt, Bordetella pertussis
cccgccaccacggc

SEQ ID NO: 2447827 - RNA, 13 nt, Bordetella pertussis
cccgccacccagg

SEQ ID NO: 2447828 - RNA, 17 nt, Bordetella pertussis
cccgccaccgcccccgc

SEQ ID NO: 2447829 - RNA, 13 nt, Bordetella pertussis
cccgccacgcggg

SEQ ID NO: 2447830 - RNA, 16 nt, Bordetella pertussis
cccgccacgcgggccg

SEQ ID NO: 2447831 - RNA, 22 nt, Bordetella pertussis
cccgccacggcggugcugaacg

SEQ ID NO: 2447832 - RNA, 13 nt, Bordetella pertussis
cccgccacggucg

SEQ ID NO: 2447833 - RNA, 12 nt, Bordetella pertussis
cccgccagcaag

SEQ ID NO: 2447834 - RNA, 16 nt, Bordetella pertussis
cccgccagcaaggcgg

SEQ ID NO: 2447835 - RNA, 13 nt, Bordetella pertussis
cccgccagcgcgg

SEQ ID NO: 2447836 - RNA, 15 nt, Bordetella pertussis
cccgccagcgcggcu

SEQ ID NO: 2447837 - RNA, 18 nt, Bordetella pertussis
cccgccagggcggggccg

SEQ ID NO: 2447838 - RNA, 21 nt, Bordetella pertussis
cccgccagguucgccuggcgg

SEQ ID NO: 2447839 - RNA, 16 nt, Bordetella pertussis
cccgccaucgccagga

SEQ ID NO: 2447840 - RNA, 18 nt, Bordetella pertussis
cccgccaucgccaggacc

SEQ ID NO: 2447841 - RNA, 14 nt, Bordetella pertussis
cccgccaugcgcag

SEQ ID NO: 2447842 - RNA, 14 nt, Bordetella pertussis
cccaguuccagcac

SEQ ID NO: 2447843 - RNA, 15 nt, Bordetella pertussis
cccaguucgcgcagc

SEQ ID NO: 2447844 - RNA, 18 nt, Bordetella pertussis
cccaguucgcgcagcagc

SEQ ID NO: 2447845 - RNA, 17 nt, Bordetella pertussis
cccaguucgcggccggc

SEQ ID NO: 2447846 - RNA, 18 nt, Bordetella pertussis
cccaguucgcggccggcc

SEQ ID NO: 2447847 - RNA, 14 nt, Bordetella pertussis
cccaguucggccgc

SEQ ID NO: 2447848 - RNA, 16 nt, Bordetella pertussis
cccaguucggccgcca

SEQ ID NO: 2447849 - RNA, 17 nt, Bordetella pertussis
cccaguucggccgccag

SEQ ID NO: 2447850 - RNA, 17 nt, Bordetella pertussis
cccaguugaaucggcgc

SEQ ID NO: 2447851 - RNA, 23 nt, Bordetella pertussis
cccaguugacgaugcccaggucg

SEQ ID NO: 2447852 - RNA, 16 nt, Bordetella pertussis
cccaguugcgcgucca

SEQ ID NO: 2447853 - RNA, 17 nt, Bordetella pertussis
cccaguugcgcguccag

SEQ ID NO: 2447854 - RNA, 18 nt, Bordetella pertussis
cccaguugcgcguccagg

SEQ ID NO: 2447855 - RNA, 19 nt, Bordetella pertussis
cccaguugcgcguccaggc

SEQ ID NO: 2447856 - RNA, 18 nt, Bordetella pertussis
cccaguugcuggcccagg

SEQ ID NO: 2447857 - RNA, 13 nt, Bordetella pertussis
cccaguuuuuccu

SEQ ID NO: 2447858 - RNA, 13 nt, Bordetella pertussis
cccauaccagccc

SEQ ID NO: 2447859 - RNA, 14 nt, Bordetella pertussis
cccauaccagcccg

SEQ ID NO: 2447860 - RNA, 22 nt, Bordetella pertussis
cccauaguccucuacuggcuga

SEQ ID NO: 2447861 - RNA, 17 nt, Bordetella pertussis
cccauaugccgccggcc

SEQ ID NO: 2447862 - RNA, 14 nt, Bordetella pertussis
cccauccacggcgc

SEQ ID NO: 2447863 - RNA, 16 nt, Bordetella pertussis
cccauccacggcgcca

SEQ ID NO: 2447864 - RNA, 20 nt, Bordetella pertussis
cccauccagcggacgggcca

SEQ ID NO: 2447865 - RNA, 23 nt, Bordetella pertussis
cccauccagcggacgggccaggc

SEQ ID NO: 2447866 - RNA, 14 nt, Bordetella pertussis
cccaucccauccgc

SEQ ID NO: 2447867 - RNA, 18 nt, Bordetella pertussis
cccaucccauccgcgcca

SEQ ID NO: 2447868 - RNA, 15 nt, Bordetella pertussis
cccauccucaucgug

SEQ ID NO: 2447869 - RNA, 14 nt, Bordetella pertussis
cccaucgcgcugac

SEQ ID NO: 2447870 - RNA, 15 nt, Bordetella pertussis
cccaucgugcgcgau

SEQ ID NO: 2447871 - RNA, 14 nt, Bordetella pertussis
cccaucucggccgc

SEQ ID NO: 2447872 - RNA, 13 nt, Bordetella pertussis
cccaucugccagg

SEQ ID NO: 2447873 - RNA, 21 nt, Bordetella pertussis
cccaucuguacggccggcucc

SEQ ID NO: 2447874 - RNA, 14 nt, Bordetella pertussis
cccaugaaggcggc

SEQ ID NO: 2447875 - RNA, 18 nt, Bordetella pertussis
cccaugaaggcggccagc

SEQ ID NO: 2447876 - RNA, 22 nt, Bordetella pertussis
cccaugaaggcggccagcaugc

SEQ ID NO: 2447877 - RNA, 16 nt, Bordetella pertussis
cccaugacgccggugu

SEQ ID NO: 2447878 - RNA, 18 nt, Bordetella pertussis
cccaugcaguagcgcucg

SEQ ID NO: 2447879 - RNA, 16 nt, Bordetella pertussis
cccaugccgccaugca

SEQ ID NO: 2447880 - RNA, 13 nt, Bordetella pertussis
cccaugccgcccg

SEQ ID NO: 2447881 - RNA, 16 nt, Bordetella pertussis
cccaugccgcccgcca

SEQ ID NO: 2447882 - RNA, 19 nt, Bordetella pertussis
cccaugcgcauggccagca

SEQ ID NO: 2447883 - RNA, 15 nt, Bordetella pertussis
cccaugcgcggcacg

SEQ ID NO: 2447884 - RNA, 19 nt, Bordetella pertussis
cccaugcgcugcgccuugg

SEQ ID NO: 2447885 - RNA, 17 nt, Bordetella pertussis
cccaugcggggacaggc

SEQ ID NO: 2447886 - RNA, 19 nt, Bordetella pertussis
cccaugcggggacaggcac

SEQ ID NO: 2447887 - RNA, 21 nt, Bordetella pertussis
cccaugcugaauugcgggccg

SEQ ID NO: 2447888 - RNA, 23 nt, Bordetella pertussis
cccaugcugaauugcgggccggc

SEQ ID NO: 2447889 - RNA, 17 nt, Bordetella pertussis
cccauggcaagcgcaau

SEQ ID NO: 2447890 - RNA, 12 nt, Bordetella pertussis
cccauggcgcgc

SEQ ID NO: 2447891 - RNA, 23 nt, Bordetella pertussis
cccauggggacuggcaccugcaa

SEQ ID NO: 2447892 - RNA, 18 nt, Bordetella pertussis
cccauguccagguagcgc

SEQ ID NO: 2447893 - RNA, 17 nt, Bordetella pertussis
cccauguggggacaggc

SEQ ID NO: 2447894 - RNA, 16 nt, Bordetella pertussis
cccauguugaacugca

SEQ ID NO: 2447895 - RNA, 16 nt, Bordetella pertussis
cccauucccgcccuga

SEQ ID NO: 2447896 - RNA, 19 nt, Bordetella pertussis
cccauugggacgccagccc

SEQ ID NO: 2447897 - RNA, 12 nt, Bordetella pertussis
ccccaacgcggc

SEQ ID NO: 2447898 - RNA, 14 nt, Bordetella pertussis
ccccaacgcggcca

SEQ ID NO: 2447899 - RNA, 18 nt, Bordetella pertussis
ccccaacgcggccagcgg

SEQ ID NO: 2447900 - RNA, 14 nt, Bordetella pertussis
ccccaacggccuuc

SEQ ID NO: 2447901 - RNA, 14 nt, Bordetella pertussis
ccccacacgcgcgc

SEQ ID NO: 2447902 - RNA, 17 nt, Bordetella pertussis
ccccacagggggacugg

SEQ ID NO: 2447903 - RNA, 20 nt, Bordetella pertussis
ccccacagggggacuggcac

SEQ ID NO: 2447904 - RNA, 21 nt, Bordetella pertussis
ccccaccacgucgcggcuggg

SEQ ID NO: 2447905 - RNA, 15 nt, Bordetella pertussis
ccccacgccgaugcc

SEQ ID NO: 2447906 - RNA, 17 nt, Bordetella pertussis
ccccacgcugcgcccgc

SEQ ID NO: 2447907 - RNA, 16 nt, Bordetella pertussis
ccccacugggggacug

SEQ ID NO: 2447908 - RNA, 21 nt, Bordetella pertussis
ccccacugggggacuggcacc

SEQ ID NO: 2447909 - RNA, 21 nt, Bordetella pertussis
ccccagagcaccgagaccggg

SEQ ID NO: 2447910 - RNA, 16 nt, Bordetella pertussis
ccccagauccgcaagu

SEQ ID NO: 2447911 - RNA, 15 nt, Bordetella pertussis
ccccagaugccgguc

SEQ ID NO: 2447912 - RNA, 12 nt, Bordetella pertussis
ccccagcacgaa

SEQ ID NO: 2447913 - RNA, 13 nt, Bordetella pertussis
ccccagcacgaag

SEQ ID NO: 2447914 - RNA, 13 nt, Bordetella pertussis
ccccagcagcagc

SEQ ID NO: 2447915 - RNA, 11 nt, Bordetella pertussis
ccccagcagcg

SEQ ID NO: 2447916 - RNA, 13 nt, Bordetella pertussis
ccccagcagcgcc

SEQ ID NO: 2447917 - RNA, 14 nt, Bordetella pertussis
ccccagcagcgccg

SEQ ID NO: 2447918 - RNA, 18 nt, Bordetella pertussis
ccccagcaugugcgcggc

SEQ ID NO: 2447919 - RNA, 12 nt, Bordetella pertussis
ccccagcggcgc

SEQ ID NO: 2447920 - RNA, 13 nt, Bordetella pertussis
ccccagcggcgca

SEQ ID NO: 2447921 - RNA, 19 nt, Bordetella pertussis
ccccagcuugucggccgcg

SEQ ID NO: 2447922 - RNA, 22 nt, Bordetella pertussis
ccccagcuugucggccgcgcgc

SEQ ID NO: 2447923 - RNA, 23 nt, Bordetella pertussis
ccccagcuugucggccgcgcgca

SEQ ID NO: 2447924 - RNA, 19 nt, Bordetella pertussis
ccccaggaaaccgaccuga

SEQ ID NO: 2447925 - RNA, 23 nt, Bordetella pertussis
ccccaggaacuugaacggcgcgg

SEQ ID NO: 2447926 - RNA, 13 nt, Bordetella pertussis
ccccaggcaggcg

SEQ ID NO: 2447927 - RNA, 17 nt, Bordetella pertussis
ccccaggcaggcgggcc

SEQ ID NO: 2447928 - RNA, 18 nt, Bordetella pertussis
ccccaggcaggcgggccc

SEQ ID NO: 2447929 - RNA, 21 nt, Bordetella pertussis
ccccaggcgcccgagagcugc

SEQ ID NO: 2447930 - RNA, 14 nt, Bordetella pertussis
ccccaggcguacga

SEQ ID NO: 2447931 - RNA, 14 nt, Bordetella pertussis
ccccagggcgcgcc

SEQ ID NO: 2447932 - RNA, 16 nt, Bordetella pertussis
ccccagggcgcgccgg

SEQ ID NO: 2447933 - RNA, 12 nt, Bordetella pertussis
ccccaggggacg

SEQ ID NO: 2447934 - RNA, 20 nt, Bordetella pertussis
ccccagguccgccggcacgc

SEQ ID NO: 2447935 - RNA, 15 nt, Bordetella pertussis
ccccaguccaggccg

SEQ ID NO: 2447936 - RNA, 18 nt, Bordetella pertussis
ccccaguccaggccggcc

SEQ ID NO: 2447937 - RNA, 14 nt, Bordetella pertussis
ccccaucaccaugg

SEQ ID NO: 2447938 - RNA, 16 nt, Bordetella pertussis
ccccaucaucugcggc

SEQ ID NO: 2447939 - RNA, 13 nt, Bordetella pertussis
ccccauccagcgg

SEQ ID NO: 2447940 - RNA, 12 nt, Bordetella pertussis
ccccaugccgga

SEQ ID NO: 2447941 - RNA, 20 nt, Bordetella pertussis
ccccaugccggaacaggcgc

SEQ ID NO: 2447942 - RNA, 18 nt, Bordetella pertussis
ccccaugcgcgguugggc

SEQ ID NO: 2447943 - RNA, 15 nt, Bordetella pertussis
ccccaugcggggaca

SEQ ID NO: 2447944 - RNA, 19 nt, Bordetella pertussis
ccccaugcggggacaggca

SEQ ID NO: 2447945 - RNA, 21 nt, Bordetella pertussis
ccccaugcggggacaggcacu

SEQ ID NO: 2447946 - RNA, 14 nt, Bordetella pertussis
ccccauggcaugca

SEQ ID NO: 2447947 - RNA, 24 nt, Bordetella pertussis
ccccauguccagguagcgccucgc

SEQ ID NO: 2447948 - RNA, 21 nt, Bordetella pertussis
ccccauguggggacaggcacc

SEQ ID NO: 2447949 - RNA, 21 nt, Bordetella pertussis
ccccauugccucgcggcagug

SEQ ID NO: 2447950 - RNA, 17 nt, Bordetella pertussis
cccccacgcugcgcccg

SEQ ID NO: 2447951 - RNA, 18 nt, Bordetella pertussis
cccccacgcugcgcccgc

SEQ ID NO: 2447952 - RNA, 17 nt, Bordetella pertussis
cccccagcccauagaug

SEQ ID NO: 2447953 - RNA, 13 nt, Bordetella pertussis
cccccagggcgcg

SEQ ID NO: 2447954 - RNA, 14 nt, Bordetella pertussis
cccccagggcgcgc

SEQ ID NO: 2447955 - RNA, 16 nt, Bordetella pertussis
cccccaugcggggaca

SEQ ID NO: 2447956 - RNA, 13 nt, Bordetella pertussis
ccccccggcgcgg

SEQ ID NO: 2447957 - RNA, 18 nt, Bordetella pertussis
cccccgaccgagccacac

SEQ ID NO: 2447958 - RNA, 13 nt, Bordetella pertussis
cccgcccacgcgg

SEQ ID NO: 2447959 - RNA, 15 nt, Bordetella pertussis
cccgcccacgcggcg

SEQ ID NO: 2447960 - RNA, 17 nt, Bordetella pertussis
cccgcccacgcggcgcu

SEQ ID NO: 2447961 - RNA, 12 nt, Bordetella pertussis
cccgcccagcau

SEQ ID NO: 2447962 - RNA, 17 nt, Bordetella pertussis
cccgcccagcgagucga

SEQ ID NO: 2447963 - RNA, 14 nt, Bordetella pertussis
cccgccccggcgca

SEQ ID NO: 2447964 - RNA, 19 nt, Bordetella pertussis
cccgcccgaaccggcaucc

SEQ ID NO: 2447965 - RNA, 23 nt, Bordetella pertussis
cccgcccgacgaggagccggcgg

SEQ ID NO: 2447966 - RNA, 13 nt, Bordetella pertussis
cccgcccgcgccc

SEQ ID NO: 2447967 - RNA, 14 nt, Bordetella pertussis
cccgcccgcgccca

SEQ ID NO: 2447968 - RNA, 20 nt, Bordetella pertussis
cccgcccggguuggcgucca

SEQ ID NO: 2447969 - RNA, 21 nt, Bordetella pertussis
cccgcccggguuggcguccag

SEQ ID NO: 2447970 - RNA, 17 nt, Bordetella pertussis
cccgcccugacgccugc

SEQ ID NO: 2447971 - RNA, 22 nt, Bordetella pertussis
cccgcccugacgccugcgccgg

SEQ ID NO: 2447972 - RNA, 13 nt, Bordetella pertussis
cccgcccugggca

SEQ ID NO: 2447973 - RNA, 15 nt, Bordetella pertussis
cccgccgcaccagcc

SEQ ID NO: 2447974 - RNA, 16 nt, Bordetella pertussis
cccgccgcaccagccu

SEQ ID NO: 2447975 - RNA, 12 nt, Bordetella pertussis
cccgccgcccgg

SEQ ID NO: 2447976 - RNA, 13 nt, Bordetella pertussis
cccgccgcccggc

SEQ ID NO: 2447977 - RNA, 15 nt, Bordetella pertussis
cccgccgcccggccg

SEQ ID NO: 2447978 - RNA, 13 nt, Bordetella pertussis
cccgccgccgccc

SEQ ID NO: 2447979 - RNA, 14 nt, Bordetella pertussis
cccgccgccgccca

SEQ ID NO: 2447980 - RNA, 20 nt, Bordetella pertussis
cccgccgcgaucagcgcggc

SEQ ID NO: 2447981 - RNA, 14 nt, Bordetella pertussis
cccgccgcggcagg

SEQ ID NO: 2447982 - RNA, 14 nt, Bordetella pertussis
cccgccgcugaacg

SEQ ID NO: 2447983 - RNA, 19 nt, Bordetella pertussis
cccgccggcacccggcuca

SEQ ID NO: 2447984 - RNA, 16 nt, Bordetella pertussis
cccgccggcagugccu

SEQ ID NO: 2447985 - RNA, 23 nt, Bordetella pertussis
cccgccggcgcgcgcgcgccgca

SEQ ID NO: 2447986 - RNA, 20 nt, Bordetella pertussis
cccgccgggacacacgcucu

SEQ ID NO: 2447987 - RNA, 12 nt, Bordetella pertussis
cccgccgggccg

SEQ ID NO: 2447988 - RNA, 15 nt, Bordetella pertussis
cccgccgggccgcgc

SEQ ID NO: 2447989 - RNA, 18 nt, Bordetella pertussis
cccgccgggccgcgccca

SEQ ID NO: 2447990 - RNA, 18 nt, Bordetella pertussis
cccgccgggcuccucgcc

SEQ ID NO: 2447991 - RNA, 17 nt, Bordetella pertussis
cccgccguaccgggcgg

SEQ ID NO: 2447992 - RNA, 12 nt, Bordetella pertussis
cccgccgugccg

SEQ ID NO: 2447993 - RNA, 13 nt, Bordetella pertussis
cccgccgugccgg

SEQ ID NO: 2447994 - RNA, 15 nt, Bordetella pertussis
cccgccgugccgggc

SEQ ID NO: 2447995 - RNA, 16 nt, Bordetella pertussis
cccgccgugccgggcc

SEQ ID NO: 2447996 - RNA, 15 nt, Bordetella pertussis
cccgccguggccaag

SEQ ID NO: 2447997 - RNA, 16 nt, Bordetella pertussis
cccgccugcagcagcg

SEQ ID NO: 2447998 - RNA, 20 nt, Bordetella pertussis
cccgccugcgccagccgcgc

SEQ ID NO: 2447999 - RNA, 23 nt, Bordetella pertussis
cccgccugcguggcgggccgcgc

SEQ ID NO: 2448000 - RNA, 22 nt, Bordetella pertussis
cccgcgacccagaacccggccg

SEQ ID NO: 2448001 - RNA, 23 nt, Bordetella pertussis
cccgcgacccagaacccggccgg

SEQ ID NO: 2448002 - RNA, 14 nt, Bordetella pertussis
cccgcgagcggcca

SEQ ID NO: 2448003 - RNA, 15 nt, Bordetella pertussis
cccgcgagcggccag

SEQ ID NO: 2448004 - RNA, 18 nt, Bordetella pertussis
cccgcgaggggcccuugu

SEQ ID NO: 2448005 - RNA, 17 nt, Bordetella pertussis
cccgcgcaccaggcgcg

SEQ ID NO: 2448006 - RNA, 18 nt, Bordetella pertussis
cccgcgcacgcccgcgac

SEQ ID NO: 2448007 - RNA, 12 nt, Bordetella pertussis
cccgcgccacca

SEQ ID NO: 2448008 - RNA, 13 nt, Bordetella pertussis
cccgcgccaccac

SEQ ID NO: 2448009 - RNA, 15 nt, Bordetella pertussis
cccgcgccaccaccg

SEQ ID NO: 2448010 - RNA, 17 nt, Bordetella pertussis
cccgcgccaccaccguc

SEQ ID NO: 2448011 - RNA, 15 nt, Bordetella pertussis
cccgcgccagcgcca

SEQ ID NO: 2448012 - RNA, 18 nt, Bordetella pertussis
cccgcgccaucgcgucga

SEQ ID NO: 2448013 - RNA, 12 nt, Bordetella pertussis
cccgcgcccagc

SEQ ID NO: 2448014 - RNA, 21 nt, Bordetella pertussis
cccgcgcccaguuccacgcgg

SEQ ID NO: 2448015 - RNA, 21 nt, Bordetella pertussis
cccgcgccgaaguugcggccg

SEQ ID NO: 2448016 - RNA, 16 nt, Bordetella pertussis
cccgcgccgcaggccg

SEQ ID NO: 2448017 - RNA, 11 nt, Bordetella pertussis
cccgcgccgcg

SEQ ID NO: 2448018 - RNA, 13 nt, Bordetella pertussis
cccgcgccgcgca

SEQ ID NO: 2448019 - RNA, 14 nt, Bordetella pertussis
cccgcgccgcgcag

SEQ ID NO: 2448020 - RNA, 13 nt, Bordetella pertussis
cccgcgccggcgg

SEQ ID NO: 2448021 - RNA, 14 nt, Bordetella pertussis
cccgcgccgggguu

SEQ ID NO: 2448022 - RNA, 13 nt, Bordetella pertussis
cccgcgccgucga

SEQ ID NO: 2448023 - RNA, 18 nt, Bordetella pertussis
cccgcgcgagcgcaagca

SEQ ID NO: 2448024 - RNA, 16 nt, Bordetella pertussis
cccgcgcgagcucacc

SEQ ID NO: 2448025 - RNA, 13 nt, Bordetella pertussis
cccgcgcgcagcg

SEQ ID NO: 2448026 - RNA, 14 nt, Bordetella pertussis
cccgcgcgcgagca

SEQ ID NO: 2448027 - RNA, 13 nt, Bordetella pertussis
cccgcgcggccag

SEQ ID NO: 2448028 - RNA, 14 nt, Bordetella pertussis
cccgcgcggccagc

SEQ ID NO: 2448029 - RNA, 18 nt, Bordetella pertussis
cccgcgcggccagcgccg

SEQ ID NO: 2448030 - RNA, 17 nt, Bordetella pertussis
cccgcgcuggcgcagca

SEQ ID NO: 2448031 - RNA, 19 nt, Bordetella pertussis
cccgcggaaagcuggcguu

SEQ ID NO: 2448032 - RNA, 21 nt, Bordetella pertussis
cccgcggaggugucgccgccc

SEQ ID NO: 2448033 - RNA, 14 nt, Bordetella pertussis
cccgcggccaccag

SEQ ID NO: 2448034 - RNA, 18 nt, Bordetella pertussis
cccgcggccaccaggcug

SEQ ID NO: 2448035 - RNA, 16 nt, Bordetella pertussis
cccgcggccagccacg

SEQ ID NO: 2448036 - RNA, 20 nt, Bordetella pertussis
cccgcggccagccacgccgg

SEQ ID NO: 2448037 - RNA, 21 nt, Bordetella pertussis
cccgcggccagggugccccgc

SEQ ID NO: 2448038 - RNA, 22 nt, Bordetella pertussis
cccgcggccagggugccccgcc

SEQ ID NO: 2448039 - RNA, 14 nt, Bordetella pertussis
cccgcggccgcggu

SEQ ID NO: 2448040 - RNA, 13 nt, Bordetella pertussis
cccgcggccgcgu

SEQ ID NO: 2448041 - RNA, 14 nt, Bordetella pertussis
cccgcggccgcguc

SEQ ID NO: 2448042 - RNA, 13 nt, Bordetella pertussis
cccgcggcgccca

SEQ ID NO: 2448043 - RNA, 14 nt, Bordetella pertussis
cccgcggcgccccg

SEQ ID NO: 2448044 - RNA, 12 nt, Bordetella pertussis
cccgcgggcgcc

SEQ ID NO: 2448045 - RNA, 15 nt, Bordetella pertussis
cccgcgggcgcccgg

SEQ ID NO: 2448046 - RNA, 18 nt, Bordetella pertussis
cccgcgggcgcccggccg

SEQ ID NO: 2448047 - RNA, 22 nt, Bordetella pertussis
cccgcgggcgcccggccggccu

SEQ ID NO: 2448048 - RNA, 14 nt, Bordetella pertussis
cccgcggggacagg

SEQ ID NO: 2448049 - RNA, 17 nt, Bordetella pertussis
cccgcggggacaggcac

SEQ ID NO: 2448050 - RNA, 20 nt, Bordetella pertussis
cccgcggggacaggcacccc

SEQ ID NO: 2448051 - RNA, 20 nt, Bordetella pertussis
cccgcggggacaggcacccu

SEQ ID NO: 2448052 - RNA, 23 nt, Bordetella pertussis
cccgcggggacaggcaccgccgc

SEQ ID NO: 2448053 - RNA, 19 nt, Bordetella pertussis
cccgcggggacaggcaccu

SEQ ID NO: 2448054 - RNA, 17 nt, Bordetella pertussis
cccgcggggacaggcuc

SEQ ID NO: 2448055 - RNA, 20 nt, Bordetella pertussis
cccgcggggacaggcucccg

SEQ ID NO: 2448056 - RNA, 15 nt, Bordetella pertussis
cccgcggguucgccc

SEQ ID NO: 2448057 - RNA, 17 nt, Bordetella pertussis
cccgcgucagacgcgcu

SEQ ID NO: 2448058 - RNA, 18 nt, Bordetella pertussis
cccgcgucagacgcgcuu

SEQ ID NO: 2448059 - RNA, 14 nt, Bordetella pertussis
cccgcgucggcgcg

SEQ ID NO: 2448060 - RNA, 18 nt, Bordetella pertussis
cccgcgucuuggcgggca

SEQ ID NO: 2448061 - RNA, 18 nt, Bordetella pertussis
cccgcgugacggccgcca

SEQ ID NO: 2448062 - RNA, 19 nt, Bordetella pertussis
cccgcgugacggccgccac

SEQ ID NO: 2448063 - RNA, 23 nt, Bordetella pertussis
cccgcgugacggccgccacgccc

SEQ ID NO: 2448064 - RNA, 13 nt, Bordetella pertussis
cccgcgugccugu

SEQ ID NO: 2448065 - RNA, 16 nt, Bordetella pertussis
cccgcgugccuguccc

SEQ ID NO: 2448066 - RNA, 18 nt, Bordetella pertussis
cccgcgugccuguccccg

SEQ ID NO: 2448067 - RNA, 19 nt, Bordetella pertussis
cccgcguucaggcgcggcu

SEQ ID NO: 2448068 - RNA, 23 nt, Bordetella pertussis
cccgcuacgcgggcuugcugccc

SEQ ID NO: 2448069 - RNA, 14 nt, Bordetella pertussis
cccgcucaggucga

SEQ ID NO: 2448070 - RNA, 20 nt, Bordetella pertussis
cccgcucgaccuugucgccc

SEQ ID NO: 2448071 - RNA, 12 nt, Bordetella pertussis
cccgcucggcca

SEQ ID NO: 2448072 - RNA, 23 nt, Bordetella pertussis
cccgcucggccacgcgcaacgcc

SEQ ID NO: 2448073 - RNA, 14 nt, Bordetella pertussis
cccgcucggccagc

SEQ ID NO: 2448074 - RNA, 15 nt, Bordetella pertussis
cccgcucggccagca

SEQ ID NO: 2448075 - RNA, 13 nt, Bordetella pertussis
cccgcugaccggc

SEQ ID NO: 2448076 - RNA, 14 nt, Bordetella pertussis
cccgcugaccuggu

SEQ ID NO: 2448077 - RNA, 23 nt, Bordetella pertussis
cccgcugacuuccggggagccug

SEQ ID NO: 2448078 - RNA, 20 nt, Bordetella pertussis
cccgcugccgagacggccgc

SEQ ID NO: 2448079 - RNA, 13 nt, Bordetella pertussis
cccgcugcggcaa

SEQ ID NO: 2448080 - RNA, 13 nt, Bordetella pertussis
cccgcuggccgau

SEQ ID NO: 2448081 - RNA, 20 nt, Bordetella pertussis
cccgcuggccgaucugcugg

SEQ ID NO: 2448082 - RNA, 15 nt, Bordetella pertussis
cccgcuggccgucgc

SEQ ID NO: 2448083 - RNA, 17 nt, Bordetella pertussis
cccgcuggccgucgccg

SEQ ID NO: 2448084 - RNA, 15 nt, Bordetella pertussis
cccgcuggcggcaca

SEQ ID NO: 2448085 - RNA, 15 nt, Bordetella pertussis
cccgcugggacaggc

SEQ ID NO: 2448086 - RNA, 19 nt, Bordetella pertussis
cccgcugggacaggcacac

SEQ ID NO: 2448087 - RNA, 12 nt, Bordetella pertussis
cccgcugggcca

SEQ ID NO: 2448088 - RNA, 22 nt, Bordetella pertussis
cccgcugggggcgguaccgucc

SEQ ID NO: 2448089 - RNA, 13 nt, Bordetella pertussis
cccgcuuccugcu

SEQ ID NO: 2448090 - RNA, 23 nt, Bordetella pertussis
cccgcuucgacggcuugcgcaua

SEQ ID NO: 2448091 - RNA, 14 nt, Bordetella pertussis
cccgcuucgggccg

SEQ ID NO: 2448092 - RNA, 19 nt, Bordetella pertussis
cccgcuucucacugcccgc

SEQ ID NO: 2448093 - RNA, 16 nt, Bordetella pertussis
cccgcuugcggccggc

SEQ ID NO: 2448094 - RNA, 19 nt, Bordetella pertussis
cccgcuugcggccggcgcu

SEQ ID NO: 2448095 - RNA, 16 nt, Bordetella pertussis
cccgcuugggccgcgc

SEQ ID NO: 2448096 - RNA, 17 nt, Bordetella pertussis
cccgcuugggccgcgcc

SEQ ID NO: 2448097 - RNA, 18 nt, Bordetella pertussis
cccgcuugggccgcgccu

SEQ ID NO: 2448098 - RNA, 14 nt, Bordetella pertussis
cccgcuuuuuccug

SEQ ID NO: 2448099 - RNA, 14 nt, Bordetella pertussis
cccggacaacgcgc

SEQ ID NO: 2448100 - RNA, 13 nt, Bordetella pertussis
cccggaccgcgcu

SEQ ID NO: 2448101 - RNA, 17 nt, Bordetella pertussis
cccggacgcggccggca

SEQ ID NO: 2448102 - RNA, 16 nt, Bordetella pertussis
cccggauauggccggc

SEQ ID NO: 2448103 - RNA, 17 nt, Bordetella pertussis
cccggauauggccggcg

SEQ ID NO: 2448104 - RNA, 19 nt, Bordetella pertussis
cccggauauggccggcgcg

SEQ ID NO: 2448105 - RNA, 16 nt, Bordetella pertussis
cccggaucauccgggc

SEQ ID NO: 2448106 - RNA, 21 nt, Bordetella pertussis
cccggaugcgauaucccgggc

SEQ ID NO: 2448107 - RNA, 15 nt, Bordetella pertussis
cccggcaacccgccc

SEQ ID NO: 2448108 - RNA, 21 nt, Bordetella pertussis
cccggcaacccgcccacgcgg

SEQ ID NO: 2448109 - RNA, 15 nt, Bordetella pertussis
cccggcaccaucgcc

SEQ ID NO: 2448110 - RNA, 19 nt, Bordetella pertussis
cccggcaccaucgccgccu

SEQ ID NO: 2448111 - RNA, 16 nt, Bordetella pertussis
cccggcaccaugcgca

SEQ ID NO: 2448112 - RNA, 21 nt, Bordetella pertussis
cccggcacggagggugcgcaa

SEQ ID NO: 2448113 - RNA, 15 nt, Bordetella pertussis
cccggcagaacagcg

SEQ ID NO: 2448114 - RNA, 13 nt, Bordetella pertussis
cccggcagccgaa

SEQ ID NO: 2448115 - RNA, 13 nt, Bordetella pertussis
cccggcaggcaca

SEQ ID NO: 2448116 - RNA, 14 nt, Bordetella pertussis
cccggcaggcacac

SEQ ID NO: 2448117 - RNA, 21 nt, Bordetella pertussis
cccggcaugggcgugccgcgc

SEQ ID NO: 2448118 - RNA, 22 nt, Bordetella pertussis
cccggcaugggcgugccgcgcu

SEQ ID NO: 2448119 - RNA, 22 nt, Bordetella pertussis
cccggccaagcuggagaagcgc

SEQ ID NO: 2448120 - RNA, 13 nt, Bordetella pertussis
cccggccaggcgc

SEQ ID NO: 2448121 - RNA, 19 nt, Bordetella pertussis
cccggccgaaaccgccgcg

SEQ ID NO: 2448122 - RNA, 14 nt, Bordetella pertussis
cccggccgaucgcg

SEQ ID NO: 2448123 - RNA, 14 nt, Bordetella pertussis
cccggccgccagca

SEQ ID NO: 2448124 - RNA, 13 nt, Bordetella pertussis
cccggccgccccc

SEQ ID NO: 2448125 - RNA, 17 nt, Bordetella pertussis
cccggccgccgccggca

SEQ ID NO: 2448126 - RNA, 17 nt, Bordetella pertussis
cccggccgccucaccgc

SEQ ID NO: 2448127 - RNA, 15 nt, Bordetella pertussis
cccggccggcacggc

SEQ ID NO: 2448128 - RNA, 20 nt, Bordetella pertussis
cccggccggcacggccggcc

SEQ ID NO: 2448129 - RNA, 22 nt, Bordetella pertussis
cccggccggcacggccggccag

SEQ ID NO: 2448130 - RNA, 15 nt, Bordetella pertussis
cccggccggcccugc

SEQ ID NO: 2448131 - RNA, 12 nt, Bordetella pertussis
cccggccggcgc

SEQ ID NO: 2448132 - RNA, 14 nt, Bordetella pertussis
cccggccggcgccg

SEQ ID NO: 2448133 - RNA, 18 nt, Bordetella pertussis
cccggccggcgccggcaa

SEQ ID NO: 2448134 - RNA, 23 nt, Bordetella pertussis
cccggccucagcggccgcugccg

SEQ ID NO: 2448135 - RNA, 15 nt, Bordetella pertussis
cccggccucgcggcg

SEQ ID NO: 2448136 - RNA, 17 nt, Bordetella pertussis
cccggccucgcugcggg

SEQ ID NO: 2448137 - RNA, 16 nt, Bordetella pertussis
cccggccugcgcgccg

SEQ ID NO: 2448138 - RNA, 21 nt, Bordetella pertussis
cccggccugcgugucaggcgg

SEQ ID NO: 2448139 - RNA, 13 nt, Bordetella pertussis
cccggcgaagccg

SEQ ID NO: 2448140 - RNA, 19 nt, Bordetella pertussis
cccggcgaagccggcacgc

SEQ ID NO: 2448141 - RNA, 20 nt, Bordetella pertussis
cccggcgaagccggcacgcc

SEQ ID NO: 2448142 - RNA, 21 nt, Bordetella pertussis
cccggcgaagccggcacgccu

SEQ ID NO: 2448143 - RNA, 19 nt, Bordetella pertussis
cccggcgacaccgcggccu

SEQ ID NO: 2448144 - RNA, 14 nt, Bordetella pertussis
cccggcgaggccgc

SEQ ID NO: 2448145 - RNA, 18 nt, Bordetella pertussis
cccggcgaggccgcccgc

SEQ ID NO: 2448146 - RNA, 19 nt, Bordetella pertussis
cccggcgaggccgcccgcc

SEQ ID NO: 2448147 - RNA, 22 nt, Bordetella pertussis
cccggcgaggccgcccgccccg

SEQ ID NO: 2448148 - RNA, 20 nt, Bordetella pertussis
cccggcgagguugcaggcca

SEQ ID NO: 2448149 - RNA, 19 nt, Bordetella pertussis
cccggcgaucaugccgccg

SEQ ID NO: 2448150 - RNA, 24 nt, Bordetella pertussis
cccggcgcaucccagacagccacg

SEQ ID NO: 2448151 - RNA, 13 nt, Bordetella pertussis
cccggcgccagcc

SEQ ID NO: 2448152 - RNA, 15 nt, Bordetella pertussis
cccggcgccagccag

SEQ ID NO: 2448153 - RNA, 17 nt, Bordetella pertussis
cccggcgccagccagau

SEQ ID NO: 2448154 - RNA, 14 nt, Bordetella pertussis
cccggcgccgcguu

SEQ ID NO: 2448155 - RNA, 17 nt, Bordetella pertussis
cccggcgcgacaggcgg

SEQ ID NO: 2448156 - RNA, 14 nt, Bordetella pertussis
cccggcgcgcagcg

SEQ ID NO: 2448157 - RNA, 18 nt, Bordetella pertussis
cccggcgcgcagcgccug

SEQ ID NO: 2448158 - RNA, 19 nt, Bordetella pertussis
cccggcgcgcagcgccugc

SEQ ID NO: 2448159 - RNA, 11 nt, Bordetella pertussis
cccggcgcgcc

SEQ ID NO: 2448160 - RNA, 12 nt, Bordetella pertussis
cccggcgcgccg

SEQ ID NO: 2448161 - RNA, 15 nt, Bordetella pertussis
cccggcgcgccggcc

SEQ ID NO: 2448162 - RNA, 19 nt, Bordetella pertussis
cccggcgcgccggccgcca

SEQ ID NO: 2448163 - RNA, 12 nt, Bordetella pertussis
cccggcgcgccu

SEQ ID NO: 2448164 - RNA, 21 nt, Bordetella pertussis
cccggcgcgccuuacgcggcg

SEQ ID NO: 2448165 - RNA, 19 nt, Bordetella pertussis
cccggcgcgccuucggcag

SEQ ID NO: 2448166 - RNA, 17 nt, Bordetella pertussis
cccggcgcggacagaug

SEQ ID NO: 2448167 - RNA, 18 nt, Bordetella pertussis
cccggcgcggccgggggu

SEQ ID NO: 2448168 - RNA, 14 nt, Bordetella pertussis
cccggcgcggcgcg

SEQ ID NO: 2448169 - RNA, 19 nt, Bordetella pertussis
cccggcgcggcgcgcgccg

SEQ ID NO: 2448170 - RNA, 21 nt, Bordetella pertussis
cccggcgcggugaggcggccg

SEQ ID NO: 2448171 - RNA, 15 nt, Bordetella pertussis
cccggcgcuggccgc

SEQ ID NO: 2448172 - RNA, 20 nt, Bordetella pertussis
cccggcggaucacccagcgg

SEQ ID NO: 2448173 - RNA, 23 nt, Bordetella pertussis
cccggcggaucacccagcggcug

SEQ ID NO: 2448174 - RNA, 20 nt, Bordetella pertussis
ccgcccgacgaggagccggc

SEQ ID NO: 2448175 - RNA, 14 nt, Bordetella pertussis
ccgcccgagcuggc

SEQ ID NO: 2448176 - RNA, 18 nt, Bordetella pertussis
ccgcccgcacgaagcggc

SEQ ID NO: 2448177 - RNA, 21 nt, Bordetella pertussis
ccgcccgcacgaagcggcauc

SEQ ID NO: 2448178 - RNA, 14 nt, Bordetella pertussis
ccgcccgcaugucc

SEQ ID NO: 2448179 - RNA, 13 nt, Bordetella pertussis
ccgcccgccccgg

SEQ ID NO: 2448180 - RNA, 14 nt, Bordetella pertussis
ccgcccgccccggc

SEQ ID NO: 2448181 - RNA, 13 nt, Bordetella pertussis
ccgcccgcccugg

SEQ ID NO: 2448182 - RNA, 15 nt, Bordetella pertussis
ccgcccgccgccugc

SEQ ID NO: 2448183 - RNA, 13 nt, Bordetella pertussis
ccgcccgccgggc

SEQ ID NO: 2448184 - RNA, 14 nt, Bordetella pertussis
ccgcccgcgcccag

SEQ ID NO: 2448185 - RNA, 12 nt, Bordetella pertussis
ccgcccgcggcc

SEQ ID NO: 2448186 - RNA, 13 nt, Bordetella pertussis
ccgcccgcggcca

SEQ ID NO: 2448187 - RNA, 16 nt, Bordetella pertussis
ccgcccgcggccagcc

SEQ ID NO: 2448188 - RNA, 19 nt, Bordetella pertussis
ccgcccgcggccagccacg

SEQ ID NO: 2448189 - RNA, 14 nt, Bordetella pertussis
ccgcccgcggcggc

SEQ ID NO: 2448190 - RNA, 17 nt, Bordetella pertussis
ccgcccgcggcggcccg

SEQ ID NO: 2448191 - RNA, 13 nt, Bordetella pertussis
ccgcccgcuccac

SEQ ID NO: 2448192 - RNA, 15 nt, Bordetella pertussis
ccgcccgcuccacca

SEQ ID NO: 2448193 - RNA, 12 nt, Bordetella pertussis
ccgcccggaugg

SEQ ID NO: 2448194 - RNA, 18 nt, Bordetella pertussis
ccgcccggcaacccgccc

SEQ ID NO: 2448195 - RNA, 12 nt, Bordetella pertussis
ccgcccggcagc

SEQ ID NO: 2448196 - RNA, 16 nt, Bordetella pertussis
ccgcccggccggcacg

SEQ ID NO: 2448197 - RNA, 17 nt, Bordetella pertussis
ccgcccggccggcccgc

SEQ ID NO: 2448198 - RNA, 19 nt, Bordetella pertussis
ccgcccggcggcgcgccgc

SEQ ID NO: 2448199 - RNA, 12 nt, Bordetella pertussis
ccgcccggggcc

SEQ ID NO: 2448200 - RNA, 13 nt, Bordetella pertussis
ccgcccggggcca

SEQ ID NO: 2448201 - RNA, 21 nt, Bordetella pertussis
ccgcccggguuggcguccagg

SEQ ID NO: 2448202 - RNA, 16 nt, Bordetella pertussis
ccgcccguccgggcgg

SEQ ID NO: 2448203 - RNA, 17 nt, Bordetella pertussis
ccgcccguccgggcggc

SEQ ID NO: 2448204 - RNA, 14 nt, Bordetella pertussis
ccgcccgugccagu

SEQ ID NO: 2448205 - RNA, 22 nt, Bordetella pertussis
ccgcccgugccaguucacggug

SEQ ID NO: 2448206 - RNA, 16 nt, Bordetella pertussis
ccgcccguugcggcgc

SEQ ID NO: 2448207 - RNA, 12 nt, Bordetella pertussis
ccgcccugcccg

SEQ ID NO: 2448208 - RNA, 14 nt, Bordetella pertussis
ccgcccugcccggc

SEQ ID NO: 2448209 - RNA, 21 nt, Bordetella pertussis
ccgcccugcugcccgccgccg

SEQ ID NO: 2448210 - RNA, 15 nt, Bordetella pertussis
ccgcccuggcgcagg

SEQ ID NO: 2448211 - RNA, 16 nt, Bordetella pertussis
ccgcccuggucaucgc

SEQ ID NO: 2448212 - RNA, 22 nt, Bordetella pertussis
ccgccgaaccagcgcaccacca

SEQ ID NO: 2448213 - RNA, 20 nt, Bordetella pertussis
ccgccgaacggcagcagcgc

SEQ ID NO: 2448214 - RNA, 14 nt, Bordetella pertussis
ccgccgaacggggc

SEQ ID NO: 2448215 - RNA, 19 nt, Bordetella pertussis
ccgccgaacggggccgccu

SEQ ID NO: 2448216 - RNA, 21 nt, Bordetella pertussis
ccgccgaacggggccgccucg

SEQ ID NO: 2448217 - RNA, 13 nt, Bordetella pertussis
ccgccgaagccgc

SEQ ID NO: 2448218 - RNA, 16 nt, Bordetella pertussis
ccgccgaagccgccgc

SEQ ID NO: 2448219 - RNA, 15 nt, Bordetella pertussis
ccgccgacgaugacc

SEQ ID NO: 2448220 - RNA, 14 nt, Bordetella pertussis
ccgccgacgccgcc

SEQ ID NO: 2448221 - RNA, 17 nt, Bordetella pertussis
ccgccgacgccgccacg

SEQ ID NO: 2448222 - RNA, 18 nt, Bordetella pertussis
ccgccgacgccgccacgc

SEQ ID NO: 2448223 - RNA, 14 nt, Bordetella pertussis
ccgccgacggcaug

SEQ ID NO: 2448224 - RNA, 21 nt, Bordetella pertussis
ccgccgacggcauggcggcca

SEQ ID NO: 2448225 - RNA, 18 nt, Bordetella pertussis
ccgccgacguagucgcgc

SEQ ID NO: 2448226 - RNA, 22 nt, Bordetella pertussis
ccgccgagaaauccagcgcgcc

SEQ ID NO: 2448227 - RNA, 24 nt, Bordetella pertussis
ccgccgagaaauccagcgcgccca

SEQ ID NO: 2448228 - RNA, 15 nt, Bordetella pertussis
ccgccgagucggcga

SEQ ID NO: 2448229 - RNA, 23 nt, Bordetella pertussis
ccgccgagucggcgauggcgcgc

SEQ ID NO: 2448230 - RNA, 16 nt, Bordetella pertussis
ccgccgauaccacgcg

SEQ ID NO: 2448231 - RNA, 21 nt, Bordetella pertussis
ccgccgauaccacgcgcggcg

SEQ ID NO: 2448232 - RNA, 16 nt, Bordetella pertussis
ccgccgaugccgccau

SEQ ID NO: 2448233 - RNA, 21 nt, Bordetella pertussis
ccgccgaugccgccaucaucc

SEQ ID NO: 2448234 - RNA, 14 nt, Bordetella pertussis
ccgccgauggcgcc

SEQ ID NO: 2448235 - RNA, 15 nt, Bordetella pertussis
ccgccgauggcgcca

SEQ ID NO: 2448236 - RNA, 15 nt, Bordetella pertussis
ccgccgauggcgcgc

SEQ ID NO: 2448237 - RNA, 17 nt, Bordetella pertussis
ccgccgauggcgcgcgg

SEQ ID NO: 2448238 - RNA, 18 nt, Bordetella pertussis
ccgccgauggcgcgcggc

SEQ ID NO: 2448239 - RNA, 15 nt, Bordetella pertussis
ccgccgaugugcggc

SEQ ID NO: 2448240 - RNA, 15 nt, Bordetella pertussis
ccgccgcagccgcca

SEQ ID NO: 2448241 - RNA, 16 nt, Bordetella pertussis
ccgccgcagccgccag

SEQ ID NO: 2448242 - RNA, 17 nt, Bordetella pertussis
ccgccgcagccgccagc

SEQ ID NO: 2448243 - RNA, 23 nt, Bordetella pertussis
ccgccgcagccgccagcgccugg

SEQ ID NO: 2448244 - RNA, 15 nt, Bordetella pertussis
ccgccgccaccagcg

SEQ ID NO: 2448245 - RNA, 16 nt, Bordetella pertussis
ccgccgccaccagcgg

SEQ ID NO: 2448246 - RNA, 19 nt, Bordetella pertussis
ccgccgccacgcgcacggc

SEQ ID NO: 2448247 - RNA, 12 nt, Bordetella pertussis
ccgccgccagca

SEQ ID NO: 2448248 - RNA, 16 nt, Bordetella pertussis
ccgccgccauggucgc

SEQ ID NO: 2448249 - RNA, 20 nt, Bordetella pertussis
ccgccgccauggucgcgacc

SEQ ID NO: 2448250 - RNA, 15 nt, Bordetella pertussis
ccgccgcccacgccg

SEQ ID NO: 2448251 - RNA, 12 nt, Bordetella pertussis
ccgccgcccgca

SEQ ID NO: 2448252 - RNA, 16 nt, Bordetella pertussis
ccgccgcccgccaggc

SEQ ID NO: 2448253 - RNA, 13 nt, Bordetella pertussis
ccgccgcccgccc

SEQ ID NO: 2448254 - RNA, 15 nt, Bordetella pertussis
ccgccgcccgcccgc

SEQ ID NO: 2448255 - RNA, 18 nt, Bordetella pertussis
ccgccgcccgccucaggc

SEQ ID NO: 2448256 - RNA, 13 nt, Bordetella pertussis
ccgccgcccggca

SEQ ID NO: 2448257 - RNA, 14 nt, Bordetella pertussis
ccgccgcccggcaa

SEQ ID NO: 2448258 - RNA, 20 nt, Bordetella pertussis
ccgccgcccggcaacccgcc

SEQ ID NO: 2448259 - RNA, 14 nt, Bordetella pertussis
ccgccgcccggccg

SEQ ID NO: 2448260 - RNA, 16 nt, Bordetella pertussis
ccgccgcccggccggc

SEQ ID NO: 2448261 - RNA, 14 nt, Bordetella pertussis
ccgccgcccugcca

SEQ ID NO: 2448262 - RNA, 20 nt, Bordetella pertussis
ccgccgcccuggccgcgccg

SEQ ID NO: 2448263 - RNA, 12 nt, Bordetella pertussis
ccgccgccgacg

SEQ ID NO: 2448264 - RNA, 14 nt, Bordetella pertussis
ccgccgccgccacc

SEQ ID NO: 2448265 - RNA, 13 nt, Bordetella pertussis
ccgccgccgcgcc

SEQ ID NO: 2448266 - RNA, 15 nt, Bordetella pertussis
ccgccgccgcgcgcg

SEQ ID NO: 2448267 - RNA, 13 nt, Bordetella pertussis
ccgccgccgcucg

SEQ ID NO: 2448268 - RNA, 15 nt, Bordetella pertussis
ccgccgccggcgaca

SEQ ID NO: 2448269 - RNA, 16 nt, Bordetella pertussis
ccgccgccgggcgcgc

SEQ ID NO: 2448270 - RNA, 22 nt, Bordetella pertussis
ccgccgccgggcgcgcgccggc

SEQ ID NO: 2448271 - RNA, 15 nt, Bordetella pertussis
ccgccgccgggcugg

SEQ ID NO: 2448272 - RNA, 22 nt, Bordetella pertussis
ccgccgccggucaccgccgccg

SEQ ID NO: 2448273 - RNA, 18 nt, Bordetella pertussis
ccgccgccuuggacgcgc

SEQ ID NO: 2448274 - RNA, 20 nt, Bordetella pertussis
ccgccgcgaccaccagcacc

SEQ ID NO: 2448275 - RNA, 16 nt, Bordetella pertussis
ccgccgcgaccgggcc

SEQ ID NO: 2448276 - RNA, 17 nt, Bordetella pertussis
ccgccgcgaccgggccg

SEQ ID NO: 2448277 - RNA, 20 nt, Bordetella pertussis
ccgccgcgaccgggccgaag

SEQ ID NO: 2448278 - RNA, 19 nt, Bordetella pertussis
ccgccgcgauugcaggugg

SEQ ID NO: 2448279 - RNA, 16 nt, Bordetella pertussis
ccgccgcgcaccaccg

SEQ ID NO: 2448280 - RNA, 17 nt, Bordetella pertussis
ccgccgcgcaccaccga

SEQ ID NO: 2448281 - RNA, 13 nt, Bordetella pertussis
ccgccgcgcccag

SEQ ID NO: 2448282 - RNA, 14 nt, Bordetella pertussis
ccgccgcgcccagc

SEQ ID NO: 2448283 - RNA, 15 nt, Bordetella pertussis
ccgccgcgcccuggc

SEQ ID NO: 2448284 - RNA, 12 nt, Bordetella pertussis
ccgccgcgccgc

SEQ ID NO: 2448285 - RNA, 13 nt, Bordetella pertussis
ccgccgcgccgcc

SEQ ID NO: 2448286 - RNA, 14 nt, Bordetella pertussis
ccgccgcgccgccc

SEQ ID NO: 2448287 - RNA, 13 nt, Bordetella pertussis
ccgccgcgccggu

SEQ ID NO: 2448288 - RNA, 15 nt, Bordetella pertussis
ccgccgcgccggugg

SEQ ID NO: 2448289 - RNA, 21 nt, Bordetella pertussis
ccgccgcgccgguggccagca

SEQ ID NO: 2448290 - RNA, 12 nt, Bordetella pertussis
ccgccgcgcgcc

SEQ ID NO: 2448291 - RNA, 14 nt, Bordetella pertussis
ccgccgcgcgccgc

SEQ ID NO: 2448292 - RNA, 15 nt, Bordetella pertussis
ccgccgcgcgccgcg

SEQ ID NO: 2448293 - RNA, 13 nt, Bordetella pertussis
ccgccgcgcgcgg

SEQ ID NO: 2448294 - RNA, 14 nt, Bordetella pertussis
ccgccgcgcgcggc

SEQ ID NO: 2448295 - RNA, 20 nt, Bordetella pertussis
ccgccgcgcggugcucggcg

SEQ ID NO: 2448296 - RNA, 17 nt, Bordetella pertussis
ccgccgcgcucaccgag

SEQ ID NO: 2448297 - RNA, 13 nt, Bordetella pertussis
ccgccgcgcugug

SEQ ID NO: 2448298 - RNA, 14 nt, Bordetella pertussis
ccgccgcggccagc

SEQ ID NO: 2448299 - RNA, 18 nt, Bordetella pertussis
ccgccgcggccagcgccg

SEQ ID NO: 2448300 - RNA, 19 nt, Bordetella pertussis
ccgccgcggccagcgccgc

SEQ ID NO: 2448301 - RNA, 12 nt, Bordetella pertussis
ccgccgcggccu

SEQ ID NO: 2448302 - RNA, 14 nt, Bordetella pertussis
ccgccgcggccucg

SEQ ID NO: 2448303 - RNA, 16 nt, Bordetella pertussis
ccgccgcggccucggc

SEQ ID NO: 2448304 - RNA, 18 nt, Bordetella pertussis
ccgccgcggccucggccg

SEQ ID NO: 2448305 - RNA, 21 nt, Bordetella pertussis
ccgccgcggcgaugccggcca

SEQ ID NO: 2448306 - RNA, 20 nt, Bordetella pertussis
ccgccgcgggauucugcugc

SEQ ID NO: 2448307 - RNA, 13 nt, Bordetella pertussis
ccgccgcgggcgc

SEQ ID NO: 2448308 - RNA, 19 nt, Bordetella pertussis
ccgccgcgggcggccacgc

SEQ ID NO: 2448309 - RNA, 24 nt, Bordetella pertussis
ccgccgcgggcggccacgcgccgc

SEQ ID NO: 2448310 - RNA, 21 nt, Bordetella pertussis
ccgccgcguccucggccuggc

SEQ ID NO: 2448311 - RNA, 15 nt, Bordetella pertussis
ccgccgcgucggcgc

SEQ ID NO: 2448312 - RNA, 18 nt, Bordetella pertussis
ccgccgcgugcgccgggc

SEQ ID NO: 2448313 - RNA, 17 nt, Bordetella pertussis
ccgccgcguggcggcgc

SEQ ID NO: 2448314 - RNA, 22 nt, Bordetella pertussis
ccgccgcguggcggcgcagcgc

SEQ ID NO: 2448315 - RNA, 14 nt, Bordetella pertussis
ccgccgcugccggc

SEQ ID NO: 2448316 - RNA, 16 nt, Bordetella pertussis
ccgccgcugccggccg

SEQ ID NO: 2448317 - RNA, 17 nt, Bordetella pertussis
ccgccgcugccggccga

SEQ ID NO: 2448318 - RNA, 14 nt, Bordetella pertussis
ccgccgcuggucgu

SEQ ID NO: 2448319 - RNA, 14 nt, Bordetella pertussis
ccgccggacgcagg

SEQ ID NO: 2448320 - RNA, 16 nt, Bordetella pertussis
ccgccggacggcgccu

SEQ ID NO: 2448321 - RNA, 14 nt, Bordetella pertussis
ccgccggcaccagc

SEQ ID NO: 2448322 - RNA, 20 nt, Bordetella pertussis
ccgccggcaccagcgccacg

SEQ ID NO: 2448323 - RNA, 13 nt, Bordetella pertussis
ccgccggcacccg

SEQ ID NO: 2448324 - RNA, 16 nt, Bordetella pertussis
ccgccggcacgcgcgg

SEQ ID NO: 2448325 - RNA, 20 nt, Bordetella pertussis
ccgccggcacguaccaggcg

SEQ ID NO: 2448326 - RNA, 20 nt, Bordetella pertussis
ccgccggcagggccagcgcc

SEQ ID NO: 2448327 - RNA, 15 nt, Bordetella pertussis
ccgccggcagugccu

SEQ ID NO: 2448328 - RNA, 15 nt, Bordetella pertussis
ccgccggccagccug

SEQ ID NO: 2448329 - RNA, 13 nt, Bordetella pertussis
ccgccggccagcg

SEQ ID NO: 2448330 - RNA, 15 nt, Bordetella pertussis
ccgccggccagcgcc

SEQ ID NO: 2448331 - RNA, 13 nt, Bordetella pertussis
ccgccggccagcu

SEQ ID NO: 2448332 - RNA, 16 nt, Bordetella pertussis
ccgccggccagggcga

SEQ ID NO: 2448333 - RNA, 12 nt, Bordetella pertussis
ccgccggccauc

SEQ ID NO: 2448334 - RNA, 13 nt, Bordetella pertussis
ccgccggccauca

SEQ ID NO: 2448335 - RNA, 18 nt, Bordetella pertussis
ccgccggccaucacgccg

SEQ ID NO: 2448336 - RNA, 13 nt, Bordetella pertussis
ccgccggcccagg

SEQ ID NO: 2448337 - RNA, 22 nt, Bordetella pertussis
ccgccggccggugcaucggccg

SEQ ID NO: 2448338 - RNA, 17 nt, Bordetella pertussis
ccgccggccugcucgcc

SEQ ID NO: 2448339 - RNA, 14 nt, Bordetella pertussis
ccgccggccugcug

SEQ ID NO: 2448340 - RNA, 15 nt, Bordetella pertussis
ccgccggcgacauag

SEQ ID NO: 2448341 - RNA, 17 nt, Bordetella pertussis
ccgccggcgaugaucgc

SEQ ID NO: 2448342 - RNA, 21 nt, Bordetella pertussis
ccgccggcgaugaucgccucg

SEQ ID NO: 2448343 - RNA, 13 nt, Bordetella pertussis
ccgccggcgcgcg

SEQ ID NO: 2448344 - RNA, 14 nt, Bordetella pertussis
ccgccggcgcgcgc

SEQ ID NO: 2448345 - RNA, 22 nt, Bordetella pertussis
ccgccggcgcgcgcgcgccgca

SEQ ID NO: 2448346 - RNA, 12 nt, Bordetella pertussis
ccgccggcgcgg

SEQ ID NO: 2448347 - RNA, 14 nt, Bordetella pertussis
ccgccggcgcggcu

SEQ ID NO: 2448348 - RNA, 23 nt, Bordetella pertussis
ccgccggcgcgguggccaugcug

SEQ ID NO: 2448349 - RNA, 20 nt, Bordetella pertussis
ccgccggcggcauucagcgc

SEQ ID NO: 2448350 - RNA, 18 nt, Bordetella pertussis
ccgccggcggccuggacc

SEQ ID NO: 2448351 - RNA, 21 nt, Bordetella pertussis
ccgccggcggccuggaccuga

SEQ ID NO: 2448352 - RNA, 23 nt, Bordetella pertussis
ccgccggcggccuggaccugagc

SEQ ID NO: 2448353 - RNA, 13 nt, Bordetella pertussis
ccgccggcggcgc

SEQ ID NO: 2448354 - RNA, 16 nt, Bordetella pertussis
ccgccggcggcgcacc

SEQ ID NO: 2448355 - RNA, 14 nt, Bordetella pertussis
ccgccggcggcguc

SEQ ID NO: 2448356 - RNA, 17 nt, Bordetella pertussis
ccgccggcggcgugccc

SEQ ID NO: 2448357 - RNA, 18 nt, Bordetella pertussis
ccgccggcgucgcucagg

SEQ ID NO: 2448358 - RNA, 11 nt, Bordetella pertussis
ccgccggcgug

SEQ ID NO: 2448359 - RNA, 12 nt, Bordetella pertussis
ccgccggcgugc

SEQ ID NO: 2448360 - RNA, 14 nt, Bordetella pertussis
ccgccggcgugccc

SEQ ID NO: 2448361 - RNA, 17 nt, Bordetella pertussis
ccgccgggacacacgcu

SEQ ID NO: 2448362 - RNA, 12 nt, Bordetella pertussis
ccgccgggacag

SEQ ID NO: 2448363 - RNA, 13 nt, Bordetella pertussis
ccgccgggacagg

SEQ ID NO: 2448364 - RNA, 17 nt, Bordetella pertussis
ccgccgggacaggcacc

SEQ ID NO: 2448365 - RNA, 20 nt, Bordetella pertussis
ccgccgggacaggcaccccg

SEQ ID NO: 2448366 - RNA, 21 nt, Bordetella pertussis
ccgccgggacaggcacccgcg

SEQ ID NO: 2448367 - RNA, 22 nt, Bordetella pertussis
ccgccgggacaggcacccgcgc

SEQ ID NO: 2448368 - RNA, 15 nt, Bordetella pertussis
ccgccgggcaugcac

SEQ ID NO: 2448369 - RNA, 19 nt, Bordetella pertussis
ccgccgggccgcgaccacg

SEQ ID NO: 2448370 - RNA, 14 nt, Bordetella pertussis
ccgccgggccgcgc

SEQ ID NO: 2448371 - RNA, 15 nt, Bordetella pertussis
ccgccgggccgcgcc

SEQ ID NO: 2448372 - RNA, 18 nt, Bordetella pertussis
ccgccgggccgcgcccac

SEQ ID NO: 2448373 - RNA, 13 nt, Bordetella pertussis
ccgccgggccguc

SEQ ID NO: 2448374 - RNA, 13 nt, Bordetella pertussis
ccgccgggccugc

SEQ ID NO: 2448375 - RNA, 16 nt, Bordetella pertussis
ccgccgggccugcccg

SEQ ID NO: 2448376 - RNA, 14 nt, Bordetella pertussis
ccgccgggcgcgcg

SEQ ID NO: 2448377 - RNA, 16 nt, Bordetella pertussis
ccgccgggcgcgcgcc

SEQ ID NO: 2448378 - RNA, 19 nt, Bordetella pertussis
ccgccgggcgcgcgccggc

SEQ ID NO: 2448379 - RNA, 16 nt, Bordetella pertussis
ccgccgggcggcgccg

SEQ ID NO: 2448380 - RNA, 18 nt, Bordetella pertussis
ccgccgggcuccucgccc

SEQ ID NO: 2448381 - RNA, 19 nt, Bordetella pertussis
ccgccgggcuccucgcccg

SEQ ID NO: 2448382 - RNA, 21 nt, Bordetella pertussis
ccgccgggcuccucgcccgac

SEQ ID NO: 2448383 - RNA, 22 nt, Bordetella pertussis
ccgccgggcuccucgcccgacc

SEQ ID NO: 2448384 - RNA, 15 nt, Bordetella pertussis
ccgccgggcuggauc

SEQ ID NO: 2448385 - RNA, 20 nt, Bordetella pertussis
ccgccgggcuggauccggcg

SEQ ID NO: 2448386 - RNA, 14 nt, Bordetella pertussis
ccgccgggucgccg

SEQ ID NO: 2448387 - RNA, 17 nt, Bordetella pertussis
ccgccggucaccgccgc

SEQ ID NO: 2448388 - RNA, 20 nt, Bordetella pertussis
ccgccggugcaccaggccac

SEQ ID NO: 2448389 - RNA, 17 nt, Bordetella pertussis
ccgccggugucggggcc

SEQ ID NO: 2448390 - RNA, 18 nt, Bordetella pertussis
ccgccggugucggggccg

SEQ ID NO: 2448391 - RNA, 15 nt, Bordetella pertussis
ccgccgguucggucg

SEQ ID NO: 2448392 - RNA, 20 nt, Bordetella pertussis
ccgccgguucggucgacgac

SEQ ID NO: 2448393 - RNA, 15 nt, Bordetella pertussis
ccgccguagccgcug

SEQ ID NO: 2448394 - RNA, 17 nt, Bordetella pertussis
ccgccguagccgcugcg

SEQ ID NO: 2448395 - RNA, 23 nt, Bordetella pertussis
ccgccguagccgcugcgcgcggc

SEQ ID NO: 2448396 - RNA, 18 nt, Bordetella pertussis
ccgccguagcgcgccagc

SEQ ID NO: 2448397 - RNA, 21 nt, Bordetella pertussis
ccgccguagcgcgccagccgc

SEQ ID NO: 2448398 - RNA, 16 nt, Bordetella pertussis
ccgccguaggacagcc

SEQ ID NO: 2448399 - RNA, 17 nt, Bordetella pertussis
ccgccgucaacgcccag

SEQ ID NO: 2448400 - RNA, 14 nt, Bordetella pertussis
ccgccgugacgcug

SEQ ID NO: 2448401 - RNA, 18 nt, Bordetella pertussis
ccgccgugacuucggccg

SEQ ID NO: 2448402 - RNA, 21 nt, Bordetella pertussis
ccgccgugacuucggccgcca

SEQ ID NO: 2448403 - RNA, 18 nt, Bordetella pertussis
ccgccgugaugccgcccg

SEQ ID NO: 2448404 - RNA, 19 nt, Bordetella pertussis
ccgccgugaugccgcccgc

SEQ ID NO: 2448405 - RNA, 15 nt, Bordetella pertussis
ccgccgugcaggccc

SEQ ID NO: 2448406 - RNA, 16 nt, Bordetella pertussis
ccgccgugcaggcccg

SEQ ID NO: 2448407 - RNA, 21 nt, Bordetella pertussis
ccgccgugcaggcccgggcgc

SEQ ID NO: 2448408 - RNA, 15 nt, Bordetella pertussis
ccgccgugccgggcc

SEQ ID NO: 2448409 - RNA, 14 nt, Bordetella pertussis
ccgccgugcgcggg

SEQ ID NO: 2448410 - RNA, 20 nt, Bordetella pertussis
ccgccgugcgcgggcgcggc

SEQ ID NO: 2448411 - RNA, 15 nt, Bordetella pertussis
ccgccguggcauaga

SEQ ID NO: 2448412 - RNA, 17 nt, Bordetella pertussis
ccgccguggccaagggc

SEQ ID NO: 2448413 - RNA, 19 nt, Bordetella pertussis
ccgccguggccaagggcgc

SEQ ID NO: 2448414 - RNA, 21 nt, Bordetella pertussis
ccgccguggccaagggcgccg

SEQ ID NO: 2448415 - RNA, 22 nt, Bordetella pertussis
ccgccguggcguugacggccca

SEQ ID NO: 2448416 - RNA, 22 nt, Bordetella pertussis
ccgccguguaggcggucuugac

SEQ ID NO: 2448417 - RNA, 21 nt, Bordetella pertussis
ccgccguugcucgcgcgcagu

SEQ ID NO: 2448418 - RNA, 17 nt, Bordetella pertussis
ccgccuaccaggugggc

SEQ ID NO: 2448419 - RNA, 21 nt, Bordetella pertussis
ccgccuaccaggugggcgcgc

SEQ ID NO: 2448420 - RNA, 16 nt, Bordetella pertussis
ccgccuacuggcgcgc

SEQ ID NO: 2448421 - RNA, 19 nt, Bordetella pertussis
ccgccuauguaggcgccgc

SEQ ID NO: 2448422 - RNA, 20 nt, Bordetella pertussis
ccgccuauguaggcgccgcg

SEQ ID NO: 2448423 - RNA, 22 nt, Bordetella pertussis
ccgccuauguaggcgccgcgcc

SEQ ID NO: 2448424 - RNA, 24 nt, Bordetella pertussis
ccgccuauguaggcgccgcgcccg

SEQ ID NO: 2448425 - RNA, 23 nt, Bordetella pertussis
ccgccucaaccuucucgaugcgc

SEQ ID NO: 2448426 - RNA, 13 nt, Bordetella pertussis
ccgccucagcccg

SEQ ID NO: 2448427 - RNA, 14 nt, Bordetella pertussis
ccgccucagcccgc

SEQ ID NO: 2448428 - RNA, 21 nt, Bordetella pertussis
ccgccucagcguuuccagggc

SEQ ID NO: 2448429 - RNA, 21 nt, Bordetella pertussis
ccgccucaggccggcgccugg

SEQ ID NO: 2448430 - RNA, 23 nt, Bordetella pertussis
ccgccuccaggaugagcgccugc

SEQ ID NO: 2448431 - RNA, 14 nt, Bordetella pertussis
ccgccuccaggcgg

SEQ ID NO: 2448432 - RNA, 14 nt, Bordetella pertussis
ccgccucgacgaug

SEQ ID NO: 2448433 - RNA, 24 nt, Bordetella pertussis
ccgccucgacgaugcccugcgcca

SEQ ID NO: 2448434 - RNA, 14 nt, Bordetella pertussis
ccgccucgacgccc

SEQ ID NO: 2448435 - RNA, 15 nt, Bordetella pertussis
ccgccucgacgcccg

SEQ ID NO: 2448436 - RNA, 17 nt, Bordetella pertussis
ccgccucgacgcccggg

SEQ ID NO: 2448437 - RNA, 18 nt, Bordetella pertussis
ccgccucgaucgccaggu

SEQ ID NO: 2448438 - RNA, 20 nt, Bordetella pertussis
ccgccucgaucgccaggucg

SEQ ID NO: 2448439 - RNA, 18 nt, Bordetella pertussis
ccgccucgcgcuccagca

SEQ ID NO: 2448440 - RNA, 12 nt, Bordetella pertussis
ccgccucggcgg

SEQ ID NO: 2448441 - RNA, 15 nt, Bordetella pertussis
ccgccucggcggcca

SEQ ID NO: 2448442 - RNA, 20 nt, Bordetella pertussis
ccgccucgggcacggccagc

SEQ ID NO: 2448443 - RNA, 15 nt, Bordetella pertussis
ccgccugagcacaug

SEQ ID NO: 2448444 - RNA, 23 nt, Bordetella pertussis
ccgccugagcacaugcccggcca

SEQ ID NO: 2448445 - RNA, 15 nt, Bordetella pertussis
ccgccugcagcagcg

SEQ ID NO: 2448446 - RNA, 13 nt, Bordetella pertussis
ccgccugccaguu

SEQ ID NO: 2448447 - RNA, 15 nt, Bordetella pertussis
ccgccugccggccug

SEQ ID NO: 2448448 - RNA, 17 nt, Bordetella pertussis
ccgccugccggccuggc

SEQ ID NO: 2448449 - RNA, 19 nt, Bordetella pertussis
ccgccugcgccagccgcgc

SEQ ID NO: 2448450 - RNA, 23 nt, Bordetella pertussis
ccgccugcgccaggugggccagg

SEQ ID NO: 2448451 - RNA, 20 nt, Bordetella pertussis
ccgccugcgccgaggcgggc

SEQ ID NO: 2448452 - RNA, 23 nt, Bordetella pertussis
ccgccugcgccgucugcgccgcc

SEQ ID NO: 2448453 - RNA, 22 nt, Bordetella pertussis
ccgccugcgcgaaacccccugg

SEQ ID NO: 2448454 - RNA, 10 nt, Bordetella pertussis
ccgccugcgg

SEQ ID NO: 2448455 - RNA, 16 nt, Bordetella pertussis
ccgccugcggacggcg

SEQ ID NO: 2448456 - RNA, 18 nt, Bordetella pertussis
ccgccugcggcgcggccg

SEQ ID NO: 2448457 - RNA, 17 nt, Bordetella pertussis
ccgccugcgggaacugc

SEQ ID NO: 2448458 - RNA, 22 nt, Bordetella pertussis
ccgccugcguggcgggccgcgc

SEQ ID NO: 2448459 - RNA, 23 nt, Bordetella pertussis
ccgccugcguggcgggccgcgcc

SEQ ID NO: 2448460 - RNA, 15 nt, Bordetella pertussis
ccgccugcugcaugu

SEQ ID NO: 2448461 - RNA, 15 nt, Bordetella pertussis
ccgccugcugggccg

SEQ ID NO: 2448462 - RNA, 18 nt, Bordetella pertussis
ccgccugcugggccgcgc

SEQ ID NO: 2448463 - RNA, 19 nt, Bordetella pertussis
ccgccugcugggccgcgcu

SEQ ID NO: 2448464 - RNA, 13 nt, Bordetella pertussis
ccgccuggccuuc

SEQ ID NO: 2448465 - RNA, 14 nt, Bordetella pertussis
ccgccuggcgccgc

SEQ ID NO: 2448466 - RNA, 19 nt, Bordetella pertussis
ccgccuggcgccgcgcccg

SEQ ID NO: 2448467 - RNA, 16 nt, Bordetella pertussis
ccgccuggcgcggcgc

SEQ ID NO: 2448468 - RNA, 17 nt, Bordetella pertussis
ccgccuggcgcggcgcc

SEQ ID NO: 2448469 - RNA, 20 nt, Bordetella pertussis
ccgccuggcgcggcgccugc

SEQ ID NO: 2448470 - RNA, 19 nt, Bordetella pertussis
ccgccuggcuuacaggccc

SEQ ID NO: 2448471 - RNA, 20 nt, Bordetella pertussis
ccgccuggcuuacaggccca

SEQ ID NO: 2448472 - RNA, 22 nt, Bordetella pertussis
ccgccuggcuuacaggcccagu

SEQ ID NO: 2448473 - RNA, 22 nt, Bordetella pertussis
ccgccuggcuuucgccgcgggc

SEQ ID NO: 2448474 - RNA, 23 nt, Bordetella pertussis
ccgccugguaguaaucgcgcgcc

SEQ ID NO: 2448475 - RNA, 19 nt, Bordetella pertussis
ccgccuggucgcuggcgcc

SEQ ID NO: 2448476 - RNA, 15 nt, Bordetella pertussis
ccgccuucccaggcg

SEQ ID NO: 2448477 - RNA, 15 nt, Bordetella pertussis
ccgccuucgcugacg

SEQ ID NO: 2448478 - RNA, 22 nt, Bordetella pertussis
ccgccuucgucgcgcacccgca

SEQ ID NO: 2448479 - RNA, 20 nt, Bordetella pertussis
ccgccuugccuugcgcggcc

SEQ ID NO: 2448480 - RNA, 22 nt, Bordetella pertussis
ccgccuuugccgcuggacgcgc

SEQ ID NO: 2448481 - RNA, 16 nt, Bordetella pertussis
ccgcgaaccggugcug

SEQ ID NO: 2448482 - RNA, 17 nt, Bordetella pertussis
ccgcgaaccggugcugg

SEQ ID NO: 2448483 - RNA, 13 nt, Bordetella pertussis
ccgcgaagcagcc

SEQ ID NO: 2448484 - RNA, 14 nt, Bordetella pertussis
ccgcgaagcagccg

SEQ ID NO: 2448485 - RNA, 17 nt, Bordetella pertussis
ccgcgaagcagccggcc

SEQ ID NO: 2448486 - RNA, 13 nt, Bordetella pertussis
ccgcgaagccgcc

SEQ ID NO: 2448487 - RNA, 15 nt, Bordetella pertussis
ccgcgaagccgcccg

SEQ ID NO: 2448488 - RNA, 15 nt, Bordetella pertussis
ccgcgaagcgcgcca

SEQ ID NO: 2448489 - RNA, 18 nt, Bordetella pertussis
ccgcgaagcgcgccagca

SEQ ID NO: 2448490 - RNA, 17 nt, Bordetella pertussis
ccgcgaagugccugucc

SEQ ID NO: 2448491 - RNA, 15 nt, Bordetella pertussis
ccgcgaaucaugcgg

SEQ ID NO: 2448492 - RNA, 23 nt, Bordetella pertussis
ccgcgacaaauagccgaccgcgc

SEQ ID NO: 2448493 - RNA, 14 nt, Bordetella pertussis
ccgcgacacaaggc

SEQ ID NO: 2448494 - RNA, 20 nt, Bordetella pertussis
ccgcgacacaaggcggccgc

SEQ ID NO: 2448495 - RNA, 22 nt, Bordetella pertussis
ccgcgaccacggucuggcgcga

SEQ ID NO: 2448496 - RNA, 15 nt, Bordetella pertussis
ccgcgaccaugcggc

SEQ ID NO: 2448497 - RNA, 19 nt, Bordetella pertussis
ccgcgaccaugcggccguc

SEQ ID NO: 2448498 - RNA, 23 nt, Bordetella pertussis
ccgcgaccaugcggccgucgccg

SEQ ID NO: 2448499 - RNA, 14 nt, Bordetella pertussis
ccgcgacccagaac

SEQ ID NO: 2448500 - RNA, 19 nt, Bordetella pertussis
ccgcgacccgauagccgcg

SEQ ID NO: 2448501 - RNA, 20 nt, Bordetella pertussis
ccgcgacgcauauccaggcg

SEQ ID NO: 2448502 - RNA, 22 nt, Bordetella pertussis
ccgcgacgcauauccaggcggc

SEQ ID NO: 2448503 - RNA, 23 nt, Bordetella pertussis
ccgcgacgcauauccaggcggcg

SEQ ID NO: 2448504 - RNA, 19 nt, Bordetella pertussis
ccgcgacgcccuggccuuc

SEQ ID NO: 2448505 - RNA, 15 nt, Bordetella pertussis
ccgcgacgcuacagc

SEQ ID NO: 2448506 - RNA, 12 nt, Bordetella pertussis
ccgcgacgcugu

SEQ ID NO: 2448507 - RNA, 17 nt, Bordetella pertussis
ccgcgcccagcagcgcc

SEQ ID NO: 2448508 - RNA, 16 nt, Bordetella pertussis
ccgcgcccagccgcgc

SEQ ID NO: 2448509 - RNA, 16 nt, Bordetella pertussis
ccgcgcccagcgcggc

SEQ ID NO: 2448510 - RNA, 13 nt, Bordetella pertussis
ccgcgcccagcgu

SEQ ID NO: 2448511 - RNA, 17 nt, Bordetella pertussis
ccgcgcccagcgugugg

SEQ ID NO: 2448512 - RNA, 16 nt, Bordetella pertussis
ccgcgcccagcugucc

SEQ ID NO: 2448513 - RNA, 22 nt, Bordetella pertussis
ccgcgcccagcuugaugccgcc

SEQ ID NO: 2448514 - RNA, 14 nt, Bordetella pertussis
ccgcgcccaggucc

SEQ ID NO: 2448515 - RNA, 23 nt, Bordetella pertussis
ccgcgcccagguccugcgccagc

SEQ ID NO: 2448516 - RNA, 22 nt, Bordetella pertussis
ccgcgcccaguuccacgcggcc

SEQ ID NO: 2448517 - RNA, 14 nt, Bordetella pertussis
ccgcgcccaugcgc

SEQ ID NO: 2448518 - RNA, 12 nt, Bordetella pertussis
ccgcgcccauuu

SEQ ID NO: 2448519 - RNA, 22 nt, Bordetella pertussis
ccgcgccccaucaccauggccg

SEQ ID NO: 2448520 - RNA, 16 nt, Bordetella pertussis
ccgcgccccuagcgcc

SEQ ID NO: 2448521 - RNA, 18 nt, Bordetella pertussis
ccgcgccccuagcgccgc

SEQ ID NO: 2448522 - RNA, 20 nt, Bordetella pertussis
ccgcgccccuagcgccgcgc

SEQ ID NO: 2448523 - RNA, 21 nt, Bordetella pertussis
ccgcgccccuagcgccgcgcc

SEQ ID NO: 2448524 - RNA, 13 nt, Bordetella pertussis
ccgcgcccgcccc

SEQ ID NO: 2448525 - RNA, 15 nt, Bordetella pertussis
ccgcgcccgccgcgc

SEQ ID NO: 2448526 - RNA, 19 nt, Bordetella pertussis
ccgcgcccgccuucagcgg

SEQ ID NO: 2448527 - RNA, 22 nt, Bordetella pertussis
ccgcgcccgccuucagcgggcc

SEQ ID NO: 2448528 - RNA, 23 nt, Bordetella pertussis
ccgcgcccgccuucagcgggccg

SEQ ID NO: 2448529 - RNA, 19 nt, Bordetella pertussis
ccgcgcccgcuugcggccg

SEQ ID NO: 2448530 - RNA, 23 nt, Bordetella pertussis
ccgcgcccgcuugcggccggcgc

SEQ ID NO: 2448531 - RNA, 17 nt, Bordetella pertussis
ccgcgcccggccggccc

SEQ ID NO: 2448532 - RNA, 20 nt, Bordetella pertussis
ccgcgcccggcggccaggcc

SEQ ID NO: 2448533 - RNA, 18 nt, Bordetella pertussis
ccgcggcgugcugcccgc

SEQ ID NO: 2448534 - RNA, 18 nt, Bordetella pertussis
ccgcggcguugcggcagc

SEQ ID NO: 2448535 - RNA, 17 nt, Bordetella pertussis
ccgcggcuugccgcggc

SEQ ID NO: 2448536 - RNA, 18 nt, Bordetella pertussis
ccgcgggcaaagcccagc

SEQ ID NO: 2448537 - RNA, 19 nt, Bordetella pertussis
ccgcgggcaaagcccagca

SEQ ID NO: 2448538 - RNA, 20 nt, Bordetella pertussis
ccgcgggcaaagcccagcaa

SEQ ID NO: 2448539 - RNA, 23 nt, Bordetella pertussis
ccgcgggcagcaauucgaccggc

SEQ ID NO: 2448540 - RNA, 13 nt, Bordetella pertussis
ccgcgggcauccu

SEQ ID NO: 2448541 - RNA, 17 nt, Bordetella pertussis
ccgcgggccgcuggucg

SEQ ID NO: 2448542 - RNA, 14 nt, Bordetella pertussis
ccgcgggcgcccgg

SEQ ID NO: 2448543 - RNA, 15 nt, Bordetella pertussis
ccgcgggcgcccggc

SEQ ID NO: 2448544 - RNA, 16 nt, Bordetella pertussis
ccgcgggcgcccggcc

SEQ ID NO: 2448545 - RNA, 14 nt, Bordetella pertussis
ccgcgggcgccgcg

SEQ ID NO: 2448546 - RNA, 14 nt, Bordetella pertussis
ccgcgggcgcgcgc

SEQ ID NO: 2448547 - RNA, 20 nt, Bordetella pertussis
ccgcgggcggccacgcgccg

SEQ ID NO: 2448548 - RNA, 21 nt, Bordetella pertussis
ccgcgggcggccacgcgccgc

SEQ ID NO: 2448549 - RNA, 13 nt, Bordetella pertussis
ccgcgggcggcgc

SEQ ID NO: 2448550 - RNA, 17 nt, Bordetella pertussis
ccgcgggcggcgccggc

SEQ ID NO: 2448551 - RNA, 19 nt, Bordetella pertussis
ccgcgggcggcgccggccg

SEQ ID NO: 2448552 - RNA, 22 nt, Bordetella pertussis
ccgcgggcggcgccggccgccc

SEQ ID NO: 2448553 - RNA, 15 nt, Bordetella pertussis
ccgcgggcggcgcgc

SEQ ID NO: 2448554 - RNA, 16 nt, Bordetella pertussis
ccgcgggcggcgcgcc

SEQ ID NO: 2448555 - RNA, 20 nt, Bordetella pertussis
ccgcgggcggcgcgcccagc

SEQ ID NO: 2448556 - RNA, 14 nt, Bordetella pertussis
ccgcgggcgugcug

SEQ ID NO: 2448557 - RNA, 23 nt, Bordetella pertussis
ccgcgggcugcgacaggcgcagc

SEQ ID NO: 2448558 - RNA, 12 nt, Bordetella pertussis
ccgcggggacag

SEQ ID NO: 2448559 - RNA, 23 nt, Bordetella pertussis
ccgcggggacaggcaccccagca

SEQ ID NO: 2448560 - RNA, 18 nt, Bordetella pertussis
ccgcggggacaggcaccg

SEQ ID NO: 2448561 - RNA, 18 nt, Bordetella pertussis
ccgcggggacaggcaccu

SEQ ID NO: 2448562 - RNA, 20 nt, Bordetella pertussis
ccgcggggcuggccagcugg

SEQ ID NO: 2448563 - RNA, 21 nt, Bordetella pertussis
ccgcggggcuggccagcuggc

SEQ ID NO: 2448564 - RNA, 18 nt, Bordetella pertussis
ccgcggguauucgaaggc

SEQ ID NO: 2448565 - RNA, 15 nt, Bordetella pertussis
ccgcggguggccgcu

SEQ ID NO: 2448566 - RNA, 17 nt, Bordetella pertussis
ccgcggguggccgcucc

SEQ ID NO: 2448567 - RNA, 16 nt, Bordetella pertussis
ccgcggguucggcggu

SEQ ID NO: 2448568 - RNA, 19 nt, Bordetella pertussis
ccgcggucgagacgauggc

SEQ ID NO: 2448569 - RNA, 14 nt, Bordetella pertussis
ccgcggugccgcgc

SEQ ID NO: 2448570 - RNA, 17 nt, Bordetella pertussis
ccgcggugccgcgcgcg

SEQ ID NO: 2448571 - RNA, 15 nt, Bordetella pertussis
ccgcggugcugggcu

SEQ ID NO: 2448572 - RNA, 17 nt, Bordetella pertussis
ccgcgguggcgggcgug

SEQ ID NO: 2448573 - RNA, 20 nt, Bordetella pertussis
ccgcgguggcgggcgugcgg

SEQ ID NO: 2448574 - RNA, 15 nt, Bordetella pertussis
ccgcguacaacgccg

SEQ ID NO: 2448575 - RNA, 17 nt, Bordetella pertussis
ccgcguacaacgccgcg

SEQ ID NO: 2448576 - RNA, 14 nt, Bordetella pertussis
ccgcguaggccuuc

SEQ ID NO: 2448577 - RNA, 17 nt, Bordetella pertussis
ccgcguaggcggucagc

SEQ ID NO: 2448578 - RNA, 17 nt, Bordetella pertussis
ccgcguaguugucggcg

SEQ ID NO: 2448579 - RNA, 22 nt, Bordetella pertussis
ccgcgucacgauuucggccaug

SEQ ID NO: 2448580 - RNA, 14 nt, Bordetella pertussis
ccgcgucagacgcg

SEQ ID NO: 2448581 - RNA, 21 nt, Bordetella pertussis
ccgcgucauacacggcgcggg

SEQ ID NO: 2448582 - RNA, 16 nt, Bordetella pertussis
ccgcguccagcgcgcg

SEQ ID NO: 2448583 - RNA, 13 nt, Bordetella pertussis
ccgcguccgcccg

SEQ ID NO: 2448584 - RNA, 14 nt, Bordetella pertussis
ccgcguccggcgcc

SEQ ID NO: 2448585 - RNA, 17 nt, Bordetella pertussis
ccgcguccucggccugg

SEQ ID NO: 2448586 - RNA, 18 nt, Bordetella pertussis
ccgcgucgauccggcagc

SEQ ID NO: 2448587 - RNA, 14 nt, Bordetella pertussis
ccgcgucgccgccg

SEQ ID NO: 2448588 - RNA, 21 nt, Bordetella pertussis
ccgcgucgcuggccggacgca

SEQ ID NO: 2448589 - RNA, 17 nt, Bordetella pertussis
ccgcgucgcugucggcg

SEQ ID NO: 2448590 - RNA, 14 nt, Bordetella pertussis
ccgcgucggacgcg

SEQ ID NO: 2448591 - RNA, 15 nt, Bordetella pertussis
ccgcgucggacgcgc

SEQ ID NO: 2448592 - RNA, 17 nt, Bordetella pertussis
ccgcgucggacgcgcgc

SEQ ID NO: 2448593 - RNA, 18 nt, Bordetella pertussis
ccgcgucggacgcgcgcc

SEQ ID NO: 2448594 - RNA, 19 nt, Bordetella pertussis
ccgcgucggacgcgcgccg

SEQ ID NO: 2448595 - RNA, 14 nt, Bordetella pertussis
ccgcgucggccgcg

SEQ ID NO: 2448596 - RNA, 12 nt, Bordetella pertussis
ccgcgucggccu

SEQ ID NO: 2448597 - RNA, 22 nt, Bordetella pertussis
ccgcgucggccucaucgagcgc

SEQ ID NO: 2448598 - RNA, 14 nt, Bordetella pertussis
ccgcgucggccugc

SEQ ID NO: 2448599 - RNA, 15 nt, Bordetella pertussis
ccgcgucggccugcc

SEQ ID NO: 2448600 - RNA, 16 nt, Bordetella pertussis
ccgcgucggccugcca

SEQ ID NO: 2448601 - RNA, 11 nt, Bordetella pertussis
ccgcgucggcg

SEQ ID NO: 2448602 - RNA, 12 nt, Bordetella pertussis
ccgcgucggcga

SEQ ID NO: 2448603 - RNA, 13 nt, Bordetella pertussis
ccgcgucggcgcc

SEQ ID NO: 2448604 - RNA, 23 nt, Bordetella pertussis
ccgcgucggcgccgaucagcagg

SEQ ID NO: 2448605 - RNA, 17 nt, Bordetella pertussis
ccgcgucgguggccagc

SEQ ID NO: 2448606 - RNA, 21 nt, Bordetella pertussis
ccgcgucgguggccagccagg

SEQ ID NO: 2448607 - RNA, 16 nt, Bordetella pertussis
ccgcgucguucaucgc

SEQ ID NO: 2448608 - RNA, 14 nt, Bordetella pertussis
ccgcgucuucggcg

SEQ ID NO: 2448609 - RNA, 15 nt, Bordetella pertussis
ccgcgucuucggcgc

SEQ ID NO: 2448610 - RNA, 18 nt, Bordetella pertussis
ccgcgucuucggcgcggc

SEQ ID NO: 2448611 - RNA, 19 nt, Bordetella pertussis
ccgcgucuuggcgggcacc

SEQ ID NO: 2448612 - RNA, 20 nt, Bordetella pertussis
ccgcgugacggccgccacgc

SEQ ID NO: 2448613 - RNA, 16 nt, Bordetella pertussis
ccgcguggaaggucca

SEQ ID NO: 2448614 - RNA, 15 nt, Bordetella pertussis
ccgcguggccgcgcu

SEQ ID NO: 2448615 - RNA, 16 nt, Bordetella pertussis
ccgcguggccgcgcug

SEQ ID NO: 2448616 - RNA, 17 nt, Bordetella pertussis
ccgcguggccgcgcugc

SEQ ID NO: 2448617 - RNA, 18 nt, Bordetella pertussis
ccgcgugggcaugguggc

SEQ ID NO: 2448618 - RNA, 14 nt, Bordetella pertussis
ccgcgugguggcgc

SEQ ID NO: 2448619 - RNA, 22 nt, Bordetella pertussis
ccgcgugguggcgcagaugggc

SEQ ID NO: 2448620 - RNA, 14 nt, Bordetella pertussis
ccgcguucacgccg

SEQ ID NO: 2448621 - RNA, 18 nt, Bordetella pertussis
ccgcguucacgccggcgc

SEQ ID NO: 2448622 - RNA, 16 nt, Bordetella pertussis
ccgcguucaggcgcgg

SEQ ID NO: 2448623 - RNA, 20 nt, Bordetella pertussis
ccgcguugaaguccggaucc

SEQ ID NO: 2448624 - RNA, 17 nt, Bordetella pertussis
ccgcguugaccggcugg

SEQ ID NO: 2448625 - RNA, 14 nt, Bordetella pertussis
ccgcguugagcgcc

SEQ ID NO: 2448626 - RNA, 19 nt, Bordetella pertussis
ccgcguugagcgccgacgg

SEQ ID NO: 2448627 - RNA, 14 nt, Bordetella pertussis
ccgcuaccaggcgc

SEQ ID NO: 2448628 - RNA, 15 nt, Bordetella pertussis
ccgcuaccaggcgcg

SEQ ID NO: 2448629 - RNA, 19 nt, Bordetella pertussis
ccgcuaccaggcgcgcgcg

SEQ ID NO: 2448630 - RNA, 23 nt, Bordetella pertussis
ccgcuaccaggcgcgcgcgcgga

SEQ ID NO: 2448631 - RNA, 21 nt, Bordetella pertussis
ccgcuacgggcgcugcacgca

SEQ ID NO: 2448632 - RNA, 22 nt, Bordetella pertussis
ccgcuacgggcgcugcacgcag

SEQ ID NO: 2448633 - RNA, 19 nt, Bordetella pertussis
ccgcuaggccuugccgccg

SEQ ID NO: 2448634 - RNA, 20 nt, Bordetella pertussis
ccgcuaggccuugccgccgc

SEQ ID NO: 2448635 - RNA, 21 nt, Bordetella pertussis
ccgcuaggccuugccgccgcc

SEQ ID NO: 2448636 - RNA, 22 nt, Bordetella pertussis
ccgcuaggccuugccgccgccg

SEQ ID NO: 2448637 - RNA, 20 nt, Bordetella pertussis
ccgcuaucauccgcgcauga

SEQ ID NO: 2448638 - RNA, 14 nt, Bordetella pertussis
ccgcuaugacgacc

SEQ ID NO: 2448639 - RNA, 18 nt, Bordetella pertussis
ccgcuaugcgggcuugcu

SEQ ID NO: 2448640 - RNA, 20 nt, Bordetella pertussis
ccgcuaugcgggcuugcugc

SEQ ID NO: 2448641 - RNA, 19 nt, Bordetella pertussis
ccgcucaauucggccugac

SEQ ID NO: 2448642 - RNA, 23 nt, Bordetella pertussis
ccgcucaauucggccugacgggc

SEQ ID NO: 2448643 - RNA, 22 nt, Bordetella pertussis
ccgcucagcuuguagcccucgg

SEQ ID NO: 2448644 - RNA, 13 nt, Bordetella pertussis
ccgcucaggucga

SEQ ID NO: 2448645 - RNA, 16 nt, Bordetella pertussis
ccgcucaggucgaaca

SEQ ID NO: 2448646 - RNA, 20 nt, Bordetella pertussis
ccgcucaguucuucgacggg

SEQ ID NO: 2448647 - RNA, 19 nt, Bordetella pertussis
ccgcucaugccggcaagca

SEQ ID NO: 2448648 - RNA, 19 nt, Bordetella pertussis
ccgcucgacgucgcccugg

SEQ ID NO: 2448649 - RNA, 16 nt, Bordetella pertussis
ccgcucgaggccaggc

SEQ ID NO: 2448650 - RNA, 12 nt, Bordetella pertussis
ccgcucgcgcga

SEQ ID NO: 2448651 - RNA, 16 nt, Bordetella pertussis
ccgcucggccagcagu

SEQ ID NO: 2448652 - RNA, 19 nt, Bordetella pertussis
ccgcucguaguguuccugg

SEQ ID NO: 2448653 - RNA, 14 nt, Bordetella pertussis
ccgcucguaucgcc

SEQ ID NO: 2448654 - RNA, 18 nt, Bordetella pertussis
ccgcucguaucgcccuga

SEQ ID NO: 2448655 - RNA, 14 nt, Bordetella pertussis
ccgcucuuggcgug

SEQ ID NO: 2448656 - RNA, 17 nt, Bordetella pertussis
ccgcugaaggaccucgc

SEQ ID NO: 2448657 - RNA, 20 nt, Bordetella pertussis
ccgcugaaggaccucgcgcc

SEQ ID NO: 2448658 - RNA, 21 nt, Bordetella pertussis
ccgcugaaggaccucgcgccg

SEQ ID NO: 2448659 - RNA, 12 nt, Bordetella pertussis
ccgcugaccggc

SEQ ID NO: 2448660 - RNA, 14 nt, Bordetella pertussis
ccgcugaccggccu

SEQ ID NO: 2448661 - RNA, 17 nt, Bordetella pertussis
ccgcugaccggcggcac

SEQ ID NO: 2448662 - RNA, 19 nt, Bordetella pertussis
ccgcugaccggcggcacgg

SEQ ID NO: 2448663 - RNA, 22 nt, Bordetella pertussis
ccgcugaccuggugugccuguc

SEQ ID NO: 2448664 - RNA, 16 nt, Bordetella pertussis
ccgcugaucuuccugg

SEQ ID NO: 2448665 - RNA, 14 nt, Bordetella pertussis
ccgcugauggcggu

SEQ ID NO: 2448666 - RNA, 15 nt, Bordetella pertussis
ccgcugcagcacgca

SEQ ID NO: 2448667 - RNA, 20 nt, Bordetella pertussis
ccgcugcagcacgcaccagg

SEQ ID NO: 2448668 - RNA, 21 nt, Bordetella pertussis
ccgcugcagcacgcaccaggc

SEQ ID NO: 2448669 - RNA, 12 nt, Bordetella pertussis
ccgcugcauggg

SEQ ID NO: 2448670 - RNA, 15 nt, Bordetella pertussis
ccgcugcccaccuuc

SEQ ID NO: 2448671 - RNA, 18 nt, Bordetella pertussis
ccgcugcccagcgucagc

SEQ ID NO: 2448672 - RNA, 19 nt, Bordetella pertussis
ccgcugccgagacggccgc

SEQ ID NO: 2448673 - RNA, 20 nt, Bordetella pertussis
ccgcugccgagacggccgcc

SEQ ID NO: 2448674 - RNA, 13 nt, Bordetella pertussis
ccgcugccgcgcg

SEQ ID NO: 2448675 - RNA, 18 nt, Bordetella pertussis
ccgcugccgggcucggcc

SEQ ID NO: 2448676 - RNA, 17 nt, Bordetella pertussis
ccgcugcgacccuuuca

SEQ ID NO: 2448677 - RNA, 16 nt, Bordetella pertussis
ccgcugcgcagcagcg

SEQ ID NO: 2448678 - RNA, 15 nt, Bordetella pertussis
ccgcugcgccgaggc

SEQ ID NO: 2448679 - RNA, 14 nt, Bordetella pertussis
ccgcugcgcgcggc

SEQ ID NO: 2448680 - RNA, 22 nt, Bordetella pertussis
ccgcugcgcuggccgcgaugca

SEQ ID NO: 2448681 - RNA, 23 nt, Bordetella pertussis
ccgcugcggcaagggugccuguc

SEQ ID NO: 2448682 - RNA, 18 nt, Bordetella pertussis
ccgcugcgggaggugccg

SEQ ID NO: 2448683 - RNA, 21 nt, Bordetella pertussis
ccgcugcgggaggugccgcag

SEQ ID NO: 2448684 - RNA, 19 nt, Bordetella pertussis
ccgcugcguccaccaccag

SEQ ID NO: 2448685 - RNA, 22 nt, Bordetella pertussis
ccgcugcguccaccaccaggcc

SEQ ID NO: 2448686 - RNA, 23 nt, Bordetella pertussis
ccgcugcguccaccaccaggccg

SEQ ID NO: 2448687 - RNA, 19 nt, Bordetella pertussis
ccgcuggacgcgccgaaca

SEQ ID NO: 2448688 - RNA, 17 nt, Bordetella pertussis
ccgcuggccagccgcuc

SEQ ID NO: 2448689 - RNA, 14 nt, Bordetella pertussis
ccgcuggccaugcc

SEQ ID NO: 2448690 - RNA, 18 nt, Bordetella pertussis
ccgcuggccaugccgucg

SEQ ID NO: 2448691 - RNA, 21 nt, Bordetella pertussis
ccgcuggccgaucugcugggc

SEQ ID NO: 2448692 - RNA, 13 nt, Bordetella pertussis
ccgcuggccgucg

SEQ ID NO: 2448693 - RNA, 14 nt, Bordetella pertussis
ccgcuggccgucgc

SEQ ID NO: 2448694 - RNA, 17 nt, Bordetella pertussis
ccgcuggccgucgccgc

SEQ ID NO: 2448695 - RNA, 22 nt, Bordetella pertussis
ccgcuggcgaucacggccaacc

SEQ ID NO: 2448696 - RNA, 16 nt, Bordetella pertussis
ccgcuggcgaucaggc

SEQ ID NO: 2448697 - RNA, 18 nt, Bordetella pertussis
ccgcuggcgaucaggccg

SEQ ID NO: 2448698 - RNA, 20 nt, Bordetella pertussis
ccgcuggcgaucaggccgcc

SEQ ID NO: 2448699 - RNA, 15 nt, Bordetella pertussis
ccgcuggcgcgccgc

SEQ ID NO: 2448700 - RNA, 17 nt, Bordetella pertussis
ccgcuggcgcgccgccu

SEQ ID NO: 2448701 - RNA, 20 nt, Bordetella pertussis
ccgcuggcgcgccgccucgc

SEQ ID NO: 2448702 - RNA, 18 nt, Bordetella pertussis
ccgcuggcggcccugccg

SEQ ID NO: 2448703 - RNA, 17 nt, Bordetella pertussis
ccgcuggcguccagguu

SEQ ID NO: 2448704 - RNA, 15 nt, Bordetella pertussis
ccgcuggcgucgcgc

SEQ ID NO: 2448705 - RNA, 19 nt, Bordetella pertussis
ccgcuggcuggcagcgacc

SEQ ID NO: 2448706 - RNA, 16 nt, Bordetella pertussis
ccgcugggacaggcac

SEQ ID NO: 2448707 - RNA, 17 nt, Bordetella pertussis
ccgcugggacaggcaca

SEQ ID NO: 2448708 - RNA, 17 nt, Bordetella pertussis
ccgcugggacaggcacu

SEQ ID NO: 2448709 - RNA, 18 nt, Bordetella pertussis
ccgcugggacaggcacuc

SEQ ID NO: 2448710 - RNA, 13 nt, Bordetella pertussis
ccgcugggccagc

SEQ ID NO: 2448711 - RNA, 19 nt, Bordetella pertussis
ccgcugggccagcaucggc

SEQ ID NO: 2448712 - RNA, 17 nt, Bordetella pertussis
ccgcuggucaccgcccc

SEQ ID NO: 2448713 - RNA, 21 nt, Bordetella pertussis
ccgcuggucaccgccccgacc

SEQ ID NO: 2448714 - RNA, 23 nt, Bordetella pertussis
ccgcuggucgugaugaacgagga

SEQ ID NO: 2448715 - RNA, 19 nt, Bordetella pertussis
ccgcuggugaucugcugcg

SEQ ID NO: 2448716 - RNA, 16 nt, Bordetella pertussis
ccgcuggugcugagac

SEQ ID NO: 2448717 - RNA, 23 nt, Bordetella pertussis
ccgcuguagaaguaguucggcgc

SEQ ID NO: 2448718 - RNA, 16 nt, Bordetella pertussis
ccgcugucgcaggcgc

SEQ ID NO: 2448719 - RNA, 21 nt, Bordetella pertussis
ccgcugucgcaggcgcugcag

SEQ ID NO: 2448720 - RNA, 22 nt, Bordetella pertussis
ccgcugucgcaggcgcugcagc

SEQ ID NO: 2448721 - RNA, 23 nt, Bordetella pertussis
ccgcugucgcaggcgcugcagca

SEQ ID NO: 2448722 - RNA, 21 nt, Bordetella pertussis
ccgcugucgcugaucugcuug

SEQ ID NO: 2448723 - RNA, 19 nt, Bordetella pertussis
ccgcuguggacgccgccgg

SEQ ID NO: 2448724 - RNA, 15 nt, Bordetella pertussis
ccgcuguggcgcgcc

SEQ ID NO: 2448725 - RNA, 18 nt, Bordetella pertussis
ccgcuuauuuccucagcc

SEQ ID NO: 2448726 - RNA, 21 nt, Bordetella pertussis
ccgcuuauuuccucagccugg

SEQ ID NO: 2448727 - RNA, 14 nt, Bordetella pertussis
ccgcuucacgcugu

SEQ ID NO: 2448728 - RNA, 23 nt, Bordetella pertussis
ccgcuucaggaacauguccacca

SEQ ID NO: 2448729 - RNA, 22 nt, Bordetella pertussis
ccgcuuccgccaccgcgccgcc

SEQ ID NO: 2448730 - RNA, 23 nt, Bordetella pertussis
ccgcuuccgccaccgcgccgccc

SEQ ID NO: 2448731 - RNA, 13 nt, Bordetella pertussis
ccgcuuccggcau

SEQ ID NO: 2448732 - RNA, 18 nt, Bordetella pertussis
ccgcuuccggccggaacu

SEQ ID NO: 2448733 - RNA, 15 nt, Bordetella pertussis
ccgcuuccggccggg

SEQ ID NO: 2448734 - RNA, 17 nt, Bordetella pertussis
ccgcuuccggccgggcc

SEQ ID NO: 2448735 - RNA, 21 nt, Bordetella pertussis
ccgcuuccggccgggccagua

SEQ ID NO: 2448736 - RNA, 15 nt, Bordetella pertussis
ccgcuuccugcugcg

SEQ ID NO: 2448737 - RNA, 21 nt, Bordetella pertussis
ccgcuucgacggcuugcgcau

SEQ ID NO: 2448738 - RNA, 19 nt, Bordetella pertussis
ccgcuucgaugcuggcggc

SEQ ID NO: 2448739 - RNA, 14 nt, Bordetella pertussis
ccgcuucggacagc

SEQ ID NO: 2448740 - RNA, 18 nt, Bordetella pertussis
ccgcuucggacagcaguu

SEQ ID NO: 2448741 - RNA, 12 nt, Bordetella pertussis
ccgcuucggccu

SEQ ID NO: 2448742 - RNA, 20 nt, Bordetella pertussis
ccgcuucgggccggauggcc

SEQ ID NO: 2448743 - RNA, 17 nt, Bordetella pertussis
ccgcuucggucagcugc

SEQ ID NO: 2448744 - RNA, 17 nt, Bordetella pertussis
ccgcuucgucgggcagc

SEQ ID NO: 2448745 - RNA, 19 nt, Bordetella pertussis
ccgcuucgucgggcagcgc

SEQ ID NO: 2448746 - RNA, 22 nt, Bordetella pertussis
ccgcuucgucgggcagcgcggc

SEQ ID NO: 2448747 - RNA, 17 nt, Bordetella pertussis
ccgcuucgugcggccgc

SEQ ID NO: 2448748 - RNA, 21 nt, Bordetella pertussis
ccgcuucgugcggccgcagca

SEQ ID NO: 2448749 - RNA, 22 nt, Bordetella pertussis
ccgcuucucacugcccgcgccg

SEQ ID NO: 2448750 - RNA, 16 nt, Bordetella pertussis
ccgcuucuucgucgcg

SEQ ID NO: 2448751 - RNA, 20 nt, Bordetella pertussis
ccgcuucuucgucgcgccag

SEQ ID NO: 2448752 - RNA, 22 nt, Bordetella pertussis
ccgcuugaaguaaucgcccggc

SEQ ID NO: 2448753 - RNA, 22 nt, Bordetella pertussis
ccgcuugcccgucaugcgccgc

SEQ ID NO: 2448754 - RNA, 19 nt, Bordetella pertussis
ccgcuugcggccggcgcug

SEQ ID NO: 2448755 - RNA, 17 nt, Bordetella pertussis
ccgcuuuuuccugcugu

SEQ ID NO: 2448756 - RNA, 20 nt, Bordetella pertussis
ccggcgcgcucgcugccggc

SEQ ID NO: 2448757 - RNA, 17 nt, Bordetella pertussis
ccggcgcggcagccugg

SEQ ID NO: 2448758 - RNA, 20 nt, Bordetella pertussis
ccggcgcggcagccuggggc

SEQ ID NO: 2448759 - RNA, 17 nt, Bordetella pertussis
ccggcgcggccgggggu

SEQ ID NO: 2448760 - RNA, 12 nt, Bordetella pertussis
ccggcgcggcgc

SEQ ID NO: 2448761 - RNA, 15 nt, Bordetella pertussis
ccggcgcggcgcgcg

SEQ ID NO: 2448762 - RNA, 16 nt, Bordetella pertussis
ccggcgcggcgcgcgc

SEQ ID NO: 2448763 - RNA, 19 nt, Bordetella pertussis
ccggcgcggcgcgcgccgu

SEQ ID NO: 2448764 - RNA, 21 nt, Bordetella pertussis
ccggcgcggcgguccucgccg

SEQ ID NO: 2448765 - RNA, 16 nt, Bordetella pertussis
ccggcgcggcugcugg

SEQ ID NO: 2448766 - RNA, 19 nt, Bordetella pertussis
ccggcgcggcugcugggca

SEQ ID NO: 2448767 - RNA, 22 nt, Bordetella pertussis
ccggcgcggcugcugggcaugg

SEQ ID NO: 2448768 - RNA, 14 nt, Bordetella pertussis
ccggcgcgguaugg

SEQ ID NO: 2448769 - RNA, 19 nt, Bordetella pertussis
ccggcgcgguauggccgcc

SEQ ID NO: 2448770 - RNA, 22 nt, Bordetella pertussis
ccggcgcgguauggccgcccag

SEQ ID NO: 2448771 - RNA, 20 nt, Bordetella pertussis
ccggcgcggugaggcggccg

SEQ ID NO: 2448772 - RNA, 23 nt, Bordetella pertussis
ccggcgcggugaggcggccgggc

SEQ ID NO: 2448773 - RNA, 21 nt, Bordetella pertussis
ccggcgcgguugguuugcggc

SEQ ID NO: 2448774 - RNA, 18 nt, Bordetella pertussis
ccggcgcguccacgccgu

SEQ ID NO: 2448775 - RNA, 20 nt, Bordetella pertussis
ccggcgcguccacgccgugg

SEQ ID NO: 2448776 - RNA, 13 nt, Bordetella pertussis
ccggcgcgucgcg

SEQ ID NO: 2448777 - RNA, 15 nt, Bordetella pertussis
ccggcgcgucgcgcg

SEQ ID NO: 2448778 - RNA, 18 nt, Bordetella pertussis
ccggcgcgucgcgcggcg

SEQ ID NO: 2448779 - RNA, 21 nt, Bordetella pertussis
ccggcgcgucgcgcggcggca

SEQ ID NO: 2448780 - RNA, 14 nt, Bordetella pertussis
ccggcgcgugcugg

SEQ ID NO: 2448781 - RNA, 17 nt, Bordetella pertussis
ccggcgcuacagggugc

SEQ ID NO: 2448782 - RNA, 22 nt, Bordetella pertussis
ccggcgcuacagggugccgcgc

SEQ ID NO: 2448783 - RNA, 15 nt, Bordetella pertussis
ccggcgcucgccccg

SEQ ID NO: 2448784 - RNA, 19 nt, Bordetella pertussis
ccggcgcucgccccggcgc

SEQ ID NO: 2448785 - RNA, 21 nt, Bordetella pertussis
ccggcgcucgccccggcgcgc

SEQ ID NO: 2448786 - RNA, 23 nt, Bordetella pertussis
ccggcgcucgccccggcgcgcag

SEQ ID NO: 2448787 - RNA, 13 nt, Bordetella pertussis
ccggcgcucgcgc

SEQ ID NO: 2448788 - RNA, 23 nt, Bordetella pertussis
ccggcgcucgcgcaccgcauggg

SEQ ID NO: 2448789 - RNA, 15 nt, Bordetella pertussis
ccggcgcugcgcagc

SEQ ID NO: 2448790 - RNA, 21 nt, Bordetella pertussis
ccggcgcugcgcagcagggcg

SEQ ID NO: 2448791 - RNA, 12 nt, Bordetella pertussis
ccggcgcugcug

SEQ ID NO: 2448792 - RNA, 18 nt, Bordetella pertussis
ccggcgcugcugucgcgc

SEQ ID NO: 2448793 - RNA, 13 nt, Bordetella pertussis
ccggcgcuggccg

SEQ ID NO: 2448794 - RNA, 15 nt, Bordetella pertussis
ccggcgcuggccgcc

SEQ ID NO: 2448795 - RNA, 17 nt, Bordetella pertussis
ccggcgcuggccgccau

SEQ ID NO: 2448796 - RNA, 18 nt, Bordetella pertussis
ccggcgcuggcgcauggc

SEQ ID NO: 2448797 - RNA, 22 nt, Bordetella pertussis
ccggcggaucacccagcggcug

SEQ ID NO: 2448798 - RNA, 15 nt, Bordetella pertussis
ccggcggcaccgcgc

SEQ ID NO: 2448799 - RNA, 20 nt, Bordetella pertussis
ccggcggcaccgcgcagccc

SEQ ID NO: 2448800 - RNA, 22 nt, Bordetella pertussis
ccggcggcaccgcgcagcccgg

SEQ ID NO: 2448801 - RNA, 15 nt, Bordetella pertussis
ccggcggcacgcugc

SEQ ID NO: 2448802 - RNA, 16 nt, Bordetella pertussis
ccggcggcacgcugcg

SEQ ID NO: 2448803 - RNA, 21 nt, Bordetella pertussis
ccggcggcacgcugcgcaggc

SEQ ID NO: 2448804 - RNA, 17 nt, Bordetella pertussis
ccggcggcacggccggc

SEQ ID NO: 2448805 - RNA, 19 nt, Bordetella pertussis
ccggcggcacggccggccu

SEQ ID NO: 2448806 - RNA, 21 nt, Bordetella pertussis
ccggcggcacggccggccugc

SEQ ID NO: 2448807 - RNA, 12 nt, Bordetella pertussis
ccggcggcagcc

SEQ ID NO: 2448808 - RNA, 15 nt, Bordetella pertussis
ccggcggcaugcgcc

SEQ ID NO: 2448809 - RNA, 22 nt, Bordetella pertussis
ccggcggcaugcgccagccagc

SEQ ID NO: 2448810 - RNA, 17 nt, Bordetella pertussis
ccggcggcauucagcgc

SEQ ID NO: 2448811 - RNA, 14 nt, Bordetella pertussis
ccggcggccagcgc

SEQ ID NO: 2448812 - RNA, 18 nt, Bordetella pertussis
ccggcggccagcgcgccg

SEQ ID NO: 2448813 - RNA, 20 nt, Bordetella pertussis
ccggcggccagcgcgccgcc

SEQ ID NO: 2448814 - RNA, 15 nt, Bordetella pertussis
ccggcggccaggccg

SEQ ID NO: 2448815 - RNA, 16 nt, Bordetella pertussis
ccggcggccaggccgg

SEQ ID NO: 2448816 - RNA, 19 nt, Bordetella pertussis
ccggcggccaggccggcgc

SEQ ID NO: 2448817 - RNA, 22 nt, Bordetella pertussis
ccggcggccaggccggcgcgcc

SEQ ID NO: 2448818 - RNA, 12 nt, Bordetella pertussis
ccggcggccaug

SEQ ID NO: 2448819 - RNA, 12 nt, Bordetella pertussis
ccggcggccggu

SEQ ID NO: 2448820 - RNA, 21 nt, Bordetella pertussis
ccggcggccuaugugcaggcc

SEQ ID NO: 2448821 - RNA, 15 nt, Bordetella pertussis
ccggcggccugcagg

SEQ ID NO: 2448822 - RNA, 16 nt, Bordetella pertussis
ccggcggccuggaccu

SEQ ID NO: 2448823 - RNA, 17 nt, Bordetella pertussis
ccggcggccuggaccug

SEQ ID NO: 2448824 - RNA, 17 nt, Bordetella pertussis
ccggcggcgagcgcggc

SEQ ID NO: 2448825 - RNA, 21 nt, Bordetella pertussis
ccggcggcgagcgcggcgcgc

SEQ ID NO: 2448826 - RNA, 22 nt, Bordetella pertussis
ccggcggcgagcgcggcgcgcg

SEQ ID NO: 2448827 - RNA, 16 nt, Bordetella pertussis
ccggcggcgaucacau

SEQ ID NO: 2448828 - RNA, 24 nt, Bordetella pertussis
ccggcggcgcauugccgucggccg

SEQ ID NO: 2448829 - RNA, 16 nt, Bordetella pertussis
ccggcggcgccggccu

SEQ ID NO: 2448830 - RNA, 12 nt, Bordetella pertussis
ccggcggcgcgc

SEQ ID NO: 2448831 - RNA, 14 nt, Bordetella pertussis
ccggcggcgcgccg

SEQ ID NO: 2448832 - RNA, 21 nt, Bordetella pertussis
ccggcggcgcggaugaucucg

SEQ ID NO: 2448833 - RNA, 15 nt, Bordetella pertussis
ccggcggcgcggcga

SEQ ID NO: 2448834 - RNA, 18 nt, Bordetella pertussis
ccggcggcgcucaucauc

SEQ ID NO: 2448835 - RNA, 20 nt, Bordetella pertussis
ccggcggcgcucaucaucgc

SEQ ID NO: 2448836 - RNA, 15 nt, Bordetella pertussis
ccggcggcgggcgug

SEQ ID NO: 2448837 - RNA, 16 nt, Bordetella pertussis
ccggcggcgucggcgc

SEQ ID NO: 2448838 - RNA, 19 nt, Bordetella pertussis
ccggcggcgucggcgcccg

SEQ ID NO: 2448839 - RNA, 20 nt, Bordetella pertussis
ccggcggcgucggcgcccgg

SEQ ID NO: 2448840 - RNA, 22 nt, Bordetella pertussis
ccggcggcgugcccugcggcgc

SEQ ID NO: 2448841 - RNA, 20 nt, Bordetella pertussis
ccggcggcgugcgccugcug

SEQ ID NO: 2448842 - RNA, 14 nt, Bordetella pertussis
ccggcggcguggcc

SEQ ID NO: 2448843 - RNA, 19 nt, Bordetella pertussis
ccggcggcguggccgugcu

SEQ ID NO: 2448844 - RNA, 20 nt, Bordetella pertussis
ccggcggcguggccgugcug

SEQ ID NO: 2448845 - RNA, 21 nt, Bordetella pertussis
ccggcggcguggccgugcugg

SEQ ID NO: 2448846 - RNA, 17 nt, Bordetella pertussis
ccggcgggaacaggcac

SEQ ID NO: 2448847 - RNA, 18 nt, Bordetella pertussis
ccggcgggaacaggcacc

SEQ ID NO: 2448848 - RNA, 23 nt, Bordetella pertussis
ccggcgggcaacuucaccgucga

SEQ ID NO: 2448849 - RNA, 14 nt, Bordetella pertussis
ccggcgggcaggcg

SEQ ID NO: 2448850 - RNA, 22 nt, Bordetella pertussis
ccggcgggcaggcgggccaggc

SEQ ID NO: 2448851 - RNA, 22 nt, Bordetella pertussis
ccggcgggcaggcuccacagcc

SEQ ID NO: 2448852 - RNA, 18 nt, Bordetella pertussis
ccggcgggcaugacgacc

SEQ ID NO: 2448853 - RNA, 14 nt, Bordetella pertussis
ccggcgggccgcac

SEQ ID NO: 2448854 - RNA, 15 nt, Bordetella pertussis
ccggcgggccgcugu

SEQ ID NO: 2448855 - RNA, 17 nt, Bordetella pertussis
ccggcgggccgcuguug

SEQ ID NO: 2448856 - RNA, 12 nt, Bordetella pertussis
ccggcgggccgg

SEQ ID NO: 2448857 - RNA, 13 nt, Bordetella pertussis
ccggcgggccggc

SEQ ID NO: 2448858 - RNA, 20 nt, Bordetella pertussis
ccggcgggcggcugcccggg

SEQ ID NO: 2448859 - RNA, 13 nt, Bordetella pertussis
ccggcggggacag

SEQ ID NO: 2448860 - RNA, 23 nt, Bordetella pertussis
ccgggacaggcacccgcgcgcag

SEQ ID NO: 2448861 - RNA, 18 nt, Bordetella pertussis
ccgggaccuuggcggcug

SEQ ID NO: 2448862 - RNA, 19 nt, Bordetella pertussis
ccgggaccuuggcggcugg

SEQ ID NO: 2448863 - RNA, 14 nt, Bordetella pertussis
ccgggagccugucc

SEQ ID NO: 2448864 - RNA, 15 nt, Bordetella pertussis
ccgggagccuguccc

SEQ ID NO: 2448865 - RNA, 17 nt, Bordetella pertussis
ccgggagccuguccccg

SEQ ID NO: 2448866 - RNA, 21 nt, Bordetella pertussis
ccgggagccuguccccgccgg

SEQ ID NO: 2448867 - RNA, 17 nt, Bordetella pertussis
ccgggagcggccagcaa

SEQ ID NO: 2448868 - RNA, 21 nt, Bordetella pertussis
ccgggagcggccagcaagcgc

SEQ ID NO: 2448869 - RNA, 22 nt, Bordetella pertussis
ccgggagcggccagcaagcgcg

SEQ ID NO: 2448870 - RNA, 18 nt, Bordetella pertussis
ccgggauccacgccgccg

SEQ ID NO: 2448871 - RNA, 19 nt, Bordetella pertussis
ccgggauccacgccgccgg

SEQ ID NO: 2448872 - RNA, 20 nt, Bordetella pertussis
ccgggauccacgccgccggc

SEQ ID NO: 2448873 - RNA, 15 nt, Bordetella pertussis
ccgggcaaucggcgu

SEQ ID NO: 2448874 - RNA, 18 nt, Bordetella pertussis
ccgggcaaucggcgugca

SEQ ID NO: 2448875 - RNA, 22 nt, Bordetella pertussis
ccgggcacaccgucacgcgcaa

SEQ ID NO: 2448876 - RNA, 21 nt, Bordetella pertussis
ccgggcaccagguccuggcgg

SEQ ID NO: 2448877 - RNA, 22 nt, Bordetella pertussis
ccgggcaccagguccuggcggc

SEQ ID NO: 2448878 - RNA, 22 nt, Bordetella pertussis
ccgggcacguaguacagcagca

SEQ ID NO: 2448879 - RNA, 15 nt, Bordetella pertussis
ccgggcagcaccgcu

SEQ ID NO: 2448880 - RNA, 19 nt, Bordetella pertussis
ccgggcagcaccgcugcua

SEQ ID NO: 2448881 - RNA, 18 nt, Bordetella pertussis
ccgggcagcaucacggug

SEQ ID NO: 2448882 - RNA, 13 nt, Bordetella pertussis
ccgggcagcccgc

SEQ ID NO: 2448883 - RNA, 13 nt, Bordetella pertussis
ccgggcagcgaga

SEQ ID NO: 2448884 - RNA, 17 nt, Bordetella pertussis
ccgggcagcgggccgca

SEQ ID NO: 2448885 - RNA, 19 nt, Bordetella pertussis
ccgggcagcgggccgcagc

SEQ ID NO: 2448886 - RNA, 13 nt, Bordetella pertussis
ccgggcaggccgc

SEQ ID NO: 2448887 - RNA, 20 nt, Bordetella pertussis
ccgggcaggcucagcccggc

SEQ ID NO: 2448888 - RNA, 23 nt, Bordetella pertussis
ccgggcaggcucagcccggcgag

SEQ ID NO: 2448889 - RNA, 19 nt, Bordetella pertussis
ccgggcaguucgggcacgc

SEQ ID NO: 2448890 - RNA, 17 nt, Bordetella pertussis
ccgggcaugcaccaggc

SEQ ID NO: 2448891 - RNA, 21 nt, Bordetella pertussis
ccgggcaugcgaaagccggcc

SEQ ID NO: 2448892 - RNA, 14 nt, Bordetella pertussis
ccgggcccgcgccg

SEQ ID NO: 2448893 - RNA, 15 nt, Bordetella pertussis
ccgggcccgcgccga

SEQ ID NO: 2448894 - RNA, 19 nt, Bordetella pertussis
ccgggcccggccacggccg

SEQ ID NO: 2448895 - RNA, 15 nt, Bordetella pertussis
ccgggcccggcgcgc

SEQ ID NO: 2448896 - RNA, 14 nt, Bordetella pertussis
ccgggccgaccagg

SEQ ID NO: 2448897 - RNA, 16 nt, Bordetella pertussis
ccgggccgaccaggcc

SEQ ID NO: 2448898 - RNA, 17 nt, Bordetella pertussis
ccgggccgaccaggccg

SEQ ID NO: 2448899 - RNA, 19 nt, Bordetella pertussis
ccgggccgaccaggccggc

SEQ ID NO: 2448900 - RNA, 23 nt, Bordetella pertussis
ccgggccgaccaggccggcggcg

SEQ ID NO: 2448901 - RNA, 15 nt, Bordetella pertussis
ccgggccgacgcgcc

SEQ ID NO: 2448902 - RNA, 18 nt, Bordetella pertussis
ccgggccgacgcgcccgg

SEQ ID NO: 2448903 - RNA, 20 nt, Bordetella pertussis
ccgggccgacgcgcccgggc

SEQ ID NO: 2448904 - RNA, 12 nt, Bordetella pertussis
ccgggccgcgcg

SEQ ID NO: 2448905 - RNA, 14 nt, Bordetella pertussis
ccgggccgcuggcc

SEQ ID NO: 2448906 - RNA, 21 nt, Bordetella pertussis
ccgggccggccugcgucgcca

SEQ ID NO: 2448907 - RNA, 13 nt, Bordetella pertussis
ccgggccggcggg

SEQ ID NO: 2448908 - RNA, 14 nt, Bordetella pertussis
ccgggccggcgggc

SEQ ID NO: 2448909 - RNA, 23 nt, Bordetella pertussis
ccgggccgguuucggccugcagg

SEQ ID NO: 2448910 - RNA, 17 nt, Bordetella pertussis
ccgggccgucgccgcgc

SEQ ID NO: 2448911 - RNA, 20 nt, Bordetella pertussis
ccgggccgucuacaggccca

SEQ ID NO: 2448912 - RNA, 23 nt, Bordetella pertussis
ccgggccguggcgauccagggcc

SEQ ID NO: 2448913 - RNA, 24 nt, Bordetella pertussis
ccgggccguggcgauccagggccg

SEQ ID NO: 2448914 - RNA, 14 nt, Bordetella pertussis
ccgggccugcccgc

SEQ ID NO: 2448915 - RNA, 13 nt, Bordetella pertussis
ccgggccuggccu

SEQ ID NO: 2448916 - RNA, 14 nt, Bordetella pertussis
ccgggccuggugcc

SEQ ID NO: 2448917 - RNA, 20 nt, Bordetella pertussis
ccgggcgaaccgguggccau

SEQ ID NO: 2448918 - RNA, 19 nt, Bordetella pertussis
ccgggcgagauggcgugca

SEQ ID NO: 2448919 - RNA, 15 nt, Bordetella pertussis
ccgggcgagccgaac

SEQ ID NO: 2448920 - RNA, 16 nt, Bordetella pertussis
ccgggcgagccgaacg

SEQ ID NO: 2448921 - RNA, 20 nt, Bordetella pertussis
ccgggcgaucgcgucggcca

SEQ ID NO: 2448922 - RNA, 17 nt, Bordetella pertussis
ccgggcgcaagcgcgcc

SEQ ID NO: 2448923 - RNA, 15 nt, Bordetella pertussis
ccgggcgccaggcug

SEQ ID NO: 2448924 - RNA, 16 nt, Bordetella pertussis
ccgggcgccaggcuga

SEQ ID NO: 2448925 - RNA, 13 nt, Bordetella pertussis
ccgggcgcccagc

SEQ ID NO: 2448926 - RNA, 20 nt, Bordetella pertussis
ccgggcgcccagcgucucga

SEQ ID NO: 2448927 - RNA, 22 nt, Bordetella pertussis
ccgggcgccgcgccccaucacc

SEQ ID NO: 2448928 - RNA, 12 nt, Bordetella pertussis
ccgggcgccggc

SEQ ID NO: 2448929 - RNA, 16 nt, Bordetella pertussis
ccgggcgccugcgcca

SEQ ID NO: 2448930 - RNA, 21 nt, Bordetella pertussis
ccgggcgcgccggcgggcgcu

SEQ ID NO: 2448931 - RNA, 15 nt, Bordetella pertussis
ccgggcgcgcgccgg

SEQ ID NO: 2448932 - RNA, 18 nt, Bordetella pertussis
ccgggcgcgcugcccagc

SEQ ID NO: 2448933 - RNA, 21 nt, Bordetella pertussis
ccgggcgcggccaggcgcuca

SEQ ID NO: 2448934 - RNA, 16 nt, Bordetella pertussis
ccgggcgcggcccggc

SEQ ID NO: 2448935 - RNA, 17 nt, Bordetella pertussis
ccgggcgcggccgccgc

SEQ ID NO: 2448936 - RNA, 22 nt, Bordetella pertussis
ccgggcgcggccgccgcccgcc

SEQ ID NO: 2448937 - RNA, 15 nt, Bordetella pertussis
ccgggcgcggcgccc

SEQ ID NO: 2448938 - RNA, 17 nt, Bordetella pertussis
ccgggcgcggcgcccgc

SEQ ID NO: 2448939 - RNA, 23 nt, Bordetella pertussis
ccgggcgcgucaguugggcgcgc

SEQ ID NO: 2448940 - RNA, 24 nt, Bordetella pertussis
ccgggcgcgucaguugggcgcgcc

SEQ ID NO: 2448941 - RNA, 23 nt, Bordetella pertussis
ccgggcgcguggcccgcgccgcg

SEQ ID NO: 2448942 - RNA, 17 nt, Bordetella pertussis
ccgggcgcugcgccggc

SEQ ID NO: 2448943 - RNA, 22 nt, Bordetella pertussis
ccgggcgcugcgccggcggcac

SEQ ID NO: 2448944 - RNA, 15 nt, Bordetella pertussis
ccgggcgcuugccgu

SEQ ID NO: 2448945 - RNA, 23 nt, Bordetella pertussis
ccgggcgcuugccguagcgcgug

SEQ ID NO: 2448946 - RNA, 14 nt, Bordetella pertussis
ccgggcggaucgcc

SEQ ID NO: 2448947 - RNA, 17 nt, Bordetella pertussis
ccgggcggaucgccgaa

SEQ ID NO: 2448948 - RNA, 18 nt, Bordetella pertussis
ccgggcggaucgccgaag

SEQ ID NO: 2448949 - RNA, 13 nt, Bordetella pertussis
ccgggcggcccgg

SEQ ID NO: 2448950 - RNA, 14 nt, Bordetella pertussis
ccgggcggcgagau

SEQ ID NO: 2448951 - RNA, 14 nt, Bordetella pertussis
ccgggcggcgcggg

SEQ ID NO: 2448952 - RNA, 20 nt, Bordetella pertussis
ccgggcggcgcgggcggcua

SEQ ID NO: 2448953 - RNA, 22 nt, Bordetella pertussis
ccgggcggguugugcccgcccg

SEQ ID NO: 2448954 - RNA, 20 nt, Bordetella pertussis
ccgggcgguccgguucgccc

SEQ ID NO: 2448955 - RNA, 17 nt, Bordetella pertussis
ccgggcgugaccagcug

SEQ ID NO: 2448956 - RNA, 17 nt, Bordetella pertussis
ccgggcucaggcugcgc

SEQ ID NO: 2448957 - RNA, 21 nt, Bordetella pertussis
ccgggcucgaaguacagcuug

SEQ ID NO: 2448958 - RNA, 14 nt, Bordetella pertussis
ccgggcucggccac

SEQ ID NO: 2448959 - RNA, 18 nt, Bordetella pertussis
ccgggcucggccaccaug

SEQ ID NO: 2448960 - RNA, 23 nt, Bordetella pertussis
ccgggcugaacauccugaccggc

SEQ ID NO: 2448961 - RNA, 15 nt, Bordetella pertussis
ccgggcugcaugcuc

SEQ ID NO: 2448962 - RNA, 20 nt, Bordetella pertussis
ccgggcugccguagcccagg

SEQ ID NO: 2448963 - RNA, 14 nt, Bordetella pertussis
ccggucugccacac

SEQ ID NO: 2448964 - RNA, 15 nt, Bordetella pertussis
ccggucugggcgcgg

SEQ ID NO: 2448965 - RNA, 15 nt, Bordetella pertussis
ccggucuggucggcg

SEQ ID NO: 2448966 - RNA, 16 nt, Bordetella pertussis
ccggucuggucggcga

SEQ ID NO: 2448967 - RNA, 19 nt, Bordetella pertussis
ccggugaacaccagggugg

SEQ ID NO: 2448968 - RNA, 14 nt, Bordetella pertussis
ccggugaccgccag

SEQ ID NO: 2448969 - RNA, 15 nt, Bordetella pertussis
ccggugaccgccagc

SEQ ID NO: 2448970 - RNA, 21 nt, Bordetella pertussis
ccggugauaugcgccaggccc

SEQ ID NO: 2448971 - RNA, 19 nt, Bordetella pertussis
ccggugaucagcaggccca

SEQ ID NO: 2448972 - RNA, 22 nt, Bordetella pertussis
ccggugaucagcaggcccacca

SEQ ID NO: 2448973 - RNA, 19 nt, Bordetella pertussis
ccggugaucaucgugccgg

SEQ ID NO: 2448974 - RNA, 21 nt, Bordetella pertussis
ccggugaucgaguaggccggc

SEQ ID NO: 2448975 - RNA, 15 nt, Bordetella pertussis
ccggugaugcggcgc

SEQ ID NO: 2448976 - RNA, 17 nt, Bordetella pertussis
ccggugaugcggcgcgc

SEQ ID NO: 2448977 - RNA, 18 nt, Bordetella pertussis
ccggugaugcggcgcgcc

SEQ ID NO: 2448978 - RNA, 19 nt, Bordetella pertussis
ccggugaugcggcgcgccg

SEQ ID NO: 2448979 - RNA, 22 nt, Bordetella pertussis
ccggugaugcggcgcgccgcgu

SEQ ID NO: 2448980 - RNA, 19 nt, Bordetella pertussis
ccggugcaccaggccaccc

SEQ ID NO: 2448981 - RNA, 21 nt, Bordetella pertussis
ccggugcaccaggccacccgc

SEQ ID NO: 2448982 - RNA, 19 nt, Bordetella pertussis
ccggugcagccgccgcagg

SEQ ID NO: 2448983 - RNA, 21 nt, Bordetella pertussis
ccggugcagccgccgcaggcu

SEQ ID NO: 2448984 - RNA, 16 nt, Bordetella pertussis
ccggugcagcguggcg

SEQ ID NO: 2448985 - RNA, 17 nt, Bordetella pertussis
ccggugcaucggccggc

SEQ ID NO: 2448986 - RNA, 14 nt, Bordetella pertussis
ccggugccaguccc

SEQ ID NO: 2448987 - RNA, 14 nt, Bordetella pertussis
ccggugccagucuc

SEQ ID NO: 2448988 - RNA, 21 nt, Bordetella pertussis
ccggugccagucuccaggcuc

SEQ ID NO: 2448989 - RNA, 16 nt, Bordetella pertussis
ccggugcgauagcgcc

SEQ ID NO: 2448990 - RNA, 18 nt, Bordetella pertussis
ccggugcgauagcgccgc

SEQ ID NO: 2448991 - RNA, 22 nt, Bordetella pertussis
ccggugcgcagcaccagcaugu

SEQ ID NO: 2448992 - RNA, 23 nt, Bordetella pertussis
ccggugcgcgcagggcggccggc

SEQ ID NO: 2448993 - RNA, 20 nt, Bordetella pertussis
ccggugcgcggcgcccccgc

SEQ ID NO: 2448994 - RNA, 21 nt, Bordetella pertussis
ccggugcgcgugggcacccgg

SEQ ID NO: 2448995 - RNA, 13 nt, Bordetella pertussis
ccggugcucggcc

SEQ ID NO: 2448996 - RNA, 18 nt, Bordetella pertussis
ccggugcucggccagcgc

SEQ ID NO: 2448997 - RNA, 23 nt, Bordetella pertussis
ccggugcucggccagcgcgcgcc

SEQ ID NO: 2448998 - RNA, 21 nt, Bordetella pertussis
ccgguggaaauacagaucgcc

SEQ ID NO: 2448999 - RNA, 15 nt, Bordetella pertussis
ccgguggccagcagc

SEQ ID NO: 2449000 - RNA, 16 nt, Bordetella pertussis
ccguggccggcaucgc

SEQ ID NO: 2449001 - RNA, 17 nt, Bordetella pertussis
ccguggccggcgcggca

SEQ ID NO: 2449002 - RNA, 18 nt, Bordetella pertussis
ccguggccgggcccggcg

SEQ ID NO: 2449003 - RNA, 19 nt, Bordetella pertussis
ccguggccgggcccggcgc

SEQ ID NO: 2449004 - RNA, 22 nt, Bordetella pertussis
ccguggcgcaaggcaugcgcca

SEQ ID NO: 2449005 - RNA, 13 nt, Bordetella pertussis
ccguggcgcacca

SEQ ID NO: 2449006 - RNA, 18 nt, Bordetella pertussis
ccguggcgcaccagguug

SEQ ID NO: 2449007 - RNA, 22 nt, Bordetella pertussis
ccguggcgcggccaauggccgg

SEQ ID NO: 2449008 - RNA, 11 nt, Bordetella pertussis
ccguggcggcc

SEQ ID NO: 2449009 - RNA, 14 nt, Bordetella pertussis
ccguggcggccaca

SEQ ID NO: 2449010 - RNA, 14 nt, Bordetella pertussis
ccguggcggccgcg

SEQ ID NO: 2449011 - RNA, 16 nt, Bordetella pertussis
ccguggcggccugcgc

SEQ ID NO: 2449012 - RNA, 23 nt, Bordetella pertussis
ccguggcggguccacguggcgac

SEQ ID NO: 2449013 - RNA, 15 nt, Bordetella pertussis
ccguggcgugcaggc

SEQ ID NO: 2449014 - RNA, 16 nt, Bordetella pertussis
ccguggcgugcaggcc

SEQ ID NO: 2449015 - RNA, 17 nt, Bordetella pertussis
ccguggcgugcaggccg

SEQ ID NO: 2449016 - RNA, 18 nt, Bordetella pertussis
ccguggcgugcaggccgg

SEQ ID NO: 2449017 - RNA, 19 nt, Bordetella pertussis
ccguggcgugcaggccggc

SEQ ID NO: 2449018 - RNA, 20 nt, Bordetella pertussis
ccguggcgugcaggccggcg

SEQ ID NO: 2449019 - RNA, 21 nt, Bordetella pertussis
ccguggcguugacggcccagc

SEQ ID NO: 2449020 - RNA, 23 nt, Bordetella pertussis
ccguggcguugacggcccagcuc

SEQ ID NO: 2449021 - RNA, 20 nt, Bordetella pertussis
ccguggcugaaaucccccgc

SEQ ID NO: 2449022 - RNA, 12 nt, Bordetella pertussis
ccgugggacagg

SEQ ID NO: 2449023 - RNA, 18 nt, Bordetella pertussis
ccgugggacaggcacccu

SEQ ID NO: 2449024 - RNA, 14 nt, Bordetella pertussis
ccgugggcggcgua

SEQ ID NO: 2449025 - RNA, 16 nt, Bordetella pertussis
ccguggggacaggcac

SEQ ID NO: 2449026 - RNA, 18 nt, Bordetella pertussis
ccguggggacaggcaccu

SEQ ID NO: 2449027 - RNA, 21 nt, Bordetella pertussis
ccguggggacgagcuccugga

SEQ ID NO: 2449028 - RNA, 22 nt, Bordetella pertussis
ccguggggacgagcuccuggag

SEQ ID NO: 2449029 - RNA, 14 nt, Bordetella pertussis
ccgugguacgugga

SEQ ID NO: 2449030 - RNA, 23 nt, Bordetella pertussis
ccguggucgccagcacgcgcagc

SEQ ID NO: 2449031 - RNA, 15 nt, Bordetella pertussis
ccgugucgccgucgg

SEQ ID NO: 2449032 - RNA, 19 nt, Bordetella pertussis
ccguguucgagcaggcgcg

SEQ ID NO: 2449033 - RNA, 19 nt, Bordetella pertussis
ccguuaggccuugcgugac

SEQ ID NO: 2449034 - RNA, 12 nt, Bordetella pertussis
ccguuauauaua

SEQ ID NO: 2449035 - RNA, 19 nt, Bordetella pertussis
ccguuaugguucggccucg

SEQ ID NO: 2449036 - RNA, 14 nt, Bordetella pertussis
ccguucagggacgg

SEQ ID NO: 2449037 - RNA, 19 nt, Bordetella pertussis
ccguucagggacgggccag

SEQ ID NO: 2449038 - RNA, 21 nt, Bordetella pertussis
ccguucagggacgggccagcc

SEQ ID NO: 2449039 - RNA, 21 nt, Bordetella pertussis
ccguucagguucaucagccgg

SEQ ID NO: 2449040 - RNA, 23 nt, Bordetella pertussis
ccguucaucagcgcgcgcagccg

SEQ ID NO: 2449041 - RNA, 13 nt, Bordetella pertussis
ccguucauggcgu

SEQ ID NO: 2449042 - RNA, 23 nt, Bordetella pertussis
ccguuccagacgauggugccggc

SEQ ID NO: 2449043 - RNA, 13 nt, Bordetella pertussis
ccguuccagcaug

SEQ ID NO: 2449044 - RNA, 20 nt, Bordetella pertussis
ccguucccggugccaguccc

SEQ ID NO: 2449045 - RNA, 13 nt, Bordetella pertussis
ccguucgcgcugc

SEQ ID NO: 2449046 - RNA, 14 nt, Bordetella pertussis
ccguucggggacag

SEQ ID NO: 2449047 - RNA, 21 nt, Bordetella pertussis
ccguucggggacaggcaccga

SEQ ID NO: 2449048 - RNA, 17 nt, Bordetella pertussis
ccguucggugcgcagcg

SEQ ID NO: 2449049 - RNA, 16 nt, Bordetella pertussis
ccguucucaggccgag

SEQ ID NO: 2449050 - RNA, 19 nt, Bordetella pertussis
ccguucuggcugcgcgccu

SEQ ID NO: 2449051 - RNA, 16 nt, Bordetella pertussis
ccguucuuccgcacgc

SEQ ID NO: 2449052 - RNA, 16 nt, Bordetella pertussis
ccguugcagcccagcg

SEQ ID NO: 2449053 - RNA, 19 nt, Bordetella pertussis
ccguugcccagauccagcu

SEQ ID NO: 2449054 - RNA, 21 nt, Bordetella pertussis
ccguugcccagauccagcuug

SEQ ID NO: 2449055 - RNA, 14 nt, Bordetella pertussis
ccguugccgcgcgc

SEQ ID NO: 2449056 - RNA, 16 nt, Bordetella pertussis
ccguugccgcgcgcga

SEQ ID NO: 2449057 - RNA, 20 nt, Bordetella pertussis
ccguugccgcuguggcgcgc

SEQ ID NO: 2449058 - RNA, 14 nt, Bordetella pertussis
ccguugcgccugcc

SEQ ID NO: 2449059 - RNA, 14 nt, Bordetella pertussis
ccguugcggcccgc

SEQ ID NO: 2449060 - RNA, 16 nt, Bordetella pertussis
ccguugcgggcugcgc

SEQ ID NO: 2449061 - RNA, 23 nt, Bordetella pertussis
ccguuggcaggccagcauggccg

SEQ ID NO: 2449062 - RNA, 17 nt, Bordetella pertussis
ccguuggccaaugcgcc

SEQ ID NO: 2449063 - RNA, 18 nt, Bordetella pertussis
ccguuggccaaugcgccg

SEQ ID NO: 2449064 - RNA, 20 nt, Bordetella pertussis
ccguuggccaaugcgccgcg

SEQ ID NO: 2449065 - RNA, 13 nt, Bordetella pertussis
ccguuggccagcg

SEQ ID NO: 2449066 - RNA, 19 nt, Bordetella pertussis
ccguuggccagcgccgcca

SEQ ID NO: 2449067 - RNA, 13 nt, Bordetella pertussis
ccguuggccgcga

SEQ ID NO: 2449068 - RNA, 14 nt, Bordetella pertussis
ccguuggccgcgcg

SEQ ID NO: 2449069 - RNA, 16 nt, Bordetella pertussis
ccguuggcgauggcgc

SEQ ID NO: 2449070 - RNA, 23 nt, Bordetella pertussis
ccguuggcgauggcgcggccgga

SEQ ID NO: 2449071 - RNA, 15 nt, Bordetella pertussis
ccguuggcgcccagc

SEQ ID NO: 2449072 - RNA, 18 nt, Bordetella pertussis
ccguuggcgcccagcgcc

SEQ ID NO: 2449073 - RNA, 15 nt, Bordetella pertussis
ccguugucgccgcgg

SEQ ID NO: 2449074 - RNA, 11 nt, Bordetella pertussis
ccguuucaggc

SEQ ID NO: 2449075 - RNA, 18 nt, Bordetella pertussis
ccguuucguaaggcugcg

SEQ ID NO: 2449076 - RNA, 19 nt, Bordetella pertussis
ccguuucguaaggcugcgu

SEQ ID NO: 2449077 - RNA, 14 nt, Bordetella pertussis
ccguuucgucggcg

SEQ ID NO: 2449078 - RNA, 23 nt, Bordetella pertussis
ccguuucgucggcgcgcgccagg

SEQ ID NO: 2449079 - RNA, 20 nt, Bordetella pertussis
ccguuucucaacccgccggc

SEQ ID NO: 2449080 - RNA, 22 nt, Bordetella pertussis
ccguuuuauuuggcaaggcccg

SEQ ID NO: 2449081 - RNA, 22 nt, Bordetella pertussis
ccguuuuuuucguugcauugca

SEQ ID NO: 2449082 - RNA, 20 nt, Bordetella pertussis
ccuaaauugccgcgaggcgc

SEQ ID NO: 2449083 - RNA, 16 nt, Bordetella pertussis
ccuacagcagcggcuc

SEQ ID NO: 2449084 - RNA, 14 nt, Bordetella pertussis
ccuacauccuggau

SEQ ID NO: 2449085 - RNA, 23 nt, Bordetella pertussis
ccuaccaaguaaacaugcggguc

SEQ ID NO: 2449086 - RNA, 16 nt, Bordetella pertussis
ccuacccgccgggcgg

SEQ ID NO: 2449087 - RNA, 15 nt, Bordetella pertussis
ccuaccucagcaugg

SEQ ID NO: 2449088 - RNA, 17 nt, Bordetella pertussis
ccuacgaguaccgccgc

SEQ ID NO: 2449089 - RNA, 15 nt, Bordetella pertussis
ccuacgccaugacau

SEQ ID NO: 2449090 - RNA, 14 nt, Bordetella pertussis
ccuacugcccucgc

SEQ ID NO: 2449091 - RNA, 16 nt, Bordetella pertussis
ccuacuggcgcgcgca

SEQ ID NO: 2449092 - RNA, 15 nt, Bordetella pertussis
ccuacuucggcagcu

SEQ ID NO: 2449093 - RNA, 17 nt, Bordetella pertussis
ccuacuucggcagcuug

SEQ ID NO: 2449094 - RNA, 13 nt, Bordetella pertussis
ccuagcccggcgc

SEQ ID NO: 2449095 - RNA, 15 nt, Bordetella pertussis
ccuagcccggcgcca

SEQ ID NO: 2449096 - RNA, 14 nt, Bordetella pertussis
ccuagcgccgcgcc

SEQ ID NO: 2449097 - RNA, 16 nt, Bordetella pertussis
ccuaggcugcagccag

SEQ ID NO: 2449098 - RNA, 16 nt, Bordetella pertussis
ccuauaucgacggcgc

SEQ ID NO: 2449099 - RNA, 15 nt, Bordetella pertussis
ccuaucaccugggca

SEQ ID NO: 2449100 - RNA, 14 nt, Bordetella pertussis
ccuaucaggccucg

SEQ ID NO: 2449101 - RNA, 16 nt, Bordetella pertussis
ccuaugaagacgcgcu

SEQ ID NO: 2449102 - RNA, 19 nt, Bordetella pertussis
ccuaugaagacgcgcucgc

SEQ ID NO: 2449103 - RNA, 16 nt, Bordetella pertussis
ccuauguaggcgccgc

SEQ ID NO: 2449104 - RNA, 17 nt, Bordetella pertussis
ccuauuuggcggccugg

SEQ ID NO: 2449105 - RNA, 21 nt, Bordetella pertussis
ccuauuuggcggccuggccgc

SEQ ID NO: 2449106 - RNA, 15 nt, Bordetella pertussis
ccucaaccgcgcgua

SEQ ID NO: 2449107 - RNA, 15 nt, Bordetella pertussis
ccucaacuggccggc

SEQ ID NO: 2449108 - RNA, 16 nt, Bordetella pertussis
ccucacgcuuccccga

SEQ ID NO: 2449109 - RNA, 17 nt, Bordetella pertussis
ccucacgcuuccccgaa

SEQ ID NO: 2449110 - RNA, 18 nt, Bordetella pertussis
ccucacuccauagcgccg

SEQ ID NO: 2449111 - RNA, 19 nt, Bordetella pertussis
ccucacuccauagcgccgc

SEQ ID NO: 2449112 - RNA, 13 nt, Bordetella pertussis
ccucagcauggcg

SEQ ID NO: 2449113 - RNA, 14 nt, Bordetella pertussis
ccucagcauggcgg

SEQ ID NO: 2449114 - RNA, 14 nt, Bordetella pertussis
ccucagccugcugg

SEQ ID NO: 2449115 - RNA, 22 nt, Bordetella pertussis
ccucgacgggauccucgcucuu

SEQ ID NO: 2449116 - RNA, 21 nt, Bordetella pertussis
ccucgacggggaaccccgcau

SEQ ID NO: 2449117 - RNA, 19 nt, Bordetella pertussis
ccucgacguaagugcccag

SEQ ID NO: 2449118 - RNA, 23 nt, Bordetella pertussis
ccucgacguaagugcccaggccc

SEQ ID NO: 2449119 - RNA, 14 nt, Bordetella pertussis
ccucgaucgccagg

SEQ ID NO: 2449120 - RNA, 23 nt, Bordetella pertussis
ccucgaucgccaggucggccagc

SEQ ID NO: 2449121 - RNA, 20 nt, Bordetella pertussis
ccucgaugaccgggucgucg

SEQ ID NO: 2449122 - RNA, 14 nt, Bordetella pertussis
ccucgaugcccucg

SEQ ID NO: 2449123 - RNA, 18 nt, Bordetella pertussis
ccucgaugcccucgcgca

SEQ ID NO: 2449124 - RNA, 14 nt, Bordetella pertussis
ccucgauggcggug

SEQ ID NO: 2449125 - RNA, 14 nt, Bordetella pertussis
ccucgaugucaucg

SEQ ID NO: 2449126 - RNA, 22 nt, Bordetella pertussis
ccucgaugucaucgcccucuuc

SEQ ID NO: 2449127 - RNA, 23 nt, Bordetella pertussis
ccucgauuuccgaggccuugcuc

SEQ ID NO: 2449128 - RNA, 20 nt, Bordetella pertussis
ccucgcaagcggccaugcgc

SEQ ID NO: 2449129 - RNA, 23 nt, Bordetella pertussis
ccucgcaagcggccaugcgccgc

SEQ ID NO: 2449130 - RNA, 13 nt, Bordetella pertussis
ccucgcacggccg

SEQ ID NO: 2449131 - RNA, 16 nt, Bordetella pertussis
ccucgcacggccguca

SEQ ID NO: 2449132 - RNA, 15 nt, Bordetella pertussis
ccucgccagcggcag

SEQ ID NO: 2449133 - RNA, 16 nt, Bordetella pertussis
ccucgccagcggcagc

SEQ ID NO: 2449134 - RNA, 19 nt, Bordetella pertussis
ccucgcccagcgagccggc

SEQ ID NO: 2449135 - RNA, 14 nt, Bordetella pertussis
ccucgcccagcggc

SEQ ID NO: 2449136 - RNA, 15 nt, Bordetella pertussis
ccucgcccagcggcg

SEQ ID NO: 2449137 - RNA, 16 nt, Bordetella pertussis
ccucgcccagcggcgc

SEQ ID NO: 2449138 - RNA, 23 nt, Bordetella pertussis
ccucgcccagcggcgccgaccag

SEQ ID NO: 2449139 - RNA, 14 nt, Bordetella pertussis
ccucgcccaggccg

SEQ ID NO: 2449140 - RNA, 15 nt, Bordetella pertussis
ccucgcccaggccgg

SEQ ID NO: 2449141 - RNA, 17 nt, Bordetella pertussis
ccucgcccaggccgggc

SEQ ID NO: 2449142 - RNA, 18 nt, Bordetella pertussis
ccucgcccccgaaggccg

SEQ ID NO: 2449143 - RNA, 20 nt, Bordetella pertussis
ccucgcccccgaaggccgcg

SEQ ID NO: 2449144 - RNA, 21 nt, Bordetella pertussis
ccucgcccccgaaggccgcgc

SEQ ID NO: 2449145 - RNA, 22 nt, Bordetella pertussis
ccucgcccccgaaggccgcgcc

SEQ ID NO: 2449146 - RNA, 17 nt, Bordetella pertussis
ccucgcccgaccugcug

SEQ ID NO: 2449147 - RNA, 18 nt, Bordetella pertussis
ccucgcccgaccugcugg

SEQ ID NO: 2449148 - RNA, 16 nt, Bordetella pertussis
ccucgcccgaucggcc

SEQ ID NO: 2449149 - RNA, 20 nt, Bordetella pertussis
ccucgcccgaucggccggcc

SEQ ID NO: 2449150 - RNA, 13 nt, Bordetella pertussis
ccucgccgcccag

SEQ ID NO: 2449151 - RNA, 17 nt, Bordetella pertussis
ccucgccgcccagccgg

SEQ ID NO: 2449152 - RNA, 19 nt, Bordetella pertussis
ccucgccgcccagccggcc

SEQ ID NO: 2449153 - RNA, 19 nt, Bordetella pertussis
ccucgccgcgccagcugcg

SEQ ID NO: 2449154 - RNA, 23 nt, Bordetella pertussis
ccucgccgcgccagcugcgcagc

SEQ ID NO: 2449155 - RNA, 12 nt, Bordetella pertussis
ccucgccggccc

SEQ ID NO: 2449156 - RNA, 20 nt, Bordetella pertussis
ccucgccggccuggcgcgcg

SEQ ID NO: 2449157 - RNA, 16 nt, Bordetella pertussis
ccucgcgacggccucc

SEQ ID NO: 2449158 - RNA, 14 nt, Bordetella pertussis
ccucgcgcaccagc

SEQ ID NO: 2449159 - RNA, 17 nt, Bordetella pertussis
ccucgcgcagggcggcc

SEQ ID NO: 2449160 - RNA, 15 nt, Bordetella pertussis
ccucgcgcugcagca

SEQ ID NO: 2449161 - RNA, 22 nt, Bordetella pertussis
ccucgcggaugaccuggugcac

SEQ ID NO: 2449162 - RNA, 15 nt, Bordetella pertussis
ccucgcggcgcagca

SEQ ID NO: 2449163 - RNA, 21 nt, Bordetella pertussis
ccucgcgggccuuggccagca

SEQ ID NO: 2449164 - RNA, 22 nt, Bordetella pertussis
ccucgcgggccuuggccagcag

SEQ ID NO: 2449165 - RNA, 13 nt, Bordetella pertussis
ccucgcggggccc

SEQ ID NO: 2449166 - RNA, 17 nt, Bordetella pertussis
ccucgcugccagggugc

SEQ ID NO: 2449167 - RNA, 16 nt, Bordetella pertussis
ccucgcugccggcgcc

SEQ ID NO: 2449168 - RNA, 18 nt, Bordetella pertussis
ccucgcuggagaccggca

SEQ ID NO: 2449169 - RNA, 21 nt, Bordetella pertussis
ccucgcuggagaccggcaugg

SEQ ID NO: 2449170 - RNA, 13 nt, Bordetella pertussis
ccucgcuggcgaa

SEQ ID NO: 2449171 - RNA, 17 nt, Bordetella pertussis
ccucgcuuuaccagcug

SEQ ID NO: 2449172 - RNA, 21 nt, Bordetella pertussis
ccucggacgagacaggcgcgc

SEQ ID NO: 2449173 - RNA, 22 nt, Bordetella pertussis
ccucggacgagacaggcgcgcc

SEQ ID NO: 2449174 - RNA, 20 nt, Bordetella pertussis
ccucggacgccuggcgcggc

SEQ ID NO: 2449175 - RNA, 14 nt, Bordetella pertussis
ccucggcacggcca

SEQ ID NO: 2449176 - RNA, 16 nt, Bordetella pertussis
ccucggcauggcgcgc

SEQ ID NO: 2449177 - RNA, 17 nt, Bordetella pertussis
ccucggcauggcgcgcg

SEQ ID NO: 2449178 - RNA, 18 nt, Bordetella pertussis
ccucggcauggcgcgcgc

SEQ ID NO: 2449179 - RNA, 23 nt, Bordetella pertussis
ccucggccacgucggcggccgcc

SEQ ID NO: 2449180 - RNA, 13 nt, Bordetella pertussis
ccucggccagccg

SEQ ID NO: 2449181 - RNA, 14 nt, Bordetella pertussis
ccucggccagcugg

SEQ ID NO: 2449182 - RNA, 15 nt, Bordetella pertussis
ccucggccagcuggg

SEQ ID NO: 2449183 - RNA, 12 nt, Bordetella pertussis
ccucggccagga

SEQ ID NO: 2449184 - RNA, 21 nt, Bordetella pertussis
ccucggccaggaaagccggcg

SEQ ID NO: 2449185 - RNA, 19 nt, Bordetella pertussis
ccucggccauguagauggc

SEQ ID NO: 2449186 - RNA, 20 nt, Bordetella pertussis
ccucggccauguagauggcc

SEQ ID NO: 2449187 - RNA, 13 nt, Bordetella pertussis
ccucggccggcag

SEQ ID NO: 2449188 - RNA, 18 nt, Bordetella pertussis
ccucggccggcaggucga

SEQ ID NO: 2449189 - RNA, 12 nt, Bordetella pertussis
ccucggccucgc

SEQ ID NO: 2449190 - RNA, 15 nt, Bordetella pertussis
ccucggccugcgguu

SEQ ID NO: 2449191 - RNA, 11 nt, Bordetella pertussis
ccucggccugg

SEQ ID NO: 2449192 - RNA, 18 nt, Bordetella pertussis
ccucggcgaagugcccgc

SEQ ID NO: 2449193 - RNA, 22 nt, Bordetella pertussis
ccucggcgaagugcccgcuggc

SEQ ID NO: 2449194 - RNA, 18 nt, Bordetella pertussis
ccucggcgagcgccucgc

SEQ ID NO: 2449195 - RNA, 12 nt, Bordetella pertussis
ccucggcgccgc

SEQ ID NO: 2449196 - RNA, 14 nt, Bordetella pertussis
ccucggcgccgcgg

SEQ ID NO: 2449197 - RNA, 14 nt, Bordetella pertussis
ccucggcgcgcgcg

SEQ ID NO: 2449198 - RNA, 20 nt, Bordetella pertussis
ccucggcgcgcgcggcgccg

SEQ ID NO: 2449199 - RNA, 21 nt, Bordetella pertussis
ccucggcggccagcgcgcccu

SEQ ID NO: 2449200 - RNA, 15 nt, Bordetella pertussis
ccucggcggccuccg

SEQ ID NO: 2449201 - RNA, 13 nt, Bordetella pertussis
ccucggcggcguc

SEQ ID NO: 2449202 - RNA, 14 nt, Bordetella pertussis
ccucggcgggcggc

SEQ ID NO: 2449203 - RNA, 23 nt, Bordetella pertussis
ccucggcgggcggcgccagcgga

SEQ ID NO: 2449204 - RNA, 17 nt, Bordetella pertussis
ccucggcgguugcccgc

SEQ ID NO: 2449205 - RNA, 12 nt, Bordetella pertussis
ccucggcgucgc

SEQ ID NO: 2449206 - RNA, 16 nt, Bordetella pertussis
ccucggcuugcgcggc

SEQ ID NO: 2449207 - RNA, 18 nt, Bordetella pertussis
ccucggcuugcgcggcgc

SEQ ID NO: 2449208 - RNA, 15 nt, Bordetella pertussis
ccucgggaaacaggc

SEQ ID NO: 2449209 - RNA, 20 nt, Bordetella pertussis
ccucgggcgacaggcgcgcc

SEQ ID NO: 2449210 - RNA, 23 nt, Bordetella pertussis
ccucgggcgacaggcgcgcccgc

SEQ ID NO: 2449211 - RNA, 18 nt, Bordetella pertussis
ccucggggcgcggccggu

SEQ ID NO: 2449212 - RNA, 16 nt, Bordetella pertussis
ccucggucagcgccag

SEQ ID NO: 2449213 - RNA, 18 nt, Bordetella pertussis
ccucggucaggguggaga

SEQ ID NO: 2449214 - RNA, 15 nt, Bordetella pertussis
ccucggucgccucga

SEQ ID NO: 2449215 - RNA, 14 nt, Bordetella pertussis
ccucggucucgugc

SEQ ID NO: 2449216 - RNA, 15 nt, Bordetella pertussis
ccucggucucgugcg

SEQ ID NO: 2449217 - RNA, 20 nt, Bordetella pertussis
ccucggucugcuucauccag

SEQ ID NO: 2449218 - RNA, 23 nt, Bordetella pertussis
ccucggugcugcuguucgccacg

SEQ ID NO: 2449219 - RNA, 15 nt, Bordetella pertussis
ccucguaaguggcgg

SEQ ID NO: 2449220 - RNA, 21 nt, Bordetella pertussis
ccucguaguguucgauggcgg

SEQ ID NO: 2449221 - RNA, 13 nt, Bordetella pertussis
ccucguaucgccu

SEQ ID NO: 2449222 - RNA, 23 nt, Bordetella pertussis
ccucguccgucucgcccaggccc

SEQ ID NO: 2449223 - RNA, 23 nt, Bordetella pertussis
ccucguccguuucgucggcgcgc

SEQ ID NO: 2449224 - RNA, 17 nt, Bordetella pertussis
ccucguccucgucggcg

SEQ ID NO: 2449225 - RNA, 14 nt, Bordetella pertussis
ccucguccugcagg

SEQ ID NO: 2449226 - RNA, 17 nt, Bordetella pertussis
ccucgucgcgcaacgcc

SEQ ID NO: 2449227 - RNA, 15 nt, Bordetella pertussis
ccucgucgcggaagc

SEQ ID NO: 2449228 - RNA, 19 nt, Bordetella pertussis
ccuggcggccgcccagcag

SEQ ID NO: 2449229 - RNA, 22 nt, Bordetella pertussis
ccuggcggcugucgggcggcgc

SEQ ID NO: 2449230 - RNA, 15 nt, Bordetella pertussis
ccuggcgggccuggg

SEQ ID NO: 2449231 - RNA, 17 nt, Bordetella pertussis
ccuggcgggccugggcg

SEQ ID NO: 2449232 - RNA, 20 nt, Bordetella pertussis
ccuggcgguaugcggcgccc

SEQ ID NO: 2449233 - RNA, 15 nt, Bordetella pertussis
ccuggcggugcgccg

SEQ ID NO: 2449234 - RNA, 16 nt, Bordetella pertussis
ccuggcggugcgccgc

SEQ ID NO: 2449235 - RNA, 12 nt, Bordetella pertussis
ccuggcguggcc

SEQ ID NO: 2449236 - RNA, 16 nt, Bordetella pertussis
ccuggcguggcgcgcg

SEQ ID NO: 2449237 - RNA, 17 nt, Bordetella pertussis
ccuggcguggcgcgcgc

SEQ ID NO: 2449238 - RNA, 19 nt, Bordetella pertussis
ccuggcguggcgcgcgccg

SEQ ID NO: 2449239 - RNA, 16 nt, Bordetella pertussis
ccuggcguucgcgcgc

SEQ ID NO: 2449240 - RNA, 21 nt, Bordetella pertussis
ccuggcguucggcaccggcag

SEQ ID NO: 2449241 - RNA, 19 nt, Bordetella pertussis
ccuggcucaggccugcacg

SEQ ID NO: 2449242 - RNA, 21 nt, Bordetella pertussis
ccuggcucagucggccuggcg

SEQ ID NO: 2449243 - RNA, 18 nt, Bordetella pertussis
ccuggcuccccgggcacc

SEQ ID NO: 2449244 - RNA, 21 nt, Bordetella pertussis
ccuggcucugaucgcgcugga

SEQ ID NO: 2449245 - RNA, 18 nt, Bordetella pertussis
ccuggcuggccagccggc

SEQ ID NO: 2449246 - RNA, 21 nt, Bordetella pertussis
ccuggcuuacaggcccaguac

SEQ ID NO: 2449247 - RNA, 20 nt, Bordetella pertussis
ccuggcuucccgguccaggc

SEQ ID NO: 2449248 - RNA, 22 nt, Bordetella pertussis
ccuggcuugcgccacgcccguc

SEQ ID NO: 2449249 - RNA, 14 nt, Bordetella pertussis
ccuggcuuggcggc

SEQ ID NO: 2449250 - RNA, 18 nt, Bordetella pertussis
ccuggcuuggcggccagg

SEQ ID NO: 2449251 - RNA, 16 nt, Bordetella pertussis
ccuggcuuucgccgcg

SEQ ID NO: 2449252 - RNA, 23 nt, Bordetella pertussis
ccugggaggcgcugaugccguac

SEQ ID NO: 2449253 - RNA, 16 nt, Bordetella pertussis
ccugggaggggccggc

SEQ ID NO: 2449254 - RNA, 12 nt, Bordetella pertussis
ccugggcacgcc

SEQ ID NO: 2449255 - RNA, 13 nt, Bordetella pertussis
ccugggccagcag

SEQ ID NO: 2449256 - RNA, 22 nt, Bordetella pertussis
ccugggccagcaggucguuggc

SEQ ID NO: 2449257 - RNA, 13 nt, Bordetella pertussis
ccugggccagcca

SEQ ID NO: 2449258 - RNA, 19 nt, Bordetella pertussis
ccugggccagccagcgccg

SEQ ID NO: 2449259 - RNA, 12 nt, Bordetella pertussis
ccugggccaucg

SEQ ID NO: 2449260 - RNA, 21 nt, Bordetella pertussis
ccugggccgagcgcgccagca

SEQ ID NO: 2449261 - RNA, 22 nt, Bordetella pertussis
ccugggccgagcgcgccagcac

SEQ ID NO: 2449262 - RNA, 11 nt, Bordetella pertussis
ccugggccgcc

SEQ ID NO: 2449263 - RNA, 12 nt, Bordetella pertussis
ccugggccgccu

SEQ ID NO: 2449264 - RNA, 16 nt, Bordetella pertussis
ccugggccgccugcug

SEQ ID NO: 2449265 - RNA, 17 nt, Bordetella pertussis
ccugggccgccugcugg

SEQ ID NO: 2449266 - RNA, 20 nt, Bordetella pertussis
ccugggccgccugcugggcc

SEQ ID NO: 2449267 - RNA, 12 nt, Bordetella pertussis
ccugggccugcg

SEQ ID NO: 2449268 - RNA, 17 nt, Bordetella pertussis
ccugggccugcggcguc

SEQ ID NO: 2449269 - RNA, 21 nt, Bordetella pertussis
ccugggcgaauccaccggcgc

SEQ ID NO: 2449270 - RNA, 15 nt, Bordetella pertussis
ccugggcgccggcgg

SEQ ID NO: 2449271 - RNA, 22 nt, Bordetella pertussis
ccugggcgcgaugggccugccc

SEQ ID NO: 2449272 - RNA, 12 nt, Bordetella pertussis
ccugggcgcgcg

SEQ ID NO: 2449273 - RNA, 14 nt, Bordetella pertussis
ccugggcgcgcgcc

SEQ ID NO: 2449274 - RNA, 15 nt, Bordetella pertussis
ccugggcgcgcgcca

SEQ ID NO: 2449275 - RNA, 21 nt, Bordetella pertussis
ccugggcgcgcgcccaggcca

SEQ ID NO: 2449276 - RNA, 12 nt, Bordetella pertussis
ccugggcgcggu

SEQ ID NO: 2449277 - RNA, 16 nt, Bordetella pertussis
ccugggcgcgguccag

SEQ ID NO: 2449278 - RNA, 17 nt, Bordetella pertussis
ccugggcggcgcagucg

SEQ ID NO: 2449279 - RNA, 15 nt, Bordetella pertussis
ccugggcggcggcga

SEQ ID NO: 2449280 - RNA, 15 nt, Bordetella pertussis
ccugggcuuuggcuu

SEQ ID NO: 2449281 - RNA, 19 nt, Bordetella pertussis
ccuggggcaguuuccaggg

SEQ ID NO: 2449282 - RNA, 12 nt, Bordetella pertussis
ccuggggccgcg

SEQ ID NO: 2449283 - RNA, 22 nt, Bordetella pertussis
ccuggggcgggcgcugcgcgaa

SEQ ID NO: 2449284 - RNA, 14 nt, Bordetella pertussis
ccuggggcgugccc

SEQ ID NO: 2449285 - RNA, 22 nt, Bordetella pertussis
ccuggggggucaaccagguacc

SEQ ID NO: 2449286 - RNA, 17 nt, Bordetella pertussis
ccugggguaggcgcggu

SEQ ID NO: 2449287 - RNA, 19 nt, Bordetella pertussis
ccugggugccuguccccga

SEQ ID NO: 2449288 - RNA, 14 nt, Bordetella pertussis
ccugggugcugccg

SEQ ID NO: 2449289 - RNA, 19 nt, Bordetella pertussis
ccugggugcugccgccgau

SEQ ID NO: 2449290 - RNA, 17 nt, Bordetella pertussis
ccuggguggccagcugc

SEQ ID NO: 2449291 - RNA, 16 nt, Bordetella pertussis
ccugguaagaaaccug

SEQ ID NO: 2449292 - RNA, 14 nt, Bordetella pertussis
ccugguacgaucag

SEQ ID NO: 2449293 - RNA, 16 nt, Bordetella pertussis
ccugguacgaucaggc

SEQ ID NO: 2449294 - RNA, 17 nt, Bordetella pertussis
ccugguacggcaucccg

SEQ ID NO: 2449295 - RNA, 22 nt, Bordetella pertussis
ccugguacggcaucccgacaug

SEQ ID NO: 2449296 - RNA, 15 nt, Bordetella pertussis
ccugguagccggcga

SEQ ID NO: 2449297 - RNA, 16 nt, Bordetella pertussis
ccugguagccggcgac

SEQ ID NO: 2449298 - RNA, 15 nt, Bordetella pertussis
ccugguaggcgagca

SEQ ID NO: 2449299 - RNA, 21 nt, Bordetella pertussis
ccugguaguaaucgcgcgcca

SEQ ID NO: 2449300 - RNA, 17 nt, Bordetella pertussis
ccugguaucccucgccc

SEQ ID NO: 2449301 - RNA, 20 nt, Bordetella pertussis
ccugguaucccucgcccagc

SEQ ID NO: 2449302 - RNA, 14 nt, Bordetella pertussis
ccuggucaagggcg

SEQ ID NO: 2449303 - RNA, 12 nt, Bordetella pertussis
ccuggucacccg

SEQ ID NO: 2449304 - RNA, 16 nt, Bordetella pertussis
ccuggucacccggcgc

SEQ ID NO: 2449305 - RNA, 19 nt, Bordetella pertussis
ccuggucacccggcgcaug

SEQ ID NO: 2449306 - RNA, 14 nt, Bordetella pertussis
ccuggucagcgccg

SEQ ID NO: 2449307 - RNA, 15 nt, Bordetella pertussis
ccuggucagcgccga

SEQ ID NO: 2449308 - RNA, 21 nt, Bordetella pertussis
ccuggucagguugcgccggcu

SEQ ID NO: 2449309 - RNA, 22 nt, Bordetella pertussis
ccuggucagguugcgccggcuc

SEQ ID NO: 2449310 - RNA, 9 nt, Bordetella pertussis
ccuggucau

SEQ ID NO: 2449311 - RNA, 18 nt, Bordetella pertussis
ccuggucaucgccaugcu

SEQ ID NO: 2449312 - RNA, 19 nt, Bordetella pertussis
ccuggucaucgccaugcug

SEQ ID NO: 2449313 - RNA, 16 nt, Bordetella pertussis
ccuggucaugacgggc

SEQ ID NO: 2449314 - RNA, 23 nt, Bordetella pertussis
ccuggucaugacgggcggcggcg

SEQ ID NO: 2449315 - RNA, 17 nt, Bordetella pertussis
ccugguccauggcgggg

SEQ ID NO: 2449316 - RNA, 13 nt, Bordetella pertussis
ccugguccgccgc

SEQ ID NO: 2449317 - RNA, 16 nt, Bordetella pertussis
ccugguccgccgcgac

SEQ ID NO: 2449318 - RNA, 20 nt, Bordetella pertussis
ccugguccugcgugauggcg

SEQ ID NO: 2449319 - RNA, 16 nt, Bordetella pertussis
ccuggucgaacguggc

SEQ ID NO: 2449320 - RNA, 20 nt, Bordetella pertussis
ccuggucgaacguggcggcg

SEQ ID NO: 2449321 - RNA, 16 nt, Bordetella pertussis
ccuggucgaccaggcc

SEQ ID NO: 2449322 - RNA, 16 nt, Bordetella pertussis
ccuggucgacccacuu

SEQ ID NO: 2449323 - RNA, 13 nt, Bordetella pertussis
ccuggucgacgcc

SEQ ID NO: 2449324 - RNA, 14 nt, Bordetella pertussis
ccuggucgacgcga

SEQ ID NO: 2449325 - RNA, 17 nt, Bordetella pertussis
ccuggucgacgcgacgc

SEQ ID NO: 2449326 - RNA, 19 nt, Bordetella pertussis
ccuggucgagcgggcgcca

SEQ ID NO: 2449327 - RNA, 17 nt, Bordetella pertussis
ccuggucgaucagcccc

SEQ ID NO: 2449328 - RNA, 21 nt, Bordetella pertussis
ccuggucgaucagccccugcc

SEQ ID NO: 2449329 - RNA, 16 nt, Bordetella pertussis
ccuggucgcgcgccug

SEQ ID NO: 2449330 - RNA, 23 nt, Bordetella pertussis
ccuggucgcgcgccugcaugcca

SEQ ID NO: 2449331 - RNA, 17 nt, Bordetella pertussis
ccuggucgcuggcgccg

SEQ ID NO: 2449332 - RNA, 14 nt, Bordetella pertussis
ccuggucggccuuc

SEQ ID NO: 2449333 - RNA, 12 nt, Bordetella pertussis
ccuggucggcgc

SEQ ID NO: 2449334 - RNA, 16 nt, Bordetella pertussis
ccuggucggcgcggca

SEQ ID NO: 2449335 - RNA, 21 nt, Bordetella pertussis
ccuggucggggucggccacca

SEQ ID NO: 2449336 - RNA, 23 nt, Bordetella pertussis
ccuggucggggucggccaccacc

SEQ ID NO: 2449337 - RNA, 24 nt, Bordetella pertussis
ccuggucgucgcggcccugggcca

SEQ ID NO: 2449338 - RNA, 22 nt, Bordetella pertussis
ccuggucgucggccacgcccug

SEQ ID NO: 2449339 - RNA, 18 nt, Bordetella pertussis
ccuggugcaccacgcgcu

SEQ ID NO: 2449340 - RNA, 14 nt, Bordetella pertussis
ccuggugcacgccg

SEQ ID NO: 2449341 - RNA, 20 nt, Bordetella pertussis
ccuggugcccgacgccgcgc

SEQ ID NO: 2449342 - RNA, 16 nt, Bordetella pertussis
ccugguggcgcuggcc

SEQ ID NO: 2449343 - RNA, 17 nt, Bordetella pertussis
ccugguggcgcuggccc

SEQ ID NO: 2449344 - RNA, 15 nt, Bordetella pertussis
ccuggugugccuguc

SEQ ID NO: 2449345 - RNA, 17 nt, Bordetella pertussis
ccuggugugccuguccc

SEQ ID NO: 2449346 - RNA, 14 nt, Bordetella pertussis
ccugguguucggca

SEQ ID NO: 2449347 - RNA, 18 nt, Bordetella pertussis
ccugguugaccgagcccg

SEQ ID NO: 2449348 - RNA, 23 nt, Bordetella pertussis
ccugguugaccgagcccggcacc

SEQ ID NO: 2449349 - RNA, 20 nt, Bordetella pertussis
ccugguugccgaggacggua

SEQ ID NO: 2449350 - RNA, 15 nt, Bordetella pertussis
ccugguuggccgccu

SEQ ID NO: 2449351 - RNA, 16 nt, Bordetella pertussis
ccugguuggccgccug

SEQ ID NO: 2449352 - RNA, 17 nt, Bordetella pertussis
ccuguacaagcgcacgc

SEQ ID NO: 2449353 - RNA, 15 nt, Bordetella pertussis
ccuguaugccguagg

SEQ ID NO: 2449354 - RNA, 15 nt, Bordetella pertussis
ccugucccaaccggg

SEQ ID NO: 2449355 - RNA, 18 nt, Bordetella pertussis
ccugucccaaccgggaca

SEQ ID NO: 2449356 - RNA, 14 nt, Bordetella pertussis
ccugucccagcggg

SEQ ID NO: 2449357 - RNA, 18 nt, Bordetella pertussis
ccugucccagcggggaca

SEQ ID NO: 2449358 - RNA, 19 nt, Bordetella pertussis
ccugucccagcggggacag

SEQ ID NO: 2449359 - RNA, 15 nt, Bordetella pertussis
ccugucccaggcgcu

SEQ ID NO: 2449360 - RNA, 15 nt, Bordetella pertussis
ccuguccccacaggg

SEQ ID NO: 2449361 - RNA, 20 nt, Bordetella pertussis
ccuguccccacagggggacu

SEQ ID NO: 2449362 - RNA, 21 nt, Bordetella pertussis
ccuguccccacagggggacug

SEQ ID NO: 2449363 - RNA, 24 nt, Bordetella pertussis
ccuguccccacagggggacuggca

SEQ ID NO: 2449364 - RNA, 20 nt, Bordetella pertussis
ccuguccccacagggggucu

SEQ ID NO: 2449365 - RNA, 16 nt, Bordetella pertussis
ccuguccccacauggg

SEQ ID NO: 2449366 - RNA, 18 nt, Bordetella pertussis
ccuguccccaccgggaca

SEQ ID NO: 2449367 - RNA, 19 nt, Bordetella pertussis
ccuguccccacguggacag

SEQ ID NO: 2449368 - RNA, 21 nt, Bordetella pertussis
ccuguccccacugggggacug

SEQ ID NO: 2449369 - RNA, 20 nt, Bordetella pertussis
ccuguccccccauggggacu

SEQ ID NO: 2449370 - RNA, 21 nt, Bordetella pertussis
ccuguccccccauggggacug

SEQ ID NO: 2449371 - RNA, 18 nt, Bordetella pertussis
ccuguccccgaacgggga

SEQ ID NO: 2449372 - RNA, 20 nt, Bordetella pertussis
ccuguccccgaacggggacu

SEQ ID NO: 2449373 - RNA, 21 nt, Bordetella pertussis
ccuguccccgaacggggacug

SEQ ID NO: 2449374 - RNA, 20 nt, Bordetella pertussis
ccuguccccgaaggggacug

SEQ ID NO: 2449375 - RNA, 22 nt, Bordetella pertussis
ccuguccccgcaagggggacug

SEQ ID NO: 2449376 - RNA, 17 nt, Bordetella pertussis
ccuguccccgcacgggg

SEQ ID NO: 2449377 - RNA, 20 nt, Bordetella pertussis
ccuguccccgcacggggaca

SEQ ID NO: 2449378 - RNA, 21 nt, Bordetella pertussis
ccuguccccgcacggggacug

SEQ ID NO: 2449379 - RNA, 18 nt, Bordetella pertussis
ccuguccccgcagggaca

SEQ ID NO: 2449380 - RNA, 19 nt, Bordetella pertussis
ccuguccccgcagggacag

SEQ ID NO: 2449381 - RNA, 18 nt, Bordetella pertussis
ccuguccccgccgggaca

SEQ ID NO: 2449382 - RNA, 18 nt, Bordetella pertussis
ccuguccccgccggggca

SEQ ID NO: 2449383 - RNA, 19 nt, Bordetella pertussis
ccuguccccgccggggcag

SEQ ID NO: 2449384 - RNA, 19 nt, Bordetella pertussis
ccuguccccgcggggacag

SEQ ID NO: 2449385 - RNA, 18 nt, Bordetella pertussis
ccuguccccgcggggacu

SEQ ID NO: 2449386 - RNA, 12 nt, Bordetella pertussis
ccuguccccgcu

SEQ ID NO: 2449387 - RNA, 18 nt, Bordetella pertussis
ccuguccccgcugcggca

SEQ ID NO: 2449388 - RNA, 18 nt, Bordetella pertussis
ccuguccccgcugggaca

SEQ ID NO: 2449389 - RNA, 18 nt, Bordetella pertussis
ccuguccccguggggaca

SEQ ID NO: 2449390 - RNA, 19 nt, Bordetella pertussis
ccugucccgacggggacag

SEQ ID NO: 2449391 - RNA, 19 nt, Bordetella pertussis
ccugucccggcugggacag

SEQ ID NO: 2449392 - RNA, 14 nt, Bordetella pertussis
ccugucccugaacg

SEQ ID NO: 2449393 - RNA, 15 nt, Bordetella pertussis
ccugucccugccggg

SEQ ID NO: 2449394 - RNA, 18 nt, Bordetella pertussis
ccugucccugccgggaca

SEQ ID NO: 2449395 - RNA, 19 nt, Bordetella pertussis
ccugucccugccgggacag

SEQ ID NO: 2449396 - RNA, 19 nt, Bordetella pertussis
ccugucccugcggggacug

SEQ ID NO: 2449397 - RNA, 18 nt, Bordetella pertussis
ccugucccugcgggggca

SEQ ID NO: 2449398 - RNA, 15 nt, Bordetella pertussis
ccuguccuccccgcu

SEQ ID NO: 2449399 - RNA, 21 nt, Bordetella pertussis
ccugucgcgcugcuuucccug

SEQ ID NO: 2449400 - RNA, 19 nt, Bordetella pertussis
ccugucggccgaaccgcgc

SEQ ID NO: 2449401 - RNA, 22 nt, Bordetella pertussis
ccugucggugaugauccugcug

SEQ ID NO: 2449402 - RNA, 23 nt, Bordetella pertussis
ccugucggugaugauccugcugg

SEQ ID NO: 2449403 - RNA, 14 nt, Bordetella pertussis
ccugugccagcugg

SEQ ID NO: 2449404 - RNA, 17 nt, Bordetella pertussis
ccugugccagcuggccc

SEQ ID NO: 2449405 - RNA, 14 nt, Bordetella pertussis
ccugugggggacag

SEQ ID NO: 2449406 - RNA, 18 nt, Bordetella pertussis
ccugugggggacaggcac

SEQ ID NO: 2449407 - RNA, 20 nt, Bordetella pertussis
ccugugggggacaggcacgc

SEQ ID NO: 2449408 - RNA, 23 nt, Bordetella pertussis
ccuguucgcggugucgcaccgca

SEQ ID NO: 2449409 - RNA, 20 nt, Bordetella pertussis
ccuguucggccacggcugga

SEQ ID NO: 2449410 - RNA, 14 nt, Bordetella pertussis
ccuguucggccggg

SEQ ID NO: 2449411 - RNA, 23 nt, Bordetella pertussis
ccuguugcaggaucugguucuug

SEQ ID NO: 2449412 - RNA, 15 nt, Bordetella pertussis
ccuguuuuggcgcac

SEQ ID NO: 2449413 - RNA, 17 nt, Bordetella pertussis
ccuuacgcggcgcgcgc

SEQ ID NO: 2449414 - RNA, 18 nt, Bordetella pertussis
ccuuacgcggcgcgcgcc

SEQ ID NO: 2449415 - RNA, 15 nt, Bordetella pertussis
ccuucaccccgccac

SEQ ID NO: 2449416 - RNA, 13 nt, Bordetella pertussis
ccuucaccggccc

SEQ ID NO: 2449417 - RNA, 14 nt, Bordetella pertussis
ccuucagcacgcuc

SEQ ID NO: 2449418 - RNA, 18 nt, Bordetella pertussis
ccuucagcagcucguuga

SEQ ID NO: 2449419 - RNA, 16 nt, Bordetella pertussis
ccuucagcgggccggc

SEQ ID NO: 2449420 - RNA, 17 nt, Bordetella pertussis
ccuucagcgggccggca

SEQ ID NO: 2449421 - RNA, 13 nt, Bordetella pertussis
ccuucagggcgcc

SEQ ID NO: 2449422 - RNA, 15 nt, Bordetella pertussis
ccuucagguuccagg

SEQ ID NO: 2449423 - RNA, 15 nt, Bordetella pertussis
ccuuccaccagccgu

SEQ ID NO: 2449424 - RNA, 14 nt, Bordetella pertussis
ccuucccaaaaaaa

SEQ ID NO: 2449425 - RNA, 23 nt, Bordetella pertussis
ccuucccaaaaaaaaaccccgcc

SEQ ID NO: 2449426 - RNA, 12 nt, Bordetella pertussis
ccuucccaggcg

SEQ ID NO: 2449427 - RNA, 15 nt, Bordetella pertussis
ccuuccuccgacagg

SEQ ID NO: 2449428 - RNA, 21 nt, Bordetella pertussis
ccuuccuccgacaggcgccgc

SEQ ID NO: 2449429 - RNA, 12 nt, Bordetella pertussis
ccuuccugcuga

SEQ ID NO: 2449430 - RNA, 18 nt, Bordetella pertussis
ccuuccugcuggaccugc

SEQ ID NO: 2449431 - RNA, 12 nt, Bordetella pertussis
ccuuccuggcca

SEQ ID NO: 2449432 - RNA, 21 nt, Bordetella pertussis
ccuuccuggccaaugccuauu

SEQ ID NO: 2449433 - RNA, 18 nt, Bordetella pertussis
ccuucgacggcgggaccg

SEQ ID NO: 2449434 - RNA, 14 nt, Bordetella pertussis
ccuucgaggaaagc

SEQ ID NO: 2449435 - RNA, 18 nt, Bordetella pertussis
ccuucgaggaaagcggcc

SEQ ID NO: 2449436 - RNA, 13 nt, Bordetella pertussis
ccuucgaggccgg

SEQ ID NO: 2449437 - RNA, 15 nt, Bordetella pertussis
ccuucgaggccggcg

SEQ ID NO: 2449438 - RNA, 13 nt, Bordetella pertussis
ccuucgccgcgca

SEQ ID NO: 2449439 - RNA, 16 nt, Bordetella pertussis
ccuucgcgcagcggcg

SEQ ID NO: 2449440 - RNA, 19 nt, Bordetella pertussis
ccuucgcgcagcggcgcgc

SEQ ID NO: 2449441 - RNA, 19 nt, Bordetella pertussis
ccuucgcgguaggacggca

SEQ ID NO: 2449442 - RNA, 14 nt, Bordetella pertussis
ccuucgcugacgcg

SEQ ID NO: 2449443 - RNA, 18 nt, Bordetella pertussis
ccuucggcauggucggca

SEQ ID NO: 2449444 - RNA, 21 nt, Bordetella pertussis
ccuucggccaaucggccugcu

SEQ ID NO: 2449445 - RNA, 13 nt, Bordetella pertussis
ccuucggccggcu

SEQ ID NO: 2449446 - RNA, 15 nt, Bordetella pertussis
ccuucggccggcugc

SEQ ID NO: 2449447 - RNA, 22 nt, Bordetella pertussis
ccuucggcgaucugggccucgg

SEQ ID NO: 2449448 - RNA, 17 nt, Bordetella pertussis
ccuucggcgcgcgccgg

SEQ ID NO: 2449449 - RNA, 23 nt, Bordetella pertussis
ccuucggcgcggcgggcgcuggc

SEQ ID NO: 2449450 - RNA, 16 nt, Bordetella pertussis
ccuucggcggcgcgcu

SEQ ID NO: 2449451 - RNA, 16 nt, Bordetella pertussis
ccuucggcggcgggcu

SEQ ID NO: 2449452 - RNA, 14 nt, Bordetella pertussis
ccuucggggcagcg

SEQ ID NO: 2449453 - RNA, 15 nt, Bordetella pertussis
ccuucggggcagcga

SEQ ID NO: 2449454 - RNA, 19 nt, Bordetella pertussis
ccuucggucgucgugcccu

SEQ ID NO: 2449455 - RNA, 17 nt, Bordetella pertussis
ccuucgucgcgcacccg

SEQ ID NO: 2449456 - RNA, 24 nt, Bordetella pertussis
ccuucgucgcgcacccgcaggccg

SEQ ID NO: 2449457 - RNA, 14 nt, Bordetella pertussis
ccuucguggcgccg

SEQ ID NO: 2449458 - RNA, 16 nt, Bordetella pertussis
ccuucguggcgccggg

SEQ ID NO: 2449459 - RNA, 14 nt, Bordetella pertussis
ccuucuacccgcuc

SEQ ID NO: 2449460 - RNA, 18 nt, Bordetella pertussis
ccuucugcgccagcggau

SEQ ID NO: 2449461 - RNA, 14 nt, Bordetella pertussis
ccuucuucagcuug

SEQ ID NO: 2449462 - RNA, 19 nt, Bordetella pertussis
ccuucuuccaggcgcccgc

SEQ ID NO: 2449463 - RNA, 14 nt, Bordetella pertussis
ccuugacgccgccg

SEQ ID NO: 2449464 - RNA, 20 nt, Bordetella pertussis
ccuugacggucacggucugg

SEQ ID NO: 2449465 - RNA, 16 nt, Bordetella pertussis
ccuugagaugccagcg

SEQ ID NO: 2449466 - RNA, 15 nt, Bordetella pertussis
ccuugagcacgcugg

SEQ ID NO: 2449467 - RNA, 18 nt, Bordetella pertussis
ccuugagcacguccagcg

SEQ ID NO: 2449468 - RNA, 13 nt, Bordetella pertussis
ccuugagcgccag

SEQ ID NO: 2449469 - RNA, 15 nt, Bordetella pertussis
ccuugagcgccagcu

SEQ ID NO: 2449470 - RNA, 18 nt, Bordetella pertussis
ccuugagcgccagcucgg

SEQ ID NO: 2449471 - RNA, 14 nt, Bordetella pertussis
ccuugagggcgcgg

SEQ ID NO: 2449472 - RNA, 21 nt, Bordetella pertussis
ccuugagggcgcgggccagcu

SEQ ID NO: 2449473 - RNA, 17 nt, Bordetella pertussis
ccuugaugccgucggcg

SEQ ID NO: 2449474 - RNA, 18 nt, Bordetella pertussis
ccuugaugccgucggcga

SEQ ID NO: 2449475 - RNA, 22 nt, Bordetella pertussis
ccuugauggccgggccguggcg

SEQ ID NO: 2449476 - RNA, 17 nt, Bordetella pertussis
ccuugauggccucggcg

SEQ ID NO: 2449477 - RNA, 19 nt, Bordetella pertussis
ccuugauggccucggcggc

SEQ ID NO: 2449478 - RNA, 14 nt, Bordetella pertussis
ccuugccauccagc

SEQ ID NO: 2449479 - RNA, 23 nt, Bordetella pertussis
ccuugccauccagccaggccgca

SEQ ID NO: 2449480 - RNA, 14 nt, Bordetella pertussis
ccuugcccaggcug

SEQ ID NO: 2449481 - RNA, 13 nt, Bordetella pertussis
ccuugccgccgug

SEQ ID NO: 2449482 - RNA, 18 nt, Bordetella pertussis
ccuugccgggcucgauga

SEQ ID NO: 2449483 - RNA, 21 nt, Bordetella pertussis
ccuugccgguggacggccagc

SEQ ID NO: 2449484 - RNA, 22 nt, Bordetella pertussis
ccuugccgguggacggccagca

SEQ ID NO: 2449485 - RNA, 23 nt, Bordetella pertussis
ccuugccgguggacggccagcag

SEQ ID NO: 2449486 - RNA, 23 nt, Bordetella pertussis
ccuugccguaggguucgccgcug

SEQ ID NO: 2449487 - RNA, 15 nt, Bordetella pertussis
ccuugcgaggcccgg

SEQ ID NO: 2449488 - RNA, 15 nt, Bordetella pertussis
ccuugcgaugccagu

SEQ ID NO: 2449489 - RNA, 18 nt, Bordetella pertussis
ccuugcgcgaaggccgcc

SEQ ID NO: 2449490 - RNA, 21 nt, Bordetella pertussis
ccuugcgcgacagcaggccgg

SEQ ID NO: 2449491 - RNA, 15 nt, Bordetella pertussis
ccuugcgcgcgaacu

SEQ ID NO: 2449492 - RNA, 20 nt, Bordetella pertussis
ccuugcgcggccacccugcc

SEQ ID NO: 2449493 - RNA, 15 nt, Bordetella pertussis
ccuugcgcguccagg

SEQ ID NO: 2449494 - RNA, 18 nt, Bordetella pertussis
ccuugcgcucgcccagca

SEQ ID NO: 2449495 - RNA, 19 nt, Bordetella pertussis
ccuugcgcucgcccagcac

SEQ ID NO: 2449496 - RNA, 21 nt, Bordetella pertussis
ccuugcgcuuuuuucuccagc

SEQ ID NO: 2449497 - RNA, 14 nt, Bordetella pertussis
ccuugcggccgccg

SEQ ID NO: 2449498 - RNA, 16 nt, Bordetella pertussis
ccuugcggccgccgaa

SEQ ID NO: 2449499 - RNA, 15 nt, Bordetella pertussis
ccuugcggcuugccg

SEQ ID NO: 2449500 - RNA, 15 nt, Bordetella pertussis
ccuugcgggccggcu

SEQ ID NO: 2449501 - RNA, 16 nt, Bordetella pertussis
ccuugcgggccggcug

SEQ ID NO: 2449502 - RNA, 21 nt, Bordetella pertussis
ccuugcgguugaaggcgaacg

SEQ ID NO: 2449503 - RNA, 17 nt, Bordetella pertussis
ccuugcucagucgggca

SEQ ID NO: 2449504 - RNA, 17 nt, Bordetella pertussis
ccuugcucccaguucug

SEQ ID NO: 2449505 - RNA, 15 nt, Bordetella pertussis
ccuugcuccggcgug

SEQ ID NO: 2449506 - RNA, 22 nt, Bordetella pertussis
ccuugcuccggcgugacguggc

SEQ ID NO: 2449507 - RNA, 14 nt, Bordetella pertussis
ccuugcugaaccug

SEQ ID NO: 2449508 - RNA, 14 nt, Bordetella pertussis
ccuugcugcccgac

SEQ ID NO: 2449509 - RNA, 19 nt, Bordetella pertussis
ccuuggaguagccgcucag

SEQ ID NO: 2449510 - RNA, 22 nt, Bordetella pertussis
ccuuggaguucuucuuggccag

SEQ ID NO: 2449511 - RNA, 18 nt, Bordetella pertussis
ccuuggccaauggccgcg

SEQ ID NO: 2449512 - RNA, 14 nt, Bordetella pertussis
ccuuggccagcagc

SEQ ID NO: 2449513 - RNA, 10 nt, Bordetella pertussis
ccuuggccau

SEQ ID NO: 2449514 - RNA, 23 nt, Bordetella pertussis
ccuuggccauguccuggcaggcc

SEQ ID NO: 2449515 - RNA, 12 nt, Bordetella pertussis
ccuuggccgcag

SEQ ID NO: 2449516 - RNA, 14 nt, Bordetella pertussis
ccuuggccgcagcc

SEQ ID NO: 2449517 - RNA, 15 nt, Bordetella pertussis
ccuuggccgcagccg

SEQ ID NO: 2449518 - RNA, 18 nt, Bordetella pertussis
ccuuggccgcagccggcu

SEQ ID NO: 2449519 - RNA, 20 nt, Bordetella pertussis
ccuuggccgcagccggcugc

SEQ ID NO: 2449520 - RNA, 17 nt, Bordetella pertussis
ccuuggccugggccgac

SEQ ID NO: 2449521 - RNA, 16 nt, Bordetella pertussis
ccuuggcgcccagcuu

SEQ ID NO: 2449522 - RNA, 15 nt, Bordetella pertussis
ccuuggcgccggcga

SEQ ID NO: 2449523 - RNA, 18 nt, Bordetella pertussis
ccuuggcgcgcagacgcg

SEQ ID NO: 2449524 - RNA, 20 nt, Bordetella pertussis
ccuuggcggccgacagcuug

SEQ ID NO: 2449525 - RNA, 17 nt, Bordetella pertussis
ccuuggcguccggcccc

SEQ ID NO: 2449526 - RNA, 19 nt, Bordetella pertussis
ccuuggcguccggccccag

SEQ ID NO: 2449527 - RNA, 18 nt, Bordetella pertussis
ccuuggggcggcccagcg

SEQ ID NO: 2449528 - RNA, 18 nt, Bordetella pertussis
ccuuggggcggcccggcg

SEQ ID NO: 2449529 - RNA, 19 nt, Bordetella pertussis
ccuuggucaccgagaggaa

SEQ ID NO: 2449530 - RNA, 22 nt, Bordetella pertussis
ccuuggucggguccagcacgcc

SEQ ID NO: 2449531 - RNA, 15 nt, Bordetella pertussis
ccuuggucugcaggc

SEQ ID NO: 2449532 - RNA, 14 nt, Bordetella pertussis
ccuuggugccguaa

SEQ ID NO: 2449533 - RNA, 18 nt, Bordetella pertussis
ccuugguggggucgaugc

SEQ ID NO: 2449534 - RNA, 22 nt, Bordetella pertussis
ccuugguggggucgaugccagu

SEQ ID NO: 2449535 - RNA, 20 nt, Bordetella pertussis
ccuugucgcccgauugcagu

SEQ ID NO: 2449536 - RNA, 15 nt, Bordetella pertussis
ccuugucgcgcagcg

SEQ ID NO: 2449537 - RNA, 17 nt, Bordetella pertussis
ccuugucgcgcagcgcc

SEQ ID NO: 2449538 - RNA, 15 nt, Bordetella pertussis
ccuugugcacgugcg

SEQ ID NO: 2449539 - RNA, 22 nt, Bordetella pertussis
ccuugugcacgugcgacgugac

SEQ ID NO: 2449540 - RNA, 15 nt, Bordetella pertussis
ccuugugcgccagcg

SEQ ID NO: 2449541 - RNA, 20 nt, Bordetella pertussis
ccuugugcgccagcgcgaaa

SEQ ID NO: 2449542 - RNA, 16 nt, Bordetella pertussis
ccuugugcgccgucgc

SEQ ID NO: 2449543 - RNA, 18 nt, Bordetella pertussis
ccuugugcggcagguuga

SEQ ID NO: 2449544 - RNA, 20 nt, Bordetella pertussis
ccuugugcugccaugccgcg

SEQ ID NO: 2449545 - RNA, 22 nt, Bordetella pertussis
ccuugugcugccaugccgcgcg

SEQ ID NO: 2449546 - RNA, 14 nt, Bordetella pertussis
ccuuguggccgccg

SEQ ID NO: 2449547 - RNA, 16 nt, Bordetella pertussis
ccuuguuggcgccggc

SEQ ID NO: 2449548 - RNA, 17 nt, Bordetella pertussis
ccuuguuggcgccggcc

SEQ ID NO: 2449549 - RNA, 14 nt, Bordetella pertussis
ccuuucccgcgccg

SEQ ID NO: 2449550 - RNA, 16 nt, Bordetella pertussis
ccuuucugcugcucgc

SEQ ID NO: 2449551 - RNA, 15 nt, Bordetella pertussis
ccuuuuccaggcgug

SEQ ID NO: 2449552 - RNA, 21 nt, Bordetella pertussis
ccuuuuccaggcgugcccggu

SEQ ID NO: 2449553 - RNA, 15 nt, Bordetella pertussis
ccuuuugcgcggccg

SEQ ID NO: 2449554 - RNA, 19 nt, Bordetella pertussis
ccuuuuuacaugcagccgc

SEQ ID NO: 2449555 - RNA, 14 nt, Bordetella pertussis
ccuuuuuccuugcg

SEQ ID NO: 2449556 - RNA, 21 nt, Bordetella pertussis
ccuuuuuguuuuggcgcacgc

SEQ ID NO: 2449557 - RNA, 20 nt, Bordetella pertussis
cgaaaaagcccgcgccacca

SEQ ID NO: 2449558 - RNA, 23 nt, Bordetella pertussis
cgaaaaagcccgcgccaccaccg

SEQ ID NO: 2449559 - RNA, 16 nt, Bordetella pertussis
cgaaaaccaggcugcc

SEQ ID NO: 2449560 - RNA, 14 nt, Bordetella pertussis
cgaaaagcccgccg

SEQ ID NO: 2449561 - RNA, 13 nt, Bordetella pertussis
cgaaacagcagcg

SEQ ID NO: 2449562 - RNA, 14 nt, Bordetella pertussis
cgaaaccaggccgg

SEQ ID NO: 2449563 - RNA, 23 nt, Bordetella pertussis
cgaaacccgcugggccagcaucg

SEQ ID NO: 2449564 - RNA, 21 nt, Bordetella pertussis
cgaaacccucccacgaccugc

SEQ ID NO: 2449565 - RNA, 15 nt, Bordetella pertussis
cgaaaccggcgcgcg

SEQ ID NO: 2449566 - RNA, 20 nt, Bordetella pertussis
cgaaaccggcgcgcgcggcc

SEQ ID NO: 2449567 - RNA, 20 nt, Bordetella pertussis
cgaaaccggugaucagcagg

SEQ ID NO: 2449568 - RNA, 21 nt, Bordetella pertussis
cgaaaccggugaucagcaggc

SEQ ID NO: 2449569 - RNA, 15 nt, Bordetella pertussis
cgaaacgccagcccg

SEQ ID NO: 2449570 - RNA, 14 nt, Bordetella pertussis
cgaaacgcgcgucc

SEQ ID NO: 2449571 - RNA, 19 nt, Bordetella pertussis
cgaaacgcgcguccuuggc

SEQ ID NO: 2449572 - RNA, 18 nt, Bordetella pertussis
cgaaacggcgggcgcgca

SEQ ID NO: 2449573 - RNA, 17 nt, Bordetella pertussis
cgaaacgggcggcgucg

SEQ ID NO: 2449574 - RNA, 22 nt, Bordetella pertussis
cgaaacgggcggcgucgccgcg

SEQ ID NO: 2449575 - RNA, 17 nt, Bordetella pertussis
cgaaacgguucuggauc

SEQ ID NO: 2449576 - RNA, 19 nt, Bordetella pertussis
cgaaacucaccgccgcccg

SEQ ID NO: 2449577 - RNA, 16 nt, Bordetella pertussis
cgaaacuggccgacga

SEQ ID NO: 2449578 - RNA, 23 nt, Bordetella pertussis
cgaaagccagcgccugcgcggcc

SEQ ID NO: 2449579 - RNA, 13 nt, Bordetella pertussis
cgaaagccggccu

SEQ ID NO: 2449580 - RNA, 14 nt, Bordetella pertussis
cgaaagcgcccagg

SEQ ID NO: 2449581 - RNA, 15 nt, Bordetella pertussis
cgaaagcggcaaagc

SEQ ID NO: 2449582 - RNA, 20 nt, Bordetella pertussis
cgaaauaggaucccggcgcc

SEQ ID NO: 2449583 - RNA, 21 nt, Bordetella pertussis
cgaaaucuucugcgccacggc

SEQ ID NO: 2449584 - RNA, 20 nt, Bordetella pertussis
cgaaaugcccagcgagcugg

SEQ ID NO: 2449585 - RNA, 16 nt, Bordetella pertussis
cgaaaugccgcagcac

SEQ ID NO: 2449586 - RNA, 12 nt, Bordetella pertussis
cgaaaugcgcgu

SEQ ID NO: 2449587 - RNA, 16 nt, Bordetella pertussis
cgaaauggcggccucg

SEQ ID NO: 2449588 - RNA, 24 nt, Bordetella pertussis
cgaaauggcggcgguagcgcucgu

SEQ ID NO: 2449589 - RNA, 20 nt, Bordetella pertussis
cgaaaugguguacagccgcc

SEQ ID NO: 2449590 - RNA, 15 nt, Bordetella pertussis
cgaacaacacgauga

SEQ ID NO: 2449591 - RNA, 23 nt, Bordetella pertussis
cgaacaacagcgccugcauccgg

SEQ ID NO: 2449592 - RNA, 14 nt, Bordetella pertussis
cgaacaaggccgga

SEQ ID NO: 2449593 - RNA, 19 nt, Bordetella pertussis
cgaacaaggcgguggccag

SEQ ID NO: 2449594 - RNA, 16 nt, Bordetella pertussis
cgaacacaucgagggc

SEQ ID NO: 2449595 - RNA, 14 nt, Bordetella pertussis
cgaacaccggcagg

SEQ ID NO: 2449596 - RNA, 15 nt, Bordetella pertussis
cgaacaccggcaggc

SEQ ID NO: 2449597 - RNA, 20 nt, Bordetella pertussis
cgaacaccggcuuggccucg

SEQ ID NO: 2449598 - RNA, 22 nt, Bordetella pertussis
cgaacaccggcuuggccucggc

SEQ ID NO: 2449599 - RNA, 24 nt, Bordetella pertussis
cgaacaccggcuuggccucggccg

SEQ ID NO: 2449600 - RNA, 21 nt, Bordetella pertussis
cgaacacgcgcgccgcgggcu

SEQ ID NO: 2449601 - RNA, 21 nt, Bordetella pertussis
cgaacacuggaagaacaccgu

SEQ ID NO: 2449602 - RNA, 22 nt, Bordetella pertussis
cgaacagauccacgcccgcgcc

SEQ ID NO: 2449603 - RNA, 14 nt, Bordetella pertussis
cgaacagcauggcg

SEQ ID NO: 2449604 - RNA, 16 nt, Bordetella pertussis
cgaacagcauggcggc

SEQ ID NO: 2449605 - RNA, 15 nt, Bordetella pertussis
cgaacagcgccaggc

SEQ ID NO: 2449606 - RNA, 15 nt, Bordetella pertussis
cgaacagcugcagcg

SEQ ID NO: 2449607 - RNA, 14 nt, Bordetella pertussis
cgaacaggccgccg

SEQ ID NO: 2449608 - RNA, 22 nt, Bordetella pertussis
cgaacaugacguucuccagcgc

SEQ ID NO: 2449609 - RNA, 15 nt, Bordetella pertussis
cgaacauggccgaga

SEQ ID NO: 2449610 - RNA, 20 nt, Bordetella pertussis
cgaacauguuguuggucgcc

SEQ ID NO: 2449611 - RNA, 20 nt, Bordetella pertussis
cgaaccacaggguggcgccc

SEQ ID NO: 2449612 - RNA, 16 nt, Bordetella pertussis
cgaaccacccggccau

SEQ ID NO: 2449613 - RNA, 18 nt, Bordetella pertussis
cgaaccacccggccaucg

SEQ ID NO: 2449614 - RNA, 22 nt, Bordetella pertussis
cgaaccagaucaggucgaugcc

SEQ ID NO: 2449615 - RNA, 17 nt, Bordetella pertussis
cgaaccagcgcaccacc

SEQ ID NO: 2449616 - RNA, 16 nt, Bordetella pertussis
cgaaccaggccaccgc

SEQ ID NO: 2449617 - RNA, 20 nt, Bordetella pertussis
cgaaccaggccaccgcggug

SEQ ID NO: 2449618 - RNA, 23 nt, Bordetella pertussis
cgaaccaggccugcgggugcgcc

SEQ ID NO: 2449619 - RNA, 17 nt, Bordetella pertussis
cgaaccaguugcgggcc

SEQ ID NO: 2449620 - RNA, 18 nt, Bordetella pertussis
cgaacccaugcaguagcg

SEQ ID NO: 2449621 - RNA, 13 nt, Bordetella pertussis
cgaaccgaccgcc

SEQ ID NO: 2449622 - RNA, 15 nt, Bordetella pertussis
cgaaccgauccagcc

SEQ ID NO: 2449623 - RNA, 17 nt, Bordetella pertussis
cgaaccgauccagcccg

SEQ ID NO: 2449624 - RNA, 22 nt, Bordetella pertussis
cgaaccgcggcgcagguccacc

SEQ ID NO: 2449625 - RNA, 23 nt, Bordetella pertussis
cgaaccgcucagcccuugacgcg

SEQ ID NO: 2449626 - RNA, 13 nt, Bordetella pertussis
cgaaccuggcggg

SEQ ID NO: 2449627 - RNA, 21 nt, Bordetella pertussis
cgaaccuuccuccgacaggcg

SEQ ID NO: 2449628 - RNA, 23 nt, Bordetella pertussis
cgaaccuuccuccgacaggcgcc

SEQ ID NO: 2449629 - RNA, 15 nt, Bordetella pertussis
cgaacgacucgucga

SEQ ID NO: 2449630 - RNA, 19 nt, Bordetella pertussis
cgaacgacucgucgaccac

SEQ ID NO: 2449631 - RNA, 14 nt, Bordetella pertussis
cgaacgacuuggcg

SEQ ID NO: 2449632 - RNA, 21 nt, Bordetella pertussis
cgaacgauucggagucgugca

SEQ ID NO: 2449633 - RNA, 16 nt, Bordetella pertussis
cgaacgccacgcccgu

SEQ ID NO: 2449634 - RNA, 13 nt, Bordetella pertussis
cgaacgcccggcc

SEQ ID NO: 2449635 - RNA, 20 nt, Bordetella pertussis
cgaacgcccggcccaggccg

SEQ ID NO: 2449636 - RNA, 21 nt, Bordetella pertussis
cgaacgcccggcccaggccgg

SEQ ID NO: 2449637 - RNA, 16 nt, Bordetella pertussis
cgaacgccgccgcagc

SEQ ID NO: 2449638 - RNA, 21 nt, Bordetella pertussis
cgaacgccgccgcagccgcca

SEQ ID NO: 2449639 - RNA, 21 nt, Bordetella pertussis
cgaacgccgcgucgcuggccg

SEQ ID NO: 2449640 - RNA, 22 nt, Bordetella pertussis
cgaacgccgcgucgcuggccgg

SEQ ID NO: 2449641 - RNA, 21 nt, Bordetella pertussis
cgaacgccucgggcgcaacgu

SEQ ID NO: 2449642 - RNA, 15 nt, Bordetella pertussis
cgaacgccugccaga

SEQ ID NO: 2449643 - RNA, 24 nt, Bordetella pertussis
cgaacgcgcagcgaacggcccacg

SEQ ID NO: 2449644 - RNA, 12 nt, Bordetella pertussis
cgaacgcgccgg

SEQ ID NO: 2449645 - RNA, 13 nt, Bordetella pertussis
cgaacgcgccggc

SEQ ID NO: 2449646 - RNA, 15 nt, Bordetella pertussis
cgaacgcgccggccc

SEQ ID NO: 2449647 - RNA, 18 nt, Bordetella pertussis
cgaacgcgccggcccagg

SEQ ID NO: 2449648 - RNA, 21 nt, Bordetella pertussis
cgaacgcgccggcccaggcgc

SEQ ID NO: 2449649 - RNA, 15 nt, Bordetella pertussis
cgaacgcgcgccggc

SEQ ID NO: 2449650 - RNA, 22 nt, Bordetella pertussis
cgaacgcgcgccggccagcggc

SEQ ID NO: 2449651 - RNA, 13 nt, Bordetella pertussis
cgaacgcggccag

SEQ ID NO: 2449652 - RNA, 21 nt, Bordetella pertussis
cgaacgcuuccugggccugcg

SEQ ID NO: 2449653 - RNA, 17 nt, Bordetella pertussis
cgaacggauugcugaug

SEQ ID NO: 2449654 - RNA, 14 nt, Bordetella pertussis
cgaacggcacgucg

SEQ ID NO: 2449655 - RNA, 16 nt, Bordetella pertussis
cgaacggcagcagcgc

SEQ ID NO: 2449656 - RNA, 17 nt, Bordetella pertussis
cgaacggcccauccauc

SEQ ID NO: 2449657 - RNA, 15 nt, Bordetella pertussis
cgaacggccgcccgg

SEQ ID NO: 2449658 - RNA, 16 nt, Bordetella pertussis
cgaacggccgcccggc

SEQ ID NO: 2449659 - RNA, 13 nt, Bordetella pertussis
cgaacggccgggc

SEQ ID NO: 2449660 - RNA, 21 nt, Bordetella pertussis
cgaacgggaauggcggacacg

SEQ ID NO: 2449661 - RNA, 19 nt, Bordetella pertussis
cgaacgggcguggcgcagg

SEQ ID NO: 2449662 - RNA, 15 nt, Bordetella pertussis
cgaacggggacuggc

SEQ ID NO: 2449663 - RNA, 18 nt, Bordetella pertussis
cgaacgggguggccggcg

SEQ ID NO: 2449664 - RNA, 20 nt, Bordetella pertussis
cgaacgggguggccggcgcg

SEQ ID NO: 2449665 - RNA, 21 nt, Bordetella pertussis
cgaacgggguggccggcgcgc

SEQ ID NO: 2449666 - RNA, 17 nt, Bordetella pertussis
cgaacgugcgcgccagc

SEQ ID NO: 2449667 - RNA, 15 nt, Bordetella pertussis
cgaacguggccugcu

SEQ ID NO: 2449668 - RNA, 22 nt, Bordetella pertussis
cgaacuccugcaaccagcucag

SEQ ID NO: 2449669 - RNA, 17 nt, Bordetella pertussis
cgaacucgauggccucg

SEQ ID NO: 2449670 - RNA, 19 nt, Bordetella pertussis
cgaacucgauggccucggc

SEQ ID NO: 2449671 - RNA, 20 nt, Bordetella pertussis
cgaacucgauggccucggca

SEQ ID NO: 2449672 - RNA, 18 nt, Bordetella pertussis
cgaacucgcgcucggcca

SEQ ID NO: 2449673 - RNA, 19 nt, Bordetella pertussis
cgaacucgcgcucggccag

SEQ ID NO: 2449674 - RNA, 15 nt, Bordetella pertussis
cgaacugggacaggc

SEQ ID NO: 2449675 - RNA, 18 nt, Bordetella pertussis
cgaacugggacaggccca

SEQ ID NO: 2449676 - RNA, 20 nt, Bordetella pertussis
cgaacugggacaggcccagc

SEQ ID NO: 2449677 - RNA, 14 nt, Bordetella pertussis
cgaacugggcgucg

SEQ ID NO: 2449678 - RNA, 17 nt, Bordetella pertussis
cgaacugggcgucgucc

SEQ ID NO: 2449679 - RNA, 21 nt, Bordetella pertussis
cgaacugggucugccccaugg

SEQ ID NO: 2449680 - RNA, 18 nt, Bordetella pertussis
cgaacugguacagcguga

SEQ ID NO: 2449681 - RNA, 15 nt, Bordetella pertussis
cgaacugucgcgcca

SEQ ID NO: 2449682 - RNA, 23 nt, Bordetella pertussis
cgaacugucgcgccacggcuucg

SEQ ID NO: 2449683 - RNA, 18 nt, Bordetella pertussis
cgaacuucagcccgggca

SEQ ID NO: 2449684 - RNA, 20 nt, Bordetella pertussis
cgaacuuggcgcgguccacg

SEQ ID NO: 2449685 - RNA, 21 nt, Bordetella pertussis
cgaagaaauagcccgcggcca

SEQ ID NO: 2449686 - RNA, 23 nt, Bordetella pertussis
cgaagaaauagcccgcggccacc

SEQ ID NO: 2449687 - RNA, 23 nt, Bordetella pertussis
cgaagaaccaguagcacacgccg

SEQ ID NO: 2449688 - RNA, 18 nt, Bordetella pertussis
cgaagaaggccuuggccu

SEQ ID NO: 2449689 - RNA, 21 nt, Bordetella pertussis
cgaagacaugcugcgacagca

SEQ ID NO: 2449690 - RNA, 17 nt, Bordetella pertussis
cgaagaccgugaucggc

SEQ ID NO: 2449691 - RNA, 17 nt, Bordetella pertussis
cgaagaucaacaaggcg

SEQ ID NO: 2449692 - RNA, 15 nt, Bordetella pertussis
cgaagaucagggugg

SEQ ID NO: 2449693 - RNA, 16 nt, Bordetella pertussis
cgaagaucccgccgga

SEQ ID NO: 2449694 - RNA, 18 nt, Bordetella pertussis
cgaagaucccgccggacu

SEQ ID NO: 2449695 - RNA, 11 nt, Bordetella pertussis
cgaagaucucg

SEQ ID NO: 2449696 - RNA, 17 nt, Bordetella pertussis
cgaagaucucgacgucg

SEQ ID NO: 2449697 - RNA, 14 nt, Bordetella pertussis
cgaagaucuucggc

SEQ ID NO: 2449698 - RNA, 21 nt, Bordetella pertussis
cgaagauuuccucgcgcacca

SEQ ID NO: 2449699 - RNA, 23 nt, Bordetella pertussis
cgaagauuuccucgcgcaccagc

SEQ ID NO: 2449700 - RNA, 12 nt, Bordetella pertussis
cgaagcaaacag

SEQ ID NO: 2449701 - RNA, 18 nt, Bordetella pertussis
cgaagcaaugcagcgcga

SEQ ID NO: 2449702 - RNA, 21 nt, Bordetella pertussis
cgaagcaggcgguacagcgga

SEQ ID NO: 2449703 - RNA, 23 nt, Bordetella pertussis
cgaagcaggugaugcgcgcggcc

SEQ ID NO: 2449704 - RNA, 14 nt, Bordetella pertussis
cgaagccacggccc

SEQ ID NO: 2449705 - RNA, 16 nt, Bordetella pertussis
cgaagccacggcccgc

SEQ ID NO: 2449706 - RNA, 21 nt, Bordetella pertussis
cgaagccagauaaaggccgca

SEQ ID NO: 2449707 - RNA, 14 nt, Bordetella pertussis
cgaagcccggcagg

SEQ ID NO: 2449708 - RNA, 18 nt, Bordetella pertussis
cgaagccgaguggcgggc

SEQ ID NO: 2449709 - RNA, 23 nt, Bordetella pertussis
cgaagccgaguggcgggccaugu

SEQ ID NO: 2449710 - RNA, 20 nt, Bordetella pertussis
cgaagccgaugcgccgcgcu

SEQ ID NO: 2449711 - RNA, 16 nt, Bordetella pertussis
cgaagccgcagcggca

SEQ ID NO: 2449712 - RNA, 20 nt, Bordetella pertussis
cgaagccggcacgccugccg

SEQ ID NO: 2449713 - RNA, 14 nt, Bordetella pertussis
cgaagccggcgcca

SEQ ID NO: 2449714 - RNA, 15 nt, Bordetella pertussis
cgaagccggcgccau

SEQ ID NO: 2449715 - RNA, 14 nt, Bordetella pertussis
cgaagccgggcggc

SEQ ID NO: 2449716 - RNA, 15 nt, Bordetella pertussis
cgaagccgggcggcg

SEQ ID NO: 2449717 - RNA, 17 nt, Bordetella pertussis
cgaagccuugcgcggcc

SEQ ID NO: 2449718 - RNA, 20 nt, Bordetella pertussis
cgaagccuugcgcggccagc

SEQ ID NO: 2449719 - RNA, 21 nt, Bordetella pertussis
cgaagccuugcgcggccagca

SEQ ID NO: 2449720 - RNA, 14 nt, Bordetella pertussis
cgaagcgcaagccc

SEQ ID NO: 2449721 - RNA, 18 nt, Bordetella pertussis
cgaagcgcaagcccaggc

SEQ ID NO: 2449722 - RNA, 16 nt, Bordetella pertussis
cgaagcgcagcaccag

SEQ ID NO: 2449723 - RNA, 20 nt, Bordetella pertussis
cgaagcgcagcaccaggucg

SEQ ID NO: 2449724 - RNA, 22 nt, Bordetella pertussis
cgaagcgcaugucgaagcaggc

SEQ ID NO: 2449725 - RNA, 21 nt, Bordetella pertussis
cgaagcgcccuggcguggcgc

SEQ ID NO: 2449726 - RNA, 23 nt, Bordetella pertussis
cgaagcgcccuggcguggcgcgc

SEQ ID NO: 2449727 - RNA, 15 nt, Bordetella pertussis
cgaagcgcgccagca

SEQ ID NO: 2449728 - RNA, 18 nt, Bordetella pertussis
cgaagcgcgccagcagcg

SEQ ID NO: 2449729 - RNA, 15 nt, Bordetella pertussis
cgaagcgcgccucgu

SEQ ID NO: 2449730 - RNA, 21 nt, Bordetella pertussis
cgaagcgcgugucccagccgg

SEQ ID NO: 2449731 - RNA, 14 nt, Bordetella pertussis
cgaagcgcucgucc

SEQ ID NO: 2449732 - RNA, 22 nt, Bordetella pertussis
cgaagcgcucguccuccgagac

SEQ ID NO: 2449733 - RNA, 19 nt, Bordetella pertussis
cgaagcggaaacgcgcgcg

SEQ ID NO: 2449734 - RNA, 23 nt, Bordetella pertussis
cgaagcggaaacgcgcgcgcccu

SEQ ID NO: 2449735 - RNA, 14 nt, Bordetella pertussis
cgaagcggcccggg

SEQ ID NO: 2449736 - RNA, 19 nt, Bordetella pertussis
cgaagcggcccgggugggc

SEQ ID NO: 2449737 - RNA, 22 nt, Bordetella pertussis
cgaagcggcccgggugggcggc

SEQ ID NO: 2449738 - RNA, 20 nt, Bordetella pertussis
cgaagcggcguucugcagcg

SEQ ID NO: 2449739 - RNA, 14 nt, Bordetella pertussis
cgaagcggcucagg

SEQ ID NO: 2449740 - RNA, 20 nt, Bordetella pertussis
cgaagcgggcgccggcgccc

SEQ ID NO: 2449741 - RNA, 21 nt, Bordetella pertussis
cgaagcuguccuucguggcgc

SEQ ID NO: 2449742 - RNA, 14 nt, Bordetella pertussis
cgaaggcagcaccu

SEQ ID NO: 2449743 - RNA, 16 nt, Bordetella pertussis
cgaaggcagcaccucg

SEQ ID NO: 2449744 - RNA, 16 nt, Bordetella pertussis
cgaaggcagcgcggcc

SEQ ID NO: 2449745 - RNA, 17 nt, Bordetella pertussis
cgaaggcagcgcggccg

SEQ ID NO: 2449746 - RNA, 21 nt, Bordetella pertussis
cgaaggcagcgcggccggcac

SEQ ID NO: 2449747 - RNA, 13 nt, Bordetella pertussis
cgaaggcagcggc

SEQ ID NO: 2449748 - RNA, 16 nt, Bordetella pertussis
cgaaggccagcgccuc

SEQ ID NO: 2449749 - RNA, 12 nt, Bordetella pertussis
cgaaggccgcgc

SEQ ID NO: 2449750 - RNA, 14 nt, Bordetella pertussis
cgaaggcgaucugc

SEQ ID NO: 2449751 - RNA, 20 nt, Bordetella pertussis
cgaaggcgccgacggcgccc

SEQ ID NO: 2449752 - RNA, 15 nt, Bordetella pertussis
cgaaggcgccggcca

SEQ ID NO: 2449753 - RNA, 17 nt, Bordetella pertussis
cgaaggcgccggccagg

SEQ ID NO: 2449754 - RNA, 20 nt, Bordetella pertussis
cgaaggcgccggccaggccc

SEQ ID NO: 2449755 - RNA, 21 nt, Bordetella pertussis
cgaaggcgccggccaggcccu

SEQ ID NO: 2449756 - RNA, 17 nt, Bordetella pertussis
cgaaggcgcgcuccagc

SEQ ID NO: 2449757 - RNA, 14 nt, Bordetella pertussis
cgaaggcgcggccg

SEQ ID NO: 2449758 - RNA, 14 nt, Bordetella pertussis
cgaaggcgcggcug

SEQ ID NO: 2449759 - RNA, 21 nt, Bordetella pertussis
cgaaggcggccggcaggccgg

SEQ ID NO: 2449760 - RNA, 15 nt, Bordetella pertussis
cgaaggcggcgccgg

SEQ ID NO: 2449761 - RNA, 16 nt, Bordetella pertussis
cgaaggcggcgccggu

SEQ ID NO: 2449762 - RNA, 15 nt, Bordetella pertussis
cgaaggcgucggcca

SEQ ID NO: 2449763 - RNA, 20 nt, Bordetella pertussis
cgaaggcuucgucgaccagc

SEQ ID NO: 2449764 - RNA, 23 nt, Bordetella pertussis
cgaagggcaccgugaugucgccg

SEQ ID NO: 2449765 - RNA, 21 nt, Bordetella pertussis
cgaagggcugcgugcgggaca

SEQ ID NO: 2449766 - RNA, 19 nt, Bordetella pertussis
cgaaggggacuggcucccg

SEQ ID NO: 2449767 - RNA, 20 nt, Bordetella pertussis
cgaaggucuggucgcacgac

SEQ ID NO: 2449768 - RNA, 21 nt, Bordetella pertussis
cgaaggucuuggcgugcaggc

SEQ ID NO: 2449769 - RNA, 16 nt, Bordetella pertussis
cgaaggugcggaucac

SEQ ID NO: 2449770 - RNA, 22 nt, Bordetella pertussis
cgaaggugggcgaaccgcggcg

SEQ ID NO: 2449771 - RNA, 21 nt, Bordetella pertussis
cgaagguguccggaugcacgu

SEQ ID NO: 2449772 - RNA, 17 nt, Bordetella pertussis
cgaagguuuccucgcga

SEQ ID NO: 2449773 - RNA, 22 nt, Bordetella pertussis
cgaagguuucgcugcgcacgcu

SEQ ID NO: 2449774 - RNA, 17 nt, Bordetella pertussis
cgaagguuucguagccg

SEQ ID NO: 2449775 - RNA, 20 nt, Bordetella pertussis
cgaagguuucguagccgccg

SEQ ID NO: 2449776 - RNA, 14 nt, Bordetella pertussis
cgaaguacacggcc

SEQ ID NO: 2449777 - RNA, 17 nt, Bordetella pertussis
cgaaguacacggccagc

SEQ ID NO: 2449778 - RNA, 18 nt, Bordetella pertussis
cgaaguacacggccagca

SEQ ID NO: 2449779 - RNA, 15 nt, Bordetella pertussis
cgaaguacucgccgg

SEQ ID NO: 2449780 - RNA, 21 nt, Bordetella pertussis
cgaaguacucgccggcgcugc

SEQ ID NO: 2449781 - RNA, 21 nt, Bordetella pertussis
cgaaguaguuggucgagcgcu

SEQ ID NO: 2449782 - RNA, 24 nt, Bordetella pertussis
cgaaguaguuggucgagcgcucgc

SEQ ID NO: 2449783 - RNA, 17 nt, Bordetella pertussis
cgaagucauaaaacagc

SEQ ID NO: 2449784 - RNA, 22 nt, Bordetella pertussis
cgaagucauguagcggccgccc

SEQ ID NO: 2449785 - RNA, 14 nt, Bordetella pertussis
cgaagucccagccg

SEQ ID NO: 2449786 - RNA, 17 nt, Bordetella pertussis
cgaaguccgcgcgcagc

SEQ ID NO: 2449787 - RNA, 19 nt, Bordetella pertussis
cgaaguccugcaugccaug

SEQ ID NO: 2449788 - RNA, 13 nt, Bordetella pertussis
cgaaguugcggcc

SEQ ID NO: 2449789 - RNA, 19 nt, Bordetella pertussis
cgaaucaguucgcgcaggc

SEQ ID NO: 2449790 - RNA, 20 nt, Bordetella pertussis
cgaaucaguucgcgcaggcg

SEQ ID NO: 2449791 - RNA, 17 nt, Bordetella pertussis
cgaauccaccggcgcgc

SEQ ID NO: 2449792 - RNA, 20 nt, Bordetella pertussis
cgaauccaccggcgcgcgca

SEQ ID NO: 2449793 - RNA, 20 nt, Bordetella pertussis
cgaauccgcaacccagcagc

SEQ ID NO: 2449794 - RNA, 24 nt, Bordetella pertussis
cgaauccgcaacccagcagcggca

SEQ ID NO: 2449795 - RNA, 15 nt, Bordetella pertussis
cgaauccggccagca

SEQ ID NO: 2449796 - RNA, 16 nt, Bordetella pertussis
cgaauccggccagcac

SEQ ID NO: 2449797 - RNA, 15 nt, Bordetella pertussis
cgaauccucucgccc

SEQ ID NO: 2449798 - RNA, 18 nt, Bordetella pertussis
cgaaucgaacuuggcgcg

SEQ ID NO: 2449799 - RNA, 22 nt, Bordetella pertussis
cgaaucggucacgaucuggccg

SEQ ID NO: 2449800 - RNA, 17 nt, Bordetella pertussis
cgaaucguucacgcccg

SEQ ID NO: 2449801 - RNA, 17 nt, Bordetella pertussis
cgaaucucccggcgccc

SEQ ID NO: 2449802 - RNA, 11 nt, Bordetella pertussis
cgaaugcacgg

SEQ ID NO: 2449803 - RNA, 16 nt, Bordetella pertussis
cgaaugcccgcccuug

SEQ ID NO: 2449804 - RNA, 13 nt, Bordetella pertussis
cgaaugccggccg

SEQ ID NO: 2449805 - RNA, 21 nt, Bordetella pertussis
cgaaugccugguaggcgagca

SEQ ID NO: 2449806 - RNA, 21 nt, Bordetella pertussis
cgaaugcguguuccagcgccu

SEQ ID NO: 2449807 - RNA, 18 nt, Bordetella pertussis
cgaauggcugcgcgccgu

SEQ ID NO: 2449808 - RNA, 19 nt, Bordetella pertussis
cgaauggguccgcgugggc

SEQ ID NO: 2449809 - RNA, 20 nt, Bordetella pertussis
cgaauggucggccucggcga

SEQ ID NO: 2449810 - RNA, 20 nt, Bordetella pertussis
cgaauuccugaacgccgggc

SEQ ID NO: 2449811 - RNA, 19 nt, Bordetella pertussis
cgaauucguuggugcccag

SEQ ID NO: 2449812 - RNA, 23 nt, Bordetella pertussis
cgaauugccgccgcugccggccg

SEQ ID NO: 2449813 - RNA, 19 nt, Bordetella pertussis
cgaauugcuggagcgccac

SEQ ID NO: 2449814 - RNA, 21 nt, Bordetella pertussis
cgaauuucccggguggcgcca

SEQ ID NO: 2449815 - RNA, 17 nt, Bordetella pertussis
cgacaacaagccgggcg

SEQ ID NO: 2449816 - RNA, 20 nt, Bordetella pertussis
cgacaacaagccgggcgccg

SEQ ID NO: 2449817 - RNA, 14 nt, Bordetella pertussis
cgacaagccggucg

SEQ ID NO: 2449818 - RNA, 19 nt, Bordetella pertussis
cgacaaggagacaucaugc

SEQ ID NO: 2449819 - RNA, 17 nt, Bordetella pertussis
cgacaccaaccugcugg

SEQ ID NO: 2449820 - RNA, 16 nt, Bordetella pertussis
cgacacccccagggcg

SEQ ID NO: 2449821 - RNA, 20 nt, Bordetella pertussis
cgacacccccagggcgcgcc

SEQ ID NO: 2449822 - RNA, 18 nt, Bordetella pertussis
cgacacccgcggccaggg

SEQ ID NO: 2449823 - RNA, 17 nt, Bordetella pertussis
cgacacccggucggccc

SEQ ID NO: 2449824 - RNA, 19 nt, Bordetella pertussis
cgacaccgcggccuugccg

SEQ ID NO: 2449825 - RNA, 18 nt, Bordetella pertussis
cgacaccgucaggaagcc

SEQ ID NO: 2449826 - RNA, 24 nt, Bordetella pertussis
cgacaccgugaaggugccggacgc

SEQ ID NO: 2449827 - RNA, 12 nt, Bordetella pertussis
cgacaccgugcg

SEQ ID NO: 2449828 - RNA, 12 nt, Bordetella pertussis
cgacacgcccag

SEQ ID NO: 2449829 - RNA, 13 nt, Bordetella pertussis
cgacacgcccagc

SEQ ID NO: 2449830 - RNA, 15 nt, Bordetella pertussis
cgacacgcccagcag

SEQ ID NO: 2449831 - RNA, 16 nt, Bordetella pertussis
cgacacgccgcgcgau

SEQ ID NO: 2449832 - RNA, 21 nt, Bordetella pertussis
cgacacgccgcgcgaucgccg

SEQ ID NO: 2449833 - RNA, 14 nt, Bordetella pertussis
cgacacgcucaagg

SEQ ID NO: 2449834 - RNA, 12 nt, Bordetella pertussis
cgacacgcuggc

SEQ ID NO: 2449835 - RNA, 13 nt, Bordetella pertussis
cgacacggcggug

SEQ ID NO: 2449836 - RNA, 22 nt, Bordetella pertussis
cgacacggcggugccgcgcacc

SEQ ID NO: 2449837 - RNA, 20 nt, Bordetella pertussis
cgacacggggcaaccggccu

SEQ ID NO: 2449838 - RNA, 19 nt, Bordetella pertussis
cgacacgucaucguggccg

SEQ ID NO: 2449839 - RNA, 22 nt, Bordetella pertussis
cgacacgucaucguggccgcgc

SEQ ID NO: 2449840 - RNA, 16 nt, Bordetella pertussis
cgacagaccguagcgc

SEQ ID NO: 2449841 - RNA, 23 nt, Bordetella pertussis
cgacagaccguagcgcaggcgcu

SEQ ID NO: 2449842 - RNA, 13 nt, Bordetella pertussis
cgacagauggcgc

SEQ ID NO: 2449843 - RNA, 22 nt, Bordetella pertussis
cgacagcaaugacgacgccggc

SEQ ID NO: 2449844 - RNA, 19 nt, Bordetella pertussis
cgacagcacauggcgcgcc

SEQ ID NO: 2449845 - RNA, 20 nt, Bordetella pertussis
cgacagcacauggcgcgccg

SEQ ID NO: 2449846 - RNA, 12 nt, Bordetella pertussis
cgacagcaccaa

SEQ ID NO: 2449847 - RNA, 21 nt, Bordetella pertussis
cgacagcaccggguaauggcg

SEQ ID NO: 2449848 - RNA, 11 nt, Bordetella pertussis
cgacagcagca

SEQ ID NO: 2449849 - RNA, 19 nt, Bordetella pertussis
cgacagcagcaugcggccc

SEQ ID NO: 2449850 - RNA, 13 nt, Bordetella pertussis
cgacagcaggccg

SEQ ID NO: 2449851 - RNA, 14 nt, Bordetella pertussis
cgacagcaggccgg

SEQ ID NO: 2449852 - RNA, 15 nt, Bordetella pertussis
cgacagcaggccggu

SEQ ID NO: 2449853 - RNA, 19 nt, Bordetella pertussis
cgacagcaggccggucagg

SEQ ID NO: 2449854 - RNA, 20 nt, Bordetella pertussis
cgacagcagggccaggccca

SEQ ID NO: 2449855 - RNA, 14 nt, Bordetella pertussis
cgacagcagggucg

SEQ ID NO: 2449856 - RNA, 16 nt, Bordetella pertussis
cgacagccaggccagc

SEQ ID NO: 2449857 - RNA, 20 nt, Bordetella pertussis
cgacagccaggccagcgcca

SEQ ID NO: 2449858 - RNA, 13 nt, Bordetella pertussis
cgacagcccggga

SEQ ID NO: 2449859 - RNA, 15 nt, Bordetella pertussis
cgacagccgcgccag

SEQ ID NO: 2449860 - RNA, 21 nt, Bordetella pertussis
cgacagccuuuccuccugccg

SEQ ID NO: 2449861 - RNA, 22 nt, Bordetella pertussis
cgacagccuuuccuccugccgg

SEQ ID NO: 2449862 - RNA, 20 nt, Bordetella pertussis
cgacagcgacaacagcuugc

SEQ ID NO: 2449863 - RNA, 22 nt, Bordetella pertussis
cgacagcgacaacagcuugccc

SEQ ID NO: 2449864 - RNA, 16 nt, Bordetella pertussis
cgacagcgacacggcg

SEQ ID NO: 2449865 - RNA, 17 nt, Bordetella pertussis
cgacagcgacagccagg

SEQ ID NO: 2449866 - RNA, 13 nt, Bordetella pertussis
cgacagcgccagc

SEQ ID NO: 2449867 - RNA, 14 nt, Bordetella pertussis
cgacagcgccagcg

SEQ ID NO: 2449868 - RNA, 21 nt, Bordetella pertussis
cgacagcgcgcaggaucagcu

SEQ ID NO: 2449869 - RNA, 15 nt, Bordetella pertussis
cgacagcgcgcccgc

SEQ ID NO: 2449870 - RNA, 16 nt, Bordetella pertussis
cgacagcgcgcccgcu

SEQ ID NO: 2449871 - RNA, 18 nt, Bordetella pertussis
cgacagcgcugguggcca

SEQ ID NO: 2449872 - RNA, 19 nt, Bordetella pertussis
cgacagcgcugguggccag

SEQ ID NO: 2449873 - RNA, 19 nt, Bordetella pertussis
cgacagcggcgagcgcggc

SEQ ID NO: 2449874 - RNA, 20 nt, Bordetella pertussis
cgacagcggcgagcgcggcg

SEQ ID NO: 2449875 - RNA, 17 nt, Bordetella pertussis
cgacagcgucgagcuga

SEQ ID NO: 2449876 - RNA, 16 nt, Bordetella pertussis
cgacagcuugaugggc

SEQ ID NO: 2449877 - RNA, 21 nt, Bordetella pertussis
cgacaggaaggcgagcgcggc

SEQ ID NO: 2449878 - RNA, 22 nt, Bordetella pertussis
cgacaggaaggcgagcgcggca

SEQ ID NO: 2449879 - RNA, 16 nt, Bordetella pertussis
cgacaggaucgaaggc

SEQ ID NO: 2449880 - RNA, 19 nt, Bordetella pertussis
cgacaggcccgcggccgcg

SEQ ID NO: 2449881 - RNA, 15 nt, Bordetella pertussis
cgacaggccgaugcu

SEQ ID NO: 2449882 - RNA, 23 nt, Bordetella pertussis
cgacaggccuggcuuggcggcca

SEQ ID NO: 2449883 - RNA, 18 nt, Bordetella pertussis
cgacaggcgcagcucgac

SEQ ID NO: 2449884 - RNA, 13 nt, Bordetella pertussis
cgacaggcgcgca

SEQ ID NO: 2449885 - RNA, 20 nt, Bordetella pertussis
cgacaggcgcgcaggcgggc

SEQ ID NO: 2449886 - RNA, 13 nt, Bordetella pertussis
cgacaggcgcgcc

SEQ ID NO: 2449887 - RNA, 15 nt, Bordetella pertussis
cgacaggcgcgcccg

SEQ ID NO: 2449888 - RNA, 14 nt, Bordetella pertussis
cgacaggcggcugu

SEQ ID NO: 2449889 - RNA, 21 nt, Bordetella pertussis
cgacaggcggugcgcgcggcc

SEQ ID NO: 2449890 - RNA, 22 nt, Bordetella pertussis
cgacaggcggugcgcgcggccg

SEQ ID NO: 2449891 - RNA, 20 nt, Bordetella pertussis
cgacagggcgucgucgggac

SEQ ID NO: 2449892 - RNA, 14 nt, Bordetella pertussis
cgacaggguccagg

SEQ ID NO: 2449893 - RNA, 15 nt, Bordetella pertussis
cgacaggguccaggu

SEQ ID NO: 2449894 - RNA, 19 nt, Bordetella pertussis
cgacagguagcggucgccg

SEQ ID NO: 2449895 - RNA, 21 nt, Bordetella pertussis
cgacagguagcggucgccgcg

SEQ ID NO: 2449896 - RNA, 23 nt, Bordetella pertussis
cgacagguagcggucgccgcggu

SEQ ID NO: 2449897 - RNA, 18 nt, Bordetella pertussis
cgacauagacgcgcagcg

SEQ ID NO: 2449898 - RNA, 21 nt, Bordetella pertussis
cgacauagacgcgcagcggca

SEQ ID NO: 2449899 - RNA, 19 nt, Bordetella pertussis
cgacauagagauuguccag

SEQ ID NO: 2449900 - RNA, 22 nt, Bordetella pertussis
cgacauagagauuguccagcgg

SEQ ID NO: 2449901 - RNA, 20 nt, Bordetella pertussis
cgacauagaucuccggcgcc

SEQ ID NO: 2449902 - RNA, 23 nt, Bordetella pertussis
cgacauagaucuccggcgccugg

SEQ ID NO: 2449903 - RNA, 13 nt, Bordetella pertussis
cgacaugagcugc

SEQ ID NO: 2449904 - RNA, 20 nt, Bordetella pertussis
cgacaugccgccccaggcgu

SEQ ID NO: 2449905 - RNA, 20 nt, Bordetella pertussis
cgacaugcuggcccagcugg

SEQ ID NO: 2449906 - RNA, 16 nt, Bordetella pertussis
cgacaugucgccgcgg

SEQ ID NO: 2449907 - RNA, 12 nt, Bordetella pertussis
cgacauugcgcc

SEQ ID NO: 2449908 - RNA, 17 nt, Bordetella pertussis
cgaccaaccugaccgcc

SEQ ID NO: 2449909 - RNA, 19 nt, Bordetella pertussis
cgaccaaccugaccgccuu

SEQ ID NO: 2449910 - RNA, 16 nt, Bordetella pertussis
cgaccaacucgaggcg

SEQ ID NO: 2449911 - RNA, 21 nt, Bordetella pertussis
cgaccaacucgaggcggcgca

SEQ ID NO: 2449912 - RNA, 18 nt, Bordetella pertussis
cgaccacaucugccggua

SEQ ID NO: 2449913 - RNA, 19 nt, Bordetella pertussis
cgaccacaucugccgguaa

SEQ ID NO: 2449914 - RNA, 15 nt, Bordetella pertussis
cgaccaccagcacca

SEQ ID NO: 2449915 - RNA, 22 nt, Bordetella pertussis
cgaccaccagcaccgaugcgcc

SEQ ID NO: 2449916 - RNA, 18 nt, Bordetella pertussis
cgaccaccagcaucgcgc

SEQ ID NO: 2449917 - RNA, 12 nt, Bordetella pertussis
cgaccaccagcg

SEQ ID NO: 2449918 - RNA, 14 nt, Bordetella pertussis
cgaccaccagcgca

SEQ ID NO: 2449919 - RNA, 23 nt, Bordetella pertussis
cgaccaccaggucguacagcgcc

SEQ ID NO: 2449920 - RNA, 22 nt, Bordetella pertussis
cgaccaccgauccgaugaugcc

SEQ ID NO: 2449921 - RNA, 17 nt, Bordetella pertussis
cgaccaccugcaccgcc

SEQ ID NO: 2449922 - RNA, 18 nt, Bordetella pertussis
cgaccaccugcaccgccg

SEQ ID NO: 2449923 - RNA, 21 nt, Bordetella pertussis
cgaccaccugcaccgccgcgu

SEQ ID NO: 2449924 - RNA, 14 nt, Bordetella pertussis
cgaccacgaccuug

SEQ ID NO: 2449925 - RNA, 21 nt, Bordetella pertussis
cgaccacgaccuuggcggccg

SEQ ID NO: 2449926 - RNA, 16 nt, Bordetella pertussis
cgaccacgccggcggc

SEQ ID NO: 2449927 - RNA, 19 nt, Bordetella pertussis
cgaccacgccggcggccau

SEQ ID NO: 2449928 - RNA, 20 nt, Bordetella pertussis
cgaccacgccggcggccaug

SEQ ID NO: 2449929 - RNA, 15 nt, Bordetella pertussis
cgaccacgcgcgcgc

SEQ ID NO: 2449930 - RNA, 16 nt, Bordetella pertussis
cgaccacgcggcggug

SEQ ID NO: 2449931 - RNA, 16 nt, Bordetella pertussis
cgaccacgcugggcca

SEQ ID NO: 2449932 - RNA, 20 nt, Bordetella pertussis
cgaccacgcugggccagacc

SEQ ID NO: 2449933 - RNA, 22 nt, Bordetella pertussis
cgaccacggucuggcgcgacag

SEQ ID NO: 2449934 - RNA, 14 nt, Bordetella pertussis
cgaccacuggaagc

SEQ ID NO: 2449935 - RNA, 21 nt, Bordetella pertussis
cgaccacuggaagcugcggcc

SEQ ID NO: 2449936 - RNA, 17 nt, Bordetella pertussis
cgaccagcacgagaugu

SEQ ID NO: 2449937 - RNA, 19 nt, Bordetella pertussis
cgaccagcacgauccagcc

SEQ ID NO: 2449938 - RNA, 11 nt, Bordetella pertussis
cgaccagcagc

SEQ ID NO: 2449939 - RNA, 14 nt, Bordetella pertussis
cgaccagcagccgg

SEQ ID NO: 2449940 - RNA, 23 nt, Bordetella pertussis
cgaccagcagccgguuggcgccu

SEQ ID NO: 2449941 - RNA, 17 nt, Bordetella pertussis
cgaccagcaggcccacc

SEQ ID NO: 2449942 - RNA, 21 nt, Bordetella pertussis
cgaccagcaggcccaccaggg

SEQ ID NO: 2449943 - RNA, 15 nt, Bordetella pertussis
cgaccagcccggccg

SEQ ID NO: 2449944 - RNA, 21 nt, Bordetella pertussis
cgaccagcccggccgccagca

SEQ ID NO: 2449945 - RNA, 14 nt, Bordetella pertussis
cgaccagcgacagc

SEQ ID NO: 2449946 - RNA, 17 nt, Bordetella pertussis
cgaccagcgcacggucg

SEQ ID NO: 2449947 - RNA, 20 nt, Bordetella pertussis
cgaccagcgcacggucgaag

SEQ ID NO: 2449948 - RNA, 16 nt, Bordetella pertussis
cgaccagcgcgcgccg

SEQ ID NO: 2449949 - RNA, 18 nt, Bordetella pertussis
cgaccagcgcgcgccggc

SEQ ID NO: 2449950 - RNA, 20 nt, Bordetella pertussis
cgaccagcgcgcggugccgc

SEQ ID NO: 2449951 - RNA, 14 nt, Bordetella pertussis
cgaccaggaccugu

SEQ ID NO: 2449952 - RNA, 15 nt, Bordetella pertussis
cgaccaggaccugua

SEQ ID NO: 2449953 - RNA, 15 nt, Bordetella pertussis
cgaccaggcccgcca

SEQ ID NO: 2449954 - RNA, 20 nt, Bordetella pertussis
cgaccaggcccgccacggcg

SEQ ID NO: 2449955 - RNA, 21 nt, Bordetella pertussis
cgaccaggcccgccacggcgc

SEQ ID NO: 2449956 - RNA, 13 nt, Bordetella pertussis
cgaccaggccggc

SEQ ID NO: 2449957 - RNA, 16 nt, Bordetella pertussis
cgaccaggccguggcc

SEQ ID NO: 2449958 - RNA, 19 nt, Bordetella pertussis
cgaccaggccguggcccag

SEQ ID NO: 2449959 - RNA, 12 nt, Bordetella pertussis
cgaccaggcugc

SEQ ID NO: 2449960 - RNA, 16 nt, Bordetella pertussis
cgaccaggcugcgcgc

SEQ ID NO: 2449961 - RNA, 20 nt, Bordetella pertussis
cgaccaggcugcgcgccggc

SEQ ID NO: 2449962 - RNA, 22 nt, Bordetella pertussis
cgaccaggcugcgcgccggcgc

SEQ ID NO: 2449963 - RNA, 23 nt, Bordetella pertussis
cgaccaggcugcgcgccggcgcc

SEQ ID NO: 2449964 - RNA, 23 nt, Bordetella pertussis
cgaccagguaucgacccaggccg

SEQ ID NO: 2449965 - RNA, 22 nt, Bordetella pertussis
cgaccaggucgaagcacugcag

SEQ ID NO: 2449966 - RNA, 18 nt, Bordetella pertussis
cgaccaggucgccguacu

SEQ ID NO: 2449967 - RNA, 15 nt, Bordetella pertussis
cgaccaggucgggca

SEQ ID NO: 2449968 - RNA, 21 nt, Bordetella pertussis
cgaccaggugcgggccgcuca

SEQ ID NO: 2449969 - RNA, 17 nt, Bordetella pertussis
cgaccaguucggccagc

SEQ ID NO: 2449970 - RNA, 20 nt, Bordetella pertussis
cgaccaguucggccagcagc

SEQ ID NO: 2449971 - RNA, 16 nt, Bordetella pertussis
cgaccaucauggccag

SEQ ID NO: 2449972 - RNA, 17 nt, Bordetella pertussis
cgaccaucauggccagg

SEQ ID NO: 2449973 - RNA, 18 nt, Bordetella pertussis
cgaccaucauggccaggg

SEQ ID NO: 2449974 - RNA, 20 nt, Bordetella pertussis
cgaccaucauggccagggcc

SEQ ID NO: 2449975 - RNA, 14 nt, Bordetella pertussis
cgaccaugcggccg

SEQ ID NO: 2449976 - RNA, 17 nt, Bordetella pertussis
cgaccaugcggccgucg

SEQ ID NO: 2449977 - RNA, 17 nt, Bordetella pertussis
cgaccauguccgcgccc

SEQ ID NO: 2449978 - RNA, 18 nt, Bordetella pertussis
cgaccauguccgcgccca

SEQ ID NO: 2449979 - RNA, 22 nt, Bordetella pertussis
cgaccauuucgauuucggcggc

SEQ ID NO: 2449980 - RNA, 19 nt, Bordetella pertussis
cgacccaccuggccacaag

SEQ ID NO: 2449981 - RNA, 21 nt, Bordetella pertussis
cgacccacuugagcagcgccu

SEQ ID NO: 2449982 - RNA, 18 nt, Bordetella pertussis
cgacccagaacccggccg

SEQ ID NO: 2449983 - RNA, 22 nt, Bordetella pertussis
cgacccagaacccggccggcgc

SEQ ID NO: 2449984 - RNA, 18 nt, Bordetella pertussis
cgacccaggccggcgcca

SEQ ID NO: 2449985 - RNA, 14 nt, Bordetella pertussis
cgacccccggcccg

SEQ ID NO: 2449986 - RNA, 15 nt, Bordetella pertussis
cgacccccggcccgc

SEQ ID NO: 2449987 - RNA, 19 nt, Bordetella pertussis
cgaccccgccgugccgggc

SEQ ID NO: 2449988 - RNA, 20 nt, Bordetella pertussis
cgaccccgccgugccgggcc

SEQ ID NO: 2449989 - RNA, 21 nt, Bordetella pertussis
cgaccccgccgugccgggccu

SEQ ID NO: 2449990 - RNA, 19 nt, Bordetella pertussis
cgacccgaaggcgcggccg

SEQ ID NO: 2449991 - RNA, 15 nt, Bordetella pertussis
cgacccgagcccugg

SEQ ID NO: 2449992 - RNA, 18 nt, Bordetella pertussis
cgacccgauagccgcgcg

SEQ ID NO: 2449993 - RNA, 17 nt, Bordetella pertussis
cgacccgcaccgacggg

SEQ ID NO: 2449994 - RNA, 13 nt, Bordetella pertussis
cgacccgcgccuc

SEQ ID NO: 2449995 - RNA, 14 nt, Bordetella pertussis
cgacccgcggcccu

SEQ ID NO: 2449996 - RNA, 18 nt, Bordetella pertussis
cgacccgcggcccuugcg

SEQ ID NO: 2449997 - RNA, 15 nt, Bordetella pertussis
cgacccgcucggcca

SEQ ID NO: 2449998 - RNA, 13 nt, Bordetella pertussis
cgacccguggccc

SEQ ID NO: 2449999 - RNA, 16 nt, Bordetella pertussis
cgacccguggcccggg

SEQ ID NO: 2450000 - RNA, 15 nt, Bordetella pertussis
cgacccucagcccgc

SEQ ID NO: 2450001 - RNA, 22 nt, Bordetella pertussis
cgcccggccugcgggcgccgcg

SEQ ID NO: 2450002 - RNA, 14 nt, Bordetella pertussis
cgcccggcgccgcg

SEQ ID NO: 2450003 - RNA, 15 nt, Bordetella pertussis
cgcccggcggccagg

SEQ ID NO: 2450004 - RNA, 16 nt, Bordetella pertussis
cgcccggcggccaggc

SEQ ID NO: 2450005 - RNA, 16 nt, Bordetella pertussis
cgcccggcggcgcgcc

SEQ ID NO: 2450006 - RNA, 17 nt, Bordetella pertussis
cgcccggcggcgcgccg

SEQ ID NO: 2450007 - RNA, 18 nt, Bordetella pertussis
cgcccggcggcgcgccgc

SEQ ID NO: 2450008 - RNA, 19 nt, Bordetella pertussis
cgcccggcggcgcgccgcc

SEQ ID NO: 2450009 - RNA, 16 nt, Bordetella pertussis
cgcccggcggcgcgcu

SEQ ID NO: 2450010 - RNA, 15 nt, Bordetella pertussis
cgcccggcggcgcgg

SEQ ID NO: 2450011 - RNA, 16 nt, Bordetella pertussis
cgcccggcggcgcggc

SEQ ID NO: 2450012 - RNA, 18 nt, Bordetella pertussis
cgcccggcggcgcggcga

SEQ ID NO: 2450013 - RNA, 19 nt, Bordetella pertussis
cgcccggcggcgcggcgag

SEQ ID NO: 2450014 - RNA, 12 nt, Bordetella pertussis
cgcccggcguga

SEQ ID NO: 2450015 - RNA, 20 nt, Bordetella pertussis
cgcccggcgugacgcugacc

SEQ ID NO: 2450016 - RNA, 15 nt, Bordetella pertussis
cgcccggcuccaggc

SEQ ID NO: 2450017 - RNA, 22 nt, Bordetella pertussis
cgcccggcuccaggccgcccag

SEQ ID NO: 2450018 - RNA, 15 nt, Bordetella pertussis
cgcccggcucgcugu

SEQ ID NO: 2450019 - RNA, 19 nt, Bordetella pertussis
cgcccgggccggcuacagc

SEQ ID NO: 2450020 - RNA, 21 nt, Bordetella pertussis
cgcccgggccgucuacaggcc

SEQ ID NO: 2450021 - RNA, 16 nt, Bordetella pertussis
cgcccgggcgccggca

SEQ ID NO: 2450022 - RNA, 14 nt, Bordetella pertussis
cgcccgggcugauc

SEQ ID NO: 2450023 - RNA, 18 nt, Bordetella pertussis
cgcccgggcugauccgca

SEQ ID NO: 2450024 - RNA, 14 nt, Bordetella pertussis
cgcccgggcugccg

SEQ ID NO: 2450025 - RNA, 18 nt, Bordetella pertussis
cgcccggggcggcgucga

SEQ ID NO: 2450026 - RNA, 23 nt, Bordetella pertussis
cgcccgggguugggaucgcgcca

SEQ ID NO: 2450027 - RNA, 17 nt, Bordetella pertussis
cgcccggguuggcgucc

SEQ ID NO: 2450028 - RNA, 20 nt, Bordetella pertussis
cgcccggguuggcguccagg

SEQ ID NO: 2450029 - RNA, 21 nt, Bordetella pertussis
cgcccggguuggcguccaggc

SEQ ID NO: 2450030 - RNA, 15 nt, Bordetella pertussis
cgcccggugccugcc

SEQ ID NO: 2450031 - RNA, 23 nt, Bordetella pertussis
cgcccggugccugccccugcggg

SEQ ID NO: 2450032 - RNA, 14 nt, Bordetella pertussis
cgcccggugcgcgc

SEQ ID NO: 2450033 - RNA, 19 nt, Bordetella pertussis
cgcccggugcguaccagcc

SEQ ID NO: 2450034 - RNA, 22 nt, Bordetella pertussis
cgcccggugcguaccagcccag

SEQ ID NO: 2450035 - RNA, 18 nt, Bordetella pertussis
cgcccgguucgccgucgu

SEQ ID NO: 2450036 - RNA, 15 nt, Bordetella pertussis
cgcccguccacggcc

SEQ ID NO: 2450037 - RNA, 23 nt, Bordetella pertussis
cgcccguccacggccugcgcgcc

SEQ ID NO: 2450038 - RNA, 15 nt, Bordetella pertussis
cgcccgucccgaccc

SEQ ID NO: 2450039 - RNA, 17 nt, Bordetella pertussis
cgcccguccgggcggcg

SEQ ID NO: 2450040 - RNA, 20 nt, Bordetella pertussis
cgcccguccgggcggcguug

SEQ ID NO: 2450041 - RNA, 16 nt, Bordetella pertussis
cgcccgucucgcgcgc

SEQ ID NO: 2450042 - RNA, 17 nt, Bordetella pertussis
cgcccgucucgcgcgcc

SEQ ID NO: 2450043 - RNA, 18 nt, Bordetella pertussis
cgcccgucucgcgcgcca

SEQ ID NO: 2450044 - RNA, 21 nt, Bordetella pertussis
cgcccgucucgcgcgccaggu

SEQ ID NO: 2450045 - RNA, 18 nt, Bordetella pertussis
cgcccgugcagaagcuga

SEQ ID NO: 2450046 - RNA, 20 nt, Bordetella pertussis
cgcccgugcagaagcugacc

SEQ ID NO: 2450047 - RNA, 23 nt, Bordetella pertussis
cgcccgugcagaagcugaccacc

SEQ ID NO: 2450048 - RNA, 14 nt, Bordetella pertussis
cgcccgugcgcggc

SEQ ID NO: 2450049 - RNA, 22 nt, Bordetella pertussis
cgcccgugcgcggcgagccgcg

SEQ ID NO: 2450050 - RNA, 20 nt, Bordetella pertussis
cgcccgugcuuuugaacucc

SEQ ID NO: 2450051 - RNA, 18 nt, Bordetella pertussis
cgcccgugucgccgucgg

SEQ ID NO: 2450052 - RNA, 14 nt, Bordetella pertussis
cgcccgugucggua

SEQ ID NO: 2450053 - RNA, 15 nt, Bordetella pertussis
cgcccguugcggcgc

SEQ ID NO: 2450054 - RNA, 16 nt, Bordetella pertussis
cgcccguugcggcgcc

SEQ ID NO: 2450055 - RNA, 18 nt, Bordetella pertussis
cgcccguugcggcgccuc

SEQ ID NO: 2450056 - RNA, 13 nt, Bordetella pertussis
cgcccucgccccc

SEQ ID NO: 2450057 - RNA, 13 nt, Bordetella pertussis
cgcccucgcgcca

SEQ ID NO: 2450058 - RNA, 16 nt, Bordetella pertussis
cgcccucguugacgcc

SEQ ID NO: 2450059 - RNA, 17 nt, Bordetella pertussis
cgcccucguugacgccg

SEQ ID NO: 2450060 - RNA, 18 nt, Bordetella pertussis
cgcccucuuccguuggcc

SEQ ID NO: 2450061 - RNA, 18 nt, Bordetella pertussis
cgcccugaacuauggcgc

SEQ ID NO: 2450062 - RNA, 19 nt, Bordetella pertussis
cgcccugaacuauggcgcg

SEQ ID NO: 2450063 - RNA, 21 nt, Bordetella pertussis
cgcccugaacuauggcgcgcg

SEQ ID NO: 2450064 - RNA, 17 nt, Bordetella pertussis
cgcccugacgaccaacc

SEQ ID NO: 2450065 - RNA, 20 nt, Bordetella pertussis
gcugaaccugcuggccgccg

SEQ ID NO: 2450066 - RNA, 23 nt, Bordetella pertussis
gcugaaccugcuggccgccggcg

SEQ ID NO: 2450067 - RNA, 17 nt, Bordetella pertussis
gcugaacgccucgggcu

SEQ ID NO: 2450068 - RNA, 22 nt, Bordetella pertussis
gcugaacguguaggucagcgcc

SEQ ID NO: 2450069 - RNA, 23 nt, Bordetella pertussis
gcugaacguguaggucagcgccu

SEQ ID NO: 2450070 - RNA, 13 nt, Bordetella pertussis
gcugaagcgccgc

SEQ ID NO: 2450071 - RNA, 14 nt, Bordetella pertussis
gcugaagcgccgcc

SEQ ID NO: 2450072 - RNA, 23 nt, Bordetella pertussis
gcugaagcgccgccacaggcuga

SEQ ID NO: 2450073 - RNA, 20 nt, Bordetella pertussis
gcugaaggggcuccccugcu

SEQ ID NO: 2450074 - RNA, 22 nt, Bordetella pertussis
gcugaaggucgcuucgguggcg

SEQ ID NO: 2450075 - RNA, 20 nt, Bordetella pertussis
gcugaauccggggugccugu

SEQ ID NO: 2450076 - RNA, 23 nt, Bordetella pertussis
gcugaauccggggugccuguccu

SEQ ID NO: 2450077 - RNA, 14 nt, Bordetella pertussis
gcugaaugccgccg

SEQ ID NO: 2450078 - RNA, 17 nt, Bordetella pertussis
gcugaauugcgggccgg

SEQ ID NO: 2450079 - RNA, 20 nt, Bordetella pertussis
gcugaauugcgggccggcga

SEQ ID NO: 2450080 - RNA, 15 nt, Bordetella pertussis
gcugaauuggcgccc

SEQ ID NO: 2450081 - RNA, 12 nt, Bordetella pertussis
gcugaccaccgg

SEQ ID NO: 2450082 - RNA, 12 nt, Bordetella pertussis
gcugaccagcac

SEQ ID NO: 2450083 - RNA, 13 nt, Bordetella pertussis
gcugaccagcagc

SEQ ID NO: 2450084 - RNA, 17 nt, Bordetella pertussis
gcugaccagcagcaccg

SEQ ID NO: 2450085 - RNA, 17 nt, Bordetella pertussis
gcugaccagcgcgucgc

SEQ ID NO: 2450086 - RNA, 14 nt, Bordetella pertussis
gcugaccgaagcgc

SEQ ID NO: 2450087 - RNA, 19 nt, Bordetella pertussis
gcugaccgaagcgcgggcg

SEQ ID NO: 2450088 - RNA, 17 nt, Bordetella pertussis
gcugaccgaagcgggcg

SEQ ID NO: 2450089 - RNA, 19 nt, Bordetella pertussis
gcugaccgaagcgggcgag

SEQ ID NO: 2450090 - RNA, 18 nt, Bordetella pertussis
gcugaccgagggcgcguc

SEQ ID NO: 2450091 - RNA, 14 nt, Bordetella pertussis
gcugaccggccugg

SEQ ID NO: 2450092 - RNA, 15 nt, Bordetella pertussis
gcugaccggccuggu

SEQ ID NO: 2450093 - RNA, 18 nt, Bordetella pertussis
gcugaccggccuggucau

SEQ ID NO: 2450094 - RNA, 21 nt, Bordetella pertussis
gcugaccggcggcacggccgg

SEQ ID NO: 2450095 - RNA, 22 nt, Bordetella pertussis
gcugaccggcguauggcccgcc

SEQ ID NO: 2450096 - RNA, 20 nt, Bordetella pertussis
gcugaccggcuucccguggc

SEQ ID NO: 2450097 - RNA, 23 nt, Bordetella pertussis
gcugaccggcuucccguggcuga

SEQ ID NO: 2450098 - RNA, 20 nt, Bordetella pertussis
gcugaccucgcccaggccgg

SEQ ID NO: 2450099 - RNA, 22 nt, Bordetella pertussis
gcugaccugcacgauggcgccg

SEQ ID NO: 2450100 - RNA, 12 nt, Bordetella pertussis
gcugaccuggug

SEQ ID NO: 2450101 - RNA, 19 nt, Bordetella pertussis
gcugaccuggugugccugu

SEQ ID NO: 2450102 - RNA, 18 nt, Bordetella pertussis
gcugacgauguucaggcc

SEQ ID NO: 2450103 - RNA, 17 nt, Bordetella pertussis
gcugacgcccggcucgc

SEQ ID NO: 2450104 - RNA, 14 nt, Bordetella pertussis
gcugacggacuggu

SEQ ID NO: 2450105 - RNA, 15 nt, Bordetella pertussis
gcugacggugccggc

SEQ ID NO: 2450106 - RNA, 18 nt, Bordetella pertussis
gcugacugcggugccugu

SEQ ID NO: 2450107 - RNA, 21 nt, Bordetella pertussis
gcugacuuccggggagccugc

SEQ ID NO: 2450108 - RNA, 16 nt, Bordetella pertussis
gcugagaucguccagc

SEQ ID NO: 2450109 - RNA, 17 nt, Bordetella pertussis
gcugagaucguccagcg

SEQ ID NO: 2450110 - RNA, 19 nt, Bordetella pertussis
gcugagaucguccagcgac

SEQ ID NO: 2450111 - RNA, 20 nt, Bordetella pertussis
gcugagaucguccagcgacu

SEQ ID NO: 2450112 - RNA, 15 nt, Bordetella pertussis
gcugagcaccagcag

SEQ ID NO: 2450113 - RNA, 14 nt, Bordetella pertussis
gcugagcaggccga

SEQ ID NO: 2450114 - RNA, 13 nt, Bordetella pertussis
gcugagcgacaug

SEQ ID NO: 2450115 - RNA, 22 nt, Bordetella pertussis
gcugagcgacaugucgccgcgg

SEQ ID NO: 2450116 - RNA, 23 nt, Bordetella pertussis
gcugaucacccacagcagcgcgc

SEQ ID NO: 2450117 - RNA, 14 nt, Bordetella pertussis
gcugaucaccgccg

SEQ ID NO: 2450118 - RNA, 13 nt, Bordetella pertussis
gcugauccaggug

SEQ ID NO: 2450119 - RNA, 17 nt, Bordetella pertussis
gcugauccucgccagcg

SEQ ID NO: 2450120 - RNA, 13 nt, Bordetella pertussis
gcugauccuggcu

SEQ ID NO: 2450121 - RNA, 18 nt, Bordetella pertussis
gcugaucgaucgcccgcu

SEQ ID NO: 2450122 - RNA, 17 nt, Bordetella pertussis
gcugaucgccggcgccc

SEQ ID NO: 2450123 - RNA, 19 nt, Bordetella pertussis
gcugaucgccggcgccccc

SEQ ID NO: 2450124 - RNA, 14 nt, Bordetella pertussis
gcugaucggccgac

SEQ ID NO: 2450125 - RNA, 22 nt, Bordetella pertussis
gcugaucugcuugaggccgcgc

SEQ ID NO: 2450126 - RNA, 20 nt, Bordetella pertussis
gcugaucuugaugcggccgu

SEQ ID NO: 2450127 - RNA, 14 nt, Bordetella pertussis
gcugaugcccagcc

SEQ ID NO: 2450128 - RNA, 16 nt, Bordetella pertussis
gcugaugcccuucggc

SEQ ID NO: 2450129 - RNA, 12 nt, Bordetella pertussis
gcugaugcgcgg

SEQ ID NO: 2450130 - RNA, 14 nt, Bordetella pertussis
gcugaugcgcggcg

SEQ ID NO: 2450131 - RNA, 16 nt, Bordetella pertussis
gcugaugcgcggcggg

SEQ ID NO: 2450132 - RNA, 13 nt, Bordetella pertussis
gcugaugcgcguc

SEQ ID NO: 2450133 - RNA, 18 nt, Bordetella pertussis
gcugaugcgcgucaggcg

SEQ ID NO: 2450134 - RNA, 23 nt, Bordetella pertussis
gcugaugcgcgucaggcgagcgc

SEQ ID NO: 2450135 - RNA, 15 nt, Bordetella pertussis
gcugaugcucgcccu

SEQ ID NO: 2450136 - RNA, 23 nt, Bordetella pertussis
gcugauggccgccagcggcuggc

SEQ ID NO: 2450137 - RNA, 15 nt, Bordetella pertussis
gcugauggccuugga

SEQ ID NO: 2450138 - RNA, 15 nt, Bordetella pertussis
gcugauggcggucac

SEQ ID NO: 2450139 - RNA, 21 nt, Bordetella pertussis
gcugauucgcgucguugcgcc

SEQ ID NO: 2450140 - RNA, 16 nt, Bordetella pertussis
gcugcaaggcagccug

SEQ ID NO: 2450141 - RNA, 19 nt, Bordetella pertussis
gcugcaaggcagccugucg

SEQ ID NO: 2450142 - RNA, 17 nt, Bordetella pertussis
gcugcaauugcgcggcc

SEQ ID NO: 2450143 - RNA, 13 nt, Bordetella pertussis
gcugcaccagcgc

SEQ ID NO: 2450144 - RNA, 16 nt, Bordetella pertussis
gcugcaccagcgcgcc

SEQ ID NO: 2450145 - RNA, 19 nt, Bordetella pertussis
gcugcaccagcgcgccgcg

SEQ ID NO: 2450146 - RNA, 20 nt, Bordetella pertussis
gcugcaccagcgcgccgcgc

SEQ ID NO: 2450147 - RNA, 23 nt, Bordetella pertussis
gcugcacccacacuuggccggcg

SEQ ID NO: 2450148 - RNA, 21 nt, Bordetella pertussis
gcugcaccugcgucugcacgc

SEQ ID NO: 2450149 - RNA, 20 nt, Bordetella pertussis
gcugcacgauguugccgccg

SEQ ID NO: 2450150 - RNA, 14 nt, Bordetella pertussis
gcugcacgcagcgc

SEQ ID NO: 2450151 - RNA, 16 nt, Bordetella pertussis
gcugcacgcagcgcag

SEQ ID NO: 2450152 - RNA, 14 nt, Bordetella pertussis
gcugcacgcggccg

SEQ ID NO: 2450153 - RNA, 19 nt, Bordetella pertussis
gcugcacgugaugcaggcg

SEQ ID NO: 2450154 - RNA, 17 nt, Bordetella pertussis
gcugcagaucaucgagc

SEQ ID NO: 2450155 - RNA, 17 nt, Bordetella pertussis
gcugcagaucaucggcg

SEQ ID NO: 2450156 - RNA, 19 nt, Bordetella pertussis
gcugcagaucaucggcgcc

SEQ ID NO: 2450157 - RNA, 23 nt, Bordetella pertussis
gcugcagaucaucggcgccauca

SEQ ID NO: 2450158 - RNA, 21 nt, Bordetella pertussis
gcugcagcacgcaccaggcgc

SEQ ID NO: 2450159 - RNA, 22 nt, Bordetella pertussis
gcugcagcacgcaccaggcgca

SEQ ID NO: 2450160 - RNA, 21 nt, Bordetella pertussis
gcugcagccaguugggccagg

SEQ ID NO: 2450161 - RNA, 13 nt, Bordetella pertussis
gcugcagcccggc

SEQ ID NO: 2450162 - RNA, 14 nt, Bordetella pertussis
gcugcagcccggcc

SEQ ID NO: 2450163 - RNA, 24 nt, Bordetella pertussis
gcugcagcccggccagagccugga

SEQ ID NO: 2450164 - RNA, 13 nt, Bordetella pertussis
gcugcagcgacuc

SEQ ID NO: 2450165 - RNA, 12 nt, Bordetella pertussis
gcugcagcgcag

SEQ ID NO: 2450166 - RNA, 17 nt, Bordetella pertussis
gcugcagcgcaggaugg

SEQ ID NO: 2450167 - RNA, 18 nt, Bordetella pertussis
gcugcagcgcaggauggg

SEQ ID NO: 2450168 - RNA, 17 nt, Bordetella pertussis
gcugcagcgcaucgccg

SEQ ID NO: 2450169 - RNA, 14 nt, Bordetella pertussis
gcugcagcgcuggu

SEQ ID NO: 2450170 - RNA, 19 nt, Bordetella pertussis
gcugcaggaucgcggccag

SEQ ID NO: 2450171 - RNA, 20 nt, Bordetella pertussis
gcugcaggaucgcggccagc

SEQ ID NO: 2450172 - RNA, 22 nt, Bordetella pertussis
gcugcaggaucgcggccagcgg

SEQ ID NO: 2450173 - RNA, 23 nt, Bordetella pertussis
gcugcaggaucgcggccagcggc

SEQ ID NO: 2450174 - RNA, 21 nt, Bordetella pertussis
gcugcaggcccuggagaucgc

SEQ ID NO: 2450175 - RNA, 17 nt, Bordetella pertussis
gcugcaggccggcgcgc

SEQ ID NO: 2450176 - RNA, 18 nt, Bordetella pertussis
gcugcaggccggcgcgca

SEQ ID NO: 2450177 - RNA, 20 nt, Bordetella pertussis
gcugcaggccggcgcgcauc

SEQ ID NO: 2450178 - RNA, 14 nt, Bordetella pertussis
gcugcagggccugg

SEQ ID NO: 2450179 - RNA, 23 nt, Bordetella pertussis
gcugcaggucgggauaguccagc

SEQ ID NO: 2450180 - RNA, 22 nt, Bordetella pertussis
gcugcaguaugcaaccggcacg

SEQ ID NO: 2450181 - RNA, 17 nt, Bordetella pertussis
gcugcaguugcgccacg

SEQ ID NO: 2450182 - RNA, 15 nt, Bordetella pertussis
gcugcauacgccgcu

SEQ ID NO: 2450183 - RNA, 19 nt, Bordetella pertussis
gcugcauacgccgcugaug

SEQ ID NO: 2450184 - RNA, 22 nt, Bordetella pertussis
gcugcauacgccgcugauggcg

SEQ ID NO: 2450185 - RNA, 17 nt, Bordetella pertussis
gcugcaugccccaacgg

SEQ ID NO: 2450186 - RNA, 14 nt, Bordetella pertussis
gcugcaugcgcacg

SEQ ID NO: 2450187 - RNA, 21 nt, Bordetella pertussis
gcugcaugcgcacggacagcc

SEQ ID NO: 2450188 - RNA, 21 nt, Bordetella pertussis
gcugcaugcgcgaacgcgcgc

SEQ ID NO: 2450189 - RNA, 15 nt, Bordetella pertussis
gcugcaugggcggcc

SEQ ID NO: 2450190 - RNA, 14 nt, Bordetella pertussis
gcugccagccaugu

SEQ ID NO: 2450191 - RNA, 23 nt, Bordetella pertussis
gcugccagccauguucgaccagg

SEQ ID NO: 2450192 - RNA, 23 nt, Bordetella pertussis
gcugccaggcuaucguggcuggc

SEQ ID NO: 2450193 - RNA, 14 nt, Bordetella pertussis
gcugccaugccgcg

SEQ ID NO: 2450194 - RNA, 15 nt, Bordetella pertussis
gcugccaugccgcgc

SEQ ID NO: 2450195 - RNA, 17 nt, Bordetella pertussis
gcugccaugccgcgcgc

SEQ ID NO: 2450196 - RNA, 18 nt, Bordetella pertussis
gcugccaugccgcgcgcc

SEQ ID NO: 2450197 - RNA, 19 nt, Bordetella pertussis
gcugccaugccgcgcgccu

SEQ ID NO: 2450198 - RNA, 17 nt, Bordetella pertussis
gcugccauuccagcucc

SEQ ID NO: 2450199 - RNA, 23 nt, Bordetella pertussis
gcugccauuccagcuccggcggc

SEQ ID NO: 2450200 - RNA, 18 nt, Bordetella pertussis
gcugcccaccgccguggc

SEQ ID NO: 2450201 - RNA, 19 nt, Bordetella pertussis
gcugcccaccgccguggcc

SEQ ID NO: 2450202 - RNA, 13 nt, Bordetella pertussis
gcugcccagccac

SEQ ID NO: 2450203 - RNA, 14 nt, Bordetella pertussis
gcugcccagccaca

SEQ ID NO: 2450204 - RNA, 20 nt, Bordetella pertussis
gcugcccagccacaccaggu

SEQ ID NO: 2450205 - RNA, 21 nt, Bordetella pertussis
gcugcccaggauggagagggc

SEQ ID NO: 2450206 - RNA, 17 nt, Bordetella pertussis
gcugcccgaagcgcagc

SEQ ID NO: 2450207 - RNA, 13 nt, Bordetella pertussis
gcugcccgacgac

SEQ ID NO: 2450208 - RNA, 18 nt, Bordetella pertussis
gcugcccgacggcgccga

SEQ ID NO: 2450209 - RNA, 18 nt, Bordetella pertussis
gcugcccgccgccgccca

SEQ ID NO: 2450210 - RNA, 19 nt, Bordetella pertussis
gcugcccgccgccgcccac

SEQ ID NO: 2450211 - RNA, 16 nt, Bordetella pertussis
gcugcccgucgcuggc

SEQ ID NO: 2450212 - RNA, 16 nt, Bordetella pertussis
gcugcccucgcccgug

SEQ ID NO: 2450213 - RNA, 22 nt, Bordetella pertussis
gcugcccucgcccgugcgcggu

SEQ ID NO: 2450214 - RNA, 20 nt, Bordetella pertussis
gcugcccucggucagcgcca

SEQ ID NO: 2450215 - RNA, 14 nt, Bordetella pertussis
gcugcccugcauga

SEQ ID NO: 2450216 - RNA, 19 nt, Bordetella pertussis
gcugcccugcaugaccgcc

SEQ ID NO: 2450217 - RNA, 13 nt, Bordetella pertussis
gcugcccugcugc

SEQ ID NO: 2450218 - RNA, 14 nt, Bordetella pertussis
gcugcccugcugcu

SEQ ID NO: 2450219 - RNA, 18 nt, Bordetella pertussis
gcugcccugcugcugcag

SEQ ID NO: 2450220 - RNA, 18 nt, Bordetella pertussis
gcugcccuggcccaggcc

SEQ ID NO: 2450221 - RNA, 14 nt, Bordetella pertussis
gcugcccuggcgcu

SEQ ID NO: 2450222 - RNA, 14 nt, Bordetella pertussis
gcugcccuugcugu

SEQ ID NO: 2450223 - RNA, 17 nt, Bordetella pertussis
gcugccgaaucggcccc

SEQ ID NO: 2450224 - RNA, 14 nt, Bordetella pertussis
gcugccgagacggc

SEQ ID NO: 2450225 - RNA, 19 nt, Bordetella pertussis
gcugccgagacggccgccg

SEQ ID NO: 2450226 - RNA, 20 nt, Bordetella pertussis
gcugccgagacggccgccga

SEQ ID NO: 2450227 - RNA, 23 nt, Bordetella pertussis
gcugccgagacggccgccgacgc

SEQ ID NO: 2450228 - RNA, 22 nt, Bordetella pertussis
gcugccgauacgggcgcggcgu

SEQ ID NO: 2450229 - RNA, 17 nt, Bordetella pertussis
gcugccgcgcgauccgg

SEQ ID NO: 2450230 - RNA, 20 nt, Bordetella pertussis
gcugccgcugcccaccuucc

SEQ ID NO: 2450231 - RNA, 18 nt, Bordetella pertussis
gcugccggaaacccgggc

SEQ ID NO: 2450232 - RNA, 15 nt, Bordetella pertussis
gcugccggauuggcg

SEQ ID NO: 2450233 - RNA, 18 nt, Bordetella pertussis
gcugccggauuggcgcug

SEQ ID NO: 2450234 - RNA, 10 nt, Bordetella pertussis
gcugccggca

SEQ ID NO: 2450235 - RNA, 21 nt, Bordetella pertussis
gcugccggccgaccggcgcgc

SEQ ID NO: 2450236 - RNA, 23 nt, Bordetella pertussis
gcugccggcguccugcggcggca

SEQ ID NO: 2450237 - RNA, 14 nt, Bordetella pertussis
gcugccgggcauga

SEQ ID NO: 2450238 - RNA, 15 nt, Bordetella pertussis
gcugccgggcaugaa

SEQ ID NO: 2450239 - RNA, 16 nt, Bordetella pertussis
gcugccgggcucggcc

SEQ ID NO: 2450240 - RNA, 20 nt, Bordetella pertussis
gcugccgggcucggccacca

SEQ ID NO: 2450241 - RNA, 18 nt, Bordetella pertussis
gcugccguagcccagguc

SEQ ID NO: 2450242 - RNA, 21 nt, Bordetella pertussis
gcugccguccuugugccaggu

SEQ ID NO: 2450243 - RNA, 22 nt, Bordetella pertussis
gcugccguccuugugccaggug

SEQ ID NO: 2450244 - RNA, 13 nt, Bordetella pertussis
gcugccgucgcca

SEQ ID NO: 2450245 - RNA, 22 nt, Bordetella pertussis
gcugccgucgccaaagcgcagc

SEQ ID NO: 2450246 - RNA, 23 nt, Bordetella pertussis
gcugccgucgccaaagcgcagcg

SEQ ID NO: 2450247 - RNA, 16 nt, Bordetella pertussis
gcugccgucggccagc

SEQ ID NO: 2450248 - RNA, 16 nt, Bordetella pertussis
gcugccgucgucgucc

SEQ ID NO: 2450249 - RNA, 23 nt, Bordetella pertussis
gcugccgucgucguccaggcgca

SEQ ID NO: 2450250 - RNA, 16 nt, Bordetella pertussis
gcugccgugaggcagc

SEQ ID NO: 2450251 - RNA, 18 nt, Bordetella pertussis
gcugccgugaggcagccu

SEQ ID NO: 2450252 - RNA, 21 nt, Bordetella pertussis
gcugccguuucucaacccgcc

SEQ ID NO: 2450253 - RNA, 22 nt, Bordetella pertussis
gcugccguuucucaacccgccg

SEQ ID NO: 2450254 - RNA, 21 nt, Bordetella pertussis
gcugccguuuucgaucagggc

SEQ ID NO: 2450255 - RNA, 17 nt, Bordetella pertussis
gcugccugagcaccgcc

SEQ ID NO: 2450256 - RNA, 14 nt, Bordetella pertussis
gcugccugccggcc

SEQ ID NO: 2450257 - RNA, 21 nt, Bordetella pertussis
gcugcgaaaaagcccgcgcca

SEQ ID NO: 2450258 - RNA, 22 nt, Bordetella pertussis
gcugcgaaaaagcccgcgccac

SEQ ID NO: 2450259 - RNA, 15 nt, Bordetella pertussis
gcugcgaaacagcag

SEQ ID NO: 2450260 - RNA, 16 nt, Bordetella pertussis
gcugcgaaacagcagc

SEQ ID NO: 2450261 - RNA, 13 nt, Bordetella pertussis
gcugcgaaagcgc

SEQ ID NO: 2450262 - RNA, 16 nt, Bordetella pertussis
gcugcgaaagcgcguc

SEQ ID NO: 2450263 - RNA, 20 nt, Bordetella pertussis
gcugcgacagcagggccagg

SEQ ID NO: 2450264 - RNA, 21 nt, Bordetella pertussis
gcugcgacagcagggccaggc

SEQ ID NO: 2450265 - RNA, 23 nt, Bordetella pertussis
gcugcgacagcagggccaggccc

SEQ ID NO: 2450266 - RNA, 14 nt, Bordetella pertussis
gcugcgacaggcgc

SEQ ID NO: 2450267 - RNA, 17 nt, Bordetella pertussis
gcugcgacaggcgcagc

SEQ ID NO: 2450268 - RNA, 18 nt, Bordetella pertussis
gcugcgacaggcgcagcu

SEQ ID NO: 2450269 - RNA, 22 nt, Bordetella pertussis
gcugcgacaggcgcagcucgac

SEQ ID NO: 2450270 - RNA, 15 nt, Bordetella pertussis
gcugcgagacgcgcu

SEQ ID NO: 2450271 - RNA, 18 nt, Bordetella pertussis
gcugcgagacgcgcucgc

SEQ ID NO: 2450272 - RNA, 14 nt, Bordetella pertussis
gcugcgaugcgggc

SEQ ID NO: 2450273 - RNA, 15 nt, Bordetella pertussis
gcugcgcagcagcgc

SEQ ID NO: 2450274 - RNA, 21 nt, Bordetella pertussis
gcugcgcagcagcgcgguggc

SEQ ID NO: 2450275 - RNA, 14 nt, Bordetella pertussis
gcugcgcagcaggg

SEQ ID NO: 2450276 - RNA, 21 nt, Bordetella pertussis
gcugcgcagcagggcggcggu

SEQ ID NO: 2450277 - RNA, 13 nt, Bordetella pertussis
gcugcgcagcgac

SEQ ID NO: 2450278 - RNA, 13 nt, Bordetella pertussis
gcugcgcaggcgc

SEQ ID NO: 2450279 - RNA, 14 nt, Bordetella pertussis
gcugcgcaggcgcg

SEQ ID NO: 2450280 - RNA, 18 nt, Bordetella pertussis
gcugcgccaacggugcca

SEQ ID NO: 2450281 - RNA, 13 nt, Bordetella pertussis
gcugcgccagccc

SEQ ID NO: 2450282 - RNA, 21 nt, Bordetella pertussis
gcugcgcccgcuacgcgggcu

SEQ ID NO: 2450283 - RNA, 21 nt, Bordetella pertussis
gcugcgcccgcuaugcgggcu

SEQ ID NO: 2450284 - RNA, 13 nt, Bordetella pertussis
gcucggccagcau

SEQ ID NO: 2450285 - RNA, 12 nt, Bordetella pertussis
gcucggccagcg

SEQ ID NO: 2450286 - RNA, 13 nt, Bordetella pertussis
gcucggccagcga

SEQ ID NO: 2450287 - RNA, 14 nt, Bordetella pertussis
gcucggccagcgag

SEQ ID NO: 2450288 - RNA, 14 nt, Bordetella pertussis
gcucggccagcgcg

SEQ ID NO: 2450289 - RNA, 16 nt, Bordetella pertussis
gcucggccagcgcgcg

SEQ ID NO: 2450290 - RNA, 17 nt, Bordetella pertussis
gcucggccagcgcgcgc

SEQ ID NO: 2450291 - RNA, 12 nt, Bordetella pertussis
gcucggccaggu

SEQ ID NO: 2450292 - RNA, 13 nt, Bordetella pertussis
gcucggcccauug

SEQ ID NO: 2450293 - RNA, 15 nt, Bordetella pertussis
gcucggccugcggcu

SEQ ID NO: 2450294 - RNA, 21 nt, Bordetella pertussis
gcucggcgaacugggcgucgu

SEQ ID NO: 2450295 - RNA, 19 nt, Bordetella pertussis
gcucggcgaagccgcagcg

SEQ ID NO: 2450296 - RNA, 14 nt, Bordetella pertussis
gcucggcgaccagg

SEQ ID NO: 2450297 - RNA, 18 nt, Bordetella pertussis
gcucggcgaccaggccca

SEQ ID NO: 2450298 - RNA, 17 nt, Bordetella pertussis
gcucggcgacggucagg

SEQ ID NO: 2450299 - RNA, 21 nt, Bordetella pertussis
gcucggcgacggucaggggca

SEQ ID NO: 2450300 - RNA, 20 nt, Bordetella pertussis
gcucggcgaucugcgcggcg

SEQ ID NO: 2450301 - RNA, 16 nt, Bordetella pertussis
gcucggcgaugcgcga

SEQ ID NO: 2450302 - RNA, 17 nt, Bordetella pertussis
gcucggcgccggcggcg

SEQ ID NO: 2450303 - RNA, 16 nt, Bordetella pertussis
gcucggcgcugccggg

SEQ ID NO: 2450304 - RNA, 20 nt, Bordetella pertussis
gcucggcggcaucguucagg

SEQ ID NO: 2450305 - RNA, 17 nt, Bordetella pertussis
gcucggcggccgccugc

SEQ ID NO: 2450306 - RNA, 18 nt, Bordetella pertussis
gcucggcggccgccugcg

SEQ ID NO: 2450307 - RNA, 15 nt, Bordetella pertussis
gcucggcggucagcg

SEQ ID NO: 2450308 - RNA, 22 nt, Bordetella pertussis
gcucggcguccucgcgguccug

SEQ ID NO: 2450309 - RNA, 18 nt, Bordetella pertussis
gcucggcguugcuggcaa

SEQ ID NO: 2450310 - RNA, 18 nt, Bordetella pertussis
gcucggcuggagcucuau

SEQ ID NO: 2450311 - RNA, 16 nt, Bordetella pertussis
gcucggcuuccugccg

SEQ ID NO: 2450312 - RNA, 17 nt, Bordetella pertussis
gcucgggacgcaggccc

SEQ ID NO: 2450313 - RNA, 20 nt, Bordetella pertussis
gcucgggacgcaggcccaug

SEQ ID NO: 2450314 - RNA, 13 nt, Bordetella pertussis
gcucgggcagcuc

SEQ ID NO: 2450315 - RNA, 15 nt, Bordetella pertussis
gcucgggcgcggcau

SEQ ID NO: 2450316 - RNA, 17 nt, Bordetella pertussis
gcucgggcucgcgcgcg

SEQ ID NO: 2450317 - RNA, 14 nt, Bordetella pertussis
gcucgggcugcggc

SEQ ID NO: 2450318 - RNA, 16 nt, Bordetella pertussis
gcucgggugggccggc

SEQ ID NO: 2450319 - RNA, 17 nt, Bordetella pertussis
gcucgggugggccggcu

SEQ ID NO: 2450320 - RNA, 21 nt, Bordetella pertussis
gcucggucauguccagcgcca

SEQ ID NO: 2450321 - RNA, 20 nt, Bordetella pertussis
gcucgguccagacgggcugg

SEQ ID NO: 2450322 - RNA, 21 nt, Bordetella pertussis
gcucggucggaaacacgucca

SEQ ID NO: 2450323 - RNA, 16 nt, Bordetella pertussis
gcucggucucgcccau

SEQ ID NO: 2450324 - RNA, 14 nt, Bordetella pertussis
gcucggugagcggc

SEQ ID NO: 2450325 - RNA, 17 nt, Bordetella pertussis
gcucggugagcggcacg

SEQ ID NO: 2450326 - RNA, 21 nt, Bordetella pertussis
gcucggugaugauggccaggu

SEQ ID NO: 2450327 - RNA, 22 nt, Bordetella pertussis
gcucggugaugauggccagguc

SEQ ID NO: 2450328 - RNA, 14 nt, Bordetella pertussis
gcucggugcagccc

SEQ ID NO: 2450329 - RNA, 15 nt, Bordetella pertussis
gcucggugcagccca

SEQ ID NO: 2450330 - RNA, 20 nt, Bordetella pertussis
gcucggugcagcccagcacc

SEQ ID NO: 2450331 - RNA, 19 nt, Bordetella pertussis
gcucggugcucuggcccgc

SEQ ID NO: 2450332 - RNA, 21 nt, Bordetella pertussis
gcucgguguugggaguucugg

SEQ ID NO: 2450333 - RNA, 13 nt, Bordetella pertussis
gcucguacuccau

SEQ ID NO: 2450334 - RNA, 22 nt, Bordetella pertussis
gcucguagaucuugccggccgu

SEQ ID NO: 2450335 - RNA, 23 nt, Bordetella pertussis
gcucguagaugguauguauggcg

SEQ ID NO: 2450336 - RNA, 13 nt, Bordetella pertussis
gcucguaucgccc

SEQ ID NO: 2450337 - RNA, 18 nt, Bordetella pertussis
gcucgucaugaucccgcg

SEQ ID NO: 2450338 - RNA, 13 nt, Bordetella pertussis
gcucguccacggc

SEQ ID NO: 2450339 - RNA, 20 nt, Bordetella pertussis
gcucguccagguugcccgag

SEQ ID NO: 2450340 - RNA, 15 nt, Bordetella pertussis
gcucguccaugccgg

SEQ ID NO: 2450341 - RNA, 14 nt, Bordetella pertussis
gcucgucccccuac

SEQ ID NO: 2450342 - RNA, 21 nt, Bordetella pertussis
gcucgucccccuacugcccuc

SEQ ID NO: 2450343 - RNA, 17 nt, Bordetella pertussis
gcucgucgacgcggccg

SEQ ID NO: 2450344 - RNA, 14 nt, Bordetella pertussis
gcucgucgccaugc

SEQ ID NO: 2450345 - RNA, 16 nt, Bordetella pertussis
gcucgucgccaugcgg

SEQ ID NO: 2450346 - RNA, 19 nt, Bordetella pertussis
gcucgucgccaugcggcug

SEQ ID NO: 2450347 - RNA, 21 nt, Bordetella pertussis
gcucgucgccaugcggcuggc

SEQ ID NO: 2450348 - RNA, 20 nt, Bordetella pertussis
gcucgucgggguggaugucg

SEQ ID NO: 2450349 - RNA, 20 nt, Bordetella pertussis
gcucgugcaucaucugggcg

SEQ ID NO: 2450350 - RNA, 21 nt, Bordetella pertussis
gcucgugcgcauacagggcgg

SEQ ID NO: 2450351 - RNA, 15 nt, Bordetella pertussis
gcucgugcuggccgg

SEQ ID NO: 2450352 - RNA, 15 nt, Bordetella pertussis
gcucguggcgcgccu

SEQ ID NO: 2450353 - RNA, 21 nt, Bordetella pertussis
gcucgugguggguuggccuug

SEQ ID NO: 2450354 - RNA, 16 nt, Bordetella pertussis
gcucguguagggccug

SEQ ID NO: 2450355 - RNA, 17 nt, Bordetella pertussis
gcucguguagggccugg

SEQ ID NO: 2450356 - RNA, 20 nt, Bordetella pertussis
gcucguguagggccuggcgu

SEQ ID NO: 2450357 - RNA, 16 nt, Bordetella pertussis
gcucguucugcgcgcc

SEQ ID NO: 2450358 - RNA, 19 nt, Bordetella pertussis
gcucguucugcgcgcccgu

SEQ ID NO: 2450359 - RNA, 17 nt, Bordetella pertussis
gcucuacacggccgcca

SEQ ID NO: 2450360 - RNA, 17 nt, Bordetella pertussis
gcucuaccaacccugcc

SEQ ID NO: 2450361 - RNA, 19 nt, Bordetella pertussis
gcucuaccaacccugccuc

SEQ ID NO: 2450362 - RNA, 14 nt, Bordetella pertussis
gcucucgaagaagc

SEQ ID NO: 2450363 - RNA, 18 nt, Bordetella pertussis
gcucugaucgcgcuggac

SEQ ID NO: 2450364 - RNA, 15 nt, Bordetella pertussis
gcucuggcugacgau

SEQ ID NO: 2450365 - RNA, 21 nt, Bordetella pertussis
gcucuuccaucuacgugcugg

SEQ ID NO: 2450366 - RNA, 19 nt, Bordetella pertussis
gcucuucgacagcgcgcag

SEQ ID NO: 2450367 - RNA, 20 nt, Bordetella pertussis
gcucuucgacagcgcgcagg

SEQ ID NO: 2450368 - RNA, 16 nt, Bordetella pertussis
gcucuucgagcgcggc

SEQ ID NO: 2450369 - RNA, 17 nt, Bordetella pertussis
gcucuucgagcgcggcg

SEQ ID NO: 2450370 - RNA, 14 nt, Bordetella pertussis
gcucuugaccuggg

SEQ ID NO: 2450371 - RNA, 16 nt, Bordetella pertussis
gcucuugaccugggcc

SEQ ID NO: 2450372 - RNA, 17 nt, Bordetella pertussis
gcucuugaccugggcca

SEQ ID NO: 2450373 - RNA, 20 nt, Bordetella pertussis
gcucuugaccugggccagca

SEQ ID NO: 2450374 - RNA, 18 nt, Bordetella pertussis
gcucuugagcgcggccuc

SEQ ID NO: 2450375 - RNA, 19 nt, Bordetella pertussis
gcucuugcgcgcgccggac

SEQ ID NO: 2450376 - RNA, 20 nt, Bordetella pertussis
gcucuugcgcgcgccggacg

SEQ ID NO: 2450377 - RNA, 13 nt, Bordetella pertussis
gcucuuggcgccg

SEQ ID NO: 2450378 - RNA, 19 nt, Bordetella pertussis
gcucuugguggugccugcu

SEQ ID NO: 2450379 - RNA, 19 nt, Bordetella pertussis
gcucuuuuucgagccgcag

SEQ ID NO: 2450380 - RNA, 24 nt, Bordetella pertussis
gcucuuuuucgagccgcagaacag

SEQ ID NO: 2450381 - RNA, 19 nt, Bordetella pertussis
gcugaaccugcuggccgcc

SEQ ID NO: 2450382 - RNA, 18 nt, Bordetella pertussis
gcugggcacauccagcgc

SEQ ID NO: 2450383 - RNA, 20 nt, Bordetella pertussis
gcugggcaugauggugcugc

SEQ ID NO: 2450384 - RNA, 17 nt, Bordetella pertussis
gcugggcaugggcggcc

SEQ ID NO: 2450385 - RNA, 19 nt, Bordetella pertussis
gcugggccagaccgcgcgc

SEQ ID NO: 2450386 - RNA, 18 nt, Bordetella pertussis
gcugggccagcaucggca

SEQ ID NO: 2450387 - RNA, 21 nt, Bordetella pertussis
gcugggccagcaucggcaccc

SEQ ID NO: 2450388 - RNA, 15 nt, Bordetella pertussis
gcugggccaggccgg

SEQ ID NO: 2450389 - RNA, 16 nt, Bordetella pertussis
gcugggccaggccggc

SEQ ID NO: 2450390 - RNA, 19 nt, Bordetella pertussis
gcugggccaggccggccuu

SEQ ID NO: 2450391 - RNA, 14 nt, Bordetella pertussis
gcugggccaugcgu

SEQ ID NO: 2450392 - RNA, 14 nt, Bordetella pertussis
gcugggccgcgcuc

SEQ ID NO: 2450393 - RNA, 15 nt, Bordetella pertussis
gcugggccggcgcgc

SEQ ID NO: 2450394 - RNA, 17 nt, Bordetella pertussis
gcugggccggcgcgcgc

SEQ ID NO: 2450395 - RNA, 18 nt, Bordetella pertussis
gcugggccggcgcgcgca

SEQ ID NO: 2450396 - RNA, 19 nt, Bordetella pertussis
gcugggccggcgcgcgcag

SEQ ID NO: 2450397 - RNA, 17 nt, Bordetella pertussis
gcugggccugcugucgc

SEQ ID NO: 2450398 - RNA, 21 nt, Bordetella pertussis
gcugggccugcugucgcuggg

SEQ ID NO: 2450399 - RNA, 18 nt, Bordetella pertussis
gcugggcgaggcgcuggc

SEQ ID NO: 2450400 - RNA, 20 nt, Bordetella pertussis
gcugggcgaucuucagcacc

SEQ ID NO: 2450401 - RNA, 15 nt, Bordetella pertussis
gcugggcgccagcag

SEQ ID NO: 2450402 - RNA, 17 nt, Bordetella pertussis
gcugggcgccaugcgcc

SEQ ID NO: 2450403 - RNA, 13 nt, Bordetella pertussis
gcugggcgcgcac

SEQ ID NO: 2450404 - RNA, 21 nt, Bordetella pertussis
gcugggcgcgcacaagcgcga

SEQ ID NO: 2450405 - RNA, 13 nt, Bordetella pertussis
gcugggcgcgccg

SEQ ID NO: 2450406 - RNA, 15 nt, Bordetella pertussis
gcugggcgcgccgcu

SEQ ID NO: 2450407 - RNA, 17 nt, Bordetella pertussis
gcugggcgcgccgcugc

SEQ ID NO: 2450408 - RNA, 18 nt, Bordetella pertussis
gcugggcgcgccgcugca

SEQ ID NO: 2450409 - RNA, 23 nt, Bordetella pertussis
gcugggcgcgccgcugcagcgcu

SEQ ID NO: 2450410 - RNA, 15 nt, Bordetella pertussis
gcugggcggccaggc

SEQ ID NO: 2450411 - RNA, 16 nt, Bordetella pertussis
gcugggcggccaggcg

SEQ ID NO: 2450412 - RNA, 17 nt, Bordetella pertussis
gcugggcggccaggcgg

SEQ ID NO: 2450413 - RNA, 13 nt, Bordetella pertussis
gcugggcggccuu

SEQ ID NO: 2450414 - RNA, 15 nt, Bordetella pertussis
gcugggcggccuugg

SEQ ID NO: 2450415 - RNA, 21 nt, Bordetella pertussis
gcugggcggccuuggccgcag

SEQ ID NO: 2450416 - RNA, 12 nt, Bordetella pertussis
gcugggcggcgg

SEQ ID NO: 2450417 - RNA, 13 nt, Bordetella pertussis
gcugggcggcgug

SEQ ID NO: 2450418 - RNA, 19 nt, Bordetella pertussis
gcugggcgguugcgcugcu

SEQ ID NO: 2450419 - RNA, 22 nt, Bordetella pertussis
gcugggcuacgacccgcugaag

SEQ ID NO: 2450420 - RNA, 19 nt, Bordetella pertussis
gcuggggcaggacgccggc

SEQ ID NO: 2450421 - RNA, 20 nt, Bordetella pertussis
gcuggggcaggacgccggcg

SEQ ID NO: 2450422 - RNA, 17 nt, Bordetella pertussis
gcuggggcaggcacugg

SEQ ID NO: 2450423 - RNA, 23 nt, Bordetella pertussis
gcuggggcaggcacuggcgcggc

SEQ ID NO: 2450424 - RNA, 23 nt, Bordetella pertussis
gcuggggguggugaagaaccgcc

SEQ ID NO: 2450425 - RNA, 20 nt, Bordetella pertussis
gcugggguggagcgcggcgc

SEQ ID NO: 2450426 - RNA, 20 nt, Bordetella pertussis
gcugggguuguauugcauga

SEQ ID NO: 2450427 - RNA, 14 nt, Bordetella pertussis
gcugggucaggucg

SEQ ID NO: 2450428 - RNA, 14 nt, Bordetella pertussis
gcugggucaucagc

SEQ ID NO: 2450429 - RNA, 15 nt, Bordetella pertussis
gcugggucaucagca

SEQ ID NO: 2450430 - RNA, 17 nt, Bordetella pertussis
gcugggugaagccaagc

SEQ ID NO: 2450431 - RNA, 19 nt, Bordetella pertussis
gcuggguguagucgcggcc

SEQ ID NO: 2450432 - RNA, 20 nt, Bordetella pertussis
gcuggguguagucgcggccg

SEQ ID NO: 2450433 - RNA, 21 nt, Bordetella pertussis
gcuggguguagucgcggccgu

SEQ ID NO: 2450434 - RNA, 18 nt, Bordetella pertussis
gcugguacagccccagcg

SEQ ID NO: 2450435 - RNA, 21 nt, Bordetella pertussis
gcugguacagccccagcgcca

SEQ ID NO: 2450436 - RNA, 16 nt, Bordetella pertussis
gcugguaguaggccac

SEQ ID NO: 2450437 - RNA, 17 nt, Bordetella pertussis
gcugguaguaggccacu

SEQ ID NO: 2450438 - RNA, 15 nt, Bordetella pertussis
gcuggucaaccuggu

SEQ ID NO: 2450439 - RNA, 16 nt, Bordetella pertussis
gcuggucaacucgccc

SEQ ID NO: 2450440 - RNA, 15 nt, Bordetella pertussis
gcuggucaccgcccc

SEQ ID NO: 2450441 - RNA, 14 nt, Bordetella pertussis
gcuggucacgucca

SEQ ID NO: 2450442 - RNA, 19 nt, Bordetella pertussis
gcuggucagccuggggcag

SEQ ID NO: 2450443 - RNA, 20 nt, Bordetella pertussis
gcuggucagccuggggcagg

SEQ ID NO: 2450444 - RNA, 21 nt, Bordetella pertussis
gcuggucagccuggggcaggc

SEQ ID NO: 2450445 - RNA, 19 nt, Bordetella pertussis
gcuggucaucuacagcgcc

SEQ ID NO: 2450446 - RNA, 14 nt, Bordetella pertussis
gcugguccgccgcc

SEQ ID NO: 2450447 - RNA, 14 nt, Bordetella pertussis
gcuggucgaugccg

SEQ ID NO: 2450448 - RNA, 17 nt, Bordetella pertussis
gcuggucgccaucugcu

SEQ ID NO: 2450449 - RNA, 12 nt, Bordetella pertussis
gcuggucgccgu

SEQ ID NO: 2450450 - RNA, 22 nt, Bordetella pertussis
gcuggucgcgcaccuguucggc

SEQ ID NO: 2450451 - RNA, 16 nt, Bordetella pertussis
gcuggucgcgcagcac

SEQ ID NO: 2450452 - RNA, 18 nt, Bordetella pertussis
gcuggucgcgcagcacga

SEQ ID NO: 2450453 - RNA, 13 nt, Bordetella pertussis
gcuggucgcgggc

SEQ ID NO: 2450454 - RNA, 14 nt, Bordetella pertussis
gcuggucgcgggcc

SEQ ID NO: 2450455 - RNA, 15 nt, Bordetella pertussis
gcuggucgcgggcca

SEQ ID NO: 2450456 - RNA, 18 nt, Bordetella pertussis
gcuggucgcgggccaggc

SEQ ID NO: 2450457 - RNA, 20 nt, Bordetella pertussis
gcuggucgcgggccaggccg

SEQ ID NO: 2450458 - RNA, 23 nt, Bordetella pertussis
gcuggucgcgggccaggccggcc

SEQ ID NO: 2450459 - RNA, 22 nt, Bordetella pertussis
gcuggucgggguggucuuccag

SEQ ID NO: 2450460 - RNA, 17 nt, Bordetella pertussis
gcuggucguaucgccgc

SEQ ID NO: 2450461 - RNA, 22 nt, Bordetella pertussis
gcuggucguaucgccgcugaug

SEQ ID NO: 2450462 - RNA, 17 nt, Bordetella pertussis
gcuggugaagucggccc

SEQ ID NO: 2450463 - RNA, 15 nt, Bordetella pertussis
gcuggugaucugcug

SEQ ID NO: 2450464 - RNA, 18 nt, Bordetella pertussis
gcuggugaucugcugcgu

SEQ ID NO: 2450465 - RNA, 19 nt, Bordetella pertussis
gcuggugauguccugcagg

SEQ ID NO: 2450466 - RNA, 13 nt, Bordetella pertussis
gcuggugcagcuu

SEQ ID NO: 2450467 - RNA, 15 nt, Bordetella pertussis
gcuggugcagcuuuu

SEQ ID NO: 2450468 - RNA, 20 nt, Bordetella pertussis
gcuggugccgacggcgcggg

SEQ ID NO: 2450469 - RNA, 11 nt, Bordetella pertussis
gcuggugccgc

SEQ ID NO: 2450470 - RNA, 12 nt, Bordetella pertussis
gcuggugccgcu

SEQ ID NO: 2450471 - RNA, 14 nt, Bordetella pertussis
gcuggugccgcugg

SEQ ID NO: 2450472 - RNA, 17 nt, Bordetella pertussis
gcuggugccgcuggcgg

SEQ ID NO: 2450473 - RNA, 18 nt, Bordetella pertussis
gcuggugccgcuggcggc

SEQ ID NO: 2450474 - RNA, 14 nt, Bordetella pertussis
gcuggugcuggugc

SEQ ID NO: 2450475 - RNA, 17 nt, Bordetella pertussis
gcuggugcuggugccgc

SEQ ID NO: 2450476 - RNA, 19 nt, Bordetella pertussis
gcugguggccaccagcccc

SEQ ID NO: 2450477 - RNA, 13 nt, Bordetella pertussis
gcugguggccaga

SEQ ID NO: 2450478 - RNA, 17 nt, Bordetella pertussis
gcugguggcgauguuca

SEQ ID NO: 2450479 - RNA, 15 nt, Bordetella pertussis
gcugguggcgucgag

SEQ ID NO: 2450480 - RNA, 19 nt, Bordetella pertussis
gcugguggugccgcgcacg

SEQ ID NO: 2450481 - RNA, 13 nt, Bordetella pertussis
gcugguucgaccu

SEQ ID NO: 2450482 - RNA, 14 nt, Bordetella pertussis
gcugguugggcucg

SEQ ID NO: 2450483 - RNA, 18 nt, Bordetella pertussis
gcugguuuucggacgcag

SEQ ID NO: 2450484 - RNA, 21 nt, Bordetella pertussis
gcugguuuucggacgcagcuu

SEQ ID NO: 2450485 - RNA, 17 nt, Bordetella pertussis
gcuguaccucagccugc

SEQ ID NO: 2450486 - RNA, 22 nt, Bordetella pertussis
gcuguaccucagccugcuggug

SEQ ID NO: 2450487 - RNA, 15 nt, Bordetella pertussis
gcuguaccuggcgau

SEQ ID NO: 2450488 - RNA, 18 nt, Bordetella pertussis
gcuguacugguaccaggc

SEQ ID NO: 2450489 - RNA, 20 nt, Bordetella pertussis
gcuguacugguaccaggcgg

SEQ ID NO: 2450490 - RNA, 22 nt, Bordetella pertussis
gcuguagaaguaguucggcgcg

SEQ ID NO: 2450491 - RNA, 17 nt, Bordetella pertussis
gcuguagaggcgcggcu

SEQ ID NO: 2450492 - RNA, 18 nt, Bordetella pertussis
gcuguagaggcgcggcuc

SEQ ID NO: 2450493 - RNA, 14 nt, Bordetella pertussis
gcuguagcccuggc

SEQ ID NO: 2450494 - RNA, 18 nt, Bordetella pertussis
gcuguagcccuggcgcug

SEQ ID NO: 2450495 - RNA, 20 nt, Bordetella pertussis
gcuguagcccuggcgcugca

SEQ ID NO: 2450496 - RNA, 15 nt, Bordetella pertussis
gcuguagcgcagccc

SEQ ID NO: 2450497 - RNA, 16 nt, Bordetella pertussis
gcuguagucgccgcug

SEQ ID NO: 2450498 - RNA, 20 nt, Bordetella pertussis
gcuguauagaugcgcggggc

SEQ ID NO: 2450499 - RNA, 19 nt, Bordetella pertussis
gcuguccaccugcaccguc

SEQ ID NO: 2450500 - RNA, 20 nt, Bordetella pertussis
gcuguccaggccggggccgc

SEQ ID NO: 2450501 - RNA, 15 nt, Bordetella pertussis
gcugucccagauggc

SEQ ID NO: 2450502 - RNA, 18 nt, Bordetella pertussis
gcuguccgaugcgcugcu

SEQ ID NO: 2450503 - RNA, 19 nt, Bordetella pertussis
gcuguccgaugcgcugcug

SEQ ID NO: 2450504 - RNA, 19 nt, Bordetella pertussis
gcuguccuucguggcgccg

SEQ ID NO: 2450505 - RNA, 17 nt, Bordetella pertussis
gcugucgcaacagcccc

SEQ ID NO: 2450506 - RNA, 22 nt, Bordetella pertussis
gcugucgcagucggggccgcag

SEQ ID NO: 2450507 - RNA, 23 nt, Bordetella pertussis
gcugucgcgcgacuggcccaggc

SEQ ID NO: 2450508 - RNA, 16 nt, Bordetella pertussis
gcugucgcgcgcaucg

SEQ ID NO: 2450509 - RNA, 19 nt, Bordetella pertussis
gcugucgcgcgcaucgccg

SEQ ID NO: 2450510 - RNA, 23 nt, Bordetella pertussis
gcugucgcgcuacagcguggugg

SEQ ID NO: 2450511 - RNA, 17 nt, Bordetella pertussis
gcugucgcugaucugcu

SEQ ID NO: 2450512 - RNA, 22 nt, Bordetella pertussis
gcugucgcugggauggguacgc

SEQ ID NO: 2450513 - RNA, 15 nt, Bordetella pertussis
gcugucgugccgcac

SEQ ID NO: 2450514 - RNA, 20 nt, Bordetella pertussis
gcugugccccacacgcgcgc

SEQ ID NO: 2450515 - RNA, 17 nt, Bordetella pertussis
gcugugcccgccccauu

SEQ ID NO: 2450516 - RNA, 24 nt, Bordetella pertussis
gcugugccugccaagcgccgcggc

SEQ ID NO: 2450517 - RNA, 18 nt, Bordetella pertussis
gcugugcgacgauccggc

SEQ ID NO: 2450518 - RNA, 21 nt, Bordetella pertussis
gcugugcgacgauccggcgac

SEQ ID NO: 2450519 - RNA, 21 nt, Bordetella pertussis
gcuguggacgccgccggccca

SEQ ID NO: 2450520 - RNA, 14 nt, Bordetella pertussis
gcuguggccgcggc

SEQ ID NO: 2450521 - RNA, 13 nt, Bordetella pertussis
gcuguggcgcgcc

SEQ ID NO: 2450522 - RNA, 23 nt, Bordetella pertussis
gcuguucaccuucaacaucgccc

SEQ ID NO: 2450523 - RNA, 17 nt, Bordetella pertussis
gcuguucaggcgcucga

SEQ ID NO: 2450524 - RNA, 21 nt, Bordetella pertussis
gcuguucaggcgcucgaucgg

SEQ ID NO: 2450525 - RNA, 19 nt, Bordetella pertussis
gcuguucgccacgcuguug

SEQ ID NO: 2450526 - RNA, 15 nt, Bordetella pertussis
gcuguucgcgcagca

SEQ ID NO: 2450527 - RNA, 23 nt, Bordetella pertussis
gcuguucgcgcagcaggccgcgc

SEQ ID NO: 2450528 - RNA, 20 nt, Bordetella pertussis
gcuguucggcgaccgccggc

SEQ ID NO: 2450529 - RNA, 20 nt, Bordetella pertussis
gcuguucggcgagccgggca

SEQ ID NO: 2450530 - RNA, 21 nt, Bordetella pertussis
gcuguucgggcgcggugcgca

SEQ ID NO: 2450531 - RNA, 20 nt, Bordetella pertussis
gcuguugaggaugugcagcg

SEQ ID NO: 2450532 - RNA, 15 nt, Bordetella pertussis
gcuguugcccaccag

SEQ ID NO: 2450533 - RNA, 21 nt, Bordetella pertussis
gcuguugcccaccagccgggc

SEQ ID NO: 2450534 - RNA, 22 nt, Bordetella pertussis
gcuguugcccaccagccgggcg

SEQ ID NO: 2450535 - RNA, 20 nt, Bordetella pertussis
gcuguuggccggcgcgcccu

SEQ ID NO: 2450536 - RNA, 23 nt, Bordetella pertussis
gcuguuuuucauuugccgccuga

SEQ ID NO: 2450537 - RNA, 19 nt, Bordetella pertussis
gcuuagcgcagcagcgaca

SEQ ID NO: 2450538 - RNA, 18 nt, Bordetella pertussis
gcuuauaggcuuucagau

SEQ ID NO: 2450539 - RNA, 16 nt, Bordetella pertussis
gcuucagccugggccu

SEQ ID NO: 2450540 - RNA, 19 nt, Bordetella pertussis
gcuucaggaacauguccac

SEQ ID NO: 2450541 - RNA, 23 nt, Bordetella pertussis
gcuucaggaacauguccaccagc

SEQ ID NO: 2450542 - RNA, 15 nt, Bordetella pertussis
gcuucaggcgccgca

SEQ ID NO: 2450543 - RNA, 16 nt, Bordetella pertussis
gcuucaggcgccgcag

SEQ ID NO: 2450544 - RNA, 21 nt, Bordetella pertussis
gcuucaggcgccgcagauggc

SEQ ID NO: 2450545 - RNA, 17 nt, Bordetella pertussis
gcuucaggcgcgcggca

SEQ ID NO: 2450546 - RNA, 14 nt, Bordetella pertussis
gcuucaggcuggcc

SEQ ID NO: 2450547 - RNA, 17 nt, Bordetella pertussis
gcuucagugcucgggcu

SEQ ID NO: 2450548 - RNA, 19 nt, Bordetella pertussis
gcuucaucaccuucccgcu

SEQ ID NO: 2450549 - RNA, 14 nt, Bordetella pertussis
gcuuccaauccgga

SEQ ID NO: 2450550 - RNA, 18 nt, Bordetella pertussis
gcuuccaccgucuggcgu

SEQ ID NO: 2450551 - RNA, 18 nt, Bordetella pertussis
gcuuccagaucgaccagg

SEQ ID NO: 2450552 - RNA, 13 nt, Bordetella pertussis
gcuuccagcagca

SEQ ID NO: 2450553 - RNA, 19 nt, Bordetella pertussis
gcuuccagcagcaugccgc

SEQ ID NO: 2450554 - RNA, 21 nt, Bordetella pertussis
gcuuccagcagcaugccgcgg

SEQ ID NO: 2450555 - RNA, 21 nt, Bordetella pertussis
gcuuccaggaguucccagcgc

SEQ ID NO: 2450556 - RNA, 23 nt, Bordetella pertussis
gcuuccaggaguucccagcgcgc

SEQ ID NO: 2450557 - RNA, 18 nt, Bordetella pertussis
gcuuccagguacaggggc

SEQ ID NO: 2450558 - RNA, 21 nt, Bordetella pertussis
gcuuccaguugcuguuucucc

SEQ ID NO: 2450559 - RNA, 23 nt, Bordetella pertussis
gcuuccaucaggaacggcauggc

SEQ ID NO: 2450560 - RNA, 17 nt, Bordetella pertussis
gcuucccgguccaggcc

SEQ ID NO: 2450561 - RNA, 22 nt, Bordetella pertussis
gcuuccggcaugaccgcggacg

SEQ ID NO: 2450562 - RNA, 14 nt, Bordetella pertussis
gcuuccggccgggc

SEQ ID NO: 2450563 - RNA, 15 nt, Bordetella pertussis
gcuuccucgaccagg

SEQ ID NO: 2450564 - RNA, 17 nt, Bordetella pertussis
gcuuccugcaccucagg

SEQ ID NO: 2450565 - RNA, 18 nt, Bordetella pertussis
gcuuccugggccugcggc

SEQ ID NO: 2450566 - RNA, 22 nt, Bordetella pertussis
gcuucgaacgacuugggcaguu

SEQ ID NO: 2450567 - RNA, 14 nt, Bordetella pertussis
gcuucgacucccuc

SEQ ID NO: 2450568 - RNA, 18 nt, Bordetella pertussis
gcuucgagauccgccggc

SEQ ID NO: 2450569 - RNA, 17 nt, Bordetella pertussis
gcuucgagccgguacag

SEQ ID NO: 2450570 - RNA, 22 nt, Bordetella pertussis
gcuucgagccgguacagccagg

SEQ ID NO: 2450571 - RNA, 15 nt, Bordetella pertussis
gcuucgaugcuggcg

SEQ ID NO: 2450572 - RNA, 16 nt, Bordetella pertussis
gcuucgauggcggcgg

SEQ ID NO: 2450573 - RNA, 17 nt, Bordetella pertussis
gcuucgauggcggcggc

SEQ ID NO: 2450574 - RNA, 14 nt, Bordetella pertussis
gcuucgcccagcgc

SEQ ID NO: 2450575 - RNA, 22 nt, Bordetella pertussis
gcuucgcccgccaccacgcgca

SEQ ID NO: 2450576 - RNA, 18 nt, Bordetella pertussis
gcuucgcgcacauccagc

SEQ ID NO: 2450577 - RNA, 21 nt, Bordetella pertussis
gcuucgcgcacauccagccga

SEQ ID NO: 2450578 - RNA, 14 nt, Bordetella pertussis
gcuucgcgcagcaa

SEQ ID NO: 2450579 - RNA, 18 nt, Bordetella pertussis
gcuucgcgguaaccggcg

SEQ ID NO: 2450580 - RNA, 13 nt, Bordetella pertussis
gcuucggcgcugg

SEQ ID NO: 2450581 - RNA, 18 nt, Bordetella pertussis
gcuucggcgcugggcgca

SEQ ID NO: 2450582 - RNA, 13 nt, Bordetella pertussis
gcuucggcggcca

SEQ ID NO: 2450583 - RNA, 18 nt, Bordetella pertussis
gcuucggcggccauggca

SEQ ID NO: 2450584 - RNA, 13 nt, Bordetella pertussis
gcuucggcggccg

SEQ ID NO: 2450585 - RNA, 19 nt, Bordetella pertussis
gcuucgggcagcucgcgcg

SEQ ID NO: 2450586 - RNA, 22 nt, Bordetella pertussis
gcuucgucauggucgaccagca

SEQ ID NO: 2450587 - RNA, 16 nt, Bordetella pertussis
gcuucgucgaccagca

SEQ ID NO: 2450588 - RNA, 16 nt, Bordetella pertussis
gcuucgucggccgcca

SEQ ID NO: 2450589 - RNA, 13 nt, Bordetella pertussis
gcuucgucgggca

SEQ ID NO: 2450590 - RNA, 14 nt, Bordetella pertussis
gcuucgucgggcag

SEQ ID NO: 2450591 - RNA, 22 nt, Bordetella pertussis
gcuucgugcagcgcgugggcca

SEQ ID NO: 2450592 - RNA, 14 nt, Bordetella pertussis
gcuucgugcggccg

SEQ ID NO: 2450593 - RNA, 16 nt, Bordetella pertussis
gcuucgugcggccgca

SEQ ID NO: 2450594 - RNA, 21 nt, Bordetella pertussis
gcuucgugcggccgcagcagu

SEQ ID NO: 2450595 - RNA, 22 nt, Bordetella pertussis
gcuucguucaagcguugccgca

SEQ ID NO: 2450596 - RNA, 21 nt, Bordetella pertussis
gcuucucgaccaggcgggcau

SEQ ID NO: 2450597 - RNA, 21 nt, Bordetella pertussis
gcuucucgcaagugcuggccc

SEQ ID NO: 2450598 - RNA, 22 nt, Bordetella pertussis
gcuucucgcaagugcuggcccg

SEQ ID NO: 2450599 - RNA, 20 nt, Bordetella pertussis
gcuucuggaucaccgccggc

SEQ ID NO: 2450600 - RNA, 18 nt, Bordetella pertussis
gcuucugguaguuggcca

SEQ ID NO: 2450601 - RNA, 20 nt, Bordetella pertussis
gcuucugguaguuggccagg

SEQ ID NO: 2450602 - RNA, 20 nt, Bordetella pertussis
gcuucuuccuugcgaugcca

SEQ ID NO: 2450603 - RNA, 17 nt, Bordetella pertussis
gcuucuucgucgcgcca

SEQ ID NO: 2450604 - RNA, 18 nt, Bordetella pertussis
gcuucuugaacucggcca

SEQ ID NO: 2450605 - RNA, 20 nt, Bordetella pertussis
gcuucuugaacucggccagc

SEQ ID NO: 2450606 - RNA, 23 nt, Bordetella pertussis
gcuucuugaacucggccagcagc

SEQ ID NO: 2450607 - RNA, 13 nt, Bordetella pertussis
gcuugaagacgcc

SEQ ID NO: 2450608 - RNA, 23 nt, Bordetella pertussis
gcuugaagcggucgauguccagc

SEQ ID NO: 2450609 - RNA, 23 nt, Bordetella pertussis
gcuugaaguaaucgcccggcgcc

SEQ ID NO: 2450610 - RNA, 21 nt, Bordetella pertussis
gcuugaccacggccagcagca

SEQ ID NO: 2450611 - RNA, 15 nt, Bordetella pertussis
gcuugaccgccagca

SEQ ID NO: 2450612 - RNA, 21 nt, Bordetella pertussis
gcuugaccgccagcauccagc

SEQ ID NO: 2450613 - RNA, 12 nt, Bordetella pertussis
gcuugaccgccu

SEQ ID NO: 2450614 - RNA, 17 nt, Bordetella pertussis
gcuugaccgccuccagg

SEQ ID NO: 2450615 - RNA, 20 nt, Bordetella pertussis
gcuugaccgccucgaucgcc

SEQ ID NO: 2450616 - RNA, 21 nt, Bordetella pertussis
gcuugaccgccucgaucgcca

SEQ ID NO: 2450617 - RNA, 22 nt, Bordetella pertussis
gcuugacgccgccgaagggcac

SEQ ID NO: 2450618 - RNA, 14 nt, Bordetella pertussis
gcuugacggccaag

SEQ ID NO: 2450619 - RNA, 20 nt, Bordetella pertussis
gcuugacguagcggaucgcg

SEQ ID NO: 2450620 - RNA, 20 nt, Bordetella pertussis
gcuugacguccagccagggu

SEQ ID NO: 2450621 - RNA, 18 nt, Bordetella pertussis
gcuugacguccagcgacu

SEQ ID NO: 2450622 - RNA, 21 nt, Bordetella pertussis
gcuugagcaggcgcgagcgcc

SEQ ID NO: 2450623 - RNA, 22 nt, Bordetella pertussis
gcuugagcgaaauggcggccuc

SEQ ID NO: 2450624 - RNA, 18 nt, Bordetella pertussis
gcuugagcgaaugcgcgu

SEQ ID NO: 2450625 - RNA, 15 nt, Bordetella pertussis
gcuugaugcccagcu

SEQ ID NO: 2450626 - RNA, 15 nt, Bordetella pertussis
gcuugaugccggcgu

SEQ ID NO: 2450627 - RNA, 20 nt, Bordetella pertussis
gcuugaugccggcguucugg

SEQ ID NO: 2450628 - RNA, 17 nt, Bordetella pertussis
gcuugauggccagcgcg

SEQ ID NO: 2450629 - RNA, 23 nt, Bordetella pertussis
gcuugauggccagcgcgcgggcg

SEQ ID NO: 2450630 - RNA, 14 nt, Bordetella pertussis
gcuugcacgccggc

SEQ ID NO: 2450631 - RNA, 17 nt, Bordetella pertussis
gcuugcacgccggccac

SEQ ID NO: 2450632 - RNA, 18 nt, Bordetella pertussis
gcuugcacgccggccacg

SEQ ID NO: 2450633 - RNA, 21 nt, Bordetella pertussis
gcuugcacgccggccacgaug

SEQ ID NO: 2450634 - RNA, 17 nt, Bordetella pertussis
gcuugcagcaacgcggc

SEQ ID NO: 2450635 - RNA, 18 nt, Bordetella pertussis
gcuugcagcuugcgcgcc

SEQ ID NO: 2450636 - RNA, 18 nt, Bordetella pertussis
gcuugccauaggccagcg

SEQ ID NO: 2450637 - RNA, 19 nt, Bordetella pertussis
gcuugccauaggccagcgc

SEQ ID NO: 2450638 - RNA, 21 nt, Bordetella pertussis
gcuugccauaggccagcgccu

SEQ ID NO: 2450639 - RNA, 14 nt, Bordetella pertussis
gcuugcccacgcgc

SEQ ID NO: 2450640 - RNA, 21 nt, Bordetella pertussis
gcuugcccagcagaucguuca

SEQ ID NO: 2450641 - RNA, 15 nt, Bordetella pertussis
gcuugcccaggccgg

SEQ ID NO: 2450642 - RNA, 20 nt, Bordetella pertussis
gcuugcccaggccggcgcgc

SEQ ID NO: 2450643 - RNA, 21 nt, Bordetella pertussis
gcuugcccaggccggcgcgcu

SEQ ID NO: 2450644 - RNA, 15 nt, Bordetella pertussis
gcuugcccgcgcgca

SEQ ID NO: 2450645 - RNA, 20 nt, Bordetella pertussis
gcuugccgaccuccaggccc

SEQ ID NO: 2450646 - RNA, 22 nt, Bordetella pertussis
gcuugccgaccuccaggcccag

SEQ ID NO: 2450647 - RNA, 15 nt, Bordetella pertussis
gcuugccgcagcggc

SEQ ID NO: 2450648 - RNA, 19 nt, Bordetella pertussis
gcuugccgcagcggccaug

SEQ ID NO: 2450649 - RNA, 14 nt, Bordetella pertussis
gcuugccgccggac

SEQ ID NO: 2450650 - RNA, 15 nt, Bordetella pertussis
gcuugccgcgcggcg

SEQ ID NO: 2450651 - RNA, 19 nt, Bordetella pertussis
gcuugccgcggcgcggccu

SEQ ID NO: 2450652 - RNA, 17 nt, Bordetella pertussis
gcuugccggcgaucacg

SEQ ID NO: 2450653 - RNA, 19 nt, Bordetella pertussis
gcuugccggugcucggcca

SEQ ID NO: 2450654 - RNA, 22 nt, Bordetella pertussis
gcuugccggugcucggccagcg

SEQ ID NO: 2450655 - RNA, 23 nt, Bordetella pertussis
gcuugccguacgagugcaggccc

SEQ ID NO: 2450656 - RNA, 20 nt, Bordetella pertussis
gcuugccguagcgcguggcc

SEQ ID NO: 2450657 - RNA, 23 nt, Bordetella pertussis
gcuugccguagcgcguggccagc

SEQ ID NO: 2450658 - RNA, 15 nt, Bordetella pertussis
gcuugccguucaggu

SEQ ID NO: 2450659 - RNA, 17 nt, Bordetella pertussis
gcuugccuguccccacu

SEQ ID NO: 2450660 - RNA, 22 nt, Bordetella pertussis
gcuugcgauaggugcgcagccg

SEQ ID NO: 2450661 - RNA, 18 nt, Bordetella pertussis
gcuugcgcaagccggccg

SEQ ID NO: 2450662 - RNA, 15 nt, Bordetella pertussis
gcuugcgccagccac

SEQ ID NO: 2450663 - RNA, 23 nt, Bordetella pertussis
gcuugcgccagccacgcgcgcug

SEQ ID NO: 2450664 - RNA, 15 nt, Bordetella pertussis
gcuugcgcgccacgu

SEQ ID NO: 2450665 - RNA, 15 nt, Bordetella pertussis
gcuugcgcgccugcu

SEQ ID NO: 2450666 - RNA, 16 nt, Bordetella pertussis
gcuugcgcgccugcug

SEQ ID NO: 2450667 - RNA, 16 nt, Bordetella pertussis
gcuugcgcguaggcgc

SEQ ID NO: 2450668 - RNA, 23 nt, Bordetella pertussis
gcuugcgcucgguguggauggcg

SEQ ID NO: 2450669 - RNA, 17 nt, Bordetella pertussis
gcuugcgcuggcgcgcg

SEQ ID NO: 2450670 - RNA, 20 nt, Bordetella pertussis
gcuugcgcuggcgcgcggcc

SEQ ID NO: 2450671 - RNA, 21 nt, Bordetella pertussis
gcuugcgcuggcgcgcggccg

SEQ ID NO: 2450672 - RNA, 15 nt, Bordetella pertussis
gcuugcggccaggcg

SEQ ID NO: 2450673 - RNA, 15 nt, Bordetella pertussis
gcuugcggcgcuggc

SEQ ID NO: 2450674 - RNA, 18 nt, Bordetella pertussis
gcuugcgucccaccugca

SEQ ID NO: 2450675 - RNA, 19 nt, Bordetella pertussis
gcuugcguuggcauggcgc

SEQ ID NO: 2450676 - RNA, 20 nt, Bordetella pertussis
gcuugcuucaggcuggccug

SEQ ID NO: 2450677 - RNA, 21 nt, Bordetella pertussis
gcuuggaccccguggucgcca

SEQ ID NO: 2450678 - RNA, 13 nt, Bordetella pertussis
gcuuggccaccac

SEQ ID NO: 2450679 - RNA, 14 nt, Bordetella pertussis
gcuuggccaccacg

SEQ ID NO: 2450680 - RNA, 17 nt, Bordetella pertussis
gcuuggccagcuggcgc

SEQ ID NO: 2450681 - RNA, 13 nt, Bordetella pertussis
gcuuggccaggcu

SEQ ID NO: 2450682 - RNA, 18 nt, Bordetella pertussis
gcuuggcccugcagcggc

SEQ ID NO: 2450683 - RNA, 22 nt, Bordetella pertussis
gcuuggcccugcagcggccagu

SEQ ID NO: 2450684 - RNA, 12 nt, Bordetella pertussis
gcuuggccgcgu

SEQ ID NO: 2450685 - RNA, 20 nt, Bordetella pertussis
gcuuggcgaacaccagggug

SEQ ID NO: 2450686 - RNA, 21 nt, Bordetella pertussis
gcuuggcgaacaccagggugg

SEQ ID NO: 2450687 - RNA, 17 nt, Bordetella pertussis
gcuuggcgcgcagcagc

SEQ ID NO: 2450688 - RNA, 13 nt, Bordetella pertussis
gcuuggcgcgccg

SEQ ID NO: 2450689 - RNA, 15 nt, Bordetella pertussis
gcuuggcgucagcgu

SEQ ID NO: 2450690 - RNA, 16 nt, Bordetella pertussis
gcuugggccgcgccug

SEQ ID NO: 2450691 - RNA, 19 nt, Bordetella pertussis
gcuugggccgcgccugcag

SEQ ID NO: 2450692 - RNA, 17 nt, Bordetella pertussis
gcuugggcgugcccuug

SEQ ID NO: 2450693 - RNA, 19 nt, Bordetella pertussis
gcuugggcuugauggccag

SEQ ID NO: 2450694 - RNA, 16 nt, Bordetella pertussis
gcuuggggcgcgccgc

SEQ ID NO: 2450695 - RNA, 20 nt, Bordetella pertussis
gcuuggggcgcgccgcggcg

SEQ ID NO: 2450696 - RNA, 17 nt, Bordetella pertussis
gcuugggggcguggcag

SEQ ID NO: 2450697 - RNA, 19 nt, Bordetella pertussis
gcuuggucagcaucagcag

SEQ ID NO: 2450698 - RNA, 18 nt, Bordetella pertussis
gcuugucgaccaccggcu

SEQ ID NO: 2450699 - RNA, 19 nt, Bordetella pertussis
gcuugucgaccaccggcuu

SEQ ID NO: 2450700 - RNA, 22 nt, Bordetella pertussis
gcuugucgaucgccaccagcgu

SEQ ID NO: 2450701 - RNA, 17 nt, Bordetella pertussis
gcuugucgaugacgcgc

SEQ ID NO: 2450702 - RNA, 19 nt, Bordetella pertussis
gcuugucgauuaugccgcc

SEQ ID NO: 2450703 - RNA, 12 nt, Bordetella pertussis
gcuugucggccg

SEQ ID NO: 2450704 - RNA, 15 nt, Bordetella pertussis
gcuugucggccgcgc

SEQ ID NO: 2450705 - RNA, 18 nt, Bordetella pertussis
gcuugucggccgcgcgca

SEQ ID NO: 2450706 - RNA, 17 nt, Bordetella pertussis
gcuuguucgagcgcgcg

SEQ ID NO: 2450707 - RNA, 14 nt, Bordetella pertussis
gcuuuaccagcugu

SEQ ID NO: 2450708 - RNA, 17 nt, Bordetella pertussis
gcuuuaccagcuguacc

SEQ ID NO: 2450709 - RNA, 20 nt, Bordetella pertussis
gcuuucagcgccgagcgcca

SEQ ID NO: 2450710 - RNA, 16 nt, Bordetella pertussis
gcuuucgaccagcgac

SEQ ID NO: 2450711 - RNA, 17 nt, Bordetella pertussis
gcuuucgaccagcgaca

SEQ ID NO: 2450712 - RNA, 21 nt, Bordetella pertussis
gcuuucgaccagcgacagcac

SEQ ID NO: 2450713 - RNA, 16 nt, Bordetella pertussis
gcuuucgcacagccgg

SEQ ID NO: 2450714 - RNA, 22 nt, Bordetella pertussis
gcuuucgcacagccggggcgag

SEQ ID NO: 2450715 - RNA, 17 nt, Bordetella pertussis
gcuuucgccgcgggccu

SEQ ID NO: 2450716 - RNA, 20 nt, Bordetella pertussis
gcuuucgccggaggcgcgca

SEQ ID NO: 2450717 - RNA, 23 nt, Bordetella pertussis
gcuuucggggcgcaagaucugga

SEQ ID NO: 2450718 - RNA, 19 nt, Bordetella pertussis
gcuuucuaucaucaggccc

SEQ ID NO: 2450719 - RNA, 15 nt, Bordetella pertussis
gcuuucucccgccgc

SEQ ID NO: 2450720 - RNA, 14 nt, Bordetella pertussis
gcuuugcgcgccau

SEQ ID NO: 2450721 - RNA, 16 nt, Bordetella pertussis
gcuuugcgggcgcgcu

SEQ ID NO: 2450722 - RNA, 23 nt, Bordetella pertussis
gcuuuggacaggcgugcgcagcu

SEQ ID NO: 2450723 - RNA, 22 nt, Bordetella pertussis
gcuuuggucuauuuccgacgag

SEQ ID NO: 2450724 - RNA, 15 nt, Bordetella pertussis
gcuuuucgcaccuca

SEQ ID NO: 2450725 - RNA, 19 nt, Bordetella pertussis
gcuuuucgcaccucacggu

SEQ ID NO: 2450726 - RNA, 13 nt, Bordetella pertussis
gcuuuuuccugcu

SEQ ID NO: 2450727 - RNA, 13 nt, Bordetella pertussis
gcuuuuucucggc

SEQ ID NO: 2450728 - RNA, 11 nt, Bordetella pertussis
gcuuuuugccu

SEQ ID NO: 2450729 - RNA, 19 nt, Bordetella pertussis
gcuuuuuucuccagcgcca

SEQ ID NO: 2450730 - RNA, 16 nt, Bordetella pertussis
gcuuuuuugcguucgc

SEQ ID NO: 2450731 - RNA, 17 nt, Bordetella pertussis
gcuuuuuuucgccgggc

SEQ ID NO: 2450732 - RNA, 14 nt, Bordetella pertussis
ggaaaaagagccug

SEQ ID NO: 2450733 - RNA, 18 nt, Bordetella pertussis
ggaaaaagagccuguccc

SEQ ID NO: 2450734 - RNA, 15 nt, Bordetella pertussis
ggaaaaccggcgccu

SEQ ID NO: 2450735 - RNA, 20 nt, Bordetella pertussis
ggaaacacguccagcgccgc

SEQ ID NO: 2450736 - RNA, 16 nt, Bordetella pertussis
ggaaacaggcccacgg

SEQ ID NO: 2450737 - RNA, 19 nt, Bordetella pertussis
ggaaacccuucgcgcagca

SEQ ID NO: 2450738 - RNA, 15 nt, Bordetella pertussis
ggaaacggaaacugc

SEQ ID NO: 2450739 - RNA, 19 nt, Bordetella pertussis
ggaaacggaaacugccauc

SEQ ID NO: 2450740 - RNA, 14 nt, Bordetella pertussis
ggaaagaggccagg

SEQ ID NO: 2450741 - RNA, 16 nt, Bordetella pertussis
ggaaagaggccaggcc

SEQ ID NO: 2450742 - RNA, 19 nt, Bordetella pertussis
ggaaagcaucagcccuacc

SEQ ID NO: 2450743 - RNA, 21 nt, Bordetella pertussis
ggaaagcccggccccaggccg

SEQ ID NO: 2450744 - RNA, 15 nt, Bordetella pertussis
ggaaagcgccgccgc

SEQ ID NO: 2450745 - RNA, 14 nt, Bordetella pertussis
ggaaagcggccugu

SEQ ID NO: 2450746 - RNA, 20 nt, Bordetella pertussis
ggaaagcuguccacgccgaa

SEQ ID NO: 2450747 - RNA, 22 nt, Bordetella pertussis
ggaaaucaggcgcaucgacagc

SEQ ID NO: 2450748 - RNA, 20 nt, Bordetella pertussis
ggaaauccguaguccagcag

SEQ ID NO: 2450749 - RNA, 23 nt, Bordetella pertussis
ggaaauccguaguccagcagcag

SEQ ID NO: 2450750 - RNA, 14 nt, Bordetella pertussis
ggaaaucgcggcgc

SEQ ID NO: 2450751 - RNA, 15 nt, Bordetella pertussis
ggaaaucgugccguc

SEQ ID NO: 2450752 - RNA, 13 nt, Bordetella pertussis
ggaaaugccgcgc

SEQ ID NO: 2450753 - RNA, 18 nt, Bordetella pertussis
ggaaaugccgcgcgcagg

SEQ ID NO: 2450754 - RNA, 13 nt, Bordetella pertussis
ggaaaugccggcg

SEQ ID NO: 2450755 - RNA, 15 nt, Bordetella pertussis
ggaaaugccguccag

SEQ ID NO: 2450756 - RNA, 18 nt, Bordetella pertussis
ggaaauggugcgguugcg

SEQ ID NO: 2450757 - RNA, 15 nt, Bordetella pertussis
ggaaauugacggcgc

SEQ ID NO: 2450758 - RNA, 12 nt, Bordetella pertussis
ggaacagccugc

SEQ ID NO: 2450759 - RNA, 20 nt, Bordetella pertussis
ggaacagcgccggcagcgca

SEQ ID NO: 2450760 - RNA, 19 nt, Bordetella pertussis
ggaacagcguccagccgcc

SEQ ID NO: 2450761 - RNA, 19 nt, Bordetella pertussis
ggaacagcuugggcauuuc

SEQ ID NO: 2450762 - RNA, 18 nt, Bordetella pertussis
ggaacaggccggccuggg

SEQ ID NO: 2450763 - RNA, 21 nt, Bordetella pertussis
ggaacaggcgcgccagccgcg

SEQ ID NO: 2450764 - RNA, 16 nt, Bordetella pertussis
ggaacaggucguugag

SEQ ID NO: 2450765 - RNA, 15 nt, Bordetella pertussis
ggaacauggcccggu

SEQ ID NO: 2450766 - RNA, 11 nt, Bordetella pertussis
ggaacauggcg

SEQ ID NO: 2450767 - RNA, 19 nt, Bordetella pertussis
ggaacauguccaccagccg

SEQ ID NO: 2450768 - RNA, 21 nt, Bordetella pertussis
ggaacauguucacgcccagga

SEQ ID NO: 2450769 - RNA, 17 nt, Bordetella pertussis
ggaaccagcggcuggcg

SEQ ID NO: 2450770 - RNA, 24 nt, Bordetella pertussis
ggaaccagcggcuggcggugcgug

SEQ ID NO: 2450771 - RNA, 21 nt, Bordetella pertussis
ggaaccgcgguacgcgggcau

SEQ ID NO: 2450772 - RNA, 18 nt, Bordetella pertussis
ggaaccgguuggccagcu

SEQ ID NO: 2450773 - RNA, 17 nt, Bordetella pertussis
ggaacggcaccagccgg

SEQ ID NO: 2450774 - RNA, 18 nt, Bordetella pertussis
ggaacggcaccagccggg

SEQ ID NO: 2450775 - RNA, 21 nt, Bordetella pertussis
ggaacguuugcggacgggcca

SEQ ID NO: 2450776 - RNA, 18 nt, Bordetella pertussis
ggaacucguuggccagcg

SEQ ID NO: 2450777 - RNA, 23 nt, Bordetella pertussis
ggaacucguuggccagcgcgccu

SEQ ID NO: 2450778 - RNA, 15 nt, Bordetella pertussis
ggaacugaugccgac

SEQ ID NO: 2450779 - RNA, 23 nt, Bordetella pertussis
ggaacugaugccgaccgaagagg

SEQ ID NO: 2450780 - RNA, 17 nt, Bordetella pertussis
ggaacugggcgccggcc

SEQ ID NO: 2450781 - RNA, 20 nt, Bordetella pertussis
ggaacugggcgccggccagg

SEQ ID NO: 2450782 - RNA, 20 nt, Bordetella pertussis
ggaacuugaacggcgcggcc

SEQ ID NO: 2450783 - RNA, 20 nt, Bordetella pertussis
ggaacuugggaucggccagg

SEQ ID NO: 2450784 - RNA, 19 nt, Bordetella pertussis
ggaagacauggcgcgcgcc

SEQ ID NO: 2450785 - RNA, 23 nt, Bordetella pertussis
ggaagacguggcccgcgugacgg

SEQ ID NO: 2450786 - RNA, 19 nt, Bordetella pertussis
ggaagacuucgucaacgcc

SEQ ID NO: 2450787 - RNA, 15 nt, Bordetella pertussis
ggaagagcuggcgcu

SEQ ID NO: 2450788 - RNA, 17 nt, Bordetella pertussis
ggaagagggcggggcgu

SEQ ID NO: 2450789 - RNA, 18 nt, Bordetella pertussis
ggaagagggcggggcgug

SEQ ID NO: 2450790 - RNA, 20 nt, Bordetella pertussis
ggaagaucacauaggccggc

SEQ ID NO: 2450791 - RNA, 21 nt, Bordetella pertussis
ggaagaucacauaggccggca

SEQ ID NO: 2450792 - RNA, 16 nt, Bordetella pertussis
ggaagaucggcccggc

SEQ ID NO: 2450793 - RNA, 17 nt, Bordetella pertussis
ggaagaucggcccggcg

SEQ ID NO: 2450794 - RNA, 21 nt, Bordetella pertussis
ggaagauguaccagcccagcc

SEQ ID NO: 2450795 - RNA, 19 nt, Bordetella pertussis
ggaagauguggucggcgcc

SEQ ID NO: 2450796 - RNA, 15 nt, Bordetella pertussis
ggaagcagcccagca

SEQ ID NO: 2450797 - RNA, 21 nt, Bordetella pertussis
ggaagcagcccagcacgacga

SEQ ID NO: 2450798 - RNA, 19 nt, Bordetella pertussis
ggaagccgccggcgugccc

SEQ ID NO: 2450799 - RNA, 15 nt, Bordetella pertussis
ggaagccugcgcgcg

SEQ ID NO: 2450800 - RNA, 12 nt, Bordetella pertussis
ggaagcgcacca

SEQ ID NO: 2450801 - RNA, 18 nt, Bordetella pertussis
ggaagcgcgccaggcgca

SEQ ID NO: 2450802 - RNA, 17 nt, Bordetella pertussis
ggaagcgcgccgcgcgc

SEQ ID NO: 2450803 - RNA, 12 nt, Bordetella pertussis
ggaagcgcuggc

SEQ ID NO: 2450804 - RNA, 15 nt, Bordetella pertussis
ggaagcuggccagcg

SEQ ID NO: 2450805 - RNA, 16 nt, Bordetella pertussis
ggaagcugucggcgcu

SEQ ID NO: 2450806 - RNA, 22 nt, Bordetella pertussis
ggaagcugucggcgcuggccau

SEQ ID NO: 2450807 - RNA, 16 nt, Bordetella pertussis
ggaaggcccggucgug

SEQ ID NO: 2450808 - RNA, 23 nt, Bordetella pertussis
ggaaggggcggcuucaggcgcgc

SEQ ID NO: 2450809 - RNA, 17 nt, Bordetella pertussis
ggaagggugcggcgcca

SEQ ID NO: 2450810 - RNA, 22 nt, Bordetella pertussis
ggaaguccugcaucgccaugcc

SEQ ID NO: 2450811 - RNA, 19 nt, Bordetella pertussis
ggaaguccuucagccgcug

SEQ ID NO: 2450812 - RNA, 17 nt, Bordetella pertussis
ggaaguggaaccgcggu

SEQ ID NO: 2450813 - RNA, 15 nt, Bordetella pertussis
ggaaguggccgagcg

SEQ ID NO: 2450814 - RNA, 22 nt, Bordetella pertussis
ggaauacgccguugcggcccgc

SEQ ID NO: 2450815 - RNA, 13 nt, Bordetella pertussis
ggaaucaccgccg

SEQ ID NO: 2450816 - RNA, 17 nt, Bordetella pertussis
ggaaucauuggccagcg

SEQ ID NO: 2450817 - RNA, 17 nt, Bordetella pertussis
ggaauccuggcgacggc

SEQ ID NO: 2450818 - RNA, 13 nt, Bordetella pertussis
ggaaucgucgacc

SEQ ID NO: 2450819 - RNA, 18 nt, Bordetella pertussis
ggaaugaugcgcauuauc

SEQ ID NO: 2450820 - RNA, 15 nt, Bordetella pertussis
ggaauggggcccgca

SEQ ID NO: 2450821 - RNA, 18 nt, Bordetella pertussis
ggaauggucaagcggcug

SEQ ID NO: 2450822 - RNA, 20 nt, Bordetella pertussis
ggaauggucaagcggcugcc

SEQ ID NO: 2450823 - RNA, 22 nt, Bordetella pertussis
ggaauggucaagcggcugcccu

SEQ ID NO: 2450824 - RNA, 16 nt, Bordetella pertussis
ggaauuccucgcggcu

SEQ ID NO: 2450825 - RNA, 14 nt, Bordetella pertussis
ggacaacgcgcgcc

SEQ ID NO: 2450826 - RNA, 19 nt, Bordetella pertussis
ggacaacgcgcgccacuau

SEQ ID NO: 2450827 - RNA, 15 nt, Bordetella pertussis
ggacaacugcgcgaa

SEQ ID NO: 2450828 - RNA, 13 nt, Bordetella pertussis
ggacaaggcgcgc

SEQ ID NO: 2450829 - RNA, 13 nt, Bordetella pertussis
ggacaaggcgcgu

SEQ ID NO: 2450830 - RNA, 19 nt, Bordetella pertussis
ggacaaggcgcguaugacg

SEQ ID NO: 2450831 - RNA, 14 nt, Bordetella pertussis
ggacacagcggcgc

SEQ ID NO: 2450832 - RNA, 15 nt, Bordetella pertussis
ggacaccgcaggugc

SEQ ID NO: 2450833 - RNA, 19 nt, Bordetella pertussis
ggacacgaugaacgcgcgc

SEQ ID NO: 2450834 - RNA, 24 nt, Bordetella pertussis
ggacacgccacuacacucugcccg

SEQ ID NO: 2450835 - RNA, 16 nt, Bordetella pertussis
ggacacgcccuggccg

SEQ ID NO: 2450836 - RNA, 19 nt, Bordetella pertussis
ggacagauaccgucuuggc

SEQ ID NO: 2450837 - RNA, 19 nt, Bordetella pertussis
ggacagauacuguucgccg

SEQ ID NO: 2450838 - RNA, 13 nt, Bordetella pertussis
ggacagauccagc

SEQ ID NO: 2450839 - RNA, 16 nt, Bordetella pertussis
ggacagauccagcgcg

SEQ ID NO: 2450840 - RNA, 18 nt, Bordetella pertussis
ggacagauccagcgcggc

SEQ ID NO: 2450841 - RNA, 16 nt, Bordetella pertussis
ggacagaugccguccu

SEQ ID NO: 2450842 - RNA, 18 nt, Bordetella pertussis
ggacagaugccguccugg

SEQ ID NO: 2450843 - RNA, 17 nt, Bordetella pertussis
ggacagcaccgacaggc

SEQ ID NO: 2450844 - RNA, 23 nt, Bordetella pertussis
ggacagcaccgacaggccgaugc

SEQ ID NO: 2450845 - RNA, 20 nt, Bordetella pertussis
ggacagcaguucggccggcg

SEQ ID NO: 2450846 - RNA, 13 nt, Bordetella pertussis
ggacagccccagc

SEQ ID NO: 2450847 - RNA, 14 nt, Bordetella pertussis
ggacagccccagca

SEQ ID NO: 2450848 - RNA, 17 nt, Bordetella pertussis
ggacagccccagcagca

SEQ ID NO: 2450849 - RNA, 23 nt, Bordetella pertussis
ggacagccccagcagcacgccca

SEQ ID NO: 2450850 - RNA, 23 nt, Bordetella pertussis
ggacagcccgcgcuggcgcagca

SEQ ID NO: 2450851 - RNA, 20 nt, Bordetella pertussis
ggacaggcaccccagcaccc

SEQ ID NO: 2450852 - RNA, 22 nt, Bordetella pertussis
ggacaggcacccccgaccgagc

SEQ ID NO: 2450853 - RNA, 14 nt, Bordetella pertussis
ggacaggcaccccu

SEQ ID NO: 2450854 - RNA, 17 nt, Bordetella pertussis
ggacaggcacccgcacg

SEQ ID NO: 2450855 - RNA, 15 nt, Bordetella pertussis
ggacaggcacccgcg

SEQ ID NO: 2450856 - RNA, 17 nt, Bordetella pertussis
ggacaggcacccgcgcg

SEQ ID NO: 2450857 - RNA, 14 nt, Bordetella pertussis
ggacaggcacccgg

SEQ ID NO: 2450858 - RNA, 22 nt, Bordetella pertussis
ggacaggcacccuugccgcggg

SEQ ID NO: 2450859 - RNA, 15 nt, Bordetella pertussis
ggacaggcaccugcg

SEQ ID NO: 2450860 - RNA, 22 nt, Bordetella pertussis
ggacaggcaccugcgaccgagc

SEQ ID NO: 2450861 - RNA, 16 nt, Bordetella pertussis
ggacaggcacgcgccg

SEQ ID NO: 2450862 - RNA, 21 nt, Bordetella pertussis
ggacaggcccagcccgccgau

SEQ ID NO: 2450863 - RNA, 17 nt, Bordetella pertussis
ggacaggcgcccgugcg

SEQ ID NO: 2450864 - RNA, 21 nt, Bordetella pertussis
ggacaggcgcccgugcgcggc

SEQ ID NO: 2450865 - RNA, 22 nt, Bordetella pertussis
ggacaggcgcccgugcgcggcg

SEQ ID NO: 2450866 - RNA, 15 nt, Bordetella pertussis
ggacagggccccggc

SEQ ID NO: 2450867 - RNA, 14 nt, Bordetella pertussis
ggacaggggccuca

SEQ ID NO: 2450868 - RNA, 22 nt, Bordetella pertussis
ggacaggucggcgcccacgccg

SEQ ID NO: 2450869 - RNA, 17 nt, Bordetella pertussis
ggaccaauaccugaucu

SEQ ID NO: 2450870 - RNA, 14 nt, Bordetella pertussis
ggaccagggcacgg

SEQ ID NO: 2450871 - RNA, 16 nt, Bordetella pertussis
ggaccagucgacccac

SEQ ID NO: 2450872 - RNA, 15 nt, Bordetella pertussis
ggaccaugcgcuggg

SEQ ID NO: 2450873 - RNA, 16 nt, Bordetella pertussis
ggaccaugcgcugggc

SEQ ID NO: 2450874 - RNA, 19 nt, Bordetella pertussis
ggacccaguucggccgcca

SEQ ID NO: 2450875 - RNA, 15 nt, Bordetella pertussis
ggaccccgaagcaca

SEQ ID NO: 2450876 - RNA, 22 nt, Bordetella pertussis
ggaccccguggucgccagcacg

SEQ ID NO: 2450877 - RNA, 22 nt, Bordetella pertussis
ggaccccuugcggccgccgaac

SEQ ID NO: 2450878 - RNA, 12 nt, Bordetella pertussis
ggaccgcgcggu

SEQ ID NO: 2450879 - RNA, 18 nt, Bordetella pertussis
ggaccgcgcugcggucag

SEQ ID NO: 2450880 - RNA, 16 nt, Bordetella pertussis
ggaccggcgauggcgu

SEQ ID NO: 2450881 - RNA, 21 nt, Bordetella pertussis
ggaccggcgauggcguugaug

SEQ ID NO: 2450882 - RNA, 15 nt, Bordetella pertussis
ggaccgugccgccga

SEQ ID NO: 2450883 - RNA, 14 nt, Bordetella pertussis
ggaccucgcgccgg

SEQ ID NO: 2450884 - RNA, 18 nt, Bordetella pertussis
ggaccucgcgccggucac

SEQ ID NO: 2450885 - RNA, 18 nt, Bordetella pertussis
ggaccugagccaggcgcc

SEQ ID NO: 2450886 - RNA, 13 nt, Bordetella pertussis
ggaccuggccagc

SEQ ID NO: 2450887 - RNA, 18 nt, Bordetella pertussis
ggaccuggccagcguggg

SEQ ID NO: 2450888 - RNA, 14 nt, Bordetella pertussis
ggaccuguacuggc

SEQ ID NO: 2450889 - RNA, 17 nt, Bordetella pertussis
ggaccuguacuggcugg

SEQ ID NO: 2450890 - RNA, 21 nt, Bordetella pertussis
ggaccuuacggauaauugggc

SEQ ID NO: 2450891 - RNA, 21 nt, Bordetella pertussis
ggaccuucguucgaaguccgc

SEQ ID NO: 2450892 - RNA, 23 nt, Bordetella pertussis
ggaccuuggcggcuggcgcggcc

SEQ ID NO: 2450893 - RNA, 16 nt, Bordetella pertussis
ggacgaacaggccgcc

SEQ ID NO: 2450894 - RNA, 17 nt, Bordetella pertussis
ggacgaacaggccgccg

SEQ ID NO: 2450895 - RNA, 22 nt, Bordetella pertussis
ggacgaccuugcuggaccgcgc

SEQ ID NO: 2450896 - RNA, 17 nt, Bordetella pertussis
ggacgagacaggcgcgc

SEQ ID NO: 2450897 - RNA, 21 nt, Bordetella pertussis
ggacgagacaggcgcgccauc

SEQ ID NO: 2450898 - RNA, 19 nt, Bordetella pertussis
ggacgaggcgauggucggc

SEQ ID NO: 2450899 - RNA, 22 nt, Bordetella pertussis
ggacgaggcgauggucggccgg

SEQ ID NO: 2450900 - RNA, 16 nt, Bordetella pertussis
ggacgagggccgcggc

SEQ ID NO: 2450901 - RNA, 17 nt, Bordetella pertussis
ggacgagggccgcggcg

SEQ ID NO: 2450902 - RNA, 18 nt, Bordetella pertussis
ggacgagggccgcggcga

SEQ ID NO: 2450903 - RNA, 19 nt, Bordetella pertussis
ggacgagggccggcgccag

SEQ ID NO: 2450904 - RNA, 18 nt, Bordetella pertussis
ggacgaugcgcgaagcgc

SEQ ID NO: 2450905 - RNA, 20 nt, Bordetella pertussis
ggacgauguagaucuggcgc

SEQ ID NO: 2450906 - RNA, 19 nt, Bordetella pertussis
ggacgcaaaaacgcccggc

SEQ ID NO: 2450907 - RNA, 20 nt, Bordetella pertussis
ggacgcaaaaacgcccggcg

SEQ ID NO: 2450908 - RNA, 22 nt, Bordetella pertussis
ggacgcaaccggucggccggca

SEQ ID NO: 2450909 - RNA, 18 nt, Bordetella pertussis
ggacgcaccuuucugcug

SEQ ID NO: 2450910 - RNA, 22 nt, Bordetella pertussis
ggacgcaccuuucugcugcucg

SEQ ID NO: 2450911 - RNA, 23 nt, Bordetella pertussis
ggacgcaccuuucugcugcucgc

SEQ ID NO: 2450912 - RNA, 13 nt, Bordetella pertussis
ggacgcagcuucu

SEQ ID NO: 2450913 - RNA, 15 nt, Bordetella pertussis
ggacgcaggcccagc

SEQ ID NO: 2450914 - RNA, 20 nt, Bordetella pertussis
ggacgcaggcccagccagcc

SEQ ID NO: 2450915 - RNA, 18 nt, Bordetella pertussis
ggacgcaggucgucguca

SEQ ID NO: 2450916 - RNA, 21 nt, Bordetella pertussis
ggacgccaagaccgcggccgc

SEQ ID NO: 2450917 - RNA, 16 nt, Bordetella pertussis
ggacgccagcccgccg

SEQ ID NO: 2450918 - RNA, 19 nt, Bordetella pertussis
ggacgccagcccgccggcg

SEQ ID NO: 2450919 - RNA, 14 nt, Bordetella pertussis
ggacgcccgcccgc

SEQ ID NO: 2450920 - RNA, 22 nt, Bordetella pertussis
ggacgcccuggcgcaggccggc

SEQ ID NO: 2450921 - RNA, 23 nt, Bordetella pertussis
ggacgcccuggcgcaggccggcg

SEQ ID NO: 2450922 - RNA, 14 nt, Bordetella pertussis
ggacgccgccggcc

SEQ ID NO: 2450923 - RNA, 16 nt, Bordetella pertussis
ggacgccgccggccca

SEQ ID NO: 2450924 - RNA, 15 nt, Bordetella pertussis
ggacgccucgccggu

SEQ ID NO: 2450925 - RNA, 16 nt, Bordetella pertussis
ggacgccucgccggug

SEQ ID NO: 2450926 - RNA, 20 nt, Bordetella pertussis
ggacgcgaagaucccgccgg

SEQ ID NO: 2450927 - RNA, 14 nt, Bordetella pertussis
ggacgcgccgggcg

SEQ ID NO: 2450928 - RNA, 14 nt, Bordetella pertussis
ggacgcgcgcggcg

SEQ ID NO: 2450929 - RNA, 18 nt, Bordetella pertussis
ggacgcgcgcggcgaccg

SEQ ID NO: 2450930 - RNA, 13 nt, Bordetella pertussis
ggacgcggccggc

SEQ ID NO: 2450931 - RNA, 14 nt, Bordetella pertussis
ggacgcggccggca

SEQ ID NO: 2450932 - RNA, 19 nt, Bordetella pertussis
ggacgcgggccacgcgccg

SEQ ID NO: 2450933 - RNA, 16 nt, Bordetella pertussis
ggacgcguccucggcc

SEQ ID NO: 2450934 - RNA, 19 nt, Bordetella pertussis
ggacgcguccucggccagc

SEQ ID NO: 2450935 - RNA, 21 nt, Bordetella pertussis
ggacgcguccucggccagccg

SEQ ID NO: 2450936 - RNA, 23 nt, Bordetella pertussis
ggacgcguccucggccagccggg

SEQ ID NO: 2450937 - RNA, 21 nt, Bordetella pertussis
ggacgcugaccgagggcgcgu

SEQ ID NO: 2450938 - RNA, 16 nt, Bordetella pertussis
ggacggaaguccugca

SEQ ID NO: 2450939 - RNA, 21 nt, Bordetella pertussis
ggacggcagcaccgccaugug

SEQ ID NO: 2450940 - RNA, 14 nt, Bordetella pertussis
ggacggccaggggc

SEQ ID NO: 2450941 - RNA, 19 nt, Bordetella pertussis
ggacggccauucagaccgg

SEQ ID NO: 2450942 - RNA, 15 nt, Bordetella pertussis
ggacggcgcgggcac

SEQ ID NO: 2450943 - RNA, 18 nt, Bordetella pertussis
ggacgggccagccccggc

SEQ ID NO: 2450944 - RNA, 14 nt, Bordetella pertussis
ggacgggccaggcc

SEQ ID NO: 2450945 - RNA, 16 nt, Bordetella pertussis
ggacgggccaggccga

SEQ ID NO: 2450946 - RNA, 15 nt, Bordetella pertussis
ggacggggaacaggc

SEQ ID NO: 2450947 - RNA, 22 nt, Bordetella pertussis
ggacggguaucgucgaccugga

SEQ ID NO: 2450948 - RNA, 16 nt, Bordetella pertussis
ggacgguacauacgug

SEQ ID NO: 2450949 - RNA, 15 nt, Bordetella pertussis
ggacggugucgcuga

SEQ ID NO: 2450950 - RNA, 17 nt, Bordetella pertussis
ggacguaguugguggca

SEQ ID NO: 2450951 - RNA, 13 nt, Bordetella pertussis
ggacgucggugug

SEQ ID NO: 2450952 - RNA, 19 nt, Bordetella pertussis
ggacgucugagcgccgggg

SEQ ID NO: 2450953 - RNA, 11 nt, Bordetella pertussis
gcgcugcgcag

SEQ ID NO: 2450954 - RNA, 22 nt, Bordetella pertussis
gcgcugcgcagcagggcggcgg

SEQ ID NO: 2450955 - RNA, 13 nt, Bordetella pertussis
gcgcugcgccaac

SEQ ID NO: 2450956 - RNA, 15 nt, Bordetella pertussis
gcgcugcgcccgcua

SEQ ID NO: 2450957 - RNA, 23 nt, Bordetella pertussis
gcgcugcgcccgcuacgcgggcu

SEQ ID NO: 2450958 - RNA, 13 nt, Bordetella pertussis
gcgcugcgccgcg

SEQ ID NO: 2450959 - RNA, 15 nt, Bordetella pertussis
gcgcugcgccgcggc

SEQ ID NO: 2450960 - RNA, 18 nt, Bordetella pertussis
gcgcugcgccgcggcgcu

SEQ ID NO: 2450961 - RNA, 13 nt, Bordetella pertussis
gcgcugcgccggc

SEQ ID NO: 2450962 - RNA, 15 nt, Bordetella pertussis
gcgcugcgccuuggc

SEQ ID NO: 2450963 - RNA, 17 nt, Bordetella pertussis
gcgcugcgccuuggcgc

SEQ ID NO: 2450964 - RNA, 20 nt, Bordetella pertussis
gcgcugcgcgaaacggccgg

SEQ ID NO: 2450965 - RNA, 17 nt, Bordetella pertussis
gcgcugcgcgaacgcgg

SEQ ID NO: 2450966 - RNA, 20 nt, Bordetella pertussis
gcgcugcgcgaacgcggcca

SEQ ID NO: 2450967 - RNA, 13 nt, Bordetella pertussis
gcgcugcgcgccg

SEQ ID NO: 2450968 - RNA, 15 nt, Bordetella pertussis
gcgcugcgcgccgcc

SEQ ID NO: 2450969 - RNA, 20 nt, Bordetella pertussis
gcgcugcgcgccgccgcgcu

SEQ ID NO: 2450970 - RNA, 14 nt, Bordetella pertussis
gcgcugcgcggucu

SEQ ID NO: 2450971 - RNA, 15 nt, Bordetella pertussis
gcgcugcgcggucug

SEQ ID NO: 2450972 - RNA, 18 nt, Bordetella pertussis
gcgcugcucguccacggc

SEQ ID NO: 2450973 - RNA, 15 nt, Bordetella pertussis
gcgcugcucuccaug

SEQ ID NO: 2450974 - RNA, 16 nt, Bordetella pertussis
gcgcugcugcaggccg

SEQ ID NO: 2450975 - RNA, 17 nt, Bordetella pertussis
gcgcugcugcaggccgg

SEQ ID NO: 2450976 - RNA, 18 nt, Bordetella pertussis
gcgcugcugcaggccggc

SEQ ID NO: 2450977 - RNA, 19 nt, Bordetella pertussis
gcgcugcugcaggccggcg

SEQ ID NO: 2450978 - RNA, 20 nt, Bordetella pertussis
gcgcugcugcaggccggcgc

SEQ ID NO: 2450979 - RNA, 15 nt, Bordetella pertussis
gcgcugcugccgucg

SEQ ID NO: 2450980 - RNA, 18 nt, Bordetella pertussis
gcgcugcugccgucggcg

SEQ ID NO: 2450981 - RNA, 13 nt, Bordetella pertussis
gcgcugcugcugg

SEQ ID NO: 2450982 - RNA, 21 nt, Bordetella pertussis
gcgcugcugcuggcugcccug

SEQ ID NO: 2450983 - RNA, 23 nt, Bordetella pertussis
gcgcugcugcuggcugcccuggc

SEQ ID NO: 2450984 - RNA, 15 nt, Bordetella pertussis
gcgcugcuggccaag

SEQ ID NO: 2450985 - RNA, 20 nt, Bordetella pertussis
gcgcugcuggccaagcgcgc

SEQ ID NO: 2450986 - RNA, 15 nt, Bordetella pertussis
gcgcugcuggccggc

SEQ ID NO: 2450987 - RNA, 18 nt, Bordetella pertussis
gcgcugcuggccggccag

SEQ ID NO: 2450988 - RNA, 19 nt, Bordetella pertussis
gcgcugcuggccggccagc

SEQ ID NO: 2450989 - RNA, 17 nt, Bordetella pertussis
gcgcugcugucgcgcug

SEQ ID NO: 2450990 - RNA, 19 nt, Bordetella pertussis
gcgcugcugucgcgcugcc

SEQ ID NO: 2450991 - RNA, 22 nt, Bordetella pertussis
gcgcuggaacguuugcggacgg

SEQ ID NO: 2450992 - RNA, 16 nt, Bordetella pertussis
gcgcuggacgcccugg

SEQ ID NO: 2450993 - RNA, 22 nt, Bordetella pertussis
gcgcuggacgcccuggcgcagg

SEQ ID NO: 2450994 - RNA, 14 nt, Bordetella pertussis
gcgcuggaggccuu

SEQ ID NO: 2450995 - RNA, 15 nt, Bordetella pertussis
gcgcuggauggcucg

SEQ ID NO: 2450996 - RNA, 16 nt, Bordetella pertussis
gcgcuggauggcucgg

SEQ ID NO: 2450997 - RNA, 21 nt, Bordetella pertussis
gcgcuggauggcucgggcagc

SEQ ID NO: 2450998 - RNA, 14 nt, Bordetella pertussis
gcgcuggccaucac

SEQ ID NO: 2450999 - RNA, 21 nt, Bordetella pertussis
gcgcuggcccaguucgcgcag

SEQ ID NO: 2451000 - RNA, 23 nt, Bordetella pertussis
gcgcuggcccaguucgcgcagca

SEQ ID NO: 2451001 - RNA, 17 nt, Bordetella pertussis
gcgcuggccccagaugc

SEQ ID NO: 2451002 - RNA, 14 nt, Bordetella pertussis
gcgcuggcccgcgc

SEQ ID NO: 2451003 - RNA, 16 nt, Bordetella pertussis
gcgcuggcccgcgcga

SEQ ID NO: 2451004 - RNA, 20 nt, Bordetella pertussis
gcgcuggcccgcgcgagcgg

SEQ ID NO: 2451005 - RNA, 15 nt, Bordetella pertussis
gcgcuggcccgucau

SEQ ID NO: 2451006 - RNA, 13 nt, Bordetella pertussis
gcgcuggccgaca

SEQ ID NO: 2451007 - RNA, 16 nt, Bordetella pertussis
gcgcuggccgccaugg

SEQ ID NO: 2451008 - RNA, 17 nt, Bordetella pertussis
gcgcuggccgccauggc

SEQ ID NO: 2451009 - RNA, 18 nt, Bordetella pertussis
gcgcuggccgccauggcg

SEQ ID NO: 2451010 - RNA, 21 nt, Bordetella pertussis
gcgcuggccgccauggcgcug

SEQ ID NO: 2451011 - RNA, 14 nt, Bordetella pertussis
gcgcuggccgcccg

SEQ ID NO: 2451012 - RNA, 15 nt, Bordetella pertussis
gcgcuggccgcccgc

SEQ ID NO: 2451013 - RNA, 17 nt, Bordetella pertussis
gcgcuggccgcccgcgg

SEQ ID NO: 2451014 - RNA, 21 nt, Bordetella pertussis
gcgcuggccgcccgcggccug

SEQ ID NO: 2451015 - RNA, 13 nt, Bordetella pertussis
gcgcuggccgcga

SEQ ID NO: 2451016 - RNA, 15 nt, Bordetella pertussis
gcgcuggccggccgc

SEQ ID NO: 2451017 - RNA, 16 nt, Bordetella pertussis
gcgcuggccggccgcg

SEQ ID NO: 2451018 - RNA, 20 nt, Bordetella pertussis
gcgcuggccggccgcguggc

SEQ ID NO: 2451019 - RNA, 18 nt, Bordetella pertussis
gcgcuggccggcgugccc

SEQ ID NO: 2451020 - RNA, 13 nt, Bordetella pertussis
gcgcuggccugcc

SEQ ID NO: 2451021 - RNA, 14 nt, Bordetella pertussis
gcgcuggccugccg

SEQ ID NO: 2451022 - RNA, 15 nt, Bordetella pertussis
gcgcuggccuggccg

SEQ ID NO: 2451023 - RNA, 18 nt, Bordetella pertussis
gcgcuggccuggccgccg

SEQ ID NO: 2451024 - RNA, 23 nt, Bordetella pertussis
gcgcuggcgaagaacaccgccgc

SEQ ID NO: 2451025 - RNA, 15 nt, Bordetella pertussis
gcgcuggcgagcaug

SEQ ID NO: 2451026 - RNA, 21 nt, Bordetella pertussis
gcgcuggcgagcauggcaucg

SEQ ID NO: 2451027 - RNA, 18 nt, Bordetella pertussis
gcgcuggcgcaaggacgc

SEQ ID NO: 2451028 - RNA, 19 nt, Bordetella pertussis
gcgcuggcgcaaggacgcg

SEQ ID NO: 2451029 - RNA, 15 nt, Bordetella pertussis
gcgcuggcgcagcag

SEQ ID NO: 2451030 - RNA, 20 nt, Bordetella pertussis
gcgcuggcgcagcaggcgcg

SEQ ID NO: 2451031 - RNA, 23 nt, Bordetella pertussis
gcgcuggcgcagcaggcgcgcgg

SEQ ID NO: 2451032 - RNA, 13 nt, Bordetella pertussis
gcgcuggcgcagg

SEQ ID NO: 2451033 - RNA, 15 nt, Bordetella pertussis
gcgcuggcgcauggc

SEQ ID NO: 2451034 - RNA, 15 nt, Bordetella pertussis
gcgcuggcgcccggc

SEQ ID NO: 2451035 - RNA, 16 nt, Bordetella pertussis
gcgcuggcgcccggcc

SEQ ID NO: 2451036 - RNA, 20 nt, Bordetella pertussis
gcgcuggcgcccggccugcg

SEQ ID NO: 2451037 - RNA, 13 nt, Bordetella pertussis
gcgcuggcgccgc

SEQ ID NO: 2451038 - RNA, 19 nt, Bordetella pertussis
gcgcuggcgccgcgcgcca

SEQ ID NO: 2451039 - RNA, 12 nt, Bordetella pertussis
gcgcuggcgcga

SEQ ID NO: 2451040 - RNA, 14 nt, Bordetella pertussis
gcgcuggcgcgcga

SEQ ID NO: 2451041 - RNA, 17 nt, Bordetella pertussis
gcgcuggcgcgcgacgg

SEQ ID NO: 2451042 - RNA, 22 nt, Bordetella pertussis
gcgcuggcgcgcgacggcgccg

SEQ ID NO: 2451043 - RNA, 14 nt, Bordetella pertussis
gcgcuggcgcgcgg

SEQ ID NO: 2451044 - RNA, 15 nt, Bordetella pertussis
gcgcuggcgcgcggc

SEQ ID NO: 2451045 - RNA, 16 nt, Bordetella pertussis
gcgcuggcgcgcggcc

SEQ ID NO: 2451046 - RNA, 17 nt, Bordetella pertussis
gcgcuggcgcgcggccg

SEQ ID NO: 2451047 - RNA, 18 nt, Bordetella pertussis
gcgcuggcgcgcggccgc

SEQ ID NO: 2451048 - RNA, 16 nt, Bordetella pertussis
gcgcuggcgcgcggcu

SEQ ID NO: 2451049 - RNA, 18 nt, Bordetella pertussis
gcgcuggcgcgcggcugg

SEQ ID NO: 2451050 - RNA, 21 nt, Bordetella pertussis
gcgcuggcgcgcggcuggcug

SEQ ID NO: 2451051 - RNA, 19 nt, Bordetella pertussis
gcgcuggcgcgcuguucgg

SEQ ID NO: 2451052 - RNA, 11 nt, Bordetella pertussis
gcgcuggcgcu

SEQ ID NO: 2451053 - RNA, 22 nt, Bordetella pertussis
gcgcuggcgcucgggcgcggca

SEQ ID NO: 2451054 - RNA, 16 nt, Bordetella pertussis
gcgcuggcgcuggccg

SEQ ID NO: 2451055 - RNA, 15 nt, Bordetella pertussis
gcgcuggcggcgcag

SEQ ID NO: 2451056 - RNA, 16 nt, Bordetella pertussis
gcgcuggcggcgcagg

SEQ ID NO: 2451057 - RNA, 17 nt, Bordetella pertussis
gcgcuggcggcgcaggc

SEQ ID NO: 2451058 - RNA, 20 nt, Bordetella pertussis
gcgcuggcggcgcaggccgc

SEQ ID NO: 2451059 - RNA, 13 nt, Bordetella pertussis
gcgcuggcggcug

SEQ ID NO: 2451060 - RNA, 19 nt, Bordetella pertussis
gcgcuggcgguggccgcgc

SEQ ID NO: 2451061 - RNA, 19 nt, Bordetella pertussis
gcguacugcugcaaggaca

SEQ ID NO: 2451062 - RNA, 16 nt, Bordetella pertussis
gcguacuggcgcggcg

SEQ ID NO: 2451063 - RNA, 17 nt, Bordetella pertussis
gcguacuggcgcggcgg

SEQ ID NO: 2451064 - RNA, 18 nt, Bordetella pertussis
gcguacuggcgcggcggc

SEQ ID NO: 2451065 - RNA, 22 nt, Bordetella pertussis
gcguacuggcgcggcggccagg

SEQ ID NO: 2451066 - RNA, 15 nt, Bordetella pertussis
gcguagaccaccugc

SEQ ID NO: 2451067 - RNA, 22 nt, Bordetella pertussis
gcguagaccaccugcucgguga

SEQ ID NO: 2451068 - RNA, 22 nt, Bordetella pertussis
gcguagagcagugugccugucc

SEQ ID NO: 2451069 - RNA, 12 nt, Bordetella pertussis
gcguagagcgcc

SEQ ID NO: 2451070 - RNA, 21 nt, Bordetella pertussis
gcguagcccuuguggccgccg

SEQ ID NO: 2451071 - RNA, 18 nt, Bordetella pertussis
gcguagccggugcgcagc

SEQ ID NO: 2451072 - RNA, 19 nt, Bordetella pertussis
gcguagccggugcgcagca

SEQ ID NO: 2451073 - RNA, 13 nt, Bordetella pertussis
gcguagcgcggcc

SEQ ID NO: 2451074 - RNA, 15 nt, Bordetella pertussis
gcguagcgcggccgg

SEQ ID NO: 2451075 - RNA, 13 nt, Bordetella pertussis
gcguagcucagcc

SEQ ID NO: 2451076 - RNA, 16 nt, Bordetella pertussis
gcguaggccucgcgcu

SEQ ID NO: 2451077 - RNA, 13 nt, Bordetella pertussis
gcguaggcgcgcg

SEQ ID NO: 2451078 - RNA, 17 nt, Bordetella pertussis
gcguaggcgcgcgcauc

SEQ ID NO: 2451079 - RNA, 13 nt, Bordetella pertussis
gcguaggucaggc

SEQ ID NO: 2451080 - RNA, 17 nt, Bordetella pertussis
gcguaggucaggcccac

SEQ ID NO: 2451081 - RNA, 19 nt, Bordetella pertussis
gcguaggucaggcccacgc

SEQ ID NO: 2451082 - RNA, 15 nt, Bordetella pertussis
gcguaguagcccagg

SEQ ID NO: 2451083 - RNA, 16 nt, Bordetella pertussis
gcguaguagcccaggc

SEQ ID NO: 2451084 - RNA, 17 nt, Bordetella pertussis
gcguaguagcccaggcc

SEQ ID NO: 2451085 - RNA, 23 nt, Bordetella pertussis
gcguaguagcccaggcccacgcc

SEQ ID NO: 2451086 - RNA, 18 nt, Bordetella pertussis
gcguagucguugccggcc

SEQ ID NO: 2451087 - RNA, 23 nt, Bordetella pertussis
gcguagugguaugaccggcgcgg

SEQ ID NO: 2451088 - RNA, 18 nt, Bordetella pertussis
gcguaguugucggcgcag

SEQ ID NO: 2451089 - RNA, 21 nt, Bordetella pertussis
gcguaucaacuuccagcgccc

SEQ ID NO: 2451090 - RNA, 19 nt, Bordetella pertussis
gcguauccagcaucaccag

SEQ ID NO: 2451091 - RNA, 18 nt, Bordetella pertussis
gcguauccgccguugcuc

SEQ ID NO: 2451092 - RNA, 18 nt, Bordetella pertussis
gcguaucgcccgcgcggu

SEQ ID NO: 2451093 - RNA, 13 nt, Bordetella pertussis
gcguaucgccgcc

SEQ ID NO: 2451094 - RNA, 18 nt, Bordetella pertussis
gcguaucggcgcgagcga

SEQ ID NO: 2451095 - RNA, 19 nt, Bordetella pertussis
gcguaucgggguucugucc

SEQ ID NO: 2451096 - RNA, 22 nt, Bordetella pertussis
gcguaucgggguucuguccggc

SEQ ID NO: 2451097 - RNA, 19 nt, Bordetella pertussis
gcguaucugaucggacugg

SEQ ID NO: 2451098 - RNA, 20 nt, Bordetella pertussis
gcguaucugaucggacuggg

SEQ ID NO: 2451099 - RNA, 23 nt, Bordetella pertussis
gcguaugacagggugccuguccc

SEQ ID NO: 2451100 - RNA, 12 nt, Bordetella pertussis
gcguaugcccug

SEQ ID NO: 2451101 - RNA, 17 nt, Bordetella pertussis
gcguaugcggcagcagg

SEQ ID NO: 2451102 - RNA, 19 nt, Bordetella pertussis
gcguauggcccgccaccac

SEQ ID NO: 2451103 - RNA, 13 nt, Bordetella pertussis
gcguauggcggcg

SEQ ID NO: 2451104 - RNA, 20 nt, Bordetella pertussis
gcguauugcuccacaggccu

SEQ ID NO: 2451105 - RNA, 14 nt, Bordetella pertussis
gcgucaagccagcg

SEQ ID NO: 2451106 - RNA, 16 nt, Bordetella pertussis
gcgucaagccagcggc

SEQ ID NO: 2451107 - RNA, 22 nt, Bordetella pertussis
gcgucaagccagcggcgcggcg

SEQ ID NO: 2451108 - RNA, 20 nt, Bordetella pertussis
gcgucaaggggcuguaccug

SEQ ID NO: 2451109 - RNA, 22 nt, Bordetella pertussis
gcgucaaggggcuguaccuggc

SEQ ID NO: 2451110 - RNA, 17 nt, Bordetella pertussis
gcgucaauccgccgcca

SEQ ID NO: 2451111 - RNA, 13 nt, Bordetella pertussis
gcgucaccagcag

SEQ ID NO: 2451112 - RNA, 22 nt, Bordetella pertussis
gcgucaccagcaggcggccgac

SEQ ID NO: 2451113 - RNA, 20 nt, Bordetella pertussis
gcgucacgaaagcgcccagg

SEQ ID NO: 2451114 - RNA, 19 nt, Bordetella pertussis
gcgucacgauuucggccau

SEQ ID NO: 2451115 - RNA, 13 nt, Bordetella pertussis
gcgucacgcacag

SEQ ID NO: 2451116 - RNA, 14 nt, Bordetella pertussis
gcgucacgcggccg

SEQ ID NO: 2451117 - RNA, 13 nt, Bordetella pertussis
gcgucaggagacg

SEQ ID NO: 2451118 - RNA, 12 nt, Bordetella pertussis
gcuccucgagcg

SEQ ID NO: 2451119 - RNA, 15 nt, Bordetella pertussis
gcuccucgagcgugg

SEQ ID NO: 2451120 - RNA, 21 nt, Bordetella pertussis
gcuccucgcccgaccugcugg

SEQ ID NO: 2451121 - RNA, 22 nt, Bordetella pertussis
gcuccucgcccgaccugcuggc

SEQ ID NO: 2451122 - RNA, 19 nt, Bordetella pertussis
gcuccucgcgcgcggacug

SEQ ID NO: 2451123 - RNA, 22 nt, Bordetella pertussis
gcuccucgcgcgcggacugcca

SEQ ID NO: 2451124 - RNA, 16 nt, Bordetella pertussis
gcuccucggccugccg

SEQ ID NO: 2451125 - RNA, 20 nt, Bordetella pertussis
gcuccucggccugccggcgc

SEQ ID NO: 2451126 - RNA, 17 nt, Bordetella pertussis
gcuccugcaggaugggg

SEQ ID NO: 2451127 - RNA, 14 nt, Bordetella pertussis
gcuccugccaggcg

SEQ ID NO: 2451128 - RNA, 15 nt, Bordetella pertussis
gcuccugccaggcgc

SEQ ID NO: 2451129 - RNA, 18 nt, Bordetella pertussis
gcuccugccaggcgccgc

SEQ ID NO: 2451130 - RNA, 17 nt, Bordetella pertussis
gcuccugcucggcgaug

SEQ ID NO: 2451131 - RNA, 19 nt, Bordetella pertussis
gcuccugugggggcgcggc

SEQ ID NO: 2451132 - RNA, 18 nt, Bordetella pertussis
gcgggucaaggcggggcu

SEQ ID NO: 2451133 - RNA, 21 nt, Bordetella pertussis
gcgggucaaguccggcgccgc

SEQ ID NO: 2451134 - RNA, 12 nt, Bordetella pertussis
gcggguccagca

SEQ ID NO: 2451135 - RNA, 15 nt, Bordetella pertussis
gcggguccagcagga

SEQ ID NO: 2451136 - RNA, 14 nt, Bordetella pertussis
gcggguccaggccc

SEQ ID NO: 2451137 - RNA, 13 nt, Bordetella pertussis
gcggguccuugcc

SEQ ID NO: 2451138 - RNA, 22 nt, Bordetella pertussis
gcgggucgaguugcgcgccaug

SEQ ID NO: 2451139 - RNA, 16 nt, Bordetella pertussis
gcgggucggcgccaug

SEQ ID NO: 2451140 - RNA, 18 nt, Bordetella pertussis
gcgggucggcgccaugac

SEQ ID NO: 2451141 - RNA, 18 nt, Bordetella pertussis
gcgggucgucccagcgca

SEQ ID NO: 2451142 - RNA, 20 nt, Bordetella pertussis
gcgggucgucccagcgcacg

SEQ ID NO: 2451143 - RNA, 19 nt, Bordetella pertussis
gcgggucuugagcggcccg

SEQ ID NO: 2451144 - RNA, 15 nt, Bordetella pertussis
gcgggugaugcugca

SEQ ID NO: 2451145 - RNA, 23 nt, Bordetella pertussis
gcgggugaugcugcagcgcaucg

SEQ ID NO: 2451146 - RNA, 19 nt, Bordetella pertussis
gcgggugccaguccccaug

SEQ ID NO: 2451147 - RNA, 14 nt, Bordetella pertussis
gcgggugcgccugc

SEQ ID NO: 2451148 - RNA, 14 nt, Bordetella pertussis
gcgggugcugcagc

SEQ ID NO: 2451149 - RNA, 17 nt, Bordetella pertussis
gcgggugcugcagcgca

SEQ ID NO: 2451150 - RNA, 19 nt, Bordetella pertussis
gcgggugcugcagcgcacc

SEQ ID NO: 2451151 - RNA, 20 nt, Bordetella pertussis
gcgggugcugcagcgcacca

SEQ ID NO: 2451152 - RNA, 13 nt, Bordetella pertussis
gcggguggccgau

SEQ ID NO: 2451153 - RNA, 22 nt, Bordetella pertussis
gcggguggccgauuccagcgcc

SEQ ID NO: 2451154 - RNA, 19 nt, Bordetella pertussis
gcggguggccgcuccagag

SEQ ID NO: 2451155 - RNA, 18 nt, Bordetella pertussis
gcggguggccggaucgag

SEQ ID NO: 2451156 - RNA, 22 nt, Bordetella pertussis
gcggguggccggaucgagcgcg

SEQ ID NO: 2451157 - RNA, 16 nt, Bordetella pertussis
gcggguggccucgccc

SEQ ID NO: 2451158 - RNA, 20 nt, Bordetella pertussis
gcggguggccucgcccuggc

SEQ ID NO: 2451159 - RNA, 23 nt, Bordetella pertussis
gcggguggccucgcccuggcgca

SEQ ID NO: 2451160 - RNA, 13 nt, Bordetella pertussis
gcggguggcggcg

SEQ ID NO: 2451161 - RNA, 17 nt, Bordetella pertussis
gcgggugggcgcgccgc

SEQ ID NO: 2451162 - RNA, 19 nt, Bordetella pertussis
gcgggugggcgcgccgcga

SEQ ID NO: 2451163 - RNA, 13 nt, Bordetella pertussis
gcgggugucccag

SEQ ID NO: 2451164 - RNA, 20 nt, Bordetella pertussis
gcgggugucgcucccccaug

SEQ ID NO: 2451165 - RNA, 17 nt, Bordetella pertussis
gcggguguugucaugcg

SEQ ID NO: 2451166 - RNA, 19 nt, Bordetella pertussis
gcggguucgacgccggcag

SEQ ID NO: 2451167 - RNA, 21 nt, Bordetella pertussis
gcggguucgacgccggcagcg

SEQ ID NO: 2451168 - RNA, 14 nt, Bordetella pertussis
gcggguucguggcu

SEQ ID NO: 2451169 - RNA, 14 nt, Bordetella pertussis
gcggguugcgcgcc

SEQ ID NO: 2451170 - RNA, 13 nt, Bordetella pertussis
gcggguugcggca

SEQ ID NO: 2451171 - RNA, 16 nt, Bordetella pertussis
gcggguugcggcagcg

SEQ ID NO: 2451172 - RNA, 22 nt, Bordetella pertussis
gcggguuggucgucagcgccgc

SEQ ID NO: 2451173 - RNA, 14 nt, Bordetella pertussis
gcggguugugcccg

SEQ ID NO: 2451174 - RNA, 15 nt, Bordetella pertussis
gcggguugugcccgc

SEQ ID NO: 2451175 - RNA, 19 nt, Bordetella pertussis
gcggguugugcccgcccgg

SEQ ID NO: 2451176 - RNA, 19 nt, Bordetella pertussis
gcggguuucucggccuugg

SEQ ID NO: 2451177 - RNA, 17 nt, Bordetella pertussis
gcgguaaugacgcagcc

SEQ ID NO: 2451178 - RNA, 18 nt, Bordetella pertussis
gcgguaaugacgcagccg

SEQ ID NO: 2451179 - RNA, 20 nt, Bordetella pertussis
gcgguaaugacgcagccgcc

SEQ ID NO: 2451180 - RNA, 19 nt, Bordetella pertussis
gcgguacaggccggcggcg

SEQ ID NO: 2451181 - RNA, 23 nt, Bordetella pertussis
gcgguacaggcugccgucggcca

SEQ ID NO: 2451182 - RNA, 13 nt, Bordetella pertussis
gcgguacaggucg

SEQ ID NO: 2451183 - RNA, 12 nt, Bordetella pertussis
gcgguaccacgc

SEQ ID NO: 2451184 - RNA, 14 nt, Bordetella pertussis
gcgguaccaggccg

SEQ ID NO: 2451185 - RNA, 14 nt, Bordetella pertussis
gcgguacgcaccgc

SEQ ID NO: 2451186 - RNA, 12 nt, Bordetella pertussis
gcgguacgccca

SEQ ID NO: 2451187 - RNA, 16 nt, Bordetella pertussis
gcgguacgcccagcug

SEQ ID NO: 2451188 - RNA, 14 nt, Bordetella pertussis
gcgguacgcgggca

SEQ ID NO: 2451189 - RNA, 15 nt, Bordetella pertussis
gcgguacgcgggcau

SEQ ID NO: 2451190 - RNA, 17 nt, Bordetella pertussis
gcgguacucgcgcgggu

SEQ ID NO: 2451191 - RNA, 14 nt, Bordetella pertussis
gcgguacugcggcg

SEQ ID NO: 2451192 - RNA, 16 nt, Bordetella pertussis
gcgguacugcggcgcc

SEQ ID NO: 2451193 - RNA, 17 nt, Bordetella pertussis
gcgguacugcggcgccu

SEQ ID NO: 2451194 - RNA, 15 nt, Bordetella pertussis
gcgguagacgccggg

SEQ ID NO: 2451195 - RNA, 18 nt, Bordetella pertussis
gcgguagacgccgggacg

SEQ ID NO: 2451196 - RNA, 23 nt, Bordetella pertussis
gcgguagcgcucguccaugccgg

SEQ ID NO: 2451197 - RNA, 15 nt, Bordetella pertussis
gcgguaggacggcag

SEQ ID NO: 2451198 - RNA, 16 nt, Bordetella pertussis
gcgguaggacggcagc

SEQ ID NO: 2451199 - RNA, 17 nt, Bordetella pertussis
gcgguaggacggcagca

SEQ ID NO: 2451200 - RNA, 15 nt, Bordetella pertussis
gcgguaggcccagca

SEQ ID NO: 2451201 - RNA, 19 nt, Bordetella pertussis
gcgguagguagcgcgcagc

SEQ ID NO: 2451202 - RNA, 20 nt, Bordetella pertussis
gcgguagguagcgcgcagcu

SEQ ID NO: 2451203 - RNA, 21 nt, Bordetella pertussis
gcgguagguaugguuggccac

SEQ ID NO: 2451204 - RNA, 23 nt, Bordetella pertussis
gcgguaguccaucgcguccaggc

SEQ ID NO: 2451205 - RNA, 21 nt, Bordetella pertussis
gcgguaucccaccugcagcca

SEQ ID NO: 2451206 - RNA, 15 nt, Bordetella pertussis
gcgguaugcggcgcc

SEQ ID NO: 2451207 - RNA, 18 nt, Bordetella pertussis
gcgguaugcggcgcccag

SEQ ID NO: 2451208 - RNA, 22 nt, Bordetella pertussis
gcgguaugcggcgcccaggccc

SEQ ID NO: 2451209 - RNA, 21 nt, Bordetella pertussis
gcgguauggccgcccagcauu

SEQ ID NO: 2451210 - RNA, 18 nt, Bordetella pertussis
gcgguauucgcgcuggcg

SEQ ID NO: 2451211 - RNA, 22 nt, Bordetella pertussis
gcgguauucgcugcuggccgcg

SEQ ID NO: 2451212 - RNA, 15 nt, Bordetella pertussis
gcgguauucggcgac

SEQ ID NO: 2451213 - RNA, 14 nt, Bordetella pertussis
gcgguauugcgcca

SEQ ID NO: 2451214 - RNA, 16 nt, Bordetella pertussis
gcgguauugcgccacc

SEQ ID NO: 2451215 - RNA, 20 nt, Bordetella pertussis
gcggucaaugaagggcugca

SEQ ID NO: 2451216 - RNA, 23 nt, Bordetella pertussis
gcguccacggcaucggccagcau

SEQ ID NO: 2451217 - RNA, 13 nt, Bordetella pertussis
gcguccagccgag

SEQ ID NO: 2451218 - RNA, 19 nt, Bordetella pertussis
gcguccagccgagccuggc

SEQ ID NO: 2451219 - RNA, 16 nt, Bordetella pertussis
gcguccagcgcgcggc

SEQ ID NO: 2451220 - RNA, 17 nt, Bordetella pertussis
gcguccagcgcgcggcc

SEQ ID NO: 2451221 - RNA, 19 nt, Bordetella pertussis
gcguccagcgcgcggccuc

SEQ ID NO: 2451222 - RNA, 15 nt, Bordetella pertussis
gcguccaggcccagc

SEQ ID NO: 2451223 - RNA, 19 nt, Bordetella pertussis
gcguccaggcccagcgcgu

SEQ ID NO: 2451224 - RNA, 20 nt, Bordetella pertussis
gcguccaggcccuggcggcg

SEQ ID NO: 2451225 - RNA, 23 nt, Bordetella pertussis
gcguccaggcccuggcggcgcag

SEQ ID NO: 2451226 - RNA, 24 nt, Bordetella pertussis
gcguccaggcccuggcggcgcagu

SEQ ID NO: 2451227 - RNA, 19 nt, Bordetella pertussis
gcguccaggcgcgccagcc

SEQ ID NO: 2451228 - RNA, 12 nt, Bordetella pertussis
gcguccaggcgg

SEQ ID NO: 2451229 - RNA, 14 nt, Bordetella pertussis
gcguccaggcugcc

SEQ ID NO: 2451230 - RNA, 15 nt, Bordetella pertussis
gcguccaggcugccg

SEQ ID NO: 2451231 - RNA, 16 nt, Bordetella pertussis
gcguccaggcugccgg

SEQ ID NO: 2451232 - RNA, 17 nt, Bordetella pertussis
gcguccaggcugccggc

SEQ ID NO: 2451233 - RNA, 20 nt, Bordetella pertussis
gcguccaggcugccggcguu

SEQ ID NO: 2451234 - RNA, 15 nt, Bordetella pertussis
gcguccagguugggc

SEQ ID NO: 2451235 - RNA, 19 nt, Bordetella pertussis
gcguccagguugggcacca

SEQ ID NO: 2451236 - RNA, 20 nt, Bordetella pertussis
gcguccagguugggcaccac

SEQ ID NO: 2451237 - RNA, 22 nt, Bordetella pertussis
gcguccagguugggcaccacca

SEQ ID NO: 2451238 - RNA, 21 nt, Bordetella pertussis
gcguccaucuggaccgcgcgc

SEQ ID NO: 2451239 - RNA, 20 nt, Bordetella pertussis
gcguccauuagggcccagcu

SEQ ID NO: 2451240 - RNA, 22 nt, Bordetella pertussis
gcguccauuagggcccagcugc

SEQ ID NO: 2451241 - RNA, 12 nt, Bordetella pertussis
gcgucccaggcc

SEQ ID NO: 2451242 - RNA, 13 nt, Bordetella pertussis
gcgucccaggcca

SEQ ID NO: 2451243 - RNA, 17 nt, Bordetella pertussis
gcgucccaggccacguu

SEQ ID NO: 2451244 - RNA, 20 nt, Bordetella pertussis
gcgucccgguaggccugguc

SEQ ID NO: 2451245 - RNA, 19 nt, Bordetella pertussis
gcgucccggugaucguccu

SEQ ID NO: 2451246 - RNA, 12 nt, Bordetella pertussis
gcguccgcccgc

SEQ ID NO: 2451247 - RNA, 17 nt, Bordetella pertussis
gcguccgccgugcaggc

SEQ ID NO: 2451248 - RNA, 19 nt, Bordetella pertussis
gcguccgccgugcaggccc

SEQ ID NO: 2451249 - RNA, 14 nt, Bordetella pertussis
gcguccgcgcgccg

SEQ ID NO: 2451250 - RNA, 15 nt, Bordetella pertussis
gcguccgcgcgccgc

SEQ ID NO: 2451251 - RNA, 16 nt, Bordetella pertussis
gcguccgcgcgccgcu

SEQ ID NO: 2451252 - RNA, 16 nt, Bordetella pertussis
gcguccgcgucgccgc

SEQ ID NO: 2451253 - RNA, 18 nt, Bordetella pertussis
gcguccgcgucgccgccg

SEQ ID NO: 2451254 - RNA, 14 nt, Bordetella pertussis
gcguccgcucaugc

SEQ ID NO: 2451255 - RNA, 15 nt, Bordetella pertussis
gcguccgcucaugcc

SEQ ID NO: 2451256 - RNA, 15 nt, Bordetella pertussis
gcguccucggccagc

SEQ ID NO: 2451257 - RNA, 16 nt, Bordetella pertussis
gcguccucggccagcc

SEQ ID NO: 2451258 - RNA, 19 nt, Bordetella pertussis
gcguccucggccagccggg

SEQ ID NO: 2451259 - RNA, 16 nt, Bordetella pertussis
gcguccucggccuggc

SEQ ID NO: 2451260 - RNA, 13 nt, Bordetella pertussis
gcguccugccagu

SEQ ID NO: 2451261 - RNA, 21 nt, Bordetella pertussis
gcguccugccaguugccgccg

SEQ ID NO: 2451262 - RNA, 15 nt, Bordetella pertussis
gcguccugcgccagu

SEQ ID NO: 2451263 - RNA, 20 nt, Bordetella pertussis
gcguccugggccgagcgcgc

SEQ ID NO: 2451264 - RNA, 21 nt, Bordetella pertussis
gcguccugggccgagcgcgcc

SEQ ID NO: 2451265 - RNA, 14 nt, Bordetella pertussis
gcguccuuggcggc

SEQ ID NO: 2451266 - RNA, 15 nt, Bordetella pertussis
gcguccuuggcggcc

SEQ ID NO: 2451267 - RNA, 19 nt, Bordetella pertussis
gcguccuuggcggccuugc

SEQ ID NO: 2451268 - RNA, 16 nt, Bordetella pertussis
gcgucgaaacgcugcg

SEQ ID NO: 2451269 - RNA, 15 nt, Bordetella pertussis
gcgucgaacggccgg

SEQ ID NO: 2451270 - RNA, 18 nt, Bordetella pertussis
gcgucgaacggccgggcg

SEQ ID NO: 2451271 - RNA, 16 nt, Bordetella pertussis
gcgucgaaggccgccg

SEQ ID NO: 2451272 - RNA, 16 nt, Bordetella pertussis
gcgucgaaggcggccg

SEQ ID NO: 2451273 - RNA, 18 nt, Bordetella pertussis
gcgucgaaggcggccggc

SEQ ID NO: 2451274 - RNA, 20 nt, Bordetella pertussis
gcgucgaaggcggccggcag

SEQ ID NO: 2451275 - RNA, 22 nt, Bordetella pertussis
gcgucgaaggcggccggcaggc

SEQ ID NO: 2451276 - RNA, 20 nt, Bordetella pertussis
gcgucgaagguuucgcugcg

SEQ ID NO: 2451277 - RNA, 18 nt, Bordetella pertussis
gcgucgaaugcacgggcg

SEQ ID NO: 2451278 - RNA, 23 nt, Bordetella pertussis
gcgucgaaugcacgggcgcugcc

SEQ ID NO: 2451279 - RNA, 14 nt, Bordetella pertussis
gcgucgaccgccau

SEQ ID NO: 2451280 - RNA, 18 nt, Bordetella pertussis
gcgucgaccgccaugcgc

SEQ ID NO: 2451281 - RNA, 16 nt, Bordetella pertussis
gcgucgaccgcgggcg

SEQ ID NO: 2451282 - RNA, 18 nt, Bordetella pertussis
gcgucgaccgcgggcgcg

SEQ ID NO: 2451283 - RNA, 21 nt, Bordetella pertussis
gcgucgaccgcgggcgcgcgc

SEQ ID NO: 2451284 - RNA, 22 nt, Bordetella pertussis
gcgucgaccgcgggcgcgcgcc

SEQ ID NO: 2451285 - RNA, 21 nt, Bordetella pertussis
gcgucgacgcccgcgcccagu

SEQ ID NO: 2451286 - RNA, 23 nt, Bordetella pertussis
gcgucgacggugcgcgccacggc

SEQ ID NO: 2451287 - RNA, 17 nt, Bordetella pertussis
gcgucgacguaccaagc

SEQ ID NO: 2451288 - RNA, 22 nt, Bordetella pertussis
gcgucgacguaccaagccugcu

SEQ ID NO: 2451289 - RNA, 20 nt, Bordetella pertussis
gcgucgacuuuguaucuguu

SEQ ID NO: 2451290 - RNA, 16 nt, Bordetella pertussis
gcgucgagcacgcggc

SEQ ID NO: 2451291 - RNA, 14 nt, Bordetella pertussis
gcgucgagcagcgc

SEQ ID NO: 2451292 - RNA, 16 nt, Bordetella pertussis
gcgucgagcaggccgg

SEQ ID NO: 2451293 - RNA, 18 nt, Bordetella pertussis
gcgucgagcaggccggcg

SEQ ID NO: 2451294 - RNA, 19 nt, Bordetella pertussis
gcgucgagcaggccggcgu

SEQ ID NO: 2451295 - RNA, 18 nt, Bordetella pertussis
gcgucgagcgcgacgcgc

SEQ ID NO: 2451296 - RNA, 12 nt, Bordetella pertussis
gcgucgagcggc

SEQ ID NO: 2451297 - RNA, 18 nt, Bordetella pertussis
gcgucgagcggcguguga

SEQ ID NO: 2451298 - RNA, 17 nt, Bordetella pertussis
gcgucgagcugacgaag

SEQ ID NO: 2451299 - RNA, 12 nt, Bordetella pertussis
gcgucgaucagc

SEQ ID NO: 2451300 - RNA, 22 nt, Bordetella pertussis
gcgucgaucaugaugcgcuggg

SEQ ID NO: 2451301 - RNA, 17 nt, Bordetella pertussis
gcgucgauccggcagca

SEQ ID NO: 2451302 - RNA, 21 nt, Bordetella pertussis
gcgucgauccggcagcagcag

SEQ ID NO: 2451303 - RNA, 14 nt, Bordetella pertussis
gcgucgaucggcgc

SEQ ID NO: 2451304 - RNA, 20 nt, Bordetella pertussis
gcgucgaucggcgcgcccgc

SEQ ID NO: 2451305 - RNA, 18 nt, Bordetella pertussis
gcgucgaucuucgccugc

SEQ ID NO: 2451306 - RNA, 20 nt, Bordetella pertussis
gcgucgaugcgcgcgcggau

SEQ ID NO: 2451307 - RNA, 22 nt, Bordetella pertussis
gcguggccaucaagaaggucga

SEQ ID NO: 2451308 - RNA, 17 nt, Bordetella pertussis
gcguggcccgcgccgcg

SEQ ID NO: 2451309 - RNA, 23 nt, Bordetella pertussis
gcguggccgaggugcccaucagg

SEQ ID NO: 2451310 - RNA, 17 nt, Bordetella pertussis
gcguggccgcagucagg

SEQ ID NO: 2451311 - RNA, 16 nt, Bordetella pertussis
gcguggccgccaccag

SEQ ID NO: 2451312 - RNA, 17 nt, Bordetella pertussis
gcguggccgccaccagc

SEQ ID NO: 2451313 - RNA, 18 nt, Bordetella pertussis
gcguggccgccaccagcg

SEQ ID NO: 2451314 - RNA, 15 nt, Bordetella pertussis
gcguggccgccacgc

SEQ ID NO: 2451315 - RNA, 13 nt, Bordetella pertussis
gcguggccgccgg

SEQ ID NO: 2451316 - RNA, 12 nt, Bordetella pertussis
gcguggccggcg

SEQ ID NO: 2451317 - RNA, 14 nt, Bordetella pertussis
gcguggccggcggg

SEQ ID NO: 2451318 - RNA, 23 nt, Bordetella pertussis
gcguggccguucggugcgcagcg

SEQ ID NO: 2451319 - RNA, 18 nt, Bordetella pertussis
gcguggccucuugcguga

SEQ ID NO: 2451320 - RNA, 14 nt, Bordetella pertussis
gcguggccugcccg

SEQ ID NO: 2451321 - RNA, 13 nt, Bordetella pertussis
gcguggcgacgcg

SEQ ID NO: 2451322 - RNA, 15 nt, Bordetella pertussis
gcguggcgacgcgcu

SEQ ID NO: 2451323 - RNA, 18 nt, Bordetella pertussis
gcguggcgacgcgcugcc

SEQ ID NO: 2451324 - RNA, 12 nt, Bordetella pertussis
gcguggcgcagg

SEQ ID NO: 2451325 - RNA, 13 nt, Bordetella pertussis
gcguggcgcaguc

SEQ ID NO: 2451326 - RNA, 22 nt, Bordetella pertussis
gcguggcgcgaugugacggcuc

SEQ ID NO: 2451327 - RNA, 15 nt, Bordetella pertussis
gcguggcgcgcaacc

SEQ ID NO: 2451328 - RNA, 14 nt, Bordetella pertussis
gcguggcgcgcaca

SEQ ID NO: 2451329 - RNA, 12 nt, Bordetella pertussis
gcguggcgcgcc

SEQ ID NO: 2451330 - RNA, 13 nt, Bordetella pertussis
gcguggcgcgcca

SEQ ID NO: 2451331 - RNA, 15 nt, Bordetella pertussis
gcguggcgcgccagc

SEQ ID NO: 2451332 - RNA, 17 nt, Bordetella pertussis
gcguggcgcgccagcgc

SEQ ID NO: 2451333 - RNA, 15 nt, Bordetella pertussis
gcguggcgcgcccgc

SEQ ID NO: 2451334 - RNA, 17 nt, Bordetella pertussis
gcguggcgcgcccgcac

SEQ ID NO: 2451335 - RNA, 20 nt, Bordetella pertussis
gcguggcgcgcgccgaugcg

SEQ ID NO: 2451336 - RNA, 14 nt, Bordetella pertussis
gcguggcggccagg

SEQ ID NO: 2451337 - RNA, 15 nt, Bordetella pertussis
gcguggcggccaggc

SEQ ID NO: 2451338 - RNA, 18 nt, Bordetella pertussis
gcguggcggccaggccgg

SEQ ID NO: 2451339 - RNA, 11 nt, Bordetella pertussis
gcguggcggcg

SEQ ID NO: 2451340 - RNA, 20 nt, Bordetella pertussis
gcguggcggcgcagcgccca

SEQ ID NO: 2451341 - RNA, 19 nt, Bordetella pertussis
gcguggcgggccgcgccgc

SEQ ID NO: 2451342 - RNA, 23 nt, Bordetella pertussis
gcguggcggggauggcuggccga

SEQ ID NO: 2451343 - RNA, 17 nt, Bordetella pertussis
gcguggcggggcguucg

SEQ ID NO: 2451344 - RNA, 21 nt, Bordetella pertussis
gcguggcgguguuggcgucca

SEQ ID NO: 2451345 - RNA, 19 nt, Bordetella pertussis
gcguggcguaauagcuggc

SEQ ID NO: 2451346 - RNA, 23 nt, Bordetella pertussis
gcguggcguaauagcuggcggcg

SEQ ID NO: 2451347 - RNA, 15 nt, Bordetella pertussis
gcguggcguccaugc

SEQ ID NO: 2451348 - RNA, 17 nt, Bordetella pertussis
gcguggcgugccgcagc

SEQ ID NO: 2451349 - RNA, 13 nt, Bordetella pertussis
gcguggcuggcgu

SEQ ID NO: 2451350 - RNA, 19 nt, Bordetella pertussis
gcguggcuggcgucgauca

SEQ ID NO: 2451351 - RNA, 16 nt, Bordetella pertussis
gcgugggcacccggcc

SEQ ID NO: 2451352 - RNA, 13 nt, Bordetella pertussis
gcgugggccagca

SEQ ID NO: 2451353 - RNA, 20 nt, Bordetella pertussis
gcgugggccagcaacuggug

SEQ ID NO: 2451354 - RNA, 20 nt, Bordetella pertussis
gcgugggccaguccgcagcg

SEQ ID NO: 2451355 - RNA, 13 nt, Bordetella pertussis
gcgugggcggcgg

SEQ ID NO: 2451356 - RNA, 17 nt, Bordetella pertussis
gcguggggacgcgggcc

SEQ ID NO: 2451357 - RNA, 17 nt, Bordetella pertussis
gcguggggagcgcggcc

SEQ ID NO: 2451358 - RNA, 18 nt, Bordetella pertussis
gcguggggccggccgcgc

SEQ ID NO: 2451359 - RNA, 16 nt, Bordetella pertussis
gcgugguaucgcgcca

SEQ ID NO: 2451360 - RNA, 23 nt, Bordetella pertussis
gcgugguaucgcgccagcgccgc

SEQ ID NO: 2451361 - RNA, 20 nt, Bordetella pertussis
gcgugguauugguggucugg

SEQ ID NO: 2451362 - RNA, 19 nt, Bordetella pertussis
gcguggucgcggguggugg

SEQ ID NO: 2451363 - RNA, 23 nt, Bordetella pertussis
gcgugguggccuugcugcccgac

SEQ ID NO: 2451364 - RNA, 21 nt, Bordetella pertussis
gcguguagagcaggccgccca

SEQ ID NO: 2451365 - RNA, 15 nt, Bordetella pertussis
gcguguccagcggcg

SEQ ID NO: 2451366 - RNA, 18 nt, Bordetella pertussis
gcguguccagcggcgcca

SEQ ID NO: 2451367 - RNA, 20 nt, Bordetella pertussis
gcguguccagcggcgccagc

SEQ ID NO: 2451368 - RNA, 21 nt, Bordetella pertussis
gcguguccagcggcgccagcg

SEQ ID NO: 2451369 - RNA, 21 nt, Bordetella pertussis
gcguguccgccguagcgcgcc

SEQ ID NO: 2451370 - RNA, 17 nt, Bordetella pertussis
gcgugucgccgacccgg

SEQ ID NO: 2451371 - RNA, 16 nt, Bordetella pertussis
gcgugugcccagcacc

SEQ ID NO: 2451372 - RNA, 19 nt, Bordetella pertussis
gcgugugcccagcaccagg

SEQ ID NO: 2451373 - RNA, 22 nt, Bordetella pertussis
gcgugugcccagcaccaggccg

SEQ ID NO: 2451374 - RNA, 21 nt, Bordetella pertussis
gcguguggugaaagccgccgg

SEQ ID NO: 2451375 - RNA, 23 nt, Bordetella pertussis
gcguguggugaaagccgccggcg

SEQ ID NO: 2451376 - RNA, 14 nt, Bordetella pertussis
gcgugugguuggcg

SEQ ID NO: 2451377 - RNA, 21 nt, Bordetella pertussis
gcguguucagcgcgcgcgccg

SEQ ID NO: 2451378 - RNA, 16 nt, Bordetella pertussis
gcguguuccagcgccu

SEQ ID NO: 2451379 - RNA, 17 nt, Bordetella pertussis
gcguguuccagcgccug

SEQ ID NO: 2451380 - RNA, 19 nt, Bordetella pertussis
gcguguuccagcgccuggc

SEQ ID NO: 2451381 - RNA, 15 nt, Bordetella pertussis
gcguguuuuccucgu

SEQ ID NO: 2451382 - RNA, 18 nt, Bordetella pertussis
gcguucaagucgcccugc

SEQ ID NO: 2451383 - RNA, 20 nt, Bordetella pertussis
gcguucaccaggaagcgcgc

SEQ ID NO: 2451384 - RNA, 22 nt, Bordetella pertussis
gcguucaccaggaagcgcgccu

SEQ ID NO: 2451385 - RNA, 14 nt, Bordetella pertussis
gcguucagcagcag

SEQ ID NO: 2451386 - RNA, 16 nt, Bordetella pertussis
gcguucaggcgcggcu

SEQ ID NO: 2451387 - RNA, 21 nt, Bordetella pertussis
gcguucaggucgccguucugg

SEQ ID NO: 2451388 - RNA, 15 nt, Bordetella pertussis
gcguucauggcgcau

SEQ ID NO: 2451389 - RNA, 17 nt, Bordetella pertussis
gcguuccaugacgucca

SEQ ID NO: 2451390 - RNA, 18 nt, Bordetella pertussis
gcguucgaaagccagcgc

SEQ ID NO: 2451391 - RNA, 19 nt, Bordetella pertussis
gcguucgaaagccagcgcc

SEQ ID NO: 2451392 - RNA, 17 nt, Bordetella pertussis
gcguucgacgggcaggc

SEQ ID NO: 2451393 - RNA, 15 nt, Bordetella pertussis
gcguucgccgcagcc

SEQ ID NO: 2451394 - RNA, 16 nt, Bordetella pertussis
gcguucgccgcagccg

SEQ ID NO: 2451395 - RNA, 15 nt, Bordetella pertussis
gcguucgccgucguu

SEQ ID NO: 2451396 - RNA, 15 nt, Bordetella pertussis
gcguucgcgccgcgu

SEQ ID NO: 2451397 - RNA, 15 nt, Bordetella pertussis
gcguucgcggcccug

SEQ ID NO: 2451398 - RNA, 19 nt, Bordetella pertussis
gcguucgcggugggcagcg

SEQ ID NO: 2451399 - RNA, 13 nt, Bordetella pertussis
gcguucggccacu

SEQ ID NO: 2451400 - RNA, 16 nt, Bordetella pertussis
gcguucggccacuucc

SEQ ID NO: 2451401 - RNA, 14 nt, Bordetella pertussis
gcguucgggacgca

SEQ ID NO: 2451402 - RNA, 15 nt, Bordetella pertussis
gcguucgggacgcag

SEQ ID NO: 2451403 - RNA, 17 nt, Bordetella pertussis
gcguucgggacgcagga

SEQ ID NO: 2451404 - RNA, 19 nt, Bordetella pertussis
gcguucgggacgcaggagu

SEQ ID NO: 2451405 - RNA, 12 nt, Bordetella pertussis
gcguucgggcgg

SEQ ID NO: 2451406 - RNA, 14 nt, Bordetella pertussis
gcguucgggcggca

SEQ ID NO: 2451407 - RNA, 16 nt, Bordetella pertussis
gcguucgguggcgugg

SEQ ID NO: 2451408 - RNA, 15 nt, Bordetella pertussis
gcguucgucgccucc

SEQ ID NO: 2451409 - RNA, 16 nt, Bordetella pertussis
gcguucguggaugacu

SEQ ID NO: 2451410 - RNA, 22 nt, Bordetella pertussis
gcguucucgacccgcucggcca

SEQ ID NO: 2451411 - RNA, 18 nt, Bordetella pertussis
gcguucugcagcgcggug

SEQ ID NO: 2451412 - RNA, 16 nt, Bordetella pertussis
gcguucuggcgcagca

SEQ ID NO: 2451413 - RNA, 17 nt, Bordetella pertussis
gcguucuucagcgcgcu

SEQ ID NO: 2451414 - RNA, 22 nt, Bordetella pertussis
gcguucuucagcuacggcuggc

SEQ ID NO: 2451415 - RNA, 17 nt, Bordetella pertussis
gcguugaccgccucgau

SEQ ID NO: 2451416 - RNA, 13 nt, Bordetella pertussis
gcguugaccuggu

SEQ ID NO: 2451417 - RNA, 20 nt, Bordetella pertussis
gcguugaccuggucgggcgu

SEQ ID NO: 2451418 - RNA, 16 nt, Bordetella pertussis
gcguugacguggcuga

SEQ ID NO: 2451419 - RNA, 17 nt, Bordetella pertussis
gcguugagcgccgacgg

SEQ ID NO: 2451420 - RNA, 16 nt, Bordetella pertussis
gcguugaucaucggcc

SEQ ID NO: 2451421 - RNA, 19 nt, Bordetella pertussis
gcguugaucaucggcccga

SEQ ID NO: 2451422 - RNA, 13 nt, Bordetella pertussis
gcguugcaccgcg

SEQ ID NO: 2451423 - RNA, 16 nt, Bordetella pertussis
gcguugcagccacagg

SEQ ID NO: 2451424 - RNA, 15 nt, Bordetella pertussis
gcggugccgcccacc

SEQ ID NO: 2451425 - RNA, 15 nt, Bordetella pertussis
gcggugccgccuggc

SEQ ID NO: 2451426 - RNA, 15 nt, Bordetella pertussis
gcggugccgcgcacc

SEQ ID NO: 2451427 - RNA, 16 nt, Bordetella pertussis
gcggugccgcgcaccc

SEQ ID NO: 2451428 - RNA, 15 nt, Bordetella pertussis
gcggugccgcgcgcg

SEQ ID NO: 2451429 - RNA, 16 nt, Bordetella pertussis
gcggugccgcgcgcgg

SEQ ID NO: 2451430 - RNA, 20 nt, Bordetella pertussis
gcggugccgcgcgcggccgg

SEQ ID NO: 2451431 - RNA, 13 nt, Bordetella pertussis
gcggugccugucc

SEQ ID NO: 2451432 - RNA, 17 nt, Bordetella pertussis
gcggugccugugcccgc

SEQ ID NO: 2451433 - RNA, 21 nt, Bordetella pertussis
gcggugcgacugcaggaugag

SEQ ID NO: 2451434 - RNA, 20 nt, Bordetella pertussis
gcggugcgcaccaggcccau

SEQ ID NO: 2451435 - RNA, 21 nt, Bordetella pertussis
gcggugcgccgcaugcggcgg

SEQ ID NO: 2451436 - RNA, 23 nt, Bordetella pertussis
gcggugcgccgcaugcggcggcu

SEQ ID NO: 2451437 - RNA, 15 nt, Bordetella pertussis
gcggugcgcgcggcc

SEQ ID NO: 2451438 - RNA, 16 nt, Bordetella pertussis
gcggugcgcgcggccg

SEQ ID NO: 2451439 - RNA, 11 nt, Bordetella pertussis
gcggugcgcgg

SEQ ID NO: 2451440 - RNA, 13 nt, Bordetella pertussis
gcggugcgcggcg

SEQ ID NO: 2451441 - RNA, 17 nt, Bordetella pertussis
gcggugcgcggcgcagc

SEQ ID NO: 2451442 - RNA, 21 nt, Bordetella pertussis
gcggugcgcggcgcagcccag

SEQ ID NO: 2451443 - RNA, 21 nt, Bordetella pertussis
gcggugcggaggcggccgcgg

SEQ ID NO: 2451444 - RNA, 14 nt, Bordetella pertussis
gcggugcggccucg

SEQ ID NO: 2451445 - RNA, 19 nt, Bordetella pertussis
gcggugcguccaggacgcg

SEQ ID NO: 2451446 - RNA, 15 nt, Bordetella pertussis
gcggugcgugcgccc

SEQ ID NO: 2451447 - RNA, 16 nt, Bordetella pertussis
gcggugcgugcgccca

SEQ ID NO: 2451448 - RNA, 18 nt, Bordetella pertussis
gcggugcgugcgcccaug

SEQ ID NO: 2451449 - RNA, 19 nt, Bordetella pertussis
gcggugcuugaugcccagc

SEQ ID NO: 2451450 - RNA, 13 nt, Bordetella pertussis
gcgguggccagcg

SEQ ID NO: 2451451 - RNA, 15 nt, Bordetella pertussis
gcgguggccagcgug

SEQ ID NO: 2451452 - RNA, 19 nt, Bordetella pertussis
gcgguggccaugcugggcg

SEQ ID NO: 2451453 - RNA, 20 nt, Bordetella pertussis
gcgguggccaugcugggcgg

SEQ ID NO: 2451454 - RNA, 16 nt, Bordetella pertussis
gcgguggccgccgcgc

SEQ ID NO: 2451455 - RNA, 19 nt, Bordetella pertussis
gcgguggccgccgcgcgcc

SEQ ID NO: 2451456 - RNA, 20 nt, Bordetella pertussis
gcgguggccgccgcgcgccg

SEQ ID NO: 2451457 - RNA, 21 nt, Bordetella pertussis
gcgguggccgccgcgcgccgc

SEQ ID NO: 2451458 - RNA, 14 nt, Bordetella pertussis
gcgguggccgcgca

SEQ ID NO: 2451459 - RNA, 23 nt, Bordetella pertussis
gcgguggccgcuucggcggccgc

SEQ ID NO: 2451460 - RNA, 13 nt, Bordetella pertussis
gcgguggcggccg

SEQ ID NO: 2451461 - RNA, 20 nt, Bordetella pertussis
gcgguggcgguuggugucgc

SEQ ID NO: 2451462 - RNA, 17 nt, Bordetella pertussis
gcgguggcguuggccug

SEQ ID NO: 2451463 - RNA, 19 nt, Bordetella pertussis
gcgguggcguuggccugcc

SEQ ID NO: 2451464 - RNA, 22 nt, Bordetella pertussis
gcgguggcguuggccugccauc

SEQ ID NO: 2451465 - RNA, 14 nt, Bordetella pertussis
gcggugggcagcgc

SEQ ID NO: 2451466 - RNA, 16 nt, Bordetella pertussis
gcggugggcagcggca

SEQ ID NO: 2451467 - RNA, 19 nt, Bordetella pertussis
gcgguggggcgcaaaagca

SEQ ID NO: 2451468 - RNA, 16 nt, Bordetella pertussis
gcggugggucucggcg

SEQ ID NO: 2451469 - RNA, 19 nt, Bordetella pertussis
gcggugguccagauugcgc

SEQ ID NO: 2451470 - RNA, 18 nt, Bordetella pertussis
gcgguggugauaaggcuc

SEQ ID NO: 2451471 - RNA, 18 nt, Bordetella pertussis
gcgguguagaccaccagc

SEQ ID NO: 2451472 - RNA, 21 nt, Bordetella pertussis
gcgguguagaccaccagcagg

SEQ ID NO: 2451473 - RNA, 20 nt, Bordetella pertussis
gcgugaccagcugcaccagg

SEQ ID NO: 2451474 - RNA, 22 nt, Bordetella pertussis
gcgugaccagcugcaccaggcu

SEQ ID NO: 2451475 - RNA, 15 nt, Bordetella pertussis
gcgugaccgacaggc

SEQ ID NO: 2451476 - RNA, 20 nt, Bordetella pertussis
gcgugaccgacaggccuggc

SEQ ID NO: 2451477 - RNA, 13 nt, Bordetella pertussis
gcgugaccgcgac

SEQ ID NO: 2451478 - RNA, 17 nt, Bordetella pertussis
gcgugaccgcgacgcgc

SEQ ID NO: 2451479 - RNA, 16 nt, Bordetella pertussis
gcgugaccggacuguc

SEQ ID NO: 2451480 - RNA, 21 nt, Bordetella pertussis
gcgugaccggacuguccacgc

SEQ ID NO: 2451481 - RNA, 19 nt, Bordetella pertussis
gcgugacgauauccaggcg

SEQ ID NO: 2451482 - RNA, 21 nt, Bordetella pertussis
gcgugacgcgcggguccaggc

SEQ ID NO: 2451483 - RNA, 14 nt, Bordetella pertussis
gcgugacgcuggag

SEQ ID NO: 2451484 - RNA, 21 nt, Bordetella pertussis
gcgugacgcuggagauggcgc

SEQ ID NO: 2451485 - RNA, 14 nt, Bordetella pertussis
gcgugacggccgcc

SEQ ID NO: 2451486 - RNA, 15 nt, Bordetella pertussis
gcgugacggccgcca

SEQ ID NO: 2451487 - RNA, 18 nt, Bordetella pertussis
gcgugacggccgccacgc

SEQ ID NO: 2451488 - RNA, 14 nt, Bordetella pertussis
gcgugacggcggcg

SEQ ID NO: 2451489 - RNA, 17 nt, Bordetella pertussis
gcgugacggcggcgcgc

SEQ ID NO: 2451490 - RNA, 20 nt, Bordetella pertussis
gcgugacggcggcgcgcgga

SEQ ID NO: 2451491 - RNA, 12 nt, Bordetella pertussis
gcgugacguggc

SEQ ID NO: 2451492 - RNA, 13 nt, Bordetella pertussis
gcgugagcaggcg

SEQ ID NO: 2451493 - RNA, 15 nt, Bordetella pertussis
gcgugagcgccaccg

SEQ ID NO: 2451494 - RNA, 18 nt, Bordetella pertussis
gcgugaugcccaggcccu

SEQ ID NO: 2451495 - RNA, 23 nt, Bordetella pertussis
gcgugaugcccaggcccuggcug

SEQ ID NO: 2451496 - RNA, 18 nt, Bordetella pertussis
gcgugaugccgaccaggc

SEQ ID NO: 2451497 - RNA, 19 nt, Bordetella pertussis
gcgugaugccgaccaggcc

SEQ ID NO: 2451498 - RNA, 21 nt, Bordetella pertussis
gcgugaugccgaccaggcccg

SEQ ID NO: 2451499 - RNA, 15 nt, Bordetella pertussis
gcgugaugccgucga

SEQ ID NO: 2451500 - RNA, 21 nt, Bordetella pertussis
gcgugaugccgucgagcgcgg

SEQ ID NO: 2451501 - RNA, 18 nt, Bordetella pertussis
gcgugaugcggucggcca

SEQ ID NO: 2451502 - RNA, 18 nt, Bordetella pertussis
gcgugauggggccgggcg

SEQ ID NO: 2451503 - RNA, 21 nt, Bordetella pertussis
gcgugauggggccgggcgcca

SEQ ID NO: 2451504 - RNA, 14 nt, Bordetella pertussis
gcgugcaccagcca

SEQ ID NO: 2451505 - RNA, 18 nt, Bordetella pertussis
gcgugcacgaccugccac

SEQ ID NO: 2451506 - RNA, 21 nt, Bordetella pertussis
gcgugcacgcguaugcccugc

SEQ ID NO: 2451507 - RNA, 19 nt, Bordetella pertussis
gcgugcagagcaccacggc

SEQ ID NO: 2451508 - RNA, 22 nt, Bordetella pertussis
gcgugcagaucugcacgcugua

SEQ ID NO: 2451509 - RNA, 13 nt, Bordetella pertussis
gcgugcagccagc

SEQ ID NO: 2451510 - RNA, 19 nt, Bordetella pertussis
gcgugcagccagcggccga

SEQ ID NO: 2451511 - RNA, 13 nt, Bordetella pertussis
gcgugcagcgccg

SEQ ID NO: 2451512 - RNA, 15 nt, Bordetella pertussis
gcgugcaggccgcgu

SEQ ID NO: 2451513 - RNA, 13 nt, Bordetella pertussis
gcgugcaggccgg

SEQ ID NO: 2451514 - RNA, 15 nt, Bordetella pertussis
gcgugcaggccggcg

SEQ ID NO: 2451515 - RNA, 17 nt, Bordetella pertussis
gcgugcaggccggcggc

SEQ ID NO: 2451516 - RNA, 19 nt, Bordetella pertussis
gcgugcagguacgccaugc

SEQ ID NO: 2451517 - RNA, 19 nt, Bordetella pertussis
gcgugccagcaggucgcgc

SEQ ID NO: 2451518 - RNA, 12 nt, Bordetella pertussis
gcgugccaggug

SEQ ID NO: 2451519 - RNA, 21 nt, Bordetella pertussis
gcgugccagguguaggccagu

SEQ ID NO: 2451520 - RNA, 20 nt, Bordetella pertussis
gcgugcccaaugucaccgac

SEQ ID NO: 2451521 - RNA, 12 nt, Bordetella pertussis
gcgugcccagcg

SEQ ID NO: 2451522 - RNA, 22 nt, Bordetella pertussis
gcgugcccaguuucgcgaccac

SEQ ID NO: 2451523 - RNA, 19 nt, Bordetella pertussis
gcgugcccucgcugcgcgu

SEQ ID NO: 2451524 - RNA, 21 nt, Bordetella pertussis
gcgugcccuugggggcccaca

SEQ ID NO: 2451525 - RNA, 13 nt, Bordetella pertussis
gcgugccgcagcg

SEQ ID NO: 2451526 - RNA, 13 nt, Bordetella pertussis
gcgugccgccggc

SEQ ID NO: 2451527 - RNA, 22 nt, Bordetella pertussis
gcgugccgcgcugggcgcugcu

SEQ ID NO: 2451528 - RNA, 15 nt, Bordetella pertussis
gcgugccggagcccg

SEQ ID NO: 2451529 - RNA, 21 nt, Bordetella pertussis
gcgugccggagcccgucaggc

SEQ ID NO: 2451530 - RNA, 21 nt, Bordetella pertussis
gcgugccgggaugcugcucgg

SEQ ID NO: 2451531 - RNA, 13 nt, Bordetella pertussis
gcgugccuguccc

SEQ ID NO: 2451532 - RNA, 20 nt, Bordetella pertussis
gcgugcgagcagaugcaccg

SEQ ID NO: 2451533 - RNA, 23 nt, Bordetella pertussis
gcgugcgagcagaugcaccggcc

SEQ ID NO: 2451534 - RNA, 14 nt, Bordetella pertussis
gcgugcgcagcugu

SEQ ID NO: 2451535 - RNA, 15 nt, Bordetella pertussis
gcgugcgcaggcgcg

SEQ ID NO: 2451536 - RNA, 15 nt, Bordetella pertussis
gcgugcgcaucagcg

SEQ ID NO: 2451537 - RNA, 12 nt, Bordetella pertussis
gcgugcgcccau

SEQ ID NO: 2451538 - RNA, 16 nt, Bordetella pertussis
gcgugcgcccauggcg

SEQ ID NO: 2451539 - RNA, 20 nt, Bordetella pertussis
gcgugcgcccauggcgcgca

SEQ ID NO: 2451540 - RNA, 14 nt, Bordetella pertussis
gcgugcgccccgcc

SEQ ID NO: 2451541 - RNA, 22 nt, Bordetella pertussis
gcgugcgccgggcuguccgcca

SEQ ID NO: 2451542 - RNA, 13 nt, Bordetella pertussis
gcgugcgcgcgcc

SEQ ID NO: 2451543 - RNA, 12 nt, Bordetella pertussis
gcgugcgcggcc

SEQ ID NO: 2451544 - RNA, 13 nt, Bordetella pertussis
gcgugcgcggccg

SEQ ID NO: 2451545 - RNA, 16 nt, Bordetella pertussis
gcgugcgcggccgcgc

SEQ ID NO: 2451546 - RNA, 19 nt, Bordetella pertussis
gcgugcgcggccgcgcgcu

SEQ ID NO: 2451547 - RNA, 14 nt, Bordetella pertussis
gcgugcgcggcgug

SEQ ID NO: 2451548 - RNA, 15 nt, Bordetella pertussis
gcgugcgcuggcugg

SEQ ID NO: 2451549 - RNA, 16 nt, Bordetella pertussis
gcgugcgcuggcuggg

SEQ ID NO: 2451550 - RNA, 22 nt, Bordetella pertussis
gcgugcgcuggcugggccugcu

SEQ ID NO: 2451551 - RNA, 15 nt, Bordetella pertussis
gcgugcggaccagcg

SEQ ID NO: 2451552 - RNA, 17 nt, Bordetella pertussis
gcgugcggaugcagcag

SEQ ID NO: 2451553 - RNA, 18 nt, Bordetella pertussis
gcgugcggaugcagcagc

SEQ ID NO: 2451554 - RNA, 19 nt, Bordetella pertussis
gcgugcggaugcagcagcg

SEQ ID NO: 2451555 - RNA, 21 nt, Bordetella pertussis
gcgugcggauggucgagcgcc

SEQ ID NO: 2451556 - RNA, 15 nt, Bordetella pertussis
gcgugcggcccagcc

SEQ ID NO: 2451557 - RNA, 16 nt, Bordetella pertussis
gcgugcgggacggcca

SEQ ID NO: 2451558 - RNA, 15 nt, Bordetella pertussis
gcgugcggggcggca

SEQ ID NO: 2451559 - RNA, 14 nt, Bordetella pertussis
gcgugcgugccgac

SEQ ID NO: 2451560 - RNA, 23 nt, Bordetella pertussis
gcgugcgugccgacgaugccgcc

SEQ ID NO: 2451561 - RNA, 20 nt, Bordetella pertussis
gcgugcucaucggcaggccg

SEQ ID NO: 2451562 - RNA, 13 nt, Bordetella pertussis
gcgugcucgcgca

SEQ ID NO: 2451563 - RNA, 13 nt, Bordetella pertussis
gcgugcugcgcgu

SEQ ID NO: 2451564 - RNA, 13 nt, Bordetella pertussis
gcgugcuggcgca

SEQ ID NO: 2451565 - RNA, 23 nt, Bordetella pertussis
gcgugcuggcgcagcagcgccgg

SEQ ID NO: 2451566 - RNA, 22 nt, Bordetella pertussis
gcgugcuugccgccggacggcg

SEQ ID NO: 2451567 - RNA, 16 nt, Bordetella pertussis
gcguggaagguccacg

SEQ ID NO: 2451568 - RNA, 18 nt, Bordetella pertussis
gcguggaagguccacggc

SEQ ID NO: 2451569 - RNA, 13 nt, Bordetella pertussis
gcguggagcugcu

SEQ ID NO: 2451570 - RNA, 21 nt, Bordetella pertussis
gcguggagcugcucaccucga

SEQ ID NO: 2451571 - RNA, 19 nt, Bordetella pertussis
gcguggauuuugcggaagg

SEQ ID NO: 2451572 - RNA, 23 nt, Bordetella pertussis
gcguggcaggugcggccgcagcg

SEQ ID NO: 2451573 - RNA, 16 nt, Bordetella pertussis
gcguggccaccaggcg

SEQ ID NO: 2451574 - RNA, 17 nt, Bordetella pertussis
gcguggccaccaggcgc

SEQ ID NO: 2451575 - RNA, 19 nt, Bordetella pertussis
gcguggccaccaggcgcgc

SEQ ID NO: 2451576 - RNA, 20 nt, Bordetella pertussis
gcguggccaccaggcgcgcg

SEQ ID NO: 2451577 - RNA, 21 nt, Bordetella pertussis
gcguggccaccaggcgcgcgc

SEQ ID NO: 2451578 - RNA, 22 nt, Bordetella pertussis
gcguggccaccaggcgcgcgcc

SEQ ID NO: 2451579 - RNA, 22 nt, Bordetella pertussis
gcguggccacggcgucgaugcg

SEQ ID NO: 2451580 - RNA, 21 nt, Bordetella pertussis
gcguggccagcacggcgcaca

SEQ ID NO: 2451581 - RNA, 13 nt, Bordetella pertussis
gcguggccaucaa

SEQ ID NO: 2451582 - RNA, 19 nt, Bordetella pertussis
gcgucgccgcuggccagcc

SEQ ID NO: 2451583 - RNA, 20 nt, Bordetella pertussis
gcgucgccgcuggccagccg

SEQ ID NO: 2451584 - RNA, 12 nt, Bordetella pertussis
gcgucgccggcc

SEQ ID NO: 2451585 - RNA, 14 nt, Bordetella pertussis
gcgucgccggccag

SEQ ID NO: 2451586 - RNA, 19 nt, Bordetella pertussis
gcgucgcgaugcgccaggc

SEQ ID NO: 2451587 - RNA, 16 nt, Bordetella pertussis
gcgucgcgcgaucagg

SEQ ID NO: 2451588 - RNA, 16 nt, Bordetella pertussis
gcgucgcgcgccaggc

SEQ ID NO: 2451589 - RNA, 13 nt, Bordetella pertussis
gcgucgcgcggcg

SEQ ID NO: 2451590 - RNA, 23 nt, Bordetella pertussis
gcgucgcgcggcggcaccagcag

SEQ ID NO: 2451591 - RNA, 18 nt, Bordetella pertussis
gcgucgcgguacaggcug

SEQ ID NO: 2451592 - RNA, 14 nt, Bordetella pertussis
gcgucgcguagcgc

SEQ ID NO: 2451593 - RNA, 18 nt, Bordetella pertussis
gcgucgcguagcgcggcc

SEQ ID NO: 2451594 - RNA, 17 nt, Bordetella pertussis
gcgucgcucaggguacg

SEQ ID NO: 2451595 - RNA, 21 nt, Bordetella pertussis
gcgucgcucaggguacggcga

SEQ ID NO: 2451596 - RNA, 15 nt, Bordetella pertussis
gcgucgcucauggag

SEQ ID NO: 2451597 - RNA, 23 nt, Bordetella pertussis
gcgucgcucauggaggggcgcag

SEQ ID NO: 2451598 - RNA, 18 nt, Bordetella pertussis
gcgucgcucugcgcggca

SEQ ID NO: 2451599 - RNA, 20 nt, Bordetella pertussis
gcgucgcugcuggcggcgcu

SEQ ID NO: 2451600 - RNA, 17 nt, Bordetella pertussis
gcgucgcuggcagccuu

SEQ ID NO: 2451601 - RNA, 14 nt, Bordetella pertussis
gcgucggacgcgcg

SEQ ID NO: 2451602 - RNA, 16 nt, Bordetella pertussis
gcgucggacgcgcgcc

SEQ ID NO: 2451603 - RNA, 17 nt, Bordetella pertussis
gcgucggacgcgcgccg

SEQ ID NO: 2451604 - RNA, 18 nt, Bordetella pertussis
gcgucggacgcgcgccgc

SEQ ID NO: 2451605 - RNA, 19 nt, Bordetella pertussis
gcgucggcaauaucgauca

SEQ ID NO: 2451606 - RNA, 18 nt, Bordetella pertussis
gcgucggccaaggccggc

SEQ ID NO: 2451607 - RNA, 13 nt, Bordetella pertussis
gcgucggccacgu

SEQ ID NO: 2451608 - RNA, 15 nt, Bordetella pertussis
gcgucggccagcgcc

SEQ ID NO: 2451609 - RNA, 15 nt, Bordetella pertussis
gcgucggccaggccg

SEQ ID NO: 2451610 - RNA, 14 nt, Bordetella pertussis
gcgucggccaggcg

SEQ ID NO: 2451611 - RNA, 15 nt, Bordetella pertussis
gcgucggccaggcgc

SEQ ID NO: 2451612 - RNA, 17 nt, Bordetella pertussis
gcgucggccaggcgcca

SEQ ID NO: 2451613 - RNA, 17 nt, Bordetella pertussis
gcgucggccauggcgcu

SEQ ID NO: 2451614 - RNA, 14 nt, Bordetella pertussis
gcgucggccgccgu

SEQ ID NO: 2451615 - RNA, 14 nt, Bordetella pertussis
gcgucggccgcgcc

SEQ ID NO: 2451616 - RNA, 13 nt, Bordetella pertussis
gcgucggccgcgu

SEQ ID NO: 2451617 - RNA, 17 nt, Bordetella pertussis
gcgucggccugccagcc

SEQ ID NO: 2451618 - RNA, 18 nt, Bordetella pertussis
gcgucggccugccagccu

SEQ ID NO: 2451619 - RNA, 14 nt, Bordetella pertussis
gcgucggcgcccgg

SEQ ID NO: 2451620 - RNA, 16 nt, Bordetella pertussis
gcgucggcgcccggcg

SEQ ID NO: 2451621 - RNA, 17 nt, Bordetella pertussis
gcgucggcgcccggcgc

SEQ ID NO: 2451622 - RNA, 20 nt, Bordetella pertussis
gcgucggcgcccggcgccgc

SEQ ID NO: 2451623 - RNA, 21 nt, Bordetella pertussis
gcgucggcgcccggcgccgcg

SEQ ID NO: 2451624 - RNA, 12 nt, Bordetella pertussis
gcgucggcgcgc

SEQ ID NO: 2451625 - RNA, 13 nt, Bordetella pertussis
gcgucggcgcgcg

SEQ ID NO: 2451626 - RNA, 16 nt, Bordetella pertussis
gcgucggcgcgcgcga

SEQ ID NO: 2451627 - RNA, 19 nt, Bordetella pertussis
gcgucggcgcgcgcgacuc

SEQ ID NO: 2451628 - RNA, 16 nt, Bordetella pertussis
gcgucggcgcggucgg

SEQ ID NO: 2451629 - RNA, 14 nt, Bordetella pertussis
gcgucggcggccca

SEQ ID NO: 2451630 - RNA, 18 nt, Bordetella pertussis
gcgucggcggcccacagc

SEQ ID NO: 2451631 - RNA, 22 nt, Bordetella pertussis
gcgucggcguaaggccgccggc

SEQ ID NO: 2451632 - RNA, 18 nt, Bordetella pertussis
gcgucggcuuccaucagg

SEQ ID NO: 2451633 - RNA, 13 nt, Bordetella pertussis
gcgucgggcacgu

SEQ ID NO: 2451634 - RNA, 17 nt, Bordetella pertussis
gcgucgggcagcaggcg

SEQ ID NO: 2451635 - RNA, 19 nt, Bordetella pertussis
gcgucgggcagcaggcgca

SEQ ID NO: 2451636 - RNA, 21 nt, Bordetella pertussis
gcgucgggcagcaggcgcauc

SEQ ID NO: 2451637 - RNA, 13 nt, Bordetella pertussis
gcgucgggcaguu

SEQ ID NO: 2451638 - RNA, 14 nt, Bordetella pertussis
gcgucgggucagcc

SEQ ID NO: 2451639 - RNA, 13 nt, Bordetella pertussis
gcgucggugccgu

SEQ ID NO: 2451640 - RNA, 18 nt, Bordetella pertussis
gcgucggugccguccagc

SEQ ID NO: 2451641 - RNA, 13 nt, Bordetella pertussis
gcgucgguggcca

SEQ ID NO: 2451642 - RNA, 19 nt, Bordetella pertussis
gcgucgguggccagccagg

SEQ ID NO: 2451643 - RNA, 12 nt, Bordetella pertussis
gcgucguagccc

SEQ ID NO: 2451644 - RNA, 16 nt, Bordetella pertussis
gcgucguagcccucgc

SEQ ID NO: 2451645 - RNA, 13 nt, Bordetella pertussis
gcgucguccagcu

SEQ ID NO: 2451646 - RNA, 19 nt, Bordetella pertussis
gcgucguccguggccggcg

SEQ ID NO: 2451647 - RNA, 19 nt, Bordetella pertussis
gcgucgucgcgguccagca

SEQ ID NO: 2451648 - RNA, 20 nt, Bordetella pertussis
gcgucgucgcgguccagcac

SEQ ID NO: 2451649 - RNA, 18 nt, Bordetella pertussis
gcgucgucgggaccggcg

SEQ ID NO: 2451650 - RNA, 19 nt, Bordetella pertussis
gcgucgucguuucccagca

SEQ ID NO: 2451651 - RNA, 22 nt, Bordetella pertussis
gcgucgucguuucccagcaagc

SEQ ID NO: 2451652 - RNA, 15 nt, Bordetella pertussis
gcgucgugcccgcca

SEQ ID NO: 2451653 - RNA, 18 nt, Bordetella pertussis
gcgucguggggcgcggcg

SEQ ID NO: 2451654 - RNA, 20 nt, Bordetella pertussis
gcgucguggggcgcggcggc

SEQ ID NO: 2451655 - RNA, 15 nt, Bordetella pertussis
gcgucguucaucgcc

SEQ ID NO: 2451656 - RNA, 20 nt, Bordetella pertussis
gcgucguugcgccgaucgcg

SEQ ID NO: 2451657 - RNA, 22 nt, Bordetella pertussis
gcgucguugcgccgaucgcggc

SEQ ID NO: 2451658 - RNA, 23 nt, Bordetella pertussis
gcgucguugcgccgaucgcggcu

SEQ ID NO: 2451659 - RNA, 18 nt, Bordetella pertussis
gcgucuccacgccgccga

SEQ ID NO: 2451660 - RNA, 22 nt, Bordetella pertussis
gcgucuccacgccgccgaccuc

SEQ ID NO: 2451661 - RNA, 16 nt, Bordetella pertussis
gcgucuccagcgcggc

SEQ ID NO: 2451662 - RNA, 17 nt, Bordetella pertussis
gcgucuccagcgcggcg

SEQ ID NO: 2451663 - RNA, 18 nt, Bordetella pertussis
gcgucucgcccacccccg

SEQ ID NO: 2451664 - RNA, 17 nt, Bordetella pertussis
gcgucucggccuguucg

SEQ ID NO: 2451665 - RNA, 17 nt, Bordetella pertussis
gcgucugcccgcggucc

SEQ ID NO: 2451666 - RNA, 20 nt, Bordetella pertussis
gcgucugcccgcgguccagc

SEQ ID NO: 2451667 - RNA, 20 nt, Bordetella pertussis
gcgucugcuacaccgugcug

SEQ ID NO: 2451668 - RNA, 21 nt, Bordetella pertussis
gcgucugcuacaccgugcugg

SEQ ID NO: 2451669 - RNA, 24 nt, Bordetella pertussis
gcgucugcuacaccgugcuggccg

SEQ ID NO: 2451670 - RNA, 22 nt, Bordetella pertussis
gcgucugcugguacagccccag

SEQ ID NO: 2451671 - RNA, 22 nt, Bordetella pertussis
gcgucuggaaacuguuggcgug

SEQ ID NO: 2451672 - RNA, 14 nt, Bordetella pertussis
gcgucuggagcggc

SEQ ID NO: 2451673 - RNA, 15 nt, Bordetella pertussis
gcgucuggagcggcc

SEQ ID NO: 2451674 - RNA, 14 nt, Bordetella pertussis
gcgucuggaggacg

SEQ ID NO: 2451675 - RNA, 22 nt, Bordetella pertussis
gcgucuguaucguugucgcgcc

SEQ ID NO: 2451676 - RNA, 21 nt, Bordetella pertussis
gcgucuucaguugacgccggc

SEQ ID NO: 2451677 - RNA, 14 nt, Bordetella pertussis
gcgucuucgccgac

SEQ ID NO: 2451678 - RNA, 19 nt, Bordetella pertussis
gcgucuucggcgcggcggg

SEQ ID NO: 2451679 - RNA, 15 nt, Bordetella pertussis
gcgucuugagcaggu

SEQ ID NO: 2451680 - RNA, 22 nt, Bordetella pertussis
gcgucuugccggaggucggcgc

SEQ ID NO: 2451681 - RNA, 14 nt, Bordetella pertussis
gcgucuuggcgggc

SEQ ID NO: 2451682 - RNA, 17 nt, Bordetella pertussis
gcgucuuggcgggcacc

SEQ ID NO: 2451683 - RNA, 17 nt, Bordetella pertussis
gcgugaaaggccagcgg

SEQ ID NO: 2451684 - RNA, 19 nt, Bordetella pertussis
gcgugaaaggccagcggcg

SEQ ID NO: 2451685 - RNA, 20 nt, Bordetella pertussis
gcgugaaaggccagcggcgg

SEQ ID NO: 2451686 - RNA, 15 nt, Bordetella pertussis
gcgugaacgccccgg

SEQ ID NO: 2451687 - RNA, 22 nt, Bordetella pertussis
gcgugaacuccugcaacuggug

SEQ ID NO: 2451688 - RNA, 20 nt, Bordetella pertussis
gcuccugugggggcgcggcg

SEQ ID NO: 2451689 - RNA, 22 nt, Bordetella pertussis
gcuccugugggggcgcggcggc

SEQ ID NO: 2451690 - RNA, 19 nt, Bordetella pertussis
gcuccuucgugguggcgaa

SEQ ID NO: 2451691 - RNA, 20 nt, Bordetella pertussis
gcuccuugaccaguucgcgc

SEQ ID NO: 2451692 - RNA, 15 nt, Bordetella pertussis
gcucgaaaugcgcgu

SEQ ID NO: 2451693 - RNA, 12 nt, Bordetella pertussis
gcucgaacaggc

SEQ ID NO: 2451694 - RNA, 15 nt, Bordetella pertussis
gcucgaacaggcugg

SEQ ID NO: 2451695 - RNA, 16 nt, Bordetella pertussis
gcucgaacaggcuggc

SEQ ID NO: 2451696 - RNA, 21 nt, Bordetella pertussis
gcucgaacaggcuggcaugga

SEQ ID NO: 2451697 - RNA, 16 nt, Bordetella pertussis
gcucgaauggcugcgc

SEQ ID NO: 2451698 - RNA, 21 nt, Bordetella pertussis
gcucgacagcagcccgcuggc

SEQ ID NO: 2451699 - RNA, 18 nt, Bordetella pertussis
gcucgaccacggcggcuu

SEQ ID NO: 2451700 - RNA, 20 nt, Bordetella pertussis
gcucgaccaucauggccagg

SEQ ID NO: 2451701 - RNA, 22 nt, Bordetella pertussis
gcucgaccaucauggccagggc

SEQ ID NO: 2451702 - RNA, 23 nt, Bordetella pertussis
gcucgaccaucauggccagggcc

SEQ ID NO: 2451703 - RNA, 13 nt, Bordetella pertussis
gcucgaccgccgc

SEQ ID NO: 2451704 - RNA, 15 nt, Bordetella pertussis
gcucgaccgccgcca

SEQ ID NO: 2451705 - RNA, 18 nt, Bordetella pertussis
gcucgaccgccgccacgc

SEQ ID NO: 2451706 - RNA, 13 nt, Bordetella pertussis
gcucgaccgucag

SEQ ID NO: 2451707 - RNA, 21 nt, Bordetella pertussis
gcucgaccgucagcaugccgu

SEQ ID NO: 2451708 - RNA, 20 nt, Bordetella pertussis
gcucgaccuugucgcccgau

SEQ ID NO: 2451709 - RNA, 16 nt, Bordetella pertussis
gcucgacgaagcccgu

SEQ ID NO: 2451710 - RNA, 22 nt, Bordetella pertussis
gcucgacgccaucucgcgcgcu

SEQ ID NO: 2451711 - RNA, 17 nt, Bordetella pertussis
gcucgacgccguacugg

SEQ ID NO: 2451712 - RNA, 20 nt, Bordetella pertussis
gcuggaacgcgccgcuggcg

SEQ ID NO: 2451713 - RNA, 19 nt, Bordetella pertussis
gcuggaacggugcgagauc

SEQ ID NO: 2451714 - RNA, 19 nt, Bordetella pertussis
gcuggaagacgccuguccg

SEQ ID NO: 2451715 - RNA, 21 nt, Bordetella pertussis
gcuggaagacguggcccgcgu

SEQ ID NO: 2451716 - RNA, 13 nt, Bordetella pertussis
gcuggaagcgcgc

SEQ ID NO: 2451717 - RNA, 14 nt, Bordetella pertussis
gcuggaagcgcgcc

SEQ ID NO: 2451718 - RNA, 15 nt, Bordetella pertussis
gcuggaagcgcgcca

SEQ ID NO: 2451719 - RNA, 21 nt, Bordetella pertussis
gcuggaagcgcgccaggcgca

SEQ ID NO: 2451720 - RNA, 14 nt, Bordetella pertussis
gcuggaagucagcc

SEQ ID NO: 2451721 - RNA, 18 nt, Bordetella pertussis
gcuggacagauccagcgc

SEQ ID NO: 2451722 - RNA, 19 nt, Bordetella pertussis
gcuggacagauccagcgcg

SEQ ID NO: 2451723 - RNA, 22 nt, Bordetella pertussis
gcuggacagauccagcgcggcc

SEQ ID NO: 2451724 - RNA, 12 nt, Bordetella pertussis
gcuggacccgcu

SEQ ID NO: 2451725 - RNA, 19 nt, Bordetella pertussis
gcuggacccgcugcgaccc

SEQ ID NO: 2451726 - RNA, 13 nt, Bordetella pertussis
gcuggaccgccug

SEQ ID NO: 2451727 - RNA, 17 nt, Bordetella pertussis
gcuggaccgccuggccu

SEQ ID NO: 2451728 - RNA, 16 nt, Bordetella pertussis
gcuggaccgcgccugg

SEQ ID NO: 2451729 - RNA, 23 nt, Bordetella pertussis
gcuggaccgcgccugggggcugg

SEQ ID NO: 2451730 - RNA, 15 nt, Bordetella pertussis
gcuggaccugcuguu

SEQ ID NO: 2451731 - RNA, 17 nt, Bordetella pertussis
gcuggaccugcuguuca

SEQ ID NO: 2451732 - RNA, 15 nt, Bordetella pertussis
gcuggaccuggccac

SEQ ID NO: 2451733 - RNA, 16 nt, Bordetella pertussis
gcuggacgaggcgaug

SEQ ID NO: 2451734 - RNA, 22 nt, Bordetella pertussis
gcuggacgaggcgauggucggc

SEQ ID NO: 2451735 - RNA, 17 nt, Bordetella pertussis
gcuggacgcgccgaaca

SEQ ID NO: 2451736 - RNA, 17 nt, Bordetella pertussis
gcuggacgcgcgcggcg

SEQ ID NO: 2451737 - RNA, 21 nt, Bordetella pertussis
gcuggacgcuuucggggcgca

SEQ ID NO: 2451738 - RNA, 22 nt, Bordetella pertussis
gcuggacgcuuucggggcgcaa

SEQ ID NO: 2451739 - RNA, 23 nt, Bordetella pertussis
gcuggacguaguugguggcaggc

SEQ ID NO: 2451740 - RNA, 17 nt, Bordetella pertussis
gcuggacuauggccugg

SEQ ID NO: 2451741 - RNA, 18 nt, Bordetella pertussis
gcuggacuauggccugga

SEQ ID NO: 2451742 - RNA, 19 nt, Bordetella pertussis
gcuggagaacaggcggcug

SEQ ID NO: 2451743 - RNA, 20 nt, Bordetella pertussis
gcuggagaacgagccggccg

SEQ ID NO: 2451744 - RNA, 21 nt, Bordetella pertussis
gcuggagaacgagccggccgc

SEQ ID NO: 2451745 - RNA, 16 nt, Bordetella pertussis
gcuggagaagcgccgc

SEQ ID NO: 2451746 - RNA, 17 nt, Bordetella pertussis
gcuggagaccggguugc

SEQ ID NO: 2451747 - RNA, 20 nt, Bordetella pertussis
gcuggagaucgccgagcggc

SEQ ID NO: 2451748 - RNA, 13 nt, Bordetella pertussis
gcuggagauggcg

SEQ ID NO: 2451749 - RNA, 16 nt, Bordetella pertussis
gcuggagcgccacgcc

SEQ ID NO: 2451750 - RNA, 14 nt, Bordetella pertussis
gcuggagcgcggcg

SEQ ID NO: 2451751 - RNA, 23 nt, Bordetella pertussis
gcuggagcucuaugucgccggcc

SEQ ID NO: 2451752 - RNA, 18 nt, Bordetella pertussis
gcuggaggccggcgugcu

SEQ ID NO: 2451753 - RNA, 23 nt, Bordetella pertussis
gcuggaggccggcgugcuguccg

SEQ ID NO: 2451754 - RNA, 20 nt, Bordetella pertussis
gcuggaggccuuccaccagc

SEQ ID NO: 2451755 - RNA, 17 nt, Bordetella pertussis
gcuggagucgggcugcu

SEQ ID NO: 2451756 - RNA, 23 nt, Bordetella pertussis
gcuggaucccggcgaucaugccg

SEQ ID NO: 2451757 - RNA, 22 nt, Bordetella pertussis
gcuggaucuggugaaacagcau

SEQ ID NO: 2451758 - RNA, 17 nt, Bordetella pertussis
gcuggauggccugcucg

SEQ ID NO: 2451759 - RNA, 15 nt, Bordetella pertussis
gcuggauggcucggg

SEQ ID NO: 2451760 - RNA, 22 nt, Bordetella pertussis
gcuggauggcucgggcagcagc

SEQ ID NO: 2451761 - RNA, 13 nt, Bordetella pertussis
gcuggauggucac

SEQ ID NO: 2451762 - RNA, 18 nt, Bordetella pertussis
gcuggauggugccgccgc

SEQ ID NO: 2451763 - RNA, 16 nt, Bordetella pertussis
gcuggcaaagcgcgcg

SEQ ID NO: 2451764 - RNA, 17 nt, Bordetella pertussis
gcuggcaaagcgcgcgu

SEQ ID NO: 2451765 - RNA, 18 nt, Bordetella pertussis
gcuggcaaagcgcgcguc

SEQ ID NO: 2451766 - RNA, 17 nt, Bordetella pertussis
gcuggcaucgucgcgcu

SEQ ID NO: 2451767 - RNA, 18 nt, Bordetella pertussis
gcuggcauggaacgggcg

SEQ ID NO: 2451768 - RNA, 14 nt, Bordetella pertussis
gcuggcauugacga

SEQ ID NO: 2451769 - RNA, 16 nt, Bordetella pertussis
gcuggcauugacgacg

SEQ ID NO: 2451770 - RNA, 18 nt, Bordetella pertussis
gcuggcauugacgacgcg

SEQ ID NO: 2451771 - RNA, 21 nt, Bordetella pertussis
gcuggcauugacgacgcggua

SEQ ID NO: 2451772 - RNA, 13 nt, Bordetella pertussis
gcuggccaacgcc

SEQ ID NO: 2451773 - RNA, 16 nt, Bordetella pertussis
gcuggccaacgccacg

SEQ ID NO: 2451774 - RNA, 20 nt, Bordetella pertussis
gcuggccaagcgcgccggcu

SEQ ID NO: 2451775 - RNA, 15 nt, Bordetella pertussis
gcuggccacccgaca

SEQ ID NO: 2451776 - RNA, 19 nt, Bordetella pertussis
gcuggccacccgacagcuc

SEQ ID NO: 2451777 - RNA, 16 nt, Bordetella pertussis
gcuggccaccgucgcc

SEQ ID NO: 2451778 - RNA, 22 nt, Bordetella pertussis
gcuggccaccgucgccaccuuc

SEQ ID NO: 2451779 - RNA, 11 nt, Bordetella pertussis
gcuggccacgu

SEQ ID NO: 2451780 - RNA, 14 nt, Bordetella pertussis
gcuggccacuggcc

SEQ ID NO: 2451781 - RNA, 18 nt, Bordetella pertussis
gcuggccacuggccgcgc

SEQ ID NO: 2451782 - RNA, 24 nt, Bordetella pertussis
gcuggccacuggccgcgcucaggc

SEQ ID NO: 2451783 - RNA, 15 nt, Bordetella pertussis
gcuggccagccgcuc

SEQ ID NO: 2451784 - RNA, 14 nt, Bordetella pertussis
gcuggccagccggc

SEQ ID NO: 2451785 - RNA, 19 nt, Bordetella pertussis
gcuggccagccggcccagc

SEQ ID NO: 2451786 - RNA, 12 nt, Bordetella pertussis
gcuggccagcgg

SEQ ID NO: 2451787 - RNA, 23 nt, Bordetella pertussis
gcuggccagcgguacgccgaacu

SEQ ID NO: 2451788 - RNA, 21 nt, Bordetella pertussis
gcuggccagcuggcggcgcag

SEQ ID NO: 2451789 - RNA, 12 nt, Bordetella pertussis
gcuggccaggcu

SEQ ID NO: 2451790 - RNA, 22 nt, Bordetella pertussis
gcuggccaucguacgcgugggc

SEQ ID NO: 2451791 - RNA, 14 nt, Bordetella pertussis
gcuggccaugccgu

SEQ ID NO: 2451792 - RNA, 16 nt, Bordetella pertussis
gcugcgccgaggccug

SEQ ID NO: 2451793 - RNA, 13 nt, Bordetella pertussis
gcugcgccgccuc

SEQ ID NO: 2451794 - RNA, 16 nt, Bordetella pertussis
gcugcgccgcggcgcu

SEQ ID NO: 2451795 - RNA, 18 nt, Bordetella pertussis
gcugcgccggcggcaccg

SEQ ID NO: 2451796 - RNA, 22 nt, Bordetella pertussis
gcugcgccggcggcaccgcgca

SEQ ID NO: 2451797 - RNA, 23 nt, Bordetella pertussis
gcugcgccgucugugcgccccgc

SEQ ID NO: 2451798 - RNA, 14 nt, Bordetella pertussis
gcugcgccuggccg

SEQ ID NO: 2451799 - RNA, 18 nt, Bordetella pertussis
gcugcgccuggccgcgcu

SEQ ID NO: 2451800 - RNA, 14 nt, Bordetella pertussis
gcugcgccuggcgg

SEQ ID NO: 2451801 - RNA, 22 nt, Bordetella pertussis
gcugcgccuggcggacgauggc

SEQ ID NO: 2451802 - RNA, 23 nt, Bordetella pertussis
gcugcgccuggcggacgauggcc

SEQ ID NO: 2451803 - RNA, 19 nt, Bordetella pertussis
gcugcgccuuggcgcgcag

SEQ ID NO: 2451804 - RNA, 20 nt, Bordetella pertussis
gcugcgcgaacgcggccaug

SEQ ID NO: 2451805 - RNA, 16 nt, Bordetella pertussis
gcugcgcgaugcgcgc

SEQ ID NO: 2451806 - RNA, 18 nt, Bordetella pertussis
gcugcgcgccgccgcgcu

SEQ ID NO: 2451807 - RNA, 17 nt, Bordetella pertussis
gcugcgcgccggcgccu

SEQ ID NO: 2451808 - RNA, 17 nt, Bordetella pertussis
gcugcgcgccguggugc

SEQ ID NO: 2451809 - RNA, 14 nt, Bordetella pertussis
gcugcgcgccuggc

SEQ ID NO: 2451810 - RNA, 17 nt, Bordetella pertussis
gcugcgcgccuggcacg

SEQ ID NO: 2451811 - RNA, 13 nt, Bordetella pertussis
gcugcgcgcgcag

SEQ ID NO: 2451812 - RNA, 15 nt, Bordetella pertussis
gcugcgcgcgcagcc

SEQ ID NO: 2451813 - RNA, 16 nt, Bordetella pertussis
gcugcgcgcgcagcca

SEQ ID NO: 2451814 - RNA, 18 nt, Bordetella pertussis
gcugcgcgcgcagccagg

SEQ ID NO: 2451815 - RNA, 18 nt, Bordetella pertussis
gcugcgcgcgccagcgcc

SEQ ID NO: 2451816 - RNA, 20 nt, Bordetella pertussis
gcugcgcgcgccagcgccug

SEQ ID NO: 2451817 - RNA, 15 nt, Bordetella pertussis
gcugcgcgcggccug

SEQ ID NO: 2451818 - RNA, 12 nt, Bordetella pertussis
gcugcgcggccg

SEQ ID NO: 2451819 - RNA, 21 nt, Bordetella pertussis
gcugcgcggccgagcgggcca

SEQ ID NO: 2451820 - RNA, 16 nt, Bordetella pertussis
gcugcgcggcggcuug

SEQ ID NO: 2451821 - RNA, 20 nt, Bordetella pertussis
gcugcgcgucgacagcauga

SEQ ID NO: 2451822 - RNA, 16 nt, Bordetella pertussis
gcugcgcgucggcagg

SEQ ID NO: 2451823 - RNA, 14 nt, Bordetella pertussis
gcugcgcguggcca

SEQ ID NO: 2451824 - RNA, 19 nt, Bordetella pertussis
gcugcgcugcucguccacg

SEQ ID NO: 2451825 - RNA, 16 nt, Bordetella pertussis
gcugcgcuugaccgcc

SEQ ID NO: 2451826 - RNA, 22 nt, Bordetella pertussis
gcugcggauacgaaaccaggcc

SEQ ID NO: 2451827 - RNA, 23 nt, Bordetella pertussis
gcugcggauacgaaaccaggccg

SEQ ID NO: 2451828 - RNA, 20 nt, Bordetella pertussis
gcugcggcaagggugccugu

SEQ ID NO: 2451829 - RNA, 16 nt, Bordetella pertussis
gcugcggcacgauuuc

SEQ ID NO: 2451830 - RNA, 18 nt, Bordetella pertussis
gcugcggcacggccagcg

SEQ ID NO: 2451831 - RNA, 19 nt, Bordetella pertussis
gcugcggcacggccagcgg

SEQ ID NO: 2451832 - RNA, 20 nt, Bordetella pertussis
gcugcggcacggccagcggc

SEQ ID NO: 2451833 - RNA, 16 nt, Bordetella pertussis
gcugcggcagccaggu

SEQ ID NO: 2451834 - RNA, 17 nt, Bordetella pertussis
gcugcggcagccaggug

SEQ ID NO: 2451835 - RNA, 23 nt, Bordetella pertussis
gcugcggccccggcaccaucgcc

SEQ ID NO: 2451836 - RNA, 14 nt, Bordetella pertussis
gcugcggcgcggcg

SEQ ID NO: 2451837 - RNA, 15 nt, Bordetella pertussis
gcugcggcgcggcgc

SEQ ID NO: 2451838 - RNA, 14 nt, Bordetella pertussis
gcugcggcguggcg

SEQ ID NO: 2451839 - RNA, 21 nt, Bordetella pertussis
gcugcggcuccugcuggcgcg

SEQ ID NO: 2451840 - RNA, 17 nt, Bordetella pertussis
gcugcggcugaucaccg

SEQ ID NO: 2451841 - RNA, 21 nt, Bordetella pertussis
gcugcggcugaucaccgccgg

SEQ ID NO: 2451842 - RNA, 15 nt, Bordetella pertussis
gcugcgggccggcgc

SEQ ID NO: 2451843 - RNA, 17 nt, Bordetella pertussis
gcugcgggcgcaagcca

SEQ ID NO: 2451844 - RNA, 19 nt, Bordetella pertussis
gcugcgggcgcaagccagc

SEQ ID NO: 2451845 - RNA, 21 nt, Bordetella pertussis
gcugcgggcgcaagccagcac

SEQ ID NO: 2451846 - RNA, 13 nt, Bordetella pertussis
gcugcgggcggcc

SEQ ID NO: 2451847 - RNA, 14 nt, Bordetella pertussis
gcugcgggcggccu

SEQ ID NO: 2451848 - RNA, 23 nt, Bordetella pertussis
gcugcgggucgaguugcgcgcca

SEQ ID NO: 2451849 - RNA, 15 nt, Bordetella pertussis
gcugcggucgcgauc

SEQ ID NO: 2451850 - RNA, 22 nt, Bordetella pertussis
gcugcgguuguauugcgucagg

SEQ ID NO: 2451851 - RNA, 20 nt, Bordetella pertussis
gcugcguaucaacuuccagc

SEQ ID NO: 2451852 - RNA, 21 nt, Bordetella pertussis
gcugcguaucaacuuccagcg

SEQ ID NO: 2451853 - RNA, 22 nt, Bordetella pertussis
gcugcguaucaacuuccagcgc

SEQ ID NO: 2451854 - RNA, 23 nt, Bordetella pertussis
gcugcguaucaacuuccagcgcc

SEQ ID NO: 2451855 - RNA, 20 nt, Bordetella pertussis
gcugcguccaccaccaggcc

SEQ ID NO: 2451856 - RNA, 21 nt, Bordetella pertussis
gcugcguccaccaccaggccg

SEQ ID NO: 2451857 - RNA, 22 nt, Bordetella pertussis
gcugcguccaccaccaggccgg

SEQ ID NO: 2451858 - RNA, 15 nt, Bordetella pertussis
gcugcgugcgggaca

SEQ ID NO: 2451859 - RNA, 16 nt, Bordetella pertussis
gcugcgugcgggacag

SEQ ID NO: 2451860 - RNA, 20 nt, Bordetella pertussis
gcugcguggcgacgcgcugc

SEQ ID NO: 2451861 - RNA, 18 nt, Bordetella pertussis
gcugcucaacggccacca

SEQ ID NO: 2451862 - RNA, 18 nt, Bordetella pertussis
gcugcucaccucgaucgc

SEQ ID NO: 2451863 - RNA, 13 nt, Bordetella pertussis
gcugcucgaaacg

SEQ ID NO: 2451864 - RNA, 19 nt, Bordetella pertussis
gcugcucgaaacgcuggac

SEQ ID NO: 2451865 - RNA, 19 nt, Bordetella pertussis
gcugcucguucugcgcgcc

SEQ ID NO: 2451866 - RNA, 16 nt, Bordetella pertussis
gcugcugaccgacggc

SEQ ID NO: 2451867 - RNA, 19 nt, Bordetella pertussis
gcugcugaccgacggccug

SEQ ID NO: 2451868 - RNA, 19 nt, Bordetella pertussis
gcugcugacugugcagcca

SEQ ID NO: 2451869 - RNA, 20 nt, Bordetella pertussis
gcugcugauccucgccagcg

SEQ ID NO: 2451870 - RNA, 22 nt, Bordetella pertussis
gcugcugcacgcgcgcgggcgc

SEQ ID NO: 2451871 - RNA, 13 nt, Bordetella pertussis
gcugcugcacgug

SEQ ID NO: 2451872 - RNA, 12 nt, Bordetella pertussis
gcugcugcagcc

SEQ ID NO: 2451873 - RNA, 17 nt, Bordetella pertussis
gcugcugcaggccggcg

SEQ ID NO: 2451874 - RNA, 15 nt, Bordetella pertussis
gcugcugcccgaagc

SEQ ID NO: 2451875 - RNA, 14 nt, Bordetella pertussis
gcugcugcuggcug

SEQ ID NO: 2451876 - RNA, 16 nt, Bordetella pertussis
gcugcugcuggcuucg

SEQ ID NO: 2451877 - RNA, 18 nt, Bordetella pertussis
gcugcuggaacggugcga

SEQ ID NO: 2451878 - RNA, 19 nt, Bordetella pertussis
gcugcuggaggccggcgug

SEQ ID NO: 2451879 - RNA, 14 nt, Bordetella pertussis
gcugcuggccggcc

SEQ ID NO: 2451880 - RNA, 16 nt, Bordetella pertussis
gcugcuggccggccag

SEQ ID NO: 2451881 - RNA, 15 nt, Bordetella pertussis
gcugcuggccggccc

SEQ ID NO: 2451882 - RNA, 15 nt, Bordetella pertussis
gcugcuggcgcgcca

SEQ ID NO: 2451883 - RNA, 18 nt, Bordetella pertussis
gcugcuggcgcgccaggc

SEQ ID NO: 2451884 - RNA, 19 nt, Bordetella pertussis
gcugcuggcgcgccaggcg

SEQ ID NO: 2451885 - RNA, 13 nt, Bordetella pertussis
gcugcuggcggcg

SEQ ID NO: 2451886 - RNA, 14 nt, Bordetella pertussis
gcugcuggcggcgc

SEQ ID NO: 2451887 - RNA, 15 nt, Bordetella pertussis
gcugcuggcuucggc

SEQ ID NO: 2451888 - RNA, 19 nt, Bordetella pertussis
gcugcugggcauggaccug

SEQ ID NO: 2451889 - RNA, 17 nt, Bordetella pertussis
gcugcugggccggcgcg

SEQ ID NO: 2451890 - RNA, 13 nt, Bordetella pertussis
gcuggccgcgccc

SEQ ID NO: 2451891 - RNA, 14 nt, Bordetella pertussis
gcuggccgcgcccg

SEQ ID NO: 2451892 - RNA, 15 nt, Bordetella pertussis
gcuggccgcgcccgc

SEQ ID NO: 2451893 - RNA, 13 nt, Bordetella pertussis
gcuggccgcggua

SEQ ID NO: 2451894 - RNA, 12 nt, Bordetella pertussis
gcuggccggcca

SEQ ID NO: 2451895 - RNA, 18 nt, Bordetella pertussis
gcuggccggccaacagcu

SEQ ID NO: 2451896 - RNA, 21 nt, Bordetella pertussis
gcuggccggccaacagcucgc

SEQ ID NO: 2451897 - RNA, 17 nt, Bordetella pertussis
gcuggccggcgacuucc

SEQ ID NO: 2451898 - RNA, 18 nt, Bordetella pertussis
gcuggccggcguggccug

SEQ ID NO: 2451899 - RNA, 21 nt, Bordetella pertussis
gcuggccggcguggccugccc

SEQ ID NO: 2451900 - RNA, 13 nt, Bordetella pertussis
gcuggccgucgcc

SEQ ID NO: 2451901 - RNA, 14 nt, Bordetella pertussis
gcuggccgucgccg

SEQ ID NO: 2451902 - RNA, 21 nt, Bordetella pertussis
gcuggccugccgcgccgaccg

SEQ ID NO: 2451903 - RNA, 16 nt, Bordetella pertussis
gcuggccuggccgccg

SEQ ID NO: 2451904 - RNA, 21 nt, Bordetella pertussis
gcuggcgaagaacaccgccgc

SEQ ID NO: 2451905 - RNA, 22 nt, Bordetella pertussis
gcuggcgaagaacaccgccgcg

SEQ ID NO: 2451906 - RNA, 23 nt, Bordetella pertussis
gcuggcgaagaacaccgccgcgc

SEQ ID NO: 2451907 - RNA, 15 nt, Bordetella pertussis
gcuggcgaggaccug

SEQ ID NO: 2451908 - RNA, 19 nt, Bordetella pertussis
gcuggcgaggaccugacca

SEQ ID NO: 2451909 - RNA, 16 nt, Bordetella pertussis
gcuggcgaucacggcc

SEQ ID NO: 2451910 - RNA, 21 nt, Bordetella pertussis
gcuggcgaucacggccaaccc

SEQ ID NO: 2451911 - RNA, 12 nt, Bordetella pertussis
gcuggcgaucag

SEQ ID NO: 2451912 - RNA, 15 nt, Bordetella pertussis
gcuggcgaucaggcc

SEQ ID NO: 2451913 - RNA, 17 nt, Bordetella pertussis
gcuggcgaucaggccgc

SEQ ID NO: 2451914 - RNA, 19 nt, Bordetella pertussis
gcuggcgaugcccaccagc

SEQ ID NO: 2451915 - RNA, 24 nt, Bordetella pertussis
gcuggcgaugcccaccagccgccc

SEQ ID NO: 2451916 - RNA, 14 nt, Bordetella pertussis
gcuggcgcaccagg

SEQ ID NO: 2451917 - RNA, 18 nt, Bordetella pertussis
gcuggcgcaccaggcugg

SEQ ID NO: 2451918 - RNA, 15 nt, Bordetella pertussis
gcuggcgcacgucca

SEQ ID NO: 2451919 - RNA, 17 nt, Bordetella pertussis
gcuggcgcacguccaga

SEQ ID NO: 2451920 - RNA, 12 nt, Bordetella pertussis
gcuggcgcagca

SEQ ID NO: 2451921 - RNA, 20 nt, Bordetella pertussis
gcuggcgcagcacgccgcgc

SEQ ID NO: 2451922 - RNA, 22 nt, Bordetella pertussis
gcuggcgcagcacgccgcgcca

SEQ ID NO: 2451923 - RNA, 18 nt, Bordetella pertussis
gcuggcgcagcagcgccg

SEQ ID NO: 2451924 - RNA, 20 nt, Bordetella pertussis
gcuggcgcagcagcgccggc

SEQ ID NO: 2451925 - RNA, 22 nt, Bordetella pertussis
gcuggcgcagcagcgccggcag

SEQ ID NO: 2451926 - RNA, 14 nt, Bordetella pertussis
gcuggcgcagcagg

SEQ ID NO: 2451927 - RNA, 15 nt, Bordetella pertussis
gcuggcgcagcaggc

SEQ ID NO: 2451928 - RNA, 21 nt, Bordetella pertussis
gcuggcgcaguaucccggcca

SEQ ID NO: 2451929 - RNA, 22 nt, Bordetella pertussis
gcuggcgcaguaucccggccag

SEQ ID NO: 2451930 - RNA, 19 nt, Bordetella pertussis
gcuggcgcauggcuggucc

SEQ ID NO: 2451931 - RNA, 14 nt, Bordetella pertussis
gcuggcgcccacgc

SEQ ID NO: 2451932 - RNA, 15 nt, Bordetella pertussis
gcuggcgcccacgca

SEQ ID NO: 2451933 - RNA, 15 nt, Bordetella pertussis
gcuggcgccgcgcgc

SEQ ID NO: 2451934 - RNA, 16 nt, Bordetella pertussis
gcuggcgccgcgcgcc

SEQ ID NO: 2451935 - RNA, 23 nt, Bordetella pertussis
gcuggcgccgcgcgccauccggc

SEQ ID NO: 2451936 - RNA, 22 nt, Bordetella pertussis
gcuggcgccguucgucgcgcag

SEQ ID NO: 2451937 - RNA, 21 nt, Bordetella pertussis
gcuggcgcgagaaccaggcca

SEQ ID NO: 2451938 - RNA, 22 nt, Bordetella pertussis
gcuggcgcgagaaccaggccac

SEQ ID NO: 2451939 - RNA, 17 nt, Bordetella pertussis
gcuggcgcgcaccaucg

SEQ ID NO: 2451940 - RNA, 13 nt, Bordetella pertussis
gcuggcgcgccag

SEQ ID NO: 2451941 - RNA, 17 nt, Bordetella pertussis
gccgaauugcuggagcg

SEQ ID NO: 2451942 - RNA, 20 nt, Bordetella pertussis
gccgaauugcuggagcgcca

SEQ ID NO: 2451943 - RNA, 21 nt, Bordetella pertussis
gccgaauugcuggagcgccac

SEQ ID NO: 2451944 - RNA, 23 nt, Bordetella pertussis
gccgaauugcuggagcgccacgc

SEQ ID NO: 2451945 - RNA, 18 nt, Bordetella pertussis
gccgacagcuugcgcugg

SEQ ID NO: 2451946 - RNA, 19 nt, Bordetella pertussis
gccgacagcuugcgcuggc

SEQ ID NO: 2451947 - RNA, 20 nt, Bordetella pertussis
gccgacagcuugcgcuggcg

SEQ ID NO: 2451948 - RNA, 21 nt, Bordetella pertussis
gccgacagcuugcgcuggcgc

SEQ ID NO: 2451949 - RNA, 22 nt, Bordetella pertussis
gccgacagcuugcgcuggcgcg

SEQ ID NO: 2451950 - RNA, 23 nt, Bordetella pertussis
gccgacagcuugcgcuggcgcgc

SEQ ID NO: 2451951 - RNA, 17 nt, Bordetella pertussis
gccgacaggaaggcgag

SEQ ID NO: 2451952 - RNA, 19 nt, Bordetella pertussis
gccgacaggaaggcgagcg

SEQ ID NO: 2451953 - RNA, 21 nt, Bordetella pertussis
gccgacaggaugaagaccacg

SEQ ID NO: 2451954 - RNA, 12 nt, Bordetella pertussis
gccgacaggcgc

SEQ ID NO: 2451955 - RNA, 14 nt, Bordetella pertussis
gccgacaggcgcgc

SEQ ID NO: 2451956 - RNA, 18 nt, Bordetella pertussis
gccgacaggcgcgcaggc

SEQ ID NO: 2451957 - RNA, 20 nt, Bordetella pertussis
gccgacaggcgcgcaggcgg

SEQ ID NO: 2451958 - RNA, 18 nt, Bordetella pertussis
gccgacagguaggcgccg

SEQ ID NO: 2451959 - RNA, 19 nt, Bordetella pertussis
gccgacagguaggcgccgg

SEQ ID NO: 2451960 - RNA, 15 nt, Bordetella pertussis
gccgacaugccguac

SEQ ID NO: 2451961 - RNA, 18 nt, Bordetella pertussis
gccgacaugucgugcugg

SEQ ID NO: 2451962 - RNA, 13 nt, Bordetella pertussis
gccgaccaccagc

SEQ ID NO: 2451963 - RNA, 15 nt, Bordetella pertussis
gccgaccaccagcac

SEQ ID NO: 2451964 - RNA, 16 nt, Bordetella pertussis
gccgaccaccagcacc

SEQ ID NO: 2451965 - RNA, 17 nt, Bordetella pertussis
gccgaccacccgcgcca

SEQ ID NO: 2451966 - RNA, 19 nt, Bordetella pertussis
gccgaccacccgcgccagg

SEQ ID NO: 2451967 - RNA, 19 nt, Bordetella pertussis
gccgaccaccugcaccgcc

SEQ ID NO: 2451968 - RNA, 22 nt, Bordetella pertussis
gccgaccacggcuuuggcguag

SEQ ID NO: 2451969 - RNA, 13 nt, Bordetella pertussis
gccgaccagcacg

SEQ ID NO: 2451970 - RNA, 14 nt, Bordetella pertussis
gccgaccagcgagu

SEQ ID NO: 2451971 - RNA, 11 nt, Bordetella pertussis
gccgaccaggc

SEQ ID NO: 2451972 - RNA, 13 nt, Bordetella pertussis
gccgaccaggccc

SEQ ID NO: 2451973 - RNA, 19 nt, Bordetella pertussis
gccgaccaggcccgccacg

SEQ ID NO: 2451974 - RNA, 21 nt, Bordetella pertussis
gccgaccaggcccgccacggc

SEQ ID NO: 2451975 - RNA, 14 nt, Bordetella pertussis
gccgaccaggccgg

SEQ ID NO: 2451976 - RNA, 15 nt, Bordetella pertussis
gccgaccaggccggc

SEQ ID NO: 2451977 - RNA, 18 nt, Bordetella pertussis
gccgaccaggccggcggc

SEQ ID NO: 2451978 - RNA, 19 nt, Bordetella pertussis
gccgaccaggccggcggcg

SEQ ID NO: 2451979 - RNA, 14 nt, Bordetella pertussis
gccgaccaggcugc

SEQ ID NO: 2451980 - RNA, 22 nt, Bordetella pertussis
gccgaccaggcugcgcgccggc

SEQ ID NO: 2451981 - RNA, 18 nt, Bordetella pertussis
gccgaccauguggcagau

SEQ ID NO: 2451982 - RNA, 20 nt, Bordetella pertussis
gccgaccauguggcagaugg

SEQ ID NO: 2451983 - RNA, 17 nt, Bordetella pertussis
gccgacccgagcccugg

SEQ ID NO: 2451984 - RNA, 19 nt, Bordetella pertussis
gccgacccgagcccuggcu

SEQ ID NO: 2451985 - RNA, 14 nt, Bordetella pertussis
gccgacccgcaccg

SEQ ID NO: 2451986 - RNA, 21 nt, Bordetella pertussis
gccgacccgcaccgacgggcu

SEQ ID NO: 2451987 - RNA, 13 nt, Bordetella pertussis
gccgacccgcggc

SEQ ID NO: 2451988 - RNA, 14 nt, Bordetella pertussis
gccgacccgcggcc

SEQ ID NO: 2451989 - RNA, 13 nt, Bordetella pertussis
gccgacccugccc

SEQ ID NO: 2451990 - RNA, 16 nt, Bordetella pertussis
gccgacccugcccggc

SEQ ID NO: 2451991 - RNA, 17 nt, Bordetella pertussis
gccgacccugcccggca

SEQ ID NO: 2451992 - RNA, 17 nt, Bordetella pertussis
gccgaccgagccgaagu

SEQ ID NO: 2451993 - RNA, 19 nt, Bordetella pertussis
gccgaccgcacgauggcgc

SEQ ID NO: 2451994 - RNA, 20 nt, Bordetella pertussis
gccgaccgcacgauggcgcg

SEQ ID NO: 2451995 - RNA, 23 nt, Bordetella pertussis
gccgaccgcacgauggcgcgcga

SEQ ID NO: 2451996 - RNA, 13 nt, Bordetella pertussis
gccgaccgcgcgc

SEQ ID NO: 2451997 - RNA, 16 nt, Bordetella pertussis
gccgaccggccccacc

SEQ ID NO: 2451998 - RNA, 13 nt, Bordetella pertussis
gccgaccgggccg

SEQ ID NO: 2451999 - RNA, 17 nt, Bordetella pertussis
gccgaccgggccgacca

SEQ ID NO: 2452000 - RNA, 20 nt, Bordetella pertussis
gccgaccgggccgaccaggc

SEQ ID NO: 2452001 - RNA, 14 nt, Bordetella pertussis
gccgaccuccaggc

SEQ ID NO: 2452002 - RNA, 18 nt, Bordetella pertussis
gccgaccuccaggcccag

SEQ ID NO: 2452003 - RNA, 21 nt, Bordetella pertussis
gccgaccuccaggcccaggcg

SEQ ID NO: 2452004 - RNA, 16 nt, Bordetella pertussis
gccgaccucggcaccg

SEQ ID NO: 2452005 - RNA, 16 nt, Bordetella pertussis
gccgaccucgucgggc

SEQ ID NO: 2452006 - RNA, 17 nt, Bordetella pertussis
gccgaccucgucgggcu

SEQ ID NO: 2452007 - RNA, 20 nt, Bordetella pertussis
gccgaccucuucguugucgc

SEQ ID NO: 2452008 - RNA, 22 nt, Bordetella pertussis
gccgaccucuucguugucgcgc

SEQ ID NO: 2452009 - RNA, 17 nt, Bordetella pertussis
gccgaccuggcgcccga

SEQ ID NO: 2452010 - RNA, 19 nt, Bordetella pertussis
gccgacgaggcgcuguucg

SEQ ID NO: 2452011 - RNA, 15 nt, Bordetella pertussis
gccgacgaugaccau

SEQ ID NO: 2452012 - RNA, 19 nt, Bordetella pertussis
gccgacgaugccgcccacg

SEQ ID NO: 2452013 - RNA, 20 nt, Bordetella pertussis
gccgacgaugccgcccacgc

SEQ ID NO: 2452014 - RNA, 17 nt, Bordetella pertussis
gccgacgaugccgccgc

SEQ ID NO: 2452015 - RNA, 19 nt, Bordetella pertussis
gccgacgaugccgccgccg

SEQ ID NO: 2452016 - RNA, 21 nt, Bordetella pertussis
gccgacgaugccgccgccgac

SEQ ID NO: 2452017 - RNA, 22 nt, Bordetella pertussis
gccgacgaugccgccgccgacg

SEQ ID NO: 2452018 - RNA, 15 nt, Bordetella pertussis
gccgacgauggccgg

SEQ ID NO: 2452019 - RNA, 18 nt, Bordetella pertussis
gccgacgaugucgccgcc

SEQ ID NO: 2452020 - RNA, 19 nt, Bordetella pertussis
gccgacgaugucgccgccg

SEQ ID NO: 2452021 - RNA, 20 nt, Bordetella pertussis
gccgacgaugucgccgccgc

SEQ ID NO: 2452022 - RNA, 23 nt, Bordetella pertussis
gccgacgaugucgccgccgcgca

SEQ ID NO: 2452023 - RNA, 14 nt, Bordetella pertussis
gccgacgccgccac

SEQ ID NO: 2452024 - RNA, 15 nt, Bordetella pertussis
gccgacgccgccacg

SEQ ID NO: 2452025 - RNA, 21 nt, Bordetella pertussis
gccgacgccggcucaggccag

SEQ ID NO: 2452026 - RNA, 16 nt, Bordetella pertussis
gccgacgcgcccgggc

SEQ ID NO: 2452027 - RNA, 17 nt, Bordetella pertussis
gccgacgcgcccgggcu

SEQ ID NO: 2452028 - RNA, 19 nt, Bordetella pertussis
gccgacgcgcccgggcuga

SEQ ID NO: 2452029 - RNA, 19 nt, Bordetella pertussis
gccgacgcgccgggccacg

SEQ ID NO: 2452030 - RNA, 16 nt, Bordetella pertussis
gccgacgcgcuggucc

SEQ ID NO: 2452031 - RNA, 15 nt, Bordetella pertussis
gccgacgcgcugucc

SEQ ID NO: 2452032 - RNA, 17 nt, Bordetella pertussis
gccgacggcaagaucgc

SEQ ID NO: 2452033 - RNA, 19 nt, Bordetella pertussis
gccgacggcauggccggca

SEQ ID NO: 2452034 - RNA, 21 nt, Bordetella pertussis
gccgacggcauggccggcagg

SEQ ID NO: 2452035 - RNA, 16 nt, Bordetella pertussis
gccgacggcauggcgg

SEQ ID NO: 2452036 - RNA, 20 nt, Bordetella pertussis
gccgacggcauggcggccag

SEQ ID NO: 2452037 - RNA, 21 nt, Bordetella pertussis
gccgacggcauggcggccagc

SEQ ID NO: 2452038 - RNA, 22 nt, Bordetella pertussis
gccgacggcauggcggccagcu

SEQ ID NO: 2452039 - RNA, 15 nt, Bordetella pertussis
gccgacggccucggc

SEQ ID NO: 2452040 - RNA, 18 nt, Bordetella pertussis
gccgacggccucggccag

SEQ ID NO: 2452041 - RNA, 20 nt, Bordetella pertussis
gccgacggccucggccagga

SEQ ID NO: 2452042 - RNA, 21 nt, Bordetella pertussis
gccgacggccucggccaggaa

SEQ ID NO: 2452043 - RNA, 19 nt, Bordetella pertussis
gccgacggcgcccugcagg

SEQ ID NO: 2452044 - RNA, 22 nt, Bordetella pertussis
gccgacggcgcccugcagggca

SEQ ID NO: 2452045 - RNA, 14 nt, Bordetella pertussis
gccgacggcgcugg

SEQ ID NO: 2452046 - RNA, 15 nt, Bordetella pertussis
gccgacggcgcuggc

SEQ ID NO: 2452047 - RNA, 16 nt, Bordetella pertussis
gccgacggcgcuggcg

SEQ ID NO: 2452048 - RNA, 17 nt, Bordetella pertussis
gccgacggcgcuggcga

SEQ ID NO: 2452049 - RNA, 18 nt, Bordetella pertussis
gccgacggcgcuggcgag

SEQ ID NO: 2452050 - RNA, 19 nt, Bordetella pertussis
gccgacggcgcuggcgagc

SEQ ID NO: 2452051 - RNA, 14 nt, Bordetella pertussis
gccgacggcggcgc

SEQ ID NO: 2452052 - RNA, 17 nt, Bordetella pertussis
gccgacggcggcgcggc

SEQ ID NO: 2452053 - RNA, 18 nt, Bordetella pertussis
gccgacggcggcgcggcg

SEQ ID NO: 2452054 - RNA, 17 nt, Bordetella pertussis
gccgacgggccggucaa

SEQ ID NO: 2452055 - RNA, 16 nt, Bordetella pertussis
gcccgccggcgcgcgc

SEQ ID NO: 2452056 - RNA, 22 nt, Bordetella pertussis
gcccgccggcgcgcgcgcgccg

SEQ ID NO: 2452057 - RNA, 13 nt, Bordetella pertussis
gcccgccgggccg

SEQ ID NO: 2452058 - RNA, 13 nt, Bordetella pertussis
gcccgccguggcc

SEQ ID NO: 2452059 - RNA, 12 nt, Bordetella pertussis
gcccgccucagg

SEQ ID NO: 2452060 - RNA, 15 nt, Bordetella pertussis
gcccgccucaggccg

SEQ ID NO: 2452061 - RNA, 12 nt, Bordetella pertussis
gcccgccucgag

SEQ ID NO: 2452062 - RNA, 14 nt, Bordetella pertussis
gcccgccucgagcg

SEQ ID NO: 2452063 - RNA, 14 nt, Bordetella pertussis
gcccgccugcagca

SEQ ID NO: 2452064 - RNA, 12 nt, Bordetella pertussis
gcccgccugccg

SEQ ID NO: 2452065 - RNA, 19 nt, Bordetella pertussis
gcccgccugccggccuggc

SEQ ID NO: 2452066 - RNA, 16 nt, Bordetella pertussis
gcccgccugcgccagc

SEQ ID NO: 2452067 - RNA, 17 nt, Bordetella pertussis
gcccgccugcgccagcc

SEQ ID NO: 2452068 - RNA, 18 nt, Bordetella pertussis
gcccgccugcgccagccg

SEQ ID NO: 2452069 - RNA, 15 nt, Bordetella pertussis
gcccgccuggcgccg

SEQ ID NO: 2452070 - RNA, 16 nt, Bordetella pertussis
gcccgccuggcgccgc

SEQ ID NO: 2452071 - RNA, 21 nt, Bordetella pertussis
gcccgccuggcgccgcgcccg

SEQ ID NO: 2452072 - RNA, 19 nt, Bordetella pertussis
gcccgccuggucgcuggcg

SEQ ID NO: 2452073 - RNA, 20 nt, Bordetella pertussis
gcccgccuggucgcuggcgc

SEQ ID NO: 2452074 - RNA, 17 nt, Bordetella pertussis
gcccgccuucagcgggc

SEQ ID NO: 2452075 - RNA, 18 nt, Bordetella pertussis
gcccgccuucgcugacgc

SEQ ID NO: 2452076 - RNA, 14 nt, Bordetella pertussis
gcccgccuucggcg

SEQ ID NO: 2452077 - RNA, 16 nt, Bordetella pertussis
gcccgccuucggcggc

SEQ ID NO: 2452078 - RNA, 17 nt, Bordetella pertussis
gcccgccuucggcggcg

SEQ ID NO: 2452079 - RNA, 20 nt, Bordetella pertussis
gcccgccuucggcggcgggc

SEQ ID NO: 2452080 - RNA, 21 nt, Bordetella pertussis
gcccgccuucggcggcgggcu

SEQ ID NO: 2452081 - RNA, 24 nt, Bordetella pertussis
gcccgccuucuugaacagcucggc

SEQ ID NO: 2452082 - RNA, 17 nt, Bordetella pertussis
gcccgccuuugccgcug

SEQ ID NO: 2452083 - RNA, 20 nt, Bordetella pertussis
gcccgcgaagcagccggcca

SEQ ID NO: 2452084 - RNA, 15 nt, Bordetella pertussis
gcccgcgacgcuggc

SEQ ID NO: 2452085 - RNA, 17 nt, Bordetella pertussis
gcccgcgacgcuggcga

SEQ ID NO: 2452086 - RNA, 22 nt, Bordetella pertussis
gcccgcgacgcuggcgaugccc

SEQ ID NO: 2452087 - RNA, 15 nt, Bordetella pertussis
gcccgcgagcggcca

SEQ ID NO: 2452088 - RNA, 16 nt, Bordetella pertussis
gcccgcgagcggccag

SEQ ID NO: 2452089 - RNA, 20 nt, Bordetella pertussis
gcccgcgagcggccagccug

SEQ ID NO: 2452090 - RNA, 14 nt, Bordetella pertussis
gcccgcgcaccagg

SEQ ID NO: 2452091 - RNA, 18 nt, Bordetella pertussis
gcccgcgcaccaggcgcg

SEQ ID NO: 2452092 - RNA, 20 nt, Bordetella pertussis
gcccgcgcaccaggcgcggc

SEQ ID NO: 2452093 - RNA, 13 nt, Bordetella pertussis
gcccgcgcaugca

SEQ ID NO: 2452094 - RNA, 18 nt, Bordetella pertussis
gcccgcgcaugcaagaca

SEQ ID NO: 2452095 - RNA, 22 nt, Bordetella pertussis
gcccgcgcaugcaagacaggcc

SEQ ID NO: 2452096 - RNA, 13 nt, Bordetella pertussis
gcccgcgccagcg

SEQ ID NO: 2452097 - RNA, 14 nt, Bordetella pertussis
gcccgcgccagcgc

SEQ ID NO: 2452098 - RNA, 16 nt, Bordetella pertussis
gcccgcgccagcgcca

SEQ ID NO: 2452099 - RNA, 18 nt, Bordetella pertussis
gcccgcgccagcgccacg

SEQ ID NO: 2452100 - RNA, 14 nt, Bordetella pertussis
gcccgcgcccagcu

SEQ ID NO: 2452101 - RNA, 14 nt, Bordetella pertussis
gcccgcgcccugcu

SEQ ID NO: 2452102 - RNA, 13 nt, Bordetella pertussis
gcccgcgccgaag

SEQ ID NO: 2452103 - RNA, 20 nt, Bordetella pertussis
gcccgcgccgacggcggcgc

SEQ ID NO: 2452104 - RNA, 13 nt, Bordetella pertussis
gcccgcgccgcgu

SEQ ID NO: 2452105 - RNA, 14 nt, Bordetella pertussis
gcccgcgccgcguc

SEQ ID NO: 2452106 - RNA, 13 nt, Bordetella pertussis
gcccgcgccgggg

SEQ ID NO: 2452107 - RNA, 19 nt, Bordetella pertussis
gcccgcgccguaccugcag

SEQ ID NO: 2452108 - RNA, 23 nt, Bordetella pertussis
gcccgcgccguaccugcagcagg

SEQ ID NO: 2452109 - RNA, 13 nt, Bordetella pertussis
gcccgcgcgagcg

SEQ ID NO: 2452110 - RNA, 16 nt, Bordetella pertussis
gcccgcgcgagcggcg

SEQ ID NO: 2452111 - RNA, 13 nt, Bordetella pertussis
gcccgcgcgcacg

SEQ ID NO: 2452112 - RNA, 12 nt, Bordetella pertussis
gcccgcgcgccu

SEQ ID NO: 2452113 - RNA, 16 nt, Bordetella pertussis
gcccgcgcgcgagcug

SEQ ID NO: 2452114 - RNA, 23 nt, Bordetella pertussis
gcccgcgcgcgagcugcgcggcu

SEQ ID NO: 2452115 - RNA, 17 nt, Bordetella pertussis
gcccgcgcgcguucagg

SEQ ID NO: 2452116 - RNA, 13 nt, Bordetella pertussis
gcccgcgcggcca

SEQ ID NO: 2452117 - RNA, 14 nt, Bordetella pertussis
gcccgcgcggccag

SEQ ID NO: 2452118 - RNA, 16 nt, Bordetella pertussis
gcccgcgcggccagcg

SEQ ID NO: 2452119 - RNA, 19 nt, Bordetella pertussis
gcccgcgcggccagcgccg

SEQ ID NO: 2452120 - RNA, 13 nt, Bordetella pertussis
gcccgcgcuggcg

SEQ ID NO: 2452121 - RNA, 14 nt, Bordetella pertussis
gcccgcgcuggcgc

SEQ ID NO: 2452122 - RNA, 18 nt, Bordetella pertussis
gcccgcgcuggcgcagca

SEQ ID NO: 2452123 - RNA, 22 nt, Bordetella pertussis
gcccgcgcuggcgcagcaggcg

SEQ ID NO: 2452124 - RNA, 14 nt, Bordetella pertussis
gcccgcgcuguugc

SEQ ID NO: 2452125 - RNA, 22 nt, Bordetella pertussis
gcccgcgcuguugcuccaggcc

SEQ ID NO: 2452126 - RNA, 17 nt, Bordetella pertussis
gcccgcggaaagcuggc

SEQ ID NO: 2452127 - RNA, 13 nt, Bordetella pertussis
gcccgcggccacc

SEQ ID NO: 2452128 - RNA, 17 nt, Bordetella pertussis
gcccgcggccaccaggc

SEQ ID NO: 2452129 - RNA, 15 nt, Bordetella pertussis
gcccgcggccagcca

SEQ ID NO: 2452130 - RNA, 22 nt, Bordetella pertussis
gcccgcggccagccacgccggc

SEQ ID NO: 2452131 - RNA, 13 nt, Bordetella pertussis
gcccgcggccgcg

SEQ ID NO: 2452132 - RNA, 19 nt, Bordetella pertussis
gcccgcggccugcagacca

SEQ ID NO: 2452133 - RNA, 14 nt, Bordetella pertussis
gcccgcggccugcg

SEQ ID NO: 2452134 - RNA, 14 nt, Bordetella pertussis
gcccgcggccuugg

SEQ ID NO: 2452135 - RNA, 17 nt, Bordetella pertussis
gcccgcggcgccagcgc

SEQ ID NO: 2452136 - RNA, 18 nt, Bordetella pertussis
gcccgcggcgccagcgcu

SEQ ID NO: 2452137 - RNA, 22 nt, Bordetella pertussis
gcccgcggcgccagcgcuucgg

SEQ ID NO: 2452138 - RNA, 20 nt, Bordetella pertussis
gcccgcggcgcccagcuggc

SEQ ID NO: 2452139 - RNA, 13 nt, Bordetella pertussis
gcccgcggcggcc

SEQ ID NO: 2452140 - RNA, 14 nt, Bordetella pertussis
gcccgcggcggccc

SEQ ID NO: 2452141 - RNA, 14 nt, Bordetella pertussis
gcccgcgggcgccc

SEQ ID NO: 2452142 - RNA, 16 nt, Bordetella pertussis
gcccgcgggcgcccgg

SEQ ID NO: 2452143 - RNA, 17 nt, Bordetella pertussis
gcccgcgggcgcccggc

SEQ ID NO: 2452144 - RNA, 19 nt, Bordetella pertussis
gcccgcgggcgcccggccg

SEQ ID NO: 2452145 - RNA, 20 nt, Bordetella pertussis
gcccgcgggcgcccggccgg

SEQ ID NO: 2452146 - RNA, 21 nt, Bordetella pertussis
gcccgcgggcgcccggccggc

SEQ ID NO: 2452147 - RNA, 23 nt, Bordetella pertussis
gcccgcgggugauauuggcgaac

SEQ ID NO: 2452148 - RNA, 15 nt, Bordetella pertussis
gcccgcgguccagca

SEQ ID NO: 2452149 - RNA, 19 nt, Bordetella pertussis
gcccgcgguccagcacggc

SEQ ID NO: 2452150 - RNA, 22 nt, Bordetella pertussis
gcccgcgguccagcacggcgag

SEQ ID NO: 2452151 - RNA, 14 nt, Bordetella pertussis
gcccgcguacagcc

SEQ ID NO: 2452152 - RNA, 22 nt, Bordetella pertussis
gcccgcguacagcccgaacaga

SEQ ID NO: 2452153 - RNA, 22 nt, Bordetella pertussis
gcccgcgucacgauuucggcca

SEQ ID NO: 2452154 - RNA, 16 nt, Bordetella pertussis
gcccgcgucagacgcg

SEQ ID NO: 2452155 - RNA, 17 nt, Bordetella pertussis
gcccgcgucagacgcgc

SEQ ID NO: 2452156 - RNA, 18 nt, Bordetella pertussis
gcccgcgucagacgcgcu

SEQ ID NO: 2452157 - RNA, 14 nt, Bordetella pertussis
gcccgcguccacca

SEQ ID NO: 2452158 - RNA, 16 nt, Bordetella pertussis
gcccgcgucggcgcgg

SEQ ID NO: 2452159 - RNA, 19 nt, Bordetella pertussis
gcccgcgugacggccgcca

SEQ ID NO: 2452160 - RNA, 20 nt, Bordetella pertussis
gcccgcgugacggccgccac

SEQ ID NO: 2452161 - RNA, 21 nt, Bordetella pertussis
gcccgcgugacggccgccacg

SEQ ID NO: 2452162 - RNA, 17 nt, Bordetella pertussis
gcccgcguucaggcgcg

SEQ ID NO: 2452163 - RNA, 19 nt, Bordetella pertussis
gcccgcguucaggcgcggc

SEQ ID NO: 2452164 - RNA, 22 nt, Bordetella pertussis
gcccgcguucaggcgcggcugg

SEQ ID NO: 2452165 - RNA, 15 nt, Bordetella pertussis
gcccgcuacgcgggc

SEQ ID NO: 2452166 - RNA, 22 nt, Bordetella pertussis
gcccgcuacgcgggcuugcugc

SEQ ID NO: 2452167 - RNA, 22 nt, Bordetella pertussis
gcccgcuaugcgggcuugcugc

SEQ ID NO: 2452168 - RNA, 23 nt, Bordetella pertussis
gcccgcuaugcgggcuugcugcc

SEQ ID NO: 2452169 - RNA, 15 nt, Bordetella pertussis
gcccgcuccaccagc

SEQ ID NO: 2452170 - RNA, 20 nt, Bordetella pertussis
gcccgcuccaccagcaccgg

SEQ ID NO: 2452171 - RNA, 14 nt, Bordetella pertussis
gcccgcuccaggcg

SEQ ID NO: 2452172 - RNA, 15 nt, Bordetella pertussis
gcccgcuccaggcgg

SEQ ID NO: 2452173 - RNA, 18 nt, Bordetella pertussis
gcccgcuccaggcggcca

SEQ ID NO: 2452174 - RNA, 15 nt, Bordetella pertussis
gcccgcucggccagc

SEQ ID NO: 2452175 - RNA, 17 nt, Bordetella pertussis
gcccgcucggccagcag

SEQ ID NO: 2452176 - RNA, 16 nt, Bordetella pertussis
gcccgcugaccggccu

SEQ ID NO: 2452177 - RNA, 19 nt, Bordetella pertussis
gcccgcugaccggccuggu

SEQ ID NO: 2452178 - RNA, 14 nt, Bordetella pertussis
gcccgcugccgaga

SEQ ID NO: 2452179 - RNA, 18 nt, Bordetella pertussis
gcccgcugccgagacggc

SEQ ID NO: 2452180 - RNA, 19 nt, Bordetella pertussis
gcccgcugccgagacggcc

SEQ ID NO: 2452181 - RNA, 22 nt, Bordetella pertussis
gcccgcugccgagacggccgcc

SEQ ID NO: 2452182 - RNA, 17 nt, Bordetella pertussis
gcccgcugcguccacca

SEQ ID NO: 2452183 - RNA, 12 nt, Bordetella pertussis
gcccgcuggcca

SEQ ID NO: 2452184 - RNA, 13 nt, Bordetella pertussis
gcccgcuggccau

SEQ ID NO: 2452185 - RNA, 13 nt, Bordetella pertussis
gcccgcuggccga

SEQ ID NO: 2452186 - RNA, 19 nt, Bordetella pertussis
gcccgcuggccgaucugcu

SEQ ID NO: 2452187 - RNA, 15 nt, Bordetella pertussis
gcccgcuuccuuggg

SEQ ID NO: 2452188 - RNA, 23 nt, Bordetella pertussis
gcccgcuugcggccggcgcugau

SEQ ID NO: 2452189 - RNA, 22 nt, Bordetella pertussis
gcccgcuugggccgcgccugca

SEQ ID NO: 2452190 - RNA, 17 nt, Bordetella pertussis
gcccggaauaccgccag

SEQ ID NO: 2452191 - RNA, 20 nt, Bordetella pertussis
gcccggaauaccgccagcuc

SEQ ID NO: 2452192 - RNA, 18 nt, Bordetella pertussis
gcccggacgcggccggca

SEQ ID NO: 2452193 - RNA, 20 nt, Bordetella pertussis
gcccggauacugcacgcggu

SEQ ID NO: 2452194 - RNA, 16 nt, Bordetella pertussis
gcccggauauggccgg

SEQ ID NO: 2452195 - RNA, 21 nt, Bordetella pertussis
gcccggauauggccggcgcgc

SEQ ID NO: 2452196 - RNA, 16 nt, Bordetella pertussis
gcccggaucaguccgg

SEQ ID NO: 2452197 - RNA, 21 nt, Bordetella pertussis
gcccggaucauccgggcccgg

SEQ ID NO: 2452198 - RNA, 23 nt, Bordetella pertussis
gcccggaucgcacccgucccugg

SEQ ID NO: 2452199 - RNA, 16 nt, Bordetella pertussis
gcccggcaacaucucc

SEQ ID NO: 2452200 - RNA, 16 nt, Bordetella pertussis
gcccggcaccaugcgc

SEQ ID NO: 2452201 - RNA, 18 nt, Bordetella pertussis
gcccggcaccaugcgcac

SEQ ID NO: 2452202 - RNA, 17 nt, Bordetella pertussis
gcccggcaccguccagc

SEQ ID NO: 2452203 - RNA, 19 nt, Bordetella pertussis
gcccggcaccguccagcau

SEQ ID NO: 2452204 - RNA, 14 nt, Bordetella pertussis
gcccggcacggagg

SEQ ID NO: 2452205 - RNA, 17 nt, Bordetella pertussis
gcccggcagcugacggg

SEQ ID NO: 2452206 - RNA, 12 nt, Bordetella pertussis
gcccggcaggca

SEQ ID NO: 2452207 - RNA, 17 nt, Bordetella pertussis
gcccggcaggcacacga

SEQ ID NO: 2452208 - RNA, 20 nt, Bordetella pertussis
gcccggcagggucucggcca

SEQ ID NO: 2452209 - RNA, 14 nt, Bordetella pertussis
gcccggcaggguga

SEQ ID NO: 2452210 - RNA, 14 nt, Bordetella pertussis
gcccggcaugggcg

SEQ ID NO: 2452211 - RNA, 15 nt, Bordetella pertussis
gcccggccaccagcg

SEQ ID NO: 2452212 - RNA, 17 nt, Bordetella pertussis
gcccggccaccagcgug

SEQ ID NO: 2452213 - RNA, 15 nt, Bordetella pertussis
gcccggccacggccg

SEQ ID NO: 2452214 - RNA, 20 nt, Bordetella pertussis
gcccggccacggccgggccu

SEQ ID NO: 2452215 - RNA, 15 nt, Bordetella pertussis
gcccggcccaggccg

SEQ ID NO: 2452216 - RNA, 16 nt, Bordetella pertussis
gcccggcccaggccgg

SEQ ID NO: 2452217 - RNA, 23 nt, Bordetella pertussis
gcccggcccaggccgggcguugu

SEQ ID NO: 2452218 - RNA, 19 nt, Bordetella pertussis
gcccggccccaggccgggu

SEQ ID NO: 2452219 - RNA, 17 nt, Bordetella pertussis
gcccggcccccagccca

SEQ ID NO: 2452220 - RNA, 16 nt, Bordetella pertussis
gcccggccgcagggcg

SEQ ID NO: 2452221 - RNA, 12 nt, Bordetella pertussis
gcccggccgcca

SEQ ID NO: 2452222 - RNA, 16 nt, Bordetella pertussis
gcccggccgccagcau

SEQ ID NO: 2452223 - RNA, 19 nt, Bordetella pertussis
gcccggccgccagcauggc

SEQ ID NO: 2452224 - RNA, 21 nt, Bordetella pertussis
gcccggccgccagcauggcgu

SEQ ID NO: 2452225 - RNA, 13 nt, Bordetella pertussis
gcccggccgccgc

SEQ ID NO: 2452226 - RNA, 14 nt, Bordetella pertussis
gcccggccgccgcc

SEQ ID NO: 2452227 - RNA, 15 nt, Bordetella pertussis
gcccggccgccgccg

SEQ ID NO: 2452228 - RNA, 16 nt, Bordetella pertussis
gcccggccgccgccgg

SEQ ID NO: 2452229 - RNA, 17 nt, Bordetella pertussis
gcccggccgccgccggc

SEQ ID NO: 2452230 - RNA, 21 nt, Bordetella pertussis
gcccggccgccucaccgcgcc

SEQ ID NO: 2452231 - RNA, 23 nt, Bordetella pertussis
gcccggccggcaaggggccagcc

SEQ ID NO: 2452232 - RNA, 20 nt, Bordetella pertussis
gcccggccggcacggccggc

SEQ ID NO: 2452233 - RNA, 12 nt, Bordetella pertussis
gcccggccggcc

SEQ ID NO: 2452234 - RNA, 13 nt, Bordetella pertussis
gcccggccggccc

SEQ ID NO: 2452235 - RNA, 16 nt, Bordetella pertussis
gcccggccggcccgcg

SEQ ID NO: 2452236 - RNA, 19 nt, Bordetella pertussis
gcccggccggcccgcgcgc

SEQ ID NO: 2452237 - RNA, 13 nt, Bordetella pertussis
gcccggccggccu

SEQ ID NO: 2452238 - RNA, 14 nt, Bordetella pertussis
gcccggcgagcaug

SEQ ID NO: 2452239 - RNA, 23 nt, Bordetella pertussis
gcccggcgagguugcaggccagg

SEQ ID NO: 2452240 - RNA, 13 nt, Bordetella pertussis
gcccggcgccauc

SEQ ID NO: 2452241 - RNA, 13 nt, Bordetella pertussis
gcccggcgccgcg

SEQ ID NO: 2452242 - RNA, 16 nt, Bordetella pertussis
gcccggcgccgcgcgc

SEQ ID NO: 2452243 - RNA, 18 nt, Bordetella pertussis
gcccggcgccgcgcgcug

SEQ ID NO: 2452244 - RNA, 19 nt, Bordetella pertussis
gcccggcgccgcgcgcugg

SEQ ID NO: 2452245 - RNA, 15 nt, Bordetella pertussis
gcccggcgccggugg

SEQ ID NO: 2452246 - RNA, 16 nt, Bordetella pertussis
gcccggcgcgacaggc

SEQ ID NO: 2452247 - RNA, 18 nt, Bordetella pertussis
gcccggcgcgacaggcgg

SEQ ID NO: 2452248 - RNA, 14 nt, Bordetella pertussis
gcccggcgcgacga

SEQ ID NO: 2452249 - RNA, 12 nt, Bordetella pertussis
gcccggcgcgca

SEQ ID NO: 2452250 - RNA, 15 nt, Bordetella pertussis
gcccggcgcgcaucg

SEQ ID NO: 2452251 - RNA, 16 nt, Bordetella pertussis
gcccggcgcgcaucgu

SEQ ID NO: 2452252 - RNA, 12 nt, Bordetella pertussis
gcccggcgcgcc

SEQ ID NO: 2452253 - RNA, 13 nt, Bordetella pertussis
gcccggcgcgcca

SEQ ID NO: 2452254 - RNA, 13 nt, Bordetella pertussis
gcccggcgcgccu

SEQ ID NO: 2452255 - RNA, 14 nt, Bordetella pertussis
gcccggcgcgccuu

SEQ ID NO: 2452256 - RNA, 16 nt, Bordetella pertussis
gcccggcgcgccuucg

SEQ ID NO: 2452257 - RNA, 17 nt, Bordetella pertussis
gcccggcgcgccuucgg

SEQ ID NO: 2452258 - RNA, 21 nt, Bordetella pertussis
gcccggcgcgccuucggcagg

SEQ ID NO: 2452259 - RNA, 21 nt, Bordetella pertussis
gcccggcggaucacccagcgg

SEQ ID NO: 2452260 - RNA, 22 nt, Bordetella pertussis
gcccggcggaucacccagcggc

SEQ ID NO: 2452261 - RNA, 12 nt, Bordetella pertussis
gcccggcggcca

SEQ ID NO: 2452262 - RNA, 13 nt, Bordetella pertussis
gcccggcggccag

SEQ ID NO: 2452263 - RNA, 17 nt, Bordetella pertussis
gcccggcggccaggccg

SEQ ID NO: 2452264 - RNA, 18 nt, Bordetella pertussis
gcccggcggccaggccgg

SEQ ID NO: 2452265 - RNA, 19 nt, Bordetella pertussis
gcccggcggccaggccggc

SEQ ID NO: 2452266 - RNA, 22 nt, Bordetella pertussis
gcccggcggccaggccggcgcg

SEQ ID NO: 2452267 - RNA, 12 nt, Bordetella pertussis
gcccggcggcgc

SEQ ID NO: 2452268 - RNA, 15 nt, Bordetella pertussis
gcccggcggcgcgcc

SEQ ID NO: 2452269 - RNA, 17 nt, Bordetella pertussis
gcccggcggcgcgccgc

SEQ ID NO: 2452270 - RNA, 22 nt, Bordetella pertussis
gcccggcggcgcgccgccgggc

SEQ ID NO: 2452271 - RNA, 14 nt, Bordetella pertussis
gcccggcggcgcgg

SEQ ID NO: 2452272 - RNA, 16 nt, Bordetella pertussis
gcccggcggcgcggcg

SEQ ID NO: 2452273 - RNA, 18 nt, Bordetella pertussis
gcccggcgggaacaggca

SEQ ID NO: 2452274 - RNA, 17 nt, Bordetella pertussis
gcccggcguagcugcgc

SEQ ID NO: 2452275 - RNA, 19 nt, Bordetella pertussis
gcccggcguagcugcgccg

SEQ ID NO: 2452276 - RNA, 20 nt, Bordetella pertussis
gcccggcguagcugcgccgc

SEQ ID NO: 2452277 - RNA, 12 nt, Bordetella pertussis
gcccggcgucgg

SEQ ID NO: 2452278 - RNA, 19 nt, Bordetella pertussis
gcccggcgucgggucagcc

SEQ ID NO: 2452279 - RNA, 23 nt, Bordetella pertussis
gcccggcgucgggucagccuugc

SEQ ID NO: 2452280 - RNA, 19 nt, Bordetella pertussis
gcccggcgugcccagggcc

SEQ ID NO: 2452281 - RNA, 20 nt, Bordetella pertussis
gcccggcgugcccagggcca

SEQ ID NO: 2452282 - RNA, 16 nt, Bordetella pertussis
gcccggcuccaggccg

SEQ ID NO: 2452283 - RNA, 19 nt, Bordetella pertussis
gcccggcuccaggccgccc

SEQ ID NO: 2452284 - RNA, 22 nt, Bordetella pertussis
gcccggcuccaggccgcccagc

SEQ ID NO: 2452285 - RNA, 16 nt, Bordetella pertussis
gcccggcucgccgagc

SEQ ID NO: 2452286 - RNA, 14 nt, Bordetella pertussis
gccgacgggcggcu

SEQ ID NO: 2452287 - RNA, 18 nt, Bordetella pertussis
gccgacgggcggcugcug

SEQ ID NO: 2452288 - RNA, 23 nt, Bordetella pertussis
gccgacgggcggcugcuggccca

SEQ ID NO: 2452289 - RNA, 20 nt, Bordetella pertussis
gccgacguagucgcgccagc

SEQ ID NO: 2452290 - RNA, 21 nt, Bordetella pertussis
gccgacguagucgcgccagcg

SEQ ID NO: 2452291 - RNA, 22 nt, Bordetella pertussis
gccgacguagucgcgccagcgg

SEQ ID NO: 2452292 - RNA, 15 nt, Bordetella pertussis
gccgacuaugcuuua

SEQ ID NO: 2452293 - RNA, 23 nt, Bordetella pertussis
gccgacucgaaacgggcggcguc

SEQ ID NO: 2452294 - RNA, 20 nt, Bordetella pertussis
gccgacugcuguacgacagc

SEQ ID NO: 2452295 - RNA, 22 nt, Bordetella pertussis
gccgacuggaugaagcguucgg

SEQ ID NO: 2452296 - RNA, 17 nt, Bordetella pertussis
gccgacuucagacagac

SEQ ID NO: 2452297 - RNA, 20 nt, Bordetella pertussis
gccgacuucuggggugccug

SEQ ID NO: 2452298 - RNA, 16 nt, Bordetella pertussis
gccgagaacgccgucg

SEQ ID NO: 2452299 - RNA, 17 nt, Bordetella pertussis
gccgagacggccgccga

SEQ ID NO: 2452300 - RNA, 19 nt, Bordetella pertussis
gccgagacggccgccgacg

SEQ ID NO: 2452301 - RNA, 20 nt, Bordetella pertussis
gccgagacggccgccgacgc

SEQ ID NO: 2452302 - RNA, 16 nt, Bordetella pertussis
gccgagaugccguucu

SEQ ID NO: 2452303 - RNA, 15 nt, Bordetella pertussis
gccgagcagaucgcc

SEQ ID NO: 2452304 - RNA, 20 nt, Bordetella pertussis
gccgagcagaucgccaacgu

SEQ ID NO: 2452305 - RNA, 12 nt, Bordetella pertussis
gccgagccauug

SEQ ID NO: 2452306 - RNA, 13 nt, Bordetella pertussis
gccgagccauugu

SEQ ID NO: 2452307 - RNA, 23 nt, Bordetella pertussis
gccgagccgcugucgcaggcgcu

SEQ ID NO: 2452308 - RNA, 13 nt, Bordetella pertussis
gccgagcgcaccc

SEQ ID NO: 2452309 - RNA, 13 nt, Bordetella pertussis
gccgagcgccagu

SEQ ID NO: 2452310 - RNA, 13 nt, Bordetella pertussis
gccgagcgcgcca

SEQ ID NO: 2452311 - RNA, 16 nt, Bordetella pertussis
gccgagcgcgccagca

SEQ ID NO: 2452312 - RNA, 13 nt, Bordetella pertussis
gccgagcgcggca

SEQ ID NO: 2452313 - RNA, 13 nt, Bordetella pertussis
gccgagcgcugcg

SEQ ID NO: 2452314 - RNA, 14 nt, Bordetella pertussis
gccgagcgcugcgc

SEQ ID NO: 2452315 - RNA, 15 nt, Bordetella pertussis
gccgagcgggccagc

SEQ ID NO: 2452316 - RNA, 19 nt, Bordetella pertussis
gccgagcgggccagcgcgg

SEQ ID NO: 2452317 - RNA, 22 nt, Bordetella pertussis
gccgagcgggccagcgcggcca

SEQ ID NO: 2452318 - RNA, 19 nt, Bordetella pertussis
gccgagcggggccgcgccg

SEQ ID NO: 2452319 - RNA, 21 nt, Bordetella pertussis
gccgagcggggccgcgccggc

SEQ ID NO: 2452320 - RNA, 22 nt, Bordetella pertussis
gccgagcggggccgcgccggcu

SEQ ID NO: 2452321 - RNA, 16 nt, Bordetella pertussis
gccgagcgugccggga

SEQ ID NO: 2452322 - RNA, 17 nt, Bordetella pertussis
gccgagcgugccgggau

SEQ ID NO: 2452323 - RNA, 12 nt, Bordetella pertussis
gccgagcuccuc

SEQ ID NO: 2452324 - RNA, 15 nt, Bordetella pertussis
gccgagcuccucgag

SEQ ID NO: 2452325 - RNA, 16 nt, Bordetella pertussis
gccgagcuccucgagc

SEQ ID NO: 2452326 - RNA, 16 nt, Bordetella pertussis
gccgaggaccugcugg

SEQ ID NO: 2452327 - RNA, 17 nt, Bordetella pertussis
gccgaggaccugcuggc

SEQ ID NO: 2452328 - RNA, 19 nt, Bordetella pertussis
gccgaggaccugcuggcgu

SEQ ID NO: 2452329 - RNA, 21 nt, Bordetella pertussis
gccgaggaucuggccggcgcu

SEQ ID NO: 2452330 - RNA, 13 nt, Bordetella pertussis
gccgaggccagcg

SEQ ID NO: 2452331 - RNA, 14 nt, Bordetella pertussis
gccgaggccagcgu

SEQ ID NO: 2452332 - RNA, 12 nt, Bordetella pertussis
gccgaggccagg

SEQ ID NO: 2452333 - RNA, 13 nt, Bordetella pertussis
gccgaggccaggu

SEQ ID NO: 2452334 - RNA, 22 nt, Bordetella pertussis
gccgaggccagguugggugcgc

SEQ ID NO: 2452335 - RNA, 14 nt, Bordetella pertussis
gccgaggcgccgcc

SEQ ID NO: 2452336 - RNA, 13 nt, Bordetella pertussis
gccgaggcgggca

SEQ ID NO: 2452337 - RNA, 15 nt, Bordetella pertussis
gccgaggcgggcagc

SEQ ID NO: 2452338 - RNA, 16 nt, Bordetella pertussis
gccgaggcgggcagca

SEQ ID NO: 2452339 - RNA, 18 nt, Bordetella pertussis
gccgaggcugcgcgcgcc

SEQ ID NO: 2452340 - RNA, 19 nt, Bordetella pertussis
gccgaggcugcgcgcgcca

SEQ ID NO: 2452341 - RNA, 18 nt, Bordetella pertussis
gccgaggcuucgauggcg

SEQ ID NO: 2452342 - RNA, 22 nt, Bordetella pertussis
gccgaggcuucgauggcggcgg

SEQ ID NO: 2452343 - RNA, 15 nt, Bordetella pertussis
gccgagggccgcgcg

SEQ ID NO: 2452344 - RNA, 18 nt, Bordetella pertussis
gccgaggucgcccuuggg

SEQ ID NO: 2452345 - RNA, 15 nt, Bordetella pertussis
gccgaggugcccauc

SEQ ID NO: 2452346 - RNA, 16 nt, Bordetella pertussis
gccgaggugcccauca

SEQ ID NO: 2452347 - RNA, 15 nt, Bordetella pertussis
gccgagguggaugcg

SEQ ID NO: 2452348 - RNA, 24 nt, Bordetella pertussis
gccgaggugucgcuucccgcacgg

SEQ ID NO: 2452349 - RNA, 15 nt, Bordetella pertussis
gccgaguagcggcgc

SEQ ID NO: 2452350 - RNA, 16 nt, Bordetella pertussis
gccgaguagcggcgca

SEQ ID NO: 2452351 - RNA, 18 nt, Bordetella pertussis
gccgaguccugguugccg

SEQ ID NO: 2452352 - RNA, 18 nt, Bordetella pertussis
gccgagucggcgauggcg

SEQ ID NO: 2452353 - RNA, 19 nt, Bordetella pertussis
gccgagucggcgauggcgc

SEQ ID NO: 2452354 - RNA, 15 nt, Bordetella pertussis
gccgaguggaugcgc

SEQ ID NO: 2452355 - RNA, 21 nt, Bordetella pertussis
gccgaguggaugcgcuugccg

SEQ ID NO: 2452356 - RNA, 13 nt, Bordetella pertussis
gccgaguggccgc

SEQ ID NO: 2452357 - RNA, 20 nt, Bordetella pertussis
gccgaguggcgggccauguc

SEQ ID NO: 2452358 - RNA, 18 nt, Bordetella pertussis
gccgaguuuccgcacccg

SEQ ID NO: 2452359 - RNA, 20 nt, Bordetella pertussis
gccgauacaggcgcucgcgc

SEQ ID NO: 2452360 - RNA, 18 nt, Bordetella pertussis
gccgauacgcgugcgcgg

SEQ ID NO: 2452361 - RNA, 19 nt, Bordetella pertussis
gccgauacgcgugcgcggc

SEQ ID NO: 2452362 - RNA, 15 nt, Bordetella pertussis
gccgauacgggcgcg

SEQ ID NO: 2452363 - RNA, 21 nt, Bordetella pertussis
gccgauacgggcgcggcgucg

SEQ ID NO: 2452364 - RNA, 22 nt, Bordetella pertussis
gccgauacgggcgcggcgucga

SEQ ID NO: 2452365 - RNA, 21 nt, Bordetella pertussis
gccgauacgucgcagcacgcc

SEQ ID NO: 2452366 - RNA, 22 nt, Bordetella pertussis
gccgauacgucgcagcacgccc

SEQ ID NO: 2452367 - RNA, 15 nt, Bordetella pertussis
gccgauagccgcggc

SEQ ID NO: 2452368 - RNA, 17 nt, Bordetella pertussis
gccgauagccgcggcgc

SEQ ID NO: 2452369 - RNA, 19 nt, Bordetella pertussis
gccgauagccgugaccugc

SEQ ID NO: 2452370 - RNA, 22 nt, Bordetella pertussis
gccgauagccgugaccugcucg

SEQ ID NO: 2452371 - RNA, 22 nt, Bordetella pertussis
gccgauaucguuggugcgcacc

SEQ ID NO: 2452372 - RNA, 22 nt, Bordetella pertussis
gccgaucaaccugaucguuccc

SEQ ID NO: 2452373 - RNA, 19 nt, Bordetella pertussis
gccgaucaccugcaggccc

SEQ ID NO: 2452374 - RNA, 21 nt, Bordetella pertussis
gccgaucaccugcaggcccac

SEQ ID NO: 2452375 - RNA, 15 nt, Bordetella pertussis
gccgaucagcaccac

SEQ ID NO: 2452376 - RNA, 14 nt, Bordetella pertussis
gccgaucagcaggu

SEQ ID NO: 2452377 - RNA, 20 nt, Bordetella pertussis
gccgaucagcaggucggcgc

SEQ ID NO: 2452378 - RNA, 23 nt, Bordetella pertussis
gccgaucagcaggucggcgcggc

SEQ ID NO: 2452379 - RNA, 13 nt, Bordetella pertussis
gccgaucagccgg

SEQ ID NO: 2452380 - RNA, 20 nt, Bordetella pertussis
gccgaucagccggccauggc

SEQ ID NO: 2452381 - RNA, 19 nt, Bordetella pertussis
gccgaucagcgacagcagg

SEQ ID NO: 2452382 - RNA, 14 nt, Bordetella pertussis
gccgaucagcgggc

SEQ ID NO: 2452383 - RNA, 20 nt, Bordetella pertussis
gccgaucagcgggcuggcca

SEQ ID NO: 2452384 - RNA, 17 nt, Bordetella pertussis
gccgauccacucggcca

SEQ ID NO: 2452385 - RNA, 20 nt, Bordetella pertussis
gccgauccacucggccagcg

SEQ ID NO: 2452386 - RNA, 21 nt, Bordetella pertussis
gccgauccacucggccagcgc

SEQ ID NO: 2452387 - RNA, 23 nt, Bordetella pertussis
gccgauccacucggccagcgcgc

SEQ ID NO: 2452388 - RNA, 14 nt, Bordetella pertussis
gccgauccagcgcc

SEQ ID NO: 2452389 - RNA, 17 nt, Bordetella pertussis
gccgauccagcgccugg

SEQ ID NO: 2452390 - RNA, 20 nt, Bordetella pertussis
gccgauccagggccgcagca

SEQ ID NO: 2452391 - RNA, 23 nt, Bordetella pertussis
gccgaucgagcaggccgccgggg

SEQ ID NO: 2452392 - RNA, 16 nt, Bordetella pertussis
gccgaucgcgcacagc

SEQ ID NO: 2452393 - RNA, 16 nt, Bordetella pertussis
gccgaucgcgccgucc

SEQ ID NO: 2452394 - RNA, 18 nt, Bordetella pertussis
gccgaucgcggcuccagc

SEQ ID NO: 2452395 - RNA, 18 nt, Bordetella pertussis
gccgaucggcgucuggaa

SEQ ID NO: 2452396 - RNA, 23 nt, Bordetella pertussis
gccgaucggcuugccgcgcggcg

SEQ ID NO: 2452397 - RNA, 15 nt, Bordetella pertussis
gccgaucgugcacgc

SEQ ID NO: 2452398 - RNA, 19 nt, Bordetella pertussis
gccgaucgugcacgcccgc

SEQ ID NO: 2452399 - RNA, 22 nt, Bordetella pertussis
gccgaucgugcacgcccgcggc

SEQ ID NO: 2452400 - RNA, 15 nt, Bordetella pertussis
gccgaucucacgggc

SEQ ID NO: 2452401 - RNA, 21 nt, Bordetella pertussis
gccgaucucacgggcgaagcg

SEQ ID NO: 2452402 - RNA, 13 nt, Bordetella pertussis
gccgaucugcugg

SEQ ID NO: 2452403 - RNA, 18 nt, Bordetella pertussis
gccgaucugcugggccgg

SEQ ID NO: 2452404 - RNA, 20 nt, Bordetella pertussis
gccgaucugcugggccgggu

SEQ ID NO: 2452405 - RNA, 16 nt, Bordetella pertussis
gccgaugaacgacagg

SEQ ID NO: 2452406 - RNA, 15 nt, Bordetella pertussis
gccgaugaagacgcc

SEQ ID NO: 2452407 - RNA, 17 nt, Bordetella pertussis
gccgaugacaucgccgc

SEQ ID NO: 2452408 - RNA, 20 nt, Bordetella pertussis
gccgaugacaucgccgcugc

SEQ ID NO: 2452409 - RNA, 21 nt, Bordetella pertussis
gccgaugacaucgccgcugcg

SEQ ID NO: 2452410 - RNA, 15 nt, Bordetella pertussis
gccgaugaccagcag

SEQ ID NO: 2452411 - RNA, 23 nt, Bordetella pertussis
gccgaugaccagcagcgccgggg

SEQ ID NO: 2452412 - RNA, 22 nt, Bordetella pertussis
gccgaugaccagggcgccgacc

SEQ ID NO: 2452413 - RNA, 22 nt, Bordetella pertussis
gccgaugaccggccaggcgcgg

SEQ ID NO: 2452414 - RNA, 15 nt, Bordetella pertussis
gccgaugauggccau

SEQ ID NO: 2452415 - RNA, 20 nt, Bordetella pertussis
gccgaugauggccauggcca

SEQ ID NO: 2452416 - RNA, 19 nt, Bordetella pertussis
gccgaugauggugaacgcc

SEQ ID NO: 2452417 - RNA, 23 nt, Bordetella pertussis
gccgaugauggugaacgccacca

SEQ ID NO: 2452418 - RNA, 22 nt, Bordetella pertussis
gccgaugcacagguagaucagc

SEQ ID NO: 2452419 - RNA, 12 nt, Bordetella pertussis
gccgaugccgca

SEQ ID NO: 2452420 - RNA, 14 nt, Bordetella pertussis
gccgaugccgcagu

SEQ ID NO: 2452421 - RNA, 14 nt, Bordetella pertussis
gccgaugccgccau

SEQ ID NO: 2452422 - RNA, 19 nt, Bordetella pertussis
gccgaugccgccaucaucc

SEQ ID NO: 2452423 - RNA, 23 nt, Bordetella pertussis
gccgaugccgccaucauccuggu

SEQ ID NO: 2452424 - RNA, 12 nt, Bordetella pertussis
gccgaugccgcg

SEQ ID NO: 2452425 - RNA, 14 nt, Bordetella pertussis
gccgaugccgcgca

SEQ ID NO: 2452426 - RNA, 18 nt, Bordetella pertussis
gccgaugccgcgcaccug

SEQ ID NO: 2452427 - RNA, 12 nt, Bordetella pertussis
gccgaugccgcu

SEQ ID NO: 2452428 - RNA, 14 nt, Bordetella pertussis
gccgaugcgccagg

SEQ ID NO: 2452429 - RNA, 16 nt, Bordetella pertussis
gccgaugcgccaggcu

SEQ ID NO: 2452430 - RNA, 22 nt, Bordetella pertussis
gccgaugcgcucgguccagacg

SEQ ID NO: 2452431 - RNA, 15 nt, Bordetella pertussis
gccgaugcggcgcau

SEQ ID NO: 2452432 - RNA, 19 nt, Bordetella pertussis
gccgaugcgguaggcccag

SEQ ID NO: 2452433 - RNA, 17 nt, Bordetella pertussis
gccgaugcuggucgcca

SEQ ID NO: 2452434 - RNA, 21 nt, Bordetella pertussis
gccgaugcuuagcgcagcagc

SEQ ID NO: 2452435 - RNA, 12 nt, Bordetella pertussis
gccgauggccuc

SEQ ID NO: 2452436 - RNA, 14 nt, Bordetella pertussis
gccgauggccucgc

SEQ ID NO: 2452437 - RNA, 19 nt, Bordetella pertussis
gccgauggccucgcugcca

SEQ ID NO: 2452438 - RNA, 20 nt, Bordetella pertussis
gccgauggccucgcugccag

SEQ ID NO: 2452439 - RNA, 15 nt, Bordetella pertussis
gccgauggcgccacc

SEQ ID NO: 2452440 - RNA, 17 nt, Bordetella pertussis
gccgauggcgccgcugu

SEQ ID NO: 2452441 - RNA, 23 nt, Bordetella pertussis
gccgauggcgccgcugucgcuga

SEQ ID NO: 2452442 - RNA, 13 nt, Bordetella pertussis
gccgauggcgcgc

SEQ ID NO: 2452443 - RNA, 16 nt, Bordetella pertussis
gccgauggcgcgcggc

SEQ ID NO: 2452444 - RNA, 14 nt, Bordetella pertussis
gccgauggcgcggc

SEQ ID NO: 2452445 - RNA, 15 nt, Bordetella pertussis
gccgauggcgcggcc

SEQ ID NO: 2452446 - RNA, 16 nt, Bordetella pertussis
gccgauggcgcggccg

SEQ ID NO: 2452447 - RNA, 17 nt, Bordetella pertussis
gccgauggcggugguga

SEQ ID NO: 2452448 - RNA, 14 nt, Bordetella pertussis
gccgauggcgucca

SEQ ID NO: 2452449 - RNA, 17 nt, Bordetella pertussis
gccgauggcguccagca

SEQ ID NO: 2452450 - RNA, 19 nt, Bordetella pertussis
gccgauggcguccagcagc

SEQ ID NO: 2452451 - RNA, 15 nt, Bordetella pertussis
gccgauggucagcgu

SEQ ID NO: 2452452 - RNA, 22 nt, Bordetella pertussis
gccgauguagcccauggccagg

SEQ ID NO: 2452453 - RNA, 19 nt, Bordetella pertussis
gccgaugucgaacagcugc

SEQ ID NO: 2452454 - RNA, 20 nt, Bordetella pertussis
gccgaugucgaacagcugca

SEQ ID NO: 2452455 - RNA, 21 nt, Bordetella pertussis
gccgaugucgccgccugcggc

SEQ ID NO: 2452456 - RNA, 17 nt, Bordetella pertussis
gccgaugugcggcguga

SEQ ID NO: 2452457 - RNA, 23 nt, Bordetella pertussis
gccgaugugcggcgugagcacga

SEQ ID NO: 2452458 - RNA, 19 nt, Bordetella pertussis
gccgauguuguuggccgcc

SEQ ID NO: 2452459 - RNA, 23 nt, Bordetella pertussis
gccgauguuguuggccgccagcc

SEQ ID NO: 2452460 - RNA, 13 nt, Bordetella pertussis
gccgauguuuucc

SEQ ID NO: 2452461 - RNA, 18 nt, Bordetella pertussis
gccgauuccagcgccgcc

SEQ ID NO: 2452462 - RNA, 23 nt, Bordetella pertussis
gccgauucgccguggcuggucac

SEQ ID NO: 2452463 - RNA, 16 nt, Bordetella pertussis
gccgauugaggccagc

SEQ ID NO: 2452464 - RNA, 17 nt, Bordetella pertussis
gccgauugaggccagca

SEQ ID NO: 2452465 - RNA, 18 nt, Bordetella pertussis
gccgauugaggccagcac

SEQ ID NO: 2452466 - RNA, 16 nt, Bordetella pertussis
gccgauuucgccgccg

SEQ ID NO: 2452467 - RNA, 19 nt, Bordetella pertussis
gccgauuucgccgccgcca

SEQ ID NO: 2452468 - RNA, 15 nt, Bordetella pertussis
gccgauuucgcgcgc

SEQ ID NO: 2452469 - RNA, 17 nt, Bordetella pertussis
gccgauuucgcgcgcca

SEQ ID NO: 2452470 - RNA, 18 nt, Bordetella pertussis
gccgauuucgcgcgccag

SEQ ID NO: 2452471 - RNA, 20 nt, Bordetella pertussis
gccgauuucggccgccggcg

SEQ ID NO: 2452472 - RNA, 21 nt, Bordetella pertussis
gccgauuucggccgccggcga

SEQ ID NO: 2452473 - RNA, 15 nt, Bordetella pertussis
gccgcaacaggcagc

SEQ ID NO: 2452474 - RNA, 18 nt, Bordetella pertussis
gccgcaaccagggagccg

SEQ ID NO: 2452475 - RNA, 19 nt, Bordetella pertussis
gccgcaacccacccccagc

SEQ ID NO: 2452476 - RNA, 23 nt, Bordetella pertussis
gccgcaacccacccccagcagca

SEQ ID NO: 2452477 - RNA, 22 nt, Bordetella pertussis
gccgcaaccgucgaccggcccg

SEQ ID NO: 2452478 - RNA, 15 nt, Bordetella pertussis
gccgcaacgccgccg

SEQ ID NO: 2452479 - RNA, 16 nt, Bordetella pertussis
gccgcaacgccgccgg

SEQ ID NO: 2452480 - RNA, 17 nt, Bordetella pertussis
gccgcaacgccgccggc

SEQ ID NO: 2452481 - RNA, 18 nt, Bordetella pertussis
gccgcaacgccgccggca

SEQ ID NO: 2452482 - RNA, 20 nt, Bordetella pertussis
gccgcaacgccgccggcagg

SEQ ID NO: 2452483 - RNA, 16 nt, Bordetella pertussis
gccgcaacgccgggcc

SEQ ID NO: 2452484 - RNA, 17 nt, Bordetella pertussis
gccgcaacgccgggccg

SEQ ID NO: 2452485 - RNA, 13 nt, Bordetella pertussis
gccgcaagacggc

SEQ ID NO: 2452486 - RNA, 14 nt, Bordetella pertussis
gccgcaagacggcg

SEQ ID NO: 2452487 - RNA, 14 nt, Bordetella pertussis
gccgcaagcaagcc

SEQ ID NO: 2452488 - RNA, 16 nt, Bordetella pertussis
gccgcaagcaagcccc

SEQ ID NO: 2452489 - RNA, 23 nt, Bordetella pertussis
gccgcaagcguacguaccaggcc

SEQ ID NO: 2452490 - RNA, 13 nt, Bordetella pertussis
gccgcaagcuggc

SEQ ID NO: 2452491 - RNA, 14 nt, Bordetella pertussis
gccgcaagcuggcc

SEQ ID NO: 2452492 - RNA, 15 nt, Bordetella pertussis
gccgcaagcuggccg

SEQ ID NO: 2452493 - RNA, 17 nt, Bordetella pertussis
gccgcaagcuggcggcg

SEQ ID NO: 2452494 - RNA, 21 nt, Bordetella pertussis
gccgcaagcuggcggcgcgcg

SEQ ID NO: 2452495 - RNA, 22 nt, Bordetella pertussis
gccgcaauaccuucagcccggc

SEQ ID NO: 2452496 - RNA, 15 nt, Bordetella pertussis
gccgcacagcguggc

SEQ ID NO: 2452497 - RNA, 17 nt, Bordetella pertussis
gccgcacagcguggcga

SEQ ID NO: 2452498 - RNA, 15 nt, Bordetella pertussis
gccgcacaucgucga

SEQ ID NO: 2452499 - RNA, 14 nt, Bordetella pertussis
gccgcaccagcgcc

SEQ ID NO: 2452500 - RNA, 15 nt, Bordetella pertussis
gccgcaccagcgccg

SEQ ID NO: 2452501 - RNA, 13 nt, Bordetella pertussis
gccgcaccagcgg

SEQ ID NO: 2452502 - RNA, 16 nt, Bordetella pertussis
gccgcaccaggccgcg

SEQ ID NO: 2452503 - RNA, 18 nt, Bordetella pertussis
gccgcaccaggccgcggc

SEQ ID NO: 2452504 - RNA, 19 nt, Bordetella pertussis
gccgcaccaggccgcggcg

SEQ ID NO: 2452505 - RNA, 22 nt, Bordetella pertussis
gccgcaccaggccgcggcgccc

SEQ ID NO: 2452506 - RNA, 19 nt, Bordetella pertussis
gccgcacccgaugacgggg

SEQ ID NO: 2452507 - RNA, 21 nt, Bordetella pertussis
gccgcacgaucgcgccggccu

SEQ ID NO: 2452508 - RNA, 12 nt, Bordetella pertussis
gccgcacgcccg

SEQ ID NO: 2452509 - RNA, 17 nt, Bordetella pertussis
gccgcacgcccgccugc

SEQ ID NO: 2452510 - RNA, 13 nt, Bordetella pertussis
gccgcacgccggu

SEQ ID NO: 2452511 - RNA, 18 nt, Bordetella pertussis
gccgcacgccggucgcca

SEQ ID NO: 2452512 - RNA, 20 nt, Bordetella pertussis
gccgcacgccggucgccagc

SEQ ID NO: 2452513 - RNA, 13 nt, Bordetella pertussis
gccgcacgcgcgg

SEQ ID NO: 2452514 - RNA, 18 nt, Bordetella pertussis
gccgcacgcgcggcagcg

SEQ ID NO: 2452515 - RNA, 15 nt, Bordetella pertussis
gccgccucgggcacg

SEQ ID NO: 2452516 - RNA, 18 nt, Bordetella pertussis
gccgccucgggcacggcc

SEQ ID NO: 2452517 - RNA, 19 nt, Bordetella pertussis
gccgccucgggcacggcca

SEQ ID NO: 2452518 - RNA, 20 nt, Bordetella pertussis
gccgccucgggcacggccag

SEQ ID NO: 2452519 - RNA, 15 nt, Bordetella pertussis
gccgccugaaaccuc

SEQ ID NO: 2452520 - RNA, 15 nt, Bordetella pertussis
gccgccugagcacau

SEQ ID NO: 2452521 - RNA, 23 nt, Bordetella pertussis
gccgccugcgcaauucuuccucc

SEQ ID NO: 2452522 - RNA, 17 nt, Bordetella pertussis
gccgccugcgccgaggc

SEQ ID NO: 2452523 - RNA, 18 nt, Bordetella pertussis
gccgccugcgccgucugc

SEQ ID NO: 2452524 - RNA, 17 nt, Bordetella pertussis
gccgccugcgcgaaacc

SEQ ID NO: 2452525 - RNA, 14 nt, Bordetella pertussis
gccgccugcggcgc

SEQ ID NO: 2452526 - RNA, 12 nt, Bordetella pertussis
gccgccugcugc

SEQ ID NO: 2452527 - RNA, 13 nt, Bordetella pertussis
gccgccugcugcg

SEQ ID NO: 2452528 - RNA, 17 nt, Bordetella pertussis
gccgccugcugcgccgu

SEQ ID NO: 2452529 - RNA, 13 nt, Bordetella pertussis
gccgccugcuggg

SEQ ID NO: 2452530 - RNA, 19 nt, Bordetella pertussis
gccgccugcugggccgcgc

SEQ ID NO: 2452531 - RNA, 13 nt, Bordetella pertussis
gccgccuggcccg

SEQ ID NO: 2452532 - RNA, 16 nt, Bordetella pertussis
gccgccuggcgcggcg

SEQ ID NO: 2452533 - RNA, 17 nt, Bordetella pertussis
gccgccuggcgcggcgc

SEQ ID NO: 2452534 - RNA, 18 nt, Bordetella pertussis
gccgccuggcgcggcgcc

SEQ ID NO: 2452535 - RNA, 22 nt, Bordetella pertussis
gccgccuggcgcggcgccugcg

SEQ ID NO: 2452536 - RNA, 19 nt, Bordetella pertussis
gccgccuggcuuucgccgc

SEQ ID NO: 2452537 - RNA, 21 nt, Bordetella pertussis
gccgccugguaguaaucgcgc

SEQ ID NO: 2452538 - RNA, 19 nt, Bordetella pertussis
gccgccuucaccggcccca

SEQ ID NO: 2452539 - RNA, 20 nt, Bordetella pertussis
gccgccuucaccggccccau

SEQ ID NO: 2452540 - RNA, 17 nt, Bordetella pertussis
gccgccuucccaggcga

SEQ ID NO: 2452541 - RNA, 17 nt, Bordetella pertussis
gccgccuucgagcuggu

SEQ ID NO: 2452542 - RNA, 16 nt, Bordetella pertussis
gccgccuucgucgcgc

SEQ ID NO: 2452543 - RNA, 22 nt, Bordetella pertussis
gccgccuugacgguggccgcgg

SEQ ID NO: 2452544 - RNA, 16 nt, Bordetella pertussis
gccgccuuggacgcgc

SEQ ID NO: 2452545 - RNA, 18 nt, Bordetella pertussis
gccgcgaaacguccccac

SEQ ID NO: 2452546 - RNA, 20 nt, Bordetella pertussis
gccgcgaacagauccacgcc

SEQ ID NO: 2452547 - RNA, 23 nt, Bordetella pertussis
gccgcgaacagauccacgcccgc

SEQ ID NO: 2452548 - RNA, 16 nt, Bordetella pertussis
gccgcgaacgcgccgg

SEQ ID NO: 2452549 - RNA, 17 nt, Bordetella pertussis
gccgcgaacgcgccggc

SEQ ID NO: 2452550 - RNA, 18 nt, Bordetella pertussis
gccgcgaacgcgccggcc

SEQ ID NO: 2452551 - RNA, 19 nt, Bordetella pertussis
gccgcgaacgcgccggccc

SEQ ID NO: 2452552 - RNA, 22 nt, Bordetella pertussis
gccgcgacaaauagccgaccgc

SEQ ID NO: 2452553 - RNA, 21 nt, Bordetella pertussis
gccgcgacacaaggcggccgc

SEQ ID NO: 2452554 - RNA, 18 nt, Bordetella pertussis
gccgcgacauagcgcugg

SEQ ID NO: 2452555 - RNA, 19 nt, Bordetella pertussis
gccgcgacauagcgcugga

SEQ ID NO: 2452556 - RNA, 18 nt, Bordetella pertussis
gccgcgaccaccagcacc

SEQ ID NO: 2452557 - RNA, 15 nt, Bordetella pertussis
gccgcgaccacgguc

SEQ ID NO: 2452558 - RNA, 22 nt, Bordetella pertussis
gccgcgaccacggucuggcgcg

SEQ ID NO: 2452559 - RNA, 19 nt, Bordetella pertussis
gccgcgaccgggccgaaga

SEQ ID NO: 2452560 - RNA, 20 nt, Bordetella pertussis
gccgcgacgcuacagcguca

SEQ ID NO: 2452561 - RNA, 16 nt, Bordetella pertussis
gccgcgagcaugcgca

SEQ ID NO: 2452562 - RNA, 18 nt, Bordetella pertussis
gccgcgagcaugcgcagc

SEQ ID NO: 2452563 - RNA, 19 nt, Bordetella pertussis
gccgcgagcaugcgcagcg

SEQ ID NO: 2452564 - RNA, 13 nt, Bordetella pertussis
gccgcgagcgccg

SEQ ID NO: 2452565 - RNA, 16 nt, Bordetella pertussis
gccgcgagcgccgaac

SEQ ID NO: 2452566 - RNA, 12 nt, Bordetella pertussis
gccgcgaggcgc

SEQ ID NO: 2452567 - RNA, 17 nt, Bordetella pertussis
gccgcgaggcgcaggcc

SEQ ID NO: 2452568 - RNA, 20 nt, Bordetella pertussis
gccgcgagguauuggccuug

SEQ ID NO: 2452569 - RNA, 22 nt, Bordetella pertussis
gccgcgagguauuggccuugcc

SEQ ID NO: 2452570 - RNA, 13 nt, Bordetella pertussis
gccgcgaucagcg

SEQ ID NO: 2452571 - RNA, 14 nt, Bordetella pertussis
gccgcgaucagcgc

SEQ ID NO: 2452572 - RNA, 17 nt, Bordetella pertussis
gccgcgaucagcgcggc

SEQ ID NO: 2452573 - RNA, 20 nt, Bordetella pertussis
gccgcgaucagcgcggccgc

SEQ ID NO: 2452574 - RNA, 23 nt, Bordetella pertussis
gccgcgaucagcgcggccgcuug

SEQ ID NO: 2452575 - RNA, 20 nt, Bordetella pertussis
gccgcgaucgaguggugcgc

SEQ ID NO: 2452576 - RNA, 23 nt, Bordetella pertussis
gccgcgaugcaugaaccgcagcg

SEQ ID NO: 2452577 - RNA, 13 nt, Bordetella pertussis
gccgcgauggcgc

SEQ ID NO: 2452578 - RNA, 14 nt, Bordetella pertussis
gccgcgauggcgcc

SEQ ID NO: 2452579 - RNA, 20 nt, Bordetella pertussis
gccgcgauggcgccggccag

SEQ ID NO: 2452580 - RNA, 21 nt, Bordetella pertussis
gccgcgauggcgccggccagc

SEQ ID NO: 2452581 - RNA, 22 nt, Bordetella pertussis
gccgcgauggcgccggccagcg

SEQ ID NO: 2452582 - RNA, 13 nt, Bordetella pertussis
gccgcgaugucgc

SEQ ID NO: 2452583 - RNA, 14 nt, Bordetella pertussis
gccgcgaugucgcg

SEQ ID NO: 2452584 - RNA, 18 nt, Bordetella pertussis
gccgcgaugucgcgcgcg

SEQ ID NO: 2452585 - RNA, 22 nt, Bordetella pertussis
gccgcgauugcagguggccagc

SEQ ID NO: 2452586 - RNA, 16 nt, Bordetella pertussis
gccgcgcaaggccugc

SEQ ID NO: 2452587 - RNA, 18 nt, Bordetella pertussis
gccgcgcaaggcggcccg

SEQ ID NO: 2452588 - RNA, 21 nt, Bordetella pertussis
gccgcgcaaggcggcccggcc

SEQ ID NO: 2452589 - RNA, 22 nt, Bordetella pertussis
gccgcgcaaggcggcccggccg

SEQ ID NO: 2452590 - RNA, 23 nt, Bordetella pertussis
gccgcgcaaggcggcccggccgc

SEQ ID NO: 2452591 - RNA, 18 nt, Bordetella pertussis
gccgcgcacacauggcgc

SEQ ID NO: 2452592 - RNA, 20 nt, Bordetella pertussis
gccgcgcacacauggcgcau

SEQ ID NO: 2452593 - RNA, 21 nt, Bordetella pertussis
gccgcgcacacauggcgcauc

SEQ ID NO: 2452594 - RNA, 22 nt, Bordetella pertussis
gccgcgcacacauggcgcaucu

SEQ ID NO: 2452595 - RNA, 16 nt, Bordetella pertussis
gccgcgcacagcccga

SEQ ID NO: 2452596 - RNA, 24 nt, Bordetella pertussis
gccgcgcacagcccgaucgacggc

SEQ ID NO: 2452597 - RNA, 17 nt, Bordetella pertussis
gccgcgcacccaggccc

SEQ ID NO: 2452598 - RNA, 18 nt, Bordetella pertussis
gccgcgcacccaggccca

SEQ ID NO: 2452599 - RNA, 19 nt, Bordetella pertussis
gccgcgcaccugggcgucg

SEQ ID NO: 2452600 - RNA, 17 nt, Bordetella pertussis
gccgcgcacgauggggc

SEQ ID NO: 2452601 - RNA, 18 nt, Bordetella pertussis
gccgcgcacgcacugagc

SEQ ID NO: 2452602 - RNA, 16 nt, Bordetella pertussis
gccgcgcacgggcgcc

SEQ ID NO: 2452603 - RNA, 22 nt, Bordetella pertussis
gccgcgcagaaaccgccacagc

SEQ ID NO: 2452604 - RNA, 18 nt, Bordetella pertussis
gccgcgcagcacgcccgc

SEQ ID NO: 2452605 - RNA, 19 nt, Bordetella pertussis
gccgcgcagcacgcccgcg

SEQ ID NO: 2452606 - RNA, 18 nt, Bordetella pertussis
gccgcgcagccgacaggc

SEQ ID NO: 2452607 - RNA, 22 nt, Bordetella pertussis
gccgcgcagccgacaggcgcgc

SEQ ID NO: 2452608 - RNA, 13 nt, Bordetella pertussis
gccgcgcagcguc

SEQ ID NO: 2452609 - RNA, 23 nt, Bordetella pertussis
gccgcgcagcgucugcgcaucga

SEQ ID NO: 2452610 - RNA, 16 nt, Bordetella pertussis
gccgcgcaggaugacg

SEQ ID NO: 2452611 - RNA, 14 nt, Bordetella pertussis
gccgcgcaggcccu

SEQ ID NO: 2452612 - RNA, 13 nt, Bordetella pertussis
gccgcgcagggca

SEQ ID NO: 2452613 - RNA, 14 nt, Bordetella pertussis
gccgcgcaggucgg

SEQ ID NO: 2452614 - RNA, 23 nt, Bordetella pertussis
gccgcgcaggucggcgaugcgcg

SEQ ID NO: 2452615 - RNA, 13 nt, Bordetella pertussis
gccgcgcaugcca

SEQ ID NO: 2452616 - RNA, 18 nt, Bordetella pertussis
gccgcgcauuugccgcgg

SEQ ID NO: 2452617 - RNA, 20 nt, Bordetella pertussis
gccgcgcauuugccgcggcg

SEQ ID NO: 2452618 - RNA, 17 nt, Bordetella pertussis
gccgcgccaacccggcc

SEQ ID NO: 2452619 - RNA, 14 nt, Bordetella pertussis
gccgcgccaagggc

SEQ ID NO: 2452620 - RNA, 18 nt, Bordetella pertussis
gccgcgccaagggcgugc

SEQ ID NO: 2452621 - RNA, 14 nt, Bordetella pertussis
gccgcgccagcgcc

SEQ ID NO: 2452622 - RNA, 14 nt, Bordetella pertussis
gccgcgccagcugc

SEQ ID NO: 2452623 - RNA, 20 nt, Bordetella pertussis
gccgcgccagcugcgcagcg

SEQ ID NO: 2452624 - RNA, 13 nt, Bordetella pertussis
gccgcgccaggua

SEQ ID NO: 2452625 - RNA, 21 nt, Bordetella pertussis
gccgcgccagguaggccggcg

SEQ ID NO: 2452626 - RNA, 21 nt, Bordetella pertussis
gccgcgccaucacggugucga

SEQ ID NO: 2452627 - RNA, 18 nt, Bordetella pertussis
gccgcgccaugcucgcgc

SEQ ID NO: 2452628 - RNA, 20 nt, Bordetella pertussis
gccgcgccaugcucgcgcac

SEQ ID NO: 2452629 - RNA, 17 nt, Bordetella pertussis
gcccucgcgccaccaug

SEQ ID NO: 2452630 - RNA, 13 nt, Bordetella pertussis
gcccucgcggccg

SEQ ID NO: 2452631 - RNA, 14 nt, Bordetella pertussis
gcccucgcggccgu

SEQ ID NO: 2452632 - RNA, 16 nt, Bordetella pertussis
gcccucgcugcgcguc

SEQ ID NO: 2452633 - RNA, 18 nt, Bordetella pertussis
gcccucgggcgacaggcg

SEQ ID NO: 2452634 - RNA, 19 nt, Bordetella pertussis
gcccucgggcgacaggcgc

SEQ ID NO: 2452635 - RNA, 23 nt, Bordetella pertussis
gcccucgggcgacaggcgcgccc

SEQ ID NO: 2452636 - RNA, 12 nt, Bordetella pertussis
gcccucggucag

SEQ ID NO: 2452637 - RNA, 16 nt, Bordetella pertussis
gcccucggucagcgcc

SEQ ID NO: 2452638 - RNA, 18 nt, Bordetella pertussis
gcccucggucagcgccag

SEQ ID NO: 2452639 - RNA, 20 nt, Bordetella pertussis
gcccucggucagcgccaggg

SEQ ID NO: 2452640 - RNA, 23 nt, Bordetella pertussis
gcccucggucagcgccagggugc

SEQ ID NO: 2452641 - RNA, 22 nt, Bordetella pertussis
gcccucggucgucagcacgccc

SEQ ID NO: 2452642 - RNA, 13 nt, Bordetella pertussis
gcccucggugcgg

SEQ ID NO: 2452643 - RNA, 16 nt, Bordetella pertussis
gcccucgucgcggccg

SEQ ID NO: 2452644 - RNA, 18 nt, Bordetella pertussis
gcccucguugacgccgac

SEQ ID NO: 2452645 - RNA, 19 nt, Bordetella pertussis
gcccucguugacgccgacg

SEQ ID NO: 2452646 - RNA, 20 nt, Bordetella pertussis
gcccucguugacgccgacga

SEQ ID NO: 2452647 - RNA, 17 nt, Bordetella pertussis
gcccucuucggcggcca

SEQ ID NO: 2452648 - RNA, 18 nt, Bordetella pertussis
gcccucuucggcggccag

SEQ ID NO: 2452649 - RNA, 19 nt, Bordetella pertussis
gcccucuucggcggccagc

SEQ ID NO: 2452650 - RNA, 21 nt, Bordetella pertussis
gcccucuucggcggccagccg

SEQ ID NO: 2452651 - RNA, 23 nt, Bordetella pertussis
gcccucuucggcggccagccggc

SEQ ID NO: 2452652 - RNA, 17 nt, Bordetella pertussis
gcccugaacuauggcgc

SEQ ID NO: 2452653 - RNA, 13 nt, Bordetella pertussis
gcccugacccgcu

SEQ ID NO: 2452654 - RNA, 14 nt, Bordetella pertussis
gcccugacccgcug

SEQ ID NO: 2452655 - RNA, 22 nt, Bordetella pertussis
gcccugacccgcuggcuggcag

SEQ ID NO: 2452656 - RNA, 14 nt, Bordetella pertussis
gcccugacgccugc

SEQ ID NO: 2452657 - RNA, 20 nt, Bordetella pertussis
gcccugcaccgucacgcgcu

SEQ ID NO: 2452658 - RNA, 13 nt, Bordetella pertussis
gcccugcacgcgc

SEQ ID NO: 2452659 - RNA, 13 nt, Bordetella pertussis
gcccugcagcggc

SEQ ID NO: 2452660 - RNA, 14 nt, Bordetella pertussis
gcccugcagcggcc

SEQ ID NO: 2452661 - RNA, 16 nt, Bordetella pertussis
gcccugcagcggccag

SEQ ID NO: 2452662 - RNA, 20 nt, Bordetella pertussis
gcccugcagcggccagucca

SEQ ID NO: 2452663 - RNA, 22 nt, Bordetella pertussis
gcccugcagcggccaguccacc

SEQ ID NO: 2452664 - RNA, 22 nt, Bordetella pertussis
gcccugcaggaacucgcacacg

SEQ ID NO: 2452665 - RNA, 23 nt, Bordetella pertussis
gcccugcagggcaugggcccggg

SEQ ID NO: 2452666 - RNA, 16 nt, Bordetella pertussis
gcccugcccgcaccau

SEQ ID NO: 2452667 - RNA, 20 nt, Bordetella pertussis
gcccugcccgcaccaugccg

SEQ ID NO: 2452668 - RNA, 21 nt, Bordetella pertussis
gcccugcccgcaccaugccga

SEQ ID NO: 2452669 - RNA, 17 nt, Bordetella pertussis
gcccugcccggcgagca

SEQ ID NO: 2452670 - RNA, 14 nt, Bordetella pertussis
gcccugccgccaag

SEQ ID NO: 2452671 - RNA, 21 nt, Bordetella pertussis
gcccugccgccaagggcgcgc

SEQ ID NO: 2452672 - RNA, 22 nt, Bordetella pertussis
gcccugccgccaagggcgcgcc

SEQ ID NO: 2452673 - RNA, 20 nt, Bordetella pertussis
gcccugccgcccuggcgcag

SEQ ID NO: 2452674 - RNA, 16 nt, Bordetella pertussis
gcccugccgccucagc

SEQ ID NO: 2452675 - RNA, 14 nt, Bordetella pertussis
gcccugcgaacccg

SEQ ID NO: 2452676 - RNA, 18 nt, Bordetella pertussis
gcccugcgaacccgccgc

SEQ ID NO: 2452677 - RNA, 20 nt, Bordetella pertussis
gcccugcgaacccgccgcga

SEQ ID NO: 2452678 - RNA, 13 nt, Bordetella pertussis
gcccugcgccagc

SEQ ID NO: 2452679 - RNA, 15 nt, Bordetella pertussis
gcccugcgccagcgc

SEQ ID NO: 2452680 - RNA, 20 nt, Bordetella pertussis
gcccugcgccagcgccucgc

SEQ ID NO: 2452681 - RNA, 17 nt, Bordetella pertussis
gcccugcgcguacgugg

SEQ ID NO: 2452682 - RNA, 20 nt, Bordetella pertussis
gcccugcgcguacguggcgc

SEQ ID NO: 2452683 - RNA, 17 nt, Bordetella pertussis
gcccugcggcgcggcca

SEQ ID NO: 2452684 - RNA, 18 nt, Bordetella pertussis
gcccugcggcgcggccag

SEQ ID NO: 2452685 - RNA, 19 nt, Bordetella pertussis
gcccugcggcgcggccagc

SEQ ID NO: 2452686 - RNA, 20 nt, Bordetella pertussis
gcccugcggcgcggccagca

SEQ ID NO: 2452687 - RNA, 21 nt, Bordetella pertussis
gcccugcgugugccugucccc

SEQ ID NO: 2452688 - RNA, 20 nt, Bordetella pertussis
gcccugcucgaucugguugg

SEQ ID NO: 2452689 - RNA, 17 nt, Bordetella pertussis
gcccugcucgcgcagcg

SEQ ID NO: 2452690 - RNA, 13 nt, Bordetella pertussis
gcccugcugcccg

SEQ ID NO: 2452691 - RNA, 22 nt, Bordetella pertussis
gcccugcugcugcagccacugg

SEQ ID NO: 2452692 - RNA, 13 nt, Bordetella pertussis
gcccugcuggcgc

SEQ ID NO: 2452693 - RNA, 15 nt, Bordetella pertussis
gcccugcuggcgcag

SEQ ID NO: 2452694 - RNA, 18 nt, Bordetella pertussis
gcccugcugggguggagc

SEQ ID NO: 2452695 - RNA, 20 nt, Bordetella pertussis
gcccuggacgucugagcgcc

SEQ ID NO: 2452696 - RNA, 20 nt, Bordetella pertussis
gcccuggagaucgccgccga

SEQ ID NO: 2452697 - RNA, 21 nt, Bordetella pertussis
gcccuggauggcggccgccag

SEQ ID NO: 2452698 - RNA, 22 nt, Bordetella pertussis
gcccuggauggcggccgccagc

SEQ ID NO: 2452699 - RNA, 23 nt, Bordetella pertussis
gcccuggauggcggccgccagcg

SEQ ID NO: 2452700 - RNA, 14 nt, Bordetella pertussis
gcccuggcagacgu

SEQ ID NO: 2452701 - RNA, 14 nt, Bordetella pertussis
gcccuggcagcugg

SEQ ID NO: 2452702 - RNA, 15 nt, Bordetella pertussis
gcccuggcagcuggc

SEQ ID NO: 2452703 - RNA, 16 nt, Bordetella pertussis
gcccuggcagcuggcg

SEQ ID NO: 2452704 - RNA, 17 nt, Bordetella pertussis
gcccuggcagcuggcgc

SEQ ID NO: 2452705 - RNA, 18 nt, Bordetella pertussis
gcccuggcagcuggcgcg

SEQ ID NO: 2452706 - RNA, 19 nt, Bordetella pertussis
gcccuggcaugugccaccg

SEQ ID NO: 2452707 - RNA, 21 nt, Bordetella pertussis
gcccuggcaugugccaccgcc

SEQ ID NO: 2452708 - RNA, 22 nt, Bordetella pertussis
gcccuggcaugugccaccgccc

SEQ ID NO: 2452709 - RNA, 18 nt, Bordetella pertussis
gcccuggccacgcugcug

SEQ ID NO: 2452710 - RNA, 21 nt, Bordetella pertussis
gcccuggccacgcugcugccg

SEQ ID NO: 2452711 - RNA, 14 nt, Bordetella pertussis
gcccuggcccagcg

SEQ ID NO: 2452712 - RNA, 16 nt, Bordetella pertussis
gcccuggcccaggccg

SEQ ID NO: 2452713 - RNA, 17 nt, Bordetella pertussis
gcccuggcccaggccga

SEQ ID NO: 2452714 - RNA, 16 nt, Bordetella pertussis
gcccuggccgcgccgu

SEQ ID NO: 2452715 - RNA, 22 nt, Bordetella pertussis
gcccuggccuucgaccugcccg

SEQ ID NO: 2452716 - RNA, 14 nt, Bordetella pertussis
gcccuggcgcaggc

SEQ ID NO: 2452717 - RNA, 18 nt, Bordetella pertussis
gcccuggcgcaggccggc

SEQ ID NO: 2452718 - RNA, 22 nt, Bordetella pertussis
gcccuggcgcaggccggcggcc

SEQ ID NO: 2452719 - RNA, 23 nt, Bordetella pertussis
gcccuggcgcaggccggcggcca

SEQ ID NO: 2452720 - RNA, 15 nt, Bordetella pertussis
gcccuggcgcagggc

SEQ ID NO: 2452721 - RNA, 16 nt, Bordetella pertussis
gcccuggcgcagggca

SEQ ID NO: 2452722 - RNA, 19 nt, Bordetella pertussis
gcccuggcgcagggcauac

SEQ ID NO: 2452723 - RNA, 16 nt, Bordetella pertussis
gcccuggcgccgcggc

SEQ ID NO: 2452724 - RNA, 18 nt, Bordetella pertussis
gcccuggcgccgcggccg

SEQ ID NO: 2452725 - RNA, 17 nt, Bordetella pertussis
gcccuggcgcggcggcg

SEQ ID NO: 2452726 - RNA, 14 nt, Bordetella pertussis
gcccuggcgcugca

SEQ ID NO: 2452727 - RNA, 18 nt, Bordetella pertussis
gcccuggcgcugcagcgu

SEQ ID NO: 2452728 - RNA, 13 nt, Bordetella pertussis
gcccuggcgcugu

SEQ ID NO: 2452729 - RNA, 14 nt, Bordetella pertussis
gcccuggcgcuguu

SEQ ID NO: 2452730 - RNA, 12 nt, Bordetella pertussis
gcccuggcggcg

SEQ ID NO: 2452731 - RNA, 13 nt, Bordetella pertussis
gcccuggcggcgc

SEQ ID NO: 2452732 - RNA, 15 nt, Bordetella pertussis
gcccuggcggcgcag

SEQ ID NO: 2452733 - RNA, 20 nt, Bordetella pertussis
gcccuggcggcgcaguucgg

SEQ ID NO: 2452734 - RNA, 15 nt, Bordetella pertussis
gcccuggcgggccgg

SEQ ID NO: 2452735 - RNA, 23 nt, Bordetella pertussis
gcccuggcggucuuucaccgaca

SEQ ID NO: 2452736 - RNA, 21 nt, Bordetella pertussis
gcccuggcguggcgcgcgccg

SEQ ID NO: 2452737 - RNA, 23 nt, Bordetella pertussis
gcccuggcguggcgcgcgccgau

SEQ ID NO: 2452738 - RNA, 14 nt, Bordetella pertussis
gcccuggcuggcca

SEQ ID NO: 2452739 - RNA, 15 nt, Bordetella pertussis
gcccuggcuggccag

SEQ ID NO: 2452740 - RNA, 19 nt, Bordetella pertussis
gcccuggcuggccagccgg

SEQ ID NO: 2452741 - RNA, 20 nt, Bordetella pertussis
gcccuggcuggccagccggc

SEQ ID NO: 2452742 - RNA, 21 nt, Bordetella pertussis
gcccuggcuggccagccggcc

SEQ ID NO: 2452743 - RNA, 16 nt, Bordetella pertussis
gccgcacgcggccgcg

SEQ ID NO: 2452744 - RNA, 15 nt, Bordetella pertussis
gccgcacgggcgccu

SEQ ID NO: 2452745 - RNA, 19 nt, Bordetella pertussis
gccgcacgggcgccugucc

SEQ ID NO: 2452746 - RNA, 14 nt, Bordetella pertussis
gccgcacgguggcg

SEQ ID NO: 2452747 - RNA, 16 nt, Bordetella pertussis
gccgcacgguggcgcc

SEQ ID NO: 2452748 - RNA, 21 nt, Bordetella pertussis
gccgcacgguggcgccgucgc

SEQ ID NO: 2452749 - RNA, 13 nt, Bordetella pertussis
gccgcacgucggu

SEQ ID NO: 2452750 - RNA, 22 nt, Bordetella pertussis
gccgcacuccguaaagaugcgc

SEQ ID NO: 2452751 - RNA, 23 nt, Bordetella pertussis
gccgcacugggugacgcuggagc

SEQ ID NO: 2452752 - RNA, 24 nt, Bordetella pertussis
gccgcacugggugacgcuggagcg

SEQ ID NO: 2452753 - RNA, 20 nt, Bordetella pertussis
gccgcacuucgggccacccg

SEQ ID NO: 2452754 - RNA, 16 nt, Bordetella pertussis
gccgcagaacagcagc

SEQ ID NO: 2452755 - RNA, 12 nt, Bordetella pertussis
gccgcagauggc

SEQ ID NO: 2452756 - RNA, 15 nt, Bordetella pertussis
gccgcagauggccag

SEQ ID NO: 2452757 - RNA, 16 nt, Bordetella pertussis
gccgcagauggccagc

SEQ ID NO: 2452758 - RNA, 19 nt, Bordetella pertussis
gccgcagauggccagcagc

SEQ ID NO: 2452759 - RNA, 20 nt, Bordetella pertussis
gccgcagauggccagcagcg

SEQ ID NO: 2452760 - RNA, 14 nt, Bordetella pertussis
gccgcagauggcgu

SEQ ID NO: 2452761 - RNA, 22 nt, Bordetella pertussis
gccgcagauggcguaggcggcc

SEQ ID NO: 2452762 - RNA, 20 nt, Bordetella pertussis
gccgcagcaauugccccagc

SEQ ID NO: 2452763 - RNA, 14 nt, Bordetella pertussis
gccgcagcaccaca

SEQ ID NO: 2452764 - RNA, 22 nt, Bordetella pertussis
gccgcagcaccacaucgccggc

SEQ ID NO: 2452765 - RNA, 23 nt, Bordetella pertussis
gccgcagcaccacaucgccggcg

SEQ ID NO: 2452766 - RNA, 13 nt, Bordetella pertussis
gccgcagcaccuc

SEQ ID NO: 2452767 - RNA, 14 nt, Bordetella pertussis
gccgcagcaggcgc

SEQ ID NO: 2452768 - RNA, 15 nt, Bordetella pertussis
gccgcagcaggcgcu

SEQ ID NO: 2452769 - RNA, 23 nt, Bordetella pertussis
gccgcagcaggcgcucggccagc

SEQ ID NO: 2452770 - RNA, 24 nt, Bordetella pertussis
gccgcagcaguucggucagcgcgg

SEQ ID NO: 2452771 - RNA, 14 nt, Bordetella pertussis
gccgcagcauggcg

SEQ ID NO: 2452772 - RNA, 15 nt, Bordetella pertussis
gccgcagcauggcgc

SEQ ID NO: 2452773 - RNA, 18 nt, Bordetella pertussis
gccgcagcauggcgccag

SEQ ID NO: 2452774 - RNA, 19 nt, Bordetella pertussis
gccgcagcauggcgccagc

SEQ ID NO: 2452775 - RNA, 20 nt, Bordetella pertussis
gccgcagcauggcgccagcu

SEQ ID NO: 2452776 - RNA, 12 nt, Bordetella pertussis
gccgcagcccgc

SEQ ID NO: 2452777 - RNA, 14 nt, Bordetella pertussis
gccgcagcccgcgc

SEQ ID NO: 2452778 - RNA, 18 nt, Bordetella pertussis
gccgcagcccgcgcgccu

SEQ ID NO: 2452779 - RNA, 19 nt, Bordetella pertussis
gccgcagcccgcgcgccug

SEQ ID NO: 2452780 - RNA, 16 nt, Bordetella pertussis
gccgcagccgccagcg

SEQ ID NO: 2452781 - RNA, 17 nt, Bordetella pertussis
gccgcagccgccagcgc

SEQ ID NO: 2452782 - RNA, 16 nt, Bordetella pertussis
gccgcagccggcugca

SEQ ID NO: 2452783 - RNA, 17 nt, Bordetella pertussis
gccgcagccgucgcgcu

SEQ ID NO: 2452784 - RNA, 14 nt, Bordetella pertussis
gccgcagcggcagc

SEQ ID NO: 2452785 - RNA, 15 nt, Bordetella pertussis
gccgcagcggcagcg

SEQ ID NO: 2452786 - RNA, 15 nt, Bordetella pertussis
gccgcagcggccaug

SEQ ID NO: 2452787 - RNA, 13 nt, Bordetella pertussis
gccgcagcgggcc

SEQ ID NO: 2452788 - RNA, 14 nt, Bordetella pertussis
gccgcagcgggccc

SEQ ID NO: 2452789 - RNA, 17 nt, Bordetella pertussis
gccgcagcgggcccguc

SEQ ID NO: 2452790 - RNA, 16 nt, Bordetella pertussis
gccgcagcggggacag

SEQ ID NO: 2452791 - RNA, 17 nt, Bordetella pertussis
gccgcagcgucgcggcg

SEQ ID NO: 2452792 - RNA, 20 nt, Bordetella pertussis
gccgcagcgucgcggcgucg

SEQ ID NO: 2452793 - RNA, 17 nt, Bordetella pertussis
gccgcaggagucgcucc

SEQ ID NO: 2452794 - RNA, 20 nt, Bordetella pertussis
gccgcaggagucgcuccccg

SEQ ID NO: 2452795 - RNA, 15 nt, Bordetella pertussis
gccgcaggccagccc

SEQ ID NO: 2452796 - RNA, 22 nt, Bordetella pertussis
gccgcaggccagcccgcgcgcg

SEQ ID NO: 2452797 - RNA, 14 nt, Bordetella pertussis
gccgcagggcgugc

SEQ ID NO: 2452798 - RNA, 17 nt, Bordetella pertussis
gccgcagguccaggccu

SEQ ID NO: 2452799 - RNA, 20 nt, Bordetella pertussis
gccgcagguccaggccuggg

SEQ ID NO: 2452800 - RNA, 17 nt, Bordetella pertussis
gccgcaguauuccugcu

SEQ ID NO: 2452801 - RNA, 18 nt, Bordetella pertussis
gccgcaguauuccugcug

SEQ ID NO: 2452802 - RNA, 20 nt, Bordetella pertussis
gccgcaguauuccugcuggu

SEQ ID NO: 2452803 - RNA, 15 nt, Bordetella pertussis
gccgcagugcgcgcg

SEQ ID NO: 2452804 - RNA, 17 nt, Bordetella pertussis
gccgcagugcgcgcgcc

SEQ ID NO: 2452805 - RNA, 15 nt, Bordetella pertussis
gccgcaguuccaggc

SEQ ID NO: 2452806 - RNA, 20 nt, Bordetella pertussis
gccgcaguugaacacgcggu

SEQ ID NO: 2452807 - RNA, 18 nt, Bordetella pertussis
gccgcauaccuuggcgcc

SEQ ID NO: 2452808 - RNA, 21 nt, Bordetella pertussis
gccgcaucauguaaggcgcau

SEQ ID NO: 2452809 - RNA, 13 nt, Bordetella pertussis
gccgcaugccggc

SEQ ID NO: 2452810 - RNA, 14 nt, Bordetella pertussis
gccgcaugccgggc

SEQ ID NO: 2452811 - RNA, 18 nt, Bordetella pertussis
gccgcaugccgggcugca

SEQ ID NO: 2452812 - RNA, 15 nt, Bordetella pertussis
gccgcaugcggcggc

SEQ ID NO: 2452813 - RNA, 13 nt, Bordetella pertussis
gccgcauggcggc

SEQ ID NO: 2452814 - RNA, 15 nt, Bordetella pertussis
gccgcauggcggccc

SEQ ID NO: 2452815 - RNA, 17 nt, Bordetella pertussis
gccgcaugggcgcgccc

SEQ ID NO: 2452816 - RNA, 20 nt, Bordetella pertussis
gccgcauugggacgcggccu

SEQ ID NO: 2452817 - RNA, 18 nt, Bordetella pertussis
gccgcauuuccucgacca

SEQ ID NO: 2452818 - RNA, 22 nt, Bordetella pertussis
gccgcauuucguaaagccgcac

SEQ ID NO: 2452819 - RNA, 24 nt, Bordetella pertussis
gccgcauuucguaaagccgcacgc

SEQ ID NO: 2452820 - RNA, 23 nt, Bordetella pertussis
gccgccaacgccaagcugcuggc

SEQ ID NO: 2452821 - RNA, 16 nt, Bordetella pertussis
gccgccaacgcggcgc

SEQ ID NO: 2452822 - RNA, 17 nt, Bordetella pertussis
gccgccaacgcggcgcg

SEQ ID NO: 2452823 - RNA, 18 nt, Bordetella pertussis
gccgccaacgcggcgcgu

SEQ ID NO: 2452824 - RNA, 15 nt, Bordetella pertussis
gccgccaagggcgcg

SEQ ID NO: 2452825 - RNA, 16 nt, Bordetella pertussis
gccgccaagggcgcgc

SEQ ID NO: 2452826 - RNA, 22 nt, Bordetella pertussis
gccgccaagggcgcgccagcac

SEQ ID NO: 2452827 - RNA, 12 nt, Bordetella pertussis
gccgccacacga

SEQ ID NO: 2452828 - RNA, 18 nt, Bordetella pertussis
gccgccacacgaggaccg

SEQ ID NO: 2452829 - RNA, 20 nt, Bordetella pertussis
gccgccacacgaggaccgcg

SEQ ID NO: 2452830 - RNA, 17 nt, Bordetella pertussis
gccgccacaggcugacg

SEQ ID NO: 2452831 - RNA, 18 nt, Bordetella pertussis
gccgccacaggcugacgc

SEQ ID NO: 2452832 - RNA, 18 nt, Bordetella pertussis
gccgccaccaccucggcc

SEQ ID NO: 2452833 - RNA, 20 nt, Bordetella pertussis
gccgccaccaccucggccuc

SEQ ID NO: 2452834 - RNA, 16 nt, Bordetella pertussis
gccgccaccagcgcgu

SEQ ID NO: 2452835 - RNA, 16 nt, Bordetella pertussis
gccgccaccagcggcg

SEQ ID NO: 2452836 - RNA, 16 nt, Bordetella pertussis
gccgccaccagggcgc

SEQ ID NO: 2452837 - RNA, 14 nt, Bordetella pertussis
gccgccacccaggc

SEQ ID NO: 2452838 - RNA, 19 nt, Bordetella pertussis
gccgccacccaggcggcag

SEQ ID NO: 2452839 - RNA, 14 nt, Bordetella pertussis
gccgccaccucggc

SEQ ID NO: 2452840 - RNA, 18 nt, Bordetella pertussis
gccgccaccucggcgucg

SEQ ID NO: 2452841 - RNA, 19 nt, Bordetella pertussis
gccgccaccucggcgucgc

SEQ ID NO: 2452842 - RNA, 14 nt, Bordetella pertussis
gccgccaccugggc

SEQ ID NO: 2452843 - RNA, 19 nt, Bordetella pertussis
gccgccacgcccuggcagc

SEQ ID NO: 2452844 - RNA, 20 nt, Bordetella pertussis
gccgccacgcgcacggccag

SEQ ID NO: 2452845 - RNA, 14 nt, Bordetella pertussis
gccgccacgcuggc

SEQ ID NO: 2452846 - RNA, 15 nt, Bordetella pertussis
gccgccacgcuggcc

SEQ ID NO: 2452847 - RNA, 17 nt, Bordetella pertussis
gccgccacgcuggccgc

SEQ ID NO: 2452848 - RNA, 21 nt, Bordetella pertussis
gccgccacgggcccgcgcaga

SEQ ID NO: 2452849 - RNA, 13 nt, Bordetella pertussis
gccgccacgugca

SEQ ID NO: 2452850 - RNA, 22 nt, Bordetella pertussis
gccgccacuugcggcaggugcg

SEQ ID NO: 2452851 - RNA, 14 nt, Bordetella pertussis
gccgccagcaccug

SEQ ID NO: 2452852 - RNA, 15 nt, Bordetella pertussis
gccgccagcaccugc

SEQ ID NO: 2452853 - RNA, 13 nt, Bordetella pertussis
gccgccagcacgc

SEQ ID NO: 2452854 - RNA, 14 nt, Bordetella pertussis
gccgccagcacgcc

SEQ ID NO: 2452855 - RNA, 15 nt, Bordetella pertussis
gccgccagcagcgcc

SEQ ID NO: 2452856 - RNA, 17 nt, Bordetella pertussis
gccgccagcagcgccgg

SEQ ID NO: 2452857 - RNA, 19 nt, Bordetella pertussis
gccgccagcauggcggcca

SEQ ID NO: 2452858 - RNA, 20 nt, Bordetella pertussis
gccgccagcauggcggccag

SEQ ID NO: 2452859 - RNA, 16 nt, Bordetella pertussis
gccgccagcauggcgu

SEQ ID NO: 2452860 - RNA, 13 nt, Bordetella pertussis
gccgccagcccga

SEQ ID NO: 2452861 - RNA, 15 nt, Bordetella pertussis
gccgccagccgcugg

SEQ ID NO: 2452862 - RNA, 18 nt, Bordetella pertussis
gccgccagccgcuggcgc

SEQ ID NO: 2452863 - RNA, 22 nt, Bordetella pertussis
gccgccagccgcuggcgcgccg

SEQ ID NO: 2452864 - RNA, 15 nt, Bordetella pertussis
gccgccagccggccc

SEQ ID NO: 2452865 - RNA, 19 nt, Bordetella pertussis
gccgccagccggcccagca

SEQ ID NO: 2452866 - RNA, 16 nt, Bordetella pertussis
gccgccagccggcccg

SEQ ID NO: 2452867 - RNA, 13 nt, Bordetella pertussis
gccgccagccugc

SEQ ID NO: 2452868 - RNA, 13 nt, Bordetella pertussis
gccgccagcgcca

SEQ ID NO: 2452869 - RNA, 16 nt, Bordetella pertussis
gccgccagcgccauga

SEQ ID NO: 2452870 - RNA, 23 nt, Bordetella pertussis
gccgccagcgccaugaugucgcg

SEQ ID NO: 2452871 - RNA, 16 nt, Bordetella pertussis
gccgccagcgccugga

SEQ ID NO: 2452872 - RNA, 20 nt, Bordetella pertussis
gccgccagcgccuggaccug

SEQ ID NO: 2452873 - RNA, 14 nt, Bordetella pertussis
gccgccagcgcgcc

SEQ ID NO: 2452874 - RNA, 15 nt, Bordetella pertussis
gccgccagcggcugg

SEQ ID NO: 2452875 - RNA, 17 nt, Bordetella pertussis
gccgccagcggcuggcg

SEQ ID NO: 2452876 - RNA, 20 nt, Bordetella pertussis
gccgccagcggcuggcgccg

SEQ ID NO: 2452877 - RNA, 19 nt, Bordetella pertussis
gccgccagcguaucgccgc

SEQ ID NO: 2452878 - RNA, 13 nt, Bordetella pertussis
gccgccagcuugg

SEQ ID NO: 2452879 - RNA, 19 nt, Bordetella pertussis
gccgccagcuuggugcuca

SEQ ID NO: 2452880 - RNA, 13 nt, Bordetella pertussis
gccgccaggccgu

SEQ ID NO: 2452881 - RNA, 21 nt, Bordetella pertussis
gccgccaggccgucgagcacg

SEQ ID NO: 2452882 - RNA, 20 nt, Bordetella pertussis
gccgccagggcggcugccga

SEQ ID NO: 2452883 - RNA, 13 nt, Bordetella pertussis
gccgccagguagc

SEQ ID NO: 2452884 - RNA, 22 nt, Bordetella pertussis
gccgccaggucggccaccgccg

SEQ ID NO: 2452885 - RNA, 16 nt, Bordetella pertussis
gccgccauagcugcgc

SEQ ID NO: 2452886 - RNA, 20 nt, Bordetella pertussis
gccgccauagcugcgccaau

SEQ ID NO: 2452887 - RNA, 18 nt, Bordetella pertussis
gccgccauaggcgcgcac

SEQ ID NO: 2452888 - RNA, 22 nt, Bordetella pertussis
gccgccauaggcgcgcaccagc

SEQ ID NO: 2452889 - RNA, 23 nt, Bordetella pertussis
gccgccauaggcgcgcaccagcc

SEQ ID NO: 2452890 - RNA, 18 nt, Bordetella pertussis
gccgccaucauggcgucg

SEQ ID NO: 2452891 - RNA, 22 nt, Bordetella pertussis
gccgccaucauggcgucggcca

SEQ ID NO: 2452892 - RNA, 22 nt, Bordetella pertussis
gccgccaucgucguagcgccag

SEQ ID NO: 2452893 - RNA, 15 nt, Bordetella pertussis
gccgccaugcagcug

SEQ ID NO: 2452894 - RNA, 17 nt, Bordetella pertussis
gccgccaugcagcugga

SEQ ID NO: 2452895 - RNA, 16 nt, Bordetella pertussis
gccgccaugcgccagc

SEQ ID NO: 2452896 - RNA, 13 nt, Bordetella pertussis
gccgccauggcgc

SEQ ID NO: 2452897 - RNA, 17 nt, Bordetella pertussis
gccgccauggcgcuggc

SEQ ID NO: 2452898 - RNA, 16 nt, Bordetella pertussis
gccgccauggcggcgc

SEQ ID NO: 2452899 - RNA, 18 nt, Bordetella pertussis
gccgccauggcggcgccc

SEQ ID NO: 2452900 - RNA, 20 nt, Bordetella pertussis
gccgccauggcggcgcccau

SEQ ID NO: 2452901 - RNA, 20 nt, Bordetella pertussis
gccgccauggucgcgaccac

SEQ ID NO: 2452902 - RNA, 22 nt, Bordetella pertussis
gccgccauggucgcgaccaccg

SEQ ID NO: 2452903 - RNA, 19 nt, Bordetella pertussis
gccgccauggugccgcgca

SEQ ID NO: 2452904 - RNA, 23 nt, Bordetella pertussis
gccgccauggugccgcgcaggcc

SEQ ID NO: 2452905 - RNA, 22 nt, Bordetella pertussis
gccgccauguauaacguggcgc

SEQ ID NO: 2452906 - RNA, 14 nt, Bordetella pertussis
gccgcccaccacca

SEQ ID NO: 2452907 - RNA, 16 nt, Bordetella pertussis
gccgcccaccaccagc

SEQ ID NO: 2452908 - RNA, 20 nt, Bordetella pertussis
gccgcccaccaccagcgcgg

SEQ ID NO: 2452909 - RNA, 15 nt, Bordetella pertussis
gccgcccaccgugac

SEQ ID NO: 2452910 - RNA, 19 nt, Bordetella pertussis
gccgcccaccgugaccagc

SEQ ID NO: 2452911 - RNA, 20 nt, Bordetella pertussis
gccgcccaccgugaccagcg

SEQ ID NO: 2452912 - RNA, 17 nt, Bordetella pertussis
gccgcccacgaucacca

SEQ ID NO: 2452913 - RNA, 12 nt, Bordetella pertussis
gccgcccacgcc

SEQ ID NO: 2452914 - RNA, 13 nt, Bordetella pertussis
gccgcccacgcca

SEQ ID NO: 2452915 - RNA, 17 nt, Bordetella pertussis
gccgcccacgccaugga

SEQ ID NO: 2452916 - RNA, 13 nt, Bordetella pertussis
gccgcccacgccg

SEQ ID NO: 2452917 - RNA, 18 nt, Bordetella pertussis
gccgcccacgccgccugg

SEQ ID NO: 2452918 - RNA, 19 nt, Bordetella pertussis
gccgcccacgccgccuggc

SEQ ID NO: 2452919 - RNA, 17 nt, Bordetella pertussis
gccgcccacgccgcugu

SEQ ID NO: 2452920 - RNA, 12 nt, Bordetella pertussis
gccgcccacggc

SEQ ID NO: 2452921 - RNA, 14 nt, Bordetella pertussis
gccgcccacggcga

SEQ ID NO: 2452922 - RNA, 16 nt, Bordetella pertussis
gccgcccacggcgacu

SEQ ID NO: 2452923 - RNA, 17 nt, Bordetella pertussis
gccgcccacgggcgccu

SEQ ID NO: 2452924 - RNA, 20 nt, Bordetella pertussis
gccgcccacgggcgccuggu

SEQ ID NO: 2452925 - RNA, 11 nt, Bordetella pertussis
gccgcccagca

SEQ ID NO: 2452926 - RNA, 12 nt, Bordetella pertussis
gccgcccagcau

SEQ ID NO: 2452927 - RNA, 18 nt, Bordetella pertussis
gccgcccagcaugcgcgc

SEQ ID NO: 2452928 - RNA, 19 nt, Bordetella pertussis
gccgcccagcaugcgcgcg

SEQ ID NO: 2452929 - RNA, 11 nt, Bordetella pertussis
gccgcccagcc

SEQ ID NO: 2452930 - RNA, 18 nt, Bordetella pertussis
gccgcccagccgcgccag

SEQ ID NO: 2452931 - RNA, 13 nt, Bordetella pertussis
gccgcccagccgg

SEQ ID NO: 2452932 - RNA, 14 nt, Bordetella pertussis
gccgcccagcgcau

SEQ ID NO: 2452933 - RNA, 18 nt, Bordetella pertussis
gccgcccagcgccugcaa

SEQ ID NO: 2452934 - RNA, 13 nt, Bordetella pertussis
gccgcccagcgcg

SEQ ID NO: 2452935 - RNA, 15 nt, Bordetella pertussis
gccgcccagcgcgug

SEQ ID NO: 2452936 - RNA, 19 nt, Bordetella pertussis
gccgcccagcgcgugggcc

SEQ ID NO: 2452937 - RNA, 22 nt, Bordetella pertussis
gccgcccagcgcgugggccagc

SEQ ID NO: 2452938 - RNA, 15 nt, Bordetella pertussis
gccgcccaggcgcag

SEQ ID NO: 2452939 - RNA, 20 nt, Bordetella pertussis
gccgcccaggcgcagccgcg

SEQ ID NO: 2452940 - RNA, 21 nt, Bordetella pertussis
gccgcccaggcgcagccgcgc

SEQ ID NO: 2452941 - RNA, 20 nt, Bordetella pertussis
gccgcccaggucggacgcgc

SEQ ID NO: 2452942 - RNA, 22 nt, Bordetella pertussis
gccgcccaggucggacgcgccg

SEQ ID NO: 2452943 - RNA, 19 nt, Bordetella pertussis
gccgcccagucguccagca

SEQ ID NO: 2452944 - RNA, 22 nt, Bordetella pertussis
gccgcccagucguccagcacgc

SEQ ID NO: 2452945 - RNA, 16 nt, Bordetella pertussis
gccgcccaugccgccg

SEQ ID NO: 2452946 - RNA, 17 nt, Bordetella pertussis
gccgcccaugccgccgg

SEQ ID NO: 2452947 - RNA, 19 nt, Bordetella pertussis
gccgcccaugccgccgggc

SEQ ID NO: 2452948 - RNA, 22 nt, Bordetella pertussis
gccgcccaugcgcauggccagc

SEQ ID NO: 2452949 - RNA, 23 nt, Bordetella pertussis
gccgcccaugcggguuggcaguc

SEQ ID NO: 2452950 - RNA, 24 nt, Bordetella pertussis
gccgcccaugcggguuggcagucg

SEQ ID NO: 2452951 - RNA, 15 nt, Bordetella pertussis
gccgccccagcagca

SEQ ID NO: 2452952 - RNA, 19 nt, Bordetella pertussis
gccgccccagcagcagcga

SEQ ID NO: 2452953 - RNA, 21 nt, Bordetella pertussis
gccgccccagcagcagcgagc

SEQ ID NO: 2452954 - RNA, 18 nt, Bordetella pertussis
gccgccccaggcguacga

SEQ ID NO: 2452955 - RNA, 19 nt, Bordetella pertussis
gccgccccaggcguacgag

SEQ ID NO: 2452956 - RNA, 23 nt, Bordetella pertussis
gccgccccaggcguacgaggacc

SEQ ID NO: 2452957 - RNA, 21 nt, Bordetella pertussis
gccgccccaguugcgcgucca

SEQ ID NO: 2452958 - RNA, 17 nt, Bordetella pertussis
gccgcccccagcgcgcc

SEQ ID NO: 2452959 - RNA, 18 nt, Bordetella pertussis
gccgcccccagcgcgccu

SEQ ID NO: 2452960 - RNA, 16 nt, Bordetella pertussis
gccgcccccgcccagc

SEQ ID NO: 2452961 - RNA, 19 nt, Bordetella pertussis
gccgcccccgcccagcauc

SEQ ID NO: 2452962 - RNA, 20 nt, Bordetella pertussis
gccgcccccgcccagcaucc

SEQ ID NO: 2452963 - RNA, 22 nt, Bordetella pertussis
gccgcccccgcccagcauccgc

SEQ ID NO: 2452964 - RNA, 17 nt, Bordetella pertussis
gccgccccggcgcggcg

SEQ ID NO: 2452965 - RNA, 21 nt, Bordetella pertussis
gccgccccggcgcggcgcgcg

SEQ ID NO: 2452966 - RNA, 23 nt, Bordetella pertussis
gccgccccggcgcggcgcgcgcc

SEQ ID NO: 2452967 - RNA, 14 nt, Bordetella pertussis
gccgcccgacagca

SEQ ID NO: 2452968 - RNA, 19 nt, Bordetella pertussis
gccgcccgacagcacgccc

SEQ ID NO: 2452969 - RNA, 20 nt, Bordetella pertussis
gccgcccgacagcacgcccg

SEQ ID NO: 2452970 - RNA, 15 nt, Bordetella pertussis
gccgcccgagcuggc

SEQ ID NO: 2452971 - RNA, 16 nt, Bordetella pertussis
gccgcccgagcuggcc

SEQ ID NO: 2452972 - RNA, 23 nt, Bordetella pertussis
gccgcccgagcuggccggcgacu

SEQ ID NO: 2452973 - RNA, 13 nt, Bordetella pertussis
gccgcccgcaagg

SEQ ID NO: 2452974 - RNA, 20 nt, Bordetella pertussis
gccgcccgcacgaagcggca

SEQ ID NO: 2452975 - RNA, 14 nt, Bordetella pertussis
gccgcccgcaggca

SEQ ID NO: 2452976 - RNA, 15 nt, Bordetella pertussis
gccgcccgcaggcau

SEQ ID NO: 2452977 - RNA, 13 nt, Bordetella pertussis
gccgcccgcaugc

SEQ ID NO: 2452978 - RNA, 20 nt, Bordetella pertussis
gccgcccgcaugcagguccu

SEQ ID NO: 2452979 - RNA, 13 nt, Bordetella pertussis
gccgcccgccagg

SEQ ID NO: 2452980 - RNA, 14 nt, Bordetella pertussis
gccgcccgccaugc

SEQ ID NO: 2452981 - RNA, 13 nt, Bordetella pertussis
gccgcccgcccgc

SEQ ID NO: 2452982 - RNA, 14 nt, Bordetella pertussis
gccgcccgccgggc

SEQ ID NO: 2452983 - RNA, 16 nt, Bordetella pertussis
gccgcccgccucaggc

SEQ ID NO: 2452984 - RNA, 17 nt, Bordetella pertussis
gccgcccgccucaggcc

SEQ ID NO: 2452985 - RNA, 15 nt, Bordetella pertussis
gccgcccgccugccg

SEQ ID NO: 2452986 - RNA, 16 nt, Bordetella pertussis
gccgcccgcggccagc

SEQ ID NO: 2452987 - RNA, 17 nt, Bordetella pertussis
gccgcccgcggccagcc

SEQ ID NO: 2452988 - RNA, 19 nt, Bordetella pertussis
gccgcccgcggccagccac

SEQ ID NO: 2452989 - RNA, 14 nt, Bordetella pertussis
gccgcccgcggccu

SEQ ID NO: 2452990 - RNA, 16 nt, Bordetella pertussis
gccgcccgcggccugc

SEQ ID NO: 2452991 - RNA, 17 nt, Bordetella pertussis
gccgcccgcggccugca

SEQ ID NO: 2452992 - RNA, 13 nt, Bordetella pertussis
gccgcccgcuucu

SEQ ID NO: 2452993 - RNA, 20 nt, Bordetella pertussis
gccgcccggaugggcggccu

SEQ ID NO: 2452994 - RNA, 14 nt, Bordetella pertussis
gccgcccggcagcu

SEQ ID NO: 2452995 - RNA, 15 nt, Bordetella pertussis
gccgcccggcagcug

SEQ ID NO: 2452996 - RNA, 17 nt, Bordetella pertussis
gccgcccggccggcacg

SEQ ID NO: 2452997 - RNA, 15 nt, Bordetella pertussis
gccgcccggccggcc

SEQ ID NO: 2452998 - RNA, 15 nt, Bordetella pertussis
gccgcccgggccggc

SEQ ID NO: 2452999 - RNA, 20 nt, Bordetella pertussis
gccgcccguccgggcggcgu

SEQ ID NO: 2453000 - RNA, 22 nt, Bordetella pertussis
gccgcccugccaauagcggugg

SEQ ID NO: 2453001 - RNA, 14 nt, Bordetella pertussis
gccgcccugcugcc

SEQ ID NO: 2453002 - RNA, 14 nt, Bordetella pertussis
gccgcccuggccgc

SEQ ID NO: 2453003 - RNA, 13 nt, Bordetella pertussis
gccgcccuggcgc

SEQ ID NO: 2453004 - RNA, 14 nt, Bordetella pertussis
gccgcccuggcgca

SEQ ID NO: 2453005 - RNA, 15 nt, Bordetella pertussis
gccgcccuggcgcag

SEQ ID NO: 2453006 - RNA, 14 nt, Bordetella pertussis
gccgcccuggucau

SEQ ID NO: 2453007 - RNA, 19 nt, Bordetella pertussis
gccgcccuggucaucgcca

SEQ ID NO: 2453008 - RNA, 13 nt, Bordetella pertussis
gccgcccuugcgc

SEQ ID NO: 2453009 - RNA, 14 nt, Bordetella pertussis
gccgccgaaccagc

SEQ ID NO: 2453010 - RNA, 15 nt, Bordetella pertussis
gccgccgaaccagcg

SEQ ID NO: 2453011 - RNA, 17 nt, Bordetella pertussis
gccgccgaaccagcgca

SEQ ID NO: 2453012 - RNA, 18 nt, Bordetella pertussis
gccgccgaaccagcgcac

SEQ ID NO: 2453013 - RNA, 20 nt, Bordetella pertussis
gccgccgaaccagcgcacca

SEQ ID NO: 2453014 - RNA, 14 nt, Bordetella pertussis
gccgccgaacgagg

SEQ ID NO: 2453015 - RNA, 23 nt, Bordetella pertussis
gccgccgaacgaggcgcggucgu

SEQ ID NO: 2453016 - RNA, 16 nt, Bordetella pertussis
gccgccgaacggggcc

SEQ ID NO: 2453017 - RNA, 11 nt, Bordetella pertussis
gccgccgacga

SEQ ID NO: 2453018 - RNA, 16 nt, Bordetella pertussis
gccgccgacgccgcca

SEQ ID NO: 2453019 - RNA, 19 nt, Bordetella pertussis
gccgccgacgccgccacgc

SEQ ID NO: 2453020 - RNA, 20 nt, Bordetella pertussis
gccgccgacggcauggcggc

SEQ ID NO: 2453021 - RNA, 21 nt, Bordetella pertussis
gccgccgacggcauggcggcc

SEQ ID NO: 2453022 - RNA, 22 nt, Bordetella pertussis
gccgccgacggcauggcggcca

SEQ ID NO: 2453023 - RNA, 13 nt, Bordetella pertussis
gccgccgagcagg

SEQ ID NO: 2453024 - RNA, 18 nt, Bordetella pertussis
gccgccgaggcggugggc

SEQ ID NO: 2453025 - RNA, 16 nt, Bordetella pertussis
gccgccgaucugcuuc

SEQ ID NO: 2453026 - RNA, 15 nt, Bordetella pertussis
gccgccgauggcgcc

SEQ ID NO: 2453027 - RNA, 23 nt, Bordetella pertussis
gccgccgauggcgcgcggcuggg

SEQ ID NO: 2453028 - RNA, 22 nt, Bordetella pertussis
gccgccgaugugcggcgugagc

SEQ ID NO: 2453029 - RNA, 12 nt, Bordetella pertussis
gccgccgcacag

SEQ ID NO: 2453030 - RNA, 15 nt, Bordetella pertussis
gccgccgcacagcgu

SEQ ID NO: 2453031 - RNA, 14 nt, Bordetella pertussis
gccgccgcagccgc

SEQ ID NO: 2453032 - RNA, 16 nt, Bordetella pertussis
gccgccgcagccgcca

SEQ ID NO: 2453033 - RNA, 17 nt, Bordetella pertussis
gccgccgcagccgccag

SEQ ID NO: 2453034 - RNA, 18 nt, Bordetella pertussis
gccgccgcagccgccagc

SEQ ID NO: 2453035 - RNA, 12 nt, Bordetella pertussis
gccgccgcaggc

SEQ ID NO: 2453036 - RNA, 15 nt, Bordetella pertussis
gccgccgccaccagc

SEQ ID NO: 2453037 - RNA, 19 nt, Bordetella pertussis
gccgccgccaccagcggcg

SEQ ID NO: 2453038 - RNA, 13 nt, Bordetella pertussis
gccgccgccagcg

SEQ ID NO: 2453039 - RNA, 15 nt, Bordetella pertussis
gccgccgccagcgcg

SEQ ID NO: 2453040 - RNA, 16 nt, Bordetella pertussis
gccgccgccagcgcgc

SEQ ID NO: 2453041 - RNA, 18 nt, Bordetella pertussis
gccgccgccagcgcgccg

SEQ ID NO: 2453042 - RNA, 19 nt, Bordetella pertussis
gccgccgccauagcugcgc

SEQ ID NO: 2453043 - RNA, 21 nt, Bordetella pertussis
gccgccgccauagcugcgcca

SEQ ID NO: 2453044 - RNA, 14 nt, Bordetella pertussis
gccgccgcccacgc

SEQ ID NO: 2453045 - RNA, 18 nt, Bordetella pertussis
gccgccgcccacgccgcc

SEQ ID NO: 2453046 - RNA, 20 nt, Bordetella pertussis
gccgccgcccacgccgccug

SEQ ID NO: 2453047 - RNA, 12 nt, Bordetella pertussis
gccgccgcccgc

SEQ ID NO: 2453048 - RNA, 14 nt, Bordetella pertussis
gccgccgcccgcac

SEQ ID NO: 2453049 - RNA, 22 nt, Bordetella pertussis
gccgccgcccgcacgaagcggc

SEQ ID NO: 2453050 - RNA, 15 nt, Bordetella pertussis
gccgccgcccgcccg

SEQ ID NO: 2453051 - RNA, 18 nt, Bordetella pertussis
gccgccgcccgcccgccg

SEQ ID NO: 2453052 - RNA, 13 nt, Bordetella pertussis
gccgccgcccggc

SEQ ID NO: 2453053 - RNA, 16 nt, Bordetella pertussis
gccgccgcccucgccc

SEQ ID NO: 2453054 - RNA, 13 nt, Bordetella pertussis
gccgccgcccugc

SEQ ID NO: 2453055 - RNA, 15 nt, Bordetella pertussis
gccgccgcccuggcc

SEQ ID NO: 2453056 - RNA, 15 nt, Bordetella pertussis
gccgccgccgcgcgc

SEQ ID NO: 2453057 - RNA, 13 nt, Bordetella pertussis
gccgccgccgcgg

SEQ ID NO: 2453058 - RNA, 17 nt, Bordetella pertussis
gccgccgccgcggccug

SEQ ID NO: 2453059 - RNA, 14 nt, Bordetella pertussis
gccgccgccggcaa

SEQ ID NO: 2453060 - RNA, 15 nt, Bordetella pertussis
gccgccgccggcccg

SEQ ID NO: 2453061 - RNA, 16 nt, Bordetella pertussis
gccgccgccggcccgc

SEQ ID NO: 2453062 - RNA, 14 nt, Bordetella pertussis
gccgccgccggcgc

SEQ ID NO: 2453063 - RNA, 16 nt, Bordetella pertussis
gccgccgccggcgcgg

SEQ ID NO: 2453064 - RNA, 13 nt, Bordetella pertussis
gccgccgccgggc

SEQ ID NO: 2453065 - RNA, 14 nt, Bordetella pertussis
gccgccgccgggcu

SEQ ID NO: 2453066 - RNA, 16 nt, Bordetella pertussis
gccgccgccgggcugg

SEQ ID NO: 2453067 - RNA, 13 nt, Bordetella pertussis
gccgccgccgguc

SEQ ID NO: 2453068 - RNA, 13 nt, Bordetella pertussis
gccgccgccguca

SEQ ID NO: 2453069 - RNA, 13 nt, Bordetella pertussis
gccgccgccuggc

SEQ ID NO: 2453070 - RNA, 14 nt, Bordetella pertussis
gccgccgcgcacca

SEQ ID NO: 2453071 - RNA, 15 nt, Bordetella pertussis
gccgccgcgcagccg

SEQ ID NO: 2453072 - RNA, 21 nt, Bordetella pertussis
gccgccgcgcagccgacaggc

SEQ ID NO: 2453073 - RNA, 14 nt, Bordetella pertussis
gccgccgcgcagga

SEQ ID NO: 2453074 - RNA, 15 nt, Bordetella pertussis
gccgccgcgcccagc

SEQ ID NO: 2453075 - RNA, 16 nt, Bordetella pertussis
gccgccgcgcccagca

SEQ ID NO: 2453076 - RNA, 22 nt, Bordetella pertussis
gccgccgcgcccagcagcgcca

SEQ ID NO: 2453077 - RNA, 16 nt, Bordetella pertussis
gccgccgcgcccagcc

SEQ ID NO: 2453078 - RNA, 17 nt, Bordetella pertussis
gccgccgcgccgcuggc

SEQ ID NO: 2453079 - RNA, 21 nt, Bordetella pertussis
gccgccgcgccgcuggcgucc

SEQ ID NO: 2453080 - RNA, 14 nt, Bordetella pertussis
gccgccgcgcgccg

SEQ ID NO: 2453081 - RNA, 20 nt, Bordetella pertussis
gccgccgcgcgccgcgccuu

SEQ ID NO: 2453082 - RNA, 13 nt, Bordetella pertussis
gccgccgcgcgcg

SEQ ID NO: 2453083 - RNA, 15 nt, Bordetella pertussis
gccgccgcgcgcugg

SEQ ID NO: 2453084 - RNA, 17 nt, Bordetella pertussis
gccgccgcgcggcggau

SEQ ID NO: 2453085 - RNA, 21 nt, Bordetella pertussis
gccgccgcgcucaccgagggc

SEQ ID NO: 2453086 - RNA, 13 nt, Bordetella pertussis
gccgccgcgcugu

SEQ ID NO: 2453087 - RNA, 14 nt, Bordetella pertussis
gccgccgcggccuc

SEQ ID NO: 2453088 - RNA, 17 nt, Bordetella pertussis
gccgccgcggccucggc

SEQ ID NO: 2453089 - RNA, 16 nt, Bordetella pertussis
gccgccgcggccuggc

SEQ ID NO: 2453090 - RNA, 12 nt, Bordetella pertussis
gccgccgcgggc

SEQ ID NO: 2453091 - RNA, 14 nt, Bordetella pertussis
gccgccgcgggcgc

SEQ ID NO: 2453092 - RNA, 16 nt, Bordetella pertussis
gccgccgcgggcgccg

SEQ ID NO: 2453093 - RNA, 22 nt, Bordetella pertussis
gccgccgcgggcggccacgcgc

SEQ ID NO: 2453094 - RNA, 13 nt, Bordetella pertussis
gccgccgcgugga

SEQ ID NO: 2453095 - RNA, 16 nt, Bordetella pertussis
gccgccgcguggcggc

SEQ ID NO: 2453096 - RNA, 20 nt, Bordetella pertussis
gccgccgcguggcggcgcag

SEQ ID NO: 2453097 - RNA, 16 nt, Bordetella pertussis
gccgccgcugccggcc

SEQ ID NO: 2453098 - RNA, 19 nt, Bordetella pertussis
gccgccgcugccggccgac

SEQ ID NO: 2453099 - RNA, 16 nt, Bordetella pertussis
gccgccggacgcaggu

SEQ ID NO: 2453100 - RNA, 22 nt, Bordetella pertussis
gccgccggacgcaggucgucgu

SEQ ID NO: 2453101 - RNA, 13 nt, Bordetella pertussis
gccgccggacggc

SEQ ID NO: 2453102 - RNA, 17 nt, Bordetella pertussis
gccgccggacggcgccu

SEQ ID NO: 2453103 - RNA, 23 nt, Bordetella pertussis
gccgccggcaaucgaaaagcccg

SEQ ID NO: 2453104 - RNA, 16 nt, Bordetella pertussis
gccgccggcacguacc

SEQ ID NO: 2453105 - RNA, 19 nt, Bordetella pertussis
gccgccggcacguaccagg

SEQ ID NO: 2453106 - RNA, 22 nt, Bordetella pertussis
gccgccggcacguaccaggcgc

SEQ ID NO: 2453107 - RNA, 14 nt, Bordetella pertussis
gccgccggcagggc

SEQ ID NO: 2453108 - RNA, 16 nt, Bordetella pertussis
gccgccggcagggcca

SEQ ID NO: 2453109 - RNA, 17 nt, Bordetella pertussis
gccgccggcagggccag

SEQ ID NO: 2453110 - RNA, 21 nt, Bordetella pertussis
gccgccggcagggccagcgcc

SEQ ID NO: 2453111 - RNA, 22 nt, Bordetella pertussis
gccgccggcagggccagcgcca

SEQ ID NO: 2453112 - RNA, 13 nt, Bordetella pertussis
gccgccggccacc

SEQ ID NO: 2453113 - RNA, 15 nt, Bordetella pertussis
gccgccggccaccag

SEQ ID NO: 2453114 - RNA, 16 nt, Bordetella pertussis
gccgccggccaccagc

SEQ ID NO: 2453115 - RNA, 13 nt, Bordetella pertussis
gccgccggccagc

SEQ ID NO: 2453116 - RNA, 14 nt, Bordetella pertussis
gccgccggccagcc

SEQ ID NO: 2453117 - RNA, 14 nt, Bordetella pertussis
gccgccggccagcg

SEQ ID NO: 2453118 - RNA, 16 nt, Bordetella pertussis
gccgccggccaucagg

SEQ ID NO: 2453119 - RNA, 13 nt, Bordetella pertussis
gccgccggcccag

SEQ ID NO: 2453120 - RNA, 15 nt, Bordetella pertussis
gccgccggcccagga

SEQ ID NO: 2453121 - RNA, 19 nt, Bordetella pertussis
gccgccggcccaggauggc

SEQ ID NO: 2453122 - RNA, 22 nt, Bordetella pertussis
gccgccggcccaggauggcgcc

SEQ ID NO: 2453123 - RNA, 12 nt, Bordetella pertussis
gccgccggcccg

SEQ ID NO: 2453124 - RNA, 15 nt, Bordetella pertussis
gccgccggcccgcca

SEQ ID NO: 2453125 - RNA, 16 nt, Bordetella pertussis
gccgccggcccgccac

SEQ ID NO: 2453126 - RNA, 13 nt, Bordetella pertussis
gccgccggcccgg

SEQ ID NO: 2453127 - RNA, 13 nt, Bordetella pertussis
gccgccggccucu

SEQ ID NO: 2453128 - RNA, 20 nt, Bordetella pertussis
gccgccggccugcugcagca

SEQ ID NO: 2453129 - RNA, 13 nt, Bordetella pertussis
gccgccggcgaca

SEQ ID NO: 2453130 - RNA, 12 nt, Bordetella pertussis
gccgccggcgag

SEQ ID NO: 2453131 - RNA, 15 nt, Bordetella pertussis
gccgccggcgaugau

SEQ ID NO: 2453132 - RNA, 13 nt, Bordetella pertussis
gccgccggcgcac

SEQ ID NO: 2453133 - RNA, 14 nt, Bordetella pertussis
gccgccggcgcgcg

SEQ ID NO: 2453134 - RNA, 15 nt, Bordetella pertussis
gccgccggcgcggcu

SEQ ID NO: 2453135 - RNA, 14 nt, Bordetella pertussis
gccgccggcgcggu

SEQ ID NO: 2453136 - RNA, 22 nt, Bordetella pertussis
gccgccggcgcgguauggccgc

SEQ ID NO: 2453137 - RNA, 21 nt, Bordetella pertussis
gccgccggcgcgguggccaug

SEQ ID NO: 2453138 - RNA, 13 nt, Bordetella pertussis
gccgccggcggca

SEQ ID NO: 2453139 - RNA, 24 nt, Bordetella pertussis
gccgccggcggcauucagcgcugc

SEQ ID NO: 2453140 - RNA, 13 nt, Bordetella pertussis
gccgccggcggcc

SEQ ID NO: 2453141 - RNA, 15 nt, Bordetella pertussis
gccgccggcggcgca

SEQ ID NO: 2453142 - RNA, 16 nt, Bordetella pertussis
gccgccggcggcgcac

SEQ ID NO: 2453143 - RNA, 18 nt, Bordetella pertussis
gccgccggcggcgcacca

SEQ ID NO: 2453144 - RNA, 16 nt, Bordetella pertussis
gccgccggcggcgccg

SEQ ID NO: 2453145 - RNA, 18 nt, Bordetella pertussis
gccgccggcggcgccggc

SEQ ID NO: 2453146 - RNA, 23 nt, Bordetella pertussis
gccgccggcggcgucggcgcccg

SEQ ID NO: 2453147 - RNA, 12 nt, Bordetella pertussis
gccgccggcggg

SEQ ID NO: 2453148 - RNA, 15 nt, Bordetella pertussis
gccgccggcgugccc

SEQ ID NO: 2453149 - RNA, 21 nt, Bordetella pertussis
gccgccgggcaugcaccaggc

SEQ ID NO: 2453150 - RNA, 22 nt, Bordetella pertussis
gccgccgggcaugcaccaggcg

SEQ ID NO: 2453151 - RNA, 14 nt, Bordetella pertussis
gccgccgggccugc

SEQ ID NO: 2453152 - RNA, 15 nt, Bordetella pertussis
gccgccgggccugcc

SEQ ID NO: 2453153 - RNA, 16 nt, Bordetella pertussis
gccgccgggccugccc

SEQ ID NO: 2453154 - RNA, 17 nt, Bordetella pertussis
gccgccgggccugcccg

SEQ ID NO: 2453155 - RNA, 18 nt, Bordetella pertussis
gccgccgggccugcccgc

SEQ ID NO: 2453156 - RNA, 13 nt, Bordetella pertussis
gccgccgggcgcg

SEQ ID NO: 2453157 - RNA, 15 nt, Bordetella pertussis
gccgccgggcgcgcg

SEQ ID NO: 2453158 - RNA, 16 nt, Bordetella pertussis
gccgccgggcgcgcgc

SEQ ID NO: 2453159 - RNA, 21 nt, Bordetella pertussis
gccgccgggcgcgcgccggcg

SEQ ID NO: 2453160 - RNA, 20 nt, Bordetella pertussis
gccgccgggucgcugugcgc

SEQ ID NO: 2453161 - RNA, 21 nt, Bordetella pertussis
gccgccgggucgcugugcgcg

SEQ ID NO: 2453162 - RNA, 22 nt, Bordetella pertussis
gccgccgggucgcugugcgcgg

SEQ ID NO: 2453163 - RNA, 16 nt, Bordetella pertussis
gccgccggucaccgcc

SEQ ID NO: 2453164 - RNA, 20 nt, Bordetella pertussis
gccgccggucaccgccgccg

SEQ ID NO: 2453165 - RNA, 23 nt, Bordetella pertussis
gccgccggucaccgccgccgcca

SEQ ID NO: 2453166 - RNA, 14 nt, Bordetella pertussis
gccgccggucgaga

SEQ ID NO: 2453167 - RNA, 21 nt, Bordetella pertussis
gccgccggugauaugcgccag

SEQ ID NO: 2453168 - RNA, 22 nt, Bordetella pertussis
gccgccggugauaugcgccagg

SEQ ID NO: 2453169 - RNA, 17 nt, Bordetella pertussis
gccgccggugcaccagg

SEQ ID NO: 2453170 - RNA, 21 nt, Bordetella pertussis
gccgccggugcaccaggccac

SEQ ID NO: 2453171 - RNA, 22 nt, Bordetella pertussis
gccgccguaaucggcgucggca

SEQ ID NO: 2453172 - RNA, 14 nt, Bordetella pertussis
gccgccguagccgc

SEQ ID NO: 2453173 - RNA, 21 nt, Bordetella pertussis
gccgccguagccgcugcgcgc

SEQ ID NO: 2453174 - RNA, 16 nt, Bordetella pertussis
gccgccguaggacagc

SEQ ID NO: 2453175 - RNA, 19 nt, Bordetella pertussis
gccgccguaggacagcccc

SEQ ID NO: 2453176 - RNA, 20 nt, Bordetella pertussis
gccgccguaggacagcccca

SEQ ID NO: 2453177 - RNA, 21 nt, Bordetella pertussis
gccgccguaggacagccccag

SEQ ID NO: 2453178 - RNA, 22 nt, Bordetella pertussis
gccgccguaggacagccccagc

SEQ ID NO: 2453179 - RNA, 23 nt, Bordetella pertussis
gccgccguaggacagccccagca

SEQ ID NO: 2453180 - RNA, 18 nt, Bordetella pertussis
gccgccgucaacgcccag

SEQ ID NO: 2453181 - RNA, 14 nt, Bordetella pertussis
gccgccgucgaugu

SEQ ID NO: 2453182 - RNA, 17 nt, Bordetella pertussis
gccgccgugacgcugau

SEQ ID NO: 2453183 - RNA, 16 nt, Bordetella pertussis
gccgccgugaugccgc

SEQ ID NO: 2453184 - RNA, 17 nt, Bordetella pertussis
gccgccgugaugccgcc

SEQ ID NO: 2453185 - RNA, 20 nt, Bordetella pertussis
gccgccgugaugccgcccgc

SEQ ID NO: 2453186 - RNA, 16 nt, Bordetella pertussis
gccgccgugcgcgggc

SEQ ID NO: 2453187 - RNA, 18 nt, Bordetella pertussis
gccgccguuuucgcccgc

SEQ ID NO: 2453188 - RNA, 20 nt, Bordetella pertussis
gccgccguuuucgcccgccc

SEQ ID NO: 2453189 - RNA, 16 nt, Bordetella pertussis
gccgccuaccaggugg

SEQ ID NO: 2453190 - RNA, 19 nt, Bordetella pertussis
gccgccuauguaggcgccg

SEQ ID NO: 2453191 - RNA, 22 nt, Bordetella pertussis
gccgccuauguaggcgccgcgc

SEQ ID NO: 2453192 - RNA, 17 nt, Bordetella pertussis
gccgccucaccgcgccg

SEQ ID NO: 2453193 - RNA, 20 nt, Bordetella pertussis
gccgccucaccgcgccgggc

SEQ ID NO: 2453194 - RNA, 15 nt, Bordetella pertussis
gccgccucagcccgc

SEQ ID NO: 2453195 - RNA, 13 nt, Bordetella pertussis
gccgccucaggcc

SEQ ID NO: 2453196 - RNA, 20 nt, Bordetella pertussis
gccgccucaggccggcgccu

SEQ ID NO: 2453197 - RNA, 22 nt, Bordetella pertussis
gccgccucgaccggcgaagagc

SEQ ID NO: 2453198 - RNA, 22 nt, Bordetella pertussis
gccgccucgauugaccagcacc

SEQ ID NO: 2453199 - RNA, 16 nt, Bordetella pertussis
gccgccucgcgcucca

SEQ ID NO: 2453200 - RNA, 19 nt, Bordetella pertussis
gccgccucgcgcuccagca

SEQ ID NO: 2453201 - RNA, 17 nt, Bordetella pertussis
gccgccucggcggccag

SEQ ID NO: 2453202 - RNA, 18 nt, Bordetella pertussis
gccgccucggcggccagc

SEQ ID NO: 2453203 - RNA, 22 nt, Bordetella pertussis
gccgccucggcggccagcgcgc

SEQ ID NO: 2453204 - RNA, 14 nt, Bordetella pertussis
gccgcgcccacagg

SEQ ID NO: 2453205 - RNA, 12 nt, Bordetella pertussis
gccgcgcccagc

SEQ ID NO: 2453206 - RNA, 13 nt, Bordetella pertussis
gccgcgcccagca

SEQ ID NO: 2453207 - RNA, 14 nt, Bordetella pertussis
gccgcgcccagcag

SEQ ID NO: 2453208 - RNA, 15 nt, Bordetella pertussis
gccgcgcccagcagc

SEQ ID NO: 2453209 - RNA, 19 nt, Bordetella pertussis
gccgcgcccagcagcgcca

SEQ ID NO: 2453210 - RNA, 22 nt, Bordetella pertussis
gccgcgcccagcauggucggca

SEQ ID NO: 2453211 - RNA, 14 nt, Bordetella pertussis
gccgcgcccagccg

SEQ ID NO: 2453212 - RNA, 20 nt, Bordetella pertussis
gccgcgcccagccgcgccau

SEQ ID NO: 2453213 - RNA, 13 nt, Bordetella pertussis
gccgcgcccagcg

SEQ ID NO: 2453214 - RNA, 17 nt, Bordetella pertussis
gccgcgcccagcgcggc

SEQ ID NO: 2453215 - RNA, 20 nt, Bordetella pertussis
gccgcgcccagcgcggccuu

SEQ ID NO: 2453216 - RNA, 15 nt, Bordetella pertussis
gccgcgcccagcgug

SEQ ID NO: 2453217 - RNA, 19 nt, Bordetella pertussis
gccgcgcccaugcgcuggc

SEQ ID NO: 2453218 - RNA, 20 nt, Bordetella pertussis
gccgcgcccaugcgcuggcg

SEQ ID NO: 2453219 - RNA, 21 nt, Bordetella pertussis
gccgcgcccaugcgcuggcgc

SEQ ID NO: 2453220 - RNA, 23 nt, Bordetella pertussis
gccgcgcccaugcgcuggcgcaa

SEQ ID NO: 2453221 - RNA, 16 nt, Bordetella pertussis
gccgcgccccuagcgc

SEQ ID NO: 2453222 - RNA, 19 nt, Bordetella pertussis
gccgcgccccuagcgccgc

SEQ ID NO: 2453223 - RNA, 23 nt, Bordetella pertussis
gccgcgccccuagcgccgcgcca

SEQ ID NO: 2453224 - RNA, 11 nt, Bordetella pertussis
gccgcgcccgc

SEQ ID NO: 2453225 - RNA, 12 nt, Bordetella pertussis
gccgcgcccgca

SEQ ID NO: 2453226 - RNA, 14 nt, Bordetella pertussis
gccgcgcccgccgc

SEQ ID NO: 2453227 - RNA, 18 nt, Bordetella pertussis
gccgcgcccgccgcgcca

SEQ ID NO: 2453228 - RNA, 15 nt, Bordetella pertussis
gccgcgcccgccuuc

SEQ ID NO: 2453229 - RNA, 14 nt, Bordetella pertussis
gccgcgcccgcggg

SEQ ID NO: 2453230 - RNA, 14 nt, Bordetella pertussis
gccgcgcccggccg

SEQ ID NO: 2453231 - RNA, 18 nt, Bordetella pertussis
gccgcgcccggcggccag

SEQ ID NO: 2453232 - RNA, 19 nt, Bordetella pertussis
gccgcgcccguccacggcc

SEQ ID NO: 2453233 - RNA, 13 nt, Bordetella pertussis
gccgcgcccuggc

SEQ ID NO: 2453234 - RNA, 14 nt, Bordetella pertussis
gccgcgcccuggcg

SEQ ID NO: 2453235 - RNA, 18 nt, Bordetella pertussis
gccgcgcccuggcgcggc

SEQ ID NO: 2453236 - RNA, 19 nt, Bordetella pertussis
gccgcgcccuggcgcggcg

SEQ ID NO: 2453237 - RNA, 16 nt, Bordetella pertussis
gccgcgccgaacgcgc

SEQ ID NO: 2453238 - RNA, 18 nt, Bordetella pertussis
gccgcgccgaacgcgcag

SEQ ID NO: 2453239 - RNA, 20 nt, Bordetella pertussis
gccgcgccgaacgcgcagcg

SEQ ID NO: 2453240 - RNA, 15 nt, Bordetella pertussis
gccgcgccgaccggc

SEQ ID NO: 2453241 - RNA, 19 nt, Bordetella pertussis
gccgcgccgaccggcccca

SEQ ID NO: 2453242 - RNA, 13 nt, Bordetella pertussis
gccgcgccgcccg

SEQ ID NO: 2453243 - RNA, 14 nt, Bordetella pertussis
gccgcgccgcccgc

SEQ ID NO: 2453244 - RNA, 15 nt, Bordetella pertussis
gccgcgccgcccgcg

SEQ ID NO: 2453245 - RNA, 17 nt, Bordetella pertussis
gccgcgccgcccgcggc

SEQ ID NO: 2453246 - RNA, 13 nt, Bordetella pertussis
gccgcgccgccgc

SEQ ID NO: 2453247 - RNA, 16 nt, Bordetella pertussis
gccgcgccgccgccug

SEQ ID NO: 2453248 - RNA, 13 nt, Bordetella pertussis
gccgcgccgcguu

SEQ ID NO: 2453249 - RNA, 16 nt, Bordetella pertussis
gccgcgccgcguugca

SEQ ID NO: 2453250 - RNA, 12 nt, Bordetella pertussis
gccgcgccgcug

SEQ ID NO: 2453251 - RNA, 14 nt, Bordetella pertussis
gccgcgccggcgcg

SEQ ID NO: 2453252 - RNA, 15 nt, Bordetella pertussis
gccgcgccggcgcgc

SEQ ID NO: 2453253 - RNA, 16 nt, Bordetella pertussis
gccgcgccggcgcgcg

SEQ ID NO: 2453254 - RNA, 17 nt, Bordetella pertussis
gccgcgccggcgcgcga

SEQ ID NO: 2453255 - RNA, 22 nt, Bordetella pertussis
gccgcgccggcucccgcgcugc

SEQ ID NO: 2453256 - RNA, 16 nt, Bordetella pertussis
gccgcgccgggcgcgc

SEQ ID NO: 2453257 - RNA, 20 nt, Bordetella pertussis
gccgcgccgggcgcgccggc

SEQ ID NO: 2453258 - RNA, 12 nt, Bordetella pertussis
gccgcgccgggg

SEQ ID NO: 2453259 - RNA, 17 nt, Bordetella pertussis
gccgcgccggggcggcg

SEQ ID NO: 2453260 - RNA, 20 nt, Bordetella pertussis
gccgcgccggggcggcgcag

SEQ ID NO: 2453261 - RNA, 22 nt, Bordetella pertussis
gccgcgccggggcggcgcagca

SEQ ID NO: 2453262 - RNA, 17 nt, Bordetella pertussis
gccgcgccggggcggcu

SEQ ID NO: 2453263 - RNA, 16 nt, Bordetella pertussis
gccgcgccggucaggc

SEQ ID NO: 2453264 - RNA, 18 nt, Bordetella pertussis
gccgcgccggucgccgcg

SEQ ID NO: 2453265 - RNA, 19 nt, Bordetella pertussis
gccgcgccgguggccagca

SEQ ID NO: 2453266 - RNA, 21 nt, Bordetella pertussis
gccgcgccgguggccagcagc

SEQ ID NO: 2453267 - RNA, 22 nt, Bordetella pertussis
gccgcgccguacagggccgcga

SEQ ID NO: 2453268 - RNA, 22 nt, Bordetella pertussis
gccgcgccguucucaggccgag

SEQ ID NO: 2453269 - RNA, 20 nt, Bordetella pertussis
gccgcgccuauaucgacggc

SEQ ID NO: 2453270 - RNA, 21 nt, Bordetella pertussis
gccgcgccuauaucgacggcg

SEQ ID NO: 2453271 - RNA, 22 nt, Bordetella pertussis
gccgcgccuauaucgacggcgc

SEQ ID NO: 2453272 - RNA, 22 nt, Bordetella pertussis
gccgcgccucggacgccuggcg

SEQ ID NO: 2453273 - RNA, 23 nt, Bordetella pertussis
gccgcgccucggacgccuggcgc

SEQ ID NO: 2453274 - RNA, 14 nt, Bordetella pertussis
gccgcgccugcagg

SEQ ID NO: 2453275 - RNA, 19 nt, Bordetella pertussis
gccgcgccuugcccgucag

SEQ ID NO: 2453276 - RNA, 23 nt, Bordetella pertussis
gccgcgccuugcccgucagggua

SEQ ID NO: 2453277 - RNA, 17 nt, Bordetella pertussis
gccgcgcgacagccgcg

SEQ ID NO: 2453278 - RNA, 22 nt, Bordetella pertussis
gccgcgcgacagccgcgccagc

SEQ ID NO: 2453279 - RNA, 23 nt, Bordetella pertussis
gccgcgcgacagccgcgccagcg

SEQ ID NO: 2453280 - RNA, 17 nt, Bordetella pertussis
gccgcgcgauccggcgu

SEQ ID NO: 2453281 - RNA, 21 nt, Bordetella pertussis
gccgcgcgauccggcguggua

SEQ ID NO: 2453282 - RNA, 13 nt, Bordetella pertussis
gccgcgcgauccu

SEQ ID NO: 2453283 - RNA, 19 nt, Bordetella pertussis
gccgcgcgauccuggggca

SEQ ID NO: 2453284 - RNA, 13 nt, Bordetella pertussis
gccgcgcgaucgc

SEQ ID NO: 2453285 - RNA, 14 nt, Bordetella pertussis
gccgcgcgaucgcc

SEQ ID NO: 2453286 - RNA, 22 nt, Bordetella pertussis
gccgcgcgaugcgcggcccggc

SEQ ID NO: 2453287 - RNA, 16 nt, Bordetella pertussis
gccgcgcgcaccggcu

SEQ ID NO: 2453288 - RNA, 12 nt, Bordetella pertussis
gccgcgcgcacg

SEQ ID NO: 2453289 - RNA, 13 nt, Bordetella pertussis
gccgcgcgcagcg

SEQ ID NO: 2453290 - RNA, 15 nt, Bordetella pertussis
gccgcgcgcagcgag

SEQ ID NO: 2453291 - RNA, 20 nt, Bordetella pertussis
gccgcgcgcagcgaggccuc

SEQ ID NO: 2453292 - RNA, 15 nt, Bordetella pertussis
gccgcgcgcagggcg

SEQ ID NO: 2453293 - RNA, 21 nt, Bordetella pertussis
gccgcgcgcaucacgcuggcc

SEQ ID NO: 2453294 - RNA, 15 nt, Bordetella pertussis
gccgcgcgcauccag

SEQ ID NO: 2453295 - RNA, 16 nt, Bordetella pertussis
gccgcgcgcauccagg

SEQ ID NO: 2453296 - RNA, 13 nt, Bordetella pertussis
gccgcgcgccauc

SEQ ID NO: 2453297 - RNA, 24 nt, Bordetella pertussis
gccgcgcgccauccggcgcaugau

SEQ ID NO: 2453298 - RNA, 11 nt, Bordetella pertussis
gccgcgcgccg

SEQ ID NO: 2453299 - RNA, 13 nt, Bordetella pertussis
gccgcgcgccgcg

SEQ ID NO: 2453300 - RNA, 16 nt, Bordetella pertussis
gccgcgcgccgcgccu

SEQ ID NO: 2453301 - RNA, 16 nt, Bordetella pertussis
gccgcgcgccgcggcc

SEQ ID NO: 2453302 - RNA, 13 nt, Bordetella pertussis
gccgcgcgccggc

SEQ ID NO: 2453303 - RNA, 14 nt, Bordetella pertussis
gccgcgcgccggcg

SEQ ID NO: 2453304 - RNA, 15 nt, Bordetella pertussis
gccgcgcgccggcgc

SEQ ID NO: 2453305 - RNA, 16 nt, Bordetella pertussis
gccgcgcgccucgaug

SEQ ID NO: 2453306 - RNA, 21 nt, Bordetella pertussis
gccgcgcgccucgaugauggc

SEQ ID NO: 2453307 - RNA, 23 nt, Bordetella pertussis
gccgcgcgccucgaugauggcgu

SEQ ID NO: 2453308 - RNA, 13 nt, Bordetella pertussis
gccgcgcgccugc

SEQ ID NO: 2453309 - RNA, 17 nt, Bordetella pertussis
gccgcgcgccugcagca

SEQ ID NO: 2453310 - RNA, 20 nt, Bordetella pertussis
gccgcgcgccugcagcagcg

SEQ ID NO: 2453311 - RNA, 17 nt, Bordetella pertussis
gccgcgcgccugcucgu

SEQ ID NO: 2453312 - RNA, 23 nt, Bordetella pertussis
gccgcgcgccuuccugggcgccg

SEQ ID NO: 2453313 - RNA, 14 nt, Bordetella pertussis
gccgcgcgcgacuu

SEQ ID NO: 2453314 - RNA, 23 nt, Bordetella pertussis
gccgcgcgcgacuucgccgaucg

SEQ ID NO: 2453315 - RNA, 13 nt, Bordetella pertussis
gccgcgcgcgcag

SEQ ID NO: 2453316 - RNA, 16 nt, Bordetella pertussis
gccgcgcgcgcagacg

SEQ ID NO: 2453317 - RNA, 13 nt, Bordetella pertussis
gccgcgcgcgcca

SEQ ID NO: 2453318 - RNA, 14 nt, Bordetella pertussis
gccgcgcgcgccag

SEQ ID NO: 2453319 - RNA, 16 nt, Bordetella pertussis
gccgcgcgcgccaggc

SEQ ID NO: 2453320 - RNA, 23 nt, Bordetella pertussis
gccgcgcgcggcaaugcgcgcgc

SEQ ID NO: 2453321 - RNA, 13 nt, Bordetella pertussis
gccgcgcgcggcc

SEQ ID NO: 2453322 - RNA, 20 nt, Bordetella pertussis
gccgcgcgcggccccggcuc

SEQ ID NO: 2453323 - RNA, 15 nt, Bordetella pertussis
gccgcgcgcggccgg

SEQ ID NO: 2453324 - RNA, 18 nt, Bordetella pertussis
gccgcgcgcggccggcgc

SEQ ID NO: 2453325 - RNA, 15 nt, Bordetella pertussis
gccgcgcgcggcggc

SEQ ID NO: 2453326 - RNA, 16 nt, Bordetella pertussis
gccgcgcgcggcggcc

SEQ ID NO: 2453327 - RNA, 13 nt, Bordetella pertussis
gccgcgcgcgggc

SEQ ID NO: 2453328 - RNA, 14 nt, Bordetella pertussis
gccgcgcgcgggcg

SEQ ID NO: 2453329 - RNA, 15 nt, Bordetella pertussis
gccgcgcgcgggcgc

SEQ ID NO: 2453330 - RNA, 14 nt, Bordetella pertussis
gccgcgcgcgucgc

SEQ ID NO: 2453331 - RNA, 17 nt, Bordetella pertussis
gccgcgcgcgucgccgc

SEQ ID NO: 2453332 - RNA, 21 nt, Bordetella pertussis
gccgcgcgcgucgccgcuggc

SEQ ID NO: 2453333 - RNA, 22 nt, Bordetella pertussis
gccgcgcgcgucgccgcuggcc

SEQ ID NO: 2453334 - RNA, 15 nt, Bordetella pertussis
gccgcgcgcgugccg

SEQ ID NO: 2453335 - RNA, 19 nt, Bordetella pertussis
gccgcgcgcgugccgcagg

SEQ ID NO: 2453336 - RNA, 14 nt, Bordetella pertussis
gccgcgcgcucaac

SEQ ID NO: 2453337 - RNA, 13 nt, Bordetella pertussis
gccgcgcgcucgg

SEQ ID NO: 2453338 - RNA, 13 nt, Bordetella pertussis
gccgcgcgcuggc

SEQ ID NO: 2453339 - RNA, 21 nt, Bordetella pertussis
gccgcgcgcuggcugugcccg

SEQ ID NO: 2453340 - RNA, 13 nt, Bordetella pertussis
gccgcgcgcuggu

SEQ ID NO: 2453341 - RNA, 15 nt, Bordetella pertussis
gccgcgcgcuggucg

SEQ ID NO: 2453342 - RNA, 20 nt, Bordetella pertussis
gccgcgcgcuucaggcgccg

SEQ ID NO: 2453343 - RNA, 21 nt, Bordetella pertussis
gccgcgcgcuucaggcgccgc

SEQ ID NO: 2453344 - RNA, 22 nt, Bordetella pertussis
gccgcgcgcuuccucgaccagg

SEQ ID NO: 2453345 - RNA, 12 nt, Bordetella pertussis
gccgcgcggccg

SEQ ID NO: 2453346 - RNA, 21 nt, Bordetella pertussis
gccgcgcggccgucaggcguu

SEQ ID NO: 2453347 - RNA, 12 nt, Bordetella pertussis
gccgcgcggcgc

SEQ ID NO: 2453348 - RNA, 14 nt, Bordetella pertussis
gccgcgcggcgccu

SEQ ID NO: 2453349 - RNA, 13 nt, Bordetella pertussis
gccgcgcggcgcg

SEQ ID NO: 2453350 - RNA, 14 nt, Bordetella pertussis
gccgcgcggcgcgu

SEQ ID NO: 2453351 - RNA, 17 nt, Bordetella pertussis
gccgcgcggcgcguuca

SEQ ID NO: 2453352 - RNA, 18 nt, Bordetella pertussis
gccgcgcggcggaucggc

SEQ ID NO: 2453353 - RNA, 19 nt, Bordetella pertussis
gccgcgcggcguauggcgc

SEQ ID NO: 2453354 - RNA, 18 nt, Bordetella pertussis
gccgcgcgguacgcaccg

SEQ ID NO: 2453355 - RNA, 20 nt, Bordetella pertussis
gccgcgcgguacgcaccgcc

SEQ ID NO: 2453356 - RNA, 21 nt, Bordetella pertussis
gccgcgcgguacgcaccgccg

SEQ ID NO: 2453357 - RNA, 18 nt, Bordetella pertussis
gccgcgcggucgccaucg

SEQ ID NO: 2453358 - RNA, 18 nt, Bordetella pertussis
gccgcgcguacgcggcgc

SEQ ID NO: 2453359 - RNA, 22 nt, Bordetella pertussis
gccgcgcguaugcaccgggccg

SEQ ID NO: 2453360 - RNA, 12 nt, Bordetella pertussis
gccgcgcgugcg

SEQ ID NO: 2453361 - RNA, 18 nt, Bordetella pertussis
gccgcgcucagcaccagg

SEQ ID NO: 2453362 - RNA, 21 nt, Bordetella pertussis
gccgcgcucagcaccaggccg

SEQ ID NO: 2453363 - RNA, 23 nt, Bordetella pertussis
gccgcgcucagcaccaggccgcc

SEQ ID NO: 2453364 - RNA, 13 nt, Bordetella pertussis
gccgcgcucaggc

SEQ ID NO: 2453365 - RNA, 14 nt, Bordetella pertussis
gccgcgcucaggcc

SEQ ID NO: 2453366 - RNA, 17 nt, Bordetella pertussis
gccgcgcucaggccgcu

SEQ ID NO: 2453367 - RNA, 18 nt, Bordetella pertussis
gccgcgcucaggccgcug

SEQ ID NO: 2453368 - RNA, 19 nt, Bordetella pertussis
gccgcgcuccagggcgucg

SEQ ID NO: 2453369 - RNA, 22 nt, Bordetella pertussis
gccgcgcuccagggcgucggcg

SEQ ID NO: 2453370 - RNA, 23 nt, Bordetella pertussis
gccgcgcuccagggcgucggcga

SEQ ID NO: 2453371 - RNA, 15 nt, Bordetella pertussis
gccgcgcucgcgcca

SEQ ID NO: 2453372 - RNA, 18 nt, Bordetella pertussis
gccgcgcucgcgccaggc

SEQ ID NO: 2453373 - RNA, 19 nt, Bordetella pertussis
gccgcgcucgcgccaggcc

SEQ ID NO: 2453374 - RNA, 20 nt, Bordetella pertussis
gccgcgcucgcgccaggccc

SEQ ID NO: 2453375 - RNA, 21 nt, Bordetella pertussis
gccgcgcucgcgccaggcccc

SEQ ID NO: 2453376 - RNA, 14 nt, Bordetella pertussis
gccgcgcucggcgc

SEQ ID NO: 2453377 - RNA, 17 nt, Bordetella pertussis
gccgcgcucggcgcugc

SEQ ID NO: 2453378 - RNA, 14 nt, Bordetella pertussis
gccgcgcugauccu

SEQ ID NO: 2453379 - RNA, 13 nt, Bordetella pertussis
gccgcgcugccag

SEQ ID NO: 2453380 - RNA, 22 nt, Bordetella pertussis
gccgcgcugccugaaaccgcag

SEQ ID NO: 2453381 - RNA, 19 nt, Bordetella pertussis
gccgcgcugcugcaggccg

SEQ ID NO: 2453382 - RNA, 23 nt, Bordetella pertussis
gccgcgcugcugcaggccggcgc

SEQ ID NO: 2453383 - RNA, 23 nt, Bordetella pertussis
gccgcgcuggaagacguggcccg

SEQ ID NO: 2453384 - RNA, 21 nt, Bordetella pertussis
gccgcgcuggcgcuggccgcc

SEQ ID NO: 2453385 - RNA, 14 nt, Bordetella pertussis
gccgcgcuggcggc

SEQ ID NO: 2453386 - RNA, 18 nt, Bordetella pertussis
gccgcgcuggcggcgcag

SEQ ID NO: 2453387 - RNA, 21 nt, Bordetella pertussis
gccgcgcuggcggcgcaggcc

SEQ ID NO: 2453388 - RNA, 16 nt, Bordetella pertussis
gccgcgcugggcgcug

SEQ ID NO: 2453389 - RNA, 21 nt, Bordetella pertussis
gccgcgcugggcgcugcugcu

SEQ ID NO: 2453390 - RNA, 17 nt, Bordetella pertussis
gccgcggaagucgggca

SEQ ID NO: 2453391 - RNA, 14 nt, Bordetella pertussis
gccgcggacccagg

SEQ ID NO: 2453392 - RNA, 15 nt, Bordetella pertussis
gccgcggacccaggc

SEQ ID NO: 2453393 - RNA, 16 nt, Bordetella pertussis
gccgcggacccaggcc

SEQ ID NO: 2453394 - RNA, 23 nt, Bordetella pertussis
gccgcggacccaggccucggcuu

SEQ ID NO: 2453395 - RNA, 19 nt, Bordetella pertussis
gccgcggacgaagccuagg

SEQ ID NO: 2453396 - RNA, 22 nt, Bordetella pertussis
gccgcggcaaauggggcggccg

SEQ ID NO: 2453397 - RNA, 16 nt, Bordetella pertussis
gccgcggcaagccgcg

SEQ ID NO: 2453398 - RNA, 19 nt, Bordetella pertussis
gccgcggcaagccgcggcg

SEQ ID NO: 2453399 - RNA, 21 nt, Bordetella pertussis
gccgcggcaggccccggcccg

SEQ ID NO: 2453400 - RNA, 17 nt, Bordetella pertussis
gccgcggcaugcugguu

SEQ ID NO: 2453401 - RNA, 13 nt, Bordetella pertussis
gccgcggccacgc

SEQ ID NO: 2453402 - RNA, 14 nt, Bordetella pertussis
gccgcggccacgcc

SEQ ID NO: 2453403 - RNA, 12 nt, Bordetella pertussis
gccgcggccagc

SEQ ID NO: 2453404 - RNA, 15 nt, Bordetella pertussis
gccgcggccagcgcc

SEQ ID NO: 2453405 - RNA, 16 nt, Bordetella pertussis
gccgcggccagcgccg

SEQ ID NO: 2453406 - RNA, 17 nt, Bordetella pertussis
gccgcggccagcgccgc

SEQ ID NO: 2453407 - RNA, 18 nt, Bordetella pertussis
gccgcggccagcgccgcg

SEQ ID NO: 2453408 - RNA, 19 nt, Bordetella pertussis
gccgcggccagcgccgcgc

SEQ ID NO: 2453409 - RNA, 15 nt, Bordetella pertussis
gccgcggccaggccc

SEQ ID NO: 2453410 - RNA, 16 nt, Bordetella pertussis
gccgcggccaggccca

SEQ ID NO: 2453411 - RNA, 17 nt, Bordetella pertussis
gccgcggccaggcccau

SEQ ID NO: 2453412 - RNA, 22 nt, Bordetella pertussis
gccgcggccaggcccaugccgc

SEQ ID NO: 2453413 - RNA, 15 nt, Bordetella pertussis
gccgcggcccagcgc

SEQ ID NO: 2453414 - RNA, 17 nt, Bordetella pertussis
gccgcggcccagcgcgg

SEQ ID NO: 2453415 - RNA, 19 nt, Bordetella pertussis
gccgcggcccagcgcggcg

SEQ ID NO: 2453416 - RNA, 22 nt, Bordetella pertussis
gccgcggcccagcgcggcggcc

SEQ ID NO: 2453417 - RNA, 15 nt, Bordetella pertussis
gccgcggccgccccc

SEQ ID NO: 2453418 - RNA, 13 nt, Bordetella pertussis
gccgcggccgccg

SEQ ID NO: 2453419 - RNA, 13 nt, Bordetella pertussis
gccgcggccggca

SEQ ID NO: 2453420 - RNA, 14 nt, Bordetella pertussis
gccgcggccggcac

SEQ ID NO: 2453421 - RNA, 13 nt, Bordetella pertussis
gccgcggccggcg

SEQ ID NO: 2453422 - RNA, 17 nt, Bordetella pertussis
gccgcggccggcgcagu

SEQ ID NO: 2453423 - RNA, 17 nt, Bordetella pertussis
gccgcggccggcggcgc

SEQ ID NO: 2453424 - RNA, 19 nt, Bordetella pertussis
gccgcggccggcggcgccg

SEQ ID NO: 2453425 - RNA, 14 nt, Bordetella pertussis
gccgcggccgggug

SEQ ID NO: 2453426 - RNA, 15 nt, Bordetella pertussis
gccgcggccuggccg

SEQ ID NO: 2453427 - RNA, 16 nt, Bordetella pertussis
gccgcggccuggccgg

SEQ ID NO: 2453428 - RNA, 14 nt, Bordetella pertussis
gccgcggcgaagcc

SEQ ID NO: 2453429 - RNA, 18 nt, Bordetella pertussis
gccgcggcgaagccuucu

SEQ ID NO: 2453430 - RNA, 21 nt, Bordetella pertussis
gccgcggcgaugccggccagc

SEQ ID NO: 2453431 - RNA, 12 nt, Bordetella pertussis
gccgcggcgccg

SEQ ID NO: 2453432 - RNA, 12 nt, Bordetella pertussis
gccgcggcgcgc

SEQ ID NO: 2453433 - RNA, 17 nt, Bordetella pertussis
gccgcggcgcgcgcggc

SEQ ID NO: 2453434 - RNA, 18 nt, Bordetella pertussis
gccgcggcgcgcgcggcg

SEQ ID NO: 2453435 - RNA, 19 nt, Bordetella pertussis
gccgcggcgcgcgcggcgc

SEQ ID NO: 2453436 - RNA, 15 nt, Bordetella pertussis
gccgcggcgcggccc

SEQ ID NO: 2453437 - RNA, 18 nt, Bordetella pertussis
gccgcggcgcggcccgcc

SEQ ID NO: 2453438 - RNA, 19 nt, Bordetella pertussis
gccgcggcgcggcccgcca

SEQ ID NO: 2453439 - RNA, 21 nt, Bordetella pertussis
gccgcggcgcggcccgccacg

SEQ ID NO: 2453440 - RNA, 13 nt, Bordetella pertussis
gccgcggcggcga

SEQ ID NO: 2453441 - RNA, 21 nt, Bordetella pertussis
gccgcggcggcgagggcgucg

SEQ ID NO: 2453442 - RNA, 11 nt, Bordetella pertussis
gccgcggcggg

SEQ ID NO: 2453443 - RNA, 14 nt, Bordetella pertussis
gccgcggcguccgc

SEQ ID NO: 2453444 - RNA, 12 nt, Bordetella pertussis
gccgcggcgugc

SEQ ID NO: 2453445 - RNA, 13 nt, Bordetella pertussis
gccgcggcgugcu

SEQ ID NO: 2453446 - RNA, 18 nt, Bordetella pertussis
gccgcggcgugcugcccg

SEQ ID NO: 2453447 - RNA, 16 nt, Bordetella pertussis
gccgcggcuugccgcg

SEQ ID NO: 2453448 - RNA, 17 nt, Bordetella pertussis
gccgcggcuugccgcgg

SEQ ID NO: 2453449 - RNA, 19 nt, Bordetella pertussis
gccgcggcuugccgcggcg

SEQ ID NO: 2453450 - RNA, 18 nt, Bordetella pertussis
gccgcgggcaaagcccag

SEQ ID NO: 2453451 - RNA, 20 nt, Bordetella pertussis
gccgcgggcaaagcccagca

SEQ ID NO: 2453452 - RNA, 15 nt, Bordetella pertussis
gccgcgggccgcugg

SEQ ID NO: 2453453 - RNA, 18 nt, Bordetella pertussis
gccgcgggccgcuggucg

SEQ ID NO: 2453454 - RNA, 23 nt, Bordetella pertussis
gccgcgggccuacuugccggcgc

SEQ ID NO: 2453455 - RNA, 14 nt, Bordetella pertussis
gccgcgggcgccgc

SEQ ID NO: 2453456 - RNA, 16 nt, Bordetella pertussis
gccgcgggcgccgcgc

SEQ ID NO: 2453457 - RNA, 16 nt, Bordetella pertussis
gccgcgggcggccacg

SEQ ID NO: 2453458 - RNA, 21 nt, Bordetella pertussis
gccgcgggcggccacgcgccg

SEQ ID NO: 2453459 - RNA, 13 nt, Bordetella pertussis
gccgcgggcggcg

SEQ ID NO: 2453460 - RNA, 18 nt, Bordetella pertussis
gccgcgggcggcgccggc

SEQ ID NO: 2453461 - RNA, 21 nt, Bordetella pertussis
gccgcgggcggcgccggccgc

SEQ ID NO: 2453462 - RNA, 17 nt, Bordetella pertussis
gccgcgggcggcgcgcc

SEQ ID NO: 2453463 - RNA, 18 nt, Bordetella pertussis
gccgcgggcggcgcgccc

SEQ ID NO: 2453464 - RNA, 22 nt, Bordetella pertussis
gccgcgggcggcgcgcccagcg

SEQ ID NO: 2453465 - RNA, 14 nt, Bordetella pertussis
gccgcgggcgugcu

SEQ ID NO: 2453466 - RNA, 16 nt, Bordetella pertussis
gccgcgggcgugcugg

SEQ ID NO: 2453467 - RNA, 18 nt, Bordetella pertussis
gccgcggggcuggccagc

SEQ ID NO: 2453468 - RNA, 19 nt, Bordetella pertussis
gccgcggggcuggccagcu

SEQ ID NO: 2453469 - RNA, 21 nt, Bordetella pertussis
gccgcggggcuggccagcugg

SEQ ID NO: 2453470 - RNA, 18 nt, Bordetella pertussis
gccgcggguggccgcucc

SEQ ID NO: 2453471 - RNA, 20 nt, Bordetella pertussis
gccgcggguggccgcuccag

SEQ ID NO: 2453472 - RNA, 14 nt, Bordetella pertussis
gccgcgggugucgc

SEQ ID NO: 2453473 - RNA, 21 nt, Bordetella pertussis
gccgcgggugucgcuccccca

SEQ ID NO: 2453474 - RNA, 19 nt, Bordetella pertussis
gccgcgguaaugacgcagc

SEQ ID NO: 2453475 - RNA, 21 nt, Bordetella pertussis
gccgcgguaaugacgcagccg

SEQ ID NO: 2453476 - RNA, 22 nt, Bordetella pertussis
gccgcgguaaugacgcagccgc

SEQ ID NO: 2453477 - RNA, 15 nt, Bordetella pertussis
gccgcggucagccag

SEQ ID NO: 2453478 - RNA, 14 nt, Bordetella pertussis
gccgcgguccgggc

SEQ ID NO: 2453479 - RNA, 15 nt, Bordetella pertussis
gccgcgguccgggcc

SEQ ID NO: 2453480 - RNA, 17 nt, Bordetella pertussis
gccgcgguccgggccau

SEQ ID NO: 2453481 - RNA, 17 nt, Bordetella pertussis
gccgcggucgcagacga

SEQ ID NO: 2453482 - RNA, 13 nt, Bordetella pertussis
gccgcggugcugg

SEQ ID NO: 2453483 - RNA, 14 nt, Bordetella pertussis
gccgcggugcuggg

SEQ ID NO: 2453484 - RNA, 15 nt, Bordetella pertussis
gccgcggugcugggc

SEQ ID NO: 2453485 - RNA, 16 nt, Bordetella pertussis
gccgcgguggcgggcg

SEQ ID NO: 2453486 - RNA, 18 nt, Bordetella pertussis
gccgcgguggcgggcgug

SEQ ID NO: 2453487 - RNA, 17 nt, Bordetella pertussis
gccgcggugguccagau

SEQ ID NO: 2453488 - RNA, 19 nt, Bordetella pertussis
gccgcgguugcgguucugg

SEQ ID NO: 2453489 - RNA, 18 nt, Bordetella pertussis
gccgcguacaacgccgcg

SEQ ID NO: 2453490 - RNA, 22 nt, Bordetella pertussis
gccgcguacaacgccgcguccg

SEQ ID NO: 2453491 - RNA, 23 nt, Bordetella pertussis
gccgcguacaacgccgcguccgc

SEQ ID NO: 2453492 - RNA, 23 nt, Bordetella pertussis
gccgcguaggcggucagcuggaa

SEQ ID NO: 2453493 - RNA, 14 nt, Bordetella pertussis
gccgcguaugcggc

SEQ ID NO: 2453494 - RNA, 18 nt, Bordetella pertussis
gccgcguaugcggcagca

SEQ ID NO: 2453495 - RNA, 19 nt, Bordetella pertussis
gccgcguaugcggcagcag

SEQ ID NO: 2453496 - RNA, 24 nt, Bordetella pertussis
gccgcguaugcggcagcagggcca

SEQ ID NO: 2453497 - RNA, 14 nt, Bordetella pertussis
gccgcgucauggcg

SEQ ID NO: 2453498 - RNA, 13 nt, Bordetella pertussis
gccgcguccagcg

SEQ ID NO: 2453499 - RNA, 14 nt, Bordetella pertussis
gccgcguccagcgc

SEQ ID NO: 2453500 - RNA, 15 nt, Bordetella pertussis
gccgcguccagcgcg

SEQ ID NO: 2453501 - RNA, 19 nt, Bordetella pertussis
gccgcguccagcgcgcggc

SEQ ID NO: 2453502 - RNA, 20 nt, Bordetella pertussis
gccgcguccagcgcgcggcc

SEQ ID NO: 2453503 - RNA, 20 nt, Bordetella pertussis
gccgcgucccgugccggccg

SEQ ID NO: 2453504 - RNA, 21 nt, Bordetella pertussis
gccgcgucccgugccggccgg

SEQ ID NO: 2453505 - RNA, 23 nt, Bordetella pertussis
gccgcgucccgugccggccggac

SEQ ID NO: 2453506 - RNA, 12 nt, Bordetella pertussis
gccgcguccgcc

SEQ ID NO: 2453507 - RNA, 15 nt, Bordetella pertussis
gccgcguccgcccgc

SEQ ID NO: 2453508 - RNA, 16 nt, Bordetella pertussis
gccgcguccggcgccc

SEQ ID NO: 2453509 - RNA, 21 nt, Bordetella pertussis
gccgcguccggcgcccgccgc

SEQ ID NO: 2453510 - RNA, 18 nt, Bordetella pertussis
gccgcguccucggccugg

SEQ ID NO: 2453511 - RNA, 14 nt, Bordetella pertussis
gccgcgucgagcgc

SEQ ID NO: 2453512 - RNA, 14 nt, Bordetella pertussis
gccgcgucgaucag

SEQ ID NO: 2453513 - RNA, 17 nt, Bordetella pertussis
gccgcgucgaucagcgc

SEQ ID NO: 2453514 - RNA, 14 nt, Bordetella pertussis
gccgcgucgcuggc

SEQ ID NO: 2453515 - RNA, 15 nt, Bordetella pertussis
gccgcgucgcuggcc

SEQ ID NO: 2453516 - RNA, 16 nt, Bordetella pertussis
gccgcgucgcuggccg

SEQ ID NO: 2453517 - RNA, 13 nt, Bordetella pertussis
gccgcgucggccu

SEQ ID NO: 2453518 - RNA, 14 nt, Bordetella pertussis
gccgcgucggccuc

SEQ ID NO: 2453519 - RNA, 19 nt, Bordetella pertussis
gccgcgucggcgccgauca

SEQ ID NO: 2453520 - RNA, 18 nt, Bordetella pertussis
gccgcgucuucggcgcgg

SEQ ID NO: 2453521 - RNA, 19 nt, Bordetella pertussis
gccgcgucuucggcgcggc

SEQ ID NO: 2453522 - RNA, 20 nt, Bordetella pertussis
gccgcgucuucggcgcggcg

SEQ ID NO: 2453523 - RNA, 23 nt, Bordetella pertussis
gccgcgucuucggcgcggcgggc

SEQ ID NO: 2453524 - RNA, 21 nt, Bordetella pertussis
gccgcgugcccgcguccacca

SEQ ID NO: 2453525 - RNA, 12 nt, Bordetella pertussis
gccgcgugcgcc

SEQ ID NO: 2453526 - RNA, 20 nt, Bordetella pertussis
gccgcguggauuuugcggaa

SEQ ID NO: 2453527 - RNA, 18 nt, Bordetella pertussis
gccgcguggccgcgcugc

SEQ ID NO: 2453528 - RNA, 19 nt, Bordetella pertussis
gccgcguggccgcgcugcu

SEQ ID NO: 2453529 - RNA, 16 nt, Bordetella pertussis
gccgcguggcggcgca

SEQ ID NO: 2453530 - RNA, 23 nt, Bordetella pertussis
gccgcguggcggcgcagcgccca

SEQ ID NO: 2453531 - RNA, 17 nt, Bordetella pertussis
gccgcgugguggcgcag

SEQ ID NO: 2453532 - RNA, 23 nt, Bordetella pertussis
gccgcgugguggcgcagaugggc

SEQ ID NO: 2453533 - RNA, 21 nt, Bordetella pertussis
gccgcguucacgccggcgcgc

SEQ ID NO: 2453534 - RNA, 19 nt, Bordetella pertussis
gccgcguugcagccacagg

SEQ ID NO: 2453535 - RNA, 21 nt, Bordetella pertussis
gccgcguugcagccacaggcc

SEQ ID NO: 2453536 - RNA, 16 nt, Bordetella pertussis
gccgcguugcgcgacu

SEQ ID NO: 2453537 - RNA, 17 nt, Bordetella pertussis
gccgcguugcgcgacuu

SEQ ID NO: 2453538 - RNA, 22 nt, Bordetella pertussis
gccgcguuucccucggugcugc

SEQ ID NO: 2453539 - RNA, 23 nt, Bordetella pertussis
gccgcguuucccucggugcugcu

SEQ ID NO: 2453540 - RNA, 14 nt, Bordetella pertussis
gccgcuacggcggu

SEQ ID NO: 2453541 - RNA, 16 nt, Bordetella pertussis
gccgcuaggccuugcc

SEQ ID NO: 2453542 - RNA, 19 nt, Bordetella pertussis
gccgcuaggccuugccgcc

SEQ ID NO: 2453543 - RNA, 14 nt, Bordetella pertussis
gccgcucagcgcgg

SEQ ID NO: 2453544 - RNA, 16 nt, Bordetella pertussis
gccgcucagcgcggcg

SEQ ID NO: 2453545 - RNA, 18 nt, Bordetella pertussis
gccgcucagcgcggcgcg

SEQ ID NO: 2453546 - RNA, 21 nt, Bordetella pertussis
gccgcucagcgcggcgcggcc

SEQ ID NO: 2453547 - RNA, 14 nt, Bordetella pertussis
gccgcucagguaga

SEQ ID NO: 2453548 - RNA, 17 nt, Bordetella pertussis
gccgcucagguagacca

SEQ ID NO: 2453549 - RNA, 22 nt, Bordetella pertussis
gccgcucagguagaccacgcgc

SEQ ID NO: 2453550 - RNA, 23 nt, Bordetella pertussis
gccgcucagguagaccacgcgcu

SEQ ID NO: 2453551 - RNA, 23 nt, Bordetella pertussis
gccgcucaguucuucgacgggga

SEQ ID NO: 2453552 - RNA, 14 nt, Bordetella pertussis
gccgcuccagagcg

SEQ ID NO: 2453553 - RNA, 17 nt, Bordetella pertussis
gccgcuccagagcgcgc

SEQ ID NO: 2453554 - RNA, 19 nt, Bordetella pertussis
gccgcuccagagcgcgcac

SEQ ID NO: 2453555 - RNA, 16 nt, Bordetella pertussis
gccgcuccagccacca

SEQ ID NO: 2453556 - RNA, 14 nt, Bordetella pertussis
gccgcuccgccaug

SEQ ID NO: 2453557 - RNA, 16 nt, Bordetella pertussis
gccgcuccgccaugga

SEQ ID NO: 2453558 - RNA, 23 nt, Bordetella pertussis
gccgcuccggcaugaaacggcaa

SEQ ID NO: 2453559 - RNA, 16 nt, Bordetella pertussis
gccgcucgacgucgcc

SEQ ID NO: 2453560 - RNA, 20 nt, Bordetella pertussis
gccgcucgacgucgcccugg

SEQ ID NO: 2453561 - RNA, 13 nt, Bordetella pertussis
gccgcucgcgcga

SEQ ID NO: 2453562 - RNA, 15 nt, Bordetella pertussis
gccgcucgcgcgacc

SEQ ID NO: 2453563 - RNA, 23 nt, Bordetella pertussis
gccgcucgcgcgaccacuggcag

SEQ ID NO: 2453564 - RNA, 17 nt, Bordetella pertussis
gccgcucggccacgcgc

SEQ ID NO: 2453565 - RNA, 19 nt, Bordetella pertussis
gccgcucguaguguuccug

SEQ ID NO: 2453566 - RNA, 22 nt, Bordetella pertussis
gccgcugaacguguaggucagc

SEQ ID NO: 2453567 - RNA, 14 nt, Bordetella pertussis
gccgcugaccagca

SEQ ID NO: 2453568 - RNA, 13 nt, Bordetella pertussis
gccgcugaccggc

SEQ ID NO: 2453569 - RNA, 14 nt, Bordetella pertussis
gccgcugaccggcg

SEQ ID NO: 2453570 - RNA, 15 nt, Bordetella pertussis
gccgcugaccggcgg

SEQ ID NO: 2453571 - RNA, 15 nt, Bordetella pertussis
gccgcugacugggcg

SEQ ID NO: 2453572 - RNA, 17 nt, Bordetella pertussis
gccgcugaucuuccugg

SEQ ID NO: 2453573 - RNA, 22 nt, Bordetella pertussis
gccgcugaucuuccugggcgaa

SEQ ID NO: 2453574 - RNA, 20 nt, Bordetella pertussis
gccgcugaugcuggcauuga

SEQ ID NO: 2453575 - RNA, 16 nt, Bordetella pertussis
gccgcugauggcgguc

SEQ ID NO: 2453576 - RNA, 17 nt, Bordetella pertussis
gccgcugcagcacgcac

SEQ ID NO: 2453577 - RNA, 14 nt, Bordetella pertussis
gccgcugcagcgcu

SEQ ID NO: 2453578 - RNA, 17 nt, Bordetella pertussis
gccgcugcagcgcuggu

SEQ ID NO: 2453579 - RNA, 14 nt, Bordetella pertussis
gccgcugcaggccc

SEQ ID NO: 2453580 - RNA, 12 nt, Bordetella pertussis
gccgcugcaugg

SEQ ID NO: 2453581 - RNA, 13 nt, Bordetella pertussis
gccgcugcccagc

SEQ ID NO: 2453582 - RNA, 15 nt, Bordetella pertussis
gccgcugccgcgcgc

SEQ ID NO: 2453583 - RNA, 21 nt, Bordetella pertussis
gccgcugccggccgaccggcg

SEQ ID NO: 2453584 - RNA, 14 nt, Bordetella pertussis
gccgcugccgggcu

SEQ ID NO: 2453585 - RNA, 22 nt, Bordetella pertussis
gccgcugcgaaaaagcccgcgc

SEQ ID NO: 2453586 - RNA, 15 nt, Bordetella pertussis
gccgcugcgcgcggc

SEQ ID NO: 2453587 - RNA, 17 nt, Bordetella pertussis
gccgcugcgcgcggccu

SEQ ID NO: 2453588 - RNA, 19 nt, Bordetella pertussis
gccgcugcgcgcggccugg

SEQ ID NO: 2453589 - RNA, 21 nt, Bordetella pertussis
gccgcugcgcgcggccuggcg

SEQ ID NO: 2453590 - RNA, 16 nt, Bordetella pertussis
gccgcugcgcggucac

SEQ ID NO: 2453591 - RNA, 16 nt, Bordetella pertussis
gccgcugcgcuggccg

SEQ ID NO: 2453592 - RNA, 18 nt, Bordetella pertussis
gccgcugcgcuggccgcg

SEQ ID NO: 2453593 - RNA, 23 nt, Bordetella pertussis
gccgcuggacagauccagcgcgg

SEQ ID NO: 2453594 - RNA, 18 nt, Bordetella pertussis
gccgcuggauuucgccgc

SEQ ID NO: 2453595 - RNA, 20 nt, Bordetella pertussis
gccgcuggauuucgccgcgu

SEQ ID NO: 2453596 - RNA, 12 nt, Bordetella pertussis
gccgcuggccac

SEQ ID NO: 2453597 - RNA, 13 nt, Bordetella pertussis
gccgcuggccacg

SEQ ID NO: 2453598 - RNA, 13 nt, Bordetella pertussis
gccgcuggccagc

SEQ ID NO: 2453599 - RNA, 15 nt, Bordetella pertussis
gccgcuggccagccg

SEQ ID NO: 2453600 - RNA, 21 nt, Bordetella pertussis
gccgcuggcgaucaggccgcc

SEQ ID NO: 2453601 - RNA, 13 nt, Bordetella pertussis
gccgcuggcgaug

SEQ ID NO: 2453602 - RNA, 15 nt, Bordetella pertussis
gccgcuggcgcgccg

SEQ ID NO: 2453603 - RNA, 16 nt, Bordetella pertussis
gccgcuggcgcgccgc

SEQ ID NO: 2453604 - RNA, 17 nt, Bordetella pertussis
gccgcuggcgcgccgcc

SEQ ID NO: 2453605 - RNA, 15 nt, Bordetella pertussis
gccgcuggcggcccu

SEQ ID NO: 2453606 - RNA, 16 nt, Bordetella pertussis
gccgcuggcggcccug

SEQ ID NO: 2453607 - RNA, 19 nt, Bordetella pertussis
gccgcuggcggcccugccg

SEQ ID NO: 2453608 - RNA, 14 nt, Bordetella pertussis
gccgcuggcggccg

SEQ ID NO: 2453609 - RNA, 16 nt, Bordetella pertussis
gccgcuggcggccgcg

SEQ ID NO: 2453610 - RNA, 23 nt, Bordetella pertussis
gccgcuggcggccgcgggcgugc

SEQ ID NO: 2453611 - RNA, 21 nt, Bordetella pertussis
gccgcuggcgucgcgcuucuu

SEQ ID NO: 2453612 - RNA, 12 nt, Bordetella pertussis
gccgcugggcac

SEQ ID NO: 2453613 - RNA, 13 nt, Bordetella pertussis
gccgcugggcaca

SEQ ID NO: 2453614 - RNA, 18 nt, Bordetella pertussis
gccgcugggcacauccag

SEQ ID NO: 2453615 - RNA, 16 nt, Bordetella pertussis
gccgcuggucaccgcc

SEQ ID NO: 2453616 - RNA, 18 nt, Bordetella pertussis
gccgcuggugcugagacg

SEQ ID NO: 2453617 - RNA, 14 nt, Bordetella pertussis
gccgcugguggcca

SEQ ID NO: 2453618 - RNA, 22 nt, Bordetella pertussis
gccgcuguagaaguaguucggc

SEQ ID NO: 2453619 - RNA, 14 nt, Bordetella pertussis
gccgcugucgaccu

SEQ ID NO: 2453620 - RNA, 19 nt, Bordetella pertussis
gccgcugucgcaggcgcug

SEQ ID NO: 2453621 - RNA, 23 nt, Bordetella pertussis
gccgcugucgcugaucugcuuga

SEQ ID NO: 2453622 - RNA, 18 nt, Bordetella pertussis
gccgcuguggacgccgcc

SEQ ID NO: 2453623 - RNA, 19 nt, Bordetella pertussis
gccgcuguggacgccgccg

SEQ ID NO: 2453624 - RNA, 21 nt, Bordetella pertussis
gccgcuguggacgccgccggc

SEQ ID NO: 2453625 - RNA, 22 nt, Bordetella pertussis
gccgcuguggacgccgccggcc

SEQ ID NO: 2453626 - RNA, 15 nt, Bordetella pertussis
gccgcuguggcgcgc

SEQ ID NO: 2453627 - RNA, 17 nt, Bordetella pertussis
gccgcuguggcgcgcca

SEQ ID NO: 2453628 - RNA, 22 nt, Bordetella pertussis
gccgcuguucggcgagccgggc

SEQ ID NO: 2453629 - RNA, 20 nt, Bordetella pertussis
gccgcuguugaggaugugca

SEQ ID NO: 2453630 - RNA, 14 nt, Bordetella pertussis
gccgcuuccggccg

SEQ ID NO: 2453631 - RNA, 17 nt, Bordetella pertussis
gccgcuucgaugcuggc

SEQ ID NO: 2453632 - RNA, 19 nt, Bordetella pertussis
gccgcuucgaugcuggcgg

SEQ ID NO: 2453633 - RNA, 14 nt, Bordetella pertussis
gccgcuucggccug

SEQ ID NO: 2453634 - RNA, 21 nt, Bordetella pertussis
gccgcuucggccugcgccacc

SEQ ID NO: 2453635 - RNA, 22 nt, Bordetella pertussis
gccgcuucggccugcgccacca

SEQ ID NO: 2453636 - RNA, 16 nt, Bordetella pertussis
gccgcuucggcggcca

SEQ ID NO: 2453637 - RNA, 18 nt, Bordetella pertussis
gccgcuucggcggccgcg

SEQ ID NO: 2453638 - RNA, 16 nt, Bordetella pertussis
gccgcuucgugcggcc

SEQ ID NO: 2453639 - RNA, 17 nt, Bordetella pertussis
gccgcuucgugcggccg

SEQ ID NO: 2453640 - RNA, 19 nt, Bordetella pertussis
gccgcuucgugcggccgca

SEQ ID NO: 2453641 - RNA, 22 nt, Bordetella pertussis
gccgcuucgugcggccgcagca

SEQ ID NO: 2453642 - RNA, 23 nt, Bordetella pertussis
gccgcuugaaguaaucgcccggc

SEQ ID NO: 2453643 - RNA, 17 nt, Bordetella pertussis
gccgcuugcccgucaug

SEQ ID NO: 2453644 - RNA, 20 nt, Bordetella pertussis
gccgcuugcguucaugccgg

SEQ ID NO: 2453645 - RNA, 20 nt, Bordetella pertussis
gccgcuuggccugcgccacc

SEQ ID NO: 2453646 - RNA, 17 nt, Bordetella pertussis
gccgcuugucgaugacg

SEQ ID NO: 2453647 - RNA, 22 nt, Bordetella pertussis
gccgcuugucgaugacgcgccg

SEQ ID NO: 2453648 - RNA, 16 nt, Bordetella pertussis
gccgcuuucgaccagc

SEQ ID NO: 2453649 - RNA, 19 nt, Bordetella pertussis
gccgcuuucgaccagcgac

SEQ ID NO: 2453650 - RNA, 20 nt, Bordetella pertussis
gccgcuuucgaccagcgaca

SEQ ID NO: 2453651 - RNA, 14 nt, Bordetella pertussis
gccgcuuucgaccu

SEQ ID NO: 2453652 - RNA, 20 nt, Bordetella pertussis
gccgcuuucgaccuugcuga

SEQ ID NO: 2453653 - RNA, 22 nt, Bordetella pertussis
gccgcuuucgaccuugcugacg

SEQ ID NO: 2453654 - RNA, 18 nt, Bordetella pertussis
gccgcuuucucccgccgc

SEQ ID NO: 2453655 - RNA, 14 nt, Bordetella pertussis
gccggaaacgcggu

SEQ ID NO: 2453656 - RNA, 16 nt, Bordetella pertussis
gccggaaagcugucca

SEQ ID NO: 2453657 - RNA, 19 nt, Bordetella pertussis
gccggaaagcuguccacgc

SEQ ID NO: 2453658 - RNA, 17 nt, Bordetella pertussis
gccggaaaucacgaucu

SEQ ID NO: 2453659 - RNA, 16 nt, Bordetella pertussis
gccggaaaugccgcgc

SEQ ID NO: 2453660 - RNA, 17 nt, Bordetella pertussis
gccggaaaugccgcgcg

SEQ ID NO: 2453661 - RNA, 20 nt, Bordetella pertussis
gccggaaaugccgcgcgcag

SEQ ID NO: 2453662 - RNA, 14 nt, Bordetella pertussis
gccggaacagcguc

SEQ ID NO: 2453663 - RNA, 15 nt, Bordetella pertussis
gccggaacaggcgcc

SEQ ID NO: 2453664 - RNA, 16 nt, Bordetella pertussis
gccggaaugcaccacg

SEQ ID NO: 2453665 - RNA, 16 nt, Bordetella pertussis
gccggcaggccggcca

SEQ ID NO: 2453666 - RNA, 17 nt, Bordetella pertussis
gccggcaggccggccag

SEQ ID NO: 2453667 - RNA, 19 nt, Bordetella pertussis
gccggcaggccggccagca

SEQ ID NO: 2453668 - RNA, 13 nt, Bordetella pertussis
gccggcaggcgcg

SEQ ID NO: 2453669 - RNA, 16 nt, Bordetella pertussis
gccggcaggcgcgcca

SEQ ID NO: 2453670 - RNA, 20 nt, Bordetella pertussis
gccggcaggcgcgccagccc

SEQ ID NO: 2453671 - RNA, 19 nt, Bordetella pertussis
gccggcagggccagcgcca

SEQ ID NO: 2453672 - RNA, 22 nt, Bordetella pertussis
gccggcagggccagcgccagca

SEQ ID NO: 2453673 - RNA, 14 nt, Bordetella pertussis
gccggcagggcggc

SEQ ID NO: 2453674 - RNA, 15 nt, Bordetella pertussis
gccggcagggcggcc

SEQ ID NO: 2453675 - RNA, 22 nt, Bordetella pertussis
gccggcagggcggccaggccgg

SEQ ID NO: 2453676 - RNA, 19 nt, Bordetella pertussis
gccggcagggugcuguuca

SEQ ID NO: 2453677 - RNA, 15 nt, Bordetella pertussis
gccggcaggucgaug

SEQ ID NO: 2453678 - RNA, 14 nt, Bordetella pertussis
gccggcagugccug

SEQ ID NO: 2453679 - RNA, 15 nt, Bordetella pertussis
gccggcagugccugc

SEQ ID NO: 2453680 - RNA, 16 nt, Bordetella pertussis
gccggcauaggcggcg

SEQ ID NO: 2453681 - RNA, 18 nt, Bordetella pertussis
gccggcauaggcggcgca

SEQ ID NO: 2453682 - RNA, 19 nt, Bordetella pertussis
gccggcauaggcggcgcag

SEQ ID NO: 2453683 - RNA, 20 nt, Bordetella pertussis
gccggcauaggcggcgcagg

SEQ ID NO: 2453684 - RNA, 23 nt, Bordetella pertussis
gccggcauaggcggcgcaggcca

SEQ ID NO: 2453685 - RNA, 17 nt, Bordetella pertussis
gccggcaucgcgcugac

SEQ ID NO: 2453686 - RNA, 19 nt, Bordetella pertussis
gccggcaugaagcgcagca

SEQ ID NO: 2453687 - RNA, 16 nt, Bordetella pertussis
gccggcaugcgccggc

SEQ ID NO: 2453688 - RNA, 17 nt, Bordetella pertussis
gccggcaugcgccggcc

SEQ ID NO: 2453689 - RNA, 19 nt, Bordetella pertussis
gccggcaugcgccggcccg

SEQ ID NO: 2453690 - RNA, 22 nt, Bordetella pertussis
gccggcaugcgccggcccggca

SEQ ID NO: 2453691 - RNA, 16 nt, Bordetella pertussis
gccggcauguugccgc

SEQ ID NO: 2453692 - RNA, 19 nt, Bordetella pertussis
gccggcauguugccgcugg

SEQ ID NO: 2453693 - RNA, 22 nt, Bordetella pertussis
gccggcauguugccgcuggugc

SEQ ID NO: 2453694 - RNA, 16 nt, Bordetella pertussis
gccggcauugcccacc

SEQ ID NO: 2453695 - RNA, 19 nt, Bordetella pertussis
gccggcauugcccaccacg

SEQ ID NO: 2453696 - RNA, 21 nt, Bordetella pertussis
gccggcauugcccaccacggc

SEQ ID NO: 2453697 - RNA, 14 nt, Bordetella pertussis
gccggccaacagcu

SEQ ID NO: 2453698 - RNA, 19 nt, Bordetella pertussis
gccggccaacagcucgcgc

SEQ ID NO: 2453699 - RNA, 23 nt, Bordetella pertussis
gccggccaaggcaagcagcgaga

SEQ ID NO: 2453700 - RNA, 16 nt, Bordetella pertussis
gccggccaccagcggc

SEQ ID NO: 2453701 - RNA, 18 nt, Bordetella pertussis
gccggccaccagcggcgc

SEQ ID NO: 2453702 - RNA, 21 nt, Bordetella pertussis
gccggccaccagcggcgccgg

SEQ ID NO: 2453703 - RNA, 22 nt, Bordetella pertussis
gccggccaccagcggcgccgga

SEQ ID NO: 2453704 - RNA, 15 nt, Bordetella pertussis
gccggccaccgccug

SEQ ID NO: 2453705 - RNA, 12 nt, Bordetella pertussis
gccggccacgaa

SEQ ID NO: 2453706 - RNA, 13 nt, Bordetella pertussis
gccggccacgcgc

SEQ ID NO: 2453707 - RNA, 23 nt, Bordetella pertussis
gccggccacgcgcugcagcagca

SEQ ID NO: 2453708 - RNA, 16 nt, Bordetella pertussis
gccgucggccagcuug

SEQ ID NO: 2453709 - RNA, 13 nt, Bordetella pertussis
gccgucggccagg

SEQ ID NO: 2453710 - RNA, 16 nt, Bordetella pertussis
gccgucggccgcgccc

SEQ ID NO: 2453711 - RNA, 17 nt, Bordetella pertussis
gccgucggccgcgccca

SEQ ID NO: 2453712 - RNA, 18 nt, Bordetella pertussis
gccgucggccgcgcccau

SEQ ID NO: 2453713 - RNA, 13 nt, Bordetella pertussis
gccgucggccugg

SEQ ID NO: 2453714 - RNA, 17 nt, Bordetella pertussis
gccgucggccuggaaca

SEQ ID NO: 2453715 - RNA, 17 nt, Bordetella pertussis
gccgucggcgcuggcgc

SEQ ID NO: 2453716 - RNA, 15 nt, Bordetella pertussis
gccgucggcgucgaa

SEQ ID NO: 2453717 - RNA, 21 nt, Bordetella pertussis
gccgucggcguugugccggcg

SEQ ID NO: 2453718 - RNA, 23 nt, Bordetella pertussis
gccgucggcguugugccggcgca

SEQ ID NO: 2453719 - RNA, 19 nt, Bordetella pertussis
gccgucgggcgccgcaacg

SEQ ID NO: 2453720 - RNA, 13 nt, Bordetella pertussis
gccgucggggccg

SEQ ID NO: 2453721 - RNA, 17 nt, Bordetella pertussis
gccgucgggggccggcu

SEQ ID NO: 2453722 - RNA, 23 nt, Bordetella pertussis
gccgucgggggccggcucgcccc

SEQ ID NO: 2453723 - RNA, 18 nt, Bordetella pertussis
gccgucgggguggcgucg

SEQ ID NO: 2453724 - RNA, 14 nt, Bordetella pertussis
gccgucgugcagcg

SEQ ID NO: 2453725 - RNA, 16 nt, Bordetella pertussis
gccgucgugcagcgug

SEQ ID NO: 2453726 - RNA, 19 nt, Bordetella pertussis
gccgucgugcgccuggcgg

SEQ ID NO: 2453727 - RNA, 21 nt, Bordetella pertussis
gccgucgugcgccuggcggcu

SEQ ID NO: 2453728 - RNA, 22 nt, Bordetella pertussis
gccgucgugcgccuggcggcug

SEQ ID NO: 2453729 - RNA, 20 nt, Bordetella pertussis
gccgucguugacggggacgc

SEQ ID NO: 2453730 - RNA, 18 nt, Bordetella pertussis
gccgucuacaggcccagc

SEQ ID NO: 2453731 - RNA, 21 nt, Bordetella pertussis
gccgucuacaggcccagcgcc

SEQ ID NO: 2453732 - RNA, 23 nt, Bordetella pertussis
gccgucuacaggcccagcgccag

SEQ ID NO: 2453733 - RNA, 21 nt, Bordetella pertussis
gccgucucgugccccgcaugc

SEQ ID NO: 2453734 - RNA, 15 nt, Bordetella pertussis
gccgucugcgccgcc

SEQ ID NO: 2453735 - RNA, 12 nt, Bordetella pertussis
gccgucuggcgg

SEQ ID NO: 2453736 - RNA, 14 nt, Bordetella pertussis
gccgucuggcggca

SEQ ID NO: 2453737 - RNA, 12 nt, Bordetella pertussis
gccgucugggcg

SEQ ID NO: 2453738 - RNA, 22 nt, Bordetella pertussis
gccgucugugcgccccgcuggc

SEQ ID NO: 2453739 - RNA, 20 nt, Bordetella pertussis
gccgucuugaggauaucggc

SEQ ID NO: 2453740 - RNA, 21 nt, Bordetella pertussis
gccgucuugaggauaucggcc

SEQ ID NO: 2453741 - RNA, 21 nt, Bordetella pertussis
gccgucuuggcgggcuagcug

SEQ ID NO: 2453742 - RNA, 21 nt, Bordetella pertussis
gccgugaaugcgccuggcguu

SEQ ID NO: 2453743 - RNA, 21 nt, Bordetella pertussis
gccgugaccugcucgucgcca

SEQ ID NO: 2453744 - RNA, 23 nt, Bordetella pertussis
gccgugaccugcucgucgccaug

SEQ ID NO: 2453745 - RNA, 17 nt, Bordetella pertussis
gccgugacgcugauggc

SEQ ID NO: 2453746 - RNA, 17 nt, Bordetella pertussis
gccgugacguugagcgc

SEQ ID NO: 2453747 - RNA, 19 nt, Bordetella pertussis
gccgugacuucggccgcca

SEQ ID NO: 2453748 - RNA, 20 nt, Bordetella pertussis
gccgugacuucggccgccag

SEQ ID NO: 2453749 - RNA, 21 nt, Bordetella pertussis
gccgugacuucggccgccagc

SEQ ID NO: 2453750 - RNA, 22 nt, Bordetella pertussis
gccgugacuucggccgccagcc

SEQ ID NO: 2453751 - RNA, 23 nt, Bordetella pertussis
gccgugacuucggccgccagccg

SEQ ID NO: 2453752 - RNA, 14 nt, Bordetella pertussis
gccgugagcgccgc

SEQ ID NO: 2453753 - RNA, 15 nt, Bordetella pertussis
gccgugagcgccgcc

SEQ ID NO: 2453754 - RNA, 17 nt, Bordetella pertussis
gccgugagcgccgccgc

SEQ ID NO: 2453755 - RNA, 21 nt, Bordetella pertussis
gccgugagcgccgccgccaug

SEQ ID NO: 2453756 - RNA, 18 nt, Bordetella pertussis
gccgugaggcagccucuu

SEQ ID NO: 2453757 - RNA, 18 nt, Bordetella pertussis
gccugguuagagcagcgg

SEQ ID NO: 2453758 - RNA, 15 nt, Bordetella pertussis
gccugguuggccgcc

SEQ ID NO: 2453759 - RNA, 17 nt, Bordetella pertussis
gccugguuggccgccug

SEQ ID NO: 2453760 - RNA, 15 nt, Bordetella pertussis
gccuguaucagcgcc

SEQ ID NO: 2453761 - RNA, 17 nt, Bordetella pertussis
gccuguaucagcgccug

SEQ ID NO: 2453762 - RNA, 19 nt, Bordetella pertussis
gccuguaucagcgccugca

SEQ ID NO: 2453763 - RNA, 20 nt, Bordetella pertussis
gccuguaucagcgccugcag

SEQ ID NO: 2453764 - RNA, 21 nt, Bordetella pertussis
gccuguaucagcgccugcagg

SEQ ID NO: 2453765 - RNA, 22 nt, Bordetella pertussis
gccuguaucagcgccugcaggu

SEQ ID NO: 2453766 - RNA, 18 nt, Bordetella pertussis
gccugucacaccccacca

SEQ ID NO: 2453767 - RNA, 24 nt, Bordetella pertussis
gccugucccaaccgggacaggcac

SEQ ID NO: 2453768 - RNA, 13 nt, Bordetella pertussis
gccugucccagcg

SEQ ID NO: 2453769 - RNA, 14 nt, Bordetella pertussis
gccugucccagcgg

SEQ ID NO: 2453770 - RNA, 16 nt, Bordetella pertussis
gccugucccagcgggg

SEQ ID NO: 2453771 - RNA, 20 nt, Bordetella pertussis
gccugucccagcggggacag

SEQ ID NO: 2453772 - RNA, 19 nt, Bordetella pertussis
gccugucccaggcgcucgc

SEQ ID NO: 2453773 - RNA, 18 nt, Bordetella pertussis
gccuguccccaccgggac

SEQ ID NO: 2453774 - RNA, 19 nt, Bordetella pertussis
gccuguccccacggggaca

SEQ ID NO: 2453775 - RNA, 19 nt, Bordetella pertussis
gccuguccccacguggaca

SEQ ID NO: 2453776 - RNA, 20 nt, Bordetella pertussis
gccuguccccacguggacag

SEQ ID NO: 2453777 - RNA, 11 nt, Bordetella pertussis
gccuguccccg

SEQ ID NO: 2453778 - RNA, 14 nt, Bordetella pertussis
gccuguccccgaac

SEQ ID NO: 2453779 - RNA, 17 nt, Bordetella pertussis
gccuguccccgaacggg

SEQ ID NO: 2453780 - RNA, 15 nt, Bordetella pertussis
gccuguccccgcacg

SEQ ID NO: 2453781 - RNA, 22 nt, Bordetella pertussis
gccuguccccgcacggggacag

SEQ ID NO: 2453782 - RNA, 21 nt, Bordetella pertussis
gccuguccccgcacggggacu

SEQ ID NO: 2453783 - RNA, 15 nt, Bordetella pertussis
gccuguccccgcagg

SEQ ID NO: 2453784 - RNA, 18 nt, Bordetella pertussis
gccuguccccgcaggagc

SEQ ID NO: 2453785 - RNA, 17 nt, Bordetella pertussis
gccuguccccgcaggga

SEQ ID NO: 2453786 - RNA, 19 nt, Bordetella pertussis
gccuguccccgcagggaca

SEQ ID NO: 2453787 - RNA, 20 nt, Bordetella pertussis
gccuguccccgcagggacag

SEQ ID NO: 2453788 - RNA, 15 nt, Bordetella pertussis
gccuguccccgcaug

SEQ ID NO: 2453789 - RNA, 22 nt, Bordetella pertussis
gccuguccccgccggggcaggc

SEQ ID NO: 2453790 - RNA, 14 nt, Bordetella pertussis
gccuguccccgcgg

SEQ ID NO: 2453791 - RNA, 15 nt, Bordetella pertussis
gccuguccccgcgga

SEQ ID NO: 2453792 - RNA, 15 nt, Bordetella pertussis
gccuguccccgcggg

SEQ ID NO: 2453793 - RNA, 20 nt, Bordetella pertussis
gccuguccccgcggggacag

SEQ ID NO: 2453794 - RNA, 14 nt, Bordetella pertussis
gccuguccccgcug

SEQ ID NO: 2453795 - RNA, 15 nt, Bordetella pertussis
gccuguccccgcugc

SEQ ID NO: 2453796 - RNA, 19 nt, Bordetella pertussis
gccuguccccgcugggaca

SEQ ID NO: 2453797 - RNA, 19 nt, Bordetella pertussis
gccuguccccgucgggaca

SEQ ID NO: 2453798 - RNA, 20 nt, Bordetella pertussis
gccuguccccgucgggacag

SEQ ID NO: 2453799 - RNA, 18 nt, Bordetella pertussis
gccuguccccguggggac

SEQ ID NO: 2453800 - RNA, 20 nt, Bordetella pertussis
gccugucccgacggggacag

SEQ ID NO: 2453801 - RNA, 21 nt, Bordetella pertussis
gccugucccgcacgcagcccu

SEQ ID NO: 2453802 - RNA, 23 nt, Bordetella pertussis
gccugucccgcacgcagcccuuc

SEQ ID NO: 2453803 - RNA, 18 nt, Bordetella pertussis
gccuucgucgaggucagc

SEQ ID NO: 2453804 - RNA, 21 nt, Bordetella pertussis
gccuucgucgcgcacccgcag

SEQ ID NO: 2453805 - RNA, 21 nt, Bordetella pertussis
gccuucguugaccgcuuccga

SEQ ID NO: 2453806 - RNA, 15 nt, Bordetella pertussis
gccuucuacccgcuc

SEQ ID NO: 2453807 - RNA, 20 nt, Bordetella pertussis
gccuucuucacguagccggc

SEQ ID NO: 2453808 - RNA, 20 nt, Bordetella pertussis
gccuucuucugcaucggcau

SEQ ID NO: 2453809 - RNA, 15 nt, Bordetella pertussis
gccuucuuucgcgag

SEQ ID NO: 2453810 - RNA, 13 nt, Bordetella pertussis
gccuugacggcgc

SEQ ID NO: 2453811 - RNA, 14 nt, Bordetella pertussis
gccuugacgguggc

SEQ ID NO: 2453812 - RNA, 17 nt, Bordetella pertussis
gccuugacgguggccgc

SEQ ID NO: 2453813 - RNA, 16 nt, Bordetella pertussis
gccuugagcaucugcg

SEQ ID NO: 2453814 - RNA, 19 nt, Bordetella pertussis
gccuugagcaucugcggca

SEQ ID NO: 2453815 - RNA, 16 nt, Bordetella pertussis
gccuugcccaggcugg

SEQ ID NO: 2453816 - RNA, 18 nt, Bordetella pertussis
gccuugcccgucagggua

SEQ ID NO: 2453817 - RNA, 11 nt, Bordetella pertussis
gccuugccgcc

SEQ ID NO: 2453818 - RNA, 22 nt, Bordetella pertussis
gccuugccgccgccgcgcgcgg

SEQ ID NO: 2453819 - RNA, 17 nt, Bordetella pertussis
gccuugccgccgcgcag

SEQ ID NO: 2453820 - RNA, 18 nt, Bordetella pertussis
gccuugccgccgcgcagg

SEQ ID NO: 2453821 - RNA, 21 nt, Bordetella pertussis
gccuugccgguggacggccag

SEQ ID NO: 2453822 - RNA, 19 nt, Bordetella pertussis
gccuugccguaggguucgc

SEQ ID NO: 2453823 - RNA, 19 nt, Bordetella pertussis
gccuugccuugcgcggcca

SEQ ID NO: 2453824 - RNA, 19 nt, Bordetella pertussis
gccuugcgcgacagcaggc

SEQ ID NO: 2453825 - RNA, 21 nt, Bordetella pertussis
gccuugcgcgacagcaggccg

SEQ ID NO: 2453826 - RNA, 13 nt, Bordetella pertussis
gccuugcgcggcc

SEQ ID NO: 2453827 - RNA, 14 nt, Bordetella pertussis
gccuugcgcggcca

SEQ ID NO: 2453828 - RNA, 16 nt, Bordetella pertussis
gccuugcgcggccacc

SEQ ID NO: 2453829 - RNA, 16 nt, Bordetella pertussis
gccuugcgcggccagc

SEQ ID NO: 2453830 - RNA, 22 nt, Bordetella pertussis
gccuugcgcggccagcaccggc

SEQ ID NO: 2453831 - RNA, 16 nt, Bordetella pertussis
gccuugcgcggcgagc

SEQ ID NO: 2453832 - RNA, 21 nt, Bordetella pertussis
gccuugcgcggcgagcgccgc

SEQ ID NO: 2453833 - RNA, 22 nt, Bordetella pertussis
gccuugcggcccuugcgcgaac

SEQ ID NO: 2453834 - RNA, 14 nt, Bordetella pertussis
gccuugcggcgaug

SEQ ID NO: 2453835 - RNA, 13 nt, Bordetella pertussis
gcgaagcggaccu

SEQ ID NO: 2453836 - RNA, 20 nt, Bordetella pertussis
gcgaagcgggcgccggcgcc

SEQ ID NO: 2453837 - RNA, 14 nt, Bordetella pertussis
gcgaaggccagcgc

SEQ ID NO: 2453838 - RNA, 14 nt, Bordetella pertussis
gcgaaggccgcccc

SEQ ID NO: 2453839 - RNA, 16 nt, Bordetella pertussis
gcgaaggccgccgcgc

SEQ ID NO: 2453840 - RNA, 18 nt, Bordetella pertussis
gcgaaggcgucggccaug

SEQ ID NO: 2453841 - RNA, 23 nt, Bordetella pertussis
gcgaaggcgucggccauggcgcu

SEQ ID NO: 2453842 - RNA, 17 nt, Bordetella pertussis
gcgaaggucuggucgca

SEQ ID NO: 2453843 - RNA, 18 nt, Bordetella pertussis
gcgaaggucuggucgcac

SEQ ID NO: 2453844 - RNA, 15 nt, Bordetella pertussis
gcgaagugcccgcug

SEQ ID NO: 2453845 - RNA, 21 nt, Bordetella pertussis
gcgaagugcccgcuggccaug

SEQ ID NO: 2453846 - RNA, 13 nt, Bordetella pertussis
gcgaagugccugu

SEQ ID NO: 2453847 - RNA, 16 nt, Bordetella pertussis
gcgaagugccuguccc

SEQ ID NO: 2453848 - RNA, 22 nt, Bordetella pertussis
gcgaaucaguucgcgcaggcgu

SEQ ID NO: 2453849 - RNA, 18 nt, Bordetella pertussis
gcgaauccaccggcgcgc

SEQ ID NO: 2453850 - RNA, 22 nt, Bordetella pertussis
gcgaauccaucaucagcauggc

SEQ ID NO: 2453851 - RNA, 18 nt, Bordetella pertussis
gcgaaucccuuggucggu

SEQ ID NO: 2453852 - RNA, 21 nt, Bordetella pertussis
gcgaauccgcaacccagcagc

SEQ ID NO: 2453853 - RNA, 17 nt, Bordetella pertussis
gcgaaugcgacagcgac

SEQ ID NO: 2453854 - RNA, 21 nt, Bordetella pertussis
gcgaaugcgacagcgacagcc

SEQ ID NO: 2453855 - RNA, 19 nt, Bordetella pertussis
gcgaauuccguuugagaca

SEQ ID NO: 2453856 - RNA, 18 nt, Bordetella pertussis
gcgacaaauagccgaccg

SEQ ID NO: 2453857 - RNA, 21 nt, Bordetella pertussis
gcgacaacagcuugcccggcg

SEQ ID NO: 2453858 - RNA, 20 nt, Bordetella pertussis
gcgacaacaggucguggccc

SEQ ID NO: 2453859 - RNA, 22 nt, Bordetella pertussis
gcgacacccccagggcgcgccg

SEQ ID NO: 2453860 - RNA, 15 nt, Bordetella pertussis
gcgacacccgcggcc

SEQ ID NO: 2453861 - RNA, 18 nt, Bordetella pertussis
gcgacacccgcggccagg

SEQ ID NO: 2453862 - RNA, 19 nt, Bordetella pertussis
gcgacacccgcggccaggg

SEQ ID NO: 2453863 - RNA, 13 nt, Bordetella pertussis
gcgacaccgcggc

SEQ ID NO: 2453864 - RNA, 14 nt, Bordetella pertussis
gcgacaccgcggcc

SEQ ID NO: 2453865 - RNA, 15 nt, Bordetella pertussis
gcgacaccgcggccu

SEQ ID NO: 2453866 - RNA, 20 nt, Bordetella pertussis
gcgacaccgugcgauggaac

SEQ ID NO: 2453867 - RNA, 13 nt, Bordetella pertussis
gcgacacgcagca

SEQ ID NO: 2453868 - RNA, 21 nt, Bordetella pertussis
gcgacacggcggugccgcgca

SEQ ID NO: 2453869 - RNA, 20 nt, Bordetella pertussis
gcgacagcaaugacgacgcc

SEQ ID NO: 2453870 - RNA, 21 nt, Bordetella pertussis
gcgacagcaaugacgacgccg

SEQ ID NO: 2453871 - RNA, 22 nt, Bordetella pertussis
gcgacagcaccggguaauggcg

SEQ ID NO: 2453872 - RNA, 13 nt, Bordetella pertussis
gcgacagcagcau

SEQ ID NO: 2453873 - RNA, 17 nt, Bordetella pertussis
gcgacagcagcaugcgg

SEQ ID NO: 2453874 - RNA, 17 nt, Bordetella pertussis
gcgacagcaggccgguc

SEQ ID NO: 2453875 - RNA, 12 nt, Bordetella pertussis
gcgacagcaggg

SEQ ID NO: 2453876 - RNA, 13 nt, Bordetella pertussis
gcgacagcagggu

SEQ ID NO: 2453877 - RNA, 15 nt, Bordetella pertussis
gcgacagcagggucg

SEQ ID NO: 2453878 - RNA, 13 nt, Bordetella pertussis
gcgacagccaggc

SEQ ID NO: 2453879 - RNA, 16 nt, Bordetella pertussis
gcgacagccaggccag

SEQ ID NO: 2453880 - RNA, 17 nt, Bordetella pertussis
gcgacagccaggccagc

SEQ ID NO: 2453881 - RNA, 18 nt, Bordetella pertussis
gcgacagccaggccagcg

SEQ ID NO: 2453882 - RNA, 20 nt, Bordetella pertussis
gcgacagccaggccagcgcc

SEQ ID NO: 2453883 - RNA, 21 nt, Bordetella pertussis
gcgacagccaggccagcgcca

SEQ ID NO: 2453884 - RNA, 22 nt, Bordetella pertussis
gcgacagcccgggaaacucgcg

SEQ ID NO: 2453885 - RNA, 18 nt, Bordetella pertussis
gcgacagccgcgccagcg

SEQ ID NO: 2453886 - RNA, 12 nt, Bordetella pertussis
gcgacagcgaca

SEQ ID NO: 2453887 - RNA, 20 nt, Bordetella pertussis
gcgacagcgacagccaggcc

SEQ ID NO: 2453888 - RNA, 21 nt, Bordetella pertussis
gcgacagcgacagccaggcca

SEQ ID NO: 2453889 - RNA, 19 nt, Bordetella pertussis
gcgacagcgauuucuucug

SEQ ID NO: 2453890 - RNA, 14 nt, Bordetella pertussis
gcgacagcgcuggu

SEQ ID NO: 2453891 - RNA, 18 nt, Bordetella pertussis
gcgacagcgcugguggcc

SEQ ID NO: 2453892 - RNA, 22 nt, Bordetella pertussis
gcgacagcuugaugggcgaggc

SEQ ID NO: 2453893 - RNA, 15 nt, Bordetella pertussis
gcgacaggcccgcgg

SEQ ID NO: 2453894 - RNA, 16 nt, Bordetella pertussis
gcgacaggcccgcggc

SEQ ID NO: 2453895 - RNA, 18 nt, Bordetella pertussis
gcgacaggcccgcggccg

SEQ ID NO: 2453896 - RNA, 14 nt, Bordetella pertussis
gcgacaggcgcagc

SEQ ID NO: 2453897 - RNA, 15 nt, Bordetella pertussis
gcgacaggcgcagcu

SEQ ID NO: 2453898 - RNA, 13 nt, Bordetella pertussis
gcgacaggcgcgc

SEQ ID NO: 2453899 - RNA, 15 nt, Bordetella pertussis
gcgacaggcgcgccc

SEQ ID NO: 2453900 - RNA, 22 nt, Bordetella pertussis
gcgacaguucgccccccgaggc

SEQ ID NO: 2453901 - RNA, 23 nt, Bordetella pertussis
gcgacaguucgccccccgaggcc

SEQ ID NO: 2453902 - RNA, 21 nt, Bordetella pertussis
gcgacauagaucuccggcgcc

SEQ ID NO: 2453903 - RNA, 22 nt, Bordetella pertussis
gcgacauagaucuccggcgccu

SEQ ID NO: 2453904 - RNA, 15 nt, Bordetella pertussis
gcgacaucgugcugu

SEQ ID NO: 2453905 - RNA, 23 nt, Bordetella pertussis
gcgacaucgugcuguucggcgac

SEQ ID NO: 2453906 - RNA, 14 nt, Bordetella pertussis
gcgacaugagcugc

SEQ ID NO: 2453907 - RNA, 16 nt, Bordetella pertussis
gcgacaugagcugcgc

SEQ ID NO: 2453908 - RNA, 20 nt, Bordetella pertussis
gcgacaugagcugcgcgugc

SEQ ID NO: 2453909 - RNA, 21 nt, Bordetella pertussis
gcgaccaccaggucguacagc

SEQ ID NO: 2453910 - RNA, 20 nt, Bordetella pertussis
gcgaccacgaccuuggcggc

SEQ ID NO: 2453911 - RNA, 18 nt, Bordetella pertussis
gcgaccagcuucugcgcc

SEQ ID NO: 2453912 - RNA, 21 nt, Bordetella pertussis
gcgaccagcuucugcgccugc

SEQ ID NO: 2453913 - RNA, 23 nt, Bordetella pertussis
gcgaccagcuucugcgccugcug

SEQ ID NO: 2453914 - RNA, 13 nt, Bordetella pertussis
gcgaccaggccca

SEQ ID NO: 2453915 - RNA, 14 nt, Bordetella pertussis
gcgaccaggcccac

SEQ ID NO: 2453916 - RNA, 19 nt, Bordetella pertussis
gcgaccaggcccauggcgu

SEQ ID NO: 2453917 - RNA, 23 nt, Bordetella pertussis
gcgaccaggcccauggcguagcc

SEQ ID NO: 2453918 - RNA, 16 nt, Bordetella pertussis
gcgaccaggugcgggc

SEQ ID NO: 2453919 - RNA, 20 nt, Bordetella pertussis
gcgaccaggugcgggccgcu

SEQ ID NO: 2453920 - RNA, 22 nt, Bordetella pertussis
gcgaccaugcggccgucgccgc

SEQ ID NO: 2453921 - RNA, 18 nt, Bordetella pertussis
gcgacccagaacccggcc

SEQ ID NO: 2453922 - RNA, 20 nt, Bordetella pertussis
gcgacccagaacccggccgg

SEQ ID NO: 2453923 - RNA, 23 nt, Bordetella pertussis
gcgacccagaacccggccggcgc

SEQ ID NO: 2453924 - RNA, 16 nt, Bordetella pertussis
gcgacccagcaccgag

SEQ ID NO: 2453925 - RNA, 18 nt, Bordetella pertussis
gcgacccagcaccgagcu

SEQ ID NO: 2453926 - RNA, 19 nt, Bordetella pertussis
gcgacccgauagccgcgcg

SEQ ID NO: 2453927 - RNA, 22 nt, Bordetella pertussis
gcgacccgauagccgcgcgccu

SEQ ID NO: 2453928 - RNA, 20 nt, Bordetella pertussis
gcgacccgcaaaaccgggcc

SEQ ID NO: 2453929 - RNA, 22 nt, Bordetella pertussis
gcgacccgcaaaaccgggcccg

SEQ ID NO: 2453930 - RNA, 12 nt, Bordetella pertussis
gcgacccguggc

SEQ ID NO: 2453931 - RNA, 16 nt, Bordetella pertussis
gcgacccguggcccgg

SEQ ID NO: 2453932 - RNA, 19 nt, Bordetella pertussis
gcgaccgacggcaucguca

SEQ ID NO: 2453933 - RNA, 13 nt, Bordetella pertussis
gcgaccgccgccu

SEQ ID NO: 2453934 - RNA, 13 nt, Bordetella pertussis
gcgaccgccgcgg

SEQ ID NO: 2453935 - RNA, 11 nt, Bordetella pertussis
gcgaccgccgg

SEQ ID NO: 2453936 - RNA, 14 nt, Bordetella pertussis
gcgaccgccggccg

SEQ ID NO: 2453937 - RNA, 17 nt, Bordetella pertussis
gcgaccgccuccagcgc

SEQ ID NO: 2453938 - RNA, 19 nt, Bordetella pertussis
gcgaccgccuccagcgcgg

SEQ ID NO: 2453939 - RNA, 20 nt, Bordetella pertussis
gcgaccgcgaaccggugcug

SEQ ID NO: 2453940 - RNA, 14 nt, Bordetella pertussis
gcgaccgcgcggcg

SEQ ID NO: 2453941 - RNA, 15 nt, Bordetella pertussis
gcgaccgcgcggcgc

SEQ ID NO: 2453942 - RNA, 19 nt, Bordetella pertussis
gcgcaccaggccugccuga

SEQ ID NO: 2453943 - RNA, 14 nt, Bordetella pertussis
gcgcaccaggcgcg

SEQ ID NO: 2453944 - RNA, 17 nt, Bordetella pertussis
gcgcaccaggcgcggcg

SEQ ID NO: 2453945 - RNA, 17 nt, Bordetella pertussis
gcgcaccaggcgcucgc

SEQ ID NO: 2453946 - RNA, 18 nt, Bordetella pertussis
gcgcaccaggcgcucgcg

SEQ ID NO: 2453947 - RNA, 22 nt, Bordetella pertussis
gcgcaccaggcgcucgcgcgcc

SEQ ID NO: 2453948 - RNA, 14 nt, Bordetella pertussis
gcgcaccaggcugg

SEQ ID NO: 2453949 - RNA, 23 nt, Bordetella pertussis
gcgcaccaggcuggggccgagcg

SEQ ID NO: 2453950 - RNA, 16 nt, Bordetella pertussis
gcgcaccaggucgcgg

SEQ ID NO: 2453951 - RNA, 22 nt, Bordetella pertussis
gcgcaccaguuucucggccacu

SEQ ID NO: 2453952 - RNA, 18 nt, Bordetella pertussis
gcgcaccaucgccgagcc

SEQ ID NO: 2453953 - RNA, 17 nt, Bordetella pertussis
gcgcaccauggcgccca

SEQ ID NO: 2453954 - RNA, 20 nt, Bordetella pertussis
gcgcaccauggcgcccacgg

SEQ ID NO: 2453955 - RNA, 19 nt, Bordetella pertussis
gcgcaccaugggcgucguc

SEQ ID NO: 2453956 - RNA, 22 nt, Bordetella pertussis
gcgcaccaugggcgucgucgcc

SEQ ID NO: 2453957 - RNA, 20 nt, Bordetella pertussis
gcgcaccauucucgcccugc

SEQ ID NO: 2453958 - RNA, 23 nt, Bordetella pertussis
gcgcaccauucucgcccugcugg

SEQ ID NO: 2453959 - RNA, 13 nt, Bordetella pertussis
gcgcacccaggcc

SEQ ID NO: 2453960 - RNA, 17 nt, Bordetella pertussis
gcgcaccccggugucgc

SEQ ID NO: 2453961 - RNA, 13 nt, Bordetella pertussis
gcgcacccgcagg

SEQ ID NO: 2453962 - RNA, 15 nt, Bordetella pertussis
gcgcacccgccugga

SEQ ID NO: 2453963 - RNA, 20 nt, Bordetella pertussis
gcgcacccgccuggacggcg

SEQ ID NO: 2453964 - RNA, 12 nt, Bordetella pertussis
gcgcacccgcgg

SEQ ID NO: 2453965 - RNA, 13 nt, Bordetella pertussis
gcgcacccgcggc

SEQ ID NO: 2453966 - RNA, 14 nt, Bordetella pertussis
gcgcacccgcggcg

SEQ ID NO: 2453967 - RNA, 20 nt, Bordetella pertussis
gcgcacccguuccagcaugu

SEQ ID NO: 2453968 - RNA, 19 nt, Bordetella pertussis
gcgcacccugcaggccggg

SEQ ID NO: 2453969 - RNA, 20 nt, Bordetella pertussis
gcgcacccugcaggccgggc

SEQ ID NO: 2453970 - RNA, 12 nt, Bordetella pertussis
gcgcaccgacgg

SEQ ID NO: 2453971 - RNA, 18 nt, Bordetella pertussis
gcgcaccgacggcagccc

SEQ ID NO: 2453972 - RNA, 21 nt, Bordetella pertussis
gcgcaccgacggcagccccgg

SEQ ID NO: 2453973 - RNA, 15 nt, Bordetella pertussis
gcgcaccgaggugcc

SEQ ID NO: 2453974 - RNA, 21 nt, Bordetella pertussis
gcgcaccgcaugggccaggcg

SEQ ID NO: 2453975 - RNA, 13 nt, Bordetella pertussis
gcgcaccgcgcug

SEQ ID NO: 2453976 - RNA, 16 nt, Bordetella pertussis
gcgcaccgcuucuucg

SEQ ID NO: 2453977 - RNA, 21 nt, Bordetella pertussis
gcgcaccgcuucuucgucgcg

SEQ ID NO: 2453978 - RNA, 20 nt, Bordetella pertussis
gcgcaccggcacgcgccagc

SEQ ID NO: 2453979 - RNA, 12 nt, Bordetella pertussis
gcgcaccggcca

SEQ ID NO: 2453980 - RNA, 15 nt, Bordetella pertussis
gcgcaccggccaggg

SEQ ID NO: 2453981 - RNA, 18 nt, Bordetella pertussis
gcgcaccggccaggggcg

SEQ ID NO: 2453982 - RNA, 22 nt, Bordetella pertussis
gcgcaccggccaggggcgcugg

SEQ ID NO: 2453983 - RNA, 23 nt, Bordetella pertussis
gcgcaccggcuuggggcgcgccg

SEQ ID NO: 2453984 - RNA, 12 nt, Bordetella pertussis
gcgcaccgucac

SEQ ID NO: 2453985 - RNA, 23 nt, Bordetella pertussis
gcgcaccgucacgcgcuccagcg

SEQ ID NO: 2453986 - RNA, 17 nt, Bordetella pertussis
gcgcaccgucgccaggg

SEQ ID NO: 2453987 - RNA, 21 nt, Bordetella pertussis
gcgcaccucguaaguggcggc

SEQ ID NO: 2453988 - RNA, 17 nt, Bordetella pertussis
gcgcaccugcugcggca

SEQ ID NO: 2453989 - RNA, 20 nt, Bordetella pertussis
gcgcaccugggaggggccgg

SEQ ID NO: 2453990 - RNA, 13 nt, Bordetella pertussis
gcgcaccuggucc

SEQ ID NO: 2453991 - RNA, 18 nt, Bordetella pertussis
gcgcaccuguucggcggc

SEQ ID NO: 2453992 - RNA, 18 nt, Bordetella pertussis
gcgcaccuugcccacgcc

SEQ ID NO: 2453993 - RNA, 19 nt, Bordetella pertussis
gcgcaccuugcccacgcca

SEQ ID NO: 2453994 - RNA, 22 nt, Bordetella pertussis
gcgcaccuugcccacgccaucg

SEQ ID NO: 2453995 - RNA, 19 nt, Bordetella pertussis
gcgcacgaaguacucgccg

SEQ ID NO: 2453996 - RNA, 21 nt, Bordetella pertussis
gcgcacgaaguacucgccggc

SEQ ID NO: 2453997 - RNA, 22 nt, Bordetella pertussis
gcgcacgaccaccagcgcacug

SEQ ID NO: 2453998 - RNA, 19 nt, Bordetella pertussis
gcgcacgauggggcagcca

SEQ ID NO: 2453999 - RNA, 22 nt, Bordetella pertussis
gcgcacgauggggccgucgccg

SEQ ID NO: 2454000 - RNA, 21 nt, Bordetella pertussis
gcgcacgauugucgucgcgcg

SEQ ID NO: 2454001 - RNA, 18 nt, Bordetella pertussis
gcgcacgcaccgcgccag

SEQ ID NO: 2454002 - RNA, 19 nt, Bordetella pertussis
gcgcacgcaccgcgccagc

SEQ ID NO: 2454003 - RNA, 16 nt, Bordetella pertussis
gcgcacgcacugagcu

SEQ ID NO: 2454004 - RNA, 14 nt, Bordetella pertussis
gcgcacgcagcgcu

SEQ ID NO: 2454005 - RNA, 14 nt, Bordetella pertussis
gcgcacgcccagac

SEQ ID NO: 2454006 - RNA, 18 nt, Bordetella pertussis
gcgcacgcccagacuggc

SEQ ID NO: 2454007 - RNA, 17 nt, Bordetella pertussis
gcgcacgccccgacgcg

SEQ ID NO: 2454008 - RNA, 19 nt, Bordetella pertussis
gcgcacgccccgacgcggu

SEQ ID NO: 2454009 - RNA, 23 nt, Bordetella pertussis
gcgcacgccccgacgcggucgcc

SEQ ID NO: 2454010 - RNA, 12 nt, Bordetella pertussis
gcgcacgccgcc

SEQ ID NO: 2454011 - RNA, 15 nt, Bordetella pertussis
gcgcacgccgcgccg

SEQ ID NO: 2454012 - RNA, 23 nt, Bordetella pertussis
gcgcacgccgcgccggcgcgcga

SEQ ID NO: 2454013 - RNA, 12 nt, Bordetella pertussis
gcgcacgccggg

SEQ ID NO: 2454014 - RNA, 13 nt, Bordetella pertussis
gcgcacgccgggc

SEQ ID NO: 2454015 - RNA, 15 nt, Bordetella pertussis
gcgcacgccgggcgc

SEQ ID NO: 2454016 - RNA, 21 nt, Bordetella pertussis
gcgcacgccgggcgcggccgc

SEQ ID NO: 2454017 - RNA, 13 nt, Bordetella pertussis
gcgcacgcgcagc

SEQ ID NO: 2454018 - RNA, 16 nt, Bordetella pertussis
gcgcacgcgcagcacg

SEQ ID NO: 2454019 - RNA, 23 nt, Bordetella pertussis
gcgcacgcgcagcacgcugcgcg

SEQ ID NO: 2454020 - RNA, 13 nt, Bordetella pertussis
gcgcacgcgcucg

SEQ ID NO: 2454021 - RNA, 17 nt, Bordetella pertussis
gcgcacgcguucgggcg

SEQ ID NO: 2454022 - RNA, 19 nt, Bordetella pertussis
gcgcacgcguucgggcggc

SEQ ID NO: 2454023 - RNA, 22 nt, Bordetella pertussis
gcgcacgcucugcaccuugggc

SEQ ID NO: 2454024 - RNA, 15 nt, Bordetella pertussis
gcgcacgcuggcgcc

SEQ ID NO: 2454025 - RNA, 16 nt, Bordetella pertussis
gcgcacgcuggcgccc

SEQ ID NO: 2454026 - RNA, 12 nt, Bordetella pertussis
gcgcacgcuggg

SEQ ID NO: 2454027 - RNA, 13 nt, Bordetella pertussis
gcgcacggccagc

SEQ ID NO: 2454028 - RNA, 14 nt, Bordetella pertussis
gcgcacggccagca

SEQ ID NO: 2454029 - RNA, 13 nt, Bordetella pertussis
gcgcacggcgccc

SEQ ID NO: 2454030 - RNA, 14 nt, Bordetella pertussis
gcgcacggcgcccu

SEQ ID NO: 2454031 - RNA, 18 nt, Bordetella pertussis
gcgcacggcgcccugcgc

SEQ ID NO: 2454032 - RNA, 13 nt, Bordetella pertussis
gcgcacggcggca

SEQ ID NO: 2454033 - RNA, 13 nt, Bordetella pertussis
gcgcacggcggcg

SEQ ID NO: 2454034 - RNA, 14 nt, Bordetella pertussis
gcgcacggcggcga

SEQ ID NO: 2454035 - RNA, 21 nt, Bordetella pertussis
gcgcacggcggcgaucacgcc

SEQ ID NO: 2454036 - RNA, 20 nt, Bordetella pertussis
gcgcacgggcgaggcggggc

SEQ ID NO: 2454037 - RNA, 20 nt, Bordetella pertussis
gcgcacgggcgagggcugcc

SEQ ID NO: 2454038 - RNA, 13 nt, Bordetella pertussis
gcgcacgggcgcc

SEQ ID NO: 2454039 - RNA, 16 nt, Bordetella pertussis
gcgcacgggcgccugu

SEQ ID NO: 2454040 - RNA, 19 nt, Bordetella pertussis
gcgcacgggcgccuguccc

SEQ ID NO: 2454041 - RNA, 15 nt, Bordetella pertussis
gcgcacgguccaggc

SEQ ID NO: 2454042 - RNA, 18 nt, Bordetella pertussis
gcgcacgguccaggcggc

SEQ ID NO: 2454043 - RNA, 14 nt, Bordetella pertussis
gcgcacguccagag

SEQ ID NO: 2454044 - RNA, 22 nt, Bordetella pertussis
gcgcacguugagauccaggaac

SEQ ID NO: 2454045 - RNA, 24 nt, Bordetella pertussis
gcgcacucgaccgccgggacaggc

SEQ ID NO: 2454046 - RNA, 13 nt, Bordetella pertussis
gcgcacugaucgc

SEQ ID NO: 2454047 - RNA, 16 nt, Bordetella pertussis
gcgcacugaucgccgc

SEQ ID NO: 2454048 - RNA, 12 nt, Bordetella pertussis
gcgcacuugugg

SEQ ID NO: 2454049 - RNA, 12 nt, Bordetella pertussis
gcgcagacgacg

SEQ ID NO: 2454050 - RNA, 12 nt, Bordetella pertussis
gcgcagacgcgc

SEQ ID NO: 2454051 - RNA, 19 nt, Bordetella pertussis
gcgcagacgcgcucaggcg

SEQ ID NO: 2454052 - RNA, 20 nt, Bordetella pertussis
gcgcagacgcgcucaggcgg

SEQ ID NO: 2454053 - RNA, 24 nt, Bordetella pertussis
gcgcagaucccaggcgcucagccg

SEQ ID NO: 2454054 - RNA, 14 nt, Bordetella pertussis
gcgcagauggcggc

SEQ ID NO: 2454055 - RNA, 15 nt, Bordetella pertussis
gcgcagaugggcggc

SEQ ID NO: 2454056 - RNA, 17 nt, Bordetella pertussis
gcgcagaugggcggcga

SEQ ID NO: 2454057 - RNA, 17 nt, Bordetella pertussis
gcgcagauugcgcucgg

SEQ ID NO: 2454058 - RNA, 17 nt, Bordetella pertussis
gcgcagcaacccgcccg

SEQ ID NO: 2454059 - RNA, 17 nt, Bordetella pertussis
gcgcagcaagcugcugc

SEQ ID NO: 2454060 - RNA, 13 nt, Bordetella pertussis
gcgcagcaaggcg

SEQ ID NO: 2454061 - RNA, 15 nt, Bordetella pertussis
gcgcagcaaggcgcg

SEQ ID NO: 2454062 - RNA, 14 nt, Bordetella pertussis
gcgcagcaccagca

SEQ ID NO: 2454063 - RNA, 13 nt, Bordetella pertussis
gcgcagcaccagg

SEQ ID NO: 2454064 - RNA, 15 nt, Bordetella pertussis
gcgcagcaccagguc

SEQ ID NO: 2454065 - RNA, 14 nt, Bordetella pertussis
gcgcagcaccgcca

SEQ ID NO: 2454066 - RNA, 16 nt, Bordetella pertussis
gcgcagcaccgccagc

SEQ ID NO: 2454067 - RNA, 18 nt, Bordetella pertussis
gcgcagcaccgccagcgc

SEQ ID NO: 2454068 - RNA, 21 nt, Bordetella pertussis
gcgcagcaccgccagcgcguc

SEQ ID NO: 2454069 - RNA, 20 nt, Bordetella pertussis
gcgcagcaccgcgcgcacga

SEQ ID NO: 2454070 - RNA, 15 nt, Bordetella pertussis
gcgcagcaccggcag

SEQ ID NO: 2454071 - RNA, 19 nt, Bordetella pertussis
gcgcagcaccggcagaugg

SEQ ID NO: 2454072 - RNA, 14 nt, Bordetella pertussis
gcgcagcaccggcg

SEQ ID NO: 2454073 - RNA, 18 nt, Bordetella pertussis
gcgcagcaccucggggcg

SEQ ID NO: 2454074 - RNA, 23 nt, Bordetella pertussis
gcgcagcaccucggggcgcggcc

SEQ ID NO: 2454075 - RNA, 12 nt, Bordetella pertussis
gcgcagcacgcc

SEQ ID NO: 2454076 - RNA, 14 nt, Bordetella pertussis
gcgcagcacgcccg

SEQ ID NO: 2454077 - RNA, 17 nt, Bordetella pertussis
gcgcagcacgcccgcgc

SEQ ID NO: 2454078 - RNA, 21 nt, Bordetella pertussis
gcgcagcacgcccgcgcgcga

SEQ ID NO: 2454079 - RNA, 15 nt, Bordetella pertussis
gcgcagcacgccgau

SEQ ID NO: 2454080 - RNA, 17 nt, Bordetella pertussis
gcgcagcacgccgaucg

SEQ ID NO: 2454081 - RNA, 15 nt, Bordetella pertussis
gcgcagcacgccgcg

SEQ ID NO: 2454082 - RNA, 22 nt, Bordetella pertussis
gcgcagcacgccgcgccaggca

SEQ ID NO: 2454083 - RNA, 20 nt, Bordetella pertussis
gcgcagcagauugccgcgcg

SEQ ID NO: 2454084 - RNA, 22 nt, Bordetella pertussis
gcgcagcagauugccgcgcggc

SEQ ID NO: 2454085 - RNA, 18 nt, Bordetella pertussis
gcgcagcagcgacaggac

SEQ ID NO: 2454086 - RNA, 16 nt, Bordetella pertussis
gcgcagcagcuugccg

SEQ ID NO: 2454087 - RNA, 23 nt, Bordetella pertussis
gcgcagcagcuugccgaccgcuu

SEQ ID NO: 2454088 - RNA, 11 nt, Bordetella pertussis
gcgcagcaggc

SEQ ID NO: 2454089 - RNA, 12 nt, Bordetella pertussis
gcgcagcaggcc

SEQ ID NO: 2454090 - RNA, 20 nt, Bordetella pertussis
gcgcagcaggccaggaagcg

SEQ ID NO: 2454091 - RNA, 15 nt, Bordetella pertussis
gcgcagcaggcccau

SEQ ID NO: 2454092 - RNA, 17 nt, Bordetella pertussis
gcgcagcaggcccaugc

SEQ ID NO: 2454093 - RNA, 20 nt, Bordetella pertussis
gcgcagcaggcccaugccgc

SEQ ID NO: 2454094 - RNA, 13 nt, Bordetella pertussis
gcgcagcaggccg

SEQ ID NO: 2454095 - RNA, 15 nt, Bordetella pertussis
gcgcagcaggcgcgc

SEQ ID NO: 2454096 - RNA, 20 nt, Bordetella pertussis
gcgcagcaggcgcgcggccu

SEQ ID NO: 2454097 - RNA, 14 nt, Bordetella pertussis
gcgcagcagggccu

SEQ ID NO: 2454098 - RNA, 15 nt, Bordetella pertussis
gcgcagcagggccug

SEQ ID NO: 2454099 - RNA, 16 nt, Bordetella pertussis
gcgcagcagggccugg

SEQ ID NO: 2454100 - RNA, 17 nt, Bordetella pertussis
gcgcagcagggccuggc

SEQ ID NO: 2454101 - RNA, 14 nt, Bordetella pertussis
gcgcagcagggcgg

SEQ ID NO: 2454102 - RNA, 15 nt, Bordetella pertussis
gcgcagcagggcggc

SEQ ID NO: 2454103 - RNA, 18 nt, Bordetella pertussis
gcgcagcaggguggccac

SEQ ID NO: 2454104 - RNA, 19 nt, Bordetella pertussis
gcgcagcaggguggccacg

SEQ ID NO: 2454105 - RNA, 20 nt, Bordetella pertussis
gcgcagcaggguggccacgc

SEQ ID NO: 2454106 - RNA, 16 nt, Bordetella pertussis
gcgcagcaucuugcgc

SEQ ID NO: 2454107 - RNA, 14 nt, Bordetella pertussis
gcgcagcaugagcu

SEQ ID NO: 2454108 - RNA, 21 nt, Bordetella pertussis
gcgcagccacagcgcguggcc

SEQ ID NO: 2454109 - RNA, 24 nt, Bordetella pertussis
gcgcagccacagcgcguggccggg

SEQ ID NO: 2454110 - RNA, 22 nt, Bordetella pertussis
gcgcagccagguaagcuggcgc

SEQ ID NO: 2454111 - RNA, 14 nt, Bordetella pertussis
gcgcagcccagcgc

SEQ ID NO: 2454112 - RNA, 19 nt, Bordetella pertussis
gcgcagcccagcgcgaugu

SEQ ID NO: 2454113 - RNA, 17 nt, Bordetella pertussis
gcgcagcccggcgugcc

SEQ ID NO: 2454114 - RNA, 22 nt, Bordetella pertussis
gcgcagccgacaggcgcgcagg

SEQ ID NO: 2454115 - RNA, 14 nt, Bordetella pertussis
gcgcagccgccaua

SEQ ID NO: 2454116 - RNA, 20 nt, Bordetella pertussis
gcgcagccgccauaggcgcg

SEQ ID NO: 2454117 - RNA, 21 nt, Bordetella pertussis
gcgcagccgccauaggcgcgc

SEQ ID NO: 2454118 - RNA, 23 nt, Bordetella pertussis
gcgcagccgccauaggcgcgcac

SEQ ID NO: 2454119 - RNA, 13 nt, Bordetella pertussis
gcgcagccgcgcc

SEQ ID NO: 2454120 - RNA, 14 nt, Bordetella pertussis
gcgcagccgcgcca

SEQ ID NO: 2454121 - RNA, 21 nt, Bordetella pertussis
gcgcagccgcgccaagggcgu

SEQ ID NO: 2454122 - RNA, 15 nt, Bordetella pertussis
gcgcagccgcgcgcc

SEQ ID NO: 2454123 - RNA, 21 nt, Bordetella pertussis
gcgcagccgcuccagccacca

SEQ ID NO: 2454124 - RNA, 13 nt, Bordetella pertussis
gcgcagccggccg

SEQ ID NO: 2454125 - RNA, 23 nt, Bordetella pertussis
gcgcagccggccgguaaggcgcu

SEQ ID NO: 2454126 - RNA, 13 nt, Bordetella pertussis
gcgcagccgggcu

SEQ ID NO: 2454127 - RNA, 17 nt, Bordetella pertussis
gcgcagccgggcugccg

SEQ ID NO: 2454128 - RNA, 22 nt, Bordetella pertussis
gcgcagccgggcugccggcagc

SEQ ID NO: 2454129 - RNA, 22 nt, Bordetella pertussis
gcgcagcgaguagacgcagccg

SEQ ID NO: 2454130 - RNA, 14 nt, Bordetella pertussis
gcgcagcgccacgc

SEQ ID NO: 2454131 - RNA, 14 nt, Bordetella pertussis
gcgcagcgcccagg

SEQ ID NO: 2454132 - RNA, 15 nt, Bordetella pertussis
gcgcagcgcccaggc

SEQ ID NO: 2454133 - RNA, 16 nt, Bordetella pertussis
gcgcagcgcccaggcg

SEQ ID NO: 2454134 - RNA, 13 nt, Bordetella pertussis
gcgcagcgccgcc

SEQ ID NO: 2454135 - RNA, 14 nt, Bordetella pertussis
gcgcagcgccgcca

SEQ ID NO: 2454136 - RNA, 22 nt, Bordetella pertussis
gcgcagcgccgccaccucggcg

SEQ ID NO: 2454137 - RNA, 16 nt, Bordetella pertussis
gcgcagcgccgcgauu

SEQ ID NO: 2454138 - RNA, 13 nt, Bordetella pertussis
gcgcagcgccgcu

SEQ ID NO: 2454139 - RNA, 23 nt, Bordetella pertussis
gcgcagcgccgcuuccaccgucu

SEQ ID NO: 2454140 - RNA, 13 nt, Bordetella pertussis
gcgcagcgccugc

SEQ ID NO: 2454141 - RNA, 19 nt, Bordetella pertussis
gcgcagcgccugcaggcgg

SEQ ID NO: 2454142 - RNA, 17 nt, Bordetella pertussis
gcgcagcgccuggccga

SEQ ID NO: 2454143 - RNA, 20 nt, Bordetella pertussis
gcgcagcgccuggccgagcg

SEQ ID NO: 2454144 - RNA, 23 nt, Bordetella pertussis
gcgcagcgccuggccgagcgcgg

SEQ ID NO: 2454145 - RNA, 15 nt, Bordetella pertussis
gcgcagcgcgccgga

SEQ ID NO: 2454146 - RNA, 12 nt, Bordetella pertussis
gcgcagcgcggc

SEQ ID NO: 2454147 - RNA, 15 nt, Bordetella pertussis
gcgcagcgcggcacg

SEQ ID NO: 2454148 - RNA, 13 nt, Bordetella pertussis
gcgcagcgcggcg

SEQ ID NO: 2454149 - RNA, 17 nt, Bordetella pertussis
gcgcagcgcggcguuga

SEQ ID NO: 2454150 - RNA, 19 nt, Bordetella pertussis
gcgcagcgcggcguugacc

SEQ ID NO: 2454151 - RNA, 15 nt, Bordetella pertussis
gcgcagcgcguccug

SEQ ID NO: 2454152 - RNA, 17 nt, Bordetella pertussis
gcgcagcgcguccugcc

SEQ ID NO: 2454153 - RNA, 15 nt, Bordetella pertussis
gcgcagcgcgucggc

SEQ ID NO: 2454154 - RNA, 21 nt, Bordetella pertussis
gcgcagcgcgucggcgcgguc

SEQ ID NO: 2454155 - RNA, 12 nt, Bordetella pertussis
gcgcagcggcag

SEQ ID NO: 2454156 - RNA, 16 nt, Bordetella pertussis
gcgcagcggcaggccc

SEQ ID NO: 2454157 - RNA, 18 nt, Bordetella pertussis
gcgcagcggcaggcccug

SEQ ID NO: 2454158 - RNA, 20 nt, Bordetella pertussis
gcgcagcggcaggcccugcc

SEQ ID NO: 2454159 - RNA, 21 nt, Bordetella pertussis
gcgcagcggcaggcccugccg

SEQ ID NO: 2454160 - RNA, 15 nt, Bordetella pertussis
gcgcagcggcaggcg

SEQ ID NO: 2454161 - RNA, 16 nt, Bordetella pertussis
gcgcagcggcaggcgg

SEQ ID NO: 2454162 - RNA, 20 nt, Bordetella pertussis
gcgcagcggcaggcggcuga

SEQ ID NO: 2454163 - RNA, 16 nt, Bordetella pertussis
gcgcagcggcgcgcgc

SEQ ID NO: 2454164 - RNA, 19 nt, Bordetella pertussis
gcgcagcgucucgcccacc

SEQ ID NO: 2454165 - RNA, 20 nt, Bordetella pertussis
gcgcagcgucugcgcaucga

SEQ ID NO: 2454166 - RNA, 20 nt, Bordetella pertussis
gcgcagcgugcggaccagcg

SEQ ID NO: 2454167 - RNA, 15 nt, Bordetella pertussis
gcgcagcguggcggc

SEQ ID NO: 2454168 - RNA, 17 nt, Bordetella pertussis
gcgcagcguggcggcga

SEQ ID NO: 2454169 - RNA, 19 nt, Bordetella pertussis
gcgcagcguggcggcgacg

SEQ ID NO: 2454170 - RNA, 19 nt, Bordetella pertussis
gcgcagcguuucaccgcug

SEQ ID NO: 2454171 - RNA, 15 nt, Bordetella pertussis
gcgcagcucccccac

SEQ ID NO: 2454172 - RNA, 21 nt, Bordetella pertussis
gcgcagcucccccacgccgcc

SEQ ID NO: 2454173 - RNA, 22 nt, Bordetella pertussis
gcgcagcuccgggucgagcgcc

SEQ ID NO: 2454174 - RNA, 23 nt, Bordetella pertussis
gcgcagcuccguauccuggucga

SEQ ID NO: 2454175 - RNA, 20 nt, Bordetella pertussis
gcgcagcucgaccgucagca

SEQ ID NO: 2454176 - RNA, 11 nt, Bordetella pertussis
gcgcagcucgu

SEQ ID NO: 2454177 - RNA, 16 nt, Bordetella pertussis
gcgcagcucguggcgc

SEQ ID NO: 2454178 - RNA, 20 nt, Bordetella pertussis
gcgcagcucguggcgcgccu

SEQ ID NO: 2454179 - RNA, 13 nt, Bordetella pertussis
gcgcagcugccug

SEQ ID NO: 2454180 - RNA, 20 nt, Bordetella pertussis
gcgcagcugccugagcaccg

SEQ ID NO: 2454181 - RNA, 22 nt, Bordetella pertussis
gcgcagcugccugagcaccgcc

SEQ ID NO: 2454182 - RNA, 23 nt, Bordetella pertussis
gcgcagcugccugagcaccgccg

SEQ ID NO: 2454183 - RNA, 18 nt, Bordetella pertussis
gcgcagcuucuaucugcc

SEQ ID NO: 2454184 - RNA, 23 nt, Bordetella pertussis
gcgcagcuucuaucugccgcgca

SEQ ID NO: 2454185 - RNA, 23 nt, Bordetella pertussis
gcgcagcuugcccgcgcgcacgu

SEQ ID NO: 2454186 - RNA, 18 nt, Bordetella pertussis
gcgcaggacaaggcgcgc

SEQ ID NO: 2454187 - RNA, 21 nt, Bordetella pertussis
gcgcaggacaaggcgcgcgcc

SEQ ID NO: 2454188 - RNA, 13 nt, Bordetella pertussis
gcgcaggacggcg

SEQ ID NO: 2454189 - RNA, 15 nt, Bordetella pertussis
gcgcaggacggcgcc

SEQ ID NO: 2454190 - RNA, 16 nt, Bordetella pertussis
gcgcaggacggcgccg

SEQ ID NO: 2454191 - RNA, 19 nt, Bordetella pertussis
gcgcaggaugacguggcag

SEQ ID NO: 2454192 - RNA, 16 nt, Bordetella pertussis
gcgcaggaugggcagc

SEQ ID NO: 2454193 - RNA, 21 nt, Bordetella pertussis
gcgcaggauuucaucgcccau

SEQ ID NO: 2454194 - RNA, 19 nt, Bordetella pertussis
gcgcaggauuuccucgccg

SEQ ID NO: 2454195 - RNA, 23 nt, Bordetella pertussis
gcgcaggcaguuggcggcgcagc

SEQ ID NO: 2454196 - RNA, 13 nt, Bordetella pertussis
gcgcaggccagcg

SEQ ID NO: 2454197 - RNA, 14 nt, Bordetella pertussis
gcgcaggccgacgc

SEQ ID NO: 2454198 - RNA, 14 nt, Bordetella pertussis
gcgcaggccgcgcc

SEQ ID NO: 2454199 - RNA, 16 nt, Bordetella pertussis
gcgcaggccgcgccgg

SEQ ID NO: 2454200 - RNA, 17 nt, Bordetella pertussis
gcgcaggccgcgccggc

SEQ ID NO: 2454201 - RNA, 21 nt, Bordetella pertussis
gcgcaggccgcgcgcauccag

SEQ ID NO: 2454202 - RNA, 11 nt, Bordetella pertussis
gcgcaggccgg

SEQ ID NO: 2454203 - RNA, 16 nt, Bordetella pertussis
gcgcaggccggcggcc

SEQ ID NO: 2454204 - RNA, 17 nt, Bordetella pertussis
gcgcaggccggcggcca

SEQ ID NO: 2454205 - RNA, 23 nt, Bordetella pertussis
gcgcaggccggcggccagcgcgc

SEQ ID NO: 2454206 - RNA, 13 nt, Bordetella pertussis
gcgcaggccucgc

SEQ ID NO: 2454207 - RNA, 17 nt, Bordetella pertussis
gcgcaggccugcggcga

SEQ ID NO: 2454208 - RNA, 15 nt, Bordetella pertussis
gcgcaggcgccgcag

SEQ ID NO: 2454209 - RNA, 20 nt, Bordetella pertussis
gcgcaggcgcgagacgaagg

SEQ ID NO: 2454210 - RNA, 17 nt, Bordetella pertussis
gcgcaggcgcgccaggg

SEQ ID NO: 2454211 - RNA, 14 nt, Bordetella pertussis
gcgcaggcgcgcgc

SEQ ID NO: 2454212 - RNA, 16 nt, Bordetella pertussis
gcgcaggcgcgcgccu

SEQ ID NO: 2454213 - RNA, 17 nt, Bordetella pertussis
gcgcaggcgcgcgccuu

SEQ ID NO: 2454214 - RNA, 15 nt, Bordetella pertussis
gcgcaggcgcgcggg

SEQ ID NO: 2454215 - RNA, 18 nt, Bordetella pertussis
gcgcaggcgcguggccac

SEQ ID NO: 2454216 - RNA, 19 nt, Bordetella pertussis
gcgcaggcgcucgaggcgc

SEQ ID NO: 2454217 - RNA, 22 nt, Bordetella pertussis
gcgcaggcgcucgaggcgcugg

SEQ ID NO: 2454218 - RNA, 14 nt, Bordetella pertussis
gcgcaggcgcuuga

SEQ ID NO: 2454219 - RNA, 16 nt, Bordetella pertussis
gcgcaggcgggccucg

SEQ ID NO: 2454220 - RNA, 19 nt, Bordetella pertussis
gcgcaggcgugcgcgggcg

SEQ ID NO: 2454221 - RNA, 19 nt, Bordetella pertussis
gcgcaggcguucgcaccag

SEQ ID NO: 2454222 - RNA, 20 nt, Bordetella pertussis
gcgcaggcguuucgccagga

SEQ ID NO: 2454223 - RNA, 11 nt, Bordetella pertussis
gcgcaggcuga

SEQ ID NO: 2454224 - RNA, 21 nt, Bordetella pertussis
gcgcaggcugauccagguggu

SEQ ID NO: 2454225 - RNA, 13 nt, Bordetella pertussis
gcgcagggcggcc

SEQ ID NO: 2454226 - RNA, 14 nt, Bordetella pertussis
gcgcagggcggccg

SEQ ID NO: 2454227 - RNA, 15 nt, Bordetella pertussis
gcgcagggcggccgg

SEQ ID NO: 2454228 - RNA, 15 nt, Bordetella pertussis
gcgcagggcgggcgg

SEQ ID NO: 2454229 - RNA, 13 nt, Bordetella pertussis
gcgcaggggcucu

SEQ ID NO: 2454230 - RNA, 15 nt, Bordetella pertussis
gcgcagggugcgggg

SEQ ID NO: 2454231 - RNA, 13 nt, Bordetella pertussis
gcgcagguccacc

SEQ ID NO: 2454232 - RNA, 19 nt, Bordetella pertussis
gcgcagguccaccgccacg

SEQ ID NO: 2454233 - RNA, 15 nt, Bordetella pertussis
gcgcaggucggccag

SEQ ID NO: 2454234 - RNA, 16 nt, Bordetella pertussis
gcgcaggucggccagg

SEQ ID NO: 2454235 - RNA, 17 nt, Bordetella pertussis
gcgcaggucggccagga

SEQ ID NO: 2454236 - RNA, 19 nt, Bordetella pertussis
gcgcaggucggcgaugcgc

SEQ ID NO: 2454237 - RNA, 23 nt, Bordetella pertussis
gcgcaggucggcgaugcgcgggg

SEQ ID NO: 2454238 - RNA, 17 nt, Bordetella pertussis
gcgcaggucguggccgu

SEQ ID NO: 2454239 - RNA, 20 nt, Bordetella pertussis
gcgcaggucguggccgugcg

SEQ ID NO: 2454240 - RNA, 21 nt, Bordetella pertussis
gcgcaguaucuggugcgcguc

SEQ ID NO: 2454241 - RNA, 23 nt, Bordetella pertussis
gcgcaguccaaggaaagcccggc

SEQ ID NO: 2454242 - RNA, 16 nt, Bordetella pertussis
gcgcaguccagcgugg

SEQ ID NO: 2454243 - RNA, 19 nt, Bordetella pertussis
gcgcaguuccggcgggccg

SEQ ID NO: 2454244 - RNA, 18 nt, Bordetella pertussis
gcgcaguugcgucuccag

SEQ ID NO: 2454245 - RNA, 21 nt, Bordetella pertussis
gcgcaguugcgucuccagcgc

SEQ ID NO: 2454246 - RNA, 18 nt, Bordetella pertussis
gcgcaguuguucgcgcaa

SEQ ID NO: 2454247 - RNA, 15 nt, Bordetella pertussis
gcgcauacagggcgg

SEQ ID NO: 2454248 - RNA, 20 nt, Bordetella pertussis
gcgcauacagggcggugcgc

SEQ ID NO: 2454249 - RNA, 23 nt, Bordetella pertussis
gcgcauacgcggguucgacgccg

SEQ ID NO: 2454250 - RNA, 20 nt, Bordetella pertussis
gcgcauauggagccaggcgg

SEQ ID NO: 2454251 - RNA, 17 nt, Bordetella pertussis
gcgcaucacgcuggccg

SEQ ID NO: 2454252 - RNA, 15 nt, Bordetella pertussis
gcgcaucaugaggcg

SEQ ID NO: 2454253 - RNA, 20 nt, Bordetella pertussis
gcgcaucaugaggcggcggu

SEQ ID NO: 2454254 - RNA, 15 nt, Bordetella pertussis
gcgcaucgacagcgc

SEQ ID NO: 2454255 - RNA, 16 nt, Bordetella pertussis
gcgcaucgagcuccug

SEQ ID NO: 2454256 - RNA, 17 nt, Bordetella pertussis
gcgcaucgagcuccugc

SEQ ID NO: 2454257 - RNA, 18 nt, Bordetella pertussis
gcgcaucgagcuccugca

SEQ ID NO: 2454258 - RNA, 19 nt, Bordetella pertussis
gcgcaucgagcuccugcag

SEQ ID NO: 2454259 - RNA, 18 nt, Bordetella pertussis
gcgcaucgaucagcgcgc

SEQ ID NO: 2454260 - RNA, 20 nt, Bordetella pertussis
gcgcaucgaucucggccucg

SEQ ID NO: 2454261 - RNA, 15 nt, Bordetella pertussis
gcgcaucgaugcggc

SEQ ID NO: 2454262 - RNA, 17 nt, Bordetella pertussis
gcgcaucgaugcggccu

SEQ ID NO: 2454263 - RNA, 19 nt, Bordetella pertussis
gcgcaucgaugcggccuuc

SEQ ID NO: 2454264 - RNA, 17 nt, Bordetella pertussis
gcgcaucgccgcaggcg

SEQ ID NO: 2454265 - RNA, 22 nt, Bordetella pertussis
gcgcaucgccgcaggcgugccc

SEQ ID NO: 2454266 - RNA, 20 nt, Bordetella pertussis
gcgcaucgcgaccgccaagc

SEQ ID NO: 2454267 - RNA, 19 nt, Bordetella pertussis
gcgcaucgcgaugcgcagc

SEQ ID NO: 2454268 - RNA, 20 nt, Bordetella pertussis
gcgcaucgcgaugcgcagca

SEQ ID NO: 2454269 - RNA, 22 nt, Bordetella pertussis
gcgcaucgcgaugcgcagcagc

SEQ ID NO: 2454270 - RNA, 23 nt, Bordetella pertussis
gcgcaucgcgcacccguuccagc

SEQ ID NO: 2454271 - RNA, 20 nt, Bordetella pertussis
gcgcaucgcgcgcgccggca

SEQ ID NO: 2454272 - RNA, 13 nt, Bordetella pertussis
gcgcaucggcgcc

SEQ ID NO: 2454273 - RNA, 14 nt, Bordetella pertussis
gcgcaucggcgcca

SEQ ID NO: 2454274 - RNA, 19 nt, Bordetella pertussis
gcgcaucggcgccaguagc

SEQ ID NO: 2454275 - RNA, 14 nt, Bordetella pertussis
gcgcaucggcgccg

SEQ ID NO: 2454276 - RNA, 22 nt, Bordetella pertussis
gcgcaucgggauccgugcggcg

SEQ ID NO: 2454277 - RNA, 14 nt, Bordetella pertussis
gcgcaucgucaggc

SEQ ID NO: 2454278 - RNA, 19 nt, Bordetella pertussis
gcgcaucgucaggcaggcg

SEQ ID NO: 2454279 - RNA, 22 nt, Bordetella pertussis
gcgcaugacgaggugccugucc

SEQ ID NO: 2454280 - RNA, 14 nt, Bordetella pertussis
gcgcaugagccggc

SEQ ID NO: 2454281 - RNA, 15 nt, Bordetella pertussis
gcgcaugagccggca

SEQ ID NO: 2454282 - RNA, 23 nt, Bordetella pertussis
gcgcaugagccggcagaucggcg

SEQ ID NO: 2454283 - RNA, 16 nt, Bordetella pertussis
gcgcaugaugcugccg

SEQ ID NO: 2454284 - RNA, 19 nt, Bordetella pertussis
gcgcaugaugcugccgggc

SEQ ID NO: 2454285 - RNA, 20 nt, Bordetella pertussis
gcgcaugaugcugccgggca

SEQ ID NO: 2454286 - RNA, 18 nt, Bordetella pertussis
gcgcaugauggccggccu

SEQ ID NO: 2454287 - RNA, 19 nt, Bordetella pertussis
gcgcaugauggccggccug

SEQ ID NO: 2454288 - RNA, 21 nt, Bordetella pertussis
gcgcaugauggccggccugcc

SEQ ID NO: 2454289 - RNA, 23 nt, Bordetella pertussis
gcgcaugauggccggccugccgg

SEQ ID NO: 2454290 - RNA, 12 nt, Bordetella pertussis
gcgcaugccagc

SEQ ID NO: 2454291 - RNA, 16 nt, Bordetella pertussis
gcgcaugccagcuugc

SEQ ID NO: 2454292 - RNA, 21 nt, Bordetella pertussis
gcgcaugccagcuugcaggcg

SEQ ID NO: 2454293 - RNA, 23 nt, Bordetella pertussis
gcgcaugccagcuugcaggcgcc

SEQ ID NO: 2454294 - RNA, 13 nt, Bordetella pertussis
gcgcaugcccgac

SEQ ID NO: 2454295 - RNA, 13 nt, Bordetella pertussis
gcgcaugcgcacg

SEQ ID NO: 2454296 - RNA, 14 nt, Bordetella pertussis
gcgcaugcgcacgc

SEQ ID NO: 2454297 - RNA, 17 nt, Bordetella pertussis
gcgcaugcgccuuacuu

SEQ ID NO: 2454298 - RNA, 19 nt, Bordetella pertussis
gcgcaugcugcgcgaggug

SEQ ID NO: 2454299 - RNA, 12 nt, Bordetella pertussis
gcgcaugcugga

SEQ ID NO: 2454300 - RNA, 14 nt, Bordetella pertussis
gcgcauggccggcg

SEQ ID NO: 2454301 - RNA, 16 nt, Bordetella pertussis
gcgcauggcugguccc

SEQ ID NO: 2454302 - RNA, 18 nt, Bordetella pertussis
gcgcauggcuggucccug

SEQ ID NO: 2454303 - RNA, 21 nt, Bordetella pertussis
gcgcauggcuggucccugcgc

SEQ ID NO: 2454304 - RNA, 22 nt, Bordetella pertussis
gcgcaugggaaauccgccgggu

SEQ ID NO: 2454305 - RNA, 23 nt, Bordetella pertussis
gcgcaugggaaauccgccgggug

SEQ ID NO: 2454306 - RNA, 15 nt, Bordetella pertussis
gcgcaugggcgcagg

SEQ ID NO: 2454307 - RNA, 20 nt, Bordetella pertussis
gcgcaugggcgcaggccgcc

SEQ ID NO: 2454308 - RNA, 15 nt, Bordetella pertussis
gcgcauggugagggc

SEQ ID NO: 2454309 - RNA, 20 nt, Bordetella pertussis
gcgcauggugagggccacgc

SEQ ID NO: 2454310 - RNA, 21 nt, Bordetella pertussis
gcgcauggugagggccacgcg

SEQ ID NO: 2454311 - RNA, 21 nt, Bordetella pertussis
gcgcaugucccgcaugaccug

SEQ ID NO: 2454312 - RNA, 22 nt, Bordetella pertussis
gcgcauguccgccacgccggcc

SEQ ID NO: 2454313 - RNA, 20 nt, Bordetella pertussis
gcgcaugucgaagcaggcgg

SEQ ID NO: 2454314 - RNA, 16 nt, Bordetella pertussis
gcgcauucgccggaca

SEQ ID NO: 2454315 - RNA, 16 nt, Bordetella pertussis
gcgcauucgcgccuga

SEQ ID NO: 2454316 - RNA, 22 nt, Bordetella pertussis
gcgcauucgucgcugccgcgcg

SEQ ID NO: 2454317 - RNA, 13 nt, Bordetella pertussis
gcgcauugccgcc

SEQ ID NO: 2454318 - RNA, 14 nt, Bordetella pertussis
gcgcauugccgccg

SEQ ID NO: 2454319 - RNA, 17 nt, Bordetella pertussis
gcgcauugccgccgccc

SEQ ID NO: 2454320 - RNA, 20 nt, Bordetella pertussis
gcgcauugccgccgcccugc

SEQ ID NO: 2454321 - RNA, 19 nt, Bordetella pertussis
gcgcauugccgucggccgc

SEQ ID NO: 2454322 - RNA, 23 nt, Bordetella pertussis
gcgcauugccgucggccgcgccc

SEQ ID NO: 2454323 - RNA, 17 nt, Bordetella pertussis
gcgcauugcgguccagg

SEQ ID NO: 2454324 - RNA, 16 nt, Bordetella pertussis
gcgcauuggcccugcu

SEQ ID NO: 2454325 - RNA, 18 nt, Bordetella pertussis
gcgcauuggcccugcugg

SEQ ID NO: 2454326 - RNA, 18 nt, Bordetella pertussis
gcgcauuggugagcacgc

SEQ ID NO: 2454327 - RNA, 20 nt, Bordetella pertussis
gcgcauuggugagcacgcgc

SEQ ID NO: 2454328 - RNA, 21 nt, Bordetella pertussis
gcgcauuucgaacaaggcggu

SEQ ID NO: 2454329 - RNA, 15 nt, Bordetella pertussis
gcgcauuucgaccug

SEQ ID NO: 2454330 - RNA, 17 nt, Bordetella pertussis
gcgcauuugccgcggcg

SEQ ID NO: 2454331 - RNA, 20 nt, Bordetella pertussis
gcgcauuugccgcggcgaag

SEQ ID NO: 2454332 - RNA, 16 nt, Bordetella pertussis
gcgccaaaaggcagca

SEQ ID NO: 2454333 - RNA, 20 nt, Bordetella pertussis
gcgccaaaaggcagcaggcu

SEQ ID NO: 2454334 - RNA, 21 nt, Bordetella pertussis
gcgccaaaaggcagcaggcug

SEQ ID NO: 2454335 - RNA, 16 nt, Bordetella pertussis
gcgccaacccggccuc

SEQ ID NO: 2454336 - RNA, 18 nt, Bordetella pertussis
gcgccaacccggccucag

SEQ ID NO: 2454337 - RNA, 15 nt, Bordetella pertussis
gcgccaacgcgucga

SEQ ID NO: 2454338 - RNA, 17 nt, Bordetella pertussis
gcgccaacggugccagu

SEQ ID NO: 2454339 - RNA, 20 nt, Bordetella pertussis
gcgccaacggugccaguccc

SEQ ID NO: 2454340 - RNA, 21 nt, Bordetella pertussis
gcgccaaucagauggcgcagc

SEQ ID NO: 2454341 - RNA, 13 nt, Bordetella pertussis
gcgccaaucggcg

SEQ ID NO: 2454342 - RNA, 18 nt, Bordetella pertussis
gcgccaauuguccugguc

SEQ ID NO: 2454343 - RNA, 20 nt, Bordetella pertussis
gcgccaauuguccuggucga

SEQ ID NO: 2454344 - RNA, 21 nt, Bordetella pertussis
gcgccaauuguccuggucgac

SEQ ID NO: 2454345 - RNA, 14 nt, Bordetella pertussis
gcgccacaaagggc

SEQ ID NO: 2454346 - RNA, 22 nt, Bordetella pertussis
gcgccacaaagggcgugucucu

SEQ ID NO: 2454347 - RNA, 21 nt, Bordetella pertussis
gcgccacaauugccagccuug

SEQ ID NO: 2454348 - RNA, 16 nt, Bordetella pertussis
gcgccacacgggcgcc

SEQ ID NO: 2454349 - RNA, 17 nt, Bordetella pertussis
gcgccacacgggcgccu

SEQ ID NO: 2454350 - RNA, 21 nt, Bordetella pertussis
gcgccacacgggcgccugccg

SEQ ID NO: 2454351 - RNA, 15 nt, Bordetella pertussis
gcgccacagcgccau

SEQ ID NO: 2454352 - RNA, 13 nt, Bordetella pertussis
gcgccacaggcgc

SEQ ID NO: 2454353 - RNA, 19 nt, Bordetella pertussis
gcgccacagggccugacgc

SEQ ID NO: 2454354 - RNA, 18 nt, Bordetella pertussis
gcgccacaggugcgcggc

SEQ ID NO: 2454355 - RNA, 19 nt, Bordetella pertussis
gcgccacaggugcgcggcg

SEQ ID NO: 2454356 - RNA, 21 nt, Bordetella pertussis
gcgccaccaccggcacgccgg

SEQ ID NO: 2454357 - RNA, 23 nt, Bordetella pertussis
gcgccaccaccggcacgccggcg

SEQ ID NO: 2454358 - RNA, 18 nt, Bordetella pertussis
gcgccaccaccucggugc

SEQ ID NO: 2454359 - RNA, 19 nt, Bordetella pertussis
gcgccaccaccucggugcc

SEQ ID NO: 2454360 - RNA, 12 nt, Bordetella pertussis
gcgccaccagca

SEQ ID NO: 2454361 - RNA, 13 nt, Bordetella pertussis
gcgccaccagcag

SEQ ID NO: 2454362 - RNA, 15 nt, Bordetella pertussis
gcgccaccagcagcg

SEQ ID NO: 2454363 - RNA, 16 nt, Bordetella pertussis
gcgccaccagcagcgc

SEQ ID NO: 2454364 - RNA, 19 nt, Bordetella pertussis
gcgccaccagcagcgccag

SEQ ID NO: 2454365 - RNA, 21 nt, Bordetella pertussis
gcgccaccagcagcgccagga

SEQ ID NO: 2454366 - RNA, 18 nt, Bordetella pertussis
gcgccaccagcuugcgcg

SEQ ID NO: 2454367 - RNA, 22 nt, Bordetella pertussis
gcgccaccagcuugcgcgccgc

SEQ ID NO: 2454368 - RNA, 21 nt, Bordetella pertussis
gcgccaccaugccuugcgcga

SEQ ID NO: 2454369 - RNA, 20 nt, Bordetella pertussis
gcgccaccccgccgcugaac

SEQ ID NO: 2454370 - RNA, 13 nt, Bordetella pertussis
gcgccaccgccag

SEQ ID NO: 2454371 - RNA, 13 nt, Bordetella pertussis
gcgccaccggucg

SEQ ID NO: 2454372 - RNA, 12 nt, Bordetella pertussis
gcgccaccgugg

SEQ ID NO: 2454373 - RNA, 19 nt, Bordetella pertussis
gcgccaccuggcgcccggc

SEQ ID NO: 2454374 - RNA, 22 nt, Bordetella pertussis
gcgccaccuggcgcccggcggc

SEQ ID NO: 2454375 - RNA, 17 nt, Bordetella pertussis
gcgccaccuucgccgcg

SEQ ID NO: 2454376 - RNA, 15 nt, Bordetella pertussis
gcgccacgacgccgu

SEQ ID NO: 2454377 - RNA, 20 nt, Bordetella pertussis
gcgccacgacguagucggcg

SEQ ID NO: 2454378 - RNA, 23 nt, Bordetella pertussis
gcgccacgaucccgucauggcgg

SEQ ID NO: 2454379 - RNA, 13 nt, Bordetella pertussis
gcgccacgccagc

SEQ ID NO: 2454380 - RNA, 16 nt, Bordetella pertussis
gcgccacgccagcggc

SEQ ID NO: 2454381 - RNA, 17 nt, Bordetella pertussis
gcgccacgccagcggcg

SEQ ID NO: 2454382 - RNA, 12 nt, Bordetella pertussis
gcgccacgcccg

SEQ ID NO: 2454383 - RNA, 15 nt, Bordetella pertussis
gcgccacgcccuggc

SEQ ID NO: 2454384 - RNA, 18 nt, Bordetella pertussis
gcgccacgcccuggcggu

SEQ ID NO: 2454385 - RNA, 14 nt, Bordetella pertussis
gcgccacgccggcc

SEQ ID NO: 2454386 - RNA, 15 nt, Bordetella pertussis
gcgccacgccggcca

SEQ ID NO: 2454387 - RNA, 17 nt, Bordetella pertussis
gcgccacgccgucagcg

SEQ ID NO: 2454388 - RNA, 17 nt, Bordetella pertussis
gcgccacgcgagcccgc

SEQ ID NO: 2454389 - RNA, 21 nt, Bordetella pertussis
gcgccacgcgagcccgcguca

SEQ ID NO: 2454390 - RNA, 23 nt, Bordetella pertussis
gcgccacgcuguuuucggccgac

SEQ ID NO: 2454391 - RNA, 14 nt, Bordetella pertussis
gcgccacggcgaug

SEQ ID NO: 2454392 - RNA, 15 nt, Bordetella pertussis
gcgccacggcgguga

SEQ ID NO: 2454393 - RNA, 16 nt, Bordetella pertussis
gcgccacggcggugau

SEQ ID NO: 2454394 - RNA, 14 nt, Bordetella pertussis
gcgccacggcgucg

SEQ ID NO: 2454395 - RNA, 17 nt, Bordetella pertussis
gcgccacggcgucgccg

SEQ ID NO: 2454396 - RNA, 22 nt, Bordetella pertussis
gcgccacggcgucgccggccag

SEQ ID NO: 2454397 - RNA, 13 nt, Bordetella pertussis
gcgccacggcuuc

SEQ ID NO: 2454398 - RNA, 12 nt, Bordetella pertussis
gcgccacggucu

SEQ ID NO: 2454399 - RNA, 19 nt, Bordetella pertussis
gcgccacggucugcacgcc

SEQ ID NO: 2454400 - RNA, 21 nt, Bordetella pertussis
gcgccacggucugcacgccgg

SEQ ID NO: 2454401 - RNA, 14 nt, Bordetella pertussis
gcgccacguccagc

SEQ ID NO: 2454402 - RNA, 15 nt, Bordetella pertussis
gcgccacguccagca

SEQ ID NO: 2454403 - RNA, 17 nt, Bordetella pertussis
gcgccacguccagcacg

SEQ ID NO: 2454404 - RNA, 19 nt, Bordetella pertussis
gcgccacguccagcacggc

SEQ ID NO: 2454405 - RNA, 17 nt, Bordetella pertussis
gcgccacuauguggcgu

SEQ ID NO: 2454406 - RNA, 15 nt, Bordetella pertussis
gcgccacugccaggc

SEQ ID NO: 2454407 - RNA, 18 nt, Bordetella pertussis
gcgccacugccaggcgcc

SEQ ID NO: 2454408 - RNA, 18 nt, Bordetella pertussis
gcgccagaaagcgcggcc

SEQ ID NO: 2454409 - RNA, 16 nt, Bordetella pertussis
gcgccagaugcgccgc

SEQ ID NO: 2454410 - RNA, 19 nt, Bordetella pertussis
gcgccagaugcgccgcacg

SEQ ID NO: 2454411 - RNA, 17 nt, Bordetella pertussis
gcgccagcaccggcacg

SEQ ID NO: 2454412 - RNA, 12 nt, Bordetella pertussis
gcgccagcacga

SEQ ID NO: 2454413 - RNA, 13 nt, Bordetella pertussis
gcgccagcacggc

SEQ ID NO: 2454414 - RNA, 16 nt, Bordetella pertussis
gcgccagcacgguggc

SEQ ID NO: 2454415 - RNA, 17 nt, Bordetella pertussis
gcgccagcacgguggcg

SEQ ID NO: 2454416 - RNA, 21 nt, Bordetella pertussis
gcgccagcagcaggccguaac

SEQ ID NO: 2454417 - RNA, 12 nt, Bordetella pertussis
gcgccagcagcg

SEQ ID NO: 2454418 - RNA, 13 nt, Bordetella pertussis
gcgccagcagcgc

SEQ ID NO: 2454419 - RNA, 15 nt, Bordetella pertussis
gcgccagcagcgccg

SEQ ID NO: 2454420 - RNA, 18 nt, Bordetella pertussis
gcgccagcagcgccgguu

SEQ ID NO: 2454421 - RNA, 15 nt, Bordetella pertussis
gcgccagcaggaugu

SEQ ID NO: 2454422 - RNA, 14 nt, Bordetella pertussis
gcgccagcaggguc

SEQ ID NO: 2454423 - RNA, 20 nt, Bordetella pertussis
gcgccagcagggucagcggc

SEQ ID NO: 2454424 - RNA, 23 nt, Bordetella pertussis
gcgccagcaugacggggucgggg

SEQ ID NO: 2454425 - RNA, 19 nt, Bordetella pertussis
gcgccagcaugcgcgcggc

SEQ ID NO: 2454426 - RNA, 14 nt, Bordetella pertussis
gcgccagccacgcg

SEQ ID NO: 2454427 - RNA, 15 nt, Bordetella pertussis
gcgccagccacgcgc

SEQ ID NO: 2454428 - RNA, 13 nt, Bordetella pertussis
gcgccagccagcg

SEQ ID NO: 2454429 - RNA, 14 nt, Bordetella pertussis
gcgccagccagcgc

SEQ ID NO: 2454430 - RNA, 21 nt, Bordetella pertussis
gcgccagccagcgcaugccgu

SEQ ID NO: 2454431 - RNA, 12 nt, Bordetella pertussis
gcgccagcccgc

SEQ ID NO: 2454432 - RNA, 21 nt, Bordetella pertussis
gcgccagcccgcccgcgagcg

SEQ ID NO: 2454433 - RNA, 14 nt, Bordetella pertussis
gcgccagcccgccg

SEQ ID NO: 2454434 - RNA, 15 nt, Bordetella pertussis
gcgccagcccgccgc

SEQ ID NO: 2454435 - RNA, 18 nt, Bordetella pertussis
gcgccagcccgccgcugg

SEQ ID NO: 2454436 - RNA, 21 nt, Bordetella pertussis
gcgccagcccgccgcuggucg

SEQ ID NO: 2454437 - RNA, 18 nt, Bordetella pertussis
gcgccagcccgcugccga

SEQ ID NO: 2454438 - RNA, 13 nt, Bordetella pertussis
gcgccagccgcgc

SEQ ID NO: 2454439 - RNA, 21 nt, Bordetella pertussis
gcgccagccgcgccugcagca

SEQ ID NO: 2454440 - RNA, 23 nt, Bordetella pertussis
gcgccagccgcgccugcagcagc

SEQ ID NO: 2454441 - RNA, 14 nt, Bordetella pertussis
gcgccagccgcgcg

SEQ ID NO: 2454442 - RNA, 18 nt, Bordetella pertussis
gcgccagccgcgcgaccu

SEQ ID NO: 2454443 - RNA, 17 nt, Bordetella pertussis
gcgccagccgcuccagg

SEQ ID NO: 2454444 - RNA, 13 nt, Bordetella pertussis
gcgccagccgcug

SEQ ID NO: 2454445 - RNA, 18 nt, Bordetella pertussis
gcgccagccgcugcagcg

SEQ ID NO: 2454446 - RNA, 21 nt, Bordetella pertussis
gcgccagccgcugcagcgacu

SEQ ID NO: 2454447 - RNA, 23 nt, Bordetella pertussis
gcgccagccguugcgccagcggc

SEQ ID NO: 2454448 - RNA, 12 nt, Bordetella pertussis
gcgccagcgcca

SEQ ID NO: 2454449 - RNA, 13 nt, Bordetella pertussis
gcgccagcgccac

SEQ ID NO: 2454450 - RNA, 14 nt, Bordetella pertussis
gcgccagcgccagc

SEQ ID NO: 2454451 - RNA, 17 nt, Bordetella pertussis
gcgccagcgccagcguc

SEQ ID NO: 2454452 - RNA, 18 nt, Bordetella pertussis
gcgccagcgccagcguca

SEQ ID NO: 2454453 - RNA, 14 nt, Bordetella pertussis
gcgccagcgccccg

SEQ ID NO: 2454454 - RNA, 16 nt, Bordetella pertussis
gcgccagcgccccggc

SEQ ID NO: 2454455 - RNA, 18 nt, Bordetella pertussis
gcgccagcgccccggcgu

SEQ ID NO: 2454456 - RNA, 12 nt, Bordetella pertussis
gcgccagcgccg

SEQ ID NO: 2454457 - RNA, 17 nt, Bordetella pertussis
gcgccagcgccgcgcgc

SEQ ID NO: 2454458 - RNA, 21 nt, Bordetella pertussis
gcgccagcgccgcgcgcgugc

SEQ ID NO: 2454459 - RNA, 14 nt, Bordetella pertussis
gcgccagcgccggc

SEQ ID NO: 2454460 - RNA, 13 nt, Bordetella pertussis
gcgccagcgccuc

SEQ ID NO: 2454461 - RNA, 15 nt, Bordetella pertussis
gcgccagcgccucca

SEQ ID NO: 2454462 - RNA, 20 nt, Bordetella pertussis
gcgccagcgccuccaucagc

SEQ ID NO: 2454463 - RNA, 16 nt, Bordetella pertussis
gcgccagcgccugggc

SEQ ID NO: 2454464 - RNA, 13 nt, Bordetella pertussis
gcgccagcgcgcg

SEQ ID NO: 2454465 - RNA, 12 nt, Bordetella pertussis
gcgccagcgcgg

SEQ ID NO: 2454466 - RNA, 14 nt, Bordetella pertussis
gcgccagcgcggcc

SEQ ID NO: 2454467 - RNA, 16 nt, Bordetella pertussis
gcgccagcgcggccag

SEQ ID NO: 2454468 - RNA, 17 nt, Bordetella pertussis
gcgccagcgcggccagc

SEQ ID NO: 2454469 - RNA, 22 nt, Bordetella pertussis
gcgccagcgcggccagcgcguc

SEQ ID NO: 2454470 - RNA, 23 nt, Bordetella pertussis
gcgccagcgcggccagcgcgucg

SEQ ID NO: 2454471 - RNA, 20 nt, Bordetella pertussis
gcgccagcgcggcgggccgg

SEQ ID NO: 2454472 - RNA, 18 nt, Bordetella pertussis
gcgccagcgcuguccagg

SEQ ID NO: 2454473 - RNA, 20 nt, Bordetella pertussis
gcgccagcgcuguccaggcc

SEQ ID NO: 2454474 - RNA, 22 nt, Bordetella pertussis
gcgccagcgcuucgggcagcuc

SEQ ID NO: 2454475 - RNA, 16 nt, Bordetella pertussis
gcgccagcggauggug

SEQ ID NO: 2454476 - RNA, 21 nt, Bordetella pertussis
gcgccagcggauggugcucgg

SEQ ID NO: 2454477 - RNA, 18 nt, Bordetella pertussis
gcgccagcggcauugccc

SEQ ID NO: 2454478 - RNA, 13 nt, Bordetella pertussis
gcgccagcggccg

SEQ ID NO: 2454479 - RNA, 19 nt, Bordetella pertussis
gcgccagcggccgucgccu

SEQ ID NO: 2454480 - RNA, 14 nt, Bordetella pertussis
gcgccagcggcgac

SEQ ID NO: 2454481 - RNA, 18 nt, Bordetella pertussis
gcgccagcggcgacugcc

SEQ ID NO: 2454482 - RNA, 13 nt, Bordetella pertussis
gcgccagcggcug

SEQ ID NO: 2454483 - RNA, 14 nt, Bordetella pertussis
gcgccagcggcugc

SEQ ID NO: 2454484 - RNA, 15 nt, Bordetella pertussis
gcgccagcggcugcu

SEQ ID NO: 2454485 - RNA, 17 nt, Bordetella pertussis
gcgccagcggcugcuug

SEQ ID NO: 2454486 - RNA, 18 nt, Bordetella pertussis
gcgccagcggcugcuuga

SEQ ID NO: 2454487 - RNA, 14 nt, Bordetella pertussis
gcgccagcguacga

SEQ ID NO: 2454488 - RNA, 12 nt, Bordetella pertussis
gcgccagcgugg

SEQ ID NO: 2454489 - RNA, 15 nt, Bordetella pertussis
gcgccagcguggccg

SEQ ID NO: 2454490 - RNA, 18 nt, Bordetella pertussis
gcgccagcguucggccac

SEQ ID NO: 2454491 - RNA, 17 nt, Bordetella pertussis
gcgccagcuccagccgc

SEQ ID NO: 2454492 - RNA, 18 nt, Bordetella pertussis
gcgccagcuccagccgca

SEQ ID NO: 2454493 - RNA, 20 nt, Bordetella pertussis
gcgccagcuccagccgcagg

SEQ ID NO: 2454494 - RNA, 21 nt, Bordetella pertussis
gcgccagcuccagccgcaggc

SEQ ID NO: 2454495 - RNA, 12 nt, Bordetella pertussis
gcgccagcucgc

SEQ ID NO: 2454496 - RNA, 17 nt, Bordetella pertussis
gcgccagcucgcgcagc

SEQ ID NO: 2454497 - RNA, 21 nt, Bordetella pertussis
gcgccagcucgcgcagcaggc

SEQ ID NO: 2454498 - RNA, 23 nt, Bordetella pertussis
gcgccagcucgcguugcaccgcg

SEQ ID NO: 2454499 - RNA, 21 nt, Bordetella pertussis
gcgccagcucggccaaggcau

SEQ ID NO: 2454500 - RNA, 23 nt, Bordetella pertussis
gcgccagcugaccucgcccaggc

SEQ ID NO: 2454501 - RNA, 18 nt, Bordetella pertussis
gcgccagcugcgcagcga

SEQ ID NO: 2454502 - RNA, 19 nt, Bordetella pertussis
gcgccagcuggaccgccug

SEQ ID NO: 2454503 - RNA, 21 nt, Bordetella pertussis
gcgccagcuggaccgccuggc

SEQ ID NO: 2454504 - RNA, 15 nt, Bordetella pertussis
gcgccagcugggcga

SEQ ID NO: 2454505 - RNA, 16 nt, Bordetella pertussis
gcgccagcugggcguu

SEQ ID NO: 2454506 - RNA, 14 nt, Bordetella pertussis
gcgccagcuugcgc

SEQ ID NO: 2454507 - RNA, 19 nt, Bordetella pertussis
gcgccagcuugcgcgccuu

SEQ ID NO: 2454508 - RNA, 15 nt, Bordetella pertussis
gcgccaggaacagcg

SEQ ID NO: 2454509 - RNA, 17 nt, Bordetella pertussis
gcgccaggaacagcgcc

SEQ ID NO: 2454510 - RNA, 20 nt, Bordetella pertussis
gcgccaggaacagcgccggc

SEQ ID NO: 2454511 - RNA, 21 nt, Bordetella pertussis
gcgccaggaacagcgccggca

SEQ ID NO: 2454512 - RNA, 17 nt, Bordetella pertussis
gcgccaggaagcgcgcc

SEQ ID NO: 2454513 - RNA, 18 nt, Bordetella pertussis
gcgccaggaagcgcgccg

SEQ ID NO: 2454514 - RNA, 19 nt, Bordetella pertussis
gcgccaggaagcgcgccgc

SEQ ID NO: 2454515 - RNA, 14 nt, Bordetella pertussis
gcgccaggauggcc

SEQ ID NO: 2454516 - RNA, 16 nt, Bordetella pertussis
gcgccaggauggccac

SEQ ID NO: 2454517 - RNA, 22 nt, Bordetella pertussis
gcgccaggauggccacgaccac

SEQ ID NO: 2454518 - RNA, 20 nt, Bordetella pertussis
gcgccaggcaaaggcccagg

SEQ ID NO: 2454519 - RNA, 21 nt, Bordetella pertussis
gcgccaggcaaaggcccaggc

SEQ ID NO: 2454520 - RNA, 22 nt, Bordetella pertussis
gcgccaggcccagggccaggua

SEQ ID NO: 2454521 - RNA, 16 nt, Bordetella pertussis
gcgccaggccccgccg

SEQ ID NO: 2454522 - RNA, 12 nt, Bordetella pertussis
gcgccaggccgc

SEQ ID NO: 2454523 - RNA, 19 nt, Bordetella pertussis
gcgccaggccgcgcagggc

SEQ ID NO: 2454524 - RNA, 16 nt, Bordetella pertussis
gcgccaggccggcggc

SEQ ID NO: 2454525 - RNA, 18 nt, Bordetella pertussis
gcgccaggccucggucgc

SEQ ID NO: 2454526 - RNA, 20 nt, Bordetella pertussis
gcgccaggccuucgacgucc

SEQ ID NO: 2454527 - RNA, 16 nt, Bordetella pertussis
gcgccaggcgauggcc

SEQ ID NO: 2454528 - RNA, 14 nt, Bordetella pertussis
gcgccaggcgcgca

SEQ ID NO: 2454529 - RNA, 15 nt, Bordetella pertussis
gcgccaggcgcgcau

SEQ ID NO: 2454530 - RNA, 16 nt, Bordetella pertussis
gcgccaggcgcgcauc

SEQ ID NO: 2454531 - RNA, 16 nt, Bordetella pertussis
gcgccaggcgcucggc

SEQ ID NO: 2454532 - RNA, 17 nt, Bordetella pertussis
gcgccaggcgcugcgcg

SEQ ID NO: 2454533 - RNA, 22 nt, Bordetella pertussis
gcgccaggcgguacaggccggc

SEQ ID NO: 2454534 - RNA, 15 nt, Bordetella pertussis
gcgccaggcggucau

SEQ ID NO: 2454535 - RNA, 16 nt, Bordetella pertussis
gcgccaggcggucaua

SEQ ID NO: 2454536 - RNA, 19 nt, Bordetella pertussis
gcgccaggcguagaccacc

SEQ ID NO: 2454537 - RNA, 21 nt, Bordetella pertussis
gcgccaggcguagaccaccug

SEQ ID NO: 2454538 - RNA, 23 nt, Bordetella pertussis
gcgccaggcguagaccaccugcu

SEQ ID NO: 2454539 - RNA, 11 nt, Bordetella pertussis
gcgccaggcug

SEQ ID NO: 2454540 - RNA, 17 nt, Bordetella pertussis
gcgccaggcugucgucg

SEQ ID NO: 2454541 - RNA, 16 nt, Bordetella pertussis
gcgccaggcuuugggc

SEQ ID NO: 2454542 - RNA, 20 nt, Bordetella pertussis
gcgccagggccaggccgccg

SEQ ID NO: 2454543 - RNA, 23 nt, Bordetella pertussis
gcgccagggccccuccggcgccg

SEQ ID NO: 2454544 - RNA, 16 nt, Bordetella pertussis
gcgccagggccgccgc

SEQ ID NO: 2454545 - RNA, 17 nt, Bordetella pertussis
gcgccagggccgccgcg

SEQ ID NO: 2454546 - RNA, 18 nt, Bordetella pertussis
gcgccagggccgccgcgc

SEQ ID NO: 2454547 - RNA, 22 nt, Bordetella pertussis
gcgccagggccgccgcgcccag

SEQ ID NO: 2454548 - RNA, 14 nt, Bordetella pertussis
gcgccagggccucc

SEQ ID NO: 2454549 - RNA, 15 nt, Bordetella pertussis
gcgccagggcgccgc

SEQ ID NO: 2454550 - RNA, 22 nt, Bordetella pertussis
gcgccagggcgcggaucauggg

SEQ ID NO: 2454551 - RNA, 16 nt, Bordetella pertussis
gcgccaggggaugacg

SEQ ID NO: 2454552 - RNA, 13 nt, Bordetella pertussis
gcgccagggugcc

SEQ ID NO: 2454553 - RNA, 14 nt, Bordetella pertussis
gcgccagggugccg

SEQ ID NO: 2454554 - RNA, 19 nt, Bordetella pertussis
gcgccagggugccgaaacc

SEQ ID NO: 2454555 - RNA, 18 nt, Bordetella pertussis
gcgccagguaggccggcg

SEQ ID NO: 2454556 - RNA, 19 nt, Bordetella pertussis
gcgccagguaggccggcgc

SEQ ID NO: 2454557 - RNA, 20 nt, Bordetella pertussis
gcgccagguaggccggcgcg

SEQ ID NO: 2454558 - RNA, 17 nt, Bordetella pertussis
gcgccaggucgcgcacc

SEQ ID NO: 2454559 - RNA, 21 nt, Bordetella pertussis
gcgccaggucgcgcaccaggu

SEQ ID NO: 2454560 - RNA, 22 nt, Bordetella pertussis
gcgccaggucgcgcaccagguc

SEQ ID NO: 2454561 - RNA, 15 nt, Bordetella pertussis
gcgccaggugcacgg

SEQ ID NO: 2454562 - RNA, 19 nt, Bordetella pertussis
gcgccaggugcacggugga

SEQ ID NO: 2454563 - RNA, 22 nt, Bordetella pertussis
gcgccaggugcuugcggcuguc

SEQ ID NO: 2454564 - RNA, 17 nt, Bordetella pertussis
gcgccaguagcgccggc

SEQ ID NO: 2454565 - RNA, 14 nt, Bordetella pertussis
gcgccaguccagcg

SEQ ID NO: 2454566 - RNA, 15 nt, Bordetella pertussis
gcgccaguccagcgc

SEQ ID NO: 2454567 - RNA, 18 nt, Bordetella pertussis
gcgccaguccagcgcgcc

SEQ ID NO: 2454568 - RNA, 19 nt, Bordetella pertussis
gcgccaguccagcgcgccg

SEQ ID NO: 2454569 - RNA, 20 nt, Bordetella pertussis
gcgccaguccagcgcgccgc

SEQ ID NO: 2454570 - RNA, 22 nt, Bordetella pertussis
gcgccaguccccaugcggggac

SEQ ID NO: 2454571 - RNA, 20 nt, Bordetella pertussis
gcgccagucgcgcagcaccu

SEQ ID NO: 2454572 - RNA, 21 nt, Bordetella pertussis
gcgccagucgcgcagcaccuc

SEQ ID NO: 2454573 - RNA, 20 nt, Bordetella pertussis
gcgccaguucaaggcgcgag

SEQ ID NO: 2454574 - RNA, 16 nt, Bordetella pertussis
gcgccaguucgguuuc

SEQ ID NO: 2454575 - RNA, 15 nt, Bordetella pertussis
gcgccaguugcgcac

SEQ ID NO: 2454576 - RNA, 17 nt, Bordetella pertussis
gcgccaguugcgcaccg

SEQ ID NO: 2454577 - RNA, 18 nt, Bordetella pertussis
gcgccaguugcgcaccgc

SEQ ID NO: 2454578 - RNA, 19 nt, Bordetella pertussis
gcgccaguugcgcaccgcu

SEQ ID NO: 2454579 - RNA, 19 nt, Bordetella pertussis
gcgccaguugcggggcgcc

SEQ ID NO: 2454580 - RNA, 23 nt, Bordetella pertussis
gcgccaguugcggggcgcccagc

SEQ ID NO: 2454581 - RNA, 24 nt, Bordetella pertussis
gcgccaguugcggggcgcccagcg

SEQ ID NO: 2454582 - RNA, 16 nt, Bordetella pertussis
gcgccauacccggucg

SEQ ID NO: 2454583 - RNA, 21 nt, Bordetella pertussis
gcgccauacccggucgaucag

SEQ ID NO: 2454584 - RNA, 15 nt, Bordetella pertussis
gcgccauacugccau

SEQ ID NO: 2454585 - RNA, 19 nt, Bordetella pertussis
gcgccauauugaugcagca

SEQ ID NO: 2454586 - RNA, 21 nt, Bordetella pertussis
gcgccauauugaugcagcacg

SEQ ID NO: 2454587 - RNA, 22 nt, Bordetella pertussis
gcgccauauugaugcagcacgu

SEQ ID NO: 2454588 - RNA, 23 nt, Bordetella pertussis
gcgccaucaaugccaaucaugcg

SEQ ID NO: 2454589 - RNA, 18 nt, Bordetella pertussis
gcgccauccggcgcauga

SEQ ID NO: 2454590 - RNA, 23 nt, Bordetella pertussis
gcgccauccugaacgccgcgcug

SEQ ID NO: 2454591 - RNA, 19 nt, Bordetella pertussis
gcgccaucgacgggcggcu

SEQ ID NO: 2454592 - RNA, 20 nt, Bordetella pertussis
gcgccaucgacgggcggcug

SEQ ID NO: 2454593 - RNA, 21 nt, Bordetella pertussis
gcgccaucgacgggcggcugc

SEQ ID NO: 2454594 - RNA, 13 nt, Bordetella pertussis
gcgccaucggcau

SEQ ID NO: 2454595 - RNA, 20 nt, Bordetella pertussis
gcgccaucuaccugucgggc

SEQ ID NO: 2454596 - RNA, 23 nt, Bordetella pertussis
gcgccaucucaaccacgaacacg

SEQ ID NO: 2454597 - RNA, 22 nt, Bordetella pertussis
gcgccaugaacgcuugacggcc

SEQ ID NO: 2454598 - RNA, 23 nt, Bordetella pertussis
gcgccaugaacgcuugacggcca

SEQ ID NO: 2454599 - RNA, 13 nt, Bordetella pertussis
gcgccaugaacuc

SEQ ID NO: 2454600 - RNA, 22 nt, Bordetella pertussis
gcgccaugaccacgucgaccag

SEQ ID NO: 2454601 - RNA, 14 nt, Bordetella pertussis
gcgccaugagccac

SEQ ID NO: 2454602 - RNA, 17 nt, Bordetella pertussis
gcgccaugagccacaau

SEQ ID NO: 2454603 - RNA, 15 nt, Bordetella pertussis
gcgccaugaucgccg

SEQ ID NO: 2454604 - RNA, 17 nt, Bordetella pertussis
gcgccaugaucgccggc

SEQ ID NO: 2454605 - RNA, 18 nt, Bordetella pertussis
gcgccaugaucgccggca

SEQ ID NO: 2454606 - RNA, 22 nt, Bordetella pertussis
gcgccaugcaacacgaccagca

SEQ ID NO: 2454607 - RNA, 16 nt, Bordetella pertussis
gcgccaugccgcgccc

SEQ ID NO: 2454608 - RNA, 20 nt, Bordetella pertussis
gcgccaugccgcgcccgccu

SEQ ID NO: 2454609 - RNA, 18 nt, Bordetella pertussis
gcgccaugccgggauggg

SEQ ID NO: 2454610 - RNA, 16 nt, Bordetella pertussis
gcgccaugcgacagcc

SEQ ID NO: 2454611 - RNA, 18 nt, Bordetella pertussis
gcgccaugcgacagcccg

SEQ ID NO: 2454612 - RNA, 16 nt, Bordetella pertussis
gcgccaugcgcaccac

SEQ ID NO: 2454613 - RNA, 18 nt, Bordetella pertussis
gcgccaugcgcccggcca

SEQ ID NO: 2454614 - RNA, 20 nt, Bordetella pertussis
gcgccaugcucgcgcacagc

SEQ ID NO: 2454615 - RNA, 22 nt, Bordetella pertussis
gcgccaugcucgcgcacagcgc

SEQ ID NO: 2454616 - RNA, 17 nt, Bordetella pertussis
gcgccaugcuggccgcc

SEQ ID NO: 2454617 - RNA, 18 nt, Bordetella pertussis
gcgccaugcuggccgccg

SEQ ID NO: 2454618 - RNA, 11 nt, Bordetella pertussis
gcgccauggca

SEQ ID NO: 2454619 - RNA, 16 nt, Bordetella pertussis
gcgccauggcaggguc

SEQ ID NO: 2454620 - RNA, 14 nt, Bordetella pertussis
gcgccauggccggc

SEQ ID NO: 2454621 - RNA, 15 nt, Bordetella pertussis
gcgccauggccggcc

SEQ ID NO: 2454622 - RNA, 17 nt, Bordetella pertussis
gcgccauggccggccgc

SEQ ID NO: 2454623 - RNA, 19 nt, Bordetella pertussis
gcgccauggccggccgccg

SEQ ID NO: 2454624 - RNA, 20 nt, Bordetella pertussis
gcgccaugucgacgaucucg

SEQ ID NO: 2454625 - RNA, 17 nt, Bordetella pertussis
gcgccaugugcguugcc

SEQ ID NO: 2454626 - RNA, 20 nt, Bordetella pertussis
gcgccaugugcguugccagc

SEQ ID NO: 2454627 - RNA, 22 nt, Bordetella pertussis
gcgccauguggcgacgcccagc

SEQ ID NO: 2454628 - RNA, 15 nt, Bordetella pertussis
gcgccauugccacgg

SEQ ID NO: 2454629 - RNA, 20 nt, Bordetella pertussis
gcgccauugccacggcgggc

SEQ ID NO: 2454630 - RNA, 18 nt, Bordetella pertussis
gcgcccaauccgaucagc

SEQ ID NO: 2454631 - RNA, 19 nt, Bordetella pertussis
gcgcccaauccgaucagca

SEQ ID NO: 2454632 - RNA, 16 nt, Bordetella pertussis
gcgcccaaucgggcag

SEQ ID NO: 2454633 - RNA, 18 nt, Bordetella pertussis
gcgcccaaucgggcagca

SEQ ID NO: 2454634 - RNA, 20 nt, Bordetella pertussis
gcgcccaaucgggcagcacg

SEQ ID NO: 2454635 - RNA, 22 nt, Bordetella pertussis
gcgcccaaucgggcagcacgcg

SEQ ID NO: 2454636 - RNA, 16 nt, Bordetella pertussis
gcgcccaccgagacgc

SEQ ID NO: 2454637 - RNA, 22 nt, Bordetella pertussis
gcgcccaccgagacgcugucgc

SEQ ID NO: 2454638 - RNA, 23 nt, Bordetella pertussis
gcgcccaccgagacgcugucgcg

SEQ ID NO: 2454639 - RNA, 20 nt, Bordetella pertussis
gcgcccacgcacaugaugcc

SEQ ID NO: 2454640 - RNA, 13 nt, Bordetella pertussis
gcgcccacggccg

SEQ ID NO: 2454641 - RNA, 13 nt, Bordetella pertussis
gcgcccacggccu

SEQ ID NO: 2454642 - RNA, 22 nt, Bordetella pertussis
gcgcccacuggggacaugcaug

SEQ ID NO: 2454643 - RNA, 16 nt, Bordetella pertussis
gcgcccagaucgaucc

SEQ ID NO: 2454644 - RNA, 14 nt, Bordetella pertussis
gcgcccagcagcgc

SEQ ID NO: 2454645 - RNA, 16 nt, Bordetella pertussis
gcgcccagcagcgcca

SEQ ID NO: 2454646 - RNA, 17 nt, Bordetella pertussis
gcgcccagcagcgccac

SEQ ID NO: 2454647 - RNA, 12 nt, Bordetella pertussis
gcgcccagcaug

SEQ ID NO: 2454648 - RNA, 18 nt, Bordetella pertussis
gcgcccagcauggucggc

SEQ ID NO: 2454649 - RNA, 13 nt, Bordetella pertussis
gcgcccagccccg

SEQ ID NO: 2454650 - RNA, 14 nt, Bordetella pertussis
gcgcccagccccgc

SEQ ID NO: 2454651 - RNA, 20 nt, Bordetella pertussis
gcgcccagccccgcggccgc

SEQ ID NO: 2454652 - RNA, 17 nt, Bordetella pertussis
gcgcccagccgcgccau

SEQ ID NO: 2454653 - RNA, 13 nt, Bordetella pertussis
gcgcccagcgagc

SEQ ID NO: 2454654 - RNA, 20 nt, Bordetella pertussis
gcgcccagcgagcugcgcug

SEQ ID NO: 2454655 - RNA, 12 nt, Bordetella pertussis
gcgcccagcgcc

SEQ ID NO: 2454656 - RNA, 15 nt, Bordetella pertussis
gcgcccagcgccauc

SEQ ID NO: 2454657 - RNA, 13 nt, Bordetella pertussis
gcgcccagcgcgg

SEQ ID NO: 2454658 - RNA, 15 nt, Bordetella pertussis
gcgcccagcgcggcc

SEQ ID NO: 2454659 - RNA, 17 nt, Bordetella pertussis
gcgcccagcgcggccuu

SEQ ID NO: 2454660 - RNA, 16 nt, Bordetella pertussis
gcgcccagcggcaggc

SEQ ID NO: 2454661 - RNA, 20 nt, Bordetella pertussis
gcgcccagcggcaggcuggc

SEQ ID NO: 2454662 - RNA, 13 nt, Bordetella pertussis
gcgcccagcgucu

SEQ ID NO: 2454663 - RNA, 13 nt, Bordetella pertussis
gcgcccagcuggc

SEQ ID NO: 2454664 - RNA, 13 nt, Bordetella pertussis
gcgcccaggccag

SEQ ID NO: 2454665 - RNA, 20 nt, Bordetella pertussis
gcgcccaggccagccaggug

SEQ ID NO: 2454666 - RNA, 19 nt, Bordetella pertussis
gcgcccaggcccagcgcgc

SEQ ID NO: 2454667 - RNA, 17 nt, Bordetella pertussis
gcgcccaggccgaucag

SEQ ID NO: 2454668 - RNA, 19 nt, Bordetella pertussis
gcgcccaggccgaucagcg

SEQ ID NO: 2454669 - RNA, 21 nt, Bordetella pertussis
gcgcccaggcgaugcccagcg

SEQ ID NO: 2454670 - RNA, 17 nt, Bordetella pertussis
gcgcccaggggccggcg

SEQ ID NO: 2454671 - RNA, 18 nt, Bordetella pertussis
gcgcccagggugguggcc

SEQ ID NO: 2454672 - RNA, 19 nt, Bordetella pertussis
gcgcccagggugguggccu

SEQ ID NO: 2454673 - RNA, 21 nt, Bordetella pertussis
gcgcccagggugguggccucg

SEQ ID NO: 2454674 - RNA, 16 nt, Bordetella pertussis
gcgcccagguacauca

SEQ ID NO: 2454675 - RNA, 22 nt, Bordetella pertussis
gcgcccagguacaucaucccca

SEQ ID NO: 2454676 - RNA, 16 nt, Bordetella pertussis
gcgcccagguccugcg

SEQ ID NO: 2454677 - RNA, 21 nt, Bordetella pertussis
gcgcccaguuccacgcggccg

SEQ ID NO: 2454678 - RNA, 18 nt, Bordetella pertussis
gcgcccaugcgcuggcgc

SEQ ID NO: 2454679 - RNA, 13 nt, Bordetella pertussis
gcgcccauggcgc

SEQ ID NO: 2454680 - RNA, 14 nt, Bordetella pertussis
gcgcccauggcgcg

SEQ ID NO: 2454681 - RNA, 15 nt, Bordetella pertussis
gcgcccauggcgcgc

SEQ ID NO: 2454682 - RNA, 17 nt, Bordetella pertussis
gcgcccauggcgcgcag

SEQ ID NO: 2454683 - RNA, 14 nt, Bordetella pertussis
gcgcccauuccgag

SEQ ID NO: 2454684 - RNA, 17 nt, Bordetella pertussis
gcgcccauuucgauggc

SEQ ID NO: 2454685 - RNA, 17 nt, Bordetella pertussis
gcgccccaacgcggcca

SEQ ID NO: 2454686 - RNA, 19 nt, Bordetella pertussis
gcgccccaacgcggccagc

SEQ ID NO: 2454687 - RNA, 13 nt, Bordetella pertussis
gcgccccacccgg

SEQ ID NO: 2454688 - RNA, 17 nt, Bordetella pertussis
gcgcccccacgccgcug

SEQ ID NO: 2454689 - RNA, 14 nt, Bordetella pertussis
gcgcccccagcagc

SEQ ID NO: 2454690 - RNA, 15 nt, Bordetella pertussis
gcgcccccagcagcg

SEQ ID NO: 2454691 - RNA, 17 nt, Bordetella pertussis
gcgcccccagcgccguc

SEQ ID NO: 2454692 - RNA, 15 nt, Bordetella pertussis
gcgcccccgcggcgc

SEQ ID NO: 2454693 - RNA, 22 nt, Bordetella pertussis
gcgccccgaucagcaagggccc

SEQ ID NO: 2454694 - RNA, 15 nt, Bordetella pertussis
gcgccccgccaugcg

SEQ ID NO: 2454695 - RNA, 14 nt, Bordetella pertussis
gcgccccgcuggcc

SEQ ID NO: 2454696 - RNA, 21 nt, Bordetella pertussis
gcgccccuagcgccgcgccag

SEQ ID NO: 2454697 - RNA, 19 nt, Bordetella pertussis
gcgccccuugcggggcgcg

SEQ ID NO: 2454698 - RNA, 20 nt, Bordetella pertussis
gcgccccuugcggggcgcgu

SEQ ID NO: 2454699 - RNA, 12 nt, Bordetella pertussis
gcgcccgaagcc

SEQ ID NO: 2454700 - RNA, 23 nt, Bordetella pertussis
gcgcccgaaggugggcgaaccgc

SEQ ID NO: 2454701 - RNA, 16 nt, Bordetella pertussis
gcgcccgacggcgcgc

SEQ ID NO: 2454702 - RNA, 22 nt, Bordetella pertussis
gcgcccgacggcgcgcccgccg

SEQ ID NO: 2454703 - RNA, 23 nt, Bordetella pertussis
gcgcccgacggcgcgcccgccgc

SEQ ID NO: 2454704 - RNA, 15 nt, Bordetella pertussis
gcgcccgagagcugc

SEQ ID NO: 2454705 - RNA, 18 nt, Bordetella pertussis
gcgcccgagagcugcguc

SEQ ID NO: 2454706 - RNA, 12 nt, Bordetella pertussis
gcgcccgagcgc

SEQ ID NO: 2454707 - RNA, 14 nt, Bordetella pertussis
gcgcccgagcgcca

SEQ ID NO: 2454708 - RNA, 15 nt, Bordetella pertussis
gcgcccgagcgccac

SEQ ID NO: 2454709 - RNA, 16 nt, Bordetella pertussis
gcgcccgagcgccaca

SEQ ID NO: 2454710 - RNA, 16 nt, Bordetella pertussis
gcgcccgaggcgcgca

SEQ ID NO: 2454711 - RNA, 15 nt, Bordetella pertussis
gcgcccgaugccuug

SEQ ID NO: 2454712 - RNA, 19 nt, Bordetella pertussis
gcgcccgaugcucgccggc

SEQ ID NO: 2454713 - RNA, 20 nt, Bordetella pertussis
gcgcccgaugcucgccggcg

SEQ ID NO: 2454714 - RNA, 14 nt, Bordetella pertussis
gcgcccgauggugc

SEQ ID NO: 2454715 - RNA, 19 nt, Bordetella pertussis
gcgcccgcaacgggccggc

SEQ ID NO: 2454716 - RNA, 21 nt, Bordetella pertussis
gcgcccgcaacgggccggccg

SEQ ID NO: 2454717 - RNA, 18 nt, Bordetella pertussis
gcgcccgcacgaugccga

SEQ ID NO: 2454718 - RNA, 17 nt, Bordetella pertussis
gcgcccgcaggcggcgg

SEQ ID NO: 2454719 - RNA, 19 nt, Bordetella pertussis
gcgcccgcaggcggcggcc

SEQ ID NO: 2454720 - RNA, 13 nt, Bordetella pertussis
gcgcccgcaucgg

SEQ ID NO: 2454721 - RNA, 21 nt, Bordetella pertussis
gcgcccgcaucggcuggcgca

SEQ ID NO: 2454722 - RNA, 22 nt, Bordetella pertussis
gcgcccgcauggaccgccgccg

SEQ ID NO: 2454723 - RNA, 12 nt, Bordetella pertussis
gcgcccgccccg

SEQ ID NO: 2454724 - RNA, 14 nt, Bordetella pertussis
gcgcccgccgacga

SEQ ID NO: 2454725 - RNA, 14 nt, Bordetella pertussis
gcgcccgccgccgg

SEQ ID NO: 2454726 - RNA, 20 nt, Bordetella pertussis
gcgcccgccgccgggcgcgc

SEQ ID NO: 2454727 - RNA, 16 nt, Bordetella pertussis
gcgcccgccgcgccau

SEQ ID NO: 2454728 - RNA, 18 nt, Bordetella pertussis
gcgcccgccgcgccaugc

SEQ ID NO: 2454729 - RNA, 17 nt, Bordetella pertussis
gcgcccgccgcgucggc

SEQ ID NO: 2454730 - RNA, 18 nt, Bordetella pertussis
gcgcccgccgcgucggcg

SEQ ID NO: 2454731 - RNA, 21 nt, Bordetella pertussis
gcgcccgccgcgucggcgccg

SEQ ID NO: 2454732 - RNA, 13 nt, Bordetella pertussis
gcgcccgccugcg

SEQ ID NO: 2454733 - RNA, 20 nt, Bordetella pertussis
gcgcccgccugcgccagccg

SEQ ID NO: 2454734 - RNA, 13 nt, Bordetella pertussis
gcgcccgccuuca

SEQ ID NO: 2454735 - RNA, 18 nt, Bordetella pertussis
gcgcccgccuucggcggc

SEQ ID NO: 2454736 - RNA, 21 nt, Bordetella pertussis
gcgcccgccuucggcggcggg

SEQ ID NO: 2454737 - RNA, 14 nt, Bordetella pertussis
gcgcccgcgccauc

SEQ ID NO: 2454738 - RNA, 18 nt, Bordetella pertussis
gcgcccgcgccaucgcgu

SEQ ID NO: 2454739 - RNA, 19 nt, Bordetella pertussis
gcgcccgcgccaucgcguc

SEQ ID NO: 2454740 - RNA, 14 nt, Bordetella pertussis
gcgcccgcgcgcga

SEQ ID NO: 2454741 - RNA, 19 nt, Bordetella pertussis
gcgcccgcgcgcgagcugc

SEQ ID NO: 2454742 - RNA, 21 nt, Bordetella pertussis
gcgcccgcgcgcgagcugcgc

SEQ ID NO: 2454743 - RNA, 18 nt, Bordetella pertussis
gcgcccgcggaaagcugg

SEQ ID NO: 2454744 - RNA, 20 nt, Bordetella pertussis
gcgcccgcggaaagcuggcg

SEQ ID NO: 2454745 - RNA, 15 nt, Bordetella pertussis
gcgcccgcugcgucc

SEQ ID NO: 2454746 - RNA, 16 nt, Bordetella pertussis
gcgcccgcugcgucca

SEQ ID NO: 2454747 - RNA, 14 nt, Bordetella pertussis
gcgcccgcuugcgc

SEQ ID NO: 2454748 - RNA, 18 nt, Bordetella pertussis
gcgcccgcuugcggccgg

SEQ ID NO: 2454749 - RNA, 12 nt, Bordetella pertussis
gcgcccggccac

SEQ ID NO: 2454750 - RNA, 15 nt, Bordetella pertussis
gcgcccggccaccgc

SEQ ID NO: 2454751 - RNA, 13 nt, Bordetella pertussis
gcgcccggccggc

SEQ ID NO: 2454752 - RNA, 15 nt, Bordetella pertussis
gcgcccggccggccu

SEQ ID NO: 2454753 - RNA, 18 nt, Bordetella pertussis
gcgcccggccugcgggcg

SEQ ID NO: 2454754 - RNA, 21 nt, Bordetella pertussis
gcgcccggccugcgggcgccg

SEQ ID NO: 2454755 - RNA, 13 nt, Bordetella pertussis
gcgcccggcgccg

SEQ ID NO: 2454756 - RNA, 13 nt, Bordetella pertussis
gcgcccggcggcc

SEQ ID NO: 2454757 - RNA, 14 nt, Bordetella pertussis
gcgcccggcggcca

SEQ ID NO: 2454758 - RNA, 15 nt, Bordetella pertussis
gcgcccggcggccag

SEQ ID NO: 2454759 - RNA, 17 nt, Bordetella pertussis
gcgcccggcggccaggc

SEQ ID NO: 2454760 - RNA, 18 nt, Bordetella pertussis
gcgcccggcggccaggcc

SEQ ID NO: 2454761 - RNA, 23 nt, Bordetella pertussis
gcgcccggcggccaggccggcgc

SEQ ID NO: 2454762 - RNA, 14 nt, Bordetella pertussis
gcgcccggcggcgc

SEQ ID NO: 2454763 - RNA, 17 nt, Bordetella pertussis
gcgcccggcggcgcgcu

SEQ ID NO: 2454764 - RNA, 23 nt, Bordetella pertussis
gcgcccggcggcgcggcgagcac

SEQ ID NO: 2454765 - RNA, 20 nt, Bordetella pertussis
gcgcccggcgugacgcugac

SEQ ID NO: 2454766 - RNA, 23 nt, Bordetella pertussis
gcgcccgggccgucuacaggccc

SEQ ID NO: 2454767 - RNA, 24 nt, Bordetella pertussis
gcgcccgggcugauccgcaccggc

SEQ ID NO: 2454768 - RNA, 14 nt, Bordetella pertussis
gcgcccgggcugcc

SEQ ID NO: 2454769 - RNA, 18 nt, Bordetella pertussis
gcgcccggucugccacac

SEQ ID NO: 2454770 - RNA, 16 nt, Bordetella pertussis
gcgcccggugcgcgca

SEQ ID NO: 2454771 - RNA, 20 nt, Bordetella pertussis
gcgcccggugcgcgcagggc

SEQ ID NO: 2454772 - RNA, 16 nt, Bordetella pertussis
gcgcccgugcgcggcg

SEQ ID NO: 2454773 - RNA, 16 nt, Bordetella pertussis
gcgcccucaguccagc

SEQ ID NO: 2454774 - RNA, 21 nt, Bordetella pertussis
gcgcccucguugacgccgacg

SEQ ID NO: 2454775 - RNA, 21 nt, Bordetella pertussis
gcgcccucuuucgccgcgcgc

SEQ ID NO: 2454776 - RNA, 23 nt, Bordetella pertussis
gcgcccucuuucgccgcgcgcuc

SEQ ID NO: 2454777 - RNA, 16 nt, Bordetella pertussis
gcgcccugcagggcau

SEQ ID NO: 2454778 - RNA, 21 nt, Bordetella pertussis
gcgcccuggcgccgcggccgg

SEQ ID NO: 2454779 - RNA, 23 nt, Bordetella pertussis
gcgcccuggcgccgcggccgggu

SEQ ID NO: 2454780 - RNA, 18 nt, Bordetella pertussis
gcgcccuggcgcggcggc

SEQ ID NO: 2454781 - RNA, 15 nt, Bordetella pertussis
gcgcccuggcguggc

SEQ ID NO: 2454782 - RNA, 21 nt, Bordetella pertussis
gcgcccuggcguggcgcgcgc

SEQ ID NO: 2454783 - RNA, 22 nt, Bordetella pertussis
gcgcccuggcguggcgcgcgcc

SEQ ID NO: 2454784 - RNA, 23 nt, Bordetella pertussis
gcgcccuggcguggcgcgcgccg

SEQ ID NO: 2454785 - RNA, 18 nt, Bordetella pertussis
gcgcccuugaugccgucg

SEQ ID NO: 2454786 - RNA, 23 nt, Bordetella pertussis
gcgcccuuugcauugcggcuggg

SEQ ID NO: 2454787 - RNA, 22 nt, Bordetella pertussis
gcgccgaaauauggaccagccc

SEQ ID NO: 2454788 - RNA, 17 nt, Bordetella pertussis
gcgccgaaauuggcgac

SEQ ID NO: 2454789 - RNA, 19 nt, Bordetella pertussis
gcgccgaacgacuuggcgc

SEQ ID NO: 2454790 - RNA, 16 nt, Bordetella pertussis
gcgccgaacgcgcagc

SEQ ID NO: 2454791 - RNA, 22 nt, Bordetella pertussis
gcgccgaacgcgcagcgaacgg

SEQ ID NO: 2454792 - RNA, 23 nt, Bordetella pertussis
gcgccgaacgcgcagcgaacggc

SEQ ID NO: 2454793 - RNA, 16 nt, Bordetella pertussis
gcgccgaagcgcaggc

SEQ ID NO: 2454794 - RNA, 18 nt, Bordetella pertussis
gcgccgaagcgcaggccu

SEQ ID NO: 2454795 - RNA, 21 nt, Bordetella pertussis
gcgccgaaggcggcgccggug

SEQ ID NO: 2454796 - RNA, 17 nt, Bordetella pertussis
gcgccgaaguugcggcc

SEQ ID NO: 2454797 - RNA, 19 nt, Bordetella pertussis
gcgccgaaguugcggccgu

SEQ ID NO: 2454798 - RNA, 23 nt, Bordetella pertussis
gcgccgaccaccugcaccgccgc

SEQ ID NO: 2454799 - RNA, 12 nt, Bordetella pertussis
gcgccgaccacg

SEQ ID NO: 2454800 - RNA, 18 nt, Bordetella pertussis
gcgccgaccacgcugggc

SEQ ID NO: 2454801 - RNA, 19 nt, Bordetella pertussis
gcgccgaccacgcugggcc

SEQ ID NO: 2454802 - RNA, 20 nt, Bordetella pertussis
gcgccgaccacgcugggcca

SEQ ID NO: 2454803 - RNA, 20 nt, Bordetella pertussis
gcgccgacccgagcccuggc

SEQ ID NO: 2454804 - RNA, 14 nt, Bordetella pertussis
gcgccgacccugcc

SEQ ID NO: 2454805 - RNA, 16 nt, Bordetella pertussis
gcgccgacccugcccg

SEQ ID NO: 2454806 - RNA, 23 nt, Bordetella pertussis
gcgccgacccugcccggcagggu

SEQ ID NO: 2454807 - RNA, 15 nt, Bordetella pertussis
gcgccgaccgcacga

SEQ ID NO: 2454808 - RNA, 16 nt, Bordetella pertussis
gcgccgaccggcccca

SEQ ID NO: 2454809 - RNA, 17 nt, Bordetella pertussis
gcgccgaccggccccac

SEQ ID NO: 2454810 - RNA, 15 nt, Bordetella pertussis
gcgccgaccgggccg

SEQ ID NO: 2454811 - RNA, 17 nt, Bordetella pertussis
gcgccgaccgggccgac

SEQ ID NO: 2454812 - RNA, 24 nt, Bordetella pertussis
gcgccgaccgggccgaccaggccg

SEQ ID NO: 2454813 - RNA, 23 nt, Bordetella pertussis
gcgccgacgauaucgcgaaagcg

SEQ ID NO: 2454814 - RNA, 15 nt, Bordetella pertussis
gcgccgacgaugccg

SEQ ID NO: 2454815 - RNA, 19 nt, Bordetella pertussis
gcgccgacgaugccgccca

SEQ ID NO: 2454816 - RNA, 20 nt, Bordetella pertussis
gcgccgacgaugccgcccac

SEQ ID NO: 2454817 - RNA, 16 nt, Bordetella pertussis
gcgccgacgcgcuggc

SEQ ID NO: 2454818 - RNA, 17 nt, Bordetella pertussis
gcgccgacggcauggcc

SEQ ID NO: 2454819 - RNA, 15 nt, Bordetella pertussis
gcgccgacggcgccc

SEQ ID NO: 2454820 - RNA, 16 nt, Bordetella pertussis
gcgccgacggcgcccu

SEQ ID NO: 2454821 - RNA, 17 nt, Bordetella pertussis
gcgccgacggcgcccug

SEQ ID NO: 2454822 - RNA, 18 nt, Bordetella pertussis
gcgccgacggcgcccugc

SEQ ID NO: 2454823 - RNA, 18 nt, Bordetella pertussis
gcgccgagcagaucgcca

SEQ ID NO: 2454824 - RNA, 13 nt, Bordetella pertussis
gcgccgagcgcca

SEQ ID NO: 2454825 - RNA, 14 nt, Bordetella pertussis
gcgccgagcggggc

SEQ ID NO: 2454826 - RNA, 18 nt, Bordetella pertussis
gcgccgaggaucuggccg

SEQ ID NO: 2454827 - RNA, 22 nt, Bordetella pertussis
gcgccgaggaucuggccggcgc

SEQ ID NO: 2454828 - RNA, 16 nt, Bordetella pertussis
gcgccgaggccugcug

SEQ ID NO: 2454829 - RNA, 24 nt, Bordetella pertussis
gcgccgagggccgcgcgauccugg

SEQ ID NO: 2454830 - RNA, 20 nt, Bordetella pertussis
gcgccgaguuuccgcacccg

SEQ ID NO: 2454831 - RNA, 21 nt, Bordetella pertussis
gcgccgaguuuccgcacccgg

SEQ ID NO: 2454832 - RNA, 15 nt, Bordetella pertussis
gcgccgaucagcagg

SEQ ID NO: 2454833 - RNA, 17 nt, Bordetella pertussis
gcgccgauccagggccg

SEQ ID NO: 2454834 - RNA, 18 nt, Bordetella pertussis
gcgccgauccagggccgc

SEQ ID NO: 2454835 - RNA, 21 nt, Bordetella pertussis
gcgccgauccagggccgcagc

SEQ ID NO: 2454836 - RNA, 17 nt, Bordetella pertussis
gcgccgauccggcgcag

SEQ ID NO: 2454837 - RNA, 18 nt, Bordetella pertussis
gcgccgauccggcgcaga

SEQ ID NO: 2454838 - RNA, 14 nt, Bordetella pertussis
gcgccgaucgcggc

SEQ ID NO: 2454839 - RNA, 17 nt, Bordetella pertussis
gcgccgaucgcggcucc

SEQ ID NO: 2454840 - RNA, 18 nt, Bordetella pertussis
gcgccgaucgcggcucca

SEQ ID NO: 2454841 - RNA, 21 nt, Bordetella pertussis
gcgccgaucgcggcuccagcu

SEQ ID NO: 2454842 - RNA, 13 nt, Bordetella pertussis
gcgccgaugcgcc

SEQ ID NO: 2454843 - RNA, 17 nt, Bordetella pertussis
gcgccgaugcgccaggc

SEQ ID NO: 2454844 - RNA, 18 nt, Bordetella pertussis
gcgccgaugcgccaggcu

SEQ ID NO: 2454845 - RNA, 14 nt, Bordetella pertussis
gcgccgauggcgcc

SEQ ID NO: 2454846 - RNA, 17 nt, Bordetella pertussis
gcgccgauggugcgggc

SEQ ID NO: 2454847 - RNA, 18 nt, Bordetella pertussis
gcgccgauuucgccgccg

SEQ ID NO: 2454848 - RNA, 21 nt, Bordetella pertussis
gcgccgauuucgccgccgcca

SEQ ID NO: 2454849 - RNA, 22 nt, Bordetella pertussis
gcgccgauuucgccgccgccau

SEQ ID NO: 2454850 - RNA, 19 nt, Bordetella pertussis
gcgccgcaacaggcagcug

SEQ ID NO: 2454851 - RNA, 22 nt, Bordetella pertussis
gcgccgcaacaggcagcugcgc

SEQ ID NO: 2454852 - RNA, 17 nt, Bordetella pertussis
gcgccgcaacgccgccg

SEQ ID NO: 2454853 - RNA, 19 nt, Bordetella pertussis
gcgccgcaacgccgggccg

SEQ ID NO: 2454854 - RNA, 14 nt, Bordetella pertussis
gcgccgcaccagcg

SEQ ID NO: 2454855 - RNA, 21 nt, Bordetella pertussis
gcgccgcaccagcgccgacgg

SEQ ID NO: 2454856 - RNA, 22 nt, Bordetella pertussis
gcgccgcaccagcgccgacggc

SEQ ID NO: 2454857 - RNA, 16 nt, Bordetella pertussis
gcgccgcaccagcggc

SEQ ID NO: 2454858 - RNA, 17 nt, Bordetella pertussis
gcgccgcaccagcggcg

SEQ ID NO: 2454859 - RNA, 13 nt, Bordetella pertussis
gcgccgcacccga

SEQ ID NO: 2454860 - RNA, 14 nt, Bordetella pertussis
gcgccgcacgccgg

SEQ ID NO: 2454861 - RNA, 15 nt, Bordetella pertussis
gcgccgcacgucggu

SEQ ID NO: 2454862 - RNA, 14 nt, Bordetella pertussis
gcgccgcagauggc

SEQ ID NO: 2454863 - RNA, 19 nt, Bordetella pertussis
gcgccgcagauggcguagg

SEQ ID NO: 2454864 - RNA, 13 nt, Bordetella pertussis
gcgccgcagcacc

SEQ ID NO: 2454865 - RNA, 15 nt, Bordetella pertussis
gcgccgcagcgucgc

SEQ ID NO: 2454866 - RNA, 21 nt, Bordetella pertussis
gcgccgcagcgucgcggcguc

SEQ ID NO: 2454867 - RNA, 14 nt, Bordetella pertussis
gcgccgcagcgugg

SEQ ID NO: 2454868 - RNA, 20 nt, Bordetella pertussis
gcgccgcagcguggcguagg

SEQ ID NO: 2454869 - RNA, 17 nt, Bordetella pertussis
gcgccgcaugcggcggc

SEQ ID NO: 2454870 - RNA, 18 nt, Bordetella pertussis
gcgccgcaugcggcggcu

SEQ ID NO: 2454871 - RNA, 19 nt, Bordetella pertussis
gcgccgcaugcggcggcug

SEQ ID NO: 2454872 - RNA, 22 nt, Bordetella pertussis
gcgccgcaugcggcggcugugg

SEQ ID NO: 2454873 - RNA, 19 nt, Bordetella pertussis
gcgccgcauuuccucgacc

SEQ ID NO: 2454874 - RNA, 20 nt, Bordetella pertussis
gcgccgccacaggcugacgc

SEQ ID NO: 2454875 - RNA, 21 nt, Bordetella pertussis
gcgccgccacaggcugacgcc

SEQ ID NO: 2454876 - RNA, 20 nt, Bordetella pertussis
gcgccgccaccucggcgucg

SEQ ID NO: 2454877 - RNA, 21 nt, Bordetella pertussis
gcgccgccaccucggcgucgc

SEQ ID NO: 2454878 - RNA, 21 nt, Bordetella pertussis
gcgccgccagcauggcggcca

SEQ ID NO: 2454879 - RNA, 12 nt, Bordetella pertussis
gcgccgccagcc

SEQ ID NO: 2454880 - RNA, 14 nt, Bordetella pertussis
gcgccgccagccgc

SEQ ID NO: 2454881 - RNA, 20 nt, Bordetella pertussis
gcgccgccagccgcuggcgc

SEQ ID NO: 2454882 - RNA, 23 nt, Bordetella pertussis
gcgccgccagccgcuggcgcgcc

SEQ ID NO: 2454883 - RNA, 17 nt, Bordetella pertussis
gcgccgccagcgcgcgc

SEQ ID NO: 2454884 - RNA, 23 nt, Bordetella pertussis
gcgccgccaggaaaagccgccuu

SEQ ID NO: 2454885 - RNA, 16 nt, Bordetella pertussis
gcgccgccaggccguc

SEQ ID NO: 2454886 - RNA, 18 nt, Bordetella pertussis
gcgccgccaggccgucga

SEQ ID NO: 2454887 - RNA, 13 nt, Bordetella pertussis
gcgccgccaggcg

SEQ ID NO: 2454888 - RNA, 12 nt, Bordetella pertussis
gcgccgccaugg

SEQ ID NO: 2454889 - RNA, 18 nt, Bordetella pertussis
gcgccgcccaccaccagc

SEQ ID NO: 2454890 - RNA, 21 nt, Bordetella pertussis
gcgccgcccccgcccagcauc

SEQ ID NO: 2454891 - RNA, 22 nt, Bordetella pertussis
gcgccgccccgucaucgggugc

SEQ ID NO: 2454892 - RNA, 16 nt, Bordetella pertussis
gcgccgccccuucagc

SEQ ID NO: 2454893 - RNA, 20 nt, Bordetella pertussis
gcgccgccccuucagcuucc

SEQ ID NO: 2454894 - RNA, 13 nt, Bordetella pertussis
gcgccgcccgcgg

SEQ ID NO: 2454895 - RNA, 17 nt, Bordetella pertussis
gcgccgcccgcggccag

SEQ ID NO: 2454896 - RNA, 18 nt, Bordetella pertussis
gcgccgcccgcggccagc

SEQ ID NO: 2454897 - RNA, 15 nt, Bordetella pertussis
gcgccgcccgggccg

SEQ ID NO: 2454898 - RNA, 18 nt, Bordetella pertussis
gcgccgcccgggccggcu

SEQ ID NO: 2454899 - RNA, 14 nt, Bordetella pertussis
gcgccgccgacggc

SEQ ID NO: 2454900 - RNA, 22 nt, Bordetella pertussis
gcgccgccgacggcauggcggc

SEQ ID NO: 2454901 - RNA, 13 nt, Bordetella pertussis
gcgccgccgccau

SEQ ID NO: 2454902 - RNA, 23 nt, Bordetella pertussis
gcgccgccgccauggucgcgacc

SEQ ID NO: 2454903 - RNA, 13 nt, Bordetella pertussis
gcgccgccgcccg

SEQ ID NO: 2454904 - RNA, 18 nt, Bordetella pertussis
gcgccgccgcccgcacga

SEQ ID NO: 2454905 - RNA, 14 nt, Bordetella pertussis
gcgccgccgcccgg

SEQ ID NO: 2454906 - RNA, 23 nt, Bordetella pertussis
gcgccgccgccgcggccuggccg

SEQ ID NO: 2454907 - RNA, 13 nt, Bordetella pertussis
gcgccgccgccgg

SEQ ID NO: 2454908 - RNA, 14 nt, Bordetella pertussis
gcgccgccgccggu

SEQ ID NO: 2454909 - RNA, 20 nt, Bordetella pertussis
gcgccgccgcgcccuggcgc

SEQ ID NO: 2454910 - RNA, 16 nt, Bordetella pertussis
gcgccgccgcgcgcug

SEQ ID NO: 2454911 - RNA, 22 nt, Bordetella pertussis
gcgccgccgcgcugugcgacga

SEQ ID NO: 2454912 - RNA, 18 nt, Bordetella pertussis
gcgccgccgcguggcggc

SEQ ID NO: 2454913 - RNA, 12 nt, Bordetella pertussis
gcgccgccggcc

SEQ ID NO: 2454914 - RNA, 14 nt, Bordetella pertussis
gcgccgccggccag

SEQ ID NO: 2454915 - RNA, 15 nt, Bordetella pertussis
gcgccgccggccagc

SEQ ID NO: 2454916 - RNA, 23 nt, Bordetella pertussis
gcgccgccggccagccugugcgc

SEQ ID NO: 2454917 - RNA, 16 nt, Bordetella pertussis
gcgccgccggccauca

SEQ ID NO: 2454918 - RNA, 13 nt, Bordetella pertussis
gcgccgccggccu

SEQ ID NO: 2454919 - RNA, 14 nt, Bordetella pertussis
gcgccgccggcggc

SEQ ID NO: 2454920 - RNA, 16 nt, Bordetella pertussis
gcgccgccggcggccu

SEQ ID NO: 2454921 - RNA, 17 nt, Bordetella pertussis
gcgccgccggcggccug

SEQ ID NO: 2454922 - RNA, 14 nt, Bordetella pertussis
gcgccgccgggccu

SEQ ID NO: 2454923 - RNA, 15 nt, Bordetella pertussis
gcgccgccgggccug

SEQ ID NO: 2454924 - RNA, 19 nt, Bordetella pertussis
gcgccgccggugcaccagg

SEQ ID NO: 2454925 - RNA, 14 nt, Bordetella pertussis
gcgccgccgugcgc

SEQ ID NO: 2454926 - RNA, 17 nt, Bordetella pertussis
gcgccgccgugcgcggg

SEQ ID NO: 2454927 - RNA, 19 nt, Bordetella pertussis
gcgccgccgugcgcgggcg

SEQ ID NO: 2454928 - RNA, 20 nt, Bordetella pertussis
gcgccgccuaccaggugggc

SEQ ID NO: 2454929 - RNA, 16 nt, Bordetella pertussis
gcgccgccuaggugug

SEQ ID NO: 2454930 - RNA, 19 nt, Bordetella pertussis
gcgccgccucagcccgcgu

SEQ ID NO: 2454931 - RNA, 18 nt, Bordetella pertussis
gcgccgccucgaccggcg

SEQ ID NO: 2454932 - RNA, 19 nt, Bordetella pertussis
gcgccgccucgggcacggc

SEQ ID NO: 2454933 - RNA, 22 nt, Bordetella pertussis
gcgccgccucgggcacggccag

SEQ ID NO: 2454934 - RNA, 13 nt, Bordetella pertussis
gcgccgccuggcc

SEQ ID NO: 2454935 - RNA, 16 nt, Bordetella pertussis
gcgccgccuggcccac

SEQ ID NO: 2454936 - RNA, 17 nt, Bordetella pertussis
gcgccgccuggcccaca

SEQ ID NO: 2454937 - RNA, 12 nt, Bordetella pertussis
gcgccgccuggu

SEQ ID NO: 2454938 - RNA, 17 nt, Bordetella pertussis
gcgccgccuucaccggc

SEQ ID NO: 2454939 - RNA, 21 nt, Bordetella pertussis
gcgccgccuucaccggcccca

SEQ ID NO: 2454940 - RNA, 13 nt, Bordetella pertussis
gcgccgcgaaacg

SEQ ID NO: 2454941 - RNA, 15 nt, Bordetella pertussis
gcgccgcgagcgccg

SEQ ID NO: 2454942 - RNA, 16 nt, Bordetella pertussis
gcgccgcgagcgccga

SEQ ID NO: 2454943 - RNA, 19 nt, Bordetella pertussis
gcgccgcgagcgccgaacc

SEQ ID NO: 2454944 - RNA, 17 nt, Bordetella pertussis
gcgccgcgauggcgccg

SEQ ID NO: 2454945 - RNA, 17 nt, Bordetella pertussis
gcgccgcgcacgcacug

SEQ ID NO: 2454946 - RNA, 12 nt, Bordetella pertussis
gcgccgcgcaga

SEQ ID NO: 2454947 - RNA, 13 nt, Bordetella pertussis
gcgccgcgcagca

SEQ ID NO: 2454948 - RNA, 17 nt, Bordetella pertussis
gcgccgcgcagcagcaa

SEQ ID NO: 2454949 - RNA, 14 nt, Bordetella pertussis
gcgccgcgcaucga

SEQ ID NO: 2454950 - RNA, 13 nt, Bordetella pertussis
gcgccgcgccaac

SEQ ID NO: 2454951 - RNA, 15 nt, Bordetella pertussis
gcgccgcgccaacgc

SEQ ID NO: 2454952 - RNA, 12 nt, Bordetella pertussis
gcgccgcgccag

SEQ ID NO: 2454953 - RNA, 22 nt, Bordetella pertussis
gcgccgcgccagguaggccggc

SEQ ID NO: 2454954 - RNA, 15 nt, Bordetella pertussis
gcgccgcgcccgcuu

SEQ ID NO: 2454955 - RNA, 14 nt, Bordetella pertussis
gcgccgcgcccggc

SEQ ID NO: 2454956 - RNA, 14 nt, Bordetella pertussis
gcgccgcgccgccg

SEQ ID NO: 2454957 - RNA, 15 nt, Bordetella pertussis
gcgccgcgccgccgc

SEQ ID NO: 2454958 - RNA, 13 nt, Bordetella pertussis
gcgccgcgccgcg

SEQ ID NO: 2454959 - RNA, 15 nt, Bordetella pertussis
gcgccgcgccgggcg

SEQ ID NO: 2454960 - RNA, 14 nt, Bordetella pertussis
gcgccgcgccgggg

SEQ ID NO: 2454961 - RNA, 14 nt, Bordetella pertussis
gcgccgcgccgguc

SEQ ID NO: 2454962 - RNA, 21 nt, Bordetella pertussis
gcgccgcgccguacagggccg

SEQ ID NO: 2454963 - RNA, 12 nt, Bordetella pertussis
gcgccgcgccuc

SEQ ID NO: 2454964 - RNA, 14 nt, Bordetella pertussis
gcgccgcgccucgg

SEQ ID NO: 2454965 - RNA, 12 nt, Bordetella pertussis
gcgccgcgccuu

SEQ ID NO: 2454966 - RNA, 16 nt, Bordetella pertussis
gcgccgcgcgcacggc

SEQ ID NO: 2454967 - RNA, 15 nt, Bordetella pertussis
gcgccgcgcgccgcg

SEQ ID NO: 2454968 - RNA, 14 nt, Bordetella pertussis
gcgccgcgcgcggc

SEQ ID NO: 2454969 - RNA, 20 nt, Bordetella pertussis
gcgccgcgcgcgugccgcag

SEQ ID NO: 2454970 - RNA, 21 nt, Bordetella pertussis
gcgccgcgcucgcgccaggcc

SEQ ID NO: 2454971 - RNA, 19 nt, Bordetella pertussis
gcgccuugcccgucagggu

SEQ ID NO: 2454972 - RNA, 17 nt, Bordetella pertussis
gcgccuugccgccgugc

SEQ ID NO: 2454973 - RNA, 18 nt, Bordetella pertussis
gcgccuugccgccgugcg

SEQ ID NO: 2454974 - RNA, 22 nt, Bordetella pertussis
gcgccuugcgcggcgagcgccg

SEQ ID NO: 2454975 - RNA, 16 nt, Bordetella pertussis
gcgccuugcggcgaug

SEQ ID NO: 2454976 - RNA, 18 nt, Bordetella pertussis
gcgccuugcggcgaugca

SEQ ID NO: 2454977 - RNA, 23 nt, Bordetella pertussis
gcgccuugcggcgcuuggcguag

SEQ ID NO: 2454978 - RNA, 13 nt, Bordetella pertussis
gcgccuuggcgcg

SEQ ID NO: 2454979 - RNA, 17 nt, Bordetella pertussis
gcgccuuucccgcgccg

SEQ ID NO: 2454980 - RNA, 18 nt, Bordetella pertussis
gcgccuuucccgcgccga

SEQ ID NO: 2454981 - RNA, 21 nt, Bordetella pertussis
gcgcgaaacccccugggugag

SEQ ID NO: 2454982 - RNA, 19 nt, Bordetella pertussis
gcgcgaaacggccgggucc

SEQ ID NO: 2454983 - RNA, 18 nt, Bordetella pertussis
gcgcgaaauccagcgcgc

SEQ ID NO: 2454984 - RNA, 20 nt, Bordetella pertussis
gcgcgaaauccagcgcgccc

SEQ ID NO: 2454985 - RNA, 21 nt, Bordetella pertussis
gcgcgaaauccagcgcgcccg

SEQ ID NO: 2454986 - RNA, 22 nt, Bordetella pertussis
gcgcgaaauccagcgcgcccga

SEQ ID NO: 2454987 - RNA, 21 nt, Bordetella pertussis
gcgcgaaaugcccagcgagcu

SEQ ID NO: 2454988 - RNA, 22 nt, Bordetella pertussis
gcgcgaaaugguguacagccgc

SEQ ID NO: 2454989 - RNA, 15 nt, Bordetella pertussis
gcgcgaacaccggca

SEQ ID NO: 2454990 - RNA, 16 nt, Bordetella pertussis
gcgcgaacaccggcag

SEQ ID NO: 2454991 - RNA, 17 nt, Bordetella pertussis
gcgcgaacauccgggug

SEQ ID NO: 2454992 - RNA, 14 nt, Bordetella pertussis
gcgcgaaccccucc

SEQ ID NO: 2454993 - RNA, 17 nt, Bordetella pertussis
gcgcgaaccccuccggc

SEQ ID NO: 2454994 - RNA, 22 nt, Bordetella pertussis
gcgcgaaccccuccggcguugc

SEQ ID NO: 2454995 - RNA, 17 nt, Bordetella pertussis
gcgcgaacgccugccag

SEQ ID NO: 2454996 - RNA, 14 nt, Bordetella pertussis
gcgcgaacgcgcgc

SEQ ID NO: 2454997 - RNA, 16 nt, Bordetella pertussis
gcgcgaacgcgcgccg

SEQ ID NO: 2454998 - RNA, 18 nt, Bordetella pertussis
gcgcgaacgcgcgccggc

SEQ ID NO: 2454999 - RNA, 20 nt, Bordetella pertussis
gcgcgaacgcgcgccggcca

SEQ ID NO: 2455000 - RNA, 17 nt, Bordetella pertussis
gcgcgaacgcggccaug

SEQ ID NO: 2455001 - RNA, 13 nt, Bordetella pertussis
gcgcgaacggcag

SEQ ID NO: 2455002 - RNA, 16 nt, Bordetella pertussis
gcgcgaacggcaggug

SEQ ID NO: 2455003 - RNA, 20 nt, Bordetella pertussis
gcgcgaacggcuugauggcg

SEQ ID NO: 2455004 - RNA, 22 nt, Bordetella pertussis
gcgcgaacggggguugccagau

SEQ ID NO: 2455005 - RNA, 13 nt, Bordetella pertussis
gcgcgaagcgccc

SEQ ID NO: 2455006 - RNA, 17 nt, Bordetella pertussis
gcgcgaagcgcccuggc

SEQ ID NO: 2455007 - RNA, 23 nt, Bordetella pertussis
gcgcgaagcggaaacgcgcgcgc

SEQ ID NO: 2455008 - RNA, 20 nt, Bordetella pertussis
gccggcggcgugcccugcgg

SEQ ID NO: 2455009 - RNA, 21 nt, Bordetella pertussis
gccggcggcgugcccugcggc

SEQ ID NO: 2455010 - RNA, 21 nt, Bordetella pertussis
gccggcggcgugcgccugcug

SEQ ID NO: 2455011 - RNA, 22 nt, Bordetella pertussis
gccggcggcguggccgugcugg

SEQ ID NO: 2455012 - RNA, 14 nt, Bordetella pertussis
gccggcgggcaggc

SEQ ID NO: 2455013 - RNA, 16 nt, Bordetella pertussis
gccggcgggcaggcgg

SEQ ID NO: 2455014 - RNA, 20 nt, Bordetella pertussis
gccggcgggcaggcgggcca

SEQ ID NO: 2455015 - RNA, 21 nt, Bordetella pertussis
gccggcgggcaggcgggccag

SEQ ID NO: 2455016 - RNA, 23 nt, Bordetella pertussis
gccggcgggcaggcgggccaggc

SEQ ID NO: 2455017 - RNA, 16 nt, Bordetella pertussis
gccggcgggcaugacg

SEQ ID NO: 2455018 - RNA, 14 nt, Bordetella pertussis
gccggcgggcgcug

SEQ ID NO: 2455019 - RNA, 15 nt, Bordetella pertussis
gccggcgggcgcugc

SEQ ID NO: 2455020 - RNA, 21 nt, Bordetella pertussis
gccggcgggcgcugccugccg

SEQ ID NO: 2455021 - RNA, 23 nt, Bordetella pertussis
gccggcgggcgcugccugccggc

SEQ ID NO: 2455022 - RNA, 14 nt, Bordetella pertussis
gccggcgggcggcu

SEQ ID NO: 2455023 - RNA, 19 nt, Bordetella pertussis
gccggcgggcggcugcccg

SEQ ID NO: 2455024 - RNA, 20 nt, Bordetella pertussis
gccggcgggcggcugcccgg

SEQ ID NO: 2455025 - RNA, 22 nt, Bordetella pertussis
gccggcgggcggcugcccgggc

SEQ ID NO: 2455026 - RNA, 17 nt, Bordetella pertussis
gccggcggucacgccga

SEQ ID NO: 2455027 - RNA, 21 nt, Bordetella pertussis
gccggcggucccgagcgcucc

SEQ ID NO: 2455028 - RNA, 16 nt, Bordetella pertussis
gccggcggucgcgcug

SEQ ID NO: 2455029 - RNA, 18 nt, Bordetella pertussis
gccggcggucgcgcuggc

SEQ ID NO: 2455030 - RNA, 19 nt, Bordetella pertussis
gccggcggucgcgcuggcc

SEQ ID NO: 2455031 - RNA, 24 nt, Bordetella pertussis
gccggcggugaugacgucgucgau

SEQ ID NO: 2455032 - RNA, 22 nt, Bordetella pertussis
gccggcguagucguugccggcc

SEQ ID NO: 2455033 - RNA, 15 nt, Bordetella pertussis
gccggcguauuccug

SEQ ID NO: 2455034 - RNA, 18 nt, Bordetella pertussis
gccggcgucaaaccaagc

SEQ ID NO: 2455035 - RNA, 17 nt, Bordetella pertussis
gccggcgucacgcggcc

SEQ ID NO: 2455036 - RNA, 20 nt, Bordetella pertussis
gccggcgucacgcggccggg

SEQ ID NO: 2455037 - RNA, 23 nt, Bordetella pertussis
gccggcguccacggcaucggcca

SEQ ID NO: 2455038 - RNA, 16 nt, Bordetella pertussis
gccggcguccugcggc

SEQ ID NO: 2455039 - RNA, 22 nt, Bordetella pertussis
gccggcgucgcucaggguacgg

SEQ ID NO: 2455040 - RNA, 22 nt, Bordetella pertussis
gccggcgucuggagcggccugg

SEQ ID NO: 2455041 - RNA, 15 nt, Bordetella pertussis
gccggcgugcugucc

SEQ ID NO: 2455042 - RNA, 13 nt, Bordetella pertussis
gccggcguggccu

SEQ ID NO: 2455043 - RNA, 17 nt, Bordetella pertussis
gccggcguggccugccc

SEQ ID NO: 2455044 - RNA, 19 nt, Bordetella pertussis
gccggcguggccugcccgu

SEQ ID NO: 2455045 - RNA, 13 nt, Bordetella pertussis
gccggcguggcgc

SEQ ID NO: 2455046 - RNA, 16 nt, Bordetella pertussis
gccggcguggcgcgca

SEQ ID NO: 2455047 - RNA, 19 nt, Bordetella pertussis
gccggcguguucagcgcgc

SEQ ID NO: 2455048 - RNA, 20 nt, Bordetella pertussis
gccggcguguucagcgcgcg

SEQ ID NO: 2455049 - RNA, 21 nt, Bordetella pertussis
gccggcguguucagcgcgcgc

SEQ ID NO: 2455050 - RNA, 16 nt, Bordetella pertussis
gccggcguucaccagg

SEQ ID NO: 2455051 - RNA, 22 nt, Bordetella pertussis
gccggcguucaccaggaagcgc

SEQ ID NO: 2455052 - RNA, 17 nt, Bordetella pertussis
gccggcguucuggucag

SEQ ID NO: 2455053 - RNA, 19 nt, Bordetella pertussis
gccggcguucuggucagcc

SEQ ID NO: 2455054 - RNA, 20 nt, Bordetella pertussis
gccggcguucuggucagccg

SEQ ID NO: 2455055 - RNA, 21 nt, Bordetella pertussis
gccggcguucuggucagccgu

SEQ ID NO: 2455056 - RNA, 17 nt, Bordetella pertussis
gccggcguugaaggcga

SEQ ID NO: 2455057 - RNA, 22 nt, Bordetella pertussis
gccggcguugaaggcgaugggc

SEQ ID NO: 2455058 - RNA, 17 nt, Bordetella pertussis
gccggcguugccguuuc

SEQ ID NO: 2455059 - RNA, 22 nt, Bordetella pertussis
gccggcguuggccgggucgcgc

SEQ ID NO: 2455060 - RNA, 23 nt, Bordetella pertussis
gccggcguuggccgggucgcgca

SEQ ID NO: 2455061 - RNA, 23 nt, Bordetella pertussis
gccggcguuggugacgauggugc

SEQ ID NO: 2455062 - RNA, 20 nt, Bordetella pertussis
gccggcuacagcucgccggc

SEQ ID NO: 2455063 - RNA, 21 nt, Bordetella pertussis
gccggcuacagcucgccggcg

SEQ ID NO: 2455064 - RNA, 15 nt, Bordetella pertussis
gccggcucagccccc

SEQ ID NO: 2455065 - RNA, 15 nt, Bordetella pertussis
gccggcucaggccag

SEQ ID NO: 2455066 - RNA, 17 nt, Bordetella pertussis
gccggcucaggccagcg

SEQ ID NO: 2455067 - RNA, 19 nt, Bordetella pertussis
gccggcucaggccagcgac

SEQ ID NO: 2455068 - RNA, 23 nt, Bordetella pertussis
gccggcucaggccagcgacccgc

SEQ ID NO: 2455069 - RNA, 19 nt, Bordetella pertussis
gccggcucauucggcgcgc

SEQ ID NO: 2455070 - RNA, 15 nt, Bordetella pertussis
gccggcuccaguccc

SEQ ID NO: 2455071 - RNA, 14 nt, Bordetella pertussis
gccggcucccgcgc

SEQ ID NO: 2455072 - RNA, 15 nt, Bordetella pertussis
gccggcucccgcgcu

SEQ ID NO: 2455073 - RNA, 17 nt, Bordetella pertussis
gccggcucccgcgcugc

SEQ ID NO: 2455074 - RNA, 20 nt, Bordetella pertussis
gccggcucccgcgcugccgc

SEQ ID NO: 2455075 - RNA, 21 nt, Bordetella pertussis
gccggcucccgcgcugccgcu

SEQ ID NO: 2455076 - RNA, 22 nt, Bordetella pertussis
gccggcucccgcgcugccgcug

SEQ ID NO: 2455077 - RNA, 24 nt, Bordetella pertussis
gccggcucccgcgcugccgcugca

SEQ ID NO: 2455078 - RNA, 19 nt, Bordetella pertussis
gccggcuccgauagcggcg

SEQ ID NO: 2455079 - RNA, 22 nt, Bordetella pertussis
gccggcuccgauagcggcgccg

SEQ ID NO: 2455080 - RNA, 20 nt, Bordetella pertussis
gccggcucgaacaggcuggc

SEQ ID NO: 2455081 - RNA, 15 nt, Bordetella pertussis
gccggcucggcggca

SEQ ID NO: 2455082 - RNA, 19 nt, Bordetella pertussis
gccggcucguacggcgucg

SEQ ID NO: 2455083 - RNA, 19 nt, Bordetella pertussis
gccggcucguaggcgaggu

SEQ ID NO: 2455084 - RNA, 21 nt, Bordetella pertussis
gccggcucguaggcgaggucc

SEQ ID NO: 2455085 - RNA, 19 nt, Bordetella pertussis
gccggcugaauuggcgccc

SEQ ID NO: 2455086 - RNA, 20 nt, Bordetella pertussis
gccggcugaauuggcgccca

SEQ ID NO: 2455087 - RNA, 20 nt, Bordetella pertussis
gccggcugcaagacgcccag

SEQ ID NO: 2455088 - RNA, 22 nt, Bordetella pertussis
gccggcugcaagacgcccaggc

SEQ ID NO: 2455089 - RNA, 16 nt, Bordetella pertussis
gccggcugcaccagcg

SEQ ID NO: 2455090 - RNA, 18 nt, Bordetella pertussis
gccggcugcaccagcgcg

SEQ ID NO: 2455091 - RNA, 21 nt, Bordetella pertussis
gccggcugcaccagcgcgccg

SEQ ID NO: 2455092 - RNA, 15 nt, Bordetella pertussis
gccggcugcgcgccg

SEQ ID NO: 2455093 - RNA, 18 nt, Bordetella pertussis
gccggcugcgcgccgacc

SEQ ID NO: 2455094 - RNA, 12 nt, Bordetella pertussis
gccggcugggcg

SEQ ID NO: 2455095 - RNA, 16 nt, Bordetella pertussis
gccggcugggcggccu

SEQ ID NO: 2455096 - RNA, 20 nt, Bordetella pertussis
gcgcgcagggcgaacguggc

SEQ ID NO: 2455097 - RNA, 23 nt, Bordetella pertussis
gcgcgcagggcgaacguggccug

SEQ ID NO: 2455098 - RNA, 14 nt, Bordetella pertussis
gcgcgcagggcggc

SEQ ID NO: 2455099 - RNA, 18 nt, Bordetella pertussis
gcgcgcagggcggccggc

SEQ ID NO: 2455100 - RNA, 19 nt, Bordetella pertussis
gcgcgcagggcggccggca

SEQ ID NO: 2455101 - RNA, 13 nt, Bordetella pertussis
gcgcgcaggucgu

SEQ ID NO: 2455102 - RNA, 18 nt, Bordetella pertussis
gcgcgcaggucguggccg

SEQ ID NO: 2455103 - RNA, 21 nt, Bordetella pertussis
gcgcgcaggugugccagccgc

SEQ ID NO: 2455104 - RNA, 16 nt, Bordetella pertussis
gcgcgcauccaggugc

SEQ ID NO: 2455105 - RNA, 23 nt, Bordetella pertussis
gcgcgcauccgguggugcugggc

SEQ ID NO: 2455106 - RNA, 14 nt, Bordetella pertussis
gcgcgcaucgccga

SEQ ID NO: 2455107 - RNA, 20 nt, Bordetella pertussis
gcgcgcaucgccgaacaggg

SEQ ID NO: 2455108 - RNA, 16 nt, Bordetella pertussis
gcgcgcaucgcgcggc

SEQ ID NO: 2455109 - RNA, 15 nt, Bordetella pertussis
gcgcgcaucggccgg

SEQ ID NO: 2455110 - RNA, 22 nt, Bordetella pertussis
gcgcgcaucggccggauccagc

SEQ ID NO: 2455111 - RNA, 13 nt, Bordetella pertussis
gcgcgcaucggcg

SEQ ID NO: 2455112 - RNA, 16 nt, Bordetella pertussis
gcgcgcaucggcgccg

SEQ ID NO: 2455113 - RNA, 19 nt, Bordetella pertussis
gcgcgcaucggcgccgagc

SEQ ID NO: 2455114 - RNA, 14 nt, Bordetella pertussis
gcgcgcaucgucag

SEQ ID NO: 2455115 - RNA, 16 nt, Bordetella pertussis
gcgcgcaucgucaggc

SEQ ID NO: 2455116 - RNA, 13 nt, Bordetella pertussis
gcgcgcaugcccg

SEQ ID NO: 2455117 - RNA, 19 nt, Bordetella pertussis
gcgcgcaugcccgaccgca

SEQ ID NO: 2455118 - RNA, 20 nt, Bordetella pertussis
gcgcgcaugcgcacgcgcgu

SEQ ID NO: 2455119 - RNA, 17 nt, Bordetella pertussis
gcgcgccacauccugca

SEQ ID NO: 2455120 - RNA, 19 nt, Bordetella pertussis
gcgcgccacauccugcacg

SEQ ID NO: 2455121 - RNA, 15 nt, Bordetella pertussis
gcgcgccaccaccuc

SEQ ID NO: 2455122 - RNA, 13 nt, Bordetella pertussis
gcgcgccaccgcc

SEQ ID NO: 2455123 - RNA, 15 nt, Bordetella pertussis
gcgcgccaccgccag

SEQ ID NO: 2455124 - RNA, 14 nt, Bordetella pertussis
gcgcgccacggcgu

SEQ ID NO: 2455125 - RNA, 21 nt, Bordetella pertussis
gcgcgccacggcgucgccggc

SEQ ID NO: 2455126 - RNA, 22 nt, Bordetella pertussis
gcgcgccacggcgucgccggcc

SEQ ID NO: 2455127 - RNA, 14 nt, Bordetella pertussis
gcgcgccacgucga

SEQ ID NO: 2455128 - RNA, 22 nt, Bordetella pertussis
gcgcgccacuauguggcguucg

SEQ ID NO: 2455129 - RNA, 12 nt, Bordetella pertussis
gcgcgccagcac

SEQ ID NO: 2455130 - RNA, 18 nt, Bordetella pertussis
gcgcgccagcacgguggc

SEQ ID NO: 2455131 - RNA, 14 nt, Bordetella pertussis
gcgcgccagcagcg

SEQ ID NO: 2455132 - RNA, 18 nt, Bordetella pertussis
gcgcgccagcagcgccgg

SEQ ID NO: 2455133 - RNA, 22 nt, Bordetella pertussis
gcgcgccagcagcgccgguucg

SEQ ID NO: 2455134 - RNA, 13 nt, Bordetella pertussis
gcgcgccagcagu

SEQ ID NO: 2455135 - RNA, 16 nt, Bordetella pertussis
gcgcgccagcaguucg

SEQ ID NO: 2455136 - RNA, 13 nt, Bordetella pertussis
gcgcgccagcaug

SEQ ID NO: 2455137 - RNA, 11 nt, Bordetella pertussis
gcgcgccagcc

SEQ ID NO: 2455138 - RNA, 12 nt, Bordetella pertussis
gcgcgccagccc

SEQ ID NO: 2455139 - RNA, 13 nt, Bordetella pertussis
gcgcgccagccgc

SEQ ID NO: 2455140 - RNA, 16 nt, Bordetella pertussis
gcgcgccagccgcgcg

SEQ ID NO: 2455141 - RNA, 19 nt, Bordetella pertussis
gcgcgccagccgcugcagc

SEQ ID NO: 2455142 - RNA, 12 nt, Bordetella pertussis
gcgcgccagcgc

SEQ ID NO: 2455143 - RNA, 13 nt, Bordetella pertussis
gcgcgccagcgcc

SEQ ID NO: 2455144 - RNA, 14 nt, Bordetella pertussis
gcgcgccagcgcca

SEQ ID NO: 2455145 - RNA, 17 nt, Bordetella pertussis
gcgcgccagcgccacgc

SEQ ID NO: 2455146 - RNA, 19 nt, Bordetella pertussis
gcgcgccagcgccacgcga

SEQ ID NO: 2455147 - RNA, 22 nt, Bordetella pertussis
gcgcgccagcgccacgcgagcc

SEQ ID NO: 2455148 - RNA, 14 nt, Bordetella pertussis
gcgcgccagcgcgg

SEQ ID NO: 2455149 - RNA, 16 nt, Bordetella pertussis
gcgcgccagcgcggcc

SEQ ID NO: 2455150 - RNA, 18 nt, Bordetella pertussis
gcgcgccagcgcggccag

SEQ ID NO: 2455151 - RNA, 20 nt, Bordetella pertussis
gcgcgccagcgcggccagcg

SEQ ID NO: 2455152 - RNA, 19 nt, Bordetella pertussis
gcgcgccagcgcggcgggc

SEQ ID NO: 2455153 - RNA, 14 nt, Bordetella pertussis
gcgcgccagcggcu

SEQ ID NO: 2455154 - RNA, 15 nt, Bordetella pertussis
gcgcgccagcggcug

SEQ ID NO: 2455155 - RNA, 17 nt, Bordetella pertussis
gcgcgccagcggcugcu

SEQ ID NO: 2455156 - RNA, 11 nt, Bordetella pertussis
gcgcgccagcu

SEQ ID NO: 2455157 - RNA, 12 nt, Bordetella pertussis
gcgcgccagcuc

SEQ ID NO: 2455158 - RNA, 15 nt, Bordetella pertussis
gcgcgccagcucgcg

SEQ ID NO: 2455159 - RNA, 20 nt, Bordetella pertussis
gcgcgccagcucgcgcagca

SEQ ID NO: 2455160 - RNA, 16 nt, Bordetella pertussis
gcgcgccagcugggcg

SEQ ID NO: 2455161 - RNA, 17 nt, Bordetella pertussis
gcgcgccagcugggcgu

SEQ ID NO: 2455162 - RNA, 16 nt, Bordetella pertussis
gcgcgccaggaagcgc

SEQ ID NO: 2455163 - RNA, 22 nt, Bordetella pertussis
gcgcgccaggaagcgcgccgcg

SEQ ID NO: 2455164 - RNA, 23 nt, Bordetella pertussis
gcgcgccaggaagcgcgccgcgc

SEQ ID NO: 2455165 - RNA, 15 nt, Bordetella pertussis
gcgcgccaggcccag

SEQ ID NO: 2455166 - RNA, 17 nt, Bordetella pertussis
gcgcgccaggcccaggg

SEQ ID NO: 2455167 - RNA, 21 nt, Bordetella pertussis
gcgcgccaggcccagggccag

SEQ ID NO: 2455168 - RNA, 13 nt, Bordetella pertussis
gcgcgccaggccu

SEQ ID NO: 2455169 - RNA, 12 nt, Bordetella pertussis
gcgcgccaggcg

SEQ ID NO: 2455170 - RNA, 14 nt, Bordetella pertussis
gcgcgccaggcgca

SEQ ID NO: 2455171 - RNA, 14 nt, Bordetella pertussis
gcgcgccaggcgcg

SEQ ID NO: 2455172 - RNA, 19 nt, Bordetella pertussis
gcgcgccaggcgcgcaucg

SEQ ID NO: 2455173 - RNA, 20 nt, Bordetella pertussis
gcgcgccaggcgcgcaucgc

SEQ ID NO: 2455174 - RNA, 16 nt, Bordetella pertussis
gcgcgccaggcgcugc

SEQ ID NO: 2455175 - RNA, 13 nt, Bordetella pertussis
gcgcgccaggcug

SEQ ID NO: 2455176 - RNA, 15 nt, Bordetella pertussis
gcgcgccaggcuguc

SEQ ID NO: 2455177 - RNA, 15 nt, Bordetella pertussis
gcgcgccagggcgcc

SEQ ID NO: 2455178 - RNA, 18 nt, Bordetella pertussis
gcgcgccagggcgccgcg

SEQ ID NO: 2455179 - RNA, 14 nt, Bordetella pertussis
gcgcgccaggucgc

SEQ ID NO: 2455180 - RNA, 15 nt, Bordetella pertussis
gcgcgccaggucgcg

SEQ ID NO: 2455181 - RNA, 16 nt, Bordetella pertussis
gcgcgccaggucgcgc

SEQ ID NO: 2455182 - RNA, 17 nt, Bordetella pertussis
gcgcgccaggucgcgca

SEQ ID NO: 2455183 - RNA, 20 nt, Bordetella pertussis
gcgcgccaggucgcgcacca

SEQ ID NO: 2455184 - RNA, 13 nt, Bordetella pertussis
gcgcgccaggugc

SEQ ID NO: 2455185 - RNA, 14 nt, Bordetella pertussis
gcgcgccauccggc

SEQ ID NO: 2455186 - RNA, 17 nt, Bordetella pertussis
gcgcgccauccggcgca

SEQ ID NO: 2455187 - RNA, 23 nt, Bordetella pertussis
gcgcgccauccugaacgccgcgc

SEQ ID NO: 2455188 - RNA, 21 nt, Bordetella pertussis
gcgcgccaucgacgggcggcu

SEQ ID NO: 2455189 - RNA, 22 nt, Bordetella pertussis
gcgcgccaugaaagcgaacagg

SEQ ID NO: 2455190 - RNA, 14 nt, Bordetella pertussis
gcgcgccaugguga

SEQ ID NO: 2455191 - RNA, 13 nt, Bordetella pertussis
gcgcgcccaccag

SEQ ID NO: 2455192 - RNA, 14 nt, Bordetella pertussis
gcgcgcccaccagg

SEQ ID NO: 2455193 - RNA, 19 nt, Bordetella pertussis
gcgcgcccaccagggugcc

SEQ ID NO: 2455194 - RNA, 15 nt, Bordetella pertussis
gcgcgccgggccaga

SEQ ID NO: 2455195 - RNA, 21 nt, Bordetella pertussis
gcgcgccgggccagaccuggu

SEQ ID NO: 2455196 - RNA, 21 nt, Bordetella pertussis
gcgcgccgggcccggccacgg

SEQ ID NO: 2455197 - RNA, 22 nt, Bordetella pertussis
gcgcgccgggcccggccacggc

SEQ ID NO: 2455198 - RNA, 15 nt, Bordetella pertussis
gcgcgccgggccggc

SEQ ID NO: 2455199 - RNA, 16 nt, Bordetella pertussis
gcgcgccgggccuagc

SEQ ID NO: 2455200 - RNA, 23 nt, Bordetella pertussis
gcgcgccgggccuagcccggcgc

SEQ ID NO: 2455201 - RNA, 19 nt, Bordetella pertussis
gcgcgccgggcgggucggc

SEQ ID NO: 2455202 - RNA, 18 nt, Bordetella pertussis
gcgcgccguacagccgcg

SEQ ID NO: 2455203 - RNA, 16 nt, Bordetella pertussis
gcgcgccguccgggcc

SEQ ID NO: 2455204 - RNA, 17 nt, Bordetella pertussis
gcgcgccguccgggccg

SEQ ID NO: 2455205 - RNA, 18 nt, Bordetella pertussis
gcgcgccgucgcuggggc

SEQ ID NO: 2455206 - RNA, 14 nt, Bordetella pertussis
gcgcgccgucgggg

SEQ ID NO: 2455207 - RNA, 20 nt, Bordetella pertussis
gcgcgccgucgggggccggc

SEQ ID NO: 2455208 - RNA, 14 nt, Bordetella pertussis
gcgcgccguggcug

SEQ ID NO: 2455209 - RNA, 21 nt, Bordetella pertussis
gcgcgccguucagggacgggc

SEQ ID NO: 2455210 - RNA, 22 nt, Bordetella pertussis
gcgcgccuacagcagcggcucg

SEQ ID NO: 2455211 - RNA, 15 nt, Bordetella pertussis
gcgcgccuccagcuc

SEQ ID NO: 2455212 - RNA, 16 nt, Bordetella pertussis
gcgcgccuccagcucc

SEQ ID NO: 2455213 - RNA, 23 nt, Bordetella pertussis
gcgcgccuccagcuccagcgcgc

SEQ ID NO: 2455214 - RNA, 16 nt, Bordetella pertussis
gcgcgccucggcgcgc

SEQ ID NO: 2455215 - RNA, 22 nt, Bordetella pertussis
gcgcgccucggcgcgcgcggcg

SEQ ID NO: 2455216 - RNA, 13 nt, Bordetella pertussis
gcgcgccugcagc

SEQ ID NO: 2455217 - RNA, 17 nt, Bordetella pertussis
gcgcgccugcagcagcg

SEQ ID NO: 2455218 - RNA, 20 nt, Bordetella pertussis
gcgcgccugcauguccagcg

SEQ ID NO: 2455219 - RNA, 24 nt, Bordetella pertussis
gcgcgccugcauguccagcggcgu

SEQ ID NO: 2455220 - RNA, 15 nt, Bordetella pertussis
gcgcgccugcccagg

SEQ ID NO: 2455221 - RNA, 16 nt, Bordetella pertussis
gcgcgccugcccaggc

SEQ ID NO: 2455222 - RNA, 18 nt, Bordetella pertussis
gcgcgccugcccaggcca

SEQ ID NO: 2455223 - RNA, 21 nt, Bordetella pertussis
gcgcgccugcccaggccagcg

SEQ ID NO: 2455224 - RNA, 13 nt, Bordetella pertussis
gcgcgccugcccc

SEQ ID NO: 2455225 - RNA, 12 nt, Bordetella pertussis
gcgcgccugccg

SEQ ID NO: 2455226 - RNA, 13 nt, Bordetella pertussis
gcgcgccugcgcg

SEQ ID NO: 2455227 - RNA, 14 nt, Bordetella pertussis
gcgcgccugcgcgc

SEQ ID NO: 2455228 - RNA, 13 nt, Bordetella pertussis
gcgcgccugcucg

SEQ ID NO: 2455229 - RNA, 21 nt, Bordetella pertussis
gcgcgccugcucgaccugcuc

SEQ ID NO: 2455230 - RNA, 13 nt, Bordetella pertussis
gcgcgccuggcac

SEQ ID NO: 2455231 - RNA, 16 nt, Bordetella pertussis
gcgcgccuggcacgac

SEQ ID NO: 2455232 - RNA, 13 nt, Bordetella pertussis
gcgcgccuggcgc

SEQ ID NO: 2455233 - RNA, 14 nt, Bordetella pertussis
gcgcgccuggcgcg

SEQ ID NO: 2455234 - RNA, 15 nt, Bordetella pertussis
gcgcgccuggcgcgc

SEQ ID NO: 2455235 - RNA, 18 nt, Bordetella pertussis
gcgcgccuggcgcgccca

SEQ ID NO: 2455236 - RNA, 13 nt, Bordetella pertussis
gcgcgccuuacgc

SEQ ID NO: 2455237 - RNA, 17 nt, Bordetella pertussis
gcgcgccuuacgcggcg

SEQ ID NO: 2455238 - RNA, 20 nt, Bordetella pertussis
gcgcgccuuacgcggcgcgc

SEQ ID NO: 2455239 - RNA, 21 nt, Bordetella pertussis
gcgcgccuuacuccggcugcu

SEQ ID NO: 2455240 - RNA, 16 nt, Bordetella pertussis
gcgcgccuuccugggc

SEQ ID NO: 2455241 - RNA, 19 nt, Bordetella pertussis
gcgcgccuuccugggcgcc

SEQ ID NO: 2455242 - RNA, 20 nt, Bordetella pertussis
gcgcgccuuccugggcgccg

SEQ ID NO: 2455243 - RNA, 22 nt, Bordetella pertussis
gcgcgccuuccugggcgccggc

SEQ ID NO: 2455244 - RNA, 23 nt, Bordetella pertussis
gcgcgccuuccugggcgccggcg

SEQ ID NO: 2455245 - RNA, 13 nt, Bordetella pertussis
gcgcgccuucggc

SEQ ID NO: 2455246 - RNA, 18 nt, Bordetella pertussis
gcgcgccuucggcaggcg

SEQ ID NO: 2455247 - RNA, 20 nt, Bordetella pertussis
gcgcgccuucggcaggcgcc

SEQ ID NO: 2455248 - RNA, 13 nt, Bordetella pertussis
gcgcgccuugcgc

SEQ ID NO: 2455249 - RNA, 15 nt, Bordetella pertussis
gcgcgccuugcgcgg

SEQ ID NO: 2455250 - RNA, 13 nt, Bordetella pertussis
gcgcgcgaccagg

SEQ ID NO: 2455251 - RNA, 12 nt, Bordetella pertussis
gcgcgcgaccuc

SEQ ID NO: 2455252 - RNA, 19 nt, Bordetella pertussis
gcgcgcgacgacagcggcg

SEQ ID NO: 2455253 - RNA, 16 nt, Bordetella pertussis
gcgcgcgacggcgccg

SEQ ID NO: 2455254 - RNA, 18 nt, Bordetella pertussis
gcgcgcgacuccaccggc

SEQ ID NO: 2455255 - RNA, 20 nt, Bordetella pertussis
gcgcgcgacuucgccgaucg

SEQ ID NO: 2455256 - RNA, 13 nt, Bordetella pertussis
gcgcgcgagcggc

SEQ ID NO: 2455257 - RNA, 14 nt, Bordetella pertussis
gcgcgcgagcggcg

SEQ ID NO: 2455258 - RNA, 19 nt, Bordetella pertussis
gcgcgcgagcggcggccgc

SEQ ID NO: 2455259 - RNA, 19 nt, Bordetella pertussis
gcgcgcgagcugcgcggcu

SEQ ID NO: 2455260 - RNA, 14 nt, Bordetella pertussis
gcgcgcgaggcggc

SEQ ID NO: 2455261 - RNA, 19 nt, Bordetella pertussis
gcgcgcgaggcggcggccg

SEQ ID NO: 2455262 - RNA, 14 nt, Bordetella pertussis
gcgcgcgaucgcca

SEQ ID NO: 2455263 - RNA, 14 nt, Bordetella pertussis
gcgcgcgaugcgca

SEQ ID NO: 2455264 - RNA, 15 nt, Bordetella pertussis
gcgcgcgaugcgcag

SEQ ID NO: 2455265 - RNA, 18 nt, Bordetella pertussis
gcgcgcgcaagccgccgc

SEQ ID NO: 2455266 - RNA, 19 nt, Bordetella pertussis
gcgcgcgcaagccgccgcc

SEQ ID NO: 2455267 - RNA, 13 nt, Bordetella pertussis
gcgcgcgcacagg

SEQ ID NO: 2455268 - RNA, 14 nt, Bordetella pertussis
gcgcgcgcacaggc

SEQ ID NO: 2455269 - RNA, 15 nt, Bordetella pertussis
gcgcgcgcacaggcg

SEQ ID NO: 2455270 - RNA, 15 nt, Bordetella pertussis
gcgcgcgcagcaauu

SEQ ID NO: 2455271 - RNA, 13 nt, Bordetella pertussis
gcgcgcgcagccg

SEQ ID NO: 2455272 - RNA, 14 nt, Bordetella pertussis
gcgcgcgcagccgc

SEQ ID NO: 2455273 - RNA, 15 nt, Bordetella pertussis
gcgcgcgcagccgcg

SEQ ID NO: 2455274 - RNA, 16 nt, Bordetella pertussis
gcgcgcgcagccgcgc

SEQ ID NO: 2455275 - RNA, 12 nt, Bordetella pertussis
gcgcgcgcaggc

SEQ ID NO: 2455276 - RNA, 14 nt, Bordetella pertussis
gcgcgcgcaggcgc

SEQ ID NO: 2455277 - RNA, 14 nt, Bordetella pertussis
gcgcgcgcaucggc

SEQ ID NO: 2455278 - RNA, 15 nt, Bordetella pertussis
gcgcgcgcaucggcc

SEQ ID NO: 2455279 - RNA, 12 nt, Bordetella pertussis
gcgcgcgccagc

SEQ ID NO: 2455280 - RNA, 16 nt, Bordetella pertussis
gcgcgcgccagcggcu

SEQ ID NO: 2455281 - RNA, 19 nt, Bordetella pertussis
gcgcgcgccagcggcugcu

SEQ ID NO: 2455282 - RNA, 14 nt, Bordetella pertussis
gcgcgcgccaggcc

SEQ ID NO: 2455283 - RNA, 13 nt, Bordetella pertussis
gcgcgcgccaggg

SEQ ID NO: 2455284 - RNA, 14 nt, Bordetella pertussis
gcgcgcgccagguu

SEQ ID NO: 2455285 - RNA, 13 nt, Bordetella pertussis
gcgcgcgccaucg

SEQ ID NO: 2455286 - RNA, 15 nt, Bordetella pertussis
gcgcgcgccauggug

SEQ ID NO: 2455287 - RNA, 13 nt, Bordetella pertussis
gcgcgcgcccacc

SEQ ID NO: 2455288 - RNA, 14 nt, Bordetella pertussis
gcgcgcgcccaggc

SEQ ID NO: 2455289 - RNA, 13 nt, Bordetella pertussis
gcgcgcgccccca

SEQ ID NO: 2455290 - RNA, 13 nt, Bordetella pertussis
gcgcgcgccccgc

SEQ ID NO: 2455291 - RNA, 13 nt, Bordetella pertussis
gcgcgcgccgccg

SEQ ID NO: 2455292 - RNA, 17 nt, Bordetella pertussis
gcgcgcgccgccggcca

SEQ ID NO: 2455293 - RNA, 12 nt, Bordetella pertussis
gcgcgcgccgcg

SEQ ID NO: 2455294 - RNA, 13 nt, Bordetella pertussis
gcgcgcgccggca

SEQ ID NO: 2455295 - RNA, 17 nt, Bordetella pertussis
gcgcgcgccggcaucgg

SEQ ID NO: 2455296 - RNA, 14 nt, Bordetella pertussis
gccuggccccgcgc

SEQ ID NO: 2455297 - RNA, 19 nt, Bordetella pertussis
gccuggccccgcgcgagcg

SEQ ID NO: 2455298 - RNA, 21 nt, Bordetella pertussis
gccuggccccgcgcgagcgca

SEQ ID NO: 2455299 - RNA, 14 nt, Bordetella pertussis
gccuggccgagcgc

SEQ ID NO: 2455300 - RNA, 17 nt, Bordetella pertussis
gccuggccgagcgcggc

SEQ ID NO: 2455301 - RNA, 18 nt, Bordetella pertussis
gccuggccgagcgcggca

SEQ ID NO: 2455302 - RNA, 19 nt, Bordetella pertussis
gccuggccgagcgcggcau

SEQ ID NO: 2455303 - RNA, 20 nt, Bordetella pertussis
gccuggccgagcgcggcaug

SEQ ID NO: 2455304 - RNA, 13 nt, Bordetella pertussis
gccuggccgccca

SEQ ID NO: 2455305 - RNA, 16 nt, Bordetella pertussis
gccuggccgcccagcg

SEQ ID NO: 2455306 - RNA, 23 nt, Bordetella pertussis
gccuggccgcccagcgccugcaa

SEQ ID NO: 2455307 - RNA, 14 nt, Bordetella pertussis
gccuggccgccggc

SEQ ID NO: 2455308 - RNA, 15 nt, Bordetella pertussis
gccuggccgcgcgcc

SEQ ID NO: 2455309 - RNA, 14 nt, Bordetella pertussis
gccuggccgcgcuc

SEQ ID NO: 2455310 - RNA, 12 nt, Bordetella pertussis
gccuggccggcu

SEQ ID NO: 2455311 - RNA, 19 nt, Bordetella pertussis
gccuggccggcuugcaugg

SEQ ID NO: 2455312 - RNA, 22 nt, Bordetella pertussis
gccuggccguagcguuggcggc

SEQ ID NO: 2455313 - RNA, 17 nt, Bordetella pertussis
gccuggccugcgccgcc

SEQ ID NO: 2455314 - RNA, 18 nt, Bordetella pertussis
gccuggccugcgccgccg

SEQ ID NO: 2455315 - RNA, 14 nt, Bordetella pertussis
gccuggccuugcgc

SEQ ID NO: 2455316 - RNA, 13 nt, Bordetella pertussis
gccuggcgcauga

SEQ ID NO: 2455317 - RNA, 20 nt, Bordetella pertussis
gccuggcgccaacccgccau

SEQ ID NO: 2455318 - RNA, 13 nt, Bordetella pertussis
gccuggcgccgcg

SEQ ID NO: 2455319 - RNA, 16 nt, Bordetella pertussis
gccuggcgccgcgccc

SEQ ID NO: 2455320 - RNA, 12 nt, Bordetella pertussis
gccuggcgcgca

SEQ ID NO: 2455321 - RNA, 15 nt, Bordetella pertussis
gccuggcgcgcaucg

SEQ ID NO: 2455322 - RNA, 16 nt, Bordetella pertussis
gccuggcgcgcaucgg

SEQ ID NO: 2455323 - RNA, 13 nt, Bordetella pertussis
gccuggcgcgccc

SEQ ID NO: 2455324 - RNA, 15 nt, Bordetella pertussis
gccuggcgcgcccac

SEQ ID NO: 2455325 - RNA, 13 nt, Bordetella pertussis
gccuggcgcgcgg

SEQ ID NO: 2455326 - RNA, 14 nt, Bordetella pertussis
gccuggcgcgcggc

SEQ ID NO: 2455327 - RNA, 16 nt, Bordetella pertussis
gccuggcgcgcggccu

SEQ ID NO: 2455328 - RNA, 21 nt, Bordetella pertussis
gccuggcgcgcggccugggcg

SEQ ID NO: 2455329 - RNA, 14 nt, Bordetella pertussis
gccuggcgcggccc

SEQ ID NO: 2455330 - RNA, 13 nt, Bordetella pertussis
gccuggcgcggcg

SEQ ID NO: 2455331 - RNA, 16 nt, Bordetella pertussis
gccuggcgcggcgccu

SEQ ID NO: 2455332 - RNA, 20 nt, Bordetella pertussis
gccuggcgcggcgccugcgc

SEQ ID NO: 2455333 - RNA, 13 nt, Bordetella pertussis
gccuggcgcuccu

SEQ ID NO: 2455334 - RNA, 16 nt, Bordetella pertussis
gccuggcgcuccucgc

SEQ ID NO: 2455335 - RNA, 22 nt, Bordetella pertussis
gccuggcgcuccucgcgcgcgg

SEQ ID NO: 2455336 - RNA, 13 nt, Bordetella pertussis
gccuggcggacga

SEQ ID NO: 2455337 - RNA, 16 nt, Bordetella pertussis
gccuggcggaucucgg

SEQ ID NO: 2455338 - RNA, 22 nt, Bordetella pertussis
gccuggcggaucucggccagca

SEQ ID NO: 2455339 - RNA, 23 nt, Bordetella pertussis
gccuggcggaucucggccagcag

SEQ ID NO: 2455340 - RNA, 12 nt, Bordetella pertussis
gccuggcggcug

SEQ ID NO: 2455341 - RNA, 17 nt, Bordetella pertussis
gccuggcgggccugggc

SEQ ID NO: 2455342 - RNA, 18 nt, Bordetella pertussis
gccuggcgggccugggcg

SEQ ID NO: 2455343 - RNA, 20 nt, Bordetella pertussis
gccuggcguagggcugcacg

SEQ ID NO: 2455344 - RNA, 22 nt, Bordetella pertussis
gccuggcguucaaucgcgcuuc

SEQ ID NO: 2455345 - RNA, 22 nt, Bordetella pertussis
gcgccgcuugcguucaugccgg

SEQ ID NO: 2455346 - RNA, 17 nt, Bordetella pertussis
gcgccgcuuucucccgc

SEQ ID NO: 2455347 - RNA, 19 nt, Bordetella pertussis
gcgccgcuuucucccgccg

SEQ ID NO: 2455348 - RNA, 23 nt, Bordetella pertussis
gcgccggacaucagccauugcgu

SEQ ID NO: 2455349 - RNA, 22 nt, Bordetella pertussis
gcgccggacgcaaaaacgcccg

SEQ ID NO: 2455350 - RNA, 21 nt, Bordetella pertussis
gcgccggacguagucgcacgc

SEQ ID NO: 2455351 - RNA, 15 nt, Bordetella pertussis
gcgccggaucgcaca

SEQ ID NO: 2455352 - RNA, 18 nt, Bordetella pertussis
gcgccggaucggccggca

SEQ ID NO: 2455353 - RNA, 22 nt, Bordetella pertussis
gcgccggaucggccggcagcgc

SEQ ID NO: 2455354 - RNA, 15 nt, Bordetella pertussis
gcgccggaugcgcgu

SEQ ID NO: 2455355 - RNA, 15 nt, Bordetella pertussis
gcgccggcacgacga

SEQ ID NO: 2455356 - RNA, 13 nt, Bordetella pertussis
gcgccggcacgcu

SEQ ID NO: 2455357 - RNA, 18 nt, Bordetella pertussis
gcgccggcacgcugaccg

SEQ ID NO: 2455358 - RNA, 19 nt, Bordetella pertussis
gcgccggcacgcugaucgc

SEQ ID NO: 2455359 - RNA, 22 nt, Bordetella pertussis
gcgccggcagccccagcgccca

SEQ ID NO: 2455360 - RNA, 14 nt, Bordetella pertussis
gcgccggcagcgca

SEQ ID NO: 2455361 - RNA, 14 nt, Bordetella pertussis
gcgccggcaggcgc

SEQ ID NO: 2455362 - RNA, 16 nt, Bordetella pertussis
gcgccggcaggcgcgc

SEQ ID NO: 2455363 - RNA, 19 nt, Bordetella pertussis
gcgccggcaggcgcgccag

SEQ ID NO: 2455364 - RNA, 22 nt, Bordetella pertussis
gcgccggcaggcgcgccagccc

SEQ ID NO: 2455365 - RNA, 15 nt, Bordetella pertussis
gcgccggcagggcgg

SEQ ID NO: 2455366 - RNA, 16 nt, Bordetella pertussis
gcgccggcagggcggc

SEQ ID NO: 2455367 - RNA, 17 nt, Bordetella pertussis
gcgccggcagggcggcc

SEQ ID NO: 2455368 - RNA, 18 nt, Bordetella pertussis
gcgccggcagggcggcca

SEQ ID NO: 2455369 - RNA, 19 nt, Bordetella pertussis
gcgccggcagggcggccag

SEQ ID NO: 2455370 - RNA, 20 nt, Bordetella pertussis
gcgccggcagggcggccagg

SEQ ID NO: 2455371 - RNA, 16 nt, Bordetella pertussis
gcgccggcagggugcu

SEQ ID NO: 2455372 - RNA, 15 nt, Bordetella pertussis
gcgccggcaucggcg

SEQ ID NO: 2455373 - RNA, 18 nt, Bordetella pertussis
gcgccggcaucggcggcu

SEQ ID NO: 2455374 - RNA, 19 nt, Bordetella pertussis
gcgccggcaucggcggcuu

SEQ ID NO: 2455375 - RNA, 21 nt, Bordetella pertussis
gcgccggcaugaagcgcagca

SEQ ID NO: 2455376 - RNA, 22 nt, Bordetella pertussis
gcgccggcaugaagcgcagcag

SEQ ID NO: 2455377 - RNA, 19 nt, Bordetella pertussis
gcgccggcauuucgcuggg

SEQ ID NO: 2455378 - RNA, 13 nt, Bordetella pertussis
gcgccggccaccg

SEQ ID NO: 2455379 - RNA, 14 nt, Bordetella pertussis
gcgccggccagcgc

SEQ ID NO: 2455380 - RNA, 15 nt, Bordetella pertussis
gcgccggccagcgcg

SEQ ID NO: 2455381 - RNA, 15 nt, Bordetella pertussis
gcgccggccagcggc

SEQ ID NO: 2455382 - RNA, 17 nt, Bordetella pertussis
gcgccggccagcggcag

SEQ ID NO: 2455383 - RNA, 13 nt, Bordetella pertussis
gcgccggccagga

SEQ ID NO: 2455384 - RNA, 15 nt, Bordetella pertussis
gcgccggccaggaug

SEQ ID NO: 2455385 - RNA, 22 nt, Bordetella pertussis
gcgccggccaggaugagggcga

SEQ ID NO: 2455386 - RNA, 13 nt, Bordetella pertussis
gcgccggccaggg

SEQ ID NO: 2455387 - RNA, 15 nt, Bordetella pertussis
gcgccggccagggcc

SEQ ID NO: 2455388 - RNA, 16 nt, Bordetella pertussis
gcgccggccagggcca

SEQ ID NO: 2455389 - RNA, 12 nt, Bordetella pertussis
gcgccggcccag

SEQ ID NO: 2455390 - RNA, 14 nt, Bordetella pertussis
gcgccggcccaggc

SEQ ID NO: 2455391 - RNA, 15 nt, Bordetella pertussis
gcgccggcccaggcg

SEQ ID NO: 2455392 - RNA, 12 nt, Bordetella pertussis
gcgccggcccgg

SEQ ID NO: 2455393 - RNA, 17 nt, Bordetella pertussis
gcgccggccgacaggug

SEQ ID NO: 2455394 - RNA, 14 nt, Bordetella pertussis
gcgccggccgacgg

SEQ ID NO: 2455395 - RNA, 19 nt, Bordetella pertussis
gcgccggccgacggcgcug

SEQ ID NO: 2455396 - RNA, 11 nt, Bordetella pertussis
gcgccggccgc

SEQ ID NO: 2455397 - RNA, 14 nt, Bordetella pertussis
gcgccggccgccag

SEQ ID NO: 2455398 - RNA, 21 nt, Bordetella pertussis
gcgccggccgcccgccugccg

SEQ ID NO: 2455399 - RNA, 12 nt, Bordetella pertussis
gcgccggccgcg

SEQ ID NO: 2455400 - RNA, 13 nt, Bordetella pertussis
gcgccggccgcgc

SEQ ID NO: 2455401 - RNA, 17 nt, Bordetella pertussis
gcgccggccgcgcgcgc

SEQ ID NO: 2455402 - RNA, 13 nt, Bordetella pertussis
gcgccggccguca

SEQ ID NO: 2455403 - RNA, 19 nt, Bordetella pertussis
gcgccggccuccagcaucg

SEQ ID NO: 2455404 - RNA, 12 nt, Bordetella pertussis
gcgccggccugc

SEQ ID NO: 2455405 - RNA, 16 nt, Bordetella pertussis
gcgccggccugcgccg

SEQ ID NO: 2455406 - RNA, 14 nt, Bordetella pertussis
gcgccggccuggcg

SEQ ID NO: 2455407 - RNA, 15 nt, Bordetella pertussis
gcgccggccuggcgc

SEQ ID NO: 2455408 - RNA, 13 nt, Bordetella pertussis
gcgccggccuggg

SEQ ID NO: 2455409 - RNA, 14 nt, Bordetella pertussis
gcgccggccugggc

SEQ ID NO: 2455410 - RNA, 15 nt, Bordetella pertussis
gcgccggccugggcg

SEQ ID NO: 2455411 - RNA, 16 nt, Bordetella pertussis
gcgccggccugggcgg

SEQ ID NO: 2455412 - RNA, 13 nt, Bordetella pertussis
gcgccggccuugc

SEQ ID NO: 2455413 - RNA, 14 nt, Bordetella pertussis
gcgcgacuucaggu

SEQ ID NO: 2455414 - RNA, 19 nt, Bordetella pertussis
gcgcgacuucgccgaucga

SEQ ID NO: 2455415 - RNA, 23 nt, Bordetella pertussis
gcgcgacuucgccgaucgagcag

SEQ ID NO: 2455416 - RNA, 17 nt, Bordetella pertussis
gcgcgagaaccaggcca

SEQ ID NO: 2455417 - RNA, 19 nt, Bordetella pertussis
gcgcgagaaccaggccacg

SEQ ID NO: 2455418 - RNA, 22 nt, Bordetella pertussis
gcgcgagaagucaucgauggcc

SEQ ID NO: 2455419 - RNA, 16 nt, Bordetella pertussis
gcgcgagaccagcgga

SEQ ID NO: 2455420 - RNA, 20 nt, Bordetella pertussis
gcgcgagaccagcggaucgc

SEQ ID NO: 2455421 - RNA, 13 nt, Bordetella pertussis
gcgcgagcagggc

SEQ ID NO: 2455422 - RNA, 13 nt, Bordetella pertussis
gcgcgagcccauc

SEQ ID NO: 2455423 - RNA, 13 nt, Bordetella pertussis
gcgcgagccgccc

SEQ ID NO: 2455424 - RNA, 22 nt, Bordetella pertussis
gcgcgagccgcccacgggcgcc

SEQ ID NO: 2455425 - RNA, 12 nt, Bordetella pertussis
gcgcgagcgcac

SEQ ID NO: 2455426 - RNA, 15 nt, Bordetella pertussis
gcgcgagcgcacagg

SEQ ID NO: 2455427 - RNA, 16 nt, Bordetella pertussis
gcgcgagcgcacaggc

SEQ ID NO: 2455428 - RNA, 17 nt, Bordetella pertussis
gcgcgagcgcacaggcg

SEQ ID NO: 2455429 - RNA, 15 nt, Bordetella pertussis
gcgcgagcgccgggc

SEQ ID NO: 2455430 - RNA, 17 nt, Bordetella pertussis
gcgcgagcgccgggcgc

SEQ ID NO: 2455431 - RNA, 13 nt, Bordetella pertussis
gcgcgagcggcgg

SEQ ID NO: 2455432 - RNA, 19 nt, Bordetella pertussis
gcgcgagcggcggccgcgu

SEQ ID NO: 2455433 - RNA, 14 nt, Bordetella pertussis
gcgcgagcggcgug

SEQ ID NO: 2455434 - RNA, 21 nt, Bordetella pertussis
gcgcgagcggcgugcgcgugc

SEQ ID NO: 2455435 - RNA, 16 nt, Bordetella pertussis
gcgcgagcugcgcggc

SEQ ID NO: 2455436 - RNA, 13 nt, Bordetella pertussis
gcgcgaggcggcg

SEQ ID NO: 2455437 - RNA, 21 nt, Bordetella pertussis
gcgcgagguggcgcucgcgcc

SEQ ID NO: 2455438 - RNA, 22 nt, Bordetella pertussis
gcgcgaguaucccuaccgccuu

SEQ ID NO: 2455439 - RNA, 18 nt, Bordetella pertussis
gcgcgaucaggcggugcc

SEQ ID NO: 2455440 - RNA, 19 nt, Bordetella pertussis
gcgcgaucaggcggugccc

SEQ ID NO: 2455441 - RNA, 15 nt, Bordetella pertussis
gcgcgauccgcgcca

SEQ ID NO: 2455442 - RNA, 17 nt, Bordetella pertussis
gcgcgauccgcgccagg

SEQ ID NO: 2455443 - RNA, 19 nt, Bordetella pertussis
gcgcgauccuggggcagga

SEQ ID NO: 2455444 - RNA, 19 nt, Bordetella pertussis
gcgcgauccuucgcggccg

SEQ ID NO: 2455445 - RNA, 14 nt, Bordetella pertussis
gcgcgaucgccagc

SEQ ID NO: 2455446 - RNA, 15 nt, Bordetella pertussis
gcgcgaucgccagca

SEQ ID NO: 2455447 - RNA, 13 nt, Bordetella pertussis
gcgcgaucgccgc

SEQ ID NO: 2455448 - RNA, 16 nt, Bordetella pertussis
gcgcgaucgccgcaug

SEQ ID NO: 2455449 - RNA, 17 nt, Bordetella pertussis
gcgcgaucgccgcaugg

SEQ ID NO: 2455450 - RNA, 19 nt, Bordetella pertussis
gcgcgaucucgggcagguc

SEQ ID NO: 2455451 - RNA, 20 nt, Bordetella pertussis
gcgcgaucucguggcccagc

SEQ ID NO: 2455452 - RNA, 16 nt, Bordetella pertussis
gcgcgaucuugccgca

SEQ ID NO: 2455453 - RNA, 17 nt, Bordetella pertussis
gcgcgaugagcuggcgc

SEQ ID NO: 2455454 - RNA, 19 nt, Bordetella pertussis
gcgcgaugccaucgcuggu

SEQ ID NO: 2455455 - RNA, 18 nt, Bordetella pertussis
gcgcgaugcgcaggcugu

SEQ ID NO: 2455456 - RNA, 12 nt, Bordetella pertussis
gcgcgaugcgcg

SEQ ID NO: 2455457 - RNA, 14 nt, Bordetella pertussis
gcgcgaugcgcgcg

SEQ ID NO: 2455458 - RNA, 15 nt, Bordetella pertussis
gcgcgaugcgcgcgc

SEQ ID NO: 2455459 - RNA, 17 nt, Bordetella pertussis
gcgcgaugcgcgcgcgg

SEQ ID NO: 2455460 - RNA, 13 nt, Bordetella pertussis
gcgcgaugcgcgg

SEQ ID NO: 2455461 - RNA, 15 nt, Bordetella pertussis
gcgcgaugcgcggcc

SEQ ID NO: 2455462 - RNA, 14 nt, Bordetella pertussis
gcgcgaugggccug

SEQ ID NO: 2455463 - RNA, 18 nt, Bordetella pertussis
gcgcgauggucaccaccc

SEQ ID NO: 2455464 - RNA, 19 nt, Bordetella pertussis
gcgcgauggucaccacccg

SEQ ID NO: 2455465 - RNA, 16 nt, Bordetella pertussis
gcgcgaugucgcccau

SEQ ID NO: 2455466 - RNA, 18 nt, Bordetella pertussis
gcgcgauguucggaugcg

SEQ ID NO: 2455467 - RNA, 20 nt, Bordetella pertussis
gcgcgauguucggaugcgcg

SEQ ID NO: 2455468 - RNA, 17 nt, Bordetella pertussis
gcgcgauucccuggcgc

SEQ ID NO: 2455469 - RNA, 19 nt, Bordetella pertussis
gcgcgauucccuggcgcgc

SEQ ID NO: 2455470 - RNA, 20 nt, Bordetella pertussis
gcgcgauugcaucuccagga

SEQ ID NO: 2455471 - RNA, 20 nt, Bordetella pertussis
gcgcgcaaaccgacgcggcc

SEQ ID NO: 2455472 - RNA, 22 nt, Bordetella pertussis
gcgcgcaaaccgacgcggccag

SEQ ID NO: 2455473 - RNA, 15 nt, Bordetella pertussis
gcgcgcaacacgcgc

SEQ ID NO: 2455474 - RNA, 16 nt, Bordetella pertussis
gcgcgcaacacgcgcg

SEQ ID NO: 2455475 - RNA, 17 nt, Bordetella pertussis
gcgcgcaacacgcgcga

SEQ ID NO: 2455476 - RNA, 18 nt, Bordetella pertussis
gcgcgcaaccaggggcgg

SEQ ID NO: 2455477 - RNA, 23 nt, Bordetella pertussis
gcgcgcaaccaggggcggcgcgg

SEQ ID NO: 2455478 - RNA, 16 nt, Bordetella pertussis
gcgcgcaacccacggc

SEQ ID NO: 2455479 - RNA, 17 nt, Bordetella pertussis
gcgcgcaacccacggcg

SEQ ID NO: 2455480 - RNA, 16 nt, Bordetella pertussis
gcgcgcaacuccagca

SEQ ID NO: 2455481 - RNA, 18 nt, Bordetella pertussis
gcgcgcaacuccagcaua

SEQ ID NO: 2455482 - RNA, 19 nt, Bordetella pertussis
gcgcgcaagccgccgcccu

SEQ ID NO: 2455483 - RNA, 17 nt, Bordetella pertussis
gaugcccugcgccagcg

SEQ ID NO: 2455484 - RNA, 22 nt, Bordetella pertussis
gaugcccuggauggccugggug

SEQ ID NO: 2455485 - RNA, 16 nt, Bordetella pertussis
gaugcccuggguggcg

SEQ ID NO: 2455486 - RNA, 17 nt, Bordetella pertussis
gaugcccuggguggcgg

SEQ ID NO: 2455487 - RNA, 17 nt, Bordetella pertussis
gaugcccuucggcaugc

SEQ ID NO: 2455488 - RNA, 17 nt, Bordetella pertussis
gaugcccuuggcggcga

SEQ ID NO: 2455489 - RNA, 20 nt, Bordetella pertussis
gaugcccuuggcggcgaucg

SEQ ID NO: 2455490 - RNA, 20 nt, Bordetella pertussis
gaugccgaacaaaccgucga

SEQ ID NO: 2455491 - RNA, 13 nt, Bordetella pertussis
gaugccgaacagc

SEQ ID NO: 2455492 - RNA, 14 nt, Bordetella pertussis
gaugccgaacagcc

SEQ ID NO: 2455493 - RNA, 17 nt, Bordetella pertussis
gaugccgaacagccagg

SEQ ID NO: 2455494 - RNA, 20 nt, Bordetella pertussis
gaugccgaacagccagggca

SEQ ID NO: 2455495 - RNA, 17 nt, Bordetella pertussis
gaugccgaaccagauca

SEQ ID NO: 2455496 - RNA, 23 nt, Bordetella pertussis
gaugccgaaccagaucaggucga

SEQ ID NO: 2455497 - RNA, 20 nt, Bordetella pertussis
gaugccgaacugucgcgcca

SEQ ID NO: 2455498 - RNA, 21 nt, Bordetella pertussis
gaugccgaacugucgcgccac

SEQ ID NO: 2455499 - RNA, 15 nt, Bordetella pertussis
gaugccgaccaggcc

SEQ ID NO: 2455500 - RNA, 15 nt, Bordetella pertussis
gaugccgaccaggcu

SEQ ID NO: 2455501 - RNA, 20 nt, Bordetella pertussis
gaugccgaccaggcugcgcg

SEQ ID NO: 2455502 - RNA, 23 nt, Bordetella pertussis
gaugccgauacgucgcagcacgc

SEQ ID NO: 2455503 - RNA, 21 nt, Bordetella pertussis
gaugccgaugauggccauggc

SEQ ID NO: 2455504 - RNA, 20 nt, Bordetella pertussis
gaugccgcagauggccagca

SEQ ID NO: 2455505 - RNA, 24 nt, Bordetella pertussis
gaugccgcagauggccagcagcgc

SEQ ID NO: 2455506 - RNA, 12 nt, Bordetella pertussis
gaugccgcaguu

SEQ ID NO: 2455507 - RNA, 16 nt, Bordetella pertussis
gaugccgccaucaucc

SEQ ID NO: 2455508 - RNA, 23 nt, Bordetella pertussis
gaugccgccaucauccuggucga

SEQ ID NO: 2455509 - RNA, 17 nt, Bordetella pertussis
gaugccgccaugcgcca

SEQ ID NO: 2455510 - RNA, 14 nt, Bordetella pertussis
gaugccgcccagca

SEQ ID NO: 2455511 - RNA, 19 nt, Bordetella pertussis
gaugccgcccagcaugcgc

SEQ ID NO: 2455512 - RNA, 19 nt, Bordetella pertussis
gaugccgccgaaccagcgc

SEQ ID NO: 2455513 - RNA, 15 nt, Bordetella pertussis
gaugccgccggcggg

SEQ ID NO: 2455514 - RNA, 17 nt, Bordetella pertussis
gaugccgccggcgggca

SEQ ID NO: 2455515 - RNA, 15 nt, Bordetella pertussis
gaugccggccagcag

SEQ ID NO: 2455516 - RNA, 17 nt, Bordetella pertussis
gaugccggccucggcca

SEQ ID NO: 2455517 - RNA, 18 nt, Bordetella pertussis
gaugccggcgcugcgcag

SEQ ID NO: 2455518 - RNA, 14 nt, Bordetella pertussis
gaugccggcguggc

SEQ ID NO: 2455519 - RNA, 19 nt, Bordetella pertussis
gaugccggcguggcgcgca

SEQ ID NO: 2455520 - RNA, 14 nt, Bordetella pertussis
gaugccgggcacgu

SEQ ID NO: 2455521 - RNA, 22 nt, Bordetella pertussis
gaugccggucaggaugcgcgcc

SEQ ID NO: 2455522 - RNA, 23 nt, Bordetella pertussis
gaugccggucaggaugcgcgcca

SEQ ID NO: 2455523 - RNA, 16 nt, Bordetella pertussis
gaugccggucuccagc

SEQ ID NO: 2455524 - RNA, 19 nt, Bordetella pertussis
gaugccggucuccagcgcg

SEQ ID NO: 2455525 - RNA, 22 nt, Bordetella pertussis
gaugccggucuccagcgcgucg

SEQ ID NO: 2455526 - RNA, 17 nt, Bordetella pertussis
gaugccgguucgggcgg

SEQ ID NO: 2455527 - RNA, 14 nt, Bordetella pertussis
gaugccguccuggc

SEQ ID NO: 2455528 - RNA, 15 nt, Bordetella pertussis
gaugccgucgaaggc

SEQ ID NO: 2455529 - RNA, 18 nt, Bordetella pertussis
gaugccgucgaaggccgc

SEQ ID NO: 2455530 - RNA, 17 nt, Bordetella pertussis
gaugccgucgagcgcgg

SEQ ID NO: 2455531 - RNA, 22 nt, Bordetella pertussis
gaugccgucgagcgcggccagg

SEQ ID NO: 2455532 - RNA, 15 nt, Bordetella pertussis
gaugccgucggccug

SEQ ID NO: 2455533 - RNA, 13 nt, Bordetella pertussis
gaugccgucggcg

SEQ ID NO: 2455534 - RNA, 13 nt, Bordetella pertussis
gaugccguucuug

SEQ ID NO: 2455535 - RNA, 17 nt, Bordetella pertussis
gaugccucgaagcggcu

SEQ ID NO: 2455536 - RNA, 23 nt, Bordetella pertussis
gaugcgacuggcggcugcgggcg

SEQ ID NO: 2455537 - RNA, 23 nt, Bordetella pertussis
gaugcgagcaaaggacacgcgcg

SEQ ID NO: 2455538 - RNA, 17 nt, Bordetella pertussis
gaugcgcaccaugcgca

SEQ ID NO: 2455539 - RNA, 20 nt, Bordetella pertussis
gaugcgcaccaugcgcagca

SEQ ID NO: 2455540 - RNA, 23 nt, Bordetella pertussis
gaugcgcaccaugcgcagcaaca

SEQ ID NO: 2455541 - RNA, 15 nt, Bordetella pertussis
gaugcgcaccggcca

SEQ ID NO: 2455542 - RNA, 18 nt, Bordetella pertussis
gaugcgcaccggccaggg

SEQ ID NO: 2455543 - RNA, 21 nt, Bordetella pertussis
gaugcgcaccggccaggggcg

SEQ ID NO: 2455544 - RNA, 23 nt, Bordetella pertussis
gaugcgcacgggcgagggcugcc

SEQ ID NO: 2455545 - RNA, 19 nt, Bordetella pertussis
gaugcgcagcagcagcgca

SEQ ID NO: 2455546 - RNA, 18 nt, Bordetella pertussis
gaugcgcaggacggcgcc

SEQ ID NO: 2455547 - RNA, 19 nt, Bordetella pertussis
gaugcgcaggacggcgccg

SEQ ID NO: 2455548 - RNA, 13 nt, Bordetella pertussis
gaugcgcauggga

SEQ ID NO: 2455549 - RNA, 22 nt, Bordetella pertussis
gaugcgcaugggaaauccgccg

SEQ ID NO: 2455550 - RNA, 13 nt, Bordetella pertussis
gaugcgccaggcc

SEQ ID NO: 2455551 - RNA, 14 nt, Bordetella pertussis
gaugcgccaggccu

SEQ ID NO: 2455552 - RNA, 15 nt, Bordetella pertussis
gaugcgccaggcgcu

SEQ ID NO: 2455553 - RNA, 20 nt, Bordetella pertussis
gaugcgccaggcgcucggcg

SEQ ID NO: 2455554 - RNA, 13 nt, Bordetella pertussis
gaugcgccaggcu

SEQ ID NO: 2455555 - RNA, 14 nt, Bordetella pertussis
gaugcgccagucca

SEQ ID NO: 2455556 - RNA, 16 nt, Bordetella pertussis
gaugcgccaguccagc

SEQ ID NO: 2455557 - RNA, 12 nt, Bordetella pertussis
gaugcgccgcac

SEQ ID NO: 2455558 - RNA, 13 nt, Bordetella pertussis
gaugcgccgcacc

SEQ ID NO: 2455559 - RNA, 20 nt, Bordetella pertussis
gaugcgccgcacgucggucg

SEQ ID NO: 2455560 - RNA, 13 nt, Bordetella pertussis
gaugcgccgcccc

SEQ ID NO: 2455561 - RNA, 11 nt, Bordetella pertussis
gaugcgccgcg

SEQ ID NO: 2455562 - RNA, 12 nt, Bordetella pertussis
gaugcgccgcgc

SEQ ID NO: 2455563 - RNA, 22 nt, Bordetella pertussis
gaugcgccgcgcuucgucggcg

SEQ ID NO: 2455564 - RNA, 12 nt, Bordetella pertussis
gaugcgccggcc

SEQ ID NO: 2455565 - RNA, 16 nt, Bordetella pertussis
gaugcgccggccuggc

SEQ ID NO: 2455566 - RNA, 22 nt, Bordetella pertussis
gaugcgccggccuggcgcgacg

SEQ ID NO: 2455567 - RNA, 14 nt, Bordetella pertussis
gaugcgcgaagcgc

SEQ ID NO: 2455568 - RNA, 14 nt, Bordetella pertussis
gaugcgcgacaccg

SEQ ID NO: 2455569 - RNA, 11 nt, Bordetella pertussis
gaugcgcgcca

SEQ ID NO: 2455570 - RNA, 12 nt, Bordetella pertussis
gaugcgcgccag

SEQ ID NO: 2455571 - RNA, 13 nt, Bordetella pertussis
gaugcgcgccagg

SEQ ID NO: 2455572 - RNA, 15 nt, Bordetella pertussis
gaugcgcgccaggcg

SEQ ID NO: 2455573 - RNA, 13 nt, Bordetella pertussis
gaugcgcgccgcu

SEQ ID NO: 2455574 - RNA, 23 nt, Bordetella pertussis
gaugcgcgccguacagccgcggc

SEQ ID NO: 2455575 - RNA, 21 nt, Bordetella pertussis
gaugcgcgcgcggaucgacgc

SEQ ID NO: 2455576 - RNA, 17 nt, Bordetella pertussis
gaugcgcgcgcgggcca

SEQ ID NO: 2455577 - RNA, 22 nt, Bordetella pertussis
gaugcgcgcgcgggccagcaga

SEQ ID NO: 2455578 - RNA, 14 nt, Bordetella pertussis
gaugcgcgcggcca

SEQ ID NO: 2455579 - RNA, 14 nt, Bordetella pertussis
gaugcgcggcccgg

SEQ ID NO: 2455580 - RNA, 15 nt, Bordetella pertussis
gcgcgcgcggcgccg

SEQ ID NO: 2455581 - RNA, 16 nt, Bordetella pertussis
gcgcgcgcggcgccgc

SEQ ID NO: 2455582 - RNA, 16 nt, Bordetella pertussis
gcgcgcgcggcgccug

SEQ ID NO: 2455583 - RNA, 13 nt, Bordetella pertussis
gcgcgcgcgggcc

SEQ ID NO: 2455584 - RNA, 14 nt, Bordetella pertussis
gcgcgcgcguagcg

SEQ ID NO: 2455585 - RNA, 14 nt, Bordetella pertussis
gcgcgcgcugcacg

SEQ ID NO: 2455586 - RNA, 14 nt, Bordetella pertussis
gcgcgcgcuggggc

SEQ ID NO: 2455587 - RNA, 13 nt, Bordetella pertussis
gcgcgcggacugc

SEQ ID NO: 2455588 - RNA, 14 nt, Bordetella pertussis
gcgcgcggacugcc

SEQ ID NO: 2455589 - RNA, 22 nt, Bordetella pertussis
gcgcgcggauauucgucggccg

SEQ ID NO: 2455590 - RNA, 16 nt, Bordetella pertussis
gcgcgcggauccagcc

SEQ ID NO: 2455591 - RNA, 20 nt, Bordetella pertussis
gcgcgcggaucgaaaccggc

SEQ ID NO: 2455592 - RNA, 18 nt, Bordetella pertussis
gcgcgcggaugaucgcgc

SEQ ID NO: 2455593 - RNA, 20 nt, Bordetella pertussis
gcgcgcggaugaucgcgcag

SEQ ID NO: 2455594 - RNA, 13 nt, Bordetella pertussis
gcgcgcggccagc

SEQ ID NO: 2455595 - RNA, 14 nt, Bordetella pertussis
gcgcgcggccccgg

SEQ ID NO: 2455596 - RNA, 12 nt, Bordetella pertussis
gcgcgcggccgc

SEQ ID NO: 2455597 - RNA, 14 nt, Bordetella pertussis
gcgcgcggccggca

SEQ ID NO: 2455598 - RNA, 16 nt, Bordetella pertussis
gcgcgcggccggccgc

SEQ ID NO: 2455599 - RNA, 14 nt, Bordetella pertussis
gcgcgcggccggcg

SEQ ID NO: 2455600 - RNA, 15 nt, Bordetella pertussis
gcgcgcggccggcgc

SEQ ID NO: 2455601 - RNA, 21 nt, Bordetella pertussis
gcgcgcggccggcgcgccggc

SEQ ID NO: 2455602 - RNA, 13 nt, Bordetella pertussis
gcgcgcggccucg

SEQ ID NO: 2455603 - RNA, 15 nt, Bordetella pertussis
gcgcgcggccucgac

SEQ ID NO: 2455604 - RNA, 14 nt, Bordetella pertussis
gcgcgcggccucgg

SEQ ID NO: 2455605 - RNA, 14 nt, Bordetella pertussis
gcgcgcggccuggc

SEQ ID NO: 2455606 - RNA, 15 nt, Bordetella pertussis
gcgcgcggccuggcg

SEQ ID NO: 2455607 - RNA, 12 nt, Bordetella pertussis
gcgcgcggcgca

SEQ ID NO: 2455608 - RNA, 15 nt, Bordetella pertussis
gcgcgcggcgcagcg

SEQ ID NO: 2455609 - RNA, 20 nt, Bordetella pertussis
gcgcgcggcgcagcgcacga

SEQ ID NO: 2455610 - RNA, 17 nt, Bordetella pertussis
gcgcgcggcgccgcgcg

SEQ ID NO: 2455611 - RNA, 13 nt, Bordetella pertussis
gcgcgcggcgccu

SEQ ID NO: 2455612 - RNA, 24 nt, Bordetella pertussis
gcgcgcggcgcgccagcgcggcca

SEQ ID NO: 2455613 - RNA, 14 nt, Bordetella pertussis
gcgcgcggcgcggc

SEQ ID NO: 2455614 - RNA, 15 nt, Bordetella pertussis
gcgcgcggcgcggcu

SEQ ID NO: 2455615 - RNA, 19 nt, Bordetella pertussis
gcgcgcggcgcggcuggcg

SEQ ID NO: 2455616 - RNA, 14 nt, Bordetella pertussis
gcgcgcggcggccu

SEQ ID NO: 2455617 - RNA, 16 nt, Bordetella pertussis
gcgcgcggcucgccgc

SEQ ID NO: 2455618 - RNA, 13 nt, Bordetella pertussis
gcgcgcggcuggc

SEQ ID NO: 2455619 - RNA, 16 nt, Bordetella pertussis
gcgcgcggcuggcugu

SEQ ID NO: 2455620 - RNA, 19 nt, Bordetella pertussis
gcgcgcgggaagcugucgg

SEQ ID NO: 2455621 - RNA, 17 nt, Bordetella pertussis
gcgcgcgggccagcaga

SEQ ID NO: 2455622 - RNA, 21 nt, Bordetella pertussis
gcgcgcgggcgauggccacgc

SEQ ID NO: 2455623 - RNA, 12 nt, Bordetella pertussis
gcgcgcgggcgc

SEQ ID NO: 2455624 - RNA, 15 nt, Bordetella pertussis
gcgcgcgggcgcccg

SEQ ID NO: 2455625 - RNA, 18 nt, Bordetella pertussis
gcgcgcgggcgcccgcgc

SEQ ID NO: 2455626 - RNA, 14 nt, Bordetella pertussis
gcgcgcgggcgcgc

SEQ ID NO: 2455627 - RNA, 15 nt, Bordetella pertussis
gcgcgcgggcgcgcc

SEQ ID NO: 2455628 - RNA, 20 nt, Bordetella pertussis
gcgcgcgggcgcgccgucgc

SEQ ID NO: 2455629 - RNA, 20 nt, Bordetella pertussis
gcgcgcggggcaggccgaug

SEQ ID NO: 2455630 - RNA, 14 nt, Bordetella pertussis
gcgcgcgggggugc

SEQ ID NO: 2455631 - RNA, 20 nt, Bordetella pertussis
gcgcgcgggguaggccucga

SEQ ID NO: 2455632 - RNA, 20 nt, Bordetella pertussis
gcgcgcgguauccaggucga

SEQ ID NO: 2455633 - RNA, 18 nt, Bordetella pertussis
gcgcgcgguccaugguga

SEQ ID NO: 2455634 - RNA, 21 nt, Bordetella pertussis
gcgcgcgguccauggugaugc

SEQ ID NO: 2455635 - RNA, 19 nt, Bordetella pertussis
gcgcgcggugccgccuggc

SEQ ID NO: 2455636 - RNA, 21 nt, Bordetella pertussis
gcgcgcggugccgccuggcca

SEQ ID NO: 2455637 - RNA, 17 nt, Bordetella pertussis
gcgcgcggugucgccgc

SEQ ID NO: 2455638 - RNA, 23 nt, Bordetella pertussis
gcgcgcgguguucgagccggacg

SEQ ID NO: 2455639 - RNA, 21 nt, Bordetella pertussis
gcgcgcgguucaucgccucgu

SEQ ID NO: 2455640 - RNA, 18 nt, Bordetella pertussis
gcgcgcgguugagcgcca

SEQ ID NO: 2455641 - RNA, 20 nt, Bordetella pertussis
gcgcgcgguugagcgccagg

SEQ ID NO: 2455642 - RNA, 14 nt, Bordetella pertussis
gcgcgcguauggcg

SEQ ID NO: 2455643 - RNA, 15 nt, Bordetella pertussis
gcgcgcguccugcgc

SEQ ID NO: 2455644 - RNA, 20 nt, Bordetella pertussis
gcgcgcgucgccgcuggcca

SEQ ID NO: 2455645 - RNA, 21 nt, Bordetella pertussis
gcgcgcgucgccgcuggccag

SEQ ID NO: 2455646 - RNA, 18 nt, Bordetella pertussis
gcgcgcgugcagcgccgc

SEQ ID NO: 2455647 - RNA, 13 nt, Bordetella pertussis
gcgcgcgugcagg

SEQ ID NO: 2455648 - RNA, 14 nt, Bordetella pertussis
gcgcgcgugcaggg

SEQ ID NO: 2455649 - RNA, 21 nt, Bordetella pertussis
gcgcgcgugcagguaggacgg

SEQ ID NO: 2455650 - RNA, 13 nt, Bordetella pertussis
gcgcgcgugccgc

SEQ ID NO: 2455651 - RNA, 14 nt, Bordetella pertussis
gcgcgcgugcuggg

SEQ ID NO: 2455652 - RNA, 19 nt, Bordetella pertussis
gcgcgcguucaggucgccg

SEQ ID NO: 2455653 - RNA, 18 nt, Bordetella pertussis
gcgcgcuaagcacaagcg

SEQ ID NO: 2455654 - RNA, 19 nt, Bordetella pertussis
gcgcgcuaagcacaagcgc

SEQ ID NO: 2455655 - RNA, 15 nt, Bordetella pertussis
gcgcgcucaggccgc

SEQ ID NO: 2455656 - RNA, 16 nt, Bordetella pertussis
gcgcgcucaggccgcc

SEQ ID NO: 2455657 - RNA, 20 nt, Bordetella pertussis
gcgcgcucaggccgccggcg

SEQ ID NO: 2455658 - RNA, 21 nt, Bordetella pertussis
gcgcgcucaggccgccggcgc

SEQ ID NO: 2455659 - RNA, 14 nt, Bordetella pertussis
gcgcgcucaggggg

SEQ ID NO: 2455660 - RNA, 18 nt, Bordetella pertussis
gcgcgcucagggggcgcc

SEQ ID NO: 2455661 - RNA, 23 nt, Bordetella pertussis
gcgcgcucagggggcgccccaac

SEQ ID NO: 2455662 - RNA, 21 nt, Bordetella pertussis
gcgcgcucauggcgcaugacg

SEQ ID NO: 2455663 - RNA, 12 nt, Bordetella pertussis
gcgcgcuccagc

SEQ ID NO: 2455664 - RNA, 13 nt, Bordetella pertussis
gcgcgcuccagca

SEQ ID NO: 2455665 - RNA, 15 nt, Bordetella pertussis
gcgcgcucgcugccg

SEQ ID NO: 2455666 - RNA, 22 nt, Bordetella pertussis
gcgcgcucggagggcuccaggc

SEQ ID NO: 2455667 - RNA, 14 nt, Bordetella pertussis
gcgcgcucggccuc

SEQ ID NO: 2455668 - RNA, 16 nt, Bordetella pertussis
gcgcgcucggcgccgg

SEQ ID NO: 2455669 - RNA, 17 nt, Bordetella pertussis
gcgcgcucggcgccggg

SEQ ID NO: 2455670 - RNA, 18 nt, Bordetella pertussis
gcgcgcucggcgccgggc

SEQ ID NO: 2455671 - RNA, 22 nt, Bordetella pertussis
gcgcgguacgcaccgccgccgg

SEQ ID NO: 2455672 - RNA, 17 nt, Bordetella pertussis
gcgcgguagcgccccuc

SEQ ID NO: 2455673 - RNA, 18 nt, Bordetella pertussis
gcgcgguauggccgccca

SEQ ID NO: 2455674 - RNA, 21 nt, Bordetella pertussis
gcgcgguauggccgcccagca

SEQ ID NO: 2455675 - RNA, 20 nt, Bordetella pertussis
gcgcgguauucgcgcuggcg

SEQ ID NO: 2455676 - RNA, 23 nt, Bordetella pertussis
gcgcgguauugcgccaccccgcc

SEQ ID NO: 2455677 - RNA, 13 nt, Bordetella pertussis
gcgcgguccacgc

SEQ ID NO: 2455678 - RNA, 19 nt, Bordetella pertussis
gcgcgguccacgcccuggc

SEQ ID NO: 2455679 - RNA, 21 nt, Bordetella pertussis
gcgcgguccacgcccuggcug

SEQ ID NO: 2455680 - RNA, 22 nt, Bordetella pertussis
gcgcgguccacgcccuggcugg

SEQ ID NO: 2455681 - RNA, 18 nt, Bordetella pertussis
gcgcgguccagcaaggcg

SEQ ID NO: 2455682 - RNA, 23 nt, Bordetella pertussis
gcgcggugacguaaucgagcugg

SEQ ID NO: 2455683 - RNA, 20 nt, Bordetella pertussis
gcgcggugaggcggccgggc

SEQ ID NO: 2455684 - RNA, 16 nt, Bordetella pertussis
gcgcggugccgccugg

SEQ ID NO: 2455685 - RNA, 17 nt, Bordetella pertussis
gcgcggugccgccuggc

SEQ ID NO: 2455686 - RNA, 15 nt, Bordetella pertussis
gcgcggugcgcacca

SEQ ID NO: 2455687 - RNA, 18 nt, Bordetella pertussis
gcgcggugcgcaccaggc

SEQ ID NO: 2455688 - RNA, 22 nt, Bordetella pertussis
gcgcggugcgggugaccuuggu

SEQ ID NO: 2455689 - RNA, 21 nt, Bordetella pertussis
gcgcggugcgggugggcgcgc

SEQ ID NO: 2455690 - RNA, 22 nt, Bordetella pertussis
gcgcggugcgggugggcgcgcc

SEQ ID NO: 2455691 - RNA, 15 nt, Bordetella pertussis
gcgcgguggcacgac

SEQ ID NO: 2455692 - RNA, 14 nt, Bordetella pertussis
gcgcgguggccagc

SEQ ID NO: 2455693 - RNA, 20 nt, Bordetella pertussis
gcgcgguggccaugcugggc

SEQ ID NO: 2455694 - RNA, 13 nt, Bordetella pertussis
gcgcgguggccgc

SEQ ID NO: 2455695 - RNA, 23 nt, Bordetella pertussis
gcgcgguggccgccgcgcgccgc

SEQ ID NO: 2455696 - RNA, 14 nt, Bordetella pertussis
gcgcgguggccgcu

SEQ ID NO: 2455697 - RNA, 15 nt, Bordetella pertussis
gcgcgguggccgcuu

SEQ ID NO: 2455698 - RNA, 23 nt, Bordetella pertussis
gcgcgguggccgcuucggcggcc

SEQ ID NO: 2455699 - RNA, 15 nt, Bordetella pertussis
gcgcggugucgccgc

SEQ ID NO: 2455700 - RNA, 15 nt, Bordetella pertussis
gcgcgguucaucgcc

SEQ ID NO: 2455701 - RNA, 19 nt, Bordetella pertussis
gcgcgguugagcgccaggg

SEQ ID NO: 2455702 - RNA, 22 nt, Bordetella pertussis
gcgcguaauaguggucgccggc

SEQ ID NO: 2455703 - RNA, 15 nt, Bordetella pertussis
gcgcguacgcggcgc

SEQ ID NO: 2455704 - RNA, 17 nt, Bordetella pertussis
gcgcguacgcggcgcgg

SEQ ID NO: 2455705 - RNA, 14 nt, Bordetella pertussis
gcgcguacguggcg

SEQ ID NO: 2455706 - RNA, 15 nt, Bordetella pertussis
gcgcguacguggcgc

SEQ ID NO: 2455707 - RNA, 16 nt, Bordetella pertussis
gcgcguacguggcgcg

SEQ ID NO: 2455708 - RNA, 22 nt, Bordetella pertussis
gcgcguagcgauccgaugcccg

SEQ ID NO: 2455709 - RNA, 19 nt, Bordetella pertussis
gcgcguaggcgcgcgcauc

SEQ ID NO: 2455710 - RNA, 15 nt, Bordetella pertussis
gcgcguaucggcgcg

SEQ ID NO: 2455711 - RNA, 16 nt, Bordetella pertussis
gcgcguaucggcgcga

SEQ ID NO: 2455712 - RNA, 18 nt, Bordetella pertussis
gcgcguaucggcgcgagc

SEQ ID NO: 2455713 - RNA, 14 nt, Bordetella pertussis
gcgcguaugacgcg

SEQ ID NO: 2455714 - RNA, 18 nt, Bordetella pertussis
gcgcguaugcaccgggcc

SEQ ID NO: 2455715 - RNA, 19 nt, Bordetella pertussis
gcgcguaugcaccgggccg

SEQ ID NO: 2455716 - RNA, 14 nt, Bordetella pertussis
gcgcguauggcggc

SEQ ID NO: 2455717 - RNA, 20 nt, Bordetella pertussis
gcgcguauuccggguccagc

SEQ ID NO: 2455718 - RNA, 21 nt, Bordetella pertussis
gcgcguauuccggguccagcc

SEQ ID NO: 2455719 - RNA, 16 nt, Bordetella pertussis
gcgcgucacgcugaac

SEQ ID NO: 2455720 - RNA, 17 nt, Bordetella pertussis
gcgcgucaggccgggca

SEQ ID NO: 2455721 - RNA, 14 nt, Bordetella pertussis
gcgcgucaggcgag

SEQ ID NO: 2455722 - RNA, 17 nt, Bordetella pertussis
gcgcgucaggcgagcgc

SEQ ID NO: 2455723 - RNA, 13 nt, Bordetella pertussis
gcgcguccacgcc

SEQ ID NO: 2455724 - RNA, 15 nt, Bordetella pertussis
gcgcguccacgccgu

SEQ ID NO: 2455725 - RNA, 12 nt, Bordetella pertussis
gcgcguccaggc

SEQ ID NO: 2455726 - RNA, 13 nt, Bordetella pertussis
gcgcguccaggcc

SEQ ID NO: 2455727 - RNA, 14 nt, Bordetella pertussis
gcgcguccaggcca

SEQ ID NO: 2455728 - RNA, 16 nt, Bordetella pertussis
gcgcguccaggccaua

SEQ ID NO: 2455729 - RNA, 18 nt, Bordetella pertussis
gcgcguccaggcgguccu

SEQ ID NO: 2455730 - RNA, 19 nt, Bordetella pertussis
gcgcguccaggcgguccug

SEQ ID NO: 2455731 - RNA, 21 nt, Bordetella pertussis
gcgcguccaggcgguccuggu

SEQ ID NO: 2455732 - RNA, 19 nt, Bordetella pertussis
gcgcguccaggugcggcgg

SEQ ID NO: 2455733 - RNA, 21 nt, Bordetella pertussis
gcgcguccaggugcggcggcg

SEQ ID NO: 2455734 - RNA, 22 nt, Bordetella pertussis
gcgcguccaggugcggcggcga

SEQ ID NO: 2455735 - RNA, 14 nt, Bordetella pertussis
gcgcguccugccag

SEQ ID NO: 2455736 - RNA, 18 nt, Bordetella pertussis
gcgcguccugccaguugc

SEQ ID NO: 2455737 - RNA, 14 nt, Bordetella pertussis
gcgcguccugcgcc

SEQ ID NO: 2455738 - RNA, 15 nt, Bordetella pertussis
gcgcguccugcgcca

SEQ ID NO: 2455739 - RNA, 15 nt, Bordetella pertussis
gcgcguccuggcgcg

SEQ ID NO: 2455740 - RNA, 23 nt, Bordetella pertussis
gcgcguccugggccgagcgcgcc

SEQ ID NO: 2455741 - RNA, 13 nt, Bordetella pertussis
gcgcguccuuggc

SEQ ID NO: 2455742 - RNA, 14 nt, Bordetella pertussis
gcgcguccuuggcg

SEQ ID NO: 2455743 - RNA, 18 nt, Bordetella pertussis
gcgcguccuuggcggccu

SEQ ID NO: 2455744 - RNA, 19 nt, Bordetella pertussis
gcgcguccuuggcggccuu

SEQ ID NO: 2455745 - RNA, 15 nt, Bordetella pertussis
gcgcgucgacagcau

SEQ ID NO: 2455746 - RNA, 17 nt, Bordetella pertussis
gcgcgucgacgaagcgc

SEQ ID NO: 2455747 - RNA, 18 nt, Bordetella pertussis
gcgcgucgagcaggccgg

SEQ ID NO: 2455748 - RNA, 13 nt, Bordetella pertussis
gcgcgucgaugga

SEQ ID NO: 2455749 - RNA, 18 nt, Bordetella pertussis
gcgcgucgcacugggugg

SEQ ID NO: 2455750 - RNA, 11 nt, Bordetella pertussis
gcgcgucgccg

SEQ ID NO: 2455751 - RNA, 13 nt, Bordetella pertussis
gcgcgucgccgcc

SEQ ID NO: 2455752 - RNA, 14 nt, Bordetella pertussis
gcgcgucgccgcgc

SEQ ID NO: 2455753 - RNA, 15 nt, Bordetella pertussis
gcgcgucgccgcgcc

SEQ ID NO: 2455754 - RNA, 15 nt, Bordetella pertussis
gcgcgucgccgcugg

SEQ ID NO: 2455755 - RNA, 13 nt, Bordetella pertussis
gcgcgucgccggc

SEQ ID NO: 2455756 - RNA, 15 nt, Bordetella pertussis
gcgcgucgccggcga

SEQ ID NO: 2455757 - RNA, 17 nt, Bordetella pertussis
gcgcgucgccggcgaug

SEQ ID NO: 2455758 - RNA, 14 nt, Bordetella pertussis
gcgcgucgcgcggc

SEQ ID NO: 2455759 - RNA, 15 nt, Bordetella pertussis
gcgcgucgcgcggcg

SEQ ID NO: 2455760 - RNA, 20 nt, Bordetella pertussis
gcgcgucgcgcggcggcacc

SEQ ID NO: 2455761 - RNA, 17 nt, Bordetella pertussis
gcgcgucgcgguacagg

SEQ ID NO: 2455762 - RNA, 16 nt, Bordetella pertussis
gcgcgucgcguagcgc

SEQ ID NO: 2455763 - RNA, 20 nt, Bordetella pertussis
gcgcgucgcguagcgcggcc

SEQ ID NO: 2455764 - RNA, 14 nt, Bordetella pertussis
gcgcgucggccagc

SEQ ID NO: 2455765 - RNA, 15 nt, Bordetella pertussis
gcgcgucggccagcg

SEQ ID NO: 2455766 - RNA, 16 nt, Bordetella pertussis
gcgcgucggccagcgc

SEQ ID NO: 2455767 - RNA, 15 nt, Bordetella pertussis
gcgcgucggccaggc

SEQ ID NO: 2455768 - RNA, 20 nt, Bordetella pertussis
gcgcgucggccaggcgccag

SEQ ID NO: 2455769 - RNA, 13 nt, Bordetella pertussis
gcgcgucggcgcc

SEQ ID NO: 2455770 - RNA, 14 nt, Bordetella pertussis
gcgcgucggcgccg

SEQ ID NO: 2455771 - RNA, 15 nt, Bordetella pertussis
gcgcgucggcgccga

SEQ ID NO: 2455772 - RNA, 21 nt, Bordetella pertussis
gcgcgucggcgcgcgcgacuc

SEQ ID NO: 2455773 - RNA, 15 nt, Bordetella pertussis
gcgcgucggcgcggu

SEQ ID NO: 2455774 - RNA, 19 nt, Bordetella pertussis
gcgcgucggcgcggucggc

SEQ ID NO: 2455775 - RNA, 19 nt, Bordetella pertussis
gcgcgucguacuggugggc

SEQ ID NO: 2455776 - RNA, 14 nt, Bordetella pertussis
gcgcgucguccagc

SEQ ID NO: 2455777 - RNA, 18 nt, Bordetella pertussis
gcgcgucguccagcgugg

SEQ ID NO: 2455778 - RNA, 20 nt, Bordetella pertussis
gcgcgucguccagcguggcg

SEQ ID NO: 2455779 - RNA, 21 nt, Bordetella pertussis
gcgcgucguccagcguggcgc

SEQ ID NO: 2455780 - RNA, 16 nt, Bordetella pertussis
gcgcgucgugcccgcc

SEQ ID NO: 2455781 - RNA, 17 nt, Bordetella pertussis
gcgcgucgugcccgcca

SEQ ID NO: 2455782 - RNA, 13 nt, Bordetella pertussis
gcgcgucuccagc

SEQ ID NO: 2455783 - RNA, 20 nt, Bordetella pertussis
gcgcgucuccagcgccggca

SEQ ID NO: 2455784 - RNA, 19 nt, Bordetella pertussis
gcgcgucuucaguugacgc

SEQ ID NO: 2455785 - RNA, 15 nt, Bordetella pertussis
gcgcgugcagccagc

SEQ ID NO: 2455786 - RNA, 24 nt, Bordetella pertussis
gcgcggaccugcucgagcggcgga

SEQ ID NO: 2455787 - RNA, 14 nt, Bordetella pertussis
gcgcggacugccag

SEQ ID NO: 2455788 - RNA, 14 nt, Bordetella pertussis
gcgcggacuucgcu

SEQ ID NO: 2455789 - RNA, 20 nt, Bordetella pertussis
gcgcggauauucgucggccg

SEQ ID NO: 2455790 - RNA, 21 nt, Bordetella pertussis
gcgcggauauucgucggccgc

SEQ ID NO: 2455791 - RNA, 21 nt, Bordetella pertussis
gcgcggaucaugggcucgcgc

SEQ ID NO: 2455792 - RNA, 18 nt, Bordetella pertussis
gcgcggauccagccaugg

SEQ ID NO: 2455793 - RNA, 20 nt, Bordetella pertussis
gcgcggaucgaaaccggcgc

SEQ ID NO: 2455794 - RNA, 22 nt, Bordetella pertussis
gcgcggaucgaaaccggcgcgc

SEQ ID NO: 2455795 - RNA, 13 nt, Bordetella pertussis
gcgcggaucggcc

SEQ ID NO: 2455796 - RNA, 16 nt, Bordetella pertussis
gcgcggaugaccugcg

SEQ ID NO: 2455797 - RNA, 17 nt, Bordetella pertussis
gcgcggaugaccugcgc

SEQ ID NO: 2455798 - RNA, 23 nt, Bordetella pertussis
gcgcggaugaccugcgccaggug

SEQ ID NO: 2455799 - RNA, 15 nt, Bordetella pertussis
gcgcggaugaucgcg

SEQ ID NO: 2455800 - RNA, 19 nt, Bordetella pertussis
gcgcggaugaucgcgcagc

SEQ ID NO: 2455801 - RNA, 20 nt, Bordetella pertussis
gcgcggaugccguccacgcc

SEQ ID NO: 2455802 - RNA, 20 nt, Bordetella pertussis
gcgcggauugaugucgcgca

SEQ ID NO: 2455803 - RNA, 23 nt, Bordetella pertussis
gcgcggauugaugucgcgcaccg

SEQ ID NO: 2455804 - RNA, 24 nt, Bordetella pertussis
gcgcggauugaugucgcgcaccgc

SEQ ID NO: 2455805 - RNA, 23 nt, Bordetella pertussis
gcgcggauuucgcgaugcucgau

SEQ ID NO: 2455806 - RNA, 18 nt, Bordetella pertussis
gcgcggcaaaaugccgcg

SEQ ID NO: 2455807 - RNA, 16 nt, Bordetella pertussis
gcgcggcacgcugcug

SEQ ID NO: 2455808 - RNA, 13 nt, Bordetella pertussis
gcgcggcagccug

SEQ ID NO: 2455809 - RNA, 14 nt, Bordetella pertussis
gcgcggcagccugg

SEQ ID NO: 2455810 - RNA, 17 nt, Bordetella pertussis
gcgcggcagcgccgggu

SEQ ID NO: 2455811 - RNA, 17 nt, Bordetella pertussis
gcgcggcagggcgucgg

SEQ ID NO: 2455812 - RNA, 22 nt, Bordetella pertussis
gcgcggcagggcgucggccgcg

SEQ ID NO: 2455813 - RNA, 20 nt, Bordetella pertussis
gcgcggcagguucugcgcgu

SEQ ID NO: 2455814 - RNA, 16 nt, Bordetella pertussis
gcgcggcagugggcgg

SEQ ID NO: 2455815 - RNA, 19 nt, Bordetella pertussis
gcgcggcagugggcgguga

SEQ ID NO: 2455816 - RNA, 23 nt, Bordetella pertussis
gcgcggcagugggcggugaccau

SEQ ID NO: 2455817 - RNA, 22 nt, Bordetella pertussis
gcgcggcauacgccgauggcgc

SEQ ID NO: 2455818 - RNA, 18 nt, Bordetella pertussis
gcgcggcauagcccaggc

SEQ ID NO: 2455819 - RNA, 22 nt, Bordetella pertussis
gcgcggcaucgagaaaccagcc

SEQ ID NO: 2455820 - RNA, 14 nt, Bordetella pertussis
gcgcggcaucggcc

SEQ ID NO: 2455821 - RNA, 14 nt, Bordetella pertussis
gcgcggcaugccgc

SEQ ID NO: 2455822 - RNA, 14 nt, Bordetella pertussis
gcgcggcaugcgca

SEQ ID NO: 2455823 - RNA, 19 nt, Bordetella pertussis
gcgcggcaugcgcaugcug

SEQ ID NO: 2455824 - RNA, 15 nt, Bordetella pertussis
gcgcggcauggcgcc

SEQ ID NO: 2455825 - RNA, 14 nt, Bordetella pertussis
gcgcggcaugggca

SEQ ID NO: 2455826 - RNA, 14 nt, Bordetella pertussis
gcgcggccaacccc

SEQ ID NO: 2455827 - RNA, 23 nt, Bordetella pertussis
gcgcggccaaccccgagggcgcg

SEQ ID NO: 2455828 - RNA, 16 nt, Bordetella pertussis
gcgcggccacccugcc

SEQ ID NO: 2455829 - RNA, 17 nt, Bordetella pertussis
gcgcggccacccugccg

SEQ ID NO: 2455830 - RNA, 13 nt, Bordetella pertussis
gcgcggccacggc

SEQ ID NO: 2455831 - RNA, 16 nt, Bordetella pertussis
gcgcggccacggccug

SEQ ID NO: 2455832 - RNA, 20 nt, Bordetella pertussis
gcgcggccacggccugcccg

SEQ ID NO: 2455833 - RNA, 12 nt, Bordetella pertussis
gcgcggccagca

SEQ ID NO: 2455834 - RNA, 13 nt, Bordetella pertussis
gcgcggccagcac

SEQ ID NO: 2455835 - RNA, 20 nt, Bordetella pertussis
gcgcggccagcaccggcccg

SEQ ID NO: 2455836 - RNA, 14 nt, Bordetella pertussis
gcgcggccagcacg

SEQ ID NO: 2455837 - RNA, 14 nt, Bordetella pertussis
gcgcggccagcagc

SEQ ID NO: 2455838 - RNA, 15 nt, Bordetella pertussis
gcgcggccagcagcg

SEQ ID NO: 2455839 - RNA, 13 nt, Bordetella pertussis
gcgcggccagcgc

SEQ ID NO: 2455840 - RNA, 17 nt, Bordetella pertussis
gcgcggccagcgccggc

SEQ ID NO: 2455841 - RNA, 18 nt, Bordetella pertussis
gcgcggccagcgccggcg

SEQ ID NO: 2455842 - RNA, 15 nt, Bordetella pertussis
gcgcggccagcgcgu

SEQ ID NO: 2455843 - RNA, 11 nt, Bordetella pertussis
gcgcggccagg

SEQ ID NO: 2455844 - RNA, 14 nt, Bordetella pertussis
gcgcggccaggcgc

SEQ ID NO: 2455845 - RNA, 15 nt, Bordetella pertussis
gcgcggccaggcgcg

SEQ ID NO: 2455846 - RNA, 17 nt, Bordetella pertussis
gcgcggccaggcgcuca

SEQ ID NO: 2455847 - RNA, 12 nt, Bordetella pertussis
gcgcggccaggg

SEQ ID NO: 2455848 - RNA, 12 nt, Bordetella pertussis
gcgcggcccgcc

SEQ ID NO: 2455849 - RNA, 13 nt, Bordetella pertussis
gcgcggcccggcc

SEQ ID NO: 2455850 - RNA, 14 nt, Bordetella pertussis
gcgcggcccggccg

SEQ ID NO: 2455851 - RNA, 17 nt, Bordetella pertussis
gcgcggcccgugccacg

SEQ ID NO: 2455852 - RNA, 13 nt, Bordetella pertussis
gcgcggccgacgu

SEQ ID NO: 2455853 - RNA, 13 nt, Bordetella pertussis
gcgcggccgagcg

SEQ ID NO: 2455854 - RNA, 16 nt, Bordetella pertussis
gcgcggccgagcgggc

SEQ ID NO: 2455855 - RNA, 17 nt, Bordetella pertussis
gcgcggccgagcgggcc

SEQ ID NO: 2455856 - RNA, 20 nt, Bordetella pertussis
gcgcggccgagcgggccagc

SEQ ID NO: 2455857 - RNA, 22 nt, Bordetella pertussis
gcgcggccgagcgggccagcgc

SEQ ID NO: 2455858 - RNA, 23 nt, Bordetella pertussis
gcgcggccgaggucggcggucca

SEQ ID NO: 2455859 - RNA, 14 nt, Bordetella pertussis
gcgcggccgccgcc

SEQ ID NO: 2455860 - RNA, 21 nt, Bordetella pertussis
gcgcggccgccggcggcgccg

SEQ ID NO: 2455861 - RNA, 12 nt, Bordetella pertussis
gcgcggccgcuu

SEQ ID NO: 2455862 - RNA, 19 nt, Bordetella pertussis
gcgcggccggaggccgccc

SEQ ID NO: 2455863 - RNA, 15 nt, Bordetella pertussis
gcgcggccggcacca

SEQ ID NO: 2455864 - RNA, 17 nt, Bordetella pertussis
gcgcggccggcaccagg

SEQ ID NO: 2455865 - RNA, 22 nt, Bordetella pertussis
gcgcggccggccgcgcccaugc

SEQ ID NO: 2455866 - RNA, 12 nt, Bordetella pertussis
gcgcggccggcg

SEQ ID NO: 2455867 - RNA, 13 nt, Bordetella pertussis
gcgcggccggcgc

SEQ ID NO: 2455868 - RNA, 15 nt, Bordetella pertussis
gcgcggccggcgcgc

SEQ ID NO: 2455869 - RNA, 16 nt, Bordetella pertussis
gcgcggccggcgcgcc

SEQ ID NO: 2455870 - RNA, 13 nt, Bordetella pertussis
gcgcggccgggcu

SEQ ID NO: 2455871 - RNA, 22 nt, Bordetella pertussis
gcgcggccgggcucaggcugcg

SEQ ID NO: 2455872 - RNA, 12 nt, Bordetella pertussis
gcgcggccggug

SEQ ID NO: 2455873 - RNA, 18 nt, Bordetella pertussis
gcgcggccgucaccgccg

SEQ ID NO: 2455874 - RNA, 15 nt, Bordetella pertussis
gcgcggccgucaggc

SEQ ID NO: 2455875 - RNA, 16 nt, Bordetella pertussis
gcgcggccgucaggcg

SEQ ID NO: 2455876 - RNA, 21 nt, Bordetella pertussis
gcgcggccguguucgagcagg

SEQ ID NO: 2455877 - RNA, 22 nt, Bordetella pertussis
gcgcggccuauuuggcggccug

SEQ ID NO: 2455878 - RNA, 14 nt, Bordetella pertussis
gcgcggccucgccg

SEQ ID NO: 2455879 - RNA, 15 nt, Bordetella pertussis
gcgcggccucgccgg

SEQ ID NO: 2455880 - RNA, 16 nt, Bordetella pertussis
gcgcggccucgccggc

SEQ ID NO: 2455881 - RNA, 21 nt, Bordetella pertussis
gcgcggccucgccggccuggc

SEQ ID NO: 2455882 - RNA, 13 nt, Bordetella pertussis
gcgcggccuggcg

SEQ ID NO: 2455883 - RNA, 14 nt, Bordetella pertussis
gcgcggccuggcgg

SEQ ID NO: 2455884 - RNA, 13 nt, Bordetella pertussis
gcgcggccugggc

SEQ ID NO: 2455885 - RNA, 18 nt, Bordetella pertussis
gcgcggccugggcggcgc

SEQ ID NO: 2455886 - RNA, 20 nt, Bordetella pertussis
gcgcggcgaaggcgcggcug

SEQ ID NO: 2455887 - RNA, 16 nt, Bordetella pertussis
gcgcggcgacaccccc

SEQ ID NO: 2455888 - RNA, 17 nt, Bordetella pertussis
gcgcggcgagcacggcc

SEQ ID NO: 2455889 - RNA, 20 nt, Bordetella pertussis
gcgcggcgagcacggccugc

SEQ ID NO: 2455890 - RNA, 21 nt, Bordetella pertussis
gcgcggcgagcacggccugcu

SEQ ID NO: 2455891 - RNA, 23 nt, Bordetella pertussis
gcgcggcgagcacggccugcucg

SEQ ID NO: 2455892 - RNA, 14 nt, Bordetella pertussis
gcgcggcgagccgc

SEQ ID NO: 2455893 - RNA, 16 nt, Bordetella pertussis
gcgcggcgagccgcgc

SEQ ID NO: 2455894 - RNA, 13 nt, Bordetella pertussis
gcgcggcgagcgc

SEQ ID NO: 2455895 - RNA, 14 nt, Bordetella pertussis
gcgcggcgagcgcc

SEQ ID NO: 2455896 - RNA, 20 nt, Bordetella pertussis
gcgcggcgagcgccgccagg

SEQ ID NO: 2455897 - RNA, 16 nt, Bordetella pertussis
gcgcggcgaggcgucc

SEQ ID NO: 2455898 - RNA, 17 nt, Bordetella pertussis
gcgcggcgaggcgucca

SEQ ID NO: 2455899 - RNA, 20 nt, Bordetella pertussis
gcgcggcgauacgcgccgcc

SEQ ID NO: 2455900 - RNA, 17 nt, Bordetella pertussis
gcgcggcgaucggcccg

SEQ ID NO: 2455901 - RNA, 14 nt, Bordetella pertussis
gcgcggcgcacagg

SEQ ID NO: 2455902 - RNA, 16 nt, Bordetella pertussis
gcgcgugcagccagcg

SEQ ID NO: 2455903 - RNA, 19 nt, Bordetella pertussis
gcgcgugcagccagcggcc

SEQ ID NO: 2455904 - RNA, 21 nt, Bordetella pertussis
gcgcgugcagccagcggccga

SEQ ID NO: 2455905 - RNA, 17 nt, Bordetella pertussis
gcgcgugcagcgccgcg

SEQ ID NO: 2455906 - RNA, 18 nt, Bordetella pertussis
gcgcgugcagcgccgcgc

SEQ ID NO: 2455907 - RNA, 14 nt, Bordetella pertussis
gcgcgugcaggccg

SEQ ID NO: 2455908 - RNA, 16 nt, Bordetella pertussis
gcgcgugcaggccgcg

SEQ ID NO: 2455909 - RNA, 13 nt, Bordetella pertussis
gcgcgugcagggu

SEQ ID NO: 2455910 - RNA, 13 nt, Bordetella pertussis
gcgcgugccagca

SEQ ID NO: 2455911 - RNA, 14 nt, Bordetella pertussis
gcgcgugccagcag

SEQ ID NO: 2455912 - RNA, 15 nt, Bordetella pertussis
gcgcgugccagcagg

SEQ ID NO: 2455913 - RNA, 20 nt, Bordetella pertussis
gcgcgugccagcaggucgcg

SEQ ID NO: 2455914 - RNA, 15 nt, Bordetella pertussis
gcgcgugccgcaggc

SEQ ID NO: 2455915 - RNA, 16 nt, Bordetella pertussis
gcgcgugccgcaggcc

SEQ ID NO: 2455916 - RNA, 18 nt, Bordetella pertussis
gcgcgugccgcaggccag

SEQ ID NO: 2455917 - RNA, 22 nt, Bordetella pertussis
gcgcgugccgcaggccagcccg

SEQ ID NO: 2455918 - RNA, 14 nt, Bordetella pertussis
gcgcgugccgcgca

SEQ ID NO: 2455919 - RNA, 13 nt, Bordetella pertussis
gcgcgugcgcagg

SEQ ID NO: 2455920 - RNA, 15 nt, Bordetella pertussis
gcgcgugcgcaggcg

SEQ ID NO: 2455921 - RNA, 16 nt, Bordetella pertussis
gcgcgugcgcaggcgc

SEQ ID NO: 2455922 - RNA, 17 nt, Bordetella pertussis
gcgcgugcgcaggcgcg

SEQ ID NO: 2455923 - RNA, 13 nt, Bordetella pertussis
gcgcgugcgcgcg

SEQ ID NO: 2455924 - RNA, 16 nt, Bordetella pertussis
gcgcgugcgcgcgcca

SEQ ID NO: 2455925 - RNA, 18 nt, Bordetella pertussis
gcgcgugcgcgcgccaug

SEQ ID NO: 2455926 - RNA, 13 nt, Bordetella pertussis
gcgcgugcggaug

SEQ ID NO: 2455927 - RNA, 22 nt, Bordetella pertussis
gcgcgugcguauucgguggcgc

SEQ ID NO: 2455928 - RNA, 14 nt, Bordetella pertussis
gcgcgugcugacgg

SEQ ID NO: 2455929 - RNA, 13 nt, Bordetella pertussis
gcgcgugcuggcg

SEQ ID NO: 2455930 - RNA, 21 nt, Bordetella pertussis
gcgcgugcuggcgcagcagcg

SEQ ID NO: 2455931 - RNA, 13 nt, Bordetella pertussis
gcgcgugcugggc

SEQ ID NO: 2455932 - RNA, 14 nt, Bordetella pertussis
gcgcguggccagca

SEQ ID NO: 2455933 - RNA, 12 nt, Bordetella pertussis
gcgcguggccau

SEQ ID NO: 2455934 - RNA, 19 nt, Bordetella pertussis
gcgcguggccaucaacgug

SEQ ID NO: 2455935 - RNA, 22 nt, Bordetella pertussis
gcgcguggccaucaacguggcg

SEQ ID NO: 2455936 - RNA, 15 nt, Bordetella pertussis
gcgcguggcccgcgc

SEQ ID NO: 2455937 - RNA, 11 nt, Bordetella pertussis
gcgcguggccg

SEQ ID NO: 2455938 - RNA, 18 nt, Bordetella pertussis
gcgcguggccgccacgcc

SEQ ID NO: 2455939 - RNA, 14 nt, Bordetella pertussis
gcgcguggccggcg

SEQ ID NO: 2455940 - RNA, 20 nt, Bordetella pertussis
gcgcguggccggcgacggca

SEQ ID NO: 2455941 - RNA, 14 nt, Bordetella pertussis
gcgcguggcgccca

SEQ ID NO: 2455942 - RNA, 12 nt, Bordetella pertussis
gcgcgugggcac

SEQ ID NO: 2455943 - RNA, 20 nt, Bordetella pertussis
gcgcgugggcacccggccgc

SEQ ID NO: 2455944 - RNA, 21 nt, Bordetella pertussis
gcgcgugggcacccggccgcu

SEQ ID NO: 2455945 - RNA, 20 nt, Bordetella pertussis
gcgcgugggcaggugcuugg

SEQ ID NO: 2455946 - RNA, 21 nt, Bordetella pertussis
gcgcgugggccagcaacuggu

SEQ ID NO: 2455947 - RNA, 19 nt, Bordetella pertussis
gcgcgugucccagccggcg

SEQ ID NO: 2455948 - RNA, 21 nt, Bordetella pertussis
gcgcgugugguuggcgcugcu

SEQ ID NO: 2455949 - RNA, 19 nt, Bordetella pertussis
gcgcguucagcagcaggcc

SEQ ID NO: 2455950 - RNA, 22 nt, Bordetella pertussis
gcgcguucagggcgccgcggcg

SEQ ID NO: 2455951 - RNA, 15 nt, Bordetella pertussis
gcgcguucaggucgc

SEQ ID NO: 2455952 - RNA, 17 nt, Bordetella pertussis
gcgcguucaggucgccg

SEQ ID NO: 2455953 - RNA, 21 nt, Bordetella pertussis
gcgcguucaggucgccguucu

SEQ ID NO: 2455954 - RNA, 15 nt, Bordetella pertussis
gcgcguuccggccgc

SEQ ID NO: 2455955 - RNA, 22 nt, Bordetella pertussis
gcgcguuccggccgcgccagcc

SEQ ID NO: 2455956 - RNA, 16 nt, Bordetella pertussis
gcgcguucgccgcagc

SEQ ID NO: 2455957 - RNA, 19 nt, Bordetella pertussis
gcgcguucgccgcagccgu

SEQ ID NO: 2455958 - RNA, 22 nt, Bordetella pertussis
gcgcguucucagccgcccgccg

SEQ ID NO: 2455959 - RNA, 18 nt, Bordetella pertussis
gcgcguugagcagcaugu

SEQ ID NO: 2455960 - RNA, 20 nt, Bordetella pertussis
gcgcguugaucaucggcccg

SEQ ID NO: 2455961 - RNA, 22 nt, Bordetella pertussis
gcgcguugaucaucggcccgau

SEQ ID NO: 2455962 - RNA, 16 nt, Bordetella pertussis
gcgcguugccggugcg

SEQ ID NO: 2455963 - RNA, 15 nt, Bordetella pertussis
gcgcguugcgcaucg

SEQ ID NO: 2455964 - RNA, 21 nt, Bordetella pertussis
gcgcguugcgcaucgcgcacc

SEQ ID NO: 2455965 - RNA, 16 nt, Bordetella pertussis
gcgcguugcgcuugcg

SEQ ID NO: 2455966 - RNA, 14 nt, Bordetella pertussis
gcgcguuggccuga

SEQ ID NO: 2455967 - RNA, 15 nt, Bordetella pertussis
gcgcguuucggucag

SEQ ID NO: 2455968 - RNA, 18 nt, Bordetella pertussis
gcgcguuuucgcuggcgg

SEQ ID NO: 2455969 - RNA, 19 nt, Bordetella pertussis
gcgcguuuucgcuggcgga

SEQ ID NO: 2455970 - RNA, 22 nt, Bordetella pertussis
gcgcuacagcguggugggccac

SEQ ID NO: 2455971 - RNA, 15 nt, Bordetella pertussis
gcgcuacagggugcc

SEQ ID NO: 2455972 - RNA, 18 nt, Bordetella pertussis
gcgcuacagggugccgcg

SEQ ID NO: 2455973 - RNA, 22 nt, Bordetella pertussis
gcgcuacagggugccgcgccgg

SEQ ID NO: 2455974 - RNA, 23 nt, Bordetella pertussis
gcgcuacgacgagaucgcgccua

SEQ ID NO: 2455975 - RNA, 14 nt, Bordetella pertussis
gcgcuacgccgccg

SEQ ID NO: 2455976 - RNA, 13 nt, Bordetella pertussis
gcgcuaugggggc

SEQ ID NO: 2455977 - RNA, 15 nt, Bordetella pertussis
gcgcuaugggggcga

SEQ ID NO: 2455978 - RNA, 16 nt, Bordetella pertussis
gcgcuaugggggcgag

SEQ ID NO: 2455979 - RNA, 22 nt, Bordetella pertussis
gcgcucacagggucaaggcgcg

SEQ ID NO: 2455980 - RNA, 15 nt, Bordetella pertussis
gcgcucagcaccagg

SEQ ID NO: 2455981 - RNA, 19 nt, Bordetella pertussis
gcgcucagcaccaggccgc

SEQ ID NO: 2455982 - RNA, 20 nt, Bordetella pertussis
gcgcucagcaccaggccgcc

SEQ ID NO: 2455983 - RNA, 17 nt, Bordetella pertussis
gcgcucagccuugucgc

SEQ ID NO: 2455984 - RNA, 20 nt, Bordetella pertussis
gcgcucagcgacgcgcgccg

SEQ ID NO: 2455985 - RNA, 22 nt, Bordetella pertussis
gcgcucagcgacgcgcgccggc

SEQ ID NO: 2455986 - RNA, 14 nt, Bordetella pertussis
gcgcucagcgccau

SEQ ID NO: 2455987 - RNA, 19 nt, Bordetella pertussis
gcgcucagcgcgccgagga

SEQ ID NO: 2455988 - RNA, 19 nt, Bordetella pertussis
gcgcucaggaaccagcggc

SEQ ID NO: 2455989 - RNA, 22 nt, Bordetella pertussis
gcgcucaggaaccagcggcugg

SEQ ID NO: 2455990 - RNA, 23 nt, Bordetella pertussis
gcgcucaggaaccagcggcuggc

SEQ ID NO: 2455991 - RNA, 14 nt, Bordetella pertussis
gcgcucaggccgcc

SEQ ID NO: 2455992 - RNA, 18 nt, Bordetella pertussis
gcgcucaggccgccggcg

SEQ ID NO: 2455993 - RNA, 21 nt, Bordetella pertussis
gcgcucaggccgccggcgcgg

SEQ ID NO: 2455994 - RNA, 14 nt, Bordetella pertussis
gcgcucaggcggug

SEQ ID NO: 2455995 - RNA, 15 nt, Bordetella pertussis
gcgcucagggggcgc

SEQ ID NO: 2455996 - RNA, 17 nt, Bordetella pertussis
gcgcucagggggcgccc

SEQ ID NO: 2455997 - RNA, 21 nt, Bordetella pertussis
gcgcucagggggcgccccaac

SEQ ID NO: 2455998 - RNA, 13 nt, Bordetella pertussis
gcgcucaucaucg

SEQ ID NO: 2455999 - RNA, 15 nt, Bordetella pertussis
gcgcucaucaucgcg

SEQ ID NO: 2456000 - RNA, 16 nt, Bordetella pertussis
gcgcucaucaucgcgc

SEQ ID NO: 2456001 - RNA, 22 nt, Bordetella pertussis
gcgcucaucaucgcgcuggcgc

SEQ ID NO: 2456002 - RNA, 17 nt, Bordetella pertussis
gcgcucauggcgcauga

SEQ ID NO: 2456003 - RNA, 20 nt, Bordetella pertussis
gcgcucauggcgcaugacga

SEQ ID NO: 2456004 - RNA, 11 nt, Bordetella pertussis
gcgcuccagca

SEQ ID NO: 2456005 - RNA, 19 nt, Bordetella pertussis
gcgcuccagcaccugcacc

SEQ ID NO: 2456006 - RNA, 22 nt, Bordetella pertussis
gcgcuccagcaccugcaccgaa

SEQ ID NO: 2456007 - RNA, 21 nt, Bordetella pertussis
gcgcuccagcaugucguggcg

SEQ ID NO: 2456008 - RNA, 13 nt, Bordetella pertussis
gcgcuccagcccu

SEQ ID NO: 2456009 - RNA, 23 nt, Bordetella pertussis
gcgcuccagcgucauggccuggc

SEQ ID NO: 2456010 - RNA, 21 nt, Bordetella pertussis
gcgcuccagggcgucggcgac

SEQ ID NO: 2456011 - RNA, 21 nt, Bordetella pertussis
gcgcuccaugaucucgggcga

SEQ ID NO: 2456012 - RNA, 22 nt, Bordetella pertussis
gcgcuccaugaucucgggcgag

SEQ ID NO: 2456013 - RNA, 14 nt, Bordetella pertussis
gcgcuccauggcgc

SEQ ID NO: 2456014 - RNA, 15 nt, Bordetella pertussis
gcgcuccauggcgcc

SEQ ID NO: 2456015 - RNA, 16 nt, Bordetella pertussis
gcgcuccauggcgccg

SEQ ID NO: 2456016 - RNA, 22 nt, Bordetella pertussis
gcgcuccauggcgccggcggcc

SEQ ID NO: 2456017 - RNA, 14 nt, Bordetella pertussis
gcgcucccgccaac

SEQ ID NO: 2456018 - RNA, 15 nt, Bordetella pertussis
gcgcucccgccaaca

SEQ ID NO: 2456019 - RNA, 19 nt, Bordetella pertussis
gcgcuccggcugcgcgcgc

SEQ ID NO: 2456020 - RNA, 20 nt, Bordetella pertussis
gcgcuccggcugcgcgcgca

SEQ ID NO: 2456021 - RNA, 21 nt, Bordetella pertussis
gcgcuccggcugcgcgcgcag

SEQ ID NO: 2456022 - RNA, 13 nt, Bordetella pertussis
gcgcuccugcucg

SEQ ID NO: 2456023 - RNA, 22 nt, Bordetella pertussis
gcgcuccuucgugguggcgaaa

SEQ ID NO: 2456024 - RNA, 14 nt, Bordetella pertussis
gcgcucgaaaaagc

SEQ ID NO: 2456025 - RNA, 22 nt, Bordetella pertussis
gcgcucgaaaaagcccugcgug

SEQ ID NO: 2456026 - RNA, 17 nt, Bordetella pertussis
gcgcucgaaggcgccga

SEQ ID NO: 2456027 - RNA, 19 nt, Bordetella pertussis
gcgcucgaaggcgccgacg

SEQ ID NO: 2456028 - RNA, 20 nt, Bordetella pertussis
gcgcucgaaggcgccgacgg

SEQ ID NO: 2456029 - RNA, 20 nt, Bordetella pertussis
gcgcucgaauggcugcgcgc

SEQ ID NO: 2456030 - RNA, 22 nt, Bordetella pertussis
gcgcucgaauggcugcgcgccg

SEQ ID NO: 2456031 - RNA, 18 nt, Bordetella pertussis
gcgcucgagcgccugcag

SEQ ID NO: 2456032 - RNA, 16 nt, Bordetella pertussis
gcgcucgagcgcggcg

SEQ ID NO: 2456033 - RNA, 17 nt, Bordetella pertussis
gcgcucgagcgcggcgc

SEQ ID NO: 2456034 - RNA, 18 nt, Bordetella pertussis
gcgcucgagcgcggcgcg

SEQ ID NO: 2456035 - RNA, 16 nt, Bordetella pertussis
gcgcucgaggcgcugg

SEQ ID NO: 2456036 - RNA, 17 nt, Bordetella pertussis
gcgcucgaggcgcuggc

SEQ ID NO: 2456037 - RNA, 18 nt, Bordetella pertussis
gcgcucgaggcgcuggcg

SEQ ID NO: 2456038 - RNA, 22 nt, Bordetella pertussis
gcgcucgaucaagggguggcug

SEQ ID NO: 2456039 - RNA, 13 nt, Bordetella pertussis
gcgcucgcacggc

SEQ ID NO: 2456040 - RNA, 18 nt, Bordetella pertussis
gcgcucgcccagcaccuc

SEQ ID NO: 2456041 - RNA, 14 nt, Bordetella pertussis
gcgcucgcccagcc

SEQ ID NO: 2456042 - RNA, 13 nt, Bordetella pertussis
gcgcucgccccgg

SEQ ID NO: 2456043 - RNA, 14 nt, Bordetella pertussis
gcgcucgccccggc

SEQ ID NO: 2456044 - RNA, 18 nt, Bordetella pertussis
gcgcucgccccggcgcgc

SEQ ID NO: 2456045 - RNA, 19 nt, Bordetella pertussis
gcgcucgccccggcgcgca

SEQ ID NO: 2456046 - RNA, 21 nt, Bordetella pertussis
gcgcucgccccggcgcgcagc

SEQ ID NO: 2456047 - RNA, 12 nt, Bordetella pertussis
gcgcucgcccgg

SEQ ID NO: 2456048 - RNA, 13 nt, Bordetella pertussis
gcgcucgcccggc

SEQ ID NO: 2456049 - RNA, 14 nt, Bordetella pertussis
gcgcucgcccggcc

SEQ ID NO: 2456050 - RNA, 12 nt, Bordetella pertussis
gcgcucgcccuc

SEQ ID NO: 2456051 - RNA, 12 nt, Bordetella pertussis
gcgcucgccggc

SEQ ID NO: 2456052 - RNA, 18 nt, Bordetella pertussis
gcgcucgccggcgcgcag

SEQ ID NO: 2456053 - RNA, 20 nt, Bordetella pertussis
gcgcucgccggcgcgcaggc

SEQ ID NO: 2456054 - RNA, 20 nt, Bordetella pertussis
gcgcucgccgucgacgccga

SEQ ID NO: 2456055 - RNA, 15 nt, Bordetella pertussis
gcgcucgcgcaccgc

SEQ ID NO: 2456056 - RNA, 13 nt, Bordetella pertussis
cgacccugcccgg

SEQ ID NO: 2456057 - RNA, 15 nt, Bordetella pertussis
cgacccugcccggca

SEQ ID NO: 2456058 - RNA, 18 nt, Bordetella pertussis
cgacccuguacaagcgca

SEQ ID NO: 2456059 - RNA, 21 nt, Bordetella pertussis
cgacccuuucauuucggcgcc

SEQ ID NO: 2456060 - RNA, 22 nt, Bordetella pertussis
cgacccuuucauuucggcgccg

SEQ ID NO: 2456061 - RNA, 18 nt, Bordetella pertussis
cgaccgaaccgauccagc

SEQ ID NO: 2456062 - RNA, 20 nt, Bordetella pertussis
cgaccgacagcacauggcgc

SEQ ID NO: 2456063 - RNA, 14 nt, Bordetella pertussis
cgaccgagccggcc

SEQ ID NO: 2456064 - RNA, 16 nt, Bordetella pertussis
cgaccgagccggccag

SEQ ID NO: 2456065 - RNA, 17 nt, Bordetella pertussis
cgaccgagccggccagc

SEQ ID NO: 2456066 - RNA, 18 nt, Bordetella pertussis
cgaccgauucgcgcaccg

SEQ ID NO: 2456067 - RNA, 13 nt, Bordetella pertussis
cgaccgcacgaug

SEQ ID NO: 2456068 - RNA, 18 nt, Bordetella pertussis
cgaccgcacgauggcgcg

SEQ ID NO: 2456069 - RNA, 22 nt, Bordetella pertussis
cgaccgcaggggauugccgcgc

SEQ ID NO: 2456070 - RNA, 21 nt, Bordetella pertussis
cgaccgcauagcgcaugaugc

SEQ ID NO: 2456071 - RNA, 13 nt, Bordetella pertussis
cgaccgcaugcgg

SEQ ID NO: 2456072 - RNA, 14 nt, Bordetella pertussis
cgaccgcaugcggc

SEQ ID NO: 2456073 - RNA, 16 nt, Bordetella pertussis
cgaccgcaugcggcac

SEQ ID NO: 2456074 - RNA, 15 nt, Bordetella pertussis
cgaccgcaugggcgc

SEQ ID NO: 2456075 - RNA, 14 nt, Bordetella pertussis
cgaccgccagcagg

SEQ ID NO: 2456076 - RNA, 17 nt, Bordetella pertussis
cgaccgccagcaggccc

SEQ ID NO: 2456077 - RNA, 14 nt, Bordetella pertussis
cgaccgccgccacg

SEQ ID NO: 2456078 - RNA, 20 nt, Bordetella pertussis
cgaccgccgccuuggacgcg

SEQ ID NO: 2456079 - RNA, 13 nt, Bordetella pertussis
cgaccgccgcggg

SEQ ID NO: 2456080 - RNA, 14 nt, Bordetella pertussis
cgaccgccggccgg

SEQ ID NO: 2456081 - RNA, 15 nt, Bordetella pertussis
cgaccgccggccggu

SEQ ID NO: 2456082 - RNA, 16 nt, Bordetella pertussis
cgaccgccgggacagg

SEQ ID NO: 2456083 - RNA, 17 nt, Bordetella pertussis
cgaccgccgggacaggc

SEQ ID NO: 2456084 - RNA, 22 nt, Bordetella pertussis
cgaccgccucgacgcccgggcg

SEQ ID NO: 2456085 - RNA, 20 nt, Bordetella pertussis
cgaccgcgaaccggugcugg

SEQ ID NO: 2456086 - RNA, 17 nt, Bordetella pertussis
cgaccgcgaagccgccc

SEQ ID NO: 2456087 - RNA, 16 nt, Bordetella pertussis
cgaccgcgaagcgcgc

SEQ ID NO: 2456088 - RNA, 18 nt, Bordetella pertussis
cgaccgcgaagcgcgcca

SEQ ID NO: 2456089 - RNA, 17 nt, Bordetella pertussis
cgaccgcgggcgcgcgc

SEQ ID NO: 2456090 - RNA, 18 nt, Bordetella pertussis
cgaccgcgggcgcgcgcc

SEQ ID NO: 2456091 - RNA, 19 nt, Bordetella pertussis
cgaccgcgggcgcgcgccc

SEQ ID NO: 2456092 - RNA, 22 nt, Bordetella pertussis
cgaccgcgggcgcgcgccccgc

SEQ ID NO: 2456093 - RNA, 20 nt, Bordetella pertussis
cgaccgcguaguugucggcg

SEQ ID NO: 2456094 - RNA, 22 nt, Bordetella pertussis
cgaccgcguaguugucggcgca

SEQ ID NO: 2456095 - RNA, 17 nt, Bordetella pertussis
cgaccgcuuccgccacc

SEQ ID NO: 2456096 - RNA, 23 nt, Bordetella pertussis
cgaccgcuuccgccaccgcgccg

SEQ ID NO: 2456097 - RNA, 16 nt, Bordetella pertussis
cgaccgcuucggucag

SEQ ID NO: 2456098 - RNA, 19 nt, Bordetella pertussis
cgaccgcuucggucagcug

SEQ ID NO: 2456099 - RNA, 20 nt, Bordetella pertussis
cgaccggaccguuccagacg

SEQ ID NO: 2456100 - RNA, 17 nt, Bordetella pertussis
cgaccggcaccugggcc

SEQ ID NO: 2456101 - RNA, 19 nt, Bordetella pertussis
cgaccggccccaccuggcg

SEQ ID NO: 2456102 - RNA, 13 nt, Bordetella pertussis
cgaccggcccgca

SEQ ID NO: 2456103 - RNA, 20 nt, Bordetella pertussis
cgaccggcgaagagccguac

SEQ ID NO: 2456104 - RNA, 13 nt, Bordetella pertussis
cgaccggcgccgg

SEQ ID NO: 2456105 - RNA, 12 nt, Bordetella pertussis
cgaccggcgcga

SEQ ID NO: 2456106 - RNA, 15 nt, Bordetella pertussis
cgaccggcgcgcgcg

SEQ ID NO: 2456107 - RNA, 14 nt, Bordetella pertussis
cgaccggcucgauc

SEQ ID NO: 2456108 - RNA, 18 nt, Bordetella pertussis
cgaccggcucgaucgccg

SEQ ID NO: 2456109 - RNA, 20 nt, Bordetella pertussis
cgaccggcucgggcucgagc

SEQ ID NO: 2456110 - RNA, 16 nt, Bordetella pertussis
cgaccggcuugccguc

SEQ ID NO: 2456111 - RNA, 14 nt, Bordetella pertussis
cgaccgggccgacc

SEQ ID NO: 2456112 - RNA, 18 nt, Bordetella pertussis
cgaccgggccgaccaggc

SEQ ID NO: 2456113 - RNA, 15 nt, Bordetella pertussis
cgaccuccaggccca

SEQ ID NO: 2456114 - RNA, 17 nt, Bordetella pertussis
cgaccucggcaccgagg

SEQ ID NO: 2456115 - RNA, 13 nt, Bordetella pertussis
cgaccucggcggc

SEQ ID NO: 2456116 - RNA, 17 nt, Bordetella pertussis
cgaccucgggacggccc

SEQ ID NO: 2456117 - RNA, 18 nt, Bordetella pertussis
cgaccucgggacggcccu

SEQ ID NO: 2456118 - RNA, 23 nt, Bordetella pertussis
cgaccugaauccguaagcgcugg

SEQ ID NO: 2456119 - RNA, 13 nt, Bordetella pertussis
cgaccugaucgcg

SEQ ID NO: 2456120 - RNA, 23 nt, Bordetella pertussis
cgaccugaucgcgcagcgccugg

SEQ ID NO: 2456121 - RNA, 19 nt, Bordetella pertussis
cgaccugcccgagaccgcc

SEQ ID NO: 2456122 - RNA, 22 nt, Bordetella pertussis
cgaccugcccgagaccgcccgc

SEQ ID NO: 2456123 - RNA, 14 nt, Bordetella pertussis
cgaccugccgcccg

SEQ ID NO: 2456124 - RNA, 20 nt, Bordetella pertussis
cgaccugccgcccgagcugg

SEQ ID NO: 2456125 - RNA, 18 nt, Bordetella pertussis
cgaccugcgcaccggccg

SEQ ID NO: 2456126 - RNA, 17 nt, Bordetella pertussis
cgaccugcgcaugcgcc

SEQ ID NO: 2456127 - RNA, 16 nt, Bordetella pertussis
cgaccugcgcgaccgc

SEQ ID NO: 2456128 - RNA, 19 nt, Bordetella pertussis
cgaccugcgcgaccgccgc

SEQ ID NO: 2456129 - RNA, 15 nt, Bordetella pertussis
cgaccugcgggcgca

SEQ ID NO: 2456130 - RNA, 20 nt, Bordetella pertussis
cgaccugcgggcgcagcgcc

SEQ ID NO: 2456131 - RNA, 22 nt, Bordetella pertussis
cgaccugcgggcgcagcgccgc

SEQ ID NO: 2456132 - RNA, 23 nt, Bordetella pertussis
cgaccugcgggcgcagcgccgcu

SEQ ID NO: 2456133 - RNA, 20 nt, Bordetella pertussis
cgaccugcuggcgcgcacca

SEQ ID NO: 2456134 - RNA, 21 nt, Bordetella pertussis
cgaccugcuggcgcgcaccau

SEQ ID NO: 2456135 - RNA, 23 nt, Bordetella pertussis
cgaccugcuggcgcgcaccaucg

SEQ ID NO: 2456136 - RNA, 14 nt, Bordetella pertussis
cgaccugcuugccc

SEQ ID NO: 2456137 - RNA, 18 nt, Bordetella pertussis
cgaccugcuugcccagca

SEQ ID NO: 2456138 - RNA, 22 nt, Bordetella pertussis
cgaccuggaucacgugccagcc

SEQ ID NO: 2456139 - RNA, 13 nt, Bordetella pertussis
cgaccuggcgccc

SEQ ID NO: 2456140 - RNA, 15 nt, Bordetella pertussis
cgaccuggcgcccga

SEQ ID NO: 2456141 - RNA, 21 nt, Bordetella pertussis
cgaccuggcgcccgacggcgc

SEQ ID NO: 2456142 - RNA, 22 nt, Bordetella pertussis
cgaccuugcccgucagcggcgc

SEQ ID NO: 2456143 - RNA, 13 nt, Bordetella pertussis
cgacgcggcggcc

SEQ ID NO: 2456144 - RNA, 16 nt, Bordetella pertussis
cgacgcggcggccggu

SEQ ID NO: 2456145 - RNA, 11 nt, Bordetella pertussis
cgacgcggcgu

SEQ ID NO: 2456146 - RNA, 20 nt, Bordetella pertussis
cgacgcggcguacuggcgcg

SEQ ID NO: 2456147 - RNA, 15 nt, Bordetella pertussis
cgacgcgggcggccg

SEQ ID NO: 2456148 - RNA, 16 nt, Bordetella pertussis
cgacgcgggcggccga

SEQ ID NO: 2456149 - RNA, 18 nt, Bordetella pertussis
cgacgcgggcggccgacg

SEQ ID NO: 2456150 - RNA, 19 nt, Bordetella pertussis
cgacgcgggcggccgacgg

SEQ ID NO: 2456151 - RNA, 15 nt, Bordetella pertussis
cgacgcggucgccca

SEQ ID NO: 2456152 - RNA, 17 nt, Bordetella pertussis
cgacgcggucgcccaac

SEQ ID NO: 2456153 - RNA, 21 nt, Bordetella pertussis
cgacgcguuguucgggccggc

SEQ ID NO: 2456154 - RNA, 20 nt, Bordetella pertussis
cgacgcucgagguaggcggg

SEQ ID NO: 2456155 - RNA, 22 nt, Bordetella pertussis
cgacgcucgagguaggcgggac

SEQ ID NO: 2456156 - RNA, 16 nt, Bordetella pertussis
cgacgcugaucggccg

SEQ ID NO: 2456157 - RNA, 17 nt, Bordetella pertussis
cgacgcugaucggccga

SEQ ID NO: 2456158 - RNA, 18 nt, Bordetella pertussis
cgacgcugaucggccgac

SEQ ID NO: 2456159 - RNA, 17 nt, Bordetella pertussis
cgacgcugaucucggcc

SEQ ID NO: 2456160 - RNA, 14 nt, Bordetella pertussis
cgacgcugaugccc

SEQ ID NO: 2456161 - RNA, 20 nt, Bordetella pertussis
cgacgcugaugcccagcccg

SEQ ID NO: 2456162 - RNA, 21 nt, Bordetella pertussis
cgacgcugaugcccagcccgg

SEQ ID NO: 2456163 - RNA, 20 nt, Bordetella pertussis
cgacgcuguagaggcgcggc

SEQ ID NO: 2456164 - RNA, 21 nt, Bordetella pertussis
cgacgcuguagaggcgcggcu

SEQ ID NO: 2456165 - RNA, 21 nt, Bordetella pertussis
cgacgcuguuggucaggucga

SEQ ID NO: 2456166 - RNA, 16 nt, Bordetella pertussis
cgacgcuugccggcga

SEQ ID NO: 2456167 - RNA, 22 nt, Bordetella pertussis
cgacgcuugccggcgaucacgc

SEQ ID NO: 2456168 - RNA, 17 nt, Bordetella pertussis
cgacggauucgcccagg

SEQ ID NO: 2456169 - RNA, 23 nt, Bordetella pertussis
cgacggcaagaucgccggcuacg

SEQ ID NO: 2456170 - RNA, 17 nt, Bordetella pertussis
cgacggcaaugccugcg

SEQ ID NO: 2456171 - RNA, 19 nt, Bordetella pertussis
cgacggcagauggacaaga

SEQ ID NO: 2456172 - RNA, 14 nt, Bordetella pertussis
cgacggcagcaagc

SEQ ID NO: 2456173 - RNA, 13 nt, Bordetella pertussis
cgacggcauggcc

SEQ ID NO: 2456174 - RNA, 15 nt, Bordetella pertussis
cgacggcauggccgg

SEQ ID NO: 2456175 - RNA, 16 nt, Bordetella pertussis
cgacggcauggccggc

SEQ ID NO: 2456176 - RNA, 17 nt, Bordetella pertussis
cgacggcauggcggcca

SEQ ID NO: 2456177 - RNA, 21 nt, Bordetella pertussis
cgacggcauggcggccagcuu

SEQ ID NO: 2456178 - RNA, 15 nt, Bordetella pertussis
cgacggccagcgcga

SEQ ID NO: 2456179 - RNA, 18 nt, Bordetella pertussis
cgacggccccagcgccgc

SEQ ID NO: 2456180 - RNA, 19 nt, Bordetella pertussis
cgacggccccagcgccgcg

SEQ ID NO: 2456181 - RNA, 21 nt, Bordetella pertussis
cgacggccccagcgccgcgag

SEQ ID NO: 2456182 - RNA, 12 nt, Bordetella pertussis
cgacggccggcg

SEQ ID NO: 2456183 - RNA, 22 nt, Bordetella pertussis
cgacggccggcgcgugcuggcg

SEQ ID NO: 2456184 - RNA, 12 nt, Bordetella pertussis
cgacggccgggg

SEQ ID NO: 2456185 - RNA, 15 nt, Bordetella pertussis
cgacggccggggccc

SEQ ID NO: 2456186 - RNA, 19 nt, Bordetella pertussis
cgacggccucccgccgccc

SEQ ID NO: 2456187 - RNA, 23 nt, Bordetella pertussis
cgacggccucccgccgcccggcc

SEQ ID NO: 2456188 - RNA, 17 nt, Bordetella pertussis
cgacggccuccgcgccg

SEQ ID NO: 2456189 - RNA, 19 nt, Bordetella pertussis
cgacggccuccgcgccgac

SEQ ID NO: 2456190 - RNA, 22 nt, Bordetella pertussis
cgacggccuccgcgccgaccac

SEQ ID NO: 2456191 - RNA, 17 nt, Bordetella pertussis
cgacggccucggccagg

SEQ ID NO: 2456192 - RNA, 20 nt, Bordetella pertussis
cgacggccucggccaggaaa

SEQ ID NO: 2456193 - RNA, 23 nt, Bordetella pertussis
cgacggccucguccucgucggcg

SEQ ID NO: 2456194 - RNA, 16 nt, Bordetella pertussis
cgacggccuggaggcc

SEQ ID NO: 2456195 - RNA, 19 nt, Bordetella pertussis
cgacggcgcccugcagggc

SEQ ID NO: 2456196 - RNA, 23 nt, Bordetella pertussis
cgacggcgcccugcagggcaugg

SEQ ID NO: 2456197 - RNA, 13 nt, Bordetella pertussis
cgacggcgccgau

SEQ ID NO: 2456198 - RNA, 13 nt, Bordetella pertussis
cgacggcgccugg

SEQ ID NO: 2456199 - RNA, 15 nt, Bordetella pertussis
cgacggcgccuggcg

SEQ ID NO: 2456200 - RNA, 15 nt, Bordetella pertussis
cgacggcgcgcccgc

SEQ ID NO: 2456201 - RNA, 17 nt, Bordetella pertussis
cgacggcgcgcccgccg

SEQ ID NO: 2456202 - RNA, 14 nt, Bordetella pertussis
cgacggcgcgcgcg

SEQ ID NO: 2456203 - RNA, 22 nt, Bordetella pertussis
cgacggcgcggcgaucggcccg

SEQ ID NO: 2456204 - RNA, 13 nt, Bordetella pertussis
cgacggcgugcug

SEQ ID NO: 2456205 - RNA, 16 nt, Bordetella pertussis
cgacggcucgcgcucg

SEQ ID NO: 2456206 - RNA, 22 nt, Bordetella pertussis
cgacggcucgcgcucgcccggc

SEQ ID NO: 2456207 - RNA, 23 nt, Bordetella pertussis
cgacggcuggagauacuggccga

SEQ ID NO: 2456208 - RNA, 23 nt, Bordetella pertussis
cgacgggauccucgcucuuggga

SEQ ID NO: 2456209 - RNA, 14 nt, Bordetella pertussis
cgacgggcaggccc

SEQ ID NO: 2456210 - RNA, 15 nt, Bordetella pertussis
cgacgggcaggccca

SEQ ID NO: 2456211 - RNA, 17 nt, Bordetella pertussis
cgacgggcaggcccagc

SEQ ID NO: 2456212 - RNA, 18 nt, Bordetella pertussis
cgacgggcaggcccagcc

SEQ ID NO: 2456213 - RNA, 19 nt, Bordetella pertussis
cgacgggcaggcccagcca

SEQ ID NO: 2456214 - RNA, 22 nt, Bordetella pertussis
cgacgggcaggcccagccagcg

SEQ ID NO: 2456215 - RNA, 16 nt, Bordetella pertussis
cgacgggcggcugcug

SEQ ID NO: 2456216 - RNA, 14 nt, Bordetella pertussis
cgacggggacacaa

SEQ ID NO: 2456217 - RNA, 15 nt, Bordetella pertussis
cgacgggugaggcga

SEQ ID NO: 2456218 - RNA, 21 nt, Bordetella pertussis
cgacgguaucucagcgcgccg

SEQ ID NO: 2456219 - RNA, 14 nt, Bordetella pertussis
cgacggucaggggc

SEQ ID NO: 2456220 - RNA, 18 nt, Bordetella pertussis
cgacgguccugcgcgccg

SEQ ID NO: 2456221 - RNA, 15 nt, Bordetella pertussis
cgacggucugggcca

SEQ ID NO: 2456222 - RNA, 14 nt, Bordetella pertussis
cgacggugcgcgcc

SEQ ID NO: 2456223 - RNA, 17 nt, Bordetella pertussis
cgacggugcgcgccacg

SEQ ID NO: 2456224 - RNA, 18 nt, Bordetella pertussis
cgacgguuaacgaaucgc

SEQ ID NO: 2456225 - RNA, 18 nt, Bordetella pertussis
cgacguaaaaucccgcgu

SEQ ID NO: 2456226 - RNA, 19 nt, Bordetella pertussis
cgacguaaaaucccgcguu

SEQ ID NO: 2456227 - RNA, 17 nt, Bordetella pertussis
cgacguaagugcccagg

SEQ ID NO: 2456228 - RNA, 19 nt, Bordetella pertussis
cgacguaagugcccaggcc

SEQ ID NO: 2456229 - RNA, 20 nt, Bordetella pertussis
cgacguaagugcccaggccc

SEQ ID NO: 2456230 - RNA, 18 nt, Bordetella pertussis
cgacguagucgcgccagc

SEQ ID NO: 2456231 - RNA, 15 nt, Bordetella pertussis
cgacguagucggcgc

SEQ ID NO: 2456232 - RNA, 18 nt, Bordetella pertussis
cgacguagucggcgccca

SEQ ID NO: 2456233 - RNA, 20 nt, Bordetella pertussis
cgacguagucggcgcccagc

SEQ ID NO: 2456234 - RNA, 22 nt, Bordetella pertussis
cgacguagucggcgcccagcuc

SEQ ID NO: 2456235 - RNA, 22 nt, Bordetella pertussis
cgacguccagcccgugggcggc

SEQ ID NO: 2456236 - RNA, 14 nt, Bordetella pertussis
cgacgucccaggcc

SEQ ID NO: 2456237 - RNA, 19 nt, Bordetella pertussis
cgacgucccaggccgaagc

SEQ ID NO: 2456238 - RNA, 21 nt, Bordetella pertussis
cgacgucccaggccgaagcca

SEQ ID NO: 2456239 - RNA, 14 nt, Bordetella pertussis
cgacguccgcccgg

SEQ ID NO: 2456240 - RNA, 15 nt, Bordetella pertussis
cgacguccuggugga

SEQ ID NO: 2456241 - RNA, 14 nt, Bordetella pertussis
cgacgucgcgcgga

SEQ ID NO: 2456242 - RNA, 12 nt, Bordetella pertussis
cgacgucggccu

SEQ ID NO: 2456243 - RNA, 23 nt, Bordetella pertussis
cgacgucggccucgcgcagggcg

SEQ ID NO: 2456244 - RNA, 18 nt, Bordetella pertussis
cgacgucggugacggcgu

SEQ ID NO: 2456245 - RNA, 23 nt, Bordetella pertussis
cgacgucggugacggcguagccg

SEQ ID NO: 2456246 - RNA, 14 nt, Bordetella pertussis
cgacgucguagugc

SEQ ID NO: 2456247 - RNA, 20 nt, Bordetella pertussis
cgacgucguagugcgcgccg

SEQ ID NO: 2456248 - RNA, 16 nt, Bordetella pertussis
cgacgucuugcugccg

SEQ ID NO: 2456249 - RNA, 15 nt, Bordetella pertussis
cgacgugaugcucga

SEQ ID NO: 2456250 - RNA, 15 nt, Bordetella pertussis
cgacguggaccgcgc

SEQ ID NO: 2456251 - RNA, 16 nt, Bordetella pertussis
cgacguggaccgcgcg

SEQ ID NO: 2456252 - RNA, 19 nt, Bordetella pertussis
cgacguggcgcuccaugcg

SEQ ID NO: 2456253 - RNA, 17 nt, Bordetella pertussis
cgacgugucggccacca

SEQ ID NO: 2456254 - RNA, 19 nt, Bordetella pertussis
cgacguuaugcucgcgcau

SEQ ID NO: 2456255 - RNA, 23 nt, Bordetella pertussis
cgacguugcauaccucgauggcg

SEQ ID NO: 2456256 - RNA, 23 nt, Bordetella pertussis
cgagcaugcgcagcgcgucggcg

SEQ ID NO: 2456257 - RNA, 20 nt, Bordetella pertussis
cgagcauggcgguggccagc

SEQ ID NO: 2456258 - RNA, 15 nt, Bordetella pertussis
cgagcauugccgcgg

SEQ ID NO: 2456259 - RNA, 18 nt, Bordetella pertussis
cgagccacgucgcucggc

SEQ ID NO: 2456260 - RNA, 20 nt, Bordetella pertussis
cgagccagguggacagcgcc

SEQ ID NO: 2456261 - RNA, 21 nt, Bordetella pertussis
cgagccagguggacagcgcca

SEQ ID NO: 2456262 - RNA, 16 nt, Bordetella pertussis
cgagcccaucaggugg

SEQ ID NO: 2456263 - RNA, 24 nt, Bordetella pertussis
cgagcccgccaucgccaggaccag

SEQ ID NO: 2456264 - RNA, 14 nt, Bordetella pertussis
cgagcccggcacca

SEQ ID NO: 2456265 - RNA, 18 nt, Bordetella pertussis
cgagcccgggcgugccug

SEQ ID NO: 2456266 - RNA, 21 nt, Bordetella pertussis
cgagcccgggcgugccugcuu

SEQ ID NO: 2456267 - RNA, 16 nt, Bordetella pertussis
cgagccgacgcuccag

SEQ ID NO: 2456268 - RNA, 13 nt, Bordetella pertussis
cgagccgauggca

SEQ ID NO: 2456269 - RNA, 16 nt, Bordetella pertussis
cgagccgauggcaugg

SEQ ID NO: 2456270 - RNA, 23 nt, Bordetella pertussis
cgagccgauggcauggggcaggc

SEQ ID NO: 2456271 - RNA, 15 nt, Bordetella pertussis
cgagccgcagaacag

SEQ ID NO: 2456272 - RNA, 15 nt, Bordetella pertussis
cgagccgcaggucca

SEQ ID NO: 2456273 - RNA, 18 nt, Bordetella pertussis
cgagccgccgcccuugcg

SEQ ID NO: 2456274 - RNA, 20 nt, Bordetella pertussis
cgagccgcugucgcaggcgc

SEQ ID NO: 2456275 - RNA, 16 nt, Bordetella pertussis
cgagccggccagcgcc

SEQ ID NO: 2456276 - RNA, 17 nt, Bordetella pertussis
cgagccggccagcgcca

SEQ ID NO: 2456277 - RNA, 17 nt, Bordetella pertussis
cgagccggccagcgccu

SEQ ID NO: 2456278 - RNA, 14 nt, Bordetella pertussis
cgagccggccgcgc

SEQ ID NO: 2456279 - RNA, 15 nt, Bordetella pertussis
cgagccggccgcgcc

SEQ ID NO: 2456280 - RNA, 16 nt, Bordetella pertussis
cgagccggccgcgccc

SEQ ID NO: 2456281 - RNA, 15 nt, Bordetella pertussis
cgagccgggccacgc

SEQ ID NO: 2456282 - RNA, 20 nt, Bordetella pertussis
cgagccgggccacgcgcaca

SEQ ID NO: 2456283 - RNA, 17 nt, Bordetella pertussis
cgagccgguacagccag

SEQ ID NO: 2456284 - RNA, 18 nt, Bordetella pertussis
cgagccgguacagccagg

SEQ ID NO: 2456285 - RNA, 19 nt, Bordetella pertussis
cgagccgguacagccaggc

SEQ ID NO: 2456286 - RNA, 23 nt, Bordetella pertussis
cgagccgguacagccaggccagc

SEQ ID NO: 2456287 - RNA, 13 nt, Bordetella pertussis
cgagccggugggc

SEQ ID NO: 2456288 - RNA, 15 nt, Bordetella pertussis
cgagccggugggcgc

SEQ ID NO: 2456289 - RNA, 18 nt, Bordetella pertussis
cgagccuaugaagacgcg

SEQ ID NO: 2456290 - RNA, 23 nt, Bordetella pertussis
cgagccuaugaagacgcgcucgc

SEQ ID NO: 2456291 - RNA, 14 nt, Bordetella pertussis
cgagccucacucca

SEQ ID NO: 2456292 - RNA, 18 nt, Bordetella pertussis
cgagcgcaagcaccgccu

SEQ ID NO: 2456293 - RNA, 20 nt, Bordetella pertussis
cgagcgcaagcaccgccugc

SEQ ID NO: 2456294 - RNA, 22 nt, Bordetella pertussis
cgagcgcaagcaccgccugcug

SEQ ID NO: 2456295 - RNA, 17 nt, Bordetella pertussis
cgagcgcacaggcggcg

SEQ ID NO: 2456296 - RNA, 23 nt, Bordetella pertussis
cgagcgcacaggcggcgccggca

SEQ ID NO: 2456297 - RNA, 13 nt, Bordetella pertussis
cgagcgcaccaug

SEQ ID NO: 2456298 - RNA, 14 nt, Bordetella pertussis
cgagcgcaccaugg

SEQ ID NO: 2456299 - RNA, 19 nt, Bordetella pertussis
cgagcgcaccauggcgccc

SEQ ID NO: 2456300 - RNA, 22 nt, Bordetella pertussis
cgagcgcaccauggcgcccacg

SEQ ID NO: 2456301 - RNA, 16 nt, Bordetella pertussis
cgagcgcaccccggcc

SEQ ID NO: 2456302 - RNA, 22 nt, Bordetella pertussis
cgagcgcaccccggccgacggc

SEQ ID NO: 2456303 - RNA, 21 nt, Bordetella pertussis
cgagcgcagcaagcugcugcu

SEQ ID NO: 2456304 - RNA, 15 nt, Bordetella pertussis
cgagcgcagccgcuc

SEQ ID NO: 2456305 - RNA, 22 nt, Bordetella pertussis
cgagcgcagccgcuccagccac

SEQ ID NO: 2456306 - RNA, 14 nt, Bordetella pertussis
cgagcgccgccagg

SEQ ID NO: 2456307 - RNA, 15 nt, Bordetella pertussis
cgagcgccgccaggc

SEQ ID NO: 2456308 - RNA, 20 nt, Bordetella pertussis
cgagcgccgccaggccgucg

SEQ ID NO: 2456309 - RNA, 20 nt, Bordetella pertussis
cgagcgccgcgcuccagggc

SEQ ID NO: 2456310 - RNA, 16 nt, Bordetella pertussis
cgagcgccgggcgccg

SEQ ID NO: 2456311 - RNA, 18 nt, Bordetella pertussis
cgagcgccgggcgccgcg

SEQ ID NO: 2456312 - RNA, 22 nt, Bordetella pertussis
cgagcgccgggcgccgcgcccc

SEQ ID NO: 2456313 - RNA, 17 nt, Bordetella pertussis
cgagcgccucgcgcucc

SEQ ID NO: 2456314 - RNA, 15 nt, Bordetella pertussis
cgagcgccugcagcg

SEQ ID NO: 2456315 - RNA, 15 nt, Bordetella pertussis
cgagcgccugcgcca

SEQ ID NO: 2456316 - RNA, 13 nt, Bordetella pertussis
cgagcgccugggc

SEQ ID NO: 2456317 - RNA, 21 nt, Bordetella pertussis
cgagcgccugggcggccacgu

SEQ ID NO: 2456318 - RNA, 17 nt, Bordetella pertussis
cgagcgcgacagcacca

SEQ ID NO: 2456319 - RNA, 14 nt, Bordetella pertussis
cgagcgcgagcagg

SEQ ID NO: 2456320 - RNA, 14 nt, Bordetella pertussis
cgagcgcgccagca

SEQ ID NO: 2456321 - RNA, 22 nt, Bordetella pertussis
cgagcgcgcccgcuugggccgc

SEQ ID NO: 2456322 - RNA, 23 nt, Bordetella pertussis
cgagcgcgcccgcuugggccgcg

SEQ ID NO: 2456323 - RNA, 12 nt, Bordetella pertussis
cgagcgcgcgca

SEQ ID NO: 2456324 - RNA, 18 nt, Bordetella pertussis
cgagcgcgcgcaugcgca

SEQ ID NO: 2456325 - RNA, 21 nt, Bordetella pertussis
cgagcgcggcauagcccaggc

SEQ ID NO: 2456326 - RNA, 22 nt, Bordetella pertussis
cgagcgcggcaugcgcaugcug

SEQ ID NO: 2456327 - RNA, 12 nt, Bordetella pertussis
cgagcgcggcca

SEQ ID NO: 2456328 - RNA, 14 nt, Bordetella pertussis
cgagcgcggccagg

SEQ ID NO: 2456329 - RNA, 17 nt, Bordetella pertussis
cgagcgcggccaggcgc

SEQ ID NO: 2456330 - RNA, 22 nt, Bordetella pertussis
cgagcgcggcgauacgcgccgc

SEQ ID NO: 2456331 - RNA, 15 nt, Bordetella pertussis
cgagcgcggcgcgcg

SEQ ID NO: 2456332 - RNA, 16 nt, Bordetella pertussis
cgagcgcggcgcgcgc

SEQ ID NO: 2456333 - RNA, 18 nt, Bordetella pertussis
cgagcgcggcgcgcgcca

SEQ ID NO: 2456334 - RNA, 20 nt, Bordetella pertussis
cgagcgcggcgcgcgccagg

SEQ ID NO: 2456335 - RNA, 22 nt, Bordetella pertussis
cgagcgcggcgggugccgcgag

SEQ ID NO: 2456336 - RNA, 19 nt, Bordetella pertussis
cgagcgcgguggccgcuuc

SEQ ID NO: 2456337 - RNA, 19 nt, Bordetella pertussis
cgagcgcguggaaccgccg

SEQ ID NO: 2456338 - RNA, 20 nt, Bordetella pertussis
cgagcgcguggaaccgccgc

SEQ ID NO: 2456339 - RNA, 13 nt, Bordetella pertussis
cgagcgcucccgc

SEQ ID NO: 2456340 - RNA, 18 nt, Bordetella pertussis
cgagcgcucgcucacggg

SEQ ID NO: 2456341 - RNA, 11 nt, Bordetella pertussis
cgagcgcugcg

SEQ ID NO: 2456342 - RNA, 16 nt, Bordetella pertussis
cgagcgcugcgccaac

SEQ ID NO: 2456343 - RNA, 12 nt, Bordetella pertussis
cgagcggcagca

SEQ ID NO: 2456344 - RNA, 16 nt, Bordetella pertussis
cgagcggcagcagcga

SEQ ID NO: 2456345 - RNA, 13 nt, Bordetella pertussis
cgagcggccagcc

SEQ ID NO: 2456346 - RNA, 17 nt, Bordetella pertussis
cgagcggccagccugcc

SEQ ID NO: 2456347 - RNA, 21 nt, Bordetella pertussis
cgagcggccagccugccgcgg

SEQ ID NO: 2456348 - RNA, 20 nt, Bordetella pertussis
cgagcggcgccagucgcgca

SEQ ID NO: 2456349 - RNA, 16 nt, Bordetella pertussis
cgagcgggccagcgcg

SEQ ID NO: 2456350 - RNA, 20 nt, Bordetella pertussis
cgagcgggccagcgcggcca

SEQ ID NO: 2456351 - RNA, 22 nt, Bordetella pertussis
cgagcgggcccgacagcgcccc

SEQ ID NO: 2456352 - RNA, 13 nt, Bordetella pertussis
cgagcgggcgcca

SEQ ID NO: 2456353 - RNA, 17 nt, Bordetella pertussis
cgagcggggccgcgccg

SEQ ID NO: 2456354 - RNA, 20 nt, Bordetella pertussis
cgagcggggccgcgccggcu

SEQ ID NO: 2456355 - RNA, 15 nt, Bordetella pertussis
cgagcggggcugguc

SEQ ID NO: 2456356 - RNA, 17 nt, Bordetella pertussis
cgagcgggugaugcugc

SEQ ID NO: 2456357 - RNA, 20 nt, Bordetella pertussis
cgagcgggugaugcugcagc

SEQ ID NO: 2456358 - RNA, 21 nt, Bordetella pertussis
cgagcgugccgggaugcugcu

SEQ ID NO: 2456359 - RNA, 22 nt, Bordetella pertussis
cgagcguguugcgugcgagcag

SEQ ID NO: 2456360 - RNA, 22 nt, Bordetella pertussis
cgagguguagaacucggccgca

SEQ ID NO: 2456361 - RNA, 19 nt, Bordetella pertussis
cgaggugucgcuucccgca

SEQ ID NO: 2456362 - RNA, 15 nt, Bordetella pertussis
cgagguugcaggcca

SEQ ID NO: 2456363 - RNA, 23 nt, Bordetella pertussis
cgagguugcaggccaggcucagc

SEQ ID NO: 2456364 - RNA, 16 nt, Bordetella pertussis
cgagguuuccgccaug

SEQ ID NO: 2456365 - RNA, 20 nt, Bordetella pertussis
cgaguacauauucacagcca

SEQ ID NO: 2456366 - RNA, 21 nt, Bordetella pertussis
cgaguacauauucacagccau

SEQ ID NO: 2456367 - RNA, 15 nt, Bordetella pertussis
cgaguaccgccgccu

SEQ ID NO: 2456368 - RNA, 22 nt, Bordetella pertussis
cgaguagaaguaggcggccagg

SEQ ID NO: 2456369 - RNA, 17 nt, Bordetella pertussis
cgaguagacgcagccgc

SEQ ID NO: 2456370 - RNA, 14 nt, Bordetella pertussis
cgaguaggccggca

SEQ ID NO: 2456371 - RNA, 22 nt, Bordetella pertussis
cgaguccugguugccgaagggu

SEQ ID NO: 2456372 - RNA, 17 nt, Bordetella pertussis
cgaguccuugacgccgc

SEQ ID NO: 2456373 - RNA, 19 nt, Bordetella pertussis
cgaguccuugacgccgccg

SEQ ID NO: 2456374 - RNA, 13 nt, Bordetella pertussis
cgagucgaccagu

SEQ ID NO: 2456375 - RNA, 19 nt, Bordetella pertussis
cgagucggcgauggcgcgc

SEQ ID NO: 2456376 - RNA, 14 nt, Bordetella pertussis
cgaguggccgcugu

SEQ ID NO: 2456377 - RNA, 15 nt, Bordetella pertussis
cgaguucgacucucg

SEQ ID NO: 2456378 - RNA, 14 nt, Bordetella pertussis
cgaguucggcgcgc

SEQ ID NO: 2456379 - RNA, 16 nt, Bordetella pertussis
cgaguucggcgcgccc

SEQ ID NO: 2456380 - RNA, 14 nt, Bordetella pertussis
cgaguucgucgucg

SEQ ID NO: 2456381 - RNA, 16 nt, Bordetella pertussis
cgaguucgucgucgcc

SEQ ID NO: 2456382 - RNA, 21 nt, Bordetella pertussis
cgaguucgucgucgccaccgc

SEQ ID NO: 2456383 - RNA, 23 nt, Bordetella pertussis
cgaguugaggaugcgcgcggcca

SEQ ID NO: 2456384 - RNA, 16 nt, Bordetella pertussis
cgaguuguccuggccg

SEQ ID NO: 2456385 - RNA, 16 nt, Bordetella pertussis
cgaguuugcgguccau

SEQ ID NO: 2456386 - RNA, 21 nt, Bordetella pertussis
cgauacagcuuggcgcgcgga

SEQ ID NO: 2456387 - RNA, 22 nt, Bordetella pertussis
cgauacaggcgcucgcgcugca

SEQ ID NO: 2456388 - RNA, 23 nt, Bordetella pertussis
cgauaccaacugccugcagcgcg

SEQ ID NO: 2456389 - RNA, 17 nt, Bordetella pertussis
cgauaccacgcgcggcg

SEQ ID NO: 2456390 - RNA, 20 nt, Bordetella pertussis
cgauaccacgcgcggcggcg

SEQ ID NO: 2456391 - RNA, 14 nt, Bordetella pertussis
cgauaccaguagcg

SEQ ID NO: 2456392 - RNA, 17 nt, Bordetella pertussis
cgauacgacacgccgcg

SEQ ID NO: 2456393 - RNA, 14 nt, Bordetella pertussis
cgauacgccgggcg

SEQ ID NO: 2456394 - RNA, 13 nt, Bordetella pertussis
cgauacgcgccgc

SEQ ID NO: 2456395 - RNA, 20 nt, Bordetella pertussis
cgauacgcgccgccuggccc

SEQ ID NO: 2456396 - RNA, 22 nt, Bordetella pertussis
cgauacgcgccgccuggcccac

SEQ ID NO: 2456397 - RNA, 21 nt, Bordetella pertussis
cgauacgucgaauuccaguug

SEQ ID NO: 2456398 - RNA, 21 nt, Bordetella pertussis
cgauacgucgcagcacgccca

SEQ ID NO: 2456399 - RNA, 14 nt, Bordetella pertussis
cgauacugcgcaug

SEQ ID NO: 2456400 - RNA, 22 nt, Bordetella pertussis
cgauacugcgcaugggcgcagg

SEQ ID NO: 2456401 - RNA, 15 nt, Bordetella pertussis
cgauagauggccagg

SEQ ID NO: 2456402 - RNA, 18 nt, Bordetella pertussis
cgauagauggccaggugg

SEQ ID NO: 2456403 - RNA, 19 nt, Bordetella pertussis
cgauagauggccagguggc

SEQ ID NO: 2456404 - RNA, 15 nt, Bordetella pertussis
cgauagccgcgcgcc

SEQ ID NO: 2456405 - RNA, 15 nt, Bordetella pertussis
cgauagccgcggcgc

SEQ ID NO: 2456406 - RNA, 16 nt, Bordetella pertussis
cgauagccgcggcgcc

SEQ ID NO: 2456407 - RNA, 19 nt, Bordetella pertussis
cgauagccgcggcgccgca

SEQ ID NO: 2456408 - RNA, 16 nt, Bordetella pertussis
cgauagcgccgcgcau

SEQ ID NO: 2456409 - RNA, 14 nt, Bordetella pertussis
cgauagcgcuccag

SEQ ID NO: 2456410 - RNA, 21 nt, Bordetella pertussis
ccgucgagcgcggccaggcgc

SEQ ID NO: 2456411 - RNA, 22 nt, Bordetella pertussis
ccgucgagcgcggccaggcgcg

SEQ ID NO: 2456412 - RNA, 19 nt, Bordetella pertussis
ccgucgaucccaucgcgcg

SEQ ID NO: 2456413 - RNA, 13 nt, Bordetella pertussis
ccgucgaugaugc

SEQ ID NO: 2456414 - RNA, 16 nt, Bordetella pertussis
ccgucgauuucgggug

SEQ ID NO: 2456415 - RNA, 12 nt, Bordetella pertussis
ccgucgccagcg

SEQ ID NO: 2456416 - RNA, 14 nt, Bordetella pertussis
ccgucgccagcgcg

SEQ ID NO: 2456417 - RNA, 15 nt, Bordetella pertussis
ccgucgccagcgcgu

SEQ ID NO: 2456418 - RNA, 14 nt, Bordetella pertussis
ccgucgccagggcg

SEQ ID NO: 2456419 - RNA, 12 nt, Bordetella pertussis
ccgucgccgccc

SEQ ID NO: 2456420 - RNA, 17 nt, Bordetella pertussis
ccgucgccgcccaugcg

SEQ ID NO: 2456421 - RNA, 22 nt, Bordetella pertussis
ccgucgccgcccaugcgcaugg

SEQ ID NO: 2456422 - RNA, 15 nt, Bordetella pertussis
ccgucgccgcccugc

SEQ ID NO: 2456423 - RNA, 19 nt, Bordetella pertussis
ccgucgccgcccugcugcc

SEQ ID NO: 2456424 - RNA, 13 nt, Bordetella pertussis
ccgucgcgccagg

SEQ ID NO: 2456425 - RNA, 14 nt, Bordetella pertussis
ccgucgcgccaggc

SEQ ID NO: 2456426 - RNA, 18 nt, Bordetella pertussis
ccgucgcgccaggccggc

SEQ ID NO: 2456427 - RNA, 14 nt, Bordetella pertussis
ccgucgcgcgcacg

SEQ ID NO: 2456428 - RNA, 15 nt, Bordetella pertussis
ccgucgcgcgcacgc

SEQ ID NO: 2456429 - RNA, 16 nt, Bordetella pertussis
ccgucgcgcucgagca

SEQ ID NO: 2456430 - RNA, 22 nt, Bordetella pertussis
ccgucgcgcucgagcaucuggc

SEQ ID NO: 2456431 - RNA, 14 nt, Bordetella pertussis
ccgucgcgcugcaa

SEQ ID NO: 2456432 - RNA, 13 nt, Bordetella pertussis
ccgucggccgucu

SEQ ID NO: 2456433 - RNA, 22 nt, Bordetella pertussis
ccgucggccuggaacauggccc

SEQ ID NO: 2456434 - RNA, 23 nt, Bordetella pertussis
ccgucggccuggaacauggcccg

SEQ ID NO: 2456435 - RNA, 16 nt, Bordetella pertussis
ccgucggcggcaagca

SEQ ID NO: 2456436 - RNA, 16 nt, Bordetella pertussis
ccgucgggcaggucgg

SEQ ID NO: 2456437 - RNA, 21 nt, Bordetella pertussis
ccgucgggcgccgcaacgccg

SEQ ID NO: 2456438 - RNA, 20 nt, Bordetella pertussis
ccgucggggccgauggucag

SEQ ID NO: 2456439 - RNA, 15 nt, Bordetella pertussis
ccgucgggguggcgu

SEQ ID NO: 2456440 - RNA, 21 nt, Bordetella pertussis
ccgucgggguggcgucguccg

SEQ ID NO: 2456441 - RNA, 22 nt, Bordetella pertussis
ccgucggguugccgcugcaugg

SEQ ID NO: 2456442 - RNA, 21 nt, Bordetella pertussis
ccgucgucaucgccaucgacc

SEQ ID NO: 2456443 - RNA, 19 nt, Bordetella pertussis
ccgucguccguccuggcca

SEQ ID NO: 2456444 - RNA, 21 nt, Bordetella pertussis
ccgucguccucggcacggcca

SEQ ID NO: 2456445 - RNA, 14 nt, Bordetella pertussis
ccgucgugcagcgu

SEQ ID NO: 2456446 - RNA, 20 nt, Bordetella pertussis
ccgucgugcgccuggcggcu

SEQ ID NO: 2456447 - RNA, 22 nt, Bordetella pertussis
ccgucguugacggggacgccgg

SEQ ID NO: 2456448 - RNA, 21 nt, Bordetella pertussis
ccgucucgaacgccgcgucgc

SEQ ID NO: 2456449 - RNA, 14 nt, Bordetella pertussis
ccgucucgcccagg

SEQ ID NO: 2456450 - RNA, 15 nt, Bordetella pertussis
ccgucucgcccaggc

SEQ ID NO: 2456451 - RNA, 16 nt, Bordetella pertussis
ccgucucgcccaggcc

SEQ ID NO: 2456452 - RNA, 13 nt, Bordetella pertussis
ccgucucgcgcgc

SEQ ID NO: 2456453 - RNA, 17 nt, Bordetella pertussis
ccgucucgcgcgccagg

SEQ ID NO: 2456454 - RNA, 15 nt, Bordetella pertussis
ccgucugcgccgccg

SEQ ID NO: 2456455 - RNA, 16 nt, Bordetella pertussis
ccgucugcgccgccgc

SEQ ID NO: 2456456 - RNA, 23 nt, Bordetella pertussis
ccgucugggcgugaaaggccagc

SEQ ID NO: 2456457 - RNA, 16 nt, Bordetella pertussis
ccgucugugcgccccg

SEQ ID NO: 2456458 - RNA, 23 nt, Bordetella pertussis
ccgucugugcgccccgcuggccg

SEQ ID NO: 2456459 - RNA, 17 nt, Bordetella pertussis
ccgucuugcccgccagc

SEQ ID NO: 2456460 - RNA, 20 nt, Bordetella pertussis
ccgucuugcccgccagcgcg

SEQ ID NO: 2456461 - RNA, 15 nt, Bordetella pertussis
ccgucuuggcgggcu

SEQ ID NO: 2456462 - RNA, 13 nt, Bordetella pertussis
ccgucuuggcgug

SEQ ID NO: 2456463 - RNA, 20 nt, Bordetella pertussis
ccgugaccugcucgucgcca

SEQ ID NO: 2456464 - RNA, 16 nt, Bordetella pertussis
ccgugacgcugauggc

SEQ ID NO: 2456465 - RNA, 21 nt, Bordetella pertussis
ccgugacgcugauggccgcca

SEQ ID NO: 2456466 - RNA, 20 nt, Bordetella pertussis
ccgugacguugagcgccggg

SEQ ID NO: 2456467 - RNA, 18 nt, Bordetella pertussis
ccgugacuucggccgcca

SEQ ID NO: 2456468 - RNA, 16 nt, Bordetella pertussis
ccgugagcgccgccgc

SEQ ID NO: 2456469 - RNA, 21 nt, Bordetella pertussis
ccgugagcgccgccgccaugg

SEQ ID NO: 2456470 - RNA, 16 nt, Bordetella pertussis
ccgugagugcagcgcu

SEQ ID NO: 2456471 - RNA, 22 nt, Bordetella pertussis
ccgugaucggcgcaaccggccc

SEQ ID NO: 2456472 - RNA, 19 nt, Bordetella pertussis
ccgugaucuugaugccgcc

SEQ ID NO: 2456473 - RNA, 15 nt, Bordetella pertussis
ccgugaugccgcccg

SEQ ID NO: 2456474 - RNA, 16 nt, Bordetella pertussis
ccgugaugccgcccgc

SEQ ID NO: 2456475 - RNA, 14 nt, Bordetella pertussis
cgaucaggcgcucc

SEQ ID NO: 2456476 - RNA, 15 nt, Bordetella pertussis
cgaucaggcggugcc

SEQ ID NO: 2456477 - RNA, 18 nt, Bordetella pertussis
cgaucaggcggugccccg

SEQ ID NO: 2456478 - RNA, 15 nt, Bordetella pertussis
cgaucagggcgcgga

SEQ ID NO: 2456479 - RNA, 22 nt, Bordetella pertussis
cgaucaguaucucggcgcccgc

SEQ ID NO: 2456480 - RNA, 23 nt, Bordetella pertussis
cgaucauccaggccgugagcgcc

SEQ ID NO: 2456481 - RNA, 21 nt, Bordetella pertussis
cgaucaugaugcgcugggcca

SEQ ID NO: 2456482 - RNA, 14 nt, Bordetella pertussis
cgaucaugccgccg

SEQ ID NO: 2456483 - RNA, 15 nt, Bordetella pertussis
cgaucaugccgccga

SEQ ID NO: 2456484 - RNA, 14 nt, Bordetella pertussis
cgaucauggccagc

SEQ ID NO: 2456485 - RNA, 15 nt, Bordetella pertussis
cgaucauggccagcc

SEQ ID NO: 2456486 - RNA, 22 nt, Bordetella pertussis
cgaucauggcgugucuccgggc

SEQ ID NO: 2456487 - RNA, 14 nt, Bordetella pertussis
cgauccacggccgg

SEQ ID NO: 2456488 - RNA, 18 nt, Bordetella pertussis
cgauccacggccggcgca

SEQ ID NO: 2456489 - RNA, 17 nt, Bordetella pertussis
cgauccacucggccagc

SEQ ID NO: 2456490 - RNA, 15 nt, Bordetella pertussis
cgauccagaagauau

SEQ ID NO: 2456491 - RNA, 13 nt, Bordetella pertussis
cgauccagcagcg

SEQ ID NO: 2456492 - RNA, 15 nt, Bordetella pertussis
cgauccagcccgcgg

SEQ ID NO: 2456493 - RNA, 20 nt, Bordetella pertussis
cgauccagccguuggcgccc

SEQ ID NO: 2456494 - RNA, 21 nt, Bordetella pertussis
cgauccagccguuggcgccca

SEQ ID NO: 2456495 - RNA, 13 nt, Bordetella pertussis
cgauccagcgccu

SEQ ID NO: 2456496 - RNA, 11 nt, Bordetella pertussis
cgauccaggcc

SEQ ID NO: 2456497 - RNA, 13 nt, Bordetella pertussis
cgauccaggccac

SEQ ID NO: 2456498 - RNA, 14 nt, Bordetella pertussis
cgauccagggccgc

SEQ ID NO: 2456499 - RNA, 18 nt, Bordetella pertussis
cgauccagggccgccagc

SEQ ID NO: 2456500 - RNA, 20 nt, Bordetella pertussis
cgauccagggccgccagcac

SEQ ID NO: 2456501 - RNA, 21 nt, Bordetella pertussis
cgauccagggccgccagcacc

SEQ ID NO: 2456502 - RNA, 23 nt, Bordetella pertussis
cgauccagggccgccagcaccug

SEQ ID NO: 2456503 - RNA, 20 nt, Bordetella pertussis
cgauccauccgcauacaacu

SEQ ID NO: 2456504 - RNA, 17 nt, Bordetella pertussis
cgauccauguggccagc

SEQ ID NO: 2456505 - RNA, 20 nt, Bordetella pertussis
cgauccauguggccagcucc

SEQ ID NO: 2456506 - RNA, 18 nt, Bordetella pertussis
cgaucccgucauggcggc

SEQ ID NO: 2456507 - RNA, 16 nt, Bordetella pertussis
cgaucccuugugcgcg

SEQ ID NO: 2456508 - RNA, 18 nt, Bordetella pertussis
cgaucccuugugcgcgcc

SEQ ID NO: 2456509 - RNA, 19 nt, Bordetella pertussis
cgaucccuugugcgcgcca

SEQ ID NO: 2456510 - RNA, 20 nt, Bordetella pertussis
cgauccgaugaugcccagga

SEQ ID NO: 2456511 - RNA, 18 nt, Bordetella pertussis
cgauccgccgcggccagc

SEQ ID NO: 2456512 - RNA, 19 nt, Bordetella pertussis
cgauccgcgacgcccuggc

SEQ ID NO: 2456513 - RNA, 21 nt, Bordetella pertussis
cgauccgcgacgcccuggccu

SEQ ID NO: 2456514 - RNA, 15 nt, Bordetella pertussis
cgauccgcgccaggc

SEQ ID NO: 2456515 - RNA, 14 nt, Bordetella pertussis
cgauccggcagcag

SEQ ID NO: 2456516 - RNA, 20 nt, Bordetella pertussis
cgauccggcgaccgacggca

SEQ ID NO: 2456517 - RNA, 16 nt, Bordetella pertussis
cgauccggcgcagauc

SEQ ID NO: 2456518 - RNA, 21 nt, Bordetella pertussis
cgauccggcgcagauccucga

SEQ ID NO: 2456519 - RNA, 22 nt, Bordetella pertussis
cgauccggcgugguaucgcgcc

SEQ ID NO: 2456520 - RNA, 15 nt, Bordetella pertussis
cgauccgggccuggc

SEQ ID NO: 2456521 - RNA, 19 nt, Bordetella pertussis
cgauccugcccaccgccgc

SEQ ID NO: 2456522 - RNA, 14 nt, Bordetella pertussis
cgauccuucgcggc

SEQ ID NO: 2456523 - RNA, 16 nt, Bordetella pertussis
cgauccuucgcggccg

SEQ ID NO: 2456524 - RNA, 14 nt, Bordetella pertussis
cgaucgaacgcggc

SEQ ID NO: 2456525 - RNA, 15 nt, Bordetella pertussis
cgaucgaacgcggcc

SEQ ID NO: 2456526 - RNA, 17 nt, Bordetella pertussis
cgaucgaacgcggccag

SEQ ID NO: 2456527 - RNA, 12 nt, Bordetella pertussis
cgaucgacggcc

SEQ ID NO: 2456528 - RNA, 15 nt, Bordetella pertussis
cgaucgacggccgca

SEQ ID NO: 2456529 - RNA, 15 nt, Bordetella pertussis
cgaucgagcaggccg

SEQ ID NO: 2456530 - RNA, 18 nt, Bordetella pertussis
cgaucgagcaggccgccg

SEQ ID NO: 2456531 - RNA, 19 nt, Bordetella pertussis
cgaucgagcaggccgccgg

SEQ ID NO: 2456532 - RNA, 16 nt, Bordetella pertussis
cgaucgcaucgcggca

SEQ ID NO: 2456533 - RNA, 21 nt, Bordetella pertussis
cgaucgcaucgcggcagcccg

SEQ ID NO: 2456534 - RNA, 22 nt, Bordetella pertussis
cgaucgcaucgcggcagcccgg

SEQ ID NO: 2456535 - RNA, 14 nt, Bordetella pertussis
cgaucgccaccagc

SEQ ID NO: 2456536 - RNA, 15 nt, Bordetella pertussis
cgaucgccaccagcg

SEQ ID NO: 2456537 - RNA, 17 nt, Bordetella pertussis
cgaucgccagcaggcgc

SEQ ID NO: 2456538 - RNA, 14 nt, Bordetella pertussis
cgaucgccaggucg

SEQ ID NO: 2456539 - RNA, 15 nt, Bordetella pertussis
cgaucgccaggucgg

SEQ ID NO: 2456540 - RNA, 21 nt, Bordetella pertussis
cgaucgccaggucggccagcc

SEQ ID NO: 2456541 - RNA, 17 nt, Bordetella pertussis
cgaucgccaugacgcug

SEQ ID NO: 2456542 - RNA, 14 nt, Bordetella pertussis
cgaucgccgacagg

SEQ ID NO: 2456543 - RNA, 14 nt, Bordetella pertussis
cgaucgccgccggc

SEQ ID NO: 2456544 - RNA, 15 nt, Bordetella pertussis
cgaucgccgccggca

SEQ ID NO: 2456545 - RNA, 14 nt, Bordetella pertussis
cgaucgcgauggcc

SEQ ID NO: 2456546 - RNA, 16 nt, Bordetella pertussis
cgaucgcgauggcccg

SEQ ID NO: 2456547 - RNA, 15 nt, Bordetella pertussis
cgaucgcgcacagca

SEQ ID NO: 2456548 - RNA, 12 nt, Bordetella pertussis
cgaucgcgccgg

SEQ ID NO: 2456549 - RNA, 13 nt, Bordetella pertussis
cgaucgcgccggc

SEQ ID NO: 2456550 - RNA, 20 nt, Bordetella pertussis
cgaucgcgccggccugggcg

SEQ ID NO: 2456551 - RNA, 15 nt, Bordetella pertussis
cgaucgcgucggcca

SEQ ID NO: 2456552 - RNA, 16 nt, Bordetella pertussis
cgaucgcgucggccaa

SEQ ID NO: 2456553 - RNA, 17 nt, Bordetella pertussis
cgaucgcgucggccaag

SEQ ID NO: 2456554 - RNA, 18 nt, Bordetella pertussis
cgaucggagaaaucgccg

SEQ ID NO: 2456555 - RNA, 22 nt, Bordetella pertussis
cgaucggagaaaucgccgccgg

SEQ ID NO: 2456556 - RNA, 18 nt, Bordetella pertussis
cgaucggauagcggugca

SEQ ID NO: 2456557 - RNA, 15 nt, Bordetella pertussis
cgaucggccggccgg

SEQ ID NO: 2456558 - RNA, 21 nt, Bordetella pertussis
cgaucggccugaaccaggccg

SEQ ID NO: 2456559 - RNA, 16 nt, Bordetella pertussis
cgaucggcgccgcgcg

SEQ ID NO: 2456560 - RNA, 18 nt, Bordetella pertussis
cgaucggcgccgcgcgcg

SEQ ID NO: 2456561 - RNA, 21 nt, Bordetella pertussis
cgaucggcgccuggccgccca

SEQ ID NO: 2456562 - RNA, 14 nt, Bordetella pertussis
cgaucggcgcgccc

SEQ ID NO: 2456563 - RNA, 15 nt, Bordetella pertussis
cgaucggcgucugga

SEQ ID NO: 2456564 - RNA, 18 nt, Bordetella pertussis
cgaucggcuugccgcgcg

SEQ ID NO: 2456565 - RNA, 21 nt, Bordetella pertussis
cgaucgucaccaucgccgcgu

SEQ ID NO: 2456566 - RNA, 14 nt, Bordetella pertussis
cgaucgucgaccgc

SEQ ID NO: 2456567 - RNA, 17 nt, Bordetella pertussis
cgaucgucuugaccagc

SEQ ID NO: 2456568 - RNA, 19 nt, Bordetella pertussis
cgaucgucuugaccagcag

SEQ ID NO: 2456569 - RNA, 16 nt, Bordetella pertussis
cgaucgugcacgcccg

SEQ ID NO: 2456570 - RNA, 18 nt, Bordetella pertussis
cgaucuacgacgccugga

SEQ ID NO: 2456571 - RNA, 20 nt, Bordetella pertussis
cgaucuacgacgccuggacc

SEQ ID NO: 2456572 - RNA, 21 nt, Bordetella pertussis
cgaucucacgggcgaagcgga

SEQ ID NO: 2456573 - RNA, 15 nt, Bordetella pertussis
cgaucucgcccugcu

SEQ ID NO: 2456574 - RNA, 16 nt, Bordetella pertussis
cgaucucgcccugcuc

SEQ ID NO: 2456575 - RNA, 18 nt, Bordetella pertussis
cgaucucgcccugcucgc

SEQ ID NO: 2456576 - RNA, 13 nt, Bordetella pertussis
cgaucucgcgcag

SEQ ID NO: 2456577 - RNA, 14 nt, Bordetella pertussis
cgaucucgcgcagg

SEQ ID NO: 2456578 - RNA, 18 nt, Bordetella pertussis
cgaucucgcgcagggugg

SEQ ID NO: 2456579 - RNA, 14 nt, Bordetella pertussis
cgaucucgcgcgcg

SEQ ID NO: 2456580 - RNA, 18 nt, Bordetella pertussis
cgaucucgggcaggucgg

SEQ ID NO: 2456581 - RNA, 19 nt, Bordetella pertussis
cgaucucgggcaggucggc

SEQ ID NO: 2456582 - RNA, 20 nt, Bordetella pertussis
cgaucucgucgaccgccucg

SEQ ID NO: 2456583 - RNA, 21 nt, Bordetella pertussis
cgaucugcgcggcggugccgc

SEQ ID NO: 2456584 - RNA, 22 nt, Bordetella pertussis
cgaucugcgcggcggugccgcc

SEQ ID NO: 2456585 - RNA, 12 nt, Bordetella pertussis
cgaucugcggcg

SEQ ID NO: 2456586 - RNA, 13 nt, Bordetella pertussis
cgaucugcugggc

SEQ ID NO: 2456587 - RNA, 15 nt, Bordetella pertussis
cgaucugcugggccg

SEQ ID NO: 2456588 - RNA, 20 nt, Bordetella pertussis
cgaucuggccgauggccucg

SEQ ID NO: 2456589 - RNA, 17 nt, Bordetella pertussis
cgauggccacgaagacg

SEQ ID NO: 2456590 - RNA, 12 nt, Bordetella pertussis
cgauggccgaca

SEQ ID NO: 2456591 - RNA, 19 nt, Bordetella pertussis
cgauggccgacaugucgug

SEQ ID NO: 2456592 - RNA, 24 nt, Bordetella pertussis
cgauggccgacaugucgugcuggc

SEQ ID NO: 2456593 - RNA, 14 nt, Bordetella pertussis
cgauggccgccagc

SEQ ID NO: 2456594 - RNA, 17 nt, Bordetella pertussis
cgauggccgggagcggc

SEQ ID NO: 2456595 - RNA, 22 nt, Bordetella pertussis
cgauggccgggagcggccagca

SEQ ID NO: 2456596 - RNA, 19 nt, Bordetella pertussis
cgauggccucgcugccagg

SEQ ID NO: 2456597 - RNA, 23 nt, Bordetella pertussis
cgauggccucgcugccagggugc

SEQ ID NO: 2456598 - RNA, 21 nt, Bordetella pertussis
cgauggccucggcauggcgcg

SEQ ID NO: 2456599 - RNA, 16 nt, Bordetella pertussis
cgauggccugugcggc

SEQ ID NO: 2456600 - RNA, 22 nt, Bordetella pertussis
cgauggccugugcggcccaugu

SEQ ID NO: 2456601 - RNA, 21 nt, Bordetella pertussis
cgauggcgauguaggccaggu

SEQ ID NO: 2456602 - RNA, 18 nt, Bordetella pertussis
cgauggcgcccacggccu

SEQ ID NO: 2456603 - RNA, 23 nt, Bordetella pertussis
cgauggcgcccacggccuguccg

SEQ ID NO: 2456604 - RNA, 16 nt, Bordetella pertussis
cgauggcgccggccag

SEQ ID NO: 2456605 - RNA, 17 nt, Bordetella pertussis
cgauggcgccggccagc

SEQ ID NO: 2456606 - RNA, 22 nt, Bordetella pertussis
cgauggcgccggccagcgcgcc

SEQ ID NO: 2456607 - RNA, 17 nt, Bordetella pertussis
cgauggcgcgcggcugg

SEQ ID NO: 2456608 - RNA, 19 nt, Bordetella pertussis
cgauggcgcgcggcugggg

SEQ ID NO: 2456609 - RNA, 22 nt, Bordetella pertussis
cgauggcgcgcggcuggggcug

SEQ ID NO: 2456610 - RNA, 18 nt, Bordetella pertussis
cgauggcgcggccggagg

SEQ ID NO: 2456611 - RNA, 18 nt, Bordetella pertussis
cgauggcgcgucgccgcg

SEQ ID NO: 2456612 - RNA, 16 nt, Bordetella pertussis
cgauggcggcaucuug

SEQ ID NO: 2456613 - RNA, 22 nt, Bordetella pertussis
cgauggcggcaucuugccuugg

SEQ ID NO: 2456614 - RNA, 14 nt, Bordetella pertussis
cgauggcggccagg

SEQ ID NO: 2456615 - RNA, 15 nt, Bordetella pertussis
cgauggcggccaggg

SEQ ID NO: 2456616 - RNA, 18 nt, Bordetella pertussis
cgauggcggcgcuggcgu

SEQ ID NO: 2456617 - RNA, 21 nt, Bordetella pertussis
cgauggcgggguuggccgcca

SEQ ID NO: 2456618 - RNA, 22 nt, Bordetella pertussis
cgauggcgggguuggccgccag

SEQ ID NO: 2456619 - RNA, 15 nt, Bordetella pertussis
cgauggcggugguga

SEQ ID NO: 2456620 - RNA, 16 nt, Bordetella pertussis
cgauggcggugguggg

SEQ ID NO: 2456621 - RNA, 17 nt, Bordetella pertussis
cgauggcgguggugggc

SEQ ID NO: 2456622 - RNA, 17 nt, Bordetella pertussis
cgauggcguacagcagg

SEQ ID NO: 2456623 - RNA, 19 nt, Bordetella pertussis
cgauggcguacagcagggu

SEQ ID NO: 2456624 - RNA, 15 nt, Bordetella pertussis
cgauggcguccagca

SEQ ID NO: 2456625 - RNA, 16 nt, Bordetella pertussis
cgauggcguccagcag

SEQ ID NO: 2456626 - RNA, 19 nt, Bordetella pertussis
cgauggcguccagcagcag

SEQ ID NO: 2456627 - RNA, 19 nt, Bordetella pertussis
cgauggcgucgauuucguc

SEQ ID NO: 2456628 - RNA, 18 nt, Bordetella pertussis
cgauggcguugcgcacca

SEQ ID NO: 2456629 - RNA, 16 nt, Bordetella pertussis
cgauggcuucgcgcac

SEQ ID NO: 2456630 - RNA, 17 nt, Bordetella pertussis
cgauggcuucgcgcaca

SEQ ID NO: 2456631 - RNA, 21 nt, Bordetella pertussis
cgaugggauacgccgugcugu

SEQ ID NO: 2456632 - RNA, 15 nt, Bordetella pertussis
cgaugggccugccca

SEQ ID NO: 2456633 - RNA, 18 nt, Bordetella pertussis
cgaugggccugcccaugg

SEQ ID NO: 2456634 - RNA, 19 nt, Bordetella pertussis
cgaugggguagucggccac

SEQ ID NO: 2456635 - RNA, 17 nt, Bordetella pertussis
cgauggggucgggccgc

SEQ ID NO: 2456636 - RNA, 19 nt, Bordetella pertussis
cgauggucaccacccgcac

SEQ ID NO: 2456637 - RNA, 15 nt, Bordetella pertussis
cgauggucagcggca

SEQ ID NO: 2456638 - RNA, 20 nt, Bordetella pertussis
cgauggucaguccgcccagc

SEQ ID NO: 2456639 - RNA, 21 nt, Bordetella pertussis
cgauggucaguccgcccagcc

SEQ ID NO: 2456640 - RNA, 17 nt, Bordetella pertussis
cgauggugcgcaggggc

SEQ ID NO: 2456641 - RNA, 16 nt, Bordetella pertussis
cgaugguggauccgcc

SEQ ID NO: 2456642 - RNA, 16 nt, Bordetella pertussis
cgauguagagggucug

SEQ ID NO: 2456643 - RNA, 20 nt, Bordetella pertussis
cgauguaguagccgccgcug

SEQ ID NO: 2456644 - RNA, 17 nt, Bordetella pertussis
cgauguccacgaaggcg

SEQ ID NO: 2456645 - RNA, 13 nt, Bordetella pertussis
cgauguccagcga

SEQ ID NO: 2456646 - RNA, 15 nt, Bordetella pertussis
cgauguccagcgcca

SEQ ID NO: 2456647 - RNA, 17 nt, Bordetella pertussis
cgauguccagcgccagc

SEQ ID NO: 2456648 - RNA, 20 nt, Bordetella pertussis
cgauguccagcgccagcagg

SEQ ID NO: 2456649 - RNA, 21 nt, Bordetella pertussis
cgauguccugguugccgagga

SEQ ID NO: 2456650 - RNA, 22 nt, Bordetella pertussis
cgauguccugguugccgaggac

SEQ ID NO: 2456651 - RNA, 18 nt, Bordetella pertussis
cgauguccuucucuucgc

SEQ ID NO: 2456652 - RNA, 21 nt, Bordetella pertussis
cgaugucgaacagcugcagcg

SEQ ID NO: 2456653 - RNA, 24 nt, Bordetella pertussis
cgaugucgaacagcugcagcgacu

SEQ ID NO: 2456654 - RNA, 15 nt, Bordetella pertussis
cgaugucgaauuccg

SEQ ID NO: 2456655 - RNA, 14 nt, Bordetella pertussis
cgaugucgccgccg

SEQ ID NO: 2456656 - RNA, 22 nt, Bordetella pertussis
cgaugucguacacaugcuugcc

SEQ ID NO: 2456657 - RNA, 18 nt, Bordetella pertussis
cgaugucguccagcucca

SEQ ID NO: 2456658 - RNA, 21 nt, Bordetella pertussis
cgaugucguccagcuccaggu

SEQ ID NO: 2456659 - RNA, 24 nt, Bordetella pertussis
cgaugucgugaucgccagcgccgg

SEQ ID NO: 2456660 - RNA, 14 nt, Bordetella pertussis
cgauguggccgucg

SEQ ID NO: 2456661 - RNA, 15 nt, Bordetella pertussis
cgauguggccgucgu

SEQ ID NO: 2456662 - RNA, 20 nt, Bordetella pertussis
cgauguggcgcuggcggcug

SEQ ID NO: 2456663 - RNA, 22 nt, Bordetella pertussis
cgauguucaggccaugcugggc

SEQ ID NO: 2456664 - RNA, 15 nt, Bordetella pertussis
cgauguugccgccgg

SEQ ID NO: 2456665 - RNA, 18 nt, Bordetella pertussis
cgauguugccgccggcca

SEQ ID NO: 2456666 - RNA, 16 nt, Bordetella pertussis
cgauguuguuggccgc

SEQ ID NO: 2456667 - RNA, 20 nt, Bordetella pertussis
cgauguuguuggccgccagc

SEQ ID NO: 2456668 - RNA, 21 nt, Bordetella pertussis
cgauguuguuggccgccagcc

SEQ ID NO: 2456669 - RNA, 23 nt, Bordetella pertussis
cgauguuguuggccgccagccgg

SEQ ID NO: 2456670 - RNA, 16 nt, Bordetella pertussis
cgauucauaucgaacu

SEQ ID NO: 2456671 - RNA, 19 nt, Bordetella pertussis
cgauuccaggacgacaggc

SEQ ID NO: 2456672 - RNA, 15 nt, Bordetella pertussis
cgauucccuggcgcg

SEQ ID NO: 2456673 - RNA, 23 nt, Bordetella pertussis
cgauucccuggcgcgccagcucg

SEQ ID NO: 2456674 - RNA, 17 nt, Bordetella pertussis
cgauuccgccuacuggc

SEQ ID NO: 2456675 - RNA, 21 nt, Bordetella pertussis
cgauuccgccuacuggcgcgc

SEQ ID NO: 2456676 - RNA, 18 nt, Bordetella pertussis
cgauucgaccugcuuggc

SEQ ID NO: 2456677 - RNA, 22 nt, Bordetella pertussis
cgauucgaccugcuuggcgaac

SEQ ID NO: 2456678 - RNA, 13 nt, Bordetella pertussis
cgauucgcgcuug

SEQ ID NO: 2456679 - RNA, 23 nt, Bordetella pertussis
cgauucgcgcuugaaaugcgugg

SEQ ID NO: 2456680 - RNA, 20 nt, Bordetella pertussis
cgauucggagucgugcagga

SEQ ID NO: 2456681 - RNA, 17 nt, Bordetella pertussis
cgauucuuuccuggccg

SEQ ID NO: 2456682 - RNA, 19 nt, Bordetella pertussis
cgauucuuuccuggccggc

SEQ ID NO: 2456683 - RNA, 17 nt, Bordetella pertussis
cgauugaccagcaccag

SEQ ID NO: 2456684 - RNA, 20 nt, Bordetella pertussis
cgauugaccagcaccagcgc

SEQ ID NO: 2456685 - RNA, 21 nt, Bordetella pertussis
cgauugaguucgcgcgccggc

SEQ ID NO: 2456686 - RNA, 20 nt, Bordetella pertussis
cgauugccuggucgaaguag

SEQ ID NO: 2456687 - RNA, 13 nt, Bordetella pertussis
cgauugcgccagc

SEQ ID NO: 2456688 - RNA, 15 nt, Bordetella pertussis
cgauugcgccagcgc

SEQ ID NO: 2456689 - RNA, 13 nt, Bordetella pertussis
cgauugcggcccg

SEQ ID NO: 2456690 - RNA, 15 nt, Bordetella pertussis
cgauugcggcccgcg

SEQ ID NO: 2456691 - RNA, 18 nt, Bordetella pertussis
cgauugucgucgcgcgag

SEQ ID NO: 2456692 - RNA, 15 nt, Bordetella pertussis
cgauuuccgaggccu

SEQ ID NO: 2456693 - RNA, 14 nt, Bordetella pertussis
cgauuucgcgcgcc

SEQ ID NO: 2456694 - RNA, 15 nt, Bordetella pertussis
cgauuucgcgcgcca

SEQ ID NO: 2456695 - RNA, 17 nt, Bordetella pertussis
cgauuucgcgcgccagc

SEQ ID NO: 2456696 - RNA, 15 nt, Bordetella pertussis
cgauuucggcggcca

SEQ ID NO: 2456697 - RNA, 18 nt, Bordetella pertussis
cgauuucggggcgcgaga

SEQ ID NO: 2456698 - RNA, 14 nt, Bordetella pertussis
cgauuugagcagcg

SEQ ID NO: 2456699 - RNA, 16 nt, Bordetella pertussis
cgauuugccgcagccc

SEQ ID NO: 2456700 - RNA, 19 nt, Bordetella pertussis
cgauuugccgcagcccgcg

SEQ ID NO: 2456701 - RNA, 23 nt, Bordetella pertussis
cgauuugccgcagcccgcgcgcc

SEQ ID NO: 2456702 - RNA, 16 nt, Bordetella pertussis
cgcaaaaacgcccggc

SEQ ID NO: 2456703 - RNA, 17 nt, Bordetella pertussis
cgaugaugagcgcgccg

SEQ ID NO: 2456704 - RNA, 17 nt, Bordetella pertussis
cgaugauggcguccgcg

SEQ ID NO: 2456705 - RNA, 21 nt, Bordetella pertussis
cgaugauggugaacgccacca

SEQ ID NO: 2456706 - RNA, 19 nt, Bordetella pertussis
cgaugcaauagcgcccgcc

SEQ ID NO: 2456707 - RNA, 14 nt, Bordetella pertussis
cgaugcacccaggc

SEQ ID NO: 2456708 - RNA, 17 nt, Bordetella pertussis
cgaugcacccaggcgcc

SEQ ID NO: 2456709 - RNA, 21 nt, Bordetella pertussis
cgaugcaugaaccgcagcgcc

SEQ ID NO: 2456710 - RNA, 22 nt, Bordetella pertussis
cgaugcaugaaccgcagcgcca

SEQ ID NO: 2456711 - RNA, 18 nt, Bordetella pertussis
cgaugcauucggcggccg

SEQ ID NO: 2456712 - RNA, 20 nt, Bordetella pertussis
cgaugcauucggcggccggc

SEQ ID NO: 2456713 - RNA, 15 nt, Bordetella pertussis
cgaugcccaccagcc

SEQ ID NO: 2456714 - RNA, 19 nt, Bordetella pertussis
cgaugcccaccagccgccc

SEQ ID NO: 2456715 - RNA, 20 nt, Bordetella pertussis
cgaugcccaccagccgcccg

SEQ ID NO: 2456716 - RNA, 16 nt, Bordetella pertussis
cgaugcccagcaccgc

SEQ ID NO: 2456717 - RNA, 14 nt, Bordetella pertussis
cgaugcccagcgcc

SEQ ID NO: 2456718 - RNA, 15 nt, Bordetella pertussis
cgaugcccagcgccg

SEQ ID NO: 2456719 - RNA, 16 nt, Bordetella pertussis
cgaugcccagcgccgc

SEQ ID NO: 2456720 - RNA, 17 nt, Bordetella pertussis
cgaugcccaggcccgcc

SEQ ID NO: 2456721 - RNA, 18 nt, Bordetella pertussis
cgaugcccagggccgcgc

SEQ ID NO: 2456722 - RNA, 20 nt, Bordetella pertussis
cgaugcccagggccgcgccg

SEQ ID NO: 2456723 - RNA, 21 nt, Bordetella pertussis
cgaugcccagggccgcgccgg

SEQ ID NO: 2456724 - RNA, 19 nt, Bordetella pertussis
cgaugccccaguccaggcc

SEQ ID NO: 2456725 - RNA, 22 nt, Bordetella pertussis
cgaugccccaguccaggccggc

SEQ ID NO: 2456726 - RNA, 22 nt, Bordetella pertussis
cgaugccccgguagucgccggc

SEQ ID NO: 2456727 - RNA, 14 nt, Bordetella pertussis
cgaugcccgcgcac

SEQ ID NO: 2456728 - RNA, 21 nt, Bordetella pertussis
cgaugcccgcgcaccaggcgc

SEQ ID NO: 2456729 - RNA, 17 nt, Bordetella pertussis
cgaugcccugcgccagc

SEQ ID NO: 2456730 - RNA, 22 nt, Bordetella pertussis
cgaugcccugcgccagcgccuc

SEQ ID NO: 2456731 - RNA, 14 nt, Bordetella pertussis
cgaugccgaccagg

SEQ ID NO: 2456732 - RNA, 15 nt, Bordetella pertussis
cgaugccgaccaggc

SEQ ID NO: 2456733 - RNA, 16 nt, Bordetella pertussis
cgaugccgaccaggcu

SEQ ID NO: 2456734 - RNA, 17 nt, Bordetella pertussis
cgaugccgaccaggcug

SEQ ID NO: 2456735 - RNA, 20 nt, Bordetella pertussis
cgaugccgauacgucgcagc

SEQ ID NO: 2456736 - RNA, 14 nt, Bordetella pertussis
cgaugccgccauca

SEQ ID NO: 2456737 - RNA, 19 nt, Bordetella pertussis
cgaugccgccaucauccug

SEQ ID NO: 2456738 - RNA, 23 nt, Bordetella pertussis
cgaugccgccaucauccuggucg

SEQ ID NO: 2456739 - RNA, 21 nt, Bordetella pertussis
cgaugccgccaugcgccagca

SEQ ID NO: 2456740 - RNA, 22 nt, Bordetella pertussis
cgaugccgccaugcgccagcag

SEQ ID NO: 2456741 - RNA, 15 nt, Bordetella pertussis
cgaugccgcccacgc

SEQ ID NO: 2456742 - RNA, 13 nt, Bordetella pertussis
cgaugccgcgcac

SEQ ID NO: 2456743 - RNA, 17 nt, Bordetella pertussis
cgaugccgcgcaccugg

SEQ ID NO: 2456744 - RNA, 21 nt, Bordetella pertussis
cgaugccgcgcaccugggcgu

SEQ ID NO: 2456745 - RNA, 12 nt, Bordetella pertussis
cgaugccggcca

SEQ ID NO: 2456746 - RNA, 13 nt, Bordetella pertussis
cgaugccggccag

SEQ ID NO: 2456747 - RNA, 18 nt, Bordetella pertussis
cgcaaaagcaacaaccgc

SEQ ID NO: 2456748 - RNA, 17 nt, Bordetella pertussis
cgcaaaccgacgcggcc

SEQ ID NO: 2456749 - RNA, 19 nt, Bordetella pertussis
cgcaaaccugaugccuguc

SEQ ID NO: 2456750 - RNA, 23 nt, Bordetella pertussis
cgcaaacgggggcaggccgcggu

SEQ ID NO: 2456751 - RNA, 18 nt, Bordetella pertussis
cgcaaacguggugucggc

SEQ ID NO: 2456752 - RNA, 13 nt, Bordetella pertussis
cgcaaagccggaa

SEQ ID NO: 2456753 - RNA, 13 nt, Bordetella pertussis
cgcaacacgcgcg

SEQ ID NO: 2456754 - RNA, 23 nt, Bordetella pertussis
cgcaacacgcgcgacgccguggu

SEQ ID NO: 2456755 - RNA, 20 nt, Bordetella pertussis
cgcaaccagggagccguucu

SEQ ID NO: 2456756 - RNA, 21 nt, Bordetella pertussis
cgcaaccaggggcggcgcggc

SEQ ID NO: 2456757 - RNA, 23 nt, Bordetella pertussis
cgcaaccaggggcggcgcggcgc

SEQ ID NO: 2456758 - RNA, 14 nt, Bordetella pertussis
cgcaacccaccccc

SEQ ID NO: 2456759 - RNA, 15 nt, Bordetella pertussis
cgcaacccaccccca

SEQ ID NO: 2456760 - RNA, 17 nt, Bordetella pertussis
cgcaacccacccccagc

SEQ ID NO: 2456761 - RNA, 21 nt, Bordetella pertussis
cgcaacccacccccagcagca

SEQ ID NO: 2456762 - RNA, 23 nt, Bordetella pertussis
cgcaacccacggcguggcgcgcc

SEQ ID NO: 2456763 - RNA, 15 nt, Bordetella pertussis
cgcaacccagcagcg

SEQ ID NO: 2456764 - RNA, 17 nt, Bordetella pertussis
cgcaacccagcagcggc

SEQ ID NO: 2456765 - RNA, 21 nt, Bordetella pertussis
cgcaacccagcagcggcagca

SEQ ID NO: 2456766 - RNA, 16 nt, Bordetella pertussis
cgcaaccggucggccg

SEQ ID NO: 2456767 - RNA, 23 nt, Bordetella pertussis
cgcaaccggucggccggcagcgg

SEQ ID NO: 2456768 - RNA, 17 nt, Bordetella pertussis
cgcaaccgucgaccggc

SEQ ID NO: 2456769 - RNA, 21 nt, Bordetella pertussis
cgcaaccgucgaccggcccgc

SEQ ID NO: 2456770 - RNA, 15 nt, Bordetella pertussis
cgcaacgccagcagg

SEQ ID NO: 2456771 - RNA, 13 nt, Bordetella pertussis
cgcaacgccgccc

SEQ ID NO: 2456772 - RNA, 19 nt, Bordetella pertussis
cgcaacgccgcccguccgg

SEQ ID NO: 2456773 - RNA, 23 nt, Bordetella pertussis
cgcaacgccgcccguccgggcgg

SEQ ID NO: 2456774 - RNA, 20 nt, Bordetella pertussis
cgcauacucgaugcccagca

SEQ ID NO: 2456775 - RNA, 14 nt, Bordetella pertussis
cgcauagacgccga

SEQ ID NO: 2456776 - RNA, 14 nt, Bordetella pertussis
cgcauaggacgcca

SEQ ID NO: 2456777 - RNA, 17 nt, Bordetella pertussis
cgcauaggacgccacca

SEQ ID NO: 2456778 - RNA, 19 nt, Bordetella pertussis
cgcauaggacgccaccagu

SEQ ID NO: 2456779 - RNA, 18 nt, Bordetella pertussis
cgcauauccaggcggcgc

SEQ ID NO: 2456780 - RNA, 17 nt, Bordetella pertussis
cgcauauggagccaggc

SEQ ID NO: 2456781 - RNA, 24 nt, Bordetella pertussis
cgcaucagcgcauugcgguccagg

SEQ ID NO: 2456782 - RNA, 15 nt, Bordetella pertussis
cgcaucagcgcgccc

SEQ ID NO: 2456783 - RNA, 21 nt, Bordetella pertussis
cgcaucagcgcgcccgcuucc

SEQ ID NO: 2456784 - RNA, 16 nt, Bordetella pertussis
cgcaucagcuuggcca

SEQ ID NO: 2456785 - RNA, 16 nt, Bordetella pertussis
cgcaucaugaggcggc

SEQ ID NO: 2456786 - RNA, 15 nt, Bordetella pertussis
cgcauccaggugccg

SEQ ID NO: 2456787 - RNA, 17 nt, Bordetella pertussis
cgcaucccagacagcca

SEQ ID NO: 2456788 - RNA, 19 nt, Bordetella pertussis
cgcaucccgcccccgccgc

SEQ ID NO: 2456789 - RNA, 14 nt, Bordetella pertussis
cgcaucgacagcgc

SEQ ID NO: 2456790 - RNA, 16 nt, Bordetella pertussis
cgcaucgacagcgcgc

SEQ ID NO: 2456791 - RNA, 18 nt, Bordetella pertussis
cgcaucgacagcgcgccc

SEQ ID NO: 2456792 - RNA, 23 nt, Bordetella pertussis
cgcaucgagcuccugcaggaugg

SEQ ID NO: 2456793 - RNA, 14 nt, Bordetella pertussis
cgcaucgaucagcg

SEQ ID NO: 2456794 - RNA, 17 nt, Bordetella pertussis
cgcaucgaucagcgcgc

SEQ ID NO: 2456795 - RNA, 22 nt, Bordetella pertussis
cgcaucgaucagcgcgccgucg

SEQ ID NO: 2456796 - RNA, 19 nt, Bordetella pertussis
cgcaucgaucucggccucg

SEQ ID NO: 2456797 - RNA, 16 nt, Bordetella pertussis
cgcaucgaugcggccu

SEQ ID NO: 2456798 - RNA, 19 nt, Bordetella pertussis
cgcaucgaugcggccuucg

SEQ ID NO: 2456799 - RNA, 14 nt, Bordetella pertussis
cgcaucgccgaaca

SEQ ID NO: 2456800 - RNA, 18 nt, Bordetella pertussis
cgcaucgccgcaggcgug

SEQ ID NO: 2456801 - RNA, 19 nt, Bordetella pertussis
cgcaucgcgaccgccaagc

SEQ ID NO: 2456802 - RNA, 17 nt, Bordetella pertussis
cgcaucgcgaugcgcag

SEQ ID NO: 2456803 - RNA, 19 nt, Bordetella pertussis
cgcaucgcgaugcgcagca

SEQ ID NO: 2456804 - RNA, 14 nt, Bordetella pertussis
cgcaucgcgcaccc

SEQ ID NO: 2456805 - RNA, 14 nt, Bordetella pertussis
cgcaucgcgcagcg

SEQ ID NO: 2456806 - RNA, 22 nt, Bordetella pertussis
cgcaucgcgcagcgugcggacc

SEQ ID NO: 2456807 - RNA, 13 nt, Bordetella pertussis
cgcaucgcgcgcc

SEQ ID NO: 2456808 - RNA, 16 nt, Bordetella pertussis
cgcaucgcgcgccgcc

SEQ ID NO: 2456809 - RNA, 17 nt, Bordetella pertussis
cgcaucgcgcgccgccg

SEQ ID NO: 2456810 - RNA, 18 nt, Bordetella pertussis
cgcaucgcgcgccgccgc

SEQ ID NO: 2456811 - RNA, 19 nt, Bordetella pertussis
cgcaucgcgcgcgccggca

SEQ ID NO: 2456812 - RNA, 21 nt, Bordetella pertussis
cgcaucgcgcgcgccggcauc

SEQ ID NO: 2456813 - RNA, 14 nt, Bordetella pertussis
cgcaucgcgcggca

SEQ ID NO: 2456814 - RNA, 16 nt, Bordetella pertussis
cgcaucgcggcagccc

SEQ ID NO: 2456815 - RNA, 22 nt, Bordetella pertussis
cgcaucgcggcagcccggcacg

SEQ ID NO: 2456816 - RNA, 24 nt, Bordetella pertussis
cgcaucggccaggcgccugagccg

SEQ ID NO: 2456817 - RNA, 12 nt, Bordetella pertussis
cgcaucggccgg

SEQ ID NO: 2456818 - RNA, 14 nt, Bordetella pertussis
cgcaucggccggau

SEQ ID NO: 2456819 - RNA, 16 nt, Bordetella pertussis
cgcaucggcgccgagc

SEQ ID NO: 2456820 - RNA, 15 nt, Bordetella pertussis
cgcaucggcgccggc

SEQ ID NO: 2456821 - RNA, 13 nt, Bordetella pertussis
cgcaucggcggca

SEQ ID NO: 2456822 - RNA, 16 nt, Bordetella pertussis
cgcaucggcguaccag

SEQ ID NO: 2456823 - RNA, 21 nt, Bordetella pertussis
cgcaucggcguaccaggcagc

SEQ ID NO: 2456824 - RNA, 14 nt, Bordetella pertussis
cgcaucggcuggcg

SEQ ID NO: 2456825 - RNA, 17 nt, Bordetella pertussis
cgcaucgucaggcaggc

SEQ ID NO: 2456826 - RNA, 14 nt, Bordetella pertussis
cgcaugaccugcag

SEQ ID NO: 2456827 - RNA, 20 nt, Bordetella pertussis
cgcaugaccugcgacagcac

SEQ ID NO: 2456828 - RNA, 21 nt, Bordetella pertussis
cgcaugaccugcgacagcacc

SEQ ID NO: 2456829 - RNA, 19 nt, Bordetella pertussis
cgcaugacgaggugccugu

SEQ ID NO: 2456830 - RNA, 14 nt, Bordetella pertussis
cgcaugacggcguc

SEQ ID NO: 2456831 - RNA, 22 nt, Bordetella pertussis
cgcaugacggcgucgagcacgc

SEQ ID NO: 2456832 - RNA, 23 nt, Bordetella pertussis
cgcaugacggcgucgagcacgcg

SEQ ID NO: 2456833 - RNA, 14 nt, Bordetella pertussis
cgcaugagccggca

SEQ ID NO: 2456834 - RNA, 17 nt, Bordetella pertussis
cgcaugauggccggccu

SEQ ID NO: 2456835 - RNA, 18 nt, Bordetella pertussis
cgcaugauggccggccug

SEQ ID NO: 2456836 - RNA, 21 nt, Bordetella pertussis
cgcaugauuccugucgcgcug

SEQ ID NO: 2456837 - RNA, 23 nt, Bordetella pertussis
cgcaugauuccugucgcgcugcu

SEQ ID NO: 2456838 - RNA, 19 nt, Bordetella pertussis
cgcaugcaagacaggccgc

SEQ ID NO: 2456839 - RNA, 21 nt, Bordetella pertussis
cgcaugcaagacaggccgcua

SEQ ID NO: 2456840 - RNA, 23 nt, Bordetella pertussis
cgcaugcaagacaggccgcuacg

SEQ ID NO: 2456841 - RNA, 16 nt, Bordetella pertussis
cgcaugcagccgcaau

SEQ ID NO: 2456842 - RNA, 15 nt, Bordetella pertussis
cgcaugccagcuugc

SEQ ID NO: 2456843 - RNA, 21 nt, Bordetella pertussis
cgcaugccagcuugcaggcgc

SEQ ID NO: 2456844 - RNA, 16 nt, Bordetella pertussis
cgcaugcccgaccgca

SEQ ID NO: 2456845 - RNA, 18 nt, Bordetella pertussis
cgcaugcccgaccgcaug

SEQ ID NO: 2456846 - RNA, 19 nt, Bordetella pertussis
cgcaugcgacaugagcugc

SEQ ID NO: 2456847 - RNA, 13 nt, Bordetella pertussis
cgcaugcgccugu

SEQ ID NO: 2456848 - RNA, 14 nt, Bordetella pertussis
cgcaugcgccuguc

SEQ ID NO: 2456849 - RNA, 18 nt, Bordetella pertussis
cgcaugcggcggcugugg

SEQ ID NO: 2456850 - RNA, 18 nt, Bordetella pertussis
cgcaugcgguuucucagc

SEQ ID NO: 2456851 - RNA, 17 nt, Bordetella pertussis
cgcaugcgugcgcauca

SEQ ID NO: 2456852 - RNA, 22 nt, Bordetella pertussis
cgcaugcugcagcugcuugccc

SEQ ID NO: 2456853 - RNA, 22 nt, Bordetella pertussis
cgcauggaaccgguuggccagc

SEQ ID NO: 2456854 - RNA, 16 nt, Bordetella pertussis
cgcauggaccgccgcc

SEQ ID NO: 2456855 - RNA, 21 nt, Bordetella pertussis
cgcauggaccgccgccgucgc

SEQ ID NO: 2456856 - RNA, 18 nt, Bordetella pertussis
cgcauggagaccggcgcc

SEQ ID NO: 2456857 - RNA, 18 nt, Bordetella pertussis
cgcauggccagcgcgcag

SEQ ID NO: 2456858 - RNA, 19 nt, Bordetella pertussis
cgcauggccagcgcgcagg

SEQ ID NO: 2456859 - RNA, 22 nt, Bordetella pertussis
cgcauggccgguucgaugaccu

SEQ ID NO: 2456860 - RNA, 15 nt, Bordetella pertussis
cgcauggcgaugacc

SEQ ID NO: 2456861 - RNA, 19 nt, Bordetella pertussis
cgcauggcgaugaccucgg

SEQ ID NO: 2456862 - RNA, 22 nt, Bordetella pertussis
cgcauggcgaugaccucggcga

SEQ ID NO: 2456863 - RNA, 19 nt, Bordetella pertussis
cgcaugggaaauccgccgg

SEQ ID NO: 2456864 - RNA, 14 nt, Bordetella pertussis
cgcaugggccaggc

SEQ ID NO: 2456865 - RNA, 16 nt, Bordetella pertussis
cgcaugggccaggcgc

SEQ ID NO: 2456866 - RNA, 20 nt, Bordetella pertussis
cgcaugggcgcaggccgcca

SEQ ID NO: 2456867 - RNA, 21 nt, Bordetella pertussis
cgcaugggcgccgagggccgc

SEQ ID NO: 2456868 - RNA, 16 nt, Bordetella pertussis
cgcaugggcgcgcccg

SEQ ID NO: 2456869 - RNA, 18 nt, Bordetella pertussis
cgcaugggcgcgcccggc

SEQ ID NO: 2456870 - RNA, 21 nt, Bordetella pertussis
cgcauggggacuggcgccugc

SEQ ID NO: 2456871 - RNA, 23 nt, Bordetella pertussis
cgcaugggggcuggcgcuugccc

SEQ ID NO: 2456872 - RNA, 15 nt, Bordetella pertussis
cgcauggugagggcc

SEQ ID NO: 2456873 - RNA, 17 nt, Bordetella pertussis
cgcaugguggcgcaggc

SEQ ID NO: 2456874 - RNA, 15 nt, Bordetella pertussis
cgcaugucagcgccu

SEQ ID NO: 2456875 - RNA, 17 nt, Bordetella pertussis
cgcaugucagcgccugg

SEQ ID NO: 2456876 - RNA, 18 nt, Bordetella pertussis
cgcaugucagcgccuggc

SEQ ID NO: 2456877 - RNA, 16 nt, Bordetella pertussis
cgcaugucccagcgcu

SEQ ID NO: 2456878 - RNA, 18 nt, Bordetella pertussis
cgcaugucccgcaugacc

SEQ ID NO: 2456879 - RNA, 17 nt, Bordetella pertussis
cgcauguccgccacgcc

SEQ ID NO: 2456880 - RNA, 19 nt, Bordetella pertussis
cgcauguccgccacgccgg

SEQ ID NO: 2456881 - RNA, 17 nt, Bordetella pertussis
cgcaccagcgaggcggc

SEQ ID NO: 2456882 - RNA, 13 nt, Bordetella pertussis
cgcaccagcgcau

SEQ ID NO: 2456883 - RNA, 20 nt, Bordetella pertussis
cgcaccagcgcauugccgcc

SEQ ID NO: 2456884 - RNA, 14 nt, Bordetella pertussis
cgcaccagcgccga

SEQ ID NO: 2456885 - RNA, 13 nt, Bordetella pertussis
cgcaccagcgcgc

SEQ ID NO: 2456886 - RNA, 14 nt, Bordetella pertussis
cgcaccagcgcgcc

SEQ ID NO: 2456887 - RNA, 22 nt, Bordetella pertussis
cgcaccagcgcgccgaucacca

SEQ ID NO: 2456888 - RNA, 13 nt, Bordetella pertussis
cgcaccagcggcg

SEQ ID NO: 2456889 - RNA, 16 nt, Bordetella pertussis
cgcaccagcuuggccu

SEQ ID NO: 2456890 - RNA, 12 nt, Bordetella pertussis
cgcaccaggccc

SEQ ID NO: 2456891 - RNA, 13 nt, Bordetella pertussis
cgcaccaggccca

SEQ ID NO: 2456892 - RNA, 16 nt, Bordetella pertussis
cgcaccaggcccauga

SEQ ID NO: 2456893 - RNA, 23 nt, Bordetella pertussis
cgcaccaggcccaugaaggcggc

SEQ ID NO: 2456894 - RNA, 14 nt, Bordetella pertussis
cgcaccaggccgcg

SEQ ID NO: 2456895 - RNA, 16 nt, Bordetella pertussis
cgcaccaggccgcggc

SEQ ID NO: 2456896 - RNA, 19 nt, Bordetella pertussis
cgcaccaggccgcggcgcc

SEQ ID NO: 2456897 - RNA, 20 nt, Bordetella pertussis
cgcaccaggccgcggcgccc

SEQ ID NO: 2456898 - RNA, 14 nt, Bordetella pertussis
cgcaccaggccugc

SEQ ID NO: 2456899 - RNA, 17 nt, Bordetella pertussis
cgcaccaggccugccug

SEQ ID NO: 2456900 - RNA, 13 nt, Bordetella pertussis
cgcaccaggcgcg

SEQ ID NO: 2456901 - RNA, 18 nt, Bordetella pertussis
cgcaccaggcuggggccg

SEQ ID NO: 2456902 - RNA, 22 nt, Bordetella pertussis
cgcaccaggcuggggccgagcg

SEQ ID NO: 2456903 - RNA, 22 nt, Bordetella pertussis
cgcaggaaguucagggcgaacu

SEQ ID NO: 2456904 - RNA, 15 nt, Bordetella pertussis
cgcaggacaaggcgc

SEQ ID NO: 2456905 - RNA, 13 nt, Bordetella pertussis
cgcaggacggcgc

SEQ ID NO: 2456906 - RNA, 23 nt, Bordetella pertussis
cgcaggaucagcuugaugccggc

SEQ ID NO: 2456907 - RNA, 13 nt, Bordetella pertussis
cgcaggaugcgcu

SEQ ID NO: 2456908 - RNA, 20 nt, Bordetella pertussis
cgcaggaugcgcuggccggc

SEQ ID NO: 2456909 - RNA, 24 nt, Bordetella pertussis
cgcaggcaagcugcuggcgcgcca

SEQ ID NO: 2456910 - RNA, 20 nt, Bordetella pertussis
cgcaggcaguuggcggcgca

SEQ ID NO: 2456911 - RNA, 22 nt, Bordetella pertussis
cgcaggcaguuggcggcgcagc

SEQ ID NO: 2456912 - RNA, 19 nt, Bordetella pertussis
cgcaggcauugcgccagcc

SEQ ID NO: 2456913 - RNA, 21 nt, Bordetella pertussis
cgcaggcauugcgccagccgu

SEQ ID NO: 2456914 - RNA, 14 nt, Bordetella pertussis
cgcaggccagcccg

SEQ ID NO: 2456915 - RNA, 17 nt, Bordetella pertussis
cgcaggccagcccgcgc

SEQ ID NO: 2456916 - RNA, 14 nt, Bordetella pertussis
cgcaggccagcgcc

SEQ ID NO: 2456917 - RNA, 15 nt, Bordetella pertussis
cgcaggccagcgccg

SEQ ID NO: 2456918 - RNA, 16 nt, Bordetella pertussis
cgcaggcccagccagc

SEQ ID NO: 2456919 - RNA, 13 nt, Bordetella pertussis
cgcaggcccgaca

SEQ ID NO: 2456920 - RNA, 22 nt, Bordetella pertussis
cgcaggcccgacaggaucgaag

SEQ ID NO: 2456921 - RNA, 21 nt, Bordetella pertussis
cgcaggcccuugaucaggcgc

SEQ ID NO: 2456922 - RNA, 14 nt, Bordetella pertussis
cgcaggccgacgcg

SEQ ID NO: 2456923 - RNA, 15 nt, Bordetella pertussis
cgcaggccgacgcgc

SEQ ID NO: 2456924 - RNA, 18 nt, Bordetella pertussis
cgcaggccgacgcgcugu

SEQ ID NO: 2456925 - RNA, 12 nt, Bordetella pertussis
cgcaggccgcca

SEQ ID NO: 2456926 - RNA, 15 nt, Bordetella pertussis
cgcaggccgccacuu

SEQ ID NO: 2456927 - RNA, 14 nt, Bordetella pertussis
cgcaggccgcgccg

SEQ ID NO: 2456928 - RNA, 16 nt, Bordetella pertussis
cgcaggccgcgccggc

SEQ ID NO: 2456929 - RNA, 17 nt, Bordetella pertussis
cgcaggccgcgccggcu

SEQ ID NO: 2456930 - RNA, 15 nt, Bordetella pertussis
cgcaggccgcgcgca

SEQ ID NO: 2456931 - RNA, 17 nt, Bordetella pertussis
cgcaggccgcggccagg

SEQ ID NO: 2456932 - RNA, 21 nt, Bordetella pertussis
cgcaggccgcggccaggccca

SEQ ID NO: 2456933 - RNA, 14 nt, Bordetella pertussis
cgcaggccggcggc

SEQ ID NO: 2456934 - RNA, 15 nt, Bordetella pertussis
cgcaggccggcggcc

SEQ ID NO: 2456935 - RNA, 13 nt, Bordetella pertussis
cgcaggccugcgg

SEQ ID NO: 2456936 - RNA, 16 nt, Bordetella pertussis
cgcaggccugcggcga

SEQ ID NO: 2456937 - RNA, 12 nt, Bordetella pertussis
cgcaggccugcu

SEQ ID NO: 2456938 - RNA, 18 nt, Bordetella pertussis
cgcaggccugcugcagcg

SEQ ID NO: 2456939 - RNA, 16 nt, Bordetella pertussis
cgcaggccuucgucga

SEQ ID NO: 2456940 - RNA, 13 nt, Bordetella pertussis
cgcaggcgccgca

SEQ ID NO: 2456941 - RNA, 17 nt, Bordetella pertussis
cgcaggcgccgcacccg

SEQ ID NO: 2456942 - RNA, 14 nt, Bordetella pertussis
cgcaggcgccgcag

SEQ ID NO: 2456943 - RNA, 15 nt, Bordetella pertussis
cgcaggcgccgcagu

SEQ ID NO: 2456944 - RNA, 15 nt, Bordetella pertussis
cgcaggcgccgcccc

SEQ ID NO: 2456945 - RNA, 12 nt, Bordetella pertussis
cgcaggcgcgcc

SEQ ID NO: 2456946 - RNA, 13 nt, Bordetella pertussis
cgcaggcgcgcgc

SEQ ID NO: 2456947 - RNA, 14 nt, Bordetella pertussis
cgcaggcgcgcgcc

SEQ ID NO: 2456948 - RNA, 16 nt, Bordetella pertussis
cgcaggcgcguggcca

SEQ ID NO: 2456949 - RNA, 18 nt, Bordetella pertussis
cgcaggcgcguggccacg

SEQ ID NO: 2456950 - RNA, 15 nt, Bordetella pertussis
cgcaggcgcucgagg

SEQ ID NO: 2456951 - RNA, 13 nt, Bordetella pertussis
cgcaggcgcugca

SEQ ID NO: 2456952 - RNA, 13 nt, Bordetella pertussis
cgcaggcggcggc

SEQ ID NO: 2456953 - RNA, 17 nt, Bordetella pertussis
cgcaggcggcggccucc

SEQ ID NO: 2456954 - RNA, 20 nt, Bordetella pertussis
cgcaggcggcggccuccagc

SEQ ID NO: 2456955 - RNA, 23 nt, Bordetella pertussis
cgcaggcggcuggugccgacggc

SEQ ID NO: 2456956 - RNA, 14 nt, Bordetella pertussis
cgcaggcgggccuc

SEQ ID NO: 2456957 - RNA, 15 nt, Bordetella pertussis
cgcaggcgggccucg

SEQ ID NO: 2456958 - RNA, 21 nt, Bordetella pertussis
cgcaggcgggcgauauccauc

SEQ ID NO: 2456959 - RNA, 17 nt, Bordetella pertussis
cgcaggcgggcgccgcg

SEQ ID NO: 2456960 - RNA, 18 nt, Bordetella pertussis
cgcaggcgggcgccgcgc

SEQ ID NO: 2456961 - RNA, 13 nt, Bordetella pertussis
cgcaggcgugccc

SEQ ID NO: 2456962 - RNA, 16 nt, Bordetella pertussis
cgcaggcgugcccuug

SEQ ID NO: 2456963 - RNA, 18 nt, Bordetella pertussis
cgcaggcgugcgcgggcg

SEQ ID NO: 2456964 - RNA, 19 nt, Bordetella pertussis
cgcaggcgugcgcgggcgc

SEQ ID NO: 2456965 - RNA, 18 nt, Bordetella pertussis
cgcaggcguuucgccagg

SEQ ID NO: 2456966 - RNA, 13 nt, Bordetella pertussis
cgcaggcugucga

SEQ ID NO: 2456967 - RNA, 13 nt, Bordetella pertussis
cgcagggacaggc

SEQ ID NO: 2456968 - RNA, 14 nt, Bordetella pertussis
cgcagggacaggcu

SEQ ID NO: 2456969 - RNA, 14 nt, Bordetella pertussis
cgcagggcauacau

SEQ ID NO: 2456970 - RNA, 23 nt, Bordetella pertussis
cgcagggcgaacguggccugcuu

SEQ ID NO: 2456971 - RNA, 15 nt, Bordetella pertussis
cgcagggcggccggc

SEQ ID NO: 2456972 - RNA, 17 nt, Bordetella pertussis
cgcagggcggccggcac

SEQ ID NO: 2456973 - RNA, 15 nt, Bordetella pertussis
cgcagggcggccucg

SEQ ID NO: 2456974 - RNA, 20 nt, Bordetella pertussis
cgcagggugcggggugccug

SEQ ID NO: 2456975 - RNA, 16 nt, Bordetella pertussis
cgcaggguuuccgaca

SEQ ID NO: 2456976 - RNA, 23 nt, Bordetella pertussis
cgcaggguuuccgacaccgucag

SEQ ID NO: 2456977 - RNA, 19 nt, Bordetella pertussis
cgcagguauuccgccguca

SEQ ID NO: 2456978 - RNA, 16 nt, Bordetella pertussis
cgcagguccaggccug

SEQ ID NO: 2456979 - RNA, 12 nt, Bordetella pertussis
cgcaggucggcc

SEQ ID NO: 2456980 - RNA, 13 nt, Bordetella pertussis
cgcaggucggcca

SEQ ID NO: 2456981 - RNA, 15 nt, Bordetella pertussis
cgcaggucguggccg

SEQ ID NO: 2456982 - RNA, 14 nt, Bordetella pertussis
cgcaggugccuguc

SEQ ID NO: 2456983 - RNA, 16 nt, Bordetella pertussis
cgcaggugccuguccc

SEQ ID NO: 2456984 - RNA, 16 nt, Bordetella pertussis
cgcagguggggcagca

SEQ ID NO: 2456985 - RNA, 19 nt, Bordetella pertussis
cgcagguggggcagcaggc

SEQ ID NO: 2456986 - RNA, 20 nt, Bordetella pertussis
cgcagguggggcagcaggcc

SEQ ID NO: 2456987 - RNA, 21 nt, Bordetella pertussis
cgcagguggggcagcaggccg

SEQ ID NO: 2456988 - RNA, 20 nt, Bordetella pertussis
cgcagguucaucgagaacac

SEQ ID NO: 2456989 - RNA, 20 nt, Bordetella pertussis
cgcaguacccggugcagcgu

SEQ ID NO: 2456990 - RNA, 22 nt, Bordetella pertussis
cgcaguacccggugcagcgugg

SEQ ID NO: 2456991 - RNA, 18 nt, Bordetella pertussis
cgcaguaucccggccagg

SEQ ID NO: 2456992 - RNA, 21 nt, Bordetella pertussis
cgcaguaucccggccaggcgc

SEQ ID NO: 2456993 - RNA, 23 nt, Bordetella pertussis
cgcaguaucccggccaggcgccg

SEQ ID NO: 2456994 - RNA, 22 nt, Bordetella pertussis
cgcaguccaaggaaagcccggc

SEQ ID NO: 2456995 - RNA, 21 nt, Bordetella pertussis
cgcagucccaguccggcagca

SEQ ID NO: 2456996 - RNA, 17 nt, Bordetella pertussis
cgcaguccugcgaucag

SEQ ID NO: 2456997 - RNA, 16 nt, Bordetella pertussis
cgcagucgagcaccgc

SEQ ID NO: 2456998 - RNA, 17 nt, Bordetella pertussis
cgcagucgagcaccgcg

SEQ ID NO: 2456999 - RNA, 19 nt, Bordetella pertussis
cgcagucgagcaccgcgcg

SEQ ID NO: 2457000 - RNA, 14 nt, Bordetella pertussis
cgcagucggggccg

SEQ ID NO: 2457001 - RNA, 13 nt, Bordetella pertussis
cgcaguggaaauc

SEQ ID NO: 2457002 - RNA, 13 nt, Bordetella pertussis
cgcaguggcgagg

SEQ ID NO: 2457003 - RNA, 15 nt, Bordetella pertussis
cgcaguuccggcggg

SEQ ID NO: 2457004 - RNA, 18 nt, Bordetella pertussis
cgcaguuccggcgggccg

SEQ ID NO: 2457005 - RNA, 23 nt, Bordetella pertussis
cgcaguuccggcgggccgcauga

SEQ ID NO: 2457006 - RNA, 15 nt, Bordetella pertussis
cgccacgcgcacggc

SEQ ID NO: 2457007 - RNA, 18 nt, Bordetella pertussis
cgccacgcgcacggccag

SEQ ID NO: 2457008 - RNA, 21 nt, Bordetella pertussis
cgccacgcgcacggccagcau

SEQ ID NO: 2457009 - RNA, 12 nt, Bordetella pertussis
cgccacgcgcgg

SEQ ID NO: 2457010 - RNA, 22 nt, Bordetella pertussis
cgccacgcgcggaucggccacg

SEQ ID NO: 2457011 - RNA, 19 nt, Bordetella pertussis
cgccaggcgcgaucgaacg

SEQ ID NO: 2457012 - RNA, 20 nt, Bordetella pertussis
cgccaggcgcgcaucgcgcg

SEQ ID NO: 2457013 - RNA, 22 nt, Bordetella pertussis
cgccaggcgcgcaucgcgcggc

SEQ ID NO: 2457014 - RNA, 23 nt, Bordetella pertussis
cgccaggcgcgcaucgcgcggca

SEQ ID NO: 2457015 - RNA, 14 nt, Bordetella pertussis
cgccaggcgcucgg

SEQ ID NO: 2457016 - RNA, 17 nt, Bordetella pertussis
cgccaggcgcucggcgu

SEQ ID NO: 2457017 - RNA, 24 nt, Bordetella pertussis
cgccaggcgcucggcguugcuggc

SEQ ID NO: 2457018 - RNA, 14 nt, Bordetella pertussis
cgccaggcgcugcg

SEQ ID NO: 2457019 - RNA, 16 nt, Bordetella pertussis
cgccaggcgcugcgcg

SEQ ID NO: 2457020 - RNA, 18 nt, Bordetella pertussis
cgccaggcgguacaggcc

SEQ ID NO: 2457021 - RNA, 20 nt, Bordetella pertussis
cgccaggcgguacaggccgg

SEQ ID NO: 2457022 - RNA, 22 nt, Bordetella pertussis
cgccaggcgguacaggccggcg

SEQ ID NO: 2457023 - RNA, 23 nt, Bordetella pertussis
cgccaggcgguacaggccggcgg

SEQ ID NO: 2457024 - RNA, 22 nt, Bordetella pertussis
cgccaggcguagaccaccugcu

SEQ ID NO: 2457025 - RNA, 15 nt, Bordetella pertussis
cgccaggcguugacc

SEQ ID NO: 2457026 - RNA, 19 nt, Bordetella pertussis
cgccaggcguugaccuggu

SEQ ID NO: 2457027 - RNA, 12 nt, Bordetella pertussis
cgcccagcuuga

SEQ ID NO: 2457028 - RNA, 15 nt, Bordetella pertussis
cgcccagcuugagau

SEQ ID NO: 2457029 - RNA, 20 nt, Bordetella pertussis
cgcccagcuugaugccgccg

SEQ ID NO: 2457030 - RNA, 21 nt, Bordetella pertussis
cgcccagcuugaugccgccga

SEQ ID NO: 2457031 - RNA, 15 nt, Bordetella pertussis
cgcccaggaaggcga

SEQ ID NO: 2457032 - RNA, 17 nt, Bordetella pertussis
cgcccaggaaggcgaaa

SEQ ID NO: 2457033 - RNA, 17 nt, Bordetella pertussis
cgcccaggccagccagg

SEQ ID NO: 2457034 - RNA, 12 nt, Bordetella pertussis
cgcccaggccca

SEQ ID NO: 2457035 - RNA, 22 nt, Bordetella pertussis
cgcccaggcccaccgcaucgcg

SEQ ID NO: 2457036 - RNA, 15 nt, Bordetella pertussis
cgcccaggcccagca

SEQ ID NO: 2457037 - RNA, 22 nt, Bordetella pertussis
cgcccaggcccagcaucaggcc

SEQ ID NO: 2457038 - RNA, 17 nt, Bordetella pertussis
cgcccaggcccagcgcg

SEQ ID NO: 2457039 - RNA, 18 nt, Bordetella pertussis
cgcccaggcccagcgcgc

SEQ ID NO: 2457040 - RNA, 19 nt, Bordetella pertussis
cgcccaggcccagcgcgcc

SEQ ID NO: 2457041 - RNA, 20 nt, Bordetella pertussis
cgcccaggcccagcgcgcca

SEQ ID NO: 2457042 - RNA, 16 nt, Bordetella pertussis
cgcccaggccgaucag

SEQ ID NO: 2457043 - RNA, 13 nt, Bordetella pertussis
cgcccaggccggg

SEQ ID NO: 2457044 - RNA, 16 nt, Bordetella pertussis
cgcccaggccgggcga

SEQ ID NO: 2457045 - RNA, 20 nt, Bordetella pertussis
cgcccaggccgggcgagccg

SEQ ID NO: 2457046 - RNA, 15 nt, Bordetella pertussis
cgcccaggccguggc

SEQ ID NO: 2457047 - RNA, 19 nt, Bordetella pertussis
cgcccaggccguggcgcac

SEQ ID NO: 2457048 - RNA, 20 nt, Bordetella pertussis
cgcccaggccguggcgcacc

SEQ ID NO: 2457049 - RNA, 15 nt, Bordetella pertussis
cgcccaggcgaugcc

SEQ ID NO: 2457050 - RNA, 16 nt, Bordetella pertussis
cgcccaggcgaugccc

SEQ ID NO: 2457051 - RNA, 22 nt, Bordetella pertussis
cgcccaggcgaugcccagcgcc

SEQ ID NO: 2457052 - RNA, 14 nt, Bordetella pertussis
cgcccaggcgcagc

SEQ ID NO: 2457053 - RNA, 16 nt, Bordetella pertussis
cgcccaggcgcagccc

SEQ ID NO: 2457054 - RNA, 19 nt, Bordetella pertussis
cgcccaggcgcagccgcgc

SEQ ID NO: 2457055 - RNA, 15 nt, Bordetella pertussis
cgcccaggggccggc

SEQ ID NO: 2457056 - RNA, 17 nt, Bordetella pertussis
cgcccaggggccggcgc

SEQ ID NO: 2457057 - RNA, 19 nt, Bordetella pertussis
cgcccagggugguggccuc

SEQ ID NO: 2457058 - RNA, 12 nt, Bordetella pertussis
cgcccagguaca

SEQ ID NO: 2457059 - RNA, 18 nt, Bordetella pertussis
cgcccagguccugcgcca

SEQ ID NO: 2457060 - RNA, 20 nt, Bordetella pertussis
cgcccagguccugcgccagc

SEQ ID NO: 2457061 - RNA, 20 nt, Bordetella pertussis
cgcccaggucggacgcgccg

SEQ ID NO: 2457062 - RNA, 21 nt, Bordetella pertussis
cgcccaggugcgggagccggc

SEQ ID NO: 2457063 - RNA, 19 nt, Bordetella pertussis
cgcccagguugcggccgcc

SEQ ID NO: 2457064 - RNA, 23 nt, Bordetella pertussis
cgcccaguauggugaccggcgug

SEQ ID NO: 2457065 - RNA, 15 nt, Bordetella pertussis
cgcccagucccaggc

SEQ ID NO: 2457066 - RNA, 20 nt, Bordetella pertussis
cgcccagucccaggccgacc

SEQ ID NO: 2457067 - RNA, 21 nt, Bordetella pertussis
cgcccagucguccagcacgcg

SEQ ID NO: 2457068 - RNA, 20 nt, Bordetella pertussis
cgcccaguuccacgcggccg

SEQ ID NO: 2457069 - RNA, 22 nt, Bordetella pertussis
cgcccaguuccacgcggccgug

SEQ ID NO: 2457070 - RNA, 20 nt, Bordetella pertussis
cgcccaucucggccgcggcg

SEQ ID NO: 2457071 - RNA, 23 nt, Bordetella pertussis
cgcccaucucggccgcggcguug

SEQ ID NO: 2457072 - RNA, 20 nt, Bordetella pertussis
cgcccaugauggugccggug

SEQ ID NO: 2457073 - RNA, 16 nt, Bordetella pertussis
cgcccaugccgccggg

SEQ ID NO: 2457074 - RNA, 12 nt, Bordetella pertussis
cgcccaugcgau

SEQ ID NO: 2457075 - RNA, 17 nt, Bordetella pertussis
cgcccaugcgaucggcc

SEQ ID NO: 2457076 - RNA, 19 nt, Bordetella pertussis
cgcccaugcgcauggccag

SEQ ID NO: 2457077 - RNA, 17 nt, Bordetella pertussis
cgcccaugcgcuggcgc

SEQ ID NO: 2457078 - RNA, 14 nt, Bordetella pertussis
cgcccaugcgggcg

SEQ ID NO: 2457079 - RNA, 15 nt, Bordetella pertussis
cgcccaugcgggcgu

SEQ ID NO: 2457080 - RNA, 23 nt, Bordetella pertussis
cgcccaugcgggcguagaaagcc

SEQ ID NO: 2457081 - RNA, 21 nt, Bordetella pertussis
cgcccaugcugaauugcgggc

SEQ ID NO: 2457082 - RNA, 22 nt, Bordetella pertussis
cgcccaugcugaauugcgggcc

SEQ ID NO: 2457083 - RNA, 12 nt, Bordetella pertussis
cgcccauggcgc

SEQ ID NO: 2457084 - RNA, 13 nt, Bordetella pertussis
cgcccauggcgcg

SEQ ID NO: 2457085 - RNA, 14 nt, Bordetella pertussis
cgcccauggcgcgc

SEQ ID NO: 2457086 - RNA, 15 nt, Bordetella pertussis
cgcccauggcgcgca

SEQ ID NO: 2457087 - RNA, 16 nt, Bordetella pertussis
cgcccauggcgcgcag

SEQ ID NO: 2457088 - RNA, 17 nt, Bordetella pertussis
cgcccauggcgcgcagc

SEQ ID NO: 2457089 - RNA, 20 nt, Bordetella pertussis
cgcccauguagaacgccagg

SEQ ID NO: 2457090 - RNA, 21 nt, Bordetella pertussis
cgcccauguagaacgccaggg

SEQ ID NO: 2457091 - RNA, 17 nt, Bordetella pertussis
cgcccauuccgagcggg

SEQ ID NO: 2457092 - RNA, 19 nt, Bordetella pertussis
cgcccauuccgagcgggcc

SEQ ID NO: 2457093 - RNA, 16 nt, Bordetella pertussis
cgcccauugcggcggg

SEQ ID NO: 2457094 - RNA, 16 nt, Bordetella pertussis
cgcccauuucgauggc

SEQ ID NO: 2457095 - RNA, 16 nt, Bordetella pertussis
cgccccaacgcggcca

SEQ ID NO: 2457096 - RNA, 13 nt, Bordetella pertussis
cgccccaacggcc

SEQ ID NO: 2457097 - RNA, 13 nt, Bordetella pertussis
cgccccacccggg

SEQ ID NO: 2457098 - RNA, 20 nt, Bordetella pertussis
cgccccagagcaccgagacc

SEQ ID NO: 2457099 - RNA, 12 nt, Bordetella pertussis
cgccccagcagc

SEQ ID NO: 2457100 - RNA, 19 nt, Bordetella pertussis
cgccccaggcgucggcggc

SEQ ID NO: 2457101 - RNA, 20 nt, Bordetella pertussis
cgccccaggcgucggcggcc

SEQ ID NO: 2457102 - RNA, 21 nt, Bordetella pertussis
cgccccaguugcgcguccagg

SEQ ID NO: 2457103 - RNA, 17 nt, Bordetella pertussis
cgccccauccacggcgc

SEQ ID NO: 2457104 - RNA, 17 nt, Bordetella pertussis
cgccccauugggacgcc

SEQ ID NO: 2457105 - RNA, 20 nt, Bordetella pertussis
cgccccauugggacgccagc

SEQ ID NO: 2457106 - RNA, 14 nt, Bordetella pertussis
cgcccccagcgcgc

SEQ ID NO: 2457107 - RNA, 15 nt, Bordetella pertussis
cgcccccagcgcgcc

SEQ ID NO: 2457108 - RNA, 20 nt, Bordetella pertussis
cgcccccagcgcgccugccc

SEQ ID NO: 2457109 - RNA, 14 nt, Bordetella pertussis
cgcccccgaaggcc

SEQ ID NO: 2457110 - RNA, 18 nt, Bordetella pertussis
cgcccccgaaggccgcgc

SEQ ID NO: 2457111 - RNA, 19 nt, Bordetella pertussis
cgcccccgaaggccgcgcc

SEQ ID NO: 2457112 - RNA, 20 nt, Bordetella pertussis
cgcccccgaaggccgcgccu

SEQ ID NO: 2457113 - RNA, 15 nt, Bordetella pertussis
cgcccccgcccagca

SEQ ID NO: 2457114 - RNA, 16 nt, Bordetella pertussis
cgcccccgccgcacgg

SEQ ID NO: 2457115 - RNA, 15 nt, Bordetella pertussis
cgcccccgccgccau

SEQ ID NO: 2457116 - RNA, 16 nt, Bordetella pertussis
cgcccccgcgccgcgc

SEQ ID NO: 2457117 - RNA, 13 nt, Bordetella pertussis
cgcccccgcggcg

SEQ ID NO: 2457118 - RNA, 16 nt, Bordetella pertussis
cgccccgacccuguac

SEQ ID NO: 2457119 - RNA, 15 nt, Bordetella pertussis
cgccccgacgcgcuu

SEQ ID NO: 2457120 - RNA, 12 nt, Bordetella pertussis
cgccccgaucag

SEQ ID NO: 2457121 - RNA, 13 nt, Bordetella pertussis
cgccccgaucggc

SEQ ID NO: 2457122 - RNA, 18 nt, Bordetella pertussis
cgccccgaucggcgccgc

SEQ ID NO: 2457123 - RNA, 20 nt, Bordetella pertussis
cgccccgaucggcgccgcgc

SEQ ID NO: 2457124 - RNA, 15 nt, Bordetella pertussis
cgccccgccaugcgc

SEQ ID NO: 2457125 - RNA, 12 nt, Bordetella pertussis
cgccccgcccuc

SEQ ID NO: 2457126 - RNA, 13 nt, Bordetella pertussis
cgccccgccucga

SEQ ID NO: 2457127 - RNA, 20 nt, Bordetella pertussis
cgccccgccucgacgaugcc

SEQ ID NO: 2457128 - RNA, 14 nt, Bordetella pertussis
cgccccgcuggccg

SEQ ID NO: 2457129 - RNA, 23 nt, Bordetella pertussis
cgccccgcuggccgucgccgccc

SEQ ID NO: 2457130 - RNA, 17 nt, Bordetella pertussis
cgccccgcuucgggccg

SEQ ID NO: 2457131 - RNA, 13 nt, Bordetella pertussis
cgccccggcgcau

SEQ ID NO: 2457132 - RNA, 16 nt, Bordetella pertussis
cgccccggcgcauccc

SEQ ID NO: 2457133 - RNA, 16 nt, Bordetella pertussis
cgccccggcgcgcagc

SEQ ID NO: 2457134 - RNA, 18 nt, Bordetella pertussis
cgccccggcgcggcgcgc

SEQ ID NO: 2457135 - RNA, 22 nt, Bordetella pertussis
cgccccggcgcggcgcgcgccg

SEQ ID NO: 2457136 - RNA, 18 nt, Bordetella pertussis
cgccccgucaucgggugc

SEQ ID NO: 2457137 - RNA, 17 nt, Bordetella pertussis
cgccccuagcgccgcgc

SEQ ID NO: 2457138 - RNA, 18 nt, Bordetella pertussis
cgccccuagcgccgcgcc

SEQ ID NO: 2457139 - RNA, 15 nt, Bordetella pertussis
cgcccgaaccggcau

SEQ ID NO: 2457140 - RNA, 17 nt, Bordetella pertussis
cgcccgaaccggcaucc

SEQ ID NO: 2457141 - RNA, 18 nt, Bordetella pertussis
cgcccgaauccagggcca

SEQ ID NO: 2457142 - RNA, 22 nt, Bordetella pertussis
cgccaugcugccaaccgcgacg

SEQ ID NO: 2457143 - RNA, 16 nt, Bordetella pertussis
cgccaugcuggccgcc

SEQ ID NO: 2457144 - RNA, 14 nt, Bordetella pertussis
cgccauggacgccg

SEQ ID NO: 2457145 - RNA, 17 nt, Bordetella pertussis
cgccauggaggcgcagc

SEQ ID NO: 2457146 - RNA, 19 nt, Bordetella pertussis
cgccauggaggcgcagcgc

SEQ ID NO: 2457147 - RNA, 13 nt, Bordetella pertussis
cgccauggccggc

SEQ ID NO: 2457148 - RNA, 15 nt, Bordetella pertussis
cgccauggccggccg

SEQ ID NO: 2457149 - RNA, 19 nt, Bordetella pertussis
cgccauggccggccgccgg

SEQ ID NO: 2457150 - RNA, 15 nt, Bordetella pertussis
cgccauggccggcgu

SEQ ID NO: 2457151 - RNA, 17 nt, Bordetella pertussis
cgccauggccggcguug

SEQ ID NO: 2457152 - RNA, 14 nt, Bordetella pertussis
cgccauggcgcgca

SEQ ID NO: 2457153 - RNA, 13 nt, Bordetella pertussis
cgccauggcgcug

SEQ ID NO: 2457154 - RNA, 14 nt, Bordetella pertussis
cgccauggcgcugg

SEQ ID NO: 2457155 - RNA, 18 nt, Bordetella pertussis
cgccauggcgcuggcagg

SEQ ID NO: 2457156 - RNA, 12 nt, Bordetella pertussis
cgccauggcggc

SEQ ID NO: 2457157 - RNA, 13 nt, Bordetella pertussis
cgccauggcggcc

SEQ ID NO: 2457158 - RNA, 16 nt, Bordetella pertussis
cgccauggcggccgcc

SEQ ID NO: 2457159 - RNA, 17 nt, Bordetella pertussis
cgccauggcggccgccg

SEQ ID NO: 2457160 - RNA, 20 nt, Bordetella pertussis
cgccauggcggccgccgcca

SEQ ID NO: 2457161 - RNA, 15 nt, Bordetella pertussis
cgccauggcggcggc

SEQ ID NO: 2457162 - RNA, 19 nt, Bordetella pertussis
cgccauggcggcggccacg

SEQ ID NO: 2457163 - RNA, 22 nt, Bordetella pertussis
cgccauggucgcgaccaccgug

SEQ ID NO: 2457164 - RNA, 23 nt, Bordetella pertussis
cgccauggucucccccucggccu

SEQ ID NO: 2457165 - RNA, 21 nt, Bordetella pertussis
cgccauggugaacggccccgc

SEQ ID NO: 2457166 - RNA, 16 nt, Bordetella pertussis
cgccauggugccgcgc

SEQ ID NO: 2457167 - RNA, 22 nt, Bordetella pertussis
cgccauggugccgcgcaggccc

SEQ ID NO: 2457168 - RNA, 20 nt, Bordetella pertussis
cgccauguauaacguggcgc

SEQ ID NO: 2457169 - RNA, 14 nt, Bordetella pertussis
cgccaugugcgccg

SEQ ID NO: 2457170 - RNA, 18 nt, Bordetella pertussis
cgccaugugcgccgcgcc

SEQ ID NO: 2457171 - RNA, 20 nt, Bordetella pertussis
cgccaugugcgccgcgccgu

SEQ ID NO: 2457172 - RNA, 21 nt, Bordetella pertussis
cgccaugugcguugccagccc

SEQ ID NO: 2457173 - RNA, 23 nt, Bordetella pertussis
cgccauguucagcuucagccugg

SEQ ID NO: 2457174 - RNA, 17 nt, Bordetella pertussis
cgccauucauccagcgc

SEQ ID NO: 2457175 - RNA, 13 nt, Bordetella pertussis
cgccauugcacgc

SEQ ID NO: 2457176 - RNA, 14 nt, Bordetella pertussis
cgccauugcacgcg

SEQ ID NO: 2457177 - RNA, 20 nt, Bordetella pertussis
cgccauugccacggcgggcc

SEQ ID NO: 2457178 - RNA, 21 nt, Bordetella pertussis
cgccauugccacggcgggccg

SEQ ID NO: 2457179 - RNA, 22 nt, Bordetella pertussis
cgccauugccacggcgggccgg

SEQ ID NO: 2457180 - RNA, 13 nt, Bordetella pertussis
cgccauugcgccg

SEQ ID NO: 2457181 - RNA, 19 nt, Bordetella pertussis
cgcccaacccggcgaggcc

SEQ ID NO: 2457182 - RNA, 22 nt, Bordetella pertussis
cgcccaacccggcgaggccgcc

SEQ ID NO: 2457183 - RNA, 21 nt, Bordetella pertussis
cgcccaagucgaguucggcgc

SEQ ID NO: 2457184 - RNA, 23 nt, Bordetella pertussis
cgcccaagucgaguucggcgcgc

SEQ ID NO: 2457185 - RNA, 23 nt, Bordetella pertussis
cgcccaauccgaucagcacgaug

SEQ ID NO: 2457186 - RNA, 23 nt, Bordetella pertussis
cgcccaaucgggcagcacgcgca

SEQ ID NO: 2457187 - RNA, 23 nt, Bordetella pertussis
cgcccacaggaacaggccggccu

SEQ ID NO: 2457188 - RNA, 20 nt, Bordetella pertussis
cgcccacauagcggccggcg

SEQ ID NO: 2457189 - RNA, 13 nt, Bordetella pertussis
cgcccacauggcg

SEQ ID NO: 2457190 - RNA, 14 nt, Bordetella pertussis
cgcccaccaccagc

SEQ ID NO: 2457191 - RNA, 19 nt, Bordetella pertussis
cgcccaccaccagcgcggc

SEQ ID NO: 2457192 - RNA, 17 nt, Bordetella pertussis
cgcccaccaccagcggc

SEQ ID NO: 2457193 - RNA, 18 nt, Bordetella pertussis
cgcccacccccggcacca

SEQ ID NO: 2457194 - RNA, 14 nt, Bordetella pertussis
cgcccaccgugacc

SEQ ID NO: 2457195 - RNA, 17 nt, Bordetella pertussis
cgcccacgaucaccacg

SEQ ID NO: 2457196 - RNA, 16 nt, Bordetella pertussis
cgcccacgccgccugg

SEQ ID NO: 2457197 - RNA, 18 nt, Bordetella pertussis
cgcccacgccgccuggcc

SEQ ID NO: 2457198 - RNA, 19 nt, Bordetella pertussis
cgcccacgccgccuggccc

SEQ ID NO: 2457199 - RNA, 14 nt, Bordetella pertussis
cgcccacgcgccgc

SEQ ID NO: 2457200 - RNA, 16 nt, Bordetella pertussis
cgcccacgcgccgcca

SEQ ID NO: 2457201 - RNA, 17 nt, Bordetella pertussis
cgcccacggcaaaagcc

SEQ ID NO: 2457202 - RNA, 16 nt, Bordetella pertussis
cgcccacggccgcaug

SEQ ID NO: 2457203 - RNA, 14 nt, Bordetella pertussis
cgcccacgggcgcc

SEQ ID NO: 2457204 - RNA, 14 nt, Bordetella pertussis
cgcccacugccagg

SEQ ID NO: 2457205 - RNA, 22 nt, Bordetella pertussis
cgcccacuuccucggcgcgcgc

SEQ ID NO: 2457206 - RNA, 23 nt, Bordetella pertussis
cgcccacuuccucggcgcgcgcg

SEQ ID NO: 2457207 - RNA, 15 nt, Bordetella pertussis
cgcccagaaugcggc

SEQ ID NO: 2457208 - RNA, 18 nt, Bordetella pertussis
cgcccagaaugcggcgga

SEQ ID NO: 2457209 - RNA, 13 nt, Bordetella pertussis
cgcccagauggcc

SEQ ID NO: 2457210 - RNA, 15 nt, Bordetella pertussis
cgcccagauggccga

SEQ ID NO: 2457211 - RNA, 20 nt, Bordetella pertussis
cgcccagcaccuuggcauug

SEQ ID NO: 2457212 - RNA, 11 nt, Bordetella pertussis
cgcccagcaga

SEQ ID NO: 2457213 - RNA, 20 nt, Bordetella pertussis
cgcccagcagauaccggcau

SEQ ID NO: 2457214 - RNA, 14 nt, Bordetella pertussis
cgcccagcagcgcc

SEQ ID NO: 2457215 - RNA, 17 nt, Bordetella pertussis
cgcccagcagcgccacc

SEQ ID NO: 2457216 - RNA, 23 nt, Bordetella pertussis
cgcccagcaggcuuucgcacagc

SEQ ID NO: 2457217 - RNA, 21 nt, Bordetella pertussis
cgcccagcauccgcgccagga

SEQ ID NO: 2457218 - RNA, 14 nt, Bordetella pertussis
cgcccagcaugcgc

SEQ ID NO: 2457219 - RNA, 20 nt, Bordetella pertussis
cgcccagccaggcgccagcg

SEQ ID NO: 2457220 - RNA, 22 nt, Bordetella pertussis
cgcccagccaggcgccagcggc

SEQ ID NO: 2457221 - RNA, 20 nt, Bordetella pertussis
cgcccagccccgcggccgcg

SEQ ID NO: 2457222 - RNA, 18 nt, Bordetella pertussis
cgcccagcccugcccgca

SEQ ID NO: 2457223 - RNA, 15 nt, Bordetella pertussis
cgcccagccgccuga

SEQ ID NO: 2457224 - RNA, 13 nt, Bordetella pertussis
cgcccgacagcac

SEQ ID NO: 2457225 - RNA, 17 nt, Bordetella pertussis
cgcccgacagcacgccc

SEQ ID NO: 2457226 - RNA, 12 nt, Bordetella pertussis
cgcccgaccugc

SEQ ID NO: 2457227 - RNA, 15 nt, Bordetella pertussis
cgcccgaccugcugg

SEQ ID NO: 2457228 - RNA, 17 nt, Bordetella pertussis
cgcccgaccugcuggcg

SEQ ID NO: 2457229 - RNA, 13 nt, Bordetella pertussis
cgcccgacggcgc

SEQ ID NO: 2457230 - RNA, 14 nt, Bordetella pertussis
cgcccgacggcgcg

SEQ ID NO: 2457231 - RNA, 19 nt, Bordetella pertussis
cgcccgacggcgcgcccgc

SEQ ID NO: 2457232 - RNA, 22 nt, Bordetella pertussis
cgcccgacggcgcgcccgccgc

SEQ ID NO: 2457233 - RNA, 24 nt, Bordetella pertussis
cgcccgacgguaucucagcgcgcc

SEQ ID NO: 2457234 - RNA, 20 nt, Bordetella pertussis
cgcccgagagcugcgucuug

SEQ ID NO: 2457235 - RNA, 18 nt, Bordetella pertussis
cgcccgagauggcgcagg

SEQ ID NO: 2457236 - RNA, 19 nt, Bordetella pertussis
cgcccgagauggcgcaggc

SEQ ID NO: 2457237 - RNA, 23 nt, Bordetella pertussis
cgcccgagauggcgcaggcgcgc

SEQ ID NO: 2457238 - RNA, 13 nt, Bordetella pertussis
cgcccgagcgcca

SEQ ID NO: 2457239 - RNA, 13 nt, Bordetella pertussis
cgcccgagcuggc

SEQ ID NO: 2457240 - RNA, 20 nt, Bordetella pertussis
cgcccgagcuggccggcgac

SEQ ID NO: 2457241 - RNA, 17 nt, Bordetella pertussis
cgcccgaggcgcgcagc

SEQ ID NO: 2457242 - RNA, 16 nt, Bordetella pertussis
cgcccgaucggccggc

SEQ ID NO: 2457243 - RNA, 17 nt, Bordetella pertussis
cgcccgaucggccggcc

SEQ ID NO: 2457244 - RNA, 13 nt, Bordetella pertussis
cgcccgaugccga

SEQ ID NO: 2457245 - RNA, 16 nt, Bordetella pertussis
cgcccgaugcucgccg

SEQ ID NO: 2457246 - RNA, 17 nt, Bordetella pertussis
cgcccgaugcucgccgg

SEQ ID NO: 2457247 - RNA, 21 nt, Bordetella pertussis
cgcccgaugcucgccggcgcc

SEQ ID NO: 2457248 - RNA, 16 nt, Bordetella pertussis
cgcccgcaacgggccg

SEQ ID NO: 2457249 - RNA, 18 nt, Bordetella pertussis
cgcccgcaacgggccggc

SEQ ID NO: 2457250 - RNA, 15 nt, Bordetella pertussis
cgcccgcacgaugcc

SEQ ID NO: 2457251 - RNA, 18 nt, Bordetella pertussis
cgcccgcacgaugccgac

SEQ ID NO: 2457252 - RNA, 21 nt, Bordetella pertussis
cgcccgcacgaugccgaccga

SEQ ID NO: 2457253 - RNA, 22 nt, Bordetella pertussis
cgcccgcaggcauugcgccagc

SEQ ID NO: 2457254 - RNA, 20 nt, Bordetella pertussis
cgcccgcauagacgccgacc

SEQ ID NO: 2457255 - RNA, 20 nt, Bordetella pertussis
cgcccgcaucggcuggcgca

SEQ ID NO: 2457256 - RNA, 19 nt, Bordetella pertussis
cgcccgcauggaccgccgc

SEQ ID NO: 2457257 - RNA, 13 nt, Bordetella pertussis
cgcccgcaugucc

SEQ ID NO: 2457258 - RNA, 14 nt, Bordetella pertussis
cgcccgccaccagg

SEQ ID NO: 2457259 - RNA, 15 nt, Bordetella pertussis
cgcccgccaccagga

SEQ ID NO: 2457260 - RNA, 18 nt, Bordetella pertussis
cgcccgccaccaggaacg

SEQ ID NO: 2457261 - RNA, 14 nt, Bordetella pertussis
cgcccgccaggcca

SEQ ID NO: 2457262 - RNA, 15 nt, Bordetella pertussis
cgcccgccaggccag

SEQ ID NO: 2457263 - RNA, 19 nt, Bordetella pertussis
cgcccgccaugcacgggcc

SEQ ID NO: 2457264 - RNA, 16 nt, Bordetella pertussis
cgcccgcccgccgccu

SEQ ID NO: 2457265 - RNA, 16 nt, Bordetella pertussis
cgcccgcccgcugacc

SEQ ID NO: 2457266 - RNA, 18 nt, Bordetella pertussis
cgcccgcccugggcagca

SEQ ID NO: 2457267 - RNA, 14 nt, Bordetella pertussis
cgcccgccgacgaa

SEQ ID NO: 2457268 - RNA, 15 nt, Bordetella pertussis
cgcccgccgacgaaa

SEQ ID NO: 2457269 - RNA, 19 nt, Bordetella pertussis
cgcccgccgccgggcgcgc

SEQ ID NO: 2457270 - RNA, 13 nt, Bordetella pertussis
cgcccgccgccug

SEQ ID NO: 2457271 - RNA, 16 nt, Bordetella pertussis
cgcccgccgccugcgc

SEQ ID NO: 2457272 - RNA, 13 nt, Bordetella pertussis
cgcccgccgcgcc

SEQ ID NO: 2457273 - RNA, 14 nt, Bordetella pertussis
cgcccgccgcgcca

SEQ ID NO: 2457274 - RNA, 16 nt, Bordetella pertussis
cgcccgccucaggccg

SEQ ID NO: 2457275 - RNA, 21 nt, Bordetella pertussis
cgcccgccugcagcagcgccu

SEQ ID NO: 2457276 - RNA, 15 nt, Bordetella pertussis
cgcccgccugccggc

SEQ ID NO: 2457277 - RNA, 16 nt, Bordetella pertussis
cgcccgccugccggcc

SEQ ID NO: 2457278 - RNA, 17 nt, Bordetella pertussis
cgcccgccugccggccu

SEQ ID NO: 2457279 - RNA, 17 nt, Bordetella pertussis
cgcccgccugcgccagc

SEQ ID NO: 2457280 - RNA, 15 nt, Bordetella pertussis
cgcccgccugcgugg

SEQ ID NO: 2457281 - RNA, 17 nt, Bordetella pertussis
cgcccgccuucagcggg

SEQ ID NO: 2457282 - RNA, 20 nt, Bordetella pertussis
cgcccgccuucagcgggccg

SEQ ID NO: 2457283 - RNA, 22 nt, Bordetella pertussis
cgcccgccuucagcgggccggc

SEQ ID NO: 2457284 - RNA, 23 nt, Bordetella pertussis
cgcccgccuucagcgggccggca

SEQ ID NO: 2457285 - RNA, 21 nt, Bordetella pertussis
cgcccgccuucuugaacagcu

SEQ ID NO: 2457286 - RNA, 14 nt, Bordetella pertussis
cgcccgcgagcggc

SEQ ID NO: 2457287 - RNA, 16 nt, Bordetella pertussis
cgcccgcgagcggcca

SEQ ID NO: 2457288 - RNA, 18 nt, Bordetella pertussis
cgcccgcgagcggccagc

SEQ ID NO: 2457289 - RNA, 21 nt, Bordetella pertussis
cgcccgcgagcggccagccug

SEQ ID NO: 2457290 - RNA, 15 nt, Bordetella pertussis
cgcccgcgcccagcu

SEQ ID NO: 2457291 - RNA, 14 nt, Bordetella pertussis
cgcccgcgcccagu

SEQ ID NO: 2457292 - RNA, 12 nt, Bordetella pertussis
cgcccgcgccga

SEQ ID NO: 2457293 - RNA, 22 nt, Bordetella pertussis
cgcccgcgcgguauugcgccac

SEQ ID NO: 2457294 - RNA, 13 nt, Bordetella pertussis
cgcccgcggccag

SEQ ID NO: 2457295 - RNA, 14 nt, Bordetella pertussis
cgcccgcggccagc

SEQ ID NO: 2457296 - RNA, 13 nt, Bordetella pertussis
cgcgcagcaggcc

SEQ ID NO: 2457297 - RNA, 15 nt, Bordetella pertussis
cgcgcagcaggccca

SEQ ID NO: 2457298 - RNA, 18 nt, Bordetella pertussis
cgcgcagcaggcccaugc

SEQ ID NO: 2457299 - RNA, 21 nt, Bordetella pertussis
cgcgcagcaggcccaugccgc

SEQ ID NO: 2457300 - RNA, 14 nt, Bordetella pertussis
cgcgcagcaggccg

SEQ ID NO: 2457301 - RNA, 15 nt, Bordetella pertussis
cgcgcagcaggccgu

SEQ ID NO: 2457302 - RNA, 21 nt, Bordetella pertussis
cgcgcagcaggccguugccgc

SEQ ID NO: 2457303 - RNA, 21 nt, Bordetella pertussis
cgcgcagcaggguggccacgc

SEQ ID NO: 2457304 - RNA, 13 nt, Bordetella pertussis
cgcgcagccaggu

SEQ ID NO: 2457305 - RNA, 23 nt, Bordetella pertussis
cgcgcagccagguaagcuggcgc

SEQ ID NO: 2457306 - RNA, 14 nt, Bordetella pertussis
cgcgcagcccggcg

SEQ ID NO: 2457307 - RNA, 14 nt, Bordetella pertussis
cgcgcagccgacag

SEQ ID NO: 2457308 - RNA, 13 nt, Bordetella pertussis
cgcgcagcgccgc

SEQ ID NO: 2457309 - RNA, 12 nt, Bordetella pertussis
cgcgcagcgccu

SEQ ID NO: 2457310 - RNA, 19 nt, Bordetella pertussis
cgcgcagcgccugcaggcg

SEQ ID NO: 2457311 - RNA, 20 nt, Bordetella pertussis
cgcgcagcgccugcaggcgg

SEQ ID NO: 2457312 - RNA, 14 nt, Bordetella pertussis
cgcgcagcgccugg

SEQ ID NO: 2457313 - RNA, 19 nt, Bordetella pertussis
cgcgcagcgccuggccgag

SEQ ID NO: 2457314 - RNA, 22 nt, Bordetella pertussis
cgcgcagcgccuggccgagcgc

SEQ ID NO: 2457315 - RNA, 17 nt, Bordetella pertussis
cgcgcagcgcgaccggg

SEQ ID NO: 2457316 - RNA, 14 nt, Bordetella pertussis
cgcgcagcgcgccg

SEQ ID NO: 2457317 - RNA, 12 nt, Bordetella pertussis
cgcgcagcggcg

SEQ ID NO: 2457318 - RNA, 14 nt, Bordetella pertussis
cgcgcagcgucugc

SEQ ID NO: 2457319 - RNA, 15 nt, Bordetella pertussis
cgcgcagcguggcgg

SEQ ID NO: 2457320 - RNA, 14 nt, Bordetella pertussis
cgcgcagcugccug

SEQ ID NO: 2457321 - RNA, 22 nt, Bordetella pertussis
cgcgcagcugccugagcaccgc

SEQ ID NO: 2457322 - RNA, 14 nt, Bordetella pertussis
cgcgcagcuugccc

SEQ ID NO: 2457323 - RNA, 18 nt, Bordetella pertussis
cgcgcagcuugcccgcgc

SEQ ID NO: 2457324 - RNA, 18 nt, Bordetella pertussis
cgcgcaggacaaggcgcg

SEQ ID NO: 2457325 - RNA, 22 nt, Bordetella pertussis
cgcgcaggacaaggcgcgcgcc

SEQ ID NO: 2457326 - RNA, 23 nt, Bordetella pertussis
cgcgcaggaucagcuugaugccg

SEQ ID NO: 2457327 - RNA, 19 nt, Bordetella pertussis
cgcgcaggcaguuggcggc

SEQ ID NO: 2457328 - RNA, 20 nt, Bordetella pertussis
cgcgcaggccauugcuggcg

SEQ ID NO: 2457329 - RNA, 22 nt, Bordetella pertussis
cgcgcaggcccuugaucaggcg

SEQ ID NO: 2457330 - RNA, 13 nt, Bordetella pertussis
cgcgcaggccucg

SEQ ID NO: 2457331 - RNA, 17 nt, Bordetella pertussis
cgcgcaggccucgcccg

SEQ ID NO: 2457332 - RNA, 19 nt, Bordetella pertussis
cgcgcaggccucgcccgau

SEQ ID NO: 2457333 - RNA, 14 nt, Bordetella pertussis
cgcgcaggcgggcc

SEQ ID NO: 2457334 - RNA, 18 nt, Bordetella pertussis
cgcgcagggcggccggca

SEQ ID NO: 2457335 - RNA, 19 nt, Bordetella pertussis
cgcgcagggcggccggcac

SEQ ID NO: 2457336 - RNA, 21 nt, Bordetella pertussis
cgcgcagggcggccggcacgc

SEQ ID NO: 2457337 - RNA, 17 nt, Bordetella pertussis
cgcgcaggguggcaucg

SEQ ID NO: 2457338 - RNA, 14 nt, Bordetella pertussis
cgcgcaggugugcc

SEQ ID NO: 2457339 - RNA, 20 nt, Bordetella pertussis
cgcgcaggugugccagccgc

SEQ ID NO: 2457340 - RNA, 22 nt, Bordetella pertussis
cgcgcaggugugccagccgcug

SEQ ID NO: 2457341 - RNA, 21 nt, Bordetella pertussis
cgcgcaguugcgucuccagcg

SEQ ID NO: 2457342 - RNA, 15 nt, Bordetella pertussis
cgcgcaucacgcugg

SEQ ID NO: 2457343 - RNA, 21 nt, Bordetella pertussis
cgcgcaucacgcuggccgcgc

SEQ ID NO: 2457344 - RNA, 20 nt, Bordetella pertussis
cgcgcaucgccgaacagggu

SEQ ID NO: 2457345 - RNA, 22 nt, Bordetella pertussis
cgcgcaucgcgcggcaugggca

SEQ ID NO: 2457346 - RNA, 22 nt, Bordetella pertussis
cgcgcaucgggauccgugcggc

SEQ ID NO: 2457347 - RNA, 18 nt, Bordetella pertussis
cgcgcaucgucaggcagg

SEQ ID NO: 2457348 - RNA, 23 nt, Bordetella pertussis
cgcgcaucgucaggcaggcgcgc

SEQ ID NO: 2457349 - RNA, 24 nt, Bordetella pertussis
cgcgcaucgucaggcaggcgcgcc

SEQ ID NO: 2457350 - RNA, 20 nt, Bordetella pertussis
cgcgcaugcaagacaggccg

SEQ ID NO: 2457351 - RNA, 13 nt, Bordetella pertussis
cgcgcaugcagcg

SEQ ID NO: 2457352 - RNA, 14 nt, Bordetella pertussis
cgcgcaugccagcu

SEQ ID NO: 2457353 - RNA, 18 nt, Bordetella pertussis
cgcgcauggacugcaggc

SEQ ID NO: 2457354 - RNA, 21 nt, Bordetella pertussis
cgcgcauggacugcaggcgcu

SEQ ID NO: 2457355 - RNA, 11 nt, Bordetella pertussis
cgcgcauggcg

SEQ ID NO: 2457356 - RNA, 14 nt, Bordetella pertussis
cgcgcauggcgaug

SEQ ID NO: 2457357 - RNA, 19 nt, Bordetella pertussis
cgcgcauucgucgcugccg

SEQ ID NO: 2457358 - RNA, 20 nt, Bordetella pertussis
cgcgcauuucgaacaaggcg

SEQ ID NO: 2457359 - RNA, 21 nt, Bordetella pertussis
cgcgcauuucgaacaaggcgg

SEQ ID NO: 2457360 - RNA, 16 nt, Bordetella pertussis
cgcgccaacccggccu

SEQ ID NO: 2457361 - RNA, 18 nt, Bordetella pertussis
cgcgccaacgcacaaggg

SEQ ID NO: 2457362 - RNA, 17 nt, Bordetella pertussis
cgcgccaagggcgugcg

SEQ ID NO: 2457363 - RNA, 19 nt, Bordetella pertussis
cgcgccaagggcgugcgcu

SEQ ID NO: 2457364 - RNA, 21 nt, Bordetella pertussis
cgcgccaaucagauggcgcag

SEQ ID NO: 2457365 - RNA, 23 nt, Bordetella pertussis
cgcgccaaucagauggcgcagcg

SEQ ID NO: 2457366 - RNA, 17 nt, Bordetella pertussis
cgcgccacacgggcgcc

SEQ ID NO: 2457367 - RNA, 20 nt, Bordetella pertussis
cgcgccacacgggcgccugc

SEQ ID NO: 2457368 - RNA, 22 nt, Bordetella pertussis
cgcgccacacgggcgccugccg

SEQ ID NO: 2457369 - RNA, 15 nt, Bordetella pertussis
cgcgccacaggcgcu

SEQ ID NO: 2457370 - RNA, 12 nt, Bordetella pertussis
cgcgccaccacc

SEQ ID NO: 2457371 - RNA, 13 nt, Bordetella pertussis
cgcgccaccaccg

SEQ ID NO: 2457372 - RNA, 24 nt, Bordetella pertussis
cgcgccaccggucgccguccaggc

SEQ ID NO: 2457373 - RNA, 21 nt, Bordetella pertussis
cgcgccacggcuucgcccagc

SEQ ID NO: 2457374 - RNA, 18 nt, Bordetella pertussis
cgcgccagaacgacagcg

SEQ ID NO: 2457375 - RNA, 21 nt, Bordetella pertussis
cgcgccagaacgacagcgaca

SEQ ID NO: 2457376 - RNA, 16 nt, Bordetella pertussis
cgcgccagcagcgccg

SEQ ID NO: 2457377 - RNA, 17 nt, Bordetella pertussis
cgcgccagcagcgccgg

SEQ ID NO: 2457378 - RNA, 12 nt, Bordetella pertussis
cgcgccagcagu

SEQ ID NO: 2457379 - RNA, 14 nt, Bordetella pertussis
cgcgccagcccgcc

SEQ ID NO: 2457380 - RNA, 18 nt, Bordetella pertussis
cgcgccagccgcgcgaac

SEQ ID NO: 2457381 - RNA, 17 nt, Bordetella pertussis
cgcgccagccgcgcgac

SEQ ID NO: 2457382 - RNA, 15 nt, Bordetella pertussis
cgcgccagccgcugc

SEQ ID NO: 2457383 - RNA, 18 nt, Bordetella pertussis
cgcgccagccgcugcagc

SEQ ID NO: 2457384 - RNA, 12 nt, Bordetella pertussis
cgcgccagcgcc

SEQ ID NO: 2457385 - RNA, 21 nt, Bordetella pertussis
cgcgccagcgccacgcccugg

SEQ ID NO: 2457386 - RNA, 13 nt, Bordetella pertussis
cgcgccagcgccg

SEQ ID NO: 2457387 - RNA, 16 nt, Bordetella pertussis
cgcgccagcgccgcgc

SEQ ID NO: 2457388 - RNA, 23 nt, Bordetella pertussis
cgcgccagcgccgcgcgcgugcc

SEQ ID NO: 2457389 - RNA, 13 nt, Bordetella pertussis
cgcgccagcgccu

SEQ ID NO: 2457390 - RNA, 13 nt, Bordetella pertussis
cgcgccagcgcgc

SEQ ID NO: 2457391 - RNA, 15 nt, Bordetella pertussis
cgcgccagcgcgcga

SEQ ID NO: 2457392 - RNA, 16 nt, Bordetella pertussis
cgcgccagcgcgcgau

SEQ ID NO: 2457393 - RNA, 16 nt, Bordetella pertussis
cgcgccagcgcggcca

SEQ ID NO: 2457394 - RNA, 16 nt, Bordetella pertussis
cgcgccagcgcggcgg

SEQ ID NO: 2457395 - RNA, 13 nt, Bordetella pertussis
cgcgccagcggcc

SEQ ID NO: 2457396 - RNA, 18 nt, Bordetella pertussis
cgcgccagcggccgucgc

SEQ ID NO: 2457397 - RNA, 15 nt, Bordetella pertussis
cgcgccagcggcugc

SEQ ID NO: 2457398 - RNA, 15 nt, Bordetella pertussis
cgcgccagcucgcgc

SEQ ID NO: 2457399 - RNA, 20 nt, Bordetella pertussis
cgcgccagcucuucgagcgc

SEQ ID NO: 2457400 - RNA, 13 nt, Bordetella pertussis
cgcgccagcugcg

SEQ ID NO: 2457401 - RNA, 14 nt, Bordetella pertussis
cgcgccagcugcgc

SEQ ID NO: 2457402 - RNA, 17 nt, Bordetella pertussis
cgcgccagcugcgcagc

SEQ ID NO: 2457403 - RNA, 17 nt, Bordetella pertussis
cgcgccaggaagcgcgc

SEQ ID NO: 2457404 - RNA, 20 nt, Bordetella pertussis
cgcgccaggaagcgcgccgc

SEQ ID NO: 2457405 - RNA, 22 nt, Bordetella pertussis
cgcgccaggaagcgcgccgcgc

SEQ ID NO: 2457406 - RNA, 16 nt, Bordetella pertussis
cgcgccaggauggcca

SEQ ID NO: 2457407 - RNA, 20 nt, Bordetella pertussis
cgcgccaggauggccacgac

SEQ ID NO: 2457408 - RNA, 18 nt, Bordetella pertussis
cgcgccaggcauucucgg

SEQ ID NO: 2457409 - RNA, 13 nt, Bordetella pertussis
cgcgccaggccca

SEQ ID NO: 2457410 - RNA, 20 nt, Bordetella pertussis
cgcgccaggcccagggccag

SEQ ID NO: 2457411 - RNA, 14 nt, Bordetella pertussis
cgcgccgcccacgc

SEQ ID NO: 2457412 - RNA, 18 nt, Bordetella pertussis
cgcgccgcccacgccgcu

SEQ ID NO: 2457413 - RNA, 17 nt, Bordetella pertussis
cgcgccgcccccgccca

SEQ ID NO: 2457414 - RNA, 20 nt, Bordetella pertussis
cgcgccgcccccgcccagca

SEQ ID NO: 2457415 - RNA, 15 nt, Bordetella pertussis
cgcgccgcccgcggc

SEQ ID NO: 2457416 - RNA, 16 nt, Bordetella pertussis
cgcgccgcccgcggcc

SEQ ID NO: 2457417 - RNA, 17 nt, Bordetella pertussis
cgcgccgcccgcggcca

SEQ ID NO: 2457418 - RNA, 13 nt, Bordetella pertussis
cgcgccgcccgcu

SEQ ID NO: 2457419 - RNA, 15 nt, Bordetella pertussis
cgcgccgcccgggcc

SEQ ID NO: 2457420 - RNA, 23 nt, Bordetella pertussis
cgcgccgccgauguugaacagcu

SEQ ID NO: 2457421 - RNA, 13 nt, Bordetella pertussis
cgcgccgccgccc

SEQ ID NO: 2457422 - RNA, 16 nt, Bordetella pertussis
cgcgccgccgcccugg

SEQ ID NO: 2457423 - RNA, 17 nt, Bordetella pertussis
cgcgccgccgcccuggc

SEQ ID NO: 2457424 - RNA, 16 nt, Bordetella pertussis
cgcgccgccgcgcccu

SEQ ID NO: 2457425 - RNA, 14 nt, Bordetella pertussis
cgcgccgccgggcc

SEQ ID NO: 2457426 - RNA, 16 nt, Bordetella pertussis
cgcgccgccgggccug

SEQ ID NO: 2457427 - RNA, 16 nt, Bordetella pertussis
cgcgccgccggugcac

SEQ ID NO: 2457428 - RNA, 20 nt, Bordetella pertussis
cgcgccgccggugcaccagg

SEQ ID NO: 2457429 - RNA, 21 nt, Bordetella pertussis
cgcgccgccggugcaccaggc

SEQ ID NO: 2457430 - RNA, 14 nt, Bordetella pertussis
cgcgccgccuacca

SEQ ID NO: 2457431 - RNA, 15 nt, Bordetella pertussis
cgcgccgccucgcgc

SEQ ID NO: 2457432 - RNA, 19 nt, Bordetella pertussis
cgcgccgccucgcgcucca

SEQ ID NO: 2457433 - RNA, 22 nt, Bordetella pertussis
cgcgccgccucgcgcuccagca

SEQ ID NO: 2457434 - RNA, 9 nt, Bordetella pertussis
cgcgccgcg

SEQ ID NO: 2457435 - RNA, 12 nt, Bordetella pertussis
cgcgccgcgacg

SEQ ID NO: 2457436 - RNA, 13 nt, Bordetella pertussis
cgcgccgcgcaga

SEQ ID NO: 2457437 - RNA, 15 nt, Bordetella pertussis
cgcgccgcgccgccc

SEQ ID NO: 2457438 - RNA, 13 nt, Bordetella pertussis
cgcgccgcgccgg

SEQ ID NO: 2457439 - RNA, 14 nt, Bordetella pertussis
cgcgccgcgccggg

SEQ ID NO: 2457440 - RNA, 12 nt, Bordetella pertussis
cgcgccgcgccu

SEQ ID NO: 2457441 - RNA, 21 nt, Bordetella pertussis
cgcgccgcgcgcacggcgccc

SEQ ID NO: 2457442 - RNA, 15 nt, Bordetella pertussis
cgcgccgcgcgcggc

SEQ ID NO: 2457443 - RNA, 16 nt, Bordetella pertussis
cgcgccgcgcgcggcg

SEQ ID NO: 2457444 - RNA, 15 nt, Bordetella pertussis
cgcgccgcgcugccc

SEQ ID NO: 2457445 - RNA, 19 nt, Bordetella pertussis
cgcgccgcgcugcccgaga

SEQ ID NO: 2457446 - RNA, 14 nt, Bordetella pertussis
cgcgccgcggcaag

SEQ ID NO: 2457447 - RNA, 19 nt, Bordetella pertussis
cgcgccgcggcacggggca

SEQ ID NO: 2457448 - RNA, 13 nt, Bordetella pertussis
cgcgccgcggcgg

SEQ ID NO: 2457449 - RNA, 14 nt, Bordetella pertussis
cgcgccgcggcggg

SEQ ID NO: 2457450 - RNA, 21 nt, Bordetella pertussis
cgcgccgcggcgggcuuggcg

SEQ ID NO: 2457451 - RNA, 12 nt, Bordetella pertussis
cgcgccgcgggc

SEQ ID NO: 2457452 - RNA, 18 nt, Bordetella pertussis
cgcgccgcgggcugcgac

SEQ ID NO: 2457453 - RNA, 22 nt, Bordetella pertussis
cgcgccgcgucgguggccagcc

SEQ ID NO: 2457454 - RNA, 22 nt, Bordetella pertussis
cgcgccgcgucuucggcgcggc

SEQ ID NO: 2457455 - RNA, 23 nt, Bordetella pertussis
cgcgccgcguugcagccacaggc

SEQ ID NO: 2457456 - RNA, 15 nt, Bordetella pertussis
cgcgccgcucuuggc

SEQ ID NO: 2457457 - RNA, 16 nt, Bordetella pertussis
cgcgccgcucuuggcg

SEQ ID NO: 2457458 - RNA, 14 nt, Bordetella pertussis
cgcgccgcugcagc

SEQ ID NO: 2457459 - RNA, 15 nt, Bordetella pertussis
cgcgccgcugcagcg

SEQ ID NO: 2457460 - RNA, 16 nt, Bordetella pertussis
cgcgccgcugcagcgc

SEQ ID NO: 2457461 - RNA, 22 nt, Bordetella pertussis
cgcgccgcuggcggccgcgggc

SEQ ID NO: 2457462 - RNA, 16 nt, Bordetella pertussis
cgcgccgcuggcgucg

SEQ ID NO: 2457463 - RNA, 21 nt, Bordetella pertussis
cgcgccgcuguggacgccgcc

SEQ ID NO: 2457464 - RNA, 22 nt, Bordetella pertussis
cgcgccgcuguugcccaccagc

SEQ ID NO: 2457465 - RNA, 23 nt, Bordetella pertussis
cgcgccgcuguugcccaccagcc

SEQ ID NO: 2457466 - RNA, 22 nt, Bordetella pertussis
cgcgccgcuuucucccgccgcu

SEQ ID NO: 2457467 - RNA, 17 nt, Bordetella pertussis
cgcgccggacaucagcc

SEQ ID NO: 2457468 - RNA, 12 nt, Bordetella pertussis
cgcgccggaucg

SEQ ID NO: 2457469 - RNA, 13 nt, Bordetella pertussis
cgcgccggaucgc

SEQ ID NO: 2457470 - RNA, 13 nt, Bordetella pertussis
cgcgccggcaggg

SEQ ID NO: 2457471 - RNA, 22 nt, Bordetella pertussis
cgcgccggcagggcggccaggc

SEQ ID NO: 2457472 - RNA, 18 nt, Bordetella pertussis
cgcgccggcaucggcggc

SEQ ID NO: 2457473 - RNA, 16 nt, Bordetella pertussis
cgcgccggccagcggc

SEQ ID NO: 2457474 - RNA, 16 nt, Bordetella pertussis
cgcgccggccagggcc

SEQ ID NO: 2457475 - RNA, 17 nt, Bordetella pertussis
cgcgccggccagggcca

SEQ ID NO: 2457476 - RNA, 21 nt, Bordetella pertussis
cgcgccggcccaaggccccgc

SEQ ID NO: 2457477 - RNA, 22 nt, Bordetella pertussis
cgcgccggcccaaggccccgcg

SEQ ID NO: 2457478 - RNA, 15 nt, Bordetella pertussis
cgcgccggcccaggc

SEQ ID NO: 2457479 - RNA, 18 nt, Bordetella pertussis
cgcgccggcccaggcgcg

SEQ ID NO: 2457480 - RNA, 19 nt, Bordetella pertussis
cgcgccggcccaggcgcgc

SEQ ID NO: 2457481 - RNA, 11 nt, Bordetella pertussis
cgcgccggccg

SEQ ID NO: 2457482 - RNA, 15 nt, Bordetella pertussis
cgcgccggccgacag

SEQ ID NO: 2457483 - RNA, 14 nt, Bordetella pertussis
cgcgccggccgacg

SEQ ID NO: 2457484 - RNA, 15 nt, Bordetella pertussis
cgcgccggccgacgg

SEQ ID NO: 2457485 - RNA, 18 nt, Bordetella pertussis
cgcgccggccgacggcgc

SEQ ID NO: 2457486 - RNA, 19 nt, Bordetella pertussis
cgcgccggccgacggcgcu

SEQ ID NO: 2457487 - RNA, 13 nt, Bordetella pertussis
cgcgccggccgcc

SEQ ID NO: 2457488 - RNA, 14 nt, Bordetella pertussis
cgcgccggccgcca

SEQ ID NO: 2457489 - RNA, 16 nt, Bordetella pertussis
cgcgccggccgccagc

SEQ ID NO: 2457490 - RNA, 15 nt, Bordetella pertussis
cgcgccggccggugg

SEQ ID NO: 2457491 - RNA, 14 nt, Bordetella pertussis
cgcgccggccugcg

SEQ ID NO: 2457492 - RNA, 16 nt, Bordetella pertussis
cgcgccggccugcgcc

SEQ ID NO: 2457493 - RNA, 16 nt, Bordetella pertussis
cgcgccggccugggcg

SEQ ID NO: 2457494 - RNA, 21 nt, Bordetella pertussis
cgcgccggccugggcggcggc

SEQ ID NO: 2457495 - RNA, 13 nt, Bordetella pertussis
cgcgccggcgccu

SEQ ID NO: 2457496 - RNA, 15 nt, Bordetella pertussis
cgcgccggcgccuug

SEQ ID NO: 2457497 - RNA, 15 nt, Bordetella pertussis
cgcgccggcgcgcga

SEQ ID NO: 2457498 - RNA, 23 nt, Bordetella pertussis
cgcgccggcggccugcaggccgu

SEQ ID NO: 2457499 - RNA, 17 nt, Bordetella pertussis
cgcgccggcuaccgcgc

SEQ ID NO: 2457500 - RNA, 19 nt, Bordetella pertussis
cgcgccggcuaccgcgcca

SEQ ID NO: 2457501 - RNA, 20 nt, Bordetella pertussis
cgcgccggcuaccgcgccau

SEQ ID NO: 2457502 - RNA, 15 nt, Bordetella pertussis
cgcgccggcucguac

SEQ ID NO: 2457503 - RNA, 20 nt, Bordetella pertussis
cgcgccggcucguacggcgu

SEQ ID NO: 2457504 - RNA, 14 nt, Bordetella pertussis
cgcgccgggccaga

SEQ ID NO: 2457505 - RNA, 22 nt, Bordetella pertussis
cgcgccgggcccggccacggcc

SEQ ID NO: 2457506 - RNA, 23 nt, Bordetella pertussis
cgcgccgggcccggccacggccg

SEQ ID NO: 2457507 - RNA, 14 nt, Bordetella pertussis
cgcgccgggccggc

SEQ ID NO: 2457508 - RNA, 21 nt, Bordetella pertussis
cgcgccgggccuagcccggcg

SEQ ID NO: 2457509 - RNA, 14 nt, Bordetella pertussis
cgcgccgggcgcgc

SEQ ID NO: 2457510 - RNA, 16 nt, Bordetella pertussis
cgcgccgggcgcgccg

SEQ ID NO: 2457511 - RNA, 18 nt, Bordetella pertussis
cgcgccgggcgcgccggc

SEQ ID NO: 2457512 - RNA, 18 nt, Bordetella pertussis
cgcgccgggcgggucggc

SEQ ID NO: 2457513 - RNA, 14 nt, Bordetella pertussis
cgcgccggggcggc

SEQ ID NO: 2457514 - RNA, 20 nt, Bordetella pertussis
cgcgccggggcggcgcagca

SEQ ID NO: 2457515 - RNA, 15 nt, Bordetella pertussis
cgcgccggggcggcu

SEQ ID NO: 2457516 - RNA, 17 nt, Bordetella pertussis
cgcgccggggcggcucg

SEQ ID NO: 2457517 - RNA, 21 nt, Bordetella pertussis
cgcgccggggcggcucggccc

SEQ ID NO: 2457518 - RNA, 17 nt, Bordetella pertussis
cgcgccggucacgcugg

SEQ ID NO: 2457519 - RNA, 21 nt, Bordetella pertussis
cgcgccggucaugcaccugca

SEQ ID NO: 2457520 - RNA, 19 nt, Bordetella pertussis
cgcgccggucgccgcgggc

SEQ ID NO: 2457521 - RNA, 20 nt, Bordetella pertussis
cgcgccggucgccgcgggca

SEQ ID NO: 2457522 - RNA, 15 nt, Bordetella pertussis
cgcgccgguggccag

SEQ ID NO: 2457523 - RNA, 19 nt, Bordetella pertussis
cgcgccgguggccagcagc

SEQ ID NO: 2457524 - RNA, 15 nt, Bordetella pertussis
cgcgccguacagccg

SEQ ID NO: 2457525 - RNA, 18 nt, Bordetella pertussis
cgcgccguacagccgcgg

SEQ ID NO: 2457526 - RNA, 17 nt, Bordetella pertussis
cgcgccguacagggccg

SEQ ID NO: 2457527 - RNA, 22 nt, Bordetella pertussis
cgcccuugggcucgucgacgcg

SEQ ID NO: 2457528 - RNA, 19 nt, Bordetella pertussis
cgcccuuggucaccgagag

SEQ ID NO: 2457529 - RNA, 15 nt, Bordetella pertussis
cgccgaaauuggcga

SEQ ID NO: 2457530 - RNA, 17 nt, Bordetella pertussis
cgccgaaauuggcgacg

SEQ ID NO: 2457531 - RNA, 20 nt, Bordetella pertussis
cgccgaacaagguccaggcc

SEQ ID NO: 2457532 - RNA, 21 nt, Bordetella pertussis
cgccgaacaagguccaggccc

SEQ ID NO: 2457533 - RNA, 22 nt, Bordetella pertussis
cgccgaacaccagcucggcggc

SEQ ID NO: 2457534 - RNA, 23 nt, Bordetella pertussis
cgccgaacaccagcucggcggcg

SEQ ID NO: 2457535 - RNA, 15 nt, Bordetella pertussis
cgccgaaccagcgca

SEQ ID NO: 2457536 - RNA, 18 nt, Bordetella pertussis
cgccgaaccagcgcacca

SEQ ID NO: 2457537 - RNA, 15 nt, Bordetella pertussis
cgccgaacgacuugg

SEQ ID NO: 2457538 - RNA, 16 nt, Bordetella pertussis
cgccgaacgacuuggc

SEQ ID NO: 2457539 - RNA, 18 nt, Bordetella pertussis
cgccgaacgacuuggcgc

SEQ ID NO: 2457540 - RNA, 15 nt, Bordetella pertussis
cgccgaacgcgcagc

SEQ ID NO: 2457541 - RNA, 14 nt, Bordetella pertussis
cgccgaacggcagc

SEQ ID NO: 2457542 - RNA, 17 nt, Bordetella pertussis
cgccgaacggcagcagc

SEQ ID NO: 2457543 - RNA, 18 nt, Bordetella pertussis
cgccgaacggcagcagcg

SEQ ID NO: 2457544 - RNA, 23 nt, Bordetella pertussis
cgccgaacggcagcagcgcgccg

SEQ ID NO: 2457545 - RNA, 20 nt, Bordetella pertussis
cgccgaacggggccgccucg

SEQ ID NO: 2457546 - RNA, 22 nt, Bordetella pertussis
cgccgaacggggccgccucggc

SEQ ID NO: 2457547 - RNA, 16 nt, Bordetella pertussis
cgccgaacugccggcg

SEQ ID NO: 2457548 - RNA, 19 nt, Bordetella pertussis
cgccgaacugccggcgcgg

SEQ ID NO: 2457549 - RNA, 15 nt, Bordetella pertussis
cgccgaacugcuugc

SEQ ID NO: 2457550 - RNA, 17 nt, Bordetella pertussis
cgccgaacugcuugcgc

SEQ ID NO: 2457551 - RNA, 21 nt, Bordetella pertussis
cgccgaagccgccgccgucaa

SEQ ID NO: 2457552 - RNA, 18 nt, Bordetella pertussis
cgccgaagcgcaggccuu

SEQ ID NO: 2457553 - RNA, 20 nt, Bordetella pertussis
cgccgaaggcggcgccggug

SEQ ID NO: 2457554 - RNA, 14 nt, Bordetella pertussis
cgccgaagggcagg

SEQ ID NO: 2457555 - RNA, 17 nt, Bordetella pertussis
cgccgaagggcaggucg

SEQ ID NO: 2457556 - RNA, 21 nt, Bordetella pertussis
cgccgaagggcaggucgucga

SEQ ID NO: 2457557 - RNA, 22 nt, Bordetella pertussis
cgccgaaguaguuggucgagcg

SEQ ID NO: 2457558 - RNA, 21 nt, Bordetella pertussis
cgccgaagucggcgcgcgcuu

SEQ ID NO: 2457559 - RNA, 17 nt, Bordetella pertussis
cgccgaagucggcucgu

SEQ ID NO: 2457560 - RNA, 15 nt, Bordetella pertussis
cgccgaaguggcuca

SEQ ID NO: 2457561 - RNA, 13 nt, Bordetella pertussis
cgccgaauacgcu

SEQ ID NO: 2457562 - RNA, 20 nt, Bordetella pertussis
cgccgaauacgcucaggguu

SEQ ID NO: 2457563 - RNA, 17 nt, Bordetella pertussis
cgccgacaacggcgugc

SEQ ID NO: 2457564 - RNA, 23 nt, Bordetella pertussis
cgccgacaacggcgugcugcggc

SEQ ID NO: 2457565 - RNA, 19 nt, Bordetella pertussis
cgccgacagguaggcgccg

SEQ ID NO: 2457566 - RNA, 24 nt, Bordetella pertussis
cgccgacagguaggcgccggucca

SEQ ID NO: 2457567 - RNA, 14 nt, Bordetella pertussis
cgccgaccaccugc

SEQ ID NO: 2457568 - RNA, 19 nt, Bordetella pertussis
cgccgaccacgcugggcca

SEQ ID NO: 2457569 - RNA, 15 nt, Bordetella pertussis
cgccgaccagcucga

SEQ ID NO: 2457570 - RNA, 17 nt, Bordetella pertussis
cgccgaccagcucgacg

SEQ ID NO: 2457571 - RNA, 20 nt, Bordetella pertussis
cgccgaccagcucgacgcca

SEQ ID NO: 2457572 - RNA, 19 nt, Bordetella pertussis
cgccgaccagguaucgacc

SEQ ID NO: 2457573 - RNA, 20 nt, Bordetella pertussis
cgccgacccgagcccuggcu

SEQ ID NO: 2457574 - RNA, 14 nt, Bordetella pertussis
cgccgacccgggcg

SEQ ID NO: 2457575 - RNA, 15 nt, Bordetella pertussis
cgcgccaggccccgc

SEQ ID NO: 2457576 - RNA, 13 nt, Bordetella pertussis
cgcgccaggccgg

SEQ ID NO: 2457577 - RNA, 15 nt, Bordetella pertussis
cgcgccaggccggcg

SEQ ID NO: 2457578 - RNA, 18 nt, Bordetella pertussis
cgcgccaggcgccgggcc

SEQ ID NO: 2457579 - RNA, 15 nt, Bordetella pertussis
cgcgccaggcgcgca

SEQ ID NO: 2457580 - RNA, 22 nt, Bordetella pertussis
cgcgccaggcgguacaggccgg

SEQ ID NO: 2457581 - RNA, 16 nt, Bordetella pertussis
cgcgccaggcguagac

SEQ ID NO: 2457582 - RNA, 19 nt, Bordetella pertussis
cgcgccaggcguagaccac

SEQ ID NO: 2457583 - RNA, 14 nt, Bordetella pertussis
cgcgccagggcgcc

SEQ ID NO: 2457584 - RNA, 17 nt, Bordetella pertussis
cgcgccagggcgccgcg

SEQ ID NO: 2457585 - RNA, 16 nt, Bordetella pertussis
cgcgccaguucaaggc

SEQ ID NO: 2457586 - RNA, 19 nt, Bordetella pertussis
cgcgccaguugcgcaccgc

SEQ ID NO: 2457587 - RNA, 21 nt, Bordetella pertussis
cgcgccaucacggugucgaug

SEQ ID NO: 2457588 - RNA, 23 nt, Bordetella pertussis
cgcgccauccugaacgccgcgcu

SEQ ID NO: 2457589 - RNA, 22 nt, Bordetella pertussis
cgcgccaucgacgggcggcugc

SEQ ID NO: 2457590 - RNA, 15 nt, Bordetella pertussis
cgcgccaucgcgucg

SEQ ID NO: 2457591 - RNA, 19 nt, Bordetella pertussis
cgcgccaucgcgucgacgg

SEQ ID NO: 2457592 - RNA, 22 nt, Bordetella pertussis
cgcgccaucgcgucgacggugc

SEQ ID NO: 2457593 - RNA, 18 nt, Bordetella pertussis
cgcgccaugaacucgcgc

SEQ ID NO: 2457594 - RNA, 16 nt, Bordetella pertussis
cgcgccaugcucgcgc

SEQ ID NO: 2457595 - RNA, 17 nt, Bordetella pertussis
cgcgccaugcucgcgca

SEQ ID NO: 2457596 - RNA, 18 nt, Bordetella pertussis
cgcgccaugcucgcgcac

SEQ ID NO: 2457597 - RNA, 15 nt, Bordetella pertussis
cgcgccauggccggc

SEQ ID NO: 2457598 - RNA, 19 nt, Bordetella pertussis
cgcgccauggccggccgcc

SEQ ID NO: 2457599 - RNA, 13 nt, Bordetella pertussis
cgcgccauggucu

SEQ ID NO: 2457600 - RNA, 20 nt, Bordetella pertussis
cgcgccauggucucccccuc

SEQ ID NO: 2457601 - RNA, 23 nt, Bordetella pertussis
cgcgccauggugaacggccccgc

SEQ ID NO: 2457602 - RNA, 12 nt, Bordetella pertussis
cgcgccaugucg

SEQ ID NO: 2457603 - RNA, 17 nt, Bordetella pertussis
cgcgccaugucggggcu

SEQ ID NO: 2457604 - RNA, 16 nt, Bordetella pertussis
cgcgccauugccacgg

SEQ ID NO: 2457605 - RNA, 21 nt, Bordetella pertussis
cgcgcccacaggaacaggccg

SEQ ID NO: 2457606 - RNA, 13 nt, Bordetella pertussis
cgcgcccaccagg

SEQ ID NO: 2457607 - RNA, 14 nt, Bordetella pertussis
cgcgcccaccaggg

SEQ ID NO: 2457608 - RNA, 21 nt, Bordetella pertussis
cgcgcccaccagggugccgcc

SEQ ID NO: 2457609 - RNA, 15 nt, Bordetella pertussis
cgcgcccagcagcgc

SEQ ID NO: 2457610 - RNA, 22 nt, Bordetella pertussis
cgcgcccagcauggucggcaug

SEQ ID NO: 2457611 - RNA, 12 nt, Bordetella pertussis
cgcgcccagccc

SEQ ID NO: 2457612 - RNA, 19 nt, Bordetella pertussis
cgcgcccagccccgcggcc

SEQ ID NO: 2457613 - RNA, 21 nt, Bordetella pertussis
cgcgcccagccccgcggccgc

SEQ ID NO: 2457614 - RNA, 15 nt, Bordetella pertussis
cgcgcccagccgcgc

SEQ ID NO: 2457615 - RNA, 16 nt, Bordetella pertussis
cgcgcccagccgcgcc

SEQ ID NO: 2457616 - RNA, 15 nt, Bordetella pertussis
cgcgcccagcgcggc

SEQ ID NO: 2457617 - RNA, 13 nt, Bordetella pertussis
cgcgcccagcggc

SEQ ID NO: 2457618 - RNA, 14 nt, Bordetella pertussis
cgcgcccagcggca

SEQ ID NO: 2457619 - RNA, 14 nt, Bordetella pertussis
cgcgcccagcuguc

SEQ ID NO: 2457620 - RNA, 13 nt, Bordetella pertussis
cgcgcccaggcca

SEQ ID NO: 2457621 - RNA, 14 nt, Bordetella pertussis
cgcgcccaggggcc

SEQ ID NO: 2457622 - RNA, 18 nt, Bordetella pertussis
cgcgcccagggugguggc

SEQ ID NO: 2457623 - RNA, 22 nt, Bordetella pertussis
cgcgcccaguuccacgcggccg

SEQ ID NO: 2457624 - RNA, 17 nt, Bordetella pertussis
cgcgcccaucucggccg

SEQ ID NO: 2457625 - RNA, 20 nt, Bordetella pertussis
cgcgcccaucucggccgcgg

SEQ ID NO: 2457626 - RNA, 20 nt, Bordetella pertussis
cgcgcccauuucgauggcca

SEQ ID NO: 2457627 - RNA, 23 nt, Bordetella pertussis
cgcgcccauuucgauggccaggg

SEQ ID NO: 2457628 - RNA, 18 nt, Bordetella pertussis
cgcgccccaucaccaugg

SEQ ID NO: 2457629 - RNA, 16 nt, Bordetella pertussis
cgcgcccccacgccgc

SEQ ID NO: 2457630 - RNA, 15 nt, Bordetella pertussis
cgcgcccccagcgcc

SEQ ID NO: 2457631 - RNA, 16 nt, Bordetella pertussis
cgcgccccgucggccg

SEQ ID NO: 2457632 - RNA, 18 nt, Bordetella pertussis
cgcgccccuagcgccgcg

SEQ ID NO: 2457633 - RNA, 19 nt, Bordetella pertussis
cgcgccccuagcgccgcgc

SEQ ID NO: 2457634 - RNA, 13 nt, Bordetella pertussis
cgcgcccgagcgc

SEQ ID NO: 2457635 - RNA, 14 nt, Bordetella pertussis
cgcgcccgagcgcc

SEQ ID NO: 2457636 - RNA, 17 nt, Bordetella pertussis
cgcgcccgaggcgcgca

SEQ ID NO: 2457637 - RNA, 19 nt, Bordetella pertussis
cgcgcccgaggcgcgcagc

SEQ ID NO: 2457638 - RNA, 20 nt, Bordetella pertussis
cgcgcccgaggcgcgcagca

SEQ ID NO: 2457639 - RNA, 13 nt, Bordetella pertussis
cgcgcccgagugg

SEQ ID NO: 2457640 - RNA, 21 nt, Bordetella pertussis
cgcgcccgcaacgggccggcc

SEQ ID NO: 2457641 - RNA, 15 nt, Bordetella pertussis
cgcgcccgcaggcgg

SEQ ID NO: 2457642 - RNA, 19 nt, Bordetella pertussis
cgcgcccgcaggcggcggc

SEQ ID NO: 2457643 - RNA, 22 nt, Bordetella pertussis
cgcgcccgcaggcggcggccuc

SEQ ID NO: 2457644 - RNA, 17 nt, Bordetella pertussis
cgcgcccgccgcgucgg

SEQ ID NO: 2457645 - RNA, 12 nt, Bordetella pertussis
cgcgcccgccgu

SEQ ID NO: 2457646 - RNA, 17 nt, Bordetella pertussis
cgcgcccgccguggcca

SEQ ID NO: 2457647 - RNA, 17 nt, Bordetella pertussis
cgcgcccggccggcccu

SEQ ID NO: 2457648 - RNA, 12 nt, Bordetella pertussis
cgcgcccggcga

SEQ ID NO: 2457649 - RNA, 13 nt, Bordetella pertussis
cgcgcccggcgcg

SEQ ID NO: 2457650 - RNA, 15 nt, Bordetella pertussis
cgcgcccggcgcgcc

SEQ ID NO: 2457651 - RNA, 14 nt, Bordetella pertussis
cgcgcccggcggcc

SEQ ID NO: 2457652 - RNA, 15 nt, Bordetella pertussis
cgcgcccggcggcca

SEQ ID NO: 2457653 - RNA, 17 nt, Bordetella pertussis
cgcgcccggcggccagg

SEQ ID NO: 2457654 - RNA, 18 nt, Bordetella pertussis
cgcgcccggcggccaggc

SEQ ID NO: 2457655 - RNA, 16 nt, Bordetella pertussis
cgcgcccgggccgucu

SEQ ID NO: 2457656 - RNA, 21 nt, Bordetella pertussis
cgcgcccggucugccacacgc

SEQ ID NO: 2457657 - RNA, 18 nt, Bordetella pertussis
cgcgcccguccacggccu

SEQ ID NO: 2457658 - RNA, 22 nt, Bordetella pertussis
cgcgcccguccacggccugcgc

SEQ ID NO: 2457659 - RNA, 18 nt, Bordetella pertussis
cgcgcccugcacgcgcgc

SEQ ID NO: 2457660 - RNA, 22 nt, Bordetella pertussis
cgcgcccugcuugagcgaaaug

SEQ ID NO: 2457661 - RNA, 20 nt, Bordetella pertussis
cgcgcccuggcgccgcggcc

SEQ ID NO: 2457662 - RNA, 15 nt, Bordetella pertussis
cgcgcccuggcgcgg

SEQ ID NO: 2457663 - RNA, 17 nt, Bordetella pertussis
cgcgcccuggcgcggcg

SEQ ID NO: 2457664 - RNA, 13 nt, Bordetella pertussis
cgcgcccuugccg

SEQ ID NO: 2457665 - RNA, 19 nt, Bordetella pertussis
cgcgccgaaaugcacgacg

SEQ ID NO: 2457666 - RNA, 23 nt, Bordetella pertussis
cgcgccgaaaugcacgacgucgu

SEQ ID NO: 2457667 - RNA, 14 nt, Bordetella pertussis
cgcgccgaacgcgc

SEQ ID NO: 2457668 - RNA, 13 nt, Bordetella pertussis
cgcgccgaagcgc

SEQ ID NO: 2457669 - RNA, 18 nt, Bordetella pertussis
cgcgccgaagcgcaggcc

SEQ ID NO: 2457670 - RNA, 21 nt, Bordetella pertussis
cgcgccgaaguugcggccgug

SEQ ID NO: 2457671 - RNA, 14 nt, Bordetella pertussis
cgcgccgaccaccu

SEQ ID NO: 2457672 - RNA, 15 nt, Bordetella pertussis
cgcgccgaccaccug

SEQ ID NO: 2457673 - RNA, 16 nt, Bordetella pertussis
cgcgccgaccacgcug

SEQ ID NO: 2457674 - RNA, 19 nt, Bordetella pertussis
cgcgccgaccacgcugggc

SEQ ID NO: 2457675 - RNA, 16 nt, Bordetella pertussis
cgcgccgaccaggucg

SEQ ID NO: 2457676 - RNA, 13 nt, Bordetella pertussis
cgcgccgaccggc

SEQ ID NO: 2457677 - RNA, 16 nt, Bordetella pertussis
cgcgccgaccggcccc

SEQ ID NO: 2457678 - RNA, 20 nt, Bordetella pertussis
cgcgccgacggcggcgcggc

SEQ ID NO: 2457679 - RNA, 19 nt, Bordetella pertussis
cgcgccgaggaucuggccg

SEQ ID NO: 2457680 - RNA, 22 nt, Bordetella pertussis
cgcgccgaggaucuggccggcg

SEQ ID NO: 2457681 - RNA, 17 nt, Bordetella pertussis
cgcgccgaugcgccagg

SEQ ID NO: 2457682 - RNA, 18 nt, Bordetella pertussis
cgcgccgcaauagaucau

SEQ ID NO: 2457683 - RNA, 14 nt, Bordetella pertussis
cgcgccgcacgcuc

SEQ ID NO: 2457684 - RNA, 14 nt, Bordetella pertussis
cgcgccgcaggccg

SEQ ID NO: 2457685 - RNA, 14 nt, Bordetella pertussis
cgcgccgccagcgc

SEQ ID NO: 2457686 - RNA, 16 nt, Bordetella pertussis
cgcgccgccagcgcgc

SEQ ID NO: 2457687 - RNA, 14 nt, Bordetella pertussis
cgcgccgcccacca

SEQ ID NO: 2457688 - RNA, 19 nt, Bordetella pertussis
cgcgccgcccaccaccagc

SEQ ID NO: 2457689 - RNA, 20 nt, Bordetella pertussis
cgcgccgcccaccaccagcg

SEQ ID NO: 2457690 - RNA, 22 nt, Bordetella pertussis
cgcgccguaccccagcaugugc

SEQ ID NO: 2457691 - RNA, 19 nt, Bordetella pertussis
cgcgccguaccugcagcag

SEQ ID NO: 2457692 - RNA, 21 nt, Bordetella pertussis
cgcgccguaccugcagcaggc

SEQ ID NO: 2457693 - RNA, 22 nt, Bordetella pertussis
cgcgccguauucagugcgacgg

SEQ ID NO: 2457694 - RNA, 18 nt, Bordetella pertussis
cgcgccguccgagcccga

SEQ ID NO: 2457695 - RNA, 23 nt, Bordetella pertussis
cgcgccgucgaacuccugcagca

SEQ ID NO: 2457696 - RNA, 14 nt, Bordetella pertussis
cgcgccgucggcgu

SEQ ID NO: 2457697 - RNA, 15 nt, Bordetella pertussis
cgcgccgugcagacg

SEQ ID NO: 2457698 - RNA, 20 nt, Bordetella pertussis
cgcgccgugcagacggcggc

SEQ ID NO: 2457699 - RNA, 18 nt, Bordetella pertussis
cgcgccguucucaggccg

SEQ ID NO: 2457700 - RNA, 22 nt, Bordetella pertussis
cgcgccguucucaggccgaggc

SEQ ID NO: 2457701 - RNA, 19 nt, Bordetella pertussis
cgcgccuacagcagcggcu

SEQ ID NO: 2457702 - RNA, 16 nt, Bordetella pertussis
cgcgccuaccggcgcc

SEQ ID NO: 2457703 - RNA, 18 nt, Bordetella pertussis
cgcgccuaccggcgccga

SEQ ID NO: 2457704 - RNA, 21 nt, Bordetella pertussis
cgcgccuaccggcgccgacgc

SEQ ID NO: 2457705 - RNA, 20 nt, Bordetella pertussis
cgcgccuauaucgacggcgc

SEQ ID NO: 2457706 - RNA, 23 nt, Bordetella pertussis
cgcgccuauaucgacggcgccua

SEQ ID NO: 2457707 - RNA, 15 nt, Bordetella pertussis
cgcgccuaucaggcc

SEQ ID NO: 2457708 - RNA, 13 nt, Bordetella pertussis
cgcgccuccagcu

SEQ ID NO: 2457709 - RNA, 21 nt, Bordetella pertussis
cgcgccuccagcuccagcgcg

SEQ ID NO: 2457710 - RNA, 14 nt, Bordetella pertussis
cgcgccucgaugau

SEQ ID NO: 2457711 - RNA, 19 nt, Bordetella pertussis
cgcgccucgaugauggcgu

SEQ ID NO: 2457712 - RNA, 19 nt, Bordetella pertussis
cgcgccucggcgcgcgcgg

SEQ ID NO: 2457713 - RNA, 23 nt, Bordetella pertussis
cgcgccucgugcgaggccacggc

SEQ ID NO: 2457714 - RNA, 14 nt, Bordetella pertussis
cgcgccugagcugc

SEQ ID NO: 2457715 - RNA, 15 nt, Bordetella pertussis
cgcgccugagcugcc

SEQ ID NO: 2457716 - RNA, 19 nt, Bordetella pertussis
cgcgccugcagcacggcca

SEQ ID NO: 2457717 - RNA, 19 nt, Bordetella pertussis
cgcgccugcagcagcggca

SEQ ID NO: 2457718 - RNA, 21 nt, Bordetella pertussis
cgcgccugcagcagcggcagc

SEQ ID NO: 2457719 - RNA, 15 nt, Bordetella pertussis
cgcgccugcaugcca

SEQ ID NO: 2457720 - RNA, 15 nt, Bordetella pertussis
cgcgccugcaugucc

SEQ ID NO: 2457721 - RNA, 21 nt, Bordetella pertussis
cgcgccugcauguccagcggc

SEQ ID NO: 2457722 - RNA, 22 nt, Bordetella pertussis
cgcgccugcauguccagcggcg

SEQ ID NO: 2457723 - RNA, 13 nt, Bordetella pertussis
cgcgccugcccag

SEQ ID NO: 2457724 - RNA, 14 nt, Bordetella pertussis
cgcgccugcccagg

SEQ ID NO: 2457725 - RNA, 13 nt, Bordetella pertussis
cgcgccugcccgc

SEQ ID NO: 2457726 - RNA, 14 nt, Bordetella pertussis
cgcgccugcccgca

SEQ ID NO: 2457727 - RNA, 20 nt, Bordetella pertussis
cgcgccugcccgcaacgccg

SEQ ID NO: 2457728 - RNA, 15 nt, Bordetella pertussis
cgcgccugcgcgccg

SEQ ID NO: 2457729 - RNA, 16 nt, Bordetella pertussis
cgcgccugcgcgccgc

SEQ ID NO: 2457730 - RNA, 17 nt, Bordetella pertussis
cgcgccugcgcgccgcc

SEQ ID NO: 2457731 - RNA, 21 nt, Bordetella pertussis
cgcgccugcucguacagcggc

SEQ ID NO: 2457732 - RNA, 22 nt, Bordetella pertussis
cgcgccugcucguacagcggca

SEQ ID NO: 2457733 - RNA, 14 nt, Bordetella pertussis
cgcgccuggcgcgc

SEQ ID NO: 2457734 - RNA, 16 nt, Bordetella pertussis
cgcgccuggcgcgccc

SEQ ID NO: 2457735 - RNA, 19 nt, Bordetella pertussis
cgcgccuggcgcgcccacu

SEQ ID NO: 2457736 - RNA, 23 nt, Bordetella pertussis
cgcgccugggggcuggaggcgca

SEQ ID NO: 2457737 - RNA, 22 nt, Bordetella pertussis
cgcgccuuacgcggcgcgcgcc

SEQ ID NO: 2457738 - RNA, 15 nt, Bordetella pertussis
cgcgccuucggcagg

SEQ ID NO: 2457739 - RNA, 19 nt, Bordetella pertussis
cgcgccuucggcaggcgcc

SEQ ID NO: 2457740 - RNA, 22 nt, Bordetella pertussis
cgcgccuucggcaggcgccggc

SEQ ID NO: 2457741 - RNA, 16 nt, Bordetella pertussis
cgcgccuucggcgcgc

SEQ ID NO: 2457742 - RNA, 17 nt, Bordetella pertussis
cgcgccuucggcgcgca

SEQ ID NO: 2457743 - RNA, 14 nt, Bordetella pertussis
cgcgccuucuaccc

SEQ ID NO: 2457744 - RNA, 19 nt, Bordetella pertussis
cgcgccuugcgcggcgagc

SEQ ID NO: 2457745 - RNA, 21 nt, Bordetella pertussis
cgcgccuugcgcggcgagcgc

SEQ ID NO: 2457746 - RNA, 15 nt, Bordetella pertussis
cgcgcgaacacugga

SEQ ID NO: 2457747 - RNA, 16 nt, Bordetella pertussis
cgcgcgacagccgcgc

SEQ ID NO: 2457748 - RNA, 23 nt, Bordetella pertussis
cgcgcgacagccgcgccagcgcc

SEQ ID NO: 2457749 - RNA, 16 nt, Bordetella pertussis
cgcgcgaccacuggca

SEQ ID NO: 2457750 - RNA, 18 nt, Bordetella pertussis
cgcgcgaccacuggcaga

SEQ ID NO: 2457751 - RNA, 13 nt, Bordetella pertussis
cgcgcgacgccgu

SEQ ID NO: 2457752 - RNA, 14 nt, Bordetella pertussis
cgcgcgacggcgcc

SEQ ID NO: 2457753 - RNA, 21 nt, Bordetella pertussis
cgcgcgacgugucggccacca

SEQ ID NO: 2457754 - RNA, 20 nt, Bordetella pertussis
cgcgcgacuccaccggcguc

SEQ ID NO: 2457755 - RNA, 19 nt, Bordetella pertussis
cgcgcgacuuccucgaccc

SEQ ID NO: 2457756 - RNA, 23 nt, Bordetella pertussis
cgcgcgacuuccucgacccgcgc

SEQ ID NO: 2457757 - RNA, 24 nt, Bordetella pertussis
cgcgcgacuuccucgacccgcgcc

SEQ ID NO: 2457758 - RNA, 23 nt, Bordetella pertussis
cgcgcgagaauggcgcgauccag

SEQ ID NO: 2457759 - RNA, 15 nt, Bordetella pertussis
cgcgcgagaccagcg

SEQ ID NO: 2457760 - RNA, 15 nt, Bordetella pertussis
cgcgcgagcagucga

SEQ ID NO: 2457761 - RNA, 16 nt, Bordetella pertussis
cgcgcgagcgcaagca

SEQ ID NO: 2457762 - RNA, 12 nt, Bordetella pertussis
cgcgcgagcggc

SEQ ID NO: 2457763 - RNA, 20 nt, Bordetella pertussis
cgcgcgagcggcggccgcgu

SEQ ID NO: 2457764 - RNA, 17 nt, Bordetella pertussis
cgcgcgagcggcgugcg

SEQ ID NO: 2457765 - RNA, 15 nt, Bordetella pertussis
cgcgcgagggugccu

SEQ ID NO: 2457766 - RNA, 13 nt, Bordetella pertussis
cgcgcgaucaggc

SEQ ID NO: 2457767 - RNA, 16 nt, Bordetella pertussis
cgcgcgauccgcgcca

SEQ ID NO: 2457768 - RNA, 19 nt, Bordetella pertussis
cgcgcgauccgcgccaggc

SEQ ID NO: 2457769 - RNA, 15 nt, Bordetella pertussis
cgcgcgauccggcgu

SEQ ID NO: 2457770 - RNA, 15 nt, Bordetella pertussis
cgcgcgaucgccagc

SEQ ID NO: 2457771 - RNA, 17 nt, Bordetella pertussis
cgcgcgaucgccagcag

SEQ ID NO: 2457772 - RNA, 19 nt, Bordetella pertussis
cgcgcgaucgccagcaggc

SEQ ID NO: 2457773 - RNA, 16 nt, Bordetella pertussis
cgcgcgaucucgggca

SEQ ID NO: 2457774 - RNA, 19 nt, Bordetella pertussis
cgcgcgaucucgggcaggu

SEQ ID NO: 2457775 - RNA, 16 nt, Bordetella pertussis
cgcgcgaugcgcaggc

SEQ ID NO: 2457776 - RNA, 17 nt, Bordetella pertussis
cgcgcgaugcgcggccc

SEQ ID NO: 2457777 - RNA, 18 nt, Bordetella pertussis
cgcgcgauguucaggccg

SEQ ID NO: 2457778 - RNA, 17 nt, Bordetella pertussis
cgcgcgcaagccgccgc

SEQ ID NO: 2457779 - RNA, 19 nt, Bordetella pertussis
cgcgcgcaagccgccgccc

SEQ ID NO: 2457780 - RNA, 20 nt, Bordetella pertussis
cgcgcgcaaugcgcggcgcu

SEQ ID NO: 2457781 - RNA, 15 nt, Bordetella pertussis
cgcgcgcacaggcgc

SEQ ID NO: 2457782 - RNA, 16 nt, Bordetella pertussis
cgcgcgcacaggcgcu

SEQ ID NO: 2457783 - RNA, 20 nt, Bordetella pertussis
cgcgcgcacaggcgcucgcc

SEQ ID NO: 2457784 - RNA, 19 nt, Bordetella pertussis
cgcgcgcacgaccaccagc

SEQ ID NO: 2457785 - RNA, 12 nt, Bordetella pertussis
cgcgcgcagccg

SEQ ID NO: 2457786 - RNA, 14 nt, Bordetella pertussis
cgcgcgcagcgcgc

SEQ ID NO: 2457787 - RNA, 20 nt, Bordetella pertussis
cgcgcgcaggucguggccgu

SEQ ID NO: 2457788 - RNA, 13 nt, Bordetella pertussis
cgcgcgcaguccu

SEQ ID NO: 2457789 - RNA, 20 nt, Bordetella pertussis
cgcgcgcaucacgcuggccg

SEQ ID NO: 2457790 - RNA, 13 nt, Bordetella pertussis
cgcgcgcauccag

SEQ ID NO: 2457791 - RNA, 13 nt, Bordetella pertussis
cgcgcgcaucggc

SEQ ID NO: 2457792 - RNA, 14 nt, Bordetella pertussis
cgcgcgcaucggcc

SEQ ID NO: 2457793 - RNA, 15 nt, Bordetella pertussis
cgcgcgcaucggccg

SEQ ID NO: 2457794 - RNA, 13 nt, Bordetella pertussis
cgcgcgcaugcgc

SEQ ID NO: 2457795 - RNA, 15 nt, Bordetella pertussis
cgcgcgcaugcgcac

SEQ ID NO: 2457796 - RNA, 11 nt, Bordetella pertussis
cgcgcgccacc

SEQ ID NO: 2457797 - RNA, 16 nt, Bordetella pertussis
cgcgcgccaccaccuc

SEQ ID NO: 2457798 - RNA, 15 nt, Bordetella pertussis
cgcgcgccaccgcca

SEQ ID NO: 2457799 - RNA, 13 nt, Bordetella pertussis
cgcgcgccacuau

SEQ ID NO: 2457800 - RNA, 12 nt, Bordetella pertussis
cgcgcgccagcg

SEQ ID NO: 2457801 - RNA, 13 nt, Bordetella pertussis
cgcgcgccagcgc

SEQ ID NO: 2457802 - RNA, 14 nt, Bordetella pertussis
cgcgcgccagcgcc

SEQ ID NO: 2457803 - RNA, 15 nt, Bordetella pertussis
cgcgcgccagcgccu

SEQ ID NO: 2457804 - RNA, 20 nt, Bordetella pertussis
cgcgcgccagcugggcguug

SEQ ID NO: 2457805 - RNA, 21 nt, Bordetella pertussis
cgcgcggugucgccgccgcgc

SEQ ID NO: 2457806 - RNA, 22 nt, Bordetella pertussis
cgcgcggugucgccgccgcgcc

SEQ ID NO: 2457807 - RNA, 21 nt, Bordetella pertussis
cgcgcgguguucgagccggac

SEQ ID NO: 2457808 - RNA, 16 nt, Bordetella pertussis
cgcgcgguucaucgcc

SEQ ID NO: 2457809 - RNA, 21 nt, Bordetella pertussis
cgcgcgguucgcauagcgccg

SEQ ID NO: 2457810 - RNA, 21 nt, Bordetella pertussis
cgcgcgguucgccgugcaggg

SEQ ID NO: 2457811 - RNA, 17 nt, Bordetella pertussis
cgcgcgguugagcgcca

SEQ ID NO: 2457812 - RNA, 19 nt, Bordetella pertussis
cgcgcgguugagcgccagg

SEQ ID NO: 2457813 - RNA, 16 nt, Bordetella pertussis
cgcgcguaucggcgcg

SEQ ID NO: 2457814 - RNA, 19 nt, Bordetella pertussis
cgcgcguaucggcgcgagc

SEQ ID NO: 2457815 - RNA, 20 nt, Bordetella pertussis
cgcgcguaucggcgcgagcg

SEQ ID NO: 2457816 - RNA, 23 nt, Bordetella pertussis
cgcgcguauggcggcgccgagau

SEQ ID NO: 2457817 - RNA, 16 nt, Bordetella pertussis
cgcgcguccugcgcca

SEQ ID NO: 2457818 - RNA, 15 nt, Bordetella pertussis
cgcgcguccuuggcg

SEQ ID NO: 2457819 - RNA, 14 nt, Bordetella pertussis
cgcgcgucgccgcu

SEQ ID NO: 2457820 - RNA, 14 nt, Bordetella pertussis
cgcgcgucgugccc

SEQ ID NO: 2457821 - RNA, 17 nt, Bordetella pertussis
cgcgcgucgugcccgcc

SEQ ID NO: 2457822 - RNA, 15 nt, Bordetella pertussis
cgcgcgugauggaga

SEQ ID NO: 2457823 - RNA, 18 nt, Bordetella pertussis
cgcgcgugcagcgccgcg

SEQ ID NO: 2457824 - RNA, 22 nt, Bordetella pertussis
cgcgcgugcagcgccgcgcgcu

SEQ ID NO: 2457825 - RNA, 14 nt, Bordetella pertussis
cgcgcgugcaggcc

SEQ ID NO: 2457826 - RNA, 15 nt, Bordetella pertussis
cgcgcgugcaggccg

SEQ ID NO: 2457827 - RNA, 16 nt, Bordetella pertussis
cgcgcgugccgcaggc

SEQ ID NO: 2457828 - RNA, 15 nt, Bordetella pertussis
cgcgcgugccgcgca

SEQ ID NO: 2457829 - RNA, 16 nt, Bordetella pertussis
cgcgcgugccgcgcag

SEQ ID NO: 2457830 - RNA, 14 nt, Bordetella pertussis
cgcgcgugcggggc

SEQ ID NO: 2457831 - RNA, 23 nt, Bordetella pertussis
cgcgcgugcggggcggcaggucg

SEQ ID NO: 2457832 - RNA, 16 nt, Bordetella pertussis
cgcgcgugcugggcca

SEQ ID NO: 2457833 - RNA, 23 nt, Bordetella pertussis
cgcgcgugcugggccaugcguau

SEQ ID NO: 2457834 - RNA, 13 nt, Bordetella pertussis
cgcgcguugaccg

SEQ ID NO: 2457835 - RNA, 14 nt, Bordetella pertussis
cgcgcguugaccgc

SEQ ID NO: 2457836 - RNA, 19 nt, Bordetella pertussis
cgcgcguugaccgccucga

SEQ ID NO: 2457837 - RNA, 12 nt, Bordetella pertussis
cgcgcucagcac

SEQ ID NO: 2457838 - RNA, 18 nt, Bordetella pertussis
cgcgcucagcaccaggcc

SEQ ID NO: 2457839 - RNA, 19 nt, Bordetella pertussis
cgcgcucagcaccaggccg

SEQ ID NO: 2457840 - RNA, 20 nt, Bordetella pertussis
cgcgcucagcaccaggccgc

SEQ ID NO: 2457841 - RNA, 14 nt, Bordetella pertussis
cgcgcucaggccgc

SEQ ID NO: 2457842 - RNA, 15 nt, Bordetella pertussis
cgcgcucaggccgcc

SEQ ID NO: 2457843 - RNA, 16 nt, Bordetella pertussis
cgcgcucaggccgcug

SEQ ID NO: 2457844 - RNA, 19 nt, Bordetella pertussis
cgcgcucaggccgcugggc

SEQ ID NO: 2457845 - RNA, 20 nt, Bordetella pertussis
cgcgcucaggccgcugggca

SEQ ID NO: 2457846 - RNA, 13 nt, Bordetella pertussis
cgcgcucaggggg

SEQ ID NO: 2457847 - RNA, 20 nt, Bordetella pertussis
cgcgcucagggggcgcccca

SEQ ID NO: 2457848 - RNA, 14 nt, Bordetella pertussis
cgcgcucauggcgc

SEQ ID NO: 2457849 - RNA, 21 nt, Bordetella pertussis
cgcgcuccggcugcgcgcgca

SEQ ID NO: 2457850 - RNA, 16 nt, Bordetella pertussis
cgcgcuccugcucggc

SEQ ID NO: 2457851 - RNA, 17 nt, Bordetella pertussis
cgcgcuccugcucggcg

SEQ ID NO: 2457852 - RNA, 19 nt, Bordetella pertussis
cgcgcuccugcucggcgau

SEQ ID NO: 2457853 - RNA, 20 nt, Bordetella pertussis
cgcgcucgaauggcugcgcg

SEQ ID NO: 2457854 - RNA, 22 nt, Bordetella pertussis
cgcgcucgagcaucuggcgcau

SEQ ID NO: 2457855 - RNA, 17 nt, Bordetella pertussis
cgcgcucgagcgcggcg

SEQ ID NO: 2457856 - RNA, 18 nt, Bordetella pertussis
cgcgcucgcccagccgcc

SEQ ID NO: 2457857 - RNA, 20 nt, Bordetella pertussis
cgcgcucgcccagccgccug

SEQ ID NO: 2457858 - RNA, 15 nt, Bordetella pertussis
cgcgcucgcccggcc

SEQ ID NO: 2457859 - RNA, 17 nt, Bordetella pertussis
cgcgcucgcccggccac

SEQ ID NO: 2457860 - RNA, 20 nt, Bordetella pertussis
cgcgcucgcccggccacgug

SEQ ID NO: 2457861 - RNA, 15 nt, Bordetella pertussis
cgcgcucgcgccagg

SEQ ID NO: 2457862 - RNA, 17 nt, Bordetella pertussis
cgcgcucgcgccaggcc

SEQ ID NO: 2457863 - RNA, 14 nt, Bordetella pertussis
cgcgcucgcugccg

SEQ ID NO: 2457864 - RNA, 17 nt, Bordetella pertussis
cgcgcucgcugccggcg

SEQ ID NO: 2457865 - RNA, 16 nt, Bordetella pertussis
cgcgcucggacgccgc

SEQ ID NO: 2457866 - RNA, 15 nt, Bordetella pertussis
cgcgcucggccagca

SEQ ID NO: 2457867 - RNA, 17 nt, Bordetella pertussis
cgcgcucggccagcaug

SEQ ID NO: 2457868 - RNA, 15 nt, Bordetella pertussis
cgcgcucggccagcg

SEQ ID NO: 2457869 - RNA, 16 nt, Bordetella pertussis
cgcgcucggccagcgc

SEQ ID NO: 2457870 - RNA, 17 nt, Bordetella pertussis
cgcgcucggccagcgcg

SEQ ID NO: 2457871 - RNA, 18 nt, Bordetella pertussis
cgcgcucggccagcgcgc

SEQ ID NO: 2457872 - RNA, 19 nt, Bordetella pertussis
cgcgcucggccagcgcgcg

SEQ ID NO: 2457873 - RNA, 15 nt, Bordetella pertussis
cgcgcucggcgacgg

SEQ ID NO: 2457874 - RNA, 16 nt, Bordetella pertussis
cgcgcucggcgccggg

SEQ ID NO: 2457875 - RNA, 17 nt, Bordetella pertussis
cgcgcucggcgccgggc

SEQ ID NO: 2457876 - RNA, 14 nt, Bordetella pertussis
cgcgcucgggcagc

SEQ ID NO: 2457877 - RNA, 23 nt, Bordetella pertussis
cgcgcucgggcagcucgcggucg

SEQ ID NO: 2457878 - RNA, 18 nt, Bordetella pertussis
cgcgcucuccgaacaggc

SEQ ID NO: 2457879 - RNA, 22 nt, Bordetella pertussis
cgcgcugaauccggggugccug

SEQ ID NO: 2457880 - RNA, 13 nt, Bordetella pertussis
cgcgcugacgaaa

SEQ ID NO: 2457881 - RNA, 15 nt, Bordetella pertussis
cgcgcugacgaaaug

SEQ ID NO: 2457882 - RNA, 19 nt, Bordetella pertussis
cgcgcugaugcgcggcggg

SEQ ID NO: 2457883 - RNA, 19 nt, Bordetella pertussis
cgcgcugcaauugcgcggc

SEQ ID NO: 2457884 - RNA, 13 nt, Bordetella pertussis
cgcgcugcacggc

SEQ ID NO: 2457885 - RNA, 15 nt, Bordetella pertussis
cgcgcugcacggccu

SEQ ID NO: 2457886 - RNA, 14 nt, Bordetella pertussis
cgcgcugcagcaug

SEQ ID NO: 2457887 - RNA, 23 nt, Bordetella pertussis
cgcgcugcaggaucgcggccagc

SEQ ID NO: 2457888 - RNA, 16 nt, Bordetella pertussis
cgcgcugcccaccgcc

SEQ ID NO: 2457889 - RNA, 20 nt, Bordetella pertussis
cgcgcugcccaccgccgugg

SEQ ID NO: 2457890 - RNA, 13 nt, Bordetella pertussis
cgcgcugcccagc

SEQ ID NO: 2457891 - RNA, 15 nt, Bordetella pertussis
cgcgcugcccagcca

SEQ ID NO: 2457892 - RNA, 19 nt, Bordetella pertussis
cgcgcugcccagccacacc

SEQ ID NO: 2457893 - RNA, 13 nt, Bordetella pertussis
cgcgcugccgcug

SEQ ID NO: 2457894 - RNA, 15 nt, Bordetella pertussis
cgcgcugcgacagca

SEQ ID NO: 2457895 - RNA, 17 nt, Bordetella pertussis
cgcgcugcgacagcagc

SEQ ID NO: 2457896 - RNA, 20 nt, Bordetella pertussis
cgcgcugcgacagcagcaug

SEQ ID NO: 2457897 - RNA, 14 nt, Bordetella pertussis
cgcgcugcgcccgc

SEQ ID NO: 2457898 - RNA, 15 nt, Bordetella pertussis
cgcgcugcgcccgcu

SEQ ID NO: 2457899 - RNA, 14 nt, Bordetella pertussis
cgcgcugcgcgccg

SEQ ID NO: 2457900 - RNA, 13 nt, Bordetella pertussis
cgcgcugcgguca

SEQ ID NO: 2457901 - RNA, 19 nt, Bordetella pertussis
cgcgcugcucuccaugcug

SEQ ID NO: 2457902 - RNA, 20 nt, Bordetella pertussis
cgcgcugcucuccaugcuga

SEQ ID NO: 2457903 - RNA, 17 nt, Bordetella pertussis
cgcgcugcugcaggccg

SEQ ID NO: 2457904 - RNA, 18 nt, Bordetella pertussis
cgcgcugcuuucccuguc

SEQ ID NO: 2457905 - RNA, 15 nt, Bordetella pertussis
cgcgcuggacgucgg

SEQ ID NO: 2457906 - RNA, 22 nt, Bordetella pertussis
cgcgcuggccccagaugccggu

SEQ ID NO: 2457907 - RNA, 21 nt, Bordetella pertussis
cgcgcuggcccgcgcgagcgg

SEQ ID NO: 2457908 - RNA, 22 nt, Bordetella pertussis
cgcgcuggcccgcgcgagcggc

SEQ ID NO: 2457909 - RNA, 12 nt, Bordetella pertussis
cgcgcuggccga

SEQ ID NO: 2457910 - RNA, 13 nt, Bordetella pertussis
cgcgcuggccgac

SEQ ID NO: 2457911 - RNA, 12 nt, Bordetella pertussis
cgcgcuggcgca

SEQ ID NO: 2457912 - RNA, 13 nt, Bordetella pertussis
cgcgcuggcgcag

SEQ ID NO: 2457913 - RNA, 14 nt, Bordetella pertussis
cgcgcuggcgcagc

SEQ ID NO: 2457914 - RNA, 19 nt, Bordetella pertussis
cgcgcuggcgcagcaggcg

SEQ ID NO: 2457915 - RNA, 20 nt, Bordetella pertussis
cgcgcuggcgcagcaggcgc

SEQ ID NO: 2457916 - RNA, 22 nt, Bordetella pertussis
cgcgcuggcgcagcaggcgcgc

SEQ ID NO: 2457917 - RNA, 12 nt, Bordetella pertussis
cgcgcuggcgcc

SEQ ID NO: 2457918 - RNA, 13 nt, Bordetella pertussis
cgcgcuggcgccc

SEQ ID NO: 2457919 - RNA, 13 nt, Bordetella pertussis
cgcgcuggcgcgc

SEQ ID NO: 2457920 - RNA, 21 nt, Bordetella pertussis
cgcgcuggcgcgcgacggcgc

SEQ ID NO: 2457921 - RNA, 17 nt, Bordetella pertussis
cgcggccagcagcgcgu

SEQ ID NO: 2457922 - RNA, 18 nt, Bordetella pertussis
cgcggccagcagcgcgug

SEQ ID NO: 2457923 - RNA, 12 nt, Bordetella pertussis
cgcggccagcca

SEQ ID NO: 2457924 - RNA, 23 nt, Bordetella pertussis
cgcggccagccacgccggcgcgc

SEQ ID NO: 2457925 - RNA, 14 nt, Bordetella pertussis
cgcggccagcgccg

SEQ ID NO: 2457926 - RNA, 13 nt, Bordetella pertussis
cgcggccagcgcg

SEQ ID NO: 2457927 - RNA, 14 nt, Bordetella pertussis
cgcggccagcgcgu

SEQ ID NO: 2457928 - RNA, 17 nt, Bordetella pertussis
cgcggccagcgcgucga

SEQ ID NO: 2457929 - RNA, 16 nt, Bordetella pertussis
cgcggccagcggcagg

SEQ ID NO: 2457930 - RNA, 16 nt, Bordetella pertussis
cgcggccagcggcgcu

SEQ ID NO: 2457931 - RNA, 12 nt, Bordetella pertussis
cgcggccaggcc

SEQ ID NO: 2457932 - RNA, 14 nt, Bordetella pertussis
cgcggccaggccca

SEQ ID NO: 2457933 - RNA, 16 nt, Bordetella pertussis
cgcggccaggcccaug

SEQ ID NO: 2457934 - RNA, 14 nt, Bordetella pertussis
cgcggccaggcgcg

SEQ ID NO: 2457935 - RNA, 21 nt, Bordetella pertussis
cgcggccaggcgcgugcgcag

SEQ ID NO: 2457936 - RNA, 22 nt, Bordetella pertussis
cgcggccaggcgcgugcgcagg

SEQ ID NO: 2457937 - RNA, 15 nt, Bordetella pertussis
cgcggccaggcgcuc

SEQ ID NO: 2457938 - RNA, 13 nt, Bordetella pertussis
cgcggccagggcu

SEQ ID NO: 2457939 - RNA, 21 nt, Bordetella pertussis
cgcggccagggcugcggcggg

SEQ ID NO: 2457940 - RNA, 14 nt, Bordetella pertussis
cgcggccaggguca

SEQ ID NO: 2457941 - RNA, 18 nt, Bordetella pertussis
cgcggccagggugccccg

SEQ ID NO: 2457942 - RNA, 19 nt, Bordetella pertussis
cgcggccagggugccccgc

SEQ ID NO: 2457943 - RNA, 20 nt, Bordetella pertussis
cgcggccagggugccccgcc

SEQ ID NO: 2457944 - RNA, 14 nt, Bordetella pertussis
cgcggccaggucgg

SEQ ID NO: 2457945 - RNA, 14 nt, Bordetella pertussis
cgcggccaugccgg

SEQ ID NO: 2457946 - RNA, 21 nt, Bordetella pertussis
cgcggccaugcggugcgccgc

SEQ ID NO: 2457947 - RNA, 13 nt, Bordetella pertussis
cgcggccaugucc

SEQ ID NO: 2457948 - RNA, 12 nt, Bordetella pertussis
cgcggcccacgg

SEQ ID NO: 2457949 - RNA, 15 nt, Bordetella pertussis
cgcggcccacggcca

SEQ ID NO: 2457950 - RNA, 16 nt, Bordetella pertussis
cgcggcccacggccag

SEQ ID NO: 2457951 - RNA, 18 nt, Bordetella pertussis
cgcggcccacggccagca

SEQ ID NO: 2457952 - RNA, 19 nt, Bordetella pertussis
cgcggcccacggccagcac

SEQ ID NO: 2457953 - RNA, 20 nt, Bordetella pertussis
cgcggcccagcgcggcggcc

SEQ ID NO: 2457954 - RNA, 18 nt, Bordetella pertussis
cgcggccccaugcgcggc

SEQ ID NO: 2457955 - RNA, 19 nt, Bordetella pertussis
cgcggccccaugcgcggca

SEQ ID NO: 2457956 - RNA, 20 nt, Bordetella pertussis
cgcggccccggcucccgcgc

SEQ ID NO: 2457957 - RNA, 22 nt, Bordetella pertussis
cgcggccccggcucccgcgcca

SEQ ID NO: 2457958 - RNA, 21 nt, Bordetella pertussis
cgcggcccgccacgcaggcgg

SEQ ID NO: 2457959 - RNA, 14 nt, Bordetella pertussis
cgcggcccgccagg

SEQ ID NO: 2457960 - RNA, 16 nt, Bordetella pertussis
cgcggcccgcccgcgg

SEQ ID NO: 2457961 - RNA, 14 nt, Bordetella pertussis
cgcggcccggccgc

SEQ ID NO: 2457962 - RNA, 12 nt, Bordetella pertussis
cgcggcccggcg

SEQ ID NO: 2457963 - RNA, 14 nt, Bordetella pertussis
cgcggcccggcguc

SEQ ID NO: 2457964 - RNA, 18 nt, Bordetella pertussis
cgcggcccuggucgucgc

SEQ ID NO: 2457965 - RNA, 18 nt, Bordetella pertussis
cgcggcccuugcgcgaag

SEQ ID NO: 2457966 - RNA, 18 nt, Bordetella pertussis
cgcggccgacccgaaccg

SEQ ID NO: 2457967 - RNA, 15 nt, Bordetella pertussis
cgcggccgacgugga

SEQ ID NO: 2457968 - RNA, 21 nt, Bordetella pertussis
cgcggccgacguggaccgcgc

SEQ ID NO: 2457969 - RNA, 17 nt, Bordetella pertussis
cgcggccgagcgggcca

SEQ ID NO: 2457970 - RNA, 20 nt, Bordetella pertussis
cgcggccgagcgggccagcg

SEQ ID NO: 2457971 - RNA, 18 nt, Bordetella pertussis
cgcggccgagcuccucga

SEQ ID NO: 2457972 - RNA, 15 nt, Bordetella pertussis
cgcggccgaggccag

SEQ ID NO: 2457973 - RNA, 18 nt, Bordetella pertussis
cgcggccgaggccagcgu

SEQ ID NO: 2457974 - RNA, 21 nt, Bordetella pertussis
cgcggccgaggccagcgugcc

SEQ ID NO: 2457975 - RNA, 18 nt, Bordetella pertussis
cgcggccgccagcccgag

SEQ ID NO: 2457976 - RNA, 19 nt, Bordetella pertussis
cgcggccgccagcccgagg

SEQ ID NO: 2457977 - RNA, 12 nt, Bordetella pertussis
cgcggccgcccc

SEQ ID NO: 2457978 - RNA, 14 nt, Bordetella pertussis
cgcggccgccccca

SEQ ID NO: 2457979 - RNA, 22 nt, Bordetella pertussis
cgcggccgcccccagcgcgccu

SEQ ID NO: 2457980 - RNA, 23 nt, Bordetella pertussis
cgcggccgccgcccgccucaggc

SEQ ID NO: 2457981 - RNA, 23 nt, Bordetella pertussis
cgcggccgccguaaucggcgucg

SEQ ID NO: 2457982 - RNA, 13 nt, Bordetella pertussis
cgcggccgcgcag

SEQ ID NO: 2457983 - RNA, 15 nt, Bordetella pertussis
cgcggccgcgcgcuu

SEQ ID NO: 2457984 - RNA, 17 nt, Bordetella pertussis
cgcggccgcgggccgcu

SEQ ID NO: 2457985 - RNA, 14 nt, Bordetella pertussis
cgcggccgcgguca

SEQ ID NO: 2457986 - RNA, 18 nt, Bordetella pertussis
cgcggccgcggucagcca

SEQ ID NO: 2457987 - RNA, 17 nt, Bordetella pertussis
cgcggccgcgucggccu

SEQ ID NO: 2457988 - RNA, 19 nt, Bordetella pertussis
cgcggccgcgucggccuca

SEQ ID NO: 2457989 - RNA, 20 nt, Bordetella pertussis
cgcggccgcgucggccucau

SEQ ID NO: 2457990 - RNA, 19 nt, Bordetella pertussis
cgcggccggacagggccgc

SEQ ID NO: 2457991 - RNA, 12 nt, Bordetella pertussis
cgcggccggcac

SEQ ID NO: 2457992 - RNA, 14 nt, Bordetella pertussis
cgcggccggcacca

SEQ ID NO: 2457993 - RNA, 16 nt, Bordetella pertussis
cgcggccggcaccagg

SEQ ID NO: 2457994 - RNA, 17 nt, Bordetella pertussis
cgcggccggcacgccca

SEQ ID NO: 2457995 - RNA, 14 nt, Bordetella pertussis
cgcggccggccgcg

SEQ ID NO: 2457996 - RNA, 15 nt, Bordetella pertussis
cgcggccggccgcgc

SEQ ID NO: 2457997 - RNA, 13 nt, Bordetella pertussis
cgcggccggccgg

SEQ ID NO: 2457998 - RNA, 15 nt, Bordetella pertussis
cgcggccggccgggu

SEQ ID NO: 2457999 - RNA, 16 nt, Bordetella pertussis
cgcggccggccugcuu

SEQ ID NO: 2458000 - RNA, 16 nt, Bordetella pertussis
cgcggccggcgcgccg

SEQ ID NO: 2458001 - RNA, 23 nt, Bordetella pertussis
cgcggccggcgcgccggccugcg

SEQ ID NO: 2458002 - RNA, 16 nt, Bordetella pertussis
cgcggccggcuugcgc

SEQ ID NO: 2458003 - RNA, 20 nt, Bordetella pertussis
cgcggccguaguucggcggg

SEQ ID NO: 2458004 - RNA, 16 nt, Bordetella pertussis
cgcggccgucaccgcc

SEQ ID NO: 2458005 - RNA, 18 nt, Bordetella pertussis
cgcggccgucaccgccgc

SEQ ID NO: 2458006 - RNA, 20 nt, Bordetella pertussis
cgcggccgucaccgccgccg

SEQ ID NO: 2458007 - RNA, 12 nt, Bordetella pertussis
cgcggccgucgg

SEQ ID NO: 2458008 - RNA, 14 nt, Bordetella pertussis
cgcggccgucggcg

SEQ ID NO: 2458009 - RNA, 16 nt, Bordetella pertussis
cgcggccgucggcgcu

SEQ ID NO: 2458010 - RNA, 16 nt, Bordetella pertussis
cgcggccgucgugcag

SEQ ID NO: 2458011 - RNA, 15 nt, Bordetella pertussis
cgcggccguggcggc

SEQ ID NO: 2458012 - RNA, 21 nt, Bordetella pertussis
cgcggccguggcggccugcgc

SEQ ID NO: 2458013 - RNA, 21 nt, Bordetella pertussis
cgcggccguguucgagcaggc

SEQ ID NO: 2458014 - RNA, 15 nt, Bordetella pertussis
cgcggccguuggcga

SEQ ID NO: 2458015 - RNA, 22 nt, Bordetella pertussis
cgcggccguuugccccucggcg

SEQ ID NO: 2458016 - RNA, 17 nt, Bordetella pertussis
cgcggccucgccggccu

SEQ ID NO: 2458017 - RNA, 19 nt, Bordetella pertussis
cgcggccucgccggccugg

SEQ ID NO: 2458018 - RNA, 20 nt, Bordetella pertussis
cgcggccucgccggccuggc

SEQ ID NO: 2458019 - RNA, 12 nt, Bordetella pertussis
cgcggccucggc

SEQ ID NO: 2458020 - RNA, 16 nt, Bordetella pertussis
cgcggccugcagacca

SEQ ID NO: 2458021 - RNA, 18 nt, Bordetella pertussis
cgcggccugcagaccagc

SEQ ID NO: 2458022 - RNA, 14 nt, Bordetella pertussis
cgcggccugcuccg

SEQ ID NO: 2458023 - RNA, 17 nt, Bordetella pertussis
cgcggccugcuccggcg

SEQ ID NO: 2458024 - RNA, 13 nt, Bordetella pertussis
cgcggccugggcg

SEQ ID NO: 2458025 - RNA, 15 nt, Bordetella pertussis
cgcggccuguccaua

SEQ ID NO: 2458026 - RNA, 18 nt, Bordetella pertussis
cgcggccuucaccccgcc

SEQ ID NO: 2458027 - RNA, 20 nt, Bordetella pertussis
cgcggccuugcaugcgccgc

SEQ ID NO: 2458028 - RNA, 12 nt, Bordetella pertussis
cgcggcgaaaug

SEQ ID NO: 2458029 - RNA, 19 nt, Bordetella pertussis
cgcggcgaaggcgcggcug

SEQ ID NO: 2458030 - RNA, 20 nt, Bordetella pertussis
cgcggcgaaggcgcggcugc

SEQ ID NO: 2458031 - RNA, 22 nt, Bordetella pertussis
cgcggcgacacccccagggcgc

SEQ ID NO: 2458032 - RNA, 13 nt, Bordetella pertussis
cgcggcgacagcg

SEQ ID NO: 2458033 - RNA, 15 nt, Bordetella pertussis
cgcggcgagcacggc

SEQ ID NO: 2458034 - RNA, 20 nt, Bordetella pertussis
cgcggcgagcacggccugcu

SEQ ID NO: 2458035 - RNA, 22 nt, Bordetella pertussis
cgcggcgagcacggccugcucg

SEQ ID NO: 2458036 - RNA, 13 nt, Bordetella pertussis
cgcggcgagccgc

SEQ ID NO: 2458037 - RNA, 14 nt, Bordetella pertussis
cgcgcgccaggccc

SEQ ID NO: 2458038 - RNA, 18 nt, Bordetella pertussis
cgcgcgccaggcccaggg

SEQ ID NO: 2458039 - RNA, 15 nt, Bordetella pertussis
cgcgcgccaucgacg

SEQ ID NO: 2458040 - RNA, 18 nt, Bordetella pertussis
cgcgcgcccccagcgccg

SEQ ID NO: 2458041 - RNA, 19 nt, Bordetella pertussis
cgcgcgcccccagcgccgu

SEQ ID NO: 2458042 - RNA, 24 nt, Bordetella pertussis
cgcgcgcccccagcgccgucagca

SEQ ID NO: 2458043 - RNA, 13 nt, Bordetella pertussis
cgcgcgccgacgc

SEQ ID NO: 2458044 - RNA, 17 nt, Bordetella pertussis
cgcgcgccgaugcgcca

SEQ ID NO: 2458045 - RNA, 11 nt, Bordetella pertussis
cgcgcgccgcc

SEQ ID NO: 2458046 - RNA, 19 nt, Bordetella pertussis
cgcgcgccggccagcggca

SEQ ID NO: 2458047 - RNA, 13 nt, Bordetella pertussis
cgcgcgccggcgc

SEQ ID NO: 2458048 - RNA, 14 nt, Bordetella pertussis
cgcgcgccggcgcu

SEQ ID NO: 2458049 - RNA, 15 nt, Bordetella pertussis
cgcgcgccggcucga

SEQ ID NO: 2458050 - RNA, 21 nt, Bordetella pertussis
cgcgcgccugcauguccagcg

SEQ ID NO: 2458051 - RNA, 14 nt, Bordetella pertussis
cgcgcgccugcccc

SEQ ID NO: 2458052 - RNA, 12 nt, Bordetella pertussis
cgcgcgccugcg

SEQ ID NO: 2458053 - RNA, 17 nt, Bordetella pertussis
cgcgcgccugcgcgccg

SEQ ID NO: 2458054 - RNA, 19 nt, Bordetella pertussis
cgcgcgccugcgcgccgcc

SEQ ID NO: 2458055 - RNA, 17 nt, Bordetella pertussis
cgcgcgcgacuccaccg

SEQ ID NO: 2458056 - RNA, 15 nt, Bordetella pertussis
cgcgcgcgcacaggc

SEQ ID NO: 2458057 - RNA, 12 nt, Bordetella pertussis
cgcgcgcgcaga

SEQ ID NO: 2458058 - RNA, 14 nt, Bordetella pertussis
cgcgcgcgcagacg

SEQ ID NO: 2458059 - RNA, 13 nt, Bordetella pertussis
cgcgcgcgccagg

SEQ ID NO: 2458060 - RNA, 12 nt, Bordetella pertussis
cgcgcgcgcccu

SEQ ID NO: 2458061 - RNA, 11 nt, Bordetella pertussis
cgcgcgcgccg

SEQ ID NO: 2458062 - RNA, 15 nt, Bordetella pertussis
cgcgcgcgccgccua

SEQ ID NO: 2458063 - RNA, 12 nt, Bordetella pertussis
cgcgcgcgccgg

SEQ ID NO: 2458064 - RNA, 13 nt, Bordetella pertussis
cgcgcgcgccggc

SEQ ID NO: 2458065 - RNA, 12 nt, Bordetella pertussis
cgcgcgcgcgca

SEQ ID NO: 2458066 - RNA, 14 nt, Bordetella pertussis
cgcgcgcgcgcagc

SEQ ID NO: 2458067 - RNA, 15 nt, Bordetella pertussis
cgcgcgcgcgcgggc

SEQ ID NO: 2458068 - RNA, 14 nt, Bordetella pertussis
cgcgcgcgcucagg

SEQ ID NO: 2458069 - RNA, 15 nt, Bordetella pertussis
cgcgcgcgcuggggc

SEQ ID NO: 2458070 - RNA, 11 nt, Bordetella pertussis
cgcgcgcggca

SEQ ID NO: 2458071 - RNA, 12 nt, Bordetella pertussis
cgcgcgcggcca

SEQ ID NO: 2458072 - RNA, 14 nt, Bordetella pertussis
cgcgcgcggccggc

SEQ ID NO: 2458073 - RNA, 15 nt, Bordetella pertussis
cgcgcgcggccggca

SEQ ID NO: 2458074 - RNA, 15 nt, Bordetella pertussis
cgcgcgcggccggcg

SEQ ID NO: 2458075 - RNA, 21 nt, Bordetella pertussis
cgcgcgcggccggcgcgccgg

SEQ ID NO: 2458076 - RNA, 22 nt, Bordetella pertussis
cgcgcgcggccguccaaaacag

SEQ ID NO: 2458077 - RNA, 12 nt, Bordetella pertussis
cgcgcgcggcgc

SEQ ID NO: 2458078 - RNA, 19 nt, Bordetella pertussis
cgcgcgcggcgccgcgcgu

SEQ ID NO: 2458079 - RNA, 14 nt, Bordetella pertussis
cgcgcgcgggcgcg

SEQ ID NO: 2458080 - RNA, 15 nt, Bordetella pertussis
cgcgcgcgggcgcgc

SEQ ID NO: 2458081 - RNA, 17 nt, Bordetella pertussis
cgcgcgcgggcgcgccg

SEQ ID NO: 2458082 - RNA, 22 nt, Bordetella pertussis
cgcgcgcgguugagcgccaggg

SEQ ID NO: 2458083 - RNA, 17 nt, Bordetella pertussis
cgcgcgcguacagccgg

SEQ ID NO: 2458084 - RNA, 13 nt, Bordetella pertussis
cgcgcgcgugccg

SEQ ID NO: 2458085 - RNA, 16 nt, Bordetella pertussis
cgcgcgcgugccgcag

SEQ ID NO: 2458086 - RNA, 15 nt, Bordetella pertussis
cgcgcgcucaacgaa

SEQ ID NO: 2458087 - RNA, 17 nt, Bordetella pertussis
cgcgcgcugcacggccu

SEQ ID NO: 2458088 - RNA, 13 nt, Bordetella pertussis
cgcgcgcuggcgc

SEQ ID NO: 2458089 - RNA, 20 nt, Bordetella pertussis
cgcgcgcuggcgcccggccu

SEQ ID NO: 2458090 - RNA, 13 nt, Bordetella pertussis
cgcgcgcuggggc

SEQ ID NO: 2458091 - RNA, 18 nt, Bordetella pertussis
cgcgcgcuucaggcgccg

SEQ ID NO: 2458092 - RNA, 21 nt, Bordetella pertussis
cgcgcgcuucaggcgccgcag

SEQ ID NO: 2458093 - RNA, 17 nt, Bordetella pertussis
cgcgcgcuuccucgacc

SEQ ID NO: 2458094 - RNA, 20 nt, Bordetella pertussis
cgcgcgcuuccucgaccagg

SEQ ID NO: 2458095 - RNA, 21 nt, Bordetella pertussis
cgcgcgcuuccucgaccaggu

SEQ ID NO: 2458096 - RNA, 23 nt, Bordetella pertussis
cgcgcggauauucgucggccgcc

SEQ ID NO: 2458097 - RNA, 18 nt, Bordetella pertussis
cgcgcggauccagccaug

SEQ ID NO: 2458098 - RNA, 16 nt, Bordetella pertussis
cgcgcggauccuugac

SEQ ID NO: 2458099 - RNA, 15 nt, Bordetella pertussis
cgcgcggaucgacgc

SEQ ID NO: 2458100 - RNA, 20 nt, Bordetella pertussis
cgcgcggaugaucgcgcagc

SEQ ID NO: 2458101 - RNA, 21 nt, Bordetella pertussis
cgcgcggaugaucgcgcagca

SEQ ID NO: 2458102 - RNA, 12 nt, Bordetella pertussis
cgcgcggcagcg

SEQ ID NO: 2458103 - RNA, 15 nt, Bordetella pertussis
cgcgcggcagcgccg

SEQ ID NO: 2458104 - RNA, 13 nt, Bordetella pertussis
cgcgcggccagcg

SEQ ID NO: 2458105 - RNA, 16 nt, Bordetella pertussis
cgcgcggccagcgccg

SEQ ID NO: 2458106 - RNA, 20 nt, Bordetella pertussis
cgcgcggccauguccagcag

SEQ ID NO: 2458107 - RNA, 13 nt, Bordetella pertussis
cgcgcggccgagg

SEQ ID NO: 2458108 - RNA, 12 nt, Bordetella pertussis
cgcgcggccgcg

SEQ ID NO: 2458109 - RNA, 12 nt, Bordetella pertussis
cgcgcggccggc

SEQ ID NO: 2458110 - RNA, 13 nt, Bordetella pertussis
cgcgcggccggcc

SEQ ID NO: 2458111 - RNA, 15 nt, Bordetella pertussis
cgcgcggccggccgc

SEQ ID NO: 2458112 - RNA, 19 nt, Bordetella pertussis
cgcgcggccgggcucaggc

SEQ ID NO: 2458113 - RNA, 13 nt, Bordetella pertussis
cgcgcggccguca

SEQ ID NO: 2458114 - RNA, 12 nt, Bordetella pertussis
cgcgcggccugg

SEQ ID NO: 2458115 - RNA, 15 nt, Bordetella pertussis
cgcgcggccugggcg

SEQ ID NO: 2458116 - RNA, 17 nt, Bordetella pertussis
cgcgcggccugggcggc

SEQ ID NO: 2458117 - RNA, 22 nt, Bordetella pertussis
cgcgcggccugggcggcgcgcu

SEQ ID NO: 2458118 - RNA, 12 nt, Bordetella pertussis
cgcgcggcgaca

SEQ ID NO: 2458119 - RNA, 20 nt, Bordetella pertussis
cgcgcggcgacacccccagg

SEQ ID NO: 2458120 - RNA, 23 nt, Bordetella pertussis
cgcgcggcgacacccccagggcg

SEQ ID NO: 2458121 - RNA, 16 nt, Bordetella pertussis
cgcgcggcgaccgcga

SEQ ID NO: 2458122 - RNA, 20 nt, Bordetella pertussis
cgcgcggcgaggcguccagc

SEQ ID NO: 2458123 - RNA, 15 nt, Bordetella pertussis
cgcgcggcgcagcgc

SEQ ID NO: 2458124 - RNA, 15 nt, Bordetella pertussis
cgcgcggcgccgcgc

SEQ ID NO: 2458125 - RNA, 14 nt, Bordetella pertussis
cgcgcggcgccugc

SEQ ID NO: 2458126 - RNA, 18 nt, Bordetella pertussis
cgcgcggcgcguucagca

SEQ ID NO: 2458127 - RNA, 13 nt, Bordetella pertussis
cgcgcggcgcugc

SEQ ID NO: 2458128 - RNA, 14 nt, Bordetella pertussis
cgcgcggcgcugca

SEQ ID NO: 2458129 - RNA, 17 nt, Bordetella pertussis
cgcgcggcggcaccagc

SEQ ID NO: 2458130 - RNA, 22 nt, Bordetella pertussis
cgcgcggcggcaccagcaggcc

SEQ ID NO: 2458131 - RNA, 17 nt, Bordetella pertussis
cgcgcggcguugcggcg

SEQ ID NO: 2458132 - RNA, 14 nt, Bordetella pertussis
cgcgcggcuggggc

SEQ ID NO: 2458133 - RNA, 21 nt, Bordetella pertussis
cgcgcggcuggggcugcuggg

SEQ ID NO: 2458134 - RNA, 22 nt, Bordetella pertussis
cgcgcgggaagcugucggcgcu

SEQ ID NO: 2458135 - RNA, 20 nt, Bordetella pertussis
cgcgcgggccuggcucaggc

SEQ ID NO: 2458136 - RNA, 22 nt, Bordetella pertussis
cgcgcgggcgauggccacgcgc

SEQ ID NO: 2458137 - RNA, 23 nt, Bordetella pertussis
cgcgcgggcgauggccacgcgcu

SEQ ID NO: 2458138 - RNA, 15 nt, Bordetella pertussis
cgcgcgggcgcccgc

SEQ ID NO: 2458139 - RNA, 17 nt, Bordetella pertussis
cgcgcgggcgcccgcgc

SEQ ID NO: 2458140 - RNA, 17 nt, Bordetella pertussis
cgcgcgggcgcgcagcg

SEQ ID NO: 2458141 - RNA, 19 nt, Bordetella pertussis
cgcgcgggcgcgcagcgcg

SEQ ID NO: 2458142 - RNA, 16 nt, Bordetella pertussis
cgcgcgggcgcgccgu

SEQ ID NO: 2458143 - RNA, 16 nt, Bordetella pertussis
cgcgcgggcggcccgc

SEQ ID NO: 2458144 - RNA, 17 nt, Bordetella pertussis
cgcgcggggcaggccga

SEQ ID NO: 2458145 - RNA, 19 nt, Bordetella pertussis
cgcgcgggggugcgcgaca

SEQ ID NO: 2458146 - RNA, 19 nt, Bordetella pertussis
cgcgcgggguaggccucga

SEQ ID NO: 2458147 - RNA, 15 nt, Bordetella pertussis
cgcgcggguccaggc

SEQ ID NO: 2458148 - RNA, 24 nt, Bordetella pertussis
cgcgcggguuggucgucagcgccg

SEQ ID NO: 2458149 - RNA, 19 nt, Bordetella pertussis
cgcgcgguauccaggucga

SEQ ID NO: 2458150 - RNA, 14 nt, Bordetella pertussis
cgcgcggugccgcc

SEQ ID NO: 2458151 - RNA, 17 nt, Bordetella pertussis
cgcgcggugcucggcga

SEQ ID NO: 2458152 - RNA, 19 nt, Bordetella pertussis
cgcgcgguggcacgacgcg

SEQ ID NO: 2458153 - RNA, 15 nt, Bordetella pertussis
cgcgcgguggccgcc

SEQ ID NO: 2458154 - RNA, 20 nt, Bordetella pertussis
cgcgcuggcgcucgggcgcg

SEQ ID NO: 2458155 - RNA, 20 nt, Bordetella pertussis
cgcgcuggcgcuggccgccc

SEQ ID NO: 2458156 - RNA, 20 nt, Bordetella pertussis
cgcgcuggcgguggccgcgc

SEQ ID NO: 2458157 - RNA, 21 nt, Bordetella pertussis
cgcgcuggcgguggccgcgca

SEQ ID NO: 2458158 - RNA, 22 nt, Bordetella pertussis
cgcgcuggcgguggccgcgcau

SEQ ID NO: 2458159 - RNA, 14 nt, Bordetella pertussis
cgcgcuggcugugc

SEQ ID NO: 2458160 - RNA, 13 nt, Bordetella pertussis
cgcgcugggcgcu

SEQ ID NO: 2458161 - RNA, 15 nt, Bordetella pertussis
cgcgcugggcgcugc

SEQ ID NO: 2458162 - RNA, 14 nt, Bordetella pertussis
cgcgcugggcgugg

SEQ ID NO: 2458163 - RNA, 19 nt, Bordetella pertussis
cgcgcugggcguggcgcgc

SEQ ID NO: 2458164 - RNA, 14 nt, Bordetella pertussis
cgcgcuggggcagc

SEQ ID NO: 2458165 - RNA, 16 nt, Bordetella pertussis
cgcgcuggggcagcag

SEQ ID NO: 2458166 - RNA, 17 nt, Bordetella pertussis
cgcgcuggggcaggacg

SEQ ID NO: 2458167 - RNA, 22 nt, Bordetella pertussis
cgcgcuggggcaggacgccggc

SEQ ID NO: 2458168 - RNA, 16 nt, Bordetella pertussis
cgcgcugggucagguc

SEQ ID NO: 2458169 - RNA, 21 nt, Bordetella pertussis
cgcgcugggucaggucgcugc

SEQ ID NO: 2458170 - RNA, 23 nt, Bordetella pertussis
cgcgcugggucaggucgcugccc

SEQ ID NO: 2458171 - RNA, 12 nt, Bordetella pertussis
cgcgcugguccg

SEQ ID NO: 2458172 - RNA, 18 nt, Bordetella pertussis
cgcgcuggugcuggccga

SEQ ID NO: 2458173 - RNA, 18 nt, Bordetella pertussis
cgcgcuguccgaugcgcu

SEQ ID NO: 2458174 - RNA, 19 nt, Bordetella pertussis
cgcgcuguucaucaacaug

SEQ ID NO: 2458175 - RNA, 21 nt, Bordetella pertussis
cgcgcuguuccagccaguaca

SEQ ID NO: 2458176 - RNA, 21 nt, Bordetella pertussis
cgcgcuguugcuccaggccgg

SEQ ID NO: 2458177 - RNA, 22 nt, Bordetella pertussis
cgcgcuguugcuccaggccggc

SEQ ID NO: 2458178 - RNA, 14 nt, Bordetella pertussis
cgcgcuucaggcgc

SEQ ID NO: 2458179 - RNA, 13 nt, Bordetella pertussis
cgcgcuuccagga

SEQ ID NO: 2458180 - RNA, 19 nt, Bordetella pertussis
cgcgcuuccucgaccaggu

SEQ ID NO: 2458181 - RNA, 12 nt, Bordetella pertussis
cgcgcuucgucg

SEQ ID NO: 2458182 - RNA, 16 nt, Bordetella pertussis
cgcgcuucgucggcgu

SEQ ID NO: 2458183 - RNA, 17 nt, Bordetella pertussis
cgcgcuucuuggcgacc

SEQ ID NO: 2458184 - RNA, 22 nt, Bordetella pertussis
cgcgcuucuuggcgaccaggcc

SEQ ID NO: 2458185 - RNA, 20 nt, Bordetella pertussis
cgcgcuugaacuccgcggcg

SEQ ID NO: 2458186 - RNA, 23 nt, Bordetella pertussis
cgcgcuugaacuccgcggcgucg

SEQ ID NO: 2458187 - RNA, 19 nt, Bordetella pertussis
cgcgcuugacguccagcga

SEQ ID NO: 2458188 - RNA, 20 nt, Bordetella pertussis
cgcgcuugacguccagcgac

SEQ ID NO: 2458189 - RNA, 14 nt, Bordetella pertussis
cgcgcuugagcggc

SEQ ID NO: 2458190 - RNA, 15 nt, Bordetella pertussis
cgcgcuugagcggcu

SEQ ID NO: 2458191 - RNA, 17 nt, Bordetella pertussis
cgcgcuugagcggcucg

SEQ ID NO: 2458192 - RNA, 13 nt, Bordetella pertussis
cgcgcuugaggcu

SEQ ID NO: 2458193 - RNA, 14 nt, Bordetella pertussis
cgcgcuugcgcgcc

SEQ ID NO: 2458194 - RNA, 15 nt, Bordetella pertussis
cgcgcuugcgcgcca

SEQ ID NO: 2458195 - RNA, 14 nt, Bordetella pertussis
cgcgcuugcucggu

SEQ ID NO: 2458196 - RNA, 14 nt, Bordetella pertussis
cgcgcuugggacgc

SEQ ID NO: 2458197 - RNA, 17 nt, Bordetella pertussis
cgcgcuugggacgcuuc

SEQ ID NO: 2458198 - RNA, 15 nt, Bordetella pertussis
cgcgcuuggucagca

SEQ ID NO: 2458199 - RNA, 17 nt, Bordetella pertussis
cgcgcuuuuccccgccc

SEQ ID NO: 2458200 - RNA, 18 nt, Bordetella pertussis
cgcggaaauccgggcgcu

SEQ ID NO: 2458201 - RNA, 21 nt, Bordetella pertussis
cgcggaagcugacgaaacgcg

SEQ ID NO: 2458202 - RNA, 21 nt, Bordetella pertussis
cgcggaagucgggcaccagca

SEQ ID NO: 2458203 - RNA, 22 nt, Bordetella pertussis
cgcggaagucgggcaccagcac

SEQ ID NO: 2458204 - RNA, 16 nt, Bordetella pertussis
cgcggacccaggccuc

SEQ ID NO: 2458205 - RNA, 18 nt, Bordetella pertussis
cgcggaccugcucgagcg

SEQ ID NO: 2458206 - RNA, 20 nt, Bordetella pertussis
cgcggaccugcucgagcggc

SEQ ID NO: 2458207 - RNA, 22 nt, Bordetella pertussis
cgcggacgccauggcggcggcc

SEQ ID NO: 2458208 - RNA, 23 nt, Bordetella pertussis
cgcggacgccauggcggcggcca

SEQ ID NO: 2458209 - RNA, 18 nt, Bordetella pertussis
cgcggaggagguggcugg

SEQ ID NO: 2458210 - RNA, 23 nt, Bordetella pertussis
cgcggaggagguuuuccuggagc

SEQ ID NO: 2458211 - RNA, 16 nt, Bordetella pertussis
cgcggaggugucgccg

SEQ ID NO: 2458212 - RNA, 23 nt, Bordetella pertussis
cgcggaggugucgccgcccaugc

SEQ ID NO: 2458213 - RNA, 19 nt, Bordetella pertussis
cgcggauauucgucggccg

SEQ ID NO: 2458214 - RNA, 22 nt, Bordetella pertussis
cgcggauauucgucggccgccg

SEQ ID NO: 2458215 - RNA, 15 nt, Bordetella pertussis
cgcggaucgaaaccg

SEQ ID NO: 2458216 - RNA, 23 nt, Bordetella pertussis
cgcggaucgaaaccggcgcgcgc

SEQ ID NO: 2458217 - RNA, 15 nt, Bordetella pertussis
cgcggaucgugucga

SEQ ID NO: 2458218 - RNA, 18 nt, Bordetella pertussis
cgcggaugaccugcgcca

SEQ ID NO: 2458219 - RNA, 22 nt, Bordetella pertussis
cgcggaugaccugcgccaggug

SEQ ID NO: 2458220 - RNA, 17 nt, Bordetella pertussis
cgcggaugaccuggugc

SEQ ID NO: 2458221 - RNA, 18 nt, Bordetella pertussis
cgcggaugaccuggugca

SEQ ID NO: 2458222 - RNA, 17 nt, Bordetella pertussis
cgcggaugaucgcgcag

SEQ ID NO: 2458223 - RNA, 23 nt, Bordetella pertussis
cgcggaugccguccacgccgcgc

SEQ ID NO: 2458224 - RNA, 21 nt, Bordetella pertussis
cgcggauugaugucgcgcacc

SEQ ID NO: 2458225 - RNA, 21 nt, Bordetella pertussis
cgcggauugccguccuggcga

SEQ ID NO: 2458226 - RNA, 18 nt, Bordetella pertussis
cgcggcaaaaugccgcgu

SEQ ID NO: 2458227 - RNA, 19 nt, Bordetella pertussis
cgcggcaaaaugccgcgug

SEQ ID NO: 2458228 - RNA, 20 nt, Bordetella pertussis
cgcggcaaauggggcggccg

SEQ ID NO: 2458229 - RNA, 23 nt, Bordetella pertussis
cgcggcacgaaaagccgcggccg

SEQ ID NO: 2458230 - RNA, 24 nt, Bordetella pertussis
cgcggcacgaaaagccgcggccgc

SEQ ID NO: 2458231 - RNA, 15 nt, Bordetella pertussis
cgcggcacgcugcug

SEQ ID NO: 2458232 - RNA, 16 nt, Bordetella pertussis
cgcggcacguccgaga

SEQ ID NO: 2458233 - RNA, 20 nt, Bordetella pertussis
cgcggcacguugucgagcag

SEQ ID NO: 2458234 - RNA, 14 nt, Bordetella pertussis
cgcggcacugaugc

SEQ ID NO: 2458235 - RNA, 18 nt, Bordetella pertussis
cgcggcacugaugcuggu

SEQ ID NO: 2458236 - RNA, 14 nt, Bordetella pertussis
cgcggcagcccggc

SEQ ID NO: 2458237 - RNA, 16 nt, Bordetella pertussis
cgcggcagcccggcac

SEQ ID NO: 2458238 - RNA, 13 nt, Bordetella pertussis
cgcggcagccugg

SEQ ID NO: 2458239 - RNA, 17 nt, Bordetella pertussis
cgcggcagccuggggcg

SEQ ID NO: 2458240 - RNA, 14 nt, Bordetella pertussis
cgcggcagcgccgg

SEQ ID NO: 2458241 - RNA, 18 nt, Bordetella pertussis
cgcggcaggccccggccc

SEQ ID NO: 2458242 - RNA, 22 nt, Bordetella pertussis
cgcggcaggccccggcccggcg

SEQ ID NO: 2458243 - RNA, 23 nt, Bordetella pertussis
cgcggcaggccccggcccggcgg

SEQ ID NO: 2458244 - RNA, 12 nt, Bordetella pertussis
cgcggcaggcgg

SEQ ID NO: 2458245 - RNA, 13 nt, Bordetella pertussis
cgcggcagggcca

SEQ ID NO: 2458246 - RNA, 22 nt, Bordetella pertussis
cgcggcagggcgucggccgcgc

SEQ ID NO: 2458247 - RNA, 21 nt, Bordetella pertussis
cgcggcagguucugcgcgucc

SEQ ID NO: 2458248 - RNA, 17 nt, Bordetella pertussis
cgcggcauacgccgaug

SEQ ID NO: 2458249 - RNA, 24 nt, Bordetella pertussis
cgcggcauacgccgauggcgcggc

SEQ ID NO: 2458250 - RNA, 23 nt, Bordetella pertussis
cgcggcaucgagaaaccagccgc

SEQ ID NO: 2458251 - RNA, 14 nt, Bordetella pertussis
cgcggcaucggcca

SEQ ID NO: 2458252 - RNA, 23 nt, Bordetella pertussis
cgcggcaugccgcugcaggucgg

SEQ ID NO: 2458253 - RNA, 14 nt, Bordetella pertussis
cgcggcaugcgcau

SEQ ID NO: 2458254 - RNA, 18 nt, Bordetella pertussis
cgcggcaugcgcaugcug

SEQ ID NO: 2458255 - RNA, 13 nt, Bordetella pertussis
cgcggccaacccc

SEQ ID NO: 2458256 - RNA, 15 nt, Bordetella pertussis
cgcggccaauggccg

SEQ ID NO: 2458257 - RNA, 14 nt, Bordetella pertussis
cgcggccaccaggc

SEQ ID NO: 2458258 - RNA, 16 nt, Bordetella pertussis
cgcggccaccaggcug

SEQ ID NO: 2458259 - RNA, 19 nt, Bordetella pertussis
cgcggccacccugccgugc

SEQ ID NO: 2458260 - RNA, 22 nt, Bordetella pertussis
cgcggccacccugccgugcaga

SEQ ID NO: 2458261 - RNA, 17 nt, Bordetella pertussis
cgcggccacggccugcc

SEQ ID NO: 2458262 - RNA, 21 nt, Bordetella pertussis
cgcggccacggccugcccggg

SEQ ID NO: 2458263 - RNA, 22 nt, Bordetella pertussis
cgcggccacggccugcccgggc

SEQ ID NO: 2458264 - RNA, 22 nt, Bordetella pertussis
cgcggccagaccuugcgcgacg

SEQ ID NO: 2458265 - RNA, 18 nt, Bordetella pertussis
cgcggccagcaccggccc

SEQ ID NO: 2458266 - RNA, 13 nt, Bordetella pertussis
cgcggccagcagc

SEQ ID NO: 2458267 - RNA, 14 nt, Bordetella pertussis
cgcggccagcagcg

SEQ ID NO: 2458268 - RNA, 15 nt, Bordetella pertussis
cgcggcgagccgcgc

SEQ ID NO: 2458269 - RNA, 20 nt, Bordetella pertussis
cgcggcgagccgcgcgcaug

SEQ ID NO: 2458270 - RNA, 21 nt, Bordetella pertussis
cgcggcgaggcguccagcccc

SEQ ID NO: 2458271 - RNA, 17 nt, Bordetella pertussis
cgcggcgauacgcgccg

SEQ ID NO: 2458272 - RNA, 18 nt, Bordetella pertussis
cgcggcgauacgcgccgc

SEQ ID NO: 2458273 - RNA, 21 nt, Bordetella pertussis
cgcggcgauacgcgccgccug

SEQ ID NO: 2458274 - RNA, 15 nt, Bordetella pertussis
cgcggcgaugccggc

SEQ ID NO: 2458275 - RNA, 17 nt, Bordetella pertussis
cgcggcgaugccggcca

SEQ ID NO: 2458276 - RNA, 20 nt, Bordetella pertussis
cgcggcgaugccggccagca

SEQ ID NO: 2458277 - RNA, 12 nt, Bordetella pertussis
cgcggcgcagca

SEQ ID NO: 2458278 - RNA, 13 nt, Bordetella pertussis
cgcggcgcagcau

SEQ ID NO: 2458279 - RNA, 23 nt, Bordetella pertussis
cgcggcgcagcaucuugcgccgc

SEQ ID NO: 2458280 - RNA, 14 nt, Bordetella pertussis
cgcggcgcagccca

SEQ ID NO: 2458281 - RNA, 13 nt, Bordetella pertussis
cgcggcgcaggcc

SEQ ID NO: 2458282 - RNA, 15 nt, Bordetella pertussis
cgcggcgcaggccug

SEQ ID NO: 2458283 - RNA, 14 nt, Bordetella pertussis
cgcggcgcaggcgg

SEQ ID NO: 2458284 - RNA, 16 nt, Bordetella pertussis
cgcggcgcagguccac

SEQ ID NO: 2458285 - RNA, 19 nt, Bordetella pertussis
cgcggcgcagguccaccgc

SEQ ID NO: 2458286 - RNA, 20 nt, Bordetella pertussis
cgcggcgcagguccaccgcc

SEQ ID NO: 2458287 - RNA, 12 nt, Bordetella pertussis
cgcggcgccagc

SEQ ID NO: 2458288 - RNA, 13 nt, Bordetella pertussis
cgcggcgccagcg

SEQ ID NO: 2458289 - RNA, 15 nt, Bordetella pertussis
cgcggcgccaugccg

SEQ ID NO: 2458290 - RNA, 13 nt, Bordetella pertussis
cgcggcgcccagc

SEQ ID NO: 2458291 - RNA, 19 nt, Bordetella pertussis
cgcggcgcccagcuggcgc

SEQ ID NO: 2458292 - RNA, 22 nt, Bordetella pertussis
cgcggcgcccagcuggcgcccc

SEQ ID NO: 2458293 - RNA, 13 nt, Bordetella pertussis
cgcggcgcccccg

SEQ ID NO: 2458294 - RNA, 14 nt, Bordetella pertussis
cgcggcgcccccgc

SEQ ID NO: 2458295 - RNA, 17 nt, Bordetella pertussis
cgcggcgcccgccugcg

SEQ ID NO: 2458296 - RNA, 20 nt, Bordetella pertussis
cgcggcgcccgccugcgugg

SEQ ID NO: 2458297 - RNA, 14 nt, Bordetella pertussis
cgcggcgcccggug

SEQ ID NO: 2458298 - RNA, 20 nt, Bordetella pertussis
cgcggcgcccggugcgcgca

SEQ ID NO: 2458299 - RNA, 12 nt, Bordetella pertussis
cgcggcgccgca

SEQ ID NO: 2458300 - RNA, 13 nt, Bordetella pertussis
cgcggcgccgccg

SEQ ID NO: 2458301 - RNA, 18 nt, Bordetella pertussis
cgcggcgccgccggcggc

SEQ ID NO: 2458302 - RNA, 19 nt, Bordetella pertussis
cgcggcgccgccggcggcc

SEQ ID NO: 2458303 - RNA, 12 nt, Bordetella pertussis
cgcggcgccgcg

SEQ ID NO: 2458304 - RNA, 13 nt, Bordetella pertussis
cgcggcgccgcug

SEQ ID NO: 2458305 - RNA, 15 nt, Bordetella pertussis
cgcggcgccggccgu

SEQ ID NO: 2458306 - RNA, 21 nt, Bordetella pertussis
cgcggcgccggccgucaucca

SEQ ID NO: 2458307 - RNA, 14 nt, Bordetella pertussis
cgcggcgccggccu

SEQ ID NO: 2458308 - RNA, 20 nt, Bordetella pertussis
cgcggcgccggccuccagca

SEQ ID NO: 2458309 - RNA, 21 nt, Bordetella pertussis
cgcggcgccguccagcgcggc

SEQ ID NO: 2458310 - RNA, 14 nt, Bordetella pertussis
cgcggcgccugccu

SEQ ID NO: 2458311 - RNA, 15 nt, Bordetella pertussis
cgcggcgccugccug

SEQ ID NO: 2458312 - RNA, 18 nt, Bordetella pertussis
cgcggcgccugccugccg

SEQ ID NO: 2458313 - RNA, 13 nt, Bordetella pertussis
cgcggcgccugcg

SEQ ID NO: 2458314 - RNA, 14 nt, Bordetella pertussis
cgcggcgccugcgc

SEQ ID NO: 2458315 - RNA, 15 nt, Bordetella pertussis
cgcggcgccuggggc

SEQ ID NO: 2458316 - RNA, 20 nt, Bordetella pertussis
cgcggcgccuggggcgugcc

SEQ ID NO: 2458317 - RNA, 19 nt, Bordetella pertussis
cgcggcgcgccagcgcggc

SEQ ID NO: 2458318 - RNA, 11 nt, Bordetella pertussis
cgcggcgcgcg

SEQ ID NO: 2458319 - RNA, 14 nt, Bordetella pertussis
cgcggcgcgcgcca

SEQ ID NO: 2458320 - RNA, 23 nt, Bordetella pertussis
cgcggcgcgcgccagggcgccgc

SEQ ID NO: 2458321 - RNA, 20 nt, Bordetella pertussis
cgcggcgcgcgccgagguga

SEQ ID NO: 2458322 - RNA, 18 nt, Bordetella pertussis
cgcggcgcgcgccugcag

SEQ ID NO: 2458323 - RNA, 15 nt, Bordetella pertussis
cgcggcgcgcgcgcg

SEQ ID NO: 2458324 - RNA, 18 nt, Bordetella pertussis
cgcggcgcgcgcgcgcag

SEQ ID NO: 2458325 - RNA, 20 nt, Bordetella pertussis
cgcggcgcgcgcgcgcagca

SEQ ID NO: 2458326 - RNA, 14 nt, Bordetella pertussis
cgcggcgcgcgcgg

SEQ ID NO: 2458327 - RNA, 15 nt, Bordetella pertussis
cgcggcgcgcgcggc

SEQ ID NO: 2458328 - RNA, 20 nt, Bordetella pertussis
cgcggcgcgcgcggcgccug

SEQ ID NO: 2458329 - RNA, 16 nt, Bordetella pertussis
cgcggcgcggccagca

SEQ ID NO: 2458330 - RNA, 16 nt, Bordetella pertussis
cgcggcgcggccggcu

SEQ ID NO: 2458331 - RNA, 12 nt, Bordetella pertussis
cgcggcgcggcg

SEQ ID NO: 2458332 - RNA, 13 nt, Bordetella pertussis
cgcggcgcggcgc

SEQ ID NO: 2458333 - RNA, 14 nt, Bordetella pertussis
cgcggcgcggcgca

SEQ ID NO: 2458334 - RNA, 13 nt, Bordetella pertussis
cgcggcgcggcug

SEQ ID NO: 2458335 - RNA, 13 nt, Bordetella pertussis
cgcggcgcggucg

SEQ ID NO: 2458336 - RNA, 20 nt, Bordetella pertussis
cgcggcgcgucgcgcgccag

SEQ ID NO: 2458337 - RNA, 17 nt, Bordetella pertussis
cgcggcgcgugccagca

SEQ ID NO: 2458338 - RNA, 20 nt, Bordetella pertussis
cgcggcgcgugccagcaggu

SEQ ID NO: 2458339 - RNA, 19 nt, Bordetella pertussis
cgcggcgcguucagcagca

SEQ ID NO: 2458340 - RNA, 23 nt, Bordetella pertussis
cgcggcgcguucagcagcaggcc

SEQ ID NO: 2458341 - RNA, 22 nt, Bordetella pertussis
cgcggcgcguucagggcgccgc

SEQ ID NO: 2458342 - RNA, 22 nt, Bordetella pertussis
cgcggcgcguucucagccgccc

SEQ ID NO: 2458343 - RNA, 16 nt, Bordetella pertussis
cgcggcgcuacgccgc

SEQ ID NO: 2458344 - RNA, 15 nt, Bordetella pertussis
cgcggcgcugcuggc

SEQ ID NO: 2458345 - RNA, 19 nt, Bordetella pertussis
cgcggcgcugcuggccggc

SEQ ID NO: 2458346 - RNA, 16 nt, Bordetella pertussis
cgcggcgcuggcgccg

SEQ ID NO: 2458347 - RNA, 12 nt, Bordetella pertussis
cgcggcgcugug

SEQ ID NO: 2458348 - RNA, 16 nt, Bordetella pertussis
cgcggcggaucggcgu

SEQ ID NO: 2458349 - RNA, 13 nt, Bordetella pertussis
cgcggcggcacca

SEQ ID NO: 2458350 - RNA, 15 nt, Bordetella pertussis
cgcggcggcaccagc

SEQ ID NO: 2458351 - RNA, 16 nt, Bordetella pertussis
cgcggcggcaccagca

SEQ ID NO: 2458352 - RNA, 20 nt, Bordetella pertussis
cgcggcggcaccagcaggcc

SEQ ID NO: 2458353 - RNA, 22 nt, Bordetella pertussis
cgcggcggcaccagcaggccgg

SEQ ID NO: 2458354 - RNA, 14 nt, Bordetella pertussis
cgcggcggcagcgc

SEQ ID NO: 2458355 - RNA, 15 nt, Bordetella pertussis
cgcggcggcagcgcg

SEQ ID NO: 2458356 - RNA, 14 nt, Bordetella pertussis
cgcggcggccaggc

SEQ ID NO: 2458357 - RNA, 21 nt, Bordetella pertussis
cgcggcggccaugcccaggcc

SEQ ID NO: 2458358 - RNA, 22 nt, Bordetella pertussis
cgcggcggccaugcccaggccc

SEQ ID NO: 2458359 - RNA, 13 nt, Bordetella pertussis
cgcggcggccggu

SEQ ID NO: 2458360 - RNA, 21 nt, Bordetella pertussis
cgcggcggcggccaugacggc

SEQ ID NO: 2458361 - RNA, 16 nt, Bordetella pertussis
cgcggcggcgugaacg

SEQ ID NO: 2458362 - RNA, 15 nt, Bordetella pertussis
cgcggcggcuugccg

SEQ ID NO: 2458363 - RNA, 16 nt, Bordetella pertussis
cgcggcgggacggcca

SEQ ID NO: 2458364 - RNA, 15 nt, Bordetella pertussis
cgcggcgggccccgc

SEQ ID NO: 2458365 - RNA, 13 nt, Bordetella pertussis
cgcggcgggccgg

SEQ ID NO: 2458366 - RNA, 13 nt, Bordetella pertussis
cgcggcgggcgau

SEQ ID NO: 2458367 - RNA, 23 nt, Bordetella pertussis
cgcggcgggcgauugcucgacau

SEQ ID NO: 2458368 - RNA, 12 nt, Bordetella pertussis
cgcggcgggcgc

SEQ ID NO: 2458369 - RNA, 20 nt, Bordetella pertussis
cgcggcgggcgcuggcgcgc

SEQ ID NO: 2458370 - RNA, 13 nt, Bordetella pertussis
cgcggcgggcggc

SEQ ID NO: 2458371 - RNA, 15 nt, Bordetella pertussis
cgcggcgggcggcgc

SEQ ID NO: 2458372 - RNA, 18 nt, Bordetella pertussis
cgcggcgggcucagcccg

SEQ ID NO: 2458373 - RNA, 20 nt, Bordetella pertussis
cgcggcgggcucagcccgcc

SEQ ID NO: 2458374 - RNA, 16 nt, Bordetella pertussis
cgcggcgggcucggcg

SEQ ID NO: 2458375 - RNA, 20 nt, Bordetella pertussis
cgcggcggguggccucgccc

SEQ ID NO: 2458376 - RNA, 22 nt, Bordetella pertussis
cgcggcggguucgcagggcgca

SEQ ID NO: 2458377 - RNA, 17 nt, Bordetella pertussis
cgcggcgguccucgccg

SEQ ID NO: 2458378 - RNA, 15 nt, Bordetella pertussis
cgcggcgguccugcu

SEQ ID NO: 2458379 - RNA, 21 nt, Bordetella pertussis
cgcggcgguccugcugaucca

SEQ ID NO: 2458380 - RNA, 16 nt, Bordetella pertussis
cgcggcggugccgccc

SEQ ID NO: 2458381 - RNA, 18 nt, Bordetella pertussis
cgcggcggugccgcccac

SEQ ID NO: 2458382 - RNA, 20 nt, Bordetella pertussis
cgcggcguacuggcgcggcg

SEQ ID NO: 2458383 - RNA, 22 nt, Bordetella pertussis
cgcggcguacuggcgcggcggc

SEQ ID NO: 2458384 - RNA, 16 nt, Bordetella pertussis
cgcggguucggcgguu

SEQ ID NO: 2458385 - RNA, 15 nt, Bordetella pertussis
cgcgguaaugacgca

SEQ ID NO: 2458386 - RNA, 17 nt, Bordetella pertussis
cgcgguaaugacgcagc

SEQ ID NO: 2458387 - RNA, 17 nt, Bordetella pertussis
cgcgguacaggcugccg

SEQ ID NO: 2458388 - RNA, 20 nt, Bordetella pertussis
cgcgguacgcaccgccgccg

SEQ ID NO: 2458389 - RNA, 21 nt, Bordetella pertussis
cgcgguacgcaccgccgccgg

SEQ ID NO: 2458390 - RNA, 15 nt, Bordetella pertussis
cgcgguacgcccagc

SEQ ID NO: 2458391 - RNA, 12 nt, Bordetella pertussis
cgcgguagcgcc

SEQ ID NO: 2458392 - RNA, 15 nt, Bordetella pertussis
cgcgguagcgccccu

SEQ ID NO: 2458393 - RNA, 17 nt, Bordetella pertussis
cgcgguagguagcgcgc

SEQ ID NO: 2458394 - RNA, 20 nt, Bordetella pertussis
cgcgguagguagcgcgcagc

SEQ ID NO: 2458395 - RNA, 15 nt, Bordetella pertussis
cgcgguauccagguc

SEQ ID NO: 2458396 - RNA, 19 nt, Bordetella pertussis
cgcgguauggccgcccagc

SEQ ID NO: 2458397 - RNA, 16 nt, Bordetella pertussis
cgcgguauucgcgcug

SEQ ID NO: 2458398 - RNA, 22 nt, Bordetella pertussis
cgcgguauucgcugcuggccgc

SEQ ID NO: 2458399 - RNA, 16 nt, Bordetella pertussis
cgcgguauucggcgac

SEQ ID NO: 2458400 - RNA, 17 nt, Bordetella pertussis
cgcgguauucggcgacc

SEQ ID NO: 2458401 - RNA, 18 nt, Bordetella pertussis
cgcgguauucggcgacca

SEQ ID NO: 2458402 - RNA, 20 nt, Bordetella pertussis
cgcgguauucggcgaccagg

SEQ ID NO: 2458403 - RNA, 21 nt, Bordetella pertussis
cgcgguauucggcgaccaggu

SEQ ID NO: 2458404 - RNA, 16 nt, Bordetella pertussis
cgcgguauugccggau

SEQ ID NO: 2458405 - RNA, 15 nt, Bordetella pertussis
cgcgguauugcgcca

SEQ ID NO: 2458406 - RNA, 21 nt, Bordetella pertussis
cgcgguauugcgccaccccgc

SEQ ID NO: 2458407 - RNA, 22 nt, Bordetella pertussis
cgcgguauugcgccaccccgcc

SEQ ID NO: 2458408 - RNA, 17 nt, Bordetella pertussis
cgcggucagccagagcg

SEQ ID NO: 2458409 - RNA, 20 nt, Bordetella pertussis
cgcggucaugccgaacagca

SEQ ID NO: 2458410 - RNA, 18 nt, Bordetella pertussis
cgcgguccaccucgucgu

SEQ ID NO: 2458411 - RNA, 22 nt, Bordetella pertussis
cgcgguccaccucgucguccag

SEQ ID NO: 2458412 - RNA, 20 nt, Bordetella pertussis
cgcgguccacgcccuggcug

SEQ ID NO: 2458413 - RNA, 13 nt, Bordetella pertussis
cgcgguccacgcg

SEQ ID NO: 2458414 - RNA, 15 nt, Bordetella pertussis
cgcgguccacgcggg

SEQ ID NO: 2458415 - RNA, 14 nt, Bordetella pertussis
cgcgguccagcaag

SEQ ID NO: 2458416 - RNA, 21 nt, Bordetella pertussis
cgcgguccagcaaggcgucga

SEQ ID NO: 2458417 - RNA, 15 nt, Bordetella pertussis
cgcgguccagcacca

SEQ ID NO: 2458418 - RNA, 20 nt, Bordetella pertussis
cgcgguccagcaccagggcg

SEQ ID NO: 2458419 - RNA, 21 nt, Bordetella pertussis
cgcgguccagcaccagggcgc

SEQ ID NO: 2458420 - RNA, 14 nt, Bordetella pertussis
cgcgguccagcacg

SEQ ID NO: 2458421 - RNA, 15 nt, Bordetella pertussis
cgcgguccagcacgg

SEQ ID NO: 2458422 - RNA, 16 nt, Bordetella pertussis
cgcgguccagcacggc

SEQ ID NO: 2458423 - RNA, 20 nt, Bordetella pertussis
cgcgguccagcacggcgagg

SEQ ID NO: 2458424 - RNA, 12 nt, Bordetella pertussis
cgcgguccagcc

SEQ ID NO: 2458425 - RNA, 14 nt, Bordetella pertussis
cgcgguccagcccc

SEQ ID NO: 2458426 - RNA, 16 nt, Bordetella pertussis
cgcgguccagccccug

SEQ ID NO: 2458427 - RNA, 21 nt, Bordetella pertussis
cgcgguccaugcgaaagcggc

SEQ ID NO: 2458428 - RNA, 19 nt, Bordetella pertussis
cgcgguccugaccggcggc

SEQ ID NO: 2458429 - RNA, 22 nt, Bordetella pertussis
cgcggucgacgaaauagccgac

SEQ ID NO: 2458430 - RNA, 23 nt, Bordetella pertussis
cgcggucgcagacgaugaagacg

SEQ ID NO: 2458431 - RNA, 19 nt, Bordetella pertussis
cgcggucgcauuggccgcc

SEQ ID NO: 2458432 - RNA, 19 nt, Bordetella pertussis
cgcggucgccaucggccgg

SEQ ID NO: 2458433 - RNA, 19 nt, Bordetella pertussis
cgcggucgcccaacccggc

SEQ ID NO: 2458434 - RNA, 20 nt, Bordetella pertussis
cgcggucgcccaacccggcg

SEQ ID NO: 2458435 - RNA, 19 nt, Bordetella pertussis
cgcggucgggaucauccug

SEQ ID NO: 2458436 - RNA, 20 nt, Bordetella pertussis
cgcggucgggaucauccugu

SEQ ID NO: 2458437 - RNA, 14 nt, Bordetella pertussis
cgcggucggugcaa

SEQ ID NO: 2458438 - RNA, 19 nt, Bordetella pertussis
cgcggucggugcaaugccc

SEQ ID NO: 2458439 - RNA, 16 nt, Bordetella pertussis
cgcggucguagcggau

SEQ ID NO: 2458440 - RNA, 23 nt, Bordetella pertussis
cgcggucguagcguucgccgucg

SEQ ID NO: 2458441 - RNA, 17 nt, Bordetella pertussis
cgcggugcaagcggccg

SEQ ID NO: 2458442 - RNA, 21 nt, Bordetella pertussis
cgcggugcaagcggccggccu

SEQ ID NO: 2458443 - RNA, 16 nt, Bordetella pertussis
cgcggugcaucucggc

SEQ ID NO: 2458444 - RNA, 14 nt, Bordetella pertussis
cgcggugccgccug

SEQ ID NO: 2458445 - RNA, 19 nt, Bordetella pertussis
cgcggugccgcgcgcggcc

SEQ ID NO: 2458446 - RNA, 20 nt, Bordetella pertussis
cgcggugccgcgcgcggccg

SEQ ID NO: 2458447 - RNA, 16 nt, Bordetella pertussis
cgcggugcgcaccagg

SEQ ID NO: 2458448 - RNA, 17 nt, Bordetella pertussis
cgcggugcgcaccaggc

SEQ ID NO: 2458449 - RNA, 19 nt, Bordetella pertussis
cgcggugcgcaccaggccc

SEQ ID NO: 2458450 - RNA, 12 nt, Bordetella pertussis
cgcggugcgcca

SEQ ID NO: 2458451 - RNA, 16 nt, Bordetella pertussis
cgcggugcgccacgau

SEQ ID NO: 2458452 - RNA, 17 nt, Bordetella pertussis
cgcggugcgccacgaug

SEQ ID NO: 2458453 - RNA, 18 nt, Bordetella pertussis
cgcggugcgggugggcgc

SEQ ID NO: 2458454 - RNA, 20 nt, Bordetella pertussis
cgcggugcgggugggcgcgc

SEQ ID NO: 2458455 - RNA, 22 nt, Bordetella pertussis
cgcggugcgggugggcgcgccg

SEQ ID NO: 2458456 - RNA, 14 nt, Bordetella pertussis
cgcggugcucggcg

SEQ ID NO: 2458457 - RNA, 17 nt, Bordetella pertussis
cgcggugcucggcgaac

SEQ ID NO: 2458458 - RNA, 15 nt, Bordetella pertussis
cgcggugcugggcuu

SEQ ID NO: 2458459 - RNA, 14 nt, Bordetella pertussis
cgcgguggcacgac

SEQ ID NO: 2458460 - RNA, 21 nt, Bordetella pertussis
cgcgguggccgccgcgcgccg

SEQ ID NO: 2458461 - RNA, 19 nt, Bordetella pertussis
cgcgguggccgcuucggcg

SEQ ID NO: 2458462 - RNA, 22 nt, Bordetella pertussis
cgcgguggccgcuucggcggcc

SEQ ID NO: 2458463 - RNA, 23 nt, Bordetella pertussis
cgcgguggccgcuucggcggccg

SEQ ID NO: 2458464 - RNA, 15 nt, Bordetella pertussis
cgcgguggcgggcgu

SEQ ID NO: 2458465 - RNA, 14 nt, Bordetella pertussis
cgcggugguccaga

SEQ ID NO: 2458466 - RNA, 16 nt, Bordetella pertussis
cgcggugucgccgccg

SEQ ID NO: 2458467 - RNA, 19 nt, Bordetella pertussis
cgcggugucgccgccgcgc

SEQ ID NO: 2458468 - RNA, 24 nt, Bordetella pertussis
cgcggugucgccgccgcgccgaac

SEQ ID NO: 2458469 - RNA, 14 nt, Bordetella pertussis
cgcggugucggaca

SEQ ID NO: 2458470 - RNA, 18 nt, Bordetella pertussis
cgcgguucaggcuugcag

SEQ ID NO: 2458471 - RNA, 14 nt, Bordetella pertussis
cgcgguucaucgcc

SEQ ID NO: 2458472 - RNA, 17 nt, Bordetella pertussis
cgcgguucgccgugcag

SEQ ID NO: 2458473 - RNA, 14 nt, Bordetella pertussis
cgcgguugagcgcc

SEQ ID NO: 2458474 - RNA, 15 nt, Bordetella pertussis
cgcgguugagcgcca

SEQ ID NO: 2458475 - RNA, 20 nt, Bordetella pertussis
cgcgguugagcgccagggcc

SEQ ID NO: 2458476 - RNA, 18 nt, Bordetella pertussis
cgcgguugcgguucuggg

SEQ ID NO: 2458477 - RNA, 17 nt, Bordetella pertussis
cgcgguugcgucucggc

SEQ ID NO: 2458478 - RNA, 13 nt, Bordetella pertussis
cgcgguugggcgc

SEQ ID NO: 2458479 - RNA, 14 nt, Bordetella pertussis
cgcgguugggcgga

SEQ ID NO: 2458480 - RNA, 18 nt, Bordetella pertussis
cgcgguugguuugcggcg

SEQ ID NO: 2458481 - RNA, 24 nt, Bordetella pertussis
cgcgguugguuugcggcgcgaccu

SEQ ID NO: 2458482 - RNA, 14 nt, Bordetella pertussis
cgcguacagcccga

SEQ ID NO: 2458483 - RNA, 20 nt, Bordetella pertussis
cgcguaccucggugaggauu

SEQ ID NO: 2458484 - RNA, 13 nt, Bordetella pertussis
cgcguacgcggcg

SEQ ID NO: 2458485 - RNA, 17 nt, Bordetella pertussis
cgcguacguggcgcggc

SEQ ID NO: 2458486 - RNA, 13 nt, Bordetella pertussis
cgcguagcgcggc

SEQ ID NO: 2458487 - RNA, 17 nt, Bordetella pertussis
cgcguagcgcggccggg

SEQ ID NO: 2458488 - RNA, 13 nt, Bordetella pertussis
cgcguaggcgcgc

SEQ ID NO: 2458489 - RNA, 18 nt, Bordetella pertussis
cgcguaggcggucagcug

SEQ ID NO: 2458490 - RNA, 24 nt, Bordetella pertussis
cgcguaggucaggcccacgccgcc

SEQ ID NO: 2458491 - RNA, 22 nt, Bordetella pertussis
cgcguaguccgaaucuucgaug

SEQ ID NO: 2458492 - RNA, 18 nt, Bordetella pertussis
cgcguaugacgcgcugau

SEQ ID NO: 2458493 - RNA, 20 nt, Bordetella pertussis
cgcguaugacgcgcugaugc

SEQ ID NO: 2458494 - RNA, 17 nt, Bordetella pertussis
cgcguaugcaccgggcc

SEQ ID NO: 2458495 - RNA, 16 nt, Bordetella pertussis
cgcguaugcggcagca

SEQ ID NO: 2458496 - RNA, 22 nt, Bordetella pertussis
cgcguaugcggcagcagggcca

SEQ ID NO: 2458497 - RNA, 13 nt, Bordetella pertussis
cgcguauggcggc

SEQ ID NO: 2458498 - RNA, 16 nt, Bordetella pertussis
cgcgucacgcugaacu

SEQ ID NO: 2458499 - RNA, 21 nt, Bordetella pertussis
cgcggcguccgaauacgccac

SEQ ID NO: 2458500 - RNA, 14 nt, Bordetella pertussis
cgcggcguccgcgc

SEQ ID NO: 2458501 - RNA, 16 nt, Bordetella pertussis
cgcggcguccgcgccg

SEQ ID NO: 2458502 - RNA, 17 nt, Bordetella pertussis
cgcggcguccgcgccga

SEQ ID NO: 2458503 - RNA, 20 nt, Bordetella pertussis
cgcggcgucgaaggccgccg

SEQ ID NO: 2458504 - RNA, 21 nt, Bordetella pertussis
cgcggcgucgaccgcgggcgc

SEQ ID NO: 2458505 - RNA, 19 nt, Bordetella pertussis
cgcggcgucgacgcccgcg

SEQ ID NO: 2458506 - RNA, 14 nt, Bordetella pertussis
cgcggcgucgaugu

SEQ ID NO: 2458507 - RNA, 24 nt, Bordetella pertussis
cgcggcgucguccaucgacgcggc

SEQ ID NO: 2458508 - RNA, 15 nt, Bordetella pertussis
cgcggcgugcugccc

SEQ ID NO: 2458509 - RNA, 17 nt, Bordetella pertussis
cgcggcgugcugcccgc

SEQ ID NO: 2458510 - RNA, 18 nt, Bordetella pertussis
cgcggcguguagagcugc

SEQ ID NO: 2458511 - RNA, 21 nt, Bordetella pertussis
cgcggcguguagagcugcggc

SEQ ID NO: 2458512 - RNA, 20 nt, Bordetella pertussis
cgcggcguugcggcagcggc

SEQ ID NO: 2458513 - RNA, 18 nt, Bordetella pertussis
cgcggcguugcggcgcca

SEQ ID NO: 2458514 - RNA, 19 nt, Bordetella pertussis
cgcggcucagagcuugccg

SEQ ID NO: 2458515 - RNA, 22 nt, Bordetella pertussis
cgcggcuccagcucagcagcgc

SEQ ID NO: 2458516 - RNA, 15 nt, Bordetella pertussis
cgcggcucgccgcgc

SEQ ID NO: 2458517 - RNA, 13 nt, Bordetella pertussis
cgcggcucgccgg

SEQ ID NO: 2458518 - RNA, 16 nt, Bordetella pertussis
cgcggcucgccggccg

SEQ ID NO: 2458519 - RNA, 19 nt, Bordetella pertussis
cgcggcucgccggccgcgc

SEQ ID NO: 2458520 - RNA, 22 nt, Bordetella pertussis
cgcggcucgccggccgcgccca

SEQ ID NO: 2458521 - RNA, 23 nt, Bordetella pertussis
cgcggcucgccggccgcgcccag

SEQ ID NO: 2458522 - RNA, 20 nt, Bordetella pertussis
cgcggcugcgaaaggccgag

SEQ ID NO: 2458523 - RNA, 12 nt, Bordetella pertussis
cgcggcugcggg

SEQ ID NO: 2458524 - RNA, 13 nt, Bordetella pertussis
cgcggcugcgggc

SEQ ID NO: 2458525 - RNA, 16 nt, Bordetella pertussis
cgcggcugcgggccgg

SEQ ID NO: 2458526 - RNA, 19 nt, Bordetella pertussis
cgcggcugcgggccggcgc

SEQ ID NO: 2458527 - RNA, 20 nt, Bordetella pertussis
cgcggcugcgggccggcgcc

SEQ ID NO: 2458528 - RNA, 12 nt, Bordetella pertussis
cgcggcugcugg

SEQ ID NO: 2458529 - RNA, 12 nt, Bordetella pertussis
cgcggcuggcug

SEQ ID NO: 2458530 - RNA, 17 nt, Bordetella pertussis
cgcggcugggucggcgu

SEQ ID NO: 2458531 - RNA, 21 nt, Bordetella pertussis
cgcggcugguggugccgcgca

SEQ ID NO: 2458532 - RNA, 22 nt, Bordetella pertussis
cgcggcugguggugccgcgcac

SEQ ID NO: 2458533 - RNA, 23 nt, Bordetella pertussis
cgcggcugguggugccgcgcacg

SEQ ID NO: 2458534 - RNA, 14 nt, Bordetella pertussis
cgcggcuucgcccg

SEQ ID NO: 2458535 - RNA, 22 nt, Bordetella pertussis
cgcggcuugcagcggacggcgc

SEQ ID NO: 2458536 - RNA, 17 nt, Bordetella pertussis
cgcggcuugccgcggcg

SEQ ID NO: 2458537 - RNA, 20 nt, Bordetella pertussis
cgcggcuuucgccggaggcg

SEQ ID NO: 2458538 - RNA, 23 nt, Bordetella pertussis
cgcggcuuucgccggaggcgcgc

SEQ ID NO: 2458539 - RNA, 19 nt, Bordetella pertussis
cgcggcuuuuucucggccu

SEQ ID NO: 2458540 - RNA, 16 nt, Bordetella pertussis
cgcgggaagcgcucgc

SEQ ID NO: 2458541 - RNA, 18 nt, Bordetella pertussis
cgcgggaagcugucggcg

SEQ ID NO: 2458542 - RNA, 20 nt, Bordetella pertussis
cgcgggaagcugucggcgcu

SEQ ID NO: 2458543 - RNA, 22 nt, Bordetella pertussis
cgcgggaagcugucggcgcugg

SEQ ID NO: 2458544 - RNA, 23 nt, Bordetella pertussis
cgcgggagaucuguaccgccggg

SEQ ID NO: 2458545 - RNA, 13 nt, Bordetella pertussis
cgcgggagcccgc

SEQ ID NO: 2458546 - RNA, 14 nt, Bordetella pertussis
cgcgggagcccgca

SEQ ID NO: 2458547 - RNA, 22 nt, Bordetella pertussis
cgcgggauucugcugcaugccg

SEQ ID NO: 2458548 - RNA, 17 nt, Bordetella pertussis
cgcgggcagugcgccgg

SEQ ID NO: 2458549 - RNA, 20 nt, Bordetella pertussis
cgcgggcagugcgccggacg

SEQ ID NO: 2458550 - RNA, 20 nt, Bordetella pertussis
cgcgggcauugggcagcgga

SEQ ID NO: 2458551 - RNA, 12 nt, Bordetella pertussis
cgcgggccacug

SEQ ID NO: 2458552 - RNA, 19 nt, Bordetella pertussis
cgcgggccacugcgccugg

SEQ ID NO: 2458553 - RNA, 14 nt, Bordetella pertussis
cgcgggccagcaga

SEQ ID NO: 2458554 - RNA, 12 nt, Bordetella pertussis
cgcgggccagcu

SEQ ID NO: 2458555 - RNA, 14 nt, Bordetella pertussis
cgcgggccaggccg

SEQ ID NO: 2458556 - RNA, 15 nt, Bordetella pertussis
cgcgggccaggccgg

SEQ ID NO: 2458557 - RNA, 17 nt, Bordetella pertussis
cgcgggccaggccggcc

SEQ ID NO: 2458558 - RNA, 17 nt, Bordetella pertussis
cgcgggcccgcucggcc

SEQ ID NO: 2458559 - RNA, 20 nt, Bordetella pertussis
cgcgggcccgcucggccagc

SEQ ID NO: 2458560 - RNA, 21 nt, Bordetella pertussis
cgcgggcccgcucggccagca

SEQ ID NO: 2458561 - RNA, 12 nt, Bordetella pertussis
cgcgggccgccg

SEQ ID NO: 2458562 - RNA, 13 nt, Bordetella pertussis
cgcgggccgccgc

SEQ ID NO: 2458563 - RNA, 18 nt, Bordetella pertussis
cgcgggccgccgcacagc

SEQ ID NO: 2458564 - RNA, 17 nt, Bordetella pertussis
cgcgggccgcuggucgu

SEQ ID NO: 2458565 - RNA, 13 nt, Bordetella pertussis
cgcgggccggccg

SEQ ID NO: 2458566 - RNA, 14 nt, Bordetella pertussis
cgcgggccugcucg

SEQ ID NO: 2458567 - RNA, 13 nt, Bordetella pertussis
cgcgggccuggcg

SEQ ID NO: 2458568 - RNA, 18 nt, Bordetella pertussis
cgcgggccuuggccagca

SEQ ID NO: 2458569 - RNA, 20 nt, Bordetella pertussis
cgcgggcgauuugccgcagc

SEQ ID NO: 2458570 - RNA, 22 nt, Bordetella pertussis
cgcgggcgauuugccgcagccc

SEQ ID NO: 2458571 - RNA, 12 nt, Bordetella pertussis
cgcgggcgcagg

SEQ ID NO: 2458572 - RNA, 18 nt, Bordetella pertussis
cgcgggcgcgcagcgcga

SEQ ID NO: 2458573 - RNA, 13 nt, Bordetella pertussis
cgcgggcgcgccg

SEQ ID NO: 2458574 - RNA, 16 nt, Bordetella pertussis
cgcgggcgcggcaggc

SEQ ID NO: 2458575 - RNA, 18 nt, Bordetella pertussis
cgcgggcgcggcaggcgg

SEQ ID NO: 2458576 - RNA, 18 nt, Bordetella pertussis
cgcgggcgcugacgccga

SEQ ID NO: 2458577 - RNA, 13 nt, Bordetella pertussis
cgcgggcggcgcg

SEQ ID NO: 2458578 - RNA, 15 nt, Bordetella pertussis
cgcgggcggcgcgcc

SEQ ID NO: 2458579 - RNA, 16 nt, Bordetella pertussis
cgcgggcggcgcgccc

SEQ ID NO: 2458580 - RNA, 16 nt, Bordetella pertussis
cgcgggcggcuaggcg

SEQ ID NO: 2458581 - RNA, 18 nt, Bordetella pertussis
cgcgggcggcuaggcgca

SEQ ID NO: 2458582 - RNA, 20 nt, Bordetella pertussis
cgcgggcggcuaggcgcagc

SEQ ID NO: 2458583 - RNA, 21 nt, Bordetella pertussis
cgcgggcggcuaggcgcagca

SEQ ID NO: 2458584 - RNA, 13 nt, Bordetella pertussis
cgcgggcgggccg

SEQ ID NO: 2458585 - RNA, 14 nt, Bordetella pertussis
cgcgggcgggccgc

SEQ ID NO: 2458586 - RNA, 14 nt, Bordetella pertussis
cgcgggcgugcugg

SEQ ID NO: 2458587 - RNA, 16 nt, Bordetella pertussis
cgcgggcugcgacagg

SEQ ID NO: 2458588 - RNA, 20 nt, Bordetella pertussis
cgcgggcugcgacaggcgca

SEQ ID NO: 2458589 - RNA, 20 nt, Bordetella pertussis
cgcgggcugucgcagucggg

SEQ ID NO: 2458590 - RNA, 13 nt, Bordetella pertussis
cgcggggacaggc

SEQ ID NO: 2458591 - RNA, 16 nt, Bordetella pertussis
cgcggggacaggcaca

SEQ ID NO: 2458592 - RNA, 17 nt, Bordetella pertussis
cgcggggacaggcacac

SEQ ID NO: 2458593 - RNA, 18 nt, Bordetella pertussis
cgcggggacaggcacacc

SEQ ID NO: 2458594 - RNA, 17 nt, Bordetella pertussis
cgcggggacaggcaccc

SEQ ID NO: 2458595 - RNA, 18 nt, Bordetella pertussis
cgcggggacaggcacccu

SEQ ID NO: 2458596 - RNA, 23 nt, Bordetella pertussis
cgcggggauggcuuccugcggca

SEQ ID NO: 2458597 - RNA, 12 nt, Bordetella pertussis
cgcggggccagg

SEQ ID NO: 2458598 - RNA, 13 nt, Bordetella pertussis
cgcggggcccuug

SEQ ID NO: 2458599 - RNA, 23 nt, Bordetella pertussis
cgcggggcuggccagcuggcggc

SEQ ID NO: 2458600 - RNA, 24 nt, Bordetella pertussis
cgcggggcuggccagcuggcggcg

SEQ ID NO: 2458601 - RNA, 23 nt, Bordetella pertussis
cgcgggggauagacccuccucgc

SEQ ID NO: 2458602 - RNA, 17 nt, Bordetella pertussis
cgcgggggugcgcgaca

SEQ ID NO: 2458603 - RNA, 16 nt, Bordetella pertussis
cgcggguaggcaaagc

SEQ ID NO: 2458604 - RNA, 21 nt, Bordetella pertussis
cgcggguauucgaaggcagca

SEQ ID NO: 2458605 - RNA, 18 nt, Bordetella pertussis
cgcggguccggcgugcca

SEQ ID NO: 2458606 - RNA, 16 nt, Bordetella pertussis
cgcggguccuugccgg

SEQ ID NO: 2458607 - RNA, 19 nt, Bordetella pertussis
cgcgggucuugagcggccc

SEQ ID NO: 2458608 - RNA, 13 nt, Bordetella pertussis
cgcggguggccgc

SEQ ID NO: 2458609 - RNA, 15 nt, Bordetella pertussis
cgcggguggccggau

SEQ ID NO: 2458610 - RNA, 15 nt, Bordetella pertussis
cgcgggugguggccg

SEQ ID NO: 2458611 - RNA, 17 nt, Bordetella pertussis
cgcgggugucgcucccc

SEQ ID NO: 2458612 - RNA, 15 nt, Bordetella pertussis
cgcggguucgacgcc

SEQ ID NO: 2458613 - RNA, 23 nt, Bordetella pertussis
cgcggguucgacgccggcagcga

SEQ ID NO: 2458614 - RNA, 14 nt, Bordetella pertussis
cgcgucagacgcgc

SEQ ID NO: 2458615 - RNA, 13 nt, Bordetella pertussis
cgcgucaggccgg

SEQ ID NO: 2458616 - RNA, 17 nt, Bordetella pertussis
cgcgucaggccgggcag

SEQ ID NO: 2458617 - RNA, 16 nt, Bordetella pertussis
cgcgucaggcgagcgc

SEQ ID NO: 2458618 - RNA, 18 nt, Bordetella pertussis
cgcgucaggcgagcgcgg

SEQ ID NO: 2458619 - RNA, 23 nt, Bordetella pertussis
cgcgucaguugggcgcgcccagc

SEQ ID NO: 2458620 - RNA, 18 nt, Bordetella pertussis
cgcgucauacgacgcggc

SEQ ID NO: 2458621 - RNA, 19 nt, Bordetella pertussis
cgcgucauacgacgcggca

SEQ ID NO: 2458622 - RNA, 16 nt, Bordetella pertussis
cgcgucauggcgugcg

SEQ ID NO: 2458623 - RNA, 16 nt, Bordetella pertussis
cgcguccaagcagacc

SEQ ID NO: 2458624 - RNA, 20 nt, Bordetella pertussis
cgcguccaagcagacccgcg

SEQ ID NO: 2458625 - RNA, 21 nt, Bordetella pertussis
cgcguccaagcagacccgcgc

SEQ ID NO: 2458626 - RNA, 22 nt, Bordetella pertussis
cgcguccaagcagacccgcgcc

SEQ ID NO: 2458627 - RNA, 20 nt, Bordetella pertussis
cgcguccagcgcgcggccuc

SEQ ID NO: 2458628 - RNA, 13 nt, Bordetella pertussis
cgcguccaggcca

SEQ ID NO: 2458629 - RNA, 13 nt, Bordetella pertussis
cgcguccaggccc

SEQ ID NO: 2458630 - RNA, 14 nt, Bordetella pertussis
cgcguccaggccca

SEQ ID NO: 2458631 - RNA, 16 nt, Bordetella pertussis
cgcguccaggcccagc

SEQ ID NO: 2458632 - RNA, 17 nt, Bordetella pertussis
cgcguccaggcccagcg

SEQ ID NO: 2458633 - RNA, 17 nt, Bordetella pertussis
cgcguccaggcccuggc

SEQ ID NO: 2458634 - RNA, 21 nt, Bordetella pertussis
cgcguccaggcccuggcggcg

SEQ ID NO: 2458635 - RNA, 19 nt, Bordetella pertussis
cgcguccaggugcggcggc

SEQ ID NO: 2458636 - RNA, 18 nt, Bordetella pertussis
cgcguccaucuggaccgc

SEQ ID NO: 2458637 - RNA, 16 nt, Bordetella pertussis
cgcgucccgugccggc

SEQ ID NO: 2458638 - RNA, 18 nt, Bordetella pertussis
cgcgucccgugccggccg

SEQ ID NO: 2458639 - RNA, 15 nt, Bordetella pertussis
cgcguccgcccgcuc

SEQ ID NO: 2458640 - RNA, 22 nt, Bordetella pertussis
cgcguccgcccgcuccaccagc

SEQ ID NO: 2458641 - RNA, 13 nt, Bordetella pertussis
cgcguccgcgacg

SEQ ID NO: 2458642 - RNA, 18 nt, Bordetella pertussis
cgcguccgcucaugccgg

SEQ ID NO: 2458643 - RNA, 19 nt, Bordetella pertussis
cgcguccggcgcccgccgc

SEQ ID NO: 2458644 - RNA, 22 nt, Bordetella pertussis
cgcguccggugcgauagcgccg

SEQ ID NO: 2458645 - RNA, 12 nt, Bordetella pertussis
cgcguccucggc

SEQ ID NO: 2458646 - RNA, 16 nt, Bordetella pertussis
cgcguccucggccagc

SEQ ID NO: 2458647 - RNA, 21 nt, Bordetella pertussis
cgcguccucggccagccgggc

SEQ ID NO: 2458648 - RNA, 16 nt, Bordetella pertussis
cgcguccucggccugg

SEQ ID NO: 2458649 - RNA, 17 nt, Bordetella pertussis
cgcguccucggccuggc

SEQ ID NO: 2458650 - RNA, 18 nt, Bordetella pertussis
cgcguccucggccuggcc

SEQ ID NO: 2458651 - RNA, 22 nt, Bordetella pertussis
cgcguccugccaguugccgccg

SEQ ID NO: 2458652 - RNA, 23 nt, Bordetella pertussis
cgcguccugccaguugccgccgc

SEQ ID NO: 2458653 - RNA, 16 nt, Bordetella pertussis
cgcguccugcgccagu

SEQ ID NO: 2458654 - RNA, 13 nt, Bordetella pertussis
cgcguccuggcgc

SEQ ID NO: 2458655 - RNA, 15 nt, Bordetella pertussis
cgcguccuggcgcga

SEQ ID NO: 2458656 - RNA, 19 nt, Bordetella pertussis
cgcguccugggccgagcgc

SEQ ID NO: 2458657 - RNA, 21 nt, Bordetella pertussis
cgcguccugggccgagcgcgc

SEQ ID NO: 2458658 - RNA, 17 nt, Bordetella pertussis
cgcguccuucgucggcg

SEQ ID NO: 2458659 - RNA, 18 nt, Bordetella pertussis
cgcguccuucgucggcgg

SEQ ID NO: 2458660 - RNA, 15 nt, Bordetella pertussis
cgcgucgacggugcg

SEQ ID NO: 2458661 - RNA, 18 nt, Bordetella pertussis
cgcgucgacggugcgcgc

SEQ ID NO: 2458662 - RNA, 20 nt, Bordetella pertussis
cgcgucgacggugcgcgcca

SEQ ID NO: 2458663 - RNA, 21 nt, Bordetella pertussis
cgcgucgacggugcgcgccac

SEQ ID NO: 2458664 - RNA, 19 nt, Bordetella pertussis
cgcgucgagcaggccggcg

SEQ ID NO: 2458665 - RNA, 18 nt, Bordetella pertussis
cgcgucgaucagcgcggg

SEQ ID NO: 2458666 - RNA, 17 nt, Bordetella pertussis
cgcgucgauccggcagc

SEQ ID NO: 2458667 - RNA, 19 nt, Bordetella pertussis
cgcgucgauccggcagcag

SEQ ID NO: 2458668 - RNA, 20 nt, Bordetella pertussis
cgcgucgauccggcagcagc

SEQ ID NO: 2458669 - RNA, 21 nt, Bordetella pertussis
cgcgucgauggagucggucag

SEQ ID NO: 2458670 - RNA, 21 nt, Bordetella pertussis
cgcgucgcacuggguggccag

SEQ ID NO: 2458671 - RNA, 15 nt, Bordetella pertussis
cgcgucgccgcuggc

SEQ ID NO: 2458672 - RNA, 18 nt, Bordetella pertussis
cgcgucgccgcuggccag

SEQ ID NO: 2458673 - RNA, 21 nt, Bordetella pertussis
cgcgucgccgcuggccagccg

SEQ ID NO: 2458674 - RNA, 14 nt, Bordetella pertussis
cgcgucgcgcgcca

SEQ ID NO: 2458675 - RNA, 20 nt, Bordetella pertussis
cgcgucgcguagcgcggccg

SEQ ID NO: 2458676 - RNA, 21 nt, Bordetella pertussis
cgcgucgcguagcgcggccgg

SEQ ID NO: 2458677 - RNA, 23 nt, Bordetella pertussis
cgcgucgcguagcgcggccgggu

SEQ ID NO: 2458678 - RNA, 14 nt, Bordetella pertussis
cgcgucgcugcgcg

SEQ ID NO: 2458679 - RNA, 16 nt, Bordetella pertussis
cgcgucgcuggccgga

SEQ ID NO: 2458680 - RNA, 14 nt, Bordetella pertussis
cgcgucggacgcgc

SEQ ID NO: 2458681 - RNA, 24 nt, Bordetella pertussis
cgcgucggacgcgcgccgcaucau

SEQ ID NO: 2458682 - RNA, 15 nt, Bordetella pertussis
cgcgucggccaaggc

SEQ ID NO: 2458683 - RNA, 18 nt, Bordetella pertussis
cgcgucggccaaggccgg

SEQ ID NO: 2458684 - RNA, 21 nt, Bordetella pertussis
cgcgucggccaaggccggcgc

SEQ ID NO: 2458685 - RNA, 19 nt, Bordetella pertussis
cgcgucggccagcgccgcg

SEQ ID NO: 2458686 - RNA, 14 nt, Bordetella pertussis
cgcgucggccaggc

SEQ ID NO: 2458687 - RNA, 17 nt, Bordetella pertussis
cgcgucggccucaucga

SEQ ID NO: 2458688 - RNA, 15 nt, Bordetella pertussis
cgcgucggccugcca

SEQ ID NO: 2458689 - RNA, 17 nt, Bordetella pertussis
cgcgucggccugccagc

SEQ ID NO: 2458690 - RNA, 16 nt, Bordetella pertussis
cgcgucggcgcgcgcg

SEQ ID NO: 2458691 - RNA, 16 nt, Bordetella pertussis
cgcgucggcgcggucg

SEQ ID NO: 2458692 - RNA, 20 nt, Bordetella pertussis
cgcgucgguggccagccagg

SEQ ID NO: 2458693 - RNA, 22 nt, Bordetella pertussis
cgcgucgguggccagccaggcg

SEQ ID NO: 2458694 - RNA, 16 nt, Bordetella pertussis
cgcgucguccagcgug

SEQ ID NO: 2458695 - RNA, 22 nt, Bordetella pertussis
cgcgucguccagcguggcgcag

SEQ ID NO: 2458696 - RNA, 16 nt, Bordetella pertussis
cgcgucgucguuuccc

SEQ ID NO: 2458697 - RNA, 22 nt, Bordetella pertussis
cgcgucgucguuucccagcaag

SEQ ID NO: 2458698 - RNA, 13 nt, Bordetella pertussis
cgcgucgugcccg

SEQ ID NO: 2458699 - RNA, 23 nt, Bordetella pertussis
cgcgucguugcgccgaucgcggc

SEQ ID NO: 2458700 - RNA, 15 nt, Bordetella pertussis
cgcgucuccagcgcc

SEQ ID NO: 2458701 - RNA, 22 nt, Bordetella pertussis
cgcgucuccagcgccggcagcc

SEQ ID NO: 2458702 - RNA, 21 nt, Bordetella pertussis
cgcgucuggaggacgagcggg

SEQ ID NO: 2458703 - RNA, 13 nt, Bordetella pertussis
cgcgucugggccg

SEQ ID NO: 2458704 - RNA, 20 nt, Bordetella pertussis
cgcgucuucaguugacgccg

SEQ ID NO: 2458705 - RNA, 16 nt, Bordetella pertussis
cgcgucuuggcgggca

SEQ ID NO: 2458706 - RNA, 17 nt, Bordetella pertussis
cgcgugaauaccgcgca

SEQ ID NO: 2458707 - RNA, 20 nt, Bordetella pertussis
cgcgugacgauauccaggcg

SEQ ID NO: 2458708 - RNA, 22 nt, Bordetella pertussis
cgcgugacgauauccaggcgcg

SEQ ID NO: 2458709 - RNA, 16 nt, Bordetella pertussis
cgcgugacggccgcca

SEQ ID NO: 2458710 - RNA, 13 nt, Bordetella pertussis
cgcgugcaccagc

SEQ ID NO: 2458711 - RNA, 15 nt, Bordetella pertussis
cgcgugcacgaccug

SEQ ID NO: 2458712 - RNA, 17 nt, Bordetella pertussis
cgcgugcacgaccugcc

SEQ ID NO: 2458713 - RNA, 15 nt, Bordetella pertussis
cgcgugcagccagcg

SEQ ID NO: 2458714 - RNA, 19 nt, Bordetella pertussis
cgcgugcagccagcggccg

SEQ ID NO: 2458715 - RNA, 20 nt, Bordetella pertussis
cgcgugcagccagcggccga

SEQ ID NO: 2458716 - RNA, 22 nt, Bordetella pertussis
cgcgugcagccagcggccgaua

SEQ ID NO: 2458717 - RNA, 15 nt, Bordetella pertussis
cgcgugcaggccgcg

SEQ ID NO: 2458718 - RNA, 20 nt, Bordetella pertussis
cgcgugcagguaggacggcg

SEQ ID NO: 2458719 - RNA, 14 nt, Bordetella pertussis
cgcgugccagcagg

SEQ ID NO: 2458720 - RNA, 15 nt, Bordetella pertussis
cgcgugccagcaggu

SEQ ID NO: 2458721 - RNA, 23 nt, Bordetella pertussis
cgcgugccagcaggucgcgcacg

SEQ ID NO: 2458722 - RNA, 16 nt, Bordetella pertussis
cgcgugccgcaggcca

SEQ ID NO: 2458723 - RNA, 17 nt, Bordetella pertussis
cgcgugccgcaggccag

SEQ ID NO: 2458724 - RNA, 20 nt, Bordetella pertussis
cgcgugccgcaggccagccc

SEQ ID NO: 2458725 - RNA, 22 nt, Bordetella pertussis
cgcgugccgcaggccagcccgc

SEQ ID NO: 2458726 - RNA, 14 nt, Bordetella pertussis
cgcgugcgcaggcg

SEQ ID NO: 2458727 - RNA, 19 nt, Bordetella pertussis
cgcgugcgcaggcgcgugg

SEQ ID NO: 2458728 - RNA, 21 nt, Bordetella pertussis
cggcaaaaaaaaccgcgcgcc

SEQ ID NO: 2458729 - RNA, 23 nt, Bordetella pertussis
cggcaaaaaaaaccgcgcgccgg

SEQ ID NO: 2458730 - RNA, 13 nt, Bordetella pertussis
cggcaaaacggug

SEQ ID NO: 2458731 - RNA, 15 nt, Bordetella pertussis
cggcaaaacggugcc

SEQ ID NO: 2458732 - RNA, 13 nt, Bordetella pertussis
cggcaaacccggc

SEQ ID NO: 2458733 - RNA, 14 nt, Bordetella pertussis
cggcaaacccggcg

SEQ ID NO: 2458734 - RNA, 20 nt, Bordetella pertussis
cggcaaagccgcugcgcugg

SEQ ID NO: 2458735 - RNA, 21 nt, Bordetella pertussis
cggcaaagccgcugcgcuggc

SEQ ID NO: 2458736 - RNA, 22 nt, Bordetella pertussis
cggcaaagccgcugcgcuggcc

SEQ ID NO: 2458737 - RNA, 19 nt, Bordetella pertussis
cggcaacaucuccaccagc

SEQ ID NO: 2458738 - RNA, 14 nt, Bordetella pertussis
cggcaacccgccca

SEQ ID NO: 2458739 - RNA, 13 nt, Bordetella pertussis
cggcaaccgcgcc

SEQ ID NO: 2458740 - RNA, 17 nt, Bordetella pertussis
cggcaaccgucgccagc

SEQ ID NO: 2458741 - RNA, 18 nt, Bordetella pertussis
cggcaaccgucgccagcg

SEQ ID NO: 2458742 - RNA, 20 nt, Bordetella pertussis
cggcaaccgucgccagcgcg

SEQ ID NO: 2458743 - RNA, 16 nt, Bordetella pertussis
cggcaacgugcaggcc

SEQ ID NO: 2458744 - RNA, 18 nt, Bordetella pertussis
cggcaacgugcaggccaa

SEQ ID NO: 2458745 - RNA, 18 nt, Bordetella pertussis
cggcaacguggugcucag

SEQ ID NO: 2458746 - RNA, 14 nt, Bordetella pertussis
cggcaagacggcgc

SEQ ID NO: 2458747 - RNA, 14 nt, Bordetella pertussis
cggcaagaugccgg

SEQ ID NO: 2458748 - RNA, 17 nt, Bordetella pertussis
cggcaagaugccggccu

SEQ ID NO: 2458749 - RNA, 16 nt, Bordetella pertussis
cggcaagcagccggaa

SEQ ID NO: 2458750 - RNA, 13 nt, Bordetella pertussis
cggcaagccgcgg

SEQ ID NO: 2458751 - RNA, 14 nt, Bordetella pertussis
cggcaagccgcggc

SEQ ID NO: 2458752 - RNA, 16 nt, Bordetella pertussis
cggcaagccgcggcgg

SEQ ID NO: 2458753 - RNA, 13 nt, Bordetella pertussis
cggcaagccuugc

SEQ ID NO: 2458754 - RNA, 19 nt, Bordetella pertussis
cggcaagccuugcggcuug

SEQ ID NO: 2458755 - RNA, 15 nt, Bordetella pertussis
cggcaagcgcucgcc

SEQ ID NO: 2458756 - RNA, 14 nt, Bordetella pertussis
cggcaagcggcgug

SEQ ID NO: 2458757 - RNA, 14 nt, Bordetella pertussis
cggcaaggccgcga

SEQ ID NO: 2458758 - RNA, 17 nt, Bordetella pertussis
cggcaaggccgcgaacg

SEQ ID NO: 2458759 - RNA, 21 nt, Bordetella pertussis
cggcaaggccgcgaacgcgcc

SEQ ID NO: 2458760 - RNA, 14 nt, Bordetella pertussis
cggcaaggcgcaca

SEQ ID NO: 2458761 - RNA, 19 nt, Bordetella pertussis
cggcaaggggccagccugg

SEQ ID NO: 2458762 - RNA, 20 nt, Bordetella pertussis
cggcaaggggccagccuggc

SEQ ID NO: 2458763 - RNA, 22 nt, Bordetella pertussis
cggcaaggggccagccuggcgc

SEQ ID NO: 2458764 - RNA, 21 nt, Bordetella pertussis
cggcaagggugccuguccccg

SEQ ID NO: 2458765 - RNA, 17 nt, Bordetella pertussis
cggcaagguccaggcgc

SEQ ID NO: 2458766 - RNA, 18 nt, Bordetella pertussis
cggcaagguccaggcgcg

SEQ ID NO: 2458767 - RNA, 14 nt, Bordetella pertussis
cggcaagucgacgc

SEQ ID NO: 2458768 - RNA, 15 nt, Bordetella pertussis
cggcaagucgacgcu

SEQ ID NO: 2458769 - RNA, 21 nt, Bordetella pertussis
cggcaagucgacgcugaucgg

SEQ ID NO: 2458770 - RNA, 17 nt, Bordetella pertussis
cggcaaguucgcugccg

SEQ ID NO: 2458771 - RNA, 23 nt, Bordetella pertussis
cggcaaguucgcugccgggaucc

SEQ ID NO: 2458772 - RNA, 14 nt, Bordetella pertussis
cggcaaucccggcg

SEQ ID NO: 2458773 - RNA, 19 nt, Bordetella pertussis
cggcaaucgaaaagcccgc

SEQ ID NO: 2458774 - RNA, 18 nt, Bordetella pertussis
cggcaaucuugccgccgg

SEQ ID NO: 2458775 - RNA, 20 nt, Bordetella pertussis
cggcaaucuugccgccgggc

SEQ ID NO: 2458776 - RNA, 22 nt, Bordetella pertussis
cggcaaucuugccgccgggcau

SEQ ID NO: 2458777 - RNA, 22 nt, Bordetella pertussis
cggcaaugacauccucgggcga

SEQ ID NO: 2458778 - RNA, 16 nt, Bordetella pertussis
cggcaaugccugcgcg

SEQ ID NO: 2458779 - RNA, 14 nt, Bordetella pertussis
cggcaaugcgcgcg

SEQ ID NO: 2458780 - RNA, 15 nt, Bordetella pertussis
cggcaauguccgggg

SEQ ID NO: 2458781 - RNA, 16 nt, Bordetella pertussis
cggcaauguccggggc

SEQ ID NO: 2458782 - RNA, 17 nt, Bordetella pertussis
cggcaauguccggggcg

SEQ ID NO: 2458783 - RNA, 23 nt, Bordetella pertussis
cggcaauguccggggcgcuugcc

SEQ ID NO: 2458784 - RNA, 17 nt, Bordetella pertussis
cggcaaugucgcaggcc

SEQ ID NO: 2458785 - RNA, 21 nt, Bordetella pertussis
cggcaaugucgcaggccgcgg

SEQ ID NO: 2458786 - RNA, 13 nt, Bordetella pertussis
cggcacaaccugg

SEQ ID NO: 2458787 - RNA, 14 nt, Bordetella pertussis
cggcacaaccuggc

SEQ ID NO: 2458788 - RNA, 16 nt, Bordetella pertussis
cggcacaaccuggcgc

SEQ ID NO: 2458789 - RNA, 18 nt, Bordetella pertussis
cggcaccacgaccggcuc

SEQ ID NO: 2458790 - RNA, 20 nt, Bordetella pertussis
cggcaccacgaccggcucgg

SEQ ID NO: 2458791 - RNA, 13 nt, Bordetella pertussis
cggcaccagcagg

SEQ ID NO: 2458792 - RNA, 15 nt, Bordetella pertussis
cggcaccagcaggcc

SEQ ID NO: 2458793 - RNA, 16 nt, Bordetella pertussis
cggcaccagcaggccg

SEQ ID NO: 2458794 - RNA, 17 nt, Bordetella pertussis
cggcaccagcaggccgg

SEQ ID NO: 2458795 - RNA, 13 nt, Bordetella pertussis
cggcaccagccgg

SEQ ID NO: 2458796 - RNA, 13 nt, Bordetella pertussis
cggcaccaucgcc

SEQ ID NO: 2458797 - RNA, 17 nt, Bordetella pertussis
cggcaccaucgccgccu

SEQ ID NO: 2458798 - RNA, 20 nt, Bordetella pertussis
cggcaccaucugcgucgcgu

SEQ ID NO: 2458799 - RNA, 13 nt, Bordetella pertussis
cggcaccaugcgc

SEQ ID NO: 2458800 - RNA, 17 nt, Bordetella pertussis
cggcaccaugcgcacca

SEQ ID NO: 2458801 - RNA, 20 nt, Bordetella pertussis
cggcaccaugcgcaccaggc

SEQ ID NO: 2458802 - RNA, 18 nt, Bordetella pertussis
cggcaccauugccggcgc

SEQ ID NO: 2458803 - RNA, 22 nt, Bordetella pertussis
cggcacccgcuaccccggcagc

SEQ ID NO: 2458804 - RNA, 15 nt, Bordetella pertussis
cggcaccgaggccga

SEQ ID NO: 2458805 - RNA, 12 nt, Bordetella pertussis
cggcaccgcgca

SEQ ID NO: 2458806 - RNA, 16 nt, Bordetella pertussis
cggcaccgcgcagccc

SEQ ID NO: 2458807 - RNA, 19 nt, Bordetella pertussis
cggcaccgcgcagcccggc

SEQ ID NO: 2458808 - RNA, 13 nt, Bordetella pertussis
cggcaccggcagc

SEQ ID NO: 2458809 - RNA, 15 nt, Bordetella pertussis
cggcaccguccagca

SEQ ID NO: 2458810 - RNA, 19 nt, Bordetella pertussis
cggcaccucggccggggcg

SEQ ID NO: 2458811 - RNA, 14 nt, Bordetella pertussis
cggcaccucggcgc

SEQ ID NO: 2458812 - RNA, 19 nt, Bordetella pertussis
cggcaccucggcgccgcgg

SEQ ID NO: 2458813 - RNA, 21 nt, Bordetella pertussis
cggcaccucggcgccgcggcg

SEQ ID NO: 2458814 - RNA, 19 nt, Bordetella pertussis
cggcaccuucuuccaggcg

SEQ ID NO: 2458815 - RNA, 18 nt, Bordetella pertussis
cggcacgaaaagccgcgg

SEQ ID NO: 2458816 - RNA, 21 nt, Bordetella pertussis
cggcacgaaaagccgcggccg

SEQ ID NO: 2458817 - RNA, 20 nt, Bordetella pertussis
cggcacgaauguggucgccg

SEQ ID NO: 2458818 - RNA, 20 nt, Bordetella pertussis
cggcacgacgaucggccuga

SEQ ID NO: 2458819 - RNA, 22 nt, Bordetella pertussis
cggcacgacgaucggccugaac

SEQ ID NO: 2458820 - RNA, 14 nt, Bordetella pertussis
cggcacgacgcuga

SEQ ID NO: 2458821 - RNA, 12 nt, Bordetella pertussis
cggcacgacggc

SEQ ID NO: 2458822 - RNA, 15 nt, Bordetella pertussis
cggcacgaucggcgc

SEQ ID NO: 2458823 - RNA, 16 nt, Bordetella pertussis
cggcacgaucggcgcc

SEQ ID NO: 2458824 - RNA, 20 nt, Bordetella pertussis
cggcacgaucggcgccuggc

SEQ ID NO: 2458825 - RNA, 15 nt, Bordetella pertussis
cggcacgauuucgcc

SEQ ID NO: 2458826 - RNA, 16 nt, Bordetella pertussis
cggcacgcacagcaug

SEQ ID NO: 2458827 - RNA, 20 nt, Bordetella pertussis
cggcacgcacagcaugcgcu

SEQ ID NO: 2458828 - RNA, 22 nt, Bordetella pertussis
cggcacgcacagcaugcgcugg

SEQ ID NO: 2458829 - RNA, 19 nt, Bordetella pertussis
cggcacgcccagccgcagc

SEQ ID NO: 2458830 - RNA, 21 nt, Bordetella pertussis
cggcacgcccagccgcagcag

SEQ ID NO: 2458831 - RNA, 14 nt, Bordetella pertussis
cggcacgccggcgg

SEQ ID NO: 2458832 - RNA, 17 nt, Bordetella pertussis
cggcacgccggcggccc

SEQ ID NO: 2458833 - RNA, 16 nt, Bordetella pertussis
cggcacgccggcggcg

SEQ ID NO: 2458834 - RNA, 23 nt, Bordetella pertussis
cggcacgccucgccggcccugcc

SEQ ID NO: 2458835 - RNA, 17 nt, Bordetella pertussis
cggcacgcgccaggcgu

SEQ ID NO: 2458836 - RNA, 14 nt, Bordetella pertussis
cggcacgcgcgccg

SEQ ID NO: 2458837 - RNA, 15 nt, Bordetella pertussis
cggcacgcgcgccgg

SEQ ID NO: 2458838 - RNA, 17 nt, Bordetella pertussis
cggcacgcgcgccggca

SEQ ID NO: 2458839 - RNA, 19 nt, Bordetella pertussis
cggcacgcgcgccggcagg

SEQ ID NO: 2458840 - RNA, 12 nt, Bordetella pertussis
cggcacgcgcgg

SEQ ID NO: 2458841 - RNA, 13 nt, Bordetella pertussis
cggcacgcugacc

SEQ ID NO: 2458842 - RNA, 15 nt, Bordetella pertussis
cggcacgcugaucgc

SEQ ID NO: 2458843 - RNA, 22 nt, Bordetella pertussis
cggcacgcugaucgccggcgcc

SEQ ID NO: 2458844 - RNA, 13 nt, Bordetella pertussis
cggcacgcugcgc

SEQ ID NO: 2458845 - RNA, 18 nt, Bordetella pertussis
cggcacgcugcgcaggcg

SEQ ID NO: 2458846 - RNA, 19 nt, Bordetella pertussis
cggcacgcugcgcaggcgc

SEQ ID NO: 2458847 - RNA, 20 nt, Bordetella pertussis
cggcacgcugcgcaggcgcg

SEQ ID NO: 2458848 - RNA, 21 nt, Bordetella pertussis
cggcacgcugcgcaggcgcgc

SEQ ID NO: 2458849 - RNA, 17 nt, Bordetella pertussis
cggcacgcugcugaucc

SEQ ID NO: 2458850 - RNA, 17 nt, Bordetella pertussis
cggcacggagggugcgc

SEQ ID NO: 2458851 - RNA, 12 nt, Bordetella pertussis
cggcacggccag

SEQ ID NO: 2458852 - RNA, 14 nt, Bordetella pertussis
cggcacggccagca

SEQ ID NO: 2458853 - RNA, 16 nt, Bordetella pertussis
cggcacggccagcggc

SEQ ID NO: 2458854 - RNA, 17 nt, Bordetella pertussis
cggcacggccagcggcg

SEQ ID NO: 2458855 - RNA, 18 nt, Bordetella pertussis
cggcacggccagcggcga

SEQ ID NO: 2458856 - RNA, 13 nt, Bordetella pertussis
cggcacggccggc

SEQ ID NO: 2458857 - RNA, 15 nt, Bordetella pertussis
cggcacggccggcca

SEQ ID NO: 2458858 - RNA, 18 nt, Bordetella pertussis
cggcacggccggccaggc

SEQ ID NO: 2458859 - RNA, 15 nt, Bordetella pertussis
cggcacggccggccu

SEQ ID NO: 2458860 - RNA, 19 nt, Bordetella pertussis
cggcacggcggcaaagucg

SEQ ID NO: 2458861 - RNA, 13 nt, Bordetella pertussis
cggcacggcuggg

SEQ ID NO: 2458862 - RNA, 21 nt, Bordetella pertussis
cggcacggcuggguucaggcc

SEQ ID NO: 2458863 - RNA, 18 nt, Bordetella pertussis
cggcacgggucaggcugc

SEQ ID NO: 2458864 - RNA, 19 nt, Bordetella pertussis
cggcacgguggcgaaggcc

SEQ ID NO: 2458865 - RNA, 21 nt, Bordetella pertussis
cggcacgguggcgaaggccgc

SEQ ID NO: 2458866 - RNA, 22 nt, Bordetella pertussis
cggcacgguggcgaaggccgcc

SEQ ID NO: 2458867 - RNA, 17 nt, Bordetella pertussis
cggcacgguuuccaggu

SEQ ID NO: 2458868 - RNA, 16 nt, Bordetella pertussis
cggcacguaccaggcg

SEQ ID NO: 2458869 - RNA, 18 nt, Bordetella pertussis
cggcacguaccaggcgcu

SEQ ID NO: 2458870 - RNA, 22 nt, Bordetella pertussis
cggcacguaccaggcgcugacc

SEQ ID NO: 2458871 - RNA, 23 nt, Bordetella pertussis
cggcacgucauugcaucgcagca

SEQ ID NO: 2458872 - RNA, 13 nt, Bordetella pertussis
cggcacguccggc

SEQ ID NO: 2458873 - RNA, 19 nt, Bordetella pertussis
cggcacguccggcacggcg

SEQ ID NO: 2458874 - RNA, 13 nt, Bordetella pertussis
cggcacgucgggc

SEQ ID NO: 2458875 - RNA, 20 nt, Bordetella pertussis
cggcacgucgguggugacca

SEQ ID NO: 2458876 - RNA, 22 nt, Bordetella pertussis
cggcacgucgguggugaccacg

SEQ ID NO: 2458877 - RNA, 21 nt, Bordetella pertussis
cggcacgugccggauggcgcg

SEQ ID NO: 2458878 - RNA, 22 nt, Bordetella pertussis
cggcacguugucgagcaggccg

SEQ ID NO: 2458879 - RNA, 20 nt, Bordetella pertussis
cggcagacgaucauccaggc

SEQ ID NO: 2458880 - RNA, 19 nt, Bordetella pertussis
cggcagaucggcgcuggcc

SEQ ID NO: 2458881 - RNA, 21 nt, Bordetella pertussis
cggcagaucggcgcuggccug

SEQ ID NO: 2458882 - RNA, 22 nt, Bordetella pertussis
cggcagaucggcgcuggccugg

SEQ ID NO: 2458883 - RNA, 17 nt, Bordetella pertussis
cggcagaucuccggauc

SEQ ID NO: 2458884 - RNA, 18 nt, Bordetella pertussis
cggcagaugaucuacgcg

SEQ ID NO: 2458885 - RNA, 22 nt, Bordetella pertussis
cggcagaugaucuacgcgcgcg

SEQ ID NO: 2458886 - RNA, 23 nt, Bordetella pertussis
cggcagaugaucuacgcgcgcgc

SEQ ID NO: 2458887 - RNA, 21 nt, Bordetella pertussis
cggcagauggugcuccgacgg

SEQ ID NO: 2458888 - RNA, 20 nt, Bordetella pertussis
cggcagcaagcugucggacg

SEQ ID NO: 2458889 - RNA, 18 nt, Bordetella pertussis
cggcagcacgauggcgcc

SEQ ID NO: 2458890 - RNA, 15 nt, Bordetella pertussis
cggcagcagcagcgu

SEQ ID NO: 2458891 - RNA, 23 nt, Bordetella pertussis
cggcagcagcgagaacagccaca

SEQ ID NO: 2458892 - RNA, 19 nt, Bordetella pertussis
cggcagcagcgcgccgggc

SEQ ID NO: 2458893 - RNA, 22 nt, Bordetella pertussis
cggcagcagcgcgccgggcggg

SEQ ID NO: 2458894 - RNA, 13 nt, Bordetella pertussis
cggcagcaggcgc

SEQ ID NO: 2458895 - RNA, 14 nt, Bordetella pertussis
cggcagcagggcca

SEQ ID NO: 2458896 - RNA, 15 nt, Bordetella pertussis
cggcagcagggccac

SEQ ID NO: 2458897 - RNA, 17 nt, Bordetella pertussis
cggcagcagggccacgc

SEQ ID NO: 2458898 - RNA, 19 nt, Bordetella pertussis
cggcagcagggccacgccc

SEQ ID NO: 2458899 - RNA, 22 nt, Bordetella pertussis
cggcagcagggccacgcccagg

SEQ ID NO: 2458900 - RNA, 16 nt, Bordetella pertussis
cggcagcauggcgcgc

SEQ ID NO: 2458901 - RNA, 20 nt, Bordetella pertussis
cggcagcauggcgcgcgggc

SEQ ID NO: 2458902 - RNA, 13 nt, Bordetella pertussis
cggcagccccagc

SEQ ID NO: 2458903 - RNA, 14 nt, Bordetella pertussis
cggcagccccagcg

SEQ ID NO: 2458904 - RNA, 18 nt, Bordetella pertussis
cggcagccccagcgccca

SEQ ID NO: 2458905 - RNA, 19 nt, Bordetella pertussis
cggcagccccagcgcccag

SEQ ID NO: 2458906 - RNA, 23 nt, Bordetella pertussis
cggcagccccgggugcagguccg

SEQ ID NO: 2458907 - RNA, 15 nt, Bordetella pertussis
cggcagcccggcacg

SEQ ID NO: 2458908 - RNA, 19 nt, Bordetella pertussis
cggcagcccggcacgucgg

SEQ ID NO: 2458909 - RNA, 22 nt, Bordetella pertussis
cggcagccggccauggccgcca

SEQ ID NO: 2458910 - RNA, 14 nt, Bordetella pertussis
cggcagccuggggc

SEQ ID NO: 2458911 - RNA, 21 nt, Bordetella pertussis
cggcagcgacuucuaccugga

SEQ ID NO: 2458912 - RNA, 23 nt, Bordetella pertussis
cggcagcgacuucuaccuggacg

SEQ ID NO: 2458913 - RNA, 17 nt, Bordetella pertussis
cggcagcgaggcgcagc

SEQ ID NO: 2458914 - RNA, 21 nt, Bordetella pertussis
cggcagcgcaaaacgcaugac

SEQ ID NO: 2458915 - RNA, 22 nt, Bordetella pertussis
cggcagcgcaaaacgcaugacc

SEQ ID NO: 2458916 - RNA, 15 nt, Bordetella pertussis
cggcagcgcaccguc

SEQ ID NO: 2458917 - RNA, 19 nt, Bordetella pertussis
cggcagcgcaccgucgcca

SEQ ID NO: 2458918 - RNA, 21 nt, Bordetella pertussis
cggcagcgcaccgucgccagg

SEQ ID NO: 2458919 - RNA, 15 nt, Bordetella pertussis
cggcagcgccggguc

SEQ ID NO: 2458920 - RNA, 19 nt, Bordetella pertussis
cggcagcgccgggucaucg

SEQ ID NO: 2458921 - RNA, 17 nt, Bordetella pertussis
cggcagcgcgaacggcg

SEQ ID NO: 2458922 - RNA, 13 nt, Bordetella pertussis
cggcagcgcgacc

SEQ ID NO: 2458923 - RNA, 14 nt, Bordetella pertussis
cggcagcgcgaccg

SEQ ID NO: 2458924 - RNA, 16 nt, Bordetella pertussis
cggcagcgcgaccggc

SEQ ID NO: 2458925 - RNA, 18 nt, Bordetella pertussis
cggcagcgcgcaggacaa

SEQ ID NO: 2458926 - RNA, 13 nt, Bordetella pertussis
cggcagcgcgcgc

SEQ ID NO: 2458927 - RNA, 17 nt, Bordetella pertussis
cggcagcggccagcgcg

SEQ ID NO: 2458928 - RNA, 18 nt, Bordetella pertussis
cggcagcggccagcgcgg

SEQ ID NO: 2458929 - RNA, 19 nt, Bordetella pertussis
cggcagcggccagcgcggc

SEQ ID NO: 2458930 - RNA, 14 nt, Bordetella pertussis
cggcagcggcgcca

SEQ ID NO: 2458931 - RNA, 16 nt, Bordetella pertussis
cggcagcguaucgccc

SEQ ID NO: 2458932 - RNA, 18 nt, Bordetella pertussis
cggcagcguaucgcccgc

SEQ ID NO: 2458933 - RNA, 20 nt, Bordetella pertussis
cggcagcguaucgcccgcgc

SEQ ID NO: 2458934 - RNA, 22 nt, Bordetella pertussis
cggcagcguaucgcccgcgcgg

SEQ ID NO: 2458935 - RNA, 23 nt, Bordetella pertussis
cggcagcgucaauccgccgccag

SEQ ID NO: 2458936 - RNA, 15 nt, Bordetella pertussis
cggcagcucgcgcug

SEQ ID NO: 2458937 - RNA, 20 nt, Bordetella pertussis
cggcagcucgcgcugcgcgc

SEQ ID NO: 2458938 - RNA, 22 nt, Bordetella pertussis
cggcagcucgcgcugcgcgccg

SEQ ID NO: 2458939 - RNA, 21 nt, Bordetella pertussis
cggcagcucggcgaagccgca

SEQ ID NO: 2458940 - RNA, 12 nt, Bordetella pertussis
cggcagcugacg

SEQ ID NO: 2458941 - RNA, 12 nt, Bordetella pertussis
cggcagcuugac

SEQ ID NO: 2458942 - RNA, 17 nt, Bordetella pertussis
cggcagcuugaccgccu

SEQ ID NO: 2458943 - RNA, 23 nt, Bordetella pertussis
cggcagcuuguagcgcucuucgc

SEQ ID NO: 2458944 - RNA, 23 nt, Bordetella pertussis
cggcagcuugucgaucgccacca

SEQ ID NO: 2458945 - RNA, 22 nt, Bordetella pertussis
cggcaggacggggaacaggcgc

SEQ ID NO: 2458946 - RNA, 19 nt, Bordetella pertussis
cggcaggagccuguccccg

SEQ ID NO: 2458947 - RNA, 14 nt, Bordetella pertussis
cggcaggcacacga

SEQ ID NO: 2458948 - RNA, 17 nt, Bordetella pertussis
cggcaggcacacgaccg

SEQ ID NO: 2458949 - RNA, 14 nt, Bordetella pertussis
cggcaggccccggc

SEQ ID NO: 2458950 - RNA, 22 nt, Bordetella pertussis
cggcaggccccggcccggcggg

SEQ ID NO: 2458951 - RNA, 15 nt, Bordetella pertussis
cggcaggccgcgcca

SEQ ID NO: 2458952 - RNA, 16 nt, Bordetella pertussis
cggcaggccggccagc

SEQ ID NO: 2458953 - RNA, 18 nt, Bordetella pertussis
cggcaggccggccagcaa

SEQ ID NO: 2458954 - RNA, 14 nt, Bordetella pertussis
cggcaggccggcgc

SEQ ID NO: 2458955 - RNA, 15 nt, Bordetella pertussis
cggcaggccggcgcg

SEQ ID NO: 2458956 - RNA, 18 nt, Bordetella pertussis
cggcaggccggcgcgcgc

SEQ ID NO: 2458957 - RNA, 14 nt, Bordetella pertussis
cggcaggcgccgcc

SEQ ID NO: 2458958 - RNA, 16 nt, Bordetella pertussis
cggcaggcgccugccc

SEQ ID NO: 2458959 - RNA, 20 nt, Bordetella pertussis
cggcaggcgcgagguggcgc

SEQ ID NO: 2458960 - RNA, 16 nt, Bordetella pertussis
cggcaggcgcgccagc

SEQ ID NO: 2458961 - RNA, 17 nt, Bordetella pertussis
cggcaggcgcgccagcc

SEQ ID NO: 2458962 - RNA, 14 nt, Bordetella pertussis
cggcaggcggcaga

SEQ ID NO: 2458963 - RNA, 22 nt, Bordetella pertussis
cggcaggcggugcggaggcggc

SEQ ID NO: 2458964 - RNA, 14 nt, Bordetella pertussis
cggcaggcuggccg

SEQ ID NO: 2458965 - RNA, 18 nt, Bordetella pertussis
cggcaggcuggccggcgu

SEQ ID NO: 2458966 - RNA, 13 nt, Bordetella pertussis
cggcagggccagc

SEQ ID NO: 2458967 - RNA, 14 nt, Bordetella pertussis
cggcagggccagcg

SEQ ID NO: 2458968 - RNA, 15 nt, Bordetella pertussis
cggcagggccagcgc

SEQ ID NO: 2458969 - RNA, 16 nt, Bordetella pertussis
cggcagggccagcgcc

SEQ ID NO: 2458970 - RNA, 20 nt, Bordetella pertussis
cggcagggccagcgccagca

SEQ ID NO: 2458971 - RNA, 22 nt, Bordetella pertussis
cggcagggccagcgccagcacg

SEQ ID NO: 2458972 - RNA, 23 nt, Bordetella pertussis
cggcagggccagcgccagcacga

SEQ ID NO: 2458973 - RNA, 14 nt, Bordetella pertussis
cggcagggcggcca

SEQ ID NO: 2458974 - RNA, 16 nt, Bordetella pertussis
cggcagggcggccagg

SEQ ID NO: 2458975 - RNA, 17 nt, Bordetella pertussis
cggcagggcggccaggc

SEQ ID NO: 2458976 - RNA, 17 nt, Bordetella pertussis
cggcagggcgucggccg

SEQ ID NO: 2458977 - RNA, 17 nt, Bordetella pertussis
cggcaggggcucgcgcc

SEQ ID NO: 2458978 - RNA, 18 nt, Bordetella pertussis
cggcaggggcucgcgccc

SEQ ID NO: 2458979 - RNA, 22 nt, Bordetella pertussis
cggcaggggcucgcgcccgagc

SEQ ID NO: 2458980 - RNA, 23 nt, Bordetella pertussis
cggcaggggcucgcgcccgagcg

SEQ ID NO: 2458981 - RNA, 17 nt, Bordetella pertussis
cggcagggucucggcca

SEQ ID NO: 2458982 - RNA, 16 nt, Bordetella pertussis
cggcagggugacgggc

SEQ ID NO: 2458983 - RNA, 20 nt, Bordetella pertussis
cggcagggugacgggcuggg

SEQ ID NO: 2458984 - RNA, 22 nt, Bordetella pertussis
cggcagggugacgggcugggcc

SEQ ID NO: 2458985 - RNA, 15 nt, Bordetella pertussis
cggcagggugcccag

SEQ ID NO: 2458986 - RNA, 15 nt, Bordetella pertussis
cggcaggucgaugcc

SEQ ID NO: 2458987 - RNA, 17 nt, Bordetella pertussis
cggcaggucgaugcccu

SEQ ID NO: 2458988 - RNA, 14 nt, Bordetella pertussis
cggcaggucgcgcg

SEQ ID NO: 2458989 - RNA, 14 nt, Bordetella pertussis
cggcaggugcacgc

SEQ ID NO: 2458990 - RNA, 13 nt, Bordetella pertussis
cggcaggugcgcc

SEQ ID NO: 2458991 - RNA, 22 nt, Bordetella pertussis
cggcaggugcgccagcacggca

SEQ ID NO: 2458992 - RNA, 19 nt, Bordetella pertussis
cggcagugggcggugacca

SEQ ID NO: 2458993 - RNA, 21 nt, Bordetella pertussis
cggcagugucaggaugcccug

SEQ ID NO: 2458994 - RNA, 16 nt, Bordetella pertussis
cggcauagcccaggcc

SEQ ID NO: 2458995 - RNA, 20 nt, Bordetella pertussis
cggcauagcccaggccgccg

SEQ ID NO: 2458996 - RNA, 21 nt, Bordetella pertussis
cggcauagcccaggccgccgg

SEQ ID NO: 2458997 - RNA, 18 nt, Bordetella pertussis
cggcauaggcggcgcagg

SEQ ID NO: 2458998 - RNA, 21 nt, Bordetella pertussis
cggcauaggcggcgcaggcca

SEQ ID NO: 2458999 - RNA, 20 nt, Bordetella pertussis
cggcaucaguucaggcuggc

SEQ ID NO: 2459000 - RNA, 20 nt, Bordetella pertussis
cggcauccagcucggcgaug

SEQ ID NO: 2459001 - RNA, 21 nt, Bordetella pertussis
cggcaucccgacaugccgccc

SEQ ID NO: 2459002 - RNA, 22 nt, Bordetella pertussis
cggcaucccgacaugccgcccc

SEQ ID NO: 2459003 - RNA, 21 nt, Bordetella pertussis
cggcaucccugcuugcgcgga

SEQ ID NO: 2459004 - RNA, 20 nt, Bordetella pertussis
cggcaucgacaugcccgccg

SEQ ID NO: 2459005 - RNA, 22 nt, Bordetella pertussis
cggcaucgagaaaccagccgcc

SEQ ID NO: 2459006 - RNA, 18 nt, Bordetella pertussis
cggcaucgauuucucgcu

SEQ ID NO: 2459007 - RNA, 14 nt, Bordetella pertussis
cggcaucgccgcgg

SEQ ID NO: 2459008 - RNA, 14 nt, Bordetella pertussis
cggcaucgcgcuga

SEQ ID NO: 2459009 - RNA, 15 nt, Bordetella pertussis
cggcaucgcgcugac

SEQ ID NO: 2459010 - RNA, 14 nt, Bordetella pertussis
cggcaucggccacg

SEQ ID NO: 2459011 - RNA, 18 nt, Bordetella pertussis
cggcaucggccacgcugc

SEQ ID NO: 2459012 - RNA, 13 nt, Bordetella pertussis
cggcaucggccag

SEQ ID NO: 2459013 - RNA, 13 nt, Bordetella pertussis
cggcaucggcgcc

SEQ ID NO: 2459014 - RNA, 14 nt, Bordetella pertussis
cggcaucggcgccg

SEQ ID NO: 2459015 - RNA, 20 nt, Bordetella pertussis
cggcaucggcgccgcgcgcu

SEQ ID NO: 2459016 - RNA, 14 nt, Bordetella pertussis
cggcaucggcggcu

SEQ ID NO: 2459017 - RNA, 22 nt, Bordetella pertussis
cggcaucggcggcuugcggucc

SEQ ID NO: 2459018 - RNA, 15 nt, Bordetella pertussis
cggcaucucgcggcg

SEQ ID NO: 2459019 - RNA, 17 nt, Bordetella pertussis
cggcaucuguccgcgcc

SEQ ID NO: 2459020 - RNA, 15 nt, Bordetella pertussis
cggcaugaagcgcag

SEQ ID NO: 2459021 - RNA, 17 nt, Bordetella pertussis
cggcaugaccgcggacg

SEQ ID NO: 2459022 - RNA, 19 nt, Bordetella pertussis
cggcaugaccgcggacgcc

SEQ ID NO: 2459023 - RNA, 15 nt, Bordetella pertussis
cggcaugauggcccg

SEQ ID NO: 2459024 - RNA, 16 nt, Bordetella pertussis
cggcaugccguccacg

SEQ ID NO: 2459025 - RNA, 20 nt, Bordetella pertussis
cggcaugccguccacgccca

SEQ ID NO: 2459026 - RNA, 22 nt, Bordetella pertussis
cggcaugccguccacgcccagc

SEQ ID NO: 2459027 - RNA, 14 nt, Bordetella pertussis
cggcaugcgcaugc

SEQ ID NO: 2459028 - RNA, 18 nt, Bordetella pertussis
cggcaugcgccagccagc

SEQ ID NO: 2459029 - RNA, 17 nt, Bordetella pertussis
cggcaugcgccggcccg

SEQ ID NO: 2459030 - RNA, 18 nt, Bordetella pertussis
cggcaugcgccggcccgg

SEQ ID NO: 2459031 - RNA, 20 nt, Bordetella pertussis
cggcauggccaaugccauug

SEQ ID NO: 2459032 - RNA, 14 nt, Bordetella pertussis
cggcauggccagcu

SEQ ID NO: 2459033 - RNA, 15 nt, Bordetella pertussis
cggcauggccagcuu

SEQ ID NO: 2459034 - RNA, 18 nt, Bordetella pertussis
cggcauggccagcuucgg

SEQ ID NO: 2459035 - RNA, 14 nt, Bordetella pertussis
cggcauggccagga

SEQ ID NO: 2459036 - RNA, 16 nt, Bordetella pertussis
cggcauggccaucgcg

SEQ ID NO: 2459037 - RNA, 12 nt, Bordetella pertussis
cggcauggccgg

SEQ ID NO: 2459038 - RNA, 14 nt, Bordetella pertussis
cggcauggccggca

SEQ ID NO: 2459039 - RNA, 22 nt, Bordetella pertussis
cggcauggcgaucgaacgcggc

SEQ ID NO: 2459040 - RNA, 23 nt, Bordetella pertussis
cggcauggcgaucgaacgcggcc

SEQ ID NO: 2459041 - RNA, 15 nt, Bordetella pertussis
cggcauggcgccgcg

SEQ ID NO: 2459042 - RNA, 18 nt, Bordetella pertussis
cggcauggcgccgcgccg

SEQ ID NO: 2459043 - RNA, 20 nt, Bordetella pertussis
cggcauggcgccgcgccgcc

SEQ ID NO: 2459044 - RNA, 15 nt, Bordetella pertussis
cggcauggcgcgcgc

SEQ ID NO: 2459045 - RNA, 15 nt, Bordetella pertussis
cggcauggcggccag

SEQ ID NO: 2459046 - RNA, 17 nt, Bordetella pertussis
cggcaugggcgugccgc

SEQ ID NO: 2459047 - RNA, 19 nt, Bordetella pertussis
cggcaugggcgugccgcgc

SEQ ID NO: 2459048 - RNA, 14 nt, Bordetella pertussis
cggcauggucgaug

SEQ ID NO: 2459049 - RNA, 14 nt, Bordetella pertussis
cggcauggucggca

SEQ ID NO: 2459050 - RNA, 20 nt, Bordetella pertussis
cggcaugguguaccgggccg

SEQ ID NO: 2459051 - RNA, 21 nt, Bordetella pertussis
cggcaugguguaccgggccga

SEQ ID NO: 2459052 - RNA, 16 nt, Bordetella pertussis
cggcauggugugccug

SEQ ID NO: 2459053 - RNA, 15 nt, Bordetella pertussis
cggcaugucgaugcc

SEQ ID NO: 2459054 - RNA, 15 nt, Bordetella pertussis
cggcauugcccaggu

SEQ ID NO: 2459055 - RNA, 20 nt, Bordetella pertussis
cggcauugccgccacgggcc

SEQ ID NO: 2459056 - RNA, 22 nt, Bordetella pertussis
cggcauuucgcauaccggccgc

SEQ ID NO: 2459057 - RNA, 16 nt, Bordetella pertussis
cggcauuucgcugggc

SEQ ID NO: 2459058 - RNA, 22 nt, Bordetella pertussis
cggcauuucgcugggcgcgcac

SEQ ID NO: 2459059 - RNA, 21 nt, Bordetella pertussis
cggccaacagcucgcgccagg

SEQ ID NO: 2459060 - RNA, 22 nt, Bordetella pertussis
cggccaacagcucgcgccaggg

SEQ ID NO: 2459061 - RNA, 24 nt, Bordetella pertussis
cggccaacagcucgcgccagggcc

SEQ ID NO: 2459062 - RNA, 17 nt, Bordetella pertussis
cggccaaccccgagggc

SEQ ID NO: 2459063 - RNA, 19 nt, Bordetella pertussis
cggccaaccccgagggcgc

SEQ ID NO: 2459064 - RNA, 16 nt, Bordetella pertussis
cggccaacggcuggcu

SEQ ID NO: 2459065 - RNA, 15 nt, Bordetella pertussis
cggccaagacgcggg

SEQ ID NO: 2459066 - RNA, 21 nt, Bordetella pertussis
cggccaagacgcggggacagg

SEQ ID NO: 2459067 - RNA, 22 nt, Bordetella pertussis
cggccaagacgcggggacaggc

SEQ ID NO: 2459068 - RNA, 16 nt, Bordetella pertussis
cggccaagcagcgccu

SEQ ID NO: 2459069 - RNA, 14 nt, Bordetella pertussis
cggccaagcuccag

SEQ ID NO: 2459070 - RNA, 16 nt, Bordetella pertussis
cggccaagcuccagga

SEQ ID NO: 2459071 - RNA, 14 nt, Bordetella pertussis
cggccaaggcaagc

SEQ ID NO: 2459072 - RNA, 22 nt, Bordetella pertussis
cgcugaaggaccucgcgccggu

SEQ ID NO: 2459073 - RNA, 21 nt, Bordetella pertussis
cgcugaauccggggugccugu

SEQ ID NO: 2459074 - RNA, 13 nt, Bordetella pertussis
cgcugaccagcac

SEQ ID NO: 2459075 - RNA, 18 nt, Bordetella pertussis
cgcugaccagcacgaugg

SEQ ID NO: 2459076 - RNA, 17 nt, Bordetella pertussis
cgcugacccuggccgaa

SEQ ID NO: 2459077 - RNA, 19 nt, Bordetella pertussis
cgcugacccuggccgaacg

SEQ ID NO: 2459078 - RNA, 23 nt, Bordetella pertussis
cgcugacccuggccgaacgccgc

SEQ ID NO: 2459079 - RNA, 20 nt, Bordetella pertussis
cgcugaccgagggcgcgucc

SEQ ID NO: 2459080 - RNA, 16 nt, Bordetella pertussis
cgcugaccggccuggu

SEQ ID NO: 2459081 - RNA, 12 nt, Bordetella pertussis
cgcugaccggcg

SEQ ID NO: 2459082 - RNA, 17 nt, Bordetella pertussis
cgcugaccggcggcacg

SEQ ID NO: 2459083 - RNA, 22 nt, Bordetella pertussis
cgcugaccggcguauggcccgc

SEQ ID NO: 2459084 - RNA, 23 nt, Bordetella pertussis
cgcugaccugcacgauggcgccg

SEQ ID NO: 2459085 - RNA, 17 nt, Bordetella pertussis
cgcugaccuggugugcc

SEQ ID NO: 2459086 - RNA, 14 nt, Bordetella pertussis
cgcugacgccgaug

SEQ ID NO: 2459087 - RNA, 20 nt, Bordetella pertussis
cgcugacugcggugccuguc

SEQ ID NO: 2459088 - RNA, 23 nt, Bordetella pertussis
cgcugaucaccaaacaccaggaa

SEQ ID NO: 2459089 - RNA, 21 nt, Bordetella pertussis
cgcugaucagguccaugaacg

SEQ ID NO: 2459090 - RNA, 23 nt, Bordetella pertussis
cgcugaucagguccaugaacgcc

SEQ ID NO: 2459091 - RNA, 15 nt, Bordetella pertussis
cgcugauccuggcuc

SEQ ID NO: 2459092 - RNA, 16 nt, Bordetella pertussis
cgcugaucggccgacu

SEQ ID NO: 2459093 - RNA, 17 nt, Bordetella pertussis
cgcugaucucggccugc

SEQ ID NO: 2459094 - RNA, 19 nt, Bordetella pertussis
cgcugaucucggccugccc

SEQ ID NO: 2459095 - RNA, 18 nt, Bordetella pertussis
cgcugaucuuccugggcg

SEQ ID NO: 2459096 - RNA, 18 nt, Bordetella pertussis
cgcugaugagaucgcccg

SEQ ID NO: 2459097 - RNA, 20 nt, Bordetella pertussis
cgcugaugagaucgcccgcg

SEQ ID NO: 2459098 - RNA, 15 nt, Bordetella pertussis
cgcugaugcgcggcg

SEQ ID NO: 2459099 - RNA, 18 nt, Bordetella pertussis
cgcugaugcgcggcgggc

SEQ ID NO: 2459100 - RNA, 15 nt, Bordetella pertussis
cgcugauggccgcca

SEQ ID NO: 2459101 - RNA, 19 nt, Bordetella pertussis
cgcugauguggcugagauc

SEQ ID NO: 2459102 - RNA, 23 nt, Bordetella pertussis
cgcugauucgcgucguugcgccg

SEQ ID NO: 2459103 - RNA, 17 nt, Bordetella pertussis
cgcugcaauugcgcggc

SEQ ID NO: 2459104 - RNA, 19 nt, Bordetella pertussis
cgcugcaauugcgcggcca

SEQ ID NO: 2459105 - RNA, 21 nt, Bordetella pertussis
cgcugcaauugcgcggccaug

SEQ ID NO: 2459106 - RNA, 24 nt, Bordetella pertussis
cgcugcaauugcgcggccaugccg

SEQ ID NO: 2459107 - RNA, 13 nt, Bordetella pertussis
cgcugcacaggga

SEQ ID NO: 2459108 - RNA, 21 nt, Bordetella pertussis
cgcugcacagggaccaccccg

SEQ ID NO: 2459109 - RNA, 12 nt, Bordetella pertussis
cgcugcacgcgg

SEQ ID NO: 2459110 - RNA, 15 nt, Bordetella pertussis
cgcugcacgcggccg

SEQ ID NO: 2459111 - RNA, 18 nt, Bordetella pertussis
cgcugcacgcggccgcgc

SEQ ID NO: 2459112 - RNA, 22 nt, Bordetella pertussis
cgcugcacgcggccgcgcagga

SEQ ID NO: 2459113 - RNA, 16 nt, Bordetella pertussis
cgcugcagcaauccau

SEQ ID NO: 2459114 - RNA, 17 nt, Bordetella pertussis
cgcugcagcaauccauc

SEQ ID NO: 2459115 - RNA, 14 nt, Bordetella pertussis
cgcugcagcacgca

SEQ ID NO: 2459116 - RNA, 20 nt, Bordetella pertussis
cgcugcagcacgcaccaggc

SEQ ID NO: 2459117 - RNA, 20 nt, Bordetella pertussis
cgcugcagccauucggccac

SEQ ID NO: 2459118 - RNA, 19 nt, Bordetella pertussis
cgcugcaggaucgcggcca

SEQ ID NO: 2459119 - RNA, 20 nt, Bordetella pertussis
cgcugcaggaucgcggccag

SEQ ID NO: 2459120 - RNA, 22 nt, Bordetella pertussis
cgcugcaggaucgcggccagcg

SEQ ID NO: 2459121 - RNA, 13 nt, Bordetella pertussis
cgcugcaggcccu

SEQ ID NO: 2459122 - RNA, 15 nt, Bordetella pertussis
cgcugcaugggcggc

SEQ ID NO: 2459123 - RNA, 18 nt, Bordetella pertussis
cgcugcaugggcggcccg

SEQ ID NO: 2459124 - RNA, 18 nt, Bordetella pertussis
cgcugccagccauguucg

SEQ ID NO: 2459125 - RNA, 14 nt, Bordetella pertussis
cgcugccagggugc

SEQ ID NO: 2459126 - RNA, 23 nt, Bordetella pertussis
cgcugccagggugcaccaggugg

SEQ ID NO: 2459127 - RNA, 21 nt, Bordetella pertussis
cgcugccaguuguaguggugu

SEQ ID NO: 2459128 - RNA, 20 nt, Bordetella pertussis
cgcugcccaccgccguggcc

SEQ ID NO: 2459129 - RNA, 15 nt, Bordetella pertussis
cgcugcccaccuucc

SEQ ID NO: 2459130 - RNA, 19 nt, Bordetella pertussis
cgcugcccaccuuccugcu

SEQ ID NO: 2459131 - RNA, 12 nt, Bordetella pertussis
cgcugcccagcc

SEQ ID NO: 2459132 - RNA, 13 nt, Bordetella pertussis
cgcugcccagcca

SEQ ID NO: 2459133 - RNA, 14 nt, Bordetella pertussis
cgcugcccagccac

SEQ ID NO: 2459134 - RNA, 15 nt, Bordetella pertussis
cgcugcccaggaugg

SEQ ID NO: 2459135 - RNA, 20 nt, Bordetella pertussis
cgcugcccgucgcuggcgcg

SEQ ID NO: 2459136 - RNA, 14 nt, Bordetella pertussis
cgcugcccugcugc

SEQ ID NO: 2459137 - RNA, 16 nt, Bordetella pertussis
cgcugcccugcugcug

SEQ ID NO: 2459138 - RNA, 14 nt, Bordetella pertussis
cgcugccgaccagc

SEQ ID NO: 2459139 - RNA, 19 nt, Bordetella pertussis
cgcugccgagacggccgcc

SEQ ID NO: 2459140 - RNA, 20 nt, Bordetella pertussis
cgcugccgagacggccgccg

SEQ ID NO: 2459141 - RNA, 21 nt, Bordetella pertussis
cgcugccgagacggccgccga

SEQ ID NO: 2459142 - RNA, 21 nt, Bordetella pertussis
cgcugccgcgcgccggcgccg

SEQ ID NO: 2459143 - RNA, 13 nt, Bordetella pertussis
cgcugccgcugca

SEQ ID NO: 2459144 - RNA, 14 nt, Bordetella pertussis
cgcugccgcugcag

SEQ ID NO: 2459145 - RNA, 18 nt, Bordetella pertussis
cgcugccgcugcaggccc

SEQ ID NO: 2459146 - RNA, 14 nt, Bordetella pertussis
cgcugccggccgac

SEQ ID NO: 2459147 - RNA, 18 nt, Bordetella pertussis
cgcugccggccgaccggc

SEQ ID NO: 2459148 - RNA, 15 nt, Bordetella pertussis
cgcugccggcgcccu

SEQ ID NO: 2459149 - RNA, 17 nt, Bordetella pertussis
cgcugccggcgcccuug

SEQ ID NO: 2459150 - RNA, 20 nt, Bordetella pertussis
cgcugccggcguccugcggc

SEQ ID NO: 2459151 - RNA, 16 nt, Bordetella pertussis
cgcugccgggcucggc

SEQ ID NO: 2459152 - RNA, 14 nt, Bordetella pertussis
cgcugccggggucc

SEQ ID NO: 2459153 - RNA, 17 nt, Bordetella pertussis
cgcugccuucggguugc

SEQ ID NO: 2459154 - RNA, 18 nt, Bordetella pertussis
cgcugcgaaaaagcccgc

SEQ ID NO: 2459155 - RNA, 23 nt, Bordetella pertussis
cgcugcgaaaaagcccgcgccac

SEQ ID NO: 2459156 - RNA, 18 nt, Bordetella pertussis
cgcugcgacagcagcaug

SEQ ID NO: 2459157 - RNA, 19 nt, Bordetella pertussis
cgcugcgacagcagcaugc

SEQ ID NO: 2459158 - RNA, 12 nt, Bordetella pertussis
cgcugcgcacgc

SEQ ID NO: 2459159 - RNA, 14 nt, Bordetella pertussis
cgcugcgcacgcug

SEQ ID NO: 2459160 - RNA, 13 nt, Bordetella pertussis
cgcugcgcagcag

SEQ ID NO: 2459161 - RNA, 15 nt, Bordetella pertussis
cgcugcgcagcagcg

SEQ ID NO: 2459162 - RNA, 16 nt, Bordetella pertussis
cgcugcgcagcagcgc

SEQ ID NO: 2459163 - RNA, 17 nt, Bordetella pertussis
cgcugcgcagcagggcg

SEQ ID NO: 2459164 - RNA, 21 nt, Bordetella pertussis
cgcugcgcaggcgcgcggggg

SEQ ID NO: 2459165 - RNA, 16 nt, Bordetella pertussis
cgcugcgccgaggccu

SEQ ID NO: 2459166 - RNA, 14 nt, Bordetella pertussis
cgcugcgccggcgg

SEQ ID NO: 2459167 - RNA, 19 nt, Bordetella pertussis
cgcugcgccggcggcaccg

SEQ ID NO: 2459168 - RNA, 20 nt, Bordetella pertussis
cgcugcgccggcggcaccgc

SEQ ID NO: 2459169 - RNA, 15 nt, Bordetella pertussis
cgcugcgccuuggcg

SEQ ID NO: 2459170 - RNA, 18 nt, Bordetella pertussis
cgcugcgccuuggcgcgc

SEQ ID NO: 2459171 - RNA, 21 nt, Bordetella pertussis
cgcugcgcgaaacggccgggu

SEQ ID NO: 2459172 - RNA, 19 nt, Bordetella pertussis
cgcugcgcgaacgcggcca

SEQ ID NO: 2459173 - RNA, 17 nt, Bordetella pertussis
cgcugcgcgaugcgcgc

SEQ ID NO: 2459174 - RNA, 13 nt, Bordetella pertussis
cgcugcgcgccgc

SEQ ID NO: 2459175 - RNA, 14 nt, Bordetella pertussis
cgcugcgcgcggcc

SEQ ID NO: 2459176 - RNA, 14 nt, Bordetella pertussis
cgcugcgcggcggc

SEQ ID NO: 2459177 - RNA, 13 nt, Bordetella pertussis
cgcugcggcaagg

SEQ ID NO: 2459178 - RNA, 15 nt, Bordetella pertussis
cgcugcgggcggccu

SEQ ID NO: 2459179 - RNA, 18 nt, Bordetella pertussis
cgcugcgggcggccuggg

SEQ ID NO: 2459180 - RNA, 17 nt, Bordetella pertussis
cgcugcggucgcgaucg

SEQ ID NO: 2459181 - RNA, 20 nt, Bordetella pertussis
cgcugcggucgcgaucgucg

SEQ ID NO: 2459182 - RNA, 14 nt, Bordetella pertussis
cgcugcguccacca

SEQ ID NO: 2459183 - RNA, 18 nt, Bordetella pertussis
cgcugcguccaccaccag

SEQ ID NO: 2459184 - RNA, 16 nt, Bordetella pertussis
cgcugcguccggucga

SEQ ID NO: 2459185 - RNA, 19 nt, Bordetella pertussis
cgcugcucgaaacgcugga

SEQ ID NO: 2459186 - RNA, 18 nt, Bordetella pertussis
cgcugcucgacagcagcc

SEQ ID NO: 2459187 - RNA, 16 nt, Bordetella pertussis
cgcgugcgcggccgcg

SEQ ID NO: 2459188 - RNA, 19 nt, Bordetella pertussis
cgcgugcggaugcagcagc

SEQ ID NO: 2459189 - RNA, 21 nt, Bordetella pertussis
cgcgugcggggcggcaggucg

SEQ ID NO: 2459190 - RNA, 19 nt, Bordetella pertussis
cgcgugcucaucggcaggc

SEQ ID NO: 2459191 - RNA, 22 nt, Bordetella pertussis
cgcgugcucaucggcaggccgg

SEQ ID NO: 2459192 - RNA, 15 nt, Bordetella pertussis
cgcgugcuggcgcag

SEQ ID NO: 2459193 - RNA, 20 nt, Bordetella pertussis
cgcgugcuggcgcagcagcg

SEQ ID NO: 2459194 - RNA, 24 nt, Bordetella pertussis
cgcgugcuggcgcagcagcgccgg

SEQ ID NO: 2459195 - RNA, 14 nt, Bordetella pertussis
cgcgugcugggcca

SEQ ID NO: 2459196 - RNA, 16 nt, Bordetella pertussis
cgcguggaaccgccgc

SEQ ID NO: 2459197 - RNA, 19 nt, Bordetella pertussis
cgcguggaaccgccgcuuu

SEQ ID NO: 2459198 - RNA, 23 nt, Bordetella pertussis
cgcguggaagguccacggcaugg

SEQ ID NO: 2459199 - RNA, 12 nt, Bordetella pertussis
cgcguggccacg

SEQ ID NO: 2459200 - RNA, 18 nt, Bordetella pertussis
cgcguggccacggcgucg

SEQ ID NO: 2459201 - RNA, 19 nt, Bordetella pertussis
cgcguggccacggcgucga

SEQ ID NO: 2459202 - RNA, 12 nt, Bordetella pertussis
cgcguggccagc

SEQ ID NO: 2459203 - RNA, 20 nt, Bordetella pertussis
cgcguggccagcacggcgca

SEQ ID NO: 2459204 - RNA, 13 nt, Bordetella pertussis
cgcguggccgcca

SEQ ID NO: 2459205 - RNA, 13 nt, Bordetella pertussis
cgcguggccgcgc

SEQ ID NO: 2459206 - RNA, 17 nt, Bordetella pertussis
cgcguggccgcgcugcu

SEQ ID NO: 2459207 - RNA, 14 nt, Bordetella pertussis
cgcguggccggcga

SEQ ID NO: 2459208 - RNA, 15 nt, Bordetella pertussis
cgcguggccggcgac

SEQ ID NO: 2459209 - RNA, 21 nt, Bordetella pertussis
cgcguggccggcgacggcauc

SEQ ID NO: 2459210 - RNA, 17 nt, Bordetella pertussis
cgcguggcgcgccagcg

SEQ ID NO: 2459211 - RNA, 20 nt, Bordetella pertussis
cgcguggcgcgccagcgcca

SEQ ID NO: 2459212 - RNA, 21 nt, Bordetella pertussis
cgcguggcgcgccagcgccac

SEQ ID NO: 2459213 - RNA, 19 nt, Bordetella pertussis
cgcguggcgcugcguccgg

SEQ ID NO: 2459214 - RNA, 15 nt, Bordetella pertussis
cgcguggcggcgcag

SEQ ID NO: 2459215 - RNA, 17 nt, Bordetella pertussis
cgcguggcggcgcagcg

SEQ ID NO: 2459216 - RNA, 23 nt, Bordetella pertussis
cgcgugggcaggugcuuggcggu

SEQ ID NO: 2459217 - RNA, 16 nt, Bordetella pertussis
cgcgugggcauggugg

SEQ ID NO: 2459218 - RNA, 13 nt, Bordetella pertussis
cgcgugggccagu

SEQ ID NO: 2459219 - RNA, 17 nt, Bordetella pertussis
cgcgugucaugcugucg

SEQ ID NO: 2459220 - RNA, 17 nt, Bordetella pertussis
cgcgugucccagccggc

SEQ ID NO: 2459221 - RNA, 20 nt, Bordetella pertussis
cgcgugucccagccggcggc

SEQ ID NO: 2459222 - RNA, 21 nt, Bordetella pertussis
cgcgugucccagccggcggca

SEQ ID NO: 2459223 - RNA, 15 nt, Bordetella pertussis
cgcguucacgccggc

SEQ ID NO: 2459224 - RNA, 16 nt, Bordetella pertussis
cgcguucagcagcagg

SEQ ID NO: 2459225 - RNA, 19 nt, Bordetella pertussis
cgcguucagcagcaggccc

SEQ ID NO: 2459226 - RNA, 17 nt, Bordetella pertussis
cgcguucaggcgcggcu

SEQ ID NO: 2459227 - RNA, 22 nt, Bordetella pertussis
cgcguucagggcgccgcggcgg

SEQ ID NO: 2459228 - RNA, 20 nt, Bordetella pertussis
cgcguucaggucgccguucu

SEQ ID NO: 2459229 - RNA, 13 nt, Bordetella pertussis
cgcguuccaugcg

SEQ ID NO: 2459230 - RNA, 13 nt, Bordetella pertussis
cgcguuccggccg

SEQ ID NO: 2459231 - RNA, 19 nt, Bordetella pertussis
cgcguuccggccgcgccag

SEQ ID NO: 2459232 - RNA, 14 nt, Bordetella pertussis
cgcguucgccgcag

SEQ ID NO: 2459233 - RNA, 16 nt, Bordetella pertussis
cgcguucucagccgcc

SEQ ID NO: 2459234 - RNA, 19 nt, Bordetella pertussis
cgcguugaccggcuggcgc

SEQ ID NO: 2459235 - RNA, 15 nt, Bordetella pertussis
cgcguugagcagcau

SEQ ID NO: 2459236 - RNA, 16 nt, Bordetella pertussis
cgcguugagcagcaug

SEQ ID NO: 2459237 - RNA, 15 nt, Bordetella pertussis
cgcguugagcgccga

SEQ ID NO: 2459238 - RNA, 19 nt, Bordetella pertussis
cgcguugaucaucggcccg

SEQ ID NO: 2459239 - RNA, 18 nt, Bordetella pertussis
cgcguugcagccacaggc

SEQ ID NO: 2459240 - RNA, 15 nt, Bordetella pertussis
cgcguugccggugcg

SEQ ID NO: 2459241 - RNA, 22 nt, Bordetella pertussis
cgcguugccggugcgcgugggc

SEQ ID NO: 2459242 - RNA, 22 nt, Bordetella pertussis
cgcguugcgcaucgcgcacccg

SEQ ID NO: 2459243 - RNA, 16 nt, Bordetella pertussis
cgcguugcgcugcccg

SEQ ID NO: 2459244 - RNA, 22 nt, Bordetella pertussis
cgcguuggcgaggacaggccag

SEQ ID NO: 2459245 - RNA, 16 nt, Bordetella pertussis
cgcguuguucgggccg

SEQ ID NO: 2459246 - RNA, 19 nt, Bordetella pertussis
cgcguuguucgggccggcu

SEQ ID NO: 2459247 - RNA, 22 nt, Bordetella pertussis
cgcguuucccucggugcugcug

SEQ ID NO: 2459248 - RNA, 17 nt, Bordetella pertussis
cgcuaaauacgcuggcu

SEQ ID NO: 2459249 - RNA, 16 nt, Bordetella pertussis
cgcuaaccgcucguca

SEQ ID NO: 2459250 - RNA, 19 nt, Bordetella pertussis
cgcuaaccgcucgucauga

SEQ ID NO: 2459251 - RNA, 23 nt, Bordetella pertussis
cgcuaagcacaagcgcguggccg

SEQ ID NO: 2459252 - RNA, 19 nt, Bordetella pertussis
cgcuacagcgucacggcaa

SEQ ID NO: 2459253 - RNA, 18 nt, Bordetella pertussis
cgcuacagggugccgcgc

SEQ ID NO: 2459254 - RNA, 21 nt, Bordetella pertussis
cgcuacagggugccgcgccgg

SEQ ID NO: 2459255 - RNA, 14 nt, Bordetella pertussis
cgcuaccaggcgcg

SEQ ID NO: 2459256 - RNA, 17 nt, Bordetella pertussis
cgcuaccaggcgcgcgc

SEQ ID NO: 2459257 - RNA, 15 nt, Bordetella pertussis
cgcuaccccggcagc

SEQ ID NO: 2459258 - RNA, 17 nt, Bordetella pertussis
cgcuaccccggcagcgu

SEQ ID NO: 2459259 - RNA, 19 nt, Bordetella pertussis
cgcuaccccggcagcguca

SEQ ID NO: 2459260 - RNA, 14 nt, Bordetella pertussis
cgcuacccugccca

SEQ ID NO: 2459261 - RNA, 17 nt, Bordetella pertussis
cgcuaccgcuucccugg

SEQ ID NO: 2459262 - RNA, 21 nt, Bordetella pertussis
cgcuacgacgagaucgcgccu

SEQ ID NO: 2459263 - RNA, 22 nt, Bordetella pertussis
cgcuacgacgagaucgcgccua

SEQ ID NO: 2459264 - RNA, 14 nt, Bordetella pertussis
cgcuacgccgccga

SEQ ID NO: 2459265 - RNA, 23 nt, Bordetella pertussis
cgcuacgccgccgauggcgcgcg

SEQ ID NO: 2459266 - RNA, 17 nt, Bordetella pertussis
cgcuacgcggcgucagg

SEQ ID NO: 2459267 - RNA, 19 nt, Bordetella pertussis
cgcuacgggcgcugcacgc

SEQ ID NO: 2459268 - RNA, 17 nt, Bordetella pertussis
cgcuacguguccugccg

SEQ ID NO: 2459269 - RNA, 18 nt, Bordetella pertussis
cgcuacguguccugccgg

SEQ ID NO: 2459270 - RNA, 14 nt, Bordetella pertussis
cgcuaggaucgcga

SEQ ID NO: 2459271 - RNA, 16 nt, Bordetella pertussis
cgcuagggcguggcgc

SEQ ID NO: 2459272 - RNA, 17 nt, Bordetella pertussis
cgcuagggcguggcgcg

SEQ ID NO: 2459273 - RNA, 18 nt, Bordetella pertussis
cgcuagggcguggcgcga

SEQ ID NO: 2459274 - RNA, 16 nt, Bordetella pertussis
cgcuaucauccgcgca

SEQ ID NO: 2459275 - RNA, 22 nt, Bordetella pertussis
cgcuaugcagcugcgccagccc

SEQ ID NO: 2459276 - RNA, 19 nt, Bordetella pertussis
cgcuaugcgggcuugcugc

SEQ ID NO: 2459277 - RNA, 19 nt, Bordetella pertussis
cgcuaugggggcgagcggg

SEQ ID NO: 2459278 - RNA, 23 nt, Bordetella pertussis
cgcuaugggggcgagcgggccgg

SEQ ID NO: 2459279 - RNA, 20 nt, Bordetella pertussis
cgcucaacagcuugcccacg

SEQ ID NO: 2459280 - RNA, 21 nt, Bordetella pertussis
cgcucaacagcuugcccacgc

SEQ ID NO: 2459281 - RNA, 17 nt, Bordetella pertussis
cgcucaaggauuucacc

SEQ ID NO: 2459282 - RNA, 16 nt, Bordetella pertussis
cgcucaauucggccug

SEQ ID NO: 2459283 - RNA, 19 nt, Bordetella pertussis
cgcucaauucggccugacg

SEQ ID NO: 2459284 - RNA, 19 nt, Bordetella pertussis
cgcucacagggucaaggcg

SEQ ID NO: 2459285 - RNA, 20 nt, Bordetella pertussis
cgcucaccgagggccggacu

SEQ ID NO: 2459286 - RNA, 14 nt, Bordetella pertussis
cgcucacgcccgug

SEQ ID NO: 2459287 - RNA, 13 nt, Bordetella pertussis
cgcucacggggcu

SEQ ID NO: 2459288 - RNA, 21 nt, Bordetella pertussis
cgcucacggggcugucgcgcg

SEQ ID NO: 2459289 - RNA, 14 nt, Bordetella pertussis
cgcucagagcccca

SEQ ID NO: 2459290 - RNA, 18 nt, Bordetella pertussis
cgcucagagccccaggaa

SEQ ID NO: 2459291 - RNA, 12 nt, Bordetella pertussis
cgcucagcacca

SEQ ID NO: 2459292 - RNA, 22 nt, Bordetella pertussis
cgcucagcaccaggccgccggc

SEQ ID NO: 2459293 - RNA, 14 nt, Bordetella pertussis
cgcucagccgugcc

SEQ ID NO: 2459294 - RNA, 15 nt, Bordetella pertussis
cgcucagccgugccg

SEQ ID NO: 2459295 - RNA, 13 nt, Bordetella pertussis
cgcucagccuugu

SEQ ID NO: 2459296 - RNA, 14 nt, Bordetella pertussis
cgcucagcgcgccg

SEQ ID NO: 2459297 - RNA, 13 nt, Bordetella pertussis
cgcucagcgcggc

SEQ ID NO: 2459298 - RNA, 18 nt, Bordetella pertussis
cgcucagcgcggcgcggc

SEQ ID NO: 2459299 - RNA, 20 nt, Bordetella pertussis
cgcucagcgcggcgcggcca

SEQ ID NO: 2459300 - RNA, 20 nt, Bordetella pertussis
cgcucagcguacagaggucg

SEQ ID NO: 2459301 - RNA, 23 nt, Bordetella pertussis
cgcugcucgacagcagcccgcug

SEQ ID NO: 2459302 - RNA, 21 nt, Bordetella pertussis
cgcugcucguccacggccuuc

SEQ ID NO: 2459303 - RNA, 13 nt, Bordetella pertussis
cgcugcucuuggc

SEQ ID NO: 2459304 - RNA, 14 nt, Bordetella pertussis
cgcugcugaccgac

SEQ ID NO: 2459305 - RNA, 21 nt, Bordetella pertussis
cgcugcugaccgacggccugg

SEQ ID NO: 2459306 - RNA, 21 nt, Bordetella pertussis
cgcugcugauccucgccagcg

SEQ ID NO: 2459307 - RNA, 22 nt, Bordetella pertussis
cgcugcugauccucgccagcgg

SEQ ID NO: 2459308 - RNA, 17 nt, Bordetella pertussis
cgcugcugcaggccggc

SEQ ID NO: 2459309 - RNA, 18 nt, Bordetella pertussis
cgcugcugcaggccggcg

SEQ ID NO: 2459310 - RNA, 22 nt, Bordetella pertussis
cgcugcugcaggccggcgcgca

SEQ ID NO: 2459311 - RNA, 13 nt, Bordetella pertussis
cgcugcugcuggc

SEQ ID NO: 2459312 - RNA, 14 nt, Bordetella pertussis
cgcugcugcuggcu

SEQ ID NO: 2459313 - RNA, 14 nt, Bordetella pertussis
cgcugcuggccaag

SEQ ID NO: 2459314 - RNA, 19 nt, Bordetella pertussis
cgcugcuggccaagcgcgc

SEQ ID NO: 2459315 - RNA, 13 nt, Bordetella pertussis
cgcugcuggccgg

SEQ ID NO: 2459316 - RNA, 14 nt, Bordetella pertussis
cgcugcuggccggc

SEQ ID NO: 2459317 - RNA, 18 nt, Bordetella pertussis
cgcugcuggccggccagc

SEQ ID NO: 2459318 - RNA, 13 nt, Bordetella pertussis
cgcugcuggcggc

SEQ ID NO: 2459319 - RNA, 16 nt, Bordetella pertussis
cgcugcuggcggcgcu

SEQ ID NO: 2459320 - RNA, 15 nt, Bordetella pertussis
cgcugcugucgcgcg

SEQ ID NO: 2459321 - RNA, 16 nt, Bordetella pertussis
cgcugcugucgcgcug

SEQ ID NO: 2459322 - RNA, 19 nt, Bordetella pertussis
cgcugcugucgcgcugccc

SEQ ID NO: 2459323 - RNA, 17 nt, Bordetella pertussis
cgcuggaagacguggcc

SEQ ID NO: 2459324 - RNA, 22 nt, Bordetella pertussis
cgcuggaccgggaauggcgccg

SEQ ID NO: 2459325 - RNA, 18 nt, Bordetella pertussis
cgcuggacgcccuggcgc

SEQ ID NO: 2459326 - RNA, 20 nt, Bordetella pertussis
cgcuggacgcccuggcgcag

SEQ ID NO: 2459327 - RNA, 18 nt, Bordetella pertussis
cgcuggacgucggugugg

SEQ ID NO: 2459328 - RNA, 15 nt, Bordetella pertussis
cgcuggagauggcgc

SEQ ID NO: 2459329 - RNA, 14 nt, Bordetella pertussis
cgcuggagcgcggc

SEQ ID NO: 2459330 - RNA, 16 nt, Bordetella pertussis
cgcuggagcgcggcgg

SEQ ID NO: 2459331 - RNA, 21 nt, Bordetella pertussis
cgcuggagcgcggcggcguga

SEQ ID NO: 2459332 - RNA, 21 nt, Bordetella pertussis
cgcuggaggccuuccaccagc

SEQ ID NO: 2459333 - RNA, 20 nt, Bordetella pertussis
cgcuggcaucgucgcgcugc

SEQ ID NO: 2459334 - RNA, 21 nt, Bordetella pertussis
cgcuggccacguugucgcgcg

SEQ ID NO: 2459335 - RNA, 13 nt, Bordetella pertussis
cgcuggccagccg

SEQ ID NO: 2459336 - RNA, 14 nt, Bordetella pertussis
cgcuggccagccgc

SEQ ID NO: 2459337 - RNA, 17 nt, Bordetella pertussis
cgcuggccaucaccgcc

SEQ ID NO: 2459338 - RNA, 21 nt, Bordetella pertussis
cgcuggccaucaccgccuccg

SEQ ID NO: 2459339 - RNA, 21 nt, Bordetella pertussis
cgcuggccaucguacgcgugg

SEQ ID NO: 2459340 - RNA, 14 nt, Bordetella pertussis
cgcuggccaugccg

SEQ ID NO: 2459341 - RNA, 18 nt, Bordetella pertussis
cgcuggccaugccgucgc

SEQ ID NO: 2459342 - RNA, 22 nt, Bordetella pertussis
cgcuggccaugccgucgcgcac

SEQ ID NO: 2459343 - RNA, 20 nt, Bordetella pertussis
cgcuggcccacucggugcgc

SEQ ID NO: 2459344 - RNA, 22 nt, Bordetella pertussis
cgcuggcccaguucgcgcagca

SEQ ID NO: 2459345 - RNA, 12 nt, Bordetella pertussis
cgcuggcccgcg

SEQ ID NO: 2459346 - RNA, 13 nt, Bordetella pertussis
cgcuggcccgcgc

SEQ ID NO: 2459347 - RNA, 20 nt, Bordetella pertussis
cgcuggcccgcgcgagcggc

SEQ ID NO: 2459348 - RNA, 18 nt, Bordetella pertussis
cgcuggcccgucaugggc

SEQ ID NO: 2459349 - RNA, 20 nt, Bordetella pertussis
cgcuggccgaucugcugggc

SEQ ID NO: 2459350 - RNA, 14 nt, Bordetella pertussis
cgcuggccgccaug

SEQ ID NO: 2459351 - RNA, 18 nt, Bordetella pertussis
cgcuggccgccauggcgc

SEQ ID NO: 2459352 - RNA, 22 nt, Bordetella pertussis
cgcuggccgccauggcgcuggc

SEQ ID NO: 2459353 - RNA, 15 nt, Bordetella pertussis
cgcuggccgcccgcg

SEQ ID NO: 2459354 - RNA, 16 nt, Bordetella pertussis
cgcuggccgcccgcgg

SEQ ID NO: 2459355 - RNA, 19 nt, Bordetella pertussis
cgcuggccgcccgcggccu

SEQ ID NO: 2459356 - RNA, 23 nt, Bordetella pertussis
cgcuggccgcccgcggccugcag

SEQ ID NO: 2459357 - RNA, 18 nt, Bordetella pertussis
cgcuggccgcgcccgccg

SEQ ID NO: 2459358 - RNA, 19 nt, Bordetella pertussis
cgcuggccgcgcuggcggc

SEQ ID NO: 2459359 - RNA, 22 nt, Bordetella pertussis
cgcuggccgcgcuggcggcgca

SEQ ID NO: 2459360 - RNA, 20 nt, Bordetella pertussis
cgcuggccggacgcaaccgg

SEQ ID NO: 2459361 - RNA, 13 nt, Bordetella pertussis
cgcuggccggccg

SEQ ID NO: 2459362 - RNA, 15 nt, Bordetella pertussis
cgcuggccggccgcg

SEQ ID NO: 2459363 - RNA, 14 nt, Bordetella pertussis
cgcuggccggcgug

SEQ ID NO: 2459364 - RNA, 21 nt, Bordetella pertussis
cgcuggccgucgccgcccugc

SEQ ID NO: 2459365 - RNA, 18 nt, Bordetella pertussis
cgcuggccugccgcgccg

SEQ ID NO: 2459366 - RNA, 19 nt, Bordetella pertussis
cgcuggccugccgcgccga

SEQ ID NO: 2459367 - RNA, 20 nt, Bordetella pertussis
cgcuggccugccgcgccgac

SEQ ID NO: 2459368 - RNA, 22 nt, Bordetella pertussis
cgcuggccugccgcgccgaccg

SEQ ID NO: 2459369 - RNA, 23 nt, Bordetella pertussis
cgcuggccugccgcgccgaccgg

SEQ ID NO: 2459370 - RNA, 22 nt, Bordetella pertussis
cgcuggccuggccgccggcggc

SEQ ID NO: 2459371 - RNA, 23 nt, Bordetella pertussis
cgcuggccuggccgccggcggcg

SEQ ID NO: 2459372 - RNA, 18 nt, Bordetella pertussis
cgcuggcgaagaccguga

SEQ ID NO: 2459373 - RNA, 15 nt, Bordetella pertussis
cgcuggcgagcaugg

SEQ ID NO: 2459374 - RNA, 16 nt, Bordetella pertussis
cgcuggcgagcauggc

SEQ ID NO: 2459375 - RNA, 18 nt, Bordetella pertussis
cgcuggcgaucacggcca

SEQ ID NO: 2459376 - RNA, 17 nt, Bordetella pertussis
cgcuggcgaucaggccg

SEQ ID NO: 2459377 - RNA, 18 nt, Bordetella pertussis
cgcuggcgaucaggccgc

SEQ ID NO: 2459378 - RNA, 20 nt, Bordetella pertussis
cgcuggcgaucaggccgccc

SEQ ID NO: 2459379 - RNA, 21 nt, Bordetella pertussis
cgcuggcgaucaggccgcccc

SEQ ID NO: 2459380 - RNA, 23 nt, Bordetella pertussis
cgcuggcgaugcccaccagccgc

SEQ ID NO: 2459381 - RNA, 17 nt, Bordetella pertussis
cgcuggcgaugcgggcc

SEQ ID NO: 2459382 - RNA, 18 nt, Bordetella pertussis
cgcuggcgaugcgggcca

SEQ ID NO: 2459383 - RNA, 19 nt, Bordetella pertussis
cgcuggcgcagcaggcgcg

SEQ ID NO: 2459384 - RNA, 23 nt, Bordetella pertussis
cgcuggcgcagcaggcgcgcggc

SEQ ID NO: 2459385 - RNA, 17 nt, Bordetella pertussis
cgcuggcgcccgccugc

SEQ ID NO: 2459386 - RNA, 19 nt, Bordetella pertussis
cgcuggcgcccggccugcg

SEQ ID NO: 2459387 - RNA, 13 nt, Bordetella pertussis
cgcuggcgccgcg

SEQ ID NO: 2459388 - RNA, 13 nt, Bordetella pertussis
cgcuggcgccggu

SEQ ID NO: 2459389 - RNA, 24 nt, Bordetella pertussis
cgcuggcgcgagaaccaggccacg

SEQ ID NO: 2459390 - RNA, 14 nt, Bordetella pertussis
cgcuggcgcgccgc

SEQ ID NO: 2459391 - RNA, 15 nt, Bordetella pertussis
cgcuggcgcgccgcc

SEQ ID NO: 2459392 - RNA, 12 nt, Bordetella pertussis
cgcuggcgcgcg

SEQ ID NO: 2459393 - RNA, 21 nt, Bordetella pertussis
cgcuggcgcgcgacggcgccg

SEQ ID NO: 2459394 - RNA, 16 nt, Bordetella pertussis
cgcuggcgcgcggccg

SEQ ID NO: 2459395 - RNA, 16 nt, Bordetella pertussis
cgcuggcgcgcggcug

SEQ ID NO: 2459396 - RNA, 19 nt, Bordetella pertussis
cgcuggcgcgcggcuggcu

SEQ ID NO: 2459397 - RNA, 13 nt, Bordetella pertussis
cgcuggcgcgucu

SEQ ID NO: 2459398 - RNA, 16 nt, Bordetella pertussis
cgcuggcgcuggccgc

SEQ ID NO: 2459399 - RNA, 15 nt, Bordetella pertussis
cgcuggcggcacacg

SEQ ID NO: 2459400 - RNA, 15 nt, Bordetella pertussis
cgcuggcggcccugc

SEQ ID NO: 2459401 - RNA, 17 nt, Bordetella pertussis
cgcuggcggcccugccg

SEQ ID NO: 2459402 - RNA, 14 nt, Bordetella pertussis
cgcuggcggccgcg

SEQ ID NO: 2459403 - RNA, 13 nt, Bordetella pertussis
cgcuggcggcgca

SEQ ID NO: 2459404 - RNA, 18 nt, Bordetella pertussis
cgcuggcggcgcaggccg

SEQ ID NO: 2459405 - RNA, 23 nt, Bordetella pertussis
cgcuggcggcgcaggccgcgccg

SEQ ID NO: 2459406 - RNA, 16 nt, Bordetella pertussis
cgcuggcggcugcgcg

SEQ ID NO: 2459407 - RNA, 20 nt, Bordetella pertussis
cgcuggcgguggccgcgcau

SEQ ID NO: 2459408 - RNA, 21 nt, Bordetella pertussis
cgcuggcgguggccgcgcaug

SEQ ID NO: 2459409 - RNA, 14 nt, Bordetella pertussis
cgcuggcguccagc

SEQ ID NO: 2459410 - RNA, 23 nt, Bordetella pertussis
cgcuggcguucagcgggcgcgcc

SEQ ID NO: 2459411 - RNA, 18 nt, Bordetella pertussis
cgcuggcuaucgccucga

SEQ ID NO: 2459412 - RNA, 15 nt, Bordetella pertussis
cgcuggcugggccug

SEQ ID NO: 2459413 - RNA, 16 nt, Bordetella pertussis
cgcuggcugugcccgc

SEQ ID NO: 2459414 - RNA, 20 nt, Bordetella pertussis
cgcuggcugugcccgcccca

SEQ ID NO: 2459415 - RNA, 14 nt, Bordetella pertussis
cggacgccucgccg

SEQ ID NO: 2459416 - RNA, 15 nt, Bordetella pertussis
cggacgccucgccgg

SEQ ID NO: 2459417 - RNA, 13 nt, Bordetella pertussis
cggacgccuggcg

SEQ ID NO: 2459418 - RNA, 14 nt, Bordetella pertussis
cggacgccuggcgc

SEQ ID NO: 2459419 - RNA, 14 nt, Bordetella pertussis
cggacgcgccgggc

SEQ ID NO: 2459420 - RNA, 15 nt, Bordetella pertussis
cggacgcgccgggcg

SEQ ID NO: 2459421 - RNA, 16 nt, Bordetella pertussis
cggacgcgccgggcga

SEQ ID NO: 2459422 - RNA, 13 nt, Bordetella pertussis
cggacgcgcgccg

SEQ ID NO: 2459423 - RNA, 14 nt, Bordetella pertussis
cggacgcgcgccgc

SEQ ID NO: 2459424 - RNA, 17 nt, Bordetella pertussis
cggacgcgcgccgcauc

SEQ ID NO: 2459425 - RNA, 15 nt, Bordetella pertussis
cggacgcggccggca

SEQ ID NO: 2459426 - RNA, 17 nt, Bordetella pertussis
cggacgcggccggcaag

SEQ ID NO: 2459427 - RNA, 23 nt, Bordetella pertussis
cggacggauagugguucaugcgu

SEQ ID NO: 2459428 - RNA, 23 nt, Bordetella pertussis
cggacggcgcggaucgugcgcca

SEQ ID NO: 2459429 - RNA, 14 nt, Bordetella pertussis
cggacgggccaggc

SEQ ID NO: 2459430 - RNA, 16 nt, Bordetella pertussis
cggacgggccaggccg

SEQ ID NO: 2459431 - RNA, 19 nt, Bordetella pertussis
cggacggguaucgucgacc

SEQ ID NO: 2459432 - RNA, 21 nt, Bordetella pertussis
cggacggguaucgucgaccug

SEQ ID NO: 2459433 - RNA, 21 nt, Bordetella pertussis
cggacgguagcgcacgcaccg

SEQ ID NO: 2459434 - RNA, 20 nt, Bordetella pertussis
cggacguagucgcacgcggc

SEQ ID NO: 2459435 - RNA, 23 nt, Bordetella pertussis
cggacgugggcgccuacggcggc

SEQ ID NO: 2459436 - RNA, 16 nt, Bordetella pertussis
cggacuggccgcgccg

SEQ ID NO: 2459437 - RNA, 20 nt, Bordetella pertussis
cggacuggcgcgcaccaugg

SEQ ID NO: 2459438 - RNA, 17 nt, Bordetella pertussis
cggacugggcgucgcuc

SEQ ID NO: 2459439 - RNA, 22 nt, Bordetella pertussis
cggacuucgcuuucgguggcgu

SEQ ID NO: 2459440 - RNA, 20 nt, Bordetella pertussis
cggagaaaucgccgccggcg

SEQ ID NO: 2459441 - RNA, 14 nt, Bordetella pertussis
cggagcacggaaga

SEQ ID NO: 2459442 - RNA, 17 nt, Bordetella pertussis
cggagcagucgcgcagc

SEQ ID NO: 2459443 - RNA, 19 nt, Bordetella pertussis
cggagccaguccccgcagg

SEQ ID NO: 2459444 - RNA, 13 nt, Bordetella pertussis
cggagccgcgcac

SEQ ID NO: 2459445 - RNA, 21 nt, Bordetella pertussis
cggagccgcgcacacauggcg

SEQ ID NO: 2459446 - RNA, 13 nt, Bordetella pertussis
cggagccuguccc

SEQ ID NO: 2459447 - RNA, 15 nt, Bordetella pertussis
cggagccugucccug

SEQ ID NO: 2459448 - RNA, 13 nt, Bordetella pertussis
cggagcgacggca

SEQ ID NO: 2459449 - RNA, 19 nt, Bordetella pertussis
cggagcgacggcagaugga

SEQ ID NO: 2459450 - RNA, 20 nt, Bordetella pertussis
cggagcggcucuggaucgug

SEQ ID NO: 2459451 - RNA, 16 nt, Bordetella pertussis
cggagcugccgaaucg

SEQ ID NO: 2459452 - RNA, 22 nt, Bordetella pertussis
cggaggagguggcuggugccag

SEQ ID NO: 2459453 - RNA, 11 nt, Bordetella pertussis
cggaggcgcgc

SEQ ID NO: 2459454 - RNA, 12 nt, Bordetella pertussis
cggaggcgcgca

SEQ ID NO: 2459455 - RNA, 15 nt, Bordetella pertussis
cggaggcggccgcgg

SEQ ID NO: 2459456 - RNA, 20 nt, Bordetella pertussis
cggaggcuuuguggcgucgg

SEQ ID NO: 2459457 - RNA, 14 nt, Bordetella pertussis
cggaggucggcgca

SEQ ID NO: 2459458 - RNA, 15 nt, Bordetella pertussis
cggaggugucgccgc

SEQ ID NO: 2459459 - RNA, 18 nt, Bordetella pertussis
cggaguaguugucgucgc

SEQ ID NO: 2459460 - RNA, 13 nt, Bordetella pertussis
cggagucgccccg

SEQ ID NO: 2459461 - RNA, 18 nt, Bordetella pertussis
cggagucgccccgacgcg

SEQ ID NO: 2459462 - RNA, 14 nt, Bordetella pertussis
cggagucggcgccg

SEQ ID NO: 2459463 - RNA, 18 nt, Bordetella pertussis
cggagucggcgccgcgca

SEQ ID NO: 2459464 - RNA, 21 nt, Bordetella pertussis
cggagucggcgccgcgcagca

SEQ ID NO: 2459465 - RNA, 20 nt, Bordetella pertussis
cggaguugcccgaaggcagc

SEQ ID NO: 2459466 - RNA, 14 nt, Bordetella pertussis
cggauaccgccgcc

SEQ ID NO: 2459467 - RNA, 18 nt, Bordetella pertussis
cggauacgaaaccaggcc

SEQ ID NO: 2459468 - RNA, 21 nt, Bordetella pertussis
cggauacgaaaccaggccggg

SEQ ID NO: 2459469 - RNA, 17 nt, Bordetella pertussis
cggauagcggugcaggg

SEQ ID NO: 2459470 - RNA, 18 nt, Bordetella pertussis
cggauagugguucaugcg

SEQ ID NO: 2459471 - RNA, 15 nt, Bordetella pertussis
cggauauucgucggc

SEQ ID NO: 2459472 - RNA, 16 nt, Bordetella pertussis
cggauauucgucggcc

SEQ ID NO: 2459473 - RNA, 19 nt, Bordetella pertussis
cggauauucgucggccgcc

SEQ ID NO: 2459474 - RNA, 20 nt, Bordetella pertussis
cggauauucgucggccgccg

SEQ ID NO: 2459475 - RNA, 13 nt, Bordetella pertussis
cggaucaagcggc

SEQ ID NO: 2459476 - RNA, 16 nt, Bordetella pertussis
cggaucaagcggcccg

SEQ ID NO: 2459477 - RNA, 19 nt, Bordetella pertussis
cggaucaagcggcccgcgc

SEQ ID NO: 2459478 - RNA, 20 nt, Bordetella pertussis
cggaucaagcggcccgcgcc

SEQ ID NO: 2459479 - RNA, 15 nt, Bordetella pertussis
cggaucaguccgggc

SEQ ID NO: 2459480 - RNA, 17 nt, Bordetella pertussis
cggaucauccgggcccg

SEQ ID NO: 2459481 - RNA, 17 nt, Bordetella pertussis
cggaucaugggccugcc

SEQ ID NO: 2459482 - RNA, 16 nt, Bordetella pertussis
cggaucccaggccggc

SEQ ID NO: 2459483 - RNA, 15 nt, Bordetella pertussis
cggauccuugacgaa

SEQ ID NO: 2459484 - RNA, 13 nt, Bordetella pertussis
cggaucgaaccca

SEQ ID NO: 2459485 - RNA, 21 nt, Bordetella pertussis
cggaucgacgcgauguccagc

SEQ ID NO: 2459486 - RNA, 20 nt, Bordetella pertussis
cggaucgcacacaccgcguc

SEQ ID NO: 2459487 - RNA, 22 nt, Bordetella pertussis
cggaucgccgguagcgcugggc

SEQ ID NO: 2459488 - RNA, 12 nt, Bordetella pertussis
cggaucgcggcg

SEQ ID NO: 2459489 - RNA, 16 nt, Bordetella pertussis
cggaucggccggcagc

SEQ ID NO: 2459490 - RNA, 15 nt, Bordetella pertussis
cggaucggggcaacg

SEQ ID NO: 2459491 - RNA, 22 nt, Bordetella pertussis
cggaucucggccagcagcgccu

SEQ ID NO: 2459492 - RNA, 17 nt, Bordetella pertussis
cggaugaacgaccagca

SEQ ID NO: 2459493 - RNA, 16 nt, Bordetella pertussis
cggaugaagggcuggc

SEQ ID NO: 2459494 - RNA, 19 nt, Bordetella pertussis
cggaugaagggcuggccgg

SEQ ID NO: 2459495 - RNA, 15 nt, Bordetella pertussis
cggaugaccugcgcc

SEQ ID NO: 2459496 - RNA, 19 nt, Bordetella pertussis
cggaugaccugcgccaggu

SEQ ID NO: 2459497 - RNA, 19 nt, Bordetella pertussis
cggaugaccuggugcacca

SEQ ID NO: 2459498 - RNA, 20 nt, Bordetella pertussis
cggaugaccuggugcaccac

SEQ ID NO: 2459499 - RNA, 18 nt, Bordetella pertussis
cggaugagcaggccgggu

SEQ ID NO: 2459500 - RNA, 15 nt, Bordetella pertussis
cggaugaucgcgcag

SEQ ID NO: 2459501 - RNA, 22 nt, Bordetella pertussis
cggaugaugcggcgccacgcag

SEQ ID NO: 2459502 - RNA, 16 nt, Bordetella pertussis
cggaugaugggcaucg

SEQ ID NO: 2459503 - RNA, 11 nt, Bordetella pertussis
cggaugccacc

SEQ ID NO: 2459504 - RNA, 14 nt, Bordetella pertussis
cggaugccgcccgu

SEQ ID NO: 2459505 - RNA, 21 nt, Bordetella pertussis
cggaugccgcccgugcagaag

SEQ ID NO: 2459506 - RNA, 18 nt, Bordetella pertussis
cggaugccguccacgccg

SEQ ID NO: 2459507 - RNA, 17 nt, Bordetella pertussis
cggaugccgucuuggcg

SEQ ID NO: 2459508 - RNA, 18 nt, Bordetella pertussis
cggaugccgucuuggcgg

SEQ ID NO: 2459509 - RNA, 17 nt, Bordetella pertussis
cggaugcgcaggacggc

SEQ ID NO: 2459510 - RNA, 20 nt, Bordetella pertussis
cggaugcgcaggacggcgcc

SEQ ID NO: 2459511 - RNA, 13 nt, Bordetella pertussis
cggaugcgccgcc

SEQ ID NO: 2459512 - RNA, 19 nt, Bordetella pertussis
cggaugcgccgccccaguu

SEQ ID NO: 2459513 - RNA, 17 nt, Bordetella pertussis
cggaugcuugcggggca

SEQ ID NO: 2459514 - RNA, 16 nt, Bordetella pertussis
cggauggucgagcgcc

SEQ ID NO: 2459515 - RNA, 17 nt, Bordetella pertussis
cggauggucgugcggca

SEQ ID NO: 2459516 - RNA, 19 nt, Bordetella pertussis
cggauggucgugcggcacg

SEQ ID NO: 2459517 - RNA, 21 nt, Bordetella pertussis
cggauggucgugcggcacgca

SEQ ID NO: 2459518 - RNA, 16 nt, Bordetella pertussis
cggauggugcucggcg

SEQ ID NO: 2459519 - RNA, 15 nt, Bordetella pertussis
cggauguccggcgcg

SEQ ID NO: 2459520 - RNA, 22 nt, Bordetella pertussis
cggauguccggcgcgaacggcu

SEQ ID NO: 2459521 - RNA, 13 nt, Bordetella pertussis
cggauucccagcu

SEQ ID NO: 2459522 - RNA, 19 nt, Bordetella pertussis
cggauugaccagcgcggcc

SEQ ID NO: 2459523 - RNA, 21 nt, Bordetella pertussis
cggauugaccagcgcggccgu

SEQ ID NO: 2459524 - RNA, 19 nt, Bordetella pertussis
cggauugaugucgcgcacc

SEQ ID NO: 2459525 - RNA, 17 nt, Bordetella pertussis
cggauugccgccgcgca

SEQ ID NO: 2459526 - RNA, 17 nt, Bordetella pertussis
cggauugcuugacgccg

SEQ ID NO: 2459527 - RNA, 19 nt, Bordetella pertussis
cggauugcuugacgccgcc

SEQ ID NO: 2459528 - RNA, 15 nt, Bordetella pertussis
cggauuggcgcugca

SEQ ID NO: 2459529 - RNA, 18 nt, Bordetella pertussis
cggauuugcuucaggucg

SEQ ID NO: 2459530 - RNA, 19 nt, Bordetella pertussis
cgcucagcuuguagcccuc

SEQ ID NO: 2459531 - RNA, 18 nt, Bordetella pertussis
cgcucaggaaccagcggc

SEQ ID NO: 2459532 - RNA, 16 nt, Bordetella pertussis
cgcucaggccgccggc

SEQ ID NO: 2459533 - RNA, 22 nt, Bordetella pertussis
cgcucaggcggugacgcccugc

SEQ ID NO: 2459534 - RNA, 15 nt, Bordetella pertussis
cgcucagggggcgcc

SEQ ID NO: 2459535 - RNA, 16 nt, Bordetella pertussis
cgcucagggggcgccc

SEQ ID NO: 2459536 - RNA, 19 nt, Bordetella pertussis
cgcucaggguacggcgaug

SEQ ID NO: 2459537 - RNA, 16 nt, Bordetella pertussis
cgcucagguagaccac

SEQ ID NO: 2459538 - RNA, 19 nt, Bordetella pertussis
cgcucaucaucgcgcuggc

SEQ ID NO: 2459539 - RNA, 14 nt, Bordetella pertussis
cgcucauccaggcg

SEQ ID NO: 2459540 - RNA, 18 nt, Bordetella pertussis
cgcucauccaggcgcguu

SEQ ID NO: 2459541 - RNA, 15 nt, Bordetella pertussis
cgcucaugaccagcg

SEQ ID NO: 2459542 - RNA, 20 nt, Bordetella pertussis
cgcucaugaccagcggcgug

SEQ ID NO: 2459543 - RNA, 22 nt, Bordetella pertussis
cgcucaugaccagcggcgugau

SEQ ID NO: 2459544 - RNA, 14 nt, Bordetella pertussis
cgcucaugccggca

SEQ ID NO: 2459545 - RNA, 17 nt, Bordetella pertussis
cgcucaugccggcaagc

SEQ ID NO: 2459546 - RNA, 20 nt, Bordetella pertussis
cgcucauggaggggcgcagg

SEQ ID NO: 2459547 - RNA, 21 nt, Bordetella pertussis
cgcucauggaggggcgcaggc

SEQ ID NO: 2459548 - RNA, 15 nt, Bordetella pertussis
cgcucauguucgggc

SEQ ID NO: 2459549 - RNA, 18 nt, Bordetella pertussis
cgcucauguucgggcgcg

SEQ ID NO: 2459550 - RNA, 13 nt, Bordetella pertussis
cgcuccaccagca

SEQ ID NO: 2459551 - RNA, 14 nt, Bordetella pertussis
cgcuccaccagcac

SEQ ID NO: 2459552 - RNA, 13 nt, Bordetella pertussis
cgcuccagcaugu

SEQ ID NO: 2459553 - RNA, 18 nt, Bordetella pertussis
cgcuccagcgucauggcc

SEQ ID NO: 2459554 - RNA, 14 nt, Bordetella pertussis
cgcuccaggcggcc

SEQ ID NO: 2459555 - RNA, 17 nt, Bordetella pertussis
cgcuccaggcggccagu

SEQ ID NO: 2459556 - RNA, 22 nt, Bordetella pertussis
cgcuccaugaucucgggcgagg

SEQ ID NO: 2459557 - RNA, 17 nt, Bordetella pertussis
cgcuccauggcgccggc

SEQ ID NO: 2459558 - RNA, 19 nt, Bordetella pertussis
cgcuccauggcgccggcgg

SEQ ID NO: 2459559 - RNA, 20 nt, Bordetella pertussis
cgcuccauggcgccggcggc

SEQ ID NO: 2459560 - RNA, 21 nt, Bordetella pertussis
cgcuccauggcgccggcggcc

SEQ ID NO: 2459561 - RNA, 22 nt, Bordetella pertussis
cgcuccauggcgccggcggccu

SEQ ID NO: 2459562 - RNA, 21 nt, Bordetella pertussis
cgcuccauguaaaaacccggc

SEQ ID NO: 2459563 - RNA, 23 nt, Bordetella pertussis
cgcuccauguaaaaacccggccu

SEQ ID NO: 2459564 - RNA, 22 nt, Bordetella pertussis
cgcucccccaugcggggacagg

SEQ ID NO: 2459565 - RNA, 22 nt, Bordetella pertussis
cgcuccccgugcggggaccggc

SEQ ID NO: 2459566 - RNA, 13 nt, Bordetella pertussis
cgcucccgccaac

SEQ ID NO: 2459567 - RNA, 18 nt, Bordetella pertussis
cgcuccggcugcgcgcgc

SEQ ID NO: 2459568 - RNA, 13 nt, Bordetella pertussis
cgcuccucgcgcg

SEQ ID NO: 2459569 - RNA, 14 nt, Bordetella pertussis
cgcuccucgcgcgc

SEQ ID NO: 2459570 - RNA, 16 nt, Bordetella pertussis
cgcuccugcucggcga

SEQ ID NO: 2459571 - RNA, 19 nt, Bordetella pertussis
cgcuccuggaacuugggau

SEQ ID NO: 2459572 - RNA, 15 nt, Bordetella pertussis
cgcucgaagcgcaug

SEQ ID NO: 2459573 - RNA, 14 nt, Bordetella pertussis
cgcucgaaggcgcc

SEQ ID NO: 2459574 - RNA, 20 nt, Bordetella pertussis
cgcucgaauggcugcgcgcc

SEQ ID NO: 2459575 - RNA, 22 nt, Bordetella pertussis
cgcucgaauggcugcgcgccgu

SEQ ID NO: 2459576 - RNA, 15 nt, Bordetella pertussis
cgcucgaccgaaaug

SEQ ID NO: 2459577 - RNA, 17 nt, Bordetella pertussis
cgcucgaccgaaaugaa

SEQ ID NO: 2459578 - RNA, 17 nt, Bordetella pertussis
cgcucgagcgccugcag

SEQ ID NO: 2459579 - RNA, 15 nt, Bordetella pertussis
cgcucgaggccaggc

SEQ ID NO: 2459580 - RNA, 16 nt, Bordetella pertussis
cgcucgaggcgcuggc

SEQ ID NO: 2459581 - RNA, 18 nt, Bordetella pertussis
cgcucgaggcgcuggcgu

SEQ ID NO: 2459582 - RNA, 23 nt, Bordetella pertussis
cgcucgaggcgcuggcguccagc

SEQ ID NO: 2459583 - RNA, 23 nt, Bordetella pertussis
cgcucgagguaggcgggacuggc

SEQ ID NO: 2459584 - RNA, 14 nt, Bordetella pertussis
cgcucgaugcgcca

SEQ ID NO: 2459585 - RNA, 19 nt, Bordetella pertussis
cgcucgcccagcaccucga

SEQ ID NO: 2459586 - RNA, 21 nt, Bordetella pertussis
cgcucgcccccgcgccgcgca

SEQ ID NO: 2459587 - RNA, 22 nt, Bordetella pertussis
cgcucgcccccgcgccgcgcag

SEQ ID NO: 2459588 - RNA, 19 nt, Bordetella pertussis
cgcucgccccggcgcgcag

SEQ ID NO: 2459589 - RNA, 16 nt, Bordetella pertussis
cgcucgcccggccacg

SEQ ID NO: 2459590 - RNA, 17 nt, Bordetella pertussis
cgcucgcccggccacgu

SEQ ID NO: 2459591 - RNA, 13 nt, Bordetella pertussis
cgcucgcccucgc

SEQ ID NO: 2459592 - RNA, 13 nt, Bordetella pertussis
cgcucgccggcgc

SEQ ID NO: 2459593 - RNA, 15 nt, Bordetella pertussis
cgcucgccggcgcgc

SEQ ID NO: 2459594 - RNA, 19 nt, Bordetella pertussis
cgcucgccggcgcgcaggc

SEQ ID NO: 2459595 - RNA, 13 nt, Bordetella pertussis
cgcucgccgucga

SEQ ID NO: 2459596 - RNA, 17 nt, Bordetella pertussis
cgcucgccgucgacgcc

SEQ ID NO: 2459597 - RNA, 18 nt, Bordetella pertussis
cgcucgccgucgacgccg

SEQ ID NO: 2459598 - RNA, 15 nt, Bordetella pertussis
cgcucgcgcaggcgu

SEQ ID NO: 2459599 - RNA, 13 nt, Bordetella pertussis
cgcucgcgccagg

SEQ ID NO: 2459600 - RNA, 11 nt, Bordetella pertussis
cgcucgcgccc

SEQ ID NO: 2459601 - RNA, 23 nt, Bordetella pertussis
cgcucgcgcccaucucggccgcg

SEQ ID NO: 2459602 - RNA, 16 nt, Bordetella pertussis
cgcucgcgcucggcca

SEQ ID NO: 2459603 - RNA, 18 nt, Bordetella pertussis
cgcucgcgggugcgcagc

SEQ ID NO: 2459604 - RNA, 16 nt, Bordetella pertussis
cgcucgcugccggcgu

SEQ ID NO: 2459605 - RNA, 18 nt, Bordetella pertussis
cgcucgcugccggcgucc

SEQ ID NO: 2459606 - RNA, 12 nt, Bordetella pertussis
cgcucggccacg

SEQ ID NO: 2459607 - RNA, 15 nt, Bordetella pertussis
cgcucggccacgcgc

SEQ ID NO: 2459608 - RNA, 21 nt, Bordetella pertussis
cgcucggccacgcgcugcugc

SEQ ID NO: 2459609 - RNA, 21 nt, Bordetella pertussis
cgcucggccacgcucacgccc

SEQ ID NO: 2459610 - RNA, 12 nt, Bordetella pertussis
cgcucggccagc

SEQ ID NO: 2459611 - RNA, 14 nt, Bordetella pertussis
cgcucggccagcag

SEQ ID NO: 2459612 - RNA, 21 nt, Bordetella pertussis
cgcucggccagcgaggccgcu

SEQ ID NO: 2459613 - RNA, 16 nt, Bordetella pertussis
cgcucggccagcgcgc

SEQ ID NO: 2459614 - RNA, 17 nt, Bordetella pertussis
cgcucggccagcgcgcg

SEQ ID NO: 2459615 - RNA, 14 nt, Bordetella pertussis
cgcucggccucccg

SEQ ID NO: 2459616 - RNA, 15 nt, Bordetella pertussis
cgcucggcgccgggc

SEQ ID NO: 2459617 - RNA, 16 nt, Bordetella pertussis
cgcucggcgccgggcu

SEQ ID NO: 2459618 - RNA, 18 nt, Bordetella pertussis
cgcucggcgccgggcugg

SEQ ID NO: 2459619 - RNA, 14 nt, Bordetella pertussis
cgcucggcgcugcc

SEQ ID NO: 2459620 - RNA, 15 nt, Bordetella pertussis
cgcucggcgcugccg

SEQ ID NO: 2459621 - RNA, 16 nt, Bordetella pertussis
cgcucggcuuccugcc

SEQ ID NO: 2459622 - RNA, 21 nt, Bordetella pertussis
cgcucgggcagcucgcggucg

SEQ ID NO: 2459623 - RNA, 13 nt, Bordetella pertussis
cgcucgggcgcgg

SEQ ID NO: 2459624 - RNA, 15 nt, Bordetella pertussis
cgcucgggcgcggca

SEQ ID NO: 2459625 - RNA, 16 nt, Bordetella pertussis
cgcucgggcgcggcau

SEQ ID NO: 2459626 - RNA, 21 nt, Bordetella pertussis
cgcucggucauguccagcgcc

SEQ ID NO: 2459627 - RNA, 14 nt, Bordetella pertussis
cgcucgguccagac

SEQ ID NO: 2459628 - RNA, 19 nt, Bordetella pertussis
cgcucgucaugaucccgcg

SEQ ID NO: 2459629 - RNA, 22 nt, Bordetella pertussis
cgcucgucaugaucccgcgccu

SEQ ID NO: 2459630 - RNA, 21 nt, Bordetella pertussis
cgcucuccgaacaggcggucu

SEQ ID NO: 2459631 - RNA, 14 nt, Bordetella pertussis
cgcucugcgcggca

SEQ ID NO: 2459632 - RNA, 15 nt, Bordetella pertussis
cgcucugcgcggcau

SEQ ID NO: 2459633 - RNA, 14 nt, Bordetella pertussis
cgcucuugagcgcg

SEQ ID NO: 2459634 - RNA, 16 nt, Bordetella pertussis
cgcucuugagcgcggc

SEQ ID NO: 2459635 - RNA, 18 nt, Bordetella pertussis
cgcucuugagcgcggccu

SEQ ID NO: 2459636 - RNA, 19 nt, Bordetella pertussis
cgcucuugagcgcggccuc

SEQ ID NO: 2459637 - RNA, 23 nt, Bordetella pertussis
cgcucuugagcgcggccucgccg

SEQ ID NO: 2459638 - RNA, 16 nt, Bordetella pertussis
cgcucuugcgcgcgcc

SEQ ID NO: 2459639 - RNA, 17 nt, Bordetella pertussis
cgcucuugcgcgcgccg

SEQ ID NO: 2459640 - RNA, 23 nt, Bordetella pertussis
cgcucuuggcgugcuugccgccg

SEQ ID NO: 2459641 - RNA, 23 nt, Bordetella pertussis
cgcugaacguguaggucagcgcc

SEQ ID NO: 2459642 - RNA, 15 nt, Bordetella pertussis
cgcugaagcgccgcc

SEQ ID NO: 2459643 - RNA, 20 nt, Bordetella pertussis
cgcugaaggaccucgcgccg

SEQ ID NO: 2459644 - RNA, 21 nt, Bordetella pertussis
cgcugaaggaccucgcgccgg

SEQ ID NO: 2459645 - RNA, 17 nt, Bordetella pertussis
cgcuggcuucgucgccg

SEQ ID NO: 2459646 - RNA, 17 nt, Bordetella pertussis
cgcugggacaggcacac

SEQ ID NO: 2459647 - RNA, 20 nt, Bordetella pertussis
cgcugggacaggcacaccgg

SEQ ID NO: 2459648 - RNA, 17 nt, Bordetella pertussis
cgcugggauggguacgc

SEQ ID NO: 2459649 - RNA, 22 nt, Bordetella pertussis
cgcugggauggguacgccggcc

SEQ ID NO: 2459650 - RNA, 23 nt, Bordetella pertussis
cgcugggauggguacgccggccu

SEQ ID NO: 2459651 - RNA, 17 nt, Bordetella pertussis
cgcugggcacauccagc

SEQ ID NO: 2459652 - RNA, 23 nt, Bordetella pertussis
cgcugggcacauccagcgccagc

SEQ ID NO: 2459653 - RNA, 15 nt, Bordetella pertussis
cgcugggcaggcugg

SEQ ID NO: 2459654 - RNA, 19 nt, Bordetella pertussis
cgcugggcaggcuggcgcg

SEQ ID NO: 2459655 - RNA, 20 nt, Bordetella pertussis
cgcugggcaugggcggcccg

SEQ ID NO: 2459656 - RNA, 12 nt, Bordetella pertussis
cgcugggccaga

SEQ ID NO: 2459657 - RNA, 15 nt, Bordetella pertussis
cgcugggccagaccg

SEQ ID NO: 2459658 - RNA, 17 nt, Bordetella pertussis
cgcugggccagaccgcg

SEQ ID NO: 2459659 - RNA, 21 nt, Bordetella pertussis
cgcugggccagcaucggcacc

SEQ ID NO: 2459660 - RNA, 12 nt, Bordetella pertussis
cgcugggccagg

SEQ ID NO: 2459661 - RNA, 13 nt, Bordetella pertussis
cgcugggccaggc

SEQ ID NO: 2459662 - RNA, 15 nt, Bordetella pertussis
cgcugggccaggccg

SEQ ID NO: 2459663 - RNA, 19 nt, Bordetella pertussis
cgcugggcgaggcgcuggc

SEQ ID NO: 2459664 - RNA, 23 nt, Bordetella pertussis
cgcugggcgaggcgcuggccggc

SEQ ID NO: 2459665 - RNA, 14 nt, Bordetella pertussis
cgcugggcgccagc

SEQ ID NO: 2459666 - RNA, 15 nt, Bordetella pertussis
cgcugggcgccagca

SEQ ID NO: 2459667 - RNA, 16 nt, Bordetella pertussis
cgcugggcgccagcag

SEQ ID NO: 2459668 - RNA, 14 nt, Bordetella pertussis
cgcugggcgcugcu

SEQ ID NO: 2459669 - RNA, 15 nt, Bordetella pertussis
cgcugggcguggcgc

SEQ ID NO: 2459670 - RNA, 13 nt, Bordetella pertussis
cgcuggggcagca

SEQ ID NO: 2459671 - RNA, 22 nt, Bordetella pertussis
cgcugggucaggucgcugccca

SEQ ID NO: 2459672 - RNA, 21 nt, Bordetella pertussis
cgcuggguguagucgcggccg

SEQ ID NO: 2459673 - RNA, 18 nt, Bordetella pertussis
cgcugguaaagggcgcgg

SEQ ID NO: 2459674 - RNA, 17 nt, Bordetella pertussis
cgcugguaguaggccac

SEQ ID NO: 2459675 - RNA, 19 nt, Bordetella pertussis
cgcugguaguaggccacug

SEQ ID NO: 2459676 - RNA, 15 nt, Bordetella pertussis
cgcuggucaaccugg

SEQ ID NO: 2459677 - RNA, 14 nt, Bordetella pertussis
cgcuggucaccgcc

SEQ ID NO: 2459678 - RNA, 16 nt, Bordetella pertussis
cgcuggucaccgcccc

SEQ ID NO: 2459679 - RNA, 17 nt, Bordetella pertussis
cgcuggucaccgccccg

SEQ ID NO: 2459680 - RNA, 13 nt, Bordetella pertussis
cgcugguccgccg

SEQ ID NO: 2459681 - RNA, 15 nt, Bordetella pertussis
cgcugguccgccgcc

SEQ ID NO: 2459682 - RNA, 20 nt, Bordetella pertussis
cgcuggucgagagccugggc

SEQ ID NO: 2459683 - RNA, 21 nt, Bordetella pertussis
cgcuggucgagagccugggcg

SEQ ID NO: 2459684 - RNA, 14 nt, Bordetella pertussis
cgcuggucgcgcag

SEQ ID NO: 2459685 - RNA, 23 nt, Bordetella pertussis
cgcuggucgggaugccccgcccg

SEQ ID NO: 2459686 - RNA, 20 nt, Bordetella pertussis
cgcuggucguaucgccgcug

SEQ ID NO: 2459687 - RNA, 17 nt, Bordetella pertussis
cgcuggugcuggccgaa

SEQ ID NO: 2459688 - RNA, 17 nt, Bordetella pertussis
cgcugguggccaccagc

SEQ ID NO: 2459689 - RNA, 15 nt, Bordetella pertussis
cgcugguggccagau

SEQ ID NO: 2459690 - RNA, 21 nt, Bordetella pertussis
cgcuguacugguaccaggcgg

SEQ ID NO: 2459691 - RNA, 22 nt, Bordetella pertussis
cgcuguacugguaccaggcggc

SEQ ID NO: 2459692 - RNA, 20 nt, Bordetella pertussis
cgcuguagaggcgcggcucg

SEQ ID NO: 2459693 - RNA, 22 nt, Bordetella pertussis
cgcuguagaggcgcggcucgcc

SEQ ID NO: 2459694 - RNA, 14 nt, Bordetella pertussis
cgcuguaggcgccg

SEQ ID NO: 2459695 - RNA, 18 nt, Bordetella pertussis
cgcuguaggcgccggcgc

SEQ ID NO: 2459696 - RNA, 21 nt, Bordetella pertussis
cgcuguccaggccggggccgc

SEQ ID NO: 2459697 - RNA, 19 nt, Bordetella pertussis
cgcuguccgaugcgcugcu

SEQ ID NO: 2459698 - RNA, 14 nt, Bordetella pertussis
cgcuguccggcgcu

SEQ ID NO: 2459699 - RNA, 13 nt, Bordetella pertussis
cgcugucgcaggc

SEQ ID NO: 2459700 - RNA, 16 nt, Bordetella pertussis
cgcugucgcaggcgcu

SEQ ID NO: 2459701 - RNA, 13 nt, Bordetella pertussis
cgcugucgcgccc

SEQ ID NO: 2459702 - RNA, 15 nt, Bordetella pertussis
cgcugucgcgcccgg

SEQ ID NO: 2459703 - RNA, 20 nt, Bordetella pertussis
cgcugucggggugccguucg

SEQ ID NO: 2459704 - RNA, 15 nt, Bordetella pertussis
cgcugucggucagca

SEQ ID NO: 2459705 - RNA, 23 nt, Bordetella pertussis
cgcugucggucagcacuugccgg

SEQ ID NO: 2459706 - RNA, 13 nt, Bordetella pertussis
cgcugucgugccg

SEQ ID NO: 2459707 - RNA, 16 nt, Bordetella pertussis
cgcugucgugccgcac

SEQ ID NO: 2459708 - RNA, 21 nt, Bordetella pertussis
cgcugucgugccgcacggugg

SEQ ID NO: 2459709 - RNA, 20 nt, Bordetella pertussis
cgcugugcgacgauccggcg

SEQ ID NO: 2459710 - RNA, 12 nt, Bordetella pertussis
cgcuguggacgc

SEQ ID NO: 2459711 - RNA, 14 nt, Bordetella pertussis
cgcuguggacgccg

SEQ ID NO: 2459712 - RNA, 15 nt, Bordetella pertussis
cgcuguggacgccgc

SEQ ID NO: 2459713 - RNA, 17 nt, Bordetella pertussis
cgcuguggacgccgccg

SEQ ID NO: 2459714 - RNA, 18 nt, Bordetella pertussis
cgcuguggacgccgccgg

SEQ ID NO: 2459715 - RNA, 19 nt, Bordetella pertussis
cgcuguggacgccgccggc

SEQ ID NO: 2459716 - RNA, 14 nt, Bordetella pertussis
cgcuguggcgcgcc

SEQ ID NO: 2459717 - RNA, 14 nt, Bordetella pertussis
cgcuguuccagcca

SEQ ID NO: 2459718 - RNA, 18 nt, Bordetella pertussis
cgcuguucgauacggcca

SEQ ID NO: 2459719 - RNA, 20 nt, Bordetella pertussis
cgcuguucgauacggccacg

SEQ ID NO: 2459720 - RNA, 21 nt, Bordetella pertussis
cgcuguucgauacggccacgc

SEQ ID NO: 2459721 - RNA, 21 nt, Bordetella pertussis
cgcuguucgggcgcggugcgc

SEQ ID NO: 2459722 - RNA, 14 nt, Bordetella pertussis
cgcuguucggggca

SEQ ID NO: 2459723 - RNA, 15 nt, Bordetella pertussis
cgcuguucggggcag

SEQ ID NO: 2459724 - RNA, 21 nt, Bordetella pertussis
cgcuguucggggcagggcgcc

SEQ ID NO: 2459725 - RNA, 20 nt, Bordetella pertussis
cgcuguucuucggcaaccgc

SEQ ID NO: 2459726 - RNA, 22 nt, Bordetella pertussis
cgcuguucuucggcaaccgcgc

SEQ ID NO: 2459727 - RNA, 13 nt, Bordetella pertussis
cgcuguugaggau

SEQ ID NO: 2459728 - RNA, 16 nt, Bordetella pertussis
cgcuguugcccaccag

SEQ ID NO: 2459729 - RNA, 18 nt, Bordetella pertussis
cgcuguugcccaccagcc

SEQ ID NO: 2459730 - RNA, 19 nt, Bordetella pertussis
cgcuguugcuccaggccgg

SEQ ID NO: 2459731 - RNA, 21 nt, Bordetella pertussis
cgcuguugcuccaggccggca

SEQ ID NO: 2459732 - RNA, 23 nt, Bordetella pertussis
cgcuguugcuccaggccggcaug

SEQ ID NO: 2459733 - RNA, 15 nt, Bordetella pertussis
cgcuguuggccggcg

SEQ ID NO: 2459734 - RNA, 21 nt, Bordetella pertussis
cgcuguuggccggcgcgcccu

SEQ ID NO: 2459735 - RNA, 23 nt, Bordetella pertussis
cgcuguuggccggcgcgcccuug

SEQ ID NO: 2459736 - RNA, 13 nt, Bordetella pertussis
cgcuguuggccgu

SEQ ID NO: 2459737 - RNA, 18 nt, Bordetella pertussis
cgcuguuggucaggucga

SEQ ID NO: 2459738 - RNA, 23 nt, Bordetella pertussis
cgcuguuucccuuccuggccaau

SEQ ID NO: 2459739 - RNA, 14 nt, Bordetella pertussis
cgcuuaccgcgccg

SEQ ID NO: 2459740 - RNA, 20 nt, Bordetella pertussis
cgcuuacuggaucuuggccu

SEQ ID NO: 2459741 - RNA, 22 nt, Bordetella pertussis
cgcuuacuggaucuuggccugu

SEQ ID NO: 2459742 - RNA, 14 nt, Bordetella pertussis
cgcuuaucgcggcg

SEQ ID NO: 2459743 - RNA, 15 nt, Bordetella pertussis
cgcuuaucgcggcgc

SEQ ID NO: 2459744 - RNA, 17 nt, Bordetella pertussis
cgcuucacccuggaugc

SEQ ID NO: 2459745 - RNA, 19 nt, Bordetella pertussis
cgcuuccgagaaggcggug

SEQ ID NO: 2459746 - RNA, 15 nt, Bordetella pertussis
cgcuuccggcaugac

SEQ ID NO: 2459747 - RNA, 23 nt, Bordetella pertussis
cgcuuccggcaugaccgcggacg

SEQ ID NO: 2459748 - RNA, 15 nt, Bordetella pertussis
cgcuuccggccgggc

SEQ ID NO: 2459749 - RNA, 16 nt, Bordetella pertussis
cgcuuccucgaccagg

SEQ ID NO: 2459750 - RNA, 14 nt, Bordetella pertussis
cgcuuccugcugcg

SEQ ID NO: 2459751 - RNA, 12 nt, Bordetella pertussis
cgcuuccuuggg

SEQ ID NO: 2459752 - RNA, 14 nt, Bordetella pertussis
cgcuucggccugcg

SEQ ID NO: 2459753 - RNA, 22 nt, Bordetella pertussis
cgcuucggccugcgccaccagc

SEQ ID NO: 2459754 - RNA, 13 nt, Bordetella pertussis
cgcuucggcggcc

SEQ ID NO: 2459755 - RNA, 19 nt, Bordetella pertussis
cgcuucgggcagcucgcgc

SEQ ID NO: 2459756 - RNA, 20 nt, Bordetella pertussis
cgcuucgggcagcucgcgcg

SEQ ID NO: 2459757 - RNA, 22 nt, Bordetella pertussis
cgcuucgggcagcucgcgcgcu

SEQ ID NO: 2459758 - RNA, 13 nt, Bordetella pertussis
cgcuucgggccgg

SEQ ID NO: 2459759 - RNA, 15 nt, Bordetella pertussis
cgcuucgggccggau

SEQ ID NO: 2459760 - RNA, 18 nt, Bordetella pertussis
cggccaaggcauuggcgc

SEQ ID NO: 2459761 - RNA, 17 nt, Bordetella pertussis
cggccaaggccggcgcg

SEQ ID NO: 2459762 - RNA, 18 nt, Bordetella pertussis
cggccaaggccggcgcgu

SEQ ID NO: 2459763 - RNA, 17 nt, Bordetella pertussis
cggccaaucggccugcu

SEQ ID NO: 2459764 - RNA, 14 nt, Bordetella pertussis
cggccaauggccgg

SEQ ID NO: 2459765 - RNA, 16 nt, Bordetella pertussis
cggccaauggccggug

SEQ ID NO: 2459766 - RNA, 13 nt, Bordetella pertussis
cggccaccaccag

SEQ ID NO: 2459767 - RNA, 18 nt, Bordetella pertussis
cggccaccaccaggccca

SEQ ID NO: 2459768 - RNA, 15 nt, Bordetella pertussis
cggccaccaccaggu

SEQ ID NO: 2459769 - RNA, 14 nt, Bordetella pertussis
cggccaccagcggc

SEQ ID NO: 2459770 - RNA, 18 nt, Bordetella pertussis
cggccaccagcggcgccg

SEQ ID NO: 2459771 - RNA, 20 nt, Bordetella pertussis
cggccaccagcggcgccgga

SEQ ID NO: 2459772 - RNA, 22 nt, Bordetella pertussis
cggccaccagcguguagagcag

SEQ ID NO: 2459773 - RNA, 14 nt, Bordetella pertussis
cggccaccaggccg

SEQ ID NO: 2459774 - RNA, 15 nt, Bordetella pertussis
cggccaccaggccgu

SEQ ID NO: 2459775 - RNA, 19 nt, Bordetella pertussis
cggccaccaggccgucggc

SEQ ID NO: 2459776 - RNA, 15 nt, Bordetella pertussis
cggccaccaggcuga

SEQ ID NO: 2459777 - RNA, 18 nt, Bordetella pertussis
cggccacccggaucgaca

SEQ ID NO: 2459778 - RNA, 20 nt, Bordetella pertussis
cggccacccggaucgacagg

SEQ ID NO: 2459779 - RNA, 21 nt, Bordetella pertussis
cggccacccggaucgacagga

SEQ ID NO: 2459780 - RNA, 14 nt, Bordetella pertussis
cggccacccggccc

SEQ ID NO: 2459781 - RNA, 18 nt, Bordetella pertussis
cggccacccugccgugca

SEQ ID NO: 2459782 - RNA, 13 nt, Bordetella pertussis
cggccaccgccgu

SEQ ID NO: 2459783 - RNA, 17 nt, Bordetella pertussis
cggccaccgccguggca

SEQ ID NO: 2459784 - RNA, 20 nt, Bordetella pertussis
cggccaccgcguugagcgcc

SEQ ID NO: 2459785 - RNA, 22 nt, Bordetella pertussis
cggccaccgcguugagcgccga

SEQ ID NO: 2459786 - RNA, 22 nt, Bordetella pertussis
cggccaccucuucagcccggcg

SEQ ID NO: 2459787 - RNA, 23 nt, Bordetella pertussis
cggccaccucuucagcccggcgc

SEQ ID NO: 2459788 - RNA, 16 nt, Bordetella pertussis
cggccaccuggcgcaa

SEQ ID NO: 2459789 - RNA, 13 nt, Bordetella pertussis
cggccacgaccgg

SEQ ID NO: 2459790 - RNA, 23 nt, Bordetella pertussis
cggccacgaccggcucgaucgcc

SEQ ID NO: 2459791 - RNA, 23 nt, Bordetella pertussis
cggccacgauguugcgcaggcug

SEQ ID NO: 2459792 - RNA, 14 nt, Bordetella pertussis
cggccacgcagcgc

SEQ ID NO: 2459793 - RNA, 14 nt, Bordetella pertussis
cggccacgcccaag

SEQ ID NO: 2459794 - RNA, 13 nt, Bordetella pertussis
cggccacgcgccg

SEQ ID NO: 2459795 - RNA, 18 nt, Bordetella pertussis
cggccacgcgccgcccgg

SEQ ID NO: 2459796 - RNA, 19 nt, Bordetella pertussis
cggccacgcgccgcccggg

SEQ ID NO: 2459797 - RNA, 20 nt, Bordetella pertussis
cggccacgcgccgcccgggc

SEQ ID NO: 2459798 - RNA, 21 nt, Bordetella pertussis
cggccacgcgccgcccgggcc

SEQ ID NO: 2459799 - RNA, 18 nt, Bordetella pertussis
cggccacgcgcugcagca

SEQ ID NO: 2459800 - RNA, 13 nt, Bordetella pertussis
cggccacggccgg

SEQ ID NO: 2459801 - RNA, 14 nt, Bordetella pertussis
cggccacggccggc

SEQ ID NO: 2459802 - RNA, 21 nt, Bordetella pertussis
cggccacggccggcagcgccu

SEQ ID NO: 2459803 - RNA, 15 nt, Bordetella pertussis
cggccacggccgggc

SEQ ID NO: 2459804 - RNA, 16 nt, Bordetella pertussis
cggccacggccgggcc

SEQ ID NO: 2459805 - RNA, 16 nt, Bordetella pertussis
cggccacggccugccc

SEQ ID NO: 2459806 - RNA, 17 nt, Bordetella pertussis
cggccacggccugcccg

SEQ ID NO: 2459807 - RNA, 22 nt, Bordetella pertussis
cggccacggccugcccgggcgg

SEQ ID NO: 2459808 - RNA, 13 nt, Bordetella pertussis
cggccacggcugg

SEQ ID NO: 2459809 - RNA, 14 nt, Bordetella pertussis
cggccacgggaccg

SEQ ID NO: 2459810 - RNA, 14 nt, Bordetella pertussis
cggccacggucggc

SEQ ID NO: 2459811 - RNA, 13 nt, Bordetella pertussis
cggccacgucgcc

SEQ ID NO: 2459812 - RNA, 17 nt, Bordetella pertussis
cggccacgucgcccaca

SEQ ID NO: 2459813 - RNA, 15 nt, Bordetella pertussis
cggccacgucggcgg

SEQ ID NO: 2459814 - RNA, 18 nt, Bordetella pertussis
cggccacgucggcggccg

SEQ ID NO: 2459815 - RNA, 17 nt, Bordetella pertussis
cggccacgucggucgcu

SEQ ID NO: 2459816 - RNA, 18 nt, Bordetella pertussis
cggccacguguggcaggc

SEQ ID NO: 2459817 - RNA, 22 nt, Bordetella pertussis
cggccacguguggcaggccagc

SEQ ID NO: 2459818 - RNA, 17 nt, Bordetella pertussis
cggccacuuccuggugg

SEQ ID NO: 2459819 - RNA, 18 nt, Bordetella pertussis
cggccacuuccugguggg

SEQ ID NO: 2459820 - RNA, 23 nt, Bordetella pertussis
cggccacuuccuggugggcggca

SEQ ID NO: 2459821 - RNA, 14 nt, Bordetella pertussis
cggccacuucgcgg

SEQ ID NO: 2459822 - RNA, 17 nt, Bordetella pertussis
cggccacuucgcggccg

SEQ ID NO: 2459823 - RNA, 16 nt, Bordetella pertussis
cggccacuuucgcgcg

SEQ ID NO: 2459824 - RNA, 18 nt, Bordetella pertussis
cggccacuuucgcgcgcg

SEQ ID NO: 2459825 - RNA, 19 nt, Bordetella pertussis
cggccagaccuugcgcgac

SEQ ID NO: 2459826 - RNA, 20 nt, Bordetella pertussis
cggccagaccuugcgcgacg

SEQ ID NO: 2459827 - RNA, 21 nt, Bordetella pertussis
cggccagaccuugcgcgacgg

SEQ ID NO: 2459828 - RNA, 16 nt, Bordetella pertussis
cggccagagccuggaa

SEQ ID NO: 2459829 - RNA, 19 nt, Bordetella pertussis
cggccagagccuggaagug

SEQ ID NO: 2459830 - RNA, 12 nt, Bordetella pertussis
cggccagcaagc

SEQ ID NO: 2459831 - RNA, 17 nt, Bordetella pertussis
cggccagcaccggcccg

SEQ ID NO: 2459832 - RNA, 16 nt, Bordetella pertussis
cggccagcaccggccg

SEQ ID NO: 2459833 - RNA, 14 nt, Bordetella pertussis
cggccagcacgccg

SEQ ID NO: 2459834 - RNA, 15 nt, Bordetella pertussis
cggccagcacgggcg

SEQ ID NO: 2459835 - RNA, 13 nt, Bordetella pertussis
cggccagcagcac

SEQ ID NO: 2459836 - RNA, 14 nt, Bordetella pertussis
cggccagcagcacg

SEQ ID NO: 2459837 - RNA, 15 nt, Bordetella pertussis
cggccagcagcacga

SEQ ID NO: 2459838 - RNA, 12 nt, Bordetella pertussis
cggccagcagcg

SEQ ID NO: 2459839 - RNA, 15 nt, Bordetella pertussis
cggccagcagcgacg

SEQ ID NO: 2459840 - RNA, 13 nt, Bordetella pertussis
cggccagcagcgc

SEQ ID NO: 2459841 - RNA, 15 nt, Bordetella pertussis
cggccagcagcgccu

SEQ ID NO: 2459842 - RNA, 14 nt, Bordetella pertussis
cggccagcagcgcg

SEQ ID NO: 2459843 - RNA, 14 nt, Bordetella pertussis
cggccagcagcggc

SEQ ID NO: 2459844 - RNA, 17 nt, Bordetella pertussis
cggccagcagcggcagg

SEQ ID NO: 2459845 - RNA, 14 nt, Bordetella pertussis
cggccagcagcuug

SEQ ID NO: 2459846 - RNA, 15 nt, Bordetella pertussis
cggccagcagcuuga

SEQ ID NO: 2459847 - RNA, 18 nt, Bordetella pertussis
cggccagcaggagcccgc

SEQ ID NO: 2459848 - RNA, 19 nt, Bordetella pertussis
cggccagcaggagcccgcu

SEQ ID NO: 2459849 - RNA, 20 nt, Bordetella pertussis
cggccagcaggagcccgcug

SEQ ID NO: 2459850 - RNA, 22 nt, Bordetella pertussis
cggccagcaggagcccgcugcc

SEQ ID NO: 2459851 - RNA, 18 nt, Bordetella pertussis
cggccagcauacccugcg

SEQ ID NO: 2459852 - RNA, 20 nt, Bordetella pertussis
cggccagcauacccugcgcg

SEQ ID NO: 2459853 - RNA, 22 nt, Bordetella pertussis
cggccagcauacccugcgcgcc

SEQ ID NO: 2459854 - RNA, 23 nt, Bordetella pertussis
cggccagcauacccugcgcgccg

SEQ ID NO: 2459855 - RNA, 13 nt, Bordetella pertussis
cggccagcauuac

SEQ ID NO: 2459856 - RNA, 12 nt, Bordetella pertussis
cggccagccacg

SEQ ID NO: 2459857 - RNA, 18 nt, Bordetella pertussis
cggccagccacgccggcg

SEQ ID NO: 2459858 - RNA, 19 nt, Bordetella pertussis
cggccagccacgccggcgc

SEQ ID NO: 2459859 - RNA, 22 nt, Bordetella pertussis
cggccagccacgccggcgcgcc

SEQ ID NO: 2459860 - RNA, 14 nt, Bordetella pertussis
cggccagccggcgc

SEQ ID NO: 2459861 - RNA, 15 nt, Bordetella pertussis
cggccagccggcgcg

SEQ ID NO: 2459862 - RNA, 18 nt, Bordetella pertussis
cggccagccggcgcgcca

SEQ ID NO: 2459863 - RNA, 12 nt, Bordetella pertussis
cggccagccggg

SEQ ID NO: 2459864 - RNA, 15 nt, Bordetella pertussis
cggccagccgggugg

SEQ ID NO: 2459865 - RNA, 23 nt, Bordetella pertussis
cggccagccggguggucgcgccc

SEQ ID NO: 2459866 - RNA, 13 nt, Bordetella pertussis
cggccagccugcc

SEQ ID NO: 2459867 - RNA, 14 nt, Bordetella pertussis
cggccagccugccc

SEQ ID NO: 2459868 - RNA, 18 nt, Bordetella pertussis
cggccagccugccgcggc

SEQ ID NO: 2459869 - RNA, 14 nt, Bordetella pertussis
cggccagcgaggcc

SEQ ID NO: 2459870 - RNA, 12 nt, Bordetella pertussis
cggccagcgcca

SEQ ID NO: 2459871 - RNA, 14 nt, Bordetella pertussis
cggccagcgccagc

SEQ ID NO: 2459872 - RNA, 17 nt, Bordetella pertussis
cggccagcgccaguccg

SEQ ID NO: 2459873 - RNA, 13 nt, Bordetella pertussis
cggccagcgccga

SEQ ID NO: 2459874 - RNA, 20 nt, Bordetella pertussis
cggccagcgccgcgaacugg

SEQ ID NO: 2459875 - RNA, 16 nt, Bordetella pertussis
cggccagcgccgcgcc

SEQ ID NO: 2459876 - RNA, 18 nt, Bordetella pertussis
cggccagcgccgcgccgg

SEQ ID NO: 2459877 - RNA, 14 nt, Bordetella pertussis
cggccagcgccggc

SEQ ID NO: 2459878 - RNA, 16 nt, Bordetella pertussis
cggccagcgccggcgc

SEQ ID NO: 2459879 - RNA, 16 nt, Bordetella pertussis
cggccagcgccugggc

SEQ ID NO: 2459880 - RNA, 17 nt, Bordetella pertussis
cggccagcgccugggcg

SEQ ID NO: 2459881 - RNA, 23 nt, Bordetella pertussis
cggccagcgcgaaguaccagcgc

SEQ ID NO: 2459882 - RNA, 15 nt, Bordetella pertussis
cggccagcgcgacgg

SEQ ID NO: 2459883 - RNA, 13 nt, Bordetella pertussis
cggccagcgcgca

SEQ ID NO: 2459884 - RNA, 13 nt, Bordetella pertussis
cggccagcgcgcc

SEQ ID NO: 2459885 - RNA, 15 nt, Bordetella pertussis
cggccagcgcgcccu

SEQ ID NO: 2459886 - RNA, 14 nt, Bordetella pertussis
cggccagcgcgccg

SEQ ID NO: 2459887 - RNA, 22 nt, Bordetella pertussis
cggccagcgcgccgccagcgcg

SEQ ID NO: 2459888 - RNA, 19 nt, Bordetella pertussis
cggccagcgcgccggccag

SEQ ID NO: 2459889 - RNA, 20 nt, Bordetella pertussis
cggccagcgcgccggccagg

SEQ ID NO: 2459890 - RNA, 14 nt, Bordetella pertussis
cggccagcgcgcgc

SEQ ID NO: 2459891 - RNA, 15 nt, Bordetella pertussis
cggccagcgcgcggc

SEQ ID NO: 2459892 - RNA, 16 nt, Bordetella pertussis
cggccagcgcgcggcc

SEQ ID NO: 2459893 - RNA, 21 nt, Bordetella pertussis
cggccagcgcgcggccggccg

SEQ ID NO: 2459894 - RNA, 22 nt, Bordetella pertussis
cggccagcgcgcggccggccgc

SEQ ID NO: 2459895 - RNA, 17 nt, Bordetella pertussis
cggccagcgcgcggcgc

SEQ ID NO: 2459896 - RNA, 20 nt, Bordetella pertussis
cggccagcgcgcggcgcagc

SEQ ID NO: 2459897 - RNA, 14 nt, Bordetella pertussis
cggccagcgcgcgu

SEQ ID NO: 2459898 - RNA, 14 nt, Bordetella pertussis
cggccagcgcggca

SEQ ID NO: 2459899 - RNA, 15 nt, Bordetella pertussis
cggccagcgcggcgg

SEQ ID NO: 2459900 - RNA, 16 nt, Bordetella pertussis
cggccagcgcggcggc

SEQ ID NO: 2459901 - RNA, 15 nt, Bordetella pertussis
cggccagcgcggugu

SEQ ID NO: 2459902 - RNA, 14 nt, Bordetella pertussis
cggccagcgcgucg

SEQ ID NO: 2459903 - RNA, 20 nt, Bordetella pertussis
cggccagcgcgucgagcagc

SEQ ID NO: 2459904 - RNA, 22 nt, Bordetella pertussis
cggccagcgcgucgagcagcgc

SEQ ID NO: 2459905 - RNA, 22 nt, Bordetella pertussis
cggccagcggaugaugcggcgc

SEQ ID NO: 2459906 - RNA, 15 nt, Bordetella pertussis
cggccagcggcaggc

SEQ ID NO: 2459907 - RNA, 17 nt, Bordetella pertussis
cggccagcggcaggggc

SEQ ID NO: 2459908 - RNA, 15 nt, Bordetella pertussis
cggccagcggcgaaa

SEQ ID NO: 2459909 - RNA, 13 nt, Bordetella pertussis
cggccagcggcgc

SEQ ID NO: 2459910 - RNA, 14 nt, Bordetella pertussis
cggccagcggcgcu

SEQ ID NO: 2459911 - RNA, 14 nt, Bordetella pertussis
cggccagcgucagc

SEQ ID NO: 2459912 - RNA, 17 nt, Bordetella pertussis
cggccagcgucagcgca

SEQ ID NO: 2459913 - RNA, 22 nt, Bordetella pertussis
cggccagcucggcggccgccug

SEQ ID NO: 2459914 - RNA, 18 nt, Bordetella pertussis
cggccagcugcaugcgca

SEQ ID NO: 2459915 - RNA, 12 nt, Bordetella pertussis
cggccagcuuga

SEQ ID NO: 2459916 - RNA, 18 nt, Bordetella pertussis
cggccagcuuguagcggc

SEQ ID NO: 2459917 - RNA, 23 nt, Bordetella pertussis
cggccagcuuguagcggccaucg

SEQ ID NO: 2459918 - RNA, 19 nt, Bordetella pertussis
cggccaggaaagccggcgu

SEQ ID NO: 2459919 - RNA, 20 nt, Bordetella pertussis
cggccaggacgaucccggcc

SEQ ID NO: 2459920 - RNA, 13 nt, Bordetella pertussis
cggccaggacggc

SEQ ID NO: 2459921 - RNA, 14 nt, Bordetella pertussis
cggccaggacggca

SEQ ID NO: 2459922 - RNA, 15 nt, Bordetella pertussis
cggccaggacggcau

SEQ ID NO: 2459923 - RNA, 17 nt, Bordetella pertussis
cggccaggacggcaucu

SEQ ID NO: 2459924 - RNA, 15 nt, Bordetella pertussis
cggccaggacggugu

SEQ ID NO: 2459925 - RNA, 17 nt, Bordetella pertussis
cggccaggacggugucg

SEQ ID NO: 2459926 - RNA, 20 nt, Bordetella pertussis
cggccaggacggugucgcug

SEQ ID NO: 2459927 - RNA, 20 nt, Bordetella pertussis
cggccaggaucgcggccagc

SEQ ID NO: 2459928 - RNA, 13 nt, Bordetella pertussis
cggccaggauggc

SEQ ID NO: 2459929 - RNA, 18 nt, Bordetella pertussis
cggccaggcaaucgauga

SEQ ID NO: 2459930 - RNA, 15 nt, Bordetella pertussis
cggccaggcccaugc

SEQ ID NO: 2459931 - RNA, 20 nt, Bordetella pertussis
cggccaggcccaugccgccc

SEQ ID NO: 2459932 - RNA, 21 nt, Bordetella pertussis
cggccaggcccaugccgcccg

SEQ ID NO: 2459933 - RNA, 11 nt, Bordetella pertussis
cggccaggccg

SEQ ID NO: 2459934 - RNA, 12 nt, Bordetella pertussis
cggccaggccga

SEQ ID NO: 2459935 - RNA, 19 nt, Bordetella pertussis
cggccaggccgaacgcggu

SEQ ID NO: 2459936 - RNA, 15 nt, Bordetella pertussis
cggccaggccggccu

SEQ ID NO: 2459937 - RNA, 17 nt, Bordetella pertussis
cggccaggccggcgaaa

SEQ ID NO: 2459938 - RNA, 17 nt, Bordetella pertussis
cggccaggccggcgcgc

SEQ ID NO: 2459939 - RNA, 19 nt, Bordetella pertussis
cggccaggccggcgcgccg

SEQ ID NO: 2459940 - RNA, 16 nt, Bordetella pertussis
cggccgauagccguga

SEQ ID NO: 2459941 - RNA, 18 nt, Bordetella pertussis
cggccgauagccgugacc

SEQ ID NO: 2459942 - RNA, 13 nt, Bordetella pertussis
cggccgaucgcgc

SEQ ID NO: 2459943 - RNA, 18 nt, Bordetella pertussis
cggccgaugacaucgccg

SEQ ID NO: 2459944 - RNA, 20 nt, Bordetella pertussis
cggccgaugacaucgccgcu

SEQ ID NO: 2459945 - RNA, 21 nt, Bordetella pertussis
cggccgaugacaucgccgcug

SEQ ID NO: 2459946 - RNA, 22 nt, Bordetella pertussis
cggccgaugacaucgccgcugc

SEQ ID NO: 2459947 - RNA, 22 nt, Bordetella pertussis
cggccgauggcaucgccccgga

SEQ ID NO: 2459948 - RNA, 19 nt, Bordetella pertussis
cggccgauguuuuccuggg

SEQ ID NO: 2459949 - RNA, 20 nt, Bordetella pertussis
cggccgauguuuuccuggga

SEQ ID NO: 2459950 - RNA, 14 nt, Bordetella pertussis
cggccgcaagcugg

SEQ ID NO: 2459951 - RNA, 17 nt, Bordetella pertussis
cggccgcaagcuggccg

SEQ ID NO: 2459952 - RNA, 16 nt, Bordetella pertussis
cggccgcacgcggccg

SEQ ID NO: 2459953 - RNA, 22 nt, Bordetella pertussis
cggccgcacgcggccgcgggcc

SEQ ID NO: 2459954 - RNA, 12 nt, Bordetella pertussis
cggccgcagcag

SEQ ID NO: 2459955 - RNA, 19 nt, Bordetella pertussis
cggccgcagggcgugcggg

SEQ ID NO: 2459956 - RNA, 17 nt, Bordetella pertussis
cggccgcauggcggccc

SEQ ID NO: 2459957 - RNA, 21 nt, Bordetella pertussis
cggccgcauugggacgcggcc

SEQ ID NO: 2459958 - RNA, 20 nt, Bordetella pertussis
cggccgccacccaggcggca

SEQ ID NO: 2459959 - RNA, 16 nt, Bordetella pertussis
cggccgccaccugggc

SEQ ID NO: 2459960 - RNA, 22 nt, Bordetella pertussis
cggccgccaccugggccgccug

SEQ ID NO: 2459961 - RNA, 14 nt, Bordetella pertussis
cggccgccacgccc

SEQ ID NO: 2459962 - RNA, 14 nt, Bordetella pertussis
cggccgccagccac

SEQ ID NO: 2459963 - RNA, 18 nt, Bordetella pertussis
cggccgccagccaccccg

SEQ ID NO: 2459964 - RNA, 14 nt, Bordetella pertussis
cggccgccagcccg

SEQ ID NO: 2459965 - RNA, 15 nt, Bordetella pertussis
cggccgccagccggc

SEQ ID NO: 2459966 - RNA, 18 nt, Bordetella pertussis
cggccgccagccggccca

SEQ ID NO: 2459967 - RNA, 20 nt, Bordetella pertussis
cggccgccagccggcccagc

SEQ ID NO: 2459968 - RNA, 14 nt, Bordetella pertussis
cggccgccagcgcc

SEQ ID NO: 2459969 - RNA, 15 nt, Bordetella pertussis
cggccgccagcgcca

SEQ ID NO: 2459970 - RNA, 12 nt, Bordetella pertussis
cggccgccaggu

SEQ ID NO: 2459971 - RNA, 14 nt, Bordetella pertussis
cggccgccagguag

SEQ ID NO: 2459972 - RNA, 15 nt, Bordetella pertussis
cggccgccaggucgg

SEQ ID NO: 2459973 - RNA, 16 nt, Bordetella pertussis
cggccgccaggucggc

SEQ ID NO: 2459974 - RNA, 20 nt, Bordetella pertussis
cggccgccaggucggccacc

SEQ ID NO: 2459975 - RNA, 18 nt, Bordetella pertussis
cggccgccauggccggcg

SEQ ID NO: 2459976 - RNA, 14 nt, Bordetella pertussis
cggccgcccacggc

SEQ ID NO: 2459977 - RNA, 14 nt, Bordetella pertussis
cggccgcccagcag

SEQ ID NO: 2459978 - RNA, 18 nt, Bordetella pertussis
cggccgcccaggcgcagc

SEQ ID NO: 2459979 - RNA, 17 nt, Bordetella pertussis
cggccgcccccagcgcg

SEQ ID NO: 2459980 - RNA, 19 nt, Bordetella pertussis
cggccgcccccagcgcgcc

SEQ ID NO: 2459981 - RNA, 20 nt, Bordetella pertussis
cggccgcccccagcgcgccu

SEQ ID NO: 2459982 - RNA, 17 nt, Bordetella pertussis
cggccgcccgccugccg

SEQ ID NO: 2459983 - RNA, 12 nt, Bordetella pertussis
cggccgcccggc

SEQ ID NO: 2459984 - RNA, 15 nt, Bordetella pertussis
cggccgccgaacgag

SEQ ID NO: 2459985 - RNA, 16 nt, Bordetella pertussis
cggccgccgcaugccg

SEQ ID NO: 2459986 - RNA, 17 nt, Bordetella pertussis
cggccgccgcaugccgg

SEQ ID NO: 2459987 - RNA, 14 nt, Bordetella pertussis
cggccgccgcccgc

SEQ ID NO: 2459988 - RNA, 15 nt, Bordetella pertussis
cggccgccgcccgcc

SEQ ID NO: 2459989 - RNA, 13 nt, Bordetella pertussis
cggccgccgccgg

SEQ ID NO: 2459990 - RNA, 13 nt, Bordetella pertussis
cggccgccggcga

SEQ ID NO: 2459991 - RNA, 14 nt, Bordetella pertussis
cggccgccggcgag

SEQ ID NO: 2459992 - RNA, 21 nt, Bordetella pertussis
cggccgccggcgagacgucgg

SEQ ID NO: 2459993 - RNA, 13 nt, Bordetella pertussis
cggccgccggcgg

SEQ ID NO: 2459994 - RNA, 15 nt, Bordetella pertussis
cggccgccggcggca

SEQ ID NO: 2459995 - RNA, 12 nt, Bordetella pertussis
cggccgccgggc

SEQ ID NO: 2459996 - RNA, 19 nt, Bordetella pertussis
cggccgccgggccgcgacc

SEQ ID NO: 2459997 - RNA, 21 nt, Bordetella pertussis
cggccgccucaccgcgccggg

SEQ ID NO: 2459998 - RNA, 18 nt, Bordetella pertussis
cggccgccuccaggcggc

SEQ ID NO: 2459999 - RNA, 20 nt, Bordetella pertussis
cgcuucgggccggauggccg

SEQ ID NO: 2460000 - RNA, 15 nt, Bordetella pertussis
cgcuucgguggcgcg

SEQ ID NO: 2460001 - RNA, 18 nt, Bordetella pertussis
cgcuucguccugaucgag

SEQ ID NO: 2460002 - RNA, 13 nt, Bordetella pertussis
cgcuucgucggcc

SEQ ID NO: 2460003 - RNA, 16 nt, Bordetella pertussis
cgcuucgucggcgucg

SEQ ID NO: 2460004 - RNA, 18 nt, Bordetella pertussis
cgcuucgucgggcagcgc

SEQ ID NO: 2460005 - RNA, 21 nt, Bordetella pertussis
cgcuucgucgggcagcgcggc

SEQ ID NO: 2460006 - RNA, 15 nt, Bordetella pertussis
cgcuucgugcggccg

SEQ ID NO: 2460007 - RNA, 21 nt, Bordetella pertussis
cgcuucucacugcccgcgccg

SEQ ID NO: 2460008 - RNA, 17 nt, Bordetella pertussis
cgcuucucggugcgccg

SEQ ID NO: 2460009 - RNA, 21 nt, Bordetella pertussis
cgcuucucggugcgccgccgc

SEQ ID NO: 2460010 - RNA, 19 nt, Bordetella pertussis
cgcuucugccagacggcca

SEQ ID NO: 2460011 - RNA, 21 nt, Bordetella pertussis
cgcuucugccagacggccagc

SEQ ID NO: 2460012 - RNA, 17 nt, Bordetella pertussis
cgcuucuucgucgcgcc

SEQ ID NO: 2460013 - RNA, 18 nt, Bordetella pertussis
cgcuugaacuccgcggcg

SEQ ID NO: 2460014 - RNA, 16 nt, Bordetella pertussis
cgcuugaccgccucga

SEQ ID NO: 2460015 - RNA, 14 nt, Bordetella pertussis
cgcuugacggccaa

SEQ ID NO: 2460016 - RNA, 15 nt, Bordetella pertussis
cgcuugacggccagg

SEQ ID NO: 2460017 - RNA, 16 nt, Bordetella pertussis
cgcuugacguccagcg

SEQ ID NO: 2460018 - RNA, 18 nt, Bordetella pertussis
cgcuugaggcuggugacc

SEQ ID NO: 2460019 - RNA, 22 nt, Bordetella pertussis
cgcuugcccgucaugcgccgca

SEQ ID NO: 2460020 - RNA, 20 nt, Bordetella pertussis
cgcuugcccgugccuugccg

SEQ ID NO: 2460021 - RNA, 19 nt, Bordetella pertussis
cgcuugccgaccuccaggc

SEQ ID NO: 2460022 - RNA, 21 nt, Bordetella pertussis
cgcuugccgaccuccaggccc

SEQ ID NO: 2460023 - RNA, 13 nt, Bordetella pertussis
cgcuugccgccca

SEQ ID NO: 2460024 - RNA, 17 nt, Bordetella pertussis
cgcuugcgcagggcggg

SEQ ID NO: 2460025 - RNA, 18 nt, Bordetella pertussis
cgcuugcgcagggcgggc

SEQ ID NO: 2460026 - RNA, 12 nt, Bordetella pertussis
cgcuugcgcaug

SEQ ID NO: 2460027 - RNA, 18 nt, Bordetella pertussis
cgcuugcgcauggccggu

SEQ ID NO: 2460028 - RNA, 13 nt, Bordetella pertussis
cgcuugcgcgcca

SEQ ID NO: 2460029 - RNA, 19 nt, Bordetella pertussis
cgcuugcgcgccacgucga

SEQ ID NO: 2460030 - RNA, 23 nt, Bordetella pertussis
cgcuugcgcgccacgucgaccuc

SEQ ID NO: 2460031 - RNA, 20 nt, Bordetella pertussis
cgcuugcggccggcgcugau

SEQ ID NO: 2460032 - RNA, 16 nt, Bordetella pertussis
cgcuugcggccgucga

SEQ ID NO: 2460033 - RNA, 15 nt, Bordetella pertussis
cgcuuggaccccgug

SEQ ID NO: 2460034 - RNA, 14 nt, Bordetella pertussis
cgcuuggcaggcgu

SEQ ID NO: 2460035 - RNA, 16 nt, Bordetella pertussis
cgcuuggcaggcgucu

SEQ ID NO: 2460036 - RNA, 23 nt, Bordetella pertussis
cgcuuggcccugcagcggccagu

SEQ ID NO: 2460037 - RNA, 13 nt, Bordetella pertussis
cgcuuggccugcg

SEQ ID NO: 2460038 - RNA, 14 nt, Bordetella pertussis
cgcuugggccgcgc

SEQ ID NO: 2460039 - RNA, 16 nt, Bordetella pertussis
cgcuugggccgcgccu

SEQ ID NO: 2460040 - RNA, 20 nt, Bordetella pertussis
cgcuugucgaugacgcgccg

SEQ ID NO: 2460041 - RNA, 15 nt, Bordetella pertussis
cgcuugucgccgcug

SEQ ID NO: 2460042 - RNA, 18 nt, Bordetella pertussis
cgcuugugcgucggcucg

SEQ ID NO: 2460043 - RNA, 20 nt, Bordetella pertussis
cgcuuucggggcgcaagauc

SEQ ID NO: 2460044 - RNA, 14 nt, Bordetella pertussis
cgcuuuuccccgcc

SEQ ID NO: 2460045 - RNA, 14 nt, Bordetella pertussis
cgcuuuuuccugcu

SEQ ID NO: 2460046 - RNA, 19 nt, Bordetella pertussis
cgcuuuuuucuccagcgcc

SEQ ID NO: 2460047 - RNA, 20 nt, Bordetella pertussis
cgcuuuuuucuccagcgcca

SEQ ID NO: 2460048 - RNA, 22 nt, Bordetella pertussis
cgcuuuuuucuccagcgccagc

SEQ ID NO: 2460049 - RNA, 15 nt, Bordetella pertussis
cggaaaacagcacca

SEQ ID NO: 2460050 - RNA, 23 nt, Bordetella pertussis
cggaaaacagcaccagcaugcgc

SEQ ID NO: 2460051 - RNA, 20 nt, Bordetella pertussis
cggaaacacguccagcgccg

SEQ ID NO: 2460052 - RNA, 14 nt, Bordetella pertussis
cggaaacgcccagc

SEQ ID NO: 2460053 - RNA, 19 nt, Bordetella pertussis
cggaaacggaaacugccau

SEQ ID NO: 2460054 - RNA, 19 nt, Bordetella pertussis
cggaaacuggcuaaaagga

SEQ ID NO: 2460055 - RNA, 22 nt, Bordetella pertussis
cggaaacuggcuaaaaggaaau

SEQ ID NO: 2460056 - RNA, 17 nt, Bordetella pertussis
cggaaagcuggcguucg

SEQ ID NO: 2460057 - RNA, 18 nt, Bordetella pertussis
cggaaauccguaguccag

SEQ ID NO: 2460058 - RNA, 22 nt, Bordetella pertussis
cggaaauccguaguccagcagc

SEQ ID NO: 2460059 - RNA, 20 nt, Bordetella pertussis
cggaaaugccgcgcgcaggg

SEQ ID NO: 2460060 - RNA, 22 nt, Bordetella pertussis
cggaaaugccgcgcgcagggcg

SEQ ID NO: 2460061 - RNA, 19 nt, Bordetella pertussis
cggaacaccagcaagccgg

SEQ ID NO: 2460062 - RNA, 18 nt, Bordetella pertussis
cggaacagccuggucagg

SEQ ID NO: 2460063 - RNA, 12 nt, Bordetella pertussis
cggaacauggcg

SEQ ID NO: 2460064 - RNA, 23 nt, Bordetella pertussis
cggaacauggcggugaaggcgcc

SEQ ID NO: 2460065 - RNA, 15 nt, Bordetella pertussis
cggaacgugccgucg

SEQ ID NO: 2460066 - RNA, 18 nt, Bordetella pertussis
cggaagagggcggggcgu

SEQ ID NO: 2460067 - RNA, 19 nt, Bordetella pertussis
cggaaguauucgcgcggcg

SEQ ID NO: 2460068 - RNA, 19 nt, Bordetella pertussis
cggaauaccgccagcucgg

SEQ ID NO: 2460069 - RNA, 16 nt, Bordetella pertussis
cggaauagauaugggc

SEQ ID NO: 2460070 - RNA, 23 nt, Bordetella pertussis
cggaauccuggcgacggccugcc

SEQ ID NO: 2460071 - RNA, 22 nt, Bordetella pertussis
cggaauggggcccgcauccuuc

SEQ ID NO: 2460072 - RNA, 19 nt, Bordetella pertussis
cggaauuggcggcgaucuc

SEQ ID NO: 2460073 - RNA, 13 nt, Bordetella pertussis
cggacaacgcgcg

SEQ ID NO: 2460074 - RNA, 14 nt, Bordetella pertussis
cggacaacgcgcgc

SEQ ID NO: 2460075 - RNA, 15 nt, Bordetella pertussis
cggacaacgcgcgcc

SEQ ID NO: 2460076 - RNA, 14 nt, Bordetella pertussis
cggacaagccccuc

SEQ ID NO: 2460077 - RNA, 15 nt, Bordetella pertussis
cggacacgcaugcag

SEQ ID NO: 2460078 - RNA, 14 nt, Bordetella pertussis
cggacacgcccugg

SEQ ID NO: 2460079 - RNA, 20 nt, Bordetella pertussis
cggacacguacaaccgcgcc

SEQ ID NO: 2460080 - RNA, 21 nt, Bordetella pertussis
cggacacguacaaccgcgccg

SEQ ID NO: 2460081 - RNA, 19 nt, Bordetella pertussis
cggacagaugccguccugg

SEQ ID NO: 2460082 - RNA, 20 nt, Bordetella pertussis
cggacagaugccguccuggc

SEQ ID NO: 2460083 - RNA, 13 nt, Bordetella pertussis
cggacagcccgcg

SEQ ID NO: 2460084 - RNA, 17 nt, Bordetella pertussis
cggacaggucggcgccc

SEQ ID NO: 2460085 - RNA, 19 nt, Bordetella pertussis
cggacaggucggcgcccac

SEQ ID NO: 2460086 - RNA, 22 nt, Bordetella pertussis
cggaccacacgaucgucagcag

SEQ ID NO: 2460087 - RNA, 18 nt, Bordetella pertussis
cggaccagcgguugcgcc

SEQ ID NO: 2460088 - RNA, 21 nt, Bordetella pertussis
cggaccagcgguugcgccagc

SEQ ID NO: 2460089 - RNA, 17 nt, Bordetella pertussis
cggacccaggccucggc

SEQ ID NO: 2460090 - RNA, 17 nt, Bordetella pertussis
cggacccaguucggccg

SEQ ID NO: 2460091 - RNA, 16 nt, Bordetella pertussis
cggacccgcgccgcag

SEQ ID NO: 2460092 - RNA, 20 nt, Bordetella pertussis
cggaccgcugugcgcguucc

SEQ ID NO: 2460093 - RNA, 18 nt, Bordetella pertussis
cggaccugcucgagcggc

SEQ ID NO: 2460094 - RNA, 16 nt, Bordetella pertussis
cggaccuugcgaggcc

SEQ ID NO: 2460095 - RNA, 13 nt, Bordetella pertussis
cggacgaagccua

SEQ ID NO: 2460096 - RNA, 14 nt, Bordetella pertussis
cggacgaagccuag

SEQ ID NO: 2460097 - RNA, 15 nt, Bordetella pertussis
cggacgagacaggcg

SEQ ID NO: 2460098 - RNA, 16 nt, Bordetella pertussis
cggacgagacaggcgc

SEQ ID NO: 2460099 - RNA, 17 nt, Bordetella pertussis
cggacgagacaggcgcg

SEQ ID NO: 2460100 - RNA, 19 nt, Bordetella pertussis
cggacgagacaggcgcgcc

SEQ ID NO: 2460101 - RNA, 20 nt, Bordetella pertussis
cggacgagacaggcgcgcca

SEQ ID NO: 2460102 - RNA, 16 nt, Bordetella pertussis
cggacgagcgcagcaa

SEQ ID NO: 2460103 - RNA, 22 nt, Bordetella pertussis
cggacgauguagaucuggcgcg

SEQ ID NO: 2460104 - RNA, 23 nt, Bordetella pertussis
cggacgauguagaucuggcgcgu

SEQ ID NO: 2460105 - RNA, 20 nt, Bordetella pertussis
cggacgcaaaaacgcccggc

SEQ ID NO: 2460106 - RNA, 23 nt, Bordetella pertussis
cggacgcaaccggucggccggca

SEQ ID NO: 2460107 - RNA, 21 nt, Bordetella pertussis
cggacgcaccuuucugcugcu

SEQ ID NO: 2460108 - RNA, 14 nt, Bordetella pertussis
cggacgccagcccu

SEQ ID NO: 2460109 - RNA, 19 nt, Bordetella pertussis
cggacgccagcccugggug

SEQ ID NO: 2460110 - RNA, 14 nt, Bordetella pertussis
cggacgccauggcg

SEQ ID NO: 2460111 - RNA, 16 nt, Bordetella pertussis
cggacgccauggcggc

SEQ ID NO: 2460112 - RNA, 23 nt, Bordetella pertussis
cggacgccauggcggcggccacg

SEQ ID NO: 2460113 - RNA, 15 nt, Bordetella pertussis
cggccgccugcgccg

SEQ ID NO: 2460114 - RNA, 15 nt, Bordetella pertussis
cggccgccuggccca

SEQ ID NO: 2460115 - RNA, 19 nt, Bordetella pertussis
cggccgccuugacgguggc

SEQ ID NO: 2460116 - RNA, 14 nt, Bordetella pertussis
cggccgcgcaaggc

SEQ ID NO: 2460117 - RNA, 14 nt, Bordetella pertussis
cggccgcgcaccug

SEQ ID NO: 2460118 - RNA, 21 nt, Bordetella pertussis
cggccgcgcaccugcugcggc

SEQ ID NO: 2460119 - RNA, 23 nt, Bordetella pertussis
cggccgcgcaggauuucaucgcc

SEQ ID NO: 2460120 - RNA, 12 nt, Bordetella pertussis
cggccgcgccca

SEQ ID NO: 2460121 - RNA, 14 nt, Bordetella pertussis
cggccgcgcccagc

SEQ ID NO: 2460122 - RNA, 15 nt, Bordetella pertussis
cggccgcgcccaggu

SEQ ID NO: 2460123 - RNA, 21 nt, Bordetella pertussis
cggccgcgcccgcaacgggcc

SEQ ID NO: 2460124 - RNA, 23 nt, Bordetella pertussis
cggccgcgcccgcaacgggccgg

SEQ ID NO: 2460125 - RNA, 17 nt, Bordetella pertussis
cggccgcgccgccgccc

SEQ ID NO: 2460126 - RNA, 14 nt, Bordetella pertussis
cggccgcgcgcgcc

SEQ ID NO: 2460127 - RNA, 15 nt, Bordetella pertussis
cggccgcgcgcgcca

SEQ ID NO: 2460128 - RNA, 18 nt, Bordetella pertussis
cggccgcgcgcgccaugu

SEQ ID NO: 2460129 - RNA, 16 nt, Bordetella pertussis
cggccgcgcgggcggc

SEQ ID NO: 2460130 - RNA, 20 nt, Bordetella pertussis
cggccgcgcuggcgcuggcc

SEQ ID NO: 2460131 - RNA, 17 nt, Bordetella pertussis
cggccgcggccggcacg

SEQ ID NO: 2460132 - RNA, 18 nt, Bordetella pertussis
cggccgcggccggcacgc

SEQ ID NO: 2460133 - RNA, 22 nt, Bordetella pertussis
cggccgcggcguugcggcagcg

SEQ ID NO: 2460134 - RNA, 14 nt, Bordetella pertussis
cggccgcgggcagc

SEQ ID NO: 2460135 - RNA, 15 nt, Bordetella pertussis
cggccgcgggcagca

SEQ ID NO: 2460136 - RNA, 17 nt, Bordetella pertussis
cggccgcgggcagcaau

SEQ ID NO: 2460137 - RNA, 14 nt, Bordetella pertussis
cggccgcgggcggc

SEQ ID NO: 2460138 - RNA, 17 nt, Bordetella pertussis
cggccgcgggcgugcug

SEQ ID NO: 2460139 - RNA, 20 nt, Bordetella pertussis
cggccgcggggcuggccagc

SEQ ID NO: 2460140 - RNA, 13 nt, Bordetella pertussis
cggccgcgggugg

SEQ ID NO: 2460141 - RNA, 14 nt, Bordetella pertussis
cggccgcggguggc

SEQ ID NO: 2460142 - RNA, 15 nt, Bordetella pertussis
cggccgcggucagcc

SEQ ID NO: 2460143 - RNA, 17 nt, Bordetella pertussis
cggccgcggucagccag

SEQ ID NO: 2460144 - RNA, 22 nt, Bordetella pertussis
cggccgcgucauacgacgcggc

SEQ ID NO: 2460145 - RNA, 13 nt, Bordetella pertussis
cggccgcguccag

SEQ ID NO: 2460146 - RNA, 15 nt, Bordetella pertussis
cggccgcguccagcg

SEQ ID NO: 2460147 - RNA, 17 nt, Bordetella pertussis
cggccgcguccagcgcg

SEQ ID NO: 2460148 - RNA, 19 nt, Bordetella pertussis
cggccgcgucggccucauc

SEQ ID NO: 2460149 - RNA, 18 nt, Bordetella pertussis
cggccgcguggccgcgcu

SEQ ID NO: 2460150 - RNA, 17 nt, Bordetella pertussis
cggccgcuccgccaugg

SEQ ID NO: 2460151 - RNA, 14 nt, Bordetella pertussis
cggccgcugccgcg

SEQ ID NO: 2460152 - RNA, 16 nt, Bordetella pertussis
cggccgcugccgcgcg

SEQ ID NO: 2460153 - RNA, 18 nt, Bordetella pertussis
cggccgcugccgcgcgcc

SEQ ID NO: 2460154 - RNA, 16 nt, Bordetella pertussis
cggccgcuugucgaug

SEQ ID NO: 2460155 - RNA, 22 nt, Bordetella pertussis
cggccgcuugucgaugacgcgc

SEQ ID NO: 2460156 - RNA, 13 nt, Bordetella pertussis
cggccggacaggg

SEQ ID NO: 2460157 - RNA, 21 nt, Bordetella pertussis
cggccggacagggccgcgagc

SEQ ID NO: 2460158 - RNA, 15 nt, Bordetella pertussis
cggccggaggccgcc

SEQ ID NO: 2460159 - RNA, 21 nt, Bordetella pertussis
cggccggauccagcugcgaaa

SEQ ID NO: 2460160 - RNA, 17 nt, Bordetella pertussis
cggccggaugcgcagga

SEQ ID NO: 2460161 - RNA, 23 nt, Bordetella pertussis
cggccggaugcgcaggacggcgc

SEQ ID NO: 2460162 - RNA, 23 nt, Bordetella pertussis
cggccggcaaggggccagccugg

SEQ ID NO: 2460163 - RNA, 19 nt, Bordetella pertussis
cggccggcaaggugaucga

SEQ ID NO: 2460164 - RNA, 23 nt, Bordetella pertussis
cggccggcaccaggauccccagc

SEQ ID NO: 2460165 - RNA, 19 nt, Bordetella pertussis
cggccggcacgcccagccg

SEQ ID NO: 2460166 - RNA, 14 nt, Bordetella pertussis
cggccggcacgccg

SEQ ID NO: 2460167 - RNA, 23 nt, Bordetella pertussis
cggccggcacgccgaugaacgac

SEQ ID NO: 2460168 - RNA, 14 nt, Bordetella pertussis
cggccggcacggcc

SEQ ID NO: 2460169 - RNA, 12 nt, Bordetella pertussis
cggccggcagcg

SEQ ID NO: 2460170 - RNA, 13 nt, Bordetella pertussis
cggccggcagcgc

SEQ ID NO: 2460171 - RNA, 14 nt, Bordetella pertussis
cggccggcagcgcc

SEQ ID NO: 2460172 - RNA, 15 nt, Bordetella pertussis
cggccggcagcgccu

SEQ ID NO: 2460173 - RNA, 15 nt, Bordetella pertussis
cggccggcagcgcga

SEQ ID NO: 2460174 - RNA, 16 nt, Bordetella pertussis
cggccggcagcgcgac

SEQ ID NO: 2460175 - RNA, 17 nt, Bordetella pertussis
cggccggcagcgcgacc

SEQ ID NO: 2460176 - RNA, 18 nt, Bordetella pertussis
cggccggcagcgcgaccg

SEQ ID NO: 2460177 - RNA, 14 nt, Bordetella pertussis
cggccggcagcggc

SEQ ID NO: 2460178 - RNA, 16 nt, Bordetella pertussis
cggccggcagcggcgc

SEQ ID NO: 2460179 - RNA, 17 nt, Bordetella pertussis
cggccggcagcggcgcc

SEQ ID NO: 2460180 - RNA, 14 nt, Bordetella pertussis
cggccggcaggccg

SEQ ID NO: 2460181 - RNA, 16 nt, Bordetella pertussis
cggccggcaggccggc

SEQ ID NO: 2460182 - RNA, 17 nt, Bordetella pertussis
cggccggcaggccggcc

SEQ ID NO: 2460183 - RNA, 13 nt, Bordetella pertussis
cggccggccaggc

SEQ ID NO: 2460184 - RNA, 15 nt, Bordetella pertussis
cggccggccaggcgc

SEQ ID NO: 2460185 - RNA, 17 nt, Bordetella pertussis
cggccggccaggcgccg

SEQ ID NO: 2460186 - RNA, 13 nt, Bordetella pertussis
cggccggccagua

SEQ ID NO: 2460187 - RNA, 19 nt, Bordetella pertussis
cggccggcccgugcgcaac

SEQ ID NO: 2460188 - RNA, 14 nt, Bordetella pertussis
cggccggccgcgcc

SEQ ID NO: 2460189 - RNA, 22 nt, Bordetella pertussis
cggccggccgcgcccaugcgcu

SEQ ID NO: 2460190 - RNA, 13 nt, Bordetella pertussis
cggccggccugca

SEQ ID NO: 2460191 - RNA, 13 nt, Bordetella pertussis
cggccggccugcu

SEQ ID NO: 2460192 - RNA, 15 nt, Bordetella pertussis
cggccggccugcuug

SEQ ID NO: 2460193 - RNA, 17 nt, Bordetella pertussis
cggccggcgcacgccgg

SEQ ID NO: 2460194 - RNA, 20 nt, Bordetella pertussis
cggccggcgcacgccggacc

SEQ ID NO: 2460195 - RNA, 12 nt, Bordetella pertussis
cggccggcgcgc

SEQ ID NO: 2460196 - RNA, 13 nt, Bordetella pertussis
cggccggcgcgcc

SEQ ID NO: 2460197 - RNA, 14 nt, Bordetella pertussis
cggccggcgcgcgc

SEQ ID NO: 2460198 - RNA, 15 nt, Bordetella pertussis
cggccggcgcgcgcg

SEQ ID NO: 2460199 - RNA, 14 nt, Bordetella pertussis
cggccggcggcgcc

SEQ ID NO: 2460200 - RNA, 18 nt, Bordetella pertussis
cggccggcguugcgcccu

SEQ ID NO: 2460201 - RNA, 14 nt, Bordetella pertussis
cggccggcuccgcu

SEQ ID NO: 2460202 - RNA, 18 nt, Bordetella pertussis
cggccggcugcaccagcg

SEQ ID NO: 2460203 - RNA, 19 nt, Bordetella pertussis
cggccggcugcaccagcgc

SEQ ID NO: 2460204 - RNA, 17 nt, Bordetella pertussis
cggccggcugcgcgccg

SEQ ID NO: 2460205 - RNA, 17 nt, Bordetella pertussis
cggccgggaccuuggcg

SEQ ID NO: 2460206 - RNA, 22 nt, Bordetella pertussis
cggccgggaccuuggcggcugg

SEQ ID NO: 2460207 - RNA, 22 nt, Bordetella pertussis
cggccgggcaguucgggcacgc

SEQ ID NO: 2460208 - RNA, 13 nt, Bordetella pertussis
cggccgggccagc

SEQ ID NO: 2460209 - RNA, 17 nt, Bordetella pertussis
cggccgggccagcgcga

SEQ ID NO: 2460210 - RNA, 14 nt, Bordetella pertussis
cggccgggccgggc

SEQ ID NO: 2460211 - RNA, 18 nt, Bordetella pertussis
cggccgggccgggcacga

SEQ ID NO: 2460212 - RNA, 20 nt, Bordetella pertussis
cggccgggccgggcacgaug

SEQ ID NO: 2460213 - RNA, 14 nt, Bordetella pertussis
cggccgggcgcggc

SEQ ID NO: 2460214 - RNA, 15 nt, Bordetella pertussis
cggccgggcgcggcg

SEQ ID NO: 2460215 - RNA, 17 nt, Bordetella pertussis
cggccgggcgcggcgcc

SEQ ID NO: 2460216 - RNA, 20 nt, Bordetella pertussis
cggccgggcgcggcgcccgc

SEQ ID NO: 2460217 - RNA, 13 nt, Bordetella pertussis
cggccggggcccg

SEQ ID NO: 2460218 - RNA, 14 nt, Bordetella pertussis
cggccggggcccgc

SEQ ID NO: 2460219 - RNA, 20 nt, Bordetella pertussis
cggccggggcccgcgggcgc

SEQ ID NO: 2460220 - RNA, 21 nt, Bordetella pertussis
cggccggggcccgcgggcgcc

SEQ ID NO: 2460221 - RNA, 21 nt, Bordetella pertussis
cggccggggccgcccugccua

SEQ ID NO: 2460222 - RNA, 22 nt, Bordetella pertussis
cggccggggucuugccgcgcag

SEQ ID NO: 2460223 - RNA, 18 nt, Bordetella pertussis
cggccgggucccuggccc

SEQ ID NO: 2460224 - RNA, 14 nt, Bordetella pertussis
cggccgggucggcc

SEQ ID NO: 2460225 - RNA, 19 nt, Bordetella pertussis
cggccgggucggccugcca

SEQ ID NO: 2460226 - RNA, 17 nt, Bordetella pertussis
cggccgguaucgacgcg

SEQ ID NO: 2460227 - RNA, 18 nt, Bordetella pertussis
cggccgguaucgacgcgc

SEQ ID NO: 2460228 - RNA, 19 nt, Bordetella pertussis
cggccgguaucggccucga

SEQ ID NO: 2460229 - RNA, 14 nt, Bordetella pertussis
cggcgagcgccgcc

SEQ ID NO: 2460230 - RNA, 17 nt, Bordetella pertussis
cggcgagcgccgccagg

SEQ ID NO: 2460231 - RNA, 19 nt, Bordetella pertussis
cggcgagcgccgccaggcc

SEQ ID NO: 2460232 - RNA, 22 nt, Bordetella pertussis
cggcgagcgccgccaggccguc

SEQ ID NO: 2460233 - RNA, 18 nt, Bordetella pertussis
cggcgagcgccucgcgcu

SEQ ID NO: 2460234 - RNA, 20 nt, Bordetella pertussis
cggcgagcgccucgcgcucc

SEQ ID NO: 2460235 - RNA, 14 nt, Bordetella pertussis
cggcgagcgcggcg

SEQ ID NO: 2460236 - RNA, 15 nt, Bordetella pertussis
cggcgagcgcggcga

SEQ ID NO: 2460237 - RNA, 15 nt, Bordetella pertussis
cggcgagcgcggcgc

SEQ ID NO: 2460238 - RNA, 21 nt, Bordetella pertussis
cggcgagcgcggcgcgcgcca

SEQ ID NO: 2460239 - RNA, 21 nt, Bordetella pertussis
cggcgagcucggcauggcgau

SEQ ID NO: 2460240 - RNA, 14 nt, Bordetella pertussis
cggcgagcuggccc

SEQ ID NO: 2460241 - RNA, 15 nt, Bordetella pertussis
cggcgagcuggcccu

SEQ ID NO: 2460242 - RNA, 13 nt, Bordetella pertussis
cggcgaggaggug

SEQ ID NO: 2460243 - RNA, 17 nt, Bordetella pertussis
cggcgaggaugccgcgc

SEQ ID NO: 2460244 - RNA, 15 nt, Bordetella pertussis
cggcgaggccgcccg

SEQ ID NO: 2460245 - RNA, 16 nt, Bordetella pertussis
cggcgaggccgcccgc

SEQ ID NO: 2460246 - RNA, 14 nt, Bordetella pertussis
cggcgagggcgucg

SEQ ID NO: 2460247 - RNA, 15 nt, Bordetella pertussis
cggcgagggcgucgu

SEQ ID NO: 2460248 - RNA, 18 nt, Bordetella pertussis
cggcgagguugcaggcca

SEQ ID NO: 2460249 - RNA, 20 nt, Bordetella pertussis
cggcgagguugcaggccagg

SEQ ID NO: 2460250 - RNA, 22 nt, Bordetella pertussis
cggcgagguugcaggccaggcu

SEQ ID NO: 2460251 - RNA, 16 nt, Bordetella pertussis
cggcgauacgcgccgc

SEQ ID NO: 2460252 - RNA, 21 nt, Bordetella pertussis
cggcgauacgcgccgccuggc

SEQ ID NO: 2460253 - RNA, 15 nt, Bordetella pertussis
cggcgauauggccag

SEQ ID NO: 2460254 - RNA, 16 nt, Bordetella pertussis
cggcgauauggccagg

SEQ ID NO: 2460255 - RNA, 17 nt, Bordetella pertussis
cggcgauauggccaggg

SEQ ID NO: 2460256 - RNA, 18 nt, Bordetella pertussis
cggcgaucaacgugcgcc

SEQ ID NO: 2460257 - RNA, 21 nt, Bordetella pertussis
cggcgaucaacgugcgccagg

SEQ ID NO: 2460258 - RNA, 24 nt, Bordetella pertussis
cggcgaucaacgugcgccaggcaa

SEQ ID NO: 2460259 - RNA, 20 nt, Bordetella pertussis
cggcgaucaccugcguggcc

SEQ ID NO: 2460260 - RNA, 19 nt, Bordetella pertussis
cggcgauccgccgcggcca

SEQ ID NO: 2460261 - RNA, 23 nt, Bordetella pertussis
cggcgauccgccgcggccagcgc

SEQ ID NO: 2460262 - RNA, 20 nt, Bordetella pertussis
cggcgaucgaauggucggcc

SEQ ID NO: 2460263 - RNA, 16 nt, Bordetella pertussis
cggcgaucgccuguau

SEQ ID NO: 2460264 - RNA, 23 nt, Bordetella pertussis
cggcgaucgccuguaucugcgcc

SEQ ID NO: 2460265 - RNA, 14 nt, Bordetella pertussis
cggcgaucucgcgc

SEQ ID NO: 2460266 - RNA, 15 nt, Bordetella pertussis
cggcgaucucgcgcg

SEQ ID NO: 2460267 - RNA, 16 nt, Bordetella pertussis
cggcgaucucgcgcgc

SEQ ID NO: 2460268 - RNA, 17 nt, Bordetella pertussis
cggcgaucucgcgcgcg

SEQ ID NO: 2460269 - RNA, 18 nt, Bordetella pertussis
cggcgaucucgcgcgcgc

SEQ ID NO: 2460270 - RNA, 21 nt, Bordetella pertussis
cggcgaucucgucgaccgccu

SEQ ID NO: 2460271 - RNA, 22 nt, Bordetella pertussis
cggcgaucucgucgaccgccuc

SEQ ID NO: 2460272 - RNA, 14 nt, Bordetella pertussis
cggcgaucugcgcg

SEQ ID NO: 2460273 - RNA, 17 nt, Bordetella pertussis
cggcgaucugcgcggcg

SEQ ID NO: 2460274 - RNA, 14 nt, Bordetella pertussis
cggcgaucugggcc

SEQ ID NO: 2460275 - RNA, 17 nt, Bordetella pertussis
cggcgaucugggccucg

SEQ ID NO: 2460276 - RNA, 19 nt, Bordetella pertussis
cggcgaucugggccucggc

SEQ ID NO: 2460277 - RNA, 23 nt, Bordetella pertussis
cggcgaucugggccucggccagc

SEQ ID NO: 2460278 - RNA, 16 nt, Bordetella pertussis
cggcgaucuuguaggc

SEQ ID NO: 2460279 - RNA, 20 nt, Bordetella pertussis
cggcgaugaacagcggcacg

SEQ ID NO: 2460280 - RNA, 17 nt, Bordetella pertussis
cggcgaugacggcuucg

SEQ ID NO: 2460281 - RNA, 23 nt, Bordetella pertussis
cggcgaugauggggucgccgggc

SEQ ID NO: 2460282 - RNA, 15 nt, Bordetella pertussis
cggcgaugcacccag

SEQ ID NO: 2460283 - RNA, 20 nt, Bordetella pertussis
cggcgaugcacccaggcgcc

SEQ ID NO: 2460284 - RNA, 21 nt, Bordetella pertussis
cggcgaugcacccaggcgccg

SEQ ID NO: 2460285 - RNA, 22 nt, Bordetella pertussis
cggcgaugccccaguccaggcc

SEQ ID NO: 2460286 - RNA, 13 nt, Bordetella pertussis
cggcgaugccggc

SEQ ID NO: 2460287 - RNA, 17 nt, Bordetella pertussis
cggcgaugccggccagc

SEQ ID NO: 2460288 - RNA, 15 nt, Bordetella pertussis
cggcgaugccggcgc

SEQ ID NO: 2460289 - RNA, 16 nt, Bordetella pertussis
cggcgaugccggcgcu

SEQ ID NO: 2460290 - RNA, 21 nt, Bordetella pertussis
cggcgaugccggcgcugcgca

SEQ ID NO: 2460291 - RNA, 23 nt, Bordetella pertussis
cggcgaugccggcgcugcgcagc

SEQ ID NO: 2460292 - RNA, 15 nt, Bordetella pertussis
cggcgaugccguacu

SEQ ID NO: 2460293 - RNA, 17 nt, Bordetella pertussis
cggcgaugccguacuug

SEQ ID NO: 2460294 - RNA, 12 nt, Bordetella pertussis
cggcgaugcgcg

SEQ ID NO: 2460295 - RNA, 13 nt, Bordetella pertussis
cggcgaugcgcga

SEQ ID NO: 2460296 - RNA, 15 nt, Bordetella pertussis
cggcgaugcgcgagc

SEQ ID NO: 2460297 - RNA, 16 nt, Bordetella pertussis
cggcgaugcgcggggc

SEQ ID NO: 2460298 - RNA, 20 nt, Bordetella pertussis
cggcgaugcgcggggccggu

SEQ ID NO: 2460299 - RNA, 14 nt, Bordetella pertussis
cggcgaugcgggcc

SEQ ID NO: 2460300 - RNA, 16 nt, Bordetella pertussis
cggcgaugcgggcggc

SEQ ID NO: 2460301 - RNA, 17 nt, Bordetella pertussis
cggcgaugcgggcggcg

SEQ ID NO: 2460302 - RNA, 15 nt, Bordetella pertussis
cggcgauggcccggu

SEQ ID NO: 2460303 - RNA, 14 nt, Bordetella pertussis
cggcgauggccgac

SEQ ID NO: 2460304 - RNA, 15 nt, Bordetella pertussis
cggcgauggccgaca

SEQ ID NO: 2460305 - RNA, 14 nt, Bordetella pertussis
cggcgauggcgcgc

SEQ ID NO: 2460306 - RNA, 15 nt, Bordetella pertussis
cggcgauggcgcgcg

SEQ ID NO: 2460307 - RNA, 16 nt, Bordetella pertussis
cggcgauggcgcgcgc

SEQ ID NO: 2460308 - RNA, 16 nt, Bordetella pertussis
cggcgauugcgccagc

SEQ ID NO: 2460309 - RNA, 18 nt, Bordetella pertussis
cggcgauugcgccagcgc

SEQ ID NO: 2460310 - RNA, 20 nt, Bordetella pertussis
cggcgauugcgccagcgcug

SEQ ID NO: 2460311 - RNA, 15 nt, Bordetella pertussis
cggcgcaacccggcc

SEQ ID NO: 2460312 - RNA, 19 nt, Bordetella pertussis
cggcgcaacccggccucgc

SEQ ID NO: 2460313 - RNA, 16 nt, Bordetella pertussis
cggcgcaaccggcccg

SEQ ID NO: 2460314 - RNA, 14 nt, Bordetella pertussis
cggcgcaacgggcc

SEQ ID NO: 2460315 - RNA, 15 nt, Bordetella pertussis
cggcgcaauccccgc

SEQ ID NO: 2460316 - RNA, 19 nt, Bordetella pertussis
cggcgcaauccccgcuucc

SEQ ID NO: 2460317 - RNA, 19 nt, Bordetella pertussis
cggcgcacaccaucagcug

SEQ ID NO: 2460318 - RNA, 20 nt, Bordetella pertussis
cggcgcacaccaucagcugg

SEQ ID NO: 2460319 - RNA, 17 nt, Bordetella pertussis
cggcgcacagggcgucg

SEQ ID NO: 2460320 - RNA, 16 nt, Bordetella pertussis
cggcgcaccagcgagg

SEQ ID NO: 2460321 - RNA, 13 nt, Bordetella pertussis
cggcgcacccgcg

SEQ ID NO: 2460322 - RNA, 14 nt, Bordetella pertussis
cggcgcacccgcgg

SEQ ID NO: 2460323 - RNA, 17 nt, Bordetella pertussis
cggcgcacccgcggcgc

SEQ ID NO: 2460324 - RNA, 23 nt, Bordetella pertussis
cggcgcacccgcggcgcaugcag

SEQ ID NO: 2460325 - RNA, 16 nt, Bordetella pertussis
cggcgcaccgacagca

SEQ ID NO: 2460326 - RNA, 22 nt, Bordetella pertussis
cggcgcaccgacagcaagggca

SEQ ID NO: 2460327 - RNA, 17 nt, Bordetella pertussis
cggcgcaccgucacgcg

SEQ ID NO: 2460328 - RNA, 14 nt, Bordetella pertussis
cggcgcacgccccg

SEQ ID NO: 2460329 - RNA, 18 nt, Bordetella pertussis
cggcgcacgccccgacgc

SEQ ID NO: 2460330 - RNA, 17 nt, Bordetella pertussis
cggcgcacgccggacca

SEQ ID NO: 2460331 - RNA, 15 nt, Bordetella pertussis
cggcgcagauggcgg

SEQ ID NO: 2460332 - RNA, 22 nt, Bordetella pertussis
cggcgcagauggcggcgaugcc

SEQ ID NO: 2460333 - RNA, 15 nt, Bordetella pertussis
cggcgcagcaccagg

SEQ ID NO: 2460334 - RNA, 19 nt, Bordetella pertussis
cggcgcagcaccaggcuuu

SEQ ID NO: 2460335 - RNA, 22 nt, Bordetella pertussis
cggcgcagcaucuugcgccgcu

SEQ ID NO: 2460336 - RNA, 22 nt, Bordetella pertussis
cggcgcagcauuucggcgccgc

SEQ ID NO: 2460337 - RNA, 15 nt, Bordetella pertussis
cggcgcagcccagcg

SEQ ID NO: 2460338 - RNA, 17 nt, Bordetella pertussis
cggcgcagcccagcgcg

SEQ ID NO: 2460339 - RNA, 13 nt, Bordetella pertussis
cggcgcagccgcc

SEQ ID NO: 2460340 - RNA, 15 nt, Bordetella pertussis
cggcgcagccgccau

SEQ ID NO: 2460341 - RNA, 23 nt, Bordetella pertussis
cggcgcagccgccauaggcgcgc

SEQ ID NO: 2460342 - RNA, 12 nt, Bordetella pertussis
cggcgcagccgg

SEQ ID NO: 2460343 - RNA, 16 nt, Bordetella pertussis
cggcgcagccggccgg

SEQ ID NO: 2460344 - RNA, 14 nt, Bordetella pertussis
cggcgcagcgcacg

SEQ ID NO: 2460345 - RNA, 13 nt, Bordetella pertussis
cggcgcagcgccc

SEQ ID NO: 2460346 - RNA, 14 nt, Bordetella pertussis
cggcgcagcgccca

SEQ ID NO: 2460347 - RNA, 16 nt, Bordetella pertussis
cggcgcagcgcccagg

SEQ ID NO: 2460348 - RNA, 17 nt, Bordetella pertussis
cggcgcagcgcccaggc

SEQ ID NO: 2460349 - RNA, 12 nt, Bordetella pertussis
cggcgcagcgcg

SEQ ID NO: 2460350 - RNA, 15 nt, Bordetella pertussis
cggcgcagcgcgucc

SEQ ID NO: 2460351 - RNA, 15 nt, Bordetella pertussis
cggcgcaggaugcgc

SEQ ID NO: 2460352 - RNA, 22 nt, Bordetella pertussis
cggcgcaggaugcgcuggccgg

SEQ ID NO: 2460353 - RNA, 23 nt, Bordetella pertussis
cggcgcaggaugcgcuggccggc

SEQ ID NO: 2460354 - RNA, 12 nt, Bordetella pertussis
cggcgcaggccg

SEQ ID NO: 2460355 - RNA, 13 nt, Bordetella pertussis
cggcgcaggccgc

SEQ ID NO: 2460356 - RNA, 16 nt, Bordetella pertussis
cggcgcaggccgcgcc

SEQ ID NO: 2460357 - RNA, 17 nt, Bordetella pertussis
cggcgcaggccgcgccg

SEQ ID NO: 2460358 - RNA, 20 nt, Bordetella pertussis
cggcgcaggccgcgccggcu

SEQ ID NO: 2460359 - RNA, 22 nt, Bordetella pertussis
cggcgcaggccgcgccggcucc

SEQ ID NO: 2460360 - RNA, 13 nt, Bordetella pertussis
cggcgcaggccug

SEQ ID NO: 2460361 - RNA, 13 nt, Bordetella pertussis
cggcgcaggcggg

SEQ ID NO: 2460362 - RNA, 14 nt, Bordetella pertussis
cggcgcagucgcgc

SEQ ID NO: 2460363 - RNA, 15 nt, Bordetella pertussis
cggcgcagucgcgca

SEQ ID NO: 2460364 - RNA, 17 nt, Bordetella pertussis
cggcgcagucgcgcacg

SEQ ID NO: 2460365 - RNA, 18 nt, Bordetella pertussis
cggcgcagucgcgcacga

SEQ ID NO: 2460366 - RNA, 18 nt, Bordetella pertussis
cggcgcaguuccggcggg

SEQ ID NO: 2460367 - RNA, 15 nt, Bordetella pertussis
cggcgcaucggcgcc

SEQ ID NO: 2460368 - RNA, 16 nt, Bordetella pertussis
cggcgcaugagccggc

SEQ ID NO: 2460369 - RNA, 19 nt, Bordetella pertussis
cggcgcaugagccggcaga

SEQ ID NO: 2460370 - RNA, 18 nt, Bordetella pertussis
cggcgcaugauggccggc

SEQ ID NO: 2460371 - RNA, 19 nt, Bordetella pertussis
cggcgcaugauggccggcc

SEQ ID NO: 2460372 - RNA, 14 nt, Bordetella pertussis
cggcgcaugcugcg

SEQ ID NO: 2460373 - RNA, 19 nt, Bordetella pertussis
cggcgcauugccgucggcc

SEQ ID NO: 2460374 - RNA, 17 nt, Bordetella pertussis
cggcgcauuggccaacg

SEQ ID NO: 2460375 - RNA, 22 nt, Bordetella pertussis
cggcgccaaagcacaggauggc

SEQ ID NO: 2460376 - RNA, 14 nt, Bordetella pertussis
cggcgccaagcggc

SEQ ID NO: 2460377 - RNA, 16 nt, Bordetella pertussis
cggcgccacaggugcg

SEQ ID NO: 2460378 - RNA, 22 nt, Bordetella pertussis
cggcgccacaggugcgcggcgc

SEQ ID NO: 2460379 - RNA, 22 nt, Bordetella pertussis
cggcgccaccccguagcgcauc

SEQ ID NO: 2460380 - RNA, 16 nt, Bordetella pertussis
cggcgccacgcagaag

SEQ ID NO: 2460381 - RNA, 20 nt, Bordetella pertussis
cggcgccacgcagaaggcga

SEQ ID NO: 2460382 - RNA, 13 nt, Bordetella pertussis
cggcgccagcauc

SEQ ID NO: 2460383 - RNA, 16 nt, Bordetella pertussis
cggcgccagcaugcgc

SEQ ID NO: 2460384 - RNA, 18 nt, Bordetella pertussis
cggcgccagcaugcgcgc

SEQ ID NO: 2460385 - RNA, 13 nt, Bordetella pertussis
cggcgccagccag

SEQ ID NO: 2460386 - RNA, 13 nt, Bordetella pertussis
cggcgccagcgcc

SEQ ID NO: 2460387 - RNA, 17 nt, Bordetella pertussis
cggcgccagcgccccgg

SEQ ID NO: 2460388 - RNA, 14 nt, Bordetella pertussis
cggcgccagcgccg

SEQ ID NO: 2460389 - RNA, 16 nt, Bordetella pertussis
cggcgccagcgccgcg

SEQ ID NO: 2460390 - RNA, 23 nt, Bordetella pertussis
cggcgccagcgcuucgggcagcu

SEQ ID NO: 2460391 - RNA, 17 nt, Bordetella pertussis
cggcgccaguagcgccg

SEQ ID NO: 2460392 - RNA, 18 nt, Bordetella pertussis
cggcgccaguagcgccgg

SEQ ID NO: 2460393 - RNA, 19 nt, Bordetella pertussis
cggcgccaguagcgccggc

SEQ ID NO: 2460394 - RNA, 15 nt, Bordetella pertussis
cggcgccagucgcgc

SEQ ID NO: 2460395 - RNA, 18 nt, Bordetella pertussis
cggcgccagucgcgcagc

SEQ ID NO: 2460396 - RNA, 21 nt, Bordetella pertussis
cggcgccauauugaugcagca

SEQ ID NO: 2460397 - RNA, 22 nt, Bordetella pertussis
cggcgccauauugaugcagcac

SEQ ID NO: 2460398 - RNA, 18 nt, Bordetella pertussis
cggcgccaugccgcgccc

SEQ ID NO: 2460399 - RNA, 20 nt, Bordetella pertussis
cggcgccaugccgcgcccgc

SEQ ID NO: 2460400 - RNA, 14 nt, Bordetella pertussis
cggcgccaugccgg

SEQ ID NO: 2460401 - RNA, 15 nt, Bordetella pertussis
cggcgccaugccggg

SEQ ID NO: 2460402 - RNA, 17 nt, Bordetella pertussis
cggcgccaugcgcacca

SEQ ID NO: 2460403 - RNA, 19 nt, Bordetella pertussis
cggcgccaugcgcaccacc

SEQ ID NO: 2460404 - RNA, 20 nt, Bordetella pertussis
cggcgccaugcgcaccaccg

SEQ ID NO: 2460405 - RNA, 22 nt, Bordetella pertussis
cggcgccaugcgcaccaccgcc

SEQ ID NO: 2460406 - RNA, 14 nt, Bordetella pertussis
cggcgccaugcugg

SEQ ID NO: 2460407 - RNA, 12 nt, Bordetella pertussis
cggcgcccacgc

SEQ ID NO: 2460408 - RNA, 14 nt, Bordetella pertussis
cggcgcccacgccg

SEQ ID NO: 2460409 - RNA, 19 nt, Bordetella pertussis
cggcgcccagcuccacccc

SEQ ID NO: 2460410 - RNA, 21 nt, Bordetella pertussis
cggcgcccagcuccaccccgg

SEQ ID NO: 2460411 - RNA, 14 nt, Bordetella pertussis
cggcgcccagcugg

SEQ ID NO: 2460412 - RNA, 22 nt, Bordetella pertussis
cggcgcccagcuggcgccccuu

SEQ ID NO: 2460413 - RNA, 14 nt, Bordetella pertussis
cggcgcccaggccc

SEQ ID NO: 2460414 - RNA, 18 nt, Bordetella pertussis
cggcgcccaggcccagcg

SEQ ID NO: 2460415 - RNA, 15 nt, Bordetella pertussis
cggccggucagccca

SEQ ID NO: 2460416 - RNA, 17 nt, Bordetella pertussis
cggccggucagcccagg

SEQ ID NO: 2460417 - RNA, 18 nt, Bordetella pertussis
cggccggucagcccaggc

SEQ ID NO: 2460418 - RNA, 21 nt, Bordetella pertussis
cggccggucagcccaggcggg

SEQ ID NO: 2460419 - RNA, 22 nt, Bordetella pertussis
cggccggucagcccaggcgggc

SEQ ID NO: 2460420 - RNA, 22 nt, Bordetella pertussis
cggccggucugcauguaguuca

SEQ ID NO: 2460421 - RNA, 15 nt, Bordetella pertussis
cggccggugcaucgg

SEQ ID NO: 2460422 - RNA, 22 nt, Bordetella pertussis
cggccggugcaucggccggcgg

SEQ ID NO: 2460423 - RNA, 13 nt, Bordetella pertussis
cggccgguggcga

SEQ ID NO: 2460424 - RNA, 16 nt, Bordetella pertussis
cggccgguggcgauca

SEQ ID NO: 2460425 - RNA, 20 nt, Bordetella pertussis
cggccguauggccguuggcc

SEQ ID NO: 2460426 - RNA, 22 nt, Bordetella pertussis
cggccguauggccguuggccag

SEQ ID NO: 2460427 - RNA, 18 nt, Bordetella pertussis
cggccgucaacggcuugg

SEQ ID NO: 2460428 - RNA, 15 nt, Bordetella pertussis
cggccgucaccgccg

SEQ ID NO: 2460429 - RNA, 18 nt, Bordetella pertussis
cggccgucaccgccgccg

SEQ ID NO: 2460430 - RNA, 21 nt, Bordetella pertussis
cggccgucaccgccgccgcgc

SEQ ID NO: 2460431 - RNA, 13 nt, Bordetella pertussis
cggccgucagcag

SEQ ID NO: 2460432 - RNA, 13 nt, Bordetella pertussis
cggccgucgaccg

SEQ ID NO: 2460433 - RNA, 17 nt, Bordetella pertussis
cggccgucgaccgacag

SEQ ID NO: 2460434 - RNA, 21 nt, Bordetella pertussis
cggccgucgaccgacagcaca

SEQ ID NO: 2460435 - RNA, 22 nt, Bordetella pertussis
cggccgucgaccgacagcacau

SEQ ID NO: 2460436 - RNA, 15 nt, Bordetella pertussis
cggccgucgccgccc

SEQ ID NO: 2460437 - RNA, 16 nt, Bordetella pertussis
cggccgucgccgccca

SEQ ID NO: 2460438 - RNA, 19 nt, Bordetella pertussis
cggccgucgccgcccaugc

SEQ ID NO: 2460439 - RNA, 12 nt, Bordetella pertussis
cggccgucgccu

SEQ ID NO: 2460440 - RNA, 19 nt, Bordetella pertussis
cggccgucggcgcuggcgc

SEQ ID NO: 2460441 - RNA, 15 nt, Bordetella pertussis
cggccgucggggccg

SEQ ID NO: 2460442 - RNA, 14 nt, Bordetella pertussis
cggccgucugggcg

SEQ ID NO: 2460443 - RNA, 15 nt, Bordetella pertussis
cggccgucugggcgu

SEQ ID NO: 2460444 - RNA, 16 nt, Bordetella pertussis
cggccgucugggcgug

SEQ ID NO: 2460445 - RNA, 14 nt, Bordetella pertussis
cggccgugccgccc

SEQ ID NO: 2460446 - RNA, 15 nt, Bordetella pertussis
cggccgugccgcccg

SEQ ID NO: 2460447 - RNA, 21 nt, Bordetella pertussis
cggccgugccucaacuggccg

SEQ ID NO: 2460448 - RNA, 15 nt, Bordetella pertussis
cggccgugcgccagc

SEQ ID NO: 2460449 - RNA, 18 nt, Bordetella pertussis
cggccgugcgccagcgcc

SEQ ID NO: 2460450 - RNA, 16 nt, Bordetella pertussis
cggccguggaggcggc

SEQ ID NO: 2460451 - RNA, 19 nt, Bordetella pertussis
cggccguguucgagcaggc

SEQ ID NO: 2460452 - RNA, 22 nt, Bordetella pertussis
cggccguguucgagcaggcgcg

SEQ ID NO: 2460453 - RNA, 14 nt, Bordetella pertussis
cggccguugcucca

SEQ ID NO: 2460454 - RNA, 17 nt, Bordetella pertussis
cggccguugcuccagcc

SEQ ID NO: 2460455 - RNA, 15 nt, Bordetella pertussis
cggccguuggcgaug

SEQ ID NO: 2460456 - RNA, 24 nt, Bordetella pertussis
cggccguuggcgauggcgcggccg

SEQ ID NO: 2460457 - RNA, 17 nt, Bordetella pertussis
cggccguuggcgugcag

SEQ ID NO: 2460458 - RNA, 19 nt, Bordetella pertussis
cggccguuggcgugcagcc

SEQ ID NO: 2460459 - RNA, 20 nt, Bordetella pertussis
cggccguuucaggccugcgg

SEQ ID NO: 2460460 - RNA, 22 nt, Bordetella pertussis
cggccguuucaggccugcggcg

SEQ ID NO: 2460461 - RNA, 16 nt, Bordetella pertussis
cggccuaugugcaggc

SEQ ID NO: 2460462 - RNA, 17 nt, Bordetella pertussis
cggccuaugugcaggcc

SEQ ID NO: 2460463 - RNA, 18 nt, Bordetella pertussis
cggccuaugugcaggcca

SEQ ID NO: 2460464 - RNA, 16 nt, Bordetella pertussis
cggccuauuuggcggc

SEQ ID NO: 2460465 - RNA, 23 nt, Bordetella pertussis
cggccuauuuggcggccuggccg

SEQ ID NO: 2460466 - RNA, 19 nt, Bordetella pertussis
cggcgccgccucaggccgg

SEQ ID NO: 2460467 - RNA, 17 nt, Bordetella pertussis
cggcgccgccucgggca

SEQ ID NO: 2460468 - RNA, 21 nt, Bordetella pertussis
cggcgccgccucgggcacggc

SEQ ID NO: 2460469 - RNA, 12 nt, Bordetella pertussis
cggcgccgcgca

SEQ ID NO: 2460470 - RNA, 13 nt, Bordetella pertussis
cggcgccgcgcag

SEQ ID NO: 2460471 - RNA, 15 nt, Bordetella pertussis
cggcgccgcgcagca

SEQ ID NO: 2460472 - RNA, 16 nt, Bordetella pertussis
cggcgccgcgcgcggc

SEQ ID NO: 2460473 - RNA, 22 nt, Bordetella pertussis
cggcgccgcgcgcggccccggc

SEQ ID NO: 2460474 - RNA, 16 nt, Bordetella pertussis
cggcgccgcgcgcugg

SEQ ID NO: 2460475 - RNA, 15 nt, Bordetella pertussis
cggcgccgcgcugau

SEQ ID NO: 2460476 - RNA, 17 nt, Bordetella pertussis
cggcgccgcggcgcuuc

SEQ ID NO: 2460477 - RNA, 16 nt, Bordetella pertussis
cggcgccgcuuccggc

SEQ ID NO: 2460478 - RNA, 19 nt, Bordetella pertussis
cggcgccgcuuccggcaug

SEQ ID NO: 2460479 - RNA, 21 nt, Bordetella pertussis
cggcgccgcuuccggcaugac

SEQ ID NO: 2460480 - RNA, 18 nt, Bordetella pertussis
cggcgccggaucggccgg

SEQ ID NO: 2460481 - RNA, 19 nt, Bordetella pertussis
cggcgccggaucggccggc

SEQ ID NO: 2460482 - RNA, 22 nt, Bordetella pertussis
cggcgccggaucggccggcagc

SEQ ID NO: 2460483 - RNA, 13 nt, Bordetella pertussis
cggcgccggccgc

SEQ ID NO: 2460484 - RNA, 15 nt, Bordetella pertussis
cggcgccggccgccc

SEQ ID NO: 2460485 - RNA, 17 nt, Bordetella pertussis
cggcgccggccgcccgc

SEQ ID NO: 2460486 - RNA, 18 nt, Bordetella pertussis
cggcgccggccgcccgcc

SEQ ID NO: 2460487 - RNA, 21 nt, Bordetella pertussis
cggcgccggccuccagcaucg

SEQ ID NO: 2460488 - RNA, 14 nt, Bordetella pertussis
cggcgccggcgacg

SEQ ID NO: 2460489 - RNA, 23 nt, Bordetella pertussis
cggcgccggcgacgccgcggugc

SEQ ID NO: 2460490 - RNA, 17 nt, Bordetella pertussis
cggcgccggcgcgccgc

SEQ ID NO: 2460491 - RNA, 14 nt, Bordetella pertussis
cggcgccgggcagc

SEQ ID NO: 2460492 - RNA, 16 nt, Bordetella pertussis
cggcgccgggcagccc

SEQ ID NO: 2460493 - RNA, 12 nt, Bordetella pertussis
cggcgccgggcg

SEQ ID NO: 2460494 - RNA, 17 nt, Bordetella pertussis
cggcgccgggcgacggc

SEQ ID NO: 2460495 - RNA, 23 nt, Bordetella pertussis
cggcgccggugcgcggcgccccc

SEQ ID NO: 2460496 - RNA, 13 nt, Bordetella pertussis
cggcgccguccag

SEQ ID NO: 2460497 - RNA, 14 nt, Bordetella pertussis
cggcgccguccgca

SEQ ID NO: 2460498 - RNA, 12 nt, Bordetella pertussis
cggcgccgucga

SEQ ID NO: 2460499 - RNA, 11 nt, Bordetella pertussis
cggcgccgucu

SEQ ID NO: 2460500 - RNA, 13 nt, Bordetella pertussis
cggcgccgugcug

SEQ ID NO: 2460501 - RNA, 22 nt, Bordetella pertussis
cggcgccguuuucagcgcaggc

SEQ ID NO: 2460502 - RNA, 21 nt, Bordetella pertussis
cggcgccuauugcgacgccgc

SEQ ID NO: 2460503 - RNA, 22 nt, Bordetella pertussis
cggcgccuauugcgacgccgcc

SEQ ID NO: 2460504 - RNA, 20 nt, Bordetella pertussis
cggcgccucgaacguccgcc

SEQ ID NO: 2460505 - RNA, 16 nt, Bordetella pertussis
cggcgccucgguccag

SEQ ID NO: 2460506 - RNA, 13 nt, Bordetella pertussis
cggcgccugcgcg

SEQ ID NO: 2460507 - RNA, 14 nt, Bordetella pertussis
cggcgccugcgcgc

SEQ ID NO: 2460508 - RNA, 16 nt, Bordetella pertussis
cggcgccugcgcgcgc

SEQ ID NO: 2460509 - RNA, 17 nt, Bordetella pertussis
cggcgccugcgcgcgcu

SEQ ID NO: 2460510 - RNA, 12 nt, Bordetella pertussis
cggcgccugcgg

SEQ ID NO: 2460511 - RNA, 14 nt, Bordetella pertussis
cggcgccugcggca

SEQ ID NO: 2460512 - RNA, 16 nt, Bordetella pertussis
cggcgccugcggcaug

SEQ ID NO: 2460513 - RNA, 17 nt, Bordetella pertussis
cggcgccugcggcaugg

SEQ ID NO: 2460514 - RNA, 13 nt, Bordetella pertussis
cggcgccuggccc

SEQ ID NO: 2460515 - RNA, 15 nt, Bordetella pertussis
cggcgccuggccgcc

SEQ ID NO: 2460516 - RNA, 18 nt, Bordetella pertussis
cggcgccuggccgcccag

SEQ ID NO: 2460517 - RNA, 19 nt, Bordetella pertussis
cggcgccuggccgcccagc

SEQ ID NO: 2460518 - RNA, 22 nt, Bordetella pertussis
cggcgccuggccgcccagcgcc

SEQ ID NO: 2460519 - RNA, 14 nt, Bordetella pertussis
cggcgccugggccu

SEQ ID NO: 2460520 - RNA, 13 nt, Bordetella pertussis
cggcgccuggggc

SEQ ID NO: 2460521 - RNA, 16 nt, Bordetella pertussis
cggcgccuggggcgug

SEQ ID NO: 2460522 - RNA, 19 nt, Bordetella pertussis
cggcgccuggggcgugccc

SEQ ID NO: 2460523 - RNA, 18 nt, Bordetella pertussis
cggcgccuggucgcgcgc

SEQ ID NO: 2460524 - RNA, 20 nt, Bordetella pertussis
cggcgccuggucgcgcgccu

SEQ ID NO: 2460525 - RNA, 14 nt, Bordetella pertussis
cggcgccuuggccu

SEQ ID NO: 2460526 - RNA, 16 nt, Bordetella pertussis
cggcgccuuggccugg

SEQ ID NO: 2460527 - RNA, 23 nt, Bordetella pertussis
cggcgcgaacaccggcaggccgc

SEQ ID NO: 2460528 - RNA, 20 nt, Bordetella pertussis
cggcgcgaacggcagcuugu

SEQ ID NO: 2460529 - RNA, 14 nt, Bordetella pertussis
cggcgcgaccgccu

SEQ ID NO: 2460530 - RNA, 15 nt, Bordetella pertussis
cggcgcgaccgccuc

SEQ ID NO: 2460531 - RNA, 22 nt, Bordetella pertussis
cggcgcgaccgccuccagcgcg

SEQ ID NO: 2460532 - RNA, 12 nt, Bordetella pertussis
cggcgcgaccug

SEQ ID NO: 2460533 - RNA, 20 nt, Bordetella pertussis
cggcgcgaccugcgcgaccg

SEQ ID NO: 2460534 - RNA, 16 nt, Bordetella pertussis
cggcgcgagcgaugcc

SEQ ID NO: 2460535 - RNA, 15 nt, Bordetella pertussis
cggcgcgagcgcaca

SEQ ID NO: 2460536 - RNA, 16 nt, Bordetella pertussis
cggcgcgagcgcacag

SEQ ID NO: 2460537 - RNA, 17 nt, Bordetella pertussis
cggcgcgagcgcacagg

SEQ ID NO: 2460538 - RNA, 22 nt, Bordetella pertussis
cggcgcgaguaucccuaccgcc

SEQ ID NO: 2460539 - RNA, 21 nt, Bordetella pertussis
cggcgcgauggucaccacccg

SEQ ID NO: 2460540 - RNA, 18 nt, Bordetella pertussis
cggcggguuucucggccu

SEQ ID NO: 2460541 - RNA, 19 nt, Bordetella pertussis
cggcggguuucucggccuu

SEQ ID NO: 2460542 - RNA, 22 nt, Bordetella pertussis
cggcgguaagcguccgcgcgcc

SEQ ID NO: 2460543 - RNA, 23 nt, Bordetella pertussis
cggcgguaagcguccgcgcgccg

SEQ ID NO: 2460544 - RNA, 15 nt, Bordetella pertussis
cggcgguaccaggcc

SEQ ID NO: 2460545 - RNA, 19 nt, Bordetella pertussis
cggcgguaccaggccgaga

SEQ ID NO: 2460546 - RNA, 23 nt, Bordetella pertussis
cggcgguaguaccaauacaggaa

SEQ ID NO: 2460547 - RNA, 23 nt, Bordetella pertussis
cggcggucaauguauuuggcggc

SEQ ID NO: 2460548 - RNA, 19 nt, Bordetella pertussis
cggcggucacgccgaugac

SEQ ID NO: 2460549 - RNA, 12 nt, Bordetella pertussis
cggcggucagcg

SEQ ID NO: 2460550 - RNA, 13 nt, Bordetella pertussis
cggcggucagcgc

SEQ ID NO: 2460551 - RNA, 15 nt, Bordetella pertussis
cggcggucagcgcgg

SEQ ID NO: 2460552 - RNA, 16 nt, Bordetella pertussis
cggcggucagcgcggc

SEQ ID NO: 2460553 - RNA, 19 nt, Bordetella pertussis
cggcggucagcgcggcgcc

SEQ ID NO: 2460554 - RNA, 18 nt, Bordetella pertussis
cggcgguccacagcccgg

SEQ ID NO: 2460555 - RNA, 22 nt, Bordetella pertussis
cggcgguccacagcccggcccc

SEQ ID NO: 2460556 - RNA, 20 nt, Bordetella pertussis
cggcggucccgagcgcuccc

SEQ ID NO: 2460557 - RNA, 16 nt, Bordetella pertussis
cggcgguccugcugau

SEQ ID NO: 2460558 - RNA, 16 nt, Bordetella pertussis
cggcggugaccaccag

SEQ ID NO: 2460559 - RNA, 17 nt, Bordetella pertussis
cggcggugaccaccagg

SEQ ID NO: 2460560 - RNA, 20 nt, Bordetella pertussis
cggcggugaccaccaggccg

SEQ ID NO: 2460561 - RNA, 21 nt, Bordetella pertussis
cggcggugaccaccaggccgc

SEQ ID NO: 2460562 - RNA, 22 nt, Bordetella pertussis
cggcggugaccaccaggccgcc

SEQ ID NO: 2460563 - RNA, 19 nt, Bordetella pertussis
cggcggugaucugcucgcc

SEQ ID NO: 2460564 - RNA, 20 nt, Bordetella pertussis
cggcggugaucugcucgccg

SEQ ID NO: 2460565 - RNA, 23 nt, Bordetella pertussis
cggcggugaucugcucgccgcgc

SEQ ID NO: 2460566 - RNA, 16 nt, Bordetella pertussis
cggcggugccagcgca

SEQ ID NO: 2460567 - RNA, 20 nt, Bordetella pertussis
cggcggugccgcccaccgug

SEQ ID NO: 2460568 - RNA, 14 nt, Bordetella pertussis
cggcggugccgcgc

SEQ ID NO: 2460569 - RNA, 15 nt, Bordetella pertussis
cggcggugccgcgca

SEQ ID NO: 2460570 - RNA, 18 nt, Bordetella pertussis
cggcggugccugucccca

SEQ ID NO: 2460571 - RNA, 18 nt, Bordetella pertussis
cggcgguugcccgccccg

SEQ ID NO: 2460572 - RNA, 21 nt, Bordetella pertussis
cggcgguuucguagaugggca

SEQ ID NO: 2460573 - RNA, 18 nt, Bordetella pertussis
cggcgguuucuuccagca

SEQ ID NO: 2460574 - RNA, 19 nt, Bordetella pertussis
cggcgguuucuuccagcag

SEQ ID NO: 2460575 - RNA, 14 nt, Bordetella pertussis
cggcguaaggccgc

SEQ ID NO: 2460576 - RNA, 15 nt, Bordetella pertussis
cggcguaaggccgcc

SEQ ID NO: 2460577 - RNA, 16 nt, Bordetella pertussis
cggcguaaggccgccg

SEQ ID NO: 2460578 - RNA, 22 nt, Bordetella pertussis
cggcguaaggccgccggccacc

SEQ ID NO: 2460579 - RNA, 17 nt, Bordetella pertussis
cggcguaaggcugcagc

SEQ ID NO: 2460580 - RNA, 17 nt, Bordetella pertussis
cggcguacaggugcugg

SEQ ID NO: 2460581 - RNA, 13 nt, Bordetella pertussis
cggcguagccgau

SEQ ID NO: 2460582 - RNA, 14 nt, Bordetella pertussis
cggcguagcugcgc

SEQ ID NO: 2460583 - RNA, 15 nt, Bordetella pertussis
cggcguagcugcgcc

SEQ ID NO: 2460584 - RNA, 17 nt, Bordetella pertussis
cggcguauaggccaccc

SEQ ID NO: 2460585 - RNA, 21 nt, Bordetella pertussis
cggcguauggcccgccaccac

SEQ ID NO: 2460586 - RNA, 16 nt, Bordetella pertussis
cggcguauugccgggu

SEQ ID NO: 2460587 - RNA, 23 nt, Bordetella pertussis
cggcgucaaaccaagcagggaca

SEQ ID NO: 2460588 - RNA, 21 nt, Bordetella pertussis
cggcgucaaugccagucgccg

SEQ ID NO: 2460589 - RNA, 22 nt, Bordetella pertussis
cggcgucaaugccagucgccgc

SEQ ID NO: 2460590 - RNA, 16 nt, Bordetella pertussis
cggcgucacgcggccg

SEQ ID NO: 2460591 - RNA, 17 nt, Bordetella pertussis
cggcgucacgcggccgg

SEQ ID NO: 2460592 - RNA, 20 nt, Bordetella pertussis
cggcgucacgcggccgggca

SEQ ID NO: 2460593 - RNA, 13 nt, Bordetella pertussis
cggcgucagcgcc

SEQ ID NO: 2460594 - RNA, 18 nt, Bordetella pertussis
cggcgucagcgcccaauc

SEQ ID NO: 2460595 - RNA, 13 nt, Bordetella pertussis
cggcguccacggc

SEQ ID NO: 2460596 - RNA, 18 nt, Bordetella pertussis
cggcguccgaauacgcca

SEQ ID NO: 2460597 - RNA, 15 nt, Bordetella pertussis
cggcguccugccgcg

SEQ ID NO: 2460598 - RNA, 18 nt, Bordetella pertussis
cggcguccugccgcgacc

SEQ ID NO: 2460599 - RNA, 18 nt, Bordetella pertussis
cggcguccugcggcggca

SEQ ID NO: 2460600 - RNA, 20 nt, Bordetella pertussis
cggcguccugcggcggcagc

SEQ ID NO: 2460601 - RNA, 21 nt, Bordetella pertussis
cggcgucgaacagcagcuugg

SEQ ID NO: 2460602 - RNA, 16 nt, Bordetella pertussis
cggcgucgaaggccgc

SEQ ID NO: 2460603 - RNA, 17 nt, Bordetella pertussis
cggcgucgaaggccgcc

SEQ ID NO: 2460604 - RNA, 19 nt, Bordetella pertussis
cggcgucgaaggccgccgg

SEQ ID NO: 2460605 - RNA, 13 nt, Bordetella pertussis
cggcgucgaauuc

SEQ ID NO: 2460606 - RNA, 17 nt, Bordetella pertussis
cggcgucgaccgcgggc

SEQ ID NO: 2460607 - RNA, 21 nt, Bordetella pertussis
cggcgucgaccgcgggcgcgc

SEQ ID NO: 2460608 - RNA, 19 nt, Bordetella pertussis
cggcgucgacgcccgcgcc

SEQ ID NO: 2460609 - RNA, 15 nt, Bordetella pertussis
cggcgucgagcacgc

SEQ ID NO: 2460610 - RNA, 17 nt, Bordetella pertussis
cggcgucgagcacgcgg

SEQ ID NO: 2460611 - RNA, 18 nt, Bordetella pertussis
cggcgucgaucggcgcgc

SEQ ID NO: 2460612 - RNA, 13 nt, Bordetella pertussis
cggcgucgaugcg

SEQ ID NO: 2460613 - RNA, 15 nt, Bordetella pertussis
cggcgucgaugcgcg

SEQ ID NO: 2460614 - RNA, 18 nt, Bordetella pertussis
cggcgucgaugcgcgcgc

SEQ ID NO: 2460615 - RNA, 19 nt, Bordetella pertussis
cggcgucgaugcgcgcgcg

SEQ ID NO: 2460616 - RNA, 11 nt, Bordetella pertussis
cggcgucgccc

SEQ ID NO: 2460617 - RNA, 13 nt, Bordetella pertussis
cggcgucgccgcg

SEQ ID NO: 2460618 - RNA, 14 nt, Bordetella pertussis
cggcgucgccgcgc

SEQ ID NO: 2460619 - RNA, 16 nt, Bordetella pertussis
cggcgucgccgcgcac

SEQ ID NO: 2460620 - RNA, 17 nt, Bordetella pertussis
cggcgucgccgcgcacg

SEQ ID NO: 2460621 - RNA, 16 nt, Bordetella pertussis
cggcgucgccggccag

SEQ ID NO: 2460622 - RNA, 22 nt, Bordetella pertussis
cggcgucgcguccuucgucggc

SEQ ID NO: 2460623 - RNA, 18 nt, Bordetella pertussis
cggcgcgcaaaccgacgc

SEQ ID NO: 2460624 - RNA, 22 nt, Bordetella pertussis
cggcgcgcaaaccgacgcggcc

SEQ ID NO: 2460625 - RNA, 21 nt, Bordetella pertussis
cggcgcgcacgcucugcaccu

SEQ ID NO: 2460626 - RNA, 19 nt, Bordetella pertussis
cggcgcgcacgggcgaggc

SEQ ID NO: 2460627 - RNA, 19 nt, Bordetella pertussis
cggcgcgcagcagacgcuu

SEQ ID NO: 2460628 - RNA, 12 nt, Bordetella pertussis
cggcgcgcagcg

SEQ ID NO: 2460629 - RNA, 15 nt, Bordetella pertussis
cggcgcgcagcgccu

SEQ ID NO: 2460630 - RNA, 21 nt, Bordetella pertussis
cggcgcgcauccgguggugcu

SEQ ID NO: 2460631 - RNA, 23 nt, Bordetella pertussis
cggcgcgcauccgguggugcugg

SEQ ID NO: 2460632 - RNA, 20 nt, Bordetella pertussis
cggcgcgcaucgucaggcag

SEQ ID NO: 2460633 - RNA, 22 nt, Bordetella pertussis
cggcgcgcaucgucaggcaggc

SEQ ID NO: 2460634 - RNA, 15 nt, Bordetella pertussis
cggcgcgccagcgcg

SEQ ID NO: 2460635 - RNA, 16 nt, Bordetella pertussis
cggcgcgccagcgcgg

SEQ ID NO: 2460636 - RNA, 13 nt, Bordetella pertussis
cggcgcgcccagc

SEQ ID NO: 2460637 - RNA, 14 nt, Bordetella pertussis
cggcgcgcccagcg

SEQ ID NO: 2460638 - RNA, 20 nt, Bordetella pertussis
cggcgcgcccagcggcaggc

SEQ ID NO: 2460639 - RNA, 23 nt, Bordetella pertussis
cggcgcgcccagcggcaggcugg

SEQ ID NO: 2460640 - RNA, 16 nt, Bordetella pertussis
cggcgcgcccaggggc

SEQ ID NO: 2460641 - RNA, 18 nt, Bordetella pertussis
cggcgcgcccgcaggcgg

SEQ ID NO: 2460642 - RNA, 19 nt, Bordetella pertussis
cggcgcgcccgcaggcggc

SEQ ID NO: 2460643 - RNA, 13 nt, Bordetella pertussis
cggcgcgcccgcc

SEQ ID NO: 2460644 - RNA, 14 nt, Bordetella pertussis
cggcgcgcccgcca

SEQ ID NO: 2460645 - RNA, 15 nt, Bordetella pertussis
cggcgcgcccgcccc

SEQ ID NO: 2460646 - RNA, 19 nt, Bordetella pertussis
cggcgcgcccgccccgcag

SEQ ID NO: 2460647 - RNA, 15 nt, Bordetella pertussis
cggcgcgcccgccuu

SEQ ID NO: 2460648 - RNA, 22 nt, Bordetella pertussis
cggcgcgcccgccuucggcggc

SEQ ID NO: 2460649 - RNA, 14 nt, Bordetella pertussis
cggcgcgcccuugc

SEQ ID NO: 2460650 - RNA, 12 nt, Bordetella pertussis
cggcgcgccgcg

SEQ ID NO: 2460651 - RNA, 15 nt, Bordetella pertussis
cggcgcgccgcgccg

SEQ ID NO: 2460652 - RNA, 17 nt, Bordetella pertussis
cggcgcgccgcgccgcc

SEQ ID NO: 2460653 - RNA, 14 nt, Bordetella pertussis
cggcgcgccgcguc

SEQ ID NO: 2460654 - RNA, 16 nt, Bordetella pertussis
cggcgcgccgcgucgg

SEQ ID NO: 2460655 - RNA, 21 nt, Bordetella pertussis
cggcgcgccgcgucgguggcc

SEQ ID NO: 2460656 - RNA, 11 nt, Bordetella pertussis
cggcgcgccgg

SEQ ID NO: 2460657 - RNA, 12 nt, Bordetella pertussis
cggcgcgccggc

SEQ ID NO: 2460658 - RNA, 13 nt, Bordetella pertussis
cggcgcgccggcc

SEQ ID NO: 2460659 - RNA, 17 nt, Bordetella pertussis
cggcgcgccggccgcca

SEQ ID NO: 2460660 - RNA, 20 nt, Bordetella pertussis
cggcgcgccggccgcggggc

SEQ ID NO: 2460661 - RNA, 14 nt, Bordetella pertussis
cggcgcgccuggcg

SEQ ID NO: 2460662 - RNA, 18 nt, Bordetella pertussis
cggcggcccacagcgccc

SEQ ID NO: 2460663 - RNA, 14 nt, Bordetella pertussis
cggcggccgccugc

SEQ ID NO: 2460664 - RNA, 18 nt, Bordetella pertussis
cggcggccgccugcgccg

SEQ ID NO: 2460665 - RNA, 20 nt, Bordetella pertussis
cggcggccgccugcgccgag

SEQ ID NO: 2460666 - RNA, 12 nt, Bordetella pertussis
cggcggccgcgu

SEQ ID NO: 2460667 - RNA, 18 nt, Bordetella pertussis
cggcggccgcguccagcg

SEQ ID NO: 2460668 - RNA, 22 nt, Bordetella pertussis
cggcggccgcgucgaucagcgc

SEQ ID NO: 2460669 - RNA, 14 nt, Bordetella pertussis
cggcggccggcucg

SEQ ID NO: 2460670 - RNA, 16 nt, Bordetella pertussis
cggcggccggcucgua

SEQ ID NO: 2460671 - RNA, 17 nt, Bordetella pertussis
cggcggccggggccgcc

SEQ ID NO: 2460672 - RNA, 21 nt, Bordetella pertussis
cggcggccuaugugcaggcca

SEQ ID NO: 2460673 - RNA, 16 nt, Bordetella pertussis
cggcggccuccagcag

SEQ ID NO: 2460674 - RNA, 16 nt, Bordetella pertussis
cggcggccuccgcgca

SEQ ID NO: 2460675 - RNA, 19 nt, Bordetella pertussis
cggcggccuccgcgcacag

SEQ ID NO: 2460676 - RNA, 13 nt, Bordetella pertussis
cggcggccugcag

SEQ ID NO: 2460677 - RNA, 14 nt, Bordetella pertussis
cggcggccugcagg

SEQ ID NO: 2460678 - RNA, 17 nt, Bordetella pertussis
cggcggccugcaggccg

SEQ ID NO: 2460679 - RNA, 13 nt, Bordetella pertussis
cggcggccuggac

SEQ ID NO: 2460680 - RNA, 15 nt, Bordetella pertussis
cggcggccugggcca

SEQ ID NO: 2460681 - RNA, 14 nt, Bordetella pertussis
cggcggccugggcg

SEQ ID NO: 2460682 - RNA, 16 nt, Bordetella pertussis
cggcggccugggcggg

SEQ ID NO: 2460683 - RNA, 17 nt, Bordetella pertussis
cggcggccugggcgggc

SEQ ID NO: 2460684 - RNA, 18 nt, Bordetella pertussis
cggcggccuugugcgcca

SEQ ID NO: 2460685 - RNA, 19 nt, Bordetella pertussis
cggcggccuugugcgccag

SEQ ID NO: 2460686 - RNA, 17 nt, Bordetella pertussis
cggcggcgacucggcau

SEQ ID NO: 2460687 - RNA, 22 nt, Bordetella pertussis
cggcggcgagcgcggcgcgcgc

SEQ ID NO: 2460688 - RNA, 14 nt, Bordetella pertussis
cggcggcgagcugg

SEQ ID NO: 2460689 - RNA, 15 nt, Bordetella pertussis
cggcggcgaucaacg

SEQ ID NO: 2460690 - RNA, 15 nt, Bordetella pertussis
cggcggcgaugccgc

SEQ ID NO: 2460691 - RNA, 18 nt, Bordetella pertussis
cggcggcgaugcgggcca

SEQ ID NO: 2460692 - RNA, 12 nt, Bordetella pertussis
cggcggcgcgcc

SEQ ID NO: 2460693 - RNA, 15 nt, Bordetella pertussis
cggcggcgcgccgcc

SEQ ID NO: 2460694 - RNA, 13 nt, Bordetella pertussis
cggcggcgcgcgc

SEQ ID NO: 2460695 - RNA, 14 nt, Bordetella pertussis
cggcggcgcgcgcg

SEQ ID NO: 2460696 - RNA, 15 nt, Bordetella pertussis
cggcggcgcgcgcgc

SEQ ID NO: 2460697 - RNA, 17 nt, Bordetella pertussis
cggcggcgcgcgcgccg

SEQ ID NO: 2460698 - RNA, 18 nt, Bordetella pertussis
cggcggcgcgcgcgccgc

SEQ ID NO: 2460699 - RNA, 12 nt, Bordetella pertussis
cggcggcgcgcu

SEQ ID NO: 2460700 - RNA, 14 nt, Bordetella pertussis
cggcggcgcgcugg

SEQ ID NO: 2460701 - RNA, 13 nt, Bordetella pertussis
cggcggcgcggcg

SEQ ID NO: 2460702 - RNA, 17 nt, Bordetella pertussis
cggcggcgcggcgagca

SEQ ID NO: 2460703 - RNA, 14 nt, Bordetella pertussis
cggcggcgcggcgc

SEQ ID NO: 2460704 - RNA, 16 nt, Bordetella pertussis
cggcggcgcggucagc

SEQ ID NO: 2460705 - RNA, 17 nt, Bordetella pertussis
cggcggcgcggucagca

SEQ ID NO: 2460706 - RNA, 18 nt, Bordetella pertussis
cggcggcgcggucagcau

SEQ ID NO: 2460707 - RNA, 12 nt, Bordetella pertussis
cggcggcgcugg

SEQ ID NO: 2460708 - RNA, 15 nt, Bordetella pertussis
cggcggcgcuggccu

SEQ ID NO: 2460709 - RNA, 16 nt, Bordetella pertussis
cggcggcgcuggccug

SEQ ID NO: 2460710 - RNA, 23 nt, Bordetella pertussis
cggcggcggaucgaacgccucgg

SEQ ID NO: 2460711 - RNA, 15 nt, Bordetella pertussis
cggcggcggccaucg

SEQ ID NO: 2460712 - RNA, 17 nt, Bordetella pertussis
cggcggcgggcggccgg

SEQ ID NO: 2460713 - RNA, 19 nt, Bordetella pertussis
cggcggcgggcggccggcg

SEQ ID NO: 2460714 - RNA, 14 nt, Bordetella pertussis
cggcggcgucgcgc

SEQ ID NO: 2460715 - RNA, 15 nt, Bordetella pertussis
cggcggcgucgcgcu

SEQ ID NO: 2460716 - RNA, 15 nt, Bordetella pertussis
cggcggcgucggcgc

SEQ ID NO: 2460717 - RNA, 19 nt, Bordetella pertussis
cggcggcgucggcgcccgg

SEQ ID NO: 2460718 - RNA, 20 nt, Bordetella pertussis
cggcggcgucggcgcccggc

SEQ ID NO: 2460719 - RNA, 13 nt, Bordetella pertussis
cggcggcgucugg

SEQ ID NO: 2460720 - RNA, 13 nt, Bordetella pertussis
cggcggcgugccc

SEQ ID NO: 2460721 - RNA, 18 nt, Bordetella pertussis
cggcggcguggccgugcu

SEQ ID NO: 2460722 - RNA, 20 nt, Bordetella pertussis
cggcggcguggccgugcugg

SEQ ID NO: 2460723 - RNA, 15 nt, Bordetella pertussis
cggcggcguggcggc

SEQ ID NO: 2460724 - RNA, 19 nt, Bordetella pertussis
cggcggcguuccugggcac

SEQ ID NO: 2460725 - RNA, 19 nt, Bordetella pertussis
cggcggcugugggccucgc

SEQ ID NO: 2460726 - RNA, 22 nt, Bordetella pertussis
cggcggcugugggccucgcugg

SEQ ID NO: 2460727 - RNA, 16 nt, Bordetella pertussis
cggcggcuucgcgcag

SEQ ID NO: 2460728 - RNA, 17 nt, Bordetella pertussis
cggcggcuucgcgcagc

SEQ ID NO: 2460729 - RNA, 19 nt, Bordetella pertussis
cggcggcuucgcgcagcaa

SEQ ID NO: 2460730 - RNA, 21 nt, Bordetella pertussis
cggcggcuucgcgcagcaagu

SEQ ID NO: 2460731 - RNA, 21 nt, Bordetella pertussis
cggcggcuucggccgucagca

SEQ ID NO: 2460732 - RNA, 22 nt, Bordetella pertussis
cggcggcuucggccgucagcag

SEQ ID NO: 2460733 - RNA, 14 nt, Bordetella pertussis
cggcgggacgcagg

SEQ ID NO: 2460734 - RNA, 17 nt, Bordetella pertussis
cggcgggacgcaggccc

SEQ ID NO: 2460735 - RNA, 18 nt, Bordetella pertussis
cggcgggacgcaggccca

SEQ ID NO: 2460736 - RNA, 14 nt, Bordetella pertussis
cggcgggacggcca

SEQ ID NO: 2460737 - RNA, 15 nt, Bordetella pertussis
cggcgggacggccau

SEQ ID NO: 2460738 - RNA, 16 nt, Bordetella pertussis
cggcgggaucgggcag

SEQ ID NO: 2460739 - RNA, 18 nt, Bordetella pertussis
cggcgggaucgggcagcu

SEQ ID NO: 2460740 - RNA, 21 nt, Bordetella pertussis
cggcgggaucgggcagcuugg

SEQ ID NO: 2460741 - RNA, 23 nt, Bordetella pertussis
cggcgggcaacuucaccgucgac

SEQ ID NO: 2460742 - RNA, 14 nt, Bordetella pertussis
cggcgggcaggcgg

SEQ ID NO: 2460743 - RNA, 16 nt, Bordetella pertussis
cggcgggcaggcgggc

SEQ ID NO: 2460744 - RNA, 20 nt, Bordetella pertussis
cggcgucgcuggcagccuug

SEQ ID NO: 2460745 - RNA, 15 nt, Bordetella pertussis
cggcgucggcgcccg

SEQ ID NO: 2460746 - RNA, 17 nt, Bordetella pertussis
cggcgucggcgcccggc

SEQ ID NO: 2460747 - RNA, 14 nt, Bordetella pertussis
cggcgucgggcagc

SEQ ID NO: 2460748 - RNA, 22 nt, Bordetella pertussis
cggcgucggugccguccagcgc

SEQ ID NO: 2460749 - RNA, 23 nt, Bordetella pertussis
cggcgucggugccguccagcgcg

SEQ ID NO: 2460750 - RNA, 21 nt, Bordetella pertussis
cggcgucuggaaacuguuggc

SEQ ID NO: 2460751 - RNA, 14 nt, Bordetella pertussis
cggcgucugguaca

SEQ ID NO: 2460752 - RNA, 13 nt, Bordetella pertussis
cggcgugaacgcg

SEQ ID NO: 2460753 - RNA, 17 nt, Bordetella pertussis
cggcgugaacgcgcauu

SEQ ID NO: 2460754 - RNA, 15 nt, Bordetella pertussis
cggcgugaccgcgac

SEQ ID NO: 2460755 - RNA, 14 nt, Bordetella pertussis
cggcgugacgcuga

SEQ ID NO: 2460756 - RNA, 16 nt, Bordetella pertussis
cggcgugacgcugacc

SEQ ID NO: 2460757 - RNA, 21 nt, Bordetella pertussis
cggcgugacguugccgcgcgc

SEQ ID NO: 2460758 - RNA, 16 nt, Bordetella pertussis
cggcgugagcacgacg

SEQ ID NO: 2460759 - RNA, 15 nt, Bordetella pertussis
cggcgugagcgccac

SEQ ID NO: 2460760 - RNA, 17 nt, Bordetella pertussis
cggcgugagcgccaccg

SEQ ID NO: 2460761 - RNA, 13 nt, Bordetella pertussis
cggcgugaugccc

SEQ ID NO: 2460762 - RNA, 15 nt, Bordetella pertussis
cggcgugaugcccag

SEQ ID NO: 2460763 - RNA, 16 nt, Bordetella pertussis
cggcgugaugcccagg

SEQ ID NO: 2460764 - RNA, 17 nt, Bordetella pertussis
cggcgugaugcccaggc

SEQ ID NO: 2460765 - RNA, 18 nt, Bordetella pertussis
cggcgugauggacgccgg

SEQ ID NO: 2460766 - RNA, 20 nt, Bordetella pertussis
cggcgugcagagcaccacgg

SEQ ID NO: 2460767 - RNA, 20 nt, Bordetella pertussis
cggcgugccauggacgccgg

SEQ ID NO: 2460768 - RNA, 12 nt, Bordetella pertussis
cggcgugcccag

SEQ ID NO: 2460769 - RNA, 13 nt, Bordetella pertussis
cggcgugcccagg

SEQ ID NO: 2460770 - RNA, 19 nt, Bordetella pertussis
cggcgugcccagggccacg

SEQ ID NO: 2460771 - RNA, 21 nt, Bordetella pertussis
cggcgugcccaguuucgcgac

SEQ ID NO: 2460772 - RNA, 16 nt, Bordetella pertussis
cggcgugcgccugcug

SEQ ID NO: 2460773 - RNA, 20 nt, Bordetella pertussis
cggcgugcgcuggcugggcc

SEQ ID NO: 2460774 - RNA, 21 nt, Bordetella pertussis
cggcgugcgcuggcugggccu

SEQ ID NO: 2460775 - RNA, 13 nt, Bordetella pertussis
cggcgugcggccc

SEQ ID NO: 2460776 - RNA, 17 nt, Bordetella pertussis
cggcgugcggcccagcc

SEQ ID NO: 2460777 - RNA, 20 nt, Bordetella pertussis
cggcgugcugcgcguggcca

SEQ ID NO: 2460778 - RNA, 13 nt, Bordetella pertussis
cggcgugcugcgg

SEQ ID NO: 2460779 - RNA, 15 nt, Bordetella pertussis
cggcguggccgugcu

SEQ ID NO: 2460780 - RNA, 16 nt, Bordetella pertussis
cggcguggccugcccg

SEQ ID NO: 2460781 - RNA, 23 nt, Bordetella pertussis
cggcguggccugcccgucgggca

SEQ ID NO: 2460782 - RNA, 21 nt, Bordetella pertussis
cggcguggcgccgaaggcggc

SEQ ID NO: 2460783 - RNA, 23 nt, Bordetella pertussis
cggcguggcgccgaaggcggcgc

SEQ ID NO: 2460784 - RNA, 13 nt, Bordetella pertussis
cggcguggcgcgc

SEQ ID NO: 2460785 - RNA, 17 nt, Bordetella pertussis
cggcguggcgcgcaacc

SEQ ID NO: 2460786 - RNA, 15 nt, Bordetella pertussis
cggcguggcgcgcac

SEQ ID NO: 2460787 - RNA, 16 nt, Bordetella pertussis
cggcguggcgcgcaca

SEQ ID NO: 2460788 - RNA, 16 nt, Bordetella pertussis
cggcguggcgcgcccg

SEQ ID NO: 2460789 - RNA, 16 nt, Bordetella pertussis
cggcguggcggccagg

SEQ ID NO: 2460790 - RNA, 17 nt, Bordetella pertussis
cggcguggcggccaggc

SEQ ID NO: 2460791 - RNA, 19 nt, Bordetella pertussis
cggcguggcggccaggccg

SEQ ID NO: 2460792 - RNA, 15 nt, Bordetella pertussis
cggcguggcggcggg

SEQ ID NO: 2460793 - RNA, 13 nt, Bordetella pertussis
cggcguggcgggg

SEQ ID NO: 2460794 - RNA, 18 nt, Bordetella pertussis
cggcguggcggggauggc

SEQ ID NO: 2460795 - RNA, 15 nt, Bordetella pertussis
cggcguggggccggc

SEQ ID NO: 2460796 - RNA, 16 nt, Bordetella pertussis
cggcguggggccggcc

SEQ ID NO: 2460797 - RNA, 18 nt, Bordetella pertussis
cggcguggggccggccgc

SEQ ID NO: 2460798 - RNA, 15 nt, Bordetella pertussis
cggcgugguaucgcg

SEQ ID NO: 2460799 - RNA, 20 nt, Bordetella pertussis
cggcgugguaucgcgccagc

SEQ ID NO: 2460800 - RNA, 21 nt, Bordetella pertussis
cggcgugguaucgcgccagcg

SEQ ID NO: 2460801 - RNA, 15 nt, Bordetella pertussis
cggcguguagagcug

SEQ ID NO: 2460802 - RNA, 20 nt, Bordetella pertussis
cggcguguagagcugcggcg

SEQ ID NO: 2460803 - RNA, 21 nt, Bordetella pertussis
cggcguguagagcugcggcgc

SEQ ID NO: 2460804 - RNA, 19 nt, Bordetella pertussis
cggcguguccagcggcgcc

SEQ ID NO: 2460805 - RNA, 20 nt, Bordetella pertussis
cggcguguccagcggcgcca

SEQ ID NO: 2460806 - RNA, 15 nt, Bordetella pertussis
cggcgugugcccagc

SEQ ID NO: 2460807 - RNA, 16 nt, Bordetella pertussis
cggcgugugcccagca

SEQ ID NO: 2460808 - RNA, 17 nt, Bordetella pertussis
cggcgugugcccagcac

SEQ ID NO: 2460809 - RNA, 18 nt, Bordetella pertussis
cggcgugugcccagcacc

SEQ ID NO: 2460810 - RNA, 19 nt, Bordetella pertussis
cggcgugugcccagcacca

SEQ ID NO: 2460811 - RNA, 14 nt, Bordetella pertussis
cggcguguucagcg

SEQ ID NO: 2460812 - RNA, 19 nt, Bordetella pertussis
cggcguguucagcgcgcgc

SEQ ID NO: 2460813 - RNA, 20 nt, Bordetella pertussis
cggcguguucagcgcgcgcg

SEQ ID NO: 2460814 - RNA, 16 nt, Bordetella pertussis
cggcguucaccaggaa

SEQ ID NO: 2460815 - RNA, 15 nt, Bordetella pertussis
cggcguuccugggca

SEQ ID NO: 2460816 - RNA, 20 nt, Bordetella pertussis
cggcguuccugggcacgccg

SEQ ID NO: 2460817 - RNA, 16 nt, Bordetella pertussis
cggcguucugcagcgc

SEQ ID NO: 2460818 - RNA, 18 nt, Bordetella pertussis
cggcguucugcagcgcgg

SEQ ID NO: 2460819 - RNA, 14 nt, Bordetella pertussis
cggcguucuggcgc

SEQ ID NO: 2460820 - RNA, 17 nt, Bordetella pertussis
cggcguucuggcgcagc

SEQ ID NO: 2460821 - RNA, 18 nt, Bordetella pertussis
cggcguucuggcgcagca

SEQ ID NO: 2460822 - RNA, 20 nt, Bordetella pertussis
cggcguucuucagcgcgcuc

SEQ ID NO: 2460823 - RNA, 21 nt, Bordetella pertussis
cggcguugaaauccacuugcg

SEQ ID NO: 2460824 - RNA, 22 nt, Bordetella pertussis
cggcguugaccuggucgggcgu

SEQ ID NO: 2460825 - RNA, 20 nt, Bordetella pertussis
cggcguugccgaagcgucgg

SEQ ID NO: 2460826 - RNA, 16 nt, Bordetella pertussis
cggcguugcggcagcg

SEQ ID NO: 2460827 - RNA, 18 nt, Bordetella pertussis
cggcguugcggcagcggc

SEQ ID NO: 2460828 - RNA, 14 nt, Bordetella pertussis
cggcguugcggcgc

SEQ ID NO: 2460829 - RNA, 22 nt, Bordetella pertussis
cggcguugcuggcaaagcgcgc

SEQ ID NO: 2460830 - RNA, 13 nt, Bordetella pertussis
cggcguuggccgg

SEQ ID NO: 2460831 - RNA, 15 nt, Bordetella pertussis
cggcguuggccgggu

SEQ ID NO: 2460832 - RNA, 24 nt, Bordetella pertussis
cggcguuggccgggucgcgcagca

SEQ ID NO: 2460833 - RNA, 18 nt, Bordetella pertussis
cggcguugugccggcgca

SEQ ID NO: 2460834 - RNA, 16 nt, Bordetella pertussis
cggcuaccacgugguc

SEQ ID NO: 2460835 - RNA, 13 nt, Bordetella pertussis
cggcuaccgcgcc

SEQ ID NO: 2460836 - RNA, 13 nt, Bordetella pertussis
cggcuacgaccug

SEQ ID NO: 2460837 - RNA, 20 nt, Bordetella pertussis
cggcuacggcaagguccagg

SEQ ID NO: 2460838 - RNA, 15 nt, Bordetella pertussis
cggcuaggcgcagca

SEQ ID NO: 2460839 - RNA, 15 nt, Bordetella pertussis
cggcuauaccgggcu

SEQ ID NO: 2460840 - RNA, 13 nt, Bordetella pertussis
cggcucagccccc

SEQ ID NO: 2460841 - RNA, 21 nt, Bordetella pertussis
cggcucagccucgagguggcg

SEQ ID NO: 2460842 - RNA, 12 nt, Bordetella pertussis
cggcucaggcca

SEQ ID NO: 2460843 - RNA, 13 nt, Bordetella pertussis
cggcucaggccag

SEQ ID NO: 2460844 - RNA, 15 nt, Bordetella pertussis
cggcucaggccagcg

SEQ ID NO: 2460845 - RNA, 18 nt, Bordetella pertussis
cggcuccagcucagcagc

SEQ ID NO: 2460846 - RNA, 14 nt, Bordetella pertussis
cggcuccaggccgc

SEQ ID NO: 2460847 - RNA, 17 nt, Bordetella pertussis
cggcuccaggccgccca

SEQ ID NO: 2460848 - RNA, 19 nt, Bordetella pertussis
cggcuccaggccgcccagc

SEQ ID NO: 2460849 - RNA, 16 nt, Bordetella pertussis
cggcuccagucccgca

SEQ ID NO: 2460850 - RNA, 21 nt, Bordetella pertussis
cggcuccagucccgcaccggg

SEQ ID NO: 2460851 - RNA, 19 nt, Bordetella pertussis
cggcuccccuggucagggc

SEQ ID NO: 2460852 - RNA, 22 nt, Bordetella pertussis
cggcucccgcgccauugccacg

SEQ ID NO: 2460853 - RNA, 16 nt, Bordetella pertussis
cggcuccgauagcggc

SEQ ID NO: 2460854 - RNA, 20 nt, Bordetella pertussis
cggcuccgauagcggcgccg

SEQ ID NO: 2460855 - RNA, 17 nt, Bordetella pertussis
cggcuccgccauugcgc

SEQ ID NO: 2460856 - RNA, 23 nt, Bordetella pertussis
cggcuccgcuaucauccgcgcau

SEQ ID NO: 2460857 - RNA, 12 nt, Bordetella pertussis
cggcuccggccg

SEQ ID NO: 2460858 - RNA, 17 nt, Bordetella pertussis
cggcuccugcuggcgcg

SEQ ID NO: 2460859 - RNA, 15 nt, Bordetella pertussis
cgggcagcccgcgca

SEQ ID NO: 2460860 - RNA, 14 nt, Bordetella pertussis
cgggcagcgcccgc

SEQ ID NO: 2460861 - RNA, 16 nt, Bordetella pertussis
cgggcagcgcccgcgc

SEQ ID NO: 2460862 - RNA, 17 nt, Bordetella pertussis
cgggcagcgcccgcgcc

SEQ ID NO: 2460863 - RNA, 23 nt, Bordetella pertussis
cgggcagcgcccgcgccaucgcg

SEQ ID NO: 2460864 - RNA, 14 nt, Bordetella pertussis
cgggcagcgcggcg

SEQ ID NO: 2460865 - RNA, 15 nt, Bordetella pertussis
cgggcagcgcggcgg

SEQ ID NO: 2460866 - RNA, 16 nt, Bordetella pertussis
cgggcagcgcggcggc

SEQ ID NO: 2460867 - RNA, 22 nt, Bordetella pertussis
cgggcagcgcggcggcgaccgg

SEQ ID NO: 2460868 - RNA, 13 nt, Bordetella pertussis
cgggcagcggcga

SEQ ID NO: 2460869 - RNA, 17 nt, Bordetella pertussis
cgggcagcggcgacggc

SEQ ID NO: 2460870 - RNA, 19 nt, Bordetella pertussis
cgggcagcggcgacggcgc

SEQ ID NO: 2460871 - RNA, 16 nt, Bordetella pertussis
cgggcagcgggccgca

SEQ ID NO: 2460872 - RNA, 16 nt, Bordetella pertussis
cgggcagcucgcgcgc

SEQ ID NO: 2460873 - RNA, 17 nt, Bordetella pertussis
cgggcagcuuggcgcgc

SEQ ID NO: 2460874 - RNA, 18 nt, Bordetella pertussis
cgggcagcuuggcgcgcc

SEQ ID NO: 2460875 - RNA, 19 nt, Bordetella pertussis
cgggcagcuuggcgcgccg

SEQ ID NO: 2460876 - RNA, 14 nt, Bordetella pertussis
cgggcaggauggcc

SEQ ID NO: 2460877 - RNA, 12 nt, Bordetella pertussis
cgggcaggccca

SEQ ID NO: 2460878 - RNA, 13 nt, Bordetella pertussis
cgggcaggcccag

SEQ ID NO: 2460879 - RNA, 14 nt, Bordetella pertussis
cgggcaggcccagc

SEQ ID NO: 2460880 - RNA, 17 nt, Bordetella pertussis
cgggcaggcccagccag

SEQ ID NO: 2460881 - RNA, 18 nt, Bordetella pertussis
cgggcaggcccagccagc

SEQ ID NO: 2460882 - RNA, 17 nt, Bordetella pertussis
cgggcaggccgcgcugg

SEQ ID NO: 2460883 - RNA, 15 nt, Bordetella pertussis
cggcucgaacaggcu

SEQ ID NO: 2460884 - RNA, 16 nt, Bordetella pertussis
cggcucgaacaggcug

SEQ ID NO: 2460885 - RNA, 17 nt, Bordetella pertussis
cggcucgaacaggcugg

SEQ ID NO: 2460886 - RNA, 19 nt, Bordetella pertussis
cggcucgaacaggcuggca

SEQ ID NO: 2460887 - RNA, 18 nt, Bordetella pertussis
cggcucgagcaagggcca

SEQ ID NO: 2460888 - RNA, 13 nt, Bordetella pertussis
cggcucgagcggc

SEQ ID NO: 2460889 - RNA, 21 nt, Bordetella pertussis
cggcucgaucgccgccggcac

SEQ ID NO: 2460890 - RNA, 14 nt, Bordetella pertussis
cggcucgaugcaau

SEQ ID NO: 2460891 - RNA, 14 nt, Bordetella pertussis
cggcucgccgcgca

SEQ ID NO: 2460892 - RNA, 13 nt, Bordetella pertussis
cggcucgccgcuc

SEQ ID NO: 2460893 - RNA, 18 nt, Bordetella pertussis
cggcucgccgcuccggca

SEQ ID NO: 2460894 - RNA, 14 nt, Bordetella pertussis
cggcucgccggccg

SEQ ID NO: 2460895 - RNA, 20 nt, Bordetella pertussis
cggcucgccggccgcgccca

SEQ ID NO: 2460896 - RNA, 20 nt, Bordetella pertussis
cggcucgccuccccaggcca

SEQ ID NO: 2460897 - RNA, 21 nt, Bordetella pertussis
cggcucgccuccccaggccag

SEQ ID NO: 2460898 - RNA, 16 nt, Bordetella pertussis
cggcucgcgcucgccc

SEQ ID NO: 2460899 - RNA, 15 nt, Bordetella pertussis
cggcucggaccuggc

SEQ ID NO: 2460900 - RNA, 18 nt, Bordetella pertussis
cggcucggaccuggccag

SEQ ID NO: 2460901 - RNA, 13 nt, Bordetella pertussis
cggcucggcggca

SEQ ID NO: 2460902 - RNA, 16 nt, Bordetella pertussis
cggcucgggcucgagc

SEQ ID NO: 2460903 - RNA, 22 nt, Bordetella pertussis
cggcucggugaugauggccagg

SEQ ID NO: 2460904 - RNA, 23 nt, Bordetella pertussis
cggcucguaggcgagguccaggc

SEQ ID NO: 2460905 - RNA, 15 nt, Bordetella pertussis
cggcucgucgaacag

SEQ ID NO: 2460906 - RNA, 22 nt, Bordetella pertussis
cggcucgucgaacagcaucagc

SEQ ID NO: 2460907 - RNA, 19 nt, Bordetella pertussis
cggcucuaccaacccugcc

SEQ ID NO: 2460908 - RNA, 12 nt, Bordetella pertussis
cggcucuggauc

SEQ ID NO: 2460909 - RNA, 19 nt, Bordetella pertussis
cggcucuggaucgugccca

SEQ ID NO: 2460910 - RNA, 20 nt, Bordetella pertussis
cggcucuuccaucuacgugc

SEQ ID NO: 2460911 - RNA, 22 nt, Bordetella pertussis
cggcucuuccaucuacgugcug

SEQ ID NO: 2460912 - RNA, 15 nt, Bordetella pertussis
cggcugaauuggcgc

SEQ ID NO: 2460913 - RNA, 21 nt, Bordetella pertussis
cggcugaauuggcgcccaucg

SEQ ID NO: 2460914 - RNA, 15 nt, Bordetella pertussis
cggcugaucaccgcc

SEQ ID NO: 2460915 - RNA, 21 nt, Bordetella pertussis
cggcugaugcccuucggcaug

SEQ ID NO: 2460916 - RNA, 17 nt, Bordetella pertussis
cggcugcaagacgccca

SEQ ID NO: 2460917 - RNA, 19 nt, Bordetella pertussis
cggcugcaagacgcccagg

SEQ ID NO: 2460918 - RNA, 20 nt, Bordetella pertussis
cggcugcaagacgcccaggc

SEQ ID NO: 2460919 - RNA, 16 nt, Bordetella pertussis
cggcugcaccagcgcg

SEQ ID NO: 2460920 - RNA, 19 nt, Bordetella pertussis
cggcugcaccagcgcgccg

SEQ ID NO: 2460921 - RNA, 21 nt, Bordetella pertussis
cggcugcaccagcgcgccgcg

SEQ ID NO: 2460922 - RNA, 22 nt, Bordetella pertussis
cggcugcaccagcgcgccgcgc

SEQ ID NO: 2460923 - RNA, 22 nt, Bordetella pertussis
cggcugcaccaguuugccguug

SEQ ID NO: 2460924 - RNA, 14 nt, Bordetella pertussis
cggcugcaugcgcg

SEQ ID NO: 2460925 - RNA, 18 nt, Bordetella pertussis
cggcugcaugcgcgaacg

SEQ ID NO: 2460926 - RNA, 20 nt, Bordetella pertussis
cggcugccagugguccauca

SEQ ID NO: 2460927 - RNA, 14 nt, Bordetella pertussis
cggcugcccaccuu

SEQ ID NO: 2460928 - RNA, 14 nt, Bordetella pertussis
cggcugcccgggcu

SEQ ID NO: 2460929 - RNA, 22 nt, Bordetella pertussis
cggcugcccgggcugcugcacg

SEQ ID NO: 2460930 - RNA, 15 nt, Bordetella pertussis
cggcugcccuugcug

SEQ ID NO: 2460931 - RNA, 16 nt, Bordetella pertussis
cggcugcccuugcugu

SEQ ID NO: 2460932 - RNA, 20 nt, Bordetella pertussis
cggcugccgauacgggcgcg

SEQ ID NO: 2460933 - RNA, 21 nt, Bordetella pertussis
cggcugccguuuucgaucagg

SEQ ID NO: 2460934 - RNA, 14 nt, Bordetella pertussis
cggcugcgcgacga

SEQ ID NO: 2460935 - RNA, 18 nt, Bordetella pertussis
cggcugcgcgccgaccac

SEQ ID NO: 2460936 - RNA, 17 nt, Bordetella pertussis
cggcugcgcgcgcagcc

SEQ ID NO: 2460937 - RNA, 19 nt, Bordetella pertussis
cggcugcgcgcgcagccag

SEQ ID NO: 2460938 - RNA, 15 nt, Bordetella pertussis
cggcugcgcggccga

SEQ ID NO: 2460939 - RNA, 22 nt, Bordetella pertussis
cggcugcgcggccgagcgggcc

SEQ ID NO: 2460940 - RNA, 14 nt, Bordetella pertussis
cggcugcgggccgg

SEQ ID NO: 2460941 - RNA, 17 nt, Bordetella pertussis
cggcugcgggccggcgc

SEQ ID NO: 2460942 - RNA, 18 nt, Bordetella pertussis
cggcugcgggccggcgcc

SEQ ID NO: 2460943 - RNA, 21 nt, Bordetella pertussis
cggcugcucguucugcgcgcc

SEQ ID NO: 2460944 - RNA, 23 nt, Bordetella pertussis
cggcugcucguucugcgcgcccg

SEQ ID NO: 2460945 - RNA, 14 nt, Bordetella pertussis
cggcugcuggaacg

SEQ ID NO: 2460946 - RNA, 13 nt, Bordetella pertussis
cggcugcuggccc

SEQ ID NO: 2460947 - RNA, 16 nt, Bordetella pertussis
cggcugcuugcccagc

SEQ ID NO: 2460948 - RNA, 14 nt, Bordetella pertussis
cggcuggacgcuuu

SEQ ID NO: 2460949 - RNA, 20 nt, Bordetella pertussis
cggcuggagauacuggccga

SEQ ID NO: 2460950 - RNA, 22 nt, Bordetella pertussis
cggcuggagauacuggccgaug

SEQ ID NO: 2460951 - RNA, 18 nt, Bordetella pertussis
cggcuggauggugccgcc

SEQ ID NO: 2460952 - RNA, 23 nt, Bordetella pertussis
cggcuggauggugccgccgcccg

SEQ ID NO: 2460953 - RNA, 15 nt, Bordetella pertussis
cggcuggcaugcggc

SEQ ID NO: 2460954 - RNA, 16 nt, Bordetella pertussis
cggcuggcaugcggcg

SEQ ID NO: 2460955 - RNA, 20 nt, Bordetella pertussis
cggcuggccacuggccgcgc

SEQ ID NO: 2460956 - RNA, 14 nt, Bordetella pertussis
cggcuggccgauca

SEQ ID NO: 2460957 - RNA, 20 nt, Bordetella pertussis
cggcuggccgaucaccugca

SEQ ID NO: 2460958 - RNA, 22 nt, Bordetella pertussis
cggcuggccgucgaacuccucg

SEQ ID NO: 2460959 - RNA, 21 nt, Bordetella pertussis
cggcuggcgcaagacgcggca

SEQ ID NO: 2460960 - RNA, 15 nt, Bordetella pertussis
cggcuggcgcacgau

SEQ ID NO: 2460961 - RNA, 13 nt, Bordetella pertussis
cggcuggcgccgu

SEQ ID NO: 2460962 - RNA, 22 nt, Bordetella pertussis
cggcuggcggugcgugcgccca

SEQ ID NO: 2460963 - RNA, 15 nt, Bordetella pertussis
cggcuggcugggcgc

SEQ ID NO: 2460964 - RNA, 19 nt, Bordetella pertussis
cggcuggcugggcgcgccg

SEQ ID NO: 2460965 - RNA, 12 nt, Bordetella pertussis
cggcugggcggc

SEQ ID NO: 2460966 - RNA, 12 nt, Bordetella pertussis
cggcuggggcug

SEQ ID NO: 2460967 - RNA, 22 nt, Bordetella pertussis
cggcuggggcugcugggccggc

SEQ ID NO: 2460968 - RNA, 15 nt, Bordetella pertussis
cggcugggucggcgu

SEQ ID NO: 2460969 - RNA, 12 nt, Bordetella pertussis
cggcugggugcg

SEQ ID NO: 2460970 - RNA, 19 nt, Bordetella pertussis
cggcuggucaacucgcccg

SEQ ID NO: 2460971 - RNA, 13 nt, Bordetella pertussis
cggcuggucgggg

SEQ ID NO: 2460972 - RNA, 16 nt, Bordetella pertussis
cggcuggugccgacgg

SEQ ID NO: 2460973 - RNA, 19 nt, Bordetella pertussis
cggcuggugccgacggcgc

SEQ ID NO: 2460974 - RNA, 21 nt, Bordetella pertussis
cggcugguggugccgcgcacg

SEQ ID NO: 2460975 - RNA, 18 nt, Bordetella pertussis
cggcuguagucgccgcug

SEQ ID NO: 2460976 - RNA, 15 nt, Bordetella pertussis
cggcugucgggcggc

SEQ ID NO: 2460977 - RNA, 17 nt, Bordetella pertussis
cggcugucgggcggcgc

SEQ ID NO: 2460978 - RNA, 13 nt, Bordetella pertussis
cggcugugggccu

SEQ ID NO: 2460979 - RNA, 23 nt, Bordetella pertussis
cggcuguugggcaaggugaacau

SEQ ID NO: 2460980 - RNA, 14 nt, Bordetella pertussis
cggcuucaggcgcg

SEQ ID NO: 2460981 - RNA, 15 nt, Bordetella pertussis
cggcuucaggcgcgc

SEQ ID NO: 2460982 - RNA, 18 nt, Bordetella pertussis
cggcuucaggcgcgcggc

SEQ ID NO: 2460983 - RNA, 17 nt, Bordetella pertussis
cggcuucaugccggcgu

SEQ ID NO: 2460984 - RNA, 17 nt, Bordetella pertussis
cggcuuccagcagcaug

SEQ ID NO: 2460985 - RNA, 16 nt, Bordetella pertussis
cggcuuccugccgcac

SEQ ID NO: 2460986 - RNA, 18 nt, Bordetella pertussis
cggcuucgaccacgcggc

SEQ ID NO: 2460987 - RNA, 18 nt, Bordetella pertussis
cggcuucgagcgcgacga

SEQ ID NO: 2460988 - RNA, 22 nt, Bordetella pertussis
cggcuucgaucaugcccgccac

SEQ ID NO: 2460989 - RNA, 14 nt, Bordetella pertussis
cggcuucgcccagc

SEQ ID NO: 2460990 - RNA, 16 nt, Bordetella pertussis
cggcuucgcccagcgc

SEQ ID NO: 2460991 - RNA, 17 nt, Bordetella pertussis
cggcuucggccgucagc

SEQ ID NO: 2460992 - RNA, 12 nt, Bordetella pertussis
cggcuugaccac

SEQ ID NO: 2460993 - RNA, 19 nt, Bordetella pertussis
cggcuugaccacggccagc

SEQ ID NO: 2460994 - RNA, 19 nt, Bordetella pertussis
cggcuugauaugggcgagc

SEQ ID NO: 2460995 - RNA, 18 nt, Bordetella pertussis
cggcuugcacgccggcca

SEQ ID NO: 2460996 - RNA, 18 nt, Bordetella pertussis
cggcuugcagcggacggc

SEQ ID NO: 2460997 - RNA, 21 nt, Bordetella pertussis
cggcuugcagcggacggcgcg

SEQ ID NO: 2460998 - RNA, 17 nt, Bordetella pertussis
cggcuugcauggugccg

SEQ ID NO: 2460999 - RNA, 19 nt, Bordetella pertussis
cggcuugccgcgcggcgua

SEQ ID NO: 2461000 - RNA, 22 nt, Bordetella pertussis
cggcuugccgcgcggcguaugg

SEQ ID NO: 2461001 - RNA, 20 nt, Bordetella pertussis
cggcuugccgcggcgcggcc

SEQ ID NO: 2461002 - RNA, 18 nt, Bordetella pertussis
cggcuugcgcaagccggc

SEQ ID NO: 2461003 - RNA, 20 nt, Bordetella pertussis
cggcuugcgcaagccggccg

SEQ ID NO: 2461004 - RNA, 17 nt, Bordetella pertussis
cggcuugcgccagccac

SEQ ID NO: 2461005 - RNA, 18 nt, Bordetella pertussis
cggcuugcgcgccugcug

SEQ ID NO: 2461006 - RNA, 21 nt, Bordetella pertussis
cggcuugcgcgccugcugguc

SEQ ID NO: 2461007 - RNA, 20 nt, Bordetella pertussis
cggcuuggccucggccggca

SEQ ID NO: 2461008 - RNA, 22 nt, Bordetella pertussis
cggcuuggcgugcgcgagcugg

SEQ ID NO: 2461009 - RNA, 19 nt, Bordetella pertussis
cggcuuguucgagcgcgcg

SEQ ID NO: 2461010 - RNA, 19 nt, Bordetella pertussis
cggcuuucagcgccgagcg

SEQ ID NO: 2461011 - RNA, 14 nt, Bordetella pertussis
cggcuuucaugggc

SEQ ID NO: 2461012 - RNA, 22 nt, Bordetella pertussis
cggcuuucaugggccugggcgc

SEQ ID NO: 2461013 - RNA, 22 nt, Bordetella pertussis
cggcuuucgauuugcagcagca

SEQ ID NO: 2461014 - RNA, 20 nt, Bordetella pertussis
cggcuuuggacaggcgugcg

SEQ ID NO: 2461015 - RNA, 17 nt, Bordetella pertussis
cggcuuuuucucggccu

SEQ ID NO: 2461016 - RNA, 23 nt, Bordetella pertussis
cggcuuuuucucggccucgcggc

SEQ ID NO: 2461017 - RNA, 22 nt, Bordetella pertussis
cggcuuuuuugcguucgcgccg

SEQ ID NO: 2461018 - RNA, 15 nt, Bordetella pertussis
cgggaaacaggccca

SEQ ID NO: 2461019 - RNA, 20 nt, Bordetella pertussis
cgggaaacucgcgcagcgug

SEQ ID NO: 2461020 - RNA, 14 nt, Bordetella pertussis
cgggaacaggcacc

SEQ ID NO: 2461021 - RNA, 17 nt, Bordetella pertussis
cauuagggcccagcugc

SEQ ID NO: 2461022 - RNA, 13 nt, Bordetella pertussis
cauucauccagcg

SEQ ID NO: 2461023 - RNA, 15 nt, Bordetella pertussis
cauucccgcccagcg

SEQ ID NO: 2461024 - RNA, 16 nt, Bordetella pertussis
cauucccgcccagcga

SEQ ID NO: 2461025 - RNA, 14 nt, Bordetella pertussis
cauuccgagcgggc

SEQ ID NO: 2461026 - RNA, 23 nt, Bordetella pertussis
cauuccuuccgggcccgcgccga

SEQ ID NO: 2461027 - RNA, 15 nt, Bordetella pertussis
cauucgcgccugagc

SEQ ID NO: 2461028 - RNA, 16 nt, Bordetella pertussis
cauucggcgcgcucgg

SEQ ID NO: 2461029 - RNA, 20 nt, Bordetella pertussis
cauucggcgcgcucggcgcc

SEQ ID NO: 2461030 - RNA, 15 nt, Bordetella pertussis
cauucggcggccggc

SEQ ID NO: 2461031 - RNA, 23 nt, Bordetella pertussis
cauucguccagguugucggccau

SEQ ID NO: 2461032 - RNA, 20 nt, Bordetella pertussis
cauucucgcccugcuggcgc

SEQ ID NO: 2461033 - RNA, 23 nt, Bordetella pertussis
cauucucggacaggucggcgccc

SEQ ID NO: 2461034 - RNA, 21 nt, Bordetella pertussis
cauucuucgccgaugcgcucg

SEQ ID NO: 2461035 - RNA, 17 nt, Bordetella pertussis
cauugaaacguacucca

SEQ ID NO: 2461036 - RNA, 18 nt, Bordetella pertussis
cauugaaagcgcgagcuc

SEQ ID NO: 2461037 - RNA, 22 nt, Bordetella pertussis
cauugaacaccccggucagcag

SEQ ID NO: 2461038 - RNA, 14 nt, Bordetella pertussis
cauugaccugcuug

SEQ ID NO: 2461039 - RNA, 15 nt, Bordetella pertussis
cauugaucgaucagc

SEQ ID NO: 2461040 - RNA, 13 nt, Bordetella pertussis
cauugcagggugu

SEQ ID NO: 2461041 - RNA, 14 nt, Bordetella pertussis
cauugcaggguguc

SEQ ID NO: 2461042 - RNA, 19 nt, Bordetella pertussis
cauugcagggugucggcca

SEQ ID NO: 2461043 - RNA, 22 nt, Bordetella pertussis
cauugcagggugucggccaggg

SEQ ID NO: 2461044 - RNA, 20 nt, Bordetella pertussis
cauugccacggcgggccggc

SEQ ID NO: 2461045 - RNA, 12 nt, Bordetella pertussis
cauugcccagca

SEQ ID NO: 2461046 - RNA, 15 nt, Bordetella pertussis
cauugcccagcacca

SEQ ID NO: 2461047 - RNA, 12 nt, Bordetella pertussis
cauugcccaggu

SEQ ID NO: 2461048 - RNA, 22 nt, Bordetella pertussis
cauugcccagguugaaggccgc

SEQ ID NO: 2461049 - RNA, 21 nt, Bordetella pertussis
cauugccgccacgggcccgcg

SEQ ID NO: 2461050 - RNA, 13 nt, Bordetella pertussis
cauugccguacgc

SEQ ID NO: 2461051 - RNA, 19 nt, Bordetella pertussis
cauugccucgcggcagugg

SEQ ID NO: 2461052 - RNA, 15 nt, Bordetella pertussis
cauugcgccagccgu

SEQ ID NO: 2461053 - RNA, 20 nt, Bordetella pertussis
cauugcgccagccguugcgc

SEQ ID NO: 2461054 - RNA, 14 nt, Bordetella pertussis
cauugcgcggccag

SEQ ID NO: 2461055 - RNA, 23 nt, Bordetella pertussis
cauugcgcggccagggcugcggc

SEQ ID NO: 2461056 - RNA, 17 nt, Bordetella pertussis
cauugcggcaccugcug

SEQ ID NO: 2461057 - RNA, 18 nt, Bordetella pertussis
cauugcggcaccugcugc

SEQ ID NO: 2461058 - RNA, 19 nt, Bordetella pertussis
cauugcggcaccugcugcu

SEQ ID NO: 2461059 - RNA, 23 nt, Bordetella pertussis
cauugcgggugggcauccagcgg

SEQ ID NO: 2461060 - RNA, 13 nt, Bordetella pertussis
cauuggccagcgc

SEQ ID NO: 2461061 - RNA, 15 nt, Bordetella pertussis
cauuggcccugcugg

SEQ ID NO: 2461062 - RNA, 16 nt, Bordetella pertussis
cauuggccgccgccac

SEQ ID NO: 2461063 - RNA, 17 nt, Bordetella pertussis
cauuggccgccgccacc

SEQ ID NO: 2461064 - RNA, 14 nt, Bordetella pertussis
cauuggcgccgcgc

SEQ ID NO: 2461065 - RNA, 13 nt, Bordetella pertussis
cauuggcggcggc

SEQ ID NO: 2461066 - RNA, 18 nt, Bordetella pertussis
cauuggcggcggcguuca

SEQ ID NO: 2461067 - RNA, 17 nt, Bordetella pertussis
cauugggacgccagccc

SEQ ID NO: 2461068 - RNA, 13 nt, Bordetella pertussis
cauugggcagcgg

SEQ ID NO: 2461069 - RNA, 18 nt, Bordetella pertussis
cauuggguacgacggccg

SEQ ID NO: 2461070 - RNA, 14 nt, Bordetella pertussis
cauuggugcgcaca

SEQ ID NO: 2461071 - RNA, 17 nt, Bordetella pertussis
cauugucaagcagcgcc

SEQ ID NO: 2461072 - RNA, 19 nt, Bordetella pertussis
cauugucaagcagcgccgg

SEQ ID NO: 2461073 - RNA, 13 nt, Bordetella pertussis
cauuucccagccg

SEQ ID NO: 2461074 - RNA, 20 nt, Bordetella pertussis
cauuuccucgaccagcgcgc

SEQ ID NO: 2461075 - RNA, 22 nt, Bordetella pertussis
cauuuccucgaccagcgcgcgg

SEQ ID NO: 2461076 - RNA, 22 nt, Bordetella pertussis
cauuucgaugcgcaccaugcgc

SEQ ID NO: 2461077 - RNA, 18 nt, Bordetella pertussis
cauuucgauuucggcggc

SEQ ID NO: 2461078 - RNA, 23 nt, Bordetella pertussis
cauuucgauuucggcggccaggc

SEQ ID NO: 2461079 - RNA, 19 nt, Bordetella pertussis
cauuucgcaaagaagcugc

SEQ ID NO: 2461080 - RNA, 16 nt, Bordetella pertussis
cauuucgcgugcgugg

SEQ ID NO: 2461081 - RNA, 17 nt, Bordetella pertussis
cauuucgcugggcgcgc

SEQ ID NO: 2461082 - RNA, 15 nt, Bordetella pertussis
cauuucggcgccgcc

SEQ ID NO: 2461083 - RNA, 18 nt, Bordetella pertussis
cauuucggcgccgcgcug

SEQ ID NO: 2461084 - RNA, 18 nt, Bordetella pertussis
cauuucguaaagccgcac

SEQ ID NO: 2461085 - RNA, 20 nt, Bordetella pertussis
cauuucucggccugggcgcg

SEQ ID NO: 2461086 - RNA, 18 nt, Bordetella pertussis
cauuugcggaugcccggg

SEQ ID NO: 2461087 - RNA, 16 nt, Bordetella pertussis
ccaaaacagacaggcc

SEQ ID NO: 2461088 - RNA, 17 nt, Bordetella pertussis
ccaaaaggcagcaggcu

SEQ ID NO: 2461089 - RNA, 16 nt, Bordetella pertussis
ccaacacgauccacgg

SEQ ID NO: 2461090 - RNA, 23 nt, Bordetella pertussis
ccaacacuuucaucaaacgcggc

SEQ ID NO: 2461091 - RNA, 16 nt, Bordetella pertussis
ccaacagcucgcgcca

SEQ ID NO: 2461092 - RNA, 18 nt, Bordetella pertussis
ccaacagcucgcgccagg

SEQ ID NO: 2461093 - RNA, 23 nt, Bordetella pertussis
ccaacaugccggacaagccccuc

SEQ ID NO: 2461094 - RNA, 23 nt, Bordetella pertussis
ccaaccacgagcugcagcccggc

SEQ ID NO: 2461095 - RNA, 19 nt, Bordetella pertussis
ccaaccccgagggcgcggc

SEQ ID NO: 2461096 - RNA, 15 nt, Bordetella pertussis
ccaacccgccauccu

SEQ ID NO: 2461097 - RNA, 21 nt, Bordetella pertussis
ccaacccguuccccaucaucu

SEQ ID NO: 2461098 - RNA, 19 nt, Bordetella pertussis
ccaaccgggacaggcaccu

SEQ ID NO: 2461099 - RNA, 15 nt, Bordetella pertussis
ccaaccugcuggcca

SEQ ID NO: 2461100 - RNA, 18 nt, Bordetella pertussis
ccaaccugguauccggcg

SEQ ID NO: 2461101 - RNA, 21 nt, Bordetella pertussis
ccaaccugguauccggcgcac

SEQ ID NO: 2461102 - RNA, 23 nt, Bordetella pertussis
ccaaccugguauccggcgcacgc

SEQ ID NO: 2461103 - RNA, 22 nt, Bordetella pertussis
ccaaccuucacgacacgcccag

SEQ ID NO: 2461104 - RNA, 21 nt, Bordetella pertussis
ccaacgacuucaccgugaugg

SEQ ID NO: 2461105 - RNA, 12 nt, Bordetella pertussis
ccaacgaggaca

SEQ ID NO: 2461106 - RNA, 20 nt, Bordetella pertussis
ccaacgcacaagggccccgc

SEQ ID NO: 2461107 - RNA, 17 nt, Bordetella pertussis
ccaacgccaagcugcug

SEQ ID NO: 2461108 - RNA, 17 nt, Bordetella pertussis
ccaacgcgaucucagcc

SEQ ID NO: 2461109 - RNA, 11 nt, Bordetella pertussis
ccaacgcggcg

SEQ ID NO: 2461110 - RNA, 19 nt, Bordetella pertussis
ccaacgcggcgucgacgcc

SEQ ID NO: 2461111 - RNA, 21 nt, Bordetella pertussis
ccaacggggacgggcgcccgc

SEQ ID NO: 2461112 - RNA, 14 nt, Bordetella pertussis
ccaacggggccgcc

SEQ ID NO: 2461113 - RNA, 20 nt, Bordetella pertussis
ccaacggugccagucccccu

SEQ ID NO: 2461114 - RNA, 21 nt, Bordetella pertussis
ccaacggugccagucccccug

SEQ ID NO: 2461115 - RNA, 15 nt, Bordetella pertussis
ccaacgucggcagcc

SEQ ID NO: 2461116 - RNA, 14 nt, Bordetella pertussis
ccaacucgaggcgg

SEQ ID NO: 2461117 - RNA, 12 nt, Bordetella pertussis
ccaacugccugc

SEQ ID NO: 2461118 - RNA, 17 nt, Bordetella pertussis
ccaagaccgcggccgcg

SEQ ID NO: 2461119 - RNA, 18 nt, Bordetella pertussis
ccaagacgcggggacagg

SEQ ID NO: 2461120 - RNA, 19 nt, Bordetella pertussis
ccaagacgcggggacaggc

SEQ ID NO: 2461121 - RNA, 14 nt, Bordetella pertussis
ccaagauggcccag

SEQ ID NO: 2461122 - RNA, 22 nt, Bordetella pertussis
ccaagauggcccagggcagcgg

SEQ ID NO: 2461123 - RNA, 21 nt, Bordetella pertussis
ccaagcagacccgcgcccagc

SEQ ID NO: 2461124 - RNA, 13 nt, Bordetella pertussis
ccaagcagcgccu

SEQ ID NO: 2461125 - RNA, 16 nt, Bordetella pertussis
ccaagcagcgccugcc

SEQ ID NO: 2461126 - RNA, 12 nt, Bordetella pertussis
ccaagcgcacgc

SEQ ID NO: 2461127 - RNA, 17 nt, Bordetella pertussis
ccaagcgcacgcgcagc

SEQ ID NO: 2461128 - RNA, 18 nt, Bordetella pertussis
ccaagcgcacgcgcagca

SEQ ID NO: 2461129 - RNA, 12 nt, Bordetella pertussis
ccaagcgcgccg

SEQ ID NO: 2461130 - RNA, 14 nt, Bordetella pertussis
ccaagcgcgccggc

SEQ ID NO: 2461131 - RNA, 17 nt, Bordetella pertussis
cgggccggcucggcggc

SEQ ID NO: 2461132 - RNA, 14 nt, Bordetella pertussis
cgggccggcugccg

SEQ ID NO: 2461133 - RNA, 15 nt, Bordetella pertussis
cgggccggcugggcg

SEQ ID NO: 2461134 - RNA, 15 nt, Bordetella pertussis
cgggccgggcacgau

SEQ ID NO: 2461135 - RNA, 16 nt, Bordetella pertussis
cgggccgggcaggccg

SEQ ID NO: 2461136 - RNA, 20 nt, Bordetella pertussis
cgggccgggcaggccgcgcu

SEQ ID NO: 2461137 - RNA, 15 nt, Bordetella pertussis
cgggccggucgcgau

SEQ ID NO: 2461138 - RNA, 20 nt, Bordetella pertussis
cgggccgguuucggccugca

SEQ ID NO: 2461139 - RNA, 23 nt, Bordetella pertussis
cgggccgucgugcgccuggcggc

SEQ ID NO: 2461140 - RNA, 22 nt, Bordetella pertussis
cgggccgucuacaggcccagcg

SEQ ID NO: 2461141 - RNA, 16 nt, Bordetella pertussis
cgggccgugcgccggg

SEQ ID NO: 2461142 - RNA, 17 nt, Bordetella pertussis
cgggccgugcgccgggc

SEQ ID NO: 2461143 - RNA, 18 nt, Bordetella pertussis
cgggccguggcgauccag

SEQ ID NO: 2461144 - RNA, 18 nt, Bordetella pertussis
cgggccguugcgccugcc

SEQ ID NO: 2461145 - RNA, 19 nt, Bordetella pertussis
cgggccuacugggccagau

SEQ ID NO: 2461146 - RNA, 18 nt, Bordetella pertussis
cgggccuacuucggcagc

SEQ ID NO: 2461147 - RNA, 21 nt, Bordetella pertussis
cgggccuacuucggcagcuug

SEQ ID NO: 2461148 - RNA, 18 nt, Bordetella pertussis
cgggccuacuugccggcg

SEQ ID NO: 2461149 - RNA, 20 nt, Bordetella pertussis
cgggccuacuugccggcgcu

SEQ ID NO: 2461150 - RNA, 12 nt, Bordetella pertussis
cgggccuagccc

SEQ ID NO: 2461151 - RNA, 16 nt, Bordetella pertussis
cgggccuagcccggcg

SEQ ID NO: 2461152 - RNA, 20 nt, Bordetella pertussis
cgggccuagcccggcgccac

SEQ ID NO: 2461153 - RNA, 20 nt, Bordetella pertussis
cgggccucaaucgaugaugu

SEQ ID NO: 2461154 - RNA, 22 nt, Bordetella pertussis
cgggccucgaagcccggcaggg

SEQ ID NO: 2461155 - RNA, 15 nt, Bordetella pertussis
cgggccucgaugacc

SEQ ID NO: 2461156 - RNA, 13 nt, Bordetella pertussis
cgggccugcagca

SEQ ID NO: 2461157 - RNA, 18 nt, Bordetella pertussis
cgggccugcagcaugacc

SEQ ID NO: 2461158 - RNA, 21 nt, Bordetella pertussis
cgggccugcaguucggccgcc

SEQ ID NO: 2461159 - RNA, 14 nt, Bordetella pertussis
cgggccugcucggc

SEQ ID NO: 2461160 - RNA, 15 nt, Bordetella pertussis
cgggccuggccugcg

SEQ ID NO: 2461161 - RNA, 16 nt, Bordetella pertussis
cgggccuggccugcgc

SEQ ID NO: 2461162 - RNA, 17 nt, Bordetella pertussis
cgggccuggccugcgcc

SEQ ID NO: 2461163 - RNA, 22 nt, Bordetella pertussis
cgggccuggccugcgccgccgc

SEQ ID NO: 2461164 - RNA, 20 nt, Bordetella pertussis
cgggccuggcggaucucggc

SEQ ID NO: 2461165 - RNA, 21 nt, Bordetella pertussis
cgggccuggcucaggccugca

SEQ ID NO: 2461166 - RNA, 21 nt, Bordetella pertussis
cgggccugggcgucgagcggc

SEQ ID NO: 2461167 - RNA, 16 nt, Bordetella pertussis
cgggccuuggccagca

SEQ ID NO: 2461168 - RNA, 20 nt, Bordetella pertussis
cgggcgaaccgguggccaug

SEQ ID NO: 2461169 - RNA, 17 nt, Bordetella pertussis
cgggcgaagcagucaug

SEQ ID NO: 2461170 - RNA, 12 nt, Bordetella pertussis
cgggcgaaguca

SEQ ID NO: 2461171 - RNA, 19 nt, Bordetella pertussis
cgggcgacaggcgcgcccg

SEQ ID NO: 2461172 - RNA, 16 nt, Bordetella pertussis
cgggcgacggcgugcu

SEQ ID NO: 2461173 - RNA, 17 nt, Bordetella pertussis
cgggcgacuccagcccg

SEQ ID NO: 2461174 - RNA, 18 nt, Bordetella pertussis
cgggcgacuccagcccga

SEQ ID NO: 2461175 - RNA, 20 nt, Bordetella pertussis
cgggcgagaucagccaccgg

SEQ ID NO: 2461176 - RNA, 22 nt, Bordetella pertussis
cgggcgagauggcgugcacgcg

SEQ ID NO: 2461177 - RNA, 18 nt, Bordetella pertussis
cgggcgagccgaacgauu

SEQ ID NO: 2461178 - RNA, 20 nt, Bordetella pertussis
cgggcgaggacuacgcggug

SEQ ID NO: 2461179 - RNA, 24 nt, Bordetella pertussis
cgggcgaggacuacgcgguguuca

SEQ ID NO: 2461180 - RNA, 13 nt, Bordetella pertussis
cgggcgagggcug

SEQ ID NO: 2461181 - RNA, 16 nt, Bordetella pertussis
cgggcgagggcugccc

SEQ ID NO: 2461182 - RNA, 17 nt, Bordetella pertussis
cgggcgaggucagcccg

SEQ ID NO: 2461183 - RNA, 19 nt, Bordetella pertussis
cgggcgaggucagcccggc

SEQ ID NO: 2461184 - RNA, 21 nt, Bordetella pertussis
cgggcgaggucagcccggcgg

SEQ ID NO: 2461185 - RNA, 23 nt, Bordetella pertussis
cgggcgauauccaucggcgcgcg

SEQ ID NO: 2461186 - RNA, 17 nt, Bordetella pertussis
cgggcgaucgcgucggc

SEQ ID NO: 2461187 - RNA, 16 nt, Bordetella pertussis
cgggcgauggccacgc

SEQ ID NO: 2461188 - RNA, 18 nt, Bordetella pertussis
cgggcgauuugccgcagc

SEQ ID NO: 2461189 - RNA, 20 nt, Bordetella pertussis
cgggcgauuugccgcagccc

SEQ ID NO: 2461190 - RNA, 21 nt, Bordetella pertussis
cgggcgauuugccgcagcccg

SEQ ID NO: 2461191 - RNA, 16 nt, Bordetella pertussis
cgggcgcaagccagca

SEQ ID NO: 2461192 - RNA, 16 nt, Bordetella pertussis
cgggcgcaagcgcgcc

SEQ ID NO: 2461193 - RNA, 17 nt, Bordetella pertussis
cgggcgcaagcgcgccg

SEQ ID NO: 2461194 - RNA, 18 nt, Bordetella pertussis
cgggcgcaaguguggcgc

SEQ ID NO: 2461195 - RNA, 22 nt, Bordetella pertussis
cgggcgcacaguugcaggccau

SEQ ID NO: 2461196 - RNA, 16 nt, Bordetella pertussis
cgggcgcagcgccgcu

SEQ ID NO: 2461197 - RNA, 12 nt, Bordetella pertussis
cgggcgccagca

SEQ ID NO: 2461198 - RNA, 16 nt, Bordetella pertussis
cgggcgccagcagcgg

SEQ ID NO: 2461199 - RNA, 22 nt, Bordetella pertussis
cgggcgccagcagcgggcuggg

SEQ ID NO: 2461200 - RNA, 14 nt, Bordetella pertussis
cgggcgccaggcug

SEQ ID NO: 2461201 - RNA, 13 nt, Bordetella pertussis
cgggcgcccagcg

SEQ ID NO: 2461202 - RNA, 17 nt, Bordetella pertussis
cgggcgccccgaucggc

SEQ ID NO: 2461203 - RNA, 18 nt, Bordetella pertussis
cgggcgcccgcgcgcgag

SEQ ID NO: 2461204 - RNA, 18 nt, Bordetella pertussis
cgggcgcccggccggccu

SEQ ID NO: 2461205 - RNA, 19 nt, Bordetella pertussis
cgggcgccgauccagccca

SEQ ID NO: 2461206 - RNA, 23 nt, Bordetella pertussis
cgggcgccgauccagcccaccgc

SEQ ID NO: 2461207 - RNA, 13 nt, Bordetella pertussis
cgggcgccgcgca

SEQ ID NO: 2461208 - RNA, 14 nt, Bordetella pertussis
cgggcgccgcgcac

SEQ ID NO: 2461209 - RNA, 18 nt, Bordetella pertussis
cgggcgccgcgcacgcac

SEQ ID NO: 2461210 - RNA, 13 nt, Bordetella pertussis
cgggcgccgcgcc

SEQ ID NO: 2461211 - RNA, 16 nt, Bordetella pertussis
cgggcgccgcgcccca

SEQ ID NO: 2461212 - RNA, 17 nt, Bordetella pertussis
cgggcgccggcacgacg

SEQ ID NO: 2461213 - RNA, 18 nt, Bordetella pertussis
cgggcgccggcgcccggc

SEQ ID NO: 2461214 - RNA, 15 nt, Bordetella pertussis
cgggcgccucguccu

SEQ ID NO: 2461215 - RNA, 18 nt, Bordetella pertussis
cgggcgccucguccugca

SEQ ID NO: 2461216 - RNA, 22 nt, Bordetella pertussis
cgggcgccucguccugcaggcg

SEQ ID NO: 2461217 - RNA, 15 nt, Bordetella pertussis
cgggcgccugccgca

SEQ ID NO: 2461218 - RNA, 19 nt, Bordetella pertussis
cgggcgccugccgcauccc

SEQ ID NO: 2461219 - RNA, 14 nt, Bordetella pertussis
cgggcgccugcgcc

SEQ ID NO: 2461220 - RNA, 15 nt, Bordetella pertussis
cgggcgccugcgcca

SEQ ID NO: 2461221 - RNA, 23 nt, Bordetella pertussis
cgggcgccugcgccaccuggcgc

SEQ ID NO: 2461222 - RNA, 16 nt, Bordetella pertussis
cgggcgccugcggcag

SEQ ID NO: 2461223 - RNA, 20 nt, Bordetella pertussis
cgggcgccugcggcaggccg

SEQ ID NO: 2461224 - RNA, 21 nt, Bordetella pertussis
cgggcgccugcggcaggccgc

SEQ ID NO: 2461225 - RNA, 15 nt, Bordetella pertussis
cgguacaggcugccg

SEQ ID NO: 2461226 - RNA, 20 nt, Bordetella pertussis
cgguacaggcugccgucggc

SEQ ID NO: 2461227 - RNA, 12 nt, Bordetella pertussis
cgguacaggucg

SEQ ID NO: 2461228 - RNA, 21 nt, Bordetella pertussis
cgguacauacgugguggugcg

SEQ ID NO: 2461229 - RNA, 22 nt, Bordetella pertussis
cgguaccguccuggcagucagc

SEQ ID NO: 2461230 - RNA, 15 nt, Bordetella pertussis
cgguacgcaccgccg

SEQ ID NO: 2461231 - RNA, 16 nt, Bordetella pertussis
cgguacgccugcaccg

SEQ ID NO: 2461232 - RNA, 19 nt, Bordetella pertussis
cgguacgccugcaccgccg

SEQ ID NO: 2461233 - RNA, 17 nt, Bordetella pertussis
cgguacuccuugacgcg

SEQ ID NO: 2461234 - RNA, 19 nt, Bordetella pertussis
cgguacuccuugacgcgcg

SEQ ID NO: 2461235 - RNA, 21 nt, Bordetella pertussis
cgguacuccuugacgcgcgcg

SEQ ID NO: 2461236 - RNA, 15 nt, Bordetella pertussis
cgguacugcggcgcc

SEQ ID NO: 2461237 - RNA, 21 nt, Bordetella pertussis
cgguacugcggcgccugggcc

SEQ ID NO: 2461238 - RNA, 14 nt, Bordetella pertussis
cgguagacgccggg

SEQ ID NO: 2461239 - RNA, 14 nt, Bordetella pertussis
cgguagcccgcgug

SEQ ID NO: 2461240 - RNA, 16 nt, Bordetella pertussis
cgguagccgggucugg

SEQ ID NO: 2461241 - RNA, 17 nt, Bordetella pertussis
cgguagcgccccucgcg

SEQ ID NO: 2461242 - RNA, 20 nt, Bordetella pertussis
cgguagcgcugggcgccagc

SEQ ID NO: 2461243 - RNA, 16 nt, Bordetella pertussis
cgguaggacggcagca

SEQ ID NO: 2461244 - RNA, 16 nt, Bordetella pertussis
cgguaggccacgcgcg

SEQ ID NO: 2461245 - RNA, 12 nt, Bordetella pertussis
cgguaggcgccc

SEQ ID NO: 2461246 - RNA, 15 nt, Bordetella pertussis
cgguaggcgcccgac

SEQ ID NO: 2461247 - RNA, 12 nt, Bordetella pertussis
cgguaggcgcgu

SEQ ID NO: 2461248 - RNA, 15 nt, Bordetella pertussis
cgguagguagcgcgc

SEQ ID NO: 2461249 - RNA, 17 nt, Bordetella pertussis
cgguagucgccggcuuc

SEQ ID NO: 2461250 - RNA, 15 nt, Bordetella pertussis
cgguaguucagcagc

SEQ ID NO: 2461251 - RNA, 21 nt, Bordetella pertussis
cgguauccacguagcgcacga

SEQ ID NO: 2461252 - RNA, 15 nt, Bordetella pertussis
cgguauccaggucga

SEQ ID NO: 2461253 - RNA, 22 nt, Bordetella pertussis
cgguaucccaccugcagccaga

SEQ ID NO: 2461254 - RNA, 13 nt, Bordetella pertussis
cgguauccgcgca

SEQ ID NO: 2461255 - RNA, 15 nt, Bordetella pertussis
cgguauccuggcgcg

SEQ ID NO: 2461256 - RNA, 17 nt, Bordetella pertussis
cgguauccuggcgcgga

SEQ ID NO: 2461257 - RNA, 17 nt, Bordetella pertussis
cgguaucgacgcgcguc

SEQ ID NO: 2461258 - RNA, 20 nt, Bordetella pertussis
cgguaucgacgcgcgucgug

SEQ ID NO: 2461259 - RNA, 13 nt, Bordetella pertussis
cgguaucgcggcg

SEQ ID NO: 2461260 - RNA, 14 nt, Bordetella pertussis
cgguaucgcggcgc

SEQ ID NO: 2461261 - RNA, 17 nt, Bordetella pertussis
cgguaucgcggcgcagg

SEQ ID NO: 2461262 - RNA, 20 nt, Bordetella pertussis
cgguaucgcggcgcaggcgg

SEQ ID NO: 2461263 - RNA, 18 nt, Bordetella pertussis
cgguaucugucccggcgg

SEQ ID NO: 2461264 - RNA, 14 nt, Bordetella pertussis
cgguaugccugcca

SEQ ID NO: 2461265 - RNA, 15 nt, Bordetella pertussis
cgguaugccugccag

SEQ ID NO: 2461266 - RNA, 15 nt, Bordetella pertussis
cgguaugcggcgccc

SEQ ID NO: 2461267 - RNA, 18 nt, Bordetella pertussis
cgguauggccgcccagca

SEQ ID NO: 2461268 - RNA, 18 nt, Bordetella pertussis
cgguauggcggcaacgug

SEQ ID NO: 2461269 - RNA, 18 nt, Bordetella pertussis
cgguauucggcgaccagg

SEQ ID NO: 2461270 - RNA, 17 nt, Bordetella pertussis
cgguauugcacggugcc

SEQ ID NO: 2461271 - RNA, 14 nt, Bordetella pertussis
cgguauugcgccac

SEQ ID NO: 2461272 - RNA, 18 nt, Bordetella pertussis
cggucaacgccugcgggc

SEQ ID NO: 2461273 - RNA, 16 nt, Bordetella pertussis
cggucaaugcggcggc

SEQ ID NO: 2461274 - RNA, 21 nt, Bordetella pertussis
cggucaauguauuuggcggcu

SEQ ID NO: 2461275 - RNA, 22 nt, Bordetella pertussis
cggucaccgagcugagcaccag

SEQ ID NO: 2461276 - RNA, 18 nt, Bordetella pertussis
cggucaccgcgcccaggg

SEQ ID NO: 2461277 - RNA, 20 nt, Bordetella pertussis
cggucacguucagcgccggc

SEQ ID NO: 2461278 - RNA, 24 nt, Bordetella pertussis
cggucacugccgaaacgcuggcgu

SEQ ID NO: 2461279 - RNA, 17 nt, Bordetella pertussis
cggucagcaaccccagc

SEQ ID NO: 2461280 - RNA, 20 nt, Bordetella pertussis
cggucagcaaccccagcagc

SEQ ID NO: 2461281 - RNA, 22 nt, Bordetella pertussis
cggucagcaaccccagcagcgc

SEQ ID NO: 2461282 - RNA, 23 nt, Bordetella pertussis
cggucagcaaccccagcagcgcc

SEQ ID NO: 2461283 - RNA, 21 nt, Bordetella pertussis
cggucagcagggcgccgacga

SEQ ID NO: 2461284 - RNA, 12 nt, Bordetella pertussis
cggucagcauga

SEQ ID NO: 2461285 - RNA, 13 nt, Bordetella pertussis
cggucagcaugaa

SEQ ID NO: 2461286 - RNA, 18 nt, Bordetella pertussis
cggucagcccaggcgggc

SEQ ID NO: 2461287 - RNA, 21 nt, Bordetella pertussis
cggucagccugauucccaggc

SEQ ID NO: 2461288 - RNA, 14 nt, Bordetella pertussis
cggucagcgccagg

SEQ ID NO: 2461289 - RNA, 15 nt, Bordetella pertussis
cggucagcgccaggg

SEQ ID NO: 2461290 - RNA, 15 nt, Bordetella pertussis
cggucagcgcggcgc

SEQ ID NO: 2461291 - RNA, 17 nt, Bordetella pertussis
cggucagcgcggcgccg

SEQ ID NO: 2461292 - RNA, 14 nt, Bordetella pertussis
cggucagcucaaga

SEQ ID NO: 2461293 - RNA, 18 nt, Bordetella pertussis
cggucagcucgucgccgc

SEQ ID NO: 2461294 - RNA, 18 nt, Bordetella pertussis
cggucagcuggaacgcgc

SEQ ID NO: 2461295 - RNA, 22 nt, Bordetella pertussis
cggucagcuggaacgcgccgcu

SEQ ID NO: 2461296 - RNA, 21 nt, Bordetella pertussis
cggucagcuugccgcccaggu

SEQ ID NO: 2461297 - RNA, 17 nt, Bordetella pertussis
cggucaggaugcgcgcc

SEQ ID NO: 2461298 - RNA, 20 nt, Bordetella pertussis
cggucaggaugcgcgccagg

SEQ ID NO: 2461299 - RNA, 21 nt, Bordetella pertussis
cggucaggaugcgcgccaggc

SEQ ID NO: 2461300 - RNA, 16 nt, Bordetella pertussis
cggucaggcgucguug

SEQ ID NO: 2461301 - RNA, 19 nt, Bordetella pertussis
cggucaggcgucguuggcc

SEQ ID NO: 2461302 - RNA, 13 nt, Bordetella pertussis
cggucagggaggc

SEQ ID NO: 2461303 - RNA, 17 nt, Bordetella pertussis
cggucagucgggacggc

SEQ ID NO: 2461304 - RNA, 19 nt, Bordetella pertussis
cggucagucgggacggcgc

SEQ ID NO: 2461305 - RNA, 14 nt, Bordetella pertussis
cggucauagacggc

SEQ ID NO: 2461306 - RNA, 18 nt, Bordetella pertussis
cggucauagacggcgucg

SEQ ID NO: 2461307 - RNA, 19 nt, Bordetella pertussis
cggucauagacggcgucgg

SEQ ID NO: 2461308 - RNA, 16 nt, Bordetella pertussis
cggucaucggcgacga

SEQ ID NO: 2461309 - RNA, 20 nt, Bordetella pertussis
cggucaugagcgucaugucc

SEQ ID NO: 2461310 - RNA, 20 nt, Bordetella pertussis
cggucaugcccaugccgcca

SEQ ID NO: 2461311 - RNA, 21 nt, Bordetella pertussis
cggucaugcccaugccgccau

SEQ ID NO: 2461312 - RNA, 13 nt, Bordetella pertussis
cggucauguccag

SEQ ID NO: 2461313 - RNA, 21 nt, Bordetella pertussis
cggucauguccagcgccaggc

SEQ ID NO: 2461314 - RNA, 15 nt, Bordetella pertussis
cgguccacgcccugg

SEQ ID NO: 2461315 - RNA, 16 nt, Bordetella pertussis
cgguccacgcccuggc

SEQ ID NO: 2461316 - RNA, 19 nt, Bordetella pertussis
cgguccacgccggguugcg

SEQ ID NO: 2461317 - RNA, 13 nt, Bordetella pertussis
cgguccagcacca

SEQ ID NO: 2461318 - RNA, 14 nt, Bordetella pertussis
cgguccagcaccag

SEQ ID NO: 2461319 - RNA, 18 nt, Bordetella pertussis
cgguccagcaccagggcg

SEQ ID NO: 2461320 - RNA, 20 nt, Bordetella pertussis
cgguccagcaccagggcgcg

SEQ ID NO: 2461321 - RNA, 21 nt, Bordetella pertussis
cgguccagcaccagggcgcgc

SEQ ID NO: 2461322 - RNA, 16 nt, Bordetella pertussis
cgguccagcacggcga

SEQ ID NO: 2461323 - RNA, 17 nt, Bordetella pertussis
cgguccagccccugccc

SEQ ID NO: 2461324 - RNA, 15 nt, Bordetella pertussis
cgguccagcgcccga

SEQ ID NO: 2461325 - RNA, 18 nt, Bordetella pertussis
cgguccagcugcgcgcga

SEQ ID NO: 2461326 - RNA, 20 nt, Bordetella pertussis
cgguccagcugcgcgcgagc

SEQ ID NO: 2461327 - RNA, 13 nt, Bordetella pertussis
cgguccaggaagc

SEQ ID NO: 2461328 - RNA, 11 nt, Bordetella pertussis
cgguccaggcc

SEQ ID NO: 2461329 - RNA, 13 nt, Bordetella pertussis
cgguccaggccga

SEQ ID NO: 2461330 - RNA, 23 nt, Bordetella pertussis
cgguccaugcgaaagcggccagc

SEQ ID NO: 2461331 - RNA, 19 nt, Bordetella pertussis
cgguccccagauccgcaag

SEQ ID NO: 2461332 - RNA, 15 nt, Bordetella pertussis
cggucccgagcgcuc

SEQ ID NO: 2461333 - RNA, 18 nt, Bordetella pertussis
cggucccgagcgcucccg

SEQ ID NO: 2461334 - RNA, 18 nt, Bordetella pertussis
cgguccgaugucgaggau

SEQ ID NO: 2461335 - RNA, 13 nt, Bordetella pertussis
cgguccgccucgc

SEQ ID NO: 2461336 - RNA, 20 nt, Bordetella pertussis
cgguccgcucgaggccaggc

SEQ ID NO: 2461337 - RNA, 22 nt, Bordetella pertussis
cgguccgcucgaggccaggcug

SEQ ID NO: 2461338 - RNA, 18 nt, Bordetella pertussis
cgguccggggcgggcgcg

SEQ ID NO: 2461339 - RNA, 14 nt, Bordetella pertussis
cgguccugcgcgcc

SEQ ID NO: 2461340 - RNA, 16 nt, Bordetella pertussis
cgguccugcugaucca

SEQ ID NO: 2461341 - RNA, 12 nt, Bordetella pertussis
cgguccugguaa

SEQ ID NO: 2461342 - RNA, 22 nt, Bordetella pertussis
cggucgaagaucuucggcaugu

SEQ ID NO: 2461343 - RNA, 12 nt, Bordetella pertussis
cggucgacaccg

SEQ ID NO: 2461344 - RNA, 20 nt, Bordetella pertussis
cggucgacauacgcgaugcc

SEQ ID NO: 2461345 - RNA, 18 nt, Bordetella pertussis
cggucgagacgauggccg

SEQ ID NO: 2461346 - RNA, 20 nt, Bordetella pertussis
cggucgagacgauggccgaa

SEQ ID NO: 2461347 - RNA, 18 nt, Bordetella pertussis
cggucgaggcgcagucca

SEQ ID NO: 2461348 - RNA, 22 nt, Bordetella pertussis
cggucgaguagaaguaggcggc

SEQ ID NO: 2461349 - RNA, 13 nt, Bordetella pertussis
cggucgaugaagc

SEQ ID NO: 2461350 - RNA, 20 nt, Bordetella pertussis
cggucgaugaagcccgagcg

SEQ ID NO: 2461351 - RNA, 15 nt, Bordetella pertussis
cggucgaugaccagc

SEQ ID NO: 2461352 - RNA, 16 nt, Bordetella pertussis
cggucgaugaccagcc

SEQ ID NO: 2461353 - RNA, 17 nt, Bordetella pertussis
cggucgaugaccagcca

SEQ ID NO: 2461354 - RNA, 18 nt, Bordetella pertussis
cggucgaugcgcacgccc

SEQ ID NO: 2461355 - RNA, 23 nt, Bordetella pertussis
cggucgaugcgcacgcccagacu

SEQ ID NO: 2461356 - RNA, 14 nt, Bordetella pertussis
cggucgauguccag

SEQ ID NO: 2461357 - RNA, 16 nt, Bordetella pertussis
cggucgauguccagcg

SEQ ID NO: 2461358 - RNA, 19 nt, Bordetella pertussis
cggucgauguccagcgcca

SEQ ID NO: 2461359 - RNA, 20 nt, Bordetella pertussis
cggucgauguccagcgccag

SEQ ID NO: 2461360 - RNA, 22 nt, Bordetella pertussis
cggucgauguccagcgccagca

SEQ ID NO: 2461361 - RNA, 23 nt, Bordetella pertussis
cggucgauguccagcgccagcag

SEQ ID NO: 2461362 - RNA, 17 nt, Bordetella pertussis
cggucgcauuggccgcc

SEQ ID NO: 2461363 - RNA, 18 nt, Bordetella pertussis
cggucgcccaacccggcg

SEQ ID NO: 2461364 - RNA, 13 nt, Bordetella pertussis
cggucgcccgccg

SEQ ID NO: 2461365 - RNA, 15 nt, Bordetella pertussis
cggucgccgcgggca

SEQ ID NO: 2461366 - RNA, 15 nt, Bordetella pertussis
cggucgccggcaugu

SEQ ID NO: 2461367 - RNA, 20 nt, Bordetella pertussis
cggucgccguccaggcgccg

SEQ ID NO: 2461368 - RNA, 22 nt, Bordetella pertussis
cggucgccguccaggcgccgca

SEQ ID NO: 2461369 - RNA, 19 nt, Bordetella pertussis
cggucgccucgaagaccuc

SEQ ID NO: 2461370 - RNA, 19 nt, Bordetella pertussis
cggucgccuguaucagcgc

SEQ ID NO: 2461371 - RNA, 16 nt, Bordetella pertussis
cggucgcgagcugcgc

SEQ ID NO: 2461372 - RNA, 14 nt, Bordetella pertussis
cggucgcgcgugca

SEQ ID NO: 2461373 - RNA, 17 nt, Bordetella pertussis
cggucgcgcgugcaggc

SEQ ID NO: 2461374 - RNA, 19 nt, Bordetella pertussis
cggucgcgcgugcaggccg

SEQ ID NO: 2461375 - RNA, 16 nt, Bordetella pertussis
cggucgcgcuggcccg

SEQ ID NO: 2461376 - RNA, 20 nt, Bordetella pertussis
cggucgcgcuggcccgcgcg

SEQ ID NO: 2461377 - RNA, 21 nt, Bordetella pertussis
cggucgcggccggccugcuug

SEQ ID NO: 2461378 - RNA, 14 nt, Bordetella pertussis
cggucgcggcguug

SEQ ID NO: 2461379 - RNA, 18 nt, Bordetella pertussis
cggucggaaacacgucca

SEQ ID NO: 2461380 - RNA, 21 nt, Bordetella pertussis
cggucggcccaggucaucgcc

SEQ ID NO: 2461381 - RNA, 15 nt, Bordetella pertussis
cggucggccgcgccg

SEQ ID NO: 2461382 - RNA, 16 nt, Bordetella pertussis
cggucggccgcgccgc

SEQ ID NO: 2461383 - RNA, 17 nt, Bordetella pertussis
cggucggccgcgccgcc

SEQ ID NO: 2461384 - RNA, 18 nt, Bordetella pertussis
cggucggccgcgccgccg

SEQ ID NO: 2461385 - RNA, 14 nt, Bordetella pertussis
cggucggccggcag

SEQ ID NO: 2461386 - RNA, 16 nt, Bordetella pertussis
cggucggccggcagcg

SEQ ID NO: 2461387 - RNA, 19 nt, Bordetella pertussis
cggucggccggcagcggcg

SEQ ID NO: 2461388 - RNA, 17 nt, Bordetella pertussis
cggucggcgcggcgccg

SEQ ID NO: 2461389 - RNA, 22 nt, Bordetella pertussis
cggucguagcguucgccgucga

SEQ ID NO: 2461390 - RNA, 15 nt, Bordetella pertussis
cggucgucagcacgc

SEQ ID NO: 2461391 - RNA, 13 nt, Bordetella pertussis
cggucguggccag

SEQ ID NO: 2461392 - RNA, 14 nt, Bordetella pertussis
cggucguggccagc

SEQ ID NO: 2461393 - RNA, 15 nt, Bordetella pertussis
cggucguggucgaca

SEQ ID NO: 2461394 - RNA, 14 nt, Bordetella pertussis
cggucuccagcgcg

SEQ ID NO: 2461395 - RNA, 19 nt, Bordetella pertussis
cggucuccagcgcgucggc

SEQ ID NO: 2461396 - RNA, 23 nt, Bordetella pertussis
cggucuccagcgcgucggccagg

SEQ ID NO: 2461397 - RNA, 15 nt, Bordetella pertussis
cggucucgugcgugc

SEQ ID NO: 2461398 - RNA, 18 nt, Bordetella pertussis
cggucugcaccugcgugg

SEQ ID NO: 2461399 - RNA, 17 nt, Bordetella pertussis
cggucugcacgccgggc

SEQ ID NO: 2461400 - RNA, 13 nt, Bordetella pertussis
cggucugccgcug

SEQ ID NO: 2461401 - RNA, 13 nt, Bordetella pertussis
cggucugcgugcg

SEQ ID NO: 2461402 - RNA, 14 nt, Bordetella pertussis
cggucugcgugcgc

SEQ ID NO: 2461403 - RNA, 19 nt, Bordetella pertussis
cggucugcgugcgcggcgu

SEQ ID NO: 2461404 - RNA, 20 nt, Bordetella pertussis
cggucuggcccacgcgcacg

SEQ ID NO: 2461405 - RNA, 15 nt, Bordetella pertussis
cggucugggccaugc

SEQ ID NO: 2461406 - RNA, 19 nt, Bordetella pertussis
cggucugggcgucccaggc

SEQ ID NO: 2461407 - RNA, 17 nt, Bordetella pertussis
cggucuggucuggcaac

SEQ ID NO: 2461408 - RNA, 18 nt, Bordetella pertussis
cggucuucacauagcccg

SEQ ID NO: 2461409 - RNA, 20 nt, Bordetella pertussis
cggucuucacauagcccggc

SEQ ID NO: 2461410 - RNA, 17 nt, Bordetella pertussis
cggucuucgaugcuggc

SEQ ID NO: 2461411 - RNA, 22 nt, Bordetella pertussis
cggucuucgaugcuggcgcgga

SEQ ID NO: 2461412 - RNA, 23 nt, Bordetella pertussis
cggugaacaccaggguggcgccg

SEQ ID NO: 2461413 - RNA, 15 nt, Bordetella pertussis
cggugaaggccacgc

SEQ ID NO: 2461414 - RNA, 23 nt, Bordetella pertussis
cggugaaggcgcccgggcugccg

SEQ ID NO: 2461415 - RNA, 20 nt, Bordetella pertussis
cggugaccaccaggccgccu

SEQ ID NO: 2461416 - RNA, 19 nt, Bordetella pertussis
cggugaccaugcgcaccga

SEQ ID NO: 2461417 - RNA, 15 nt, Bordetella pertussis
cggugaccgccagca

SEQ ID NO: 2461418 - RNA, 20 nt, Bordetella pertussis
cggugaccgccagcaggcgc

SEQ ID NO: 2461419 - RNA, 23 nt, Bordetella pertussis
cggugaccgccagcaggcgcucg

SEQ ID NO: 2461420 - RNA, 21 nt, Bordetella pertussis
cggugacggcguagccgaucu

SEQ ID NO: 2461421 - RNA, 18 nt, Bordetella pertussis
cggugagauccagcgaga

SEQ ID NO: 2461422 - RNA, 21 nt, Bordetella pertussis
cggugagcaagcgcuggaugg

SEQ ID NO: 2461423 - RNA, 13 nt, Bordetella pertussis
cggugagcggcac

SEQ ID NO: 2461424 - RNA, 20 nt, Bordetella pertussis
cggugagcggcacgacgucg

SEQ ID NO: 2461425 - RNA, 22 nt, Bordetella pertussis
cggugagcggcacgacgucguc

SEQ ID NO: 2461426 - RNA, 20 nt, Bordetella pertussis
cggugaggauuuccagcucg

SEQ ID NO: 2461427 - RNA, 15 nt, Bordetella pertussis
cggugauaugcgcca

SEQ ID NO: 2461428 - RNA, 21 nt, Bordetella pertussis
cggugauaugcgccaggcccu

SEQ ID NO: 2461429 - RNA, 11 nt, Bordetella pertussis
cggugaucagc

SEQ ID NO: 2461430 - RNA, 15 nt, Bordetella pertussis
cggugaucagcaggc

SEQ ID NO: 2461431 - RNA, 18 nt, Bordetella pertussis
cggugaucagcaggccca

SEQ ID NO: 2461432 - RNA, 19 nt, Bordetella pertussis
cggugaucagcaggcccac

SEQ ID NO: 2461433 - RNA, 21 nt, Bordetella pertussis
cggugaucagcaggcccacca

SEQ ID NO: 2461434 - RNA, 17 nt, Bordetella pertussis
cggugaucaucgugccg

SEQ ID NO: 2461435 - RNA, 19 nt, Bordetella pertussis
cggugaucaucgugccggg

SEQ ID NO: 2461436 - RNA, 23 nt, Bordetella pertussis
cggugaucaugccgcugaccagc

SEQ ID NO: 2461437 - RNA, 18 nt, Bordetella pertussis
cggugauccacugcagca

SEQ ID NO: 2461438 - RNA, 23 nt, Bordetella pertussis
cggugauccacugcagcaguucg

SEQ ID NO: 2461439 - RNA, 19 nt, Bordetella pertussis
cggugaucgaguaggccgg

SEQ ID NO: 2461440 - RNA, 15 nt, Bordetella pertussis
cggugaucugcucgc

SEQ ID NO: 2461441 - RNA, 22 nt, Bordetella pertussis
cguaauaguggucgccggcgca

SEQ ID NO: 2461442 - RNA, 16 nt, Bordetella pertussis
cguaauccaggcaaca

SEQ ID NO: 2461443 - RNA, 20 nt, Bordetella pertussis
cguaaucgaagccgggcggc

SEQ ID NO: 2461444 - RNA, 14 nt, Bordetella pertussis
cguaaucggcgucg

SEQ ID NO: 2461445 - RNA, 14 nt, Bordetella pertussis
cguaaugcaucuuu

SEQ ID NO: 2461446 - RNA, 15 nt, Bordetella pertussis
cguacaaccgcgccg

SEQ ID NO: 2461447 - RNA, 16 nt, Bordetella pertussis
cguacaaccgcgccga

SEQ ID NO: 2461448 - RNA, 15 nt, Bordetella pertussis
cguacagccgggugu

SEQ ID NO: 2461449 - RNA, 13 nt, Bordetella pertussis
cguacagccugcc

SEQ ID NO: 2461450 - RNA, 14 nt, Bordetella pertussis
cguacagccugccc

SEQ ID NO: 2461451 - RNA, 20 nt, Bordetella pertussis
cguacagcgccugcgcggcg

SEQ ID NO: 2461452 - RNA, 22 nt, Bordetella pertussis
cguacaggccguuguccuggcg

SEQ ID NO: 2461453 - RNA, 14 nt, Bordetella pertussis
cguacagggccgcg

SEQ ID NO: 2461454 - RNA, 16 nt, Bordetella pertussis
cguacagggccgcgau

SEQ ID NO: 2461455 - RNA, 17 nt, Bordetella pertussis
cguaccaggcagccggc

SEQ ID NO: 2461456 - RNA, 19 nt, Bordetella pertussis
cguaccaggcagccggccc

SEQ ID NO: 2461457 - RNA, 23 nt, Bordetella pertussis
cguaccaggcagccggccccgca

SEQ ID NO: 2461458 - RNA, 12 nt, Bordetella pertussis
cguacccgcgcc

SEQ ID NO: 2461459 - RNA, 16 nt, Bordetella pertussis
cguacccgcgccgucg

SEQ ID NO: 2461460 - RNA, 14 nt, Bordetella pertussis
cguaccugcagcag

SEQ ID NO: 2461461 - RNA, 22 nt, Bordetella pertussis
cguacgaagcaaacaggcugcu

SEQ ID NO: 2461462 - RNA, 14 nt, Bordetella pertussis
cguacgaccgcagg

SEQ ID NO: 2461463 - RNA, 14 nt, Bordetella pertussis
cguacgacggggug

SEQ ID NO: 2461464 - RNA, 18 nt, Bordetella pertussis
cguacgaggaccuguggc

SEQ ID NO: 2461465 - RNA, 21 nt, Bordetella pertussis
cguacgagugcaggcccgaca

SEQ ID NO: 2461466 - RNA, 18 nt, Bordetella pertussis
cguacgaucuucuggacu

SEQ ID NO: 2461467 - RNA, 15 nt, Bordetella pertussis
cguacgcccggccgc

SEQ ID NO: 2461468 - RNA, 17 nt, Bordetella pertussis
cguacgcccggccgccu

SEQ ID NO: 2461469 - RNA, 12 nt, Bordetella pertussis
cguacgcggcgc

SEQ ID NO: 2461470 - RNA, 19 nt, Bordetella pertussis
cguacgcggcgcccgcgca

SEQ ID NO: 2461471 - RNA, 19 nt, Bordetella pertussis
cguacgcgugggcggcggc

SEQ ID NO: 2461472 - RNA, 20 nt, Bordetella pertussis
cguacguaccaggccgucga

SEQ ID NO: 2461473 - RNA, 15 nt, Bordetella pertussis
cguacguggcgcggc

SEQ ID NO: 2461474 - RNA, 23 nt, Bordetella pertussis
cguacuccaucuguucggcgccg

SEQ ID NO: 2461475 - RNA, 14 nt, Bordetella pertussis
cguacucgaucgcc

SEQ ID NO: 2461476 - RNA, 18 nt, Bordetella pertussis
cguacucgaucgccauga

SEQ ID NO: 2461477 - RNA, 20 nt, Bordetella pertussis
cguacucgccggucgcggcg

SEQ ID NO: 2461478 - RNA, 15 nt, Bordetella pertussis
cguacucgccgucga

SEQ ID NO: 2461479 - RNA, 20 nt, Bordetella pertussis
cguacuggcgcggcggccag

SEQ ID NO: 2461480 - RNA, 21 nt, Bordetella pertussis
cguacuggcgcggcggccagg

SEQ ID NO: 2461481 - RNA, 17 nt, Bordetella pertussis
cguacuuccucgaccag

SEQ ID NO: 2461482 - RNA, 18 nt, Bordetella pertussis
cguacuuccucgaccagc

SEQ ID NO: 2461483 - RNA, 16 nt, Bordetella pertussis
cguacuucucgucgcg

SEQ ID NO: 2461484 - RNA, 17 nt, Bordetella pertussis
cguacuuggcgauggcc

SEQ ID NO: 2461485 - RNA, 17 nt, Bordetella pertussis
cguagaaagccagugcc

SEQ ID NO: 2461486 - RNA, 17 nt, Bordetella pertussis
cguagaaauacgcgcgc

SEQ ID NO: 2461487 - RNA, 18 nt, Bordetella pertussis
cguagaaauacgcgcgcg

SEQ ID NO: 2461488 - RNA, 14 nt, Bordetella pertussis
cguagaacacgucg

SEQ ID NO: 2461489 - RNA, 20 nt, Bordetella pertussis
cguagaacacgucgaucagc

SEQ ID NO: 2461490 - RNA, 19 nt, Bordetella pertussis
cguagaccgccgcgcccag

SEQ ID NO: 2461491 - RNA, 21 nt, Bordetella pertussis
cguagaccgccgcgcccagca

SEQ ID NO: 2461492 - RNA, 18 nt, Bordetella pertussis
cguagagaccaagcugcg

SEQ ID NO: 2461493 - RNA, 19 nt, Bordetella pertussis
cguagagcagugugccugu

SEQ ID NO: 2461494 - RNA, 22 nt, Bordetella pertussis
cguagagcgccgcgugguggcg

SEQ ID NO: 2461495 - RNA, 13 nt, Bordetella pertussis
cguagagggucug

SEQ ID NO: 2461496 - RNA, 22 nt, Bordetella pertussis
cguagagggucuggcggccggu

SEQ ID NO: 2461497 - RNA, 20 nt, Bordetella pertussis
cguagauccaggcggccacc

SEQ ID NO: 2461498 - RNA, 18 nt, Bordetella pertussis
cguagaugcgggucggcg

SEQ ID NO: 2461499 - RNA, 19 nt, Bordetella pertussis
cguagaugcgggucggcgc

SEQ ID NO: 2461500 - RNA, 12 nt, Bordetella pertussis
cguagcccaggu

SEQ ID NO: 2461501 - RNA, 17 nt, Bordetella pertussis
cguagcccagguccagc

SEQ ID NO: 2461502 - RNA, 20 nt, Bordetella pertussis
cguagcccagguccagcgcc

SEQ ID NO: 2461503 - RNA, 20 nt, Bordetella pertussis
cguagcccuuguggccgccg

SEQ ID NO: 2461504 - RNA, 20 nt, Bordetella pertussis
cguagccgcugcgcgcggcc

SEQ ID NO: 2461505 - RNA, 22 nt, Bordetella pertussis
cguagccgcugcgcgcggccug

SEQ ID NO: 2461506 - RNA, 13 nt, Bordetella pertussis
cguagccggccag

SEQ ID NO: 2461507 - RNA, 16 nt, Bordetella pertussis
cguagccggugcgcag

SEQ ID NO: 2461508 - RNA, 18 nt, Bordetella pertussis
cguagccggugcgcagca

SEQ ID NO: 2461509 - RNA, 21 nt, Bordetella pertussis
cguagccggugcgcagcacca

SEQ ID NO: 2461510 - RNA, 14 nt, Bordetella pertussis
cguagccguccucg

SEQ ID NO: 2461511 - RNA, 21 nt, Bordetella pertussis
cguagccguccucgcgggccu

SEQ ID NO: 2461512 - RNA, 12 nt, Bordetella pertussis
cguagcgcacga

SEQ ID NO: 2461513 - RNA, 15 nt, Bordetella pertussis
cguagcgcaggcgcu

SEQ ID NO: 2461514 - RNA, 13 nt, Bordetella pertussis
cguagcgccagcg

SEQ ID NO: 2461515 - RNA, 18 nt, Bordetella pertussis
cguagcgcguggccagca

SEQ ID NO: 2461516 - RNA, 20 nt, Bordetella pertussis
cguagcgcguggccagcacg

SEQ ID NO: 2461517 - RNA, 21 nt, Bordetella pertussis
cguagcguuggcggccggcca

SEQ ID NO: 2461518 - RNA, 23 nt, Bordetella pertussis
cguagcguuggcggccggccagc

SEQ ID NO: 2461519 - RNA, 12 nt, Bordetella pertussis
cguagcucagcc

SEQ ID NO: 2461520 - RNA, 15 nt, Bordetella pertussis
cguagcugcgccgca

SEQ ID NO: 2461521 - RNA, 16 nt, Bordetella pertussis
cguagcugucgaccgg

SEQ ID NO: 2461522 - RNA, 13 nt, Bordetella pertussis
cguaggacagccc

SEQ ID NO: 2461523 - RNA, 18 nt, Bordetella pertussis
cguaggacagccccagca

SEQ ID NO: 2461524 - RNA, 21 nt, Bordetella pertussis
cguaggacagccccagcagca

SEQ ID NO: 2461525 - RNA, 23 nt, Bordetella pertussis
cguaggcaaagcgcggcugcggg

SEQ ID NO: 2461526 - RNA, 11 nt, Bordetella pertussis
cguaggcgccg

SEQ ID NO: 2461527 - RNA, 17 nt, Bordetella pertussis
cguaggcgccggccuug

SEQ ID NO: 2461528 - RNA, 19 nt, Bordetella pertussis
cguaggcgcgcgcaucggc

SEQ ID NO: 2461529 - RNA, 15 nt, Bordetella pertussis
cguaggcggcccagg

SEQ ID NO: 2461530 - RNA, 16 nt, Bordetella pertussis
cguaggcggcccaggc

SEQ ID NO: 2461531 - RNA, 18 nt, Bordetella pertussis
cguagggcacaucggcca

SEQ ID NO: 2461532 - RNA, 20 nt, Bordetella pertussis
cguagggcacaucggccacc

SEQ ID NO: 2461533 - RNA, 18 nt, Bordetella pertussis
cguaggguucgccgcugu

SEQ ID NO: 2461534 - RNA, 19 nt, Bordetella pertussis
cguaggucaggcccacgcc

SEQ ID NO: 2461535 - RNA, 21 nt, Bordetella pertussis
cguaggucaggcccacgccgc

SEQ ID NO: 2461536 - RNA, 23 nt, Bordetella pertussis
cguaggucaggcccacgccgccg

SEQ ID NO: 2461537 - RNA, 15 nt, Bordetella pertussis
cguaggugcgcgcca

SEQ ID NO: 2461538 - RNA, 17 nt, Bordetella pertussis
cguaggugcgcgccaca

SEQ ID NO: 2461539 - RNA, 15 nt, Bordetella pertussis
cguaguacagcagca

SEQ ID NO: 2461540 - RNA, 16 nt, Bordetella pertussis
cguaguacagcagcag

SEQ ID NO: 2461541 - RNA, 13 nt, Bordetella pertussis
cguaguccagcag

SEQ ID NO: 2461542 - RNA, 14 nt, Bordetella pertussis
cguaguccagcagc

SEQ ID NO: 2461543 - RNA, 20 nt, Bordetella pertussis
cguaguccagcagcagcgcc

SEQ ID NO: 2461544 - RNA, 18 nt, Bordetella pertussis
cguaguccgagcccgggc

SEQ ID NO: 2461545 - RNA, 16 nt, Bordetella pertussis
cguagucgagccaggu

SEQ ID NO: 2461546 - RNA, 20 nt, Bordetella pertussis
cguagucgcacgcggcuucg

SEQ ID NO: 2461547 - RNA, 23 nt, Bordetella pertussis
cguagucgcgccagcggccgucg

SEQ ID NO: 2461548 - RNA, 14 nt, Bordetella pertussis
cguagucggcgccc

SEQ ID NO: 2461549 - RNA, 20 nt, Bordetella pertussis
cguagucguugccggccagc

SEQ ID NO: 2461550 - RNA, 15 nt, Bordetella pertussis
cguaguugucggcgc

SEQ ID NO: 2461551 - RNA, 16 nt, Bordetella pertussis
cguaucaacuuccagc

SEQ ID NO: 2461552 - RNA, 21 nt, Bordetella pertussis
cguaucaacuuccagcgcccg

SEQ ID NO: 2461553 - RNA, 18 nt, Bordetella pertussis
cguauccucgaucagcga

SEQ ID NO: 2461554 - RNA, 19 nt, Bordetella pertussis
cggugaucugcucgccgcg

SEQ ID NO: 2461555 - RNA, 14 nt, Bordetella pertussis
cggugaucuugccg

SEQ ID NO: 2461556 - RNA, 17 nt, Bordetella pertussis
cggugaucuugccgaug

SEQ ID NO: 2461557 - RNA, 19 nt, Bordetella pertussis
cggugaucuugccgaugcg

SEQ ID NO: 2461558 - RNA, 17 nt, Bordetella pertussis
cggugaugacgucgucg

SEQ ID NO: 2461559 - RNA, 14 nt, Bordetella pertussis
cggugaugcgaugg

SEQ ID NO: 2461560 - RNA, 18 nt, Bordetella pertussis
cggugaugcggcgcgccg

SEQ ID NO: 2461561 - RNA, 19 nt, Bordetella pertussis
cggugaugcggcgcgccgc

SEQ ID NO: 2461562 - RNA, 15 nt, Bordetella pertussis
cggugaugcucugcc

SEQ ID NO: 2461563 - RNA, 13 nt, Bordetella pertussis
cggugcaagcggc

SEQ ID NO: 2461564 - RNA, 14 nt, Bordetella pertussis
cggugcaagcggcc

SEQ ID NO: 2461565 - RNA, 15 nt, Bordetella pertussis
cggugcaagcggccg

SEQ ID NO: 2461566 - RNA, 16 nt, Bordetella pertussis
cggugcaagcggccgg

SEQ ID NO: 2461567 - RNA, 17 nt, Bordetella pertussis
cggugcaagcggccggc

SEQ ID NO: 2461568 - RNA, 18 nt, Bordetella pertussis
cggugcaagcggccggcc

SEQ ID NO: 2461569 - RNA, 13 nt, Bordetella pertussis
cggugcaaugccc

SEQ ID NO: 2461570 - RNA, 15 nt, Bordetella pertussis
cggugcaccaggcca

SEQ ID NO: 2461571 - RNA, 17 nt, Bordetella pertussis
cggugcaccaggccacc

SEQ ID NO: 2461572 - RNA, 19 nt, Bordetella pertussis
cggugcaccaggccacccg

SEQ ID NO: 2461573 - RNA, 18 nt, Bordetella pertussis
cggugcagcccagcacca

SEQ ID NO: 2461574 - RNA, 13 nt, Bordetella pertussis
cggugcagccgcc

SEQ ID NO: 2461575 - RNA, 16 nt, Bordetella pertussis
cggugcagccgccgca

SEQ ID NO: 2461576 - RNA, 19 nt, Bordetella pertussis
cggugcagccgccgcaggc

SEQ ID NO: 2461577 - RNA, 16 nt, Bordetella pertussis
cggugcaggggccgca

SEQ ID NO: 2461578 - RNA, 17 nt, Bordetella pertussis
cggugcaggggccgcac

SEQ ID NO: 2461579 - RNA, 18 nt, Bordetella pertussis
cggugcaggggccgcacg

SEQ ID NO: 2461580 - RNA, 21 nt, Bordetella pertussis
cggugcaggucaucgcgcugg

SEQ ID NO: 2461581 - RNA, 21 nt, Bordetella pertussis
cggugcaucggccggcggucg

SEQ ID NO: 2461582 - RNA, 15 nt, Bordetella pertussis
cggugcaucucggca

SEQ ID NO: 2461583 - RNA, 16 nt, Bordetella pertussis
cggugcaucucggcau

SEQ ID NO: 2461584 - RNA, 20 nt, Bordetella pertussis
cggugcaucucggcaucggc

SEQ ID NO: 2461585 - RNA, 22 nt, Bordetella pertussis
cggugcaucucggcaucggcca

SEQ ID NO: 2461586 - RNA, 21 nt, Bordetella pertussis
cggugccaguccccaugcggc

SEQ ID NO: 2461587 - RNA, 15 nt, Bordetella pertussis
cggugccaguccccc

SEQ ID NO: 2461588 - RNA, 17 nt, Bordetella pertussis
cggugccagucccccgc

SEQ ID NO: 2461589 - RNA, 18 nt, Bordetella pertussis
cggugccagucccccugc

SEQ ID NO: 2461590 - RNA, 23 nt, Bordetella pertussis
cggugccagucuccaggcucagg

SEQ ID NO: 2461591 - RNA, 16 nt, Bordetella pertussis
cggugccccggccucg

SEQ ID NO: 2461592 - RNA, 17 nt, Bordetella pertussis
cggugccccggccucgc

SEQ ID NO: 2461593 - RNA, 21 nt, Bordetella pertussis
cggugccccggccucgcggcg

SEQ ID NO: 2461594 - RNA, 22 nt, Bordetella pertussis
cggugcccuugcucccaguucu

SEQ ID NO: 2461595 - RNA, 14 nt, Bordetella pertussis
cggugccgagcaga

SEQ ID NO: 2461596 - RNA, 17 nt, Bordetella pertussis
cggugccgagcagaugc

SEQ ID NO: 2461597 - RNA, 19 nt, Bordetella pertussis
cggugccgagcagaugcga

SEQ ID NO: 2461598 - RNA, 22 nt, Bordetella pertussis
cggugccgcccaccgugaccag

SEQ ID NO: 2461599 - RNA, 15 nt, Bordetella pertussis
cggugccgccgagca

SEQ ID NO: 2461600 - RNA, 15 nt, Bordetella pertussis
cggugccgccgaucu

SEQ ID NO: 2461601 - RNA, 16 nt, Bordetella pertussis
cggugccgccuggcca

SEQ ID NO: 2461602 - RNA, 19 nt, Bordetella pertussis
cggugccgccuggccagau

SEQ ID NO: 2461603 - RNA, 12 nt, Bordetella pertussis
cggugccgcgca

SEQ ID NO: 2461604 - RNA, 22 nt, Bordetella pertussis
cggugccgcgcacccaggccca

SEQ ID NO: 2461605 - RNA, 12 nt, Bordetella pertussis
cggugccgcgcg

SEQ ID NO: 2461606 - RNA, 21 nt, Bordetella pertussis
cggugccgcgcgcggccggca

SEQ ID NO: 2461607 - RNA, 14 nt, Bordetella pertussis
cggugccgcgcgcu

SEQ ID NO: 2461608 - RNA, 17 nt, Bordetella pertussis
cggugccgcgcgcuucc

SEQ ID NO: 2461609 - RNA, 12 nt, Bordetella pertussis
cggugccggcca

SEQ ID NO: 2461610 - RNA, 19 nt, Bordetella pertussis
cggugccguccagcgcggc

SEQ ID NO: 2461611 - RNA, 13 nt, Bordetella pertussis
cggugccugugcc

SEQ ID NO: 2461612 - RNA, 13 nt, Bordetella pertussis
cggugccuugcgg

SEQ ID NO: 2461613 - RNA, 16 nt, Bordetella pertussis
cggugccuugcggcgc

SEQ ID NO: 2461614 - RNA, 14 nt, Bordetella pertussis
cggugcgacugcag

SEQ ID NO: 2461615 - RNA, 19 nt, Bordetella pertussis
cggugcgagaucucgaugc

SEQ ID NO: 2461616 - RNA, 19 nt, Bordetella pertussis
cggugcgauagcgccgcgc

SEQ ID NO: 2461617 - RNA, 14 nt, Bordetella pertussis
cggugcgcacaugg

SEQ ID NO: 2461618 - RNA, 18 nt, Bordetella pertussis
cggugcgcacauggcgga

SEQ ID NO: 2461619 - RNA, 16 nt, Bordetella pertussis
cggugcgcaccaggcc

SEQ ID NO: 2461620 - RNA, 18 nt, Bordetella pertussis
cggugcgcaccaggccca

SEQ ID NO: 2461621 - RNA, 20 nt, Bordetella pertussis
cggugcgcaccaggcccaug

SEQ ID NO: 2461622 - RNA, 15 nt, Bordetella pertussis
cggugcgcacgaugg

SEQ ID NO: 2461623 - RNA, 15 nt, Bordetella pertussis
cggugcgcagcacca

SEQ ID NO: 2461624 - RNA, 17 nt, Bordetella pertussis
cggugcgcagcaccagc

SEQ ID NO: 2461625 - RNA, 19 nt, Bordetella pertussis
cggugcgcagcaccagcau

SEQ ID NO: 2461626 - RNA, 15 nt, Bordetella pertussis
cggugcgcagcggca

SEQ ID NO: 2461627 - RNA, 18 nt, Bordetella pertussis
cggugcgccgcaugcggc

SEQ ID NO: 2461628 - RNA, 17 nt, Bordetella pertussis
cggugcgccgccgccgc

SEQ ID NO: 2461629 - RNA, 12 nt, Bordetella pertussis
cggugcgccgcg

SEQ ID NO: 2461630 - RNA, 15 nt, Bordetella pertussis
cggugcgcgcagggc

SEQ ID NO: 2461631 - RNA, 20 nt, Bordetella pertussis
cggugcgcgccacggcgucg

SEQ ID NO: 2461632 - RNA, 14 nt, Bordetella pertussis
cggugcgcgcgccc

SEQ ID NO: 2461633 - RNA, 13 nt, Bordetella pertussis
cggugcgcgcggc

SEQ ID NO: 2461634 - RNA, 15 nt, Bordetella pertussis
cggugcgcggcgccc

SEQ ID NO: 2461635 - RNA, 18 nt, Bordetella pertussis
cggugcgcggcgcccccg

SEQ ID NO: 2461636 - RNA, 16 nt, Bordetella pertussis
cggugcgcucgaagcg

SEQ ID NO: 2461637 - RNA, 15 nt, Bordetella pertussis
cggugcggaggcggc

SEQ ID NO: 2461638 - RNA, 22 nt, Bordetella pertussis
cggugcggaggcggccgcgggc

SEQ ID NO: 2461639 - RNA, 20 nt, Bordetella pertussis
cggugcggaucaagcggccc

SEQ ID NO: 2461640 - RNA, 21 nt, Bordetella pertussis
cggugcggaucaagcggcccg

SEQ ID NO: 2461641 - RNA, 13 nt, Bordetella pertussis
cggugcggccucg

SEQ ID NO: 2461642 - RNA, 12 nt, Bordetella pertussis
cggugcgggccg

SEQ ID NO: 2461643 - RNA, 14 nt, Bordetella pertussis
cggugcgggccggc

SEQ ID NO: 2461644 - RNA, 16 nt, Bordetella pertussis
cggugcgggccggcgc

SEQ ID NO: 2461645 - RNA, 17 nt, Bordetella pertussis
cggugcgggccggcgcg

SEQ ID NO: 2461646 - RNA, 19 nt, Bordetella pertussis
cggugcgggccggcgcgcc

SEQ ID NO: 2461647 - RNA, 20 nt, Bordetella pertussis
cggugcgggccggcgcgccu

SEQ ID NO: 2461648 - RNA, 15 nt, Bordetella pertussis
cggugcgggugaccu

SEQ ID NO: 2461649 - RNA, 22 nt, Bordetella pertussis
cggugcgggugaccuuggucgg

SEQ ID NO: 2461650 - RNA, 19 nt, Bordetella pertussis
cggugcgggugggcgcgcc

SEQ ID NO: 2461651 - RNA, 20 nt, Bordetella pertussis
cggugcgggugggcgcgccg

SEQ ID NO: 2461652 - RNA, 21 nt, Bordetella pertussis
cggugcgggugggcgcgccgc

SEQ ID NO: 2461653 - RNA, 22 nt, Bordetella pertussis
cggugcgggugggcgcgccgcg

SEQ ID NO: 2461654 - RNA, 17 nt, Bordetella pertussis
cggugcguaccagccca

SEQ ID NO: 2461655 - RNA, 12 nt, Bordetella pertussis
cggugcgugcgc

SEQ ID NO: 2461656 - RNA, 19 nt, Bordetella pertussis
cggugcucggccagcgcgc

SEQ ID NO: 2461657 - RNA, 22 nt, Bordetella pertussis
cggugcucggccagcgcgcgcc

SEQ ID NO: 2461658 - RNA, 13 nt, Bordetella pertussis
cggugcucggcga

SEQ ID NO: 2461659 - RNA, 15 nt, Bordetella pertussis
cggugcucggcgaac

SEQ ID NO: 2461660 - RNA, 22 nt, Bordetella pertussis
cggugcucggcgaacugggcgu

SEQ ID NO: 2461661 - RNA, 15 nt, Bordetella pertussis
cggugcucuggcccg

SEQ ID NO: 2461662 - RNA, 16 nt, Bordetella pertussis
cggugcucuggcccgc

SEQ ID NO: 2461663 - RNA, 19 nt, Bordetella pertussis
cggugcucuggcccgccuc

SEQ ID NO: 2461664 - RNA, 23 nt, Bordetella pertussis
cggugcugaacgccucgggcuug

SEQ ID NO: 2461665 - RNA, 17 nt, Bordetella pertussis
cggugcuggugcucaac

SEQ ID NO: 2461666 - RNA, 18 nt, Bordetella pertussis
cggugcuugaugcccagc

SEQ ID NO: 2461667 - RNA, 16 nt, Bordetella pertussis
cgguggaccagggcac

SEQ ID NO: 2461668 - RNA, 15 nt, Bordetella pertussis
cgguggacggccagc

SEQ ID NO: 2461669 - RNA, 15 nt, Bordetella pertussis
cguaucgaauucgca

SEQ ID NO: 2461670 - RNA, 18 nt, Bordetella pertussis
cguaucgcccgcgcggua

SEQ ID NO: 2461671 - RNA, 13 nt, Bordetella pertussis
cguaucgccgccg

SEQ ID NO: 2461672 - RNA, 19 nt, Bordetella pertussis
cguaucgccgccgccggca

SEQ ID NO: 2461673 - RNA, 12 nt, Bordetella pertussis
cguaucgccuga

SEQ ID NO: 2461674 - RNA, 13 nt, Bordetella pertussis
cguaucgcggccg

SEQ ID NO: 2461675 - RNA, 21 nt, Bordetella pertussis
cguaucgcguggcgcgccagc

SEQ ID NO: 2461676 - RNA, 15 nt, Bordetella pertussis
cguaugcggcagcag

SEQ ID NO: 2461677 - RNA, 16 nt, Bordetella pertussis
cguaugcggcagcagg

SEQ ID NO: 2461678 - RNA, 18 nt, Bordetella pertussis
cguaugcggcagcagggc

SEQ ID NO: 2461679 - RNA, 15 nt, Bordetella pertussis
cguauggcggcgccg

SEQ ID NO: 2461680 - RNA, 23 nt, Bordetella pertussis
cguauuccccuucucggccguca

SEQ ID NO: 2461681 - RNA, 19 nt, Bordetella pertussis
cguauuccggguccagccc

SEQ ID NO: 2461682 - RNA, 17 nt, Bordetella pertussis
cguauucgguggcgcgc

SEQ ID NO: 2461683 - RNA, 18 nt, Bordetella pertussis
cguauucgguggcgcgca

SEQ ID NO: 2461684 - RNA, 14 nt, Bordetella pertussis
cguauugcugcugc

SEQ ID NO: 2461685 - RNA, 15 nt, Bordetella pertussis
cguauugcugcugcu

SEQ ID NO: 2461686 - RNA, 18 nt, Bordetella pertussis
cguauugugcaugcgcgc

SEQ ID NO: 2461687 - RNA, 14 nt, Bordetella pertussis
cgucaacagcaugg

SEQ ID NO: 2461688 - RNA, 16 nt, Bordetella pertussis
cgucaacagcauggac

SEQ ID NO: 2461689 - RNA, 19 nt, Bordetella pertussis
cgucaacccgucgacgcag

SEQ ID NO: 2461690 - RNA, 20 nt, Bordetella pertussis
cgucaagccagcggcgcggc

SEQ ID NO: 2461691 - RNA, 17 nt, Bordetella pertussis
cgucaagcgucgauggc

SEQ ID NO: 2461692 - RNA, 21 nt, Bordetella pertussis
cgucaagcguucauggcguau

SEQ ID NO: 2461693 - RNA, 21 nt, Bordetella pertussis
cgucaaggggcuguaccuggc

SEQ ID NO: 2461694 - RNA, 19 nt, Bordetella pertussis
cgucaauccgccgccagca

SEQ ID NO: 2461695 - RNA, 17 nt, Bordetella pertussis
cgucaaugccagucgcc

SEQ ID NO: 2461696 - RNA, 12 nt, Bordetella pertussis
cgucaccagcag

SEQ ID NO: 2461697 - RNA, 18 nt, Bordetella pertussis
cgucaccagcaggcggcc

SEQ ID NO: 2461698 - RNA, 19 nt, Bordetella pertussis
cgucaccagcaggcggccg

SEQ ID NO: 2461699 - RNA, 13 nt, Bordetella pertussis
cgucaccaucgcc

SEQ ID NO: 2461700 - RNA, 14 nt, Bordetella pertussis
cgucaccaucgccg

SEQ ID NO: 2461701 - RNA, 14 nt, Bordetella pertussis
cgucaccccgcccu

SEQ ID NO: 2461702 - RNA, 15 nt, Bordetella pertussis
cgucaccccgcccug

SEQ ID NO: 2461703 - RNA, 22 nt, Bordetella pertussis
cgucaccccgcccugcccggcg

SEQ ID NO: 2461704 - RNA, 17 nt, Bordetella pertussis
cgucaccgacgccagca

SEQ ID NO: 2461705 - RNA, 16 nt, Bordetella pertussis
cgucaccggcgagccg

SEQ ID NO: 2461706 - RNA, 19 nt, Bordetella pertussis
cgucaccuugggaucgucc

SEQ ID NO: 2461707 - RNA, 23 nt, Bordetella pertussis
cgucaccuugggaucgucccagg

SEQ ID NO: 2461708 - RNA, 21 nt, Bordetella pertussis
cgucacgaaagcgcccaggcc

SEQ ID NO: 2461709 - RNA, 19 nt, Bordetella pertussis
cgucacgauuucggccaug

SEQ ID NO: 2461710 - RNA, 16 nt, Bordetella pertussis
cgucacgcgcaaggcg

SEQ ID NO: 2461711 - RNA, 17 nt, Bordetella pertussis
cgucacgcggccgggca

SEQ ID NO: 2461712 - RNA, 19 nt, Bordetella pertussis
cgucacggaucagccgcuu

SEQ ID NO: 2461713 - RNA, 13 nt, Bordetella pertussis
cgucacggcaaga

SEQ ID NO: 2461714 - RNA, 20 nt, Bordetella pertussis
cgucacggcaagacggcgcu

SEQ ID NO: 2461715 - RNA, 11 nt, Bordetella pertussis
cgucagagccc

SEQ ID NO: 2461716 - RNA, 20 nt, Bordetella pertussis
cgucagagcccuucgacgcg

SEQ ID NO: 2461717 - RNA, 14 nt, Bordetella pertussis
cgucagcacgcccu

SEQ ID NO: 2461718 - RNA, 20 nt, Bordetella pertussis
cgucagcacgcccuggcuga

SEQ ID NO: 2461719 - RNA, 14 nt, Bordetella pertussis
cgucagcacggucg

SEQ ID NO: 2461720 - RNA, 11 nt, Bordetella pertussis
cgucagcagca

SEQ ID NO: 2461721 - RNA, 17 nt, Bordetella pertussis
cgucagcagcaggcugg

SEQ ID NO: 2461722 - RNA, 16 nt, Bordetella pertussis
cgucagcagcgcggcg

SEQ ID NO: 2461723 - RNA, 22 nt, Bordetella pertussis
cgucagcaugccguuggagccg

SEQ ID NO: 2461724 - RNA, 20 nt, Bordetella pertussis
cgucagcgcaaacgggggca

SEQ ID NO: 2461725 - RNA, 13 nt, Bordetella pertussis
cgucagcgccgcg

SEQ ID NO: 2461726 - RNA, 15 nt, Bordetella pertussis
cgucagcgccgcgau

SEQ ID NO: 2461727 - RNA, 15 nt, Bordetella pertussis
cgucagcgugcgccc

SEQ ID NO: 2461728 - RNA, 23 nt, Bordetella pertussis
cgucagcgugcgccccgccucga

SEQ ID NO: 2461729 - RNA, 23 nt, Bordetella pertussis
cgucagcucgaucaggcgcucca

SEQ ID NO: 2461730 - RNA, 22 nt, Bordetella pertussis
cgucagcugggcaugcacgaug

SEQ ID NO: 2461731 - RNA, 15 nt, Bordetella pertussis
cgucaggaagcccga

SEQ ID NO: 2461732 - RNA, 17 nt, Bordetella pertussis
cgucaggaagcccgagu

SEQ ID NO: 2461733 - RNA, 18 nt, Bordetella pertussis
cgucaggaucaggccggc

SEQ ID NO: 2461734 - RNA, 16 nt, Bordetella pertussis
cgucaggcaggcgcgc

SEQ ID NO: 2461735 - RNA, 18 nt, Bordetella pertussis
cgucaggcaggcgcgccg

SEQ ID NO: 2461736 - RNA, 13 nt, Bordetella pertussis
cgucaggccgucg

SEQ ID NO: 2461737 - RNA, 18 nt, Bordetella pertussis
cgucaggcgagcgcggcg

SEQ ID NO: 2461738 - RNA, 21 nt, Bordetella pertussis
cgucaggcugggagagccggc

SEQ ID NO: 2461739 - RNA, 22 nt, Bordetella pertussis
cgucaggcugggagagccggcc

SEQ ID NO: 2461740 - RNA, 23 nt, Bordetella pertussis
cgucaggcugggagagccggcca

SEQ ID NO: 2461741 - RNA, 17 nt, Bordetella pertussis
cgucagggccgcagcac

SEQ ID NO: 2461742 - RNA, 19 nt, Bordetella pertussis
cgucagggccgcagcaccu

SEQ ID NO: 2461743 - RNA, 18 nt, Bordetella pertussis
cgucaggggcaugccggc

SEQ ID NO: 2461744 - RNA, 20 nt, Bordetella pertussis
cgucaggggcaugccggcau

SEQ ID NO: 2461745 - RNA, 13 nt, Bordetella pertussis
cgucaggguacgc

SEQ ID NO: 2461746 - RNA, 19 nt, Bordetella pertussis
cgucaggguacgcucgacg

SEQ ID NO: 2461747 - RNA, 15 nt, Bordetella pertussis
cgucaggugcagcga

SEQ ID NO: 2461748 - RNA, 20 nt, Bordetella pertussis
cgucaguccguggcgcggcc

SEQ ID NO: 2461749 - RNA, 21 nt, Bordetella pertussis
cgucaguccguggcgcggcca

SEQ ID NO: 2461750 - RNA, 15 nt, Bordetella pertussis
cgucaguugaagacg

SEQ ID NO: 2461751 - RNA, 19 nt, Bordetella pertussis
cgucaguugaagacgccgg

SEQ ID NO: 2461752 - RNA, 24 nt, Bordetella pertussis
cgucaguugaagacgccggucgac

SEQ ID NO: 2461753 - RNA, 17 nt, Bordetella pertussis
cgucaguugggcgcgcc

SEQ ID NO: 2461754 - RNA, 21 nt, Bordetella pertussis
cgucaguugggcgcgcccagc

SEQ ID NO: 2461755 - RNA, 23 nt, Bordetella pertussis
cgucaguugggcgcgcccagccc

SEQ ID NO: 2461756 - RNA, 15 nt, Bordetella pertussis
cgucauacacggcgc

SEQ ID NO: 2461757 - RNA, 16 nt, Bordetella pertussis
cgucauacgacgcggc

SEQ ID NO: 2461758 - RNA, 17 nt, Bordetella pertussis
cgucaucaccaagggcg

SEQ ID NO: 2461759 - RNA, 17 nt, Bordetella pertussis
cgucauccugggcgcgc

SEQ ID NO: 2461760 - RNA, 18 nt, Bordetella pertussis
cgucauccugggcgcgcg

SEQ ID NO: 2461761 - RNA, 21 nt, Bordetella pertussis
cgucauccugggcgcgcgcca

SEQ ID NO: 2461762 - RNA, 16 nt, Bordetella pertussis
cgucaucggcgcgcag

SEQ ID NO: 2461763 - RNA, 19 nt, Bordetella pertussis
cgucaucgggugcggcgcc

SEQ ID NO: 2461764 - RNA, 19 nt, Bordetella pertussis
cgucaucggugcggccggu

SEQ ID NO: 2461765 - RNA, 14 nt, Bordetella pertussis
cgucaucguggccg

SEQ ID NO: 2461766 - RNA, 22 nt, Bordetella pertussis
cgucaucguggccgcgcaaggc

SEQ ID NO: 2461767 - RNA, 21 nt, Bordetella pertussis
cgucaucugcggaaacagauu

SEQ ID NO: 2461768 - RNA, 17 nt, Bordetella pertussis
cgucaugaucccgcgcc

SEQ ID NO: 2461769 - RNA, 19 nt, Bordetella pertussis
cgucaugaucccgcgccua

SEQ ID NO: 2461770 - RNA, 17 nt, Bordetella pertussis
cgucaugauguagccca

SEQ ID NO: 2461771 - RNA, 19 nt, Bordetella pertussis
cgucaugauguagcccaug

SEQ ID NO: 2461772 - RNA, 21 nt, Bordetella pertussis
cgucaugcgcaccuugucgcg

SEQ ID NO: 2461773 - RNA, 14 nt, Bordetella pertussis
cgucaugcgccaug

SEQ ID NO: 2461774 - RNA, 13 nt, Bordetella pertussis
cgucaugcgccgc

SEQ ID NO: 2461775 - RNA, 17 nt, Bordetella pertussis
cgucaugcgccgcagca

SEQ ID NO: 2461776 - RNA, 16 nt, Bordetella pertussis
cgucaugcgccguccu

SEQ ID NO: 2461777 - RNA, 23 nt, Bordetella pertussis
cgucaugcgcuugucgccgcugc

SEQ ID NO: 2461778 - RNA, 15 nt, Bordetella pertussis
cgucauggccuggcc

SEQ ID NO: 2461779 - RNA, 22 nt, Bordetella pertussis
cgucauggccuggcccagcucc

SEQ ID NO: 2461780 - RNA, 19 nt, Bordetella pertussis
cgucauguccgagucgaac

SEQ ID NO: 2461781 - RNA, 17 nt, Bordetella pertussis
cgucauuacccauggca

SEQ ID NO: 2461782 - RNA, 19 nt, Bordetella pertussis
cgucauugcaucgcagcag

SEQ ID NO: 2461783 - RNA, 14 nt, Bordetella pertussis
cguccaaaacagac

SEQ ID NO: 2461784 - RNA, 17 nt, Bordetella pertussis
cguccaagcagacccgc

SEQ ID NO: 2461785 - RNA, 14 nt, Bordetella pertussis
cguccaaugccagg

SEQ ID NO: 2461786 - RNA, 17 nt, Bordetella pertussis
cguccaauucgagcagg

SEQ ID NO: 2461787 - RNA, 21 nt, Bordetella pertussis
cguccaauucgagcaggcgca

SEQ ID NO: 2461788 - RNA, 17 nt, Bordetella pertussis
cguccaccaccaggccg

SEQ ID NO: 2461789 - RNA, 21 nt, Bordetella pertussis
cguccaccaccaggccggcca

SEQ ID NO: 2461790 - RNA, 17 nt, Bordetella pertussis
cguccacccccgucagc

SEQ ID NO: 2461791 - RNA, 21 nt, Bordetella pertussis
cguccaccuugacgcgcaggc

SEQ ID NO: 2461792 - RNA, 14 nt, Bordetella pertussis
cguccacgaaggca

SEQ ID NO: 2461793 - RNA, 21 nt, Bordetella pertussis
cguccacgaaggcagcaccuc

SEQ ID NO: 2461794 - RNA, 17 nt, Bordetella pertussis
cguccacgcccagcgcc

SEQ ID NO: 2461795 - RNA, 22 nt, Bordetella pertussis
cguccacgcccagcgccggcac

SEQ ID NO: 2461796 - RNA, 15 nt, Bordetella pertussis
cguccacgccgcgcg

SEQ ID NO: 2461797 - RNA, 16 nt, Bordetella pertussis
cguccacgccguggcg

SEQ ID NO: 2461798 - RNA, 21 nt, Bordetella pertussis
cguccacgcggguggugcugc

SEQ ID NO: 2461799 - RNA, 23 nt, Bordetella pertussis
cguccacgcggguggugcugcuc

SEQ ID NO: 2461800 - RNA, 15 nt, Bordetella pertussis
cguccacggccugcg

SEQ ID NO: 2461801 - RNA, 19 nt, Bordetella pertussis
cguccacggccugcgcgcc

SEQ ID NO: 2461802 - RNA, 20 nt, Bordetella pertussis
cguccacggccugcgcgccg

SEQ ID NO: 2461803 - RNA, 24 nt, Bordetella pertussis
cguccacggccugcgcgccgacca

SEQ ID NO: 2461804 - RNA, 22 nt, Bordetella pertussis
cguccacugaaagaaccgccuu

SEQ ID NO: 2461805 - RNA, 23 nt, Bordetella pertussis
cguccacugaaagaaccgccuuc

SEQ ID NO: 2461806 - RNA, 16 nt, Bordetella pertussis
cguccagcacgcggcg

SEQ ID NO: 2461807 - RNA, 21 nt, Bordetella pertussis
cguccagcacgcggcgcagca

SEQ ID NO: 2461808 - RNA, 13 nt, Bordetella pertussis
cguccagcacggc

SEQ ID NO: 2461809 - RNA, 17 nt, Bordetella pertussis
cguccagcacggccgcg

SEQ ID NO: 2461810 - RNA, 22 nt, Bordetella pertussis
cguccagcacggccgcggccgg

SEQ ID NO: 2461811 - RNA, 23 nt, Bordetella pertussis
cguccagcagcaggaacaggcug

SEQ ID NO: 2461812 - RNA, 19 nt, Bordetella pertussis
cguccagcccgugggcggc

SEQ ID NO: 2461813 - RNA, 15 nt, Bordetella pertussis
cguccagccgcccgu

SEQ ID NO: 2461814 - RNA, 15 nt, Bordetella pertussis
cguccagccugcccg

SEQ ID NO: 2461815 - RNA, 20 nt, Bordetella pertussis
cguccagcgacuccggccgg

SEQ ID NO: 2461816 - RNA, 21 nt, Bordetella pertussis
cguccagcgacuccggccggg

SEQ ID NO: 2461817 - RNA, 22 nt, Bordetella pertussis
cguccagcgacuccggccgggc

SEQ ID NO: 2461818 - RNA, 23 nt, Bordetella pertussis
cguccagcgacuccggccgggcc

SEQ ID NO: 2461819 - RNA, 18 nt, Bordetella pertussis
cguccagcgacucgguca

SEQ ID NO: 2461820 - RNA, 15 nt, Bordetella pertussis
cguccagcgccacca

SEQ ID NO: 2461821 - RNA, 17 nt, Bordetella pertussis
cguccagcgccaccagc

SEQ ID NO: 2461822 - RNA, 19 nt, Bordetella pertussis
cguccagcgccaccagcag

SEQ ID NO: 2461823 - RNA, 12 nt, Bordetella pertussis
cguccagcgccg

SEQ ID NO: 2461824 - RNA, 13 nt, Bordetella pertussis
cguccagcgcgcg

SEQ ID NO: 2461825 - RNA, 14 nt, Bordetella pertussis
cguccagcgcgcgg

SEQ ID NO: 2461826 - RNA, 13 nt, Bordetella pertussis
cguccagcgcggc

SEQ ID NO: 2461827 - RNA, 23 nt, Bordetella pertussis
cguccagcgcggcaugccgcugc

SEQ ID NO: 2461828 - RNA, 14 nt, Bordetella pertussis
cguccagcgcggcg

SEQ ID NO: 2461829 - RNA, 13 nt, Bordetella pertussis
cguccagcggcgc

SEQ ID NO: 2461830 - RNA, 17 nt, Bordetella pertussis
cguccagcggcgcgacg

SEQ ID NO: 2461831 - RNA, 20 nt, Bordetella pertussis
cguccagcggcgcgacgcgc

SEQ ID NO: 2461832 - RNA, 21 nt, Bordetella pertussis
cguccagcgucaugcgcaccu

SEQ ID NO: 2461833 - RNA, 15 nt, Bordetella pertussis
cguccaggaagcagc

SEQ ID NO: 2461834 - RNA, 17 nt, Bordetella pertussis
cguccaggaagcagccc

SEQ ID NO: 2461835 - RNA, 19 nt, Bordetella pertussis
cguccaggaagcagcccag

SEQ ID NO: 2461836 - RNA, 14 nt, Bordetella pertussis
cguccaggcccagc

SEQ ID NO: 2461837 - RNA, 17 nt, Bordetella pertussis
cguccaggcccagcgcg

SEQ ID NO: 2461838 - RNA, 17 nt, Bordetella pertussis
cguccaggcccuggcgg

SEQ ID NO: 2461839 - RNA, 21 nt, Bordetella pertussis
cguccaggcccuggcggcgca

SEQ ID NO: 2461840 - RNA, 23 nt, Bordetella pertussis
cguccaggccuuucucaaggccg

SEQ ID NO: 2461841 - RNA, 13 nt, Bordetella pertussis
cguccaggcgccg

SEQ ID NO: 2461842 - RNA, 13 nt, Bordetella pertussis
cguccaggcgcgc

SEQ ID NO: 2461843 - RNA, 17 nt, Bordetella pertussis
cguccaggcgcgccagc

SEQ ID NO: 2461844 - RNA, 13 nt, Bordetella pertussis
cguccaggcggcc

SEQ ID NO: 2461845 - RNA, 17 nt, Bordetella pertussis
cguccaggcggccaucg

SEQ ID NO: 2461846 - RNA, 20 nt, Bordetella pertussis
cguccaggcugccggcguug

SEQ ID NO: 2461847 - RNA, 17 nt, Bordetella pertussis
cguccaggugcggcggc

SEQ ID NO: 2461848 - RNA, 19 nt, Bordetella pertussis
cguccagguugcccgagcg

SEQ ID NO: 2461849 - RNA, 21 nt, Bordetella pertussis
cguccagguugcccgagcgcg

SEQ ID NO: 2461850 - RNA, 22 nt, Bordetella pertussis
cguccagguugucggccaugcg

SEQ ID NO: 2461851 - RNA, 18 nt, Bordetella pertussis
cguccagucccguggcgc

SEQ ID NO: 2461852 - RNA, 22 nt, Bordetella pertussis
cguccagucccguggcgcucau

SEQ ID NO: 2461853 - RNA, 16 nt, Bordetella pertussis
cguccaucgacgcggc

SEQ ID NO: 2461854 - RNA, 20 nt, Bordetella pertussis
cguccaucgccugcacgacc

SEQ ID NO: 2461855 - RNA, 18 nt, Bordetella pertussis
cguccaucuggaccgcgc

SEQ ID NO: 2461856 - RNA, 19 nt, Bordetella pertussis
cguccaucuggaccgcgcg

SEQ ID NO: 2461857 - RNA, 14 nt, Bordetella pertussis
cguccaugccggcc

SEQ ID NO: 2461858 - RNA, 15 nt, Bordetella pertussis
cguccaugcggaggc

SEQ ID NO: 2461859 - RNA, 18 nt, Bordetella pertussis
cguccauggugggcaggu

SEQ ID NO: 2461860 - RNA, 22 nt, Bordetella pertussis
cgucccagccaaugccgcgguu

SEQ ID NO: 2461861 - RNA, 12 nt, Bordetella pertussis
cgucccagcgca

SEQ ID NO: 2461862 - RNA, 15 nt, Bordetella pertussis
cgucccagcgcacgc

SEQ ID NO: 2461863 - RNA, 18 nt, Bordetella pertussis
cgucccagcgcacgcagc

SEQ ID NO: 2461864 - RNA, 12 nt, Bordetella pertussis
cgucccaggcca

SEQ ID NO: 2461865 - RNA, 15 nt, Bordetella pertussis
cgucccagucgccgc

SEQ ID NO: 2461866 - RNA, 17 nt, Bordetella pertussis
cgucccagucgccgcgc

SEQ ID NO: 2461867 - RNA, 18 nt, Bordetella pertussis
cgucccagucgccgcgcc

SEQ ID NO: 2461868 - RNA, 19 nt, Bordetella pertussis
cgucccagucgccgcgccc

SEQ ID NO: 2461869 - RNA, 20 nt, Bordetella pertussis
cguccccaccuccaccucga

SEQ ID NO: 2461870 - RNA, 16 nt, Bordetella pertussis
cguccccacggggacu

SEQ ID NO: 2461871 - RNA, 17 nt, Bordetella pertussis
cguccccacggggacug

SEQ ID NO: 2461872 - RNA, 17 nt, Bordetella pertussis
cgucccccuacugcccu

SEQ ID NO: 2461873 - RNA, 19 nt, Bordetella pertussis
cgucccccuacugcccucg

SEQ ID NO: 2461874 - RNA, 18 nt, Bordetella pertussis
cgucccgacccccggccc

SEQ ID NO: 2461875 - RNA, 22 nt, Bordetella pertussis
cgucccgacccccggcccgcgc

SEQ ID NO: 2461876 - RNA, 23 nt, Bordetella pertussis
cgucccgacccccggcccgcgcc

SEQ ID NO: 2461877 - RNA, 13 nt, Bordetella pertussis
cgucccggaugcg

SEQ ID NO: 2461878 - RNA, 14 nt, Bordetella pertussis
cgucccgugccggc

SEQ ID NO: 2461879 - RNA, 15 nt, Bordetella pertussis
cgucccgugccggcc

SEQ ID NO: 2461880 - RNA, 16 nt, Bordetella pertussis
cgucccugguccagca

SEQ ID NO: 2461881 - RNA, 17 nt, Bordetella pertussis
cguccgccaggacggga

SEQ ID NO: 2461882 - RNA, 16 nt, Bordetella pertussis
cguccgccccauccac

SEQ ID NO: 2461883 - RNA, 23 nt, Bordetella pertussis
cguccgccccauccacggcgcca

SEQ ID NO: 2461884 - RNA, 18 nt, Bordetella pertussis
cguccgcccgcuccacca

SEQ ID NO: 2461885 - RNA, 22 nt, Bordetella pertussis
cguccgcccgcuccaccagcac

SEQ ID NO: 2461886 - RNA, 22 nt, Bordetella pertussis
cguccgccgugcaggcccgggc

SEQ ID NO: 2461887 - RNA, 19 nt, Bordetella pertussis
cgugcgcaggcgcguggcc

SEQ ID NO: 2461888 - RNA, 24 nt, Bordetella pertussis
cgugcgcaggcgcguggccacggc

SEQ ID NO: 2461889 - RNA, 20 nt, Bordetella pertussis
cgugcgcauacagggcggug

SEQ ID NO: 2461890 - RNA, 14 nt, Bordetella pertussis
cgugcgcaucagcg

SEQ ID NO: 2461891 - RNA, 15 nt, Bordetella pertussis
cgugcgcaucagcgc

SEQ ID NO: 2461892 - RNA, 23 nt, Bordetella pertussis
cgugcgccacuucgccucggcgg

SEQ ID NO: 2461893 - RNA, 13 nt, Bordetella pertussis
cgugcgccagcgc

SEQ ID NO: 2461894 - RNA, 14 nt, Bordetella pertussis
cgugcgccagcgcc

SEQ ID NO: 2461895 - RNA, 12 nt, Bordetella pertussis
cgugcgcccaug

SEQ ID NO: 2461896 - RNA, 15 nt, Bordetella pertussis
cgugcgcccauggcg

SEQ ID NO: 2461897 - RNA, 21 nt, Bordetella pertussis
cgugcgcccauggcgcgcagc

SEQ ID NO: 2461898 - RNA, 13 nt, Bordetella pertussis
cgugcgcccgacg

SEQ ID NO: 2461899 - RNA, 14 nt, Bordetella pertussis
cgugcgccgcauca

SEQ ID NO: 2461900 - RNA, 16 nt, Bordetella pertussis
cgugcgccugcugguc

SEQ ID NO: 2461901 - RNA, 13 nt, Bordetella pertussis
cgugcgccuggcg

SEQ ID NO: 2461902 - RNA, 16 nt, Bordetella pertussis
cgugcgccuggcggcu

SEQ ID NO: 2461903 - RNA, 19 nt, Bordetella pertussis
cgugcgcgaccgcgcggcg

SEQ ID NO: 2461904 - RNA, 21 nt, Bordetella pertussis
cgugcgcgaccgcgcggcgcu

SEQ ID NO: 2461905 - RNA, 17 nt, Bordetella pertussis
cgugcgcgaccuccggc

SEQ ID NO: 2461906 - RNA, 17 nt, Bordetella pertussis
cgugcgcgacgcguagc

SEQ ID NO: 2461907 - RNA, 14 nt, Bordetella pertussis
cgugcgcgagggcu

SEQ ID NO: 2461908 - RNA, 17 nt, Bordetella pertussis
cgugcgcgaucuugccg

SEQ ID NO: 2461909 - RNA, 13 nt, Bordetella pertussis
cgugcgcgcccga

SEQ ID NO: 2461910 - RNA, 16 nt, Bordetella pertussis
cgugcgcgcgccaugg

SEQ ID NO: 2461911 - RNA, 14 nt, Bordetella pertussis
cgugcgcggccgcg

SEQ ID NO: 2461912 - RNA, 18 nt, Bordetella pertussis
cgugcgcggccgcgcgcu

SEQ ID NO: 2461913 - RNA, 19 nt, Bordetella pertussis
cgugcgcggccgcgcgcuu

SEQ ID NO: 2461914 - RNA, 17 nt, Bordetella pertussis
cgugcgcggcgagccgc

SEQ ID NO: 2461915 - RNA, 15 nt, Bordetella pertussis
cgugcgcgggcgcca

SEQ ID NO: 2461916 - RNA, 14 nt, Bordetella pertussis
cgugcgcgggcgcg

SEQ ID NO: 2461917 - RNA, 16 nt, Bordetella pertussis
cgugcgcgggcgcggc

SEQ ID NO: 2461918 - RNA, 17 nt, Bordetella pertussis
cgugcgcgggcgcggca

SEQ ID NO: 2461919 - RNA, 13 nt, Bordetella pertussis
cgugcgcuggcug

SEQ ID NO: 2461920 - RNA, 21 nt, Bordetella pertussis
cgugcgcuggcugggccugcu

SEQ ID NO: 2461921 - RNA, 14 nt, Bordetella pertussis
cgugcggaccagcg

SEQ ID NO: 2461922 - RNA, 20 nt, Bordetella pertussis
cgugcggaccagcgguugcg

SEQ ID NO: 2461923 - RNA, 17 nt, Bordetella pertussis
cgugcggaugcagcagc

SEQ ID NO: 2461924 - RNA, 18 nt, Bordetella pertussis
cgugcggaugcagcagcg

SEQ ID NO: 2461925 - RNA, 14 nt, Bordetella pertussis
cgugcggcacgcac

SEQ ID NO: 2461926 - RNA, 17 nt, Bordetella pertussis
cgugcggcacgcacagc

SEQ ID NO: 2461927 - RNA, 18 nt, Bordetella pertussis
cgugcggcacgcacagca

SEQ ID NO: 2461928 - RNA, 22 nt, Bordetella pertussis
cgugcggcacgcacagcaugcg

SEQ ID NO: 2461929 - RNA, 23 nt, Bordetella pertussis
cgugcggcacgcacagcaugcgc

SEQ ID NO: 2461930 - RNA, 13 nt, Bordetella pertussis
cgugcggcagggc

SEQ ID NO: 2461931 - RNA, 13 nt, Bordetella pertussis
cgugcggcccagc

SEQ ID NO: 2461932 - RNA, 15 nt, Bordetella pertussis
cgugcggcccagccg

SEQ ID NO: 2461933 - RNA, 12 nt, Bordetella pertussis
cgugcggccgca

SEQ ID NO: 2461934 - RNA, 13 nt, Bordetella pertussis
cgugcggccgcag

SEQ ID NO: 2461935 - RNA, 15 nt, Bordetella pertussis
cgugcggccgcagca

SEQ ID NO: 2461936 - RNA, 12 nt, Bordetella pertussis
cgugcggcgcgc

SEQ ID NO: 2461937 - RNA, 13 nt, Bordetella pertussis
cgugcggcgcgca

SEQ ID NO: 2461938 - RNA, 18 nt, Bordetella pertussis
cgugcggcgcgcacgggc

SEQ ID NO: 2461939 - RNA, 21 nt, Bordetella pertussis
cgugcggcuguugggcaaggu

SEQ ID NO: 2461940 - RNA, 16 nt, Bordetella pertussis
cgugcgggacggccag

SEQ ID NO: 2461941 - RNA, 18 nt, Bordetella pertussis
cgugcgggacggccaggg

SEQ ID NO: 2461942 - RNA, 19 nt, Bordetella pertussis
cgugcgggccugcaguucg

SEQ ID NO: 2461943 - RNA, 22 nt, Bordetella pertussis
cgugcggggaccggcacccgcu

SEQ ID NO: 2461944 - RNA, 16 nt, Bordetella pertussis
cgugcggggcggcagg

SEQ ID NO: 2461945 - RNA, 21 nt, Bordetella pertussis
cgugcggggcggcaggucgcg

SEQ ID NO: 2461946 - RNA, 16 nt, Bordetella pertussis
cgugcgggugccuguc

SEQ ID NO: 2461947 - RNA, 20 nt, Bordetella pertussis
cgugcgguucgucagggccg

SEQ ID NO: 2461948 - RNA, 21 nt, Bordetella pertussis
cgugcguauucgguggcgcgc

SEQ ID NO: 2461949 - RNA, 23 nt, Bordetella pertussis
cgugcguauucgguggcgcgcag

SEQ ID NO: 2461950 - RNA, 19 nt, Bordetella pertussis
cgugcgugaccacgaucau

SEQ ID NO: 2461951 - RNA, 15 nt, Bordetella pertussis
cgugcgugccgacga

SEQ ID NO: 2461952 - RNA, 15 nt, Bordetella pertussis
cgugcgugcgccugu

SEQ ID NO: 2461953 - RNA, 16 nt, Bordetella pertussis
cgugcgugugccuguc

SEQ ID NO: 2461954 - RNA, 20 nt, Bordetella pertussis
cgugcucaucggcaggccgg

SEQ ID NO: 2461955 - RNA, 21 nt, Bordetella pertussis
cgugcucaucggcaggccggc

SEQ ID NO: 2461956 - RNA, 20 nt, Bordetella pertussis
cgugcuccagaacgcgccgu

SEQ ID NO: 2461957 - RNA, 22 nt, Bordetella pertussis
cgugcugaucgacaugcuggcc

SEQ ID NO: 2461958 - RNA, 16 nt, Bordetella pertussis
cgugcugcagggcugc

SEQ ID NO: 2461959 - RNA, 14 nt, Bordetella pertussis
cgugcugcccgcgu

SEQ ID NO: 2461960 - RNA, 17 nt, Bordetella pertussis
cgugcugcugcaggcgc

SEQ ID NO: 2461961 - RNA, 14 nt, Bordetella pertussis
cgugcuggacccgc

SEQ ID NO: 2461962 - RNA, 21 nt, Bordetella pertussis
cgugcuggacccgcugcgacc

SEQ ID NO: 2461963 - RNA, 17 nt, Bordetella pertussis
cgugcuggccaucuaug

SEQ ID NO: 2461964 - RNA, 15 nt, Bordetella pertussis
cgugcuggccggaua

SEQ ID NO: 2461965 - RNA, 15 nt, Bordetella pertussis
cgugcuggcgcagca

SEQ ID NO: 2461966 - RNA, 16 nt, Bordetella pertussis
cgugcuggcgcagcag

SEQ ID NO: 2461967 - RNA, 18 nt, Bordetella pertussis
cgugcuggcgcagcagcg

SEQ ID NO: 2461968 - RNA, 20 nt, Bordetella pertussis
cgugcuggcgcagcagcgcc

SEQ ID NO: 2461969 - RNA, 20 nt, Bordetella pertussis
cgugcuggcugagcaggccg

SEQ ID NO: 2461970 - RNA, 12 nt, Bordetella pertussis
cgugcugggcgg

SEQ ID NO: 2461971 - RNA, 15 nt, Bordetella pertussis
cgugcugggcggcca

SEQ ID NO: 2461972 - RNA, 12 nt, Bordetella pertussis
cgugcugguugu

SEQ ID NO: 2461973 - RNA, 22 nt, Bordetella pertussis
cgugcuguaccucagccugcug

SEQ ID NO: 2461974 - RNA, 13 nt, Bordetella pertussis
cgugcuugagggu

SEQ ID NO: 2461975 - RNA, 23 nt, Bordetella pertussis
cgugcuugccgccggacggcgcc

SEQ ID NO: 2461976 - RNA, 22 nt, Bordetella pertussis
cguggaagguccacggcauggc

SEQ ID NO: 2461977 - RNA, 13 nt, Bordetella pertussis
cguggacaggcac

SEQ ID NO: 2461978 - RNA, 16 nt, Bordetella pertussis
cguggacaggcaccug

SEQ ID NO: 2461979 - RNA, 21 nt, Bordetella pertussis
cguggacgugcgcgaccgcgc

SEQ ID NO: 2461980 - RNA, 23 nt, Bordetella pertussis
cguggacuucguguucgcggccg

SEQ ID NO: 2461981 - RNA, 15 nt, Bordetella pertussis
cguggaggcggcggc

SEQ ID NO: 2461982 - RNA, 21 nt, Bordetella pertussis
cguggaugggcuuugacgccg

SEQ ID NO: 2461983 - RNA, 22 nt, Bordetella pertussis
cguggaugggcuuugacgccgg

SEQ ID NO: 2461984 - RNA, 13 nt, Bordetella pertussis
cguggcaggugcg

SEQ ID NO: 2461985 - RNA, 15 nt, Bordetella pertussis
cguggcaggugcggc

SEQ ID NO: 2461986 - RNA, 18 nt, Bordetella pertussis
cguggcaggugcggccgc

SEQ ID NO: 2461987 - RNA, 19 nt, Bordetella pertussis
cguggcaggugcggccgca

SEQ ID NO: 2461988 - RNA, 21 nt, Bordetella pertussis
cguggcaggugcggccgcagc

SEQ ID NO: 2461989 - RNA, 22 nt, Bordetella pertussis
cguggcaggugcggccgcagcg

SEQ ID NO: 2461990 - RNA, 13 nt, Bordetella pertussis
cguggcaugccau

SEQ ID NO: 2461991 - RNA, 18 nt, Bordetella pertussis
cguggccaagggcgccgc

SEQ ID NO: 2461992 - RNA, 22 nt, Bordetella pertussis
cguggccaagggcgccgcgccg

SEQ ID NO: 2461993 - RNA, 17 nt, Bordetella pertussis
cguggccaccaggcgcg

SEQ ID NO: 2461994 - RNA, 20 nt, Bordetella pertussis
cguggccaccaggcgcgcgc

SEQ ID NO: 2461995 - RNA, 22 nt, Bordetella pertussis
cguggccaccaggcgcgcgcca

SEQ ID NO: 2461996 - RNA, 22 nt, Bordetella pertussis
cguggccacggccgcgaucgag

SEQ ID NO: 2461997 - RNA, 24 nt, Bordetella pertussis
cguggccacggcgucgaugcgcgc

SEQ ID NO: 2461998 - RNA, 11 nt, Bordetella pertussis
cguggcccagc

SEQ ID NO: 2461999 - RNA, 12 nt, Bordetella pertussis
cguggcccagca

SEQ ID NO: 2462000 - RNA, 15 nt, Bordetella pertussis
cguggcccagcaccg

SEQ ID NO: 2462001 - RNA, 12 nt, Bordetella pertussis
cguggcccagcc

SEQ ID NO: 2462002 - RNA, 14 nt, Bordetella pertussis
cguggcccagccgc

SEQ ID NO: 2462003 - RNA, 15 nt, Bordetella pertussis
cguggcccgcgccgc

SEQ ID NO: 2462004 - RNA, 16 nt, Bordetella pertussis
cguggcccgcgccgcg

SEQ ID NO: 2462005 - RNA, 18 nt, Bordetella pertussis
cguggcccgcgccgcguc

SEQ ID NO: 2462006 - RNA, 15 nt, Bordetella pertussis
cguggccgcagucag

SEQ ID NO: 2462007 - RNA, 16 nt, Bordetella pertussis
cguggccgccaccagc

SEQ ID NO: 2462008 - RNA, 11 nt, Bordetella pertussis
cguggccgccg

SEQ ID NO: 2462009 - RNA, 22 nt, Bordetella pertussis
cguggccgccgggucgcugugc

SEQ ID NO: 2462010 - RNA, 23 nt, Bordetella pertussis
cguggccgcgcaaggccugcucg

SEQ ID NO: 2462011 - RNA, 12 nt, Bordetella pertussis
cguggccgcgcu

SEQ ID NO: 2462012 - RNA, 20 nt, Bordetella pertussis
cguggccgcgcugcugcagg

SEQ ID NO: 2462013 - RNA, 18 nt, Bordetella pertussis
cguggccgcuucggcggc

SEQ ID NO: 2462014 - RNA, 20 nt, Bordetella pertussis
cguggccgcuucggcggcca

SEQ ID NO: 2462015 - RNA, 18 nt, Bordetella pertussis
cguggccggcaucgcgcu

SEQ ID NO: 2462016 - RNA, 19 nt, Bordetella pertussis
cguggccggcaucgcgcug

SEQ ID NO: 2462017 - RNA, 14 nt, Bordetella pertussis
cguggccggcgacg

SEQ ID NO: 2462018 - RNA, 17 nt, Bordetella pertussis
cguggccggcgacggca

SEQ ID NO: 2462019 - RNA, 16 nt, Bordetella pertussis
cguggccggcgcggca

SEQ ID NO: 2462020 - RNA, 17 nt, Bordetella pertussis
cgucgacgcccgcgccc

SEQ ID NO: 2462021 - RNA, 14 nt, Bordetella pertussis
cgucgacgcggccg

SEQ ID NO: 2462022 - RNA, 14 nt, Bordetella pertussis
cgucgacggugcgc

SEQ ID NO: 2462023 - RNA, 18 nt, Bordetella pertussis
cgucgacguaccaagccu

SEQ ID NO: 2462024 - RNA, 14 nt, Bordetella pertussis
cgucgacguccugg

SEQ ID NO: 2462025 - RNA, 17 nt, Bordetella pertussis
cgucgacguccuggugg

SEQ ID NO: 2462026 - RNA, 17 nt, Bordetella pertussis
cgucgacgucgaucgag

SEQ ID NO: 2462027 - RNA, 18 nt, Bordetella pertussis
cgucgacgucggugacgg

SEQ ID NO: 2462028 - RNA, 19 nt, Bordetella pertussis
cgucgacuucgacccggac

SEQ ID NO: 2462029 - RNA, 13 nt, Bordetella pertussis
cgguggccgccgc

SEQ ID NO: 2462030 - RNA, 16 nt, Bordetella pertussis
cgguggccgcgcaugc

SEQ ID NO: 2462031 - RNA, 23 nt, Bordetella pertussis
cgguggccucguccacgucgucg

SEQ ID NO: 2462032 - RNA, 15 nt, Bordetella pertussis
cgguggcgaaggccg

SEQ ID NO: 2462033 - RNA, 17 nt, Bordetella pertussis
cgguggcgaaggccgcc

SEQ ID NO: 2462034 - RNA, 18 nt, Bordetella pertussis
cgguggcgaaggccgccg

SEQ ID NO: 2462035 - RNA, 23 nt, Bordetella pertussis
cgguggcgaaggccgccgcgccc

SEQ ID NO: 2462036 - RNA, 17 nt, Bordetella pertussis
cgguggcgcccggcggc

SEQ ID NO: 2462037 - RNA, 18 nt, Bordetella pertussis
cgguggcgccgucgcgcu

SEQ ID NO: 2462038 - RNA, 13 nt, Bordetella pertussis
cgguggcgggcca

SEQ ID NO: 2462039 - RNA, 16 nt, Bordetella pertussis
cgguggcgggccagcu

SEQ ID NO: 2462040 - RNA, 16 nt, Bordetella pertussis
cgguggcgggcgugcg

SEQ ID NO: 2462041 - RNA, 21 nt, Bordetella pertussis
cgguggcguaguagcccaggc

SEQ ID NO: 2462042 - RNA, 17 nt, Bordetella pertussis
cgguggcguguccgccg

SEQ ID NO: 2462043 - RNA, 19 nt, Bordetella pertussis
cggugggauaaggcgugcc

SEQ ID NO: 2462044 - RNA, 20 nt, Bordetella pertussis
cggugggauaaggcgugccg

SEQ ID NO: 2462045 - RNA, 21 nt, Bordetella pertussis
cggugggcagcagcacgccca

SEQ ID NO: 2462046 - RNA, 19 nt, Bordetella pertussis
cggugggcgacgcggcgua

SEQ ID NO: 2462047 - RNA, 16 nt, Bordetella pertussis
cgguggggcaggucgc

SEQ ID NO: 2462048 - RNA, 22 nt, Bordetella pertussis
cgguggggcaggucgccagcag

SEQ ID NO: 2462049 - RNA, 18 nt, Bordetella pertussis
cggugggucucggcgucg

SEQ ID NO: 2462050 - RNA, 22 nt, Bordetella pertussis
cgguggguguggccaugcacca

SEQ ID NO: 2462051 - RNA, 20 nt, Bordetella pertussis
cgguggucaucgaugcgccg

SEQ ID NO: 2462052 - RNA, 12 nt, Bordetella pertussis
cgguggucgggc

SEQ ID NO: 2462053 - RNA, 18 nt, Bordetella pertussis
cgguggucugccagucca

SEQ ID NO: 2462054 - RNA, 21 nt, Bordetella pertussis
cgguggugaccacggcgcgcc

SEQ ID NO: 2462055 - RNA, 23 nt, Bordetella pertussis
cgguggugaccacggcgcgcccg

SEQ ID NO: 2462056 - RNA, 16 nt, Bordetella pertussis
cgguggugcugcuggg

SEQ ID NO: 2462057 - RNA, 19 nt, Bordetella pertussis
cgguggugcugcugggcgc

SEQ ID NO: 2462058 - RNA, 21 nt, Bordetella pertussis
cgguggugcugcugggcgcca

SEQ ID NO: 2462059 - RNA, 14 nt, Bordetella pertussis
cgguggugcugggc

SEQ ID NO: 2462060 - RNA, 15 nt, Bordetella pertussis
cgguggugcugggcg

SEQ ID NO: 2462061 - RNA, 16 nt, Bordetella pertussis
cgguggugcugggcgg

SEQ ID NO: 2462062 - RNA, 17 nt, Bordetella pertussis
cgguggugcugggcggc

SEQ ID NO: 2462063 - RNA, 18 nt, Bordetella pertussis
cgguggugcugggcggcg

SEQ ID NO: 2462064 - RNA, 17 nt, Bordetella pertussis
cgguggugucgaacagc

SEQ ID NO: 2462065 - RNA, 22 nt, Bordetella pertussis
cgguggugucgaacagcgagac

SEQ ID NO: 2462066 - RNA, 18 nt, Bordetella pertussis
cgguggugucggcggcca

SEQ ID NO: 2462067 - RNA, 22 nt, Bordetella pertussis
cgguggugucggcggccagcag

SEQ ID NO: 2462068 - RNA, 15 nt, Bordetella pertussis
cgguguagaccacca

SEQ ID NO: 2462069 - RNA, 16 nt, Bordetella pertussis
cgguguagaccaccag

SEQ ID NO: 2462070 - RNA, 21 nt, Bordetella pertussis
cgguguaggcgggcagcggcg

SEQ ID NO: 2462071 - RNA, 14 nt, Bordetella pertussis
cggugucgaugggc

SEQ ID NO: 2462072 - RNA, 15 nt, Bordetella pertussis
cggugucgccgccgc

SEQ ID NO: 2462073 - RNA, 19 nt, Bordetella pertussis
cggugucgccgccgcgccg

SEQ ID NO: 2462074 - RNA, 13 nt, Bordetella pertussis
cggugucgccgug

SEQ ID NO: 2462075 - RNA, 15 nt, Bordetella pertussis
cgguguucgcgucgu

SEQ ID NO: 2462076 - RNA, 21 nt, Bordetella pertussis
cgguguugaccaccacgcugg

SEQ ID NO: 2462077 - RNA, 13 nt, Bordetella pertussis
cgguguugcucca

SEQ ID NO: 2462078 - RNA, 15 nt, Bordetella pertussis
cgguguugcucgugc

SEQ ID NO: 2462079 - RNA, 16 nt, Bordetella pertussis
cgguguugcucgugcu

SEQ ID NO: 2462080 - RNA, 20 nt, Bordetella pertussis
cgguguugcucgugcuggcc

SEQ ID NO: 2462081 - RNA, 13 nt, Bordetella pertussis
cgguucagaacgc

SEQ ID NO: 2462082 - RNA, 17 nt, Bordetella pertussis
cgguucagcgcgccagc

SEQ ID NO: 2462083 - RNA, 20 nt, Bordetella pertussis
cgguucagcgcgccagcgcg

SEQ ID NO: 2462084 - RNA, 18 nt, Bordetella pertussis
cgguucaggccccggccg

SEQ ID NO: 2462085 - RNA, 18 nt, Bordetella pertussis
cgguucaggguggccgcg

SEQ ID NO: 2462086 - RNA, 12 nt, Bordetella pertussis
cgguucaucgcc

SEQ ID NO: 2462087 - RNA, 16 nt, Bordetella pertussis
cgguuccagccuggca

SEQ ID NO: 2462088 - RNA, 22 nt, Bordetella pertussis
cgguuccugcaaggccggcggc

SEQ ID NO: 2462089 - RNA, 23 nt, Bordetella pertussis
cgguuccugcaaggccggcggca

SEQ ID NO: 2462090 - RNA, 16 nt, Bordetella pertussis
cgguucgaugaccugg

SEQ ID NO: 2462091 - RNA, 23 nt, Bordetella pertussis
cgguucgaugaccugggccuggu

SEQ ID NO: 2462092 - RNA, 22 nt, Bordetella pertussis
cgguucgcccaccaccagcggc

SEQ ID NO: 2462093 - RNA, 13 nt, Bordetella pertussis
cgguucgccgucg

SEQ ID NO: 2462094 - RNA, 19 nt, Bordetella pertussis
cgguucgccgugcagggcc

SEQ ID NO: 2462095 - RNA, 20 nt, Bordetella pertussis
cgguucgccgugcagggcca

SEQ ID NO: 2462096 - RNA, 16 nt, Bordetella pertussis
cgguucggcgcggcgc

SEQ ID NO: 2462097 - RNA, 15 nt, Bordetella pertussis
cgguucggucgacga

SEQ ID NO: 2462098 - RNA, 19 nt, Bordetella pertussis
cgguucguagccgguaucg

SEQ ID NO: 2462099 - RNA, 19 nt, Bordetella pertussis
cgguucguccucgucggcc

SEQ ID NO: 2462100 - RNA, 18 nt, Bordetella pertussis
cgguucgugccgggcagc

SEQ ID NO: 2462101 - RNA, 21 nt, Bordetella pertussis
cgguucgugccgggcagcauc

SEQ ID NO: 2462102 - RNA, 19 nt, Bordetella pertussis
cgguucuggaucgcgccca

SEQ ID NO: 2462103 - RNA, 14 nt, Bordetella pertussis
cgguugacugcagc

SEQ ID NO: 2462104 - RNA, 19 nt, Bordetella pertussis
cgguugaucagggccgcca

SEQ ID NO: 2462105 - RNA, 16 nt, Bordetella pertussis
cgguugcagcgcgcca

SEQ ID NO: 2462106 - RNA, 19 nt, Bordetella pertussis
cgguugcccgccccgugca

SEQ ID NO: 2462107 - RNA, 20 nt, Bordetella pertussis
cgguugcgaggcggccuuga

SEQ ID NO: 2462108 - RNA, 13 nt, Bordetella pertussis
cgguugcgccagc

SEQ ID NO: 2462109 - RNA, 22 nt, Bordetella pertussis
cgguugcgccagcuugcgcgcc

SEQ ID NO: 2462110 - RNA, 16 nt, Bordetella pertussis
cgguugcgcugcuguc

SEQ ID NO: 2462111 - RNA, 12 nt, Bordetella pertussis
cgguuggcgccu

SEQ ID NO: 2462112 - RNA, 16 nt, Bordetella pertussis
cgguugguuugcggcg

SEQ ID NO: 2462113 - RNA, 17 nt, Bordetella pertussis
cgguuguugcccaccgc

SEQ ID NO: 2462114 - RNA, 14 nt, Bordetella pertussis
cgguuuccagguug

SEQ ID NO: 2462115 - RNA, 20 nt, Bordetella pertussis
cgguuucccgaugcuccggg

SEQ ID NO: 2462116 - RNA, 14 nt, Bordetella pertussis
cgguuucggccugc

SEQ ID NO: 2462117 - RNA, 21 nt, Bordetella pertussis
cgguuucggccugcaggccca

SEQ ID NO: 2462118 - RNA, 13 nt, Bordetella pertussis
cgguuucggugcg

SEQ ID NO: 2462119 - RNA, 15 nt, Bordetella pertussis
cgguuucucagcgcg

SEQ ID NO: 2462120 - RNA, 18 nt, Bordetella pertussis
cgguuugguagcaggcgc

SEQ ID NO: 2462121 - RNA, 19 nt, Bordetella pertussis
cgguuugguagcaggcgcg

SEQ ID NO: 2462122 - RNA, 18 nt, Bordetella pertussis
cgguuuuuucuugccggc

SEQ ID NO: 2462123 - RNA, 18 nt, Bordetella pertussis
cgguuuuuuugcgccgcu

SEQ ID NO: 2462124 - RNA, 15 nt, Bordetella pertussis
cguaaacaucgcgca

SEQ ID NO: 2462125 - RNA, 20 nt, Bordetella pertussis
cguaaacaucgcgcauggcg

SEQ ID NO: 2462126 - RNA, 16 nt, Bordetella pertussis
cguaaagaugcgcgcc

SEQ ID NO: 2462127 - RNA, 17 nt, Bordetella pertussis
cguaaagaugcgcgccg

SEQ ID NO: 2462128 - RNA, 19 nt, Bordetella pertussis
cguaaagccgcacgcccgc

SEQ ID NO: 2462129 - RNA, 14 nt, Bordetella pertussis
cguaaccggccagu

SEQ ID NO: 2462130 - RNA, 23 nt, Bordetella pertussis
cguaagcaggucugcacgaggcg

SEQ ID NO: 2462131 - RNA, 14 nt, Bordetella pertussis
cguaagcccacuca

SEQ ID NO: 2462132 - RNA, 17 nt, Bordetella pertussis
cguaagcccacucacgc

SEQ ID NO: 2462133 - RNA, 13 nt, Bordetella pertussis
cguaagcgcugga

SEQ ID NO: 2462134 - RNA, 14 nt, Bordetella pertussis
cguaaggccgccgg

SEQ ID NO: 2462135 - RNA, 19 nt, Bordetella pertussis
cguaaggccgccggccacc

SEQ ID NO: 2462136 - RNA, 20 nt, Bordetella pertussis
cguaaggccgccggccacca

SEQ ID NO: 2462137 - RNA, 24 nt, Bordetella pertussis
cguaaggcugcagcuugcgcgcca

SEQ ID NO: 2462138 - RNA, 16 nt, Bordetella pertussis
cguaaguggcggcggg

SEQ ID NO: 2462139 - RNA, 21 nt, Bordetella pertussis
cgucgcgcuucuuguccuuga

SEQ ID NO: 2462140 - RNA, 18 nt, Bordetella pertussis
cgucgcggcccugggcca

SEQ ID NO: 2462141 - RNA, 14 nt, Bordetella pertussis
cgucgcggcugggc

SEQ ID NO: 2462142 - RNA, 18 nt, Bordetella pertussis
cgucgcgguacaggcugc

SEQ ID NO: 2462143 - RNA, 14 nt, Bordetella pertussis
cgucgcgguccagc

SEQ ID NO: 2462144 - RNA, 18 nt, Bordetella pertussis
cgucgcgguccagcacca

SEQ ID NO: 2462145 - RNA, 22 nt, Bordetella pertussis
cgucgcguagcgcggccggguc

SEQ ID NO: 2462146 - RNA, 23 nt, Bordetella pertussis
cgucgcguccuucgucggcggga

SEQ ID NO: 2462147 - RNA, 23 nt, Bordetella pertussis
cgucgcucaggguacggcgaugc

SEQ ID NO: 2462148 - RNA, 12 nt, Bordetella pertussis
cgucgcucaugg

SEQ ID NO: 2462149 - RNA, 17 nt, Bordetella pertussis
cgucgcucugcgcggca

SEQ ID NO: 2462150 - RNA, 14 nt, Bordetella pertussis
cgucgcugccgcgc

SEQ ID NO: 2462151 - RNA, 15 nt, Bordetella pertussis
cgucgcugccgcgcg

SEQ ID NO: 2462152 - RNA, 14 nt, Bordetella pertussis
cgucgcugcgcggc

SEQ ID NO: 2462153 - RNA, 15 nt, Bordetella pertussis
cgucgcugcgcggcg

SEQ ID NO: 2462154 - RNA, 12 nt, Bordetella pertussis
cgucgcugcggc

SEQ ID NO: 2462155 - RNA, 14 nt, Bordetella pertussis
cgucgcugcggccg

SEQ ID NO: 2462156 - RNA, 16 nt, Bordetella pertussis
cgucgcugcggccggu

SEQ ID NO: 2462157 - RNA, 17 nt, Bordetella pertussis
cgucgcugcggccggug

SEQ ID NO: 2462158 - RNA, 17 nt, Bordetella pertussis
cgucgcugcuggcggcg

SEQ ID NO: 2462159 - RNA, 18 nt, Bordetella pertussis
cgucgcugcuggcggcgc

SEQ ID NO: 2462160 - RNA, 15 nt, Bordetella pertussis
cgucgcuggcagccu

SEQ ID NO: 2462161 - RNA, 18 nt, Bordetella pertussis
cgucgcuggcagccuuga

SEQ ID NO: 2462162 - RNA, 15 nt, Bordetella pertussis
cgucgcugucggcga

SEQ ID NO: 2462163 - RNA, 17 nt, Bordetella pertussis
cgucggacaacgccagg

SEQ ID NO: 2462164 - RNA, 18 nt, Bordetella pertussis
cgucggacaacgccagga

SEQ ID NO: 2462165 - RNA, 12 nt, Bordetella pertussis
cgucggacgcgc

SEQ ID NO: 2462166 - RNA, 13 nt, Bordetella pertussis
cgucggacgcgcg

SEQ ID NO: 2462167 - RNA, 17 nt, Bordetella pertussis
cgucggacgcgcgccgc

SEQ ID NO: 2462168 - RNA, 18 nt, Bordetella pertussis
cgucggacgcgcgccgca

SEQ ID NO: 2462169 - RNA, 16 nt, Bordetella pertussis
cgucggacguagccga

SEQ ID NO: 2462170 - RNA, 18 nt, Bordetella pertussis
cgucggcaaccgucgcca

SEQ ID NO: 2462171 - RNA, 19 nt, Bordetella pertussis
cgucggcaauaucgaucag

SEQ ID NO: 2462172 - RNA, 19 nt, Bordetella pertussis
cgucggcaccuucgcgcag

SEQ ID NO: 2462173 - RNA, 13 nt, Bordetella pertussis
cgucggcaugggu

SEQ ID NO: 2462174 - RNA, 15 nt, Bordetella pertussis
cgucggccaaggccg

SEQ ID NO: 2462175 - RNA, 18 nt, Bordetella pertussis
cgucggccaaggccggcg

SEQ ID NO: 2462176 - RNA, 19 nt, Bordetella pertussis
cgucggccaaggccggcgc

SEQ ID NO: 2462177 - RNA, 21 nt, Bordetella pertussis
cgucggccacgcccuguugcu

SEQ ID NO: 2462178 - RNA, 11 nt, Bordetella pertussis
cgucggccagc

SEQ ID NO: 2462179 - RNA, 12 nt, Bordetella pertussis
cgucggccagcg

SEQ ID NO: 2462180 - RNA, 13 nt, Bordetella pertussis
cgucggccagcgc

SEQ ID NO: 2462181 - RNA, 15 nt, Bordetella pertussis
cgucggccagcgccg

SEQ ID NO: 2462182 - RNA, 17 nt, Bordetella pertussis
cgucggccagcgccgcg

SEQ ID NO: 2462183 - RNA, 17 nt, Bordetella pertussis
cgucggccagcgcgaag

SEQ ID NO: 2462184 - RNA, 14 nt, Bordetella pertussis
cgucggccagcuug

SEQ ID NO: 2462185 - RNA, 18 nt, Bordetella pertussis
cgucggccagcuugccgc

SEQ ID NO: 2462186 - RNA, 21 nt, Bordetella pertussis
cgucggccagcuugccgcuca

SEQ ID NO: 2462187 - RNA, 13 nt, Bordetella pertussis
cgucggccaggcc

SEQ ID NO: 2462188 - RNA, 17 nt, Bordetella pertussis
cgucggccaggcgccag

SEQ ID NO: 2462189 - RNA, 14 nt, Bordetella pertussis
cgucggccaggggc

SEQ ID NO: 2462190 - RNA, 16 nt, Bordetella pertussis
cgucggccaugcgcgc

SEQ ID NO: 2462191 - RNA, 17 nt, Bordetella pertussis
cgucggccaugcgcgcc

SEQ ID NO: 2462192 - RNA, 18 nt, Bordetella pertussis
cgucggccaugcgcgcca

SEQ ID NO: 2462193 - RNA, 19 nt, Bordetella pertussis
cgucggccaugcgcgccag

SEQ ID NO: 2462194 - RNA, 21 nt, Bordetella pertussis
cgucggccaugcgcgccagca

SEQ ID NO: 2462195 - RNA, 23 nt, Bordetella pertussis
cgucggccaugcgcgccagcaug

SEQ ID NO: 2462196 - RNA, 14 nt, Bordetella pertussis
cgucggccgccagc

SEQ ID NO: 2462197 - RNA, 15 nt, Bordetella pertussis
cgucggccgccguga

SEQ ID NO: 2462198 - RNA, 14 nt, Bordetella pertussis
cgucggccgcgccc

SEQ ID NO: 2462199 - RNA, 20 nt, Bordetella pertussis
cgucggccgucugggcguga

SEQ ID NO: 2462200 - RNA, 16 nt, Bordetella pertussis
cgucggccucgcgcag

SEQ ID NO: 2462201 - RNA, 19 nt, Bordetella pertussis
cgucggccucgcgcagggc

SEQ ID NO: 2462202 - RNA, 21 nt, Bordetella pertussis
cgucggccucgcgcagggcgg

SEQ ID NO: 2462203 - RNA, 19 nt, Bordetella pertussis
cgucggcgaagccuugcgc

SEQ ID NO: 2462204 - RNA, 14 nt, Bordetella pertussis
cgucggcgacguga

SEQ ID NO: 2462205 - RNA, 15 nt, Bordetella pertussis
cgucggcgacgugau

SEQ ID NO: 2462206 - RNA, 20 nt, Bordetella pertussis
cgucggcgacgugaugcucg

SEQ ID NO: 2462207 - RNA, 15 nt, Bordetella pertussis
cgucggcgauggccc

SEQ ID NO: 2462208 - RNA, 12 nt, Bordetella pertussis
cgucggcgccau

SEQ ID NO: 2462209 - RNA, 18 nt, Bordetella pertussis
cgucggcgccaugcuggc

SEQ ID NO: 2462210 - RNA, 16 nt, Bordetella pertussis
cgucggcgcccggcgc

SEQ ID NO: 2462211 - RNA, 17 nt, Bordetella pertussis
cgucggcgcccggcgcc

SEQ ID NO: 2462212 - RNA, 18 nt, Bordetella pertussis
cgucggcgccgaucagca

SEQ ID NO: 2462213 - RNA, 19 nt, Bordetella pertussis
cgucggcgccgaucagcag

SEQ ID NO: 2462214 - RNA, 12 nt, Bordetella pertussis
cgucggcgcgcg

SEQ ID NO: 2462215 - RNA, 13 nt, Bordetella pertussis
cgucggcgcgcgc

SEQ ID NO: 2462216 - RNA, 15 nt, Bordetella pertussis
cgucggcgcgcgcca

SEQ ID NO: 2462217 - RNA, 19 nt, Bordetella pertussis
cgucggcgcgcgccaggcc

SEQ ID NO: 2462218 - RNA, 14 nt, Bordetella pertussis
cgucggcgcgcgcg

SEQ ID NO: 2462219 - RNA, 14 nt, Bordetella pertussis
cgucggcgcggucg

SEQ ID NO: 2462220 - RNA, 16 nt, Bordetella pertussis
cgucggcgcugcagcg

SEQ ID NO: 2462221 - RNA, 18 nt, Bordetella pertussis
cgucggcgcugcagcgca

SEQ ID NO: 2462222 - RNA, 17 nt, Bordetella pertussis
cgucggcgcuggcgcgc

SEQ ID NO: 2462223 - RNA, 11 nt, Bordetella pertussis
cgucggcggca

SEQ ID NO: 2462224 - RNA, 14 nt, Bordetella pertussis
cgucggcggcaagc

SEQ ID NO: 2462225 - RNA, 15 nt, Bordetella pertussis
cgucggcggcaagca

SEQ ID NO: 2462226 - RNA, 22 nt, Bordetella pertussis
cgucggcggcaagcagccggaa

SEQ ID NO: 2462227 - RNA, 20 nt, Bordetella pertussis
cgucggcggcccacagcgcc

SEQ ID NO: 2462228 - RNA, 14 nt, Bordetella pertussis
cgucggcggccgcc

SEQ ID NO: 2462229 - RNA, 21 nt, Bordetella pertussis
cgucggcgggacgcaggccca

SEQ ID NO: 2462230 - RNA, 22 nt, Bordetella pertussis
cgucggcgucgaaugcacgggc

SEQ ID NO: 2462231 - RNA, 18 nt, Bordetella pertussis
cgucggcguugugccggc

SEQ ID NO: 2462232 - RNA, 21 nt, Bordetella pertussis
cgucggcguugugccggcgca

SEQ ID NO: 2462233 - RNA, 13 nt, Bordetella pertussis
cgucggcuuccau

SEQ ID NO: 2462234 - RNA, 13 nt, Bordetella pertussis
cgucgggacaggc

SEQ ID NO: 2462235 - RNA, 15 nt, Bordetella pertussis
cgucgggaccgaaca

SEQ ID NO: 2462236 - RNA, 15 nt, Bordetella pertussis
cgucgggaccggcgc

SEQ ID NO: 2462237 - RNA, 16 nt, Bordetella pertussis
cgucgggaccggcgcg

SEQ ID NO: 2462238 - RNA, 11 nt, Bordetella pertussis
cgucgggcagc

SEQ ID NO: 2462239 - RNA, 14 nt, Bordetella pertussis
cgucgggcagcagg

SEQ ID NO: 2462240 - RNA, 16 nt, Bordetella pertussis
cgucgggcagcgcggc

SEQ ID NO: 2462241 - RNA, 17 nt, Bordetella pertussis
cgucgggcagcgcggcg

SEQ ID NO: 2462242 - RNA, 16 nt, Bordetella pertussis
cgucgggcaggucggc

SEQ ID NO: 2462243 - RNA, 18 nt, Bordetella pertussis
cgucgggcaguugcuggc

SEQ ID NO: 2462244 - RNA, 13 nt, Bordetella pertussis
cgucgggcgccgc

SEQ ID NO: 2462245 - RNA, 21 nt, Bordetella pertussis
cgucgggcuugccguucaugc

SEQ ID NO: 2462246 - RNA, 23 nt, Bordetella pertussis
cgucggucaugcccaugccgcca

SEQ ID NO: 2462247 - RNA, 20 nt, Bordetella pertussis
cgucggucgcuuccagcgca

SEQ ID NO: 2462248 - RNA, 17 nt, Bordetella pertussis
cgucggugccguccagc

SEQ ID NO: 2462249 - RNA, 18 nt, Bordetella pertussis
cgucggugggaaucggca

SEQ ID NO: 2462250 - RNA, 21 nt, Bordetella pertussis
cgucggugggaaucggcaccu

SEQ ID NO: 2462251 - RNA, 14 nt, Bordetella pertussis
cgucgguggggcag

SEQ ID NO: 2462252 - RNA, 22 nt, Bordetella pertussis
cgucgguggggcaggucgccag

SEQ ID NO: 2462253 - RNA, 19 nt, Bordetella pertussis
cgugaucgaccgccagcag

SEQ ID NO: 2462254 - RNA, 13 nt, Bordetella pertussis
cgugaucgccagc

SEQ ID NO: 2462255 - RNA, 16 nt, Bordetella pertussis
cgugaucgccagcgcc

SEQ ID NO: 2462256 - RNA, 22 nt, Bordetella pertussis
cgugaucuugaugccgcccagc

SEQ ID NO: 2462257 - RNA, 15 nt, Bordetella pertussis
cgugaugcaggcggu

SEQ ID NO: 2462258 - RNA, 12 nt, Bordetella pertussis
cgugaugcccag

SEQ ID NO: 2462259 - RNA, 13 nt, Bordetella pertussis
cgugaugcccagg

SEQ ID NO: 2462260 - RNA, 14 nt, Bordetella pertussis
cgugaugcccaggc

SEQ ID NO: 2462261 - RNA, 21 nt, Bordetella pertussis
cgugaugccccagguccgccg

SEQ ID NO: 2462262 - RNA, 12 nt, Bordetella pertussis
cgugaugccgac

SEQ ID NO: 2462263 - RNA, 16 nt, Bordetella pertussis
cgugaugccgaccagg

SEQ ID NO: 2462264 - RNA, 17 nt, Bordetella pertussis
cgugaugccgaccaggc

SEQ ID NO: 2462265 - RNA, 18 nt, Bordetella pertussis
cgugaugccgaccaggcc

SEQ ID NO: 2462266 - RNA, 15 nt, Bordetella pertussis
cgugaugccgcccgc

SEQ ID NO: 2462267 - RNA, 21 nt, Bordetella pertussis
cgugaugccgcccgcaugcag

SEQ ID NO: 2462268 - RNA, 22 nt, Bordetella pertussis
cgugaugccgucgagcgcggcc

SEQ ID NO: 2462269 - RNA, 17 nt, Bordetella pertussis
cgugguggggccgggcu

SEQ ID NO: 2462270 - RNA, 19 nt, Bordetella pertussis
cgugguggugcgggccgcg

SEQ ID NO: 2462271 - RNA, 19 nt, Bordetella pertussis
cguggugugcgaggacgac

SEQ ID NO: 2462272 - RNA, 23 nt, Bordetella pertussis
cguguagacggcaaucuugccgc

SEQ ID NO: 2462273 - RNA, 19 nt, Bordetella pertussis
cguguagagcaggccgccc

SEQ ID NO: 2462274 - RNA, 16 nt, Bordetella pertussis
cguguagcugugaacu

SEQ ID NO: 2462275 - RNA, 17 nt, Bordetella pertussis
cguguaggucagcgccu

SEQ ID NO: 2462276 - RNA, 20 nt, Bordetella pertussis
cgugucaggcggagucgccc

SEQ ID NO: 2462277 - RNA, 13 nt, Bordetella pertussis
cguguccagcggc

SEQ ID NO: 2462278 - RNA, 14 nt, Bordetella pertussis
cguguccagcggcg

SEQ ID NO: 2462279 - RNA, 17 nt, Bordetella pertussis
cguguccagcggcgcca

SEQ ID NO: 2462280 - RNA, 19 nt, Bordetella pertussis
cguguccagcggcgccagc

SEQ ID NO: 2462281 - RNA, 13 nt, Bordetella pertussis
cgugucccagccg

SEQ ID NO: 2462282 - RNA, 19 nt, Bordetella pertussis
cgugucccagccggcggca

SEQ ID NO: 2462283 - RNA, 13 nt, Bordetella pertussis
cgugucgcccuuc

SEQ ID NO: 2462284 - RNA, 19 nt, Bordetella pertussis
cgugucgcccuucaggcca

SEQ ID NO: 2462285 - RNA, 21 nt, Bordetella pertussis
cgugucgcccuucaggccagu

SEQ ID NO: 2462286 - RNA, 14 nt, Bordetella pertussis
cgugucggccacca

SEQ ID NO: 2462287 - RNA, 16 nt, Bordetella pertussis
cgugucggccaccacg

SEQ ID NO: 2462288 - RNA, 17 nt, Bordetella pertussis
cgugugccuguccccgc

SEQ ID NO: 2462289 - RNA, 18 nt, Bordetella pertussis
cguguggcaggccagcgc

SEQ ID NO: 2462290 - RNA, 20 nt, Bordetella pertussis
cguguggcaggccagcgcca

SEQ ID NO: 2462291 - RNA, 20 nt, Bordetella pertussis
cguguggugaaagccgccgg

SEQ ID NO: 2462292 - RNA, 16 nt, Bordetella pertussis
cgugugguuggcgcug

SEQ ID NO: 2462293 - RNA, 19 nt, Bordetella pertussis
cgugugguuggcgcugcug

SEQ ID NO: 2462294 - RNA, 17 nt, Bordetella pertussis
cuacugcccucgccucg

SEQ ID NO: 2462295 - RNA, 15 nt, Bordetella pertussis
cuacuggcgcgcgca

SEQ ID NO: 2462296 - RNA, 23 nt, Bordetella pertussis
cuacugggccagauagucgcgga

SEQ ID NO: 2462297 - RNA, 16 nt, Bordetella pertussis
cuacugggugcuggcc

SEQ ID NO: 2462298 - RNA, 17 nt, Bordetella pertussis
cuagagcaugcggcguc

SEQ ID NO: 2462299 - RNA, 19 nt, Bordetella pertussis
cuagagcggcguggcgccg

SEQ ID NO: 2462300 - RNA, 14 nt, Bordetella pertussis
cuagcccggcgcca

SEQ ID NO: 2462301 - RNA, 14 nt, Bordetella pertussis
cuagcgccgcgcca

SEQ ID NO: 2462302 - RNA, 15 nt, Bordetella pertussis
cuagcgccgcgccag

SEQ ID NO: 2462303 - RNA, 19 nt, Bordetella pertussis
cuaggccguuuccucugga

SEQ ID NO: 2462304 - RNA, 21 nt, Bordetella pertussis
cuaggccguuuccucuggaga

SEQ ID NO: 2462305 - RNA, 19 nt, Bordetella pertussis
cuaggccuugccgccgccg

SEQ ID NO: 2462306 - RNA, 13 nt, Bordetella pertussis
cuaggcgcagcag

SEQ ID NO: 2462307 - RNA, 17 nt, Bordetella pertussis
cuaggcgcagcaggcca

SEQ ID NO: 2462308 - RNA, 20 nt, Bordetella pertussis
cuaggcgcagcaggccagga

SEQ ID NO: 2462309 - RNA, 14 nt, Bordetella pertussis
cuagggcguggcgc

SEQ ID NO: 2462310 - RNA, 14 nt, Bordetella pertussis
cuaggugugaacug

SEQ ID NO: 2462311 - RNA, 17 nt, Bordetella pertussis
cuaguagaacucgccag

SEQ ID NO: 2462312 - RNA, 16 nt, Bordetella pertussis
cuauaccgggcugguc

SEQ ID NO: 2462313 - RNA, 22 nt, Bordetella pertussis
cuauaucgacggcgccuauugc

SEQ ID NO: 2462314 - RNA, 15 nt, Bordetella pertussis
cuaucauggccuugg

SEQ ID NO: 2462315 - RNA, 14 nt, Bordetella pertussis
cuaucugccgcgca

SEQ ID NO: 2462316 - RNA, 13 nt, Bordetella pertussis
cuaugacgaccgc

SEQ ID NO: 2462317 - RNA, 17 nt, Bordetella pertussis
cuaugcagcugcgccag

SEQ ID NO: 2462318 - RNA, 19 nt, Bordetella pertussis
cuaugcagcugcgccagcc

SEQ ID NO: 2462319 - RNA, 21 nt, Bordetella pertussis
cuaugcgguguugcucgugcu

SEQ ID NO: 2462320 - RNA, 12 nt, Bordetella pertussis
cuauggccugca

SEQ ID NO: 2462321 - RNA, 21 nt, Bordetella pertussis
cuaugggggcgagcgggccgg

SEQ ID NO: 2462322 - RNA, 21 nt, Bordetella pertussis
cuauguaggcgccgcgcccgu

SEQ ID NO: 2462323 - RNA, 16 nt, Bordetella pertussis
cuaugucgccggccag

SEQ ID NO: 2462324 - RNA, 22 nt, Bordetella pertussis
cuauucgggaaugaugcgcauu

SEQ ID NO: 2462325 - RNA, 16 nt, Bordetella pertussis
cuauugcgacgccgcc

SEQ ID NO: 2462326 - RNA, 18 nt, Bordetella pertussis
cuauugcgacgccgccga

SEQ ID NO: 2462327 - RNA, 13 nt, Bordetella pertussis
cuauuggcuguau

SEQ ID NO: 2462328 - RNA, 18 nt, Bordetella pertussis
cuauuggcuguaucuggc

SEQ ID NO: 2462329 - RNA, 21 nt, Bordetella pertussis
cuauuuccgacgagaaugcgc

SEQ ID NO: 2462330 - RNA, 17 nt, Bordetella pertussis
cuauuuggcggccuggc

SEQ ID NO: 2462331 - RNA, 21 nt, Bordetella pertussis
cucaacaguacuacaguaugg

SEQ ID NO: 2462332 - RNA, 18 nt, Bordetella pertussis
cucaaccacgaacacgau

SEQ ID NO: 2462333 - RNA, 19 nt, Bordetella pertussis
cucaacccgccggccauca

SEQ ID NO: 2462334 - RNA, 17 nt, Bordetella pertussis
cucaaccucgacgcgca

SEQ ID NO: 2462335 - RNA, 19 nt, Bordetella pertussis
cucaaccucgacgcgcauu

SEQ ID NO: 2462336 - RNA, 23 nt, Bordetella pertussis
cucaaccuucucgaugcgcgcca

SEQ ID NO: 2462337 - RNA, 22 nt, Bordetella pertussis
cucaacgaagaacagccgcugc

SEQ ID NO: 2462338 - RNA, 15 nt, Bordetella pertussis
cucaacuggccggcc

SEQ ID NO: 2462339 - RNA, 18 nt, Bordetella pertussis
cucaacuggccggccugg

SEQ ID NO: 2462340 - RNA, 19 nt, Bordetella pertussis
cucaagaagaagccgggcu

SEQ ID NO: 2462341 - RNA, 15 nt, Bordetella pertussis
cucaaggccgaauug

SEQ ID NO: 2462342 - RNA, 19 nt, Bordetella pertussis
cucaagggccugucacacc

SEQ ID NO: 2462343 - RNA, 18 nt, Bordetella pertussis
cucacagacgaucacggu

SEQ ID NO: 2462344 - RNA, 19 nt, Bordetella pertussis
cucacagggucaaggcgcg

SEQ ID NO: 2462345 - RNA, 15 nt, Bordetella pertussis
cucaccgccgcccgc

SEQ ID NO: 2462346 - RNA, 22 nt, Bordetella pertussis
cucacgaugcgaucgucgcugc

SEQ ID NO: 2462347 - RNA, 21 nt, Bordetella pertussis
cucacgcaaggccgacuggau

SEQ ID NO: 2462348 - RNA, 17 nt, Bordetella pertussis
cucacgccccgcccucu

SEQ ID NO: 2462349 - RNA, 23 nt, Bordetella pertussis
cucacgggcgaagcggaccuggu

SEQ ID NO: 2462350 - RNA, 12 nt, Bordetella pertussis
cucacggggcug

SEQ ID NO: 2462351 - RNA, 14 nt, Bordetella pertussis
cucacggggcuguc

SEQ ID NO: 2462352 - RNA, 15 nt, Bordetella pertussis
cucacggggcugucg

SEQ ID NO: 2462353 - RNA, 22 nt, Bordetella pertussis
cucacggggcugucgcgcgcau

SEQ ID NO: 2462354 - RNA, 21 nt, Bordetella pertussis
cucagaccaucuuguccuuca

SEQ ID NO: 2462355 - RNA, 15 nt, Bordetella pertussis
cucagcaccaggccg

SEQ ID NO: 2462356 - RNA, 17 nt, Bordetella pertussis
cucagcaccaggccgcc

SEQ ID NO: 2462357 - RNA, 21 nt, Bordetella pertussis
cucagcaccaggccgccggcc

SEQ ID NO: 2462358 - RNA, 14 nt, Bordetella pertussis
cucagcagcgccag

SEQ ID NO: 2462359 - RNA, 22 nt, Bordetella pertussis
cucagcagggucgagaccagca

SEQ ID NO: 2462360 - RNA, 10 nt, Bordetella pertussis
cucagccccc

SEQ ID NO: 2462361 - RNA, 22 nt, Bordetella pertussis
cucagccccccguaggcggccc

SEQ ID NO: 2462362 - RNA, 19 nt, Bordetella pertussis
cucagcccgcaccgcccgc

SEQ ID NO: 2462363 - RNA, 13 nt, Bordetella pertussis
cucagcccgcguu

SEQ ID NO: 2462364 - RNA, 21 nt, Bordetella pertussis
cucagcccgcguucaggcgcg

SEQ ID NO: 2462365 - RNA, 23 nt, Bordetella pertussis
cucagcccggcgagguugcaggc

SEQ ID NO: 2462366 - RNA, 14 nt, Bordetella pertussis
cucagccgcccgcc

SEQ ID NO: 2462367 - RNA, 20 nt, Bordetella pertussis
cucagccgcgcgcggccggc

SEQ ID NO: 2462368 - RNA, 16 nt, Bordetella pertussis
cucagccgugccgcgc

SEQ ID NO: 2462369 - RNA, 13 nt, Bordetella pertussis
cucagcgacgcgc

SEQ ID NO: 2462370 - RNA, 17 nt, Bordetella pertussis
cucagcgacgcgcgccg

SEQ ID NO: 2462371 - RNA, 22 nt, Bordetella pertussis
cucagcgacgcgcgccggcgcu

SEQ ID NO: 2462372 - RNA, 15 nt, Bordetella pertussis
cucagcgccaucauc

SEQ ID NO: 2462373 - RNA, 16 nt, Bordetella pertussis
cucagcgccaucaucg

SEQ ID NO: 2462374 - RNA, 13 nt, Bordetella pertussis
cgugugucccggc

SEQ ID NO: 2462375 - RNA, 20 nt, Bordetella pertussis
cguguucagcgcgcgcgccg

SEQ ID NO: 2462376 - RNA, 16 nt, Bordetella pertussis
cguguuccagcgccug

SEQ ID NO: 2462377 - RNA, 14 nt, Bordetella pertussis
cguguucgcggccg

SEQ ID NO: 2462378 - RNA, 18 nt, Bordetella pertussis
cguguucgcggccggaca

SEQ ID NO: 2462379 - RNA, 19 nt, Bordetella pertussis
cguguucgcggccggacag

SEQ ID NO: 2462380 - RNA, 16 nt, Bordetella pertussis
cguguugccaggcgau

SEQ ID NO: 2462381 - RNA, 16 nt, Bordetella pertussis
cguguuguucagguug

SEQ ID NO: 2462382 - RNA, 16 nt, Bordetella pertussis
cguguuucucgcucuu

SEQ ID NO: 2462383 - RNA, 16 nt, Bordetella pertussis
cguucaagucgcccug

SEQ ID NO: 2462384 - RNA, 17 nt, Bordetella pertussis
cguucaaucgcgcuucu

SEQ ID NO: 2462385 - RNA, 15 nt, Bordetella pertussis
cguucaccaggaagc

SEQ ID NO: 2462386 - RNA, 21 nt, Bordetella pertussis
cguucaccaggaagcgcgccu

SEQ ID NO: 2462387 - RNA, 14 nt, Bordetella pertussis
cguucaccccccga

SEQ ID NO: 2462388 - RNA, 18 nt, Bordetella pertussis
cguucacgccggcgcgcc

SEQ ID NO: 2462389 - RNA, 22 nt, Bordetella pertussis
cguucacgccggcgcgccgggc

SEQ ID NO: 2462390 - RNA, 14 nt, Bordetella pertussis
cguucacgcgcagc

SEQ ID NO: 2462391 - RNA, 13 nt, Bordetella pertussis
cguucacguagaa

SEQ ID NO: 2462392 - RNA, 23 nt, Bordetella pertussis
cguucacguagaaauacgcgcgc

SEQ ID NO: 2462393 - RNA, 15 nt, Bordetella pertussis
cguucagcagcaggc

SEQ ID NO: 2462394 - RNA, 14 nt, Bordetella pertussis
cguucagcgccggc

SEQ ID NO: 2462395 - RNA, 16 nt, Bordetella pertussis
cguucagcgccggcau

SEQ ID NO: 2462396 - RNA, 15 nt, Bordetella pertussis
cguucagcgggcgcg

SEQ ID NO: 2462397 - RNA, 16 nt, Bordetella pertussis
cguucagggacgggcc

SEQ ID NO: 2462398 - RNA, 14 nt, Bordetella pertussis
cguucagggcgccg

SEQ ID NO: 2462399 - RNA, 17 nt, Bordetella pertussis
cguucagggcgccgcgg

SEQ ID NO: 2462400 - RNA, 19 nt, Bordetella pertussis
cguucagggcgccgcggcg

SEQ ID NO: 2462401 - RNA, 22 nt, Bordetella pertussis
cguucagguucaucagccggau

SEQ ID NO: 2462402 - RNA, 15 nt, Bordetella pertussis
cguucaucagcgcgc

SEQ ID NO: 2462403 - RNA, 18 nt, Bordetella pertussis
cguucauggcgcaugacg

SEQ ID NO: 2462404 - RNA, 19 nt, Bordetella pertussis
cguuccagaugcgcagcag

SEQ ID NO: 2462405 - RNA, 20 nt, Bordetella pertussis
cguuccagcagaucgcggcg

SEQ ID NO: 2462406 - RNA, 20 nt, Bordetella pertussis
cguuccaugacguccagcgc

SEQ ID NO: 2462407 - RNA, 22 nt, Bordetella pertussis
cguuccaugacguccagcgcca

SEQ ID NO: 2462408 - RNA, 19 nt, Bordetella pertussis
cguuccaugcgauccaggg

SEQ ID NO: 2462409 - RNA, 21 nt, Bordetella pertussis
cguuccauuauuucggagacc

SEQ ID NO: 2462410 - RNA, 17 nt, Bordetella pertussis
cguuccccaucaucugc

SEQ ID NO: 2462411 - RNA, 15 nt, Bordetella pertussis
cguuccggccgcgcc

SEQ ID NO: 2462412 - RNA, 16 nt, Bordetella pertussis
cguuccugggcacgcc

SEQ ID NO: 2462413 - RNA, 22 nt, Bordetella pertussis
cguuccuggucuuccgguacgc

SEQ ID NO: 2462414 - RNA, 19 nt, Bordetella pertussis
cguucgaaagccagcgccu

SEQ ID NO: 2462415 - RNA, 20 nt, Bordetella pertussis
cguucgaaagccagcgccug

SEQ ID NO: 2462416 - RNA, 20 nt, Bordetella pertussis
cguucgaaguccgcgcgcag

SEQ ID NO: 2462417 - RNA, 15 nt, Bordetella pertussis
cguucgacgggcagg

SEQ ID NO: 2462418 - RNA, 20 nt, Bordetella pertussis
cguucgacgggcaggcccag

SEQ ID NO: 2462419 - RNA, 22 nt, Bordetella pertussis
cguucgacgggcaggcccagcc

SEQ ID NO: 2462420 - RNA, 24 nt, Bordetella pertussis
cguucgacuucguccggcgcgucg

SEQ ID NO: 2462421 - RNA, 15 nt, Bordetella pertussis
cguucgccgcagccg

SEQ ID NO: 2462422 - RNA, 22 nt, Bordetella pertussis
cguucgccgucguugacgggga

SEQ ID NO: 2462423 - RNA, 13 nt, Bordetella pertussis
cguucgcgccgcg

SEQ ID NO: 2462424 - RNA, 17 nt, Bordetella pertussis
cguucgcgccgcgucuu

SEQ ID NO: 2462425 - RNA, 13 nt, Bordetella pertussis
cguucgcgcugcc

SEQ ID NO: 2462426 - RNA, 18 nt, Bordetella pertussis
cguucgcgcuugcggccg

SEQ ID NO: 2462427 - RNA, 21 nt, Bordetella pertussis
cguucgcgcuugcggccgucg

SEQ ID NO: 2462428 - RNA, 21 nt, Bordetella pertussis
cguucgcggugggcagcggca

SEQ ID NO: 2462429 - RNA, 16 nt, Bordetella pertussis
cguucggcaccggcag

SEQ ID NO: 2462430 - RNA, 19 nt, Bordetella pertussis
cguucggccacuuccuggu

SEQ ID NO: 2462431 - RNA, 13 nt, Bordetella pertussis
cguucggccagcc

SEQ ID NO: 2462432 - RNA, 14 nt, Bordetella pertussis
cguucggccagcgc

SEQ ID NO: 2462433 - RNA, 16 nt, Bordetella pertussis
cguucggccagcgcgc

SEQ ID NO: 2462434 - RNA, 22 nt, Bordetella pertussis
cguucggccagcgcgcggcgca

SEQ ID NO: 2462435 - RNA, 21 nt, Bordetella pertussis
cguucgggcggcaggugcgcc

SEQ ID NO: 2462436 - RNA, 22 nt, Bordetella pertussis
cguucggggcgucgcugcuggc

SEQ ID NO: 2462437 - RNA, 23 nt, Bordetella pertussis
cguucggggcgucgcugcuggcg

SEQ ID NO: 2462438 - RNA, 16 nt, Bordetella pertussis
cguucggugcgcagcg

SEQ ID NO: 2462439 - RNA, 19 nt, Bordetella pertussis
cguucggugcgcagcggca

SEQ ID NO: 2462440 - RNA, 18 nt, Bordetella pertussis
cguucguauugcugcugc

SEQ ID NO: 2462441 - RNA, 14 nt, Bordetella pertussis
cguucgucgcgcag

SEQ ID NO: 2462442 - RNA, 15 nt, Bordetella pertussis
cguucgucgcgcagc

SEQ ID NO: 2462443 - RNA, 16 nt, Bordetella pertussis
cguucgucgcgcagca

SEQ ID NO: 2462444 - RNA, 14 nt, Bordetella pertussis
cguucucgcgcuuc

SEQ ID NO: 2462445 - RNA, 16 nt, Bordetella pertussis
cguucugcgcgcccgu

SEQ ID NO: 2462446 - RNA, 15 nt, Bordetella pertussis
cguucugcguggcgg

SEQ ID NO: 2462447 - RNA, 21 nt, Bordetella pertussis
cguucuggcagugcgccuggc

SEQ ID NO: 2462448 - RNA, 21 nt, Bordetella pertussis
cguucuggcugcgcgccuggc

SEQ ID NO: 2462449 - RNA, 15 nt, Bordetella pertussis
cguucugggagcgcg

SEQ ID NO: 2462450 - RNA, 20 nt, Bordetella pertussis
cguucugggagcgcgggccg

SEQ ID NO: 2462451 - RNA, 14 nt, Bordetella pertussis
cguucuucagcgcg

SEQ ID NO: 2462452 - RNA, 21 nt, Bordetella pertussis
cguucuugagaauggcgcggu

SEQ ID NO: 2462453 - RNA, 15 nt, Bordetella pertussis
cguugaagcgcagcc

SEQ ID NO: 2462454 - RNA, 16 nt, Bordetella pertussis
cguugaccgccucgau

SEQ ID NO: 2462455 - RNA, 18 nt, Bordetella pertussis
cguugaccgccucgaugc

SEQ ID NO: 2462456 - RNA, 20 nt, Bordetella pertussis
cguugaccggcuggcgcacg

SEQ ID NO: 2462457 - RNA, 20 nt, Bordetella pertussis
cguugaccuggucgaucagc

SEQ ID NO: 2462458 - RNA, 15 nt, Bordetella pertussis
cguugaccuugccga

SEQ ID NO: 2462459 - RNA, 20 nt, Bordetella pertussis
cguugaccuugccgauccag

SEQ ID NO: 2462460 - RNA, 15 nt, Bordetella pertussis
cguugacgccgacga

SEQ ID NO: 2462461 - RNA, 14 nt, Bordetella pertussis
cucccacgaccugc

SEQ ID NO: 2462462 - RNA, 13 nt, Bordetella pertussis
cucccagaccugc

SEQ ID NO: 2462463 - RNA, 14 nt, Bordetella pertussis
cucccagaccugcg

SEQ ID NO: 2462464 - RNA, 19 nt, Bordetella pertussis
cucccagaccugcgcgccg

SEQ ID NO: 2462465 - RNA, 20 nt, Bordetella pertussis
cucccagaccugcgcgccgg

SEQ ID NO: 2462466 - RNA, 21 nt, Bordetella pertussis
cucccagaccugcgcgccggc

SEQ ID NO: 2462467 - RNA, 14 nt, Bordetella pertussis
cucccauugcgcgg

SEQ ID NO: 2462468 - RNA, 17 nt, Bordetella pertussis
cucccauugcgcggcca

SEQ ID NO: 2462469 - RNA, 20 nt, Bordetella pertussis
cucccauugcgcggccaggg

SEQ ID NO: 2462470 - RNA, 14 nt, Bordetella pertussis
cucccccacgccgc

SEQ ID NO: 2462471 - RNA, 16 nt, Bordetella pertussis
cucccccucggccugc

SEQ ID NO: 2462472 - RNA, 18 nt, Bordetella pertussis
cuccccgcugaccuggug

SEQ ID NO: 2462473 - RNA, 16 nt, Bordetella pertussis
cuccccgugcggggac

SEQ ID NO: 2462474 - RNA, 19 nt, Bordetella pertussis
cuccccuggucagggcugc

SEQ ID NO: 2462475 - RNA, 13 nt, Bordetella pertussis
cucccgcaggccc

SEQ ID NO: 2462476 - RNA, 15 nt, Bordetella pertussis
cucccgccgcccggc

SEQ ID NO: 2462477 - RNA, 16 nt, Bordetella pertussis
cucccgccgcccggcc

SEQ ID NO: 2462478 - RNA, 19 nt, Bordetella pertussis
cucccgccgcccggccggc

SEQ ID NO: 2462479 - RNA, 13 nt, Bordetella pertussis
cucccgcgccauu

SEQ ID NO: 2462480 - RNA, 17 nt, Bordetella pertussis
cucccgcgccauugcca

SEQ ID NO: 2462481 - RNA, 16 nt, Bordetella pertussis
cucccgcgcugccgcu

SEQ ID NO: 2462482 - RNA, 18 nt, Bordetella pertussis
cucccgcgcugccgcugc

SEQ ID NO: 2462483 - RNA, 21 nt, Bordetella pertussis
cucccgcgcugccgcugcagg

SEQ ID NO: 2462484 - RNA, 21 nt, Bordetella pertussis
cucccgcugacuuccggggag

SEQ ID NO: 2462485 - RNA, 14 nt, Bordetella pertussis
cucccggaccagca

SEQ ID NO: 2462486 - RNA, 17 nt, Bordetella pertussis
cucccguaagcaggucu

SEQ ID NO: 2462487 - RNA, 19 nt, Bordetella pertussis
cucccguaagcaggucugc

SEQ ID NO: 2462488 - RNA, 18 nt, Bordetella pertussis
cucccugugggggacagg

SEQ ID NO: 2462489 - RNA, 22 nt, Bordetella pertussis
cucccugugggggacaggcacg

SEQ ID NO: 2462490 - RNA, 17 nt, Bordetella pertussis
cuccgaacaggcggucu

SEQ ID NO: 2462491 - RNA, 14 nt, Bordetella pertussis
cuccgaacgcgaca

SEQ ID NO: 2462492 - RNA, 19 nt, Bordetella pertussis
cuccgaacgcgacagcgcu

SEQ ID NO: 2462493 - RNA, 22 nt, Bordetella pertussis
cuccgaagggcugcgugcggga

SEQ ID NO: 2462494 - RNA, 16 nt, Bordetella pertussis
cuccgacaggcgccgc

SEQ ID NO: 2462495 - RNA, 17 nt, Bordetella pertussis
cuccgacaggcgccgca

SEQ ID NO: 2462496 - RNA, 15 nt, Bordetella pertussis
cuccgagggacaccg

SEQ ID NO: 2462497 - RNA, 16 nt, Bordetella pertussis
cuccgagggacaccgc

SEQ ID NO: 2462498 - RNA, 19 nt, Bordetella pertussis
cuccgagggacaccgcagg

SEQ ID NO: 2462499 - RNA, 18 nt, Bordetella pertussis
cuccgauagcggcgccgc

SEQ ID NO: 2462500 - RNA, 17 nt, Bordetella pertussis
cuggcgcagcagcgccg

SEQ ID NO: 2462501 - RNA, 14 nt, Bordetella pertussis
cuggcgcagcaggc

SEQ ID NO: 2462502 - RNA, 17 nt, Bordetella pertussis
cuggcgcagcaggcgcg

SEQ ID NO: 2462503 - RNA, 18 nt, Bordetella pertussis
cuggcgcagcauuucuuc

SEQ ID NO: 2462504 - RNA, 13 nt, Bordetella pertussis
cuggcgcaggccg

SEQ ID NO: 2462505 - RNA, 14 nt, Bordetella pertussis
cuggcgcaggccgg

SEQ ID NO: 2462506 - RNA, 22 nt, Bordetella pertussis
cuggcgcaggccggcggccagc

SEQ ID NO: 2462507 - RNA, 23 nt, Bordetella pertussis
cuggcgcaggccggcggccagcg

SEQ ID NO: 2462508 - RNA, 20 nt, Bordetella pertussis
cuggcgcaguaucccggcca

SEQ ID NO: 2462509 - RNA, 23 nt, Bordetella pertussis
cuggcgcaguaucccggccaggc

SEQ ID NO: 2462510 - RNA, 14 nt, Bordetella pertussis
cuggcgcauggccg

SEQ ID NO: 2462511 - RNA, 16 nt, Bordetella pertussis
cuggcgcauggccggc

SEQ ID NO: 2462512 - RNA, 13 nt, Bordetella pertussis
cuggcgcauggcu

SEQ ID NO: 2462513 - RNA, 16 nt, Bordetella pertussis
cuggcgcauggcuggu

SEQ ID NO: 2462514 - RNA, 13 nt, Bordetella pertussis
cuggcgcccacgc

SEQ ID NO: 2462515 - RNA, 15 nt, Bordetella pertussis
cuggcgcccgccugc

SEQ ID NO: 2462516 - RNA, 14 nt, Bordetella pertussis
cuggcgcccggcgg

SEQ ID NO: 2462517 - RNA, 15 nt, Bordetella pertussis
cuggcgcccggcggc

SEQ ID NO: 2462518 - RNA, 16 nt, Bordetella pertussis
cuggcgcccggcggcg

SEQ ID NO: 2462519 - RNA, 17 nt, Bordetella pertussis
cuggcgcccggcggcgc

SEQ ID NO: 2462520 - RNA, 15 nt, Bordetella pertussis
cuggcgccgcgcgcc

SEQ ID NO: 2462521 - RNA, 21 nt, Bordetella pertussis
cuggcgccgcggccggguggc

SEQ ID NO: 2462522 - RNA, 18 nt, Bordetella pertussis
cuggcgccggucugggcg

SEQ ID NO: 2462523 - RNA, 18 nt, Bordetella pertussis
cuggcgccguucgucgcg

SEQ ID NO: 2462524 - RNA, 23 nt, Bordetella pertussis
cuggcgccguucgucgcgcagca

SEQ ID NO: 2462525 - RNA, 14 nt, Bordetella pertussis
cuggcgcgacgccu

SEQ ID NO: 2462526 - RNA, 23 nt, Bordetella pertussis
cugggcgucgaaggcggccggca

SEQ ID NO: 2462527 - RNA, 20 nt, Bordetella pertussis
cugggcgucguccugcagca

SEQ ID NO: 2462528 - RNA, 23 nt, Bordetella pertussis
cugggcgucguccugcagcaggg

SEQ ID NO: 2462529 - RNA, 20 nt, Bordetella pertussis
cugggcgugaaaggccagcg

SEQ ID NO: 2462530 - RNA, 13 nt, Bordetella pertussis
cugggcguggcgc

SEQ ID NO: 2462531 - RNA, 15 nt, Bordetella pertussis
cugggcguggcgcgc

SEQ ID NO: 2462532 - RNA, 14 nt, Bordetella pertussis
cugggcuugccggu

SEQ ID NO: 2462533 - RNA, 21 nt, Bordetella pertussis
cugggcuugccggugcucggc

SEQ ID NO: 2462534 - RNA, 19 nt, Bordetella pertussis
cuggggaagcgcucgucgg

SEQ ID NO: 2462535 - RNA, 23 nt, Bordetella pertussis
cuggggcagcaggaguuccgcgu

SEQ ID NO: 2462536 - RNA, 17 nt, Bordetella pertussis
cuggggcaggacgccgg

SEQ ID NO: 2462537 - RNA, 15 nt, Bordetella pertussis
cuggggcaggcacug

SEQ ID NO: 2462538 - RNA, 19 nt, Bordetella pertussis
cuggggcaggcacuggcgc

SEQ ID NO: 2462539 - RNA, 12 nt, Bordetella pertussis
cuggggcaggcg

SEQ ID NO: 2462540 - RNA, 16 nt, Bordetella pertussis
cuggggcaggcggcuu

SEQ ID NO: 2462541 - RNA, 20 nt, Bordetella pertussis
cuggggcaggcggcuuucau

SEQ ID NO: 2462542 - RNA, 19 nt, Bordetella pertussis
cuggggccgcggcgcgcgc

SEQ ID NO: 2462543 - RNA, 20 nt, Bordetella pertussis
cuggggccgcggcgcgcgcg

SEQ ID NO: 2462544 - RNA, 23 nt, Bordetella pertussis
cuggggccgcggcgcgcgcggcg

SEQ ID NO: 2462545 - RNA, 13 nt, Bordetella pertussis
cuggggcgcgguc

SEQ ID NO: 2462546 - RNA, 13 nt, Bordetella pertussis
cuggggcgggcgc

SEQ ID NO: 2462547 - RNA, 15 nt, Bordetella pertussis
cugggggcuggaggc

SEQ ID NO: 2462548 - RNA, 19 nt, Bordetella pertussis
cuggggguucgugggcgag

SEQ ID NO: 2462549 - RNA, 20 nt, Bordetella pertussis
cuggggguucgugggcgagc

SEQ ID NO: 2462550 - RNA, 15 nt, Bordetella pertussis
cugggguaggcgcgg

SEQ ID NO: 2462551 - RNA, 18 nt, Bordetella pertussis
cugggguggagcgcggcg

SEQ ID NO: 2462552 - RNA, 19 nt, Bordetella pertussis
cugggguuguauugcauga

SEQ ID NO: 2462553 - RNA, 22 nt, Bordetella pertussis
cugggguuguauugcaugaccg

SEQ ID NO: 2462554 - RNA, 14 nt, Bordetella pertussis
cugggucaggucgc

SEQ ID NO: 2462555 - RNA, 16 nt, Bordetella pertussis
cugggucaucagcacg

SEQ ID NO: 2462556 - RNA, 17 nt, Bordetella pertussis
cugggucaucagcacga

SEQ ID NO: 2462557 - RNA, 18 nt, Bordetella pertussis
cugggucaucagcacgau

SEQ ID NO: 2462558 - RNA, 22 nt, Bordetella pertussis
cugggugaagccaagcagggca

SEQ ID NO: 2462559 - RNA, 23 nt, Bordetella pertussis
cugggugacgcuggagcgcggcg

SEQ ID NO: 2462560 - RNA, 12 nt, Bordetella pertussis
cugggugcuggc

SEQ ID NO: 2462561 - RNA, 17 nt, Bordetella pertussis
cugggugcuggccaacg

SEQ ID NO: 2462562 - RNA, 14 nt, Bordetella pertussis
cugggugcuggugc

SEQ ID NO: 2462563 - RNA, 14 nt, Bordetella pertussis
cuggguggccagcg

SEQ ID NO: 2462564 - RNA, 19 nt, Bordetella pertussis
cuggguggccagcgccgcc

SEQ ID NO: 2462565 - RNA, 19 nt, Bordetella pertussis
cuggguguagucgcggccg

SEQ ID NO: 2462566 - RNA, 14 nt, Bordetella pertussis
cuggguucaggccu

SEQ ID NO: 2462567 - RNA, 20 nt, Bordetella pertussis
cugguacagccccagcgcca

SEQ ID NO: 2462568 - RNA, 20 nt, Bordetella pertussis
cugguagaguacugcguucg

SEQ ID NO: 2462569 - RNA, 18 nt, Bordetella pertussis
cugguagaucagcgcguc

SEQ ID NO: 2462570 - RNA, 23 nt, Bordetella pertussis
cugguagaucagcgcgucggcgc

SEQ ID NO: 2462571 - RNA, 20 nt, Bordetella pertussis
cugguaguaaucgcgcgcca

SEQ ID NO: 2462572 - RNA, 21 nt, Bordetella pertussis
cugguaguagagcgaauccau

SEQ ID NO: 2462573 - RNA, 20 nt, Bordetella pertussis
cugguagugcaggccgcgca

SEQ ID NO: 2462574 - RNA, 21 nt, Bordetella pertussis
cugguauccggcgcacgcccc

SEQ ID NO: 2462575 - RNA, 22 nt, Bordetella pertussis
cugguaugcacgaugccgucgc

SEQ ID NO: 2462576 - RNA, 16 nt, Bordetella pertussis
cuggucaaccuggugu

SEQ ID NO: 2462577 - RNA, 18 nt, Bordetella pertussis
cuggucaacucgcccgau

SEQ ID NO: 2462578 - RNA, 16 nt, Bordetella pertussis
cuggucaagggcggcc

SEQ ID NO: 2462579 - RNA, 20 nt, Bordetella pertussis
cuggucaagggcggccaugc

SEQ ID NO: 2462580 - RNA, 14 nt, Bordetella pertussis
cuggucaccgcccc

SEQ ID NO: 2462581 - RNA, 17 nt, Bordetella pertussis
cuggucaccgccccgac

SEQ ID NO: 2462582 - RNA, 18 nt, Bordetella pertussis
cuggucaccgccccgacc

SEQ ID NO: 2462583 - RNA, 15 nt, Bordetella pertussis
cuggucacguccagu

SEQ ID NO: 2462584 - RNA, 15 nt, Bordetella pertussis
cuggucagccugggc

SEQ ID NO: 2462585 - RNA, 17 nt, Bordetella pertussis
cuggucagccugggcgc

SEQ ID NO: 2462586 - RNA, 16 nt, Bordetella pertussis
cuggucagccuggggc

SEQ ID NO: 2462587 - RNA, 14 nt, Bordetella pertussis
cuggucagcgccga

SEQ ID NO: 2462588 - RNA, 18 nt, Bordetella pertussis
cuggucagcgccgacgau

SEQ ID NO: 2462589 - RNA, 16 nt, Bordetella pertussis
cuggucaggcggucga

SEQ ID NO: 2462590 - RNA, 15 nt, Bordetella pertussis
cuggucagggcugca

SEQ ID NO: 2462591 - RNA, 16 nt, Bordetella pertussis
cuggucagguugcgcc

SEQ ID NO: 2462592 - RNA, 20 nt, Bordetella pertussis
cuggucagguugcgccggcu

SEQ ID NO: 2462593 - RNA, 22 nt, Bordetella pertussis
cuggucaucgccaugcugccaa

SEQ ID NO: 2462594 - RNA, 20 nt, Bordetella pertussis
cuggucaucuacagcgccug

SEQ ID NO: 2462595 - RNA, 18 nt, Bordetella pertussis
cuggucaugacgggcggc

SEQ ID NO: 2462596 - RNA, 23 nt, Bordetella pertussis
cugguccaccaccuucagggcgc

SEQ ID NO: 2462597 - RNA, 14 nt, Bordetella pertussis
cugguccacggcgg

SEQ ID NO: 2462598 - RNA, 14 nt, Bordetella pertussis
cugguccagcagcg

SEQ ID NO: 2462599 - RNA, 23 nt, Bordetella pertussis
cugguccaggcggugcguccagg

SEQ ID NO: 2462600 - RNA, 15 nt, Bordetella pertussis
cugguccgccgccgc

SEQ ID NO: 2462601 - RNA, 17 nt, Bordetella pertussis
cugguccgccgccgcgu

SEQ ID NO: 2462602 - RNA, 13 nt, Bordetella pertussis
cugguccugggcc

SEQ ID NO: 2462603 - RNA, 14 nt, Bordetella pertussis
cugguccugggccg

SEQ ID NO: 2462604 - RNA, 23 nt, Bordetella pertussis
cuggucgaacgcuuccugggccu

SEQ ID NO: 2462605 - RNA, 18 nt, Bordetella pertussis
cuggucgaacguggcggc

SEQ ID NO: 2462606 - RNA, 17 nt, Bordetella pertussis
cuggucgaccaggccgg

SEQ ID NO: 2462607 - RNA, 23 nt, Bordetella pertussis
cuggucgacccacuugagcagcg

SEQ ID NO: 2462608 - RNA, 13 nt, Bordetella pertussis
cuggucgacgccg

SEQ ID NO: 2462609 - RNA, 14 nt, Bordetella pertussis
cuggucgacgccgg

SEQ ID NO: 2462610 - RNA, 16 nt, Bordetella pertussis
cuggucgacgccggcg

SEQ ID NO: 2462611 - RNA, 19 nt, Bordetella pertussis
cuggucgagagccugggcg

SEQ ID NO: 2462612 - RNA, 20 nt, Bordetella pertussis
cuggucgagagccugggcgc

SEQ ID NO: 2462613 - RNA, 16 nt, Bordetella pertussis
cuggucgagcgggcgc

SEQ ID NO: 2462614 - RNA, 18 nt, Bordetella pertussis
cuggucgagcgggcgcca

SEQ ID NO: 2462615 - RNA, 19 nt, Bordetella pertussis
cuggucgagcgggcgccag

SEQ ID NO: 2462616 - RNA, 20 nt, Bordetella pertussis
cuggucgagcgggcgccaga

SEQ ID NO: 2462617 - RNA, 20 nt, Bordetella pertussis
cuggucgcacaucaggucga

SEQ ID NO: 2462618 - RNA, 17 nt, Bordetella pertussis
cuggucgcacgacagca

SEQ ID NO: 2462619 - RNA, 23 nt, Bordetella pertussis
cuggucgccaucugcugcgagac

SEQ ID NO: 2462620 - RNA, 19 nt, Bordetella pertussis
cuggucgccgucaggauca

SEQ ID NO: 2462621 - RNA, 13 nt, Bordetella pertussis
cuggucgcgcacc

SEQ ID NO: 2462622 - RNA, 17 nt, Bordetella pertussis
cuggucgcgcaccuguu

SEQ ID NO: 2462623 - RNA, 23 nt, Bordetella pertussis
cuggucgcgcaccuguucggcgg

SEQ ID NO: 2462624 - RNA, 14 nt, Bordetella pertussis
cuggucgcgcagca

SEQ ID NO: 2462625 - RNA, 17 nt, Bordetella pertussis
cuggucgcgcgccugca

SEQ ID NO: 2462626 - RNA, 16 nt, Bordetella pertussis
cuggucgcgggccagg

SEQ ID NO: 2462627 - RNA, 20 nt, Bordetella pertussis
cuggucgcgggccaggccgg

SEQ ID NO: 2462628 - RNA, 13 nt, Bordetella pertussis
cuggucgcuggcg

SEQ ID NO: 2462629 - RNA, 15 nt, Bordetella pertussis
cuggucgcuggcgcc

SEQ ID NO: 2462630 - RNA, 18 nt, Bordetella pertussis
cuggucgcuggcgccggu

SEQ ID NO: 2462631 - RNA, 12 nt, Bordetella pertussis
cuggucggccuc

SEQ ID NO: 2462632 - RNA, 18 nt, Bordetella pertussis
cuggucggccucguagug

SEQ ID NO: 2462633 - RNA, 15 nt, Bordetella pertussis
cuggucggcgcggca

SEQ ID NO: 2462634 - RNA, 18 nt, Bordetella pertussis
cuggucgggaugccccgc

SEQ ID NO: 2462635 - RNA, 23 nt, Bordetella pertussis
cuggucggggucggccaccacca

SEQ ID NO: 2462636 - RNA, 22 nt, Bordetella pertussis
cuggucgucgcggcccugggcc

SEQ ID NO: 2462637 - RNA, 19 nt, Bordetella pertussis
cuggucuucgagcgcgagc

SEQ ID NO: 2462638 - RNA, 19 nt, Bordetella pertussis
cuggugaaacagcaucagc

SEQ ID NO: 2462639 - RNA, 22 nt, Bordetella pertussis
cuggugaccgcguaggccuuca

SEQ ID NO: 2462640 - RNA, 19 nt, Bordetella pertussis
cuccgauagcggcgccgcu

SEQ ID NO: 2462641 - RNA, 22 nt, Bordetella pertussis
cuccgauagcggcgccgcuucc

SEQ ID NO: 2462642 - RNA, 21 nt, Bordetella pertussis
cuccgccauggaggcgcagcg

SEQ ID NO: 2462643 - RNA, 14 nt, Bordetella pertussis
cuccgcgccgacca

SEQ ID NO: 2462644 - RNA, 17 nt, Bordetella pertussis
cuccgcgccgaccacgc

SEQ ID NO: 2462645 - RNA, 21 nt, Bordetella pertussis
cuccgcguugcgcugcccguc

SEQ ID NO: 2462646 - RNA, 18 nt, Bordetella pertussis
cuccgcuaucauccgcgc

SEQ ID NO: 2462647 - RNA, 19 nt, Bordetella pertussis
cuccgcuaucauccgcgca

SEQ ID NO: 2462648 - RNA, 18 nt, Bordetella pertussis
cuccggauaccgccgccg

SEQ ID NO: 2462649 - RNA, 19 nt, Bordetella pertussis
cuccggauaccgccgccgc

SEQ ID NO: 2462650 - RNA, 14 nt, Bordetella pertussis
cuccggccgggcca

SEQ ID NO: 2462651 - RNA, 17 nt, Bordetella pertussis
cuccggccgggccagcg

SEQ ID NO: 2462652 - RNA, 11 nt, Bordetella pertussis
cuccggcgcca

SEQ ID NO: 2462653 - RNA, 19 nt, Bordetella pertussis
cuccggcgccagcaugcgc

SEQ ID NO: 2462654 - RNA, 16 nt, Bordetella pertussis
cuccggcgccuggccg

SEQ ID NO: 2462655 - RNA, 19 nt, Bordetella pertussis
cuccggcgugauggacgcc

SEQ ID NO: 2462656 - RNA, 17 nt, Bordetella pertussis
cuccggcugcgcgcgca

SEQ ID NO: 2462657 - RNA, 18 nt, Bordetella pertussis
cuccggcugcgcgcgcag

SEQ ID NO: 2462658 - RNA, 14 nt, Bordetella pertussis
cuccgggucgcggc

SEQ ID NO: 2462659 - RNA, 17 nt, Bordetella pertussis
cuccgguacgccugcac

SEQ ID NO: 2462660 - RNA, 18 nt, Bordetella pertussis
cuccgguacgccugcacc

SEQ ID NO: 2462661 - RNA, 21 nt, Bordetella pertussis
cuccgguacgccugcaccgcc

SEQ ID NO: 2462662 - RNA, 16 nt, Bordetella pertussis
cuccgguucggcgcgg

SEQ ID NO: 2462663 - RNA, 17 nt, Bordetella pertussis
cuccgguucggcgcggc

SEQ ID NO: 2462664 - RNA, 17 nt, Bordetella pertussis
cuccguauccuggucga

SEQ ID NO: 2462665 - RNA, 16 nt, Bordetella pertussis
cuccgucauggcgccg

SEQ ID NO: 2462666 - RNA, 13 nt, Bordetella pertussis
cuccucgacgucg

SEQ ID NO: 2462667 - RNA, 14 nt, Bordetella pertussis
cuccucgacgucgc

SEQ ID NO: 2462668 - RNA, 16 nt, Bordetella pertussis
cuccucgacgucgccc

SEQ ID NO: 2462669 - RNA, 18 nt, Bordetella pertussis
cuccucgacgucgcccaa

SEQ ID NO: 2462670 - RNA, 14 nt, Bordetella pertussis
cuccucgagcgugg

SEQ ID NO: 2462671 - RNA, 17 nt, Bordetella pertussis
cuccucgcgcgcggacu

SEQ ID NO: 2462672 - RNA, 20 nt, Bordetella pertussis
cuccucgcgcgcggacugcc

SEQ ID NO: 2462673 - RNA, 19 nt, Bordetella pertussis
cuccucggccaggucgcgc

SEQ ID NO: 2462674 - RNA, 19 nt, Bordetella pertussis
cuccucggccugccggcgc

SEQ ID NO: 2462675 - RNA, 21 nt, Bordetella pertussis
cuccucggccugccggcgcgc

SEQ ID NO: 2462676 - RNA, 16 nt, Bordetella pertussis
cuccugcagcaggucg

SEQ ID NO: 2462677 - RNA, 16 nt, Bordetella pertussis
cuccugccaggcgccg

SEQ ID NO: 2462678 - RNA, 13 nt, Bordetella pertussis
cuccugccggcgg

SEQ ID NO: 2462679 - RNA, 14 nt, Bordetella pertussis
cuccugccggcgga

SEQ ID NO: 2462680 - RNA, 16 nt, Bordetella pertussis
cuccugguugaccgag

SEQ ID NO: 2462681 - RNA, 22 nt, Bordetella pertussis
cuccugguugaccgagcccggc

SEQ ID NO: 2462682 - RNA, 23 nt, Bordetella pertussis
cuccugguugaccgagcccggca

SEQ ID NO: 2462683 - RNA, 19 nt, Bordetella pertussis
cuccugugggggcgcggcg

SEQ ID NO: 2462684 - RNA, 15 nt, Bordetella pertussis
cuccuugacgcgcgc

SEQ ID NO: 2462685 - RNA, 16 nt, Bordetella pertussis
cuccuugacgcgcgcg

SEQ ID NO: 2462686 - RNA, 14 nt, Bordetella pertussis
cuccuugagcacgu

SEQ ID NO: 2462687 - RNA, 22 nt, Bordetella pertussis
cuccuugagcacguccagcggc

SEQ ID NO: 2462688 - RNA, 14 nt, Bordetella pertussis
cucgaacacgccga

SEQ ID NO: 2462689 - RNA, 19 nt, Bordetella pertussis
cucgaacaggccaucgccg

SEQ ID NO: 2462690 - RNA, 20 nt, Bordetella pertussis
cucgaagaagcagccgcgcu

SEQ ID NO: 2462691 - RNA, 22 nt, Bordetella pertussis
cucgaagaccucggcgcucagg

SEQ ID NO: 2462692 - RNA, 14 nt, Bordetella pertussis
cucgaagaucucga

SEQ ID NO: 2462693 - RNA, 14 nt, Bordetella pertussis
cucgaagcccggca

SEQ ID NO: 2462694 - RNA, 16 nt, Bordetella pertussis
cucgaagcccggcagg

SEQ ID NO: 2462695 - RNA, 17 nt, Bordetella pertussis
cucgaagcggcucaggc

SEQ ID NO: 2462696 - RNA, 19 nt, Bordetella pertussis
cucgaaggcgccgacggcg

SEQ ID NO: 2462697 - RNA, 20 nt, Bordetella pertussis
cucgaaggcgccgacggcgc

SEQ ID NO: 2462698 - RNA, 21 nt, Bordetella pertussis
cucgaauggcugcgcgccgug

SEQ ID NO: 2462699 - RNA, 15 nt, Bordetella pertussis
cucgacagcagcccg

SEQ ID NO: 2462700 - RNA, 23 nt, Bordetella pertussis
cucgacauagagauuguccagcg

SEQ ID NO: 2462701 - RNA, 15 nt, Bordetella pertussis
cucgaccacggcggc

SEQ ID NO: 2462702 - RNA, 16 nt, Bordetella pertussis
cucgaccagcccggcc

SEQ ID NO: 2462703 - RNA, 13 nt, Bordetella pertussis
cucgaccagcgcg

SEQ ID NO: 2462704 - RNA, 13 nt, Bordetella pertussis
cucgaccaggcgg

SEQ ID NO: 2462705 - RNA, 17 nt, Bordetella pertussis
cucgaccaucauggcca

SEQ ID NO: 2462706 - RNA, 18 nt, Bordetella pertussis
cucgaccaucauggccag

SEQ ID NO: 2462707 - RNA, 23 nt, Bordetella pertussis
cucgacccgaaggcgcggccggg

SEQ ID NO: 2462708 - RNA, 13 nt, Bordetella pertussis
cucgacccgcgcc

SEQ ID NO: 2462709 - RNA, 17 nt, Bordetella pertussis
cucgacccgcucggcca

SEQ ID NO: 2462710 - RNA, 19 nt, Bordetella pertussis
cucgacccgcucggccacg

SEQ ID NO: 2462711 - RNA, 13 nt, Bordetella pertussis
cucgaccgccgcc

SEQ ID NO: 2462712 - RNA, 15 nt, Bordetella pertussis
cucgaccgccgccac

SEQ ID NO: 2462713 - RNA, 18 nt, Bordetella pertussis
cucgaccgccgggacagg

SEQ ID NO: 2462714 - RNA, 20 nt, Bordetella pertussis
cucgaccgccgggacaggca

SEQ ID NO: 2462715 - RNA, 16 nt, Bordetella pertussis
cucgaccugggucgga

SEQ ID NO: 2462716 - RNA, 19 nt, Bordetella pertussis
cucgaccugggucggaaac

SEQ ID NO: 2462717 - RNA, 19 nt, Bordetella pertussis
cucgaccuugucgcccgau

SEQ ID NO: 2462718 - RNA, 18 nt, Bordetella pertussis
cucgacgaacacgcgcgc

SEQ ID NO: 2462719 - RNA, 20 nt, Bordetella pertussis
cucgacgaacacgcgcgccg

SEQ ID NO: 2462720 - RNA, 19 nt, Bordetella pertussis
cucgacgaagcccgugucg

SEQ ID NO: 2462721 - RNA, 14 nt, Bordetella pertussis
cucgacgaugcccu

SEQ ID NO: 2462722 - RNA, 14 nt, Bordetella pertussis
cucgacgauggccg

SEQ ID NO: 2462723 - RNA, 14 nt, Bordetella pertussis
cucgacgauggcgg

SEQ ID NO: 2462724 - RNA, 13 nt, Bordetella pertussis
cucgacgcagccu

SEQ ID NO: 2462725 - RNA, 15 nt, Bordetella pertussis
cucgacgcccgggcg

SEQ ID NO: 2462726 - RNA, 16 nt, Bordetella pertussis
cucgacgcccgggcgg

SEQ ID NO: 2462727 - RNA, 19 nt, Bordetella pertussis
cucgacgccguacugggca

SEQ ID NO: 2462728 - RNA, 22 nt, Bordetella pertussis
cucgacgcgcauuucgaccugc

SEQ ID NO: 2462729 - RNA, 14 nt, Bordetella pertussis
cucgacggccgccg

SEQ ID NO: 2462730 - RNA, 14 nt, Bordetella pertussis
cucgacggcgcgcg

SEQ ID NO: 2462731 - RNA, 19 nt, Bordetella pertussis
cucgacguaagugcccagg

SEQ ID NO: 2462732 - RNA, 16 nt, Bordetella pertussis
cucgacgucgcccugg

SEQ ID NO: 2462733 - RNA, 19 nt, Bordetella pertussis
cucgagcaagggccagaca

SEQ ID NO: 2462734 - RNA, 15 nt, Bordetella pertussis
cucgagcaccuugac

SEQ ID NO: 2462735 - RNA, 22 nt, Bordetella pertussis
cucgagcaccuugacggucacg

SEQ ID NO: 2462736 - RNA, 19 nt, Bordetella pertussis
cucgagcgcggcgcgcgcg

SEQ ID NO: 2462737 - RNA, 20 nt, Bordetella pertussis
cucgagcggcagcagcgaga

SEQ ID NO: 2462738 - RNA, 13 nt, Bordetella pertussis
cucgagcggcgga

SEQ ID NO: 2462739 - RNA, 14 nt, Bordetella pertussis
cucgaggaaccagc

SEQ ID NO: 2462740 - RNA, 21 nt, Bordetella pertussis
cucgaggcgcuggcguccagc

SEQ ID NO: 2462741 - RNA, 20 nt, Bordetella pertussis
cucgaguuugcgguccaugu

SEQ ID NO: 2462742 - RNA, 18 nt, Bordetella pertussis
cucgauaugcagcaccgg

SEQ ID NO: 2462743 - RNA, 19 nt, Bordetella pertussis
cucgauaugcagcaccgga

SEQ ID NO: 2462744 - RNA, 18 nt, Bordetella pertussis
cucgaucaccaccggcaa

SEQ ID NO: 2462745 - RNA, 16 nt, Bordetella pertussis
cucgauccgggccugg

SEQ ID NO: 2462746 - RNA, 24 nt, Bordetella pertussis
cucgaucgccaggucggccagccg

SEQ ID NO: 2462747 - RNA, 18 nt, Bordetella pertussis
cucgaucgccaugacgcu

SEQ ID NO: 2462748 - RNA, 13 nt, Bordetella pertussis
cucgaucgccgcc

SEQ ID NO: 2462749 - RNA, 20 nt, Bordetella pertussis
cucgaucuucucgacggcgc

SEQ ID NO: 2462750 - RNA, 16 nt, Bordetella pertussis
cucgaugaccagcagc

SEQ ID NO: 2462751 - RNA, 21 nt, Bordetella pertussis
cucgaugcaauagcgcccgcc

SEQ ID NO: 2462752 - RNA, 16 nt, Bordetella pertussis
cucgaugcccagcacc

SEQ ID NO: 2462753 - RNA, 19 nt, Bordetella pertussis
cucgaugcccagcaccgcc

SEQ ID NO: 2462754 - RNA, 23 nt, Bordetella pertussis
cucgaugcccagcaccgccaccg

SEQ ID NO: 2462755 - RNA, 21 nt, Bordetella pertussis
cuguccugauucacaggcccg

SEQ ID NO: 2462756 - RNA, 17 nt, Bordetella pertussis
cuguccuucguggcgcc

SEQ ID NO: 2462757 - RNA, 16 nt, Bordetella pertussis
cugucgcaggcgcugc

SEQ ID NO: 2462758 - RNA, 21 nt, Bordetella pertussis
cuggcucuccgugcaucggca

SEQ ID NO: 2462759 - RNA, 17 nt, Bordetella pertussis
cuggcucugaucgcgcu

SEQ ID NO: 2462760 - RNA, 21 nt, Bordetella pertussis
cuggcugacgauguucaggcc

SEQ ID NO: 2462761 - RNA, 14 nt, Bordetella pertussis
cuggcugagcaggc

SEQ ID NO: 2462762 - RNA, 17 nt, Bordetella pertussis
cuggcugagcaggccga

SEQ ID NO: 2462763 - RNA, 18 nt, Bordetella pertussis
cuggcugagcaggccgau

SEQ ID NO: 2462764 - RNA, 22 nt, Bordetella pertussis
cuggcugagcgacaugucgccg

SEQ ID NO: 2462765 - RNA, 20 nt, Bordetella pertussis
cuggcugaucacagccgcca

SEQ ID NO: 2462766 - RNA, 14 nt, Bordetella pertussis
cuggcugcccuggc

SEQ ID NO: 2462767 - RNA, 13 nt, Bordetella pertussis
cuggcugcgcgcc

SEQ ID NO: 2462768 - RNA, 14 nt, Bordetella pertussis
cuggcugcgcgccu

SEQ ID NO: 2462769 - RNA, 18 nt, Bordetella pertussis
cuggcuggccagccggcc

SEQ ID NO: 2462770 - RNA, 20 nt, Bordetella pertussis
cuggcuggccagccggccca

SEQ ID NO: 2462771 - RNA, 22 nt, Bordetella pertussis
cuggcuggccagccggcccagc

SEQ ID NO: 2462772 - RNA, 16 nt, Bordetella pertussis
cuggcugggccugcug

SEQ ID NO: 2462773 - RNA, 22 nt, Bordetella pertussis
cuggcugggccugcugucgcug

SEQ ID NO: 2462774 - RNA, 15 nt, Bordetella pertussis
cuggcugggcgcgcc

SEQ ID NO: 2462775 - RNA, 18 nt, Bordetella pertussis
cuggcugggcgcgccgcu

SEQ ID NO: 2462776 - RNA, 18 nt, Bordetella pertussis
cuggcugugcccgcccca

SEQ ID NO: 2462777 - RNA, 20 nt, Bordetella pertussis
cuggcugugcccgccccauu

SEQ ID NO: 2462778 - RNA, 17 nt, Bordetella pertussis
cuggcuguucgccaugu

SEQ ID NO: 2462779 - RNA, 16 nt, Bordetella pertussis
cuggcuucccggucca

SEQ ID NO: 2462780 - RNA, 19 nt, Bordetella pertussis
cuggcuucccgguccaggc

SEQ ID NO: 2462781 - RNA, 20 nt, Bordetella pertussis
cuggcuucccgguccaggcc

SEQ ID NO: 2462782 - RNA, 18 nt, Bordetella pertussis
cuggcuucggcgcugggc

SEQ ID NO: 2462783 - RNA, 15 nt, Bordetella pertussis
cuggcuucgucgccg

SEQ ID NO: 2462784 - RNA, 19 nt, Bordetella pertussis
cuggcuugcgccacgcccg

SEQ ID NO: 2462785 - RNA, 22 nt, Bordetella pertussis
cuggcuugcgccacgcccgucc

SEQ ID NO: 2462786 - RNA, 20 nt, Bordetella pertussis
cuggcuuucgccgcgggccu

SEQ ID NO: 2462787 - RNA, 22 nt, Bordetella pertussis
cugggacaggcacaccgugccg

SEQ ID NO: 2462788 - RNA, 22 nt, Bordetella pertussis
cugggacaggcacaccguggca

SEQ ID NO: 2462789 - RNA, 16 nt, Bordetella pertussis
cugggacaggcacauu

SEQ ID NO: 2462790 - RNA, 15 nt, Bordetella pertussis
cugggacaggcacuc

SEQ ID NO: 2462791 - RNA, 18 nt, Bordetella pertussis
cugggagagccggccacg

SEQ ID NO: 2462792 - RNA, 19 nt, Bordetella pertussis
cugggaggcgugcugcacc

SEQ ID NO: 2462793 - RNA, 23 nt, Bordetella pertussis
cugggauggguacgccggccuga

SEQ ID NO: 2462794 - RNA, 17 nt, Bordetella pertussis
cugggcaaccgccacgu

SEQ ID NO: 2462795 - RNA, 19 nt, Bordetella pertussis
cugggcacauccagcgcca

SEQ ID NO: 2462796 - RNA, 16 nt, Bordetella pertussis
cugggcaugggcggcc

SEQ ID NO: 2462797 - RNA, 23 nt, Bordetella pertussis
cugggccaaccacgagcugcagc

SEQ ID NO: 2462798 - RNA, 13 nt, Bordetella pertussis
cugggccacaggg

SEQ ID NO: 2462799 - RNA, 16 nt, Bordetella pertussis
cugggccagaccgcgc

SEQ ID NO: 2462800 - RNA, 20 nt, Bordetella pertussis
cugggccagcagcuggcgca

SEQ ID NO: 2462801 - RNA, 16 nt, Bordetella pertussis
cugggccagcaggcuc

SEQ ID NO: 2462802 - RNA, 23 nt, Bordetella pertussis
cugggccagcaucggcacccagc

SEQ ID NO: 2462803 - RNA, 24 nt, Bordetella pertussis
cugggccagcaucggcacccagcc

SEQ ID NO: 2462804 - RNA, 12 nt, Bordetella pertussis
cugggccagcca

SEQ ID NO: 2462805 - RNA, 13 nt, Bordetella pertussis
cugggccagccag

SEQ ID NO: 2462806 - RNA, 14 nt, Bordetella pertussis
cugggccagccagc

SEQ ID NO: 2462807 - RNA, 13 nt, Bordetella pertussis
cugggccaggccg

SEQ ID NO: 2462808 - RNA, 14 nt, Bordetella pertussis
cugggccaggccgg

SEQ ID NO: 2462809 - RNA, 20 nt, Bordetella pertussis
cugggccaguucggcuugca

SEQ ID NO: 2462810 - RNA, 23 nt, Bordetella pertussis
cugggccaucagguuguccagcg

SEQ ID NO: 2462811 - RNA, 18 nt, Bordetella pertussis
cugggccaugccguccug

SEQ ID NO: 2462812 - RNA, 15 nt, Bordetella pertussis
cugggccaugcguau

SEQ ID NO: 2462813 - RNA, 15 nt, Bordetella pertussis
cugggccauggccuc

SEQ ID NO: 2462814 - RNA, 17 nt, Bordetella pertussis
cugggccauggccucgu

SEQ ID NO: 2462815 - RNA, 16 nt, Bordetella pertussis
cugggccgagcgcgcc

SEQ ID NO: 2462816 - RNA, 17 nt, Bordetella pertussis
cugggccgagcgcgcca

SEQ ID NO: 2462817 - RNA, 14 nt, Bordetella pertussis
cugggccgaggcgc

SEQ ID NO: 2462818 - RNA, 19 nt, Bordetella pertussis
cugggccgaggcgccgccg

SEQ ID NO: 2462819 - RNA, 18 nt, Bordetella pertussis
cugggccgaguuggcaga

SEQ ID NO: 2462820 - RNA, 19 nt, Bordetella pertussis
cugggccgaguuggcagag

SEQ ID NO: 2462821 - RNA, 19 nt, Bordetella pertussis
cugggccgccugcugggcc

SEQ ID NO: 2462822 - RNA, 17 nt, Bordetella pertussis
cugggccggcgcgcgca

SEQ ID NO: 2462823 - RNA, 16 nt, Bordetella pertussis
cugggccucggccagc

SEQ ID NO: 2462824 - RNA, 17 nt, Bordetella pertussis
cugggccucggccagcu

SEQ ID NO: 2462825 - RNA, 19 nt, Bordetella pertussis
cugggccucggccagcugg

SEQ ID NO: 2462826 - RNA, 23 nt, Bordetella pertussis
cugggccucggccagcugggcca

SEQ ID NO: 2462827 - RNA, 17 nt, Bordetella pertussis
cugggccugcugucgcu

SEQ ID NO: 2462828 - RNA, 19 nt, Bordetella pertussis
cugggccugcugucgcugg

SEQ ID NO: 2462829 - RNA, 19 nt, Bordetella pertussis
cugggccugguacaggccg

SEQ ID NO: 2462830 - RNA, 16 nt, Bordetella pertussis
cugggccuucuugucg

SEQ ID NO: 2462831 - RNA, 18 nt, Bordetella pertussis
cugggccuucuugucgcu

SEQ ID NO: 2462832 - RNA, 22 nt, Bordetella pertussis
cugggccuucuugucgcuggag

SEQ ID NO: 2462833 - RNA, 19 nt, Bordetella pertussis
cugggcgaaacggccagcg

SEQ ID NO: 2462834 - RNA, 16 nt, Bordetella pertussis
cugggcgaggcgcugg

SEQ ID NO: 2462835 - RNA, 13 nt, Bordetella pertussis
cugggcgccagca

SEQ ID NO: 2462836 - RNA, 16 nt, Bordetella pertussis
cugggcgccagcagca

SEQ ID NO: 2462837 - RNA, 22 nt, Bordetella pertussis
cugggcgccagcagcacgucgu

SEQ ID NO: 2462838 - RNA, 23 nt, Bordetella pertussis
cugggcgccaugcgcccggccac

SEQ ID NO: 2462839 - RNA, 20 nt, Bordetella pertussis
cugggcgccuacacgguggc

SEQ ID NO: 2462840 - RNA, 14 nt, Bordetella pertussis
cugggcgccuggcu

SEQ ID NO: 2462841 - RNA, 17 nt, Bordetella pertussis
cugggcgccuggcugca

SEQ ID NO: 2462842 - RNA, 19 nt, Bordetella pertussis
cugggcgccuggcugcaag

SEQ ID NO: 2462843 - RNA, 20 nt, Bordetella pertussis
cugggcgcgaugggccugcc

SEQ ID NO: 2462844 - RNA, 21 nt, Bordetella pertussis
cugggcgcgcacaagcgcgaa

SEQ ID NO: 2462845 - RNA, 16 nt, Bordetella pertussis
cugggcgcgccgcugc

SEQ ID NO: 2462846 - RNA, 17 nt, Bordetella pertussis
cugggcgcgcgcccagg

SEQ ID NO: 2462847 - RNA, 14 nt, Bordetella pertussis
cugggcgcggaaca

SEQ ID NO: 2462848 - RNA, 16 nt, Bordetella pertussis
cugggcgcggaacagc

SEQ ID NO: 2462849 - RNA, 18 nt, Bordetella pertussis
cugggcgcgucguacugg

SEQ ID NO: 2462850 - RNA, 14 nt, Bordetella pertussis
cugggcgcugcugc

SEQ ID NO: 2462851 - RNA, 15 nt, Bordetella pertussis
cugggcgcugcugcu

SEQ ID NO: 2462852 - RNA, 19 nt, Bordetella pertussis
cugggcggauuggacagca

SEQ ID NO: 2462853 - RNA, 14 nt, Bordetella pertussis
cugggcggccaggc

SEQ ID NO: 2462854 - RNA, 16 nt, Bordetella pertussis
cugggcggccaggcgg

SEQ ID NO: 2462855 - RNA, 17 nt, Bordetella pertussis
cugggcggccaggcgga

SEQ ID NO: 2462856 - RNA, 14 nt, Bordetella pertussis
cugggcggccuugg

SEQ ID NO: 2462857 - RNA, 19 nt, Bordetella pertussis
cugggcggccuuggccgca

SEQ ID NO: 2462858 - RNA, 12 nt, Bordetella pertussis
cugggcggcgca

SEQ ID NO: 2462859 - RNA, 14 nt, Bordetella pertussis
cugggcggcgcgcu

SEQ ID NO: 2462860 - RNA, 21 nt, Bordetella pertussis
cugggcggcggcgaugccgcu

SEQ ID NO: 2462861 - RNA, 23 nt, Bordetella pertussis
cugggcggcggcgaugccgcugg

SEQ ID NO: 2462862 - RNA, 14 nt, Bordetella pertussis
cugggcggcgggca

SEQ ID NO: 2462863 - RNA, 14 nt, Bordetella pertussis
cugggcggcgugac

SEQ ID NO: 2462864 - RNA, 15 nt, Bordetella pertussis
cugggcggcgugacc

SEQ ID NO: 2462865 - RNA, 21 nt, Bordetella pertussis
cugggcggcgugaccgcgacg

SEQ ID NO: 2462866 - RNA, 13 nt, Bordetella pertussis
cugggcgggccgu

SEQ ID NO: 2462867 - RNA, 15 nt, Bordetella pertussis
cugggcgggccguug

SEQ ID NO: 2462868 - RNA, 17 nt, Bordetella pertussis
cugggcgggcugguggu

SEQ ID NO: 2462869 - RNA, 15 nt, Bordetella pertussis
cugggcgguugcgcu

SEQ ID NO: 2462870 - RNA, 17 nt, Bordetella pertussis
cugggcgguugcgcugc

SEQ ID NO: 2462871 - RNA, 21 nt, Bordetella pertussis
cugggcgguugcgcugcuguc

SEQ ID NO: 2462872 - RNA, 17 nt, Bordetella pertussis
cugggcgucccaggcca

SEQ ID NO: 2462873 - RNA, 22 nt, Bordetella pertussis
cuugccgauccagcgccugggg

SEQ ID NO: 2462874 - RNA, 21 nt, Bordetella pertussis
cuugccgaugcggcgcaugcu

SEQ ID NO: 2462875 - RNA, 17 nt, Bordetella pertussis
cuugccgcagcggccau

SEQ ID NO: 2462876 - RNA, 16 nt, Bordetella pertussis
cuugccgcagcgggga

SEQ ID NO: 2462877 - RNA, 18 nt, Bordetella pertussis
cuugccgcagcggggaca

SEQ ID NO: 2462878 - RNA, 19 nt, Bordetella pertussis
cuugccgcagcggggacag

SEQ ID NO: 2462879 - RNA, 20 nt, Bordetella pertussis
cuugccgcagcggggacagg

SEQ ID NO: 2462880 - RNA, 22 nt, Bordetella pertussis
cuugccgcccacugccaggcga

SEQ ID NO: 2462881 - RNA, 13 nt, Bordetella pertussis
cuugccgcccagg

SEQ ID NO: 2462882 - RNA, 17 nt, Bordetella pertussis
cuugccgcccaggucgg

SEQ ID NO: 2462883 - RNA, 17 nt, Bordetella pertussis
cuugccgccgccgcgcg

SEQ ID NO: 2462884 - RNA, 19 nt, Bordetella pertussis
cuugccgccgccgcgcgcg

SEQ ID NO: 2462885 - RNA, 13 nt, Bordetella pertussis
cuugccgccgcgc

SEQ ID NO: 2462886 - RNA, 15 nt, Bordetella pertussis
cuugccgccgcgcag

SEQ ID NO: 2462887 - RNA, 17 nt, Bordetella pertussis
cuugccgccgcgcagga

SEQ ID NO: 2462888 - RNA, 22 nt, Bordetella pertussis
gaaacgcucgaugcgccagucc

SEQ ID NO: 2462889 - RNA, 23 nt, Bordetella pertussis
gaaacgcuggacaugggcaagcc

SEQ ID NO: 2462890 - RNA, 14 nt, Bordetella pertussis
gaaacggccaagca

SEQ ID NO: 2462891 - RNA, 22 nt, Bordetella pertussis
gaaacggccaagcagcgccugc

SEQ ID NO: 2462892 - RNA, 21 nt, Bordetella pertussis
gaaacggcgggcgcgcaggcc

SEQ ID NO: 2462893 - RNA, 18 nt, Bordetella pertussis
gaaacgggcggcgucgcc

SEQ ID NO: 2462894 - RNA, 14 nt, Bordetella pertussis
gaaacucaccgccg

SEQ ID NO: 2462895 - RNA, 20 nt, Bordetella pertussis
gaaacucaccgccgcccgca

SEQ ID NO: 2462896 - RNA, 23 nt, Bordetella pertussis
gaaacucaccgccgcccgcaggc

SEQ ID NO: 2462897 - RNA, 14 nt, Bordetella pertussis
gaaacuggcgcugc

SEQ ID NO: 2462898 - RNA, 15 nt, Bordetella pertussis
gaaagaagcccccgc

SEQ ID NO: 2462899 - RNA, 19 nt, Bordetella pertussis
gaaagaagcccccgcgcug

SEQ ID NO: 2462900 - RNA, 13 nt, Bordetella pertussis
gaaagaggccagg

SEQ ID NO: 2462901 - RNA, 14 nt, Bordetella pertussis
gaaagaggccaggc

SEQ ID NO: 2462902 - RNA, 12 nt, Bordetella pertussis
gaaagcacgcca

SEQ ID NO: 2462903 - RNA, 22 nt, Bordetella pertussis
gaaagcacggcgaugcugccgu

SEQ ID NO: 2462904 - RNA, 13 nt, Bordetella pertussis
gaaagccagcgcc

SEQ ID NO: 2462905 - RNA, 18 nt, Bordetella pertussis
gaaagcccggccccaggc

SEQ ID NO: 2462906 - RNA, 19 nt, Bordetella pertussis
gaaagcccggccccaggcc

SEQ ID NO: 2462907 - RNA, 19 nt, Bordetella pertussis
gaaagccgccggcgcgcgg

SEQ ID NO: 2462908 - RNA, 24 nt, Bordetella pertussis
gaaagccggcgucaaaccaagcag

SEQ ID NO: 2462909 - RNA, 15 nt, Bordetella pertussis
gaaagcgcggccggg

SEQ ID NO: 2462910 - RNA, 17 nt, Bordetella pertussis
gaaagcgcgucgagcag

SEQ ID NO: 2462911 - RNA, 18 nt, Bordetella pertussis
gaaagcgcgucgagcagg

SEQ ID NO: 2462912 - RNA, 20 nt, Bordetella pertussis
gaaagcgcgucgagcaggcc

SEQ ID NO: 2462913 - RNA, 23 nt, Bordetella pertussis
gaaagcggcaaagccgcugcgcu

SEQ ID NO: 2462914 - RNA, 21 nt, Bordetella pertussis
gaaagcggcgugugcccagca

SEQ ID NO: 2462915 - RNA, 14 nt, Bordetella pertussis
gaaaggggcugccg

SEQ ID NO: 2462916 - RNA, 19 nt, Bordetella pertussis
gaaaguccgauguuacaga

SEQ ID NO: 2462917 - RNA, 15 nt, Bordetella pertussis
gaaauacgcgcgcgc

SEQ ID NO: 2462918 - RNA, 15 nt, Bordetella pertussis
gaaauagcccgcggc

SEQ ID NO: 2462919 - RNA, 23 nt, Bordetella pertussis
gaaauaggaucccggcgccagcc

SEQ ID NO: 2462920 - RNA, 15 nt, Bordetella pertussis
gaaauccagcgcgcc

SEQ ID NO: 2462921 - RNA, 17 nt, Bordetella pertussis
gaaauccagcgcgccca

SEQ ID NO: 2462922 - RNA, 16 nt, Bordetella pertussis
gaaaucccccgcgucg

SEQ ID NO: 2462923 - RNA, 19 nt, Bordetella pertussis
gaaauccguaguccagcag

SEQ ID NO: 2462924 - RNA, 20 nt, Bordetella pertussis
gaaauccguaguccagcagc

SEQ ID NO: 2462925 - RNA, 14 nt, Bordetella pertussis
gaaaucgugcuaga

SEQ ID NO: 2462926 - RNA, 20 nt, Bordetella pertussis
gaaaucuucugcgccacggc

SEQ ID NO: 2462927 - RNA, 18 nt, Bordetella pertussis
gaaaugccgaagcgcgcg

SEQ ID NO: 2462928 - RNA, 19 nt, Bordetella pertussis
gaaaugccgaagcgcgcgu

SEQ ID NO: 2462929 - RNA, 21 nt, Bordetella pertussis
gaaaugccgaagcgcgcgugc

SEQ ID NO: 2462930 - RNA, 14 nt, Bordetella pertussis
gaaaugccgcagca

SEQ ID NO: 2462931 - RNA, 17 nt, Bordetella pertussis
gaaaugccgcgcgcagg

SEQ ID NO: 2462932 - RNA, 20 nt, Bordetella pertussis
gaaaugccgcgcgcagggcg

SEQ ID NO: 2462933 - RNA, 14 nt, Bordetella pertussis
gaaaugccggcggc

SEQ ID NO: 2462934 - RNA, 15 nt, Bordetella pertussis
gaaaugccggcggcg

SEQ ID NO: 2462935 - RNA, 20 nt, Bordetella pertussis
gaaaugcguggcgugccgca

SEQ ID NO: 2462936 - RNA, 17 nt, Bordetella pertussis
gaaauggaugcgcgccc

SEQ ID NO: 2462937 - RNA, 14 nt, Bordetella pertussis
gaaauggcggcggu

SEQ ID NO: 2462938 - RNA, 21 nt, Bordetella pertussis
gaaauggcggcgguagcgcuc

SEQ ID NO: 2462939 - RNA, 13 nt, Bordetella pertussis
gaaauggugcggc

SEQ ID NO: 2462940 - RNA, 19 nt, Bordetella pertussis
gaaaugucgagcgcgaugc

SEQ ID NO: 2462941 - RNA, 16 nt, Bordetella pertussis
gaaauugacggcgcuc

SEQ ID NO: 2462942 - RNA, 23 nt, Bordetella pertussis
gaaauugacggcgcucuuggugg

SEQ ID NO: 2462943 - RNA, 23 nt, Bordetella pertussis
gaaauugggcguggcgguacggu

SEQ ID NO: 2462944 - RNA, 23 nt, Bordetella pertussis
gaacaaaccgucgaugaccagcg

SEQ ID NO: 2462945 - RNA, 17 nt, Bordetella pertussis
gaacaacagcgccugca

SEQ ID NO: 2462946 - RNA, 16 nt, Bordetella pertussis
gaacaacgggaucggc

SEQ ID NO: 2462947 - RNA, 24 nt, Bordetella pertussis
gaacaagguacccgcgccggcggc

SEQ ID NO: 2462948 - RNA, 23 nt, Bordetella pertussis
gaacaagguccaggcccggcaga

SEQ ID NO: 2462949 - RNA, 20 nt, Bordetella pertussis
gaacaccaccgagggccgga

SEQ ID NO: 2462950 - RNA, 21 nt, Bordetella pertussis
gaacaccaggguggcgccggc

SEQ ID NO: 2462951 - RNA, 22 nt, Bordetella pertussis
gaacaccaggguggcgccggcc

SEQ ID NO: 2462952 - RNA, 14 nt, Bordetella pertussis
gaacaccaugcccg

SEQ ID NO: 2462953 - RNA, 18 nt, Bordetella pertussis
gaacaccgccgcgccgcc

SEQ ID NO: 2462954 - RNA, 23 nt, Bordetella pertussis
gaacaccgccgcgccgcccgcgg

SEQ ID NO: 2462955 - RNA, 15 nt, Bordetella pertussis
gaacaccggcaggcc

SEQ ID NO: 2462956 - RNA, 16 nt, Bordetella pertussis
gaacaccggcaggccg

SEQ ID NO: 2462957 - RNA, 21 nt, Bordetella pertussis
gaacaccggcaggccgcgcug

SEQ ID NO: 2462958 - RNA, 19 nt, Bordetella pertussis
gaacaccggcgcgccuggc

SEQ ID NO: 2462959 - RNA, 20 nt, Bordetella pertussis
gaacaccgugugaucgccga

SEQ ID NO: 2462960 - RNA, 17 nt, Bordetella pertussis
gaacaccguuuccaagc

SEQ ID NO: 2462961 - RNA, 19 nt, Bordetella pertussis
gaacacgaugaagaugccg

SEQ ID NO: 2462962 - RNA, 13 nt, Bordetella pertussis
gaacacgccgacc

SEQ ID NO: 2462963 - RNA, 16 nt, Bordetella pertussis
gaacacgcgcgccgcg

SEQ ID NO: 2462964 - RNA, 18 nt, Bordetella pertussis
gaacagaaggcgugcgug

SEQ ID NO: 2462965 - RNA, 20 nt, Bordetella pertussis
gaacagcaacgccacgcgcg

SEQ ID NO: 2462966 - RNA, 24 nt, Bordetella pertussis
gaacagcagcgugaugcggucggc

SEQ ID NO: 2462967 - RNA, 16 nt, Bordetella pertussis
gaacagcauggcggcg

SEQ ID NO: 2462968 - RNA, 19 nt, Bordetella pertussis
gaacagcauggcggcgccc

SEQ ID NO: 2462969 - RNA, 11 nt, Bordetella pertussis
gaacagccgcc

SEQ ID NO: 2462970 - RNA, 14 nt, Bordetella pertussis
gaacagccgcccca

SEQ ID NO: 2462971 - RNA, 19 nt, Bordetella pertussis
gaacagccgccccagcagc

SEQ ID NO: 2462972 - RNA, 21 nt, Bordetella pertussis
gaacagccgccccagcagcag

SEQ ID NO: 2462973 - RNA, 17 nt, Bordetella pertussis
gaacagccuggucaggu

SEQ ID NO: 2462974 - RNA, 23 nt, Bordetella pertussis
gaacagcgagaagcaaccgauga

SEQ ID NO: 2462975 - RNA, 14 nt, Bordetella pertussis
gaacagcgccaggc

SEQ ID NO: 2462976 - RNA, 14 nt, Bordetella pertussis
gaacagcgccggca

SEQ ID NO: 2462977 - RNA, 17 nt, Bordetella pertussis
gaacagcggaucgccgg

SEQ ID NO: 2462978 - RNA, 17 nt, Bordetella pertussis
gaacagcggcacgccgg

SEQ ID NO: 2462979 - RNA, 19 nt, Bordetella pertussis
gaacagcggcacgccggcg

SEQ ID NO: 2462980 - RNA, 18 nt, Bordetella pertussis
gaacagcguccagccgcc

SEQ ID NO: 2462981 - RNA, 22 nt, Bordetella pertussis
gaacagcucggcccauugcggc

SEQ ID NO: 2462982 - RNA, 14 nt, Bordetella pertussis
gaacagcugcagcg

SEQ ID NO: 2462983 - RNA, 13 nt, Bordetella pertussis
gaacaggaugcgc

SEQ ID NO: 2462984 - RNA, 16 nt, Bordetella pertussis
gaacaggcacaggaac

SEQ ID NO: 2462985 - RNA, 14 nt, Bordetella pertussis
gaacaggcaguggu

SEQ ID NO: 2462986 - RNA, 14 nt, Bordetella pertussis
gaacaggccgccgu

SEQ ID NO: 2462987 - RNA, 17 nt, Bordetella pertussis
gaacaggcgcgccagcc

SEQ ID NO: 2462988 - RNA, 18 nt, Bordetella pertussis
gaacaggcgcgccagccg

SEQ ID NO: 2462989 - RNA, 14 nt, Bordetella pertussis
gaacaggcgcuugc

SEQ ID NO: 2462990 - RNA, 21 nt, Bordetella pertussis
gaacaggcgcuugcgcucggu

SEQ ID NO: 2462991 - RNA, 15 nt, Bordetella pertussis
gaacaggcugcgcag

SEQ ID NO: 2462992 - RNA, 17 nt, Bordetella pertussis
gaacagggugccgcccu

SEQ ID NO: 2462993 - RNA, 20 nt, Bordetella pertussis
gaacagguugaagccgacgg

SEQ ID NO: 2462994 - RNA, 17 nt, Bordetella pertussis
gaacauauccacgccac

SEQ ID NO: 2462995 - RNA, 23 nt, Bordetella pertussis
gaacauauccacgccacuggccu

SEQ ID NO: 2462996 - RNA, 16 nt, Bordetella pertussis
gaacauccugaccggc

SEQ ID NO: 2462997 - RNA, 18 nt, Bordetella pertussis
gaacaugacuucggucag

SEQ ID NO: 2462998 - RNA, 20 nt, Bordetella pertussis
gaacccggccggcgccggca

SEQ ID NO: 2462999 - RNA, 21 nt, Bordetella pertussis
gaacccggccggcgccggcaa

SEQ ID NO: 2463000 - RNA, 18 nt, Bordetella pertussis
gaaccgaaaugccgcagc

SEQ ID NO: 2463001 - RNA, 16 nt, Bordetella pertussis
gaaccgaccgccacga

SEQ ID NO: 2463002 - RNA, 16 nt, Bordetella pertussis
gaaccgcaacgccagc

SEQ ID NO: 2463003 - RNA, 19 nt, Bordetella pertussis
gaaccgcaacgccagcagg

SEQ ID NO: 2463004 - RNA, 23 nt, Bordetella pertussis
gaaccgcagaagcagccgcgcgg

SEQ ID NO: 2463005 - RNA, 18 nt, Bordetella pertussis
gaaccgcagcgccaccgg

SEQ ID NO: 2463006 - RNA, 19 nt, Bordetella pertussis
gaaccgccgcuuucgaccu

SEQ ID NO: 2463007 - RNA, 14 nt, Bordetella pertussis
gaaccgcggcgcag

SEQ ID NO: 2463008 - RNA, 16 nt, Bordetella pertussis
gaaccgcggcgcaggu

SEQ ID NO: 2463009 - RNA, 17 nt, Bordetella pertussis
gaaccgcggcgcagguc

SEQ ID NO: 2463010 - RNA, 23 nt, Bordetella pertussis
gaaccgcggcgcagguccaccgc

SEQ ID NO: 2463011 - RNA, 17 nt, Bordetella pertussis
gaaccgguggccaugga

SEQ ID NO: 2463012 - RNA, 18 nt, Bordetella pertussis
gaaccugcuggccgccgg

SEQ ID NO: 2463013 - RNA, 21 nt, Bordetella pertussis
gaacgaauaaucgccgguggg

SEQ ID NO: 2463014 - RNA, 23 nt, Bordetella pertussis
gaacgacacccggucggcccagg

SEQ ID NO: 2463015 - RNA, 19 nt, Bordetella pertussis
gaacgacagaccguagcgc

SEQ ID NO: 2463016 - RNA, 14 nt, Bordetella pertussis
gaacgacagcgaca

SEQ ID NO: 2463017 - RNA, 18 nt, Bordetella pertussis
gaacgacaggguccaggu

SEQ ID NO: 2463018 - RNA, 21 nt, Bordetella pertussis
gaacgacaggguccagguggc

SEQ ID NO: 2463019 - RNA, 22 nt, Bordetella pertussis
gaacgacucgucgaccaccagc

SEQ ID NO: 2463020 - RNA, 16 nt, Bordetella pertussis
gaacgagccggccgcg

SEQ ID NO: 2463021 - RNA, 20 nt, Bordetella pertussis
gaacgaggauauccaucugg

SEQ ID NO: 2463022 - RNA, 13 nt, Bordetella pertussis
gaacgaggcgcgg

SEQ ID NO: 2463023 - RNA, 16 nt, Bordetella pertussis
gaacgagguccgcaug

SEQ ID NO: 2463024 - RNA, 22 nt, Bordetella pertussis
gaacgauucuuuccuggccggc

SEQ ID NO: 2463025 - RNA, 18 nt, Bordetella pertussis
gaacgcaagcccggcacg

SEQ ID NO: 2463026 - RNA, 17 nt, Bordetella pertussis
gaacgccaccaggccga

SEQ ID NO: 2463027 - RNA, 15 nt, Bordetella pertussis
gaacgccacgcccgu

SEQ ID NO: 2463028 - RNA, 15 nt, Bordetella pertussis
gaacgccagcagcac

SEQ ID NO: 2463029 - RNA, 16 nt, Bordetella pertussis
gaacgccagcagcacc

SEQ ID NO: 2463030 - RNA, 23 nt, Bordetella pertussis
gaacgccagggucugcuggucgc

SEQ ID NO: 2463031 - RNA, 14 nt, Bordetella pertussis
gaacgccccggccg

SEQ ID NO: 2463032 - RNA, 18 nt, Bordetella pertussis
gaacgcccggcccaggcc

SEQ ID NO: 2463033 - RNA, 15 nt, Bordetella pertussis
gaacgccgccgcagc

SEQ ID NO: 2463034 - RNA, 13 nt, Bordetella pertussis
gaacgccgcgccc

SEQ ID NO: 2463035 - RNA, 17 nt, Bordetella pertussis
gaacgccgcgcccgccc

SEQ ID NO: 2463036 - RNA, 16 nt, Bordetella pertussis
gaacgccgcgcucagc

SEQ ID NO: 2463037 - RNA, 20 nt, Bordetella pertussis
gaacgccgcgcucagcacca

SEQ ID NO: 2463038 - RNA, 13 nt, Bordetella pertussis
gaacgccgcgcug

SEQ ID NO: 2463039 - RNA, 14 nt, Bordetella pertussis
gaacgccgcgcugc

SEQ ID NO: 2463040 - RNA, 24 nt, Bordetella pertussis
gaacgccgcgucgcuggccggacg

SEQ ID NO: 2463041 - RNA, 19 nt, Bordetella pertussis
gaacgccgggccgugcgcc

SEQ ID NO: 2463042 - RNA, 23 nt, Bordetella pertussis
gaacgccgucgggguggcgucgu

SEQ ID NO: 2463043 - RNA, 23 nt, Bordetella pertussis
gaacgccugccagaacagccgcg

SEQ ID NO: 2463044 - RNA, 21 nt, Bordetella pertussis
gaacgccuugcccgggcuggc

SEQ ID NO: 2463045 - RNA, 15 nt, Bordetella pertussis
gaacgcgacagcgcu

SEQ ID NO: 2463046 - RNA, 15 nt, Bordetella pertussis
gaacgcgccgcuggc

SEQ ID NO: 2463047 - RNA, 22 nt, Bordetella pertussis
gaacgcgccgcuggcgucgcgc

SEQ ID NO: 2463048 - RNA, 13 nt, Bordetella pertussis
gaacgcgccggcc

SEQ ID NO: 2463049 - RNA, 18 nt, Bordetella pertussis
gaacgcgccggcccaggc

SEQ ID NO: 2463050 - RNA, 16 nt, Bordetella pertussis
gaacgcgcgcaacagg

SEQ ID NO: 2463051 - RNA, 14 nt, Bordetella pertussis
gaacgcgcgccggc

SEQ ID NO: 2463052 - RNA, 15 nt, Bordetella pertussis
gaacgcgcgccggcc

SEQ ID NO: 2463053 - RNA, 16 nt, Bordetella pertussis
gaacgcgcgccggcca

SEQ ID NO: 2463054 - RNA, 18 nt, Bordetella pertussis
gaacgcgcgccggccagc

SEQ ID NO: 2463055 - RNA, 19 nt, Bordetella pertussis
gaacgcgcgccggccagcg

SEQ ID NO: 2463056 - RNA, 16 nt, Bordetella pertussis
gaacgcggccaugcgg

SEQ ID NO: 2463057 - RNA, 20 nt, Bordetella pertussis
gaacgcguaggucaggccca

SEQ ID NO: 2463058 - RNA, 21 nt, Bordetella pertussis
gaacgcguaggucaggcccac

SEQ ID NO: 2463059 - RNA, 21 nt, Bordetella pertussis
gaacgcguucaagucgcccug

SEQ ID NO: 2463060 - RNA, 14 nt, Bordetella pertussis
gaacgcugaugcgc

SEQ ID NO: 2463061 - RNA, 20 nt, Bordetella pertussis
gaacgcuuccugggccugcg

SEQ ID NO: 2463062 - RNA, 22 nt, Bordetella pertussis
gaacgcuuccugggccugcggc

SEQ ID NO: 2463063 - RNA, 17 nt, Bordetella pertussis
gaacggaaacgcccagc

SEQ ID NO: 2463064 - RNA, 19 nt, Bordetella pertussis
gaacggauugcugauggga

SEQ ID NO: 2463065 - RNA, 17 nt, Bordetella pertussis
gaacggcaccagccggg

SEQ ID NO: 2463066 - RNA, 16 nt, Bordetella pertussis
gaacggcacgucgcgc

SEQ ID NO: 2463067 - RNA, 14 nt, Bordetella pertussis
gaacggcagcagcg

SEQ ID NO: 2463068 - RNA, 22 nt, Bordetella pertussis
gaacggcaggugcacgcacggu

SEQ ID NO: 2463069 - RNA, 17 nt, Bordetella pertussis
gaacggcccauccaucu

SEQ ID NO: 2463070 - RNA, 18 nt, Bordetella pertussis
gaacggccccgccagggc

SEQ ID NO: 2463071 - RNA, 23 nt, Bordetella pertussis
gaacggccccgccagggcggggc

SEQ ID NO: 2463072 - RNA, 13 nt, Bordetella pertussis
gaacggccgcccg

SEQ ID NO: 2463073 - RNA, 18 nt, Bordetella pertussis
gaacggccgggcgcccag

SEQ ID NO: 2463074 - RNA, 20 nt, Bordetella pertussis
gaacggccggucagcccagg

SEQ ID NO: 2463075 - RNA, 21 nt, Bordetella pertussis
gaacggccggucagcccaggc

SEQ ID NO: 2463076 - RNA, 22 nt, Bordetella pertussis
gaacggccggucagcccaggcg

SEQ ID NO: 2463077 - RNA, 14 nt, Bordetella pertussis
gaacggcgcggccu

SEQ ID NO: 2463078 - RNA, 17 nt, Bordetella pertussis
gaacggcgcggccugcu

SEQ ID NO: 2463079 - RNA, 20 nt, Bordetella pertussis
gaacggcgcggccugcucga

SEQ ID NO: 2463080 - RNA, 13 nt, Bordetella pertussis
gaacggcucgagc

SEQ ID NO: 2463081 - RNA, 17 nt, Bordetella pertussis
gaacggcucgagcuccu

SEQ ID NO: 2463082 - RNA, 20 nt, Bordetella pertussis
gaacggcuuggcgugcgcga

SEQ ID NO: 2463083 - RNA, 13 nt, Bordetella pertussis
gaacgggcagccg

SEQ ID NO: 2463084 - RNA, 13 nt, Bordetella pertussis
gaacgggcguggc

SEQ ID NO: 2463085 - RNA, 15 nt, Bordetella pertussis
gaacgggcguggcgc

SEQ ID NO: 2463086 - RNA, 18 nt, Bordetella pertussis
gaacgggcguggcgcagg

SEQ ID NO: 2463087 - RNA, 21 nt, Bordetella pertussis
cuuccaggaguucccagcgcg

SEQ ID NO: 2463088 - RNA, 15 nt, Bordetella pertussis
cuuccaggcgcaggc

SEQ ID NO: 2463089 - RNA, 20 nt, Bordetella pertussis
cuuccaggcgcccgccacca

SEQ ID NO: 2463090 - RNA, 23 nt, Bordetella pertussis
cuuccaggcgcccgccaccagga

SEQ ID NO: 2463091 - RNA, 22 nt, Bordetella pertussis
cuuccagguacaggggcaaggc

SEQ ID NO: 2463092 - RNA, 15 nt, Bordetella pertussis
cuuccaguucgcuuu

SEQ ID NO: 2463093 - RNA, 18 nt, Bordetella pertussis
cuuccaguucgcuuucca

SEQ ID NO: 2463094 - RNA, 21 nt, Bordetella pertussis
cuuccaguucgcuuuccaggg

SEQ ID NO: 2463095 - RNA, 19 nt, Bordetella pertussis
cuucccaggcgaggcuggc

SEQ ID NO: 2463096 - RNA, 20 nt, Bordetella pertussis
cuuccccgaaacucaccgcc

SEQ ID NO: 2463097 - RNA, 18 nt, Bordetella pertussis
cuuccccgcgugccuguc

SEQ ID NO: 2463098 - RNA, 21 nt, Bordetella pertussis
cuuccccgucggcggcaagca

SEQ ID NO: 2463099 - RNA, 15 nt, Bordetella pertussis
cuuccgagauggccu

SEQ ID NO: 2463100 - RNA, 14 nt, Bordetella pertussis
cuuccgcacgccga

SEQ ID NO: 2463101 - RNA, 20 nt, Bordetella pertussis
cuuccgcacgccgaccuggc

SEQ ID NO: 2463102 - RNA, 16 nt, Bordetella pertussis
cuuccggcagcggcca

SEQ ID NO: 2463103 - RNA, 14 nt, Bordetella pertussis
cuuccggccgggcc

SEQ ID NO: 2463104 - RNA, 15 nt, Bordetella pertussis
cuuccgggcccgcgc

SEQ ID NO: 2463105 - RNA, 17 nt, Bordetella pertussis
cuuccgguacgcgcagu

SEQ ID NO: 2463106 - RNA, 22 nt, Bordetella pertussis
cuuccgugccauacagcaagga

SEQ ID NO: 2463107 - RNA, 23 nt, Bordetella pertussis
cuuccucccagaccugcgcgccg

SEQ ID NO: 2463108 - RNA, 19 nt, Bordetella pertussis
cuuccuccgacaggcgccg

SEQ ID NO: 2463109 - RNA, 17 nt, Bordetella pertussis
cuuccucgaccagcccg

SEQ ID NO: 2463110 - RNA, 16 nt, Bordetella pertussis
cuuccucgacccgcgc

SEQ ID NO: 2463111 - RNA, 18 nt, Bordetella pertussis
cuuccucgacccgcgccu

SEQ ID NO: 2463112 - RNA, 22 nt, Bordetella pertussis
cuuccucgacccgcgccucggc

SEQ ID NO: 2463113 - RNA, 12 nt, Bordetella pertussis
cuuccucggcgc

SEQ ID NO: 2463114 - RNA, 14 nt, Bordetella pertussis
cuuccucggcgcgc

SEQ ID NO: 2463115 - RNA, 15 nt, Bordetella pertussis
cuuccucggcgcgcg

SEQ ID NO: 2463116 - RNA, 15 nt, Bordetella pertussis
cuuccugcaccucag

SEQ ID NO: 2463117 - RNA, 17 nt, Bordetella pertussis
cuuccugcugcgccugg

SEQ ID NO: 2463118 - RNA, 18 nt, Bordetella pertussis
cuuccugcugcgccuggc

SEQ ID NO: 2463119 - RNA, 23 nt, Bordetella pertussis
cuuccugggccugcggcgucagg

SEQ ID NO: 2463120 - RNA, 16 nt, Bordetella pertussis
cuuccuggugggcggc

SEQ ID NO: 2463121 - RNA, 15 nt, Bordetella pertussis
cuuccuuggucagcg

SEQ ID NO: 2463122 - RNA, 21 nt, Bordetella pertussis
cuuccuuuauugaaaugaagg

SEQ ID NO: 2463123 - RNA, 22 nt, Bordetella pertussis
cuucgaaguauuucaggaugcc

SEQ ID NO: 2463124 - RNA, 15 nt, Bordetella pertussis
cuucgacagcgcgca

SEQ ID NO: 2463125 - RNA, 21 nt, Bordetella pertussis
cuucgacggcgggaccggcga

SEQ ID NO: 2463126 - RNA, 19 nt, Bordetella pertussis
cuucgagauccgccggcga

SEQ ID NO: 2463127 - RNA, 21 nt, Bordetella pertussis
cuucgagcgacggcaaugccu

SEQ ID NO: 2463128 - RNA, 17 nt, Bordetella pertussis
cuucgagcgcggcgcgc

SEQ ID NO: 2463129 - RNA, 19 nt, Bordetella pertussis
cuucgaggaaagcggccug

SEQ ID NO: 2463130 - RNA, 12 nt, Bordetella pertussis
cuucgaggccgg

SEQ ID NO: 2463131 - RNA, 18 nt, Bordetella pertussis
cuucgaugaugagcgcgc

SEQ ID NO: 2463132 - RNA, 20 nt, Bordetella pertussis
cuucgaugaugagcgcgccg

SEQ ID NO: 2463133 - RNA, 13 nt, Bordetella pertussis
cuucgaugcuggc

SEQ ID NO: 2463134 - RNA, 16 nt, Bordetella pertussis
cuucgaugcuggcgcg

SEQ ID NO: 2463135 - RNA, 17 nt, Bordetella pertussis
cuucgaugcuggcgcgg

SEQ ID NO: 2463136 - RNA, 19 nt, Bordetella pertussis
cuucgaugcuggcgcggac

SEQ ID NO: 2463137 - RNA, 16 nt, Bordetella pertussis
cuucgauggcggcggc

SEQ ID NO: 2463138 - RNA, 14 nt, Bordetella pertussis
cuucgcccagcgcu

SEQ ID NO: 2463139 - RNA, 22 nt, Bordetella pertussis
cuucgcccagcgcuugcacgcc

SEQ ID NO: 2463140 - RNA, 20 nt, Bordetella pertussis
cuucgccgaucgagcaggcc

SEQ ID NO: 2463141 - RNA, 18 nt, Bordetella pertussis
cuucgccgaugaccagca

SEQ ID NO: 2463142 - RNA, 20 nt, Bordetella pertussis
cuucgccggugaacaccagg

SEQ ID NO: 2463143 - RNA, 22 nt, Bordetella pertussis
cuucgccggugaacaccagggu

SEQ ID NO: 2463144 - RNA, 14 nt, Bordetella pertussis
cuucgccgucgacg

SEQ ID NO: 2463145 - RNA, 15 nt, Bordetella pertussis
cuucgccgucgacgu

SEQ ID NO: 2463146 - RNA, 15 nt, Bordetella pertussis
cuucgccuggccggc

SEQ ID NO: 2463147 - RNA, 18 nt, Bordetella pertussis
cuucgcgcacauccagcc

SEQ ID NO: 2463148 - RNA, 20 nt, Bordetella pertussis
cuucgcgcacauccagccga

SEQ ID NO: 2463149 - RNA, 12 nt, Bordetella pertussis
cuucgcgcagca

SEQ ID NO: 2463150 - RNA, 13 nt, Bordetella pertussis
cuucgcggcuggu

SEQ ID NO: 2463151 - RNA, 21 nt, Bordetella pertussis
cuucgcgguaaccggcgauaa

SEQ ID NO: 2463152 - RNA, 17 nt, Bordetella pertussis
cuucggcaaccgcgccu

SEQ ID NO: 2463153 - RNA, 12 nt, Bordetella pertussis
cuucggcagcuu

SEQ ID NO: 2463154 - RNA, 19 nt, Bordetella pertussis
cuucggcagcuuguagcgc

SEQ ID NO: 2463155 - RNA, 19 nt, Bordetella pertussis
cuucggcaggcgccggcug

SEQ ID NO: 2463156 - RNA, 21 nt, Bordetella pertussis
cuucggcaggcgccggcuggc

SEQ ID NO: 2463157 - RNA, 15 nt, Bordetella pertussis
cuucggcaucugcca

SEQ ID NO: 2463158 - RNA, 24 nt, Bordetella pertussis
cuucggcauguaggccucgggcca

SEQ ID NO: 2463159 - RNA, 13 nt, Bordetella pertussis
cuucggccgacau

SEQ ID NO: 2463160 - RNA, 13 nt, Bordetella pertussis
cuucggccgccag

SEQ ID NO: 2463161 - RNA, 20 nt, Bordetella pertussis
cuucggccggcugcgcgccg

SEQ ID NO: 2463162 - RNA, 21 nt, Bordetella pertussis
cuucggccggcugcgcgccga

SEQ ID NO: 2463163 - RNA, 14 nt, Bordetella pertussis
cuucggccgucagc

SEQ ID NO: 2463164 - RNA, 15 nt, Bordetella pertussis
cuucggccugcgcca

SEQ ID NO: 2463165 - RNA, 18 nt, Bordetella pertussis
cuucggccugcgccacca

SEQ ID NO: 2463166 - RNA, 21 nt, Bordetella pertussis
cuucggcgacuucggcggcca

SEQ ID NO: 2463167 - RNA, 18 nt, Bordetella pertussis
cuucggcgcgcacgcucu

SEQ ID NO: 2463168 - RNA, 23 nt, Bordetella pertussis
cuucggcgcggcgggcgcuggcg

SEQ ID NO: 2463169 - RNA, 22 nt, Bordetella pertussis
cuucggcgcggcgggcucagcc

SEQ ID NO: 2463170 - RNA, 16 nt, Bordetella pertussis
cuucggcggccaugcc

SEQ ID NO: 2463171 - RNA, 20 nt, Bordetella pertussis
cuucggcggccaugccgacg

SEQ ID NO: 2463172 - RNA, 21 nt, Bordetella pertussis
cuucggcggccaugccgacgg

SEQ ID NO: 2463173 - RNA, 15 nt, Bordetella pertussis
cuucggcggccgcgu

SEQ ID NO: 2463174 - RNA, 23 nt, Bordetella pertussis
cuucggcggccgcgucgaucagc

SEQ ID NO: 2463175 - RNA, 13 nt, Bordetella pertussis
cuucggcggcggg

SEQ ID NO: 2463176 - RNA, 17 nt, Bordetella pertussis
cuucggcguaaggcugc

SEQ ID NO: 2463177 - RNA, 19 nt, Bordetella pertussis
cuucgggauuucgcuggcc

SEQ ID NO: 2463178 - RNA, 21 nt, Bordetella pertussis
cuucggguugcaaauucugca

SEQ ID NO: 2463179 - RNA, 20 nt, Bordetella pertussis
cuucggucacguucagcgcc

SEQ ID NO: 2463180 - RNA, 18 nt, Bordetella pertussis
cuucggucagcuugccgc

SEQ ID NO: 2463181 - RNA, 12 nt, Bordetella pertussis
cuucguccugcc

SEQ ID NO: 2463182 - RNA, 21 nt, Bordetella pertussis
cuucgucgaccagcauccuca

SEQ ID NO: 2463183 - RNA, 14 nt, Bordetella pertussis
cuucgucgccggcg

SEQ ID NO: 2463184 - RNA, 15 nt, Bordetella pertussis
cuucgucgccggcgu

SEQ ID NO: 2463185 - RNA, 12 nt, Bordetella pertussis
cuucgucggccg

SEQ ID NO: 2463186 - RNA, 12 nt, Bordetella pertussis
cuucgucggcgu

SEQ ID NO: 2463187 - RNA, 17 nt, Bordetella pertussis
cuucgucgggcagcgcg

SEQ ID NO: 2463188 - RNA, 20 nt, Bordetella pertussis
cuucgucgggcagcgcggcg

SEQ ID NO: 2463189 - RNA, 14 nt, Bordetella pertussis
cuucgucuucgacc

SEQ ID NO: 2463190 - RNA, 14 nt, Bordetella pertussis
cuucgugcagcgcg

SEQ ID NO: 2463191 - RNA, 17 nt, Bordetella pertussis
cuucgugcagcgcgugg

SEQ ID NO: 2463192 - RNA, 14 nt, Bordetella pertussis
cuucgugcuggcca

SEQ ID NO: 2463193 - RNA, 13 nt, Bordetella pertussis
cuucguggcgcag

SEQ ID NO: 2463194 - RNA, 15 nt, Bordetella pertussis
cuucguggcgccggg

SEQ ID NO: 2463195 - RNA, 16 nt, Bordetella pertussis
cuucgugguggcgaaa

SEQ ID NO: 2463196 - RNA, 15 nt, Bordetella pertussis
cuucguucagcuucu

SEQ ID NO: 2463197 - RNA, 16 nt, Bordetella pertussis
cuucguugaccgcuuc

SEQ ID NO: 2463198 - RNA, 18 nt, Bordetella pertussis
cuucucgacggcgcgcgc

SEQ ID NO: 2463199 - RNA, 22 nt, Bordetella pertussis
cuucucgcaagugcuggcccgc

SEQ ID NO: 2463200 - RNA, 17 nt, Bordetella pertussis
cuuggcgaaucaguucg

SEQ ID NO: 2463201 - RNA, 13 nt, Bordetella pertussis
cuuggcgaccagg

SEQ ID NO: 2463202 - RNA, 15 nt, Bordetella pertussis
cuuggcgaccaggcc

SEQ ID NO: 2463203 - RNA, 17 nt, Bordetella pertussis
cuuggcgaccaggccca

SEQ ID NO: 2463204 - RNA, 18 nt, Bordetella pertussis
cuuggcgaccaggcccac

SEQ ID NO: 2463205 - RNA, 21 nt, Bordetella pertussis
cuuggcgaucucguccugcag

SEQ ID NO: 2463206 - RNA, 16 nt, Bordetella pertussis
cuuggcgauggccgcc

SEQ ID NO: 2463207 - RNA, 17 nt, Bordetella pertussis
cuuggcgauggccgcca

SEQ ID NO: 2463208 - RNA, 22 nt, Bordetella pertussis
cuuggcgcaggaacucagcgca

SEQ ID NO: 2463209 - RNA, 15 nt, Bordetella pertussis
cuuggcgcgcagcag

SEQ ID NO: 2463210 - RNA, 18 nt, Bordetella pertussis
cuuggcgcgguccacgcc

SEQ ID NO: 2463211 - RNA, 20 nt, Bordetella pertussis
cuuggcgcuuacuggaucuu

SEQ ID NO: 2463212 - RNA, 14 nt, Bordetella pertussis
cuuggcggccagga

SEQ ID NO: 2463213 - RNA, 20 nt, Bordetella pertussis
cuuggcggccccgcgucggc

SEQ ID NO: 2463214 - RNA, 14 nt, Bordetella pertussis
cuuggcggccuugc

SEQ ID NO: 2463215 - RNA, 21 nt, Bordetella pertussis
cuuggcggccuugcgggccgg

SEQ ID NO: 2463216 - RNA, 18 nt, Bordetella pertussis
cuuggcggcuggcgcggc

SEQ ID NO: 2463217 - RNA, 21 nt, Bordetella pertussis
gaacugcuggaacaccaugcc

SEQ ID NO: 2463218 - RNA, 14 nt, Bordetella pertussis
gaacuggacggcgc

SEQ ID NO: 2463219 - RNA, 17 nt, Bordetella pertussis
gaacuggacggcgcugg

SEQ ID NO: 2463220 - RNA, 18 nt, Bordetella pertussis
gaacuggacggcgcuggg

SEQ ID NO: 2463221 - RNA, 16 nt, Bordetella pertussis
gaacugggacaggccc

SEQ ID NO: 2463222 - RNA, 18 nt, Bordetella pertussis
gaacugggcgccggccag

SEQ ID NO: 2463223 - RNA, 13 nt, Bordetella pertussis
gaacugggcgcgu

SEQ ID NO: 2463224 - RNA, 18 nt, Bordetella pertussis
gaacugucgcgccacggc

SEQ ID NO: 2463225 - RNA, 20 nt, Bordetella pertussis
gaacuucagcccgggcaugc

SEQ ID NO: 2463226 - RNA, 13 nt, Bordetella pertussis
gaacuuggcgcgg

SEQ ID NO: 2463227 - RNA, 16 nt, Bordetella pertussis
gaacuuggcgcggucc

SEQ ID NO: 2463228 - RNA, 20 nt, Bordetella pertussis
gaagaaauagcccgcggcca

SEQ ID NO: 2463229 - RNA, 21 nt, Bordetella pertussis
gaagaaauuuuuccgucgcua

SEQ ID NO: 2463230 - RNA, 16 nt, Bordetella pertussis
gaagaagcagccgcgc

SEQ ID NO: 2463231 - RNA, 19 nt, Bordetella pertussis
gaagacauggcgcgcgcca

SEQ ID NO: 2463232 - RNA, 21 nt, Bordetella pertussis
gaagacauggcgcgcgccagc

SEQ ID NO: 2463233 - RNA, 20 nt, Bordetella pertussis
gaagaccacguggaugaugg

SEQ ID NO: 2463234 - RNA, 16 nt, Bordetella pertussis
gaagaccgugaucggc

SEQ ID NO: 2463235 - RNA, 15 nt, Bordetella pertussis
gaagaccucggcgcu

SEQ ID NO: 2463236 - RNA, 18 nt, Bordetella pertussis
gaagacgaagucccagcc

SEQ ID NO: 2463237 - RNA, 16 nt, Bordetella pertussis
gaagacgccggucgac

SEQ ID NO: 2463238 - RNA, 18 nt, Bordetella pertussis
gaagacgccgucgacccc

SEQ ID NO: 2463239 - RNA, 12 nt, Bordetella pertussis
gaagacgcgcuc

SEQ ID NO: 2463240 - RNA, 14 nt, Bordetella pertussis
gaagacggaaagag

SEQ ID NO: 2463241 - RNA, 21 nt, Bordetella pertussis
gaagacggaaagagccagggg

SEQ ID NO: 2463242 - RNA, 16 nt, Bordetella pertussis
gaagacguggcccgcg

SEQ ID NO: 2463243 - RNA, 17 nt, Bordetella pertussis
gaagacguggcccgcgu

SEQ ID NO: 2463244 - RNA, 22 nt, Bordetella pertussis
gaagacuucgucaacgcccuga

SEQ ID NO: 2463245 - RNA, 17 nt, Bordetella pertussis
gaagagcuggcgcugcu

SEQ ID NO: 2463246 - RNA, 15 nt, Bordetella pertussis
gaagagggcggggcg

SEQ ID NO: 2463247 - RNA, 22 nt, Bordetella pertussis
gaagaggguuauuuccggccgc

SEQ ID NO: 2463248 - RNA, 21 nt, Bordetella pertussis
gaagaucaacaaggcgacggu

SEQ ID NO: 2463249 - RNA, 20 nt, Bordetella pertussis
gaagaucacauaggccggca

SEQ ID NO: 2463250 - RNA, 21 nt, Bordetella pertussis
gaagaucacauaggccggcac

SEQ ID NO: 2463251 - RNA, 22 nt, Bordetella pertussis
gaagauccgccauaugcgcgaa

SEQ ID NO: 2463252 - RNA, 16 nt, Bordetella pertussis
gaagaucggcccggcg

SEQ ID NO: 2463253 - RNA, 22 nt, Bordetella pertussis
gaagaucuccucgcgcgcgaug

SEQ ID NO: 2463254 - RNA, 18 nt, Bordetella pertussis
gaagaugccgaaccagau

SEQ ID NO: 2463255 - RNA, 16 nt, Bordetella pertussis
gaagauguaccagccc

SEQ ID NO: 2463256 - RNA, 17 nt, Bordetella pertussis
gaagauguggucggcgc

SEQ ID NO: 2463257 - RNA, 13 nt, Bordetella pertussis
gaagauuucccag

SEQ ID NO: 2463258 - RNA, 21 nt, Bordetella pertussis
gaagauuucccagagcugggg

SEQ ID NO: 2463259 - RNA, 11 nt, Bordetella pertussis
gaagcaaugca

SEQ ID NO: 2463260 - RNA, 15 nt, Bordetella pertussis
gaagcacugcaggcc

SEQ ID NO: 2463261 - RNA, 13 nt, Bordetella pertussis
gaagcagccgcgc

SEQ ID NO: 2463262 - RNA, 20 nt, Bordetella pertussis
gaagcagccgcgcggccggg

SEQ ID NO: 2463263 - RNA, 15 nt, Bordetella pertussis
gaagcagccgcgcuc

SEQ ID NO: 2463264 - RNA, 13 nt, Bordetella pertussis
gaagcagccggcc

SEQ ID NO: 2463265 - RNA, 21 nt, Bordetella pertussis
gaagcaggcgguacagcggau

SEQ ID NO: 2463266 - RNA, 16 nt, Bordetella pertussis
gaagcaggugaugcgc

SEQ ID NO: 2463267 - RNA, 22 nt, Bordetella pertussis
gaagcaggugaugcgcgcggcc

SEQ ID NO: 2463268 - RNA, 14 nt, Bordetella pertussis
gaagccaagcaggg

SEQ ID NO: 2463269 - RNA, 15 nt, Bordetella pertussis
gaagccaagcagggc

SEQ ID NO: 2463270 - RNA, 12 nt, Bordetella pertussis
gaagccacggcc

SEQ ID NO: 2463271 - RNA, 20 nt, Bordetella pertussis
gaagccacggcccgccagga

SEQ ID NO: 2463272 - RNA, 20 nt, Bordetella pertussis
gaagccagauaaaggccgca

SEQ ID NO: 2463273 - RNA, 16 nt, Bordetella pertussis
gaagccaucgacaagc

SEQ ID NO: 2463274 - RNA, 14 nt, Bordetella pertussis
gaagcccauggcgu

SEQ ID NO: 2463275 - RNA, 16 nt, Bordetella pertussis
gaagcccccgcgcugc

SEQ ID NO: 2463276 - RNA, 18 nt, Bordetella pertussis
gaagcccccgcgcugcgc

SEQ ID NO: 2463277 - RNA, 17 nt, Bordetella pertussis
gaagcccggcugcucgu

SEQ ID NO: 2463278 - RNA, 19 nt, Bordetella pertussis
gaagcccucgucgcggccg

SEQ ID NO: 2463279 - RNA, 22 nt, Bordetella pertussis
gaagcccucgucgcggccguug

SEQ ID NO: 2463280 - RNA, 14 nt, Bordetella pertussis
gaagccgaugcgcc

SEQ ID NO: 2463281 - RNA, 20 nt, Bordetella pertussis
gaagccgaugcgccgcgcuu

SEQ ID NO: 2463282 - RNA, 15 nt, Bordetella pertussis
gaagccgcagcggca

SEQ ID NO: 2463283 - RNA, 22 nt, Bordetella pertussis
gaagccgccccacgagaagccg

SEQ ID NO: 2463284 - RNA, 15 nt, Bordetella pertussis
gaagccgccgccguc

SEQ ID NO: 2463285 - RNA, 22 nt, Bordetella pertussis
gaagccgccgccgucaacgccc

SEQ ID NO: 2463286 - RNA, 18 nt, Bordetella pertussis
gaagccggcacgccugcc

SEQ ID NO: 2463287 - RNA, 21 nt, Bordetella pertussis
gaagccggcacgccugccgcg

SEQ ID NO: 2463288 - RNA, 22 nt, Bordetella pertussis
gaagccggcccguuggcaggcc

SEQ ID NO: 2463289 - RNA, 23 nt, Bordetella pertussis
gaagccggcccguuggcaggcca

SEQ ID NO: 2463290 - RNA, 23 nt, Bordetella pertussis
gaagccgggcggcgagaugccgu

SEQ ID NO: 2463291 - RNA, 19 nt, Bordetella pertussis
gaagccguaguugaugcuu

SEQ ID NO: 2463292 - RNA, 20 nt, Bordetella pertussis
gaagccguccuugagggcgc

SEQ ID NO: 2463293 - RNA, 22 nt, Bordetella pertussis
gaagccguccuugagggcgcgg

SEQ ID NO: 2463294 - RNA, 18 nt, Bordetella pertussis
gaagccuaggcugcagcc

SEQ ID NO: 2463295 - RNA, 14 nt, Bordetella pertussis
gaagccuugcgcgg

SEQ ID NO: 2463296 - RNA, 17 nt, Bordetella pertussis
gaagccuugcgcggcca

SEQ ID NO: 2463297 - RNA, 19 nt, Bordetella pertussis
gaagccuugcgcggccagc

SEQ ID NO: 2463298 - RNA, 20 nt, Bordetella pertussis
gaagccuugcgcggccagca

SEQ ID NO: 2463299 - RNA, 21 nt, Bordetella pertussis
gaagccuugcgcggccagcac

SEQ ID NO: 2463300 - RNA, 14 nt, Bordetella pertussis
gaagcgagugcgcc

SEQ ID NO: 2463301 - RNA, 16 nt, Bordetella pertussis
gaagcgcaagcccagg

SEQ ID NO: 2463302 - RNA, 15 nt, Bordetella pertussis
gaagcuggcgccggu

SEQ ID NO: 2463303 - RNA, 18 nt, Bordetella pertussis
gaagcuguagcgguagcc

SEQ ID NO: 2463304 - RNA, 20 nt, Bordetella pertussis
gaagcuguccuucguggcgc

SEQ ID NO: 2463305 - RNA, 15 nt, Bordetella pertussis
gaaggcagcaccgcc

SEQ ID NO: 2463306 - RNA, 16 nt, Bordetella pertussis
gaaggcagcaccgcca

SEQ ID NO: 2463307 - RNA, 18 nt, Bordetella pertussis
gaaggcagcgcggccggc

SEQ ID NO: 2463308 - RNA, 20 nt, Bordetella pertussis
gaaggcagcgcggccggcac

SEQ ID NO: 2463309 - RNA, 17 nt, Bordetella pertussis
gaaggccgaggccaggu

SEQ ID NO: 2463310 - RNA, 19 nt, Bordetella pertussis
gaaggccgaggccagguug

SEQ ID NO: 2463311 - RNA, 16 nt, Bordetella pertussis
gaaggccgcaaccagg

SEQ ID NO: 2463312 - RNA, 18 nt, Bordetella pertussis
gaaggccgcgccgcggca

SEQ ID NO: 2463313 - RNA, 17 nt, Bordetella pertussis
gaaggccuuggccuggg

SEQ ID NO: 2463314 - RNA, 17 nt, Bordetella pertussis
gaaggcgagcgcggcau

SEQ ID NO: 2463315 - RNA, 14 nt, Bordetella pertussis
gaaggcgaucugcg

SEQ ID NO: 2463316 - RNA, 18 nt, Bordetella pertussis
gaaggcgaucugcggcgu

SEQ ID NO: 2463317 - RNA, 17 nt, Bordetella pertussis
gaaggcgccgacggcgc

SEQ ID NO: 2463318 - RNA, 17 nt, Bordetella pertussis
gaaggcgccggccaggc

SEQ ID NO: 2463319 - RNA, 14 nt, Bordetella pertussis
gaaggcgcgcucca

SEQ ID NO: 2463320 - RNA, 15 nt, Bordetella pertussis
gaaggcgcggccggg

SEQ ID NO: 2463321 - RNA, 13 nt, Bordetella pertussis
gaaggcggccggc

SEQ ID NO: 2463322 - RNA, 18 nt, Bordetella pertussis
gaaggcggccggcaggcc

SEQ ID NO: 2463323 - RNA, 23 nt, Bordetella pertussis
gaaggcggccggcaggccggcca

SEQ ID NO: 2463324 - RNA, 15 nt, Bordetella pertussis
gaaggcggcgccggu

SEQ ID NO: 2463325 - RNA, 22 nt, Bordetella pertussis
gaaggcgguguagaccaccagc

SEQ ID NO: 2463326 - RNA, 13 nt, Bordetella pertussis
gaaggcgugaggc

SEQ ID NO: 2463327 - RNA, 16 nt, Bordetella pertussis
gaaggcgugaggccca

SEQ ID NO: 2463328 - RNA, 21 nt, Bordetella pertussis
gaaggcgugcgugacgcugga

SEQ ID NO: 2463329 - RNA, 17 nt, Bordetella pertussis
gaaggcuuucugcuugc

SEQ ID NO: 2463330 - RNA, 13 nt, Bordetella pertussis
gaagggcagcagc

SEQ ID NO: 2463331 - RNA, 15 nt, Bordetella pertussis
gaagggcuggccggc

SEQ ID NO: 2463332 - RNA, 17 nt, Bordetella pertussis
gaagggcuggccggcca

SEQ ID NO: 2463333 - RNA, 19 nt, Bordetella pertussis
gaagggcuugaccagggcg

SEQ ID NO: 2463334 - RNA, 22 nt, Bordetella pertussis
gaaggggacguguugccaggcg

SEQ ID NO: 2463335 - RNA, 13 nt, Bordetella pertussis
gaaggggacuggc

SEQ ID NO: 2463336 - RNA, 19 nt, Bordetella pertussis
gaaggggacuggcucccgc

SEQ ID NO: 2463337 - RNA, 12 nt, Bordetella pertussis
gaagggugcggc

SEQ ID NO: 2463338 - RNA, 16 nt, Bordetella pertussis
gaagggugcggcgcca

SEQ ID NO: 2463339 - RNA, 22 nt, Bordetella pertussis
gaaggguugcaguucgccggcg

SEQ ID NO: 2463340 - RNA, 22 nt, Bordetella pertussis
gaagguccacggcauggccagc

SEQ ID NO: 2463341 - RNA, 23 nt, Bordetella pertussis
gaagguccacggcauggccagcu

SEQ ID NO: 2463342 - RNA, 17 nt, Bordetella pertussis
gaaggucgcuucggugg

SEQ ID NO: 2463343 - RNA, 22 nt, Bordetella pertussis
gaaggucggcacgacgcugaug

SEQ ID NO: 2463344 - RNA, 18 nt, Bordetella pertussis
gaaggucugggccagcag

SEQ ID NO: 2463345 - RNA, 14 nt, Bordetella pertussis
gaaggugcgcagca

SEQ ID NO: 2463346 - RNA, 19 nt, Bordetella pertussis
gaagguguugaccacgccc

SEQ ID NO: 2463347 - RNA, 23 nt, Bordetella pertussis
gaagguguugaccacgcccugga

SEQ ID NO: 2463348 - RNA, 15 nt, Bordetella pertussis
gaaguaaucgcccgg

SEQ ID NO: 2463349 - RNA, 16 nt, Bordetella pertussis
gaaguacacggccagc

SEQ ID NO: 2463350 - RNA, 17 nt, Bordetella pertussis
gaaguagaacgccggcu

SEQ ID NO: 2463351 - RNA, 20 nt, Bordetella pertussis
gaaguagaacgccggcuugg

SEQ ID NO: 2463352 - RNA, 18 nt, Bordetella pertussis
gaaguauucgcgcggcga

SEQ ID NO: 2463353 - RNA, 16 nt, Bordetella pertussis
gaaguccgacaggcag

SEQ ID NO: 2463354 - RNA, 19 nt, Bordetella pertussis
gaaguccggaucccaggcc

SEQ ID NO: 2463355 - RNA, 23 nt, Bordetella pertussis
gaaguccuucagccgcugacugg

SEQ ID NO: 2463356 - RNA, 19 nt, Bordetella pertussis
gaagucgcaauagcucgca

SEQ ID NO: 2463357 - RNA, 18 nt, Bordetella pertussis
gaagucgggcaccagcac

SEQ ID NO: 2463358 - RNA, 18 nt, Bordetella pertussis
gaagugaugccgccggcg

SEQ ID NO: 2463359 - RNA, 19 nt, Bordetella pertussis
gaagugaugccgccggcgg

SEQ ID NO: 2463360 - RNA, 15 nt, Bordetella pertussis
gaagugcccgcuggc

SEQ ID NO: 2463361 - RNA, 15 nt, Bordetella pertussis
gaaguggaaccgcgg

SEQ ID NO: 2463362 - RNA, 16 nt, Bordetella pertussis
gaaguggucgcgcagg

SEQ ID NO: 2463363 - RNA, 17 nt, Bordetella pertussis
gaaguggucgcgcaggc

SEQ ID NO: 2463364 - RNA, 23 nt, Bordetella pertussis
gaagugucagguuagcggcagug

SEQ ID NO: 2463365 - RNA, 14 nt, Bordetella pertussis
gaauacacgcgaug

SEQ ID NO: 2463366 - RNA, 16 nt, Bordetella pertussis
gaauaccgcgcacagg

SEQ ID NO: 2463367 - RNA, 22 nt, Bordetella pertussis
gaauagauaugggccugaucgg

SEQ ID NO: 2463368 - RNA, 15 nt, Bordetella pertussis
gaauauccuggucga

SEQ ID NO: 2463369 - RNA, 19 nt, Bordetella pertussis
gaauccacagcuggugccg

SEQ ID NO: 2463370 - RNA, 13 nt, Bordetella pertussis
gaauccaccggcg

SEQ ID NO: 2463371 - RNA, 21 nt, Bordetella pertussis
gaauccccgcucaggucgaac

SEQ ID NO: 2463372 - RNA, 19 nt, Bordetella pertussis
gaauccgcaacccagcagc

SEQ ID NO: 2463373 - RNA, 20 nt, Bordetella pertussis
gaauccgcaacccagcagcg

SEQ ID NO: 2463374 - RNA, 13 nt, Bordetella pertussis
gaauccggccagc

SEQ ID NO: 2463375 - RNA, 18 nt, Bordetella pertussis
gaauccggccagcacgcc

SEQ ID NO: 2463376 - RNA, 18 nt, Bordetella pertussis
gaauccggggugccuguc

SEQ ID NO: 2463377 - RNA, 20 nt, Bordetella pertussis
gaauccggggugccuguccu

SEQ ID NO: 2463378 - RNA, 20 nt, Bordetella pertussis
gaauccucucgccccgacca

SEQ ID NO: 2463379 - RNA, 13 nt, Bordetella pertussis
gaauccuggcgac

SEQ ID NO: 2463380 - RNA, 16 nt, Bordetella pertussis
gaaucgcccgggcgcc

SEQ ID NO: 2463381 - RNA, 21 nt, Bordetella pertussis
gaaucgcccgggcgccggcac

SEQ ID NO: 2463382 - RNA, 18 nt, Bordetella pertussis
gaaucgcguucacguaga

SEQ ID NO: 2463383 - RNA, 20 nt, Bordetella pertussis
gaaucggcaccucggcgccg

SEQ ID NO: 2463384 - RNA, 12 nt, Bordetella pertussis
gaaucgguggaa

SEQ ID NO: 2463385 - RNA, 22 nt, Bordetella pertussis
gacaacagcuugcccggcgugc

SEQ ID NO: 2463386 - RNA, 12 nt, Bordetella pertussis
gacaacgcgcgc

SEQ ID NO: 2463387 - RNA, 13 nt, Bordetella pertussis
gacaacggcgugc

SEQ ID NO: 2463388 - RNA, 17 nt, Bordetella pertussis
gacaacggcgugcugcg

SEQ ID NO: 2463389 - RNA, 12 nt, Bordetella pertussis
gacaacugcgcg

SEQ ID NO: 2463390 - RNA, 14 nt, Bordetella pertussis
gacaaggcgcgcgc

SEQ ID NO: 2463391 - RNA, 20 nt, Bordetella pertussis
gacaauccuggcugauccag

SEQ ID NO: 2463392 - RNA, 14 nt, Bordetella pertussis
gacaaugccccgca

SEQ ID NO: 2463393 - RNA, 14 nt, Bordetella pertussis
gacaccaaccugcu

SEQ ID NO: 2463394 - RNA, 18 nt, Bordetella pertussis
gacaccaaggggcggauc

SEQ ID NO: 2463395 - RNA, 15 nt, Bordetella pertussis
gacaccaugauggcc

SEQ ID NO: 2463396 - RNA, 19 nt, Bordetella pertussis
gacaccaugauggccgcgc

SEQ ID NO: 2463397 - RNA, 13 nt, Bordetella pertussis
gacacccccaggg

SEQ ID NO: 2463398 - RNA, 16 nt, Bordetella pertussis
gacacccggucggccc

SEQ ID NO: 2463399 - RNA, 15 nt, Bordetella pertussis
gacacccuugcgcaa

SEQ ID NO: 2463400 - RNA, 16 nt, Bordetella pertussis
gacaccgcggccuugc

SEQ ID NO: 2463401 - RNA, 17 nt, Bordetella pertussis
gacaccgugaaggugcc

SEQ ID NO: 2463402 - RNA, 19 nt, Bordetella pertussis
gacaccgugaaggugccgg

SEQ ID NO: 2463403 - RNA, 17 nt, Bordetella pertussis
gacaccguuuuggcagg

SEQ ID NO: 2463404 - RNA, 23 nt, Bordetella pertussis
gacaccguuuuggcaggcuggca

SEQ ID NO: 2463405 - RNA, 20 nt, Bordetella pertussis
gacaccuacauccuggaugu

SEQ ID NO: 2463406 - RNA, 24 nt, Bordetella pertussis
gacaccuacauccuggaugugcgc

SEQ ID NO: 2463407 - RNA, 19 nt, Bordetella pertussis
gacaccuggacccgcucga

SEQ ID NO: 2463408 - RNA, 19 nt, Bordetella pertussis
gacacgaugaacgcgcgca

SEQ ID NO: 2463409 - RNA, 15 nt, Bordetella pertussis
gacacgcccagcagg

SEQ ID NO: 2463410 - RNA, 16 nt, Bordetella pertussis
gacacgcccagcaggc

SEQ ID NO: 2463411 - RNA, 12 nt, Bordetella pertussis
gacacgcccugg

SEQ ID NO: 2463412 - RNA, 15 nt, Bordetella pertussis
gacacgcccuggccg

SEQ ID NO: 2463413 - RNA, 17 nt, Bordetella pertussis
gacacgcccuggccgua

SEQ ID NO: 2463414 - RNA, 13 nt, Bordetella pertussis
gacacgccgcgcg

SEQ ID NO: 2463415 - RNA, 15 nt, Bordetella pertussis
gacacgccgcgcgau

SEQ ID NO: 2463416 - RNA, 18 nt, Bordetella pertussis
gacacgccgcgcgaucgc

SEQ ID NO: 2463417 - RNA, 21 nt, Bordetella pertussis
gacacgccgcgcgaucgccgc

SEQ ID NO: 2463418 - RNA, 24 nt, Bordetella pertussis
gacacgccgcgcgaucgccgcaug

SEQ ID NO: 2463419 - RNA, 18 nt, Bordetella pertussis
gacacgcuagggcguggc

SEQ ID NO: 2463420 - RNA, 20 nt, Bordetella pertussis
gacacgcuagggcguggcgc

SEQ ID NO: 2463421 - RNA, 14 nt, Bordetella pertussis
gacacgcuggcgga

SEQ ID NO: 2463422 - RNA, 15 nt, Bordetella pertussis
gacacgcuggcggac

SEQ ID NO: 2463423 - RNA, 19 nt, Bordetella pertussis
gacacggggcaaccggccu

SEQ ID NO: 2463424 - RNA, 20 nt, Bordetella pertussis
gacacguacaaccgcgccga

SEQ ID NO: 2463425 - RNA, 16 nt, Bordetella pertussis
gacagauagaacgagg

SEQ ID NO: 2463426 - RNA, 12 nt, Bordetella pertussis
gacagauggcgc

SEQ ID NO: 2463427 - RNA, 16 nt, Bordetella pertussis
gacagcaagggcagau

SEQ ID NO: 2463428 - RNA, 16 nt, Bordetella pertussis
gacagcaaugacgacg

SEQ ID NO: 2463429 - RNA, 17 nt, Bordetella pertussis
gacagcacauggcgcgc

SEQ ID NO: 2463430 - RNA, 21 nt, Bordetella pertussis
gacagcacauggcgcgccggc

SEQ ID NO: 2463431 - RNA, 22 nt, Bordetella pertussis
gacagcacauggcgcgccggcc

SEQ ID NO: 2463432 - RNA, 16 nt, Bordetella pertussis
gacagcagcaugcggc

SEQ ID NO: 2463433 - RNA, 19 nt, Bordetella pertussis
gacagcagcaugcggcccg

SEQ ID NO: 2463434 - RNA, 18 nt, Bordetella pertussis
gacagcagcccgcuggcc

SEQ ID NO: 2463435 - RNA, 19 nt, Bordetella pertussis
gacagcagcccgcuggccg

SEQ ID NO: 2463436 - RNA, 20 nt, Bordetella pertussis
gacagcagcccgcuggccga

SEQ ID NO: 2463437 - RNA, 20 nt, Bordetella pertussis
gacagcagggccaggcccac

SEQ ID NO: 2463438 - RNA, 17 nt, Bordetella pertussis
gacagcaguucggccgg

SEQ ID NO: 2463439 - RNA, 19 nt, Bordetella pertussis
gacagcaguucggccggcg

SEQ ID NO: 2463440 - RNA, 18 nt, Bordetella pertussis
gacagcaguuucugcacc

SEQ ID NO: 2463441 - RNA, 21 nt, Bordetella pertussis
gacagcaucuuggccgccacg

SEQ ID NO: 2463442 - RNA, 14 nt, Bordetella pertussis
gacagccacgcgcg

SEQ ID NO: 2463443 - RNA, 15 nt, Bordetella pertussis
gacagccaggccagc

SEQ ID NO: 2463444 - RNA, 16 nt, Bordetella pertussis
gacagccaggccagcg

SEQ ID NO: 2463445 - RNA, 18 nt, Bordetella pertussis
gacagccaggccagcgcc

SEQ ID NO: 2463446 - RNA, 19 nt, Bordetella pertussis
gacagccaggccagcgcca

SEQ ID NO: 2463447 - RNA, 17 nt, Bordetella pertussis
gacagccccagcagcac

SEQ ID NO: 2463448 - RNA, 19 nt, Bordetella pertussis
gacagccccagcagcacgc

SEQ ID NO: 2463449 - RNA, 14 nt, Bordetella pertussis
gacagcccgcgcug

SEQ ID NO: 2463450 - RNA, 16 nt, Bordetella pertussis
gacagcccgcgcuggc

SEQ ID NO: 2463451 - RNA, 18 nt, Bordetella pertussis
gacagcccgcgcuggcgc

SEQ ID NO: 2463452 - RNA, 19 nt, Bordetella pertussis
gacagcccgcgcuggcgca

SEQ ID NO: 2463453 - RNA, 12 nt, Bordetella pertussis
gacagccgcgcc

SEQ ID NO: 2463454 - RNA, 14 nt, Bordetella pertussis
gacagccgcgccag

SEQ ID NO: 2463455 - RNA, 15 nt, Bordetella pertussis
gacagccgcgccagc

SEQ ID NO: 2463456 - RNA, 20 nt, Bordetella pertussis
gacagccgcgccagcgccuc

SEQ ID NO: 2463457 - RNA, 21 nt, Bordetella pertussis
gacagccgcgccagcgccucc

SEQ ID NO: 2463458 - RNA, 17 nt, Bordetella pertussis
gacagccuuuccuccug

SEQ ID NO: 2463459 - RNA, 22 nt, Bordetella pertussis
gacagcgacagccaggccagcg

SEQ ID NO: 2463460 - RNA, 13 nt, Bordetella pertussis
gacagcgcgcagg

SEQ ID NO: 2463461 - RNA, 20 nt, Bordetella pertussis
gacagcgcgcaggaucagcu

SEQ ID NO: 2463462 - RNA, 13 nt, Bordetella pertussis
gacagcgcgcccg

SEQ ID NO: 2463463 - RNA, 14 nt, Bordetella pertussis
gacagcgcgcccgc

SEQ ID NO: 2463464 - RNA, 21 nt, Bordetella pertussis
gacagcgcgcccgcuugcgcg

SEQ ID NO: 2463465 - RNA, 17 nt, Bordetella pertussis
gacaggcaccgccgcac

SEQ ID NO: 2463466 - RNA, 18 nt, Bordetella pertussis
gacaggcaccucguucac

SEQ ID NO: 2463467 - RNA, 23 nt, Bordetella pertussis
gacaggcaccugcgaccgagcca

SEQ ID NO: 2463468 - RNA, 19 nt, Bordetella pertussis
gacaggcaccugcgguguc

SEQ ID NO: 2463469 - RNA, 20 nt, Bordetella pertussis
gacaggcaccugcggugucc

SEQ ID NO: 2463470 - RNA, 15 nt, Bordetella pertussis
gacaggcacgcgccg

SEQ ID NO: 2463471 - RNA, 23 nt, Bordetella pertussis
gacaggcacucuugccgcugcgc

SEQ ID NO: 2463472 - RNA, 22 nt, Bordetella pertussis
gacaggcagacgaugcccaggc

SEQ ID NO: 2463473 - RNA, 18 nt, Bordetella pertussis
gacaggccagugccugga

SEQ ID NO: 2463474 - RNA, 16 nt, Bordetella pertussis
gacaggcccgcggccg

SEQ ID NO: 2463475 - RNA, 13 nt, Bordetella pertussis
gacaggcgcagcu

SEQ ID NO: 2463476 - RNA, 15 nt, Bordetella pertussis
gacaggcgccacagg

SEQ ID NO: 2463477 - RNA, 11 nt, Bordetella pertussis
gacaggcgccc

SEQ ID NO: 2463478 - RNA, 13 nt, Bordetella pertussis
gacaggcgccgca

SEQ ID NO: 2463479 - RNA, 19 nt, Bordetella pertussis
gacaggcgccucgcgacgg

SEQ ID NO: 2463480 - RNA, 22 nt, Bordetella pertussis
gacaggcgccucgcgacggccu

SEQ ID NO: 2463481 - RNA, 23 nt, Bordetella pertussis
gacaggcgccucgcgacggccuc

SEQ ID NO: 2463482 - RNA, 11 nt, Bordetella pertussis
gacaggcgcgc

SEQ ID NO: 2463483 - RNA, 13 nt, Bordetella pertussis
gacaggcgcgcag

SEQ ID NO: 2463484 - RNA, 14 nt, Bordetella pertussis
gacaggcgcgcagg

SEQ ID NO: 2463485 - RNA, 15 nt, Bordetella pertussis
gacaggcgcgcaggc

SEQ ID NO: 2463486 - RNA, 13 nt, Bordetella pertussis
gacaggcgcgcca

SEQ ID NO: 2463487 - RNA, 14 nt, Bordetella pertussis
gacaggcgcgccau

SEQ ID NO: 2463488 - RNA, 16 nt, Bordetella pertussis
gacaggcgcgccaucc

SEQ ID NO: 2463489 - RNA, 14 nt, Bordetella pertussis
gacaggcgcgcccg

SEQ ID NO: 2463490 - RNA, 15 nt, Bordetella pertussis
gacaggcgcgcccgc

SEQ ID NO: 2463491 - RNA, 17 nt, Bordetella pertussis
gacaggcggugcgcgcg

SEQ ID NO: 2463492 - RNA, 22 nt, Bordetella pertussis
gacaggcggugcgcgcggccga

SEQ ID NO: 2463493 - RNA, 15 nt, Bordetella pertussis
gacaggcgugcgcag

SEQ ID NO: 2463494 - RNA, 19 nt, Bordetella pertussis
gacaggcucccgcuggcgg

SEQ ID NO: 2463495 - RNA, 19 nt, Bordetella pertussis
gacaggcuccgagggacac

SEQ ID NO: 2463496 - RNA, 18 nt, Bordetella pertussis
gacagggccccggccucc

SEQ ID NO: 2463497 - RNA, 13 nt, Bordetella pertussis
gacagggccgcga

SEQ ID NO: 2463498 - RNA, 16 nt, Bordetella pertussis
gacagggccgcgagca

SEQ ID NO: 2463499 - RNA, 19 nt, Bordetella pertussis
gacaggggccucaugacgg

SEQ ID NO: 2463500 - RNA, 16 nt, Bordetella pertussis
gacaggguccaggugg

SEQ ID NO: 2463501 - RNA, 18 nt, Bordetella pertussis
gacagguaggcgccgguc

SEQ ID NO: 2463502 - RNA, 16 nt, Bordetella pertussis
gacaggucggcgccca

SEQ ID NO: 2463503 - RNA, 16 nt, Bordetella pertussis
gacaucgccgcugcgc

SEQ ID NO: 2463504 - RNA, 20 nt, Bordetella pertussis
gacaucgccgcugcgcagca

SEQ ID NO: 2463505 - RNA, 22 nt, Bordetella pertussis
gacaucgccgcugcgcagcagc

SEQ ID NO: 2463506 - RNA, 23 nt, Bordetella pertussis
gacaucgccgcugcgcagcagcg

SEQ ID NO: 2463507 - RNA, 15 nt, Bordetella pertussis
gacaugagcugcgcg

SEQ ID NO: 2463508 - RNA, 14 nt, Bordetella pertussis
gacaugcccgccgg

SEQ ID NO: 2463509 - RNA, 16 nt, Bordetella pertussis
gacaugcccgccggca

SEQ ID NO: 2463510 - RNA, 19 nt, Bordetella pertussis
gacaugccgccccaggcgu

SEQ ID NO: 2463511 - RNA, 19 nt, Bordetella pertussis
gacaugcucgaugccggcc

SEQ ID NO: 2463512 - RNA, 17 nt, Bordetella pertussis
gacaugcugcgacagca

SEQ ID NO: 2463513 - RNA, 14 nt, Bordetella pertussis
gacaugcuggccca

SEQ ID NO: 2463514 - RNA, 15 nt, Bordetella pertussis
gacaugcuggcccag

SEQ ID NO: 2463515 - RNA, 14 nt, Bordetella pertussis
gacauggcgcgcgc

SEQ ID NO: 2463516 - RNA, 16 nt, Bordetella pertussis
gacauggcgcgcgcca

SEQ ID NO: 2463517 - RNA, 14 nt, Bordetella pertussis
gacauugcccagca

SEQ ID NO: 2463518 - RNA, 21 nt, Bordetella pertussis
gacauugucaagcagcgccgg

SEQ ID NO: 2463519 - RNA, 22 nt, Bordetella pertussis
gacauugucaagcagcgccggc

SEQ ID NO: 2463520 - RNA, 17 nt, Bordetella pertussis
gaccaacucgaggcggc

SEQ ID NO: 2463521 - RNA, 19 nt, Bordetella pertussis
gaccaacucgaggcggcgc

SEQ ID NO: 2463522 - RNA, 13 nt, Bordetella pertussis
gaccaagcgccac

SEQ ID NO: 2463523 - RNA, 15 nt, Bordetella pertussis
gaccaagcgccacag

SEQ ID NO: 2463524 - RNA, 17 nt, Bordetella pertussis
gaccaagcgccacagcg

SEQ ID NO: 2463525 - RNA, 19 nt, Bordetella pertussis
gaccaauacgccgccaugg

SEQ ID NO: 2463526 - RNA, 21 nt, Bordetella pertussis
gaccacacgaucgucagcagc

SEQ ID NO: 2463527 - RNA, 13 nt, Bordetella pertussis
gaccaccagcacc

SEQ ID NO: 2463528 - RNA, 17 nt, Bordetella pertussis
gaccaccagcaccaugc

SEQ ID NO: 2463529 - RNA, 14 nt, Bordetella pertussis
gaccaccagcaccg

SEQ ID NO: 2463530 - RNA, 13 nt, Bordetella pertussis
gaccaccagcagg

SEQ ID NO: 2463531 - RNA, 14 nt, Bordetella pertussis
gaccaccagcagga

SEQ ID NO: 2463532 - RNA, 14 nt, Bordetella pertussis
gaccaccagcaucg

SEQ ID NO: 2463533 - RNA, 14 nt, Bordetella pertussis
gaccaccagcguca

SEQ ID NO: 2463534 - RNA, 14 nt, Bordetella pertussis
gaccaccaggccgc

SEQ ID NO: 2463535 - RNA, 15 nt, Bordetella pertussis
gaccaccccgagaua

SEQ ID NO: 2463536 - RNA, 14 nt, Bordetella pertussis
gaccacccgcgcca

SEQ ID NO: 2463537 - RNA, 17 nt, Bordetella pertussis
gaccacccgcgccagga

SEQ ID NO: 2463538 - RNA, 22 nt, Bordetella pertussis
gaccaccggcuugggcgugccc

SEQ ID NO: 2463539 - RNA, 23 nt, Bordetella pertussis
gaccaccgucuugcccgccagcg

SEQ ID NO: 2463540 - RNA, 19 nt, Bordetella pertussis
gaccaccugcaccgccgcg

SEQ ID NO: 2463541 - RNA, 16 nt, Bordetella pertussis
gaccacgaccuuggcg

SEQ ID NO: 2463542 - RNA, 19 nt, Bordetella pertussis
gaccgacagcacauggcgc

SEQ ID NO: 2463543 - RNA, 16 nt, Bordetella pertussis
gaccgacaggccuggc

SEQ ID NO: 2463544 - RNA, 14 nt, Bordetella pertussis
gaccgacaggcggc

SEQ ID NO: 2463545 - RNA, 15 nt, Bordetella pertussis
gaccgacaggcggcu

SEQ ID NO: 2463546 - RNA, 15 nt, Bordetella pertussis
gaccgacggccugga

SEQ ID NO: 2463547 - RNA, 16 nt, Bordetella pertussis
gaccgacggccuggag

SEQ ID NO: 2463548 - RNA, 18 nt, Bordetella pertussis
gaccgacggccuggaggc

SEQ ID NO: 2463549 - RNA, 18 nt, Bordetella pertussis
gaccgacgugcgccgcau

SEQ ID NO: 2463550 - RNA, 12 nt, Bordetella pertussis
gaccgagccaca

SEQ ID NO: 2463551 - RNA, 14 nt, Bordetella pertussis
gaccgagcccggca

SEQ ID NO: 2463552 - RNA, 20 nt, Bordetella pertussis
gaccgagcccggcaccaugc

SEQ ID NO: 2463553 - RNA, 21 nt, Bordetella pertussis
gaccgagcccggcaccaugcg

SEQ ID NO: 2463554 - RNA, 21 nt, Bordetella pertussis
gaccgagccggccagcgccug

SEQ ID NO: 2463555 - RNA, 19 nt, Bordetella pertussis
gaccgagggcgcguccaag

SEQ ID NO: 2463556 - RNA, 16 nt, Bordetella pertussis
gaccgcacgauggcgc

SEQ ID NO: 2463557 - RNA, 19 nt, Bordetella pertussis
gaccgcacgauggcgcgcg

SEQ ID NO: 2463558 - RNA, 20 nt, Bordetella pertussis
gaccgcaggggauugccgcg

SEQ ID NO: 2463559 - RNA, 22 nt, Bordetella pertussis
gaccgcaggggauugccgcgcg

SEQ ID NO: 2463560 - RNA, 23 nt, Bordetella pertussis
gaccgcaggggauugccgcgcgg

SEQ ID NO: 2463561 - RNA, 15 nt, Bordetella pertussis
gaccgcaugcggcac

SEQ ID NO: 2463562 - RNA, 13 nt, Bordetella pertussis
gaccgcaugcugc

SEQ ID NO: 2463563 - RNA, 20 nt, Bordetella pertussis
gaccgccagcaggcccuggg

SEQ ID NO: 2463564 - RNA, 23 nt, Bordetella pertussis
gaccgccagcaggcccugggcca

SEQ ID NO: 2463565 - RNA, 16 nt, Bordetella pertussis
gaccgccagcaggcgc

SEQ ID NO: 2463566 - RNA, 22 nt, Bordetella pertussis
gaccgccagcaggcgcucggcu

SEQ ID NO: 2463567 - RNA, 19 nt, Bordetella pertussis
gaccgccagcauccagccg

SEQ ID NO: 2463568 - RNA, 23 nt, Bordetella pertussis
gaccgccaugcgcauggccagcg

SEQ ID NO: 2463569 - RNA, 19 nt, Bordetella pertussis
gaccgccgccacgcgcacg

SEQ ID NO: 2463570 - RNA, 14 nt, Bordetella pertussis
gaccgccgccagca

SEQ ID NO: 2463571 - RNA, 17 nt, Bordetella pertussis
gaccgccgccagcagcg

SEQ ID NO: 2463572 - RNA, 20 nt, Bordetella pertussis
gaccgccgccagcagcgccg

SEQ ID NO: 2463573 - RNA, 14 nt, Bordetella pertussis
gaccgccgccgucg

SEQ ID NO: 2463574 - RNA, 22 nt, Bordetella pertussis
gaccgccgccuuggacgcgcug

SEQ ID NO: 2463575 - RNA, 16 nt, Bordetella pertussis
gaccgccgcgcccagc

SEQ ID NO: 2463576 - RNA, 15 nt, Bordetella pertussis
gaccgccgcgccggu

SEQ ID NO: 2463577 - RNA, 23 nt, Bordetella pertussis
gaccgccgcgccgguggccagca

SEQ ID NO: 2463578 - RNA, 14 nt, Bordetella pertussis
gaccgccuccagcg

SEQ ID NO: 2463579 - RNA, 16 nt, Bordetella pertussis
gaccgccuccagcgcg

SEQ ID NO: 2463580 - RNA, 23 nt, Bordetella pertussis
gaccgccuccagcgcggcgggcg

SEQ ID NO: 2463581 - RNA, 21 nt, Bordetella pertussis
gaccgccuccaggaugagcgc

SEQ ID NO: 2463582 - RNA, 23 nt, Bordetella pertussis
gaccgccuccaggaugagcgccu

SEQ ID NO: 2463583 - RNA, 17 nt, Bordetella pertussis
gaccgccucgacgcccg

SEQ ID NO: 2463584 - RNA, 12 nt, Bordetella pertussis
gaccgccucgau

SEQ ID NO: 2463585 - RNA, 17 nt, Bordetella pertussis
gaccgccucgaugcccu

SEQ ID NO: 2463586 - RNA, 15 nt, Bordetella pertussis
gaccgccuucuuucg

SEQ ID NO: 2463587 - RNA, 16 nt, Bordetella pertussis
gaccgcgaagccgccc

SEQ ID NO: 2463588 - RNA, 17 nt, Bordetella pertussis
gaccgcgaagccgcccg

SEQ ID NO: 2463589 - RNA, 21 nt, Bordetella pertussis
gaccgcgacccgauagccgcg

SEQ ID NO: 2463590 - RNA, 16 nt, Bordetella pertussis
gaccgcgacgcgccug

SEQ ID NO: 2463591 - RNA, 17 nt, Bordetella pertussis
gaccgcgacgcgccugc

SEQ ID NO: 2463592 - RNA, 14 nt, Bordetella pertussis
gaccgcgaugcugc

SEQ ID NO: 2463593 - RNA, 16 nt, Bordetella pertussis
gaccgcgaugcugcgc

SEQ ID NO: 2463594 - RNA, 17 nt, Bordetella pertussis
gaccgcgaugcugcgca

SEQ ID NO: 2463595 - RNA, 18 nt, Bordetella pertussis
gaccgcgaugcugcgcaa

SEQ ID NO: 2463596 - RNA, 15 nt, Bordetella pertussis
gaccgcgccgccgcg

SEQ ID NO: 2463597 - RNA, 16 nt, Bordetella pertussis
gaccgcgccgccgcgc

SEQ ID NO: 2463598 - RNA, 23 nt, Bordetella pertussis
gaccgcgccugggggcuggaggc

SEQ ID NO: 2463599 - RNA, 14 nt, Bordetella pertussis
gaccgcgcgcacca

SEQ ID NO: 2463600 - RNA, 13 nt, Bordetella pertussis
gaccgcgcggcgc

SEQ ID NO: 2463601 - RNA, 15 nt, Bordetella pertussis
gaccgcgcggcgcug

SEQ ID NO: 2463602 - RNA, 16 nt, Bordetella pertussis
gaccgcgcggcgcugc

SEQ ID NO: 2463603 - RNA, 19 nt, Bordetella pertussis
gaccgcgcggcgcugcacg

SEQ ID NO: 2463604 - RNA, 22 nt, Bordetella pertussis
gaccugcgggcgcagcgccgcu

SEQ ID NO: 2463605 - RNA, 15 nt, Bordetella pertussis
gaccugcucgagcgg

SEQ ID NO: 2463606 - RNA, 23 nt, Bordetella pertussis
gaccugcucgucgccaugcggcu

SEQ ID NO: 2463607 - RNA, 22 nt, Bordetella pertussis
gaccugcuggcguuugcgcgcg

SEQ ID NO: 2463608 - RNA, 20 nt, Bordetella pertussis
gaccugcuugaagcggucga

SEQ ID NO: 2463609 - RNA, 15 nt, Bordetella pertussis
gaccuggacgagggc

SEQ ID NO: 2463610 - RNA, 19 nt, Bordetella pertussis
gaccuggacgagggccgcg

SEQ ID NO: 2463611 - RNA, 11 nt, Bordetella pertussis
gaccugggcca

SEQ ID NO: 2463612 - RNA, 14 nt, Bordetella pertussis
gaccugggccagca

SEQ ID NO: 2463613 - RNA, 17 nt, Bordetella pertussis
gaccugggccagcaggu

SEQ ID NO: 2463614 - RNA, 14 nt, Bordetella pertussis
gaccugggccuggu

SEQ ID NO: 2463615 - RNA, 22 nt, Bordetella pertussis
gaccugggccugguacaggccg

SEQ ID NO: 2463616 - RNA, 17 nt, Bordetella pertussis
gaccuggggguucgugg

SEQ ID NO: 2463617 - RNA, 23 nt, Bordetella pertussis
gaccuggggguucgugggcgagc

SEQ ID NO: 2463618 - RNA, 19 nt, Bordetella pertussis
gaccuggucgaucagcccc

SEQ ID NO: 2463619 - RNA, 14 nt, Bordetella pertussis
gaccuggucggccu

SEQ ID NO: 2463620 - RNA, 17 nt, Bordetella pertussis
gaccuggucgggcguga

SEQ ID NO: 2463621 - RNA, 22 nt, Bordetella pertussis
gaccuggucgggcgugagcgcc

SEQ ID NO: 2463622 - RNA, 16 nt, Bordetella pertussis
gaccuggugaucgcgc

SEQ ID NO: 2463623 - RNA, 17 nt, Bordetella pertussis
gaccuggugugccuguc

SEQ ID NO: 2463624 - RNA, 21 nt, Bordetella pertussis
gaccuugagaugccagcggcg

SEQ ID NO: 2463625 - RNA, 16 nt, Bordetella pertussis
gaccuugccgauccag

SEQ ID NO: 2463626 - RNA, 20 nt, Bordetella pertussis
gaccuugccgauccagcgcc

SEQ ID NO: 2463627 - RNA, 21 nt, Bordetella pertussis
gaccuugccgauccagcgccu

SEQ ID NO: 2463628 - RNA, 20 nt, Bordetella pertussis
gaccuugcgcgacggcgaug

SEQ ID NO: 2463629 - RNA, 17 nt, Bordetella pertussis
gaccuugcggccgcgca

SEQ ID NO: 2463630 - RNA, 13 nt, Bordetella pertussis
gaccuuggcggcc

SEQ ID NO: 2463631 - RNA, 14 nt, Bordetella pertussis
gaccuuggcggcug

SEQ ID NO: 2463632 - RNA, 19 nt, Bordetella pertussis
gaccuuggcggcuggcgcg

SEQ ID NO: 2463633 - RNA, 23 nt, Bordetella pertussis
gaccuuggucggguccagcacgc

SEQ ID NO: 2463634 - RNA, 14 nt, Bordetella pertussis
gacgaaagcggcaa

SEQ ID NO: 2463635 - RNA, 23 nt, Bordetella pertussis
gacgaaagcggcaaagccgcugc

SEQ ID NO: 2463636 - RNA, 12 nt, Bordetella pertussis
gacgaacaacac

SEQ ID NO: 2463637 - RNA, 18 nt, Bordetella pertussis
gacgaacaacacgaugau

SEQ ID NO: 2463638 - RNA, 14 nt, Bordetella pertussis
gacgaacaggccgc

SEQ ID NO: 2463639 - RNA, 13 nt, Bordetella pertussis
gacgaagccgggu

SEQ ID NO: 2463640 - RNA, 18 nt, Bordetella pertussis
gacgaagccuaggcugca

SEQ ID NO: 2463641 - RNA, 19 nt, Bordetella pertussis
gacgaaggcgccggccagg

SEQ ID NO: 2463642 - RNA, 19 nt, Bordetella pertussis
gacgaagucccagccggcc

SEQ ID NO: 2463643 - RNA, 17 nt, Bordetella pertussis
gacgaauacgcuggcgc

SEQ ID NO: 2463644 - RNA, 17 nt, Bordetella pertussis
gacgaauuucucggcca

SEQ ID NO: 2463645 - RNA, 20 nt, Bordetella pertussis
gacgaauuucucggccagcg

SEQ ID NO: 2463646 - RNA, 22 nt, Bordetella pertussis
gacgaauuucucggccagcgcc

SEQ ID NO: 2463647 - RNA, 14 nt, Bordetella pertussis
gacgacagcggcga

SEQ ID NO: 2463648 - RNA, 21 nt, Bordetella pertussis
gacgaccaaccugaccgccuu

SEQ ID NO: 2463649 - RNA, 17 nt, Bordetella pertussis
gacgaccccgccgugcc

SEQ ID NO: 2463650 - RNA, 21 nt, Bordetella pertussis
gacgaccccgccgugccgggc

SEQ ID NO: 2463651 - RNA, 15 nt, Bordetella pertussis
gacgaccgaaaagcc

SEQ ID NO: 2463652 - RNA, 13 nt, Bordetella pertussis
gacgaccgcgacc

SEQ ID NO: 2463653 - RNA, 19 nt, Bordetella pertussis
gacgaccuugcccgucagc

SEQ ID NO: 2463654 - RNA, 17 nt, Bordetella pertussis
gacgaccuugcggccgc

SEQ ID NO: 2463655 - RNA, 19 nt, Bordetella pertussis
gacgaccuugcggccgcgc

SEQ ID NO: 2463656 - RNA, 20 nt, Bordetella pertussis
gacgaccuugcggccgcgca

SEQ ID NO: 2463657 - RNA, 14 nt, Bordetella pertussis
gacgaccuugcugg

SEQ ID NO: 2463658 - RNA, 16 nt, Bordetella pertussis
gacgaccuugcuggac

SEQ ID NO: 2463659 - RNA, 23 nt, Bordetella pertussis
gacgacgaaacccgggccgucgc

SEQ ID NO: 2463660 - RNA, 13 nt, Bordetella pertussis
gacgacgccggcu

SEQ ID NO: 2463661 - RNA, 20 nt, Bordetella pertussis
gacgacgcgguaguuggggg

SEQ ID NO: 2463662 - RNA, 22 nt, Bordetella pertussis
gacgacgcguuguucgggccgg

SEQ ID NO: 2463663 - RNA, 20 nt, Bordetella pertussis
gacgccggcggcgugcgccu

SEQ ID NO: 2463664 - RNA, 23 nt, Bordetella pertussis
gacgccggcggcgugcgccugcu

SEQ ID NO: 2463665 - RNA, 15 nt, Bordetella pertussis
gacgccggcucaggc

SEQ ID NO: 2463666 - RNA, 20 nt, Bordetella pertussis
gacgccggcuucagccgcaa

SEQ ID NO: 2463667 - RNA, 15 nt, Bordetella pertussis
gacgccggcuuucag

SEQ ID NO: 2463668 - RNA, 19 nt, Bordetella pertussis
gacgccgguguagcugccc

SEQ ID NO: 2463669 - RNA, 20 nt, Bordetella pertussis
gacgccgguguagcugcccg

SEQ ID NO: 2463670 - RNA, 17 nt, Bordetella pertussis
gacgccguacugggcac

SEQ ID NO: 2463671 - RNA, 20 nt, Bordetella pertussis
gacgccguacugggcaccac

SEQ ID NO: 2463672 - RNA, 16 nt, Bordetella pertussis
gacgccgucgcggacc

SEQ ID NO: 2463673 - RNA, 17 nt, Bordetella pertussis
gacgccgucgcggaccu

SEQ ID NO: 2463674 - RNA, 14 nt, Bordetella pertussis
gacgccgugguggu

SEQ ID NO: 2463675 - RNA, 14 nt, Bordetella pertussis
gacgccucgccggu

SEQ ID NO: 2463676 - RNA, 13 nt, Bordetella pertussis
gacgccuggaccg

SEQ ID NO: 2463677 - RNA, 16 nt, Bordetella pertussis
gacgccuggcgcggcc

SEQ ID NO: 2463678 - RNA, 23 nt, Bordetella pertussis
gacgccuuccuugaacugcgcgg

SEQ ID NO: 2463679 - RNA, 22 nt, Bordetella pertussis
gacgcgaaccaggccaccgcgg

SEQ ID NO: 2463680 - RNA, 18 nt, Bordetella pertussis
gacgcgaagaucccgccg

SEQ ID NO: 2463681 - RNA, 22 nt, Bordetella pertussis
gacgcgacacgcagcaacggug

SEQ ID NO: 2463682 - RNA, 14 nt, Bordetella pertussis
gacgcgacgcgacg

SEQ ID NO: 2463683 - RNA, 17 nt, Bordetella pertussis
gacgcgacgcgggcggc

SEQ ID NO: 2463684 - RNA, 22 nt, Bordetella pertussis
gacgcgaggcagaaguggucgc

SEQ ID NO: 2463685 - RNA, 17 nt, Bordetella pertussis
gacgcgauacugcgcau

SEQ ID NO: 2463686 - RNA, 21 nt, Bordetella pertussis
gacgcgauacugcgcaugggc

SEQ ID NO: 2463687 - RNA, 16 nt, Bordetella pertussis
gacgcgauguccagcu

SEQ ID NO: 2463688 - RNA, 18 nt, Bordetella pertussis
gacgcgauguccagcucc

SEQ ID NO: 2463689 - RNA, 13 nt, Bordetella pertussis
gacgcgcaggcca

SEQ ID NO: 2463690 - RNA, 17 nt, Bordetella pertussis
gacgcgcaggccauugc

SEQ ID NO: 2463691 - RNA, 22 nt, Bordetella pertussis
gacgcgcaggccauugcuggcg

SEQ ID NO: 2463692 - RNA, 23 nt, Bordetella pertussis
gacgcgcaggccauugcuggcgc

SEQ ID NO: 2463693 - RNA, 22 nt, Bordetella pertussis
gacgcgccgaacaccagcucgg

SEQ ID NO: 2463694 - RNA, 16 nt, Bordetella pertussis
gacgcgccggaugcgc

SEQ ID NO: 2463695 - RNA, 21 nt, Bordetella pertussis
gacgcgccggaugcgcguggc

SEQ ID NO: 2463696 - RNA, 23 nt, Bordetella pertussis
gacgcgccggaugcgcguggcgc

SEQ ID NO: 2463697 - RNA, 13 nt, Bordetella pertussis
gacgcgcgccggc

SEQ ID NO: 2463698 - RNA, 14 nt, Bordetella pertussis
gacgcgcgccggcg

SEQ ID NO: 2463699 - RNA, 17 nt, Bordetella pertussis
gacgcgcgccggcgcuc

SEQ ID NO: 2463700 - RNA, 16 nt, Bordetella pertussis
gacgcgcgcggcgacc

SEQ ID NO: 2463701 - RNA, 17 nt, Bordetella pertussis
gacgcgcgcggcgaccg

SEQ ID NO: 2463702 - RNA, 19 nt, Bordetella pertussis
gacgcgcgcggcgaccgcg

SEQ ID NO: 2463703 - RNA, 20 nt, Bordetella pertussis
gacgcgcgcggugucgccgc

SEQ ID NO: 2463704 - RNA, 21 nt, Bordetella pertussis
gacgcgcggguccaggcccga

SEQ ID NO: 2463705 - RNA, 13 nt, Bordetella pertussis
gacgcgcucgccg

SEQ ID NO: 2463706 - RNA, 14 nt, Bordetella pertussis
gacgcgcucgccgu

SEQ ID NO: 2463707 - RNA, 13 nt, Bordetella pertussis
gacgcgcucgcgc

SEQ ID NO: 2463708 - RNA, 16 nt, Bordetella pertussis
gacgcgcucgcgcgcg

SEQ ID NO: 2463709 - RNA, 17 nt, Bordetella pertussis
gacgcgcucgcgcgcgu

SEQ ID NO: 2463710 - RNA, 15 nt, Bordetella pertussis
gacgcgcucgucgaa

SEQ ID NO: 2463711 - RNA, 15 nt, Bordetella pertussis
gacgcgcugaugcgc

SEQ ID NO: 2463712 - RNA, 19 nt, Bordetella pertussis
gacgcgcugccggaaaccc

SEQ ID NO: 2463713 - RNA, 13 nt, Bordetella pertussis
gacgcgcuggccg

SEQ ID NO: 2463714 - RNA, 17 nt, Bordetella pertussis
gacgcgcuguaggcgcc

SEQ ID NO: 2463715 - RNA, 20 nt, Bordetella pertussis
gacgcgcuguaggcgccggc

SEQ ID NO: 2463716 - RNA, 22 nt, Bordetella pertussis
gacgcgcuguaggcgccggcgc

SEQ ID NO: 2463717 - RNA, 17 nt, Bordetella pertussis
gacgcgcuuccaggagu

SEQ ID NO: 2463718 - RNA, 20 nt, Bordetella pertussis
gacgcgcuugacguccagcg

SEQ ID NO: 2463719 - RNA, 21 nt, Bordetella pertussis
gacgcgcuugacguccagcga

SEQ ID NO: 2463720 - RNA, 22 nt, Bordetella pertussis
gacgcgcuuuuccccgcccagc

SEQ ID NO: 2463721 - RNA, 23 nt, Bordetella pertussis
gacgcgcuuuuccccgcccagcg

SEQ ID NO: 2463722 - RNA, 15 nt, Bordetella pertussis
gacgcggcagggcca

SEQ ID NO: 2463723 - RNA, 16 nt, Bordetella pertussis
gacgcggccagcggcg

SEQ ID NO: 2463724 - RNA, 12 nt, Bordetella pertussis
gacgcggcgacg

SEQ ID NO: 2463725 - RNA, 11 nt, Bordetella pertussis
gacgcggcggc

SEQ ID NO: 2463726 - RNA, 18 nt, Bordetella pertussis
gacgcggcguacuggcgc

SEQ ID NO: 2463727 - RNA, 19 nt, Bordetella pertussis
gacgcggcguacuggcgcg

SEQ ID NO: 2463728 - RNA, 20 nt, Bordetella pertussis
gacgcggcguacuggcgcgg

SEQ ID NO: 2463729 - RNA, 21 nt, Bordetella pertussis
gacgcggcguacuggcgcggc

SEQ ID NO: 2463730 - RNA, 12 nt, Bordetella pertussis
gacgcgggcggc

SEQ ID NO: 2463731 - RNA, 15 nt, Bordetella pertussis
gacgcgggcggccga

SEQ ID NO: 2463732 - RNA, 14 nt, Bordetella pertussis
gacgcggggacagg

SEQ ID NO: 2463733 - RNA, 16 nt, Bordetella pertussis
gacgcggggacaggca

SEQ ID NO: 2463734 - RNA, 18 nt, Bordetella pertussis
gacgcggggacaggcaca

SEQ ID NO: 2463735 - RNA, 19 nt, Bordetella pertussis
gacgcggggacaggcacac

SEQ ID NO: 2463736 - RNA, 21 nt, Bordetella pertussis
gacgcggggacaggcacacca

SEQ ID NO: 2463737 - RNA, 19 nt, Bordetella pertussis
gacgcguacgaucuucugg

SEQ ID NO: 2463738 - RNA, 16 nt, Bordetella pertussis
gacgcguccucggcca

SEQ ID NO: 2463739 - RNA, 17 nt, Bordetella pertussis
gacgcguccucggccag

SEQ ID NO: 2463740 - RNA, 18 nt, Bordetella pertussis
gacgcguccucggccagc

SEQ ID NO: 2463741 - RNA, 16 nt, Bordetella pertussis
gacgcguucgccgucg

SEQ ID NO: 2463742 - RNA, 21 nt, Bordetella pertussis
gacgcguuguucgggccggcu

SEQ ID NO: 2463743 - RNA, 19 nt, Bordetella pertussis
gacgcucauccaggcgcgu

SEQ ID NO: 2463744 - RNA, 18 nt, Bordetella pertussis
gacgcugacccuggccga

SEQ ID NO: 2463745 - RNA, 18 nt, Bordetella pertussis
gacgcugaccgagggcgc

SEQ ID NO: 2463746 - RNA, 12 nt, Bordetella pertussis
gacgcugaucgg

SEQ ID NO: 2463747 - RNA, 21 nt, Bordetella pertussis
gacgcugaucggccgacugcu

SEQ ID NO: 2463748 - RNA, 17 nt, Bordetella pertussis
gacgcugaucucggccu

SEQ ID NO: 2463749 - RNA, 19 nt, Bordetella pertussis
gacgcugaucucggccugc

SEQ ID NO: 2463750 - RNA, 18 nt, Bordetella pertussis
gacgcugauggccgccag

SEQ ID NO: 2463751 - RNA, 20 nt, Bordetella pertussis
gacgcugauggccgccagcg

SEQ ID NO: 2463752 - RNA, 23 nt, Bordetella pertussis
gacgcugauggccgccagcggcu

SEQ ID NO: 2463753 - RNA, 17 nt, Bordetella pertussis
gacgcuggagauggcgc

SEQ ID NO: 2463754 - RNA, 18 nt, Bordetella pertussis
gacgcuggagauggcgcc

SEQ ID NO: 2463755 - RNA, 21 nt, Bordetella pertussis
gacgcuggagauggcgccgau

SEQ ID NO: 2463756 - RNA, 13 nt, Bordetella pertussis
gacgcuggagcgc

SEQ ID NO: 2463757 - RNA, 15 nt, Bordetella pertussis
gacgcuggagcgcgg

SEQ ID NO: 2463758 - RNA, 16 nt, Bordetella pertussis
gacgcuggagcgcggc

SEQ ID NO: 2463759 - RNA, 20 nt, Bordetella pertussis
gacgcuggagcgcggcggcg

SEQ ID NO: 2463760 - RNA, 20 nt, Bordetella pertussis
gacgcuggcgaugcccacca

SEQ ID NO: 2463761 - RNA, 22 nt, Bordetella pertussis
gacgcuggucgagagccugggc

SEQ ID NO: 2463762 - RNA, 16 nt, Bordetella pertussis
gacgcuguaacaacac

SEQ ID NO: 2463763 - RNA, 17 nt, Bordetella pertussis
gacgcuguaacaacacg

SEQ ID NO: 2463764 - RNA, 16 nt, Bordetella pertussis
gacgcuguagaggcgc

SEQ ID NO: 2463765 - RNA, 17 nt, Bordetella pertussis
gacgcuguagaggcgcg

SEQ ID NO: 2463766 - RNA, 18 nt, Bordetella pertussis
gacgcuguagaggcgcgg

SEQ ID NO: 2463767 - RNA, 20 nt, Bordetella pertussis
gacgcuguagaggcgcggcu

SEQ ID NO: 2463768 - RNA, 17 nt, Bordetella pertussis
gacgcuguuggucaggu

SEQ ID NO: 2463769 - RNA, 15 nt, Bordetella pertussis
gacgcuucaggccgu

SEQ ID NO: 2463770 - RNA, 14 nt, Bordetella pertussis
gacgcuugccggcg

SEQ ID NO: 2463771 - RNA, 16 nt, Bordetella pertussis
gacgcuuucggggcgc

SEQ ID NO: 2463772 - RNA, 18 nt, Bordetella pertussis
gacggacuggcuggucag

SEQ ID NO: 2463773 - RNA, 20 nt, Bordetella pertussis
gacggacuggcuggucaggc

SEQ ID NO: 2463774 - RNA, 19 nt, Bordetella pertussis
gacggaugggcgccgugcc

SEQ ID NO: 2463775 - RNA, 15 nt, Bordetella pertussis
gacggauucgcccag

SEQ ID NO: 2463776 - RNA, 17 nt, Bordetella pertussis
gacggcaaucuugccgc

SEQ ID NO: 2463777 - RNA, 19 nt, Bordetella pertussis
gagcgaaagccgucggcca

SEQ ID NO: 2463778 - RNA, 17 nt, Bordetella pertussis
gagcgaaauggcggccu

SEQ ID NO: 2463779 - RNA, 20 nt, Bordetella pertussis
gagcgaaauggcggccucgg

SEQ ID NO: 2463780 - RNA, 18 nt, Bordetella pertussis
gagcgaaugcgcguaguc

SEQ ID NO: 2463781 - RNA, 21 nt, Bordetella pertussis
gagcgacacccgcggccaggg

SEQ ID NO: 2463782 - RNA, 17 nt, Bordetella pertussis
gagcgacaugucgccgc

SEQ ID NO: 2463783 - RNA, 18 nt, Bordetella pertussis
gagcgacccguggcccgg

SEQ ID NO: 2463784 - RNA, 16 nt, Bordetella pertussis
gagcgacggcagaugg

SEQ ID NO: 2463785 - RNA, 13 nt, Bordetella pertussis
gagcgaugcccug

SEQ ID NO: 2463786 - RNA, 16 nt, Bordetella pertussis
gagcgcaagcaccgcc

SEQ ID NO: 2463787 - RNA, 14 nt, Bordetella pertussis
gagcgcacaggcgg

SEQ ID NO: 2463788 - RNA, 16 nt, Bordetella pertussis
gagcgcacaggcggcg

SEQ ID NO: 2463789 - RNA, 17 nt, Bordetella pertussis
gagcgcaccauggcgcc

SEQ ID NO: 2463790 - RNA, 21 nt, Bordetella pertussis
gagcgcaccauggcgcccacg

SEQ ID NO: 2463791 - RNA, 23 nt, Bordetella pertussis
gagcgcaccauggcgcccacggc

SEQ ID NO: 2463792 - RNA, 12 nt, Bordetella pertussis
gagcgcaccccg

SEQ ID NO: 2463793 - RNA, 13 nt, Bordetella pertussis
gagcgcaccccgg

SEQ ID NO: 2463794 - RNA, 15 nt, Bordetella pertussis
gagcgcaccccggcc

SEQ ID NO: 2463795 - RNA, 20 nt, Bordetella pertussis
gagcgcagcaagcugcugcu

SEQ ID NO: 2463796 - RNA, 13 nt, Bordetella pertussis
gagcgcagccgcu

SEQ ID NO: 2463797 - RNA, 21 nt, Bordetella pertussis
gagcgccacauaaucgucggc

SEQ ID NO: 2463798 - RNA, 19 nt, Bordetella pertussis
gagcgccacgccagcggcg

SEQ ID NO: 2463799 - RNA, 22 nt, Bordetella pertussis
gagcgccagcucggccaaggca

SEQ ID NO: 2463800 - RNA, 12 nt, Bordetella pertussis
gagcgccgaacc

SEQ ID NO: 2463801 - RNA, 15 nt, Bordetella pertussis
gagcgccgacgggcc

SEQ ID NO: 2463802 - RNA, 14 nt, Bordetella pertussis
gagcgccgccaggc

SEQ ID NO: 2463803 - RNA, 19 nt, Bordetella pertussis
gagcgccgccaggccgucg

SEQ ID NO: 2463804 - RNA, 16 nt, Bordetella pertussis
gagcgccgccgccaug

SEQ ID NO: 2463805 - RNA, 12 nt, Bordetella pertussis
gagcgccgcgcu

SEQ ID NO: 2463806 - RNA, 14 nt, Bordetella pertussis
gagcgccgcguggu

SEQ ID NO: 2463807 - RNA, 22 nt, Bordetella pertussis
gagcgccgggcgccgcgcccca

SEQ ID NO: 2463808 - RNA, 15 nt, Bordetella pertussis
gagcgccggggcgug

SEQ ID NO: 2463809 - RNA, 19 nt, Bordetella pertussis
gagcgccggggcguggccg

SEQ ID NO: 2463810 - RNA, 14 nt, Bordetella pertussis
gagcgccggggugg

SEQ ID NO: 2463811 - RNA, 23 nt, Bordetella pertussis
gagcgccucgaguuugcggucca

SEQ ID NO: 2463812 - RNA, 12 nt, Bordetella pertussis
gagcgccugcag

SEQ ID NO: 2463813 - RNA, 23 nt, Bordetella pertussis
gagcgccugcgccacguccagca

SEQ ID NO: 2463814 - RNA, 19 nt, Bordetella pertussis
gagcgccugggcggccacg

SEQ ID NO: 2463815 - RNA, 20 nt, Bordetella pertussis
gagcgccugggcggccacgu

SEQ ID NO: 2463816 - RNA, 21 nt, Bordetella pertussis
gagcgccugggcggccacgua

SEQ ID NO: 2463817 - RNA, 14 nt, Bordetella pertussis
gagcgcgacgcgcu

SEQ ID NO: 2463818 - RNA, 22 nt, Bordetella pertussis
gagcgcgccagcacgguggcgc

SEQ ID NO: 2463819 - RNA, 22 nt, Bordetella pertussis
gagcgcgcccgcuugggccgcg

SEQ ID NO: 2463820 - RNA, 15 nt, Bordetella pertussis
gagcgcgccgccgua

SEQ ID NO: 2463821 - RNA, 12 nt, Bordetella pertussis
gagcgcggccuc

SEQ ID NO: 2463822 - RNA, 13 nt, Bordetella pertussis
gagcgcggccucg

SEQ ID NO: 2463823 - RNA, 13 nt, Bordetella pertussis
gagcgcggcgcgc

SEQ ID NO: 2463824 - RNA, 15 nt, Bordetella pertussis
gagcgcggcgcgcga

SEQ ID NO: 2463825 - RNA, 14 nt, Bordetella pertussis
gagcgcggcgcugg

SEQ ID NO: 2463826 - RNA, 12 nt, Bordetella pertussis
gagcgcgggccg

SEQ ID NO: 2463827 - RNA, 18 nt, Bordetella pertussis
gagcgcgggccgccgcac

SEQ ID NO: 2463828 - RNA, 17 nt, Bordetella pertussis
gagcgcgguggccgcuu

SEQ ID NO: 2463829 - RNA, 13 nt, Bordetella pertussis
gagcggcagcagc

SEQ ID NO: 2463830 - RNA, 12 nt, Bordetella pertussis
gagcggccagcc

SEQ ID NO: 2463831 - RNA, 16 nt, Bordetella pertussis
gagcggccagccugcc

SEQ ID NO: 2463832 - RNA, 12 nt, Bordetella pertussis
gagcggccuggc

SEQ ID NO: 2463833 - RNA, 15 nt, Bordetella pertussis
gagcggccuggcccc

SEQ ID NO: 2463834 - RNA, 19 nt, Bordetella pertussis
gagcggccuggccccgcgc

SEQ ID NO: 2463835 - RNA, 19 nt, Bordetella pertussis
gagcggcgccagucgcgca

SEQ ID NO: 2463836 - RNA, 20 nt, Bordetella pertussis
gagcggcgccagucgcgcag

SEQ ID NO: 2463837 - RNA, 12 nt, Bordetella pertussis
gagcggcggcuu

SEQ ID NO: 2463838 - RNA, 18 nt, Bordetella pertussis
gagcggcgucgcguccuu

SEQ ID NO: 2463839 - RNA, 23 nt, Bordetella pertussis
gagcggcgugugauagcacugca

SEQ ID NO: 2463840 - RNA, 16 nt, Bordetella pertussis
gagcggcucgccgcuc

SEQ ID NO: 2463841 - RNA, 18 nt, Bordetella pertussis
gagcgggccagcgcggcc

SEQ ID NO: 2463842 - RNA, 14 nt, Bordetella pertussis
gagcgggccggucg

SEQ ID NO: 2463843 - RNA, 13 nt, Bordetella pertussis
gagcgggcgccag

SEQ ID NO: 2463844 - RNA, 13 nt, Bordetella pertussis
gagcggggccgcg

SEQ ID NO: 2463845 - RNA, 13 nt, Bordetella pertussis
gagcggggcuggu

SEQ ID NO: 2463846 - RNA, 20 nt, Bordetella pertussis
gagcuacccccugaccggcg

SEQ ID NO: 2463847 - RNA, 13 nt, Bordetella pertussis
gagcuccagccgg

SEQ ID NO: 2463848 - RNA, 18 nt, Bordetella pertussis
gagcuccagccgggucgg

SEQ ID NO: 2463849 - RNA, 17 nt, Bordetella pertussis
gagcuccucgagcgugg

SEQ ID NO: 2463850 - RNA, 17 nt, Bordetella pertussis
gagcuccugcaggaugg

SEQ ID NO: 2463851 - RNA, 14 nt, Bordetella pertussis
gagcucggcauggc

SEQ ID NO: 2463852 - RNA, 12 nt, Bordetella pertussis
gagcucgucccc

SEQ ID NO: 2463853 - RNA, 19 nt, Bordetella pertussis
gagcucguguagggccugg

SEQ ID NO: 2463854 - RNA, 16 nt, Bordetella pertussis
gagcugagcaccagca

SEQ ID NO: 2463855 - RNA, 17 nt, Bordetella pertussis
gagcugagcaccagcag

SEQ ID NO: 2463856 - RNA, 15 nt, Bordetella pertussis
gagcugcacccacac

SEQ ID NO: 2463857 - RNA, 18 nt, Bordetella pertussis
gagcugcagcccggccag

SEQ ID NO: 2463858 - RNA, 22 nt, Bordetella pertussis
gagcugccaggcuaucguggcu

SEQ ID NO: 2463859 - RNA, 13 nt, Bordetella pertussis
gagcugcgcggcu

SEQ ID NO: 2463860 - RNA, 17 nt, Bordetella pertussis
gagcugcggcgcggcgc

SEQ ID NO: 2463861 - RNA, 13 nt, Bordetella pertussis
gagcuggccggcg

SEQ ID NO: 2463862 - RNA, 21 nt, Bordetella pertussis
gagcuggcuggccagcggggc

SEQ ID NO: 2463863 - RNA, 17 nt, Bordetella pertussis
gagcuggggccgcgcgc

SEQ ID NO: 2463864 - RNA, 23 nt, Bordetella pertussis
gagcugguccaccaccuucaggg

SEQ ID NO: 2463865 - RNA, 17 nt, Bordetella pertussis
gagcuguugcagcggcu

SEQ ID NO: 2463866 - RNA, 18 nt, Bordetella pertussis
gagcuguugcagcggcuu

SEQ ID NO: 2463867 - RNA, 15 nt, Bordetella pertussis
gagcuuggccggugc

SEQ ID NO: 2463868 - RNA, 20 nt, Bordetella pertussis
gaggaaauggugcgguugcg

SEQ ID NO: 2463869 - RNA, 13 nt, Bordetella pertussis
gaggaaccagccg

SEQ ID NO: 2463870 - RNA, 14 nt, Bordetella pertussis
gaggaacggcacca

SEQ ID NO: 2463871 - RNA, 21 nt, Bordetella pertussis
gaggaacggcaccagccgggc

SEQ ID NO: 2463872 - RNA, 17 nt, Bordetella pertussis
gaggaacuggacggcgc

SEQ ID NO: 2463873 - RNA, 13 nt, Bordetella pertussis
gaggaaggcccgc

SEQ ID NO: 2463874 - RNA, 17 nt, Bordetella pertussis
gaggaagggugcggcgc

SEQ ID NO: 2463875 - RNA, 18 nt, Bordetella pertussis
gaggaagggugcggcgcc

SEQ ID NO: 2463876 - RNA, 13 nt, Bordetella pertussis
gaggacaggccag

SEQ ID NO: 2463877 - RNA, 13 nt, Bordetella pertussis
gaggacaggggcc

SEQ ID NO: 2463878 - RNA, 20 nt, Bordetella pertussis
gaggaccccgaagcacagau

SEQ ID NO: 2463879 - RNA, 13 nt, Bordetella pertussis
gaggaccgcgaug

SEQ ID NO: 2463880 - RNA, 15 nt, Bordetella pertussis
gaggaccugcuggcg

SEQ ID NO: 2463881 - RNA, 21 nt, Bordetella pertussis
gaggagcugcugugcgccggg

SEQ ID NO: 2463882 - RNA, 22 nt, Bordetella pertussis
gaggagcugcugugcgccgggg

SEQ ID NO: 2463883 - RNA, 16 nt, Bordetella pertussis
gaggaggugcgccgcu

SEQ ID NO: 2463884 - RNA, 17 nt, Bordetella pertussis
gaggaggugcgccgcuc

SEQ ID NO: 2463885 - RNA, 18 nt, Bordetella pertussis
gaggagguuuuccuggag

SEQ ID NO: 2463886 - RNA, 15 nt, Bordetella pertussis
gaggauacggccagc

SEQ ID NO: 2463887 - RNA, 16 nt, Bordetella pertussis
gaggauacggccagcg

SEQ ID NO: 2463888 - RNA, 18 nt, Bordetella pertussis
gaggauacggccagcgcc

SEQ ID NO: 2463889 - RNA, 13 nt, Bordetella pertussis
gaggaucaccgca

SEQ ID NO: 2463890 - RNA, 21 nt, Bordetella pertussis
gaggaucuggccggcgcuggg

SEQ ID NO: 2463891 - RNA, 17 nt, Bordetella pertussis
gaggaugcgcgcggcca

SEQ ID NO: 2463892 - RNA, 14 nt, Bordetella pertussis
gaggaugugcagcg

SEQ ID NO: 2463893 - RNA, 11 nt, Bordetella pertussis
gacggcgcugg

SEQ ID NO: 2463894 - RNA, 19 nt, Bordetella pertussis
gacggcgcuggggaagcgc

SEQ ID NO: 2463895 - RNA, 11 nt, Bordetella pertussis
gacggcggcgc

SEQ ID NO: 2463896 - RNA, 14 nt, Bordetella pertussis
gacggcggcgcggc

SEQ ID NO: 2463897 - RNA, 14 nt, Bordetella pertussis
gacggcggcgugga

SEQ ID NO: 2463898 - RNA, 13 nt, Bordetella pertussis
gacggcggcugga

SEQ ID NO: 2463899 - RNA, 13 nt, Bordetella pertussis
gacggcgggcgcc

SEQ ID NO: 2463900 - RNA, 15 nt, Bordetella pertussis
gacggcgggcgcccc

SEQ ID NO: 2463901 - RNA, 18 nt, Bordetella pertussis
gacggcgucgagcacgcg

SEQ ID NO: 2463902 - RNA, 20 nt, Bordetella pertussis
gacggcgucgagcacgcggc

SEQ ID NO: 2463903 - RNA, 13 nt, Bordetella pertussis
gacggcgucggcc

SEQ ID NO: 2463904 - RNA, 17 nt, Bordetella pertussis
gacggcgucggccuggu

SEQ ID NO: 2463905 - RNA, 22 nt, Bordetella pertussis
gacggcgucgggcagcaggcgc

SEQ ID NO: 2463906 - RNA, 15 nt, Bordetella pertussis
gacggcgugcugcgc

SEQ ID NO: 2463907 - RNA, 22 nt, Bordetella pertussis
gacggcgugcugcgcguggcca

SEQ ID NO: 2463908 - RNA, 22 nt, Bordetella pertussis
gacggcucgcgcucgcccggcc

SEQ ID NO: 2463909 - RNA, 20 nt, Bordetella pertussis
gacggcuucgaccacgcggc

SEQ ID NO: 2463910 - RNA, 23 nt, Bordetella pertussis
gacggcuucgaccacgcggcggu

SEQ ID NO: 2463911 - RNA, 15 nt, Bordetella pertussis
gacggcuugaccacg

SEQ ID NO: 2463912 - RNA, 17 nt, Bordetella pertussis
gacggcuugaccacggc

SEQ ID NO: 2463913 - RNA, 19 nt, Bordetella pertussis
gacggcuugaccacggcca

SEQ ID NO: 2463914 - RNA, 21 nt, Bordetella pertussis
gacggcuugaccacggccagc

SEQ ID NO: 2463915 - RNA, 22 nt, Bordetella pertussis
gacggcuugaccacggccagca

SEQ ID NO: 2463916 - RNA, 13 nt, Bordetella pertussis
gacggcuugcgca

SEQ ID NO: 2463917 - RNA, 15 nt, Bordetella pertussis
gacgggaaagcggcg

SEQ ID NO: 2463918 - RNA, 19 nt, Bordetella pertussis
gacgggaaagcggcgaucc

SEQ ID NO: 2463919 - RNA, 17 nt, Bordetella pertussis
gacgggcaccgacacgc

SEQ ID NO: 2463920 - RNA, 23 nt, Bordetella pertussis
gacgggcaccgacacgcuggcgg

SEQ ID NO: 2463921 - RNA, 14 nt, Bordetella pertussis
gacgggcaggccca

SEQ ID NO: 2463922 - RNA, 21 nt, Bordetella pertussis
gacgggccagccccggcgcgc

SEQ ID NO: 2463923 - RNA, 23 nt, Bordetella pertussis
gacgggccagccccggcgcgccg

SEQ ID NO: 2463924 - RNA, 18 nt, Bordetella pertussis
gacgggcccguuuugcag

SEQ ID NO: 2463925 - RNA, 22 nt, Bordetella pertussis
gacgggccgaugaagacgccgu

SEQ ID NO: 2463926 - RNA, 23 nt, Bordetella pertussis
gacgggcgcacaguugcaggcca

SEQ ID NO: 2463927 - RNA, 13 nt, Bordetella pertussis
gacgggcgcccgc

SEQ ID NO: 2463928 - RNA, 17 nt, Bordetella pertussis
gacgggcggcggcgcgc

SEQ ID NO: 2463929 - RNA, 22 nt, Bordetella pertussis
gacgggcggcggcgcgcgcgcc

SEQ ID NO: 2463930 - RNA, 23 nt, Bordetella pertussis
gacgggcggcggcgcgcgcgccg

SEQ ID NO: 2463931 - RNA, 14 nt, Bordetella pertussis
gacgggcggcugcu

SEQ ID NO: 2463932 - RNA, 18 nt, Bordetella pertussis
gacgggcggcugcuggcc

SEQ ID NO: 2463933 - RNA, 20 nt, Bordetella pertussis
gacgggcggcugcuggccca

SEQ ID NO: 2463934 - RNA, 23 nt, Bordetella pertussis
gacgggcuggagaacgagccggc

SEQ ID NO: 2463935 - RNA, 15 nt, Bordetella pertussis
gacgggcugggccga

SEQ ID NO: 2463936 - RNA, 23 nt, Bordetella pertussis
gacgggcugggccgaggcgccgc

SEQ ID NO: 2463937 - RNA, 19 nt, Bordetella pertussis
gacggggaacaggcgcgcc

SEQ ID NO: 2463938 - RNA, 21 nt, Bordetella pertussis
gacggggaacaggcgcgccag

SEQ ID NO: 2463939 - RNA, 22 nt, Bordetella pertussis
gacggggaacaggcgcgccagc

SEQ ID NO: 2463940 - RNA, 23 nt, Bordetella pertussis
gacggggaacaggcgcgccagcc

SEQ ID NO: 2463941 - RNA, 14 nt, Bordetella pertussis
gacggggacaggcu

SEQ ID NO: 2463942 - RNA, 15 nt, Bordetella pertussis
gacggggacaggcuc

SEQ ID NO: 2463943 - RNA, 16 nt, Bordetella pertussis
gacggggacgccggcg

SEQ ID NO: 2463944 - RNA, 13 nt, Bordetella pertussis
gacggggcggcgc

SEQ ID NO: 2463945 - RNA, 17 nt, Bordetella pertussis
gacggggcggcgccugc

SEQ ID NO: 2463946 - RNA, 23 nt, Bordetella pertussis
gacggggucggggcaggccuggu

SEQ ID NO: 2463947 - RNA, 12 nt, Bordetella pertussis
gacggggugccu

SEQ ID NO: 2463948 - RNA, 17 nt, Bordetella pertussis
gacggguaucgucgacc

SEQ ID NO: 2463949 - RNA, 21 nt, Bordetella pertussis
gacggguaucgucgaccugga

SEQ ID NO: 2463950 - RNA, 19 nt, Bordetella pertussis
gacgggucacccgccgcac

SEQ ID NO: 2463951 - RNA, 16 nt, Bordetella pertussis
gacgguaagcaccagg

SEQ ID NO: 2463952 - RNA, 14 nt, Bordetella pertussis
gacgguagcgcacg

SEQ ID NO: 2463953 - RNA, 18 nt, Bordetella pertussis
gacgguagcgcacgcacc

SEQ ID NO: 2463954 - RNA, 23 nt, Bordetella pertussis
gacgguaucucagcgcgccgcgc

SEQ ID NO: 2463955 - RNA, 15 nt, Bordetella pertussis
gacgguaucuguccc

SEQ ID NO: 2463956 - RNA, 23 nt, Bordetella pertussis
gacgguaucuguccccgcgggga

SEQ ID NO: 2463957 - RNA, 17 nt, Bordetella pertussis
gacggucacggucuggc

SEQ ID NO: 2463958 - RNA, 21 nt, Bordetella pertussis
gacggucacggucuggcccac

SEQ ID NO: 2463959 - RNA, 17 nt, Bordetella pertussis
gacggucaggggcaggc

SEQ ID NO: 2463960 - RNA, 16 nt, Bordetella pertussis
gacgcagaccacgccg

SEQ ID NO: 2463961 - RNA, 19 nt, Bordetella pertussis
gacgcagcacggcuugcgc

SEQ ID NO: 2463962 - RNA, 15 nt, Bordetella pertussis
gacgcagcagccgcu

SEQ ID NO: 2463963 - RNA, 14 nt, Bordetella pertussis
gacgcagccgcagu

SEQ ID NO: 2463964 - RNA, 13 nt, Bordetella pertussis
gacgcagccgccc

SEQ ID NO: 2463965 - RNA, 15 nt, Bordetella pertussis
gacgcagccgcccgg

SEQ ID NO: 2463966 - RNA, 16 nt, Bordetella pertussis
gacgcagccgcccggc

SEQ ID NO: 2463967 - RNA, 13 nt, Bordetella pertussis
gacgcagccuucg

SEQ ID NO: 2463968 - RNA, 16 nt, Bordetella pertussis
gacgcagccuucgucc

SEQ ID NO: 2463969 - RNA, 23 nt, Bordetella pertussis
gacgcagcgcaccgacggcagcc

SEQ ID NO: 2463970 - RNA, 13 nt, Bordetella pertussis
gacgcagcgugcg

SEQ ID NO: 2463971 - RNA, 13 nt, Bordetella pertussis
gacgcagcuucuu

SEQ ID NO: 2463972 - RNA, 12 nt, Bordetella pertussis
gacgcaggccca

SEQ ID NO: 2463973 - RNA, 14 nt, Bordetella pertussis
gacgcaggcccagc

SEQ ID NO: 2463974 - RNA, 18 nt, Bordetella pertussis
gacgcaggcccagccagc

SEQ ID NO: 2463975 - RNA, 13 nt, Bordetella pertussis
gacgcaggcccau

SEQ ID NO: 2463976 - RNA, 18 nt, Bordetella pertussis
gacgcaggcccaugacga

SEQ ID NO: 2463977 - RNA, 14 nt, Bordetella pertussis
gacgcaggcgccgc

SEQ ID NO: 2463978 - RNA, 15 nt, Bordetella pertussis
gacgcaggcgccgca

SEQ ID NO: 2463979 - RNA, 14 nt, Bordetella pertussis
gacgccaagaccgc

SEQ ID NO: 2463980 - RNA, 15 nt, Bordetella pertussis
gacgccaagaccgcg

SEQ ID NO: 2463981 - RNA, 17 nt, Bordetella pertussis
gacgccaagaccgcggc

SEQ ID NO: 2463982 - RNA, 22 nt, Bordetella pertussis
gacgccagcaugaucaugccgc

SEQ ID NO: 2463983 - RNA, 17 nt, Bordetella pertussis
gacgccagcccgccggc

SEQ ID NO: 2463984 - RNA, 23 nt, Bordetella pertussis
gacgccagcccgccggcgcgcgc

SEQ ID NO: 2463985 - RNA, 16 nt, Bordetella pertussis
gacgccagcgcgccau

SEQ ID NO: 2463986 - RNA, 23 nt, Bordetella pertussis
gacgccagcgcgccauggccggc

SEQ ID NO: 2463987 - RNA, 22 nt, Bordetella pertussis
gacgccaucucgcgcgcuaagc

SEQ ID NO: 2463988 - RNA, 14 nt, Bordetella pertussis
gacgccauggcggc

SEQ ID NO: 2463989 - RNA, 15 nt, Bordetella pertussis
gacgccauggcggcg

SEQ ID NO: 2463990 - RNA, 17 nt, Bordetella pertussis
gacgccauggcggcggc

SEQ ID NO: 2463991 - RNA, 15 nt, Bordetella pertussis
gacgcccaggcccac

SEQ ID NO: 2463992 - RNA, 23 nt, Bordetella pertussis
gacgcccaggcccaccgcaucgc

SEQ ID NO: 2463993 - RNA, 14 nt, Bordetella pertussis
gacgcccagguccg

SEQ ID NO: 2463994 - RNA, 21 nt, Bordetella pertussis
gacgcccagguccgaaccgac

SEQ ID NO: 2463995 - RNA, 17 nt, Bordetella pertussis
gacgcccgcccgcugac

SEQ ID NO: 2463996 - RNA, 15 nt, Bordetella pertussis
gacgcccgcgcccag

SEQ ID NO: 2463997 - RNA, 15 nt, Bordetella pertussis
gacgcccgggcggcu

SEQ ID NO: 2463998 - RNA, 23 nt, Bordetella pertussis
gacgcccuggccuucgaccugcc

SEQ ID NO: 2463999 - RNA, 15 nt, Bordetella pertussis
gacgcccuggcgcag

SEQ ID NO: 2464000 - RNA, 21 nt, Bordetella pertussis
gacgcccuggcgcaggccggc

SEQ ID NO: 2464001 - RNA, 17 nt, Bordetella pertussis
gacgccgaaggucuugg

SEQ ID NO: 2464002 - RNA, 21 nt, Bordetella pertussis
gacgccgaaggucuuggcgug

SEQ ID NO: 2464003 - RNA, 15 nt, Bordetella pertussis
gacgccgacgaugcc

SEQ ID NO: 2464004 - RNA, 22 nt, Bordetella pertussis
gacgccgacugggugcgccuga

SEQ ID NO: 2464005 - RNA, 21 nt, Bordetella pertussis
gacgccgccacgcuggccgcg

SEQ ID NO: 2464006 - RNA, 23 nt, Bordetella pertussis
gacgccgccacgcuggccgcgcu

SEQ ID NO: 2464007 - RNA, 13 nt, Bordetella pertussis
gacgccgccgaac

SEQ ID NO: 2464008 - RNA, 14 nt, Bordetella pertussis
gacgccgccgaagg

SEQ ID NO: 2464009 - RNA, 16 nt, Bordetella pertussis
gacgccgccgaagggc

SEQ ID NO: 2464010 - RNA, 19 nt, Bordetella pertussis
gacgccgccgaagggcacc

SEQ ID NO: 2464011 - RNA, 20 nt, Bordetella pertussis
gacgccgccgaagggcaccg

SEQ ID NO: 2464012 - RNA, 20 nt, Bordetella pertussis
gacgccgccgauggcgccac

SEQ ID NO: 2464013 - RNA, 16 nt, Bordetella pertussis
gacgccgccggcccag

SEQ ID NO: 2464014 - RNA, 20 nt, Bordetella pertussis
gacgccgcgcgcgacgcgau

SEQ ID NO: 2464015 - RNA, 13 nt, Bordetella pertussis
gacgccgcgcggu

SEQ ID NO: 2464016 - RNA, 16 nt, Bordetella pertussis
gacgccgcgcgguucg

SEQ ID NO: 2464017 - RNA, 16 nt, Bordetella pertussis
gacgccggcagcgacu

SEQ ID NO: 2464018 - RNA, 17 nt, Bordetella pertussis
gacgccggcagcgacuu

SEQ ID NO: 2464019 - RNA, 13 nt, Bordetella pertussis
gacgccggcgacg

SEQ ID NO: 2464020 - RNA, 15 nt, Bordetella pertussis
gacgccggcgccggc

SEQ ID NO: 2464021 - RNA, 12 nt, Bordetella pertussis
gacgccggcggc

SEQ ID NO: 2464022 - RNA, 13 nt, Bordetella pertussis
gacgccggcggcg

SEQ ID NO: 2464023 - RNA, 16 nt, Bordetella pertussis
gacgccggcggcgugc

SEQ ID NO: 2464024 - RNA, 15 nt, Bordetella pertussis
gagccaauaacagag

SEQ ID NO: 2464025 - RNA, 17 nt, Bordetella pertussis
gagccacaauccauucc

SEQ ID NO: 2464026 - RNA, 21 nt, Bordetella pertussis
gagccacgucgcucggccucc

SEQ ID NO: 2464027 - RNA, 12 nt, Bordetella pertussis
gagccaggcgcc

SEQ ID NO: 2464028 - RNA, 13 nt, Bordetella pertussis
gagccaggcgccc

SEQ ID NO: 2464029 - RNA, 16 nt, Bordetella pertussis
gagccaggcgcccggc

SEQ ID NO: 2464030 - RNA, 17 nt, Bordetella pertussis
gagccaggcgcccggcg

SEQ ID NO: 2464031 - RNA, 13 nt, Bordetella pertussis
gagccaggcggcg

SEQ ID NO: 2464032 - RNA, 14 nt, Bordetella pertussis
gagccagguggaca

SEQ ID NO: 2464033 - RNA, 17 nt, Bordetella pertussis
gagccagguggacagcg

SEQ ID NO: 2464034 - RNA, 22 nt, Bordetella pertussis
gagccagguggacagcgccagc

SEQ ID NO: 2464035 - RNA, 23 nt, Bordetella pertussis
gagccaguccccgcggggacagg

SEQ ID NO: 2464036 - RNA, 16 nt, Bordetella pertussis
gagccaugccgucugg

SEQ ID NO: 2464037 - RNA, 19 nt, Bordetella pertussis
gagccaugccgucuggcgg

SEQ ID NO: 2464038 - RNA, 17 nt, Bordetella pertussis
gagccauuccggcuggu

SEQ ID NO: 2464039 - RNA, 19 nt, Bordetella pertussis
gagcccaucaggugggccg

SEQ ID NO: 2464040 - RNA, 16 nt, Bordetella pertussis
gagcccgaugccgcca

SEQ ID NO: 2464041 - RNA, 20 nt, Bordetella pertussis
gagcccgcgucagacgcgcu

SEQ ID NO: 2464042 - RNA, 14 nt, Bordetella pertussis
gagcccgcgucggc

SEQ ID NO: 2464043 - RNA, 18 nt, Bordetella pertussis
gagcccgcgucggcgcgg

SEQ ID NO: 2464044 - RNA, 12 nt, Bordetella pertussis
gagcccgcugcc

SEQ ID NO: 2464045 - RNA, 14 nt, Bordetella pertussis
gagcccuggcuugg

SEQ ID NO: 2464046 - RNA, 16 nt, Bordetella pertussis
gagccgauacaggcgc

SEQ ID NO: 2464047 - RNA, 20 nt, Bordetella pertussis
gagccgauacaggcgcucgc

SEQ ID NO: 2464048 - RNA, 13 nt, Bordetella pertussis
gagccgauggcau

SEQ ID NO: 2464049 - RNA, 22 nt, Bordetella pertussis
gagccgauggcauggggcaggc

SEQ ID NO: 2464050 - RNA, 22 nt, Bordetella pertussis
gagccgcagaacagcagcguga

SEQ ID NO: 2464051 - RNA, 17 nt, Bordetella pertussis
gagccgcagguccaggc

SEQ ID NO: 2464052 - RNA, 16 nt, Bordetella pertussis
gagccgccccggcgcg

SEQ ID NO: 2464053 - RNA, 17 nt, Bordetella pertussis
gagccgccccggcgcgg

SEQ ID NO: 2464054 - RNA, 17 nt, Bordetella pertussis
gagccgcgcacacaugg

SEQ ID NO: 2464055 - RNA, 13 nt, Bordetella pertussis
gagccgcgcgcau

SEQ ID NO: 2464056 - RNA, 13 nt, Bordetella pertussis
gagccgcugucgc

SEQ ID NO: 2464057 - RNA, 15 nt, Bordetella pertussis
gagccgcugucgcag

SEQ ID NO: 2464058 - RNA, 16 nt, Bordetella pertussis
gagccggacgugggcg

SEQ ID NO: 2464059 - RNA, 20 nt, Bordetella pertussis
gagccggagcagucgcgcag

SEQ ID NO: 2464060 - RNA, 21 nt, Bordetella pertussis
gagccggagcagucgcgcagc

SEQ ID NO: 2464061 - RNA, 16 nt, Bordetella pertussis
gagccggcagaucggc

SEQ ID NO: 2464062 - RNA, 20 nt, Bordetella pertussis
gagccggcagaucggcgcug

SEQ ID NO: 2464063 - RNA, 22 nt, Bordetella pertussis
gagccggcagaucggcgcuggc

SEQ ID NO: 2464064 - RNA, 22 nt, Bordetella pertussis
gagccggccaccucuucagccc

SEQ ID NO: 2464065 - RNA, 13 nt, Bordetella pertussis
gagccggccagcg

SEQ ID NO: 2464066 - RNA, 14 nt, Bordetella pertussis
gagccggccagcgc

SEQ ID NO: 2464067 - RNA, 15 nt, Bordetella pertussis
gagccggccagcgcc

SEQ ID NO: 2464068 - RNA, 19 nt, Bordetella pertussis
gagccggccagcgccacca

SEQ ID NO: 2464069 - RNA, 19 nt, Bordetella pertussis
gagccggccagcgccuggg

SEQ ID NO: 2464070 - RNA, 14 nt, Bordetella pertussis
gagccggccgcgcc

SEQ ID NO: 2464071 - RNA, 14 nt, Bordetella pertussis
gagccggcgggcgg

SEQ ID NO: 2464072 - RNA, 16 nt, Bordetella pertussis
gagccggcgggcggcu

SEQ ID NO: 2464073 - RNA, 22 nt, Bordetella pertussis
gagccggcuccagucccgcacc

SEQ ID NO: 2464074 - RNA, 18 nt, Bordetella pertussis
gagccgggcaccgagccg

SEQ ID NO: 2464075 - RNA, 12 nt, Bordetella pertussis
gagccgggccac

SEQ ID NO: 2464076 - RNA, 16 nt, Bordetella pertussis
gagccgggccaugcgg

SEQ ID NO: 2464077 - RNA, 13 nt, Bordetella pertussis
gagccgguacagc

SEQ ID NO: 2464078 - RNA, 16 nt, Bordetella pertussis
gagccgguacagccag

SEQ ID NO: 2464079 - RNA, 20 nt, Bordetella pertussis
gagccgguacagccaggcca

SEQ ID NO: 2464080 - RNA, 17 nt, Bordetella pertussis
gagccgguccgccucgc

SEQ ID NO: 2464081 - RNA, 15 nt, Bordetella pertussis
gagccggugggcgcg

SEQ ID NO: 2464082 - RNA, 17 nt, Bordetella pertussis
gagccucacuccauagc

SEQ ID NO: 2464083 - RNA, 22 nt, Bordetella pertussis
gagccucacuccauagcgccgc

SEQ ID NO: 2464084 - RNA, 22 nt, Bordetella pertussis
gagccuggaagugaugccgccg

SEQ ID NO: 2464085 - RNA, 14 nt, Bordetella pertussis
gagccugggcgcgc

SEQ ID NO: 2464086 - RNA, 16 nt, Bordetella pertussis
gagccugggcgcgcgc

SEQ ID NO: 2464087 - RNA, 19 nt, Bordetella pertussis
gagccuguccccgcgggga

SEQ ID NO: 2464088 - RNA, 20 nt, Bordetella pertussis
gagccuguccccgcggggac

SEQ ID NO: 2464089 - RNA, 23 nt, Bordetella pertussis
gagccuguccccgucgggacagg

SEQ ID NO: 2464090 - RNA, 19 nt, Bordetella pertussis
gagccugucccgacgggga

SEQ ID NO: 2464091 - RNA, 23 nt, Bordetella pertussis
gagccugucccgacggggacagg

SEQ ID NO: 2464092 - RNA, 20 nt, Bordetella pertussis
gagccugucccugcggggac

SEQ ID NO: 2464093 - RNA, 22 nt, Bordetella pertussis
gagccuucggccggcugcgcgc

SEQ ID NO: 2464094 - RNA, 16 nt, Bordetella pertussis
gaggaugugcagcgca

SEQ ID NO: 2464095 - RNA, 14 nt, Bordetella pertussis
gaggcaaucagccc

SEQ ID NO: 2464096 - RNA, 21 nt, Bordetella pertussis
gaggcacuccgucauggcgcc

SEQ ID NO: 2464097 - RNA, 20 nt, Bordetella pertussis
gaggcauacaggcuguggcc

SEQ ID NO: 2464098 - RNA, 19 nt, Bordetella pertussis
gaggcaucgaaggcgaccg

SEQ ID NO: 2464099 - RNA, 21 nt, Bordetella pertussis
gaggccagcacgccggccagg

SEQ ID NO: 2464100 - RNA, 18 nt, Bordetella pertussis
gaggccagcgugcccagc

SEQ ID NO: 2464101 - RNA, 13 nt, Bordetella pertussis
gaggccaggccgg

SEQ ID NO: 2464102 - RNA, 11 nt, Bordetella pertussis
gaggccaggcu

SEQ ID NO: 2464103 - RNA, 15 nt, Bordetella pertussis
gaggccagggagugc

SEQ ID NO: 2464104 - RNA, 14 nt, Bordetella pertussis
gaggccagguuggg

SEQ ID NO: 2464105 - RNA, 14 nt, Bordetella pertussis
gaggcccagccgcu

SEQ ID NO: 2464106 - RNA, 21 nt, Bordetella pertussis
gaggccccuguccucgcagga

SEQ ID NO: 2464107 - RNA, 18 nt, Bordetella pertussis
gaggcccgauggcgggga

SEQ ID NO: 2464108 - RNA, 14 nt, Bordetella pertussis
gaggcccggccugc

SEQ ID NO: 2464109 - RNA, 14 nt, Bordetella pertussis
gaggcccguuuugu

SEQ ID NO: 2464110 - RNA, 16 nt, Bordetella pertussis
gaggccgagcgcgagc

SEQ ID NO: 2464111 - RNA, 19 nt, Bordetella pertussis
gaggccgaguagcggcgca

SEQ ID NO: 2464112 - RNA, 18 nt, Bordetella pertussis
gaggccgaguggccgcug

SEQ ID NO: 2464113 - RNA, 20 nt, Bordetella pertussis
gaggccgaucucacgggcga

SEQ ID NO: 2464114 - RNA, 14 nt, Bordetella pertussis
gaggccgcgcgccu

SEQ ID NO: 2464115 - RNA, 23 nt, Bordetella pertussis
gaggccgcgcgccucgaugaugg

SEQ ID NO: 2464116 - RNA, 18 nt, Bordetella pertussis
gaggccggcgugcugucc

SEQ ID NO: 2464117 - RNA, 17 nt, Bordetella pertussis
gaggcgaacauggccga

SEQ ID NO: 2464118 - RNA, 17 nt, Bordetella pertussis
gaggcgauggucggccg

SEQ ID NO: 2464119 - RNA, 15 nt, Bordetella pertussis
gaggcgcagcgcggc

SEQ ID NO: 2464120 - RNA, 20 nt, Bordetella pertussis
gaggcgccccagagcaccga

SEQ ID NO: 2464121 - RNA, 16 nt, Bordetella pertussis
gaggcgccgccgugcg

SEQ ID NO: 2464122 - RNA, 13 nt, Bordetella pertussis
gaggcgcgcagcu

SEQ ID NO: 2464123 - RNA, 17 nt, Bordetella pertussis
gaggcgcgcagcuccgu

SEQ ID NO: 2464124 - RNA, 13 nt, Bordetella pertussis
gaggcgcggcucg

SEQ ID NO: 2464125 - RNA, 23 nt, Bordetella pertussis
gaggcgcggcucgccggccgcgc

SEQ ID NO: 2464126 - RNA, 12 nt, Bordetella pertussis
gaggcgcgggca

SEQ ID NO: 2464127 - RNA, 13 nt, Bordetella pertussis
gaggcgcgggcag

SEQ ID NO: 2464128 - RNA, 16 nt, Bordetella pertussis
gaggcgcuggccggcg

SEQ ID NO: 2464129 - RNA, 19 nt, Bordetella pertussis
gaggcgcuggcguccagcc

SEQ ID NO: 2464130 - RNA, 23 nt, Bordetella pertussis
gaggcgcuggcguccagccugcc

SEQ ID NO: 2464131 - RNA, 20 nt, Bordetella pertussis
gaggcggccgcgggcggcgc

SEQ ID NO: 2464132 - RNA, 20 nt, Bordetella pertussis
gaggcggcgacgcagcacgg

SEQ ID NO: 2464133 - RNA, 14 nt, Bordetella pertussis
gaggcggcgcagga

SEQ ID NO: 2464134 - RNA, 23 nt, Bordetella pertussis
gaggcggcgcaggaugcgcuggc

SEQ ID NO: 2464135 - RNA, 15 nt, Bordetella pertussis
gaggcggcgcggguc

SEQ ID NO: 2464136 - RNA, 15 nt, Bordetella pertussis
gaggcggcggccggg

SEQ ID NO: 2464137 - RNA, 19 nt, Bordetella pertussis
gaggcgggcagcauggcgc

SEQ ID NO: 2464138 - RNA, 16 nt, Bordetella pertussis
gaggcggggcuggcgc

SEQ ID NO: 2464139 - RNA, 18 nt, Bordetella pertussis
gaggcggggcuggcgcgg

SEQ ID NO: 2464140 - RNA, 14 nt, Bordetella pertussis
gaggcugcgcgcgc

SEQ ID NO: 2464141 - RNA, 21 nt, Bordetella pertussis
gaggcugcgcgcgccagcgcc

SEQ ID NO: 2464142 - RNA, 12 nt, Bordetella pertussis
gaggcuggcgcc

SEQ ID NO: 2464143 - RNA, 23 nt, Bordetella pertussis
gaggcuggcgcccacgcacauga

SEQ ID NO: 2464144 - RNA, 16 nt, Bordetella pertussis
gaggcuggugaccgcg

SEQ ID NO: 2464145 - RNA, 15 nt, Bordetella pertussis
gaggcuguccccgca

SEQ ID NO: 2464146 - RNA, 16 nt, Bordetella pertussis
gaggcuucgauggcgg

SEQ ID NO: 2464147 - RNA, 17 nt, Bordetella pertussis
gaggcuucgauggcggc

SEQ ID NO: 2464148 - RNA, 18 nt, Bordetella pertussis
gaggcuucgauggcggcg

SEQ ID NO: 2464149 - RNA, 19 nt, Bordetella pertussis
gaggcuucgauggcggcgg

SEQ ID NO: 2464150 - RNA, 22 nt, Bordetella pertussis
gagggacaccgcaggugccugu

SEQ ID NO: 2464151 - RNA, 14 nt, Bordetella pertussis
gagggccgcggcga

SEQ ID NO: 2464152 - RNA, 18 nt, Bordetella pertussis
gagggccggaacagcguc

SEQ ID NO: 2464153 - RNA, 19 nt, Bordetella pertussis
gagggccggacuggcgcgc

SEQ ID NO: 2464154 - RNA, 21 nt, Bordetella pertussis
gagggccggacuggcgcgcac

SEQ ID NO: 2464155 - RNA, 15 nt, Bordetella pertussis
gagggccggcgccag

SEQ ID NO: 2464156 - RNA, 18 nt, Bordetella pertussis
gagggccuggucagcgcc

SEQ ID NO: 2464157 - RNA, 15 nt, Bordetella pertussis
gagggcgacggcggc

SEQ ID NO: 2464158 - RNA, 13 nt, Bordetella pertussis
gagggcgcggcgc

SEQ ID NO: 2464159 - RNA, 17 nt, Bordetella pertussis
gagggcgcgggccagcu

SEQ ID NO: 2464160 - RNA, 20 nt, Bordetella pertussis
gagggcgcgggccagcucuu

SEQ ID NO: 2464161 - RNA, 15 nt, Bordetella pertussis
gagggcggggcguga

SEQ ID NO: 2464162 - RNA, 19 nt, Bordetella pertussis
gagggcugcccucgcccgu

SEQ ID NO: 2464163 - RNA, 13 nt, Bordetella pertussis
gaggggcgcaggc

SEQ ID NO: 2464164 - RNA, 15 nt, Bordetella pertussis
gagggucuggcggcc

SEQ ID NO: 2464165 - RNA, 16 nt, Bordetella pertussis
gagggugucgacgcga

SEQ ID NO: 2464166 - RNA, 15 nt, Bordetella pertussis
gaggguuucgacgcc

SEQ ID NO: 2464167 - RNA, 19 nt, Bordetella pertussis
gaggguuucgacgccuucc

SEQ ID NO: 2464168 - RNA, 22 nt, Bordetella pertussis
gagguaccacaguucggccagc

SEQ ID NO: 2464169 - RNA, 20 nt, Bordetella pertussis
gagguaggugaacgacagcg

SEQ ID NO: 2464170 - RNA, 13 nt, Bordetella pertussis
gagguaugcacga

SEQ ID NO: 2464171 - RNA, 20 nt, Bordetella pertussis
gagguaugcacgaccaggcc

SEQ ID NO: 2464172 - RNA, 14 nt, Bordetella pertussis
gagguccugcucgg

SEQ ID NO: 2464173 - RNA, 15 nt, Bordetella pertussis
gaggucggcggucca

SEQ ID NO: 2464174 - RNA, 19 nt, Bordetella pertussis
gaggucggggugguugucg

SEQ ID NO: 2464175 - RNA, 14 nt, Bordetella pertussis
gaggucuugccgau

SEQ ID NO: 2464176 - RNA, 16 nt, Bordetella pertussis
gaggucuugccgaucg

SEQ ID NO: 2464177 - RNA, 23 nt, Bordetella pertussis
gaggugaucgguaaugagcccga

SEQ ID NO: 2464178 - RNA, 17 nt, Bordetella pertussis
gaggugaugauggccga

SEQ ID NO: 2464179 - RNA, 22 nt, Bordetella pertussis
gaggugcacgugggcacgccgg

SEQ ID NO: 2464180 - RNA, 13 nt, Bordetella pertussis
gaggugccagccu

SEQ ID NO: 2464181 - RNA, 17 nt, Bordetella pertussis
gaggugccggacgccga

SEQ ID NO: 2464182 - RNA, 15 nt, Bordetella pertussis
gaggugcgccgcucg

SEQ ID NO: 2464183 - RNA, 16 nt, Bordetella pertussis
gagguggacaagaaag

SEQ ID NO: 2464184 - RNA, 13 nt, Bordetella pertussis
gagguggcgcauu

SEQ ID NO: 2464185 - RNA, 22 nt, Bordetella pertussis
gagguguagaacucggccgcau

SEQ ID NO: 2464186 - RNA, 17 nt, Bordetella pertussis
gagguugcaggccaggc

SEQ ID NO: 2464187 - RNA, 21 nt, Bordetella pertussis
gagguuuccgccaugcggcgc

SEQ ID NO: 2464188 - RNA, 15 nt, Bordetella pertussis
gaguacugcguucgg

SEQ ID NO: 2464189 - RNA, 23 nt, Bordetella pertussis
gaguaguugucgucgcgcuggcc

SEQ ID NO: 2464190 - RNA, 17 nt, Bordetella pertussis
gaguaucccuaccgccu

SEQ ID NO: 2464191 - RNA, 21 nt, Bordetella pertussis
gagucgaccaguucggccagc

SEQ ID NO: 2464192 - RNA, 17 nt, Bordetella pertussis
gagucgccccgacgcgc

SEQ ID NO: 2464193 - RNA, 18 nt, Bordetella pertussis
gagucgcuccccgugcgg

SEQ ID NO: 2464194 - RNA, 21 nt, Bordetella pertussis
gagucgcuccccgugcgggga

SEQ ID NO: 2464195 - RNA, 14 nt, Bordetella pertussis
gagucggcgccgcg

SEQ ID NO: 2464196 - RNA, 15 nt, Bordetella pertussis
gagucgggcugcugc

SEQ ID NO: 2464197 - RNA, 21 nt, Bordetella pertussis
gagucgugcaggauggcgucg

SEQ ID NO: 2464198 - RNA, 14 nt, Bordetella pertussis
gagugcaggcccga

SEQ ID NO: 2464199 - RNA, 16 nt, Bordetella pertussis
gaguggccgcuguucg

SEQ ID NO: 2464200 - RNA, 21 nt, Bordetella pertussis
gaguggccguagagggucugg

SEQ ID NO: 2464201 - RNA, 14 nt, Bordetella pertussis
gaguuccgcgacgc

SEQ ID NO: 2464202 - RNA, 17 nt, Bordetella pertussis
gaguuccgcgacgcgga

SEQ ID NO: 2464203 - RNA, 16 nt, Bordetella pertussis
gaguucgcgcgccggc

SEQ ID NO: 2464204 - RNA, 17 nt, Bordetella pertussis
gaguucgcgcgccggca

SEQ ID NO: 2464205 - RNA, 15 nt, Bordetella pertussis
gaguucggcgcggcc

SEQ ID NO: 2464206 - RNA, 16 nt, Bordetella pertussis
gaguucggcgcggccu

SEQ ID NO: 2464207 - RNA, 14 nt, Bordetella pertussis
gaguucggugucgg

SEQ ID NO: 2464208 - RNA, 23 nt, Bordetella pertussis
gaguucgucgucgccaccgccca

SEQ ID NO: 2464209 - RNA, 20 nt, Bordetella pertussis
gaguugaaggcuuucugcuu

SEQ ID NO: 2464210 - RNA, 14 nt, Bordetella pertussis
gaguugcgggucgu

SEQ ID NO: 2464211 - RNA, 16 nt, Bordetella pertussis
gaguuggcagaguggc

SEQ ID NO: 2464212 - RNA, 17 nt, Bordetella pertussis
gaguuguccuggccggg

SEQ ID NO: 2464213 - RNA, 13 nt, Bordetella pertussis
gauaaaggccgca

SEQ ID NO: 2464214 - RNA, 21 nt, Bordetella pertussis
gauaaaggccgcaacccaccc

SEQ ID NO: 2464215 - RNA, 14 nt, Bordetella pertussis
gauaaggcgugccg

SEQ ID NO: 2464216 - RNA, 20 nt, Bordetella pertussis
gauacaaggugccugucccc

SEQ ID NO: 2464217 - RNA, 19 nt, Bordetella pertussis
gauacagcuuggcgcgcgg

SEQ ID NO: 2464218 - RNA, 13 nt, Bordetella pertussis
gauacaggcgcuc

SEQ ID NO: 2464219 - RNA, 15 nt, Bordetella pertussis
gauacaggcgcucgc

SEQ ID NO: 2464220 - RNA, 20 nt, Bordetella pertussis
gauacccauggccgugcgcc

SEQ ID NO: 2464221 - RNA, 13 nt, Bordetella pertussis
gauaccgccgccg

SEQ ID NO: 2464222 - RNA, 16 nt, Bordetella pertussis
gauaccgccuuggccg

SEQ ID NO: 2464223 - RNA, 16 nt, Bordetella pertussis
gauaccgcuggccagg

SEQ ID NO: 2464224 - RNA, 21 nt, Bordetella pertussis
gauaccggagcggcucgccgc

SEQ ID NO: 2464225 - RNA, 17 nt, Bordetella pertussis
gauaccggcauggcagc

SEQ ID NO: 2464226 - RNA, 14 nt, Bordetella pertussis
gauaccgucgcgcu

SEQ ID NO: 2464227 - RNA, 17 nt, Bordetella pertussis
gauaccgucgcgcucga

SEQ ID NO: 2464228 - RNA, 18 nt, Bordetella pertussis
gauacgaaaccaggccgg

SEQ ID NO: 2464229 - RNA, 15 nt, Bordetella pertussis
gauacgccgggcgcg

SEQ ID NO: 2464230 - RNA, 17 nt, Bordetella pertussis
gauacgcgccgccuggc

SEQ ID NO: 2464231 - RNA, 15 nt, Bordetella pertussis
gauacgcgugcgcgg

SEQ ID NO: 2464232 - RNA, 17 nt, Bordetella pertussis
gauacgcgugcgcggcc

SEQ ID NO: 2464233 - RNA, 18 nt, Bordetella pertussis
gauacgcgugcgcggccg

SEQ ID NO: 2464234 - RNA, 13 nt, Bordetella pertussis
gauacggccagcg

SEQ ID NO: 2464235 - RNA, 14 nt, Bordetella pertussis
gauacgggcgcggc

SEQ ID NO: 2464236 - RNA, 15 nt, Bordetella pertussis
gauacgggcgcggcg

SEQ ID NO: 2464237 - RNA, 16 nt, Bordetella pertussis
gauacgucgcagcacg

SEQ ID NO: 2464238 - RNA, 23 nt, Bordetella pertussis
gauacugcgcaugggcgcaggcc

SEQ ID NO: 2464239 - RNA, 16 nt, Bordetella pertussis
gauacuguucgccgca

SEQ ID NO: 2464240 - RNA, 21 nt, Bordetella pertussis
gauacuguucgccgcaccagg

SEQ ID NO: 2464241 - RNA, 17 nt, Bordetella pertussis
gauagaguucggcgcgg

SEQ ID NO: 2464242 - RNA, 14 nt, Bordetella pertussis
gauagcccagcacc

SEQ ID NO: 2464243 - RNA, 15 nt, Bordetella pertussis
gauagcccagcaccu

SEQ ID NO: 2464244 - RNA, 18 nt, Bordetella pertussis
gauagcccagcaccugca

SEQ ID NO: 2464245 - RNA, 22 nt, Bordetella pertussis
gauagcccagcaccugcaggcc

SEQ ID NO: 2464246 - RNA, 23 nt, Bordetella pertussis
gauagcccuugaucagcggcggc

SEQ ID NO: 2464247 - RNA, 12 nt, Bordetella pertussis
gauagccgcgcg

SEQ ID NO: 2464248 - RNA, 16 nt, Bordetella pertussis
gauagccgcggcgccg

SEQ ID NO: 2464249 - RNA, 18 nt, Bordetella pertussis
gauagccgcggcgccgca

SEQ ID NO: 2464250 - RNA, 12 nt, Bordetella pertussis
gauagcgccgcg

SEQ ID NO: 2464251 - RNA, 16 nt, Bordetella pertussis
gauagcgccgcgcauc

SEQ ID NO: 2464252 - RNA, 14 nt, Bordetella pertussis
gauagcgcuccagc

SEQ ID NO: 2464253 - RNA, 15 nt, Bordetella pertussis
gauagcggcgccgcu

SEQ ID NO: 2464254 - RNA, 15 nt, Bordetella pertussis
gauagcgggccugca

SEQ ID NO: 2464255 - RNA, 15 nt, Bordetella pertussis
gauagcggugcaggg

SEQ ID NO: 2464256 - RNA, 18 nt, Bordetella pertussis
gauaggcgaagcgcggga

SEQ ID NO: 2464257 - RNA, 14 nt, Bordetella pertussis
gauaggcggccagg

SEQ ID NO: 2464258 - RNA, 15 nt, Bordetella pertussis
gauaggcggccaggc

SEQ ID NO: 2464259 - RNA, 16 nt, Bordetella pertussis
gauaggugcgcagccg

SEQ ID NO: 2464260 - RNA, 19 nt, Bordetella pertussis
gauaggugcgcagccgggc

SEQ ID NO: 2464261 - RNA, 15 nt, Bordetella pertussis
gauauagaccagcag

SEQ ID NO: 2464262 - RNA, 16 nt, Bordetella pertussis
gauauagaccagcagc

SEQ ID NO: 2464263 - RNA, 17 nt, Bordetella pertussis
gauauagaccagcagcu

SEQ ID NO: 2464264 - RNA, 16 nt, Bordetella pertussis
gauauccagguaggcg

SEQ ID NO: 2464265 - RNA, 20 nt, Bordetella pertussis
gauauccagguaggcggcgc

SEQ ID NO: 2464266 - RNA, 19 nt, Bordetella pertussis
gauauccaucggcgcgcgc

SEQ ID NO: 2464267 - RNA, 17 nt, Bordetella pertussis
gauauccaucuggcccg

SEQ ID NO: 2464268 - RNA, 22 nt, Bordetella pertussis
gauauccuugcgcucgcccagc

SEQ ID NO: 2464269 - RNA, 16 nt, Bordetella pertussis
gauaucgccauccagg

SEQ ID NO: 2464270 - RNA, 19 nt, Bordetella pertussis
gauaucgccauccagguac

SEQ ID NO: 2464271 - RNA, 22 nt, Bordetella pertussis
gauaucggccaggcgcugcgcg

SEQ ID NO: 2464272 - RNA, 14 nt, Bordetella pertussis
gauaugcagccgca

SEQ ID NO: 2464273 - RNA, 16 nt, Bordetella pertussis
gauaugccgauugugc

SEQ ID NO: 2464274 - RNA, 20 nt, Bordetella pertussis
gauaugcgccaggcccuuga

SEQ ID NO: 2464275 - RNA, 15 nt, Bordetella pertussis
gauauggccaggguc

SEQ ID NO: 2464276 - RNA, 15 nt, Bordetella pertussis
gauaugggcggccuc

SEQ ID NO: 2464277 - RNA, 16 nt, Bordetella pertussis
gaucaaaaucgugacg

SEQ ID NO: 2464278 - RNA, 17 nt, Bordetella pertussis
gaucaacgugcgccagg

SEQ ID NO: 2464279 - RNA, 15 nt, Bordetella pertussis
gaucaagagccugga

SEQ ID NO: 2464280 - RNA, 20 nt, Bordetella pertussis
gaucaagcggcccgcgcccu

SEQ ID NO: 2464281 - RNA, 14 nt, Bordetella pertussis
gaucaaggcccgga

SEQ ID NO: 2464282 - RNA, 17 nt, Bordetella pertussis
gaucacauaggccggca

SEQ ID NO: 2464283 - RNA, 18 nt, Bordetella pertussis
gaucacauggaaauccuu

SEQ ID NO: 2464284 - RNA, 12 nt, Bordetella pertussis
gaucaccacggg

SEQ ID NO: 2464285 - RNA, 14 nt, Bordetella pertussis
gaucacccagcggc

SEQ ID NO: 2464286 - RNA, 15 nt, Bordetella pertussis
gaucacccagcggcu

SEQ ID NO: 2464287 - RNA, 18 nt, Bordetella pertussis
gaucacccagcggcuggc

SEQ ID NO: 2464288 - RNA, 16 nt, Bordetella pertussis
gaucaccgacagcgcc

SEQ ID NO: 2464289 - RNA, 20 nt, Bordetella pertussis
gaucaccgacagcgccagcg

SEQ ID NO: 2464290 - RNA, 17 nt, Bordetella pertussis
gaucaccgcauggaacc

SEQ ID NO: 2464291 - RNA, 20 nt, Bordetella pertussis
gaucaccgcauggaaccggu

SEQ ID NO: 2464292 - RNA, 15 nt, Bordetella pertussis
gaucaccgccauggc

SEQ ID NO: 2464293 - RNA, 19 nt, Bordetella pertussis
gaucaccgccauggcggcc

SEQ ID NO: 2464294 - RNA, 12 nt, Bordetella pertussis
gaucaccgccgc

SEQ ID NO: 2464295 - RNA, 15 nt, Bordetella pertussis
gaucaccgccgcgcc

SEQ ID NO: 2464296 - RNA, 15 nt, Bordetella pertussis
gaucaccgccggcgg

SEQ ID NO: 2464297 - RNA, 22 nt, Bordetella pertussis
gaucaccgccggcggcgugccc

SEQ ID NO: 2464298 - RNA, 14 nt, Bordetella pertussis
gaucaccguucuuc

SEQ ID NO: 2464299 - RNA, 18 nt, Bordetella pertussis
gaucaccguuuggccugc

SEQ ID NO: 2464300 - RNA, 23 nt, Bordetella pertussis
gaucaccugcaggcccaccggca

SEQ ID NO: 2464301 - RNA, 16 nt, Bordetella pertussis
gaucacgaacagcgcc

SEQ ID NO: 2464302 - RNA, 22 nt, Bordetella pertussis
gaucacgaacagcgccaggcuc

SEQ ID NO: 2464303 - RNA, 15 nt, Bordetella pertussis
gaucacgaagcccag

SEQ ID NO: 2464304 - RNA, 17 nt, Bordetella pertussis
gaucacgccgaaggcgu

SEQ ID NO: 2464305 - RNA, 22 nt, Bordetella pertussis
gaucacgcgcuccggcugcgcg

SEQ ID NO: 2464306 - RNA, 13 nt, Bordetella pertussis
gaucacggcgcgc

SEQ ID NO: 2464307 - RNA, 19 nt, Bordetella pertussis
gaucacggcgcgcgccugc

SEQ ID NO: 2464308 - RNA, 21 nt, Bordetella pertussis
gaucacgggcuguucgcgcag

SEQ ID NO: 2464309 - RNA, 19 nt, Bordetella pertussis
gaucagcaagggccccagc

SEQ ID NO: 2464310 - RNA, 23 nt, Bordetella pertussis
gaucagcaagggccccagcaucu

SEQ ID NO: 2464311 - RNA, 18 nt, Bordetella pertussis
gaucagcaccacggcggc

SEQ ID NO: 2464312 - RNA, 16 nt, Bordetella pertussis
gaucagcaccgcgacc

SEQ ID NO: 2464313 - RNA, 19 nt, Bordetella pertussis
gaucagcaccgcggcgggc

SEQ ID NO: 2464314 - RNA, 15 nt, Bordetella pertussis
gaucagcacgauggu

SEQ ID NO: 2464315 - RNA, 14 nt, Bordetella pertussis
gaucagcaggccca

SEQ ID NO: 2464316 - RNA, 16 nt, Bordetella pertussis
gaucagcaggcccacc

SEQ ID NO: 2464317 - RNA, 19 nt, Bordetella pertussis
gaucagcaggcccaccagg

SEQ ID NO: 2464318 - RNA, 21 nt, Bordetella pertussis
gaucagcaggcccaccaggga

SEQ ID NO: 2464319 - RNA, 19 nt, Bordetella pertussis
gaucagcaggucggcgcgg

SEQ ID NO: 2464320 - RNA, 20 nt, Bordetella pertussis
gaucagcaggucggcgcggc

SEQ ID NO: 2464321 - RNA, 17 nt, Bordetella pertussis
gaucagccagccggcgg

SEQ ID NO: 2464322 - RNA, 19 nt, Bordetella pertussis
gaucagccgcugcagcacg

SEQ ID NO: 2464323 - RNA, 12 nt, Bordetella pertussis
gaucagccggcc

SEQ ID NO: 2464324 - RNA, 15 nt, Bordetella pertussis
gaucagccggccaug

SEQ ID NO: 2464325 - RNA, 22 nt, Bordetella pertussis
gaucagccggccauggcccuug

SEQ ID NO: 2464326 - RNA, 16 nt, Bordetella pertussis
gaucagcgacagcagg

SEQ ID NO: 2464327 - RNA, 17 nt, Bordetella pertussis
gaucagcgacagcaggg

SEQ ID NO: 2464328 - RNA, 14 nt, Bordetella pertussis
gaucagcgcccagg

SEQ ID NO: 2464329 - RNA, 12 nt, Bordetella pertussis
gaucagcgcgcc

SEQ ID NO: 2464330 - RNA, 22 nt, Bordetella pertussis
gaucagcgcgccgucgggggcc

SEQ ID NO: 2464331 - RNA, 14 nt, Bordetella pertussis
gaucagcgcggccg

SEQ ID NO: 2464332 - RNA, 15 nt, Bordetella pertussis
gaucagcgcgggcca

SEQ ID NO: 2464333 - RNA, 20 nt, Bordetella pertussis
gaucagcgcgucggcgccga

SEQ ID NO: 2464334 - RNA, 23 nt, Bordetella pertussis
gaucagcggauugaccagcgcgg

SEQ ID NO: 2464335 - RNA, 16 nt, Bordetella pertussis
gaucagcggcggcacg

SEQ ID NO: 2464336 - RNA, 19 nt, Bordetella pertussis
gaucagcggcggcacgcgc

SEQ ID NO: 2464337 - RNA, 20 nt, Bordetella pertussis
gaucagcggcggcacgcgcg

SEQ ID NO: 2464338 - RNA, 21 nt, Bordetella pertussis
gaucagcggcggcacgcgcgc

SEQ ID NO: 2464339 - RNA, 16 nt, Bordetella pertussis
gaucagcgggcuggcc

SEQ ID NO: 2464340 - RNA, 20 nt, Bordetella pertussis
gaucagcgggcuggccagcg

SEQ ID NO: 2464341 - RNA, 14 nt, Bordetella pertussis
gaucagcugcggcc

SEQ ID NO: 2464342 - RNA, 15 nt, Bordetella pertussis
gaucagcugcggccc

SEQ ID NO: 2464343 - RNA, 22 nt, Bordetella pertussis
gaucagcugcggccccggcacc

SEQ ID NO: 2464344 - RNA, 23 nt, Bordetella pertussis
gaucagcugcggccccggcacca

SEQ ID NO: 2464345 - RNA, 13 nt, Bordetella pertussis
gaucaggaugggc

SEQ ID NO: 2464346 - RNA, 19 nt, Bordetella pertussis
gaucaggaugggcgcggcg

SEQ ID NO: 2464347 - RNA, 14 nt, Bordetella pertussis
gaucaggcccagca

SEQ ID NO: 2464348 - RNA, 17 nt, Bordetella pertussis
gaucaggccgaacuggg

SEQ ID NO: 2464349 - RNA, 15 nt, Bordetella pertussis
gaucaggccgcccca

SEQ ID NO: 2464350 - RNA, 16 nt, Bordetella pertussis
gaucaggccggcgaug

SEQ ID NO: 2464351 - RNA, 12 nt, Bordetella pertussis
gaucaggcgcuc

SEQ ID NO: 2464352 - RNA, 21 nt, Bordetella pertussis
gaucaggcgcuccauggcgcc

SEQ ID NO: 2464353 - RNA, 13 nt, Bordetella pertussis
gaucaggcggcgc

SEQ ID NO: 2464354 - RNA, 14 nt, Bordetella pertussis
gaucaggcggcgcg

SEQ ID NO: 2464355 - RNA, 16 nt, Bordetella pertussis
gaucaggcggcgcggc

SEQ ID NO: 2464356 - RNA, 15 nt, Bordetella pertussis
gaucaggcggcugcc

SEQ ID NO: 2464357 - RNA, 21 nt, Bordetella pertussis
gaucaggcggugccccggccu

SEQ ID NO: 2464358 - RNA, 16 nt, Bordetella pertussis
gaucagggccacggcg

SEQ ID NO: 2464359 - RNA, 22 nt, Bordetella pertussis
gaucagggccgccagggcggcu

SEQ ID NO: 2464360 - RNA, 23 nt, Bordetella pertussis
gaucagggccgccagggcggcug

SEQ ID NO: 2464361 - RNA, 15 nt, Bordetella pertussis
gaucagggccgugcc

SEQ ID NO: 2464362 - RNA, 20 nt, Bordetella pertussis
gaucagggccgugcccgagg

SEQ ID NO: 2464363 - RNA, 16 nt, Bordetella pertussis
gaucagggcgcggacu

SEQ ID NO: 2464364 - RNA, 15 nt, Bordetella pertussis
gaucagggugggcac

SEQ ID NO: 2464365 - RNA, 19 nt, Bordetella pertussis
gaucaggucgaugccggcg

SEQ ID NO: 2464366 - RNA, 18 nt, Bordetella pertussis
gaucaguaucucggcgcc

SEQ ID NO: 2464367 - RNA, 16 nt, Bordetella pertussis
gaucaguccgacgaca

SEQ ID NO: 2464368 - RNA, 16 nt, Bordetella pertussis
gaucauccuguucgug

SEQ ID NO: 2464369 - RNA, 17 nt, Bordetella pertussis
gaucaucgagcaccgcc

SEQ ID NO: 2464370 - RNA, 22 nt, Bordetella pertussis
gaucaucuucgugcuggccauc

SEQ ID NO: 2464371 - RNA, 19 nt, Bordetella pertussis
gaucaugaugcgcugggcc

SEQ ID NO: 2464372 - RNA, 20 nt, Bordetella pertussis
gaucaugcaguacaggcgcg

SEQ ID NO: 2464373 - RNA, 22 nt, Bordetella pertussis
gaucaugccgcugaccagcacg

SEQ ID NO: 2464374 - RNA, 13 nt, Bordetella pertussis
gaucaugcgcugc

SEQ ID NO: 2464375 - RNA, 14 nt, Bordetella pertussis
gaucauggcgccga

SEQ ID NO: 2464376 - RNA, 16 nt, Bordetella pertussis
gaucaugggccugccc

SEQ ID NO: 2464377 - RNA, 16 nt, Bordetella pertussis
gauccacgcccgcgcc

SEQ ID NO: 2464378 - RNA, 18 nt, Bordetella pertussis
gauccacgcccgcgccga

SEQ ID NO: 2464379 - RNA, 20 nt, Bordetella pertussis
gauccacgccgccggccagc

SEQ ID NO: 2464380 - RNA, 21 nt, Bordetella pertussis
gauccacgccgccggccagcu

SEQ ID NO: 2464381 - RNA, 11 nt, Bordetella pertussis
gauccacggcc

SEQ ID NO: 2464382 - RNA, 16 nt, Bordetella pertussis
gauccacggccggcgc

SEQ ID NO: 2464383 - RNA, 17 nt, Bordetella pertussis
gauccacucggccagcg

SEQ ID NO: 2464384 - RNA, 16 nt, Bordetella pertussis
gauccagcccaccgcg

SEQ ID NO: 2464385 - RNA, 20 nt, Bordetella pertussis
gauccagcccaccgcgaacc

SEQ ID NO: 2464386 - RNA, 12 nt, Bordetella pertussis
gauccagccguu

SEQ ID NO: 2464387 - RNA, 21 nt, Bordetella pertussis
gauccagccguuggcgcccag

SEQ ID NO: 2464388 - RNA, 21 nt, Bordetella pertussis
gauccagcgagaccuugugcg

SEQ ID NO: 2464389 - RNA, 14 nt, Bordetella pertussis
gauccagcgcggcc

SEQ ID NO: 2464390 - RNA, 22 nt, Bordetella pertussis
gauccagcgcucgggcucgcgc

SEQ ID NO: 2464391 - RNA, 20 nt, Bordetella pertussis
gauccaggccaccgcggcgg

SEQ ID NO: 2464392 - RNA, 18 nt, Bordetella pertussis
gauccagggccgccagca

SEQ ID NO: 2464393 - RNA, 20 nt, Bordetella pertussis
gauccagggccgccagcacc

SEQ ID NO: 2464394 - RNA, 14 nt, Bordetella pertussis
gauccauguggcca

SEQ ID NO: 2464395 - RNA, 14 nt, Bordetella pertussis
gaucccaucgcgcg

SEQ ID NO: 2464396 - RNA, 14 nt, Bordetella pertussis
gaucccgacgaucc

SEQ ID NO: 2464397 - RNA, 13 nt, Bordetella pertussis
gaucccggcgcca

SEQ ID NO: 2464398 - RNA, 15 nt, Bordetella pertussis
gaucccggcgcuggc

SEQ ID NO: 2464399 - RNA, 20 nt, Bordetella pertussis
gaucccggcgcuggccgcca

SEQ ID NO: 2464400 - RNA, 24 nt, Bordetella pertussis
gaucccggcgcuggccgccauggc

SEQ ID NO: 2464401 - RNA, 23 nt, Bordetella pertussis
gaucccgucauggcggcaggcgc

SEQ ID NO: 2464402 - RNA, 14 nt, Bordetella pertussis
gauccgccaauggc

SEQ ID NO: 2464403 - RNA, 18 nt, Bordetella pertussis
gauccgccauaugcgcga

SEQ ID NO: 2464404 - RNA, 19 nt, Bordetella pertussis
gauccgccauaugcgcgaa

SEQ ID NO: 2464405 - RNA, 18 nt, Bordetella pertussis
gauccgccgcggccagcg

SEQ ID NO: 2464406 - RNA, 20 nt, Bordetella pertussis
gauccgcgacgcccuggccu

SEQ ID NO: 2464407 - RNA, 14 nt, Bordetella pertussis
gauccgcgccaggc

SEQ ID NO: 2464408 - RNA, 16 nt, Bordetella pertussis
gauccgcgccaggcgg

SEQ ID NO: 2464409 - RNA, 12 nt, Bordetella pertussis
gauccgcgggcg

SEQ ID NO: 2464410 - RNA, 14 nt, Bordetella pertussis
gauccgcgggcggg

SEQ ID NO: 2464411 - RNA, 17 nt, Bordetella pertussis
gauccgcgggcgggccg

SEQ ID NO: 2464412 - RNA, 20 nt, Bordetella pertussis
gauccgcgggcgggccgcgg

SEQ ID NO: 2464413 - RNA, 24 nt, Bordetella pertussis
gauccggacugaacgcguccaggc

SEQ ID NO: 2464414 - RNA, 22 nt, Bordetella pertussis
gauccggcagcagcagcgugcg

SEQ ID NO: 2464415 - RNA, 12 nt, Bordetella pertussis
gauccggcgacc

SEQ ID NO: 2464416 - RNA, 13 nt, Bordetella pertussis
gauccggcgaccg

SEQ ID NO: 2464417 - RNA, 19 nt, Bordetella pertussis
gauccggcgaccgacggca

SEQ ID NO: 2464418 - RNA, 14 nt, Bordetella pertussis
gauccggcgcuggc

SEQ ID NO: 2464419 - RNA, 16 nt, Bordetella pertussis
gauccggcgcuggcgc

SEQ ID NO: 2464420 - RNA, 19 nt, Bordetella pertussis
gauccgguaugccugccag

SEQ ID NO: 2464421 - RNA, 23 nt, Bordetella pertussis
gauccgguaugccugccagccca

SEQ ID NO: 2464422 - RNA, 23 nt, Bordetella pertussis
gauccggugaucaucgugccggg

SEQ ID NO: 2464423 - RNA, 14 nt, Bordetella pertussis
gauccgugcggcgc

SEQ ID NO: 2464424 - RNA, 22 nt, Bordetella pertussis
gauccucgacccgaaggcgcgg

SEQ ID NO: 2464425 - RNA, 23 nt, Bordetella pertussis
gauccucgacccgaaggcgcggc

SEQ ID NO: 2464426 - RNA, 17 nt, Bordetella pertussis
gauccucgccagcggca

SEQ ID NO: 2464427 - RNA, 17 nt, Bordetella pertussis
gauccucgcugccggcg

SEQ ID NO: 2464428 - RNA, 18 nt, Bordetella pertussis
gauccucgcugccggcgc

SEQ ID NO: 2464429 - RNA, 20 nt, Bordetella pertussis
gauccucgcugccggcgccc

SEQ ID NO: 2464430 - RNA, 18 nt, Bordetella pertussis
gauccugcugguggcgau

SEQ ID NO: 2464431 - RNA, 17 nt, Bordetella pertussis
gauccuucgcggccgua

SEQ ID NO: 2464432 - RNA, 22 nt, Bordetella pertussis
gaucgaacgccucgggcgcaac

SEQ ID NO: 2464433 - RNA, 21 nt, Bordetella pertussis
gaucgaaggcagcgcggccgg

SEQ ID NO: 2464434 - RNA, 22 nt, Bordetella pertussis
gaucgacagccuuuccuccugc

SEQ ID NO: 2464435 - RNA, 18 nt, Bordetella pertussis
gaucgacaugcuggccca

SEQ ID NO: 2464436 - RNA, 14 nt, Bordetella pertussis
gaucgaccgccagc

SEQ ID NO: 2464437 - RNA, 15 nt, Bordetella pertussis
gaucgaccgccagca

SEQ ID NO: 2464438 - RNA, 17 nt, Bordetella pertussis
gaucgaccgccagcagg

SEQ ID NO: 2464439 - RNA, 23 nt, Bordetella pertussis
gaucgacgagaugccgaugaugg

SEQ ID NO: 2464440 - RNA, 23 nt, Bordetella pertussis
gaucgccggcgcccccagcagcg

SEQ ID NO: 2464441 - RNA, 19 nt, Bordetella pertussis
gaucgccgguagcgcuggg

SEQ ID NO: 2464442 - RNA, 14 nt, Bordetella pertussis
gaucgccucggggc

SEQ ID NO: 2464443 - RNA, 16 nt, Bordetella pertussis
gaucgccucggggcuc

SEQ ID NO: 2464444 - RNA, 23 nt, Bordetella pertussis
gaucgccuggggggucaaccagg

SEQ ID NO: 2464445 - RNA, 13 nt, Bordetella pertussis
gaucgcgauggcc

SEQ ID NO: 2464446 - RNA, 16 nt, Bordetella pertussis
gaucgcgauggcccga

SEQ ID NO: 2464447 - RNA, 18 nt, Bordetella pertussis
gaucgcgcagcaccgcca

SEQ ID NO: 2464448 - RNA, 20 nt, Bordetella pertussis
gaucgcgcagcaccgccagc

SEQ ID NO: 2464449 - RNA, 22 nt, Bordetella pertussis
gaucgcgcagcaccgccagcgc

SEQ ID NO: 2464450 - RNA, 14 nt, Bordetella pertussis
gaucgcgcagcgcc

SEQ ID NO: 2464451 - RNA, 15 nt, Bordetella pertussis
gaucgcgcagcgccu

SEQ ID NO: 2464452 - RNA, 18 nt, Bordetella pertussis
gaucgcgcagcgccuggc

SEQ ID NO: 2464453 - RNA, 13 nt, Bordetella pertussis
gaucgcgccaggc

SEQ ID NO: 2464454 - RNA, 13 nt, Bordetella pertussis
gaucgcgcccagc

SEQ ID NO: 2464455 - RNA, 14 nt, Bordetella pertussis
gaucgcgccgacga

SEQ ID NO: 2464456 - RNA, 17 nt, Bordetella pertussis
gaucgcgccgacgaccg

SEQ ID NO: 2464457 - RNA, 18 nt, Bordetella pertussis
gaucgcgccggccugggc

SEQ ID NO: 2464458 - RNA, 22 nt, Bordetella pertussis
gaucgcgccggccugggcggcg

SEQ ID NO: 2464459 - RNA, 23 nt, Bordetella pertussis
gaucgcgccggccugggcggcgg

SEQ ID NO: 2464460 - RNA, 15 nt, Bordetella pertussis
gaucgcgcuggaccg

SEQ ID NO: 2464461 - RNA, 13 nt, Bordetella pertussis
gaucgcggccagc

SEQ ID NO: 2464462 - RNA, 14 nt, Bordetella pertussis
gaucgcggccagcc

SEQ ID NO: 2464463 - RNA, 15 nt, Bordetella pertussis
gaucgcggccagccg

SEQ ID NO: 2464464 - RNA, 16 nt, Bordetella pertussis
gaucgcggccagccgg

SEQ ID NO: 2464465 - RNA, 16 nt, Bordetella pertussis
gaucgcggccagcggc

SEQ ID NO: 2464466 - RNA, 17 nt, Bordetella pertussis
gaucgcggccagcggca

SEQ ID NO: 2464467 - RNA, 13 nt, Bordetella pertussis
gaucgcggcgcgg

SEQ ID NO: 2464468 - RNA, 13 nt, Bordetella pertussis
gaucgcggcgcug

SEQ ID NO: 2464469 - RNA, 14 nt, Bordetella pertussis
gaucgcggcgcugg

SEQ ID NO: 2464470 - RNA, 17 nt, Bordetella pertussis
gaucgcggcgcuggcga

SEQ ID NO: 2464471 - RNA, 12 nt, Bordetella pertussis
gaucgcggcggg

SEQ ID NO: 2464472 - RNA, 18 nt, Bordetella pertussis
gaucggacgggccgauga

SEQ ID NO: 2464473 - RNA, 17 nt, Bordetella pertussis
gaucggauagcggugca

SEQ ID NO: 2464474 - RNA, 16 nt, Bordetella pertussis
gaucggccaggccggc

SEQ ID NO: 2464475 - RNA, 17 nt, Bordetella pertussis
gaucggccaggccggcc

SEQ ID NO: 2464476 - RNA, 17 nt, Bordetella pertussis
gaucggcccgggcgugg

SEQ ID NO: 2464477 - RNA, 18 nt, Bordetella pertussis
gaucggcccgggcguggc

SEQ ID NO: 2464478 - RNA, 12 nt, Bordetella pertussis
gaucggccggcc

SEQ ID NO: 2464479 - RNA, 14 nt, Bordetella pertussis
gaucggccggccgg

SEQ ID NO: 2464480 - RNA, 16 nt, Bordetella pertussis
gaucggccucggucuc

SEQ ID NO: 2464481 - RNA, 22 nt, Bordetella pertussis
gaucggccugaaccaggccgcc

SEQ ID NO: 2464482 - RNA, 16 nt, Bordetella pertussis
gaucggcgcaaccggc

SEQ ID NO: 2464483 - RNA, 20 nt, Bordetella pertussis
gaucggcgcaaccggcccga

SEQ ID NO: 2464484 - RNA, 14 nt, Bordetella pertussis
gaucggcgccauga

SEQ ID NO: 2464485 - RNA, 21 nt, Bordetella pertussis
gaucggcgccaugaucgccgg

SEQ ID NO: 2464486 - RNA, 13 nt, Bordetella pertussis
gaucggcgccgcg

SEQ ID NO: 2464487 - RNA, 15 nt, Bordetella pertussis
gaucggcgccgcgcg

SEQ ID NO: 2464488 - RNA, 13 nt, Bordetella pertussis
gaucggcgcuggc

SEQ ID NO: 2464489 - RNA, 16 nt, Bordetella pertussis
gaucggcgcuggccug

SEQ ID NO: 2464490 - RNA, 17 nt, Bordetella pertussis
gaucggcgcuggccugg

SEQ ID NO: 2464491 - RNA, 16 nt, Bordetella pertussis
gaucggcggccugggc

SEQ ID NO: 2464492 - RNA, 23 nt, Bordetella pertussis
gaucggcguauugcuccacaggc

SEQ ID NO: 2464493 - RNA, 18 nt, Bordetella pertussis
gaucggcgucagcgccca

SEQ ID NO: 2464494 - RNA, 18 nt, Bordetella pertussis
gaucggcguggucgcagu

SEQ ID NO: 2464495 - RNA, 18 nt, Bordetella pertussis
gaucggcuugccgcgcgg

SEQ ID NO: 2464496 - RNA, 15 nt, Bordetella pertussis
gaucgggcagcuugg

SEQ ID NO: 2464497 - RNA, 23 nt, Bordetella pertussis
gaucggggcaacgacgcaggcgc

SEQ ID NO: 2464498 - RNA, 22 nt, Bordetella pertussis
gaucggggccaagauccagcuu

SEQ ID NO: 2464499 - RNA, 12 nt, Bordetella pertussis
gaucgucccagg

SEQ ID NO: 2464500 - RNA, 18 nt, Bordetella pertussis
gaucguccugaaucgccc

SEQ ID NO: 2464501 - RNA, 22 nt, Bordetella pertussis
gaucguccugaaucgcccgggc

SEQ ID NO: 2464502 - RNA, 15 nt, Bordetella pertussis
gaucgucgcugcgcg

SEQ ID NO: 2464503 - RNA, 19 nt, Bordetella pertussis
gaucgucuacgcgaacccc

SEQ ID NO: 2464504 - RNA, 17 nt, Bordetella pertussis
gaucgucuugaccagca

SEQ ID NO: 2464505 - RNA, 15 nt, Bordetella pertussis
gaucgugcacgcccg

SEQ ID NO: 2464506 - RNA, 19 nt, Bordetella pertussis
gaucgugcccagcuggcac

SEQ ID NO: 2464507 - RNA, 20 nt, Bordetella pertussis
gaucgugcccagcuggcacc

SEQ ID NO: 2464508 - RNA, 21 nt, Bordetella pertussis
gaucgugcccagcuggcaccg

SEQ ID NO: 2464509 - RNA, 24 nt, Bordetella pertussis
gaucgugcgccacuucgccucggc

SEQ ID NO: 2464510 - RNA, 18 nt, Bordetella pertussis
gaucguggcgccgcgggc

SEQ ID NO: 2464511 - RNA, 22 nt, Bordetella pertussis
gaucguucccuacccgccgggc

SEQ ID NO: 2464512 - RNA, 23 nt, Bordetella pertussis
gaucguucccuacccgccgggcg

SEQ ID NO: 2464513 - RNA, 15 nt, Bordetella pertussis
gaucuacgacgccug

SEQ ID NO: 2464514 - RNA, 17 nt, Bordetella pertussis
gaucuacgacgccugga

SEQ ID NO: 2464515 - RNA, 22 nt, Bordetella pertussis
gaucuacgacgccuggaccggc

SEQ ID NO: 2464516 - RNA, 19 nt, Bordetella pertussis
gaucuacgcgcgcgccggc

SEQ ID NO: 2464517 - RNA, 20 nt, Bordetella pertussis
gaucuacgcgcgcgccggca

SEQ ID NO: 2464518 - RNA, 23 nt, Bordetella pertussis
gaucuaggccguuuccucuggag

SEQ ID NO: 2464519 - RNA, 13 nt, Bordetella pertussis
gaucucacgggcg

SEQ ID NO: 2464520 - RNA, 17 nt, Bordetella pertussis
gaucucagccaucauca

SEQ ID NO: 2464521 - RNA, 22 nt, Bordetella pertussis
gaucucagccaucaucaucguc

SEQ ID NO: 2464522 - RNA, 15 nt, Bordetella pertussis
gaucuccacccccgg

SEQ ID NO: 2464523 - RNA, 22 nt, Bordetella pertussis
gaucuccgcccaggugcgggag

SEQ ID NO: 2464524 - RNA, 19 nt, Bordetella pertussis
gaucuccggcgccuggccg

SEQ ID NO: 2464525 - RNA, 16 nt, Bordetella pertussis
gaucuccgggagccug

SEQ ID NO: 2464526 - RNA, 17 nt, Bordetella pertussis
gaucuccgggagccugu

SEQ ID NO: 2464527 - RNA, 19 nt, Bordetella pertussis
gaucuccgggagccugucc

SEQ ID NO: 2464528 - RNA, 21 nt, Bordetella pertussis
gaucuccgggagccugucccc

SEQ ID NO: 2464529 - RNA, 13 nt, Bordetella pertussis
gaugcggcgcgcc

SEQ ID NO: 2464530 - RNA, 16 nt, Bordetella pertussis
gaugcggcgcgccgcg

SEQ ID NO: 2464531 - RNA, 16 nt, Bordetella pertussis
gaugcgggcaucgccc

SEQ ID NO: 2464532 - RNA, 22 nt, Bordetella pertussis
gaugcgggcaucgcccugcucg

SEQ ID NO: 2464533 - RNA, 16 nt, Bordetella pertussis
gaugcgggccacgccg

SEQ ID NO: 2464534 - RNA, 17 nt, Bordetella pertussis
gaugcgggccacgccgg

SEQ ID NO: 2464535 - RNA, 14 nt, Bordetella pertussis
gaugcgggccugga

SEQ ID NO: 2464536 - RNA, 20 nt, Bordetella pertussis
gaugcgggggaugaacagcg

SEQ ID NO: 2464537 - RNA, 14 nt, Bordetella pertussis
gaugcgggucggcg

SEQ ID NO: 2464538 - RNA, 19 nt, Bordetella pertussis
gaugcgggucggcgccaug

SEQ ID NO: 2464539 - RNA, 20 nt, Bordetella pertussis
gaugcgggucggcgccauga

SEQ ID NO: 2464540 - RNA, 15 nt, Bordetella pertussis
gaugcgguaccacgc

SEQ ID NO: 2464541 - RNA, 16 nt, Bordetella pertussis
gaugcgguaccacgcg

SEQ ID NO: 2464542 - RNA, 17 nt, Bordetella pertussis
gaugcgguaccacgcga

SEQ ID NO: 2464543 - RNA, 17 nt, Bordetella pertussis
gaugcgguacugcggcg

SEQ ID NO: 2464544 - RNA, 19 nt, Bordetella pertussis
gaugcgguacugcggcgcc

SEQ ID NO: 2464545 - RNA, 20 nt, Bordetella pertussis
gaugcgguacugcggcgccu

SEQ ID NO: 2464546 - RNA, 18 nt, Bordetella pertussis
gaugcgguaggcccagca

SEQ ID NO: 2464547 - RNA, 16 nt, Bordetella pertussis
gaugcggucggccgcg

SEQ ID NO: 2464548 - RNA, 17 nt, Bordetella pertussis
gaugcggucggccgcgc

SEQ ID NO: 2464549 - RNA, 11 nt, Bordetella pertussis
gaugcgguggg

SEQ ID NO: 2464550 - RNA, 20 nt, Bordetella pertussis
gaugcgguuguugccgcguc

SEQ ID NO: 2464551 - RNA, 18 nt, Bordetella pertussis
gaugcgguuuuugaggac

SEQ ID NO: 2464552 - RNA, 13 nt, Bordetella pertussis
gaugcgucagggg

SEQ ID NO: 2464553 - RNA, 20 nt, Bordetella pertussis
gaugcguucgaaagccagcg

SEQ ID NO: 2464554 - RNA, 22 nt, Bordetella pertussis
gaugcguucgaaagccagcgcc

SEQ ID NO: 2464555 - RNA, 23 nt, Bordetella pertussis
gaugcguucgaaagccagcgccu

SEQ ID NO: 2464556 - RNA, 14 nt, Bordetella pertussis
gaugcucacgccca

SEQ ID NO: 2464557 - RNA, 14 nt, Bordetella pertussis
gaugcucgccggcg

SEQ ID NO: 2464558 - RNA, 16 nt, Bordetella pertussis
gaugcucgccggcgcc

SEQ ID NO: 2464559 - RNA, 19 nt, Bordetella pertussis
gaugcucgccggcgccgcc

SEQ ID NO: 2464560 - RNA, 15 nt, Bordetella pertussis
gaugcugccgggcau

SEQ ID NO: 2464561 - RNA, 15 nt, Bordetella pertussis
gaugcugccgucgcc

SEQ ID NO: 2464562 - RNA, 14 nt, Bordetella pertussis
gaugcuggucagcc

SEQ ID NO: 2464563 - RNA, 15 nt, Bordetella pertussis
gaugcuugcggggca

SEQ ID NO: 2464564 - RNA, 23 nt, Bordetella pertussis
gaugcuugcuugccagcucgacg

SEQ ID NO: 2464565 - RNA, 19 nt, Bordetella pertussis
gauggaaaugccguccagg

SEQ ID NO: 2464566 - RNA, 12 nt, Bordetella pertussis
gauggaacucgu

SEQ ID NO: 2464567 - RNA, 22 nt, Bordetella pertussis
gauggaacucguuggccagcgc

SEQ ID NO: 2464568 - RNA, 22 nt, Bordetella pertussis
gauggaaucauuggccagcgcg

SEQ ID NO: 2464569 - RNA, 21 nt, Bordetella pertussis
gauggaaucgucgaccagcag

SEQ ID NO: 2464570 - RNA, 16 nt, Bordetella pertussis
gauggacuugaccaug

SEQ ID NO: 2464571 - RNA, 16 nt, Bordetella pertussis
gauggagagggccugg

SEQ ID NO: 2464572 - RNA, 14 nt, Bordetella pertussis
gauggaggccagga

SEQ ID NO: 2464573 - RNA, 19 nt, Bordetella pertussis
gauggaguucagcagcucg

SEQ ID NO: 2464574 - RNA, 17 nt, Bordetella pertussis
gauggaucccuggucga

SEQ ID NO: 2464575 - RNA, 21 nt, Bordetella pertussis
gauggaugccgucggccugga

SEQ ID NO: 2464576 - RNA, 18 nt, Bordetella pertussis
gauggauucgcgccggcc

SEQ ID NO: 2464577 - RNA, 17 nt, Bordetella pertussis
gauggauuucgaccgca

SEQ ID NO: 2464578 - RNA, 14 nt, Bordetella pertussis
gauggcacggcacg

SEQ ID NO: 2464579 - RNA, 15 nt, Bordetella pertussis
gauggccacgaccac

SEQ ID NO: 2464580 - RNA, 17 nt, Bordetella pertussis
gauggccacgaccacca

SEQ ID NO: 2464581 - RNA, 20 nt, Bordetella pertussis
gauggccacgaccaccagcg

SEQ ID NO: 2464582 - RNA, 15 nt, Bordetella pertussis
gauggccacgcgcug

SEQ ID NO: 2464583 - RNA, 16 nt, Bordetella pertussis
gauggccagcagcgcc

SEQ ID NO: 2464584 - RNA, 18 nt, Bordetella pertussis
gauggccagcagcgccgc

SEQ ID NO: 2464585 - RNA, 16 nt, Bordetella pertussis
gauggccagcgcgcgg

SEQ ID NO: 2464586 - RNA, 18 nt, Bordetella pertussis
gauggccagguggcggcg

SEQ ID NO: 2464587 - RNA, 15 nt, Bordetella pertussis
gauggccaucgacgc

SEQ ID NO: 2464588 - RNA, 14 nt, Bordetella pertussis
gauggccauggcca

SEQ ID NO: 2464589 - RNA, 14 nt, Bordetella pertussis
gauggcccagggca

SEQ ID NO: 2464590 - RNA, 17 nt, Bordetella pertussis
gauggcccagggcagcg

SEQ ID NO: 2464591 - RNA, 20 nt, Bordetella pertussis
gauggcccagggcagcggcc

SEQ ID NO: 2464592 - RNA, 21 nt, Bordetella pertussis
gauggcccagggcagcggcca

SEQ ID NO: 2464593 - RNA, 19 nt, Bordetella pertussis
gauggcccgcagguggggc

SEQ ID NO: 2464594 - RNA, 22 nt, Bordetella pertussis
gauggcccgcagguggggcagc

SEQ ID NO: 2464595 - RNA, 23 nt, Bordetella pertussis
gauggcccgcagguggggcagca

SEQ ID NO: 2464596 - RNA, 17 nt, Bordetella pertussis
gauggcccuugcccagc

SEQ ID NO: 2464597 - RNA, 17 nt, Bordetella pertussis
gauggccgaaucguuca

SEQ ID NO: 2464598 - RNA, 20 nt, Bordetella pertussis
gauggccgaaugcccgcccu

SEQ ID NO: 2464599 - RNA, 17 nt, Bordetella pertussis
gauggccgacaugucgu

SEQ ID NO: 2464600 - RNA, 22 nt, Bordetella pertussis
gauggccgacaugucgugcugg

SEQ ID NO: 2464601 - RNA, 20 nt, Bordetella pertussis
gauggccgccagcggcuggc

SEQ ID NO: 2464602 - RNA, 23 nt, Bordetella pertussis
gauggccgccagcguaucgccgc

SEQ ID NO: 2464603 - RNA, 12 nt, Bordetella pertussis
gauggccgcgcc

SEQ ID NO: 2464604 - RNA, 14 nt, Bordetella pertussis
gauggccgcgccca

SEQ ID NO: 2464605 - RNA, 17 nt, Bordetella pertussis
gauggccgcgcgcagcg

SEQ ID NO: 2464606 - RNA, 15 nt, Bordetella pertussis
gauggccggccugcc

SEQ ID NO: 2464607 - RNA, 16 nt, Bordetella pertussis
gauggccggccugccg

SEQ ID NO: 2464608 - RNA, 17 nt, Bordetella pertussis
gauggccggccugccgg

SEQ ID NO: 2464609 - RNA, 13 nt, Bordetella pertussis
gauggccggcgcg

SEQ ID NO: 2464610 - RNA, 16 nt, Bordetella pertussis
gauggccggcgcgaac

SEQ ID NO: 2464611 - RNA, 20 nt, Bordetella pertussis
gauggccgggagcggccagc

SEQ ID NO: 2464612 - RNA, 16 nt, Bordetella pertussis
gauggccggggcgucg

SEQ ID NO: 2464613 - RNA, 14 nt, Bordetella pertussis
gauggccggguggu

SEQ ID NO: 2464614 - RNA, 13 nt, Bordetella pertussis
gauggccucggcg

SEQ ID NO: 2464615 - RNA, 15 nt, Bordetella pertussis
gauggccucggcggc

SEQ ID NO: 2464616 - RNA, 21 nt, Bordetella pertussis
gauggccugcuuggcgcgcag

SEQ ID NO: 2464617 - RNA, 18 nt, Bordetella pertussis
gauggccugugcggccca

SEQ ID NO: 2464618 - RNA, 18 nt, Bordetella pertussis
gauggccuuuuccaggcg

SEQ ID NO: 2464619 - RNA, 21 nt, Bordetella pertussis
gauggccuuuuccaggcgugc

SEQ ID NO: 2464620 - RNA, 18 nt, Bordetella pertussis
gauggcgaaacuggccga

SEQ ID NO: 2464621 - RNA, 21 nt, Bordetella pertussis
gauggcgaucaggaaaagcag

SEQ ID NO: 2464622 - RNA, 20 nt, Bordetella pertussis
gauggcgaucuucugggcgg

SEQ ID NO: 2464623 - RNA, 16 nt, Bordetella pertussis
gauggcgauggcuugg

SEQ ID NO: 2464624 - RNA, 19 nt, Bordetella pertussis
gauggcgauggcuuggcgc

SEQ ID NO: 2464625 - RNA, 19 nt, Bordetella pertussis
gauggcgauguaggccagg

SEQ ID NO: 2464626 - RNA, 20 nt, Bordetella pertussis
gauggcgauguaggccaggu

SEQ ID NO: 2464627 - RNA, 19 nt, Bordetella pertussis
gauggcgauguccagcgag

SEQ ID NO: 2464628 - RNA, 22 nt, Bordetella pertussis
gauggcgcaauaggccgcgaug

SEQ ID NO: 2464629 - RNA, 14 nt, Bordetella pertussis
gaucucgcccugcu

SEQ ID NO: 2464630 - RNA, 22 nt, Bordetella pertussis
gaucucgcccugcucgcgcagc

SEQ ID NO: 2464631 - RNA, 15 nt, Bordetella pertussis
gaucucgcgcaccga

SEQ ID NO: 2464632 - RNA, 16 nt, Bordetella pertussis
gaucucgcgcgcgcgg

SEQ ID NO: 2464633 - RNA, 20 nt, Bordetella pertussis
gaucucgcgcgcgcggucca

SEQ ID NO: 2464634 - RNA, 14 nt, Bordetella pertussis
gaucucggccagca

SEQ ID NO: 2464635 - RNA, 15 nt, Bordetella pertussis
gaucucggccagcag

SEQ ID NO: 2464636 - RNA, 20 nt, Bordetella pertussis
gaucucggccagcagcgccu

SEQ ID NO: 2464637 - RNA, 14 nt, Bordetella pertussis
gaucucgggcaggu

SEQ ID NO: 2464638 - RNA, 23 nt, Bordetella pertussis
gaucucgggcgaggucagcccgg

SEQ ID NO: 2464639 - RNA, 15 nt, Bordetella pertussis
gaucucguccugcag

SEQ ID NO: 2464640 - RNA, 16 nt, Bordetella pertussis
gaucucgucgaccgcc

SEQ ID NO: 2464641 - RNA, 22 nt, Bordetella pertussis
gaucugacgggucacccgccgc

SEQ ID NO: 2464642 - RNA, 23 nt, Bordetella pertussis
gaucugacgggucacccgccgca

SEQ ID NO: 2464643 - RNA, 21 nt, Bordetella pertussis
gaucugcauguacucggccag

SEQ ID NO: 2464644 - RNA, 23 nt, Bordetella pertussis
gaucugcauguacucggccaggc

SEQ ID NO: 2464645 - RNA, 14 nt, Bordetella pertussis
gaucugcgcggcgg

SEQ ID NO: 2464646 - RNA, 15 nt, Bordetella pertussis
gaucugcgcggcggu

SEQ ID NO: 2464647 - RNA, 14 nt, Bordetella pertussis
gaucugcuggcucg

SEQ ID NO: 2464648 - RNA, 16 nt, Bordetella pertussis
gaucugcugggccggg

SEQ ID NO: 2464649 - RNA, 11 nt, Bordetella pertussis
gaucugcuuga

SEQ ID NO: 2464650 - RNA, 12 nt, Bordetella pertussis
gauggcgcagcg

SEQ ID NO: 2464651 - RNA, 14 nt, Bordetella pertussis
gauggcgccagccc

SEQ ID NO: 2464652 - RNA, 17 nt, Bordetella pertussis
gauggcgccagcccgcc

SEQ ID NO: 2464653 - RNA, 16 nt, Bordetella pertussis
gauggcgcccacggcc

SEQ ID NO: 2464654 - RNA, 21 nt, Bordetella pertussis
gauggcgccgauuucgccgcc

SEQ ID NO: 2464655 - RNA, 22 nt, Bordetella pertussis
gauggcgccgauuucgccgccg

SEQ ID NO: 2464656 - RNA, 17 nt, Bordetella pertussis
gauggcgccgcugucgc

SEQ ID NO: 2464657 - RNA, 14 nt, Bordetella pertussis
gauggcgccggcca

SEQ ID NO: 2464658 - RNA, 19 nt, Bordetella pertussis
gauggcgccggccagcgcg

SEQ ID NO: 2464659 - RNA, 21 nt, Bordetella pertussis
gauggcgccggccagcgcgcc

SEQ ID NO: 2464660 - RNA, 12 nt, Bordetella pertussis
gauggcgcgcgc

SEQ ID NO: 2464661 - RNA, 17 nt, Bordetella pertussis
gauggcgcgcggcuggg

SEQ ID NO: 2464662 - RNA, 13 nt, Bordetella pertussis
gauggcgcggccg

SEQ ID NO: 2464663 - RNA, 15 nt, Bordetella pertussis
gauggcgcggccgga

SEQ ID NO: 2464664 - RNA, 15 nt, Bordetella pertussis
gauggcgcgucgccg

SEQ ID NO: 2464665 - RNA, 19 nt, Bordetella pertussis
gauggcgcgucgccgcgcc

SEQ ID NO: 2464666 - RNA, 16 nt, Bordetella pertussis
gauggcggccagggca

SEQ ID NO: 2464667 - RNA, 16 nt, Bordetella pertussis
gauggcggccgccagc

SEQ ID NO: 2464668 - RNA, 11 nt, Bordetella pertussis
gauggcggcgc

SEQ ID NO: 2464669 - RNA, 12 nt, Bordetella pertussis
gauggcggcggc

SEQ ID NO: 2464670 - RNA, 14 nt, Bordetella pertussis
gauggcggggaugg

SEQ ID NO: 2464671 - RNA, 22 nt, Bordetella pertussis
gauggcgggguuggccgccagg

SEQ ID NO: 2464672 - RNA, 17 nt, Bordetella pertussis
gauggcggucaccaacg

SEQ ID NO: 2464673 - RNA, 15 nt, Bordetella pertussis
gauggcggugguggg

SEQ ID NO: 2464674 - RNA, 17 nt, Bordetella pertussis
gauggcgguggugggca

SEQ ID NO: 2464675 - RNA, 15 nt, Bordetella pertussis
gauggcguacagcag

SEQ ID NO: 2464676 - RNA, 13 nt, Bordetella pertussis
gauggcguaggcg

SEQ ID NO: 2464677 - RNA, 16 nt, Bordetella pertussis
gauggcguccagcagc

SEQ ID NO: 2464678 - RNA, 17 nt, Bordetella pertussis
gauggcguccagcagca

SEQ ID NO: 2464679 - RNA, 19 nt, Bordetella pertussis
gauggcgugcacgcguaug

SEQ ID NO: 2464680 - RNA, 15 nt, Bordetella pertussis
gauggcucgggcagc

SEQ ID NO: 2464681 - RNA, 19 nt, Bordetella pertussis
gauggcuuccugcggcacg

SEQ ID NO: 2464682 - RNA, 16 nt, Bordetella pertussis
gauggcuucgcgcaca

SEQ ID NO: 2464683 - RNA, 19 nt, Bordetella pertussis
gaugggcagcucgccuucg

SEQ ID NO: 2464684 - RNA, 14 nt, Bordetella pertussis
gaugggcaggccca

SEQ ID NO: 2464685 - RNA, 20 nt, Bordetella pertussis
gaugggcaggcccaugacgc

SEQ ID NO: 2464686 - RNA, 13 nt, Bordetella pertussis
gaugggccaccca

SEQ ID NO: 2464687 - RNA, 15 nt, Bordetella pertussis
gaugggccacccagc

SEQ ID NO: 2464688 - RNA, 22 nt, Bordetella pertussis
gaugggcccgggcaggcucagc

SEQ ID NO: 2464689 - RNA, 23 nt, Bordetella pertussis
gaugggccugcccauggccugca

SEQ ID NO: 2464690 - RNA, 14 nt, Bordetella pertussis
gaugggcgcgcgca

SEQ ID NO: 2464691 - RNA, 16 nt, Bordetella pertussis
gaugggcgcgcgcauc

SEQ ID NO: 2464692 - RNA, 15 nt, Bordetella pertussis
gaugggcgcggcgcg

SEQ ID NO: 2464693 - RNA, 20 nt, Bordetella pertussis
gaugggcgcggcgcgcgccg

SEQ ID NO: 2464694 - RNA, 13 nt, Bordetella pertussis
gaugggcggccua

SEQ ID NO: 2464695 - RNA, 13 nt, Bordetella pertussis
gaugggcggccuu

SEQ ID NO: 2464696 - RNA, 13 nt, Bordetella pertussis
gauggggccgcgc

SEQ ID NO: 2464697 - RNA, 14 nt, Bordetella pertussis
gauggggccgcgcc

SEQ ID NO: 2464698 - RNA, 17 nt, Bordetella pertussis
gauggggccgggcgcca

SEQ ID NO: 2464699 - RNA, 13 nt, Bordetella pertussis
gauggggccgucg

SEQ ID NO: 2464700 - RNA, 22 nt, Bordetella pertussis
gauggggguggaaaugccggcg

SEQ ID NO: 2464701 - RNA, 15 nt, Bordetella pertussis
gauggguacagcgcg

SEQ ID NO: 2464702 - RNA, 15 nt, Bordetella pertussis
gauggguacgccggc

SEQ ID NO: 2464703 - RNA, 17 nt, Bordetella pertussis
gauggguacgccggccu

SEQ ID NO: 2464704 - RNA, 19 nt, Bordetella pertussis
gauggguacgccggccuga

SEQ ID NO: 2464705 - RNA, 20 nt, Bordetella pertussis
gauggucacgcccaggcgcu

SEQ ID NO: 2464706 - RNA, 14 nt, Bordetella pertussis
gauggucgcggccg

SEQ ID NO: 2464707 - RNA, 21 nt, Bordetella pertussis
gauggucggugccgccgagca

SEQ ID NO: 2464708 - RNA, 18 nt, Bordetella pertussis
gauggucgugcggcacgc

SEQ ID NO: 2464709 - RNA, 19 nt, Bordetella pertussis
gauggucgugcggcacgca

SEQ ID NO: 2464710 - RNA, 20 nt, Bordetella pertussis
gauggucugccacaucacgc

SEQ ID NO: 2464711 - RNA, 17 nt, Bordetella pertussis
gauggucuugccgccgu

SEQ ID NO: 2464712 - RNA, 20 nt, Bordetella pertussis
gauggugcauucguccaggu

SEQ ID NO: 2464713 - RNA, 14 nt, Bordetella pertussis
gauggugcgggcga

SEQ ID NO: 2464714 - RNA, 16 nt, Bordetella pertussis
gauggugucgaagccg

SEQ ID NO: 2464715 - RNA, 20 nt, Bordetella pertussis
gauguagcccauggccaggg

SEQ ID NO: 2464716 - RNA, 21 nt, Bordetella pertussis
gauguagcccauggccaggga

SEQ ID NO: 2464717 - RNA, 13 nt, Bordetella pertussis
gauguaggccagg

SEQ ID NO: 2464718 - RNA, 11 nt, Bordetella pertussis
gauguaugacu

SEQ ID NO: 2464719 - RNA, 23 nt, Bordetella pertussis
gaugucaguccucaugcgggaca

SEQ ID NO: 2464720 - RNA, 19 nt, Bordetella pertussis
gauguccacggucgccggc

SEQ ID NO: 2464721 - RNA, 19 nt, Bordetella pertussis
gauguccagcgccagcagg

SEQ ID NO: 2464722 - RNA, 16 nt, Bordetella pertussis
gauguccauggccugc

SEQ ID NO: 2464723 - RNA, 14 nt, Bordetella pertussis
gauguccggcgcga

SEQ ID NO: 2464724 - RNA, 19 nt, Bordetella pertussis
gauguccggcgcgaacggc

SEQ ID NO: 2464725 - RNA, 14 nt, Bordetella pertussis
gauguccugcaggc

SEQ ID NO: 2464726 - RNA, 16 nt, Bordetella pertussis
gauguccugcaggccc

SEQ ID NO: 2464727 - RNA, 17 nt, Bordetella pertussis
gauguccugcaggcccg

SEQ ID NO: 2464728 - RNA, 23 nt, Bordetella pertussis
gauguccugguugccgaggacgg

SEQ ID NO: 2464729 - RNA, 13 nt, Bordetella pertussis
gaugucgaacagc

SEQ ID NO: 2464730 - RNA, 20 nt, Bordetella pertussis
gaugucgaacagcugcagcg

SEQ ID NO: 2464731 - RNA, 23 nt, Bordetella pertussis
gaugucgaacagcugcagcgacu

SEQ ID NO: 2464732 - RNA, 17 nt, Bordetella pertussis
gaugucgccgccgcgca

SEQ ID NO: 2464733 - RNA, 15 nt, Bordetella pertussis
gaugucgccgccugc

SEQ ID NO: 2464734 - RNA, 14 nt, Bordetella pertussis
gaugucgcgcaccg

SEQ ID NO: 2464735 - RNA, 16 nt, Bordetella pertussis
gaugucgcgcgccugc

SEQ ID NO: 2464736 - RNA, 15 nt, Bordetella pertussis
gaugucgcgcgcgcu

SEQ ID NO: 2464737 - RNA, 16 nt, Bordetella pertussis
gaugucgcgcgcgcuc

SEQ ID NO: 2464738 - RNA, 18 nt, Bordetella pertussis
gaugucggugaaggccac

SEQ ID NO: 2464739 - RNA, 16 nt, Bordetella pertussis
gaugucgugaucgcca

SEQ ID NO: 2464740 - RNA, 17 nt, Bordetella pertussis
gaugucgugaucgccag

SEQ ID NO: 2464741 - RNA, 18 nt, Bordetella pertussis
gaugucgugaucgccagc

SEQ ID NO: 2464742 - RNA, 19 nt, Bordetella pertussis
gaugucgugaucgccagcg

SEQ ID NO: 2464743 - RNA, 13 nt, Bordetella pertussis
gaugugcagcgca

SEQ ID NO: 2464744 - RNA, 15 nt, Bordetella pertussis
gaugugcagcgcacg

SEQ ID NO: 2464745 - RNA, 16 nt, Bordetella pertussis
gaugugcggcguggcg

SEQ ID NO: 2464746 - RNA, 23 nt, Bordetella pertussis
gaugugcggcguggcggggcguu

SEQ ID NO: 2464747 - RNA, 19 nt, Bordetella pertussis
gauguggcgcuggcggcug

SEQ ID NO: 2464748 - RNA, 20 nt, Bordetella pertussis
gauguggcgcuggcggcugc

SEQ ID NO: 2464749 - RNA, 17 nt, Bordetella pertussis
gauguggucggcgccga

SEQ ID NO: 2464750 - RNA, 23 nt, Bordetella pertussis
gauguucaugaccgccgcgccgg

SEQ ID NO: 2464751 - RNA, 15 nt, Bordetella pertussis
gauguuccugcgcga

SEQ ID NO: 2464752 - RNA, 17 nt, Bordetella pertussis
gauguuccugcgcgaca

SEQ ID NO: 2464753 - RNA, 15 nt, Bordetella pertussis
gauguugcgcaggcu

SEQ ID NO: 2464754 - RNA, 18 nt, Bordetella pertussis
gauguugcgcaggcuguc

SEQ ID NO: 2464755 - RNA, 20 nt, Bordetella pertussis
gauguuguuggccgccagcc

SEQ ID NO: 2464756 - RNA, 21 nt, Bordetella pertussis
gauuagccucguuggucagca

SEQ ID NO: 2464757 - RNA, 16 nt, Bordetella pertussis
gauuaugccgcccgca

SEQ ID NO: 2464758 - RNA, 22 nt, Bordetella pertussis
gauucacaggcccgcgcggcca

SEQ ID NO: 2464759 - RNA, 15 nt, Bordetella pertussis
gauuccaccuugccg

SEQ ID NO: 2464760 - RNA, 20 nt, Bordetella pertussis
gauuccaggacgacaggcau

SEQ ID NO: 2464761 - RNA, 22 nt, Bordetella pertussis
gauuccaggacgacaggcaugc

SEQ ID NO: 2464762 - RNA, 13 nt, Bordetella pertussis
gauucccaggccc

SEQ ID NO: 2464763 - RNA, 17 nt, Bordetella pertussis
gauucccaggcccggcc

SEQ ID NO: 2464764 - RNA, 12 nt, Bordetella pertussis
gauucccccgca

SEQ ID NO: 2464765 - RNA, 23 nt, Bordetella pertussis
gauucccuggcgcgccagcucgc

SEQ ID NO: 2464766 - RNA, 14 nt, Bordetella pertussis
gcaccacggcgcgc

SEQ ID NO: 2464767 - RNA, 15 nt, Bordetella pertussis
gcaccacggcgcgcg

SEQ ID NO: 2464768 - RNA, 15 nt, Bordetella pertussis
gcaccacggcggcca

SEQ ID NO: 2464769 - RNA, 18 nt, Bordetella pertussis
gcaccacggcggccaggc

SEQ ID NO: 2464770 - RNA, 16 nt, Bordetella pertussis
gcaccggggcagggcg

SEQ ID NO: 2464771 - RNA, 19 nt, Bordetella pertussis
gcaccggguaauggcgcuc

SEQ ID NO: 2464772 - RNA, 18 nt, Bordetella pertussis
gcaccggugggagccagu

SEQ ID NO: 2464773 - RNA, 14 nt, Bordetella pertussis
gcaccgucacgcgc

SEQ ID NO: 2464774 - RNA, 15 nt, Bordetella pertussis
gcaccgucacgcgcu

SEQ ID NO: 2464775 - RNA, 16 nt, Bordetella pertussis
gcaccgucacgcgcug

SEQ ID NO: 2464776 - RNA, 15 nt, Bordetella pertussis
gcaccgucaggugca

SEQ ID NO: 2464777 - RNA, 17 nt, Bordetella pertussis
gcaccgucaggugcagc

SEQ ID NO: 2464778 - RNA, 23 nt, Bordetella pertussis
gcaccgucgccagggcgaugacc

SEQ ID NO: 2464779 - RNA, 12 nt, Bordetella pertussis
gcaccgugaccu

SEQ ID NO: 2464780 - RNA, 15 nt, Bordetella pertussis
gcaccgugaccugcg

SEQ ID NO: 2464781 - RNA, 15 nt, Bordetella pertussis
gcaccgugaugcgcg

SEQ ID NO: 2464782 - RNA, 18 nt, Bordetella pertussis
gcaccgugaugcgcgccg

SEQ ID NO: 2464783 - RNA, 20 nt, Bordetella pertussis
gcaccgugaugucgccgucg

SEQ ID NO: 2464784 - RNA, 14 nt, Bordetella pertussis
gcaccgugccggcg

SEQ ID NO: 2464785 - RNA, 17 nt, Bordetella pertussis
gcaccgugccggcguau

SEQ ID NO: 2464786 - RNA, 21 nt, Bordetella pertussis
gcaccuagcauaucggugccc

SEQ ID NO: 2464787 - RNA, 21 nt, Bordetella pertussis
gcaccucacggugaccgggug

SEQ ID NO: 2464788 - RNA, 16 nt, Bordetella pertussis
gcaccucgacgcagcc

SEQ ID NO: 2464789 - RNA, 22 nt, Bordetella pertussis
gcaccucggacgagacaggcgc

SEQ ID NO: 2464790 - RNA, 23 nt, Bordetella pertussis
gcaccucggacgagacaggcgcg

SEQ ID NO: 2464791 - RNA, 17 nt, Bordetella pertussis
gcaccucggcgcccagc

SEQ ID NO: 2464792 - RNA, 18 nt, Bordetella pertussis
gcaccucggcgccgcggc

SEQ ID NO: 2464793 - RNA, 17 nt, Bordetella pertussis
gcaccucggggcgcggc

SEQ ID NO: 2464794 - RNA, 18 nt, Bordetella pertussis
gcaccucggggcgcggcc

SEQ ID NO: 2464795 - RNA, 22 nt, Bordetella pertussis
gcaccucguaaguggcggcggg

SEQ ID NO: 2464796 - RNA, 17 nt, Bordetella pertussis
gcaccugcaccgaagca

SEQ ID NO: 2464797 - RNA, 14 nt, Bordetella pertussis
gcaccugcaggccg

SEQ ID NO: 2464798 - RNA, 15 nt, Bordetella pertussis
gcaccugcaggccgc

SEQ ID NO: 2464799 - RNA, 17 nt, Bordetella pertussis
gcaccugcaggccgccg

SEQ ID NO: 2464800 - RNA, 20 nt, Bordetella pertussis
gcaccugcaggccgccggcc

SEQ ID NO: 2464801 - RNA, 14 nt, Bordetella pertussis
gcaccugcaggguc

SEQ ID NO: 2464802 - RNA, 23 nt, Bordetella pertussis
gcaccugcagggucagcccgcca

SEQ ID NO: 2464803 - RNA, 14 nt, Bordetella pertussis
gcaccugccugccg

SEQ ID NO: 2464804 - RNA, 16 nt, Bordetella pertussis
gcaccugccugccgcc

SEQ ID NO: 2464805 - RNA, 21 nt, Bordetella pertussis
gcaccugccugccgccugcca

SEQ ID NO: 2464806 - RNA, 22 nt, Bordetella pertussis
gcaccugccugccgccugccag

SEQ ID NO: 2464807 - RNA, 19 nt, Bordetella pertussis
gcaccugcgaccgagccac

SEQ ID NO: 2464808 - RNA, 23 nt, Bordetella pertussis
gcaccugcgucugcacgcugaac

SEQ ID NO: 2464809 - RNA, 14 nt, Bordetella pertussis
gcaccugcguggcc

SEQ ID NO: 2464810 - RNA, 15 nt, Bordetella pertussis
gcaccugcguggccu

SEQ ID NO: 2464811 - RNA, 14 nt, Bordetella pertussis
gcaccugcuccagc

SEQ ID NO: 2464812 - RNA, 15 nt, Bordetella pertussis
gcaccugcuccagcg

SEQ ID NO: 2464813 - RNA, 17 nt, Bordetella pertussis
gcaccugcugcggcacg

SEQ ID NO: 2464814 - RNA, 18 nt, Bordetella pertussis
gcaccugcugcggcacgg

SEQ ID NO: 2464815 - RNA, 19 nt, Bordetella pertussis
gcaccugcugcggcacggc

SEQ ID NO: 2464816 - RNA, 20 nt, Bordetella pertussis
gcaccugcugcggcacggcc

SEQ ID NO: 2464817 - RNA, 15 nt, Bordetella pertussis
gcaccugcugcuuga

SEQ ID NO: 2464818 - RNA, 22 nt, Bordetella pertussis
gcaccugcugcuugaccuuggc

SEQ ID NO: 2464819 - RNA, 23 nt, Bordetella pertussis
gcaccugcugcuugaccuuggcu

SEQ ID NO: 2464820 - RNA, 23 nt, Bordetella pertussis
gcaccugcuugagcaccacgucc

SEQ ID NO: 2464821 - RNA, 19 nt, Bordetella pertussis
gcaccugguccugcgugau

SEQ ID NO: 2464822 - RNA, 13 nt, Bordetella pertussis
gcaccugguggcg

SEQ ID NO: 2464823 - RNA, 20 nt, Bordetella pertussis
gcaccugguggcgcuggccc

SEQ ID NO: 2464824 - RNA, 17 nt, Bordetella pertussis
gcaccuguucggcggcg

SEQ ID NO: 2464825 - RNA, 20 nt, Bordetella pertussis
gcaccuguucggcggcgccc

SEQ ID NO: 2464826 - RNA, 14 nt, Bordetella pertussis
gcaccuucgaggaa

SEQ ID NO: 2464827 - RNA, 18 nt, Bordetella pertussis
gcaccuucugccgccagg

SEQ ID NO: 2464828 - RNA, 19 nt, Bordetella pertussis
gcaccuucugccgccaggc

SEQ ID NO: 2464829 - RNA, 20 nt, Bordetella pertussis
gcaccuucugccgccaggca

SEQ ID NO: 2464830 - RNA, 20 nt, Bordetella pertussis
gcaccuucuuccaggcgccc

SEQ ID NO: 2464831 - RNA, 16 nt, Bordetella pertussis
gcaccuugcccacgcc

SEQ ID NO: 2464832 - RNA, 14 nt, Bordetella pertussis
gcaccuugccugca

SEQ ID NO: 2464833 - RNA, 15 nt, Bordetella pertussis
gcaccuugccugcaa

SEQ ID NO: 2464834 - RNA, 14 nt, Bordetella pertussis
gcaccuuggcccgg

SEQ ID NO: 2464835 - RNA, 15 nt, Bordetella pertussis
gcaccuugggcgccu

SEQ ID NO: 2464836 - RNA, 17 nt, Bordetella pertussis
gcaccuugggcgccugc

SEQ ID NO: 2464837 - RNA, 23 nt, Bordetella pertussis
gcaccuuguacuggucgcgcagc

SEQ ID NO: 2464838 - RNA, 17 nt, Bordetella pertussis
gcaccuugucgcgcagc

SEQ ID NO: 2464839 - RNA, 19 nt, Bordetella pertussis
gcaccuugucgcgcagcgc

SEQ ID NO: 2464840 - RNA, 20 nt, Bordetella pertussis
gcaccuugucgcgcagcgcc

SEQ ID NO: 2464841 - RNA, 16 nt, Bordetella pertussis
gcaccuuucugcugcu

SEQ ID NO: 2464842 - RNA, 17 nt, Bordetella pertussis
gcaccuuucugcugcuc

SEQ ID NO: 2464843 - RNA, 22 nt, Bordetella pertussis
gcaccuuucugcugcucgcggc

SEQ ID NO: 2464844 - RNA, 17 nt, Bordetella pertussis
gcacgaaaagccgcggc

SEQ ID NO: 2464845 - RNA, 19 nt, Bordetella pertussis
gcacgaacagguugaagcc

SEQ ID NO: 2464846 - RNA, 22 nt, Bordetella pertussis
gcacgaaccacaggguggcgcc

SEQ ID NO: 2464847 - RNA, 16 nt, Bordetella pertussis
gcacgaacgacacccg

SEQ ID NO: 2464848 - RNA, 20 nt, Bordetella pertussis
gcacgaagccgaugcgccgc

SEQ ID NO: 2464849 - RNA, 22 nt, Bordetella pertussis
gcacgaagccgaugcgccgcgc

SEQ ID NO: 2464850 - RNA, 23 nt, Bordetella pertussis
gcacgaagccgaugcgccgcgcu

SEQ ID NO: 2464851 - RNA, 11 nt, Bordetella pertussis
gcacgaagcgg

SEQ ID NO: 2464852 - RNA, 19 nt, Bordetella pertussis
gcacgaagggcagcagcag

SEQ ID NO: 2464853 - RNA, 19 nt, Bordetella pertussis
gcacgaaguacucgccggc

SEQ ID NO: 2464854 - RNA, 20 nt, Bordetella pertussis
gcacgaaguacucgccggcg

SEQ ID NO: 2464855 - RNA, 22 nt, Bordetella pertussis
gcacgaauguggucgccguucu

SEQ ID NO: 2464856 - RNA, 15 nt, Bordetella pertussis
gcacgaccaccagcg

SEQ ID NO: 2464857 - RNA, 13 nt, Bordetella pertussis
gcacgaccaggcc

SEQ ID NO: 2464858 - RNA, 14 nt, Bordetella pertussis
gcacgaccaggccg

SEQ ID NO: 2464859 - RNA, 20 nt, Bordetella pertussis
gcacgaccaggccguggccc

SEQ ID NO: 2464860 - RNA, 18 nt, Bordetella pertussis
gcacgacgaagaacacca

SEQ ID NO: 2464861 - RNA, 17 nt, Bordetella pertussis
gcacgacgacggccggc

SEQ ID NO: 2464862 - RNA, 19 nt, Bordetella pertussis
gcacgacgacggccggcgc

SEQ ID NO: 2464863 - RNA, 15 nt, Bordetella pertussis
gcacgacgaucggcc

SEQ ID NO: 2464864 - RNA, 13 nt, Bordetella pertussis
gcacgacgcgaac

SEQ ID NO: 2464865 - RNA, 17 nt, Bordetella pertussis
gcacgacgcgaaccagg

SEQ ID NO: 2464866 - RNA, 19 nt, Bordetella pertussis
gcacgacgcgaaccaggcc

SEQ ID NO: 2464867 - RNA, 21 nt, Bordetella pertussis
gcacgacgcgaaccaggccac

SEQ ID NO: 2464868 - RNA, 21 nt, Bordetella pertussis
gcacgacgcugaugcccagcc

SEQ ID NO: 2464869 - RNA, 22 nt, Bordetella pertussis
gcacgacgcugaugcccagccc

SEQ ID NO: 2464870 - RNA, 20 nt, Bordetella pertussis
gcacgacggccuccgcgccg

SEQ ID NO: 2464871 - RNA, 22 nt, Bordetella pertussis
gcacgacggccuccgcgccgac

SEQ ID NO: 2464872 - RNA, 14 nt, Bordetella pertussis
gcacgacgucgcgc

SEQ ID NO: 2464873 - RNA, 22 nt, Bordetella pertussis
gcacgacgucgucgguggggca

SEQ ID NO: 2464874 - RNA, 21 nt, Bordetella pertussis
gcacgacuacggcggacuggc

SEQ ID NO: 2464875 - RNA, 17 nt, Bordetella pertussis
gcacgagaucgccuggg

SEQ ID NO: 2464876 - RNA, 20 nt, Bordetella pertussis
gcacgagaucgccuggggca

SEQ ID NO: 2464877 - RNA, 15 nt, Bordetella pertussis
gcacgaggcgcucgg

SEQ ID NO: 2464878 - RNA, 21 nt, Bordetella pertussis
gcacgauauuggcgucggccg

SEQ ID NO: 2464879 - RNA, 22 nt, Bordetella pertussis
gcacgauauuggcgucggccgc

SEQ ID NO: 2464880 - RNA, 21 nt, Bordetella pertussis
gcacgaucaccgccgcggcga

SEQ ID NO: 2464881 - RNA, 19 nt, Bordetella pertussis
gcacgaucacgaacagcgc

SEQ ID NO: 2464882 - RNA, 16 nt, Bordetella pertussis
gcacgaucgcggcgcu

SEQ ID NO: 2464883 - RNA, 21 nt, Bordetella pertussis
gcacgaucgcggcgcuggcga

SEQ ID NO: 2464884 - RNA, 22 nt, Bordetella pertussis
gcacgaucggcgccuggccgcc

SEQ ID NO: 2464885 - RNA, 18 nt, Bordetella pertussis
gcacgaucuggcgcgcga

SEQ ID NO: 2464886 - RNA, 17 nt, Bordetella pertussis
gcacgaucuugauccag

SEQ ID NO: 2464887 - RNA, 13 nt, Bordetella pertussis
gcacgaugcccag

SEQ ID NO: 2464888 - RNA, 21 nt, Bordetella pertussis
gcaggugccgccggcgcggcu

SEQ ID NO: 2464889 - RNA, 23 nt, Bordetella pertussis
gcaggugccgccggcgcggcugc

SEQ ID NO: 2464890 - RNA, 14 nt, Bordetella pertussis
gcaggugccugucc

SEQ ID NO: 2464891 - RNA, 15 nt, Bordetella pertussis
gcaggugccuguccc

SEQ ID NO: 2464892 - RNA, 13 nt, Bordetella pertussis
gcaggugcgccag

SEQ ID NO: 2464893 - RNA, 15 nt, Bordetella pertussis
gcaggugcgccagca

SEQ ID NO: 2464894 - RNA, 20 nt, Bordetella pertussis
gcaggugcgucacgcacagc

SEQ ID NO: 2464895 - RNA, 21 nt, Bordetella pertussis
gcaggugcgucacgcacagca

SEQ ID NO: 2464896 - RNA, 11 nt, Bordetella pertussis
gcagguggcau

SEQ ID NO: 2464897 - RNA, 15 nt, Bordetella pertussis
gcagguggccagccc

SEQ ID NO: 2464898 - RNA, 17 nt, Bordetella pertussis
gcagguggccagcccgg

SEQ ID NO: 2464899 - RNA, 14 nt, Bordetella pertussis
gcagguggcgcugu

SEQ ID NO: 2464900 - RNA, 20 nt, Bordetella pertussis
gcagguggcgcuguccggcg

SEQ ID NO: 2464901 - RNA, 23 nt, Bordetella pertussis
gcagguggggcagcaggccggcg

SEQ ID NO: 2464902 - RNA, 18 nt, Bordetella pertussis
gcaggugucgccccccau

SEQ ID NO: 2464903 - RNA, 19 nt, Bordetella pertussis
gcaggugucgccccccaug

SEQ ID NO: 2464904 - RNA, 22 nt, Bordetella pertussis
gcaggugugccagccgcuggcg

SEQ ID NO: 2464905 - RNA, 19 nt, Bordetella pertussis
gcagguguuguugcacgac

SEQ ID NO: 2464906 - RNA, 18 nt, Bordetella pertussis
gcagguucaucgagaaca

SEQ ID NO: 2464907 - RNA, 19 nt, Bordetella pertussis
gcagguucugcgcguccug

SEQ ID NO: 2464908 - RNA, 16 nt, Bordetella pertussis
gcagguuggagaucau

SEQ ID NO: 2464909 - RNA, 22 nt, Bordetella pertussis
gcagguuggagaucaugaccac

SEQ ID NO: 2464910 - RNA, 21 nt, Bordetella pertussis
gcaguacaggcgcguggcgcc

SEQ ID NO: 2464911 - RNA, 14 nt, Bordetella pertussis
gcaguaucccggcc

SEQ ID NO: 2464912 - RNA, 17 nt, Bordetella pertussis
gcaguaucccggccagg

SEQ ID NO: 2464913 - RNA, 18 nt, Bordetella pertussis
gcaguaucccggccaggc

SEQ ID NO: 2464914 - RNA, 20 nt, Bordetella pertussis
gcagucaaccguucauggcg

SEQ ID NO: 2464915 - RNA, 12 nt, Bordetella pertussis
gcagucagccgu

SEQ ID NO: 2464916 - RNA, 20 nt, Bordetella pertussis
gcagucagccguucauggcg

SEQ ID NO: 2464917 - RNA, 22 nt, Bordetella pertussis
gcaguccaaggaaagcccggcc

SEQ ID NO: 2464918 - RNA, 14 nt, Bordetella pertussis
gcaguccagcgugg

SEQ ID NO: 2464919 - RNA, 14 nt, Bordetella pertussis
gcagucccaguccg

SEQ ID NO: 2464920 - RNA, 16 nt, Bordetella pertussis
gcagucccaguccggc

SEQ ID NO: 2464921 - RNA, 22 nt, Bordetella pertussis
gcagucccaguccggcagcacc

SEQ ID NO: 2464922 - RNA, 21 nt, Bordetella pertussis
gcaguccucguugcccgcggu

SEQ ID NO: 2464923 - RNA, 15 nt, Bordetella pertussis
gcagucgagcaccgc

SEQ ID NO: 2464924 - RNA, 15 nt, Bordetella pertussis
gcagucgcgcagcca

SEQ ID NO: 2464925 - RNA, 16 nt, Bordetella pertussis
gcagucgcgcagccac

SEQ ID NO: 2464926 - RNA, 18 nt, Bordetella pertussis
gcagucggggccgcagcu

SEQ ID NO: 2464927 - RNA, 22 nt, Bordetella pertussis
gcagugccugcgaacgcccggc

SEQ ID NO: 2464928 - RNA, 15 nt, Bordetella pertussis
gcagugcgccggacg

SEQ ID NO: 2464929 - RNA, 23 nt, Bordetella pertussis
gcagugggcggugaccaugcgca

SEQ ID NO: 2464930 - RNA, 17 nt, Bordetella pertussis
gcagugguggugcagcg

SEQ ID NO: 2464931 - RNA, 18 nt, Bordetella pertussis
gcagugucaggaugcccu

SEQ ID NO: 2464932 - RNA, 21 nt, Bordetella pertussis
gcaguguuucggccugcucgc

SEQ ID NO: 2464933 - RNA, 15 nt, Bordetella pertussis
gcaguuccacaggag

SEQ ID NO: 2464934 - RNA, 13 nt, Bordetella pertussis
gcaguuccaggca

SEQ ID NO: 2464935 - RNA, 17 nt, Bordetella pertussis
gcaguuccggcgggccg

SEQ ID NO: 2464936 - RNA, 13 nt, Bordetella pertussis
gcaguucgcccgg

SEQ ID NO: 2464937 - RNA, 15 nt, Bordetella pertussis
gcaguucgcccggcu

SEQ ID NO: 2464938 - RNA, 18 nt, Bordetella pertussis
gcaguucggccgccaggu

SEQ ID NO: 2464939 - RNA, 16 nt, Bordetella pertussis
gcaguucgggcacgcc

SEQ ID NO: 2464940 - RNA, 18 nt, Bordetella pertussis
gcaguucgggcacgccgu

SEQ ID NO: 2464941 - RNA, 13 nt, Bordetella pertussis
gcaguucggugcg

SEQ ID NO: 2464942 - RNA, 15 nt, Bordetella pertussis
gcaguugaacacgcg

SEQ ID NO: 2464943 - RNA, 22 nt, Bordetella pertussis
gcaguugacccauaccagcccg

SEQ ID NO: 2464944 - RNA, 23 nt, Bordetella pertussis
gcaguugacccauaccagcccgg

SEQ ID NO: 2464945 - RNA, 17 nt, Bordetella pertussis
gcaguugcgccacgguc

SEQ ID NO: 2464946 - RNA, 18 nt, Bordetella pertussis
gcaguugcgucuccagcg

SEQ ID NO: 2464947 - RNA, 23 nt, Bordetella pertussis
gcaguugcgucuccagcgcggcg

SEQ ID NO: 2464948 - RNA, 14 nt, Bordetella pertussis
gcaguugcuggcgg

SEQ ID NO: 2464949 - RNA, 18 nt, Bordetella pertussis
gcaguugcuggcggccgu

SEQ ID NO: 2464950 - RNA, 20 nt, Bordetella pertussis
gcaguuggcggcgcagccgc

SEQ ID NO: 2464951 - RNA, 15 nt, Bordetella pertussis
gcaguuuccagggcu

SEQ ID NO: 2464952 - RNA, 18 nt, Bordetella pertussis
gcaguuucugcaccggcg

SEQ ID NO: 2464953 - RNA, 22 nt, Bordetella pertussis
gcauacaggcuguggccgcggc

SEQ ID NO: 2464954 - RNA, 23 nt, Bordetella pertussis
gcauacauccucgaugccgaacu

SEQ ID NO: 2464955 - RNA, 21 nt, Bordetella pertussis
gcauacaugaguucuggcauc

SEQ ID NO: 2464956 - RNA, 15 nt, Bordetella pertussis
gcauacccauggcca

SEQ ID NO: 2464957 - RNA, 20 nt, Bordetella pertussis
gcauacccugcgcgccgccg

SEQ ID NO: 2464958 - RNA, 18 nt, Bordetella pertussis
gcauaccucgauggcggu

SEQ ID NO: 2464959 - RNA, 22 nt, Bordetella pertussis
gcauacgccgauggcgcggccg

SEQ ID NO: 2464960 - RNA, 22 nt, Bordetella pertussis
gcauacgccgcugauggcgguc

SEQ ID NO: 2464961 - RNA, 20 nt, Bordetella pertussis
gcauacgcggguucgacgcc

SEQ ID NO: 2464962 - RNA, 23 nt, Bordetella pertussis
gcauacgcggguucgacgccggc

SEQ ID NO: 2464963 - RNA, 14 nt, Bordetella pertussis
gcauacucgaugcc

SEQ ID NO: 2464964 - RNA, 19 nt, Bordetella pertussis
gcauacucgaugcccagca

SEQ ID NO: 2464965 - RNA, 20 nt, Bordetella pertussis
gcauacucgaugcccagcac

SEQ ID NO: 2464966 - RNA, 15 nt, Bordetella pertussis
gcauagacccacagg

SEQ ID NO: 2464967 - RNA, 15 nt, Bordetella pertussis
gcauagacgccgacc

SEQ ID NO: 2464968 - RNA, 17 nt, Bordetella pertussis
gcauagacgccgaccgc

SEQ ID NO: 2464969 - RNA, 21 nt, Bordetella pertussis
gcauagaugccgaacagccag

SEQ ID NO: 2464970 - RNA, 13 nt, Bordetella pertussis
gcauagcccaggc

SEQ ID NO: 2464971 - RNA, 16 nt, Bordetella pertussis
gcauagcccaggccgc

SEQ ID NO: 2464972 - RNA, 18 nt, Bordetella pertussis
gcaucgucauuacccaug

SEQ ID NO: 2464973 - RNA, 15 nt, Bordetella pertussis
gcaucgucgcgcugc

SEQ ID NO: 2464974 - RNA, 14 nt, Bordetella pertussis
gcaucgugacaugc

SEQ ID NO: 2464975 - RNA, 18 nt, Bordetella pertussis
gcaucgugacaugcacga

SEQ ID NO: 2464976 - RNA, 22 nt, Bordetella pertussis
gcaucguggccgcuucggcggc

SEQ ID NO: 2464977 - RNA, 19 nt, Bordetella pertussis
gcaucgugugccagccccc

SEQ ID NO: 2464978 - RNA, 22 nt, Bordetella pertussis
gcaucguuacacuggcccuggc

SEQ ID NO: 2464979 - RNA, 15 nt, Bordetella pertussis
gcaucucgcggcggu

SEQ ID NO: 2464980 - RNA, 18 nt, Bordetella pertussis
gcaucucggcaucggcca

SEQ ID NO: 2464981 - RNA, 16 nt, Bordetella pertussis
gcaucugccccagcuu

SEQ ID NO: 2464982 - RNA, 16 nt, Bordetella pertussis
gcaucuggcgcauggc

SEQ ID NO: 2464983 - RNA, 21 nt, Bordetella pertussis
gcaucuggcgcauggccggcg

SEQ ID NO: 2464984 - RNA, 17 nt, Bordetella pertussis
gcaucuugccuuggcga

SEQ ID NO: 2464985 - RNA, 19 nt, Bordetella pertussis
gcaucuugccuuggcgaau

SEQ ID NO: 2464986 - RNA, 17 nt, Bordetella pertussis
gcaucuugcgccgcugc

SEQ ID NO: 2464987 - RNA, 18 nt, Bordetella pertussis
gcaucuuggccgccacgc

SEQ ID NO: 2464988 - RNA, 19 nt, Bordetella pertussis
gcaugaaaaagggcgcacc

SEQ ID NO: 2464989 - RNA, 17 nt, Bordetella pertussis
gcaugaaccgcagcgcc

SEQ ID NO: 2464990 - RNA, 18 nt, Bordetella pertussis
gcaugaaccgcagcgcca

SEQ ID NO: 2464991 - RNA, 19 nt, Bordetella pertussis
gcaugaacggcagcgcgcg

SEQ ID NO: 2464992 - RNA, 14 nt, Bordetella pertussis
gcaugaagcgcagc

SEQ ID NO: 2464993 - RNA, 18 nt, Bordetella pertussis
gcaugaagcgcagcagau

SEQ ID NO: 2464994 - RNA, 15 nt, Bordetella pertussis
gcaugaagcgguggc

SEQ ID NO: 2464995 - RNA, 16 nt, Bordetella pertussis
gcaugaagcgguggcg

SEQ ID NO: 2464996 - RNA, 17 nt, Bordetella pertussis
gcaugaagcgguggcgg

SEQ ID NO: 2464997 - RNA, 19 nt, Bordetella pertussis
gcaugaagcugcccagcaa

SEQ ID NO: 2464998 - RNA, 16 nt, Bordetella pertussis
gcaugaccgacaggcg

SEQ ID NO: 2464999 - RNA, 18 nt, Bordetella pertussis
gcaugaccgccgccagca

SEQ ID NO: 2465000 - RNA, 20 nt, Bordetella pertussis
gcaugaccgccgccagcagc

SEQ ID NO: 2465001 - RNA, 13 nt, Bordetella pertussis
gcaugaccgccgg

SEQ ID NO: 2465002 - RNA, 15 nt, Bordetella pertussis
gcaugaccgccggca

SEQ ID NO: 2465003 - RNA, 16 nt, Bordetella pertussis
gcaugaccgccggcac

SEQ ID NO: 2465004 - RNA, 14 nt, Bordetella pertussis
gcaugaccucggcc

SEQ ID NO: 2465005 - RNA, 22 nt, Bordetella pertussis
gcaugaccugcgacagcaccgg

SEQ ID NO: 2465006 - RNA, 15 nt, Bordetella pertussis
gcaugacgaccgcga

SEQ ID NO: 2465007 - RNA, 18 nt, Bordetella pertussis
gcaugacgaggugccugu

SEQ ID NO: 2465008 - RNA, 24 nt, Bordetella pertussis
gcaugacgaucacgggcuguucgc

SEQ ID NO: 2465009 - RNA, 14 nt, Bordetella pertussis
gcaugacggccagg

SEQ ID NO: 2465010 - RNA, 15 nt, Bordetella pertussis
gcaugacggccagga

SEQ ID NO: 2465011 - RNA, 19 nt, Bordetella pertussis
gcaugacggggucggggca

SEQ ID NO: 2465012 - RNA, 21 nt, Bordetella pertussis
gcaugaucaugccgcugccca

SEQ ID NO: 2465013 - RNA, 17 nt, Bordetella pertussis
gcaugauggccggccug

SEQ ID NO: 2465014 - RNA, 21 nt, Bordetella pertussis
gcaugauggugcugccgcugc

SEQ ID NO: 2465015 - RNA, 14 nt, Bordetella pertussis
gcaugaugucgcgg

SEQ ID NO: 2465016 - RNA, 17 nt, Bordetella pertussis
gcaugaugucgcgggcc

SEQ ID NO: 2465017 - RNA, 21 nt, Bordetella pertussis
gcaugaugucgcgggcccgcu

SEQ ID NO: 2465018 - RNA, 22 nt, Bordetella pertussis
gcaugauuccugucgcgcugcu

SEQ ID NO: 2465019 - RNA, 12 nt, Bordetella pertussis
gcaugcaagaca

SEQ ID NO: 2465020 - RNA, 14 nt, Bordetella pertussis
gcaugcaccgcgug

SEQ ID NO: 2465021 - RNA, 17 nt, Bordetella pertussis
gcaugcaccgcguggcg

SEQ ID NO: 2465022 - RNA, 23 nt, Bordetella pertussis
gcaugcaccgcguggcgcugcgu

SEQ ID NO: 2465023 - RNA, 21 nt, Bordetella pertussis
gcaugcacgaugguaucggcc

SEQ ID NO: 2465024 - RNA, 20 nt, Bordetella pertussis
gcaugcagcauguauucauc

SEQ ID NO: 2465025 - RNA, 17 nt, Bordetella pertussis
gcaugccagcuugcagg

SEQ ID NO: 2465026 - RNA, 21 nt, Bordetella pertussis
gcaugccagcuugcaggcgcc

SEQ ID NO: 2465027 - RNA, 23 nt, Bordetella pertussis
gcaugccagcuugcaggcgccuu

SEQ ID NO: 2465028 - RNA, 15 nt, Bordetella pertussis
gcaugccaugcgcac

SEQ ID NO: 2465029 - RNA, 20 nt, Bordetella pertussis
gcaugccauggacgagggcc

SEQ ID NO: 2465030 - RNA, 21 nt, Bordetella pertussis
gcaugccauggccgcgcggcg

SEQ ID NO: 2465031 - RNA, 19 nt, Bordetella pertussis
gcaugcccauuuccaccac

SEQ ID NO: 2465032 - RNA, 21 nt, Bordetella pertussis
gcaugcccuuugcagccagau

SEQ ID NO: 2465033 - RNA, 19 nt, Bordetella pertussis
gcaugccgaccaccagcac

SEQ ID NO: 2465034 - RNA, 20 nt, Bordetella pertussis
gcaugccgaucagcgggcug

SEQ ID NO: 2465035 - RNA, 20 nt, Bordetella pertussis
gcaugccgcugcaggucggg

SEQ ID NO: 2465036 - RNA, 22 nt, Bordetella pertussis
gcaugccggacgcggggauggc

SEQ ID NO: 2465037 - RNA, 23 nt, Bordetella pertussis
gcaugccggacgcggggauggcu

SEQ ID NO: 2465038 - RNA, 19 nt, Bordetella pertussis
gcaugccggcauaggcggc

SEQ ID NO: 2465039 - RNA, 14 nt, Bordetella pertussis
gcaugccggcgaug

SEQ ID NO: 2465040 - RNA, 14 nt, Bordetella pertussis
gcaugccgggcugc

SEQ ID NO: 2465041 - RNA, 23 nt, Bordetella pertussis
gcaugccguccacgcccagcgcc

SEQ ID NO: 2465042 - RNA, 12 nt, Bordetella pertussis
gcaugccgucgc

SEQ ID NO: 2465043 - RNA, 23 nt, Bordetella pertussis
gcaugccgucgcgcucggacgcc

SEQ ID NO: 2465044 - RNA, 18 nt, Bordetella pertussis
gcaugcgaaagccggccu

SEQ ID NO: 2465045 - RNA, 19 nt, Bordetella pertussis
gcaugcgaaagccggccuc

SEQ ID NO: 2465046 - RNA, 16 nt, Bordetella pertussis
gcaugcgacaugagcu

SEQ ID NO: 2465047 - RNA, 18 nt, Bordetella pertussis
gcaugcgacaugagcugc

SEQ ID NO: 2465048 - RNA, 15 nt, Bordetella pertussis
gcaugcgcacgcgcg

SEQ ID NO: 2465049 - RNA, 17 nt, Bordetella pertussis
gcaugcgcagcgcgucg

SEQ ID NO: 2465050 - RNA, 14 nt, Bordetella pertussis
gcaugcgccagcca

SEQ ID NO: 2465051 - RNA, 17 nt, Bordetella pertussis
gcaugcgccagcgccug

SEQ ID NO: 2465052 - RNA, 15 nt, Bordetella pertussis
gcaugcgccggcccg

SEQ ID NO: 2465053 - RNA, 17 nt, Bordetella pertussis
gcaugcgccugcgccau

SEQ ID NO: 2465054 - RNA, 20 nt, Bordetella pertussis
gcaugcgccugucccaggcg

SEQ ID NO: 2465055 - RNA, 18 nt, Bordetella pertussis
gcaugcgcgaacgcgcgc

SEQ ID NO: 2465056 - RNA, 20 nt, Bordetella pertussis
gcaugcgcgaacgcgcgccg

SEQ ID NO: 2465057 - RNA, 23 nt, Bordetella pertussis
gcaugcgcgaacgcgcgccggcc

SEQ ID NO: 2465058 - RNA, 12 nt, Bordetella pertussis
gcaugcgcgcca

SEQ ID NO: 2465059 - RNA, 13 nt, Bordetella pertussis
gcaugcgcgccag

SEQ ID NO: 2465060 - RNA, 14 nt, Bordetella pertussis
gcaugcgcgccagu

SEQ ID NO: 2465061 - RNA, 14 nt, Bordetella pertussis
gcaugcgcgcgacu

SEQ ID NO: 2465062 - RNA, 17 nt, Bordetella pertussis
gcaugcgcgcgacuucc

SEQ ID NO: 2465063 - RNA, 12 nt, Bordetella pertussis
gcaugcgcgcgg

SEQ ID NO: 2465064 - RNA, 13 nt, Bordetella pertussis
gcaugcgcgcggc

SEQ ID NO: 2465065 - RNA, 21 nt, Bordetella pertussis
gcaugcgcuggucgcgcagca

SEQ ID NO: 2465066 - RNA, 19 nt, Bordetella pertussis
gcaugcggcacaaccuggc

SEQ ID NO: 2465067 - RNA, 22 nt, Bordetella pertussis
gcaugcggcacaaccuggcgcg

SEQ ID NO: 2465068 - RNA, 18 nt, Bordetella pertussis
gcaugcggcccgcgcugu

SEQ ID NO: 2465069 - RNA, 14 nt, Bordetella pertussis
gcaugcggcggcug

SEQ ID NO: 2465070 - RNA, 15 nt, Bordetella pertussis
gcaugcggcguccug

SEQ ID NO: 2465071 - RNA, 17 nt, Bordetella pertussis
gcaugcggcguccugcc

SEQ ID NO: 2465072 - RNA, 21 nt, Bordetella pertussis
gcaugcgugaagcccauggcg

SEQ ID NO: 2465073 - RNA, 21 nt, Bordetella pertussis
gcaugcgugcgcaucagcgca

SEQ ID NO: 2465074 - RNA, 21 nt, Bordetella pertussis
gcaugcucuggcacaccagcg

SEQ ID NO: 2465075 - RNA, 22 nt, Bordetella pertussis
gcaugcucuggcacaccagcgc

SEQ ID NO: 2465076 - RNA, 13 nt, Bordetella pertussis
gcaugcuggucau

SEQ ID NO: 2465077 - RNA, 22 nt, Bordetella pertussis
gcauggaaccgguuggccagcu

SEQ ID NO: 2465078 - RNA, 16 nt, Bordetella pertussis
gcauggacugcaggcg

SEQ ID NO: 2465079 - RNA, 20 nt, Bordetella pertussis
gcauggagaccggcgccugc

SEQ ID NO: 2465080 - RNA, 16 nt, Bordetella pertussis
gcauggagcuggggcc

SEQ ID NO: 2465081 - RNA, 14 nt, Bordetella pertussis
gcauggcagcagau

SEQ ID NO: 2465082 - RNA, 22 nt, Bordetella pertussis
gcauggcagcagaucggcggcc

SEQ ID NO: 2465083 - RNA, 14 nt, Bordetella pertussis
gcauggccagcgcg

SEQ ID NO: 2465084 - RNA, 15 nt, Bordetella pertussis
gcauggccagcgcgc

SEQ ID NO: 2465085 - RNA, 16 nt, Bordetella pertussis
gcauggccagcgcgca

SEQ ID NO: 2465086 - RNA, 13 nt, Bordetella pertussis
gcauggccaucgc

SEQ ID NO: 2465087 - RNA, 13 nt, Bordetella pertussis
gcauggccggcag

SEQ ID NO: 2465088 - RNA, 23 nt, Bordetella pertussis
gcauggccgguucgaugaccugg

SEQ ID NO: 2465089 - RNA, 14 nt, Bordetella pertussis
gcauggccguggcg

SEQ ID NO: 2465090 - RNA, 16 nt, Bordetella pertussis
gcauggcgaucgaacg

SEQ ID NO: 2465091 - RNA, 17 nt, Bordetella pertussis
gcauggcgaucgaacgc

SEQ ID NO: 2465092 - RNA, 22 nt, Bordetella pertussis
gcauggcgaucgaacgcggcca

SEQ ID NO: 2465093 - RNA, 17 nt, Bordetella pertussis
gcauggcgaugaccucg

SEQ ID NO: 2465094 - RNA, 19 nt, Bordetella pertussis
gcauggcgaugaccucggc

SEQ ID NO: 2465095 - RNA, 20 nt, Bordetella pertussis
gcauggcgaugaccucggcg

SEQ ID NO: 2465096 - RNA, 15 nt, Bordetella pertussis
gcauggcgccagcug

SEQ ID NO: 2465097 - RNA, 13 nt, Bordetella pertussis
gcauggcgccgcg

SEQ ID NO: 2465098 - RNA, 14 nt, Bordetella pertussis
gcauggcgccgcgc

SEQ ID NO: 2465099 - RNA, 22 nt, Bordetella pertussis
gcauggcgccgcgccgccgccu

SEQ ID NO: 2465100 - RNA, 14 nt, Bordetella pertussis
gcauggcgcgugcg

SEQ ID NO: 2465101 - RNA, 18 nt, Bordetella pertussis
gcauggcgcgugcgcgcg

SEQ ID NO: 2465102 - RNA, 19 nt, Bordetella pertussis
gcauggcgcgugcgcgcgc

SEQ ID NO: 2465103 - RNA, 15 nt, Bordetella pertussis
gcauggcggccaggc

SEQ ID NO: 2465104 - RNA, 16 nt, Bordetella pertussis
gcauggcggccaggcg

SEQ ID NO: 2465105 - RNA, 22 nt, Bordetella pertussis
gcauggcggccaggcgcgccgc

SEQ ID NO: 2465106 - RNA, 20 nt, Bordetella pertussis
gcauggcgggcgagaucagc

SEQ ID NO: 2465107 - RNA, 21 nt, Bordetella pertussis
gcauggcggucuccgguucgg

SEQ ID NO: 2465108 - RNA, 20 nt, Bordetella pertussis
gcauggcgguggccagcgcc

SEQ ID NO: 2465109 - RNA, 22 nt, Bordetella pertussis
gcauggcgguggccagcgccug

SEQ ID NO: 2465110 - RNA, 14 nt, Bordetella pertussis
gcauggcgucaagc

SEQ ID NO: 2465111 - RNA, 22 nt, Bordetella pertussis
gcauggcgucaagccagcggcg

SEQ ID NO: 2465112 - RNA, 20 nt, Bordetella pertussis
gcauggcgucgaaacgcugc

SEQ ID NO: 2465113 - RNA, 22 nt, Bordetella pertussis
gcauggcgucgaaacgcugcgc

SEQ ID NO: 2465114 - RNA, 19 nt, Bordetella pertussis
gcauggcuggucccugcgc

SEQ ID NO: 2465115 - RNA, 20 nt, Bordetella pertussis
gcaugggagaguucauccac

SEQ ID NO: 2465116 - RNA, 23 nt, Bordetella pertussis
gcaugggcacauacagcggagcc

SEQ ID NO: 2465117 - RNA, 17 nt, Bordetella pertussis
gcaugggcccgggcgcg

SEQ ID NO: 2465118 - RNA, 20 nt, Bordetella pertussis
gcaugggcccgggcgcgcug

SEQ ID NO: 2465119 - RNA, 19 nt, Bordetella pertussis
gcaugggcgcaggccgcca

SEQ ID NO: 2465120 - RNA, 22 nt, Bordetella pertussis
gcaugggcgccgagggccgcgc

SEQ ID NO: 2465121 - RNA, 16 nt, Bordetella pertussis
gcaugggcgcgcccgg

SEQ ID NO: 2465122 - RNA, 18 nt, Bordetella pertussis
gcaugggcgcgcccggcg

SEQ ID NO: 2465123 - RNA, 20 nt, Bordetella pertussis
gcaugggcgugccgcgcugg

SEQ ID NO: 2465124 - RNA, 19 nt, Bordetella pertussis
gcauggggcaggcgcagcg

SEQ ID NO: 2465125 - RNA, 20 nt, Bordetella pertussis
gcaugguagcgguccagcug

SEQ ID NO: 2465126 - RNA, 16 nt, Bordetella pertussis
gcauggucggcauggc

SEQ ID NO: 2465127 - RNA, 14 nt, Bordetella pertussis
gcaugguggcgcag

SEQ ID NO: 2465128 - RNA, 14 nt, Bordetella pertussis
gcauguacucggcc

SEQ ID NO: 2465129 - RNA, 15 nt, Bordetella pertussis
gcauguacucggcca

SEQ ID NO: 2465130 - RNA, 18 nt, Bordetella pertussis
gcauguacucggccaggc

SEQ ID NO: 2465131 - RNA, 19 nt, Bordetella pertussis
gcauguacucggccaggcc

SEQ ID NO: 2465132 - RNA, 21 nt, Bordetella pertussis
gcauguagucgucgcuggccc

SEQ ID NO: 2465133 - RNA, 14 nt, Bordetella pertussis
gcaugucagcgccu

SEQ ID NO: 2465134 - RNA, 15 nt, Bordetella pertussis
gcaugucccagcgcu

SEQ ID NO: 2465135 - RNA, 16 nt, Bordetella pertussis
gcaugucccagcgcuc

SEQ ID NO: 2465136 - RNA, 22 nt, Bordetella pertussis
gcaugucccagcgcucguccac

SEQ ID NO: 2465137 - RNA, 14 nt, Bordetella pertussis
gcaugucccgaggc

SEQ ID NO: 2465138 - RNA, 23 nt, Bordetella pertussis
gcaugucccgcaugaccugcagg

SEQ ID NO: 2465139 - RNA, 16 nt, Bordetella pertussis
gcauguccgccacgcc

SEQ ID NO: 2465140 - RNA, 19 nt, Bordetella pertussis
gcauguccgccaugcgaug

SEQ ID NO: 2465141 - RNA, 14 nt, Bordetella pertussis
gcaugucgaugccg

SEQ ID NO: 2465142 - RNA, 19 nt, Bordetella pertussis
gcaugucgcggcccacggc

SEQ ID NO: 2465143 - RNA, 20 nt, Bordetella pertussis
gcaugucgcggcccacggcc

SEQ ID NO: 2465144 - RNA, 17 nt, Bordetella pertussis
gcaugucguacaggccg

SEQ ID NO: 2465145 - RNA, 18 nt, Bordetella pertussis
gcaugucguacaggccgu

SEQ ID NO: 2465146 - RNA, 19 nt, Bordetella pertussis
gcaugucguacaggccguu

SEQ ID NO: 2465147 - RNA, 21 nt, Bordetella pertussis
gcaugugccaccgcccaggcg

SEQ ID NO: 2465148 - RNA, 16 nt, Bordetella pertussis
gcaugugcgcggcguu

SEQ ID NO: 2465149 - RNA, 14 nt, Bordetella pertussis
gcauuaccagcaac

SEQ ID NO: 2465150 - RNA, 18 nt, Bordetella pertussis
gcauuaccagcaacgcgc

SEQ ID NO: 2465151 - RNA, 21 nt, Bordetella pertussis
gcauucagcgcugcaugcccc

SEQ ID NO: 2465152 - RNA, 22 nt, Bordetella pertussis
gcauuccgcgaaacggcgggcg

SEQ ID NO: 2465153 - RNA, 20 nt, Bordetella pertussis
gcauucgaacaacagcgccu

SEQ ID NO: 2465154 - RNA, 21 nt, Bordetella pertussis
gcauucgaacaacagcgccug

SEQ ID NO: 2465155 - RNA, 23 nt, Bordetella pertussis
gcauucgaacaacagcgccugca

SEQ ID NO: 2465156 - RNA, 14 nt, Bordetella pertussis
gcauucgcagaagg

SEQ ID NO: 2465157 - RNA, 17 nt, Bordetella pertussis
gcauucgcgccugagcu

SEQ ID NO: 2465158 - RNA, 15 nt, Bordetella pertussis
gcauucggcggccgg

SEQ ID NO: 2465159 - RNA, 14 nt, Bordetella pertussis
gcauucguccaggu

SEQ ID NO: 2465160 - RNA, 23 nt, Bordetella pertussis
gcauucguccagguugucggcca

SEQ ID NO: 2465161 - RNA, 15 nt, Bordetella pertussis
gcauucgucgcugcc

SEQ ID NO: 2465162 - RNA, 19 nt, Bordetella pertussis
gcauucgugaugccccagg

SEQ ID NO: 2465163 - RNA, 19 nt, Bordetella pertussis
gcauucuggugcagcggcu

SEQ ID NO: 2465164 - RNA, 22 nt, Bordetella pertussis
gcauugaagcuggcgccggucu

SEQ ID NO: 2465165 - RNA, 18 nt, Bordetella pertussis
gcauugagcacuuucgac

SEQ ID NO: 2465166 - RNA, 21 nt, Bordetella pertussis
gcauugaucgaucagccagcc

SEQ ID NO: 2465167 - RNA, 18 nt, Bordetella pertussis
gcauugcacaacgggcag

SEQ ID NO: 2465168 - RNA, 15 nt, Bordetella pertussis
gcauugcccaccacg

SEQ ID NO: 2465169 - RNA, 18 nt, Bordetella pertussis
gcauugcccaccacggcg

SEQ ID NO: 2465170 - RNA, 16 nt, Bordetella pertussis
gcauugccgccgcccu

SEQ ID NO: 2465171 - RNA, 18 nt, Bordetella pertussis
gcauugccgccgcccugc

SEQ ID NO: 2465172 - RNA, 13 nt, Bordetella pertussis
gcauugcgccagc

SEQ ID NO: 2465173 - RNA, 23 nt, Bordetella pertussis
gcauugcggcugggugcggucag

SEQ ID NO: 2465174 - RNA, 14 nt, Bordetella pertussis
gcauuggcgccgcg

SEQ ID NO: 2465175 - RNA, 23 nt, Bordetella pertussis
gcauuggcgccgcgcucgcgcca

SEQ ID NO: 2465176 - RNA, 21 nt, Bordetella pertussis
gcauuggcggcggcguucagg

SEQ ID NO: 2465177 - RNA, 23 nt, Bordetella pertussis
gcauuuccauuuguugggccacc

SEQ ID NO: 2465178 - RNA, 20 nt, Bordetella pertussis
gcauuuccucgaccagcgcg

SEQ ID NO: 2465179 - RNA, 22 nt, Bordetella pertussis
gcauuuccucgaccagcgcgcg

SEQ ID NO: 2465180 - RNA, 23 nt, Bordetella pertussis
gcauuuccucgaccagcgcgcgg

SEQ ID NO: 2465181 - RNA, 21 nt, Bordetella pertussis
gcauuucggcgccgccggcca

SEQ ID NO: 2465182 - RNA, 17 nt, Bordetella pertussis
gcauuucucggccuggg

SEQ ID NO: 2465183 - RNA, 14 nt, Bordetella pertussis
gcauuucuuccagu

SEQ ID NO: 2465184 - RNA, 22 nt, Bordetella pertussis
gcauuucuuccaguugcgggcg

SEQ ID NO: 2465185 - RNA, 13 nt, Bordetella pertussis
gccaaaaaaaacc

SEQ ID NO: 2465186 - RNA, 15 nt, Bordetella pertussis
gccaaagacaaugcc

SEQ ID NO: 2465187 - RNA, 21 nt, Bordetella pertussis
gccaaagaucaaaaaggcccu

SEQ ID NO: 2465188 - RNA, 16 nt, Bordetella pertussis
gccaaagcgcagcgug

SEQ ID NO: 2465189 - RNA, 11 nt, Bordetella pertussis
gccaaagcgcu

SEQ ID NO: 2465190 - RNA, 21 nt, Bordetella pertussis
gccaaaucaacgaucuaggcc

SEQ ID NO: 2465191 - RNA, 21 nt, Bordetella pertussis
gccaacagcucgcgccagggc

SEQ ID NO: 2465192 - RNA, 20 nt, Bordetella pertussis
gccaacccggccucagcggc

SEQ ID NO: 2465193 - RNA, 15 nt, Bordetella pertussis
gccaacccucgcacg

SEQ ID NO: 2465194 - RNA, 20 nt, Bordetella pertussis
gccaacgauuccgcguccau

SEQ ID NO: 2465195 - RNA, 21 nt, Bordetella pertussis
gccaacgcacaagggccccgc

SEQ ID NO: 2465196 - RNA, 18 nt, Bordetella pertussis
gccaccacugcaaggccc

SEQ ID NO: 2465197 - RNA, 22 nt, Bordetella pertussis
gccaccagaucgauaccgucgc

SEQ ID NO: 2465198 - RNA, 12 nt, Bordetella pertussis
gccaccagcagc

SEQ ID NO: 2465199 - RNA, 14 nt, Bordetella pertussis
gccaccagcagcgc

SEQ ID NO: 2465200 - RNA, 15 nt, Bordetella pertussis
gccaccagcagcgcc

SEQ ID NO: 2465201 - RNA, 16 nt, Bordetella pertussis
gccaccagcagcgcca

SEQ ID NO: 2465202 - RNA, 18 nt, Bordetella pertussis
gccaccagcagcgccagg

SEQ ID NO: 2465203 - RNA, 19 nt, Bordetella pertussis
gccaccagcagcgccagga

SEQ ID NO: 2465204 - RNA, 15 nt, Bordetella pertussis
gccaccagcgcgcca

SEQ ID NO: 2465205 - RNA, 19 nt, Bordetella pertussis
gccaccagcgcgucgccgc

SEQ ID NO: 2465206 - RNA, 21 nt, Bordetella pertussis
gccaccagcgcgucgccgcca

SEQ ID NO: 2465207 - RNA, 22 nt, Bordetella pertussis
gccaccagcgcgucgccgccau

SEQ ID NO: 2465208 - RNA, 13 nt, Bordetella pertussis
gccaccagcggcg

SEQ ID NO: 2465209 - RNA, 14 nt, Bordetella pertussis
gccaccagcggcgc

SEQ ID NO: 2465210 - RNA, 23 nt, Bordetella pertussis
gccaccagcggcgccggaucggc

SEQ ID NO: 2465211 - RNA, 17 nt, Bordetella pertussis
gccaccagcggcguggc

SEQ ID NO: 2465212 - RNA, 18 nt, Bordetella pertussis
gccaccagcgucagcaca

SEQ ID NO: 2465213 - RNA, 19 nt, Bordetella pertussis
gccaccagcgucagcacau

SEQ ID NO: 2465214 - RNA, 19 nt, Bordetella pertussis
gccaccagcuugcgcgccg

SEQ ID NO: 2465215 - RNA, 21 nt, Bordetella pertussis
gccaccagcuugcgcgccgca

SEQ ID NO: 2465216 - RNA, 17 nt, Bordetella pertussis
gccaccaggaacgccag

SEQ ID NO: 2465217 - RNA, 18 nt, Bordetella pertussis
gccaccaggaacgccagc

SEQ ID NO: 2465218 - RNA, 19 nt, Bordetella pertussis
gccaccaggaacgccagca

SEQ ID NO: 2465219 - RNA, 21 nt, Bordetella pertussis
gccaccaggaacgccagcagc

SEQ ID NO: 2465220 - RNA, 22 nt, Bordetella pertussis
gccaccaggaacgccagcagca

SEQ ID NO: 2465221 - RNA, 13 nt, Bordetella pertussis
gccaccaggccga

SEQ ID NO: 2465222 - RNA, 13 nt, Bordetella pertussis
gccaccaggccgu

SEQ ID NO: 2465223 - RNA, 13 nt, Bordetella pertussis
gccaccaggcgcg

SEQ ID NO: 2465224 - RNA, 16 nt, Bordetella pertussis
gccaccaggcgcgcgc

SEQ ID NO: 2465225 - RNA, 17 nt, Bordetella pertussis
gccaccaggcgcgcgcc

SEQ ID NO: 2465226 - RNA, 18 nt, Bordetella pertussis
gccaccaggcgcgcgcca

SEQ ID NO: 2465227 - RNA, 21 nt, Bordetella pertussis
gccaccaggcgcgcgccaucg

SEQ ID NO: 2465228 - RNA, 22 nt, Bordetella pertussis
gccaccagggcccggacgcggc

SEQ ID NO: 2465229 - RNA, 15 nt, Bordetella pertussis
gccaccagggcgccc

SEQ ID NO: 2465230 - RNA, 23 nt, Bordetella pertussis
gccaccagggcgcccgccgacga

SEQ ID NO: 2465231 - RNA, 18 nt, Bordetella pertussis
gccaccaugccuugcgcg

SEQ ID NO: 2465232 - RNA, 15 nt, Bordetella pertussis
gccaccaugucccug

SEQ ID NO: 2465233 - RNA, 20 nt, Bordetella pertussis
gccaccaugucccuggccau

SEQ ID NO: 2465234 - RNA, 17 nt, Bordetella pertussis
gccacccagcucagcgg

SEQ ID NO: 2465235 - RNA, 15 nt, Bordetella pertussis
gccacccaggcggca

SEQ ID NO: 2465236 - RNA, 22 nt, Bordetella pertussis
gccacccaggcggcaggcgccg

SEQ ID NO: 2465237 - RNA, 13 nt, Bordetella pertussis
gccaccccgccgc

SEQ ID NO: 2465238 - RNA, 16 nt, Bordetella pertussis
gccaccccgccgcuga

SEQ ID NO: 2465239 - RNA, 17 nt, Bordetella pertussis
gccaccccgucaucgcc

SEQ ID NO: 2465240 - RNA, 18 nt, Bordetella pertussis
gccaccccgucaucgccg

SEQ ID NO: 2465241 - RNA, 21 nt, Bordetella pertussis
gccaccccgucaucgccgcgg

SEQ ID NO: 2465242 - RNA, 22 nt, Bordetella pertussis
gccaccccgucaucgccgcggc

SEQ ID NO: 2465243 - RNA, 17 nt, Bordetella pertussis
gccaccccguugcagcc

SEQ ID NO: 2465244 - RNA, 19 nt, Bordetella pertussis
gccaccccguugcagccca

SEQ ID NO: 2465245 - RNA, 21 nt, Bordetella pertussis
gccaccccguugcagcccagc

SEQ ID NO: 2465246 - RNA, 22 nt, Bordetella pertussis
gccaccccguugcagcccagcg

SEQ ID NO: 2465247 - RNA, 18 nt, Bordetella pertussis
gccacccgacagcucgga

SEQ ID NO: 2465248 - RNA, 12 nt, Bordetella pertussis
gccacccgccgc

SEQ ID NO: 2465249 - RNA, 15 nt, Bordetella pertussis
gccacccgccgccgg

SEQ ID NO: 2465250 - RNA, 16 nt, Bordetella pertussis
gccacccgccgccggc

SEQ ID NO: 2465251 - RNA, 12 nt, Bordetella pertussis
gccacccgccgu

SEQ ID NO: 2465252 - RNA, 21 nt, Bordetella pertussis
gccacccgccguaccgggcgg

SEQ ID NO: 2465253 - RNA, 17 nt, Bordetella pertussis
gccacccggaucgacag

SEQ ID NO: 2465254 - RNA, 19 nt, Bordetella pertussis
gccacccugccgugcagau

SEQ ID NO: 2465255 - RNA, 13 nt, Bordetella pertussis
gccacccugguac

SEQ ID NO: 2465256 - RNA, 14 nt, Bordetella pertussis
gccaccgaagcggc

SEQ ID NO: 2465257 - RNA, 20 nt, Bordetella pertussis
gccaccgaagcggcguucug

SEQ ID NO: 2465258 - RNA, 21 nt, Bordetella pertussis
gccaccgaagcggcguucugc

SEQ ID NO: 2465259 - RNA, 12 nt, Bordetella pertussis
gccaccgacggc

SEQ ID NO: 2465260 - RNA, 13 nt, Bordetella pertussis
gccaccgcccaga

SEQ ID NO: 2465261 - RNA, 16 nt, Bordetella pertussis
gccaccgcccaggcgc

SEQ ID NO: 2465262 - RNA, 17 nt, Bordetella pertussis
gccaccgcccaggcgca

SEQ ID NO: 2465263 - RNA, 20 nt, Bordetella pertussis
gccaccgcccaggcgcagcc

SEQ ID NO: 2465264 - RNA, 21 nt, Bordetella pertussis
gccaccgcccaggcgcagccc

SEQ ID NO: 2465265 - RNA, 22 nt, Bordetella pertussis
gccaccgccugugccagcuggc

SEQ ID NO: 2465266 - RNA, 23 nt, Bordetella pertussis
gccaccgccugugccagcuggcc

SEQ ID NO: 2465267 - RNA, 15 nt, Bordetella pertussis
gccaccgcgccgccc

SEQ ID NO: 2465268 - RNA, 13 nt, Bordetella pertussis
gccaccgcggcgg

SEQ ID NO: 2465269 - RNA, 14 nt, Bordetella pertussis
gccaccgcggcgga

SEQ ID NO: 2465270 - RNA, 17 nt, Bordetella pertussis
gccaccgcggcggacca

SEQ ID NO: 2465271 - RNA, 18 nt, Bordetella pertussis
gccaccgcggugccgcgc

SEQ ID NO: 2465272 - RNA, 19 nt, Bordetella pertussis
gccaccgcguugagcgccg

SEQ ID NO: 2465273 - RNA, 23 nt, Bordetella pertussis
gccaccgcguugagcgccgacgg

SEQ ID NO: 2465274 - RNA, 18 nt, Bordetella pertussis
gccaccggucgccgucca

SEQ ID NO: 2465275 - RNA, 20 nt, Bordetella pertussis
gccaccgguugcagcgcgcc

SEQ ID NO: 2465276 - RNA, 22 nt, Bordetella pertussis
gccaccgguugcagcgcgccag

SEQ ID NO: 2465277 - RNA, 23 nt, Bordetella pertussis
gccaccgguugcagcgcgccagg

SEQ ID NO: 2465278 - RNA, 17 nt, Bordetella pertussis
gccaccgucucgcccau

SEQ ID NO: 2465279 - RNA, 16 nt, Bordetella pertussis
gccaccguggcgucca

SEQ ID NO: 2465280 - RNA, 22 nt, Bordetella pertussis
gccaccucgaucaccaccggca

SEQ ID NO: 2465281 - RNA, 15 nt, Bordetella pertussis
gccaccucgcuugcc

SEQ ID NO: 2465282 - RNA, 15 nt, Bordetella pertussis
gccaccucuucagcc

SEQ ID NO: 2465283 - RNA, 21 nt, Bordetella pertussis
gccaccucuucagcccggcgc

SEQ ID NO: 2465284 - RNA, 23 nt, Bordetella pertussis
gccaccucuucagcccggcgcgc

SEQ ID NO: 2465285 - RNA, 13 nt, Bordetella pertussis
gccaccuggcgca

SEQ ID NO: 2465286 - RNA, 17 nt, Bordetella pertussis
gccaccuggcgcaaggc

SEQ ID NO: 2465287 - RNA, 13 nt, Bordetella pertussis
gccaccuggcgcc

SEQ ID NO: 2465288 - RNA, 14 nt, Bordetella pertussis
gccaccugggccgc

SEQ ID NO: 2465289 - RNA, 18 nt, Bordetella pertussis
gccaccugggccgccugc

SEQ ID NO: 2465290 - RNA, 20 nt, Bordetella pertussis
gccaccugggccgccugcug

SEQ ID NO: 2465291 - RNA, 21 nt, Bordetella pertussis
gccaccugggccgccugcugg

SEQ ID NO: 2465292 - RNA, 19 nt, Bordetella pertussis
gccaccuggucgucggcca

SEQ ID NO: 2465293 - RNA, 21 nt, Bordetella pertussis
gccaccuggucgucggccacg

SEQ ID NO: 2465294 - RNA, 16 nt, Bordetella pertussis
gccaccuucgccgcgc

SEQ ID NO: 2465295 - RNA, 17 nt, Bordetella pertussis
gccacgaaacccacggc

SEQ ID NO: 2465296 - RNA, 14 nt, Bordetella pertussis
gccacgaaacccag

SEQ ID NO: 2465297 - RNA, 16 nt, Bordetella pertussis
gccacgaagcgcagca

SEQ ID NO: 2465298 - RNA, 16 nt, Bordetella pertussis
gccacgaagugcgccc

SEQ ID NO: 2465299 - RNA, 19 nt, Bordetella pertussis
gccacgaagugcgccccca

SEQ ID NO: 2465300 - RNA, 20 nt, Bordetella pertussis
gccacgaauuccucgccgcc

SEQ ID NO: 2465301 - RNA, 21 nt, Bordetella pertussis
gccacgaauuccucgccgccc

SEQ ID NO: 2465302 - RNA, 22 nt, Bordetella pertussis
gccacgaauuccucgccgccca

SEQ ID NO: 2465303 - RNA, 16 nt, Bordetella pertussis
gccacgaccaccagcg

SEQ ID NO: 2465304 - RNA, 12 nt, Bordetella pertussis
gccacgaccggc

SEQ ID NO: 2465305 - RNA, 18 nt, Bordetella pertussis
gccacgacgccgucgcgg

SEQ ID NO: 2465306 - RNA, 19 nt, Bordetella pertussis
gccacgacgccgucgcgga

SEQ ID NO: 2465307 - RNA, 18 nt, Bordetella pertussis
gccacgacguagucggcg

SEQ ID NO: 2465308 - RNA, 14 nt, Bordetella pertussis
gccacgucggcggc

SEQ ID NO: 2465309 - RNA, 15 nt, Bordetella pertussis
gccacgucggcggcc

SEQ ID NO: 2465310 - RNA, 15 nt, Bordetella pertussis
gccacgugaagcgcc

SEQ ID NO: 2465311 - RNA, 19 nt, Bordetella pertussis
gccacgugaagcgccgcgc

SEQ ID NO: 2465312 - RNA, 20 nt, Bordetella pertussis
gccacgugaagcgccgcgcc

SEQ ID NO: 2465313 - RNA, 16 nt, Bordetella pertussis
gccacgugcugcugga

SEQ ID NO: 2465314 - RNA, 20 nt, Bordetella pertussis
gccacguugaagcgcagcca

SEQ ID NO: 2465315 - RNA, 22 nt, Bordetella pertussis
gccacguugaagcgcagccacg

SEQ ID NO: 2465316 - RNA, 16 nt, Bordetella pertussis
gccacguugucgcgcg

SEQ ID NO: 2465317 - RNA, 19 nt, Bordetella pertussis
gccacguugucgcgcguga

SEQ ID NO: 2465318 - RNA, 18 nt, Bordetella pertussis
gccacuauguggcguucg

SEQ ID NO: 2465319 - RNA, 20 nt, Bordetella pertussis
gccacuauguggcguucgcg

SEQ ID NO: 2465320 - RNA, 18 nt, Bordetella pertussis
gccacuauuuucagaagc

SEQ ID NO: 2465321 - RNA, 22 nt, Bordetella pertussis
gccacuccugguugaccgagcc

SEQ ID NO: 2465322 - RNA, 19 nt, Bordetella pertussis
gccacucgaugggcgcgcg

SEQ ID NO: 2465323 - RNA, 20 nt, Bordetella pertussis
gccacucgaugggcgcgcgc

SEQ ID NO: 2465324 - RNA, 18 nt, Bordetella pertussis
gccacugcaucgugcgcg

SEQ ID NO: 2465325 - RNA, 13 nt, Bordetella pertussis
gccacugccaggc

SEQ ID NO: 2465326 - RNA, 14 nt, Bordetella pertussis
gccacugccaggcg

SEQ ID NO: 2465327 - RNA, 18 nt, Bordetella pertussis
gccacugcgccugggcgg

SEQ ID NO: 2465328 - RNA, 12 nt, Bordetella pertussis
gccacugcggcc

SEQ ID NO: 2465329 - RNA, 13 nt, Bordetella pertussis
gccacugcggccc

SEQ ID NO: 2465330 - RNA, 14 nt, Bordetella pertussis
gccacugcggcccg

SEQ ID NO: 2465331 - RNA, 14 nt, Bordetella pertussis
gccacuggccgcgc

SEQ ID NO: 2465332 - RNA, 15 nt, Bordetella pertussis
gccacuggccgcgcu

SEQ ID NO: 2465333 - RNA, 14 nt, Bordetella pertussis
gccacuggccuugu

SEQ ID NO: 2465334 - RNA, 15 nt, Bordetella pertussis
gccacuuccuggugg

SEQ ID NO: 2465335 - RNA, 21 nt, Bordetella pertussis
gccacuuccuggugggcggca

SEQ ID NO: 2465336 - RNA, 22 nt, Bordetella pertussis
gccacuuccuggugggcggcaa

SEQ ID NO: 2465337 - RNA, 15 nt, Bordetella pertussis
gccacuucgcggccg

SEQ ID NO: 2465338 - RNA, 18 nt, Bordetella pertussis
gccacuugcaggccgcga

SEQ ID NO: 2465339 - RNA, 15 nt, Bordetella pertussis
gccacuuucgcgcgc

SEQ ID NO: 2465340 - RNA, 17 nt, Bordetella pertussis
gccacuuucgcgcgcgc

SEQ ID NO: 2465341 - RNA, 22 nt, Bordetella pertussis
gccacuuucgcgcgcgccugcc

SEQ ID NO: 2465342 - RNA, 16 nt, Bordetella pertussis
gccagaaagcgcggcc

SEQ ID NO: 2465343 - RNA, 16 nt, Bordetella pertussis
gccagaacagccgcga

SEQ ID NO: 2465344 - RNA, 17 nt, Bordetella pertussis
gccagaacaugagccau

SEQ ID NO: 2465345 - RNA, 21 nt, Bordetella pertussis
gccagacauugucaagcagcg

SEQ ID NO: 2465346 - RNA, 22 nt, Bordetella pertussis
gccagacauugucaagcagcgc

SEQ ID NO: 2465347 - RNA, 14 nt, Bordetella pertussis
gccagaccgcgcgc

SEQ ID NO: 2465348 - RNA, 17 nt, Bordetella pertussis
gccagaccgcgcgcacc

SEQ ID NO: 2465349 - RNA, 14 nt, Bordetella pertussis
gccagaccuugcgc

SEQ ID NO: 2465350 - RNA, 13 nt, Bordetella pertussis
gccagacggccag

SEQ ID NO: 2465351 - RNA, 19 nt, Bordetella pertussis
gccagagcgggauggucgc

SEQ ID NO: 2465352 - RNA, 16 nt, Bordetella pertussis
gccagauaaaggccgc

SEQ ID NO: 2465353 - RNA, 18 nt, Bordetella pertussis
gccagauaaaggccgcaa

SEQ ID NO: 2465354 - RNA, 20 nt, Bordetella pertussis
gccagauaaaggccgcaacc

SEQ ID NO: 2465355 - RNA, 22 nt, Bordetella pertussis
gccagauaaaggccgcaaccca

SEQ ID NO: 2465356 - RNA, 21 nt, Bordetella pertussis
gccagauaccguccuugagcg

SEQ ID NO: 2465357 - RNA, 13 nt, Bordetella pertussis
gccagauagccca

SEQ ID NO: 2465358 - RNA, 18 nt, Bordetella pertussis
gccagauagcccaggcgg

SEQ ID NO: 2465359 - RNA, 21 nt, Bordetella pertussis
gccagauagucgcggaugcgc

SEQ ID NO: 2465360 - RNA, 22 nt, Bordetella pertussis
gccagauagucgcggaugcgcg

SEQ ID NO: 2465361 - RNA, 20 nt, Bordetella pertussis
gccagauccgguaugccugc

SEQ ID NO: 2465362 - RNA, 22 nt, Bordetella pertussis
gccagauccgguaugccugcca

SEQ ID NO: 2465363 - RNA, 22 nt, Bordetella pertussis
gccagaucggacgggccgauga

SEQ ID NO: 2465364 - RNA, 19 nt, Bordetella pertussis
gccagaucguugaucucgc

SEQ ID NO: 2465365 - RNA, 17 nt, Bordetella pertussis
gccagcaagcgcgccau

SEQ ID NO: 2465366 - RNA, 19 nt, Bordetella pertussis
gccagcaagcgcgccauga

SEQ ID NO: 2465367 - RNA, 13 nt, Bordetella pertussis
gccagcaagcgcu

SEQ ID NO: 2465368 - RNA, 15 nt, Bordetella pertussis
gccagcaagcgcucg

SEQ ID NO: 2465369 - RNA, 16 nt, Bordetella pertussis
gccagcaagcgcucgg

SEQ ID NO: 2465370 - RNA, 20 nt, Bordetella pertussis
gccagcaagcgcucggccac

SEQ ID NO: 2465371 - RNA, 21 nt, Bordetella pertussis
gccagcaaggcggcaaacccg

SEQ ID NO: 2465372 - RNA, 13 nt, Bordetella pertussis
gccagcaaggcgu

SEQ ID NO: 2465373 - RNA, 16 nt, Bordetella pertussis
gccagcaaggcgucgg

SEQ ID NO: 2465374 - RNA, 20 nt, Bordetella pertussis
gccagcaaggcgucggccag

SEQ ID NO: 2465375 - RNA, 13 nt, Bordetella pertussis
gccagcaccggca

SEQ ID NO: 2465376 - RNA, 14 nt, Bordetella pertussis
gccagcaccggcac

SEQ ID NO: 2465377 - RNA, 15 nt, Bordetella pertussis
gccagcaccggcacg

SEQ ID NO: 2465378 - RNA, 16 nt, Bordetella pertussis
gccagcaccggcccga

SEQ ID NO: 2465379 - RNA, 17 nt, Bordetella pertussis
gccagcaccggcccgaa

SEQ ID NO: 2465380 - RNA, 15 nt, Bordetella pertussis
gccagcaccggccgc

SEQ ID NO: 2465381 - RNA, 15 nt, Bordetella pertussis
gccagcacgaucacg

SEQ ID NO: 2465382 - RNA, 18 nt, Bordetella pertussis
gccagcacgaucacgaac

SEQ ID NO: 2465383 - RNA, 23 nt, Bordetella pertussis
gccagcacgaucacgaacagcgc

SEQ ID NO: 2465384 - RNA, 21 nt, Bordetella pertussis
gccagcacgccauucauccag

SEQ ID NO: 2465385 - RNA, 13 nt, Bordetella pertussis
gccagcacgccgg

SEQ ID NO: 2465386 - RNA, 17 nt, Bordetella pertussis
gccagcacgccggccag

SEQ ID NO: 2465387 - RNA, 15 nt, Bordetella pertussis
gccagcacgccggcg

SEQ ID NO: 2465388 - RNA, 16 nt, Bordetella pertussis
gccagcacgcgcagcu

SEQ ID NO: 2465389 - RNA, 14 nt, Bordetella pertussis
gccagcacggcgca

SEQ ID NO: 2465390 - RNA, 15 nt, Bordetella pertussis
gccagcacggcgcac

SEQ ID NO: 2465391 - RNA, 16 nt, Bordetella pertussis
gccagcacggcgcaca

SEQ ID NO: 2465392 - RNA, 18 nt, Bordetella pertussis
gccagcacggcgcacacc

SEQ ID NO: 2465393 - RNA, 13 nt, Bordetella pertussis
gccagcacggugg

SEQ ID NO: 2465394 - RNA, 16 nt, Bordetella pertussis
gccagcacgguggcgc

SEQ ID NO: 2465395 - RNA, 17 nt, Bordetella pertussis
gccagcacgguggcgcc

SEQ ID NO: 2465396 - RNA, 18 nt, Bordetella pertussis
gccagcacgguggcgccc

SEQ ID NO: 2465397 - RNA, 20 nt, Bordetella pertussis
gccagcacgguggcgcccgg

SEQ ID NO: 2465398 - RNA, 17 nt, Bordetella pertussis
gccagcacgucauccug

SEQ ID NO: 2465399 - RNA, 22 nt, Bordetella pertussis
gccagcagaaugccgcccacga

SEQ ID NO: 2465400 - RNA, 21 nt, Bordetella pertussis
gccagcagcacgaucgcggcg

SEQ ID NO: 2465401 - RNA, 22 nt, Bordetella pertussis
gccagcagcacgaucgcggcgc

SEQ ID NO: 2465402 - RNA, 15 nt, Bordetella pertussis
gccagcagcaggccg

SEQ ID NO: 2465403 - RNA, 18 nt, Bordetella pertussis
gccagcagcgacggcccc

SEQ ID NO: 2465404 - RNA, 19 nt, Bordetella pertussis
gccagcagcgacggcccca

SEQ ID NO: 2465405 - RNA, 16 nt, Bordetella pertussis
gccagcagcgcaucgc

SEQ ID NO: 2465406 - RNA, 19 nt, Bordetella pertussis
gccagcagcgcaucgcgcg

SEQ ID NO: 2465407 - RNA, 13 nt, Bordetella pertussis
gccagcagcgccg

SEQ ID NO: 2465408 - RNA, 14 nt, Bordetella pertussis
gccagcagcgccgc

SEQ ID NO: 2465409 - RNA, 15 nt, Bordetella pertussis
gccagcagcgccgcc

SEQ ID NO: 2465410 - RNA, 16 nt, Bordetella pertussis
gccagcagcgccgcca

SEQ ID NO: 2465411 - RNA, 17 nt, Bordetella pertussis
gccagcagcgccgccag

SEQ ID NO: 2465412 - RNA, 18 nt, Bordetella pertussis
gccagcagcgccgccagc

SEQ ID NO: 2465413 - RNA, 13 nt, Bordetella pertussis
gccagcagcgcgu

SEQ ID NO: 2465414 - RNA, 16 nt, Bordetella pertussis
gccagcagcgcgugca

SEQ ID NO: 2465415 - RNA, 19 nt, Bordetella pertussis
gccagcagcgcgugcagcc

SEQ ID NO: 2465416 - RNA, 20 nt, Bordetella pertussis
gccagcagcgcgugcagcca

SEQ ID NO: 2465417 - RNA, 23 nt, Bordetella pertussis
gccagcagcgcgugcagccagcg

SEQ ID NO: 2465418 - RNA, 16 nt, Bordetella pertussis
gccagcagcgggcugg

SEQ ID NO: 2465419 - RNA, 17 nt, Bordetella pertussis
gccagcagcgggcuggg

SEQ ID NO: 2465420 - RNA, 20 nt, Bordetella pertussis
gccagcagcgggcuggggca

SEQ ID NO: 2465421 - RNA, 14 nt, Bordetella pertussis
gccagccugccgcg

SEQ ID NO: 2465422 - RNA, 15 nt, Bordetella pertussis
gccagccugccgcgg

SEQ ID NO: 2465423 - RNA, 19 nt, Bordetella pertussis
gccagccugccgcggccgc

SEQ ID NO: 2465424 - RNA, 20 nt, Bordetella pertussis
gccagccugccgcggccgcc

SEQ ID NO: 2465425 - RNA, 21 nt, Bordetella pertussis
gccagccugccgcggccgccc

SEQ ID NO: 2465426 - RNA, 13 nt, Bordetella pertussis
gccagccuggccu

SEQ ID NO: 2465427 - RNA, 16 nt, Bordetella pertussis
gccagccuggccuugc

SEQ ID NO: 2465428 - RNA, 19 nt, Bordetella pertussis
gccagccuggccuugcgcu

SEQ ID NO: 2465429 - RNA, 14 nt, Bordetella pertussis
gccagccuggcgcc

SEQ ID NO: 2465430 - RNA, 15 nt, Bordetella pertussis
gccagccuggcgcca

SEQ ID NO: 2465431 - RNA, 17 nt, Bordetella pertussis
gccagccuggcgccaac

SEQ ID NO: 2465432 - RNA, 21 nt, Bordetella pertussis
gccagccuuggcccacucaug

SEQ ID NO: 2465433 - RNA, 20 nt, Bordetella pertussis
gccagcgaaauacgcgacag

SEQ ID NO: 2465434 - RNA, 23 nt, Bordetella pertussis
gccagcgacccgcaaaaccgggc

SEQ ID NO: 2465435 - RNA, 14 nt, Bordetella pertussis
gccagcgacgacuu

SEQ ID NO: 2465436 - RNA, 23 nt, Bordetella pertussis
gccagcgacgacuugaucagggc

SEQ ID NO: 2465437 - RNA, 13 nt, Bordetella pertussis
gccagcgaggccg

SEQ ID NO: 2465438 - RNA, 16 nt, Bordetella pertussis
gccagcgaggccgcuu

SEQ ID NO: 2465439 - RNA, 17 nt, Bordetella pertussis
gccagcgccaccaccgg

SEQ ID NO: 2465440 - RNA, 19 nt, Bordetella pertussis
gccagcgccaccaccggca

SEQ ID NO: 2465441 - RNA, 12 nt, Bordetella pertussis
gccagcgccacg

SEQ ID NO: 2465442 - RNA, 16 nt, Bordetella pertussis
gccagcgccacgcccu

SEQ ID NO: 2465443 - RNA, 18 nt, Bordetella pertussis
gccagcgccacgcccugg

SEQ ID NO: 2465444 - RNA, 16 nt, Bordetella pertussis
gccagcgccacgcgag

SEQ ID NO: 2465445 - RNA, 17 nt, Bordetella pertussis
gccagcgccacgcgagc

SEQ ID NO: 2465446 - RNA, 20 nt, Bordetella pertussis
gccagcgccagaaagcgcgg

SEQ ID NO: 2465447 - RNA, 22 nt, Bordetella pertussis
gccagcgccagaaagcgcggcc

SEQ ID NO: 2465448 - RNA, 13 nt, Bordetella pertussis
gccagcgccagca

SEQ ID NO: 2465449 - RNA, 14 nt, Bordetella pertussis
gccagcgccagcac

SEQ ID NO: 2465450 - RNA, 15 nt, Bordetella pertussis
gccagcgccagcacg

SEQ ID NO: 2465451 - RNA, 13 nt, Bordetella pertussis
gccagcgccagcc

SEQ ID NO: 2465452 - RNA, 15 nt, Bordetella pertussis
gccagcgccagccgc

SEQ ID NO: 2465453 - RNA, 22 nt, Bordetella pertussis
gccagcgccaguccgcgcucgc

SEQ ID NO: 2465454 - RNA, 19 nt, Bordetella pertussis
gccagcgccaugaugucgc

SEQ ID NO: 2465455 - RNA, 21 nt, Bordetella pertussis
gccagcgccaugaugucgcgc

SEQ ID NO: 2465456 - RNA, 14 nt, Bordetella pertussis
gccagcgccccggc

SEQ ID NO: 2465457 - RNA, 15 nt, Bordetella pertussis
gccagcgccccggcg

SEQ ID NO: 2465458 - RNA, 16 nt, Bordetella pertussis
gccagcgccgcagcgu

SEQ ID NO: 2465459 - RNA, 14 nt, Bordetella pertussis
gccagcgccgccag

SEQ ID NO: 2465460 - RNA, 15 nt, Bordetella pertussis
gccagcgccgccagc

SEQ ID NO: 2465461 - RNA, 21 nt, Bordetella pertussis
gccagcgccgccagccgcugg

SEQ ID NO: 2465462 - RNA, 22 nt, Bordetella pertussis
gccagcgccgccagccgcuggc

SEQ ID NO: 2465463 - RNA, 16 nt, Bordetella pertussis
gccagcgccgccauca

SEQ ID NO: 2465464 - RNA, 12 nt, Bordetella pertussis
gccagcgccgcg

SEQ ID NO: 2465465 - RNA, 13 nt, Bordetella pertussis
gccagcgccgcga

SEQ ID NO: 2465466 - RNA, 14 nt, Bordetella pertussis
gccagcgccgcgcg

SEQ ID NO: 2465467 - RNA, 17 nt, Bordetella pertussis
gccagcgccgcgcgcgu

SEQ ID NO: 2465468 - RNA, 18 nt, Bordetella pertussis
gccagcgccgcgcgcgug

SEQ ID NO: 2465469 - RNA, 20 nt, Bordetella pertussis
gccagcgccgcgcgcgugcc

SEQ ID NO: 2465470 - RNA, 13 nt, Bordetella pertussis
gccagcgccgcgg

SEQ ID NO: 2465471 - RNA, 14 nt, Bordetella pertussis
gccagcgccgcggc

SEQ ID NO: 2465472 - RNA, 16 nt, Bordetella pertussis
gccagcgccgcggccg

SEQ ID NO: 2465473 - RNA, 17 nt, Bordetella pertussis
gccagcgccgcggccgg

SEQ ID NO: 2465474 - RNA, 14 nt, Bordetella pertussis
gccagcgccgcggu

SEQ ID NO: 2465475 - RNA, 12 nt, Bordetella pertussis
gccagcgccggc

SEQ ID NO: 2465476 - RNA, 13 nt, Bordetella pertussis
gccagcgccggcg

SEQ ID NO: 2465477 - RNA, 15 nt, Bordetella pertussis
gccagcgccggcgcg

SEQ ID NO: 2465478 - RNA, 22 nt, Bordetella pertussis
gccagcgccggcgcguccacgc

SEQ ID NO: 2465479 - RNA, 18 nt, Bordetella pertussis
gccagcgccuccaucagc

SEQ ID NO: 2465480 - RNA, 12 nt, Bordetella pertussis
gccagcgccucg

SEQ ID NO: 2465481 - RNA, 15 nt, Bordetella pertussis
gccagcgccucgcgc

SEQ ID NO: 2465482 - RNA, 19 nt, Bordetella pertussis
gccagcgccucgucgcgca

SEQ ID NO: 2465483 - RNA, 18 nt, Bordetella pertussis
gccagcgccugcgcggcc

SEQ ID NO: 2465484 - RNA, 12 nt, Bordetella pertussis
gccagcgccugg

SEQ ID NO: 2465485 - RNA, 15 nt, Bordetella pertussis
gccagcgccuggacc

SEQ ID NO: 2465486 - RNA, 18 nt, Bordetella pertussis
gccagcgccuggaccugg

SEQ ID NO: 2465487 - RNA, 13 nt, Bordetella pertussis
gccagcgccuggg

SEQ ID NO: 2465488 - RNA, 15 nt, Bordetella pertussis
gccagcgccugggcg

SEQ ID NO: 2465489 - RNA, 21 nt, Bordetella pertussis
gccagcgcgaaaacccgcggc

SEQ ID NO: 2465490 - RNA, 23 nt, Bordetella pertussis
gccagcgcgaaaacccgcggcag

SEQ ID NO: 2465491 - RNA, 16 nt, Bordetella pertussis
gccagcgcgacggccu

SEQ ID NO: 2465492 - RNA, 19 nt, Bordetella pertussis
gccagcgcgaucucgcgca

SEQ ID NO: 2465493 - RNA, 21 nt, Bordetella pertussis
gccagcgcgcaggugugccag

SEQ ID NO: 2465494 - RNA, 12 nt, Bordetella pertussis
gccagcgcgcca

SEQ ID NO: 2465495 - RNA, 13 nt, Bordetella pertussis
gccagcgcgccau

SEQ ID NO: 2465496 - RNA, 22 nt, Bordetella pertussis
gccagcgcgccauggccggccg

SEQ ID NO: 2465497 - RNA, 13 nt, Bordetella pertussis
gccagcgcgccgc

SEQ ID NO: 2465498 - RNA, 19 nt, Bordetella pertussis
gccagcgcgccgcccacca

SEQ ID NO: 2465499 - RNA, 13 nt, Bordetella pertussis
gccagcgcgccuu

SEQ ID NO: 2465500 - RNA, 21 nt, Bordetella pertussis
gccagcgcgcgauagauggcc

SEQ ID NO: 2465501 - RNA, 14 nt, Bordetella pertussis
gccagcgcgcgcca

SEQ ID NO: 2465502 - RNA, 23 nt, Bordetella pertussis
gccagcgcgcgccaguugcgcac

SEQ ID NO: 2465503 - RNA, 22 nt, Bordetella pertussis
gccagcgcgcgcgaggcggcgg

SEQ ID NO: 2465504 - RNA, 14 nt, Bordetella pertussis
gccagcgcgcggcg

SEQ ID NO: 2465505 - RNA, 19 nt, Bordetella pertussis
gccagcgcgcggcgcagcg

SEQ ID NO: 2465506 - RNA, 18 nt, Bordetella pertussis
gccagcgcggcaucggcc

SEQ ID NO: 2465507 - RNA, 12 nt, Bordetella pertussis
gccagcgcggcc

SEQ ID NO: 2465508 - RNA, 14 nt, Bordetella pertussis
gccagcgcggccag

SEQ ID NO: 2465509 - RNA, 16 nt, Bordetella pertussis
gccagcgcggccagcg

SEQ ID NO: 2465510 - RNA, 15 nt, Bordetella pertussis
gccagcgcggccagg

SEQ ID NO: 2465511 - RNA, 15 nt, Bordetella pertussis
gccagcgcggcggca

SEQ ID NO: 2465512 - RNA, 13 nt, Bordetella pertussis
gccagcgcggcuu

SEQ ID NO: 2465513 - RNA, 16 nt, Bordetella pertussis
gccagcgcgguguugc

SEQ ID NO: 2465514 - RNA, 22 nt, Bordetella pertussis
gccagcgcgucgcguagcgcgg

SEQ ID NO: 2465515 - RNA, 23 nt, Bordetella pertussis
gccagcgcgucgcguagcgcggc

SEQ ID NO: 2465516 - RNA, 18 nt, Bordetella pertussis
gccagcgcgucguccagc

SEQ ID NO: 2465517 - RNA, 21 nt, Bordetella pertussis
gccagcgcgucguccagcgug

SEQ ID NO: 2465518 - RNA, 17 nt, Bordetella pertussis
gccagcgcuucgggcag

SEQ ID NO: 2465519 - RNA, 19 nt, Bordetella pertussis
gccagcgcuucgggcagcu

SEQ ID NO: 2465520 - RNA, 21 nt, Bordetella pertussis
gccagcgcuucgggcagcucg

SEQ ID NO: 2465521 - RNA, 22 nt, Bordetella pertussis
gccagcggaugaugcggcgcca

SEQ ID NO: 2465522 - RNA, 15 nt, Bordetella pertussis
gccagcggauggugc

SEQ ID NO: 2465523 - RNA, 21 nt, Bordetella pertussis
gccagcggauggugcucggcg

SEQ ID NO: 2465524 - RNA, 22 nt, Bordetella pertussis
gccagcggauggugcucggcga

SEQ ID NO: 2465525 - RNA, 13 nt, Bordetella pertussis
gccagcggcagcg

SEQ ID NO: 2465526 - RNA, 17 nt, Bordetella pertussis
gccagcggcagcgcgca

SEQ ID NO: 2465527 - RNA, 17 nt, Bordetella pertussis
gccagcggcaggacggg

SEQ ID NO: 2465528 - RNA, 15 nt, Bordetella pertussis
gccagcggcaggccc

SEQ ID NO: 2465529 - RNA, 16 nt, Bordetella pertussis
gccagcggcaggccca

SEQ ID NO: 2465530 - RNA, 17 nt, Bordetella pertussis
gccagcggcaggcccag

SEQ ID NO: 2465531 - RNA, 19 nt, Bordetella pertussis
gccagcggcaggcccagcu

SEQ ID NO: 2465532 - RNA, 16 nt, Bordetella pertussis
gccagcggcaggggcu

SEQ ID NO: 2465533 - RNA, 23 nt, Bordetella pertussis
gccagcggcaggggcucgcgccc

SEQ ID NO: 2465534 - RNA, 17 nt, Bordetella pertussis
gccagcggcgacugccc

SEQ ID NO: 2465535 - RNA, 21 nt, Bordetella pertussis
gccaggcaaucgaugaucacg

SEQ ID NO: 2465536 - RNA, 23 nt, Bordetella pertussis
gccaggcauugaagcuggcgccg

SEQ ID NO: 2465537 - RNA, 14 nt, Bordetella pertussis
gccaggccagcagc

SEQ ID NO: 2465538 - RNA, 19 nt, Bordetella pertussis
gccaggccagcagcucggc

SEQ ID NO: 2465539 - RNA, 12 nt, Bordetella pertussis
gccaggccagcg

SEQ ID NO: 2465540 - RNA, 13 nt, Bordetella pertussis
gccaggccagcgc

SEQ ID NO: 2465541 - RNA, 14 nt, Bordetella pertussis
gccaggccagcgcc

SEQ ID NO: 2465542 - RNA, 16 nt, Bordetella pertussis
gccaggccagcgccag

SEQ ID NO: 2465543 - RNA, 14 nt, Bordetella pertussis
gccaggccauggcg

SEQ ID NO: 2465544 - RNA, 17 nt, Bordetella pertussis
gccaggccauggcgcga

SEQ ID NO: 2465545 - RNA, 14 nt, Bordetella pertussis
gccaggcccacggc

SEQ ID NO: 2465546 - RNA, 15 nt, Bordetella pertussis
gccaggcccacggcg

SEQ ID NO: 2465547 - RNA, 18 nt, Bordetella pertussis
gccaggcccaugccgccc

SEQ ID NO: 2465548 - RNA, 21 nt, Bordetella pertussis
gccaggcccaugccgcccgcc

SEQ ID NO: 2465549 - RNA, 22 nt, Bordetella pertussis
gccaggcccaugccgcccgcca

SEQ ID NO: 2465550 - RNA, 12 nt, Bordetella pertussis
gccaggccccgc

SEQ ID NO: 2465551 - RNA, 14 nt, Bordetella pertussis
gccaggccccgccg

SEQ ID NO: 2465552 - RNA, 17 nt, Bordetella pertussis
gccaggccccgccgggc

SEQ ID NO: 2465553 - RNA, 13 nt, Bordetella pertussis
gccaggcccggcg

SEQ ID NO: 2465554 - RNA, 14 nt, Bordetella pertussis
gccaggcccggcgc

SEQ ID NO: 2465555 - RNA, 15 nt, Bordetella pertussis
gccaggcccggcgcg

SEQ ID NO: 2465556 - RNA, 16 nt, Bordetella pertussis
gccaggcccggcgcgc

SEQ ID NO: 2465557 - RNA, 13 nt, Bordetella pertussis
gccaggcccucgc

SEQ ID NO: 2465558 - RNA, 21 nt, Bordetella pertussis
gccaggcccucgcggccgucg

SEQ ID NO: 2465559 - RNA, 12 nt, Bordetella pertussis
gccaggcccugu

SEQ ID NO: 2465560 - RNA, 18 nt, Bordetella pertussis
gccaggcccuugauggcc

SEQ ID NO: 2465561 - RNA, 19 nt, Bordetella pertussis
gccaggccgaacgcggucg

SEQ ID NO: 2465562 - RNA, 17 nt, Bordetella pertussis
gccaggccgaucagcac

SEQ ID NO: 2465563 - RNA, 22 nt, Bordetella pertussis
gccaggccgauuucggccgccg

SEQ ID NO: 2465564 - RNA, 15 nt, Bordetella pertussis
gccaggccgcauacg

SEQ ID NO: 2465565 - RNA, 16 nt, Bordetella pertussis
gccaggccgccgccgg

SEQ ID NO: 2465566 - RNA, 14 nt, Bordetella pertussis
gccaggccggcggc

SEQ ID NO: 2465567 - RNA, 15 nt, Bordetella pertussis
gccaggccggcggcg

SEQ ID NO: 2465568 - RNA, 14 nt, Bordetella pertussis
gccaggccggggcc

SEQ ID NO: 2465569 - RNA, 18 nt, Bordetella pertussis
gccaggccggggccgugg

SEQ ID NO: 2465570 - RNA, 21 nt, Bordetella pertussis
gccaggccgucgagcacgggg

SEQ ID NO: 2465571 - RNA, 17 nt, Bordetella pertussis
gccaggccucggcuccg

SEQ ID NO: 2465572 - RNA, 15 nt, Bordetella pertussis
gccaggccucggucg

SEQ ID NO: 2465573 - RNA, 17 nt, Bordetella pertussis
gccaggccucggucgcc

SEQ ID NO: 2465574 - RNA, 17 nt, Bordetella pertussis
gccaggcgaaccuggcg

SEQ ID NO: 2465575 - RNA, 16 nt, Bordetella pertussis
gccaggcgagcgccgc

SEQ ID NO: 2465576 - RNA, 17 nt, Bordetella pertussis
gccaggcgagcgccgcg

SEQ ID NO: 2465577 - RNA, 18 nt, Bordetella pertussis
gccaggcgagcgccgcgc

SEQ ID NO: 2465578 - RNA, 20 nt, Bordetella pertussis
gccaggcgagcgccgcgcuc

SEQ ID NO: 2465579 - RNA, 23 nt, Bordetella pertussis
gccaggcgagcgccgcgcuccag

SEQ ID NO: 2465580 - RNA, 21 nt, Bordetella pertussis
gccaggcgauggccgggagcg

SEQ ID NO: 2465581 - RNA, 20 nt, Bordetella pertussis
gccaggcgcaguaucuggug

SEQ ID NO: 2465582 - RNA, 22 nt, Bordetella pertussis
gccaggcgcauguccgccacgc

SEQ ID NO: 2465583 - RNA, 21 nt, Bordetella pertussis
gccaggcgccagaugcgccgc

SEQ ID NO: 2465584 - RNA, 16 nt, Bordetella pertussis
gccaggcgccagcggc

SEQ ID NO: 2465585 - RNA, 16 nt, Bordetella pertussis
gccagggccuggcaca

SEQ ID NO: 2465586 - RNA, 19 nt, Bordetella pertussis
gccagggcgaugcggcggc

SEQ ID NO: 2465587 - RNA, 15 nt, Bordetella pertussis
gccagggcgccgcgg

SEQ ID NO: 2465588 - RNA, 12 nt, Bordetella pertussis
gccagggcggcg

SEQ ID NO: 2465589 - RNA, 14 nt, Bordetella pertussis
gccagggcggggcc

SEQ ID NO: 2465590 - RNA, 18 nt, Bordetella pertussis
gccaggggaugacgggcg

SEQ ID NO: 2465591 - RNA, 20 nt, Bordetella pertussis
gccaggggcagcucggugca

SEQ ID NO: 2465592 - RNA, 22 nt, Bordetella pertussis
gccaggggcagcucggugcagc

SEQ ID NO: 2465593 - RNA, 17 nt, Bordetella pertussis
gccaggggcgcuggucg

SEQ ID NO: 2465594 - RNA, 19 nt, Bordetella pertussis
gccaggggcgcuggucgau

SEQ ID NO: 2465595 - RNA, 18 nt, Bordetella pertussis
gccagggugaccuggcgc

SEQ ID NO: 2465596 - RNA, 12 nt, Bordetella pertussis
gccagggugcac

SEQ ID NO: 2465597 - RNA, 18 nt, Bordetella pertussis
gccagggugcaccaggug

SEQ ID NO: 2465598 - RNA, 18 nt, Bordetella pertussis
gccaggguuugcuggcgc

SEQ ID NO: 2465599 - RNA, 19 nt, Bordetella pertussis
gccaggguuugcuggcgca

SEQ ID NO: 2465600 - RNA, 22 nt, Bordetella pertussis
gccaggguuugcuggcgcagca

SEQ ID NO: 2465601 - RNA, 18 nt, Bordetella pertussis
gccagguaagcuggcgcu

SEQ ID NO: 2465602 - RNA, 14 nt, Bordetella pertussis
gccagguacaggcc

SEQ ID NO: 2465603 - RNA, 16 nt, Bordetella pertussis
gccagguacaggccgc

SEQ ID NO: 2465604 - RNA, 21 nt, Bordetella pertussis
gccagguacaggccgccgguc

SEQ ID NO: 2465605 - RNA, 16 nt, Bordetella pertussis
gccagguagcgggugg

SEQ ID NO: 2465606 - RNA, 18 nt, Bordetella pertussis
gccagguagcggguggcc

SEQ ID NO: 2465607 - RNA, 14 nt, Bordetella pertussis
gccagguaggccgg

SEQ ID NO: 2465608 - RNA, 18 nt, Bordetella pertussis
gccagguaggccggcgcg

SEQ ID NO: 2465609 - RNA, 21 nt, Bordetella pertussis
gccagguaggccggcgcgacc

SEQ ID NO: 2465610 - RNA, 22 nt, Bordetella pertussis
gccagguagucgucgaaggcgc

SEQ ID NO: 2465611 - RNA, 23 nt, Bordetella pertussis
gccagguagucgucgaaggcgcg

SEQ ID NO: 2465612 - RNA, 21 nt, Bordetella pertussis
gccagguauugcucggcgguc

SEQ ID NO: 2465613 - RNA, 15 nt, Bordetella pertussis
gccaggucgcgcacc

SEQ ID NO: 2465614 - RNA, 16 nt, Bordetella pertussis
gccaggucgcgcacca

SEQ ID NO: 2465615 - RNA, 16 nt, Bordetella pertussis
gccaggucgcgcauca

SEQ ID NO: 2465616 - RNA, 15 nt, Bordetella pertussis
gccaggucggccacc

SEQ ID NO: 2465617 - RNA, 22 nt, Bordetella pertussis
gccaggucggccaccgccgugg

SEQ ID NO: 2465618 - RNA, 16 nt, Bordetella pertussis
gccaggucggccagcc

SEQ ID NO: 2465619 - RNA, 20 nt, Bordetella pertussis
gccaggucggccagccggcc

SEQ ID NO: 2465620 - RNA, 21 nt, Bordetella pertussis
gccaggucggccagccggccg

SEQ ID NO: 2465621 - RNA, 18 nt, Bordetella pertussis
gccaggucggcggccagc

SEQ ID NO: 2465622 - RNA, 13 nt, Bordetella pertussis
gccaggucggcgu

SEQ ID NO: 2465623 - RNA, 18 nt, Bordetella pertussis
gccaggugcacagcgucc

SEQ ID NO: 2465624 - RNA, 13 nt, Bordetella pertussis
gccaggugcuugc

SEQ ID NO: 2465625 - RNA, 18 nt, Bordetella pertussis
gccagguggacagcgcca

SEQ ID NO: 2465626 - RNA, 21 nt, Bordetella pertussis
gccagguggacagcgccagcc

SEQ ID NO: 2465627 - RNA, 17 nt, Bordetella pertussis
gccagguggcggcggca

SEQ ID NO: 2465628 - RNA, 15 nt, Bordetella pertussis
gccagguguaggcca

SEQ ID NO: 2465629 - RNA, 16 nt, Bordetella pertussis
gccagguguaggccag

SEQ ID NO: 2465630 - RNA, 12 nt, Bordetella pertussis
gccagguucgcc

SEQ ID NO: 2465631 - RNA, 15 nt, Bordetella pertussis
gccagguucgccugg

SEQ ID NO: 2465632 - RNA, 15 nt, Bordetella pertussis
gccagguucuggucg

SEQ ID NO: 2465633 - RNA, 17 nt, Bordetella pertussis
gccagguugggugcgcc

SEQ ID NO: 2465634 - RNA, 20 nt, Bordetella pertussis
gccagguugggugcgccgcc

SEQ ID NO: 2465635 - RNA, 22 nt, Bordetella pertussis
gccagguugggugcgccgccgg

SEQ ID NO: 2465636 - RNA, 16 nt, Bordetella pertussis
gccaguacaggcugcc

SEQ ID NO: 2465637 - RNA, 17 nt, Bordetella pertussis
gccaguacaggcugccg

SEQ ID NO: 2465638 - RNA, 22 nt, Bordetella pertussis
gccaguacaggcugccgucguc

SEQ ID NO: 2465639 - RNA, 16 nt, Bordetella pertussis
gccaguagcgccggcu

SEQ ID NO: 2465640 - RNA, 16 nt, Bordetella pertussis
gccaguugccgccgcc

SEQ ID NO: 2465641 - RNA, 18 nt, Bordetella pertussis
gccaguugccgccgccgg

SEQ ID NO: 2465642 - RNA, 23 nt, Bordetella pertussis
gccaguugccgccgccggcgcgg

SEQ ID NO: 2465643 - RNA, 18 nt, Bordetella pertussis
gccaguugcgcaccgcuu

SEQ ID NO: 2465644 - RNA, 21 nt, Bordetella pertussis
gccaguugcggggcgcccagc

SEQ ID NO: 2465645 - RNA, 17 nt, Bordetella pertussis
gccaguuguagguccag

SEQ ID NO: 2465646 - RNA, 21 nt, Bordetella pertussis
gccauaaggcuucucgaccag

SEQ ID NO: 2465647 - RNA, 22 nt, Bordetella pertussis
gccauaaggcuucucgaccagg

SEQ ID NO: 2465648 - RNA, 17 nt, Bordetella pertussis
gccauacagcaaggaca

SEQ ID NO: 2465649 - RNA, 19 nt, Bordetella pertussis
gccauacccggucgaucag

SEQ ID NO: 2465650 - RNA, 21 nt, Bordetella pertussis
gccauacguccuuuggcgucg

SEQ ID NO: 2465651 - RNA, 18 nt, Bordetella pertussis
gccauagcguucgguggc

SEQ ID NO: 2465652 - RNA, 15 nt, Bordetella pertussis
gccauagcugcgcca

SEQ ID NO: 2465653 - RNA, 14 nt, Bordetella pertussis
gccauaggccagcg

SEQ ID NO: 2465654 - RNA, 14 nt, Bordetella pertussis
gccauaggcgcgca

SEQ ID NO: 2465655 - RNA, 16 nt, Bordetella pertussis
gccauaggcgcgcacc

SEQ ID NO: 2465656 - RNA, 20 nt, Bordetella pertussis
gccauaggcgcgcaccagcc

SEQ ID NO: 2465657 - RNA, 21 nt, Bordetella pertussis
gccauaggcgcgcaccagccc

SEQ ID NO: 2465658 - RNA, 20 nt, Bordetella pertussis
gccauagggcgacugcagca

SEQ ID NO: 2465659 - RNA, 14 nt, Bordetella pertussis
gccauagucgcgca

SEQ ID NO: 2465660 - RNA, 16 nt, Bordetella pertussis
gccauagucgcgcaau

SEQ ID NO: 2465661 - RNA, 17 nt, Bordetella pertussis
gccauaucccugcggca

SEQ ID NO: 2465662 - RNA, 18 nt, Bordetella pertussis
gccauauugaugcagcac

SEQ ID NO: 2465663 - RNA, 14 nt, Bordetella pertussis
gccaucaacguggc

SEQ ID NO: 2465664 - RNA, 18 nt, Bordetella pertussis
gccaucacaucgcuaugc

SEQ ID NO: 2465665 - RNA, 16 nt, Bordetella pertussis
gccaucaggugcaggg

SEQ ID NO: 2465666 - RNA, 18 nt, Bordetella pertussis
gccaucaggugcaggguu

SEQ ID NO: 2465667 - RNA, 19 nt, Bordetella pertussis
gccaucaggugcaggguug

SEQ ID NO: 2465668 - RNA, 22 nt, Bordetella pertussis
gccaucagguuguccagcgcgc

SEQ ID NO: 2465669 - RNA, 20 nt, Bordetella pertussis
gccaucaucaucgucggcgc

SEQ ID NO: 2465670 - RNA, 14 nt, Bordetella pertussis
gccauccagccagg

SEQ ID NO: 2465671 - RNA, 17 nt, Bordetella pertussis
gccauccagccaggccg

SEQ ID NO: 2465672 - RNA, 18 nt, Bordetella pertussis
gccauccagccaggccgc

SEQ ID NO: 2465673 - RNA, 19 nt, Bordetella pertussis
gccauccagccaggccgca

SEQ ID NO: 2465674 - RNA, 11 nt, Bordetella pertussis
gccauccggcc

SEQ ID NO: 2465675 - RNA, 14 nt, Bordetella pertussis
gccauccggccacg

SEQ ID NO: 2465676 - RNA, 15 nt, Bordetella pertussis
gccauccggccacgc

SEQ ID NO: 2465677 - RNA, 19 nt, Bordetella pertussis
gccauccggccgcacgcgg

SEQ ID NO: 2465678 - RNA, 16 nt, Bordetella pertussis
gccauccggcgcauga

SEQ ID NO: 2465679 - RNA, 17 nt, Bordetella pertussis
gccauccguccgccagg

SEQ ID NO: 2465680 - RNA, 21 nt, Bordetella pertussis
gccauccguccgccaggacgg

SEQ ID NO: 2465681 - RNA, 16 nt, Bordetella pertussis
gccauccucgcccagc

SEQ ID NO: 2465682 - RNA, 18 nt, Bordetella pertussis
gccauccucgcccagcgg

SEQ ID NO: 2465683 - RNA, 22 nt, Bordetella pertussis
gccauccucgcccagcggcgcc

SEQ ID NO: 2465684 - RNA, 23 nt, Bordetella pertussis
gccauccucgcccagcggcgccg

SEQ ID NO: 2465685 - RNA, 13 nt, Bordetella pertussis
gccauccuggccg

SEQ ID NO: 2465686 - RNA, 14 nt, Bordetella pertussis
gccauccuggccgc

SEQ ID NO: 2465687 - RNA, 17 nt, Bordetella pertussis
gccauccuggccgccgc

SEQ ID NO: 2465688 - RNA, 16 nt, Bordetella pertussis
gccaucgaacuccugc

SEQ ID NO: 2465689 - RNA, 17 nt, Bordetella pertussis
gccaucgaacuccugca

SEQ ID NO: 2465690 - RNA, 21 nt, Bordetella pertussis
gccaucgaacuccugcaacca

SEQ ID NO: 2465691 - RNA, 22 nt, Bordetella pertussis
gccaucgaacuccugcaaccag

SEQ ID NO: 2465692 - RNA, 22 nt, Bordetella pertussis
gccaucgacgcuugccggcgau

SEQ ID NO: 2465693 - RNA, 18 nt, Bordetella pertussis
gccaucgacgggcggcug

SEQ ID NO: 2465694 - RNA, 20 nt, Bordetella pertussis
gccaucgacgggcggcugcc

SEQ ID NO: 2465695 - RNA, 18 nt, Bordetella pertussis
gccaucgauaugggcggc

SEQ ID NO: 2465696 - RNA, 20 nt, Bordetella pertussis
gccaucgauaugggcggccu

SEQ ID NO: 2465697 - RNA, 22 nt, Bordetella pertussis
gccaucgauaugggcggccucg

SEQ ID NO: 2465698 - RNA, 23 nt, Bordetella pertussis
gccaucgauaugggcggccucgg

SEQ ID NO: 2465699 - RNA, 16 nt, Bordetella pertussis
gccaucgccaggacca

SEQ ID NO: 2465700 - RNA, 15 nt, Bordetella pertussis
gccaucgccauggcc

SEQ ID NO: 2465701 - RNA, 13 nt, Bordetella pertussis
gccaucgccgcca

SEQ ID NO: 2465702 - RNA, 15 nt, Bordetella pertussis
gccaucgccgccacg

SEQ ID NO: 2465703 - RNA, 19 nt, Bordetella pertussis
gccaucgccgccacgugca

SEQ ID NO: 2465704 - RNA, 20 nt, Bordetella pertussis
gccaucgccgccgccgggcu

SEQ ID NO: 2465705 - RNA, 12 nt, Bordetella pertussis
gccaucgcgcau

SEQ ID NO: 2465706 - RNA, 13 nt, Bordetella pertussis
gccaucgcgcauu

SEQ ID NO: 2465707 - RNA, 19 nt, Bordetella pertussis
gccaucgcggucgaugacc

SEQ ID NO: 2465708 - RNA, 16 nt, Bordetella pertussis
gccaucgcugguaugc

SEQ ID NO: 2465709 - RNA, 12 nt, Bordetella pertussis
gccaucggccgg

SEQ ID NO: 2465710 - RNA, 13 nt, Bordetella pertussis
gccaucggcgcca

SEQ ID NO: 2465711 - RNA, 15 nt, Bordetella pertussis
gccaucggcgccaag

SEQ ID NO: 2465712 - RNA, 22 nt, Bordetella pertussis
gccaucgggauaccgcuggcca

SEQ ID NO: 2465713 - RNA, 20 nt, Bordetella pertussis
gccaucgggcugcggauacg

SEQ ID NO: 2465714 - RNA, 20 nt, Bordetella pertussis
gccaucgucguagcgccagc

SEQ ID NO: 2465715 - RNA, 21 nt, Bordetella pertussis
gccaucgucguagcgccagcg

SEQ ID NO: 2465716 - RNA, 16 nt, Bordetella pertussis
gccaucucgcgcgcua

SEQ ID NO: 2465717 - RNA, 20 nt, Bordetella pertussis
gccaucugcugcgagacgcg

SEQ ID NO: 2465718 - RNA, 22 nt, Bordetella pertussis
gccaucuugcaggcgccagucc

SEQ ID NO: 2465719 - RNA, 23 nt, Bordetella pertussis
gccaucuugcaggcgccaguccc

SEQ ID NO: 2465720 - RNA, 21 nt, Bordetella pertussis
gccaucuuggugcgcgccagg

SEQ ID NO: 2465721 - RNA, 20 nt, Bordetella pertussis
gccaugaacgcuugacggcc

SEQ ID NO: 2465722 - RNA, 21 nt, Bordetella pertussis
gccaugaacgcuugacggcca

SEQ ID NO: 2465723 - RNA, 23 nt, Bordetella pertussis
gccaugaacgcuugacggccaag

SEQ ID NO: 2465724 - RNA, 12 nt, Bordetella pertussis
gccaugaacucg

SEQ ID NO: 2465725 - RNA, 22 nt, Bordetella pertussis
gccaugacauaggagaguucgg

SEQ ID NO: 2465726 - RNA, 19 nt, Bordetella pertussis
gccaugaccacgucgacca

SEQ ID NO: 2465727 - RNA, 14 nt, Bordetella pertussis
gccaugacgcuggu

SEQ ID NO: 2465728 - RNA, 14 nt, Bordetella pertussis
gccaugagccacaa

SEQ ID NO: 2465729 - RNA, 16 nt, Bordetella pertussis
gccaugaucaggccga

SEQ ID NO: 2465730 - RNA, 19 nt, Bordetella pertussis
gccaugaucaggccgaacu

SEQ ID NO: 2465731 - RNA, 15 nt, Bordetella pertussis
gccaugaucgccggc

SEQ ID NO: 2465732 - RNA, 17 nt, Bordetella pertussis
gccaugaucgccggcaa

SEQ ID NO: 2465733 - RNA, 18 nt, Bordetella pertussis
gccaugaugucgcgcgcc

SEQ ID NO: 2465734 - RNA, 18 nt, Bordetella pertussis
gccaugcaacacgaccag

SEQ ID NO: 2465735 - RNA, 20 nt, Bordetella pertussis
gccaugcaacacgaccagca

SEQ ID NO: 2465736 - RNA, 23 nt, Bordetella pertussis
gccaugcaacacgaccagcaggc

SEQ ID NO: 2465737 - RNA, 18 nt, Bordetella pertussis
gccaugcaccagcacauc

SEQ ID NO: 2465738 - RNA, 19 nt, Bordetella pertussis
gccaugcacgggccaugga

SEQ ID NO: 2465739 - RNA, 21 nt, Bordetella pertussis
gccaugcagcuggauggccug

SEQ ID NO: 2465740 - RNA, 22 nt, Bordetella pertussis
gccaugcagcuggauggccugc

SEQ ID NO: 2465741 - RNA, 17 nt, Bordetella pertussis
gccaugccaacgguugc

SEQ ID NO: 2465742 - RNA, 16 nt, Bordetella pertussis
gccaugcccaggccca

SEQ ID NO: 2465743 - RNA, 17 nt, Bordetella pertussis
gccaugcccaggcccag

SEQ ID NO: 2465744 - RNA, 16 nt, Bordetella pertussis
gccaugccccauccag

SEQ ID NO: 2465745 - RNA, 17 nt, Bordetella pertussis
gccaugccccauccagc

SEQ ID NO: 2465746 - RNA, 21 nt, Bordetella pertussis
gccaugccccauccagcggac

SEQ ID NO: 2465747 - RNA, 13 nt, Bordetella pertussis
gccaugccgcgcc

SEQ ID NO: 2465748 - RNA, 14 nt, Bordetella pertussis
gccaugccgcgccc

SEQ ID NO: 2465749 - RNA, 16 nt, Bordetella pertussis
gccaugccgcgcccgc

SEQ ID NO: 2465750 - RNA, 19 nt, Bordetella pertussis
gccaugccgcgcccgccuu

SEQ ID NO: 2465751 - RNA, 16 nt, Bordetella pertussis
gccaugccgcgcgccu

SEQ ID NO: 2465752 - RNA, 13 nt, Bordetella pertussis
gauuccgcuggcg

SEQ ID NO: 2465753 - RNA, 21 nt, Bordetella pertussis
gauuccugcgaggacaggggc

SEQ ID NO: 2465754 - RNA, 13 nt, Bordetella pertussis
gauuccugggugc

SEQ ID NO: 2465755 - RNA, 21 nt, Bordetella pertussis
gauuccugucgcgcugcuuuc

SEQ ID NO: 2465756 - RNA, 14 nt, Bordetella pertussis
gauucgauugccug

SEQ ID NO: 2465757 - RNA, 22 nt, Bordetella pertussis
gauucgcggugcaagcggccgg

SEQ ID NO: 2465758 - RNA, 19 nt, Bordetella pertussis
gauucggagucgugcagga

SEQ ID NO: 2465759 - RNA, 13 nt, Bordetella pertussis
gauucggucgcca

SEQ ID NO: 2465760 - RNA, 21 nt, Bordetella pertussis
gauucugcugcaugccggacg

SEQ ID NO: 2465761 - RNA, 14 nt, Bordetella pertussis
gauugaacugcugg

SEQ ID NO: 2465762 - RNA, 18 nt, Bordetella pertussis
gcaacgccggccauggcg

SEQ ID NO: 2465763 - RNA, 24 nt, Bordetella pertussis
gcaacgccggccauggcggccggc

SEQ ID NO: 2465764 - RNA, 17 nt, Bordetella pertussis
gcaacgccggccgccau

SEQ ID NO: 2465765 - RNA, 18 nt, Bordetella pertussis
gcaacgccggccgccaug

SEQ ID NO: 2465766 - RNA, 21 nt, Bordetella pertussis
gcaacgccggccgccauggcc

SEQ ID NO: 2465767 - RNA, 15 nt, Bordetella pertussis
gcaacgcgccgcugu

SEQ ID NO: 2465768 - RNA, 13 nt, Bordetella pertussis
gcaacgggccggc

SEQ ID NO: 2465769 - RNA, 18 nt, Bordetella pertussis
gcaacgggucgcgcagca

SEQ ID NO: 2465770 - RNA, 15 nt, Bordetella pertussis
gcaacgugcgcacgc

SEQ ID NO: 2465771 - RNA, 14 nt, Bordetella pertussis
gcaacguggugcuc

SEQ ID NO: 2465772 - RNA, 14 nt, Bordetella pertussis
gcaacuccagcaua

SEQ ID NO: 2465773 - RNA, 14 nt, Bordetella pertussis
gcaagaagauccgc

SEQ ID NO: 2465774 - RNA, 20 nt, Bordetella pertussis
gcaagaaucgacucggccga

SEQ ID NO: 2465775 - RNA, 14 nt, Bordetella pertussis
gcaagacgcccagg

SEQ ID NO: 2465776 - RNA, 18 nt, Bordetella pertussis
gcaagacgcccaggccca

SEQ ID NO: 2465777 - RNA, 13 nt, Bordetella pertussis
gcaagacgcggca

SEQ ID NO: 2465778 - RNA, 21 nt, Bordetella pertussis
gcaagacggcguuucuacugg

SEQ ID NO: 2465779 - RNA, 12 nt, Bordetella pertussis
gcaagagccugg

SEQ ID NO: 2465780 - RNA, 16 nt, Bordetella pertussis
gcaagauuucauggcg

SEQ ID NO: 2465781 - RNA, 17 nt, Bordetella pertussis
gcaagauuucauggcgu

SEQ ID NO: 2465782 - RNA, 17 nt, Bordetella pertussis
gcaagcaagccccaggc

SEQ ID NO: 2465783 - RNA, 15 nt, Bordetella pertussis
gcaagcaccgccugc

SEQ ID NO: 2465784 - RNA, 14 nt, Bordetella pertussis
gcaagcagccggaa

SEQ ID NO: 2465785 - RNA, 12 nt, Bordetella pertussis
gcaagccagcac

SEQ ID NO: 2465786 - RNA, 13 nt, Bordetella pertussis
gcaagccagggca

SEQ ID NO: 2465787 - RNA, 19 nt, Bordetella pertussis
gcaagccagggcaggaggc

SEQ ID NO: 2465788 - RNA, 15 nt, Bordetella pertussis
gcaagcccaccgggc

SEQ ID NO: 2465789 - RNA, 18 nt, Bordetella pertussis
gcaagcccaccgggccgg

SEQ ID NO: 2465790 - RNA, 13 nt, Bordetella pertussis
gcaagcccaggcg

SEQ ID NO: 2465791 - RNA, 19 nt, Bordetella pertussis
gcaagcccaggcggcccag

SEQ ID NO: 2465792 - RNA, 12 nt, Bordetella pertussis
gcaagccccagg

SEQ ID NO: 2465793 - RNA, 21 nt, Bordetella pertussis
gcaagccccaggcaggcgggc

SEQ ID NO: 2465794 - RNA, 15 nt, Bordetella pertussis
gcaagcccggcacgg

SEQ ID NO: 2465795 - RNA, 22 nt, Bordetella pertussis
gcaagccgcccggccggcacgg

SEQ ID NO: 2465796 - RNA, 12 nt, Bordetella pertussis
gcaagccgccgc

SEQ ID NO: 2465797 - RNA, 19 nt, Bordetella pertussis
gcaagccgccgcccucgcc

SEQ ID NO: 2465798 - RNA, 13 nt, Bordetella pertussis
gcaagccggccgc

SEQ ID NO: 2465799 - RNA, 19 nt, Bordetella pertussis
gcaagccggccgcgccgcg

SEQ ID NO: 2465800 - RNA, 19 nt, Bordetella pertussis
gcaagccggccgcgcggcc

SEQ ID NO: 2465801 - RNA, 22 nt, Bordetella pertussis
gcaagccggcggucccgagcgc

SEQ ID NO: 2465802 - RNA, 13 nt, Bordetella pertussis
gcaagccuugcgg

SEQ ID NO: 2465803 - RNA, 14 nt, Bordetella pertussis
gcaagcgcgccgac

SEQ ID NO: 2465804 - RNA, 15 nt, Bordetella pertussis
gcaagcgcgccgaca

SEQ ID NO: 2465805 - RNA, 20 nt, Bordetella pertussis
gcaagcgcgucgauggaguc

SEQ ID NO: 2465806 - RNA, 17 nt, Bordetella pertussis
gcaagcgcucgccggcg

SEQ ID NO: 2465807 - RNA, 17 nt, Bordetella pertussis
gcaagcgcuggaugguc

SEQ ID NO: 2465808 - RNA, 16 nt, Bordetella pertussis
gcaagcggccccaguc

SEQ ID NO: 2465809 - RNA, 14 nt, Bordetella pertussis
gcaagcggccggcc

SEQ ID NO: 2465810 - RNA, 15 nt, Bordetella pertussis
gcaagcggccggccu

SEQ ID NO: 2465811 - RNA, 21 nt, Bordetella pertussis
gcaagcggcguggggccggcc

SEQ ID NO: 2465812 - RNA, 16 nt, Bordetella pertussis
gcaagcugcugcugga

SEQ ID NO: 2465813 - RNA, 22 nt, Bordetella pertussis
gcaagcugcugcuggaccuggc

SEQ ID NO: 2465814 - RNA, 17 nt, Bordetella pertussis
gcaagcugcuggcgcgc

SEQ ID NO: 2465815 - RNA, 19 nt, Bordetella pertussis
gcaagcugcuggcgcgcca

SEQ ID NO: 2465816 - RNA, 16 nt, Bordetella pertussis
gcaagcuggccgaugu

SEQ ID NO: 2465817 - RNA, 19 nt, Bordetella pertussis
gcaagcuggccgaugucgc

SEQ ID NO: 2465818 - RNA, 18 nt, Bordetella pertussis
gcaaggaaguggccgagc

SEQ ID NO: 2465819 - RNA, 12 nt, Bordetella pertussis
gcaaggacaagg

SEQ ID NO: 2465820 - RNA, 15 nt, Bordetella pertussis
gcaaggacaaggcgc

SEQ ID NO: 2465821 - RNA, 18 nt, Bordetella pertussis
gcaaggaccaugcgcugg

SEQ ID NO: 2465822 - RNA, 21 nt, Bordetella pertussis
gcaaggaccaugcgcugggca

SEQ ID NO: 2465823 - RNA, 23 nt, Bordetella pertussis
gcaaggacgcguccucggccagc

SEQ ID NO: 2465824 - RNA, 17 nt, Bordetella pertussis
gcaaggcaugcgccagc

SEQ ID NO: 2465825 - RNA, 16 nt, Bordetella pertussis
gcaaggcccgccgcgg

SEQ ID NO: 2465826 - RNA, 19 nt, Bordetella pertussis
gcaaggcccgccgcggcag

SEQ ID NO: 2465827 - RNA, 16 nt, Bordetella pertussis
gcaaggccgcgaacgc

SEQ ID NO: 2465828 - RNA, 22 nt, Bordetella pertussis
gcaaggccgcgaacgcgccggc

SEQ ID NO: 2465829 - RNA, 14 nt, Bordetella pertussis
gcaaggccggcggc

SEQ ID NO: 2465830 - RNA, 16 nt, Bordetella pertussis
gcaaggccggcggcac

SEQ ID NO: 2465831 - RNA, 17 nt, Bordetella pertussis
gcaaggccugccaaaga

SEQ ID NO: 2465832 - RNA, 22 nt, Bordetella pertussis
gcaaggcgcgccaccggucgcc

SEQ ID NO: 2465833 - RNA, 18 nt, Bordetella pertussis
gcaaggcggcaaacccgg

SEQ ID NO: 2465834 - RNA, 19 nt, Bordetella pertussis
gcaaggcggcaaacccggc

SEQ ID NO: 2465835 - RNA, 12 nt, Bordetella pertussis
gcaaggcgggcu

SEQ ID NO: 2465836 - RNA, 13 nt, Bordetella pertussis
gcaaggcgggcug

SEQ ID NO: 2465837 - RNA, 20 nt, Bordetella pertussis
gcaaggcgggcuggucgcgc

SEQ ID NO: 2465838 - RNA, 22 nt, Bordetella pertussis
gcaaggcgggcuggucgcgccg

SEQ ID NO: 2465839 - RNA, 18 nt, Bordetella pertussis
gcaaggcgucggccaggc

SEQ ID NO: 2465840 - RNA, 19 nt, Bordetella pertussis
gcaaggcgucggccaggcc

SEQ ID NO: 2465841 - RNA, 22 nt, Bordetella pertussis
gcaaggcgucgggcacguccgg

SEQ ID NO: 2465842 - RNA, 14 nt, Bordetella pertussis
gcaagggagaccgg

SEQ ID NO: 2465843 - RNA, 12 nt, Bordetella pertussis
gcaagggccagu

SEQ ID NO: 2465844 - RNA, 20 nt, Bordetella pertussis
gcaagggccagucguucagc

SEQ ID NO: 2465845 - RNA, 14 nt, Bordetella pertussis
gcaagggccccagc

SEQ ID NO: 2465846 - RNA, 18 nt, Bordetella pertussis
gcaagggccccagcaucu

SEQ ID NO: 2465847 - RNA, 22 nt, Bordetella pertussis
gcaagggcgucuucgccgacca

SEQ ID NO: 2465848 - RNA, 17 nt, Bordetella pertussis
gcaaggggccagccugg

SEQ ID NO: 2465849 - RNA, 19 nt, Bordetella pertussis
gcaaggggccagccuggcg

SEQ ID NO: 2465850 - RNA, 15 nt, Bordetella pertussis
gcaagggggacuggc

SEQ ID NO: 2465851 - RNA, 22 nt, Bordetella pertussis
gcaagggguccguggcggccgc

SEQ ID NO: 2465852 - RNA, 19 nt, Bordetella pertussis
gcaagggugccuguccccg

SEQ ID NO: 2465853 - RNA, 22 nt, Bordetella pertussis
gcaagggugccuguccccgcgg

SEQ ID NO: 2465854 - RNA, 22 nt, Bordetella pertussis
gcaagguagccgaugaccggcc

SEQ ID NO: 2465855 - RNA, 21 nt, Bordetella pertussis
gcaagguggcgugcagcaggu

SEQ ID NO: 2465856 - RNA, 17 nt, Bordetella pertussis
gcaaguccagcguggug

SEQ ID NO: 2465857 - RNA, 17 nt, Bordetella pertussis
gcaagucuucuucagca

SEQ ID NO: 2465858 - RNA, 18 nt, Bordetella pertussis
gcaagucuucuucagcau

SEQ ID NO: 2465859 - RNA, 21 nt, Bordetella pertussis
gcaagucuucuucagcaugga

SEQ ID NO: 2465860 - RNA, 20 nt, Bordetella pertussis
gcaagugcuggcccgccagc

SEQ ID NO: 2465861 - RNA, 15 nt, Bordetella pertussis
gcaaguguggcgcac

SEQ ID NO: 2465862 - RNA, 16 nt, Bordetella pertussis
gcaaguguggcgcacc

SEQ ID NO: 2465863 - RNA, 17 nt, Bordetella pertussis
gcaaguguggcgcaccg

SEQ ID NO: 2465864 - RNA, 23 nt, Bordetella pertussis
gcaaguguggcgcaccgcgcugg

SEQ ID NO: 2465865 - RNA, 15 nt, Bordetella pertussis
gcaaguucaucaucg

SEQ ID NO: 2465866 - RNA, 17 nt, Bordetella pertussis
gcaaguucaucaucgcc

SEQ ID NO: 2465867 - RNA, 19 nt, Bordetella pertussis
gcaaguucaucaucgccga

SEQ ID NO: 2465868 - RNA, 20 nt, Bordetella pertussis
gcaaguucaucaucgccgac

SEQ ID NO: 2465869 - RNA, 19 nt, Bordetella pertussis
gcaaguucgcugccgggau

SEQ ID NO: 2465870 - RNA, 14 nt, Bordetella pertussis
gcaauaccuucagc

SEQ ID NO: 2465871 - RNA, 15 nt, Bordetella pertussis
gcaauacgugcgcga

SEQ ID NO: 2465872 - RNA, 14 nt, Bordetella pertussis
gcaauaggccgcga

SEQ ID NO: 2465873 - RNA, 23 nt, Bordetella pertussis
gcaauccccgcuuccugcugcgc

SEQ ID NO: 2465874 - RNA, 23 nt, Bordetella pertussis
gcaaucccggcgacaccgcggcc

SEQ ID NO: 2465875 - RNA, 15 nt, Bordetella pertussis
gcacgauggccgcgc

SEQ ID NO: 2465876 - RNA, 13 nt, Bordetella pertussis
gcacgauggcgcc

SEQ ID NO: 2465877 - RNA, 15 nt, Bordetella pertussis
gcacgauggcgccca

SEQ ID NO: 2465878 - RNA, 22 nt, Bordetella pertussis
gcacgauggcgcccacggccug

SEQ ID NO: 2465879 - RNA, 15 nt, Bordetella pertussis
gcacgauggcgccgg

SEQ ID NO: 2465880 - RNA, 16 nt, Bordetella pertussis
gcacgauggcgccggc

SEQ ID NO: 2465881 - RNA, 18 nt, Bordetella pertussis
gcacgauggcgcgcgaac

SEQ ID NO: 2465882 - RNA, 19 nt, Bordetella pertussis
gcacgauggggcagccauc

SEQ ID NO: 2465883 - RNA, 14 nt, Bordetella pertussis
gcacgauggggcca

SEQ ID NO: 2465884 - RNA, 24 nt, Bordetella pertussis
gcacgauggggccgucgccgaucg

SEQ ID NO: 2465885 - RNA, 21 nt, Bordetella pertussis
gcacgaugguaucggccgggc

SEQ ID NO: 2465886 - RNA, 22 nt, Bordetella pertussis
gcacgaugguaucggccgggcc

SEQ ID NO: 2465887 - RNA, 15 nt, Bordetella pertussis
gcacgauggucagcg

SEQ ID NO: 2465888 - RNA, 17 nt, Bordetella pertussis
gcacgaugguguucagg

SEQ ID NO: 2465889 - RNA, 13 nt, Bordetella pertussis
gcacgauguugcc

SEQ ID NO: 2465890 - RNA, 21 nt, Bordetella pertussis
gcacgauguugccgccggcca

SEQ ID NO: 2465891 - RNA, 16 nt, Bordetella pertussis
gcacgauuucacccag

SEQ ID NO: 2465892 - RNA, 21 nt, Bordetella pertussis
gcacgauuucacccagggugu

SEQ ID NO: 2465893 - RNA, 20 nt, Bordetella pertussis
gcacgauuuccgcuaccagg

SEQ ID NO: 2465894 - RNA, 13 nt, Bordetella pertussis
gcacgcacagcau

SEQ ID NO: 2465895 - RNA, 15 nt, Bordetella pertussis
gcacgcacagcaugc

SEQ ID NO: 2465896 - RNA, 24 nt, Bordetella pertussis
gcacgcacagcaugcgcuggucgc

SEQ ID NO: 2465897 - RNA, 14 nt, Bordetella pertussis
gcacgcaccaggcg

SEQ ID NO: 2465898 - RNA, 15 nt, Bordetella pertussis
gcacgcaccaggcgc

SEQ ID NO: 2465899 - RNA, 17 nt, Bordetella pertussis
gcacgcaccaggcgcac

SEQ ID NO: 2465900 - RNA, 23 nt, Bordetella pertussis
gcacgcaccaggcgcacggcggc

SEQ ID NO: 2465901 - RNA, 16 nt, Bordetella pertussis
gcacgcaccgcgccag

SEQ ID NO: 2465902 - RNA, 18 nt, Bordetella pertussis
gcacgcaccgcgccagcg

SEQ ID NO: 2465903 - RNA, 23 nt, Bordetella pertussis
gcacgcacgguacgccgaacaag

SEQ ID NO: 2465904 - RNA, 18 nt, Bordetella pertussis
gcacgcacugagcuucgc

SEQ ID NO: 2465905 - RNA, 13 nt, Bordetella pertussis
gcacgcagcgcag

SEQ ID NO: 2465906 - RNA, 15 nt, Bordetella pertussis
gcacgcagcgcucau

SEQ ID NO: 2465907 - RNA, 23 nt, Bordetella pertussis
gcacgcaggauaccggagcggcu

SEQ ID NO: 2465908 - RNA, 12 nt, Bordetella pertussis
gcacgccauggu

SEQ ID NO: 2465909 - RNA, 20 nt, Bordetella pertussis
gcacgcccagacuggcguag

SEQ ID NO: 2465910 - RNA, 16 nt, Bordetella pertussis
gcacgcccagccgcag

SEQ ID NO: 2465911 - RNA, 18 nt, Bordetella pertussis
gcacgcccagccgcagca

SEQ ID NO: 2465912 - RNA, 22 nt, Bordetella pertussis
gcacgcccagccgcagcaggcg

SEQ ID NO: 2465913 - RNA, 23 nt, Bordetella pertussis
gcacgcccagccgcagcaggcgc

SEQ ID NO: 2465914 - RNA, 22 nt, Bordetella pertussis
gcacgcccauggucaggacgac

SEQ ID NO: 2465915 - RNA, 23 nt, Bordetella pertussis
gcacgcccauggucaggacgacg

SEQ ID NO: 2465916 - RNA, 13 nt, Bordetella pertussis
gcacgcccgccag

SEQ ID NO: 2465917 - RNA, 14 nt, Bordetella pertussis
gcacgcccgccagc

SEQ ID NO: 2465918 - RNA, 15 nt, Bordetella pertussis
gcacgcccgccagca

SEQ ID NO: 2465919 - RNA, 18 nt, Bordetella pertussis
gcacgcccgccagcagcu

SEQ ID NO: 2465920 - RNA, 14 nt, Bordetella pertussis
gcacgcccgccugc

SEQ ID NO: 2465921 - RNA, 18 nt, Bordetella pertussis
gcacgcccgccugcagca

SEQ ID NO: 2465922 - RNA, 16 nt, Bordetella pertussis
gcacgcccgcggcgcc

SEQ ID NO: 2465923 - RNA, 18 nt, Bordetella pertussis
gcacgcccgcggcgccca

SEQ ID NO: 2465924 - RNA, 15 nt, Bordetella pertussis
gcacgccgaccuggc

SEQ ID NO: 2465925 - RNA, 18 nt, Bordetella pertussis
gcacgccgaccuggcgcc

SEQ ID NO: 2465926 - RNA, 21 nt, Bordetella pertussis
gcacgccgaccuggcgcccga

SEQ ID NO: 2465927 - RNA, 22 nt, Bordetella pertussis
gcacgccgauguccacgaaggc

SEQ ID NO: 2465928 - RNA, 13 nt, Bordetella pertussis
gcacgccgcgccg

SEQ ID NO: 2465929 - RNA, 14 nt, Bordetella pertussis
gcacgccgcgcucg

SEQ ID NO: 2465930 - RNA, 19 nt, Bordetella pertussis
gcacgccgcgcucguugcg

SEQ ID NO: 2465931 - RNA, 13 nt, Bordetella pertussis
gcacgccggacca

SEQ ID NO: 2465932 - RNA, 14 nt, Bordetella pertussis
gcacgccggccagg

SEQ ID NO: 2465933 - RNA, 14 nt, Bordetella pertussis
gcacgccggccugc

SEQ ID NO: 2465934 - RNA, 13 nt, Bordetella pertussis
gcacgccggcggc

SEQ ID NO: 2465935 - RNA, 15 nt, Bordetella pertussis
gcacgccggcggccc

SEQ ID NO: 2465936 - RNA, 15 nt, Bordetella pertussis
gcacgccggcggcgc

SEQ ID NO: 2465937 - RNA, 14 nt, Bordetella pertussis
gcacgccggcgggc

SEQ ID NO: 2465938 - RNA, 16 nt, Bordetella pertussis
gcacgccggcgggcag

SEQ ID NO: 2465939 - RNA, 15 nt, Bordetella pertussis
gcacgccgggcgcgc

SEQ ID NO: 2465940 - RNA, 18 nt, Bordetella pertussis
gcacgccgggcgcgcugc

SEQ ID NO: 2465941 - RNA, 19 nt, Bordetella pertussis
gcacgccgggcgcgcugcc

SEQ ID NO: 2465942 - RNA, 21 nt, Bordetella pertussis
gcacgccgggcgcgcugccca

SEQ ID NO: 2465943 - RNA, 18 nt, Bordetella pertussis
gcacgccggucgccagcg

SEQ ID NO: 2465944 - RNA, 15 nt, Bordetella pertussis
gcacgccucgccggc

SEQ ID NO: 2465945 - RNA, 16 nt, Bordetella pertussis
gcacgccucgccggcc

SEQ ID NO: 2465946 - RNA, 17 nt, Bordetella pertussis
gcacgccugccgcgccc

SEQ ID NO: 2465947 - RNA, 18 nt, Bordetella pertussis
gcacgccugccgcgcccg

SEQ ID NO: 2465948 - RNA, 21 nt, Bordetella pertussis
gcacgccugccgcgcccggcg

SEQ ID NO: 2465949 - RNA, 20 nt, Bordetella pertussis
gcacgccuugcucgaccagg

SEQ ID NO: 2465950 - RNA, 21 nt, Bordetella pertussis
gcacgccuugcucgaccaggu

SEQ ID NO: 2465951 - RNA, 14 nt, Bordetella pertussis
gcacgcgcaccagg

SEQ ID NO: 2465952 - RNA, 15 nt, Bordetella pertussis
gcacgcgcaccaggc

SEQ ID NO: 2465953 - RNA, 16 nt, Bordetella pertussis
gcacgcgcaccaggcc

SEQ ID NO: 2465954 - RNA, 19 nt, Bordetella pertussis
gcacgcgcaccaggccugc

SEQ ID NO: 2465955 - RNA, 18 nt, Bordetella pertussis
gcacgcgcagcacgcugc

SEQ ID NO: 2465956 - RNA, 18 nt, Bordetella pertussis
gcacgcgcagcuugcccg

SEQ ID NO: 2465957 - RNA, 13 nt, Bordetella pertussis
gcacgcgccaggc

SEQ ID NO: 2465958 - RNA, 14 nt, Bordetella pertussis
gcacgcgccaggcg

SEQ ID NO: 2465959 - RNA, 13 nt, Bordetella pertussis
gcacgcgcgccag

SEQ ID NO: 2465960 - RNA, 14 nt, Bordetella pertussis
gcacgcgcgccagc

SEQ ID NO: 2465961 - RNA, 14 nt, Bordetella pertussis
gcacgcgcgccggc

SEQ ID NO: 2465962 - RNA, 14 nt, Bordetella pertussis
gcacgcgcgcggcg

SEQ ID NO: 2465963 - RNA, 17 nt, Bordetella pertussis
gcacgcgcgcggcgcgg

SEQ ID NO: 2465964 - RNA, 18 nt, Bordetella pertussis
gcacgcgcgcggcgcggc

SEQ ID NO: 2465965 - RNA, 19 nt, Bordetella pertussis
gcacgcgcgcggcgcggcu

SEQ ID NO: 2465966 - RNA, 15 nt, Bordetella pertussis
gcacgcgcgcgggcg

SEQ ID NO: 2465967 - RNA, 13 nt, Bordetella pertussis
gcacgcgcgcgug

SEQ ID NO: 2465968 - RNA, 15 nt, Bordetella pertussis
gcacgcgcgcgugca

SEQ ID NO: 2465969 - RNA, 12 nt, Bordetella pertussis
gcacgcgcggca

SEQ ID NO: 2465970 - RNA, 16 nt, Bordetella pertussis
gcacgcgcggcagcgc

SEQ ID NO: 2465971 - RNA, 18 nt, Bordetella pertussis
gcacgcgcucgggcagcu

SEQ ID NO: 2465972 - RNA, 22 nt, Bordetella pertussis
gcacgcgcugaauccggggugc

SEQ ID NO: 2465973 - RNA, 15 nt, Bordetella pertussis
gcacgcgcuugaggc

SEQ ID NO: 2465974 - RNA, 14 nt, Bordetella pertussis
gcacgcggccgcgc

SEQ ID NO: 2465975 - RNA, 15 nt, Bordetella pertussis
gcacgcggccgcgca

SEQ ID NO: 2465976 - RNA, 22 nt, Bordetella pertussis
gcacgcggccgcgggccgcugg

SEQ ID NO: 2465977 - RNA, 14 nt, Bordetella pertussis
gcacgcggcgcagc

SEQ ID NO: 2465978 - RNA, 17 nt, Bordetella pertussis
gcacgcggcgcagcauc

SEQ ID NO: 2465979 - RNA, 21 nt, Bordetella pertussis
gcacguggaugaugcgcgagc

SEQ ID NO: 2465980 - RNA, 16 nt, Bordetella pertussis
gcacgugggcacgccg

SEQ ID NO: 2465981 - RNA, 19 nt, Bordetella pertussis
gcacgugggcacgccggcc

SEQ ID NO: 2465982 - RNA, 21 nt, Bordetella pertussis
gcacguugucgagcaggccgc

SEQ ID NO: 2465983 - RNA, 22 nt, Bordetella pertussis
gcacuaccugcgcuaugggggc

SEQ ID NO: 2465984 - RNA, 19 nt, Bordetella pertussis
gcacucccgaaaaccgcuc

SEQ ID NO: 2465985 - RNA, 17 nt, Bordetella pertussis
gcacuccggauaccgcc

SEQ ID NO: 2465986 - RNA, 19 nt, Bordetella pertussis
gcacuccguaaagaugcgc

SEQ ID NO: 2465987 - RNA, 23 nt, Bordetella pertussis
gcacuccguaaagaugcgcgccg

SEQ ID NO: 2465988 - RNA, 16 nt, Bordetella pertussis
gcacuccgucauggcg

SEQ ID NO: 2465989 - RNA, 16 nt, Bordetella pertussis
gcacucuugccgcugc

SEQ ID NO: 2465990 - RNA, 19 nt, Bordetella pertussis
gcacucuugccgcugcgcg

SEQ ID NO: 2465991 - RNA, 14 nt, Bordetella pertussis
gcacugaucgccgc

SEQ ID NO: 2465992 - RNA, 16 nt, Bordetella pertussis
gcacugaucgccgccu

SEQ ID NO: 2465993 - RNA, 14 nt, Bordetella pertussis
gcagcauggcgggc

SEQ ID NO: 2465994 - RNA, 15 nt, Bordetella pertussis
gcagcauggcgggcg

SEQ ID NO: 2465995 - RNA, 14 nt, Bordetella pertussis
gcagcaugugcucg

SEQ ID NO: 2465996 - RNA, 16 nt, Bordetella pertussis
gcagcaugugcucggg

SEQ ID NO: 2465997 - RNA, 22 nt, Bordetella pertussis
gcagcaugugcucgggacgcag

SEQ ID NO: 2465998 - RNA, 19 nt, Bordetella pertussis
gcagcauucuggugcagcg

SEQ ID NO: 2465999 - RNA, 21 nt, Bordetella pertussis
gcagcauucuggugcagcggc

SEQ ID NO: 2466000 - RNA, 17 nt, Bordetella pertussis
gcagcauuucgaugcgc

SEQ ID NO: 2466001 - RNA, 18 nt, Bordetella pertussis
gcagcauuucgaugcgca

SEQ ID NO: 2466002 - RNA, 21 nt, Bordetella pertussis
gcagcauuucgaugcgcacca

SEQ ID NO: 2466003 - RNA, 15 nt, Bordetella pertussis
gcagcauuucggcgc

SEQ ID NO: 2466004 - RNA, 23 nt, Bordetella pertussis
gcagcauuucggcgccgccggcc

SEQ ID NO: 2466005 - RNA, 13 nt, Bordetella pertussis
gcagccacaggcc

SEQ ID NO: 2466006 - RNA, 17 nt, Bordetella pertussis
gcagccacaggcccaug

SEQ ID NO: 2466007 - RNA, 23 nt, Bordetella pertussis
gcagccacaggcccaugccgcgg

SEQ ID NO: 2466008 - RNA, 23 nt, Bordetella pertussis
gcagccacgggauguccgcgucg

SEQ ID NO: 2466009 - RNA, 17 nt, Bordetella pertussis
gcagccacugcgucacg

SEQ ID NO: 2466010 - RNA, 18 nt, Bordetella pertussis
gcagccacuggaacagcu

SEQ ID NO: 2466011 - RNA, 23 nt, Bordetella pertussis
gcagccacuggaacagcuugggc

SEQ ID NO: 2466012 - RNA, 17 nt, Bordetella pertussis
gcagccagaacaugagc

SEQ ID NO: 2466013 - RNA, 21 nt, Bordetella pertussis
gcagccagaacaugagccaug

SEQ ID NO: 2466014 - RNA, 20 nt, Bordetella pertussis
gcagccagguaagcuggcgc

SEQ ID NO: 2466015 - RNA, 21 nt, Bordetella pertussis
gcagccagguaagcuggcgcu

SEQ ID NO: 2466016 - RNA, 15 nt, Bordetella pertussis
gcagccagguggcga

SEQ ID NO: 2466017 - RNA, 14 nt, Bordetella pertussis
gcagccaguugggc

SEQ ID NO: 2466018 - RNA, 20 nt, Bordetella pertussis
gcagccaguugggccagggc

SEQ ID NO: 2466019 - RNA, 21 nt, Bordetella pertussis
gcagccaguugggccagggcc

SEQ ID NO: 2466020 - RNA, 22 nt, Bordetella pertussis
gcagccauccucgcccagcggc

SEQ ID NO: 2466021 - RNA, 23 nt, Bordetella pertussis
gcagccauccucgcccagcggcg

SEQ ID NO: 2466022 - RNA, 15 nt, Bordetella pertussis
gcagccauucggcca

SEQ ID NO: 2466023 - RNA, 17 nt, Bordetella pertussis
gcagccauucggccagg

SEQ ID NO: 2466024 - RNA, 17 nt, Bordetella pertussis
gcagcccacucagggcg

SEQ ID NO: 2466025 - RNA, 17 nt, Bordetella pertussis
gcagccccagcgcccag

SEQ ID NO: 2466026 - RNA, 21 nt, Bordetella pertussis
gcagccccagcgcccaggcga

SEQ ID NO: 2466027 - RNA, 21 nt, Bordetella pertussis
gcagccccagcguccaggcgg

SEQ ID NO: 2466028 - RNA, 17 nt, Bordetella pertussis
gcagccccgggugcagg

SEQ ID NO: 2466029 - RNA, 14 nt, Bordetella pertussis
gcagcccgcgcgcc

SEQ ID NO: 2466030 - RNA, 15 nt, Bordetella pertussis
gcagcccgcgcgccu

SEQ ID NO: 2466031 - RNA, 16 nt, Bordetella pertussis
gcagcccgcgcgccug

SEQ ID NO: 2466032 - RNA, 18 nt, Bordetella pertussis
gcagcccgcgcgccugca

SEQ ID NO: 2466033 - RNA, 22 nt, Bordetella pertussis
gcagcccgcgcgccugcauguc

SEQ ID NO: 2466034 - RNA, 13 nt, Bordetella pertussis
gcagcccggcacg

SEQ ID NO: 2466035 - RNA, 12 nt, Bordetella pertussis
gcagcccggcgu

SEQ ID NO: 2466036 - RNA, 18 nt, Bordetella pertussis
gcagcccggcgugcccag

SEQ ID NO: 2466037 - RNA, 21 nt, Bordetella pertussis
gcagcccggcgugcccagggc

SEQ ID NO: 2466038 - RNA, 22 nt, Bordetella pertussis
gcagcccggcgugcccagggcc

SEQ ID NO: 2466039 - RNA, 15 nt, Bordetella pertussis
gcagccgacaggcgc

SEQ ID NO: 2466040 - RNA, 21 nt, Bordetella pertussis
gcagccgacaggcgcgcaggc

SEQ ID NO: 2466041 - RNA, 22 nt, Bordetella pertussis
gcagccgacaggcgcgcaggcg

SEQ ID NO: 2466042 - RNA, 15 nt, Bordetella pertussis
gcagccgcaccagcg

SEQ ID NO: 2466043 - RNA, 16 nt, Bordetella pertussis
gcagccgcaccagcgc

SEQ ID NO: 2466044 - RNA, 14 nt, Bordetella pertussis
gcagccgccgcagg

SEQ ID NO: 2466045 - RNA, 15 nt, Bordetella pertussis
gcagccgccgcaggc

SEQ ID NO: 2466046 - RNA, 13 nt, Bordetella pertussis
gcagccgccgcga

SEQ ID NO: 2466047 - RNA, 13 nt, Bordetella pertussis
gcagccgcgccaa

SEQ ID NO: 2466048 - RNA, 14 nt, Bordetella pertussis
gcagccgcgccaag

SEQ ID NO: 2466049 - RNA, 14 nt, Bordetella pertussis
gcagccgcgcgccu

SEQ ID NO: 2466050 - RNA, 14 nt, Bordetella pertussis
gcagccgcgcggcc

SEQ ID NO: 2466051 - RNA, 15 nt, Bordetella pertussis
gcagccgcgcggccg

SEQ ID NO: 2466052 - RNA, 18 nt, Bordetella pertussis
gcagccgcgcggccgggc

SEQ ID NO: 2466053 - RNA, 15 nt, Bordetella pertussis
gcagccgcuccagcc

SEQ ID NO: 2466054 - RNA, 19 nt, Bordetella pertussis
gcagccgcuccagccacca

SEQ ID NO: 2466055 - RNA, 20 nt, Bordetella pertussis
gcagccgcuccagccaccac

SEQ ID NO: 2466056 - RNA, 20 nt, Bordetella pertussis
gcagccggccaaggcaagca

SEQ ID NO: 2466057 - RNA, 15 nt, Bordetella pertussis
gcagccggccauggc

SEQ ID NO: 2466058 - RNA, 20 nt, Bordetella pertussis
gcagccggccauggccgcca

SEQ ID NO: 2466059 - RNA, 22 nt, Bordetella pertussis
gcagccggccccgcaaggggcc

SEQ ID NO: 2466060 - RNA, 12 nt, Bordetella pertussis
gcagccggccgg

SEQ ID NO: 2466061 - RNA, 15 nt, Bordetella pertussis
gcagccggcugcaag

SEQ ID NO: 2466062 - RNA, 18 nt, Bordetella pertussis
gcagccgguuggcgccuu

SEQ ID NO: 2466063 - RNA, 18 nt, Bordetella pertussis
gcagccguugaucugguu

SEQ ID NO: 2466064 - RNA, 17 nt, Bordetella pertussis
gcagccuucguccugcc

SEQ ID NO: 2466065 - RNA, 16 nt, Bordetella pertussis
gcagccuuggucagcg

SEQ ID NO: 2466066 - RNA, 19 nt, Bordetella pertussis
gcagcgaauacggcaagca

SEQ ID NO: 2466067 - RNA, 18 nt, Bordetella pertussis
gcagcgacaacaggucgu

SEQ ID NO: 2466068 - RNA, 15 nt, Bordetella pertussis
gcagcgaccgcggcg

SEQ ID NO: 2466069 - RNA, 15 nt, Bordetella pertussis
gcagcgacggcccca

SEQ ID NO: 2466070 - RNA, 20 nt, Bordetella pertussis
gcagcgacuugucgcgcccg

SEQ ID NO: 2466071 - RNA, 24 nt, Bordetella pertussis
gcagcgacuugucgcgcccgaagc

SEQ ID NO: 2466072 - RNA, 23 nt, Bordetella pertussis
gcagcgagaacagccacacgcug

SEQ ID NO: 2466073 - RNA, 14 nt, Bordetella pertussis
gcagcgagagcgcc

SEQ ID NO: 2466074 - RNA, 15 nt, Bordetella pertussis
gcagcgagagcgcca

SEQ ID NO: 2466075 - RNA, 18 nt, Bordetella pertussis
gcagcgagagcgccacgc

SEQ ID NO: 2466076 - RNA, 19 nt, Bordetella pertussis
gcagcgagagcgccacgcc

SEQ ID NO: 2466077 - RNA, 13 nt, Bordetella pertussis
gcagcgagcccgc

SEQ ID NO: 2466078 - RNA, 13 nt, Bordetella pertussis
gcagcgaggccuc

SEQ ID NO: 2466079 - RNA, 21 nt, Bordetella pertussis
gcagcgaggccucgugcugcu

SEQ ID NO: 2466080 - RNA, 22 nt, Bordetella pertussis
gcagcgaggccucgugcugcug

SEQ ID NO: 2466081 - RNA, 13 nt, Bordetella pertussis
gcagcgaggcgca

SEQ ID NO: 2466082 - RNA, 14 nt, Bordetella pertussis
gcagcgaggcgcag

SEQ ID NO: 2466083 - RNA, 15 nt, Bordetella pertussis
gcagcgaggcgcagc

SEQ ID NO: 2466084 - RNA, 16 nt, Bordetella pertussis
gcagcgaggcgcagcg

SEQ ID NO: 2466085 - RNA, 17 nt, Bordetella pertussis
gcagcgaggcgcagcgc

SEQ ID NO: 2466086 - RNA, 21 nt, Bordetella pertussis
gcagcgaggcgcagcgcagcu

SEQ ID NO: 2466087 - RNA, 16 nt, Bordetella pertussis
gcagcgaggcgcgggc

SEQ ID NO: 2466088 - RNA, 12 nt, Bordetella pertussis
gcagcgcaccac

SEQ ID NO: 2466089 - RNA, 13 nt, Bordetella pertussis
gcagcgcaccgac

SEQ ID NO: 2466090 - RNA, 18 nt, Bordetella pertussis
gcagcgcaccgacggcag

SEQ ID NO: 2466091 - RNA, 20 nt, Bordetella pertussis
gcagcgcaccgacggcagcc

SEQ ID NO: 2466092 - RNA, 22 nt, Bordetella pertussis
gcagcgcaccgacggcagcccc

SEQ ID NO: 2466093 - RNA, 14 nt, Bordetella pertussis
gcagcgcagcgcca

SEQ ID NO: 2466094 - RNA, 15 nt, Bordetella pertussis
gcagcgcagcgccac

SEQ ID NO: 2466095 - RNA, 14 nt, Bordetella pertussis
gcagcgcaggaugg

SEQ ID NO: 2466096 - RNA, 16 nt, Bordetella pertussis
gcagcgcaggaugggc

SEQ ID NO: 2466097 - RNA, 22 nt, Bordetella pertussis
gcagcgcaucgagcuccugcag

SEQ ID NO: 2466098 - RNA, 21 nt, Bordetella pertussis
gcagcgcaucgaucucggccu

SEQ ID NO: 2466099 - RNA, 18 nt, Bordetella pertussis
gcagcgcaucgccgcagg

SEQ ID NO: 2466100 - RNA, 20 nt, Bordetella pertussis
gcagcgcaucgccgcaggcg

SEQ ID NO: 2466101 - RNA, 20 nt, Bordetella pertussis
gcagcgcaucgcgcgcgccg

SEQ ID NO: 2466102 - RNA, 16 nt, Bordetella pertussis
gcagcgccaccggcug

SEQ ID NO: 2466103 - RNA, 17 nt, Bordetella pertussis
gcagcgccaccggcugg

SEQ ID NO: 2466104 - RNA, 17 nt, Bordetella pertussis
gcagcgccagggccagg

SEQ ID NO: 2466105 - RNA, 14 nt, Bordetella pertussis
gcagcgcccaggcg

SEQ ID NO: 2466106 - RNA, 15 nt, Bordetella pertussis
gcagcguggcggcga

SEQ ID NO: 2466107 - RNA, 13 nt, Bordetella pertussis
gcagcguggcgua

SEQ ID NO: 2466108 - RNA, 16 nt, Bordetella pertussis
gcagcgugggcucgau

SEQ ID NO: 2466109 - RNA, 17 nt, Bordetella pertussis
gcagcguuacgcgacca

SEQ ID NO: 2466110 - RNA, 16 nt, Bordetella pertussis
gcagcucccccacgcc

SEQ ID NO: 2466111 - RNA, 22 nt, Bordetella pertussis
gcagcuccgggucgagcgccga

SEQ ID NO: 2466112 - RNA, 14 nt, Bordetella pertussis
gcagcuccucggcc

SEQ ID NO: 2466113 - RNA, 15 nt, Bordetella pertussis
gcagcuccucggccu

SEQ ID NO: 2466114 - RNA, 22 nt, Bordetella pertussis
gcagcuccucggccugccggcg

SEQ ID NO: 2466115 - RNA, 12 nt, Bordetella pertussis
gcagcucgaccg

SEQ ID NO: 2466116 - RNA, 14 nt, Bordetella pertussis
gcagcucgcgcgcu

SEQ ID NO: 2466117 - RNA, 16 nt, Bordetella pertussis
gcagcucgcgcugcgc

SEQ ID NO: 2466118 - RNA, 17 nt, Bordetella pertussis
gcagcucgcgcugcgcg

SEQ ID NO: 2466119 - RNA, 14 nt, Bordetella pertussis
gcagcucgcggucg

SEQ ID NO: 2466120 - RNA, 16 nt, Bordetella pertussis
gcagcucggcgaagcc

SEQ ID NO: 2466121 - RNA, 22 nt, Bordetella pertussis
gcagcucggcgaagccgcagcg

SEQ ID NO: 2466122 - RNA, 21 nt, Bordetella pertussis
gcagcucggcgaccaggccca

SEQ ID NO: 2466123 - RNA, 19 nt, Bordetella pertussis
gcagcucggcgaucugcgc

SEQ ID NO: 2466124 - RNA, 16 nt, Bordetella pertussis
gcagcucggugcagcc

SEQ ID NO: 2466125 - RNA, 17 nt, Bordetella pertussis
gcagcucggugcagccc

SEQ ID NO: 2466126 - RNA, 21 nt, Bordetella pertussis
gcagcucggugcagcccagca

SEQ ID NO: 2466127 - RNA, 19 nt, Bordetella pertussis
gcagcucguggcgcgccuc

SEQ ID NO: 2466128 - RNA, 20 nt, Bordetella pertussis
gcagcucguggcgcgccucc

SEQ ID NO: 2466129 - RNA, 20 nt, Bordetella pertussis
gcagcucguugaccugcugg

SEQ ID NO: 2466130 - RNA, 15 nt, Bordetella pertussis
gcagcugccugagca

SEQ ID NO: 2466131 - RNA, 20 nt, Bordetella pertussis
gcagcugccugagcaccgcc

SEQ ID NO: 2466132 - RNA, 15 nt, Bordetella pertussis
gcagcugcuugccca

SEQ ID NO: 2466133 - RNA, 23 nt, Bordetella pertussis
gcagcugcuugcccaggccggcg

SEQ ID NO: 2466134 - RNA, 14 nt, Bordetella pertussis
gcagcuggauggcc

SEQ ID NO: 2466135 - RNA, 23 nt, Bordetella pertussis
gcagcuggauggccugcucgccc

SEQ ID NO: 2466136 - RNA, 12 nt, Bordetella pertussis
gcagcuggcgcg

SEQ ID NO: 2466137 - RNA, 15 nt, Bordetella pertussis
gcagcuggcgcgggc

SEQ ID NO: 2466138 - RNA, 17 nt, Bordetella pertussis
gcagcuggcgcgggcgg

SEQ ID NO: 2466139 - RNA, 13 nt, Bordetella pertussis
gcagcuguagccc

SEQ ID NO: 2466140 - RNA, 15 nt, Bordetella pertussis
gcagcuguagcccug

SEQ ID NO: 2466141 - RNA, 16 nt, Bordetella pertussis
gcagcuguagcccugg

SEQ ID NO: 2466142 - RNA, 17 nt, Bordetella pertussis
gcagcuguagcccuggc

SEQ ID NO: 2466143 - RNA, 18 nt, Bordetella pertussis
gcagcuguagcccuggcg

SEQ ID NO: 2466144 - RNA, 19 nt, Bordetella pertussis
gcagcuguagcccuggcgc

SEQ ID NO: 2466145 - RNA, 20 nt, Bordetella pertussis
gcagcuguagcccuggcgcu

SEQ ID NO: 2466146 - RNA, 22 nt, Bordetella pertussis
gcagcuguagcccuggcgcugc

SEQ ID NO: 2466147 - RNA, 20 nt, Bordetella pertussis
gcagcuguucagacugcugc

SEQ ID NO: 2466148 - RNA, 15 nt, Bordetella pertussis
gcagcuucuaucugc

SEQ ID NO: 2466149 - RNA, 19 nt, Bordetella pertussis
gcagcuucuaucugccgcg

SEQ ID NO: 2466150 - RNA, 20 nt, Bordetella pertussis
gcagcuucuugaacucggcc

SEQ ID NO: 2466151 - RNA, 21 nt, Bordetella pertussis
gcagcuucuugaacucggcca

SEQ ID NO: 2466152 - RNA, 20 nt, Bordetella pertussis
gcagcuugagcgaaugcgcg

SEQ ID NO: 2466153 - RNA, 20 nt, Bordetella pertussis
gcagcuugaggguggcauug

SEQ ID NO: 2466154 - RNA, 15 nt, Bordetella pertussis
gcagcuugcgcgcca

SEQ ID NO: 2466155 - RNA, 15 nt, Bordetella pertussis
gcagcuugcgcgccc

SEQ ID NO: 2466156 - RNA, 15 nt, Bordetella pertussis
gcagcuuggcgcgcc

SEQ ID NO: 2466157 - RNA, 17 nt, Bordetella pertussis
gcagcuuggcgcgccgg

SEQ ID NO: 2466158 - RNA, 18 nt, Bordetella pertussis
gcagcuuggcgcgccgga

SEQ ID NO: 2466159 - RNA, 20 nt, Bordetella pertussis
gcagcuuggugaagcccucg

SEQ ID NO: 2466160 - RNA, 20 nt, Bordetella pertussis
gcagcuugucgaucgccacc

SEQ ID NO: 2466161 - RNA, 19 nt, Bordetella pertussis
gcaggaaaaagccucgccc

SEQ ID NO: 2466162 - RNA, 15 nt, Bordetella pertussis
gcaggaagcgcacca

SEQ ID NO: 2466163 - RNA, 16 nt, Bordetella pertussis
gcaggaagcgcaccag

SEQ ID NO: 2466164 - RNA, 18 nt, Bordetella pertussis
gcaggaaggccgccgcgu

SEQ ID NO: 2466165 - RNA, 23 nt, Bordetella pertussis
gcaggaaguccuucagccgcuga

SEQ ID NO: 2466166 - RNA, 23 nt, Bordetella pertussis
gcaggaauccuggugccaguccc

SEQ ID NO: 2466167 - RNA, 22 nt, Bordetella pertussis
gcaggaauuccucgcggcuguc

SEQ ID NO: 2466168 - RNA, 20 nt, Bordetella pertussis
gcaggaccgcgccgccgcgc

SEQ ID NO: 2466169 - RNA, 13 nt, Bordetella pertussis
gcaggacgccggc

SEQ ID NO: 2466170 - RNA, 19 nt, Bordetella pertussis
gcaggacggcgccguccgc

SEQ ID NO: 2466171 - RNA, 16 nt, Bordetella pertussis
gcaggagcccgcugcc

SEQ ID NO: 2466172 - RNA, 17 nt, Bordetella pertussis
gcaggagccuguccccg

SEQ ID NO: 2466173 - RNA, 20 nt, Bordetella pertussis
gcaggagccuguccccgcgg

SEQ ID NO: 2466174 - RNA, 12 nt, Bordetella pertussis
gcaggaucgcgg

SEQ ID NO: 2466175 - RNA, 17 nt, Bordetella pertussis
gcaggaucgcggccagc

SEQ ID NO: 2466176 - RNA, 22 nt, Bordetella pertussis
gcaggaucuccgcccaggugcg

SEQ ID NO: 2466177 - RNA, 16 nt, Bordetella pertussis
gcaggaucugcaccuu

SEQ ID NO: 2466178 - RNA, 23 nt, Bordetella pertussis
gcaggaucugguagugcaggccg

SEQ ID NO: 2466179 - RNA, 20 nt, Bordetella pertussis
gcaggaucugguucuugguc

SEQ ID NO: 2466180 - RNA, 21 nt, Bordetella pertussis
gcaggaugacguggcaguccu

SEQ ID NO: 2466181 - RNA, 15 nt, Bordetella pertussis
gcaggaugaggcgcc

SEQ ID NO: 2466182 - RNA, 19 nt, Bordetella pertussis
gcaggaugaggcgccgggu

SEQ ID NO: 2466183 - RNA, 22 nt, Bordetella pertussis
gcaggaugaggcgccggguggg

SEQ ID NO: 2466184 - RNA, 14 nt, Bordetella pertussis
gcaggaugcgcggc

SEQ ID NO: 2466185 - RNA, 17 nt, Bordetella pertussis
gcaggaugcgcggcacg

SEQ ID NO: 2466186 - RNA, 14 nt, Bordetella pertussis
gcaggaugcgcugg

SEQ ID NO: 2466187 - RNA, 16 nt, Bordetella pertussis
gcaggaugcgcuggcc

SEQ ID NO: 2466188 - RNA, 18 nt, Bordetella pertussis
gcaggaugcgcuggccgg

SEQ ID NO: 2466189 - RNA, 19 nt, Bordetella pertussis
gcaggaugcgcuggccggc

SEQ ID NO: 2466190 - RNA, 19 nt, Bordetella pertussis
gcaggauggccaugcgcuu

SEQ ID NO: 2466191 - RNA, 14 nt, Bordetella pertussis
gcaggauggcgaac

SEQ ID NO: 2466192 - RNA, 23 nt, Bordetella pertussis
gcaggauggcgucgaccgccaug

SEQ ID NO: 2466193 - RNA, 20 nt, Bordetella pertussis
gcaggaugggccguccggcc

SEQ ID NO: 2466194 - RNA, 21 nt, Bordetella pertussis
gcaggaugggccguccggccg

SEQ ID NO: 2466195 - RNA, 12 nt, Bordetella pertussis
gcaggauggggc

SEQ ID NO: 2466196 - RNA, 14 nt, Bordetella pertussis
gcaggauguccacg

SEQ ID NO: 2466197 - RNA, 18 nt, Bordetella pertussis
gcaggcaagcugcuggcg

SEQ ID NO: 2466198 - RNA, 20 nt, Bordetella pertussis
gcaggcaagcugcuggcgcg

SEQ ID NO: 2466199 - RNA, 23 nt, Bordetella pertussis
gcaggcaagcugcuggcgcgcca

SEQ ID NO: 2466200 - RNA, 14 nt, Bordetella pertussis
gcaggcacgcggag

SEQ ID NO: 2466201 - RNA, 14 nt, Bordetella pertussis
gcaggcacuggcgc

SEQ ID NO: 2466202 - RNA, 15 nt, Bordetella pertussis
gcaggcacuggcgcg

SEQ ID NO: 2466203 - RNA, 21 nt, Bordetella pertussis
gcaggcauucgaacaacagcg

SEQ ID NO: 2466204 - RNA, 22 nt, Bordetella pertussis
gcaggcauucgaacaacagcgc

SEQ ID NO: 2466205 - RNA, 20 nt, Bordetella pertussis
gcaggcauugcgccagccgu

SEQ ID NO: 2466206 - RNA, 21 nt, Bordetella pertussis
gcaggccaccgacggcgcggc

SEQ ID NO: 2466207 - RNA, 13 nt, Bordetella pertussis
gcaggccagcaug

SEQ ID NO: 2466208 - RNA, 15 nt, Bordetella pertussis
gcaggccagcauggc

SEQ ID NO: 2466209 - RNA, 21 nt, Bordetella pertussis
gcaggccagcauggccguggc

SEQ ID NO: 2466210 - RNA, 18 nt, Bordetella pertussis
gcaggccagcccgcgcgc

SEQ ID NO: 2466211 - RNA, 20 nt, Bordetella pertussis
gcaggccagcccgcgcgcgu

SEQ ID NO: 2466212 - RNA, 23 nt, Bordetella pertussis
gcaggccagcccgcgcgcguuca

SEQ ID NO: 2466213 - RNA, 19 nt, Bordetella pertussis
gcaggccagcgccgcggug

SEQ ID NO: 2466214 - RNA, 13 nt, Bordetella pertussis
gcaggccaggcuc

SEQ ID NO: 2466215 - RNA, 16 nt, Bordetella pertussis
gcaggccaggcucagc

SEQ ID NO: 2466216 - RNA, 17 nt, Bordetella pertussis
gcaggccaggcucagca

SEQ ID NO: 2466217 - RNA, 17 nt, Bordetella pertussis
gcaggccaucgcggucg

SEQ ID NO: 2466218 - RNA, 11 nt, Bordetella pertussis
gcaggcggcgg

SEQ ID NO: 2466219 - RNA, 21 nt, Bordetella pertussis
gcaggcggcggccuccagcag

SEQ ID NO: 2466220 - RNA, 23 nt, Bordetella pertussis
gcaggcggcggccuccagcaggg

SEQ ID NO: 2466221 - RNA, 13 nt, Bordetella pertussis
gcaggcggcuggu

SEQ ID NO: 2466222 - RNA, 14 nt, Bordetella pertussis
gcaggcggcuggug

SEQ ID NO: 2466223 - RNA, 16 nt, Bordetella pertussis
gcaggcgggccaggcc

SEQ ID NO: 2466224 - RNA, 17 nt, Bordetella pertussis
gcaggcgggccaggccg

SEQ ID NO: 2466225 - RNA, 13 nt, Bordetella pertussis
gcaggcgggcccg

SEQ ID NO: 2466226 - RNA, 15 nt, Bordetella pertussis
gcaggcgggcccgca

SEQ ID NO: 2466227 - RNA, 19 nt, Bordetella pertussis
gcaggcgggcccgcaucgc

SEQ ID NO: 2466228 - RNA, 21 nt, Bordetella pertussis
gcaggcgggcccgcaucgcgc

SEQ ID NO: 2466229 - RNA, 15 nt, Bordetella pertussis
gcaggcgguacagcg

SEQ ID NO: 2466230 - RNA, 17 nt, Bordetella pertussis
gcaggcggucgaggcgc

SEQ ID NO: 2466231 - RNA, 18 nt, Bordetella pertussis
gcaggcggucgaggcgca

SEQ ID NO: 2466232 - RNA, 14 nt, Bordetella pertussis
gcaggcggucggug

SEQ ID NO: 2466233 - RNA, 22 nt, Bordetella pertussis
gcaggcggugcggaggcggccg

SEQ ID NO: 2466234 - RNA, 13 nt, Bordetella pertussis
gcaggcgucggcc

SEQ ID NO: 2466235 - RNA, 17 nt, Bordetella pertussis
gcaggcgugcgcgggcg

SEQ ID NO: 2466236 - RNA, 22 nt, Bordetella pertussis
gcaggcgugcgcgggcgccauc

SEQ ID NO: 2466237 - RNA, 15 nt, Bordetella pertussis
gcaggcguucgcacc

SEQ ID NO: 2466238 - RNA, 17 nt, Bordetella pertussis
gcaggcguuucgccagg

SEQ ID NO: 2466239 - RNA, 18 nt, Bordetella pertussis
gcaggcguuucgccagga

SEQ ID NO: 2466240 - RNA, 16 nt, Bordetella pertussis
gcaggcuaugcaggcu

SEQ ID NO: 2466241 - RNA, 15 nt, Bordetella pertussis
gcaggcucagcccgg

SEQ ID NO: 2466242 - RNA, 15 nt, Bordetella pertussis
gcaggcuccacagcc

SEQ ID NO: 2466243 - RNA, 14 nt, Bordetella pertussis
gcaggcugccgccg

SEQ ID NO: 2466244 - RNA, 18 nt, Bordetella pertussis
gcaggcugccgccggcga

SEQ ID NO: 2466245 - RNA, 13 nt, Bordetella pertussis
gcaggcuggccac

SEQ ID NO: 2466246 - RNA, 15 nt, Bordetella pertussis
gcaggcuggccggcg

SEQ ID NO: 2466247 - RNA, 21 nt, Bordetella pertussis
gcaggcuggccggcguggccu

SEQ ID NO: 2466248 - RNA, 15 nt, Bordetella pertussis
gcaggcuggcgcggu

SEQ ID NO: 2466249 - RNA, 17 nt, Bordetella pertussis
gcaggcuggcgcggucc

SEQ ID NO: 2466250 - RNA, 23 nt, Bordetella pertussis
gcaggcugggcgaaacggccagc

SEQ ID NO: 2466251 - RNA, 21 nt, Bordetella pertussis
gcaggcuuucgcacagccggg

SEQ ID NO: 2466252 - RNA, 22 nt, Bordetella pertussis
gcaggcuuucgcacagccgggg

SEQ ID NO: 2466253 - RNA, 17 nt, Bordetella pertussis
gcaggcuuugcuggcca

SEQ ID NO: 2466254 - RNA, 18 nt, Bordetella pertussis
gcaggcuuugcuggccau

SEQ ID NO: 2466255 - RNA, 12 nt, Bordetella pertussis
gcagggacaggc

SEQ ID NO: 2466256 - RNA, 16 nt, Bordetella pertussis
gcagggacaggcaccg

SEQ ID NO: 2466257 - RNA, 13 nt, Bordetella pertussis
gcagggacaggcu

SEQ ID NO: 2466258 - RNA, 17 nt, Bordetella pertussis
gcagggacuugggcagg

SEQ ID NO: 2466259 - RNA, 17 nt, Bordetella pertussis
gcagggcaucaccaucg

SEQ ID NO: 2466260 - RNA, 17 nt, Bordetella pertussis
gcagggcaugggcccgg

SEQ ID NO: 2466261 - RNA, 19 nt, Bordetella pertussis
gcagggcaugggcccgggc

SEQ ID NO: 2466262 - RNA, 21 nt, Bordetella pertussis
gcagggcaugggcccgggcgc

SEQ ID NO: 2466263 - RNA, 23 nt, Bordetella pertussis
gcagggcaugggcccgggcgcgc

SEQ ID NO: 2466264 - RNA, 18 nt, Bordetella pertussis
gcagggccacgcccaggc

SEQ ID NO: 2466265 - RNA, 20 nt, Bordetella pertussis
gcagggccacgcccaggccg

SEQ ID NO: 2466266 - RNA, 24 nt, Bordetella pertussis
gcagggccacgcccaggccguggc

SEQ ID NO: 2466267 - RNA, 18 nt, Bordetella pertussis
gcagggccagcgccagca

SEQ ID NO: 2466268 - RNA, 12 nt, Bordetella pertussis
gcagggcccgca

SEQ ID NO: 2466269 - RNA, 18 nt, Bordetella pertussis
gcagggcccgcaucggcg

SEQ ID NO: 2466270 - RNA, 12 nt, Bordetella pertussis
gcagggccuccu

SEQ ID NO: 2466271 - RNA, 20 nt, Bordetella pertussis
gcagggccuggaagcuggcc

SEQ ID NO: 2466272 - RNA, 16 nt, Bordetella pertussis
gcagggccuggcagau

SEQ ID NO: 2466273 - RNA, 15 nt, Bordetella pertussis
gcagggcgccgacga

SEQ ID NO: 2466274 - RNA, 21 nt, Bordetella pertussis
gcagggcgccgacgaugccgc

SEQ ID NO: 2466275 - RNA, 18 nt, Bordetella pertussis
gcagggcgccgcgcgguc

SEQ ID NO: 2466276 - RNA, 20 nt, Bordetella pertussis
gcagggcggaaaacagcacc

SEQ ID NO: 2466277 - RNA, 15 nt, Bordetella pertussis
gcagggcggccaggc

SEQ ID NO: 2466278 - RNA, 17 nt, Bordetella pertussis
gcagggcggccaggccg

SEQ ID NO: 2466279 - RNA, 14 nt, Bordetella pertussis
gcagggcggccggc

SEQ ID NO: 2466280 - RNA, 15 nt, Bordetella pertussis
gcagggcggccggca

SEQ ID NO: 2466281 - RNA, 16 nt, Bordetella pertussis
gcagggcggccggcac

SEQ ID NO: 2466282 - RNA, 20 nt, Bordetella pertussis
gcagggcggccucgacggcc

SEQ ID NO: 2466283 - RNA, 12 nt, Bordetella pertussis
gcagggcggcgu

SEQ ID NO: 2466284 - RNA, 21 nt, Bordetella pertussis
gcagggcggcgucgaucggcg

SEQ ID NO: 2466285 - RNA, 17 nt, Bordetella pertussis
gcagggcgggggacgcc

SEQ ID NO: 2466286 - RNA, 16 nt, Bordetella pertussis
gcagggcgucggccgc

SEQ ID NO: 2466287 - RNA, 18 nt, Bordetella pertussis
gcagggcgucggccgcgc

SEQ ID NO: 2466288 - RNA, 21 nt, Bordetella pertussis
gcagggcgucggccgcgccca

SEQ ID NO: 2466289 - RNA, 20 nt, Bordetella pertussis
gcagggcgucugcucgccgu

SEQ ID NO: 2466290 - RNA, 15 nt, Bordetella pertussis
gcaggggauugccgc

SEQ ID NO: 2466291 - RNA, 20 nt, Bordetella pertussis
gcaggggauugccgcgcggu

SEQ ID NO: 2466292 - RNA, 17 nt, Bordetella pertussis
gcaggggccgcacgcgc

SEQ ID NO: 2466293 - RNA, 18 nt, Bordetella pertussis
gcaggggcucgcgcccga

SEQ ID NO: 2466294 - RNA, 23 nt, Bordetella pertussis
gcaggggcucuucgacagcgcgc

SEQ ID NO: 2466295 - RNA, 20 nt, Bordetella pertussis
gcagggggucgaucauggcc

SEQ ID NO: 2466296 - RNA, 22 nt, Bordetella pertussis
gcagggggucgaucauggccag

SEQ ID NO: 2466297 - RNA, 16 nt, Bordetella pertussis
gcaggggguggcggcc

SEQ ID NO: 2466298 - RNA, 17 nt, Bordetella pertussis
gcaggggguggcggccg

SEQ ID NO: 2466299 - RNA, 16 nt, Bordetella pertussis
gcagggucagcccgcc

SEQ ID NO: 2466300 - RNA, 22 nt, Bordetella pertussis
gcagggucagcccgccaucgcg

SEQ ID NO: 2466301 - RNA, 18 nt, Bordetella pertussis
gcagggucagcggccggc

SEQ ID NO: 2466302 - RNA, 18 nt, Bordetella pertussis
gcagggucagggugucgc

SEQ ID NO: 2466303 - RNA, 15 nt, Bordetella pertussis
gcagggucgagacca

SEQ ID NO: 2466304 - RNA, 19 nt, Bordetella pertussis
gcagggucgagaccagcag

SEQ ID NO: 2466305 - RNA, 20 nt, Bordetella pertussis
gcagggucgagaccagcagc

SEQ ID NO: 2466306 - RNA, 16 nt, Bordetella pertussis
gcagggucggccccau

SEQ ID NO: 2466307 - RNA, 17 nt, Bordetella pertussis
gcagggucugcaggccg

SEQ ID NO: 2466308 - RNA, 18 nt, Bordetella pertussis
gcagggugacgggcuggg

SEQ ID NO: 2466309 - RNA, 19 nt, Bordetella pertussis
gcagggugacgggcugggc

SEQ ID NO: 2466310 - RNA, 16 nt, Bordetella pertussis
gcagggugccuguccc

SEQ ID NO: 2466311 - RNA, 15 nt, Bordetella pertussis
gcagggugcggggug

SEQ ID NO: 2466312 - RNA, 19 nt, Bordetella pertussis
gcagggugucggccagggc

SEQ ID NO: 2466313 - RNA, 20 nt, Bordetella pertussis
gcagggugucggccagggcg

SEQ ID NO: 2466314 - RNA, 12 nt, Bordetella pertussis
gcagggugugcc

SEQ ID NO: 2466315 - RNA, 17 nt, Bordetella pertussis
gcaggguuggcgcgccg

SEQ ID NO: 2466316 - RNA, 20 nt, Bordetella pertussis
gcaggguuggcgcgccgugg

SEQ ID NO: 2466317 - RNA, 21 nt, Bordetella pertussis
gcaggguuuuauacggcgcga

SEQ ID NO: 2466318 - RNA, 13 nt, Bordetella pertussis
gcagguacgccau

SEQ ID NO: 2466319 - RNA, 16 nt, Bordetella pertussis
gcagguaggacggcgc

SEQ ID NO: 2466320 - RNA, 21 nt, Bordetella pertussis
gcagguagucggucaccgucc

SEQ ID NO: 2466321 - RNA, 22 nt, Bordetella pertussis
gcagguagucggucaccguccc

SEQ ID NO: 2466322 - RNA, 17 nt, Bordetella pertussis
gcaggucacgggcgaug

SEQ ID NO: 2466323 - RNA, 18 nt, Bordetella pertussis
gcaggucaucgcgcuggc

SEQ ID NO: 2466324 - RNA, 14 nt, Bordetella pertussis
gcagguccaccgcc

SEQ ID NO: 2466325 - RNA, 20 nt, Bordetella pertussis
gcagguccaccgccacguca

SEQ ID NO: 2466326 - RNA, 16 nt, Bordetella pertussis
gcagguccaggccugg

SEQ ID NO: 2466327 - RNA, 20 nt, Bordetella pertussis
gcagguccauggccagucug

SEQ ID NO: 2466328 - RNA, 15 nt, Bordetella pertussis
gcagguccggucgcg

SEQ ID NO: 2466329 - RNA, 22 nt, Bordetella pertussis
gcagguccggucgcgcgugcag

SEQ ID NO: 2466330 - RNA, 20 nt, Bordetella pertussis
gcagguccugcacgcgggcc

SEQ ID NO: 2466331 - RNA, 17 nt, Bordetella pertussis
gcacugaugcuggucag

SEQ ID NO: 2466332 - RNA, 20 nt, Bordetella pertussis
gcacugaugcuggucagccu

SEQ ID NO: 2466333 - RNA, 16 nt, Bordetella pertussis
gcacugcaggccaucg

SEQ ID NO: 2466334 - RNA, 18 nt, Bordetella pertussis
gcacuggcgcggcgcuac

SEQ ID NO: 2466335 - RNA, 21 nt, Bordetella pertussis
gcacugggugacgcuggagcg

SEQ ID NO: 2466336 - RNA, 22 nt, Bordetella pertussis
gcacugggugacgcuggagcgc

SEQ ID NO: 2466337 - RNA, 16 nt, Bordetella pertussis
gcacuggguggccagc

SEQ ID NO: 2466338 - RNA, 17 nt, Bordetella pertussis
gcacuggguggccagcg

SEQ ID NO: 2466339 - RNA, 22 nt, Bordetella pertussis
gcacuggguggccagcgccgcc

SEQ ID NO: 2466340 - RNA, 14 nt, Bordetella pertussis
gcacuggguuuuuc

SEQ ID NO: 2466341 - RNA, 23 nt, Bordetella pertussis
gcacugucggcguuccuggcgcu

SEQ ID NO: 2466342 - RNA, 17 nt, Bordetella pertussis
gcacuugcgaacggccg

SEQ ID NO: 2466343 - RNA, 21 nt, Bordetella pertussis
gcacuugcgaacggccgcccg

SEQ ID NO: 2466344 - RNA, 14 nt, Bordetella pertussis
gcacuuguggaccg

SEQ ID NO: 2466345 - RNA, 21 nt, Bordetella pertussis
gcacuuguggaccgcgaagaa

SEQ ID NO: 2466346 - RNA, 14 nt, Bordetella pertussis
gcagaaaccccagg

SEQ ID NO: 2466347 - RNA, 16 nt, Bordetella pertussis
gcagaaauggaugcgc

SEQ ID NO: 2466348 - RNA, 14 nt, Bordetella pertussis
gcagaacagggugc

SEQ ID NO: 2466349 - RNA, 21 nt, Bordetella pertussis
gcagaacggaaacgcccagcc

SEQ ID NO: 2466350 - RNA, 15 nt, Bordetella pertussis
gcagaagcagccgcg

SEQ ID NO: 2466351 - RNA, 16 nt, Bordetella pertussis
gcagaagcagccgcgc

SEQ ID NO: 2466352 - RNA, 17 nt, Bordetella pertussis
gcagaagcagccgcgcg

SEQ ID NO: 2466353 - RNA, 23 nt, Bordetella pertussis
gcagaaggucugggccagcaggc

SEQ ID NO: 2466354 - RNA, 16 nt, Bordetella pertussis
gcagaaguggucgcgc

SEQ ID NO: 2466355 - RNA, 15 nt, Bordetella pertussis
gcagaaugccgccca

SEQ ID NO: 2466356 - RNA, 23 nt, Bordetella pertussis
gcagaaugccgcccacgaucacc

SEQ ID NO: 2466357 - RNA, 19 nt, Bordetella pertussis
gcagaauguauuggcccag

SEQ ID NO: 2466358 - RNA, 14 nt, Bordetella pertussis
gcagaccacgccgg

SEQ ID NO: 2466359 - RNA, 16 nt, Bordetella pertussis
gcagaccacgccggcg

SEQ ID NO: 2466360 - RNA, 20 nt, Bordetella pertussis
gcagaccacgccggcgguca

SEQ ID NO: 2466361 - RNA, 21 nt, Bordetella pertussis
gcagaccacgccggcggucac

SEQ ID NO: 2466362 - RNA, 16 nt, Bordetella pertussis
gcagaccagcaccggc

SEQ ID NO: 2466363 - RNA, 17 nt, Bordetella pertussis
gcagaccagcaccggca

SEQ ID NO: 2466364 - RNA, 12 nt, Bordetella pertussis
gcagacccgcgc

SEQ ID NO: 2466365 - RNA, 14 nt, Bordetella pertussis
gcagacccgcgccc

SEQ ID NO: 2466366 - RNA, 18 nt, Bordetella pertussis
gcagacccgcgcccagcu

SEQ ID NO: 2466367 - RNA, 13 nt, Bordetella pertussis
gcagacccuggcg

SEQ ID NO: 2466368 - RNA, 18 nt, Bordetella pertussis
gcagacccuggcgcgcgu

SEQ ID NO: 2466369 - RNA, 16 nt, Bordetella pertussis
gcagaccuaccaggcc

SEQ ID NO: 2466370 - RNA, 17 nt, Bordetella pertussis
gcagaccuaccaggccg

SEQ ID NO: 2466371 - RNA, 17 nt, Bordetella pertussis
gcagacgaucauccagg

SEQ ID NO: 2466372 - RNA, 20 nt, Bordetella pertussis
gcagacgaucauccaggccg

SEQ ID NO: 2466373 - RNA, 17 nt, Bordetella pertussis
gcagacgaugcccaggc

SEQ ID NO: 2466374 - RNA, 18 nt, Bordetella pertussis
gcagacgaugcccaggcc

SEQ ID NO: 2466375 - RNA, 12 nt, Bordetella pertussis
gcagacgcgcuc

SEQ ID NO: 2466376 - RNA, 19 nt, Bordetella pertussis
gcagacgcgcucaggcggu

SEQ ID NO: 2466377 - RNA, 21 nt, Bordetella pertussis
gcagacgcgcucaggcgguga

SEQ ID NO: 2466378 - RNA, 16 nt, Bordetella pertussis
gcagacgcuucaggcc

SEQ ID NO: 2466379 - RNA, 18 nt, Bordetella pertussis
gcagacgcuucaggccgu

SEQ ID NO: 2466380 - RNA, 15 nt, Bordetella pertussis
gcagacggcggcugg

SEQ ID NO: 2466381 - RNA, 13 nt, Bordetella pertussis
gcagacuccagga

SEQ ID NO: 2466382 - RNA, 15 nt, Bordetella pertussis
gcagacuguucagaa

SEQ ID NO: 2466383 - RNA, 21 nt, Bordetella pertussis
gcagagacagauaccgccuug

SEQ ID NO: 2466384 - RNA, 19 nt, Bordetella pertussis
gcagagcaccacggcgcgc

SEQ ID NO: 2466385 - RNA, 14 nt, Bordetella pertussis
gcagagggcgacgg

SEQ ID NO: 2466386 - RNA, 20 nt, Bordetella pertussis
gcagagggcgacggcggcgu

SEQ ID NO: 2466387 - RNA, 15 nt, Bordetella pertussis
gcagauaccggcaug

SEQ ID NO: 2466388 - RNA, 19 nt, Bordetella pertussis
gcagaucaucgagcaccgc

SEQ ID NO: 2466389 - RNA, 15 nt, Bordetella pertussis
gcagaucaucggcgc

SEQ ID NO: 2466390 - RNA, 17 nt, Bordetella pertussis
gcagaucaucggcgcca

SEQ ID NO: 2466391 - RNA, 14 nt, Bordetella pertussis
gcagaucccaggcg

SEQ ID NO: 2466392 - RNA, 21 nt, Bordetella pertussis
gcagauccucgaacaggccau

SEQ ID NO: 2466393 - RNA, 15 nt, Bordetella pertussis
gcagaucgcggcggg

SEQ ID NO: 2466394 - RNA, 16 nt, Bordetella pertussis
gcagaucggcgcuggc

SEQ ID NO: 2466395 - RNA, 17 nt, Bordetella pertussis
gcagaucggcgcuggcc

SEQ ID NO: 2466396 - RNA, 20 nt, Bordetella pertussis
gcagaucggcgcuggccugg

SEQ ID NO: 2466397 - RNA, 18 nt, Bordetella pertussis
gcagaucggcggccuggg

SEQ ID NO: 2466398 - RNA, 21 nt, Bordetella pertussis
gcagaucggcggccugggcca

SEQ ID NO: 2466399 - RNA, 19 nt, Bordetella pertussis
gcagaugaucuacgcgcgc

SEQ ID NO: 2466400 - RNA, 22 nt, Bordetella pertussis
gcagaugaucuacgcgcgcgcc

SEQ ID NO: 2466401 - RNA, 19 nt, Bordetella pertussis
gcagaugcgacuggcggcu

SEQ ID NO: 2466402 - RNA, 14 nt, Bordetella pertussis
gcagaugcgcgcca

SEQ ID NO: 2466403 - RNA, 16 nt, Bordetella pertussis
gcagauggccagcagc

SEQ ID NO: 2466404 - RNA, 18 nt, Bordetella pertussis
gcagauggccagcagcgc

SEQ ID NO: 2466405 - RNA, 22 nt, Bordetella pertussis
gcagauggccagcagcgccgcc

SEQ ID NO: 2466406 - RNA, 16 nt, Bordetella pertussis
gcagauggcccuugcc

SEQ ID NO: 2466407 - RNA, 19 nt, Bordetella pertussis
gcagauggcccuugcccag

SEQ ID NO: 2466408 - RNA, 15 nt, Bordetella pertussis
gcagauggcggaugg

SEQ ID NO: 2466409 - RNA, 14 nt, Bordetella pertussis
gcagauggcggcga

SEQ ID NO: 2466410 - RNA, 20 nt, Bordetella pertussis
gcagauggcguaggcggccu

SEQ ID NO: 2466411 - RNA, 14 nt, Bordetella pertussis
gcagaugggcggcg

SEQ ID NO: 2466412 - RNA, 19 nt, Bordetella pertussis
gcagaugggcggcgacgaa

SEQ ID NO: 2466413 - RNA, 17 nt, Bordetella pertussis
gcagauggugcuccgac

SEQ ID NO: 2466414 - RNA, 23 nt, Bordetella pertussis
gcagauggugcuccgacggcugg

SEQ ID NO: 2466415 - RNA, 23 nt, Bordetella pertussis
gcagauugaugcccaugcgcugc

SEQ ID NO: 2466416 - RNA, 16 nt, Bordetella pertussis
gcagcaacccgcccgg

SEQ ID NO: 2466417 - RNA, 15 nt, Bordetella pertussis
gcagcaaccggaaca

SEQ ID NO: 2466418 - RNA, 21 nt, Bordetella pertussis
gcagcaaccggaacaccagca

SEQ ID NO: 2466419 - RNA, 14 nt, Bordetella pertussis
gcagcaacgccggc

SEQ ID NO: 2466420 - RNA, 15 nt, Bordetella pertussis
gcagcaacggugagc

SEQ ID NO: 2466421 - RNA, 22 nt, Bordetella pertussis
gcagcaagcugucggacgagca

SEQ ID NO: 2466422 - RNA, 19 nt, Bordetella pertussis
gcagcaauucgaccggcag

SEQ ID NO: 2466423 - RNA, 23 nt, Bordetella pertussis
gcagcacacgcauuugcagcggc

SEQ ID NO: 2466424 - RNA, 17 nt, Bordetella pertussis
gcagcacacggucagca

SEQ ID NO: 2466425 - RNA, 23 nt, Bordetella pertussis
gcagcacacggucagcaacccca

SEQ ID NO: 2466426 - RNA, 16 nt, Bordetella pertussis
gcagcacaugggcgcg

SEQ ID NO: 2466427 - RNA, 20 nt, Bordetella pertussis
gcagcaccacaucgccggcg

SEQ ID NO: 2466428 - RNA, 23 nt, Bordetella pertussis
gcagcaccacaucgccggcggcg

SEQ ID NO: 2466429 - RNA, 13 nt, Bordetella pertussis
gcagcaccagcau

SEQ ID NO: 2466430 - RNA, 19 nt, Bordetella pertussis
gcccaccgcgaaccaggcc

SEQ ID NO: 2466431 - RNA, 20 nt, Bordetella pertussis
gcccaccggcaugccgucca

SEQ ID NO: 2466432 - RNA, 22 nt, Bordetella pertussis
gcccaccggcaugccguccacg

SEQ ID NO: 2466433 - RNA, 16 nt, Bordetella pertussis
gcccaccgggccggcc

SEQ ID NO: 2466434 - RNA, 16 nt, Bordetella pertussis
gcccaccgugaccagc

SEQ ID NO: 2466435 - RNA, 19 nt, Bordetella pertussis
gcccaccgugaccagcgag

SEQ ID NO: 2466436 - RNA, 17 nt, Bordetella pertussis
gcccaccuuccugcugg

SEQ ID NO: 2466437 - RNA, 18 nt, Bordetella pertussis
gcccaccuuccugcugga

SEQ ID NO: 2466438 - RNA, 19 nt, Bordetella pertussis
gcccacgacgaacaacacg

SEQ ID NO: 2466439 - RNA, 20 nt, Bordetella pertussis
gcccacgaucaccacgcccg

SEQ ID NO: 2466440 - RNA, 21 nt, Bordetella pertussis
gcccacgaucaccacgcccgc

SEQ ID NO: 2466441 - RNA, 22 nt, Bordetella pertussis
gcccacgccaucgaacuccugc

SEQ ID NO: 2466442 - RNA, 13 nt, Bordetella pertussis
gcccacgccgccg

SEQ ID NO: 2466443 - RNA, 15 nt, Bordetella pertussis
gcccacgccgccugg

SEQ ID NO: 2466444 - RNA, 16 nt, Bordetella pertussis
gcccacgccgccuggc

SEQ ID NO: 2466445 - RNA, 16 nt, Bordetella pertussis
gcccacgccgcguucg

SEQ ID NO: 2466446 - RNA, 22 nt, Bordetella pertussis
gcccacgccgcguucguucuug

SEQ ID NO: 2466447 - RNA, 16 nt, Bordetella pertussis
gcccacgccgcugucg

SEQ ID NO: 2466448 - RNA, 14 nt, Bordetella pertussis
gcccacgcgccgcc

SEQ ID NO: 2466449 - RNA, 15 nt, Bordetella pertussis
gcccacgcgccgcca

SEQ ID NO: 2466450 - RNA, 18 nt, Bordetella pertussis
gcccacgcgccgccaggc

SEQ ID NO: 2466451 - RNA, 13 nt, Bordetella pertussis
gcccacgcgcucc

SEQ ID NO: 2466452 - RNA, 14 nt, Bordetella pertussis
gcccacgcgcuccu

SEQ ID NO: 2466453 - RNA, 17 nt, Bordetella pertussis
gcccacgcgcuccugcu

SEQ ID NO: 2466454 - RNA, 18 nt, Bordetella pertussis
gcccacgcggcgcugcug

SEQ ID NO: 2466455 - RNA, 19 nt, Bordetella pertussis
gcccacgcggcgcugcugg

SEQ ID NO: 2466456 - RNA, 22 nt, Bordetella pertussis
gcccacgcggcgcugcuggccg

SEQ ID NO: 2466457 - RNA, 16 nt, Bordetella pertussis
gcccacgcugucgggg

SEQ ID NO: 2466458 - RNA, 21 nt, Bordetella pertussis
gcccacgcugucggggugccg

SEQ ID NO: 2466459 - RNA, 20 nt, Bordetella pertussis
gcccacggcaaaagccgggg

SEQ ID NO: 2466460 - RNA, 16 nt, Bordetella pertussis
gcccacggccagcacu

SEQ ID NO: 2466461 - RNA, 18 nt, Bordetella pertussis
gcccacggccuguccggc

SEQ ID NO: 2466462 - RNA, 19 nt, Bordetella pertussis
gcccacggccuguccggca

SEQ ID NO: 2466463 - RNA, 13 nt, Bordetella pertussis
gcccacggcgcca

SEQ ID NO: 2466464 - RNA, 17 nt, Bordetella pertussis
gcccacgggcgccuggu

SEQ ID NO: 2466465 - RNA, 22 nt, Bordetella pertussis
gcccacguaggcaaagcgcggc

SEQ ID NO: 2466466 - RNA, 16 nt, Bordetella pertussis
gcccacguaggugguc

SEQ ID NO: 2466467 - RNA, 17 nt, Bordetella pertussis
gcccacucggugcgcgc

SEQ ID NO: 2466468 - RNA, 22 nt, Bordetella pertussis
gcccacucggugcgcgcgccca

SEQ ID NO: 2466469 - RNA, 23 nt, Bordetella pertussis
gcccacucggugcgcgcgcccac

SEQ ID NO: 2466470 - RNA, 14 nt, Bordetella pertussis
gcccacugccaggc

SEQ ID NO: 2466471 - RNA, 15 nt, Bordetella pertussis
gcccacugccaggcg

SEQ ID NO: 2466472 - RNA, 16 nt, Bordetella pertussis
gcccacugccaggcga

SEQ ID NO: 2466473 - RNA, 22 nt, Bordetella pertussis
gcccacuggaucgccgaucggc

SEQ ID NO: 2466474 - RNA, 23 nt, Bordetella pertussis
gcccacuggaucgccgaucggca

SEQ ID NO: 2466475 - RNA, 23 nt, Bordetella pertussis
gcccagauccagcuugcguccca

SEQ ID NO: 2466476 - RNA, 13 nt, Bordetella pertussis
gcccagcaagggu

SEQ ID NO: 2466477 - RNA, 15 nt, Bordetella pertussis
gcccagcaaggguuc

SEQ ID NO: 2466478 - RNA, 21 nt, Bordetella pertussis
gcccagcaaggguucgggcau

SEQ ID NO: 2466479 - RNA, 22 nt, Bordetella pertussis
gcccagcaauucguugaucugg

SEQ ID NO: 2466480 - RNA, 13 nt, Bordetella pertussis
gcccagcaccacg

SEQ ID NO: 2466481 - RNA, 20 nt, Bordetella pertussis
gcccagcaccacggcaucgg

SEQ ID NO: 2466482 - RNA, 15 nt, Bordetella pertussis
gcccagcaccacggg

SEQ ID NO: 2466483 - RNA, 20 nt, Bordetella pertussis
gcccagcaccacgggcucgc

SEQ ID NO: 2466484 - RNA, 13 nt, Bordetella pertussis
gcccagcaccgcc

SEQ ID NO: 2466485 - RNA, 14 nt, Bordetella pertussis
gcccagcaccgcca

SEQ ID NO: 2466486 - RNA, 22 nt, Bordetella pertussis
gcccagcaccgccaccguggcg

SEQ ID NO: 2466487 - RNA, 14 nt, Bordetella pertussis
gcccagcaccgccg

SEQ ID NO: 2466488 - RNA, 15 nt, Bordetella pertussis
gcccagcaccgccgc

SEQ ID NO: 2466489 - RNA, 16 nt, Bordetella pertussis
gcccagcaccgccgcc

SEQ ID NO: 2466490 - RNA, 22 nt, Bordetella pertussis
gcccagcaccucgacgcagccu

SEQ ID NO: 2466491 - RNA, 15 nt, Bordetella pertussis
gcccagcacgccgcg

SEQ ID NO: 2466492 - RNA, 19 nt, Bordetella pertussis
gcccagcacgccgcgcucg

SEQ ID NO: 2466493 - RNA, 20 nt, Bordetella pertussis
gcccagcacgccgcgcucgu

SEQ ID NO: 2466494 - RNA, 14 nt, Bordetella pertussis
gcccagcacgcgcg

SEQ ID NO: 2466495 - RNA, 17 nt, Bordetella pertussis
gcccagcacgcgcgcca

SEQ ID NO: 2466496 - RNA, 18 nt, Bordetella pertussis
gcccagcagauaccggca

SEQ ID NO: 2466497 - RNA, 20 nt, Bordetella pertussis
gcccagcagauaccggcaug

SEQ ID NO: 2466498 - RNA, 14 nt, Bordetella pertussis
gcccagcagauggc

SEQ ID NO: 2466499 - RNA, 15 nt, Bordetella pertussis
gcccagcagauggcu

SEQ ID NO: 2466500 - RNA, 14 nt, Bordetella pertussis
gcccagcagcgcca

SEQ ID NO: 2466501 - RNA, 16 nt, Bordetella pertussis
gcccagcagcgccacc

SEQ ID NO: 2466502 - RNA, 17 nt, Bordetella pertussis
gcccagcagcgccaccg

SEQ ID NO: 2466503 - RNA, 14 nt, Bordetella pertussis
gcccagcagcuccu

SEQ ID NO: 2466504 - RNA, 15 nt, Bordetella pertussis
gcccagcagcuccuc

SEQ ID NO: 2466505 - RNA, 17 nt, Bordetella pertussis
gcccagcagcuccucgg

SEQ ID NO: 2466506 - RNA, 17 nt, Bordetella pertussis
gcccagcaggcuuucgc

SEQ ID NO: 2466507 - RNA, 11 nt, Bordetella pertussis
gcccagcaggu

SEQ ID NO: 2466508 - RNA, 12 nt, Bordetella pertussis
gcccagcagguc

SEQ ID NO: 2466509 - RNA, 14 nt, Bordetella pertussis
gcccagcagguccu

SEQ ID NO: 2466510 - RNA, 17 nt, Bordetella pertussis
gcccagcaucaggcccg

SEQ ID NO: 2466511 - RNA, 13 nt, Bordetella pertussis
gcccagcaugggg

SEQ ID NO: 2466512 - RNA, 22 nt, Bordetella pertussis
gcccagcauggucggcauggcc

SEQ ID NO: 2466513 - RNA, 23 nt, Bordetella pertussis
gcccagcauggucggcauggcca

SEQ ID NO: 2466514 - RNA, 15 nt, Bordetella pertussis
gcccagccacaccag

SEQ ID NO: 2466515 - RNA, 17 nt, Bordetella pertussis
gcccagccacaccaggu

SEQ ID NO: 2466516 - RNA, 18 nt, Bordetella pertussis
gcccagccacaccagguu

SEQ ID NO: 2466517 - RNA, 13 nt, Bordetella pertussis
gcccagccagccc

SEQ ID NO: 2466518 - RNA, 15 nt, Bordetella pertussis
gcccagccagcccug

SEQ ID NO: 2466519 - RNA, 16 nt, Bordetella pertussis
gcccagccagcccugg

SEQ ID NO: 2466520 - RNA, 19 nt, Bordetella pertussis
gcccagccagcccuggccc

SEQ ID NO: 2466521 - RNA, 15 nt, Bordetella pertussis
gcccagccagcggug

SEQ ID NO: 2466522 - RNA, 20 nt, Bordetella pertussis
gcccagccagcggugcgcgg

SEQ ID NO: 2466523 - RNA, 12 nt, Bordetella pertussis
gcccagccaggc

SEQ ID NO: 2466524 - RNA, 13 nt, Bordetella pertussis
gcccagccaggcg

SEQ ID NO: 2466525 - RNA, 19 nt, Bordetella pertussis
gcccagccccgcggccgcg

SEQ ID NO: 2466526 - RNA, 12 nt, Bordetella pertussis
gcccagcccugc

SEQ ID NO: 2466527 - RNA, 17 nt, Bordetella pertussis
gcccagcccugcccgca

SEQ ID NO: 2466528 - RNA, 13 nt, Bordetella pertussis
gcccagccgcagc

SEQ ID NO: 2466529 - RNA, 21 nt, Bordetella pertussis
gcccagccgcagcaggcgcuc

SEQ ID NO: 2466530 - RNA, 23 nt, Bordetella pertussis
gcccagccgcagcaggcgcucgg

SEQ ID NO: 2466531 - RNA, 19 nt, Bordetella pertussis
gcccagccgcaugccggcg

SEQ ID NO: 2466532 - RNA, 14 nt, Bordetella pertussis
gcccagccgccuga

SEQ ID NO: 2466533 - RNA, 18 nt, Bordetella pertussis
gcccagccgcucggccac

SEQ ID NO: 2466534 - RNA, 19 nt, Bordetella pertussis
gcccagccgcucggccacg

SEQ ID NO: 2466535 - RNA, 12 nt, Bordetella pertussis
gcccagccggug

SEQ ID NO: 2466536 - RNA, 18 nt, Bordetella pertussis
gcccagccugccggcggc

SEQ ID NO: 2466537 - RNA, 19 nt, Bordetella pertussis
gcccagccugccggcggcc

SEQ ID NO: 2466538 - RNA, 20 nt, Bordetella pertussis
gcccagcgacgagggcgcca

SEQ ID NO: 2466539 - RNA, 19 nt, Bordetella pertussis
gcccagcgagccggccagc

SEQ ID NO: 2466540 - RNA, 20 nt, Bordetella pertussis
gcccagcgagccggccagcg

SEQ ID NO: 2466541 - RNA, 21 nt, Bordetella pertussis
gcccagcgagccggccagcgc

SEQ ID NO: 2466542 - RNA, 17 nt, Bordetella pertussis
gcccagcgagcugcgcu

SEQ ID NO: 2466543 - RNA, 15 nt, Bordetella pertussis
gcccagcgagcuggu

SEQ ID NO: 2466544 - RNA, 17 nt, Bordetella pertussis
gcccagcgagcugguga

SEQ ID NO: 2466545 - RNA, 17 nt, Bordetella pertussis
gcccagcgagucgacca

SEQ ID NO: 2466546 - RNA, 19 nt, Bordetella pertussis
gcccagcgcauaggacgcc

SEQ ID NO: 2466547 - RNA, 11 nt, Bordetella pertussis
gcccagcgcca

SEQ ID NO: 2466548 - RNA, 16 nt, Bordetella pertussis
gcccagcgccagcagc

SEQ ID NO: 2466549 - RNA, 17 nt, Bordetella pertussis
gcccagcgccagcagca

SEQ ID NO: 2466550 - RNA, 16 nt, Bordetella pertussis
gcccagcgccagggcc

SEQ ID NO: 2466551 - RNA, 22 nt, Bordetella pertussis
gcccagcgccaucaagagcacc

SEQ ID NO: 2466552 - RNA, 14 nt, Bordetella pertussis
gcccagcgccgccg

SEQ ID NO: 2466553 - RNA, 23 nt, Bordetella pertussis
gcccagcgccgccgacggcaugg

SEQ ID NO: 2466554 - RNA, 20 nt, Bordetella pertussis
gcccagcgcgaugucgccca

SEQ ID NO: 2466555 - RNA, 19 nt, Bordetella pertussis
gcccagcgcgauucccugg

SEQ ID NO: 2466556 - RNA, 12 nt, Bordetella pertussis
gcccagcgcgcc

SEQ ID NO: 2466557 - RNA, 13 nt, Bordetella pertussis
gcccagcgcgccg

SEQ ID NO: 2466558 - RNA, 16 nt, Bordetella pertussis
gcccagcgcgccgggg

SEQ ID NO: 2466559 - RNA, 13 nt, Bordetella pertussis
gcccagcgcggcc

SEQ ID NO: 2466560 - RNA, 15 nt, Bordetella pertussis
gcccagcgcggccuu

SEQ ID NO: 2466561 - RNA, 17 nt, Bordetella pertussis
gcccagcgcggcggcca

SEQ ID NO: 2466562 - RNA, 17 nt, Bordetella pertussis
gcccagcgcguccugca

SEQ ID NO: 2466563 - RNA, 14 nt, Bordetella pertussis
gcccagcgcgucgg

SEQ ID NO: 2466564 - RNA, 16 nt, Bordetella pertussis
gcccagcgcgucggcc

SEQ ID NO: 2466565 - RNA, 19 nt, Bordetella pertussis
gcccagcgcgucggccagc

SEQ ID NO: 2466566 - RNA, 20 nt, Bordetella pertussis
gcccagcgcgucggccagcg

SEQ ID NO: 2466567 - RNA, 21 nt, Bordetella pertussis
gcccagcgcgucggccagcgc

SEQ ID NO: 2466568 - RNA, 17 nt, Bordetella pertussis
gcccagcgcgugggcca

SEQ ID NO: 2466569 - RNA, 20 nt, Bordetella pertussis
gcccagcgcgugggccagca

SEQ ID NO: 2466570 - RNA, 17 nt, Bordetella pertussis
gcccagcggaauggggc

SEQ ID NO: 2466571 - RNA, 14 nt, Bordetella pertussis
gcccagcggcgccg

SEQ ID NO: 2466572 - RNA, 15 nt, Bordetella pertussis
gcccagcggcgccga

SEQ ID NO: 2466573 - RNA, 18 nt, Bordetella pertussis
gcccagcggcgccgacca

SEQ ID NO: 2466574 - RNA, 13 nt, Bordetella pertussis
gcccagcgucagc

SEQ ID NO: 2466575 - RNA, 22 nt, Bordetella pertussis
gcccagcguguaggcggccggc

SEQ ID NO: 2466576 - RNA, 23 nt, Bordetella pertussis
gcccagcguguaggcggccggcu

SEQ ID NO: 2466577 - RNA, 19 nt, Bordetella pertussis
gcccagcucauggcacagc

SEQ ID NO: 2466578 - RNA, 15 nt, Bordetella pertussis
gcccagcuccagcug

SEQ ID NO: 2466579 - RNA, 20 nt, Bordetella pertussis
gcccagcuccagcuggcgca

SEQ ID NO: 2466580 - RNA, 21 nt, Bordetella pertussis
gcccagcucugguccaggcgg

SEQ ID NO: 2466581 - RNA, 11 nt, Bordetella pertussis
gcccagcugca

SEQ ID NO: 2466582 - RNA, 16 nt, Bordetella pertussis
gcccagcuggcaccgc

SEQ ID NO: 2466583 - RNA, 20 nt, Bordetella pertussis
gcccagcuggcaccgcgacg

SEQ ID NO: 2466584 - RNA, 17 nt, Bordetella pertussis
gcccagcuggcgccccu

SEQ ID NO: 2466585 - RNA, 18 nt, Bordetella pertussis
gcccagcuggcgccccuu

SEQ ID NO: 2466586 - RNA, 23 nt, Bordetella pertussis
gcccagcuggcgccccuuccacc

SEQ ID NO: 2466587 - RNA, 16 nt, Bordetella pertussis
gcccagcugggccaca

SEQ ID NO: 2466588 - RNA, 17 nt, Bordetella pertussis
gcccagcugggccacag

SEQ ID NO: 2466589 - RNA, 16 nt, Bordetella pertussis
gcccagcugggcggcg

SEQ ID NO: 2466590 - RNA, 17 nt, Bordetella pertussis
gcccagcugggcggcgu

SEQ ID NO: 2466591 - RNA, 12 nt, Bordetella pertussis
gcccagcugucc

SEQ ID NO: 2466592 - RNA, 21 nt, Bordetella pertussis
gcccagcuguccaagcgcgug

SEQ ID NO: 2466593 - RNA, 18 nt, Bordetella pertussis
gcccagcuugaacaggca

SEQ ID NO: 2466594 - RNA, 19 nt, Bordetella pertussis
gcccaggaaaccggcgacc

SEQ ID NO: 2466595 - RNA, 14 nt, Bordetella pertussis
gcccaggaugcccu

SEQ ID NO: 2466596 - RNA, 19 nt, Bordetella pertussis
gcccaggaugcccuuggcg

SEQ ID NO: 2466597 - RNA, 14 nt, Bordetella pertussis
gcccaggauggaga

SEQ ID NO: 2466598 - RNA, 15 nt, Bordetella pertussis
gcccaggauggcgcc

SEQ ID NO: 2466599 - RNA, 18 nt, Bordetella pertussis
gcccaggauggcgccagc

SEQ ID NO: 2466600 - RNA, 21 nt, Bordetella pertussis
gcccaggauggcgccagcccg

SEQ ID NO: 2466601 - RNA, 10 nt, Bordetella pertussis
gcccaggcaa

SEQ ID NO: 2466602 - RNA, 18 nt, Bordetella pertussis
gcccaggcaaugcgcagg

SEQ ID NO: 2466603 - RNA, 19 nt, Bordetella pertussis
gcccaggcaaugcgcaggc

SEQ ID NO: 2466604 - RNA, 21 nt, Bordetella pertussis
gcccaggcaaugcgcaggccc

SEQ ID NO: 2466605 - RNA, 12 nt, Bordetella pertussis
gcccaggccagc

SEQ ID NO: 2466606 - RNA, 14 nt, Bordetella pertussis
gcccaggccagcca

SEQ ID NO: 2466607 - RNA, 17 nt, Bordetella pertussis
gcccaggccagcgccgc

SEQ ID NO: 2466608 - RNA, 21 nt, Bordetella pertussis
gcccaggccagcgccgcggcc

SEQ ID NO: 2466609 - RNA, 16 nt, Bordetella pertussis
gcccaggcccaccgca

SEQ ID NO: 2466610 - RNA, 16 nt, Bordetella pertussis
gcccaggcccacgccg

SEQ ID NO: 2466611 - RNA, 19 nt, Bordetella pertussis
gcccaggcccacgccgcgu

SEQ ID NO: 2466612 - RNA, 12 nt, Bordetella pertussis
gcccaggcccag

SEQ ID NO: 2466613 - RNA, 13 nt, Bordetella pertussis
gcccaggcccagc

SEQ ID NO: 2466614 - RNA, 14 nt, Bordetella pertussis
gcccaggcccagca

SEQ ID NO: 2466615 - RNA, 16 nt, Bordetella pertussis
gcccaggcccagcauc

SEQ ID NO: 2466616 - RNA, 14 nt, Bordetella pertussis
gcccaggcccagcg

SEQ ID NO: 2466617 - RNA, 15 nt, Bordetella pertussis
gcccaggcccaguuc

SEQ ID NO: 2466618 - RNA, 14 nt, Bordetella pertussis
gcccaggcccgcca

SEQ ID NO: 2466619 - RNA, 16 nt, Bordetella pertussis
gcccaggcccgccagg

SEQ ID NO: 2466620 - RNA, 19 nt, Bordetella pertussis
gcccaggcccgccagggcc

SEQ ID NO: 2466621 - RNA, 19 nt, Bordetella pertussis
gcccaggccgaaccacagc

SEQ ID NO: 2466622 - RNA, 20 nt, Bordetella pertussis
gcccaggccgaaccacagca

SEQ ID NO: 2466623 - RNA, 20 nt, Bordetella pertussis
gcccaggccgaucagcggau

SEQ ID NO: 2466624 - RNA, 14 nt, Bordetella pertussis
gcccaggccgccgg

SEQ ID NO: 2466625 - RNA, 13 nt, Bordetella pertussis
gcccaggccggcg

SEQ ID NO: 2466626 - RNA, 16 nt, Bordetella pertussis
gcccaggccggcgcgc

SEQ ID NO: 2466627 - RNA, 17 nt, Bordetella pertussis
gcccaggccggcgcgcu

SEQ ID NO: 2466628 - RNA, 16 nt, Bordetella pertussis
gcccaggccguggcgc

SEQ ID NO: 2466629 - RNA, 20 nt, Bordetella pertussis
gcccaggccguggcgcacca

SEQ ID NO: 2466630 - RNA, 18 nt, Bordetella pertussis
gcccaggcgacccagcac

SEQ ID NO: 2466631 - RNA, 19 nt, Bordetella pertussis
gcccaggcgacccagcacc

SEQ ID NO: 2466632 - RNA, 15 nt, Bordetella pertussis
gcccaggcgaugccc

SEQ ID NO: 2466633 - RNA, 17 nt, Bordetella pertussis
gcccaggcgaugcccag

SEQ ID NO: 2466634 - RNA, 20 nt, Bordetella pertussis
gcccaggcgaugcccagcgc

SEQ ID NO: 2466635 - RNA, 13 nt, Bordetella pertussis
gcccaggcgcagc

SEQ ID NO: 2466636 - RNA, 15 nt, Bordetella pertussis
gcccaggcgcagccc

SEQ ID NO: 2466637 - RNA, 15 nt, Bordetella pertussis
gcccaggcgcgcugg

SEQ ID NO: 2466638 - RNA, 21 nt, Bordetella pertussis
gcccaggcgcgcuggcgcucg

SEQ ID NO: 2466639 - RNA, 17 nt, Bordetella pertussis
gcccaggcggcccagcg

SEQ ID NO: 2466640 - RNA, 14 nt, Bordetella pertussis
gcccaggcgggcca

SEQ ID NO: 2466641 - RNA, 19 nt, Bordetella pertussis
gcccaggcgggccagguau

SEQ ID NO: 2466642 - RNA, 20 nt, Bordetella pertussis
gcccaggcgggcgugcugca

SEQ ID NO: 2466643 - RNA, 17 nt, Bordetella pertussis
gcccaggcugggccaga

SEQ ID NO: 2466644 - RNA, 18 nt, Bordetella pertussis
gcccagggcagcggccag

SEQ ID NO: 2466645 - RNA, 23 nt, Bordetella pertussis
gcccagggcagcggccagaucgg

SEQ ID NO: 2466646 - RNA, 14 nt, Bordetella pertussis
gcccagggccgcgc

SEQ ID NO: 2466647 - RNA, 16 nt, Bordetella pertussis
gcccagggccgcgccg

SEQ ID NO: 2466648 - RNA, 19 nt, Bordetella pertussis
gcccagggccgcgccgggg

SEQ ID NO: 2466649 - RNA, 18 nt, Bordetella pertussis
gcccaggggccggcgcgc

SEQ ID NO: 2466650 - RNA, 20 nt, Bordetella pertussis
gcccaggggccggcgcgccg

SEQ ID NO: 2466651 - RNA, 23 nt, Bordetella pertussis
gcccaggggccggcgcgccgcgc

SEQ ID NO: 2466652 - RNA, 17 nt, Bordetella pertussis
gcccagggucggaugcg

SEQ ID NO: 2466653 - RNA, 14 nt, Bordetella pertussis
gcccaggguggugg

SEQ ID NO: 2466654 - RNA, 15 nt, Bordetella pertussis
gcccagggugguggc

SEQ ID NO: 2466655 - RNA, 17 nt, Bordetella pertussis
gcccagguacaucaucc

SEQ ID NO: 2466656 - RNA, 20 nt, Bordetella pertussis
gcccagguacaucaucccca

SEQ ID NO: 2466657 - RNA, 16 nt, Bordetella pertussis
gcccaggucaucgcca

SEQ ID NO: 2466658 - RNA, 13 nt, Bordetella pertussis
gcccagguccagc

SEQ ID NO: 2466659 - RNA, 14 nt, Bordetella pertussis
gcccagguccagcg

SEQ ID NO: 2466660 - RNA, 17 nt, Bordetella pertussis
gcccaggucggacgcgc

SEQ ID NO: 2466661 - RNA, 13 nt, Bordetella pertussis
gcccggcugcucg

SEQ ID NO: 2466662 - RNA, 18 nt, Bordetella pertussis
gcccgggaaacucgcgca

SEQ ID NO: 2466663 - RNA, 12 nt, Bordetella pertussis
gcccgggcacca

SEQ ID NO: 2466664 - RNA, 18 nt, Bordetella pertussis
gcccgggcaccagguccu

SEQ ID NO: 2466665 - RNA, 22 nt, Bordetella pertussis
gcccgggcaccagguccuggcg

SEQ ID NO: 2466666 - RNA, 13 nt, Bordetella pertussis
gcccgggcagcac

SEQ ID NO: 2466667 - RNA, 15 nt, Bordetella pertussis
gcccgggcaggcuca

SEQ ID NO: 2466668 - RNA, 16 nt, Bordetella pertussis
gcccgggcaggcucag

SEQ ID NO: 2466669 - RNA, 17 nt, Bordetella pertussis
gcccgggcaggcucagc

SEQ ID NO: 2466670 - RNA, 21 nt, Bordetella pertussis
gcccgggcaggcucagcccgg

SEQ ID NO: 2466671 - RNA, 14 nt, Bordetella pertussis
gcccgggcaugcga

SEQ ID NO: 2466672 - RNA, 13 nt, Bordetella pertussis
gcccgggccggcu

SEQ ID NO: 2466673 - RNA, 19 nt, Bordetella pertussis
gcccgggcgagauggcgug

SEQ ID NO: 2466674 - RNA, 15 nt, Bordetella pertussis
gcccgggcgccggca

SEQ ID NO: 2466675 - RNA, 14 nt, Bordetella pertussis
gcccgggcgccugc

SEQ ID NO: 2466676 - RNA, 16 nt, Bordetella pertussis
gcccgggcgccugcgc

SEQ ID NO: 2466677 - RNA, 19 nt, Bordetella pertussis
gcccgggcgccugcgccac

SEQ ID NO: 2466678 - RNA, 12 nt, Bordetella pertussis
gcccgggcgcgc

SEQ ID NO: 2466679 - RNA, 13 nt, Bordetella pertussis
gcccgggcgcgcu

SEQ ID NO: 2466680 - RNA, 15 nt, Bordetella pertussis
gcccgggcgcgcugu

SEQ ID NO: 2466681 - RNA, 13 nt, Bordetella pertussis
gcccgggcgugcc

SEQ ID NO: 2466682 - RNA, 17 nt, Bordetella pertussis
gcccgggcgugccugcu

SEQ ID NO: 2466683 - RNA, 17 nt, Bordetella pertussis
gcccgggcugcugcacg

SEQ ID NO: 2466684 - RNA, 19 nt, Bordetella pertussis
gcccgggcuggccgccugc

SEQ ID NO: 2466685 - RNA, 16 nt, Bordetella pertussis
gcccggggccauggca

SEQ ID NO: 2466686 - RNA, 14 nt, Bordetella pertussis
gcccggggcggcgu

SEQ ID NO: 2466687 - RNA, 14 nt, Bordetella pertussis
gcccggggugugcc

SEQ ID NO: 2466688 - RNA, 19 nt, Bordetella pertussis
gcccgggguugccaagaug

SEQ ID NO: 2466689 - RNA, 20 nt, Bordetella pertussis
gcccgggguugggaucgcgc

SEQ ID NO: 2466690 - RNA, 21 nt, Bordetella pertussis
gcccgggguugggaucgcgcc

SEQ ID NO: 2466691 - RNA, 22 nt, Bordetella pertussis
gcccgggguugggaucgcgcca

SEQ ID NO: 2466692 - RNA, 17 nt, Bordetella pertussis
gcccgggugaucagucc

SEQ ID NO: 2466693 - RNA, 23 nt, Bordetella pertussis
gcccgggugccuguccccgccgg

SEQ ID NO: 2466694 - RNA, 16 nt, Bordetella pertussis
gcccggguuggcgucc

SEQ ID NO: 2466695 - RNA, 19 nt, Bordetella pertussis
gcccggguuggcguccagg

SEQ ID NO: 2466696 - RNA, 20 nt, Bordetella pertussis
gcccggguuggcguccaggc

SEQ ID NO: 2466697 - RNA, 22 nt, Bordetella pertussis
gcccggguuggcguccaggcgc

SEQ ID NO: 2466698 - RNA, 13 nt, Bordetella pertussis
gcccgguaggcca

SEQ ID NO: 2466699 - RNA, 22 nt, Bordetella pertussis
gcccgguaggccacgcgcgggc

SEQ ID NO: 2466700 - RNA, 21 nt, Bordetella pertussis
gcccggucugccacacgcggu

SEQ ID NO: 2466701 - RNA, 14 nt, Bordetella pertussis
gcccggugaucgag

SEQ ID NO: 2466702 - RNA, 15 nt, Bordetella pertussis
gcccggugcagccgc

SEQ ID NO: 2466703 - RNA, 19 nt, Bordetella pertussis
gcccggugcagccgccgca

SEQ ID NO: 2466704 - RNA, 21 nt, Bordetella pertussis
gcccggugcagccgccgcagg

SEQ ID NO: 2466705 - RNA, 18 nt, Bordetella pertussis
gcccggugccugccccug

SEQ ID NO: 2466706 - RNA, 17 nt, Bordetella pertussis
gcccgguucugcggcgc

SEQ ID NO: 2466707 - RNA, 18 nt, Bordetella pertussis
gcccgguucugcggcgcg

SEQ ID NO: 2466708 - RNA, 14 nt, Bordetella pertussis
gcccguagcagaug

SEQ ID NO: 2466709 - RNA, 15 nt, Bordetella pertussis
gcccguagcagaugc

SEQ ID NO: 2466710 - RNA, 14 nt, Bordetella pertussis
gcccgucagcggcg

SEQ ID NO: 2466711 - RNA, 16 nt, Bordetella pertussis
gcccgucagcggcgcg

SEQ ID NO: 2466712 - RNA, 21 nt, Bordetella pertussis
gcccgucagcggcgcgcccac

SEQ ID NO: 2466713 - RNA, 13 nt, Bordetella pertussis
gcccgucaggcgg

SEQ ID NO: 2466714 - RNA, 16 nt, Bordetella pertussis
gcccgucaugcgccgc

SEQ ID NO: 2466715 - RNA, 21 nt, Bordetella pertussis
gcccgucaugcgccgcagcac

SEQ ID NO: 2466716 - RNA, 22 nt, Bordetella pertussis
gcccgucaugcgccgcagcacc

SEQ ID NO: 2466717 - RNA, 20 nt, Bordetella pertussis
gcccgucaugggcggggcca

SEQ ID NO: 2466718 - RNA, 13 nt, Bordetella pertussis
gcccguccacggc

SEQ ID NO: 2466719 - RNA, 17 nt, Bordetella pertussis
gcccguccacggccugc

SEQ ID NO: 2466720 - RNA, 19 nt, Bordetella pertussis
gcccguccacggccugcgc

SEQ ID NO: 2466721 - RNA, 20 nt, Bordetella pertussis
gcccgucccgacccccggcc

SEQ ID NO: 2466722 - RNA, 22 nt, Bordetella pertussis
gcccgucccgacccccggcccg

SEQ ID NO: 2466723 - RNA, 13 nt, Bordetella pertussis
gcccguccgggcg

SEQ ID NO: 2466724 - RNA, 15 nt, Bordetella pertussis
gcccguccuggugca

SEQ ID NO: 2466725 - RNA, 15 nt, Bordetella pertussis
gcccgucgcgccagg

SEQ ID NO: 2466726 - RNA, 18 nt, Bordetella pertussis
gcccgucgcgccaggccg

SEQ ID NO: 2466727 - RNA, 19 nt, Bordetella pertussis
gcccgucgcgccaggccgg

SEQ ID NO: 2466728 - RNA, 18 nt, Bordetella pertussis
gcccgucuauggccugca

SEQ ID NO: 2466729 - RNA, 16 nt, Bordetella pertussis
gcccgucucgcgcgcc

SEQ ID NO: 2466730 - RNA, 23 nt, Bordetella pertussis
gcccgugcagaagcugaccaccg

SEQ ID NO: 2466731 - RNA, 14 nt, Bordetella pertussis
gcccgugccuugcc

SEQ ID NO: 2466732 - RNA, 13 nt, Bordetella pertussis
gcccgugcgcaac

SEQ ID NO: 2466733 - RNA, 19 nt, Bordetella pertussis
gcccgugcgcaacgcgcgc

SEQ ID NO: 2466734 - RNA, 11 nt, Bordetella pertussis
gcccgugcgcg

SEQ ID NO: 2466735 - RNA, 24 nt, Bordetella pertussis
gcccgugcgcgguucaggcuugca

SEQ ID NO: 2466736 - RNA, 17 nt, Bordetella pertussis
gcccgugcgggccugca

SEQ ID NO: 2466737 - RNA, 17 nt, Bordetella pertussis
gcccgugcgggugccug

SEQ ID NO: 2466738 - RNA, 21 nt, Bordetella pertussis
gcccgugcgggugccuguccc

SEQ ID NO: 2466739 - RNA, 19 nt, Bordetella pertussis
gcccgugcgugcgccuguc

SEQ ID NO: 2466740 - RNA, 20 nt, Bordetella pertussis
gcccgugcgugcgccugucc

SEQ ID NO: 2466741 - RNA, 21 nt, Bordetella pertussis
gcccgugcgugcgccuguccc

SEQ ID NO: 2466742 - RNA, 20 nt, Bordetella pertussis
gcccgugcuccagaacgcgc

SEQ ID NO: 2466743 - RNA, 22 nt, Bordetella pertussis
gcccgugcuccagaacgcgccg

SEQ ID NO: 2466744 - RNA, 22 nt, Bordetella pertussis
gcccguggacgaauacgcuggc

SEQ ID NO: 2466745 - RNA, 14 nt, Bordetella pertussis
gcccgugggcggcg

SEQ ID NO: 2466746 - RNA, 18 nt, Bordetella pertussis
gcccgugucggcaaccug

SEQ ID NO: 2466747 - RNA, 18 nt, Bordetella pertussis
gcccguucacgcgcagcg

SEQ ID NO: 2466748 - RNA, 17 nt, Bordetella pertussis
gcccguuccacaggcga

SEQ ID NO: 2466749 - RNA, 14 nt, Bordetella pertussis
gcccguugccgcgc

SEQ ID NO: 2466750 - RNA, 16 nt, Bordetella pertussis
gcccguugcggcgccu

SEQ ID NO: 2466751 - RNA, 17 nt, Bordetella pertussis
gcccguugcggcgccuc

SEQ ID NO: 2466752 - RNA, 16 nt, Bordetella pertussis
gcccguuggcaggcca

SEQ ID NO: 2466753 - RNA, 18 nt, Bordetella pertussis
gcccguuggcaggccagc

SEQ ID NO: 2466754 - RNA, 19 nt, Bordetella pertussis
gcccguuggcaggccagca

SEQ ID NO: 2466755 - RNA, 18 nt, Bordetella pertussis
gcccguuggcgucgagca

SEQ ID NO: 2466756 - RNA, 20 nt, Bordetella pertussis
gcccguuggcgucgagcacc

SEQ ID NO: 2466757 - RNA, 17 nt, Bordetella pertussis
gcccuagagcaugcggc

SEQ ID NO: 2466758 - RNA, 18 nt, Bordetella pertussis
gcccuagagcaugcggcg

SEQ ID NO: 2466759 - RNA, 13 nt, Bordetella pertussis
gcccucaguccag

SEQ ID NO: 2466760 - RNA, 14 nt, Bordetella pertussis
gcccucaguccagc

SEQ ID NO: 2466761 - RNA, 18 nt, Bordetella pertussis
gcccucaguccagcuggc

SEQ ID NO: 2466762 - RNA, 19 nt, Bordetella pertussis
gcccucaguccagcuggcc

SEQ ID NO: 2466763 - RNA, 21 nt, Bordetella pertussis
gcccucaguccagcuggcccu

SEQ ID NO: 2466764 - RNA, 21 nt, Bordetella pertussis
gcccucccagaaacuggcgcu

SEQ ID NO: 2466765 - RNA, 15 nt, Bordetella pertussis
gcccuccggcgccag

SEQ ID NO: 2466766 - RNA, 17 nt, Bordetella pertussis
gcccuccggcgccagca

SEQ ID NO: 2466767 - RNA, 14 nt, Bordetella pertussis
gcccuccucggcca

SEQ ID NO: 2466768 - RNA, 15 nt, Bordetella pertussis
gcccuccucggccag

SEQ ID NO: 2466769 - RNA, 17 nt, Bordetella pertussis
gcccuccucggccaggu

SEQ ID NO: 2466770 - RNA, 23 nt, Bordetella pertussis
gcccuccucggccaggucgcgca

SEQ ID NO: 2466771 - RNA, 18 nt, Bordetella pertussis
gcccucgauaugggcgcg

SEQ ID NO: 2466772 - RNA, 22 nt, Bordetella pertussis
gcccucgcccccgaaggccgcg

SEQ ID NO: 2466773 - RNA, 16 nt, Bordetella pertussis
gcccucgcccgugcgc

SEQ ID NO: 2466774 - RNA, 13 nt, Bordetella pertussis
gcccucgcgccac

SEQ ID NO: 2466775 - RNA, 16 nt, Bordetella pertussis
gcccucgcgccaccau

SEQ ID NO: 2466776 - RNA, 14 nt, Bordetella pertussis
gccccagcagcacg

SEQ ID NO: 2466777 - RNA, 16 nt, Bordetella pertussis
gccccagcagcacgcc

SEQ ID NO: 2466778 - RNA, 19 nt, Bordetella pertussis
gccccagcagcacgcccag

SEQ ID NO: 2466779 - RNA, 15 nt, Bordetella pertussis
gccccagcagcagcg

SEQ ID NO: 2466780 - RNA, 17 nt, Bordetella pertussis
gccccagcgccagcgug

SEQ ID NO: 2466781 - RNA, 15 nt, Bordetella pertussis
gccccagcgcccagg

SEQ ID NO: 2466782 - RNA, 16 nt, Bordetella pertussis
gccccagcgcccaggc

SEQ ID NO: 2466783 - RNA, 17 nt, Bordetella pertussis
gccccagcgccgcgagc

SEQ ID NO: 2466784 - RNA, 14 nt, Bordetella pertussis
gccccagcguccag

SEQ ID NO: 2466785 - RNA, 19 nt, Bordetella pertussis
gccccagcguccaggcggc

SEQ ID NO: 2466786 - RNA, 20 nt, Bordetella pertussis
gccccagcguccaggcggcc

SEQ ID NO: 2466787 - RNA, 21 nt, Bordetella pertussis
gccccagcguccaggcggcca

SEQ ID NO: 2466788 - RNA, 19 nt, Bordetella pertussis
gccccagcuugucggccgc

SEQ ID NO: 2466789 - RNA, 21 nt, Bordetella pertussis
gccccaggaaaccgaccugau

SEQ ID NO: 2466790 - RNA, 20 nt, Bordetella pertussis
gccccaggaugcgcaccggc

SEQ ID NO: 2466791 - RNA, 15 nt, Bordetella pertussis
gccccaggcaggcgg

SEQ ID NO: 2466792 - RNA, 20 nt, Bordetella pertussis
gccccaggcaggcgggcccg

SEQ ID NO: 2466793 - RNA, 15 nt, Bordetella pertussis
gccccaggcgucggc

SEQ ID NO: 2466794 - RNA, 16 nt, Bordetella pertussis
gccccaggcgucggcg

SEQ ID NO: 2466795 - RNA, 18 nt, Bordetella pertussis
gccccaggcgugaacgcc

SEQ ID NO: 2466796 - RNA, 22 nt, Bordetella pertussis
gccccaggcgugaacgccccgg

SEQ ID NO: 2466797 - RNA, 17 nt, Bordetella pertussis
gccccagguccgccggc

SEQ ID NO: 2466798 - RNA, 23 nt, Bordetella pertussis
gccccagguccgccggcacgcgc

SEQ ID NO: 2466799 - RNA, 17 nt, Bordetella pertussis
gccccaguccaggccgg

SEQ ID NO: 2466800 - RNA, 18 nt, Bordetella pertussis
gccccaguccaggccggc

SEQ ID NO: 2466801 - RNA, 23 nt, Bordetella pertussis
gccccaguccaggccggccugca

SEQ ID NO: 2466802 - RNA, 16 nt, Bordetella pertussis
gccccaguugcgcguc

SEQ ID NO: 2466803 - RNA, 20 nt, Bordetella pertussis
gccccaucaacgacaaagcc

SEQ ID NO: 2466804 - RNA, 13 nt, Bordetella pertussis
gccccaucaccau

SEQ ID NO: 2466805 - RNA, 21 nt, Bordetella pertussis
gccccaucaccauggccgaca

SEQ ID NO: 2466806 - RNA, 23 nt, Bordetella pertussis
gccccaucaccauggccgacagc

SEQ ID NO: 2466807 - RNA, 17 nt, Bordetella pertussis
gccccaucauguuguag

SEQ ID NO: 2466808 - RNA, 19 nt, Bordetella pertussis
gccccauccacggcgccau

SEQ ID NO: 2466809 - RNA, 21 nt, Bordetella pertussis
gccccauccacggcgccaugc

SEQ ID NO: 2466810 - RNA, 13 nt, Bordetella pertussis
gccccaugcgcgg

SEQ ID NO: 2466811 - RNA, 19 nt, Bordetella pertussis
gccccaugcgcggcacguc

SEQ ID NO: 2466812 - RNA, 15 nt, Bordetella pertussis
gccccauggcaugca

SEQ ID NO: 2466813 - RNA, 22 nt, Bordetella pertussis
gccccauggcaugcaccgcgug

SEQ ID NO: 2466814 - RNA, 17 nt, Bordetella pertussis
gccccauggccugggug

SEQ ID NO: 2466815 - RNA, 14 nt, Bordetella pertussis
gccccauugccucg

SEQ ID NO: 2466816 - RNA, 20 nt, Bordetella pertussis
gccccauugcgggugggcau

SEQ ID NO: 2466817 - RNA, 19 nt, Bordetella pertussis
gccccauugggacgccagc

SEQ ID NO: 2466818 - RNA, 20 nt, Bordetella pertussis
gccccauugggacgccagcc

SEQ ID NO: 2466819 - RNA, 21 nt, Bordetella pertussis
gccccauugggacgccagccc

SEQ ID NO: 2466820 - RNA, 22 nt, Bordetella pertussis
gcccccacgcugcgcccgcuau

SEQ ID NO: 2466821 - RNA, 17 nt, Bordetella pertussis
gcccccagcacgguugc

SEQ ID NO: 2466822 - RNA, 12 nt, Bordetella pertussis
gcccccagcagc

SEQ ID NO: 2466823 - RNA, 13 nt, Bordetella pertussis
gcccccagcagcg

SEQ ID NO: 2466824 - RNA, 16 nt, Bordetella pertussis
gcccccagcagcgagg

SEQ ID NO: 2466825 - RNA, 15 nt, Bordetella pertussis
gcccccagcccauag

SEQ ID NO: 2466826 - RNA, 12 nt, Bordetella pertussis
gcccccagcgcc

SEQ ID NO: 2466827 - RNA, 13 nt, Bordetella pertussis
gcccccagcgcgc

SEQ ID NO: 2466828 - RNA, 19 nt, Bordetella pertussis
gcccccagcgcgccugccc

SEQ ID NO: 2466829 - RNA, 20 nt, Bordetella pertussis
gcccccagcgcgccugccca

SEQ ID NO: 2466830 - RNA, 16 nt, Bordetella pertussis
gcccccauguccaggu

SEQ ID NO: 2466831 - RNA, 14 nt, Bordetella pertussis
gccccccgaggcca

SEQ ID NO: 2466832 - RNA, 16 nt, Bordetella pertussis
gccccccgagggggcu

SEQ ID NO: 2466833 - RNA, 23 nt, Bordetella pertussis
gccccccgagggggcuuuuugcc

SEQ ID NO: 2466834 - RNA, 14 nt, Bordetella pertussis
gccccccggcgcgg

SEQ ID NO: 2466835 - RNA, 17 nt, Bordetella pertussis
gccccccguaggcggcc

SEQ ID NO: 2466836 - RNA, 18 nt, Bordetella pertussis
gccccccguaggcggccc

SEQ ID NO: 2466837 - RNA, 22 nt, Bordetella pertussis
gccccccguaggcggcccaggc

SEQ ID NO: 2466838 - RNA, 15 nt, Bordetella pertussis
gcccccgaaggccgc

SEQ ID NO: 2466839 - RNA, 19 nt, Bordetella pertussis
gcccccgaaggccgcgccu

SEQ ID NO: 2466840 - RNA, 22 nt, Bordetella pertussis
gcccccgauccccugcccgccu

SEQ ID NO: 2466841 - RNA, 16 nt, Bordetella pertussis
gcccccgccgcacggg

SEQ ID NO: 2466842 - RNA, 16 nt, Bordetella pertussis
gcccccgccgccaugc

SEQ ID NO: 2466843 - RNA, 16 nt, Bordetella pertussis
gcccccgcgccgcgca

SEQ ID NO: 2466844 - RNA, 19 nt, Bordetella pertussis
gcccccgcgcugcgcccgc

SEQ ID NO: 2466845 - RNA, 15 nt, Bordetella pertussis
gcccccgcggcgccc

SEQ ID NO: 2466846 - RNA, 16 nt, Bordetella pertussis
gcccccgcggcgcccc

SEQ ID NO: 2466847 - RNA, 23 nt, Bordetella pertussis
gcccccucaacgguaucgcgucg

SEQ ID NO: 2466848 - RNA, 13 nt, Bordetella pertussis
gcccccugcgggg

SEQ ID NO: 2466849 - RNA, 22 nt, Bordetella pertussis
gcccccuuguagggaaucguca

SEQ ID NO: 2466850 - RNA, 13 nt, Bordetella pertussis
gccccgacgcgcu

SEQ ID NO: 2466851 - RNA, 15 nt, Bordetella pertussis
gccccgacgcgcuuc

SEQ ID NO: 2466852 - RNA, 16 nt, Bordetella pertussis
gccccgacgcgcuucc

SEQ ID NO: 2466853 - RNA, 17 nt, Bordetella pertussis
gccccgacgcgcuucca

SEQ ID NO: 2466854 - RNA, 16 nt, Bordetella pertussis
gccccgacgcggucgc

SEQ ID NO: 2466855 - RNA, 23 nt, Bordetella pertussis
gccccgaucagcaagggccccag

SEQ ID NO: 2466856 - RNA, 16 nt, Bordetella pertussis
gccccgaucggcgccg

SEQ ID NO: 2466857 - RNA, 20 nt, Bordetella pertussis
gccccgaucggcgccgcgcg

SEQ ID NO: 2466858 - RNA, 24 nt, Bordetella pertussis
gccccgaugauggauucgcgccgg

SEQ ID NO: 2466859 - RNA, 20 nt, Bordetella pertussis
gccccgcaaggggccggcgc

SEQ ID NO: 2466860 - RNA, 22 nt, Bordetella pertussis
gccccgcaaggggccggcgccg

SEQ ID NO: 2466861 - RNA, 17 nt, Bordetella pertussis
gccccgcacgaucagca

SEQ ID NO: 2466862 - RNA, 18 nt, Bordetella pertussis
gccccgcacgaucagcau

SEQ ID NO: 2466863 - RNA, 17 nt, Bordetella pertussis
gccccgcagggcccgca

SEQ ID NO: 2466864 - RNA, 14 nt, Bordetella pertussis
gccccgcaguuuga

SEQ ID NO: 2466865 - RNA, 20 nt, Bordetella pertussis
gccccgcaugcgcagacugu

SEQ ID NO: 2466866 - RNA, 19 nt, Bordetella pertussis
gccccgccacgucgccggc

SEQ ID NO: 2466867 - RNA, 15 nt, Bordetella pertussis
gccccgccagggcgg

SEQ ID NO: 2466868 - RNA, 20 nt, Bordetella pertussis
gccccgccagggcggggccg

SEQ ID NO: 2466869 - RNA, 15 nt, Bordetella pertussis
gccccgcccgcguca

SEQ ID NO: 2466870 - RNA, 20 nt, Bordetella pertussis
gccccgccggaggcacuccg

SEQ ID NO: 2466871 - RNA, 17 nt, Bordetella pertussis
gccccgccgggccgcgc

SEQ ID NO: 2466872 - RNA, 19 nt, Bordetella pertussis
gccccgccgggccgcgccc

SEQ ID NO: 2466873 - RNA, 14 nt, Bordetella pertussis
gccccgccucgacg

SEQ ID NO: 2466874 - RNA, 15 nt, Bordetella pertussis
gccccgccugcgcca

SEQ ID NO: 2466875 - RNA, 20 nt, Bordetella pertussis
gccccgcgacccagaacccg

SEQ ID NO: 2466876 - RNA, 22 nt, Bordetella pertussis
gccccgcgaggggcccuugugc

SEQ ID NO: 2466877 - RNA, 13 nt, Bordetella pertussis
gccccgcggccgc

SEQ ID NO: 2466878 - RNA, 22 nt, Bordetella pertussis
gccccgcggccgcggucagcca

SEQ ID NO: 2466879 - RNA, 13 nt, Bordetella pertussis
gccccgcgucggc

SEQ ID NO: 2466880 - RNA, 16 nt, Bordetella pertussis
gccccgcgucggcgaa

SEQ ID NO: 2466881 - RNA, 17 nt, Bordetella pertussis
gccccgcgucggcgaag

SEQ ID NO: 2466882 - RNA, 18 nt, Bordetella pertussis
gccccgcgucggcgaagc

SEQ ID NO: 2466883 - RNA, 20 nt, Bordetella pertussis
gccccgcuacguguccugcc

SEQ ID NO: 2466884 - RNA, 22 nt, Bordetella pertussis
gccccgcuacguguccugccgg

SEQ ID NO: 2466885 - RNA, 23 nt, Bordetella pertussis
gccccgcuacguguccugccggg

SEQ ID NO: 2466886 - RNA, 16 nt, Bordetella pertussis
gccccgcuggccgucg

SEQ ID NO: 2466887 - RNA, 23 nt, Bordetella pertussis
gccccgcuggccgucgccgcccu

SEQ ID NO: 2466888 - RNA, 17 nt, Bordetella pertussis
gccccgcuucgggccgg

SEQ ID NO: 2466889 - RNA, 18 nt, Bordetella pertussis
gccccgcuucgggccgga

SEQ ID NO: 2466890 - RNA, 20 nt, Bordetella pertussis
gccccgcuucgggccggaug

SEQ ID NO: 2466891 - RNA, 13 nt, Bordetella pertussis
gccccggcccggc

SEQ ID NO: 2466892 - RNA, 15 nt, Bordetella pertussis
gccccggcccggcgg

SEQ ID NO: 2466893 - RNA, 16 nt, Bordetella pertussis
gccccggcccggcggg

SEQ ID NO: 2466894 - RNA, 13 nt, Bordetella pertussis
gccccggccgccc

SEQ ID NO: 2466895 - RNA, 11 nt, Bordetella pertussis
gccccggccgg

SEQ ID NO: 2466896 - RNA, 19 nt, Bordetella pertussis
gccccggccgguuccugca

SEQ ID NO: 2466897 - RNA, 13 nt, Bordetella pertussis
gccccggccuccc

SEQ ID NO: 2466898 - RNA, 22 nt, Bordetella pertussis
gccccggccucccggaccagca

SEQ ID NO: 2466899 - RNA, 17 nt, Bordetella pertussis
gccccggccucgcggcg

SEQ ID NO: 2466900 - RNA, 13 nt, Bordetella pertussis
gccccggcgcauc

SEQ ID NO: 2466901 - RNA, 13 nt, Bordetella pertussis
gccccggcgcgca

SEQ ID NO: 2466902 - RNA, 15 nt, Bordetella pertussis
gccccggcgcgcagc

SEQ ID NO: 2466903 - RNA, 16 nt, Bordetella pertussis
gccccggcgcgcagcg

SEQ ID NO: 2466904 - RNA, 17 nt, Bordetella pertussis
gccccggcgcgcagcgc

SEQ ID NO: 2466905 - RNA, 19 nt, Bordetella pertussis
gccccggcgcgcagcgccu

SEQ ID NO: 2466906 - RNA, 20 nt, Bordetella pertussis
gccccggcgcgcagcgccug

SEQ ID NO: 2466907 - RNA, 22 nt, Bordetella pertussis
gccccggcgcgcagcgccugca

SEQ ID NO: 2466908 - RNA, 14 nt, Bordetella pertussis
gccccggcgcgccg

SEQ ID NO: 2466909 - RNA, 16 nt, Bordetella pertussis
gccccggcgcgccggc

SEQ ID NO: 2466910 - RNA, 17 nt, Bordetella pertussis
gccccggcgcgccggcc

SEQ ID NO: 2466911 - RNA, 18 nt, Bordetella pertussis
gccccggcgcgccggccg

SEQ ID NO: 2466912 - RNA, 13 nt, Bordetella pertussis
gccccggcgcggc

SEQ ID NO: 2466913 - RNA, 15 nt, Bordetella pertussis
gccccggcgcggcgc

SEQ ID NO: 2466914 - RNA, 22 nt, Bordetella pertussis
gccccggcgcggcgcgcgccgu

SEQ ID NO: 2466915 - RNA, 18 nt, Bordetella pertussis
gccccggcucccgcgcca

SEQ ID NO: 2466916 - RNA, 22 nt, Bordetella pertussis
gccccgggcggguugugcccgc

SEQ ID NO: 2466917 - RNA, 19 nt, Bordetella pertussis
gccccgggugcagguccgg

SEQ ID NO: 2466918 - RNA, 18 nt, Bordetella pertussis
gccccgguagucgccggc

SEQ ID NO: 2466919 - RNA, 20 nt, Bordetella pertussis
gccccgguagucgccggcuu

SEQ ID NO: 2466920 - RNA, 18 nt, Bordetella pertussis
gccccgucaucgggugcg

SEQ ID NO: 2466921 - RNA, 22 nt, Bordetella pertussis
gccccgucaucgggugcggcgc

SEQ ID NO: 2466922 - RNA, 21 nt, Bordetella pertussis
gccccguccuuacuugcgcac

SEQ ID NO: 2466923 - RNA, 13 nt, Bordetella pertussis
gccccgucggccg

SEQ ID NO: 2466924 - RNA, 22 nt, Bordetella pertussis
gccccgugccgcggcgcggccc

SEQ ID NO: 2466925 - RNA, 16 nt, Bordetella pertussis
gccccguugucgccgc

SEQ ID NO: 2466926 - RNA, 14 nt, Bordetella pertussis
gccccuagcgccgc

SEQ ID NO: 2466927 - RNA, 16 nt, Bordetella pertussis
gccccuagcgccgcgc

SEQ ID NO: 2466928 - RNA, 19 nt, Bordetella pertussis
gccccuagcgccgcgccag

SEQ ID NO: 2466929 - RNA, 14 nt, Bordetella pertussis
gccccuccggcgcc

SEQ ID NO: 2466930 - RNA, 15 nt, Bordetella pertussis
gccccuccggcgccg

SEQ ID NO: 2466931 - RNA, 16 nt, Bordetella pertussis
gccccuccggcgccgc

SEQ ID NO: 2466932 - RNA, 13 nt, Bordetella pertussis
gccccuccggguc

SEQ ID NO: 2466933 - RNA, 21 nt, Bordetella pertussis
gccccucgcggaugaccuggu

SEQ ID NO: 2466934 - RNA, 21 nt, Bordetella pertussis
gccccucggcgggcuugucgc

SEQ ID NO: 2466935 - RNA, 22 nt, Bordetella pertussis
gccccugcccgucuauggccug

SEQ ID NO: 2466936 - RNA, 14 nt, Bordetella pertussis
gccccugcggggac

SEQ ID NO: 2466937 - RNA, 12 nt, Bordetella pertussis
gccccuugccca

SEQ ID NO: 2466938 - RNA, 16 nt, Bordetella pertussis
gcccgaaacgcgcagc

SEQ ID NO: 2466939 - RNA, 20 nt, Bordetella pertussis
gcccgaaacgcgcagcaccg

SEQ ID NO: 2466940 - RNA, 21 nt, Bordetella pertussis
gcccgaaacgcgcagcaccgg

SEQ ID NO: 2466941 - RNA, 15 nt, Bordetella pertussis
gcccgaacagaaggc

SEQ ID NO: 2466942 - RNA, 17 nt, Bordetella pertussis
gcccgaacagaaggcgu

SEQ ID NO: 2466943 - RNA, 20 nt, Bordetella pertussis
gcccgaaccggcaucccugc

SEQ ID NO: 2466944 - RNA, 16 nt, Bordetella pertussis
gcccgaacggcccauc

SEQ ID NO: 2466945 - RNA, 21 nt, Bordetella pertussis
gcccgaagauuuccucgcgca

SEQ ID NO: 2466946 - RNA, 15 nt, Bordetella pertussis
gcccgaagcgcagca

SEQ ID NO: 2466947 - RNA, 16 nt, Bordetella pertussis
gcccgaagcgcagcac

SEQ ID NO: 2466948 - RNA, 20 nt, Bordetella pertussis
gcccgaagcgcagcaccagg

SEQ ID NO: 2466949 - RNA, 22 nt, Bordetella pertussis
gcccgaagcgcagcaccagguc

SEQ ID NO: 2466950 - RNA, 14 nt, Bordetella pertussis
gcccgaagcggccc

SEQ ID NO: 2466951 - RNA, 17 nt, Bordetella pertussis
gcccgaaggcagcggca

SEQ ID NO: 2466952 - RNA, 18 nt, Bordetella pertussis
gcccgaaggcagcggcac

SEQ ID NO: 2466953 - RNA, 19 nt, Bordetella pertussis
gcccgaaggcagcggcaca

SEQ ID NO: 2466954 - RNA, 22 nt, Bordetella pertussis
gcccgacaccuggacccgcucg

SEQ ID NO: 2466955 - RNA, 16 nt, Bordetella pertussis
gcccgacagcacgccc

SEQ ID NO: 2466956 - RNA, 14 nt, Bordetella pertussis
gcccgacaggaaca

SEQ ID NO: 2466957 - RNA, 15 nt, Bordetella pertussis
gcccgacaggaacau

SEQ ID NO: 2466958 - RNA, 17 nt, Bordetella pertussis
gcccgaccgcaugggcg

SEQ ID NO: 2466959 - RNA, 16 nt, Bordetella pertussis
gcccgaccugcuggcg

SEQ ID NO: 2466960 - RNA, 18 nt, Bordetella pertussis
gcccgaccugcuggcgcg

SEQ ID NO: 2466961 - RNA, 19 nt, Bordetella pertussis
gcccgaccugcuggcgcgc

SEQ ID NO: 2466962 - RNA, 23 nt, Bordetella pertussis
gcccgacgacgacuacuggcaac

SEQ ID NO: 2466963 - RNA, 18 nt, Bordetella pertussis
gcccgacgaggagccggc

SEQ ID NO: 2466964 - RNA, 14 nt, Bordetella pertussis
gcccgacgccgcgc

SEQ ID NO: 2466965 - RNA, 15 nt, Bordetella pertussis
gcccgacgcgaggca

SEQ ID NO: 2466966 - RNA, 20 nt, Bordetella pertussis
gcccgacgcuguaacaacac

SEQ ID NO: 2466967 - RNA, 13 nt, Bordetella pertussis
gcccgacggccag

SEQ ID NO: 2466968 - RNA, 14 nt, Bordetella pertussis
gcccgacggccagc

SEQ ID NO: 2466969 - RNA, 14 nt, Bordetella pertussis
gcccgacggcgccg

SEQ ID NO: 2466970 - RNA, 22 nt, Bordetella pertussis
gcccgacggcgccgauccggcg

SEQ ID NO: 2466971 - RNA, 14 nt, Bordetella pertussis
gcccgacggcgcgc

SEQ ID NO: 2466972 - RNA, 16 nt, Bordetella pertussis
gcccgacggcgcgccc

SEQ ID NO: 2466973 - RNA, 17 nt, Bordetella pertussis
gcccgacggcgcgcccg

SEQ ID NO: 2466974 - RNA, 23 nt, Bordetella pertussis
gcccgacggcgcgcccgccgcgu

SEQ ID NO: 2466975 - RNA, 18 nt, Bordetella pertussis
gcccgacuuggugggcac

SEQ ID NO: 2466976 - RNA, 20 nt, Bordetella pertussis
gcccgacuuggugggcaccu

SEQ ID NO: 2466977 - RNA, 22 nt, Bordetella pertussis
gcccgagaagggcuugaccagg

SEQ ID NO: 2466978 - RNA, 16 nt, Bordetella pertussis
gcccgagaccgcccgc

SEQ ID NO: 2466979 - RNA, 15 nt, Bordetella pertussis
gcccgagagcugcgu

SEQ ID NO: 2466980 - RNA, 18 nt, Bordetella pertussis
gcccgagagcugcgucuu

SEQ ID NO: 2466981 - RNA, 14 nt, Bordetella pertussis
gcccgagauggcgc

SEQ ID NO: 2466982 - RNA, 19 nt, Bordetella pertussis
gcccgagauggcgcaggcg

SEQ ID NO: 2466983 - RNA, 22 nt, Bordetella pertussis
gcccgagauggcgcaggcgcgc

SEQ ID NO: 2466984 - RNA, 13 nt, Bordetella pertussis
gcccgagcgccac

SEQ ID NO: 2466985 - RNA, 13 nt, Bordetella pertussis
gcccgagcggcgc

SEQ ID NO: 2466986 - RNA, 15 nt, Bordetella pertussis
gcccgagcggcgcca

SEQ ID NO: 2466987 - RNA, 16 nt, Bordetella pertussis
gcccgagcggcgccag

SEQ ID NO: 2466988 - RNA, 17 nt, Bordetella pertussis
gcccgagcggcgccagu

SEQ ID NO: 2466989 - RNA, 19 nt, Bordetella pertussis
gcccgagcggcgccagucg

SEQ ID NO: 2466990 - RNA, 22 nt, Bordetella pertussis
gcccgagcggcgccagucgcgc

SEQ ID NO: 2466991 - RNA, 23 nt, Bordetella pertussis
gcccgagcggcgccagucgcgca

SEQ ID NO: 2466992 - RNA, 24 nt, Bordetella pertussis
gcccgagcggcgccagucgcgcag

SEQ ID NO: 2466993 - RNA, 15 nt, Bordetella pertussis
gcccgagcuggccgg

SEQ ID NO: 2466994 - RNA, 20 nt, Bordetella pertussis
gcccgagcuggccggcgacu

SEQ ID NO: 2466995 - RNA, 18 nt, Bordetella pertussis
gcccgaggcacaaggccg

SEQ ID NO: 2466996 - RNA, 18 nt, Bordetella pertussis
gcccgaggcgcgcagcac

SEQ ID NO: 2466997 - RNA, 15 nt, Bordetella pertussis
gcccgaggcggcgcg

SEQ ID NO: 2466998 - RNA, 17 nt, Bordetella pertussis
gcccgaggcggcgcggg

SEQ ID NO: 2466999 - RNA, 17 nt, Bordetella pertussis
gcccgagugggaagacu

SEQ ID NO: 2467000 - RNA, 20 nt, Bordetella pertussis
gcccgauaugcagccgcacc

SEQ ID NO: 2467001 - RNA, 15 nt, Bordetella pertussis
gcccgaucgacggcc

SEQ ID NO: 2467002 - RNA, 18 nt, Bordetella pertussis
gcccgaucgacggccgca

SEQ ID NO: 2467003 - RNA, 15 nt, Bordetella pertussis
gcccgaucgccggug

SEQ ID NO: 2467004 - RNA, 23 nt, Bordetella pertussis
gcccgaucgccggugaugcgaug

SEQ ID NO: 2467005 - RNA, 19 nt, Bordetella pertussis
gcccaggucggacgcgccg

SEQ ID NO: 2467006 - RNA, 22 nt, Bordetella pertussis
gcccaggucggacgcgccgggc

SEQ ID NO: 2467007 - RNA, 18 nt, Bordetella pertussis
gcccagguugaaggccgc

SEQ ID NO: 2467008 - RNA, 19 nt, Bordetella pertussis
gcccagguugaaggccgcg

SEQ ID NO: 2467009 - RNA, 17 nt, Bordetella pertussis
gcccagguugcggccgc

SEQ ID NO: 2467010 - RNA, 18 nt, Bordetella pertussis
gcccagguugcggccgcc

SEQ ID NO: 2467011 - RNA, 19 nt, Bordetella pertussis
gcccagguugcggccgcca

SEQ ID NO: 2467012 - RNA, 15 nt, Bordetella pertussis
gcccaguacgaugcc

SEQ ID NO: 2467013 - RNA, 20 nt, Bordetella pertussis
gcccaguacgaugccgucga

SEQ ID NO: 2467014 - RNA, 15 nt, Bordetella pertussis
gcccaguacggccug

SEQ ID NO: 2467015 - RNA, 19 nt, Bordetella pertussis
gcccaguacggccugcaug

SEQ ID NO: 2467016 - RNA, 21 nt, Bordetella pertussis
gcccaguauggugaccggcgu

SEQ ID NO: 2467017 - RNA, 15 nt, Bordetella pertussis
gcccaguccagggug

SEQ ID NO: 2467018 - RNA, 13 nt, Bordetella pertussis
gcccagucccagg

SEQ ID NO: 2467019 - RNA, 15 nt, Bordetella pertussis
gcccagucguccagc

SEQ ID NO: 2467020 - RNA, 16 nt, Bordetella pertussis
gcccagucguccagca

SEQ ID NO: 2467021 - RNA, 17 nt, Bordetella pertussis
gcccagugucucgacca

SEQ ID NO: 2467022 - RNA, 17 nt, Bordetella pertussis
gcccaguuccacgcggc

SEQ ID NO: 2467023 - RNA, 19 nt, Bordetella pertussis
gcccaguuccacgcggccg

SEQ ID NO: 2467024 - RNA, 17 nt, Bordetella pertussis
gcccaguucgcgcagca

SEQ ID NO: 2467025 - RNA, 19 nt, Bordetella pertussis
gcccaguucgcgcagcagc

SEQ ID NO: 2467026 - RNA, 20 nt, Bordetella pertussis
gcccaguucgcgcagcagcu

SEQ ID NO: 2467027 - RNA, 16 nt, Bordetella pertussis
gcccaguucgcggccg

SEQ ID NO: 2467028 - RNA, 18 nt, Bordetella pertussis
gcccaguucgcggccggc

SEQ ID NO: 2467029 - RNA, 19 nt, Bordetella pertussis
gcccaguucgcggccggcc

SEQ ID NO: 2467030 - RNA, 16 nt, Bordetella pertussis
gcccaguucggcgacg

SEQ ID NO: 2467031 - RNA, 21 nt, Bordetella pertussis
gcccaguucgucccagggggu

SEQ ID NO: 2467032 - RNA, 17 nt, Bordetella pertussis
gcccaguugaaucggcg

SEQ ID NO: 2467033 - RNA, 20 nt, Bordetella pertussis
gcccaguugaaucggcgcga

SEQ ID NO: 2467034 - RNA, 22 nt, Bordetella pertussis
gcccaguugaaucggcgcgagc

SEQ ID NO: 2467035 - RNA, 16 nt, Bordetella pertussis
gcccaguugcuggccc

SEQ ID NO: 2467036 - RNA, 20 nt, Bordetella pertussis
gcccaguugcuggcccagga

SEQ ID NO: 2467037 - RNA, 22 nt, Bordetella pertussis
gcccaguuuuuccuucagcagc

SEQ ID NO: 2467038 - RNA, 14 nt, Bordetella pertussis
gcccauaugccgcc

SEQ ID NO: 2467039 - RNA, 12 nt, Bordetella pertussis
gcccaucaggcc

SEQ ID NO: 2467040 - RNA, 22 nt, Bordetella pertussis
gcccaucaggugaaacagcagc

SEQ ID NO: 2467041 - RNA, 23 nt, Bordetella pertussis
gcccaucaggugaaacagcagcg

SEQ ID NO: 2467042 - RNA, 18 nt, Bordetella pertussis
gcccaucaggugggccga

SEQ ID NO: 2467043 - RNA, 21 nt, Bordetella pertussis
gcccaucaggugggccgagcc

SEQ ID NO: 2467044 - RNA, 16 nt, Bordetella pertussis
gcccauccaucuggug

SEQ ID NO: 2467045 - RNA, 22 nt, Bordetella pertussis
gcccauccaucugguggugccg

SEQ ID NO: 2467046 - RNA, 20 nt, Bordetella pertussis
gcccaucgcggucaucggcg

SEQ ID NO: 2467047 - RNA, 17 nt, Bordetella pertussis
gcccaucucggccgcgg

SEQ ID NO: 2467048 - RNA, 20 nt, Bordetella pertussis
gcccaucugguugagcagca

SEQ ID NO: 2467049 - RNA, 19 nt, Bordetella pertussis
gcccaucuguacggccggc

SEQ ID NO: 2467050 - RNA, 21 nt, Bordetella pertussis
gcccaucuguacggccggcuc

SEQ ID NO: 2467051 - RNA, 22 nt, Bordetella pertussis
gcccaugaacaggcacgacgcg

SEQ ID NO: 2467052 - RNA, 16 nt, Bordetella pertussis
gcccaugaaggcggcc

SEQ ID NO: 2467053 - RNA, 23 nt, Bordetella pertussis
gcccaugaaggcggccagcaugc

SEQ ID NO: 2467054 - RNA, 21 nt, Bordetella pertussis
gcccaugacgaccuugcggcc

SEQ ID NO: 2467055 - RNA, 19 nt, Bordetella pertussis
gcccaugauggugccggug

SEQ ID NO: 2467056 - RNA, 16 nt, Bordetella pertussis
gcccaugccgcccgcc

SEQ ID NO: 2467057 - RNA, 13 nt, Bordetella pertussis
gcccaugccgccg

SEQ ID NO: 2467058 - RNA, 16 nt, Bordetella pertussis
gcccaugccgccgggc

SEQ ID NO: 2467059 - RNA, 17 nt, Bordetella pertussis
gcccaugccgccgggca

SEQ ID NO: 2467060 - RNA, 13 nt, Bordetella pertussis
gcccaugccgcgg

SEQ ID NO: 2467061 - RNA, 14 nt, Bordetella pertussis
gcccaugcgaucgg

SEQ ID NO: 2467062 - RNA, 15 nt, Bordetella pertussis
gcccaugcgcauggc

SEQ ID NO: 2467063 - RNA, 17 nt, Bordetella pertussis
gcccaugcgcauggcca

SEQ ID NO: 2467064 - RNA, 21 nt, Bordetella pertussis
gcccaugcgcauggccagcac

SEQ ID NO: 2467065 - RNA, 15 nt, Bordetella pertussis
gcccaugcgcugcgc

SEQ ID NO: 2467066 - RNA, 16 nt, Bordetella pertussis
gcccaugcgcugcgcc

SEQ ID NO: 2467067 - RNA, 18 nt, Bordetella pertussis
gcccaugcgcugcgccuu

SEQ ID NO: 2467068 - RNA, 23 nt, Bordetella pertussis
gcccaugcggguuggcagucggc

SEQ ID NO: 2467069 - RNA, 19 nt, Bordetella pertussis
gcccaugcugaauugcggg

SEQ ID NO: 2467070 - RNA, 20 nt, Bordetella pertussis
gcccaugcugaauugcgggc

SEQ ID NO: 2467071 - RNA, 13 nt, Bordetella pertussis
gcccauggcaagc

SEQ ID NO: 2467072 - RNA, 13 nt, Bordetella pertussis
gcccauggcaucg

SEQ ID NO: 2467073 - RNA, 14 nt, Bordetella pertussis
gcccauggcaucga

SEQ ID NO: 2467074 - RNA, 16 nt, Bordetella pertussis
gcccauggccagggag

SEQ ID NO: 2467075 - RNA, 19 nt, Bordetella pertussis
gcccauggccugcaaccug

SEQ ID NO: 2467076 - RNA, 20 nt, Bordetella pertussis
gcccauggccugcaaccugg

SEQ ID NO: 2467077 - RNA, 17 nt, Bordetella pertussis
gcccauggcgcgcagca

SEQ ID NO: 2467078 - RNA, 11 nt, Bordetella pertussis
gcccauggcgu

SEQ ID NO: 2467079 - RNA, 14 nt, Bordetella pertussis
gcccauggcguagg

SEQ ID NO: 2467080 - RNA, 20 nt, Bordetella pertussis
gcccaugggaaucugcuugc

SEQ ID NO: 2467081 - RNA, 22 nt, Bordetella pertussis
gcccauggggugcuccugccag

SEQ ID NO: 2467082 - RNA, 22 nt, Bordetella pertussis
gcccauguagaacgccaggguc

SEQ ID NO: 2467083 - RNA, 23 nt, Bordetella pertussis
gcccauguucuggucucccggca

SEQ ID NO: 2467084 - RNA, 16 nt, Bordetella pertussis
gcccauguugaacugc

SEQ ID NO: 2467085 - RNA, 20 nt, Bordetella pertussis
gcccauguugaacugcaggc

SEQ ID NO: 2467086 - RNA, 23 nt, Bordetella pertussis
gcccauguugaacugcaggccgc

SEQ ID NO: 2467087 - RNA, 14 nt, Bordetella pertussis
gcccauucccgccc

SEQ ID NO: 2467088 - RNA, 16 nt, Bordetella pertussis
gcccauucccgcccug

SEQ ID NO: 2467089 - RNA, 18 nt, Bordetella pertussis
gcccauuccgagcgggcc

SEQ ID NO: 2467090 - RNA, 24 nt, Bordetella pertussis
gcccauuccgagcgggcccgacag

SEQ ID NO: 2467091 - RNA, 16 nt, Bordetella pertussis
gcccauucgcgcaccg

SEQ ID NO: 2467092 - RNA, 19 nt, Bordetella pertussis
gcccauugcggcaccugcu

SEQ ID NO: 2467093 - RNA, 20 nt, Bordetella pertussis
gcccauugcggcaccugcug

SEQ ID NO: 2467094 - RNA, 15 nt, Bordetella pertussis
gcccauugcggcggg

SEQ ID NO: 2467095 - RNA, 16 nt, Bordetella pertussis
gcccauugcggcgggc

SEQ ID NO: 2467096 - RNA, 15 nt, Bordetella pertussis
gcccauuucgauggc

SEQ ID NO: 2467097 - RNA, 15 nt, Bordetella pertussis
gccccaacgcggcca

SEQ ID NO: 2467098 - RNA, 18 nt, Bordetella pertussis
gccccaacgcggccagcg

SEQ ID NO: 2467099 - RNA, 19 nt, Bordetella pertussis
gccccaacgcggccagcgg

SEQ ID NO: 2467100 - RNA, 19 nt, Bordetella pertussis
gccccaacggccuucggcg

SEQ ID NO: 2467101 - RNA, 21 nt, Bordetella pertussis
gccccaacggccuucggcggc

SEQ ID NO: 2467102 - RNA, 23 nt, Bordetella pertussis
gccccaacggccuucggcggcgc

SEQ ID NO: 2467103 - RNA, 21 nt, Bordetella pertussis
gccccaaugugcugacggugc

SEQ ID NO: 2467104 - RNA, 15 nt, Bordetella pertussis
gccccacacgcgcgc

SEQ ID NO: 2467105 - RNA, 20 nt, Bordetella pertussis
gccccacccggguacguggc

SEQ ID NO: 2467106 - RNA, 22 nt, Bordetella pertussis
gccccacccggguacguggccc

SEQ ID NO: 2467107 - RNA, 13 nt, Bordetella pertussis
gccccaccuggcg

SEQ ID NO: 2467108 - RNA, 21 nt, Bordetella pertussis
gccccaccuggcggugcgccg

SEQ ID NO: 2467109 - RNA, 24 nt, Bordetella pertussis
gccccaccuggcggugcgccgcau

SEQ ID NO: 2467110 - RNA, 18 nt, Bordetella pertussis
gccccaccuugcccagca

SEQ ID NO: 2467111 - RNA, 20 nt, Bordetella pertussis
gccccaccuugcccagcagc

SEQ ID NO: 2467112 - RNA, 16 nt, Bordetella pertussis
gccccacgccgaccuc

SEQ ID NO: 2467113 - RNA, 14 nt, Bordetella pertussis
gccccacggguacc

SEQ ID NO: 2467114 - RNA, 17 nt, Bordetella pertussis
gccccacggguaccagg

SEQ ID NO: 2467115 - RNA, 14 nt, Bordetella pertussis
gccccacuuggcga

SEQ ID NO: 2467116 - RNA, 17 nt, Bordetella pertussis
gccccagaugccgguca

SEQ ID NO: 2467117 - RNA, 20 nt, Bordetella pertussis
gccccagcacgaagggcagc

SEQ ID NO: 2467118 - RNA, 21 nt, Bordetella pertussis
gccccagcacgaagggcagca

SEQ ID NO: 2467119 - RNA, 16 nt, Bordetella pertussis
gcccgaucggccggcc

SEQ ID NO: 2467120 - RNA, 17 nt, Bordetella pertussis
gcccgaucggccggccg

SEQ ID NO: 2467121 - RNA, 21 nt, Bordetella pertussis
gcccgaucggccggccgggcc

SEQ ID NO: 2467122 - RNA, 22 nt, Bordetella pertussis
gcccgaugccgauacgucgcag

SEQ ID NO: 2467123 - RNA, 21 nt, Bordetella pertussis
gcccgaugccuuggugggguc

SEQ ID NO: 2467124 - RNA, 17 nt, Bordetella pertussis
gcccgaugcgccaggcc

SEQ ID NO: 2467125 - RNA, 19 nt, Bordetella pertussis
gcccgaugcgccaggccuc

SEQ ID NO: 2467126 - RNA, 16 nt, Bordetella pertussis
gcccgaugcucgccgg

SEQ ID NO: 2467127 - RNA, 19 nt, Bordetella pertussis
gcccgaugcucgccggcgc

SEQ ID NO: 2467128 - RNA, 22 nt, Bordetella pertussis
gcccgaugcucgccggcgccgc

SEQ ID NO: 2467129 - RNA, 14 nt, Bordetella pertussis
gcccgauggcgggg

SEQ ID NO: 2467130 - RNA, 15 nt, Bordetella pertussis
gcccgauggcgggga

SEQ ID NO: 2467131 - RNA, 21 nt, Bordetella pertussis
gcccgcaacgccgcccguccg

SEQ ID NO: 2467132 - RNA, 16 nt, Bordetella pertussis
gcccgcaacgggccgg

SEQ ID NO: 2467133 - RNA, 18 nt, Bordetella pertussis
gcccgcaacgggccggcc

SEQ ID NO: 2467134 - RNA, 19 nt, Bordetella pertussis
gcccgcaacgggccggccg

SEQ ID NO: 2467135 - RNA, 19 nt, Bordetella pertussis
gcccgcaaggaccaugcgc

SEQ ID NO: 2467136 - RNA, 18 nt, Bordetella pertussis
gcccgcacauacaaggcg

SEQ ID NO: 2467137 - RNA, 20 nt, Bordetella pertussis
gcccgcaccaugccgauggc

SEQ ID NO: 2467138 - RNA, 21 nt, Bordetella pertussis
gcccgcaccaugccgauggcg

SEQ ID NO: 2467139 - RNA, 18 nt, Bordetella pertussis
gcccgcaccgcccgcaag

SEQ ID NO: 2467140 - RNA, 16 nt, Bordetella pertussis
gcccgcaccgggcggc

SEQ ID NO: 2467141 - RNA, 18 nt, Bordetella pertussis
gcccgcaccgggcggccc

SEQ ID NO: 2467142 - RNA, 21 nt, Bordetella pertussis
gcccgcaccgggcggcccggc

SEQ ID NO: 2467143 - RNA, 22 nt, Bordetella pertussis
gcccgcaccgggcggcccggcg

SEQ ID NO: 2467144 - RNA, 14 nt, Bordetella pertussis
gcccgcaccuugcc

SEQ ID NO: 2467145 - RNA, 13 nt, Bordetella pertussis
gcccgcacgggcc

SEQ ID NO: 2467146 - RNA, 18 nt, Bordetella pertussis
gcccgcacgggccgacgg

SEQ ID NO: 2467147 - RNA, 23 nt, Bordetella pertussis
gcccgcacgggccgacggccucg

SEQ ID NO: 2467148 - RNA, 22 nt, Bordetella pertussis
gcccgcaggcauugcgccagcc

SEQ ID NO: 2467149 - RNA, 15 nt, Bordetella pertussis
gcccgcaggcggcgg

SEQ ID NO: 2467150 - RNA, 18 nt, Bordetella pertussis
gcccgcagguggggcagc

SEQ ID NO: 2467151 - RNA, 20 nt, Bordetella pertussis
gcccgcauagacgccgaccg

SEQ ID NO: 2467152 - RNA, 21 nt, Bordetella pertussis
gcccgcauagacgccgaccgc

SEQ ID NO: 2467153 - RNA, 17 nt, Bordetella pertussis
gcccgcaucgcgcgccg

SEQ ID NO: 2467154 - RNA, 18 nt, Bordetella pertussis
gcccgcaucgcgcgccgc

SEQ ID NO: 2467155 - RNA, 22 nt, Bordetella pertussis
gcccgcaucggcguaccaggca

SEQ ID NO: 2467156 - RNA, 24 nt, Bordetella pertussis
gcccgcaucggcguaccaggcagc

SEQ ID NO: 2467157 - RNA, 13 nt, Bordetella pertussis
gcccgcaucggcu

SEQ ID NO: 2467158 - RNA, 19 nt, Bordetella pertussis
gcccgcaucggcuggcgca

SEQ ID NO: 2467159 - RNA, 15 nt, Bordetella pertussis
gcccgcaugcagguc

SEQ ID NO: 2467160 - RNA, 21 nt, Bordetella pertussis
gcccgcaugcagguccuggua

SEQ ID NO: 2467161 - RNA, 17 nt, Bordetella pertussis
gcccgcauggaccgccg

SEQ ID NO: 2467162 - RNA, 18 nt, Bordetella pertussis
gcccgcauggaccgccgc

SEQ ID NO: 2467163 - RNA, 20 nt, Bordetella pertussis
gcccgcauggaccgccgccg

SEQ ID NO: 2467164 - RNA, 21 nt, Bordetella pertussis
gcccgcauggaccgccgccgu

SEQ ID NO: 2467165 - RNA, 17 nt, Bordetella pertussis
gcccgcaugucccagcg

SEQ ID NO: 2467166 - RNA, 19 nt, Bordetella pertussis
gcccgcaugucccagcgcu

SEQ ID NO: 2467167 - RNA, 21 nt, Bordetella pertussis
gcccgcaugucccagcgcucg

SEQ ID NO: 2467168 - RNA, 15 nt, Bordetella pertussis
gcccgcauguccgag

SEQ ID NO: 2467169 - RNA, 15 nt, Bordetella pertussis
gcccgccaccacgcg

SEQ ID NO: 2467170 - RNA, 18 nt, Bordetella pertussis
gcccgccaccacgcgcac

SEQ ID NO: 2467171 - RNA, 15 nt, Bordetella pertussis
gcccgccaccacggc

SEQ ID NO: 2467172 - RNA, 17 nt, Bordetella pertussis
gcccgccaccacggcgc

SEQ ID NO: 2467173 - RNA, 18 nt, Bordetella pertussis
gcccgccaccacggcgcg

SEQ ID NO: 2467174 - RNA, 13 nt, Bordetella pertussis
gcccgccaccagg

SEQ ID NO: 2467175 - RNA, 21 nt, Bordetella pertussis
gcccgccaccaggaacgccag

SEQ ID NO: 2467176 - RNA, 20 nt, Bordetella pertussis
gcccgccacccagggcuuga

SEQ ID NO: 2467177 - RNA, 16 nt, Bordetella pertussis
gcccgccacgcgggcc

SEQ ID NO: 2467178 - RNA, 17 nt, Bordetella pertussis
gcccgccacgcgggccg

SEQ ID NO: 2467179 - RNA, 21 nt, Bordetella pertussis
gcccgccacgcgggccggccg

SEQ ID NO: 2467180 - RNA, 16 nt, Bordetella pertussis
gcccgccacggcgccc

SEQ ID NO: 2467181 - RNA, 19 nt, Bordetella pertussis
gcccgccacggucgcgagc

SEQ ID NO: 2467182 - RNA, 18 nt, Bordetella pertussis
gcccgccagcaaggcggc

SEQ ID NO: 2467183 - RNA, 13 nt, Bordetella pertussis
gcccgccagcagc

SEQ ID NO: 2467184 - RNA, 14 nt, Bordetella pertussis
gcccgccagcagcu

SEQ ID NO: 2467185 - RNA, 18 nt, Bordetella pertussis
gcccgccagcagcucggc

SEQ ID NO: 2467186 - RNA, 12 nt, Bordetella pertussis
gcccgccagcgc

SEQ ID NO: 2467187 - RNA, 13 nt, Bordetella pertussis
gcccgccagcgcg

SEQ ID NO: 2467188 - RNA, 19 nt, Bordetella pertussis
gcccgccaggaagcgggcc

SEQ ID NO: 2467189 - RNA, 22 nt, Bordetella pertussis
gcccgccaggaagcgggccugc

SEQ ID NO: 2467190 - RNA, 14 nt, Bordetella pertussis
gcccgccagggcgu

SEQ ID NO: 2467191 - RNA, 17 nt, Bordetella pertussis
gcccgccaucgccagga

SEQ ID NO: 2467192 - RNA, 15 nt, Bordetella pertussis
gcccgccaucgcgca

SEQ ID NO: 2467193 - RNA, 17 nt, Bordetella pertussis
gcccgccaucgcgcauu

SEQ ID NO: 2467194 - RNA, 17 nt, Bordetella pertussis
gcccgccaugcacgggc

SEQ ID NO: 2467195 - RNA, 18 nt, Bordetella pertussis
gcccgccaugcacgggcc

SEQ ID NO: 2467196 - RNA, 19 nt, Bordetella pertussis
gcccgcccacauggcggcg

SEQ ID NO: 2467197 - RNA, 16 nt, Bordetella pertussis
gcccgccccacggcga

SEQ ID NO: 2467198 - RNA, 17 nt, Bordetella pertussis
gcccgccccacggcgag

SEQ ID NO: 2467199 - RNA, 15 nt, Bordetella pertussis
gcccgccccgggcag

SEQ ID NO: 2467200 - RNA, 13 nt, Bordetella pertussis
gcccgcccgccgc

SEQ ID NO: 2467201 - RNA, 15 nt, Bordetella pertussis
gcccgcccgccgccu

SEQ ID NO: 2467202 - RNA, 18 nt, Bordetella pertussis
gcccgcccgccgccugcg

SEQ ID NO: 2467203 - RNA, 14 nt, Bordetella pertussis
gcccgcccgcgagc

SEQ ID NO: 2467204 - RNA, 21 nt, Bordetella pertussis
gcccgcccgcgagcggccagc

SEQ ID NO: 2467205 - RNA, 17 nt, Bordetella pertussis
gcccgcccgcgcccagc

SEQ ID NO: 2467206 - RNA, 18 nt, Bordetella pertussis
gcccgcccgcgcccagcu

SEQ ID NO: 2467207 - RNA, 13 nt, Bordetella pertussis
gcccgcccgcgga

SEQ ID NO: 2467208 - RNA, 14 nt, Bordetella pertussis
gcccgcccgcugac

SEQ ID NO: 2467209 - RNA, 11 nt, Bordetella pertussis
gcccgcccggg

SEQ ID NO: 2467210 - RNA, 18 nt, Bordetella pertussis
gcccgcccuuggucaccg

SEQ ID NO: 2467211 - RNA, 21 nt, Bordetella pertussis
gcccgcccuuggucaccgaga

SEQ ID NO: 2467212 - RNA, 17 nt, Bordetella pertussis
gcccgccgagucggcga

SEQ ID NO: 2467213 - RNA, 19 nt, Bordetella pertussis
gcccgccgagucggcgaug

SEQ ID NO: 2467214 - RNA, 23 nt, Bordetella pertussis
gcccgccgauccacucggccagc

SEQ ID NO: 2467215 - RNA, 14 nt, Bordetella pertussis
gcccgccgccgccc

SEQ ID NO: 2467216 - RNA, 12 nt, Bordetella pertussis
gcccgccgccgg

SEQ ID NO: 2467217 - RNA, 15 nt, Bordetella pertussis
gcccgccgccgggcg

SEQ ID NO: 2467218 - RNA, 13 nt, Bordetella pertussis
gcccgccgccugc

SEQ ID NO: 2467219 - RNA, 15 nt, Bordetella pertussis
gcccgccgccugcgc

SEQ ID NO: 2467220 - RNA, 14 nt, Bordetella pertussis
gcccgccgcgccau

SEQ ID NO: 2467221 - RNA, 15 nt, Bordetella pertussis
gcccgccgcgccaug

SEQ ID NO: 2467222 - RNA, 16 nt, Bordetella pertussis
gcccgccgcgccaugc

SEQ ID NO: 2467223 - RNA, 23 nt, Bordetella pertussis
gcccgccgcgccaugcucgcgca

SEQ ID NO: 2467224 - RNA, 13 nt, Bordetella pertussis
gcccgccgcggca

SEQ ID NO: 2467225 - RNA, 14 nt, Bordetella pertussis
gcccgccgcggcag

SEQ ID NO: 2467226 - RNA, 22 nt, Bordetella pertussis
gcccgccgcggcaggccccggc

SEQ ID NO: 2467227 - RNA, 13 nt, Bordetella pertussis
gcccgccgcgucg

SEQ ID NO: 2467228 - RNA, 14 nt, Bordetella pertussis
gcccgccgcugguc

SEQ ID NO: 2467229 - RNA, 11 nt, Bordetella pertussis
gcccgccggca

SEQ ID NO: 2467230 - RNA, 13 nt, Bordetella pertussis
gcccgccggcacc

SEQ ID NO: 2467231 - RNA, 16 nt, Bordetella pertussis
gcccgccggcacccgg

SEQ ID NO: 2467232 - RNA, 17 nt, Bordetella pertussis
gcccgccggcacccggc

SEQ ID NO: 2467233 - RNA, 14 nt, Bordetella pertussis
gcccgccggcgcgc

SEQ ID NO: 2467234 - RNA, 22 nt, Bordetella pertussis
gcccuggcuggccagccggccc

SEQ ID NO: 2467235 - RNA, 13 nt, Bordetella pertussis
gcccuggcuggcg

SEQ ID NO: 2467236 - RNA, 15 nt, Bordetella pertussis
gcccuggcuggcggc

SEQ ID NO: 2467237 - RNA, 17 nt, Bordetella pertussis
gcccuggcuggcggccc

SEQ ID NO: 2467238 - RNA, 14 nt, Bordetella pertussis
gcccugggccagca

SEQ ID NO: 2467239 - RNA, 17 nt, Bordetella pertussis
gcccugggccagcagcu

SEQ ID NO: 2467240 - RNA, 22 nt, Bordetella pertussis
gcccugggccagcagcuggcgc

SEQ ID NO: 2467241 - RNA, 15 nt, Bordetella pertussis
gcccugggccagcca

SEQ ID NO: 2467242 - RNA, 22 nt, Bordetella pertussis
gcccugggccagccagcgccgc

SEQ ID NO: 2467243 - RNA, 14 nt, Bordetella pertussis
gcccugggcgcggc

SEQ ID NO: 2467244 - RNA, 22 nt, Bordetella pertussis
gcccuggggccgcggcgcgcgc

SEQ ID NO: 2467245 - RNA, 14 nt, Bordetella pertussis
gcccuggguggcgg

SEQ ID NO: 2467246 - RNA, 22 nt, Bordetella pertussis
gcccuggguggcggggcgcauc

SEQ ID NO: 2467247 - RNA, 23 nt, Bordetella pertussis
gcccuggucaucgccaugcugcc

SEQ ID NO: 2467248 - RNA, 19 nt, Bordetella pertussis
gcccuggucgucgcggccc

SEQ ID NO: 2467249 - RNA, 19 nt, Bordetella pertussis
gcccugucggccgaaccgc

SEQ ID NO: 2467250 - RNA, 19 nt, Bordetella pertussis
gcccuguguccacgaacgc

SEQ ID NO: 2467251 - RNA, 23 nt, Bordetella pertussis
gcccugugugcauuuuccucggc

SEQ ID NO: 2467252 - RNA, 16 nt, Bordetella pertussis
gcccuguucgcgcggc

SEQ ID NO: 2467253 - RNA, 18 nt, Bordetella pertussis
gcccuguucgcgcggccc

SEQ ID NO: 2467254 - RNA, 13 nt, Bordetella pertussis
gcccuucaggcca

SEQ ID NO: 2467255 - RNA, 13 nt, Bordetella pertussis
gcccuucgacgcg

SEQ ID NO: 2467256 - RNA, 15 nt, Bordetella pertussis
gcccuucgacgcggc

SEQ ID NO: 2467257 - RNA, 19 nt, Bordetella pertussis
gcccuucgacgcggcggcc

SEQ ID NO: 2467258 - RNA, 17 nt, Bordetella pertussis
gcccuucggcaugcugc

SEQ ID NO: 2467259 - RNA, 13 nt, Bordetella pertussis
gcccuugaccgac

SEQ ID NO: 2467260 - RNA, 14 nt, Bordetella pertussis
gcccuugaccgacg

SEQ ID NO: 2467261 - RNA, 19 nt, Bordetella pertussis
gcccuugagcaaucaaggg

SEQ ID NO: 2467262 - RNA, 18 nt, Bordetella pertussis
gcccuugagcacggcgcg

SEQ ID NO: 2467263 - RNA, 19 nt, Bordetella pertussis
gcccuugaucagcggcggc

SEQ ID NO: 2467264 - RNA, 12 nt, Bordetella pertussis
gcccuugauggc

SEQ ID NO: 2467265 - RNA, 18 nt, Bordetella pertussis
gcccuugccagggccugg

SEQ ID NO: 2467266 - RNA, 23 nt, Bordetella pertussis
gcccuugccagggccuggcacau

SEQ ID NO: 2467267 - RNA, 12 nt, Bordetella pertussis
gcccuugccgcc

SEQ ID NO: 2467268 - RNA, 20 nt, Bordetella pertussis
gcccuugccguugagcacgg

SEQ ID NO: 2467269 - RNA, 21 nt, Bordetella pertussis
gcccuugccguuguccgccug

SEQ ID NO: 2467270 - RNA, 23 nt, Bordetella pertussis
gcccuugccguuguccgccugcg

SEQ ID NO: 2467271 - RNA, 19 nt, Bordetella pertussis
gcccuugcgcgaacggcag

SEQ ID NO: 2467272 - RNA, 12 nt, Bordetella pertussis
gcccuugcggcg

SEQ ID NO: 2467273 - RNA, 17 nt, Bordetella pertussis
gcccuugcucccaguuc

SEQ ID NO: 2467274 - RNA, 20 nt, Bordetella pertussis
gcccuuggcggccuucauga

SEQ ID NO: 2467275 - RNA, 13 nt, Bordetella pertussis
gcccuuggcggcg

SEQ ID NO: 2467276 - RNA, 17 nt, Bordetella pertussis
gcccuuggcggcgaucg

SEQ ID NO: 2467277 - RNA, 19 nt, Bordetella pertussis
gcccuuggcggcgaucgaa

SEQ ID NO: 2467278 - RNA, 18 nt, Bordetella pertussis
gcccuugggggcccacau

SEQ ID NO: 2467279 - RNA, 19 nt, Bordetella pertussis
gcccuugugcguuggcgcg

SEQ ID NO: 2467280 - RNA, 17 nt, Bordetella pertussis
gcccuugugcugccaug

SEQ ID NO: 2467281 - RNA, 20 nt, Bordetella pertussis
gcccuugugcugccaugccg

SEQ ID NO: 2467282 - RNA, 15 nt, Bordetella pertussis
gcccuuguggccgcc

SEQ ID NO: 2467283 - RNA, 15 nt, Bordetella pertussis
gccgaaaaacggcgg

SEQ ID NO: 2467284 - RNA, 16 nt, Bordetella pertussis
gccgaaaccgccgcgg

SEQ ID NO: 2467285 - RNA, 17 nt, Bordetella pertussis
gccgaaaccgccgcggc

SEQ ID NO: 2467286 - RNA, 15 nt, Bordetella pertussis
gccgaaacgcuggcg

SEQ ID NO: 2467287 - RNA, 20 nt, Bordetella pertussis
gccgaaauauggaccagccc

SEQ ID NO: 2467288 - RNA, 22 nt, Bordetella pertussis
gccgaaauauggaccagcccgu

SEQ ID NO: 2467289 - RNA, 14 nt, Bordetella pertussis
gccgaaauuggcga

SEQ ID NO: 2467290 - RNA, 20 nt, Bordetella pertussis
gccgaacacaucgagggcgu

SEQ ID NO: 2467291 - RNA, 22 nt, Bordetella pertussis
gccgaacacaucgagggcguca

SEQ ID NO: 2467292 - RNA, 14 nt, Bordetella pertussis
gccgaacaccagcu

SEQ ID NO: 2467293 - RNA, 15 nt, Bordetella pertussis
gccgaacaccagcuc

SEQ ID NO: 2467294 - RNA, 15 nt, Bordetella pertussis
gccgaacagcauggc

SEQ ID NO: 2467295 - RNA, 20 nt, Bordetella pertussis
gccgaacagcauggcggcgc

SEQ ID NO: 2467296 - RNA, 21 nt, Bordetella pertussis
gccgaacagccagggcagggc

SEQ ID NO: 2467297 - RNA, 17 nt, Bordetella pertussis
gccgaaccagcgcacca

SEQ ID NO: 2467298 - RNA, 20 nt, Bordetella pertussis
gccgaaccauugcagggugu

SEQ ID NO: 2467299 - RNA, 19 nt, Bordetella pertussis
gccgaacgacuuggcgcaa

SEQ ID NO: 2467300 - RNA, 15 nt, Bordetella pertussis
gccgaacgaggcgcg

SEQ ID NO: 2467301 - RNA, 13 nt, Bordetella pertussis
gccgaacgccgcc

SEQ ID NO: 2467302 - RNA, 16 nt, Bordetella pertussis
gccgaacgccgccgca

SEQ ID NO: 2467303 - RNA, 12 nt, Bordetella pertussis
gccgaacgcgca

SEQ ID NO: 2467304 - RNA, 16 nt, Bordetella pertussis
gccgaacgcgcagcga

SEQ ID NO: 2467305 - RNA, 18 nt, Bordetella pertussis
gccgaacgcgcagcgaac

SEQ ID NO: 2467306 - RNA, 18 nt, Bordetella pertussis
gccgaacggcacgugaua

SEQ ID NO: 2467307 - RNA, 20 nt, Bordetella pertussis
gccgaacggcagcagcgcgc

SEQ ID NO: 2467308 - RNA, 18 nt, Bordetella pertussis
gccgaacggggccgccuc

SEQ ID NO: 2467309 - RNA, 21 nt, Bordetella pertussis
gccgaacggggccgccucggc

SEQ ID NO: 2467310 - RNA, 15 nt, Bordetella pertussis
gccgaacucgcgcuc

SEQ ID NO: 2467311 - RNA, 21 nt, Bordetella pertussis
gccgaacucgcgcucggccag

SEQ ID NO: 2467312 - RNA, 22 nt, Bordetella pertussis
gccgaacucgcgcucggccagc

SEQ ID NO: 2467313 - RNA, 15 nt, Bordetella pertussis
gccgaacugccggcg

SEQ ID NO: 2467314 - RNA, 17 nt, Bordetella pertussis
gccgaacugucgcgcca

SEQ ID NO: 2467315 - RNA, 18 nt, Bordetella pertussis
gccgaacugucgcgccac

SEQ ID NO: 2467316 - RNA, 19 nt, Bordetella pertussis
gccgaacuucagcccgggc

SEQ ID NO: 2467317 - RNA, 21 nt, Bordetella pertussis
gccgaagaaauagcccgcggc

SEQ ID NO: 2467318 - RNA, 23 nt, Bordetella pertussis
gccgaagaaauagcccgcggcca

SEQ ID NO: 2467319 - RNA, 18 nt, Bordetella pertussis
gccgaagaaccaguagca

SEQ ID NO: 2467320 - RNA, 17 nt, Bordetella pertussis
gccgaagauucccgcgc

SEQ ID NO: 2467321 - RNA, 20 nt, Bordetella pertussis
gccgaagcaaugcagcgcga

SEQ ID NO: 2467322 - RNA, 14 nt, Bordetella pertussis
gccgaagccgccgc

SEQ ID NO: 2467323 - RNA, 19 nt, Bordetella pertussis
gccgaagccgccgccguca

SEQ ID NO: 2467324 - RNA, 18 nt, Bordetella pertussis
gccgaagcgucggccugc

SEQ ID NO: 2467325 - RNA, 14 nt, Bordetella pertussis
gccgaaggcggcgc

SEQ ID NO: 2467326 - RNA, 15 nt, Bordetella pertussis
gccgaaggcggcgcc

SEQ ID NO: 2467327 - RNA, 16 nt, Bordetella pertussis
gccgaaggcggcgccg

SEQ ID NO: 2467328 - RNA, 20 nt, Bordetella pertussis
gccgaaggcggcgccgguga

SEQ ID NO: 2467329 - RNA, 22 nt, Bordetella pertussis
gccgaaggcgugcugaacgcgc

SEQ ID NO: 2467330 - RNA, 15 nt, Bordetella pertussis
gccgaagggcagguc

SEQ ID NO: 2467331 - RNA, 16 nt, Bordetella pertussis
gccgaagggcaggucg

SEQ ID NO: 2467332 - RNA, 17 nt, Bordetella pertussis
gccgaagggcaggucgu

SEQ ID NO: 2467333 - RNA, 20 nt, Bordetella pertussis
gccgaaguacacggccagca

SEQ ID NO: 2467334 - RNA, 21 nt, Bordetella pertussis
gccgaaguacacggccagcac

SEQ ID NO: 2467335 - RNA, 23 nt, Bordetella pertussis
gccgaaguaguuggucgagcgcu

SEQ ID NO: 2467336 - RNA, 12 nt, Bordetella pertussis
gccgaagucggc

SEQ ID NO: 2467337 - RNA, 16 nt, Bordetella pertussis
gccgaagucggcgcgc

SEQ ID NO: 2467338 - RNA, 17 nt, Bordetella pertussis
gccgaaguugcggccgu

SEQ ID NO: 2467339 - RNA, 13 nt, Bordetella pertussis
gccgaauccggcc

SEQ ID NO: 2467340 - RNA, 17 nt, Bordetella pertussis
gccgaauccggccagca

SEQ ID NO: 2467341 - RNA, 21 nt, Bordetella pertussis
gccgaauccggccagcacgcc

SEQ ID NO: 2467342 - RNA, 15 nt, Bordetella pertussis
gccgaaucggccccu

SEQ ID NO: 2467343 - RNA, 21 nt, Bordetella pertussis
gccgaaucggccccugcccug

SEQ ID NO: 2467344 - RNA, 23 nt, Bordetella pertussis
gccgaauucguuggugcccagcg

SEQ ID NO: 2467345 - RNA, 16 nt, Bordetella pertussis
gccgaauugccgccgc

SEQ ID NO: 2467346 - RNA, 19 nt, Bordetella pertussis
gccgaauugccgccgcugc

SEQ ID NO: 2467347 - RNA, 23 nt, Bordetella pertussis
gccgaauugccgccgcugccggc

SEQ ID NO: 2467348 - RNA, 22 nt, Bordetella pertussis
gccggacacguacaaccgcgcc

SEQ ID NO: 2467349 - RNA, 23 nt, Bordetella pertussis
gccggacacguacaaccgcgccg

SEQ ID NO: 2467350 - RNA, 15 nt, Bordetella pertussis
gccggacagggccgc

SEQ ID NO: 2467351 - RNA, 13 nt, Bordetella pertussis
gccggacccgcgc

SEQ ID NO: 2467352 - RNA, 20 nt, Bordetella pertussis
gccggacccgcgccgcaggc

SEQ ID NO: 2467353 - RNA, 21 nt, Bordetella pertussis
gccggaccgcugugcgcguuc

SEQ ID NO: 2467354 - RNA, 13 nt, Bordetella pertussis
gccggaccugggc

SEQ ID NO: 2467355 - RNA, 22 nt, Bordetella pertussis
gccggaccuugcgaggcccggc

SEQ ID NO: 2467356 - RNA, 20 nt, Bordetella pertussis
gccggacgcaaccggucggc

SEQ ID NO: 2467357 - RNA, 14 nt, Bordetella pertussis
gccggacgcgggga

SEQ ID NO: 2467358 - RNA, 17 nt, Bordetella pertussis
gccggacgcggggaugg

SEQ ID NO: 2467359 - RNA, 21 nt, Bordetella pertussis
gccggacgcggggauggcuuc

SEQ ID NO: 2467360 - RNA, 14 nt, Bordetella pertussis
gccggacggcgccu

SEQ ID NO: 2467361 - RNA, 17 nt, Bordetella pertussis
gccggacgugggcgccu

SEQ ID NO: 2467362 - RNA, 22 nt, Bordetella pertussis
gccggacucguccauggugggc

SEQ ID NO: 2467363 - RNA, 23 nt, Bordetella pertussis
gccggacucguccauggugggca

SEQ ID NO: 2467364 - RNA, 20 nt, Bordetella pertussis
gccggacuggauauggcgcc

SEQ ID NO: 2467365 - RNA, 22 nt, Bordetella pertussis
gccggacuggauauggcgccgc

SEQ ID NO: 2467366 - RNA, 13 nt, Bordetella pertussis
gccggacuggcgc

SEQ ID NO: 2467367 - RNA, 14 nt, Bordetella pertussis
gccggacuggcgcg

SEQ ID NO: 2467368 - RNA, 16 nt, Bordetella pertussis
gccggacuggcgcgca

SEQ ID NO: 2467369 - RNA, 17 nt, Bordetella pertussis
gccggacuggcgcgcac

SEQ ID NO: 2467370 - RNA, 19 nt, Bordetella pertussis
gccggagauccggccuucc

SEQ ID NO: 2467371 - RNA, 13 nt, Bordetella pertussis
gccggagcagcag

SEQ ID NO: 2467372 - RNA, 14 nt, Bordetella pertussis
gccggagcagcagc

SEQ ID NO: 2467373 - RNA, 18 nt, Bordetella pertussis
gccggagcagucgcgcag

SEQ ID NO: 2467374 - RNA, 19 nt, Bordetella pertussis
gccggagcagucgcgcagc

SEQ ID NO: 2467375 - RNA, 20 nt, Bordetella pertussis
gccggagcagucgcgcagcc

SEQ ID NO: 2467376 - RNA, 21 nt, Bordetella pertussis
gccggagcagucgcgcagcca

SEQ ID NO: 2467377 - RNA, 17 nt, Bordetella pertussis
gccggagcccgucaggc

SEQ ID NO: 2467378 - RNA, 19 nt, Bordetella pertussis
gccggaggcacuccgucau

SEQ ID NO: 2467379 - RNA, 14 nt, Bordetella pertussis
gccggaggcgcgca

SEQ ID NO: 2467380 - RNA, 17 nt, Bordetella pertussis
gccggaggcgcgcagcu

SEQ ID NO: 2467381 - RNA, 15 nt, Bordetella pertussis
gccggaggucggcgc

SEQ ID NO: 2467382 - RNA, 14 nt, Bordetella pertussis
gccggaucagcgcc

SEQ ID NO: 2467383 - RNA, 15 nt, Bordetella pertussis
gccggaucagcgccu

SEQ ID NO: 2467384 - RNA, 14 nt, Bordetella pertussis
gccggauccagcug

SEQ ID NO: 2467385 - RNA, 23 nt, Bordetella pertussis
gccggauccagcugcgaaagcgc

SEQ ID NO: 2467386 - RNA, 20 nt, Bordetella pertussis
gccggaucgcacacaccgcg

SEQ ID NO: 2467387 - RNA, 14 nt, Bordetella pertussis
gccggaucggccgg

SEQ ID NO: 2467388 - RNA, 17 nt, Bordetella pertussis
gccggaucggccggcag

SEQ ID NO: 2467389 - RNA, 12 nt, Bordetella pertussis
gccggaucugca

SEQ ID NO: 2467390 - RNA, 12 nt, Bordetella pertussis
gccggaugcgca

SEQ ID NO: 2467391 - RNA, 13 nt, Bordetella pertussis
gccggaugcgcag

SEQ ID NO: 2467392 - RNA, 20 nt, Bordetella pertussis
gccggaugcgcaggacggcg

SEQ ID NO: 2467393 - RNA, 21 nt, Bordetella pertussis
gccggaugcgcaggacggcgc

SEQ ID NO: 2467394 - RNA, 22 nt, Bordetella pertussis
gccggaugcgcaggacggcgcc

SEQ ID NO: 2467395 - RNA, 13 nt, Bordetella pertussis
gccggaugcgcgu

SEQ ID NO: 2467396 - RNA, 19 nt, Bordetella pertussis
gccggaugcgcguggcgcg

SEQ ID NO: 2467397 - RNA, 12 nt, Bordetella pertussis
gccggauggcgc

SEQ ID NO: 2467398 - RNA, 23 nt, Bordetella pertussis
gccggauggcgcggaugaccugc

SEQ ID NO: 2467399 - RNA, 14 nt, Bordetella pertussis
gccggauggcgucc

SEQ ID NO: 2467400 - RNA, 18 nt, Bordetella pertussis
gccggaugguagaugcgc

SEQ ID NO: 2467401 - RNA, 20 nt, Bordetella pertussis
gccggaugguagaugcgcgc

SEQ ID NO: 2467402 - RNA, 21 nt, Bordetella pertussis
gccggauugacguccaugauu

SEQ ID NO: 2467403 - RNA, 21 nt, Bordetella pertussis
gccggauugcuugacgccgcc

SEQ ID NO: 2467404 - RNA, 15 nt, Bordetella pertussis
gccggauuggcgcug

SEQ ID NO: 2467405 - RNA, 13 nt, Bordetella pertussis
gccggcaaacccg

SEQ ID NO: 2467406 - RNA, 15 nt, Bordetella pertussis
gccggcaacguggug

SEQ ID NO: 2467407 - RNA, 17 nt, Bordetella pertussis
gccggcaagaugccggc

SEQ ID NO: 2467408 - RNA, 18 nt, Bordetella pertussis
gccggcaagaugccggcc

SEQ ID NO: 2467409 - RNA, 20 nt, Bordetella pertussis
gccggcaagccagggcagga

SEQ ID NO: 2467410 - RNA, 16 nt, Bordetella pertussis
gccggcaaggggccag

SEQ ID NO: 2467411 - RNA, 18 nt, Bordetella pertussis
gccggcaaggggccagcc

SEQ ID NO: 2467412 - RNA, 19 nt, Bordetella pertussis
gccggcaaggggccagccu

SEQ ID NO: 2467413 - RNA, 18 nt, Bordetella pertussis
gccggcaaggucagcagc

SEQ ID NO: 2467414 - RNA, 18 nt, Bordetella pertussis
gccggcaaggugaucgag

SEQ ID NO: 2467415 - RNA, 15 nt, Bordetella pertussis
gccggcaccacgacc

SEQ ID NO: 2467416 - RNA, 23 nt, Bordetella pertussis
gccggcaccacgaccggcucggg

SEQ ID NO: 2467417 - RNA, 13 nt, Bordetella pertussis
gccggcaccagcg

SEQ ID NO: 2467418 - RNA, 15 nt, Bordetella pertussis
gccggcaccagcgcc

SEQ ID NO: 2467419 - RNA, 19 nt, Bordetella pertussis
gccggcaccagcgccacgc

SEQ ID NO: 2467420 - RNA, 16 nt, Bordetella pertussis
gccggcaccaggaucc

SEQ ID NO: 2467421 - RNA, 22 nt, Bordetella pertussis
gccggcaccaggauccccagca

SEQ ID NO: 2467422 - RNA, 17 nt, Bordetella pertussis
gccggcaccaucugcgu

SEQ ID NO: 2467423 - RNA, 21 nt, Bordetella pertussis
gccggcaccaucugcgucgcg

SEQ ID NO: 2467424 - RNA, 19 nt, Bordetella pertussis
gccggcacgacgaucggcc

SEQ ID NO: 2467425 - RNA, 13 nt, Bordetella pertussis
gccggcacgccca

SEQ ID NO: 2467426 - RNA, 15 nt, Bordetella pertussis
gccggcacgcccagc

SEQ ID NO: 2467427 - RNA, 16 nt, Bordetella pertussis
gccggcacgcccagcc

SEQ ID NO: 2467428 - RNA, 17 nt, Bordetella pertussis
gccggcacgcccagccg

SEQ ID NO: 2467429 - RNA, 19 nt, Bordetella pertussis
gccggcacgcccagccgca

SEQ ID NO: 2467430 - RNA, 21 nt, Bordetella pertussis
gccggcacgcccagccgcagc

SEQ ID NO: 2467431 - RNA, 23 nt, Bordetella pertussis
gccggcacgccgaugaacgacag

SEQ ID NO: 2467432 - RNA, 15 nt, Bordetella pertussis
gccggcacgccugcc

SEQ ID NO: 2467433 - RNA, 18 nt, Bordetella pertussis
gccggcacgccugccgcg

SEQ ID NO: 2467434 - RNA, 21 nt, Bordetella pertussis
gccggcacgccugccgcgccc

SEQ ID NO: 2467435 - RNA, 22 nt, Bordetella pertussis
gccggcacgccugccgcgcccg

SEQ ID NO: 2467436 - RNA, 23 nt, Bordetella pertussis
gccggcacgccugccgcgcccgg

SEQ ID NO: 2467437 - RNA, 13 nt, Bordetella pertussis
gccggcacgcgcg

SEQ ID NO: 2467438 - RNA, 14 nt, Bordetella pertussis
gccggcacgcgcgg

SEQ ID NO: 2467439 - RNA, 13 nt, Bordetella pertussis
gccggcacgcuga

SEQ ID NO: 2467440 - RNA, 17 nt, Bordetella pertussis
gccggcacgcugaccga

SEQ ID NO: 2467441 - RNA, 21 nt, Bordetella pertussis
gccggcacgcugaucgccggc

SEQ ID NO: 2467442 - RNA, 15 nt, Bordetella pertussis
gccggcacggccggc

SEQ ID NO: 2467443 - RNA, 16 nt, Bordetella pertussis
gccggcacggccggcc

SEQ ID NO: 2467444 - RNA, 23 nt, Bordetella pertussis
gccggcacggccggccaggcgcc

SEQ ID NO: 2467445 - RNA, 19 nt, Bordetella pertussis
gccggcacguaccaggcgc

SEQ ID NO: 2467446 - RNA, 18 nt, Bordetella pertussis
gccggcacguccggcacg

SEQ ID NO: 2467447 - RNA, 19 nt, Bordetella pertussis
gccggcagaucggcgcugg

SEQ ID NO: 2467448 - RNA, 20 nt, Bordetella pertussis
gccggcagaucggcgcuggc

SEQ ID NO: 2467449 - RNA, 21 nt, Bordetella pertussis
gccggcagaucggcgcuggcc

SEQ ID NO: 2467450 - RNA, 13 nt, Bordetella pertussis
gccggcagcccca

SEQ ID NO: 2467451 - RNA, 15 nt, Bordetella pertussis
gccggcagccccagc

SEQ ID NO: 2467452 - RNA, 16 nt, Bordetella pertussis
gccggcagcgccuugc

SEQ ID NO: 2467453 - RNA, 15 nt, Bordetella pertussis
gccggcagcgcgacc

SEQ ID NO: 2467454 - RNA, 16 nt, Bordetella pertussis
gccggcagcgcgaccg

SEQ ID NO: 2467455 - RNA, 14 nt, Bordetella pertussis
gccggcagcggcgc

SEQ ID NO: 2467456 - RNA, 15 nt, Bordetella pertussis
gccggcagcggcgcc

SEQ ID NO: 2467457 - RNA, 16 nt, Bordetella pertussis
gccggcagcggcgcca

SEQ ID NO: 2467458 - RNA, 17 nt, Bordetella pertussis
gccggcagcggcgccau

SEQ ID NO: 2467459 - RNA, 20 nt, Bordetella pertussis
gccggcagcggcgccaugcg

SEQ ID NO: 2467460 - RNA, 13 nt, Bordetella pertussis
gccggcaggccgg

SEQ ID NO: 2467461 - RNA, 14 nt, Bordetella pertussis
gccggcaggccggc

SEQ ID NO: 2467462 - RNA, 15 nt, Bordetella pertussis
gccggcaggccggcc

SEQ ID NO: 2467463 - RNA, 22 nt, Bordetella pertussis
gccggugaugcggcgcgccgcg

SEQ ID NO: 2467464 - RNA, 18 nt, Bordetella pertussis
gccggugauguacgcauc

SEQ ID NO: 2467465 - RNA, 17 nt, Bordetella pertussis
gccggugcaccaggcca

SEQ ID NO: 2467466 - RNA, 14 nt, Bordetella pertussis
gccggugcagguca

SEQ ID NO: 2467467 - RNA, 19 nt, Bordetella pertussis
gccggugcaucggccggcg

SEQ ID NO: 2467468 - RNA, 12 nt, Bordetella pertussis
gccggugcgcac

SEQ ID NO: 2467469 - RNA, 18 nt, Bordetella pertussis
gccggugcgcacauggcg

SEQ ID NO: 2467470 - RNA, 14 nt, Bordetella pertussis
gccggugcgcagca

SEQ ID NO: 2467471 - RNA, 19 nt, Bordetella pertussis
gccggugcgcagcaccagc

SEQ ID NO: 2467472 - RNA, 14 nt, Bordetella pertussis
gccggugcgcggcg

SEQ ID NO: 2467473 - RNA, 17 nt, Bordetella pertussis
gccggugcgcggcgccc

SEQ ID NO: 2467474 - RNA, 15 nt, Bordetella pertussis
gccggugcgcggcuu

SEQ ID NO: 2467475 - RNA, 14 nt, Bordetella pertussis
gccggugcgcgugg

SEQ ID NO: 2467476 - RNA, 16 nt, Bordetella pertussis
gccggugcgcgugggc

SEQ ID NO: 2467477 - RNA, 19 nt, Bordetella pertussis
gccggugcgcgugggcacc

SEQ ID NO: 2467478 - RNA, 12 nt, Bordetella pertussis
gccggugcucgg

SEQ ID NO: 2467479 - RNA, 17 nt, Bordetella pertussis
gccggugcucggccagc

SEQ ID NO: 2467480 - RNA, 23 nt, Bordetella pertussis
gccggugcucggccagcgcgcgc

SEQ ID NO: 2467481 - RNA, 20 nt, Bordetella pertussis
gccgguggaccagggcacgg

SEQ ID NO: 2467482 - RNA, 15 nt, Bordetella pertussis
gccgguggccagcag

SEQ ID NO: 2467483 - RNA, 13 nt, Bordetella pertussis
gccggugggcagg

SEQ ID NO: 2467484 - RNA, 13 nt, Bordetella pertussis
gccggugggcgag

SEQ ID NO: 2467485 - RNA, 23 nt, Bordetella pertussis
gccgguggugcccaucgcgcuga

SEQ ID NO: 2467486 - RNA, 15 nt, Bordetella pertussis
gccgguggugucgaa

SEQ ID NO: 2467487 - RNA, 18 nt, Bordetella pertussis
gccgguguagcugcccgc

SEQ ID NO: 2467488 - RNA, 13 nt, Bordetella pertussis
gccggugucgggg

SEQ ID NO: 2467489 - RNA, 16 nt, Bordetella pertussis
gccggugucggggccg

SEQ ID NO: 2467490 - RNA, 18 nt, Bordetella pertussis
gccgguguucucgcuggu

SEQ ID NO: 2467491 - RNA, 20 nt, Bordetella pertussis
gccgguucgaugaccugggc

SEQ ID NO: 2467492 - RNA, 22 nt, Bordetella pertussis
gccgguucgaugaccugggccu

SEQ ID NO: 2467493 - RNA, 22 nt, Bordetella pertussis
gccgguucggucgacgacggca

SEQ ID NO: 2467494 - RNA, 15 nt, Bordetella pertussis
gccgguugcgcgccg

SEQ ID NO: 2467495 - RNA, 18 nt, Bordetella pertussis
gccgguugcgcgccgaca

SEQ ID NO: 2467496 - RNA, 19 nt, Bordetella pertussis
gccgguugcgcgccgacag

SEQ ID NO: 2467497 - RNA, 13 nt, Bordetella pertussis
gccgguuggcgcc

SEQ ID NO: 2467498 - RNA, 14 nt, Bordetella pertussis
gccgguuggcgccu

SEQ ID NO: 2467499 - RNA, 19 nt, Bordetella pertussis
gccgguuuuuuugcgccgc

SEQ ID NO: 2467500 - RNA, 20 nt, Bordetella pertussis
gccgguuuuuuugcgccgcu

SEQ ID NO: 2467501 - RNA, 21 nt, Bordetella pertussis
gccgguuuuuuugcgccgcua

SEQ ID NO: 2467502 - RNA, 19 nt, Bordetella pertussis
gccguaacaggacagccgc

SEQ ID NO: 2467503 - RNA, 15 nt, Bordetella pertussis
gccguaaccggccag

SEQ ID NO: 2467504 - RNA, 16 nt, Bordetella pertussis
gccguaaccggccagu

SEQ ID NO: 2467505 - RNA, 14 nt, Bordetella pertussis
gccguaauccaggc

SEQ ID NO: 2467506 - RNA, 16 nt, Bordetella pertussis
gccguacagccgcggc

SEQ ID NO: 2467507 - RNA, 23 nt, Bordetella pertussis
gccguacauggccagguacaggc

SEQ ID NO: 2467508 - RNA, 18 nt, Bordetella pertussis
gccguaccaggugcgcau

SEQ ID NO: 2467509 - RNA, 17 nt, Bordetella pertussis
gccguaccaguacaccg

SEQ ID NO: 2467510 - RNA, 19 nt, Bordetella pertussis
gccguaccaguacaccggc

SEQ ID NO: 2467511 - RNA, 20 nt, Bordetella pertussis
gccguaccaguacaccggcg

SEQ ID NO: 2467512 - RNA, 21 nt, Bordetella pertussis
gccguaccaguacaccggcgu

SEQ ID NO: 2467513 - RNA, 16 nt, Bordetella pertussis
gccguaccccagcaug

SEQ ID NO: 2467514 - RNA, 21 nt, Bordetella pertussis
gccguaccugcagcaggcgca

SEQ ID NO: 2467515 - RNA, 23 nt, Bordetella pertussis
gccguaccugcagcaggcgcacc

SEQ ID NO: 2467516 - RNA, 19 nt, Bordetella pertussis
gccguacgagugcaggccc

SEQ ID NO: 2467517 - RNA, 20 nt, Bordetella pertussis
gccguacgcggcgcccgcgc

SEQ ID NO: 2467518 - RNA, 21 nt, Bordetella pertussis
gccguacuuggcgauggccgc

SEQ ID NO: 2467519 - RNA, 23 nt, Bordetella pertussis
gccguacuuggcgauggccgcca

SEQ ID NO: 2467520 - RNA, 19 nt, Bordetella pertussis
gccguagcccagguccagc

SEQ ID NO: 2467521 - RNA, 15 nt, Bordetella pertussis
gccguagcgcgccag

SEQ ID NO: 2467522 - RNA, 16 nt, Bordetella pertussis
gccguagcgcgccagc

SEQ ID NO: 2467523 - RNA, 20 nt, Bordetella pertussis
gccguagcgcguggccagca

SEQ ID NO: 2467524 - RNA, 22 nt, Bordetella pertussis
gccguagcgcguggccagcacg

SEQ ID NO: 2467525 - RNA, 19 nt, Bordetella pertussis
gccguagcguuggcggccg

SEQ ID NO: 2467526 - RNA, 21 nt, Bordetella pertussis
gccguagcguuggcggccggc

SEQ ID NO: 2467527 - RNA, 22 nt, Bordetella pertussis
gccguagcguuggcggccggcc

SEQ ID NO: 2467528 - RNA, 23 nt, Bordetella pertussis
gccguagcguuggcggccggcca

SEQ ID NO: 2467529 - RNA, 14 nt, Bordetella pertussis
gccguaggacagcc

SEQ ID NO: 2467530 - RNA, 20 nt, Bordetella pertussis
gccguaggacagccccagca

SEQ ID NO: 2467531 - RNA, 21 nt, Bordetella pertussis
gccguaggacagccccagcag

SEQ ID NO: 2467532 - RNA, 15 nt, Bordetella pertussis
gccguaggcgccggc

SEQ ID NO: 2467533 - RNA, 16 nt, Bordetella pertussis
gccguaggcgccggcc

SEQ ID NO: 2467534 - RNA, 17 nt, Bordetella pertussis
gccguaggugcgcgcca

SEQ ID NO: 2467535 - RNA, 20 nt, Bordetella pertussis
gccguauagcgguacucgcg

SEQ ID NO: 2467536 - RNA, 16 nt, Bordetella pertussis
gccgucaacagcaugg

SEQ ID NO: 2467537 - RNA, 20 nt, Bordetella pertussis
gccgucaacggcuugggggg

SEQ ID NO: 2467538 - RNA, 15 nt, Bordetella pertussis
gccgucaagcguuca

SEQ ID NO: 2467539 - RNA, 20 nt, Bordetella pertussis
gccgucaagcguucauggcg

SEQ ID NO: 2467540 - RNA, 21 nt, Bordetella pertussis
gccgucaagcguucauggcgu

SEQ ID NO: 2467541 - RNA, 14 nt, Bordetella pertussis
gccgucaccgccgc

SEQ ID NO: 2467542 - RNA, 19 nt, Bordetella pertussis
gccgucaccgccgccgcgc

SEQ ID NO: 2467543 - RNA, 16 nt, Bordetella pertussis
gccgucacgcgugaau

SEQ ID NO: 2467544 - RNA, 23 nt, Bordetella pertussis
gccgucacgcgugaauaccgcgc

SEQ ID NO: 2467545 - RNA, 13 nt, Bordetella pertussis
gccgucagcagca

SEQ ID NO: 2467546 - RNA, 14 nt, Bordetella pertussis
gccgucagcagcag

SEQ ID NO: 2467547 - RNA, 13 nt, Bordetella pertussis
gccgucagcagcg

SEQ ID NO: 2467548 - RNA, 21 nt, Bordetella pertussis
gccgucagcagcgcggcgccg

SEQ ID NO: 2467549 - RNA, 14 nt, Bordetella pertussis
gccgucagcgacau

SEQ ID NO: 2467550 - RNA, 17 nt, Bordetella pertussis
gccgucagcucgaucag

SEQ ID NO: 2467551 - RNA, 18 nt, Bordetella pertussis
gccgucaggaucaggccg

SEQ ID NO: 2467552 - RNA, 23 nt, Bordetella pertussis
gccgucaggaucaggccggcgau

SEQ ID NO: 2467553 - RNA, 14 nt, Bordetella pertussis
gccgucaugcgccg

SEQ ID NO: 2467554 - RNA, 18 nt, Bordetella pertussis
gccguccacgaaggcagc

SEQ ID NO: 2467555 - RNA, 20 nt, Bordetella pertussis
gccguccacgaaggcagcac

SEQ ID NO: 2467556 - RNA, 21 nt, Bordetella pertussis
gccguccacgaaggcagcacc

SEQ ID NO: 2467557 - RNA, 12 nt, Bordetella pertussis
gccguccacgcc

SEQ ID NO: 2467558 - RNA, 14 nt, Bordetella pertussis
gccguccacgccca

SEQ ID NO: 2467559 - RNA, 22 nt, Bordetella pertussis
gccguccacgcccagcgccggc

SEQ ID NO: 2467560 - RNA, 16 nt, Bordetella pertussis
gccguccacgccgcgc

SEQ ID NO: 2467561 - RNA, 18 nt, Bordetella pertussis
gccguccacgccgcgcgc

SEQ ID NO: 2467562 - RNA, 19 nt, Bordetella pertussis
gccguccacgccgcgcgcg

SEQ ID NO: 2467563 - RNA, 15 nt, Bordetella pertussis
gccguccagcgcggc

SEQ ID NO: 2467564 - RNA, 16 nt, Bordetella pertussis
gccguccagcgcggca

SEQ ID NO: 2467565 - RNA, 17 nt, Bordetella pertussis
gccguccagcgcggcau

SEQ ID NO: 2467566 - RNA, 19 nt, Bordetella pertussis
gccguccagcgcggcaugc

SEQ ID NO: 2467567 - RNA, 23 nt, Bordetella pertussis
gccguccagcgcggcaugccgcu

SEQ ID NO: 2467568 - RNA, 18 nt, Bordetella pertussis
gccguccagcgcggcgcc

SEQ ID NO: 2467569 - RNA, 19 nt, Bordetella pertussis
gccguccagcgcggcgcca

SEQ ID NO: 2467570 - RNA, 20 nt, Bordetella pertussis
gccguccagcgcggcgccau

SEQ ID NO: 2467571 - RNA, 18 nt, Brucella suis 1330
gacgaucuuuuccauaug

SEQ ID NO: 2467572 - RNA, 14 nt, Brucella suis 1330
gacgauucgcccuu

SEQ ID NO: 2467573 - RNA, 22 nt, Brucella suis 1330
gacgauuucuuccagaauaucu

SEQ ID NO: 2467574 - RNA, 22 nt, Brucella suis 1330
gacgauuuucgccaagccggcg

SEQ ID NO: 2467575 - RNA, 12 nt, Brucella suis 1330
gacgcagccuuu

SEQ ID NO: 2467576 - RNA, 14 nt, Brucella suis 1330
gacgcgagcggacg

SEQ ID NO: 2467577 - RNA, 20 nt, Brucella suis 1330
gacgcgcagacgcagcgcau

SEQ ID NO: 2467578 - RNA, 20 nt, Brucella suis 1330
gacgcgcuaaaaagcgcgcg

SEQ ID NO: 2467579 - RNA, 19 nt, Brucella suis 1330
gacgcgugaaaauagcugg

SEQ ID NO: 2467580 - RNA, 21 nt, Brucella suis 1330
gacgcgugaaaauagcugggu

SEQ ID NO: 2467581 - RNA, 19 nt, Brucella suis 1330
gacgcuacccauucauuuc

SEQ ID NO: 2467582 - RNA, 20 nt, Brucella suis 1330
gacgcugcaacacgccgccg

SEQ ID NO: 2467583 - RNA, 16 nt, Brucella suis 1330
gacgcuuggcaccgcc

SEQ ID NO: 2467584 - RNA, 18 nt, Brucella suis 1330
gacgcuuggcaccgccug

SEQ ID NO: 2467585 - RNA, 13 nt, Brucella suis 1330
gacggagccuucg

SEQ ID NO: 2467586 - RNA, 13 nt, Brucella suis 1330
gacggcauaaaug

SEQ ID NO: 2467587 - RNA, 19 nt, Brucella suis 1330
gacggcgcagcgacuucca

SEQ ID NO: 2467588 - RNA, 12 nt, Brucella suis 1330
gacggcgcggcg

SEQ ID NO: 2467589 - RNA, 22 nt, Brucella suis 1330
gacggcgcggcgcauggccuca

SEQ ID NO: 2467590 - RNA, 12 nt, Brucella suis 1330
gacgggcaggca

SEQ ID NO: 2467591 - RNA, 19 nt, Brucella suis 1330
gacgggcaguccggcagcc

SEQ ID NO: 2467592 - RNA, 18 nt, Brucella suis 1330
gacgggcgagcgccagcg

SEQ ID NO: 2467593 - RNA, 18 nt, Brucella suis 1330
gacggggauugcuauuga

SEQ ID NO: 2467594 - RNA, 23 nt, Brucella suis 1330
gacgggguuucgccggugcccgg

SEQ ID NO: 2467595 - RNA, 18 nt, Brucella suis 1330
gacguccaccaccucgcc

SEQ ID NO: 2467596 - RNA, 20 nt, Brucella suis 1330
gacgugaccgccuggcccgg

SEQ ID NO: 2467597 - RNA, 14 nt, Brucella suis 1330
gacguggagcaggc

SEQ ID NO: 2467598 - RNA, 12 nt, Brucella suis 1330
gacuagacaaag

SEQ ID NO: 2467599 - RNA, 20 nt, Brucella suis 1330
gacuaugcgccacgagaacc

SEQ ID NO: 2467600 - RNA, 16 nt, Brucella suis 1330
gacucugaccuuccug

SEQ ID NO: 2467601 - RNA, 15 nt, Brucella suis 1330
gacucuuuucgcccg

SEQ ID NO: 2467602 - RNA, 12 nt, Brucella suis 1330
gacugaaauaau

SEQ ID NO: 2467603 - RNA, 17 nt, Brucella suis 1330
gacugauuuccccgcgu

SEQ ID NO: 2467604 - RNA, 15 nt, Brucella suis 1330
gacuggcggccaagc

SEQ ID NO: 2467605 - RNA, 23 nt, Brucella suis 1330
gacuuauuccgugccuugaauag

SEQ ID NO: 2467606 - RNA, 15 nt, Brucella suis 1330
gacuuccagaagcgc

SEQ ID NO: 2467607 - RNA, 15 nt, Brucella suis 1330
gacuuuauagaggaa

SEQ ID NO: 2467608 - RNA, 22 nt, Brucella suis 1330
gagaaaauggcgcuagcgauga

SEQ ID NO: 2467609 - RNA, 23 nt, Brucella suis 1330
gagaaagcuugucgcggccuuga

SEQ ID NO: 2467610 - RNA, 19 nt, Brucella suis 1330
gagaaccaccuuccugccu

SEQ ID NO: 2467611 - RNA, 13 nt, Brucella suis 1330
gagaacggcggcg

SEQ ID NO: 2467612 - RNA, 14 nt, Brucella suis 1330
gagaacggcggcgg

SEQ ID NO: 2467613 - RNA, 15 nt, Brucella suis 1330
gagaacggcggcggc

SEQ ID NO: 2467614 - RNA, 22 nt, Brucella suis 1330
gagaacuucggcauggcagccg

SEQ ID NO: 2467615 - RNA, 24 nt, Brucella suis 1330
gagaagcgguguggcccggucgac

SEQ ID NO: 2467616 - RNA, 21 nt, Brucella suis 1330
gagaauggcaacacggcgcuu

SEQ ID NO: 2467617 - RNA, 15 nt, Brucella suis 1330
gagaccugccaucac

SEQ ID NO: 2467618 - RNA, 19 nt, Brucella suis 1330
gagaccugccaucaccagc

SEQ ID NO: 2467619 - RNA, 20 nt, Brucella suis 1330
gagaccugccaucaccagcc

SEQ ID NO: 2467620 - RNA, 19 nt, Brucella suis 1330
gagacggguugcaccgcuc

SEQ ID NO: 2467621 - RNA, 19 nt, Brucella suis 1330
gagagauuucaccacgcca

SEQ ID NO: 2467622 - RNA, 18 nt, Brucella suis 1330
gagagcaugaucgcccgc

SEQ ID NO: 2467623 - RNA, 22 nt, Brucella suis 1330
gagagcaugaucgcccgcccgg

SEQ ID NO: 2467624 - RNA, 17 nt, Brucella suis 1330
gagaguagucugcgcau

SEQ ID NO: 2467625 - RNA, 14 nt, Brucella suis 1330
gagagugaugcaga

SEQ ID NO: 2467626 - RNA, 20 nt, Brucella suis 1330
gagauauccauaucuuucca

SEQ ID NO: 2467627 - RNA, 13 nt, Brucella suis 1330
gagauguguaggc

SEQ ID NO: 2467628 - RNA, 16 nt, Brucella suis 1330
gagauugggcagcaga

SEQ ID NO: 2467629 - RNA, 11 nt, Brucella suis 1330
gagauuucacc

SEQ ID NO: 2467630 - RNA, 20 nt, Brucella suis 1330
gagcaaguggaucuuugaaa

SEQ ID NO: 2467631 - RNA, 20 nt, Brucella suis 1330
gagcaaucccgucaagacaa

SEQ ID NO: 2467632 - RNA, 22 nt, Brucella suis 1330
gagcaccggaagcgcaaaacag

SEQ ID NO: 2467633 - RNA, 17 nt, Brucella suis 1330
gagcacgccgcucagga

SEQ ID NO: 2467634 - RNA, 22 nt, Brucella suis 1330
gagcagcucuauugcccggcgg

SEQ ID NO: 2467635 - RNA, 21 nt, Brucella suis 1330
gagcaggcaggccgccuggga

SEQ ID NO: 2467636 - RNA, 21 nt, Brucella suis 1330
gagcaggccgguaagcccugu

SEQ ID NO: 2467637 - RNA, 13 nt, Brucella suis 1330
gagcaggcucccg

SEQ ID NO: 2467638 - RNA, 17 nt, Brucella suis 1330
gagcaggcucccgccug

SEQ ID NO: 2467639 - RNA, 17 nt, Brucella suis 1330
gagcaugaugccgacga

SEQ ID NO: 2467640 - RNA, 20 nt, Brucella suis 1330
gagcauggcaaggccacgca

SEQ ID NO: 2467641 - RNA, 21 nt, Brucella suis 1330
gagcauucccuucgcgccgcc

SEQ ID NO: 2467642 - RNA, 16 nt, Brucella suis 1330
gagcauuuuucgggcg

SEQ ID NO: 2467643 - RNA, 20 nt, Brucella suis 1330
gagcauuuuucgggcgaaug

SEQ ID NO: 2467644 - RNA, 16 nt, Brucella suis 1330
gagccacgagaaaaug

SEQ ID NO: 2467645 - RNA, 13 nt, Brucella suis 1330
gagcccgccgaaa

SEQ ID NO: 2467646 - RNA, 18 nt, Brucella suis 1330
gagccgccguaauggcuu

SEQ ID NO: 2467647 - RNA, 15 nt, Brucella suis 1330
gagccgcgccaugcc

SEQ ID NO: 2467648 - RNA, 15 nt, Brucella suis 1330
gagccgcucuaacua

SEQ ID NO: 2467649 - RNA, 20 nt, Brucella suis 1330
gagccggaaaauaucaaagc

SEQ ID NO: 2467650 - RNA, 18 nt, Brucella suis 1330
gagccggccacgaaaugg

SEQ ID NO: 2467651 - RNA, 18 nt, Brucella suis 1330
gagccgggcugugacuuu

SEQ ID NO: 2467652 - RNA, 21 nt, Brucella suis 1330
gagccucggcgcggacaagcu

SEQ ID NO: 2467653 - RNA, 21 nt, Brucella suis 1330
gagccugccguucgcaaaugg

SEQ ID NO: 2467654 - RNA, 18 nt, Brucella suis 1330
gagcgacauauucuuccg

SEQ ID NO: 2467655 - RNA, 23 nt, Brucella suis 1330
gagcgagcuugcaaugagcgcgc

SEQ ID NO: 2467656 - RNA, 13 nt, Brucella suis 1330
gagcgauccgcca

SEQ ID NO: 2467657 - RNA, 19 nt, Brucella suis 1330
gagcgauuucuggagccgc

SEQ ID NO: 2467658 - RNA, 20 nt, Brucella suis 1330
gagcgauuucuggagccgcu

SEQ ID NO: 2467659 - RNA, 20 nt, Brucella suis 1330
gagcgcaaggcuucgccagu

SEQ ID NO: 2467660 - RNA, 17 nt, Brucella suis 1330
gagcgcaauaucggcga

SEQ ID NO: 2467661 - RNA, 12 nt, Brucella suis 1330
gagcgcacauaa

SEQ ID NO: 2467662 - RNA, 14 nt, Brucella suis 1330
gagcgcacauaaaa

SEQ ID NO: 2467663 - RNA, 16 nt, Brucella suis 1330
gagcgcagcggcagca

SEQ ID NO: 2467664 - RNA, 14 nt, Brucella suis 1330
gagcgcauccagcg

SEQ ID NO: 2467665 - RNA, 20 nt, Brucella suis 1330
gagcgccuguccgccugcca

SEQ ID NO: 2467666 - RNA, 15 nt, Brucella suis 1330
gagcggcagcggcgu

SEQ ID NO: 2467667 - RNA, 15 nt, Brucella suis 1330
gagcggguucccacu

SEQ ID NO: 2467668 - RNA, 12 nt, Brucella suis 1330
gagcguccgagc

SEQ ID NO: 2467669 - RNA, 15 nt, Brucella suis 1330
gagcgugaccagccc

SEQ ID NO: 2467670 - RNA, 19 nt, Brucella suis 1330
gagcguuacuucggcggcg

SEQ ID NO: 2467671 - RNA, 19 nt, Brucella suis 1330
gagcugcaagggaaugcgc

SEQ ID NO: 2467672 - RNA, 15 nt, Brucella suis 1330
gagcugcaucgcagg

SEQ ID NO: 2467673 - RNA, 21 nt, Brucella suis 1330
gagcuucggauuuuucucaau

SEQ ID NO: 2467674 - RNA, 20 nt, Brucella suis 1330
gagcuuguugcggcgagcga

SEQ ID NO: 2467675 - RNA, 14 nt, Brucella suis 1330
gaggaaaaagcccg

SEQ ID NO: 2467676 - RNA, 15 nt, Brucella suis 1330
gaggaaaaagcccgc

SEQ ID NO: 2467677 - RNA, 17 nt, Brucella suis 1330
gaggaaaaagcccgcca

SEQ ID NO: 2467678 - RNA, 15 nt, Brucella suis 1330
gaggaaauugacgcc

SEQ ID NO: 2467679 - RNA, 14 nt, Brucella suis 1330
gaggaaguggaagc

SEQ ID NO: 2467680 - RNA, 19 nt, Brucella suis 1330
gaggaggggacgcagccuu

SEQ ID NO: 2467681 - RNA, 21 nt, Brucella suis 1330
gaggauuuccacccgguucga

SEQ ID NO: 2467682 - RNA, 21 nt, Brucella suis 1330
gaggcaaaugccgaagcccau

SEQ ID NO: 2467683 - RNA, 11 nt, Brucella suis 1330
gaggcaaugaa

SEQ ID NO: 2467684 - RNA, 16 nt, Brucella suis 1330
gaggcaaugaaaacgg

SEQ ID NO: 2467685 - RNA, 15 nt, Brucella suis 1330
gaggcaucagccucc

SEQ ID NO: 2467686 - RNA, 20 nt, Brucella suis 1330
gaggcaucagccucccuuca

SEQ ID NO: 2467687 - RNA, 15 nt, Brucella suis 1330
gaggccauggcuuca

SEQ ID NO: 2467688 - RNA, 14 nt, Brucella suis 1330
gaggccgaacgagg

SEQ ID NO: 2467689 - RNA, 21 nt, Brucella suis 1330
gaagcgcgcgcccgugacaag

SEQ ID NO: 2467690 - RNA, 14 nt, Brucella suis 1330
gaagcgcggcggcc

SEQ ID NO: 2467691 - RNA, 13 nt, Brucella suis 1330
gaagcgcugcaaa

SEQ ID NO: 2467692 - RNA, 22 nt, Brucella suis 1330
gaagcggcgcgaugcgaaacgg

SEQ ID NO: 2467693 - RNA, 19 nt, Brucella suis 1330
gaagcguaaugccccgcac

SEQ ID NO: 2467694 - RNA, 14 nt, Brucella suis 1330
gaaggaaagcccag

SEQ ID NO: 2467695 - RNA, 16 nt, Brucella suis 1330
gaaggaaugggcgggg

SEQ ID NO: 2467696 - RNA, 12 nt, Brucella suis 1330
gaaggagaggcc

SEQ ID NO: 2467697 - RNA, 14 nt, Brucella suis 1330
gaaggcaagcaggc

SEQ ID NO: 2467698 - RNA, 18 nt, Brucella suis 1330
gaaggcaagccccagcac

SEQ ID NO: 2467699 - RNA, 14 nt, Brucella suis 1330
gaaggcaucggugc

SEQ ID NO: 2467700 - RNA, 19 nt, Brucella suis 1330
gaaggcaucggugcgcggc

SEQ ID NO: 2467701 - RNA, 14 nt, Brucella suis 1330
gaaggcccuucagg

SEQ ID NO: 2467702 - RNA, 22 nt, Brucella suis 1330
gaaggcgcgacguaaagcguga

SEQ ID NO: 2467703 - RNA, 15 nt, Brucella suis 1330
gaaggcgcggcagcu

SEQ ID NO: 2467704 - RNA, 22 nt, Brucella suis 1330
gaaggcgcggcagcuaugcgcc

SEQ ID NO: 2467705 - RNA, 17 nt, Brucella suis 1330
gaaggcgcugcacaccc

SEQ ID NO: 2467706 - RNA, 18 nt, Brucella suis 1330
gaaggcguuggccgcggc

SEQ ID NO: 2467707 - RNA, 21 nt, Brucella suis 1330
gaaggcugagugagccuuccg

SEQ ID NO: 2467708 - RNA, 22 nt, Brucella suis 1330
gaaggcugccgggguuuuucuu

SEQ ID NO: 2467709 - RNA, 13 nt, Brucella suis 1330
gaagggaaagcgg

SEQ ID NO: 2467710 - RNA, 11 nt, Brucella suis 1330
gaagggcaagg

SEQ ID NO: 2467711 - RNA, 19 nt, Brucella suis 1330
gaagggcugagggaaacac

SEQ ID NO: 2467712 - RNA, 16 nt, Brucella suis 1330
gaaggucaaaaagggc

SEQ ID NO: 2467713 - RNA, 21 nt, Brucella suis 1330
gaaguaggugcgcggguauug

SEQ ID NO: 2467714 - RNA, 19 nt, Brucella suis 1330
gaagucacgauggcccagc

SEQ ID NO: 2467715 - RNA, 15 nt, Brucella suis 1330
gaagugcauaugaug

SEQ ID NO: 2467716 - RNA, 14 nt, Brucella suis 1330
gaagugcugcugca

SEQ ID NO: 2467717 - RNA, 22 nt, Brucella suis 1330
gaauaaaacgccggguaugaca

SEQ ID NO: 2467718 - RNA, 15 nt, Brucella suis 1330
gaauagcgagaucga

SEQ ID NO: 2467719 - RNA, 13 nt, Brucella suis 1330
gaauaucuugaag

SEQ ID NO: 2467720 - RNA, 16 nt, Brucella suis 1330
gaauaucuugaagccu

SEQ ID NO: 2467721 - RNA, 24 nt, Brucella suis 1330
gaaucagaucggcgcucuaauccu

SEQ ID NO: 2467722 - RNA, 19 nt, Brucella suis 1330
gaaucuaagcggaaaacgg

SEQ ID NO: 2467723 - RNA, 23 nt, Brucella suis 1330
gaaucuccggcccauaccgcgcc

SEQ ID NO: 2467724 - RNA, 21 nt, Brucella suis 1330
gaaucugaggccauuuugacc

SEQ ID NO: 2467725 - RNA, 20 nt, Brucella suis 1330
gaaucugccuugucagaagc

SEQ ID NO: 2467726 - RNA, 23 nt, Brucella suis 1330
gaaugacauggaaaugcagguga

SEQ ID NO: 2467727 - RNA, 16 nt, Brucella suis 1330
gaaugacuucaucgcg

SEQ ID NO: 2467728 - RNA, 17 nt, Brucella suis 1330
gaaugcagacaaguccu

SEQ ID NO: 2467729 - RNA, 16 nt, Brucella suis 1330
gaaugcagaucagucc

SEQ ID NO: 2467730 - RNA, 20 nt, Brucella suis 1330
gaaugcccuugagaagcucg

SEQ ID NO: 2467731 - RNA, 17 nt, Brucella suis 1330
gaaugccgaagccaggu

SEQ ID NO: 2467732 - RNA, 13 nt, Brucella suis 1330
gaaugcgccgcca

SEQ ID NO: 2467733 - RNA, 19 nt, Brucella suis 1330
gaaugcggcaaucgcuuca

SEQ ID NO: 2467734 - RNA, 14 nt, Brucella suis 1330
gaauggcgaaaucg

SEQ ID NO: 2467735 - RNA, 17 nt, Brucella suis 1330
gaauggcgaaaucgcca

SEQ ID NO: 2467736 - RNA, 17 nt, Brucella suis 1330
gaauggggggcaggcaa

SEQ ID NO: 2467737 - RNA, 21 nt, Brucella suis 1330
gaauuccugaaccacuuccga

SEQ ID NO: 2467738 - RNA, 14 nt, Brucella suis 1330
gaauuguuccagcc

SEQ ID NO: 2467739 - RNA, 14 nt, Brucella suis 1330
gacaaccgcgccgc

SEQ ID NO: 2467740 - RNA, 13 nt, Brucella suis 1330
gacaacgcgcagc

SEQ ID NO: 2467741 - RNA, 15 nt, Brucella suis 1330
gacaagccgcuccgc

SEQ ID NO: 2467742 - RNA, 17 nt, Brucella suis 1330
gacaagccgcuccgcac

SEQ ID NO: 2467743 - RNA, 17 nt, Brucella suis 1330
gacaagcgugagcuuca

SEQ ID NO: 2467744 - RNA, 19 nt, Brucella suis 1330
gacaagcucgcguuccagc

SEQ ID NO: 2467745 - RNA, 14 nt, Brucella suis 1330
gacaaucuccccuu

SEQ ID NO: 2467746 - RNA, 21 nt, Brucella suis 1330
gacaaucuugcgcagcgcagg

SEQ ID NO: 2467747 - RNA, 20 nt, Brucella suis 1330
gacaauggcaauaugcgccu

SEQ ID NO: 2467748 - RNA, 19 nt, Brucella suis 1330
gacaccuucggccagcgca

SEQ ID NO: 2467749 - RNA, 14 nt, Brucella suis 1330
gacacgccggaaca

SEQ ID NO: 2467750 - RNA, 18 nt, Brucella suis 1330
gacagcaaccgaaagcgc

SEQ ID NO: 2467751 - RNA, 12 nt, Brucella suis 1330
gacagcacugcc

SEQ ID NO: 2467752 - RNA, 19 nt, Brucella suis 1330
gacagggcaagcgccugcu

SEQ ID NO: 2467753 - RNA, 17 nt, Brucella suis 1330
gacagggcgcugcgaag

SEQ ID NO: 2467754 - RNA, 13 nt, Brucella suis 1330
gacagggcggauc

SEQ ID NO: 2467755 - RNA, 17 nt, Brucella suis 1330
gacaggguaagcgccuu

SEQ ID NO: 2467756 - RNA, 23 nt, Brucella suis 1330
gacauagacgcuuggcaccgccu

SEQ ID NO: 2467757 - RNA, 14 nt, Brucella suis 1330
gacauauucuuccg

SEQ ID NO: 2467758 - RNA, 15 nt, Brucella suis 1330
gacauauucuuccgu

SEQ ID NO: 2467759 - RNA, 23 nt, Brucella suis 1330
gacauccaucggcucauccucca

SEQ ID NO: 2467760 - RNA, 19 nt, Brucella suis 1330
gacaugaaggagaggccga

SEQ ID NO: 2467761 - RNA, 20 nt, Brucella suis 1330
gacaugaaggagaggccgau

SEQ ID NO: 2467762 - RNA, 20 nt, Brucella suis 1330
gacaugcaugacaccuucgg

SEQ ID NO: 2467763 - RNA, 12 nt, Brucella suis 1330
gacaugccaaga

SEQ ID NO: 2467764 - RNA, 18 nt, Brucella suis 1330
gacaugccaagagccgcu

SEQ ID NO: 2467765 - RNA, 21 nt, Brucella suis 1330
gacauggguggcgcccgcccg

SEQ ID NO: 2467766 - RNA, 13 nt, Brucella suis 1330
gacauguucuagu

SEQ ID NO: 2467767 - RNA, 14 nt, Brucella suis 1330
gacauucugcacgu

SEQ ID NO: 2467768 - RNA, 13 nt, Brucella suis 1330
gaccacauugccc

SEQ ID NO: 2467769 - RNA, 16 nt, Brucella suis 1330
gaccacccggccgccc

SEQ ID NO: 2467770 - RNA, 14 nt, Brucella suis 1330
gaccaccgcacggu

SEQ ID NO: 2467771 - RNA, 21 nt, Brucella suis 1330
gaccaccggccugagccauau

SEQ ID NO: 2467772 - RNA, 14 nt, Brucella suis 1330
gaccacgccgagga

SEQ ID NO: 2467773 - RNA, 13 nt, Brucella suis 1330
gaccagcaggaag

SEQ ID NO: 2467774 - RNA, 14 nt, Brucella suis 1330
gaccagcaggaaga

SEQ ID NO: 2467775 - RNA, 23 nt, Brucella suis 1330
gaccagcaggaagaaggcgacga

SEQ ID NO: 2467776 - RNA, 19 nt, Brucella suis 1330
gaccagccuugcccuggcu

SEQ ID NO: 2467777 - RNA, 16 nt, Brucella suis 1330
gaccagcgcaaugccc

SEQ ID NO: 2467778 - RNA, 16 nt, Brucella suis 1330
gaccauauugcugggc

SEQ ID NO: 2467779 - RNA, 20 nt, Brucella suis 1330
gaccauggcgcauucagagc

SEQ ID NO: 2467780 - RNA, 18 nt, Brucella suis 1330
gaccauggcggaacccac

SEQ ID NO: 2467781 - RNA, 17 nt, Brucella suis 1330
gacccaauccgccaacg

SEQ ID NO: 2467782 - RNA, 13 nt, Brucella suis 1330
gaccgaaggccag

SEQ ID NO: 2467783 - RNA, 13 nt, Brucella suis 1330
gaccgccgcgauu

SEQ ID NO: 2467784 - RNA, 16 nt, Brucella suis 1330
gaccgccuggcccggc

SEQ ID NO: 2467785 - RNA, 14 nt, Brucella suis 1330
gaccgccuuuucca

SEQ ID NO: 2467786 - RNA, 15 nt, Brucella suis 1330
gaccgccuuuuccag

SEQ ID NO: 2467787 - RNA, 13 nt, Brucella suis 1330
gaccggaucgcgc

SEQ ID NO: 2467788 - RNA, 15 nt, Brucella suis 1330
gaccggcggcaggca

SEQ ID NO: 2467789 - RNA, 16 nt, Brucella suis 1330
gaccggcggcaggcag

SEQ ID NO: 2467790 - RNA, 14 nt, Brucella suis 1330
gaccggcuggucaa

SEQ ID NO: 2467791 - RNA, 15 nt, Brucella suis 1330
gaccgucaaaacgcc

SEQ ID NO: 2467792 - RNA, 20 nt, Brucella suis 1330
gaccguucaacuggcgcagc

SEQ ID NO: 2467793 - RNA, 20 nt, Brucella suis 1330
gaccuucgaguucgccagca

SEQ ID NO: 2467794 - RNA, 23 nt, Brucella suis 1330
gaccuucgaguucgccagcaccu

SEQ ID NO: 2467795 - RNA, 17 nt, Brucella suis 1330
gaccuucuuggagccga

SEQ ID NO: 2467796 - RNA, 17 nt, Brucella suis 1330
gaccuugaugauagaau

SEQ ID NO: 2467797 - RNA, 22 nt, Brucella suis 1330
gaccuuguuaauucugccgcuc

SEQ ID NO: 2467798 - RNA, 19 nt, Brucella suis 1330
gacgaaaaaggcgaucagg

SEQ ID NO: 2467799 - RNA, 20 nt, Brucella suis 1330
gacgaaagccacgcuccaca

SEQ ID NO: 2467800 - RNA, 17 nt, Brucella suis 1330
gacgaaaggcggcgcau

SEQ ID NO: 2467801 - RNA, 18 nt, Brucella suis 1330
gacgaaccccgcaucaug

SEQ ID NO: 2467802 - RNA, 14 nt, Brucella suis 1330
gacgaauggugagg

SEQ ID NO: 2467803 - RNA, 15 nt, Brucella suis 1330
gacgacgaaucuuca

SEQ ID NO: 2467804 - RNA, 15 nt, Brucella suis 1330
gacgacugaaauaau

SEQ ID NO: 2467805 - RNA, 15 nt, Brucella suis 1330
gacgagauugccgcc

SEQ ID NO: 2467806 - RNA, 20 nt, Brucella suis 1330
gacgaucuggaacaguucca

SEQ ID NO: 2467807 - RNA, 15 nt, Brucella suis 1330
gacgaucuggaaggc

SEQ ID NO: 2467808 - RNA, 16 nt, Brucella suis 1330
gaaacaaggccgagcg

SEQ ID NO: 2467809 - RNA, 16 nt, Brucella suis 1330
gaaacagcauauugcc

SEQ ID NO: 2467810 - RNA, 19 nt, Brucella suis 1330
gaaaccauccaugcgcggc

SEQ ID NO: 2467811 - RNA, 15 nt, Brucella suis 1330
gaaaccaucgagcau

SEQ ID NO: 2467812 - RNA, 21 nt, Brucella suis 1330
gaaacccgcgaucaccagccc

SEQ ID NO: 2467813 - RNA, 20 nt, Brucella suis 1330
gaaacccgcucuacuugguu

SEQ ID NO: 2467814 - RNA, 19 nt, Brucella suis 1330
gaaaccggcauuauccgca

SEQ ID NO: 2467815 - RNA, 14 nt, Brucella suis 1330
gaaaccgucacgcc

SEQ ID NO: 2467816 - RNA, 12 nt, Brucella suis 1330
gaaaccgugaca

SEQ ID NO: 2467817 - RNA, 13 nt, Brucella suis 1330
gaaacgcgugcca

SEQ ID NO: 2467818 - RNA, 14 nt, Brucella suis 1330
gaaacggcagccga

SEQ ID NO: 2467819 - RNA, 14 nt, Brucella suis 1330
gaaacggccagggc

SEQ ID NO: 2467820 - RNA, 14 nt, Brucella suis 1330
gaaacucucacagc

SEQ ID NO: 2467821 - RNA, 20 nt, Brucella suis 1330
gaaacugaaaaaggccggga

SEQ ID NO: 2467822 - RNA, 20 nt, Brucella suis 1330
gaaagacauuuucgccgggg

SEQ ID NO: 2467823 - RNA, 19 nt, Brucella suis 1330
gaaagacucgaacaggccc

SEQ ID NO: 2467824 - RNA, 14 nt, Brucella suis 1330
gaaagaugaaucac

SEQ ID NO: 2467825 - RNA, 13 nt, Brucella suis 1330
gaaagccacgcuc

SEQ ID NO: 2467826 - RNA, 13 nt, Brucella suis 1330
gaaagccagaacc

SEQ ID NO: 2467827 - RNA, 22 nt, Brucella suis 1330
gaaagcccaguucguggcgggg

SEQ ID NO: 2467828 - RNA, 15 nt, Brucella suis 1330
gaaagcccggcugga

SEQ ID NO: 2467829 - RNA, 16 nt, Brucella suis 1330
gaaagcgccagauuca

SEQ ID NO: 2467830 - RNA, 19 nt, Brucella suis 1330
gaaagcggauuggcguuca

SEQ ID NO: 2467831 - RNA, 15 nt, Brucella suis 1330
gaaagcgggccugug

SEQ ID NO: 2467832 - RNA, 18 nt, Brucella suis 1330
gaaagcguaaaccucccu

SEQ ID NO: 2467833 - RNA, 22 nt, Brucella suis 1330
gaaagcugccgcgaaaaagccg

SEQ ID NO: 2467834 - RNA, 13 nt, Brucella suis 1330
gaaaggagcacga

SEQ ID NO: 2467835 - RNA, 19 nt, Brucella suis 1330
gaaaggcucuauuuuucca

SEQ ID NO: 2467836 - RNA, 24 nt, Brucella suis 1330
gaaaggcuucgcgaacaugcgcca

SEQ ID NO: 2467837 - RNA, 22 nt, Brucella suis 1330
gaaagggccgccuugcuugaag

SEQ ID NO: 2467838 - RNA, 22 nt, Brucella suis 1330
gaaagucuggaacguguugaga

SEQ ID NO: 2467839 - RNA, 23 nt, Brucella suis 1330
gaaauagcacauaucagcccgcu

SEQ ID NO: 2467840 - RNA, 16 nt, Brucella suis 1330
gaaauagcucauguuc

SEQ ID NO: 2467841 - RNA, 13 nt, Brucella suis 1330
gaaauaucgccga

SEQ ID NO: 2467842 - RNA, 15 nt, Brucella suis 1330
gaaaucaagaugcuu

SEQ ID NO: 2467843 - RNA, 23 nt, Brucella suis 1330
gaaauccacuacaaccggcucgc

SEQ ID NO: 2467844 - RNA, 22 nt, Brucella suis 1330
gaaauccauagcgaauggcaau

SEQ ID NO: 2467845 - RNA, 18 nt, Brucella suis 1330
gaaauccuucagaagcac

SEQ ID NO: 2467846 - RNA, 15 nt, Brucella suis 1330
gaaaucugcgccggu

SEQ ID NO: 2467847 - RNA, 21 nt, Brucella suis 1330
gaaaugcggaucguaucgcca

SEQ ID NO: 2467848 - RNA, 20 nt, Brucella suis 1330
gaaauggccccauaaagcug

SEQ ID NO: 2467849 - RNA, 14 nt, Brucella suis 1330
gaaauuauagccgc

SEQ ID NO: 2467850 - RNA, 16 nt, Brucella suis 1330
gaaauucgcuguugcg

SEQ ID NO: 2467851 - RNA, 21 nt, Brucella suis 1330
gaaauucgcuguugcgcccgc

SEQ ID NO: 2467852 - RNA, 15 nt, Brucella suis 1330
gaaauugcuccagcc

SEQ ID NO: 2467853 - RNA, 20 nt, Brucella suis 1330
gaaauuggccgcugccugca

SEQ ID NO: 2467854 - RNA, 13 nt, Brucella suis 1330
gaaauuucagcca

SEQ ID NO: 2467855 - RNA, 16 nt, Brucella suis 1330
gaacaaacuuauccag

SEQ ID NO: 2467856 - RNA, 15 nt, Brucella suis 1330
gaacaagcagaugca

SEQ ID NO: 2467857 - RNA, 20 nt, Brucella suis 1330
gaacaagcagaugcagcgga

SEQ ID NO: 2467858 - RNA, 20 nt, Brucella suis 1330
gaacacagagacaggaaaag

SEQ ID NO: 2467859 - RNA, 15 nt, Brucella suis 1330
gaacagaagcaccag

SEQ ID NO: 2467860 - RNA, 20 nt, Brucella suis 1330
gaacagaagcaccagcgcgc

SEQ ID NO: 2467861 - RNA, 13 nt, Brucella suis 1330
gaacagaucgcca

SEQ ID NO: 2467862 - RNA, 20 nt, Brucella suis 1330
gaacagaucggaaucaaaac

SEQ ID NO: 2467863 - RNA, 23 nt, Brucella suis 1330
gaacagcgcgaacaugccugccg

SEQ ID NO: 2467864 - RNA, 15 nt, Brucella suis 1330
gaacaggagcggaag

SEQ ID NO: 2467865 - RNA, 16 nt, Brucella suis 1330
gaacagguugcgccac

SEQ ID NO: 2467866 - RNA, 18 nt, Brucella suis 1330
gaacauauguuucggggc

SEQ ID NO: 2467867 - RNA, 13 nt, Brucella suis 1330
gaacaucagaagc

SEQ ID NO: 2467868 - RNA, 21 nt, Brucella suis 1330
gaacaucgaggaauuuccgcu

SEQ ID NO: 2467869 - RNA, 14 nt, Brucella suis 1330
gaacaugcgccaga

SEQ ID NO: 2467870 - RNA, 19 nt, Brucella suis 1330
gaaccagauccaccgcgcu

SEQ ID NO: 2467871 - RNA, 15 nt, Brucella suis 1330
gaaccaggccgcggg

SEQ ID NO: 2467872 - RNA, 23 nt, Brucella suis 1330
gaaccccaugguuugcagcaauu

SEQ ID NO: 2467873 - RNA, 14 nt, Brucella suis 1330
gaacccgccgaccg

SEQ ID NO: 2467874 - RNA, 20 nt, Brucella suis 1330
gaacccggccucugcaagag

SEQ ID NO: 2467875 - RNA, 17 nt, Brucella suis 1330
gaaccgaaaccgugaca

SEQ ID NO: 2467876 - RNA, 16 nt, Brucella suis 1330
gaaccgaacgcgccuu

SEQ ID NO: 2467877 - RNA, 20 nt, Brucella suis 1330
gaaccgaacgcgccuuuucu

SEQ ID NO: 2467878 - RNA, 19 nt, Brucella suis 1330
gaaccgaggcaaugaaaac

SEQ ID NO: 2467879 - RNA, 16 nt, Brucella suis 1330
gaaccggcgagccggg

SEQ ID NO: 2467880 - RNA, 18 nt, Brucella suis 1330
gaaccggcugucccugcg

SEQ ID NO: 2467881 - RNA, 22 nt, Brucella suis 1330
gaaccgggcccuucucgacagc

SEQ ID NO: 2467882 - RNA, 15 nt, Brucella suis 1330
gaaccggggcagggc

SEQ ID NO: 2467883 - RNA, 15 nt, Brucella suis 1330
gaaccgguuuucggg

SEQ ID NO: 2467884 - RNA, 18 nt, Brucella suis 1330
gaaccgucgccagcucgc

SEQ ID NO: 2467885 - RNA, 21 nt, Brucella suis 1330
gaaccgucgcuauauugccgc

SEQ ID NO: 2467886 - RNA, 14 nt, Brucella suis 1330
gaacgagcuccccg

SEQ ID NO: 2467887 - RNA, 16 nt, Brucella suis 1330
gaacgcauagagccac

SEQ ID NO: 2467888 - RNA, 17 nt, Brucella suis 1330
gaacgcaucgagcuggu

SEQ ID NO: 2467889 - RNA, 16 nt, Brucella suis 1330
gaacgccaaugcgguc

SEQ ID NO: 2467890 - RNA, 20 nt, Brucella suis 1330
gaacgccgccggaaacgggc

SEQ ID NO: 2467891 - RNA, 16 nt, Brucella suis 1330
gaacggcgugcgcugu

SEQ ID NO: 2467892 - RNA, 19 nt, Brucella suis 1330
gaacgggggcgaucaucaa

SEQ ID NO: 2467893 - RNA, 20 nt, Brucella suis 1330
gaacggguggcgcgaaaccg

SEQ ID NO: 2467894 - RNA, 23 nt, Brucella suis 1330
gaacucgcccaccgaagccacga

SEQ ID NO: 2467895 - RNA, 22 nt, Brucella suis 1330
gaacuggcggaugaagaagaua

SEQ ID NO: 2467896 - RNA, 16 nt, Brucella suis 1330
gaacuucgccaagccc

SEQ ID NO: 2467897 - RNA, 16 nt, Brucella suis 1330
gaacuucggcauggca

SEQ ID NO: 2467898 - RNA, 21 nt, Brucella suis 1330
gaagaaauucgcuguugcgcc

SEQ ID NO: 2467899 - RNA, 19 nt, Brucella suis 1330
gaagaacagaagcaccagc

SEQ ID NO: 2467900 - RNA, 17 nt, Brucella suis 1330
gaagaagagccugccgu

SEQ ID NO: 2467901 - RNA, 20 nt, Brucella suis 1330
gaagaagauaaucagcagaa

SEQ ID NO: 2467902 - RNA, 22 nt, Brucella suis 1330
gaagaagauaaucagcagaagg

SEQ ID NO: 2467903 - RNA, 17 nt, Brucella suis 1330
gaagaagcgccagcuuc

SEQ ID NO: 2467904 - RNA, 19 nt, Brucella suis 1330
gaagaagcgccagcuuccg

SEQ ID NO: 2467905 - RNA, 15 nt, Brucella suis 1330
gaagacauugccaag

SEQ ID NO: 2467906 - RNA, 16 nt, Brucella suis 1330
gaagacgaucuuuucc

SEQ ID NO: 2467907 - RNA, 18 nt, Brucella suis 1330
gaagagcguugcugccgg

SEQ ID NO: 2467908 - RNA, 15 nt, Brucella suis 1330
gaagauaaucagcag

SEQ ID NO: 2467909 - RNA, 22 nt, Brucella suis 1330
gaagauaaucgaugucgccgcu

SEQ ID NO: 2467910 - RNA, 18 nt, Brucella suis 1330
gaagaucaaguggcuuuu

SEQ ID NO: 2467911 - RNA, 23 nt, Brucella suis 1330
gaagaucgucggcaagcuggaag

SEQ ID NO: 2467912 - RNA, 16 nt, Brucella suis 1330
gaagaugacgcccagc

SEQ ID NO: 2467913 - RNA, 12 nt, Brucella suis 1330
gaagaugcaaug

SEQ ID NO: 2467914 - RNA, 22 nt, Brucella suis 1330
gaagauugaugauaggcugcuu

SEQ ID NO: 2467915 - RNA, 16 nt, Brucella suis 1330
gaagauuucguacugc

SEQ ID NO: 2467916 - RNA, 15 nt, Brucella suis 1330
gaagcacauggcggc

SEQ ID NO: 2467917 - RNA, 19 nt, Brucella suis 1330
gaagcaccagcgcgccgau

SEQ ID NO: 2467918 - RNA, 22 nt, Brucella suis 1330
gaagccagguggcugcccgccg

SEQ ID NO: 2467919 - RNA, 19 nt, Brucella suis 1330
gaagccaucuuucuugaag

SEQ ID NO: 2467920 - RNA, 16 nt, Brucella suis 1330
gaagccgaagaacagu

SEQ ID NO: 2467921 - RNA, 15 nt, Brucella suis 1330
gaagccgauccgcag

SEQ ID NO: 2467922 - RNA, 20 nt, Brucella suis 1330
gaagccgguucguugaacug

SEQ ID NO: 2467923 - RNA, 22 nt, Brucella suis 1330
gaagccgguucguugaacugca

SEQ ID NO: 2467924 - RNA, 17 nt, Brucella suis 1330
gaagcgaagaacagaag

SEQ ID NO: 2467925 - RNA, 18 nt, Brucella suis 1330
gaagcgccuacgcgggga

SEQ ID NO: 2467926 - RNA, 16 nt, Brucella suis 1330
gaggccgaccagaacg

SEQ ID NO: 2467927 - RNA, 20 nt, Brucella suis 1330
gaggccgccaccggaaagau

SEQ ID NO: 2467928 - RNA, 23 nt, Brucella suis 1330
gaggcgaauggauugcgggcaug

SEQ ID NO: 2467929 - RNA, 18 nt, Brucella suis 1330
gaggcggauaucgccuga

SEQ ID NO: 2467930 - RNA, 15 nt, Brucella suis 1330
gaggcggcugccuuu

SEQ ID NO: 2467931 - RNA, 14 nt, Brucella suis 1330
gaggcggcugcggc

SEQ ID NO: 2467932 - RNA, 19 nt, Brucella suis 1330
gaggcuuccgaaucgcugu

SEQ ID NO: 2467933 - RNA, 15 nt, Brucella suis 1330
gaggcuuucgccggu

SEQ ID NO: 2467934 - RNA, 16 nt, Brucella suis 1330
gagggaaacacucugc

SEQ ID NO: 2467935 - RNA, 19 nt, Brucella suis 1330
gagggccagaagauugaac

SEQ ID NO: 2467936 - RNA, 14 nt, Brucella suis 1330
gagggccucgauuu

SEQ ID NO: 2467937 - RNA, 17 nt, Brucella suis 1330
gagggccucgauuucau

SEQ ID NO: 2467938 - RNA, 14 nt, Brucella suis 1330
gagggcgcagcagc

SEQ ID NO: 2467939 - RNA, 17 nt, Brucella suis 1330
gagggguaaauccucca

SEQ ID NO: 2467940 - RNA, 15 nt, Brucella suis 1330
gagguaggacugugg

SEQ ID NO: 2467941 - RNA, 19 nt, Brucella suis 1330
gagguucguuuuauggcga

SEQ ID NO: 2467942 - RNA, 15 nt, Brucella suis 1330
gagguugagcugcuc

SEQ ID NO: 2467943 - RNA, 17 nt, Brucella suis 1330
gagguugagcugcucgg

SEQ ID NO: 2467944 - RNA, 20 nt, Brucella suis 1330
gaguaucuggcgauaaagau

SEQ ID NO: 2467945 - RNA, 12 nt, Brucella suis 1330
gagugcggccug

SEQ ID NO: 2467946 - RNA, 18 nt, Brucella suis 1330
gagugugcauuccccgcc

SEQ ID NO: 2467947 - RNA, 14 nt, Brucella suis 1330
gaguucgccagcac

SEQ ID NO: 2467948 - RNA, 20 nt, Brucella suis 1330
gaguucgcccgucucgcagc

SEQ ID NO: 2467949 - RNA, 19 nt, Brucella suis 1330
gaguucugcgcggaaacca

SEQ ID NO: 2467950 - RNA, 20 nt, Brucella suis 1330
gaguugucaauacaccugca

SEQ ID NO: 2467951 - RNA, 14 nt, Brucella suis 1330
gaguuuuucuucca

SEQ ID NO: 2467952 - RNA, 15 nt, Brucella suis 1330
gaguuuuucuuccag

SEQ ID NO: 2467953 - RNA, 15 nt, Brucella suis 1330
gauaaacccgccccc

SEQ ID NO: 2467954 - RNA, 17 nt, Brucella suis 1330
gauaauagaugagcugg

SEQ ID NO: 2467955 - RNA, 13 nt, Brucella suis 1330
gauaaucagcaga

SEQ ID NO: 2467956 - RNA, 20 nt, Brucella suis 1330
gauaaucuggcugguagcgc

SEQ ID NO: 2467957 - RNA, 13 nt, Brucella suis 1330
gauaaugaagaca

SEQ ID NO: 2467958 - RNA, 19 nt, Brucella suis 1330
gauaaugcgauaaaaugaa

SEQ ID NO: 2467959 - RNA, 23 nt, Brucella suis 1330
gauaaugcucgcccagaaacaau

SEQ ID NO: 2467960 - RNA, 22 nt, Brucella suis 1330
gauacauauacuuacuaguggu

SEQ ID NO: 2467961 - RNA, 15 nt, Brucella suis 1330
gauaccaaggccgau

SEQ ID NO: 2467962 - RNA, 22 nt, Brucella suis 1330
gauacccaugcgaugagccuuc

SEQ ID NO: 2467963 - RNA, 23 nt, Brucella suis 1330
gauacgccccgugaucuugucca

SEQ ID NO: 2467964 - RNA, 16 nt, Brucella suis 1330
gauacgcuucaucgca

SEQ ID NO: 2467965 - RNA, 23 nt, Brucella suis 1330
gauacgguucacgccauaagccg

SEQ ID NO: 2467966 - RNA, 13 nt, Brucella suis 1330
gauacgucacccg

SEQ ID NO: 2467967 - RNA, 16 nt, Brucella suis 1330
gauagauauuucuucc

SEQ ID NO: 2467968 - RNA, 18 nt, Brucella suis 1330
gauagauauuucuuccag

SEQ ID NO: 2467969 - RNA, 17 nt, Brucella suis 1330
gauagccauagcgcaga

SEQ ID NO: 2467970 - RNA, 18 nt, Brucella suis 1330
gauagccccagcccgccc

SEQ ID NO: 2467971 - RNA, 22 nt, Brucella suis 1330
gauagcgcccgccucgcaggca

SEQ ID NO: 2467972 - RNA, 16 nt, Brucella suis 1330
gauagcguaaaacgca

SEQ ID NO: 2467973 - RNA, 13 nt, Brucella suis 1330
gauaggcgcgccc

SEQ ID NO: 2467974 - RNA, 21 nt, Brucella suis 1330
gauaggcguugaugacgaaaa

SEQ ID NO: 2467975 - RNA, 17 nt, Brucella suis 1330
gauaggcugcuucuguu

SEQ ID NO: 2467976 - RNA, 17 nt, Brucella suis 1330
gauaguucaaggcugcu

SEQ ID NO: 2467977 - RNA, 20 nt, Brucella suis 1330
gauauagagcagcaccggcg

SEQ ID NO: 2467978 - RNA, 16 nt, Brucella suis 1330
gauaucgagaccggcu

SEQ ID NO: 2467979 - RNA, 16 nt, Brucella suis 1330
gauaucgagcgccaga

SEQ ID NO: 2467980 - RNA, 22 nt, Brucella suis 1330
gauaucgagcgccagaucgaug

SEQ ID NO: 2467981 - RNA, 15 nt, Brucella suis 1330
gauaucgccuucgcg

SEQ ID NO: 2467982 - RNA, 18 nt, Brucella suis 1330
gauaucgccuucgcgcac

SEQ ID NO: 2467983 - RNA, 22 nt, Brucella suis 1330
gauaucuuccugaauggucugc

SEQ ID NO: 2467984 - RNA, 17 nt, Brucella suis 1330
gauaugccgacgcgcuc

SEQ ID NO: 2467985 - RNA, 22 nt, Brucella suis 1330
gauauggucgugauguugcggg

SEQ ID NO: 2467986 - RNA, 13 nt, Brucella suis 1330
gauauucgccgcc

SEQ ID NO: 2467987 - RNA, 16 nt, Brucella suis 1330
gauauugaccuuggca

SEQ ID NO: 2467988 - RNA, 17 nt, Brucella suis 1330
gaucaacccgucuucau

SEQ ID NO: 2467989 - RNA, 14 nt, Brucella suis 1330
gaucaauucccugg

SEQ ID NO: 2467990 - RNA, 22 nt, Brucella suis 1330
gaucacagccgcgccaauccag

SEQ ID NO: 2467991 - RNA, 16 nt, Brucella suis 1330
gaucacaugcgcgccc

SEQ ID NO: 2467992 - RNA, 17 nt, Brucella suis 1330
gaucaccgcagucaugc

SEQ ID NO: 2467993 - RNA, 21 nt, Brucella suis 1330
gaucaccuguggcuguuucgc

SEQ ID NO: 2467994 - RNA, 14 nt, Brucella suis 1330
gaucagaagugcug

SEQ ID NO: 2467995 - RNA, 20 nt, Brucella suis 1330
gaucagauagccggugcugu

SEQ ID NO: 2467996 - RNA, 13 nt, Brucella suis 1330
gaucagcaucgcc

SEQ ID NO: 2467997 - RNA, 18 nt, Brucella suis 1330
gaucagcgcaagaaggcg

SEQ ID NO: 2467998 - RNA, 16 nt, Brucella suis 1330
gaucagcgcgccgguc

SEQ ID NO: 2467999 - RNA, 22 nt, Brucella suis 1330
gaucagcuugucgucgugcagc

SEQ ID NO: 2468000 - RNA, 14 nt, Brucella suis 1330
gaucaggaauacgc

SEQ ID NO: 2468001 - RNA, 17 nt, Brucella suis 1330
gaucaggcgaucaacgc

SEQ ID NO: 2468002 - RNA, 16 nt, Brucella suis 1330
gaucagggauaaagcc

SEQ ID NO: 2468003 - RNA, 17 nt, Brucella suis 1330
gaucauauuugcgggcg

SEQ ID NO: 2468004 - RNA, 21 nt, Brucella suis 1330
gaucaucaacgguucguccuu

SEQ ID NO: 2468005 - RNA, 21 nt, Brucella suis 1330
gaucaucagcccauagaucag

SEQ ID NO: 2468006 - RNA, 18 nt, Brucella suis 1330
gaucaucgucaugcagac

SEQ ID NO: 2468007 - RNA, 14 nt, Brucella suis 1330
gaucaugggcggcc

SEQ ID NO: 2468008 - RNA, 17 nt, Brucella suis 1330
gauccaccaucacgucg

SEQ ID NO: 2468009 - RNA, 13 nt, Brucella suis 1330
gauccagaagccg

SEQ ID NO: 2468010 - RNA, 23 nt, Brucella suis 1330
gauccagguauagauaucgagcg

SEQ ID NO: 2468011 - RNA, 19 nt, Brucella suis 1330
gauccgcuccagauugcgg

SEQ ID NO: 2468012 - RNA, 15 nt, Brucella suis 1330
gauccggcgaauggc

SEQ ID NO: 2468013 - RNA, 14 nt, Brucella suis 1330
gauccucuugcaug

SEQ ID NO: 2468014 - RNA, 19 nt, Brucella suis 1330
gauccugcugcgcggcauu

SEQ ID NO: 2468015 - RNA, 16 nt, Brucella suis 1330
gauccugucuuuuccg

SEQ ID NO: 2468016 - RNA, 14 nt, Brucella suis 1330
gaucgaggcaaaug

SEQ ID NO: 2468017 - RNA, 23 nt, Brucella suis 1330
gaucgcaccgauauagagcagca

SEQ ID NO: 2468018 - RNA, 13 nt, Brucella suis 1330
gaucgccagaagc

SEQ ID NO: 2468019 - RNA, 21 nt, Brucella suis 1330
gaucgccuuuauauggcgguc

SEQ ID NO: 2468020 - RNA, 23 nt, Brucella suis 1330
gaucggcaagcuugacgaucuuu

SEQ ID NO: 2468021 - RNA, 17 nt, Brucella suis 1330
gaucggccauuucggcu

SEQ ID NO: 2468022 - RNA, 13 nt, Brucella suis 1330
gaucggcgagcgc

SEQ ID NO: 2468023 - RNA, 22 nt, Brucella suis 1330
gaucggcgucaggccgagcgca

SEQ ID NO: 2468024 - RNA, 19 nt, Brucella suis 1330
gaucgggccaucuuccuca

SEQ ID NO: 2468025 - RNA, 16 nt, Brucella suis 1330
gaucgguacggaaagg

SEQ ID NO: 2468026 - RNA, 20 nt, Brucella suis 1330
gaucguaaagcagauggcga

SEQ ID NO: 2468027 - RNA, 15 nt, Brucella suis 1330
gaucguauccccggc

SEQ ID NO: 2468028 - RNA, 16 nt, Brucella suis 1330
gaucgucagcaccgcu

SEQ ID NO: 2468029 - RNA, 14 nt, Brucella suis 1330
gaucgucaggcgca

SEQ ID NO: 2468030 - RNA, 23 nt, Brucella suis 1330
gaucgucugaacggaucuugcgc

SEQ ID NO: 2468031 - RNA, 17 nt, Brucella suis 1330
gaucgugccgccuucgg

SEQ ID NO: 2468032 - RNA, 22 nt, Brucella suis 1330
gaucucauuucggcuggcugga

SEQ ID NO: 2468033 - RNA, 21 nt, Brucella suis 1330
gaucucggccuggucuagccg

SEQ ID NO: 2468034 - RNA, 16 nt, Brucella suis 1330
gaucugcaucccgaaa

SEQ ID NO: 2468035 - RNA, 20 nt, Brucella suis 1330
gaucugcaucccgaaaagug

SEQ ID NO: 2468036 - RNA, 13 nt, Brucella suis 1330
gaucuggaacagu

SEQ ID NO: 2468037 - RNA, 17 nt, Brucella suis 1330
gaucuggaacaguucca

SEQ ID NO: 2468038 - RNA, 17 nt, Brucella suis 1330
gaucuggggcacgagaa

SEQ ID NO: 2468039 - RNA, 20 nt, Brucella suis 1330
gaucuguaucccgaaaagug

SEQ ID NO: 2468040 - RNA, 21 nt, Brucella suis 1330
gaucuguaucccgaaaagugc

SEQ ID NO: 2468041 - RNA, 22 nt, Brucella suis 1330
gaucuuccuguccgacauccau

SEQ ID NO: 2468042 - RNA, 12 nt, Brucella suis 1330
gaucuucugcuc

SEQ ID NO: 2468043 - RNA, 12 nt, Brucella suis 1330
gaugaaauagcu

SEQ ID NO: 2468044 - RNA, 21 nt, Brucella suis 1330
gaugaagaagauaaucagcag

SEQ ID NO: 2468045 - RNA, 12 nt, Brucella suis 1330
gaugaagagcgu

SEQ ID NO: 2468046 - RNA, 22 nt, Brucella suis 1330
gaugaauggggggcaggcaaau

SEQ ID NO: 2468047 - RNA, 22 nt, Brucella suis 1330
gaugacgguaucauaaaugccg

SEQ ID NO: 2468048 - RNA, 17 nt, Brucella suis 1330
gaugagaaugccguucu

SEQ ID NO: 2468049 - RNA, 12 nt, Brucella suis 1330
gaugagccucaa

SEQ ID NO: 2468050 - RNA, 17 nt, Brucella suis 1330
gaugagccucaauggca

SEQ ID NO: 2468051 - RNA, 17 nt, Brucella suis 1330
gaugagcggcagcagcc

SEQ ID NO: 2468052 - RNA, 16 nt, Brucella suis 1330
gaugagggccgugacc

SEQ ID NO: 2468053 - RNA, 20 nt, Brucella suis 1330
gaugagggccgugaccagcg

SEQ ID NO: 2468054 - RNA, 17 nt, Brucella suis 1330
gaugauagcgcccgccu

SEQ ID NO: 2468055 - RNA, 14 nt, Brucella suis 1330
gaugauaggcugcu

SEQ ID NO: 2468056 - RNA, 15 nt, Brucella suis 1330
gaugaucgccagcac

SEQ ID NO: 2468057 - RNA, 19 nt, Brucella suis 1330
gaugaucgguacggaaagg

SEQ ID NO: 2468058 - RNA, 13 nt, Brucella suis 1330
gaugaugaagaaa

SEQ ID NO: 2468059 - RNA, 13 nt, Brucella suis 1330
gaugaugaccuga

SEQ ID NO: 2468060 - RNA, 21 nt, Brucella suis 1330
gaugauuucccgugcggccuu

SEQ ID NO: 2468061 - RNA, 15 nt, Brucella suis 1330
gaugcaccaucaucg

SEQ ID NO: 2468062 - RNA, 13 nt, Brucella suis 1330
gaugcagauaaaa

SEQ ID NO: 2468063 - RNA, 17 nt, Brucella suis 1330
gaugccgccgcagacca

SEQ ID NO: 2468064 - RNA, 23 nt, Brucella suis 1330
gaugccggaugcgcacauauuug

SEQ ID NO: 2468065 - RNA, 20 nt, Brucella suis 1330
gaugccguuuucaucaaauu

SEQ ID NO: 2468066 - RNA, 21 nt, Brucella suis 1330
gaugcgaauuucaucgcccuc

SEQ ID NO: 2468067 - RNA, 16 nt, Brucella suis 1330
gaugcgcagccgcguc

SEQ ID NO: 2468068 - RNA, 14 nt, Brucella suis 1330
gaugcgcaggcgcu

SEQ ID NO: 2468069 - RNA, 20 nt, Brucella suis 1330
gaugcgcggauaaacgcuuc

SEQ ID NO: 2468070 - RNA, 15 nt, Brucella suis 1330
gaugcgcgucaaaac

SEQ ID NO: 2468071 - RNA, 12 nt, Brucella suis 1330
gaugcggaacac

SEQ ID NO: 2468072 - RNA, 19 nt, Brucella suis 1330
gaugcggaacacgccgcca

SEQ ID NO: 2468073 - RNA, 13 nt, Brucella suis 1330
gaugcggcggcgc

SEQ ID NO: 2468074 - RNA, 14 nt, Brucella suis 1330
gaugcggcggcgcg

SEQ ID NO: 2468075 - RNA, 13 nt, Brucella suis 1330
gaugcggcgguga

SEQ ID NO: 2468076 - RNA, 13 nt, Brucella suis 1330
gaugcucuuucug

SEQ ID NO: 2468077 - RNA, 14 nt, Brucella suis 1330
gaugcugccagcag

SEQ ID NO: 2468078 - RNA, 22 nt, Brucella suis 1330
gaugcuugaggaucgucugacg

SEQ ID NO: 2468079 - RNA, 21 nt, Brucella suis 1330
gaugcuuuauucaaccguuuc

SEQ ID NO: 2468080 - RNA, 19 nt, Brucella suis 1330
gauggaaggaaagcccagu

SEQ ID NO: 2468081 - RNA, 14 nt, Brucella suis 1330
gauggaauuucacc

SEQ ID NO: 2468082 - RNA, 21 nt, Brucella suis 1330
gauggaccauauccaucugcu

SEQ ID NO: 2468083 - RNA, 19 nt, Brucella suis 1330
gauggccgaauagcgcauc

SEQ ID NO: 2468084 - RNA, 16 nt, Brucella suis 1330
gauggcgagcgcgcuu

SEQ ID NO: 2468085 - RNA, 17 nt, Brucella suis 1330
gauggcgaucacgaaaa

SEQ ID NO: 2468086 - RNA, 18 nt, Brucella suis 1330
gauggcgguaaugcuggc

SEQ ID NO: 2468087 - RNA, 21 nt, Brucella suis 1330
gauggcguucugaaaccgcag

SEQ ID NO: 2468088 - RNA, 17 nt, Brucella suis 1330
gauggucgcaagaccca

SEQ ID NO: 2468089 - RNA, 18 nt, Brucella suis 1330
gauguccgaaugcaaggg

SEQ ID NO: 2468090 - RNA, 18 nt, Brucella suis 1330
gaugucgauuucaccggg

SEQ ID NO: 2468091 - RNA, 16 nt, Brucella suis 1330
gaugugccaccagcac

SEQ ID NO: 2468092 - RNA, 22 nt, Brucella suis 1330
gauguguaggcuggcaucgcca

SEQ ID NO: 2468093 - RNA, 15 nt, Brucella suis 1330
gauguuccgguucua

SEQ ID NO: 2468094 - RNA, 20 nt, Brucella suis 1330
gauguucggcaaggccgcgc

SEQ ID NO: 2468095 - RNA, 14 nt, Brucella suis 1330
gauguugauggaag

SEQ ID NO: 2468096 - RNA, 13 nt, Brucella suis 1330
gauuagagcgccg

SEQ ID NO: 2468097 - RNA, 18 nt, Brucella suis 1330
gauuaugcuuuaaaagca

SEQ ID NO: 2468098 - RNA, 23 nt, Brucella suis 1330
gauucacccgaaaccauccaugc

SEQ ID NO: 2468099 - RNA, 21 nt, Brucella suis 1330
gauuccagaugcggcgcgcau

SEQ ID NO: 2468100 - RNA, 17 nt, Brucella suis 1330
gauuccagcguaaaugg

SEQ ID NO: 2468101 - RNA, 17 nt, Brucella suis 1330
gauuccgaauagaugau

SEQ ID NO: 2468102 - RNA, 23 nt, Brucella suis 1330
gauucgcccggcccauugacgau

SEQ ID NO: 2468103 - RNA, 15 nt, Brucella suis 1330
gauucuaucgccugg

SEQ ID NO: 2468104 - RNA, 16 nt, Brucella suis 1330
gauucuuaugccagau

SEQ ID NO: 2468105 - RNA, 15 nt, Brucella suis 1330
gauucuuucuucgcc

SEQ ID NO: 2468106 - RNA, 18 nt, Brucella suis 1330
gauugaagccgauccgca

SEQ ID NO: 2468107 - RNA, 21 nt, Brucella suis 1330
gauugaauuagaucggcgcuc

SEQ ID NO: 2468108 - RNA, 23 nt, Brucella suis 1330
gauugaggacgaaccccgcauca

SEQ ID NO: 2468109 - RNA, 18 nt, Brucella suis 1330
gauugaggccgaaaacca

SEQ ID NO: 2468110 - RNA, 16 nt, Brucella suis 1330
gauugaugaaaaaccc

SEQ ID NO: 2468111 - RNA, 14 nt, Brucella suis 1330
gauugcaaacgaau

SEQ ID NO: 2468112 - RNA, 17 nt, Brucella suis 1330
gauugcaggucuuucug

SEQ ID NO: 2468113 - RNA, 18 nt, Brucella suis 1330
gauugccauuuucauccu

SEQ ID NO: 2468114 - RNA, 22 nt, Brucella suis 1330
gauugccauuuucauccuucgg

SEQ ID NO: 2468115 - RNA, 19 nt, Brucella suis 1330
gauugccgccgcacuuaca

SEQ ID NO: 2468116 - RNA, 16 nt, Brucella suis 1330
gauugccgcgcgcggc

SEQ ID NO: 2468117 - RNA, 16 nt, Brucella suis 1330
gauugcgcaagugcug

SEQ ID NO: 2468118 - RNA, 12 nt, Brucella suis 1330
gauugcgggcau

SEQ ID NO: 2468119 - RNA, 13 nt, Brucella suis 1330
gauugggcggcgg

SEQ ID NO: 2468120 - RNA, 16 nt, Brucella suis 1330
gauuguggcaaaagcc

SEQ ID NO: 2468121 - RNA, 20 nt, Brucella suis 1330
gauuuccgcgacaucaucaa

SEQ ID NO: 2468122 - RNA, 14 nt, Brucella suis 1330
gauuucgagcugac

SEQ ID NO: 2468123 - RNA, 23 nt, Brucella suis 1330
gauuucgccaaguucuuccgcca

SEQ ID NO: 2468124 - RNA, 13 nt, Brucella suis 1330
gauuucugauccc

SEQ ID NO: 2468125 - RNA, 17 nt, Brucella suis 1330
gauuucugaucccgcuu

SEQ ID NO: 2468126 - RNA, 22 nt, Brucella suis 1330
gauuucugaucccgcuucgaug

SEQ ID NO: 2468127 - RNA, 19 nt, Brucella suis 1330
gauuuggacuauuuccauc

SEQ ID NO: 2468128 - RNA, 21 nt, Brucella suis 1330
gauuuugccuucaggcggcgc

SEQ ID NO: 2468129 - RNA, 21 nt, Brucella suis 1330
gcaaaaaacuugcauuauuua

SEQ ID NO: 2468130 - RNA, 19 nt, Brucella suis 1330
gcaaaaaauaucuuuuuuc

SEQ ID NO: 2468131 - RNA, 15 nt, Brucella suis 1330
gcaaaacggcaggca

SEQ ID NO: 2468132 - RNA, 21 nt, Brucella suis 1330
gcaaaacggcccaugagcuuc

SEQ ID NO: 2468133 - RNA, 15 nt, Brucella suis 1330
gcaaaaggcgcaaug

SEQ ID NO: 2468134 - RNA, 21 nt, Brucella suis 1330
gcaaagagaaccaccuuccug

SEQ ID NO: 2468135 - RNA, 18 nt, Brucella suis 1330
gcaaagccgaaugccagu

SEQ ID NO: 2468136 - RNA, 18 nt, Brucella suis 1330
gcaaagcguuccgcgcaa

SEQ ID NO: 2468137 - RNA, 14 nt, Brucella suis 1330
gcaaaggaggagga

SEQ ID NO: 2468138 - RNA, 18 nt, Brucella suis 1330
gcaaaggcaggcacaccc

SEQ ID NO: 2468139 - RNA, 17 nt, Brucella suis 1330
gcaaaggccgccgucgc

SEQ ID NO: 2468140 - RNA, 14 nt, Brucella suis 1330
gcaaaggccggguu

SEQ ID NO: 2468141 - RNA, 17 nt, Brucella suis 1330
gcaaaucaggcaggcga

SEQ ID NO: 2468142 - RNA, 19 nt, Brucella suis 1330
gcaaauggcaauuuaucug

SEQ ID NO: 2468143 - RNA, 20 nt, Brucella suis 1330
gcaacaaaugcaaaugccgc

SEQ ID NO: 2468144 - RNA, 14 nt, Brucella suis 1330
gcaacaccccgcgc

SEQ ID NO: 2468145 - RNA, 21 nt, Brucella suis 1330
gcaacacgccgccgcgcggca

SEQ ID NO: 2468146 - RNA, 21 nt, Brucella suis 1330
gcaacagggcgaaaagccgcc

SEQ ID NO: 2468147 - RNA, 17 nt, Brucella suis 1330
gcaacauugaguuucau

SEQ ID NO: 2468148 - RNA, 22 nt, Brucella suis 1330
gcaacauugauguguccggcgu

SEQ ID NO: 2468149 - RNA, 13 nt, Brucella suis 1330
gcaacccggcggc

SEQ ID NO: 2468150 - RNA, 19 nt, Brucella suis 1330
gcaaccgccagaucgacag

SEQ ID NO: 2468151 - RNA, 14 nt, Brucella suis 1330
gcaaccggcgggcg

SEQ ID NO: 2468152 - RNA, 17 nt, Brucella suis 1330
gcaaccuggcugcacca

SEQ ID NO: 2468153 - RNA, 21 nt, Brucella suis 1330
gcaacgaauacagugacgcgc

SEQ ID NO: 2468154 - RNA, 23 nt, Brucella suis 1330
gcaacgaauacagugacgcgcgc

SEQ ID NO: 2468155 - RNA, 14 nt, Brucella suis 1330
gcaacgacauagau

SEQ ID NO: 2468156 - RNA, 23 nt, Brucella suis 1330
gcaacgauaaucgaugagaucgu

SEQ ID NO: 2468157 - RNA, 20 nt, Brucella suis 1330
gcaacgcaauggagcaggaa

SEQ ID NO: 2468158 - RNA, 23 nt, Brucella suis 1330
gcaacuguucgggcgugaaagac

SEQ ID NO: 2468159 - RNA, 17 nt, Brucella suis 1330
gcaacuuccuugccggu

SEQ ID NO: 2468160 - RNA, 22 nt, Brucella suis 1330
gcaagaauggcuccguccggcc

SEQ ID NO: 2468161 - RNA, 12 nt, Brucella suis 1330
gcaagacagauc

SEQ ID NO: 2468162 - RNA, 23 nt, Brucella suis 1330
gcaagacccaauccgccaacgau

SEQ ID NO: 2468163 - RNA, 15 nt, Brucella suis 1330
gcaagauaagcgccg

SEQ ID NO: 2468164 - RNA, 15 nt, Brucella suis 1330
gcaagauggcugccc

SEQ ID NO: 2468165 - RNA, 13 nt, Brucella suis 1330
gcaagccaaagcc

SEQ ID NO: 2468166 - RNA, 17 nt, Brucella suis 1330
gcaagccaaagcccgug

SEQ ID NO: 2468167 - RNA, 13 nt, Brucella suis 1330
gcaagcggcuuca

SEQ ID NO: 2468168 - RNA, 18 nt, Brucella suis 1330
gcaagcgggccuuuuuca

SEQ ID NO: 2468169 - RNA, 19 nt, Brucella suis 1330
gcaagcugcucgcgguuga

SEQ ID NO: 2468170 - RNA, 18 nt, Brucella suis 1330
gcaagcuggaaccagcgu

SEQ ID NO: 2468171 - RNA, 13 nt, Brucella suis 1330
gcaagcugugugg

SEQ ID NO: 2468172 - RNA, 23 nt, Brucella suis 1330
gcaaggagcgagcuugcaaugag

SEQ ID NO: 2468173 - RNA, 15 nt, Brucella suis 1330
gcaaggcgcgcccgu

SEQ ID NO: 2468174 - RNA, 21 nt, Brucella suis 1330
gcaaggcgcgcccgucaccgc

SEQ ID NO: 2468175 - RNA, 12 nt, Brucella suis 1330
gcaagggcaagc

SEQ ID NO: 2468176 - RNA, 18 nt, Brucella suis 1330
gcaaggggcggaacaggc

SEQ ID NO: 2468177 - RNA, 22 nt, Brucella suis 1330
gcaaggucucgacaguccagcu

SEQ ID NO: 2468178 - RNA, 22 nt, Brucella suis 1330
gcaagguggaucuugcgguucg

SEQ ID NO: 2468179 - RNA, 18 nt, Brucella suis 1330
gcaagugugaaagcacaa

SEQ ID NO: 2468180 - RNA, 23 nt, Brucella suis 1330
gcaagugugaaagcacaaagaac

SEQ ID NO: 2468181 - RNA, 19 nt, Brucella suis 1330
gcaagugugcagacaggcc

SEQ ID NO: 2468182 - RNA, 23 nt, Brucella suis 1330
gcaaguuccgcauugaugaagcc

SEQ ID NO: 2468183 - RNA, 19 nt, Brucella suis 1330
gcaaguugcuccagcccuu

SEQ ID NO: 2468184 - RNA, 19 nt, Brucella suis 1330
gcaaguuuaucggccugau

SEQ ID NO: 2468185 - RNA, 19 nt, Brucella suis 1330
gcaauaaaaggcaaagccg

SEQ ID NO: 2468186 - RNA, 11 nt, Brucella suis 1330
gcaauaaugca

SEQ ID NO: 2468187 - RNA, 22 nt, Brucella suis 1330
gcaauaauuaugcaggaaagcc

SEQ ID NO: 2468188 - RNA, 22 nt, Brucella suis 1330
gcaauacgccuggccggcgccu

SEQ ID NO: 2468189 - RNA, 12 nt, Brucella suis 1330
gcaauaucgcga

SEQ ID NO: 2468190 - RNA, 22 nt, Brucella suis 1330
gcaaucacgcggcgcaaagccc

SEQ ID NO: 2468191 - RNA, 16 nt, Brucella suis 1330
gcaauccacaggagau

SEQ ID NO: 2468192 - RNA, 18 nt, Brucella suis 1330
gcaauccuggugcgcagc

SEQ ID NO: 2468193 - RNA, 23 nt, Brucella suis 1330
gcaauccuggugcgcagcucggc

SEQ ID NO: 2468194 - RNA, 18 nt, Brucella suis 1330
gcaauccuguucaagcag

SEQ ID NO: 2468195 - RNA, 21 nt, Brucella suis 1330
gcaauccuucacccucggugc

SEQ ID NO: 2468196 - RNA, 22 nt, Brucella suis 1330
gcaaucgccguaaauuaugaga

SEQ ID NO: 2468197 - RNA, 18 nt, Brucella suis 1330
gcaaucggcacucuggcc

SEQ ID NO: 2468198 - RNA, 14 nt, Brucella suis 1330
gcaaucugcgcugc

SEQ ID NO: 2468199 - RNA, 18 nt, Brucella suis 1330
gcaaugcaccgauggcca

SEQ ID NO: 2468200 - RNA, 20 nt, Brucella suis 1330
gcaaugcccucuucguccuc

SEQ ID NO: 2468201 - RNA, 14 nt, Brucella suis 1330
gcaaugccggaugc

SEQ ID NO: 2468202 - RNA, 21 nt, Brucella suis 1330
gcaaugcgcuucgcgcaggcc

SEQ ID NO: 2468203 - RNA, 17 nt, Brucella suis 1330
gcaauggaaaaggccug

SEQ ID NO: 2468204 - RNA, 14 nt, Brucella suis 1330
gcaauggagcagga

SEQ ID NO: 2468205 - RNA, 19 nt, Brucella suis 1330
gcaauggccgcaugaacau

SEQ ID NO: 2468206 - RNA, 14 nt, Brucella suis 1330
gcaauggccuugcc

SEQ ID NO: 2468207 - RNA, 17 nt, Brucella suis 1330
gcaaugugcgggcuucu

SEQ ID NO: 2468208 - RNA, 18 nt, Brucella suis 1330
gcaauuccugcgccaccu

SEQ ID NO: 2468209 - RNA, 16 nt, Brucella suis 1330
gcaauugccgcugccg

SEQ ID NO: 2468210 - RNA, 18 nt, Brucella suis 1330
gcaauugcugggcuuccu

SEQ ID NO: 2468211 - RNA, 14 nt, Brucella suis 1330
gcacaaaagaaacc

SEQ ID NO: 2468212 - RNA, 17 nt, Brucella suis 1330
gcacaagaacagccgcc

SEQ ID NO: 2468213 - RNA, 19 nt, Brucella suis 1330
gcacaagaacagccgcccc

SEQ ID NO: 2468214 - RNA, 12 nt, Brucella suis 1330
gcacaagaagca

SEQ ID NO: 2468215 - RNA, 15 nt, Brucella suis 1330
gcacaauaugguccg

SEQ ID NO: 2468216 - RNA, 14 nt, Brucella suis 1330
gcacacagccaaga

SEQ ID NO: 2468217 - RNA, 16 nt, Brucella suis 1330
gcacaccaaaagagcg

SEQ ID NO: 2468218 - RNA, 14 nt, Brucella suis 1330
gcacacggcgcagg

SEQ ID NO: 2468219 - RNA, 19 nt, Brucella suis 1330
gcacacggucaugcaggcg

SEQ ID NO: 2468220 - RNA, 14 nt, Brucella suis 1330
gcacagccagaaag

SEQ ID NO: 2468221 - RNA, 19 nt, Brucella suis 1330
gcacagcggucgaaaccuu

SEQ ID NO: 2468222 - RNA, 17 nt, Brucella suis 1330
gcacaggcucgggcagc

SEQ ID NO: 2468223 - RNA, 14 nt, Brucella suis 1330
gcacauaaaacgcg

SEQ ID NO: 2468224 - RNA, 19 nt, Brucella suis 1330
gcacauaaaacgcgccgau

SEQ ID NO: 2468225 - RNA, 18 nt, Brucella suis 1330
gcacauagaaaucaaccu

SEQ ID NO: 2468226 - RNA, 20 nt, Brucella suis 1330
gcacauccauaugcagcggc

SEQ ID NO: 2468227 - RNA, 22 nt, Brucella suis 1330
gcacauccugcaccggcuuccc

SEQ ID NO: 2468228 - RNA, 17 nt, Brucella suis 1330
gcacauggcggccuuuu

SEQ ID NO: 2468229 - RNA, 16 nt, Brucella suis 1330
gcaccaagaccgccgc

SEQ ID NO: 2468230 - RNA, 19 nt, Brucella suis 1330
gcaccagcgcgccgaucac

SEQ ID NO: 2468231 - RNA, 14 nt, Brucella suis 1330
gcaccaugagcgcc

SEQ ID NO: 2468232 - RNA, 20 nt, Brucella suis 1330
gcaccauucuugcgcccucc

SEQ ID NO: 2468233 - RNA, 22 nt, Brucella suis 1330
gcaccauucuugcgcccuccac

SEQ ID NO: 2468234 - RNA, 17 nt, Brucella suis 1330
gcaccauugggcaugga

SEQ ID NO: 2468235 - RNA, 14 nt, Brucella suis 1330
gcacccacugcccg

SEQ ID NO: 2468236 - RNA, 18 nt, Brucella suis 1330
gcacccacugcccgccuu

SEQ ID NO: 2468237 - RNA, 18 nt, Brucella suis 1330
gcacccgcaacccauuuu

SEQ ID NO: 2468238 - RNA, 21 nt, Brucella suis 1330
gcaccgaaaauuguggccgau

SEQ ID NO: 2468239 - RNA, 21 nt, Brucella suis 1330
gcaccgauauagagcagcacc

SEQ ID NO: 2468240 - RNA, 12 nt, Brucella suis 1330
gcaccgaucacg

SEQ ID NO: 2468241 - RNA, 18 nt, Brucella suis 1330
gcaccgauccgcaacuca

SEQ ID NO: 2468242 - RNA, 16 nt, Brucella suis 1330
gcaccgauggccagga

SEQ ID NO: 2468243 - RNA, 18 nt, Brucella suis 1330
gcaccgcacuggggacau

SEQ ID NO: 2468244 - RNA, 20 nt, Brucella suis 1330
gcaccgccugccagcccgcu

SEQ ID NO: 2468245 - RNA, 16 nt, Brucella suis 1330
gcaccggauuugccaa

SEQ ID NO: 2468246 - RNA, 17 nt, Brucella suis 1330
gcaccggauuugccaag

SEQ ID NO: 2468247 - RNA, 18 nt, Brucella suis 1330
gcaccgggucgagaaugg

SEQ ID NO: 2468248 - RNA, 14 nt, Brucella suis 1330
gcaccgugcuccag

SEQ ID NO: 2468249 - RNA, 17 nt, Brucella suis 1330
gcaccgugcuccagaua

SEQ ID NO: 2468250 - RNA, 20 nt, Brucella suis 1330
gcaccguuucaaaccccagu

SEQ ID NO: 2468251 - RNA, 13 nt, Brucella suis 1330
gcaccguuucucu

SEQ ID NO: 2468252 - RNA, 16 nt, Brucella suis 1330
gcaccguuucucugcu

SEQ ID NO: 2468253 - RNA, 21 nt, Brucella suis 1330
gcaccguuucucugcucgccu

SEQ ID NO: 2468254 - RNA, 17 nt, Brucella suis 1330
gcaccugggccacggcg

SEQ ID NO: 2468255 - RNA, 17 nt, Brucella suis 1330
gcaccuucgcuaucacc

SEQ ID NO: 2468256 - RNA, 20 nt, Brucella suis 1330
gcacgaaaagcaggaucagg

SEQ ID NO: 2468257 - RNA, 20 nt, Brucella suis 1330
gcacgaacagaucgccaagc

SEQ ID NO: 2468258 - RNA, 16 nt, Brucella suis 1330
gcacgaauugcacggu

SEQ ID NO: 2468259 - RNA, 20 nt, Brucella suis 1330
gcacgaccagcgcaaugccc

SEQ ID NO: 2468260 - RNA, 22 nt, Brucella suis 1330
gcacgauaugggucugcgacgg

SEQ ID NO: 2468261 - RNA, 15 nt, Brucella suis 1330
gcacgcaaggcggcu

SEQ ID NO: 2468262 - RNA, 18 nt, Brucella suis 1330
gcacgcaaggcggcugga

SEQ ID NO: 2468263 - RNA, 16 nt, Brucella suis 1330
gcacgcaggacaagcc

SEQ ID NO: 2468264 - RNA, 21 nt, Brucella suis 1330
gcacgccgcccaggaccgcgc

SEQ ID NO: 2468265 - RNA, 13 nt, Brucella suis 1330
gcacgccgugcgc

SEQ ID NO: 2468266 - RNA, 16 nt, Brucella suis 1330
gcacgccugccgcgcg

SEQ ID NO: 2468267 - RNA, 21 nt, Brucella suis 1330
gcacgcgcaccugacggcgca

SEQ ID NO: 2468268 - RNA, 15 nt, Brucella suis 1330
gcacgcgcagauaac

SEQ ID NO: 2468269 - RNA, 17 nt, Brucella suis 1330
gcacggcaaucagaucg

SEQ ID NO: 2468270 - RNA, 22 nt, Brucella suis 1330
gcacggcgaaugacuucaucgc

SEQ ID NO: 2468271 - RNA, 19 nt, Brucella suis 1330
gcacggucaugaugcgggg

SEQ ID NO: 2468272 - RNA, 21 nt, Brucella suis 1330
gcacggucuugccggccugaa

SEQ ID NO: 2468273 - RNA, 15 nt, Brucella suis 1330
gcacgucggacuucu

SEQ ID NO: 2468274 - RNA, 15 nt, Brucella suis 1330
gcacucaucaaaagc

SEQ ID NO: 2468275 - RNA, 22 nt, Brucella suis 1330
gcacugaaacgggaccaagccc

SEQ ID NO: 2468276 - RNA, 17 nt, Brucella suis 1330
gcacuucgcccagaaua

SEQ ID NO: 2468277 - RNA, 18 nt, Brucella suis 1330
gcacuuuugacuugaaau

SEQ ID NO: 2468278 - RNA, 14 nt, Brucella suis 1330
gcagaagaaagggc

SEQ ID NO: 2468279 - RNA, 14 nt, Brucella suis 1330
gcagaaggaugauc

SEQ ID NO: 2468280 - RNA, 15 nt, Brucella suis 1330
gcagaauaucugaau

SEQ ID NO: 2468281 - RNA, 17 nt, Brucella suis 1330
gcagaccacccggccgc

SEQ ID NO: 2468282 - RNA, 16 nt, Brucella suis 1330
gcagaccuuuggcguc

SEQ ID NO: 2468283 - RNA, 13 nt, Brucella suis 1330
gcagacgggaagc

SEQ ID NO: 2468284 - RNA, 13 nt, Brucella suis 1330
gcagagcgcaucc

SEQ ID NO: 2468285 - RNA, 13 nt, Brucella suis 1330
gcagauaaagggu

SEQ ID NO: 2468286 - RNA, 19 nt, Brucella suis 1330
gcagauaaagggugauggc

SEQ ID NO: 2468287 - RNA, 18 nt, Brucella suis 1330
gcagauaggcguugauga

SEQ ID NO: 2468288 - RNA, 15 nt, Brucella suis 1330
gcagauauuccuucu

SEQ ID NO: 2468289 - RNA, 21 nt, Brucella suis 1330
gcagaucaguccuugaccgcu

SEQ ID NO: 2468290 - RNA, 19 nt, Brucella suis 1330
gcagaucuguaucccgaaa

SEQ ID NO: 2468291 - RNA, 16 nt, Brucella suis 1330
gcagaugagcggcagc

SEQ ID NO: 2468292 - RNA, 18 nt, Brucella suis 1330
gcagaugcaccaucaucg

SEQ ID NO: 2468293 - RNA, 13 nt, Brucella suis 1330
gcagcaaaaccgu

SEQ ID NO: 2468294 - RNA, 15 nt, Brucella suis 1330
gcagcaaagugcaau

SEQ ID NO: 2468295 - RNA, 13 nt, Brucella suis 1330
gcagcaccggcgg

SEQ ID NO: 2468296 - RNA, 17 nt, Brucella suis 1330
gcagcaccggcggaagg

SEQ ID NO: 2468297 - RNA, 12 nt, Brucella suis 1330
gcagcagcaucg

SEQ ID NO: 2468298 - RNA, 13 nt, Brucella suis 1330
gcagcagcaucgc

SEQ ID NO: 2468299 - RNA, 21 nt, Brucella suis 1330
gcagcagcgcaaacucgucgg

SEQ ID NO: 2468300 - RNA, 21 nt, Brucella suis 1330
gcagcaggggcagcgcgcggu

SEQ ID NO: 2468301 - RNA, 16 nt, Brucella suis 1330
gcagcaucgccgccag

SEQ ID NO: 2468302 - RNA, 18 nt, Brucella suis 1330
gcagcaucugcgcgagga

SEQ ID NO: 2468303 - RNA, 17 nt, Brucella suis 1330
gcagcaucuugccaagc

SEQ ID NO: 2468304 - RNA, 20 nt, Brucella suis 1330
gcagcaugcgguucaggugg

SEQ ID NO: 2468305 - RNA, 20 nt, Brucella suis 1330
gcagccagggauugcgcaag

SEQ ID NO: 2468306 - RNA, 19 nt, Brucella suis 1330
gcagcccaaccgagcagaa

SEQ ID NO: 2468307 - RNA, 15 nt, Brucella suis 1330
gcagccgcgaacgau

SEQ ID NO: 2468308 - RNA, 21 nt, Brucella suis 1330
gcagccuuucaaugucgccgg

SEQ ID NO: 2468309 - RNA, 23 nt, Brucella suis 1330
gcagcgacagcggcgcgccuggg

SEQ ID NO: 2468310 - RNA, 15 nt, Brucella suis 1330
gcagcgacccgcgcc

SEQ ID NO: 2468311 - RNA, 16 nt, Brucella suis 1330
gcagcgcaaacucguc

SEQ ID NO: 2468312 - RNA, 13 nt, Brucella suis 1330
gcagcgccgcgcc

SEQ ID NO: 2468313 - RNA, 16 nt, Brucella suis 1330
gcagcgcgguuuuugc

SEQ ID NO: 2468314 - RNA, 18 nt, Brucella suis 1330
gcagcggaacuggaugac

SEQ ID NO: 2468315 - RNA, 21 nt, Brucella suis 1330
gcagcggaucauccuugaugc

SEQ ID NO: 2468316 - RNA, 13 nt, Brucella suis 1330
gcagcggcgacgg

SEQ ID NO: 2468317 - RNA, 21 nt, Brucella suis 1330
gcagcggucacagaagcaagc

SEQ ID NO: 2468318 - RNA, 23 nt, Brucella suis 1330
gcagcgguuccugauugaagaca

SEQ ID NO: 2468319 - RNA, 21 nt, Brucella suis 1330
gcagcgucacaaaacagacgc

SEQ ID NO: 2468320 - RNA, 22 nt, Brucella suis 1330
gcagcgucacaaaacagacgcc

SEQ ID NO: 2468321 - RNA, 21 nt, Brucella suis 1330
gcagcucggcuucaaaggccu

SEQ ID NO: 2468322 - RNA, 22 nt, Brucella suis 1330
gcagcucggcuucaaaggccug

SEQ ID NO: 2468323 - RNA, 14 nt, Brucella suis 1330
gcaggaaagcccgg

SEQ ID NO: 2468324 - RNA, 16 nt, Brucella suis 1330
gcaggaaagcccggcu

SEQ ID NO: 2468325 - RNA, 14 nt, Brucella suis 1330
gcaggaucgccaga

SEQ ID NO: 2468326 - RNA, 19 nt, Brucella suis 1330
gcaggaucuuccaucuggc

SEQ ID NO: 2468327 - RNA, 17 nt, Brucella suis 1330
gcaggauugccgccaug

SEQ ID NO: 2468328 - RNA, 12 nt, Brucella suis 1330
gcaggcacuggu

SEQ ID NO: 2468329 - RNA, 20 nt, Brucella suis 1330
gcaggcagaugcgaagcgga

SEQ ID NO: 2468330 - RNA, 15 nt, Brucella suis 1330
gcaggcaggccgccu

SEQ ID NO: 2468331 - RNA, 17 nt, Brucella suis 1330
gcaggcccugcauaucg

SEQ ID NO: 2468332 - RNA, 16 nt, Brucella suis 1330
gcaggccgcaaagcga

SEQ ID NO: 2468333 - RNA, 20 nt, Brucella suis 1330
gcaggccggcgagggcgggc

SEQ ID NO: 2468334 - RNA, 18 nt, Brucella suis 1330
gcaggcgacaucccgcau

SEQ ID NO: 2468335 - RNA, 14 nt, Brucella suis 1330
gcaggcgagaugcc

SEQ ID NO: 2468336 - RNA, 18 nt, Brucella suis 1330
gcaggcgcaacuguucgg

SEQ ID NO: 2468337 - RNA, 15 nt, Brucella suis 1330
gcaggcgcaggcccu

SEQ ID NO: 2468338 - RNA, 14 nt, Brucella suis 1330
gcaggcgccgugcc

SEQ ID NO: 2468339 - RNA, 12 nt, Brucella suis 1330
gcaggcgcggca

SEQ ID NO: 2468340 - RNA, 15 nt, Brucella suis 1330
gcaggcgcucggugc

SEQ ID NO: 2468341 - RNA, 21 nt, Brucella suis 1330
gcaggcgcucuuuccgcgcau

SEQ ID NO: 2468342 - RNA, 16 nt, Brucella suis 1330
gcaggcucccgccugc

SEQ ID NO: 2468343 - RNA, 15 nt, Brucella suis 1330
gcaggcuguccgaga

SEQ ID NO: 2468344 - RNA, 20 nt, Brucella suis 1330
gcaggcuuuauuccaucagc

SEQ ID NO: 2468345 - RNA, 17 nt, Brucella suis 1330
gcagggcaggccgggag

SEQ ID NO: 2468346 - RNA, 20 nt, Brucella suis 1330
gcagggucaaaauggccuca

SEQ ID NO: 2468347 - RNA, 22 nt, Brucella suis 1330
gcaggugauagaccgucuggcc

SEQ ID NO: 2468348 - RNA, 19 nt, Brucella suis 1330
gcagguuccaguccagcgc

SEQ ID NO: 2468349 - RNA, 11 nt, Brucella suis 1330
gcaguaccgac

SEQ ID NO: 2468350 - RNA, 19 nt, Brucella suis 1330
gcaguacgguuauggcuca

SEQ ID NO: 2468351 - RNA, 13 nt, Brucella suis 1330
gcaguagggcagu

SEQ ID NO: 2468352 - RNA, 19 nt, Brucella suis 1330
gcaguagggcaguagggca

SEQ ID NO: 2468353 - RNA, 21 nt, Brucella suis 1330
gcaguagggcaguagggcagu

SEQ ID NO: 2468354 - RNA, 21 nt, Brucella suis 1330
gcaguaugauuugucggaagc

SEQ ID NO: 2468355 - RNA, 17 nt, Brucella suis 1330
gcagugaagaauauggu

SEQ ID NO: 2468356 - RNA, 17 nt, Brucella suis 1330
gcaguucaaugggcggg

SEQ ID NO: 2468357 - RNA, 16 nt, Brucella suis 1330
gcaguuucaccauggc

SEQ ID NO: 2468358 - RNA, 19 nt, Brucella suis 1330
gcauaauauucagcgaacc

SEQ ID NO: 2468359 - RNA, 11 nt, Brucella suis 1330
gcauaaucgcg

SEQ ID NO: 2468360 - RNA, 19 nt, Brucella suis 1330
gcauaaucgcgccaugcac

SEQ ID NO: 2468361 - RNA, 14 nt, Brucella suis 1330
gcauaggagacugu

SEQ ID NO: 2468362 - RNA, 19 nt, Brucella suis 1330
gcauaggcuucggccgcuu

SEQ ID NO: 2468363 - RNA, 21 nt, Brucella suis 1330
gcauauagguguuggucaugc

SEQ ID NO: 2468364 - RNA, 23 nt, Brucella suis 1330
gcauaugaugaacgucaauagca

SEQ ID NO: 2468365 - RNA, 17 nt, Brucella suis 1330
gcauauuccacauugcc

SEQ ID NO: 2468366 - RNA, 15 nt, Brucella suis 1330
gcauauugccgagca

SEQ ID NO: 2468367 - RNA, 18 nt, Brucella suis 1330
gcauauugccgagcaugg

SEQ ID NO: 2468368 - RNA, 21 nt, Brucella suis 1330
gcaucaaacuggauccggcga

SEQ ID NO: 2468369 - RNA, 13 nt, Brucella suis 1330
gcaucaaccuuuu

SEQ ID NO: 2468370 - RNA, 17 nt, Brucella suis 1330
gcaucaaccuuuucggc

SEQ ID NO: 2468371 - RNA, 20 nt, Brucella suis 1330
gcaucaauccuucaugccgc

SEQ ID NO: 2468372 - RNA, 22 nt, Brucella suis 1330
gcaucaauccuucaugccgccg

SEQ ID NO: 2468373 - RNA, 20 nt, Brucella suis 1330
gcaucacgaagagugcggcu

SEQ ID NO: 2468374 - RNA, 23 nt, Brucella suis 1330
gcaucacgaagagugcggcuguc

SEQ ID NO: 2468375 - RNA, 18 nt, Brucella suis 1330
gcaucacuggcaacgacg

SEQ ID NO: 2468376 - RNA, 17 nt, Brucella suis 1330
gcaucagaaauuugcgg

SEQ ID NO: 2468377 - RNA, 20 nt, Brucella suis 1330
gcaucagaaauuugcgggcg

SEQ ID NO: 2468378 - RNA, 12 nt, Brucella suis 1330
gcaucagccuuc

SEQ ID NO: 2468379 - RNA, 17 nt, Brucella suis 1330
gcaucagccuucgucaa

SEQ ID NO: 2468380 - RNA, 16 nt, Brucella suis 1330
gcaucagcuugcccau

SEQ ID NO: 2468381 - RNA, 13 nt, Brucella suis 1330
gcaucagucgaau

SEQ ID NO: 2468382 - RNA, 19 nt, Brucella suis 1330
gcaucagucgaauuucagc

SEQ ID NO: 2468383 - RNA, 21 nt, Brucella suis 1330
gcaucauuggcguugagccgc

SEQ ID NO: 2468384 - RNA, 22 nt, Brucella suis 1330
gcauccagaacuucgccaagcc

SEQ ID NO: 2468385 - RNA, 17 nt, Brucella suis 1330
gcauccagcacuuccag

SEQ ID NO: 2468386 - RNA, 20 nt, Brucella suis 1330
gcauccagcacuuccagaua

SEQ ID NO: 2468387 - RNA, 13 nt, Brucella suis 1330
gcauccagccggc

SEQ ID NO: 2468388 - RNA, 21 nt, Brucella suis 1330
gcauccagcggugacggcggc

SEQ ID NO: 2468389 - RNA, 18 nt, Brucella suis 1330
gcauccaugagcagcggc

SEQ ID NO: 2468390 - RNA, 16 nt, Brucella suis 1330
gcaucccgaaaagugc

SEQ ID NO: 2468391 - RNA, 19 nt, Brucella suis 1330
gcauccgaaaugcgcggcg

SEQ ID NO: 2468392 - RNA, 15 nt, Brucella suis 1330
gcauccuugucggca

SEQ ID NO: 2468393 - RNA, 23 nt, Brucella suis 1330
gcaucgaacccuucccgaacuga

SEQ ID NO: 2468394 - RNA, 17 nt, Brucella suis 1330
gcaucgaaugccgcaug

SEQ ID NO: 2468395 - RNA, 22 nt, Brucella suis 1330
gcaucgacaaucuccccuuccu

SEQ ID NO: 2468396 - RNA, 21 nt, Brucella suis 1330
gcaucgagcggcacgaugcgc

SEQ ID NO: 2468397 - RNA, 22 nt, Brucella suis 1330
gcaucgagcggcacgaugcgca

SEQ ID NO: 2468398 - RNA, 17 nt, Brucella suis 1330
gcaucgaucacaugcgc

SEQ ID NO: 2468399 - RNA, 13 nt, Brucella suis 1330
gcaucgcccgaga

SEQ ID NO: 2468400 - RNA, 14 nt, Brucella suis 1330
gcaucgcgguucgg

SEQ ID NO: 2468401 - RNA, 17 nt, Brucella suis 1330
gcaucggaagggcaagg

SEQ ID NO: 2468402 - RNA, 22 nt, Brucella suis 1330
gcaucggaagggcaaggcgcgc

SEQ ID NO: 2468403 - RNA, 15 nt, Brucella suis 1330
gcaucguaaucgccg

SEQ ID NO: 2468404 - RNA, 19 nt, Brucella suis 1330
gcaucguaaucgccgggcc

SEQ ID NO: 2468405 - RNA, 18 nt, Brucella suis 1330
gcaucgucaaucacgcca

SEQ ID NO: 2468406 - RNA, 15 nt, Brucella suis 1330
gcaucgugucaucga

SEQ ID NO: 2468407 - RNA, 20 nt, Brucella suis 1330
gcaucugauuugaaaagccc

SEQ ID NO: 2468408 - RNA, 21 nt, Brucella suis 1330
gcaucugauuugaaaagcccc

SEQ ID NO: 2468409 - RNA, 11 nt, Brucella suis 1330
gcaucuuugcc

SEQ ID NO: 2468410 - RNA, 14 nt, Brucella suis 1330
gcaugaaaacgccg

SEQ ID NO: 2468411 - RNA, 14 nt, Brucella suis 1330
gcaugaacaugcgc

SEQ ID NO: 2468412 - RNA, 21 nt, Brucella suis 1330
gcaugaacaugcgccacuucc

SEQ ID NO: 2468413 - RNA, 20 nt, Brucella suis 1330
gcaugacaccuucggccagc

SEQ ID NO: 2468414 - RNA, 20 nt, Brucella suis 1330
gcaugaucgugagcgagcgc

SEQ ID NO: 2468415 - RNA, 21 nt, Brucella suis 1330
gcauggaucgccuuuauaugg

SEQ ID NO: 2468416 - RNA, 20 nt, Brucella suis 1330
gcauggcaagacggggcaag

SEQ ID NO: 2468417 - RNA, 13 nt, Brucella suis 1330
gcauggcucugaa

SEQ ID NO: 2468418 - RNA, 20 nt, Brucella suis 1330
gcaugggcaacccggcggcc

SEQ ID NO: 2468419 - RNA, 22 nt, Brucella suis 1330
gcaugggccgcacguuccgcau

SEQ ID NO: 2468420 - RNA, 21 nt, Brucella suis 1330
gcaugggcgcgugugcauagg

SEQ ID NO: 2468421 - RNA, 18 nt, Brucella suis 1330
gcaugggcgugaucggcc

SEQ ID NO: 2468422 - RNA, 16 nt, Brucella suis 1330
gcaugucauccgaaac

SEQ ID NO: 2468423 - RNA, 22 nt, Brucella suis 1330
gcaugucauuugcgaccauggc

SEQ ID NO: 2468424 - RNA, 16 nt, Brucella suis 1330
gcauguugcccaucgc

SEQ ID NO: 2468425 - RNA, 18 nt, Brucella suis 1330
gcauuacggccagccggu

SEQ ID NO: 2468426 - RNA, 12 nt, Brucella suis 1330
gcauuauuccgc

SEQ ID NO: 2468427 - RNA, 16 nt, Brucella suis 1330
gcauuauuccgccugc

SEQ ID NO: 2468428 - RNA, 19 nt, Brucella suis 1330
gcauuccccgcccgcggcc

SEQ ID NO: 2468429 - RNA, 20 nt, Brucella suis 1330
gcauuccccgcccgcggcca

SEQ ID NO: 2468430 - RNA, 21 nt, Brucella suis 1330
gcauucccuucgcgccgccuu

SEQ ID NO: 2468431 - RNA, 15 nt, Brucella suis 1330
gcauuccgggccgca

SEQ ID NO: 2468432 - RNA, 16 nt, Brucella suis 1330
gcauuccgggccgcac

SEQ ID NO: 2468433 - RNA, 15 nt, Brucella suis 1330
gcauucgaugaacag

SEQ ID NO: 2468434 - RNA, 23 nt, Brucella suis 1330
gcauucgggucacccggcgcagu

SEQ ID NO: 2468435 - RNA, 14 nt, Brucella suis 1330
gcauugcccaugga

SEQ ID NO: 2468436 - RNA, 20 nt, Brucella suis 1330
gcauugccgagcuugcggcg

SEQ ID NO: 2468437 - RNA, 21 nt, Brucella suis 1330
gcauugccugugccaaugaca

SEQ ID NO: 2468438 - RNA, 14 nt, Brucella suis 1330
gcauuggaaacgcc

SEQ ID NO: 2468439 - RNA, 15 nt, Brucella suis 1330
gcauuuccagcaaaa

SEQ ID NO: 2468440 - RNA, 19 nt, Brucella suis 1330
gcauuuccagcaaaagugc

SEQ ID NO: 2468441 - RNA, 23 nt, Brucella suis 1330
gcauuugacguccggcuucgugc

SEQ ID NO: 2468442 - RNA, 17 nt, Brucella suis 1330
gcauuuucgagccaaaa

SEQ ID NO: 2468443 - RNA, 15 nt, Brucella suis 1330
gccaaaacgcagccg

SEQ ID NO: 2468444 - RNA, 14 nt, Brucella suis 1330
gccaaaaggccuuc

SEQ ID NO: 2468445 - RNA, 13 nt, Brucella suis 1330
gccaaaagugcgc

SEQ ID NO: 2468446 - RNA, 17 nt, Brucella suis 1330
gccaaagaccagcagga

SEQ ID NO: 2468447 - RNA, 12 nt, Brucella suis 1330
gccaaagcccgu

SEQ ID NO: 2468448 - RNA, 23 nt, Brucella suis 1330
gccaaccauauuggcggcaagcu

SEQ ID NO: 2468449 - RNA, 16 nt, Brucella suis 1330
gccaacucuuuccugu

SEQ ID NO: 2468450 - RNA, 18 nt, Brucella suis 1330
gccaagaagaacacagcc

SEQ ID NO: 2468451 - RNA, 22 nt, Brucella suis 1330
gccaagaagaacacagccccuu

SEQ ID NO: 2468452 - RNA, 17 nt, Brucella suis 1330
gccaagacuuuccaucc

SEQ ID NO: 2468453 - RNA, 21 nt, Brucella suis 1330
gccaagaucgacaaagccuga

SEQ ID NO: 2468454 - RNA, 18 nt, Brucella suis 1330
gccaagcccuuccacugc

SEQ ID NO: 2468455 - RNA, 19 nt, Brucella suis 1330
gccaagcccuuccacugca

SEQ ID NO: 2468456 - RNA, 14 nt, Brucella suis 1330
gccaagcgcaucga

SEQ ID NO: 2468457 - RNA, 20 nt, Brucella suis 1330
gccaagcguugcaagauccu

SEQ ID NO: 2468458 - RNA, 18 nt, Brucella suis 1330
gccaagcuugaucgccgc

SEQ ID NO: 2468459 - RNA, 18 nt, Brucella suis 1330
gccaaggaacgcggccuu

SEQ ID NO: 2468460 - RNA, 13 nt, Brucella suis 1330
gccaaggagcgcg

SEQ ID NO: 2468461 - RNA, 18 nt, Brucella suis 1330
gccaaggccggaagcgcg

SEQ ID NO: 2468462 - RNA, 15 nt, Brucella suis 1330
gccaaggcugcgcgc

SEQ ID NO: 2468463 - RNA, 16 nt, Brucella suis 1330
gccaagugaagcgaag

SEQ ID NO: 2468464 - RNA, 23 nt, Brucella suis 1330
gccaagugcggucugcuugccgc

SEQ ID NO: 2468465 - RNA, 12 nt, Brucella suis 1330
gccaauccccuc

SEQ ID NO: 2468466 - RNA, 15 nt, Brucella suis 1330
gccaauccccucacc

SEQ ID NO: 2468467 - RNA, 16 nt, Brucella suis 1330
gccaauccccucaccu

SEQ ID NO: 2468468 - RNA, 13 nt, Brucella suis 1330
gccaaucgccgcg

SEQ ID NO: 2468469 - RNA, 13 nt, Brucella suis 1330
gccaccauggccg

SEQ ID NO: 2468470 - RNA, 16 nt, Brucella suis 1330
gccaccauggccgccc

SEQ ID NO: 2468471 - RNA, 18 nt, Brucella suis 1330
gccaccauggccgccccg

SEQ ID NO: 2468472 - RNA, 22 nt, Brucella suis 1330
gccaccauggccgccccgacga

SEQ ID NO: 2468473 - RNA, 14 nt, Brucella suis 1330
gccacccugaugcc

SEQ ID NO: 2468474 - RNA, 19 nt, Brucella suis 1330
gccaccgccggcgccgcca

SEQ ID NO: 2468475 - RNA, 23 nt, Brucella suis 1330
gccaccgcgaaagccagaaccac

SEQ ID NO: 2468476 - RNA, 22 nt, Brucella suis 1330
gccaccgguuuucaucgcguca

SEQ ID NO: 2468477 - RNA, 13 nt, Brucella suis 1330
gccacgaaacgcc

SEQ ID NO: 2468478 - RNA, 18 nt, Brucella suis 1330
gccacgacagggcgcugc

SEQ ID NO: 2468479 - RNA, 22 nt, Brucella suis 1330
gccacgcacggucuugccggcc

SEQ ID NO: 2468480 - RNA, 16 nt, Brucella suis 1330
gccacgccagccgcga

SEQ ID NO: 2468481 - RNA, 14 nt, Brucella suis 1330
gccacgcgccgcca

SEQ ID NO: 2468482 - RNA, 21 nt, Brucella suis 1330
gccacgcgccgccaucugugc

SEQ ID NO: 2468483 - RNA, 13 nt, Brucella suis 1330
gccacgcuccaca

SEQ ID NO: 2468484 - RNA, 16 nt, Brucella suis 1330
gccacggcgaaagcug

SEQ ID NO: 2468485 - RNA, 17 nt, Brucella suis 1330
gccacggcgaaagcugc

SEQ ID NO: 2468486 - RNA, 16 nt, Brucella suis 1330
gccacgggccagaaug

SEQ ID NO: 2468487 - RNA, 21 nt, Brucella suis 1330
gccacugaccuuuugacggcc

SEQ ID NO: 2468488 - RNA, 20 nt, Brucella suis 1330
gccacugcgaaagcgccaga

SEQ ID NO: 2468489 - RNA, 13 nt, Brucella suis 1330
gccagaaaaaccg

SEQ ID NO: 2468490 - RNA, 22 nt, Brucella suis 1330
gccagaaagacauuuucgccgg

SEQ ID NO: 2468491 - RNA, 21 nt, Brucella suis 1330
gccagaaccaccagagcaaaa

SEQ ID NO: 2468492 - RNA, 23 nt, Brucella suis 1330
gccagagcggcauauugcggcgg

SEQ ID NO: 2468493 - RNA, 14 nt, Brucella suis 1330
gccagauaaagcag

SEQ ID NO: 2468494 - RNA, 18 nt, Brucella suis 1330
gccagauaaccugcgcga

SEQ ID NO: 2468495 - RNA, 19 nt, Brucella suis 1330
gccagauaagacauggcuu

SEQ ID NO: 2468496 - RNA, 19 nt, Brucella suis 1330
gccagauaagguucgaugg

SEQ ID NO: 2468497 - RNA, 18 nt, Brucella suis 1330
gccagaucaugggcggcc

SEQ ID NO: 2468498 - RNA, 13 nt, Brucella suis 1330
gccagaucauuga

SEQ ID NO: 2468499 - RNA, 18 nt, Brucella suis 1330
gccagauccgcugacugc

SEQ ID NO: 2468500 - RNA, 14 nt, Brucella suis 1330
gccagaugcgcaaa

SEQ ID NO: 2468501 - RNA, 15 nt, Brucella suis 1330
gccagaugugccacc

SEQ ID NO: 2468502 - RNA, 16 nt, Brucella suis 1330
gccagaugugccacca

SEQ ID NO: 2468503 - RNA, 21 nt, Brucella suis 1330
gccagauugcgaauggaaaga

SEQ ID NO: 2468504 - RNA, 19 nt, Brucella suis 1330
gccagccgaaaugagauca

SEQ ID NO: 2468505 - RNA, 15 nt, Brucella suis 1330
gccagccgcaaucag

SEQ ID NO: 2468506 - RNA, 16 nt, Brucella suis 1330
gccagccgcaaugagc

SEQ ID NO: 2468507 - RNA, 16 nt, Brucella suis 1330
gccagccgccagcagg

SEQ ID NO: 2468508 - RNA, 16 nt, Brucella suis 1330
gccagccgcgggggcc

SEQ ID NO: 2468509 - RNA, 18 nt, Brucella suis 1330
gccagcgcauaaaggccg

SEQ ID NO: 2468510 - RNA, 14 nt, Brucella suis 1330
gccagcggcagacc

SEQ ID NO: 2468511 - RNA, 21 nt, Brucella suis 1330
gccagcggugacgaucuggaa

SEQ ID NO: 2468512 - RNA, 14 nt, Brucella suis 1330
gccagcuccggguu

SEQ ID NO: 2468513 - RNA, 21 nt, Brucella suis 1330
gccagcugauauugugucagc

SEQ ID NO: 2468514 - RNA, 16 nt, Brucella suis 1330
gccagcuugaaaagcc

SEQ ID NO: 2468515 - RNA, 21 nt, Brucella suis 1330
gccaggcaaaugcuccuuccu

SEQ ID NO: 2468516 - RNA, 14 nt, Brucella suis 1330
gccagggauugcgc

SEQ ID NO: 2468517 - RNA, 20 nt, Brucella suis 1330
gccagguggcugcccgccgc

SEQ ID NO: 2468518 - RNA, 22 nt, Brucella suis 1330
gccagguggcugcccgccgcaa

SEQ ID NO: 2468519 - RNA, 19 nt, Brucella suis 1330
gccaguaggccccgucauu

SEQ ID NO: 2468520 - RNA, 20 nt, Brucella suis 1330
gccagucauugacggcagcc

SEQ ID NO: 2468521 - RNA, 15 nt, Brucella suis 1330
gccaguccuugcccu

SEQ ID NO: 2468522 - RNA, 18 nt, Brucella suis 1330
gccaguggccgaagccgc

SEQ ID NO: 2468523 - RNA, 22 nt, Brucella suis 1330
gccagugucgaccggcggcagg

SEQ ID NO: 2468524 - RNA, 18 nt, Brucella suis 1330
gccaguuuggcugugcug

SEQ ID NO: 2468525 - RNA, 23 nt, Brucella suis 1330
gccauaccgucgaggaaaaagcc

SEQ ID NO: 2468526 - RNA, 19 nt, Brucella suis 1330
gccauagaacagcaagccc

SEQ ID NO: 2468527 - RNA, 19 nt, Brucella suis 1330
gccauagcgcagaaugagc

SEQ ID NO: 2468528 - RNA, 14 nt, Brucella suis 1330
gccauaggucacgc

SEQ ID NO: 2468529 - RNA, 16 nt, Brucella suis 1330
gccauauccgccaccg

SEQ ID NO: 2468530 - RNA, 23 nt, Brucella suis 1330
gccaucaagcgucaugccaaccg

SEQ ID NO: 2468531 - RNA, 24 nt, Brucella suis 1330
gccaucaccagcccccagaugaag

SEQ ID NO: 2468532 - RNA, 19 nt, Brucella suis 1330
gccaucagcauugaacgcc

SEQ ID NO: 2468533 - RNA, 23 nt, Brucella suis 1330
gccauccucgccaagcuuuugca

SEQ ID NO: 2468534 - RNA, 14 nt, Brucella suis 1330
gccaucgccgacgc

SEQ ID NO: 2468535 - RNA, 20 nt, Brucella suis 1330
gccaucgccgacgcgcguga

SEQ ID NO: 2468536 - RNA, 13 nt, Brucella suis 1330
gccaucuuccagu

SEQ ID NO: 2468537 - RNA, 21 nt, Brucella suis 1330
gccaucuuccucacccuucaa

SEQ ID NO: 2468538 - RNA, 16 nt, Brucella suis 1330
gccaucuucuuccagu

SEQ ID NO: 2468539 - RNA, 23 nt, Brucella suis 1330
gccaucuuucuugaagucaucac

SEQ ID NO: 2468540 - RNA, 19 nt, Brucella suis 1330
gccaugaagaucaauuccc

SEQ ID NO: 2468541 - RNA, 14 nt, Brucella suis 1330
gccaugacggcccg

SEQ ID NO: 2468542 - RNA, 23 nt, Brucella suis 1330
gccaugaguugucaauacaccug

SEQ ID NO: 2468543 - RNA, 19 nt, Brucella suis 1330
gccaugaugccgacaagca

SEQ ID NO: 2468544 - RNA, 19 nt, Brucella suis 1330
gccaugcccgucagcgcgc

SEQ ID NO: 2468545 - RNA, 20 nt, Brucella suis 1330
gccaugcccgucagcgcgcc

SEQ ID NO: 2468546 - RNA, 15 nt, Brucella suis 1330
gccaugccgccaagg

SEQ ID NO: 2468547 - RNA, 14 nt, Brucella suis 1330
gccaugccuucccg

SEQ ID NO: 2468548 - RNA, 22 nt, Brucella suis 1330
gccaugcgcaaccaaaacauac

SEQ ID NO: 2468549 - RNA, 13 nt, Brucella suis 1330
gccaugcgcauga

SEQ ID NO: 2468550 - RNA, 14 nt, Brucella suis 1330
gccaugcgcaugaa

SEQ ID NO: 2468551 - RNA, 15 nt, Brucella suis 1330
gccaugcggccagcc

SEQ ID NO: 2468552 - RNA, 12 nt, Brucella suis 1330
gccauggccgaa

SEQ ID NO: 2468553 - RNA, 19 nt, Brucella suis 1330
gccauggcuucaagcggcg

SEQ ID NO: 2468554 - RNA, 19 nt, Brucella suis 1330
gccauggucgcgcaccagc

SEQ ID NO: 2468555 - RNA, 20 nt, Brucella suis 1330
gccauguugggguuggccug

SEQ ID NO: 2468556 - RNA, 12 nt, Brucella suis 1330
gccauugaccgc

SEQ ID NO: 2468557 - RNA, 14 nt, Brucella suis 1330
gccauugaccgccu

SEQ ID NO: 2468558 - RNA, 16 nt, Brucella suis 1330
gcccaaaagcgcgccg

SEQ ID NO: 2468559 - RNA, 14 nt, Brucella suis 1330
gcccaaucucgaua

SEQ ID NO: 2468560 - RNA, 13 nt, Brucella suis 1330
gcccacauagaca

SEQ ID NO: 2468561 - RNA, 21 nt, Brucella suis 1330
gcccacccaccgccugcagcc

SEQ ID NO: 2468562 - RNA, 22 nt, Brucella suis 1330
gcccacccaccgccugcagccg

SEQ ID NO: 2468563 - RNA, 15 nt, Brucella suis 1330
gcccacgguuuuugu

SEQ ID NO: 2468564 - RNA, 14 nt, Brucella suis 1330
gcccagaaccugcc

SEQ ID NO: 2468565 - RNA, 20 nt, Brucella suis 1330
gcccagaaccugcccgucuu

SEQ ID NO: 2468566 - RNA, 14 nt, Brucella suis 1330
gcccagagcgguuu

SEQ ID NO: 2468567 - RNA, 17 nt, Brucella suis 1330
gcccagagcgguuucaa

SEQ ID NO: 2468568 - RNA, 22 nt, Brucella suis 1330
gcccagcccuuuucagcggaga

SEQ ID NO: 2468569 - RNA, 13 nt, Brucella suis 1330
gcccagcucgccg

SEQ ID NO: 2468570 - RNA, 19 nt, Brucella suis 1330
gcccaguucguggcggggc

SEQ ID NO: 2468571 - RNA, 13 nt, Brucella suis 1330
gcccauaccgcgc

SEQ ID NO: 2468572 - RNA, 19 nt, Brucella suis 1330
gcccauacgcgcggcaacu

SEQ ID NO: 2468573 - RNA, 17 nt, Brucella suis 1330
gcccaucgcauugcuga

SEQ ID NO: 2468574 - RNA, 18 nt, Brucella suis 1330
gcccaugaucgcgccauc

SEQ ID NO: 2468575 - RNA, 21 nt, Brucella suis 1330
gcccauggacuuuucagccuc

SEQ ID NO: 2468576 - RNA, 16 nt, Brucella suis 1330
gcccauggugccagcg

SEQ ID NO: 2468577 - RNA, 23 nt, Brucella suis 1330
gcccauguccgccugaucgucag

SEQ ID NO: 2468578 - RNA, 20 nt, Brucella suis 1330
gcccauucaaccgugcggca

SEQ ID NO: 2468579 - RNA, 22 nt, Brucella suis 1330
gcccauugaacugcccccgaaa

SEQ ID NO: 2468580 - RNA, 15 nt, Brucella suis 1330
gccccacggaucgac

SEQ ID NO: 2468581 - RNA, 22 nt, Brucella suis 1330
gccccacggaucgacaaaggug

SEQ ID NO: 2468582 - RNA, 19 nt, Brucella suis 1330
gcccccagaaggcgcggca

SEQ ID NO: 2468583 - RNA, 14 nt, Brucella suis 1330
gccccgacgaaacc

SEQ ID NO: 2468584 - RNA, 15 nt, Brucella suis 1330
gccccgaucgggcca

SEQ ID NO: 2468585 - RNA, 16 nt, Brucella suis 1330
gccccgcugaggcggc

SEQ ID NO: 2468586 - RNA, 16 nt, Brucella suis 1330
gccccggagcggggcc

SEQ ID NO: 2468587 - RNA, 23 nt, Brucella suis 1330
gccccguugcaccguuucucugc

SEQ ID NO: 2468588 - RNA, 19 nt, Brucella suis 1330
gccccuaaagccgcuccau

SEQ ID NO: 2468589 - RNA, 14 nt, Brucella suis 1330
gccccuaaaggcuc

SEQ ID NO: 2468590 - RNA, 22 nt, Brucella suis 1330
gccccuaaaggcucugcgccag

SEQ ID NO: 2468591 - RNA, 23 nt, Brucella suis 1330
gccccuaaaggcucugcgccagc

SEQ ID NO: 2468592 - RNA, 14 nt, Brucella suis 1330
gccccuugccccgg

SEQ ID NO: 2468593 - RNA, 15 nt, Brucella suis 1330
gccccuugccccggc

SEQ ID NO: 2468594 - RNA, 19 nt, Brucella suis 1330
gccccuuugcuucggccga

SEQ ID NO: 2468595 - RNA, 21 nt, Brucella suis 1330
gcccgaacaauuugcgggccg

SEQ ID NO: 2468596 - RNA, 16 nt, Brucella suis 1330
gcccgaagcgcaaagc

SEQ ID NO: 2468597 - RNA, 19 nt, Brucella suis 1330
gcccgacaaagaucaucgc

SEQ ID NO: 2468598 - RNA, 20 nt, Brucella suis 1330
gcccgacaaagaucaucgcc

SEQ ID NO: 2468599 - RNA, 22 nt, Brucella suis 1330
gcccgacaaagaucaucgccgu

SEQ ID NO: 2468600 - RNA, 17 nt, Brucella suis 1330
gcccgacugcacgucuu

SEQ ID NO: 2468601 - RNA, 21 nt, Brucella suis 1330
gcccgagaagcucaacgccgu

SEQ ID NO: 2468602 - RNA, 17 nt, Brucella suis 1330
gcccgcauagccaucgc

SEQ ID NO: 2468603 - RNA, 18 nt, Brucella suis 1330
gcccgcauagccaucgcc

SEQ ID NO: 2468604 - RNA, 23 nt, Brucella suis 1330
gcccgccacaugggcggcggccg

SEQ ID NO: 2468605 - RNA, 17 nt, Brucella suis 1330
gcccgccacgaggaaga

SEQ ID NO: 2468606 - RNA, 19 nt, Brucella suis 1330
gcccgccagauugcaaacg

SEQ ID NO: 2468607 - RNA, 15 nt, Brucella suis 1330
gcccgcccgccgcaa

SEQ ID NO: 2468608 - RNA, 19 nt, Brucella suis 1330
gcccgcccgucuucggcgc

SEQ ID NO: 2468609 - RNA, 22 nt, Brucella suis 1330
gcccgccgaagagacuguucuu

SEQ ID NO: 2468610 - RNA, 16 nt, Brucella suis 1330
gcccgccgauccggcg

SEQ ID NO: 2468611 - RNA, 13 nt, Brucella suis 1330
gcccgcgccgcuu

SEQ ID NO: 2468612 - RNA, 15 nt, Brucella suis 1330
gcccgcgcuccucga

SEQ ID NO: 2468613 - RNA, 11 nt, Brucella suis 1330
gcccgcgugca

SEQ ID NO: 2468614 - RNA, 20 nt, Brucella suis 1330
gcccgcgugugacggaugag

SEQ ID NO: 2468615 - RNA, 14 nt, Brucella suis 1330
gcccgcugcgccgc

SEQ ID NO: 2468616 - RNA, 17 nt, Brucella suis 1330
gcccgcuuuuacgcgcc

SEQ ID NO: 2468617 - RNA, 14 nt, Brucella suis 1330
gcccggaagcgaaa

SEQ ID NO: 2468618 - RNA, 20 nt, Brucella suis 1330
gcccggcauccgaggcgcgc

SEQ ID NO: 2468619 - RNA, 16 nt, Brucella suis 1330
gcccggcauggccugc

SEQ ID NO: 2468620 - RNA, 17 nt, Brucella suis 1330
gcccggccuuuucggcu

SEQ ID NO: 2468621 - RNA, 20 nt, Brucella suis 1330
gcccggcgauuucgccgggc

SEQ ID NO: 2468622 - RNA, 20 nt, Brucella suis 1330
gcccggucgaccaugaggug

SEQ ID NO: 2468623 - RNA, 19 nt, Brucella suis 1330
gcccggucucgcgaccggg

SEQ ID NO: 2468624 - RNA, 12 nt, Brucella suis 1330
gcccggugcagc

SEQ ID NO: 2468625 - RNA, 14 nt, Brucella suis 1330
gcccgguuccggcg

SEQ ID NO: 2468626 - RNA, 21 nt, Brucella suis 1330
gcccgguugcgccaaaacgca

SEQ ID NO: 2468627 - RNA, 14 nt, Brucella suis 1330
gcccguccucaucg

SEQ ID NO: 2468628 - RNA, 21 nt, Brucella suis 1330
gcccgucgaccagcgcauggc

SEQ ID NO: 2468629 - RNA, 14 nt, Brucella suis 1330
gcccgugccgcguu

SEQ ID NO: 2468630 - RNA, 13 nt, Brucella suis 1330
gcccucaaccgag

SEQ ID NO: 2468631 - RNA, 13 nt, Brucella suis 1330
gcccucgccgccg

SEQ ID NO: 2468632 - RNA, 16 nt, Brucella suis 1330
gcccucgccgccggug

SEQ ID NO: 2468633 - RNA, 15 nt, Brucella suis 1330
gcccucgcgcucggc

SEQ ID NO: 2468634 - RNA, 23 nt, Brucella suis 1330
gcccucgcggaucagcuugccgc

SEQ ID NO: 2468635 - RNA, 23 nt, Brucella suis 1330
gcccucugaaccggcgggcuuga

SEQ ID NO: 2468636 - RNA, 16 nt, Brucella suis 1330
gcccugaaaaggcuca

SEQ ID NO: 2468637 - RNA, 15 nt, Brucella suis 1330
gcccugcgucgggug

SEQ ID NO: 2468638 - RNA, 15 nt, Brucella suis 1330
gcccuggaaagaagc

SEQ ID NO: 2468639 - RNA, 19 nt, Brucella suis 1330
gcccuggaaagaagcgaaa

SEQ ID NO: 2468640 - RNA, 20 nt, Brucella suis 1330
gcccugucagaaagucugcu

SEQ ID NO: 2468641 - RNA, 11 nt, Brucella suis 1330
gcccugucagc

SEQ ID NO: 2468642 - RNA, 16 nt, Brucella suis 1330
gcccuucaucaagcug

SEQ ID NO: 2468643 - RNA, 22 nt, Brucella suis 1330
gcccuucgcuuucaauggccgc

SEQ ID NO: 2468644 - RNA, 15 nt, Brucella suis 1330
gcccuugucgcgcaa

SEQ ID NO: 2468645 - RNA, 15 nt, Brucella suis 1330
gccgaaaaccaccuu

SEQ ID NO: 2468646 - RNA, 12 nt, Brucella suis 1330
gccgaaaagccg

SEQ ID NO: 2468647 - RNA, 12 nt, Brucella suis 1330
gccgaaacgccc

SEQ ID NO: 2468648 - RNA, 23 nt, Brucella suis 1330
gccgaaaugagaucaaccccgca

SEQ ID NO: 2468649 - RNA, 15 nt, Brucella suis 1330
gccgaaauuggccgc

SEQ ID NO: 2468650 - RNA, 21 nt, Brucella suis 1330
gccgaaauuggccgcugccug

SEQ ID NO: 2468651 - RNA, 20 nt, Brucella suis 1330
gccgaaccggggcagggcag

SEQ ID NO: 2468652 - RNA, 13 nt, Brucella suis 1330
gccgaaccguccg

SEQ ID NO: 2468653 - RNA, 22 nt, Brucella suis 1330
gccgaagccagguggcugcccg

SEQ ID NO: 2468654 - RNA, 16 nt, Brucella suis 1330
gccgaagccgaugcgc

SEQ ID NO: 2468655 - RNA, 17 nt, Brucella suis 1330
gccgaaggaugcaagcc

SEQ ID NO: 2468656 - RNA, 12 nt, Brucella suis 1330
gccgaauagcgc

SEQ ID NO: 2468657 - RNA, 17 nt, Brucella suis 1330
gccgaauagcgcaucgc

SEQ ID NO: 2468658 - RNA, 14 nt, Brucella suis 1330
gccgaauuccgcca

SEQ ID NO: 2468659 - RNA, 16 nt, Brucella suis 1330
gccgaauuccgccaug

SEQ ID NO: 2468660 - RNA, 17 nt, Brucella suis 1330
gccgaauuccgccaugc

SEQ ID NO: 2468661 - RNA, 18 nt, Brucella suis 1330
gccgacaaaaaacaccgc

SEQ ID NO: 2468662 - RNA, 19 nt, Brucella suis 1330
gccgacaaaaaacaccgcg

SEQ ID NO: 2468663 - RNA, 20 nt, Brucella suis 1330
gccgacaaaaaacaccgcgc

SEQ ID NO: 2468664 - RNA, 13 nt, Brucella suis 1330
gccgaccagaacg

SEQ ID NO: 2468665 - RNA, 19 nt, Brucella suis 1330
gccgaccuccccccgcguc

SEQ ID NO: 2468666 - RNA, 12 nt, Brucella suis 1330
gccgacgcgcgu

SEQ ID NO: 2468667 - RNA, 20 nt, Brucella suis 1330
gccgacgcggcaggugccau

SEQ ID NO: 2468668 - RNA, 18 nt, Brucella suis 1330
gccgagaaugaccacgcc

SEQ ID NO: 2468669 - RNA, 22 nt, Brucella suis 1330
gccgagaaugcgaauaucgucg

SEQ ID NO: 2468670 - RNA, 14 nt, Brucella suis 1330
gccgagaugggcaa

SEQ ID NO: 2468671 - RNA, 17 nt, Brucella suis 1330
gccgagauugggcagca

SEQ ID NO: 2468672 - RNA, 15 nt, Brucella suis 1330
gccgagcauggccug

SEQ ID NO: 2468673 - RNA, 20 nt, Brucella suis 1330
gccgagcauggccugcgcac

SEQ ID NO: 2468674 - RNA, 13 nt, Brucella suis 1330
gccgagcgccgcc

SEQ ID NO: 2468675 - RNA, 14 nt, Brucella suis 1330
gccgagcgccgccg

SEQ ID NO: 2468676 - RNA, 15 nt, Brucella suis 1330
gccgagcgccgccgc

SEQ ID NO: 2468677 - RNA, 16 nt, Brucella suis 1330
gccgagcgccgccgcg

SEQ ID NO: 2468678 - RNA, 14 nt, Brucella suis 1330
gccgagcggcgcau

SEQ ID NO: 2468679 - RNA, 13 nt, Brucella suis 1330
gccgagcugcaag

SEQ ID NO: 2468680 - RNA, 21 nt, Brucella suis 1330
gccgagcugcaagggaaugcg

SEQ ID NO: 2468681 - RNA, 19 nt, Brucella suis 1330
gccgaggaaauugacgcca

SEQ ID NO: 2468682 - RNA, 17 nt, Brucella suis 1330
gccgauaagugccgcgc

SEQ ID NO: 2468683 - RNA, 19 nt, Brucella suis 1330
gccgauaagugccgcgccg

SEQ ID NO: 2468684 - RNA, 21 nt, Brucella suis 1330
gccgauaagugccgcgccgau

SEQ ID NO: 2468685 - RNA, 18 nt, Brucella suis 1330
gccgauaauggcauagga

SEQ ID NO: 2468686 - RNA, 15 nt, Brucella suis 1330
gccgaucagcaucgc

SEQ ID NO: 2468687 - RNA, 21 nt, Brucella suis 1330
gccgaucaucagcccauagau

SEQ ID NO: 2468688 - RNA, 15 nt, Brucella suis 1330
gccgaucugauucaa

SEQ ID NO: 2468689 - RNA, 20 nt, Brucella suis 1330
gccgaucugauucaaucaga

SEQ ID NO: 2468690 - RNA, 13 nt, Brucella suis 1330
gccgaugacggcg

SEQ ID NO: 2468691 - RNA, 16 nt, Brucella suis 1330
gccgaugcagaugcca

SEQ ID NO: 2468692 - RNA, 13 nt, Brucella suis 1330
gccgauugccccg

SEQ ID NO: 2468693 - RNA, 13 nt, Brucella suis 1330
gccgauuucggcg

SEQ ID NO: 2468694 - RNA, 17 nt, Brucella suis 1330
gccgcaaaggcaggcac

SEQ ID NO: 2468695 - RNA, 17 nt, Brucella suis 1330
gccgcaaccggcgggcg

SEQ ID NO: 2468696 - RNA, 18 nt, Brucella suis 1330
gccgcaagcgugagacca

SEQ ID NO: 2468697 - RNA, 14 nt, Brucella suis 1330
gccgcaauccuggu

SEQ ID NO: 2468698 - RNA, 20 nt, Brucella suis 1330
gccgcaauccuggugcgcag

SEQ ID NO: 2468699 - RNA, 21 nt, Brucella suis 1330
gccgcaauccuggugcgcagc

SEQ ID NO: 2468700 - RNA, 16 nt, Brucella suis 1330
gccgcaaugagcccgc

SEQ ID NO: 2468701 - RNA, 19 nt, Brucella suis 1330
gccgcaauugccgcugccg

SEQ ID NO: 2468702 - RNA, 15 nt, Brucella suis 1330
gccgcacguuccgca

SEQ ID NO: 2468703 - RNA, 21 nt, Brucella suis 1330
gccgcagaccacccggccgcc

SEQ ID NO: 2468704 - RNA, 23 nt, Brucella suis 1330
gccgcagaccacccggccgcccu

SEQ ID NO: 2468705 - RNA, 13 nt, Brucella suis 1330
gccgcagccgcca

SEQ ID NO: 2468706 - RNA, 22 nt, Brucella suis 1330
gccgcagcguuuugucauggcc

SEQ ID NO: 2468707 - RNA, 20 nt, Brucella suis 1330
gccgcaggaacgcaucgagc

SEQ ID NO: 2468708 - RNA, 20 nt, Brucella suis 1330
gccgcaggcacuggucggga

SEQ ID NO: 2468709 - RNA, 22 nt, Brucella suis 1330
gccgcauaggcuuucagcgcag

SEQ ID NO: 2468710 - RNA, 19 nt, Brucella suis 1330
gccgcaugauccgcuccag

SEQ ID NO: 2468711 - RNA, 21 nt, Brucella suis 1330
gccgcaugauccgcuccagau

SEQ ID NO: 2468712 - RNA, 16 nt, Brucella suis 1330
gccgcauugucgaagg

SEQ ID NO: 2468713 - RNA, 18 nt, Brucella suis 1330
gccgccaacgaccagcug

SEQ ID NO: 2468714 - RNA, 20 nt, Brucella suis 1330
gccgccaagggccgccgaag

SEQ ID NO: 2468715 - RNA, 15 nt, Brucella suis 1330
gccgccaauccccuc

SEQ ID NO: 2468716 - RNA, 19 nt, Brucella suis 1330
gccgccaauccccucaccu

SEQ ID NO: 2468717 - RNA, 13 nt, Brucella suis 1330
gccgccacccaug

SEQ ID NO: 2468718 - RNA, 15 nt, Brucella suis 1330
gccgccagcaggccg

SEQ ID NO: 2468719 - RNA, 13 nt, Brucella suis 1330
gccgccagccgca

SEQ ID NO: 2468720 - RNA, 18 nt, Brucella suis 1330
gccgccauggucgcgcac

SEQ ID NO: 2468721 - RNA, 13 nt, Brucella suis 1330
gccgcccugcgcc

SEQ ID NO: 2468722 - RNA, 13 nt, Brucella suis 1330
gccgccgcagacc

SEQ ID NO: 2468723 - RNA, 14 nt, Brucella suis 1330
gccgccgcagacca

SEQ ID NO: 2468724 - RNA, 20 nt, Brucella suis 1330
gccgccgcagaccacccggc

SEQ ID NO: 2468725 - RNA, 15 nt, Brucella suis 1330
gccgccgcgcggcag

SEQ ID NO: 2468726 - RNA, 20 nt, Brucella suis 1330
gccgccgcuuccagcgaaac

SEQ ID NO: 2468727 - RNA, 12 nt, Brucella suis 1330
gccgccggugcu

SEQ ID NO: 2468728 - RNA, 17 nt, Brucella suis 1330
gccgccuucggcugcuu

SEQ ID NO: 2468729 - RNA, 23 nt, Brucella suis 1330
gccgccuucggcugcuuccggcg

SEQ ID NO: 2468730 - RNA, 16 nt, Brucella suis 1330
gccgcgaaccgucgcc

SEQ ID NO: 2468731 - RNA, 18 nt, Brucella suis 1330
gccgcgaaccgucgccag

SEQ ID NO: 2468732 - RNA, 24 nt, Brucella suis 1330
gccgcgacugucaccgccagcaga

SEQ ID NO: 2468733 - RNA, 22 nt, Brucella suis 1330
gccgcgauaucgucgcgcucgc

SEQ ID NO: 2468734 - RNA, 19 nt, Brucella suis 1330
gccgcgaucacagccgcgc

SEQ ID NO: 2468735 - RNA, 17 nt, Brucella suis 1330
gccgcgaucacggccau

SEQ ID NO: 2468736 - RNA, 21 nt, Brucella suis 1330
gccgcgauugcaucggcagcu

SEQ ID NO: 2468737 - RNA, 17 nt, Brucella suis 1330
gccgcgcacuggcagca

SEQ ID NO: 2468738 - RNA, 17 nt, Brucella suis 1330
gccgcgccaauccaggu

SEQ ID NO: 2468739 - RNA, 19 nt, Brucella suis 1330
gccgcgccaugccauccuc

SEQ ID NO: 2468740 - RNA, 18 nt, Brucella suis 1330
gccgcgccgaucaucagc

SEQ ID NO: 2468741 - RNA, 13 nt, Brucella suis 1330
gccgcgcgcgcgc

SEQ ID NO: 2468742 - RNA, 20 nt, Brucella suis 1330
gccgcgcgggcaagcgggaa

SEQ ID NO: 2468743 - RNA, 14 nt, Brucella suis 1330
gccgcgcuccagau

SEQ ID NO: 2468744 - RNA, 18 nt, Brucella suis 1330
gccgcggaugacgccgcu

SEQ ID NO: 2468745 - RNA, 21 nt, Brucella suis 1330
gccgcggcguuucggaauaga

SEQ ID NO: 2468746 - RNA, 15 nt, Brucella suis 1330
gccgcgucagccggu

SEQ ID NO: 2468747 - RNA, 16 nt, Brucella suis 1330
gccgcgucagccgguu

SEQ ID NO: 2468748 - RNA, 15 nt, Brucella suis 1330
gccgcgugaaaagca

SEQ ID NO: 2468749 - RNA, 22 nt, Brucella suis 1330
gccgcguggcuaugcgcuucau

SEQ ID NO: 2468750 - RNA, 17 nt, Brucella suis 1330
gccgcguugcccauguc

SEQ ID NO: 2468751 - RNA, 20 nt, Brucella suis 1330
gccgcuauuugaguuuuucu

SEQ ID NO: 2468752 - RNA, 13 nt, Brucella suis 1330
gccgcuccagccg

SEQ ID NO: 2468753 - RNA, 16 nt, Brucella suis 1330
gccgcuccagccgagc

SEQ ID NO: 2468754 - RNA, 20 nt, Brucella suis 1330
gccgcuccagccgagcgcca

SEQ ID NO: 2468755 - RNA, 16 nt, Brucella suis 1330
gccgcucggcgaugaa

SEQ ID NO: 2468756 - RNA, 13 nt, Brucella suis 1330
gccgcugcgcaga

SEQ ID NO: 2468757 - RNA, 22 nt, Brucella suis 1330
gccgcugcgcagaagauugaug

SEQ ID NO: 2468758 - RNA, 18 nt, Brucella suis 1330
gccgcuggugcgauccac

SEQ ID NO: 2468759 - RNA, 20 nt, Brucella suis 1330
gccgcuggugcgauccacca

SEQ ID NO: 2468760 - RNA, 15 nt, Brucella suis 1330
gccgcuuccagcauc

SEQ ID NO: 2468761 - RNA, 18 nt, Brucella suis 1330
gccgcuuccagcauccgc

SEQ ID NO: 2468762 - RNA, 23 nt, Brucella suis 1330
gccgcuucugcucaccaaaaggc

SEQ ID NO: 2468763 - RNA, 16 nt, Brucella suis 1330
gccgcuugcgccgaac

SEQ ID NO: 2468764 - RNA, 14 nt, Brucella suis 1330
gccgcuuucuucca

SEQ ID NO: 2468765 - RNA, 22 nt, Brucella suis 1330
gccggaaagcgauuucaggaaa

SEQ ID NO: 2468766 - RNA, 21 nt, Brucella suis 1330
gccggaaauugggaucgaaag

SEQ ID NO: 2468767 - RNA, 17 nt, Brucella suis 1330
gccggaccgugccgcuu

SEQ ID NO: 2468768 - RNA, 22 nt, Brucella suis 1330
gccggaccgugccgcuuccagc

SEQ ID NO: 2468769 - RNA, 19 nt, Brucella suis 1330
gccggacgugacaucaagc

SEQ ID NO: 2468770 - RNA, 23 nt, Brucella suis 1330
gccggagcgaccagcaacgcgcc

SEQ ID NO: 2468771 - RNA, 13 nt, Brucella suis 1330
gccggagcgcaga

SEQ ID NO: 2468772 - RNA, 15 nt, Brucella suis 1330
gccggauaucgccag

SEQ ID NO: 2468773 - RNA, 22 nt, Brucella suis 1330
gccggcagcgguuccugauuga

SEQ ID NO: 2468774 - RNA, 22 nt, Brucella suis 1330
gccggcaugaaugugccuguga

SEQ ID NO: 2468775 - RNA, 21 nt, Brucella suis 1330
gccggcgauaccagacgcgca

SEQ ID NO: 2468776 - RNA, 13 nt, Brucella suis 1330
gccgggaaaucug

SEQ ID NO: 2468777 - RNA, 20 nt, Brucella suis 1330
gccgggaaaucugcgcgcgc

SEQ ID NO: 2468778 - RNA, 21 nt, Brucella suis 1330
gccgggaaaucugcgcgcgcg

SEQ ID NO: 2468779 - RNA, 15 nt, Brucella suis 1330
gccgggauuuucggc

SEQ ID NO: 2468780 - RNA, 20 nt, Brucella suis 1330
gccgggauuuucggccagcg

SEQ ID NO: 2468781 - RNA, 22 nt, Brucella suis 1330
gccgggcauggaagccgacaga

SEQ ID NO: 2468782 - RNA, 19 nt, Brucella suis 1330
gccgggcggaucggcagga

SEQ ID NO: 2468783 - RNA, 15 nt, Brucella suis 1330
gccgggcggcuugcc

SEQ ID NO: 2468784 - RNA, 13 nt, Brucella suis 1330
gccgggcuuuccu

SEQ ID NO: 2468785 - RNA, 16 nt, Brucella suis 1330
gccgggcuuuccugca

SEQ ID NO: 2468786 - RNA, 14 nt, Brucella suis 1330
gccggggcaggcuc

SEQ ID NO: 2468787 - RNA, 17 nt, Brucella suis 1330
gccggggggaauggcgc

SEQ ID NO: 2468788 - RNA, 16 nt, Brucella suis 1330
gccgggguuucuucau

SEQ ID NO: 2468789 - RNA, 15 nt, Brucella suis 1330
gccgguaagcccugu

SEQ ID NO: 2468790 - RNA, 23 nt, Brucella suis 1330
gccgguaagcccugucagcgccg

SEQ ID NO: 2468791 - RNA, 18 nt, Brucella suis 1330
gccgguaucaagcuucau

SEQ ID NO: 2468792 - RNA, 13 nt, Brucella suis 1330
gccgguauccagc

SEQ ID NO: 2468793 - RNA, 16 nt, Brucella suis 1330
gccgguauccagcaga

SEQ ID NO: 2468794 - RNA, 21 nt, Brucella suis 1330
gccgguauccagcagauccgu

SEQ ID NO: 2468795 - RNA, 23 nt, Brucella suis 1330
gccgguauccagcagauccguga

SEQ ID NO: 2468796 - RNA, 18 nt, Brucella suis 1330
gccgguauuuugcaacug

SEQ ID NO: 2468797 - RNA, 15 nt, Brucella suis 1330
gccggucaaaacgcc

SEQ ID NO: 2468798 - RNA, 16 nt, Brucella suis 1330
gccggucaaaacgccc

SEQ ID NO: 2468799 - RNA, 18 nt, Brucella suis 1330
gccggucaaaacgccccg

SEQ ID NO: 2468800 - RNA, 19 nt, Brucella suis 1330
gccgguccagaucgauggc

SEQ ID NO: 2468801 - RNA, 23 nt, Brucella suis 1330
gccggucccgugucggagccggc

SEQ ID NO: 2468802 - RNA, 21 nt, Brucella suis 1330
gccggucuucccgcaauucga

SEQ ID NO: 2468803 - RNA, 13 nt, Brucella suis 1330
gccggugcccgga

SEQ ID NO: 2468804 - RNA, 18 nt, Brucella suis 1330
gccggugcccggaagcga

SEQ ID NO: 2468805 - RNA, 13 nt, Brucella suis 1330
gccggugccggca

SEQ ID NO: 2468806 - RNA, 19 nt, Brucella suis 1330
gccggugcugucgcccaga

SEQ ID NO: 2468807 - RNA, 21 nt, Brucella suis 1330
gccggugcugucgcccagaac

SEQ ID NO: 2468808 - RNA, 17 nt, Brucella suis 1330
gccgguggaauagccgg

SEQ ID NO: 2468809 - RNA, 18 nt, Brucella suis 1330
gccgguucggucccgucc

SEQ ID NO: 2468810 - RNA, 18 nt, Brucella suis 1330
gccgguugcuuccaugcc

SEQ ID NO: 2468811 - RNA, 13 nt, Brucella suis 1330
gccgguuucgacu

SEQ ID NO: 2468812 - RNA, 14 nt, Brucella suis 1330
gccguaaauuauga

SEQ ID NO: 2468813 - RNA, 22 nt, Brucella suis 1330
gccguccccacgggauggcggc

SEQ ID NO: 2468814 - RNA, 19 nt, Brucella suis 1330
gccgucccggaagccgccu

SEQ ID NO: 2468815 - RNA, 21 nt, Brucella suis 1330
gccgucccggaagccgccuuc

SEQ ID NO: 2468816 - RNA, 15 nt, Brucella suis 1330
gccgucgagcagcau

SEQ ID NO: 2468817 - RNA, 16 nt, Brucella suis 1330
gccgucgagggcaccg

SEQ ID NO: 2468818 - RNA, 20 nt, Brucella suis 1330
gccgucgagggcaccggccu

SEQ ID NO: 2468819 - RNA, 18 nt, Brucella suis 1330
gccgugaaacagugccgc

SEQ ID NO: 2468820 - RNA, 22 nt, Brucella suis 1330
gccgugaaacagugccgccauc

SEQ ID NO: 2468821 - RNA, 19 nt, Brucella suis 1330
gccgugaaaggugaaggcc

SEQ ID NO: 2468822 - RNA, 22 nt, Brucella suis 1330
gccgugaaaggugaaggccugc

SEQ ID NO: 2468823 - RNA, 16 nt, Brucella suis 1330
gccgugaccagcgcaa

SEQ ID NO: 2468824 - RNA, 22 nt, Brucella suis 1330
gccgugagcauggcaaggccac

SEQ ID NO: 2468825 - RNA, 18 nt, Brucella suis 1330
gccgugcacuucgagcag

SEQ ID NO: 2468826 - RNA, 13 nt, Brucella suis 1330
gccgugggcaaga

SEQ ID NO: 2468827 - RNA, 15 nt, Brucella suis 1330
gccguguagggcaag

SEQ ID NO: 2468828 - RNA, 18 nt, Brucella suis 1330
gccguuauuucgcgcgca

SEQ ID NO: 2468829 - RNA, 20 nt, Brucella suis 1330
gccguuauuucgcgcgcaag

SEQ ID NO: 2468830 - RNA, 17 nt, Brucella suis 1330
gccguuccucuuccuca

SEQ ID NO: 2468831 - RNA, 18 nt, Brucella suis 1330
gccguugcgaucuucugc

SEQ ID NO: 2468832 - RNA, 13 nt, Brucella suis 1330
gccguuggaaacg

SEQ ID NO: 2468833 - RNA, 21 nt, Brucella suis 1330
gccuaacaggaacgccgccgg

SEQ ID NO: 2468834 - RNA, 22 nt, Brucella suis 1330
gccuaacaggaacgccgccgga

SEQ ID NO: 2468835 - RNA, 21 nt, Brucella suis 1330
gccuaaggcgcgcacuguuga

SEQ ID NO: 2468836 - RNA, 20 nt, Brucella suis 1330
gccuaaucaaaagaaaccuu

SEQ ID NO: 2468837 - RNA, 19 nt, Brucella suis 1330
gccucacccuccaccgaau

SEQ ID NO: 2468838 - RNA, 18 nt, Brucella suis 1330
gccucaucgaucacggcg

SEQ ID NO: 2468839 - RNA, 23 nt, Brucella suis 1330
gccucauugucgcauccaugagc

SEQ ID NO: 2468840 - RNA, 13 nt, Brucella suis 1330
gccuccauggcgu

SEQ ID NO: 2468841 - RNA, 18 nt, Brucella suis 1330
gccuccauggcgucccca

SEQ ID NO: 2468842 - RNA, 18 nt, Brucella suis 1330
gccuccugugcauugcca

SEQ ID NO: 2468843 - RNA, 14 nt, Brucella suis 1330
gccucgauggccug

SEQ ID NO: 2468844 - RNA, 18 nt, Brucella suis 1330
gccucgcaggcaaagcgg

SEQ ID NO: 2468845 - RNA, 21 nt, Brucella suis 1330
gccucggagccuucauugcgg

SEQ ID NO: 2468846 - RNA, 22 nt, Brucella suis 1330
gccucggagccuucauugcggc

SEQ ID NO: 2468847 - RNA, 15 nt, Brucella suis 1330
gccucuucauccggc

SEQ ID NO: 2468848 - RNA, 16 nt, Brucella suis 1330
gccucuuccaggagag

SEQ ID NO: 2468849 - RNA, 14 nt, Brucella suis 1330
gccugaaacaaggc

SEQ ID NO: 2468850 - RNA, 19 nt, Brucella suis 1330
gccugaaacaaggccgagc

SEQ ID NO: 2468851 - RNA, 22 nt, Brucella suis 1330
gccugaaacagcauauugccga

SEQ ID NO: 2468852 - RNA, 12 nt, Brucella suis 1330
gccugaacagcg

SEQ ID NO: 2468853 - RNA, 23 nt, Brucella suis 1330
gccugaaugaaaacgaggccgac

SEQ ID NO: 2468854 - RNA, 17 nt, Brucella suis 1330
gccugacggugcagccc

SEQ ID NO: 2468855 - RNA, 13 nt, Brucella suis 1330
gccugagaucgau

SEQ ID NO: 2468856 - RNA, 13 nt, Brucella suis 1330
gccugaggccgga

SEQ ID NO: 2468857 - RNA, 14 nt, Brucella suis 1330
gccugaggccggac

SEQ ID NO: 2468858 - RNA, 18 nt, Brucella suis 1330
gccugaugauccuggucu

SEQ ID NO: 2468859 - RNA, 13 nt, Brucella suis 1330
gccugcacauaaa

SEQ ID NO: 2468860 - RNA, 18 nt, Brucella suis 1330
gccugcacauaaaguuca

SEQ ID NO: 2468861 - RNA, 13 nt, Brucella suis 1330
gccugcaccaugg

SEQ ID NO: 2468862 - RNA, 14 nt, Brucella suis 1330
gccugcaccaugga

SEQ ID NO: 2468863 - RNA, 13 nt, Brucella suis 1330
gccugcaccggcc

SEQ ID NO: 2468864 - RNA, 18 nt, Brucella suis 1330
gccugcaccugcuggaac

SEQ ID NO: 2468865 - RNA, 20 nt, Brucella suis 1330
gccugcagccggaagaacag

SEQ ID NO: 2468866 - RNA, 18 nt, Brucella suis 1330
gccugcaucauaggccca

SEQ ID NO: 2468867 - RNA, 21 nt, Brucella suis 1330
gccugcaucauaggcccaggc

SEQ ID NO: 2468868 - RNA, 14 nt, Brucella suis 1330
gccugccagcccgc

SEQ ID NO: 2468869 - RNA, 20 nt, Brucella suis 1330
gccugccagcccgcuugcuu

SEQ ID NO: 2468870 - RNA, 17 nt, Brucella suis 1330
gccugccauccgccccg

SEQ ID NO: 2468871 - RNA, 21 nt, Brucella suis 1330
gccugccaugccgaaggcgaa

SEQ ID NO: 2468872 - RNA, 14 nt, Brucella suis 1330
gccugccaugccgc

SEQ ID NO: 2468873 - RNA, 16 nt, Brucella suis 1330
gccugccaugccgcca

SEQ ID NO: 2468874 - RNA, 17 nt, Brucella suis 1330
gccugccgcgcgggcaa

SEQ ID NO: 2468875 - RNA, 21 nt, Brucella suis 1330
gccugcgaggauuucaggugg

SEQ ID NO: 2468876 - RNA, 21 nt, Brucella suis 1330
gccugcgcaccgguauugccc

SEQ ID NO: 2468877 - RNA, 20 nt, Brucella suis 1330
gccugcgccagcgauugcgc

SEQ ID NO: 2468878 - RNA, 22 nt, Brucella suis 1330
gccugcugcauccugcucggcg

SEQ ID NO: 2468879 - RNA, 19 nt, Brucella suis 1330
gccugcugcauuuucugca

SEQ ID NO: 2468880 - RNA, 19 nt, Brucella suis 1330
gccugcuuccuuuucggcu

SEQ ID NO: 2468881 - RNA, 17 nt, Brucella suis 1330
gccuggccgauuuccgc

SEQ ID NO: 2468882 - RNA, 18 nt, Brucella suis 1330
gccuggcgaaaacggcca

SEQ ID NO: 2468883 - RNA, 23 nt, Brucella suis 1330
gccuggcgaaaacggccaugcgc

SEQ ID NO: 2468884 - RNA, 23 nt, Brucella suis 1330
gccugguagcgcaccucguucgg

SEQ ID NO: 2468885 - RNA, 18 nt, Brucella suis 1330
gccuggucuagccgcgca

SEQ ID NO: 2468886 - RNA, 22 nt, Brucella suis 1330
gccugucacgaucuugccgagg

SEQ ID NO: 2468887 - RNA, 18 nt, Brucella suis 1330
gccuguccuuguuccagu

SEQ ID NO: 2468888 - RNA, 17 nt, Brucella suis 1330
gccugugccaaugacau

SEQ ID NO: 2468889 - RNA, 13 nt, Brucella suis 1330
gccugugcgacga

SEQ ID NO: 2468890 - RNA, 13 nt, Brucella suis 1330
gccugugcggcgg

SEQ ID NO: 2468891 - RNA, 22 nt, Brucella suis 1330
gccugugggaagacucauuguc

SEQ ID NO: 2468892 - RNA, 13 nt, Brucella suis 1330
gccuguuccugca

SEQ ID NO: 2468893 - RNA, 14 nt, Brucella suis 1330
gccuucaucggcaa

SEQ ID NO: 2468894 - RNA, 15 nt, Brucella suis 1330
gccuucccagccggg

SEQ ID NO: 2468895 - RNA, 23 nt, Brucella suis 1330
gccuucccgauugcccauugccc

SEQ ID NO: 2468896 - RNA, 19 nt, Brucella suis 1330
gccuuccgccucuucgaga

SEQ ID NO: 2468897 - RNA, 16 nt, Brucella suis 1330
gccuucgacaaccgcg

SEQ ID NO: 2468898 - RNA, 18 nt, Brucella suis 1330
gccuucgacaaccgcgcc

SEQ ID NO: 2468899 - RNA, 20 nt, Brucella suis 1330
gccuucgacaaccgcgccgc

SEQ ID NO: 2468900 - RNA, 17 nt, Brucella suis 1330
gccuucgcgccaggcuu

SEQ ID NO: 2468901 - RNA, 20 nt, Brucella suis 1330
gccuucuucccguaauuccc

SEQ ID NO: 2468902 - RNA, 22 nt, Brucella suis 1330
gccuucuucccguaauucccgc

SEQ ID NO: 2468903 - RNA, 14 nt, Brucella suis 1330
gccuugaauagcgg

SEQ ID NO: 2468904 - RNA, 13 nt, Brucella suis 1330
gccuugaugccgc

SEQ ID NO: 2468905 - RNA, 20 nt, Brucella suis 1330
gccuugauguccggcgcgcu

SEQ ID NO: 2468906 - RNA, 19 nt, Brucella suis 1330
gccuugcagaugagcggca

SEQ ID NO: 2468907 - RNA, 19 nt, Brucella suis 1330
gccuugcccauggugccag

SEQ ID NO: 2468908 - RNA, 23 nt, Brucella suis 1330
gccuugcccauggugccagcguc

SEQ ID NO: 2468909 - RNA, 17 nt, Brucella suis 1330
gccuugcccuggcucuu

SEQ ID NO: 2468910 - RNA, 13 nt, Brucella suis 1330
gccuugcggcggc

SEQ ID NO: 2468911 - RNA, 19 nt, Brucella suis 1330
gccuugcggcggcguucca

SEQ ID NO: 2468912 - RNA, 22 nt, Brucella suis 1330
gccuugcggcggcguuccagcu

SEQ ID NO: 2468913 - RNA, 13 nt, Brucella suis 1330
gccuuggaaacca

SEQ ID NO: 2468914 - RNA, 23 nt, Brucella suis 1330
gccuuggaggcggcauaaggccc

SEQ ID NO: 2468915 - RNA, 22 nt, Brucella suis 1330
gccuuggcgaucagcgcaagaa

SEQ ID NO: 2468916 - RNA, 19 nt, Brucella suis 1330
gccuuguaggaaagcacac

SEQ ID NO: 2468917 - RNA, 21 nt, Brucella suis 1330
gccuugucgaucccuucgacg

SEQ ID NO: 2468918 - RNA, 22 nt, Brucella suis 1330
gccuugucgcccauuuucucca

SEQ ID NO: 2468919 - RNA, 20 nt, Brucella suis 1330
gccuuugccgcaauugccgc

SEQ ID NO: 2468920 - RNA, 12 nt, Brucella suis 1330
gccuuugccgcg

SEQ ID NO: 2468921 - RNA, 13 nt, Brucella suis 1330
gccuuugccgcgc

SEQ ID NO: 2468922 - RNA, 13 nt, Brucella suis 1330
gccuuugcgccgg

SEQ ID NO: 2468923 - RNA, 19 nt, Brucella suis 1330
gccuuugcgccggguuuug

SEQ ID NO: 2468924 - RNA, 14 nt, Brucella suis 1330
gccuuugcgcgccu

SEQ ID NO: 2468925 - RNA, 14 nt, Brucella suis 1330
gccuuuguuuucau

SEQ ID NO: 2468926 - RNA, 16 nt, Brucella suis 1330
gccuuuguuuucauug

SEQ ID NO: 2468927 - RNA, 12 nt, Brucella suis 1330
gccuuuucuuca

SEQ ID NO: 2468928 - RNA, 16 nt, Brucella suis 1330
gccuuuuucaguuuca

SEQ ID NO: 2468929 - RNA, 20 nt, Brucella suis 1330
gcgaaaaccggcuggcuuuc

SEQ ID NO: 2468930 - RNA, 21 nt, Brucella suis 1330
gcgaaaaccggcuggcuuucg

SEQ ID NO: 2468931 - RNA, 22 nt, Brucella suis 1330
gcgaaaacggccaugcgcauga

SEQ ID NO: 2468932 - RNA, 23 nt, Brucella suis 1330
gcgaaaagccgccucugucaccu

SEQ ID NO: 2468933 - RNA, 14 nt, Brucella suis 1330
gcgaaaccauggag

SEQ ID NO: 2468934 - RNA, 15 nt, Brucella suis 1330
gcgaaaccggaacgc

SEQ ID NO: 2468935 - RNA, 20 nt, Brucella suis 1330
gcgaaacggcagccgaggcg

SEQ ID NO: 2468936 - RNA, 15 nt, Brucella suis 1330
gcgaaagccagaacc

SEQ ID NO: 2468937 - RNA, 23 nt, Brucella suis 1330
gcgaaauaaucguaucgccaaag

SEQ ID NO: 2468938 - RNA, 22 nt, Brucella suis 1330
gcgaaauauuggcuaaaaaugg

SEQ ID NO: 2468939 - RNA, 14 nt, Brucella suis 1330
gcgaaaugccgaua

SEQ ID NO: 2468940 - RNA, 17 nt, Brucella suis 1330
gcgaacacgaugauggc

SEQ ID NO: 2468941 - RNA, 16 nt, Brucella suis 1330
gcgaaccguccacgau

SEQ ID NO: 2468942 - RNA, 20 nt, Brucella suis 1330
gcgaaccguccacgauggcc

SEQ ID NO: 2468943 - RNA, 12 nt, Brucella suis 1330
gcgaagaacaga

SEQ ID NO: 2468944 - RNA, 13 nt, Brucella suis 1330
gcgaagaacagaa

SEQ ID NO: 2468945 - RNA, 21 nt, Brucella suis 1330
gcgaagaccuucuggaagcgc

SEQ ID NO: 2468946 - RNA, 15 nt, Brucella suis 1330
gcgaagcgaugacgg

SEQ ID NO: 2468947 - RNA, 14 nt, Brucella suis 1330
gcgaagcgguuuug

SEQ ID NO: 2468948 - RNA, 15 nt, Brucella suis 1330
gcgaagcucaucggg

SEQ ID NO: 2468949 - RNA, 19 nt, Brucella suis 1330
gcgaaugacuucaucgcgc

SEQ ID NO: 2468950 - RNA, 20 nt, Brucella suis 1330
gcgaauggucggcgucaagc

SEQ ID NO: 2468951 - RNA, 18 nt, Brucella suis 1330
gcgaauguauagcgauga

SEQ ID NO: 2468952 - RNA, 19 nt, Brucella suis 1330
gcgaauuccacgaugagaa

SEQ ID NO: 2468953 - RNA, 15 nt, Brucella suis 1330
gcgacaccugcggcg

SEQ ID NO: 2468954 - RNA, 12 nt, Brucella suis 1330
gcgacagcggcg

SEQ ID NO: 2468955 - RNA, 15 nt, Brucella suis 1330
gcgacagcggcgcgc

SEQ ID NO: 2468956 - RNA, 17 nt, Brucella suis 1330
gcgacagcggcgcgccu

SEQ ID NO: 2468957 - RNA, 22 nt, Brucella suis 1330
gcgacagcggcgcgccugggcu

SEQ ID NO: 2468958 - RNA, 12 nt, Brucella suis 1330
gcgacaucauca

SEQ ID NO: 2468959 - RNA, 22 nt, Brucella suis 1330
gcgacauguuuuggaaagaaau

SEQ ID NO: 2468960 - RNA, 16 nt, Brucella suis 1330
gcgaccaccauggagg

SEQ ID NO: 2468961 - RNA, 20 nt, Brucella suis 1330
gcgaccaugagcagacggcc

SEQ ID NO: 2468962 - RNA, 23 nt, Brucella suis 1330
gcgacccagccaacggugcgggc

SEQ ID NO: 2468963 - RNA, 12 nt, Brucella suis 1330
gcgacgccgccc

SEQ ID NO: 2468964 - RNA, 21 nt, Brucella suis 1330
gcgacgcugcaacacgccgcc

SEQ ID NO: 2468965 - RNA, 14 nt, Brucella suis 1330
gcgacggccagcgc

SEQ ID NO: 2468966 - RNA, 18 nt, Brucella suis 1330
gcgacgggcgagcgccag

SEQ ID NO: 2468967 - RNA, 22 nt, Brucella suis 1330
gcgacguagggcgcgagcacgc

SEQ ID NO: 2468968 - RNA, 16 nt, Brucella suis 1330
gcgacguauauccggu

SEQ ID NO: 2468969 - RNA, 13 nt, Brucella suis 1330
gcgacuccuugua

SEQ ID NO: 2468970 - RNA, 22 nt, Brucella suis 1330
gcgacucuacgcugaucgcaag

SEQ ID NO: 2468971 - RNA, 23 nt, Brucella suis 1330
gcgacugcuaaugcguuuucgag

SEQ ID NO: 2468972 - RNA, 17 nt, Brucella suis 1330
gcgacugucaccgccag

SEQ ID NO: 2468973 - RNA, 13 nt, Brucella suis 1330
gcgacuucaccug

SEQ ID NO: 2468974 - RNA, 22 nt, Brucella suis 1330
gcgacuuccaguggaagcacau

SEQ ID NO: 2468975 - RNA, 19 nt, Brucella suis 1330
gcgacuucgggucggugaa

SEQ ID NO: 2468976 - RNA, 16 nt, Brucella suis 1330
gcgagaacuucccgcc

SEQ ID NO: 2468977 - RNA, 15 nt, Brucella suis 1330
gcgagacagacugga

SEQ ID NO: 2468978 - RNA, 15 nt, Brucella suis 1330
gcgagcacgccgcuc

SEQ ID NO: 2468979 - RNA, 15 nt, Brucella suis 1330
gcgagccgggaaugc

SEQ ID NO: 2468980 - RNA, 20 nt, Brucella suis 1330
gcgagcgacauauucuuccg

SEQ ID NO: 2468981 - RNA, 15 nt, Brucella suis 1330
gcgagcgcgccacgg

SEQ ID NO: 2468982 - RNA, 22 nt, Brucella suis 1330
gcgagcgcgccacggauuucca

SEQ ID NO: 2468983 - RNA, 22 nt, Brucella suis 1330
gcgagcggacggauggcaugga

SEQ ID NO: 2468984 - RNA, 20 nt, Brucella suis 1330
gcgagcgucuuggcgucggu

SEQ ID NO: 2468985 - RNA, 21 nt, Brucella suis 1330
gcgagcgucuuggcgucggug

SEQ ID NO: 2468986 - RNA, 14 nt, Brucella suis 1330
gcgaggaagagaau

SEQ ID NO: 2468987 - RNA, 15 nt, Brucella suis 1330
gcgaggagcguucca

SEQ ID NO: 2468988 - RNA, 23 nt, Brucella suis 1330
gcgagggcgggcaugggcaccug

SEQ ID NO: 2468989 - RNA, 13 nt, Brucella suis 1330
gcgagggcgggcg

SEQ ID NO: 2468990 - RNA, 16 nt, Brucella suis 1330
gcgagggcgggcggcc

SEQ ID NO: 2468991 - RNA, 17 nt, Brucella suis 1330
gcgagggcgggcggcca

SEQ ID NO: 2468992 - RNA, 20 nt, Brucella suis 1330
gcgaggggaaacugcgggcg

SEQ ID NO: 2468993 - RNA, 18 nt, Brucella suis 1330
gcgaggggaugggggccg

SEQ ID NO: 2468994 - RNA, 17 nt, Brucella suis 1330
gcgagguccggggugaa

SEQ ID NO: 2468995 - RNA, 16 nt, Brucella suis 1330
gcgagugucacgcugc

SEQ ID NO: 2468996 - RNA, 19 nt, Brucella suis 1330
gcgaguuuucaaaccaaaa

SEQ ID NO: 2468997 - RNA, 20 nt, Brucella suis 1330
gcgauaccagacgcgcacgu

SEQ ID NO: 2468998 - RNA, 16 nt, Brucella suis 1330
gcgauagcuuucuaug

SEQ ID NO: 2468999 - RNA, 20 nt, Brucella suis 1330
gcgauaucaccaauauugca

SEQ ID NO: 2469000 - RNA, 19 nt, Brucella suis 1330
gcgauauccggcacggcca

SEQ ID NO: 2469001 - RNA, 20 nt, Brucella suis 1330
gcgaucaacgcuuugaccgc

SEQ ID NO: 2469002 - RNA, 13 nt, Brucella suis 1330
gcgaucaccagcc

SEQ ID NO: 2469003 - RNA, 14 nt, Brucella suis 1330
gcgaucaccucgcc

SEQ ID NO: 2469004 - RNA, 11 nt, Brucella suis 1330
gcgaucagcgc

SEQ ID NO: 2469005 - RNA, 15 nt, Brucella suis 1330
gcgaucagguugaug

SEQ ID NO: 2469006 - RNA, 20 nt, Brucella suis 1330
gcgauccaccaucacgucga

SEQ ID NO: 2469007 - RNA, 19 nt, Brucella suis 1330
gcgauccugcugcgcggca

SEQ ID NO: 2469008 - RNA, 15 nt, Brucella suis 1330
gcgauccuuguucuu

SEQ ID NO: 2469009 - RNA, 14 nt, Brucella suis 1330
gcgaucucguccuc

SEQ ID NO: 2469010 - RNA, 19 nt, Brucella suis 1330
gcgaucuuacgaccaagcc

SEQ ID NO: 2469011 - RNA, 19 nt, Brucella suis 1330
gcgaugaagcgggccgcuu

SEQ ID NO: 2469012 - RNA, 18 nt, Brucella suis 1330
gcgaugauagcgcccgcc

SEQ ID NO: 2469013 - RNA, 14 nt, Brucella suis 1330
gcgaugcccaucgc

SEQ ID NO: 2469014 - RNA, 15 nt, Brucella suis 1330
gcgaugcccaucgca

SEQ ID NO: 2469015 - RNA, 18 nt, Brucella suis 1330
gcgaugcgccagcgauga

SEQ ID NO: 2469016 - RNA, 15 nt, Brucella suis 1330
gcgauggcgacgcgc

SEQ ID NO: 2469017 - RNA, 15 nt, Brucella suis 1330
gcgauggcgccgcau

SEQ ID NO: 2469018 - RNA, 18 nt, Brucella suis 1330
gcgauggcgccgcauggc

SEQ ID NO: 2469019 - RNA, 23 nt, Brucella suis 1330
gcgauugaugucauacauggcgu

SEQ ID NO: 2469020 - RNA, 17 nt, Brucella suis 1330
gcgauugcgcauugaca

SEQ ID NO: 2469021 - RNA, 21 nt, Brucella suis 1330
gcgauugcgcuccugcgugcg

SEQ ID NO: 2469022 - RNA, 16 nt, Brucella suis 1330
gcgauuucgccgggcu

SEQ ID NO: 2469023 - RNA, 16 nt, Brucella suis 1330
gcgauuucguccagag

SEQ ID NO: 2469024 - RNA, 13 nt, Brucella suis 1330
gcgcaaacaagcu

SEQ ID NO: 2469025 - RNA, 22 nt, Brucella suis 1330
gcgcaaaccaggaccgcgagga

SEQ ID NO: 2469026 - RNA, 18 nt, Brucella suis 1330
gcgcaaagcccgccgaag

SEQ ID NO: 2469027 - RNA, 13 nt, Brucella suis 1330
gcgcaaagccugc

SEQ ID NO: 2469028 - RNA, 14 nt, Brucella suis 1330
gcgcaaagcgcgcg

SEQ ID NO: 2469029 - RNA, 14 nt, Brucella suis 1330
gcgcaaaggccggg

SEQ ID NO: 2469030 - RNA, 15 nt, Brucella suis 1330
gcgcaaaggccgggu

SEQ ID NO: 2469031 - RNA, 19 nt, Brucella suis 1330
gcgcaaccaaaacauacuc

SEQ ID NO: 2469032 - RNA, 23 nt, Brucella suis 1330
gcgcaacgcaauggagcaggaag

SEQ ID NO: 2469033 - RNA, 17 nt, Brucella suis 1330
gcgcaacuggucggcga

SEQ ID NO: 2469034 - RNA, 18 nt, Brucella suis 1330
gcgcaacuguucgggcgu

SEQ ID NO: 2469035 - RNA, 17 nt, Brucella suis 1330
gcgcaacuuuguuguug

SEQ ID NO: 2469036 - RNA, 23 nt, Brucella suis 1330
gcgcaagaaggcguucgcgggcg

SEQ ID NO: 2469037 - RNA, 17 nt, Brucella suis 1330
gcgcaagauuuuggcga

SEQ ID NO: 2469038 - RNA, 14 nt, Brucella suis 1330
gcgcaaggcggcgc

SEQ ID NO: 2469039 - RNA, 16 nt, Brucella suis 1330
gcgcaagggccgcauc

SEQ ID NO: 2469040 - RNA, 12 nt, Brucella suis 1330
gcgcaagugcug

SEQ ID NO: 2469041 - RNA, 20 nt, Brucella suis 1330
gcgcaauaaugcagcgccgc

SEQ ID NO: 2469042 - RNA, 15 nt, Brucella suis 1330
gcgcaauaucggcga

SEQ ID NO: 2469043 - RNA, 18 nt, Brucella suis 1330
gcgcaaugugcuggcggc

SEQ ID NO: 2469044 - RNA, 14 nt, Brucella suis 1330
gcgcaauucaugcc

SEQ ID NO: 2469045 - RNA, 17 nt, Brucella suis 1330
gcgcaauugcgcgccug

SEQ ID NO: 2469046 - RNA, 13 nt, Brucella suis 1330
gcgcacgcgcacc

SEQ ID NO: 2469047 - RNA, 16 nt, Brucella suis 1330
gcgcacucaucaaaag

SEQ ID NO: 2469048 - RNA, 15 nt, Brucella suis 1330
gcgcacuggcagcau

SEQ ID NO: 2469049 - RNA, 16 nt, Brucella suis 1330
gcgcacuggcagcaug

SEQ ID NO: 2469050 - RNA, 23 nt, Brucella suis 1330
gcgcagaaugagcuugcgcccgc

SEQ ID NO: 2469051 - RNA, 18 nt, Brucella suis 1330
gcgcagauauggcgccug

SEQ ID NO: 2469052 - RNA, 13 nt, Brucella suis 1330
gcgcagaucggcg

SEQ ID NO: 2469053 - RNA, 16 nt, Brucella suis 1330
gcgcagaucggcgagc

SEQ ID NO: 2469054 - RNA, 19 nt, Brucella suis 1330
gcgcagaucggcgagcgcc

SEQ ID NO: 2469055 - RNA, 19 nt, Brucella suis 1330
gcgcagauggggcuggccg

SEQ ID NO: 2469056 - RNA, 14 nt, Brucella suis 1330
gcgcagcagcacca

SEQ ID NO: 2469057 - RNA, 19 nt, Brucella suis 1330
gcgcagcagcaucgccgcc

SEQ ID NO: 2469058 - RNA, 20 nt, Brucella suis 1330
gcgcagcaucugcgcgagga

SEQ ID NO: 2469059 - RNA, 21 nt, Brucella suis 1330
gcgcagcgacagcggcgcgcc

SEQ ID NO: 2469060 - RNA, 13 nt, Brucella suis 1330
gcgcagcgcgacc

SEQ ID NO: 2469061 - RNA, 19 nt, Brucella suis 1330
gcgcaggacuucacccgcc

SEQ ID NO: 2469062 - RNA, 20 nt, Brucella suis 1330
gcgcaggacuucacccgcca

SEQ ID NO: 2469063 - RNA, 21 nt, Brucella suis 1330
gcgcaggacuucacccgccag

SEQ ID NO: 2469064 - RNA, 22 nt, Brucella suis 1330
gcgcagggucugcgccagauca

SEQ ID NO: 2469065 - RNA, 20 nt, Brucella suis 1330
gcgcagugccuuugccuccg

SEQ ID NO: 2469066 - RNA, 16 nt, Brucella suis 1330
gcgcaguucgcgcauc

SEQ ID NO: 2469067 - RNA, 19 nt, Brucella suis 1330
gcgcaguuucgcagccaag

SEQ ID NO: 2469068 - RNA, 14 nt, Brucella suis 1330
gcgcauaucgagcc

SEQ ID NO: 2469069 - RNA, 15 nt, Brucella suis 1330
gcgcauaucgcgcga

SEQ ID NO: 2469070 - RNA, 17 nt, Brucella suis 1330
gcgcauccagccggcgc

SEQ ID NO: 2469071 - RNA, 20 nt, Brucella suis 1330
gcgcauccagccggcgcauc

SEQ ID NO: 2469072 - RNA, 13 nt, Brucella suis 1330
gcgcaucccgaaa

SEQ ID NO: 2469073 - RNA, 18 nt, Brucella suis 1330
gcgcaucccgaaaagugc

SEQ ID NO: 2469074 - RNA, 19 nt, Brucella suis 1330
gcgcaucccgaaaagugug

SEQ ID NO: 2469075 - RNA, 22 nt, Brucella suis 1330
gcgcaucgguggcauugcccau

SEQ ID NO: 2469076 - RNA, 19 nt, Brucella suis 1330
gcgcaucgucaaucacgcc

SEQ ID NO: 2469077 - RNA, 21 nt, Brucella suis 1330
gcgcaucuguucugccaucgc

SEQ ID NO: 2469078 - RNA, 15 nt, Brucella suis 1330
gcgcaugaagcgcgg

SEQ ID NO: 2469079 - RNA, 17 nt, Brucella suis 1330
gcgcaugaagcgcggcg

SEQ ID NO: 2469080 - RNA, 13 nt, Brucella suis 1330
gcgcauggcaugg

SEQ ID NO: 2469081 - RNA, 14 nt, Brucella suis 1330
gcgcauggccgcag

SEQ ID NO: 2469082 - RNA, 16 nt, Brucella suis 1330
gcgccaaacugcaccg

SEQ ID NO: 2469083 - RNA, 18 nt, Brucella suis 1330
gcgccaauccaggucagc

SEQ ID NO: 2469084 - RNA, 14 nt, Brucella suis 1330
gcgccaaucgccgc

SEQ ID NO: 2469085 - RNA, 21 nt, Brucella suis 1330
gcgccaccgucaccggcuggg

SEQ ID NO: 2469086 - RNA, 13 nt, Brucella suis 1330
gcgccacgcgggc

SEQ ID NO: 2469087 - RNA, 19 nt, Brucella suis 1330
gcgccacuucccgcgccuc

SEQ ID NO: 2469088 - RNA, 12 nt, Brucella suis 1330
gcgccagaaaga

SEQ ID NO: 2469089 - RNA, 24 nt, Brucella suis 1330
gcgccagagcauuuucgccgcagc

SEQ ID NO: 2469090 - RNA, 14 nt, Brucella suis 1330
gcgccagccgccag

SEQ ID NO: 2469091 - RNA, 12 nt, Brucella suis 1330
gcgccagcuucc

SEQ ID NO: 2469092 - RNA, 22 nt, Brucella suis 1330
gcgccagcuuccgucagggccg

SEQ ID NO: 2469093 - RNA, 21 nt, Brucella suis 1330
gcgccagucauugacggcagc

SEQ ID NO: 2469094 - RNA, 19 nt, Brucella suis 1330
gcgccauaaccucgacggc

SEQ ID NO: 2469095 - RNA, 12 nt, Brucella suis 1330
gcgccaucggca

SEQ ID NO: 2469096 - RNA, 17 nt, Brucella suis 1330
gcgccauuugcaggccg

SEQ ID NO: 2469097 - RNA, 19 nt, Brucella suis 1330
gcgcccacuuugccgucuu

SEQ ID NO: 2469098 - RNA, 12 nt, Brucella suis 1330
gcgcccagggaa

SEQ ID NO: 2469099 - RNA, 20 nt, Brucella suis 1330
gcgcccgccacaugggcggc

SEQ ID NO: 2469100 - RNA, 22 nt, Brucella suis 1330
gcgcccgccuuuaccgccgggg

SEQ ID NO: 2469101 - RNA, 15 nt, Brucella suis 1330
gcgcccgucaccggc

SEQ ID NO: 2469102 - RNA, 22 nt, Brucella suis 1330
gcgcccucaaccgagcagccgc

SEQ ID NO: 2469103 - RNA, 22 nt, Brucella suis 1330
gcgcccuugccggauaucgcca

SEQ ID NO: 2469104 - RNA, 15 nt, Brucella suis 1330
gcgccgaaaaucggc

SEQ ID NO: 2469105 - RNA, 20 nt, Brucella suis 1330
gcgccgaacagcgcccagag

SEQ ID NO: 2469106 - RNA, 19 nt, Brucella suis 1330
gcgccgaaccgggccgcau

SEQ ID NO: 2469107 - RNA, 20 nt, Brucella suis 1330
gcgccgaaccgggccgcaug

SEQ ID NO: 2469108 - RNA, 15 nt, Brucella suis 1330
gcgccgaggcgcagg

SEQ ID NO: 2469109 - RNA, 22 nt, Brucella suis 1330
gcgccgauaccaaggccgaugg

SEQ ID NO: 2469110 - RNA, 18 nt, Brucella suis 1330
gcgccgauauagacgcca

SEQ ID NO: 2469111 - RNA, 21 nt, Brucella suis 1330
gcgccgaugcggggaaaucag

SEQ ID NO: 2469112 - RNA, 16 nt, Brucella suis 1330
gcgccgccauggccga

SEQ ID NO: 2469113 - RNA, 14 nt, Brucella suis 1330
gcgccgccgcgaca

SEQ ID NO: 2469114 - RNA, 21 nt, Brucella suis 1330
gcgccgccgcgacauagccga

SEQ ID NO: 2469115 - RNA, 19 nt, Brucella suis 1330
gcgccgccuucaaaacgca

SEQ ID NO: 2469116 - RNA, 20 nt, Brucella suis 1330
gcgccggaagauggagcggc

SEQ ID NO: 2469117 - RNA, 22 nt, Brucella suis 1330
gcgccggaagauggagcggcug

SEQ ID NO: 2469118 - RNA, 18 nt, Brucella suis 1330
gcgccggaaggcggggcu

SEQ ID NO: 2469119 - RNA, 22 nt, Brucella suis 1330
gcgccgggaaauuucagccaug

SEQ ID NO: 2469120 - RNA, 22 nt, Brucella suis 1330
gcgccgggauuuucggccagcg

SEQ ID NO: 2469121 - RNA, 18 nt, Brucella suis 1330
gcgccggucuucauggcu

SEQ ID NO: 2469122 - RNA, 22 nt, Brucella suis 1330
gcgccggucuucauggcuugaa

SEQ ID NO: 2469123 - RNA, 20 nt, Brucella suis 1330
gcgccgguguagagcuggcg

SEQ ID NO: 2469124 - RNA, 16 nt, Brucella suis 1330
gcgccguaauggcgcg

SEQ ID NO: 2469125 - RNA, 17 nt, Brucella suis 1330
gcgccgucgccgaccgc

SEQ ID NO: 2469126 - RNA, 23 nt, Brucella suis 1330
gcgccgucgggaccaccggccug

SEQ ID NO: 2469127 - RNA, 21 nt, Brucella suis 1330
gcgccuacgcggggaaaucag

SEQ ID NO: 2469128 - RNA, 16 nt, Brucella suis 1330
gcgccucacccuccac

SEQ ID NO: 2469129 - RNA, 21 nt, Brucella suis 1330
gcgccugaggccggacgcuuc

SEQ ID NO: 2469130 - RNA, 23 nt, Brucella suis 1330
gcgccugaggccggacgcuucaa

SEQ ID NO: 2469131 - RNA, 17 nt, Brucella suis 1330
gcgccuguguggcccug

SEQ ID NO: 2469132 - RNA, 19 nt, Brucella suis 1330
gcgccuuuucuucauccag

SEQ ID NO: 2469133 - RNA, 17 nt, Brucella suis 1330
gcgcgaacaugccugcc

SEQ ID NO: 2469134 - RNA, 22 nt, Brucella suis 1330
gcgcgaaccagauccaccgcgc

SEQ ID NO: 2469135 - RNA, 23 nt, Brucella suis 1330
gcgcgaaccagauccaccgcgcu

SEQ ID NO: 2469136 - RNA, 14 nt, Brucella suis 1330
gcgcgaagcgcauc

SEQ ID NO: 2469137 - RNA, 14 nt, Brucella suis 1330
gcgcgaauuuucuc

SEQ ID NO: 2469138 - RNA, 20 nt, Brucella suis 1330
gcgcgaauuuucucagcguu

SEQ ID NO: 2469139 - RNA, 16 nt, Brucella suis 1330
gcgcgacaagcgcauc

SEQ ID NO: 2469140 - RNA, 22 nt, Brucella suis 1330
gcgcgaccugcucgaucuggcc

SEQ ID NO: 2469141 - RNA, 15 nt, Brucella suis 1330
gcgcgagcacgccgc

SEQ ID NO: 2469142 - RNA, 13 nt, Brucella suis 1330
gcgcgaggcggcu

SEQ ID NO: 2469143 - RNA, 21 nt, Brucella suis 1330
gcgcgaucucguccucgauca

SEQ ID NO: 2469144 - RNA, 21 nt, Brucella suis 1330
gcgcgauuuuuccguggugcu

SEQ ID NO: 2469145 - RNA, 14 nt, Brucella suis 1330
gcgcgcaagggccg

SEQ ID NO: 2469146 - RNA, 21 nt, Brucella suis 1330
gcgcgcaccgauggagcgccc

SEQ ID NO: 2469147 - RNA, 22 nt, Brucella suis 1330
gcgcgcauuucgguuuucgugc

SEQ ID NO: 2469148 - RNA, 16 nt, Brucella suis 1330
gcgcgccaguaggccc

SEQ ID NO: 2469149 - RNA, 23 nt, Brucella suis 1330
gcgcgcccucgcgcucggcaagc

SEQ ID NO: 2469150 - RNA, 17 nt, Brucella suis 1330
gcgcgccggucuucaug

SEQ ID NO: 2469151 - RNA, 22 nt, Brucella suis 1330
gcgcgccggucuucauggcuug

SEQ ID NO: 2469152 - RNA, 12 nt, Brucella suis 1330
gcgcgcggcaua

SEQ ID NO: 2469153 - RNA, 17 nt, Brucella suis 1330
gcgcgcgguugauaucg

SEQ ID NO: 2469154 - RNA, 21 nt, Brucella suis 1330
gcgcgcgguugauaucgcgga

SEQ ID NO: 2469155 - RNA, 23 nt, Brucella suis 1330
gcgcgcuuuccccgggcagcggc

SEQ ID NO: 2469156 - RNA, 23 nt, Brucella suis 1330
gcgcggaaaauguuccgcaccgc

SEQ ID NO: 2469157 - RNA, 14 nt, Brucella suis 1330
gcgcggaaugacau

SEQ ID NO: 2469158 - RNA, 21 nt, Brucella suis 1330
gcgcggagaugauggcggagc

SEQ ID NO: 2469159 - RNA, 16 nt, Brucella suis 1330
gcgcggaucguacggc

SEQ ID NO: 2469160 - RNA, 20 nt, Brucella suis 1330
gcgcggcaacgcuggcgcgc

SEQ ID NO: 2469161 - RNA, 17 nt, Brucella suis 1330
gcgcggcaggaucgcca

SEQ ID NO: 2469162 - RNA, 22 nt, Brucella suis 1330
gcgcggcaggaucgccagaagc

SEQ ID NO: 2469163 - RNA, 19 nt, Brucella suis 1330
gcgcggccccgauuuuggc

SEQ ID NO: 2469164 - RNA, 15 nt, Brucella suis 1330
gcgcggcgaaacgcc

SEQ ID NO: 2469165 - RNA, 22 nt, Brucella suis 1330
gcgcggcgcuucaucuuccgug

SEQ ID NO: 2469166 - RNA, 13 nt, Brucella suis 1330
gcgcggcggcacc

SEQ ID NO: 2469167 - RNA, 14 nt, Brucella suis 1330
gcgcggcggcaccg

SEQ ID NO: 2469168 - RNA, 19 nt, Brucella suis 1330
gcgcggcggcaccgcaagu

SEQ ID NO: 2469169 - RNA, 18 nt, Brucella suis 1330
gcgcggcguucggcaagu

SEQ ID NO: 2469170 - RNA, 16 nt, Brucella suis 1330
gcgcggcuuccagcgc

SEQ ID NO: 2469171 - RNA, 16 nt, Brucella suis 1330
gcgcgggcaagcggga

SEQ ID NO: 2469172 - RNA, 14 nt, Brucella suis 1330
gcgcguaucgacac

SEQ ID NO: 2469173 - RNA, 22 nt, Brucella suis 1330
gcgcguaucgacaccgccaagu

SEQ ID NO: 2469174 - RNA, 13 nt, Brucella suis 1330
gcgcucaugaaac

SEQ ID NO: 2469175 - RNA, 13 nt, Brucella suis 1330
gcgcucgccgccc

SEQ ID NO: 2469176 - RNA, 15 nt, Brucella suis 1330
gcgcucgcggcuggu

SEQ ID NO: 2469177 - RNA, 18 nt, Brucella suis 1330
gcgcucuuuccgcgcauc

SEQ ID NO: 2469178 - RNA, 18 nt, Brucella suis 1330
gcgcugaagccguuccau

SEQ ID NO: 2469179 - RNA, 20 nt, Brucella suis 1330
gcgcugaagccguuccauga

SEQ ID NO: 2469180 - RNA, 15 nt, Brucella suis 1330
gcgcugaagcggccu

SEQ ID NO: 2469181 - RNA, 20 nt, Brucella suis 1330
gcgcugauucuggauuucau

SEQ ID NO: 2469182 - RNA, 17 nt, Brucella suis 1330
gcgcugauugggcggcg

SEQ ID NO: 2469183 - RNA, 20 nt, Brucella suis 1330
gcgcugcaauggucgacaau

SEQ ID NO: 2469184 - RNA, 18 nt, Brucella suis 1330
gcgcugccauugccgcga

SEQ ID NO: 2469185 - RNA, 19 nt, Brucella suis 1330
gcgcugcucaucaucacau

SEQ ID NO: 2469186 - RNA, 14 nt, Brucella suis 1330
gcgcugucgccugu

SEQ ID NO: 2469187 - RNA, 17 nt, Brucella suis 1330
gcgcuucgaggaaccag

SEQ ID NO: 2469188 - RNA, 16 nt, Brucella suis 1330
gcgcuucgcgcaggcc

SEQ ID NO: 2469189 - RNA, 16 nt, Brucella suis 1330
gcgcuuuaaagcagga

SEQ ID NO: 2469190 - RNA, 19 nt, Brucella suis 1330
gcggaaaauguuccgcacc

SEQ ID NO: 2469191 - RNA, 13 nt, Brucella suis 1330
gcggaaaggcuuc

SEQ ID NO: 2469192 - RNA, 16 nt, Brucella suis 1330
gcggaacacgccgcca

SEQ ID NO: 2469193 - RNA, 18 nt, Brucella suis 1330
gcggaacacgccgccaua

SEQ ID NO: 2469194 - RNA, 16 nt, Brucella suis 1330
gcggaacaggcagcau

SEQ ID NO: 2469195 - RNA, 21 nt, Brucella suis 1330
gcggaacugcaugggcucgac

SEQ ID NO: 2469196 - RNA, 14 nt, Brucella suis 1330
gcggaagcauaugu

SEQ ID NO: 2469197 - RNA, 19 nt, Brucella suis 1330
gcggaagcauauguuccug

SEQ ID NO: 2469198 - RNA, 18 nt, Brucella suis 1330
gcggaagcgacgauaucg

SEQ ID NO: 2469199 - RNA, 20 nt, Brucella suis 1330
gcggaagcgagaaugaggcc

SEQ ID NO: 2469200 - RNA, 13 nt, Brucella suis 1330
gcggaaugacaug

SEQ ID NO: 2469201 - RNA, 16 nt, Brucella suis 1330
gcggaauucauccgcc

SEQ ID NO: 2469202 - RNA, 21 nt, Brucella suis 1330
gcggauaguucaaggcugcug

SEQ ID NO: 2469203 - RNA, 17 nt, Brucella suis 1330
gcggauauucgccgccu

SEQ ID NO: 2469204 - RNA, 18 nt, Brucella suis 1330
gcggaucagcgcgccggu

SEQ ID NO: 2469205 - RNA, 22 nt, Brucella suis 1330
gcggaucagcgcgccggucuuc

SEQ ID NO: 2469206 - RNA, 12 nt, Brucella suis 1330
gcggaucggcag

SEQ ID NO: 2469207 - RNA, 16 nt, Brucella suis 1330
gcggaucgugacccgc

SEQ ID NO: 2469208 - RNA, 15 nt, Brucella suis 1330
gcggaugaagcgccg

SEQ ID NO: 2469209 - RNA, 15 nt, Brucella suis 1330
gcggaugauguugcg

SEQ ID NO: 2469210 - RNA, 21 nt, Brucella suis 1330
gcggaugcgcggcgccagcgc

SEQ ID NO: 2469211 - RNA, 17 nt, Brucella suis 1330
gcggaugcguggcugug

SEQ ID NO: 2469212 - RNA, 15 nt, Brucella suis 1330
gcggauggaccggcu

SEQ ID NO: 2469213 - RNA, 19 nt, Brucella suis 1330
gcggauggaccggcugguc

SEQ ID NO: 2469214 - RNA, 19 nt, Brucella suis 1330
gcggauggggugagggcca

SEQ ID NO: 2469215 - RNA, 16 nt, Brucella suis 1330
gcggauugcuguugcg

SEQ ID NO: 2469216 - RNA, 13 nt, Brucella suis 1330
gcggauuucaucg

SEQ ID NO: 2469217 - RNA, 21 nt, Brucella suis 1330
gcggauuugaggauugccgcc

SEQ ID NO: 2469218 - RNA, 23 nt, Brucella suis 1330
gcggcaaauagcuuaugcgcgcc

SEQ ID NO: 2469219 - RNA, 16 nt, Brucella suis 1330
gcggcaagcugcucgc

SEQ ID NO: 2469220 - RNA, 19 nt, Brucella suis 1330
gcggcaaugcgcuucgcgc

SEQ ID NO: 2469221 - RNA, 14 nt, Brucella suis 1330
gcggcacaugaaau

SEQ ID NO: 2469222 - RNA, 16 nt, Brucella suis 1330
gcggcacccccggcag

SEQ ID NO: 2469223 - RNA, 14 nt, Brucella suis 1330
gcggcacccgcaac

SEQ ID NO: 2469224 - RNA, 19 nt, Brucella suis 1330
gcggcacgaugcgcagccg

SEQ ID NO: 2469225 - RNA, 17 nt, Brucella suis 1330
gcggcacgucggacuuc

SEQ ID NO: 2469226 - RNA, 12 nt, Brucella suis 1330
gcggcagccgcc

SEQ ID NO: 2469227 - RNA, 15 nt, Brucella suis 1330
gcggcagccgccgcc

SEQ ID NO: 2469228 - RNA, 19 nt, Brucella suis 1330
gcggcagccgccgccgcaa

SEQ ID NO: 2469229 - RNA, 20 nt, Brucella suis 1330
gcggcaggaucgccagaagc

SEQ ID NO: 2469230 - RNA, 21 nt, Brucella suis 1330
gcggcaggccgcaaagcgaac

SEQ ID NO: 2469231 - RNA, 20 nt, Brucella suis 1330
gcggcaggugccaucaagcg

SEQ ID NO: 2469232 - RNA, 13 nt, Brucella suis 1330
gcggcaguuucac

SEQ ID NO: 2469233 - RNA, 21 nt, Brucella suis 1330
gcggcauauccggaccgaagg

SEQ ID NO: 2469234 - RNA, 22 nt, Brucella suis 1330
gcggcaucgagaaaagcgcaac

SEQ ID NO: 2469235 - RNA, 22 nt, Brucella suis 1330
gcggcauuggugaaggauaucg

SEQ ID NO: 2469236 - RNA, 24 nt, Brucella suis 1330
gcggccaacgccacgaaccguguu

SEQ ID NO: 2469237 - RNA, 14 nt, Brucella suis 1330
gcggccaagcggau

SEQ ID NO: 2469238 - RNA, 21 nt, Brucella suis 1330
gcggccacaagcgccgguucg

SEQ ID NO: 2469239 - RNA, 15 nt, Brucella suis 1330
gcggccagaauaucc

SEQ ID NO: 2469240 - RNA, 23 nt, Brucella suis 1330
gcggcccuuuucuauugaacacc

SEQ ID NO: 2469241 - RNA, 15 nt, Brucella suis 1330
gcggccggagcgcag

SEQ ID NO: 2469242 - RNA, 19 nt, Brucella suis 1330
gcggccuugaugcggcggc

SEQ ID NO: 2469243 - RNA, 20 nt, Brucella suis 1330
gcggcgaguugccacgcgcc

SEQ ID NO: 2469244 - RNA, 20 nt, Brucella suis 1330
gcggcgcaaagcccagccgu

SEQ ID NO: 2469245 - RNA, 22 nt, Brucella suis 1330
gcggcgccaccgucaccggcug

SEQ ID NO: 2469246 - RNA, 21 nt, Brucella suis 1330
gcggcgcggcaggaucgccag

SEQ ID NO: 2469247 - RNA, 17 nt, Brucella suis 1330
gcggcgcggcggcaccg

SEQ ID NO: 2469248 - RNA, 20 nt, Brucella suis 1330
gcggcggauaaugcucgccc

SEQ ID NO: 2469249 - RNA, 14 nt, Brucella suis 1330
gcggcggauuucau

SEQ ID NO: 2469250 - RNA, 17 nt, Brucella suis 1330
gcggcggcaaucgagac

SEQ ID NO: 2469251 - RNA, 15 nt, Brucella suis 1330
gcggcggcgcgcaag

SEQ ID NO: 2469252 - RNA, 14 nt, Brucella suis 1330
gcggcggcuccagc

SEQ ID NO: 2469253 - RNA, 17 nt, Brucella suis 1330
gcggcggcuccagccgg

SEQ ID NO: 2469254 - RNA, 15 nt, Brucella suis 1330
gcggcggucaguucc

SEQ ID NO: 2469255 - RNA, 14 nt, Brucella suis 1330
gcggcggucggccu

SEQ ID NO: 2469256 - RNA, 20 nt, Brucella suis 1330
gcggcgguuuugagcugcug

SEQ ID NO: 2469257 - RNA, 23 nt, Brucella suis 1330
gcggcgguuuugagcugcugggu

SEQ ID NO: 2469258 - RNA, 19 nt, Brucella suis 1330
gcggcgucagggcauugcc

SEQ ID NO: 2469259 - RNA, 15 nt, Brucella suis 1330
gcggcguggaaagcu

SEQ ID NO: 2469260 - RNA, 21 nt, Brucella suis 1330
gcggcuaauggcgguuucgau

SEQ ID NO: 2469261 - RNA, 17 nt, Brucella suis 1330
gcggcucaagcuccagc

SEQ ID NO: 2469262 - RNA, 19 nt, Brucella suis 1330
gcggcucucacgcgcagca

SEQ ID NO: 2469263 - RNA, 20 nt, Brucella suis 1330
gcggcugaaaucugcgccgg

SEQ ID NO: 2469264 - RNA, 22 nt, Brucella suis 1330
gcggcugaaaucugcgccgguu

SEQ ID NO: 2469265 - RNA, 19 nt, Brucella suis 1330
gcggcuuccagauugucuu

SEQ ID NO: 2469266 - RNA, 16 nt, Brucella suis 1330
gcggcuuccagcgccu

SEQ ID NO: 2469267 - RNA, 13 nt, Brucella suis 1330
gcggcuucugggc

SEQ ID NO: 2469268 - RNA, 14 nt, Brucella suis 1330
gcggcuucugggcc

SEQ ID NO: 2469269 - RNA, 13 nt, Brucella suis 1330
gcggcuugaaauc

SEQ ID NO: 2469270 - RNA, 14 nt, Brucella suis 1330
gcggcuugccacca

SEQ ID NO: 2469271 - RNA, 14 nt, Brucella suis 1330
gcggcuugccagau

SEQ ID NO: 2469272 - RNA, 17 nt, Brucella suis 1330
gcggcuugcgcgacgau

SEQ ID NO: 2469273 - RNA, 18 nt, Brucella suis 1330
gcggcuuuccagcgggcg

SEQ ID NO: 2469274 - RNA, 20 nt, Brucella suis 1330
gcggcuuuccagcgggcgcg

SEQ ID NO: 2469275 - RNA, 20 nt, Brucella suis 1330
gcgggaaaaaucgcgcggcu

SEQ ID NO: 2469276 - RNA, 14 nt, Brucella suis 1330
gcgggaaggcgcga

SEQ ID NO: 2469277 - RNA, 16 nt, Brucella suis 1330
gcgggagcggcacaug

SEQ ID NO: 2469278 - RNA, 22 nt, Brucella suis 1330
gcgggagcggcacaugaaauaa

SEQ ID NO: 2469279 - RNA, 17 nt, Brucella suis 1330
gcgggaucagaaaucag

SEQ ID NO: 2469280 - RNA, 19 nt, Brucella suis 1330
gcgggaugacgccgggcau

SEQ ID NO: 2469281 - RNA, 22 nt, Brucella suis 1330
gcgggcaaaggcgauggcuugc

SEQ ID NO: 2469282 - RNA, 20 nt, Brucella suis 1330
gcgggcaagcauuccgggcc

SEQ ID NO: 2469283 - RNA, 18 nt, Brucella suis 1330
gcgggcaauggccgcaug

SEQ ID NO: 2469284 - RNA, 20 nt, Brucella suis 1330
gcgggcagcacugaaacggg

SEQ ID NO: 2469285 - RNA, 21 nt, Brucella suis 1330
gcgggcaugaaaacgccgcgg

SEQ ID NO: 2469286 - RNA, 14 nt, Brucella suis 1330
gcgggcaugggcac

SEQ ID NO: 2469287 - RNA, 21 nt, Brucella suis 1330
gcgggccauuuccaaugccuc

SEQ ID NO: 2469288 - RNA, 21 nt, Brucella suis 1330
gcgggcgcagcgacagcggcg

SEQ ID NO: 2469289 - RNA, 19 nt, Brucella suis 1330
gcgggcuguuggccggcag

SEQ ID NO: 2469290 - RNA, 23 nt, Brucella suis 1330
gcgggcuguuggccggcagcggu

SEQ ID NO: 2469291 - RNA, 21 nt, Brucella suis 1330
gcgggcuucugcgcccgcgcc

SEQ ID NO: 2469292 - RNA, 14 nt, Brucella suis 1330
gcgggcuucuucca

SEQ ID NO: 2469293 - RNA, 19 nt, Brucella suis 1330
gcgggcuucuuccaguucc

SEQ ID NO: 2469294 - RNA, 21 nt, Brucella suis 1330
gcgggcuucuuccaguuccuu

SEQ ID NO: 2469295 - RNA, 16 nt, Brucella suis 1330
gcgggcuuuccagccc

SEQ ID NO: 2469296 - RNA, 19 nt, Brucella suis 1330
gcgggcuuuccagcccccu

SEQ ID NO: 2469297 - RNA, 20 nt, Brucella suis 1330
gcgggcuuuuucguaucggg

SEQ ID NO: 2469298 - RNA, 17 nt, Brucella suis 1330
gcggggccugaaugcaa

SEQ ID NO: 2469299 - RNA, 19 nt, Brucella suis 1330
gcggggcuguagcgcgcac

SEQ ID NO: 2469300 - RNA, 12 nt, Brucella suis 1330
gcggggcuucca

SEQ ID NO: 2469301 - RNA, 12 nt, Brucella suis 1330
gcgggggcggcg

SEQ ID NO: 2469302 - RNA, 13 nt, Brucella suis 1330
gcgggggcggcgg

SEQ ID NO: 2469303 - RNA, 16 nt, Brucella suis 1330
gcgggguguacaacaa

SEQ ID NO: 2469304 - RNA, 16 nt, Brucella suis 1330
gcggguagccgccauu

SEQ ID NO: 2469305 - RNA, 19 nt, Brucella suis 1330
gcgggugaagguccauagc

SEQ ID NO: 2469306 - RNA, 15 nt, Brucella suis 1330
gcggguugcgcccgg

SEQ ID NO: 2469307 - RNA, 17 nt, Brucella suis 1330
gcgguaccgaagagcuu

SEQ ID NO: 2469308 - RNA, 20 nt, Brucella suis 1330
gcggucgagcuuuccaucgu

SEQ ID NO: 2469309 - RNA, 15 nt, Brucella suis 1330
gcggucgcccauaug

SEQ ID NO: 2469310 - RNA, 15 nt, Brucella suis 1330
gcggucggccucgcc

SEQ ID NO: 2469311 - RNA, 16 nt, Brucella suis 1330
gcggucucgaagauca

SEQ ID NO: 2469312 - RNA, 19 nt, Brucella suis 1330
gcggucugcuugccgccga

SEQ ID NO: 2469313 - RNA, 15 nt, Brucella suis 1330
gcggugacggcggca

SEQ ID NO: 2469314 - RNA, 20 nt, Brucella suis 1330
gcggugcacgaauugcacgg

SEQ ID NO: 2469315 - RNA, 20 nt, Brucella suis 1330
gcgguuccagcgauuccauu

SEQ ID NO: 2469316 - RNA, 19 nt, Brucella suis 1330
gcgguuccuguuuuaacac

SEQ ID NO: 2469317 - RNA, 19 nt, Brucella suis 1330
gcgguugcgacauugaggc

SEQ ID NO: 2469318 - RNA, 13 nt, Brucella suis 1330
gcgguugcggccg

SEQ ID NO: 2469319 - RNA, 17 nt, Brucella suis 1330
gcguaaaaauaaagaaa

SEQ ID NO: 2469320 - RNA, 16 nt, Brucella suis 1330
gcguaaaccucccugu

SEQ ID NO: 2469321 - RNA, 14 nt, Brucella suis 1330
gcguaagcggcaau

SEQ ID NO: 2469322 - RNA, 20 nt, Brucella suis 1330
gcguaaguucauaaggcaau

SEQ ID NO: 2469323 - RNA, 20 nt, Brucella suis 1330
gcguaaucacuugcaagcgc

SEQ ID NO: 2469324 - RNA, 20 nt, Brucella suis 1330
gcguacaacaucgccugagg

SEQ ID NO: 2469325 - RNA, 19 nt, Brucella suis 1330
gcguaccauaggcgcgcgc

SEQ ID NO: 2469326 - RNA, 17 nt, Brucella suis 1330
gcguaccggagcuaaag

SEQ ID NO: 2469327 - RNA, 19 nt, Brucella suis 1330
gcguagaaauagggccaga

SEQ ID NO: 2469328 - RNA, 15 nt, Brucella suis 1330
gcguauccaggugca

SEQ ID NO: 2469329 - RNA, 19 nt, Brucella suis 1330
gcguaucguuaucgcgcag

SEQ ID NO: 2469330 - RNA, 13 nt, Brucella suis 1330
gcgucaacaggcu

SEQ ID NO: 2469331 - RNA, 17 nt, Brucella suis 1330
gcgucaccgugcgcaau

SEQ ID NO: 2469332 - RNA, 15 nt, Brucella suis 1330
gcgucacggucggau

SEQ ID NO: 2469333 - RNA, 17 nt, Brucella suis 1330
gcgucaggacaacgucg

SEQ ID NO: 2469334 - RNA, 16 nt, Brucella suis 1330
gcgucaggccaaagcc

SEQ ID NO: 2469335 - RNA, 13 nt, Brucella suis 1330
gcgucaggcccag

SEQ ID NO: 2469336 - RNA, 13 nt, Brucella suis 1330
gcgucauaggcag

SEQ ID NO: 2469337 - RNA, 18 nt, Brucella suis 1330
gcguccgccaccgccggc

SEQ ID NO: 2469338 - RNA, 18 nt, Brucella suis 1330
gcguccuucaggccgucg

SEQ ID NO: 2469339 - RNA, 22 nt, Brucella suis 1330
gcguccuuuuuugaucucggag

SEQ ID NO: 2469340 - RNA, 14 nt, Brucella suis 1330
gcgucgagcaggcu

SEQ ID NO: 2469341 - RNA, 18 nt, Brucella suis 1330
gcgucgauacugcgggcg

SEQ ID NO: 2469342 - RNA, 15 nt, Brucella suis 1330
gcgucgauggccggu

SEQ ID NO: 2469343 - RNA, 23 nt, Brucella suis 1330
gcgucgcaccggauuugccaagc

SEQ ID NO: 2469344 - RNA, 21 nt, Brucella suis 1330
gcgucgggauggagcgcacac

SEQ ID NO: 2469345 - RNA, 17 nt, Brucella suis 1330
gcgucgucaacggcaag

SEQ ID NO: 2469346 - RNA, 21 nt, Brucella suis 1330
gcgucuguacauacaugauga

SEQ ID NO: 2469347 - RNA, 23 nt, Brucella suis 1330
gcgucuucugagaaaaaaaugcg

SEQ ID NO: 2469348 - RNA, 17 nt, Brucella suis 1330
gcgugaccagccccugc

SEQ ID NO: 2469349 - RNA, 13 nt, Brucella suis 1330
gcgugagccggcg

SEQ ID NO: 2469350 - RNA, 19 nt, Brucella suis 1330
gcgugauaggcgacacggc

SEQ ID NO: 2469351 - RNA, 22 nt, Brucella suis 1330
gcgugauaggcgacacggccga

SEQ ID NO: 2469352 - RNA, 13 nt, Brucella suis 1330
gcgugaucggccg

SEQ ID NO: 2469353 - RNA, 17 nt, Brucella suis 1330
gcgugaugagccgcuuc

SEQ ID NO: 2469354 - RNA, 15 nt, Brucella suis 1330
gcgugcggucgccgc

SEQ ID NO: 2469355 - RNA, 15 nt, Brucella suis 1330
gcguggauauuggca

SEQ ID NO: 2469356 - RNA, 20 nt, Brucella suis 1330
gcgugggaaaccgcgcggcg

SEQ ID NO: 2469357 - RNA, 13 nt, Brucella suis 1330
gcgugggcugcug

SEQ ID NO: 2469358 - RNA, 21 nt, Brucella suis 1330
gcguggggagcguuuccgggu

SEQ ID NO: 2469359 - RNA, 22 nt, Brucella suis 1330
gcguguagccgcgaaccgucgc

SEQ ID NO: 2469360 - RNA, 14 nt, Brucella suis 1330
gcguguauggcacg

SEQ ID NO: 2469361 - RNA, 16 nt, Brucella suis 1330
gcguguuugcggccuu

SEQ ID NO: 2469362 - RNA, 19 nt, Brucella suis 1330
gcguuauaagccgccucaa

SEQ ID NO: 2469363 - RNA, 18 nt, Brucella suis 1330
gcguucaacuccgucaga

SEQ ID NO: 2469364 - RNA, 16 nt, Brucella suis 1330
gcguuccagccguucc

SEQ ID NO: 2469365 - RNA, 22 nt, Brucella suis 1330
gcguucgauucgcuaucgaaac

SEQ ID NO: 2469366 - RNA, 22 nt, Brucella suis 1330
gcguucucaagagcccgccgaa

SEQ ID NO: 2469367 - RNA, 13 nt, Brucella suis 1330
gcguugaugacga

SEQ ID NO: 2469368 - RNA, 18 nt, Brucella suis 1330
gcguugcaagauccucgc

SEQ ID NO: 2469369 - RNA, 15 nt, Brucella suis 1330
gcguugccuugcugg

SEQ ID NO: 2469370 - RNA, 23 nt, Brucella suis 1330
gcguugcgcucaccaccuucgcc

SEQ ID NO: 2469371 - RNA, 17 nt, Brucella suis 1330
gcuaaaaagcgcgcgca

SEQ ID NO: 2469372 - RNA, 22 nt, Brucella suis 1330
gcuacacccagcauauggauga

SEQ ID NO: 2469373 - RNA, 14 nt, Brucella suis 1330
gcuauaagcaacag

SEQ ID NO: 2469374 - RNA, 15 nt, Brucella suis 1330
gcuauaagcggcucu

SEQ ID NO: 2469375 - RNA, 19 nt, Brucella suis 1330
gcuauagccugcgccaguu

SEQ ID NO: 2469376 - RNA, 13 nt, Brucella suis 1330
gcuauauugccgc

SEQ ID NO: 2469377 - RNA, 15 nt, Brucella suis 1330
gcuaucaacgcugca

SEQ ID NO: 2469378 - RNA, 17 nt, Brucella suis 1330
gcuaucaacgcugcaac

SEQ ID NO: 2469379 - RNA, 18 nt, Brucella suis 1330
gcuaucaacgcugcaaca

SEQ ID NO: 2469380 - RNA, 22 nt, Brucella suis 1330
gcuaucgcugcuuuaccacgau

SEQ ID NO: 2469381 - RNA, 19 nt, Brucella suis 1330
gcuaugcgcaauugcgcgc

SEQ ID NO: 2469382 - RNA, 16 nt, Brucella suis 1330
gcuauugaaugccaga

SEQ ID NO: 2469383 - RNA, 16 nt, Brucella suis 1330
gcucaaaacgauccag

SEQ ID NO: 2469384 - RNA, 21 nt, Brucella suis 1330
gcucaaggccuguuccacacc

SEQ ID NO: 2469385 - RNA, 14 nt, Brucella suis 1330
gcucaaucgccgcg

SEQ ID NO: 2469386 - RNA, 18 nt, Brucella suis 1330
gcucaccaccuucgccgu

SEQ ID NO: 2469387 - RNA, 15 nt, Brucella suis 1330
gcucaccuuuuccac

SEQ ID NO: 2469388 - RNA, 21 nt, Brucella suis 1330
gcucagagaagugagcgcaag

SEQ ID NO: 2469389 - RNA, 17 nt, Brucella suis 1330
gcucagcuucgggaagu

SEQ ID NO: 2469390 - RNA, 19 nt, Brucella suis 1330
gcucagcuuuuccaucacu

SEQ ID NO: 2469391 - RNA, 19 nt, Brucella suis 1330
gcucauauggaugccgccg

SEQ ID NO: 2469392 - RNA, 20 nt, Brucella suis 1330
gcucauauggaugccgccgc

SEQ ID NO: 2469393 - RNA, 16 nt, Brucella suis 1330
gcucaucgcaguugca

SEQ ID NO: 2469394 - RNA, 16 nt, Brucella suis 1330
gcucaucgcgcugcuc

SEQ ID NO: 2469395 - RNA, 15 nt, Brucella suis 1330
gcucauggucacgcg

SEQ ID NO: 2469396 - RNA, 18 nt, Brucella suis 1330
gcucauucggguugccuu

SEQ ID NO: 2469397 - RNA, 21 nt, Brucella suis 1330
gcucauucuguaaacugccgc

SEQ ID NO: 2469398 - RNA, 21 nt, Brucella suis 1330
gcuccacuagaucagagcggu

SEQ ID NO: 2469399 - RNA, 19 nt, Brucella suis 1330
gcuccagauugcgggcaag

SEQ ID NO: 2469400 - RNA, 19 nt, Brucella suis 1330
gcuccagccgagcgccaga

SEQ ID NO: 2469401 - RNA, 16 nt, Brucella suis 1330
gcuccagggugccguc

SEQ ID NO: 2469402 - RNA, 18 nt, Brucella suis 1330
gcuccagggugccgucgc

SEQ ID NO: 2469403 - RNA, 16 nt, Brucella suis 1330
gcucccggucuuccug

SEQ ID NO: 2469404 - RNA, 17 nt, Brucella suis 1330
gcucccggucuuccugc

SEQ ID NO: 2469405 - RNA, 23 nt, Brucella suis 1330
gcuccgaugcguuggaaaaugcg

SEQ ID NO: 2469406 - RNA, 17 nt, Brucella suis 1330
gcuccuauuucugauga

SEQ ID NO: 2469407 - RNA, 20 nt, Brucella suis 1330
gcuccucgaaauaggucagc

SEQ ID NO: 2469408 - RNA, 12 nt, Brucella suis 1330
gcuccugcaugu

SEQ ID NO: 2469409 - RNA, 18 nt, Brucella suis 1330
gcuccugcgucgcaucca

SEQ ID NO: 2469410 - RNA, 19 nt, Brucella suis 1330
gcuccugcgucgcauccag

SEQ ID NO: 2469411 - RNA, 13 nt, Brucella suis 1330
gcuccuuccugcg

SEQ ID NO: 2469412 - RNA, 20 nt, Brucella suis 1330
gcucgauaagauugcggcug

SEQ ID NO: 2469413 - RNA, 13 nt, Brucella suis 1330
gcucgaucuggcc

SEQ ID NO: 2469414 - RNA, 14 nt, Brucella suis 1330
gcucgcauagccga

SEQ ID NO: 2469415 - RNA, 19 nt, Brucella suis 1330
gcucgcgucccgcacgcag

SEQ ID NO: 2469416 - RNA, 14 nt, Brucella suis 1330
gcucgcucucgcau

SEQ ID NO: 2469417 - RNA, 18 nt, Brucella suis 1330
gcucggaguuuuucggcc

SEQ ID NO: 2469418 - RNA, 13 nt, Brucella suis 1330
gcucggcgaugaa

SEQ ID NO: 2469419 - RNA, 16 nt, Brucella suis 1330
gcucggugccgcgcgg

SEQ ID NO: 2469420 - RNA, 14 nt, Brucella suis 1330
gcucguccaugagc

SEQ ID NO: 2469421 - RNA, 17 nt, Brucella suis 1330
gcucguccggccagccg

SEQ ID NO: 2469422 - RNA, 23 nt, Brucella suis 1330
gcucgucggaaauaucgccgacg

SEQ ID NO: 2469423 - RNA, 14 nt, Brucella suis 1330
gcucuauuuuucca

SEQ ID NO: 2469424 - RNA, 14 nt, Brucella suis 1330
gcucucaaaaaggu

SEQ ID NO: 2469425 - RNA, 19 nt, Brucella suis 1330
gcucucacgcgcagcagca

SEQ ID NO: 2469426 - RNA, 13 nt, Brucella suis 1330
gcucugaaacuga

SEQ ID NO: 2469427 - RNA, 15 nt, Brucella suis 1330
gcucugcgcccaggc

SEQ ID NO: 2469428 - RNA, 15 nt, Brucella suis 1330
gcucuggaauuucua

SEQ ID NO: 2469429 - RNA, 17 nt, Brucella suis 1330
gcucuucacagcggacu

SEQ ID NO: 2469430 - RNA, 21 nt, Brucella suis 1330
gcucuuccggccguuauuccc

SEQ ID NO: 2469431 - RNA, 16 nt, Brucella suis 1330
gcucuucgcauugccg

SEQ ID NO: 2469432 - RNA, 17 nt, Brucella suis 1330
gcucuucgcauugccga

SEQ ID NO: 2469433 - RNA, 22 nt, Brucella suis 1330
gcugaaaaggcuggccaugcgg

SEQ ID NO: 2469434 - RNA, 17 nt, Brucella suis 1330
gcugacuucaaaauugg

SEQ ID NO: 2469435 - RNA, 13 nt, Brucella suis 1330
gcugagugagccu

SEQ ID NO: 2469436 - RNA, 21 nt, Brucella suis 1330
gcugaguuuuccgcuuucuuc

SEQ ID NO: 2469437 - RNA, 21 nt, Brucella suis 1330
gcugauauugugucagcgggc

SEQ ID NO: 2469438 - RNA, 16 nt, Brucella suis 1330
gcugaucgcaagcagg

SEQ ID NO: 2469439 - RNA, 20 nt, Brucella suis 1330
gcugaucggcgcaggggccg

SEQ ID NO: 2469440 - RNA, 20 nt, Brucella suis 1330
gcugaucuggaaggaaagcc

SEQ ID NO: 2469441 - RNA, 14 nt, Brucella suis 1330
gcugaugauuuccc

SEQ ID NO: 2469442 - RNA, 14 nt, Brucella suis 1330
gcugaugcggauga

SEQ ID NO: 2469443 - RNA, 15 nt, Brucella suis 1330
gcugauucuggauuu

SEQ ID NO: 2469444 - RNA, 18 nt, Brucella suis 1330
gcugauucuggauuucau

SEQ ID NO: 2469445 - RNA, 12 nt, Brucella suis 1330
gcugauuuaggc

SEQ ID NO: 2469446 - RNA, 13 nt, Brucella suis 1330
gcugauuucuucc

SEQ ID NO: 2469447 - RNA, 23 nt, Brucella suis 1330
gcugcaaagggugcaagcgcaaa

SEQ ID NO: 2469448 - RNA, 13 nt, Brucella suis 1330
gcugcaacaaaug

SEQ ID NO: 2469449 - RNA, 21 nt, Brucella suis 1330
gcugcaacaaaugcaaaugcc

SEQ ID NO: 2469450 - RNA, 13 nt, Brucella suis 1330
gcugcaauggucg

SEQ ID NO: 2469451 - RNA, 16 nt, Brucella suis 1330
gcugcaauggucgaca

SEQ ID NO: 2469452 - RNA, 15 nt, Brucella suis 1330
gcugcacacccuuga

SEQ ID NO: 2469453 - RNA, 23 nt, Brucella suis 1330
gcugcaucggcaaaucaggcagg

SEQ ID NO: 2469454 - RNA, 14 nt, Brucella suis 1330
gcugccauugccgc

SEQ ID NO: 2469455 - RNA, 16 nt, Brucella suis 1330
gcugccauugccgcga

SEQ ID NO: 2469456 - RNA, 18 nt, Brucella suis 1330
gcugccgcaauccuggug

SEQ ID NO: 2469457 - RNA, 16 nt, Brucella suis 1330
gcugccugcggugcug

SEQ ID NO: 2469458 - RNA, 20 nt, Brucella suis 1330
gcugccuuuagccaagccau

SEQ ID NO: 2469459 - RNA, 19 nt, Brucella suis 1330
gcugcgacgagaugcgcuu

SEQ ID NO: 2469460 - RNA, 15 nt, Brucella suis 1330
gcugcgcgaaccaga

SEQ ID NO: 2469461 - RNA, 17 nt, Brucella suis 1330
gcugcgcggcauuggug

SEQ ID NO: 2469462 - RNA, 23 nt, Brucella suis 1330
gcugcggaucuucgaucauuucc

SEQ ID NO: 2469463 - RNA, 16 nt, Brucella suis 1330
gcugcggccaugcgca

SEQ ID NO: 2469464 - RNA, 16 nt, Brucella suis 1330
gcugcgugggaaaccg

SEQ ID NO: 2469465 - RNA, 14 nt, Brucella suis 1330
gcugcguuucggcg

SEQ ID NO: 2469466 - RNA, 17 nt, Brucella suis 1330
gcugcguuucggcggcu

SEQ ID NO: 2469467 - RNA, 22 nt, Brucella suis 1330
gcugcucaucaucacauuggug

SEQ ID NO: 2469468 - RNA, 21 nt, Brucella suis 1330
gcugcugauagcagccgcuuc

SEQ ID NO: 2469469 - RNA, 18 nt, Brucella suis 1330
gcugcugcacuugcgcca

SEQ ID NO: 2469470 - RNA, 17 nt, Brucella suis 1330
gcugcugcgugcugcuu

SEQ ID NO: 2469471 - RNA, 15 nt, Brucella suis 1330
gcuggaaccagcgug

SEQ ID NO: 2469472 - RNA, 23 nt, Brucella suis 1330
gcuggaacgagcuccccggcggg

SEQ ID NO: 2469473 - RNA, 19 nt, Brucella suis 1330
gcuggaacuggcgcauggc

SEQ ID NO: 2469474 - RNA, 14 nt, Brucella suis 1330
gcuggaugaucuuu

SEQ ID NO: 2469475 - RNA, 18 nt, Brucella suis 1330
gcuggaugucgauuucac

SEQ ID NO: 2469476 - RNA, 17 nt, Brucella suis 1330
gcuggauuaugcucuua

SEQ ID NO: 2469477 - RNA, 16 nt, Brucella suis 1330
gcuggcagcggcagga

SEQ ID NO: 2469478 - RNA, 13 nt, Brucella suis 1330
gcuggcauccagc

SEQ ID NO: 2469479 - RNA, 23 nt, Brucella suis 1330
gcuggcauccagcacuuccagau

SEQ ID NO: 2469480 - RNA, 13 nt, Brucella suis 1330
gcuggccaccaga

SEQ ID NO: 2469481 - RNA, 15 nt, Brucella suis 1330
gcuggccaccagaaa

SEQ ID NO: 2469482 - RNA, 19 nt, Brucella suis 1330
gcuggccaugaugccgguc

SEQ ID NO: 2469483 - RNA, 12 nt, Brucella suis 1330
gcuggcgcgcug

SEQ ID NO: 2469484 - RNA, 14 nt, Brucella suis 1330
gcuggcgcggcgga

SEQ ID NO: 2469485 - RNA, 23 nt, Brucella suis 1330
gcuggcuccagucgaggcagcca

SEQ ID NO: 2469486 - RNA, 21 nt, Brucella suis 1330
gcuggcuucucuugccgccgc

SEQ ID NO: 2469487 - RNA, 16 nt, Brucella suis 1330
gcugguaauagcccgg

SEQ ID NO: 2469488 - RNA, 14 nt, Brucella suis 1330
gcugguccauacgg

SEQ ID NO: 2469489 - RNA, 18 nt, Brucella suis 1330
gcuggucuggcgaggcgc

SEQ ID NO: 2469490 - RNA, 23 nt, Brucella suis 1330
gcuggucuggcgaggcgcugaug

SEQ ID NO: 2469491 - RNA, 13 nt, Brucella suis 1330
gcugguuuuucac

SEQ ID NO: 2469492 - RNA, 18 nt, Brucella suis 1330
gcuguaaccgccaccuuc

SEQ ID NO: 2469493 - RNA, 13 nt, Brucella suis 1330
gcuguccgagagc

SEQ ID NO: 2469494 - RNA, 14 nt, Brucella suis 1330
gcugucgaaugucu

SEQ ID NO: 2469495 - RNA, 15 nt, Brucella suis 1330
gcugucgccagcgcc

SEQ ID NO: 2469496 - RNA, 19 nt, Brucella suis 1330
gcugucgccagcgccgguc

SEQ ID NO: 2469497 - RNA, 16 nt, Brucella suis 1330
gcugucgcgcccgcaa

SEQ ID NO: 2469498 - RNA, 22 nt, Brucella suis 1330
gcugucgcgcccgcaaaucguc

SEQ ID NO: 2469499 - RNA, 16 nt, Brucella suis 1330
gcuuaacccaaccacc

SEQ ID NO: 2469500 - RNA, 16 nt, Brucella suis 1330
gcuuaugugaagauuu

SEQ ID NO: 2469501 - RNA, 16 nt, Brucella suis 1330
gcuucaaaggccugau

SEQ ID NO: 2469502 - RNA, 23 nt, Brucella suis 1330
gcuucaaaggccugauauucggc

SEQ ID NO: 2469503 - RNA, 17 nt, Brucella suis 1330
gcuucaacgccguggcg

SEQ ID NO: 2469504 - RNA, 23 nt, Brucella suis 1330
gcuucaacgccguggcggcuggc

SEQ ID NO: 2469505 - RNA, 14 nt, Brucella suis 1330
gcuucaaucaggau

SEQ ID NO: 2469506 - RNA, 19 nt, Brucella suis 1330
gcuucacaugcuugccgac

SEQ ID NO: 2469507 - RNA, 20 nt, Brucella suis 1330
gcuucacgcggcugcucgac

SEQ ID NO: 2469508 - RNA, 21 nt, Brucella suis 1330
gcuucaggcacucuccucugc

SEQ ID NO: 2469509 - RNA, 22 nt, Brucella suis 1330
gcuucaggcacucuccucugcc

SEQ ID NO: 2469510 - RNA, 15 nt, Brucella suis 1330
gcuucaggucggcau

SEQ ID NO: 2469511 - RNA, 19 nt, Brucella suis 1330
gcuucagucuggauuccuu

SEQ ID NO: 2469512 - RNA, 19 nt, Brucella suis 1330
gcuucauaucguugccgau

SEQ ID NO: 2469513 - RNA, 18 nt, Brucella suis 1330
gcuucaucgcggcagccg

SEQ ID NO: 2469514 - RNA, 20 nt, Brucella suis 1330
gcuuccacgcggauaucggc

SEQ ID NO: 2469515 - RNA, 11 nt, Brucella suis 1330
gcuuccagcau

SEQ ID NO: 2469516 - RNA, 12 nt, Brucella suis 1330
gcuuccagcauc

SEQ ID NO: 2469517 - RNA, 13 nt, Brucella suis 1330
gcuuccaugccca

SEQ ID NO: 2469518 - RNA, 15 nt, Brucella suis 1330
gcuuccggcguggug

SEQ ID NO: 2469519 - RNA, 12 nt, Brucella suis 1330
gcuuccggcugc

SEQ ID NO: 2469520 - RNA, 18 nt, Brucella suis 1330
gcuuccguaucuccgggc

SEQ ID NO: 2469521 - RNA, 13 nt, Brucella suis 1330
gcuucgagcgccu

SEQ ID NO: 2469522 - RNA, 19 nt, Brucella suis 1330
gcuucgaucguuucgccau

SEQ ID NO: 2469523 - RNA, 23 nt, Brucella suis 1330
gcuucgaucguuucgccaugcuc

SEQ ID NO: 2469524 - RNA, 15 nt, Brucella suis 1330
gcuucgcacuuuugc

SEQ ID NO: 2469525 - RNA, 16 nt, Brucella suis 1330
gcuucgcacuuuugcu

SEQ ID NO: 2469526 - RNA, 23 nt, Brucella suis 1330
gcuucgccgccauggucgcgcac

SEQ ID NO: 2469527 - RNA, 14 nt, Brucella suis 1330
gcuucgcgcaggcc

SEQ ID NO: 2469528 - RNA, 19 nt, Brucella suis 1330
gcuucgcuccgcaccucag

SEQ ID NO: 2469529 - RNA, 15 nt, Brucella suis 1330
gcuucgcuucgcucc

SEQ ID NO: 2469530 - RNA, 19 nt, Brucella suis 1330
gcuucucccaaagcgggcg

SEQ ID NO: 2469531 - RNA, 21 nt, Brucella suis 1330
gcuucugcucaccaaaaggcg

SEQ ID NO: 2469532 - RNA, 20 nt, Brucella suis 1330
gcuugaaauaaucgagaucg

SEQ ID NO: 2469533 - RNA, 20 nt, Brucella suis 1330
gcuugacgaucuuuucggcg

SEQ ID NO: 2469534 - RNA, 22 nt, Brucella suis 1330
gcuugagaaccgaacgcgccuu

SEQ ID NO: 2469535 - RNA, 21 nt, Brucella suis 1330
gcuugagcgucaggccgauga

SEQ ID NO: 2469536 - RNA, 20 nt, Brucella suis 1330
gcuugagcguuacuucggcg

SEQ ID NO: 2469537 - RNA, 18 nt, Brucella suis 1330
gcuugaggaucgucugac

SEQ ID NO: 2469538 - RNA, 18 nt, Brucella suis 1330
gcuugaucgccgcacggc

SEQ ID NO: 2469539 - RNA, 21 nt, Brucella suis 1330
gcuugaugacgccaucuucuu

SEQ ID NO: 2469540 - RNA, 13 nt, Brucella suis 1330
gcuugcaaugagc

SEQ ID NO: 2469541 - RNA, 12 nt, Brucella suis 1330
gcuugcauucca

SEQ ID NO: 2469542 - RNA, 17 nt, Brucella suis 1330
gcuugccagaugugcca

SEQ ID NO: 2469543 - RNA, 19 nt, Brucella suis 1330
gcuugccauucuccgcagc

SEQ ID NO: 2469544 - RNA, 14 nt, Brucella suis 1330
gcuugcccgcgcca

SEQ ID NO: 2469545 - RNA, 17 nt, Brucella suis 1330
gcuugccuuuuggccgc

SEQ ID NO: 2469546 - RNA, 19 nt, Brucella suis 1330
gcuugcgaugauauucggc

SEQ ID NO: 2469547 - RNA, 23 nt, Brucella suis 1330
gcuugcuugagggguucggcguc

SEQ ID NO: 2469548 - RNA, 23 nt, Brucella suis 1330
gcuuggauacgucacccgccuug

SEQ ID NO: 2469549 - RNA, 16 nt, Brucella suis 1330
gcuuggccucuuccag

SEQ ID NO: 2469550 - RNA, 20 nt, Brucella suis 1330
gcuuuaaaagcauauugaag

SEQ ID NO: 2469551 - RNA, 23 nt, Brucella suis 1330
gcuuuauccgcaauacgccuggc

SEQ ID NO: 2469552 - RNA, 16 nt, Brucella suis 1330
gcuuuauucaaccguu

SEQ ID NO: 2469553 - RNA, 15 nt, Brucella suis 1330
gcuuucaauggccgc

SEQ ID NO: 2469554 - RNA, 19 nt, Brucella suis 1330
gcuuuccauggucaggcca

SEQ ID NO: 2469555 - RNA, 21 nt, Brucella suis 1330
gcuuucccggcuuuuuauccu

SEQ ID NO: 2469556 - RNA, 19 nt, Brucella suis 1330
gcuuuccgacagggcaagc

SEQ ID NO: 2469557 - RNA, 23 nt, Brucella suis 1330
gcuuuccgcaucgcaauagacca

SEQ ID NO: 2469558 - RNA, 16 nt, Brucella suis 1330
gcuuuccggcaaaaaa

SEQ ID NO: 2469559 - RNA, 18 nt, Brucella suis 1330
gcuuucgcgggcgugccu

SEQ ID NO: 2469560 - RNA, 20 nt, Brucella suis 1330
gcuuucggcggcaguuucac

SEQ ID NO: 2469561 - RNA, 15 nt, Brucella suis 1330
gcuuugaccgccgcg

SEQ ID NO: 2469562 - RNA, 14 nt, Brucella suis 1330
gcuuugaugcguug

SEQ ID NO: 2469563 - RNA, 14 nt, Brucella suis 1330
gcuuugcccuugcg

SEQ ID NO: 2469564 - RNA, 20 nt, Brucella suis 1330
gcuuugcccuugcgaauggc

SEQ ID NO: 2469565 - RNA, 14 nt, Brucella suis 1330
gcuuuguauuucaa

SEQ ID NO: 2469566 - RNA, 17 nt, Brucella suis 1330
gcuuuguauuucaaugc

SEQ ID NO: 2469567 - RNA, 19 nt, Brucella suis 1330
gcuuuucacgcgagcgcag

SEQ ID NO: 2469568 - RNA, 13 nt, Brucella suis 1330
gcuuuuccaucac

SEQ ID NO: 2469569 - RNA, 21 nt, Brucella suis 1330
gcuuuuguuucaagcucccaa

SEQ ID NO: 2469570 - RNA, 16 nt, Brucella suis 1330
gcuuuuuauccuccca

SEQ ID NO: 2469571 - RNA, 19 nt, Brucella suis 1330
gcuuuuuucgauugaaaaa

SEQ ID NO: 2469572 - RNA, 20 nt, Brucella suis 1330
ggaaaagcuggcauccagca

SEQ ID NO: 2469573 - RNA, 15 nt, Brucella suis 1330
ggaaacgauuuucgc

SEQ ID NO: 2469574 - RNA, 23 nt, Brucella suis 1330
ggaaacgauuuucgccagacgcg

SEQ ID NO: 2469575 - RNA, 16 nt, Brucella suis 1330
ggaaacgggaaagggc

SEQ ID NO: 2469576 - RNA, 21 nt, Brucella suis 1330
ggaaagaguuggcccgcgugc

SEQ ID NO: 2469577 - RNA, 12 nt, Brucella suis 1330
ggaaagauccuu

SEQ ID NO: 2469578 - RNA, 23 nt, Brucella suis 1330
ggaaagaucugcaucccgaaaag

SEQ ID NO: 2469579 - RNA, 22 nt, Brucella suis 1330
ggaaagcccaguucguggcggg

SEQ ID NO: 2469580 - RNA, 18 nt, Brucella suis 1330
ggaaaggucuuccgggac

SEQ ID NO: 2469581 - RNA, 17 nt, Brucella suis 1330
ggaaauaucgccgacga

SEQ ID NO: 2469582 - RNA, 18 nt, Brucella suis 1330
ggaaauauucgggcggca

SEQ ID NO: 2469583 - RNA, 18 nt, Brucella suis 1330
ggaaaucaguccacugga

SEQ ID NO: 2469584 - RNA, 20 nt, Brucella suis 1330
ggaaauuauagccgccaagc

SEQ ID NO: 2469585 - RNA, 20 nt, Brucella suis 1330
ggaaauucccgcccgugagg

SEQ ID NO: 2469586 - RNA, 19 nt, Brucella suis 1330
ggaacaauaggcgcgggca

SEQ ID NO: 2469587 - RNA, 20 nt, Brucella suis 1330
ggaacaggcagcaugaacca

SEQ ID NO: 2469588 - RNA, 23 nt, Brucella suis 1330
ggaacauauaaagcaaaggcccc

SEQ ID NO: 2469589 - RNA, 22 nt, Brucella suis 1330
ggaaccgaccugcuucuugccu

SEQ ID NO: 2469590 - RNA, 14 nt, Brucella suis 1330
ggaacgagcucccc

SEQ ID NO: 2469591 - RNA, 22 nt, Brucella suis 1330
ggaacgcggccuugucgauccc

SEQ ID NO: 2469592 - RNA, 19 nt, Brucella suis 1330
ggaacugcggaucggcuuc

SEQ ID NO: 2469593 - RNA, 17 nt, Brucella suis 1330
ggaagagaaucuugccc

SEQ ID NO: 2469594 - RNA, 17 nt, Brucella suis 1330
ggaaggcgagcaggccg

SEQ ID NO: 2469595 - RNA, 14 nt, Brucella suis 1330
ggaagggaaagcgg

SEQ ID NO: 2469596 - RNA, 21 nt, Brucella suis 1330
ggaauaccaagcucguuccag

SEQ ID NO: 2469597 - RNA, 23 nt, Brucella suis 1330
ggaauauagccgaugcagaugcc

SEQ ID NO: 2469598 - RNA, 21 nt, Brucella suis 1330
ggaaucugccuugucagaagc

SEQ ID NO: 2469599 - RNA, 24 nt, Brucella suis 1330
ggaaugacauggaaaugcagguga

SEQ ID NO: 2469600 - RNA, 18 nt, Brucella suis 1330
ggaaugcggggcuuuuca

SEQ ID NO: 2469601 - RNA, 23 nt, Brucella suis 1330
ggaauuccugaaccacuuccgaa

SEQ ID NO: 2469602 - RNA, 16 nt, Brucella suis 1330
ggacauaaaccgauga

SEQ ID NO: 2469603 - RNA, 17 nt, Brucella suis 1330
ggaccacgaacgacacc

SEQ ID NO: 2469604 - RNA, 14 nt, Brucella suis 1330
ggaccauaaaucag

SEQ ID NO: 2469605 - RNA, 19 nt, Brucella suis 1330
ggaccgcgaggaagccugc

SEQ ID NO: 2469606 - RNA, 15 nt, Brucella suis 1330
ggacgccugccaucc

SEQ ID NO: 2469607 - RNA, 20 nt, Brucella suis 1330
ggacgcgcagauauggcgcc

SEQ ID NO: 2469608 - RNA, 21 nt, Brucella suis 1330
ggacgcgugaaaauagcuggg

SEQ ID NO: 2469609 - RNA, 23 nt, Brucella suis 1330
ggacggccgauuuucugcugcgg

SEQ ID NO: 2469610 - RNA, 15 nt, Brucella suis 1330
ggacgggcaggcaga

SEQ ID NO: 2469611 - RNA, 16 nt, Brucella suis 1330
ggacuauuuccaucgc

SEQ ID NO: 2469612 - RNA, 15 nt, Brucella suis 1330
ggacugauuuccgcu

SEQ ID NO: 2469613 - RNA, 16 nt, Brucella suis 1330
ggacuucuucaccagc

SEQ ID NO: 2469614 - RNA, 18 nt, Brucella suis 1330
ggagaaaagaugggcgca

SEQ ID NO: 2469615 - RNA, 15 nt, Brucella suis 1330
ggagagaggaagcaa

SEQ ID NO: 2469616 - RNA, 17 nt, Brucella suis 1330
ggagagaggaagcaaga

SEQ ID NO: 2469617 - RNA, 21 nt, Brucella suis 1330
ggagagcaugaucgcccgccc

SEQ ID NO: 2469618 - RNA, 21 nt, Brucella suis 1330
ggagcaccgcccgucccccaa

SEQ ID NO: 2469619 - RNA, 12 nt, Brucella suis 1330
ggagcaggccau

SEQ ID NO: 2469620 - RNA, 16 nt, Brucella suis 1330
ggagccggacgugaca

SEQ ID NO: 2469621 - RNA, 21 nt, Brucella suis 1330
ggagccuucauugcggccaag

SEQ ID NO: 2469622 - RNA, 19 nt, Brucella suis 1330
ggagcgcacaccgaacugg

SEQ ID NO: 2469623 - RNA, 22 nt, Brucella suis 1330
ggagcgcagaucggcgagcgcc

SEQ ID NO: 2469624 - RNA, 21 nt, Brucella suis 1330
ggagcgcauccgccugcgcau

SEQ ID NO: 2469625 - RNA, 11 nt, Brucella suis 1330
ggagcggcaca

SEQ ID NO: 2469626 - RNA, 13 nt, Brucella suis 1330
ggagcggccggau

SEQ ID NO: 2469627 - RNA, 19 nt, Brucella suis 1330
ggaggcauccuugucggca

SEQ ID NO: 2469628 - RNA, 14 nt, Brucella suis 1330
ggaggcggcugccu

SEQ ID NO: 2469629 - RNA, 13 nt, Brucella suis 1330
ggauagauggaaa

SEQ ID NO: 2469630 - RNA, 17 nt, Brucella suis 1330
ggauagcguaaaacgca

SEQ ID NO: 2469631 - RNA, 18 nt, Brucella suis 1330
ggauaguucaaggcugcu

SEQ ID NO: 2469632 - RNA, 15 nt, Brucella suis 1330
ggaucaaaccggcca

SEQ ID NO: 2469633 - RNA, 17 nt, Brucella suis 1330
ggaucagcuugccgcca

SEQ ID NO: 2469634 - RNA, 20 nt, Brucella suis 1330
ggaucagugcgcacauuguc

SEQ ID NO: 2469635 - RNA, 15 nt, Brucella suis 1330
ggaucauccauuccu

SEQ ID NO: 2469636 - RNA, 21 nt, Brucella suis 1330
ggaucauccuugaugcccagc

SEQ ID NO: 2469637 - RNA, 22 nt, Brucella suis 1330
ggaucauccuugaugcccagcu

SEQ ID NO: 2469638 - RNA, 15 nt, Brucella suis 1330
ggaucgaccgaacgg

SEQ ID NO: 2469639 - RNA, 14 nt, Brucella suis 1330
ggaucggaaacgcg

SEQ ID NO: 2469640 - RNA, 17 nt, Brucella suis 1330
ggaucgugagguucuug

SEQ ID NO: 2469641 - RNA, 14 nt, Brucella suis 1330
ggaucguguagaac

SEQ ID NO: 2469642 - RNA, 21 nt, Brucella suis 1330
ggaucugguacugcguaccgg

SEQ ID NO: 2469643 - RNA, 14 nt, Brucella suis 1330
ggaugacgccgcuu

SEQ ID NO: 2469644 - RNA, 22 nt, Brucella suis 1330
ggaugacuucgguuuccacauc

SEQ ID NO: 2469645 - RNA, 11 nt, Brucella suis 1330
ggaugagggag

SEQ ID NO: 2469646 - RNA, 15 nt, Brucella suis 1330
ggaugaugcuuuauu

SEQ ID NO: 2469647 - RNA, 13 nt, Brucella suis 1330
ggaugcgcggcgc

SEQ ID NO: 2469648 - RNA, 19 nt, Brucella suis 1330
ggaugcgcggcgccagcgc

SEQ ID NO: 2469649 - RNA, 16 nt, Brucella suis 1330
ggaugcugccagcagc

SEQ ID NO: 2469650 - RNA, 16 nt, Brucella suis 1330
ggaugucgauuucacc

SEQ ID NO: 2469651 - RNA, 16 nt, Brucella suis 1330
ggaugugucggccaga

SEQ ID NO: 2469652 - RNA, 20 nt, Brucella suis 1330
ggauuaugcucuuaaaaugc

SEQ ID NO: 2469653 - RNA, 18 nt, Brucella suis 1330
ggauucuccuauugccag

SEQ ID NO: 2469654 - RNA, 15 nt, Brucella suis 1330
ggauucuuaugccag

SEQ ID NO: 2469655 - RNA, 17 nt, Brucella suis 1330
ggauugcgcaagugcug

SEQ ID NO: 2469656 - RNA, 12 nt, Brucella suis 1330
ggauuucaucca

SEQ ID NO: 2469657 - RNA, 17 nt, Brucella suis 1330
ggauuugcccgguuuuc

SEQ ID NO: 2469658 - RNA, 12 nt, Brucella suis 1330
ggcaaaaagcgg

SEQ ID NO: 2469659 - RNA, 20 nt, Brucella suis 1330
ggcaaagccgaaugccagug

SEQ ID NO: 2469660 - RNA, 20 nt, Brucella suis 1330
ggcaaagcggaucagcgcgc

SEQ ID NO: 2469661 - RNA, 14 nt, Brucella suis 1330
ggcaacaucgccuu

SEQ ID NO: 2469662 - RNA, 14 nt, Brucella suis 1330
ggcaagcagcaaaa

SEQ ID NO: 2469663 - RNA, 14 nt, Brucella suis 1330
ggcaagcaggcgca

SEQ ID NO: 2469664 - RNA, 18 nt, Brucella suis 1330
ggcaagccccagcacgaa

SEQ ID NO: 2469665 - RNA, 15 nt, Brucella suis 1330
ggcaagcgccugcug

SEQ ID NO: 2469666 - RNA, 14 nt, Brucella suis 1330
ggcaagcuggaagg

SEQ ID NO: 2469667 - RNA, 18 nt, Brucella suis 1330
ggcaaggccgcgcuccag

SEQ ID NO: 2469668 - RNA, 13 nt, Brucella suis 1330
ggcaauaugcgcc

SEQ ID NO: 2469669 - RNA, 16 nt, Brucella suis 1330
ggcaauccccggacca

SEQ ID NO: 2469670 - RNA, 16 nt, Brucella suis 1330
ggcaaucguguccaca

SEQ ID NO: 2469671 - RNA, 17 nt, Brucella suis 1330
ggcaaucuugaccuggc

SEQ ID NO: 2469672 - RNA, 20 nt, Brucella suis 1330
ggcaaucuugaccuggccag

SEQ ID NO: 2469673 - RNA, 15 nt, Brucella suis 1330
ggcaauggccgcaug

SEQ ID NO: 2469674 - RNA, 20 nt, Brucella suis 1330
ggcaauggcgggccauuucc

SEQ ID NO: 2469675 - RNA, 16 nt, Brucella suis 1330
ggcaaugucgcaaagc

SEQ ID NO: 2469676 - RNA, 19 nt, Brucella suis 1330
ggcacaagaacagccgccc

SEQ ID NO: 2469677 - RNA, 21 nt, Brucella suis 1330
ggcacaagcuugauaaggccg

SEQ ID NO: 2469678 - RNA, 20 nt, Brucella suis 1330
ggcaccaugcggcuccaguu

SEQ ID NO: 2469679 - RNA, 19 nt, Brucella suis 1330
ggcacccacugcccgccuu

SEQ ID NO: 2469680 - RNA, 16 nt, Brucella suis 1330
ggcaccggccuugaug

SEQ ID NO: 2469681 - RNA, 20 nt, Brucella suis 1330
ggcacgcucgauccgcuugc

SEQ ID NO: 2469682 - RNA, 16 nt, Brucella suis 1330
ggcagaccccaucagc

SEQ ID NO: 2469683 - RNA, 17 nt, Brucella suis 1330
ggcagacgaaaauaucg

SEQ ID NO: 2469684 - RNA, 17 nt, Brucella suis 1330
ggcagacgugaccgccu

SEQ ID NO: 2469685 - RNA, 20 nt, Brucella suis 1330
ggcagauagagguaggacug

SEQ ID NO: 2469686 - RNA, 18 nt, Brucella suis 1330
ggcagcacugaaacggga

SEQ ID NO: 2469687 - RNA, 17 nt, Brucella suis 1330
ggcagccgugagcaugg

SEQ ID NO: 2469688 - RNA, 19 nt, Brucella suis 1330
ggcagccucgacacgccgg

SEQ ID NO: 2469689 - RNA, 17 nt, Brucella suis 1330
ggcagccuucgcugccg

SEQ ID NO: 2469690 - RNA, 18 nt, Brucella suis 1330
ggcagccuucgcugccgg

SEQ ID NO: 2469691 - RNA, 15 nt, Brucella suis 1330
ggcagcgcgguuuuu

SEQ ID NO: 2469692 - RNA, 17 nt, Brucella suis 1330
ggcagcggcgugccggg

SEQ ID NO: 2469693 - RNA, 17 nt, Brucella suis 1330
ggcaggaggccaaaaag

SEQ ID NO: 2469694 - RNA, 14 nt, Brucella suis 1330
ggcaggccgccugg

SEQ ID NO: 2469695 - RNA, 16 nt, Brucella suis 1330
ggcaggccgccuggga

SEQ ID NO: 2469696 - RNA, 17 nt, Brucella suis 1330
ggcaggggugcaaagcu

SEQ ID NO: 2469697 - RNA, 15 nt, Brucella suis 1330
ggcaguagggcagua

SEQ ID NO: 2469698 - RNA, 14 nt, Brucella suis 1330
ggcagugcgagcgu

SEQ ID NO: 2469699 - RNA, 21 nt, Brucella suis 1330
ggcaguucaaugggcggggcu

SEQ ID NO: 2469700 - RNA, 14 nt, Brucella suis 1330
ggcauaaaugcccu

SEQ ID NO: 2469701 - RNA, 20 nt, Brucella suis 1330
ggcauaauaggcaucggccu

SEQ ID NO: 2469702 - RNA, 11 nt, Brucella suis 1330
ggcaucaaacu

SEQ ID NO: 2469703 - RNA, 16 nt, Brucella suis 1330
ggcaucaaaggagcau

SEQ ID NO: 2469704 - RNA, 15 nt, Brucella suis 1330
ggcaucagccucccu

SEQ ID NO: 2469705 - RNA, 18 nt, Brucella suis 1330
ggcauccacucggcggca

SEQ ID NO: 2469706 - RNA, 15 nt, Brucella suis 1330
ggcauccgaggcgcg

SEQ ID NO: 2469707 - RNA, 16 nt, Brucella suis 1330
ggcauccuugccgguu

SEQ ID NO: 2469708 - RNA, 15 nt, Brucella suis 1330
ggcaucgcggaucgu

SEQ ID NO: 2469709 - RNA, 22 nt, Brucella suis 1330
ggcaugaacaguuugagcauga

SEQ ID NO: 2469710 - RNA, 12 nt, Brucella suis 1330
ggcauggaagcc

SEQ ID NO: 2469711 - RNA, 18 nt, Brucella suis 1330
ggcauggauggaauaucg

SEQ ID NO: 2469712 - RNA, 19 nt, Brucella suis 1330
ggcauggcguagaaauagg

SEQ ID NO: 2469713 - RNA, 21 nt, Brucella suis 1330
ggcaugggcaacccggcggcc

SEQ ID NO: 2469714 - RNA, 23 nt, Brucella suis 1330
ggcaugggcaacccggcggccuu

SEQ ID NO: 2469715 - RNA, 14 nt, Brucella suis 1330
ggcauuauccgcau

SEQ ID NO: 2469716 - RNA, 19 nt, Brucella suis 1330
ggcauugaggaucgaccag

SEQ ID NO: 2469717 - RNA, 18 nt, Brucella suis 1330
ggcauugcccauggacuu

SEQ ID NO: 2469718 - RNA, 18 nt, Brucella suis 1330
ggcauugcgaagcgacuc

SEQ ID NO: 2469719 - RNA, 22 nt, Brucella suis 1330
ggccaaaggcggcuaugcgcaa

SEQ ID NO: 2469720 - RNA, 15 nt, Brucella suis 1330
ggccaacucuuuccu

SEQ ID NO: 2469721 - RNA, 22 nt, Brucella suis 1330
ggccaagcgcaucgguggcauu

SEQ ID NO: 2469722 - RNA, 14 nt, Brucella suis 1330
ggccacaagcgccg

SEQ ID NO: 2469723 - RNA, 17 nt, Brucella suis 1330
ggccacaagcgccgguu

SEQ ID NO: 2469724 - RNA, 20 nt, Brucella suis 1330
ggccacccagcccgaagacc

SEQ ID NO: 2469725 - RNA, 21 nt, Brucella suis 1330
ggccaccguuucggguggccu

SEQ ID NO: 2469726 - RNA, 13 nt, Brucella suis 1330
ggccacgaaaugg

SEQ ID NO: 2469727 - RNA, 14 nt, Brucella suis 1330
ggccacgacagggc

SEQ ID NO: 2469728 - RNA, 16 nt, Brucella suis 1330
ggccacgacagggcgc

SEQ ID NO: 2469729 - RNA, 20 nt, Brucella suis 1330
ggccacgcacggucuugccg

SEQ ID NO: 2469730 - RNA, 21 nt, Brucella suis 1330
ggccacgcgcagaagauaauc

SEQ ID NO: 2469731 - RNA, 13 nt, Brucella suis 1330
ggccacggcaucc

SEQ ID NO: 2469732 - RNA, 16 nt, Brucella suis 1330
ggccacuccguugccg

SEQ ID NO: 2469733 - RNA, 20 nt, Brucella suis 1330
ggccagacauagaccucauu

SEQ ID NO: 2469734 - RNA, 18 nt, Brucella suis 1330
ggccagaucgcgcgcggc

SEQ ID NO: 2469735 - RNA, 19 nt, Brucella suis 1330
ggccagaucgcgcgcggcc

SEQ ID NO: 2469736 - RNA, 21 nt, Brucella suis 1330
ggccagcuugaaaagccguga

SEQ ID NO: 2469737 - RNA, 13 nt, Brucella suis 1330
ggccaggaaaacg

SEQ ID NO: 2469738 - RNA, 16 nt, Brucella suis 1330
ggccaguucagcggcg

SEQ ID NO: 2469739 - RNA, 15 nt, Brucella suis 1330
ggccaugaugccgac

SEQ ID NO: 2469740 - RNA, 21 nt, Brucella suis 1330
ggccaugaugccgacaagcag

SEQ ID NO: 2469741 - RNA, 23 nt, Brucella suis 1330
ggccauugcccaaaagcgcgccg

SEQ ID NO: 2469742 - RNA, 21 nt, Brucella suis 1330
ggccauuucauuaucggcggc

SEQ ID NO: 2469743 - RNA, 14 nt, Brucella suis 1330
ggcccaaaggccgc

SEQ ID NO: 2469744 - RNA, 17 nt, Brucella suis 1330
ggcccaaaggccgcgcc

SEQ ID NO: 2469745 - RNA, 15 nt, Brucella suis 1330
ggcccacccaccgcc

SEQ ID NO: 2469746 - RNA, 16 nt, Brucella suis 1330
ggccccaucggguguu

SEQ ID NO: 2469747 - RNA, 20 nt, Brucella suis 1330
ggcccgcgcaagcgggccuu

SEQ ID NO: 2469748 - RNA, 20 nt, Brucella suis 1330
ggcccgcgugcacgcgcaga

SEQ ID NO: 2469749 - RNA, 18 nt, Brucella suis 1330
ggcccgcgugugacggau

SEQ ID NO: 2469750 - RNA, 18 nt, Brucella suis 1330
ggcccgguccgcgcucgu

SEQ ID NO: 2469751 - RNA, 16 nt, Brucella suis 1330
ggcccggugcagcggc

SEQ ID NO: 2469752 - RNA, 19 nt, Brucella suis 1330
ggcccugucagcgaaacca

SEQ ID NO: 2469753 - RNA, 15 nt, Brucella suis 1330
ggcccuucgcuuuca

SEQ ID NO: 2469754 - RNA, 17 nt, Brucella suis 1330
ggcccuugucgcgcaac

SEQ ID NO: 2469755 - RNA, 14 nt, Brucella suis 1330
ggccgaaaauauca

SEQ ID NO: 2469756 - RNA, 19 nt, Brucella suis 1330
ggccgaaauagcggcccga

SEQ ID NO: 2469757 - RNA, 15 nt, Brucella suis 1330
ggccgaagccgaugc

SEQ ID NO: 2469758 - RNA, 20 nt, Brucella suis 1330
ggccgaagccgaugcgcuga

SEQ ID NO: 2469759 - RNA, 14 nt, Brucella suis 1330
ggccgaagccgcuu

SEQ ID NO: 2469760 - RNA, 20 nt, Brucella suis 1330
ggccgaaggaugcaagccgg

SEQ ID NO: 2469761 - RNA, 13 nt, Brucella suis 1330
ggccgaaucgcga

SEQ ID NO: 2469762 - RNA, 15 nt, Brucella suis 1330
ggccgagcgccgccg

SEQ ID NO: 2469763 - RNA, 16 nt, Brucella suis 1330
ggccgauccugcgccc

SEQ ID NO: 2469764 - RNA, 12 nt, Brucella suis 1330
ggccgaucgcca

SEQ ID NO: 2469765 - RNA, 16 nt, Brucella suis 1330
ggccgaugacggcgcg

SEQ ID NO: 2469766 - RNA, 20 nt, Brucella suis 1330
ggccgaugacggcgcggcgc

SEQ ID NO: 2469767 - RNA, 12 nt, Brucella suis 1330
ggccgaugccga

SEQ ID NO: 2469768 - RNA, 17 nt, Brucella suis 1330
ggccgcagugagcagaa

SEQ ID NO: 2469769 - RNA, 23 nt, Brucella suis 1330
ggccgcggcaucccugucgccga

SEQ ID NO: 2469770 - RNA, 15 nt, Brucella suis 1330
ggccgcuaugcgguu

SEQ ID NO: 2469771 - RNA, 22 nt, Brucella suis 1330
ggccgcucaaggccuguuccac

SEQ ID NO: 2469772 - RNA, 23 nt, Brucella suis 1330
ggccgcucgcugcggcgaugggc

SEQ ID NO: 2469773 - RNA, 21 nt, Brucella suis 1330
ggccgcucuucggggcggccu

SEQ ID NO: 2469774 - RNA, 16 nt, Brucella suis 1330
ggccgcugccugcaca

SEQ ID NO: 2469775 - RNA, 12 nt, Brucella suis 1330
ggccggcagcgg

SEQ ID NO: 2469776 - RNA, 15 nt, Brucella suis 1330
ggccggcagcgguuc

SEQ ID NO: 2469777 - RNA, 18 nt, Brucella suis 1330
ggccgggccaacgccggc

SEQ ID NO: 2469778 - RNA, 17 nt, Brucella suis 1330
ggccgguaagcccuguc

SEQ ID NO: 2469779 - RNA, 10 nt, Brucella suis 1330
ggccggugcg

SEQ ID NO: 2469780 - RNA, 15 nt, Brucella suis 1330
ggccgguuucccggc

SEQ ID NO: 2469781 - RNA, 20 nt, Brucella suis 1330
ggccgucccggaagccgccu

SEQ ID NO: 2469782 - RNA, 13 nt, Brucella suis 1330
ggccgucgaucag

SEQ ID NO: 2469783 - RNA, 16 nt, Brucella suis 1330
ggccgugaccagcgca

SEQ ID NO: 2469784 - RNA, 16 nt, Brucella suis 1330
ggccguuacucggccg

SEQ ID NO: 2469785 - RNA, 22 nt, Brucella suis 1330
ggccuaccccucccucacccug

SEQ ID NO: 2469786 - RNA, 20 nt, Brucella suis 1330
ggccucaagcggcuccacca

SEQ ID NO: 2469787 - RNA, 21 nt, Brucella suis 1330
ggccucaagcggcuccaccac

SEQ ID NO: 2469788 - RNA, 18 nt, Brucella suis 1330
ggccucaagugccgccuu

SEQ ID NO: 2469789 - RNA, 14 nt, Brucella suis 1330
ggccucugccucca

SEQ ID NO: 2469790 - RNA, 12 nt, Brucella suis 1330
ggccucuuccag

SEQ ID NO: 2469791 - RNA, 16 nt, Brucella suis 1330
ggccucuuccaggaga

SEQ ID NO: 2469792 - RNA, 15 nt, Brucella suis 1330
ggccugaaacagcau

SEQ ID NO: 2469793 - RNA, 14 nt, Brucella suis 1330
ggccugaaagcugc

SEQ ID NO: 2469794 - RNA, 21 nt, Brucella suis 1330
ggccugaaagcugcuggcggg

SEQ ID NO: 2469795 - RNA, 14 nt, Brucella suis 1330
ggccugaccggcca

SEQ ID NO: 2469796 - RNA, 19 nt, Brucella suis 1330
ggccuggucuagccgcgca

SEQ ID NO: 2469797 - RNA, 22 nt, Brucella suis 1330
ggccugugcgacgaggccugaa

SEQ ID NO: 2469798 - RNA, 19 nt, Brucella suis 1330
ggccuguuccacaccugca

SEQ ID NO: 2469799 - RNA, 22 nt, Brucella suis 1330
ggccuguuccacaccugcacca

SEQ ID NO: 2469800 - RNA, 18 nt, Brucella suis 1330
ggccuucagcacauccug

SEQ ID NO: 2469801 - RNA, 14 nt, Brucella suis 1330
ggccuugcggcggc

SEQ ID NO: 2469802 - RNA, 18 nt, Brucella suis 1330
ggccuugcgguccggcca

SEQ ID NO: 2469803 - RNA, 23 nt, Brucella suis 1330
ggccuuguuuucugccggugccg

SEQ ID NO: 2469804 - RNA, 15 nt, Brucella suis 1330
ggccuuuccggcggc

SEQ ID NO: 2469805 - RNA, 22 nt, Brucella suis 1330
ggccuuugucauaucagacggu

SEQ ID NO: 2469806 - RNA, 14 nt, Brucella suis 1330
ggcgaaagcugccg

SEQ ID NO: 2469807 - RNA, 18 nt, Brucella suis 1330
ggcgaaaugucgaucccg

SEQ ID NO: 2469808 - RNA, 12 nt, Brucella suis 1330
ggcgaagcucau

SEQ ID NO: 2469809 - RNA, 14 nt, Brucella suis 1330
ggcgaccgccuuuu

SEQ ID NO: 2469810 - RNA, 13 nt, Brucella suis 1330
ggcgacggccagc

SEQ ID NO: 2469811 - RNA, 14 nt, Brucella suis 1330
ggcgacggccagcg

SEQ ID NO: 2469812 - RNA, 18 nt, Brucella suis 1330
ggcgagccgagcggcgca

SEQ ID NO: 2469813 - RNA, 21 nt, Brucella suis 1330
ggcgagcgacauauucuuccg

SEQ ID NO: 2469814 - RNA, 19 nt, Brucella suis 1330
ggcgagcgccagcguaucc

SEQ ID NO: 2469815 - RNA, 15 nt, Brucella suis 1330
ggcgaggaagagaau

SEQ ID NO: 2469816 - RNA, 20 nt, Brucella suis 1330
ggcgagggccucgauuucau

SEQ ID NO: 2469817 - RNA, 17 nt, Brucella suis 1330
ggcgagggcgggcggcc

SEQ ID NO: 2469818 - RNA, 21 nt, Brucella suis 1330
ggcgauaauaauuggcaagcg

SEQ ID NO: 2469819 - RNA, 17 nt, Brucella suis 1330
ggcgauaccagacgcgc

SEQ ID NO: 2469820 - RNA, 19 nt, Brucella suis 1330
ggcgaucagguugaugccg

SEQ ID NO: 2469821 - RNA, 21 nt, Brucella suis 1330
ggcgauccaauauugccuucc

SEQ ID NO: 2469822 - RNA, 22 nt, Brucella suis 1330
ggcgaugcccaucgcauugcug

SEQ ID NO: 2469823 - RNA, 21 nt, Brucella suis 1330
ggcgauggucgcaagacccaa

SEQ ID NO: 2469824 - RNA, 16 nt, Brucella suis 1330
ggcgcaaagcccagcc

SEQ ID NO: 2469825 - RNA, 14 nt, Brucella suis 1330
ggcgcaaaggccgg

SEQ ID NO: 2469826 - RNA, 20 nt, Brucella suis 1330
ggcgcaaccuggcugcacca

SEQ ID NO: 2469827 - RNA, 19 nt, Brucella suis 1330
ggcgcaaggucucgacagu

SEQ ID NO: 2469828 - RNA, 23 nt, Brucella suis 1330
ggcgcaaggucucgacaguccag

SEQ ID NO: 2469829 - RNA, 15 nt, Brucella suis 1330
ggcgcaggcagggag

SEQ ID NO: 2469830 - RNA, 21 nt, Brucella suis 1330
ggcgcagucaggccgaccgca

SEQ ID NO: 2469831 - RNA, 22 nt, Brucella suis 1330
ggcgccaacggcggcaaacgga

SEQ ID NO: 2469832 - RNA, 19 nt, Brucella suis 1330
ggcgccaccgucaccggcu

SEQ ID NO: 2469833 - RNA, 21 nt, Brucella suis 1330
ggcgccaccgucaccggcugg

SEQ ID NO: 2469834 - RNA, 12 nt, Brucella suis 1330
ggcgccagccca

SEQ ID NO: 2469835 - RNA, 13 nt, Brucella suis 1330
ggcgccagcgcgg

SEQ ID NO: 2469836 - RNA, 15 nt, Brucella suis 1330
ggcgcccgcccgccg

SEQ ID NO: 2469837 - RNA, 13 nt, Brucella suis 1330
ggcgccgucggga

SEQ ID NO: 2469838 - RNA, 23 nt, Brucella suis 1330
ggcgccgucgggaccaccggccu

SEQ ID NO: 2469839 - RNA, 14 nt, Brucella suis 1330
ggcgcgaaaccgga

SEQ ID NO: 2469840 - RNA, 15 nt, Brucella suis 1330
ggcgcgaaacgccuu

SEQ ID NO: 2469841 - RNA, 19 nt, Brucella suis 1330
ggcgcgaugagcgaaaucg

SEQ ID NO: 2469842 - RNA, 15 nt, Brucella suis 1330
ggcgcgccaguaggc

SEQ ID NO: 2469843 - RNA, 17 nt, Brucella suis 1330
ggcgcgccaguaggccc

SEQ ID NO: 2469844 - RNA, 18 nt, Brucella suis 1330
ggcgcggacaagcucgcg

SEQ ID NO: 2469845 - RNA, 12 nt, Brucella suis 1330
ggcgcggcagcu

SEQ ID NO: 2469846 - RNA, 20 nt, Brucella suis 1330
ggcgcggcaggaucgccaga

SEQ ID NO: 2469847 - RNA, 17 nt, Brucella suis 1330
ggcgcggcgcauggccu

SEQ ID NO: 2469848 - RNA, 21 nt, Brucella suis 1330
ggcgcgggaugacgccgggca

SEQ ID NO: 2469849 - RNA, 21 nt, Brucella suis 1330
ggcgcgggcuuuccagccccc

SEQ ID NO: 2469850 - RNA, 17 nt, Brucella suis 1330
ggcgcgugccguuucca

SEQ ID NO: 2469851 - RNA, 22 nt, Brucella suis 1330
ggcgcuagcgaugaugauccag

SEQ ID NO: 2469852 - RNA, 17 nt, Brucella suis 1330
ggcgcucggcggaacug

SEQ ID NO: 2469853 - RNA, 19 nt, Brucella suis 1330
ggcgcucuuuccgcgcauc

SEQ ID NO: 2469854 - RNA, 12 nt, Brucella suis 1330
ggcgcugcacac

SEQ ID NO: 2469855 - RNA, 16 nt, Brucella suis 1330
ggcgcugcgaaggccc

SEQ ID NO: 2469856 - RNA, 20 nt, Brucella suis 1330
ggcgcugcuggccgucgcgu

SEQ ID NO: 2469857 - RNA, 16 nt, Brucella suis 1330
ggcggaacaggcagca

SEQ ID NO: 2469858 - RNA, 20 nt, Brucella suis 1330
ggcggaacugcaugggcucg

SEQ ID NO: 2469859 - RNA, 14 nt, Brucella suis 1330
ggcggaagcgacga

SEQ ID NO: 2469860 - RNA, 22 nt, Brucella suis 1330
ggcggaagcgggaauagccgag

SEQ ID NO: 2469861 - RNA, 18 nt, Brucella suis 1330
ggcggagccucaucggcg

SEQ ID NO: 2469862 - RNA, 17 nt, Brucella suis 1330
ggcggauaaugcucgcc

SEQ ID NO: 2469863 - RNA, 18 nt, Brucella suis 1330
ggcggauaaugcucgccc

SEQ ID NO: 2469864 - RNA, 18 nt, Brucella suis 1330
ggcggaucgugacccgcc

SEQ ID NO: 2469865 - RNA, 16 nt, Brucella suis 1330
ggcggauuuccugccu

SEQ ID NO: 2469866 - RNA, 20 nt, Brucella suis 1330
ggcggcaacgggcgagggcg

SEQ ID NO: 2469867 - RNA, 15 nt, Brucella suis 1330
ggcggcaagcucgcc

SEQ ID NO: 2469868 - RNA, 17 nt, Brucella suis 1330
ggcggcaggcagacaug

SEQ ID NO: 2469869 - RNA, 21 nt, Brucella suis 1330
ggcggccaggacaacgggugc

SEQ ID NO: 2469870 - RNA, 22 nt, Brucella suis 1330
ggcggccaggacaacgggugcg

SEQ ID NO: 2469871 - RNA, 16 nt, Brucella suis 1330
ggcggccugaccggcc

SEQ ID NO: 2469872 - RNA, 19 nt, Brucella suis 1330
ggcggccugaccggccacc

SEQ ID NO: 2469873 - RNA, 16 nt, Brucella suis 1330
ggcggccuuggaggcg

SEQ ID NO: 2469874 - RNA, 13 nt, Brucella suis 1330
ggcggcgaugccu

SEQ ID NO: 2469875 - RNA, 12 nt, Brucella suis 1330
ggcggcgcucgg

SEQ ID NO: 2469876 - RNA, 14 nt, Brucella suis 1330
ggcggcgcucggcg

SEQ ID NO: 2469877 - RNA, 14 nt, Brucella suis 1330
ggcggcgguaccga

SEQ ID NO: 2469878 - RNA, 15 nt, Brucella suis 1330
ggcggcgguaccgaa

SEQ ID NO: 2469879 - RNA, 17 nt, Brucella suis 1330
ggcggcgucagcuuguc

SEQ ID NO: 2469880 - RNA, 16 nt, Brucella suis 1330
ggcggcgugggcugcu

SEQ ID NO: 2469881 - RNA, 12 nt, Brucella suis 1330
ggcggcuccagc

SEQ ID NO: 2469882 - RNA, 23 nt, Brucella suis 1330
ggcggcuggaacgagcuccccgg

SEQ ID NO: 2469883 - RNA, 11 nt, Brucella suis 1330
ggcggcuuccu

SEQ ID NO: 2469884 - RNA, 16 nt, Brucella suis 1330
ggcgggagcggcacau

SEQ ID NO: 2469885 - RNA, 22 nt, Brucella suis 1330
ggcgggagcggcacaugaaaua

SEQ ID NO: 2469886 - RNA, 18 nt, Brucella suis 1330
ggcgggcggggaauaucg

SEQ ID NO: 2469887 - RNA, 14 nt, Brucella suis 1330
ggcggggcuguagc

SEQ ID NO: 2469888 - RNA, 13 nt, Brucella suis 1330
ggcgguaaugcug

SEQ ID NO: 2469889 - RNA, 14 nt, Brucella suis 1330
ggcgguaaugcugg

SEQ ID NO: 2469890 - RNA, 20 nt, Brucella suis 1330
ggcgguaaugcuggccacca

SEQ ID NO: 2469891 - RNA, 18 nt, Brucella suis 1330
ggcggucacgcuccgcca

SEQ ID NO: 2469892 - RNA, 20 nt, Brucella suis 1330
ggcggucugaaaucagaucg

SEQ ID NO: 2469893 - RNA, 22 nt, Brucella suis 1330
ggcggugaagaagcgccagcuu

SEQ ID NO: 2469894 - RNA, 17 nt, Brucella suis 1330
ggcgguuauagcgcagc

SEQ ID NO: 2469895 - RNA, 19 nt, Brucella suis 1330
ggcgguuauagcgcagcga

SEQ ID NO: 2469896 - RNA, 16 nt, Brucella suis 1330
ggcgguucggcugccu

SEQ ID NO: 2469897 - RNA, 15 nt, Brucella suis 1330
ggcguauccggcccc

SEQ ID NO: 2469898 - RNA, 22 nt, Brucella suis 1330
ggcgucacauaaagcguggcga

SEQ ID NO: 2469899 - RNA, 23 nt, Brucella suis 1330
ggcgucaccugcaacgcgccaaa

SEQ ID NO: 2469900 - RNA, 13 nt, Brucella suis 1330
ggcgucagcaggu

SEQ ID NO: 2469901 - RNA, 20 nt, Brucella suis 1330
ggcgucagcuugaccagaua

SEQ ID NO: 2469902 - RNA, 13 nt, Brucella suis 1330
ggcgucaggccaa

SEQ ID NO: 2469903 - RNA, 18 nt, Brucella suis 1330
ggcgucagggcauugccg

SEQ ID NO: 2469904 - RNA, 17 nt, Brucella suis 1330
ggcguccuucaggcccu

SEQ ID NO: 2469905 - RNA, 15 nt, Brucella suis 1330
ggcgugcgcuguacu

SEQ ID NO: 2469906 - RNA, 13 nt, Brucella suis 1330
ggcguggaaagcu

SEQ ID NO: 2469907 - RNA, 14 nt, Brucella suis 1330
ggcguggaaagcug

SEQ ID NO: 2469908 - RNA, 17 nt, Brucella suis 1330
ggcguguuugcggccuu

SEQ ID NO: 2469909 - RNA, 17 nt, Brucella suis 1330
ggcguuaugagcugcau

SEQ ID NO: 2469910 - RNA, 14 nt, Brucella suis 1330
ggcguucgcgggcg

SEQ ID NO: 2469911 - RNA, 16 nt, Brucella suis 1330
ggcguucgucaaugcg

SEQ ID NO: 2469912 - RNA, 13 nt, Brucella suis 1330
ggcuaaagauacc

SEQ ID NO: 2469913 - RNA, 19 nt, Brucella suis 1330
ggcuaaagauaccagauca

SEQ ID NO: 2469914 - RNA, 20 nt, Brucella suis 1330
ggcuaaagcauaucuuccag

SEQ ID NO: 2469915 - RNA, 13 nt, Brucella suis 1330
ggcuaccggaugg

SEQ ID NO: 2469916 - RNA, 15 nt, Brucella suis 1330
ggcuaugcgcuucau

SEQ ID NO: 2469917 - RNA, 23 nt, Brucella suis 1330
ggcucauaguugaaaagggcaag

SEQ ID NO: 2469918 - RNA, 13 nt, Brucella suis 1330
ggcucauccucca

SEQ ID NO: 2469919 - RNA, 14 nt, Brucella suis 1330
ggcucauccuccac

SEQ ID NO: 2469920 - RNA, 23 nt, Brucella suis 1330
ggcucauucuguaaacugccgcg

SEQ ID NO: 2469921 - RNA, 17 nt, Brucella suis 1330
ggcuccguccggccagu

SEQ ID NO: 2469922 - RNA, 13 nt, Brucella suis 1330
ggcucgggcagcu

SEQ ID NO: 2469923 - RNA, 21 nt, Brucella suis 1330
ggcucgggcagcuugucgaaa

SEQ ID NO: 2469924 - RNA, 20 nt, Brucella suis 1330
ggcucucacgcgcagcagca

SEQ ID NO: 2469925 - RNA, 18 nt, Brucella suis 1330
ggcucuccggcaaaacgg

SEQ ID NO: 2469926 - RNA, 12 nt, Brucella suis 1330
ggcucugcgcca

SEQ ID NO: 2469927 - RNA, 20 nt, Brucella suis 1330
ggcugaaaucugcgccgguu

SEQ ID NO: 2469928 - RNA, 18 nt, Brucella suis 1330
ggcugaggcggcagacgu

SEQ ID NO: 2469929 - RNA, 13 nt, Brucella suis 1330
ggcugcaaauggc

SEQ ID NO: 2469930 - RNA, 21 nt, Brucella suis 1330
ggcugccaugugcagccgggu

SEQ ID NO: 2469931 - RNA, 19 nt, Brucella suis 1330
ggcugcccaugcccgccaa

SEQ ID NO: 2469932 - RNA, 20 nt, Brucella suis 1330
ggcugcccgccgcaagcucu

SEQ ID NO: 2469933 - RNA, 15 nt, Brucella suis 1330
ggcugcccgcgccgg

SEQ ID NO: 2469934 - RNA, 16 nt, Brucella suis 1330
ggcugcccgcgccggu

SEQ ID NO: 2469935 - RNA, 20 nt, Brucella suis 1330
ggcugccgggguuuuucuuu

SEQ ID NO: 2469936 - RNA, 12 nt, Brucella suis 1330
ggcugcggcgcc

SEQ ID NO: 2469937 - RNA, 22 nt, Brucella suis 1330
ggcugcugcgugcugcuugccg

SEQ ID NO: 2469938 - RNA, 20 nt, Brucella suis 1330
ggcuggaacgagcuccccgg

SEQ ID NO: 2469939 - RNA, 18 nt, Brucella suis 1330
ggcuggcacaaagcggcc

SEQ ID NO: 2469940 - RNA, 19 nt, Brucella suis 1330
ggcuggcacaaagcggccc

SEQ ID NO: 2469941 - RNA, 24 nt, Brucella suis 1330
ggcuggcucgcgugauaggcgaca

SEQ ID NO: 2469942 - RNA, 10 nt, Brucella suis 1330
ggcugggccc

SEQ ID NO: 2469943 - RNA, 22 nt, Brucella suis 1330
ggcuggucaauaucgcgcaggc

SEQ ID NO: 2469944 - RNA, 16 nt, Brucella suis 1330
ggcuguccgagagcga

SEQ ID NO: 2469945 - RNA, 18 nt, Brucella suis 1330
ggcuguuggccggcagcg

SEQ ID NO: 2469946 - RNA, 18 nt, Brucella suis 1330
ggcuguuucgcauugccc

SEQ ID NO: 2469947 - RNA, 16 nt, Brucella suis 1330
ggcuucaagcggcguc

SEQ ID NO: 2469948 - RNA, 16 nt, Brucella suis 1330
ggcuucagaucgcgcg

SEQ ID NO: 2469949 - RNA, 13 nt, Brucella suis 1330
ggcuuccagcagg

SEQ ID NO: 2469950 - RNA, 19 nt, Brucella suis 1330
ggcuuccuugcgcuugcga

SEQ ID NO: 2469951 - RNA, 18 nt, Brucella suis 1330
ggcuucggccgcuugcga

SEQ ID NO: 2469952 - RNA, 16 nt, Brucella suis 1330
ggcuucguaaagcgcg

SEQ ID NO: 2469953 - RNA, 15 nt, Brucella suis 1330
ggcuugagcgucagg

SEQ ID NO: 2469954 - RNA, 13 nt, Brucella suis 1330
ggcuugcaugguu

SEQ ID NO: 2469955 - RNA, 13 nt, Brucella suis 1330
ggcuugccagaug

SEQ ID NO: 2469956 - RNA, 23 nt, Brucella suis 1330
ggcuuggugaaacggccaagcag

SEQ ID NO: 2469957 - RNA, 23 nt, Brucella suis 1330
ggcuuucgccgguccagcggcua

SEQ ID NO: 2469958 - RNA, 15 nt, Brucella suis 1330
ggcuuucggucagga

SEQ ID NO: 2469959 - RNA, 13 nt, Brucella suis 1330
gggaaacggccag

SEQ ID NO: 2469960 - RNA, 16 nt, Brucella suis 1330
gggaaaucaguccacu

SEQ ID NO: 2469961 - RNA, 18 nt, Brucella suis 1330
gggaauagcaacuuccuu

SEQ ID NO: 2469962 - RNA, 14 nt, Brucella suis 1330
gggaaugcggaagc

SEQ ID NO: 2469963 - RNA, 13 nt, Brucella suis 1330
gggaccaccggcc

SEQ ID NO: 2469964 - RNA, 15 nt, Brucella suis 1330
gggacgcgugaaaau

SEQ ID NO: 2469965 - RNA, 14 nt, Brucella suis 1330
gggacgggcggugc

SEQ ID NO: 2469966 - RNA, 18 nt, Brucella suis 1330
gggagauguguaggcugg

SEQ ID NO: 2469967 - RNA, 15 nt, Brucella suis 1330
gggagcgcaauaucg

SEQ ID NO: 2469968 - RNA, 15 nt, Brucella suis 1330
gggagcgcagugccu

SEQ ID NO: 2469969 - RNA, 21 nt, Brucella suis 1330
gggagcggcacaugaaauaag

SEQ ID NO: 2469970 - RNA, 20 nt, Brucella suis 1330
gggaggacauucaugaagau

SEQ ID NO: 2469971 - RNA, 20 nt, Brucella suis 1330
gggaggcaaauguuggaauc

SEQ ID NO: 2469972 - RNA, 16 nt, Brucella suis 1330
gggaugggggccgggc

SEQ ID NO: 2469973 - RNA, 18 nt, Brucella suis 1330
gggaugggggccgggcgc

SEQ ID NO: 2469974 - RNA, 16 nt, Brucella suis 1330
gggauuuucggccagc

SEQ ID NO: 2469975 - RNA, 15 nt, Brucella suis 1330
gggcaaccgcgcgua

SEQ ID NO: 2469976 - RNA, 22 nt, Brucella suis 1330
gggcaaggggcggaacaggcag

SEQ ID NO: 2469977 - RNA, 16 nt, Brucella suis 1330
gggcaauuggccccca

SEQ ID NO: 2469978 - RNA, 18 nt, Brucella suis 1330
gggcacgcucgauccgcu

SEQ ID NO: 2469979 - RNA, 18 nt, Brucella suis 1330
gggcagcuucgagcgccu

SEQ ID NO: 2469980 - RNA, 23 nt, Brucella suis 1330
gggcaggaggccaaaaagcguau

SEQ ID NO: 2469981 - RNA, 21 nt, Brucella suis 1330
gggcaguagggcaguagggca

SEQ ID NO: 2469982 - RNA, 17 nt, Brucella suis 1330
gggcaguccggcagccg

SEQ ID NO: 2469983 - RNA, 14 nt, Brucella suis 1330
gggcagugaaagcc

SEQ ID NO: 2469984 - RNA, 22 nt, Brucella suis 1330
gggcaugacauccaugaaagcc

SEQ ID NO: 2469985 - RNA, 15 nt, Brucella suis 1330
gggccaaggccccag

SEQ ID NO: 2469986 - RNA, 19 nt, Brucella suis 1330
gggccaaggccccagauca

SEQ ID NO: 2469987 - RNA, 14 nt, Brucella suis 1330
gggccacgggccag

SEQ ID NO: 2469988 - RNA, 18 nt, Brucella suis 1330
gggccagaucgcgcgcgg

SEQ ID NO: 2469989 - RNA, 15 nt, Brucella suis 1330
gggccaugccugcga

SEQ ID NO: 2469990 - RNA, 14 nt, Brucella suis 1330
gggcccuucgcuuu

SEQ ID NO: 2469991 - RNA, 14 nt, Brucella suis 1330
gggccgcacguucc

SEQ ID NO: 2469992 - RNA, 18 nt, Brucella suis 1330
gggccucgauuucaucuc

SEQ ID NO: 2469993 - RNA, 15 nt, Brucella suis 1330
gggcgaacgggggcg

SEQ ID NO: 2469994 - RNA, 14 nt, Brucella suis 1330
gggcgagcgcgcca

SEQ ID NO: 2469995 - RNA, 22 nt, Brucella suis 1330
gggcgccgggaaauuucagcca

SEQ ID NO: 2469996 - RNA, 13 nt, Brucella suis 1330
gggcggcaccccc

SEQ ID NO: 2469997 - RNA, 13 nt, Brucella suis 1330
gggcggccacggc

SEQ ID NO: 2469998 - RNA, 12 nt, Brucella suis 1330
gggcggcggccg

SEQ ID NO: 2469999 - RNA, 19 nt, Brucella suis 1330
gggcggucacgcuccgcca

SEQ ID NO: 2470000 - RNA, 21 nt, Brucella suis 1330
gggcguaucguuaucgcgcag

SEQ ID NO: 2470001 - RNA, 13 nt, Brucella suis 1330
gggcgucgcgcau

SEQ ID NO: 2470002 - RNA, 20 nt, Brucella suis 1330
gggcugcuuccacaggcgcc

SEQ ID NO: 2470003 - RNA, 21 nt, Brucella suis 1330
gggcugcuuccacaggcgcca

SEQ ID NO: 2470004 - RNA, 23 nt, Brucella suis 1330
gggcuggcucuauacgaugcaga

SEQ ID NO: 2470005 - RNA, 23 nt, Brucella suis 1330
gggcugucggcaaacauccagcc

SEQ ID NO: 2470006 - RNA, 19 nt, Brucella suis 1330
gggcuguuggccggcagcg

SEQ ID NO: 2470007 - RNA, 21 nt, Brucella suis 1330
gggcuuccugcaaaagcgcac

SEQ ID NO: 2470008 - RNA, 18 nt, Brucella suis 1330
gggcuucugcgcccgcgc

SEQ ID NO: 2470009 - RNA, 16 nt, Brucella suis 1330
gggcuuucucguuuuc

SEQ ID NO: 2470010 - RNA, 17 nt, Brucella suis 1330
ggggauugccaugaaac

SEQ ID NO: 2470011 - RNA, 18 nt, Brucella suis 1330
ggggcaaauuucaguccc

SEQ ID NO: 2470012 - RNA, 20 nt, Brucella suis 1330
ggggccaaaggucggcggcg

SEQ ID NO: 2470013 - RNA, 17 nt, Brucella suis 1330
ggggccaaggccccaga

SEQ ID NO: 2470014 - RNA, 14 nt, Brucella suis 1330
ggggccgacagggc

SEQ ID NO: 2470015 - RNA, 20 nt, Brucella suis 1330
ggggcuguagcgcgcaccga

SEQ ID NO: 2470016 - RNA, 13 nt, Brucella suis 1330
ggggcuuggcuug

SEQ ID NO: 2470017 - RNA, 22 nt, Brucella suis 1330
ggguagagcuucuuuucgauga

SEQ ID NO: 2470018 - RNA, 23 nt, Brucella suis 1330
ggguaugugucauaaaaaacggu

SEQ ID NO: 2470019 - RNA, 20 nt, Brucella suis 1330
gggucuucauagaccccgcc

SEQ ID NO: 2470020 - RNA, 12 nt, Brucella suis 1330
gggugagcgugu

SEQ ID NO: 2470021 - RNA, 13 nt, Brucella suis 1330
ggguggcgcccgc

SEQ ID NO: 2470022 - RNA, 20 nt, Brucella suis 1330
ggguggcgcccgcccgccgc

SEQ ID NO: 2470023 - RNA, 15 nt, Brucella suis 1330
ggguguuugcgacgg

SEQ ID NO: 2470024 - RNA, 23 nt, Brucella suis 1330
ggguguuugcgacgggcgagcgc

SEQ ID NO: 2470025 - RNA, 15 nt, Brucella suis 1330
ggguugacgaucacc

SEQ ID NO: 2470026 - RNA, 19 nt, Brucella suis 1330
gguaaaaugcaccgccugc

SEQ ID NO: 2470027 - RNA, 21 nt, Brucella suis 1330
gguaaaggcgaguuuucaaac

SEQ ID NO: 2470028 - RNA, 23 nt, Brucella suis 1330
gguaagcccugucagcgccgccc

SEQ ID NO: 2470029 - RNA, 22 nt, Brucella suis 1330
gguaagcgaccaccaccgggca

SEQ ID NO: 2470030 - RNA, 15 nt, Brucella suis 1330
gguacggaaagggcu

SEQ ID NO: 2470031 - RNA, 23 nt, Brucella suis 1330
gguagauuguggugugagugcgc

SEQ ID NO: 2470032 - RNA, 12 nt, Brucella suis 1330
gguauccagcag

SEQ ID NO: 2470033 - RNA, 19 nt, Brucella suis 1330
ggucaaaauggccucagau

SEQ ID NO: 2470034 - RNA, 15 nt, Brucella suis 1330
ggucacgcuccgcca

SEQ ID NO: 2470035 - RNA, 14 nt, Brucella suis 1330
ggucagcaggcgcc

SEQ ID NO: 2470036 - RNA, 17 nt, Brucella suis 1330
ggucagccacgauaccg

SEQ ID NO: 2470037 - RNA, 18 nt, Brucella suis 1330
ggucaggccaagugcggu

SEQ ID NO: 2470038 - RNA, 20 nt, Brucella suis 1330
gguccaccacaugcuccagg

SEQ ID NO: 2470039 - RNA, 12 nt, Brucella suis 1330
ggucgaaaccuu

SEQ ID NO: 2470040 - RNA, 20 nt, Brucella suis 1330
ggucgagcgccuguccgccu

SEQ ID NO: 2470041 - RNA, 21 nt, Brucella suis 1330
ggucgucuuucaguuuuugca

SEQ ID NO: 2470042 - RNA, 14 nt, Brucella suis 1330
ggucuuccgggaca

SEQ ID NO: 2470043 - RNA, 15 nt, Brucella suis 1330
ggucuucgcccggca

SEQ ID NO: 2470044 - RNA, 16 nt, Brucella suis 1330
ggugaaacggccaagc

SEQ ID NO: 2470045 - RNA, 22 nt, Brucella suis 1330
ggugaaagaccgcauuccggcu

SEQ ID NO: 2470046 - RNA, 17 nt, Brucella suis 1330
ggugaagaagcgccagc

SEQ ID NO: 2470047 - RNA, 18 nt, Brucella suis 1330
ggugaaggauaucgaaaa

SEQ ID NO: 2470048 - RNA, 13 nt, Brucella suis 1330
ggugacggcggca

SEQ ID NO: 2470049 - RNA, 22 nt, Brucella suis 1330
ggugacggucguuucgccgccc

SEQ ID NO: 2470050 - RNA, 19 nt, Brucella suis 1330
ggugaggcuggcgccgccg

SEQ ID NO: 2470051 - RNA, 16 nt, Brucella suis 1330
ggugcaaugccaucca

SEQ ID NO: 2470052 - RNA, 21 nt, Brucella suis 1330
ggugcagucuucggccgggca

SEQ ID NO: 2470053 - RNA, 19 nt, Brucella suis 1330
ggugcauuuuuccagaccu

SEQ ID NO: 2470054 - RNA, 15 nt, Brucella suis 1330
ggugcccuuucgcuu

SEQ ID NO: 2470055 - RNA, 14 nt, Brucella suis 1330
ggugccggcaggcu

SEQ ID NO: 2470056 - RNA, 16 nt, Brucella suis 1330
ggugcgcggaaaaugu

SEQ ID NO: 2470057 - RNA, 20 nt, Brucella suis 1330
ggugcugcauccuucaagca

SEQ ID NO: 2470058 - RNA, 20 nt, Brucella suis 1330
gguggcgcccgcccgccgca

SEQ ID NO: 2470059 - RNA, 17 nt, Brucella suis 1330
ggugucauagaccauga

SEQ ID NO: 2470060 - RNA, 17 nt, Brucella suis 1330
ggugugagugcgcacgc

SEQ ID NO: 2470061 - RNA, 16 nt, Brucella suis 1330
gguuauacucggcguu

SEQ ID NO: 2470062 - RNA, 14 nt, Brucella suis 1330
gguucaauacccau

SEQ ID NO: 2470063 - RNA, 16 nt, Brucella suis 1330
gguucaauacccaugc

SEQ ID NO: 2470064 - RNA, 19 nt, Brucella suis 1330
gguuccagcgauuccauuu

SEQ ID NO: 2470065 - RNA, 18 nt, Brucella suis 1330
gguuccaguccagcgcgc

SEQ ID NO: 2470066 - RNA, 21 nt, Brucella suis 1330
gguucgcccaugccgcaggau

SEQ ID NO: 2470067 - RNA, 21 nt, Brucella suis 1330
gguucgcucguaacgggagca

SEQ ID NO: 2470068 - RNA, 19 nt, Brucella suis 1330
gguucgcuggccaugaugc

SEQ ID NO: 2470069 - RNA, 21 nt, Brucella suis 1330
gguucguugaacugcaucaca

SEQ ID NO: 2470070 - RNA, 19 nt, Brucella suis 1330
gguucucgaaucccgguga

SEQ ID NO: 2470071 - RNA, 20 nt, Brucella suis 1330
gguucuugagguugagcugc

SEQ ID NO: 2470072 - RNA, 20 nt, Brucella suis 1330
gguugcaggcgcaggcccug

SEQ ID NO: 2470073 - RNA, 21 nt, Brucella suis 1330
gguugcgccgguguagagcug

SEQ ID NO: 2470074 - RNA, 15 nt, Brucella suis 1330
gguugcuggaauuga

SEQ ID NO: 2470075 - RNA, 13 nt, Brucella suis 1330
gguuuugagcugc

SEQ ID NO: 2470076 - RNA, 11 nt, Brucella suis 1330
gguuuuucggu

SEQ ID NO: 2470077 - RNA, 15 nt, Brucella suis 1330
gguuuuucgguuuuc

SEQ ID NO: 2470078 - RNA, 21 nt, Brucella suis 1330
guaaaaccauccccgccauga

SEQ ID NO: 2470079 - RNA, 14 nt, Brucella suis 1330
guaaagaucgaugu

SEQ ID NO: 2470080 - RNA, 17 nt, Brucella suis 1330
guaacaauuggccgaga

SEQ ID NO: 2470081 - RNA, 15 nt, Brucella suis 1330
guaaccgucuugaac

SEQ ID NO: 2470082 - RNA, 15 nt, Brucella suis 1330
guaagcggcaauccu

SEQ ID NO: 2470083 - RNA, 18 nt, Brucella suis 1330
guaaggcuucagucugga

SEQ ID NO: 2470084 - RNA, 21 nt, Brucella suis 1330
guaauaacgacgcccgccccc

SEQ ID NO: 2470085 - RNA, 22 nt, Brucella suis 1330
guaauaacgacgcccgcccccg

SEQ ID NO: 2470086 - RNA, 22 nt, Brucella suis 1330
guaauagcccgguguauccacc

SEQ ID NO: 2470087 - RNA, 18 nt, Brucella suis 1330
guaauauugaagccgaga

SEQ ID NO: 2470088 - RNA, 13 nt, Brucella suis 1330
guaaucgccggug

SEQ ID NO: 2470089 - RNA, 23 nt, Brucella suis 1330
guaaucgccggugccauaacggc

SEQ ID NO: 2470090 - RNA, 11 nt, Brucella suis 1330
guaaucgugcc

SEQ ID NO: 2470091 - RNA, 18 nt, Brucella suis 1330
guaaugcuggccaccaga

SEQ ID NO: 2470092 - RNA, 16 nt, Brucella suis 1330
guacaccgaggccgcc

SEQ ID NO: 2470093 - RNA, 23 nt, Brucella suis 1330
guacauacaugaugaucgccagc

SEQ ID NO: 2470094 - RNA, 19 nt, Brucella suis 1330
guaccgacaugccaagagc

SEQ ID NO: 2470095 - RNA, 16 nt, Brucella suis 1330
guacgccauagacgcc

SEQ ID NO: 2470096 - RNA, 16 nt, Brucella suis 1330
guacggcgcgcugaag

SEQ ID NO: 2470097 - RNA, 20 nt, Brucella suis 1330
guagaaaauauagccgccug

SEQ ID NO: 2470098 - RNA, 14 nt, Brucella suis 1330
guagaauucgauga

SEQ ID NO: 2470099 - RNA, 20 nt, Brucella suis 1330
guagagcuucuuuucgauga

SEQ ID NO: 2470100 - RNA, 14 nt, Brucella suis 1330
guagagugcuuccu

SEQ ID NO: 2470101 - RNA, 13 nt, Brucella suis 1330
guagccaugcguu

SEQ ID NO: 2470102 - RNA, 18 nt, Brucella suis 1330
guagccaugcguuuuugg

SEQ ID NO: 2470103 - RNA, 17 nt, Brucella suis 1330
guagcgcgagcaaugau

SEQ ID NO: 2470104 - RNA, 15 nt, Brucella suis 1330
guagcuucuggguga

SEQ ID NO: 2470105 - RNA, 15 nt, Brucella suis 1330
guaggcguuucacac

SEQ ID NO: 2470106 - RNA, 20 nt, Brucella suis 1330
guaguucaggccggccuuga

SEQ ID NO: 2470107 - RNA, 15 nt, Brucella suis 1330
guauagcgaugaaga

SEQ ID NO: 2470108 - RNA, 19 nt, Brucella suis 1330
guauauucggcgaccgccu

SEQ ID NO: 2470109 - RNA, 15 nt, Brucella suis 1330
guaucgacaccgcca

SEQ ID NO: 2470110 - RNA, 19 nt, Brucella suis 1330
guaucgccaaugcccugcu

SEQ ID NO: 2470111 - RNA, 22 nt, Brucella suis 1330
guaucgccaaugcccugcugca

SEQ ID NO: 2470112 - RNA, 13 nt, Brucella suis 1330
guaucggaugcga

SEQ ID NO: 2470113 - RNA, 18 nt, Brucella suis 1330
guaucggcaguuucaucu

SEQ ID NO: 2470114 - RNA, 19 nt, Brucella suis 1330
guaucggcgauauggcgca

SEQ ID NO: 2470115 - RNA, 12 nt, Brucella suis 1330
guauggcaaaag

SEQ ID NO: 2470116 - RNA, 20 nt, Brucella suis 1330
guauuagacgaauaaaacgc

SEQ ID NO: 2470117 - RNA, 13 nt, Brucella suis 1330
gucaaaacaaagg

SEQ ID NO: 2470118 - RNA, 15 nt, Brucella suis 1330
gucaauacaccugca

SEQ ID NO: 2470119 - RNA, 15 nt, Brucella suis 1330
gucaaugccaccgcg

SEQ ID NO: 2470120 - RNA, 14 nt, Brucella suis 1330
gucaaugccauccg

SEQ ID NO: 2470121 - RNA, 18 nt, Brucella suis 1330
gucacaaugugaaugaaa

SEQ ID NO: 2470122 - RNA, 18 nt, Brucella suis 1330
gucaccauucacaucgag

SEQ ID NO: 2470123 - RNA, 17 nt, Brucella suis 1330
gucacccgcgucgucug

SEQ ID NO: 2470124 - RNA, 22 nt, Brucella suis 1330
gucacccgcgucgucugcaucc

SEQ ID NO: 2470125 - RNA, 18 nt, Brucella suis 1330
gucaccugcaacgcgcca

SEQ ID NO: 2470126 - RNA, 15 nt, Brucella suis 1330
gucacgaucuugccg

SEQ ID NO: 2470127 - RNA, 17 nt, Brucella suis 1330
gucacgauggcccagcg

SEQ ID NO: 2470128 - RNA, 20 nt, Brucella suis 1330
gucacgccacggcuuucggu

SEQ ID NO: 2470129 - RNA, 20 nt, Brucella suis 1330
gucacgccaucagcauugaa

SEQ ID NO: 2470130 - RNA, 14 nt, Brucella suis 1330
gucacgcccaugau

SEQ ID NO: 2470131 - RNA, 23 nt, Brucella suis 1330
gucacgcgcccacgugagagguc

SEQ ID NO: 2470132 - RNA, 20 nt, Brucella suis 1330
gucacgcugcaucggcaaau

SEQ ID NO: 2470133 - RNA, 17 nt, Brucella suis 1330
gucacggucagaucauc

SEQ ID NO: 2470134 - RNA, 17 nt, Brucella suis 1330
gucacgguugccuugcu

SEQ ID NO: 2470135 - RNA, 14 nt, Brucella suis 1330
gucacguccagaag

SEQ ID NO: 2470136 - RNA, 18 nt, Brucella suis 1330
gucacugcaaaaaauacc

SEQ ID NO: 2470137 - RNA, 19 nt, Brucella suis 1330
gucagaaagucugcuuccg

SEQ ID NO: 2470138 - RNA, 21 nt, Brucella suis 1330
gucagaagcaaucgacaauug

SEQ ID NO: 2470139 - RNA, 24 nt, Brucella suis 1330
gucagcaggcgccgugcccgacug

SEQ ID NO: 2470140 - RNA, 16 nt, Brucella suis 1330
gucagcagguugacga

SEQ ID NO: 2470141 - RNA, 22 nt, Brucella suis 1330
gucagccacgauaccgagaacg

SEQ ID NO: 2470142 - RNA, 17 nt, Brucella suis 1330
gucagcgccgcccaggg

SEQ ID NO: 2470143 - RNA, 22 nt, Brucella suis 1330
gucagcggcggauaaugcucgc

SEQ ID NO: 2470144 - RNA, 13 nt, Brucella suis 1330
gucagcuuggaaa

SEQ ID NO: 2470145 - RNA, 18 nt, Brucella suis 1330
gucagcuuggaaagcugu

SEQ ID NO: 2470146 - RNA, 12 nt, Brucella suis 1330
gucagcuugucg

SEQ ID NO: 2470147 - RNA, 20 nt, Brucella suis 1330
gucaggauaaccuucuggaa

SEQ ID NO: 2470148 - RNA, 21 nt, Brucella suis 1330
gucaggauaaccuucuggaaa

SEQ ID NO: 2470149 - RNA, 13 nt, Brucella suis 1330
gucaggccgauga

SEQ ID NO: 2470150 - RNA, 22 nt, Brucella suis 1330
gucaggcuuuccgacagggcaa

SEQ ID NO: 2470151 - RNA, 18 nt, Brucella suis 1330
gucauaaugcauggaggc

SEQ ID NO: 2470152 - RNA, 20 nt, Brucella suis 1330
gucauagaccaugacgccgc

SEQ ID NO: 2470153 - RNA, 20 nt, Brucella suis 1330
gucauagaucggaugcucca

SEQ ID NO: 2470154 - RNA, 20 nt, Brucella suis 1330
gucauaggcaauaccaagcg

SEQ ID NO: 2470155 - RNA, 17 nt, Brucella suis 1330
gucauauucggccuuga

SEQ ID NO: 2470156 - RNA, 20 nt, Brucella suis 1330
gucaucgccaccauggccgc

SEQ ID NO: 2470157 - RNA, 21 nt, Brucella suis 1330
gucaugcgcgcccugcagggc

SEQ ID NO: 2470158 - RNA, 21 nt, Brucella suis 1330
gucauggccacgccagccgcg

SEQ ID NO: 2470159 - RNA, 22 nt, Brucella suis 1330
gucauggugugcaaugcagcca

SEQ ID NO: 2470160 - RNA, 18 nt, Brucella suis 1330
gucauuugcgaccauggc

SEQ ID NO: 2470161 - RNA, 16 nt, Brucella suis 1330
guccacgcccuuggcg

SEQ ID NO: 2470162 - RNA, 20 nt, Brucella suis 1330
guccacuggacugauuucug

SEQ ID NO: 2470163 - RNA, 19 nt, Brucella suis 1330
guccacuggacugauuuuu

SEQ ID NO: 2470164 - RNA, 17 nt, Brucella suis 1330
guccagaaagagcaucc

SEQ ID NO: 2470165 - RNA, 17 nt, Brucella suis 1330
guccagcccugccggcu

SEQ ID NO: 2470166 - RNA, 18 nt, Brucella suis 1330
guccagcgcguugccuug

SEQ ID NO: 2470167 - RNA, 23 nt, Brucella suis 1330
gucccgcccgucgaccagcgcau

SEQ ID NO: 2470168 - RNA, 14 nt, Brucella suis 1330
guccgaaugcaagg

SEQ ID NO: 2470169 - RNA, 20 nt, Brucella suis 1330
guccgcaccauucugcccag

SEQ ID NO: 2470170 - RNA, 16 nt, Brucella suis 1330
guccgccaccgccggc

SEQ ID NO: 2470171 - RNA, 23 nt, Brucella suis 1330
guccgccugaucgucaggcgcau

SEQ ID NO: 2470172 - RNA, 21 nt, Brucella suis 1330
guccggcauugaugagaaccg

SEQ ID NO: 2470173 - RNA, 22 nt, Brucella suis 1330
guccggccagcuugaaaagccg

SEQ ID NO: 2470174 - RNA, 15 nt, Brucella suis 1330
guccggccugcgcca

SEQ ID NO: 2470175 - RNA, 16 nt, Brucella suis 1330
guccggcgcgcugcaa

SEQ ID NO: 2470176 - RNA, 18 nt, Brucella suis 1330
guccgggaagcaguuccu

SEQ ID NO: 2470177 - RNA, 19 nt, Brucella suis 1330
guccgguccccgccgccga

SEQ ID NO: 2470178 - RNA, 16 nt, Brucella suis 1330
guccucgaucaaaccc

SEQ ID NO: 2470179 - RNA, 14 nt, Brucella suis 1330
guccucgcgccaga

SEQ ID NO: 2470180 - RNA, 17 nt, Brucella suis 1330
guccugcaaaccggcug

SEQ ID NO: 2470181 - RNA, 21 nt, Brucella suis 1330
gucgaaaaucuugaucgagcc

SEQ ID NO: 2470182 - RNA, 14 nt, Brucella suis 1330
gucgaccagcgcau

SEQ ID NO: 2470183 - RNA, 16 nt, Brucella suis 1330
gucgagcaaugcgccg

SEQ ID NO: 2470184 - RNA, 19 nt, Brucella suis 1330
gucgagcaaugcgccgugc

SEQ ID NO: 2470185 - RNA, 23 nt, Brucella suis 1330
gucgagcggcauggcguagaaau

SEQ ID NO: 2470186 - RNA, 18 nt, Brucella suis 1330
gucgaggaaaaagcccgc

SEQ ID NO: 2470187 - RNA, 20 nt, Brucella suis 1330
gucgaggaaaaagcccgcca

SEQ ID NO: 2470188 - RNA, 24 nt, Brucella suis 1330
gucgaggaagcgguccuggcgcac

SEQ ID NO: 2470189 - RNA, 19 nt, Brucella suis 1330
gucgauauugaccuuggca

SEQ ID NO: 2470190 - RNA, 23 nt, Brucella suis 1330
gucgcaaccacgguuuucgccgc

SEQ ID NO: 2470191 - RNA, 14 nt, Brucella suis 1330
gucgcacgcuuggc

SEQ ID NO: 2470192 - RNA, 23 nt, Brucella suis 1330
gucgcacgcuuggccucuuccag

SEQ ID NO: 2470193 - RNA, 20 nt, Brucella suis 1330
gucgcaggcggaugaagcgc

SEQ ID NO: 2470194 - RNA, 18 nt, Brucella suis 1330
gucgccgaaaagcgccug

SEQ ID NO: 2470195 - RNA, 16 nt, Brucella suis 1330
gucgcgcgauguuccg

SEQ ID NO: 2470196 - RNA, 13 nt, Brucella suis 1330
gucgcgcucgccg

SEQ ID NO: 2470197 - RNA, 16 nt, Brucella suis 1330
gucgcgcucgccgccc

SEQ ID NO: 2470198 - RNA, 16 nt, Brucella suis 1330
gucgcguauccaggug

SEQ ID NO: 2470199 - RNA, 21 nt, Brucella suis 1330
gucgcuuucgauuuuugccag

SEQ ID NO: 2470200 - RNA, 21 nt, Brucella suis 1330
gucgcuuuucaguugcgcaaa

SEQ ID NO: 2470201 - RNA, 14 nt, Brucella suis 1330
gucggcaagcugga

SEQ ID NO: 2470202 - RNA, 11 nt, Brucella suis 1330
gucggcauauu

SEQ ID NO: 2470203 - RNA, 19 nt, Brucella suis 1330
gucggccaguuuggcugug

SEQ ID NO: 2470204 - RNA, 20 nt, Brucella suis 1330
gucggcggcgugggcugcug

SEQ ID NO: 2470205 - RNA, 21 nt, Brucella suis 1330
gucggcguccacacugauuuu

SEQ ID NO: 2470206 - RNA, 17 nt, Brucella suis 1330
gucggcucaucgcgcug

SEQ ID NO: 2470207 - RNA, 19 nt, Brucella suis 1330
gucggcucaucgcgcugcu

SEQ ID NO: 2470208 - RNA, 18 nt, Brucella suis 1330
gucggguccagcgaugcc

SEQ ID NO: 2470209 - RNA, 19 nt, Brucella suis 1330
gucgggugaacuggcaagu

SEQ ID NO: 2470210 - RNA, 19 nt, Brucella suis 1330
gucguccagcccugccggc

SEQ ID NO: 2470211 - RNA, 14 nt, Brucella suis 1330
gucgucuagcgcca

SEQ ID NO: 2470212 - RNA, 19 nt, Brucella suis 1330
gucgucuuucaguuuuugc

SEQ ID NO: 2470213 - RNA, 18 nt, Brucella suis 1330
gucguugacacgcuugaa

SEQ ID NO: 2470214 - RNA, 16 nt, Brucella suis 1330
gucuagcgccaugagu

SEQ ID NO: 2470215 - RNA, 18 nt, Brucella suis 1330
gucuauuuucugcgggcg

SEQ ID NO: 2470216 - RNA, 22 nt, Brucella suis 1330
gucugacgggaugauugcgcca

SEQ ID NO: 2470217 - RNA, 16 nt, Brucella suis 1330
gucuggcgaggcgcug

SEQ ID NO: 2470218 - RNA, 19 nt, Brucella suis 1330
gucuggugcucuauccagc

SEQ ID NO: 2470219 - RNA, 15 nt, Brucella suis 1330
gucugugucacgcag

SEQ ID NO: 2470220 - RNA, 16 nt, Brucella suis 1330
gucuuauaguuuucug

SEQ ID NO: 2470221 - RNA, 20 nt, Brucella suis 1330
gucuucauagaccccgccug

SEQ ID NO: 2470222 - RNA, 14 nt, Brucella suis 1330
gucuucgcccggca

SEQ ID NO: 2470223 - RNA, 21 nt, Brucella suis 1330
gucuucugagaaaaaaaugcg

SEQ ID NO: 2470224 - RNA, 19 nt, Brucella suis 1330
gucuucuugugaacaugga

SEQ ID NO: 2470225 - RNA, 18 nt, Brucella suis 1330
gucuuuuccgcugccagc

SEQ ID NO: 2470226 - RNA, 16 nt, Brucella suis 1330
gugaaacagugccgcc

SEQ ID NO: 2470227 - RNA, 17 nt, Brucella suis 1330
gugaaacagugccgcca

SEQ ID NO: 2470228 - RNA, 19 nt, Brucella suis 1330
gugaaaccagcguggcuuu

SEQ ID NO: 2470229 - RNA, 20 nt, Brucella suis 1330
gugaaagacucgaacaggcc

SEQ ID NO: 2470230 - RNA, 19 nt, Brucella suis 1330
gugaacauuucggucggga

SEQ ID NO: 2470231 - RNA, 18 nt, Brucella suis 1330
gugaagcgcuugccguga

SEQ ID NO: 2470232 - RNA, 16 nt, Brucella suis 1330
gugaagugaaaccagc

SEQ ID NO: 2470233 - RNA, 22 nt, Brucella suis 1330
gugaauucgggguucuucaacu

SEQ ID NO: 2470234 - RNA, 16 nt, Brucella suis 1330
gugaccagccccugca

SEQ ID NO: 2470235 - RNA, 19 nt, Brucella suis 1330
gugaccagcgccgaggcgc

SEQ ID NO: 2470236 - RNA, 22 nt, Brucella suis 1330
gugacgaucuggaacaguucca

SEQ ID NO: 2470237 - RNA, 14 nt, Brucella suis 1330
gugacggaugaggc

SEQ ID NO: 2470238 - RNA, 14 nt, Brucella suis 1330
gugacggcggcaga

SEQ ID NO: 2470239 - RNA, 22 nt, Brucella suis 1330
gugacggucgaagccacggcga

SEQ ID NO: 2470240 - RNA, 14 nt, Brucella suis 1330
gugacuuugaucgc

SEQ ID NO: 2470241 - RNA, 18 nt, Brucella suis 1330
gugagcagaagaaagggc

SEQ ID NO: 2470242 - RNA, 18 nt, Brucella suis 1330
gugagcgcgcaaacaagc

SEQ ID NO: 2470243 - RNA, 12 nt, Brucella suis 1330
gugagcggcagg

SEQ ID NO: 2470244 - RNA, 22 nt, Brucella suis 1330
gugcaaaccuccgacaccagcc

SEQ ID NO: 2470245 - RNA, 18 nt, Brucella suis 1330
gugcaaagcggcuuucca

SEQ ID NO: 2470246 - RNA, 15 nt, Brucella suis 1330
gugcaagcgcaaagc

SEQ ID NO: 2470247 - RNA, 16 nt, Brucella suis 1330
gugcacgaauugcacg

SEQ ID NO: 2470248 - RNA, 15 nt, Brucella suis 1330
gugcacuucgagcag

SEQ ID NO: 2470249 - RNA, 15 nt, Brucella suis 1330
gugcagcgugccgug

SEQ ID NO: 2470250 - RNA, 14 nt, Brucella suis 1330
gugcagggugcggu

SEQ ID NO: 2470251 - RNA, 18 nt, Brucella suis 1330
gugcauaggauucgcggc

SEQ ID NO: 2470252 - RNA, 15 nt, Brucella suis 1330
gugccagaucggcaa

SEQ ID NO: 2470253 - RNA, 14 nt, Brucella suis 1330
gugccagauggcgu

SEQ ID NO: 2470254 - RNA, 14 nt, Brucella suis 1330
gugccagcgucggc

SEQ ID NO: 2470255 - RNA, 12 nt, Brucella suis 1330
gugcccugcugc

SEQ ID NO: 2470256 - RNA, 16 nt, Brucella suis 1330
gugcccuugagagcca

SEQ ID NO: 2470257 - RNA, 21 nt, Brucella suis 1330
gugccgaauguggugacggcg

SEQ ID NO: 2470258 - RNA, 17 nt, Brucella suis 1330
gugccgcuuccagcauc

SEQ ID NO: 2470259 - RNA, 23 nt, Brucella suis 1330
gugccggacgggaauauagccga

SEQ ID NO: 2470260 - RNA, 13 nt, Brucella suis 1330
gugccggcaggcu

SEQ ID NO: 2470261 - RNA, 15 nt, Brucella suis 1330
gugccggcaggcugu

SEQ ID NO: 2470262 - RNA, 12 nt, Brucella suis 1330
gugccucaggau

SEQ ID NO: 2470263 - RNA, 20 nt, Brucella suis 1330
gugccuccgacugugauuug

SEQ ID NO: 2470264 - RNA, 17 nt, Brucella suis 1330
gugcgaagcgccuacgc

SEQ ID NO: 2470265 - RNA, 19 nt, Brucella suis 1330
gugcgcggacgggcaggca

SEQ ID NO: 2470266 - RNA, 18 nt, Brucella suis 1330
gugcgcuuccggcugcuu

SEQ ID NO: 2470267 - RNA, 17 nt, Brucella suis 1330
gugcgggcuucuuccag

SEQ ID NO: 2470268 - RNA, 13 nt, Brucella suis 1330
gugcggucgccgc

SEQ ID NO: 2470269 - RNA, 17 nt, Brucella suis 1330
gugcucuauccagcuga

SEQ ID NO: 2470270 - RNA, 20 nt, Brucella suis 1330
guggaacuuugugccgccgc

SEQ ID NO: 2470271 - RNA, 22 nt, Brucella suis 1330
guggaagcacauggcggccuuu

SEQ ID NO: 2470272 - RNA, 13 nt, Brucella suis 1330
guggagcaccgcc

SEQ ID NO: 2470273 - RNA, 21 nt, Brucella suis 1330
guggagcguacaccgaccagc

SEQ ID NO: 2470274 - RNA, 23 nt, Brucella suis 1330
guggagcguacaccgaccagcgc

SEQ ID NO: 2470275 - RNA, 22 nt, Brucella suis 1330
guggcaagcccgcugcgccgca

SEQ ID NO: 2470276 - RNA, 23 nt, Brucella suis 1330
guggcaaugacggcauuuugcga

SEQ ID NO: 2470277 - RNA, 19 nt, Brucella suis 1330
guggccgccacccaugucg

SEQ ID NO: 2470278 - RNA, 23 nt, Brucella suis 1330
guggcgauggucgcaagacccaa

SEQ ID NO: 2470279 - RNA, 21 nt, Brucella suis 1330
guggcgcccgcccgccgcaag

SEQ ID NO: 2470280 - RNA, 18 nt, Brucella suis 1330
guggcgggguguacaaca

SEQ ID NO: 2470281 - RNA, 14 nt, Brucella suis 1330
guggcugcccgccg

SEQ ID NO: 2470282 - RNA, 15 nt, Brucella suis 1330
guggcugcccgccgc

SEQ ID NO: 2470283 - RNA, 13 nt, Brucella suis 1330
guggcugggcccc

SEQ ID NO: 2470284 - RNA, 15 nt, Brucella suis 1330
guggcugggccccaa

SEQ ID NO: 2470285 - RNA, 17 nt, Brucella suis 1330
gugggaaaccgcgcggc

SEQ ID NO: 2470286 - RNA, 18 nt, Brucella suis 1330
gugggccucaagcggcuc

SEQ ID NO: 2470287 - RNA, 19 nt, Brucella suis 1330
guggucccaaagcgggcug

SEQ ID NO: 2470288 - RNA, 16 nt, Brucella suis 1330
guguagcgcagccugg

SEQ ID NO: 2470289 - RNA, 16 nt, Brucella suis 1330
guguaucaccagaccg

SEQ ID NO: 2470290 - RNA, 16 nt, Brucella suis 1330
guguccacgcgcuuga

SEQ ID NO: 2470291 - RNA, 23 nt, Brucella suis 1330
gugucgauugccugugcggcggc

SEQ ID NO: 2470292 - RNA, 17 nt, Brucella suis 1330
gugugacggaugaggcc

SEQ ID NO: 2470293 - RNA, 14 nt, Brucella suis 1330
gugugcgcgcgcca

SEQ ID NO: 2470294 - RNA, 20 nt, Brucella suis 1330
gugugcuugccgaaaagccg

SEQ ID NO: 2470295 - RNA, 15 nt, Brucella suis 1330
guguugagaucgcgc

SEQ ID NO: 2470296 - RNA, 18 nt, Brucella suis 1330
guguuuauucaucgucuu

SEQ ID NO: 2470297 - RNA, 18 nt, Brucella suis 1330
guguuucgguccacacuu

SEQ ID NO: 2470298 - RNA, 21 nt, Brucella suis 1330
guguuucgguccacacuuccg

SEQ ID NO: 2470299 - RNA, 16 nt, Brucella suis 1330
guuaaugccuuugcug

SEQ ID NO: 2470300 - RNA, 18 nt, Brucella suis 1330
guuaccuugccgucacca

SEQ ID NO: 2470301 - RNA, 13 nt, Brucella suis 1330
guuacgccauauu

SEQ ID NO: 2470302 - RNA, 15 nt, Brucella suis 1330
guuacucggccgcgu

SEQ ID NO: 2470303 - RNA, 14 nt, Brucella suis 1330
guuagagcggcucc

SEQ ID NO: 2470304 - RNA, 16 nt, Brucella suis 1330
guuagcgacuucgggu

SEQ ID NO: 2470305 - RNA, 20 nt, Brucella suis 1330
guuaucaagccgguuugcug

SEQ ID NO: 2470306 - RNA, 23 nt, Brucella suis 1330
guuaucauuuauuuuagcugcug

SEQ ID NO: 2470307 - RNA, 20 nt, Brucella suis 1330
guucaagcaguaugauuugu

SEQ ID NO: 2470308 - RNA, 15 nt, Brucella suis 1330
guucagauugcagca

SEQ ID NO: 2470309 - RNA, 19 nt, Brucella suis 1330
guucagccgcuccggcguc

SEQ ID NO: 2470310 - RNA, 18 nt, Brucella suis 1330
guucauguuuugaaucug

SEQ ID NO: 2470311 - RNA, 15 nt, Brucella suis 1330
guuccacgauuuccg

SEQ ID NO: 2470312 - RNA, 20 nt, Brucella suis 1330
guuccacgauuuccgcgaca

SEQ ID NO: 2470313 - RNA, 19 nt, Brucella suis 1330
guuccacggacgaucugga

SEQ ID NO: 2470314 - RNA, 22 nt, Brucella suis 1330
guuccagccguuccucuuccuc

SEQ ID NO: 2470315 - RNA, 14 nt, Brucella suis 1330
guuccagggcgcgc

SEQ ID NO: 2470316 - RNA, 17 nt, Brucella suis 1330
guuccaguccagcgcgc

SEQ ID NO: 2470317 - RNA, 14 nt, Brucella suis 1330
guuccagucgccuu

SEQ ID NO: 2470318 - RNA, 17 nt, Brucella suis 1330
guuccagucgccuuccg

SEQ ID NO: 2470319 - RNA, 21 nt, Brucella suis 1330
guucccucuaaucgcgagcag

SEQ ID NO: 2470320 - RNA, 18 nt, Brucella suis 1330
guuccgaauacaagccca

SEQ ID NO: 2470321 - RNA, 19 nt, Brucella suis 1330
guuccgaccgcaggaccac

SEQ ID NO: 2470322 - RNA, 20 nt, Brucella suis 1330
guuccgcauccgaaaugcgc

SEQ ID NO: 2470323 - RNA, 12 nt, Brucella suis 1330
guuccggcacuc

SEQ ID NO: 2470324 - RNA, 19 nt, Brucella suis 1330
guuccgugccgauuucggc

SEQ ID NO: 2470325 - RNA, 16 nt, Brucella suis 1330
guuccguguugaaaag

SEQ ID NO: 2470326 - RNA, 17 nt, Brucella suis 1330
guuccugcuucaucgcg

SEQ ID NO: 2470327 - RNA, 17 nt, Brucella suis 1330
guuccuguuuuaacaga

SEQ ID NO: 2470328 - RNA, 19 nt, Brucella suis 1330
guucgacuugaagagccgc

SEQ ID NO: 2470329 - RNA, 22 nt, Brucella suis 1330
guucgcucguaacgggagcagc

SEQ ID NO: 2470330 - RNA, 20 nt, Brucella suis 1330
guucggauccuccugcgccc

SEQ ID NO: 2470331 - RNA, 17 nt, Brucella suis 1330
guucggcgagcgucuug

SEQ ID NO: 2470332 - RNA, 19 nt, Brucella suis 1330
guucggcuuccaggccggg

SEQ ID NO: 2470333 - RNA, 14 nt, Brucella suis 1330
guucgggacgaggg

SEQ ID NO: 2470334 - RNA, 12 nt, Brucella suis 1330
guucuaguggau

SEQ ID NO: 2470335 - RNA, 18 nt, Brucella suis 1330
guucucgacaaugccgag

SEQ ID NO: 2470336 - RNA, 16 nt, Brucella suis 1330
guucucgcaaaacacc

SEQ ID NO: 2470337 - RNA, 15 nt, Brucella suis 1330
guucugaaaccgcag

SEQ ID NO: 2470338 - RNA, 17 nt, Brucella suis 1330
guucugcgcggaaacca

SEQ ID NO: 2470339 - RNA, 19 nt, Brucella suis 1330
guucuuccgccagauaaga

SEQ ID NO: 2470340 - RNA, 22 nt, Brucella suis 1330
guucuucggccaugcguugcug

SEQ ID NO: 2470341 - RNA, 16 nt, Brucella suis 1330
guugaaaagggcaagg

SEQ ID NO: 2470342 - RNA, 19 nt, Brucella suis 1330
guugaacgguccaccacau

SEQ ID NO: 2470343 - RNA, 16 nt, Brucella suis 1330
guugaagagccuuuuc

SEQ ID NO: 2470344 - RNA, 16 nt, Brucella suis 1330
guugaccacauugccc

SEQ ID NO: 2470345 - RNA, 16 nt, Brucella suis 1330
guugagaucgcgcgca

SEQ ID NO: 2470346 - RNA, 11 nt, Brucella suis 1330
guugagcuguu

SEQ ID NO: 2470347 - RNA, 16 nt, Brucella suis 1330
guugauggaaggcgcu

SEQ ID NO: 2470348 - RNA, 20 nt, Brucella suis 1330
guugaugucgucaaucgugc

SEQ ID NO: 2470349 - RNA, 17 nt, Brucella suis 1330
guugcaagauccucgcc

SEQ ID NO: 2470350 - RNA, 18 nt, Brucella suis 1330
guugcaccgcucucggcu

SEQ ID NO: 2470351 - RNA, 21 nt, Brucella suis 1330
guugcagccgccagauccgcu

SEQ ID NO: 2470352 - RNA, 15 nt, Brucella suis 1330
guugccacgcgccgc

SEQ ID NO: 2470353 - RNA, 24 nt, Brucella suis 1330
guugccauugacggagccggacgu

SEQ ID NO: 2470354 - RNA, 14 nt, Brucella suis 1330
guugcgauggcgcc

SEQ ID NO: 2470355 - RNA, 20 nt, Brucella suis 1330
guugcgccuggcgcugcugg

SEQ ID NO: 2470356 - RNA, 19 nt, Brucella suis 1330
guugcgcgccagugcgcca

SEQ ID NO: 2470357 - RNA, 14 nt, Brucella suis 1330
guugcuccagcccu

SEQ ID NO: 2470358 - RNA, 18 nt, Brucella suis 1330
guuggcauccacucggcg

SEQ ID NO: 2470359 - RNA, 19 nt, Brucella suis 1330
guugucuucaagcgcaagc

SEQ ID NO: 2470360 - RNA, 22 nt, Brucella suis 1330
guuuaucgggccuuauuggaac

SEQ ID NO: 2470361 - RNA, 21 nt, Brucella suis 1330
guuuauuuugauugguggugc

SEQ ID NO: 2470362 - RNA, 16 nt, Brucella suis 1330
guuucaagcucccaag

SEQ ID NO: 2470363 - RNA, 14 nt, Brucella suis 1330
guuucagcgccacg

SEQ ID NO: 2470364 - RNA, 23 nt, Brucella suis 1330
guuucaguuuguugaaacaggcc

SEQ ID NO: 2470365 - RNA, 20 nt, Brucella suis 1330
guuucauuuccucaaaacuu

SEQ ID NO: 2470366 - RNA, 20 nt, Brucella suis 1330
guuuccagccugcugcaucc

SEQ ID NO: 2470367 - RNA, 12 nt, Brucella suis 1330
guuuccgccauc

SEQ ID NO: 2470368 - RNA, 18 nt, Brucella suis 1330
guuuccggcugccuuggc

SEQ ID NO: 2470369 - RNA, 19 nt, Brucella suis 1330
guuucgaucacaacgccgu

SEQ ID NO: 2470370 - RNA, 18 nt, Brucella suis 1330
guuucgaucugauugaau

SEQ ID NO: 2470371 - RNA, 19 nt, Brucella suis 1330
guuucggcggcuuuccagu

SEQ ID NO: 2470372 - RNA, 20 nt, Brucella suis 1330
guuucucugcucgccugcac

SEQ ID NO: 2470373 - RNA, 22 nt, Brucella suis 1330
guuugccgucgaagcgcugcaa

SEQ ID NO: 2470374 - RNA, 15 nt, Brucella suis 1330
guuugguuuuagaag

SEQ ID NO: 2470375 - RNA, 17 nt, Brucella suis 1330
guuuuaaccggaagcgc

SEQ ID NO: 2470376 - RNA, 16 nt, Brucella suis 1330
guuuuaucgcauuauc

SEQ ID NO: 2470377 - RNA, 15 nt, Brucella suis 1330
guuuucagcggcggg

SEQ ID NO: 2470378 - RNA, 20 nt, Brucella suis 1330
guuuuccgguagcgaaugca

SEQ ID NO: 2470379 - RNA, 21 nt, Brucella suis 1330
guuuuccgucugcaucgagcg

SEQ ID NO: 2470380 - RNA, 13 nt, Brucella suis 1330
guuuucgaggcca

SEQ ID NO: 2470381 - RNA, 12 nt, Brucella suis 1330
guuuugagcugc

SEQ ID NO: 2470382 - RNA, 14 nt, Brucella suis 1330
guuuugagcugcug

SEQ ID NO: 2470383 - RNA, 20 nt, Brucella suis 1330
guuuugcguuggaaaaugcg

SEQ ID NO: 2470384 - RNA, 19 nt, Brucella suis 1330
guuuuucacauagccugca

SEQ ID NO: 2470385 - RNA, 19 nt, Brucella suis 1330
guuuuucuuuguccagaaa

SEQ ID NO: 2470386 - RNA, 13 nt, Brucella suis 1330
uaaaaccggaacc

SEQ ID NO: 2470387 - RNA, 22 nt, Brucella suis 1330
uaaaaggcaaagccgaaugcca

SEQ ID NO: 2470388 - RNA, 16 nt, Brucella suis 1330
uaaacagcguuuccau

SEQ ID NO: 2470389 - RNA, 22 nt, Brucella suis 1330
uaaaccucccuguccugccagc

SEQ ID NO: 2470390 - RNA, 17 nt, Brucella suis 1330
uaaaccuuugaaauaau

SEQ ID NO: 2470391 - RNA, 19 nt, Brucella suis 1330
uaaaccuuugaaauaauug

SEQ ID NO: 2470392 - RNA, 15 nt, Brucella suis 1330
uaaacgcaccaagac

SEQ ID NO: 2470393 - RNA, 22 nt, Brucella suis 1330
uaaacugaauccgcgacgccgc

SEQ ID NO: 2470394 - RNA, 13 nt, Brucella suis 1330
uaaagaccacgaa

SEQ ID NO: 2470395 - RNA, 13 nt, Brucella suis 1330
uaaagcaaaggcc

SEQ ID NO: 2470396 - RNA, 18 nt, Brucella suis 1330
uaaagcacagccagaaag

SEQ ID NO: 2470397 - RNA, 22 nt, Brucella suis 1330
uaaagcacagccagaaagaaga

SEQ ID NO: 2470398 - RNA, 22 nt, Brucella suis 1330
uaaaggccgaaauagcggcccg

SEQ ID NO: 2470399 - RNA, 18 nt, Brucella suis 1330
uaaaggcgaguuuucaaa

SEQ ID NO: 2470400 - RNA, 17 nt, Brucella suis 1330
uaaaguacacuccgcuc

SEQ ID NO: 2470401 - RNA, 21 nt, Brucella suis 1330
uaaauauucaggaucuuucca

SEQ ID NO: 2470402 - RNA, 16 nt, Brucella suis 1330
uaaauccuccagauug

SEQ ID NO: 2470403 - RNA, 21 nt, Brucella suis 1330
uaaaugcacccggcaccgcaa

SEQ ID NO: 2470404 - RNA, 21 nt, Brucella suis 1330
uaaaugccggcgaucuuuucg

SEQ ID NO: 2470405 - RNA, 22 nt, Brucella suis 1330
uaacaaaggccgccguccccac

SEQ ID NO: 2470406 - RNA, 16 nt, Brucella suis 1330
uaacagucgaagcggc

SEQ ID NO: 2470407 - RNA, 14 nt, Brucella suis 1330
uaaccgccaccuuc

SEQ ID NO: 2470408 - RNA, 13 nt, Brucella suis 1330
uaacgacgaacga

SEQ ID NO: 2470409 - RNA, 16 nt, Brucella suis 1330
uaacggugaucggcgu

SEQ ID NO: 2470410 - RNA, 21 nt, Brucella suis 1330
uaacuuccgguauaugcacca

SEQ ID NO: 2470411 - RNA, 18 nt, Brucella suis 1330
uaagccccggcaucacug

SEQ ID NO: 2470412 - RNA, 22 nt, Brucella suis 1330
uaagccggcaugaaugugccug

SEQ ID NO: 2470413 - RNA, 17 nt, Brucella suis 1330
uaagcgccuuugccgcg

SEQ ID NO: 2470414 - RNA, 19 nt, Brucella suis 1330
uaagcggaaaacggcugca

SEQ ID NO: 2470415 - RNA, 22 nt, Brucella suis 1330
uaagcggaaaacggcugcaaca

SEQ ID NO: 2470416 - RNA, 21 nt, Brucella suis 1330
uaagcuuuucauuuuccucau

SEQ ID NO: 2470417 - RNA, 18 nt, Brucella suis 1330
uaaggcccccagaaggcg

SEQ ID NO: 2470418 - RNA, 13 nt, Brucella suis 1330
uaaggccugcugg

SEQ ID NO: 2470419 - RNA, 12 nt, Brucella suis 1330
uaaggcggaugc

SEQ ID NO: 2470420 - RNA, 20 nt, Brucella suis 1330
uaaguuuggcuaaagauacc

SEQ ID NO: 2470421 - RNA, 23 nt, Brucella suis 1330
uaauagaugagcugguuuuucac

SEQ ID NO: 2470422 - RNA, 16 nt, Brucella suis 1330
uaauagucgaaaaaag

SEQ ID NO: 2470423 - RNA, 18 nt, Brucella suis 1330
uaauagucgaaaaaagaa

SEQ ID NO: 2470424 - RNA, 21 nt, Brucella suis 1330
uaaucaaaaacaaucuccggc

SEQ ID NO: 2470425 - RNA, 17 nt, Brucella suis 1330
uaauccucacggccaua

SEQ ID NO: 2470426 - RNA, 23 nt, Brucella suis 1330
uaaucgcaaaaaauaucuuuuuu

SEQ ID NO: 2470427 - RNA, 15 nt, Brucella suis 1330
uaaucguaucgccaa

SEQ ID NO: 2470428 - RNA, 20 nt, Brucella suis 1330
uaaugcguaaaaauaaagaa

SEQ ID NO: 2470429 - RNA, 22 nt, Brucella suis 1330
uacaaaugcaagugugcgcgcg

SEQ ID NO: 2470430 - RNA, 18 nt, Brucella suis 1330
uacagccuaaucaaaaga

SEQ ID NO: 2470431 - RNA, 17 nt, Brucella suis 1330
uacagugacgcgcgcau

SEQ ID NO: 2470432 - RNA, 17 nt, Brucella suis 1330
uacauauacuuacuagu

SEQ ID NO: 2470433 - RNA, 21 nt, Brucella suis 1330
uacaucaaaccaguugaagcu

SEQ ID NO: 2470434 - RNA, 17 nt, Brucella suis 1330
uacauuuuugaaaacau

SEQ ID NO: 2470435 - RNA, 21 nt, Brucella suis 1330
uaccaacccuuuuccgcaccg

SEQ ID NO: 2470436 - RNA, 19 nt, Brucella suis 1330
uaccaagcgcauccagccg

SEQ ID NO: 2470437 - RNA, 16 nt, Brucella suis 1330
uaccaaggcccgccuc

SEQ ID NO: 2470438 - RNA, 13 nt, Brucella suis 1330
uaccauaacgcuu

SEQ ID NO: 2470439 - RNA, 19 nt, Brucella suis 1330
uaccauaggccguuccgcc

SEQ ID NO: 2470440 - RNA, 12 nt, Brucella suis 1330
uaccauauccuc

SEQ ID NO: 2470441 - RNA, 16 nt, Brucella suis 1330
uaccgccaaggaacgc

SEQ ID NO: 2470442 - RNA, 21 nt, Brucella suis 1330
uaccgccggggcugccgaugg

SEQ ID NO: 2470443 - RNA, 16 nt, Brucella suis 1330
uaccggcaucagccuu

SEQ ID NO: 2470444 - RNA, 17 nt, Brucella suis 1330
uaccggcaucagccuuc

SEQ ID NO: 2470445 - RNA, 11 nt, Brucella suis 1330
uaccuuccagc

SEQ ID NO: 2470446 - RNA, 21 nt, Brucella suis 1330
uacgcagccgaugccuugauc

SEQ ID NO: 2470447 - RNA, 12 nt, Brucella suis 1330
uacgcuccgccc

SEQ ID NO: 2470448 - RNA, 19 nt, Brucella suis 1330
uacggcccucgaccgccac

SEQ ID NO: 2470449 - RNA, 15 nt, Brucella suis 1330
uacggcggaucuugc

SEQ ID NO: 2470450 - RNA, 15 nt, Brucella suis 1330
uacgggugcuugccu

SEQ ID NO: 2470451 - RNA, 13 nt, Brucella suis 1330
uacgugcaagagc

SEQ ID NO: 2470452 - RNA, 15 nt, Brucella suis 1330
uacgugcaagagcaa

SEQ ID NO: 2470453 - RNA, 16 nt, Brucella suis 1330
uacguggcuugaagcu

SEQ ID NO: 2470454 - RNA, 21 nt, Brucella suis 1330
uacguggcuugaagcugccgc

SEQ ID NO: 2470455 - RNA, 14 nt, Brucella suis 1330
uacuaguggucuuu

SEQ ID NO: 2470456 - RNA, 22 nt, Brucella suis 1330
uacugcccuauugccuuaaucc

SEQ ID NO: 2470457 - RNA, 11 nt, Brucella suis 1330
uacuggcaaua

SEQ ID NO: 2470458 - RNA, 13 nt, Brucella suis 1330
uacuggccaagcg

SEQ ID NO: 2470459 - RNA, 12 nt, Brucella suis 1330
uacuguuagagc

SEQ ID NO: 2470460 - RNA, 12 nt, Brucella suis 1330
uagaaugcgcuu

SEQ ID NO: 2470461 - RNA, 19 nt, Brucella suis 1330
uagaauucgaugacuuccg

SEQ ID NO: 2470462 - RNA, 18 nt, Brucella suis 1330
uagagcauuuccagcaaa

SEQ ID NO: 2470463 - RNA, 20 nt, Brucella suis 1330
uagagcauuuccagcaaaag

SEQ ID NO: 2470464 - RNA, 21 nt, Brucella suis 1330
uagagcauuuccagcaaaagu

SEQ ID NO: 2470465 - RNA, 22 nt, Brucella suis 1330
uagagcgcguuucgaucugauu

SEQ ID NO: 2470466 - RNA, 15 nt, Brucella suis 1330
uagauauuucuucca

SEQ ID NO: 2470467 - RNA, 18 nt, Brucella suis 1330
uagaucggaugcuccacg

SEQ ID NO: 2470468 - RNA, 20 nt, Brucella suis 1330
uagaugagcugguuuuucac

SEQ ID NO: 2470469 - RNA, 18 nt, Brucella suis 1330
uagauguucuuccccguc

SEQ ID NO: 2470470 - RNA, 15 nt, Brucella suis 1330
uagcagcaacaggca

SEQ ID NO: 2470471 - RNA, 19 nt, Brucella suis 1330
uagcccugaucguaaagca

SEQ ID NO: 2470472 - RNA, 18 nt, Brucella suis 1330
uagccgccaagccagccc

SEQ ID NO: 2470473 - RNA, 19 nt, Brucella suis 1330
uagccgcgaaccgucgcca

SEQ ID NO: 2470474 - RNA, 17 nt, Brucella suis 1330
uagccgguauccagcag

SEQ ID NO: 2470475 - RNA, 19 nt, Brucella suis 1330
uagccggucgagccgacau

SEQ ID NO: 2470476 - RNA, 13 nt, Brucella suis 1330
uagccugacccgg

SEQ ID NO: 2470477 - RNA, 16 nt, Brucella suis 1330
uagccugacccggccu

SEQ ID NO: 2470478 - RNA, 13 nt, Brucella suis 1330
uagccuuggcccu

SEQ ID NO: 2470479 - RNA, 17 nt, Brucella suis 1330
uagcgcauggcagcaaa

SEQ ID NO: 2470480 - RNA, 18 nt, Brucella suis 1330
uagcgccggaaugggccu

SEQ ID NO: 2470481 - RNA, 13 nt, Brucella suis 1330
uagcgcgcaccga

SEQ ID NO: 2470482 - RNA, 17 nt, Brucella suis 1330
uagcucgacgcuuucca

SEQ ID NO: 2470483 - RNA, 11 nt, Brucella suis 1330
uagcugcaucc

SEQ ID NO: 2470484 - RNA, 14 nt, Brucella suis 1330
uagcuggaaaaaau

SEQ ID NO: 2470485 - RNA, 15 nt, Brucella suis 1330
uagcuuaugcgcgcc

SEQ ID NO: 2470486 - RNA, 22 nt, Brucella suis 1330
uaggauaaugcgauaaaacaaa

SEQ ID NO: 2470487 - RNA, 15 nt, Brucella suis 1330
uaggauucuccuauu

SEQ ID NO: 2470488 - RNA, 20 nt, Brucella suis 1330
uaggcaacaucgccuugcgg

SEQ ID NO: 2470489 - RNA, 23 nt, Brucella suis 1330
uaggcacccuugguugcgcgcca

SEQ ID NO: 2470490 - RNA, 22 nt, Brucella suis 1330
uaggcagcgauauccggcacgg

SEQ ID NO: 2470491 - RNA, 14 nt, Brucella suis 1330
uaggcauaaucuuu

SEQ ID NO: 2470492 - RNA, 17 nt, Brucella suis 1330
uaggcgcgcgcaagggc

SEQ ID NO: 2470493 - RNA, 13 nt, Brucella suis 1330
uagggcaaggagc

SEQ ID NO: 2470494 - RNA, 20 nt, Brucella suis 1330
uagggcaaggagcgagcuug

SEQ ID NO: 2470495 - RNA, 21 nt, Brucella suis 1330
uagggcguaaucagcgucagc

SEQ ID NO: 2470496 - RNA, 20 nt, Brucella suis 1330
uaggucagcaggcgccgugc

SEQ ID NO: 2470497 - RNA, 15 nt, Brucella suis 1330
uaggugagcggcagg

SEQ ID NO: 2470498 - RNA, 15 nt, Brucella suis 1330
uaguuagcgacugcu

SEQ ID NO: 2470499 - RNA, 19 nt, Brucella suis 1330
uauacucggcguuuacuuu

SEQ ID NO: 2470500 - RNA, 13 nt, Brucella suis 1330
uauaugcaccagc

SEQ ID NO: 2470501 - RNA, 15 nt, Brucella suis 1330
uaucagcucuucaca

SEQ ID NO: 2470502 - RNA, 18 nt, Brucella suis 1330
uaucagcuuauucuaaag

SEQ ID NO: 2470503 - RNA, 16 nt, Brucella suis 1330
uauccaccuggccgcc

SEQ ID NO: 2470504 - RNA, 18 nt, Brucella suis 1330
uauccacgauauguuccg

SEQ ID NO: 2470505 - RNA, 16 nt, Brucella suis 1330
uauccagccgccgggg

SEQ ID NO: 2470506 - RNA, 19 nt, Brucella suis 1330
uauccaguuuauucauugg

SEQ ID NO: 2470507 - RNA, 21 nt, Brucella suis 1330
uauccgccaccgguuuucauc

SEQ ID NO: 2470508 - RNA, 16 nt, Brucella suis 1330
uauccggcucauucug

SEQ ID NO: 2470509 - RNA, 15 nt, Brucella suis 1330
uauccgugcccggca

SEQ ID NO: 2470510 - RNA, 18 nt, Brucella suis 1330
uauccugaaaauacucua

SEQ ID NO: 2470511 - RNA, 18 nt, Brucella suis 1330
uauccuggccuuccuuga

SEQ ID NO: 2470512 - RNA, 15 nt, Brucella suis 1330
uaucgauaucugcaa

SEQ ID NO: 2470513 - RNA, 15 nt, Brucella suis 1330
uaucgccugcuuccu

SEQ ID NO: 2470514 - RNA, 21 nt, Brucella suis 1330
uaucgcgaagaagaauacgca

SEQ ID NO: 2470515 - RNA, 16 nt, Brucella suis 1330
uaucgcggaucggcag

SEQ ID NO: 2470516 - RNA, 21 nt, Brucella suis 1330
uaucggggcguccgccaccgc

SEQ ID NO: 2470517 - RNA, 20 nt, Brucella suis 1330
uaucucuuuguuuugccgca

SEQ ID NO: 2470518 - RNA, 15 nt, Brucella suis 1330
uaucuuccagagcgg

SEQ ID NO: 2470519 - RNA, 12 nt, Brucella suis 1330
uaucuuccugaa

SEQ ID NO: 2470520 - RNA, 13 nt, Brucella suis 1330
uaucuuuuuucaa

SEQ ID NO: 2470521 - RNA, 22 nt, Brucella suis 1330
uaugcaccagcgucuguacaua

SEQ ID NO: 2470522 - RNA, 18 nt, Brucella suis 1330
uaugcggggcgacgcugc

SEQ ID NO: 2470523 - RNA, 15 nt, Brucella suis 1330
uauggaugccgccgc

SEQ ID NO: 2470524 - RNA, 17 nt, Brucella suis 1330
uauucaaccguuuccug

SEQ ID NO: 2470525 - RNA, 18 nt, Brucella suis 1330
uauucaaccguuuccuga

SEQ ID NO: 2470526 - RNA, 18 nt, Brucella suis 1330
uauuccacauugccuucg

SEQ ID NO: 2470527 - RNA, 22 nt, Brucella suis 1330
uauuccaucagccgggcagugc

SEQ ID NO: 2470528 - RNA, 18 nt, Brucella suis 1330
uauuccccuauuccccua

SEQ ID NO: 2470529 - RNA, 14 nt, Brucella suis 1330
uauuccgccugcaa

SEQ ID NO: 2470530 - RNA, 23 nt, Brucella suis 1330
uauucggcgaccgccuuuuccag

SEQ ID NO: 2470531 - RNA, 19 nt, Brucella suis 1330
uauucgugccuggcgaaaa

SEQ ID NO: 2470532 - RNA, 13 nt, Brucella suis 1330
uauucuugcgaac

SEQ ID NO: 2470533 - RNA, 20 nt, Brucella suis 1330
uauugcccuuccgggccgca

SEQ ID NO: 2470534 - RNA, 21 nt, Brucella suis 1330
uauugccgagcauggccugcg

SEQ ID NO: 2470535 - RNA, 17 nt, Brucella suis 1330
uauugccuuaaucccuu

SEQ ID NO: 2470536 - RNA, 22 nt, Brucella suis 1330
uauuuagauuugcuuaaguguc

SEQ ID NO: 2470537 - RNA, 18 nt, Brucella suis 1330
uauuuauucugacgcgca

SEQ ID NO: 2470538 - RNA, 23 nt, Brucella suis 1330
uauuuauucugacgcgcaucuua

SEQ ID NO: 2470539 - RNA, 18 nt, Brucella suis 1330
uauuuccaucgcuugaac

SEQ ID NO: 2470540 - RNA, 13 nt, Brucella suis 1330
uauuucgcgcgca

SEQ ID NO: 2470541 - RNA, 14 nt, Brucella suis 1330
uauuugaacaaaga

SEQ ID NO: 2470542 - RNA, 15 nt, Brucella suis 1330
uauuugaacaaagau

SEQ ID NO: 2470543 - RNA, 21 nt, Brucella suis 1330
uauuuggcacucauuaucagc

SEQ ID NO: 2470544 - RNA, 14 nt, Brucella suis 1330
uauuuuagcugcug

SEQ ID NO: 2470545 - RNA, 22 nt, Brucella suis 1330
uauuuucgagccaaaagugcgc

SEQ ID NO: 2470546 - RNA, 21 nt, Brucella suis 1330
ucaaaaacgagggguuuugau

SEQ ID NO: 2470547 - RNA, 12 nt, Brucella suis 1330
ucaaaacaaagg

SEQ ID NO: 2470548 - RNA, 13 nt, Brucella suis 1330
ucaaaacgcagca

SEQ ID NO: 2470549 - RNA, 17 nt, Brucella suis 1330
ucaaaacgcugccagcc

SEQ ID NO: 2470550 - RNA, 22 nt, Brucella suis 1330
ucaaaacuuucccggcgcacgg

SEQ ID NO: 2470551 - RNA, 16 nt, Brucella suis 1330
ucaaaagcuggaugau

SEQ ID NO: 2470552 - RNA, 21 nt, Brucella suis 1330
ucaaaccaaaaaaccuccggu

SEQ ID NO: 2470553 - RNA, 19 nt, Brucella suis 1330
ucaaaccggccaugcccau

SEQ ID NO: 2470554 - RNA, 18 nt, Brucella suis 1330
ucaaagcgcggaaugaca

SEQ ID NO: 2470555 - RNA, 15 nt, Brucella suis 1330
ucaaagcgcguuuca

SEQ ID NO: 2470556 - RNA, 17 nt, Brucella suis 1330
ucaaaggaaagauccuu

SEQ ID NO: 2470557 - RNA, 23 nt, Brucella suis 1330
ucaaaggaaagauccuucacaua

SEQ ID NO: 2470558 - RNA, 20 nt, Brucella suis 1330
ucaaaguuaaugccuuugcu

SEQ ID NO: 2470559 - RNA, 22 nt, Brucella suis 1330
ucaacagccuuggcuuccagcg

SEQ ID NO: 2470560 - RNA, 15 nt, Brucella suis 1330
ucaacaugcacaucc

SEQ ID NO: 2470561 - RNA, 15 nt, Brucella suis 1330
ucaaccgugcauucu

SEQ ID NO: 2470562 - RNA, 15 nt, Brucella suis 1330
ucaacuggcgcagca

SEQ ID NO: 2470563 - RNA, 18 nt, Brucella suis 1330
ucaacuggcgcagcagca

SEQ ID NO: 2470564 - RNA, 21 nt, Brucella suis 1330
ucaacuguguugccagcagcg

SEQ ID NO: 2470565 - RNA, 15 nt, Brucella suis 1330
ucaagaaugugccgc

SEQ ID NO: 2470566 - RNA, 21 nt, Brucella suis 1330
ucaagaggaacgacuuuggcc

SEQ ID NO: 2470567 - RNA, 17 nt, Brucella suis 1330
ucaagauagcccggcag

SEQ ID NO: 2470568 - RNA, 21 nt, Brucella suis 1330
ucaagcaguaugauuugucgg

SEQ ID NO: 2470569 - RNA, 17 nt, Brucella suis 1330
ucaagcaucuugauuuc

SEQ ID NO: 2470570 - RNA, 19 nt, Brucella suis 1330
ucaagcggcuccaccaccu

SEQ ID NO: 2470571 - RNA, 18 nt, Brucella suis 1330
ucaaggcccggugcaauc

SEQ ID NO: 2470572 - RNA, 16 nt, Brucella suis 1330
ucaauaagcuuuucau

SEQ ID NO: 2470573 - RNA, 19 nt, Brucella suis 1330
ucaauacccaugccuuuca

SEQ ID NO: 2470574 - RNA, 19 nt, Brucella suis 1330
ucaaucacgccacugcccu

SEQ ID NO: 2470575 - RNA, 19 nt, Brucella suis 1330
ucaaucgcgccgucgccga

SEQ ID NO: 2470576 - RNA, 15 nt, Brucella suis 1330
ucaaugaucuggcuu

SEQ ID NO: 2470577 - RNA, 12 nt, Brucella suis 1330
ucaaugccaccg

SEQ ID NO: 2470578 - RNA, 11 nt, Brucella suis 1330
ucaaugcugca

SEQ ID NO: 2470579 - RNA, 15 nt, Brucella suis 1330
ucaauggccgcgcgg

SEQ ID NO: 2470580 - RNA, 13 nt, Brucella suis 1330
ucaauucacccuu

SEQ ID NO: 2470581 - RNA, 19 nt, Brucella suis 1330
ucacacugcaaaacugaag

SEQ ID NO: 2470582 - RNA, 21 nt, Brucella suis 1330
ucacagccgcgccaauccagg

SEQ ID NO: 2470583 - RNA, 17 nt, Brucella suis 1330
ucacauuucaugaaaau

SEQ ID NO: 2470584 - RNA, 19 nt, Brucella suis 1330
ucaccacgauuucgcccac

SEQ ID NO: 2470585 - RNA, 17 nt, Brucella suis 1330
ucaccagcgucgcaccg

SEQ ID NO: 2470586 - RNA, 17 nt, Brucella suis 1330
ucaccgagggcagcuuc

SEQ ID NO: 2470587 - RNA, 21 nt, Brucella suis 1330
ucaccgcgacgcuucuugcug

SEQ ID NO: 2470588 - RNA, 22 nt, Brucella suis 1330
ucaccgcgacgcuucuugcugu

SEQ ID NO: 2470589 - RNA, 23 nt, Brucella suis 1330
ucaccggcuggcacaaagcggcc

SEQ ID NO: 2470590 - RNA, 14 nt, Brucella suis 1330
ucaccggcugggcc

SEQ ID NO: 2470591 - RNA, 22 nt, Brucella suis 1330
ucaccggcugggccuuguuuuc

SEQ ID NO: 2470592 - RNA, 19 nt, Brucella suis 1330
ucaccugacggauuucggc

SEQ ID NO: 2470593 - RNA, 15 nt, Brucella suis 1330
ucaccugagcaagag

SEQ ID NO: 2470594 - RNA, 13 nt, Brucella suis 1330
ucaccuguggcug

SEQ ID NO: 2470595 - RNA, 13 nt, Brucella suis 1330
ucacgaucuugcc

SEQ ID NO: 2470596 - RNA, 12 nt, Brucella suis 1330
ucacgcagcgug

SEQ ID NO: 2470597 - RNA, 18 nt, Brucella suis 1330
ucacgccgucaaaggaaa

SEQ ID NO: 2470598 - RNA, 15 nt, Brucella suis 1330
ucacgcgcagcagca

SEQ ID NO: 2470599 - RNA, 22 nt, Brucella suis 1330
ucacgcgcagcagcaucgccgc

SEQ ID NO: 2470600 - RNA, 12 nt, Brucella suis 1330
ucacgcggcgca

SEQ ID NO: 2470601 - RNA, 17 nt, Brucella suis 1330
ucacggaacgucacaga

SEQ ID NO: 2470602 - RNA, 23 nt, Brucella suis 1330
ucacggaguguagcgcagccugg

SEQ ID NO: 2470603 - RNA, 24 nt, Brucella suis 1330
ucacguaggcgcggcguggaaagc

SEQ ID NO: 2470604 - RNA, 19 nt, Brucella suis 1330
ucacguaggggucuucucu

SEQ ID NO: 2470605 - RNA, 18 nt, Brucella suis 1330
ucacguuugacagccugg

SEQ ID NO: 2470606 - RNA, 19 nt, Brucella suis 1330
ucacuggcaacgacggcug

SEQ ID NO: 2470607 - RNA, 21 nt, Brucella suis 1330
ucacuucgucgcugacuucaa

SEQ ID NO: 2470608 - RNA, 16 nt, Brucella suis 1330
ucagaaagaaagcugu

SEQ ID NO: 2470609 - RNA, 16 nt, Brucella suis 1330
ucagaaagucugcuuc

SEQ ID NO: 2470610 - RNA, 12 nt, Brucella suis 1330
ucagaaccggaa

SEQ ID NO: 2470611 - RNA, 21 nt, Brucella suis 1330
ucagaaccggaauaucuacag

SEQ ID NO: 2470612 - RNA, 17 nt, Brucella suis 1330
ucagaagugcugcugca

SEQ ID NO: 2470613 - RNA, 15 nt, Brucella suis 1330
ucagacgauccucaa

SEQ ID NO: 2470614 - RNA, 15 nt, Brucella suis 1330
ucagagcuucauugu

SEQ ID NO: 2470615 - RNA, 20 nt, Brucella suis 1330
ucagagcuucauugucccaa

SEQ ID NO: 2470616 - RNA, 22 nt, Brucella suis 1330
ucagaucgacgcagaaauugca

SEQ ID NO: 2470617 - RNA, 16 nt, Brucella suis 1330
ucagaucgcgcggcga

SEQ ID NO: 2470618 - RNA, 18 nt, Brucella suis 1330
ucagauugaugaaaaacc

SEQ ID NO: 2470619 - RNA, 22 nt, Brucella suis 1330
ucagcaaguuuaucggccugau

SEQ ID NO: 2470620 - RNA, 16 nt, Brucella suis 1330
ucagcacaagccaucc

SEQ ID NO: 2470621 - RNA, 15 nt, Brucella suis 1330
ucagcaggcgccgug

SEQ ID NO: 2470622 - RNA, 15 nt, Brucella suis 1330
ucagcaggcguugca

SEQ ID NO: 2470623 - RNA, 23 nt, Brucella suis 1330
ucagcauugaacgccuuuuucac

SEQ ID NO: 2470624 - RNA, 15 nt, Brucella suis 1330
ucagccgcccgccuu

SEQ ID NO: 2470625 - RNA, 15 nt, Brucella suis 1330
ucagccguugcgauc

SEQ ID NO: 2470626 - RNA, 15 nt, Brucella suis 1330
ucagccucccuucau

SEQ ID NO: 2470627 - RNA, 23 nt, Brucella suis 1330
ucagccucggaaaaguccuuucc

SEQ ID NO: 2470628 - RNA, 14 nt, Brucella suis 1330
ucagcgauggcgac

SEQ ID NO: 2470629 - RNA, 16 nt, Brucella suis 1330
ucagcgcaaagccugc

SEQ ID NO: 2470630 - RNA, 15 nt, Brucella suis 1330
ucagcgccacgccuu

SEQ ID NO: 2470631 - RNA, 18 nt, Brucella suis 1330
ucagcgccgcccagggca

SEQ ID NO: 2470632 - RNA, 20 nt, Brucella suis 1330
ucagcgcgccguaauggcgc

SEQ ID NO: 2470633 - RNA, 19 nt, Brucella suis 1330
ucagcggauauucggcguu

SEQ ID NO: 2470634 - RNA, 15 nt, Brucella suis 1330
ucagcgucagcgcaa

SEQ ID NO: 2470635 - RNA, 16 nt, Brucella suis 1330
ucagcucgaaauccag

SEQ ID NO: 2470636 - RNA, 15 nt, Brucella suis 1330
ucagcucguccauga

SEQ ID NO: 2470637 - RNA, 15 nt, Brucella suis 1330
ucagcuuauucuaaa

SEQ ID NO: 2470638 - RNA, 20 nt, Brucella suis 1330
ucagcuugccgccaaucccc

SEQ ID NO: 2470639 - RNA, 22 nt, Brucella suis 1330
ucagcuugccgccaauccccuc

SEQ ID NO: 2470640 - RNA, 20 nt, Brucella suis 1330
ucagcuuuuccaucacuucg

SEQ ID NO: 2470641 - RNA, 21 nt, Brucella suis 1330
ucaggauaucgccguccuuug

SEQ ID NO: 2470642 - RNA, 21 nt, Brucella suis 1330
ucaggaucuuuccaaguucau

SEQ ID NO: 2470643 - RNA, 14 nt, Brucella suis 1330
ucaggaugagggag

SEQ ID NO: 2470644 - RNA, 15 nt, Brucella suis 1330
ucaggccaaagccuu

SEQ ID NO: 2470645 - RNA, 19 nt, Brucella suis 1330
ucaggccaagugcggucug

SEQ ID NO: 2470646 - RNA, 18 nt, Brucella suis 1330
ucaggcccagaugcagcg

SEQ ID NO: 2470647 - RNA, 21 nt, Brucella suis 1330
ucaggcccagaugcagcggcg

SEQ ID NO: 2470648 - RNA, 18 nt, Brucella suis 1330
ucaggcccuugucgcgca

SEQ ID NO: 2470649 - RNA, 20 nt, Brucella suis 1330
ucaggcccuugucgcgcaac

SEQ ID NO: 2470650 - RNA, 16 nt, Brucella suis 1330
ucaggcuacugacaaa

SEQ ID NO: 2470651 - RNA, 17 nt, Brucella suis 1330
ucagggacgagcggcag

SEQ ID NO: 2470652 - RNA, 19 nt, Brucella suis 1330
ucagggcaaucugcgcugc

SEQ ID NO: 2470653 - RNA, 20 nt, Brucella suis 1330
ucagggcaaucugcgcugcc

SEQ ID NO: 2470654 - RNA, 19 nt, Brucella suis 1330
ucagggccacuccguugcc

SEQ ID NO: 2470655 - RNA, 16 nt, Brucella suis 1330
ucaggucgcuuucgau

SEQ ID NO: 2470656 - RNA, 20 nt, Brucella suis 1330
ucaggucggcauugaucaac

SEQ ID NO: 2470657 - RNA, 17 nt, Brucella suis 1330
ucaggucgucuuucagu

SEQ ID NO: 2470658 - RNA, 16 nt, Brucella suis 1330
ucagguuacauggacg

SEQ ID NO: 2470659 - RNA, 15 nt, Brucella suis 1330
ucagucgaauuucag

SEQ ID NO: 2470660 - RNA, 14 nt, Brucella suis 1330
ucagugccaccaga

SEQ ID NO: 2470661 - RNA, 18 nt, Brucella suis 1330
ucaguuuguugaaacagg

SEQ ID NO: 2470662 - RNA, 14 nt, Brucella suis 1330
ucauaaugcaugga

SEQ ID NO: 2470663 - RNA, 20 nt, Brucella suis 1330
ucauaaugcauggaggcaag

SEQ ID NO: 2470664 - RNA, 15 nt, Brucella suis 1330
ucauaguguggaauu

SEQ ID NO: 2470665 - RNA, 17 nt, Brucella suis 1330
ucauaucguugccgauc

SEQ ID NO: 2470666 - RNA, 22 nt, Brucella suis 1330
ucaucaaaagcgucgcaaugcc

SEQ ID NO: 2470667 - RNA, 16 nt, Brucella suis 1330
ucaucaaggaaaaaac

SEQ ID NO: 2470668 - RNA, 18 nt, Brucella suis 1330
ucaucaaggaaaaaaccg

SEQ ID NO: 2470669 - RNA, 16 nt, Brucella suis 1330
ucaucaaucugacccg

SEQ ID NO: 2470670 - RNA, 20 nt, Brucella suis 1330
ucaucaccgcgggaaaaauc

SEQ ID NO: 2470671 - RNA, 20 nt, Brucella suis 1330
ucaucagcccauagaucaga

SEQ ID NO: 2470672 - RNA, 16 nt, Brucella suis 1330
ucauccagucauggcg

SEQ ID NO: 2470673 - RNA, 17 nt, Brucella suis 1330
ucauccagucauggcgc

SEQ ID NO: 2470674 - RNA, 20 nt, Brucella suis 1330
ucauccgccuuggaugccgc

SEQ ID NO: 2470675 - RNA, 16 nt, Brucella suis 1330
ucauccuugaugccca

SEQ ID NO: 2470676 - RNA, 16 nt, Brucella suis 1330
ucaucgauaugcgcga

SEQ ID NO: 2470677 - RNA, 15 nt, Brucella suis 1330
ucaucgccaccaugg

SEQ ID NO: 2470678 - RNA, 16 nt, Brucella suis 1330
ucaucgcccucgcgcc

SEQ ID NO: 2470679 - RNA, 12 nt, Brucella suis 1330
ucaucgcggcag

SEQ ID NO: 2470680 - RNA, 21 nt, Brucella suis 1330
ucaucgcggcagccgccgccg

SEQ ID NO: 2470681 - RNA, 16 nt, Brucella suis 1330
ucaucggcaagcggcu

SEQ ID NO: 2470682 - RNA, 15 nt, Brucella suis 1330
ucaucucguucacaa

SEQ ID NO: 2470683 - RNA, 17 nt, Brucella suis 1330
ucaucugccaaccauug

SEQ ID NO: 2470684 - RNA, 23 nt, Brucella suis 1330
ucaucuggcgggguuuuuuauug

SEQ ID NO: 2470685 - RNA, 13 nt, Brucella suis 1330
ucaugauggaaga

SEQ ID NO: 2470686 - RNA, 19 nt, Brucella suis 1330
ucaugcaggcggaagggcc

SEQ ID NO: 2470687 - RNA, 14 nt, Brucella suis 1330
ucaugcccugacuc

SEQ ID NO: 2470688 - RNA, 14 nt, Brucella suis 1330
ucaugcgcggcaug

SEQ ID NO: 2470689 - RNA, 15 nt, Brucella suis 1330
ucauggccgccccgg

SEQ ID NO: 2470690 - RNA, 18 nt, Brucella suis 1330
ucauggcuugaagcguga

SEQ ID NO: 2470691 - RNA, 15 nt, Brucella suis 1330
ucauguuucaaaagu

SEQ ID NO: 2470692 - RNA, 17 nt, Brucella suis 1330
ucauuccggcgcugcuc

SEQ ID NO: 2470693 - RNA, 18 nt, Brucella suis 1330
ucauucggguugccuucg

SEQ ID NO: 2470694 - RNA, 20 nt, Brucella suis 1330
ucauugaacccgccaccaga

SEQ ID NO: 2470695 - RNA, 16 nt, Brucella suis 1330
ucauugcgauccagcg

SEQ ID NO: 2470696 - RNA, 18 nt, Brucella suis 1330
ucauuguuaaagcggauc

SEQ ID NO: 2470697 - RNA, 19 nt, Brucella suis 1330
ucauuuccuuccacugggc

SEQ ID NO: 2470698 - RNA, 18 nt, Brucella suis 1330
ucauuugcgaccauggcg

SEQ ID NO: 2470699 - RNA, 18 nt, Brucella suis 1330
ucauuuggacaaaagccc

SEQ ID NO: 2470700 - RNA, 13 nt, Brucella suis 1330
uccaaugugcccu

SEQ ID NO: 2470701 - RNA, 20 nt, Brucella suis 1330
uccaaugugcccuugagagc

SEQ ID NO: 2470702 - RNA, 18 nt, Brucella suis 1330
uccacaagcaucugcuca

SEQ ID NO: 2470703 - RNA, 21 nt, Brucella suis 1330
uccacaagcaucugcucaaaa

SEQ ID NO: 2470704 - RNA, 18 nt, Brucella suis 1330
uccacaaugauguucggc

SEQ ID NO: 2470705 - RNA, 21 nt, Brucella suis 1330
uccacaccugcaccaaucagu

SEQ ID NO: 2470706 - RNA, 19 nt, Brucella suis 1330
uccaccaccucgccaauga

SEQ ID NO: 2470707 - RNA, 16 nt, Brucella suis 1330
uccaccaccugcccgc

SEQ ID NO: 2470708 - RNA, 13 nt, Brucella suis 1330
uccaccagcauga

SEQ ID NO: 2470709 - RNA, 21 nt, Brucella suis 1330
uccaccgcgcugaagcggccu

SEQ ID NO: 2470710 - RNA, 15 nt, Brucella suis 1330
uccacgacgggagcc

SEQ ID NO: 2470711 - RNA, 14 nt, Brucella suis 1330
uccacgcgccgaca

SEQ ID NO: 2470712 - RNA, 20 nt, Brucella suis 1330
uccacggcauugagaccggg

SEQ ID NO: 2470713 - RNA, 14 nt, Brucella suis 1330
uccagaaagagcau

SEQ ID NO: 2470714 - RNA, 17 nt, Brucella suis 1330
uccagaagccgcuugca

SEQ ID NO: 2470715 - RNA, 13 nt, Brucella suis 1330
uccagaagcgcgu

SEQ ID NO: 2470716 - RNA, 22 nt, Brucella suis 1330
uccagaaggcgggaaggcaauc

SEQ ID NO: 2470717 - RNA, 17 nt, Brucella suis 1330
uccagaucggccauuuc

SEQ ID NO: 2470718 - RNA, 20 nt, Brucella suis 1330
uccagaucggccauuucggc

SEQ ID NO: 2470719 - RNA, 14 nt, Brucella suis 1330
uccagaucggccuu

SEQ ID NO: 2470720 - RNA, 13 nt, Brucella suis 1330
uccagaucuuccu

SEQ ID NO: 2470721 - RNA, 15 nt, Brucella suis 1330
uccagcaaaagugag

SEQ ID NO: 2470722 - RNA, 13 nt, Brucella suis 1330
uccagcagauccg

SEQ ID NO: 2470723 - RNA, 18 nt, Brucella suis 1330
uccagcaggcgcgcagca

SEQ ID NO: 2470724 - RNA, 18 nt, Brucella suis 1330
uccagcccauaaggcgga

SEQ ID NO: 2470725 - RNA, 14 nt, Brucella suis 1330
uccagcccuucauc

SEQ ID NO: 2470726 - RNA, 21 nt, Brucella suis 1330
uccagccgggcuuuuuuauuc

SEQ ID NO: 2470727 - RNA, 17 nt, Brucella suis 1330
uccagccuuuccagaag

SEQ ID NO: 2470728 - RNA, 19 nt, Brucella suis 1330
uccagccuuuccagaaggc

SEQ ID NO: 2470729 - RNA, 15 nt, Brucella suis 1330
uccagcgaguucggc

SEQ ID NO: 2470730 - RNA, 16 nt, Brucella suis 1330
uccagcgcguugccuu

SEQ ID NO: 2470731 - RNA, 11 nt, Brucella suis 1330
uccagcgggcg

SEQ ID NO: 2470732 - RNA, 18 nt, Brucella suis 1330
uccagcggugacggcggc

SEQ ID NO: 2470733 - RNA, 20 nt, Brucella suis 1330
uccagcggugacggcggcag

SEQ ID NO: 2470734 - RNA, 13 nt, Brucella suis 1330
uccagcuugcagu

SEQ ID NO: 2470735 - RNA, 17 nt, Brucella suis 1330
uccagcuugcagugcag

SEQ ID NO: 2470736 - RNA, 15 nt, Brucella suis 1330
uccagcuuuccgcau

SEQ ID NO: 2470737 - RNA, 16 nt, Brucella suis 1330
uccaguccgauaucga

SEQ ID NO: 2470738 - RNA, 20 nt, Brucella suis 1330
uccagucgaggcagccacgg

SEQ ID NO: 2470739 - RNA, 13 nt, Brucella suis 1330
uccagucuucauc

SEQ ID NO: 2470740 - RNA, 16 nt, Brucella suis 1330
uccagugcaaagcggc

SEQ ID NO: 2470741 - RNA, 14 nt, Brucella suis 1330
uccauaucuuucca

SEQ ID NO: 2470742 - RNA, 16 nt, Brucella suis 1330
uccauccggcggcgcc

SEQ ID NO: 2470743 - RNA, 12 nt, Brucella suis 1330
uccaugaaagcc

SEQ ID NO: 2470744 - RNA, 19 nt, Brucella suis 1330
uccauggccacgacagggc

SEQ ID NO: 2470745 - RNA, 13 nt, Brucella suis 1330
uccauggucaggc

SEQ ID NO: 2470746 - RNA, 15 nt, Brucella suis 1330
uccauguggaaggcg

SEQ ID NO: 2470747 - RNA, 14 nt, Brucella suis 1330
ucccaaagcgggcg

SEQ ID NO: 2470748 - RNA, 22 nt, Brucella suis 1330
ucccaaagcgggcgcuccagcc

SEQ ID NO: 2470749 - RNA, 18 nt, Brucella suis 1330
ucccaagcggguuucagc

SEQ ID NO: 2470750 - RNA, 18 nt, Brucella suis 1330
ucccccaauaucgcgccg

SEQ ID NO: 2470751 - RNA, 22 nt, Brucella suis 1330
ucccccaauaucgcgccggggc

SEQ ID NO: 2470752 - RNA, 13 nt, Brucella suis 1330
uccccccauucau

SEQ ID NO: 2470753 - RNA, 15 nt, Brucella suis 1330
uccccccauucaugc

SEQ ID NO: 2470754 - RNA, 16 nt, Brucella suis 1330
uccccgcccgcggcca

SEQ ID NO: 2470755 - RNA, 14 nt, Brucella suis 1330
uccccuacucccuu

SEQ ID NO: 2470756 - RNA, 15 nt, Brucella suis 1330
uccccuauuccccua

SEQ ID NO: 2470757 - RNA, 21 nt, Brucella suis 1330
uccccuauuccccuauucccc

SEQ ID NO: 2470758 - RNA, 17 nt, Brucella suis 1330
uccccuauucccuuaac

SEQ ID NO: 2470759 - RNA, 16 nt, Brucella suis 1330
ucccgccaugugcccg

SEQ ID NO: 2470760 - RNA, 23 nt, Brucella suis 1330
ucccgccccuaaaggcucugcgc

SEQ ID NO: 2470761 - RNA, 21 nt, Brucella suis 1330
ucccgccgcgaaaaccggcug

SEQ ID NO: 2470762 - RNA, 17 nt, Brucella suis 1330
ucccgcgccucacccuc

SEQ ID NO: 2470763 - RNA, 15 nt, Brucella suis 1330
ucccggaagccgccu

SEQ ID NO: 2470764 - RNA, 20 nt, Brucella suis 1330
ucccucuaaucgcgagcagc

SEQ ID NO: 2470765 - RNA, 23 nt, Brucella suis 1330
ucccugcgggccaugguuucggc

SEQ ID NO: 2470766 - RNA, 14 nt, Brucella suis 1330
ucccuuacuccauu

SEQ ID NO: 2470767 - RNA, 14 nt, Brucella suis 1330
ucccuucgcgccgc

SEQ ID NO: 2470768 - RNA, 17 nt, Brucella suis 1330
ucccuugccgccuuuca

SEQ ID NO: 2470769 - RNA, 17 nt, Brucella suis 1330
uccgacagggcaagcgc

SEQ ID NO: 2470770 - RNA, 15 nt, Brucella suis 1330
uccgacauccaucgg

SEQ ID NO: 2470771 - RNA, 19 nt, Brucella suis 1330
uccgacauccaucggcuca

SEQ ID NO: 2470772 - RNA, 20 nt, Brucella suis 1330
uccgaggcgcgcagcagcgg

SEQ ID NO: 2470773 - RNA, 17 nt, Brucella suis 1330
uccgauggaacugcucc

SEQ ID NO: 2470774 - RNA, 16 nt, Brucella suis 1330
uccgcaacucauggaa

SEQ ID NO: 2470775 - RNA, 15 nt, Brucella suis 1330
uccgcaagccagucc

SEQ ID NO: 2470776 - RNA, 21 nt, Brucella suis 1330
uccgcaagccaguccuugccc

SEQ ID NO: 2470777 - RNA, 18 nt, Brucella suis 1330
uccgcaccauucugccca

SEQ ID NO: 2470778 - RNA, 20 nt, Brucella suis 1330
uccgcaccgaaggcaagcag

SEQ ID NO: 2470779 - RNA, 11 nt, Brucella suis 1330
uccgcaccgca

SEQ ID NO: 2470780 - RNA, 17 nt, Brucella suis 1330
uccgcaccggcauggau

SEQ ID NO: 2470781 - RNA, 17 nt, Brucella suis 1330
uccgcaccucaggauga

SEQ ID NO: 2470782 - RNA, 21 nt, Brucella suis 1330
uccgcauaagccccggcauca

SEQ ID NO: 2470783 - RNA, 13 nt, Brucella suis 1330
uccgcaucgcaau

SEQ ID NO: 2470784 - RNA, 21 nt, Brucella suis 1330
uccgcauucccuugaaaucau

SEQ ID NO: 2470785 - RNA, 23 nt, Brucella suis 1330
uccgccagauaagacauggcuuc

SEQ ID NO: 2470786 - RNA, 17 nt, Brucella suis 1330
uccgccagcauuucagg

SEQ ID NO: 2470787 - RNA, 16 nt, Brucella suis 1330
uccgccgaucugcacg

SEQ ID NO: 2470788 - RNA, 17 nt, Brucella suis 1330
uccgccucccugcgcgc

SEQ ID NO: 2470789 - RNA, 17 nt, Brucella suis 1330
uccgccugcgcauggga

SEQ ID NO: 2470790 - RNA, 22 nt, Brucella suis 1330
uccgcggcgguuuugagcugcu

SEQ ID NO: 2470791 - RNA, 23 nt, Brucella suis 1330
uccgcggcgguuuugagcugcug

SEQ ID NO: 2470792 - RNA, 12 nt, Brucella suis 1330
uccgcuccagau

SEQ ID NO: 2470793 - RNA, 19 nt, Brucella suis 1330
uccggcaaaacggcaggca

SEQ ID NO: 2470794 - RNA, 20 nt, Brucella suis 1330
uccggcagcccgacauccuu

SEQ ID NO: 2470795 - RNA, 18 nt, Brucella suis 1330
uccggcagguuccagucc

SEQ ID NO: 2470796 - RNA, 15 nt, Brucella suis 1330
uccggccagccgacc

SEQ ID NO: 2470797 - RNA, 22 nt, Brucella suis 1330
uccggccaguggccgaagccgc

SEQ ID NO: 2470798 - RNA, 23 nt, Brucella suis 1330
uccggccccuuucgcaucagacg

SEQ ID NO: 2470799 - RNA, 15 nt, Brucella suis 1330
uccggcuagaaagga

SEQ ID NO: 2470800 - RNA, 15 nt, Brucella suis 1330
uccggcucaaugccg

SEQ ID NO: 2470801 - RNA, 22 nt, Brucella suis 1330
uccggcucgggccgguccagau

SEQ ID NO: 2470802 - RNA, 17 nt, Brucella suis 1330
uccgggaagcaguuccu

SEQ ID NO: 2470803 - RNA, 14 nt, Brucella suis 1330
uccgggcaccgacc

SEQ ID NO: 2470804 - RNA, 23 nt, Brucella suis 1330
uccgggcaccgaccgggcuugca

SEQ ID NO: 2470805 - RNA, 15 nt, Brucella suis 1330
uccgggcugcuucca

SEQ ID NO: 2470806 - RNA, 22 nt, Brucella suis 1330
uccgggcuuuguuguuucaggc

SEQ ID NO: 2470807 - RNA, 21 nt, Brucella suis 1330
uccgggucuucgcccggcaug

SEQ ID NO: 2470808 - RNA, 21 nt, Brucella suis 1330
uccggguucaauacccaugcc

SEQ ID NO: 2470809 - RNA, 15 nt, Brucella suis 1330
uccguaucuccgggc

SEQ ID NO: 2470810 - RNA, 15 nt, Brucella suis 1330
uccgucagacgaucc

SEQ ID NO: 2470811 - RNA, 15 nt, Brucella suis 1330
uccguccugaugccg

SEQ ID NO: 2470812 - RNA, 18 nt, Brucella suis 1330
uccgucugcaucgagcgg

SEQ ID NO: 2470813 - RNA, 12 nt, Brucella suis 1330
uccgugaaucug

SEQ ID NO: 2470814 - RNA, 14 nt, Brucella suis 1330
uccgugccgauuuc

SEQ ID NO: 2470815 - RNA, 23 nt, Brucella suis 1330
uccguguugaaaaggauauccuu

SEQ ID NO: 2470816 - RNA, 15 nt, Brucella suis 1330
uccuacgcaaaaccg

SEQ ID NO: 2470817 - RNA, 15 nt, Brucella suis 1330
uccuauugccagacg

SEQ ID NO: 2470818 - RNA, 13 nt, Brucella suis 1330
uccucaagauaca

SEQ ID NO: 2470819 - RNA, 20 nt, Brucella suis 1330
uccucaagauacaaaaaauc

SEQ ID NO: 2470820 - RNA, 14 nt, Brucella suis 1330
uccucacggccaua

SEQ ID NO: 2470821 - RNA, 20 nt, Brucella suis 1330
uccuccagcccuucaucaag

SEQ ID NO: 2470822 - RNA, 18 nt, Brucella suis 1330
uccucggcaauccccgga

SEQ ID NO: 2470823 - RNA, 14 nt, Brucella suis 1330
uccucggcggcgcg

SEQ ID NO: 2470824 - RNA, 15 nt, Brucella suis 1330
uccucugccugcuga

SEQ ID NO: 2470825 - RNA, 16 nt, Brucella suis 1330
uccucugccugcugau

SEQ ID NO: 2470826 - RNA, 17 nt, Brucella suis 1330
uccugaauggucugcgc

SEQ ID NO: 2470827 - RNA, 13 nt, Brucella suis 1330
uccugacccaugg

SEQ ID NO: 2470828 - RNA, 19 nt, Brucella suis 1330
uccugacccauggccugcu

SEQ ID NO: 2470829 - RNA, 22 nt, Brucella suis 1330
uccugacccauggccugcugca

SEQ ID NO: 2470830 - RNA, 18 nt, Brucella suis 1330
uccugaucguguugacca

SEQ ID NO: 2470831 - RNA, 11 nt, Brucella suis 1330
uccugaucuug

SEQ ID NO: 2470832 - RNA, 13 nt, Brucella suis 1330
uccugaucuugcg

SEQ ID NO: 2470833 - RNA, 14 nt, Brucella suis 1330
uccugaucuugcgu

SEQ ID NO: 2470834 - RNA, 16 nt, Brucella suis 1330
uccugcaccggcuucc

SEQ ID NO: 2470835 - RNA, 15 nt, Brucella suis 1330
uccugccagcggcag

SEQ ID NO: 2470836 - RNA, 16 nt, Brucella suis 1330
uccugccuuugaagac

SEQ ID NO: 2470837 - RNA, 15 nt, Brucella suis 1330
uccugcgaugcgcca

SEQ ID NO: 2470838 - RNA, 23 nt, Brucella suis 1330
uccugcgcccauucaaugccacc

SEQ ID NO: 2470839 - RNA, 21 nt, Brucella suis 1330
uccugcgcccugucagaaagu

SEQ ID NO: 2470840 - RNA, 17 nt, Brucella suis 1330
uccugcggaaugcccug

SEQ ID NO: 2470841 - RNA, 19 nt, Brucella suis 1330
uccugcuucaucgcggcag

SEQ ID NO: 2470842 - RNA, 23 nt, Brucella suis 1330
uccuggugcgcagcucggcuuca

SEQ ID NO: 2470843 - RNA, 20 nt, Brucella suis 1330
uccuuaacggugaucggcgu

SEQ ID NO: 2470844 - RNA, 17 nt, Brucella suis 1330
uccuucacauauugugc

SEQ ID NO: 2470845 - RNA, 21 nt, Brucella suis 1330
uccuucaggcccuugccggcc

SEQ ID NO: 2470846 - RNA, 15 nt, Brucella suis 1330
uccuugaaaagcugg

SEQ ID NO: 2470847 - RNA, 18 nt, Brucella suis 1330
uccuugaccgcuaugucg

SEQ ID NO: 2470848 - RNA, 22 nt, Brucella suis 1330
uccuugacgcugaagaaaacaa

SEQ ID NO: 2470849 - RNA, 12 nt, Brucella suis 1330
uccuugaugccc

SEQ ID NO: 2470850 - RNA, 23 nt, Brucella suis 1330
uccuuggcacguugcgccuggcg

SEQ ID NO: 2470851 - RNA, 18 nt, Brucella suis 1330
uccuugucggcaucgguc

SEQ ID NO: 2470852 - RNA, 12 nt, Brucella suis 1330
uccuuuccgggu

SEQ ID NO: 2470853 - RNA, 15 nt, Brucella suis 1330
uccuuuguuuugacg

SEQ ID NO: 2470854 - RNA, 12 nt, Brucella suis 1330
uccuuuuucagc

SEQ ID NO: 2470855 - RNA, 16 nt, Brucella suis 1330
uccuuuuucagcaccg

SEQ ID NO: 2470856 - RNA, 21 nt, Brucella suis 1330
ucgaaaaugcucuaggaaaac

SEQ ID NO: 2470857 - RNA, 15 nt, Brucella suis 1330
ucgaaacaaguucau

SEQ ID NO: 2470858 - RNA, 14 nt, Brucella suis 1330
ucgaaaccggcauu

SEQ ID NO: 2470859 - RNA, 19 nt, Brucella suis 1330
ucgaaauccaguccgauau

SEQ ID NO: 2470860 - RNA, 21 nt, Brucella suis 1330
ucgaaauccuucagaagcacc

SEQ ID NO: 2470861 - RNA, 20 nt, Brucella suis 1330
ucgaacagguugcgccacca

SEQ ID NO: 2470862 - RNA, 19 nt, Brucella suis 1330
ucgaacugguucagccgcu

SEQ ID NO: 2470863 - RNA, 12 nt, Brucella suis 1330
ucgaagcggccu

SEQ ID NO: 2470864 - RNA, 17 nt, Brucella suis 1330
ucgaagcggccuuugau

SEQ ID NO: 2470865 - RNA, 22 nt, Brucella suis 1330
ucgaagcgggaucagaaaucag

SEQ ID NO: 2470866 - RNA, 20 nt, Brucella suis 1330
ucgaagggcugagggaaaca

SEQ ID NO: 2470867 - RNA, 17 nt, Brucella suis 1330
ucgaauaucuugaagcc

SEQ ID NO: 2470868 - RNA, 16 nt, Brucella suis 1330
ucgacaaucuccccuu

SEQ ID NO: 2470869 - RNA, 14 nt, Brucella suis 1330
ucgacagcacugcc

SEQ ID NO: 2470870 - RNA, 11 nt, Brucella suis 1330
ucgacagggug

SEQ ID NO: 2470871 - RNA, 13 nt, Brucella suis 1330
ucgacauauuugu

SEQ ID NO: 2470872 - RNA, 18 nt, Brucella suis 1330
ucgacauggacaggaugc

SEQ ID NO: 2470873 - RNA, 21 nt, Brucella suis 1330
ucgacgcuuuccaccggcuca

SEQ ID NO: 2470874 - RNA, 20 nt, Brucella suis 1330
ucgagaaaaagaugcgccgg

SEQ ID NO: 2470875 - RNA, 13 nt, Brucella suis 1330
ucgagaauuucuc

SEQ ID NO: 2470876 - RNA, 17 nt, Brucella suis 1330
ucgagacggcgcuccau

SEQ ID NO: 2470877 - RNA, 14 nt, Brucella suis 1330
ucgagaucgaccgc

SEQ ID NO: 2470878 - RNA, 22 nt, Brucella suis 1330
ucgagcggaagaggacaaggcc

SEQ ID NO: 2470879 - RNA, 22 nt, Brucella suis 1330
ucgagcggcacgaugcgcagcc

SEQ ID NO: 2470880 - RNA, 16 nt, Brucella suis 1330
ucgagcgugaccagcc

SEQ ID NO: 2470881 - RNA, 20 nt, Brucella suis 1330
ucgaggaauaggcgccagca

SEQ ID NO: 2470882 - RNA, 23 nt, Brucella suis 1330
ucgaggaauaggcgccagcacuu

SEQ ID NO: 2470883 - RNA, 22 nt, Brucella suis 1330
ucgaggcagccacggcagagug

SEQ ID NO: 2470884 - RNA, 18 nt, Brucella suis 1330
ucgaguucugcgcggaaa

SEQ ID NO: 2470885 - RNA, 15 nt, Brucella suis 1330
ucgauauccuggccu

SEQ ID NO: 2470886 - RNA, 21 nt, Brucella suis 1330
ucgauauccuggccuuccuug

SEQ ID NO: 2470887 - RNA, 17 nt, Brucella suis 1330
ucgauaucgagcacgag

SEQ ID NO: 2470888 - RNA, 19 nt, Brucella suis 1330
ucgauauggucgaggauca

SEQ ID NO: 2470889 - RNA, 19 nt, Brucella suis 1330
ucgaucagugccaccagau

SEQ ID NO: 2470890 - RNA, 22 nt, Brucella suis 1330
ucgaucccuucgacguggagca

SEQ ID NO: 2470891 - RNA, 14 nt, Brucella suis 1330
ucgaucgacccgcc

SEQ ID NO: 2470892 - RNA, 15 nt, Brucella suis 1330
ucgaucggugcaaug

SEQ ID NO: 2470893 - RNA, 22 nt, Brucella suis 1330
ucgaugaacaggagcggaagca

SEQ ID NO: 2470894 - RNA, 17 nt, Brucella suis 1330
ucgaugaccaccgcgaa

SEQ ID NO: 2470895 - RNA, 16 nt, Brucella suis 1330
ucgaugauaucgccuu

SEQ ID NO: 2470896 - RNA, 21 nt, Brucella suis 1330
ucgaugcgcuggaugaugcuu

SEQ ID NO: 2470897 - RNA, 16 nt, Brucella suis 1330
ucgauggccgaauagc

SEQ ID NO: 2470898 - RNA, 20 nt, Brucella suis 1330
ucgauggugcggaacaaugc

SEQ ID NO: 2470899 - RNA, 17 nt, Brucella suis 1330
ucgauuugcgcaccaga

SEQ ID NO: 2470900 - RNA, 18 nt, Brucella suis 1330
ucgauuugcgcaccagau

SEQ ID NO: 2470901 - RNA, 21 nt, Brucella suis 1330
ucgcaaaauaguccaguagcu

SEQ ID NO: 2470902 - RNA, 20 nt, Brucella suis 1330
ucgcaaagcguuccgcgcaa

SEQ ID NO: 2470903 - RNA, 16 nt, Brucella suis 1330
ucgcaagcaggcauug

SEQ ID NO: 2470904 - RNA, 22 nt, Brucella suis 1330
ucgcaccggauuugccaagcgu

SEQ ID NO: 2470905 - RNA, 15 nt, Brucella suis 1330
ucgcacgcgcaugcc

SEQ ID NO: 2470906 - RNA, 22 nt, Brucella suis 1330
ucgcacgcuuggccucuuccag

SEQ ID NO: 2470907 - RNA, 19 nt, Brucella suis 1330
ucgcaucgggaucaaugau

SEQ ID NO: 2470908 - RNA, 16 nt, Brucella suis 1330
ucgcaucugccaguug

SEQ ID NO: 2470909 - RNA, 20 nt, Brucella suis 1330
ucgccaagaagaacacagcc

SEQ ID NO: 2470910 - RNA, 20 nt, Brucella suis 1330
ucgccaagcuugaucgccgc

SEQ ID NO: 2470911 - RNA, 23 nt, Brucella suis 1330
ucgccaauuccgccggggcaggc

SEQ ID NO: 2470912 - RNA, 17 nt, Brucella suis 1330
ucgccaccggcggcgcg

SEQ ID NO: 2470913 - RNA, 20 nt, Brucella suis 1330
ucgccaccggcggcgcggcc

SEQ ID NO: 2470914 - RNA, 15 nt, Brucella suis 1330
ucgccagcaccucga

SEQ ID NO: 2470915 - RNA, 12 nt, Brucella suis 1330
ucgccagcgccg

SEQ ID NO: 2470916 - RNA, 18 nt, Brucella suis 1330
ucgccagcucgccggcuu

SEQ ID NO: 2470917 - RNA, 17 nt, Brucella suis 1330
ucgccaguuucauuucc

SEQ ID NO: 2470918 - RNA, 22 nt, Brucella suis 1330
ucgcccacgcccagcgcggcaa

SEQ ID NO: 2470919 - RNA, 14 nt, Brucella suis 1330
ucgcccagaaacaa

SEQ ID NO: 2470920 - RNA, 14 nt, Brucella suis 1330
ucgcccauuuucuc

SEQ ID NO: 2470921 - RNA, 21 nt, Brucella suis 1330
ucgcccugaagaagcuucaca

SEQ ID NO: 2470922 - RNA, 16 nt, Brucella suis 1330
ucgccgaaaagcgccu

SEQ ID NO: 2470923 - RNA, 15 nt, Brucella suis 1330
ucgccgauauccucg

SEQ ID NO: 2470924 - RNA, 13 nt, Brucella suis 1330
ucgccgcacggcg

SEQ ID NO: 2470925 - RNA, 14 nt, Brucella suis 1330
ucgccgcccuugug

SEQ ID NO: 2470926 - RNA, 21 nt, Brucella suis 1330
ucgccgccggugcucugcgcc

SEQ ID NO: 2470927 - RNA, 15 nt, Brucella suis 1330
ucgccgcgcacuggc

SEQ ID NO: 2470928 - RNA, 12 nt, Brucella suis 1330
ucgccggaaagc

SEQ ID NO: 2470929 - RNA, 18 nt, Brucella suis 1330
ucgccggaaccgcucuaa

SEQ ID NO: 2470930 - RNA, 16 nt, Brucella suis 1330
ucgccggaccgugccg

SEQ ID NO: 2470931 - RNA, 15 nt, Brucella suis 1330
ucgccguccuuugug

SEQ ID NO: 2470932 - RNA, 18 nt, Brucella suis 1330
ucgccucauggcggcgcu

SEQ ID NO: 2470933 - RNA, 15 nt, Brucella suis 1330
ucgccucuucauccg

SEQ ID NO: 2470934 - RNA, 13 nt, Brucella suis 1330
ucgccugcaaugg

SEQ ID NO: 2470935 - RNA, 16 nt, Brucella suis 1330
ucgccugcaccaugga

SEQ ID NO: 2470936 - RNA, 20 nt, Brucella suis 1330
ucgccugcuuccuuuucggc

SEQ ID NO: 2470937 - RNA, 22 nt, Brucella suis 1330
ucgcgauccugcugcgcggcau

SEQ ID NO: 2470938 - RNA, 17 nt, Brucella suis 1330
ucgcgaucgugucgcga

SEQ ID NO: 2470939 - RNA, 17 nt, Brucella suis 1330
ucgcgcaauucaugccc

SEQ ID NO: 2470940 - RNA, 14 nt, Brucella suis 1330
ucgcgcaggccgcg

SEQ ID NO: 2470941 - RNA, 15 nt, Brucella suis 1330
ucgcgcaggccgcgg

SEQ ID NO: 2470942 - RNA, 18 nt, Brucella suis 1330
ucgcgcaggccgcggcau

SEQ ID NO: 2470943 - RNA, 16 nt, Brucella suis 1330
ucgcgccauaaaucga

SEQ ID NO: 2470944 - RNA, 11 nt, Brucella suis 1330
ucgcgccgccu

SEQ ID NO: 2470945 - RNA, 14 nt, Brucella suis 1330
ucgcgccggggccg

SEQ ID NO: 2470946 - RNA, 15 nt, Brucella suis 1330
ucgcgcgcaagcggc

SEQ ID NO: 2470947 - RNA, 20 nt, Brucella suis 1330
ucgcgcggcuuaucgcucuu

SEQ ID NO: 2470948 - RNA, 23 nt, Brucella suis 1330
ucgcgcguaucgacaccgccaag

SEQ ID NO: 2470949 - RNA, 16 nt, Brucella suis 1330
ucgcgcucggcaagcg

SEQ ID NO: 2470950 - RNA, 22 nt, Brucella suis 1330
ucgcguauccaggugcagucuu

SEQ ID NO: 2470951 - RNA, 16 nt, Brucella suis 1330
ucgcuaccaugcggcc

SEQ ID NO: 2470952 - RNA, 15 nt, Brucella suis 1330
ucgcucaccuuuucc

SEQ ID NO: 2470953 - RNA, 20 nt, Brucella suis 1330
ucgcucguaacgggagcagc

SEQ ID NO: 2470954 - RNA, 13 nt, Brucella suis 1330
ucgcugcggccau

SEQ ID NO: 2470955 - RNA, 15 nt, Brucella suis 1330
ucgcugcggccaugc

SEQ ID NO: 2470956 - RNA, 23 nt, Brucella suis 1330
ucgcuguccgacgccaaaaggcc

SEQ ID NO: 2470957 - RNA, 23 nt, Brucella suis 1330
ucgcuguuggcaagaaccucgac

SEQ ID NO: 2470958 - RNA, 18 nt, Brucella suis 1330
ucgcuuauuggcuuucaa

SEQ ID NO: 2470959 - RNA, 19 nt, Brucella suis 1330
ucgcuuucaaugcuggccu

SEQ ID NO: 2470960 - RNA, 20 nt, Brucella suis 1330
ucgcuuucaauggccgcgcg

SEQ ID NO: 2470961 - RNA, 22 nt, Brucella suis 1330
ucgcuuucgauuuuugccagau

SEQ ID NO: 2470962 - RNA, 20 nt, Brucella suis 1330
ucggaagggcaaggcgcgcc

SEQ ID NO: 2470963 - RNA, 21 nt, Brucella suis 1330
ucggagccuucauugcggcca

SEQ ID NO: 2470964 - RNA, 14 nt, Brucella suis 1330
ucggauaagaugcg

SEQ ID NO: 2470965 - RNA, 22 nt, Brucella suis 1330
ucggauaagaugcgcgcaagga

SEQ ID NO: 2470966 - RNA, 15 nt, Brucella suis 1330
ucggauccuccugcg

SEQ ID NO: 2470967 - RNA, 19 nt, Brucella suis 1330
ucggauucuuaugccagau

SEQ ID NO: 2470968 - RNA, 13 nt, Brucella suis 1330
ucggcaacaagag

SEQ ID NO: 2470969 - RNA, 19 nt, Brucella suis 1330
ucggcaagcgcaauggccu

SEQ ID NO: 2470970 - RNA, 21 nt, Brucella suis 1330
ucggcaagcuggaaggccagg

SEQ ID NO: 2470971 - RNA, 16 nt, Brucella suis 1330
ucggcaaggccgcgcu

SEQ ID NO: 2470972 - RNA, 16 nt, Brucella suis 1330
ucggcaagggcaagca

SEQ ID NO: 2470973 - RNA, 17 nt, Brucella suis 1330
ucggcaagggcaagcag

SEQ ID NO: 2470974 - RNA, 22 nt, Brucella suis 1330
ucggcaagggcaagcagaacac

SEQ ID NO: 2470975 - RNA, 16 nt, Brucella suis 1330
ucggcaagggcggcaa

SEQ ID NO: 2470976 - RNA, 14 nt, Brucella suis 1330
ucggcaaugaucug

SEQ ID NO: 2470977 - RNA, 12 nt, Brucella suis 1330
ucggcagcgaac

SEQ ID NO: 2470978 - RNA, 17 nt, Brucella suis 1330
ucggcagcgaaccgucc

SEQ ID NO: 2470979 - RNA, 20 nt, Brucella suis 1330
ucggcauaggcuucggccgc

SEQ ID NO: 2470980 - RNA, 19 nt, Brucella suis 1330
ucggcauauuugaggcauu

SEQ ID NO: 2470981 - RNA, 22 nt, Brucella suis 1330
ucggcaucgcucaccuuuucca

SEQ ID NO: 2470982 - RNA, 13 nt, Brucella suis 1330
ucggcaucggaaa

SEQ ID NO: 2470983 - RNA, 15 nt, Brucella suis 1330
ucggcauggcagccg

SEQ ID NO: 2470984 - RNA, 14 nt, Brucella suis 1330
ucggccagagcuuc

SEQ ID NO: 2470985 - RNA, 17 nt, Brucella suis 1330
ucggccagagcuucgcc

SEQ ID NO: 2470986 - RNA, 21 nt, Brucella suis 1330
ucggccagagcuucgccgcca

SEQ ID NO: 2470987 - RNA, 23 nt, Brucella suis 1330
ucggccagagcuucgccgccaug

SEQ ID NO: 2470988 - RNA, 22 nt, Brucella suis 1330
ucggccagaucauugaaauucu

SEQ ID NO: 2470989 - RNA, 16 nt, Brucella suis 1330
ucggcccagcaccgcg

SEQ ID NO: 2470990 - RNA, 14 nt, Brucella suis 1330
ucggccccggcacg

SEQ ID NO: 2470991 - RNA, 23 nt, Brucella suis 1330
ucggcccggucacccgcacgccg

SEQ ID NO: 2470992 - RNA, 13 nt, Brucella suis 1330
ucggccuggucua

SEQ ID NO: 2470993 - RNA, 17 nt, Brucella suis 1330
ucggccuggucuagccg

SEQ ID NO: 2470994 - RNA, 22 nt, Brucella suis 1330
ucggccuuguaggaaagcacac

SEQ ID NO: 2470995 - RNA, 19 nt, Brucella suis 1330
ucggcgaccgccuuuucca

SEQ ID NO: 2470996 - RNA, 17 nt, Brucella suis 1330
ucggcgacuggcagggc

SEQ ID NO: 2470997 - RNA, 18 nt, Brucella suis 1330
ucggcgaggucucccggc

SEQ ID NO: 2470998 - RNA, 21 nt, Brucella suis 1330
ucggcgaggucucccggcacg

SEQ ID NO: 2470999 - RNA, 15 nt, Brucella suis 1330
ucggcgaugaagcgg

SEQ ID NO: 2471000 - RNA, 19 nt, Brucella suis 1330
ucggcgcucuaauccuuug

SEQ ID NO: 2471001 - RNA, 20 nt, Brucella suis 1330
ucggcgcucuaauccuuugu

SEQ ID NO: 2471002 - RNA, 14 nt, Brucella suis 1330
ucggcggaaccaug

SEQ ID NO: 2471003 - RNA, 16 nt, Brucella suis 1330
ucggcggcguuucgcc

SEQ ID NO: 2471004 - RNA, 13 nt, Brucella suis 1330
ucggcggcuuccu

SEQ ID NO: 2471005 - RNA, 17 nt, Brucella suis 1330
ucggcgggcuuuuucgu

SEQ ID NO: 2471006 - RNA, 17 nt, Brucella suis 1330
ucggcucauccuccacg

SEQ ID NO: 2471007 - RNA, 15 nt, Brucella suis 1330
ucggcuugccgaccu

SEQ ID NO: 2471008 - RNA, 15 nt, Brucella suis 1330
ucgggaucaaugauc

SEQ ID NO: 2471009 - RNA, 17 nt, Brucella suis 1330
ucggggaagguggggag

SEQ ID NO: 2471010 - RNA, 13 nt, Brucella suis 1330
ucggggcggccuu

SEQ ID NO: 2471011 - RNA, 20 nt, Brucella suis 1330
ucggggcguccgccaccgcc

SEQ ID NO: 2471012 - RNA, 15 nt, Brucella suis 1330
ucggguaaggcuuca

SEQ ID NO: 2471013 - RNA, 21 nt, Brucella suis 1330
ucggguagagcuucuuuucga

SEQ ID NO: 2471014 - RNA, 19 nt, Brucella suis 1330
ucggguuugaugaggcgga

SEQ ID NO: 2471015 - RNA, 21 nt, Brucella suis 1330
ucggucagggcaauccuuucc

SEQ ID NO: 2471016 - RNA, 22 nt, Brucella suis 1330
ucggucagggcaauccuuucca

SEQ ID NO: 2471017 - RNA, 19 nt, Brucella suis 1330
ucggucucguucugccagu

SEQ ID NO: 2471018 - RNA, 14 nt, Brucella suis 1330
ucggugaaauauuu

SEQ ID NO: 2471019 - RNA, 14 nt, Brucella suis 1330
ucggugccugacug

SEQ ID NO: 2471020 - RNA, 20 nt, Brucella suis 1330
ucgguggcauugcccaugga

SEQ ID NO: 2471021 - RNA, 22 nt, Brucella suis 1330
ucgguguuggucugcggcuucc

SEQ ID NO: 2471022 - RNA, 18 nt, Brucella suis 1330
ucgguuaaacccgagcgu

SEQ ID NO: 2471023 - RNA, 20 nt, Brucella suis 1330
ucgguucgcuggccaugaug

SEQ ID NO: 2471024 - RNA, 22 nt, Brucella suis 1330
ucgguucgcuggccaugaugcc

SEQ ID NO: 2471025 - RNA, 14 nt, Brucella suis 1330
ucgguuuucaaugc

SEQ ID NO: 2471026 - RNA, 23 nt, Brucella suis 1330
ucguaaucgccgggccuugccaa

SEQ ID NO: 2471027 - RNA, 15 nt, Brucella suis 1330
ucgucaaugcgcgcc

SEQ ID NO: 2471028 - RNA, 23 nt, Brucella suis 1330
ucgucacacaccaauguccaguu

SEQ ID NO: 2471029 - RNA, 14 nt, Brucella suis 1330
ucgucaugcagacg

SEQ ID NO: 2471030 - RNA, 22 nt, Brucella suis 1330
ucguccagcccugccggcucau

SEQ ID NO: 2471031 - RNA, 17 nt, Brucella suis 1330
ucgucgcgcucgccgcc

SEQ ID NO: 2471032 - RNA, 18 nt, Brucella suis 1330
ucgucgcgcucgccgccc

SEQ ID NO: 2471033 - RNA, 16 nt, Brucella suis 1330
ucgugaagccgcuuca

SEQ ID NO: 2471034 - RNA, 15 nt, Brucella suis 1330
ucgugauguugcggg

SEQ ID NO: 2471035 - RNA, 12 nt, Brucella suis 1330
ucgugccgccuu

SEQ ID NO: 2471036 - RNA, 17 nt, Brucella suis 1330
ucgugccggaauggcca

SEQ ID NO: 2471037 - RNA, 21 nt, Brucella suis 1330
ucgugccuggcgaaaacggcc

SEQ ID NO: 2471038 - RNA, 14 nt, Brucella suis 1330
ucguggccagccgc

SEQ ID NO: 2471039 - RNA, 14 nt, Brucella suis 1330
ucguggcggcaaaa

SEQ ID NO: 2471040 - RNA, 21 nt, Brucella suis 1330
ucguggcggcaaaaagcggcg

SEQ ID NO: 2471041 - RNA, 16 nt, Brucella suis 1330
ucgugggccucaagcg

SEQ ID NO: 2471042 - RNA, 20 nt, Brucella suis 1330
ucguggucgccucuucaucc

SEQ ID NO: 2471043 - RNA, 15 nt, Brucella suis 1330
ucguguccggcguca

SEQ ID NO: 2471044 - RNA, 20 nt, Brucella suis 1330
ucgugugaccuuggccacga

SEQ ID NO: 2471045 - RNA, 21 nt, Brucella suis 1330
ucguuacgccacugcgaaagc

SEQ ID NO: 2471046 - RNA, 19 nt, Brucella suis 1330
ucguucacaaucuugccaa

SEQ ID NO: 2471047 - RNA, 14 nt, Brucella suis 1330
ucguucaccgcaac

SEQ ID NO: 2471048 - RNA, 22 nt, Brucella suis 1330
ucguuugccucggagccuucau

SEQ ID NO: 2471049 - RNA, 11 nt, Brucella suis 1330
ucguuuucaug

SEQ ID NO: 2471050 - RNA, 13 nt, Brucella suis 1330
ucuaauccuuugu

SEQ ID NO: 2471051 - RNA, 13 nt, Brucella suis 1330
ucuauuuuuccac

SEQ ID NO: 2471052 - RNA, 18 nt, Brucella suis 1330
ucucacgcgcagcagcau

SEQ ID NO: 2471053 - RNA, 20 nt, Brucella suis 1330
ucucagcguuuucugaaaga

SEQ ID NO: 2471054 - RNA, 19 nt, Brucella suis 1330
ucucaugauggcccuugug

SEQ ID NO: 2471055 - RNA, 17 nt, Brucella suis 1330
ucuccaguaaagucuga

SEQ ID NO: 2471056 - RNA, 12 nt, Brucella suis 1330
ucuccgcccaua

SEQ ID NO: 2471057 - RNA, 16 nt, Brucella suis 1330
ucuccggcaaaacggc

SEQ ID NO: 2471058 - RNA, 21 nt, Brucella suis 1330
ucuccggcaaaacggcaggca

SEQ ID NO: 2471059 - RNA, 21 nt, Brucella suis 1330
ucuccuaaacucaucaaaagc

SEQ ID NO: 2471060 - RNA, 13 nt, Brucella suis 1330
ucucgacagccau

SEQ ID NO: 2471061 - RNA, 15 nt, Brucella suis 1330
ucucgcaaaacacca

SEQ ID NO: 2471062 - RNA, 20 nt, Brucella suis 1330
ucucgcccaaggucggcuca

SEQ ID NO: 2471063 - RNA, 21 nt, Brucella suis 1330
ucucgcgguucuugcggcguu

SEQ ID NO: 2471064 - RNA, 18 nt, Brucella suis 1330
ucucgucgaaauccuuca

SEQ ID NO: 2471065 - RNA, 12 nt, Brucella suis 1330
ucucguuuucau

SEQ ID NO: 2471066 - RNA, 15 nt, Brucella suis 1330
ucucuauccgcugau

SEQ ID NO: 2471067 - RNA, 13 nt, Brucella suis 1330
ucucuugccgccg

SEQ ID NO: 2471068 - RNA, 20 nt, Brucella suis 1330
ucugacccggcgcaaaggcc

SEQ ID NO: 2471069 - RNA, 21 nt, Brucella suis 1330
ucugaccuuccugacccaugg

SEQ ID NO: 2471070 - RNA, 17 nt, Brucella suis 1330
ucugaucuaguggagca

SEQ ID NO: 2471071 - RNA, 18 nt, Brucella suis 1330
ucugcacgucaucaucgu

SEQ ID NO: 2471072 - RNA, 14 nt, Brucella suis 1330
ucugcagcaaucuc

SEQ ID NO: 2471073 - RNA, 14 nt, Brucella suis 1330
ucugcaucccgaaa

SEQ ID NO: 2471074 - RNA, 17 nt, Brucella suis 1330
ucugcaucgagcggcac

SEQ ID NO: 2471075 - RNA, 19 nt, Brucella suis 1330
ucugcccgccggggccgga

SEQ ID NO: 2471076 - RNA, 22 nt, Brucella suis 1330
ucugccgguuuccagccugcug

SEQ ID NO: 2471077 - RNA, 17 nt, Brucella suis 1330
ucugccugcccucgucc

SEQ ID NO: 2471078 - RNA, 18 nt, Brucella suis 1330
ucugcgccgguuuuccgu

SEQ ID NO: 2471079 - RNA, 22 nt, Brucella suis 1330
ucugcgccguaguagcuaaugu

SEQ ID NO: 2471080 - RNA, 23 nt, Brucella suis 1330
ucugcgcgucgagcaaugcgccg

SEQ ID NO: 2471081 - RNA, 22 nt, Brucella suis 1330
ucugcgcugcccucuugauccu

SEQ ID NO: 2471082 - RNA, 16 nt, Brucella suis 1330
ucugcggcuuccagau

SEQ ID NO: 2471083 - RNA, 19 nt, Brucella suis 1330
ucugcgggcggcggcucca

SEQ ID NO: 2471084 - RNA, 12 nt, Brucella suis 1330
ucugcggucuuu

SEQ ID NO: 2471085 - RNA, 20 nt, Brucella suis 1330
ucugcguuccggugcuugug

SEQ ID NO: 2471086 - RNA, 20 nt, Brucella suis 1330
ucugcucggcgagcuuguug

SEQ ID NO: 2471087 - RNA, 13 nt, Brucella suis 1330
ucugcuugccgcc

SEQ ID NO: 2471088 - RNA, 15 nt, Brucella suis 1330
ucugcuugccgccga

SEQ ID NO: 2471089 - RNA, 21 nt, Brucella suis 1330
ucugcuugguuuccgccagca

SEQ ID NO: 2471090 - RNA, 23 nt, Brucella suis 1330
ucuggccgcuaugcgguuucagc

SEQ ID NO: 2471091 - RNA, 18 nt, Brucella suis 1330
ucuggcgauaaagaugcg

SEQ ID NO: 2471092 - RNA, 22 nt, Brucella suis 1330
ucuggcugagauaaaccggccc

SEQ ID NO: 2471093 - RNA, 14 nt, Brucella suis 1330
ucuguaucccgaaa

SEQ ID NO: 2471094 - RNA, 15 nt, Brucella suis 1330
ucugucaccugacgg

SEQ ID NO: 2471095 - RNA, 14 nt, Brucella suis 1330
ucuuauaguuuucu

SEQ ID NO: 2471096 - RNA, 21 nt, Brucella suis 1330
ucuucacagcggacuuggccu

SEQ ID NO: 2471097 - RNA, 17 nt, Brucella suis 1330
ucuucaccuguucggcg

SEQ ID NO: 2471098 - RNA, 23 nt, Brucella suis 1330
ucuucauugaccgaaaauggccc

SEQ ID NO: 2471099 - RNA, 20 nt, Brucella suis 1330
ucuucauuuuaucaauaagu

SEQ ID NO: 2471100 - RNA, 15 nt, Brucella suis 1330
ucuuccagaaugcgc

SEQ ID NO: 2471101 - RNA, 22 nt, Brucella suis 1330
ucuuccaggagagccuuugcuu

SEQ ID NO: 2471102 - RNA, 19 nt, Brucella suis 1330
ucuuccaguuccuucuuga

SEQ ID NO: 2471103 - RNA, 21 nt, Brucella suis 1330
ucuuccgacccgucaaugcca

SEQ ID NO: 2471104 - RNA, 18 nt, Brucella suis 1330
ucuucgauauugagagau

SEQ ID NO: 2471105 - RNA, 13 nt, Brucella suis 1330
ucuucgcccgacu

SEQ ID NO: 2471106 - RNA, 20 nt, Brucella suis 1330
ucuucugagaaaaaaaugcg

SEQ ID NO: 2471107 - RNA, 12 nt, Brucella suis 1330
ucuucugcaucg

SEQ ID NO: 2471108 - RNA, 15 nt, Brucella suis 1330
ucuugaccuggccag

SEQ ID NO: 2471109 - RNA, 18 nt, Brucella suis 1330
ucuugacguuauuuccga

SEQ ID NO: 2471110 - RNA, 17 nt, Brucella suis 1330
ucuugagguugagcugc

SEQ ID NO: 2471111 - RNA, 19 nt, Brucella suis 1330
ucuugagguugagcugcuc

SEQ ID NO: 2471112 - RNA, 19 nt, Brucella suis 1330
ucuugaucgauucggcuuc

SEQ ID NO: 2471113 - RNA, 15 nt, Brucella suis 1330
ucuugccaacauggc

SEQ ID NO: 2471114 - RNA, 22 nt, Brucella suis 1330
ucuugcgcccuccaccgcucac

SEQ ID NO: 2471115 - RNA, 21 nt, Brucella suis 1330
ucuugggauucucgaacaggu

SEQ ID NO: 2471116 - RNA, 16 nt, Brucella suis 1330
ucuugucgaagacgcg

SEQ ID NO: 2471117 - RNA, 14 nt, Brucella suis 1330
ucuuuccaaguuca

SEQ ID NO: 2471118 - RNA, 20 nt, Brucella suis 1330
ucuuuccccaugaccggaug

SEQ ID NO: 2471119 - RNA, 14 nt, Brucella suis 1330
ucuuugucggcucc

SEQ ID NO: 2471120 - RNA, 17 nt, Brucella suis 1330
ugaaaacaucgcggaac

SEQ ID NO: 2471121 - RNA, 16 nt, Brucella suis 1330
ugaaaaggauauccuu

SEQ ID NO: 2471122 - RNA, 19 nt, Brucella suis 1330
ugaaacgagacaaggcaau

SEQ ID NO: 2471123 - RNA, 22 nt, Brucella suis 1330
ugaaagaacggcaggaucuucc

SEQ ID NO: 2471124 - RNA, 14 nt, Brucella suis 1330
ugaaagaacggccc

SEQ ID NO: 2471125 - RNA, 14 nt, Brucella suis 1330
ugaaagcacaaaga

SEQ ID NO: 2471126 - RNA, 17 nt, Brucella suis 1330
ugaaagcacaaagaaca

SEQ ID NO: 2471127 - RNA, 19 nt, Brucella suis 1330
ugaaagcacaaagaacaag

SEQ ID NO: 2471128 - RNA, 21 nt, Brucella suis 1330
ugaaagcgcaauugcacagcg

SEQ ID NO: 2471129 - RNA, 18 nt, Brucella suis 1330
ugaaagcguagagugcuu

SEQ ID NO: 2471130 - RNA, 20 nt, Brucella suis 1330
ugaaauaauagucgaaaaaa

SEQ ID NO: 2471131 - RNA, 19 nt, Brucella suis 1330
ugaaauagcgguugcagcc

SEQ ID NO: 2471132 - RNA, 16 nt, Brucella suis 1330
ugaaauauuuauccgc

SEQ ID NO: 2471133 - RNA, 19 nt, Brucella suis 1330
ugaaaucgcugaucggcgc

SEQ ID NO: 2471134 - RNA, 14 nt, Brucella suis 1330
ugaaaucgucacug

SEQ ID NO: 2471135 - RNA, 13 nt, Brucella suis 1330
ugaacaaagauga

SEQ ID NO: 2471136 - RNA, 19 nt, Brucella suis 1330
ugaacagacccuugagcgu

SEQ ID NO: 2471137 - RNA, 22 nt, Brucella suis 1330
ugaacaguuugagcaugaugcc

SEQ ID NO: 2471138 - RNA, 19 nt, Brucella suis 1330
ugaacccgccaccagaccg

SEQ ID NO: 2471139 - RNA, 18 nt, Brucella suis 1330
ugaacggaucuugcgcac

SEQ ID NO: 2471140 - RNA, 12 nt, Brucella suis 1330
ugaagaaaacaa

SEQ ID NO: 2471141 - RNA, 20 nt, Brucella suis 1330
ugaagaagauaaucagcaga

SEQ ID NO: 2471142 - RNA, 18 nt, Brucella suis 1330
ugaagaagcuucacaucc

SEQ ID NO: 2471143 - RNA, 20 nt, Brucella suis 1330
ugaagaagcuucacauccuu

SEQ ID NO: 2471144 - RNA, 13 nt, Brucella suis 1330
ugaagacaucgag

SEQ ID NO: 2471145 - RNA, 21 nt, Brucella suis 1330
ugaagacaucgguggugccga

SEQ ID NO: 2471146 - RNA, 20 nt, Brucella suis 1330
ugaagacauggcgggccaug

SEQ ID NO: 2471147 - RNA, 16 nt, Brucella suis 1330
ugaagccaucuuucuu

SEQ ID NO: 2471148 - RNA, 23 nt, Brucella suis 1330
ugaagcgccgauaccgacggucg

SEQ ID NO: 2471149 - RNA, 13 nt, Brucella suis 1330
ugaagcugccgcg

SEQ ID NO: 2471150 - RNA, 19 nt, Brucella suis 1330
ugaaggcucggcaaaggga

SEQ ID NO: 2471151 - RNA, 22 nt, Brucella suis 1330
ugaagguaagcuuugcaccgcg

SEQ ID NO: 2471152 - RNA, 22 nt, Brucella suis 1330
ugaaucugaggccauuuugacc

SEQ ID NO: 2471153 - RNA, 22 nt, Brucella suis 1330
ugaaugccagauaaccugcgcg

SEQ ID NO: 2471154 - RNA, 15 nt, Brucella suis 1330
ugaaugcgccgccag

SEQ ID NO: 2471155 - RNA, 22 nt, Brucella suis 1330
ugaaugcgccgccagcauggcg

SEQ ID NO: 2471156 - RNA, 16 nt, Brucella suis 1330
ugaaugugccugugau

SEQ ID NO: 2471157 - RNA, 22 nt, Brucella suis 1330
ugaauugcccacauagggccuu

SEQ ID NO: 2471158 - RNA, 16 nt, Brucella suis 1330
ugacaccuucggccag

SEQ ID NO: 2471159 - RNA, 17 nt, Brucella suis 1330
ugacaccuucggccagc

SEQ ID NO: 2471160 - RNA, 20 nt, Brucella suis 1330
ugacagaauuuggaaguuuu

SEQ ID NO: 2471161 - RNA, 16 nt, Brucella suis 1330
ugacauccaugaaagc

SEQ ID NO: 2471162 - RNA, 14 nt, Brucella suis 1330
ugacaucuucuucg

SEQ ID NO: 2471163 - RNA, 14 nt, Brucella suis 1330
ugaccacgggcuuu

SEQ ID NO: 2471164 - RNA, 18 nt, Brucella suis 1330
ugacccggcgcaaaggcc

SEQ ID NO: 2471165 - RNA, 13 nt, Brucella suis 1330
ugaccgccgcgau

SEQ ID NO: 2471166 - RNA, 18 nt, Brucella suis 1330
ugaccgccuggcccggcu

SEQ ID NO: 2471167 - RNA, 20 nt, Brucella suis 1330
ugaccggaugcaaaaccggu

SEQ ID NO: 2471168 - RNA, 18 nt, Brucella suis 1330
ugaccggccacccagccc

SEQ ID NO: 2471169 - RNA, 17 nt, Brucella suis 1330
ugaccugacuugaaguc

SEQ ID NO: 2471170 - RNA, 14 nt, Brucella suis 1330
ugacgaaaaaggcg

SEQ ID NO: 2471171 - RNA, 21 nt, Brucella suis 1330
ugacgaaaaaggcgaucaggu

SEQ ID NO: 2471172 - RNA, 12 nt, Brucella suis 1330
ugacgaauucaa

SEQ ID NO: 2471173 - RNA, 17 nt, Brucella suis 1330
ugacgacggcuaaagca

SEQ ID NO: 2471174 - RNA, 15 nt, Brucella suis 1330
ugacgacugaaauaa

SEQ ID NO: 2471175 - RNA, 16 nt, Brucella suis 1330
ugacgacugaaauaau

SEQ ID NO: 2471176 - RNA, 15 nt, Brucella suis 1330
ugacgagcgcacgca

SEQ ID NO: 2471177 - RNA, 16 nt, Brucella suis 1330
ugacgccauugaccgc

SEQ ID NO: 2471178 - RNA, 23 nt, Brucella suis 1330
ugacgcccauuucacccgccaga

SEQ ID NO: 2471179 - RNA, 14 nt, Brucella suis 1330
ugacgcgcaucuuu

SEQ ID NO: 2471180 - RNA, 19 nt, Brucella suis 1330
ugacgcgggugaggcuuuc

SEQ ID NO: 2471181 - RNA, 21 nt, Brucella suis 1330
ugacggaugaggccugauagc

SEQ ID NO: 2471182 - RNA, 20 nt, Brucella suis 1330
ugacggccugcaaauggcgu

SEQ ID NO: 2471183 - RNA, 22 nt, Brucella suis 1330
ugacggcgcagcgacuuccagu

SEQ ID NO: 2471184 - RNA, 15 nt, Brucella suis 1330
ugacggcgcggcgca

SEQ ID NO: 2471185 - RNA, 23 nt, Brucella suis 1330
ugacggucgaagccacggcgauu

SEQ ID NO: 2471186 - RNA, 20 nt, Brucella suis 1330
ugacucugaccuuccugacc

SEQ ID NO: 2471187 - RNA, 20 nt, Brucella suis 1330
ugacuugaagucaucccgcc

SEQ ID NO: 2471188 - RNA, 18 nt, Brucella suis 1330
ugacuuuaauugucggcg

SEQ ID NO: 2471189 - RNA, 15 nt, Brucella suis 1330
ugagaagaaggaaua

SEQ ID NO: 2471190 - RNA, 16 nt, Brucella suis 1330
ugagaaggcaagcccc

SEQ ID NO: 2471191 - RNA, 22 nt, Brucella suis 1330
ugagaucaaccccgcacgguca

SEQ ID NO: 2471192 - RNA, 21 nt, Brucella suis 1330
ugagcaauagagucgccgaaa

SEQ ID NO: 2471193 - RNA, 23 nt, Brucella suis 1330
ugagcaccggaagcgcaaaacag

SEQ ID NO: 2471194 - RNA, 18 nt, Brucella suis 1330
ugagcagaagaaagggcg

SEQ ID NO: 2471195 - RNA, 16 nt, Brucella suis 1330
ugagcagcggcaaaaa

SEQ ID NO: 2471196 - RNA, 20 nt, Brucella suis 1330
ugagcaguaucgucguccag

SEQ ID NO: 2471197 - RNA, 15 nt, Brucella suis 1330
ugagccgcuucugcu

SEQ ID NO: 2471198 - RNA, 20 nt, Brucella suis 1330
ugagcgcaaggcuucgccag

SEQ ID NO: 2471199 - RNA, 20 nt, Brucella suis 1330
ugagcuugcgcagcgccgca

SEQ ID NO: 2471200 - RNA, 21 nt, Brucella suis 1330
ugagcuugcgcagcgccgcau

SEQ ID NO: 2471201 - RNA, 13 nt, Brucella suis 1330
ugaggauuuccac

SEQ ID NO: 2471202 - RNA, 15 nt, Brucella suis 1330
ugaggccauuuugac

SEQ ID NO: 2471203 - RNA, 14 nt, Brucella suis 1330
ugaggccgcgcgcg

SEQ ID NO: 2471204 - RNA, 13 nt, Brucella suis 1330
ugagggccagaag

SEQ ID NO: 2471205 - RNA, 14 nt, Brucella suis 1330
ugagggccgugacc

SEQ ID NO: 2471206 - RNA, 14 nt, Brucella suis 1330
ugaggggccaaagg

SEQ ID NO: 2471207 - RNA, 17 nt, Brucella suis 1330
ugagguguuucgcgcaa

SEQ ID NO: 2471208 - RNA, 15 nt, Brucella suis 1330
ugagguugagcugcu

SEQ ID NO: 2471209 - RNA, 20 nt, Brucella suis 1330
ugagugcgcacgccugccgc

SEQ ID NO: 2471210 - RNA, 17 nt, Brucella suis 1330
ugaguuuuucuuccaga

SEQ ID NO: 2471211 - RNA, 22 nt, Brucella suis 1330
ugauaagggcgcuuuucccaau

SEQ ID NO: 2471212 - RNA, 19 nt, Brucella suis 1330
ugauagaccgucuggccug

SEQ ID NO: 2471213 - RNA, 17 nt, Brucella suis 1330
ugauagcggaaaccagu

SEQ ID NO: 2471214 - RNA, 17 nt, Brucella suis 1330
ugauagcugcauccagc

SEQ ID NO: 2471215 - RNA, 18 nt, Brucella suis 1330
ugauagcuggaaaaaauc

SEQ ID NO: 2471216 - RNA, 13 nt, Brucella suis 1330
ugauaggcugcuu

SEQ ID NO: 2471217 - RNA, 21 nt, Brucella suis 1330
ugauagggcaauuggccccca

SEQ ID NO: 2471218 - RNA, 17 nt, Brucella suis 1330
ugaucagggcaaucugc

SEQ ID NO: 2471219 - RNA, 17 nt, Brucella suis 1330
ugauccgcuccagauug

SEQ ID NO: 2471220 - RNA, 17 nt, Brucella suis 1330
ugauccgucacggucag

SEQ ID NO: 2471221 - RNA, 17 nt, Brucella suis 1330
ugaucgauucggcuuca

SEQ ID NO: 2471222 - RNA, 18 nt, Brucella suis 1330
ugaucgauucggcuucac

SEQ ID NO: 2471223 - RNA, 18 nt, Brucella suis 1330
ugaucgcccgcccggcau

SEQ ID NO: 2471224 - RNA, 20 nt, Brucella suis 1330
ugaucgccgcccuugugauc

SEQ ID NO: 2471225 - RNA, 18 nt, Brucella suis 1330
ugaucggcgugccauugu

SEQ ID NO: 2471226 - RNA, 14 nt, Brucella suis 1330
ugaucguauagccc

SEQ ID NO: 2471227 - RNA, 16 nt, Brucella suis 1330
ugaucguauagcccug

SEQ ID NO: 2471228 - RNA, 19 nt, Brucella suis 1330
ugaucucggagcggccgga

SEQ ID NO: 2471229 - RNA, 13 nt, Brucella suis 1330
ugaucuggaagga

SEQ ID NO: 2471230 - RNA, 12 nt, Brucella suis 1330
ugaucuugucca

SEQ ID NO: 2471231 - RNA, 15 nt, Brucella suis 1330
ugaugauaggcugcu

SEQ ID NO: 2471232 - RNA, 22 nt, Brucella suis 1330
ugaugccggucgcaggcgcucu

SEQ ID NO: 2471233 - RNA, 21 nt, Brucella suis 1330
ugauggcccuuguggccacga

SEQ ID NO: 2471234 - RNA, 20 nt, Brucella suis 1330
ugauggcgagaacuucccgc

SEQ ID NO: 2471235 - RNA, 13 nt, Brucella suis 1330
ugauggugcccag

SEQ ID NO: 2471236 - RNA, 21 nt, Brucella suis 1330
ugauucaaucagaucgaaaug

SEQ ID NO: 2471237 - RNA, 18 nt, Brucella suis 1330
ugauugggcggcggcacg

SEQ ID NO: 2471238 - RNA, 21 nt, Brucella suis 1330
ugauuucaauaacaaaggccg

SEQ ID NO: 2471239 - RNA, 18 nt, Brucella suis 1330
ugauuuccccgcauaaau

SEQ ID NO: 2471240 - RNA, 19 nt, Brucella suis 1330
ugauuucccgugcggccuu

SEQ ID NO: 2471241 - RNA, 19 nt, Brucella suis 1330
ugauuuccgcuucugcuuu

SEQ ID NO: 2471242 - RNA, 20 nt, Brucella suis 1330
ugauuucuucccgaaagcuu

SEQ ID NO: 2471243 - RNA, 13 nt, Brucella suis 1330
ugcaaaaccgguu

SEQ ID NO: 2471244 - RNA, 21 nt, Brucella suis 1330
ugcaaagcgcaucccgaaaag

SEQ ID NO: 2471245 - RNA, 19 nt, Brucella suis 1330
ugcaaagcggcuuuccagc

SEQ ID NO: 2471246 - RNA, 20 nt, Brucella suis 1330
ugcaaauggcaauuuaucug

SEQ ID NO: 2471247 - RNA, 13 nt, Brucella suis 1330
ugcaaauggcguu

SEQ ID NO: 2471248 - RNA, 14 nt, Brucella suis 1330
ugcaacaaaagaag

SEQ ID NO: 2471249 - RNA, 16 nt, Brucella suis 1330
ugcaacaaaagaagau

SEQ ID NO: 2471250 - RNA, 20 nt, Brucella suis 1330
ugcaacaaaugcaaaugccg

SEQ ID NO: 2471251 - RNA, 16 nt, Brucella suis 1330
ugcaacgcgccaaacu

SEQ ID NO: 2471252 - RNA, 14 nt, Brucella suis 1330
ugcaagccgcggcg

SEQ ID NO: 2471253 - RNA, 15 nt, Brucella suis 1330
ugcaagcgcaaagcu

SEQ ID NO: 2471254 - RNA, 21 nt, Brucella suis 1330
ugcaagcgucuucugagaaaa

SEQ ID NO: 2471255 - RNA, 15 nt, Brucella suis 1330
ugcaagggcuggcuc

SEQ ID NO: 2471256 - RNA, 16 nt, Brucella suis 1330
ugcaagggcuggcucu

SEQ ID NO: 2471257 - RNA, 21 nt, Brucella suis 1330
ugcaagugugcgcgcgccauc

SEQ ID NO: 2471258 - RNA, 24 nt, Brucella suis 1330
ugcaaucaccagagacaguggcuc

SEQ ID NO: 2471259 - RNA, 16 nt, Brucella suis 1330
ugcaauccacaggaga

SEQ ID NO: 2471260 - RNA, 22 nt, Brucella suis 1330
ugcaaugcgucgauggccgguu

SEQ ID NO: 2471261 - RNA, 16 nt, Brucella suis 1330
ugcaauggucgacaau

SEQ ID NO: 2471262 - RNA, 19 nt, Brucella suis 1330
ugcaauggucgacaaugaa

SEQ ID NO: 2471263 - RNA, 12 nt, Brucella suis 1330
ugcacaguuccg

SEQ ID NO: 2471264 - RNA, 12 nt, Brucella suis 1330
ugcaccagagca

SEQ ID NO: 2471265 - RNA, 20 nt, Brucella suis 1330
ugcaccagagcauucccuuc

SEQ ID NO: 2471266 - RNA, 12 nt, Brucella suis 1330
ugcaccgccgau

SEQ ID NO: 2471267 - RNA, 16 nt, Brucella suis 1330
ugcaccgccugccagc

SEQ ID NO: 2471268 - RNA, 18 nt, Brucella suis 1330
ugcaccggcccaaaggcc

SEQ ID NO: 2471269 - RNA, 20 nt, Brucella suis 1330
ugcaccggcccaaaggccgc

SEQ ID NO: 2471270 - RNA, 14 nt, Brucella suis 1330
ugcaccggcuuccc

SEQ ID NO: 2471271 - RNA, 19 nt, Brucella suis 1330
ugcacgcacaucggaaagc

SEQ ID NO: 2471272 - RNA, 23 nt, Brucella suis 1330
ugcacgucaccauauucguccac

SEQ ID NO: 2471273 - RNA, 13 nt, Brucella suis 1330
ugcacuucuuuau

SEQ ID NO: 2471274 - RNA, 18 nt, Brucella suis 1330
ugcacuucuuuauggcuc

SEQ ID NO: 2471275 - RNA, 18 nt, Brucella suis 1330
ugcagaacaaagaaguug

SEQ ID NO: 2471276 - RNA, 15 nt, Brucella suis 1330
ugcagaacgucucgg

SEQ ID NO: 2471277 - RNA, 16 nt, Brucella suis 1330
ugcagaacgucucggg

SEQ ID NO: 2471278 - RNA, 23 nt, Brucella suis 1330
ugcagacaaguccuaaaacaccg

SEQ ID NO: 2471279 - RNA, 13 nt, Brucella suis 1330
ugcagacacgcuu

SEQ ID NO: 2471280 - RNA, 14 nt, Brucella suis 1330
ugcagacaggccag

SEQ ID NO: 2471281 - RNA, 18 nt, Brucella suis 1330
ugcagacgggacgcaggc

SEQ ID NO: 2471282 - RNA, 21 nt, Brucella suis 1330
ugcagagcgcauccagcgagu

SEQ ID NO: 2471283 - RNA, 22 nt, Brucella suis 1330
ugcagaugagcggcagcagcca

SEQ ID NO: 2471284 - RNA, 23 nt, Brucella suis 1330
ugcagaugagcggcagcagccau

SEQ ID NO: 2471285 - RNA, 15 nt, Brucella suis 1330
ugcagaugcaccauc

SEQ ID NO: 2471286 - RNA, 17 nt, Brucella suis 1330
ugcagaugcaccaucau

SEQ ID NO: 2471287 - RNA, 19 nt, Brucella suis 1330
ugcagcaauuccugcgcca

SEQ ID NO: 2471288 - RNA, 19 nt, Brucella suis 1330
ugcagcccaaccgagcaga

SEQ ID NO: 2471289 - RNA, 13 nt, Brucella suis 1330
ugcagccugaaca

SEQ ID NO: 2471290 - RNA, 15 nt, Brucella suis 1330
ugcagccugaacagc

SEQ ID NO: 2471291 - RNA, 18 nt, Brucella suis 1330
ugcagccugaacagcguu

SEQ ID NO: 2471292 - RNA, 18 nt, Brucella suis 1330
ugcagcggcgcacucauc

SEQ ID NO: 2471293 - RNA, 15 nt, Brucella suis 1330
ugcaggacuggacau

SEQ ID NO: 2471294 - RNA, 23 nt, Brucella suis 1330
ugcaggccgucagaaccggaaua

SEQ ID NO: 2471295 - RNA, 14 nt, Brucella suis 1330
ugcaggcgcggcaa

SEQ ID NO: 2471296 - RNA, 14 nt, Brucella suis 1330
ugcagggcuugcuu

SEQ ID NO: 2471297 - RNA, 17 nt, Brucella suis 1330
ugcagucuucggccggg

SEQ ID NO: 2471298 - RNA, 19 nt, Brucella suis 1330
ugcagucuucggccgggca

SEQ ID NO: 2471299 - RNA, 24 nt, Brucella suis 1330
ugcagucuucggccgggcaucgcu

SEQ ID NO: 2471300 - RNA, 13 nt, Brucella suis 1330
ugcauaaucggca

SEQ ID NO: 2471301 - RNA, 12 nt, Brucella suis 1330
ugcauauuaagc

SEQ ID NO: 2471302 - RNA, 14 nt, Brucella suis 1330
ugcauauuccacau

SEQ ID NO: 2471303 - RNA, 18 nt, Brucella suis 1330
ugcaucgaaugccgcaug

SEQ ID NO: 2471304 - RNA, 20 nt, Brucella suis 1330
ugcaucgaaugccgcaugau

SEQ ID NO: 2471305 - RNA, 20 nt, Brucella suis 1330
ugcaucgacugcgaauguca

SEQ ID NO: 2471306 - RNA, 20 nt, Brucella suis 1330
ugcaugugcggugagaagaa

SEQ ID NO: 2471307 - RNA, 13 nt, Brucella suis 1330
ugcauuccagaag

SEQ ID NO: 2471308 - RNA, 19 nt, Brucella suis 1330
ugcauucucgcccaagguc

SEQ ID NO: 2471309 - RNA, 17 nt, Brucella suis 1330
ugcauuggcgauuuucu

SEQ ID NO: 2471310 - RNA, 21 nt, Brucella suis 1330
ugcauuuuucgccgcgcacug

SEQ ID NO: 2471311 - RNA, 19 nt, Brucella suis 1330
ugccaagugaagcgaagaa

SEQ ID NO: 2471312 - RNA, 15 nt, Brucella suis 1330
ugccacgcgccgcca

SEQ ID NO: 2471313 - RNA, 13 nt, Brucella suis 1330
ugccagcaauugc

SEQ ID NO: 2471314 - RNA, 15 nt, Brucella suis 1330
ugccagcaccagcgg

SEQ ID NO: 2471315 - RNA, 14 nt, Brucella suis 1330
ugccauaauucagc

SEQ ID NO: 2471316 - RNA, 19 nt, Brucella suis 1330
ugccauagccuuucugcca

SEQ ID NO: 2471317 - RNA, 16 nt, Brucella suis 1330
ugccauauaggauucu

SEQ ID NO: 2471318 - RNA, 18 nt, Brucella suis 1330
ugccaucaccagccccca

SEQ ID NO: 2471319 - RNA, 22 nt, Brucella suis 1330
ugccaucuucacccacgccaau

SEQ ID NO: 2471320 - RNA, 18 nt, Brucella suis 1330
ugccaugccgccaaggcc

SEQ ID NO: 2471321 - RNA, 13 nt, Brucella suis 1330
ugccauugccgcg

SEQ ID NO: 2471322 - RNA, 20 nt, Brucella suis 1330
ugcccaaaagcgcgccgaaa

SEQ ID NO: 2471323 - RNA, 16 nt, Brucella suis 1330
ugcccacaucgccuug

SEQ ID NO: 2471324 - RNA, 20 nt, Brucella suis 1330
ugcccauggacuuuucagcc

SEQ ID NO: 2471325 - RNA, 17 nt, Brucella suis 1330
ugcccauguccgccuga

SEQ ID NO: 2471326 - RNA, 19 nt, Brucella suis 1330
ugcccauguccgccugauc

SEQ ID NO: 2471327 - RNA, 19 nt, Brucella suis 1330
ugcccgacugaacgaaugc

SEQ ID NO: 2471328 - RNA, 22 nt, Brucella suis 1330
ugcccgcacccuauuccccuau

SEQ ID NO: 2471329 - RNA, 14 nt, Brucella suis 1330
ugcccgccaauacc

SEQ ID NO: 2471330 - RNA, 13 nt, Brucella suis 1330
ugcccgccggggc

SEQ ID NO: 2471331 - RNA, 15 nt, Brucella suis 1330
ugcccgccggggccg

SEQ ID NO: 2471332 - RNA, 21 nt, Brucella suis 1330
ugcccggaucaauuccugugc

SEQ ID NO: 2471333 - RNA, 22 nt, Brucella suis 1330
ugcccgucgcaggcggaugaag

SEQ ID NO: 2471334 - RNA, 14 nt, Brucella suis 1330
ugcccucgccgccg

SEQ ID NO: 2471335 - RNA, 17 nt, Brucella suis 1330
ugcccugcugcaacaaa

SEQ ID NO: 2471336 - RNA, 19 nt, Brucella suis 1330
ugcccuugcgaauggcaau

SEQ ID NO: 2471337 - RNA, 16 nt, Brucella suis 1330
ugccgaagcccauggc

SEQ ID NO: 2471338 - RNA, 17 nt, Brucella suis 1330
ugccgaagcccauggca

SEQ ID NO: 2471339 - RNA, 23 nt, Brucella suis 1330
ugccgaagcccauggcauaccga

SEQ ID NO: 2471340 - RNA, 22 nt, Brucella suis 1330
ugccgacgcgcucggcaagcuc

SEQ ID NO: 2471341 - RNA, 13 nt, Brucella suis 1330
ugccgagaaugcg

SEQ ID NO: 2471342 - RNA, 18 nt, Brucella suis 1330
ugccgagcauggccugcg

SEQ ID NO: 2471343 - RNA, 23 nt, Brucella suis 1330
ugccgagccgaauuccgccaugc

SEQ ID NO: 2471344 - RNA, 23 nt, Brucella suis 1330
ugccgagcgaacgcuccugcaug

SEQ ID NO: 2471345 - RNA, 18 nt, Brucella suis 1330
ugccgauggugacggucg

SEQ ID NO: 2471346 - RNA, 16 nt, Brucella suis 1330
ugccgauuucggcgug

SEQ ID NO: 2471347 - RNA, 18 nt, Brucella suis 1330
ugccgauuucggcgugca

SEQ ID NO: 2471348 - RNA, 14 nt, Brucella suis 1330
ugccgcaauccugg

SEQ ID NO: 2471349 - RNA, 14 nt, Brucella suis 1330
ugccgcagccaggg

SEQ ID NO: 2471350 - RNA, 17 nt, Brucella suis 1330
ugccgcauaaagcacag

SEQ ID NO: 2471351 - RNA, 19 nt, Brucella suis 1330
ugccgcauaaagcacagcc

SEQ ID NO: 2471352 - RNA, 20 nt, Brucella suis 1330
ugccgcccaucccggaagga

SEQ ID NO: 2471353 - RNA, 16 nt, Brucella suis 1330
ugccgccgcuuccagc

SEQ ID NO: 2471354 - RNA, 17 nt, Brucella suis 1330
ugccgcgcaucggccuu

SEQ ID NO: 2471355 - RNA, 23 nt, Brucella suis 1330
ugccgcggcucucacgcgcagca

SEQ ID NO: 2471356 - RNA, 21 nt, Brucella suis 1330
ugccgcucggcgaugaagcgg

SEQ ID NO: 2471357 - RNA, 13 nt, Brucella suis 1330
ugccgcuuccagc

SEQ ID NO: 2471358 - RNA, 17 nt, Brucella suis 1330
ugccgcuuuucauguuu

SEQ ID NO: 2471359 - RNA, 22 nt, Brucella suis 1330
ugccgggcgcaaccuggcugca

SEQ ID NO: 2471360 - RNA, 12 nt, Brucella suis 1330
ugccgggcgggc

SEQ ID NO: 2471361 - RNA, 21 nt, Brucella suis 1330
ugccgggcgggcagcacugaa

SEQ ID NO: 2471362 - RNA, 14 nt, Brucella suis 1330
ugccgggguuuuuc

SEQ ID NO: 2471363 - RNA, 18 nt, Brucella suis 1330
ugccgguauuuugcaacu

SEQ ID NO: 2471364 - RNA, 17 nt, Brucella suis 1330
ugccggucgcaggcgcu

SEQ ID NO: 2471365 - RNA, 22 nt, Brucella suis 1330
ugccgguugccuugcccauggu

SEQ ID NO: 2471366 - RNA, 18 nt, Brucella suis 1330
ugccguaucacgccgcga

SEQ ID NO: 2471367 - RNA, 23 nt, Brucella suis 1330
ugccguuuuucacauagccugca

SEQ ID NO: 2471368 - RNA, 20 nt, Brucella suis 1330
ugccucgcgaacauucaggc

SEQ ID NO: 2471369 - RNA, 21 nt, Brucella suis 1330
ugccucggcaucggaacccca

SEQ ID NO: 2471370 - RNA, 16 nt, Brucella suis 1330
ugccugaaacaaggcc

SEQ ID NO: 2471371 - RNA, 15 nt, Brucella suis 1330
ugccugccgcagcca

SEQ ID NO: 2471372 - RNA, 13 nt, Brucella suis 1330
ugccugccgcgcc

SEQ ID NO: 2471373 - RNA, 14 nt, Brucella suis 1330
ugccugccgcgccg

SEQ ID NO: 2471374 - RNA, 17 nt, Brucella suis 1330
ugccuuaaucccuuacu

SEQ ID NO: 2471375 - RNA, 18 nt, Brucella suis 1330
ugccuuaaucccuuacuc

SEQ ID NO: 2471376 - RNA, 20 nt, Brucella suis 1330
ugccuuccccauacguccag

SEQ ID NO: 2471377 - RNA, 20 nt, Brucella suis 1330
ugccuucgacaaccgcgccg

SEQ ID NO: 2471378 - RNA, 19 nt, Brucella suis 1330
ugccuucgcgccaggcuuc

SEQ ID NO: 2471379 - RNA, 20 nt, Brucella suis 1330
ugccuucuugcacaguuccg

SEQ ID NO: 2471380 - RNA, 18 nt, Brucella suis 1330
ugccuugggaggcgauuu

SEQ ID NO: 2471381 - RNA, 16 nt, Brucella suis 1330
ugccuuuuacagcgua

SEQ ID NO: 2471382 - RNA, 16 nt, Brucella suis 1330
ugcgaaacggagaaaa

SEQ ID NO: 2471383 - RNA, 17 nt, Brucella suis 1330
ugcgaaacggagaaaac

SEQ ID NO: 2471384 - RNA, 13 nt, Brucella suis 1330
ugcgaaccaucac

SEQ ID NO: 2471385 - RNA, 18 nt, Brucella suis 1330
ugcgaagcgguguucggg

SEQ ID NO: 2471386 - RNA, 19 nt, Brucella suis 1330
ugcgaauggcaaucuccau

SEQ ID NO: 2471387 - RNA, 20 nt, Brucella suis 1330
ugcgaugagccuucaucuuc

SEQ ID NO: 2471388 - RNA, 14 nt, Brucella suis 1330
ugcgaugauauucg

SEQ ID NO: 2471389 - RNA, 24 nt, Brucella suis 1330
ugcgauuuccuugccgcucucguc

SEQ ID NO: 2471390 - RNA, 18 nt, Brucella suis 1330
ugcgauuucgccaaguuc

SEQ ID NO: 2471391 - RNA, 16 nt, Brucella suis 1330
ugcgcaccgguauugc

SEQ ID NO: 2471392 - RNA, 20 nt, Brucella suis 1330
ugcgcacgccugccgcgcgg

SEQ ID NO: 2471393 - RNA, 14 nt, Brucella suis 1330
ugcgcagcgccgca

SEQ ID NO: 2471394 - RNA, 16 nt, Brucella suis 1330
ugcgcagggucugcgc

SEQ ID NO: 2471395 - RNA, 21 nt, Brucella suis 1330
ugcgcaucuuugcccuugccu

SEQ ID NO: 2471396 - RNA, 18 nt, Brucella suis 1330
ugcgcaugaagcgcggcg

SEQ ID NO: 2471397 - RNA, 17 nt, Brucella suis 1330
ugcgcaugggacuggac

SEQ ID NO: 2471398 - RNA, 21 nt, Brucella suis 1330
ugcgccacgagaaccgcgccg

SEQ ID NO: 2471399 - RNA, 13 nt, Brucella suis 1330
ugcgccgaacagc

SEQ ID NO: 2471400 - RNA, 14 nt, Brucella suis 1330
ugcgccgcaggaac

SEQ ID NO: 2471401 - RNA, 15 nt, Brucella suis 1330
ugcgccgccagcaug

SEQ ID NO: 2471402 - RNA, 15 nt, Brucella suis 1330
ugcgccuaccaaggc

SEQ ID NO: 2471403 - RNA, 21 nt, Brucella suis 1330
ugcgcgcaaggaaagaucugc

SEQ ID NO: 2471404 - RNA, 18 nt, Brucella suis 1330
ugcgcgcgccaucggcaa

SEQ ID NO: 2471405 - RNA, 21 nt, Brucella suis 1330
ugcgcggaaaauguuccgcac

SEQ ID NO: 2471406 - RNA, 18 nt, Brucella suis 1330
ugcgcggacgggcaggca

SEQ ID NO: 2471407 - RNA, 18 nt, Brucella suis 1330
ugcgcggcaagauagccc

SEQ ID NO: 2471408 - RNA, 20 nt, Brucella suis 1330
ugcgcggccagccagcgcau

SEQ ID NO: 2471409 - RNA, 20 nt, Brucella suis 1330
ugcgcguagggcagaucugu

SEQ ID NO: 2471410 - RNA, 17 nt, Brucella suis 1330
ugcgcucgguaucggcg

SEQ ID NO: 2471411 - RNA, 16 nt, Brucella suis 1330
ugcgcucuaaccauuu

SEQ ID NO: 2471412 - RNA, 21 nt, Brucella suis 1330
ugcgcugauucuggauuucau

SEQ ID NO: 2471413 - RNA, 15 nt, Brucella suis 1330
ugcgcuucgaggaac

SEQ ID NO: 2471414 - RNA, 18 nt, Brucella suis 1330
ugcggaggcggcugccuu

SEQ ID NO: 2471415 - RNA, 17 nt, Brucella suis 1330
ugcggauacccaugcga

SEQ ID NO: 2471416 - RNA, 15 nt, Brucella suis 1330
ugcggaucggcuuca

SEQ ID NO: 2471417 - RNA, 16 nt, Brucella suis 1330
ugcggcaguccggcag

SEQ ID NO: 2471418 - RNA, 19 nt, Brucella suis 1330
ugcggccugcacggcuuca

SEQ ID NO: 2471419 - RNA, 13 nt, Brucella suis 1330
ugcggcgagcgac

SEQ ID NO: 2471420 - RNA, 17 nt, Brucella suis 1330
ugcggcgcgcauuucau

SEQ ID NO: 2471421 - RNA, 15 nt, Brucella suis 1330
ugcggcggcgcgcaa

SEQ ID NO: 2471422 - RNA, 17 nt, Brucella suis 1330
ugcggcggcgucagcuu

SEQ ID NO: 2471423 - RNA, 20 nt, Brucella suis 1330
ugcggcggcgucagcuuguc

SEQ ID NO: 2471424 - RNA, 15 nt, Brucella suis 1330
ugcggcuugccacca

SEQ ID NO: 2471425 - RNA, 19 nt, Brucella suis 1330
ugcggcuugccaccacgau

SEQ ID NO: 2471426 - RNA, 12 nt, Brucella suis 1330
ugcgggcaagca

SEQ ID NO: 2471427 - RNA, 23 nt, Brucella suis 1330
ugcgggcaagcauuccgggccgc

SEQ ID NO: 2471428 - RNA, 20 nt, Brucella suis 1330
ugcgggccaugguuucggcg

SEQ ID NO: 2471429 - RNA, 16 nt, Brucella suis 1330
ugcgggcuucuuccag

SEQ ID NO: 2471430 - RNA, 15 nt, Brucella suis 1330
ugcggucggccgcgc

SEQ ID NO: 2471431 - RNA, 17 nt, Brucella suis 1330
ugcggucggccgcgcgg

SEQ ID NO: 2471432 - RNA, 22 nt, Brucella suis 1330
ugcggucuuuaccuugaaaguc

SEQ ID NO: 2471433 - RNA, 17 nt, Brucella suis 1330
ugcggugagaagaagga

SEQ ID NO: 2471434 - RNA, 13 nt, Brucella suis 1330
ugcggugcuccca

SEQ ID NO: 2471435 - RNA, 16 nt, Brucella suis 1330
ugcggugugaagcgga

SEQ ID NO: 2471436 - RNA, 21 nt, Brucella suis 1330
ugcguaccauaggcgcgcgca

SEQ ID NO: 2471437 - RNA, 17 nt, Brucella suis 1330
ugcguugcuggaacauc

SEQ ID NO: 2471438 - RNA, 22 nt, Brucella suis 1330
ugcguuguuuucgcgcagaagg

SEQ ID NO: 2471439 - RNA, 20 nt, Brucella suis 1330
ugcguuuucgagccaaaagu

SEQ ID NO: 2471440 - RNA, 16 nt, Brucella suis 1330
ugcuauggcacaagaa

SEQ ID NO: 2471441 - RNA, 12 nt, Brucella suis 1330
ugcucaaaugcg

SEQ ID NO: 2471442 - RNA, 21 nt, Brucella suis 1330
ugcucaucaucacauuggugc

SEQ ID NO: 2471443 - RNA, 17 nt, Brucella suis 1330
ugcucauggcuuccugc

SEQ ID NO: 2471444 - RNA, 20 nt, Brucella suis 1330
ugcuccagcccuuuccugac

SEQ ID NO: 2471445 - RNA, 21 nt, Brucella suis 1330
ugcuccagcccuuuccugacc

SEQ ID NO: 2471446 - RNA, 13 nt, Brucella suis 1330
ugcuccuggcaca

SEQ ID NO: 2471447 - RNA, 23 nt, Brucella suis 1330
ugcucgcgguugaggauuuccac

SEQ ID NO: 2471448 - RNA, 23 nt, Brucella suis 1330
ugcucgucggaaauaucgccgac

SEQ ID NO: 2471449 - RNA, 15 nt, Brucella suis 1330
ugcucuauuucggcg

SEQ ID NO: 2471450 - RNA, 16 nt, Brucella suis 1330
ugcucugcgcccaggc

SEQ ID NO: 2471451 - RNA, 16 nt, Brucella suis 1330
ugcugaaaaggcuggc

SEQ ID NO: 2471452 - RNA, 22 nt, Brucella suis 1330
ugcugaaacgagacaaggcaau

SEQ ID NO: 2471453 - RNA, 20 nt, Brucella suis 1330
ugcugcaauccacaggagau

SEQ ID NO: 2471454 - RNA, 20 nt, Brucella suis 1330
ugcugcaccguugccucugu

SEQ ID NO: 2471455 - RNA, 13 nt, Brucella suis 1330
ugcugccaugucu

SEQ ID NO: 2471456 - RNA, 13 nt, Brucella suis 1330
ugcuggaaaugcu

SEQ ID NO: 2471457 - RNA, 17 nt, Brucella suis 1330
ugcuggaauugacgaca

SEQ ID NO: 2471458 - RNA, 17 nt, Brucella suis 1330
ugcuggccaccagaaau

SEQ ID NO: 2471459 - RNA, 18 nt, Brucella suis 1330
ugcuggccguggcaucaa

SEQ ID NO: 2471460 - RNA, 13 nt, Brucella suis 1330
ugcuggccugugc

SEQ ID NO: 2471461 - RNA, 20 nt, Brucella suis 1330
ugcuggcggccaagcgccag

SEQ ID NO: 2471462 - RNA, 17 nt, Brucella suis 1330
ugcugggcuuccucacg

SEQ ID NO: 2471463 - RNA, 17 nt, Brucella suis 1330
ugcuggucguuugccuc

SEQ ID NO: 2471464 - RNA, 17 nt, Brucella suis 1330
ugcuggugccgcuggcu

SEQ ID NO: 2471465 - RNA, 21 nt, Brucella suis 1330
ugcugguuuaagccuuggucc

SEQ ID NO: 2471466 - RNA, 17 nt, Brucella suis 1330
ugcuuauacgcuccgcc

SEQ ID NO: 2471467 - RNA, 14 nt, Brucella suis 1330
ugcuucacaugcuu

SEQ ID NO: 2471468 - RNA, 13 nt, Brucella suis 1330
ugcuucaggcacu

SEQ ID NO: 2471469 - RNA, 22 nt, Brucella suis 1330
ugcuucaggcacucuccucugc

SEQ ID NO: 2471470 - RNA, 20 nt, Brucella suis 1330
ugcuuccuuuucggcuuccu

SEQ ID NO: 2471471 - RNA, 22 nt, Brucella suis 1330
ugcuucgcaccuuccacauugu

SEQ ID NO: 2471472 - RNA, 22 nt, Brucella suis 1330
ugcuucggccgacagaugcgca

SEQ ID NO: 2471473 - RNA, 18 nt, Brucella suis 1330
ugcuugagggguucggcg

SEQ ID NO: 2471474 - RNA, 19 nt, Brucella suis 1330
ugcuugagggguucggcgu

SEQ ID NO: 2471475 - RNA, 20 nt, Brucella suis 1330
ugcuugccauucugucggcg

SEQ ID NO: 2471476 - RNA, 15 nt, Brucella suis 1330
ugcuugccgauaaua

SEQ ID NO: 2471477 - RNA, 15 nt, Brucella suis 1330
ugcuugccgccgauc

SEQ ID NO: 2471478 - RNA, 14 nt, Brucella suis 1330
ugcuugccucgucc

SEQ ID NO: 2471479 - RNA, 12 nt, Brucella suis 1330
ugcuuuccugca

SEQ ID NO: 2471480 - RNA, 20 nt, Brucella suis 1330
ugcuuucggcggcaguuuca

SEQ ID NO: 2471481 - RNA, 21 nt, Brucella suis 1330
ugcuuucggcggcaguuucac

SEQ ID NO: 2471482 - RNA, 16 nt, Brucella suis 1330
ugcuuuggugaagguu

SEQ ID NO: 2471483 - RNA, 21 nt, Brucella suis 1330
uggaaaaacccggccuuugcg

SEQ ID NO: 2471484 - RNA, 17 nt, Brucella suis 1330
uggaaacgauuuucgcc

SEQ ID NO: 2471485 - RNA, 15 nt, Brucella suis 1330
uggaaaugcgcucga

SEQ ID NO: 2471486 - RNA, 22 nt, Brucella suis 1330
uggaaauugacauuugaagcga

SEQ ID NO: 2471487 - RNA, 23 nt, Brucella suis 1330
uggaaauugacauuugaagcgac

SEQ ID NO: 2471488 - RNA, 19 nt, Brucella suis 1330
uggaacggaaaaugcccgg

SEQ ID NO: 2471489 - RNA, 18 nt, Brucella suis 1330
uggaacgggcccuucgcu

SEQ ID NO: 2471490 - RNA, 20 nt, Brucella suis 1330
uggaacucgaagauggaacg

SEQ ID NO: 2471491 - RNA, 20 nt, Brucella suis 1330
uggaagcacauggcggccuu

SEQ ID NO: 2471492 - RNA, 23 nt, Brucella suis 1330
uggaagccgacagaagauagaca

SEQ ID NO: 2471493 - RNA, 14 nt, Brucella suis 1330
uggaaggccaggcc

SEQ ID NO: 2471494 - RNA, 16 nt, Brucella suis 1330
uggaagugaauuucgg

SEQ ID NO: 2471495 - RNA, 16 nt, Brucella suis 1330
uggaauuguuccagcc

SEQ ID NO: 2471496 - RNA, 23 nt, Brucella suis 1330
uggacauagccgguauccagcag

SEQ ID NO: 2471497 - RNA, 20 nt, Brucella suis 1330
uggaccacgcauagcgcgcc

SEQ ID NO: 2471498 - RNA, 17 nt, Brucella suis 1330
uggacuauuuccaucgc

SEQ ID NO: 2471499 - RNA, 19 nt, Brucella suis 1330
uggagagaggaagcaagaa

SEQ ID NO: 2471500 - RNA, 19 nt, Brucella suis 1330
uggagcauuuccagcaaaa

SEQ ID NO: 2471501 - RNA, 18 nt, Brucella suis 1330
uggagcgcauccgccugc

SEQ ID NO: 2471502 - RNA, 17 nt, Brucella suis 1330
uggagcguacaccgacc

SEQ ID NO: 2471503 - RNA, 22 nt, Brucella suis 1330
uggaggcaacauugaguuucau

SEQ ID NO: 2471504 - RNA, 16 nt, Brucella suis 1330
uggagugcacggccau

SEQ ID NO: 2471505 - RNA, 18 nt, Brucella suis 1330
uggauauccacaagcauc

SEQ ID NO: 2471506 - RNA, 14 nt, Brucella suis 1330
uggaugccgccgca

SEQ ID NO: 2471507 - RNA, 17 nt, Brucella suis 1330
uggaugugcagcgugcc

SEQ ID NO: 2471508 - RNA, 12 nt, Brucella suis 1330
uggcaagcccgc

SEQ ID NO: 2471509 - RNA, 16 nt, Brucella suis 1330
uggcaagcccgcugcg

SEQ ID NO: 2471510 - RNA, 22 nt, Brucella suis 1330
uggcaaucuugaccuggccagc

SEQ ID NO: 2471511 - RNA, 15 nt, Brucella suis 1330
uggcaauuuccagau

SEQ ID NO: 2471512 - RNA, 14 nt, Brucella suis 1330
uggcagcagucaaa

SEQ ID NO: 2471513 - RNA, 13 nt, Brucella suis 1330
uggcagccgggau

SEQ ID NO: 2471514 - RNA, 21 nt, Brucella suis 1330
uggcaucaauccuucaugccg

SEQ ID NO: 2471515 - RNA, 15 nt, Brucella suis 1330
uggcauccacucggc

SEQ ID NO: 2471516 - RNA, 13 nt, Brucella suis 1330
uggcauccagcac

SEQ ID NO: 2471517 - RNA, 16 nt, Brucella suis 1330
uggcaugggagcaccg

SEQ ID NO: 2471518 - RNA, 14 nt, Brucella suis 1330
uggccccggagcgg

SEQ ID NO: 2471519 - RNA, 21 nt, Brucella suis 1330
uggcccgauaucgguggccuu

SEQ ID NO: 2471520 - RNA, 14 nt, Brucella suis 1330
uggccgaaccgucc

SEQ ID NO: 2471521 - RNA, 17 nt, Brucella suis 1330
uggccgagcgacacauc

SEQ ID NO: 2471522 - RNA, 20 nt, Brucella suis 1330
uggccgcauugucgaaggac

SEQ ID NO: 2471523 - RNA, 13 nt, Brucella suis 1330
uggccgcucgcug

SEQ ID NO: 2471524 - RNA, 23 nt, Brucella suis 1330
uggccgucccggaagccgccuuc

SEQ ID NO: 2471525 - RNA, 19 nt, Brucella suis 1330
uggccucgauggccugcac

SEQ ID NO: 2471526 - RNA, 14 nt, Brucella suis 1330
uggccucuuccagg

SEQ ID NO: 2471527 - RNA, 15 nt, Brucella suis 1330
uggccuucagcacau

SEQ ID NO: 2471528 - RNA, 21 nt, Brucella suis 1330
uggccuugugcagaugcacca

SEQ ID NO: 2471529 - RNA, 22 nt, Brucella suis 1330
uggccuuugcccuggggcauga

SEQ ID NO: 2471530 - RNA, 14 nt, Brucella suis 1330
uggcgacggccagc

SEQ ID NO: 2471531 - RNA, 20 nt, Brucella suis 1330
uggcgacggccagcgcgaug

SEQ ID NO: 2471532 - RNA, 23 nt, Brucella suis 1330
uggcgauaaagaugcgcgccagc

SEQ ID NO: 2471533 - RNA, 22 nt, Brucella suis 1330
uggcgauaauaauuggcaagcg

SEQ ID NO: 2471534 - RNA, 23 nt, Brucella suis 1330
uggcgauaauaauuggcaagcgc

SEQ ID NO: 2471535 - RNA, 14 nt, Brucella suis 1330
uggcgaucacgaaa

SEQ ID NO: 2471536 - RNA, 19 nt, Brucella suis 1330
uggcgcacccgaaaggauu

SEQ ID NO: 2471537 - RNA, 13 nt, Brucella suis 1330
uggcgcacgucga

SEQ ID NO: 2471538 - RNA, 18 nt, Brucella suis 1330
uggcgcccgcccgccgca

SEQ ID NO: 2471539 - RNA, 17 nt, Brucella suis 1330
uggcgcgaaaccggaac

SEQ ID NO: 2471540 - RNA, 19 nt, Brucella suis 1330
uggcgcgcgaacgggaaca

SEQ ID NO: 2471541 - RNA, 17 nt, Brucella suis 1330
uggcggauugcagcggu

SEQ ID NO: 2471542 - RNA, 10 nt, Brucella suis 1330
uggcggcacu

SEQ ID NO: 2471543 - RNA, 16 nt, Brucella suis 1330
uggcgggccauuucca

SEQ ID NO: 2471544 - RNA, 22 nt, Brucella suis 1330
uggcgucaccugcaacgcgcca

SEQ ID NO: 2471545 - RNA, 18 nt, Brucella suis 1330
uggcgucgaauaucuuga

SEQ ID NO: 2471546 - RNA, 16 nt, Brucella suis 1330
uggcguugagccgcgc

SEQ ID NO: 2471547 - RNA, 17 nt, Brucella suis 1330
uggcguugagccgcgcc

SEQ ID NO: 2471548 - RNA, 18 nt, Brucella suis 1330
uggcguugagccgcgcca

SEQ ID NO: 2471549 - RNA, 22 nt, Brucella suis 1330
uggcuaaaaaugggcugauuua

SEQ ID NO: 2471550 - RNA, 19 nt, Brucella suis 1330
uggcuaucacguuggggcg

SEQ ID NO: 2471551 - RNA, 12 nt, Brucella suis 1330
uggcucaaaucc

SEQ ID NO: 2471552 - RNA, 22 nt, Brucella suis 1330
uggcucuuccggccguuauucc

SEQ ID NO: 2471553 - RNA, 19 nt, Brucella suis 1330
uggcugcaaucaccagaga

SEQ ID NO: 2471554 - RNA, 14 nt, Brucella suis 1330
uggcugcccgccgc

SEQ ID NO: 2471555 - RNA, 15 nt, Brucella suis 1330
uggcugcccgccgca

SEQ ID NO: 2471556 - RNA, 15 nt, Brucella suis 1330
uggcugcccgcgccg

SEQ ID NO: 2471557 - RNA, 22 nt, Brucella suis 1330
uggcuguuucgcauugcccacg

SEQ ID NO: 2471558 - RNA, 17 nt, Brucella suis 1330
uggcuucaacaugcaca

SEQ ID NO: 2471559 - RNA, 20 nt, Brucella suis 1330
uggcuuccagcgucaggaca

SEQ ID NO: 2471560 - RNA, 19 nt, Brucella suis 1330
ugggaagaucauaaaccga

SEQ ID NO: 2471561 - RNA, 21 nt, Brucella suis 1330
ugggagcgcagugccuuugcc

SEQ ID NO: 2471562 - RNA, 13 nt, Brucella suis 1330
ugggcaagugcac

SEQ ID NO: 2471563 - RNA, 17 nt, Brucella suis 1330
ugggcauggaaacgaac

SEQ ID NO: 2471564 - RNA, 17 nt, Brucella suis 1330
ugggcauugucguccag

SEQ ID NO: 2471565 - RNA, 18 nt, Brucella suis 1330
ugggccggucuucccgca

SEQ ID NO: 2471566 - RNA, 18 nt, Brucella suis 1330
ugggccuuguuuucugcc

SEQ ID NO: 2471567 - RNA, 20 nt, Brucella suis 1330
ugggcgagaaugcaccgccg

SEQ ID NO: 2471568 - RNA, 21 nt, Brucella suis 1330
ugggcgagaaugcaccgccga

SEQ ID NO: 2471569 - RNA, 15 nt, Brucella suis 1330
ugggcgcaccgcaag

SEQ ID NO: 2471570 - RNA, 17 nt, Brucella suis 1330
ugggcucuuguggucau

SEQ ID NO: 2471571 - RNA, 15 nt, Brucella suis 1330
ugggcugauuuaggc

SEQ ID NO: 2471572 - RNA, 15 nt, Brucella suis 1330
uggggcaugacaucc

SEQ ID NO: 2471573 - RNA, 20 nt, Brucella suis 1330
uggggcuuuuuacauucugu

SEQ ID NO: 2471574 - RNA, 18 nt, Brucella suis 1330
ugggggccacgggccaga

SEQ ID NO: 2471575 - RNA, 21 nt, Brucella suis 1330
ugggguaugacgcccuuugcc

SEQ ID NO: 2471576 - RNA, 12 nt, Brucella suis 1330
uggguaaagcgg

SEQ ID NO: 2471577 - RNA, 15 nt, Brucella suis 1330
uggucaagagcccca

SEQ ID NO: 2471578 - RNA, 13 nt, Brucella suis 1330
uggucacggccac

SEQ ID NO: 2471579 - RNA, 13 nt, Brucella suis 1330
uggucaugcgcgg

SEQ ID NO: 2471580 - RNA, 19 nt, Brucella suis 1330
uggucaugcgcggcauggg

SEQ ID NO: 2471581 - RNA, 16 nt, Brucella suis 1330
ugguccagucuucauc

SEQ ID NO: 2471582 - RNA, 16 nt, Brucella suis 1330
uggucgcgcaccagcu

SEQ ID NO: 2471583 - RNA, 19 nt, Brucella suis 1330
uggucguuugccucggagc

SEQ ID NO: 2471584 - RNA, 15 nt, Brucella suis 1330
uggucugcggcuucc

SEQ ID NO: 2471585 - RNA, 23 nt, Brucella suis 1330
uggucuucuugcguggcgggggc

SEQ ID NO: 2471586 - RNA, 15 nt, Brucella suis 1330
uggugacggcgguga

SEQ ID NO: 2471587 - RNA, 16 nt, Brucella suis 1330
uggugaguugaagaua

SEQ ID NO: 2471588 - RNA, 12 nt, Brucella suis 1330
uggugccagcgu

SEQ ID NO: 2471589 - RNA, 17 nt, Brucella suis 1330
uggugccagcgucggcg

SEQ ID NO: 2471590 - RNA, 16 nt, Brucella suis 1330
uggugccgcuggcucc

SEQ ID NO: 2471591 - RNA, 22 nt, Brucella suis 1330
uggugcggcugcacacaaagau

SEQ ID NO: 2471592 - RNA, 14 nt, Brucella suis 1330
uggugcucuaucca

SEQ ID NO: 2471593 - RNA, 21 nt, Brucella suis 1330
ugguguagaagacaaagcccg

SEQ ID NO: 2471594 - RNA, 18 nt, Brucella suis 1330
uggugucauagaccauga

SEQ ID NO: 2471595 - RNA, 21 nt, Brucella suis 1330
uggugucauagaccaugacgc

SEQ ID NO: 2471596 - RNA, 19 nt, Brucella suis 1330
ugguucagccgcuccggcg

SEQ ID NO: 2471597 - RNA, 17 nt, Brucella suis 1330
ugguuucggcgucugcc

SEQ ID NO: 2471598 - RNA, 15 nt, Brucella suis 1330
ugguuugaaaauguu

SEQ ID NO: 2471599 - RNA, 24 nt, Brucella suis 1330
ugguuugcagcaauuccugcgcca

SEQ ID NO: 2471600 - RNA, 21 nt, Brucella suis 1330
uguacacgccaaccaaagaaa

SEQ ID NO: 2471601 - RNA, 12 nt, Brucella suis 1330
uguaggaaagca

SEQ ID NO: 2471602 - RNA, 15 nt, Brucella suis 1330
ugucaccacaucggc

SEQ ID NO: 2471603 - RNA, 16 nt, Brucella suis 1330
ugucacgaucuugccg

SEQ ID NO: 2471604 - RNA, 19 nt, Brucella suis 1330
ugucacgccggcaucaaac

SEQ ID NO: 2471605 - RNA, 16 nt, Brucella suis 1330
ugucagcgccgcccag

SEQ ID NO: 2471606 - RNA, 20 nt, Brucella suis 1330
ugucagcuuuccggcuucca

SEQ ID NO: 2471607 - RNA, 19 nt, Brucella suis 1330
ugucauaaaaaacgguugg

SEQ ID NO: 2471608 - RNA, 13 nt, Brucella suis 1330
ugucauagccgau

SEQ ID NO: 2471609 - RNA, 15 nt, Brucella suis 1330
uguccagaaagagca

SEQ ID NO: 2471610 - RNA, 17 nt, Brucella suis 1330
uguccgaauaggcgcgc

SEQ ID NO: 2471611 - RNA, 12 nt, Brucella suis 1330
uguccuccagcc

SEQ ID NO: 2471612 - RNA, 20 nt, Brucella suis 1330
uguccuccagcccuucauca

SEQ ID NO: 2471613 - RNA, 13 nt, Brucella suis 1330
ugucgaaugucuu

SEQ ID NO: 2471614 - RNA, 19 nt, Brucella suis 1330
ugucgaccggcggcaggca

SEQ ID NO: 2471615 - RNA, 18 nt, Brucella suis 1330
ugucgagccgcaacugca

SEQ ID NO: 2471616 - RNA, 23 nt, Brucella suis 1330
ugucgcaaagcguuccgcgcaaa

SEQ ID NO: 2471617 - RNA, 17 nt, Brucella suis 1330
ugucgcggccuugaucc

SEQ ID NO: 2471618 - RNA, 16 nt, Brucella suis 1330
ugucggccagagcuuc

SEQ ID NO: 2471619 - RNA, 23 nt, Brucella suis 1330
ugucggccagagcuucgccgcca

SEQ ID NO: 2471620 - RNA, 20 nt, Brucella suis 1330
ugucggcgcugcucgcgcaa

SEQ ID NO: 2471621 - RNA, 18 nt, Brucella suis 1330
ugucgugcuauggcacaa

SEQ ID NO: 2471622 - RNA, 13 nt, Brucella suis 1330
ugucguugccgcc

SEQ ID NO: 2471623 - RNA, 16 nt, Brucella suis 1330
ugucuagagcauuuuu

SEQ ID NO: 2471624 - RNA, 19 nt, Brucella suis 1330
ugucugcgugauauugcag

SEQ ID NO: 2471625 - RNA, 21 nt, Brucella suis 1330
ugucugggaggacauucauga

SEQ ID NO: 2471626 - RNA, 15 nt, Brucella suis 1330
ugugaaagcacaaag

SEQ ID NO: 2471627 - RNA, 12 nt, Brucella suis 1330
ugugaaggcgcu

SEQ ID NO: 2471628 - RNA, 14 nt, Brucella suis 1330
ugugacgacaacca

SEQ ID NO: 2471629 - RNA, 14 nt, Brucella suis 1330
ugugagcacaaaag

SEQ ID NO: 2471630 - RNA, 14 nt, Brucella suis 1330
ugugcagacaggcc

SEQ ID NO: 2471631 - RNA, 17 nt, Brucella suis 1330
ugugcccuugagagcca

SEQ ID NO: 2471632 - RNA, 18 nt, Brucella suis 1330
ugugccgcugcaccgggc

SEQ ID NO: 2471633 - RNA, 23 nt, Brucella suis 1330
ugugccgguuuauccgccgaacc

SEQ ID NO: 2471634 - RNA, 18 nt, Brucella suis 1330
ugugccugaaacaaggcc

SEQ ID NO: 2471635 - RNA, 16 nt, Brucella suis 1330
ugugcgggcuucuucc

SEQ ID NO: 2471636 - RNA, 20 nt, Brucella suis 1330
ugugugaacaggucugacgg

SEQ ID NO: 2471637 - RNA, 17 nt, Brucella suis 1330
uguucaauaagcuuuuc

SEQ ID NO: 2471638 - RNA, 16 nt, Brucella suis 1330
uguucacauuucauga

SEQ ID NO: 2471639 - RNA, 16 nt, Brucella suis 1330
uguucauguuuugaau

SEQ ID NO: 2471640 - RNA, 23 nt, Brucella suis 1330
uguuccagccgggcuuuccugca

SEQ ID NO: 2471641 - RNA, 19 nt, Brucella suis 1330
uguuccgcaccgcacuggg

SEQ ID NO: 2471642 - RNA, 16 nt, Brucella suis 1330
uguucggguagagcuu

SEQ ID NO: 2471643 - RNA, 13 nt, Brucella suis 1330
uguucuuccgaga

SEQ ID NO: 2471644 - RNA, 19 nt, Brucella suis 1330
uguugcacuuuggcaacaa

SEQ ID NO: 2471645 - RNA, 15 nt, Brucella suis 1330
uguugcagccguccc

SEQ ID NO: 2471646 - RNA, 13 nt, Brucella suis 1330
uguuguuucaggc

SEQ ID NO: 2471647 - RNA, 14 nt, Brucella suis 1330
uguuguuucaggcc

SEQ ID NO: 2471648 - RNA, 21 nt, Brucella suis 1330
uguuucgauucgcccggccca

SEQ ID NO: 2471649 - RNA, 17 nt, Brucella suis 1330
uguuuuaacacaaucgc

SEQ ID NO: 2471650 - RNA, 16 nt, Brucella suis 1330
uguuuucgcgcagaag

SEQ ID NO: 2471651 - RNA, 18 nt, Brucella suis 1330
uguuuugccgcauuaucc

SEQ ID NO: 2471652 - RNA, 13 nt, Brucella suis 1330
uuaaaauggaauc

SEQ ID NO: 2471653 - RNA, 23 nt, Brucella suis 1330
uuaacagaaccaucggaaccgcu

SEQ ID NO: 2471654 - RNA, 15 nt, Brucella suis 1330
uuacaaaaaaaucuc

SEQ ID NO: 2471655 - RNA, 20 nt, Brucella suis 1330
uuaccgcccuuuuugaagcc

SEQ ID NO: 2471656 - RNA, 13 nt, Brucella suis 1330
uuacgcgccgcca

SEQ ID NO: 2471657 - RNA, 18 nt, Brucella suis 1330
uuacgcgccgccaggcaa

SEQ ID NO: 2471658 - RNA, 13 nt, Brucella suis 1330
uuacgggcggcag

SEQ ID NO: 2471659 - RNA, 14 nt, Brucella suis 1330
uuacuccauuaauc

SEQ ID NO: 2471660 - RNA, 16 nt, Brucella suis 1330
uuacuugcgcuuugca

SEQ ID NO: 2471661 - RNA, 17 nt, Brucella suis 1330
uuagagcaaucccguca

SEQ ID NO: 2471662 - RNA, 19 nt, Brucella suis 1330
uuagagcauuuccagcaaa

SEQ ID NO: 2471663 - RNA, 21 nt, Brucella suis 1330
uuagagcgccgaucugauuca

SEQ ID NO: 2471664 - RNA, 18 nt, Brucella suis 1330
uuagaucggcgcucuaac

SEQ ID NO: 2471665 - RNA, 21 nt, Brucella suis 1330
uuagauuaugcuuuaaaagca

SEQ ID NO: 2471666 - RNA, 21 nt, Brucella suis 1330
uuagcugcuguagcagcaaca

SEQ ID NO: 2471667 - RNA, 19 nt, Brucella suis 1330
uuaggcggauuucaggcgc

SEQ ID NO: 2471668 - RNA, 21 nt, Brucella suis 1330
uuauccggucggcauauuuga

SEQ ID NO: 2471669 - RNA, 20 nt, Brucella suis 1330
uuauccuacgcaaaaccgcu

SEQ ID NO: 2471670 - RNA, 20 nt, Brucella suis 1330
uuaugcaggaaagcccggcu

SEQ ID NO: 2471671 - RNA, 18 nt, Brucella suis 1330
uuaugcuuuaaaagcaua

SEQ ID NO: 2471672 - RNA, 14 nt, Brucella suis 1330
uuauucgucagcuc

SEQ ID NO: 2471673 - RNA, 21 nt, Brucella suis 1330
uuauucgugccuggcgaaaac

SEQ ID NO: 2471674 - RNA, 19 nt, Brucella suis 1330
uuauuggaacucgaagaug

SEQ ID NO: 2471675 - RNA, 17 nt, Brucella suis 1330
uuauuugaacaaagaug

SEQ ID NO: 2471676 - RNA, 20 nt, Brucella suis 1330
uucaaaagcuggaugaucuu

SEQ ID NO: 2471677 - RNA, 21 nt, Brucella suis 1330
uucaacgagaacaaacuuauc

SEQ ID NO: 2471678 - RNA, 19 nt, Brucella suis 1330
uucaacuccgucagacgau

SEQ ID NO: 2471679 - RNA, 18 nt, Brucella suis 1330
uucaacuguguugccagc

SEQ ID NO: 2471680 - RNA, 14 nt, Brucella suis 1330
uucaagcagggcau

SEQ ID NO: 2471681 - RNA, 22 nt, Brucella suis 1330
uucacacuuuucgggaugcgcu

SEQ ID NO: 2471682 - RNA, 17 nt, Brucella suis 1330
uucacauagccugcaag

SEQ ID NO: 2471683 - RNA, 18 nt, Brucella suis 1330
uucacauagccugcaagc

SEQ ID NO: 2471684 - RNA, 19 nt, Brucella suis 1330
uucacauagccugcaagcg

SEQ ID NO: 2471685 - RNA, 15 nt, Brucella suis 1330
uucacauccuucacu

SEQ ID NO: 2471686 - RNA, 17 nt, Brucella suis 1330
uucaccugagcaagagc

SEQ ID NO: 2471687 - RNA, 17 nt, Brucella suis 1330
uucagaaagaaagcugu

SEQ ID NO: 2471688 - RNA, 14 nt, Brucella suis 1330
uucagccugcgagg

SEQ ID NO: 2471689 - RNA, 17 nt, Brucella suis 1330
uucagccugcgaggauu

SEQ ID NO: 2471690 - RNA, 22 nt, Brucella suis 1330
uucagcgaaccugauccagaag

SEQ ID NO: 2471691 - RNA, 19 nt, Brucella suis 1330
uucagcgccacgccuucaa

SEQ ID NO: 2471692 - RNA, 22 nt, Brucella suis 1330
uucaggauagauauuucuucca

SEQ ID NO: 2471693 - RNA, 21 nt, Brucella suis 1330
uucaggcacucuccucugccu

SEQ ID NO: 2471694 - RNA, 23 nt, Brucella suis 1330
uucauaaacgcggguggauggaa

SEQ ID NO: 2471695 - RNA, 17 nt, Brucella suis 1330
uucauauucgaugagcu

SEQ ID NO: 2471696 - RNA, 22 nt, Brucella suis 1330
uucaucagcacgaaaugaaagc

SEQ ID NO: 2471697 - RNA, 19 nt, Brucella suis 1330
uucaucgauaugcgcgaug

SEQ ID NO: 2471698 - RNA, 17 nt, Brucella suis 1330
uucaugccgccgugggc

SEQ ID NO: 2471699 - RNA, 16 nt, Brucella suis 1330
uucauggcuugaagcg

SEQ ID NO: 2471700 - RNA, 18 nt, Brucella suis 1330
uucauugcgcuugccgcc

SEQ ID NO: 2471701 - RNA, 18 nt, Brucella suis 1330
uuccacaggcgccagccc

SEQ ID NO: 2471702 - RNA, 22 nt, Brucella suis 1330
uuccacauccgccaccgcgccg

SEQ ID NO: 2471703 - RNA, 13 nt, Brucella suis 1330
uuccacauugccu

SEQ ID NO: 2471704 - RNA, 22 nt, Brucella suis 1330
uuccacgaugagaaugccguuc

SEQ ID NO: 2471705 - RNA, 20 nt, Brucella suis 1330
uuccagagcggguucccacu

SEQ ID NO: 2471706 - RNA, 15 nt, Brucella suis 1330
uuccagccggaaugc

SEQ ID NO: 2471707 - RNA, 12 nt, Brucella suis 1330
uuccagccguuc

SEQ ID NO: 2471708 - RNA, 18 nt, Brucella suis 1330
uuccaguuccauugcaac

SEQ ID NO: 2471709 - RNA, 14 nt, Brucella suis 1330
uuccaguuucugaa

SEQ ID NO: 2471710 - RNA, 15 nt, Brucella suis 1330
uuccaguuucugaau

SEQ ID NO: 2471711 - RNA, 22 nt, Brucella suis 1330
uuccaucgaauccucgaucuug

SEQ ID NO: 2471712 - RNA, 22 nt, Brucella suis 1330
uuccaucggcgaggaagagaau

SEQ ID NO: 2471713 - RNA, 18 nt, Brucella suis 1330
uuccaugcccggcgcgac

SEQ ID NO: 2471714 - RNA, 19 nt, Brucella suis 1330
uucccccaauaucgcgccg

SEQ ID NO: 2471715 - RNA, 22 nt, Brucella suis 1330
uuccccuaaaucacucccgcau

SEQ ID NO: 2471716 - RNA, 17 nt, Brucella suis 1330
uuccccuauuccccuau

SEQ ID NO: 2471717 - RNA, 15 nt, Brucella suis 1330
uuccccuauucccuu

SEQ ID NO: 2471718 - RNA, 19 nt, Brucella suis 1330
uucccggcuuuuuauccuc

SEQ ID NO: 2471719 - RNA, 18 nt, Brucella suis 1330
uuccgaagugaucucggc

SEQ ID NO: 2471720 - RNA, 16 nt, Brucella suis 1330
uuccgacagggcaagc

SEQ ID NO: 2471721 - RNA, 21 nt, Brucella suis 1330
uuccgacccgucaaugccauc

SEQ ID NO: 2471722 - RNA, 20 nt, Brucella suis 1330
uuccgaugcgggaaaguuau

SEQ ID NO: 2471723 - RNA, 15 nt, Brucella suis 1330
uuccgcaagccaguc

SEQ ID NO: 2471724 - RNA, 22 nt, Brucella suis 1330
uuccgcaagccaguccuugccc

SEQ ID NO: 2471725 - RNA, 14 nt, Brucella suis 1330
uuccgcaccgcacu

SEQ ID NO: 2471726 - RNA, 13 nt, Brucella suis 1330
uuccgcaccgccg

SEQ ID NO: 2471727 - RNA, 20 nt, Brucella suis 1330
uuccgcgcaaaaucugcucg

SEQ ID NO: 2471728 - RNA, 17 nt, Brucella suis 1330
uuccgcugcgaucugcu

SEQ ID NO: 2471729 - RNA, 22 nt, Brucella suis 1330
uuccggaucgcccacgaggauc

SEQ ID NO: 2471730 - RNA, 17 nt, Brucella suis 1330
uuccggcagaccggauc

SEQ ID NO: 2471731 - RNA, 17 nt, Brucella suis 1330
uuccggcauaaccgaaa

SEQ ID NO: 2471732 - RNA, 18 nt, Brucella suis 1330
uuccgggaauuccugaac

SEQ ID NO: 2471733 - RNA, 17 nt, Brucella suis 1330
uuccgggccgcaagcug

SEQ ID NO: 2471734 - RNA, 16 nt, Brucella suis 1330
uuccggguguccugcc

SEQ ID NO: 2471735 - RNA, 18 nt, Brucella suis 1330
uuccgguuaaaauggaau

SEQ ID NO: 2471736 - RNA, 19 nt, Brucella suis 1330
uuccguuuuaaccggaacc

SEQ ID NO: 2471737 - RNA, 21 nt, Brucella suis 1330
uuccucauaaagcgcgcuguc

SEQ ID NO: 2471738 - RNA, 14 nt, Brucella suis 1330
uuccucguccuuga

SEQ ID NO: 2471739 - RNA, 22 nt, Brucella suis 1330
uuccugacccauggccugcugc

SEQ ID NO: 2471740 - RNA, 17 nt, Brucella suis 1330
uuccugcccggcaucac

SEQ ID NO: 2471741 - RNA, 18 nt, Brucella suis 1330
uuccuguccgacauccau

SEQ ID NO: 2471742 - RNA, 13 nt, Brucella suis 1330
uuccuuaucgagg

SEQ ID NO: 2471743 - RNA, 12 nt, Brucella suis 1330
uuccuuccacug

SEQ ID NO: 2471744 - RNA, 14 nt, Brucella suis 1330
uuccuucuccaucu

SEQ ID NO: 2471745 - RNA, 23 nt, Brucella suis 1330
uuccuuuuggagcggaaaggcuu

SEQ ID NO: 2471746 - RNA, 13 nt, Brucella suis 1330
uucgagccaaaag

SEQ ID NO: 2471747 - RNA, 15 nt, Brucella suis 1330
uucgagcgccuugga

SEQ ID NO: 2471748 - RNA, 20 nt, Brucella suis 1330
uucgagcugacgaauaauga

SEQ ID NO: 2471749 - RNA, 20 nt, Brucella suis 1330
uucgaucacaacgccgucag

SEQ ID NO: 2471750 - RNA, 21 nt, Brucella suis 1330
uucgaucgacccgccaugcgg

SEQ ID NO: 2471751 - RNA, 14 nt, Brucella suis 1330
uucgcaaugccggg

SEQ ID NO: 2471752 - RNA, 19 nt, Brucella suis 1330
uucgccaaguucuuccgcc

SEQ ID NO: 2471753 - RNA, 22 nt, Brucella suis 1330
uucgccagcaccucgaaaacau

SEQ ID NO: 2471754 - RNA, 12 nt, Brucella suis 1330
uucgcccacgcc

SEQ ID NO: 2471755 - RNA, 13 nt, Brucella suis 1330
uucgcccacgccc

SEQ ID NO: 2471756 - RNA, 16 nt, Brucella suis 1330
uucgcccgugccgcgu

SEQ ID NO: 2471757 - RNA, 13 nt, Brucella suis 1330
uucgccgcgcacu

SEQ ID NO: 2471758 - RNA, 19 nt, Brucella suis 1330
uucgccgcgcacuggcagc

SEQ ID NO: 2471759 - RNA, 14 nt, Brucella suis 1330
uucgcgcaguuucc

SEQ ID NO: 2471760 - RNA, 22 nt, Brucella suis 1330
uucgcgcaucgggcgcacaagc

SEQ ID NO: 2471761 - RNA, 15 nt, Brucella suis 1330
uucgcuuuaaagcuu

SEQ ID NO: 2471762 - RNA, 19 nt, Brucella suis 1330
uucggcaaggaugcugcca

SEQ ID NO: 2471763 - RNA, 14 nt, Brucella suis 1330
uucggcaccacaag

SEQ ID NO: 2471764 - RNA, 15 nt, Brucella suis 1330
uucggcauggcagcc

SEQ ID NO: 2471765 - RNA, 12 nt, Brucella suis 1330
uucggccagcgc

SEQ ID NO: 2471766 - RNA, 17 nt, Brucella suis 1330
uucggccagcgcaaagc

SEQ ID NO: 2471767 - RNA, 12 nt, Brucella suis 1330
uucggccugugc

SEQ ID NO: 2471768 - RNA, 21 nt, Brucella suis 1330
uucggccuugacggagagagg

SEQ ID NO: 2471769 - RNA, 19 nt, Brucella suis 1330
uucggcgaccgccuuuucc

SEQ ID NO: 2471770 - RNA, 22 nt, Brucella suis 1330
uucggcuuccuugcgcuugcga

SEQ ID NO: 2471771 - RNA, 23 nt, Brucella suis 1330
uucgggaugcgcucuaugcagca

SEQ ID NO: 2471772 - RNA, 19 nt, Brucella suis 1330
uucggggcuuggcuugccg

SEQ ID NO: 2471773 - RNA, 22 nt, Brucella suis 1330
uucggugacgaauucaaccaua

SEQ ID NO: 2471774 - RNA, 13 nt, Brucella suis 1330
uucguccuugacg

SEQ ID NO: 2471775 - RNA, 12 nt, Brucella suis 1330
uucguugugcca

SEQ ID NO: 2471776 - RNA, 13 nt, Brucella suis 1330
uucuauugaacac

SEQ ID NO: 2471777 - RNA, 20 nt, Brucella suis 1330
uucuauugaacaccaaaaac

SEQ ID NO: 2471778 - RNA, 21 nt, Brucella suis 1330
uucucagcguuuucugaaaga

SEQ ID NO: 2471779 - RNA, 18 nt, Brucella suis 1330
uucuccgcagccgccaac

SEQ ID NO: 2471780 - RNA, 17 nt, Brucella suis 1330
uucucgacaaugccgag

SEQ ID NO: 2471781 - RNA, 12 nt, Brucella suis 1330
uucucgcaaaac

SEQ ID NO: 2471782 - RNA, 15 nt, Brucella suis 1330
uucucuugccgccgc

SEQ ID NO: 2471783 - RNA, 18 nt, Brucella suis 1330
uucugaaagaacggcagg

SEQ ID NO: 2471784 - RNA, 18 nt, Brucella suis 1330
uucugagaaaaaaaugcg

SEQ ID NO: 2471785 - RNA, 23 nt, Brucella suis 1330
uucugcaucaugucauggccgcc

SEQ ID NO: 2471786 - RNA, 13 nt, Brucella suis 1330
uucugcccagaaa

SEQ ID NO: 2471787 - RNA, 14 nt, Brucella suis 1330
uucugccgcgcauc

SEQ ID NO: 2471788 - RNA, 18 nt, Brucella suis 1330
uucugccggugccggcag

SEQ ID NO: 2471789 - RNA, 21 nt, Brucella suis 1330
uucugccggugccggcaggcu

SEQ ID NO: 2471790 - RNA, 22 nt, Brucella suis 1330
uucuggacgugcuggugaaaga

SEQ ID NO: 2471791 - RNA, 19 nt, Brucella suis 1330
uucuggagccgcucuaggu

SEQ ID NO: 2471792 - RNA, 14 nt, Brucella suis 1330
uucugggccuuugu

SEQ ID NO: 2471793 - RNA, 18 nt, Brucella suis 1330
uucuguaaacugccgcgu

SEQ ID NO: 2471794 - RNA, 19 nt, Brucella suis 1330
uucuguuucguuugcaaua

SEQ ID NO: 2471795 - RNA, 16 nt, Brucella suis 1330
uucuucaccagccuug

SEQ ID NO: 2471796 - RNA, 23 nt, Brucella suis 1330
uucuuccagacagccuugucgcc

SEQ ID NO: 2471797 - RNA, 14 nt, Brucella suis 1330
uucuuccgagaacc

SEQ ID NO: 2471798 - RNA, 21 nt, Brucella suis 1330
uucuucgcacggcugaucugg

SEQ ID NO: 2471799 - RNA, 20 nt, Brucella suis 1330
uucuucggccaugcguugcu

SEQ ID NO: 2471800 - RNA, 21 nt, Brucella suis 1330
uucuuggccaugaugccgaca

SEQ ID NO: 2471801 - RNA, 18 nt, Brucella suis 1330
uugaacgguccaccacau

SEQ ID NO: 2471802 - RNA, 18 nt, Brucella suis 1330
uugaagccaucuuucuug

SEQ ID NO: 2471803 - RNA, 22 nt, Brucella suis 1330
uugaaucccggcuguuacauau

SEQ ID NO: 2471804 - RNA, 14 nt, Brucella suis 1330
uugacauuugaagc

SEQ ID NO: 2471805 - RNA, 16 nt, Brucella suis 1330
uugaccacauugcccc

SEQ ID NO: 2471806 - RNA, 17 nt, Brucella suis 1330
uugaccuggccagccau

SEQ ID NO: 2471807 - RNA, 15 nt, Brucella suis 1330
uugacguuugaaucc

SEQ ID NO: 2471808 - RNA, 17 nt, Brucella suis 1330
uugaggauugccgccgc

SEQ ID NO: 2471809 - RNA, 18 nt, Brucella suis 1330
uugaggcauugcgcggca

SEQ ID NO: 2471810 - RNA, 18 nt, Brucella suis 1330
uugaggcgggggcgcuuu

SEQ ID NO: 2471811 - RNA, 19 nt, Brucella suis 1330
uugaggcugucgaaugucu

SEQ ID NO: 2471812 - RNA, 18 nt, Brucella suis 1330
uugagguguuucgcgcaa

SEQ ID NO: 2471813 - RNA, 20 nt, Brucella suis 1330
uugaucaacccgucuucauu

SEQ ID NO: 2471814 - RNA, 16 nt, Brucella suis 1330
uugaucgagccgacau

SEQ ID NO: 2471815 - RNA, 22 nt, Brucella suis 1330
uugaucgagccgacaucgcgcu

SEQ ID NO: 2471816 - RNA, 14 nt, Brucella suis 1330
uugaucgccgcacg

SEQ ID NO: 2471817 - RNA, 11 nt, Brucella suis 1330
uugaucggcau

SEQ ID NO: 2471818 - RNA, 14 nt, Brucella suis 1330
uugaugaaaaaccc

SEQ ID NO: 2471819 - RNA, 14 nt, Brucella suis 1330
uugaugcgccaguc

SEQ ID NO: 2471820 - RNA, 23 nt, Brucella suis 1330
uugaugcggcggcgcgcaaguuc

SEQ ID NO: 2471821 - RNA, 18 nt, Brucella suis 1330
uugauuccgaucuguuca

SEQ ID NO: 2471822 - RNA, 20 nt, Brucella suis 1330
uugauuucggauugaagccg

SEQ ID NO: 2471823 - RNA, 20 nt, Brucella suis 1330
uugcaaagcgcaucccgaaa

SEQ ID NO: 2471824 - RNA, 14 nt, Brucella suis 1330
uugcaagcgcgaug

SEQ ID NO: 2471825 - RNA, 22 nt, Brucella suis 1330
uugcacagcggucgaaaccuug

SEQ ID NO: 2471826 - RNA, 20 nt, Brucella suis 1330
uugcaccguuucaaacccca

SEQ ID NO: 2471827 - RNA, 14 nt, Brucella suis 1330
uugcacuuuggcaa

SEQ ID NO: 2471828 - RNA, 14 nt, Brucella suis 1330
uugcagagcgcauc

SEQ ID NO: 2471829 - RNA, 16 nt, Brucella suis 1330
uugcagccgccagauc

SEQ ID NO: 2471830 - RNA, 22 nt, Brucella suis 1330
uugcagggcuugcuugccauuc

SEQ ID NO: 2471831 - RNA, 23 nt, Brucella suis 1330
uugcaucgccaagcuugaucgcc

SEQ ID NO: 2471832 - RNA, 12 nt, Brucella suis 1330
uugcaucggcag

SEQ ID NO: 2471833 - RNA, 23 nt, Brucella suis 1330
uugcaucugauuugaaaagcccc

SEQ ID NO: 2471834 - RNA, 16 nt, Brucella suis 1330
uugcaugggcgugauc

SEQ ID NO: 2471835 - RNA, 19 nt, Brucella suis 1330
uugccaagcguugcaagau

SEQ ID NO: 2471836 - RNA, 20 nt, Brucella suis 1330
uugccaugaaacccgcgauc

SEQ ID NO: 2471837 - RNA, 21 nt, Brucella suis 1330
uugcccauaccgaucugauug

SEQ ID NO: 2471838 - RNA, 19 nt, Brucella suis 1330
uugcccauggacuuuucag

SEQ ID NO: 2471839 - RNA, 17 nt, Brucella suis 1330
uugcccauguccgccug

SEQ ID NO: 2471840 - RNA, 15 nt, Brucella suis 1330
uugccccaaggcgca

SEQ ID NO: 2471841 - RNA, 16 nt, Brucella suis 1330
uugccgagaaugacca

SEQ ID NO: 2471842 - RNA, 20 nt, Brucella suis 1330
uugccgcauaaagcacagcc

SEQ ID NO: 2471843 - RNA, 19 nt, Brucella suis 1330
uugccgcgcgaagcgcauc

SEQ ID NO: 2471844 - RNA, 19 nt, Brucella suis 1330
uugccgcucucgucgagaa

SEQ ID NO: 2471845 - RNA, 17 nt, Brucella suis 1330
uugccgggcgggcagca

SEQ ID NO: 2471846 - RNA, 14 nt, Brucella suis 1330
uugccgucaccauu

SEQ ID NO: 2471847 - RNA, 17 nt, Brucella suis 1330
uugccuuaaucccuuac

SEQ ID NO: 2471848 - RNA, 17 nt, Brucella suis 1330
uugcgaccaugagcaga

SEQ ID NO: 2471849 - RNA, 17 nt, Brucella suis 1330
uugcgaccauggcgcau

SEQ ID NO: 2471850 - RNA, 15 nt, Brucella suis 1330
uugcgauauccagcu

SEQ ID NO: 2471851 - RNA, 14 nt, Brucella suis 1330
uugcgauuuccuug

SEQ ID NO: 2471852 - RNA, 22 nt, Brucella suis 1330
uugcgcaaggcccucgcggauc

SEQ ID NO: 2471853 - RNA, 13 nt, Brucella suis 1330
uugcgcagcgcag

SEQ ID NO: 2471854 - RNA, 17 nt, Brucella suis 1330
uugcgccaaucgccgcg

SEQ ID NO: 2471855 - RNA, 14 nt, Brucella suis 1330
uugcgcguugcguc

SEQ ID NO: 2471856 - RNA, 15 nt, Brucella suis 1330
uugcgcugauucugg

SEQ ID NO: 2471857 - RNA, 17 nt, Brucella suis 1330
uugcggcggaugaaccc

SEQ ID NO: 2471858 - RNA, 14 nt, Brucella suis 1330
uugcgggaaggcgc

SEQ ID NO: 2471859 - RNA, 17 nt, Brucella suis 1330
uugcgggaaggcgcgac

SEQ ID NO: 2471860 - RNA, 19 nt, Brucella suis 1330
uugcggggcuuccacagcc

SEQ ID NO: 2471861 - RNA, 22 nt, Brucella suis 1330
uugcggguugaauccuuccuga

SEQ ID NO: 2471862 - RNA, 17 nt, Brucella suis 1330
uugcguuggaaaaugcg

SEQ ID NO: 2471863 - RNA, 13 nt, Brucella suis 1330
uugcuaaaugcaa

SEQ ID NO: 2471864 - RNA, 22 nt, Brucella suis 1330
uugcuauaagcaacagggcgaa

SEQ ID NO: 2471865 - RNA, 18 nt, Brucella suis 1330
uugcucaacgcuugaacc

SEQ ID NO: 2471866 - RNA, 19 nt, Brucella suis 1330
uugcuccagcccuuuccug

SEQ ID NO: 2471867 - RNA, 12 nt, Brucella suis 1330
uugcugaaauag

SEQ ID NO: 2471868 - RNA, 21 nt, Brucella suis 1330
uugcugaugagccgcuuguag

SEQ ID NO: 2471869 - RNA, 19 nt, Brucella suis 1330
uugcuggaaaugcucuagu

SEQ ID NO: 2471870 - RNA, 12 nt, Brucella suis 1330
uugcuugaagca

SEQ ID NO: 2471871 - RNA, 21 nt, Brucella suis 1330
uugcuugagggguucggcguc

SEQ ID NO: 2471872 - RNA, 17 nt, Brucella suis 1330
uuggaaucugccuuguc

SEQ ID NO: 2471873 - RNA, 18 nt, Brucella suis 1330
uuggauagaccaccgcac

SEQ ID NO: 2471874 - RNA, 15 nt, Brucella suis 1330
uuggcaacaucacca

SEQ ID NO: 2471875 - RNA, 18 nt, Brucella suis 1330
uuggcaugugauagucga

SEQ ID NO: 2471876 - RNA, 17 nt, Brucella suis 1330
uuggccgcugccugcac

SEQ ID NO: 2471877 - RNA, 14 nt, Brucella suis 1330
uuggccucuuccag

SEQ ID NO: 2471878 - RNA, 19 nt, Brucella suis 1330
uuggcgguuugcgaccaug

SEQ ID NO: 2471879 - RNA, 22 nt, Brucella suis 1330
uuggugaaggauaucgaaaaau

SEQ ID NO: 2471880 - RNA, 13 nt, Brucella suis 1330
uugguugcgcgcc

SEQ ID NO: 2471881 - RNA, 17 nt, Brucella suis 1330
uugucugucaccacauc

SEQ ID NO: 2471882 - RNA, 19 nt, Brucella suis 1330
uugugaucgccacucuugu

SEQ ID NO: 2471883 - RNA, 14 nt, Brucella suis 1330
uuguguacccaaac

SEQ ID NO: 2471884 - RNA, 13 nt, Brucella suis 1330
uugugugccugug

SEQ ID NO: 2471885 - RNA, 21 nt, Brucella suis 1330
uuguuccagccgggcuuuccu

SEQ ID NO: 2471886 - RNA, 19 nt, Brucella suis 1330
uuguucgacuugaagagcc

SEQ ID NO: 2471887 - RNA, 22 nt, Brucella suis 1330
uuguucgacuugaagagccgca

SEQ ID NO: 2471888 - RNA, 23 nt, Brucella suis 1330
uuuaacagaaccaucggaaccgc

SEQ ID NO: 2471889 - RNA, 21 nt, Brucella suis 1330
uuuaaccggaaccgcucugga

SEQ ID NO: 2471890 - RNA, 22 nt, Brucella suis 1330
uuuacgcauuauccgacgcauc

SEQ ID NO: 2471891 - RNA, 21 nt, Brucella suis 1330
uuuagauuaugcuuuaaaagc

SEQ ID NO: 2471892 - RNA, 16 nt, Brucella suis 1330
uuuagauuugcuuaag

SEQ ID NO: 2471893 - RNA, 20 nt, Brucella suis 1330
uuuauugcccggaucaucca

SEQ ID NO: 2471894 - RNA, 20 nt, Brucella suis 1330
uuucaaagcgcguuucauug

SEQ ID NO: 2471895 - RNA, 13 nt, Brucella suis 1330
uuucaacgcuguc

SEQ ID NO: 2471896 - RNA, 17 nt, Brucella suis 1330
uuucacauagccugcaa

SEQ ID NO: 2471897 - RNA, 20 nt, Brucella suis 1330
uuucaccagaugcugaacaa

SEQ ID NO: 2471898 - RNA, 17 nt, Brucella suis 1330
uuucaccauggccgcau

SEQ ID NO: 2471899 - RNA, 20 nt, Brucella suis 1330
uuucacccgccagaugauca

SEQ ID NO: 2471900 - RNA, 16 nt, Brucella suis 1330
uuucacccuuggcgac

SEQ ID NO: 2471901 - RNA, 16 nt, Brucella suis 1330
uuucacugcauuggcg

SEQ ID NO: 2471902 - RNA, 19 nt, Brucella suis 1330
uuucagaaagaaagcuguc

SEQ ID NO: 2471903 - RNA, 19 nt, Brucella suis 1330
uuucaggucgucuuucagu

SEQ ID NO: 2471904 - RNA, 23 nt, Brucella suis 1330
uuucagguggcggauugcagcgg

SEQ ID NO: 2471905 - RNA, 14 nt, Brucella suis 1330
uuucaugaaaaugc

SEQ ID NO: 2471906 - RNA, 12 nt, Brucella suis 1330
uuucauuaaagc

SEQ ID NO: 2471907 - RNA, 21 nt, Brucella suis 1330
uuucauuaucggcggcuuccu

SEQ ID NO: 2471908 - RNA, 15 nt, Brucella suis 1330
uuuccaaugcacugg

SEQ ID NO: 2471909 - RNA, 15 nt, Brucella suis 1330
uuuccaccggcucau

SEQ ID NO: 2471910 - RNA, 21 nt, Brucella suis 1330
uuuccagcaaaagugagaaac

SEQ ID NO: 2471911 - RNA, 15 nt, Brucella suis 1330
uuuccagugcaaagc

SEQ ID NO: 2471912 - RNA, 17 nt, Brucella suis 1330
uuuccaguuccauugca

SEQ ID NO: 2471913 - RNA, 12 nt, Brucella suis 1330
uuuccaucacuu

SEQ ID NO: 2471914 - RNA, 20 nt, Brucella suis 1330
uuuccaucgucauugcgauc

SEQ ID NO: 2471915 - RNA, 22 nt, Brucella suis 1330
uuuccaugaaauacuuguaagg

SEQ ID NO: 2471916 - RNA, 14 nt, Brucella suis 1330
uuuccauuccagcc

SEQ ID NO: 2471917 - RNA, 22 nt, Brucella suis 1330
uuucccgugcggccuugcgguc

SEQ ID NO: 2471918 - RNA, 21 nt, Brucella suis 1330
uuuccgaaaaccguuucacac

SEQ ID NO: 2471919 - RNA, 13 nt, Brucella suis 1330
uuuccggcaaaaa

SEQ ID NO: 2471920 - RNA, 14 nt, Brucella suis 1330
uuuccggccuggcg

SEQ ID NO: 2471921 - RNA, 21 nt, Brucella suis 1330
uuuccggcugccuuggcauca

SEQ ID NO: 2471922 - RNA, 13 nt, Brucella suis 1330
uuuccggcuucca

SEQ ID NO: 2471923 - RNA, 17 nt, Brucella suis 1330
uuuccugucccuucuug

SEQ ID NO: 2471924 - RNA, 17 nt, Brucella suis 1330
uuucgccgcgcacuggc

SEQ ID NO: 2471925 - RNA, 18 nt, Brucella suis 1330
uuucgccgcgcacuggca

SEQ ID NO: 2471926 - RNA, 15 nt, Brucella suis 1330
uuucggaaaagaugc

SEQ ID NO: 2471927 - RNA, 21 nt, Brucella suis 1330
uuucggcaaggaugcugccag

SEQ ID NO: 2471928 - RNA, 22 nt, Brucella suis 1330
uuucgggagggaugcucuuucu

SEQ ID NO: 2471929 - RNA, 19 nt, Brucella suis 1330
uuucgggaugcgcuuuaaa

SEQ ID NO: 2471930 - RNA, 23 nt, Brucella suis 1330
uuucgguccacacuuccgcucau

SEQ ID NO: 2471931 - RNA, 22 nt, Brucella suis 1330
uuucguccagaucggccuugau

SEQ ID NO: 2471932 - RNA, 17 nt, Brucella suis 1330
uuucuaugcucaaaugc

SEQ ID NO: 2471933 - RNA, 15 nt, Brucella suis 1330
uuucugccgcgcauc

SEQ ID NO: 2471934 - RNA, 12 nt, Brucella suis 1330
uuucuucaucca

SEQ ID NO: 2471935 - RNA, 23 nt, Brucella suis 1330
uuucuuguaucuugcggguugaa

SEQ ID NO: 2471936 - RNA, 20 nt, Brucella suis 1330
uuucuuuguccagaaagagc

SEQ ID NO: 2471937 - RNA, 21 nt, Brucella suis 1330
uuugaaucccggcuguuacau

SEQ ID NO: 2471938 - RNA, 15 nt, Brucella suis 1330
uuugaguuuuucuuc

SEQ ID NO: 2471939 - RNA, 20 nt, Brucella suis 1330
uuugaucugauugaaucaga

SEQ ID NO: 2471940 - RNA, 20 nt, Brucella suis 1330
uuugcaagccgcggcgcgac

SEQ ID NO: 2471941 - RNA, 18 nt, Brucella suis 1330
uuugcagcaauuccugcg

SEQ ID NO: 2471942 - RNA, 21 nt, Brucella suis 1330
uuugcagcaauuccugcgcca

SEQ ID NO: 2471943 - RNA, 18 nt, Brucella suis 1330
uuugccgcauuuucgagc

SEQ ID NO: 2471944 - RNA, 11 nt, Brucella suis 1330
uuugcgcccag

SEQ ID NO: 2471945 - RNA, 20 nt, Brucella suis 1330
uuugcgccgggucagauuga

SEQ ID NO: 2471946 - RNA, 15 nt, Brucella suis 1330
uuugugauuccaaca

SEQ ID NO: 2471947 - RNA, 16 nt, Brucella suis 1330
uuuuaacuguucuucc

SEQ ID NO: 2471948 - RNA, 14 nt, Brucella suis 1330
uuuuaugcaucuga

SEQ ID NO: 2471949 - RNA, 20 nt, Brucella suis 1330
uuuucgccaagccggcgcag

SEQ ID NO: 2471950 - RNA, 15 nt, Brucella suis 1330
uuuucggaaaagaug

SEQ ID NO: 2471951 - RNA, 17 nt, Brucella suis 1330
uuuucggaaaagaugcg

SEQ ID NO: 2471952 - RNA, 22 nt, Brucella suis 1330
uuuucggcacgucauaaacuga

SEQ ID NO: 2471953 - RNA, 14 nt, Brucella suis 1330
uuuucuauugaaca

SEQ ID NO: 2471954 - RNA, 13 nt, Brucella suis 1330
uuuucugcacagc

SEQ ID NO: 2471955 - RNA, 13 nt, Brucella suis 1330
uuuucugcaucau

SEQ ID NO: 2471956 - RNA, 12 nt, Brucella suis 1330
uuuucuucaucc

SEQ ID NO: 2471957 - RNA, 18 nt, Brucella suis 1330
uuuugagcugcuggguga

SEQ ID NO: 2471958 - RNA, 20 nt, Brucella suis 1330
uuuugcuggaaaugcucuag

SEQ ID NO: 2471959 - RNA, 16 nt, Brucella suis 1330
uuuuggcucgaaaaug

SEQ ID NO: 2471960 - RNA, 16 nt, Brucella suis 1330
uuuugguuugaaaaug

SEQ ID NO: 2471961 - RNA, 20 nt, Brucella suis 1330
uuuugguuugaaaauguucu

SEQ ID NO: 2471962 - RNA, 15 nt, Brucella suis 1330
uuuugucauggccgg

SEQ ID NO: 2471963 - RNA, 13 nt, Brucella suis 1330
uuuuuauccuccc

SEQ ID NO: 2471964 - RNA, 12 nt, Brucella suis 1330
uuuuuccagacc

SEQ ID NO: 2471965 - RNA, 22 nt, Brucella suis 1330
uuuuugacugcugccaaaaauc

SEQ ID NO: 2471966 - RNA, 12 nt, Brucella suis 1330
aaaaaaaucucg

SEQ ID NO: 2471967 - RNA, 12 nt, Brucella suis 1330
aaaaaauaccag

SEQ ID NO: 2471968 - RNA, 20 nt, Brucella suis 1330
aaaaaauaccaguguugcga

SEQ ID NO: 2471969 - RNA, 11 nt, Brucella suis 1330
aaaaaaucacc

SEQ ID NO: 2471970 - RNA, 14 nt, Brucella suis 1330
aaaaacaacagcag

SEQ ID NO: 2471971 - RNA, 13 nt, Brucella suis 1330
aaaaacccggccu

SEQ ID NO: 2471972 - RNA, 21 nt, Brucella suis 1330
aaaaacgcuuuccggcaaaaa

SEQ ID NO: 2471973 - RNA, 22 nt, Brucella suis 1330
aaaaacuggugcgucaggccca

SEQ ID NO: 2471974 - RNA, 18 nt, Brucella suis 1330
aaaaagcccggcuggaau

SEQ ID NO: 2471975 - RNA, 22 nt, Brucella suis 1330
aaaaagcggcgucagcagguug

SEQ ID NO: 2471976 - RNA, 18 nt, Brucella suis 1330
aaaaaggcgaucagguug

SEQ ID NO: 2471977 - RNA, 17 nt, Brucella suis 1330
aaaaauaaagaaauagc

SEQ ID NO: 2471978 - RNA, 16 nt, Brucella suis 1330
aaaaauaccaguguug

SEQ ID NO: 2471979 - RNA, 23 nt, Brucella suis 1330
aaaacgacgcgcauuuuccgguu

SEQ ID NO: 2471980 - RNA, 20 nt, Brucella suis 1330
aaaacgcaccgugcuccaga

SEQ ID NO: 2471981 - RNA, 23 nt, Brucella suis 1330
aaaacgcaccgugcuccagauac

SEQ ID NO: 2471982 - RNA, 15 nt, Brucella suis 1330
aaaacgcgccgauac

SEQ ID NO: 2471983 - RNA, 17 nt, Brucella suis 1330
aaaacggcugcaacaaa

SEQ ID NO: 2471984 - RNA, 23 nt, Brucella suis 1330
aaaacggcugcaacaaaagaaga

SEQ ID NO: 2471985 - RNA, 18 nt, Brucella suis 1330
aaaacuuccgacaagcgu

SEQ ID NO: 2471986 - RNA, 20 nt, Brucella suis 1330
aaaagacgugucaaagccuc

SEQ ID NO: 2471987 - RNA, 22 nt, Brucella suis 1330
aaaagcacacggucaugcaggc

SEQ ID NO: 2471988 - RNA, 21 nt, Brucella suis 1330
aaaagcccgccacgaggaaga

SEQ ID NO: 2471989 - RNA, 23 nt, Brucella suis 1330
aaaagcccgccacgaggaagaaa

SEQ ID NO: 2471990 - RNA, 16 nt, Brucella suis 1330
aaaagccggagcauuc

SEQ ID NO: 2471991 - RNA, 12 nt, Brucella suis 1330
aaaagccuccag

SEQ ID NO: 2471992 - RNA, 21 nt, Brucella suis 1330
aaaagcgcaacuuuguuguug

SEQ ID NO: 2471993 - RNA, 17 nt, Brucella suis 1330
aaaagcgcggagcaaca

SEQ ID NO: 2471994 - RNA, 17 nt, Brucella suis 1330
aaaagugcgaagcgccu

SEQ ID NO: 2471995 - RNA, 17 nt, Brucella suis 1330
aaaaguggaaccgcucu

SEQ ID NO: 2471996 - RNA, 12 nt, Brucella suis 1330
aaaauauagccg

SEQ ID NO: 2471997 - RNA, 20 nt, Brucella suis 1330
aaaauaucuuuuuucaaaga

SEQ ID NO: 2471998 - RNA, 12 nt, Brucella suis 1330
aaaaucgacagg

SEQ ID NO: 2471999 - RNA, 19 nt, Brucella suis 1330
aaaaucuguucacauuuca

SEQ ID NO: 2472000 - RNA, 22 nt, Brucella suis 1330
aaaaugaaaagccggagcauuc

SEQ ID NO: 2472001 - RNA, 17 nt, Brucella suis 1330
aaaaugauuucgcaaug

SEQ ID NO: 2472002 - RNA, 16 nt, Brucella suis 1330
aaaaugcagcggguuc

SEQ ID NO: 2472003 - RNA, 21 nt, Brucella suis 1330
aaaaugccauggaacagacag

SEQ ID NO: 2472004 - RNA, 22 nt, Brucella suis 1330
aaaaugccauggaacagacagg

SEQ ID NO: 2472005 - RNA, 23 nt, Brucella suis 1330
aaaaugcgcuuaugugaagauuu

SEQ ID NO: 2472006 - RNA, 15 nt, Brucella suis 1330
aaaauggaaaaaccc

SEQ ID NO: 2472007 - RNA, 16 nt, Brucella suis 1330
aaaauggaaaaacccg

SEQ ID NO: 2472008 - RNA, 17 nt, Brucella suis 1330
aaaauggcccugucagc

SEQ ID NO: 2472009 - RNA, 18 nt, Brucella suis 1330
aaaauggccucagauuca

SEQ ID NO: 2472010 - RNA, 16 nt, Brucella suis 1330
aaacaaaagauuagag

SEQ ID NO: 2472011 - RNA, 12 nt, Brucella suis 1330
aaacaagcuuua

SEQ ID NO: 2472012 - RNA, 14 nt, Brucella suis 1330
aaacaaggccgagc

SEQ ID NO: 2472013 - RNA, 12 nt, Brucella suis 1330
aaacaccgcgca

SEQ ID NO: 2472014 - RNA, 22 nt, Brucella suis 1330
aaacaccgcgcaauaaugcagc

SEQ ID NO: 2472015 - RNA, 19 nt, Brucella suis 1330
aaacagcauauugccgagc

SEQ ID NO: 2472016 - RNA, 22 nt, Brucella suis 1330
aaacagcauauugccgagcaug

SEQ ID NO: 2472017 - RNA, 21 nt, Brucella suis 1330
aaacaucgacauggacaggau

SEQ ID NO: 2472018 - RNA, 21 nt, Brucella suis 1330
aaacaucuuauaaaaaggccg

SEQ ID NO: 2472019 - RNA, 14 nt, Brucella suis 1330
aaaccaaaaaaccu

SEQ ID NO: 2472020 - RNA, 19 nt, Brucella suis 1330
aaaccaccuuguugccauu

SEQ ID NO: 2472021 - RNA, 19 nt, Brucella suis 1330
aaaccauccccgccaugau

SEQ ID NO: 2472022 - RNA, 18 nt, Brucella suis 1330
aaaccaucgagcauuuca

SEQ ID NO: 2472023 - RNA, 15 nt, Brucella suis 1330
aaacccggccuuugc

SEQ ID NO: 2472024 - RNA, 15 nt, Brucella suis 1330
aaaccgcuucagcca

SEQ ID NO: 2472025 - RNA, 20 nt, Brucella suis 1330
aaaccggcauuauccgcauc

SEQ ID NO: 2472026 - RNA, 22 nt, Brucella suis 1330
aaaccggccaugcccaugcagu

SEQ ID NO: 2472027 - RNA, 19 nt, Brucella suis 1330
aaaccggggcggacggggu

SEQ ID NO: 2472028 - RNA, 16 nt, Brucella suis 1330
aaaccguggaaauucc

SEQ ID NO: 2472029 - RNA, 17 nt, Brucella suis 1330
aaaccguuucacacuuu

SEQ ID NO: 2472030 - RNA, 12 nt, Brucella suis 1330
aaacgaggccga

SEQ ID NO: 2472031 - RNA, 22 nt, Brucella suis 1330
aaacgauccagaucuuccuguc

SEQ ID NO: 2472032 - RNA, 22 nt, Brucella suis 1330
aaacgcaccaagaccgccgcga

SEQ ID NO: 2472033 - RNA, 13 nt, Brucella suis 1330
aaacgccaccuuu

SEQ ID NO: 2472034 - RNA, 23 nt, Brucella suis 1330
aaacgccgucuauaaacagcguu

SEQ ID NO: 2472035 - RNA, 18 nt, Brucella suis 1330
aaacgcggguggauggaa

SEQ ID NO: 2472036 - RNA, 23 nt, Brucella suis 1330
aaacgcguuccuucggagcgcgu

SEQ ID NO: 2472037 - RNA, 13 nt, Brucella suis 1330
aaacggccaagca

SEQ ID NO: 2472038 - RNA, 14 nt, Brucella suis 1330
aaacguacauuguu

SEQ ID NO: 2472039 - RNA, 16 nt, Brucella suis 1330
aaacucaucaaaagcu

SEQ ID NO: 2472040 - RNA, 20 nt, Brucella suis 1330
aaacucgucggaaaauucca

SEQ ID NO: 2472041 - RNA, 19 nt, Brucella suis 1330
aaacucgucggguuuuggc

SEQ ID NO: 2472042 - RNA, 22 nt, Brucella suis 1330
aaacucgucggguuuuggcauc

SEQ ID NO: 2472043 - RNA, 17 nt, Brucella suis 1330
aaacugaauccgcgacg

SEQ ID NO: 2472044 - RNA, 20 nt, Brucella suis 1330
aaacuugugcgugccauaca

SEQ ID NO: 2472045 - RNA, 22 nt, Brucella suis 1330
aaagaagaugagcgacaggaac

SEQ ID NO: 2472046 - RNA, 23 nt, Brucella suis 1330
aaagacacgguuccaccggcugu

SEQ ID NO: 2472047 - RNA, 19 nt, Brucella suis 1330
aaagaccagcaggaagaag

SEQ ID NO: 2472048 - RNA, 15 nt, Brucella suis 1330
aaagauaccagauca

SEQ ID NO: 2472049 - RNA, 21 nt, Brucella suis 1330
aaagaucaccauuacaaaaau

SEQ ID NO: 2472050 - RNA, 14 nt, Brucella suis 1330
aaagauccuucaca

SEQ ID NO: 2472051 - RNA, 16 nt, Brucella suis 1330
aaagauccuucacaua

SEQ ID NO: 2472052 - RNA, 10 nt, Brucella suis 1330
aaagaucugc

SEQ ID NO: 2472053 - RNA, 22 nt, Brucella suis 1330
aaagaucugcaucccgaaaagu

SEQ ID NO: 2472054 - RNA, 14 nt, Brucella suis 1330
aaagaugcgcgcca

SEQ ID NO: 2472055 - RNA, 21 nt, Brucella suis 1330
aaagaugcgcgucaaaacaaa

SEQ ID NO: 2472056 - RNA, 15 nt, Brucella suis 1330
aaagcacaaagaaca

SEQ ID NO: 2472057 - RNA, 21 nt, Brucella suis 1330
aaagcacagccagaaagaaga

SEQ ID NO: 2472058 - RNA, 21 nt, Brucella suis 1330
aaagcaccgaucacgccguca

SEQ ID NO: 2472059 - RNA, 14 nt, Brucella suis 1330
aaagcagauggcga

SEQ ID NO: 2472060 - RNA, 16 nt, Brucella suis 1330
aaagccacaacgcugu

SEQ ID NO: 2472061 - RNA, 20 nt, Brucella suis 1330
aaagccacaacgcugucugu

SEQ ID NO: 2472062 - RNA, 23 nt, Brucella suis 1330
aaagccauacgacaauaaucuca

SEQ ID NO: 2472063 - RNA, 15 nt, Brucella suis 1330
aaagcccagccguuu

SEQ ID NO: 2472064 - RNA, 17 nt, Brucella suis 1330
aaagccccgcucaucug

SEQ ID NO: 2472065 - RNA, 20 nt, Brucella suis 1330
aaagcccgccacgaggaaga

SEQ ID NO: 2472066 - RNA, 20 nt, Brucella suis 1330
aaagccgagcugcaagggaa

SEQ ID NO: 2472067 - RNA, 19 nt, Brucella suis 1330
aaagccgauugccccgcca

SEQ ID NO: 2472068 - RNA, 18 nt, Brucella suis 1330
aaagccgcuccauuccca

SEQ ID NO: 2472069 - RNA, 19 nt, Brucella suis 1330
aaagccguccaggcaucau

SEQ ID NO: 2472070 - RNA, 20 nt, Brucella suis 1330
aaagccuuuucgauaacgaa

SEQ ID NO: 2472071 - RNA, 14 nt, Brucella suis 1330
aaagcgcaguucgc

SEQ ID NO: 2472072 - RNA, 19 nt, Brucella suis 1330
aaagcgcaguucgcgcauc

SEQ ID NO: 2472073 - RNA, 15 nt, Brucella suis 1330
aaagcgcaucccgaa

SEQ ID NO: 2472074 - RNA, 19 nt, Brucella suis 1330
aaagcgcaucccgaaaagu

SEQ ID NO: 2472075 - RNA, 20 nt, Brucella suis 1330
aaagcgcaucccgaaaagug

SEQ ID NO: 2472076 - RNA, 18 nt, Brucella suis 1330
aaagcgcgccaucggcac

SEQ ID NO: 2472077 - RNA, 21 nt, Brucella suis 1330
aaagcgcgcgccaagacuuuc

SEQ ID NO: 2472078 - RNA, 20 nt, Brucella suis 1330
aaagcggauuggcguucaca

SEQ ID NO: 2472079 - RNA, 22 nt, Brucella suis 1330
aaagcggauuggcguucacauu

SEQ ID NO: 2472080 - RNA, 23 nt, Brucella suis 1330
aaagcugguugcgcggccagcca

SEQ ID NO: 2472081 - RNA, 17 nt, Brucella suis 1330
aaagcuuuccagcggaa

SEQ ID NO: 2472082 - RNA, 15 nt, Brucella suis 1330
aaaggaaagauccuu

SEQ ID NO: 2472083 - RNA, 13 nt, Brucella suis 1330
aaaggauauccuu

SEQ ID NO: 2472084 - RNA, 23 nt, Brucella suis 1330
aaaggaugaaugccgaagccagg

SEQ ID NO: 2472085 - RNA, 21 nt, Brucella suis 1330
aaaggaugaugaccugacuug

SEQ ID NO: 2472086 - RNA, 17 nt, Brucella suis 1330
aaaggcgaucagguuga

SEQ ID NO: 2472087 - RNA, 20 nt, Brucella suis 1330
aaaggcgauggcuugcggca

SEQ ID NO: 2472088 - RNA, 24 nt, Brucella suis 1330
aaaggcgauguuuucaccagucac

SEQ ID NO: 2472089 - RNA, 14 nt, Brucella suis 1330
aaaggcucugcgcc

SEQ ID NO: 2472090 - RNA, 15 nt, Brucella suis 1330
aaaggcucugcgcca

SEQ ID NO: 2472091 - RNA, 16 nt, Brucella suis 1330
aaagggugcgagcagg

SEQ ID NO: 2472092 - RNA, 11 nt, Brucella suis 1330
aaagugagaaa

SEQ ID NO: 2472093 - RNA, 16 nt, Brucella suis 1330
aaagugugaugcgguu

SEQ ID NO: 2472094 - RNA, 12 nt, Brucella suis 1330
aaauaaugccaa

SEQ ID NO: 2472095 - RNA, 13 nt, Brucella suis 1330
aaauaaugccaag

SEQ ID NO: 2472096 - RNA, 19 nt, Brucella suis 1330
aaauacaccaaugcaggcg

SEQ ID NO: 2472097 - RNA, 20 nt, Brucella suis 1330
aaaucaguccacuggacuga

SEQ ID NO: 2472098 - RNA, 20 nt, Brucella suis 1330
aaauccauagcgaauggcaa

SEQ ID NO: 2472099 - RNA, 14 nt, Brucella suis 1330
aaauccgacgggcg

SEQ ID NO: 2472100 - RNA, 17 nt, Brucella suis 1330
aaaucggcacuucgcca

SEQ ID NO: 2472101 - RNA, 13 nt, Brucella suis 1330
aaaucugcgcgcg

SEQ ID NO: 2472102 - RNA, 23 nt, Brucella suis 1330
aaaugcaagcgucuucugagaaa

SEQ ID NO: 2472103 - RNA, 22 nt, Brucella suis 1330
aaaugcaagugugcgcgcgcca

SEQ ID NO: 2472104 - RNA, 17 nt, Brucella suis 1330
aaaugccgcacagauca

SEQ ID NO: 2472105 - RNA, 20 nt, Brucella suis 1330
aaaugccggcgaucuuuucg

SEQ ID NO: 2472106 - RNA, 20 nt, Brucella suis 1330
aaaugcucuaggaaaacuug

SEQ ID NO: 2472107 - RNA, 19 nt, Brucella suis 1330
aaauggaaaaacccggccu

SEQ ID NO: 2472108 - RNA, 20 nt, Brucella suis 1330
aaauggcccugucagcgaaa

SEQ ID NO: 2472109 - RNA, 16 nt, Brucella suis 1330
aaaugggcugauuuag

SEQ ID NO: 2472110 - RNA, 19 nt, Brucella suis 1330
aaaugucacgcucgucgga

SEQ ID NO: 2472111 - RNA, 17 nt, Brucella suis 1330
aaauucauugaaauauu

SEQ ID NO: 2472112 - RNA, 18 nt, Brucella suis 1330
aaauugacgccauugacc

SEQ ID NO: 2472113 - RNA, 12 nt, Brucella suis 1330
aacaaaaugccc

SEQ ID NO: 2472114 - RNA, 12 nt, Brucella suis 1330
aacaaaugcaaa

SEQ ID NO: 2472115 - RNA, 17 nt, Brucella suis 1330
aacaaaugcaaaugccg

SEQ ID NO: 2472116 - RNA, 14 nt, Brucella suis 1330
aacaagaagcuucu

SEQ ID NO: 2472117 - RNA, 20 nt, Brucella suis 1330
aacaagagggcgcagcagcg

SEQ ID NO: 2472118 - RNA, 13 nt, Brucella suis 1330
aacaagcagaugc

SEQ ID NO: 2472119 - RNA, 15 nt, Brucella suis 1330
aacacaaucgccgga

SEQ ID NO: 2472120 - RNA, 21 nt, Brucella suis 1330
aacacaaucgccggaaccgcu

SEQ ID NO: 2472121 - RNA, 22 nt, Brucella suis 1330
aacaccaaaaacuuggaaauug

SEQ ID NO: 2472122 - RNA, 16 nt, Brucella suis 1330
aacaccgcgcaauaau

SEQ ID NO: 2472123 - RNA, 21 nt, Brucella suis 1330
aacaccgcgcaauaaugcagc

SEQ ID NO: 2472124 - RNA, 24 nt, Brucella suis 1330
aacacuucgaucgacccgccaugc

SEQ ID NO: 2472125 - RNA, 13 nt, Brucella suis 1330
aacagaugcggga

SEQ ID NO: 2472126 - RNA, 14 nt, Brucella suis 1330
aacagcaagguauu

SEQ ID NO: 2472127 - RNA, 13 nt, Brucella suis 1330
aacagcagcaggg

SEQ ID NO: 2472128 - RNA, 17 nt, Brucella suis 1330
aacagcauauugccgag

SEQ ID NO: 2472129 - RNA, 19 nt, Brucella suis 1330
aacagcguucaacuccguc

SEQ ID NO: 2472130 - RNA, 14 nt, Brucella suis 1330
aacagggcgaaaag

SEQ ID NO: 2472131 - RNA, 20 nt, Brucella suis 1330
aacaguuugagcaugaugcc

SEQ ID NO: 2472132 - RNA, 14 nt, Brucella suis 1330
aacaguuuuuugaa

SEQ ID NO: 2472133 - RNA, 13 nt, Brucella suis 1330
aacauacuccccu

SEQ ID NO: 2472134 - RNA, 19 nt, Brucella suis 1330
aacaucccgguugagccgu

SEQ ID NO: 2472135 - RNA, 18 nt, Brucella suis 1330
aacaucgacauggacagg

SEQ ID NO: 2472136 - RNA, 21 nt, Brucella suis 1330
aacaugccugccgcagccagg

SEQ ID NO: 2472137 - RNA, 16 nt, Brucella suis 1330
aacauggaaaagcccg

SEQ ID NO: 2472138 - RNA, 13 nt, Brucella suis 1330
aaccaaagcgucc

SEQ ID NO: 2472139 - RNA, 23 nt, Brucella suis 1330
aaccaccuuccugccuuugaaga

SEQ ID NO: 2472140 - RNA, 14 nt, Brucella suis 1330
aaccaccuuguugc

SEQ ID NO: 2472141 - RNA, 17 nt, Brucella suis 1330
aaccaguggccuucagc

SEQ ID NO: 2472142 - RNA, 13 nt, Brucella suis 1330
aaccauauaaagc

SEQ ID NO: 2472143 - RNA, 19 nt, Brucella suis 1330
aaccauauaaagcuugaac

SEQ ID NO: 2472144 - RNA, 16 nt, Brucella suis 1330
aaccaucgagcauuuc

SEQ ID NO: 2472145 - RNA, 16 nt, Brucella suis 1330
aacccaucaaugcacc

SEQ ID NO: 2472146 - RNA, 15 nt, Brucella suis 1330
aaccccaaugcucga

SEQ ID NO: 2472147 - RNA, 16 nt, Brucella suis 1330
aaccccaaugcucgau

SEQ ID NO: 2472148 - RNA, 16 nt, Brucella suis 1330
aacccgccaccagacc

SEQ ID NO: 2472149 - RNA, 19 nt, Brucella suis 1330
aacccggccucugcaagag

SEQ ID NO: 2472150 - RNA, 21 nt, Brucella suis 1330
aacccgggccaugacggcccg

SEQ ID NO: 2472151 - RNA, 20 nt, Brucella suis 1330
aacccuuuuucaugcaugau

SEQ ID NO: 2472152 - RNA, 21 nt, Brucella suis 1330
aaccgaagaaugcgcagccgu

SEQ ID NO: 2472153 - RNA, 20 nt, Brucella suis 1330
aaccgagcagccgcgaacga

SEQ ID NO: 2472154 - RNA, 17 nt, Brucella suis 1330
aaccgaugacgagccuc

SEQ ID NO: 2472155 - RNA, 20 nt, Brucella suis 1330
aaccgccggaaccauaucga

SEQ ID NO: 2472156 - RNA, 13 nt, Brucella suis 1330
aaccgcucuggaa

SEQ ID NO: 2472157 - RNA, 11 nt, Brucella suis 1330
aaccgcuucag

SEQ ID NO: 2472158 - RNA, 17 nt, Brucella suis 1330
aaccggcauuauccgca

SEQ ID NO: 2472159 - RNA, 14 nt, Brucella suis 1330
aaccggccauauga

SEQ ID NO: 2472160 - RNA, 23 nt, Brucella suis 1330
aaccgggcccuucucgacagcca

SEQ ID NO: 2472161 - RNA, 13 nt, Brucella suis 1330
aaccgucuugaac

SEQ ID NO: 2472162 - RNA, 18 nt, Brucella suis 1330
aaccgucuugaacagacc

SEQ ID NO: 2472163 - RNA, 16 nt, Brucella suis 1330
aaccgugccagauggc

SEQ ID NO: 2472164 - RNA, 15 nt, Brucella suis 1330
aaccuccgacaccag

SEQ ID NO: 2472165 - RNA, 21 nt, Brucella suis 1330
aaccuccgguucaugccggag

SEQ ID NO: 2472166 - RNA, 15 nt, Brucella suis 1330
aaccugcccgucuuc

SEQ ID NO: 2472167 - RNA, 19 nt, Brucella suis 1330
aaccuugccgcguccuuuu

SEQ ID NO: 2472168 - RNA, 18 nt, Brucella suis 1330
aaccuuuucggcaaggau

SEQ ID NO: 2472169 - RNA, 14 nt, Brucella suis 1330
aaccuuuuuccuga

SEQ ID NO: 2472170 - RNA, 22 nt, Brucella suis 1330
aacgaauacagugacgcgcgca

SEQ ID NO: 2472171 - RNA, 19 nt, Brucella suis 1330
aacgacuuuggccgucucu

SEQ ID NO: 2472172 - RNA, 23 nt, Brucella suis 1330
aacgacuuuggccgucucugaag

SEQ ID NO: 2472173 - RNA, 17 nt, Brucella suis 1330
aacgaggccgaccagaa

SEQ ID NO: 2472174 - RNA, 17 nt, Brucella suis 1330
aacgauggugcggcgcg

SEQ ID NO: 2472175 - RNA, 19 nt, Brucella suis 1330
aacgcaccgugcuccagau

SEQ ID NO: 2472176 - RNA, 22 nt, Brucella suis 1330
aacgcaccgugcuccagauacc

SEQ ID NO: 2472177 - RNA, 14 nt, Brucella suis 1330
aacgcagcaucaca

SEQ ID NO: 2472178 - RNA, 22 nt, Brucella suis 1330
aacgcagccgggcuuugcauug

SEQ ID NO: 2472179 - RNA, 15 nt, Brucella suis 1330
aacgccacgaaccgu

SEQ ID NO: 2472180 - RNA, 14 nt, Brucella suis 1330
aacgcccgaucaga

SEQ ID NO: 2472181 - RNA, 18 nt, Brucella suis 1330
aacgcccgaucagauagc

SEQ ID NO: 2472182 - RNA, 18 nt, Brucella suis 1330
aacgccggccugguuuca

SEQ ID NO: 2472183 - RNA, 23 nt, Brucella suis 1330
aacgccugauugaucgugccgga

SEQ ID NO: 2472184 - RNA, 18 nt, Brucella suis 1330
aacgccuuuuucacugca

SEQ ID NO: 2472185 - RNA, 21 nt, Brucella suis 1330
aacgcgccgauaccaaggccg

SEQ ID NO: 2472186 - RNA, 21 nt, Brucella suis 1330
aacgcuugcagagcgcaucca

SEQ ID NO: 2472187 - RNA, 15 nt, Brucella suis 1330
aacggaucaggcgcc

SEQ ID NO: 2472188 - RNA, 16 nt, Brucella suis 1330
aacggcccaugagcuu

SEQ ID NO: 2472189 - RNA, 18 nt, Brucella suis 1330
aacggcggaaagaagccc

SEQ ID NO: 2472190 - RNA, 16 nt, Brucella suis 1330
aacggcggaagcggca

SEQ ID NO: 2472191 - RNA, 14 nt, Brucella suis 1330
aacggcguccuuca

SEQ ID NO: 2472192 - RNA, 14 nt, Brucella suis 1330
aacggcugcaacaa

SEQ ID NO: 2472193 - RNA, 17 nt, Brucella suis 1330
aacggcugcaacaaaag

SEQ ID NO: 2472194 - RNA, 23 nt, Brucella suis 1330
aacgggcgagggcgggcggccag

SEQ ID NO: 2472195 - RNA, 19 nt, Brucella suis 1330
aacgggggcgaucaucaau

SEQ ID NO: 2472196 - RNA, 16 nt, Brucella suis 1330
aacgggugcgcugcca

SEQ ID NO: 2472197 - RNA, 13 nt, Brucella suis 1330
aacggucuggcgu

SEQ ID NO: 2472198 - RNA, 13 nt, Brucella suis 1330
aacgguucguccu

SEQ ID NO: 2472199 - RNA, 15 nt, Brucella suis 1330
aacgucacagauuca

SEQ ID NO: 2472200 - RNA, 21 nt, Brucella suis 1330
aacuacagccuggcggcuauu

SEQ ID NO: 2472201 - RNA, 14 nt, Brucella suis 1330
aacuaccaucugcc

SEQ ID NO: 2472202 - RNA, 16 nt, Brucella suis 1330
aacuauuuguuuuauc

SEQ ID NO: 2472203 - RNA, 12 nt, Brucella suis 1330
aacuccgcgcga

SEQ ID NO: 2472204 - RNA, 11 nt, Brucella suis 1330
aacucggcaua

SEQ ID NO: 2472205 - RNA, 23 nt, Brucella suis 1330
aacucuuuauccgugucguucuc

SEQ ID NO: 2472206 - RNA, 17 nt, Brucella suis 1330
aacugagggauagaugg

SEQ ID NO: 2472207 - RNA, 19 nt, Brucella suis 1330
aacugcaccgucucguuga

SEQ ID NO: 2472208 - RNA, 17 nt, Brucella suis 1330
aacugcccccgaaaguu

SEQ ID NO: 2472209 - RNA, 18 nt, Brucella suis 1330
aacugcggaucggcuuca

SEQ ID NO: 2472210 - RNA, 21 nt, Brucella suis 1330
aacugcggguaugcgcaugau

SEQ ID NO: 2472211 - RNA, 22 nt, Brucella suis 1330
aacuggauccggcgaauggcuu

SEQ ID NO: 2472212 - RNA, 15 nt, Brucella suis 1330
aacuggcgcagcagc

SEQ ID NO: 2472213 - RNA, 18 nt, Brucella suis 1330
aacuggcgcauggccgca

SEQ ID NO: 2472214 - RNA, 18 nt, Brucella suis 1330
aacuguguugccagcagc

SEQ ID NO: 2472215 - RNA, 17 nt, Brucella suis 1330
aacuuccgguauaugca

SEQ ID NO: 2472216 - RNA, 22 nt, Brucella suis 1330
aacuuccgguauaugcaccagc

SEQ ID NO: 2472217 - RNA, 19 nt, Brucella suis 1330
aacuuccuugccggucgac

SEQ ID NO: 2472218 - RNA, 23 nt, Brucella suis 1330
aacuucgccaagcccuuccacug

SEQ ID NO: 2472219 - RNA, 20 nt, Brucella suis 1330
aacuucgggcgccuucauuc

SEQ ID NO: 2472220 - RNA, 19 nt, Brucella suis 1330
aacuugcccgaugugauau

SEQ ID NO: 2472221 - RNA, 20 nt, Brucella suis 1330
aacuugcccgcauagccauc

SEQ ID NO: 2472222 - RNA, 21 nt, Brucella suis 1330
aacuuugugccgccgcugaaa

SEQ ID NO: 2472223 - RNA, 22 nt, Brucella suis 1330
aacuuugugccgccgcugaaag

SEQ ID NO: 2472224 - RNA, 23 nt, Brucella suis 1330
aagaaaccccggcagcgaaggcu

SEQ ID NO: 2472225 - RNA, 19 nt, Brucella suis 1330
aagaaagcccggcgauuuc

SEQ ID NO: 2472226 - RNA, 17 nt, Brucella suis 1330
aagaacagaagcaccag

SEQ ID NO: 2472227 - RNA, 18 nt, Brucella suis 1330
aagaagauaaucagcaga

SEQ ID NO: 2472228 - RNA, 19 nt, Brucella suis 1330
aagaagauaaucagcagaa

SEQ ID NO: 2472229 - RNA, 21 nt, Brucella suis 1330
aagaagauuucguacugcaau

SEQ ID NO: 2472230 - RNA, 14 nt, Brucella suis 1330
aagaauggcaagca

SEQ ID NO: 2472231 - RNA, 20 nt, Brucella suis 1330
aagaauggcaagcagcaaaa

SEQ ID NO: 2472232 - RNA, 13 nt, Brucella suis 1330
aagacaaagcccg

SEQ ID NO: 2472233 - RNA, 22 nt, Brucella suis 1330
aagacauugccaaggagcgcga

SEQ ID NO: 2472234 - RNA, 13 nt, Brucella suis 1330
aagaccagcagga

SEQ ID NO: 2472235 - RNA, 16 nt, Brucella suis 1330
aagaccagcaggaaga

SEQ ID NO: 2472236 - RNA, 18 nt, Brucella suis 1330
aagaccagcaggaagaag

SEQ ID NO: 2472237 - RNA, 18 nt, Brucella suis 1330
aagagccccaggaacggc

SEQ ID NO: 2472238 - RNA, 12 nt, Brucella suis 1330
aagagccgcagg

SEQ ID NO: 2472239 - RNA, 16 nt, Brucella suis 1330
aagagccgcucuggac

SEQ ID NO: 2472240 - RNA, 19 nt, Brucella suis 1330
aagagccgcugaaccacug

SEQ ID NO: 2472241 - RNA, 16 nt, Brucella suis 1330
aagagcguugcugccg

SEQ ID NO: 2472242 - RNA, 22 nt, Brucella suis 1330
aagagcuugcccucgccuucca

SEQ ID NO: 2472243 - RNA, 13 nt, Brucella suis 1330
aagaggacaaggc

SEQ ID NO: 2472244 - RNA, 14 nt, Brucella suis 1330
aagauaaucagcag

SEQ ID NO: 2472245 - RNA, 11 nt, Brucella suis 1330
aagaucagcca

SEQ ID NO: 2472246 - RNA, 14 nt, Brucella suis 1330
aagauccucgccuu

SEQ ID NO: 2472247 - RNA, 21 nt, Brucella suis 1330
aagaucgucacugcaaaaaau

SEQ ID NO: 2472248 - RNA, 16 nt, Brucella suis 1330
aagaugagcgacagga

SEQ ID NO: 2472249 - RNA, 17 nt, Brucella suis 1330
aagaugagcgacaggaa

SEQ ID NO: 2472250 - RNA, 16 nt, Brucella suis 1330
aagaugcgccgggcaa

SEQ ID NO: 2472251 - RNA, 22 nt, Brucella suis 1330
aagauugccgugguaugccagc

SEQ ID NO: 2472252 - RNA, 16 nt, Brucella suis 1330
aagauugcggcugaua

SEQ ID NO: 2472253 - RNA, 14 nt, Brucella suis 1330
aagcaaagagcggu

SEQ ID NO: 2472254 - RNA, 14 nt, Brucella suis 1330
aagcacaaagaaca

SEQ ID NO: 2472255 - RNA, 16 nt, Brucella suis 1330
aagcacagccagaaag

SEQ ID NO: 2472256 - RNA, 17 nt, Brucella suis 1330
aagcacagccagaaaga

SEQ ID NO: 2472257 - RNA, 20 nt, Brucella suis 1330
aagcacagccagaaagaaga

SEQ ID NO: 2472258 - RNA, 17 nt, Brucella suis 1330
aagcaccagcgcgccga

SEQ ID NO: 2472259 - RNA, 16 nt, Brucella suis 1330
aagcaccaugagcgcc

SEQ ID NO: 2472260 - RNA, 18 nt, Brucella suis 1330
aagcaccaugagcgccgu

SEQ ID NO: 2472261 - RNA, 16 nt, Brucella suis 1330
aagcagacgggaagcg

SEQ ID NO: 2472262 - RNA, 23 nt, Brucella suis 1330
aagcagcaaaaccguauaggcaa

SEQ ID NO: 2472263 - RNA, 16 nt, Brucella suis 1330
aagcaggaucgacagc

SEQ ID NO: 2472264 - RNA, 13 nt, Brucella suis 1330
aagcaggaucggc

SEQ ID NO: 2472265 - RNA, 18 nt, Brucella suis 1330
aagcaggaucggcagcag

SEQ ID NO: 2472266 - RNA, 23 nt, Brucella suis 1330
aagcagggcauggguggccgcca

SEQ ID NO: 2472267 - RNA, 18 nt, Brucella suis 1330
aagcauaucuuccagagc

SEQ ID NO: 2472268 - RNA, 14 nt, Brucella suis 1330
aagccaaagcccgu

SEQ ID NO: 2472269 - RNA, 16 nt, Brucella suis 1330
aagccaaagcccguga

SEQ ID NO: 2472270 - RNA, 22 nt, Brucella suis 1330
aagccacgaagcgguugcugga

SEQ ID NO: 2472271 - RNA, 16 nt, Brucella suis 1330
aagccacgcuccacac

SEQ ID NO: 2472272 - RNA, 14 nt, Brucella suis 1330
aagccagcccguga

SEQ ID NO: 2472273 - RNA, 22 nt, Brucella suis 1330
aagccagguggcugcccgccgc

SEQ ID NO: 2472274 - RNA, 20 nt, Brucella suis 1330
aagcccaagaaagaucagcc

SEQ ID NO: 2472275 - RNA, 16 nt, Brucella suis 1330
aagcccagaaauccau

SEQ ID NO: 2472276 - RNA, 23 nt, Brucella suis 1330
aagccccauguuuaugaaaacau

SEQ ID NO: 2472277 - RNA, 17 nt, Brucella suis 1330
aagcccgccacgaggaa

SEQ ID NO: 2472278 - RNA, 19 nt, Brucella suis 1330
aagcccgccacgaggaaga

SEQ ID NO: 2472279 - RNA, 21 nt, Brucella suis 1330
aagcccguaccaacccuuuuc

SEQ ID NO: 2472280 - RNA, 16 nt, Brucella suis 1330
aagccgaaugccagug

SEQ ID NO: 2472281 - RNA, 21 nt, Brucella suis 1330
aagccgaugcgcugaacaugg

SEQ ID NO: 2472282 - RNA, 16 nt, Brucella suis 1330
aagccgccucugucac

SEQ ID NO: 2472283 - RNA, 16 nt, Brucella suis 1330
aagccggucugucauu

SEQ ID NO: 2472284 - RNA, 16 nt, Brucella suis 1330
aagccuguccuuguuc

SEQ ID NO: 2472285 - RNA, 21 nt, Brucella suis 1330
aagccuucauugcgggaaggc

SEQ ID NO: 2472286 - RNA, 13 nt, Brucella suis 1330
aagcgaaaugccg

SEQ ID NO: 2472287 - RNA, 15 nt, Brucella suis 1330
aagcgaccaccaccg

SEQ ID NO: 2472288 - RNA, 22 nt, Brucella suis 1330
aagcgacgauaucgccugcuuc

SEQ ID NO: 2472289 - RNA, 18 nt, Brucella suis 1330
aagcgcauccagccggcg

SEQ ID NO: 2472290 - RNA, 21 nt, Brucella suis 1330
aagcgcauccagccggcgcau

SEQ ID NO: 2472291 - RNA, 16 nt, Brucella suis 1330
aagcgcaucccgaaaa

SEQ ID NO: 2472292 - RNA, 14 nt, Brucella suis 1330
aagcgccagaaaga

SEQ ID NO: 2472293 - RNA, 22 nt, Brucella suis 1330
aagcgccuacgcggggaaauca

SEQ ID NO: 2472294 - RNA, 12 nt, Brucella suis 1330
aagcgcgcgcca

SEQ ID NO: 2472295 - RNA, 23 nt, Brucella suis 1330
aagcgcguacauuuuugaaaaca

SEQ ID NO: 2472296 - RNA, 19 nt, Brucella suis 1330
aagcggcgucagcagguug

SEQ ID NO: 2472297 - RNA, 16 nt, Brucella suis 1330
aagcgggcuguuggcc

SEQ ID NO: 2472298 - RNA, 12 nt, Brucella suis 1330
aagcgguuuugc

SEQ ID NO: 2472299 - RNA, 19 nt, Brucella suis 1330
aagcgucauaggcagcgau

SEQ ID NO: 2472300 - RNA, 15 nt, Brucella suis 1330
aagcgugagcuucag

SEQ ID NO: 2472301 - RNA, 23 nt, Brucella suis 1330
aagcuccagcgugcgauugaugu

SEQ ID NO: 2472302 - RNA, 21 nt, Brucella suis 1330
aagcugccgcgaaaaagccga

SEQ ID NO: 2472303 - RNA, 22 nt, Brucella suis 1330
aagcugcgucguggcaucauaa

SEQ ID NO: 2472304 - RNA, 23 nt, Brucella suis 1330
aagcuuaacccaaccaccauuuu

SEQ ID NO: 2472305 - RNA, 17 nt, Brucella suis 1330
aagcuucacauccuuca

SEQ ID NO: 2472306 - RNA, 17 nt, Brucella suis 1330
aagcuugaacccgccga

SEQ ID NO: 2472307 - RNA, 19 nt, Brucella suis 1330
aagcuugaucgccgcacgg

SEQ ID NO: 2472308 - RNA, 23 nt, Brucella suis 1330
aagcuuuuuauuaaauggcuucc

SEQ ID NO: 2472309 - RNA, 13 nt, Brucella suis 1330
aaggaaagcccag

SEQ ID NO: 2472310 - RNA, 21 nt, Brucella suis 1330
aaggaaagccguuucgaucac

SEQ ID NO: 2472311 - RNA, 15 nt, Brucella suis 1330
aaggaacgcggccuu

SEQ ID NO: 2472312 - RNA, 18 nt, Brucella suis 1330
aaggaaggucagaagacc

SEQ ID NO: 2472313 - RNA, 16 nt, Brucella suis 1330
aaggaaugggcgggga

SEQ ID NO: 2472314 - RNA, 22 nt, Brucella suis 1330
aaggaaugggcggggagcaggc

SEQ ID NO: 2472315 - RNA, 21 nt, Brucella suis 1330
aaggagccgcugcgcagaaga

SEQ ID NO: 2472316 - RNA, 15 nt, Brucella suis 1330
aaggcaagcaggcgc

SEQ ID NO: 2472317 - RNA, 20 nt, Brucella suis 1330
aaggcccucgccgacccugu

SEQ ID NO: 2472318 - RNA, 22 nt, Brucella suis 1330
aaggccgaggcaaccgccucgg

SEQ ID NO: 2472319 - RNA, 18 nt, Brucella suis 1330
aaggccgcgcuccagauc

SEQ ID NO: 2472320 - RNA, 15 nt, Brucella suis 1330
aaggccgggaaaacc

SEQ ID NO: 2472321 - RNA, 16 nt, Brucella suis 1330
aaggccgggucaggcu

SEQ ID NO: 2472322 - RNA, 22 nt, Brucella suis 1330
aaggccucaucgaucacggcgc

SEQ ID NO: 2472323 - RNA, 16 nt, Brucella suis 1330
aaggccuguuccacac

SEQ ID NO: 2472324 - RNA, 15 nt, Brucella suis 1330
aaggcgacgagaccu

SEQ ID NO: 2472325 - RNA, 13 nt, Brucella suis 1330
aaggcgagcaggc

SEQ ID NO: 2472326 - RNA, 15 nt, Brucella suis 1330
aaggcgaucagguug

SEQ ID NO: 2472327 - RNA, 18 nt, Brucella suis 1330
aaggcgcagauagccuuu

SEQ ID NO: 2472328 - RNA, 18 nt, Brucella suis 1330
aaggcgcuguagucuguu

SEQ ID NO: 2472329 - RNA, 15 nt, Brucella suis 1330
aaggcgugaaccaca

SEQ ID NO: 2472330 - RNA, 16 nt, Brucella suis 1330
aaggcuccggcauuau

SEQ ID NO: 2472331 - RNA, 22 nt, Brucella suis 1330
aagggccgcaucggaagggcaa

SEQ ID NO: 2472332 - RNA, 23 nt, Brucella suis 1330
aaggggcaaauuucagucccgca

SEQ ID NO: 2472333 - RNA, 16 nt, Brucella suis 1330
aagggugcaagcgcaa

SEQ ID NO: 2472334 - RNA, 22 nt, Brucella suis 1330
aagguauuugauguuuuaggca

SEQ ID NO: 2472335 - RNA, 18 nt, Brucella suis 1330
aaggugaaggccugcuuc

SEQ ID NO: 2472336 - RNA, 20 nt, Brucella suis 1330
aaggugaaggccugcuucac

SEQ ID NO: 2472337 - RNA, 21 nt, Brucella suis 1330
aaguaacugauucuaucgccu

SEQ ID NO: 2472338 - RNA, 23 nt, Brucella suis 1330
aagucacgauggcccagcgguuu

SEQ ID NO: 2472339 - RNA, 21 nt, Brucella suis 1330
aagucguccugugcggcugca

SEQ ID NO: 2472340 - RNA, 18 nt, Brucella suis 1330
aagugaaaccagcguggc

SEQ ID NO: 2472341 - RNA, 19 nt, Brucella suis 1330
aagugcgcagcaucugcgc

SEQ ID NO: 2472342 - RNA, 18 nt, Brucella suis 1330
aagugcggucugcuugcc

SEQ ID NO: 2472343 - RNA, 17 nt, Brucella suis 1330
aaguggcgcgugccguu

SEQ ID NO: 2472344 - RNA, 11 nt, Brucella suis 1330
aagugguguug

SEQ ID NO: 2472345 - RNA, 19 nt, Brucella suis 1330
aagugugaaacgguuuugc

SEQ ID NO: 2472346 - RNA, 15 nt, Brucella suis 1330
aagugugaugcgguu

SEQ ID NO: 2472347 - RNA, 22 nt, Brucella suis 1330
aagugugcagacaggccagucg

SEQ ID NO: 2472348 - RNA, 16 nt, Brucella suis 1330
aaguucauccguucga

SEQ ID NO: 2472349 - RNA, 16 nt, Brucella suis 1330
aaguuuggcuaaagau

SEQ ID NO: 2472350 - RNA, 16 nt, Brucella suis 1330
aauaaagccauauuuu

SEQ ID NO: 2472351 - RNA, 16 nt, Brucella suis 1330
aauaagcuuuucauuu

SEQ ID NO: 2472352 - RNA, 22 nt, Brucella suis 1330
aauaaucguaucgccaaagacc

SEQ ID NO: 2472353 - RNA, 16 nt, Brucella suis 1330
aauacaccugcaucgg

SEQ ID NO: 2472354 - RNA, 18 nt, Brucella suis 1330
aauacccaugccuuucag

SEQ ID NO: 2472355 - RNA, 20 nt, Brucella suis 1330
aauacccaugccuuucaggu

SEQ ID NO: 2472356 - RNA, 13 nt, Brucella suis 1330
aauacgccuggcc

SEQ ID NO: 2472357 - RNA, 17 nt, Brucella suis 1330
aauacuaaucgcaaaaa

SEQ ID NO: 2472358 - RNA, 20 nt, Brucella suis 1330
aauagaugagcugguuuuuc

SEQ ID NO: 2472359 - RNA, 12 nt, Brucella suis 1330
aauagcacauau

SEQ ID NO: 2472360 - RNA, 20 nt, Brucella suis 1330
aauagcggcgaguugccacg

SEQ ID NO: 2472361 - RNA, 19 nt, Brucella suis 1330
aauagggaaacggccaggg

SEQ ID NO: 2472362 - RNA, 12 nt, Brucella suis 1330
aauagucgaaaa

SEQ ID NO: 2472363 - RNA, 12 nt, Brucella suis 1330
aauaguuagagc

SEQ ID NO: 2472364 - RNA, 23 nt, Brucella suis 1330
aauaucggauucuuaugccagau

SEQ ID NO: 2472365 - RNA, 17 nt, Brucella suis 1330
aauaucugaaucuccgg

SEQ ID NO: 2472366 - RNA, 12 nt, Brucella suis 1330
aauaucuugaag

SEQ ID NO: 2472367 - RNA, 19 nt, Brucella suis 1330
aauaugcgccuugcgccgc

SEQ ID NO: 2472368 - RNA, 21 nt, Brucella suis 1330
aauauucagcgaaccugaucc

SEQ ID NO: 2472369 - RNA, 19 nt, Brucella suis 1330
aauauucaggaucuuucca

SEQ ID NO: 2472370 - RNA, 17 nt, Brucella suis 1330
aauauugccuuccccau

SEQ ID NO: 2472371 - RNA, 22 nt, Brucella suis 1330
aaucaccagagacaguggcucu

SEQ ID NO: 2472372 - RNA, 13 nt, Brucella suis 1330
aaucacuugcaag

SEQ ID NO: 2472373 - RNA, 18 nt, Brucella suis 1330
aaucagaccgaugcucua

SEQ ID NO: 2472374 - RNA, 15 nt, Brucella suis 1330
aaucagaucggcgcu

SEQ ID NO: 2472375 - RNA, 15 nt, Brucella suis 1330
aaucagccagaagac

SEQ ID NO: 2472376 - RNA, 19 nt, Brucella suis 1330
aaucagcggauagagaaca

SEQ ID NO: 2472377 - RNA, 23 nt, Brucella suis 1330
aaucaggauaucgccguccuuug

SEQ ID NO: 2472378 - RNA, 16 nt, Brucella suis 1330
aaucagggauagaaug

SEQ ID NO: 2472379 - RNA, 16 nt, Brucella suis 1330
aaucaguccacuggac

SEQ ID NO: 2472380 - RNA, 17 nt, Brucella suis 1330
aaucauuuucucaagau

SEQ ID NO: 2472381 - RNA, 23 nt, Brucella suis 1330
aaucauuuucucaagaugaaagg

SEQ ID NO: 2472382 - RNA, 23 nt, Brucella suis 1330
aaucccggcuguuacauaugcug

SEQ ID NO: 2472383 - RNA, 22 nt, Brucella suis 1330
aauccgguucgcccaugccgca

SEQ ID NO: 2472384 - RNA, 16 nt, Brucella suis 1330
aauccuucagaagcac

SEQ ID NO: 2472385 - RNA, 15 nt, Brucella suis 1330
aaucgagggguuuuu

SEQ ID NO: 2472386 - RNA, 17 nt, Brucella suis 1330
aaucgaugacaucuucu

SEQ ID NO: 2472387 - RNA, 19 nt, Brucella suis 1330
aaucgaugacaucuucuuc

SEQ ID NO: 2472388 - RNA, 18 nt, Brucella suis 1330
aaucgaugucgccgcuca

SEQ ID NO: 2472389 - RNA, 12 nt, Brucella suis 1330
aaucgccgggcc

SEQ ID NO: 2472390 - RNA, 21 nt, Brucella suis 1330
aaucgcgagcagcgcgaugag

SEQ ID NO: 2472391 - RNA, 13 nt, Brucella suis 1330
aaucgcuggaacc

SEQ ID NO: 2472392 - RNA, 13 nt, Brucella suis 1330
aaucguaucgcca

SEQ ID NO: 2472393 - RNA, 21 nt, Brucella suis 1330
aaucgugccgguaacgaugau

SEQ ID NO: 2472394 - RNA, 13 nt, Brucella suis 1330
aaucuccggccca

SEQ ID NO: 2472395 - RNA, 13 nt, Brucella suis 1330
aaucugacccggc

SEQ ID NO: 2472396 - RNA, 14 nt, Brucella suis 1330
aaucugcuugguuu

SEQ ID NO: 2472397 - RNA, 20 nt, Brucella suis 1330
aaucuucucgaacugguuca

SEQ ID NO: 2472398 - RNA, 18 nt, Brucella suis 1330
aaugaaagcaacgcccuu

SEQ ID NO: 2472399 - RNA, 15 nt, Brucella suis 1330
aaugaacaacacaac

SEQ ID NO: 2472400 - RNA, 14 nt, Brucella suis 1330
aaugaaccggcucu

SEQ ID NO: 2472401 - RNA, 19 nt, Brucella suis 1330
aaugauguucggcaaggcc

SEQ ID NO: 2472402 - RNA, 20 nt, Brucella suis 1330
aaugcaaaugccgcacagau

SEQ ID NO: 2472403 - RNA, 19 nt, Brucella suis 1330
aaugcaagggcuggcucua

SEQ ID NO: 2472404 - RNA, 17 nt, Brucella suis 1330
aaugcaccgccugccag

SEQ ID NO: 2472405 - RNA, 21 nt, Brucella suis 1330
aaugcaccgccugccagcccg

SEQ ID NO: 2472406 - RNA, 16 nt, Brucella suis 1330
aaugccgaagccaggu

SEQ ID NO: 2472407 - RNA, 22 nt, Brucella suis 1330
aaugccuugagaugagcgacgu

SEQ ID NO: 2472408 - RNA, 16 nt, Brucella suis 1330
aaugcgacaaaacaaa

SEQ ID NO: 2472409 - RNA, 20 nt, Brucella suis 1330
aaugcgauaaaaugaaaagc

SEQ ID NO: 2472410 - RNA, 16 nt, Brucella suis 1330
aaugcggaagcgagaa

SEQ ID NO: 2472411 - RNA, 21 nt, Brucella suis 1330
aaugcguaaaaauaaagaaau

SEQ ID NO: 2472412 - RNA, 14 nt, Brucella suis 1330
aaugcuggccacca

SEQ ID NO: 2472413 - RNA, 15 nt, Brucella suis 1330
aaugcuggccaccag

SEQ ID NO: 2472414 - RNA, 16 nt, Brucella suis 1330
aauggcaaucuccauc

SEQ ID NO: 2472415 - RNA, 22 nt, Brucella suis 1330
aauggcccugucagcgaaacca

SEQ ID NO: 2472416 - RNA, 12 nt, Brucella suis 1330
aauggccuugcc

SEQ ID NO: 2472417 - RNA, 18 nt, Brucella suis 1330
aauggcgggccauuucca

SEQ ID NO: 2472418 - RNA, 19 nt, Brucella suis 1330
aauggcgggccauuuccaa

SEQ ID NO: 2472419 - RNA, 19 nt, Brucella suis 1330
aauggcugucaaugcagcg

SEQ ID NO: 2472420 - RNA, 18 nt, Brucella suis 1330
aaugggcugauuuaggcg

SEQ ID NO: 2472421 - RNA, 14 nt, Brucella suis 1330
aauggucacggcca

SEQ ID NO: 2472422 - RNA, 20 nt, Brucella suis 1330
aauggucugguugaguuccg

SEQ ID NO: 2472423 - RNA, 16 nt, Brucella suis 1330
aaugugaaggcgcugu

SEQ ID NO: 2472424 - RNA, 19 nt, Brucella suis 1330
aaugugcgggcuucuucca

SEQ ID NO: 2472425 - RNA, 15 nt, Brucella suis 1330
aauguuccgcaccgc

SEQ ID NO: 2472426 - RNA, 17 nt, Brucella suis 1330
aauguugagggacggcu

SEQ ID NO: 2472427 - RNA, 17 nt, Brucella suis 1330
aauuccacgcgccgaca

SEQ ID NO: 2472428 - RNA, 21 nt, Brucella suis 1330
aauuccaugcgauagcggcgc

SEQ ID NO: 2472429 - RNA, 22 nt, Brucella suis 1330
aauugcaucgcgguuuucaaga

SEQ ID NO: 2472430 - RNA, 13 nt, Brucella suis 1330
aauugcuccagcc

SEQ ID NO: 2472431 - RNA, 14 nt, Brucella suis 1330
aauugcugggcuuc

SEQ ID NO: 2472432 - RNA, 19 nt, Brucella suis 1330
aauugcuuuccugcacaug

SEQ ID NO: 2472433 - RNA, 13 nt, Brucella suis 1330
aauugucaggaaa

SEQ ID NO: 2472434 - RNA, 15 nt, Brucella suis 1330
aauugucaggaaaaa

SEQ ID NO: 2472435 - RNA, 17 nt, Brucella suis 1330
aauugucaggaaaaauc

SEQ ID NO: 2472436 - RNA, 21 nt, Brucella suis 1330
aauuugcagaacgucucgggc

SEQ ID NO: 2472437 - RNA, 20 nt, Brucella suis 1330
aauuugcgggcgaaccaauc

SEQ ID NO: 2472438 - RNA, 13 nt, Brucella suis 1330
acaaaaccgccgg

SEQ ID NO: 2472439 - RNA, 11 nt, Brucella suis 1330
acaaaaugccc

SEQ ID NO: 2472440 - RNA, 20 nt, Brucella suis 1330
acaaagaguuguagcgguuc

SEQ ID NO: 2472441 - RNA, 23 nt, Brucella suis 1330
acaaagccgggauuuuagagcgc

SEQ ID NO: 2472442 - RNA, 16 nt, Brucella suis 1330
acaaaggauuagagcg

SEQ ID NO: 2472443 - RNA, 20 nt, Brucella suis 1330
acaaauaguuagagcggcuc

SEQ ID NO: 2472444 - RNA, 20 nt, Brucella suis 1330
acaaauaguuagagcgguuc

SEQ ID NO: 2472445 - RNA, 20 nt, Brucella suis 1330
acaaauaguuggagcgguuc

SEQ ID NO: 2472446 - RNA, 16 nt, Brucella suis 1330
acaaaugcaaaugccg

SEQ ID NO: 2472447 - RNA, 21 nt, Brucella suis 1330
acaaaugcaaaugccgcacag

SEQ ID NO: 2472448 - RNA, 14 nt, Brucella suis 1330
acaaccgcgccgcu

SEQ ID NO: 2472449 - RNA, 17 nt, Brucella suis 1330
acaacgcaaaggccacc

SEQ ID NO: 2472450 - RNA, 17 nt, Brucella suis 1330
acaacgcgcagcaaagc

SEQ ID NO: 2472451 - RNA, 16 nt, Brucella suis 1330
acaagaacagccgccc

SEQ ID NO: 2472452 - RNA, 17 nt, Brucella suis 1330
acaagaauaggagccgg

SEQ ID NO: 2472453 - RNA, 22 nt, Brucella suis 1330
acaagagggauuuucguugcuu

SEQ ID NO: 2472454 - RNA, 21 nt, Brucella suis 1330
acaagaucgucacugcaaaaa

SEQ ID NO: 2472455 - RNA, 16 nt, Brucella suis 1330
acaagcgugagcuuca

SEQ ID NO: 2472456 - RNA, 18 nt, Brucella suis 1330
acaagcgugagcuucagg

SEQ ID NO: 2472457 - RNA, 15 nt, Brucella suis 1330
acaagcguguugccg

SEQ ID NO: 2472458 - RNA, 16 nt, Brucella suis 1330
acaaguuccuuuucca

SEQ ID NO: 2472459 - RNA, 13 nt, Brucella suis 1330
acaaucuugccaa

SEQ ID NO: 2472460 - RNA, 20 nt, Brucella suis 1330
acaaugguuauacucggcgu

SEQ ID NO: 2472461 - RNA, 22 nt, Brucella suis 1330
acaaugugccguaucacgccgc

SEQ ID NO: 2472462 - RNA, 16 nt, Brucella suis 1330
acacagagacaggaaa

SEQ ID NO: 2472463 - RNA, 13 nt, Brucella suis 1330
acacagccaagac

SEQ ID NO: 2472464 - RNA, 14 nt, Brucella suis 1330
acacaucgcccuga

SEQ ID NO: 2472465 - RNA, 20 nt, Brucella suis 1330
acaccgaacugggcggccag

SEQ ID NO: 2472466 - RNA, 15 nt, Brucella suis 1330
acaccgaccagcgca

SEQ ID NO: 2472467 - RNA, 19 nt, Brucella suis 1330
acaccgaccggcacccacu

SEQ ID NO: 2472468 - RNA, 23 nt, Brucella suis 1330
acaccgcgcaauaaugcagcgcc

SEQ ID NO: 2472469 - RNA, 21 nt, Brucella suis 1330
acaccucgccgauauccucga

SEQ ID NO: 2472470 - RNA, 20 nt, Brucella suis 1330
acacgaacagcagcaggggc

SEQ ID NO: 2472471 - RNA, 14 nt, Brucella suis 1330
acacgaacuugccc

SEQ ID NO: 2472472 - RNA, 18 nt, Brucella suis 1330
acacgccgccgcgcggca

SEQ ID NO: 2472473 - RNA, 17 nt, Brucella suis 1330
acacgcuuuuucgccuu

SEQ ID NO: 2472474 - RNA, 14 nt, Brucella suis 1330
acacggcgcaggca

SEQ ID NO: 2472475 - RNA, 15 nt, Brucella suis 1330
acacggcgcaggcag

SEQ ID NO: 2472476 - RNA, 18 nt, Brucella suis 1330
acacucugccugcccucg

SEQ ID NO: 2472477 - RNA, 22 nt, Brucella suis 1330
acacuuuucgggaugcgcucua

SEQ ID NO: 2472478 - RNA, 19 nt, Brucella suis 1330
acagaaccaucggaaccgc

SEQ ID NO: 2472479 - RNA, 21 nt, Brucella suis 1330
acagacuagacaaagcgguuu

SEQ ID NO: 2472480 - RNA, 13 nt, Brucella suis 1330
acagacuggaaug

SEQ ID NO: 2472481 - RNA, 13 nt, Brucella suis 1330
acagagacaggaa

SEQ ID NO: 2472482 - RNA, 12 nt, Brucella suis 1330
acagaucggcaa

SEQ ID NO: 2472483 - RNA, 20 nt, Brucella suis 1330
acagauugcuaaaugcaagc

SEQ ID NO: 2472484 - RNA, 12 nt, Brucella suis 1330
acagcaagccca

SEQ ID NO: 2472485 - RNA, 22 nt, Brucella suis 1330
acagccaagacuaugcgccacg

SEQ ID NO: 2472486 - RNA, 16 nt, Brucella suis 1330
acagccagaaagaaga

SEQ ID NO: 2472487 - RNA, 15 nt, Brucella suis 1330
acagccccgcaauaa

SEQ ID NO: 2472488 - RNA, 20 nt, Brucella suis 1330
acagccgguucggauccucc

SEQ ID NO: 2472489 - RNA, 19 nt, Brucella suis 1330
acagccuagacagcagugc

SEQ ID NO: 2472490 - RNA, 13 nt, Brucella suis 1330
acagccuggauga

SEQ ID NO: 2472491 - RNA, 12 nt, Brucella suis 1330
acagccuggcgg

SEQ ID NO: 2472492 - RNA, 20 nt, Brucella suis 1330
acagccuggcggcuauucca

SEQ ID NO: 2472493 - RNA, 21 nt, Brucella suis 1330
acagccuuggaauggcgcaca

SEQ ID NO: 2472494 - RNA, 15 nt, Brucella suis 1330
acagccuuggcuucc

SEQ ID NO: 2472495 - RNA, 17 nt, Brucella suis 1330
acagcgcgaacaugccu

SEQ ID NO: 2472496 - RNA, 20 nt, Brucella suis 1330
acagcgcgaacaugccugcc

SEQ ID NO: 2472497 - RNA, 14 nt, Brucella suis 1330
acagcggcgcgccu

SEQ ID NO: 2472498 - RNA, 18 nt, Brucella suis 1330
acagcggucgaaaccuug

SEQ ID NO: 2472499 - RNA, 15 nt, Brucella suis 1330
acaggaacgccgccg

SEQ ID NO: 2472500 - RNA, 17 nt, Brucella suis 1330
acaggcagcaugaacca

SEQ ID NO: 2472501 - RNA, 18 nt, Brucella suis 1330
acaggcucgggcagcuug

SEQ ID NO: 2472502 - RNA, 23 nt, Brucella suis 1330
acaggcucgggcagcuugucgaa

SEQ ID NO: 2472503 - RNA, 16 nt, Brucella suis 1330
acagggugacgacuga

SEQ ID NO: 2472504 - RNA, 21 nt, Brucella suis 1330
acagggugacgacugaaauaa

SEQ ID NO: 2472505 - RNA, 17 nt, Brucella suis 1330
acagucgaagcggccuu

SEQ ID NO: 2472506 - RNA, 16 nt, Brucella suis 1330
acagugacgcgcgcau

SEQ ID NO: 2472507 - RNA, 11 nt, Brucella suis 1330
acauaaaacgc

SEQ ID NO: 2472508 - RNA, 20 nt, Brucella suis 1330
acauacugccuuacugcccu

SEQ ID NO: 2472509 - RNA, 23 nt, Brucella suis 1330
acauagacgcuuggcaccgccug

SEQ ID NO: 2472510 - RNA, 17 nt, Brucella suis 1330
acauaggcgaucaccuc

SEQ ID NO: 2472511 - RNA, 15 nt, Brucella suis 1330
acauauucuuccguc

SEQ ID NO: 2472512 - RNA, 13 nt, Brucella suis 1330
acaucauugaacu

SEQ ID NO: 2472513 - RNA, 16 nt, Brucella suis 1330
acauccaucggcucau

SEQ ID NO: 2472514 - RNA, 20 nt, Brucella suis 1330
acauccucggcccuggaaag

SEQ ID NO: 2472515 - RNA, 14 nt, Brucella suis 1330
acauccuucacuuc

SEQ ID NO: 2472516 - RNA, 21 nt, Brucella suis 1330
acaucgcccugaagaagcuuc

SEQ ID NO: 2472517 - RNA, 23 nt, Brucella suis 1330
acaucgguggugccgaaggccuc

SEQ ID NO: 2472518 - RNA, 20 nt, Brucella suis 1330
acaucgucggucgucauuuc

SEQ ID NO: 2472519 - RNA, 22 nt, Brucella suis 1330
acaucgucggucgucauuuccg

SEQ ID NO: 2472520 - RNA, 18 nt, Brucella suis 1330
acaugaaauaaggucgcu

SEQ ID NO: 2472521 - RNA, 18 nt, Brucella suis 1330
acaugaacagaucggaau

SEQ ID NO: 2472522 - RNA, 14 nt, Brucella suis 1330
acaugaaggagagg

SEQ ID NO: 2472523 - RNA, 16 nt, Brucella suis 1330
acaugaugaucgccag

SEQ ID NO: 2472524 - RNA, 20 nt, Brucella suis 1330
acaugaugaucgccagcacg

SEQ ID NO: 2472525 - RNA, 12 nt, Brucella suis 1330
acaugccaagag

SEQ ID NO: 2472526 - RNA, 15 nt, Brucella suis 1330
acaugcuccagggug

SEQ ID NO: 2472527 - RNA, 16 nt, Brucella suis 1330
acaugcuuuaugcaag

SEQ ID NO: 2472528 - RNA, 12 nt, Brucella suis 1330
acaugcuuucga

SEQ ID NO: 2472529 - RNA, 20 nt, Brucella suis 1330
acauggcgggccaugccugc

SEQ ID NO: 2472530 - RNA, 14 nt, Brucella suis 1330
acauguggcgugau

SEQ ID NO: 2472531 - RNA, 14 nt, Brucella suis 1330
acauguuuuggaaa

SEQ ID NO: 2472532 - RNA, 20 nt, Brucella suis 1330
acauuggaguuugacaagau

SEQ ID NO: 2472533 - RNA, 14 nt, Brucella suis 1330
acauugucugaaaa

SEQ ID NO: 2472534 - RNA, 22 nt, Brucella suis 1330
acauugucugaaaacgaauuca

SEQ ID NO: 2472535 - RNA, 16 nt, Brucella suis 1330
acauuucaugaaaaug

SEQ ID NO: 2472536 - RNA, 19 nt, Brucella suis 1330
acauuucaugaaaaugcca

SEQ ID NO: 2472537 - RNA, 14 nt, Brucella suis 1330
acauuuucgccggg

SEQ ID NO: 2472538 - RNA, 14 nt, Brucella suis 1330
accaaacagccccg

SEQ ID NO: 2472539 - RNA, 13 nt, Brucella suis 1330
accaaagaaaaaa

SEQ ID NO: 2472540 - RNA, 22 nt, Brucella suis 1330
accaacccuuuuccgcaccgcc

SEQ ID NO: 2472541 - RNA, 11 nt, Brucella suis 1330
accaaggcagg

SEQ ID NO: 2472542 - RNA, 13 nt, Brucella suis 1330
accaaucggccuu

SEQ ID NO: 2472543 - RNA, 11 nt, Brucella suis 1330
accaccggccu

SEQ ID NO: 2472544 - RNA, 22 nt, Brucella suis 1330
accaccggccugagccauaucg

SEQ ID NO: 2472545 - RNA, 23 nt, Brucella suis 1330
accaccgggcagucagcaccgua

SEQ ID NO: 2472546 - RNA, 23 nt, Brucella suis 1330
accaccuaaaccuuugaaauaau

SEQ ID NO: 2472547 - RNA, 16 nt, Brucella suis 1330
accaccuuccugccuu

SEQ ID NO: 2472548 - RNA, 17 nt, Brucella suis 1330
accacgauuucgcccac

SEQ ID NO: 2472549 - RNA, 16 nt, Brucella suis 1330
accacgcuugcgcccg

SEQ ID NO: 2472550 - RNA, 19 nt, Brucella suis 1330
accagaucaagcgcucagc

SEQ ID NO: 2472551 - RNA, 16 nt, Brucella suis 1330
accagauccaccgcgc

SEQ ID NO: 2472552 - RNA, 22 nt, Brucella suis 1330
accagauuggcaacaucaccau

SEQ ID NO: 2472553 - RNA, 16 nt, Brucella suis 1330
accagcaacgcgcccg

SEQ ID NO: 2472554 - RNA, 19 nt, Brucella suis 1330
accagcaacgcgcccgcca

SEQ ID NO: 2472555 - RNA, 20 nt, Brucella suis 1330
accagcaacgcgcccgccac

SEQ ID NO: 2472556 - RNA, 12 nt, Brucella suis 1330
accagcaggaag

SEQ ID NO: 2472557 - RNA, 14 nt, Brucella suis 1330
accagcaggaagaa

SEQ ID NO: 2472558 - RNA, 23 nt, Brucella suis 1330
accagccguuccagggcgcgcca

SEQ ID NO: 2472559 - RNA, 19 nt, Brucella suis 1330
accauauaaagcuugaacc

SEQ ID NO: 2472560 - RNA, 14 nt, Brucella suis 1330
accauauccaucug

SEQ ID NO: 2472561 - RNA, 15 nt, Brucella suis 1330
accauauuggcggca

SEQ ID NO: 2472562 - RNA, 17 nt, Brucella suis 1330
accauauuggcggcaag

SEQ ID NO: 2472563 - RNA, 18 nt, Brucella suis 1330
accauauuugccgccaga

SEQ ID NO: 2472564 - RNA, 22 nt, Brucella suis 1330
accauauuugccgccagaaaau

SEQ ID NO: 2472565 - RNA, 19 nt, Brucella suis 1330
accaucacgacauugauau

SEQ ID NO: 2472566 - RNA, 15 nt, Brucella suis 1330
accaucggcaacaag

SEQ ID NO: 2472567 - RNA, 14 nt, Brucella suis 1330
accaugcggcucca

SEQ ID NO: 2472568 - RNA, 16 nt, Brucella suis 1330
accauggcgcauucag

SEQ ID NO: 2472569 - RNA, 16 nt, Brucella suis 1330
accauucugcccagaa

SEQ ID NO: 2472570 - RNA, 20 nt, Brucella suis 1330
accauuucccgguuuuucca

SEQ ID NO: 2472571 - RNA, 19 nt, Brucella suis 1330
accauuuucgcacgcgcau

SEQ ID NO: 2472572 - RNA, 12 nt, Brucella suis 1330
acccaaccacca

SEQ ID NO: 2472573 - RNA, 23 nt, Brucella suis 1330
acccaauagccgagauagacaug

SEQ ID NO: 2472574 - RNA, 14 nt, Brucella suis 1330
acccaugcgaugag

SEQ ID NO: 2472575 - RNA, 19 nt, Brucella suis 1330
acccaugucgaaagcccug

SEQ ID NO: 2472576 - RNA, 19 nt, Brucella suis 1330
accccaugagaaggcaagc

SEQ ID NO: 2472577 - RNA, 12 nt, Brucella suis 1330
accccaugguuu

SEQ ID NO: 2472578 - RNA, 19 nt, Brucella suis 1330
accccuuccuugccgggaa

SEQ ID NO: 2472579 - RNA, 23 nt, Brucella suis 1330
acccgaaacgguggccuuccuuc

SEQ ID NO: 2472580 - RNA, 20 nt, Brucella suis 1330
acccgaccaguaaggcgggc

SEQ ID NO: 2472581 - RNA, 13 nt, Brucella suis 1330
acccgcucccccc

SEQ ID NO: 2472582 - RNA, 22 nt, Brucella suis 1330
acccgcuccccccauucaugca

SEQ ID NO: 2472583 - RNA, 16 nt, Brucella suis 1330
acccggcaccgcaaag

SEQ ID NO: 2472584 - RNA, 21 nt, Brucella suis 1330
acccggcaccgcaaagagaac

SEQ ID NO: 2472585 - RNA, 17 nt, Brucella suis 1330
acccggccuuugcgccg

SEQ ID NO: 2472586 - RNA, 13 nt, Brucella suis 1330
acccgguaagcga

SEQ ID NO: 2472587 - RNA, 14 nt, Brucella suis 1330
acccggucuugagc

SEQ ID NO: 2472588 - RNA, 13 nt, Brucella suis 1330
acccguuccuugc

SEQ ID NO: 2472589 - RNA, 17 nt, Brucella suis 1330
acccuucaacagcccga

SEQ ID NO: 2472590 - RNA, 19 nt, Brucella suis 1330
acccuuggcgacggccagc

SEQ ID NO: 2472591 - RNA, 22 nt, Brucella suis 1330
acccuuggcgacggccagcgcg

SEQ ID NO: 2472592 - RNA, 13 nt, Brucella suis 1330
acccuuuuccgca

SEQ ID NO: 2472593 - RNA, 15 nt, Brucella suis 1330
accgaaaauggcccu

SEQ ID NO: 2472594 - RNA, 20 nt, Brucella suis 1330
accgaaggcaagcaggcgca

SEQ ID NO: 2472595 - RNA, 15 nt, Brucella suis 1330
accgacaaaaacaga

SEQ ID NO: 2472596 - RNA, 19 nt, Brucella suis 1330
accgagggcagcuucgagc

SEQ ID NO: 2472597 - RNA, 14 nt, Brucella suis 1330
accgauaccggauc

SEQ ID NO: 2472598 - RNA, 14 nt, Brucella suis 1330
accgauauagagca

SEQ ID NO: 2472599 - RNA, 18 nt, Brucella suis 1330
accgauauagagcagcac

SEQ ID NO: 2472600 - RNA, 22 nt, Brucella suis 1330
accgauccgcaacucauggaag

SEQ ID NO: 2472601 - RNA, 16 nt, Brucella suis 1330
accgauggagcgcccg

SEQ ID NO: 2472602 - RNA, 14 nt, Brucella suis 1330
accgauuccagcgu

SEQ ID NO: 2472603 - RNA, 17 nt, Brucella suis 1330
accgcacgcaaggcggc

SEQ ID NO: 2472604 - RNA, 20 nt, Brucella suis 1330
accgcacgcaaggcggcugg

SEQ ID NO: 2472605 - RNA, 15 nt, Brucella suis 1330
accgcacguuggggg

SEQ ID NO: 2472606 - RNA, 16 nt, Brucella suis 1330
accgcacguuggggga

SEQ ID NO: 2472607 - RNA, 19 nt, Brucella suis 1330
accgccaaggaacgcggcc

SEQ ID NO: 2472608 - RNA, 22 nt, Brucella suis 1330
accgccaccagaccaucggcaa

SEQ ID NO: 2472609 - RNA, 22 nt, Brucella suis 1330
accgcccggaucaaaccggcca

SEQ ID NO: 2472610 - RNA, 21 nt, Brucella suis 1330
accgccgcgauugcaucggca

SEQ ID NO: 2472611 - RNA, 15 nt, Brucella suis 1330
accgccugcgcgcau

SEQ ID NO: 2472612 - RNA, 18 nt, Brucella suis 1330
accgccugcgcgcauuuc

SEQ ID NO: 2472613 - RNA, 21 nt, Brucella suis 1330
accgccuguccggccugcgcc

SEQ ID NO: 2472614 - RNA, 13 nt, Brucella suis 1330
accgccuuuucca

SEQ ID NO: 2472615 - RNA, 16 nt, Brucella suis 1330
accgccuuuuccagug

SEQ ID NO: 2472616 - RNA, 18 nt, Brucella suis 1330
accgcgaaagccagaacc

SEQ ID NO: 2472617 - RNA, 20 nt, Brucella suis 1330
accgcgacguauauccggua

SEQ ID NO: 2472618 - RNA, 18 nt, Brucella suis 1330
accgcgccaaggcugcgc

SEQ ID NO: 2472619 - RNA, 18 nt, Brucella suis 1330
accgcgccauaaccucga

SEQ ID NO: 2472620 - RNA, 17 nt, Brucella suis 1330
accgcgccggaaggcgg

SEQ ID NO: 2472621 - RNA, 21 nt, Brucella suis 1330
accgcggguucccuguggaga

SEQ ID NO: 2472622 - RNA, 22 nt, Brucella suis 1330
accgcucuagguacaugagcac

SEQ ID NO: 2472623 - RNA, 16 nt, Brucella suis 1330
accggaacggauaacg

SEQ ID NO: 2472624 - RNA, 15 nt, Brucella suis 1330
accggauuugccaag

SEQ ID NO: 2472625 - RNA, 17 nt, Brucella suis 1330
accggauuugccaagcg

SEQ ID NO: 2472626 - RNA, 14 nt, Brucella suis 1330
accggcauggauca

SEQ ID NO: 2472627 - RNA, 12 nt, Brucella suis 1330
accggcauugag

SEQ ID NO: 2472628 - RNA, 17 nt, Brucella suis 1330
accggcauugagccgcg

SEQ ID NO: 2472629 - RNA, 18 nt, Brucella suis 1330
accggcauugagccgcgc

SEQ ID NO: 2472630 - RNA, 19 nt, Brucella suis 1330
accggcauugagccgcgcg

SEQ ID NO: 2472631 - RNA, 18 nt, Brucella suis 1330
accggccacccagcccga

SEQ ID NO: 2472632 - RNA, 15 nt, Brucella suis 1330
accggccaugcccau

SEQ ID NO: 2472633 - RNA, 16 nt, Brucella suis 1330
accggcccaaaggccg

SEQ ID NO: 2472634 - RNA, 15 nt, Brucella suis 1330
accggcgaaaaggcg

SEQ ID NO: 2472635 - RNA, 23 nt, Brucella suis 1330
accggcuggucaauaucgcgcag

SEQ ID NO: 2472636 - RNA, 21 nt, Brucella suis 1330
accggcugucccugcgggcca

SEQ ID NO: 2472637 - RNA, 22 nt, Brucella suis 1330
accggcuucggccauuucaggu

SEQ ID NO: 2472638 - RNA, 15 nt, Brucella suis 1330
accgggccgcaugau

SEQ ID NO: 2472639 - RNA, 17 nt, Brucella suis 1330
accgggccucgcgcccg

SEQ ID NO: 2472640 - RNA, 14 nt, Brucella suis 1330
accggggcagggca

SEQ ID NO: 2472641 - RNA, 13 nt, Brucella suis 1330
accgguuuucauc

SEQ ID NO: 2472642 - RNA, 19 nt, Brucella suis 1330
accgguuuucaucgcguca

SEQ ID NO: 2472643 - RNA, 15 nt, Brucella suis 1330
accguccacgauggc

SEQ ID NO: 2472644 - RNA, 17 nt, Brucella suis 1330
accgucgaggaaaaagc

SEQ ID NO: 2472645 - RNA, 17 nt, Brucella suis 1330
accgugccgagaaugcg

SEQ ID NO: 2472646 - RNA, 14 nt, Brucella suis 1330
accgugcuccagau

SEQ ID NO: 2472647 - RNA, 16 nt, Brucella suis 1330
accgugcuccagauac

SEQ ID NO: 2472648 - RNA, 13 nt, Brucella suis 1330
accguggcggccg

SEQ ID NO: 2472649 - RNA, 22 nt, Brucella suis 1330
accguucaacuggcgcagcagc

SEQ ID NO: 2472650 - RNA, 18 nt, Brucella suis 1330
accuaaaccuuugaaaua

SEQ ID NO: 2472651 - RNA, 16 nt, Brucella suis 1330
accucauuuugcuggc

SEQ ID NO: 2472652 - RNA, 17 nt, Brucella suis 1330
accucccuguccugcca

SEQ ID NO: 2472653 - RNA, 16 nt, Brucella suis 1330
accuccgacaccagcc

SEQ ID NO: 2472654 - RNA, 14 nt, Brucella suis 1330
accucgacggcggc

SEQ ID NO: 2472655 - RNA, 20 nt, Brucella suis 1330
accucguucaacgagaacaa

SEQ ID NO: 2472656 - RNA, 19 nt, Brucella suis 1330
accugacggauuucggcgg

SEQ ID NO: 2472657 - RNA, 14 nt, Brucella suis 1330
accugacuugaagu

SEQ ID NO: 2472658 - RNA, 14 nt, Brucella suis 1330
accugccaucacca

SEQ ID NO: 2472659 - RNA, 15 nt, Brucella suis 1330
accugccaucaccag

SEQ ID NO: 2472660 - RNA, 12 nt, Brucella suis 1330
accugcccgcac

SEQ ID NO: 2472661 - RNA, 20 nt, Brucella suis 1330
accugcggcgccagaugcgc

SEQ ID NO: 2472662 - RNA, 16 nt, Brucella suis 1330
accugcuucuugccuu

SEQ ID NO: 2472663 - RNA, 14 nt, Brucella suis 1330
accuuccagcaugg

SEQ ID NO: 2472664 - RNA, 11 nt, Brucella suis 1330
accuucgaguu

SEQ ID NO: 2472665 - RNA, 22 nt, Brucella suis 1330
accuucgaguucgccagcaccu

SEQ ID NO: 2472666 - RNA, 13 nt, Brucella suis 1330
accuucggccagc

SEQ ID NO: 2472667 - RNA, 14 nt, Brucella suis 1330
accuuguugacauu

SEQ ID NO: 2472668 - RNA, 22 nt, Brucella suis 1330
accuuugaaauaauugucagga

SEQ ID NO: 2472669 - RNA, 22 nt, Brucella suis 1330
accuuuucggcaaggaugcugc

SEQ ID NO: 2472670 - RNA, 22 nt, Brucella suis 1330
acgaaaagcaggaucagggcca

SEQ ID NO: 2472671 - RNA, 15 nt, Brucella suis 1330
acgaaaauaucggcu

SEQ ID NO: 2472672 - RNA, 20 nt, Brucella suis 1330
acgaaagccacgcuccacac

SEQ ID NO: 2472673 - RNA, 14 nt, Brucella suis 1330
acgaaaugaaagcc

SEQ ID NO: 2472674 - RNA, 15 nt, Brucella suis 1330
acgaaccccgcauca

SEQ ID NO: 2472675 - RNA, 14 nt, Brucella suis 1330
acgaaggaucaggu

SEQ ID NO: 2472676 - RNA, 20 nt, Brucella suis 1330
acgaauaguuagagcgguuc

SEQ ID NO: 2472677 - RNA, 14 nt, Brucella suis 1330
acgaauucaaccau

SEQ ID NO: 2472678 - RNA, 17 nt, Brucella suis 1330
acgaauucaggaucgcu

SEQ ID NO: 2472679 - RNA, 14 nt, Brucella suis 1330
acgacaauaaucuc

SEQ ID NO: 2472680 - RNA, 13 nt, Brucella suis 1330
acgacagggcgcu

SEQ ID NO: 2472681 - RNA, 16 nt, Brucella suis 1330
acgacagggcgcugcg

SEQ ID NO: 2472682 - RNA, 19 nt, Brucella suis 1330
acgacaugaaggagaggcc

SEQ ID NO: 2472683 - RNA, 17 nt, Brucella suis 1330
acgaccagaagcccgcg

SEQ ID NO: 2472684 - RNA, 13 nt, Brucella suis 1330
acgacgcccgccc

SEQ ID NO: 2472685 - RNA, 15 nt, Brucella suis 1330
acgacugaaauaaua

SEQ ID NO: 2472686 - RNA, 14 nt, Brucella suis 1330
acgagacaaggcaa

SEQ ID NO: 2472687 - RNA, 23 nt, Brucella suis 1330
acgagaugcgcuuuccgggcugc

SEQ ID NO: 2472688 - RNA, 19 nt, Brucella suis 1330
acgagcuccccggcgggug

SEQ ID NO: 2472689 - RNA, 19 nt, Brucella suis 1330
acgaggauagcguaaaacg

SEQ ID NO: 2472690 - RNA, 13 nt, Brucella suis 1330
acgagggguuuug

SEQ ID NO: 2472691 - RNA, 21 nt, Brucella suis 1330
acgaguaucuggcgauaaaga

SEQ ID NO: 2472692 - RNA, 13 nt, Brucella suis 1330
acgauacagccca

SEQ ID NO: 2472693 - RNA, 20 nt, Brucella suis 1330
acgauccagaucuuccuguc

SEQ ID NO: 2472694 - RNA, 14 nt, Brucella suis 1330
acgaucuccaguaa

SEQ ID NO: 2472695 - RNA, 13 nt, Brucella suis 1330
acgauggaaggaa

SEQ ID NO: 2472696 - RNA, 15 nt, Brucella suis 1330
acgauggugcggcgc

SEQ ID NO: 2472697 - RNA, 19 nt, Brucella suis 1330
acgauucgcccuuuaucag

SEQ ID NO: 2472698 - RNA, 22 nt, Brucella suis 1330
acgauucgcccuuuaucagcga

SEQ ID NO: 2472699 - RNA, 15 nt, Brucella suis 1330
acgcaaaggccaccc

SEQ ID NO: 2472700 - RNA, 17 nt, Brucella suis 1330
acgcaaucuuugauaga

SEQ ID NO: 2472701 - RNA, 20 nt, Brucella suis 1330
acgcaaucuuugauagacag

SEQ ID NO: 2472702 - RNA, 16 nt, Brucella suis 1330
acgcacggucuugccg

SEQ ID NO: 2472703 - RNA, 21 nt, Brucella suis 1330
acgcacugcaagauaggccca

SEQ ID NO: 2472704 - RNA, 22 nt, Brucella suis 1330
acgcagcguguagccgcgaacc

SEQ ID NO: 2472705 - RNA, 19 nt, Brucella suis 1330
acgccaaccaaagaaaaaa

SEQ ID NO: 2472706 - RNA, 22 nt, Brucella suis 1330
acgccagccgcgaucacagccg

SEQ ID NO: 2472707 - RNA, 20 nt, Brucella suis 1330
acgccauaagccggcaugaa

SEQ ID NO: 2472708 - RNA, 17 nt, Brucella suis 1330
acgccauagacgcccca

SEQ ID NO: 2472709 - RNA, 18 nt, Brucella suis 1330
acgccauagacgccccau

SEQ ID NO: 2472710 - RNA, 20 nt, Brucella suis 1330
acgccaucagcauugaacgc

SEQ ID NO: 2472711 - RNA, 22 nt, Brucella suis 1330
acgccauccauguggaaggcga

SEQ ID NO: 2472712 - RNA, 14 nt, Brucella suis 1330
acgccauugaccgc

SEQ ID NO: 2472713 - RNA, 21 nt, Brucella suis 1330
acgcccuucaaaccauccucg

SEQ ID NO: 2472714 - RNA, 18 nt, Brucella suis 1330
acgcccuuggcgagaauu

SEQ ID NO: 2472715 - RNA, 21 nt, Brucella suis 1330
acgccgaggaauuucagcgaa

SEQ ID NO: 2472716 - RNA, 23 nt, Brucella suis 1330
acgccgccuuaucggggcggcgu

SEQ ID NO: 2472717 - RNA, 20 nt, Brucella suis 1330
acgccggccugguuucacag

SEQ ID NO: 2472718 - RNA, 16 nt, Brucella suis 1330
acgccugauugaucgu

SEQ ID NO: 2472719 - RNA, 14 nt, Brucella suis 1330
acgccugccgcgcg

SEQ ID NO: 2472720 - RNA, 22 nt, Brucella suis 1330
acgccugucacgaucuugccga

SEQ ID NO: 2472721 - RNA, 24 nt, Brucella suis 1330
acgccuuauaggcgcgcgccucga

SEQ ID NO: 2472722 - RNA, 16 nt, Brucella suis 1330
acgcgacacgccaaaa

SEQ ID NO: 2472723 - RNA, 12 nt, Brucella suis 1330
acgcgcagcagc

SEQ ID NO: 2472724 - RNA, 14 nt, Brucella suis 1330
acgcgcagcagcau

SEQ ID NO: 2472725 - RNA, 22 nt, Brucella suis 1330
acgcgcagcagcaucgccgcca

SEQ ID NO: 2472726 - RNA, 24 nt, Brucella suis 1330
acgcgcagcagcaucgccgccagc

SEQ ID NO: 2472727 - RNA, 19 nt, Brucella suis 1330
acgcgcaucuuauccgaaa

SEQ ID NO: 2472728 - RNA, 19 nt, Brucella suis 1330
acgcgcaucuuuuccgaaa

SEQ ID NO: 2472729 - RNA, 16 nt, Brucella suis 1330
acgcgccaaacugcac

SEQ ID NO: 2472730 - RNA, 20 nt, Brucella suis 1330
acgcgccgacaaaaaacacc

SEQ ID NO: 2472731 - RNA, 22 nt, Brucella suis 1330
acgcgccgacaaaaaacaccgc

SEQ ID NO: 2472732 - RNA, 12 nt, Brucella suis 1330
acgcgccgauac

SEQ ID NO: 2472733 - RNA, 15 nt, Brucella suis 1330
acgcgccuuuucuuc

SEQ ID NO: 2472734 - RNA, 18 nt, Brucella suis 1330
acgcgcuaaaaagcgcgc

SEQ ID NO: 2472735 - RNA, 17 nt, Brucella suis 1330
acgcggauaucggcgcg

SEQ ID NO: 2472736 - RNA, 22 nt, Brucella suis 1330
acgcggauaucggcgcggauga

SEQ ID NO: 2472737 - RNA, 16 nt, Brucella suis 1330
acgcggcaggugccau

SEQ ID NO: 2472738 - RNA, 15 nt, Brucella suis 1330
acgcgggcgcagcga

SEQ ID NO: 2472739 - RNA, 21 nt, Brucella suis 1330
acgcggguggauggaauuuca

SEQ ID NO: 2472740 - RNA, 20 nt, Brucella suis 1330
acgcuccacacgaacagcag

SEQ ID NO: 2472741 - RNA, 20 nt, Brucella suis 1330
acgcuccgcccuggcggcgu

SEQ ID NO: 2472742 - RNA, 23 nt, Brucella suis 1330
acgcugaaugcggcaaucgcuuc

SEQ ID NO: 2472743 - RNA, 23 nt, Brucella suis 1330
acgcugcgugggaaaccgcgcgg

SEQ ID NO: 2472744 - RNA, 23 nt, Brucella suis 1330
acgcuucuugcuguaaccgccac

SEQ ID NO: 2472745 - RNA, 21 nt, Brucella suis 1330
acgcuugcgcccgcgguuucu

SEQ ID NO: 2472746 - RNA, 17 nt, Brucella suis 1330
acgcuuggccucuucca

SEQ ID NO: 2472747 - RNA, 20 nt, Brucella suis 1330
acgcuuggccucuuccagga

SEQ ID NO: 2472748 - RNA, 20 nt, Brucella suis 1330
acgcuuuccggcaaaaaacu

SEQ ID NO: 2472749 - RNA, 13 nt, Brucella suis 1330
acgcuuugaccgc

SEQ ID NO: 2472750 - RNA, 23 nt, Brucella suis 1330
acggaacgucacagauucaaaac

SEQ ID NO: 2472751 - RNA, 15 nt, Brucella suis 1330
acggaucaggcgcca

SEQ ID NO: 2472752 - RNA, 12 nt, Brucella suis 1330
acggauuuccac

SEQ ID NO: 2472753 - RNA, 19 nt, Brucella suis 1330
acggauuuccaccacgcgc

SEQ ID NO: 2472754 - RNA, 20 nt, Brucella suis 1330
acggcacguucggcaaucgu

SEQ ID NO: 2472755 - RNA, 23 nt, Brucella suis 1330
acggcacguucggcaaucguguc

SEQ ID NO: 2472756 - RNA, 16 nt, Brucella suis 1330
acggcagccucgacac

SEQ ID NO: 2472757 - RNA, 16 nt, Brucella suis 1330
acggcagguaagagca

SEQ ID NO: 2472758 - RNA, 13 nt, Brucella suis 1330
acggccaugcgca

SEQ ID NO: 2472759 - RNA, 21 nt, Brucella suis 1330
acggcggccuuggaggcggca

SEQ ID NO: 2472760 - RNA, 16 nt, Brucella suis 1330
acggcuggaaaugcgc

SEQ ID NO: 2472761 - RNA, 16 nt, Brucella suis 1330
acggcuucaacgccgu

SEQ ID NO: 2472762 - RNA, 17 nt, Brucella suis 1330
acgggaaagggccgccu

SEQ ID NO: 2472763 - RNA, 13 nt, Brucella suis 1330
acgggaagcgugc

SEQ ID NO: 2472764 - RNA, 14 nt, Brucella suis 1330
acgggagcagcucu

SEQ ID NO: 2472765 - RNA, 14 nt, Brucella suis 1330
acgggcagaacagu

SEQ ID NO: 2472766 - RNA, 15 nt, Brucella suis 1330
acgggcgagcgccag

SEQ ID NO: 2472767 - RNA, 15 nt, Brucella suis 1330
acggucggaauaucg

SEQ ID NO: 2472768 - RNA, 20 nt, Brucella suis 1330
acgguuuugcguuggaaaau

SEQ ID NO: 2472769 - RNA, 13 nt, Brucella suis 1330
acguagggcgcga

SEQ ID NO: 2472770 - RNA, 11 nt, Brucella suis 1330
acgucaacagc

SEQ ID NO: 2472771 - RNA, 21 nt, Brucella suis 1330
acgucaauagcauggccccgg

SEQ ID NO: 2472772 - RNA, 22 nt, Brucella suis 1330
acguccuuggcacguugcgccu

SEQ ID NO: 2472773 - RNA, 14 nt, Brucella suis 1330
acgucuucggcgcc

SEQ ID NO: 2472774 - RNA, 14 nt, Brucella suis 1330
acgugacaucaagc

SEQ ID NO: 2472775 - RNA, 15 nt, Brucella suis 1330
acguggcuugaagcu

SEQ ID NO: 2472776 - RNA, 13 nt, Brucella suis 1330
acuaaucgcaaaa

SEQ ID NO: 2472777 - RNA, 22 nt, Brucella suis 1330
acuacagccuggcggcuauucc

SEQ ID NO: 2472778 - RNA, 18 nt, Brucella suis 1330
acuaugcgccacgagaac

SEQ ID NO: 2472779 - RNA, 19 nt, Brucella suis 1330
acuauucaaacggcaucau

SEQ ID NO: 2472780 - RNA, 20 nt, Brucella suis 1330
acuauuuccaucgcuugaac

SEQ ID NO: 2472781 - RNA, 18 nt, Brucella suis 1330
acuccauuaaucaaaaac

SEQ ID NO: 2472782 - RNA, 16 nt, Brucella suis 1330
acuccccuacucccuu

SEQ ID NO: 2472783 - RNA, 16 nt, Brucella suis 1330
acuccgaccauuuccc

SEQ ID NO: 2472784 - RNA, 12 nt, Brucella suis 1330
acucgaaaauca

SEQ ID NO: 2472785 - RNA, 15 nt, Brucella suis 1330
acucgaacaggccca

SEQ ID NO: 2472786 - RNA, 14 nt, Brucella suis 1330
acucgaagauggaa

SEQ ID NO: 2472787 - RNA, 22 nt, Brucella suis 1330
acucgaagauggaacggaaaau

SEQ ID NO: 2472788 - RNA, 18 nt, Brucella suis 1330
acucgaugccuuucuggu

SEQ ID NO: 2472789 - RNA, 19 nt, Brucella suis 1330
acucggccgcguugcccau

SEQ ID NO: 2472790 - RNA, 12 nt, Brucella suis 1330
acucucacagcc

SEQ ID NO: 2472791 - RNA, 13 nt, Brucella suis 1330
acucuuuccuguu

SEQ ID NO: 2472792 - RNA, 12 nt, Brucella suis 1330
acugaaugcaga

SEQ ID NO: 2472793 - RNA, 23 nt, Brucella suis 1330
acugagaacuucggcauggcagc

SEQ ID NO: 2472794 - RNA, 23 nt, Brucella suis 1330
acugauagaaaaacccggucuug

SEQ ID NO: 2472795 - RNA, 12 nt, Brucella suis 1330
acugauuuucaa

SEQ ID NO: 2472796 - RNA, 22 nt, Brucella suis 1330
acugauuuucaaaagcuggaug

SEQ ID NO: 2472797 - RNA, 21 nt, Brucella suis 1330
acugcaaucugguccacgccc

SEQ ID NO: 2472798 - RNA, 13 nt, Brucella suis 1330
acugcacgucuuc

SEQ ID NO: 2472799 - RNA, 18 nt, Brucella suis 1330
acugcauuggcgauuuuc

SEQ ID NO: 2472800 - RNA, 20 nt, Brucella suis 1330
acugcauuggcgauuuucug

SEQ ID NO: 2472801 - RNA, 22 nt, Brucella suis 1330
acugcccauaucuucgcccuga

SEQ ID NO: 2472802 - RNA, 14 nt, Brucella suis 1330
acugcccuauugcc

SEQ ID NO: 2472803 - RNA, 18 nt, Brucella suis 1330
acugccgcguccggcauu

SEQ ID NO: 2472804 - RNA, 13 nt, Brucella suis 1330
acugcgaaagcgc

SEQ ID NO: 2472805 - RNA, 18 nt, Brucella suis 1330
acugcgcgcaaaccagga

SEQ ID NO: 2472806 - RNA, 20 nt, Brucella suis 1330
acugcggguaugcgcaugau

SEQ ID NO: 2472807 - RNA, 15 nt, Brucella suis 1330
acugcuaaugcguuu

SEQ ID NO: 2472808 - RNA, 17 nt, Brucella suis 1330
acuggaucaccuguucc

SEQ ID NO: 2472809 - RNA, 16 nt, Brucella suis 1330
acuggcgcauggccgc

SEQ ID NO: 2472810 - RNA, 22 nt, Brucella suis 1330
acuggcggaugaagaagauaau

SEQ ID NO: 2472811 - RNA, 15 nt, Brucella suis 1330
acuggcggccaagcg

SEQ ID NO: 2472812 - RNA, 14 nt, Brucella suis 1330
acuggguugaacgg

SEQ ID NO: 2472813 - RNA, 16 nt, Brucella suis 1330
acuguucuuccgagaa

SEQ ID NO: 2472814 - RNA, 22 nt, Brucella suis 1330
acuguucuuugcagccuccucg

SEQ ID NO: 2472815 - RNA, 11 nt, Brucella suis 1330
acuuccagugg

SEQ ID NO: 2472816 - RNA, 23 nt, Brucella suis 1330
acuucccgcccguccucaucgcc

SEQ ID NO: 2472817 - RNA, 21 nt, Brucella suis 1330
acuucccgcgccucacccucc

SEQ ID NO: 2472818 - RNA, 14 nt, Brucella suis 1330
acuuccgacaagcg

SEQ ID NO: 2472819 - RNA, 18 nt, Brucella suis 1330
acuucgcgggcaauggcc

SEQ ID NO: 2472820 - RNA, 19 nt, Brucella suis 1330
acuucgucgcugacuucaa

SEQ ID NO: 2472821 - RNA, 22 nt, Brucella suis 1330
acuucgucgcugacuucaaaau

SEQ ID NO: 2472822 - RNA, 20 nt, Brucella suis 1330
acuucuuuguucugcagcaa

SEQ ID NO: 2472823 - RNA, 12 nt, Brucella suis 1330
acuugaagagcc

SEQ ID NO: 2472824 - RNA, 20 nt, Brucella suis 1330
acuugaucugcuccaucgca

SEQ ID NO: 2472825 - RNA, 16 nt, Brucella suis 1330
acuugcgcuuugcaag

SEQ ID NO: 2472826 - RNA, 17 nt, Brucella suis 1330
acuuggaaauugacauu

SEQ ID NO: 2472827 - RNA, 18 nt, Brucella suis 1330
acuuggaaauugacauuu

SEQ ID NO: 2472828 - RNA, 23 nt, Brucella suis 1330
acuugguugccagcaauugcuuc

SEQ ID NO: 2472829 - RNA, 16 nt, Brucella suis 1330
agaaaagcaaaagccc

SEQ ID NO: 2472830 - RNA, 12 nt, Brucella suis 1330
agaaaauauagc

SEQ ID NO: 2472831 - RNA, 17 nt, Brucella suis 1330
agaaauagggccagaca

SEQ ID NO: 2472832 - RNA, 18 nt, Brucella suis 1330
agaacacagccccuugcc

SEQ ID NO: 2472833 - RNA, 13 nt, Brucella suis 1330
agaacauauccug

SEQ ID NO: 2472834 - RNA, 14 nt, Brucella suis 1330
agaaccaccagagc

SEQ ID NO: 2472835 - RNA, 23 nt, Brucella suis 1330
agaaccgcuuuccauggucaggc

SEQ ID NO: 2472836 - RNA, 13 nt, Brucella suis 1330
agaacuucggcac

SEQ ID NO: 2472837 - RNA, 17 nt, Brucella suis 1330
agaacuucggcauggca

SEQ ID NO: 2472838 - RNA, 20 nt, Brucella suis 1330
agaacuucggcauggcagcc

SEQ ID NO: 2472839 - RNA, 21 nt, Brucella suis 1330
agaagaccaaacagccccgca

SEQ ID NO: 2472840 - RNA, 22 nt, Brucella suis 1330
agaagauagacaacgcgcagca

SEQ ID NO: 2472841 - RNA, 23 nt, Brucella suis 1330
agaagcaagugugaaagcacaaa

SEQ ID NO: 2472842 - RNA, 19 nt, Brucella suis 1330
agaagcgcgggguguugcu

SEQ ID NO: 2472843 - RNA, 22 nt, Brucella suis 1330
agaagcucgacaucaagcgggc

SEQ ID NO: 2472844 - RNA, 21 nt, Brucella suis 1330
agaagcuucacauccuucacu

SEQ ID NO: 2472845 - RNA, 22 nt, Brucella suis 1330
agaagcuucuauagauggccgc

SEQ ID NO: 2472846 - RNA, 19 nt, Brucella suis 1330
agaaggcaagccccagcac

SEQ ID NO: 2472847 - RNA, 22 nt, Brucella suis 1330
agaaggcgcugcacacccuuga

SEQ ID NO: 2472848 - RNA, 18 nt, Brucella suis 1330
agaaggcgggaaggcaau

SEQ ID NO: 2472849 - RNA, 19 nt, Brucella suis 1330
agaagguacuggcaauaaa

SEQ ID NO: 2472850 - RNA, 21 nt, Brucella suis 1330
agaagguacuggcaauaaaag

SEQ ID NO: 2472851 - RNA, 21 nt, Brucella suis 1330
agaagugcugcugcaauccac

SEQ ID NO: 2472852 - RNA, 13 nt, Brucella suis 1330
agaaguugggggc

SEQ ID NO: 2472853 - RNA, 14 nt, Brucella suis 1330
agaaguugggggcc

SEQ ID NO: 2472854 - RNA, 22 nt, Brucella suis 1330
agaauaucuuccggcagaccgg

SEQ ID NO: 2472855 - RNA, 13 nt, Brucella suis 1330
agaaugaccacgc

SEQ ID NO: 2472856 - RNA, 16 nt, Brucella suis 1330
agaaugccacaagguc

SEQ ID NO: 2472857 - RNA, 12 nt, Brucella suis 1330
agaaugcguggc

SEQ ID NO: 2472858 - RNA, 12 nt, Brucella suis 1330
agaauuucucuu

SEQ ID NO: 2472859 - RNA, 20 nt, Brucella suis 1330
agacaggauuugcccgguuu

SEQ ID NO: 2472860 - RNA, 18 nt, Brucella suis 1330
agacauggcgggccaugc

SEQ ID NO: 2472861 - RNA, 19 nt, Brucella suis 1330
agaccagcaggaagaaggc

SEQ ID NO: 2472862 - RNA, 17 nt, Brucella suis 1330
agaccaucggcaacaag

SEQ ID NO: 2472863 - RNA, 17 nt, Brucella suis 1330
agaccgucuggccugaa

SEQ ID NO: 2472864 - RNA, 14 nt, Brucella suis 1330
agaccuggaacggg

SEQ ID NO: 2472865 - RNA, 21 nt, Brucella suis 1330
agaccuuccgggcaauaucgc

SEQ ID NO: 2472866 - RNA, 17 nt, Brucella suis 1330
agaccuucuggaagcgc

SEQ ID NO: 2472867 - RNA, 18 nt, Brucella suis 1330
agacggacuucuucacca

SEQ ID NO: 2472868 - RNA, 23 nt, Brucella suis 1330
agacggacuucuucaccagccuu

SEQ ID NO: 2472869 - RNA, 23 nt, Brucella suis 1330
agacgugaccgccuggcccggcu

SEQ ID NO: 2472870 - RNA, 19 nt, Brucella suis 1330
agacuggaaugucucgcag

SEQ ID NO: 2472871 - RNA, 15 nt, Brucella suis 1330
agacuuuccauccag

SEQ ID NO: 2472872 - RNA, 15 nt, Brucella suis 1330
agagacaguggcucu

SEQ ID NO: 2472873 - RNA, 23 nt, Brucella suis 1330
agagaccuucgguacgcugcccu

SEQ ID NO: 2472874 - RNA, 21 nt, Brucella suis 1330
agagaccuugaugauagaaua

SEQ ID NO: 2472875 - RNA, 19 nt, Brucella suis 1330
agagaugcgcgaauuuucu

SEQ ID NO: 2472876 - RNA, 23 nt, Brucella suis 1330
agagauuucaccacgccaucuuc

SEQ ID NO: 2472877 - RNA, 22 nt, Brucella suis 1330
agagcaaauacaccaaugcagg

SEQ ID NO: 2472878 - RNA, 24 nt, Brucella suis 1330
agagcagcaccggcggaaggcuga

SEQ ID NO: 2472879 - RNA, 23 nt, Brucella suis 1330
agagcauuuuucgggcgaaugga

SEQ ID NO: 2472880 - RNA, 14 nt, Brucella suis 1330
agagccgcaggcac

SEQ ID NO: 2472881 - RNA, 17 nt, Brucella suis 1330
agagccgcucuggacga

SEQ ID NO: 2472882 - RNA, 23 nt, Brucella suis 1330
agagccgcucuggacgaaaggcg

SEQ ID NO: 2472883 - RNA, 19 nt, Brucella suis 1330
agagcgcaucccgaaaagu

SEQ ID NO: 2472884 - RNA, 22 nt, Brucella suis 1330
agagcuucuuuucgaugaaaua

SEQ ID NO: 2472885 - RNA, 18 nt, Brucella suis 1330
agaggguuccgaauacaa

SEQ ID NO: 2472886 - RNA, 22 nt, Brucella suis 1330
agagucgccgaaauuggccgcu

SEQ ID NO: 2472887 - RNA, 15 nt, Brucella suis 1330
agagugcuuccucgu

SEQ ID NO: 2472888 - RNA, 19 nt, Brucella suis 1330
agauaagcggcaaaggccg

SEQ ID NO: 2472889 - RNA, 22 nt, Brucella suis 1330
agauaaucagcagaaggaugau

SEQ ID NO: 2472890 - RNA, 12 nt, Brucella suis 1330
agauacaaaaaa

SEQ ID NO: 2472891 - RNA, 19 nt, Brucella suis 1330
agauacaaaaaaucccgga

SEQ ID NO: 2472892 - RNA, 13 nt, Brucella suis 1330
agauagcccggca

SEQ ID NO: 2472893 - RNA, 14 nt, Brucella suis 1330
agauaggcguugau

SEQ ID NO: 2472894 - RNA, 19 nt, Brucella suis 1330
agauauccauaucuuucca

SEQ ID NO: 2472895 - RNA, 18 nt, Brucella suis 1330
agaucaaagguaaggccg

SEQ ID NO: 2472896 - RNA, 20 nt, Brucella suis 1330
agaucaauacgcucgcacau

SEQ ID NO: 2472897 - RNA, 17 nt, Brucella suis 1330
agaucacccagaaaacg

SEQ ID NO: 2472898 - RNA, 22 nt, Brucella suis 1330
agaucauccggcucauaguuga

SEQ ID NO: 2472899 - RNA, 11 nt, Brucella suis 1330
agaucaucgcc

SEQ ID NO: 2472900 - RNA, 21 nt, Brucella suis 1330
agaucaugggcggccacggca

SEQ ID NO: 2472901 - RNA, 15 nt, Brucella suis 1330
agauccgcugacugc

SEQ ID NO: 2472902 - RNA, 19 nt, Brucella suis 1330
agauccgcugacugcgcca

SEQ ID NO: 2472903 - RNA, 22 nt, Brucella suis 1330
agauccgcugacugcgccaucc

SEQ ID NO: 2472904 - RNA, 19 nt, Brucella suis 1330
agaucgaagcgaaagugac

SEQ ID NO: 2472905 - RNA, 15 nt, Brucella suis 1330
agaucgacaaagccu

SEQ ID NO: 2472906 - RNA, 22 nt, Brucella suis 1330
agaucgaccugagccucgggca

SEQ ID NO: 2472907 - RNA, 20 nt, Brucella suis 1330
agaucgacgcagaaauugca

SEQ ID NO: 2472908 - RNA, 23 nt, Brucella suis 1330
agaucgauaucgagaccggcugc

SEQ ID NO: 2472909 - RNA, 23 nt, Brucella suis 1330
agaucggacgggcagaacaguuu

SEQ ID NO: 2472910 - RNA, 20 nt, Brucella suis 1330
agaucggccauuucggcuuc

SEQ ID NO: 2472911 - RNA, 14 nt, Brucella suis 1330
agaucggcgcucua

SEQ ID NO: 2472912 - RNA, 16 nt, Brucella suis 1330
agaucugcaucccgaa

SEQ ID NO: 2472913 - RNA, 21 nt, Brucella suis 1330
agaucugcaucccgaaaagug

SEQ ID NO: 2472914 - RNA, 16 nt, Brucella suis 1330
agaucuguaucccgaa

SEQ ID NO: 2472915 - RNA, 20 nt, Brucella suis 1330
agaucuguaucccgaaaagu

SEQ ID NO: 2472916 - RNA, 22 nt, Brucella suis 1330
agaucuguaucccgaaaagugc

SEQ ID NO: 2472917 - RNA, 16 nt, Brucella suis 1330
agaugaaucaccagcg

SEQ ID NO: 2472918 - RNA, 18 nt, Brucella suis 1330
agaugagcggcagcagcc

SEQ ID NO: 2472919 - RNA, 22 nt, Brucella suis 1330
agaugaucauaacagaugcggg

SEQ ID NO: 2472920 - RNA, 15 nt, Brucella suis 1330
agaugcaaugcaccg

SEQ ID NO: 2472921 - RNA, 10 nt, Brucella suis 1330
agaugcagcg

SEQ ID NO: 2472922 - RNA, 21 nt, Brucella suis 1330
agaugcagcggaacuggauga

SEQ ID NO: 2472923 - RNA, 14 nt, Brucella suis 1330
agaugcagcggcgc

SEQ ID NO: 2472924 - RNA, 17 nt, Brucella suis 1330
agaugccgugggcaaga

SEQ ID NO: 2472925 - RNA, 18 nt, Brucella suis 1330
agaugcgcgucaaaacaa

SEQ ID NO: 2472926 - RNA, 13 nt, Brucella suis 1330
agauggacauagc

SEQ ID NO: 2472927 - RNA, 20 nt, Brucella suis 1330
agauggccgcuuugcggagg

SEQ ID NO: 2472928 - RNA, 19 nt, Brucella suis 1330
agauggcgaaugcccuuga

SEQ ID NO: 2472929 - RNA, 22 nt, Brucella suis 1330
agauggcguucugaaaccgcag

SEQ ID NO: 2472930 - RNA, 20 nt, Brucella suis 1330
agauggguugcgauggcgcc

SEQ ID NO: 2472931 - RNA, 17 nt, Brucella suis 1330
agaugugccaccagcac

SEQ ID NO: 2472932 - RNA, 17 nt, Brucella suis 1330
agauuaugcuuuaaaag

SEQ ID NO: 2472933 - RNA, 14 nt, Brucella suis 1330
agauucccuuuucc

SEQ ID NO: 2472934 - RNA, 17 nt, Brucella suis 1330
agauugaacccggccuc

SEQ ID NO: 2472935 - RNA, 15 nt, Brucella suis 1330
agauugaucccgauc

SEQ ID NO: 2472936 - RNA, 12 nt, Brucella suis 1330
agauugcagcaa

SEQ ID NO: 2472937 - RNA, 15 nt, Brucella suis 1330
agauugggcagcaga

SEQ ID NO: 2472938 - RNA, 17 nt, Brucella suis 1330
agauuguaauccauggc

SEQ ID NO: 2472939 - RNA, 22 nt, Brucella suis 1330
agcaaaagccccgcccauugaa

SEQ ID NO: 2472940 - RNA, 22 nt, Brucella suis 1330
agcaaaggucgggugccagauc

SEQ ID NO: 2472941 - RNA, 14 nt, Brucella suis 1330
agcaacuuccuugc

SEQ ID NO: 2472942 - RNA, 13 nt, Brucella suis 1330
agcaaggcggccc

SEQ ID NO: 2472943 - RNA, 18 nt, Brucella suis 1330
agcaagguauuugauguu

SEQ ID NO: 2472944 - RNA, 12 nt, Brucella suis 1330
agcaauuccugc

SEQ ID NO: 2472945 - RNA, 14 nt, Brucella suis 1330
agcacaagccaucc

SEQ ID NO: 2472946 - RNA, 19 nt, Brucella suis 1330
agcacagccagaaagaaga

SEQ ID NO: 2472947 - RNA, 20 nt, Brucella suis 1330
agcacauccugcaccggcuu

SEQ ID NO: 2472948 - RNA, 15 nt, Brucella suis 1330
agcacauggcggccu

SEQ ID NO: 2472949 - RNA, 14 nt, Brucella suis 1330
agcacccgcuuggg

SEQ ID NO: 2472950 - RNA, 16 nt, Brucella suis 1330
agcacccgcuugggca

SEQ ID NO: 2472951 - RNA, 13 nt, Brucella suis 1330
agcaccgaucacg

SEQ ID NO: 2472952 - RNA, 23 nt, Brucella suis 1330
agcacgaggauagcguaaaacgc

SEQ ID NO: 2472953 - RNA, 17 nt, Brucella suis 1330
agcacgaguaucuggcg

SEQ ID NO: 2472954 - RNA, 18 nt, Brucella suis 1330
agcacuacgucaacagcc

SEQ ID NO: 2472955 - RNA, 19 nt, Brucella suis 1330
agcacuacgucaacagccg

SEQ ID NO: 2472956 - RNA, 12 nt, Brucella suis 1330
agcacucugcca

SEQ ID NO: 2472957 - RNA, 16 nt, Brucella suis 1330
agcacuuccagauaga

SEQ ID NO: 2472958 - RNA, 23 nt, Brucella suis 1330
agcagauccgugaugauggcgag

SEQ ID NO: 2472959 - RNA, 14 nt, Brucella suis 1330
agcagcaggggcag

SEQ ID NO: 2472960 - RNA, 20 nt, Brucella suis 1330
agcagcaggggcagcgcgcg

SEQ ID NO: 2472961 - RNA, 17 nt, Brucella suis 1330
agcagcaucuugccaag

SEQ ID NO: 2472962 - RNA, 14 nt, Brucella suis 1330
agcagcgcaaacuc

SEQ ID NO: 2472963 - RNA, 19 nt, Brucella suis 1330
agcagcgcgaugagccgac

SEQ ID NO: 2472964 - RNA, 14 nt, Brucella suis 1330
agcagcggcaaaaa

SEQ ID NO: 2472965 - RNA, 13 nt, Brucella suis 1330
agcaggaagaagg

SEQ ID NO: 2472966 - RNA, 14 nt, Brucella suis 1330
agcaggaagaaggc

SEQ ID NO: 2472967 - RNA, 12 nt, Brucella suis 1330
agcaggagauag

SEQ ID NO: 2472968 - RNA, 15 nt, Brucella suis 1330
agcaggaucgacagc

SEQ ID NO: 2472969 - RNA, 14 nt, Brucella suis 1330
agcaggaucggcag

SEQ ID NO: 2472970 - RNA, 21 nt, Brucella suis 1330
agcaggccauucccgccucag

SEQ ID NO: 2472971 - RNA, 22 nt, Brucella suis 1330
agcaggccggcgagggcgggca

SEQ ID NO: 2472972 - RNA, 15 nt, Brucella suis 1330
agcaggcgcgcagca

SEQ ID NO: 2472973 - RNA, 22 nt, Brucella suis 1330
agcaggcguugcagauauuccu

SEQ ID NO: 2472974 - RNA, 16 nt, Brucella suis 1330
agcaggcuuucggccu

SEQ ID NO: 2472975 - RNA, 17 nt, Brucella suis 1330
agcaggcuuucggccug

SEQ ID NO: 2472976 - RNA, 21 nt, Brucella suis 1330
agcaggcuuucggccugugcg

SEQ ID NO: 2472977 - RNA, 16 nt, Brucella suis 1330
agcauauguuccugcg

SEQ ID NO: 2472978 - RNA, 22 nt, Brucella suis 1330
agcauauugccgagcauggccu

SEQ ID NO: 2472979 - RNA, 16 nt, Brucella suis 1330
agcaucagcuugccca

SEQ ID NO: 2472980 - RNA, 18 nt, Brucella suis 1330
agcaucagcuugcccauc

SEQ ID NO: 2472981 - RNA, 20 nt, Brucella suis 1330
agcaucgaccagccggggcg

SEQ ID NO: 2472982 - RNA, 23 nt, Brucella suis 1330
agcaugaucgcccgcccggcauc

SEQ ID NO: 2472983 - RNA, 14 nt, Brucella suis 1330
agcaugaugccgac

SEQ ID NO: 2472984 - RNA, 22 nt, Brucella suis 1330
agcaugaugccgacgaaagcca

SEQ ID NO: 2472985 - RNA, 21 nt, Brucella suis 1330
agcauuccgggccgcacaaau

SEQ ID NO: 2472986 - RNA, 22 nt, Brucella suis 1330
agcauugaacgccuuuuucacu

SEQ ID NO: 2472987 - RNA, 22 nt, Brucella suis 1330
agcauuuucgagccaaaagugc

SEQ ID NO: 2472988 - RNA, 22 nt, Brucella suis 1330
agccagcccgugacguccacca

SEQ ID NO: 2472989 - RNA, 19 nt, Brucella suis 1330
agccagcgcauaaaggccg

SEQ ID NO: 2472990 - RNA, 22 nt, Brucella suis 1330
agccagguggcugcccgccgca

SEQ ID NO: 2472991 - RNA, 16 nt, Brucella suis 1330
agccauaucggggcgu

SEQ ID NO: 2472992 - RNA, 14 nt, Brucella suis 1330
agccaucgccgacg

SEQ ID NO: 2472993 - RNA, 15 nt, Brucella suis 1330
agccaucuuucuuga

SEQ ID NO: 2472994 - RNA, 15 nt, Brucella suis 1330
agcccaaagcgguuu

SEQ ID NO: 2472995 - RNA, 19 nt, Brucella suis 1330
agcccaagaaagaucagcc

SEQ ID NO: 2472996 - RNA, 19 nt, Brucella suis 1330
agcccacggucgagugcgg

SEQ ID NO: 2472997 - RNA, 14 nt, Brucella suis 1330
agcccagaaaucca

SEQ ID NO: 2472998 - RNA, 15 nt, Brucella suis 1330
agcccagcgccuuca

SEQ ID NO: 2472999 - RNA, 21 nt, Brucella suis 1330
agcccaugacagcaaccgaaa

SEQ ID NO: 2473000 - RNA, 12 nt, Brucella suis 1330
agccccagcccg

SEQ ID NO: 2473001 - RNA, 17 nt, Brucella suis 1330
agccccaggaacggcag

SEQ ID NO: 2473002 - RNA, 19 nt, Brucella suis 1330
agcccccagaugaagguaa

SEQ ID NO: 2473003 - RNA, 19 nt, Brucella suis 1330
agccccuugccccggcacc

SEQ ID NO: 2473004 - RNA, 22 nt, Brucella suis 1330
agccccuugccccggcaccgcg

SEQ ID NO: 2473005 - RNA, 20 nt, Brucella suis 1330
agcccgccacgaggaagaaa

SEQ ID NO: 2473006 - RNA, 23 nt, Brucella suis 1330
agcccgccgaaagccucgaucac

SEQ ID NO: 2473007 - RNA, 19 nt, Brucella suis 1330
agcccgcugcgccgcacgc

SEQ ID NO: 2473008 - RNA, 14 nt, Brucella suis 1330
agcccggacaggcg

SEQ ID NO: 2473009 - RNA, 22 nt, Brucella suis 1330
agcccggaugaaccgggcccuu

SEQ ID NO: 2473010 - RNA, 23 nt, Brucella suis 1330
agcccggaugaaccgggcccuuc

SEQ ID NO: 2473011 - RNA, 22 nt, Brucella suis 1330
agcccggcuggaauuguuccag

SEQ ID NO: 2473012 - RNA, 15 nt, Brucella suis 1330
agcccugucagcgcc

SEQ ID NO: 2473013 - RNA, 16 nt, Brucella suis 1330
agcccuucaucaagcu

SEQ ID NO: 2473014 - RNA, 16 nt, Brucella suis 1330
agcccuuccacugcaa

SEQ ID NO: 2473015 - RNA, 22 nt, Brucella suis 1330
agccgaaagcacguccuuggca

SEQ ID NO: 2473016 - RNA, 22 nt, Brucella suis 1330
agccgaagggaaugggaucgac

SEQ ID NO: 2473017 - RNA, 20 nt, Brucella suis 1330
agccgacauaggcgaucacc

SEQ ID NO: 2473018 - RNA, 16 nt, Brucella suis 1330
agccgaugcagaugcc

SEQ ID NO: 2473019 - RNA, 18 nt, Brucella suis 1330
agccgccaagccagcccg

SEQ ID NO: 2473020 - RNA, 21 nt, Brucella suis 1330
agccgccaagccagcccguga

SEQ ID NO: 2473021 - RNA, 20 nt, Brucella suis 1330
agccgccauaccgucgagga

SEQ ID NO: 2473022 - RNA, 22 nt, Brucella suis 1330
agccgccauaccgucgaggaaa

SEQ ID NO: 2473023 - RNA, 22 nt, Brucella suis 1330
agccgccccgcugaggcggccg

SEQ ID NO: 2473024 - RNA, 16 nt, Brucella suis 1330
agccgcccgccuugga

SEQ ID NO: 2473025 - RNA, 15 nt, Brucella suis 1330
agccgccucaauggu

SEQ ID NO: 2473026 - RNA, 20 nt, Brucella suis 1330
agccgcgaucacagccgcgc

SEQ ID NO: 2473027 - RNA, 16 nt, Brucella suis 1330
agccgcgccaauccag

SEQ ID NO: 2473028 - RNA, 18 nt, Brucella suis 1330
agccgcggcgcgaccugc

SEQ ID NO: 2473029 - RNA, 21 nt, Brucella suis 1330
agccggccacgaaaugggggc

SEQ ID NO: 2473030 - RNA, 21 nt, Brucella suis 1330
agccggcgauaccagacgcgc

SEQ ID NO: 2473031 - RNA, 20 nt, Brucella suis 1330
agccgggauucaaucagauc

SEQ ID NO: 2473032 - RNA, 19 nt, Brucella suis 1330
agccgguaauauugaagcc

SEQ ID NO: 2473033 - RNA, 17 nt, Brucella suis 1330
agccgguagccuuuuug

SEQ ID NO: 2473034 - RNA, 16 nt, Brucella suis 1330
agccgguauccagcag

SEQ ID NO: 2473035 - RNA, 17 nt, Brucella suis 1330
agccggucgagccgaca

SEQ ID NO: 2473036 - RNA, 14 nt, Brucella suis 1330
agccggucugucau

SEQ ID NO: 2473037 - RNA, 17 nt, Brucella suis 1330
agccggucugucauuug

SEQ ID NO: 2473038 - RNA, 16 nt, Brucella suis 1330
agccgucuauuugcac

SEQ ID NO: 2473039 - RNA, 13 nt, Brucella suis 1330
agccgugacagaa

SEQ ID NO: 2473040 - RNA, 16 nt, Brucella suis 1330
agccgugagcauggca

SEQ ID NO: 2473041 - RNA, 14 nt, Brucella suis 1330
agccguuccagggc

SEQ ID NO: 2473042 - RNA, 17 nt, Brucella suis 1330
agccguuccagggcgcg

SEQ ID NO: 2473043 - RNA, 13 nt, Brucella suis 1330
agccuauaucgcg

SEQ ID NO: 2473044 - RNA, 14 nt, Brucella suis 1330
agccucaucggcgg

SEQ ID NO: 2473045 - RNA, 23 nt, Brucella suis 1330
agccugcaccggcccaaaggccg

SEQ ID NO: 2473046 - RNA, 15 nt, Brucella suis 1330
agccuguccuuguuc

SEQ ID NO: 2473047 - RNA, 22 nt, Brucella suis 1330
agccuucauugcggccaagcgc

SEQ ID NO: 2473048 - RNA, 21 nt, Brucella suis 1330
agccuugagcauauucagggc

SEQ ID NO: 2473049 - RNA, 15 nt, Brucella suis 1330
agccuugcccuggcu

SEQ ID NO: 2473050 - RNA, 18 nt, Brucella suis 1330
agccuugcccuggcucuu

SEQ ID NO: 2473051 - RNA, 12 nt, Brucella suis 1330
agccuuggcccu

SEQ ID NO: 2473052 - RNA, 20 nt, Brucella suis 1330
agccuuucaaugucgccgga

SEQ ID NO: 2473053 - RNA, 22 nt, Brucella suis 1330
agccuuuuugacgcaaaagcuc

SEQ ID NO: 2473054 - RNA, 16 nt, Brucella suis 1330
agcgaauagaccaugc

SEQ ID NO: 2473055 - RNA, 21 nt, Brucella suis 1330
agcgaauagaccaugccgcca

SEQ ID NO: 2473056 - RNA, 21 nt, Brucella suis 1330
agcgaauggcaauuuccagau

SEQ ID NO: 2473057 - RNA, 15 nt, Brucella suis 1330
agcgacagcggcgcg

SEQ ID NO: 2473058 - RNA, 19 nt, Brucella suis 1330
agcgacaggguaagcgccu

SEQ ID NO: 2473059 - RNA, 21 nt, Brucella suis 1330
agcgacaggguaagcgccuuu

SEQ ID NO: 2473060 - RNA, 14 nt, Brucella suis 1330
agcgacuuccagug

SEQ ID NO: 2473061 - RNA, 19 nt, Brucella suis 1330
agcgagcgcacauaaaacg

SEQ ID NO: 2473062 - RNA, 18 nt, Brucella suis 1330
agcgaggggaaacugcgg

SEQ ID NO: 2473063 - RNA, 15 nt, Brucella suis 1330
agcgaucgucuugca

SEQ ID NO: 2473064 - RNA, 13 nt, Brucella suis 1330
agcgcaaagcuuu

SEQ ID NO: 2473065 - RNA, 16 nt, Brucella suis 1330
agcgcaagaaggcguu

SEQ ID NO: 2473066 - RNA, 21 nt, Brucella suis 1330
agcgcaauaucggcgaugccc

SEQ ID NO: 2473067 - RNA, 20 nt, Brucella suis 1330
agcgcagccugguagcgcac

SEQ ID NO: 2473068 - RNA, 15 nt, Brucella suis 1330
agcgcaguucgcgca

SEQ ID NO: 2473069 - RNA, 16 nt, Brucella suis 1330
agcgcauaaaggccga

SEQ ID NO: 2473070 - RNA, 18 nt, Brucella suis 1330
agcgcauaaaggccgaaa

SEQ ID NO: 2473071 - RNA, 14 nt, Brucella suis 1330
agcgcauccagccg

SEQ ID NO: 2473072 - RNA, 16 nt, Brucella suis 1330
agcgcauccagccggc

SEQ ID NO: 2473073 - RNA, 13 nt, Brucella suis 1330
agcgcauccgccu

SEQ ID NO: 2473074 - RNA, 23 nt, Brucella suis 1330
agcgcauccgccugcgcauggga

SEQ ID NO: 2473075 - RNA, 22 nt, Brucella suis 1330
agcgcaucgacaaucuccccuu

SEQ ID NO: 2473076 - RNA, 13 nt, Brucella suis 1330
agcgcaucgccac

SEQ ID NO: 2473077 - RNA, 13 nt, Brucella suis 1330
agcgcaucggcca

SEQ ID NO: 2473078 - RNA, 20 nt, Brucella suis 1330
agcgcaucgguggcauugcc

SEQ ID NO: 2473079 - RNA, 20 nt, Brucella suis 1330
agcgcauuggcgaccgaaug

SEQ ID NO: 2473080 - RNA, 22 nt, Brucella suis 1330
agcgcauuuucauugccgggcg

SEQ ID NO: 2473081 - RNA, 13 nt, Brucella suis 1330
agcgccagaaaga

SEQ ID NO: 2473082 - RNA, 17 nt, Brucella suis 1330
agcgccagauaaagcag

SEQ ID NO: 2473083 - RNA, 22 nt, Brucella suis 1330
agcgccagaucgauggugcgga

SEQ ID NO: 2473084 - RNA, 22 nt, Brucella suis 1330
agcgcccuugccggauaucgcc

SEQ ID NO: 2473085 - RNA, 20 nt, Brucella suis 1330
agcgccgaggcgcagguccg

SEQ ID NO: 2473086 - RNA, 12 nt, Brucella suis 1330
agcgccgauacc

SEQ ID NO: 2473087 - RNA, 16 nt, Brucella suis 1330
agcgccgaugcgggga

SEQ ID NO: 2473088 - RNA, 11 nt, Brucella suis 1330
agcgccgccgc

SEQ ID NO: 2473089 - RNA, 23 nt, Brucella suis 1330
agcgccuacgcagggaaaucagu

SEQ ID NO: 2473090 - RNA, 14 nt, Brucella suis 1330
agcgccuucagcgu

SEQ ID NO: 2473091 - RNA, 17 nt, Brucella suis 1330
agcgccuuugccgcgcg

SEQ ID NO: 2473092 - RNA, 17 nt, Brucella suis 1330
agcgccuuugcggggga

SEQ ID NO: 2473093 - RNA, 21 nt, Brucella suis 1330
agcgccuuugcgggggaaugu

SEQ ID NO: 2473094 - RNA, 20 nt, Brucella suis 1330
agcgcgaacaugccugccgc

SEQ ID NO: 2473095 - RNA, 21 nt, Brucella suis 1330
agcgcgaacaugccugccgca

SEQ ID NO: 2473096 - RNA, 20 nt, Brucella suis 1330
agcgcgcaccgauggagcgc

SEQ ID NO: 2473097 - RNA, 14 nt, Brucella suis 1330
agcgcgccaucggc

SEQ ID NO: 2473098 - RNA, 16 nt, Brucella suis 1330
agcgcgccaucggcac

SEQ ID NO: 2473099 - RNA, 20 nt, Brucella suis 1330
agcgcgccgaaaaucggcac

SEQ ID NO: 2473100 - RNA, 23 nt, Brucella suis 1330
agcgcgccggucuucauggcuug

SEQ ID NO: 2473101 - RNA, 18 nt, Brucella suis 1330
agcgcgcgugagcgcgca

SEQ ID NO: 2473102 - RNA, 21 nt, Brucella suis 1330
agcgcggagcaacaccccgcg

SEQ ID NO: 2473103 - RNA, 22 nt, Brucella suis 1330
agcgcggagcaacaccccgcgc

SEQ ID NO: 2473104 - RNA, 17 nt, Brucella suis 1330
agcgcucagcuuuucca

SEQ ID NO: 2473105 - RNA, 15 nt, Brucella suis 1330
agcgcucgcggcugg

SEQ ID NO: 2473106 - RNA, 14 nt, Brucella suis 1330
agcgcugucagccg

SEQ ID NO: 2473107 - RNA, 15 nt, Brucella suis 1330
agcggaucagcgcgc

SEQ ID NO: 2473108 - RNA, 23 nt, Brucella suis 1330
agcggaucauccuugaugcccag

SEQ ID NO: 2473109 - RNA, 18 nt, Brucella suis 1330
agcggaucgugagguucu

SEQ ID NO: 2473110 - RNA, 20 nt, Brucella suis 1330
agcggaucgugagguucuug

SEQ ID NO: 2473111 - RNA, 14 nt, Brucella suis 1330
agcggcaaaggccg

SEQ ID NO: 2473112 - RNA, 16 nt, Brucella suis 1330
agcggcaccucgcugg

SEQ ID NO: 2473113 - RNA, 15 nt, Brucella suis 1330
agcggcacgccgccc

SEQ ID NO: 2473114 - RNA, 16 nt, Brucella suis 1330
agcggcacgccgccca

SEQ ID NO: 2473115 - RNA, 13 nt, Brucella suis 1330
agcggcagaccug

SEQ ID NO: 2473116 - RNA, 14 nt, Brucella suis 1330
agcggcagcagcca

SEQ ID NO: 2473117 - RNA, 22 nt, Brucella suis 1330
agcggcagcggcgugccgggcg

SEQ ID NO: 2473118 - RNA, 20 nt, Brucella suis 1330
agcggcaggagccggaaaau

SEQ ID NO: 2473119 - RNA, 16 nt, Brucella suis 1330
agcggcaggccgaagg

SEQ ID NO: 2473120 - RNA, 17 nt, Brucella suis 1330
agcggcaggccgcaaag

SEQ ID NO: 2473121 - RNA, 20 nt, Brucella suis 1330
agcggcaucaucgucggcca

SEQ ID NO: 2473122 - RNA, 22 nt, Brucella suis 1330
agcggccaucuuccaguuccga

SEQ ID NO: 2473123 - RNA, 13 nt, Brucella suis 1330
agcggcgacggcg

SEQ ID NO: 2473124 - RNA, 16 nt, Brucella suis 1330
agcggcgaguugccac

SEQ ID NO: 2473125 - RNA, 17 nt, Brucella suis 1330
agcggcgucaggccaaa

SEQ ID NO: 2473126 - RNA, 16 nt, Brucella suis 1330
agcggcuccaacgauu

SEQ ID NO: 2473127 - RNA, 16 nt, Brucella suis 1330
agcggcucucaaaaag

SEQ ID NO: 2473128 - RNA, 14 nt, Brucella suis 1330
agcgggcaauagaa

SEQ ID NO: 2473129 - RNA, 22 nt, Brucella suis 1330
agcggucacagaagcaagcacu

SEQ ID NO: 2473130 - RNA, 20 nt, Brucella suis 1330
agcgguuccugauugaagac

SEQ ID NO: 2473131 - RNA, 22 nt, Brucella suis 1330
agcgguuccuguuuuaacacaa

SEQ ID NO: 2473132 - RNA, 22 nt, Brucella suis 1330
agcgguuucgguuaugccggaa

SEQ ID NO: 2473133 - RNA, 19 nt, Brucella suis 1330
agcguacaccgaccagcgc

SEQ ID NO: 2473134 - RNA, 20 nt, Brucella suis 1330
agcguauugccguugagaau

SEQ ID NO: 2473135 - RNA, 23 nt, Brucella suis 1330
agcguauuuucgagccaaaagug

SEQ ID NO: 2473136 - RNA, 22 nt, Brucella suis 1330
agcgucuguacauacaugauga

SEQ ID NO: 2473137 - RNA, 16 nt, Brucella suis 1330
agcgucuucugagaaa

SEQ ID NO: 2473138 - RNA, 23 nt, Brucella suis 1330
agcgucuugcgcuccaccagcau

SEQ ID NO: 2473139 - RNA, 19 nt, Brucella suis 1330
agcgugaccagccccugca

SEQ ID NO: 2473140 - RNA, 16 nt, Brucella suis 1330
agcgugagaccagcgc

SEQ ID NO: 2473141 - RNA, 20 nt, Brucella suis 1330
agcgugaugaugcuugccuc

SEQ ID NO: 2473142 - RNA, 14 nt, Brucella suis 1330
agcgugccguguag

SEQ ID NO: 2473143 - RNA, 15 nt, Brucella suis 1330
agcgugcgauaaaua

SEQ ID NO: 2473144 - RNA, 16 nt, Brucella suis 1330
agcgugucuugcccag

SEQ ID NO: 2473145 - RNA, 16 nt, Brucella suis 1330
agcguugcaucggcgg

SEQ ID NO: 2473146 - RNA, 18 nt, Brucella suis 1330
agcguuuugucauggccg

SEQ ID NO: 2473147 - RNA, 19 nt, Brucella suis 1330
agcguuuugucauggccgg

SEQ ID NO: 2473148 - RNA, 20 nt, Brucella suis 1330
agcuacgccggaagaaugcu

SEQ ID NO: 2473149 - RNA, 17 nt, Brucella suis 1330
agcucgccauccuugaa

SEQ ID NO: 2473150 - RNA, 22 nt, Brucella suis 1330
agcucgccauccuugaacauca

SEQ ID NO: 2473151 - RNA, 17 nt, Brucella suis 1330
agcucgcguuccagccg

SEQ ID NO: 2473152 - RNA, 22 nt, Brucella suis 1330
agcucggacaaugcuccgggcu

SEQ ID NO: 2473153 - RNA, 20 nt, Brucella suis 1330
agcugcaagggaaugcgcuu

SEQ ID NO: 2473154 - RNA, 18 nt, Brucella suis 1330
agcugcauccagcgguga

SEQ ID NO: 2473155 - RNA, 13 nt, Brucella suis 1330
agcugccgcaaca

SEQ ID NO: 2473156 - RNA, 21 nt, Brucella suis 1330
agcugccgcggcucucacgcg

SEQ ID NO: 2473157 - RNA, 14 nt, Brucella suis 1330
agcugcugggugaa

SEQ ID NO: 2473158 - RNA, 16 nt, Brucella suis 1330
agcuggaaggccaggc

SEQ ID NO: 2473159 - RNA, 12 nt, Brucella suis 1330
agcuggcaucca

SEQ ID NO: 2473160 - RNA, 19 nt, Brucella suis 1330
agcugguugcgcggccagc

SEQ ID NO: 2473161 - RNA, 14 nt, Brucella suis 1330
agcuguguggccuu

SEQ ID NO: 2473162 - RNA, 14 nt, Brucella suis 1330
agcuguugcagccg

SEQ ID NO: 2473163 - RNA, 20 nt, Brucella suis 1330
agcuguuugcgauugaggcc

SEQ ID NO: 2473164 - RNA, 16 nt, Brucella suis 1330
agcuucaggucggcau

SEQ ID NO: 2473165 - RNA, 12 nt, Brucella suis 1330
agcuucggaaga

SEQ ID NO: 2473166 - RNA, 13 nt, Brucella suis 1330
agcuucggaagaa

SEQ ID NO: 2473167 - RNA, 13 nt, Brucella suis 1330
agcuugcaaugag

SEQ ID NO: 2473168 - RNA, 16 nt, Brucella suis 1330
agcuugcaaugagcgc

SEQ ID NO: 2473169 - RNA, 14 nt, Brucella suis 1330
agcuugcccgucac

SEQ ID NO: 2473170 - RNA, 21 nt, Brucella suis 1330
agcuugccgccaauccccuca

SEQ ID NO: 2473171 - RNA, 24 nt, Brucella suis 1330
agcuugccgccaauccccucaccu

SEQ ID NO: 2473172 - RNA, 18 nt, Brucella suis 1330
agcuugcgcagcgccgca

SEQ ID NO: 2473173 - RNA, 18 nt, Brucella suis 1330
agcuuucacucuccagau

SEQ ID NO: 2473174 - RNA, 14 nt, Brucella suis 1330
agcuuugcaccgcg

SEQ ID NO: 2473175 - RNA, 16 nt, Brucella suis 1330
agcuuugcaccgcgcc

SEQ ID NO: 2473176 - RNA, 13 nt, Brucella suis 1330
agcuuuucacgcg

SEQ ID NO: 2473177 - RNA, 14 nt, Brucella suis 1330
agcuuuugcagccg

SEQ ID NO: 2473178 - RNA, 19 nt, Brucella suis 1330
agcuuuuuucgauugaaaa

SEQ ID NO: 2473179 - RNA, 22 nt, Brucella suis 1330
aggaaaaaaccggcgaugaggg

SEQ ID NO: 2473180 - RNA, 10 nt, Brucella suis 1330
aggaaaaagc

SEQ ID NO: 2473181 - RNA, 20 nt, Brucella suis 1330
aggaaauugacgccauugac

SEQ ID NO: 2473182 - RNA, 14 nt, Brucella suis 1330
aggaacgccgccgg

SEQ ID NO: 2473183 - RNA, 13 nt, Brucella suis 1330
aggaacgcggccu

SEQ ID NO: 2473184 - RNA, 14 nt, Brucella suis 1330
aggaagggaaagcg

SEQ ID NO: 2473185 - RNA, 16 nt, Brucella suis 1330
aggaagguuuccggua

SEQ ID NO: 2473186 - RNA, 14 nt, Brucella suis 1330
aggaaguggaagca

SEQ ID NO: 2473187 - RNA, 13 nt, Brucella suis 1330
aggaaucagcaag

SEQ ID NO: 2473188 - RNA, 14 nt, Brucella suis 1330
aggaaucagcaagu

SEQ ID NO: 2473189 - RNA, 15 nt, Brucella suis 1330
aggaaugggcgggga

SEQ ID NO: 2473190 - RNA, 16 nt, Brucella suis 1330
aggacaacgggugcgc

SEQ ID NO: 2473191 - RNA, 17 nt, Brucella suis 1330
aggaccggcgaaaaggc

SEQ ID NO: 2473192 - RNA, 21 nt, Brucella suis 1330
aggacgaaccccgcaucauga

SEQ ID NO: 2473193 - RNA, 14 nt, Brucella suis 1330
aggagccggaaaau

SEQ ID NO: 2473194 - RNA, 13 nt, Brucella suis 1330
aggagcggaagca

SEQ ID NO: 2473195 - RNA, 21 nt, Brucella suis 1330
aggauaaccuucuggaaaagu

SEQ ID NO: 2473196 - RNA, 17 nt, Brucella suis 1330
aggauagcguaaaacgc

SEQ ID NO: 2473197 - RNA, 16 nt, Brucella suis 1330
aggaucagggccacuc

SEQ ID NO: 2473198 - RNA, 14 nt, Brucella suis 1330
aggaucgaagggcu

SEQ ID NO: 2473199 - RNA, 19 nt, Brucella suis 1330
aggaucgccagaagcguaa

SEQ ID NO: 2473200 - RNA, 17 nt, Brucella suis 1330
aggaugagggagagaac

SEQ ID NO: 2473201 - RNA, 21 nt, Brucella suis 1330
aggaugagggagagaacacag

SEQ ID NO: 2473202 - RNA, 14 nt, Brucella suis 1330
aggaugaucggcga

SEQ ID NO: 2473203 - RNA, 22 nt, Brucella suis 1330
aggaugugagcgaauaugcggg

SEQ ID NO: 2473204 - RNA, 12 nt, Brucella suis 1330
aggcaaagcgga

SEQ ID NO: 2473205 - RNA, 20 nt, Brucella suis 1330
aggcaaauguuggaaucaga

SEQ ID NO: 2473206 - RNA, 15 nt, Brucella suis 1330
aggcaagccccagca

SEQ ID NO: 2473207 - RNA, 23 nt, Brucella suis 1330
aggcacccuugguugcgcgccag

SEQ ID NO: 2473208 - RNA, 16 nt, Brucella suis 1330
aggcacucuccucugc

SEQ ID NO: 2473209 - RNA, 17 nt, Brucella suis 1330
aggcagacggacuucuu

SEQ ID NO: 2473210 - RNA, 16 nt, Brucella suis 1330
aggcagcaugaaccaa

SEQ ID NO: 2473211 - RNA, 20 nt, Brucella suis 1330
aggcagccgugagcauggca

SEQ ID NO: 2473212 - RNA, 18 nt, Brucella suis 1330
aggcagcgcgguuuuugc

SEQ ID NO: 2473213 - RNA, 22 nt, Brucella suis 1330
aggcagggaggagccgauaugc

SEQ ID NO: 2473214 - RNA, 18 nt, Brucella suis 1330
aggcauaguggcggggug

SEQ ID NO: 2473215 - RNA, 16 nt, Brucella suis 1330
aggcauuuuccuuucu

SEQ ID NO: 2473216 - RNA, 15 nt, Brucella suis 1330
aggccaaaaagcgua

SEQ ID NO: 2473217 - RNA, 22 nt, Brucella suis 1330
aggccaccguuucggguggccu

SEQ ID NO: 2473218 - RNA, 20 nt, Brucella suis 1330
aggccacgcacggucuugcc

SEQ ID NO: 2473219 - RNA, 13 nt, Brucella suis 1330
aggcccaggccuu

SEQ ID NO: 2473220 - RNA, 11 nt, Brucella suis 1330
aggcccauugg

SEQ ID NO: 2473221 - RNA, 17 nt, Brucella suis 1330
aggcccccuguuucugc

SEQ ID NO: 2473222 - RNA, 13 nt, Brucella suis 1330
aggcccgccucga

SEQ ID NO: 2473223 - RNA, 23 nt, Brucella suis 1330
aggcccgccucgaccgcaacagg

SEQ ID NO: 2473224 - RNA, 22 nt, Brucella suis 1330
aggccgagcgcaucggccagcu

SEQ ID NO: 2473225 - RNA, 20 nt, Brucella suis 1330
aggccgaugaugaucgucag

SEQ ID NO: 2473226 - RNA, 18 nt, Brucella suis 1330
aggccgauggcgaucacg

SEQ ID NO: 2473227 - RNA, 12 nt, Brucella suis 1330
aggccgcgccga

SEQ ID NO: 2473228 - RNA, 20 nt, Brucella suis 1330
aggccgcgcuccagaucgug

SEQ ID NO: 2473229 - RNA, 15 nt, Brucella suis 1330
aggccgggcuuugga

SEQ ID NO: 2473230 - RNA, 13 nt, Brucella suis 1330
aggccggguuuuu

SEQ ID NO: 2473231 - RNA, 16 nt, Brucella suis 1330
aggccgguaagcccug

SEQ ID NO: 2473232 - RNA, 17 nt, Brucella suis 1330
aggccgguaagcccugu

SEQ ID NO: 2473233 - RNA, 19 nt, Brucella suis 1330
aggccgguaauaacuuccg

SEQ ID NO: 2473234 - RNA, 16 nt, Brucella suis 1330
aggccucugccuccau

SEQ ID NO: 2473235 - RNA, 19 nt, Brucella suis 1330
aggccucugccuccauggc

SEQ ID NO: 2473236 - RNA, 18 nt, Brucella suis 1330
aggccuuccgcgucggaa

SEQ ID NO: 2473237 - RNA, 18 nt, Brucella suis 1330
aggcgaagccgaagaaca

SEQ ID NO: 2473238 - RNA, 23 nt, Brucella suis 1330
aggcgaauggauugcgggcauga

SEQ ID NO: 2473239 - RNA, 22 nt, Brucella suis 1330
aggcgacgagaccugccaucac

SEQ ID NO: 2473240 - RNA, 22 nt, Brucella suis 1330
aggcgagaugccgugggcaaga

SEQ ID NO: 2473241 - RNA, 17 nt, Brucella suis 1330
aggcgagcauggaucgc

SEQ ID NO: 2473242 - RNA, 21 nt, Brucella suis 1330
aggcgauauggcccagaaccu

SEQ ID NO: 2473243 - RNA, 23 nt, Brucella suis 1330
aggcgaucagguugaugccgggc

SEQ ID NO: 2473244 - RNA, 23 nt, Brucella suis 1330
aggcgauuuaaaacuuaauugcu

SEQ ID NO: 2473245 - RNA, 14 nt, Brucella suis 1330
aggcgcaggcccug

SEQ ID NO: 2473246 - RNA, 19 nt, Brucella suis 1330
aggcgcgaggcggcugcgg

SEQ ID NO: 2473247 - RNA, 21 nt, Brucella suis 1330
aggcgcggcguggaaagcugg

SEQ ID NO: 2473248 - RNA, 13 nt, Brucella suis 1330
aggcgcucuuucc

SEQ ID NO: 2473249 - RNA, 21 nt, Brucella suis 1330
aggcgcuuuuucacgcgggcg

SEQ ID NO: 2473250 - RNA, 17 nt, Brucella suis 1330
aggcggauuuccugccu

SEQ ID NO: 2473251 - RNA, 19 nt, Brucella suis 1330
aggcggcgcauucggccgc

SEQ ID NO: 2473252 - RNA, 14 nt, Brucella suis 1330
aggcgggaaggcaa

SEQ ID NO: 2473253 - RNA, 17 nt, Brucella suis 1330
aggcguucccagacaug

SEQ ID NO: 2473254 - RNA, 13 nt, Brucella suis 1330
aggcguuccgccu

SEQ ID NO: 2473255 - RNA, 18 nt, Brucella suis 1330
aggcguugaugacgaaaa

SEQ ID NO: 2473256 - RNA, 23 nt, Brucella suis 1330
aggcuccguugcuuuauccgcaa

SEQ ID NO: 2473257 - RNA, 17 nt, Brucella suis 1330
aggcucgggcagcuugu

SEQ ID NO: 2473258 - RNA, 15 nt, Brucella suis 1330
aggcugaguuuuccg

SEQ ID NO: 2473259 - RNA, 22 nt, Brucella suis 1330
aggcugaguuuuccgcuuucuu

SEQ ID NO: 2473260 - RNA, 17 nt, Brucella suis 1330
aggcugucgaaugucuu

SEQ ID NO: 2473261 - RNA, 19 nt, Brucella suis 1330
aggcuuccgaaucgcuguu

SEQ ID NO: 2473262 - RNA, 23 nt, Brucella suis 1330
aggcuucgcuucgcuccgcaccu

SEQ ID NO: 2473263 - RNA, 19 nt, Brucella suis 1330
aggcuuucagcgcagugga

SEQ ID NO: 2473264 - RNA, 22 nt, Brucella suis 1330
agggaaacacucugccugcccu

SEQ ID NO: 2473265 - RNA, 21 nt, Brucella suis 1330
agggaaagcgggccugugcuu

SEQ ID NO: 2473266 - RNA, 20 nt, Brucella suis 1330
agggaggcaucagccucccu

SEQ ID NO: 2473267 - RNA, 18 nt, Brucella suis 1330
agggcaauuggcccccaa

SEQ ID NO: 2473268 - RNA, 23 nt, Brucella suis 1330
agggcagaucuguaucccgaaaa

SEQ ID NO: 2473269 - RNA, 21 nt, Brucella suis 1330
agggcagcggucacagaagca

SEQ ID NO: 2473270 - RNA, 12 nt, Brucella suis 1330
agggcagcuucg

SEQ ID NO: 2473271 - RNA, 13 nt, Brucella suis 1330
agggcaguagggc

SEQ ID NO: 2473272 - RNA, 15 nt, Brucella suis 1330
agggcaguagggcag

SEQ ID NO: 2473273 - RNA, 17 nt, Brucella suis 1330
agggcaguagggcagua

SEQ ID NO: 2473274 - RNA, 22 nt, Brucella suis 1330
agggcaguagggcaguagggca

SEQ ID NO: 2473275 - RNA, 18 nt, Brucella suis 1330
agggccgcaucggaaggg

SEQ ID NO: 2473276 - RNA, 15 nt, Brucella suis 1330
agggccgugaccagc

SEQ ID NO: 2473277 - RNA, 22 nt, Brucella suis 1330
agggccuggccgauuuccgcuu

SEQ ID NO: 2473278 - RNA, 19 nt, Brucella suis 1330
agggcgcgccaguaggccc

SEQ ID NO: 2473279 - RNA, 20 nt, Brucella suis 1330
agggcgcugcgaaggcccuu

SEQ ID NO: 2473280 - RNA, 21 nt, Brucella suis 1330
agggcgggcaugggcaccugg

SEQ ID NO: 2473281 - RNA, 17 nt, Brucella suis 1330
agggcgggcggccagga

SEQ ID NO: 2473282 - RNA, 21 nt, Brucella suis 1330
agggcgguugcacgcacaucg

SEQ ID NO: 2473283 - RNA, 15 nt, Brucella suis 1330
agggcguagauagcg

SEQ ID NO: 2473284 - RNA, 19 nt, Brucella suis 1330
aggggaugggggccgggcg

SEQ ID NO: 2473285 - RNA, 15 nt, Brucella suis 1330
aggggcagcgcgcgg

SEQ ID NO: 2473286 - RNA, 16 nt, Brucella suis 1330
aggggccaaggcccca

SEQ ID NO: 2473287 - RNA, 20 nt, Brucella suis 1330
agggucaaaauggccucaga

SEQ ID NO: 2473288 - RNA, 17 nt, Brucella suis 1330
agguauagauaucgagc

SEQ ID NO: 2473289 - RNA, 17 nt, Brucella suis 1330
aggucauaaugcaugga

SEQ ID NO: 2473290 - RNA, 16 nt, Brucella suis 1330
aggucgagaucgaccg

SEQ ID NO: 2473291 - RNA, 11 nt, Brucella suis 1330
aggucggcauu

SEQ ID NO: 2473292 - RNA, 21 nt, Brucella suis 1330
aggugacgcuauccacgcccu

SEQ ID NO: 2473293 - RNA, 20 nt, Brucella suis 1330
aggugagcggcaggccgcaa

SEQ ID NO: 2473294 - RNA, 14 nt, Brucella suis 1330
aggugccaucaagc

SEQ ID NO: 2473295 - RNA, 20 nt, Brucella suis 1330
aggugcgcggacgggcaggc

SEQ ID NO: 2473296 - RNA, 15 nt, Brucella suis 1330
agguguccuccagcc

SEQ ID NO: 2473297 - RNA, 13 nt, Brucella suis 1330
agguugagcugcu

SEQ ID NO: 2473298 - RNA, 21 nt, Brucella suis 1330
agguuugucaguagccugacc

SEQ ID NO: 2473299 - RNA, 17 nt, Brucella suis 1330
agguuuuucgguuuuca

SEQ ID NO: 2473300 - RNA, 15 nt, Brucella suis 1330
aguacggcgcgcuga

SEQ ID NO: 2473301 - RNA, 17 nt, Brucella suis 1330
aguacgguuauggcuca

SEQ ID NO: 2473302 - RNA, 16 nt, Brucella suis 1330
aguagcuucuggguga

SEQ ID NO: 2473303 - RNA, 17 nt, Brucella suis 1330
aguagcuucugggugag

SEQ ID NO: 2473304 - RNA, 17 nt, Brucella suis 1330
aguagggcaguagggca

SEQ ID NO: 2473305 - RNA, 20 nt, Brucella suis 1330
aguaucgucguccagcccug

SEQ ID NO: 2473306 - RNA, 22 nt, Brucella suis 1330
aguccagcuuuccgcaucgcaa

SEQ ID NO: 2473307 - RNA, 19 nt, Brucella suis 1330
aguccggcagcacgugccc

SEQ ID NO: 2473308 - RNA, 22 nt, Brucella suis 1330
aguccucggcaauccccggacc

SEQ ID NO: 2473309 - RNA, 23 nt, Brucella suis 1330
aguccuugcccucgaucccuauc

SEQ ID NO: 2473310 - RNA, 15 nt, Brucella suis 1330
agucgaauuucagca

SEQ ID NO: 2473311 - RNA, 22 nt, Brucella suis 1330
agucugaucgacgaggaagguu

SEQ ID NO: 2473312 - RNA, 20 nt, Brucella suis 1330
agucuggauuccuucaccac

SEQ ID NO: 2473313 - RNA, 20 nt, Brucella suis 1330
agugaaaccagcguggcuuu

SEQ ID NO: 2473314 - RNA, 17 nt, Brucella suis 1330
agugagcagaagaaagg

SEQ ID NO: 2473315 - RNA, 19 nt, Brucella suis 1330
agugagcagaagaaagggc

SEQ ID NO: 2473316 - RNA, 21 nt, Brucella suis 1330
agugcaaagcggcuuuccagc

SEQ ID NO: 2473317 - RNA, 13 nt, Brucella suis 1330
agugcaaucaggg

SEQ ID NO: 2473318 - RNA, 18 nt, Brucella suis 1330
agugcacggccaugaaga

SEQ ID NO: 2473319 - RNA, 15 nt, Brucella suis 1330
agugcauaaucggca

SEQ ID NO: 2473320 - RNA, 15 nt, Brucella suis 1330
agugccggaaacacg

SEQ ID NO: 2473321 - RNA, 23 nt, Brucella suis 1330
agugcgaagcgguuuugcguagg

SEQ ID NO: 2473322 - RNA, 17 nt, Brucella suis 1330
agugcgcacgccugccg

SEQ ID NO: 2473323 - RNA, 21 nt, Brucella suis 1330
agugcgcacgccugccgcgcg

SEQ ID NO: 2473324 - RNA, 22 nt, Brucella suis 1330
agugcgcacgccugccgcgcgg

SEQ ID NO: 2473325 - RNA, 22 nt, Brucella suis 1330
agugcgcagcaucugcgcgagg

SEQ ID NO: 2473326 - RNA, 19 nt, Brucella suis 1330
agugcgcgaauuccaugcg

SEQ ID NO: 2473327 - RNA, 21 nt, Brucella suis 1330
agugcggccugcacggcuuca

SEQ ID NO: 2473328 - RNA, 19 nt, Brucella suis 1330
agugcuuccucguccuuga

SEQ ID NO: 2473329 - RNA, 19 nt, Brucella suis 1330
aguggauuggauuugacgu

SEQ ID NO: 2473330 - RNA, 14 nt, Brucella suis 1330
aguggcagcaggca

SEQ ID NO: 2473331 - RNA, 15 nt, Brucella suis 1330
aguggccuucagcac

SEQ ID NO: 2473332 - RNA, 21 nt, Brucella suis 1330
aguggcgggguguacaacaac

SEQ ID NO: 2473333 - RNA, 23 nt, Brucella suis 1330
agugugaaacgccuacgcgggga

SEQ ID NO: 2473334 - RNA, 15 nt, Brucella suis 1330
agugugcgcgcgcca

SEQ ID NO: 2473335 - RNA, 23 nt, Brucella suis 1330
aguuauguuugguuuuagaagcu

SEQ ID NO: 2473336 - RNA, 14 nt, Brucella suis 1330
aguuccauugcaac

SEQ ID NO: 2473337 - RNA, 22 nt, Brucella suis 1330
aguuccguguugaaaaggauau

SEQ ID NO: 2473338 - RNA, 18 nt, Brucella suis 1330
aguuccugcuucaucgcg

SEQ ID NO: 2473339 - RNA, 15 nt, Brucella suis 1330
aguucguugugccag

SEQ ID NO: 2473340 - RNA, 20 nt, Brucella suis 1330
aguucguugugccagaaggu

SEQ ID NO: 2473341 - RNA, 18 nt, Brucella suis 1330
aguucugcgcggaaacca

SEQ ID NO: 2473342 - RNA, 21 nt, Brucella suis 1330
aguucuugucugucaccacau

SEQ ID NO: 2473343 - RNA, 19 nt, Brucella suis 1330
aguugacgaguuugccguc

SEQ ID NO: 2473344 - RNA, 16 nt, Brucella suis 1330
aguugcaccgcccgga

SEQ ID NO: 2473345 - RNA, 15 nt, Brucella suis 1330
aguugcuccagcccu

SEQ ID NO: 2473346 - RNA, 18 nt, Brucella suis 1330
aguugucaauacaccugc

SEQ ID NO: 2473347 - RNA, 15 nt, Brucella suis 1330
aguugucgccgggcu

SEQ ID NO: 2473348 - RNA, 21 nt, Brucella suis 1330
aguugucgccgggcugcuucu

SEQ ID NO: 2473349 - RNA, 15 nt, Brucella suis 1330
aguuucauuuccuca

SEQ ID NO: 2473350 - RNA, 15 nt, Brucella suis 1330
aguuuucaaaccaaa

SEQ ID NO: 2473351 - RNA, 22 nt, Brucella suis 1330
aguuuucaaaccaaaaaaccuc

SEQ ID NO: 2473352 - RNA, 16 nt, Brucella suis 1330
aguuuuugcaggucug

SEQ ID NO: 2473353 - RNA, 15 nt, Brucella suis 1330
auaaaaaggccgcuc

SEQ ID NO: 2473354 - RNA, 19 nt, Brucella suis 1330
auaaaaggcaaagccgaau

SEQ ID NO: 2473355 - RNA, 15 nt, Brucella suis 1330
auaaacgcaccaaga

SEQ ID NO: 2473356 - RNA, 21 nt, Brucella suis 1330
auaaacugaauccgcgacgcc

SEQ ID NO: 2473357 - RNA, 14 nt, Brucella suis 1330
auaaagaugcgcgc

SEQ ID NO: 2473358 - RNA, 16 nt, Brucella suis 1330
auaaagcguggcgaug

SEQ ID NO: 2473359 - RNA, 13 nt, Brucella suis 1330
auaaagcuugaac

SEQ ID NO: 2473360 - RNA, 19 nt, Brucella suis 1330
auaaauauucccgauagcc

SEQ ID NO: 2473361 - RNA, 20 nt, Brucella suis 1330
auaaccugcgcgaauagcga

SEQ ID NO: 2473362 - RNA, 20 nt, Brucella suis 1330
auaagccggcaugaaugugc

SEQ ID NO: 2473363 - RNA, 11 nt, Brucella suis 1330
auaagcggcaa

SEQ ID NO: 2473364 - RNA, 17 nt, Brucella suis 1330
auaaggcggaugcgcgg

SEQ ID NO: 2473365 - RNA, 22 nt, Brucella suis 1330
auaauauucagcgaaccugauc

SEQ ID NO: 2473366 - RNA, 20 nt, Brucella suis 1330
auaaucagcagaaggaugau

SEQ ID NO: 2473367 - RNA, 22 nt, Brucella suis 1330
auaaucagccucguaaagaucg

SEQ ID NO: 2473368 - RNA, 20 nt, Brucella suis 1330
auaaucuuuuugcaggaaau

SEQ ID NO: 2473369 - RNA, 17 nt, Brucella suis 1330
auaaugcgacaaaacaa

SEQ ID NO: 2473370 - RNA, 21 nt, Brucella suis 1330
auaauucagcuuuacugccgg

SEQ ID NO: 2473371 - RNA, 16 nt, Brucella suis 1330
auacaccaaugcaggc

SEQ ID NO: 2473372 - RNA, 18 nt, Brucella suis 1330
auacagcccaugacagca

SEQ ID NO: 2473373 - RNA, 23 nt, Brucella suis 1330
auacaugcuuucgacaaaggccc

SEQ ID NO: 2473374 - RNA, 13 nt, Brucella suis 1330
auaccgacggucg

SEQ ID NO: 2473375 - RNA, 20 nt, Brucella suis 1330
auaccgguacuggccaagcg

SEQ ID NO: 2473376 - RNA, 16 nt, Brucella suis 1330
auacgaccaacccuuu

SEQ ID NO: 2473377 - RNA, 12 nt, Brucella suis 1330
auacgccccgug

SEQ ID NO: 2473378 - RNA, 16 nt, Brucella suis 1330
auacgccccgugaucu

SEQ ID NO: 2473379 - RNA, 20 nt, Brucella suis 1330
auacguaaaaaggccgcgcg

SEQ ID NO: 2473380 - RNA, 22 nt, Brucella suis 1330
auacgucacccgccuugcagau

SEQ ID NO: 2473381 - RNA, 16 nt, Brucella suis 1330
auacgugcaagagcaa

SEQ ID NO: 2473382 - RNA, 20 nt, Brucella suis 1330
auacuccccuacucccuuau

SEQ ID NO: 2473383 - RNA, 18 nt, Brucella suis 1330
auacugccuuacugcccu

SEQ ID NO: 2473384 - RNA, 17 nt, Brucella suis 1330
auacuuguaaggugaug

SEQ ID NO: 2473385 - RNA, 23 nt, Brucella suis 1330
auagaauaaagccauauuuuguu

SEQ ID NO: 2473386 - RNA, 13 nt, Brucella suis 1330
auagacauauugc

SEQ ID NO: 2473387 - RNA, 19 nt, Brucella suis 1330
auagacaugcggcaguccg

SEQ ID NO: 2473388 - RNA, 14 nt, Brucella suis 1330
auagaccaugacgc

SEQ ID NO: 2473389 - RNA, 18 nt, Brucella suis 1330
auagacuucagccagaau

SEQ ID NO: 2473390 - RNA, 11 nt, Brucella suis 1330
auagagcagca

SEQ ID NO: 2473391 - RNA, 15 nt, Brucella suis 1330
auagagccacgagaa

SEQ ID NO: 2473392 - RNA, 21 nt, Brucella suis 1330
auagagcgccgaucugauuga

SEQ ID NO: 2473393 - RNA, 23 nt, Brucella suis 1330
auagaugagcugguuuuucacca

SEQ ID NO: 2473394 - RNA, 13 nt, Brucella suis 1330
auagauggaaaga

SEQ ID NO: 2473395 - RNA, 14 nt, Brucella suis 1330
auagauuguggcaa

SEQ ID NO: 2473396 - RNA, 23 nt, Brucella suis 1330
auagauuguggcaaaagccucca

SEQ ID NO: 2473397 - RNA, 14 nt, Brucella suis 1330
auagcaacuuccuu

SEQ ID NO: 2473398 - RNA, 22 nt, Brucella suis 1330
auagcauggccccggagcgggg

SEQ ID NO: 2473399 - RNA, 15 nt, Brucella suis 1330
auagccugcgccagu

SEQ ID NO: 2473400 - RNA, 16 nt, Brucella suis 1330
auagccuuggcccuuu

SEQ ID NO: 2473401 - RNA, 15 nt, Brucella suis 1330
auagccuuucugcca

SEQ ID NO: 2473402 - RNA, 13 nt, Brucella suis 1330
auagcgaauggca

SEQ ID NO: 2473403 - RNA, 14 nt, Brucella suis 1330
auagcgcaucgcca

SEQ ID NO: 2473404 - RNA, 16 nt, Brucella suis 1330
auagcguaaaacgcac

SEQ ID NO: 2473405 - RNA, 13 nt, Brucella suis 1330
auagcucauguuc

SEQ ID NO: 2473406 - RNA, 16 nt, Brucella suis 1330
auagcucgacgcuuuc

SEQ ID NO: 2473407 - RNA, 19 nt, Brucella suis 1330
auagcucgacgcuuuccac

SEQ ID NO: 2473408 - RNA, 23 nt, Brucella suis 1330
auagcucgacgcuuuccaccggc

SEQ ID NO: 2473409 - RNA, 19 nt, Brucella suis 1330
auaggaaucagcaaguuua

SEQ ID NO: 2473410 - RNA, 18 nt, Brucella suis 1330
auaggcguugaugacgaa

SEQ ID NO: 2473411 - RNA, 12 nt, Brucella suis 1330
auagggaauggu

SEQ ID NO: 2473412 - RNA, 17 nt, Brucella suis 1330
auagggccuuuccggcg

SEQ ID NO: 2473413 - RNA, 21 nt, Brucella suis 1330
auaggucgugcuauagccacc

SEQ ID NO: 2473414 - RNA, 17 nt, Brucella suis 1330
auaggugagcggcaggc

SEQ ID NO: 2473415 - RNA, 18 nt, Brucella suis 1330
auaggugcgcggacgggc

SEQ ID NO: 2473416 - RNA, 18 nt, Brucella suis 1330
auaguccaguagcuucug

SEQ ID NO: 2473417 - RNA, 14 nt, Brucella suis 1330
auagucgaaaaaag

SEQ ID NO: 2473418 - RNA, 17 nt, Brucella suis 1330
auagucgaaaaaagaau

SEQ ID NO: 2473419 - RNA, 20 nt, Brucella suis 1330
auagucgaaaaaagaaugac

SEQ ID NO: 2473420 - RNA, 23 nt, Brucella suis 1330
auaguggcgggguguacaacaac

SEQ ID NO: 2473421 - RNA, 17 nt, Brucella suis 1330
auaguuagagcggcucc

SEQ ID NO: 2473422 - RNA, 16 nt, Brucella suis 1330
auaguucaaggcugcu

SEQ ID NO: 2473423 - RNA, 23 nt, Brucella suis 1330
auauauguccugugaaggccugu

SEQ ID NO: 2473424 - RNA, 18 nt, Brucella suis 1330
auaucacgcuugcccgcg

SEQ ID NO: 2473425 - RNA, 17 nt, Brucella suis 1330
auaucagcccgcuuuua

SEQ ID NO: 2473426 - RNA, 15 nt, Brucella suis 1330
auauccauaucuuuc

SEQ ID NO: 2473427 - RNA, 16 nt, Brucella suis 1330
auauccauaucuuucc

SEQ ID NO: 2473428 - RNA, 17 nt, Brucella suis 1330
auauccauaucuuucca

SEQ ID NO: 2473429 - RNA, 21 nt, Brucella suis 1330
auauccgccaccgguuuucau

SEQ ID NO: 2473430 - RNA, 13 nt, Brucella suis 1330
auauccucuguga

SEQ ID NO: 2473431 - RNA, 16 nt, Brucella suis 1330
auaucgccuucgcgca

SEQ ID NO: 2473432 - RNA, 22 nt, Brucella suis 1330
auaucggauucuuaugccagau

SEQ ID NO: 2473433 - RNA, 20 nt, Brucella suis 1330
auaugccgacgcgcucggca

SEQ ID NO: 2473434 - RNA, 16 nt, Brucella suis 1330
auauggaugccgccgc

SEQ ID NO: 2473435 - RNA, 22 nt, Brucella suis 1330
auaugguccgcaccggcaugga

SEQ ID NO: 2473436 - RNA, 16 nt, Brucella suis 1330
auauucaggaucuuuc

SEQ ID NO: 2473437 - RNA, 17 nt, Brucella suis 1330
auauuccuucuccaucu

SEQ ID NO: 2473438 - RNA, 15 nt, Brucella suis 1330
auauugaaguauuag

SEQ ID NO: 2473439 - RNA, 21 nt, Brucella suis 1330
auauugaaguauuagacgaau

SEQ ID NO: 2473440 - RNA, 18 nt, Brucella suis 1330
auauugcagacacgcuuu

SEQ ID NO: 2473441 - RNA, 13 nt, Brucella suis 1330
auauugcccugcu

SEQ ID NO: 2473442 - RNA, 16 nt, Brucella suis 1330
auauugugccagaaug

SEQ ID NO: 2473443 - RNA, 15 nt, Brucella suis 1330
aucaaaagaaaccuu

SEQ ID NO: 2473444 - RNA, 17 nt, Brucella suis 1330
aucaaaagaaaccuugc

SEQ ID NO: 2473445 - RNA, 21 nt, Brucella suis 1330
aucaaaagcugccgcaacaag

SEQ ID NO: 2473446 - RNA, 22 nt, Brucella suis 1330
aucaaccuuuucggcaaggaug

SEQ ID NO: 2473447 - RNA, 17 nt, Brucella suis 1330
aucaacgcugcaacaaa

SEQ ID NO: 2473448 - RNA, 18 nt, Brucella suis 1330
aucaacgcugcaacaaau

SEQ ID NO: 2473449 - RNA, 21 nt, Brucella suis 1330
aucaagcgcucagcuuuucca

SEQ ID NO: 2473450 - RNA, 11 nt, Brucella suis 1330
aucaaggccgg

SEQ ID NO: 2473451 - RNA, 14 nt, Brucella suis 1330
aucaaggccgggcc

SEQ ID NO: 2473452 - RNA, 17 nt, Brucella suis 1330
aucaaugcaccccauga

SEQ ID NO: 2473453 - RNA, 17 nt, Brucella suis 1330
aucaaugugaaggcgcu

SEQ ID NO: 2473454 - RNA, 15 nt, Brucella suis 1330
aucaauucccuggcu

SEQ ID NO: 2473455 - RNA, 20 nt, Brucella suis 1330
aucaccagcgucgcaccgga

SEQ ID NO: 2473456 - RNA, 15 nt, Brucella suis 1330
aucacccagaaaacg

SEQ ID NO: 2473457 - RNA, 17 nt, Brucella suis 1330
aucaccggcagggccag

SEQ ID NO: 2473458 - RNA, 16 nt, Brucella suis 1330
aucaccuguuccgcau

SEQ ID NO: 2473459 - RNA, 20 nt, Brucella suis 1330
aucacgaagagugcggcugu

SEQ ID NO: 2473460 - RNA, 23 nt, Brucella suis 1330
aucacgucgauggccgaauagcg

SEQ ID NO: 2473461 - RNA, 19 nt, Brucella suis 1330
aucacuucgucgcugacuu

SEQ ID NO: 2473462 - RNA, 14 nt, Brucella suis 1330
aucacuugcaagcg

SEQ ID NO: 2473463 - RNA, 12 nt, Brucella suis 1330
aucagaaaucag

SEQ ID NO: 2473464 - RNA, 23 nt, Brucella suis 1330
aucagaccgaugcucuaacuauu

SEQ ID NO: 2473465 - RNA, 11 nt, Brucella suis 1330
aucagauagcc

SEQ ID NO: 2473466 - RNA, 13 nt, Brucella suis 1330
aucagaucggcgc

SEQ ID NO: 2473467 - RNA, 22 nt, Brucella suis 1330
aucagauggguugcgauggcgc

SEQ ID NO: 2473468 - RNA, 18 nt, Brucella suis 1330
aucagcaccaucgaggaa

SEQ ID NO: 2473469 - RNA, 20 nt, Brucella suis 1330
aucagccgcccgccuuggaa

SEQ ID NO: 2473470 - RNA, 21 nt, Brucella suis 1330
aucagcgaauagggaaacggc

SEQ ID NO: 2473471 - RNA, 22 nt, Brucella suis 1330
aucagcgucagcgcaaagccug

SEQ ID NO: 2473472 - RNA, 14 nt, Brucella suis 1330
aucagcucuucaca

SEQ ID NO: 2473473 - RNA, 18 nt, Brucella suis 1330
aucagggcaaucugcgcu

SEQ ID NO: 2473474 - RNA, 22 nt, Brucella suis 1330
aucagggccggagggcauugca

SEQ ID NO: 2473475 - RNA, 19 nt, Brucella suis 1330
aucagguugaugccgggca

SEQ ID NO: 2473476 - RNA, 14 nt, Brucella suis 1330
aucagucgaauuuc

SEQ ID NO: 2473477 - RNA, 22 nt, Brucella suis 1330
aucagucgcgguuugcaagccg

SEQ ID NO: 2473478 - RNA, 15 nt, Brucella suis 1330
aucauaggcccaggc

SEQ ID NO: 2473479 - RNA, 18 nt, Brucella suis 1330
aucauauaggugccgagc

SEQ ID NO: 2473480 - RNA, 16 nt, Brucella suis 1330
aucaucaaggaaaaaa

SEQ ID NO: 2473481 - RNA, 16 nt, Brucella suis 1330
aucaucacauuggugc

SEQ ID NO: 2473482 - RNA, 19 nt, Brucella suis 1330
aucauccauuccucaagau

SEQ ID NO: 2473483 - RNA, 15 nt, Brucella suis 1330
aucaugucauggccg

SEQ ID NO: 2473484 - RNA, 17 nt, Brucella suis 1330
aucaugucauggccgcc

SEQ ID NO: 2473485 - RNA, 21 nt, Brucella suis 1330
aucauuuauuuuagcugcugu

SEQ ID NO: 2473486 - RNA, 14 nt, Brucella suis 1330
aucauuuccuucca

SEQ ID NO: 2473487 - RNA, 20 nt, Brucella suis 1330
auccaccgcgcugaagcggc

SEQ ID NO: 2473488 - RNA, 15 nt, Brucella suis 1330
auccacgauauguuc

SEQ ID NO: 2473489 - RNA, 23 nt, Brucella suis 1330
auccacucggcggcaucgcccga

SEQ ID NO: 2473490 - RNA, 17 nt, Brucella suis 1330
auccagcacuuccagau

SEQ ID NO: 2473491 - RNA, 22 nt, Brucella suis 1330
auccagccggugaaaauacggc

SEQ ID NO: 2473492 - RNA, 22 nt, Brucella suis 1330
auccagcggugacggcggcaga

SEQ ID NO: 2473493 - RNA, 23 nt, Brucella suis 1330
auccagcugagcuacgggugcuu

SEQ ID NO: 2473494 - RNA, 23 nt, Brucella suis 1330
auccaguugucgccgggcugcuu

SEQ ID NO: 2473495 - RNA, 14 nt, Brucella suis 1330
auccaguuucuugu

SEQ ID NO: 2473496 - RNA, 17 nt, Brucella suis 1330
auccaucugcuccugcg

SEQ ID NO: 2473497 - RNA, 17 nt, Brucella suis 1330
auccauguggaaggcga

SEQ ID NO: 2473498 - RNA, 22 nt, Brucella suis 1330
aucccgaaaagugcgaagcgcc

SEQ ID NO: 2473499 - RNA, 22 nt, Brucella suis 1330
aucccgccccuaaaggcucugc

SEQ ID NO: 2473500 - RNA, 19 nt, Brucella suis 1330
aucccgcuucgaugcgcug

SEQ ID NO: 2473501 - RNA, 17 nt, Brucella suis 1330
aucccgcuucgaugcgu

SEQ ID NO: 2473502 - RNA, 16 nt, Brucella suis 1330
aucccgguugagccgu

SEQ ID NO: 2473503 - RNA, 16 nt, Brucella suis 1330
aucccgucaagacaag

SEQ ID NO: 2473504 - RNA, 18 nt, Brucella suis 1330
aucccguuuugagaugac

SEQ ID NO: 2473505 - RNA, 14 nt, Brucella suis 1330
auccgaggcgcgca

SEQ ID NO: 2473506 - RNA, 13 nt, Brucella suis 1330
auccgaucggcgc

SEQ ID NO: 2473507 - RNA, 19 nt, Brucella suis 1330
auccgcaacucauggaagu

SEQ ID NO: 2473508 - RNA, 20 nt, Brucella suis 1330
auccgcaacucauggaagug

SEQ ID NO: 2473509 - RNA, 13 nt, Brucella suis 1330
auccgcaguuccc

SEQ ID NO: 2473510 - RNA, 13 nt, Brucella suis 1330
auccgcaucggcc

SEQ ID NO: 2473511 - RNA, 18 nt, Brucella suis 1330
auccgcauucccuugaaa

SEQ ID NO: 2473512 - RNA, 19 nt, Brucella suis 1330
auccgccuuggaugccgca

SEQ ID NO: 2473513 - RNA, 23 nt, Brucella suis 1330
auccgcggcgguuuugagcugcu

SEQ ID NO: 2473514 - RNA, 13 nt, Brucella suis 1330
auccgcuccagau

SEQ ID NO: 2473515 - RNA, 19 nt, Brucella suis 1330
auccgcuugcuucgggcau

SEQ ID NO: 2473516 - RNA, 12 nt, Brucella suis 1330
auccggcagcuu

SEQ ID NO: 2473517 - RNA, 22 nt, Brucella suis 1330
auccggcagcuuucgcaccgcg

SEQ ID NO: 2473518 - RNA, 20 nt, Brucella suis 1330
auccggcgggcuuuucauuc

SEQ ID NO: 2473519 - RNA, 15 nt, Brucella suis 1330
auccggcugggucau

SEQ ID NO: 2473520 - RNA, 17 nt, Brucella suis 1330
auccuccugcgcccauu

SEQ ID NO: 2473521 - RNA, 17 nt, Brucella suis 1330
auccucgaagucgccag

SEQ ID NO: 2473522 - RNA, 16 nt, Brucella suis 1330
auccucgccuuccgac

SEQ ID NO: 2473523 - RNA, 22 nt, Brucella suis 1330
auccucggcccuggaaagaagc

SEQ ID NO: 2473524 - RNA, 15 nt, Brucella suis 1330
auccucgguuuucaa

SEQ ID NO: 2473525 - RNA, 23 nt, Brucella suis 1330
auccucgguuuucaaugccuggc

SEQ ID NO: 2473526 - RNA, 23 nt, Brucella suis 1330
auccucucacuccgaccauuucc

SEQ ID NO: 2473527 - RNA, 20 nt, Brucella suis 1330
auccucugugacugcggcaa

SEQ ID NO: 2473528 - RNA, 23 nt, Brucella suis 1330
auccugaccgugauucuuucuuc

SEQ ID NO: 2473529 - RNA, 16 nt, Brucella suis 1330
auccugcaccggcuuc

SEQ ID NO: 2473530 - RNA, 16 nt, Brucella suis 1330
auccugcgcccuguca

SEQ ID NO: 2473531 - RNA, 17 nt, Brucella suis 1330
auccuggccuuccuuga

SEQ ID NO: 2473532 - RNA, 14 nt, Brucella suis 1330
auccuucacuucau

SEQ ID NO: 2473533 - RNA, 16 nt, Brucella suis 1330
auccuucaugccgccg

SEQ ID NO: 2473534 - RNA, 13 nt, Brucella suis 1330
auccuucggcaug

SEQ ID NO: 2473535 - RNA, 17 nt, Brucella suis 1330
auccuugaugcccagcu

SEQ ID NO: 2473536 - RNA, 23 nt, Brucella suis 1330
auccuuguucuuggcgacggcca

SEQ ID NO: 2473537 - RNA, 19 nt, Brucella suis 1330
auccuuuccaguuccauug

SEQ ID NO: 2473538 - RNA, 20 nt, Brucella suis 1330
aucgaagcgggaccauaaau

SEQ ID NO: 2473539 - RNA, 18 nt, Brucella suis 1330
aucgaauagggcauggau

SEQ ID NO: 2473540 - RNA, 14 nt, Brucella suis 1330
aucgacaggcgccu

SEQ ID NO: 2473541 - RNA, 21 nt, Brucella suis 1330
aucgacauauuugucgccgac

SEQ ID NO: 2473542 - RNA, 22 nt, Brucella suis 1330
aucgaccaggaugugucggcca

SEQ ID NO: 2473543 - RNA, 16 nt, Brucella suis 1330
aucgacucauuuuuag

SEQ ID NO: 2473544 - RNA, 23 nt, Brucella suis 1330
aucgagaucgcgcguaucgacac

SEQ ID NO: 2473545 - RNA, 21 nt, Brucella suis 1330
aucgagauugggcgcgcuaug

SEQ ID NO: 2473546 - RNA, 18 nt, Brucella suis 1330
aucgauaucugcaacacc

SEQ ID NO: 2473547 - RNA, 18 nt, Brucella suis 1330
aucgaucacaugcgcgcc

SEQ ID NO: 2473548 - RNA, 15 nt, Brucella suis 1330
aucgaucacggcgcc

SEQ ID NO: 2473549 - RNA, 21 nt, Brucella suis 1330
aucgauccaguugucgccggg

SEQ ID NO: 2473550 - RNA, 18 nt, Brucella suis 1330
aucgaugauaucgccuuc

SEQ ID NO: 2473551 - RNA, 14 nt, Brucella suis 1330
aucgcaagccaaag

SEQ ID NO: 2473552 - RNA, 23 nt, Brucella suis 1330
aucgcaucggucagcacgcccgu

SEQ ID NO: 2473553 - RNA, 13 nt, Brucella suis 1330
aucgccaagcuug

SEQ ID NO: 2473554 - RNA, 17 nt, Brucella suis 1330
aucgccaccauggccgc

SEQ ID NO: 2473555 - RNA, 19 nt, Brucella suis 1330
aucgccaccauggccgccc

SEQ ID NO: 2473556 - RNA, 22 nt, Brucella suis 1330
aucgccaccguugcauauucca

SEQ ID NO: 2473557 - RNA, 14 nt, Brucella suis 1330
aucgcccgcccggc

SEQ ID NO: 2473558 - RNA, 16 nt, Brucella suis 1330
aucgcccgcccggcau

SEQ ID NO: 2473559 - RNA, 12 nt, Brucella suis 1330
aucgcccgccgc

SEQ ID NO: 2473560 - RNA, 14 nt, Brucella suis 1330
aucgcccgccgcga

SEQ ID NO: 2473561 - RNA, 18 nt, Brucella suis 1330
aucgcccucgaucagcac

SEQ ID NO: 2473562 - RNA, 23 nt, Brucella suis 1330
aucgccgcccuugugaucgccac

SEQ ID NO: 2473563 - RNA, 13 nt, Brucella suis 1330
aucgccggaaagc

SEQ ID NO: 2473564 - RNA, 12 nt, Brucella suis 1330
aucgccguccuu

SEQ ID NO: 2473565 - RNA, 18 nt, Brucella suis 1330
aucgccugcuuccuuuuc

SEQ ID NO: 2473566 - RNA, 16 nt, Brucella suis 1330
aucgccuggcauugcg

SEQ ID NO: 2473567 - RNA, 22 nt, Brucella suis 1330
aucgcgagcagcgcgaugagcc

SEQ ID NO: 2473568 - RNA, 17 nt, Brucella suis 1330
aucgcgccggggccgac

SEQ ID NO: 2473569 - RNA, 15 nt, Brucella suis 1330
aucgcgcgaccaggu

SEQ ID NO: 2473570 - RNA, 17 nt, Brucella suis 1330
aucgcgcguaucgacac

SEQ ID NO: 2473571 - RNA, 22 nt, Brucella suis 1330
aucgcgcguaucgacaccgcca

SEQ ID NO: 2473572 - RNA, 13 nt, Brucella suis 1330
aucgcggaacauc

SEQ ID NO: 2473573 - RNA, 15 nt, Brucella suis 1330
aucgcggcagccgcc

SEQ ID NO: 2473574 - RNA, 17 nt, Brucella suis 1330
aucgcgguuuucaagau

SEQ ID NO: 2473575 - RNA, 18 nt, Brucella suis 1330
aucgcguaagucccauug

SEQ ID NO: 2473576 - RNA, 19 nt, Brucella suis 1330
aucgcgucccuugccgccu

SEQ ID NO: 2473577 - RNA, 22 nt, Brucella suis 1330
aucgcucaccuuuuccaccggc

SEQ ID NO: 2473578 - RNA, 20 nt, Brucella suis 1330
aucgcugaucggcgcagggg

SEQ ID NO: 2473579 - RNA, 23 nt, Brucella suis 1330
aucgcuucacgcggcugcucgac

SEQ ID NO: 2473580 - RNA, 14 nt, Brucella suis 1330
aucggaacaaacug

SEQ ID NO: 2473581 - RNA, 20 nt, Brucella suis 1330
aucggaaccccaaugcucga

SEQ ID NO: 2473582 - RNA, 15 nt, Brucella suis 1330
aucggaaccgcucua

SEQ ID NO: 2473583 - RNA, 17 nt, Brucella suis 1330
aucggaugcuccacggc

SEQ ID NO: 2473584 - RNA, 17 nt, Brucella suis 1330
aucggcaacaagagggc

SEQ ID NO: 2473585 - RNA, 13 nt, Brucella suis 1330
aucggcagcagcg

SEQ ID NO: 2473586 - RNA, 13 nt, Brucella suis 1330
aucggcagccuug

SEQ ID NO: 2473587 - RNA, 20 nt, Brucella suis 1330
aucggcaucggaaaggucuu

SEQ ID NO: 2473588 - RNA, 20 nt, Brucella suis 1330
aucggccauuucggcuucca

SEQ ID NO: 2473589 - RNA, 22 nt, Brucella suis 1330
aucggccuugaaaccaaagcgu

SEQ ID NO: 2473590 - RNA, 19 nt, Brucella suis 1330
aucggcgaggaagagaauc

SEQ ID NO: 2473591 - RNA, 16 nt, Brucella suis 1330
aucggcgaggucuccc

SEQ ID NO: 2473592 - RNA, 21 nt, Brucella suis 1330
aucggcgaggucucccggcac

SEQ ID NO: 2473593 - RNA, 16 nt, Brucella suis 1330
aucggcgcgcuuggca

SEQ ID NO: 2473594 - RNA, 16 nt, Brucella suis 1330
aucggggcgagcgcgc

SEQ ID NO: 2473595 - RNA, 14 nt, Brucella suis 1330
aucggguugacgau

SEQ ID NO: 2473596 - RNA, 16 nt, Brucella suis 1330
aucggugcgcggcgcu

SEQ ID NO: 2473597 - RNA, 23 nt, Brucella suis 1330
aucgguggccuugccauggccga

SEQ ID NO: 2473598 - RNA, 19 nt, Brucella suis 1330
aucguauccccggcaaaga

SEQ ID NO: 2473599 - RNA, 15 nt, Brucella suis 1330
aucguaucgccaaag

SEQ ID NO: 2473600 - RNA, 16 nt, Brucella suis 1330
aucgucguccagcccu

SEQ ID NO: 2473601 - RNA, 21 nt, Brucella suis 1330
aucgugccgccuucggcugcu

SEQ ID NO: 2473602 - RNA, 23 nt, Brucella suis 1330
aucgugccgccuucggcugcuuc

SEQ ID NO: 2473603 - RNA, 19 nt, Brucella suis 1330
aucgugccggaauggccac

SEQ ID NO: 2473604 - RNA, 20 nt, Brucella suis 1330
aucgugccgguaacgaugau

SEQ ID NO: 2473605 - RNA, 17 nt, Brucella suis 1330
aucguggucgccucuuc

SEQ ID NO: 2473606 - RNA, 16 nt, Brucella suis 1330
aucguuaugcucuauu

SEQ ID NO: 2473607 - RNA, 21 nt, Brucella suis 1330
aucguugcggcuugccaccac

SEQ ID NO: 2473608 - RNA, 14 nt, Brucella suis 1330
aucucauccacagu

SEQ ID NO: 2473609 - RNA, 14 nt, Brucella suis 1330
aucucgaaaugcgc

SEQ ID NO: 2473610 - RNA, 11 nt, Brucella suis 1330
aucucgcccag

SEQ ID NO: 2473611 - RNA, 23 nt, Brucella suis 1330
aucucguucacaaucuugccaac

SEQ ID NO: 2473612 - RNA, 12 nt, Brucella suis 1330
aucucucgccug

SEQ ID NO: 2473613 - RNA, 17 nt, Brucella suis 1330
aucugacagaauuugga

SEQ ID NO: 2473614 - RNA, 16 nt, Brucella suis 1330
aucugcaucccgaaaa

SEQ ID NO: 2473615 - RNA, 21 nt, Brucella suis 1330
aucugcaucccgaaaagugcg

SEQ ID NO: 2473616 - RNA, 18 nt, Brucella suis 1330
aucugccgucagcaaaau

SEQ ID NO: 2473617 - RNA, 17 nt, Brucella suis 1330
aucugcggcgucagggc

SEQ ID NO: 2473618 - RNA, 21 nt, Brucella suis 1330
aucugcucguccggccagccg

SEQ ID NO: 2473619 - RNA, 15 nt, Brucella suis 1330
aucuggaaggccagc

SEQ ID NO: 2473620 - RNA, 15 nt, Brucella suis 1330
aucugguccacgccc

SEQ ID NO: 2473621 - RNA, 19 nt, Brucella suis 1330
aucuguucacauuucauga

SEQ ID NO: 2473622 - RNA, 18 nt, Brucella suis 1330
aucuuacgaccaagccca

SEQ ID NO: 2473623 - RNA, 20 nt, Brucella suis 1330
aucuuccagagcggguuccc

SEQ ID NO: 2473624 - RNA, 12 nt, Brucella suis 1330
aucuuccaucug

SEQ ID NO: 2473625 - RNA, 16 nt, Brucella suis 1330
aucuuccgcaagccag

SEQ ID NO: 2473626 - RNA, 17 nt, Brucella suis 1330
aucuucgaucauuuccu

SEQ ID NO: 2473627 - RNA, 17 nt, Brucella suis 1330
aucuugaccuggccagc

SEQ ID NO: 2473628 - RNA, 23 nt, Brucella suis 1330
aucuugaucgagccgacaucgcg

SEQ ID NO: 2473629 - RNA, 15 nt, Brucella suis 1330
aucuugcugaugagc

SEQ ID NO: 2473630 - RNA, 14 nt, Brucella suis 1330
aucuuucuugaagu

SEQ ID NO: 2473631 - RNA, 12 nt, Brucella suis 1330
augaaaaugcca

SEQ ID NO: 2473632 - RNA, 18 nt, Brucella suis 1330
augaaagcaacgcccuuc

SEQ ID NO: 2473633 - RNA, 17 nt, Brucella suis 1330
augaacccgcucccccc

SEQ ID NO: 2473634 - RNA, 12 nt, Brucella suis 1330
augaaucaccag

SEQ ID NO: 2473635 - RNA, 19 nt, Brucella suis 1330
augaauggggggcaggcaa

SEQ ID NO: 2473636 - RNA, 17 nt, Brucella suis 1330
augacauccaugaaagc

SEQ ID NO: 2473637 - RNA, 21 nt, Brucella suis 1330
augacauccaugaaagccaca

SEQ ID NO: 2473638 - RNA, 13 nt, Brucella suis 1330
augacgaaaugaa

SEQ ID NO: 2473639 - RNA, 16 nt, Brucella suis 1330
augacgagccucgccc

SEQ ID NO: 2473640 - RNA, 22 nt, Brucella suis 1330
augacgcccagcgaauagacca

SEQ ID NO: 2473641 - RNA, 21 nt, Brucella suis 1330
augacgccgggcauggaagcc

SEQ ID NO: 2473642 - RNA, 22 nt, Brucella suis 1330
augacgccugcuaucaacgcug

SEQ ID NO: 2473643 - RNA, 13 nt, Brucella suis 1330
augacgcggguga

SEQ ID NO: 2473644 - RNA, 22 nt, Brucella suis 1330
augacgcgggugaggcuuucgc

SEQ ID NO: 2473645 - RNA, 20 nt, Brucella suis 1330
augacugaaggggcaaauuu

SEQ ID NO: 2473646 - RNA, 23 nt, Brucella suis 1330
augacuucgguuuccacauccgc

SEQ ID NO: 2473647 - RNA, 15 nt, Brucella suis 1330
augagaaccggcucg

SEQ ID NO: 2473648 - RNA, 12 nt, Brucella suis 1330
augagccgcuuc

SEQ ID NO: 2473649 - RNA, 17 nt, Brucella suis 1330
augagcgacaggaacau

SEQ ID NO: 2473650 - RNA, 16 nt, Brucella suis 1330
augagcggcagcagcc

SEQ ID NO: 2473651 - RNA, 15 nt, Brucella suis 1330
augauagcugcaucc

SEQ ID NO: 2473652 - RNA, 18 nt, Brucella suis 1330
augauagcuggaaaaaau

SEQ ID NO: 2473653 - RNA, 14 nt, Brucella suis 1330
augauccagguaua

SEQ ID NO: 2473654 - RNA, 15 nt, Brucella suis 1330
augaucgccagcacg

SEQ ID NO: 2473655 - RNA, 18 nt, Brucella suis 1330
augaucgcccgcccggca

SEQ ID NO: 2473656 - RNA, 15 nt, Brucella suis 1330
augaucuggcgcgcg

SEQ ID NO: 2473657 - RNA, 17 nt, Brucella suis 1330
augaucuuugucggguc

SEQ ID NO: 2473658 - RNA, 20 nt, Brucella suis 1330
augaugacggcgauaaucca

SEQ ID NO: 2473659 - RNA, 22 nt, Brucella suis 1330
augaugauccagguauagauau

SEQ ID NO: 2473660 - RNA, 16 nt, Brucella suis 1330
augaugaucgccagca

SEQ ID NO: 2473661 - RNA, 18 nt, Brucella suis 1330
augaugccggucgcaggc

SEQ ID NO: 2473662 - RNA, 12 nt, Brucella suis 1330
augauugcgcca

SEQ ID NO: 2473663 - RNA, 14 nt, Brucella suis 1330
augauuuccucagc

SEQ ID NO: 2473664 - RNA, 22 nt, Brucella suis 1330
augcaaaaccgguucccgcuuc

SEQ ID NO: 2473665 - RNA, 12 nt, Brucella suis 1330
augcaaggccgg

SEQ ID NO: 2473666 - RNA, 20 nt, Brucella suis 1330
augcacauccucggcccugg

SEQ ID NO: 2473667 - RNA, 14 nt, Brucella suis 1330
augcaccaucaucg

SEQ ID NO: 2473668 - RNA, 13 nt, Brucella suis 1330
augcacccggcac

SEQ ID NO: 2473669 - RNA, 16 nt, Brucella suis 1330
augcaccgccgaugca

SEQ ID NO: 2473670 - RNA, 21 nt, Brucella suis 1330
augcaccgccugccagcccgc

SEQ ID NO: 2473671 - RNA, 20 nt, Brucella suis 1330
augcagaucaguccuugacc

SEQ ID NO: 2473672 - RNA, 15 nt, Brucella suis 1330
augcagcauaggcac

SEQ ID NO: 2473673 - RNA, 13 nt, Brucella suis 1330
augcagcgccgcg

SEQ ID NO: 2473674 - RNA, 20 nt, Brucella suis 1330
augcagcgccgcgcccacca

SEQ ID NO: 2473675 - RNA, 16 nt, Brucella suis 1330
augcaggccgugaaga

SEQ ID NO: 2473676 - RNA, 18 nt, Brucella suis 1330
augcaucgaaugccgcau

SEQ ID NO: 2473677 - RNA, 18 nt, Brucella suis 1330
augcaugacaccuucggc

SEQ ID NO: 2473678 - RNA, 20 nt, Brucella suis 1330
augccaccgcgaucaguucg

SEQ ID NO: 2473679 - RNA, 21 nt, Brucella suis 1330
augcccaucaaccgugcauuc

SEQ ID NO: 2473680 - RNA, 14 nt, Brucella suis 1330
augccccgcaccga

SEQ ID NO: 2473681 - RNA, 23 nt, Brucella suis 1330
augcccgccaauaccgugaucag

SEQ ID NO: 2473682 - RNA, 21 nt, Brucella suis 1330
augcccugcugcaacaaaaug

SEQ ID NO: 2473683 - RNA, 13 nt, Brucella suis 1330
augccgaagccag

SEQ ID NO: 2473684 - RNA, 16 nt, Brucella suis 1330
augccgaagcccaugg

SEQ ID NO: 2473685 - RNA, 23 nt, Brucella suis 1330
augccgaaggcgaagccgaagaa

SEQ ID NO: 2473686 - RNA, 16 nt, Brucella suis 1330
augccgaucaucgccu

SEQ ID NO: 2473687 - RNA, 22 nt, Brucella suis 1330
augccgcccaucccggaaggaa

SEQ ID NO: 2473688 - RNA, 13 nt, Brucella suis 1330
augccggaaccgc

SEQ ID NO: 2473689 - RNA, 17 nt, Brucella suis 1330
augccggcgaucuuuuc

SEQ ID NO: 2473690 - RNA, 17 nt, Brucella suis 1330
augccguuuucaucaaa

SEQ ID NO: 2473691 - RNA, 14 nt, Brucella suis 1330
augccugccaugcc

SEQ ID NO: 2473692 - RNA, 15 nt, Brucella suis 1330
augccugccgcagcc

SEQ ID NO: 2473693 - RNA, 16 nt, Brucella suis 1330
augccugccgcagcca

SEQ ID NO: 2473694 - RNA, 17 nt, Brucella suis 1330
augccugccgcagccag

SEQ ID NO: 2473695 - RNA, 15 nt, Brucella suis 1330
augccuuucaggucg

SEQ ID NO: 2473696 - RNA, 17 nt, Brucella suis 1330
augcgagguccggggug

SEQ ID NO: 2473697 - RNA, 14 nt, Brucella suis 1330
augcgaugagccuu

SEQ ID NO: 2473698 - RNA, 14 nt, Brucella suis 1330
augcgauuucgcca

SEQ ID NO: 2473699 - RNA, 17 nt, Brucella suis 1330
augcgauuucgccuucg

SEQ ID NO: 2473700 - RNA, 16 nt, Brucella suis 1330
augcgcaaaacgcuug

SEQ ID NO: 2473701 - RNA, 21 nt, Brucella suis 1330
augcgcaaaacgcuugacgaa

SEQ ID NO: 2473702 - RNA, 19 nt, Brucella suis 1330
augcgcaaccaaaacauac

SEQ ID NO: 2473703 - RNA, 18 nt, Brucella suis 1330
augcgcaauugcgcgccu

SEQ ID NO: 2473704 - RNA, 15 nt, Brucella suis 1330
augcgcacauauuug

SEQ ID NO: 2473705 - RNA, 18 nt, Brucella suis 1330
augcgcaugaagcgcggc

SEQ ID NO: 2473706 - RNA, 14 nt, Brucella suis 1330
augcgcaugaucau

SEQ ID NO: 2473707 - RNA, 20 nt, Brucella suis 1330
augcgccacaccggaggaga

SEQ ID NO: 2473708 - RNA, 22 nt, Brucella suis 1330
augcgccacaccggaggagagc

SEQ ID NO: 2473709 - RNA, 20 nt, Brucella suis 1330
augcgccacgagaaccgcgc

SEQ ID NO: 2473710 - RNA, 24 nt, Brucella suis 1330
augcgccagagcauuuucgccgca

SEQ ID NO: 2473711 - RNA, 19 nt, Brucella suis 1330
augcgccgugcagggugcg

SEQ ID NO: 2473712 - RNA, 19 nt, Brucella suis 1330
augcgcgaauuuucucagc

SEQ ID NO: 2473713 - RNA, 18 nt, Brucella suis 1330
augcgcgauggcccagcc

SEQ ID NO: 2473714 - RNA, 20 nt, Brucella suis 1330
augcgcgccagccgccagca

SEQ ID NO: 2473715 - RNA, 19 nt, Brucella suis 1330
augcgcgcccgucaccggc

SEQ ID NO: 2473716 - RNA, 15 nt, Brucella suis 1330
augcgcgucaaaaca

SEQ ID NO: 2473717 - RNA, 17 nt, Brucella suis 1330
augcgcucuaaccauuu

SEQ ID NO: 2473718 - RNA, 17 nt, Brucella suis 1330
augcgcucuaugcagca

SEQ ID NO: 2473719 - RNA, 20 nt, Brucella suis 1330
augcgcuucuuccuucggca

SEQ ID NO: 2473720 - RNA, 12 nt, Brucella suis 1330
augcgcuugccc

SEQ ID NO: 2473721 - RNA, 13 nt, Brucella suis 1330
augcggauuugga

SEQ ID NO: 2473722 - RNA, 17 nt, Brucella suis 1330
augcggguggguuugag

SEQ ID NO: 2473723 - RNA, 22 nt, Brucella suis 1330
augcgguccgaauuugcugccu

SEQ ID NO: 2473724 - RNA, 14 nt, Brucella suis 1330
augcggugcacgaa

SEQ ID NO: 2473725 - RNA, 16 nt, Brucella suis 1330
augcuccagggugccg

SEQ ID NO: 2473726 - RNA, 20 nt, Brucella suis 1330
augcucuaggaaaacuugcu

SEQ ID NO: 2473727 - RNA, 21 nt, Brucella suis 1330
augcucuuucuggacaaagaa

SEQ ID NO: 2473728 - RNA, 15 nt, Brucella suis 1330
augcugaacaagcag

SEQ ID NO: 2473729 - RNA, 24 nt, Brucella suis 1330
augcuggcacugucgggcucaggc

SEQ ID NO: 2473730 - RNA, 20 nt, Brucella suis 1330
augcuggcagcggcaggagc

SEQ ID NO: 2473731 - RNA, 14 nt, Brucella suis 1330
augcuggccaccag

SEQ ID NO: 2473732 - RNA, 16 nt, Brucella suis 1330
augcuggccaccagaa

SEQ ID NO: 2473733 - RNA, 22 nt, Brucella suis 1330
augcuugccucguccgguuuuc

SEQ ID NO: 2473734 - RNA, 14 nt, Brucella suis 1330
auggaaaaggccug

SEQ ID NO: 2473735 - RNA, 22 nt, Brucella suis 1330
auggaacggaaaaugcccggcg

SEQ ID NO: 2473736 - RNA, 15 nt, Brucella suis 1330
auggaagaugacgcc

SEQ ID NO: 2473737 - RNA, 20 nt, Brucella suis 1330
auggaagaugacgcccagcg

SEQ ID NO: 2473738 - RNA, 18 nt, Brucella suis 1330
auggacggaaccaagguc

SEQ ID NO: 2473739 - RNA, 14 nt, Brucella suis 1330
auggagauacgcuu

SEQ ID NO: 2473740 - RNA, 17 nt, Brucella suis 1330
auggagauacgcuucau

SEQ ID NO: 2473741 - RNA, 17 nt, Brucella suis 1330
auggagcauuuccagca

SEQ ID NO: 2473742 - RNA, 13 nt, Brucella suis 1330
auggagcggcuga

SEQ ID NO: 2473743 - RNA, 22 nt, Brucella suis 1330
auggaucaacgcaggcgagaug

SEQ ID NO: 2473744 - RNA, 21 nt, Brucella suis 1330
auggaugccgccgcagaccac

SEQ ID NO: 2473745 - RNA, 17 nt, Brucella suis 1330
auggcaagcagcaaaac

SEQ ID NO: 2473746 - RNA, 22 nt, Brucella suis 1330
auggcaauuuaucugcguuccg

SEQ ID NO: 2473747 - RNA, 15 nt, Brucella suis 1330
auggcagaccccauc

SEQ ID NO: 2473748 - RNA, 18 nt, Brucella suis 1330
auggcagaccccaucagc

SEQ ID NO: 2473749 - RNA, 22 nt, Brucella suis 1330
auggcagugaauacuaaucgca

SEQ ID NO: 2473750 - RNA, 15 nt, Brucella suis 1330
auggcauggaccacg

SEQ ID NO: 2473751 - RNA, 16 nt, Brucella suis 1330
auggcauggcuugagc

SEQ ID NO: 2473752 - RNA, 19 nt, Brucella suis 1330
auggcccagcgguuuuccg

SEQ ID NO: 2473753 - RNA, 16 nt, Brucella suis 1330
auggccgccccgacga

SEQ ID NO: 2473754 - RNA, 19 nt, Brucella suis 1330
auggccucaagugccgccu

SEQ ID NO: 2473755 - RNA, 16 nt, Brucella suis 1330
auggccugcgcgcgca

SEQ ID NO: 2473756 - RNA, 21 nt, Brucella suis 1330
auggccugcgcgcgcauggcg

SEQ ID NO: 2473757 - RNA, 21 nt, Brucella suis 1330
auggccuuugcagaaccaggc

SEQ ID NO: 2473758 - RNA, 21 nt, Brucella suis 1330
auggcgauuauuuuuacaaaa

SEQ ID NO: 2473759 - RNA, 18 nt, Brucella suis 1330
auggcgccgcauggcggc

SEQ ID NO: 2473760 - RNA, 14 nt, Brucella suis 1330
auggcggaauagcg

SEQ ID NO: 2473761 - RNA, 16 nt, Brucella suis 1330
auggcggagagcgcga

SEQ ID NO: 2473762 - RNA, 10 nt, Brucella suis 1330
auggcggcgc

SEQ ID NO: 2473763 - RNA, 17 nt, Brucella suis 1330
auggcgggccauuucca

SEQ ID NO: 2473764 - RNA, 18 nt, Brucella suis 1330
auggcgggccauuuccaa

SEQ ID NO: 2473765 - RNA, 18 nt, Brucella suis 1330
auggcguucugaaaccgc

SEQ ID NO: 2473766 - RNA, 21 nt, Brucella suis 1330
auggcucaugcggguggguuu

SEQ ID NO: 2473767 - RNA, 16 nt, Brucella suis 1330
auggcugauuucuucc

SEQ ID NO: 2473768 - RNA, 13 nt, Brucella suis 1330
auggcuugaagcg

SEQ ID NO: 2473769 - RNA, 14 nt, Brucella suis 1330
auggcuugaagcgu

SEQ ID NO: 2473770 - RNA, 21 nt, Brucella suis 1330
augggcaccugggccacggcg

SEQ ID NO: 2473771 - RNA, 14 nt, Brucella suis 1330
augggccggucuuc

SEQ ID NO: 2473772 - RNA, 20 nt, Brucella suis 1330
augggcgcagucaggccgac

SEQ ID NO: 2473773 - RNA, 15 nt, Brucella suis 1330
augggcggccacggc

SEQ ID NO: 2473774 - RNA, 17 nt, Brucella suis 1330
augggcggcggccgggc

SEQ ID NO: 2473775 - RNA, 18 nt, Brucella suis 1330
augggcggcggccgggcg

SEQ ID NO: 2473776 - RNA, 21 nt, Brucella suis 1330
augggcggggagcaggcaggc

SEQ ID NO: 2473777 - RNA, 19 nt, Brucella suis 1330
augggcgguauugcugccg

SEQ ID NO: 2473778 - RNA, 18 nt, Brucella suis 1330
auggggauugacgccccc

SEQ ID NO: 2473779 - RNA, 22 nt, Brucella suis 1330
auggggcaccaugcggcuccag

SEQ ID NO: 2473780 - RNA, 22 nt, Brucella suis 1330
auggggcuggccgacaccgacc

SEQ ID NO: 2473781 - RNA, 21 nt, Brucella suis 1330
auggguggcgcccgcccgccg

SEQ ID NO: 2473782 - RNA, 17 nt, Brucella suis 1330
auggucgaugccgccga

SEQ ID NO: 2473783 - RNA, 19 nt, Brucella suis 1330
auggucugcgccaguuccu

SEQ ID NO: 2473784 - RNA, 16 nt, Brucella suis 1330
auggugucauagacca

SEQ ID NO: 2473785 - RNA, 22 nt, Brucella suis 1330
augguuugcagcaauuccugcg

SEQ ID NO: 2473786 - RNA, 17 nt, Brucella suis 1330
augguuuuagcccgguu

SEQ ID NO: 2473787 - RNA, 15 nt, Brucella suis 1330
augucaugcuccgca

SEQ ID NO: 2473788 - RNA, 20 nt, Brucella suis 1330
augucauuugcgaccauggc

SEQ ID NO: 2473789 - RNA, 17 nt, Brucella suis 1330
augucuagagcauuuuu

SEQ ID NO: 2473790 - RNA, 12 nt, Brucella suis 1330
auguggaaggcg

SEQ ID NO: 2473791 - RNA, 13 nt, Brucella suis 1330
auguguccggcgu

SEQ ID NO: 2473792 - RNA, 19 nt, Brucella suis 1330
auguuccgcaccgcacugg

SEQ ID NO: 2473793 - RNA, 21 nt, Brucella suis 1330
auguuccgggccgggaaaucu

SEQ ID NO: 2473794 - RNA, 16 nt, Brucella suis 1330
auguuccugcggaaug

SEQ ID NO: 2473795 - RNA, 19 nt, Brucella suis 1330
auguucggcaaggccgcgc

SEQ ID NO: 2473796 - RNA, 17 nt, Brucella suis 1330
auguucggguagagcuu

SEQ ID NO: 2473797 - RNA, 19 nt, Brucella suis 1330
auuaagccgggcggcgcgg

SEQ ID NO: 2473798 - RNA, 12 nt, Brucella suis 1330
auuacggccagc

SEQ ID NO: 2473799 - RNA, 14 nt, Brucella suis 1330
auuaguaucggcag

SEQ ID NO: 2473800 - RNA, 18 nt, Brucella suis 1330
auuauacaugcuuucgac

SEQ ID NO: 2473801 - RNA, 22 nt, Brucella suis 1330
auuaucgcgaagaagaauacgc

SEQ ID NO: 2473802 - RNA, 19 nt, Brucella suis 1330
auuaucggcggcuuccucg

SEQ ID NO: 2473803 - RNA, 13 nt, Brucella suis 1330
auuaugcggcacu

SEQ ID NO: 2473804 - RNA, 14 nt, Brucella suis 1330
auuaugcuuuaaaa

SEQ ID NO: 2473805 - RNA, 12 nt, Brucella suis 1330
auucaaaacaug

SEQ ID NO: 2473806 - RNA, 18 nt, Brucella suis 1330
auucaaugccacccuuug

SEQ ID NO: 2473807 - RNA, 19 nt, Brucella suis 1330
auucagagcgauuucugga

SEQ ID NO: 2473808 - RNA, 18 nt, Brucella suis 1330
auucaggauagauauuuc

SEQ ID NO: 2473809 - RNA, 20 nt, Brucella suis 1330
auuccaacauuugcucaacg

SEQ ID NO: 2473810 - RNA, 20 nt, Brucella suis 1330
auuccagaugcggcgcgcau

SEQ ID NO: 2473811 - RNA, 17 nt, Brucella suis 1330
auuccaucagccgggca

SEQ ID NO: 2473812 - RNA, 22 nt, Brucella suis 1330
auuccaucagccgggcagugcc

SEQ ID NO: 2473813 - RNA, 11 nt, Brucella suis 1330
auucccauuga

SEQ ID NO: 2473814 - RNA, 14 nt, Brucella suis 1330
auuccccuauuccc

SEQ ID NO: 2473815 - RNA, 17 nt, Brucella suis 1330
auuccccuauuccccua

SEQ ID NO: 2473816 - RNA, 18 nt, Brucella suis 1330
auuccccuauuccccuau

SEQ ID NO: 2473817 - RNA, 18 nt, Brucella suis 1330
auuccccuauucccuuaa

SEQ ID NO: 2473818 - RNA, 21 nt, Brucella suis 1330
auucccgaagacgaucuuuuc

SEQ ID NO: 2473819 - RNA, 13 nt, Brucella suis 1330
auucccgcagcau

SEQ ID NO: 2473820 - RNA, 13 nt, Brucella suis 1330
auucccgccucag

SEQ ID NO: 2473821 - RNA, 20 nt, Brucella suis 1330
auucccuuaacauacugccu

SEQ ID NO: 2473822 - RNA, 17 nt, Brucella suis 1330
auuccgauggaacugcu

SEQ ID NO: 2473823 - RNA, 11 nt, Brucella suis 1330
auuccgccaug

SEQ ID NO: 2473824 - RNA, 12 nt, Brucella suis 1330
auuccgccaugc

SEQ ID NO: 2473825 - RNA, 14 nt, Brucella suis 1330
auuccgggccgcac

SEQ ID NO: 2473826 - RNA, 17 nt, Brucella suis 1330
auuccuucuccaucugc

SEQ ID NO: 2473827 - RNA, 12 nt, Brucella suis 1330
auucggcuucac

SEQ ID NO: 2473828 - RNA, 14 nt, Brucella suis 1330
auucgggguucuuc

SEQ ID NO: 2473829 - RNA, 18 nt, Brucella suis 1330
auucuccuauugccagac

SEQ ID NO: 2473830 - RNA, 22 nt, Brucella suis 1330
auucucgcccaaggucggcuca

SEQ ID NO: 2473831 - RNA, 22 nt, Brucella suis 1330
auucugcuuaucaaggccgggc

SEQ ID NO: 2473832 - RNA, 17 nt, Brucella suis 1330
auucuggacgugcuggu

SEQ ID NO: 2473833 - RNA, 19 nt, Brucella suis 1330
auucuuccagaaugcgccg

SEQ ID NO: 2473834 - RNA, 20 nt, Brucella suis 1330
auucuugcgaaccaucacga

SEQ ID NO: 2473835 - RNA, 14 nt, Brucella suis 1330
auucuuucuugcgc

SEQ ID NO: 2473836 - RNA, 22 nt, Brucella suis 1330
auugaacugcggcugcaucggc

SEQ ID NO: 2473837 - RNA, 12 nt, Brucella suis 1330
auugaucaaccc

SEQ ID NO: 2473838 - RNA, 21 nt, Brucella suis 1330
auugaucuucuugcauucgcu

SEQ ID NO: 2473839 - RNA, 16 nt, Brucella suis 1330
auugaugauaggcugc

SEQ ID NO: 2473840 - RNA, 16 nt, Brucella suis 1330
auugauguguccggcg

SEQ ID NO: 2473841 - RNA, 16 nt, Brucella suis 1330
auugcacagcggucga

SEQ ID NO: 2473842 - RNA, 20 nt, Brucella suis 1330
auugcagacacgcuuuuucg

SEQ ID NO: 2473843 - RNA, 19 nt, Brucella suis 1330
auugcaggucuuucugcuu

SEQ ID NO: 2473844 - RNA, 19 nt, Brucella suis 1330
auugcaucgccaagcuuga

SEQ ID NO: 2473845 - RNA, 17 nt, Brucella suis 1330
auugccaaggagcgcga

SEQ ID NO: 2473846 - RNA, 19 nt, Brucella suis 1330
auugcccuaucaagaaugu

SEQ ID NO: 2473847 - RNA, 21 nt, Brucella suis 1330
auugcccuaucaagaaugugc

SEQ ID NO: 2473848 - RNA, 21 nt, Brucella suis 1330
auugcccuuccgggccgcaag

SEQ ID NO: 2473849 - RNA, 16 nt, Brucella suis 1330
auugccgcccugcgcc

SEQ ID NO: 2473850 - RNA, 19 nt, Brucella suis 1330
auugccguugagaaucgca

SEQ ID NO: 2473851 - RNA, 18 nt, Brucella suis 1330
auugccuuaaucccuuac

SEQ ID NO: 2473852 - RNA, 14 nt, Brucella suis 1330
auugcgcauugaca

SEQ ID NO: 2473853 - RNA, 14 nt, Brucella suis 1330
auugcgcuaucagc

SEQ ID NO: 2473854 - RNA, 17 nt, Brucella suis 1330
auugcgggaaggcgcga

SEQ ID NO: 2473855 - RNA, 13 nt, Brucella suis 1330
auugcuaaaugca

SEQ ID NO: 2473856 - RNA, 15 nt, Brucella suis 1330
auugcuaaaugcaag

SEQ ID NO: 2473857 - RNA, 22 nt, Brucella suis 1330
auugcugcagaacaaagaaguu

SEQ ID NO: 2473858 - RNA, 20 nt, Brucella suis 1330
auugcuguugcgcuccuauu

SEQ ID NO: 2473859 - RNA, 16 nt, Brucella suis 1330
auuggaacucgaagau

SEQ ID NO: 2473860 - RNA, 18 nt, Brucella suis 1330
auuggcaagcgccaugaa

SEQ ID NO: 2473861 - RNA, 19 nt, Brucella suis 1330
auuggcccccaacuucuuu

SEQ ID NO: 2473862 - RNA, 22 nt, Brucella suis 1330
auuggcgaccgaaugaaccggc

SEQ ID NO: 2473863 - RNA, 21 nt, Brucella suis 1330
auuggcgauuuucugcacagc

SEQ ID NO: 2473864 - RNA, 20 nt, Brucella suis 1330
auuggugccgaaugugguga

SEQ ID NO: 2473865 - RNA, 22 nt, Brucella suis 1330
auugucaggaaaaaucuguuca

SEQ ID NO: 2473866 - RNA, 15 nt, Brucella suis 1330
auugucccgccaugu

SEQ ID NO: 2473867 - RNA, 17 nt, Brucella suis 1330
auuguuccagccgggcu

SEQ ID NO: 2473868 - RNA, 23 nt, Brucella suis 1330
auuguuccggcacucgaaaauca

SEQ ID NO: 2473869 - RNA, 10 nt, Brucella suis 1330
auuguugcga

SEQ ID NO: 2473870 - RNA, 22 nt, Brucella suis 1330
auuuacguuuucgucaaaguua

SEQ ID NO: 2473871 - RNA, 23 nt, Brucella suis 1330
auuucacccgccagaugaucaua

SEQ ID NO: 2473872 - RNA, 17 nt, Brucella suis 1330
auuucaccgcgcaagau

SEQ ID NO: 2473873 - RNA, 18 nt, Brucella suis 1330
auuucagcaggcguugca

SEQ ID NO: 2473874 - RNA, 23 nt, Brucella suis 1330
auuucaucgagaauuucucuugc

SEQ ID NO: 2473875 - RNA, 14 nt, Brucella suis 1330
auuucaugaaaaug

SEQ ID NO: 2473876 - RNA, 15 nt, Brucella suis 1330
auuucaugaaaaugc

SEQ ID NO: 2473877 - RNA, 12 nt, Brucella suis 1330
auuucauggaaa

SEQ ID NO: 2473878 - RNA, 16 nt, Brucella suis 1330
auuuccacgcucgcau

SEQ ID NO: 2473879 - RNA, 12 nt, Brucella suis 1330
auuuccagcaaa

SEQ ID NO: 2473880 - RNA, 17 nt, Brucella suis 1330
auuuccagcaaaagugc

SEQ ID NO: 2473881 - RNA, 15 nt, Brucella suis 1330
auuuccaucgcuuga

SEQ ID NO: 2473882 - RNA, 21 nt, Brucella suis 1330
auuuccgaagcccgugccauc

SEQ ID NO: 2473883 - RNA, 18 nt, Brucella suis 1330
auuuccgcgacaucauca

SEQ ID NO: 2473884 - RNA, 14 nt, Brucella suis 1330
auuucgcccacgcc

SEQ ID NO: 2473885 - RNA, 12 nt, Brucella suis 1330
auuucgcgcgca

SEQ ID NO: 2473886 - RNA, 23 nt, Brucella suis 1330
auuucgguuuucgugccgcaacg

SEQ ID NO: 2473887 - RNA, 14 nt, Brucella suis 1330
auuucugaucccgc

SEQ ID NO: 2473888 - RNA, 13 nt, Brucella suis 1330
auuugaacaaaga

SEQ ID NO: 2473889 - RNA, 16 nt, Brucella suis 1330
auuugaacaaagauga

SEQ ID NO: 2473890 - RNA, 17 nt, Brucella suis 1330
auuugacguccggcuuc

SEQ ID NO: 2473891 - RNA, 19 nt, Brucella suis 1330
auuugaggauugccgccgc

SEQ ID NO: 2473892 - RNA, 18 nt, Brucella suis 1330
auuugaguuuuucuucca

SEQ ID NO: 2473893 - RNA, 15 nt, Brucella suis 1330
auuugcccgguuuuc

SEQ ID NO: 2473894 - RNA, 17 nt, Brucella suis 1330
auuuggaaguuuuccug

SEQ ID NO: 2473895 - RNA, 23 nt, Brucella suis 1330
auuuucauggguaccuuccagca

SEQ ID NO: 2473896 - RNA, 21 nt, Brucella suis 1330
auuuucauugaacccgccacc

SEQ ID NO: 2473897 - RNA, 17 nt, Brucella suis 1330
auuuucauugccgggcg

SEQ ID NO: 2473898 - RNA, 21 nt, Brucella suis 1330
auuuucgccagacgcgguuca

SEQ ID NO: 2473899 - RNA, 15 nt, Brucella suis 1330
auuuuugaaaacauc

SEQ ID NO: 2473900 - RNA, 17 nt, Brucella suis 1330
auuuuuggcagcaguca

SEQ ID NO: 2473901 - RNA, 11 nt, Brucella suis 1330
caaaaaacugg

SEQ ID NO: 2473902 - RNA, 20 nt, Brucella suis 1330
caaaaaauaucuuuuuucaa

SEQ ID NO: 2473903 - RNA, 18 nt, Brucella suis 1330
caaaaacgagggguuuug

SEQ ID NO: 2473904 - RNA, 21 nt, Brucella suis 1330
caaaaacgcguuccuucggag

SEQ ID NO: 2473905 - RNA, 22 nt, Brucella suis 1330
caaaaacgcguuccuucggagc

SEQ ID NO: 2473906 - RNA, 17 nt, Brucella suis 1330
caaaaauggaaaaaccc

SEQ ID NO: 2473907 - RNA, 15 nt, Brucella suis 1330
caaaacaaaagauua

SEQ ID NO: 2473908 - RNA, 20 nt, Brucella suis 1330
caaaacagcgccauuugcag

SEQ ID NO: 2473909 - RNA, 21 nt, Brucella suis 1330
caaaaccacgguggcucaaau

SEQ ID NO: 2473910 - RNA, 20 nt, Brucella suis 1330
caaaaccgcuucgcacuuuu

SEQ ID NO: 2473911 - RNA, 12 nt, Brucella suis 1330
caaaaccgugca

SEQ ID NO: 2473912 - RNA, 14 nt, Brucella suis 1330
caaaacgcugccag

SEQ ID NO: 2473913 - RNA, 21 nt, Brucella suis 1330
caaaacggcaggcauucagaa

SEQ ID NO: 2473914 - RNA, 21 nt, Brucella suis 1330
caaaacggcccaugagcuuca

SEQ ID NO: 2473915 - RNA, 24 nt, Brucella suis 1330
caaaagaacggggaucagaagugc

SEQ ID NO: 2473916 - RNA, 13 nt, Brucella suis 1330
caaaagcgcgccg

SEQ ID NO: 2473917 - RNA, 17 nt, Brucella suis 1330
caaaagcuccaccaccc

SEQ ID NO: 2473918 - RNA, 20 nt, Brucella suis 1330
caaaagcugccgcaacaaga

SEQ ID NO: 2473919 - RNA, 22 nt, Brucella suis 1330
caaaagcuuuguauuucaaugc

SEQ ID NO: 2473920 - RNA, 22 nt, Brucella suis 1330
caaaagucguccugugcggcug

SEQ ID NO: 2473921 - RNA, 20 nt, Brucella suis 1330
caaaaucgagugcggccugc

SEQ ID NO: 2473922 - RNA, 11 nt, Brucella suis 1330
caaacaagcuu

SEQ ID NO: 2473923 - RNA, 22 nt, Brucella suis 1330
caaacauccagccggugaaaau

SEQ ID NO: 2473924 - RNA, 13 nt, Brucella suis 1330
caaaccaggaccg

SEQ ID NO: 2473925 - RNA, 16 nt, Brucella suis 1330
caaaccaggaccgcga

SEQ ID NO: 2473926 - RNA, 13 nt, Brucella suis 1330
caaacggauugcc

SEQ ID NO: 2473927 - RNA, 18 nt, Brucella suis 1330
caaacggcaucauuggaa

SEQ ID NO: 2473928 - RNA, 15 nt, Brucella suis 1330
caaagaaaaaagccc

SEQ ID NO: 2473929 - RNA, 16 nt, Brucella suis 1330
caaagaaguugggggc

SEQ ID NO: 2473930 - RNA, 18 nt, Brucella suis 1330
caaagaucgcguaagucc

SEQ ID NO: 2473931 - RNA, 15 nt, Brucella suis 1330
caaagccgaaugcca

SEQ ID NO: 2473932 - RNA, 17 nt, Brucella suis 1330
caaagccgaaugccagu

SEQ ID NO: 2473933 - RNA, 15 nt, Brucella suis 1330
caaagcggaucagcg

SEQ ID NO: 2473934 - RNA, 17 nt, Brucella suis 1330
caaaggcaggcacaccc

SEQ ID NO: 2473935 - RNA, 21 nt, Brucella suis 1330
caaagggaauaccaagcucgu

SEQ ID NO: 2473936 - RNA, 21 nt, Brucella suis 1330
caaauucucgucacacaccaa

SEQ ID NO: 2473937 - RNA, 12 nt, Brucella suis 1330
caacaaaagaag

SEQ ID NO: 2473938 - RNA, 13 nt, Brucella suis 1330
caacaaaaugccc

SEQ ID NO: 2473939 - RNA, 14 nt, Brucella suis 1330
caacaaggcgaaau

SEQ ID NO: 2473940 - RNA, 21 nt, Brucella suis 1330
caacacgccgccgcgcggcag

SEQ ID NO: 2473941 - RNA, 19 nt, Brucella suis 1330
caacacgcgcuccagcuca

SEQ ID NO: 2473942 - RNA, 22 nt, Brucella suis 1330
caacagccguaccggcaucagc

SEQ ID NO: 2473943 - RNA, 14 nt, Brucella suis 1330
caacagccuuggcu

SEQ ID NO: 2473944 - RNA, 20 nt, Brucella suis 1330
caacaggaaagaguuggccc

SEQ ID NO: 2473945 - RNA, 22 nt, Brucella suis 1330
caacagggcgaaaagccgccuc

SEQ ID NO: 2473946 - RNA, 14 nt, Brucella suis 1330
caaccaaagaaaaa

SEQ ID NO: 2473947 - RNA, 15 nt, Brucella suis 1330
caaccauauaaagcu

SEQ ID NO: 2473948 - RNA, 21 nt, Brucella suis 1330
caaccauauuggcggcaagcu

SEQ ID NO: 2473949 - RNA, 22 nt, Brucella suis 1330
caaccaucuucuggaaguccuc

SEQ ID NO: 2473950 - RNA, 16 nt, Brucella suis 1330
caaccccaaauaccgc

SEQ ID NO: 2473951 - RNA, 16 nt, Brucella suis 1330
caacccgaugagccaa

SEQ ID NO: 2473952 - RNA, 21 nt, Brucella suis 1330
caaccgccucggccuuuuugu

SEQ ID NO: 2473953 - RNA, 13 nt, Brucella suis 1330
caaccgcgccgcu

SEQ ID NO: 2473954 - RNA, 21 nt, Brucella suis 1330
caacgaauacagugacgcgcg

SEQ ID NO: 2473955 - RNA, 22 nt, Brucella suis 1330
caacgaccagcugaauacgacc

SEQ ID NO: 2473956 - RNA, 23 nt, Brucella suis 1330
caacgacggcuguuuucgaggcc

SEQ ID NO: 2473957 - RNA, 15 nt, Brucella suis 1330
caacgcaauggagca

SEQ ID NO: 2473958 - RNA, 17 nt, Brucella suis 1330
caacgcaauggagcagg

SEQ ID NO: 2473959 - RNA, 15 nt, Brucella suis 1330
caacgcccuucaaac

SEQ ID NO: 2473960 - RNA, 21 nt, Brucella suis 1330
caacgcccuucaaaccauccu

SEQ ID NO: 2473961 - RNA, 22 nt, Brucella suis 1330
caacgcccuucaaaccauccuc

SEQ ID NO: 2473962 - RNA, 13 nt, Brucella suis 1330
caacgccgucagc

SEQ ID NO: 2473963 - RNA, 17 nt, Brucella suis 1330
caacgccgucagccccg

SEQ ID NO: 2473964 - RNA, 22 nt, Brucella suis 1330
caacgcgccaaacugcaccguc

SEQ ID NO: 2473965 - RNA, 21 nt, Brucella suis 1330
caacgcugcgugggaaaccgc

SEQ ID NO: 2473966 - RNA, 16 nt, Brucella suis 1330
caacgcuggcgcgcug

SEQ ID NO: 2473967 - RNA, 18 nt, Brucella suis 1330
caacgcugucuguuucau

SEQ ID NO: 2473968 - RNA, 22 nt, Brucella suis 1330
caacgcuugaaccgagggaggc

SEQ ID NO: 2473969 - RNA, 13 nt, Brucella suis 1330
caacuuccuugcc

SEQ ID NO: 2473970 - RNA, 16 nt, Brucella suis 1330
caagaacagccgcccc

SEQ ID NO: 2473971 - RNA, 20 nt, Brucella suis 1330
caagaauaggagccggccac

SEQ ID NO: 2473972 - RNA, 23 nt, Brucella suis 1330
caagagcggcguugaugucguca

SEQ ID NO: 2473973 - RNA, 13 nt, Brucella suis 1330
caagauagcccca

SEQ ID NO: 2473974 - RNA, 15 nt, Brucella suis 1330
caagaucagccacau

SEQ ID NO: 2473975 - RNA, 17 nt, Brucella suis 1330
caagaucauccggcuca

SEQ ID NO: 2473976 - RNA, 21 nt, Brucella suis 1330
caagaucauccggcucauagu

SEQ ID NO: 2473977 - RNA, 17 nt, Brucella suis 1330
caagaucgacaaagccu

SEQ ID NO: 2473978 - RNA, 22 nt, Brucella suis 1330
caagcacuacgucaacagccgu

SEQ ID NO: 2473979 - RNA, 16 nt, Brucella suis 1330
caagcagaugcagcgg

SEQ ID NO: 2473980 - RNA, 15 nt, Brucella suis 1330
caagcaggcauuggc

SEQ ID NO: 2473981 - RNA, 18 nt, Brucella suis 1330
caagcauuccgggccgca

SEQ ID NO: 2473982 - RNA, 14 nt, Brucella suis 1330
caagccaaagcccg

SEQ ID NO: 2473983 - RNA, 20 nt, Brucella suis 1330
caagcccagaaauccauagc

SEQ ID NO: 2473984 - RNA, 13 nt, Brucella suis 1330
caagccccagcac

SEQ ID NO: 2473985 - RNA, 14 nt, Brucella suis 1330
caagccccagcacg

SEQ ID NO: 2473986 - RNA, 21 nt, Brucella suis 1330
caagccgcggcgcgaccugcu

SEQ ID NO: 2473987 - RNA, 18 nt, Brucella suis 1330
caagccgcuccgcaccga

SEQ ID NO: 2473988 - RNA, 18 nt, Brucella suis 1330
caagcgcauccagccggc

SEQ ID NO: 2473989 - RNA, 14 nt, Brucella suis 1330
caagcgcggucagc

SEQ ID NO: 2473990 - RNA, 18 nt, Brucella suis 1330
caagcggcgucaggccaa

SEQ ID NO: 2473991 - RNA, 15 nt, Brucella suis 1330
caagcggcuccacca

SEQ ID NO: 2473992 - RNA, 16 nt, Brucella suis 1330
caagcggcuccaccac

SEQ ID NO: 2473993 - RNA, 18 nt, Brucella suis 1330
caagcgucuucugagaaa

SEQ ID NO: 2473994 - RNA, 17 nt, Brucella suis 1330
caagcgugagaccagcg

SEQ ID NO: 2473995 - RNA, 17 nt, Brucella suis 1330
caagcugcgucguggca

SEQ ID NO: 2473996 - RNA, 13 nt, Brucella suis 1330
caagcuggaaggc

SEQ ID NO: 2473997 - RNA, 18 nt, Brucella suis 1330
caagcuggaaggccaggc

SEQ ID NO: 2473998 - RNA, 15 nt, Brucella suis 1330
caagcuucaggcucu

SEQ ID NO: 2473999 - RNA, 14 nt, Brucella suis 1330
caagcuuuugcagc

SEQ ID NO: 2474000 - RNA, 18 nt, Brucella suis 1330
caaggaaaaaaccggcga

SEQ ID NO: 2474001 - RNA, 19 nt, Brucella suis 1330
caaggaaagaucugcaucc

SEQ ID NO: 2474002 - RNA, 14 nt, Brucella suis 1330
caaggaugcugcca

SEQ ID NO: 2474003 - RNA, 14 nt, Brucella suis 1330
caaggccccagauc

SEQ ID NO: 2474004 - RNA, 18 nt, Brucella suis 1330
caaggccgcgcuccagau

SEQ ID NO: 2474005 - RNA, 13 nt, Brucella suis 1330
caaggccuguucc

SEQ ID NO: 2474006 - RNA, 19 nt, Brucella suis 1330
caaggcgcgggaugacgcc

SEQ ID NO: 2474007 - RNA, 12 nt, Brucella suis 1330
caagggaaugcg

SEQ ID NO: 2474008 - RNA, 20 nt, Brucella suis 1330
caagggccgcaucggaaggg

SEQ ID NO: 2474009 - RNA, 14 nt, Brucella suis 1330
caagggcggcaagc

SEQ ID NO: 2474010 - RNA, 22 nt, Brucella suis 1330
caaggggcggaacaggcagcau

SEQ ID NO: 2474011 - RNA, 19 nt, Brucella suis 1330
caagguuugcauagggcag

SEQ ID NO: 2474012 - RNA, 16 nt, Brucella suis 1330
caagugaagcgaagaa

SEQ ID NO: 2474013 - RNA, 17 nt, Brucella suis 1330
caagugugcgcgcgcca

SEQ ID NO: 2474014 - RNA, 13 nt, Brucella suis 1330
caauaaaaggcaa

SEQ ID NO: 2474015 - RNA, 15 nt, Brucella suis 1330
caauacaccugcauc

SEQ ID NO: 2474016 - RNA, 16 nt, Brucella suis 1330
caauagcauggccccg

SEQ ID NO: 2474017 - RNA, 18 nt, Brucella suis 1330
caauagcauggccccgga

SEQ ID NO: 2474018 - RNA, 23 nt, Brucella suis 1330
caauauagcagucuucuugugaa

SEQ ID NO: 2474019 - RNA, 22 nt, Brucella suis 1330
caauaucgcgccggggccgaca

SEQ ID NO: 2474020 - RNA, 15 nt, Brucella suis 1330
caaucaccagagaca

SEQ ID NO: 2474021 - RNA, 19 nt, Brucella suis 1330
caaucagaucgaaacccgc

SEQ ID NO: 2474022 - RNA, 12 nt, Brucella suis 1330
caaucagccaga

SEQ ID NO: 2474023 - RNA, 19 nt, Brucella suis 1330
caauccaggucagcggcgg

SEQ ID NO: 2474024 - RNA, 11 nt, Brucella suis 1330
caauccccuca

SEQ ID NO: 2474025 - RNA, 18 nt, Brucella suis 1330
caauccggcgugaucggg

SEQ ID NO: 2474026 - RNA, 11 nt, Brucella suis 1330
caauccuuucc

SEQ ID NO: 2474027 - RNA, 23 nt, Brucella suis 1330
caaucgugccgccgugaaaauaa

SEQ ID NO: 2474028 - RNA, 16 nt, Brucella suis 1330
caaucguguccacaug

SEQ ID NO: 2474029 - RNA, 17 nt, Brucella suis 1330
caaucugcgcugcccuc

SEQ ID NO: 2474030 - RNA, 23 nt, Brucella suis 1330
caaugaaaacggugaucaggacc

SEQ ID NO: 2474031 - RNA, 13 nt, Brucella suis 1330
caaugaaagcaac

SEQ ID NO: 2474032 - RNA, 15 nt, Brucella suis 1330
caaugaagcaaaggu

SEQ ID NO: 2474033 - RNA, 21 nt, Brucella suis 1330
caaugacggcauuuugcgaaa

SEQ ID NO: 2474034 - RNA, 17 nt, Brucella suis 1330
caaugaucuggcgcgcg

SEQ ID NO: 2474035 - RNA, 14 nt, Brucella suis 1330
caaugaucuggcuu

SEQ ID NO: 2474036 - RNA, 17 nt, Brucella suis 1330
caaugaucuggcuugca

SEQ ID NO: 2474037 - RNA, 18 nt, Brucella suis 1330
caaugauguucggcaagg

SEQ ID NO: 2474038 - RNA, 19 nt, Brucella suis 1330
caaugauguucggcaaggc

SEQ ID NO: 2474039 - RNA, 16 nt, Brucella suis 1330
caaugcaacgaaggau

SEQ ID NO: 2474040 - RNA, 18 nt, Brucella suis 1330
caaugcaaucauaaaggc

SEQ ID NO: 2474041 - RNA, 19 nt, Brucella suis 1330
caaugcccugcugcaacaa

SEQ ID NO: 2474042 - RNA, 18 nt, Brucella suis 1330
caaugcgccgugcagggu

SEQ ID NO: 2474043 - RNA, 16 nt, Brucella suis 1330
caaugcucgauggucc

SEQ ID NO: 2474044 - RNA, 16 nt, Brucella suis 1330
caaugcugcaucgcga

SEQ ID NO: 2474045 - RNA, 15 nt, Brucella suis 1330
caauggagcaggaag

SEQ ID NO: 2474046 - RNA, 17 nt, Brucella suis 1330
caauggcccgauaucgg

SEQ ID NO: 2474047 - RNA, 15 nt, Brucella suis 1330
caauggccgcgcggu

SEQ ID NO: 2474048 - RNA, 15 nt, Brucella suis 1330
caauggcgacaugcu

SEQ ID NO: 2474049 - RNA, 13 nt, Brucella suis 1330
caauggcggcauc

SEQ ID NO: 2474050 - RNA, 22 nt, Brucella suis 1330
caauggcgggccauuuccaaug

SEQ ID NO: 2474051 - RNA, 13 nt, Brucella suis 1330
caauggcugucaa

SEQ ID NO: 2474052 - RNA, 17 nt, Brucella suis 1330
caaugugaaugaaaaaa

SEQ ID NO: 2474053 - RNA, 14 nt, Brucella suis 1330
caaugugcuggcgg

SEQ ID NO: 2474054 - RNA, 18 nt, Brucella suis 1330
caauucaugcccuauacc

SEQ ID NO: 2474055 - RNA, 13 nt, Brucella suis 1330
caauucccuggcu

SEQ ID NO: 2474056 - RNA, 21 nt, Brucella suis 1330
cacaacugcggguaugcgcau

SEQ ID NO: 2474057 - RNA, 13 nt, Brucella suis 1330
cacaagcgccggu

SEQ ID NO: 2474058 - RNA, 15 nt, Brucella suis 1330
cacaaugugaaugaa

SEQ ID NO: 2474059 - RNA, 19 nt, Brucella suis 1330
cacaccaauguccaguugg

SEQ ID NO: 2474060 - RNA, 13 nt, Brucella suis 1330
cacaccugcacca

SEQ ID NO: 2474061 - RNA, 13 nt, Brucella suis 1330
cacacgaacagca

SEQ ID NO: 2474062 - RNA, 14 nt, Brucella suis 1330
cacacuuuucggga

SEQ ID NO: 2474063 - RNA, 11 nt, Brucella suis 1330
cacagccccuu

SEQ ID NO: 2474064 - RNA, 15 nt, Brucella suis 1330
cacagccccuugccc

SEQ ID NO: 2474065 - RNA, 21 nt, Brucella suis 1330
cacagccgguucggauccucc

SEQ ID NO: 2474066 - RNA, 10 nt, Brucella suis 1330
cacagccuug

SEQ ID NO: 2474067 - RNA, 22 nt, Brucella suis 1330
cacagccuuggaauggcgcaca

SEQ ID NO: 2474068 - RNA, 15 nt, Brucella suis 1330
cacaggaucgcaccg

SEQ ID NO: 2474069 - RNA, 20 nt, Brucella suis 1330
cacaggcucgggcagcuugu

SEQ ID NO: 2474070 - RNA, 20 nt, Brucella suis 1330
cacagucacgccaucagcau

SEQ ID NO: 2474071 - RNA, 16 nt, Brucella suis 1330
cacauagccugcaagc

SEQ ID NO: 2474072 - RNA, 18 nt, Brucella suis 1330
cacaucgagacggcgcuc

SEQ ID NO: 2474073 - RNA, 13 nt, Brucella suis 1330
cacaugcgcgccc

SEQ ID NO: 2474074 - RNA, 15 nt, Brucella suis 1330
cacaugcgcgcccuc

SEQ ID NO: 2474075 - RNA, 12 nt, Brucella suis 1330
cacauugccuuc

SEQ ID NO: 2474076 - RNA, 21 nt, Brucella suis 1330
cacauugccuucgcgccaggc

SEQ ID NO: 2474077 - RNA, 13 nt, Brucella suis 1330
cacauuucaugaa

SEQ ID NO: 2474078 - RNA, 14 nt, Brucella suis 1330
caccaagaccgccg

SEQ ID NO: 2474079 - RNA, 23 nt, Brucella suis 1330
caccacaccaucgcccgccgcga

SEQ ID NO: 2474080 - RNA, 20 nt, Brucella suis 1330
caccacaugcuccagggugc

SEQ ID NO: 2474081 - RNA, 18 nt, Brucella suis 1330
caccaccgggcagucagc

SEQ ID NO: 2474082 - RNA, 15 nt, Brucella suis 1330
caccagaaauggccc

SEQ ID NO: 2474083 - RNA, 22 nt, Brucella suis 1330
caccagaccaucggcaacaaga

SEQ ID NO: 2474084 - RNA, 12 nt, Brucella suis 1330
caccagagacag

SEQ ID NO: 2474085 - RNA, 15 nt, Brucella suis 1330
caccagagacagugg

SEQ ID NO: 2474086 - RNA, 13 nt, Brucella suis 1330
caccagcgcgccg

SEQ ID NO: 2474087 - RNA, 14 nt, Brucella suis 1330
caccagcgcgccga

SEQ ID NO: 2474088 - RNA, 20 nt, Brucella suis 1330
caccagcgcgccgaucacga

SEQ ID NO: 2474089 - RNA, 22 nt, Brucella suis 1330
caccagcgcgccgaucacgacc

SEQ ID NO: 2474090 - RNA, 17 nt, Brucella suis 1330
caccauauucguccacg

SEQ ID NO: 2474091 - RNA, 16 nt, Brucella suis 1330
caccauauuugccgcc

SEQ ID NO: 2474092 - RNA, 11 nt, Brucella suis 1330
caccaucaucg

SEQ ID NO: 2474093 - RNA, 16 nt, Brucella suis 1330
caccaucgcccgccgc

SEQ ID NO: 2474094 - RNA, 19 nt, Brucella suis 1330
caccaugcggcuccaguuc

SEQ ID NO: 2474095 - RNA, 15 nt, Brucella suis 1330
caccauuacaaaaau

SEQ ID NO: 2474096 - RNA, 13 nt, Brucella suis 1330
caccauucugccc

SEQ ID NO: 2474097 - RNA, 15 nt, Brucella suis 1330
caccauucuugcgcc

SEQ ID NO: 2474098 - RNA, 18 nt, Brucella suis 1330
caccauugggcauggaaa

SEQ ID NO: 2474099 - RNA, 20 nt, Brucella suis 1330
cacccagaaaacgacgcgca

SEQ ID NO: 2474100 - RNA, 19 nt, Brucella suis 1330
cacccagcauauggaugag

SEQ ID NO: 2474101 - RNA, 23 nt, Brucella suis 1330
cacccagcccgaagaccaggccc

SEQ ID NO: 2474102 - RNA, 17 nt, Brucella suis 1330
caccccaugagaaggca

SEQ ID NO: 2474103 - RNA, 12 nt, Brucella suis 1330
caccccgcgcuu

SEQ ID NO: 2474104 - RNA, 14 nt, Brucella suis 1330
cacccgaaacggug

SEQ ID NO: 2474105 - RNA, 17 nt, Brucella suis 1330
cacccgauaaacccgcc

SEQ ID NO: 2474106 - RNA, 19 nt, Brucella suis 1330
cacccgauaaacccgcccc

SEQ ID NO: 2474107 - RNA, 16 nt, Brucella suis 1330
cacccgcacgccgugc

SEQ ID NO: 2474108 - RNA, 21 nt, Brucella suis 1330
cacccggcaccgcaaagagaa

SEQ ID NO: 2474109 - RNA, 13 nt, Brucella suis 1330
cacccggccgccc

SEQ ID NO: 2474110 - RNA, 14 nt, Brucella suis 1330
cacccggccgcccu

SEQ ID NO: 2474111 - RNA, 15 nt, Brucella suis 1330
cacccuauuccccua

SEQ ID NO: 2474112 - RNA, 16 nt, Brucella suis 1330
cacccucggugccaag

SEQ ID NO: 2474113 - RNA, 21 nt, Brucella suis 1330
cacccuuggcgacggccagcg

SEQ ID NO: 2474114 - RNA, 22 nt, Brucella suis 1330
cacccuuggcgacggccagcgc

SEQ ID NO: 2474115 - RNA, 23 nt, Brucella suis 1330
cacccuugguugcgcgccagugc

SEQ ID NO: 2474116 - RNA, 21 nt, Brucella suis 1330
cacccuuugugccauagacgc

SEQ ID NO: 2474117 - RNA, 18 nt, Brucella suis 1330
cacccuuuucgggaugcg

SEQ ID NO: 2474118 - RNA, 15 nt, Brucella suis 1330
caccgaaauccaggc

SEQ ID NO: 2474119 - RNA, 22 nt, Brucella suis 1330
caccgaccggcacccacugccc

SEQ ID NO: 2474120 - RNA, 14 nt, Brucella suis 1330
caccgaggccgcca

SEQ ID NO: 2474121 - RNA, 15 nt, Brucella suis 1330
caccgaggccgccac

SEQ ID NO: 2474122 - RNA, 17 nt, Brucella suis 1330
caccgauggccaggaaa

SEQ ID NO: 2474123 - RNA, 20 nt, Brucella suis 1330
caccgcaaagagaaccaccu

SEQ ID NO: 2474124 - RNA, 18 nt, Brucella suis 1330
caccgcaaguggcgcuga

SEQ ID NO: 2474125 - RNA, 23 nt, Brucella suis 1330
caccgcacguugggggacgggcg

SEQ ID NO: 2474126 - RNA, 15 nt, Brucella suis 1330
caccgccagcagaac

SEQ ID NO: 2474127 - RNA, 23 nt, Brucella suis 1330
caccgccccgcgugaugagccgc

SEQ ID NO: 2474128 - RNA, 23 nt, Brucella suis 1330
caccgcccggaucaaaccggcca

SEQ ID NO: 2474129 - RNA, 14 nt, Brucella suis 1330
caccgccgaucagg

SEQ ID NO: 2474130 - RNA, 19 nt, Brucella suis 1330
caccgcgaaagccagaacc

SEQ ID NO: 2474131 - RNA, 15 nt, Brucella suis 1330
caccgcgccggaagg

SEQ ID NO: 2474132 - RNA, 16 nt, Brucella suis 1330
caccgcgccggaaggc

SEQ ID NO: 2474133 - RNA, 23 nt, Brucella suis 1330
caccgcgggaaaaaucgcgcggc

SEQ ID NO: 2474134 - RNA, 19 nt, Brucella suis 1330
caccgcgugaagaauggca

SEQ ID NO: 2474135 - RNA, 22 nt, Brucella suis 1330
caccgcgugaagaauggcaagc

SEQ ID NO: 2474136 - RNA, 19 nt, Brucella suis 1330
caccgcucgcccuccggac

SEQ ID NO: 2474137 - RNA, 17 nt, Brucella suis 1330
caccggcgggagcggca

SEQ ID NO: 2474138 - RNA, 20 nt, Brucella suis 1330
caccggcuggcacaaagcgg

SEQ ID NO: 2474139 - RNA, 13 nt, Brucella suis 1330
caccgucaccggc

SEQ ID NO: 2474140 - RNA, 14 nt, Brucella suis 1330
caccgugcuccaga

SEQ ID NO: 2474141 - RNA, 16 nt, Brucella suis 1330
caccgugcuccagaua

SEQ ID NO: 2474142 - RNA, 19 nt, Brucella suis 1330
caccguuucaaaccccagu

SEQ ID NO: 2474143 - RNA, 21 nt, Brucella suis 1330
caccugacggauuucggcggc

SEQ ID NO: 2474144 - RNA, 21 nt, Brucella suis 1330
caccugauacaaaacgccggc

SEQ ID NO: 2474145 - RNA, 19 nt, Brucella suis 1330
caccugcggcgccagaugc

SEQ ID NO: 2474146 - RNA, 15 nt, Brucella suis 1330
caccugggccacggc

SEQ ID NO: 2474147 - RNA, 16 nt, Brucella suis 1330
caccuucaugaaacag

SEQ ID NO: 2474148 - RNA, 20 nt, Brucella suis 1330
caccuuccugccuuugaaga

SEQ ID NO: 2474149 - RNA, 15 nt, Brucella suis 1330
caccuucggccagcg

SEQ ID NO: 2474150 - RNA, 14 nt, Brucella suis 1330
caccuugccgggcg

SEQ ID NO: 2474151 - RNA, 14 nt, Brucella suis 1330
cacgaaacgccugc

SEQ ID NO: 2474152 - RNA, 22 nt, Brucella suis 1330
cacgaacagaucgccaagcgca

SEQ ID NO: 2474153 - RNA, 23 nt, Brucella suis 1330
cacgaaccguguucgcacaagaa

SEQ ID NO: 2474154 - RNA, 15 nt, Brucella suis 1330
cacgaacgacaccuu

SEQ ID NO: 2474155 - RNA, 17 nt, Brucella suis 1330
cacgacaauggcaauau

SEQ ID NO: 2474156 - RNA, 15 nt, Brucella suis 1330
cacgagaaccgcgcc

SEQ ID NO: 2474157 - RNA, 13 nt, Brucella suis 1330
cacgagaacggua

SEQ ID NO: 2474158 - RNA, 13 nt, Brucella suis 1330
cacgaugagaaug

SEQ ID NO: 2474159 - RNA, 18 nt, Brucella suis 1330
cacgaugcgcagccgcgu

SEQ ID NO: 2474160 - RNA, 22 nt, Brucella suis 1330
cacgaugggacaucuuugcggc

SEQ ID NO: 2474161 - RNA, 13 nt, Brucella suis 1330
cacgcaaggcggc

SEQ ID NO: 2474162 - RNA, 22 nt, Brucella suis 1330
cacgcaaugugcgggcuucuuc

SEQ ID NO: 2474163 - RNA, 17 nt, Brucella suis 1330
cacgcaggacaagccgc

SEQ ID NO: 2474164 - RNA, 16 nt, Brucella suis 1330
cacgcccagcgcggca

SEQ ID NO: 2474165 - RNA, 22 nt, Brucella suis 1330
cacgcccuuggcgagaauugca

SEQ ID NO: 2474166 - RNA, 21 nt, Brucella suis 1330
cacgccgaggaauuucagcga

SEQ ID NO: 2474167 - RNA, 17 nt, Brucella suis 1330
cacgccgcgacuccuug

SEQ ID NO: 2474168 - RNA, 14 nt, Brucella suis 1330
cacgcgcagcagca

SEQ ID NO: 2474169 - RNA, 12 nt, Brucella suis 1330
cacgcgcaugcc

SEQ ID NO: 2474170 - RNA, 14 nt, Brucella suis 1330
cacgcgccgccauc

SEQ ID NO: 2474171 - RNA, 15 nt, Brucella suis 1330
cacgcgccgccaucu

SEQ ID NO: 2474172 - RNA, 15 nt, Brucella suis 1330
cacgcgcuccagcuc

SEQ ID NO: 2474173 - RNA, 20 nt, Brucella suis 1330
cacgcgggcgcagcgacagc

SEQ ID NO: 2474174 - RNA, 13 nt, Brucella suis 1330
cacgcucaacacu

SEQ ID NO: 2474175 - RNA, 13 nt, Brucella suis 1330
cacgcuccacacg

SEQ ID NO: 2474176 - RNA, 14 nt, Brucella suis 1330
cacgcuccgccacu

SEQ ID NO: 2474177 - RNA, 14 nt, Brucella suis 1330
cacgcuccgggcuu

SEQ ID NO: 2474178 - RNA, 12 nt, Brucella suis 1330
cacgcuugcccg

SEQ ID NO: 2474179 - RNA, 17 nt, Brucella suis 1330
cacgcuuggccucuucc

SEQ ID NO: 2474180 - RNA, 16 nt, Brucella suis 1330
cacggacgaucuggaa

SEQ ID NO: 2474181 - RNA, 18 nt, Brucella suis 1330
cacggauagaaccaccgc

SEQ ID NO: 2474182 - RNA, 16 nt, Brucella suis 1330
cacggauuuccaccac

SEQ ID NO: 2474183 - RNA, 23 nt, Brucella suis 1330
cacggauuuccaccacgcgcgcu

SEQ ID NO: 2474184 - RNA, 12 nt, Brucella suis 1330
cacggcagagug

SEQ ID NO: 2474185 - RNA, 13 nt, Brucella suis 1330
cacggccgaucgc

SEQ ID NO: 2474186 - RNA, 19 nt, Brucella suis 1330
cacggcgaaagcugccgcg

SEQ ID NO: 2474187 - RNA, 21 nt, Brucella suis 1330
cacggcgaaugacuucaucgc

SEQ ID NO: 2474188 - RNA, 22 nt, Brucella suis 1330
cacggcgccugugugaacaggu

SEQ ID NO: 2474189 - RNA, 18 nt, Brucella suis 1330
cacggcuucauccagauc

SEQ ID NO: 2474190 - RNA, 23 nt, Brucella suis 1330
cacggugaagacauggcgggcca

SEQ ID NO: 2474191 - RNA, 15 nt, Brucella suis 1330
cacgguugccuugcu

SEQ ID NO: 2474192 - RNA, 22 nt, Brucella suis 1330
cacgucaucaucgucuucaagc

SEQ ID NO: 2474193 - RNA, 23 nt, Brucella suis 1330
cacgucaucaucgucuucaagca

SEQ ID NO: 2474194 - RNA, 20 nt, Brucella suis 1330
cacguccggcacuucgccca

SEQ ID NO: 2474195 - RNA, 14 nt, Brucella suis 1330
cacguccuuggcac

SEQ ID NO: 2474196 - RNA, 22 nt, Brucella suis 1330
cacguccuuggcacguugcgcc

SEQ ID NO: 2474197 - RNA, 21 nt, Brucella suis 1330
cacgucggucaaugccaccgc

SEQ ID NO: 2474198 - RNA, 16 nt, Brucella suis 1330
cacgucguggccagcc

SEQ ID NO: 2474199 - RNA, 16 nt, Brucella suis 1330
cacguuugacagccug

SEQ ID NO: 2474200 - RNA, 19 nt, Brucella suis 1330
cacuagaauuuguaguuca

SEQ ID NO: 2474201 - RNA, 22 nt, Brucella suis 1330
cacucggcggcaucgcccgaga

SEQ ID NO: 2474202 - RNA, 12 nt, Brucella suis 1330
cacucugccugc

SEQ ID NO: 2474203 - RNA, 20 nt, Brucella suis 1330
cacucuuguggugcuugccc

SEQ ID NO: 2474204 - RNA, 21 nt, Brucella suis 1330
cacugaccuuuugacggcccg

SEQ ID NO: 2474205 - RNA, 14 nt, Brucella suis 1330
cacugcaaggaagg

SEQ ID NO: 2474206 - RNA, 22 nt, Brucella suis 1330
cacuggaaauauucgggcggca

SEQ ID NO: 2474207 - RNA, 23 nt, Brucella suis 1330
cacuggcaacgacggcuguuuuc

SEQ ID NO: 2474208 - RNA, 14 nt, Brucella suis 1330
cacuggcagcauga

SEQ ID NO: 2474209 - RNA, 22 nt, Brucella suis 1330
cacuggucgggauugucgauau

SEQ ID NO: 2474210 - RNA, 22 nt, Brucella suis 1330
cacugucgggcucaggcugagu

SEQ ID NO: 2474211 - RNA, 17 nt, Brucella suis 1330
cacuuacaaaugcaagu

SEQ ID NO: 2474212 - RNA, 22 nt, Brucella suis 1330
cacuucccgcgccucacccucc

SEQ ID NO: 2474213 - RNA, 19 nt, Brucella suis 1330
cacuuccgcucaucgcagu

SEQ ID NO: 2474214 - RNA, 22 nt, Brucella suis 1330
cacuucuuuauggcucagagaa

SEQ ID NO: 2474215 - RNA, 12 nt, Brucella suis 1330
cacuuuuaaagc

SEQ ID NO: 2474216 - RNA, 13 nt, Brucella suis 1330
cagaaagaaagcu

SEQ ID NO: 2474217 - RNA, 15 nt, Brucella suis 1330
cagaaagaaagcugu

SEQ ID NO: 2474218 - RNA, 10 nt, Brucella suis 1330
cagaaaucag

SEQ ID NO: 2474219 - RNA, 12 nt, Brucella suis 1330
cagaaaucaguc

SEQ ID NO: 2474220 - RNA, 22 nt, Brucella suis 1330
cagaaauggccccauaaagcug

SEQ ID NO: 2474221 - RNA, 18 nt, Brucella suis 1330
cagaaauugcacaugagc

SEQ ID NO: 2474222 - RNA, 23 nt, Brucella suis 1330
cagaacaaugccuugagaugagc

SEQ ID NO: 2474223 - RNA, 17 nt, Brucella suis 1330
cagaaccaccagagcaa

SEQ ID NO: 2474224 - RNA, 15 nt, Brucella suis 1330
cagaaccgcaucgac

SEQ ID NO: 2474225 - RNA, 20 nt, Brucella suis 1330
cagaacgauggugcggcgcg

SEQ ID NO: 2474226 - RNA, 16 nt, Brucella suis 1330
cagaacuucgccaagc

SEQ ID NO: 2474227 - RNA, 13 nt, Brucella suis 1330
cagaagaaagggc

SEQ ID NO: 2474228 - RNA, 14 nt, Brucella suis 1330
cagaagaaagggcg

SEQ ID NO: 2474229 - RNA, 19 nt, Brucella suis 1330
cagaagauagacaacgcgc

SEQ ID NO: 2474230 - RNA, 20 nt, Brucella suis 1330
cagaagauagacaacgcgca

SEQ ID NO: 2474231 - RNA, 20 nt, Brucella suis 1330
cagaagaucgucggcaagcu

SEQ ID NO: 2474232 - RNA, 15 nt, Brucella suis 1330
cagaagcaccagcgc

SEQ ID NO: 2474233 - RNA, 22 nt, Brucella suis 1330
cagaagcgcguccuucaggccg

SEQ ID NO: 2474234 - RNA, 23 nt, Brucella suis 1330
cagaagcgcguccuucaggccgu

SEQ ID NO: 2474235 - RNA, 18 nt, Brucella suis 1330
cagaagcguaaugccccg

SEQ ID NO: 2474236 - RNA, 15 nt, Brucella suis 1330
cagaaggcgcugcac

SEQ ID NO: 2474237 - RNA, 20 nt, Brucella suis 1330
cagaagguuucagccuccug

SEQ ID NO: 2474238 - RNA, 14 nt, Brucella suis 1330
cagaauaucugaau

SEQ ID NO: 2474239 - RNA, 17 nt, Brucella suis 1330
cagaauaucugaaucuc

SEQ ID NO: 2474240 - RNA, 15 nt, Brucella suis 1330
cagaaugcauuuuuc

SEQ ID NO: 2474241 - RNA, 20 nt, Brucella suis 1330
cagaaugcauuuuucgccgc

SEQ ID NO: 2474242 - RNA, 13 nt, Brucella suis 1330
cagacacgcuuuu

SEQ ID NO: 2474243 - RNA, 17 nt, Brucella suis 1330
cagacagccuugucgcc

SEQ ID NO: 2474244 - RNA, 19 nt, Brucella suis 1330
cagaccacccggccgcccu

SEQ ID NO: 2474245 - RNA, 13 nt, Brucella suis 1330
cagaccccaucag

SEQ ID NO: 2474246 - RNA, 22 nt, Brucella suis 1330
cagaccgcccccucgcaaccau

SEQ ID NO: 2474247 - RNA, 23 nt, Brucella suis 1330
cagaccgcccccucgcaaccaug

SEQ ID NO: 2474248 - RNA, 19 nt, Brucella suis 1330
cagacgaaaauaucggcug

SEQ ID NO: 2474249 - RNA, 19 nt, Brucella suis 1330
cagacgauccucaagcauc

SEQ ID NO: 2474250 - RNA, 16 nt, Brucella suis 1330
cagacgauuuucgcca

SEQ ID NO: 2474251 - RNA, 15 nt, Brucella suis 1330
cagacgcagcgcauu

SEQ ID NO: 2474252 - RNA, 19 nt, Brucella suis 1330
cagacggccaccgggcuuc

SEQ ID NO: 2474253 - RNA, 17 nt, Brucella suis 1330
cagacgguccgccggau

SEQ ID NO: 2474254 - RNA, 11 nt, Brucella suis 1330
cagacgugacc

SEQ ID NO: 2474255 - RNA, 14 nt, Brucella suis 1330
cagacguuccagau

SEQ ID NO: 2474256 - RNA, 20 nt, Brucella suis 1330
cagacguuccagauugccgc

SEQ ID NO: 2474257 - RNA, 16 nt, Brucella suis 1330
cagacuagacaaagcg

SEQ ID NO: 2474258 - RNA, 12 nt, Brucella suis 1330
cagagcaaauac

SEQ ID NO: 2474259 - RNA, 18 nt, Brucella suis 1330
cagagccucggcgcggac

SEQ ID NO: 2474260 - RNA, 15 nt, Brucella suis 1330
cagagcggguuccca

SEQ ID NO: 2474261 - RNA, 16 nt, Brucella suis 1330
cagagcggguucccac

SEQ ID NO: 2474262 - RNA, 18 nt, Brucella suis 1330
cagagcggguucccacuu

SEQ ID NO: 2474263 - RNA, 22 nt, Brucella suis 1330
cagagcgguuccuguuuuaaca

SEQ ID NO: 2474264 - RNA, 15 nt, Brucella suis 1330
cagagcuucgccgcc

SEQ ID NO: 2474265 - RNA, 16 nt, Brucella suis 1330
cagagcuucgccgcca

SEQ ID NO: 2474266 - RNA, 14 nt, Brucella suis 1330
cagauaaagcagga

SEQ ID NO: 2474267 - RNA, 22 nt, Brucella suis 1330
cagauaaagcaggaucgacagc

SEQ ID NO: 2474268 - RNA, 14 nt, Brucella suis 1330
cagauauccauugu

SEQ ID NO: 2474269 - RNA, 13 nt, Brucella suis 1330
cagaucaagcgcu

SEQ ID NO: 2474270 - RNA, 13 nt, Brucella suis 1330
cagaucaucguca

SEQ ID NO: 2474271 - RNA, 21 nt, Brucella suis 1330
cagaucaucgucaugcagacg

SEQ ID NO: 2474272 - RNA, 18 nt, Brucella suis 1330
cagaucaugaggacauuc

SEQ ID NO: 2474273 - RNA, 18 nt, Brucella suis 1330
cagaucccguuuugagau

SEQ ID NO: 2474274 - RNA, 15 nt, Brucella suis 1330
cagauccgcugacug

SEQ ID NO: 2474275 - RNA, 20 nt, Brucella suis 1330
cagaucgacagcggaagcgc

SEQ ID NO: 2474276 - RNA, 17 nt, Brucella suis 1330
cagaucggaaucaaaac

SEQ ID NO: 2474277 - RNA, 17 nt, Brucella suis 1330
cagaucggcaagauggc

SEQ ID NO: 2474278 - RNA, 16 nt, Brucella suis 1330
cagaucggcaagcgca

SEQ ID NO: 2474279 - RNA, 23 nt, Brucella suis 1330
cagaucggccauuucggcuucca

SEQ ID NO: 2474280 - RNA, 11 nt, Brucella suis 1330
cagaucggccu

SEQ ID NO: 2474281 - RNA, 15 nt, Brucella suis 1330
cagaucgugaucuuc

SEQ ID NO: 2474282 - RNA, 19 nt, Brucella suis 1330
cagaucgugaucuucggca

SEQ ID NO: 2474283 - RNA, 19 nt, Brucella suis 1330
cagaugagcggcagcagcc

SEQ ID NO: 2474284 - RNA, 22 nt, Brucella suis 1330
cagaugcagcggaacuggauga

SEQ ID NO: 2474285 - RNA, 15 nt, Brucella suis 1330
cagaugcggcgcgca

SEQ ID NO: 2474286 - RNA, 22 nt, Brucella suis 1330
cagauggcguucugaaaccgca

SEQ ID NO: 2474287 - RNA, 14 nt, Brucella suis 1330
cagauggggcuggc

SEQ ID NO: 2474288 - RNA, 22 nt, Brucella suis 1330
cagaugugccaccagcacacag

SEQ ID NO: 2474289 - RNA, 22 nt, Brucella suis 1330
cagauugaucccgaucugagaa

SEQ ID NO: 2474290 - RNA, 16 nt, Brucella suis 1330
cagauugaucgcaagc

SEQ ID NO: 2474291 - RNA, 19 nt, Brucella suis 1330
cagauugaucgcaagccaa

SEQ ID NO: 2474292 - RNA, 19 nt, Brucella suis 1330
cagauugccgcgcgcggcu

SEQ ID NO: 2474293 - RNA, 18 nt, Brucella suis 1330
cagauugcgggcaagcau

SEQ ID NO: 2474294 - RNA, 14 nt, Brucella suis 1330
cagcaaaaccguau

SEQ ID NO: 2474295 - RNA, 16 nt, Brucella suis 1330
cagcaaaagugagaaa

SEQ ID NO: 2474296 - RNA, 17 nt, Brucella suis 1330
cagcaaaagugagaaac

SEQ ID NO: 2474297 - RNA, 13 nt, Brucella suis 1330
cagcaaagcccca

SEQ ID NO: 2474298 - RNA, 18 nt, Brucella suis 1330
cagcaaagcgauuucaca

SEQ ID NO: 2474299 - RNA, 20 nt, Brucella suis 1330
cagcaauuccugcgccaccu

SEQ ID NO: 2474300 - RNA, 15 nt, Brucella suis 1330
cagcacaagccaucc

SEQ ID NO: 2474301 - RNA, 13 nt, Brucella suis 1330
cagcaccggcgga

SEQ ID NO: 2474302 - RNA, 15 nt, Brucella suis 1330
cagcacuuccagaua

SEQ ID NO: 2474303 - RNA, 14 nt, Brucella suis 1330
cagcagaaggauga

SEQ ID NO: 2474304 - RNA, 17 nt, Brucella suis 1330
cagcagaaggaugaucg

SEQ ID NO: 2474305 - RNA, 20 nt, Brucella suis 1330
cagcagauccgugaugaugg

SEQ ID NO: 2474306 - RNA, 20 nt, Brucella suis 1330
cagcagcaggggcagcgcgc

SEQ ID NO: 2474307 - RNA, 14 nt, Brucella suis 1330
cagcagcaucgccg

SEQ ID NO: 2474308 - RNA, 15 nt, Brucella suis 1330
cagcagcaucgccgc

SEQ ID NO: 2474309 - RNA, 20 nt, Brucella suis 1330
cagcagcaucgccgccagca

SEQ ID NO: 2474310 - RNA, 15 nt, Brucella suis 1330
cagcagcgcaaacuc

SEQ ID NO: 2474311 - RNA, 15 nt, Brucella suis 1330
cagcaggccggcgag

SEQ ID NO: 2474312 - RNA, 13 nt, Brucella suis 1330
cagcaggcgcgca

SEQ ID NO: 2474313 - RNA, 22 nt, Brucella suis 1330
cagcaggcgcgcagcaaccauc

SEQ ID NO: 2474314 - RNA, 21 nt, Brucella suis 1330
cagcagguugacgauggggau

SEQ ID NO: 2474315 - RNA, 22 nt, Brucella suis 1330
cagcauauugccgagcauggcc

SEQ ID NO: 2474316 - RNA, 22 nt, Brucella suis 1330
cagcaucugcgcgaggaaauca

SEQ ID NO: 2474317 - RNA, 13 nt, Brucella suis 1330
cagcaucuugcca

SEQ ID NO: 2474318 - RNA, 18 nt, Brucella suis 1330
cagcaugaucgccaccgg

SEQ ID NO: 2474319 - RNA, 21 nt, Brucella suis 1330
cagcaugucauccgaaaccag

SEQ ID NO: 2474320 - RNA, 22 nt, Brucella suis 1330
cagcauugaacgccuuuuucac

SEQ ID NO: 2474321 - RNA, 15 nt, Brucella suis 1330
cagcauuucagggcu

SEQ ID NO: 2474322 - RNA, 18 nt, Brucella suis 1330
cagcauuucagggcugcc

SEQ ID NO: 2474323 - RNA, 19 nt, Brucella suis 1330
cagccaagcgccacgcggg

SEQ ID NO: 2474324 - RNA, 22 nt, Brucella suis 1330
cagccacgauaccgagaacggc

SEQ ID NO: 2474325 - RNA, 12 nt, Brucella suis 1330
cagccacggcag

SEQ ID NO: 2474326 - RNA, 17 nt, Brucella suis 1330
cagccacggcagagugg

SEQ ID NO: 2474327 - RNA, 14 nt, Brucella suis 1330
cagccagaaagaag

SEQ ID NO: 2474328 - RNA, 20 nt, Brucella suis 1330
cagccagaaagaagaugagc

SEQ ID NO: 2474329 - RNA, 20 nt, Brucella suis 1330
cagccagaaucugcgcgucg

SEQ ID NO: 2474330 - RNA, 13 nt, Brucella suis 1330
cagccagccgaaa

SEQ ID NO: 2474331 - RNA, 17 nt, Brucella suis 1330
cagccaucaggauuugg

SEQ ID NO: 2474332 - RNA, 13 nt, Brucella suis 1330
cagccccgccaga

SEQ ID NO: 2474333 - RNA, 13 nt, Brucella suis 1330
cagccccuugccc

SEQ ID NO: 2474334 - RNA, 17 nt, Brucella suis 1330
cagccccuugccccggc

SEQ ID NO: 2474335 - RNA, 18 nt, Brucella suis 1330
cagcccgaagaccaggcc

SEQ ID NO: 2474336 - RNA, 21 nt, Brucella suis 1330
cagcccgccccaagaucagcc

SEQ ID NO: 2474337 - RNA, 22 nt, Brucella suis 1330
cagcccgccccaagaucagcca

SEQ ID NO: 2474338 - RNA, 22 nt, Brucella suis 1330
cagcccgcuuuuacgcgccgcc

SEQ ID NO: 2474339 - RNA, 13 nt, Brucella suis 1330
cagcccggacagg

SEQ ID NO: 2474340 - RNA, 16 nt, Brucella suis 1330
cagcccugccggcuca

SEQ ID NO: 2474341 - RNA, 21 nt, Brucella suis 1330
cagcccuucaucaagcugucg

SEQ ID NO: 2474342 - RNA, 13 nt, Brucella suis 1330
cagccgaaaugag

SEQ ID NO: 2474343 - RNA, 17 nt, Brucella suis 1330
cagccgaucaucagcga

SEQ ID NO: 2474344 - RNA, 23 nt, Brucella suis 1330
cagccgaucaucagcgaauaggg

SEQ ID NO: 2474345 - RNA, 19 nt, Brucella suis 1330
cagccgcgaucacagccgc

SEQ ID NO: 2474346 - RNA, 21 nt, Brucella suis 1330
cagccgcgaucacagccgcgc

SEQ ID NO: 2474347 - RNA, 22 nt, Brucella suis 1330
cagccgcgaucacagccgcgcc

SEQ ID NO: 2474348 - RNA, 18 nt, Brucella suis 1330
cagccggaaugccucccg

SEQ ID NO: 2474349 - RNA, 16 nt, Brucella suis 1330
cagccgggcagugccg

SEQ ID NO: 2474350 - RNA, 14 nt, Brucella suis 1330
cagccgggcuuucc

SEQ ID NO: 2474351 - RNA, 17 nt, Brucella suis 1330
cagccguaccggcauca

SEQ ID NO: 2474352 - RNA, 20 nt, Brucella suis 1330
cagccgucgagggcaccggc

SEQ ID NO: 2474353 - RNA, 15 nt, Brucella suis 1330
cagccgugagcaugg

SEQ ID NO: 2474354 - RNA, 16 nt, Brucella suis 1330
cagccguuccggcucg

SEQ ID NO: 2474355 - RNA, 23 nt, Brucella suis 1330
cagccguugcgaucuucugcucg

SEQ ID NO: 2474356 - RNA, 16 nt, Brucella suis 1330
cagccuggaugacauc

SEQ ID NO: 2474357 - RNA, 14 nt, Brucella suis 1330
cagcgaaggcugcc

SEQ ID NO: 2474358 - RNA, 15 nt, Brucella suis 1330
cagcgaauagaccau

SEQ ID NO: 2474359 - RNA, 17 nt, Brucella suis 1330
cagcgaauagaccaugc

SEQ ID NO: 2474360 - RNA, 21 nt, Brucella suis 1330
cagcgaauagggaaacggcca

SEQ ID NO: 2474361 - RNA, 20 nt, Brucella suis 1330
cagcgacaggguaagcgccu

SEQ ID NO: 2474362 - RNA, 21 nt, Brucella suis 1330
cagcgacaggguaagcgccuu

SEQ ID NO: 2474363 - RNA, 16 nt, Brucella suis 1330
cagcgacccgcgcccu

SEQ ID NO: 2474364 - RNA, 21 nt, Brucella suis 1330
cagcgacuuccaguggaagca

SEQ ID NO: 2474365 - RNA, 20 nt, Brucella suis 1330
cagcgauaguguccacgcgc

SEQ ID NO: 2474366 - RNA, 23 nt, Brucella suis 1330
cagcgaugauagcgcccgccucg

SEQ ID NO: 2474367 - RNA, 18 nt, Brucella suis 1330
cagcgauggcgacgcgcu

SEQ ID NO: 2474368 - RNA, 19 nt, Brucella suis 1330
cagcgauggcgacgcgcuc

SEQ ID NO: 2474369 - RNA, 17 nt, Brucella suis 1330
cagcgcaaagccugcua

SEQ ID NO: 2474370 - RNA, 20 nt, Brucella suis 1330
cagcgcauucugcuuaucaa

SEQ ID NO: 2474371 - RNA, 23 nt, Brucella suis 1330
cagcgcauuuucauugccgggcg

SEQ ID NO: 2474372 - RNA, 15 nt, Brucella suis 1330
cagcgccgaggcgca

SEQ ID NO: 2474373 - RNA, 14 nt, Brucella suis 1330
cagcgccgcgccca

SEQ ID NO: 2474374 - RNA, 21 nt, Brucella suis 1330
cagcgccucauaaucagccuc

SEQ ID NO: 2474375 - RNA, 22 nt, Brucella suis 1330
cagcgccuucagcgugaugccc

SEQ ID NO: 2474376 - RNA, 14 nt, Brucella suis 1330
cagcgcgccgauca

SEQ ID NO: 2474377 - RNA, 17 nt, Brucella suis 1330
cagcgcgccgaucacga

SEQ ID NO: 2474378 - RNA, 15 nt, Brucella suis 1330
cagcgcguccagcgc

SEQ ID NO: 2474379 - RNA, 13 nt, Brucella suis 1330
cagcggcagaccu

SEQ ID NO: 2474380 - RNA, 15 nt, Brucella suis 1330
cagcggcagcacaau

SEQ ID NO: 2474381 - RNA, 21 nt, Brucella suis 1330
cagcggcaucaucgucggcca

SEQ ID NO: 2474382 - RNA, 15 nt, Brucella suis 1330
cagcggccaucuucc

SEQ ID NO: 2474383 - RNA, 12 nt, Brucella suis 1330
cagcggcgcgcc

SEQ ID NO: 2474384 - RNA, 19 nt, Brucella suis 1330
cagcggcggguagccgcca

SEQ ID NO: 2474385 - RNA, 16 nt, Brucella suis 1330
cagcgguugcggccgc

SEQ ID NO: 2474386 - RNA, 12 nt, Brucella suis 1330
cagcgguuuucc

SEQ ID NO: 2474387 - RNA, 14 nt, Brucella suis 1330
cagcgucaggacaa

SEQ ID NO: 2474388 - RNA, 20 nt, Brucella suis 1330
cagcguccauccggcggcgc

SEQ ID NO: 2474389 - RNA, 22 nt, Brucella suis 1330
cagcgugaagggcaggaggcca

SEQ ID NO: 2474390 - RNA, 20 nt, Brucella suis 1330
cagcgugcagccugaacagc

SEQ ID NO: 2474391 - RNA, 23 nt, Brucella suis 1330
cagcguuaccuugccgucaccau

SEQ ID NO: 2474392 - RNA, 13 nt, Brucella suis 1330
cagcguugcgcuc

SEQ ID NO: 2474393 - RNA, 14 nt, Brucella suis 1330
cagcucgaaaucca

SEQ ID NO: 2474394 - RNA, 15 nt, Brucella suis 1330
cagcucgaaauccag

SEQ ID NO: 2474395 - RNA, 13 nt, Brucella suis 1330
cagcucgauaucg

SEQ ID NO: 2474396 - RNA, 16 nt, Brucella suis 1330
cagcucguccaugagc

SEQ ID NO: 2474397 - RNA, 19 nt, Brucella suis 1330
cagcucguccaugagcgca

SEQ ID NO: 2474398 - RNA, 20 nt, Brucella suis 1330
cagcucguccaugagcgcac

SEQ ID NO: 2474399 - RNA, 17 nt, Brucella suis 1330
cagcuuauuccugcggc

SEQ ID NO: 2474400 - RNA, 21 nt, Brucella suis 1330
cagcuucccggauugggucaa

SEQ ID NO: 2474401 - RNA, 14 nt, Brucella suis 1330
cagcuucgggaagu

SEQ ID NO: 2474402 - RNA, 15 nt, Brucella suis 1330
cagcuugaccagaua

SEQ ID NO: 2474403 - RNA, 13 nt, Brucella suis 1330
cagcuuggaaagc

SEQ ID NO: 2474404 - RNA, 14 nt, Brucella suis 1330
cagcuuggaaagcu

SEQ ID NO: 2474405 - RNA, 11 nt, Brucella suis 1330
cagcuugucga

SEQ ID NO: 2474406 - RNA, 20 nt, Brucella suis 1330
cagcuugucgucgugcagcg

SEQ ID NO: 2474407 - RNA, 17 nt, Brucella suis 1330
cagcuuuacugccgggu

SEQ ID NO: 2474408 - RNA, 21 nt, Brucella suis 1330
cagcuuuuuucgauugaaaaa

SEQ ID NO: 2474409 - RNA, 17 nt, Brucella suis 1330
caggaaaagccccaugu

SEQ ID NO: 2474410 - RNA, 14 nt, Brucella suis 1330
caggaaagcccggc

SEQ ID NO: 2474411 - RNA, 17 nt, Brucella suis 1330
caggaacgcaucgagcu

SEQ ID NO: 2474412 - RNA, 18 nt, Brucella suis 1330
caggaaucauuuucucaa

SEQ ID NO: 2474413 - RNA, 15 nt, Brucella suis 1330
caggaauucguccug

SEQ ID NO: 2474414 - RNA, 20 nt, Brucella suis 1330
caggacaacgucgaaauccg

SEQ ID NO: 2474415 - RNA, 18 nt, Brucella suis 1330
caggacaccgucgccauu

SEQ ID NO: 2474416 - RNA, 19 nt, Brucella suis 1330
caggacaccgucgccauua

SEQ ID NO: 2474417 - RNA, 21 nt, Brucella suis 1330
caggaccgcgaggaagccugc

SEQ ID NO: 2474418 - RNA, 19 nt, Brucella suis 1330
caggaccgcgcagaucauc

SEQ ID NO: 2474419 - RNA, 20 nt, Brucella suis 1330
caggaccgcgcagaucaucg

SEQ ID NO: 2474420 - RNA, 13 nt, Brucella suis 1330
caggaccggcgaa

SEQ ID NO: 2474421 - RNA, 19 nt, Brucella suis 1330
caggagcgcgaucaucgca

SEQ ID NO: 2474422 - RNA, 15 nt, Brucella suis 1330
caggaggccaaaaag

SEQ ID NO: 2474423 - RNA, 20 nt, Brucella suis 1330
caggauagauauuucuucca

SEQ ID NO: 2474424 - RNA, 22 nt, Brucella suis 1330
caggauagauauuucuuccaga

SEQ ID NO: 2474425 - RNA, 21 nt, Brucella suis 1330
caggaucgcaccgauauagag

SEQ ID NO: 2474426 - RNA, 19 nt, Brucella suis 1330
caggaucgguuaugggcgg

SEQ ID NO: 2474427 - RNA, 20 nt, Brucella suis 1330
caggaugcccuucguguccg

SEQ ID NO: 2474428 - RNA, 16 nt, Brucella suis 1330
caggaugugucggcca

SEQ ID NO: 2474429 - RNA, 21 nt, Brucella suis 1330
caggauuucaacgcugucguc

SEQ ID NO: 2474430 - RNA, 13 nt, Brucella suis 1330
caggcacacccgg

SEQ ID NO: 2474431 - RNA, 14 nt, Brucella suis 1330
caggcacucuccuc

SEQ ID NO: 2474432 - RNA, 20 nt, Brucella suis 1330
caggcagaugcgaagcggau

SEQ ID NO: 2474433 - RNA, 17 nt, Brucella suis 1330
caggcagcgcgguuuuu

SEQ ID NO: 2474434 - RNA, 13 nt, Brucella suis 1330
caggcagggagga

SEQ ID NO: 2474435 - RNA, 20 nt, Brucella suis 1330
caggccauucccgccucagc

SEQ ID NO: 2474436 - RNA, 15 nt, Brucella suis 1330
caggcccaccgugcc

SEQ ID NO: 2474437 - RNA, 20 nt, Brucella suis 1330
caggcccaccgugccgagaa

SEQ ID NO: 2474438 - RNA, 13 nt, Brucella suis 1330
caggcccagcaug

SEQ ID NO: 2474439 - RNA, 19 nt, Brucella suis 1330
caggccccgaugcggcugc

SEQ ID NO: 2474440 - RNA, 23 nt, Brucella suis 1330
caggccgagcgcaucggccagcu

SEQ ID NO: 2474441 - RNA, 16 nt, Brucella suis 1330
caggccgcaaagcgaa

SEQ ID NO: 2474442 - RNA, 15 nt, Brucella suis 1330
caggccgcgaucacg

SEQ ID NO: 2474443 - RNA, 14 nt, Brucella suis 1330
caggccggccuuga

SEQ ID NO: 2474444 - RNA, 19 nt, Brucella suis 1330
caggccgggcuuuggagga

SEQ ID NO: 2474445 - RNA, 20 nt, Brucella suis 1330
caggcgagcauggaucgccu

SEQ ID NO: 2474446 - RNA, 21 nt, Brucella suis 1330
caggcgcaacuguucgggcgu

SEQ ID NO: 2474447 - RNA, 18 nt, Brucella suis 1330
caggcgcaggcccugcau

SEQ ID NO: 2474448 - RNA, 23 nt, Brucella suis 1330
caggcgcauucgggucacccggc

SEQ ID NO: 2474449 - RNA, 16 nt, Brucella suis 1330
caggcgcgaucaugcc

SEQ ID NO: 2474450 - RNA, 13 nt, Brucella suis 1330
caggcggaagggc

SEQ ID NO: 2474451 - RNA, 21 nt, Brucella suis 1330
caggcggauauucgccgccuc

SEQ ID NO: 2474452 - RNA, 22 nt, Brucella suis 1330
caggcggaugaagcgccgauac

SEQ ID NO: 2474453 - RNA, 14 nt, Brucella suis 1330
caggcuccguugcu

SEQ ID NO: 2474454 - RNA, 22 nt, Brucella suis 1330
caggcucugaaacugaaaaagg

SEQ ID NO: 2474455 - RNA, 16 nt, Brucella suis 1330
caggcucuugucgaag

SEQ ID NO: 2474456 - RNA, 20 nt, Brucella suis 1330
caggcugaguuuuccgcuuu

SEQ ID NO: 2474457 - RNA, 16 nt, Brucella suis 1330
caggcuuucggccugu

SEQ ID NO: 2474458 - RNA, 19 nt, Brucella suis 1330
caggcuuucggccugugcg

SEQ ID NO: 2474459 - RNA, 21 nt, Brucella suis 1330
cagggaaacucucacagccau

SEQ ID NO: 2474460 - RNA, 23 nt, Brucella suis 1330
cagggaaacucucacagccauca

SEQ ID NO: 2474461 - RNA, 22 nt, Brucella suis 1330
cagggaaucgcgcaauucaugc

SEQ ID NO: 2474462 - RNA, 18 nt, Brucella suis 1330
cagggacgagcggcaggc

SEQ ID NO: 2474463 - RNA, 18 nt, Brucella suis 1330
cagggcaagcgccugcug

SEQ ID NO: 2474464 - RNA, 16 nt, Brucella suis 1330
cagggcaaucugcgcu

SEQ ID NO: 2474465 - RNA, 20 nt, Brucella suis 1330
cagggcauggguggccgcca

SEQ ID NO: 2474466 - RNA, 19 nt, Brucella suis 1330
cagggcgauggauaaagca

SEQ ID NO: 2474467 - RNA, 21 nt, Brucella suis 1330
cagggcggaucgugacccgcc

SEQ ID NO: 2474468 - RNA, 22 nt, Brucella suis 1330
cagggcggaucgugacccgccc

SEQ ID NO: 2474469 - RNA, 21 nt, Brucella suis 1330
cagggcguagauagcgucagc

SEQ ID NO: 2474470 - RNA, 21 nt, Brucella suis 1330
cagggcugccgcacagcauca

SEQ ID NO: 2474471 - RNA, 19 nt, Brucella suis 1330
cagggcuugcuugccauuc

SEQ ID NO: 2474472 - RNA, 13 nt, Brucella suis 1330
caggggcagcgcg

SEQ ID NO: 2474473 - RNA, 21 nt, Brucella suis 1330
cagggucaaaauggccucaga

SEQ ID NO: 2474474 - RNA, 19 nt, Brucella suis 1330
caggucuuucugcuucugu

SEQ ID NO: 2474475 - RNA, 21 nt, Brucella suis 1330
cagguggcggauugcagcggu

SEQ ID NO: 2474476 - RNA, 12 nt, Brucella suis 1330
cagguugacgau

SEQ ID NO: 2474477 - RNA, 12 nt, Brucella suis 1330
cagguugcgcca

SEQ ID NO: 2474478 - RNA, 19 nt, Brucella suis 1330
cagguugcgccaccacggc

SEQ ID NO: 2474479 - RNA, 16 nt, Brucella suis 1330
cagguugcgccgauau

SEQ ID NO: 2474480 - RNA, 20 nt, Brucella suis 1330
cagguuuccggacgcgcaga

SEQ ID NO: 2474481 - RNA, 13 nt, Brucella suis 1330
caguaaagucuga

SEQ ID NO: 2474482 - RNA, 23 nt, Brucella suis 1330
caguacgccgccuucccagccgg

SEQ ID NO: 2474483 - RNA, 18 nt, Brucella suis 1330
caguacgguuauggcuca

SEQ ID NO: 2474484 - RNA, 17 nt, Brucella suis 1330
caguagccugacccggc

SEQ ID NO: 2474485 - RNA, 21 nt, Brucella suis 1330
caguagcuucugggugagcgu

SEQ ID NO: 2474486 - RNA, 13 nt, Brucella suis 1330
caguagggcagua

SEQ ID NO: 2474487 - RNA, 20 nt, Brucella suis 1330
caguaucggcaguuucaucu

SEQ ID NO: 2474488 - RNA, 23 nt, Brucella suis 1330
cagucaaaaacgagggguuuuga

SEQ ID NO: 2474489 - RNA, 22 nt, Brucella suis 1330
cagucacgguugccuugcugaa

SEQ ID NO: 2474490 - RNA, 15 nt, Brucella suis 1330
cagucaugcccauaa

SEQ ID NO: 2474491 - RNA, 14 nt, Brucella suis 1330
caguccacuggacu

SEQ ID NO: 2474492 - RNA, 15 nt, Brucella suis 1330
caguccagcgcgcgg

SEQ ID NO: 2474493 - RNA, 22 nt, Brucella suis 1330
caguccagcuuuccgcaucgca

SEQ ID NO: 2474494 - RNA, 19 nt, Brucella suis 1330
cagucgagaaaaagaugcg

SEQ ID NO: 2474495 - RNA, 22 nt, Brucella suis 1330
cagucgagaaaaagaugcgccg

SEQ ID NO: 2474496 - RNA, 21 nt, Brucella suis 1330
cagucugaucgacgaggaagg

SEQ ID NO: 2474497 - RNA, 11 nt, Brucella suis 1330
cagucuggauu

SEQ ID NO: 2474498 - RNA, 20 nt, Brucella suis 1330
cagugaauacuaaucgcaaa

SEQ ID NO: 2474499 - RNA, 22 nt, Brucella suis 1330
cagugagcagaagaaagggcgc

SEQ ID NO: 2474500 - RNA, 15 nt, Brucella suis 1330
cagugcaaagcggcu

SEQ ID NO: 2474501 - RNA, 20 nt, Brucella suis 1330
cagugcauuggaaacgccgu

SEQ ID NO: 2474502 - RNA, 18 nt, Brucella suis 1330
cagugccaccagaugguc

SEQ ID NO: 2474503 - RNA, 20 nt, Brucella suis 1330
cagugcgagcgugaagggca

SEQ ID NO: 2474504 - RNA, 15 nt, Brucella suis 1330
cagugcgccaccgcg

SEQ ID NO: 2474505 - RNA, 16 nt, Brucella suis 1330
caguggcagcaggcag

SEQ ID NO: 2474506 - RNA, 16 nt, Brucella suis 1330
caguggccuucagcac

SEQ ID NO: 2474507 - RNA, 12 nt, Brucella suis 1330
caguggcucucc

SEQ ID NO: 2474508 - RNA, 18 nt, Brucella suis 1330
caguucagcgugcgauaa

SEQ ID NO: 2474509 - RNA, 19 nt, Brucella suis 1330
caguucagcgugcgauaaa

SEQ ID NO: 2474510 - RNA, 12 nt, Brucella suis 1330
caguuccugaaa

SEQ ID NO: 2474511 - RNA, 15 nt, Brucella suis 1330
caguuccugaaacac

SEQ ID NO: 2474512 - RNA, 18 nt, Brucella suis 1330
caguuccugcuucaucgc

SEQ ID NO: 2474513 - RNA, 19 nt, Brucella suis 1330
caguucgucggccagauca

SEQ ID NO: 2474514 - RNA, 15 nt, Brucella suis 1330
caguucguggcgggg

SEQ ID NO: 2474515 - RNA, 18 nt, Brucella suis 1330
caguugaucgaggcaaau

SEQ ID NO: 2474516 - RNA, 16 nt, Brucella suis 1330
caguuucugccgcgca

SEQ ID NO: 2474517 - RNA, 20 nt, Brucella suis 1330
caguuugagcaugaugccga

SEQ ID NO: 2474518 - RNA, 15 nt, Brucella suis 1330
caguuuguugaaaca

SEQ ID NO: 2474519 - RNA, 21 nt, Brucella suis 1330
cauaaaccgaugacgagccuc

SEQ ID NO: 2474520 - RNA, 12 nt, Brucella suis 1330
cauaaagcacca

SEQ ID NO: 2474521 - RNA, 22 nt, Brucella suis 1330
cauaaagcugguugcgcggcca

SEQ ID NO: 2474522 - RNA, 23 nt, Brucella suis 1330
cauaaaggccgaaauagcggccc

SEQ ID NO: 2474523 - RNA, 20 nt, Brucella suis 1330
cauaaggcggaugcgcggcg

SEQ ID NO: 2474524 - RNA, 17 nt, Brucella suis 1330
cauaaucggcaucggaa

SEQ ID NO: 2474525 - RNA, 14 nt, Brucella suis 1330
cauaaucuuuuugc

SEQ ID NO: 2474526 - RNA, 21 nt, Brucella suis 1330
cauacaugaugaucgccagca

SEQ ID NO: 2474527 - RNA, 21 nt, Brucella suis 1330
cauacauggcguaggcauaau

SEQ ID NO: 2474528 - RNA, 15 nt, Brucella suis 1330
cauaccgaucugauu

SEQ ID NO: 2474529 - RNA, 20 nt, Brucella suis 1330
cauacuccccuacucccuua

SEQ ID NO: 2474530 - RNA, 20 nt, Brucella suis 1330
cauagaacagcaagcccaga

SEQ ID NO: 2474531 - RNA, 16 nt, Brucella suis 1330
cauagaccaugacgcc

SEQ ID NO: 2474532 - RNA, 19 nt, Brucella suis 1330
cauagacgcgcagacgcag

SEQ ID NO: 2474533 - RNA, 14 nt, Brucella suis 1330
cauagagccacgag

SEQ ID NO: 2474534 - RNA, 21 nt, Brucella suis 1330
cauagagcgugcccugaaaug

SEQ ID NO: 2474535 - RNA, 16 nt, Brucella suis 1330
cauagccugcaagcgc

SEQ ID NO: 2474536 - RNA, 22 nt, Brucella suis 1330
cauagcgcgcccaaucucgaua

SEQ ID NO: 2474537 - RNA, 17 nt, Brucella suis 1330
cauagcguucgaucagu

SEQ ID NO: 2474538 - RNA, 24 nt, Brucella suis 1330
cauaggcgaucaccucgcccugcu

SEQ ID NO: 2474539 - RNA, 17 nt, Brucella suis 1330
cauaggcgcgcgcaagg

SEQ ID NO: 2474540 - RNA, 20 nt, Brucella suis 1330
cauaggcuucggccgcuugc

SEQ ID NO: 2474541 - RNA, 12 nt, Brucella suis 1330
cauaggcuuuca

SEQ ID NO: 2474542 - RNA, 13 nt, Brucella suis 1330
cauaugaugaacg

SEQ ID NO: 2474543 - RNA, 20 nt, Brucella suis 1330
caucaaaagcugccgcaaca

SEQ ID NO: 2474544 - RNA, 18 nt, Brucella suis 1330
caucaaaggagcauggcu

SEQ ID NO: 2474545 - RNA, 13 nt, Brucella suis 1330
caucaaugcaccc

SEQ ID NO: 2474546 - RNA, 15 nt, Brucella suis 1330
caucacaugggcauu

SEQ ID NO: 2474547 - RNA, 21 nt, Brucella suis 1330
caucacauuggugccgaaugu

SEQ ID NO: 2474548 - RNA, 11 nt, Brucella suis 1330
caucaccagcc

SEQ ID NO: 2474549 - RNA, 20 nt, Brucella suis 1330
caucaccauugcccaaugcg

SEQ ID NO: 2474550 - RNA, 21 nt, Brucella suis 1330
caucacuggcaacgacggcug

SEQ ID NO: 2474551 - RNA, 22 nt, Brucella suis 1330
caucacuucgucgcugacuuca

SEQ ID NO: 2474552 - RNA, 13 nt, Brucella suis 1330
caucagaaauuug

SEQ ID NO: 2474553 - RNA, 19 nt, Brucella suis 1330
caucagcauugaacgccuu

SEQ ID NO: 2474554 - RNA, 13 nt, Brucella suis 1330
caucagccgggca

SEQ ID NO: 2474555 - RNA, 15 nt, Brucella suis 1330
caucagccucccuuc

SEQ ID NO: 2474556 - RNA, 21 nt, Brucella suis 1330
caucagccucccuucauucaa

SEQ ID NO: 2474557 - RNA, 13 nt, Brucella suis 1330
caucagcggcggg

SEQ ID NO: 2474558 - RNA, 22 nt, Brucella suis 1330
caucagcggcggguagccgcca

SEQ ID NO: 2474559 - RNA, 23 nt, Brucella suis 1330
caucagcggcggguagccgccau

SEQ ID NO: 2474560 - RNA, 15 nt, Brucella suis 1330
caucagcuugcccau

SEQ ID NO: 2474561 - RNA, 22 nt, Brucella suis 1330
caucaggauuugggaucggcgg

SEQ ID NO: 2474562 - RNA, 17 nt, Brucella suis 1330
caucaggucgagcgccu

SEQ ID NO: 2474563 - RNA, 18 nt, Brucella suis 1330
caucauuggcguugagcc

SEQ ID NO: 2474564 - RNA, 19 nt, Brucella suis 1330
caucauuggcguugagccg

SEQ ID NO: 2474565 - RNA, 17 nt, Brucella suis 1330
cauccacaaugauguuc

SEQ ID NO: 2474566 - RNA, 19 nt, Brucella suis 1330
cauccacucggcggcaucg

SEQ ID NO: 2474567 - RNA, 13 nt, Brucella suis 1330
cauccagaacuuc

SEQ ID NO: 2474568 - RNA, 21 nt, Brucella suis 1330
cauccagaacuucgccaagcc

SEQ ID NO: 2474569 - RNA, 11 nt, Brucella suis 1330
cauccagccgg

SEQ ID NO: 2474570 - RNA, 14 nt, Brucella suis 1330
cauccagccggcgc

SEQ ID NO: 2474571 - RNA, 15 nt, Brucella suis 1330
cauccagccggcgca

SEQ ID NO: 2474572 - RNA, 10 nt, Brucella suis 1330
cauccagcgu

SEQ ID NO: 2474573 - RNA, 19 nt, Brucella suis 1330
cauccagucauggcgcacg

SEQ ID NO: 2474574 - RNA, 22 nt, Brucella suis 1330
cauccaucggcucauccuccac

SEQ ID NO: 2474575 - RNA, 13 nt, Brucella suis 1330
cauccauguggaa

SEQ ID NO: 2474576 - RNA, 12 nt, Brucella suis 1330
cauccauuccuc

SEQ ID NO: 2474577 - RNA, 14 nt, Brucella suis 1330
cauccauuccucaa

SEQ ID NO: 2474578 - RNA, 22 nt, Brucella suis 1330
cauccccauugcaucgccaagc

SEQ ID NO: 2474579 - RNA, 20 nt, Brucella suis 1330
caucccgaaaagugcgaagc

SEQ ID NO: 2474580 - RNA, 23 nt, Brucella suis 1330
caucccgccccuaaaggcucugc

SEQ ID NO: 2474581 - RNA, 13 nt, Brucella suis 1330
caucccucccgaa

SEQ ID NO: 2474582 - RNA, 22 nt, Brucella suis 1330
cauccgaggcgcgcagcagcgg

SEQ ID NO: 2474583 - RNA, 14 nt, Brucella suis 1330
cauccgcacccggc

SEQ ID NO: 2474584 - RNA, 14 nt, Brucella suis 1330
cauccgccaccgcg

SEQ ID NO: 2474585 - RNA, 15 nt, Brucella suis 1330
cauccgccccgaucg

SEQ ID NO: 2474586 - RNA, 16 nt, Brucella suis 1330
cauccggcggcgccca

SEQ ID NO: 2474587 - RNA, 13 nt, Brucella suis 1330
cauccucgccaag

SEQ ID NO: 2474588 - RNA, 15 nt, Brucella suis 1330
cauccucgccaagcu

SEQ ID NO: 2474589 - RNA, 20 nt, Brucella suis 1330
cauccugcaccggcuucccg

SEQ ID NO: 2474590 - RNA, 19 nt, Brucella suis 1330
cauccugcucggcgcggcg

SEQ ID NO: 2474591 - RNA, 18 nt, Brucella suis 1330
cauccuugaugcccagcu

SEQ ID NO: 2474592 - RNA, 15 nt, Brucella suis 1330
caucgaaaccggcau

SEQ ID NO: 2474593 - RNA, 19 nt, Brucella suis 1330
caucgaaccgcccagaccg

SEQ ID NO: 2474594 - RNA, 18 nt, Brucella suis 1330
caucgacaaucuccccuu

SEQ ID NO: 2474595 - RNA, 20 nt, Brucella suis 1330
caucgacauggacaggaugc

SEQ ID NO: 2474596 - RNA, 19 nt, Brucella suis 1330
caucgagcguaacggcgga

SEQ ID NO: 2474597 - RNA, 21 nt, Brucella suis 1330
caucgaggaauuuccgcuccu

SEQ ID NO: 2474598 - RNA, 21 nt, Brucella suis 1330
caucgcaauagaccaccaggc

SEQ ID NO: 2474599 - RNA, 16 nt, Brucella suis 1330
caucgcaucggucagc

SEQ ID NO: 2474600 - RNA, 21 nt, Brucella suis 1330
caucgccaagcuugaucgccg

SEQ ID NO: 2474601 - RNA, 22 nt, Brucella suis 1330
caucgccaccauggccgccccg

SEQ ID NO: 2474602 - RNA, 23 nt, Brucella suis 1330
caucgcccgagaagcucaacgcc

SEQ ID NO: 2474603 - RNA, 11 nt, Brucella suis 1330
caucgcccgcc

SEQ ID NO: 2474604 - RNA, 21 nt, Brucella suis 1330
caucgccugaggcauugagga

SEQ ID NO: 2474605 - RNA, 12 nt, Brucella suis 1330
caucgccuugcg

SEQ ID NO: 2474606 - RNA, 13 nt, Brucella suis 1330
caucgcgccgcaa

SEQ ID NO: 2474607 - RNA, 21 nt, Brucella suis 1330
caucgcgccgcaacucuuuau

SEQ ID NO: 2474608 - RNA, 21 nt, Brucella suis 1330
caucgcgucagggcgaggaaa

SEQ ID NO: 2474609 - RNA, 21 nt, Brucella suis 1330
caucgcucgaaggcagccgug

SEQ ID NO: 2474610 - RNA, 22 nt, Brucella suis 1330
caucggaagggcaaggcgcgcc

SEQ ID NO: 2474611 - RNA, 15 nt, Brucella suis 1330
caucggaauagggaa

SEQ ID NO: 2474612 - RNA, 13 nt, Brucella suis 1330
caucggccucggc

SEQ ID NO: 2474613 - RNA, 18 nt, Brucella suis 1330
caucggcgaggaagagaa

SEQ ID NO: 2474614 - RNA, 16 nt, Brucella suis 1330
caucggcgcgcuuggc

SEQ ID NO: 2474615 - RNA, 21 nt, Brucella suis 1330
caucggcuugggaagaucaua

SEQ ID NO: 2474616 - RNA, 19 nt, Brucella suis 1330
caucggggcgagcgcgcca

SEQ ID NO: 2474617 - RNA, 16 nt, Brucella suis 1330
caucggugcgcggcgc

SEQ ID NO: 2474618 - RNA, 16 nt, Brucella suis 1330
caucguaaucgccggg

SEQ ID NO: 2474619 - RNA, 13 nt, Brucella suis 1330
caucguggcggca

SEQ ID NO: 2474620 - RNA, 22 nt, Brucella suis 1330
caucguugcggcuugccaccac

SEQ ID NO: 2474621 - RNA, 21 nt, Brucella suis 1330
caucucguucacaaucuugcc

SEQ ID NO: 2474622 - RNA, 13 nt, Brucella suis 1330
caucugccaacca

SEQ ID NO: 2474623 - RNA, 16 nt, Brucella suis 1330
caucuggccgcuaugc

SEQ ID NO: 2474624 - RNA, 21 nt, Brucella suis 1330
caucuuauaaaaaggccgcuc

SEQ ID NO: 2474625 - RNA, 15 nt, Brucella suis 1330
caucuucaccuguuc

SEQ ID NO: 2474626 - RNA, 21 nt, Brucella suis 1330
caucuucuucguugucuucaa

SEQ ID NO: 2474627 - RNA, 15 nt, Brucella suis 1330
caucuuucuugaagu

SEQ ID NO: 2474628 - RNA, 15 nt, Brucella suis 1330
caucuuugcggcgcg

SEQ ID NO: 2474629 - RNA, 16 nt, Brucella suis 1330
caucuuugcggcgcgc

SEQ ID NO: 2474630 - RNA, 13 nt, Brucella suis 1330
caucuuuuccgaa

SEQ ID NO: 2474631 - RNA, 23 nt, Brucella suis 1330
caugaaaaugccauggaacagac

SEQ ID NO: 2474632 - RNA, 17 nt, Brucella suis 1330
caugaacaugcgccacu

SEQ ID NO: 2474633 - RNA, 15 nt, Brucella suis 1330
caugaagcgcggcgg

SEQ ID NO: 2474634 - RNA, 20 nt, Brucella suis 1330
caugaagcgcggcggccacu

SEQ ID NO: 2474635 - RNA, 18 nt, Brucella suis 1330
caugaccggaugcaaaac

SEQ ID NO: 2474636 - RNA, 14 nt, Brucella suis 1330
caugaccuucucga

SEQ ID NO: 2474637 - RNA, 20 nt, Brucella suis 1330
caugacgccgcuccagccga

SEQ ID NO: 2474638 - RNA, 20 nt, Brucella suis 1330
caugagaaggcaagccccag

SEQ ID NO: 2474639 - RNA, 19 nt, Brucella suis 1330
caugagcaccggaagcgca

SEQ ID NO: 2474640 - RNA, 14 nt, Brucella suis 1330
caugagcuucaaca

SEQ ID NO: 2474641 - RNA, 17 nt, Brucella suis 1330
caugauccgcuccagau

SEQ ID NO: 2474642 - RNA, 15 nt, Brucella suis 1330
caugaucgccaccgg

SEQ ID NO: 2474643 - RNA, 18 nt, Brucella suis 1330
caugaugccgacaagcag

SEQ ID NO: 2474644 - RNA, 13 nt, Brucella suis 1330
caugauggcccuu

SEQ ID NO: 2474645 - RNA, 14 nt, Brucella suis 1330
caugauggcccuug

SEQ ID NO: 2474646 - RNA, 17 nt, Brucella suis 1330
caugauggcccuugugg

SEQ ID NO: 2474647 - RNA, 19 nt, Brucella suis 1330
caugcaggccgugaagauu

SEQ ID NO: 2474648 - RNA, 16 nt, Brucella suis 1330
caugcaggcggaaggg

SEQ ID NO: 2474649 - RNA, 17 nt, Brucella suis 1330
caugcaguuccauccau

SEQ ID NO: 2474650 - RNA, 18 nt, Brucella suis 1330
caugcccaucaaccgugc

SEQ ID NO: 2474651 - RNA, 22 nt, Brucella suis 1330
caugcccggcgcgaccgcguuc

SEQ ID NO: 2474652 - RNA, 21 nt, Brucella suis 1330
caugcccugacucugaccuuc

SEQ ID NO: 2474653 - RNA, 14 nt, Brucella suis 1330
caugccgccaaggc

SEQ ID NO: 2474654 - RNA, 15 nt, Brucella suis 1330
caugccgccagccgc

SEQ ID NO: 2474655 - RNA, 16 nt, Brucella suis 1330
caugccugccgcagcc

SEQ ID NO: 2474656 - RNA, 20 nt, Brucella suis 1330
caugccuucccgccagccgu

SEQ ID NO: 2474657 - RNA, 19 nt, Brucella suis 1330
caugcgauagcggcgcggc

SEQ ID NO: 2474658 - RNA, 21 nt, Brucella suis 1330
caugcgauagcggcgcggcag

SEQ ID NO: 2474659 - RNA, 15 nt, Brucella suis 1330
caugcgccacuuccc

SEQ ID NO: 2474660 - RNA, 18 nt, Brucella suis 1330
caugcgcgcccucgcgcu

SEQ ID NO: 2474661 - RNA, 16 nt, Brucella suis 1330
caugcgcggcaugggc

SEQ ID NO: 2474662 - RNA, 14 nt, Brucella suis 1330
caugcgcucccggu

SEQ ID NO: 2474663 - RNA, 15 nt, Brucella suis 1330
caugcggaugacgaa

SEQ ID NO: 2474664 - RNA, 20 nt, Brucella suis 1330
caugcggugcacgaauugca

SEQ ID NO: 2474665 - RNA, 17 nt, Brucella suis 1330
caugcguugcuggaaca

SEQ ID NO: 2474666 - RNA, 18 nt, Brucella suis 1330
caugcguugcuggaacau

SEQ ID NO: 2474667 - RNA, 21 nt, Brucella suis 1330
caugcugauuggauuaugcua

SEQ ID NO: 2474668 - RNA, 15 nt, Brucella suis 1330
cauggaaaacgccgc

SEQ ID NO: 2474669 - RNA, 21 nt, Brucella suis 1330
cauggaagugaauuucggcga

SEQ ID NO: 2474670 - RNA, 18 nt, Brucella suis 1330
cauggacuuuucagccuc

SEQ ID NO: 2474671 - RNA, 19 nt, Brucella suis 1330
cauggagcgcauccgccug

SEQ ID NO: 2474672 - RNA, 15 nt, Brucella suis 1330
cauggaucaacgcag

SEQ ID NO: 2474673 - RNA, 17 nt, Brucella suis 1330
cauggcagccgaucauc

SEQ ID NO: 2474674 - RNA, 21 nt, Brucella suis 1330
cauggccugcgcgcgcauggc

SEQ ID NO: 2474675 - RNA, 22 nt, Brucella suis 1330
cauggccugcugcauuuucugc

SEQ ID NO: 2474676 - RNA, 17 nt, Brucella suis 1330
cauggcggaacccacgc

SEQ ID NO: 2474677 - RNA, 16 nt, Brucella suis 1330
cauggcgggccaugcc

SEQ ID NO: 2474678 - RNA, 18 nt, Brucella suis 1330
cauggcugauuucuuccc

SEQ ID NO: 2474679 - RNA, 24 nt, Brucella suis 1330
cauggcugcaacaccaauagcugc

SEQ ID NO: 2474680 - RNA, 21 nt, Brucella suis 1330
cauggcuugaagcgugaugau

SEQ ID NO: 2474681 - RNA, 20 nt, Brucella suis 1330
cauggcuugagcgucaggcc

SEQ ID NO: 2474682 - RNA, 21 nt, Brucella suis 1330
cauggguaccuuccagcaugg

SEQ ID NO: 2474683 - RNA, 20 nt, Brucella suis 1330
cauggguggccgccacccau

SEQ ID NO: 2474684 - RNA, 14 nt, Brucella suis 1330
cauggucaggccaa

SEQ ID NO: 2474685 - RNA, 19 nt, Brucella suis 1330
caugguugaauuccggcag

SEQ ID NO: 2474686 - RNA, 16 nt, Brucella suis 1330
caugguuugcagcaau

SEQ ID NO: 2474687 - RNA, 21 nt, Brucella suis 1330
caugucauccgaaaccagaac

SEQ ID NO: 2474688 - RNA, 18 nt, Brucella suis 1330
caugucgaaagcccugcg

SEQ ID NO: 2474689 - RNA, 22 nt, Brucella suis 1330
caugucuccccaaaguggaaag

SEQ ID NO: 2474690 - RNA, 14 nt, Brucella suis 1330
cauuaauggcaucg

SEQ ID NO: 2474691 - RNA, 23 nt, Brucella suis 1330
cauuacaaaaauggaaaaacccg

SEQ ID NO: 2474692 - RNA, 21 nt, Brucella suis 1330
cauuauccgcaucgaucacau

SEQ ID NO: 2474693 - RNA, 22 nt, Brucella suis 1330
cauuauccuacgcaaaaccgcu

SEQ ID NO: 2474694 - RNA, 19 nt, Brucella suis 1330
cauuauccugaaaauacuc

SEQ ID NO: 2474695 - RNA, 12 nt, Brucella suis 1330
cauuaucggcgg

SEQ ID NO: 2474696 - RNA, 13 nt, Brucella suis 1330
cauuauucuccca

SEQ ID NO: 2474697 - RNA, 20 nt, Brucella suis 1330
cauucaaaaacgcguuccuu

SEQ ID NO: 2474698 - RNA, 13 nt, Brucella suis 1330
cauucaaugccac

SEQ ID NO: 2474699 - RNA, 15 nt, Brucella suis 1330
cauucagauggacau

SEQ ID NO: 2474700 - RNA, 22 nt, Brucella suis 1330
cauucauaaccgaagaaugcgc

SEQ ID NO: 2474701 - RNA, 12 nt, Brucella suis 1330
cauuccccgccc

SEQ ID NO: 2474702 - RNA, 17 nt, Brucella suis 1330
cauucccuucgcgccgc

SEQ ID NO: 2474703 - RNA, 20 nt, Brucella suis 1330
cauucccuucgcgccgccuu

SEQ ID NO: 2474704 - RNA, 12 nt, Brucella suis 1330
cauuccgggccg

SEQ ID NO: 2474705 - RNA, 12 nt, Brucella suis 1330
cauuccucaaga

SEQ ID NO: 2474706 - RNA, 21 nt, Brucella suis 1330
cauuccucaagauacaaaaaa

SEQ ID NO: 2474707 - RNA, 20 nt, Brucella suis 1330
cauucgcugcgcuugagaua

SEQ ID NO: 2474708 - RNA, 19 nt, Brucella suis 1330
cauucggguugccuucgac

SEQ ID NO: 2474709 - RNA, 12 nt, Brucella suis 1330
cauucugaauga

SEQ ID NO: 2474710 - RNA, 17 nt, Brucella suis 1330
cauucugcacgucauca

SEQ ID NO: 2474711 - RNA, 14 nt, Brucella suis 1330
cauucugcuuauca

SEQ ID NO: 2474712 - RNA, 14 nt, Brucella suis 1330
cauucuugcgcccu

SEQ ID NO: 2474713 - RNA, 15 nt, Brucella suis 1330
cauucuugcgcccuc

SEQ ID NO: 2474714 - RNA, 21 nt, Brucella suis 1330
cauucuugcgcccuccaccgc

SEQ ID NO: 2474715 - RNA, 14 nt, Brucella suis 1330
cauucuuuccccau

SEQ ID NO: 2474716 - RNA, 24 nt, Brucella suis 1330
cauugaaauauuccggcacgacag

SEQ ID NO: 2474717 - RNA, 19 nt, Brucella suis 1330
cauugaacgccuuuuucac

SEQ ID NO: 2474718 - RNA, 19 nt, Brucella suis 1330
cauugaccgaaaauggccc

SEQ ID NO: 2474719 - RNA, 15 nt, Brucella suis 1330
cauugacgauacagc

SEQ ID NO: 2474720 - RNA, 14 nt, Brucella suis 1330
cauugacgcgcacc

SEQ ID NO: 2474721 - RNA, 18 nt, Brucella suis 1330
cauugaggaucgaccagg

SEQ ID NO: 2474722 - RNA, 15 nt, Brucella suis 1330
cauugaugagaaccg

SEQ ID NO: 2474723 - RNA, 16 nt, Brucella suis 1330
cauugccccaaggcgc

SEQ ID NO: 2474724 - RNA, 19 nt, Brucella suis 1330
cauugccgcgacugucacc

SEQ ID NO: 2474725 - RNA, 23 nt, Brucella suis 1330
cauugccgggcgcaaccuggcug

SEQ ID NO: 2474726 - RNA, 15 nt, Brucella suis 1330
cauugccuucgcgcc

SEQ ID NO: 2474727 - RNA, 17 nt, Brucella suis 1330
cauugcgcuugccgccg

SEQ ID NO: 2474728 - RNA, 18 nt, Brucella suis 1330
cauugcggauacccaugc

SEQ ID NO: 2474729 - RNA, 18 nt, Brucella suis 1330
cauugcggccaagcgcau

SEQ ID NO: 2474730 - RNA, 12 nt, Brucella suis 1330
cauuggaaacgc

SEQ ID NO: 2474731 - RNA, 21 nt, Brucella suis 1330
cauuggcgauuuucugcacag

SEQ ID NO: 2474732 - RNA, 16 nt, Brucella suis 1330
cauuggcggaugaucg

SEQ ID NO: 2474733 - RNA, 21 nt, Brucella suis 1330
cauuggcugcuuccgaauaga

SEQ ID NO: 2474734 - RNA, 13 nt, Brucella suis 1330
cauugggcccuua

SEQ ID NO: 2474735 - RNA, 18 nt, Brucella suis 1330
cauuggugaugcgcccgu

SEQ ID NO: 2474736 - RNA, 13 nt, Brucella suis 1330
cauugucggugaa

SEQ ID NO: 2474737 - RNA, 22 nt, Brucella suis 1330
cauuucacccgccagaugauca

SEQ ID NO: 2474738 - RNA, 14 nt, Brucella suis 1330
cauuucaugcacgg

SEQ ID NO: 2474739 - RNA, 23 nt, Brucella suis 1330
cauuucccccaauaucgcgccgg

SEQ ID NO: 2474740 - RNA, 12 nt, Brucella suis 1330
cauuucggcuuc

SEQ ID NO: 2474741 - RNA, 16 nt, Brucella suis 1330
cauuugcgaccauggc

SEQ ID NO: 2474742 - RNA, 12 nt, Brucella suis 1330
cauuuucucaag

SEQ ID NO: 2474743 - RNA, 14 nt, Brucella suis 1330
cauuuucugcauca

SEQ ID NO: 2474744 - RNA, 15 nt, Brucella suis 1330
cauuuuuccagaccu

SEQ ID NO: 2474745 - RNA, 16 nt, Brucella suis 1330
ccaaaacauacucccc

SEQ ID NO: 2474746 - RNA, 17 nt, Brucella suis 1330
ccaaaacauacuccccu

SEQ ID NO: 2474747 - RNA, 17 nt, Brucella suis 1330
ccaaacguacauuguuc

SEQ ID NO: 2474748 - RNA, 21 nt, Brucella suis 1330
ccaaagaccagcaggaagaag

SEQ ID NO: 2474749 - RNA, 15 nt, Brucella suis 1330
ccaaagcgggcuguu

SEQ ID NO: 2474750 - RNA, 18 nt, Brucella suis 1330
ccaaagggugcgagcagg

SEQ ID NO: 2474751 - RNA, 13 nt, Brucella suis 1330
ccaacccuuuucc

SEQ ID NO: 2474752 - RNA, 13 nt, Brucella suis 1330
ccaaccggauuuc

SEQ ID NO: 2474753 - RNA, 20 nt, Brucella suis 1330
ccaacgugcggugcucccau

SEQ ID NO: 2474754 - RNA, 20 nt, Brucella suis 1330
ccaacuuucgggggcaguuc

SEQ ID NO: 2474755 - RNA, 21 nt, Brucella suis 1330
ccaagaagaacacagccccuu

SEQ ID NO: 2474756 - RNA, 22 nt, Brucella suis 1330
ccaagaucagccacauucccga

SEQ ID NO: 2474757 - RNA, 18 nt, Brucella suis 1330
ccaagcaggccgcgauca

SEQ ID NO: 2474758 - RNA, 16 nt, Brucella suis 1330
ccaagcccaaagcggu

SEQ ID NO: 2474759 - RNA, 18 nt, Brucella suis 1330
ccaagcccuuccacugca

SEQ ID NO: 2474760 - RNA, 15 nt, Brucella suis 1330
ccaagccggcgcagc

SEQ ID NO: 2474761 - RNA, 16 nt, Brucella suis 1330
ccaagcgccagaaaga

SEQ ID NO: 2474762 - RNA, 15 nt, Brucella suis 1330
ccaaggcccgccucg

SEQ ID NO: 2474763 - RNA, 21 nt, Brucella suis 1330
ccaagugugacuuccgccgug

SEQ ID NO: 2474764 - RNA, 13 nt, Brucella suis 1330
ccaaguucaugcc

SEQ ID NO: 2474765 - RNA, 14 nt, Brucella suis 1330
ccaauaucgcgccg

SEQ ID NO: 2474766 - RNA, 16 nt, Brucella suis 1330
ccaaugcaggcgcggc

SEQ ID NO: 2474767 - RNA, 16 nt, Brucella suis 1330
ccaaugcccugcugca

SEQ ID NO: 2474768 - RNA, 18 nt, Brucella suis 1330
ccaaugccucauugucgc

SEQ ID NO: 2474769 - RNA, 22 nt, Brucella suis 1330
ccaaugcucgaugguccagucu

SEQ ID NO: 2474770 - RNA, 22 nt, Brucella suis 1330
ccaauuccgccggggcaggcuc

SEQ ID NO: 2474771 - RNA, 14 nt, Brucella suis 1330
ccacaaaaaccggg

SEQ ID NO: 2474772 - RNA, 17 nt, Brucella suis 1330
ccacaccggaggagagc

SEQ ID NO: 2474773 - RNA, 13 nt, Brucella suis 1330
ccacacgaacagc

SEQ ID NO: 2474774 - RNA, 11 nt, Brucella suis 1330
ccacacuuccg

SEQ ID NO: 2474775 - RNA, 13 nt, Brucella suis 1330
ccacacuuccgcu

SEQ ID NO: 2474776 - RNA, 16 nt, Brucella suis 1330
ccacacuuccgcucau

SEQ ID NO: 2474777 - RNA, 13 nt, Brucella suis 1330
ccacauccgccac

SEQ ID NO: 2474778 - RNA, 14 nt, Brucella suis 1330
ccacauccgccacc

SEQ ID NO: 2474779 - RNA, 16 nt, Brucella suis 1330
ccacauguggcgugau

SEQ ID NO: 2474780 - RNA, 18 nt, Brucella suis 1330
ccacauucauaaccgaag

SEQ ID NO: 2474781 - RNA, 18 nt, Brucella suis 1330
ccaccacaugcuccaggg

SEQ ID NO: 2474782 - RNA, 23 nt, Brucella suis 1330
ccaccaccccuuccuugccggga

SEQ ID NO: 2474783 - RNA, 14 nt, Brucella suis 1330
ccaccaccucgcca

SEQ ID NO: 2474784 - RNA, 15 nt, Brucella suis 1330
ccaccaccugcccgc

SEQ ID NO: 2474785 - RNA, 20 nt, Brucella suis 1330
ccaccacgauggaaggaaag

SEQ ID NO: 2474786 - RNA, 19 nt, Brucella suis 1330
ccaccagaaauggccccau

SEQ ID NO: 2474787 - RNA, 22 nt, Brucella suis 1330
ccaccagacgauuuucgccaag

SEQ ID NO: 2474788 - RNA, 17 nt, Brucella suis 1330
ccaccauggccgccccg

SEQ ID NO: 2474789 - RNA, 14 nt, Brucella suis 1330
ccacccagcccgaa

SEQ ID NO: 2474790 - RNA, 15 nt, Brucella suis 1330
ccacccggccgcccu

SEQ ID NO: 2474791 - RNA, 14 nt, Brucella suis 1330
ccaccgccugcagc

SEQ ID NO: 2474792 - RNA, 19 nt, Brucella suis 1330
ccaccgccugcagccggaa

SEQ ID NO: 2474793 - RNA, 21 nt, Brucella suis 1330
ccaccggacugauuucugauc

SEQ ID NO: 2474794 - RNA, 23 nt, Brucella suis 1330
ccaccuucgccgucgagcagcau

SEQ ID NO: 2474795 - RNA, 13 nt, Brucella suis 1330
ccacgaaccgugu

SEQ ID NO: 2474796 - RNA, 19 nt, Brucella suis 1330
ccacgacgggagccgcagc

SEQ ID NO: 2474797 - RNA, 15 nt, Brucella suis 1330
ccacgagaaaauggc

SEQ ID NO: 2474798 - RNA, 14 nt, Brucella suis 1330
ccacgagaaccgcg

SEQ ID NO: 2474799 - RNA, 22 nt, Brucella suis 1330
ccacgauaccgagaacggcggc

SEQ ID NO: 2474800 - RNA, 22 nt, Brucella suis 1330
ccacgauggaaggaaagcccag

SEQ ID NO: 2474801 - RNA, 12 nt, Brucella suis 1330
ccacgauuuccg

SEQ ID NO: 2474802 - RNA, 16 nt, Brucella suis 1330
ccacgauuuccgcgac

SEQ ID NO: 2474803 - RNA, 23 nt, Brucella suis 1330
ccacgauuuccgcgacaucauca

SEQ ID NO: 2474804 - RNA, 16 nt, Brucella suis 1330
ccacgccagccgcgau

SEQ ID NO: 2474805 - RNA, 14 nt, Brucella suis 1330
ccacgcgccgccau

SEQ ID NO: 2474806 - RNA, 12 nt, Brucella suis 1330
ccacgcuccaca

SEQ ID NO: 2474807 - RNA, 14 nt, Brucella suis 1330
ccacgcuugcgccc

SEQ ID NO: 2474808 - RNA, 15 nt, Brucella suis 1330
ccacggaucgacaaa

SEQ ID NO: 2474809 - RNA, 22 nt, Brucella suis 1330
ccacggaucgacaaaggugcug

SEQ ID NO: 2474810 - RNA, 22 nt, Brucella suis 1330
ccacggcgccugugugaacagg

SEQ ID NO: 2474811 - RNA, 12 nt, Brucella suis 1330
ccacgggccaga

SEQ ID NO: 2474812 - RNA, 17 nt, Brucella suis 1330
ccacguuuggagcggcg

SEQ ID NO: 2474813 - RNA, 14 nt, Brucella suis 1330
ccacugcccuggau

SEQ ID NO: 2474814 - RNA, 20 nt, Brucella suis 1330
ccacuucgucgguugagagc

SEQ ID NO: 2474815 - RNA, 12 nt, Brucella suis 1330
ccacuuugccgu

SEQ ID NO: 2474816 - RNA, 14 nt, Brucella suis 1330
ccacuuugccgucu

SEQ ID NO: 2474817 - RNA, 12 nt, Brucella suis 1330
ccagaaaaaccg

SEQ ID NO: 2474818 - RNA, 13 nt, Brucella suis 1330
ccagaaagagcau

SEQ ID NO: 2474819 - RNA, 20 nt, Brucella suis 1330
ccagaaccugcccgucuucc

SEQ ID NO: 2474820 - RNA, 20 nt, Brucella suis 1330
ccagaacuucgccaagcccu

SEQ ID NO: 2474821 - RNA, 22 nt, Brucella suis 1330
ccagaagauugcgcgacggagc

SEQ ID NO: 2474822 - RNA, 19 nt, Brucella suis 1330
ccagaagcccgcgcuccuc

SEQ ID NO: 2474823 - RNA, 12 nt, Brucella suis 1330
ccagaaggcgcg

SEQ ID NO: 2474824 - RNA, 13 nt, Brucella suis 1330
ccagaaugcgccg

SEQ ID NO: 2474825 - RNA, 16 nt, Brucella suis 1330
ccagaauguugaggga

SEQ ID NO: 2474826 - RNA, 19 nt, Brucella suis 1330
ccagacagccuugucgccc

SEQ ID NO: 2474827 - RNA, 20 nt, Brucella suis 1330
ccagacaugcgauaaugcuu

SEQ ID NO: 2474828 - RNA, 14 nt, Brucella suis 1330
ccagaccggcaauc

SEQ ID NO: 2474829 - RNA, 19 nt, Brucella suis 1330
ccagagacaucagauugag

SEQ ID NO: 2474830 - RNA, 15 nt, Brucella suis 1330
ccagagccucggcgc

SEQ ID NO: 2474831 - RNA, 23 nt, Brucella suis 1330
ccagagccucggcgcggacaagc

SEQ ID NO: 2474832 - RNA, 17 nt, Brucella suis 1330
ccagagccuguuccaaa

SEQ ID NO: 2474833 - RNA, 21 nt, Brucella suis 1330
ccagaucauugaaauucuuuu

SEQ ID NO: 2474834 - RNA, 15 nt, Brucella suis 1330
ccagaucggccuuga

SEQ ID NO: 2474835 - RNA, 19 nt, Brucella suis 1330
ccagauugcgccuaccaag

SEQ ID NO: 2474836 - RNA, 13 nt, Brucella suis 1330
ccagauugcgggc

SEQ ID NO: 2474837 - RNA, 18 nt, Brucella suis 1330
ccagcaaaagugcgaagc

SEQ ID NO: 2474838 - RNA, 13 nt, Brucella suis 1330
ccagcaaagcgau

SEQ ID NO: 2474839 - RNA, 14 nt, Brucella suis 1330
ccagcaauugcugg

SEQ ID NO: 2474840 - RNA, 18 nt, Brucella suis 1330
ccagcaccagcggcacgc

SEQ ID NO: 2474841 - RNA, 13 nt, Brucella suis 1330
ccagcacuuccag

SEQ ID NO: 2474842 - RNA, 13 nt, Brucella suis 1330
ccagccagcgcau

SEQ ID NO: 2474843 - RNA, 19 nt, Brucella suis 1330
ccagccagcgcauaaaggc

SEQ ID NO: 2474844 - RNA, 20 nt, Brucella suis 1330
ccagcccgaagaccaggccc

SEQ ID NO: 2474845 - RNA, 23 nt, Brucella suis 1330
ccagcccgugacguccaccaccu

SEQ ID NO: 2474846 - RNA, 17 nt, Brucella suis 1330
ccagcccuucaucaagc

SEQ ID NO: 2474847 - RNA, 13 nt, Brucella suis 1330
ccagccgcgauca

SEQ ID NO: 2474848 - RNA, 21 nt, Brucella suis 1330
ccagccggaaugccucccgau

SEQ ID NO: 2474849 - RNA, 23 nt, Brucella suis 1330
ccagccgucgagggcaccggccu

SEQ ID NO: 2474850 - RNA, 17 nt, Brucella suis 1330
ccagccuugcccuggcu

SEQ ID NO: 2474851 - RNA, 13 nt, Brucella suis 1330
ccagccuuuccag

SEQ ID NO: 2474852 - RNA, 19 nt, Brucella suis 1330
ccagcgaaacggcagccga

SEQ ID NO: 2474853 - RNA, 13 nt, Brucella suis 1330
ccagcgccuucag

SEQ ID NO: 2474854 - RNA, 15 nt, Brucella suis 1330
ccagcgcgccgauca

SEQ ID NO: 2474855 - RNA, 19 nt, Brucella suis 1330
ccagcgcggcaaugcgcuu

SEQ ID NO: 2474856 - RNA, 17 nt, Brucella suis 1330
ccagcggccaucuucca

SEQ ID NO: 2474857 - RNA, 13 nt, Brucella suis 1330
ccagcgggcgcga

SEQ ID NO: 2474858 - RNA, 15 nt, Brucella suis 1330
ccagcguauccacga

SEQ ID NO: 2474859 - RNA, 18 nt, Brucella suis 1330
ccagcguauugccguuga

SEQ ID NO: 2474860 - RNA, 13 nt, Brucella suis 1330
ccagcgucggcgg

SEQ ID NO: 2474861 - RNA, 14 nt, Brucella suis 1330
ccagcgugcagccu

SEQ ID NO: 2474862 - RNA, 22 nt, Brucella suis 1330
ccagcgugcagccugaacagcg

SEQ ID NO: 2474863 - RNA, 18 nt, Brucella suis 1330
ccaggaccgcgcagauca

SEQ ID NO: 2474864 - RNA, 13 nt, Brucella suis 1330
ccaggcauuggcu

SEQ ID NO: 2474865 - RNA, 12 nt, Brucella suis 1330
ccagggcuggcu

SEQ ID NO: 2474866 - RNA, 18 nt, Brucella suis 1330
ccagguggcugcccgccg

SEQ ID NO: 2474867 - RNA, 16 nt, Brucella suis 1330
ccagguugcgccgaua

SEQ ID NO: 2474868 - RNA, 13 nt, Brucella suis 1330
ccaguaaggcggg

SEQ ID NO: 2474869 - RNA, 15 nt, Brucella suis 1330
ccagucaaugccgug

SEQ ID NO: 2474870 - RNA, 14 nt, Brucella suis 1330
ccagucauggcgca

SEQ ID NO: 2474871 - RNA, 12 nt, Brucella suis 1330
ccaguccuugcc

SEQ ID NO: 2474872 - RNA, 16 nt, Brucella suis 1330
ccaguccuugcccucg

SEQ ID NO: 2474873 - RNA, 14 nt, Brucella suis 1330
ccagugcgccaccg

SEQ ID NO: 2474874 - RNA, 15 nt, Brucella suis 1330
ccaguggaagcacau

SEQ ID NO: 2474875 - RNA, 23 nt, Brucella suis 1330
ccaguugucgccgggcugcuucu

SEQ ID NO: 2474876 - RNA, 18 nt, Brucella suis 1330
ccaguuuauucauuggcg

SEQ ID NO: 2474877 - RNA, 12 nt, Brucella suis 1330
ccauaaagcacc

SEQ ID NO: 2474878 - RNA, 19 nt, Brucella suis 1330
ccauacgaauaccgcaccg

SEQ ID NO: 2474879 - RNA, 15 nt, Brucella suis 1330
ccauacguccagcca

SEQ ID NO: 2474880 - RNA, 23 nt, Brucella suis 1330
ccauagccccccuggauauccac

SEQ ID NO: 2474881 - RNA, 18 nt, Brucella suis 1330
ccauauaaagcuugaacc

SEQ ID NO: 2474882 - RNA, 18 nt, Brucella suis 1330
ccauauccaucugcuccu

SEQ ID NO: 2474883 - RNA, 18 nt, Brucella suis 1330
ccauaucuuuccauucca

SEQ ID NO: 2474884 - RNA, 17 nt, Brucella suis 1330
ccauauuggcggcaagc

SEQ ID NO: 2474885 - RNA, 14 nt, Brucella suis 1330
ccaucaaccgugca

SEQ ID NO: 2474886 - RNA, 13 nt, Brucella suis 1330
ccaucaaugcacc

SEQ ID NO: 2474887 - RNA, 16 nt, Brucella suis 1330
ccaucaccagccccca

SEQ ID NO: 2474888 - RNA, 21 nt, Brucella suis 1330
ccaucacgggcuuugccgcau

SEQ ID NO: 2474889 - RNA, 12 nt, Brucella suis 1330
ccaucagccggg

SEQ ID NO: 2474890 - RNA, 19 nt, Brucella suis 1330
ccaucgaaaccggcauuau

SEQ ID NO: 2474891 - RNA, 18 nt, Brucella suis 1330
ccaucgcaccauugggca

SEQ ID NO: 2474892 - RNA, 20 nt, Brucella suis 1330
ccaucgccgacgcgcgugac

SEQ ID NO: 2474893 - RNA, 13 nt, Brucella suis 1330
ccaucgcuugaac

SEQ ID NO: 2474894 - RNA, 20 nt, Brucella suis 1330
ccaucggcaaaggcuccggc

SEQ ID NO: 2474895 - RNA, 20 nt, Brucella suis 1330
ccaucggcgaggaagagaau

SEQ ID NO: 2474896 - RNA, 19 nt, Brucella suis 1330
ccaucggcucauccuccac

SEQ ID NO: 2474897 - RNA, 19 nt, Brucella suis 1330
ccaucucgcccaggaauuc

SEQ ID NO: 2474898 - RNA, 17 nt, Brucella suis 1330
ccaucugccgucagcaa

SEQ ID NO: 2474899 - RNA, 13 nt, Brucella suis 1330
ccaucugcggcgu

SEQ ID NO: 2474900 - RNA, 12 nt, Brucella suis 1330
ccaucugcuccu

SEQ ID NO: 2474901 - RNA, 14 nt, Brucella suis 1330
ccaucuucuuccag

SEQ ID NO: 2474902 - RNA, 16 nt, Brucella suis 1330
ccaucuuucuugaagu

SEQ ID NO: 2474903 - RNA, 19 nt, Brucella suis 1330
ccaugaaagaacggcccgc

SEQ ID NO: 2474904 - RNA, 15 nt, Brucella suis 1330
ccaugaagaucaauu

SEQ ID NO: 2474905 - RNA, 23 nt, Brucella suis 1330
ccaugacagcaaccgaaagcgcc

SEQ ID NO: 2474906 - RNA, 21 nt, Brucella suis 1330
ccaugcaguuccauccauuga

SEQ ID NO: 2474907 - RNA, 13 nt, Brucella suis 1330
ccaugccgcagga

SEQ ID NO: 2474908 - RNA, 19 nt, Brucella suis 1330
ccaugccgccaaggccgga

SEQ ID NO: 2474909 - RNA, 12 nt, Brucella suis 1330
ccaugccgccag

SEQ ID NO: 2474910 - RNA, 15 nt, Brucella suis 1330
ccaugccuuucaggu

SEQ ID NO: 2474911 - RNA, 22 nt, Brucella suis 1330
ccaugcgcucccggucuuccug

SEQ ID NO: 2474912 - RNA, 20 nt, Brucella suis 1330
ccaugcggccagccuauauc

SEQ ID NO: 2474913 - RNA, 15 nt, Brucella suis 1330
ccaugcgggcacgcu

SEQ ID NO: 2474914 - RNA, 18 nt, Brucella suis 1330
ccaugcucgauaaagccc

SEQ ID NO: 2474915 - RNA, 23 nt, Brucella suis 1330
ccauggaacagacaggauuugcc

SEQ ID NO: 2474916 - RNA, 16 nt, Brucella suis 1330
ccauggagcgcauccg

SEQ ID NO: 2474917 - RNA, 18 nt, Brucella suis 1330
ccauggcguccccaucga

SEQ ID NO: 2474918 - RNA, 20 nt, Brucella suis 1330
ccauguccgccugaucguca

SEQ ID NO: 2474919 - RNA, 17 nt, Brucella suis 1330
ccaugucgaaagcccug

SEQ ID NO: 2474920 - RNA, 15 nt, Brucella suis 1330
ccauguuuaugaaaa

SEQ ID NO: 2474921 - RNA, 17 nt, Brucella suis 1330
ccauguuuaugaaaaca

SEQ ID NO: 2474922 - RNA, 18 nt, Brucella suis 1330
ccauuaaucaaaaacaau

SEQ ID NO: 2474923 - RNA, 16 nt, Brucella suis 1330
ccauuauucucccaga

SEQ ID NO: 2474924 - RNA, 20 nt, Brucella suis 1330
ccauucaagcggcaugucau

SEQ ID NO: 2474925 - RNA, 16 nt, Brucella suis 1330
ccauucacuugcgauu

SEQ ID NO: 2474926 - RNA, 21 nt, Brucella suis 1330
ccauucccgccucagccggau

SEQ ID NO: 2474927 - RNA, 18 nt, Brucella suis 1330
ccauucgucacuacagcc

SEQ ID NO: 2474928 - RNA, 16 nt, Brucella suis 1330
ccauugcccgcccguc

SEQ ID NO: 2474929 - RNA, 15 nt, Brucella suis 1330
ccauuucacccgcca

SEQ ID NO: 2474930 - RNA, 18 nt, Brucella suis 1330
ccauuucauuaucggcgg

SEQ ID NO: 2474931 - RNA, 18 nt, Brucella suis 1330
ccauuucgggcgcgaucu

SEQ ID NO: 2474932 - RNA, 22 nt, Brucella suis 1330
ccauuuucauggguaccuucca

SEQ ID NO: 2474933 - RNA, 19 nt, Brucella suis 1330
cccaaaaaucccggaauuu

SEQ ID NO: 2474934 - RNA, 15 nt, Brucella suis 1330
cccaaagcgggcgcu

SEQ ID NO: 2474935 - RNA, 15 nt, Brucella suis 1330
cccaaccgagcagaa

SEQ ID NO: 2474936 - RNA, 22 nt, Brucella suis 1330
cccaagaaagaucagccagccg

SEQ ID NO: 2474937 - RNA, 23 nt, Brucella suis 1330
cccaaggucggcucaucgcgcug

SEQ ID NO: 2474938 - RNA, 16 nt, Brucella suis 1330
cccacaucgccuugca

SEQ ID NO: 2474939 - RNA, 13 nt, Brucella suis 1330
cccacccaccgcc

SEQ ID NO: 2474940 - RNA, 14 nt, Brucella suis 1330
cccacccaccgccu

SEQ ID NO: 2474941 - RNA, 16 nt, Brucella suis 1330
cccacccaccgccugc

SEQ ID NO: 2474942 - RNA, 19 nt, Brucella suis 1330
cccaccgccugcagccgga

SEQ ID NO: 2474943 - RNA, 16 nt, Brucella suis 1330
cccaccgucaaucgca

SEQ ID NO: 2474944 - RNA, 20 nt, Brucella suis 1330
cccacgaggaucggcacgau

SEQ ID NO: 2474945 - RNA, 15 nt, Brucella suis 1330
cccacgcccagcgcg

SEQ ID NO: 2474946 - RNA, 12 nt, Brucella suis 1330
cccacggaucga

SEQ ID NO: 2474947 - RNA, 17 nt, Brucella suis 1330
cccagaaccugcccguc

SEQ ID NO: 2474948 - RNA, 14 nt, Brucella suis 1330
cccagaaggcgcgg

SEQ ID NO: 2474949 - RNA, 15 nt, Brucella suis 1330
cccagaaggcgcggc

SEQ ID NO: 2474950 - RNA, 18 nt, Brucella suis 1330
cccagacauggaagauga

SEQ ID NO: 2474951 - RNA, 22 nt, Brucella suis 1330
cccagacauggaagaugacgcc

SEQ ID NO: 2474952 - RNA, 23 nt, Brucella suis 1330
cccagaggguuccgaauacaagc

SEQ ID NO: 2474953 - RNA, 15 nt, Brucella suis 1330
cccagcaccgcgcca

SEQ ID NO: 2474954 - RNA, 14 nt, Brucella suis 1330
cccagcauauggau

SEQ ID NO: 2474955 - RNA, 15 nt, Brucella suis 1330
cccagccaagcgcca

SEQ ID NO: 2474956 - RNA, 18 nt, Brucella suis 1330
cccagcccuuuucagcgg

SEQ ID NO: 2474957 - RNA, 19 nt, Brucella suis 1330
cccagcccuuuucagcgga

SEQ ID NO: 2474958 - RNA, 19 nt, Brucella suis 1330
cccagcgcggcaaugcgcu

SEQ ID NO: 2474959 - RNA, 15 nt, Brucella suis 1330
cccagcgguuuuccg

SEQ ID NO: 2474960 - RNA, 14 nt, Brucella suis 1330
cccagggcagauau

SEQ ID NO: 2474961 - RNA, 20 nt, Brucella suis 1330
cccagugugaccacugcauc

SEQ ID NO: 2474962 - RNA, 13 nt, Brucella suis 1330
cccaucaaugcac

SEQ ID NO: 2474963 - RNA, 22 nt, Brucella suis 1330
cccaucgcauugcugaugauuu

SEQ ID NO: 2474964 - RNA, 14 nt, Brucella suis 1330
cccaugaccggaug

SEQ ID NO: 2474965 - RNA, 16 nt, Brucella suis 1330
cccaugaccggaugca

SEQ ID NO: 2474966 - RNA, 23 nt, Brucella suis 1330
cccaugagaaggcaagccccagc

SEQ ID NO: 2474967 - RNA, 15 nt, Brucella suis 1330
cccaugagcuucaac

SEQ ID NO: 2474968 - RNA, 22 nt, Brucella suis 1330
cccauggacuuuucagccucgg

SEQ ID NO: 2474969 - RNA, 17 nt, Brucella suis 1330
cccauggccugcugcau

SEQ ID NO: 2474970 - RNA, 18 nt, Brucella suis 1330
cccaugguuugcagcaau

SEQ ID NO: 2474971 - RNA, 23 nt, Brucella suis 1330
cccaugguuugcagcaauuccug

SEQ ID NO: 2474972 - RNA, 22 nt, Brucella suis 1330
cccauguuuaugaaaacauggg

SEQ ID NO: 2474973 - RNA, 17 nt, Brucella suis 1330
ccccaccgucaaucgca

SEQ ID NO: 2474974 - RNA, 21 nt, Brucella suis 1330
ccccacgggauggcggccuug

SEQ ID NO: 2474975 - RNA, 16 nt, Brucella suis 1330
ccccagaaggcgcggc

SEQ ID NO: 2474976 - RNA, 15 nt, Brucella suis 1330
ccccagcccgcccca

SEQ ID NO: 2474977 - RNA, 22 nt, Brucella suis 1330
ccccagcguauugccguugaga

SEQ ID NO: 2474978 - RNA, 23 nt, Brucella suis 1330
ccccaucggguguuugcgacggg

SEQ ID NO: 2474979 - RNA, 13 nt, Brucella suis 1330
ccccaugaccgga

SEQ ID NO: 2474980 - RNA, 16 nt, Brucella suis 1330
ccccaugagaaggcaa

SEQ ID NO: 2474981 - RNA, 18 nt, Brucella suis 1330
ccccaugagaaggcaagc

SEQ ID NO: 2474982 - RNA, 17 nt, Brucella suis 1330
ccccaugguuugcagca

SEQ ID NO: 2474983 - RNA, 15 nt, Brucella suis 1330
ccccauucaugcacc

SEQ ID NO: 2474984 - RNA, 14 nt, Brucella suis 1330
cccccaacgugcgg

SEQ ID NO: 2474985 - RNA, 22 nt, Brucella suis 1330
cccccaacgugcggugcuccca

SEQ ID NO: 2474986 - RNA, 16 nt, Brucella suis 1330
cccccagaaggcgcgg

SEQ ID NO: 2474987 - RNA, 17 nt, Brucella suis 1330
cccccuggauauccaca

SEQ ID NO: 2474988 - RNA, 22 nt, Brucella suis 1330
cccccuguuucugcuggagcuu

SEQ ID NO: 2474989 - RNA, 18 nt, Brucella suis 1330
ccccgcccgcggccacaa

SEQ ID NO: 2474990 - RNA, 15 nt, Brucella suis 1330
ccccggcaccgcgca

SEQ ID NO: 2474991 - RNA, 21 nt, Brucella suis 1330
ccccggcaguuucugccgcgc

SEQ ID NO: 2474992 - RNA, 22 nt, Brucella suis 1330
ccccggcaguuucugccgcgca

SEQ ID NO: 2474993 - RNA, 13 nt, Brucella suis 1330
ccccggcgcagcg

SEQ ID NO: 2474994 - RNA, 16 nt, Brucella suis 1330
ccccgggcagcggcgc

SEQ ID NO: 2474995 - RNA, 18 nt, Brucella suis 1330
ccccgggcagcggcgcgc

SEQ ID NO: 2474996 - RNA, 20 nt, Brucella suis 1330
ccccgugaucuuguccagac

SEQ ID NO: 2474997 - RNA, 18 nt, Brucella suis 1330
ccccuaaagccgcuccau

SEQ ID NO: 2474998 - RNA, 14 nt, Brucella suis 1330
ccccuacucccuua

SEQ ID NO: 2474999 - RNA, 13 nt, Brucella suis 1330
ccccuauuccccu

SEQ ID NO: 2475000 - RNA, 16 nt, Brucella suis 1330
ccccucaccuugccgg

SEQ ID NO: 2475001 - RNA, 23 nt, Brucella suis 1330
cccgaaaccauccaugcgcggcg

SEQ ID NO: 2475002 - RNA, 18 nt, Brucella suis 1330
cccgagaagcucaacgcc

SEQ ID NO: 2475003 - RNA, 14 nt, Brucella suis 1330
cccgagcgucugau

SEQ ID NO: 2475004 - RNA, 14 nt, Brucella suis 1330
cccgauaaacccgc

SEQ ID NO: 2475005 - RNA, 19 nt, Brucella suis 1330
cccgauaaacccgccccca

SEQ ID NO: 2475006 - RNA, 15 nt, Brucella suis 1330
cccgaucagauagcc

SEQ ID NO: 2475007 - RNA, 18 nt, Brucella suis 1330
cccgcacccuauuccccu

SEQ ID NO: 2475008 - RNA, 20 nt, Brucella suis 1330
cccgcauaaaugcuccuggc

SEQ ID NO: 2475009 - RNA, 20 nt, Brucella suis 1330
cccgcauagccaucgccgac

SEQ ID NO: 2475010 - RNA, 17 nt, Brucella suis 1330
cccgcauggucgaugcc

SEQ ID NO: 2475011 - RNA, 17 nt, Brucella suis 1330
cccgccaugcggccagc

SEQ ID NO: 2475012 - RNA, 12 nt, Brucella suis 1330
cccgcccgcggc

SEQ ID NO: 2475013 - RNA, 21 nt, Brucella suis 1330
cccgcccguccucaucgccgg

SEQ ID NO: 2475014 - RNA, 15 nt, Brucella suis 1330
cccgccgcgacgaug

SEQ ID NO: 2475015 - RNA, 22 nt, Brucella suis 1330
cccgccuugcagaugagcggca

SEQ ID NO: 2475016 - RNA, 14 nt, Brucella suis 1330
cccgccuuggaaac

SEQ ID NO: 2475017 - RNA, 15 nt, Brucella suis 1330
cccgcggccacaagc

SEQ ID NO: 2475018 - RNA, 19 nt, Brucella suis 1330
cccgcggccacaagcgccg

SEQ ID NO: 2475019 - RNA, 20 nt, Brucella suis 1330
cccgcgugaugagccgcuuc

SEQ ID NO: 2475020 - RNA, 16 nt, Brucella suis 1330
cccgcuucgaugcgcu

SEQ ID NO: 2475021 - RNA, 19 nt, Brucella suis 1330
cccggaagcgcaaggcggc

SEQ ID NO: 2475022 - RNA, 13 nt, Brucella suis 1330
cccggacaaagcc

SEQ ID NO: 2475023 - RNA, 23 nt, Brucella suis 1330
cccggagccuucgcaucgggauc

SEQ ID NO: 2475024 - RNA, 19 nt, Brucella suis 1330
cccggauugggucaacgcc

SEQ ID NO: 2475025 - RNA, 20 nt, Brucella suis 1330
cccggauugggucaacgccc

SEQ ID NO: 2475026 - RNA, 14 nt, Brucella suis 1330
cccggcaccgcaaa

SEQ ID NO: 2475027 - RNA, 20 nt, Brucella suis 1330
cccggcagcgaaggcugccg

SEQ ID NO: 2475028 - RNA, 22 nt, Brucella suis 1330
cccggcauggccugcgcgcgca

SEQ ID NO: 2475029 - RNA, 16 nt, Brucella suis 1330
cccggccuuugcgccg

SEQ ID NO: 2475030 - RNA, 13 nt, Brucella suis 1330
cccggcgcacggc

SEQ ID NO: 2475031 - RNA, 17 nt, Brucella suis 1330
cccggcgcgaccgcguu

SEQ ID NO: 2475032 - RNA, 16 nt, Brucella suis 1330
cccggcggcugaaauc

SEQ ID NO: 2475033 - RNA, 22 nt, Brucella suis 1330
cccggcggugaagaagcgccag

SEQ ID NO: 2475034 - RNA, 15 nt, Brucella suis 1330
cccggcuggaauugu

SEQ ID NO: 2475035 - RNA, 15 nt, Brucella suis 1330
cccggcuuucgccgg

SEQ ID NO: 2475036 - RNA, 14 nt, Brucella suis 1330
cccgggcagcggcg

SEQ ID NO: 2475037 - RNA, 18 nt, Brucella suis 1330
cccggucacccgcacgcc

SEQ ID NO: 2475038 - RNA, 19 nt, Brucella suis 1330
cccggucacccgcacgccg

SEQ ID NO: 2475039 - RNA, 22 nt, Brucella suis 1330
cccggugcauuuuuccagaccu

SEQ ID NO: 2475040 - RNA, 21 nt, Brucella suis 1330
cccgguggacaugaacacggc

SEQ ID NO: 2475041 - RNA, 13 nt, Brucella suis 1330
cccgucaaugcca

SEQ ID NO: 2475042 - RNA, 23 nt, Brucella suis 1330
cccguugccgaucagcaucgccc

SEQ ID NO: 2475043 - RNA, 14 nt, Brucella suis 1330
cccguuggcgccca

SEQ ID NO: 2475044 - RNA, 19 nt, Brucella suis 1330
cccguuugaagagcuuuca

SEQ ID NO: 2475045 - RNA, 13 nt, Brucella suis 1330
cccuacucccuua

SEQ ID NO: 2475046 - RNA, 15 nt, Brucella suis 1330
cccuaucaagaaugu

SEQ ID NO: 2475047 - RNA, 22 nt, Brucella suis 1330
cccucaaaacgcugccagccgc

SEQ ID NO: 2475048 - RNA, 20 nt, Brucella suis 1330
cccucaaccgagcagccgcg

SEQ ID NO: 2475049 - RNA, 15 nt, Brucella suis 1330
cccucauggcgauaa

SEQ ID NO: 2475050 - RNA, 16 nt, Brucella suis 1330
cccuccaccgcucacc

SEQ ID NO: 2475051 - RNA, 21 nt, Brucella suis 1330
cccucgaucagcaccaucgag

SEQ ID NO: 2475052 - RNA, 20 nt, Brucella suis 1330
cccucgaucggugcaaugcc

SEQ ID NO: 2475053 - RNA, 12 nt, Brucella suis 1330
cccucgccgccg

SEQ ID NO: 2475054 - RNA, 19 nt, Brucella suis 1330
cccucugaaccggcgggcu

SEQ ID NO: 2475055 - RNA, 19 nt, Brucella suis 1330
cccucuucguccucgcgcc

SEQ ID NO: 2475056 - RNA, 17 nt, Brucella suis 1330
cccugcaauaacagcgu

SEQ ID NO: 2475057 - RNA, 14 nt, Brucella suis 1330
cccugcacaccaaa

SEQ ID NO: 2475058 - RNA, 14 nt, Brucella suis 1330
cccugcgggccaug

SEQ ID NO: 2475059 - RNA, 13 nt, Brucella suis 1330
cccugcugcuucg

SEQ ID NO: 2475060 - RNA, 13 nt, Brucella suis 1330
cccuggaaagaag

SEQ ID NO: 2475061 - RNA, 23 nt, Brucella suis 1330
cccuggcggcgugcaggcugccc

SEQ ID NO: 2475062 - RNA, 22 nt, Brucella suis 1330
cccugucagaaagucugcuucc

SEQ ID NO: 2475063 - RNA, 17 nt, Brucella suis 1330
cccuguccugccagcgg

SEQ ID NO: 2475064 - RNA, 20 nt, Brucella suis 1330
cccugucgccgaaaagcgcc

SEQ ID NO: 2475065 - RNA, 22 nt, Brucella suis 1330
cccugucgccgaaaagcgccug

SEQ ID NO: 2475066 - RNA, 14 nt, Brucella suis 1330
cccuguuucugcug

SEQ ID NO: 2475067 - RNA, 17 nt, Brucella suis 1330
cccuuaugaucgccgcc

SEQ ID NO: 2475068 - RNA, 19 nt, Brucella suis 1330
cccuucaaaccauccucga

SEQ ID NO: 2475069 - RNA, 14 nt, Brucella suis 1330
cccuugaaaucauu

SEQ ID NO: 2475070 - RNA, 16 nt, Brucella suis 1330
cccuugaagaauucau

SEQ ID NO: 2475071 - RNA, 22 nt, Brucella suis 1330
cccuugccggauaucgccagaa

SEQ ID NO: 2475072 - RNA, 17 nt, Brucella suis 1330
cccuuuuccgcaccgcc

SEQ ID NO: 2475073 - RNA, 12 nt, Brucella suis 1330
ccgaaaaccgcu

SEQ ID NO: 2475074 - RNA, 19 nt, Brucella suis 1330
ccgaaaaccguuucacacu

SEQ ID NO: 2475075 - RNA, 12 nt, Brucella suis 1330
ccgaaaagccgc

SEQ ID NO: 2475076 - RNA, 15 nt, Brucella suis 1330
ccgaaaagccgcgcg

SEQ ID NO: 2475077 - RNA, 12 nt, Brucella suis 1330
ccgaaaagugcg

SEQ ID NO: 2475078 - RNA, 24 nt, Brucella suis 1330
ccgaaaccauccaugcgcggcgaa

SEQ ID NO: 2475079 - RNA, 21 nt, Brucella suis 1330
ccgaaacgguggccuuccuuc

SEQ ID NO: 2475080 - RNA, 20 nt, Brucella suis 1330
ccgaacagcgcccagaguuc

SEQ ID NO: 2475081 - RNA, 15 nt, Brucella suis 1330
ccgaaccgggccgca

SEQ ID NO: 2475082 - RNA, 21 nt, Brucella suis 1330
ccgaaccggggcagggcaggc

SEQ ID NO: 2475083 - RNA, 17 nt, Brucella suis 1330
ccgaacugggcggccag

SEQ ID NO: 2475084 - RNA, 12 nt, Brucella suis 1330
ccgaagaacagu

SEQ ID NO: 2475085 - RNA, 13 nt, Brucella suis 1330
ccgaagaaugcgc

SEQ ID NO: 2475086 - RNA, 12 nt, Brucella suis 1330
ccgaagccaggu

SEQ ID NO: 2475087 - RNA, 16 nt, Brucella suis 1330
ccgaauacaagcccaa

SEQ ID NO: 2475088 - RNA, 17 nt, Brucella suis 1330
ccgaauacaagcccaag

SEQ ID NO: 2475089 - RNA, 18 nt, Brucella suis 1330
ccgaauagcgcaucgcca

SEQ ID NO: 2475090 - RNA, 21 nt, Brucella suis 1330
ccgaauagcgcaucgccaccg

SEQ ID NO: 2475091 - RNA, 15 nt, Brucella suis 1330
ccgaauaggcgcgca

SEQ ID NO: 2475092 - RNA, 17 nt, Brucella suis 1330
ccgaaucggaaaggaug

SEQ ID NO: 2475093 - RNA, 13 nt, Brucella suis 1330
ccgaaugccagug

SEQ ID NO: 2475094 - RNA, 18 nt, Brucella suis 1330
ccgaaugccagugccaua

SEQ ID NO: 2475095 - RNA, 21 nt, Brucella suis 1330
ccgacaaagaucaucgccgug

SEQ ID NO: 2475096 - RNA, 12 nt, Brucella suis 1330
ccgacaagcagc

SEQ ID NO: 2475097 - RNA, 13 nt, Brucella suis 1330
ccgacagggcaag

SEQ ID NO: 2475098 - RNA, 13 nt, Brucella suis 1330
ccgacauccaucg

SEQ ID NO: 2475099 - RNA, 14 nt, Brucella suis 1330
ccgacauccaucgg

SEQ ID NO: 2475100 - RNA, 20 nt, Brucella suis 1330
ccgacauccuugaaaagcug

SEQ ID NO: 2475101 - RNA, 21 nt, Brucella suis 1330
ccgacaugcuuguagacgauc

SEQ ID NO: 2475102 - RNA, 12 nt, Brucella suis 1330
ccgaccagaacg

SEQ ID NO: 2475103 - RNA, 18 nt, Brucella suis 1330
ccgacccgucaaugccau

SEQ ID NO: 2475104 - RNA, 17 nt, Brucella suis 1330
ccgacgaaagccacgcu

SEQ ID NO: 2475105 - RNA, 19 nt, Brucella suis 1330
ccgacugaacgaaugcgua

SEQ ID NO: 2475106 - RNA, 19 nt, Brucella suis 1330
ccgacugcacgucuucggc

SEQ ID NO: 2475107 - RNA, 20 nt, Brucella suis 1330
ccgagaacggcggcggcgau

SEQ ID NO: 2475108 - RNA, 15 nt, Brucella suis 1330
ccgagcauggccugc

SEQ ID NO: 2475109 - RNA, 13 nt, Brucella suis 1330
ccgagcgccgccg

SEQ ID NO: 2475110 - RNA, 13 nt, Brucella suis 1330
ccgagcugcaagg

SEQ ID NO: 2475111 - RNA, 18 nt, Brucella suis 1330
ccgaggaauuucagcgaa

SEQ ID NO: 2475112 - RNA, 15 nt, Brucella suis 1330
ccgaggccgccaccg

SEQ ID NO: 2475113 - RNA, 18 nt, Brucella suis 1330
ccgaggggaacgacgcgc

SEQ ID NO: 2475114 - RNA, 22 nt, Brucella suis 1330
ccgauaagugccgcgccgauga

SEQ ID NO: 2475115 - RNA, 15 nt, Brucella suis 1330
ccgaucacgccguca

SEQ ID NO: 2475116 - RNA, 18 nt, Brucella suis 1330
ccgaucagcaucgccccc

SEQ ID NO: 2475117 - RNA, 21 nt, Brucella suis 1330
ccgaucaucgccugaaugaaa

SEQ ID NO: 2475118 - RNA, 11 nt, Brucella suis 1330
ccgaucuauca

SEQ ID NO: 2475119 - RNA, 20 nt, Brucella suis 1330
ccgaucuguucauguuuuga

SEQ ID NO: 2475120 - RNA, 15 nt, Brucella suis 1330
ccgaugacggcgcgg

SEQ ID NO: 2475121 - RNA, 17 nt, Brucella suis 1330
ccgaugcagaugccaug

SEQ ID NO: 2475122 - RNA, 18 nt, Brucella suis 1330
ccgaugcgggaaaguuau

SEQ ID NO: 2475123 - RNA, 23 nt, Brucella suis 1330
ccgaugcguuggaaaaugcgaca

SEQ ID NO: 2475124 - RNA, 13 nt, Brucella suis 1330
ccgauggcgauca

SEQ ID NO: 2475125 - RNA, 17 nt, Brucella suis 1330
ccgauggcgaucacgaa

SEQ ID NO: 2475126 - RNA, 22 nt, Brucella suis 1330
ccgauugccccgccauaaagca

SEQ ID NO: 2475127 - RNA, 23 nt, Brucella suis 1330
ccgauugccccgccauaaagcac

SEQ ID NO: 2475128 - RNA, 15 nt, Brucella suis 1330
ccgauuuucugcugc

SEQ ID NO: 2475129 - RNA, 11 nt, Brucella suis 1330
ccgcaaaggca

SEQ ID NO: 2475130 - RNA, 14 nt, Brucella suis 1330
ccgcaaccagcgac

SEQ ID NO: 2475131 - RNA, 17 nt, Brucella suis 1330
ccgcaaccagcgacagg

SEQ ID NO: 2475132 - RNA, 16 nt, Brucella suis 1330
ccgcaacccauuuuca

SEQ ID NO: 2475133 - RNA, 21 nt, Brucella suis 1330
ccgcaagcuggaaccagcgug

SEQ ID NO: 2475134 - RNA, 20 nt, Brucella suis 1330
ccgcaaggaugugagcgaau

SEQ ID NO: 2475135 - RNA, 22 nt, Brucella suis 1330
ccgcaauacgccuggccggcgc

SEQ ID NO: 2475136 - RNA, 17 nt, Brucella suis 1330
ccgcaauccuggugcgc

SEQ ID NO: 2475137 - RNA, 22 nt, Brucella suis 1330
ccgcaaucgccaccggcggcgc

SEQ ID NO: 2475138 - RNA, 19 nt, Brucella suis 1330
ccgcaauggcgacaugcug

SEQ ID NO: 2475139 - RNA, 11 nt, Brucella suis 1330
ccgcacagcau

SEQ ID NO: 2475140 - RNA, 14 nt, Brucella suis 1330
ccgcacccuauucc

SEQ ID NO: 2475141 - RNA, 17 nt, Brucella suis 1330
ccgcacccuauuccccu

SEQ ID NO: 2475142 - RNA, 12 nt, Brucella suis 1330
ccgcaccgccga

SEQ ID NO: 2475143 - RNA, 23 nt, Brucella suis 1330
ccgcaccgccgaucaggaccggc

SEQ ID NO: 2475144 - RNA, 15 nt, Brucella suis 1330
ccgcacgcaaggcgg

SEQ ID NO: 2475145 - RNA, 23 nt, Brucella suis 1330
ccgcacguugggggacgggcggu

SEQ ID NO: 2475146 - RNA, 12 nt, Brucella suis 1330
ccgcagccaggg

SEQ ID NO: 2475147 - RNA, 11 nt, Brucella suis 1330
ccgcaggcacu

SEQ ID NO: 2475148 - RNA, 15 nt, Brucella suis 1330
ccgcagugagcagaa

SEQ ID NO: 2475149 - RNA, 17 nt, Brucella suis 1330
ccgcauaaaugcuccug

SEQ ID NO: 2475150 - RNA, 19 nt, Brucella suis 1330
ccgcauaaaugcuccuggc

SEQ ID NO: 2475151 - RNA, 20 nt, Brucella suis 1330
ccgcauaauccucacggcca

SEQ ID NO: 2475152 - RNA, 15 nt, Brucella suis 1330
ccgcauaggggcgca

SEQ ID NO: 2475153 - RNA, 17 nt, Brucella suis 1330
ccgcauaggggcgcaag

SEQ ID NO: 2475154 - RNA, 13 nt, Brucella suis 1330
ccgcaucgaucac

SEQ ID NO: 2475155 - RNA, 19 nt, Brucella suis 1330
ccgcaucgaucacaugcgc

SEQ ID NO: 2475156 - RNA, 22 nt, Brucella suis 1330
ccgcaucggaagggcaaggcgc

SEQ ID NO: 2475157 - RNA, 21 nt, Brucella suis 1330
ccgcaucggccugacggugca

SEQ ID NO: 2475158 - RNA, 18 nt, Brucella suis 1330
ccgcaucuccucaaucgc

SEQ ID NO: 2475159 - RNA, 18 nt, Brucella suis 1330
ccgcaugauccgcuccag

SEQ ID NO: 2475160 - RNA, 19 nt, Brucella suis 1330
ccgcauggucgaugccgcc

SEQ ID NO: 2475161 - RNA, 18 nt, Brucella suis 1330
ccgcauuuucgagcaucg

SEQ ID NO: 2475162 - RNA, 14 nt, Brucella suis 1330
ccgccaagccagcc

SEQ ID NO: 2475163 - RNA, 16 nt, Brucella suis 1330
ccgccaagccagcccg

SEQ ID NO: 2475164 - RNA, 17 nt, Brucella suis 1330
ccgccaaggaacgcggc

SEQ ID NO: 2475165 - RNA, 18 nt, Brucella suis 1330
ccgccaaggaacgcggcc

SEQ ID NO: 2475166 - RNA, 18 nt, Brucella suis 1330
ccgccaagggccgccgaa

SEQ ID NO: 2475167 - RNA, 16 nt, Brucella suis 1330
ccgccaauaccgugau

SEQ ID NO: 2475168 - RNA, 19 nt, Brucella suis 1330
ccgccaauaccgugaucag

SEQ ID NO: 2475169 - RNA, 11 nt, Brucella suis 1330
ccgccacaugu

SEQ ID NO: 2475170 - RNA, 13 nt, Brucella suis 1330
ccgccaccgccgg

SEQ ID NO: 2475171 - RNA, 13 nt, Brucella suis 1330
ccgccaccgcgcc

SEQ ID NO: 2475172 - RNA, 15 nt, Brucella suis 1330
ccgccacgaggaaga

SEQ ID NO: 2475173 - RNA, 14 nt, Brucella suis 1330
ccgccagcaccggc

SEQ ID NO: 2475174 - RNA, 12 nt, Brucella suis 1330
ccgccagcagaa

SEQ ID NO: 2475175 - RNA, 14 nt, Brucella suis 1330
ccgccagcaggccg

SEQ ID NO: 2475176 - RNA, 15 nt, Brucella suis 1330
ccgccauaccgucga

SEQ ID NO: 2475177 - RNA, 19 nt, Brucella suis 1330
ccgccaugcggccagccua

SEQ ID NO: 2475178 - RNA, 21 nt, Brucella suis 1330
ccgccauggucgcgcaccagc

SEQ ID NO: 2475179 - RNA, 14 nt, Brucella suis 1330
ccgcccagggcaga

SEQ ID NO: 2475180 - RNA, 18 nt, Brucella suis 1330
ccgcccaucccggaagga

SEQ ID NO: 2475181 - RNA, 12 nt, Brucella suis 1330
ccgcccgcggcc

SEQ ID NO: 2475182 - RNA, 14 nt, Brucella suis 1330
ccgccgaucaggac

SEQ ID NO: 2475183 - RNA, 14 nt, Brucella suis 1330
ccgccgcacuuaca

SEQ ID NO: 2475184 - RNA, 23 nt, Brucella suis 1330
ccgccgcacuuacaaaugcaagu

SEQ ID NO: 2475185 - RNA, 19 nt, Brucella suis 1330
ccgccgcagaccacccggc

SEQ ID NO: 2475186 - RNA, 15 nt, Brucella suis 1330
ccgccgcuuccagcg

SEQ ID NO: 2475187 - RNA, 18 nt, Brucella suis 1330
ccgccggaaccauaucga

SEQ ID NO: 2475188 - RNA, 17 nt, Brucella suis 1330
ccgccggcgccgccaag

SEQ ID NO: 2475189 - RNA, 24 nt, Brucella suis 1330
ccgccugaucgucaggcgcauucg

SEQ ID NO: 2475190 - RNA, 14 nt, Brucella suis 1330
ccgccugcagccgg

SEQ ID NO: 2475191 - RNA, 16 nt, Brucella suis 1330
ccgccugcagccggaa

SEQ ID NO: 2475192 - RNA, 13 nt, Brucella suis 1330
ccgccugccagcc

SEQ ID NO: 2475193 - RNA, 16 nt, Brucella suis 1330
ccgccugccaugccgc

SEQ ID NO: 2475194 - RNA, 13 nt, Brucella suis 1330
ccgccugcgcaug

SEQ ID NO: 2475195 - RNA, 18 nt, Brucella suis 1330
ccgccuuaucggggcggc

SEQ ID NO: 2475196 - RNA, 23 nt, Brucella suis 1330
ccgccuucaaaacgcagcaucac

SEQ ID NO: 2475197 - RNA, 23 nt, Brucella suis 1330
ccgccuugcagaugagcggcagc

SEQ ID NO: 2475198 - RNA, 14 nt, Brucella suis 1330
ccgccuuggcgaag

SEQ ID NO: 2475199 - RNA, 15 nt, Brucella suis 1330
ccgcgaaaaccggcu

SEQ ID NO: 2475200 - RNA, 17 nt, Brucella suis 1330
ccgcgaaagccagaacc

SEQ ID NO: 2475201 - RNA, 22 nt, Brucella suis 1330
ccgcgauaggugacgcgggcau

SEQ ID NO: 2475202 - RNA, 23 nt, Brucella suis 1330
ccgcgauaucgucgcgcucgccg

SEQ ID NO: 2475203 - RNA, 21 nt, Brucella suis 1330
ccgcgcaauaaugcagcgccg

SEQ ID NO: 2475204 - RNA, 14 nt, Brucella suis 1330
ccgcgccaugccau

SEQ ID NO: 2475205 - RNA, 18 nt, Brucella suis 1330
ccgcgccccuggcggcac

SEQ ID NO: 2475206 - RNA, 12 nt, Brucella suis 1330
ccgcgccgauca

SEQ ID NO: 2475207 - RNA, 19 nt, Brucella suis 1330
ccgcgccggucuccucagc

SEQ ID NO: 2475208 - RNA, 17 nt, Brucella suis 1330
ccgcgcgaagcgcaucg

SEQ ID NO: 2475209 - RNA, 13 nt, Brucella suis 1330
ccgcgcggcagcg

SEQ ID NO: 2475210 - RNA, 12 nt, Brucella suis 1330
ccgcgcggcuua

SEQ ID NO: 2475211 - RNA, 16 nt, Brucella suis 1330
ccgcgcugaagcggcc

SEQ ID NO: 2475212 - RNA, 22 nt, Brucella suis 1330
ccgcggcaucccugucgccgaa

SEQ ID NO: 2475213 - RNA, 17 nt, Brucella suis 1330
ccgcggcgguuuugagc

SEQ ID NO: 2475214 - RNA, 20 nt, Brucella suis 1330
ccgcggcgguuuugagcugc

SEQ ID NO: 2475215 - RNA, 20 nt, Brucella suis 1330
ccgcggcucucacgcgcagc

SEQ ID NO: 2475216 - RNA, 15 nt, Brucella suis 1330
ccgcgguuucuccug

SEQ ID NO: 2475217 - RNA, 19 nt, Brucella suis 1330
ccgcucaucgcaguugcac

SEQ ID NO: 2475218 - RNA, 20 nt, Brucella suis 1330
ccgcucaugcgguagaauuc

SEQ ID NO: 2475219 - RNA, 20 nt, Brucella suis 1330
ccgcuccagccgagcgccag

SEQ ID NO: 2475220 - RNA, 24 nt, Brucella suis 1330
ccgcuccagccgagcgccagauaa

SEQ ID NO: 2475221 - RNA, 16 nt, Brucella suis 1330
ccgcuccggcgucagc

SEQ ID NO: 2475222 - RNA, 16 nt, Brucella suis 1330
ccgcucuaacuauuug

SEQ ID NO: 2475223 - RNA, 21 nt, Brucella suis 1330
ccgcucuagguucgcguaucg

SEQ ID NO: 2475224 - RNA, 13 nt, Brucella suis 1330
ccgcugaggcggc

SEQ ID NO: 2475225 - RNA, 18 nt, Brucella suis 1330
ccgcugaggcggccggag

SEQ ID NO: 2475226 - RNA, 21 nt, Brucella suis 1330
ccgcugccauaauucagcuuu

SEQ ID NO: 2475227 - RNA, 20 nt, Brucella suis 1330
ccgcugcgccgcacgcgcga

SEQ ID NO: 2475228 - RNA, 16 nt, Brucella suis 1330
ccgcuugcggcgauaa

SEQ ID NO: 2475229 - RNA, 13 nt, Brucella suis 1330
ccggaacaaguuc

SEQ ID NO: 2475230 - RNA, 15 nt, Brucella suis 1330
ccggaaccauaucga

SEQ ID NO: 2475231 - RNA, 17 nt, Brucella suis 1330
ccggaaccgaccugcuu

SEQ ID NO: 2475232 - RNA, 17 nt, Brucella suis 1330
ccggaagagccgggcug

SEQ ID NO: 2475233 - RNA, 13 nt, Brucella suis 1330
ccggaagcgcaag

SEQ ID NO: 2475234 - RNA, 20 nt, Brucella suis 1330
ccggaagcgcaaggcggcgc

SEQ ID NO: 2475235 - RNA, 22 nt, Brucella suis 1330
ccggaccacgcagggucgcgac

SEQ ID NO: 2475236 - RNA, 21 nt, Brucella suis 1330
ccggaccgaaggccagacacu

SEQ ID NO: 2475237 - RNA, 18 nt, Brucella suis 1330
ccggacgugacaucaagc

SEQ ID NO: 2475238 - RNA, 23 nt, Brucella suis 1330
ccggacgugacaucaagccccuu

SEQ ID NO: 2475239 - RNA, 14 nt, Brucella suis 1330
ccggagcgaccagc

SEQ ID NO: 2475240 - RNA, 13 nt, Brucella suis 1330
ccggaucauccau

SEQ ID NO: 2475241 - RNA, 15 nt, Brucella suis 1330
ccggaucgcgcggca

SEQ ID NO: 2475242 - RNA, 15 nt, Brucella suis 1330
ccggaugcgcggaua

SEQ ID NO: 2475243 - RNA, 14 nt, Brucella suis 1330
ccggauuugccaag

SEQ ID NO: 2475244 - RNA, 16 nt, Brucella suis 1330
ccggauuuugccuuca

SEQ ID NO: 2475245 - RNA, 13 nt, Brucella suis 1330
ccggcaccgcaaa

SEQ ID NO: 2475246 - RNA, 13 nt, Brucella suis 1330
ccggcaccgcgca

SEQ ID NO: 2475247 - RNA, 14 nt, Brucella suis 1330
ccggcaccgcgcaa

SEQ ID NO: 2475248 - RNA, 14 nt, Brucella suis 1330
ccggcacgaucagg

SEQ ID NO: 2475249 - RNA, 20 nt, Brucella suis 1330
ccggcacgaucagggaacgg

SEQ ID NO: 2475250 - RNA, 14 nt, Brucella suis 1330
ccggcacuucgccc

SEQ ID NO: 2475251 - RNA, 17 nt, Brucella suis 1330
ccggcacuucgcccaga

SEQ ID NO: 2475252 - RNA, 20 nt, Brucella suis 1330
ccggcagcacgugcccguuc

SEQ ID NO: 2475253 - RNA, 14 nt, Brucella suis 1330
ccggcagccuucgc

SEQ ID NO: 2475254 - RNA, 11 nt, Brucella suis 1330
ccggcagcuuu

SEQ ID NO: 2475255 - RNA, 13 nt, Brucella suis 1330
ccggcagcuuucg

SEQ ID NO: 2475256 - RNA, 22 nt, Brucella suis 1330
ccggcaucacgaagagugcggc

SEQ ID NO: 2475257 - RNA, 19 nt, Brucella suis 1330
ccggcauccgaggcgcgca

SEQ ID NO: 2475258 - RNA, 21 nt, Brucella suis 1330
ccggcauccgaggcgcgcagc

SEQ ID NO: 2475259 - RNA, 18 nt, Brucella suis 1330
ccggcauggccugcgcgc

SEQ ID NO: 2475260 - RNA, 16 nt, Brucella suis 1330
ccggcauugagccgcg

SEQ ID NO: 2475261 - RNA, 15 nt, Brucella suis 1330
ccggccagcuugaaa

SEQ ID NO: 2475262 - RNA, 17 nt, Brucella suis 1330
ccggccaguggccgaag

SEQ ID NO: 2475263 - RNA, 16 nt, Brucella suis 1330
ccggcccaaaggccgc

SEQ ID NO: 2475264 - RNA, 20 nt, Brucella suis 1330
ccggcccaaaggccgcgccg

SEQ ID NO: 2475265 - RNA, 16 nt, Brucella suis 1330
ccggcccacccaccgc

SEQ ID NO: 2475266 - RNA, 16 nt, Brucella suis 1330
ccggcccauaccgcgc

SEQ ID NO: 2475267 - RNA, 22 nt, Brucella suis 1330
ccggcccguugccgaucagcau

SEQ ID NO: 2475268 - RNA, 22 nt, Brucella suis 1330
ccggccugaugccuugggaggc

SEQ ID NO: 2475269 - RNA, 17 nt, Brucella suis 1330
ccggccugguuucacag

SEQ ID NO: 2475270 - RNA, 23 nt, Brucella suis 1330
ccggccuugauguccggcgcgcu

SEQ ID NO: 2475271 - RNA, 21 nt, Brucella suis 1330
ccggccuuguguuucaccaga

SEQ ID NO: 2475272 - RNA, 15 nt, Brucella suis 1330
ccggccuuugcgccg

SEQ ID NO: 2475273 - RNA, 18 nt, Brucella suis 1330
ccggccuuugcgcgccug

SEQ ID NO: 2475274 - RNA, 16 nt, Brucella suis 1330
ccggccuuuuucaguu

SEQ ID NO: 2475275 - RNA, 17 nt, Brucella suis 1330
ccggcgcaaaggccggg

SEQ ID NO: 2475276 - RNA, 16 nt, Brucella suis 1330
ccggcgcaucuguucu

SEQ ID NO: 2475277 - RNA, 19 nt, Brucella suis 1330
ccggcggaaggcugaguga

SEQ ID NO: 2475278 - RNA, 14 nt, Brucella suis 1330
ccggcggcaggcag

SEQ ID NO: 2475279 - RNA, 14 nt, Brucella suis 1330
ccggcggcgcccac

SEQ ID NO: 2475280 - RNA, 13 nt, Brucella suis 1330
ccggcggcggcgc

SEQ ID NO: 2475281 - RNA, 12 nt, Brucella suis 1330
ccggcgggcggg

SEQ ID NO: 2475282 - RNA, 22 nt, Brucella suis 1330
ccggcggugaagaagcgccagc

SEQ ID NO: 2475283 - RNA, 13 nt, Brucella suis 1330
ccggcgugaucuc

SEQ ID NO: 2475284 - RNA, 16 nt, Brucella suis 1330
ccggcgugaucucgca

SEQ ID NO: 2475285 - RNA, 11 nt, Brucella suis 1330
ccggcucgccg

SEQ ID NO: 2475286 - RNA, 21 nt, Brucella suis 1330
ccggcugccaugugcagccgg

SEQ ID NO: 2475287 - RNA, 13 nt, Brucella suis 1330
ccggcugcggcgc

SEQ ID NO: 2475288 - RNA, 19 nt, Brucella suis 1330
ccggcugggccuuguuuuc

SEQ ID NO: 2475289 - RNA, 12 nt, Brucella suis 1330
ccggcuguuaca

SEQ ID NO: 2475290 - RNA, 13 nt, Brucella suis 1330
ccggcuucggcca

SEQ ID NO: 2475291 - RNA, 22 nt, Brucella suis 1330
ccgggaaaucugcgcgcgcgca

SEQ ID NO: 2475292 - RNA, 17 nt, Brucella suis 1330
ccgggcagcggcgcgcc

SEQ ID NO: 2475293 - RNA, 18 nt, Brucella suis 1330
ccgggcagcggcgcgcca

SEQ ID NO: 2475294 - RNA, 17 nt, Brucella suis 1330
ccgggccucgcgcccgg

SEQ ID NO: 2475295 - RNA, 17 nt, Brucella suis 1330
ccgggcggcgcggcggc

SEQ ID NO: 2475296 - RNA, 11 nt, Brucella suis 1330
ccgggcucuuc

SEQ ID NO: 2475297 - RNA, 15 nt, Brucella suis 1330
ccgggcuugcauggu

SEQ ID NO: 2475298 - RNA, 20 nt, Brucella suis 1330
ccggggcagggcaggccggg

SEQ ID NO: 2475299 - RNA, 19 nt, Brucella suis 1330
ccggggggaauggcgcgcg

SEQ ID NO: 2475300 - RNA, 16 nt, Brucella suis 1330
ccggggugaaugcgga

SEQ ID NO: 2475301 - RNA, 17 nt, Brucella suis 1330
ccggguauucuuccaga

SEQ ID NO: 2475302 - RNA, 22 nt, Brucella suis 1330
ccgggucuucauagaccccgcc

SEQ ID NO: 2475303 - RNA, 19 nt, Brucella suis 1330
ccggguucaauacccaugc

SEQ ID NO: 2475304 - RNA, 14 nt, Brucella suis 1330
ccgguauccggcgc

SEQ ID NO: 2475305 - RNA, 15 nt, Brucella suis 1330
ccggucaaaacgccc

SEQ ID NO: 2475306 - RNA, 17 nt, Brucella suis 1330
ccggucaaaacgccccg

SEQ ID NO: 2475307 - RNA, 17 nt, Brucella suis 1330
ccgguccccgccgccga

SEQ ID NO: 2475308 - RNA, 19 nt, Brucella suis 1330
ccgguccccgccgccgaua

SEQ ID NO: 2475309 - RNA, 15 nt, Brucella suis 1330
ccggucggccccggc

SEQ ID NO: 2475310 - RNA, 23 nt, Brucella suis 1330
ccggucggguuugaugaggcgga

SEQ ID NO: 2475311 - RNA, 22 nt, Brucella suis 1330
ccggucucgcgaccgggcuucu

SEQ ID NO: 2475312 - RNA, 12 nt, Brucella suis 1330
ccggucuugagc

SEQ ID NO: 2475313 - RNA, 17 nt, Brucella suis 1330
ccggugcgauccauauc

SEQ ID NO: 2475314 - RNA, 20 nt, Brucella suis 1330
ccgguggacugauuuccccg

SEQ ID NO: 2475315 - RNA, 17 nt, Brucella suis 1330
ccgguguauccaccaga

SEQ ID NO: 2475316 - RNA, 20 nt, Brucella suis 1330
ccgguuauggcgugccgaaa

SEQ ID NO: 2475317 - RNA, 16 nt, Brucella suis 1330
ccgguucauuuuuaga

SEQ ID NO: 2475318 - RNA, 17 nt, Brucella suis 1330
ccgguucggauccuccu

SEQ ID NO: 2475319 - RNA, 13 nt, Brucella suis 1330
ccguaauggcgcg

SEQ ID NO: 2475320 - RNA, 16 nt, Brucella suis 1330
ccgucaaaacgccaua

SEQ ID NO: 2475321 - RNA, 12 nt, Brucella suis 1330
ccgucaaaaggu

SEQ ID NO: 2475322 - RNA, 14 nt, Brucella suis 1330
ccgucaaugccauc

SEQ ID NO: 2475323 - RNA, 14 nt, Brucella suis 1330
ccgucagcgcgccg

SEQ ID NO: 2475324 - RNA, 18 nt, Brucella suis 1330
ccgucagcuuuucaccgg

SEQ ID NO: 2475325 - RNA, 16 nt, Brucella suis 1330
ccgucauucaucagca

SEQ ID NO: 2475326 - RNA, 22 nt, Brucella suis 1330
ccguccgguugcaggcgcaggc

SEQ ID NO: 2475327 - RNA, 18 nt, Brucella suis 1330
ccgucgagcagcaucuug

SEQ ID NO: 2475328 - RNA, 18 nt, Brucella suis 1330
ccgucgagggcaccggcc

SEQ ID NO: 2475329 - RNA, 17 nt, Brucella suis 1330
ccgucgcguucagccug

SEQ ID NO: 2475330 - RNA, 19 nt, Brucella suis 1330
ccgugaaacagugccgcca

SEQ ID NO: 2475331 - RNA, 20 nt, Brucella suis 1330
ccgugaaacagugccgccau

SEQ ID NO: 2475332 - RNA, 13 nt, Brucella suis 1330
ccgugacaauggc

SEQ ID NO: 2475333 - RNA, 23 nt, Brucella suis 1330
ccgugacguccaccaccucgcca

SEQ ID NO: 2475334 - RNA, 17 nt, Brucella suis 1330
ccgugcgauagcccucu

SEQ ID NO: 2475335 - RNA, 22 nt, Brucella suis 1330
ccgugcgauagcccucugaacc

SEQ ID NO: 2475336 - RNA, 22 nt, Brucella suis 1330
ccgugcggcaagauaagcgccg

SEQ ID NO: 2475337 - RNA, 15 nt, Brucella suis 1330
ccgugcggccuugcg

SEQ ID NO: 2475338 - RNA, 16 nt, Brucella suis 1330
ccguggcggccggcaa

SEQ ID NO: 2475339 - RNA, 20 nt, Brucella suis 1330
ccgugggcaagaucauccgg

SEQ ID NO: 2475340 - RNA, 21 nt, Brucella suis 1330
ccguguacgcuaucucuccua

SEQ ID NO: 2475341 - RNA, 17 nt, Brucella suis 1330
ccgugucggagccggcc

SEQ ID NO: 2475342 - RNA, 17 nt, Brucella suis 1330
ccguuauuucgcgcgca

SEQ ID NO: 2475343 - RNA, 18 nt, Brucella suis 1330
ccguugaagcugucgcca

SEQ ID NO: 2475344 - RNA, 13 nt, Brucella suis 1330
ccguugccgauca

SEQ ID NO: 2475345 - RNA, 13 nt, Brucella suis 1330
ccguuggcaucca

SEQ ID NO: 2475346 - RNA, 15 nt, Brucella suis 1330
ccguuuccaucgggg

SEQ ID NO: 2475347 - RNA, 14 nt, Brucella suis 1330
ccguuucgaucaca

SEQ ID NO: 2475348 - RNA, 16 nt, Brucella suis 1330
ccguuugaucagccgu

SEQ ID NO: 2475349 - RNA, 19 nt, Brucella suis 1330
ccguuuggaugugcagcgu

SEQ ID NO: 2475350 - RNA, 21 nt, Brucella suis 1330
ccguuuuaacggaaucgccgg

SEQ ID NO: 2475351 - RNA, 13 nt, Brucella suis 1330
ccguuuugcgccc

SEQ ID NO: 2475352 - RNA, 17 nt, Brucella suis 1330
ccguuuugcgcccagcu

SEQ ID NO: 2475353 - RNA, 21 nt, Brucella suis 1330
ccuaaagccgcuccauuccca

SEQ ID NO: 2475354 - RNA, 15 nt, Brucella suis 1330
ccuacgcagggaaau

SEQ ID NO: 2475355 - RNA, 17 nt, Brucella suis 1330
ccuauuccccuauuccc

SEQ ID NO: 2475356 - RNA, 19 nt, Brucella suis 1330
ccuauuccccuauuccccu

SEQ ID NO: 2475357 - RNA, 18 nt, Brucella suis 1330
ccuauugccuuaaucccu

SEQ ID NO: 2475358 - RNA, 16 nt, Brucella suis 1330
ccucaagcaucuugau

SEQ ID NO: 2475359 - RNA, 16 nt, Brucella suis 1330
ccucaagugccgccuu

SEQ ID NO: 2475360 - RNA, 16 nt, Brucella suis 1330
ccucaaucacggcaau

SEQ ID NO: 2475361 - RNA, 19 nt, Brucella suis 1330
ccucaauggucacggccac

SEQ ID NO: 2475362 - RNA, 15 nt, Brucella suis 1330
ccucacccuccaccg

SEQ ID NO: 2475363 - RNA, 18 nt, Brucella suis 1330
ccucacccuucaacagcc

SEQ ID NO: 2475364 - RNA, 16 nt, Brucella suis 1330
ccucaccuugccgggc

SEQ ID NO: 2475365 - RNA, 20 nt, Brucella suis 1330
ccucaccuugccgggcgggc

SEQ ID NO: 2475366 - RNA, 21 nt, Brucella suis 1330
ccuccacgacgggagccgcag

SEQ ID NO: 2475367 - RNA, 22 nt, Brucella suis 1330
ccuccacgacgggagccgcagc

SEQ ID NO: 2475368 - RNA, 21 nt, Brucella suis 1330
ccuccagcccuucaucaagcu

SEQ ID NO: 2475369 - RNA, 22 nt, Brucella suis 1330
ccuccgacaccagccguuccag

SEQ ID NO: 2475370 - RNA, 14 nt, Brucella suis 1330
ccucgaagucgcca

SEQ ID NO: 2475371 - RNA, 16 nt, Brucella suis 1330
ccucgacacgccggaa

SEQ ID NO: 2475372 - RNA, 16 nt, Brucella suis 1330
ccucgacagcacugcc

SEQ ID NO: 2475373 - RNA, 13 nt, Brucella suis 1330
ccucgaccgccac

SEQ ID NO: 2475374 - RNA, 15 nt, Brucella suis 1330
ccucgacggcggccu

SEQ ID NO: 2475375 - RNA, 22 nt, Brucella suis 1330
ccucgacguccucguucuugcc

SEQ ID NO: 2475376 - RNA, 17 nt, Brucella suis 1330
ccucgaucacccgauca

SEQ ID NO: 2475377 - RNA, 16 nt, Brucella suis 1330
ccucgcccugcaauaa

SEQ ID NO: 2475378 - RNA, 15 nt, Brucella suis 1330
ccucgcccugcuuca

SEQ ID NO: 2475379 - RNA, 18 nt, Brucella suis 1330
ccucgcccugcuucacau

SEQ ID NO: 2475380 - RNA, 14 nt, Brucella suis 1330
ccucgccuuccagc

SEQ ID NO: 2475381 - RNA, 14 nt, Brucella suis 1330
ccucgcgauugcgc

SEQ ID NO: 2475382 - RNA, 19 nt, Brucella suis 1330
ccucgcgcucggcaagcgc

SEQ ID NO: 2475383 - RNA, 17 nt, Brucella suis 1330
ccucgcggaaaagcucg

SEQ ID NO: 2475384 - RNA, 16 nt, Brucella suis 1330
ccucggugccaagaag

SEQ ID NO: 2475385 - RNA, 13 nt, Brucella suis 1330
ccucguggaucga

SEQ ID NO: 2475386 - RNA, 21 nt, Brucella suis 1330
ccucguuuuugacugcugcca

SEQ ID NO: 2475387 - RNA, 22 nt, Brucella suis 1330
ccucucacuccgaccauuuccc

SEQ ID NO: 2475388 - RNA, 13 nt, Brucella suis 1330
ccucugccuccau

SEQ ID NO: 2475389 - RNA, 14 nt, Brucella suis 1330
ccucugccugcuga

SEQ ID NO: 2475390 - RNA, 20 nt, Brucella suis 1330
ccucuucguccucgcgccag

SEQ ID NO: 2475391 - RNA, 20 nt, Brucella suis 1330
ccugaaacagcauauugccg

SEQ ID NO: 2475392 - RNA, 19 nt, Brucella suis 1330
ccugacccauggccugcug

SEQ ID NO: 2475393 - RNA, 12 nt, Brucella suis 1330
ccugacccggcc

SEQ ID NO: 2475394 - RNA, 17 nt, Brucella suis 1330
ccugacccggccuuugc

SEQ ID NO: 2475395 - RNA, 19 nt, Brucella suis 1330
ccugaccggccacccagcc

SEQ ID NO: 2475396 - RNA, 22 nt, Brucella suis 1330
ccugagcuugucgaaggaucga

SEQ ID NO: 2475397 - RNA, 14 nt, Brucella suis 1330
ccugaggcauugag

SEQ ID NO: 2475398 - RNA, 15 nt, Brucella suis 1330
ccugaucgucggcuu

SEQ ID NO: 2475399 - RNA, 19 nt, Brucella suis 1330
ccugaucguguugaccaca

SEQ ID NO: 2475400 - RNA, 13 nt, Brucella suis 1330
ccugaugcaaugc

SEQ ID NO: 2475401 - RNA, 15 nt, Brucella suis 1330
ccugaugcaaugcgu

SEQ ID NO: 2475402 - RNA, 18 nt, Brucella suis 1330
ccugaugccggaugcgca

SEQ ID NO: 2475403 - RNA, 12 nt, Brucella suis 1330
ccugcaaaagcg

SEQ ID NO: 2475404 - RNA, 12 nt, Brucella suis 1330
ccugcaaaccgg

SEQ ID NO: 2475405 - RNA, 14 nt, Brucella suis 1330
ccugcaaaccggcu

SEQ ID NO: 2475406 - RNA, 20 nt, Brucella suis 1330
ccugcaaaccggcugccgca

SEQ ID NO: 2475407 - RNA, 13 nt, Brucella suis 1330
ccugcaccaugga

SEQ ID NO: 2475408 - RNA, 14 nt, Brucella suis 1330
ccugcacggcuuca

SEQ ID NO: 2475409 - RNA, 20 nt, Brucella suis 1330
ccugcacuucacgcgugcgg

SEQ ID NO: 2475410 - RNA, 19 nt, Brucella suis 1330
ccugcagccggaagaacag

SEQ ID NO: 2475411 - RNA, 18 nt, Brucella suis 1330
ccugcauaauuauugcgc

SEQ ID NO: 2475412 - RNA, 22 nt, Brucella suis 1330
ccugccaaacuaaaugaagaag

SEQ ID NO: 2475413 - RNA, 14 nt, Brucella suis 1330
ccugccagcccgcu

SEQ ID NO: 2475414 - RNA, 12 nt, Brucella suis 1330
ccugccagcggc

SEQ ID NO: 2475415 - RNA, 16 nt, Brucella suis 1330
ccugccauccgccccg

SEQ ID NO: 2475416 - RNA, 13 nt, Brucella suis 1330
ccugccggucccg

SEQ ID NO: 2475417 - RNA, 22 nt, Brucella suis 1330
ccugccggucccgugucggagc

SEQ ID NO: 2475418 - RNA, 13 nt, Brucella suis 1330
ccugccuucuuca

SEQ ID NO: 2475419 - RNA, 14 nt, Brucella suis 1330
ccugcgaaaaccug

SEQ ID NO: 2475420 - RNA, 16 nt, Brucella suis 1330
ccugcgaaaaccugcu

SEQ ID NO: 2475421 - RNA, 16 nt, Brucella suis 1330
ccugcgaggauuucag

SEQ ID NO: 2475422 - RNA, 15 nt, Brucella suis 1330
ccugcgaugcgccag

SEQ ID NO: 2475423 - RNA, 22 nt, Brucella suis 1330
ccugcgcaccgguauugcccuu

SEQ ID NO: 2475424 - RNA, 23 nt, Brucella suis 1330
ccugcgccagcgauugcgcauug

SEQ ID NO: 2475425 - RNA, 13 nt, Brucella suis 1330
ccugcgccaguuu

SEQ ID NO: 2475426 - RNA, 12 nt, Brucella suis 1330
ccugcgcccugu

SEQ ID NO: 2475427 - RNA, 17 nt, Brucella suis 1330
ccugcgcgcgcauggcg

SEQ ID NO: 2475428 - RNA, 24 nt, Brucella suis 1330
ccugcgcgcgccgccauggccgaa

SEQ ID NO: 2475429 - RNA, 17 nt, Brucella suis 1330
ccugcgucgcauccaga

SEQ ID NO: 2475430 - RNA, 13 nt, Brucella suis 1330
ccugcgucgggug

SEQ ID NO: 2475431 - RNA, 18 nt, Brucella suis 1330
ccugcucauaaacgcugc

SEQ ID NO: 2475432 - RNA, 16 nt, Brucella suis 1330
ccugcugcaacaaaau

SEQ ID NO: 2475433 - RNA, 19 nt, Brucella suis 1330
ccugcugcaacaaaaugcc

SEQ ID NO: 2475434 - RNA, 19 nt, Brucella suis 1330
ccugcugguuuaagccuug

SEQ ID NO: 2475435 - RNA, 21 nt, Brucella suis 1330
ccugcuucaucgcggcagccg

SEQ ID NO: 2475436 - RNA, 13 nt, Brucella suis 1330
ccugcuuccuuuu

SEQ ID NO: 2475437 - RNA, 20 nt, Brucella suis 1330
ccugcuuccuuuucggcuuc

SEQ ID NO: 2475438 - RNA, 19 nt, Brucella suis 1330
ccugcuucuugccuucauc

SEQ ID NO: 2475439 - RNA, 14 nt, Brucella suis 1330
ccuggauauccaca

SEQ ID NO: 2475440 - RNA, 14 nt, Brucella suis 1330
ccuggaugacaucg

SEQ ID NO: 2475441 - RNA, 14 nt, Brucella suis 1330
ccuggccgccgccg

SEQ ID NO: 2475442 - RNA, 15 nt, Brucella suis 1330
ccuggccgccgccga

SEQ ID NO: 2475443 - RNA, 14 nt, Brucella suis 1330
ccuggccggcgccu

SEQ ID NO: 2475444 - RNA, 21 nt, Brucella suis 1330
ccuggcgcacgucgaaaagcu

SEQ ID NO: 2475445 - RNA, 18 nt, Brucella suis 1330
ccuggcggcgugcaggcu

SEQ ID NO: 2475446 - RNA, 23 nt, Brucella suis 1330
ccugggccacggcgaaagcugcc

SEQ ID NO: 2475447 - RNA, 15 nt, Brucella suis 1330
ccuggucuagccgcg

SEQ ID NO: 2475448 - RNA, 15 nt, Brucella suis 1330
ccugucaaaacugau

SEQ ID NO: 2475449 - RNA, 16 nt, Brucella suis 1330
ccugucgccgaaaagc

SEQ ID NO: 2475450 - RNA, 19 nt, Brucella suis 1330
ccugucuuuuccgcugcca

SEQ ID NO: 2475451 - RNA, 14 nt, Brucella suis 1330
ccugugcauugcca

SEQ ID NO: 2475452 - RNA, 17 nt, Brucella suis 1330
ccugugcggcugcaaau

SEQ ID NO: 2475453 - RNA, 18 nt, Brucella suis 1330
ccuguguucggcaacgcc

SEQ ID NO: 2475454 - RNA, 22 nt, Brucella suis 1330
ccuguucaagcaguaugauuug

SEQ ID NO: 2475455 - RNA, 19 nt, Brucella suis 1330
ccuguucaauaagcuuuuc

SEQ ID NO: 2475456 - RNA, 14 nt, Brucella suis 1330
ccuguucaucgggg

SEQ ID NO: 2475457 - RNA, 21 nt, Brucella suis 1330
ccuguuccgcauaggggcgca

SEQ ID NO: 2475458 - RNA, 15 nt, Brucella suis 1330
ccuguuccugcaugu

SEQ ID NO: 2475459 - RNA, 13 nt, Brucella suis 1330
ccuuaaucccuua

SEQ ID NO: 2475460 - RNA, 15 nt, Brucella suis 1330
ccuucaaagcgcgga

SEQ ID NO: 2475461 - RNA, 20 nt, Brucella suis 1330
ccuucaccacgauuucgccc

SEQ ID NO: 2475462 - RNA, 19 nt, Brucella suis 1330
ccuucacuucauugcgcuu

SEQ ID NO: 2475463 - RNA, 18 nt, Brucella suis 1330
ccuucagcacauccugca

SEQ ID NO: 2475464 - RNA, 14 nt, Brucella suis 1330
ccuucaucaagcug

SEQ ID NO: 2475465 - RNA, 15 nt, Brucella suis 1330
ccuucaucggcaagc

SEQ ID NO: 2475466 - RNA, 13 nt, Brucella suis 1330
ccuuccgccucuu

SEQ ID NO: 2475467 - RNA, 19 nt, Brucella suis 1330
ccuuccggguguccugccg

SEQ ID NO: 2475468 - RNA, 23 nt, Brucella suis 1330
ccuuccguugcagcccaacccau

SEQ ID NO: 2475469 - RNA, 17 nt, Brucella suis 1330
ccuuccugacccauggc

SEQ ID NO: 2475470 - RNA, 15 nt, Brucella suis 1330
ccuuccugcggcagc

SEQ ID NO: 2475471 - RNA, 22 nt, Brucella suis 1330
ccuuccugcggcagcgacccgc

SEQ ID NO: 2475472 - RNA, 15 nt, Brucella suis 1330
ccuucgaguucgcca

SEQ ID NO: 2475473 - RNA, 19 nt, Brucella suis 1330
ccuucgccgucgagcagca

SEQ ID NO: 2475474 - RNA, 16 nt, Brucella suis 1330
ccuucgcgccgccuuc

SEQ ID NO: 2475475 - RNA, 13 nt, Brucella suis 1330
ccuucggcauggc

SEQ ID NO: 2475476 - RNA, 16 nt, Brucella suis 1330
ccuucggcugcuuccg

SEQ ID NO: 2475477 - RNA, 14 nt, Brucella suis 1330
ccuucucgacagcc

SEQ ID NO: 2475478 - RNA, 18 nt, Brucella suis 1330
ccuucuggaagcgcgcgc

SEQ ID NO: 2475479 - RNA, 22 nt, Brucella suis 1330
ccuucuuggagccgaagcgcau

SEQ ID NO: 2475480 - RNA, 12 nt, Brucella suis 1330
ccuugaaaucau

SEQ ID NO: 2475481 - RNA, 12 nt, Brucella suis 1330
ccuugaccgcua

SEQ ID NO: 2475482 - RNA, 23 nt, Brucella suis 1330
ccuugagggcagcggucacagaa

SEQ ID NO: 2475483 - RNA, 19 nt, Brucella suis 1330
ccuugauguccggcgcgcu

SEQ ID NO: 2475484 - RNA, 21 nt, Brucella suis 1330
ccuugcagaugagcggcagca

SEQ ID NO: 2475485 - RNA, 23 nt, Brucella suis 1330
ccuugcagaugagcggcagcagc

SEQ ID NO: 2475486 - RNA, 15 nt, Brucella suis 1330
ccuugccaucuucac

SEQ ID NO: 2475487 - RNA, 23 nt, Brucella suis 1330
ccuugcccccacaacugcgggua

SEQ ID NO: 2475488 - RNA, 18 nt, Brucella suis 1330
ccuugccgggaagaugca

SEQ ID NO: 2475489 - RNA, 21 nt, Brucella suis 1330
ccuugccgggcgggcagcacu

SEQ ID NO: 2475490 - RNA, 18 nt, Brucella suis 1330
ccuugccgguugccuugc

SEQ ID NO: 2475491 - RNA, 21 nt, Brucella suis 1330
ccuugccgguugccuugccca

SEQ ID NO: 2475492 - RNA, 23 nt, Brucella suis 1330
ccuugcgaauggcaaucuccauc

SEQ ID NO: 2475493 - RNA, 13 nt, Brucella suis 1330
ccuugcgccgcag

SEQ ID NO: 2475494 - RNA, 19 nt, Brucella suis 1330
ccuugcgguccggccagag

SEQ ID NO: 2475495 - RNA, 16 nt, Brucella suis 1330
ccuuggcacguugcgc

SEQ ID NO: 2475496 - RNA, 13 nt, Brucella suis 1330
ccuugguugcgcg

SEQ ID NO: 2475497 - RNA, 20 nt, Brucella suis 1330
ccuuguaggaaagcacacug

SEQ ID NO: 2475498 - RNA, 17 nt, Brucella suis 1330
ccuugugaucgccacuc

SEQ ID NO: 2475499 - RNA, 12 nt, Brucella suis 1330
ccuuguggccac

SEQ ID NO: 2475500 - RNA, 19 nt, Brucella suis 1330
ccuuguuuucugccggugc

SEQ ID NO: 2475501 - RNA, 22 nt, Brucella suis 1330
ccuuuccaguuccauugcaacg

SEQ ID NO: 2475502 - RNA, 23 nt, Brucella suis 1330
ccuuucgcaucagacgccgcaug

SEQ ID NO: 2475503 - RNA, 13 nt, Brucella suis 1330
ccuuugccgcgcg

SEQ ID NO: 2475504 - RNA, 14 nt, Brucella suis 1330
ccuuugccgcgcga

SEQ ID NO: 2475505 - RNA, 11 nt, Brucella suis 1330
ccuuugcgggg

SEQ ID NO: 2475506 - RNA, 22 nt, Brucella suis 1330
ccuuugcuucggccgacagaug

SEQ ID NO: 2475507 - RNA, 14 nt, Brucella suis 1330
ccuuugugccuuuc

SEQ ID NO: 2475508 - RNA, 22 nt, Brucella suis 1330
ccuuuguuuucauugggcccuu

SEQ ID NO: 2475509 - RNA, 23 nt, Brucella suis 1330
ccuuuuccgcaaaaaucuucucg

SEQ ID NO: 2475510 - RNA, 15 nt, Brucella suis 1330
ccuuuugacggcccg

SEQ ID NO: 2475511 - RNA, 19 nt, Brucella suis 1330
ccuuuugcggggcuuccac

SEQ ID NO: 2475512 - RNA, 16 nt, Brucella suis 1330
ccuuuuucaguuucau

SEQ ID NO: 2475513 - RNA, 18 nt, Brucella suis 1330
ccuuuuuccugaucuugc

SEQ ID NO: 2475514 - RNA, 13 nt, Brucella suis 1330
ccuuuuucgagaa

SEQ ID NO: 2475515 - RNA, 17 nt, Brucella suis 1330
cgaaaaccguuucacac

SEQ ID NO: 2475516 - RNA, 21 nt, Brucella suis 1330
cgaaaaccguuucacacuuuu

SEQ ID NO: 2475517 - RNA, 13 nt, Brucella suis 1330
cgaaaagcuugcc

SEQ ID NO: 2475518 - RNA, 17 nt, Brucella suis 1330
cgaaaagugcgaagcgg

SEQ ID NO: 2475519 - RNA, 18 nt, Brucella suis 1330
cgaaaauaucggcugucu

SEQ ID NO: 2475520 - RNA, 11 nt, Brucella suis 1330
cgaaagcggcg

SEQ ID NO: 2475521 - RNA, 15 nt, Brucella suis 1330
cgaaaguuggacgac

SEQ ID NO: 2475522 - RNA, 22 nt, Brucella suis 1330
cgaaaucggguugacgaucacc

SEQ ID NO: 2475523 - RNA, 21 nt, Brucella suis 1330
cgaaaugaacaucggcgcgcu

SEQ ID NO: 2475524 - RNA, 15 nt, Brucella suis 1330
cgaaaugagaucaac

SEQ ID NO: 2475525 - RNA, 15 nt, Brucella suis 1330
cgaaaugccgauauc

SEQ ID NO: 2475526 - RNA, 16 nt, Brucella suis 1330
cgaaaugcgcgcggca

SEQ ID NO: 2475527 - RNA, 14 nt, Brucella suis 1330
cgaaaugcgcggcg

SEQ ID NO: 2475528 - RNA, 13 nt, Brucella suis 1330
cgaaauuggccgc

SEQ ID NO: 2475529 - RNA, 18 nt, Brucella suis 1330
cgaacagaucgccaagcg

SEQ ID NO: 2475530 - RNA, 16 nt, Brucella suis 1330
cgaacagguugcgcca

SEQ ID NO: 2475531 - RNA, 20 nt, Brucella suis 1330
cgaacagguugcgccaccac

SEQ ID NO: 2475532 - RNA, 23 nt, Brucella suis 1330
cgaacaugccugccgcagccagg

SEQ ID NO: 2475533 - RNA, 20 nt, Brucella suis 1330
cgaaccagauccaccgcgcu

SEQ ID NO: 2475534 - RNA, 22 nt, Brucella suis 1330
cgaacgcgccuuuucuucaucc

SEQ ID NO: 2475535 - RNA, 16 nt, Brucella suis 1330
cgaacgcuccugcaug

SEQ ID NO: 2475536 - RNA, 14 nt, Brucella suis 1330
cgaacucgaugccu

SEQ ID NO: 2475537 - RNA, 19 nt, Brucella suis 1330
cgaagaccuucuggaagcg

SEQ ID NO: 2475538 - RNA, 18 nt, Brucella suis 1330
cgaagagacuguucuuug

SEQ ID NO: 2475539 - RNA, 19 nt, Brucella suis 1330
cgaagauaagcggcaaagg

SEQ ID NO: 2475540 - RNA, 17 nt, Brucella suis 1330
cgaagccagguggcugc

SEQ ID NO: 2475541 - RNA, 13 nt, Brucella suis 1330
cgaagcgaugacg

SEQ ID NO: 2475542 - RNA, 17 nt, Brucella suis 1330
cgaagcgggaucagaaa

SEQ ID NO: 2475543 - RNA, 22 nt, Brucella suis 1330
cgaagcgguuuucggauaagau

SEQ ID NO: 2475544 - RNA, 14 nt, Brucella suis 1330
cgaagcgguuuugc

SEQ ID NO: 2475545 - RNA, 16 nt, Brucella suis 1330
cgaaggacuggaucac

SEQ ID NO: 2475546 - RNA, 19 nt, Brucella suis 1330
cgaaggcaagcaggcgcaa

SEQ ID NO: 2475547 - RNA, 22 nt, Brucella suis 1330
cgaauagcgcaucgccaccguu

SEQ ID NO: 2475548 - RNA, 21 nt, Brucella suis 1330
cgaauaggcgcgcacauccau

SEQ ID NO: 2475549 - RNA, 21 nt, Brucella suis 1330
cgaauccacguuuggagcggc

SEQ ID NO: 2475550 - RNA, 17 nt, Brucella suis 1330
cgaaucucgaucuugcu

SEQ ID NO: 2475551 - RNA, 14 nt, Brucella suis 1330
cgaaugacuucauc

SEQ ID NO: 2475552 - RNA, 16 nt, Brucella suis 1330
cgaaugaucuuguucg

SEQ ID NO: 2475553 - RNA, 21 nt, Brucella suis 1330
cgaauggcaauuuccagauau

SEQ ID NO: 2475554 - RNA, 18 nt, Brucella suis 1330
cgaauuccacgaugagaa

SEQ ID NO: 2475555 - RNA, 14 nt, Brucella suis 1330
cgaauuccgccaug

SEQ ID NO: 2475556 - RNA, 23 nt, Brucella suis 1330
cgaauuucaucgcccucgcgcca

SEQ ID NO: 2475557 - RNA, 17 nt, Brucella suis 1330
cgacaaaggugcugucg

SEQ ID NO: 2475558 - RNA, 17 nt, Brucella suis 1330
cgacaagcuucaggcuc

SEQ ID NO: 2475559 - RNA, 20 nt, Brucella suis 1330
cgacaaucggaacaaacugg

SEQ ID NO: 2475560 - RNA, 21 nt, Brucella suis 1330
cgacaaucggaacaaacuggc

SEQ ID NO: 2475561 - RNA, 20 nt, Brucella suis 1330
cgacacccggauauuucucg

SEQ ID NO: 2475562 - RNA, 14 nt, Brucella suis 1330
cgacagaucggcaa

SEQ ID NO: 2475563 - RNA, 16 nt, Brucella suis 1330
cgacagaucggcaaga

SEQ ID NO: 2475564 - RNA, 21 nt, Brucella suis 1330
cgacagauugagauagccuug

SEQ ID NO: 2475565 - RNA, 14 nt, Brucella suis 1330
cgacagggcaagcg

SEQ ID NO: 2475566 - RNA, 20 nt, Brucella suis 1330
cgacagggugacgacugaaa

SEQ ID NO: 2475567 - RNA, 20 nt, Brucella suis 1330
cgacaguccagcuuuccgca

SEQ ID NO: 2475568 - RNA, 15 nt, Brucella suis 1330
cgacauagccgaucu

SEQ ID NO: 2475569 - RNA, 20 nt, Brucella suis 1330
cgacauauuugucgccgacu

SEQ ID NO: 2475570 - RNA, 20 nt, Brucella suis 1330
cgacauccuugaaaagcugg

SEQ ID NO: 2475571 - RNA, 14 nt, Brucella suis 1330
cgacaugccaagag

SEQ ID NO: 2475572 - RNA, 14 nt, Brucella suis 1330
cgacaugcugaaau

SEQ ID NO: 2475573 - RNA, 12 nt, Brucella suis 1330
cgaccaacccuu

SEQ ID NO: 2475574 - RNA, 14 nt, Brucella suis 1330
cgaccaccaccggg

SEQ ID NO: 2475575 - RNA, 18 nt, Brucella suis 1330
cgaccagaagcccgcgcu

SEQ ID NO: 2475576 - RNA, 20 nt, Brucella suis 1330
cgaccagaagcccgcgcucc

SEQ ID NO: 2475577 - RNA, 18 nt, Brucella suis 1330
cgaccagcaacgcgcccg

SEQ ID NO: 2475578 - RNA, 21 nt, Brucella suis 1330
cgaccaugagcagacggccac

SEQ ID NO: 2475579 - RNA, 22 nt, Brucella suis 1330
cgaccauuucccgguuuuucca

SEQ ID NO: 2475580 - RNA, 14 nt, Brucella suis 1330
cgacccguuugaag

SEQ ID NO: 2475581 - RNA, 15 nt, Brucella suis 1330
cgaccgccuuuucca

SEQ ID NO: 2475582 - RNA, 17 nt, Brucella suis 1330
cgaccgccuuuuccagu

SEQ ID NO: 2475583 - RNA, 19 nt, Brucella suis 1330
cgaccggcacccacugccc

SEQ ID NO: 2475584 - RNA, 15 nt, Brucella suis 1330
cgaccgggcuugcau

SEQ ID NO: 2475585 - RNA, 12 nt, Brucella suis 1330
cgaccggucgaa

SEQ ID NO: 2475586 - RNA, 17 nt, Brucella suis 1330
cgaccggucgaagcggc

SEQ ID NO: 2475587 - RNA, 16 nt, Brucella suis 1330
cgaccugcuucuugcc

SEQ ID NO: 2475588 - RNA, 17 nt, Brucella suis 1330
cgacgauuucuuccaga

SEQ ID NO: 2475589 - RNA, 14 nt, Brucella suis 1330
cgacgcccgccccc

SEQ ID NO: 2475590 - RNA, 15 nt, Brucella suis 1330
cgacgcgaucuuacg

SEQ ID NO: 2475591 - RNA, 22 nt, Brucella suis 1330
cgacgcgcuaaaaagcgcgcgc

SEQ ID NO: 2475592 - RNA, 18 nt, Brucella suis 1330
cgacgcuuuccaccggcu

SEQ ID NO: 2475593 - RNA, 15 nt, Brucella suis 1330
cgacggaaacgagcg

SEQ ID NO: 2475594 - RNA, 16 nt, Brucella suis 1330
cgacggaaacgagcgc

SEQ ID NO: 2475595 - RNA, 18 nt, Brucella suis 1330
cgacggcgugaugcgcag

SEQ ID NO: 2475596 - RNA, 22 nt, Brucella suis 1330
cgacggcgugaugcgcaggcgc

SEQ ID NO: 2475597 - RNA, 13 nt, Brucella suis 1330
cgacgggagccgc

SEQ ID NO: 2475598 - RNA, 22 nt, Brucella suis 1330
cgacguaaagcgugagccggcg

SEQ ID NO: 2475599 - RNA, 14 nt, Brucella suis 1330
cgacucauuuuuag

SEQ ID NO: 2475600 - RNA, 20 nt, Brucella suis 1330
cgacuuccaguggaagcaca

SEQ ID NO: 2475601 - RNA, 14 nt, Brucella suis 1330
cgacuugaagagcc

SEQ ID NO: 2475602 - RNA, 18 nt, Brucella suis 1330
cgacuugaagagccgcag

SEQ ID NO: 2475603 - RNA, 20 nt, Brucella suis 1330
cgacuugaagagccgcaggc

SEQ ID NO: 2475604 - RNA, 16 nt, Brucella suis 1330
cgagaaccagcggcca

SEQ ID NO: 2475605 - RNA, 17 nt, Brucella suis 1330
cgagaacccguuccuug

SEQ ID NO: 2475606 - RNA, 23 nt, Brucella suis 1330
cgagaacggcggcggcgaugccu

SEQ ID NO: 2475607 - RNA, 22 nt, Brucella suis 1330
cgagaagcgguguggcccgguc

SEQ ID NO: 2475608 - RNA, 14 nt, Brucella suis 1330
cgagaccggcugcu

SEQ ID NO: 2475609 - RNA, 22 nt, Brucella suis 1330
cgagauagacaugcggcagucc

SEQ ID NO: 2475610 - RNA, 22 nt, Brucella suis 1330
cgagaucgucugaacggaucuu

SEQ ID NO: 2475611 - RNA, 21 nt, Brucella suis 1330
cgagaucgugggccucaagcg

SEQ ID NO: 2475612 - RNA, 19 nt, Brucella suis 1330
cgagauggccuugugcaga

SEQ ID NO: 2475613 - RNA, 20 nt, Brucella suis 1330
cgagaugggcaaauucauug

SEQ ID NO: 2475614 - RNA, 17 nt, Brucella suis 1330
cgagauugccgccacau

SEQ ID NO: 2475615 - RNA, 20 nt, Brucella suis 1330
cgagauugccgccacaugug

SEQ ID NO: 2475616 - RNA, 16 nt, Brucella suis 1330
cgagauugggcagcag

SEQ ID NO: 2475617 - RNA, 13 nt, Brucella suis 1330
cgagcaaugauag

SEQ ID NO: 2475618 - RNA, 21 nt, Brucella suis 1330
cgagcagcaucuugccaagcu

SEQ ID NO: 2475619 - RNA, 19 nt, Brucella suis 1330
cgagcaggcuuucggccug

SEQ ID NO: 2475620 - RNA, 14 nt, Brucella suis 1330
cgagcauggccugc

SEQ ID NO: 2475621 - RNA, 22 nt, Brucella suis 1330
cgagccaaaaaugugaaacgcc

SEQ ID NO: 2475622 - RNA, 16 nt, Brucella suis 1330
cgagccgacauaggcg

SEQ ID NO: 2475623 - RNA, 17 nt, Brucella suis 1330
cgagcgcagcggcagca

SEQ ID NO: 2475624 - RNA, 20 nt, Brucella suis 1330
cgagcgccuguccgccugcc

SEQ ID NO: 2475625 - RNA, 13 nt, Brucella suis 1330
cgagcgcgccacg

SEQ ID NO: 2475626 - RNA, 15 nt, Brucella suis 1330
cgagcggagccgaag

SEQ ID NO: 2475627 - RNA, 12 nt, Brucella suis 1330
cgagcggccauu

SEQ ID NO: 2475628 - RNA, 13 nt, Brucella suis 1330
cgagcgugaucuc

SEQ ID NO: 2475629 - RNA, 15 nt, Brucella suis 1330
cgaggaaaaagcccg

SEQ ID NO: 2475630 - RNA, 13 nt, Brucella suis 1330
cgaggaagagaau

SEQ ID NO: 2475631 - RNA, 23 nt, Brucella suis 1330
cgaggccauggcuucaagcggcg

SEQ ID NO: 2475632 - RNA, 18 nt, Brucella suis 1330
cgagggcgggcggccagg

SEQ ID NO: 2475633 - RNA, 23 nt, Brucella suis 1330
cgaggggaugggggccgggcgca

SEQ ID NO: 2475634 - RNA, 18 nt, Brucella suis 1330
cgaggucucccggcacga

SEQ ID NO: 2475635 - RNA, 16 nt, Brucella suis 1330
cgagugcggccugcac

SEQ ID NO: 2475636 - RNA, 16 nt, Brucella suis 1330
cgaguggucugggcga

SEQ ID NO: 2475637 - RNA, 22 nt, Brucella suis 1330
cgaguggucugggcgaugagcg

SEQ ID NO: 2475638 - RNA, 14 nt, Brucella suis 1330
cgaguucugcgcgg

SEQ ID NO: 2475639 - RNA, 13 nt, Brucella suis 1330
cgaguugccacgc

SEQ ID NO: 2475640 - RNA, 19 nt, Brucella suis 1330
cgaguugccacgcgccgcc

SEQ ID NO: 2475641 - RNA, 20 nt, Brucella suis 1330
cgaguugugccugccgcgcc

SEQ ID NO: 2475642 - RNA, 15 nt, Brucella suis 1330
cgauaaacccgcccc

SEQ ID NO: 2475643 - RNA, 16 nt, Brucella suis 1330
cgauaaagaugcgcgc

SEQ ID NO: 2475644 - RNA, 14 nt, Brucella suis 1330
cgauaaggcggcgu

SEQ ID NO: 2475645 - RNA, 21 nt, Brucella suis 1330
cgauaauaauuggcaagcgcc

SEQ ID NO: 2475646 - RNA, 15 nt, Brucella suis 1330
cgauagacgcggcgg

SEQ ID NO: 2475647 - RNA, 21 nt, Brucella suis 1330
cgauagcccucugaaccggcg

SEQ ID NO: 2475648 - RNA, 18 nt, Brucella suis 1330
cgauagcggcgcggcagg

SEQ ID NO: 2475649 - RNA, 15 nt, Brucella suis 1330
cgauaggugacgcgg

SEQ ID NO: 2475650 - RNA, 20 nt, Brucella suis 1330
cgauauagacuucagccaga

SEQ ID NO: 2475651 - RNA, 24 nt, Brucella suis 1330
cgauaucaccaauauugcaggcga

SEQ ID NO: 2475652 - RNA, 16 nt, Brucella suis 1330
cgauauccuggccuuc

SEQ ID NO: 2475653 - RNA, 16 nt, Brucella suis 1330
cgauaucgagauuggg

SEQ ID NO: 2475654 - RNA, 20 nt, Brucella suis 1330
cgauaucggacuggauuucg

SEQ ID NO: 2475655 - RNA, 16 nt, Brucella suis 1330
cgauaucggcauguuu

SEQ ID NO: 2475656 - RNA, 14 nt, Brucella suis 1330
cgauaucugcaaca

SEQ ID NO: 2475657 - RNA, 21 nt, Brucella suis 1330
cgauauggcgcaaugccugca

SEQ ID NO: 2475658 - RNA, 24 nt, Brucella suis 1330
cgaucaacgcuuugaccgccgcga

SEQ ID NO: 2475659 - RNA, 14 nt, Brucella suis 1330
cgaucaauccggca

SEQ ID NO: 2475660 - RNA, 21 nt, Brucella suis 1330
cgaucacaacgccgucagccc

SEQ ID NO: 2475661 - RNA, 21 nt, Brucella suis 1330
cgaucaccgcagucaugccca

SEQ ID NO: 2475662 - RNA, 18 nt, Brucella suis 1330
cgaucacggccauugccc

SEQ ID NO: 2475663 - RNA, 22 nt, Brucella suis 1330
cgaucagggaacggucgcuauu

SEQ ID NO: 2475664 - RNA, 18 nt, Brucella suis 1330
cgaucagugccaccagau

SEQ ID NO: 2475665 - RNA, 18 nt, Brucella suis 1330
cgauccaauauugccuuc

SEQ ID NO: 2475666 - RNA, 20 nt, Brucella suis 1330
cgauccaguugucgccgggc

SEQ ID NO: 2475667 - RNA, 20 nt, Brucella suis 1330
cgauccauaucacgcuugcc

SEQ ID NO: 2475668 - RNA, 21 nt, Brucella suis 1330
cgauccgauucauuauucguc

SEQ ID NO: 2475669 - RNA, 20 nt, Brucella suis 1330
cgauccgcuugcuucgggca

SEQ ID NO: 2475670 - RNA, 19 nt, Brucella suis 1330
cgauccugcugcgcggcau

SEQ ID NO: 2475671 - RNA, 17 nt, Brucella suis 1330
cgauccuuguucuuggc

SEQ ID NO: 2475672 - RNA, 18 nt, Brucella suis 1330
cgauccuuguucuuggcg

SEQ ID NO: 2475673 - RNA, 20 nt, Brucella suis 1330
cgaucgccaguuucauuucc

SEQ ID NO: 2475674 - RNA, 15 nt, Brucella suis 1330
cgaugaacaggagcg

SEQ ID NO: 2475675 - RNA, 12 nt, Brucella suis 1330
cgaugaagagcg

SEQ ID NO: 2475676 - RNA, 12 nt, Brucella suis 1330
cgaugaccaccg

SEQ ID NO: 2475677 - RNA, 16 nt, Brucella suis 1330
cgaugaccaccgcgaa

SEQ ID NO: 2475678 - RNA, 11 nt, Brucella suis 1330
cgaugacccag

SEQ ID NO: 2475679 - RNA, 16 nt, Brucella suis 1330
cgaugacggcgcggcg

SEQ ID NO: 2475680 - RNA, 17 nt, Brucella suis 1330
cgaugacggcgcggcgc

SEQ ID NO: 2475681 - RNA, 18 nt, Brucella suis 1330
cgaugagccuucaucuuc

SEQ ID NO: 2475682 - RNA, 14 nt, Brucella suis 1330
cgaugagcgccauu

SEQ ID NO: 2475683 - RNA, 12 nt, Brucella suis 1330
cgaugaugauga

SEQ ID NO: 2475684 - RNA, 23 nt, Brucella suis 1330
cgaugauggcagaccccaucagc

SEQ ID NO: 2475685 - RNA, 22 nt, Brucella suis 1330
cgaugccgauacuguagaaaau

SEQ ID NO: 2475686 - RNA, 16 nt, Brucella suis 1330
cgaugccugccaugcc

SEQ ID NO: 2475687 - RNA, 19 nt, Brucella suis 1330
cgaugcgccagcgaugaua

SEQ ID NO: 2475688 - RNA, 19 nt, Brucella suis 1330
cgaugcgcugaacauggcu

SEQ ID NO: 2475689 - RNA, 21 nt, Brucella suis 1330
cgaugcucuaacuauuuauuc

SEQ ID NO: 2475690 - RNA, 14 nt, Brucella suis 1330
cgauggcgacgcgc

SEQ ID NO: 2475691 - RNA, 16 nt, Brucella suis 1330
cgauggcgagcgcgcu

SEQ ID NO: 2475692 - RNA, 18 nt, Brucella suis 1330
cgauggcgccgcauggcg

SEQ ID NO: 2475693 - RNA, 22 nt, Brucella suis 1330
cgauggcguucgucaaugcgcg

SEQ ID NO: 2475694 - RNA, 23 nt, Brucella suis 1330
cgauggugacggucguuucgccg

SEQ ID NO: 2475695 - RNA, 14 nt, Brucella suis 1330
cgaugucgccgcuc

SEQ ID NO: 2475696 - RNA, 18 nt, Brucella suis 1330
cgauguuuucaccaguca

SEQ ID NO: 2475697 - RNA, 12 nt, Brucella suis 1330
cgauuaaaaaag

SEQ ID NO: 2475698 - RNA, 12 nt, Brucella suis 1330
cgauuaucgcga

SEQ ID NO: 2475699 - RNA, 21 nt, Brucella suis 1330
cgauucgcccuuuaucagcga

SEQ ID NO: 2475700 - RNA, 14 nt, Brucella suis 1330
cgauucgcgauccu

SEQ ID NO: 2475701 - RNA, 19 nt, Brucella suis 1330
cgauucgcuaucgaaacaa

SEQ ID NO: 2475702 - RNA, 19 nt, Brucella suis 1330
cgauugcaccaugguguca

SEQ ID NO: 2475703 - RNA, 15 nt, Brucella suis 1330
cgauugcgcauugac

SEQ ID NO: 2475704 - RNA, 13 nt, Brucella suis 1330
cgauuuccuugcc

SEQ ID NO: 2475705 - RNA, 16 nt, Brucella suis 1330
cgcaaaaaaggcgcga

SEQ ID NO: 2475706 - RNA, 22 nt, Brucella suis 1330
cgcaaaagcuccaccaccccuu

SEQ ID NO: 2475707 - RNA, 13 nt, Brucella suis 1330
cgcaaacaucgac

SEQ ID NO: 2475708 - RNA, 12 nt, Brucella suis 1330
cgcaaagcgcgc

SEQ ID NO: 2475709 - RNA, 16 nt, Brucella suis 1330
cgcaaagcgcgcgcca

SEQ ID NO: 2475710 - RNA, 19 nt, Brucella suis 1330
cgcaaagcguuccgcgcaa

SEQ ID NO: 2475711 - RNA, 22 nt, Brucella suis 1330
cgcaaaggaggaggacacgucg

SEQ ID NO: 2475712 - RNA, 17 nt, Brucella suis 1330
cgcaaaggcaggcacac

SEQ ID NO: 2475713 - RNA, 20 nt, Brucella suis 1330
cgcaaccuggcugcaccaga

SEQ ID NO: 2475714 - RNA, 16 nt, Brucella suis 1330
cgcaacuggucggcga

SEQ ID NO: 2475715 - RNA, 18 nt, Brucella suis 1330
cgcaagacccaauccgcc

SEQ ID NO: 2475716 - RNA, 13 nt, Brucella suis 1330
cgcaagccaaagc

SEQ ID NO: 2475717 - RNA, 18 nt, Brucella suis 1330
cgcaagccaaagcccgug

SEQ ID NO: 2475718 - RNA, 18 nt, Brucella suis 1330
cgcaagccaguccuugcc

SEQ ID NO: 2475719 - RNA, 19 nt, Brucella suis 1330
cgcaagccaguccuugccc

SEQ ID NO: 2475720 - RNA, 20 nt, Brucella suis 1330
cgcaaggaaagaucugcauc

SEQ ID NO: 2475721 - RNA, 18 nt, Brucella suis 1330
cgcaaggcuucgccagug

SEQ ID NO: 2475722 - RNA, 18 nt, Brucella suis 1330
cgcaauaaugcagcgccg

SEQ ID NO: 2475723 - RNA, 20 nt, Brucella suis 1330
cgcaauaaugcagcgccgcg

SEQ ID NO: 2475724 - RNA, 19 nt, Brucella suis 1330
cgcaauggccuugccgauc

SEQ ID NO: 2475725 - RNA, 13 nt, Brucella suis 1330
cgcaauggcgaca

SEQ ID NO: 2475726 - RNA, 22 nt, Brucella suis 1330
cgcaaugugcgggcuucuucca

SEQ ID NO: 2475727 - RNA, 18 nt, Brucella suis 1330
cgcaauuucaaagcgcgu

SEQ ID NO: 2475728 - RNA, 13 nt, Brucella suis 1330
cgcacacggcgca

SEQ ID NO: 2475729 - RNA, 18 nt, Brucella suis 1330
cgcacauaaaacgcgccg

SEQ ID NO: 2475730 - RNA, 22 nt, Brucella suis 1330
cgcacaucaaugugaaggcgcu

SEQ ID NO: 2475731 - RNA, 12 nt, Brucella suis 1330
cgcacauccaua

SEQ ID NO: 2475732 - RNA, 17 nt, Brucella suis 1330
cgcacauugucugaaaa

SEQ ID NO: 2475733 - RNA, 23 nt, Brucella suis 1330
cgcaccgauauagagcagcaccg

SEQ ID NO: 2475734 - RNA, 23 nt, Brucella suis 1330
cgcaccgauccgcaacucaugga

SEQ ID NO: 2475735 - RNA, 21 nt, Brucella suis 1330
cgcaccgaucucaccggaagg

SEQ ID NO: 2475736 - RNA, 18 nt, Brucella suis 1330
cgcaccgauggagcgccc

SEQ ID NO: 2475737 - RNA, 14 nt, Brucella suis 1330
cgcaccggcaugga

SEQ ID NO: 2475738 - RNA, 12 nt, Brucella suis 1330
cgcacgaccaga

SEQ ID NO: 2475739 - RNA, 23 nt, Brucella suis 1330
cgcacgcuuggccucuuccagga

SEQ ID NO: 2475740 - RNA, 18 nt, Brucella suis 1330
cgcacgguaacggugcgc

SEQ ID NO: 2475741 - RNA, 21 nt, Brucella suis 1330
cgcacggucuugccggccuga

SEQ ID NO: 2475742 - RNA, 12 nt, Brucella suis 1330
cgcacguccggc

SEQ ID NO: 2475743 - RNA, 18 nt, Brucella suis 1330
cgcacuuuugcuggaaau

SEQ ID NO: 2475744 - RNA, 12 nt, Brucella suis 1330
cgcagaaggcgc

SEQ ID NO: 2475745 - RNA, 20 nt, Brucella suis 1330
cgcagaccacccggccgccc

SEQ ID NO: 2475746 - RNA, 21 nt, Brucella suis 1330
cgcagaucggcgagcgccucg

SEQ ID NO: 2475747 - RNA, 16 nt, Brucella suis 1330
cgcagcaaccaucauc

SEQ ID NO: 2475748 - RNA, 20 nt, Brucella suis 1330
cgcagcagcgcaaacucguc

SEQ ID NO: 2475749 - RNA, 20 nt, Brucella suis 1330
cgcagcagcggaucgaccga

SEQ ID NO: 2475750 - RNA, 20 nt, Brucella suis 1330
cgcagcaucacaugggcauu

SEQ ID NO: 2475751 - RNA, 21 nt, Brucella suis 1330
cgcagccagggauugcgcaag

SEQ ID NO: 2475752 - RNA, 17 nt, Brucella suis 1330
cgcagcccggacaggcg

SEQ ID NO: 2475753 - RNA, 22 nt, Brucella suis 1330
cgcagccgccaacgaccagcug

SEQ ID NO: 2475754 - RNA, 18 nt, Brucella suis 1330
cgcagccgcgucagccgg

SEQ ID NO: 2475755 - RNA, 12 nt, Brucella suis 1330
cgcagccgucgu

SEQ ID NO: 2475756 - RNA, 15 nt, Brucella suis 1330
cgcagcgucgagcag

SEQ ID NO: 2475757 - RNA, 16 nt, Brucella suis 1330
cgcagcgucgagcagg

SEQ ID NO: 2475758 - RNA, 19 nt, Brucella suis 1330
cgcagcguuuugucauggc

SEQ ID NO: 2475759 - RNA, 22 nt, Brucella suis 1330
cgcaggaccacgaacgacaccu

SEQ ID NO: 2475760 - RNA, 17 nt, Brucella suis 1330
cgcaggacuucacccgc

SEQ ID NO: 2475761 - RNA, 19 nt, Brucella suis 1330
cgcaggcgcucggugccgc

SEQ ID NO: 2475762 - RNA, 20 nt, Brucella suis 1330
cgcaggcggaugaagcgccg

SEQ ID NO: 2475763 - RNA, 21 nt, Brucella suis 1330
cgcagggucgcgaccuucuug

SEQ ID NO: 2475764 - RNA, 18 nt, Brucella suis 1330
cgcaguugcaccgcccgg

SEQ ID NO: 2475765 - RNA, 19 nt, Brucella suis 1330
cgcauaauccucacggcca

SEQ ID NO: 2475766 - RNA, 22 nt, Brucella suis 1330
cgcauauugcuugucgaaagcg

SEQ ID NO: 2475767 - RNA, 17 nt, Brucella suis 1330
cgcauccagaacuucgc

SEQ ID NO: 2475768 - RNA, 18 nt, Brucella suis 1330
cgcauccgaaaugcgcgg

SEQ ID NO: 2475769 - RNA, 22 nt, Brucella suis 1330
cgcaucgacaaucuccccuucc

SEQ ID NO: 2475770 - RNA, 13 nt, Brucella suis 1330
cgcaucgaccacu

SEQ ID NO: 2475771 - RNA, 20 nt, Brucella suis 1330
cgcaucgcaauagaccacca

SEQ ID NO: 2475772 - RNA, 17 nt, Brucella suis 1330
cgcaucggucagcacgc

SEQ ID NO: 2475773 - RNA, 18 nt, Brucella suis 1330
cgcaucgguggcauugcc

SEQ ID NO: 2475774 - RNA, 21 nt, Brucella suis 1330
cgcaucguaaucgccgggccu

SEQ ID NO: 2475775 - RNA, 22 nt, Brucella suis 1330
cgcaucuuuuccgaaaaccguu

SEQ ID NO: 2475776 - RNA, 22 nt, Brucella suis 1330
cgcaugaacaugcgccacuucc

SEQ ID NO: 2475777 - RNA, 20 nt, Brucella suis 1330
cgcauggguggugcccggug

SEQ ID NO: 2475778 - RNA, 17 nt, Brucella suis 1330
cgcauuauccgacgcau

SEQ ID NO: 2475779 - RNA, 18 nt, Brucella suis 1330
cgcauuauccgacgcauc

SEQ ID NO: 2475780 - RNA, 14 nt, Brucella suis 1330
cgcauucagagcuu

SEQ ID NO: 2475781 - RNA, 17 nt, Brucella suis 1330
cgcauucagagcuucau

SEQ ID NO: 2475782 - RNA, 19 nt, Brucella suis 1330
cgcauucccuugaaaucau

SEQ ID NO: 2475783 - RNA, 20 nt, Brucella suis 1330
cgcauucuggacgugcuggu

SEQ ID NO: 2475784 - RNA, 12 nt, Brucella suis 1330
cgcauugcccac

SEQ ID NO: 2475785 - RNA, 19 nt, Brucella suis 1330
cgcauuuucgagcaucgau

SEQ ID NO: 2475786 - RNA, 14 nt, Brucella suis 1330
cgccaaaagauucc

SEQ ID NO: 2475787 - RNA, 18 nt, Brucella suis 1330
cgccaaacugcaccgucu

SEQ ID NO: 2475788 - RNA, 17 nt, Brucella suis 1330
cgccaaagaccagcagg

SEQ ID NO: 2475789 - RNA, 18 nt, Brucella suis 1330
cgccaagacuuuccaucc

SEQ ID NO: 2475790 - RNA, 17 nt, Brucella suis 1330
cgccaagccggcgcagc

SEQ ID NO: 2475791 - RNA, 13 nt, Brucella suis 1330
cgccaagcgcauc

SEQ ID NO: 2475792 - RNA, 18 nt, Brucella suis 1330
cgccaaggaacgcggccu

SEQ ID NO: 2475793 - RNA, 16 nt, Brucella suis 1330
cgccaagggccgccga

SEQ ID NO: 2475794 - RNA, 20 nt, Brucella suis 1330
cgccaaguucuuccgccaga

SEQ ID NO: 2475795 - RNA, 16 nt, Brucella suis 1330
cgccaauaccgugauc

SEQ ID NO: 2475796 - RNA, 19 nt, Brucella suis 1330
cgccaaucagaaugcgugg

SEQ ID NO: 2475797 - RNA, 15 nt, Brucella suis 1330
cgccaaucgccgcga

SEQ ID NO: 2475798 - RNA, 18 nt, Brucella suis 1330
cgccaaugcccugcugca

SEQ ID NO: 2475799 - RNA, 13 nt, Brucella suis 1330
cgccacaugggcg

SEQ ID NO: 2475800 - RNA, 13 nt, Brucella suis 1330
cgccaccauggcc

SEQ ID NO: 2475801 - RNA, 18 nt, Brucella suis 1330
cgccaccauggccgcccc

SEQ ID NO: 2475802 - RNA, 14 nt, Brucella suis 1330
cgccaccgcgccgg

SEQ ID NO: 2475803 - RNA, 15 nt, Brucella suis 1330
cgccaccgcgccggu

SEQ ID NO: 2475804 - RNA, 13 nt, Brucella suis 1330
cgccaccggcggc

SEQ ID NO: 2475805 - RNA, 15 nt, Brucella suis 1330
cgccaccggcggcgc

SEQ ID NO: 2475806 - RNA, 21 nt, Brucella suis 1330
cgccacgaucgagcgaacggc

SEQ ID NO: 2475807 - RNA, 18 nt, Brucella suis 1330
cgccacgcgggcuucugc

SEQ ID NO: 2475808 - RNA, 17 nt, Brucella suis 1330
cgccacggauuuccacc

SEQ ID NO: 2475809 - RNA, 22 nt, Brucella suis 1330
cgccacggauuuccaccacgcg

SEQ ID NO: 2475810 - RNA, 11 nt, Brucella suis 1330
cgccacuuccc

SEQ ID NO: 2475811 - RNA, 15 nt, Brucella suis 1330
cgccacuucgcgggc

SEQ ID NO: 2475812 - RNA, 15 nt, Brucella suis 1330
cgccagaagcguaau

SEQ ID NO: 2475813 - RNA, 22 nt, Brucella suis 1330
cgccagaagcguaaugccccgc

SEQ ID NO: 2475814 - RNA, 22 nt, Brucella suis 1330
cgccagagcauuuucgccgcag

SEQ ID NO: 2475815 - RNA, 18 nt, Brucella suis 1330
cgccagagcggcauauug

SEQ ID NO: 2475816 - RNA, 22 nt, Brucella suis 1330
cgccagagcggcauauugcggc

SEQ ID NO: 2475817 - RNA, 22 nt, Brucella suis 1330
cgccagauaagacauggcuucc

SEQ ID NO: 2475818 - RNA, 16 nt, Brucella suis 1330
cgccagcacucugcca

SEQ ID NO: 2475819 - RNA, 18 nt, Brucella suis 1330
cgccagcacucugccagg

SEQ ID NO: 2475820 - RNA, 15 nt, Brucella suis 1330
cgccagcauggcguc

SEQ ID NO: 2475821 - RNA, 18 nt, Brucella suis 1330
cgccagcauuucagggcu

SEQ ID NO: 2475822 - RNA, 15 nt, Brucella suis 1330
cgccagcccauucaa

SEQ ID NO: 2475823 - RNA, 17 nt, Brucella suis 1330
cgccagcccauucaacc

SEQ ID NO: 2475824 - RNA, 14 nt, Brucella suis 1330
cgccagccgccagc

SEQ ID NO: 2475825 - RNA, 13 nt, Brucella suis 1330
cgccagccgcgau

SEQ ID NO: 2475826 - RNA, 11 nt, Brucella suis 1330
cgccagcgccg

SEQ ID NO: 2475827 - RNA, 15 nt, Brucella suis 1330
cgccagcucgccggc

SEQ ID NO: 2475828 - RNA, 17 nt, Brucella suis 1330
cgccagcucgccggcuu

SEQ ID NO: 2475829 - RNA, 17 nt, Brucella suis 1330
cgccagcuuccgucagg

SEQ ID NO: 2475830 - RNA, 21 nt, Brucella suis 1330
cgccagucauugacggcagcc

SEQ ID NO: 2475831 - RNA, 16 nt, Brucella suis 1330
cgccauaaagcaccau

SEQ ID NO: 2475832 - RNA, 20 nt, Brucella suis 1330
cgccauaaagcaccaugagc

SEQ ID NO: 2475833 - RNA, 17 nt, Brucella suis 1330
cgccauauugggagcgc

SEQ ID NO: 2475834 - RNA, 19 nt, Brucella suis 1330
cgccauauugggagcgcag

SEQ ID NO: 2475835 - RNA, 23 nt, Brucella suis 1330
cgccaugaaagaacggcccgcau

SEQ ID NO: 2475836 - RNA, 22 nt, Brucella suis 1330
cgccauguugggguuggccuga

SEQ ID NO: 2475837 - RNA, 13 nt, Brucella suis 1330
cgccauugaccgc

SEQ ID NO: 2475838 - RNA, 20 nt, Brucella suis 1330
cgcccaaggucggcucaucg

SEQ ID NO: 2475839 - RNA, 17 nt, Brucella suis 1330
cgcccaccacgacaaaa

SEQ ID NO: 2475840 - RNA, 23 nt, Brucella suis 1330
cgcccaccauauuugccgccaga

SEQ ID NO: 2475841 - RNA, 13 nt, Brucella suis 1330
cgcccacgaggau

SEQ ID NO: 2475842 - RNA, 13 nt, Brucella suis 1330
cgcccagcgcggc

SEQ ID NO: 2475843 - RNA, 14 nt, Brucella suis 1330
cgcccagcucgaaa

SEQ ID NO: 2475844 - RNA, 13 nt, Brucella suis 1330
cgcccaggcgccc

SEQ ID NO: 2475845 - RNA, 23 nt, Brucella suis 1330
cgcccagggcagauauuucaugg

SEQ ID NO: 2475846 - RNA, 16 nt, Brucella suis 1330
cgcccauacgcgcggc

SEQ ID NO: 2475847 - RNA, 20 nt, Brucella suis 1330
cgcccauuucacccgccaga

SEQ ID NO: 2475848 - RNA, 15 nt, Brucella suis 1330
cgcccauuuucucca

SEQ ID NO: 2475849 - RNA, 23 nt, Brucella suis 1330
cgccccgcgugaugagccgcuuc

SEQ ID NO: 2475850 - RNA, 12 nt, Brucella suis 1330
cgccccgugauc

SEQ ID NO: 2475851 - RNA, 19 nt, Brucella suis 1330
cgcccgauauccggcuggg

SEQ ID NO: 2475852 - RNA, 15 nt, Brucella suis 1330
cgcccgcaaaucguc

SEQ ID NO: 2475853 - RNA, 15 nt, Brucella suis 1330
cgcccgcccgccgca

SEQ ID NO: 2475854 - RNA, 23 nt, Brucella suis 1330
cgcccgcggccacaagcgccggu

SEQ ID NO: 2475855 - RNA, 12 nt, Brucella suis 1330
cgcccggcaucc

SEQ ID NO: 2475856 - RNA, 18 nt, Brucella suis 1330
cgcccgucaccgcggcuu

SEQ ID NO: 2475857 - RNA, 17 nt, Brucella suis 1330
cgcccgucgaccagcgc

SEQ ID NO: 2475858 - RNA, 16 nt, Brucella suis 1330
cgcccguuguucugga

SEQ ID NO: 2475859 - RNA, 17 nt, Brucella suis 1330
cgcccugaagaagcuuc

SEQ ID NO: 2475860 - RNA, 14 nt, Brucella suis 1330
cgcccugcgccgga

SEQ ID NO: 2475861 - RNA, 15 nt, Brucella suis 1330
cgccgaacccgccga

SEQ ID NO: 2475862 - RNA, 23 nt, Brucella suis 1330
cgccgacaaaaaacaccgcgcaa

SEQ ID NO: 2475863 - RNA, 16 nt, Brucella suis 1330
cgccgagauugggcag

SEQ ID NO: 2475864 - RNA, 16 nt, Brucella suis 1330
cgccgaggaauuucag

SEQ ID NO: 2475865 - RNA, 23 nt, Brucella suis 1330
cgccgaggaggggacgcagccuu

SEQ ID NO: 2475866 - RNA, 16 nt, Brucella suis 1330
cgccgauauccucgaa

SEQ ID NO: 2475867 - RNA, 20 nt, Brucella suis 1330
cgccgaugcggggaaaucag

SEQ ID NO: 2475868 - RNA, 11 nt, Brucella suis 1330
cgccgcagacc

SEQ ID NO: 2475869 - RNA, 23 nt, Brucella suis 1330
cgccgccaggcaaaugcuccuuc

SEQ ID NO: 2475870 - RNA, 23 nt, Brucella suis 1330
cgccgccccgauaaggcggcguu

SEQ ID NO: 2475871 - RNA, 22 nt, Brucella suis 1330
cgccgccggugcucugcgccca

SEQ ID NO: 2475872 - RNA, 12 nt, Brucella suis 1330
cgccgccuucaa

SEQ ID NO: 2475873 - RNA, 19 nt, Brucella suis 1330
cgccgcgaaaaccggcugg

SEQ ID NO: 2475874 - RNA, 20 nt, Brucella suis 1330
cgccgcgauugcaucggcag

SEQ ID NO: 2475875 - RNA, 14 nt, Brucella suis 1330
cgccgcgcacuggc

SEQ ID NO: 2475876 - RNA, 18 nt, Brucella suis 1330
cgccgcgcggcagcggca

SEQ ID NO: 2475877 - RNA, 16 nt, Brucella suis 1330
cgccgcggcguuucgg

SEQ ID NO: 2475878 - RNA, 22 nt, Brucella suis 1330
cgccgcgucuuauaguuuucug

SEQ ID NO: 2475879 - RNA, 13 nt, Brucella suis 1330
cgccgcuccagcc

SEQ ID NO: 2475880 - RNA, 20 nt, Brucella suis 1330
cgccgcuccagccgagcgcc

SEQ ID NO: 2475881 - RNA, 21 nt, Brucella suis 1330
cgccgcuugccagcaccagcg

SEQ ID NO: 2475882 - RNA, 16 nt, Brucella suis 1330
cgccgcuuucuuccag

SEQ ID NO: 2475883 - RNA, 17 nt, Brucella suis 1330
cgccggaagauggagcg

SEQ ID NO: 2475884 - RNA, 20 nt, Brucella suis 1330
cgccggaagauggagcggcu

SEQ ID NO: 2475885 - RNA, 16 nt, Brucella suis 1330
cgccggaaugggccug

SEQ ID NO: 2475886 - RNA, 13 nt, Brucella suis 1330
cgccggcgccgcc

SEQ ID NO: 2475887 - RNA, 11 nt, Brucella suis 1330
cgccgggcaau

SEQ ID NO: 2475888 - RNA, 23 nt, Brucella suis 1330
cgccgggcugcuucucccaaagc

SEQ ID NO: 2475889 - RNA, 23 nt, Brucella suis 1330
cgccggggggaauggcgcgcgcg

SEQ ID NO: 2475890 - RNA, 20 nt, Brucella suis 1330
cgccggguucgcucuggcuu

SEQ ID NO: 2475891 - RNA, 12 nt, Brucella suis 1330
cgccggguuuug

SEQ ID NO: 2475892 - RNA, 13 nt, Brucella suis 1330
cgccggguuuugc

SEQ ID NO: 2475893 - RNA, 20 nt, Brucella suis 1330
cgccggugcucugcgcccag

SEQ ID NO: 2475894 - RNA, 13 nt, Brucella suis 1330
cgccgguuuuccg

SEQ ID NO: 2475895 - RNA, 18 nt, Brucella suis 1330
cgccguaauggcgcggcu

SEQ ID NO: 2475896 - RNA, 13 nt, Brucella suis 1330
cgccgucagcccc

SEQ ID NO: 2475897 - RNA, 12 nt, Brucella suis 1330
cgccgucgggac

SEQ ID NO: 2475898 - RNA, 17 nt, Brucella suis 1330
cgccgucgggaccaccg

SEQ ID NO: 2475899 - RNA, 16 nt, Brucella suis 1330
cgccgugcgauagccc

SEQ ID NO: 2475900 - RNA, 13 nt, Brucella suis 1330
cgccgugcugguu

SEQ ID NO: 2475901 - RNA, 13 nt, Brucella suis 1330
cgccuaaggcgcg

SEQ ID NO: 2475902 - RNA, 22 nt, Brucella suis 1330
cgccuacgcggggaaaucaguc

SEQ ID NO: 2475903 - RNA, 23 nt, Brucella suis 1330
cgccucaauggucacggccacau

SEQ ID NO: 2475904 - RNA, 18 nt, Brucella suis 1330
cgccucauaaucagccuc

SEQ ID NO: 2475905 - RNA, 21 nt, Brucella suis 1330
cgccucauggcggcgcucggc

SEQ ID NO: 2475906 - RNA, 15 nt, Brucella suis 1330
cgccucgaauuccac

SEQ ID NO: 2475907 - RNA, 16 nt, Brucella suis 1330
cgccucgacacccgga

SEQ ID NO: 2475908 - RNA, 17 nt, Brucella suis 1330
cgccucugucaccugac

SEQ ID NO: 2475909 - RNA, 18 nt, Brucella suis 1330
cgccucuucauccggcag

SEQ ID NO: 2475910 - RNA, 19 nt, Brucella suis 1330
cgccucuucauccggcagg

SEQ ID NO: 2475911 - RNA, 20 nt, Brucella suis 1330
cgccucuucauccggcaggu

SEQ ID NO: 2475912 - RNA, 15 nt, Brucella suis 1330
cgccugaggcauuga

SEQ ID NO: 2475913 - RNA, 22 nt, Brucella suis 1330
cgccugcaacugcaaggcaucg

SEQ ID NO: 2475914 - RNA, 23 nt, Brucella suis 1330
cgccugcaauggaaaaggccugu

SEQ ID NO: 2475915 - RNA, 15 nt, Brucella suis 1330
cgccugcaccaugga

SEQ ID NO: 2475916 - RNA, 13 nt, Brucella suis 1330
cgccugccagccc

SEQ ID NO: 2475917 - RNA, 16 nt, Brucella suis 1330
cgccugccaugccgcc

SEQ ID NO: 2475918 - RNA, 16 nt, Brucella suis 1330
cgccugcugccauguc

SEQ ID NO: 2475919 - RNA, 14 nt, Brucella suis 1330
cgccuggcccggcu

SEQ ID NO: 2475920 - RNA, 16 nt, Brucella suis 1330
cgccuggccggcgccu

SEQ ID NO: 2475921 - RNA, 14 nt, Brucella suis 1330
cgccuguccgccug

SEQ ID NO: 2475922 - RNA, 15 nt, Brucella suis 1330
cgccuguccgccugc

SEQ ID NO: 2475923 - RNA, 16 nt, Brucella suis 1330
cgccugugugaacagg

SEQ ID NO: 2475924 - RNA, 20 nt, Brucella suis 1330
cgccuuauaggcgcgcgccu

SEQ ID NO: 2475925 - RNA, 15 nt, Brucella suis 1330
cgccuuccuugaacu

SEQ ID NO: 2475926 - RNA, 13 nt, Brucella suis 1330
cgccuucgcgcac

SEQ ID NO: 2475927 - RNA, 23 nt, Brucella suis 1330
cgccuugaugccgcucggcaagg

SEQ ID NO: 2475928 - RNA, 23 nt, Brucella suis 1330
cgccuugcagaugagcggcagca

SEQ ID NO: 2475929 - RNA, 24 nt, Brucella suis 1330
cgccuugcggcauauccggaccga

SEQ ID NO: 2475930 - RNA, 14 nt, Brucella suis 1330
cgccuuugccgcgc

SEQ ID NO: 2475931 - RNA, 19 nt, Brucella suis 1330
cgccuuuugcggggcuucc

SEQ ID NO: 2475932 - RNA, 19 nt, Brucella suis 1330
cgcgaaaccauggagcgca

SEQ ID NO: 2475933 - RNA, 13 nt, Brucella suis 1330
cgcgaaacgccuu

SEQ ID NO: 2475934 - RNA, 19 nt, Brucella suis 1330
cgcgaaccagauccaccgc

SEQ ID NO: 2475935 - RNA, 23 nt, Brucella suis 1330
cgcgaaccagauccaccgcgcug

SEQ ID NO: 2475936 - RNA, 18 nt, Brucella suis 1330
cgcgaaccgucgccagcu

SEQ ID NO: 2475937 - RNA, 23 nt, Brucella suis 1330
cgcgaaccgucgccagcucgccg

SEQ ID NO: 2475938 - RNA, 22 nt, Brucella suis 1330
cgcgaagauaagcggcaaaggc

SEQ ID NO: 2475939 - RNA, 13 nt, Brucella suis 1330
cgcgacaagcgca

SEQ ID NO: 2475940 - RNA, 19 nt, Brucella suis 1330
cgcgacacgccaaaaccac

SEQ ID NO: 2475941 - RNA, 14 nt, Brucella suis 1330
cgcgacaucaucaa

SEQ ID NO: 2475942 - RNA, 19 nt, Brucella suis 1330
cgcgaccagguugcgccga

SEQ ID NO: 2475943 - RNA, 22 nt, Brucella suis 1330
cgcgaccucauuugccaccugc

SEQ ID NO: 2475944 - RNA, 14 nt, Brucella suis 1330
cgcgacuccuugua

SEQ ID NO: 2475945 - RNA, 18 nt, Brucella suis 1330
cgcgacugucaccgccag

SEQ ID NO: 2475946 - RNA, 21 nt, Brucella suis 1330
cgcgaggcauaauaggcaucg

SEQ ID NO: 2475947 - RNA, 14 nt, Brucella suis 1330
cgcgauaauauuga

SEQ ID NO: 2475948 - RNA, 22 nt, Brucella suis 1330
cgcgaucacagccgcgccaauc

SEQ ID NO: 2475949 - RNA, 12 nt, Brucella suis 1330
cgcgaucaccag

SEQ ID NO: 2475950 - RNA, 23 nt, Brucella suis 1330
cgcgaucaugcccacaucgccuu

SEQ ID NO: 2475951 - RNA, 20 nt, Brucella suis 1330
cgcgauccugcugcgcggca

SEQ ID NO: 2475952 - RNA, 22 nt, Brucella suis 1330
cgcgaugauggcagaccccauc

SEQ ID NO: 2475953 - RNA, 16 nt, Brucella suis 1330
cgcgaugcggcgguga

SEQ ID NO: 2475954 - RNA, 15 nt, Brucella suis 1330
cgcgauggaccauau

SEQ ID NO: 2475955 - RNA, 18 nt, Brucella suis 1330
cgcgauugcaucggcagc

SEQ ID NO: 2475956 - RNA, 20 nt, Brucella suis 1330
cgcgcaaaaucugcucgucc

SEQ ID NO: 2475957 - RNA, 19 nt, Brucella suis 1330
cgcgcaccgauggagcgcc

SEQ ID NO: 2475958 - RNA, 19 nt, Brucella suis 1330
cgcgcacguccggcacuuc

SEQ ID NO: 2475959 - RNA, 12 nt, Brucella suis 1330
cgcgcagaaggc

SEQ ID NO: 2475960 - RNA, 14 nt, Brucella suis 1330
cgcgcagacgcagc

SEQ ID NO: 2475961 - RNA, 18 nt, Brucella suis 1330
cgcgcagauauggcgccu

SEQ ID NO: 2475962 - RNA, 19 nt, Brucella suis 1330
cgcgcagauauggcgccug

SEQ ID NO: 2475963 - RNA, 20 nt, Brucella suis 1330
cgcgcaggacuucacccgcc

SEQ ID NO: 2475964 - RNA, 18 nt, Brucella suis 1330
cgcgcaggccgcggcauc

SEQ ID NO: 2475965 - RNA, 13 nt, Brucella suis 1330
cgcgcaucgcgcg

SEQ ID NO: 2475966 - RNA, 21 nt, Brucella suis 1330
cgcgcaucgcgguucgggcau

SEQ ID NO: 2475967 - RNA, 19 nt, Brucella suis 1330
cgcgcaucuuuuccgaaaa

SEQ ID NO: 2475968 - RNA, 15 nt, Brucella suis 1330
cgcgcauugacgcgc

SEQ ID NO: 2475969 - RNA, 13 nt, Brucella suis 1330
cgcgccaauccag

SEQ ID NO: 2475970 - RNA, 18 nt, Brucella suis 1330
cgcgccaauccaggucag

SEQ ID NO: 2475971 - RNA, 18 nt, Brucella suis 1330
cgcgccagagcggcauau

SEQ ID NO: 2475972 - RNA, 13 nt, Brucella suis 1330
cgcgccaggcuuc

SEQ ID NO: 2475973 - RNA, 13 nt, Brucella suis 1330
cgcgccaucggca

SEQ ID NO: 2475974 - RNA, 13 nt, Brucella suis 1330
cgcgccaugccau

SEQ ID NO: 2475975 - RNA, 14 nt, Brucella suis 1330
cgcgccaugccauc

SEQ ID NO: 2475976 - RNA, 13 nt, Brucella suis 1330
cgcgcccaccacg

SEQ ID NO: 2475977 - RNA, 18 nt, Brucella suis 1330
cgcgccccuggcggcacu

SEQ ID NO: 2475978 - RNA, 12 nt, Brucella suis 1330
cgcgcccggcgg

SEQ ID NO: 2475979 - RNA, 20 nt, Brucella suis 1330
cgcgcccgucaccgcggcuu

SEQ ID NO: 2475980 - RNA, 15 nt, Brucella suis 1330
cgcgcccgucaccgg

SEQ ID NO: 2475981 - RNA, 14 nt, Brucella suis 1330
cgcgcccucgcgcu

SEQ ID NO: 2475982 - RNA, 13 nt, Brucella suis 1330
cgcgcccuggcug

SEQ ID NO: 2475983 - RNA, 19 nt, Brucella suis 1330
cgcgccgaaaaucggcacu

SEQ ID NO: 2475984 - RNA, 20 nt, Brucella suis 1330
cgcgccgaugaggccgguaa

SEQ ID NO: 2475985 - RNA, 15 nt, Brucella suis 1330
cgcgccgcaacucuu

SEQ ID NO: 2475986 - RNA, 22 nt, Brucella suis 1330
cgcgccgcuugccagcaccagc

SEQ ID NO: 2475987 - RNA, 16 nt, Brucella suis 1330
cgcgcgaaaccaugga

SEQ ID NO: 2475988 - RNA, 20 nt, Brucella suis 1330
cgcgcgaaaccauggagcgc

SEQ ID NO: 2475989 - RNA, 18 nt, Brucella suis 1330
cgcgcgccaucggcaagg

SEQ ID NO: 2475990 - RNA, 22 nt, Brucella suis 1330
cgcgcgccucgaauuccaccgc

SEQ ID NO: 2475991 - RNA, 13 nt, Brucella suis 1330
cgcgcgcgcgcag

SEQ ID NO: 2475992 - RNA, 14 nt, Brucella suis 1330
cgcgcgcgcgcagg

SEQ ID NO: 2475993 - RNA, 12 nt, Brucella suis 1330
cgcgcgcggcuu

SEQ ID NO: 2475994 - RNA, 18 nt, Brucella suis 1330
cgcgcggcaugaaagcgc

SEQ ID NO: 2475995 - RNA, 16 nt, Brucella suis 1330
cgcgcggcgaaacgcc

SEQ ID NO: 2475996 - RNA, 21 nt, Brucella suis 1330
cgcgcggcuuccagcgccuca

SEQ ID NO: 2475997 - RNA, 14 nt, Brucella suis 1330
cgcgcggcuucugu

SEQ ID NO: 2475998 - RNA, 22 nt, Brucella suis 1330
cgcgcggucaguggaucgacau

SEQ ID NO: 2475999 - RNA, 23 nt, Brucella suis 1330
cgcgcguggucauggccacgcca

SEQ ID NO: 2476000 - RNA, 19 nt, Brucella suis 1330
cgcgcuccacauccacccg

SEQ ID NO: 2476001 - RNA, 21 nt, Brucella suis 1330
cgcgcugcgacgagaugcgcu

SEQ ID NO: 2476002 - RNA, 16 nt, Brucella suis 1330
cgcggacaagcucgcg

SEQ ID NO: 2476003 - RNA, 14 nt, Brucella suis 1330
cgcggaucggcagc

SEQ ID NO: 2476004 - RNA, 15 nt, Brucella suis 1330
cgcggaucggcagcg

SEQ ID NO: 2476005 - RNA, 15 nt, Brucella suis 1330
cgcggaugacgccgc

SEQ ID NO: 2476006 - RNA, 14 nt, Brucella suis 1330
cgcggcaacugccg

SEQ ID NO: 2476007 - RNA, 16 nt, Brucella suis 1330
cgcggcaagauagccc

SEQ ID NO: 2476008 - RNA, 13 nt, Brucella suis 1330
cgcggcaaugcgc

SEQ ID NO: 2476009 - RNA, 22 nt, Brucella suis 1330
cgcggcaaugcgcuucgcgcag

SEQ ID NO: 2476010 - RNA, 23 nt, Brucella suis 1330
cgcggcaaugcgcuucgcgcagg

SEQ ID NO: 2476011 - RNA, 21 nt, Brucella suis 1330
cgcggcaucccugucgccgaa

SEQ ID NO: 2476012 - RNA, 17 nt, Brucella suis 1330
cgcggccacaagcgccg

SEQ ID NO: 2476013 - RNA, 18 nt, Brucella suis 1330
cgcggccacaagcgccgg

SEQ ID NO: 2476014 - RNA, 14 nt, Brucella suis 1330
cgcggccagccagc

SEQ ID NO: 2476015 - RNA, 19 nt, Brucella suis 1330
cgcggcggcaacgggcgag

SEQ ID NO: 2476016 - RNA, 17 nt, Brucella suis 1330
cgcggcguucggcaagu

SEQ ID NO: 2476017 - RNA, 18 nt, Brucella suis 1330
cgcggcucucacgcgcag

SEQ ID NO: 2476018 - RNA, 16 nt, Brucella suis 1330
cgcgggcgcagcgaca

SEQ ID NO: 2476019 - RNA, 15 nt, Brucella suis 1330
cgcgguuugcaagcc

SEQ ID NO: 2476020 - RNA, 18 nt, Brucella suis 1330
cgcgguuugcaagccgcg

SEQ ID NO: 2476021 - RNA, 14 nt, Brucella suis 1330
cgcgucaucgccac

SEQ ID NO: 2476022 - RNA, 15 nt, Brucella suis 1330
cgcguccuucaggcc

SEQ ID NO: 2476023 - RNA, 16 nt, Brucella suis 1330
cgcguccuucaggccg

SEQ ID NO: 2476024 - RNA, 17 nt, Brucella suis 1330
cgcgucgagcaaugcgc

SEQ ID NO: 2476025 - RNA, 21 nt, Brucella suis 1330
cgcgucuuauaguuuucuggc

SEQ ID NO: 2476026 - RNA, 19 nt, Brucella suis 1330
cgcgugaaaauagcugggu

SEQ ID NO: 2476027 - RNA, 14 nt, Brucella suis 1330
cgcgugagcgcgca

SEQ ID NO: 2476028 - RNA, 17 nt, Brucella suis 1330
cgcgugcacgcgcagau

SEQ ID NO: 2476029 - RNA, 20 nt, Brucella suis 1330
cgcguucacguaggcgcggc

SEQ ID NO: 2476030 - RNA, 12 nt, Brucella suis 1330
cgcguucagcca

SEQ ID NO: 2476031 - RNA, 16 nt, Brucella suis 1330
cgcguugcccaugucc

SEQ ID NO: 2476032 - RNA, 16 nt, Brucella suis 1330
cgcguugccuugcugg

SEQ ID NO: 2476033 - RNA, 21 nt, Brucella suis 1330
cgcguugcggccgggccaacg

SEQ ID NO: 2476034 - RNA, 13 nt, Brucella suis 1330
cgcucaacacucu

SEQ ID NO: 2476035 - RNA, 18 nt, Brucella suis 1330
cgcucaaggccuguucca

SEQ ID NO: 2476036 - RNA, 13 nt, Brucella suis 1330
cgcuccaccagca

SEQ ID NO: 2476037 - RNA, 16 nt, Brucella suis 1330
cgcucccggucuuccu

SEQ ID NO: 2476038 - RNA, 17 nt, Brucella suis 1330
cgcucgaaugccucgau

SEQ ID NO: 2476039 - RNA, 13 nt, Brucella suis 1330
cgcucgccgccca

SEQ ID NO: 2476040 - RNA, 14 nt, Brucella suis 1330
cgcucgccgcccac

SEQ ID NO: 2476041 - RNA, 20 nt, Brucella suis 1330
cgcucuaacagucgaagcgg

SEQ ID NO: 2476042 - RNA, 18 nt, Brucella suis 1330
cgcucucgcauugagcgc

SEQ ID NO: 2476043 - RNA, 23 nt, Brucella suis 1330
cgcucucgucgagaagcaucagc

SEQ ID NO: 2476044 - RNA, 16 nt, Brucella suis 1330
cgcugaaugcggcaau

SEQ ID NO: 2476045 - RNA, 17 nt, Brucella suis 1330
cgcugaaugcggcaauc

SEQ ID NO: 2476046 - RNA, 14 nt, Brucella suis 1330
cgcugacugcgcca

SEQ ID NO: 2476047 - RNA, 15 nt, Brucella suis 1330
cgcugaggcggccgg

SEQ ID NO: 2476048 - RNA, 13 nt, Brucella suis 1330
cgcugaucgccuu

SEQ ID NO: 2476049 - RNA, 13 nt, Brucella suis 1330
cgcugaucggcgc

SEQ ID NO: 2476050 - RNA, 17 nt, Brucella suis 1330
cgcugauugggcggcgg

SEQ ID NO: 2476051 - RNA, 16 nt, Brucella suis 1330
cgcugcaacaaaugca

SEQ ID NO: 2476052 - RNA, 16 nt, Brucella suis 1330
cgcugccauugccgcg

SEQ ID NO: 2476053 - RNA, 14 nt, Brucella suis 1330
cgcugcgaaggccc

SEQ ID NO: 2476054 - RNA, 18 nt, Brucella suis 1330
cgcugcgacgagaugcgc

SEQ ID NO: 2476055 - RNA, 15 nt, Brucella suis 1330
cgcugcgggcagccu

SEQ ID NO: 2476056 - RNA, 20 nt, Brucella suis 1330
cgcuggaugucgauuucacc

SEQ ID NO: 2476057 - RNA, 19 nt, Brucella suis 1330
cgcuucaucgcauccggcc

SEQ ID NO: 2476058 - RNA, 21 nt, Brucella suis 1330
cgcuucaugauaaggccgcuu

SEQ ID NO: 2476059 - RNA, 17 nt, Brucella suis 1330
cgcuucaugggcuugau

SEQ ID NO: 2476060 - RNA, 15 nt, Brucella suis 1330
cgcuuccggugcuca

SEQ ID NO: 2476061 - RNA, 16 nt, Brucella suis 1330
cgcuucgaugcguugg

SEQ ID NO: 2476062 - RNA, 22 nt, Brucella suis 1330
cgcuucgcugcgguagcgcaug

SEQ ID NO: 2476063 - RNA, 22 nt, Brucella suis 1330
cgcuucuugcuguaaccgccac

SEQ ID NO: 2476064 - RNA, 20 nt, Brucella suis 1330
cgcuugaggcucauaccgau

SEQ ID NO: 2476065 - RNA, 12 nt, Brucella suis 1330
cgcuugaugacg

SEQ ID NO: 2476066 - RNA, 18 nt, Brucella suis 1330
cgcuugaugacgccaucu

SEQ ID NO: 2476067 - RNA, 18 nt, Brucella suis 1330
cgcuugcauuccagaagg

SEQ ID NO: 2476068 - RNA, 20 nt, Brucella suis 1330
cgcuugccagcaccagcggc

SEQ ID NO: 2476069 - RNA, 15 nt, Brucella suis 1330
cgcuugcgcccgcgg

SEQ ID NO: 2476070 - RNA, 17 nt, Brucella suis 1330
cgcuuuauuccuuugau

SEQ ID NO: 2476071 - RNA, 13 nt, Brucella suis 1330
cgcuuuugcgcuc

SEQ ID NO: 2476072 - RNA, 19 nt, Brucella suis 1330
cggaaaagaugcgcgucaa

SEQ ID NO: 2476073 - RNA, 19 nt, Brucella suis 1330
cggaaaccaguggccuuca

SEQ ID NO: 2476074 - RNA, 20 nt, Brucella suis 1330
cggaaacgcgugccagcauu

SEQ ID NO: 2476075 - RNA, 13 nt, Brucella suis 1330
cggaaagggcugc

SEQ ID NO: 2476076 - RNA, 15 nt, Brucella suis 1330
cggaacaaacuggcg

SEQ ID NO: 2476077 - RNA, 15 nt, Brucella suis 1330
cggaacaaugcaauc

SEQ ID NO: 2476078 - RNA, 21 nt, Brucella suis 1330
cggaacaggcagcaugaacca

SEQ ID NO: 2476079 - RNA, 21 nt, Brucella suis 1330
cggaacauauaaagcaaaggc

SEQ ID NO: 2476080 - RNA, 20 nt, Brucella suis 1330
cggaaccaucaucuucaccu

SEQ ID NO: 2476081 - RNA, 18 nt, Brucella suis 1330
cggaaccauggcugcgau

SEQ ID NO: 2476082 - RNA, 21 nt, Brucella suis 1330
cggaacgcugaucgccuuuca

SEQ ID NO: 2476083 - RNA, 20 nt, Brucella suis 1330
cggaacuggaugacaguuuc

SEQ ID NO: 2476084 - RNA, 15 nt, Brucella suis 1330
cggaagcgaaaugcc

SEQ ID NO: 2476085 - RNA, 17 nt, Brucella suis 1330
cggaagcgauuggcuuc

SEQ ID NO: 2476086 - RNA, 12 nt, Brucella suis 1330
cggaagcgcaaa

SEQ ID NO: 2476087 - RNA, 16 nt, Brucella suis 1330
cggaagcgcaaaacag

SEQ ID NO: 2476088 - RNA, 23 nt, Brucella suis 1330
cggaagcgcaaaacagcgccauu

SEQ ID NO: 2476089 - RNA, 19 nt, Brucella suis 1330
cggaagcgcguacggcauu

SEQ ID NO: 2476090 - RNA, 15 nt, Brucella suis 1330
cggaagggcaaggcg

SEQ ID NO: 2476091 - RNA, 18 nt, Brucella suis 1330
cggaaugggccugaugau

SEQ ID NO: 2476092 - RNA, 14 nt, Brucella suis 1330
cggacagauugcua

SEQ ID NO: 2476093 - RNA, 16 nt, Brucella suis 1330
cggaccgugccgcuuc

SEQ ID NO: 2476094 - RNA, 18 nt, Brucella suis 1330
cggacgagauugccgcca

SEQ ID NO: 2476095 - RNA, 21 nt, Brucella suis 1330
cggacgagauugccgccacau

SEQ ID NO: 2476096 - RNA, 12 nt, Brucella suis 1330
cggacgcgcaga

SEQ ID NO: 2476097 - RNA, 17 nt, Brucella suis 1330
cggacggaugcggaaac

SEQ ID NO: 2476098 - RNA, 20 nt, Brucella suis 1330
cggacggauggcauggacca

SEQ ID NO: 2476099 - RNA, 17 nt, Brucella suis 1330
cggagagagggccgcuc

SEQ ID NO: 2476100 - RNA, 21 nt, Brucella suis 1330
cggagccgaagucacgauggc

SEQ ID NO: 2476101 - RNA, 21 nt, Brucella suis 1330
cggagccggccuuugcgcgcc

SEQ ID NO: 2476102 - RNA, 22 nt, Brucella suis 1330
cggagccggccuuugcgcgccu

SEQ ID NO: 2476103 - RNA, 19 nt, Brucella suis 1330
cggagccucaucggcgggc

SEQ ID NO: 2476104 - RNA, 20 nt, Brucella suis 1330
cggagcggaguguacuguua

SEQ ID NO: 2476105 - RNA, 21 nt, Brucella suis 1330
cggagcguccgagcggcagcg

SEQ ID NO: 2476106 - RNA, 21 nt, Brucella suis 1330
cggagcuaaaguaucucucgc

SEQ ID NO: 2476107 - RNA, 12 nt, Brucella suis 1330
cggaggcuuccg

SEQ ID NO: 2476108 - RNA, 14 nt, Brucella suis 1330
cggauaauagauga

SEQ ID NO: 2476109 - RNA, 19 nt, Brucella suis 1330
cggauaauagaugagcugg

SEQ ID NO: 2476110 - RNA, 16 nt, Brucella suis 1330
cggauaaugcucgccc

SEQ ID NO: 2476111 - RNA, 19 nt, Brucella suis 1330
cggauagagaacauauccu

SEQ ID NO: 2476112 - RNA, 16 nt, Brucella suis 1330
cggauaucuuccugaa

SEQ ID NO: 2476113 - RNA, 13 nt, Brucella suis 1330
cggauauggucgu

SEQ ID NO: 2476114 - RNA, 15 nt, Brucella suis 1330
cggaucaaaccggcc

SEQ ID NO: 2476115 - RNA, 22 nt, Brucella suis 1330
cggaucaaaccggccaugccca

SEQ ID NO: 2476116 - RNA, 15 nt, Brucella suis 1330
cggaucgaggccgaa

SEQ ID NO: 2476117 - RNA, 14 nt, Brucella suis 1330
cggaucgcgcggca

SEQ ID NO: 2476118 - RNA, 16 nt, Brucella suis 1330
cggaucggcaggauag

SEQ ID NO: 2476119 - RNA, 18 nt, Brucella suis 1330
cggaucgugacccgcccu

SEQ ID NO: 2476120 - RNA, 17 nt, Brucella suis 1330
cggaucgugagguucuu

SEQ ID NO: 2476121 - RNA, 12 nt, Brucella suis 1330
cggaugaacccg

SEQ ID NO: 2476122 - RNA, 18 nt, Brucella suis 1330
cggaugcgcacauauuug

SEQ ID NO: 2476123 - RNA, 19 nt, Brucella suis 1330
cggaugcgguugcgacauu

SEQ ID NO: 2476124 - RNA, 17 nt, Brucella suis 1330
cggaugguucuugaaag

SEQ ID NO: 2476125 - RNA, 19 nt, Brucella suis 1330
cggaugguucuugaaagcg

SEQ ID NO: 2476126 - RNA, 17 nt, Brucella suis 1330
cggauucuuaugccaga

SEQ ID NO: 2476127 - RNA, 20 nt, Brucella suis 1330
cggauucuuaugccagauau

SEQ ID NO: 2476128 - RNA, 17 nt, Brucella suis 1330
cggauuggcguucacau

SEQ ID NO: 2476129 - RNA, 18 nt, Brucella suis 1330
cggauuuccaccacgcgc

SEQ ID NO: 2476130 - RNA, 22 nt, Brucella suis 1330
cggauuugaggauugccgccgc

SEQ ID NO: 2476131 - RNA, 14 nt, Brucella suis 1330
cggauuuugccuuc

SEQ ID NO: 2476132 - RNA, 18 nt, Brucella suis 1330
cggauuuuucucaaugcg

SEQ ID NO: 2476133 - RNA, 19 nt, Brucella suis 1330
cggcaaaggccgccgucgc

SEQ ID NO: 2476134 - RNA, 24 nt, Brucella suis 1330
cggcaaauagcuuaugcgcgcccg

SEQ ID NO: 2476135 - RNA, 21 nt, Brucella suis 1330
cggcaaaugucacgcucgucg

SEQ ID NO: 2476136 - RNA, 14 nt, Brucella suis 1330
cggcaaccaucuuc

SEQ ID NO: 2476137 - RNA, 21 nt, Brucella suis 1330
cggcaacgccgaagcuugccg

SEQ ID NO: 2476138 - RNA, 16 nt, Brucella suis 1330
cggcaacggcgcuggc

SEQ ID NO: 2476139 - RNA, 17 nt, Brucella suis 1330
cggcaacuugcaacgau

SEQ ID NO: 2476140 - RNA, 19 nt, Brucella suis 1330
cggcaagaacaagaacggc

SEQ ID NO: 2476141 - RNA, 17 nt, Brucella suis 1330
cggcaagauaagcgccg

SEQ ID NO: 2476142 - RNA, 22 nt, Brucella suis 1330
cggcaagauagccccagcccgc

SEQ ID NO: 2476143 - RNA, 13 nt, Brucella suis 1330
cggcaagauggcu

SEQ ID NO: 2476144 - RNA, 13 nt, Brucella suis 1330
cggcaagcgcaau

SEQ ID NO: 2476145 - RNA, 23 nt, Brucella suis 1330
cggcaagcgcaauggccuugccg

SEQ ID NO: 2476146 - RNA, 23 nt, Brucella suis 1330
cggcaagcgcggucagcucgucc

SEQ ID NO: 2476147 - RNA, 12 nt, Brucella suis 1330
cggcaagcggcu

SEQ ID NO: 2476148 - RNA, 14 nt, Brucella suis 1330
cggcaagcuugacg

SEQ ID NO: 2476149 - RNA, 15 nt, Brucella suis 1330
cggcaaggccgcgcu

SEQ ID NO: 2476150 - RNA, 21 nt, Brucella suis 1330
cggcaaguguggcgucgucaa

SEQ ID NO: 2476151 - RNA, 20 nt, Brucella suis 1330
cggcaaucgagacggaacgc

SEQ ID NO: 2476152 - RNA, 14 nt, Brucella suis 1330
cggcaaugaucugg

SEQ ID NO: 2476153 - RNA, 18 nt, Brucella suis 1330
cggcaaugaucuggcgcg

SEQ ID NO: 2476154 - RNA, 16 nt, Brucella suis 1330
cggcacaugaaauaag

SEQ ID NO: 2476155 - RNA, 23 nt, Brucella suis 1330
cggcaccgcaaagagaaccaccu

SEQ ID NO: 2476156 - RNA, 21 nt, Brucella suis 1330
cggcacgaacagaucgccaag

SEQ ID NO: 2476157 - RNA, 16 nt, Brucella suis 1330
cggcacgacaggcuca

SEQ ID NO: 2476158 - RNA, 13 nt, Brucella suis 1330
cggcacgaucagg

SEQ ID NO: 2476159 - RNA, 14 nt, Brucella suis 1330
cggcacgaucaggg

SEQ ID NO: 2476160 - RNA, 12 nt, Brucella suis 1330
cggcagaccgga

SEQ ID NO: 2476161 - RNA, 18 nt, Brucella suis 1330
cggcagacgugaccgccu

SEQ ID NO: 2476162 - RNA, 23 nt, Brucella suis 1330
cggcagccgccgccgcaaaggca

SEQ ID NO: 2476163 - RNA, 16 nt, Brucella suis 1330
cggcagccuucgcugc

SEQ ID NO: 2476164 - RNA, 20 nt, Brucella suis 1330
cggcagccuugagcuggucc

SEQ ID NO: 2476165 - RNA, 17 nt, Brucella suis 1330
cggcagcgaaccgucca

SEQ ID NO: 2476166 - RNA, 21 nt, Brucella suis 1330
cggcagcgaaccguccacgau

SEQ ID NO: 2476167 - RNA, 18 nt, Brucella suis 1330
cggcagcgacccgcgccc

SEQ ID NO: 2476168 - RNA, 20 nt, Brucella suis 1330
cggcagcggcgugccgggcg

SEQ ID NO: 2476169 - RNA, 20 nt, Brucella suis 1330
cggcaggaucuuccaucugg

SEQ ID NO: 2476170 - RNA, 19 nt, Brucella suis 1330
cggcaggccgaaggaugca

SEQ ID NO: 2476171 - RNA, 22 nt, Brucella suis 1330
cggcaggccgcaaagcgaacgc

SEQ ID NO: 2476172 - RNA, 12 nt, Brucella suis 1330
cggcagggccag

SEQ ID NO: 2476173 - RNA, 14 nt, Brucella suis 1330
cggcagggccagau

SEQ ID NO: 2476174 - RNA, 16 nt, Brucella suis 1330
cggcagguaagagcag

SEQ ID NO: 2476175 - RNA, 17 nt, Brucella suis 1330
cggcagguaagagcaga

SEQ ID NO: 2476176 - RNA, 16 nt, Brucella suis 1330
cggcaguccggcagca

SEQ ID NO: 2476177 - RNA, 19 nt, Brucella suis 1330
cggcaguccggcagcacgu

SEQ ID NO: 2476178 - RNA, 17 nt, Brucella suis 1330
cggcaguuucaccaugg

SEQ ID NO: 2476179 - RNA, 18 nt, Brucella suis 1330
cggcaguuucaccauggc

SEQ ID NO: 2476180 - RNA, 20 nt, Brucella suis 1330
cggcaguuucugccgcgcau

SEQ ID NO: 2476181 - RNA, 22 nt, Brucella suis 1330
cggcauaaaaaaagcgcggagc

SEQ ID NO: 2476182 - RNA, 12 nt, Brucella suis 1330
cggcaucacugg

SEQ ID NO: 2476183 - RNA, 18 nt, Brucella suis 1330
cggcaucagaaauuugcg

SEQ ID NO: 2476184 - RNA, 14 nt, Brucella suis 1330
cggcauccuugccg

SEQ ID NO: 2476185 - RNA, 18 nt, Brucella suis 1330
cggcaucggaaccccaau

SEQ ID NO: 2476186 - RNA, 19 nt, Brucella suis 1330
cggcauggccugcgcgcgc

SEQ ID NO: 2476187 - RNA, 22 nt, Brucella suis 1330
cggcauuauccgcaucgaucac

SEQ ID NO: 2476188 - RNA, 13 nt, Brucella suis 1330
cggcauugccugu

SEQ ID NO: 2476189 - RNA, 20 nt, Brucella suis 1330
cggcauuuugcgaaaugcgc

SEQ ID NO: 2476190 - RNA, 13 nt, Brucella suis 1330
cggccaagcagga

SEQ ID NO: 2476191 - RNA, 15 nt, Brucella suis 1330
cggccaagcgcaucg

SEQ ID NO: 2476192 - RNA, 23 nt, Brucella suis 1330
cggccaagcgcaucgguggcauu

SEQ ID NO: 2476193 - RNA, 15 nt, Brucella suis 1330
cggccaagcgccaga

SEQ ID NO: 2476194 - RNA, 15 nt, Brucella suis 1330
cggccacccagcccg

SEQ ID NO: 2476195 - RNA, 15 nt, Brucella suis 1330
cggccacgaaauggg

SEQ ID NO: 2476196 - RNA, 12 nt, Brucella suis 1330
cggccacgcgca

SEQ ID NO: 2476197 - RNA, 14 nt, Brucella suis 1330
cggccacgcgcaga

SEQ ID NO: 2476198 - RNA, 14 nt, Brucella suis 1330
cggccacggcaucc

SEQ ID NO: 2476199 - RNA, 23 nt, Brucella suis 1330
cggccagcaauugcugggcuucc

SEQ ID NO: 2476200 - RNA, 19 nt, Brucella suis 1330
cggccagcgcaaagcgcgc

SEQ ID NO: 2476201 - RNA, 21 nt, Brucella suis 1330
cggccagcgcaaagcgcgcgc

SEQ ID NO: 2476202 - RNA, 14 nt, Brucella suis 1330
cggccagcuugaaa

SEQ ID NO: 2476203 - RNA, 11 nt, Brucella suis 1330
cggccagggcu

SEQ ID NO: 2476204 - RNA, 20 nt, Brucella suis 1330
cggccaugaagaucaauucc

SEQ ID NO: 2476205 - RNA, 13 nt, Brucella suis 1330
cggccaugcccau

SEQ ID NO: 2476206 - RNA, 17 nt, Brucella suis 1330
cggccaugcguugcugg

SEQ ID NO: 2476207 - RNA, 15 nt, Brucella suis 1330
cggccauuucagguu

SEQ ID NO: 2476208 - RNA, 15 nt, Brucella suis 1330
cggcccgcgcacgcg

SEQ ID NO: 2476209 - RNA, 18 nt, Brucella suis 1330
cggccgcuugcgacaccu

SEQ ID NO: 2476210 - RNA, 13 nt, Brucella suis 1330
cggccgggcaucg

SEQ ID NO: 2476211 - RNA, 18 nt, Brucella suis 1330
cggccgggcggcuugcca

SEQ ID NO: 2476212 - RNA, 21 nt, Brucella suis 1330
cggccggucaagaggaacgac

SEQ ID NO: 2476213 - RNA, 17 nt, Brucella suis 1330
cggccucggcaucgcuc

SEQ ID NO: 2476214 - RNA, 14 nt, Brucella suis 1330
cggccugacggugc

SEQ ID NO: 2476215 - RNA, 19 nt, Brucella suis 1330
cggccuggucuagccgcgc

SEQ ID NO: 2476216 - RNA, 14 nt, Brucella suis 1330
cggccuuugcgccg

SEQ ID NO: 2476217 - RNA, 15 nt, Brucella suis 1330
cggccuuugcgccgg

SEQ ID NO: 2476218 - RNA, 17 nt, Brucella suis 1330
cggccuuugcgccgggu

SEQ ID NO: 2476219 - RNA, 20 nt, Brucella suis 1330
cggccuuugcgccgggucag

SEQ ID NO: 2476220 - RNA, 15 nt, Brucella suis 1330
cggccuuuuugucag

SEQ ID NO: 2476221 - RNA, 17 nt, Brucella suis 1330
cggcgagacagacugga

SEQ ID NO: 2476222 - RNA, 20 nt, Brucella suis 1330
cggcgagcuuguugcggcga

SEQ ID NO: 2476223 - RNA, 19 nt, Brucella suis 1330
cggcgauaccagacgcgca

SEQ ID NO: 2476224 - RNA, 20 nt, Brucella suis 1330
cggcgauaccagacgcgcac

SEQ ID NO: 2476225 - RNA, 17 nt, Brucella suis 1330
cggcgauuuccacgcuc

SEQ ID NO: 2476226 - RNA, 20 nt, Brucella suis 1330
cggcgauuuccacgcucgca

SEQ ID NO: 2476227 - RNA, 18 nt, Brucella suis 1330
cggcgauuucgccgggcu

SEQ ID NO: 2476228 - RNA, 14 nt, Brucella suis 1330
cggcgcaaaggccg

SEQ ID NO: 2476229 - RNA, 19 nt, Brucella suis 1330
cggcgcaaaggccggguuu

SEQ ID NO: 2476230 - RNA, 17 nt, Brucella suis 1330
cggcgcacucaucaaaa

SEQ ID NO: 2476231 - RNA, 23 nt, Brucella suis 1330
cggcgccaccgucaccggcuggg

SEQ ID NO: 2476232 - RNA, 18 nt, Brucella suis 1330
cggcgcgcaaguucgagc

SEQ ID NO: 2476233 - RNA, 13 nt, Brucella suis 1330
cggcgcggcagga

SEQ ID NO: 2476234 - RNA, 16 nt, Brucella suis 1330
cggcgcggcaggaucg

SEQ ID NO: 2476235 - RNA, 11 nt, Brucella suis 1330
cggcgcgggcu

SEQ ID NO: 2476236 - RNA, 13 nt, Brucella suis 1330
cggcgcugcucgc

SEQ ID NO: 2476237 - RNA, 23 nt, Brucella suis 1330
cggcgcuugaugacgccaucuuc

SEQ ID NO: 2476238 - RNA, 22 nt, Brucella suis 1330
cggcggaaacgauuguuuucgg

SEQ ID NO: 2476239 - RNA, 20 nt, Brucella suis 1330
cggcggaaccauggcugcga

SEQ ID NO: 2476240 - RNA, 15 nt, Brucella suis 1330
cggcggcaacgggcg

SEQ ID NO: 2476241 - RNA, 14 nt, Brucella suis 1330
cggcggcaagcgcg

SEQ ID NO: 2476242 - RNA, 10 nt, Brucella suis 1330
cggcggcacc

SEQ ID NO: 2476243 - RNA, 19 nt, Brucella suis 1330
cggcggcauccuugccggu

SEQ ID NO: 2476244 - RNA, 23 nt, Brucella suis 1330
cggcggccuugaugcggcggcgc

SEQ ID NO: 2476245 - RNA, 21 nt, Brucella suis 1330
cggcggcgccaccgucaccgg

SEQ ID NO: 2476246 - RNA, 12 nt, Brucella suis 1330
cggcggcgcggu

SEQ ID NO: 2476247 - RNA, 16 nt, Brucella suis 1330
cggcggcuccagccgg

SEQ ID NO: 2476248 - RNA, 21 nt, Brucella suis 1330
cggcggcuuccucggcggcgc

SEQ ID NO: 2476249 - RNA, 23 nt, Brucella suis 1330
cggcggcuuuccaguacggcgcg

SEQ ID NO: 2476250 - RNA, 15 nt, Brucella suis 1330
cggcgggagcggcac

SEQ ID NO: 2476251 - RNA, 13 nt, Brucella suis 1330
cggcgggcgggcg

SEQ ID NO: 2476252 - RNA, 23 nt, Brucella suis 1330
cggcggugcauucucgcccaagg

SEQ ID NO: 2476253 - RNA, 14 nt, Brucella suis 1330
cggcggugcggauu

SEQ ID NO: 2476254 - RNA, 19 nt, Brucella suis 1330
cggcgguucggcugccuug

SEQ ID NO: 2476255 - RNA, 14 nt, Brucella suis 1330
cggcgguugugcgc

SEQ ID NO: 2476256 - RNA, 15 nt, Brucella suis 1330
cggcgucagcuuguc

SEQ ID NO: 2476257 - RNA, 20 nt, Brucella suis 1330
cggcgucaguggcagcaggc

SEQ ID NO: 2476258 - RNA, 17 nt, Brucella suis 1330
cggcguccauugccggu

SEQ ID NO: 2476259 - RNA, 19 nt, Brucella suis 1330
cggcgucuucuccaaaggg

SEQ ID NO: 2476260 - RNA, 21 nt, Brucella suis 1330
cggcgugaucucgcagguucc

SEQ ID NO: 2476261 - RNA, 18 nt, Brucella suis 1330
cggcgugcaggcugccca

SEQ ID NO: 2476262 - RNA, 15 nt, Brucella suis 1330
cggcguggugcccgc

SEQ ID NO: 2476263 - RNA, 23 nt, Brucella suis 1330
cggcguuaugagcugcaucgcag

SEQ ID NO: 2476264 - RNA, 15 nt, Brucella suis 1330
cggcguuuuccauga

SEQ ID NO: 2476265 - RNA, 16 nt, Brucella suis 1330
cggcucaucgcgcugc

SEQ ID NO: 2476266 - RNA, 14 nt, Brucella suis 1330
cggcuccaccaccu

SEQ ID NO: 2476267 - RNA, 14 nt, Brucella suis 1330
cggcuccagccggu

SEQ ID NO: 2476268 - RNA, 19 nt, Brucella suis 1330
cggcucgccgaguggcccg

SEQ ID NO: 2476269 - RNA, 17 nt, Brucella suis 1330
cggcucgcucgacugga

SEQ ID NO: 2476270 - RNA, 15 nt, Brucella suis 1330
cggcucucacgcgca

SEQ ID NO: 2476271 - RNA, 18 nt, Brucella suis 1330
cggcucucacgcgcagca

SEQ ID NO: 2476272 - RNA, 17 nt, Brucella suis 1330
cggcugccgcaauccug

SEQ ID NO: 2476273 - RNA, 21 nt, Brucella suis 1330
cggcugccuuggcgaucagcg

SEQ ID NO: 2476274 - RNA, 22 nt, Brucella suis 1330
cggcuggaacaauuccagccgg

SEQ ID NO: 2476275 - RNA, 22 nt, Brucella suis 1330
cggcuggaacgagcuccccggc

SEQ ID NO: 2476276 - RNA, 22 nt, Brucella suis 1330
cggcuggaauuguuccagccgg

SEQ ID NO: 2476277 - RNA, 20 nt, Brucella suis 1330
cggcuggauauagaugccgu

SEQ ID NO: 2476278 - RNA, 14 nt, Brucella suis 1330
cggcugggccuugu

SEQ ID NO: 2476279 - RNA, 16 nt, Brucella suis 1330
cggcuggucuggcgag

SEQ ID NO: 2476280 - RNA, 18 nt, Brucella suis 1330
cggcuuccagauugucuu

SEQ ID NO: 2476281 - RNA, 24 nt, Brucella suis 1330
cggcuugccagaugugccaccagc

SEQ ID NO: 2476282 - RNA, 14 nt, Brucella suis 1330
cggcuugccgaccu

SEQ ID NO: 2476283 - RNA, 15 nt, Brucella suis 1330
cggcuuucgccgccc

SEQ ID NO: 2476284 - RNA, 15 nt, Brucella suis 1330
cggcuuuuuauccuc

SEQ ID NO: 2476285 - RNA, 17 nt, Brucella suis 1330
cggcuuuuuauccuccc

SEQ ID NO: 2476286 - RNA, 20 nt, Brucella suis 1330
cggcuuuuuauccucccaug

SEQ ID NO: 2476287 - RNA, 15 nt, Brucella suis 1330
cgggaaaaaucgcgc

SEQ ID NO: 2476288 - RNA, 17 nt, Brucella suis 1330
cgggaaagggccgccuu

SEQ ID NO: 2476289 - RNA, 14 nt, Brucella suis 1330
cgggaaauuucagc

SEQ ID NO: 2476290 - RNA, 17 nt, Brucella suis 1330
cgggaacaauaggcgcg

SEQ ID NO: 2476291 - RNA, 13 nt, Brucella suis 1330
cgggagggaugcu

SEQ ID NO: 2476292 - RNA, 14 nt, Brucella suis 1330
cgggauaagagacc

SEQ ID NO: 2476293 - RNA, 19 nt, Brucella suis 1330
cgggaucaaugaucuggcu

SEQ ID NO: 2476294 - RNA, 22 nt, Brucella suis 1330
cgggaucaaugaucuggcuugc

SEQ ID NO: 2476295 - RNA, 20 nt, Brucella suis 1330
cgggcaaaaucgagugcggc

SEQ ID NO: 2476296 - RNA, 17 nt, Brucella suis 1330
cgggcaaaggcgauggc

SEQ ID NO: 2476297 - RNA, 22 nt, Brucella suis 1330
cgggcaagcauuccgggccgca

SEQ ID NO: 2476298 - RNA, 14 nt, Brucella suis 1330
cgggcaaucgcccg

SEQ ID NO: 2476299 - RNA, 15 nt, Brucella suis 1330
cgggcaauggccgca

SEQ ID NO: 2476300 - RNA, 17 nt, Brucella suis 1330
cgggcagucagcaccgu

SEQ ID NO: 2476301 - RNA, 17 nt, Brucella suis 1330
cgggcagugaaagccgc

SEQ ID NO: 2476302 - RNA, 18 nt, Brucella suis 1330
cgggcagugaaagccgcg

SEQ ID NO: 2476303 - RNA, 21 nt, Brucella suis 1330
cgggcaucgcucgaaggcagc

SEQ ID NO: 2476304 - RNA, 20 nt, Brucella suis 1330
cgggcaugaaaacgccgcgg

SEQ ID NO: 2476305 - RNA, 20 nt, Brucella suis 1330
cgggcauuguggugcgcauc

SEQ ID NO: 2476306 - RNA, 20 nt, Brucella suis 1330
cgggccaacgccggcaccgc

SEQ ID NO: 2476307 - RNA, 22 nt, Brucella suis 1330
cgggccaacgccggcaccgccc

SEQ ID NO: 2476308 - RNA, 18 nt, Brucella suis 1330
cgggccaugccugcgaag

SEQ ID NO: 2476309 - RNA, 12 nt, Brucella suis 1330
cgggcccuucgc

SEQ ID NO: 2476310 - RNA, 20 nt, Brucella suis 1330
cgggccgguggaauagccgg

SEQ ID NO: 2476311 - RNA, 17 nt, Brucella suis 1330
cgggccucgcgcccggu

SEQ ID NO: 2476312 - RNA, 13 nt, Brucella suis 1330
cgggccugugcuu

SEQ ID NO: 2476313 - RNA, 14 nt, Brucella suis 1330
cgggcgagcgccag

SEQ ID NO: 2476314 - RNA, 15 nt, Brucella suis 1330
cgggcgagcgccagc

SEQ ID NO: 2476315 - RNA, 20 nt, Brucella suis 1330
cgggcgaucaucaucaccgg

SEQ ID NO: 2476316 - RNA, 15 nt, Brucella suis 1330
cgggcgcagcgacag

SEQ ID NO: 2476317 - RNA, 20 nt, Brucella suis 1330
cgggcgcagcgacagcggcg

SEQ ID NO: 2476318 - RNA, 13 nt, Brucella suis 1330
cgggcggccagga

SEQ ID NO: 2476319 - RNA, 15 nt, Brucella suis 1330
cgggcggccaggaca

SEQ ID NO: 2476320 - RNA, 16 nt, Brucella suis 1330
cgggcggccaggacaa

SEQ ID NO: 2476321 - RNA, 16 nt, Brucella suis 1330
cgggcuuugccgcaua

SEQ ID NO: 2476322 - RNA, 23 nt, Brucella suis 1330
cgggcuuugccgcauaaagcaca

SEQ ID NO: 2476323 - RNA, 22 nt, Brucella suis 1330
cgggcuuuuuuauucaggauag

SEQ ID NO: 2476324 - RNA, 20 nt, Brucella suis 1330
cggggcaggggugcaaagcu

SEQ ID NO: 2476325 - RNA, 18 nt, Brucella suis 1330
cggggcguccgccaccgc

SEQ ID NO: 2476326 - RNA, 15 nt, Brucella suis 1330
cggggcuuccacagc

SEQ ID NO: 2476327 - RNA, 14 nt, Brucella suis 1330
cgggggaaugcggg

SEQ ID NO: 2476328 - RNA, 19 nt, Brucella suis 1330
cgggguucuucaacugugu

SEQ ID NO: 2476329 - RNA, 23 nt, Brucella suis 1330
cgggguuuuucuuuguccagaaa

SEQ ID NO: 2476330 - RNA, 18 nt, Brucella suis 1330
cgggucguucaccgcaac

SEQ ID NO: 2476331 - RNA, 19 nt, Brucella suis 1330
cgggucuucgcccggcaug

SEQ ID NO: 2476332 - RNA, 18 nt, Brucella suis 1330
cgggugaacuggcaagug

SEQ ID NO: 2476333 - RNA, 18 nt, Brucella suis 1330
cggguggcgcgaaaccgg

SEQ ID NO: 2476334 - RNA, 21 nt, Brucella suis 1330
cggguguuugcgacgggcgag

SEQ ID NO: 2476335 - RNA, 18 nt, Brucella suis 1330
cggguugacgaucaccug

SEQ ID NO: 2476336 - RNA, 14 nt, Brucella suis 1330
cggguugcgcccgg

SEQ ID NO: 2476337 - RNA, 24 nt, Brucella suis 1330
cgguaagcccugucagcgccgccc

SEQ ID NO: 2476338 - RNA, 18 nt, Brucella suis 1330
cgguaagcgaccaccacc

SEQ ID NO: 2476339 - RNA, 22 nt, Brucella suis 1330
cgguaauaacgacgcccgcccc

SEQ ID NO: 2476340 - RNA, 18 nt, Brucella suis 1330
cgguacgccauagacgcc

SEQ ID NO: 2476341 - RNA, 15 nt, Brucella suis 1330
cgguacggaaagggc

SEQ ID NO: 2476342 - RNA, 18 nt, Brucella suis 1330
cgguagcgcauggcagca

SEQ ID NO: 2476343 - RNA, 13 nt, Brucella suis 1330
cgguaucaagcuu

SEQ ID NO: 2476344 - RNA, 22 nt, Brucella suis 1330
cgguaucggcgauauggcgcaa

SEQ ID NO: 2476345 - RNA, 17 nt, Brucella suis 1330
cggucaaaacgccccgg

SEQ ID NO: 2476346 - RNA, 20 nt, Brucella suis 1330
cggucaaaacgccccggcau

SEQ ID NO: 2476347 - RNA, 16 nt, Brucella suis 1330
cggucacgcuccgcca

SEQ ID NO: 2476348 - RNA, 20 nt, Brucella suis 1330
cggucaggcuuuccgacagg

SEQ ID NO: 2476349 - RNA, 15 nt, Brucella suis 1330
cgguccaccacaugc

SEQ ID NO: 2476350 - RNA, 13 nt, Brucella suis 1330
cgguccccgccgc

SEQ ID NO: 2476351 - RNA, 15 nt, Brucella suis 1330
cggucgagccgacau

SEQ ID NO: 2476352 - RNA, 16 nt, Brucella suis 1330
cggucgagugcggcca

SEQ ID NO: 2476353 - RNA, 16 nt, Brucella suis 1330
cggucgccgcccgguu

SEQ ID NO: 2476354 - RNA, 16 nt, Brucella suis 1330
cggucggccgcgcggc

SEQ ID NO: 2476355 - RNA, 17 nt, Brucella suis 1330
cggucggcuugccgacc

SEQ ID NO: 2476356 - RNA, 15 nt, Brucella suis 1330
cggucgucauuuccg

SEQ ID NO: 2476357 - RNA, 18 nt, Brucella suis 1330
cggucguuucgccgcccg

SEQ ID NO: 2476358 - RNA, 23 nt, Brucella suis 1330
cggucucgugugaccuuggccac

SEQ ID NO: 2476359 - RNA, 19 nt, Brucella suis 1330
cggucuucauggcuugaag

SEQ ID NO: 2476360 - RNA, 11 nt, Brucella suis 1330
cggucuugccg

SEQ ID NO: 2476361 - RNA, 16 nt, Brucella suis 1330
cggucuugccggccug

SEQ ID NO: 2476362 - RNA, 13 nt, Brucella suis 1330
cggucuugggauu

SEQ ID NO: 2476363 - RNA, 21 nt, Brucella suis 1330
cggugaagacauggcgggcca

SEQ ID NO: 2476364 - RNA, 24 nt, Brucella suis 1330
cggugcaaugccauccagaucggc

SEQ ID NO: 2476365 - RNA, 13 nt, Brucella suis 1330
cggugccggcagg

SEQ ID NO: 2476366 - RNA, 22 nt, Brucella suis 1330
cggugcgcggaaaauguuccgc

SEQ ID NO: 2476367 - RNA, 16 nt, Brucella suis 1330
cggugcgggcaagggc

SEQ ID NO: 2476368 - RNA, 15 nt, Brucella suis 1330
cggugcuggccgugg

SEQ ID NO: 2476369 - RNA, 14 nt, Brucella suis 1330
cgguggacaugaac

SEQ ID NO: 2476370 - RNA, 14 nt, Brucella suis 1330
cgguggugccgaag

SEQ ID NO: 2476371 - RNA, 20 nt, Brucella suis 1330
cgguucagauugcagcaagc

SEQ ID NO: 2476372 - RNA, 16 nt, Brucella suis 1330
cgguuccuguuuuaac

SEQ ID NO: 2476373 - RNA, 13 nt, Brucella suis 1330
cgguucgccgcuu

SEQ ID NO: 2476374 - RNA, 16 nt, Brucella suis 1330
cgguucuugcggcguu

SEQ ID NO: 2476375 - RNA, 23 nt, Brucella suis 1330
cgguugcaggcgcaggcccugca

SEQ ID NO: 2476376 - RNA, 21 nt, Brucella suis 1330
cgguugcgccaaaacgcagcc

SEQ ID NO: 2476377 - RNA, 13 nt, Brucella suis 1330
cgguuggaacgcc

SEQ ID NO: 2476378 - RNA, 15 nt, Brucella suis 1330
cgguuugcaagccgc

SEQ ID NO: 2476379 - RNA, 23 nt, Brucella suis 1330
cgguuuucaucgcgucagggcga

SEQ ID NO: 2476380 - RNA, 18 nt, Brucella suis 1330
cgguuuuccgucugcauc

SEQ ID NO: 2476381 - RNA, 15 nt, Brucella suis 1330
cgguuuucgccgcaa

SEQ ID NO: 2476382 - RNA, 13 nt, Brucella suis 1330
cgguuuuuccaaa

SEQ ID NO: 2476383 - RNA, 15 nt, Brucella suis 1330
cguaaagcagauggc

SEQ ID NO: 2476384 - RNA, 14 nt, Brucella suis 1330
cguaaagcgcgcca

SEQ ID NO: 2476385 - RNA, 16 nt, Brucella suis 1330
cguaaccgucuugaac

SEQ ID NO: 2476386 - RNA, 16 nt, Brucella suis 1330
cguaagcggcaauccu

SEQ ID NO: 2476387 - RNA, 18 nt, Brucella suis 1330
cguaaucacuugcaagcg

SEQ ID NO: 2476388 - RNA, 20 nt, Brucella suis 1330
cguaaucacuugcaagcgcg

SEQ ID NO: 2476389 - RNA, 21 nt, Brucella suis 1330
cguaaucacuugcaagcgcga

SEQ ID NO: 2476390 - RNA, 18 nt, Brucella suis 1330
cguaauggccucgauggc

SEQ ID NO: 2476391 - RNA, 18 nt, Brucella suis 1330
cguacaccgaggccgcca

SEQ ID NO: 2476392 - RNA, 16 nt, Brucella suis 1330
cguaccgaauccacgu

SEQ ID NO: 2476393 - RNA, 20 nt, Brucella suis 1330
cguaccggcaucagccuucg

SEQ ID NO: 2476394 - RNA, 16 nt, Brucella suis 1330
cguacggcccucgacc

SEQ ID NO: 2476395 - RNA, 17 nt, Brucella suis 1330
cguagaaauagggccag

SEQ ID NO: 2476396 - RNA, 20 nt, Brucella suis 1330
cguauccaggugcagucuuc

SEQ ID NO: 2476397 - RNA, 16 nt, Brucella suis 1330
cguaucgacaccgcca

SEQ ID NO: 2476398 - RNA, 14 nt, Brucella suis 1330
cguaucgccaaaga

SEQ ID NO: 2476399 - RNA, 19 nt, Brucella suis 1330
cguaucgccaaugcccugc

SEQ ID NO: 2476400 - RNA, 19 nt, Brucella suis 1330
cguaucggcggcaagcgcg

SEQ ID NO: 2476401 - RNA, 12 nt, Brucella suis 1330
cguaucuccggg

SEQ ID NO: 2476402 - RNA, 11 nt, Brucella suis 1330
cguaugcgucc

SEQ ID NO: 2476403 - RNA, 13 nt, Brucella suis 1330
cguauuuucgagc

SEQ ID NO: 2476404 - RNA, 15 nt, Brucella suis 1330
cgucaaugcgcgccc

SEQ ID NO: 2476405 - RNA, 21 nt, Brucella suis 1330
cgucacaaaacagacgcccuc

SEQ ID NO: 2476406 - RNA, 15 nt, Brucella suis 1330
cgucacccgccuugc

SEQ ID NO: 2476407 - RNA, 20 nt, Brucella suis 1330
cgucaccggcugggccuugu

SEQ ID NO: 2476408 - RNA, 19 nt, Brucella suis 1330
cgucacgccacggcuuucg

SEQ ID NO: 2476409 - RNA, 15 nt, Brucella suis 1330
cgucacggcgagaca

SEQ ID NO: 2476410 - RNA, 12 nt, Brucella suis 1330
cgucacggucag

SEQ ID NO: 2476411 - RNA, 19 nt, Brucella suis 1330
cgucacggucagaucaucu

SEQ ID NO: 2476412 - RNA, 15 nt, Brucella suis 1330
cgucagcgcaaagcc

SEQ ID NO: 2476413 - RNA, 20 nt, Brucella suis 1330
cgucaggccgaugacggcgc

SEQ ID NO: 2476414 - RNA, 13 nt, Brucella suis 1330
cgucaggcgcauu

SEQ ID NO: 2476415 - RNA, 16 nt, Brucella suis 1330
cgucaguggcagcagg

SEQ ID NO: 2476416 - RNA, 14 nt, Brucella suis 1330
cgucaucaucgucu

SEQ ID NO: 2476417 - RNA, 23 nt, Brucella suis 1330
cgucaucgccaccauggccgccc

SEQ ID NO: 2476418 - RNA, 13 nt, Brucella suis 1330
cgucauucaucag

SEQ ID NO: 2476419 - RNA, 22 nt, Brucella suis 1330
cgucauugaacagguuuccggc

SEQ ID NO: 2476420 - RNA, 16 nt, Brucella suis 1330
cgucauuuccgugacg

SEQ ID NO: 2476421 - RNA, 16 nt, Brucella suis 1330
cguccaccaccucgcc

SEQ ID NO: 2476422 - RNA, 20 nt, Brucella suis 1330
cguccagaagaucgucggca

SEQ ID NO: 2476423 - RNA, 15 nt, Brucella suis 1330
cguccagaucggccu

SEQ ID NO: 2476424 - RNA, 21 nt, Brucella suis 1330
cguccagaucggccuugaucg

SEQ ID NO: 2476425 - RNA, 15 nt, Brucella suis 1330
cguccaugagcgcac

SEQ ID NO: 2476426 - RNA, 19 nt, Brucella suis 1330
cguccaugagcgcaccauu

SEQ ID NO: 2476427 - RNA, 15 nt, Brucella suis 1330
cgucccgcccgucga

SEQ ID NO: 2476428 - RNA, 23 nt, Brucella suis 1330
cgucccgcccgucgaccagcgca

SEQ ID NO: 2476429 - RNA, 18 nt, Brucella suis 1330
cgucccggaagccgccuu

SEQ ID NO: 2476430 - RNA, 20 nt, Brucella suis 1330
cgucccggaagccgccuucc

SEQ ID NO: 2476431 - RNA, 15 nt, Brucella suis 1330
cguccggccagccga

SEQ ID NO: 2476432 - RNA, 19 nt, Brucella suis 1330
cguccggcuucgugcaaac

SEQ ID NO: 2476433 - RNA, 19 nt, Brucella suis 1330
cguccucaugguugaauuc

SEQ ID NO: 2476434 - RNA, 22 nt, Brucella suis 1330
cguccugaugccguuuucauca

SEQ ID NO: 2476435 - RNA, 17 nt, Brucella suis 1330
cguccugugcggcugca

SEQ ID NO: 2476436 - RNA, 17 nt, Brucella suis 1330
cguccuucaggcccuug

SEQ ID NO: 2476437 - RNA, 13 nt, Brucella suis 1330
cguccuucgaggc

SEQ ID NO: 2476438 - RNA, 19 nt, Brucella suis 1330
cguccuuuuuugaucucgg

SEQ ID NO: 2476439 - RNA, 15 nt, Brucella suis 1330
cgucgaccagcgcau

SEQ ID NO: 2476440 - RNA, 22 nt, Brucella suis 1330
cgucgagaagcaucagcuugcc

SEQ ID NO: 2476441 - RNA, 14 nt, Brucella suis 1330
cgucgagcagcauc

SEQ ID NO: 2476442 - RNA, 18 nt, Brucella suis 1330
cgucgauaucgagcgcga

SEQ ID NO: 2476443 - RNA, 20 nt, Brucella suis 1330
cgucgcaccggauuugccaa

SEQ ID NO: 2476444 - RNA, 14 nt, Brucella suis 1330
cgucgcauccagaa

SEQ ID NO: 2476445 - RNA, 20 nt, Brucella suis 1330
cgucgcuaccaugcggccgu

SEQ ID NO: 2476446 - RNA, 18 nt, Brucella suis 1330
cgucggaaaauuccaugc

SEQ ID NO: 2476447 - RNA, 18 nt, Brucella suis 1330
cgucggaaauaucgccga

SEQ ID NO: 2476448 - RNA, 15 nt, Brucella suis 1330
cgucggacuucugcu

SEQ ID NO: 2476449 - RNA, 14 nt, Brucella suis 1330
cgucggauaacgcg

SEQ ID NO: 2476450 - RNA, 22 nt, Brucella suis 1330
cgucggcaaugaucuggcgcgc

SEQ ID NO: 2476451 - RNA, 20 nt, Brucella suis 1330
cgucggccaguucagcggcg

SEQ ID NO: 2476452 - RNA, 17 nt, Brucella suis 1330
cgucgggauggagcgca

SEQ ID NO: 2476453 - RNA, 15 nt, Brucella suis 1330
cgucgugcggccgca

SEQ ID NO: 2476454 - RNA, 21 nt, Brucella suis 1330
cgucgugcggccgcagcccgg

SEQ ID NO: 2476455 - RNA, 17 nt, Brucella suis 1330
cgucugcaucgagcggc

SEQ ID NO: 2476456 - RNA, 22 nt, Brucella suis 1330
cgucugccggagcgaccagcaa

SEQ ID NO: 2476457 - RNA, 23 nt, Brucella suis 1330
cgucuucgcccgacugcacgucu

SEQ ID NO: 2476458 - RNA, 13 nt, Brucella suis 1330
cgucuucggcgca

SEQ ID NO: 2476459 - RNA, 14 nt, Brucella suis 1330
cgucuucuccaaag

SEQ ID NO: 2476460 - RNA, 15 nt, Brucella suis 1330
cgucuugauugcgaa

SEQ ID NO: 2476461 - RNA, 17 nt, Brucella suis 1330
cgugaagccgcuucaac

SEQ ID NO: 2476462 - RNA, 22 nt, Brucella suis 1330
cgugaaucugaggccauuuuga

SEQ ID NO: 2476463 - RNA, 14 nt, Brucella suis 1330
cgugacaucaagcc

SEQ ID NO: 2476464 - RNA, 16 nt, Brucella suis 1330
cgugaccagccccugc

SEQ ID NO: 2476465 - RNA, 14 nt, Brucella suis 1330
cgugacgagcgcac

SEQ ID NO: 2476466 - RNA, 15 nt, Brucella suis 1330
cgugagaccagcgca

SEQ ID NO: 2476467 - RNA, 15 nt, Brucella suis 1330
cgugauauugcagac

SEQ ID NO: 2476468 - RNA, 13 nt, Brucella suis 1330
cgugaugagccgc

SEQ ID NO: 2476469 - RNA, 18 nt, Brucella suis 1330
cgugauuacccaucacgg

SEQ ID NO: 2476470 - RNA, 14 nt, Brucella suis 1330
cgugcagaugcgag

SEQ ID NO: 2476471 - RNA, 14 nt, Brucella suis 1330
cgugcagccugaac

SEQ ID NO: 2476472 - RNA, 21 nt, Brucella suis 1330
cgugccaucggugccugacug

SEQ ID NO: 2476473 - RNA, 13 nt, Brucella suis 1330
cgugccgauuucg

SEQ ID NO: 2476474 - RNA, 20 nt, Brucella suis 1330
cgugccgccgugaaaauaag

SEQ ID NO: 2476475 - RNA, 16 nt, Brucella suis 1330
cgugccggaauggcca

SEQ ID NO: 2476476 - RNA, 19 nt, Brucella suis 1330
cgugccguaauucgacacg

SEQ ID NO: 2476477 - RNA, 15 nt, Brucella suis 1330
cgugccguuuccauc

SEQ ID NO: 2476478 - RNA, 17 nt, Brucella suis 1330
cgugcgauugaugucau

SEQ ID NO: 2476479 - RNA, 15 nt, Brucella suis 1330
cgugcggugcuccca

SEQ ID NO: 2476480 - RNA, 12 nt, Brucella suis 1330
cgugcuccagau

SEQ ID NO: 2476481 - RNA, 14 nt, Brucella suis 1330
cguggacgauucgc

SEQ ID NO: 2476482 - RNA, 16 nt, Brucella suis 1330
cguggagggauaggug

SEQ ID NO: 2476483 - RNA, 19 nt, Brucella suis 1330
cguggaucgacaggcgccu

SEQ ID NO: 2476484 - RNA, 12 nt, Brucella suis 1330
cguggcggggca

SEQ ID NO: 2476485 - RNA, 17 nt, Brucella suis 1330
cguggcgggggcggcgg

SEQ ID NO: 2476486 - RNA, 14 nt, Brucella suis 1330
cguggucaugcgcg

SEQ ID NO: 2476487 - RNA, 21 nt, Brucella suis 1330
cguguagaacauauccgucug

SEQ ID NO: 2476488 - RNA, 15 nt, Brucella suis 1330
cgugucguucucuau

SEQ ID NO: 2476489 - RNA, 14 nt, Brucella suis 1330
cgugucuugcccag

SEQ ID NO: 2476490 - RNA, 13 nt, Brucella suis 1330
cguuacuucggcg

SEQ ID NO: 2476491 - RNA, 14 nt, Brucella suis 1330
cguuaugagcugca

SEQ ID NO: 2476492 - RNA, 16 nt, Brucella suis 1330
cguuaugcucuauuuc

SEQ ID NO: 2476493 - RNA, 12 nt, Brucella suis 1330
cguucagccugc

SEQ ID NO: 2476494 - RNA, 20 nt, Brucella suis 1330
cguuccgccgaucugcacgg

SEQ ID NO: 2476495 - RNA, 22 nt, Brucella suis 1330
cguuccgccucccugcgcgcgc

SEQ ID NO: 2476496 - RNA, 14 nt, Brucella suis 1330
cguuccucuuccuc

SEQ ID NO: 2476497 - RNA, 16 nt, Brucella suis 1330
cguugaagcugucgcc

SEQ ID NO: 2476498 - RNA, 19 nt, Brucella suis 1330
cguugaggcguuccgccuc

SEQ ID NO: 2476499 - RNA, 20 nt, Brucella suis 1330
cguugaggcguuccgccucc

SEQ ID NO: 2476500 - RNA, 18 nt, Brucella suis 1330
cguugcagauauuccuuc

SEQ ID NO: 2476501 - RNA, 14 nt, Brucella suis 1330
cguugcaucggcgg

SEQ ID NO: 2476502 - RNA, 12 nt, Brucella suis 1330
cguugcgccugg

SEQ ID NO: 2476503 - RNA, 12 nt, Brucella suis 1330
cguugcgcggcg

SEQ ID NO: 2476504 - RNA, 13 nt, Brucella suis 1330
cguugcuggaaca

SEQ ID NO: 2476505 - RNA, 22 nt, Brucella suis 1330
cguuggaaaaugcgacaaaaca

SEQ ID NO: 2476506 - RNA, 23 nt, Brucella suis 1330
cguuucgauauccuggccuuccu

SEQ ID NO: 2476507 - RNA, 23 nt, Brucella suis 1330
cguuucgaucugauugaaucaga

SEQ ID NO: 2476508 - RNA, 17 nt, Brucella suis 1330
cguuucgccccguugca

SEQ ID NO: 2476509 - RNA, 17 nt, Brucella suis 1330
cguuucggaauagauga

SEQ ID NO: 2476510 - RNA, 14 nt, Brucella suis 1330
cguuuggagcggcg

SEQ ID NO: 2476511 - RNA, 16 nt, Brucella suis 1330
cuaaagccgcuccauu

SEQ ID NO: 2476512 - RNA, 20 nt, Brucella suis 1330
cuaaaugcaagcgucuucug

SEQ ID NO: 2476513 - RNA, 22 nt, Brucella suis 1330
cuaagcggaaaacggcugcaac

SEQ ID NO: 2476514 - RNA, 14 nt, Brucella suis 1330
cuaauuuuaugcug

SEQ ID NO: 2476515 - RNA, 20 nt, Brucella suis 1330
cuacagccuagacagcagug

SEQ ID NO: 2476516 - RNA, 23 nt, Brucella suis 1330
cuacagccuagacagcagugccu

SEQ ID NO: 2476517 - RNA, 11 nt, Brucella suis 1330
cuaccaucugc

SEQ ID NO: 2476518 - RNA, 18 nt, Brucella suis 1330
cuaccggaggcauccuug

SEQ ID NO: 2476519 - RNA, 20 nt, Brucella suis 1330
cuaccggaggcauccuuguc

SEQ ID NO: 2476520 - RNA, 15 nt, Brucella suis 1330
cuacgcaaaaccgcu

SEQ ID NO: 2476521 - RNA, 13 nt, Brucella suis 1330
cuagacagcagug

SEQ ID NO: 2476522 - RNA, 21 nt, Brucella suis 1330
cuaguggagcaccgcccgucc

SEQ ID NO: 2476523 - RNA, 18 nt, Brucella suis 1330
cuaguggauuggauuuga

SEQ ID NO: 2476524 - RNA, 21 nt, Brucella suis 1330
cuaguggauuggauuugacgu

SEQ ID NO: 2476525 - RNA, 17 nt, Brucella suis 1330
cuaucaacgcugcaaca

SEQ ID NO: 2476526 - RNA, 15 nt, Brucella suis 1330
cuauccugaccguga

SEQ ID NO: 2476527 - RNA, 19 nt, Brucella suis 1330
cuaucguuguugaagagcc

SEQ ID NO: 2476528 - RNA, 14 nt, Brucella suis 1330
cuaugcgccacgag

SEQ ID NO: 2476529 - RNA, 18 nt, Brucella suis 1330
cuauggcacaagaacagc

SEQ ID NO: 2476530 - RNA, 11 nt, Brucella suis 1330
cuauuccccua

SEQ ID NO: 2476531 - RNA, 14 nt, Brucella suis 1330
cuauuccccuauuc

SEQ ID NO: 2476532 - RNA, 14 nt, Brucella suis 1330
cuauuucugaugaa

SEQ ID NO: 2476533 - RNA, 21 nt, Brucella suis 1330
cucaagauacaaaaaaucccg

SEQ ID NO: 2476534 - RNA, 14 nt, Brucella suis 1330
cucaagcaucuuga

SEQ ID NO: 2476535 - RNA, 22 nt, Brucella suis 1330
cucaagugccgccuugcggaua

SEQ ID NO: 2476536 - RNA, 21 nt, Brucella suis 1330
cucacccugaggagccguugg

SEQ ID NO: 2476537 - RNA, 12 nt, Brucella suis 1330
cucaccuuuucc

SEQ ID NO: 2476538 - RNA, 13 nt, Brucella suis 1330
cucaccuuuucca

SEQ ID NO: 2476539 - RNA, 16 nt, Brucella suis 1330
cucacgcgcagcagca

SEQ ID NO: 2476540 - RNA, 14 nt, Brucella suis 1330
cucacggccauagc

SEQ ID NO: 2476541 - RNA, 19 nt, Brucella suis 1330
cucacuccgaccauuuccc

SEQ ID NO: 2476542 - RNA, 13 nt, Brucella suis 1330
cucagagaaguga

SEQ ID NO: 2476543 - RNA, 14 nt, Brucella suis 1330
cucagcguuuucug

SEQ ID NO: 2476544 - RNA, 18 nt, Brucella suis 1330
cucagcuuuuccaucacu

SEQ ID NO: 2476545 - RNA, 23 nt, Brucella suis 1330
cucagcuuuuccaucacuucguc

SEQ ID NO: 2476546 - RNA, 22 nt, Brucella suis 1330
cucaggagauaggggccaaggc

SEQ ID NO: 2476547 - RNA, 12 nt, Brucella suis 1330
cucaggccuugc

SEQ ID NO: 2476548 - RNA, 19 nt, Brucella suis 1330
cucaggccuugcggcggcg

SEQ ID NO: 2476549 - RNA, 21 nt, Brucella suis 1330
cucauaguugaaaagggcaag

SEQ ID NO: 2476550 - RNA, 21 nt, Brucella suis 1330
cucauauggaugccgccgcag

SEQ ID NO: 2476551 - RNA, 22 nt, Brucella suis 1330
cucaucaaaagcgucgcaaugc

SEQ ID NO: 2476552 - RNA, 14 nt, Brucella suis 1330
cucauccacaguca

SEQ ID NO: 2476553 - RNA, 13 nt, Brucella suis 1330
cucauccuccacg

SEQ ID NO: 2476554 - RNA, 22 nt, Brucella suis 1330
cucauccuccacgacgggagcc

SEQ ID NO: 2476555 - RNA, 21 nt, Brucella suis 1330
cucaucgcaguugcaccgccc

SEQ ID NO: 2476556 - RNA, 12 nt, Brucella suis 1330
cucaucgccgga

SEQ ID NO: 2476557 - RNA, 14 nt, Brucella suis 1330
cucaucgcgcugcu

SEQ ID NO: 2476558 - RNA, 17 nt, Brucella suis 1330
cucaugauggcccuugu

SEQ ID NO: 2476559 - RNA, 13 nt, Brucella suis 1330
cucauggcggcgc

SEQ ID NO: 2476560 - RNA, 19 nt, Brucella suis 1330
cucauucggguugccuucg

SEQ ID NO: 2476561 - RNA, 17 nt, Brucella suis 1330
cucauuuggacaaaagc

SEQ ID NO: 2476562 - RNA, 15 nt, Brucella suis 1330
cuccaccagugcggc

SEQ ID NO: 2476563 - RNA, 21 nt, Brucella suis 1330
cuccagauaccgguacuggcc

SEQ ID NO: 2476564 - RNA, 23 nt, Brucella suis 1330
cuccagauaccgguacuggccaa

SEQ ID NO: 2476565 - RNA, 21 nt, Brucella suis 1330
cuccagauugcgggcaagcau

SEQ ID NO: 2476566 - RNA, 17 nt, Brucella suis 1330
cuccagcccuucaucaa

SEQ ID NO: 2476567 - RNA, 13 nt, Brucella suis 1330
cuccagcccuuuc

SEQ ID NO: 2476568 - RNA, 16 nt, Brucella suis 1330
cuccagccgagcgcca

SEQ ID NO: 2476569 - RNA, 13 nt, Brucella suis 1330
cuccaguuccggc

SEQ ID NO: 2476570 - RNA, 12 nt, Brucella suis 1330
cuccaucugcgg

SEQ ID NO: 2476571 - RNA, 17 nt, Brucella suis 1330
cuccaugcggucggccg

SEQ ID NO: 2476572 - RNA, 18 nt, Brucella suis 1330
cuccaugcggucggccgc

SEQ ID NO: 2476573 - RNA, 17 nt, Brucella suis 1330
cucccaaagcgggcgcu

SEQ ID NO: 2476574 - RNA, 21 nt, Brucella suis 1330
cucccgaaagugggaaccggu

SEQ ID NO: 2476575 - RNA, 19 nt, Brucella suis 1330
cucccgaaggauuuuccaa

SEQ ID NO: 2476576 - RNA, 15 nt, Brucella suis 1330
cucccggcacgacca

SEQ ID NO: 2476577 - RNA, 18 nt, Brucella suis 1330
cucccggucuuccugcga

SEQ ID NO: 2476578 - RNA, 17 nt, Brucella suis 1330
cucccucacccugagga

SEQ ID NO: 2476579 - RNA, 22 nt, Brucella suis 1330
cuccgacugugauuugauccau

SEQ ID NO: 2476580 - RNA, 19 nt, Brucella suis 1330
cuccgcaccgaaggcaagc

SEQ ID NO: 2476581 - RNA, 20 nt, Brucella suis 1330
cuccgcaccgaaggcaagca

SEQ ID NO: 2476582 - RNA, 15 nt, Brucella suis 1330
cuccgcaccucagga

SEQ ID NO: 2476583 - RNA, 17 nt, Brucella suis 1330
cuccgcccuggcggcgu

SEQ ID NO: 2476584 - RNA, 20 nt, Brucella suis 1330
cuccggcaaaacggcaggca

SEQ ID NO: 2476585 - RNA, 22 nt, Brucella suis 1330
cuccggcaaaacggcaggcauu

SEQ ID NO: 2476586 - RNA, 14 nt, Brucella suis 1330
cuccggcgcgggcu

SEQ ID NO: 2476587 - RNA, 18 nt, Brucella suis 1330
cuccggguucucgucgau

SEQ ID NO: 2476588 - RNA, 14 nt, Brucella suis 1330
cuccgguucauuuu

SEQ ID NO: 2476589 - RNA, 21 nt, Brucella suis 1330
cuccgguucauuuuuagaaga

SEQ ID NO: 2476590 - RNA, 13 nt, Brucella suis 1330
cuccguaacaauu

SEQ ID NO: 2476591 - RNA, 22 nt, Brucella suis 1330
cuccuaucgugacgacggcuaa

SEQ ID NO: 2476592 - RNA, 17 nt, Brucella suis 1330
cuccucagcuauagccu

SEQ ID NO: 2476593 - RNA, 22 nt, Brucella suis 1330
cuccucagcuauagccugcgcc

SEQ ID NO: 2476594 - RNA, 17 nt, Brucella suis 1330
cuccugcgcccauucaa

SEQ ID NO: 2476595 - RNA, 21 nt, Brucella suis 1330
cuccugcgugcggaagcgauu

SEQ ID NO: 2476596 - RNA, 16 nt, Brucella suis 1330
cuccugugcauugcca

SEQ ID NO: 2476597 - RNA, 19 nt, Brucella suis 1330
cucgaaaaucaccauuuuc

SEQ ID NO: 2476598 - RNA, 15 nt, Brucella suis 1330
cucgaaauagccgac

SEQ ID NO: 2476599 - RNA, 23 nt, Brucella suis 1330
cucgaaauaggucagcaggcgcc

SEQ ID NO: 2476600 - RNA, 21 nt, Brucella suis 1330
cucgaacagguugcgccacca

SEQ ID NO: 2476601 - RNA, 20 nt, Brucella suis 1330
cucgaagaucaaguggcuuu

SEQ ID NO: 2476602 - RNA, 15 nt, Brucella suis 1330
cucgaagucgccagc

SEQ ID NO: 2476603 - RNA, 18 nt, Brucella suis 1330
cucgaauuccaccgccuu

SEQ ID NO: 2476604 - RNA, 16 nt, Brucella suis 1330
cucgaucuggccgaua

SEQ ID NO: 2476605 - RNA, 22 nt, Brucella suis 1330
cucgaucuugcugaugagccgc

SEQ ID NO: 2476606 - RNA, 19 nt, Brucella suis 1330
cucgaucuugucgccgaaa

SEQ ID NO: 2476607 - RNA, 17 nt, Brucella suis 1330
cucgauggccugcacau

SEQ ID NO: 2476608 - RNA, 17 nt, Brucella suis 1330
cucgaugguccagucuu

SEQ ID NO: 2476609 - RNA, 21 nt, Brucella suis 1330
cucgcagcguauucagggaca

SEQ ID NO: 2476610 - RNA, 18 nt, Brucella suis 1330
cucgcauugagcgcccuu

SEQ ID NO: 2476611 - RNA, 21 nt, Brucella suis 1330
cucgcccaccgaagccacgaa

SEQ ID NO: 2476612 - RNA, 15 nt, Brucella suis 1330
cucgcccagaaacaa

SEQ ID NO: 2476613 - RNA, 14 nt, Brucella suis 1330
cucgccggcuucca

SEQ ID NO: 2476614 - RNA, 17 nt, Brucella suis 1330
cucgccguucgccacgu

SEQ ID NO: 2476615 - RNA, 11 nt, Brucella suis 1330
cucgccugcaa

SEQ ID NO: 2476616 - RNA, 12 nt, Brucella suis 1330
cucgccugcaau

SEQ ID NO: 2476617 - RNA, 22 nt, Brucella suis 1330
cucgcgccagagcggcauauug

SEQ ID NO: 2476618 - RNA, 23 nt, Brucella suis 1330
cucggcaaagggaauaccaagcu

SEQ ID NO: 2476619 - RNA, 23 nt, Brucella suis 1330
cucggcccuggaaagaagcgaaa

SEQ ID NO: 2476620 - RNA, 15 nt, Brucella suis 1330
cucggcgaugaagcg

SEQ ID NO: 2476621 - RNA, 18 nt, Brucella suis 1330
cucggcggaagcgacgau

SEQ ID NO: 2476622 - RNA, 18 nt, Brucella suis 1330
cucgguucgcuggccaug

SEQ ID NO: 2476623 - RNA, 21 nt, Brucella suis 1330
cucguccucgaucaaacccuc

SEQ ID NO: 2476624 - RNA, 17 nt, Brucella suis 1330
cucguccuucgaggcuu

SEQ ID NO: 2476625 - RNA, 17 nt, Brucella suis 1330
cucguucugccaguucg

SEQ ID NO: 2476626 - RNA, 12 nt, Brucella suis 1330
cucguuuucaug

SEQ ID NO: 2476627 - RNA, 20 nt, Brucella suis 1330
cucguuuuugacugcugcca

SEQ ID NO: 2476628 - RNA, 19 nt, Brucella suis 1330
cucuauugcccggcgguga

SEQ ID NO: 2476629 - RNA, 15 nt, Brucella suis 1330
cucuauuggaucagu

SEQ ID NO: 2476630 - RNA, 15 nt, Brucella suis 1330
cucucacagccauca

SEQ ID NO: 2476631 - RNA, 13 nt, Brucella suis 1330
cucuccucugccu

SEQ ID NO: 2476632 - RNA, 18 nt, Brucella suis 1330
cucugcaagagcggcguu

SEQ ID NO: 2476633 - RNA, 16 nt, Brucella suis 1330
cucugccuccauggcg

SEQ ID NO: 2476634 - RNA, 17 nt, Brucella suis 1330
cucugcgccagccuugc

SEQ ID NO: 2476635 - RNA, 18 nt, Brucella suis 1330
cucugcggaaagcccggc

SEQ ID NO: 2476636 - RNA, 13 nt, Brucella suis 1330
cucugucagcuuu

SEQ ID NO: 2476637 - RNA, 15 nt, Brucella suis 1330
cucuucauccggcag

SEQ ID NO: 2476638 - RNA, 15 nt, Brucella suis 1330
cucuuccaggagagc

SEQ ID NO: 2476639 - RNA, 18 nt, Brucella suis 1330
cucuugggagcggcgcca

SEQ ID NO: 2476640 - RNA, 22 nt, Brucella suis 1330
cucuuguggugcuugcccaucu

SEQ ID NO: 2476641 - RNA, 13 nt, Brucella suis 1330
cugaaaaggcuca

SEQ ID NO: 2476642 - RNA, 21 nt, Brucella suis 1330
cugaaaccgucacgccacggc

SEQ ID NO: 2476643 - RNA, 21 nt, Brucella suis 1330
cugaaacgggaccaagcccgu

SEQ ID NO: 2476644 - RNA, 16 nt, Brucella suis 1330
cugaaacugaugaugc

SEQ ID NO: 2476645 - RNA, 18 nt, Brucella suis 1330
cugaaacuugugcgugcc

SEQ ID NO: 2476646 - RNA, 20 nt, Brucella suis 1330
cugaaauaauagucgaaaaa

SEQ ID NO: 2476647 - RNA, 11 nt, Brucella suis 1330
cugaagcggcc

SEQ ID NO: 2476648 - RNA, 19 nt, Brucella suis 1330
cugaaguaugggaugaaag

SEQ ID NO: 2476649 - RNA, 17 nt, Brucella suis 1330
cugaauccgcgacgccg

SEQ ID NO: 2476650 - RNA, 18 nt, Brucella suis 1330
cugaauccgcgacgccgc

SEQ ID NO: 2476651 - RNA, 13 nt, Brucella suis 1330
cugaaucuccggc

SEQ ID NO: 2476652 - RNA, 16 nt, Brucella suis 1330
cugaauggucugcgcc

SEQ ID NO: 2476653 - RNA, 18 nt, Brucella suis 1330
cugaccagccuugcccug

SEQ ID NO: 2476654 - RNA, 13 nt, Brucella suis 1330
cugacccauggcc

SEQ ID NO: 2476655 - RNA, 16 nt, Brucella suis 1330
cugacccauggccugc

SEQ ID NO: 2476656 - RNA, 17 nt, Brucella suis 1330
cugaccuuccugaccca

SEQ ID NO: 2476657 - RNA, 17 nt, Brucella suis 1330
cugacgaauaaugaauc

SEQ ID NO: 2476658 - RNA, 13 nt, Brucella suis 1330
cugacgcgcaucu

SEQ ID NO: 2476659 - RNA, 18 nt, Brucella suis 1330
cugacgcgcaucuuaucc

SEQ ID NO: 2476660 - RNA, 20 nt, Brucella suis 1330
cugacggauuucggcggcgu

SEQ ID NO: 2476661 - RNA, 20 nt, Brucella suis 1330
cugacgggaugauugcgcca

SEQ ID NO: 2476662 - RNA, 16 nt, Brucella suis 1330
cugagaucgaugcgcu

SEQ ID NO: 2476663 - RNA, 19 nt, Brucella suis 1330
cugaggcggccggagcgca

SEQ ID NO: 2476664 - RNA, 16 nt, Brucella suis 1330
cugagggauagauggu

SEQ ID NO: 2476665 - RNA, 21 nt, Brucella suis 1330
cugagggguaaauccuccaga

SEQ ID NO: 2476666 - RNA, 23 nt, Brucella suis 1330
cugauaagggcgcuuuucccaau

SEQ ID NO: 2476667 - RNA, 22 nt, Brucella suis 1330
cugauagaaaaacccggucuug

SEQ ID NO: 2476668 - RNA, 15 nt, Brucella suis 1330
cugauagcaaggcgc

SEQ ID NO: 2476669 - RNA, 22 nt, Brucella suis 1330
cugauccagaagccgcuugcau

SEQ ID NO: 2476670 - RNA, 13 nt, Brucella suis 1330
cugauccugcuuc

SEQ ID NO: 2476671 - RNA, 19 nt, Brucella suis 1330
cugaucgagauaagcgcca

SEQ ID NO: 2476672 - RNA, 14 nt, Brucella suis 1330
cugaucguaaagca

SEQ ID NO: 2476673 - RNA, 19 nt, Brucella suis 1330
cugaucguaaagcagaugg

SEQ ID NO: 2476674 - RNA, 16 nt, Brucella suis 1330
cugaucgucaggcgca

SEQ ID NO: 2476675 - RNA, 17 nt, Brucella suis 1330
cugaucuaguggagcac

SEQ ID NO: 2476676 - RNA, 16 nt, Brucella suis 1330
cugaugagccgcuugu

SEQ ID NO: 2476677 - RNA, 12 nt, Brucella suis 1330
cugaugcaaugc

SEQ ID NO: 2476678 - RNA, 22 nt, Brucella suis 1330
cugaugcagcaaagugcaauca

SEQ ID NO: 2476679 - RNA, 19 nt, Brucella suis 1330
cugaugccuugggaggcga

SEQ ID NO: 2476680 - RNA, 15 nt, Brucella suis 1330
cugaugcggauuugg

SEQ ID NO: 2476681 - RNA, 18 nt, Brucella suis 1330
cugcaaaaaauaccagug

SEQ ID NO: 2476682 - RNA, 22 nt, Brucella suis 1330
cugcaacaaaagaagauuucgu

SEQ ID NO: 2476683 - RNA, 14 nt, Brucella suis 1330
cugcaacaaaaugc

SEQ ID NO: 2476684 - RNA, 20 nt, Brucella suis 1330
cugcaacgcgccaaacugca

SEQ ID NO: 2476685 - RNA, 17 nt, Brucella suis 1330
cugcaagauaggcccag

SEQ ID NO: 2476686 - RNA, 23 nt, Brucella suis 1330
cugcaagcgcgacaagcgcaucu

SEQ ID NO: 2476687 - RNA, 13 nt, Brucella suis 1330
cugcacacccuug

SEQ ID NO: 2476688 - RNA, 17 nt, Brucella suis 1330
cugcacacccuugaucg

SEQ ID NO: 2476689 - RNA, 16 nt, Brucella suis 1330
cugcacaucaccauug

SEQ ID NO: 2476690 - RNA, 14 nt, Brucella suis 1330
cugcaccagagcau

SEQ ID NO: 2476691 - RNA, 16 nt, Brucella suis 1330
cugcacgucaucaucg

SEQ ID NO: 2476692 - RNA, 14 nt, Brucella suis 1330
cugcacuugcgcca

SEQ ID NO: 2476693 - RNA, 23 nt, Brucella suis 1330
cugcagcaaucucacacugcaaa

SEQ ID NO: 2476694 - RNA, 20 nt, Brucella suis 1330
cugcaucauaggcccaggcc

SEQ ID NO: 2476695 - RNA, 18 nt, Brucella suis 1330
cugcaucaugucauggcc

SEQ ID NO: 2476696 - RNA, 12 nt, Brucella suis 1330
cugcaucgagcg

SEQ ID NO: 2476697 - RNA, 15 nt, Brucella suis 1330
cugcaucgagcggca

SEQ ID NO: 2476698 - RNA, 17 nt, Brucella suis 1330
cugcaucgagcggcacg

SEQ ID NO: 2476699 - RNA, 19 nt, Brucella suis 1330
cugcaucgagcggcacgau

SEQ ID NO: 2476700 - RNA, 21 nt, Brucella suis 1330
cugcaucggcaaaucaggcag

SEQ ID NO: 2476701 - RNA, 14 nt, Brucella suis 1330
cugcaucgggcgcu

SEQ ID NO: 2476702 - RNA, 12 nt, Brucella suis 1330
cugccaggcauu

SEQ ID NO: 2476703 - RNA, 17 nt, Brucella suis 1330
cugccauccgccccgau

SEQ ID NO: 2476704 - RNA, 18 nt, Brucella suis 1330
cugccaugccgccaaggc

SEQ ID NO: 2476705 - RNA, 15 nt, Brucella suis 1330
cugccauggcaguga

SEQ ID NO: 2476706 - RNA, 18 nt, Brucella suis 1330
cugcccgcacccuauucc

SEQ ID NO: 2476707 - RNA, 13 nt, Brucella suis 1330
cugcccgccgcaa

SEQ ID NO: 2476708 - RNA, 21 nt, Brucella suis 1330
cugcccucguccuucgaggcu

SEQ ID NO: 2476709 - RNA, 16 nt, Brucella suis 1330
cugcccuggauaucuu

SEQ ID NO: 2476710 - RNA, 15 nt, Brucella suis 1330
cugccgcaacaagac

SEQ ID NO: 2476711 - RNA, 16 nt, Brucella suis 1330
cugccgcgaaaaagcc

SEQ ID NO: 2476712 - RNA, 17 nt, Brucella suis 1330
cugccgcgaaaaagccg

SEQ ID NO: 2476713 - RNA, 22 nt, Brucella suis 1330
cugccgcgccgaaccgggccgc

SEQ ID NO: 2476714 - RNA, 16 nt, Brucella suis 1330
cugccggcucaugguc

SEQ ID NO: 2476715 - RNA, 18 nt, Brucella suis 1330
cugccgggguuucuuuug

SEQ ID NO: 2476716 - RNA, 18 nt, Brucella suis 1330
cugccgguauuuugcaac

SEQ ID NO: 2476717 - RNA, 24 nt, Brucella suis 1330
cugccggugcauccucgaaaacaa

SEQ ID NO: 2476718 - RNA, 23 nt, Brucella suis 1330
cugccggugccggcaggcugucc

SEQ ID NO: 2476719 - RNA, 22 nt, Brucella suis 1330
cugccgguucugcauguaguug

SEQ ID NO: 2476720 - RNA, 13 nt, Brucella suis 1330
cugccuccauggc

SEQ ID NO: 2476721 - RNA, 20 nt, Brucella suis 1330
cugccuccauggcgucccca

SEQ ID NO: 2476722 - RNA, 15 nt, Brucella suis 1330
cugccuuacugcccu

SEQ ID NO: 2476723 - RNA, 22 nt, Brucella suis 1330
cugccuuacugcccuauugccu

SEQ ID NO: 2476724 - RNA, 18 nt, Brucella suis 1330
cugccuugcccccacaac

SEQ ID NO: 2476725 - RNA, 17 nt, Brucella suis 1330
cugccuuuagccaagcc

SEQ ID NO: 2476726 - RNA, 15 nt, Brucella suis 1330
cugcgaaaaccugcu

SEQ ID NO: 2476727 - RNA, 17 nt, Brucella suis 1330
cugcgaaagcgccagau

SEQ ID NO: 2476728 - RNA, 21 nt, Brucella suis 1330
cugcgauagugcaucgaucuc

SEQ ID NO: 2476729 - RNA, 15 nt, Brucella suis 1330
cugcgaucugcuucu

SEQ ID NO: 2476730 - RNA, 17 nt, Brucella suis 1330
cugcgcaugggacugga

SEQ ID NO: 2476731 - RNA, 13 nt, Brucella suis 1330
cugcgcccaggcg

SEQ ID NO: 2476732 - RNA, 15 nt, Brucella suis 1330
cugcgcccugucaga

SEQ ID NO: 2476733 - RNA, 13 nt, Brucella suis 1330
cugcgcgaaaucg

SEQ ID NO: 2476734 - RNA, 22 nt, Brucella suis 1330
cugcgcgaaccagauccaccgc

SEQ ID NO: 2476735 - RNA, 22 nt, Brucella suis 1330
cugcgcgcaaaaucuuucgcuu

SEQ ID NO: 2476736 - RNA, 19 nt, Brucella suis 1330
cugcgcguuugauagccuc

SEQ ID NO: 2476737 - RNA, 12 nt, Brucella suis 1330
cugcggcggcgu

SEQ ID NO: 2476738 - RNA, 12 nt, Brucella suis 1330
cugcggcuucug

SEQ ID NO: 2476739 - RNA, 20 nt, Brucella suis 1330
cugcgggccaugguuucggc

SEQ ID NO: 2476740 - RNA, 18 nt, Brucella suis 1330
cugcgguagcgcauggca

SEQ ID NO: 2476741 - RNA, 22 nt, Brucella suis 1330
cugcgguagcgcauggcagcaa

SEQ ID NO: 2476742 - RNA, 19 nt, Brucella suis 1330
cugcgucgcauccagaacu

SEQ ID NO: 2476743 - RNA, 22 nt, Brucella suis 1330
cugcgugauauugcagacacgc

SEQ ID NO: 2476744 - RNA, 20 nt, Brucella suis 1330
cugcguuucggcggcuuucc

SEQ ID NO: 2476745 - RNA, 14 nt, Brucella suis 1330
cugcuaaugcguuu

SEQ ID NO: 2476746 - RNA, 14 nt, Brucella suis 1330
cugcucagaggcuc

SEQ ID NO: 2476747 - RNA, 22 nt, Brucella suis 1330
cugcucggcgcggcguucggca

SEQ ID NO: 2476748 - RNA, 18 nt, Brucella suis 1330
cugcucguccggccagcc

SEQ ID NO: 2476749 - RNA, 16 nt, Brucella suis 1330
cugcugcaauccacag

SEQ ID NO: 2476750 - RNA, 13 nt, Brucella suis 1330
cugcugcgcggca

SEQ ID NO: 2476751 - RNA, 14 nt, Brucella suis 1330
cugcugcgcggcau

SEQ ID NO: 2476752 - RNA, 14 nt, Brucella suis 1330
cugcuggccgucgc

SEQ ID NO: 2476753 - RNA, 23 nt, Brucella suis 1330
cugcuggccgucgcguucagccu

SEQ ID NO: 2476754 - RNA, 15 nt, Brucella suis 1330
cugcuuaucaaggcc

SEQ ID NO: 2476755 - RNA, 13 nt, Brucella suis 1330
cugcuucaucgcg

SEQ ID NO: 2476756 - RNA, 19 nt, Brucella suis 1330
cugcuucaucgcggcagcc

SEQ ID NO: 2476757 - RNA, 14 nt, Brucella suis 1330
cugcuucgaucaga

SEQ ID NO: 2476758 - RNA, 14 nt, Brucella suis 1330
cugcuuugcugggc

SEQ ID NO: 2476759 - RNA, 13 nt, Brucella suis 1330
cuggaaagaagcg

SEQ ID NO: 2476760 - RNA, 20 nt, Brucella suis 1330
cuggaaauauucgggcggca

SEQ ID NO: 2476761 - RNA, 19 nt, Brucella suis 1330
cuggaauuucuaaaaugaa

SEQ ID NO: 2476762 - RNA, 18 nt, Brucella suis 1330
cuggacauaaaccgauga

SEQ ID NO: 2476763 - RNA, 12 nt, Brucella suis 1330
cuggagccgcuc

SEQ ID NO: 2476764 - RNA, 21 nt, Brucella suis 1330
cuggagcuucggauuuuucuc

SEQ ID NO: 2476765 - RNA, 16 nt, Brucella suis 1330
cuggagugcacggcca

SEQ ID NO: 2476766 - RNA, 13 nt, Brucella suis 1330
cuggauaucuucc

SEQ ID NO: 2476767 - RNA, 14 nt, Brucella suis 1330
cuggauccggcgaa

SEQ ID NO: 2476768 - RNA, 15 nt, Brucella suis 1330
cuggaugaucuuugu

SEQ ID NO: 2476769 - RNA, 14 nt, Brucella suis 1330
cuggaugcggaaca

SEQ ID NO: 2476770 - RNA, 16 nt, Brucella suis 1330
cuggcaacgacggcug

SEQ ID NO: 2476771 - RNA, 16 nt, Brucella suis 1330
cuggcacaaagcggcc

SEQ ID NO: 2476772 - RNA, 15 nt, Brucella suis 1330
cuggcacugucgggc

SEQ ID NO: 2476773 - RNA, 18 nt, Brucella suis 1330
cuggcagcaugaucgcca

SEQ ID NO: 2476774 - RNA, 14 nt, Brucella suis 1330
cuggcagcggcagg

SEQ ID NO: 2476775 - RNA, 10 nt, Brucella suis 1330
cuggcaucca

SEQ ID NO: 2476776 - RNA, 19 nt, Brucella suis 1330
cuggcauccagcacuucca

SEQ ID NO: 2476777 - RNA, 21 nt, Brucella suis 1330
cuggcauccagcacuuccaga

SEQ ID NO: 2476778 - RNA, 13 nt, Brucella suis 1330
cuggccaagcguc

SEQ ID NO: 2476779 - RNA, 23 nt, Brucella suis 1330
cuggccaagcgucuugcgcucca

SEQ ID NO: 2476780 - RNA, 21 nt, Brucella suis 1330
cuggccaugaugccggucgca

SEQ ID NO: 2476781 - RNA, 17 nt, Brucella suis 1330
cuggcccucgcggaaaa

SEQ ID NO: 2476782 - RNA, 16 nt, Brucella suis 1330
cuggccggcgccuugu

SEQ ID NO: 2476783 - RNA, 20 nt, Brucella suis 1330
cuggccgucgcguucagccu

SEQ ID NO: 2476784 - RNA, 17 nt, Brucella suis 1330
cuggcgaaaacggccau

SEQ ID NO: 2476785 - RNA, 14 nt, Brucella suis 1330
cuggcgauaaagau

SEQ ID NO: 2476786 - RNA, 14 nt, Brucella suis 1330
cuggcgcagcagca

SEQ ID NO: 2476787 - RNA, 20 nt, Brucella suis 1330
cuggcgcgcgaacgggaaca

SEQ ID NO: 2476788 - RNA, 18 nt, Brucella suis 1330
cuggcgcguaauggccuc

SEQ ID NO: 2476789 - RNA, 19 nt, Brucella suis 1330
cuggcggccaagcgccaga

SEQ ID NO: 2476790 - RNA, 21 nt, Brucella suis 1330
cuggcuccagucgaggcagcc

SEQ ID NO: 2476791 - RNA, 21 nt, Brucella suis 1330
cuggcugagauaaaccggccc

SEQ ID NO: 2476792 - RNA, 15 nt, Brucella suis 1330
cuggcuuucgcgggc

SEQ ID NO: 2476793 - RNA, 16 nt, Brucella suis 1330
cuggcuuuucugacca

SEQ ID NO: 2476794 - RNA, 21 nt, Brucella suis 1330
cugggccuuguuuucugccgg

SEQ ID NO: 2476795 - RNA, 20 nt, Brucella suis 1330
cuggggauacgugcaagagc

SEQ ID NO: 2476796 - RNA, 21 nt, Brucella suis 1330
cugggucauuuuugacaagcc

SEQ ID NO: 2476797 - RNA, 20 nt, Brucella suis 1330
cugggugaauucgggguucu

SEQ ID NO: 2476798 - RNA, 21 nt, Brucella suis 1330
cugggugaauucgggguucuu

SEQ ID NO: 2476799 - RNA, 22 nt, Brucella suis 1330
cuggguucguagcugcuuugcu

SEQ ID NO: 2476800 - RNA, 19 nt, Brucella suis 1330
cuggugcggcugcacacaa

SEQ ID NO: 2476801 - RNA, 16 nt, Brucella suis 1330
cugguuuaagccuugg

SEQ ID NO: 2476802 - RNA, 17 nt, Brucella suis 1330
cugguuuuucaccaucu

SEQ ID NO: 2476803 - RNA, 22 nt, Brucella suis 1330
cuguaaacugccgcguccggca

SEQ ID NO: 2476804 - RNA, 15 nt, Brucella suis 1330
cuguaaccgccaccu

SEQ ID NO: 2476805 - RNA, 16 nt, Brucella suis 1330
cuguaaggccugcugg

SEQ ID NO: 2476806 - RNA, 19 nt, Brucella suis 1330
cuguagaaaauauagccgc

SEQ ID NO: 2476807 - RNA, 14 nt, Brucella suis 1330
cugucaccgccagc

SEQ ID NO: 2476808 - RNA, 17 nt, Brucella suis 1330
cugucacgaucuugccg

SEQ ID NO: 2476809 - RNA, 16 nt, Brucella suis 1330
cugucagcgccgccca

SEQ ID NO: 2476810 - RNA, 18 nt, Brucella suis 1330
cugucagcgccgcccagg

SEQ ID NO: 2476811 - RNA, 20 nt, Brucella suis 1330
cugucagcuuuccggcuucc

SEQ ID NO: 2476812 - RNA, 20 nt, Brucella suis 1330
cugucauuugcggcaguucc

SEQ ID NO: 2476813 - RNA, 16 nt, Brucella suis 1330
cuguccgccugccaug

SEQ ID NO: 2476814 - RNA, 21 nt, Brucella suis 1330
cuguccggccagcuugaaaag

SEQ ID NO: 2476815 - RNA, 12 nt, Brucella suis 1330
cuguccugccag

SEQ ID NO: 2476816 - RNA, 17 nt, Brucella suis 1330
cuguccugccagcggca

SEQ ID NO: 2476817 - RNA, 21 nt, Brucella suis 1330
cuguccugccagcggcagacc

SEQ ID NO: 2476818 - RNA, 20 nt, Brucella suis 1330
cuguccuuguuccagucgcc

SEQ ID NO: 2476819 - RNA, 19 nt, Brucella suis 1330
cugucgaaauaaugccaag

SEQ ID NO: 2476820 - RNA, 16 nt, Brucella suis 1330
cugucgaaugucuucg

SEQ ID NO: 2476821 - RNA, 21 nt, Brucella suis 1330
cugucgauaaauccgacgggc

SEQ ID NO: 2476822 - RNA, 15 nt, Brucella suis 1330
cugucgccagcgccg

SEQ ID NO: 2476823 - RNA, 17 nt, Brucella suis 1330
cugucgccagcgccggu

SEQ ID NO: 2476824 - RNA, 16 nt, Brucella suis 1330
cugucgcccagaaccg

SEQ ID NO: 2476825 - RNA, 17 nt, Brucella suis 1330
cugucggcaaacaucca

SEQ ID NO: 2476826 - RNA, 11 nt, Brucella suis 1330
cugucggcgcu

SEQ ID NO: 2476827 - RNA, 20 nt, Brucella suis 1330
cugucggcgcugcucgcgca

SEQ ID NO: 2476828 - RNA, 16 nt, Brucella suis 1330
cugucgggcucaggcu

SEQ ID NO: 2476829 - RNA, 20 nt, Brucella suis 1330
cugugacgacaaccacgcuu

SEQ ID NO: 2476830 - RNA, 14 nt, Brucella suis 1330
cugugacugcggca

SEQ ID NO: 2476831 - RNA, 13 nt, Brucella suis 1330
cugugcggcggcg

SEQ ID NO: 2476832 - RNA, 18 nt, Brucella suis 1330
cugugcguaccgaaucca

SEQ ID NO: 2476833 - RNA, 15 nt, Brucella suis 1330
cugugucacgcagcg

SEQ ID NO: 2476834 - RNA, 18 nt, Brucella suis 1330
cuguuaucccucaaaacg

SEQ ID NO: 2476835 - RNA, 23 nt, Brucella suis 1330
cuguucaauaagcuuuucauuuu

SEQ ID NO: 2476836 - RNA, 14 nt, Brucella suis 1330
cuguucagccgcag

SEQ ID NO: 2476837 - RNA, 18 nt, Brucella suis 1330
cuguucauaggcuuucau

SEQ ID NO: 2476838 - RNA, 21 nt, Brucella suis 1330
cuguugaggcgaaugaucuug

SEQ ID NO: 2476839 - RNA, 20 nt, Brucella suis 1330
cuguuucgaggcccaggccc

SEQ ID NO: 2476840 - RNA, 12 nt, Brucella suis 1330
cuguuuucgagg

SEQ ID NO: 2476841 - RNA, 12 nt, Brucella suis 1330
cuuaacauacug

SEQ ID NO: 2476842 - RNA, 18 nt, Brucella suis 1330
cuuaaucccuuacuccau

SEQ ID NO: 2476843 - RNA, 20 nt, Brucella suis 1330
cuuaauugcuuuccugcaca

SEQ ID NO: 2476844 - RNA, 20 nt, Brucella suis 1330
cuuacugcccuauugccuua

SEQ ID NO: 2476845 - RNA, 22 nt, Brucella suis 1330
cuuauaggagcgugucuugccc

SEQ ID NO: 2476846 - RNA, 22 nt, Brucella suis 1330
cuuaugaucgccgcccuuguga

SEQ ID NO: 2476847 - RNA, 11 nt, Brucella suis 1330
cuuaugccaga

SEQ ID NO: 2476848 - RNA, 14 nt, Brucella suis 1330
cuuaugugaagauu

SEQ ID NO: 2476849 - RNA, 12 nt, Brucella suis 1330
cuuauuccccua

SEQ ID NO: 2476850 - RNA, 18 nt, Brucella suis 1330
cuucaauuuucccggcaa

SEQ ID NO: 2476851 - RNA, 15 nt, Brucella suis 1330
cuucacauccuucac

SEQ ID NO: 2476852 - RNA, 16 nt, Brucella suis 1330
cuucacauccuucacu

SEQ ID NO: 2476853 - RNA, 18 nt, Brucella suis 1330
cuucacaugcuugccgac

SEQ ID NO: 2476854 - RNA, 14 nt, Brucella suis 1330
cuucaccagccuug

SEQ ID NO: 2476855 - RNA, 16 nt, Brucella suis 1330
cuucaccagccuugag

SEQ ID NO: 2476856 - RNA, 18 nt, Brucella suis 1330
cuucaccugagcaagagc

SEQ ID NO: 2476857 - RNA, 19 nt, Brucella suis 1330
cuucagaucgcgcggcgaa

SEQ ID NO: 2476858 - RNA, 15 nt, Brucella suis 1330
cuucaggcccuugcc

SEQ ID NO: 2476859 - RNA, 20 nt, Brucella suis 1330
cuucaggccgucgaucagcu

SEQ ID NO: 2476860 - RNA, 19 nt, Brucella suis 1330
cuucaggcgcgaggcggcu

SEQ ID NO: 2476861 - RNA, 19 nt, Brucella suis 1330
cuucagggacgagcggcag

SEQ ID NO: 2476862 - RNA, 23 nt, Brucella suis 1330
cuucagggacgagcggcaggccg

SEQ ID NO: 2476863 - RNA, 18 nt, Brucella suis 1330
cuucauagaccccgccug

SEQ ID NO: 2476864 - RNA, 17 nt, Brucella suis 1330
cuucaugauggaagaca

SEQ ID NO: 2476865 - RNA, 17 nt, Brucella suis 1330
cuucauucaaucugcau

SEQ ID NO: 2476866 - RNA, 18 nt, Brucella suis 1330
cuucauugcgcuugccgc

SEQ ID NO: 2476867 - RNA, 13 nt, Brucella suis 1330
cuuccagagccuc

SEQ ID NO: 2476868 - RNA, 19 nt, Brucella suis 1330
cuuccagagcggguuccca

SEQ ID NO: 2476869 - RNA, 23 nt, Brucella suis 1330
cuuccagauagauaaacgcacca

SEQ ID NO: 2476870 - RNA, 22 nt, Brucella suis 1330
cuuccaggagagccuuugcuuc

SEQ ID NO: 2476871 - RNA, 16 nt, Brucella suis 1330
cuuccaguuucugaau

SEQ ID NO: 2476872 - RNA, 13 nt, Brucella suis 1330
cuucccgcaauuc

SEQ ID NO: 2476873 - RNA, 12 nt, Brucella suis 1330
cuucccgcccgu

SEQ ID NO: 2476874 - RNA, 21 nt, Brucella suis 1330
cuucccgcgccucacccucca

SEQ ID NO: 2476875 - RNA, 15 nt, Brucella suis 1330
cuucccguaauuccc

SEQ ID NO: 2476876 - RNA, 19 nt, Brucella suis 1330
cuuccgaaaaccgcuucag

SEQ ID NO: 2476877 - RNA, 20 nt, Brucella suis 1330
cuuccgacccgucaaugcca

SEQ ID NO: 2476878 - RNA, 22 nt, Brucella suis 1330
cuuccgacccgucaaugccauc

SEQ ID NO: 2476879 - RNA, 15 nt, Brucella suis 1330
cuuccggcugcuuuc

SEQ ID NO: 2476880 - RNA, 16 nt, Brucella suis 1330
cuuccgggcaauaucg

SEQ ID NO: 2476881 - RNA, 17 nt, Brucella suis 1330
cuuccgucgcacgcuug

SEQ ID NO: 2476882 - RNA, 21 nt, Brucella suis 1330
cuuccgucgcacgcuuggccu

SEQ ID NO: 2476883 - RNA, 22 nt, Brucella suis 1330
cuuccuaauggaugacgccugc

SEQ ID NO: 2476884 - RNA, 14 nt, Brucella suis 1330
cuuccucacccuuc

SEQ ID NO: 2476885 - RNA, 15 nt, Brucella suis 1330
cuuccucguccuuga

SEQ ID NO: 2476886 - RNA, 16 nt, Brucella suis 1330
cuuccugacccauggc

SEQ ID NO: 2476887 - RNA, 19 nt, Brucella suis 1330
cuuccugccuuugaagaca

SEQ ID NO: 2476888 - RNA, 20 nt, Brucella suis 1330
cuuccugcgaaaaccugcuc

SEQ ID NO: 2476889 - RNA, 18 nt, Brucella suis 1330
cuucgacugaacauggaa

SEQ ID NO: 2476890 - RNA, 20 nt, Brucella suis 1330
cuucgacugaacauggaaaa

SEQ ID NO: 2476891 - RNA, 14 nt, Brucella suis 1330
cuucgagcaggcgg

SEQ ID NO: 2476892 - RNA, 16 nt, Brucella suis 1330
cuucgaguucgccagc

SEQ ID NO: 2476893 - RNA, 16 nt, Brucella suis 1330
cuucgaucauuuccuu

SEQ ID NO: 2476894 - RNA, 13 nt, Brucella suis 1330
cuucgccaagccc

SEQ ID NO: 2476895 - RNA, 18 nt, Brucella suis 1330
cuucgccaagcccuucca

SEQ ID NO: 2476896 - RNA, 20 nt, Brucella suis 1330
cuucgccaagcccuuccacu

SEQ ID NO: 2476897 - RNA, 13 nt, Brucella suis 1330
cuucgcccggcau

SEQ ID NO: 2476898 - RNA, 15 nt, Brucella suis 1330
cuucgccgagauggg

SEQ ID NO: 2476899 - RNA, 17 nt, Brucella suis 1330
cuucgcgaacaugcgcc

SEQ ID NO: 2476900 - RNA, 19 nt, Brucella suis 1330
cuucgcgcaggccgcggca

SEQ ID NO: 2476901 - RNA, 13 nt, Brucella suis 1330
cuucggagcgcgu

SEQ ID NO: 2476902 - RNA, 22 nt, Brucella suis 1330
cuucggcauaggcuucggccgc

SEQ ID NO: 2476903 - RNA, 19 nt, Brucella suis 1330
cuucggccgacagaugcgc

SEQ ID NO: 2476904 - RNA, 16 nt, Brucella suis 1330
cuucgguaaagccgcg

SEQ ID NO: 2476905 - RNA, 17 nt, Brucella suis 1330
cuucguguccggcguca

SEQ ID NO: 2476906 - RNA, 12 nt, Brucella suis 1330
cuucucccaaag

SEQ ID NO: 2476907 - RNA, 12 nt, Brucella suis 1330
cuucuguugcag

SEQ ID NO: 2476908 - RNA, 15 nt, Brucella suis 1330
cuucuugccuucauc

SEQ ID NO: 2476909 - RNA, 20 nt, Brucella suis 1330
cuucuugguuucuucggccc

SEQ ID NO: 2476910 - RNA, 21 nt, Brucella suis 1330
cuucuugguuucuucggccca

SEQ ID NO: 2476911 - RNA, 18 nt, Brucella suis 1330
cuugaagucaucaccgcg

SEQ ID NO: 2476912 - RNA, 23 nt, Brucella suis 1330
cuugaauagcggcgaguugccac

SEQ ID NO: 2476913 - RNA, 14 nt, Brucella suis 1330
cuugaccuggccag

SEQ ID NO: 2476914 - RNA, 23 nt, Brucella suis 1330
cuugagauauccauaucuuucca

SEQ ID NO: 2476915 - RNA, 17 nt, Brucella suis 1330
cuugaggccgcgcgcgc

SEQ ID NO: 2476916 - RNA, 22 nt, Brucella suis 1330
cuugagggcagcggucacagaa

SEQ ID NO: 2476917 - RNA, 16 nt, Brucella suis 1330
cuugagguugagcugc

SEQ ID NO: 2476918 - RNA, 16 nt, Brucella suis 1330
cuugauagggcaauug

SEQ ID NO: 2476919 - RNA, 20 nt, Brucella suis 1330
cuugaucgaaugguucuuca

SEQ ID NO: 2476920 - RNA, 12 nt, Brucella suis 1330
cuugaucgagcc

SEQ ID NO: 2476921 - RNA, 12 nt, Brucella suis 1330
cuugaugcccag

SEQ ID NO: 2476922 - RNA, 14 nt, Brucella suis 1330
cuugaugcccagcu

SEQ ID NO: 2476923 - RNA, 19 nt, Brucella suis 1330
cuugaugccugcaugggca

SEQ ID NO: 2476924 - RNA, 16 nt, Brucella suis 1330
cuugaugcggcggcgc

SEQ ID NO: 2476925 - RNA, 19 nt, Brucella suis 1330
cuugauguccggcgcgcug

SEQ ID NO: 2476926 - RNA, 16 nt, Brucella suis 1330
cuugcaaugagcgcgc

SEQ ID NO: 2476927 - RNA, 23 nt, Brucella suis 1330
cuugcauuauuuagauuugcuua

SEQ ID NO: 2476928 - RNA, 21 nt, Brucella suis 1330
cuugcauucgcucgaagaguu

SEQ ID NO: 2476929 - RNA, 19 nt, Brucella suis 1330
cuugccaaaaugauuucgc

SEQ ID NO: 2476930 - RNA, 16 nt, Brucella suis 1330
cuugccaacauggcug

SEQ ID NO: 2476931 - RNA, 21 nt, Brucella suis 1330
cuugccaccacgauggaagga

SEQ ID NO: 2476932 - RNA, 20 nt, Brucella suis 1330
cuugccauuuuccguggcgc

SEQ ID NO: 2476933 - RNA, 15 nt, Brucella suis 1330
cuugcccagaacauc

SEQ ID NO: 2476934 - RNA, 17 nt, Brucella suis 1330
cuugccccggcaccgcg

SEQ ID NO: 2476935 - RNA, 11 nt, Brucella suis 1330
cuugcccgcau

SEQ ID NO: 2476936 - RNA, 18 nt, Brucella suis 1330
cuugcccgcauauugcuu

SEQ ID NO: 2476937 - RNA, 16 nt, Brucella suis 1330
cuugcccucgccgccg

SEQ ID NO: 2476938 - RNA, 15 nt, Brucella suis 1330
cuugccgaaaagccg

SEQ ID NO: 2476939 - RNA, 16 nt, Brucella suis 1330
cuugccgaaaagccgc

SEQ ID NO: 2476940 - RNA, 16 nt, Brucella suis 1330
cuugccgaccuccccc

SEQ ID NO: 2476941 - RNA, 14 nt, Brucella suis 1330
cuugccgccgcuuc

SEQ ID NO: 2476942 - RNA, 14 nt, Brucella suis 1330
cuugccgcguccuu

SEQ ID NO: 2476943 - RNA, 15 nt, Brucella suis 1330
cuugccggccugaaa

SEQ ID NO: 2476944 - RNA, 23 nt, Brucella suis 1330
cuugccguuggcauccacucggc

SEQ ID NO: 2476945 - RNA, 19 nt, Brucella suis 1330
cuugccuucuugcacaguu

SEQ ID NO: 2476946 - RNA, 17 nt, Brucella suis 1330
cuugcgauuuccuugcc

SEQ ID NO: 2476947 - RNA, 19 nt, Brucella suis 1330
cuugcgauuuccuugccgc

SEQ ID NO: 2476948 - RNA, 14 nt, Brucella suis 1330
cuugcgauuugaca

SEQ ID NO: 2476949 - RNA, 14 nt, Brucella suis 1330
cuugcgcagcgccg

SEQ ID NO: 2476950 - RNA, 14 nt, Brucella suis 1330
cuugcgccaaucgc

SEQ ID NO: 2476951 - RNA, 20 nt, Brucella suis 1330
cuugcgccaaucgccgcgau

SEQ ID NO: 2476952 - RNA, 18 nt, Brucella suis 1330
cuugcgcccuccaccgcu

SEQ ID NO: 2476953 - RNA, 15 nt, Brucella suis 1330
cuugcggcacugucg

SEQ ID NO: 2476954 - RNA, 13 nt, Brucella suis 1330
cuugcggcggcgu

SEQ ID NO: 2476955 - RNA, 22 nt, Brucella suis 1330
cuugcgguugcaacgacauaga

SEQ ID NO: 2476956 - RNA, 23 nt, Brucella suis 1330
cuugcucauggcuuccugcgucu

SEQ ID NO: 2476957 - RNA, 20 nt, Brucella suis 1330
cuugcuguaaccgccaccuu

SEQ ID NO: 2476958 - RNA, 19 nt, Brucella suis 1330
cuugcuucgcaccuuccac

SEQ ID NO: 2476959 - RNA, 19 nt, Brucella suis 1330
cuugcuugaagcaaggcgg

SEQ ID NO: 2476960 - RNA, 15 nt, Brucella suis 1330
cuugcuugccauucu

SEQ ID NO: 2476961 - RNA, 14 nt, Brucella suis 1330
cuugcuuugcccuu

SEQ ID NO: 2476962 - RNA, 23 nt, Brucella suis 1330
cuuggaacguacaccgaggccgc

SEQ ID NO: 2476963 - RNA, 17 nt, Brucella suis 1330
cuuggcaauauauacac

SEQ ID NO: 2476964 - RNA, 12 nt, Brucella suis 1330
cuuggcaccgcc

SEQ ID NO: 2476965 - RNA, 22 nt, Brucella suis 1330
cuuggcaucaaccuuuucggca

SEQ ID NO: 2476966 - RNA, 14 nt, Brucella suis 1330
cuuggcgacggcca

SEQ ID NO: 2476967 - RNA, 17 nt, Brucella suis 1330
cuuggcgacggccacau

SEQ ID NO: 2476968 - RNA, 23 nt, Brucella suis 1330
cuuggcuuccagcgucaggacaa

SEQ ID NO: 2476969 - RNA, 14 nt, Brucella suis 1330
cuuguccaccaccu

SEQ ID NO: 2476970 - RNA, 22 nt, Brucella suis 1330
cuuguccaccaccugcccgcac

SEQ ID NO: 2476971 - RNA, 17 nt, Brucella suis 1330
cuugucgaaggaucgaa

SEQ ID NO: 2476972 - RNA, 16 nt, Brucella suis 1330
cuugucgucgugcagc

SEQ ID NO: 2476973 - RNA, 18 nt, Brucella suis 1330
cuugucgucgugcagcgg

SEQ ID NO: 2476974 - RNA, 18 nt, Brucella suis 1330
cuuguguuucaccagaug

SEQ ID NO: 2476975 - RNA, 20 nt, Brucella suis 1330
cuuguguuucaccagaugcu

SEQ ID NO: 2476976 - RNA, 13 nt, Brucella suis 1330
cuuguucggcuuu

SEQ ID NO: 2476977 - RNA, 17 nt, Brucella suis 1330
cuuguugaaagaaaaga

SEQ ID NO: 2476978 - RNA, 19 nt, Brucella suis 1330
cuuuaaaagcauauugaag

SEQ ID NO: 2476979 - RNA, 16 nt, Brucella suis 1330
cuuuaccgcaacccag

SEQ ID NO: 2476980 - RNA, 16 nt, Brucella suis 1330
cuuuauagaggaacuc

SEQ ID NO: 2476981 - RNA, 16 nt, Brucella suis 1330
cuuuauggcucagaga

SEQ ID NO: 2476982 - RNA, 21 nt, Brucella suis 1330
cuuuauucaaccguuuccuga

SEQ ID NO: 2476983 - RNA, 16 nt, Brucella suis 1330
cuuucagcgcagugga

SEQ ID NO: 2476984 - RNA, 12 nt, Brucella suis 1330
cuuuccagaagg

SEQ ID NO: 2476985 - RNA, 21 nt, Brucella suis 1330
cuuuccagcccccuugccgcu

SEQ ID NO: 2476986 - RNA, 19 nt, Brucella suis 1330
cuuuccauccagucgauca

SEQ ID NO: 2476987 - RNA, 14 nt, Brucella suis 1330
cuuuccggcuucca

SEQ ID NO: 2476988 - RNA, 22 nt, Brucella suis 1330
cuuucgccgggguuucuucauu

SEQ ID NO: 2476989 - RNA, 23 nt, Brucella suis 1330
cuuucgcuuccguaucuccgggc

SEQ ID NO: 2476990 - RNA, 19 nt, Brucella suis 1330
cuuucggcggcaguuucac

SEQ ID NO: 2476991 - RNA, 14 nt, Brucella suis 1330
cuuucggucaggaa

SEQ ID NO: 2476992 - RNA, 20 nt, Brucella suis 1330
cuuucugccaggagaugagg

SEQ ID NO: 2476993 - RNA, 18 nt, Brucella suis 1330
cuuucugcuucuguugca

SEQ ID NO: 2476994 - RNA, 15 nt, Brucella suis 1330
cuuucuggacaaaga

SEQ ID NO: 2476995 - RNA, 16 nt, Brucella suis 1330
cuuucuggacaaagaa

SEQ ID NO: 2476996 - RNA, 18 nt, Brucella suis 1330
cuuucuguccggccagcu

SEQ ID NO: 2476997 - RNA, 15 nt, Brucella suis 1330
cuuugaccgccgcga

SEQ ID NO: 2476998 - RNA, 22 nt, Brucella suis 1330
cuuugcccuggggcaugacauc

SEQ ID NO: 2476999 - RNA, 14 nt, Brucella suis 1330
cuuugccgcgcgaa

SEQ ID NO: 2477000 - RNA, 18 nt, Brucella suis 1330
cuuugccgucuucgauca

SEQ ID NO: 2477001 - RNA, 20 nt, Brucella suis 1330
cuuugcggaggcggcugccu

SEQ ID NO: 2477002 - RNA, 20 nt, Brucella suis 1330
cuuugcggggccugaaugca

SEQ ID NO: 2477003 - RNA, 20 nt, Brucella suis 1330
cuuuggccgucucugaagua

SEQ ID NO: 2477004 - RNA, 15 nt, Brucella suis 1330
cuuuguauuucaaug

SEQ ID NO: 2477005 - RNA, 19 nt, Brucella suis 1330
cuuuguauuucaaugcugc

SEQ ID NO: 2477006 - RNA, 20 nt, Brucella suis 1330
cuuuguauuucaaugcugca

SEQ ID NO: 2477007 - RNA, 17 nt, Brucella suis 1330
cuuugucacgccggcau

SEQ ID NO: 2477008 - RNA, 14 nt, Brucella suis 1330
cuuugugccgccgc

SEQ ID NO: 2477009 - RNA, 16 nt, Brucella suis 1330
cuuuucauucugaaug

SEQ ID NO: 2477010 - RNA, 15 nt, Brucella suis 1330
cuuuuccaccggccc

SEQ ID NO: 2477011 - RNA, 15 nt, Brucella suis 1330
cuuuuccgcaaaaau

SEQ ID NO: 2477012 - RNA, 14 nt, Brucella suis 1330
cuuuucggcaagga

SEQ ID NO: 2477013 - RNA, 21 nt, Brucella suis 1330
cuuuucggcaaggaugcugcc

SEQ ID NO: 2477014 - RNA, 16 nt, Brucella suis 1330
cuuuucggcgaaagcc

SEQ ID NO: 2477015 - RNA, 15 nt, Brucella suis 1330
cuuuucggcggaaag

SEQ ID NO: 2477016 - RNA, 17 nt, Brucella suis 1330
cuuuucggcuuccuugc

SEQ ID NO: 2477017 - RNA, 13 nt, Brucella suis 1330
cuuuucuucaucc

SEQ ID NO: 2477018 - RNA, 17 nt, Brucella suis 1330
cuuuugcuggaaaugcu

SEQ ID NO: 2477019 - RNA, 23 nt, Brucella suis 1330
cuuuugcuggaaaugcucuagaa

SEQ ID NO: 2477020 - RNA, 16 nt, Brucella suis 1330
cuuuuguuuucaaagc

SEQ ID NO: 2477021 - RNA, 13 nt, Brucella suis 1330
gaaaaacccgguc

SEQ ID NO: 2477022 - RNA, 14 nt, Brucella suis 1330
gaaaaacccggucu

SEQ ID NO: 2477023 - RNA, 15 nt, Brucella suis 1330
gaaaaagcccgccac

SEQ ID NO: 2477024 - RNA, 14 nt, Brucella suis 1330
gaaaacgaggccga

SEQ ID NO: 2477025 - RNA, 18 nt, Brucella suis 1330
gaaaacgccgaagccagg

SEQ ID NO: 2477026 - RNA, 16 nt, Brucella suis 1330
gaaaacggcugcaaca

SEQ ID NO: 2477027 - RNA, 17 nt, Brucella suis 1330
gaaaacggcugcaacaa

SEQ ID NO: 2477028 - RNA, 18 nt, Brucella suis 1330
gaaaacggcugcaacaaa

SEQ ID NO: 2477029 - RNA, 20 nt, Brucella suis 1330
gaaaacggcugcaacaaaag

SEQ ID NO: 2477030 - RNA, 22 nt, Brucella suis 1330
gaaaacggcugcaacaaaagaa

SEQ ID NO: 2477031 - RNA, 17 nt, Brucella suis 1330
gaaaagcaggaucaggg

SEQ ID NO: 2477032 - RNA, 15 nt, Brucella suis 1330
gaaaagccccauguu

SEQ ID NO: 2477033 - RNA, 15 nt, Brucella suis 1330
gaaaagccggagcau

SEQ ID NO: 2477034 - RNA, 17 nt, Brucella suis 1330
gaaaagccggagcauuc

SEQ ID NO: 2477035 - RNA, 19 nt, Brucella suis 1330
gaaaaggcucaaucgccgc

SEQ ID NO: 2477036 - RNA, 22 nt, Brucella suis 1330
gaaaaggcuggccaugcgggca

SEQ ID NO: 2477037 - RNA, 16 nt, Brucella suis 1330
gaaaagugcgaagcgc

SEQ ID NO: 2477038 - RNA, 22 nt, Brucella suis 1330
gaaaauauagccgccugccuuc

SEQ ID NO: 2477039 - RNA, 12 nt, Brucella suis 1330
gaaaaucuugau

SEQ ID NO: 2477040 - RNA, 21 nt, Brucella suis 1330
gaaaaugcccggcgcgaugag

SEQ ID NO: 2477041 - RNA, 18 nt, Brucella suis 1330
gaaaauuguggccgauga

SEQ ID NO: 2477042 - RNA, 14 nt, Brucella suis 1330
aaaacgccgcggcg

SEQ ID NO: 2477043 - RNA, 14 nt, Brucella suis 1330
aaaacggcccauga

SEQ ID NO: 2477044 - RNA, 20 nt, Brucella suis 1330
aaaacggcccaugagcuuca

SEQ ID NO: 2477045 - RNA, 21 nt, Brucella suis 1330
aaaacggcugcaacaaaagaa

SEQ ID NO: 2477046 - RNA, 19 nt, Brucella suis 1330
aaaagaaaaagcccggucu

SEQ ID NO: 2477047 - RNA, 20 nt, Brucella suis 1330
aaaagcccgccacgaggaag

SEQ ID NO: 2477048 - RNA, 19 nt, Brucella suis 1330
aaaagcggcgucagcaggu

SEQ ID NO: 2477049 - RNA, 23 nt, Brucella suis 1330
aaaagcggcgucagcagguugac

SEQ ID NO: 2477050 - RNA, 19 nt, Brucella suis 1330
aaaagcgucgcaaugccga

SEQ ID NO: 2477051 - RNA, 17 nt, Brucella suis 1330
aaaaggaugaaugccga

SEQ ID NO: 2477052 - RNA, 18 nt, Brucella suis 1330
aaaaggaugaaugccgaa

SEQ ID NO: 2477053 - RNA, 18 nt, Brucella suis 1330
aaaaggccgggaaaaccg

SEQ ID NO: 2477054 - RNA, 22 nt, Brucella suis 1330
aaaaggccuuccgcgucggaaa

SEQ ID NO: 2477055 - RNA, 15 nt, Brucella suis 1330
aaaaggcgcaaugug

SEQ ID NO: 2477056 - RNA, 14 nt, Brucella suis 1330
aaaaguccuuuccg

SEQ ID NO: 2477057 - RNA, 23 nt, Brucella suis 1330
aaaagugagaaacgguuuugcgu

SEQ ID NO: 2477058 - RNA, 14 nt, Brucella suis 1330
aaaagugcgaagcg

SEQ ID NO: 2477059 - RNA, 16 nt, Brucella suis 1330
aaaauaguccaguagc

SEQ ID NO: 2477060 - RNA, 16 nt, Brucella suis 1330
aaaauaucaaagcgcu

SEQ ID NO: 2477061 - RNA, 18 nt, Brucella suis 1330
aaaaucaccauuuucgca

SEQ ID NO: 2477062 - RNA, 14 nt, Brucella suis 1330
aaaauccgcaaugg

SEQ ID NO: 2477063 - RNA, 18 nt, Brucella suis 1330
aaaaucgagggguuuuuc

SEQ ID NO: 2477064 - RNA, 19 nt, Brucella suis 1330
aaaaucucgguuaucauuu

SEQ ID NO: 2477065 - RNA, 18 nt, Brucella suis 1330
aaaaucuguucacauuuc

SEQ ID NO: 2477066 - RNA, 20 nt, Brucella suis 1330
aaaaugcucuaggaaaacuu

SEQ ID NO: 2477067 - RNA, 11 nt, Brucella suis 1330
aaaauggaauc

SEQ ID NO: 2477068 - RNA, 13 nt, Brucella suis 1330
aaaauggcccugu

SEQ ID NO: 2477069 - RNA, 20 nt, Brucella suis 1330
aaaauggcgcuagcgaugau

SEQ ID NO: 2477070 - RNA, 17 nt, Brucella suis 1330
aaaaugggcugauuuag

SEQ ID NO: 2477071 - RNA, 16 nt, Brucella suis 1330
aaaccaucgagcauuu

SEQ ID NO: 2477072 - RNA, 16 nt, Brucella suis 1330
aaaccauggagcgcau

SEQ ID NO: 2477073 - RNA, 12 nt, Brucella suis 1330
aaacccgaccag

SEQ ID NO: 2477074 - RNA, 22 nt, Brucella suis 1330
aaacccgaccaguaaggcgggc

SEQ ID NO: 2477075 - RNA, 22 nt, Brucella suis 1330
aaacccggccuuugcgccgggu

SEQ ID NO: 2477076 - RNA, 18 nt, Brucella suis 1330
aaacccggcgcaaaggcc

SEQ ID NO: 2477077 - RNA, 22 nt, Brucella suis 1330
aaaccgcuucgcacuuuugcug

SEQ ID NO: 2477078 - RNA, 15 nt, Brucella suis 1330
aaaccggcuggcuuu

SEQ ID NO: 2477079 - RNA, 14 nt, Brucella suis 1330
aaaccguuucacac

SEQ ID NO: 2477080 - RNA, 20 nt, Brucella suis 1330
aaaccucgggcagggucaaa

SEQ ID NO: 2477081 - RNA, 22 nt, Brucella suis 1330
aaacgaacgccugauugaucgu

SEQ ID NO: 2477082 - RNA, 20 nt, Brucella suis 1330
aaacgauuguuuucggcaug

SEQ ID NO: 2477083 - RNA, 15 nt, Brucella suis 1330
aaacgauuuucgcca

SEQ ID NO: 2477084 - RNA, 20 nt, Brucella suis 1330
aaacgccccgccaaaaagca

SEQ ID NO: 2477085 - RNA, 16 nt, Brucella suis 1330
aaacgcugccagccgc

SEQ ID NO: 2477086 - RNA, 22 nt, Brucella suis 1330
aaacgcugcugauagcagccgc

SEQ ID NO: 2477087 - RNA, 22 nt, Brucella suis 1330
aaacgcuuuccggcaaaaaacu

SEQ ID NO: 2477088 - RNA, 17 nt, Brucella suis 1330
aaacggaaacguugaaa

SEQ ID NO: 2477089 - RNA, 14 nt, Brucella suis 1330
aaacggcugcaaca

SEQ ID NO: 2477090 - RNA, 19 nt, Brucella suis 1330
aaacggcugcaacaaaaga

SEQ ID NO: 2477091 - RNA, 20 nt, Brucella suis 1330
aaacgggucguucaccgcaa

SEQ ID NO: 2477092 - RNA, 14 nt, Brucella suis 1330
aaacgguuuucgga

SEQ ID NO: 2477093 - RNA, 22 nt, Brucella suis 1330
aaacgguuuucggaaaagaugc

SEQ ID NO: 2477094 - RNA, 19 nt, Brucella suis 1330
aaagaauucccggcugagc

SEQ ID NO: 2477095 - RNA, 17 nt, Brucella suis 1330
aaagaccagcaggaaga

SEQ ID NO: 2477096 - RNA, 20 nt, Brucella suis 1330
aaagagccauuauucuccca

SEQ ID NO: 2477097 - RNA, 17 nt, Brucella suis 1330
aaagaguuggcccgcgu

SEQ ID NO: 2477098 - RNA, 15 nt, Brucella suis 1330
aaagaguuguagcgg

SEQ ID NO: 2477099 - RNA, 16 nt, Brucella suis 1330
aaagaucagccagccg

SEQ ID NO: 2477100 - RNA, 22 nt, Brucella suis 1330
aaagauccuucacauauugugc

SEQ ID NO: 2477101 - RNA, 18 nt, Brucella suis 1330
aaagaucugcaucccgaa

SEQ ID NO: 2477102 - RNA, 18 nt, Brucella suis 1330
aaagaugcgcgccagccg

SEQ ID NO: 2477103 - RNA, 19 nt, Brucella suis 1330
aaagaugcgcgccagccgc

SEQ ID NO: 2477104 - RNA, 23 nt, Brucella suis 1330
aaagaugcgcgucaaaacaaagg

SEQ ID NO: 2477105 - RNA, 20 nt, Brucella suis 1330
aaagcacagccagaaagaag

SEQ ID NO: 2477106 - RNA, 16 nt, Brucella suis 1330
aaagcaggaucggcag

SEQ ID NO: 2477107 - RNA, 13 nt, Brucella suis 1330
aaagcauaucuuc

SEQ ID NO: 2477108 - RNA, 19 nt, Brucella suis 1330
aaagccagaaccaccagag

SEQ ID NO: 2477109 - RNA, 23 nt, Brucella suis 1330
aaagcccagccguuuugcgccca

SEQ ID NO: 2477110 - RNA, 13 nt, Brucella suis 1330
aaagcccggauga

SEQ ID NO: 2477111 - RNA, 18 nt, Brucella suis 1330
aaagccugcuacaaaaaa

SEQ ID NO: 2477112 - RNA, 22 nt, Brucella suis 1330
aaagccuguccuuguuccaguc

SEQ ID NO: 2477113 - RNA, 11 nt, Brucella suis 1330
aaagcgaacgc

SEQ ID NO: 2477114 - RNA, 20 nt, Brucella suis 1330
aaagcgccagauucagggca

SEQ ID NO: 2477115 - RNA, 23 nt, Brucella suis 1330
aaagcgcggagcaacaccccgcg

SEQ ID NO: 2477116 - RNA, 17 nt, Brucella suis 1330
aaagcgggcgcuccagc

SEQ ID NO: 2477117 - RNA, 18 nt, Brucella suis 1330
aaagcucgcgucccgcac

SEQ ID NO: 2477118 - RNA, 21 nt, Brucella suis 1330
aaagcugccgcgaaaaagccg

SEQ ID NO: 2477119 - RNA, 12 nt, Brucella suis 1330
aaagcuggauga

SEQ ID NO: 2477120 - RNA, 23 nt, Brucella suis 1330
aaagcuggcauccagcacuucca

SEQ ID NO: 2477121 - RNA, 15 nt, Brucella suis 1330
aaaggaugacggcuu

SEQ ID NO: 2477122 - RNA, 16 nt, Brucella suis 1330
aaaggauucgaaccuc

SEQ ID NO: 2477123 - RNA, 20 nt, Brucella suis 1330
aaaggcaaagccgaaugcca

SEQ ID NO: 2477124 - RNA, 18 nt, Brucella suis 1330
aaaggccuccguaacaau

SEQ ID NO: 2477125 - RNA, 19 nt, Brucella suis 1330
aaaggccuccguaacaauu

SEQ ID NO: 2477126 - RNA, 23 nt, Brucella suis 1330
aaaggcgauggcuugcggcacug

SEQ ID NO: 2477127 - RNA, 15 nt, Brucella suis 1330
aaaggcuccggcauu

SEQ ID NO: 2477128 - RNA, 18 nt, Brucella suis 1330
aaaggcucuauuuuucca

SEQ ID NO: 2477129 - RNA, 22 nt, Brucella suis 1330
aaaggcucuauuuuuccacgaa

SEQ ID NO: 2477130 - RNA, 13 nt, Brucella suis 1330
aaagggaauacca

SEQ ID NO: 2477131 - RNA, 19 nt, Brucella suis 1330
aaagggccgccuugcuuga

SEQ ID NO: 2477132 - RNA, 21 nt, Brucella suis 1330
aaagggugcgagcaggcuuuc

SEQ ID NO: 2477133 - RNA, 17 nt, Brucella suis 1330
aaaggucgggugccaga

SEQ ID NO: 2477134 - RNA, 19 nt, Brucella suis 1330
aaauaauagucgaaaaaag

SEQ ID NO: 2477135 - RNA, 22 nt, Brucella suis 1330
aaauagggccagacauagaccu

SEQ ID NO: 2477136 - RNA, 14 nt, Brucella suis 1330
aaaucaaccucgcg

SEQ ID NO: 2477137 - RNA, 17 nt, Brucella suis 1330
aaaucaaccucgcggca

SEQ ID NO: 2477138 - RNA, 14 nt, Brucella suis 1330
aaaucaguccacug

SEQ ID NO: 2477139 - RNA, 19 nt, Brucella suis 1330
aaaucaguccacuggacug

SEQ ID NO: 2477140 - RNA, 18 nt, Brucella suis 1330
aaaucgagugcggccugc

SEQ ID NO: 2477141 - RNA, 17 nt, Brucella suis 1330
aaaugcaccgccugcca

SEQ ID NO: 2477142 - RNA, 19 nt, Brucella suis 1330
aaaugccauggaacagaca

SEQ ID NO: 2477143 - RNA, 19 nt, Brucella suis 1330
aaaugcccuuccuuaucga

SEQ ID NO: 2477144 - RNA, 20 nt, Brucella suis 1330
aaaugcgaauucagagcgau

SEQ ID NO: 2477145 - RNA, 12 nt, Brucella suis 1330
aaaugcgcgcgg

SEQ ID NO: 2477146 - RNA, 14 nt, Brucella suis 1330
aaaugcgcgcggca

SEQ ID NO: 2477147 - RNA, 20 nt, Brucella suis 1330
aaaugcuccuuccugcggca

SEQ ID NO: 2477148 - RNA, 23 nt, Brucella suis 1330
aaauggugcugccauggcaguga

SEQ ID NO: 2477149 - RNA, 13 nt, Brucella suis 1330
aaauugcacauga

SEQ ID NO: 2477150 - RNA, 15 nt, Brucella suis 1330
aaauugcuccagcca

SEQ ID NO: 2477151 - RNA, 13 nt, Brucella suis 1330
aacaaaagaagau

SEQ ID NO: 2477152 - RNA, 15 nt, Brucella suis 1330
aacaaaagaagauuu

SEQ ID NO: 2477153 - RNA, 13 nt, Brucella suis 1330
aacaacgggguug

SEQ ID NO: 2477154 - RNA, 19 nt, Brucella suis 1330
aacaacgggguugagguuc

SEQ ID NO: 2477155 - RNA, 17 nt, Brucella suis 1330
aacaagcagaugcagcg

SEQ ID NO: 2477156 - RNA, 17 nt, Brucella suis 1330
aacaccguggacgucgu

SEQ ID NO: 2477157 - RNA, 13 nt, Brucella suis 1330
aacacgagagcgu

SEQ ID NO: 2477158 - RNA, 14 nt, Brucella suis 1330
aagcauauugaagu

SEQ ID NO: 2477159 - RNA, 15 nt, Brucella suis 1330
aagcaucagcuugcc

SEQ ID NO: 2477160 - RNA, 24 nt, Brucella suis 1330
aagcaucugcucaaaacgauccag

SEQ ID NO: 2477161 - RNA, 23 nt, Brucella suis 1330
aagccacgcuccacacgaacagc

SEQ ID NO: 2477162 - RNA, 12 nt, Brucella suis 1330
aagccacggcga

SEQ ID NO: 2477163 - RNA, 15 nt, Brucella suis 1330
aagccaguccuugcc

SEQ ID NO: 2477164 - RNA, 19 nt, Brucella suis 1330
aagccaucuuucuugaagu

SEQ ID NO: 2477165 - RNA, 21 nt, Brucella suis 1330
aagcccaagaaagaucagcca

SEQ ID NO: 2477166 - RNA, 15 nt, Brucella suis 1330
aagcccagcgccuuc

SEQ ID NO: 2477167 - RNA, 13 nt, Brucella suis 1330
aagccccgcccau

SEQ ID NO: 2477168 - RNA, 21 nt, Brucella suis 1330
aagcccgccacgaggaagaaa

SEQ ID NO: 2477169 - RNA, 12 nt, Brucella suis 1330
aagcccgccgau

SEQ ID NO: 2477170 - RNA, 23 nt, Brucella suis 1330
aagcccggcgauuucgccgggcu

SEQ ID NO: 2477171 - RNA, 16 nt, Brucella suis 1330
aagcccggcuggaaca

SEQ ID NO: 2477172 - RNA, 23 nt, Brucella suis 1330
aagcccuuccacugcaaggaagg

SEQ ID NO: 2477173 - RNA, 14 nt, Brucella suis 1330
aagccgaagaacag

SEQ ID NO: 2477174 - RNA, 15 nt, Brucella suis 1330
aagccgaaugccagu

SEQ ID NO: 2477175 - RNA, 23 nt, Brucella suis 1330
aagccggcgcagcgcgaccucau

SEQ ID NO: 2477176 - RNA, 23 nt, Brucella suis 1330
aagccugcuacaaaaaacaacag

SEQ ID NO: 2477177 - RNA, 19 nt, Brucella suis 1330
aagccuuuucgauaacgaa

SEQ ID NO: 2477178 - RNA, 16 nt, Brucella suis 1330
aagcgaacgcacugca

SEQ ID NO: 2477179 - RNA, 22 nt, Brucella suis 1330
aagcgaagaacagaagcaccag

SEQ ID NO: 2477180 - RNA, 13 nt, Brucella suis 1330
aagcgaagauccc

SEQ ID NO: 2477181 - RNA, 13 nt, Brucella suis 1330
aagcgcaaaacag

SEQ ID NO: 2477182 - RNA, 14 nt, Brucella suis 1330
aagcgcaaaacagc

SEQ ID NO: 2477183 - RNA, 21 nt, Brucella suis 1330
aagcgcaaagcccgccgaaga

SEQ ID NO: 2477184 - RNA, 12 nt, Brucella suis 1330
aagcgccagaga

SEQ ID NO: 2477185 - RNA, 14 nt, Brucella suis 1330
aagcgccagcuucc

SEQ ID NO: 2477186 - RNA, 21 nt, Brucella suis 1330
aagcgccgguucggucccguc

SEQ ID NO: 2477187 - RNA, 22 nt, Brucella suis 1330
aagcgccuacgcagggaaauca

SEQ ID NO: 2477188 - RNA, 22 nt, Brucella suis 1330
aagcgcgccaucggcacggcgu

SEQ ID NO: 2477189 - RNA, 15 nt, Brucella suis 1330
aagcgcgccgaaaau

SEQ ID NO: 2477190 - RNA, 14 nt, Brucella suis 1330
aagcgcucagcuuu

SEQ ID NO: 2477191 - RNA, 16 nt, Brucella suis 1330
aagcggauuugaggau

SEQ ID NO: 2477192 - RNA, 18 nt, Brucella suis 1330
aagcggccuaccauaucc

SEQ ID NO: 2477193 - RNA, 15 nt, Brucella suis 1330
aagcggccuuugauc

SEQ ID NO: 2477194 - RNA, 20 nt, Brucella suis 1330
aagcggcgucagcagguuga

SEQ ID NO: 2477195 - RNA, 19 nt, Brucella suis 1330
aagcggcuuuccagcgggc

SEQ ID NO: 2477196 - RNA, 18 nt, Brucella suis 1330
aagcgggaucagaaauca

SEQ ID NO: 2477197 - RNA, 21 nt, Brucella suis 1330
aagcgggccuuuuucaugcug

SEQ ID NO: 2477198 - RNA, 18 nt, Brucella suis 1330
aagcgguuccuguuuuaa

SEQ ID NO: 2477199 - RNA, 21 nt, Brucella suis 1330
aagcgguucgugaagccgcuu

SEQ ID NO: 2477200 - RNA, 18 nt, Brucella suis 1330
aagcgugagaccagcgca

SEQ ID NO: 2477201 - RNA, 14 nt, Brucella suis 1330
aagcgugagcuuca

SEQ ID NO: 2477202 - RNA, 23 nt, Brucella suis 1330
aagcucgacccagcuaaggccgg

SEQ ID NO: 2477203 - RNA, 14 nt, Brucella suis 1330
aagcucgcgucccg

SEQ ID NO: 2477204 - RNA, 19 nt, Brucella suis 1330
aagcucgcgucccgcacgc

SEQ ID NO: 2477205 - RNA, 15 nt, Brucella suis 1330
aagcuggaaggccag

SEQ ID NO: 2477206 - RNA, 13 nt, Brucella suis 1330
aagcugucguucc

SEQ ID NO: 2477207 - RNA, 17 nt, Brucella suis 1330
aagcuugaucgccgcac

SEQ ID NO: 2477208 - RNA, 13 nt, Brucella suis 1330
aaggaaaaaaccg

SEQ ID NO: 2477209 - RNA, 20 nt, Brucella suis 1330
aaggaaaaaaccggcgauga

SEQ ID NO: 2477210 - RNA, 23 nt, Brucella suis 1330
aaggaaaagcuggcauccagcac

SEQ ID NO: 2477211 - RNA, 16 nt, Brucella suis 1330
aaggaaggucagaaga

SEQ ID NO: 2477212 - RNA, 23 nt, Brucella suis 1330
aaggaucgaagggcugagggaaa

SEQ ID NO: 2477213 - RNA, 16 nt, Brucella suis 1330
aaggauuuccuguccc

SEQ ID NO: 2477214 - RNA, 22 nt, Brucella suis 1330
aaggauuuccugucccuucuug

SEQ ID NO: 2477215 - RNA, 13 nt, Brucella suis 1330
aaggcaagcccca

SEQ ID NO: 2477216 - RNA, 17 nt, Brucella suis 1330
aaggcaagccccagcac

SEQ ID NO: 2477217 - RNA, 16 nt, Brucella suis 1330
aaggccauuucauuau

SEQ ID NO: 2477218 - RNA, 20 nt, Brucella suis 1330
aaggcccccagaaggcgcgg

SEQ ID NO: 2477219 - RNA, 21 nt, Brucella suis 1330
aaggccgauggcgaucacgaa

SEQ ID NO: 2477220 - RNA, 18 nt, Brucella suis 1330
aaggccgcgccgaucauc

SEQ ID NO: 2477221 - RNA, 15 nt, Brucella suis 1330
aaggccggguuuuuc

SEQ ID NO: 2477222 - RNA, 14 nt, Brucella suis 1330
aaggcgaagccgaa

SEQ ID NO: 2477223 - RNA, 12 nt, Brucella suis 1330
aaggcgaucagg

SEQ ID NO: 2477224 - RNA, 17 nt, Brucella suis 1330
aaggcgaucagguugau

SEQ ID NO: 2477225 - RNA, 15 nt, Brucella suis 1330
aaggcgggaaggcaa

SEQ ID NO: 2477226 - RNA, 16 nt, Brucella suis 1330
aaggcgggaaggcaau

SEQ ID NO: 2477227 - RNA, 14 nt, Brucella suis 1330
aaggcguuggccgc

SEQ ID NO: 2477228 - RNA, 23 nt, Brucella suis 1330
aaggcucggcaaagggaauacca

SEQ ID NO: 2477229 - RNA, 22 nt, Brucella suis 1330
aaggcucugcgccagccuugcg

SEQ ID NO: 2477230 - RNA, 20 nt, Brucella suis 1330
aagggcaggaggccaaaaag

SEQ ID NO: 2477231 - RNA, 18 nt, Brucella suis 1330
aagggccggucgugccag

SEQ ID NO: 2477232 - RNA, 13 nt, Brucella suis 1330
aagggcgccagcg

SEQ ID NO: 2477233 - RNA, 17 nt, Brucella suis 1330
aagggcgcggugccgga

SEQ ID NO: 2477234 - RNA, 20 nt, Brucella suis 1330
aagggcggcuuucgccgccc

SEQ ID NO: 2477235 - RNA, 16 nt, Brucella suis 1330
aagguauuugauguuu

SEQ ID NO: 2477236 - RNA, 13 nt, Brucella suis 1330
aaggucgaacaug

SEQ ID NO: 2477237 - RNA, 23 nt, Brucella suis 1330
aaggucuuccgggacaaucuugc

SEQ ID NO: 2477238 - RNA, 18 nt, Brucella suis 1330
aagguguaggugccgaga

SEQ ID NO: 2477239 - RNA, 22 nt, Brucella suis 1330
aagguuacuugcgcuuugcaag

SEQ ID NO: 2477240 - RNA, 17 nt, Brucella suis 1330
aagugaucucggccugg

SEQ ID NO: 2477241 - RNA, 15 nt, Brucella suis 1330
aagugcauaaucggc

SEQ ID NO: 2477242 - RNA, 15 nt, Brucella suis 1330
aagugcauaugauga

SEQ ID NO: 2477243 - RNA, 23 nt, Brucella suis 1330
aagugccgcgccgaugaggccgg

SEQ ID NO: 2477244 - RNA, 10 nt, Brucella suis 1330
aagugcugcu

SEQ ID NO: 2477245 - RNA, 13 nt, Brucella suis 1330
aagugcugcugca

SEQ ID NO: 2477246 - RNA, 19 nt, Brucella suis 1330
aagugggaaccgguuuucg

SEQ ID NO: 2477247 - RNA, 19 nt, Brucella suis 1330
aagugucguugacacgcuu

SEQ ID NO: 2477248 - RNA, 16 nt, Brucella suis 1330
aagugugcgcgcgcca

SEQ ID NO: 2477249 - RNA, 11 nt, Brucella suis 1330
aauaaagccau

SEQ ID NO: 2477250 - RNA, 14 nt, Brucella suis 1330
aauaagcugauaaa

SEQ ID NO: 2477251 - RNA, 17 nt, Brucella suis 1330
aauaagcuuuucauuuu

SEQ ID NO: 2477252 - RNA, 17 nt, Brucella suis 1330
aauaaugcagcgccgcg

SEQ ID NO: 2477253 - RNA, 13 nt, Brucella suis 1330
aauaaugccaagu

SEQ ID NO: 2477254 - RNA, 19 nt, Brucella suis 1330
aauaauugucaggaaaaau

SEQ ID NO: 2477255 - RNA, 17 nt, Brucella suis 1330
aauagaugagcugguuu

SEQ ID NO: 2477256 - RNA, 13 nt, Brucella suis 1330
aauagauuguggc

SEQ ID NO: 2477257 - RNA, 13 nt, Brucella suis 1330
aauagcauggccc

SEQ ID NO: 2477258 - RNA, 14 nt, Brucella suis 1330
aauagcauggcccc

SEQ ID NO: 2477259 - RNA, 11 nt, Brucella suis 1330
aauagccgaga

SEQ ID NO: 2477260 - RNA, 19 nt, Brucella suis 1330
aauagccggucgagccgac

SEQ ID NO: 2477261 - RNA, 20 nt, Brucella suis 1330
aauagcgcuuggaacguaca

SEQ ID NO: 2477262 - RNA, 17 nt, Brucella suis 1330
aauagcuuaugcgcgcc

SEQ ID NO: 2477263 - RNA, 18 nt, Brucella suis 1330
aauagggaaacggccagg

SEQ ID NO: 2477264 - RNA, 15 nt, Brucella suis 1330
aauagucaguuccug

SEQ ID NO: 2477265 - RNA, 14 nt, Brucella suis 1330
aauagucgaaaaaa

SEQ ID NO: 2477266 - RNA, 18 nt, Brucella suis 1330
aauagucgaaaaaagaau

SEQ ID NO: 2477267 - RNA, 18 nt, Brucella suis 1330
aauauagccgaugcagau

SEQ ID NO: 2477268 - RNA, 20 nt, Brucella suis 1330
aauauagccgaugcagaugc

SEQ ID NO: 2477269 - RNA, 19 nt, Brucella suis 1330
aauaucuuuuuucaaagag

SEQ ID NO: 2477270 - RNA, 20 nt, Brucella suis 1330
aauaugcgccuugcgccgca

SEQ ID NO: 2477271 - RNA, 13 nt, Brucella suis 1330
aaucaaaaacaau

SEQ ID NO: 2477272 - RNA, 15 nt, Brucella suis 1330
aaucaccagagacag

SEQ ID NO: 2477273 - RNA, 19 nt, Brucella suis 1330
aaucacgccacugcccugg

SEQ ID NO: 2477274 - RNA, 15 nt, Brucella suis 1330
aaucagaucgaaacc

SEQ ID NO: 2477275 - RNA, 20 nt, Brucella suis 1330
acagagcgggcaaaggcgau

SEQ ID NO: 2477276 - RNA, 20 nt, Brucella suis 1330
acagaucaugaggacauuca

SEQ ID NO: 2477277 - RNA, 17 nt, Brucella suis 1330
acagaugcgggacuugc

SEQ ID NO: 2477278 - RNA, 16 nt, Brucella suis 1330
acagcaguaccgacau

SEQ ID NO: 2477279 - RNA, 21 nt, Brucella suis 1330
acagcauauugccgagcaugg

SEQ ID NO: 2477280 - RNA, 20 nt, Brucella suis 1330
acagccagaaagaagaugag

SEQ ID NO: 2477281 - RNA, 19 nt, Brucella suis 1330
acagccccgcaauaacgaa

SEQ ID NO: 2477282 - RNA, 20 nt, Brucella suis 1330
acagccccgcaauaacgaau

SEQ ID NO: 2477283 - RNA, 22 nt, Brucella suis 1330
acagccgguucggauccuccug

SEQ ID NO: 2477284 - RNA, 21 nt, Brucella suis 1330
acagccuagacagcagugccu

SEQ ID NO: 2477285 - RNA, 17 nt, Brucella suis 1330
acagccuggaugacauc

SEQ ID NO: 2477286 - RNA, 13 nt, Brucella suis 1330
acagcggcgcgcc

SEQ ID NO: 2477287 - RNA, 21 nt, Brucella suis 1330
acagcggcgcgccugggcuuu

SEQ ID NO: 2477288 - RNA, 22 nt, Brucella suis 1330
acaggagcggaagcauauguuc

SEQ ID NO: 2477289 - RNA, 20 nt, Brucella suis 1330
acagggcaagcgccugcugc

SEQ ID NO: 2477290 - RNA, 16 nt, Brucella suis 1330
acagggcgaaaagccg

SEQ ID NO: 2477291 - RNA, 23 nt, Brucella suis 1330
acagggcgcugcgaaggcccuuc

SEQ ID NO: 2477292 - RNA, 18 nt, Brucella suis 1330
acagucacgccaucagca

SEQ ID NO: 2477293 - RNA, 21 nt, Brucella suis 1330
acagugaccagcgccgaggcg

SEQ ID NO: 2477294 - RNA, 19 nt, Brucella suis 1330
acauaaaguucacgcgcca

SEQ ID NO: 2477295 - RNA, 17 nt, Brucella suis 1330
acauagaaaucaaccuc

SEQ ID NO: 2477296 - RNA, 14 nt, Brucella suis 1330
acauagccugcaag

SEQ ID NO: 2477297 - RNA, 13 nt, Brucella suis 1330
acauauucuuccg

SEQ ID NO: 2477298 - RNA, 12 nt, Brucella suis 1330
acauauugcccu

SEQ ID NO: 2477299 - RNA, 14 nt, Brucella suis 1330
acauauuugccaua

SEQ ID NO: 2477300 - RNA, 23 nt, Brucella suis 1330
acauauuugucgccgacuuucaa

SEQ ID NO: 2477301 - RNA, 20 nt, Brucella suis 1330
acaucaaugugaaggcgcug

SEQ ID NO: 2477302 - RNA, 19 nt, Brucella suis 1330
acaucauugaacugcggcu

SEQ ID NO: 2477303 - RNA, 12 nt, Brucella suis 1330
acauccauaugc

SEQ ID NO: 2477304 - RNA, 19 nt, Brucella suis 1330
acauccauaugcagcggca

SEQ ID NO: 2477305 - RNA, 20 nt, Brucella suis 1330
acauccaucggcucauccuc

SEQ ID NO: 2477306 - RNA, 22 nt, Brucella suis 1330
acauccucggcccuggaaagaa

SEQ ID NO: 2477307 - RNA, 16 nt, Brucella suis 1330
acaucgcaucggucag

SEQ ID NO: 2477308 - RNA, 22 nt, Brucella suis 1330
acaucuuauaaaaaggccgcuc

SEQ ID NO: 2477309 - RNA, 12 nt, Brucella suis 1330
acaucuucuucg

SEQ ID NO: 2477310 - RNA, 17 nt, Brucella suis 1330
acaugagcaccggaagc

SEQ ID NO: 2477311 - RNA, 14 nt, Brucella suis 1330
acaugcaugacacc

SEQ ID NO: 2477312 - RNA, 14 nt, Brucella suis 1330
acaugccugccgca

SEQ ID NO: 2477313 - RNA, 15 nt, Brucella suis 1330
acaugcgccagagca

SEQ ID NO: 2477314 - RNA, 20 nt, Brucella suis 1330
acaugcggcaguccggcagc

SEQ ID NO: 2477315 - RNA, 20 nt, Brucella suis 1330
acaugcuugccgaccuugag

SEQ ID NO: 2477316 - RNA, 15 nt, Brucella suis 1330
acauggaaaugcagg

SEQ ID NO: 2477317 - RNA, 14 nt, Brucella suis 1330
acaugggccgggcg

SEQ ID NO: 2477318 - RNA, 23 nt, Brucella suis 1330
acauucccgaagacgaucuuuuc

SEQ ID NO: 2477319 - RNA, 17 nt, Brucella suis 1330
acauucuguaaggccug

SEQ ID NO: 2477320 - RNA, 20 nt, Brucella suis 1330
acauugauauucaugaccuu

SEQ ID NO: 2477321 - RNA, 12 nt, Brucella suis 1330
acauugccuucg

SEQ ID NO: 2477322 - RNA, 22 nt, Brucella suis 1330
acauuguuccggcacucgaaaa

SEQ ID NO: 2477323 - RNA, 18 nt, Brucella suis 1330
accaaaacauacuccccu

SEQ ID NO: 2477324 - RNA, 12 nt, Brucella suis 1330
accaaaacuucc

SEQ ID NO: 2477325 - RNA, 23 nt, Brucella suis 1330
accaaaaggcgugaaccacagcc

SEQ ID NO: 2477326 - RNA, 16 nt, Brucella suis 1330
accaacccuuuuucau

SEQ ID NO: 2477327 - RNA, 13 nt, Brucella suis 1330
accaagaccgccg

SEQ ID NO: 2477328 - RNA, 15 nt, Brucella suis 1330
accaagcaggccgcg

SEQ ID NO: 2477329 - RNA, 23 nt, Brucella suis 1330
accaaucggccuuguaggaaagc

SEQ ID NO: 2477330 - RNA, 22 nt, Brucella suis 1330
accacaccaucgcccgccgcga

SEQ ID NO: 2477331 - RNA, 14 nt, Brucella suis 1330
accacagccgguuc

SEQ ID NO: 2477332 - RNA, 14 nt, Brucella suis 1330
accacauugcccca

SEQ ID NO: 2477333 - RNA, 15 nt, Brucella suis 1330
accacauugccccac

SEQ ID NO: 2477334 - RNA, 16 nt, Brucella suis 1330
accacauugccccacg

SEQ ID NO: 2477335 - RNA, 16 nt, Brucella suis 1330
accaccagagcaaaaa

SEQ ID NO: 2477336 - RNA, 13 nt, Brucella suis 1330
accaccggccuga

SEQ ID NO: 2477337 - RNA, 15 nt, Brucella suis 1330
accaccuuccugccu

SEQ ID NO: 2477338 - RNA, 14 nt, Brucella suis 1330
accaccuucgccgu

SEQ ID NO: 2477339 - RNA, 14 nt, Brucella suis 1330
accacgacaaaacc

SEQ ID NO: 2477340 - RNA, 17 nt, Brucella suis 1330
accacgauggaaggaaa

SEQ ID NO: 2477341 - RNA, 18 nt, Brucella suis 1330
accagacgauuuucgcca

SEQ ID NO: 2477342 - RNA, 13 nt, Brucella suis 1330
accagagacagug

SEQ ID NO: 2477343 - RNA, 20 nt, Brucella suis 1330
accagagagcggauugcugu

SEQ ID NO: 2477344 - RNA, 19 nt, Brucella suis 1330
accagcccccagaugaagg

SEQ ID NO: 2477345 - RNA, 20 nt, Brucella suis 1330
accagcccccagaugaaggu

SEQ ID NO: 2477346 - RNA, 19 nt, Brucella suis 1330
accagccguuccagggcgc

SEQ ID NO: 2477347 - RNA, 21 nt, Brucella suis 1330
accagccuugcccuggcucuu

SEQ ID NO: 2477348 - RNA, 14 nt, Brucella suis 1330
accagcgcauggca

SEQ ID NO: 2477349 - RNA, 16 nt, Brucella suis 1330
accagcgcauggcaug

SEQ ID NO: 2477350 - RNA, 13 nt, Brucella suis 1330
accagcgugcagc

SEQ ID NO: 2477351 - RNA, 15 nt, Brucella suis 1330
accagcgugcagccu

SEQ ID NO: 2477352 - RNA, 21 nt, Brucella suis 1330
accaggcccauuggaaauuau

SEQ ID NO: 2477353 - RNA, 14 nt, Brucella suis 1330
accaggccgcggga

SEQ ID NO: 2477354 - RNA, 14 nt, Brucella suis 1330
accagguugcgccg

SEQ ID NO: 2477355 - RNA, 13 nt, Brucella suis 1330
accaguggccuuc

SEQ ID NO: 2477356 - RNA, 11 nt, Brucella suis 1330
accauauccuc

SEQ ID NO: 2477357 - RNA, 15 nt, Brucella suis 1330
accauauuugccgcc

SEQ ID NO: 2477358 - RNA, 19 nt, Brucella suis 1330
accauauuugccgccagaa

SEQ ID NO: 2477359 - RNA, 23 nt, Brucella suis 1330
accauauuugccgccagaaaaug

SEQ ID NO: 2477360 - RNA, 22 nt, Brucella suis 1330
accaucaucuucaccuguucgg

SEQ ID NO: 2477361 - RNA, 17 nt, Brucella suis 1330
accaucgaaagcccguc

SEQ ID NO: 2477362 - RNA, 16 nt, Brucella suis 1330
accaucgagcauuuca

SEQ ID NO: 2477363 - RNA, 15 nt, Brucella suis 1330
accaucugccgucag

SEQ ID NO: 2477364 - RNA, 17 nt, Brucella suis 1330
accauggcgcauucaga

SEQ ID NO: 2477365 - RNA, 10 nt, Brucella suis 1330
accauucaca

SEQ ID NO: 2477366 - RNA, 18 nt, Brucella suis 1330
accauucugcccagaaau

SEQ ID NO: 2477367 - RNA, 22 nt, Brucella suis 1330
accauuuguuuugucgcauuau

SEQ ID NO: 2477368 - RNA, 16 nt, Brucella suis 1330
acccaccgccugcagc

SEQ ID NO: 2477369 - RNA, 18 nt, Brucella suis 1330
acccagccaagcgccacg

SEQ ID NO: 2477370 - RNA, 15 nt, Brucella suis 1330
acccagcuaaggccg

SEQ ID NO: 2477371 - RNA, 15 nt, Brucella suis 1330
acccaucaaugcacc

SEQ ID NO: 2477372 - RNA, 15 nt, Brucella suis 1330
acccaugccuuucag

SEQ ID NO: 2477373 - RNA, 11 nt, Brucella suis 1330
acccauggccu

SEQ ID NO: 2477374 - RNA, 18 nt, Brucella suis 1330
acccauuaccgaggggaa

SEQ ID NO: 2477375 - RNA, 15 nt, Brucella suis 1330
accccaaugcucgau

SEQ ID NO: 2477376 - RNA, 20 nt, Brucella suis 1330
accccgcacggucaugaugc

SEQ ID NO: 2477377 - RNA, 13 nt, Brucella suis 1330
accccucccucac

SEQ ID NO: 2477378 - RNA, 19 nt, Brucella suis 1330
acccgaaacgguggccuuc

SEQ ID NO: 2477379 - RNA, 12 nt, Brucella suis 1330
acccgaaaggau

SEQ ID NO: 2477380 - RNA, 13 nt, Brucella suis 1330
acccgagcgucug

SEQ ID NO: 2477381 - RNA, 21 nt, Brucella suis 1330
acccgauaaacccgcccccac

SEQ ID NO: 2477382 - RNA, 16 nt, Brucella suis 1330
acccgccagaugauca

SEQ ID NO: 2477383 - RNA, 19 nt, Brucella suis 1330
acccggcgcaaaggccggg

SEQ ID NO: 2477384 - RNA, 22 nt, Brucella suis 1330
acccggcgucacgucauaggca

SEQ ID NO: 2477385 - RNA, 12 nt, Brucella suis 1330
acccggucuuga

SEQ ID NO: 2477386 - RNA, 19 nt, Brucella suis 1330
acccuaccgaacccggauc

SEQ ID NO: 2477387 - RNA, 18 nt, Brucella suis 1330
acccuuuuccgcaccgcc

SEQ ID NO: 2477388 - RNA, 19 nt, Brucella suis 1330
acccuuuuucaugcaugau

SEQ ID NO: 2477389 - RNA, 21 nt, Brucella suis 1330
accgaacgcgccuuuucuuca

SEQ ID NO: 2477390 - RNA, 19 nt, Brucella suis 1330
accgaacggaucaggcgcc

SEQ ID NO: 2477391 - RNA, 23 nt, Brucella suis 1330
accgaacugaugcggauuuggac

SEQ ID NO: 2477392 - RNA, 19 nt, Brucella suis 1330
acgcaggcgagaugccgug

SEQ ID NO: 2477393 - RNA, 23 nt, Brucella suis 1330
acgcaggcggauauucgccgccu

SEQ ID NO: 2477394 - RNA, 16 nt, Brucella suis 1330
acgcauagagccacga

SEQ ID NO: 2477395 - RNA, 16 nt, Brucella suis 1330
acgccaaccaaagaaa

SEQ ID NO: 2477396 - RNA, 20 nt, Brucella suis 1330
acgccauccauguggaaggc

SEQ ID NO: 2477397 - RNA, 18 nt, Brucella suis 1330
acgcccaugaucgcgcca

SEQ ID NO: 2477398 - RNA, 18 nt, Brucella suis 1330
acgcccgaucagauagcc

SEQ ID NO: 2477399 - RNA, 12 nt, Brucella suis 1330
acgcccgccccc

SEQ ID NO: 2477400 - RNA, 18 nt, Brucella suis 1330
acgcccuucaaaccaucc

SEQ ID NO: 2477401 - RNA, 23 nt, Brucella suis 1330
acgccgcaugacgugacggucga

SEQ ID NO: 2477402 - RNA, 17 nt, Brucella suis 1330
acgccgcuccagccgag

SEQ ID NO: 2477403 - RNA, 14 nt, Brucella suis 1330
acgccggcaccgcc

SEQ ID NO: 2477404 - RNA, 15 nt, Brucella suis 1330
acgccggcaucaaac

SEQ ID NO: 2477405 - RNA, 16 nt, Brucella suis 1330
acgccuaaggcgcgca

SEQ ID NO: 2477406 - RNA, 17 nt, Brucella suis 1330
acgccuuauaggcgcgc

SEQ ID NO: 2477407 - RNA, 13 nt, Brucella suis 1330
acgccuucaaagc

SEQ ID NO: 2477408 - RNA, 18 nt, Brucella suis 1330
acgccuuuuucacugcau

SEQ ID NO: 2477409 - RNA, 16 nt, Brucella suis 1330
acgcgagcgcagcggc

SEQ ID NO: 2477410 - RNA, 17 nt, Brucella suis 1330
acgcgcacguccggcac

SEQ ID NO: 2477411 - RNA, 18 nt, Brucella suis 1330
acgcgcagacgcagcgca

SEQ ID NO: 2477412 - RNA, 22 nt, Brucella suis 1330
acgcgcagauauggcgccugcg

SEQ ID NO: 2477413 - RNA, 13 nt, Brucella suis 1330
acgcgcagcagca

SEQ ID NO: 2477414 - RNA, 18 nt, Brucella suis 1330
acgcgcauuuuccgguug

SEQ ID NO: 2477415 - RNA, 13 nt, Brucella suis 1330
acgcgccgauacc

SEQ ID NO: 2477416 - RNA, 16 nt, Brucella suis 1330
acgcgccuuuucuuca

SEQ ID NO: 2477417 - RNA, 20 nt, Brucella suis 1330
acgcgcguugcggccgggcc

SEQ ID NO: 2477418 - RNA, 19 nt, Brucella suis 1330
acgcgcuaaaaagcgcgcg

SEQ ID NO: 2477419 - RNA, 21 nt, Brucella suis 1330
acgcggcaggugccaucaagc

SEQ ID NO: 2477420 - RNA, 19 nt, Brucella suis 1330
acgcgggcuucugcgcccg

SEQ ID NO: 2477421 - RNA, 18 nt, Brucella suis 1330
acgcuacccauucauuuc

SEQ ID NO: 2477422 - RNA, 17 nt, Brucella suis 1330
acgcucggcggaagcga

SEQ ID NO: 2477423 - RNA, 22 nt, Brucella suis 1330
acgcuucaugauaaggccgcuu

SEQ ID NO: 2477424 - RNA, 22 nt, Brucella suis 1330
acgcuugcgcccgcgguuucuc

SEQ ID NO: 2477425 - RNA, 12 nt, Brucella suis 1330
acgcuugcguuc

SEQ ID NO: 2477426 - RNA, 15 nt, Brucella suis 1330
acgcuuggcaccgcc

SEQ ID NO: 2477427 - RNA, 15 nt, Brucella suis 1330
acgcuuggccucuuc

SEQ ID NO: 2477428 - RNA, 18 nt, Brucella suis 1330
acgcuuuccaccggcuca

SEQ ID NO: 2477429 - RNA, 15 nt, Brucella suis 1330
acggacgccugccau

SEQ ID NO: 2477430 - RNA, 22 nt, Brucella suis 1330
acggauuuccaccacgcgcgcu

SEQ ID NO: 2477431 - RNA, 23 nt, Brucella suis 1330
acggcaagguggaucuugcgguu

SEQ ID NO: 2477432 - RNA, 14 nt, Brucella suis 1330
acggcacguucggc

SEQ ID NO: 2477433 - RNA, 16 nt, Brucella suis 1330
acggcauaaaugcccu

SEQ ID NO: 2477434 - RNA, 20 nt, Brucella suis 1330
acggcaugacgggcaguccg

SEQ ID NO: 2477435 - RNA, 14 nt, Brucella suis 1330
acggcauucaaaaa

SEQ ID NO: 2477436 - RNA, 16 nt, Brucella suis 1330
acggcauucaaaaacg

SEQ ID NO: 2477437 - RNA, 15 nt, Brucella suis 1330
acggccaagcaggag

SEQ ID NO: 2477438 - RNA, 17 nt, Brucella suis 1330
acggccaugcgcaugaa

SEQ ID NO: 2477439 - RNA, 16 nt, Brucella suis 1330
acggcgaaagcugccg

SEQ ID NO: 2477440 - RNA, 19 nt, Brucella suis 1330
acggcgaaagcugccgcga

SEQ ID NO: 2477441 - RNA, 19 nt, Brucella suis 1330
acggcgagacagacuggaa

SEQ ID NO: 2477442 - RNA, 20 nt, Brucella suis 1330
acggcgcagcgacuuccagu

SEQ ID NO: 2477443 - RNA, 13 nt, Brucella suis 1330
acggcgcggcgca

SEQ ID NO: 2477444 - RNA, 17 nt, Brucella suis 1330
acggcggcagaauaucu

SEQ ID NO: 2477445 - RNA, 20 nt, Brucella suis 1330
acggcggccuuggaggcggc

SEQ ID NO: 2477446 - RNA, 22 nt, Brucella suis 1330
acgggaauauagccgaugcaga

SEQ ID NO: 2477447 - RNA, 15 nt, Brucella suis 1330
acgggagcagcucua

SEQ ID NO: 2477448 - RNA, 13 nt, Brucella suis 1330
acgggcaggcaga

SEQ ID NO: 2477449 - RNA, 13 nt, Brucella suis 1330
acgggccagaaug

SEQ ID NO: 2477450 - RNA, 16 nt, Brucella suis 1330
acgggcgaacgggggc

SEQ ID NO: 2477451 - RNA, 17 nt, Brucella suis 1330
acgggcgagcgccagcg

SEQ ID NO: 2477452 - RNA, 18 nt, Brucella suis 1330
acgggcuugucgcagccc

SEQ ID NO: 2477453 - RNA, 20 nt, Brucella suis 1330
acgggucguucaccgcaacg

SEQ ID NO: 2477454 - RNA, 14 nt, Brucella suis 1330
acgggugcgcugcc

SEQ ID NO: 2477455 - RNA, 13 nt, Brucella suis 1330
acggguggcgcga

SEQ ID NO: 2477456 - RNA, 23 nt, Brucella suis 1330
acggucacgauugucgagccgca

SEQ ID NO: 2477457 - RNA, 15 nt, Brucella suis 1330
acggucagaucaucu

SEQ ID NO: 2477458 - RNA, 18 nt, Brucella suis 1330
acggucgaagccacggcg

SEQ ID NO: 2477459 - RNA, 16 nt, Brucella suis 1330
acggucgagugcggcc

SEQ ID NO: 2477460 - RNA, 19 nt, Brucella suis 1330
acggucugugucacgcagc

SEQ ID NO: 2477461 - RNA, 16 nt, Brucella suis 1330
acggucuugccggccu

SEQ ID NO: 2477462 - RNA, 14 nt, Brucella suis 1330
acgguugccuugcu

SEQ ID NO: 2477463 - RNA, 17 nt, Brucella suis 1330
acgguuuucggaaaaga

SEQ ID NO: 2477464 - RNA, 20 nt, Brucella suis 1330
acgguuuucggaaaagaugc

SEQ ID NO: 2477465 - RNA, 18 nt, Brucella suis 1330
acgguuuugcguuggaaa

SEQ ID NO: 2477466 - RNA, 19 nt, Brucella suis 1330
acguacauuguuccggcac

SEQ ID NO: 2477467 - RNA, 23 nt, Brucella suis 1330
acguaggcgcggcguggaaagcu

SEQ ID NO: 2477468 - RNA, 14 nt, Brucella suis 1330
acguauauccggua

SEQ ID NO: 2477469 - RNA, 15 nt, Brucella suis 1330
acgucaauagcaugg

SEQ ID NO: 2477470 - RNA, 19 nt, Brucella suis 1330
acgucacagauucaaaaca

SEQ ID NO: 2477471 - RNA, 19 nt, Brucella suis 1330
acgucaucaucgucuucaa

SEQ ID NO: 2477472 - RNA, 12 nt, Brucella suis 1330
acguccagccag

SEQ ID NO: 2477473 - RNA, 21 nt, Brucella suis 1330
acgucgaaauccguuucggaa

SEQ ID NO: 2477474 - RNA, 16 nt, Brucella suis 1330
acgucguggccagccg

SEQ ID NO: 2477475 - RNA, 17 nt, Brucella suis 1330
acguggcuugaagcugc

SEQ ID NO: 2477476 - RNA, 22 nt, Brucella suis 1330
acguuccgcauccgaaaugcgc

SEQ ID NO: 2477477 - RNA, 16 nt, Brucella suis 1330
acguuccgugaaucug

SEQ ID NO: 2477478 - RNA, 20 nt, Brucella suis 1330
acguuccgugaaucugaggc

SEQ ID NO: 2477479 - RNA, 16 nt, Brucella suis 1330
acuaauucguucuugu

SEQ ID NO: 2477480 - RNA, 21 nt, Brucella suis 1330
acuauuuccaucgcuugaacc

SEQ ID NO: 2477481 - RNA, 23 nt, Brucella suis 1330
acucaucaaaagcugccgcaaca

SEQ ID NO: 2477482 - RNA, 16 nt, Brucella suis 1330
acucauuaucagcauu

SEQ ID NO: 2477483 - RNA, 22 nt, Brucella suis 1330
acucggcauaaaccacgagauc

SEQ ID NO: 2477484 - RNA, 21 nt, Brucella suis 1330
acugaauccgcgacgccgccc

SEQ ID NO: 2477485 - RNA, 16 nt, Brucella suis 1330
acugcaaaaaauacca

SEQ ID NO: 2477486 - RNA, 16 nt, Brucella suis 1330
acugcaaggcaucgcg

SEQ ID NO: 2477487 - RNA, 21 nt, Brucella suis 1330
acugcaucacagucacgccau

SEQ ID NO: 2477488 - RNA, 18 nt, Brucella suis 1330
acugccuuacugcccuau

SEQ ID NO: 2477489 - RNA, 16 nt, Brucella suis 1330
acugcgcgcaaaccag

SEQ ID NO: 2477490 - RNA, 16 nt, Brucella suis 1330
acugcggcaacggcgc

SEQ ID NO: 2477491 - RNA, 15 nt, Brucella suis 1330
acugcugccaaaaau

SEQ ID NO: 2477492 - RNA, 18 nt, Brucella suis 1330
acuggaaauauucgggcg

SEQ ID NO: 2477493 - RNA, 21 nt, Brucella suis 1330
acuggauuucgagcugacgaa

SEQ ID NO: 2477494 - RNA, 15 nt, Brucella suis 1330
acuggcaagugugca

SEQ ID NO: 2477495 - RNA, 13 nt, Brucella suis 1330
acuggcagcauga

SEQ ID NO: 2477496 - RNA, 12 nt, Brucella suis 1330
acuggcagggcu

SEQ ID NO: 2477497 - RNA, 14 nt, Brucella suis 1330
acugggcggccagc

SEQ ID NO: 2477498 - RNA, 19 nt, Brucella suis 1330
acugugauuugauccaugc

SEQ ID NO: 2477499 - RNA, 23 nt, Brucella suis 1330
acuucaaguuucggaucggcaag

SEQ ID NO: 2477500 - RNA, 20 nt, Brucella suis 1330
acuucagccagaaucugcgc

SEQ ID NO: 2477501 - RNA, 21 nt, Brucella suis 1330
acuucaucgcgccgcaacucu

SEQ ID NO: 2477502 - RNA, 14 nt, Brucella suis 1330
acuuccagauagau

SEQ ID NO: 2477503 - RNA, 16 nt, Brucella suis 1330
acuuccgccuucgaga

SEQ ID NO: 2477504 - RNA, 22 nt, Brucella suis 1330
acuucgccaaagauacgguuca

SEQ ID NO: 2477505 - RNA, 15 nt, Brucella suis 1330
acuucgccaagcccu

SEQ ID NO: 2477506 - RNA, 14 nt, Brucella suis 1330
acuucggcggcgcg

SEQ ID NO: 2477507 - RNA, 15 nt, Brucella suis 1330
acuucgggcgccuuc

SEQ ID NO: 2477508 - RNA, 13 nt, Brucella suis 1330
agcaaaagccccg

SEQ ID NO: 2477509 - RNA, 13 nt, Brucella suis 1330
agcaaaagugaga

SEQ ID NO: 2477510 - RNA, 12 nt, Brucella suis 1330
agcaaaagugcg

SEQ ID NO: 2477511 - RNA, 16 nt, Brucella suis 1330
agcaaagagcgguucc

SEQ ID NO: 2477512 - RNA, 16 nt, Brucella suis 1330
agcaaagcgauuucac

SEQ ID NO: 2477513 - RNA, 16 nt, Brucella suis 1330
agcaaauacaccaaug

SEQ ID NO: 2477514 - RNA, 20 nt, Brucella suis 1330
agcaaauucaaagaauuccc

SEQ ID NO: 2477515 - RNA, 19 nt, Brucella suis 1330
agcaacagggcgaaaagcc

SEQ ID NO: 2477516 - RNA, 23 nt, Brucella suis 1330
agcaacagggcgaaaagccgccu

SEQ ID NO: 2477517 - RNA, 19 nt, Brucella suis 1330
agcaagagcgucauugaac

SEQ ID NO: 2477518 - RNA, 19 nt, Brucella suis 1330
agcaaucgacaauugccca

SEQ ID NO: 2477519 - RNA, 21 nt, Brucella suis 1330
agcaaucucacacugcaaaac

SEQ ID NO: 2477520 - RNA, 18 nt, Brucella suis 1330
agcaauugcugggcuucc

SEQ ID NO: 2477521 - RNA, 13 nt, Brucella suis 1330
agcacaaagaaca

SEQ ID NO: 2477522 - RNA, 19 nt, Brucella suis 1330
agcacacggucaugcaggc

SEQ ID NO: 2477523 - RNA, 16 nt, Brucella suis 1330
agcaccggaagcgcaa

SEQ ID NO: 2477524 - RNA, 21 nt, Brucella suis 1330
agcaccucgaaaacaucggaa

SEQ ID NO: 2477525 - RNA, 14 nt, Brucella suis 1330
agcacguccuuggc

SEQ ID NO: 2477526 - RNA, 14 nt, Brucella suis 1330
agcacucugccagg

SEQ ID NO: 2477527 - RNA, 14 nt, Brucella suis 1330
agcacugaaacggg

SEQ ID NO: 2477528 - RNA, 17 nt, Brucella suis 1330
agcacugaaacgggacc

SEQ ID NO: 2477529 - RNA, 14 nt, Brucella suis 1330
agcacuuccagaua

SEQ ID NO: 2477530 - RNA, 13 nt, Brucella suis 1330
agcagaaggauga

SEQ ID NO: 2477531 - RNA, 14 nt, Brucella suis 1330
agcagacgggaagc

SEQ ID NO: 2477532 - RNA, 14 nt, Brucella suis 1330
agcagauccuguag

SEQ ID NO: 2477533 - RNA, 12 nt, Brucella suis 1330
agcagcaacagg

SEQ ID NO: 2477534 - RNA, 20 nt, Brucella suis 1330
agcagcaccggcggaaggcu

SEQ ID NO: 2477535 - RNA, 15 nt, Brucella suis 1330
agcagcaucuugcca

SEQ ID NO: 2477536 - RNA, 13 nt, Brucella suis 1330
agcaggaucggca

SEQ ID NO: 2477537 - RNA, 16 nt, Brucella suis 1330
agcaggcaggccgccu

SEQ ID NO: 2477538 - RNA, 18 nt, Brucella suis 1330
agcaggccgguaagcccu

SEQ ID NO: 2477539 - RNA, 19 nt, Brucella suis 1330
agcaggccgguaagcccug

SEQ ID NO: 2477540 - RNA, 20 nt, Brucella suis 1330
agcaggccgguaagcccugu

SEQ ID NO: 2477541 - RNA, 11 nt, Brucella suis 1330
agcaggcgcgc

SEQ ID NO: 2477542 - RNA, 13 nt, Brucella suis 1330
agcaggcguugca

SEQ ID NO: 2477543 - RNA, 21 nt, Brucella suis 1330
agcaggcucugaaacugaaaa

SEQ ID NO: 2477544 - RNA, 20 nt, Brucella suis 1330
agcaguaccgacaugccaag

SEQ ID NO: 2477545 - RNA, 22 nt, Brucella suis 1330
agcaguaccgacaugccaagag

SEQ ID NO: 2477546 - RNA, 14 nt, Brucella suis 1330
agcagucaaaaacg

SEQ ID NO: 2477547 - RNA, 23 nt, Brucella suis 1330
agcagucuucuugugaacaugga

SEQ ID NO: 2477548 - RNA, 14 nt, Brucella suis 1330
agcauauguuccug

SEQ ID NO: 2477549 - RNA, 23 nt, Brucella suis 1330
agcauauugccgagcauggccug

SEQ ID NO: 2477550 - RNA, 15 nt, Brucella suis 1330
agcaucagcuugccc

SEQ ID NO: 2477551 - RNA, 17 nt, Brucella suis 1330
agcaucagcuugcccau

SEQ ID NO: 2477552 - RNA, 21 nt, Brucella suis 1330
agcauccgcucgcgcaucgcg

SEQ ID NO: 2477553 - RNA, 21 nt, Brucella suis 1330
agcauccuauccccuggaugu

SEQ ID NO: 2477554 - RNA, 13 nt, Brucella suis 1330
agcaucgcccccu

SEQ ID NO: 2477555 - RNA, 14 nt, Brucella suis 1330
agcaucgccgccag

SEQ ID NO: 2477556 - RNA, 14 nt, Brucella suis 1330
agcaucuugccaag

SEQ ID NO: 2477557 - RNA, 13 nt, Brucella suis 1330
agcaugaucgcca

SEQ ID NO: 2477558 - RNA, 14 nt, Brucella suis 1330
agcaugaucgcccg

SEQ ID NO: 2477559 - RNA, 21 nt, Brucella suis 1330
agcaugaucgcccgcccggca

SEQ ID NO: 2477560 - RNA, 23 nt, Brucella suis 1330
agcaugcgguucagguggaucgg

SEQ ID NO: 2477561 - RNA, 15 nt, Brucella suis 1330
agcauggcaaggcca

SEQ ID NO: 2477562 - RNA, 18 nt, Brucella suis 1330
agcauggcaaggccacgc

SEQ ID NO: 2477563 - RNA, 20 nt, Brucella suis 1330
agcauggugcgcacuuccgc

SEQ ID NO: 2477564 - RNA, 17 nt, Brucella suis 1330
agcauuccgauggaacu

SEQ ID NO: 2477565 - RNA, 18 nt, Brucella suis 1330
agcauuccgauggaacug

SEQ ID NO: 2477566 - RNA, 22 nt, Brucella suis 1330
agcauucuuuccccaugaccgg

SEQ ID NO: 2477567 - RNA, 15 nt, Brucella suis 1330
agcauugaaaggcag

SEQ ID NO: 2477568 - RNA, 18 nt, Brucella suis 1330
agcauugaaaggcagcac

SEQ ID NO: 2477569 - RNA, 23 nt, Brucella suis 1330
agcauugaacgccuuuuucacug

SEQ ID NO: 2477570 - RNA, 16 nt, Brucella suis 1330
agcauuuccagcaaaa

SEQ ID NO: 2477571 - RNA, 19 nt, Brucella suis 1330
agcauuuccagcaaaagug

SEQ ID NO: 2477572 - RNA, 20 nt, Brucella suis 1330
agcauuuucgagccaaaaau

SEQ ID NO: 2477573 - RNA, 20 nt, Brucella suis 1330
agcauuuucgagccaaaagu

SEQ ID NO: 2477574 - RNA, 12 nt, Brucella suis 1330
agccaaaagugc

SEQ ID NO: 2477575 - RNA, 22 nt, Brucella suis 1330
agccaaaagugcgaagcgccga

SEQ ID NO: 2477576 - RNA, 21 nt, Brucella suis 1330
agccaaaagugcgcagcaucu

SEQ ID NO: 2477577 - RNA, 14 nt, Brucella suis 1330
agccaaagcccgug

SEQ ID NO: 2477578 - RNA, 14 nt, Brucella suis 1330
agccacgaaacgcc

SEQ ID NO: 2477579 - RNA, 23 nt, Brucella suis 1330
agccagaagacggcggguggcag

SEQ ID NO: 2477580 - RNA, 20 nt, Brucella suis 1330
agccagaucccguuuugaga

SEQ ID NO: 2477581 - RNA, 21 nt, Brucella suis 1330
agccagguggcugcccgccgc

SEQ ID NO: 2477582 - RNA, 17 nt, Brucella suis 1330
agccauacgacaauaau

SEQ ID NO: 2477583 - RNA, 15 nt, Brucella suis 1330
agccauagcgcagaa

SEQ ID NO: 2477584 - RNA, 24 nt, Brucella suis 1330
agccauagcgcagaaugagcuugc

SEQ ID NO: 2477585 - RNA, 21 nt, Brucella suis 1330
agccauccccauugcaucgcc

SEQ ID NO: 2477586 - RNA, 19 nt, Brucella suis 1330
agcccaaccgagcagaaug

SEQ ID NO: 2477587 - RNA, 18 nt, Brucella suis 1330
agcccaagaaagaucagc

SEQ ID NO: 2477588 - RNA, 22 nt, Brucella suis 1330
agcccaccggacugauuucuga

SEQ ID NO: 2477589 - RNA, 14 nt, Brucella suis 1330
agcccagcgccuuc

SEQ ID NO: 2477590 - RNA, 12 nt, Brucella suis 1330
agccccagcacg

SEQ ID NO: 2477591 - RNA, 18 nt, Brucella suis 1330
agccccccuggauaucca

SEQ ID NO: 2477592 - RNA, 19 nt, Brucella suis 1330
agccccguuggcgcccagg

SEQ ID NO: 2477593 - RNA, 22 nt, Brucella suis 1330
agccccuuugcuucggccgaca

SEQ ID NO: 2477594 - RNA, 19 nt, Brucella suis 1330
agcccgccacgaggaagaa

SEQ ID NO: 2477595 - RNA, 12 nt, Brucella suis 1330
agcccgccccaa

SEQ ID NO: 2477596 - RNA, 18 nt, Brucella suis 1330
agcccgccccaagaucag

SEQ ID NO: 2477597 - RNA, 20 nt, Brucella suis 1330
agcccgugauuacccaucac

SEQ ID NO: 2477598 - RNA, 16 nt, Brucella suis 1330
agcccgugccaucggu

SEQ ID NO: 2477599 - RNA, 16 nt, Brucella suis 1330
agcccugcacaccaaa

SEQ ID NO: 2477600 - RNA, 22 nt, Brucella suis 1330
agcccuuccacugcaaggaagg

SEQ ID NO: 2477601 - RNA, 15 nt, Brucella suis 1330
agccgaauuccgcca

SEQ ID NO: 2477602 - RNA, 21 nt, Brucella suis 1330
agccgaccuugggcgagaaug

SEQ ID NO: 2477603 - RNA, 21 nt, Brucella suis 1330
agccgagcgccagauaaagca

SEQ ID NO: 2477604 - RNA, 11 nt, Brucella suis 1330
agccgagcugc

SEQ ID NO: 2477605 - RNA, 19 nt, Brucella suis 1330
agccgauaugccgacgcgc

SEQ ID NO: 2477606 - RNA, 15 nt, Brucella suis 1330
agccgaucuggcuga

SEQ ID NO: 2477607 - RNA, 22 nt, Brucella suis 1330
agccgaucuggcugagauaaac

SEQ ID NO: 2477608 - RNA, 22 nt, Brucella suis 1330
agccgaugcagaugccaugggc

SEQ ID NO: 2477609 - RNA, 14 nt, Brucella suis 1330
agccgaugccuuga

SEQ ID NO: 2477610 - RNA, 14 nt, Brucella suis 1330
agccgcagccgcca

SEQ ID NO: 2477611 - RNA, 18 nt, Brucella suis 1330
agccgccagcaggccggc

SEQ ID NO: 2477612 - RNA, 21 nt, Brucella suis 1330
agccgccauaccgucgaggaa

SEQ ID NO: 2477613 - RNA, 17 nt, Brucella suis 1330
agccgcccgccuuggaa

SEQ ID NO: 2477614 - RNA, 21 nt, Brucella suis 1330
agccgcccgccuuggaaacca

SEQ ID NO: 2477615 - RNA, 19 nt, Brucella suis 1330
agccgccgccgcaaaggca

SEQ ID NO: 2477616 - RNA, 17 nt, Brucella suis 1330
agccgccucugucaccu

SEQ ID NO: 2477617 - RNA, 15 nt, Brucella suis 1330
agccgccuuccuuga

SEQ ID NO: 2477618 - RNA, 21 nt, Brucella suis 1330
agccgcgaucacagccgcgcc

SEQ ID NO: 2477619 - RNA, 22 nt, Brucella suis 1330
agccgcgaucacagccgcgcca

SEQ ID NO: 2477620 - RNA, 18 nt, Brucella suis 1330
agccgcgccaugccaucc

SEQ ID NO: 2477621 - RNA, 11 nt, Brucella suis 1330
agccgcggcgc

SEQ ID NO: 2477622 - RNA, 22 nt, Brucella suis 1330
agccgcggcgcgaccugcucga

SEQ ID NO: 2477623 - RNA, 13 nt, Brucella suis 1330
agccgcuccauuc

SEQ ID NO: 2477624 - RNA, 18 nt, Brucella suis 1330
ucacugucggguuccuua

SEQ ID NO: 2477625 - RNA, 11 nt, Brucella suis 1330
ucagaaaucag

SEQ ID NO: 2477626 - RNA, 15 nt, Brucella suis 1330
ucagaaauuugcggg

SEQ ID NO: 2477627 - RNA, 22 nt, Brucella suis 1330
ucagaaauuugcgggcgaacca

SEQ ID NO: 2477628 - RNA, 18 nt, Brucella suis 1330
ucagaccgaugcucuaac

SEQ ID NO: 2477629 - RNA, 23 nt, Brucella suis 1330
ucagacgguccgccggauagggc

SEQ ID NO: 2477630 - RNA, 19 nt, Brucella suis 1330
ucagaggaucaucaacggu

SEQ ID NO: 2477631 - RNA, 14 nt, Brucella suis 1330
ucagauaagaugcg

SEQ ID NO: 2477632 - RNA, 22 nt, Brucella suis 1330
ucagauagccggugcugucgcc

SEQ ID NO: 2477633 - RNA, 15 nt, Brucella suis 1330
ucagaucgaaaugcg

SEQ ID NO: 2477634 - RNA, 17 nt, Brucella suis 1330
ucagauggacauagccg

SEQ ID NO: 2477635 - RNA, 20 nt, Brucella suis 1330
ucagcacaagccauccccau

SEQ ID NO: 2477636 - RNA, 22 nt, Brucella suis 1330
ucagcaccgugaagcgcuugcc

SEQ ID NO: 2477637 - RNA, 19 nt, Brucella suis 1330
ucagcaucgcccccuugau

SEQ ID NO: 2477638 - RNA, 23 nt, Brucella suis 1330
ucagcccgcuuuuacgcgccgcc

SEQ ID NO: 2477639 - RNA, 18 nt, Brucella suis 1330
ucagccgggcagugccgg

SEQ ID NO: 2477640 - RNA, 14 nt, Brucella suis 1330
ucagccuccugugc

SEQ ID NO: 2477641 - RNA, 11 nt, Brucella suis 1330
ucagccucgua

SEQ ID NO: 2477642 - RNA, 14 nt, Brucella suis 1330
ucagcgccacgccu

SEQ ID NO: 2477643 - RNA, 22 nt, Brucella suis 1330
ucagcggcggguagccgccauu

SEQ ID NO: 2477644 - RNA, 18 nt, Brucella suis 1330
ucagcggcgggugccgcg

SEQ ID NO: 2477645 - RNA, 19 nt, Brucella suis 1330
ucagcuauagccugcgcca

SEQ ID NO: 2477646 - RNA, 13 nt, Brucella suis 1330
ucagcuugccgcc

SEQ ID NO: 2477647 - RNA, 14 nt, Brucella suis 1330
ucagcuuggaaagc

SEQ ID NO: 2477648 - RNA, 17 nt, Brucella suis 1330
ucagcuuuacugccggg

SEQ ID NO: 2477649 - RNA, 17 nt, Brucella suis 1330
ucagcuuuucaccggca

SEQ ID NO: 2477650 - RNA, 15 nt, Brucella suis 1330
ucagcuuuuccauca

SEQ ID NO: 2477651 - RNA, 17 nt, Brucella suis 1330
ucaggaaaucgaugaca

SEQ ID NO: 2477652 - RNA, 11 nt, Brucella suis 1330
ucaggaucgcu

SEQ ID NO: 2477653 - RNA, 18 nt, Brucella suis 1330
ucaggaucgcuuucgagc

SEQ ID NO: 2477654 - RNA, 14 nt, Brucella suis 1330
ucaggaucuuucca

SEQ ID NO: 2477655 - RNA, 20 nt, Brucella suis 1330
ucaggaugagggagagaaca

SEQ ID NO: 2477656 - RNA, 21 nt, Brucella suis 1330
ucaggcacucuccucugccug

SEQ ID NO: 2477657 - RNA, 21 nt, Brucella suis 1330
ucaggccgauccugcgcccug

SEQ ID NO: 2477658 - RNA, 17 nt, Brucella suis 1330
ucaggcgaucaacgcuu

SEQ ID NO: 2477659 - RNA, 18 nt, Brucella suis 1330
ucaggcgcgaggcggcug

SEQ ID NO: 2477660 - RNA, 19 nt, Brucella suis 1330
ucaggcuuuccgacagggc

SEQ ID NO: 2477661 - RNA, 23 nt, Brucella suis 1330
ucagggauaaagccuguccuugu

SEQ ID NO: 2477662 - RNA, 18 nt, Brucella suis 1330
ucagggcaauccuuucca

SEQ ID NO: 2477663 - RNA, 21 nt, Brucella suis 1330
ucagggcaaucugcgcugccc

SEQ ID NO: 2477664 - RNA, 13 nt, Brucella suis 1330
ucagggcauugcc

SEQ ID NO: 2477665 - RNA, 17 nt, Brucella suis 1330
ucagggcgaggaaaauc

SEQ ID NO: 2477666 - RNA, 16 nt, Brucella suis 1330
ucaggucgagcgccug

SEQ ID NO: 2477667 - RNA, 18 nt, Brucella suis 1330
ucaggucgagcgccuguc

SEQ ID NO: 2477668 - RNA, 12 nt, Brucella suis 1330
ucaggucgcuuu

SEQ ID NO: 2477669 - RNA, 19 nt, Brucella suis 1330
ucaggucggcauugaucaa

SEQ ID NO: 2477670 - RNA, 16 nt, Brucella suis 1330
ucagguggaucggcgu

SEQ ID NO: 2477671 - RNA, 22 nt, Brucella suis 1330
ucagguuucgacaagcuucagg

SEQ ID NO: 2477672 - RNA, 14 nt, Brucella suis 1330
ucaguaacugccuu

SEQ ID NO: 2477673 - RNA, 19 nt, Brucella suis 1330
ucaguagccugacccggcc

SEQ ID NO: 2477674 - RNA, 16 nt, Brucella suis 1330
ucagucgaauuucagc

SEQ ID NO: 2477675 - RNA, 20 nt, Brucella suis 1330
ucaguggaucgacauauuug

SEQ ID NO: 2477676 - RNA, 12 nt, Brucella suis 1330
ucauaaggcaau

SEQ ID NO: 2477677 - RNA, 15 nt, Brucella suis 1330
ucauaaugcauggag

SEQ ID NO: 2477678 - RNA, 14 nt, Brucella suis 1330
ucauagauuccaga

SEQ ID NO: 2477679 - RNA, 14 nt, Brucella suis 1330
ucauagcgcgugcc

SEQ ID NO: 2477680 - RNA, 21 nt, Brucella suis 1330
ucauaucguugccgaucaugg

SEQ ID NO: 2477681 - RNA, 15 nt, Brucella suis 1330
ucaucaaggaaaaaa

SEQ ID NO: 2477682 - RNA, 12 nt, Brucella suis 1330
ucaucagcccau

SEQ ID NO: 2477683 - RNA, 13 nt, Brucella suis 1330
ucaucccgccccu

SEQ ID NO: 2477684 - RNA, 21 nt, Brucella suis 1330
ucaucccgccccuaaaggcuc

SEQ ID NO: 2477685 - RNA, 16 nt, Brucella suis 1330
ucaucgagaauuucuc

SEQ ID NO: 2477686 - RNA, 18 nt, Brucella suis 1330
ucaucgcccucgcgccaa

SEQ ID NO: 2477687 - RNA, 14 nt, Brucella suis 1330
ucaucgcgcugcuc

SEQ ID NO: 2477688 - RNA, 16 nt, Brucella suis 1330
ucaucggaggcuuccg

SEQ ID NO: 2477689 - RNA, 14 nt, Brucella suis 1330
ucaucgucggccag

SEQ ID NO: 2477690 - RNA, 18 nt, Brucella suis 1330
ucaucguggcggcaaaaa

SEQ ID NO: 2477691 - RNA, 19 nt, Brucella suis 1330
ucaucguggcggcaaaaag

SEQ ID NO: 2477692 - RNA, 22 nt, Brucella suis 1330
ucaucuggcgggguuuuuuauu

SEQ ID NO: 2477693 - RNA, 23 nt, Brucella suis 1330
ucaugcccuauaccgccaaggaa

SEQ ID NO: 2477694 - RNA, 13 nt, Brucella suis 1330
ucaugcugauugg

SEQ ID NO: 2477695 - RNA, 19 nt, Brucella suis 1330
ucauggaaaacgccgccuu

SEQ ID NO: 2477696 - RNA, 21 nt, Brucella suis 1330
ucauggagauacgcuucaucg

SEQ ID NO: 2477697 - RNA, 18 nt, Brucella suis 1330
ucauggcggcgcucggcg

SEQ ID NO: 2477698 - RNA, 16 nt, Brucella suis 1330
ucaugggcuugaucug

SEQ ID NO: 2477699 - RNA, 16 nt, Brucella suis 1330
ucauguuuugaaucug

SEQ ID NO: 2477700 - RNA, 22 nt, Brucella suis 1330
ucauuacagccuaaucaaaaga

SEQ ID NO: 2477701 - RNA, 18 nt, Brucella suis 1330
ucauuccggcgcugcuca

SEQ ID NO: 2477702 - RNA, 20 nt, Brucella suis 1330
ucauucggguugccuucgac

SEQ ID NO: 2477703 - RNA, 20 nt, Brucella suis 1330
ucauugaacagguuuccggc

SEQ ID NO: 2477704 - RNA, 22 nt, Brucella suis 1330
ucauugcggccaagcgcaucgg

SEQ ID NO: 2477705 - RNA, 19 nt, Brucella suis 1330
ucauuggauagauggaaag

SEQ ID NO: 2477706 - RNA, 15 nt, Brucella suis 1330
ucauugucccaauau

SEQ ID NO: 2477707 - RNA, 19 nt, Brucella suis 1330
ucauuuauuuuagcugcug

SEQ ID NO: 2477708 - RNA, 23 nt, Brucella suis 1330
ucauuucaagguuugcauagggc

SEQ ID NO: 2477709 - RNA, 13 nt, Brucella suis 1330
ucauuuccuucca

SEQ ID NO: 2477710 - RNA, 16 nt, Brucella suis 1330
ucauuugccaccugca

SEQ ID NO: 2477711 - RNA, 15 nt, Brucella suis 1330
ucauuuuagaaauuc

SEQ ID NO: 2477712 - RNA, 15 nt, Brucella suis 1330
ucauuuuuagaagau

SEQ ID NO: 2477713 - RNA, 17 nt, Brucella suis 1330
ucauuuuugacaagccg

SEQ ID NO: 2477714 - RNA, 16 nt, Brucella suis 1330
uccaauauugccuucc

SEQ ID NO: 2477715 - RNA, 22 nt, Brucella suis 1330
uccaaugugcccuugagagcca

SEQ ID NO: 2477716 - RNA, 15 nt, Brucella suis 1330
uccacaaugauguuc

SEQ ID NO: 2477717 - RNA, 15 nt, Brucella suis 1330
uccacaccugcacca

SEQ ID NO: 2477718 - RNA, 19 nt, Brucella suis 1330
uccacacgaacagcagcag

SEQ ID NO: 2477719 - RNA, 16 nt, Brucella suis 1330
uccacaggcgccagcc

SEQ ID NO: 2477720 - RNA, 15 nt, Brucella suis 1330
uccacauugccuucg

SEQ ID NO: 2477721 - RNA, 22 nt, Brucella suis 1330
uccaccaccucgccaaugaaga

SEQ ID NO: 2477722 - RNA, 15 nt, Brucella suis 1330
uccaccgcgcugaag

SEQ ID NO: 2477723 - RNA, 20 nt, Brucella suis 1330
uccaccgcgcugaagcggcc

SEQ ID NO: 2477724 - RNA, 14 nt, Brucella suis 1330
uccacgaaagccuu

SEQ ID NO: 2477725 - RNA, 20 nt, Brucella suis 1330
uccacgcccuuggcgagaau

SEQ ID NO: 2477726 - RNA, 21 nt, Brucella suis 1330
uccacuggacugauuucugau

SEQ ID NO: 2477727 - RNA, 20 nt, Brucella suis 1330
uccagaacuucgccaagccc

SEQ ID NO: 2477728 - RNA, 23 nt, Brucella suis 1330
uccagaagaucgucggcaagcug

SEQ ID NO: 2477729 - RNA, 21 nt, Brucella suis 1330
uccagaaggcgggaaggcaau

SEQ ID NO: 2477730 - RNA, 18 nt, Brucella suis 1330
uccagaauaucuucgagc

SEQ ID NO: 2477731 - RNA, 12 nt, Brucella suis 1330
uccagaucggcc

SEQ ID NO: 2477732 - RNA, 23 nt, Brucella suis 1330
uccagauugccgcgcgcggcuuc

SEQ ID NO: 2477733 - RNA, 23 nt, Brucella suis 1330
uccagauugcgggcaagcauucc

SEQ ID NO: 2477734 - RNA, 12 nt, Brucella suis 1330
uccagcaaaagu

SEQ ID NO: 2477735 - RNA, 17 nt, Brucella suis 1330
uccagcagaauuucagc

SEQ ID NO: 2477736 - RNA, 23 nt, Brucella suis 1330
uccagcauggugcgcacuuccgc

SEQ ID NO: 2477737 - RNA, 22 nt, Brucella suis 1330
uccagcgaaacggcagccgagg

SEQ ID NO: 2477738 - RNA, 19 nt, Brucella suis 1330
uccagcggugacggcggca

SEQ ID NO: 2477739 - RNA, 15 nt, Brucella suis 1330
uccagcgugaagggc

SEQ ID NO: 2477740 - RNA, 17 nt, Brucella suis 1330
cccuucguguccggcgu

SEQ ID NO: 2477741 - RNA, 13 nt, Brucella suis 1330
cccuugaaaucau

SEQ ID NO: 2477742 - RNA, 15 nt, Brucella suis 1330
cccuugagagccaga

SEQ ID NO: 2477743 - RNA, 20 nt, Brucella suis 1330
cccuugaucguauagcccug

SEQ ID NO: 2477744 - RNA, 20 nt, Brucella suis 1330
cccuugccgucggcgccguc

SEQ ID NO: 2477745 - RNA, 19 nt, Brucella suis 1330
cccuuggccggaauggcga

SEQ ID NO: 2477746 - RNA, 16 nt, Brucella suis 1330
cccuugugaucgccac

SEQ ID NO: 2477747 - RNA, 13 nt, Brucella suis 1330
cccuuguggccac

SEQ ID NO: 2477748 - RNA, 15 nt, Brucella suis 1330
ccgaaaaccgcuuca

SEQ ID NO: 2477749 - RNA, 11 nt, Brucella suis 1330
ccgaaaagccg

SEQ ID NO: 2477750 - RNA, 16 nt, Brucella suis 1330
ccgaaaagccgcgcgg

SEQ ID NO: 2477751 - RNA, 18 nt, Brucella suis 1330
ccgaaagauuucuucgca

SEQ ID NO: 2477752 - RNA, 19 nt, Brucella suis 1330
ccgaaauagcggcccgauu

SEQ ID NO: 2477753 - RNA, 18 nt, Brucella suis 1330
ccgaaaugcgcggcggca

SEQ ID NO: 2477754 - RNA, 18 nt, Brucella suis 1330
ccgaacggaucaggcgcc

SEQ ID NO: 2477755 - RNA, 15 nt, Brucella suis 1330
ccgaacugggcggcc

SEQ ID NO: 2477756 - RNA, 19 nt, Brucella suis 1330
ccgaagaaugcgcagccgu

SEQ ID NO: 2477757 - RNA, 17 nt, Brucella suis 1330
ccgaagacgaucuuuuc

SEQ ID NO: 2477758 - RNA, 18 nt, Brucella suis 1330
ccgaagcccgugccaucg

SEQ ID NO: 2477759 - RNA, 15 nt, Brucella suis 1330
ccgaaggaugcaagc

SEQ ID NO: 2477760 - RNA, 16 nt, Brucella suis 1330
ccgaaguuggucgucc

SEQ ID NO: 2477761 - RNA, 14 nt, Brucella suis 1330
ccgaauacaagccc

SEQ ID NO: 2477762 - RNA, 17 nt, Brucella suis 1330
ccgaaucgcuguuggca

SEQ ID NO: 2477763 - RNA, 15 nt, Brucella suis 1330
ccgaauuccgccaug

SEQ ID NO: 2477764 - RNA, 16 nt, Brucella suis 1330
ccgacaaaaaacaccg

SEQ ID NO: 2477765 - RNA, 17 nt, Brucella suis 1330
ccgacaaaaaacaccgc

SEQ ID NO: 2477766 - RNA, 20 nt, Brucella suis 1330
ccgacagggcaagcgccugc

SEQ ID NO: 2477767 - RNA, 13 nt, Brucella suis 1330
ccgacaugccaag

SEQ ID NO: 2477768 - RNA, 24 nt, Brucella suis 1330
ccgaccagaacgauggugcggcgc

SEQ ID NO: 2477769 - RNA, 20 nt, Brucella suis 1330
ccgaccaguaaggcgggcgg

SEQ ID NO: 2477770 - RNA, 19 nt, Brucella suis 1330
ccgaccgcgaaauagaugu

SEQ ID NO: 2477771 - RNA, 14 nt, Brucella suis 1330
ccgaccuccccccg

SEQ ID NO: 2477772 - RNA, 15 nt, Brucella suis 1330
ccgaccuccccccgc

SEQ ID NO: 2477773 - RNA, 16 nt, Brucella suis 1330
ccgaccuugagccccu

SEQ ID NO: 2477774 - RNA, 21 nt, Brucella suis 1330
ccgacgggcgaacgggggcga

SEQ ID NO: 2477775 - RNA, 15 nt, Brucella suis 1330
ccgagaacggcggcg

SEQ ID NO: 2477776 - RNA, 19 nt, Brucella suis 1330
ccgagauagacaugcggca

SEQ ID NO: 2477777 - RNA, 20 nt, Brucella suis 1330
ccggaagaaacaaaucagcu

SEQ ID NO: 2477778 - RNA, 18 nt, Brucella suis 1330
ccggaagaacagcgcgaa

SEQ ID NO: 2477779 - RNA, 14 nt, Brucella suis 1330
ccggaagccgccuu

SEQ ID NO: 2477780 - RNA, 13 nt, Brucella suis 1330
ccggaagcgcaaa

SEQ ID NO: 2477781 - RNA, 18 nt, Brucella suis 1330
ccggaagcgcaaggcggc

SEQ ID NO: 2477782 - RNA, 16 nt, Brucella suis 1330
ccggaaggcggggcug

SEQ ID NO: 2477783 - RNA, 18 nt, Brucella suis 1330
ccggaauaucauccaguc

SEQ ID NO: 2477784 - RNA, 17 nt, Brucella suis 1330
ccggagccuucgcaucg

SEQ ID NO: 2477785 - RNA, 16 nt, Brucella suis 1330
ccggauacaugcagau

SEQ ID NO: 2477786 - RNA, 21 nt, Brucella suis 1330
ccggauacaugcagaucgcau

SEQ ID NO: 2477787 - RNA, 15 nt, Brucella suis 1330
ccggauaucgccaga

SEQ ID NO: 2477788 - RNA, 22 nt, Brucella suis 1330
ccggaucaaaccggccaugccc

SEQ ID NO: 2477789 - RNA, 15 nt, Brucella suis 1330
ccggaucgaggccga

SEQ ID NO: 2477790 - RNA, 14 nt, Brucella suis 1330
ccggaugcaaaacc

SEQ ID NO: 2477791 - RNA, 14 nt, Brucella suis 1330
ccggauuuccaaug

SEQ ID NO: 2477792 - RNA, 18 nt, Brucella suis 1330
ccggcaacuugcaacgau

SEQ ID NO: 2477793 - RNA, 18 nt, Brucella suis 1330
ccggcacccacugcccgc

SEQ ID NO: 2477794 - RNA, 15 nt, Brucella suis 1330
ccggcaccgccccgc

SEQ ID NO: 2477795 - RNA, 20 nt, Brucella suis 1330
ccggcacgaacagaucgcca

SEQ ID NO: 2477796 - RNA, 22 nt, Brucella suis 1330
ccggcacgaccagcgcaaugcc

SEQ ID NO: 2477797 - RNA, 12 nt, Brucella suis 1330
ccggcagcgaag

SEQ ID NO: 2477798 - RNA, 20 nt, Brucella suis 1330
ccggcaguuucugccgcgca

SEQ ID NO: 2477799 - RNA, 23 nt, Brucella suis 1330
ccggcaguuucugccgcgcaucg

SEQ ID NO: 2477800 - RNA, 12 nt, Brucella suis 1330
ccggcauggccu

SEQ ID NO: 2477801 - RNA, 21 nt, Brucella suis 1330
ccggcauggccugcgcgcgca

SEQ ID NO: 2477802 - RNA, 12 nt, Brucella suis 1330
ccggccaguggc

SEQ ID NO: 2477803 - RNA, 17 nt, Brucella suis 1330
ccggcccacccaccgcc

SEQ ID NO: 2477804 - RNA, 12 nt, Brucella suis 1330
ccggccugcgcc

SEQ ID NO: 2477805 - RNA, 20 nt, Brucella suis 1330
ccggccuugauguccggcgc

SEQ ID NO: 2477806 - RNA, 22 nt, Brucella suis 1330
ccggccuuguguuucaccagau

SEQ ID NO: 2477807 - RNA, 17 nt, Brucella suis 1330
ccggcgcaguuucgcag

SEQ ID NO: 2477808 - RNA, 18 nt, Brucella suis 1330
ccggcgcgggcuuuccag

SEQ ID NO: 2477809 - RNA, 22 nt, Brucella suis 1330
ccggcgcgggcuuuccagcccc

SEQ ID NO: 2477810 - RNA, 16 nt, Brucella suis 1330
ccggcgcggucggcgc

SEQ ID NO: 2477811 - RNA, 18 nt, Brucella suis 1330
ccggcgcggucggcgcca

SEQ ID NO: 2477812 - RNA, 19 nt, Brucella suis 1330
ccggcggccuugaugcggc

SEQ ID NO: 2477813 - RNA, 13 nt, Brucella suis 1330
ccggcggcgccca

SEQ ID NO: 2477814 - RNA, 16 nt, Brucella suis 1330
ccggcgggagcggcac

SEQ ID NO: 2477815 - RNA, 23 nt, Brucella suis 1330
ccggcgggcuugaugcgccaguc

SEQ ID NO: 2477816 - RNA, 21 nt, Brucella suis 1330
ccggcggugaagaagcgccag

SEQ ID NO: 2477817 - RNA, 21 nt, Brucella suis 1330
ccggcgucagggaaaugcgga

SEQ ID NO: 2477818 - RNA, 15 nt, Brucella suis 1330
ccggcgucuugucgc

SEQ ID NO: 2477819 - RNA, 16 nt, Brucella suis 1330
ccggcguggccaagau

SEQ ID NO: 2477820 - RNA, 22 nt, Brucella suis 1330
ccggcucaaugccgcauucagc

SEQ ID NO: 2477821 - RNA, 22 nt, Brucella suis 1330
ccggcucauggucacgcgccca

SEQ ID NO: 2477822 - RNA, 21 nt, Brucella suis 1330
ccggcucauucggguugccuu

SEQ ID NO: 2477823 - RNA, 13 nt, Brucella suis 1330
ccggcucugcgga

SEQ ID NO: 2477824 - RNA, 13 nt, Brucella suis 1330
ccggcugccgcaa

SEQ ID NO: 2477825 - RNA, 17 nt, Brucella suis 1330
ccggcugccuuggcauc

SEQ ID NO: 2477826 - RNA, 19 nt, Brucella suis 1330
ccggcugcggcgccuugau

SEQ ID NO: 2477827 - RNA, 16 nt, Brucella suis 1330
ccggcuggaauuguuc

SEQ ID NO: 2477828 - RNA, 21 nt, Brucella suis 1330
ccggcuuucgccgggguuucu

SEQ ID NO: 2477829 - RNA, 20 nt, Brucella suis 1330
ccgggacaaucuugcgcagc

SEQ ID NO: 2477830 - RNA, 16 nt, Brucella suis 1330
ccgggcagcggcgcgc

SEQ ID NO: 2477831 - RNA, 16 nt, Brucella suis 1330
ccgggcaucgcucgaa

SEQ ID NO: 2477832 - RNA, 22 nt, Brucella suis 1330
ccgggccaacgccggcaccgcc

SEQ ID NO: 2477833 - RNA, 21 nt, Brucella suis 1330
ccgggccgcaugauccgcucc

SEQ ID NO: 2477834 - RNA, 18 nt, Brucella suis 1330
ccgggcggcgcggcggca

SEQ ID NO: 2477835 - RNA, 22 nt, Brucella suis 1330
ccgggcggcuugccagaugugc

SEQ ID NO: 2477836 - RNA, 20 nt, Brucella suis 1330
ccgggcucuucgcauugccg

SEQ ID NO: 2477837 - RNA, 16 nt, Brucella suis 1330
ccgggcugcuuccaca

SEQ ID NO: 2477838 - RNA, 22 nt, Brucella suis 1330
ccgggcugcuuccacaggcgcc

SEQ ID NO: 2477839 - RNA, 17 nt, Brucella suis 1330
ccggggccaaaggcggc

SEQ ID NO: 2477840 - RNA, 18 nt, Brucella suis 1330
ccgggucuucgcccggca

SEQ ID NO: 2477841 - RNA, 23 nt, Brucella suis 1330
ccgggucuucgcccggcauggcc

SEQ ID NO: 2477842 - RNA, 18 nt, Brucella suis 1330
ccgguacuggccaagcgu

SEQ ID NO: 2477843 - RNA, 16 nt, Brucella suis 1330
ccgguauccggcgcga

SEQ ID NO: 2477844 - RNA, 17 nt, Brucella suis 1330
ccgguauccggcgcgau

SEQ ID NO: 2477845 - RNA, 16 nt, Brucella suis 1330
ccggucgaagcggcgc

SEQ ID NO: 2477846 - RNA, 20 nt, Brucella suis 1330
ccggucgagccgacauaggc

SEQ ID NO: 2477847 - RNA, 21 nt, Brucella suis 1330
ccggucgagccgacauaggcg

SEQ ID NO: 2477848 - RNA, 22 nt, Brucella suis 1330
ccggucugucauuugcggcagu

SEQ ID NO: 2477849 - RNA, 17 nt, Brucella suis 1330
ccggugagcgaagcuca

SEQ ID NO: 2477850 - RNA, 16 nt, Brucella suis 1330
ccggugccggcaggcu

SEQ ID NO: 2477851 - RNA, 16 nt, Brucella suis 1330
ccgguggacugauuuc

SEQ ID NO: 2477852 - RNA, 22 nt, Brucella suis 1330
ccgguuaaaauggaaucgcugg

SEQ ID NO: 2477853 - RNA, 15 nt, Brucella suis 1330
ccgguucuuuuccuu

SEQ ID NO: 2477854 - RNA, 18 nt, Brucella suis 1330
ccgguugccuugcccaug

SEQ ID NO: 2477855 - RNA, 12 nt, Brucella suis 1330
ccgguugcgcca

SEQ ID NO: 2477856 - RNA, 23 nt, Brucella suis 1330
ccgguugcgccaaaacgcagccg

SEQ ID NO: 2477857 - RNA, 20 nt, Brucella suis 1330
ccgguugcuuccaugcccau

SEQ ID NO: 2477858 - RNA, 15 nt, Brucella suis 1330
ccgguugguccuugu

SEQ ID NO: 2477859 - RNA, 17 nt, Brucella suis 1330
ccguaccggcaucagcc

SEQ ID NO: 2477860 - RNA, 21 nt, Brucella suis 1330
ccguaucacgccgcgacuccu

SEQ ID NO: 2477861 - RNA, 17 nt, Brucella suis 1330
ccguaucggcggcaagc

SEQ ID NO: 2477862 - RNA, 12 nt, Brucella suis 1330
ccguaucuccgg

SEQ ID NO: 2477863 - RNA, 15 nt, Brucella suis 1330
ccgucauucaucagc

SEQ ID NO: 2477864 - RNA, 17 nt, Brucella suis 1330
ccguccuucaccacgau

SEQ ID NO: 2477865 - RNA, 14 nt, Brucella suis 1330
ccgucgagcagcau

SEQ ID NO: 2477866 - RNA, 21 nt, Brucella suis 1330
ccgucgaggaaaaagcccgcc

SEQ ID NO: 2477867 - RNA, 19 nt, Brucella suis 1330
ccgucgcacgcuuggccuc

SEQ ID NO: 2477868 - RNA, 14 nt, Brucella suis 1330
ccgucgccgaccgc

SEQ ID NO: 2477869 - RNA, 13 nt, Brucella suis 1330
ccgucggccauca

SEQ ID NO: 2477870 - RNA, 17 nt, Brucella suis 1330
ccgucgggaccaccggc

SEQ ID NO: 2477871 - RNA, 19 nt, Brucella suis 1330
ccgucgggaccaccggccu

SEQ ID NO: 2477872 - RNA, 22 nt, Brucella suis 1330
ccgugccaucggugccugacug

SEQ ID NO: 2477873 - RNA, 19 nt, Brucella suis 1330
ccguucaacuggcgcagca

SEQ ID NO: 2477874 - RNA, 21 nt, Brucella suis 1330
ccguucacacuuuucgggaug

SEQ ID NO: 2477875 - RNA, 17 nt, Brucella suis 1330
ccguuccagggcgcgcc

SEQ ID NO: 2477876 - RNA, 20 nt, Brucella suis 1330
ccguugcaccguuucucugc

SEQ ID NO: 2477877 - RNA, 22 nt, Brucella suis 1330
ccguuggaaacggcgcaucauc

SEQ ID NO: 2477878 - RNA, 17 nt, Brucella suis 1330
ccuaccggaggcauccu

SEQ ID NO: 2477879 - RNA, 16 nt, Brucella suis 1330
ccuauuccccuauucc

SEQ ID NO: 2477880 - RNA, 16 nt, Brucella suis 1330
ccucaagauacaaaaa

SEQ ID NO: 2477881 - RNA, 15 nt, Brucella suis 1330
ccucaagcggcucca

SEQ ID NO: 2477882 - RNA, 13 nt, Brucella suis 1330
ccucaaucgcgcc

SEQ ID NO: 2477883 - RNA, 15 nt, Brucella suis 1330
ccucaaucgcgccgu

SEQ ID NO: 2477884 - RNA, 23 nt, Brucella suis 1330
ccucaauggcauuggcugcuucc

SEQ ID NO: 2477885 - RNA, 22 nt, Brucella suis 1330
ccucagcuauagccugcgccag

SEQ ID NO: 2477886 - RNA, 19 nt, Brucella suis 1330
ccucaucgaucacggcgcc

SEQ ID NO: 2477887 - RNA, 23 nt, Brucella suis 1330
ccuccauucaagcggcaugucau

SEQ ID NO: 2477888 - RNA, 16 nt, Brucella suis 1330
ccuccccccgcgucau

SEQ ID NO: 2477889 - RNA, 18 nt, Brucella suis 1330
ccucccuguccugccagc

SEQ ID NO: 2477890 - RNA, 20 nt, Brucella suis 1330
ccucccuguccugccagcgg

SEQ ID NO: 2477891 - RNA, 21 nt, Brucella suis 1330
ccucccuguccugccagcggc

SEQ ID NO: 2477892 - RNA, 18 nt, Brucella suis 1330
cgaaaaaugucgcgcgau

SEQ ID NO: 2477893 - RNA, 13 nt, Brucella suis 1330
cgaaaaccaccuu

SEQ ID NO: 2477894 - RNA, 20 nt, Brucella suis 1330
cgaaaaccguucacacuuuu

SEQ ID NO: 2477895 - RNA, 18 nt, Brucella suis 1330
cgaaaagugcgaagcgcc

SEQ ID NO: 2477896 - RNA, 20 nt, Brucella suis 1330
cgaaaaucaccauuuucgca

SEQ ID NO: 2477897 - RNA, 14 nt, Brucella suis 1330
cgaaaauggugaug

SEQ ID NO: 2477898 - RNA, 21 nt, Brucella suis 1330
cgaaaauggugauguuugcga

SEQ ID NO: 2477899 - RNA, 17 nt, Brucella suis 1330
cgaaagcacccgcuugg

SEQ ID NO: 2477900 - RNA, 18 nt, Brucella suis 1330
cgaaagcagacgggaagc

SEQ ID NO: 2477901 - RNA, 23 nt, Brucella suis 1330
cgaaauagauguucuuccccguc

SEQ ID NO: 2477902 - RNA, 21 nt, Brucella suis 1330
cgaaauaggucagcaggcgcc

SEQ ID NO: 2477903 - RNA, 20 nt, Brucella suis 1330
cgaaaucggguugacgauca

SEQ ID NO: 2477904 - RNA, 22 nt, Brucella suis 1330
cgaaaugccgauaucggcaugu

SEQ ID NO: 2477905 - RNA, 19 nt, Brucella suis 1330
cgaaaugcgcucuagacgg

SEQ ID NO: 2477906 - RNA, 15 nt, Brucella suis 1330
cgaacacgaugaugg

SEQ ID NO: 2477907 - RNA, 16 nt, Brucella suis 1330
cgaacagaucgccaag

SEQ ID NO: 2477908 - RNA, 13 nt, Brucella suis 1330
cgaacaugccugc

SEQ ID NO: 2477909 - RNA, 23 nt, Brucella suis 1330
cgaacaugcgccagagcauuuuc

SEQ ID NO: 2477910 - RNA, 13 nt, Brucella suis 1330
cgaacauucaggc

SEQ ID NO: 2477911 - RNA, 15 nt, Brucella suis 1330
cgaaccagauccacc

SEQ ID NO: 2477912 - RNA, 17 nt, Brucella suis 1330
cgaaccagauccaccgc

SEQ ID NO: 2477913 - RNA, 15 nt, Brucella suis 1330
cgaaccgggccgcau

SEQ ID NO: 2477914 - RNA, 15 nt, Brucella suis 1330
cgaaccguccgguug

SEQ ID NO: 2477915 - RNA, 20 nt, Brucella suis 1330
cgaaccgucgccagcucgcc

SEQ ID NO: 2477916 - RNA, 17 nt, Brucella suis 1330
cgaaccugauccagaag

SEQ ID NO: 2477917 - RNA, 13 nt, Brucella suis 1330
cgaacgagcggcc

SEQ ID NO: 2477918 - RNA, 13 nt, Brucella suis 1330
cgaacgcacugca

SEQ ID NO: 2477919 - RNA, 17 nt, Brucella suis 1330
cgaacgcuccugcaugu

SEQ ID NO: 2477920 - RNA, 15 nt, Brucella suis 1330
cgaacggaugagguc

SEQ ID NO: 2477921 - RNA, 12 nt, Brucella suis 1330
cgaacgggaaca

SEQ ID NO: 2477922 - RNA, 13 nt, Brucella suis 1330
cgaacugaugcgg

SEQ ID NO: 2477923 - RNA, 18 nt, Brucella suis 1330
cgaacugggcggccagcu

SEQ ID NO: 2477924 - RNA, 19 nt, Brucella suis 1330
cgaacugguucagccgcuc

SEQ ID NO: 2477925 - RNA, 16 nt, Brucella suis 1330
cgaagaacaguccuga

SEQ ID NO: 2477926 - RNA, 19 nt, Brucella suis 1330
cgaagaagaauacgcagcg

SEQ ID NO: 2477927 - RNA, 17 nt, Brucella suis 1330
cgaagacgaucuuuucc

SEQ ID NO: 2477928 - RNA, 21 nt, Brucella suis 1330
cgaagacgaucuuuuccauau

SEQ ID NO: 2477929 - RNA, 15 nt, Brucella suis 1330
cgaagauaagcggca

SEQ ID NO: 2477930 - RNA, 19 nt, Brucella suis 1330
cgaagccaggcagacggac

SEQ ID NO: 2477931 - RNA, 18 nt, Brucella suis 1330
cgaagcgaugacggagcg

SEQ ID NO: 2477932 - RNA, 15 nt, Brucella suis 1330
cgaagcggccuuuga

SEQ ID NO: 2477933 - RNA, 15 nt, Brucella suis 1330
cgaagcgguuuucgg

SEQ ID NO: 2477934 - RNA, 18 nt, Brucella suis 1330
cgaaggcagccgugagca

SEQ ID NO: 2477935 - RNA, 13 nt, Brucella suis 1330
cgaaggcccuuca

SEQ ID NO: 2477936 - RNA, 22 nt, Brucella suis 1330
cgaagggaaugggaucgaccga

SEQ ID NO: 2477937 - RNA, 14 nt, Brucella suis 1330
cgaagggcugaggg

SEQ ID NO: 2477938 - RNA, 17 nt, Brucella suis 1330
cgaauacaagcccaaga

SEQ ID NO: 2477939 - RNA, 19 nt, Brucella suis 1330
cgaauacagugacgcgcgc

SEQ ID NO: 2477940 - RNA, 17 nt, Brucella suis 1330
cgaauagaccaugccgc

SEQ ID NO: 2477941 - RNA, 21 nt, Brucella suis 1330
cgaauagcgcaucgccaccgu

SEQ ID NO: 2477942 - RNA, 20 nt, Brucella suis 1330
cgaauagggaaacggccagg

SEQ ID NO: 2477943 - RNA, 14 nt, Brucella suis 1330
cgaauaucuugaag

SEQ ID NO: 2477944 - RNA, 23 nt, Brucella suis 1330
cgaaugaaccggcucugcggaaa

SEQ ID NO: 2477945 - RNA, 15 nt, Brucella suis 1330
cgaaugacuucaucg

SEQ ID NO: 2477946 - RNA, 13 nt, Brucella suis 1330
cgaaugcccuuga

SEQ ID NO: 2477947 - RNA, 16 nt, Brucella suis 1330
cgaauggcuugcugga

SEQ ID NO: 2477948 - RNA, 24 nt, Brucella suis 1330
cgaauucagagcgauuucuggagc

SEQ ID NO: 2477949 - RNA, 20 nt, Brucella suis 1330
cgaauuccucuccgcccaua

SEQ ID NO: 2477950 - RNA, 21 nt, Brucella suis 1330
cgaauuccucuccgcccauac

SEQ ID NO: 2477951 - RNA, 16 nt, Brucella suis 1330
cgaauuuggugcccuu

SEQ ID NO: 2477952 - RNA, 15 nt, Brucella suis 1330
cgacaaaacaaauag

SEQ ID NO: 2477953 - RNA, 16 nt, Brucella suis 1330
cgacaaagaucaucgc

SEQ ID NO: 2477954 - RNA, 20 nt, Brucella suis 1330
cgacaaccacgcuugcgccc

SEQ ID NO: 2477955 - RNA, 16 nt, Brucella suis 1330
cgacaaucggaacaaa

SEQ ID NO: 2477956 - RNA, 22 nt, Brucella suis 1330
cgacacauccguuacacgcccc

SEQ ID NO: 2477957 - RNA, 15 nt, Brucella suis 1330
cgacacggccgaucg

SEQ ID NO: 2477958 - RNA, 16 nt, Brucella suis 1330
cgacacggccgaucgc

SEQ ID NO: 2477959 - RNA, 14 nt, Brucella suis 1330
cgacacguccggga

SEQ ID NO: 2477960 - RNA, 17 nt, Brucella suis 1330
cgacacguccgggaagc

SEQ ID NO: 2477961 - RNA, 19 nt, Brucella suis 1330
cgacagauugagauagccu

SEQ ID NO: 2477962 - RNA, 14 nt, Brucella suis 1330
cgacagcacugcca

SEQ ID NO: 2477963 - RNA, 22 nt, Brucella suis 1330
cgacagccggucaaaacgcccc

SEQ ID NO: 2477964 - RNA, 21 nt, Brucella suis 1330
cgacagcggcgcgccugggcu

SEQ ID NO: 2477965 - RNA, 17 nt, Brucella suis 1330
cgacaggguaagcgccu

SEQ ID NO: 2477966 - RNA, 18 nt, Brucella suis 1330
cgacaggguaagcgccuu

SEQ ID NO: 2477967 - RNA, 15 nt, Brucella suis 1330
cgacauauucuuccg

SEQ ID NO: 2477968 - RNA, 15 nt, Brucella suis 1330
cgacauccaucggcu

SEQ ID NO: 2477969 - RNA, 16 nt, Brucella suis 1330
cgacauccaucggcuc

SEQ ID NO: 2477970 - RNA, 17 nt, Brucella suis 1330
cgacaucgcgcuuggau

SEQ ID NO: 2477971 - RNA, 13 nt, Brucella suis 1330
cgacaugcugaaa

SEQ ID NO: 2477972 - RNA, 17 nt, Brucella suis 1330
cgacauguuuuggaaag

SEQ ID NO: 2477973 - RNA, 19 nt, Brucella suis 1330
cgacauuggugaugcgccc

SEQ ID NO: 2477974 - RNA, 18 nt, Brucella suis 1330
cgaccaguaaggcgggcg

SEQ ID NO: 2477975 - RNA, 13 nt, Brucella suis 1330
cgaccauggcgca

SEQ ID NO: 2477976 - RNA, 18 nt, Brucella suis 1330
cgaccauggcgcauucag

SEQ ID NO: 2477977 - RNA, 17 nt, Brucella suis 1330
cgaccauggcggaaccc

SEQ ID NO: 2477978 - RNA, 20 nt, Brucella suis 1330
cgaccgaaugaaccggcucu

SEQ ID NO: 2477979 - RNA, 23 nt, Brucella suis 1330
cgaccgcguucagaucgacgcag

SEQ ID NO: 2477980 - RNA, 13 nt, Brucella suis 1330
cgaccggucgaag

SEQ ID NO: 2477981 - RNA, 23 nt, Brucella suis 1330
cgaccugagccucgggcagugaa

SEQ ID NO: 2477982 - RNA, 20 nt, Brucella suis 1330
cgaccuucgaguucgccagc

SEQ ID NO: 2477983 - RNA, 15 nt, Brucella suis 1330
cgaccuugagccccu

SEQ ID NO: 2477984 - RNA, 18 nt, Brucella suis 1330
cgacgaggccugaaagcu

SEQ ID NO: 2477985 - RNA, 16 nt, Brucella suis 1330
cgacggcgugaugcgc

SEQ ID NO: 2477986 - RNA, 13 nt, Brucella suis 1330
cgacgggcgagcg

SEQ ID NO: 2477987 - RNA, 14 nt, Brucella suis 1330
cgacgggcgagcgc

SEQ ID NO: 2477988 - RNA, 14 nt, Brucella suis 1330
cgacuccuuguaau

SEQ ID NO: 2477989 - RNA, 17 nt, Brucella suis 1330
cgacucuacgcugaucg

SEQ ID NO: 2477990 - RNA, 23 nt, Brucella suis 1330
cgacugcgaaugucaguugaucg

SEQ ID NO: 2477991 - RNA, 14 nt, Brucella suis 1330
cgacuggcggaauu

SEQ ID NO: 2477992 - RNA, 20 nt, Brucella suis 1330
cgacugucaccgccagcaga

SEQ ID NO: 2477993 - RNA, 18 nt, Brucella suis 1330
cgacuuccaguggaagca

SEQ ID NO: 2477994 - RNA, 21 nt, Brucella suis 1330
cgacuuuggccgucucugaag

SEQ ID NO: 2477995 - RNA, 20 nt, Brucella suis 1330
cgagaaaaagaugcgccggg

SEQ ID NO: 2477996 - RNA, 13 nt, Brucella suis 1330
cgagaaaagcgca

SEQ ID NO: 2477997 - RNA, 14 nt, Brucella suis 1330
cgagaacggcggcg

SEQ ID NO: 2477998 - RNA, 15 nt, Brucella suis 1330
cgagaacggcggcgg

SEQ ID NO: 2477999 - RNA, 22 nt, Brucella suis 1330
cgagaagcaucagcuugcccau

SEQ ID NO: 2478000 - RNA, 21 nt, Brucella suis 1330
cgagaagcgguguggcccggu

SEQ ID NO: 2478001 - RNA, 18 nt, Brucella suis 1330
cgagaagcucaacgccgu

SEQ ID NO: 2478002 - RNA, 14 nt, Brucella suis 1330
cgagaaugaccacg

SEQ ID NO: 2478003 - RNA, 21 nt, Brucella suis 1330
cgagaaugaggccgaugauga

SEQ ID NO: 2478004 - RNA, 18 nt, Brucella suis 1330
cgagaauggcaacacggc

SEQ ID NO: 2478005 - RNA, 19 nt, Brucella suis 1330
cgagaauggcaacacggcg

SEQ ID NO: 2478006 - RNA, 15 nt, Brucella suis 1330
cgagacaaggcaaug

SEQ ID NO: 2478007 - RNA, 15 nt, Brucella suis 1330
cgagaccugccauca

SEQ ID NO: 2478008 - RNA, 13 nt, Brucella suis 1330
cgagacggaacgc

SEQ ID NO: 2478009 - RNA, 22 nt, Brucella suis 1330
cgcaauucguggucaugcgcgc

SEQ ID NO: 2478010 - RNA, 19 nt, Brucella suis 1330
cgcaauugcgcaaggcccu

SEQ ID NO: 2478011 - RNA, 19 nt, Brucella suis 1330
cgcacaaauucauugaaau

SEQ ID NO: 2478012 - RNA, 19 nt, Brucella suis 1330
cgcacauaaaacgcgccga

SEQ ID NO: 2478013 - RNA, 17 nt, Brucella suis 1330
cgcacauaugcgauuuc

SEQ ID NO: 2478014 - RNA, 18 nt, Brucella suis 1330
cgcacaucgggucgaccu

SEQ ID NO: 2478015 - RNA, 15 nt, Brucella suis 1330
cgcaccagcuugagc

SEQ ID NO: 2478016 - RNA, 16 nt, Brucella suis 1330
cgcacccuauuccccu

SEQ ID NO: 2478017 - RNA, 21 nt, Brucella suis 1330
cgcaccgauauagagcagcac

SEQ ID NO: 2478018 - RNA, 20 nt, Brucella suis 1330
cgcaccgauggagcgcccga

SEQ ID NO: 2478019 - RNA, 14 nt, Brucella suis 1330
cgcaccgcacgcaa

SEQ ID NO: 2478020 - RNA, 16 nt, Brucella suis 1330
cgcaccgcacugggga

SEQ ID NO: 2478021 - RNA, 16 nt, Brucella suis 1330
cgcaccggcauggauc

SEQ ID NO: 2478022 - RNA, 18 nt, Brucella suis 1330
cgcaccgugcuccagaua

SEQ ID NO: 2478023 - RNA, 18 nt, Brucella suis 1330
cgcaccugacggcgcagc

SEQ ID NO: 2478024 - RNA, 15 nt, Brucella suis 1330
cgcaccuuccacauu

SEQ ID NO: 2478025 - RNA, 20 nt, Brucella suis 1330
cgcacgauuauccuuugacg

SEQ ID NO: 2478026 - RNA, 14 nt, Brucella suis 1330
cgcacgcaggacaa

SEQ ID NO: 2478027 - RNA, 15 nt, Brucella suis 1330
cgcacgccugccgcg

SEQ ID NO: 2478028 - RNA, 14 nt, Brucella suis 1330
cgcacggucuugcc

SEQ ID NO: 2478029 - RNA, 22 nt, Brucella suis 1330
cgcacuggggacauagacgcuu

SEQ ID NO: 2478030 - RNA, 16 nt, Brucella suis 1330
cgcagaaggcgcugca

SEQ ID NO: 2478031 - RNA, 15 nt, Brucella suis 1330
cgcagacgcagcgca

SEQ ID NO: 2478032 - RNA, 22 nt, Brucella suis 1330
cgcagccuuucaaugucgccgg

SEQ ID NO: 2478033 - RNA, 14 nt, Brucella suis 1330
cgcagcgacgacau

SEQ ID NO: 2478034 - RNA, 13 nt, Brucella suis 1330
cgcagcgccgcau

SEQ ID NO: 2478035 - RNA, 19 nt, Brucella suis 1330
cgcaggaacgcaucgagcu

SEQ ID NO: 2478036 - RNA, 15 nt, Brucella suis 1330
cgcaggacaagccgc

SEQ ID NO: 2478037 - RNA, 16 nt, Brucella suis 1330
cgcaggacaagccgcu

SEQ ID NO: 2478038 - RNA, 21 nt, Brucella suis 1330
cgcaggcagggaggagccgau

SEQ ID NO: 2478039 - RNA, 14 nt, Brucella suis 1330
cgcaggccgcggca

SEQ ID NO: 2478040 - RNA, 21 nt, Brucella suis 1330
cgcaggcgagcauggaucgcc

SEQ ID NO: 2478041 - RNA, 22 nt, Brucella suis 1330
cgcaggcggauauucgccgccu

SEQ ID NO: 2478042 - RNA, 21 nt, Brucella suis 1330
cgcaggcuuuauuccaucagc

SEQ ID NO: 2478043 - RNA, 16 nt, Brucella suis 1330
cgcagggucgcgaccu

SEQ ID NO: 2478044 - RNA, 16 nt, Brucella suis 1330
cgcaguucgcgcaucg

SEQ ID NO: 2478045 - RNA, 14 nt, Brucella suis 1330
cgcaguugcaccgc

SEQ ID NO: 2478046 - RNA, 14 nt, Brucella suis 1330
cgcauaaagcacag

SEQ ID NO: 2478047 - RNA, 13 nt, Brucella suis 1330
cgcauaagccccg

SEQ ID NO: 2478048 - RNA, 18 nt, Brucella suis 1330
cgcauaagccccggcauc

SEQ ID NO: 2478049 - RNA, 16 nt, Brucella suis 1330
cgcauagagccacgag

SEQ ID NO: 2478050 - RNA, 19 nt, Brucella suis 1330
cgcauaucgcgcgaccagg

SEQ ID NO: 2478051 - RNA, 17 nt, Brucella suis 1330
cgcaucauccugagcuu

SEQ ID NO: 2478052 - RNA, 18 nt, Brucella suis 1330
cgcauccagccggcgcau

SEQ ID NO: 2478053 - RNA, 22 nt, Brucella suis 1330
cgcaucgaucacaugcgcgccc

SEQ ID NO: 2478054 - RNA, 12 nt, Brucella suis 1330
cgcaucggccag

SEQ ID NO: 2478055 - RNA, 20 nt, Brucella suis 1330
cgcaugauccgcuccagauu

SEQ ID NO: 2478056 - RNA, 22 nt, Brucella suis 1330
cgcauggucucgucggcgguau

SEQ ID NO: 2478057 - RNA, 16 nt, Brucella suis 1330
cgcauucccuugaaau

SEQ ID NO: 2478058 - RNA, 17 nt, Brucella suis 1330
cgcauugccgaugacug

SEQ ID NO: 2478059 - RNA, 22 nt, Brucella suis 1330
cgccaagaagaacacagccccu

SEQ ID NO: 2478060 - RNA, 14 nt, Brucella suis 1330
cgccaagccagccc

SEQ ID NO: 2478061 - RNA, 18 nt, Brucella suis 1330
cgccaagccggcgcagcg

SEQ ID NO: 2478062 - RNA, 21 nt, Brucella suis 1330
cgccaagcuugaucgccgcac

SEQ ID NO: 2478063 - RNA, 18 nt, Brucella suis 1330
cgccaaggcugcgcgcaa

SEQ ID NO: 2478064 - RNA, 15 nt, Brucella suis 1330
cgccaauccccucac

SEQ ID NO: 2478065 - RNA, 23 nt, Brucella suis 1330
cgccaaucgccgcgauaucgucg

SEQ ID NO: 2478066 - RNA, 23 nt, Brucella suis 1330
cgccaaugcccugcugcaacaaa

SEQ ID NO: 2478067 - RNA, 23 nt, Brucella suis 1330
cgccaauggcauauuuggcggua

SEQ ID NO: 2478068 - RNA, 16 nt, Brucella suis 1330
cgccaccauggccgcc

SEQ ID NO: 2478069 - RNA, 19 nt, Brucella suis 1330
cgccaccgucaccggcugg

SEQ ID NO: 2478070 - RNA, 18 nt, Brucella suis 1330
cgccaccugcacuucacg

SEQ ID NO: 2478071 - RNA, 17 nt, Brucella suis 1330
cgccacuucccgcgccu

SEQ ID NO: 2478072 - RNA, 20 nt, Brucella suis 1330
cgccagaagcguaaugcccc

SEQ ID NO: 2478073 - RNA, 18 nt, Brucella suis 1330
cgccagacaaggcgcggg

SEQ ID NO: 2478074 - RNA, 20 nt, Brucella suis 1330
cgccagauaagacauggcuu

SEQ ID NO: 2478075 - RNA, 14 nt, Brucella suis 1330
cgccagauagagcg

SEQ ID NO: 2478076 - RNA, 20 nt, Brucella suis 1330
cgccagaucaugggcggcca

SEQ ID NO: 2478077 - RNA, 13 nt, Brucella suis 1330
cgccagcaccggc

SEQ ID NO: 2478078 - RNA, 19 nt, Brucella suis 1330
cgccagcacucugccaggc

SEQ ID NO: 2478079 - RNA, 17 nt, Brucella suis 1330
cgccagccgccagcagg

SEQ ID NO: 2478080 - RNA, 18 nt, Brucella suis 1330
cgccagccgccagcaggc

SEQ ID NO: 2478081 - RNA, 14 nt, Brucella suis 1330
cgccagccgcgauc

SEQ ID NO: 2478082 - RNA, 20 nt, Brucella suis 1330
cgccagcggugacgaucugg

SEQ ID NO: 2478083 - RNA, 17 nt, Brucella suis 1330
cgccagcggugcccuuu

SEQ ID NO: 2478084 - RNA, 20 nt, Brucella suis 1330
cgccagcucgccggcuucca

SEQ ID NO: 2478085 - RNA, 23 nt, Brucella suis 1330
cgccagcucgccggcuuccacgc

SEQ ID NO: 2478086 - RNA, 20 nt, Brucella suis 1330
cgccaggcaaaugcuccuuc

SEQ ID NO: 2478087 - RNA, 14 nt, Brucella suis 1330
cgccaguuccugaa

SEQ ID NO: 2478088 - RNA, 18 nt, Brucella suis 1330
cgccaguuucauuuccuc

SEQ ID NO: 2478089 - RNA, 18 nt, Brucella suis 1330
cgccaguuuucgcggcag

SEQ ID NO: 2478090 - RNA, 19 nt, Brucella suis 1330
cgccaguuuucgcggcaga

SEQ ID NO: 2478091 - RNA, 18 nt, Brucella suis 1330
cgccauaaccucgacggc

SEQ ID NO: 2478092 - RNA, 16 nt, Brucella suis 1330
cgccauagaacagcaa

SEQ ID NO: 2478093 - RNA, 13 nt, Brucella suis 1330
cgccauauccgcc

SEQ ID NO: 2478094 - RNA, 14 nt, Brucella suis 1330
cgccauauugggag

SEQ ID NO: 2478095 - RNA, 14 nt, Brucella suis 1330
cgccaucggcaagg

SEQ ID NO: 2478096 - RNA, 23 nt, Brucella suis 1330
cgccaugcacccgucgcuaccau

SEQ ID NO: 2478097 - RNA, 16 nt, Brucella suis 1330
cgccaugccauccucg

SEQ ID NO: 2478098 - RNA, 22 nt, Brucella suis 1330
cgccauggucgcgcaccagcuu

SEQ ID NO: 2478099 - RNA, 15 nt, Brucella suis 1330
cgccauugaccgccu

SEQ ID NO: 2478100 - RNA, 18 nt, Brucella suis 1330
cgccauugaccgccucga

SEQ ID NO: 2478101 - RNA, 22 nt, Brucella suis 1330
cgccauugcgcguugcgucggc

SEQ ID NO: 2478102 - RNA, 15 nt, Brucella suis 1330
cgccauuucccccaa

SEQ ID NO: 2478103 - RNA, 19 nt, Brucella suis 1330
cgcccagcgaauagaccau

SEQ ID NO: 2478104 - RNA, 17 nt, Brucella suis 1330
cgcccagcucgaaacau

SEQ ID NO: 2478105 - RNA, 17 nt, Brucella suis 1330
cgcccaugaucgcgcca

SEQ ID NO: 2478106 - RNA, 20 nt, Brucella suis 1330
cgcccauuuucuccaccagu

SEQ ID NO: 2478107 - RNA, 13 nt, Brucella suis 1330
cgccccauucgau

SEQ ID NO: 2478108 - RNA, 18 nt, Brucella suis 1330
cgcccccuugauaggcgc

SEQ ID NO: 2478109 - RNA, 14 nt, Brucella suis 1330
cgccccgugaucuu

SEQ ID NO: 2478110 - RNA, 18 nt, Brucella suis 1330
cgcccgaauugcggcuga

SEQ ID NO: 2478111 - RNA, 18 nt, Brucella suis 1330
cgcccgacaaagaucauc

SEQ ID NO: 2478112 - RNA, 18 nt, Brucella suis 1330
cgcccgauauccggcugg

SEQ ID NO: 2478113 - RNA, 13 nt, Brucella suis 1330
cgcccgcccccgc

SEQ ID NO: 2478114 - RNA, 17 nt, Brucella suis 1330
cgcccgcccccgcgcuu

SEQ ID NO: 2478115 - RNA, 11 nt, Brucella suis 1330
cgcccgcccgc

SEQ ID NO: 2478116 - RNA, 13 nt, Brucella suis 1330
cgcccgccucgca

SEQ ID NO: 2478117 - RNA, 21 nt, Brucella suis 1330
cgcccgccucgcaggcaaagc

SEQ ID NO: 2478118 - RNA, 18 nt, Brucella suis 1330
cgcccgcggccacaagcg

SEQ ID NO: 2478119 - RNA, 19 nt, Brucella suis 1330
cgcccggcauccgaggcgc

SEQ ID NO: 2478120 - RNA, 17 nt, Brucella suis 1330
cgcccggucggaaagau

SEQ ID NO: 2478121 - RNA, 14 nt, Brucella suis 1330
cgcccgguuccggc

SEQ ID NO: 2478122 - RNA, 18 nt, Brucella suis 1330
cgcccgguuccggcguca

SEQ ID NO: 2478123 - RNA, 17 nt, Brucella suis 1330
cgcccgucaccgcggcu

SEQ ID NO: 2478124 - RNA, 22 nt, Brucella suis 1330
cgcccgucccccaacgugcggu

SEQ ID NO: 2478125 - RNA, 14 nt, Brucella suis 1330
cgcgcccgccacau

SEQ ID NO: 2478126 - RNA, 14 nt, Brucella suis 1330
cgcgcccggcggcu

SEQ ID NO: 2478127 - RNA, 13 nt, Brucella suis 1330
cgcgcccucgcgc

SEQ ID NO: 2478128 - RNA, 17 nt, Brucella suis 1330
cgcgcccucgcgcucgg

SEQ ID NO: 2478129 - RNA, 17 nt, Brucella suis 1330
cgcgccgaaaaucggca

SEQ ID NO: 2478130 - RNA, 14 nt, Brucella suis 1330
cgcgccgaaccggg

SEQ ID NO: 2478131 - RNA, 16 nt, Brucella suis 1330
cgcgccgaaccgggcc

SEQ ID NO: 2478132 - RNA, 14 nt, Brucella suis 1330
cgcgccgccuucaa

SEQ ID NO: 2478133 - RNA, 23 nt, Brucella suis 1330
cgcgccgcuggugcgauccacca

SEQ ID NO: 2478134 - RNA, 19 nt, Brucella suis 1330
cgcgccgcuugccagcacc

SEQ ID NO: 2478135 - RNA, 15 nt, Brucella suis 1330
cgcgccucacccucc

SEQ ID NO: 2478136 - RNA, 16 nt, Brucella suis 1330
cgcgccucacccucca

SEQ ID NO: 2478137 - RNA, 19 nt, Brucella suis 1330
cgcgccucacccuccaccg

SEQ ID NO: 2478138 - RNA, 22 nt, Brucella suis 1330
cgcgcgaccagguugcgccgau

SEQ ID NO: 2478139 - RNA, 17 nt, Brucella suis 1330
cgcgcgccaucggcaag

SEQ ID NO: 2478140 - RNA, 12 nt, Brucella suis 1330
cgcgcgcggccc

SEQ ID NO: 2478141 - RNA, 14 nt, Brucella suis 1330
cgcgcggcaugaaa

SEQ ID NO: 2478142 - RNA, 19 nt, Brucella suis 1330
cgcgcggccccgauuuugg

SEQ ID NO: 2478143 - RNA, 18 nt, Brucella suis 1330
cgcgcggcuuccagcgcc

SEQ ID NO: 2478144 - RNA, 22 nt, Brucella suis 1330
cgcgcgguugauaucgcggauc

SEQ ID NO: 2478145 - RNA, 19 nt, Brucella suis 1330
cgcgcuaaaaagcgcgcgc

SEQ ID NO: 2478146 - RNA, 20 nt, Brucella suis 1330
cgcgcuaaaaagcgcgcgca

SEQ ID NO: 2478147 - RNA, 21 nt, Brucella suis 1330
cgcgcuccacauccacccgcg

SEQ ID NO: 2478148 - RNA, 12 nt, Brucella suis 1330
cgcgcuccagau

SEQ ID NO: 2478149 - RNA, 12 nt, Brucella suis 1330
cgcgcucgccgc

SEQ ID NO: 2478150 - RNA, 13 nt, Brucella suis 1330
cgcgcucggcaag

SEQ ID NO: 2478151 - RNA, 14 nt, Brucella suis 1330
cgcgcucggcaagc

SEQ ID NO: 2478152 - RNA, 23 nt, Brucella suis 1330
cgcgcucggcaagcgcggucagc

SEQ ID NO: 2478153 - RNA, 21 nt, Brucella suis 1330
cgcgcugcaauggucgacaau

SEQ ID NO: 2478154 - RNA, 15 nt, Brucella suis 1330
cgcgcuuaugaucug

SEQ ID NO: 2478155 - RNA, 16 nt, Brucella suis 1330
cgcgcuuggcgaagcc

SEQ ID NO: 2478156 - RNA, 19 nt, Brucella suis 1330
cgcgcuuuccccgggcagc

SEQ ID NO: 2478157 - RNA, 16 nt, Brucella suis 1330
cgcggaaaagcucgcg

SEQ ID NO: 2478158 - RNA, 20 nt, Brucella suis 1330
cgcggaaaagcucgcguccc

SEQ ID NO: 2478159 - RNA, 23 nt, Brucella suis 1330
cgcggaaaauguuccgcaccgca

SEQ ID NO: 2478160 - RNA, 14 nt, Brucella suis 1330
cgcggaaugacaug

SEQ ID NO: 2478161 - RNA, 22 nt, Brucella suis 1330
cgcggacgggcaggcagaugcg

SEQ ID NO: 2478162 - RNA, 16 nt, Brucella suis 1330
cgcggauaucggcgcg

SEQ ID NO: 2478163 - RNA, 18 nt, Brucella suis 1330
cgcggauaucggcgcgga

SEQ ID NO: 2478164 - RNA, 13 nt, Brucella suis 1330
cgcggaucggcag

SEQ ID NO: 2478165 - RNA, 23 nt, Brucella suis 1330
cgcggcaagauagccccagcccg

SEQ ID NO: 2478166 - RNA, 14 nt, Brucella suis 1330
cgcggcaaugcgcu

SEQ ID NO: 2478167 - RNA, 20 nt, Brucella suis 1330
cgcggcagauaaagcgcaag

SEQ ID NO: 2478168 - RNA, 16 nt, Brucella suis 1330
cgcggcagcuaugcgc

SEQ ID NO: 2478169 - RNA, 18 nt, Brucella suis 1330
cgcggcagcuaugcgcca

SEQ ID NO: 2478170 - RNA, 19 nt, Brucella suis 1330
cgcggcaugaaagcgcaau

SEQ ID NO: 2478171 - RNA, 13 nt, Brucella suis 1330
cgcggccacaagc

SEQ ID NO: 2478172 - RNA, 22 nt, Brucella suis 1330
cgcggccuugauccgucacggu

SEQ ID NO: 2478173 - RNA, 23 nt, Brucella suis 1330
cgcggcgaaacgccugucacgau

SEQ ID NO: 2478174 - RNA, 15 nt, Brucella suis 1330
cgcggcgcauggccu

SEQ ID NO: 2478175 - RNA, 19 nt, Brucella suis 1330
cgcggcgguuuugagcugc

SEQ ID NO: 2478176 - RNA, 15 nt, Brucella suis 1330
cgcggcguggaaagc

SEQ ID NO: 2478177 - RNA, 21 nt, Brucella suis 1330
cgcggcguggaaagcuggacc

SEQ ID NO: 2478178 - RNA, 18 nt, Brucella suis 1330
cgcggcucaagcuccagc

SEQ ID NO: 2478179 - RNA, 18 nt, Brucella suis 1330
cgcggcuugcgcgacgau

SEQ ID NO: 2478180 - RNA, 18 nt, Brucella suis 1330
cgcgggaaaaaucgcgcg

SEQ ID NO: 2478181 - RNA, 20 nt, Brucella suis 1330
cgcgggcuucugcgcccgcg

SEQ ID NO: 2478182 - RNA, 17 nt, Brucella suis 1330
cgcgggggcccagaugu

SEQ ID NO: 2478183 - RNA, 17 nt, Brucella suis 1330
cgcgguuugcaagccgc

SEQ ID NO: 2478184 - RNA, 16 nt, Brucella suis 1330
cgcguaagcggcaauc

SEQ ID NO: 2478185 - RNA, 21 nt, Brucella suis 1330
cgcguaucggcaaaugucacg

SEQ ID NO: 2478186 - RNA, 13 nt, Brucella suis 1330
cgcgucagccggu

SEQ ID NO: 2478187 - RNA, 14 nt, Brucella suis 1330
cgcgucccgcacgc

SEQ ID NO: 2478188 - RNA, 16 nt, Brucella suis 1330
cgcgucgagcaaugcg

SEQ ID NO: 2478189 - RNA, 15 nt, Brucella suis 1330
cgcgugcacgcgcag

SEQ ID NO: 2478190 - RNA, 14 nt, Brucella suis 1330
cgcgugcacgcggg

SEQ ID NO: 2478191 - RNA, 20 nt, Brucella suis 1330
cgcgugcggucgccgcccgg

SEQ ID NO: 2478192 - RNA, 14 nt, Brucella suis 1330
cgcguugcggccgg

SEQ ID NO: 2478193 - RNA, 17 nt, Brucella suis 1330
cgcuacccauucauuuc

SEQ ID NO: 2478194 - RNA, 17 nt, Brucella suis 1330
cgcuacguggcuugaag

SEQ ID NO: 2478195 - RNA, 18 nt, Brucella suis 1330
cgcuaucagcucuucaca

SEQ ID NO: 2478196 - RNA, 22 nt, Brucella suis 1330
cgcuaucucuccuaaacucauc

SEQ ID NO: 2478197 - RNA, 21 nt, Brucella suis 1330
cgcucaccuuuuccaccggcc

SEQ ID NO: 2478198 - RNA, 21 nt, Brucella suis 1330
cgcucauauggaugccgccgc

SEQ ID NO: 2478199 - RNA, 12 nt, Brucella suis 1330
cgcucaucgcag

SEQ ID NO: 2478200 - RNA, 19 nt, Brucella suis 1330
cgcucaucgcaguugcacc

SEQ ID NO: 2478201 - RNA, 20 nt, Brucella suis 1330
cgcuccacacgaacagcagc

SEQ ID NO: 2478202 - RNA, 23 nt, Brucella suis 1330
cgcuccacacgaacagcagcagg

SEQ ID NO: 2478203 - RNA, 20 nt, Brucella suis 1330
cgcuccaugcggucggccgc

SEQ ID NO: 2478204 - RNA, 14 nt, Brucella suis 1330
cgcuccauucccau

SEQ ID NO: 2478205 - RNA, 19 nt, Brucella suis 1330
cgcuccgcccuggcggcgu

SEQ ID NO: 2478206 - RNA, 13 nt, Brucella suis 1330
cgcuccuauuucu

SEQ ID NO: 2478207 - RNA, 17 nt, Brucella suis 1330
cgcucgaaggcagccgu

SEQ ID NO: 2478208 - RNA, 19 nt, Brucella suis 1330
cgcucgaccgcaccucugg

SEQ ID NO: 2478209 - RNA, 15 nt, Brucella suis 1330
cgcucgcauagccga

SEQ ID NO: 2478210 - RNA, 21 nt, Brucella suis 1330
cgcucucgucgagaagcauca

SEQ ID NO: 2478211 - RNA, 23 nt, Brucella suis 1330
cgcucuggaauuucuaaaaugaa

SEQ ID NO: 2478212 - RNA, 18 nt, Brucella suis 1330
cgcucuggacgaaaggcg

SEQ ID NO: 2478213 - RNA, 19 nt, Brucella suis 1330
cgcucuucggggcggccuu

SEQ ID NO: 2478214 - RNA, 21 nt, Brucella suis 1330
cgcugaggcggccggagcgca

SEQ ID NO: 2478215 - RNA, 21 nt, Brucella suis 1330
cgcugaucgcaagcaggcauu

SEQ ID NO: 2478216 - RNA, 12 nt, Brucella suis 1330
cgcugcaacaaa

SEQ ID NO: 2478217 - RNA, 13 nt, Brucella suis 1330
cgcugcaacaaau

SEQ ID NO: 2478218 - RNA, 23 nt, Brucella suis 1330
cgcugccgguaucaagcuucaua

SEQ ID NO: 2478219 - RNA, 19 nt, Brucella suis 1330
cgcugcgacgagaugcgcu

SEQ ID NO: 2478220 - RNA, 13 nt, Brucella suis 1330
cgcugcgggcagc

SEQ ID NO: 2478221 - RNA, 17 nt, Brucella suis 1330
cgcugcgguagcgcaug

SEQ ID NO: 2478222 - RNA, 14 nt, Brucella suis 1330
cgcugcucgcgcaa

SEQ ID NO: 2478223 - RNA, 15 nt, Brucella suis 1330
cgcuggccuugccau

SEQ ID NO: 2478224 - RNA, 14 nt, Brucella suis 1330
cgcuggcgcggcgg

SEQ ID NO: 2478225 - RNA, 16 nt, Brucella suis 1330
cgcuguaucaagcgau

SEQ ID NO: 2478226 - RNA, 12 nt, Brucella suis 1330
cgcuuccggcug

SEQ ID NO: 2478227 - RNA, 12 nt, Brucella suis 1330
cgcuuccuccag

SEQ ID NO: 2478228 - RNA, 15 nt, Brucella suis 1330
cgcuucgaugcgcug

SEQ ID NO: 2478229 - RNA, 13 nt, Brucella suis 1330
cgcuucgaugcgu

SEQ ID NO: 2478230 - RNA, 22 nt, Brucella suis 1330
cgcuucgcgcaggccgcggcau

SEQ ID NO: 2478231 - RNA, 12 nt, Brucella suis 1330
cgcuucuucauu

SEQ ID NO: 2478232 - RNA, 20 nt, Brucella suis 1330
cgcuucuuccuucggcaagg

SEQ ID NO: 2478233 - RNA, 21 nt, Brucella suis 1330
cgcuucuuccuucggcaaggg

SEQ ID NO: 2478234 - RNA, 23 nt, Brucella suis 1330
cgcuucuuccuucggcaagggca

SEQ ID NO: 2478235 - RNA, 12 nt, Brucella suis 1330
cgcuugaugccu

SEQ ID NO: 2478236 - RNA, 20 nt, Brucella suis 1330
cgcuugcccgcauauugcuu

SEQ ID NO: 2478237 - RNA, 15 nt, Brucella suis 1330
cgcuugcguuccucu

SEQ ID NO: 2478238 - RNA, 13 nt, Brucella suis 1330
cgcuuggcaccgc

SEQ ID NO: 2478239 - RNA, 20 nt, Brucella suis 1330
cgcuuucuucgauggugagu

SEQ ID NO: 2478240 - RNA, 20 nt, Brucella suis 1330
cgcuuuuacgcgccgccagg

SEQ ID NO: 2478241 - RNA, 18 nt, Brucella suis 1330
cggaaaacggcugcaaca

SEQ ID NO: 2478242 - RNA, 20 nt, Brucella suis 1330
cggcccaaaggccgcgccga

SEQ ID NO: 2478243 - RNA, 17 nt, Brucella suis 1330
cggcccgauuccuccgg

SEQ ID NO: 2478244 - RNA, 23 nt, Brucella suis 1330
cggcccggucacccgcacgccgu

SEQ ID NO: 2478245 - RNA, 19 nt, Brucella suis 1330
cggcccgguccgcgcucgu

SEQ ID NO: 2478246 - RNA, 15 nt, Brucella suis 1330
cggcccggugcagcg

SEQ ID NO: 2478247 - RNA, 19 nt, Brucella suis 1330
cggcccuggaaagaagcga

SEQ ID NO: 2478248 - RNA, 16 nt, Brucella suis 1330
cggccgcccuugcgca

SEQ ID NO: 2478249 - RNA, 16 nt, Brucella suis 1330
cggccggagcgcagau

SEQ ID NO: 2478250 - RNA, 17 nt, Brucella suis 1330
cggccggagcgcagauc

SEQ ID NO: 2478251 - RNA, 16 nt, Brucella suis 1330
cggccuaccauauccu

SEQ ID NO: 2478252 - RNA, 15 nt, Brucella suis 1330
cggccucgccugcaa

SEQ ID NO: 2478253 - RNA, 15 nt, Brucella suis 1330
cggccugaaacagca

SEQ ID NO: 2478254 - RNA, 20 nt, Brucella suis 1330
cggccugaaacagcauauug

SEQ ID NO: 2478255 - RNA, 17 nt, Brucella suis 1330
cggccugaccggccacc

SEQ ID NO: 2478256 - RNA, 17 nt, Brucella suis 1330
cggccugaugcaaugcg

SEQ ID NO: 2478257 - RNA, 14 nt, Brucella suis 1330
cggccugaugccuu

SEQ ID NO: 2478258 - RNA, 20 nt, Brucella suis 1330
cggccuugacggagagaggg

SEQ ID NO: 2478259 - RNA, 17 nt, Brucella suis 1330
cggccuugaucggcaug

SEQ ID NO: 2478260 - RNA, 13 nt, Brucella suis 1330
cggccuuugcgcc

SEQ ID NO: 2478261 - RNA, 16 nt, Brucella suis 1330
cggccuuugcgccggg

SEQ ID NO: 2478262 - RNA, 14 nt, Brucella suis 1330
cggcgaaacgccug

SEQ ID NO: 2478263 - RNA, 15 nt, Brucella suis 1330
cggcgaaacgccugu

SEQ ID NO: 2478264 - RNA, 24 nt, Brucella suis 1330
cggcgaaagccuugagauccgcau

SEQ ID NO: 2478265 - RNA, 17 nt, Brucella suis 1330
cggcgaacgagcggcca

SEQ ID NO: 2478266 - RNA, 17 nt, Brucella suis 1330
cggcgaccgccuuuucc

SEQ ID NO: 2478267 - RNA, 21 nt, Brucella suis 1330
cggcgaguugccacgcgccgc

SEQ ID NO: 2478268 - RNA, 12 nt, Brucella suis 1330
cggcgauuucgc

SEQ ID NO: 2478269 - RNA, 16 nt, Brucella suis 1330
cggcgcaaaggccggg

SEQ ID NO: 2478270 - RNA, 15 nt, Brucella suis 1330
cggcgcagcgcgacc

SEQ ID NO: 2478271 - RNA, 16 nt, Brucella suis 1330
cggcgcagcgcgaccu

SEQ ID NO: 2478272 - RNA, 12 nt, Brucella suis 1330
cggcgcaggcag

SEQ ID NO: 2478273 - RNA, 23 nt, Brucella suis 1330
cggcgcaguuucgcagccaagau

SEQ ID NO: 2478274 - RNA, 16 nt, Brucella suis 1330
cggcgcaucauccuga

SEQ ID NO: 2478275 - RNA, 20 nt, Brucella suis 1330
cggcgcauggccucaagugc

SEQ ID NO: 2478276 - RNA, 19 nt, Brucella suis 1330
cggcgcauucaggcggccu

SEQ ID NO: 2478277 - RNA, 17 nt, Brucella suis 1330
cggcgccuugaugccgc

SEQ ID NO: 2478278 - RNA, 19 nt, Brucella suis 1330
cggcgccuugaugccgcuc

SEQ ID NO: 2478279 - RNA, 14 nt, Brucella suis 1330
cggcgcgaaacgcc

SEQ ID NO: 2478280 - RNA, 15 nt, Brucella suis 1330
cggcgcgaccgcguu

SEQ ID NO: 2478281 - RNA, 12 nt, Brucella suis 1330
cggcgcgcugca

SEQ ID NO: 2478282 - RNA, 17 nt, Brucella suis 1330
cggcgcgcugcaauggu

SEQ ID NO: 2478283 - RNA, 13 nt, Brucella suis 1330
cggcgcggcggca

SEQ ID NO: 2478284 - RNA, 16 nt, Brucella suis 1330
cggcgcugcucgcgca

SEQ ID NO: 2478285 - RNA, 17 nt, Brucella suis 1330
cggcggaacugcauggg

SEQ ID NO: 2478286 - RNA, 13 nt, Brucella suis 1330
cggcggaagcggc

SEQ ID NO: 2478287 - RNA, 18 nt, Brucella suis 1330
cggcggauaaugcucgcc

SEQ ID NO: 2478288 - RNA, 15 nt, Brucella suis 1330
cggcggauuucaucg

SEQ ID NO: 2478289 - RNA, 13 nt, Brucella suis 1330
cggcggcaggcag

SEQ ID NO: 2478290 - RNA, 22 nt, Brucella suis 1330
cggcggcgccaccgucaccggc

SEQ ID NO: 2478291 - RNA, 17 nt, Brucella suis 1330
cggcggcgucagcuugu

SEQ ID NO: 2478292 - RNA, 23 nt, Brucella suis 1330
cggcggcgucagcuugucgagcg

SEQ ID NO: 2478293 - RNA, 14 nt, Brucella suis 1330
cggcggcuccagcc

SEQ ID NO: 2478294 - RNA, 22 nt, Brucella suis 1330
cggcggcugaaaucugcgccgg

SEQ ID NO: 2478295 - RNA, 14 nt, Brucella suis 1330
cggcggcuucgauc

SEQ ID NO: 2478296 - RNA, 14 nt, Brucella suis 1330
cggcgggagcggca

SEQ ID NO: 2478297 - RNA, 16 nt, Brucella suis 1330
cggcgggagcggcaca

SEQ ID NO: 2478298 - RNA, 15 nt, Brucella suis 1330
cggcgggcgggcgau

SEQ ID NO: 2478299 - RNA, 21 nt, Brucella suis 1330
cggcggugaagaagcgccagc

SEQ ID NO: 2478300 - RNA, 17 nt, Brucella suis 1330
cggcgguucggcugccu

SEQ ID NO: 2478301 - RNA, 16 nt, Brucella suis 1330
cggcgguugugcgccc

SEQ ID NO: 2478302 - RNA, 18 nt, Brucella suis 1330
cggcgguugugcgccccg

SEQ ID NO: 2478303 - RNA, 19 nt, Brucella suis 1330
cggcgucagcuugaccaga

SEQ ID NO: 2478304 - RNA, 15 nt, Brucella suis 1330
cggcgucagggcauu

SEQ ID NO: 2478305 - RNA, 18 nt, Brucella suis 1330
cggcgucagggcauugcc

SEQ ID NO: 2478306 - RNA, 17 nt, Brucella suis 1330
cggcgucaguggcagca

SEQ ID NO: 2478307 - RNA, 17 nt, Brucella suis 1330
cggcgucugccggagcg

SEQ ID NO: 2478308 - RNA, 22 nt, Brucella suis 1330
cggcguggugagcuugcgcagc

SEQ ID NO: 2478309 - RNA, 21 nt, Brucella suis 1330
cggcucauucggguugccuuc

SEQ ID NO: 2478310 - RNA, 20 nt, Brucella suis 1330
cggcucucacgcgcagcagc

SEQ ID NO: 2478311 - RNA, 17 nt, Brucella suis 1330
cggcucuugggagcggc

SEQ ID NO: 2478312 - RNA, 21 nt, Brucella suis 1330
cggcugaaagcgccaguucag

SEQ ID NO: 2478313 - RNA, 20 nt, Brucella suis 1330
cggcugaaaucugcgccggu

SEQ ID NO: 2478314 - RNA, 20 nt, Brucella suis 1330
cggcugaucuggaaggaaag

SEQ ID NO: 2478315 - RNA, 13 nt, Brucella suis 1330
cggcugcaacaaa

SEQ ID NO: 2478316 - RNA, 20 nt, Brucella suis 1330
cggcugcaacaaaagaagau

SEQ ID NO: 2478317 - RNA, 14 nt, Brucella suis 1330
cggcugcaucggcu

SEQ ID NO: 2478318 - RNA, 13 nt, Brucella suis 1330
cggcugcggcaau

SEQ ID NO: 2478319 - RNA, 13 nt, Brucella suis 1330
cggcugcggcgcc

SEQ ID NO: 2478320 - RNA, 17 nt, Brucella suis 1330
cggcugguuggccagau

SEQ ID NO: 2478321 - RNA, 17 nt, Brucella suis 1330
cggcugucccugcgggc

SEQ ID NO: 2478322 - RNA, 15 nt, Brucella suis 1330
cggcuguuacauaug

SEQ ID NO: 2478323 - RNA, 16 nt, Brucella suis 1330
cggcuguuuucgaggc

SEQ ID NO: 2478324 - RNA, 18 nt, Brucella suis 1330
cggcuucagaucgcgcgg

SEQ ID NO: 2478325 - RNA, 19 nt, Brucella suis 1330
cggcuucagaucgcgcggc

SEQ ID NO: 2478326 - RNA, 22 nt, Brucella suis 1330
cggcuuccagauugucuugauc

SEQ ID NO: 2478327 - RNA, 15 nt, Brucella suis 1330
cggcuuccagcgccu

SEQ ID NO: 2478328 - RNA, 14 nt, Brucella suis 1330
cggcuugccaccac

SEQ ID NO: 2478329 - RNA, 12 nt, Brucella suis 1330
cggcuugccauu

SEQ ID NO: 2478330 - RNA, 20 nt, Brucella suis 1330
cggcuuuacguccggcacga

SEQ ID NO: 2478331 - RNA, 17 nt, Brucella suis 1330
cggcuuucgccgcccuu

SEQ ID NO: 2478332 - RNA, 16 nt, Brucella suis 1330
cgggaaauaaaccguc

SEQ ID NO: 2478333 - RNA, 12 nt, Brucella suis 1330
cgggaaggcgcg

SEQ ID NO: 2478334 - RNA, 16 nt, Brucella suis 1330
cgggaauagccgagcu

SEQ ID NO: 2478335 - RNA, 15 nt, Brucella suis 1330
cgggaaugcggaagc

SEQ ID NO: 2478336 - RNA, 13 nt, Brucella suis 1330
cgggaccaccggc

SEQ ID NO: 2478337 - RNA, 20 nt, Brucella suis 1330
cgggagauguguaggcuggc

SEQ ID NO: 2478338 - RNA, 15 nt, Brucella suis 1330
cgggagcggaagugg

SEQ ID NO: 2478339 - RNA, 13 nt, Brucella suis 1330
cgggagcggcaca

SEQ ID NO: 2478340 - RNA, 23 nt, Brucella suis 1330
cgggaucaaugaucuggcuugca

SEQ ID NO: 2478341 - RNA, 22 nt, Brucella suis 1330
cgggaucagaaaucaguccagu

SEQ ID NO: 2478342 - RNA, 19 nt, Brucella suis 1330
cgggaugcgcuuuaaagca

SEQ ID NO: 2478343 - RNA, 23 nt, Brucella suis 1330
cgggaugcgcuuuaaagcaggau

SEQ ID NO: 2478344 - RNA, 15 nt, Brucella suis 1330
cgggauggagcgcac

SEQ ID NO: 2478345 - RNA, 22 nt, Brucella suis 1330
cgggcacgaaaagcaggaucag

SEQ ID NO: 2478346 - RNA, 16 nt, Brucella suis 1330
cgggcagcggcgcgcc

SEQ ID NO: 2478347 - RNA, 19 nt, Brucella suis 1330
cgggcaguccggcagccga

SEQ ID NO: 2478348 - RNA, 20 nt, Brucella suis 1330
cgggcagugaaagccgcguc

SEQ ID NO: 2478349 - RNA, 14 nt, Brucella suis 1330
cgggcauggaagcc

SEQ ID NO: 2478350 - RNA, 21 nt, Brucella suis 1330
cgggcauuguggugcgcaucu

SEQ ID NO: 2478351 - RNA, 19 nt, Brucella suis 1330
cgggccagguaucgugcag

SEQ ID NO: 2478352 - RNA, 22 nt, Brucella suis 1330
cgggccagguaucgugcagaag

SEQ ID NO: 2478353 - RNA, 15 nt, Brucella suis 1330
cgggccauuuccaau

SEQ ID NO: 2478354 - RNA, 21 nt, Brucella suis 1330
cgggccauuuccaaugccuca

SEQ ID NO: 2478355 - RNA, 22 nt, Brucella suis 1330
cgggcccuucgcuuucaauggc

SEQ ID NO: 2478356 - RNA, 21 nt, Brucella suis 1330
cgggcccuucucgacagccau

SEQ ID NO: 2478357 - RNA, 13 nt, Brucella suis 1330
cgggccuuuuuca

SEQ ID NO: 2478358 - RNA, 18 nt, Brucella suis 1330
cgggccuuuuucaugcug

SEQ ID NO: 2478359 - RNA, 19 nt, Brucella suis 1330
cgucauucaucagcacgaa

SEQ ID NO: 2478360 - RNA, 20 nt, Brucella suis 1330
cgucauuuccgugacgccgu

SEQ ID NO: 2478361 - RNA, 15 nt, Brucella suis 1330
cguccaccaccucgc

SEQ ID NO: 2478362 - RNA, 16 nt, Brucella suis 1330
cguccagcgcguugcc

SEQ ID NO: 2478363 - RNA, 20 nt, Brucella suis 1330
cguccagcgcguugccuugc

SEQ ID NO: 2478364 - RNA, 17 nt, Brucella suis 1330
cguccauccggcggcgc

SEQ ID NO: 2478365 - RNA, 18 nt, Brucella suis 1330
cguccaugagcgcaccau

SEQ ID NO: 2478366 - RNA, 21 nt, Brucella suis 1330
cguccccaucgaaaccggcau

SEQ ID NO: 2478367 - RNA, 19 nt, Brucella suis 1330
cgucccgcacgcaggacaa

SEQ ID NO: 2478368 - RNA, 21 nt, Brucella suis 1330
cguccgacaugggccgggcgc

SEQ ID NO: 2478369 - RNA, 15 nt, Brucella suis 1330
cguccgagcggcagc

SEQ ID NO: 2478370 - RNA, 13 nt, Brucella suis 1330
cguccgccaccgc

SEQ ID NO: 2478371 - RNA, 16 nt, Brucella suis 1330
cguccgccaccgccgg

SEQ ID NO: 2478372 - RNA, 19 nt, Brucella suis 1330
cguccggcacuucgcccag

SEQ ID NO: 2478373 - RNA, 12 nt, Brucella suis 1330
cguccggcuucg

SEQ ID NO: 2478374 - RNA, 17 nt, Brucella suis 1330
cguccgguugcaggcgc

SEQ ID NO: 2478375 - RNA, 17 nt, Brucella suis 1330
cguccgucgcgugagga

SEQ ID NO: 2478376 - RNA, 15 nt, Brucella suis 1330
cguccucaucgccgg

SEQ ID NO: 2478377 - RNA, 20 nt, Brucella suis 1330
cguccuucaggcccuugccg

SEQ ID NO: 2478378 - RNA, 14 nt, Brucella suis 1330
cguccuugacggga

SEQ ID NO: 2478379 - RNA, 22 nt, Brucella suis 1330
cgucgaaauccuucagaagcac

SEQ ID NO: 2478380 - RNA, 15 nt, Brucella suis 1330
cgucgagcaaugcgc

SEQ ID NO: 2478381 - RNA, 17 nt, Brucella suis 1330
cgucgagcagcaucuug

SEQ ID NO: 2478382 - RNA, 14 nt, Brucella suis 1330
cgucgaggaaaaag

SEQ ID NO: 2478383 - RNA, 19 nt, Brucella suis 1330
cgucgaggaaaaagcccgc

SEQ ID NO: 2478384 - RNA, 15 nt, Brucella suis 1330
cgucgauaucgagcg

SEQ ID NO: 2478385 - RNA, 17 nt, Brucella suis 1330
cgucgcagacgaugugc

SEQ ID NO: 2478386 - RNA, 21 nt, Brucella suis 1330
cgucgccagcucgccggcuuc

SEQ ID NO: 2478387 - RNA, 22 nt, Brucella suis 1330
cgucgccauuaguaucggcagc

SEQ ID NO: 2478388 - RNA, 20 nt, Brucella suis 1330
cgucgcgaaucucgaucuug

SEQ ID NO: 2478389 - RNA, 12 nt, Brucella suis 1330
cgucgcgcauca

SEQ ID NO: 2478390 - RNA, 21 nt, Brucella suis 1330
cgucggucaaugccaccgcga

SEQ ID NO: 2478391 - RNA, 16 nt, Brucella suis 1330
cgucguaaucgccggu

SEQ ID NO: 2478392 - RNA, 16 nt, Brucella suis 1330
cgucgugcagcggcga

SEQ ID NO: 2478393 - RNA, 19 nt, Brucella suis 1330
cgucguugaacuugcccgc

SEQ ID NO: 2478394 - RNA, 21 nt, Brucella suis 1330
cgucugaacggaucuugcgca

SEQ ID NO: 2478395 - RNA, 15 nt, Brucella suis 1330
cgucugauccgugag

SEQ ID NO: 2478396 - RNA, 21 nt, Brucella suis 1330
cgucugauuggguuuggcccc

SEQ ID NO: 2478397 - RNA, 15 nt, Brucella suis 1330
cgucugcaucgagcg

SEQ ID NO: 2478398 - RNA, 18 nt, Brucella suis 1330
cgucugcaucgagcggca

SEQ ID NO: 2478399 - RNA, 23 nt, Brucella suis 1330
cgugaagaauggcaagcagcaaa

SEQ ID NO: 2478400 - RNA, 20 nt, Brucella suis 1330
cgugaagauugcuucaggca

SEQ ID NO: 2478401 - RNA, 20 nt, Brucella suis 1330
cgugaccagccccugcacgu

SEQ ID NO: 2478402 - RNA, 15 nt, Brucella suis 1330
cgugaccagcgcaau

SEQ ID NO: 2478403 - RNA, 19 nt, Brucella suis 1330
cgugaccgccuggcccggc

SEQ ID NO: 2478404 - RNA, 18 nt, Brucella suis 1330
cgugacgagcgcacgcag

SEQ ID NO: 2478405 - RNA, 11 nt, Brucella suis 1330
cgugacggugc

SEQ ID NO: 2478406 - RNA, 22 nt, Brucella suis 1330
cgugagcuucaggucggcauug

SEQ ID NO: 2478407 - RNA, 22 nt, Brucella suis 1330
cgugaggccgguaaaauuggca

SEQ ID NO: 2478408 - RNA, 21 nt, Brucella suis 1330
cgugaucucauccacagucac

SEQ ID NO: 2478409 - RNA, 17 nt, Brucella suis 1330
cgugaugcgcaggcgcu

SEQ ID NO: 2478410 - RNA, 14 nt, Brucella suis 1330
cgugcaagagcaag

SEQ ID NO: 2478411 - RNA, 13 nt, Brucella suis 1330
cgugcaggcugcc

SEQ ID NO: 2478412 - RNA, 16 nt, Brucella suis 1330
cgugcauucugccggu

SEQ ID NO: 2478413 - RNA, 20 nt, Brucella suis 1330
cgugccaucggugccugacu

SEQ ID NO: 2478414 - RNA, 16 nt, Brucella suis 1330
cgugccgguauccggc

SEQ ID NO: 2478415 - RNA, 16 nt, Brucella suis 1330
cgugccuugaauagcg

SEQ ID NO: 2478416 - RNA, 13 nt, Brucella suis 1330
cgugcgauagccc

SEQ ID NO: 2478417 - RNA, 20 nt, Brucella suis 1330
cgugcgccugaggccggacg

SEQ ID NO: 2478418 - RNA, 13 nt, Brucella suis 1330
cgugcggaagcga

SEQ ID NO: 2478419 - RNA, 13 nt, Brucella suis 1330
cgugcggccgcag

SEQ ID NO: 2478420 - RNA, 15 nt, Brucella suis 1330
cgugcuccagauacc

SEQ ID NO: 2478421 - RNA, 15 nt, Brucella suis 1330
cguggagcaggccau

SEQ ID NO: 2478422 - RNA, 22 nt, Brucella suis 1330
cguggagggauaggugagcggc

SEQ ID NO: 2478423 - RNA, 19 nt, Brucella suis 1330
cguggcaagcccgcugcgc

SEQ ID NO: 2478424 - RNA, 22 nt, Brucella suis 1330
cguggcaagcccgcugcgccgc

SEQ ID NO: 2478425 - RNA, 22 nt, Brucella suis 1330
cguggcgaagaucgaagcgaaa

SEQ ID NO: 2478426 - RNA, 18 nt, Brucella suis 1330
cguggcgauggucgcaag

SEQ ID NO: 2478427 - RNA, 19 nt, Brucella suis 1330
cguggcggcaaaaagcggc

SEQ ID NO: 2478428 - RNA, 21 nt, Brucella suis 1330
cguggcuugaagcugccgcgg

SEQ ID NO: 2478429 - RNA, 18 nt, Brucella suis 1330
cguggcuuuuccggcggc

SEQ ID NO: 2478430 - RNA, 19 nt, Brucella suis 1330
cguggcuuuuccggcggcg

SEQ ID NO: 2478431 - RNA, 18 nt, Brucella suis 1330
cgugggccaaccggcaga

SEQ ID NO: 2478432 - RNA, 14 nt, Brucella suis 1330
cgugguaugccagc

SEQ ID NO: 2478433 - RNA, 13 nt, Brucella suis 1330
cguggucaugcgc

SEQ ID NO: 2478434 - RNA, 18 nt, Brucella suis 1330
cguggucauggccacgcc

SEQ ID NO: 2478435 - RNA, 21 nt, Brucella suis 1330
cguggucauggccacgccagc

SEQ ID NO: 2478436 - RNA, 18 nt, Brucella suis 1330
cguggucgccucuucauc

SEQ ID NO: 2478437 - RNA, 21 nt, Brucella suis 1330
cguggugagugcgaaagcacc

SEQ ID NO: 2478438 - RNA, 17 nt, Brucella suis 1330
cguguacuugaucugcu

SEQ ID NO: 2478439 - RNA, 19 nt, Brucella suis 1330
cguguagccgcgaaccguc

SEQ ID NO: 2478440 - RNA, 21 nt, Brucella suis 1330
cguguagggcaaggagcgagc

SEQ ID NO: 2478441 - RNA, 21 nt, Brucella suis 1330
cgugucauuguuaaagcggau

SEQ ID NO: 2478442 - RNA, 19 nt, Brucella suis 1330
cgugucgauugccugugcg

SEQ ID NO: 2478443 - RNA, 15 nt, Brucella suis 1330
cgugucuugcccaga

SEQ ID NO: 2478444 - RNA, 21 nt, Brucella suis 1330
cgugugcuugccgaaaagccg

SEQ ID NO: 2478445 - RNA, 19 nt, Brucella suis 1330
cguguugaccacauugccc

SEQ ID NO: 2478446 - RNA, 16 nt, Brucella suis 1330
cguguugagaucgcgc

SEQ ID NO: 2478447 - RNA, 18 nt, Brucella suis 1330
cguguuuauucaucgucu

SEQ ID NO: 2478448 - RNA, 19 nt, Brucella suis 1330
cguuaauuccacgcgccga

SEQ ID NO: 2478449 - RNA, 17 nt, Brucella suis 1330
cguuaugcucuauuucg

SEQ ID NO: 2478450 - RNA, 20 nt, Brucella suis 1330
cguuaugugccgguuuaucc

SEQ ID NO: 2478451 - RNA, 18 nt, Brucella suis 1330
cguucacaaucuugccaa

SEQ ID NO: 2478452 - RNA, 20 nt, Brucella suis 1330
cguucacguaggcgcggcgu

SEQ ID NO: 2478453 - RNA, 15 nt, Brucella suis 1330
cguucagaucgacgc

SEQ ID NO: 2478454 - RNA, 13 nt, Brucella suis 1330
cguucagccaccg

SEQ ID NO: 2478455 - RNA, 12 nt, Brucella suis 1330
cguuccagccgu

SEQ ID NO: 2478456 - RNA, 13 nt, Brucella suis 1330
cguuccagggcgc

SEQ ID NO: 2478457 - RNA, 15 nt, Brucella suis 1330
cguuccgccucccug

SEQ ID NO: 2478458 - RNA, 21 nt, Brucella suis 1330
cguuccgugccgauuucggcg

SEQ ID NO: 2478459 - RNA, 21 nt, Brucella suis 1330
cguuccucugccgguuuccag

SEQ ID NO: 2478460 - RNA, 18 nt, Brucella suis 1330
cguuccuucggagcgcgu

SEQ ID NO: 2478461 - RNA, 15 nt, Brucella suis 1330
cguucgucaaugcgc

SEQ ID NO: 2478462 - RNA, 22 nt, Brucella suis 1330
cguugagccgcgccaugccauc

SEQ ID NO: 2478463 - RNA, 15 nt, Brucella suis 1330
uccgcgacaucauca

SEQ ID NO: 2478464 - RNA, 19 nt, Brucella suis 1330
uccgcgacaucaucaagga

SEQ ID NO: 2478465 - RNA, 15 nt, Brucella suis 1330
uccgcgacgccgccc

SEQ ID NO: 2478466 - RNA, 20 nt, Brucella suis 1330
uccgcugccagcuacgccgg

SEQ ID NO: 2478467 - RNA, 23 nt, Brucella suis 1330
uccggaauagucaguuccugcuu

SEQ ID NO: 2478468 - RNA, 20 nt, Brucella suis 1330
uccggcaaaacggcaggcau

SEQ ID NO: 2478469 - RNA, 19 nt, Brucella suis 1330
uccggcccauaccgcgcca

SEQ ID NO: 2478470 - RNA, 17 nt, Brucella suis 1330
uccggcguggccaagau

SEQ ID NO: 2478471 - RNA, 12 nt, Brucella suis 1330
uccggcguuucu

SEQ ID NO: 2478472 - RNA, 22 nt, Brucella suis 1330
uccggcucaaugccgcauucag

SEQ ID NO: 2478473 - RNA, 21 nt, Brucella suis 1330
uccggcuugauacugcgcgca

SEQ ID NO: 2478474 - RNA, 13 nt, Brucella suis 1330
uccgggccgcaca

SEQ ID NO: 2478475 - RNA, 20 nt, Brucella suis 1330
uccgggucuucgcccggcau

SEQ ID NO: 2478476 - RNA, 14 nt, Brucella suis 1330
uccggguuuuguuu

SEQ ID NO: 2478477 - RNA, 19 nt, Brucella suis 1330
uccgguauaugcaccagcg

SEQ ID NO: 2478478 - RNA, 19 nt, Brucella suis 1330
uccgucagggccgaugccg

SEQ ID NO: 2478479 - RNA, 12 nt, Brucella suis 1330
uccgucugcauc

SEQ ID NO: 2478480 - RNA, 20 nt, Brucella suis 1330
uccgugacgagcgcacgcag

SEQ ID NO: 2478481 - RNA, 15 nt, Brucella suis 1330
uccguuacacgcccc

SEQ ID NO: 2478482 - RNA, 16 nt, Brucella suis 1330
uccuacgcaaaaccgc

SEQ ID NO: 2478483 - RNA, 17 nt, Brucella suis 1330
uccuccugcgcccauuc

SEQ ID NO: 2478484 - RNA, 14 nt, Brucella suis 1330
uccucggcccugga

SEQ ID NO: 2478485 - RNA, 22 nt, Brucella suis 1330
uccugaaaauacucuacaaucu

SEQ ID NO: 2478486 - RNA, 19 nt, Brucella suis 1330
uccugaauggucugcgcca

SEQ ID NO: 2478487 - RNA, 16 nt, Brucella suis 1330
uccugcaaaccggcug

SEQ ID NO: 2478488 - RNA, 18 nt, Brucella suis 1330
uccugcaaaccggcugcc

SEQ ID NO: 2478489 - RNA, 19 nt, Brucella suis 1330
uccugcaaaccggcugccg

SEQ ID NO: 2478490 - RNA, 14 nt, Brucella suis 1330
uccugcaccggcuu

SEQ ID NO: 2478491 - RNA, 23 nt, Brucella suis 1330
uccugccaaacuaaaugaagaag

SEQ ID NO: 2478492 - RNA, 14 nt, Brucella suis 1330
uccugccagcggca

SEQ ID NO: 2478493 - RNA, 19 nt, Brucella suis 1330
uccugcggaaugcccugga

SEQ ID NO: 2478494 - RNA, 13 nt, Brucella suis 1330
uccugcggcuucu

SEQ ID NO: 2478495 - RNA, 15 nt, Brucella suis 1330
uccugcugcgcggca

SEQ ID NO: 2478496 - RNA, 22 nt, Brucella suis 1330
uccugcuucgaucagauaagau

SEQ ID NO: 2478497 - RNA, 22 nt, Brucella suis 1330
uccuggccuuccuugacgcuga

SEQ ID NO: 2478498 - RNA, 18 nt, Brucella suis 1330
uccugucccuucuugcuc

SEQ ID NO: 2478499 - RNA, 17 nt, Brucella suis 1330
uccuguccgacauccau

SEQ ID NO: 2478500 - RNA, 21 nt, Brucella suis 1330
uccuuaaccuuuuuccugauc

SEQ ID NO: 2478501 - RNA, 15 nt, Brucella suis 1330
uccuucacauauugu

SEQ ID NO: 2478502 - RNA, 16 nt, Brucella suis 1330
uccuucaccacgauuu

SEQ ID NO: 2478503 - RNA, 16 nt, Brucella suis 1330
uccuucagaagcacca

SEQ ID NO: 2478504 - RNA, 19 nt, Brucella suis 1330
uccuucuccaucugcggcg

SEQ ID NO: 2478505 - RNA, 20 nt, Brucella suis 1330
uccuucuccaucugcggcgu

SEQ ID NO: 2478506 - RNA, 14 nt, Brucella suis 1330
uccuugaucgauuu

SEQ ID NO: 2478507 - RNA, 14 nt, Brucella suis 1330
uccuugcccucgau

SEQ ID NO: 2478508 - RNA, 17 nt, Brucella suis 1330
uccuuguuccagucgcc

SEQ ID NO: 2478509 - RNA, 15 nt, Brucella suis 1330
uccuuuccaguucca

SEQ ID NO: 2478510 - RNA, 14 nt, Brucella suis 1330
ucgaaaacaucgga

SEQ ID NO: 2478511 - RNA, 22 nt, Brucella suis 1330
ucgaaaccggcauuauccgcau

SEQ ID NO: 2478512 - RNA, 19 nt, Brucella suis 1330
ucgaaagcccgucggccau

SEQ ID NO: 2478513 - RNA, 13 nt, Brucella suis 1330
ucgaaccucugac

SEQ ID NO: 2478514 - RNA, 21 nt, Brucella suis 1330
ucgaagaguuugacgcccauu

SEQ ID NO: 2478515 - RNA, 16 nt, Brucella suis 1330
ucgaagaucaaguggc

SEQ ID NO: 2478516 - RNA, 21 nt, Brucella suis 1330
ucgaagcgggaucagaaauca

SEQ ID NO: 2478517 - RNA, 23 nt, Brucella suis 1330
ucgaaggacaagacuuccucgcc

SEQ ID NO: 2478518 - RNA, 17 nt, Brucella suis 1330
ucgaagggcugagggaa

SEQ ID NO: 2478519 - RNA, 15 nt, Brucella suis 1330
ucgaauuccaccgcc

SEQ ID NO: 2478520 - RNA, 19 nt, Brucella suis 1330
ucgacaaagccugaacccc

SEQ ID NO: 2478521 - RNA, 14 nt, Brucella suis 1330
ucgacaaaggugcu

SEQ ID NO: 2478522 - RNA, 17 nt, Brucella suis 1330
ucgacaaccgcgccgcu

SEQ ID NO: 2478523 - RNA, 18 nt, Brucella suis 1330
ucgacaaucuccccuucc

SEQ ID NO: 2478524 - RNA, 19 nt, Brucella suis 1330
ucgacaaucuccccuuccu

SEQ ID NO: 2478525 - RNA, 23 nt, Brucella suis 1330
ucgacaaugucaucggaggcuuc

SEQ ID NO: 2478526 - RNA, 16 nt, Brucella suis 1330
ucgacacccggauauu

SEQ ID NO: 2478527 - RNA, 12 nt, Brucella suis 1330
ucgacaccgcca

SEQ ID NO: 2478528 - RNA, 18 nt, Brucella suis 1330
ucgacacgccggaacacc

SEQ ID NO: 2478529 - RNA, 19 nt, Brucella suis 1330
ucgacagcacugccaccau

SEQ ID NO: 2478530 - RNA, 18 nt, Brucella suis 1330
ucgacagcggaagcgcgu

SEQ ID NO: 2478531 - RNA, 18 nt, Brucella suis 1330
ucgacccgccaugcggcc

SEQ ID NO: 2478532 - RNA, 23 nt, Brucella suis 1330
ucgacgcuuuccaccggcucauu

SEQ ID NO: 2478533 - RNA, 20 nt, Brucella suis 1330
ucgacguccucguucuugcc

SEQ ID NO: 2478534 - RNA, 22 nt, Brucella suis 1330
ucgagaagcaucagcuugccca

SEQ ID NO: 2478535 - RNA, 21 nt, Brucella suis 1330
ucgagaagcgguguggcccgg

SEQ ID NO: 2478536 - RNA, 15 nt, Brucella suis 1330
ucgagaaucugcuug

SEQ ID NO: 2478537 - RNA, 18 nt, Brucella suis 1330
ucgagaauggcaacacgg

SEQ ID NO: 2478538 - RNA, 20 nt, Brucella suis 1330
ucgagauggccuugugcaga

SEQ ID NO: 2478539 - RNA, 17 nt, Brucella suis 1330
ucgagcaaugcgccgug

SEQ ID NO: 2478540 - RNA, 18 nt, Brucella suis 1330
ucgagcagcaucuugcca

SEQ ID NO: 2478541 - RNA, 23 nt, Brucella suis 1330
ucgagcaggcggucgcuugccuu

SEQ ID NO: 2478542 - RNA, 19 nt, Brucella suis 1330
ucgagcauuucaugcacgg

SEQ ID NO: 2478543 - RNA, 16 nt, Brucella suis 1330
ucgagccgacaucgcg

SEQ ID NO: 2478544 - RNA, 19 nt, Brucella suis 1330
ucgagccgacaucgcgcuu

SEQ ID NO: 2478545 - RNA, 14 nt, Brucella suis 1330
ucgagcgccugucc

SEQ ID NO: 2478546 - RNA, 20 nt, Brucella suis 1330
ucgagcgccuguccgccugc

SEQ ID NO: 2478547 - RNA, 22 nt, Brucella suis 1330
ucgagcggcauggcguagaaau

SEQ ID NO: 2478548 - RNA, 14 nt, Brucella suis 1330
ucgagcuuuccauc

SEQ ID NO: 2478549 - RNA, 19 nt, Brucella suis 1330
ucgaggccgaacgaggcga

SEQ ID NO: 2478550 - RNA, 14 nt, Brucella suis 1330
ucgaggcugcgcga

SEQ ID NO: 2478551 - RNA, 15 nt, Brucella suis 1330
ucgagggcaccggcc

SEQ ID NO: 2478552 - RNA, 17 nt, Brucella suis 1330
ucgagggcaccggccuu

SEQ ID NO: 2478553 - RNA, 17 nt, Brucella suis 1330
ucgagugcggccugcac

SEQ ID NO: 2478554 - RNA, 15 nt, Brucella suis 1330
ucgaguucugcgcgg

SEQ ID NO: 2478555 - RNA, 16 nt, Brucella suis 1330
ucgaguugugccugcc

SEQ ID NO: 2478556 - RNA, 22 nt, Brucella suis 1330
ucgauaucggacuggauuucga

SEQ ID NO: 2478557 - RNA, 20 nt, Brucella suis 1330
ucgauaucugcaacaccauc

SEQ ID NO: 2478558 - RNA, 18 nt, Brucella suis 1330
ucgaucaaggccguuauu

SEQ ID NO: 2478559 - RNA, 14 nt, Brucella suis 1330
ucgaucagcaccau

SEQ ID NO: 2478560 - RNA, 16 nt, Brucella suis 1330
ucgaucagcuugucgu

SEQ ID NO: 2478561 - RNA, 19 nt, Brucella suis 1330
ucgaucauauaggccucgg

SEQ ID NO: 2478562 - RNA, 16 nt, Brucella suis 1330
ucgaucaucagcggcg

SEQ ID NO: 2478563 - RNA, 16 nt, Brucella suis 1330
ucgaucuggcggauga

SEQ ID NO: 2478564 - RNA, 23 nt, Brucella suis 1330
ucgaugaacaggagcggaagcau

SEQ ID NO: 2478565 - RNA, 14 nt, Brucella suis 1330
ucgauggccugcac

SEQ ID NO: 2478566 - RNA, 22 nt, Brucella suis 1330
ucgauggcggagcguccggcgc

SEQ ID NO: 2478567 - RNA, 15 nt, Brucella suis 1330
ucgcaaagcguuccg

SEQ ID NO: 2478568 - RNA, 23 nt, Brucella suis 1330
ucgcaaagcguuccgcgcaaaau

SEQ ID NO: 2478569 - RNA, 13 nt, Brucella suis 1330
ucgcaagcaggca

SEQ ID NO: 2478570 - RNA, 16 nt, Brucella suis 1330
ucgcaagccaaagccc

SEQ ID NO: 2478571 - RNA, 20 nt, Brucella suis 1330
ucgcaaugccggggaagggu

SEQ ID NO: 2478572 - RNA, 20 nt, Brucella suis 1330
ucgcaccgauauagagcagc

SEQ ID NO: 2478573 - RNA, 21 nt, Brucella suis 1330
ucgcaccgauauagagcagca

SEQ ID NO: 2478574 - RNA, 16 nt, Brucella suis 1330
ucgcagcguauucagg

SEQ ID NO: 2478575 - RNA, 16 nt, Brucella suis 1330
ucgcagguuccgccgc

SEQ ID NO: 2478576 - RNA, 18 nt, Brucella suis 1330
ucgcaguugcaccgcccg

SEQ ID NO: 2478577 - RNA, 22 nt, Brucella suis 1330
ucgcauccagaacuucgccaag

SEQ ID NO: 2478578 - RNA, 23 nt, Brucella suis 1330
ucgcauccggcccguugccgauc

SEQ ID NO: 2478579 - RNA, 23 nt, Brucella suis 1330
ucgccaaagaccagcaggaagaa

SEQ ID NO: 2478580 - RNA, 23 nt, Brucella suis 1330
ucgccaagaagaacacagccccu

SEQ ID NO: 2478581 - RNA, 16 nt, Brucella suis 1330
ucgccaagccggcgca

SEQ ID NO: 2478582 - RNA, 13 nt, Brucella suis 1330
ucgccaagcuuga

SEQ ID NO: 2478583 - RNA, 19 nt, Brucella suis 1330
ucgccaagcuuuugcagcc

SEQ ID NO: 2478584 - RNA, 14 nt, Brucella suis 1330
ucgccaccauggcc

SEQ ID NO: 2478585 - RNA, 18 nt, Brucella suis 1330
ucgccaccauggccgccc

SEQ ID NO: 2478586 - RNA, 21 nt, Brucella suis 1330
ucgcccacgaggaucggcacg

SEQ ID NO: 2478587 - RNA, 16 nt, Brucella suis 1330
ucgcccauuuucucca

SEQ ID NO: 2478588 - RNA, 14 nt, Brucella suis 1330
ucgcccgcccggca

SEQ ID NO: 2478589 - RNA, 23 nt, Brucella suis 1330
ucgcccugcuucacaugcuugcc

SEQ ID NO: 2478590 - RNA, 19 nt, Brucella suis 1330
ucgccgaaauuggccgcug

SEQ ID NO: 2478591 - RNA, 20 nt, Brucella suis 1330
ucgccgacgauuucuuccag

SEQ ID NO: 2478592 - RNA, 16 nt, Brucella suis 1330
ucgccgcccgguuccg

SEQ ID NO: 2478593 - RNA, 20 nt, Brucella suis 1330
ucgccgcgcacuggcagcau

SEQ ID NO: 2478594 - RNA, 18 nt, Brucella suis 1330
ucgccgcuugcgccgaac

SEQ ID NO: 2478595 - RNA, 17 nt, Brucella suis 1330
ucgccggggggaauggc

SEQ ID NO: 2478596 - RNA, 18 nt, Brucella suis 1330
ucgccgggguuucuucau

SEQ ID NO: 2478597 - RNA, 14 nt, Brucella suis 1330
ucgccgugcgccug

SEQ ID NO: 2478598 - RNA, 11 nt, Brucella suis 1330
ucgccugcaau

SEQ ID NO: 2478599 - RNA, 14 nt, Brucella suis 1330
ucgccugcaaugga

SEQ ID NO: 2478600 - RNA, 14 nt, Brucella suis 1330
ucgccuucgccgag

SEQ ID NO: 2478601 - RNA, 20 nt, Brucella suis 1330
ucgccuucgcgcaccagacc

SEQ ID NO: 2478602 - RNA, 22 nt, Brucella suis 1330
ucgcgacaggacaccgucgcca

SEQ ID NO: 2478603 - RNA, 18 nt, Brucella suis 1330
ucgcgaccgggcuucuug

SEQ ID NO: 2478604 - RNA, 15 nt, Brucella suis 1330
ucgcgaccuucuugc

SEQ ID NO: 2478605 - RNA, 14 nt, Brucella suis 1330
ucgcgcaccagcuu

SEQ ID NO: 2478606 - RNA, 14 nt, Brucella suis 1330
ucgcgccaggcuuc

SEQ ID NO: 2478607 - RNA, 16 nt, Brucella suis 1330
ucgcgccaggcuucgg

SEQ ID NO: 2478608 - RNA, 19 nt, Brucella suis 1330
ucgcgcucgaaugccucga

SEQ ID NO: 2478609 - RNA, 15 nt, Brucella suis 1330
ucgcgcucgccgccc

SEQ ID NO: 2478610 - RNA, 23 nt, Brucella suis 1330
ucgcgcuuggauacgucacccgc

SEQ ID NO: 2478611 - RNA, 22 nt, Brucella suis 1330
ucgcggcagccgccgccgcaaa

SEQ ID NO: 2478612 - RNA, 21 nt, Brucella suis 1330
ucgcgucagggcgaggaaaau

SEQ ID NO: 2478613 - RNA, 14 nt, Brucella suis 1330
ucgcgucccuugcc

SEQ ID NO: 2478614 - RNA, 17 nt, Brucella suis 1330
ucgcucaccuuuuccac

SEQ ID NO: 2478615 - RNA, 15 nt, Brucella suis 1330
ucgcucaggccuguu

SEQ ID NO: 2478616 - RNA, 21 nt, Brucella suis 1330
ucgcucguaacgggagcagcu

SEQ ID NO: 2478617 - RNA, 14 nt, Brucella suis 1330
ucgcugacuucaaa

SEQ ID NO: 2478618 - RNA, 20 nt, Brucella suis 1330
ucgcugaucggcgcaggggc

SEQ ID NO: 2478619 - RNA, 19 nt, Brucella suis 1330
ucgcuuauuggcuuucaaa

SEQ ID NO: 2478620 - RNA, 18 nt, Brucella suis 1330
ucgcuuucaauggccgcg

SEQ ID NO: 2478621 - RNA, 22 nt, Brucella suis 1330
ucggaaauaucgauaucugcaa

SEQ ID NO: 2478622 - RNA, 14 nt, Brucella suis 1330
ucggagccggccuu

SEQ ID NO: 2478623 - RNA, 22 nt, Brucella suis 1330
ucggagccggccuuugcgcgcc

SEQ ID NO: 2478624 - RNA, 13 nt, Brucella suis 1330
ucggaggcuuccg

SEQ ID NO: 2478625 - RNA, 16 nt, Brucella suis 1330
ucggauaacgcgacaa

SEQ ID NO: 2478626 - RNA, 19 nt, Brucella suis 1330
ucggcaaacauccagccgg

SEQ ID NO: 2478627 - RNA, 20 nt, Brucella suis 1330
ucggcaaaggcuccggcauu

SEQ ID NO: 2478628 - RNA, 15 nt, Brucella suis 1330
ucggcaacaagaggg

SEQ ID NO: 2478629 - RNA, 22 nt, Brucella suis 1330
ucggcaacaagagggcgcagca

SEQ ID NO: 2478630 - RNA, 13 nt, Brucella suis 1330
ucggcaacgccga

SEQ ID NO: 2478631 - RNA, 15 nt, Brucella suis 1330
ucggcaacgccgaag

SEQ ID NO: 2478632 - RNA, 17 nt, Brucella suis 1330
ucggcaagauggcugcc

SEQ ID NO: 2478633 - RNA, 18 nt, Brucella suis 1330
ucggcaaggccgcgcucc

SEQ ID NO: 2478634 - RNA, 19 nt, Brucella suis 1330
ucggcaaggccgcgcucca

SEQ ID NO: 2478635 - RNA, 17 nt, Brucella suis 1330
ucggcacuucgccaaag

SEQ ID NO: 2478636 - RNA, 21 nt, Brucella suis 1330
ucggcaggagcgcgaucaucg

SEQ ID NO: 2478637 - RNA, 17 nt, Brucella suis 1330
ucggcauggcagccgau

SEQ ID NO: 2478638 - RNA, 21 nt, Brucella suis 1330
ucggccagcgcaaagcgcgcg

SEQ ID NO: 2478639 - RNA, 18 nt, Brucella suis 1330
ucggccaguucagcggcg

SEQ ID NO: 2478640 - RNA, 11 nt, Brucella suis 1330
ucggccaguuu

SEQ ID NO: 2478641 - RNA, 11 nt, Brucella suis 1330
ucggcccagca

SEQ ID NO: 2478642 - RNA, 14 nt, Brucella suis 1330
ucggcccagcaccg

SEQ ID NO: 2478643 - RNA, 18 nt, Brucella suis 1330
ucggcccuggaaagaagc

SEQ ID NO: 2478644 - RNA, 19 nt, Brucella suis 1330
ucggccgacagaugcgcau

SEQ ID NO: 2478645 - RNA, 14 nt, Brucella suis 1330
ucggccgcguugcc

SEQ ID NO: 2478646 - RNA, 21 nt, Brucella suis 1330
ucggccgcguugcccaugucc

SEQ ID NO: 2478647 - RNA, 21 nt, Brucella suis 1330
ucggccgggcaucgcucgaag

SEQ ID NO: 2478648 - RNA, 13 nt, Brucella suis 1330
ucggccucgccug

SEQ ID NO: 2478649 - RNA, 14 nt, Brucella suis 1330
ucggccugaugcaa

SEQ ID NO: 2478650 - RNA, 23 nt, Brucella suis 1330
ucggccugugcgacgaggccuga

SEQ ID NO: 2478651 - RNA, 17 nt, Brucella suis 1330
ucggccuugaucggcau

SEQ ID NO: 2478652 - RNA, 19 nt, Brucella suis 1330
ucggcgaugaagcgggccg

SEQ ID NO: 2478653 - RNA, 22 nt, Brucella suis 1330
ucggcggaacugcaugggcucg

SEQ ID NO: 2478654 - RNA, 16 nt, Brucella suis 1330
ucggcggcaguuucac

SEQ ID NO: 2478655 - RNA, 22 nt, Brucella suis 1330
ucggcggcaguuucaccauggc

SEQ ID NO: 2478656 - RNA, 12 nt, Brucella suis 1330
ucggcgugcaga

SEQ ID NO: 2478657 - RNA, 11 nt, Brucella suis 1330
ucggcuggcug

SEQ ID NO: 2478658 - RNA, 20 nt, Brucella suis 1330
ucggcuuuacguccggcacg

SEQ ID NO: 2478659 - RNA, 22 nt, Brucella suis 1330
ucggcuuuacguccggcacgau

SEQ ID NO: 2478660 - RNA, 15 nt, Brucella suis 1330
ucgggaccaccggcc

SEQ ID NO: 2478661 - RNA, 21 nt, Brucella suis 1330
ucgggcaaggggcggaacagg

SEQ ID NO: 2478662 - RNA, 14 nt, Brucella suis 1330
ucgggcagcuuguc

SEQ ID NO: 2478663 - RNA, 14 nt, Brucella suis 1330
ucgggcagggucaa

SEQ ID NO: 2478664 - RNA, 15 nt, Brucella suis 1330
ucgggcagugaaagc

SEQ ID NO: 2478665 - RNA, 19 nt, Brucella suis 1330
ucgggcgcgaucucguccu

SEQ ID NO: 2478666 - RNA, 19 nt, Brucella suis 1330
ucgggcuugauagcgccgg

SEQ ID NO: 2478667 - RNA, 21 nt, Brucella suis 1330
ucgggucgaucaucagcggcg

SEQ ID NO: 2478668 - RNA, 22 nt, Brucella suis 1330
ucggguguuugcgacgggcgag

SEQ ID NO: 2478669 - RNA, 18 nt, Brucella suis 1330
ucgguuuucaaugccugg

SEQ ID NO: 2478670 - RNA, 16 nt, Brucella suis 1330
ucguagcugcuuugcu

SEQ ID NO: 2478671 - RNA, 21 nt, Brucella suis 1330
ucguaucgccaaagaccagca

SEQ ID NO: 2478672 - RNA, 23 nt, Brucella suis 1330
ucgucaaaaccgucgaguugugc

SEQ ID NO: 2478673 - RNA, 21 nt, Brucella suis 1330
ucgucacccgcgucgucugca

SEQ ID NO: 2478674 - RNA, 15 nt, Brucella suis 1330
ucgucgaguucugcg

SEQ ID NO: 2478675 - RNA, 19 nt, Brucella suis 1330
ucgucgcugacuucaaaau

SEQ ID NO: 2478676 - RNA, 12 nt, Brucella suis 1330
ucgucggcuucg

SEQ ID NO: 2478677 - RNA, 16 nt, Brucella suis 1330
ucgucggucagggcaa

SEQ ID NO: 2478678 - RNA, 12 nt, Brucella suis 1330
ucgucugcaucc

SEQ ID NO: 2478679 - RNA, 14 nt, Brucella suis 1330
ucgucuucaagcac

SEQ ID NO: 2478680 - RNA, 20 nt, Brucella suis 1330
ucgucuuccuuauccugaug

SEQ ID NO: 2478681 - RNA, 16 nt, Brucella suis 1330
ucgugagcgagcgcac

SEQ ID NO: 2478682 - RNA, 22 nt, Brucella suis 1330
ucgugcauuugacguccggcuu

SEQ ID NO: 2478683 - RNA, 17 nt, Brucella suis 1330
ucgugucauagccgaug

SEQ ID NO: 2478684 - RNA, 20 nt, Brucella suis 1330
ucgugucgauugccugugcg

SEQ ID NO: 2478685 - RNA, 20 nt, Brucella suis 1330
ucgugugcuugccgaaaagc

SEQ ID NO: 2478686 - RNA, 12 nt, Brucella suis 1330
ucguuccgggug

SEQ ID NO: 2478687 - RNA, 12 nt, Brucella suis 1330
ucguugcuuccg

SEQ ID NO: 2478688 - RNA, 13 nt, Brucella suis 1330
ucuaaccauuugu

SEQ ID NO: 2478689 - RNA, 18 nt, Brucella suis 1330
ucuaacuauuuauucuga

SEQ ID NO: 2478690 - RNA, 20 nt, Brucella suis 1330
ucuaagcggaaaacggcugc

SEQ ID NO: 2478691 - RNA, 24 nt, Brucella suis 1330
ucuaauccuuuguuuugacgcgca

SEQ ID NO: 2478692 - RNA, 13 nt, Brucella suis 1330
ucuauccgcugau

SEQ ID NO: 2478693 - RNA, 15 nt, Brucella suis 1330
ucuaucgccuggcau

SEQ ID NO: 2478694 - RNA, 16 nt, Brucella suis 1330
ucucacacugcaaaac

SEQ ID NO: 2478695 - RNA, 14 nt, Brucella suis 1330
ucucacagccauca

SEQ ID NO: 2478696 - RNA, 18 nt, Brucella suis 1330
ucucacagccaucaggau

SEQ ID NO: 2478697 - RNA, 20 nt, Brucella suis 1330
ucucacuccgaccauuuccc

SEQ ID NO: 2478698 - RNA, 15 nt, Brucella suis 1330
ucucagcguuuucug

SEQ ID NO: 2478699 - RNA, 21 nt, Brucella suis 1330
ucucagcguuuucugaaagaa

SEQ ID NO: 2478700 - RNA, 21 nt, Brucella suis 1330
ucuccggcccauaccgcgcca

SEQ ID NO: 2478701 - RNA, 13 nt, Brucella suis 1330
ucuccucugccug

SEQ ID NO: 2478702 - RNA, 16 nt, Brucella suis 1330
ucuccucugccugcug

SEQ ID NO: 2478703 - RNA, 18 nt, Brucella suis 1330
ucuccugccacgaugccu

SEQ ID NO: 2478704 - RNA, 22 nt, Brucella suis 1330
ucucggccuggucuagccgcgc

SEQ ID NO: 2478705 - RNA, 17 nt, Brucella suis 1330
ucucgucgagaagcauc

SEQ ID NO: 2478706 - RNA, 22 nt, Brucella suis 1330
ucucgucgagaagcaucagcuu

SEQ ID NO: 2478707 - RNA, 17 nt, Brucella suis 1330
ucucugcucgccugcac

SEQ ID NO: 2478708 - RNA, 14 nt, Brucella suis 1330
ucugaaaucucuca

SEQ ID NO: 2478709 - RNA, 21 nt, Brucella suis 1330
ucugacgggaugauugcgcca

SEQ ID NO: 2478710 - RNA, 13 nt, Brucella suis 1330
ucugauucaauca

SEQ ID NO: 2478711 - RNA, 19 nt, Brucella suis 1330
ucugauugcaggucuuucu

SEQ ID NO: 2478712 - RNA, 21 nt, Brucella suis 1330
ucugauuugaaaagccccgcu

SEQ ID NO: 2478713 - RNA, 13 nt, Brucella suis 1330
ucugcacagccug

SEQ ID NO: 2478714 - RNA, 20 nt, Brucella suis 1330
ucugcacggcacguucggca

SEQ ID NO: 2478715 - RNA, 17 nt, Brucella suis 1330
ucugcacgucaucaucg

SEQ ID NO: 2478716 - RNA, 22 nt, Brucella suis 1330
ucugcacgucaucaucgucuuc

SEQ ID NO: 2478717 - RNA, 12 nt, Brucella suis 1330
ucugccaaccau

SEQ ID NO: 2478718 - RNA, 21 nt, Brucella suis 1330
ucugcccgccggggccggaug

SEQ ID NO: 2478719 - RNA, 20 nt, Brucella suis 1330
ucugccggugccggcaggcu

SEQ ID NO: 2478720 - RNA, 17 nt, Brucella suis 1330
ucugccgguucugcaug

SEQ ID NO: 2478721 - RNA, 15 nt, Brucella suis 1330
ucugccgucagcaaa

SEQ ID NO: 2478722 - RNA, 15 nt, Brucella suis 1330
ucugccgugucgucg

SEQ ID NO: 2478723 - RNA, 18 nt, Brucella suis 1330
ucugccugcccucguccu

SEQ ID NO: 2478724 - RNA, 18 nt, Brucella suis 1330
ucugccuugucagaagca

SEQ ID NO: 2478725 - RNA, 20 nt, Brucella suis 1330
ucugcggaaagcccggccuu

SEQ ID NO: 2478726 - RNA, 16 nt, Brucella suis 1330
ucugcuggagcuucgg

SEQ ID NO: 2478727 - RNA, 18 nt, Brucella suis 1330
ucuggaaguccucggcaa

SEQ ID NO: 2478728 - RNA, 18 nt, Brucella suis 1330
ucuggauuucauccagcg

SEQ ID NO: 2478729 - RNA, 17 nt, Brucella suis 1330
ucuggccgauaagcucg

SEQ ID NO: 2478730 - RNA, 18 nt, Brucella suis 1330
ucuguacauacaugauga

SEQ ID NO: 2478731 - RNA, 17 nt, Brucella suis 1330
ucugucaccacaucggc

SEQ ID NO: 2478732 - RNA, 23 nt, Brucella suis 1330
ucuguccggccagcuugaaaagc

SEQ ID NO: 2478733 - RNA, 17 nt, Brucella suis 1330
ucuguucgucugcgcgu

SEQ ID NO: 2478734 - RNA, 19 nt, Brucella suis 1330
ucuucacagcggacuuggc

SEQ ID NO: 2478735 - RNA, 13 nt, Brucella suis 1330
ucuucauucgcug

SEQ ID NO: 2478736 - RNA, 17 nt, Brucella suis 1330
ucuuccaguuucugaau

SEQ ID NO: 2478737 - RNA, 17 nt, Brucella suis 1330
ucuuccucacccuucaa

SEQ ID NO: 2478738 - RNA, 16 nt, Brucella suis 1330
ucuucgaucauuuccu

SEQ ID NO: 2478739 - RNA, 18 nt, Brucella suis 1330
ucuucgcguuccacgauu

SEQ ID NO: 2478740 - RNA, 17 nt, Brucella suis 1330
ucuucuuccaguuucug

SEQ ID NO: 2478741 - RNA, 14 nt, Brucella suis 1330
ucuucuugcauucg

SEQ ID NO: 2478742 - RNA, 11 nt, Brucella suis 1330
ucuugcccaga

SEQ ID NO: 2478743 - RNA, 17 nt, Brucella suis 1330
ucuugcccagaacaucg

SEQ ID NO: 2478744 - RNA, 12 nt, Brucella suis 1330
ucuugccgccgc

SEQ ID NO: 2478745 - RNA, 14 nt, Brucella suis 1330
ucuugccgccgcuu

SEQ ID NO: 2478746 - RNA, 14 nt, Brucella suis 1330
ucuugccggccuga

SEQ ID NO: 2478747 - RNA, 21 nt, Brucella suis 1330
ucuugccggccugaaacagca

SEQ ID NO: 2478748 - RNA, 15 nt, Brucella suis 1330
ucuugcgcccuccac

SEQ ID NO: 2478749 - RNA, 14 nt, Brucella suis 1330
ucuugcgcuugcga

SEQ ID NO: 2478750 - RNA, 15 nt, Brucella suis 1330
ucuugcgcuugcgac

SEQ ID NO: 2478751 - RNA, 14 nt, Brucella suis 1330
ucuuggccaugaug

SEQ ID NO: 2478752 - RNA, 16 nt, Brucella suis 1330
ucuugggauucucgaa

SEQ ID NO: 2478753 - RNA, 21 nt, Brucella suis 1330
ucuuguucauaggcauuuucc

SEQ ID NO: 2478754 - RNA, 22 nt, Brucella suis 1330
ucuuuacaccgucuauuuucug

SEQ ID NO: 2478755 - RNA, 22 nt, Brucella suis 1330
ucuuuccaaguucaugccuguc

SEQ ID NO: 2478756 - RNA, 22 nt, Brucella suis 1330
ucuuucuugaagucaucaccgc

SEQ ID NO: 2478757 - RNA, 17 nt, Brucella suis 1330
ucuuuuccgaaaaccgu

SEQ ID NO: 2478758 - RNA, 11 nt, Brucella suis 1330
ucuuuuuucaa

SEQ ID NO: 2478759 - RNA, 19 nt, Brucella suis 1330
ugaaaacggugaucaggac

SEQ ID NO: 2478760 - RNA, 13 nt, Brucella suis 1330
ugaaaaggcuggc

SEQ ID NO: 2478761 - RNA, 15 nt, Brucella suis 1330
ugaaaauaucugccg

SEQ ID NO: 2478762 - RNA, 16 nt, Brucella suis 1330
ugaaacagcauauugc

SEQ ID NO: 2478763 - RNA, 14 nt, Brucella suis 1330
ugaaacaggccuuc

SEQ ID NO: 2478764 - RNA, 22 nt, Brucella suis 1330
ugaaacagugccgccaucggca

SEQ ID NO: 2478765 - RNA, 19 nt, Brucella suis 1330
ugaaagaccgcauuccggc

SEQ ID NO: 2478766 - RNA, 14 nt, Brucella suis 1330
ugaaaggcagcacu

SEQ ID NO: 2478767 - RNA, 16 nt, Brucella suis 1330
ugaaaggugaaggccu

SEQ ID NO: 2478768 - RNA, 19 nt, Brucella suis 1330
ugaaaggugaaggccugcu

SEQ ID NO: 2478769 - RNA, 21 nt, Brucella suis 1330
ugaaauaauugucaggaaaaa

SEQ ID NO: 2478770 - RNA, 17 nt, Brucella suis 1330
ugaaaucagaucggcga

SEQ ID NO: 2478771 - RNA, 16 nt, Brucella suis 1330
ugaaaucauugcgcac

SEQ ID NO: 2478772 - RNA, 17 nt, Brucella suis 1330
ugaaaucgucacugaga

SEQ ID NO: 2478773 - RNA, 11 nt, Brucella suis 1330
ugaaauucuuu

SEQ ID NO: 2478774 - RNA, 17 nt, Brucella suis 1330
ugaacaacacaacaccg

SEQ ID NO: 2478775 - RNA, 12 nt, Brucella suis 1330
ugaacaagcaga

SEQ ID NO: 2478776 - RNA, 15 nt, Brucella suis 1330
ugaacaagcagaugc

SEQ ID NO: 2478777 - RNA, 23 nt, Brucella suis 1330
ugaacagaucggaaucaaaaccc

SEQ ID NO: 2478778 - RNA, 17 nt, Brucella suis 1330
ugaacaucggcgcgcuu

SEQ ID NO: 2478779 - RNA, 21 nt, Brucella suis 1330
ugaacaugcgccacuucccgc

SEQ ID NO: 2478780 - RNA, 18 nt, Brucella suis 1330
ugaaccccagacaugcga

SEQ ID NO: 2478781 - RNA, 18 nt, Brucella suis 1330
ugaacccgccaccagacc

SEQ ID NO: 2478782 - RNA, 21 nt, Brucella suis 1330
ugaacgcauagagccacgaga

SEQ ID NO: 2478783 - RNA, 22 nt, Brucella suis 1330
ugaacgcauagagccacgagaa

SEQ ID NO: 2478784 - RNA, 14 nt, Brucella suis 1330
ugaacgccuuuuuc

SEQ ID NO: 2478785 - RNA, 21 nt, Brucella suis 1330
ugaagaagauaaucagcagaa

SEQ ID NO: 2478786 - RNA, 20 nt, Brucella suis 1330
ugaagagccgcaggcacugg

SEQ ID NO: 2478787 - RNA, 20 nt, Brucella suis 1330
ugaagagcguugcugccgga

SEQ ID NO: 2478788 - RNA, 18 nt, Brucella suis 1330
ugaagcaaggcggcccuu

SEQ ID NO: 2478789 - RNA, 13 nt, Brucella suis 1330
ugaagccuuccgc

SEQ ID NO: 2478790 - RNA, 17 nt, Brucella suis 1330
ugaagcgggccgcuugc

SEQ ID NO: 2478791 - RNA, 22 nt, Brucella suis 1330
ugaagcugucgccagcgccggu

SEQ ID NO: 2478792 - RNA, 14 nt, Brucella suis 1330
ugaaggggcgguca

SEQ ID NO: 2478793 - RNA, 13 nt, Brucella suis 1330
ugaaucaccagcg

SEQ ID NO: 2478794 - RNA, 23 nt, Brucella suis 1330
ugaaucagaucggcgcucuaauc

SEQ ID NO: 2478795 - RNA, 19 nt, Brucella suis 1330
ugaauccuuccugauuuac

SEQ ID NO: 2478796 - RNA, 11 nt, Brucella suis 1330
ugaaugcaauc

SEQ ID NO: 2478797 - RNA, 16 nt, Brucella suis 1330
ugaauggucugcgcca

SEQ ID NO: 2478798 - RNA, 16 nt, Brucella suis 1330
ugaauuagaucggcgc

SEQ ID NO: 2478799 - RNA, 13 nt, Brucella suis 1330
ugaauuucggcga

SEQ ID NO: 2478800 - RNA, 18 nt, Brucella suis 1330
ugaauuucggcgacuggc

SEQ ID NO: 2478801 - RNA, 21 nt, Brucella suis 1330
ugacaagaucgucacugcaaa

SEQ ID NO: 2478802 - RNA, 18 nt, Brucella suis 1330
ugacaagcgugagcuuca

SEQ ID NO: 2478803 - RNA, 13 nt, Brucella suis 1330
ugacaauggccgu

SEQ ID NO: 2478804 - RNA, 12 nt, Brucella suis 1330
ugacagccuggg

SEQ ID NO: 2478805 - RNA, 20 nt, Brucella suis 1330
ugacauggaaaugcagguga

SEQ ID NO: 2478806 - RNA, 18 nt, Brucella suis 1330
ugaccagauagccauagc

SEQ ID NO: 2478807 - RNA, 16 nt, Brucella suis 1330
ugaccauagcggugcu

SEQ ID NO: 2478808 - RNA, 22 nt, Brucella suis 1330
ugaccauauugcugggcaagug

SEQ ID NO: 2478809 - RNA, 23 nt, Brucella suis 1330
ugacccgcccuucaucaccuuca

SEQ ID NO: 2478810 - RNA, 16 nt, Brucella suis 1330
ugacccggccuuugcg

SEQ ID NO: 2478811 - RNA, 20 nt, Brucella suis 1330
ugaccgccucgacagcacug

SEQ ID NO: 2478812 - RNA, 19 nt, Brucella suis 1330
ugaccgcuaucgcugcuuu

SEQ ID NO: 2478813 - RNA, 19 nt, Brucella suis 1330
ugaccggccacccagcccg

SEQ ID NO: 2478814 - RNA, 22 nt, Brucella suis 1330
ugaccgugauucuuucuucgcc

SEQ ID NO: 2478815 - RNA, 20 nt, Brucella suis 1330
ugaccuuccugacccauggc

SEQ ID NO: 2478816 - RNA, 14 nt, Brucella suis 1330
ugaccuuggccacg

SEQ ID NO: 2478817 - RNA, 14 nt, Brucella suis 1330
ugacgaaacgcggc

SEQ ID NO: 2478818 - RNA, 16 nt, Brucella suis 1330
ugacgaaacgcggcgu

SEQ ID NO: 2478819 - RNA, 22 nt, Brucella suis 1330
ugacgaaaugaacaucggcgcg

SEQ ID NO: 2478820 - RNA, 18 nt, Brucella suis 1330
ugacgacugaaauaauag

SEQ ID NO: 2478821 - RNA, 12 nt, Brucella suis 1330
ugacgagcgcac

SEQ ID NO: 2478822 - RNA, 18 nt, Brucella suis 1330
ugacgagcgcacgcaggc

SEQ ID NO: 2478823 - RNA, 20 nt, Brucella suis 1330
ugacgagcgcacgcaggcau

SEQ ID NO: 2478824 - RNA, 18 nt, Brucella suis 1330
ugacgauacagcccauga

SEQ ID NO: 2478825 - RNA, 18 nt, Brucella suis 1330
ugacgaucaccuguggcu

SEQ ID NO: 2478826 - RNA, 17 nt, Brucella suis 1330
ugacgaucuggaacagu

SEQ ID NO: 2478827 - RNA, 21 nt, Brucella suis 1330
ugacgauggggauugccauga

SEQ ID NO: 2478828 - RNA, 20 nt, Brucella suis 1330
ugacgccaucuucuuccagu

SEQ ID NO: 2478829 - RNA, 21 nt, Brucella suis 1330
ugacgccauugaccgccucga

SEQ ID NO: 2478830 - RNA, 19 nt, Brucella suis 1330
ugacgcccauuucacccgc

SEQ ID NO: 2478831 - RNA, 17 nt, Brucella suis 1330
ugacgccgggcauggaa

SEQ ID NO: 2478832 - RNA, 16 nt, Brucella suis 1330
ugacgcgagcggacgg

SEQ ID NO: 2478833 - RNA, 18 nt, Brucella suis 1330
ugacgcugaagaaaacaa

SEQ ID NO: 2478834 - RNA, 21 nt, Brucella suis 1330
ugacggcagccucgacacgcc

SEQ ID NO: 2478835 - RNA, 21 nt, Brucella suis 1330
ugacggcccggugcagcggca

SEQ ID NO: 2478836 - RNA, 21 nt, Brucella suis 1330
ugacgggaugauugcgccauc

SEQ ID NO: 2478837 - RNA, 20 nt, Brucella suis 1330
ugacggucguuucgccgccc

SEQ ID NO: 2478838 - RNA, 24 nt, Brucella suis 1330
ugacguccggcuucgugcaaaccu

SEQ ID NO: 2478839 - RNA, 22 nt, Brucella suis 1330
ugacugcgccauccguugcgac

SEQ ID NO: 2478840 - RNA, 17 nt, Brucella suis 1330
ugacuuuaauugucggc

SEQ ID NO: 2478841 - RNA, 22 nt, Brucella suis 1330
ugagaaagcuugucgcggccuu

SEQ ID NO: 2478842 - RNA, 13 nt, Brucella suis 1330
ugagaagcuugag

SEQ ID NO: 2478843 - RNA, 15 nt, Brucella suis 1330
ugagaaggcaagccc

SEQ ID NO: 2478844 - RNA, 14 nt, Brucella suis 1330
ugagauagccuugg

SEQ ID NO: 2478845 - RNA, 14 nt, Brucella suis 1330
ugagauauccauau

SEQ ID NO: 2478846 - RNA, 14 nt, Brucella suis 1330
ugagaucgcgcgca

SEQ ID NO: 2478847 - RNA, 20 nt, Brucella suis 1330
ugagcaccggaagcgcaaaa

SEQ ID NO: 2478848 - RNA, 12 nt, Brucella suis 1330
ugagcaugaugc

SEQ ID NO: 2478849 - RNA, 14 nt, Brucella suis 1330
ugagcgaaaucggg

SEQ ID NO: 2478850 - RNA, 15 nt, Brucella suis 1330
ugagcgacaggaaca

SEQ ID NO: 2478851 - RNA, 15 nt, Brucella suis 1330
ugagcggcagcagcc

SEQ ID NO: 2478852 - RNA, 16 nt, Brucella suis 1330
ugagcggcagcagcca

SEQ ID NO: 2478853 - RNA, 16 nt, Brucella suis 1330
ugagcggcaggccgca

SEQ ID NO: 2478854 - RNA, 16 nt, Brucella suis 1330
ugagcugcucggcaag

SEQ ID NO: 2478855 - RNA, 15 nt, Brucella suis 1330
ugagcugcuggguga

SEQ ID NO: 2478856 - RNA, 20 nt, Brucella suis 1330
ugaggccauuuugacccugc

SEQ ID NO: 2478857 - RNA, 16 nt, Brucella suis 1330
ugaggccggacgcuuc

SEQ ID NO: 2478858 - RNA, 15 nt, Brucella suis 1330
ugaggccgguaaaau

SEQ ID NO: 2478859 - RNA, 14 nt, Brucella suis 1330
ugaggcucauaccg

SEQ ID NO: 2478860 - RNA, 19 nt, Brucella suis 1330
ugagggaaacacucugccu

SEQ ID NO: 2478861 - RNA, 15 nt, Brucella suis 1330
ugagggccagaagau

SEQ ID NO: 2478862 - RNA, 14 nt, Brucella suis 1330
ugagguccaccaca

SEQ ID NO: 2478863 - RNA, 19 nt, Brucella suis 1330
ugagguguuucgcgcaaug

SEQ ID NO: 2478864 - RNA, 16 nt, Brucella suis 1330
ugagguugagcugcuc

SEQ ID NO: 2478865 - RNA, 22 nt, Brucella suis 1330
ugauacugcgcgcaaaccagga

SEQ ID NO: 2478866 - RNA, 17 nt, Brucella suis 1330
ugauagcgcccgccucg

SEQ ID NO: 2478867 - RNA, 12 nt, Brucella suis 1330
ugauaggcugcu

SEQ ID NO: 2478868 - RNA, 17 nt, Brucella suis 1330
ugauagggcaauuggcc

SEQ ID NO: 2478869 - RNA, 18 nt, Brucella suis 1330
ugauaucgcggaucggca

SEQ ID NO: 2478870 - RNA, 23 nt, Brucella suis 1330
ugauauugcccauaccgaucuga

SEQ ID NO: 2478871 - RNA, 17 nt, Brucella suis 1330
ugaucaacccgucuuca

SEQ ID NO: 2478872 - RNA, 15 nt, Brucella suis 1330
ugauccagaagccgc

SEQ ID NO: 2478873 - RNA, 13 nt, Brucella suis 1330
ugauccaugcgca

SEQ ID NO: 2478874 - RNA, 15 nt, Brucella suis 1330
ugauccgcuccagau

SEQ ID NO: 2478875 - RNA, 13 nt, Brucella suis 1330
ugaucggcgugcc

SEQ ID NO: 2478876 - RNA, 13 nt, Brucella suis 1330
ugaucgugccgga

SEQ ID NO: 2478877 - RNA, 19 nt, Brucella suis 1330
ugaucgugccggaauggcc

SEQ ID NO: 2478878 - RNA, 16 nt, Brucella suis 1330
ugaucucggagcggcc

SEQ ID NO: 2478879 - RNA, 22 nt, Brucella suis 1330
ugaucuggggcacgagaacggu

SEQ ID NO: 2478880 - RNA, 17 nt, Brucella suis 1330
ugaucuuguucggcuuu

SEQ ID NO: 2478881 - RNA, 12 nt, Brucella suis 1330
ugaugaaaaacc

SEQ ID NO: 2478882 - RNA, 14 nt, Brucella suis 1330
ugaugaaaaacccc

SEQ ID NO: 2478883 - RNA, 18 nt, Brucella suis 1330
ugaugauuucccgugcgg

SEQ ID NO: 2478884 - RNA, 22 nt, Brucella suis 1330
ugaugcagauaaaaaggaugaa

SEQ ID NO: 2478885 - RNA, 19 nt, Brucella suis 1330
ugaugccguuuucaucaaa

SEQ ID NO: 2478886 - RNA, 17 nt, Brucella suis 1330
ugauggccgggaaugcg

SEQ ID NO: 2478887 - RNA, 15 nt, Brucella suis 1330
ugauggcggagcgga

SEQ ID NO: 2478888 - RNA, 14 nt, Brucella suis 1330
ugauguucggcaag

SEQ ID NO: 2478889 - RNA, 21 nt, Brucella suis 1330
ugauguucggcaaggccgcgc

SEQ ID NO: 2478890 - RNA, 19 nt, Brucella suis 1330
ugauguuugcgaaccggag

SEQ ID NO: 2478891 - RNA, 18 nt, Brucella suis 1330
ugauucuggauuucaucc

SEQ ID NO: 2478892 - RNA, 21 nt, Brucella suis 1330
ugauugcaggucuuucugcuu

SEQ ID NO: 2478893 - RNA, 22 nt, Brucella suis 1330
ugauugcaggucuuucugcuuc

SEQ ID NO: 2478894 - RNA, 15 nt, Brucella suis 1330
ugauuugauccaugc

SEQ ID NO: 2478895 - RNA, 17 nt, Brucella suis 1330
ugauuugucggaagccg

SEQ ID NO: 2478896 - RNA, 20 nt, Brucella suis 1330
ugcaaaccuccgacaccagc

SEQ ID NO: 2478897 - RNA, 18 nt, Brucella suis 1330
ugcaacaaaugcaaaugc

SEQ ID NO: 2478898 - RNA, 15 nt, Brucella suis 1330
ugcaacaccaauagc

SEQ ID NO: 2478899 - RNA, 22 nt, Brucella suis 1330
ugcaacaccaucgaguuccggg

SEQ ID NO: 2478900 - RNA, 16 nt, Brucella suis 1330
ugcaagccgcggcgcg

SEQ ID NO: 2478901 - RNA, 20 nt, Brucella suis 1330
ugcaagcgucuucugagaaa

SEQ ID NO: 2478902 - RNA, 17 nt, Brucella suis 1330
ugcaaugcgucgauggc

SEQ ID NO: 2478903 - RNA, 16 nt, Brucella suis 1330
ugcacacccuugaucg

SEQ ID NO: 2478904 - RNA, 21 nt, Brucella suis 1330
ugcacagccuggaugacaucg

SEQ ID NO: 2478905 - RNA, 23 nt, Brucella suis 1330
ugcacagcggucgaaaccuuguu

SEQ ID NO: 2478906 - RNA, 23 nt, Brucella suis 1330
ugcaccagcgucuguacauacau

SEQ ID NO: 2478907 - RNA, 12 nt, Brucella suis 1330
ugcacccggcac

SEQ ID NO: 2478908 - RNA, 15 nt, Brucella suis 1330
ugcaccgauggccag

SEQ ID NO: 2478909 - RNA, 19 nt, Brucella suis 1330
ugcaccgauggccaggaaa

SEQ ID NO: 2478910 - RNA, 16 nt, Brucella suis 1330
ugcaccgcccggauca

SEQ ID NO: 2478911 - RNA, 17 nt, Brucella suis 1330
ugcaccgcgccggaagg

SEQ ID NO: 2478912 - RNA, 19 nt, Brucella suis 1330
ugcaccgcgccggaaggcg

SEQ ID NO: 2478913 - RNA, 19 nt, Brucella suis 1330
ugcacgcgggccaacucuu

SEQ ID NO: 2478914 - RNA, 22 nt, Brucella suis 1330
ugcacgucaccauauucgucca

SEQ ID NO: 2478915 - RNA, 14 nt, Brucella suis 1330
ugcacgucaucauc

SEQ ID NO: 2478916 - RNA, 20 nt, Brucella suis 1330
ugcacguucauauguucaag

SEQ ID NO: 2478917 - RNA, 19 nt, Brucella suis 1330
ugcacuucuuuauggcuca

SEQ ID NO: 2478918 - RNA, 23 nt, Brucella suis 1330
ugcacuugcgccaaucgccgcga

SEQ ID NO: 2478919 - RNA, 15 nt, Brucella suis 1330
ugcagaaauucauag

SEQ ID NO: 2478920 - RNA, 17 nt, Brucella suis 1330
ugcagagcgcauccagc

SEQ ID NO: 2478921 - RNA, 20 nt, Brucella suis 1330
ugcagauaaagggugauggc

SEQ ID NO: 2478922 - RNA, 21 nt, Brucella suis 1330
ugcagauaaagggugauggcg

SEQ ID NO: 2478923 - RNA, 15 nt, Brucella suis 1330
ugcagaucgcaucca

SEQ ID NO: 2478924 - RNA, 21 nt, Brucella suis 1330
ugcagaugagcggcagcagcc

SEQ ID NO: 2478925 - RNA, 21 nt, Brucella suis 1330
ugcagcgugccguguagggca

SEQ ID NO: 2478926 - RNA, 19 nt, Brucella suis 1330
ugcaggcgcaggcccugca

SEQ ID NO: 2478927 - RNA, 21 nt, Brucella suis 1330
ugcaggcgcggcaacgcuggc

SEQ ID NO: 2478928 - RNA, 22 nt, Brucella suis 1330
ugcaggcugcccaugcccgcca

SEQ ID NO: 2478929 - RNA, 13 nt, Brucella suis 1330
ugcagggcuugcu

SEQ ID NO: 2478930 - RNA, 18 nt, Brucella suis 1330
ugcaggucugauugcagg

SEQ ID NO: 2478931 - RNA, 15 nt, Brucella suis 1330
ugcaguuccauccau

SEQ ID NO: 2478932 - RNA, 15 nt, Brucella suis 1330
ugcaucauaggccca

SEQ ID NO: 2478933 - RNA, 17 nt, Brucella suis 1330
ugcaucccgaaaagugc

SEQ ID NO: 2478934 - RNA, 17 nt, Brucella suis 1330
ugcauccucgaaaacaa

SEQ ID NO: 2478935 - RNA, 17 nt, Brucella suis 1330
ugcaucgaaugccgcau

SEQ ID NO: 2478936 - RNA, 15 nt, Brucella suis 1330
ugcaugggcaagaca

SEQ ID NO: 2478937 - RNA, 15 nt, Brucella suis 1330
ugcauuccagaaggu

SEQ ID NO: 2478938 - RNA, 18 nt, Brucella suis 1330
ugccaaccauugaucuuc

SEQ ID NO: 2478939 - RNA, 23 nt, Brucella suis 1330
ugccaaccguaucauccggcgug

SEQ ID NO: 2478940 - RNA, 23 nt, Brucella suis 1330
ugccaccagcacacagccaagac

SEQ ID NO: 2478941 - RNA, 19 nt, Brucella suis 1330
ugccacgcgccgccaucug

SEQ ID NO: 2478942 - RNA, 18 nt, Brucella suis 1330
ugccagaagguuucagcc

SEQ ID NO: 2478943 - RNA, 14 nt, Brucella suis 1330
ugccagauggcguu

SEQ ID NO: 2478944 - RNA, 17 nt, Brucella suis 1330
ugccagaugugccacca

SEQ ID NO: 2478945 - RNA, 21 nt, Brucella suis 1330
ugccagcccgaagcgcaaagc

SEQ ID NO: 2478946 - RNA, 16 nt, Brucella suis 1330
ugccauaauucagcuu

SEQ ID NO: 2478947 - RNA, 20 nt, Brucella suis 1330
ugccaucaagcgucaugcca

SEQ ID NO: 2478948 - RNA, 13 nt, Brucella suis 1330
ugccauccacaaa

SEQ ID NO: 2478949 - RNA, 18 nt, Brucella suis 1330
ugccauccguaucggcgg

SEQ ID NO: 2478950 - RNA, 13 nt, Brucella suis 1330
ugccaucgcgcca

SEQ ID NO: 2478951 - RNA, 21 nt, Brucella suis 1330
ugccauggaacagacaggauu

SEQ ID NO: 2478952 - RNA, 14 nt, Brucella suis 1330
ugccauggcaguga

SEQ ID NO: 2478953 - RNA, 21 nt, Brucella suis 1330
ugccauucuccgcagccgcca

SEQ ID NO: 2478954 - RNA, 21 nt, Brucella suis 1330
ugccauucugucggcgcugcu

SEQ ID NO: 2478955 - RNA, 18 nt, Brucella suis 1330
ugcccacaucgccuugca

SEQ ID NO: 2478956 - RNA, 20 nt, Brucella suis 1330
ugcccagaaauccacuacaa

SEQ ID NO: 2478957 - RNA, 16 nt, Brucella suis 1330
ugcccaugcaguucca

SEQ ID NO: 2478958 - RNA, 18 nt, Brucella suis 1330
ugcccauguccgccugau

SEQ ID NO: 2478959 - RNA, 16 nt, Brucella suis 1330
ugcccauugcccgccc

SEQ ID NO: 2478960 - RNA, 11 nt, Brucella suis 1330
ugccccggcac

SEQ ID NO: 2478961 - RNA, 13 nt, Brucella suis 1330
ugccccggcaccg

SEQ ID NO: 2478962 - RNA, 21 nt, Brucella suis 1330
ugcccgcacccuauuccccua

SEQ ID NO: 2478963 - RNA, 15 nt, Brucella suis 1330
ugcccgccgcaagcu

SEQ ID NO: 2478964 - RNA, 19 nt, Brucella suis 1330
ugcccgccggggccggaug

SEQ ID NO: 2478965 - RNA, 17 nt, Brucella suis 1330
ugcccgccuuugccgca

SEQ ID NO: 2478966 - RNA, 20 nt, Brucella suis 1330
ugcccggaagcgaaaugccg

SEQ ID NO: 2478967 - RNA, 16 nt, Brucella suis 1330
ugcccggaucauccau

SEQ ID NO: 2478968 - RNA, 20 nt, Brucella suis 1330
ugcccuauaccgccaaggaa

SEQ ID NO: 2478969 - RNA, 18 nt, Brucella suis 1330
ugcccuggaugcggaaca

SEQ ID NO: 2478970 - RNA, 19 nt, Brucella suis 1330
ugcccuggaugcggaacac

SEQ ID NO: 2478971 - RNA, 20 nt, Brucella suis 1330
ugcccuggcucuuccggccg

SEQ ID NO: 2478972 - RNA, 17 nt, Brucella suis 1330
ugcccuuccgggccgca

SEQ ID NO: 2478973 - RNA, 17 nt, Brucella suis 1330
ugcccuugagagccaga

SEQ ID NO: 2478974 - RNA, 12 nt, Brucella suis 1330
ugccgaaaagcc

SEQ ID NO: 2478975 - RNA, 14 nt, Brucella suis 1330
ugccgaagccaggu

SEQ ID NO: 2478976 - RNA, 14 nt, Brucella suis 1330
ugccgaaucaaaca

SEQ ID NO: 2478977 - RNA, 17 nt, Brucella suis 1330
ugccgcaacaagacgga

SEQ ID NO: 2478978 - RNA, 13 nt, Brucella suis 1330
ugccgcaggauuu

SEQ ID NO: 2478979 - RNA, 19 nt, Brucella suis 1330
ugccgcaugauaggcaaca

SEQ ID NO: 2478980 - RNA, 23 nt, Brucella suis 1330
ugccgccgcagaccacccggccg

SEQ ID NO: 2478981 - RNA, 13 nt, Brucella suis 1330
ugccgccgcugaa

SEQ ID NO: 2478982 - RNA, 14 nt, Brucella suis 1330
ugccgccgcuucca

SEQ ID NO: 2478983 - RNA, 21 nt, Brucella suis 1330
ugccgccuuucaugcccugac

SEQ ID NO: 2478984 - RNA, 15 nt, Brucella suis 1330
ugccgcgaaaaagcc

SEQ ID NO: 2478985 - RNA, 20 nt, Brucella suis 1330
ugccgcgcgcggcuuccagc

SEQ ID NO: 2478986 - RNA, 16 nt, Brucella suis 1330
ugccgcguccggcauu

SEQ ID NO: 2478987 - RNA, 21 nt, Brucella suis 1330
ugccgcguucagccaccgacu

SEQ ID NO: 2478988 - RNA, 15 nt, Brucella suis 1330
ugccgcuuccagcau

SEQ ID NO: 2478989 - RNA, 17 nt, Brucella suis 1330
ugccggaucgaggccga

SEQ ID NO: 2478990 - RNA, 19 nt, Brucella suis 1330
ugccggaugcgguugcgac

SEQ ID NO: 2478991 - RNA, 22 nt, Brucella suis 1330
ugccggccgagaacuucggcac

SEQ ID NO: 2478992 - RNA, 17 nt, Brucella suis 1330
ugccggccugaaacagc

SEQ ID NO: 2478993 - RNA, 19 nt, Brucella suis 1330
ugccgggcacgaaaagcag

SEQ ID NO: 2478994 - RNA, 15 nt, Brucella suis 1330
ugccgggcgggcagc

SEQ ID NO: 2478995 - RNA, 14 nt, Brucella suis 1330
ugccgguaucaagc

SEQ ID NO: 2478996 - RNA, 15 nt, Brucella suis 1330
ugccggucgcaggcg

SEQ ID NO: 2478997 - RNA, 15 nt, Brucella suis 1330
ugccggugccggcag

SEQ ID NO: 2478998 - RNA, 19 nt, Brucella suis 1330
ugccgucaacagccuuggc

SEQ ID NO: 2478999 - RNA, 16 nt, Brucella suis 1330
ugccgucaccauucac

SEQ ID NO: 2479000 - RNA, 18 nt, Brucella suis 1330
ugccgucgaagcgcugca

SEQ ID NO: 2479001 - RNA, 21 nt, Brucella suis 1330
ugccgucuuugcgggcaaaau

SEQ ID NO: 2479002 - RNA, 20 nt, Brucella suis 1330
ugccgugcacuucgagcagg

SEQ ID NO: 2479003 - RNA, 15 nt, Brucella suis 1330
ugccgugucgucguc

SEQ ID NO: 2479004 - RNA, 18 nt, Brucella suis 1330
ugccguugagaaucgcac

SEQ ID NO: 2479005 - RNA, 19 nt, Brucella suis 1330
ugccucccgauaaugcgaa

SEQ ID NO: 2479006 - RNA, 17 nt, Brucella suis 1330
ugccucggagccuucau

SEQ ID NO: 2479007 - RNA, 16 nt, Brucella suis 1330
ugccucugucagcuuu

SEQ ID NO: 2479008 - RNA, 20 nt, Brucella suis 1330
ugccuggcgaaaacggccau

SEQ ID NO: 2479009 - RNA, 16 nt, Brucella suis 1330
ugccuuaugucaugga

SEQ ID NO: 2479010 - RNA, 15 nt, Brucella suis 1330
ugccuucaucggcaa

SEQ ID NO: 2479011 - RNA, 12 nt, Brucella suis 1330
ugccuucuucau

SEQ ID NO: 2479012 - RNA, 17 nt, Brucella suis 1330
ugccuucuucauauccu

SEQ ID NO: 2479013 - RNA, 12 nt, Brucella suis 1330
ugccuugaucca

SEQ ID NO: 2479014 - RNA, 18 nt, Brucella suis 1330
ugccuugucgaggcugcg

SEQ ID NO: 2479015 - RNA, 18 nt, Brucella suis 1330
ugccuuuagccaagccau

SEQ ID NO: 2479016 - RNA, 22 nt, Brucella suis 1330
ugccuuucaggucgucuuucag

SEQ ID NO: 2479017 - RNA, 19 nt, Brucella suis 1330
ugcgaaaaugauagcugca

SEQ ID NO: 2479018 - RNA, 20 nt, Brucella suis 1330
ugcgaaaaugauagcugcau

SEQ ID NO: 2479019 - RNA, 13 nt, Brucella suis 1330
ugcgaaagcaccg

SEQ ID NO: 2479020 - RNA, 20 nt, Brucella suis 1330
ugcgaaagcaccgaucacgc

SEQ ID NO: 2479021 - RNA, 15 nt, Brucella suis 1330
ugcgaaaugcgcgcg

SEQ ID NO: 2479022 - RNA, 17 nt, Brucella suis 1330
ugcgaaggcccuucagg

SEQ ID NO: 2479023 - RNA, 23 nt, Brucella suis 1330
ugcgacauguuuuggaaagaaau

SEQ ID NO: 2479024 - RNA, 22 nt, Brucella suis 1330
ugcgaccauggcgcauucagag

SEQ ID NO: 2479025 - RNA, 18 nt, Brucella suis 1330
ugcgagaagggcugaggc

SEQ ID NO: 2479026 - RNA, 20 nt, Brucella suis 1330
ugcgagguccggggugaaug

SEQ ID NO: 2479027 - RNA, 12 nt, Brucella suis 1330
ugcgauaaaaug

SEQ ID NO: 2479028 - RNA, 16 nt, Brucella suis 1330
ugcgauccaccaucac

SEQ ID NO: 2479029 - RNA, 16 nt, Brucella suis 1330
ugcgaugcgccagcga

SEQ ID NO: 2479030 - RNA, 23 nt, Brucella suis 1330
ugcgauuucgccuucgccgagau

SEQ ID NO: 2479031 - RNA, 15 nt, Brucella suis 1330
ugcgcaagugcugca

SEQ ID NO: 2479032 - RNA, 15 nt, Brucella suis 1330
ugcgcacauauuugc

SEQ ID NO: 2479033 - RNA, 13 nt, Brucella suis 1330
ugcgcacgaccag

SEQ ID NO: 2479034 - RNA, 15 nt, Brucella suis 1330
ugcgcagcgcaggcg

SEQ ID NO: 2479035 - RNA, 15 nt, Brucella suis 1330
ugcgcagcgccgcau

SEQ ID NO: 2479036 - RNA, 18 nt, Brucella suis 1330
ugcgcagcucggcuucaa

SEQ ID NO: 2479037 - RNA, 19 nt, Brucella suis 1330
ugcgcagcucggcuucaaa

SEQ ID NO: 2479038 - RNA, 17 nt, Brucella suis 1330
ugcgcaucgucaaucac

SEQ ID NO: 2479039 - RNA, 20 nt, Brucella suis 1330
ugcgcaugaagcgcggcggc

SEQ ID NO: 2479040 - RNA, 22 nt, Brucella suis 1330
ugcgcaugaucauauacggcuu

SEQ ID NO: 2479041 - RNA, 15 nt, Brucella suis 1330
ugcgcauuacggcca

SEQ ID NO: 2479042 - RNA, 18 nt, Brucella suis 1330
ugcgccaccacggcgccu

SEQ ID NO: 2479043 - RNA, 23 nt, Brucella suis 1330
ugcgccacgagaaccgcgccggg

SEQ ID NO: 2479044 - RNA, 18 nt, Brucella suis 1330
ugcgccagccuugcgauu

SEQ ID NO: 2479045 - RNA, 20 nt, Brucella suis 1330
ugcgccagcgauugcgcauu

SEQ ID NO: 2479046 - RNA, 20 nt, Brucella suis 1330
ugcgccaguuuucgcggcag

SEQ ID NO: 2479047 - RNA, 13 nt, Brucella suis 1330
ugcgcccgccgaa

SEQ ID NO: 2479048 - RNA, 15 nt, Brucella suis 1330
ugcgcccgcgccgcu

SEQ ID NO: 2479049 - RNA, 18 nt, Brucella suis 1330
ugcgcccuccaccgcuca

SEQ ID NO: 2479050 - RNA, 21 nt, Brucella suis 1330
ugcgccgaacagcgcccagag

SEQ ID NO: 2479051 - RNA, 19 nt, Brucella suis 1330
ugcgccgauauagacgcca

SEQ ID NO: 2479052 - RNA, 16 nt, Brucella suis 1330
ugcgcgaauuccaugc

SEQ ID NO: 2479053 - RNA, 14 nt, Brucella suis 1330
ugcgcgacgaucag

SEQ ID NO: 2479054 - RNA, 23 nt, Brucella suis 1330
ugcgcgaggggaugggggccggg

SEQ ID NO: 2479055 - RNA, 14 nt, Brucella suis 1330
ugcgcgaugcggcg

SEQ ID NO: 2479056 - RNA, 14 nt, Brucella suis 1330
ugcgcgcccggcgg

SEQ ID NO: 2479057 - RNA, 20 nt, Brucella suis 1330
ugcgcgcccgucaccggcug

SEQ ID NO: 2479058 - RNA, 15 nt, Brucella suis 1330
ugcgcgcgcauggcg

SEQ ID NO: 2479059 - RNA, 16 nt, Brucella suis 1330
ugcgcgcgccaucggc

SEQ ID NO: 2479060 - RNA, 17 nt, Brucella suis 1330
ugcgcgcgccgccaugg

SEQ ID NO: 2479061 - RNA, 16 nt, Brucella suis 1330
ugcgcgcuggaugucg

SEQ ID NO: 2479062 - RNA, 13 nt, Brucella suis 1330
ugcgcggcgcuuc

SEQ ID NO: 2479063 - RNA, 23 nt, Brucella suis 1330
ugcgcggugcggauggggugagg

SEQ ID NO: 2479064 - RNA, 19 nt, Brucella suis 1330
ugcgcgucaaaacaaaaga

SEQ ID NO: 2479065 - RNA, 15 nt, Brucella suis 1330
ugcgcuccaccagca

SEQ ID NO: 2479066 - RNA, 23 nt, Brucella suis 1330
ugcgcucgauggguaggauaaug

SEQ ID NO: 2479067 - RNA, 12 nt, Brucella suis 1330
ugcgcucuagac

SEQ ID NO: 2479068 - RNA, 14 nt, Brucella suis 1330
ugcgcucuaugcag

SEQ ID NO: 2479069 - RNA, 16 nt, Brucella suis 1330
ugcgcucuaugcagca

SEQ ID NO: 2479070 - RNA, 14 nt, Brucella suis 1330
ugcgcugauucugg

SEQ ID NO: 2479071 - RNA, 19 nt, Brucella suis 1330
ugcgcugccauugccgcga

SEQ ID NO: 2479072 - RNA, 20 nt, Brucella suis 1330
ugcgcuggaugaugcuuuau

SEQ ID NO: 2479073 - RNA, 14 nt, Brucella suis 1330
ugcgcuucgcgcag

SEQ ID NO: 2479074 - RNA, 17 nt, Brucella suis 1330
ugcgcuucgcgcaggcc

SEQ ID NO: 2479075 - RNA, 18 nt, Brucella suis 1330
ugcgcuucgcgcaggccg

SEQ ID NO: 2479076 - RNA, 17 nt, Brucella suis 1330
ugcgcuugccgccggau

SEQ ID NO: 2479077 - RNA, 17 nt, Brucella suis 1330
ugcggaacacgccgcca

SEQ ID NO: 2479078 - RNA, 18 nt, Brucella suis 1330
ugcggaacacgccgccau

SEQ ID NO: 2479079 - RNA, 21 nt, Brucella suis 1330
ugcggauaucgcuggcgucga

SEQ ID NO: 2479080 - RNA, 16 nt, Brucella suis 1330
ugcggccaagcgcauc

SEQ ID NO: 2479081 - RNA, 22 nt, Brucella suis 1330
ugcggccgggccaacgccggca

SEQ ID NO: 2479082 - RNA, 19 nt, Brucella suis 1330
ugcggcgccuugaugccgc

SEQ ID NO: 2479083 - RNA, 22 nt, Brucella suis 1330
ugcggcggauaucuuccugaau

SEQ ID NO: 2479084 - RNA, 12 nt, Brucella suis 1330
ugcggcggcgcg

SEQ ID NO: 2479085 - RNA, 15 nt, Brucella suis 1330
ugcggcggucggccu

SEQ ID NO: 2479086 - RNA, 11 nt, Brucella suis 1330
ugcggcuugcc

SEQ ID NO: 2479087 - RNA, 15 nt, Brucella suis 1330
ugcgggcaagcauuc

SEQ ID NO: 2479088 - RNA, 22 nt, Brucella suis 1330
ugcgggcaagcauuccgggccg

SEQ ID NO: 2479089 - RNA, 17 nt, Brucella suis 1330
ugcgggcuucuuccagu

SEQ ID NO: 2479090 - RNA, 13 nt, Brucella suis 1330
ugcggggaaauca

SEQ ID NO: 2479091 - RNA, 13 nt, Brucella suis 1330
ugcggggcuucca

SEQ ID NO: 2479092 - RNA, 18 nt, Brucella suis 1330
ugcggguugcgcccggau

SEQ ID NO: 2479093 - RNA, 19 nt, Brucella suis 1330
ugcggucgagcgugaucuc

SEQ ID NO: 2479094 - RNA, 13 nt, Brucella suis 1330
ugcggucucgguu

SEQ ID NO: 2479095 - RNA, 20 nt, Brucella suis 1330
ugcgucaggcccagaugcag

SEQ ID NO: 2479096 - RNA, 17 nt, Brucella suis 1330
ugcgucgcauccagaac

SEQ ID NO: 2479097 - RNA, 22 nt, Brucella suis 1330
ugcguuaaagagccauuauucu

SEQ ID NO: 2479098 - RNA, 12 nt, Brucella suis 1330
ugcguuggaaaa

SEQ ID NO: 2479099 - RNA, 16 nt, Brucella suis 1330
ugcguuggaaaaugcg

SEQ ID NO: 2479100 - RNA, 17 nt, Brucella suis 1330
ugcguuuuuggcaaaac

SEQ ID NO: 2479101 - RNA, 20 nt, Brucella suis 1330
ugcuacaaaaaacaacagca

SEQ ID NO: 2479102 - RNA, 16 nt, Brucella suis 1330
ugcuauaagcaacagg

SEQ ID NO: 2479103 - RNA, 16 nt, Brucella suis 1330
ugcuaucaacgcugca

SEQ ID NO: 2479104 - RNA, 23 nt, Brucella suis 1330
ugcuauggcacaagaacagccgc

SEQ ID NO: 2479105 - RNA, 14 nt, Brucella suis 1330
ugcucccaugccac

SEQ ID NO: 2479106 - RNA, 13 nt, Brucella suis 1330
ugcuccuuccugc

SEQ ID NO: 2479107 - RNA, 21 nt, Brucella suis 1330
ugcucgcccagaaacaaugug

SEQ ID NO: 2479108 - RNA, 18 nt, Brucella suis 1330
ugcucgcgcaaggcuuca

SEQ ID NO: 2479109 - RNA, 19 nt, Brucella suis 1330
ugcucgcgguugaggauuu

SEQ ID NO: 2479110 - RNA, 22 nt, Brucella suis 1330
ugcucgcgguugaggauuucca

SEQ ID NO: 2479111 - RNA, 15 nt, Brucella suis 1330
ugcucggcgagcuug

SEQ ID NO: 2479112 - RNA, 18 nt, Brucella suis 1330
ugcucguccggccagccg

SEQ ID NO: 2479113 - RNA, 21 nt, Brucella suis 1330
ugcugaaaaggcuggccaugc

SEQ ID NO: 2479114 - RNA, 18 nt, Brucella suis 1330
ugcugcaacaaaaugccc

SEQ ID NO: 2479115 - RNA, 13 nt, Brucella suis 1330
ugcugcaauccac

SEQ ID NO: 2479116 - RNA, 16 nt, Brucella suis 1330
ugcugcaauccacagg

SEQ ID NO: 2479117 - RNA, 14 nt, Brucella suis 1330
ugcugcauccugcu

SEQ ID NO: 2479118 - RNA, 18 nt, Brucella suis 1330
ugcugcauuuucugcauc

SEQ ID NO: 2479119 - RNA, 19 nt, Brucella suis 1330
ugcugccaugucucgccgu

SEQ ID NO: 2479120 - RNA, 20 nt, Brucella suis 1330
ugcugcuucgcaaaauaguc

SEQ ID NO: 2479121 - RNA, 15 nt, Brucella suis 1330
ugcuggcagcggcag

SEQ ID NO: 2479122 - RNA, 13 nt, Brucella suis 1330
ugcuggccguggc

SEQ ID NO: 2479123 - RNA, 13 nt, Brucella suis 1330
ugcugggcuuccu

SEQ ID NO: 2479124 - RNA, 15 nt, Brucella suis 1330
ugcuggugaaagacc

SEQ ID NO: 2479125 - RNA, 16 nt, Brucella suis 1330
ugcuggugaaagaccg

SEQ ID NO: 2479126 - RNA, 18 nt, Brucella suis 1330
ugcuguagcagcaacagg

SEQ ID NO: 2479127 - RNA, 22 nt, Brucella suis 1330
ugcuucacaugcuugccgaccu

SEQ ID NO: 2479128 - RNA, 19 nt, Brucella suis 1330
ugcuucaggcacucuccuc

SEQ ID NO: 2479129 - RNA, 19 nt, Brucella suis 1330
ugcuuccucguccuugaac

SEQ ID NO: 2479130 - RNA, 20 nt, Brucella suis 1330
ugcuucgaucagauaagaug

SEQ ID NO: 2479131 - RNA, 12 nt, Brucella suis 1330
ugcuucuugccu

SEQ ID NO: 2479132 - RNA, 13 nt, Brucella suis 1330
ugcuugaagcaag

SEQ ID NO: 2479133 - RNA, 20 nt, Brucella suis 1330
ugcuuguagacgaucuugcc

SEQ ID NO: 2479134 - RNA, 23 nt, Brucella suis 1330
ugcuuguguacccaaacguacau

SEQ ID NO: 2479135 - RNA, 15 nt, Brucella suis 1330
ugcuuugaugcguug

SEQ ID NO: 2479136 - RNA, 21 nt, Brucella suis 1330
ugcuuugaugcguugaaugca

SEQ ID NO: 2479137 - RNA, 20 nt, Brucella suis 1330
uggaaaaaauccgcaauggc

SEQ ID NO: 2479138 - RNA, 15 nt, Brucella suis 1330
uggaaaacgccgccu

SEQ ID NO: 2479139 - RNA, 18 nt, Brucella suis 1330
uggaaaccaucaacggga

SEQ ID NO: 2479140 - RNA, 22 nt, Brucella suis 1330
uggaaacggcgcaucauccuga

SEQ ID NO: 2479141 - RNA, 23 nt, Brucella suis 1330
uggaaacgggaaagggccgccuu

SEQ ID NO: 2479142 - RNA, 19 nt, Brucella suis 1330
uggaaauauucgggcggca

SEQ ID NO: 2479143 - RNA, 20 nt, Brucella suis 1330
uggaaauuauagccgccaag

SEQ ID NO: 2479144 - RNA, 13 nt, Brucella suis 1330
uggaacaagaagc

SEQ ID NO: 2479145 - RNA, 15 nt, Brucella suis 1330
uggaacaauuccagc

SEQ ID NO: 2479146 - RNA, 15 nt, Brucella suis 1330
uggaaccggcugucc

SEQ ID NO: 2479147 - RNA, 23 nt, Brucella suis 1330
uggaacguacaccgaggccgcca

SEQ ID NO: 2479148 - RNA, 17 nt, Brucella suis 1330
uggaagacauugccaag

SEQ ID NO: 2479149 - RNA, 17 nt, Brucella suis 1330
uggaagaugacgcccag

SEQ ID NO: 2479150 - RNA, 23 nt, Brucella suis 1330
uggaagcgcgcgcccgugacaag

SEQ ID NO: 2479151 - RNA, 13 nt, Brucella suis 1330
uggaauuucuaaa

SEQ ID NO: 2479152 - RNA, 16 nt, Brucella suis 1330
uggacaugaacacggc

SEQ ID NO: 2479153 - RNA, 22 nt, Brucella suis 1330
uggacaugaacacggcgcgguc

SEQ ID NO: 2479154 - RNA, 20 nt, Brucella suis 1330
uggacgaaaggcggcgcauu

SEQ ID NO: 2479155 - RNA, 15 nt, Brucella suis 1330
uggacugaaugcaga

SEQ ID NO: 2479156 - RNA, 12 nt, Brucella suis 1330
uggagcaggcca

SEQ ID NO: 2479157 - RNA, 16 nt, Brucella suis 1330
uggagcauuuccagca

SEQ ID NO: 2479158 - RNA, 18 nt, Brucella suis 1330
uggagcauuuccagcaaa

SEQ ID NO: 2479159 - RNA, 20 nt, Brucella suis 1330
uggagcguacaccgaccagc

SEQ ID NO: 2479160 - RNA, 12 nt, Brucella suis 1330
uggaggcaagcu

SEQ ID NO: 2479161 - RNA, 22 nt, Brucella suis 1330
uggaguuugacaagaucgucac

SEQ ID NO: 2479162 - RNA, 12 nt, Brucella suis 1330
uggaugccgcaa

SEQ ID NO: 2479163 - RNA, 17 nt, Brucella suis 1330
uggaugucgauuucacc

SEQ ID NO: 2479164 - RNA, 17 nt, Brucella suis 1330
uggauuggauuugacgu

SEQ ID NO: 2479165 - RNA, 15 nt, Brucella suis 1330
uggauuucgagcuga

SEQ ID NO: 2479166 - RNA, 16 nt, Brucella suis 1330
uggcaaaagccuccag

SEQ ID NO: 2479167 - RNA, 15 nt, Brucella suis 1330
uggcaagcagcaaaa

SEQ ID NO: 2479168 - RNA, 15 nt, Brucella suis 1330
uggcaagcccgcugc

SEQ ID NO: 2479169 - RNA, 20 nt, Brucella suis 1330
uggcaagcgccaugaaagaa

SEQ ID NO: 2479170 - RNA, 17 nt, Brucella suis 1330
uggcaagugugcagaca

SEQ ID NO: 2479171 - RNA, 22 nt, Brucella suis 1330
uggcaagugugcagacaggcca

SEQ ID NO: 2479172 - RNA, 15 nt, Brucella suis 1330
uggcaauaaaaggca

SEQ ID NO: 2479173 - RNA, 15 nt, Brucella suis 1330
uggcacaagaacagc

SEQ ID NO: 2479174 - RNA, 21 nt, Brucella suis 1330
uggcagcaaauucaaagaauu

SEQ ID NO: 2479175 - RNA, 18 nt, Brucella suis 1330
uggcagcaugaucgccac

SEQ ID NO: 2479176 - RNA, 13 nt, Brucella suis 1330
uggcagcgccggg

SEQ ID NO: 2479177 - RNA, 17 nt, Brucella suis 1330
uggcauagccggcaugg

SEQ ID NO: 2479178 - RNA, 22 nt, Brucella suis 1330
uggcauaggagacuguuccgcc

SEQ ID NO: 2479179 - RNA, 17 nt, Brucella suis 1330
uggcaucaauccuucau

SEQ ID NO: 2479180 - RNA, 20 nt, Brucella suis 1330
uggcaucagucgaauuucag

SEQ ID NO: 2479181 - RNA, 12 nt, Brucella suis 1330
uggcauccacuc

SEQ ID NO: 2479182 - RNA, 19 nt, Brucella suis 1330
uggcaucgguuucagccgu

SEQ ID NO: 2479183 - RNA, 18 nt, Brucella suis 1330
uggcauuauuccgccugc

SEQ ID NO: 2479184 - RNA, 16 nt, Brucella suis 1330
uggcauugcccaugga

SEQ ID NO: 2479185 - RNA, 22 nt, Brucella suis 1330
uggccagccgcaaugagcccgc

SEQ ID NO: 2479186 - RNA, 18 nt, Brucella suis 1330
uggcccagcccuuuucag

SEQ ID NO: 2479187 - RNA, 18 nt, Brucella suis 1330
uggccccauaaagcuggu

SEQ ID NO: 2479188 - RNA, 20 nt, Brucella suis 1330
uggccccauaaagcugguug

SEQ ID NO: 2479189 - RNA, 15 nt, Brucella suis 1330
uggcccgauaucggu

SEQ ID NO: 2479190 - RNA, 22 nt, Brucella suis 1330
uggcccugucagcgaaaccauc

SEQ ID NO: 2479191 - RNA, 17 nt, Brucella suis 1330
uggccgaagccgcuugc

SEQ ID NO: 2479192 - RNA, 13 nt, Brucella suis 1330
uggccgccccggc

SEQ ID NO: 2479193 - RNA, 18 nt, Brucella suis 1330
uggccgccccggcgcagc

SEQ ID NO: 2479194 - RNA, 22 nt, Brucella suis 1330
uggccgccccggcgcagcgcgu

SEQ ID NO: 2479195 - RNA, 23 nt, Brucella suis 1330
uggccgcuuugcggaggcggcug

SEQ ID NO: 2479196 - RNA, 23 nt, Brucella suis 1330
uggccggcgccuuguucuuuguc

SEQ ID NO: 2479197 - RNA, 17 nt, Brucella suis 1330
uggccgucgcguucagc

SEQ ID NO: 2479198 - RNA, 21 nt, Brucella suis 1330
uggccucgauggccugcacau

SEQ ID NO: 2479199 - RNA, 13 nt, Brucella suis 1330
uggccucuuccag

SEQ ID NO: 2479200 - RNA, 16 nt, Brucella suis 1330
uggccucuuccaggag

SEQ ID NO: 2479201 - RNA, 14 nt, Brucella suis 1330
uggccuuccuugac

SEQ ID NO: 2479202 - RNA, 22 nt, Brucella suis 1330
uggccuugccgaucuggugcgg

SEQ ID NO: 2479203 - RNA, 16 nt, Brucella suis 1330
uggccuuugcccuggg

SEQ ID NO: 2479204 - RNA, 14 nt, Brucella suis 1330
uggcgaaaacggcc

SEQ ID NO: 2479205 - RNA, 21 nt, Brucella suis 1330
uggcgaaaacggccaugcgca

SEQ ID NO: 2479206 - RNA, 19 nt, Brucella suis 1330
uggcgacgcgcucgucgca

SEQ ID NO: 2479207 - RNA, 16 nt, Brucella suis 1330
uggcgacggccagcgc

SEQ ID NO: 2479208 - RNA, 22 nt, Brucella suis 1330
uggcgagcgcgcuuaugaucug

SEQ ID NO: 2479209 - RNA, 22 nt, Brucella suis 1330
uggcgaucagcgcaagaaggcg

SEQ ID NO: 2479210 - RNA, 14 nt, Brucella suis 1330
uggcgcccgcccgc

SEQ ID NO: 2479211 - RNA, 20 nt, Brucella suis 1330
uggcgcgaaaccggaacgcc

SEQ ID NO: 2479212 - RNA, 20 nt, Brucella suis 1330
uggcgcucaugaaacugucc

SEQ ID NO: 2479213 - RNA, 14 nt, Brucella suis 1330
uggcggaugaagaa

SEQ ID NO: 2479214 - RNA, 16 nt, Brucella suis 1330
uggcggauugcagcgg

SEQ ID NO: 2479215 - RNA, 18 nt, Brucella suis 1330
uggcggcaaaaagcggcg

SEQ ID NO: 2479216 - RNA, 20 nt, Brucella suis 1330
uggcggccaagcggaucgcg

SEQ ID NO: 2479217 - RNA, 13 nt, Brucella suis 1330
uggcggccggcaa

SEQ ID NO: 2479218 - RNA, 14 nt, Brucella suis 1330
uggcggccggcaac

SEQ ID NO: 2479219 - RNA, 17 nt, Brucella suis 1330
uggcgggccauuuccaa

SEQ ID NO: 2479220 - RNA, 18 nt, Brucella suis 1330
uggcgggccauuuccaau

SEQ ID NO: 2479221 - RNA, 14 nt, Brucella suis 1330
uggcggggcagggg

SEQ ID NO: 2479222 - RNA, 19 nt, Brucella suis 1330
uggcguagaaauagggcca

SEQ ID NO: 2479223 - RNA, 23 nt, Brucella suis 1330
uggcguccccaucgaaaccggca

SEQ ID NO: 2479224 - RNA, 21 nt, Brucella suis 1330
uggcguugcggcggucggccu

SEQ ID NO: 2479225 - RNA, 16 nt, Brucella suis 1330
uggcuaugcgcuucau

SEQ ID NO: 2479226 - RNA, 19 nt, Brucella suis 1330
uggcugagauaaaccggcc

SEQ ID NO: 2479227 - RNA, 16 nt, Brucella suis 1330
uggcugauuucuuccc

SEQ ID NO: 2479228 - RNA, 12 nt, Brucella suis 1330
uggcugggcccc

SEQ ID NO: 2479229 - RNA, 21 nt, Brucella suis 1330
uggcugugcugguaaaaugca

SEQ ID NO: 2479230 - RNA, 14 nt, Brucella suis 1330
uggcuguuucgcau

SEQ ID NO: 2479231 - RNA, 15 nt, Brucella suis 1330
uggcuucaagcggcg

SEQ ID NO: 2479232 - RNA, 12 nt, Brucella suis 1330
uggcuuccagca

SEQ ID NO: 2479233 - RNA, 19 nt, Brucella suis 1330
uggcuugaagcugccgcgg

SEQ ID NO: 2479234 - RNA, 13 nt, Brucella suis 1330
ugggaaaccgcgc

SEQ ID NO: 2479235 - RNA, 11 nt, Brucella suis 1330
ugggacuggac

SEQ ID NO: 2479236 - RNA, 16 nt, Brucella suis 1330
ugggcaagaucauccg

SEQ ID NO: 2479237 - RNA, 18 nt, Brucella suis 1330
ugggcaaggccagagagc

SEQ ID NO: 2479238 - RNA, 12 nt, Brucella suis 1330
ugggcagcagau

SEQ ID NO: 2479239 - RNA, 22 nt, Brucella suis 1330
ugggcccuuaugaucgccgccc

SEQ ID NO: 2479240 - RNA, 12 nt, Brucella suis 1330
ugggccucaagc

SEQ ID NO: 2479241 - RNA, 11 nt, Brucella suis 1330
ugggccugaug

SEQ ID NO: 2479242 - RNA, 13 nt, Brucella suis 1330
ugggccugaugau

SEQ ID NO: 2479243 - RNA, 14 nt, Brucella suis 1330
ugggccuuguuuuc

SEQ ID NO: 2479244 - RNA, 12 nt, Brucella suis 1330
ugggcggccagc

SEQ ID NO: 2479245 - RNA, 16 nt, Brucella suis 1330
ugggcggcggccgggc

SEQ ID NO: 2479246 - RNA, 20 nt, Brucella suis 1330
ugggcggggagcaggcaggc

SEQ ID NO: 2479247 - RNA, 19 nt, Brucella suis 1330
ugggcguguuugcggccuu

SEQ ID NO: 2479248 - RNA, 14 nt, Brucella suis 1330
uggguaggauaaug

SEQ ID NO: 2479249 - RNA, 23 nt, Brucella suis 1330
ugguaaaaugcaccgccugccag

SEQ ID NO: 2479250 - RNA, 17 nt, Brucella suis 1330
uggucgacaaugaagca

SEQ ID NO: 2479251 - RNA, 19 nt, Brucella suis 1330
uggucugcggcuuccagau

SEQ ID NO: 2479252 - RNA, 16 nt, Brucella suis 1330
uggugagcauggucac

SEQ ID NO: 2479253 - RNA, 17 nt, Brucella suis 1330
uggugagcuugcgcagc

SEQ ID NO: 2479254 - RNA, 23 nt, Brucella suis 1330
uggugccgaauguggugacggcg

SEQ ID NO: 2479255 - RNA, 19 nt, Brucella suis 1330
uggugcgauccaccaucac

SEQ ID NO: 2479256 - RNA, 15 nt, Brucella suis 1330
uggugcugccauggc

SEQ ID NO: 2479257 - RNA, 20 nt, Brucella suis 1330
ugguugcgcggccagccagc

SEQ ID NO: 2479258 - RNA, 13 nt, Brucella suis 1330
ugguuugaaaaug

SEQ ID NO: 2479259 - RNA, 20 nt, Brucella suis 1330
uguaaggugaugucaguuca

SEQ ID NO: 2479260 - RNA, 23 nt, Brucella suis 1330
uguacacgccaaccaaagaaaaa

SEQ ID NO: 2479261 - RNA, 23 nt, Brucella suis 1330
uguacccaaacguacauuguucc

SEQ ID NO: 2479262 - RNA, 22 nt, Brucella suis 1330
uguaccuuaaaguacacuccgc

SEQ ID NO: 2479263 - RNA, 22 nt, Brucella suis 1330
uguagaagacaaagcccgucuc

SEQ ID NO: 2479264 - RNA, 20 nt, Brucella suis 1330
uguagccgcgaaccgucgcc

SEQ ID NO: 2479265 - RNA, 20 nt, Brucella suis 1330
uguaggcuggcaucgccaau

SEQ ID NO: 2479266 - RNA, 15 nt, Brucella suis 1330
uguaucaccagaccg

SEQ ID NO: 2479267 - RNA, 12 nt, Brucella suis 1330
uguaucccgaaa

SEQ ID NO: 2479268 - RNA, 14 nt, Brucella suis 1330
ugucacgccggcau

SEQ ID NO: 2479269 - RNA, 16 nt, Brucella suis 1330
ugucacgccggcauca

SEQ ID NO: 2479270 - RNA, 17 nt, Brucella suis 1330
ugucagccgguagccuu

SEQ ID NO: 2479271 - RNA, 13 nt, Brucella suis 1330
ugucagcgggcaa

SEQ ID NO: 2479272 - RNA, 18 nt, Brucella suis 1330
ugucagcuuuccggcuuc

SEQ ID NO: 2479273 - RNA, 22 nt, Brucella suis 1330
ugucagggaaacucucacagcc

SEQ ID NO: 2479274 - RNA, 21 nt, Brucella suis 1330
ugucaguucaggugcgacuuc

SEQ ID NO: 2479275 - RNA, 14 nt, Brucella suis 1330
ugucauacauggcg

SEQ ID NO: 2479276 - RNA, 20 nt, Brucella suis 1330
ugucauggccgccccggcgc

SEQ ID NO: 2479277 - RNA, 19 nt, Brucella suis 1330
uguccacauggucgucgag

SEQ ID NO: 2479278 - RNA, 16 nt, Brucella suis 1330
uguccaccaccugccc

SEQ ID NO: 2479279 - RNA, 16 nt, Brucella suis 1330
uguccagaaagagcau

SEQ ID NO: 2479280 - RNA, 20 nt, Brucella suis 1330
uguccgacagaucggcaaga

SEQ ID NO: 2479281 - RNA, 18 nt, Brucella suis 1330
uguccgacauccaucggc

SEQ ID NO: 2479282 - RNA, 23 nt, Brucella suis 1330
uguccgccugaucgucaggcgca

SEQ ID NO: 2479283 - RNA, 13 nt, Brucella suis 1330
uguccgccugcca

SEQ ID NO: 2479284 - RNA, 13 nt, Brucella suis 1330
uguccggccagcu

SEQ ID NO: 2479285 - RNA, 17 nt, Brucella suis 1330
uguccgguccccgccgc

SEQ ID NO: 2479286 - RNA, 14 nt, Brucella suis 1330
uguccugccagcgg

SEQ ID NO: 2479287 - RNA, 20 nt, Brucella suis 1330
ugucgaccggcggcaggcag

SEQ ID NO: 2479288 - RNA, 23 nt, Brucella suis 1330
ugucgcauccaugagcagcggca

SEQ ID NO: 2479289 - RNA, 23 nt, Brucella suis 1330
ugucgcauuauccuacgcaaaac

SEQ ID NO: 2479290 - RNA, 13 nt, Brucella suis 1330
ugucgccgcucau

SEQ ID NO: 2479291 - RNA, 14 nt, Brucella suis 1330
ugucgucgugcagc

SEQ ID NO: 2479292 - RNA, 22 nt, Brucella suis 1330
ugugaugcgguucagauugcag

SEQ ID NO: 2479293 - RNA, 19 nt, Brucella suis 1330
ugugauuccaacauuugcu

SEQ ID NO: 2479294 - RNA, 19 nt, Brucella suis 1330
ugugcagacaggccagucg

SEQ ID NO: 2479295 - RNA, 13 nt, Brucella suis 1330
ugugcagcgugcc

SEQ ID NO: 2479296 - RNA, 18 nt, Brucella suis 1330
ugugcauaggauucgcgg

SEQ ID NO: 2479297 - RNA, 14 nt, Brucella suis 1330
ugugccaccagcac

SEQ ID NO: 2479298 - RNA, 20 nt, Brucella suis 1330
ugugccgcugcaccgggccg

SEQ ID NO: 2479299 - RNA, 12 nt, Brucella suis 1330
ugugcgcgcgcc

SEQ ID NO: 2479300 - RNA, 20 nt, Brucella suis 1330
ugugcgcgcgccaucggcaa

SEQ ID NO: 2479301 - RNA, 17 nt, Brucella suis 1330
ugugcgggcuucuucca

SEQ ID NO: 2479302 - RNA, 18 nt, Brucella suis 1330
ugugcgggcuucuuccag

SEQ ID NO: 2479303 - RNA, 23 nt, Brucella suis 1330
ugugcgggcuucuuccaguuccu

SEQ ID NO: 2479304 - RNA, 22 nt, Brucella suis 1330
ugugcugguaaaaugcaccgcc

SEQ ID NO: 2479305 - RNA, 16 nt, Brucella suis 1330
uguggcaaaagccucc

SEQ ID NO: 2479306 - RNA, 17 nt, Brucella suis 1330
uguggugugagugcgca

SEQ ID NO: 2479307 - RNA, 14 nt, Brucella suis 1330
uguuaaaaccggaa

SEQ ID NO: 2479308 - RNA, 20 nt, Brucella suis 1330
uguucagccgcagccgccau

SEQ ID NO: 2479309 - RNA, 20 nt, Brucella suis 1330
uguuccagccgggcuuuccu

SEQ ID NO: 2479310 - RNA, 13 nt, Brucella suis 1330
uguuccgggccgg

SEQ ID NO: 2479311 - RNA, 21 nt, Brucella suis 1330
uguucgacuugaagagccgca

SEQ ID NO: 2479312 - RNA, 17 nt, Brucella suis 1330
uguucgaugccauucac

SEQ ID NO: 2479313 - RNA, 14 nt, Brucella suis 1330
uguucuuugcagcc

SEQ ID NO: 2479314 - RNA, 18 nt, Brucella suis 1330
uguugaaacaggccuuca

SEQ ID NO: 2479315 - RNA, 21 nt, Brucella suis 1330
uguugcagaagguacuggcaa

SEQ ID NO: 2479316 - RNA, 20 nt, Brucella suis 1330
uguugccggaaauugggauc

SEQ ID NO: 2479317 - RNA, 22 nt, Brucella suis 1330
uguugcgaggaaaagacguguc

SEQ ID NO: 2479318 - RNA, 16 nt, Brucella suis 1330
uguugcgauccucuug

SEQ ID NO: 2479319 - RNA, 19 nt, Brucella suis 1330
uguuggcccauaucaucag

SEQ ID NO: 2479320 - RNA, 17 nt, Brucella suis 1330
uguugggguuggccuga

SEQ ID NO: 2479321 - RNA, 19 nt, Brucella suis 1330
uguugggguuggccugaac

SEQ ID NO: 2479322 - RNA, 16 nt, Brucella suis 1330
uguuggucugcggcuu

SEQ ID NO: 2479323 - RNA, 13 nt, Brucella suis 1330
uguuuaugaaaac

SEQ ID NO: 2479324 - RNA, 18 nt, Brucella suis 1330
uguuucgcgcaauggcug

SEQ ID NO: 2479325 - RNA, 12 nt, Brucella suis 1330
uguuuuggaaag

SEQ ID NO: 2479326 - RNA, 16 nt, Brucella suis 1330
uguuuuuacgcauuau

SEQ ID NO: 2479327 - RNA, 15 nt, Brucella suis 1330
uuaaacuaccaucug

SEQ ID NO: 2479328 - RNA, 17 nt, Brucella suis 1330
uuaaagagccauuauuc

SEQ ID NO: 2479329 - RNA, 20 nt, Brucella suis 1330
uuacaaaaauggaaaaaccc

SEQ ID NO: 2479330 - RNA, 21 nt, Brucella suis 1330
uuacaucaaaccaguugaagc

SEQ ID NO: 2479331 - RNA, 21 nt, Brucella suis 1330
uuacccaucacgggcuuugcc

SEQ ID NO: 2479332 - RNA, 13 nt, Brucella suis 1330
uuaccgcaaccca

SEQ ID NO: 2479333 - RNA, 21 nt, Brucella suis 1330
uuacgccauauugggagcgca

SEQ ID NO: 2479334 - RNA, 16 nt, Brucella suis 1330
uuacguuuucgucaaa

SEQ ID NO: 2479335 - RNA, 19 nt, Brucella suis 1330
uuacugcccuauugccuua

SEQ ID NO: 2479336 - RNA, 22 nt, Brucella suis 1330
uuacugcccuauugccuuaauc

SEQ ID NO: 2479337 - RNA, 13 nt, Brucella suis 1330
uuagagcaauccc

SEQ ID NO: 2479338 - RNA, 21 nt, Brucella suis 1330
uuaguaucggcagccuugagc

SEQ ID NO: 2479339 - RNA, 15 nt, Brucella suis 1330
uuauccgaaaaccgu

SEQ ID NO: 2479340 - RNA, 23 nt, Brucella suis 1330
uuauccgcggcgguuuugagcug

SEQ ID NO: 2479341 - RNA, 21 nt, Brucella suis 1330
uuauccuuugacggacgccug

SEQ ID NO: 2479342 - RNA, 11 nt, Brucella suis 1330
uuaugcaucug

SEQ ID NO: 2479343 - RNA, 21 nt, Brucella suis 1330
uuaugcuauagagcgccgauc

SEQ ID NO: 2479344 - RNA, 18 nt, Brucella suis 1330
uuaugcuggcagcggcag

SEQ ID NO: 2479345 - RNA, 21 nt, Brucella suis 1330
uuauugcccggaucauccauu

SEQ ID NO: 2479346 - RNA, 15 nt, Brucella suis 1330
uucaaacaacgcugc

SEQ ID NO: 2479347 - RNA, 15 nt, Brucella suis 1330
uucaaaccaaaaaac

SEQ ID NO: 2479348 - RNA, 19 nt, Brucella suis 1330
uucaaagcgcggaaugaca

SEQ ID NO: 2479349 - RNA, 22 nt, Brucella suis 1330
uucaaaggaaagauccuucaca

SEQ ID NO: 2479350 - RNA, 12 nt, Brucella suis 1330
uucaacgcuguc

SEQ ID NO: 2479351 - RNA, 15 nt, Brucella suis 1330
uucaaucugcauaau

SEQ ID NO: 2479352 - RNA, 19 nt, Brucella suis 1330
uucacauccuucacuucau

SEQ ID NO: 2479353 - RNA, 15 nt, Brucella suis 1330
uucacaugcuugccg

SEQ ID NO: 2479354 - RNA, 22 nt, Brucella suis 1330
uucaccagucacgguugccuug

SEQ ID NO: 2479355 - RNA, 21 nt, Brucella suis 1330
uucacgcgagcgcagcggcag

SEQ ID NO: 2479356 - RNA, 23 nt, Brucella suis 1330
uucacugcauuggcgauuuucug

SEQ ID NO: 2479357 - RNA, 18 nt, Brucella suis 1330
uucagaaagaaagcuguc

SEQ ID NO: 2479358 - RNA, 21 nt, Brucella suis 1330
uucagaucgacgcagaaauug

SEQ ID NO: 2479359 - RNA, 16 nt, Brucella suis 1330
uucagcacaagccauc

SEQ ID NO: 2479360 - RNA, 14 nt, Brucella suis 1330
uucagccagaaucu

SEQ ID NO: 2479361 - RNA, 21 nt, Brucella suis 1330
uucagccagaaucugcgcguc

SEQ ID NO: 2479362 - RNA, 20 nt, Brucella suis 1330
uucagcccugcacaccaaaa

SEQ ID NO: 2479363 - RNA, 22 nt, Brucella suis 1330
uucagccuccugugcauugcca

SEQ ID NO: 2479364 - RNA, 15 nt, Brucella suis 1330
uucagcgaagcgaug

SEQ ID NO: 2479365 - RNA, 16 nt, Brucella suis 1330
uucaggcacucuccuc

SEQ ID NO: 2479366 - RNA, 19 nt, Brucella suis 1330
uucaggccgucgaucagcu

SEQ ID NO: 2479367 - RNA, 13 nt, Brucella suis 1330
uucagggcaucga

SEQ ID NO: 2479368 - RNA, 18 nt, Brucella suis 1330
uucaguuuguugaaacag

SEQ ID NO: 2479369 - RNA, 15 nt, Brucella suis 1330
uucaucgcgccgcaa

SEQ ID NO: 2479370 - RNA, 15 nt, Brucella suis 1330
uucaugcugauugga

SEQ ID NO: 2479371 - RNA, 17 nt, Brucella suis 1330
uucauggcuugaagcgu

SEQ ID NO: 2479372 - RNA, 15 nt, Brucella suis 1330
uucauuaaagccaua

SEQ ID NO: 2479373 - RNA, 14 nt, Brucella suis 1330
uucauucaaucugc

SEQ ID NO: 2479374 - RNA, 13 nt, Brucella suis 1330
uucauuuuaucaa

SEQ ID NO: 2479375 - RNA, 16 nt, Brucella suis 1330
uucauuuuuagaagau

SEQ ID NO: 2479376 - RNA, 16 nt, Brucella suis 1330
uuccagauugucuuga

SEQ ID NO: 2479377 - RNA, 23 nt, Brucella suis 1330
uuccagcaaaagugugaaacggu

SEQ ID NO: 2479378 - RNA, 16 nt, Brucella suis 1330
uuccagcaaagcgauu

SEQ ID NO: 2479379 - RNA, 19 nt, Brucella suis 1330
uuccagcaggcucugaaac

SEQ ID NO: 2479380 - RNA, 20 nt, Brucella suis 1330
uucccacuuaugggagacau

SEQ ID NO: 2479381 - RNA, 21 nt, Brucella suis 1330
uuccccgcauaaaugcuccug

SEQ ID NO: 2479382 - RNA, 19 nt, Brucella suis 1330
uucccuguggagagaggaa

SEQ ID NO: 2479383 - RNA, 17 nt, Brucella suis 1330
uuccgaauacaagccca

SEQ ID NO: 2479384 - RNA, 16 nt, Brucella suis 1330
uuccgcaccgcacugg

SEQ ID NO: 2479385 - RNA, 16 nt, Brucella suis 1330
uuccgcaccgccgauc

SEQ ID NO: 2479386 - RNA, 16 nt, Brucella suis 1330
uuccgccgaucugcac

SEQ ID NO: 2479387 - RNA, 17 nt, Brucella suis 1330
uuccgccggggcaggcu

SEQ ID NO: 2479388 - RNA, 12 nt, Brucella suis 1330
uuccgccucccu

SEQ ID NO: 2479389 - RNA, 19 nt, Brucella suis 1330
uuccgcgcaaaaucugcuc

SEQ ID NO: 2479390 - RNA, 17 nt, Brucella suis 1330
uuccgcuacugcggcga

SEQ ID NO: 2479391 - RNA, 21 nt, Brucella suis 1330
uuccgggcugcuuccacaggc

SEQ ID NO: 2479392 - RNA, 16 nt, Brucella suis 1330
uuccgggucuucgccc

SEQ ID NO: 2479393 - RNA, 18 nt, Brucella suis 1330
uuccgguauaugcaccag

SEQ ID NO: 2479394 - RNA, 14 nt, Brucella suis 1330
uuccguaucuccgg

SEQ ID NO: 2479395 - RNA, 14 nt, Brucella suis 1330
uuccgucagggccg

SEQ ID NO: 2479396 - RNA, 16 nt, Brucella suis 1330
uuccguggcgcggauc

SEQ ID NO: 2479397 - RNA, 21 nt, Brucella suis 1330
uuccuccagaucguccucgug

SEQ ID NO: 2479398 - RNA, 18 nt, Brucella suis 1330
uuccugaccguuucgaua

SEQ ID NO: 2479399 - RNA, 23 nt, Brucella suis 1330
uuccugcccggcaucacgaagag

SEQ ID NO: 2479400 - RNA, 17 nt, Brucella suis 1330
uuccugcggcuucuggg

SEQ ID NO: 2479401 - RNA, 20 nt, Brucella suis 1330
uuccugcuucaucgcggcag

SEQ ID NO: 2479402 - RNA, 16 nt, Brucella suis 1330
uuccuugccgggaaga

SEQ ID NO: 2479403 - RNA, 20 nt, Brucella suis 1330
uuccuuuucggcuuccuugc

SEQ ID NO: 2479404 - RNA, 22 nt, Brucella suis 1330
uucgacguggagcaggccauuc

SEQ ID NO: 2479405 - RNA, 18 nt, Brucella suis 1330
uucgagcaucgaucugaa

SEQ ID NO: 2479406 - RNA, 22 nt, Brucella suis 1330
uucgauauugagagauuucacc

SEQ ID NO: 2479407 - RNA, 23 nt, Brucella suis 1330
uucgauggcguucgucaaugcgc

SEQ ID NO: 2479408 - RNA, 21 nt, Brucella suis 1330
uucgauucgcuaucgaaacaa

SEQ ID NO: 2479409 - RNA, 13 nt, Brucella suis 1330
uucgcauugccca

SEQ ID NO: 2479410 - RNA, 14 nt, Brucella suis 1330
uucgcgcagaaggc

SEQ ID NO: 2479411 - RNA, 18 nt, Brucella suis 1330
uucgcgcaucgggcgcac

SEQ ID NO: 2479412 - RNA, 21 nt, Brucella suis 1330
uucgcgcgcaagcggcucgac

SEQ ID NO: 2479413 - RNA, 20 nt, Brucella suis 1330
uucggaaaagaugcgcguca

SEQ ID NO: 2479414 - RNA, 17 nt, Brucella suis 1330
uucggauccuccugcgc

SEQ ID NO: 2479415 - RNA, 13 nt, Brucella suis 1330
uucggauuuuucu

SEQ ID NO: 2479416 - RNA, 16 nt, Brucella suis 1330
uucggccauuucaggu

SEQ ID NO: 2479417 - RNA, 15 nt, Brucella suis 1330
uucggcggcuuucca

SEQ ID NO: 2479418 - RNA, 14 nt, Brucella suis 1330
uucggcgggcuuuu

SEQ ID NO: 2479419 - RNA, 18 nt, Brucella suis 1330
uucggcuuccuugcgcuu

SEQ ID NO: 2479420 - RNA, 15 nt, Brucella suis 1330
uucgggcgaauggaa

SEQ ID NO: 2479421 - RNA, 16 nt, Brucella suis 1330
uucgggcggcaccccc

SEQ ID NO: 2479422 - RNA, 12 nt, Brucella suis 1330
uucguagcugcu

SEQ ID NO: 2479423 - RNA, 21 nt, Brucella suis 1330
uucgucaaaccgcccuuuucc

SEQ ID NO: 2479424 - RNA, 21 nt, Brucella suis 1330
uucguugcuuccguggcaaug

SEQ ID NO: 2479425 - RNA, 21 nt, Brucella suis 1330
uucguuuuaucagcuuauucu

SEQ ID NO: 2479426 - RNA, 14 nt, Brucella suis 1330
uucuaaagcaaaac

SEQ ID NO: 2479427 - RNA, 23 nt, Brucella suis 1330
uucuccaucugcggcgucagggc

SEQ ID NO: 2479428 - RNA, 20 nt, Brucella suis 1330
uucucgaacagguugcgcca

SEQ ID NO: 2479429 - RNA, 14 nt, Brucella suis 1330
uucucgaaucccgg

SEQ ID NO: 2479430 - RNA, 15 nt, Brucella suis 1330
uucucgcaaaacacc

SEQ ID NO: 2479431 - RNA, 12 nt, Brucella suis 1330
uucucuugccgc

SEQ ID NO: 2479432 - RNA, 12 nt, Brucella suis 1330
uucugcaucaug

SEQ ID NO: 2479433 - RNA, 20 nt, Brucella suis 1330
uucugcccgccggggccgga

SEQ ID NO: 2479434 - RNA, 11 nt, Brucella suis 1330
uucugccgcgc

SEQ ID NO: 2479435 - RNA, 23 nt, Brucella suis 1330
uucugcgcccgcgccgcuugcca

SEQ ID NO: 2479436 - RNA, 14 nt, Brucella suis 1330
uucugcugcggauc

SEQ ID NO: 2479437 - RNA, 20 nt, Brucella suis 1330
uucugcuuaucaaggccggg

SEQ ID NO: 2479438 - RNA, 14 nt, Brucella suis 1330
uucuggauuucauc

SEQ ID NO: 2479439 - RNA, 14 nt, Brucella suis 1330
uucuguuaucccuc

SEQ ID NO: 2479440 - RNA, 15 nt, Brucella suis 1330
uucuguuaucccuca

SEQ ID NO: 2479441 - RNA, 13 nt, Brucella suis 1330
uucuuaugccaga

SEQ ID NO: 2479442 - RNA, 21 nt, Brucella suis 1330
uucuucaccagccuugagggc

SEQ ID NO: 2479443 - RNA, 17 nt, Brucella suis 1330
uucuuccaguuccuucu

SEQ ID NO: 2479444 - RNA, 18 nt, Brucella suis 1330
uucuuccaguuccuucuu

SEQ ID NO: 2479445 - RNA, 17 nt, Brucella suis 1330
uucuuccaguuucugaa

SEQ ID NO: 2479446 - RNA, 18 nt, Brucella suis 1330
uucuugagguugagcugc

SEQ ID NO: 2479447 - RNA, 23 nt, Brucella suis 1330
uucuugagguugagcugcucggc

SEQ ID NO: 2479448 - RNA, 18 nt, Brucella suis 1330
uugaaaaggauauccuug

SEQ ID NO: 2479449 - RNA, 10 nt, Brucella suis 1330
uugaaauaau

SEQ ID NO: 2479450 - RNA, 17 nt, Brucella suis 1330
uugaacgccuuuuucac

SEQ ID NO: 2479451 - RNA, 16 nt, Brucella suis 1330
uugaagccgauccgca

SEQ ID NO: 2479452 - RNA, 20 nt, Brucella suis 1330
uugaagccuuccgccucuuc

SEQ ID NO: 2479453 - RNA, 19 nt, Brucella suis 1330
uugaagcugucgccagcgc

SEQ ID NO: 2479454 - RNA, 21 nt, Brucella suis 1330
uugacaagaucgucacugcaa

SEQ ID NO: 2479455 - RNA, 14 nt, Brucella suis 1330
uugaccagauagcc

SEQ ID NO: 2479456 - RNA, 23 nt, Brucella suis 1330
uugagaguagucugcgcaucguc

SEQ ID NO: 2479457 - RNA, 20 nt, Brucella suis 1330
uugagccgcgccaugccauc

SEQ ID NO: 2479458 - RNA, 21 nt, Brucella suis 1330
uugagccgcgccaugccaucc

SEQ ID NO: 2479459 - RNA, 14 nt, Brucella suis 1330
uugaggauuuccac

SEQ ID NO: 2479460 - RNA, 11 nt, Brucella suis 1330
uugaguuucau

SEQ ID NO: 2479461 - RNA, 21 nt, Brucella suis 1330
uugauaaucggacagauugcu

SEQ ID NO: 2479462 - RNA, 21 nt, Brucella suis 1330
uugaucccgaucugagaaagc

SEQ ID NO: 2479463 - RNA, 21 nt, Brucella suis 1330
uugaucgcaagccaaagcccg

SEQ ID NO: 2479464 - RNA, 22 nt, Brucella suis 1330
uugaucgcaagccaaagcccgu

SEQ ID NO: 2479465 - RNA, 21 nt, Brucella suis 1330
uugaugacgaaaaaggcgauc

SEQ ID NO: 2479466 - RNA, 22 nt, Brucella suis 1330
uugaugauagaauaaagccaua

SEQ ID NO: 2479467 - RNA, 22 nt, Brucella suis 1330
uugauuucggauugaagccgau

SEQ ID NO: 2479468 - RNA, 19 nt, Brucella suis 1330
uugcaacgacauagauucc

SEQ ID NO: 2479469 - RNA, 22 nt, Brucella suis 1330
uugcaacgucaagcagcggauc

SEQ ID NO: 2479470 - RNA, 20 nt, Brucella suis 1330
uugcaccgcgccggaaggcg

SEQ ID NO: 2479471 - RNA, 16 nt, Brucella suis 1330
uugcagaugagcggca

SEQ ID NO: 2479472 - RNA, 14 nt, Brucella suis 1330
uugcauuccagaag

SEQ ID NO: 2479473 - RNA, 18 nt, Brucella suis 1330
uugccauuuuccguggcg

SEQ ID NO: 2479474 - RNA, 12 nt, Brucella suis 1330
uugcccagaaca

SEQ ID NO: 2479475 - RNA, 17 nt, Brucella suis 1330
uugccgaccuugagccc

SEQ ID NO: 2479476 - RNA, 14 nt, Brucella suis 1330
uugccgcauuaucc

SEQ ID NO: 2479477 - RNA, 17 nt, Brucella suis 1330
uugccgccgcgcguauc

SEQ ID NO: 2479478 - RNA, 14 nt, Brucella suis 1330
uugccgccuuucau

SEQ ID NO: 2479479 - RNA, 16 nt, Brucella suis 1330
uugccgccuuucaugc

SEQ ID NO: 2479480 - RNA, 15 nt, Brucella suis 1330
uugccggccugaaac

SEQ ID NO: 2479481 - RNA, 19 nt, Brucella suis 1330
uugccgugguaugccagcc

SEQ ID NO: 2479482 - RNA, 21 nt, Brucella suis 1330
uugccuucaggcggcgcucga

SEQ ID NO: 2479483 - RNA, 16 nt, Brucella suis 1330
uugccuucaucggcaa

SEQ ID NO: 2479484 - RNA, 15 nt, Brucella suis 1330
uugccuugcccaugg

SEQ ID NO: 2479485 - RNA, 12 nt, Brucella suis 1330
uugccuugucca

SEQ ID NO: 2479486 - RNA, 12 nt, Brucella suis 1330
uugcgaaccgga

SEQ ID NO: 2479487 - RNA, 12 nt, Brucella suis 1330
uugcgaauggca

SEQ ID NO: 2479488 - RNA, 13 nt, Brucella suis 1330
uugcgaauggcaa

SEQ ID NO: 2479489 - RNA, 14 nt, Brucella suis 1330
uugcgaggaaaaga

SEQ ID NO: 2479490 - RNA, 18 nt, Brucella suis 1330
uugcgcaaacaucgacau

SEQ ID NO: 2479491 - RNA, 20 nt, Brucella suis 1330
uugcgcaagugcugcaaagg

SEQ ID NO: 2479492 - RNA, 21 nt, Brucella suis 1330
uugcgcagcgcaggcgcgauc

SEQ ID NO: 2479493 - RNA, 14 nt, Brucella suis 1330
uugcgcagcgccgc

SEQ ID NO: 2479494 - RNA, 16 nt, Brucella suis 1330
uugcgccaccacggcg

SEQ ID NO: 2479495 - RNA, 16 nt, Brucella suis 1330
uugcgcuugccgccgg

SEQ ID NO: 2479496 - RNA, 17 nt, Brucella suis 1330
uugcggauacccaugcg

SEQ ID NO: 2479497 - RNA, 14 nt, Brucella suis 1330
uugcggcuugccac

SEQ ID NO: 2479498 - RNA, 14 nt, Brucella suis 1330
uugcgggaacccuc

SEQ ID NO: 2479499 - RNA, 13 nt, Brucella suis 1330
uugcgggcaagca

SEQ ID NO: 2479500 - RNA, 13 nt, Brucella suis 1330
uugcguuggaaaa

SEQ ID NO: 2479501 - RNA, 14 nt, Brucella suis 1330
uugcuaaaugcaag

SEQ ID NO: 2479502 - RNA, 16 nt, Brucella suis 1330
uugcugaugauuuccc

SEQ ID NO: 2479503 - RNA, 23 nt, Brucella suis 1330
uugcugccugcggugcugaaggc

SEQ ID NO: 2479504 - RNA, 20 nt, Brucella suis 1330
uugcuggaaaugcucuagaa

SEQ ID NO: 2479505 - RNA, 15 nt, Brucella suis 1330
uugcuucgcaccuuc

SEQ ID NO: 2479506 - RNA, 15 nt, Brucella suis 1330
uugcuuuauccgcaa

SEQ ID NO: 2479507 - RNA, 19 nt, Brucella suis 1330
uuggauugccauuuucauc

SEQ ID NO: 2479508 - RNA, 15 nt, Brucella suis 1330
uuggcaacaaggcga

SEQ ID NO: 2479509 - RNA, 17 nt, Brucella suis 1330
uuggcguugagccgcgc

SEQ ID NO: 2479510 - RNA, 15 nt, Brucella suis 1330
uuggcuaaagauacc

SEQ ID NO: 2479511 - RNA, 18 nt, Brucella suis 1330
uuggcucgaaaaugcucu

SEQ ID NO: 2479512 - RNA, 19 nt, Brucella suis 1330
uugggagcggcgccaacca

SEQ ID NO: 2479513 - RNA, 11 nt, Brucella suis 1330
uugggcagcag

SEQ ID NO: 2479514 - RNA, 22 nt, Brucella suis 1330
uugguaaaggcgaguuuucaaa

SEQ ID NO: 2479515 - RNA, 15 nt, Brucella suis 1330
uuguaauugaugcca

SEQ ID NO: 2479516 - RNA, 18 nt, Brucella suis 1330
uuguagacgaucuugcca

SEQ ID NO: 2479517 - RNA, 18 nt, Brucella suis 1330
uuguaguucaggccggcc

SEQ ID NO: 2479518 - RNA, 13 nt, Brucella suis 1330
uugucaggaaaaa

SEQ ID NO: 2479519 - RNA, 13 nt, Brucella suis 1330
uugucgagcggca

SEQ ID NO: 2479520 - RNA, 18 nt, Brucella suis 1330
uugucgccgacuuucaau

SEQ ID NO: 2479521 - RNA, 17 nt, Brucella suis 1330
uugucgucgugcagcgg

SEQ ID NO: 2479522 - RNA, 18 nt, Brucella suis 1330
uugucuguuguguuguug

SEQ ID NO: 2479523 - RNA, 14 nt, Brucella suis 1330
uugugauuccaaca

SEQ ID NO: 2479524 - RNA, 16 nt, Brucella suis 1330
uuguggcaaaagccuc

SEQ ID NO: 2479525 - RNA, 18 nt, Brucella suis 1330
uugugugccugugccgcu

SEQ ID NO: 2479526 - RNA, 14 nt, Brucella suis 1330
uuguuaucaagccg

SEQ ID NO: 2479527 - RNA, 22 nt, Brucella suis 1330
uuguuccagccgggcuuuccug

SEQ ID NO: 2479528 - RNA, 20 nt, Brucella suis 1330
uuguuccagucgccuuccgg

SEQ ID NO: 2479529 - RNA, 17 nt, Brucella suis 1330
uuguugaaagaaaagac

SEQ ID NO: 2479530 - RNA, 17 nt, Brucella suis 1330
uuuagagcauuuccagc

SEQ ID NO: 2479531 - RNA, 23 nt, Brucella suis 1330
uuuaugcuggcagcggcaggagc

SEQ ID NO: 2479532 - RNA, 19 nt, Brucella suis 1330
uuuauucaggauagauauu

SEQ ID NO: 2479533 - RNA, 16 nt, Brucella suis 1330
uuucaaacaacgcugc

SEQ ID NO: 2479534 - RNA, 13 nt, Brucella suis 1330
uuucaauggccgc

SEQ ID NO: 2479535 - RNA, 23 nt, Brucella suis 1330
uuucaccagaugcugaacaagca

SEQ ID NO: 2479536 - RNA, 18 nt, Brucella suis 1330
uuucacugcauuggcgau

SEQ ID NO: 2479537 - RNA, 17 nt, Brucella suis 1330
uuucagcaggcguugca

SEQ ID NO: 2479538 - RNA, 13 nt, Brucella suis 1330
uuucauagauucc

SEQ ID NO: 2479539 - RNA, 16 nt, Brucella suis 1330
uuucaugaaaaugcca

SEQ ID NO: 2479540 - RNA, 13 nt, Brucella suis 1330
uuucauucugaau

SEQ ID NO: 2479541 - RNA, 17 nt, Brucella suis 1330
uuucauugucgaaaauc

SEQ ID NO: 2479542 - RNA, 13 nt, Brucella suis 1330
uuuccaaugugcc

SEQ ID NO: 2479543 - RNA, 13 nt, Brucella suis 1330
uuuccagcccccu

SEQ ID NO: 2479544 - RNA, 15 nt, Brucella suis 1330
uuuccaguuccauug

SEQ ID NO: 2479545 - RNA, 21 nt, Brucella suis 1330
uuuccccgcauaaaugcuccu

SEQ ID NO: 2479546 - RNA, 17 nt, Brucella suis 1330
uuucccggcgcacggcg

SEQ ID NO: 2479547 - RNA, 22 nt, Brucella suis 1330
uuucccgguuuuuccaaaagcu

SEQ ID NO: 2479548 - RNA, 20 nt, Brucella suis 1330
uuuccgcuccugguucauca

SEQ ID NO: 2479549 - RNA, 13 nt, Brucella suis 1330
uuuccggcugccu

SEQ ID NO: 2479550 - RNA, 17 nt, Brucella suis 1330
uuuccgguagcgaaugc

SEQ ID NO: 2479551 - RNA, 17 nt, Brucella suis 1330
uuuccguggugcugcau

SEQ ID NO: 2479552 - RNA, 20 nt, Brucella suis 1330
uuucgccaagccggcgcagc

SEQ ID NO: 2479553 - RNA, 20 nt, Brucella suis 1330
uuucggcaaggaugcugcca

SEQ ID NO: 2479554 - RNA, 19 nt, Brucella suis 1330
uuucgggaugcgcucuaac

SEQ ID NO: 2479555 - RNA, 19 nt, Brucella suis 1330
uuucgggaugcgcucuaau

SEQ ID NO: 2479556 - RNA, 22 nt, Brucella suis 1330
uuucgggcaaggggcggaacag

SEQ ID NO: 2479557 - RNA, 15 nt, Brucella suis 1330
uuucgguuuggcgag

SEQ ID NO: 2479558 - RNA, 14 nt, Brucella suis 1330
uuucucaaugcgaa

SEQ ID NO: 2479559 - RNA, 16 nt, Brucella suis 1330
uuucucguuuucaugc

SEQ ID NO: 2479560 - RNA, 18 nt, Brucella suis 1330
uuucugguuuccgccauc

SEQ ID NO: 2479561 - RNA, 15 nt, Brucella suis 1330
uuucuucauccaguu

SEQ ID NO: 2479562 - RNA, 17 nt, Brucella suis 1330
uuugaaaauguucuaaa

SEQ ID NO: 2479563 - RNA, 22 nt, Brucella suis 1330
uuugaaucccggcuguuacaua

SEQ ID NO: 2479564 - RNA, 17 nt, Brucella suis 1330
uuugacgcgcaucuuuu

SEQ ID NO: 2479565 - RNA, 19 nt, Brucella suis 1330
uuugacggacgccugccau

SEQ ID NO: 2479566 - RNA, 18 nt, Brucella suis 1330
uuugacugcugccaaaaa

SEQ ID NO: 2479567 - RNA, 12 nt, Brucella suis 1330
uuugagcugcug

SEQ ID NO: 2479568 - RNA, 21 nt, Brucella suis 1330
uuugaucucggagcggccgga

SEQ ID NO: 2479569 - RNA, 16 nt, Brucella suis 1330
uuugaucugauugaau

SEQ ID NO: 2479570 - RNA, 21 nt, Brucella suis 1330
uuugcagggcuugcuugccau

SEQ ID NO: 2479571 - RNA, 18 nt, Brucella suis 1330
uuugcaggucugauugca

SEQ ID NO: 2479572 - RNA, 13 nt, Brucella suis 1330
uuugccgccagaa

SEQ ID NO: 2479573 - RNA, 20 nt, Brucella suis 1330
uuugccgcgcgaagcgcauc

SEQ ID NO: 2479574 - RNA, 22 nt, Brucella suis 1330
uuugccguugcgaugagccuca

SEQ ID NO: 2479575 - RNA, 14 nt, Brucella suis 1330
uuugcgcaccagau

SEQ ID NO: 2479576 - RNA, 18 nt, Brucella suis 1330
uuugcggcggaugaaccc

SEQ ID NO: 2479577 - RNA, 21 nt, Brucella suis 1330
uuugcggggccugaaugcaau

SEQ ID NO: 2479578 - RNA, 15 nt, Brucella suis 1330
uuugcggggcuucca

SEQ ID NO: 2479579 - RNA, 24 nt, Brucella suis 1330
uuugcgggggaaugugcuuaguug

SEQ ID NO: 2479580 - RNA, 14 nt, Brucella suis 1330
uuugcugccugcgg

SEQ ID NO: 2479581 - RNA, 20 nt, Brucella suis 1330
uuugcuggaaaugcucuaga

SEQ ID NO: 2479582 - RNA, 22 nt, Brucella suis 1330
uuuggcuaaagauaccagauca

SEQ ID NO: 2479583 - RNA, 22 nt, Brucella suis 1330
uuugguuugaaaauguucuaaa

SEQ ID NO: 2479584 - RNA, 16 nt, Brucella suis 1330
uuuguauuucaaugcu

SEQ ID NO: 2479585 - RNA, 12 nt, Brucella suis 1330
uuuguugcacuc

SEQ ID NO: 2479586 - RNA, 19 nt, Brucella suis 1330
uuuuagagcgcaucccgaa

SEQ ID NO: 2479587 - RNA, 23 nt, Brucella suis 1330
uuuuagcccgguugcgccaaaac

SEQ ID NO: 2479588 - RNA, 21 nt, Brucella suis 1330
uuuuauugcccggaucaucca

SEQ ID NO: 2479589 - RNA, 20 nt, Brucella suis 1330
uuuucaccggcauugagccg

SEQ ID NO: 2479590 - RNA, 19 nt, Brucella suis 1330
uuuucaguugcgcaaacau

SEQ ID NO: 2479591 - RNA, 11 nt, Brucella suis 1330
uuuucauguuu

SEQ ID NO: 2479592 - RNA, 13 nt, Brucella suis 1330
uuuucauucugaa

SEQ ID NO: 2479593 - RNA, 14 nt, Brucella suis 1330
uuuucauucugaau

SEQ ID NO: 2479594 - RNA, 12 nt, Brucella suis 1330
uuuuccagugca

SEQ ID NO: 2479595 - RNA, 16 nt, Brucella suis 1330
uuuucgagccaaaagu

SEQ ID NO: 2479596 - RNA, 14 nt, Brucella suis 1330
uuuucggauaagau

SEQ ID NO: 2479597 - RNA, 15 nt, Brucella suis 1330
uuuucggauaagaug

SEQ ID NO: 2479598 - RNA, 19 nt, Brucella suis 1330
uuuucgggauuuuucuuug

SEQ ID NO: 2479599 - RNA, 13 nt, Brucella suis 1330
uuuucuucaucca

SEQ ID NO: 2479600 - RNA, 14 nt, Brucella suis 1330
uuuugaaucuguga

SEQ ID NO: 2479601 - RNA, 15 nt, Brucella suis 1330
uuuugacgcaaaagc

SEQ ID NO: 2479602 - RNA, 11 nt, Brucella suis 1330
uuuugagcugc

SEQ ID NO: 2479603 - RNA, 15 nt, Brucella suis 1330
uuuugccgcauuuuc

SEQ ID NO: 2479604 - RNA, 17 nt, Brucella suis 1330
uuuugcgcgggauaaug

SEQ ID NO: 2479605 - RNA, 19 nt, Brucella suis 1330
uuuugcguuggaaaaugcg

SEQ ID NO: 2479606 - RNA, 18 nt, Brucella suis 1330
uuuugcuggaaaugcucu

SEQ ID NO: 2479607 - RNA, 20 nt, Brucella suis 1330
uuuuggcucgaaaaugcucu

SEQ ID NO: 2479608 - RNA, 19 nt, Brucella suis 1330
uuuuggguggcauagccgg

SEQ ID NO: 2479609 - RNA, 21 nt, Brucella suis 1330
uuuuguuucaagcucccaagc

SEQ ID NO: 2479610 - RNA, 19 nt, Brucella suis 1330
uuuuuccgcugcgaucugc

SEQ ID NO: 2479611 - RNA, 22 nt, Brucella suis 1330
uuuuugguuugaaaauguucua

SEQ ID NO: 2479612 - RNA, 16 nt, Brucella suis 1330
cguuggccgcggccgg

SEQ ID NO: 2479613 - RNA, 23 nt, Brucella suis 1330
cguuuccaucggggcgagcgcgc

SEQ ID NO: 2479614 - RNA, 22 nt, Brucella suis 1330
cguuuccgggucuucgcccggc

SEQ ID NO: 2479615 - RNA, 20 nt, Brucella suis 1330
cguuucgauauccuggccuu

SEQ ID NO: 2479616 - RNA, 13 nt, Brucella suis 1330
cguuuuccaugaa

SEQ ID NO: 2479617 - RNA, 13 nt, Brucella suis 1330
cuaaaaagcgcgc

SEQ ID NO: 2479618 - RNA, 21 nt, Brucella suis 1330
cuaaaaagcgcgcgcaaaaga

SEQ ID NO: 2479619 - RNA, 16 nt, Brucella suis 1330
cuaaaccggaacggau

SEQ ID NO: 2479620 - RNA, 15 nt, Brucella suis 1330
cuaaacucaucaaaa

SEQ ID NO: 2479621 - RNA, 14 nt, Brucella suis 1330
cuaaagcauaucuu

SEQ ID NO: 2479622 - RNA, 19 nt, Brucella suis 1330
cuaaaugaagaagcgcggg

SEQ ID NO: 2479623 - RNA, 16 nt, Brucella suis 1330
cuaacuauuuguuuug

SEQ ID NO: 2479624 - RNA, 18 nt, Brucella suis 1330
cuaagcggaaaacggcug

SEQ ID NO: 2479625 - RNA, 16 nt, Brucella suis 1330
cuaauggcgguuucga

SEQ ID NO: 2479626 - RNA, 23 nt, Brucella suis 1330
cuacaggucggcguaaaugcacc

SEQ ID NO: 2479627 - RNA, 15 nt, Brucella suis 1330
cuacccauucauuuc

SEQ ID NO: 2479628 - RNA, 13 nt, Brucella suis 1330
cuacgcaaaaccg

SEQ ID NO: 2479629 - RNA, 16 nt, Brucella suis 1330
cuagcgaugaugaucc

SEQ ID NO: 2479630 - RNA, 11 nt, Brucella suis 1330
cuagcggauga

SEQ ID NO: 2479631 - RNA, 18 nt, Brucella suis 1330
cuaguggucuuugugauu

SEQ ID NO: 2479632 - RNA, 16 nt, Brucella suis 1330
cuauaagcaacagggc

SEQ ID NO: 2479633 - RNA, 18 nt, Brucella suis 1330
cuaucucuccuaaacuca

SEQ ID NO: 2479634 - RNA, 19 nt, Brucella suis 1330
cuaugcggggaaaucaguc

SEQ ID NO: 2479635 - RNA, 14 nt, Brucella suis 1330
cuaugcgguuucag

SEQ ID NO: 2479636 - RNA, 17 nt, Brucella suis 1330
cuaugcgugguccagcc

SEQ ID NO: 2479637 - RNA, 14 nt, Brucella suis 1330
cuauuauucaccgc

SEQ ID NO: 2479638 - RNA, 15 nt, Brucella suis 1330
cuauuauucaccgcg

SEQ ID NO: 2479639 - RNA, 19 nt, Brucella suis 1330
cuauuccccuauuccccua

SEQ ID NO: 2479640 - RNA, 22 nt, Brucella suis 1330
cuauucccuuaacauacugccu

SEQ ID NO: 2479641 - RNA, 14 nt, Brucella suis 1330
cuauugccagacga

SEQ ID NO: 2479642 - RNA, 20 nt, Brucella suis 1330
cucaaaaaccggagccgccg

SEQ ID NO: 2479643 - RNA, 15 nt, Brucella suis 1330
cucaagauacaaaaa

SEQ ID NO: 2479644 - RNA, 13 nt, Brucella suis 1330
cucaagaucugaa

SEQ ID NO: 2479645 - RNA, 21 nt, Brucella suis 1330
cucaaugccgcauucagcaca

SEQ ID NO: 2479646 - RNA, 19 nt, Brucella suis 1330
cucacacugcaaaacugaa

SEQ ID NO: 2479647 - RNA, 12 nt, Brucella suis 1330
cucaccuugccg

SEQ ID NO: 2479648 - RNA, 14 nt, Brucella suis 1330
cucaccuuuuccac

SEQ ID NO: 2479649 - RNA, 15 nt, Brucella suis 1330
cucagcuauagccug

SEQ ID NO: 2479650 - RNA, 17 nt, Brucella suis 1330
cucaggagauaggggcc

SEQ ID NO: 2479651 - RNA, 13 nt, Brucella suis 1330
cucaggccuugcg

SEQ ID NO: 2479652 - RNA, 22 nt, Brucella suis 1330
cucauauauucaucguugcggc

SEQ ID NO: 2479653 - RNA, 23 nt, Brucella suis 1330
cucaucaaaagcgucgcaaugcc

SEQ ID NO: 2479654 - RNA, 14 nt, Brucella suis 1330
cucauccuccacga

SEQ ID NO: 2479655 - RNA, 15 nt, Brucella suis 1330
cucaucgcaguugca

SEQ ID NO: 2479656 - RNA, 17 nt, Brucella suis 1330
cucaucggguucugcua

SEQ ID NO: 2479657 - RNA, 19 nt, Brucella suis 1330
cucaugauggcccuugugg

SEQ ID NO: 2479658 - RNA, 18 nt, Brucella suis 1330
cucauggcuuccugcguc

SEQ ID NO: 2479659 - RNA, 21 nt, Brucella suis 1330
cucauggcuuccugcgucuug

SEQ ID NO: 2479660 - RNA, 14 nt, Brucella suis 1330
cucauuaucagcau

SEQ ID NO: 2479661 - RNA, 12 nt, Brucella suis 1330
cucauuucggcu

SEQ ID NO: 2479662 - RNA, 12 nt, Brucella suis 1330
cucauuuuuaga

SEQ ID NO: 2479663 - RNA, 16 nt, Brucella suis 1330
cuccacacgaacagca

SEQ ID NO: 2479664 - RNA, 18 nt, Brucella suis 1330
cuccacacgaacagcagc

SEQ ID NO: 2479665 - RNA, 22 nt, Brucella suis 1330
cuccaccaccccuuccuugccg

SEQ ID NO: 2479666 - RNA, 15 nt, Brucella suis 1330
cuccagaucguccuc

SEQ ID NO: 2479667 - RNA, 16 nt, Brucella suis 1330
cuccagauugcgggca

SEQ ID NO: 2479668 - RNA, 22 nt, Brucella suis 1330
cuccagcccuucaucaagcugu

SEQ ID NO: 2479669 - RNA, 15 nt, Brucella suis 1330
cuccagcucauggcc

SEQ ID NO: 2479670 - RNA, 18 nt, Brucella suis 1330
cuccagucgaggcagcca

SEQ ID NO: 2479671 - RNA, 18 nt, Brucella suis 1330
cuccaucgcaaaggagga

SEQ ID NO: 2479672 - RNA, 20 nt, Brucella suis 1330
cuccauuaaucaaaaacaau

SEQ ID NO: 2479673 - RNA, 15 nt, Brucella suis 1330
cucccaugcaggccg

SEQ ID NO: 2479674 - RNA, 14 nt, Brucella suis 1330
cuccccuacucccu

SEQ ID NO: 2479675 - RNA, 14 nt, Brucella suis 1330
cucccgauaaugcg

SEQ ID NO: 2479676 - RNA, 15 nt, Brucella suis 1330
cucccugcgcgcgcc

SEQ ID NO: 2479677 - RNA, 15 nt, Brucella suis 1330
cucccuguccugcca

SEQ ID NO: 2479678 - RNA, 22 nt, Brucella suis 1330
cucccuguccugccagcggcag

SEQ ID NO: 2479679 - RNA, 15 nt, Brucella suis 1330
cuccgcaccgaaggc

SEQ ID NO: 2479680 - RNA, 17 nt, Brucella suis 1330
cuccgcaccucaggaug

SEQ ID NO: 2479681 - RNA, 19 nt, Brucella suis 1330
cuccgcaccucaggaugag

SEQ ID NO: 2479682 - RNA, 20 nt, Brucella suis 1330
cuccgcccauacgcgcggca

SEQ ID NO: 2479683 - RNA, 15 nt, Brucella suis 1330
cuccgcgcgaaagga

SEQ ID NO: 2479684 - RNA, 20 nt, Brucella suis 1330
cuccggaucugguacugcgu

SEQ ID NO: 2479685 - RNA, 23 nt, Brucella suis 1330
cuccggcgggcuuuuguuuucaa

SEQ ID NO: 2479686 - RNA, 22 nt, Brucella suis 1330
cuccggcuugauacugcgcgca

SEQ ID NO: 2479687 - RNA, 17 nt, Brucella suis 1330
cuccgguucauuuuuag

SEQ ID NO: 2479688 - RNA, 14 nt, Brucella suis 1330
cuccuaaacucauc

SEQ ID NO: 2479689 - RNA, 17 nt, Brucella suis 1330
cuccucaaucgcgccgu

SEQ ID NO: 2479690 - RNA, 17 nt, Brucella suis 1330
cuccugcgucgcaucca

SEQ ID NO: 2479691 - RNA, 17 nt, Brucella suis 1330
cucgacagcacugccac

SEQ ID NO: 2479692 - RNA, 20 nt, Brucella suis 1330
cucgacagcacugccaccau

SEQ ID NO: 2479693 - RNA, 23 nt, Brucella suis 1330
cucgacaguuggauagaccaccg

SEQ ID NO: 2479694 - RNA, 15 nt, Brucella suis 1330
cucgaccgcaacagg

SEQ ID NO: 2479695 - RNA, 18 nt, Brucella suis 1330
cucgaccgcaacaggaaa

SEQ ID NO: 2479696 - RNA, 14 nt, Brucella suis 1330
cucgaccgccacca

SEQ ID NO: 2479697 - RNA, 14 nt, Brucella suis 1330
cucgacgcuuucca

SEQ ID NO: 2479698 - RNA, 17 nt, Brucella suis 1330
cucgacgcuuuccaccg

SEQ ID NO: 2479699 - RNA, 17 nt, Brucella suis 1330
cucgaucacgaaagucu

SEQ ID NO: 2479700 - RNA, 18 nt, Brucella suis 1330
cucgaucacgaaagucug

SEQ ID NO: 2479701 - RNA, 19 nt, Brucella suis 1330
cucgaucggugcaaugcca

SEQ ID NO: 2479702 - RNA, 18 nt, Brucella suis 1330
cucgaucucgcgguucuu

SEQ ID NO: 2479703 - RNA, 22 nt, Brucella suis 1330
cucgaucuggccgauaagcucg

SEQ ID NO: 2479704 - RNA, 14 nt, Brucella suis 1330
cucgaucuugucgc

SEQ ID NO: 2479705 - RNA, 13 nt, Brucella suis 1330
cucgcaaaacacc

SEQ ID NO: 2479706 - RNA, 14 nt, Brucella suis 1330
cucgcaaaacacca

SEQ ID NO: 2479707 - RNA, 15 nt, Brucella suis 1330
cucgccugcaccaug

SEQ ID NO: 2479708 - RNA, 18 nt, Brucella suis 1330
cucgcgacaggacaccgu

SEQ ID NO: 2479709 - RNA, 16 nt, Brucella suis 1330
cucgcggaaaagcucg

SEQ ID NO: 2479710 - RNA, 17 nt, Brucella suis 1330
cucgcgucccgcacgca

SEQ ID NO: 2479711 - RNA, 15 nt, Brucella suis 1330
cucgcucaggccugu

SEQ ID NO: 2479712 - RNA, 13 nt, Brucella suis 1330
cucgcucucgcau

SEQ ID NO: 2479713 - RNA, 16 nt, Brucella suis 1330
cucgcuggcgcggcgg

SEQ ID NO: 2479714 - RNA, 16 nt, Brucella suis 1330
cucggagcggccggau

SEQ ID NO: 2479715 - RNA, 19 nt, Brucella suis 1330
cucggaguuuuucggccag

SEQ ID NO: 2479716 - RNA, 19 nt, Brucella suis 1330
cucggcaaagggaauacca

SEQ ID NO: 2479717 - RNA, 13 nt, Brucella suis 1330
cucggcaagcucg

SEQ ID NO: 2479718 - RNA, 22 nt, Brucella suis 1330
cucggcaucgcucaccuuuucc

SEQ ID NO: 2479719 - RNA, 18 nt, Brucella suis 1330
cucggcccuggaaagaag

SEQ ID NO: 2479720 - RNA, 21 nt, Brucella suis 1330
cucggccuggucuagccgcgc

SEQ ID NO: 2479721 - RNA, 18 nt, Brucella suis 1330
cucggcgcggcguucggc

SEQ ID NO: 2479722 - RNA, 15 nt, Brucella suis 1330
cucggcggcaucgcc

SEQ ID NO: 2479723 - RNA, 11 nt, Brucella suis 1330
cucggcuucaa

SEQ ID NO: 2479724 - RNA, 15 nt, Brucella suis 1330
cucguccggccagcc

SEQ ID NO: 2479725 - RNA, 23 nt, Brucella suis 1330
cucgucgaaauccuucagaagca

SEQ ID NO: 2479726 - RNA, 16 nt, Brucella suis 1330
cucgucgagaagcauc

SEQ ID NO: 2479727 - RNA, 24 nt, Brucella suis 1330
cucgucggaaauaucgccgacgau

SEQ ID NO: 2479728 - RNA, 14 nt, Brucella suis 1330
cucguucugccagu

SEQ ID NO: 2479729 - RNA, 14 nt, Brucella suis 1330
cugcggcgccagau

SEQ ID NO: 2479730 - RNA, 16 nt, Brucella suis 1330
cugcggcggcgucagc

SEQ ID NO: 2479731 - RNA, 16 nt, Brucella suis 1330
cugcgggcgagaucgu

SEQ ID NO: 2479732 - RNA, 15 nt, Brucella suis 1330
cugcgggcggcggcu

SEQ ID NO: 2479733 - RNA, 16 nt, Brucella suis 1330
cugcgggcggcggcuc

SEQ ID NO: 2479734 - RNA, 21 nt, Brucella suis 1330
cugcgguagcgcauggcagca

SEQ ID NO: 2479735 - RNA, 13 nt, Brucella suis 1330
cugcgucuugugg

SEQ ID NO: 2479736 - RNA, 13 nt, Brucella suis 1330
cugcgugcugcuu

SEQ ID NO: 2479737 - RNA, 19 nt, Brucella suis 1330
cugcucauaaacgcugcug

SEQ ID NO: 2479738 - RNA, 19 nt, Brucella suis 1330
cugcuccaucgcaaaggag

SEQ ID NO: 2479739 - RNA, 23 nt, Brucella suis 1330
cugcuccugcgucgcauccagaa

SEQ ID NO: 2479740 - RNA, 21 nt, Brucella suis 1330
cugcucgacaugcaugacacc

SEQ ID NO: 2479741 - RNA, 17 nt, Brucella suis 1330
cugcucgaucuggccga

SEQ ID NO: 2479742 - RNA, 23 nt, Brucella suis 1330
cugcucgcgguugaggauuucca

SEQ ID NO: 2479743 - RNA, 17 nt, Brucella suis 1330
cugcucggcgcggcguu

SEQ ID NO: 2479744 - RNA, 20 nt, Brucella suis 1330
cugcugauagcagccgcuuc

SEQ ID NO: 2479745 - RNA, 14 nt, Brucella suis 1330
cugcugcaauccac

SEQ ID NO: 2479746 - RNA, 13 nt, Brucella suis 1330
cugcugcauccug

SEQ ID NO: 2479747 - RNA, 15 nt, Brucella suis 1330
cugcugcauccugcu

SEQ ID NO: 2479748 - RNA, 16 nt, Brucella suis 1330
cugcugcauuuucugc

SEQ ID NO: 2479749 - RNA, 14 nt, Brucella suis 1330
cugcugccaugucu

SEQ ID NO: 2479750 - RNA, 14 nt, Brucella suis 1330
cugcuuccuuuucg

SEQ ID NO: 2479751 - RNA, 13 nt, Brucella suis 1330
cugcuucuugccu

SEQ ID NO: 2479752 - RNA, 21 nt, Brucella suis 1330
cugcuugguuuccgccagcau

SEQ ID NO: 2479753 - RNA, 15 nt, Brucella suis 1330
cuggaaaaaauccgc

SEQ ID NO: 2479754 - RNA, 23 nt, Brucella suis 1330
cuggaagucauauucggccuuga

SEQ ID NO: 2479755 - RNA, 17 nt, Brucella suis 1330
cuggagcucccgaagga

SEQ ID NO: 2479756 - RNA, 15 nt, Brucella suis 1330
cuggaugcggaacac

SEQ ID NO: 2479757 - RNA, 14 nt, Brucella suis 1330
cuggaugucgauuu

SEQ ID NO: 2479758 - RNA, 17 nt, Brucella suis 1330
cuggcaauaaaaggcaa

SEQ ID NO: 2479759 - RNA, 22 nt, Brucella suis 1330
cuggcauuauuccgccugcaac

SEQ ID NO: 2479760 - RNA, 23 nt, Brucella suis 1330
cuggccaugaugccggucgcagg

SEQ ID NO: 2479761 - RNA, 20 nt, Brucella suis 1330
cuggccgacaccgaccggca

SEQ ID NO: 2479762 - RNA, 18 nt, Brucella suis 1330
cuggccggcgccuuguuc

SEQ ID NO: 2479763 - RNA, 18 nt, Brucella suis 1330
cuggccgucgcguucagc

SEQ ID NO: 2479764 - RNA, 13 nt, Brucella suis 1330
cuggccuugccau

SEQ ID NO: 2479765 - RNA, 22 nt, Brucella suis 1330
cuggcgaaaacggccaugcgca

SEQ ID NO: 2479766 - RNA, 13 nt, Brucella suis 1330
cuggcgcacgucg

SEQ ID NO: 2479767 - RNA, 21 nt, Brucella suis 1330
cuggcgcgcgaacgggaacaa

SEQ ID NO: 2479768 - RNA, 21 nt, Brucella suis 1330
cuggcgcguaauggccucgau

SEQ ID NO: 2479769 - RNA, 13 nt, Brucella suis 1330
cuggcggcacuug

SEQ ID NO: 2479770 - RNA, 20 nt, Brucella suis 1330
cuggcggcacuugucgccau

SEQ ID NO: 2479771 - RNA, 13 nt, Brucella suis 1330
cuggcggccaagc

SEQ ID NO: 2479772 - RNA, 16 nt, Brucella suis 1330
cuggcguccagaagau

SEQ ID NO: 2479773 - RNA, 19 nt, Brucella suis 1330
cuggcuucucuugccgccg

SEQ ID NO: 2479774 - RNA, 21 nt, Brucella suis 1330
cuggcuucucuugccgccgcu

SEQ ID NO: 2479775 - RNA, 13 nt, Brucella suis 1330
cugggccuuguuu

SEQ ID NO: 2479776 - RNA, 16 nt, Brucella suis 1330
cugggcgacccagcca

SEQ ID NO: 2479777 - RNA, 17 nt, Brucella suis 1330
cugggcgaugagcgcca

SEQ ID NO: 2479778 - RNA, 15 nt, Brucella suis 1330
cuggggauacgugca

SEQ ID NO: 2479779 - RNA, 16 nt, Brucella suis 1330
cuggggcacgagaacg

SEQ ID NO: 2479780 - RNA, 24 nt, Brucella suis 1330
cugggugaggcuggcgccgccgcu

SEQ ID NO: 2479781 - RNA, 15 nt, Brucella suis 1330
cuggguugaacgguc

SEQ ID NO: 2479782 - RNA, 14 nt, Brucella suis 1330
cugguagagacugg

SEQ ID NO: 2479783 - RNA, 21 nt, Brucella suis 1330
cuggucaauaucgcgcaggcg

SEQ ID NO: 2479784 - RNA, 20 nt, Brucella suis 1330
cugguugcgcggccagccag

SEQ ID NO: 2479785 - RNA, 20 nt, Brucella suis 1330
cugguuuaagccuugguccu

SEQ ID NO: 2479786 - RNA, 15 nt, Brucella suis 1330
cugguuuccgccauc

SEQ ID NO: 2479787 - RNA, 13 nt, Brucella suis 1330
cuguaaggccugc

SEQ ID NO: 2479788 - RNA, 17 nt, Brucella suis 1330
cuguacauacaugauga

SEQ ID NO: 2479789 - RNA, 22 nt, Brucella suis 1330
cuguagaaaauauagccgccug

SEQ ID NO: 2479790 - RNA, 19 nt, Brucella suis 1330
cuguagcagcaacaggcau

SEQ ID NO: 2479791 - RNA, 19 nt, Brucella suis 1330
cuguaucccgaaaagugcg

SEQ ID NO: 2479792 - RNA, 21 nt, Brucella suis 1330
cugucaccgccagcagaaccg

SEQ ID NO: 2479793 - RNA, 19 nt, Brucella suis 1330
cugucaccugacggauuuc

SEQ ID NO: 2479794 - RNA, 16 nt, Brucella suis 1330
cugucacgaucuugcc

SEQ ID NO: 2479795 - RNA, 14 nt, Brucella suis 1330
cugucagcgccgcc

SEQ ID NO: 2479796 - RNA, 19 nt, Brucella suis 1330
cugucccuucuugcucuca

SEQ ID NO: 2479797 - RNA, 14 nt, Brucella suis 1330
cuguccgccugcca

SEQ ID NO: 2479798 - RNA, 20 nt, Brucella suis 1330
cuguccgguccccgccgccg

SEQ ID NO: 2479799 - RNA, 19 nt, Brucella suis 1330
cuguccugccagcggcaga

SEQ ID NO: 2479800 - RNA, 14 nt, Brucella suis 1330
cuguccuuguucca

SEQ ID NO: 2479801 - RNA, 13 nt, Brucella suis 1330
cugucgcccagaa

SEQ ID NO: 2479802 - RNA, 13 nt, Brucella suis 1330
cugucguuccaau

SEQ ID NO: 2479803 - RNA, 19 nt, Brucella suis 1330
cugugcggcggcggaagga

SEQ ID NO: 2479804 - RNA, 17 nt, Brucella suis 1330
cugugcggcugcaaaug

SEQ ID NO: 2479805 - RNA, 22 nt, Brucella suis 1330
cuguucaagcaguaugauuugu

SEQ ID NO: 2479806 - RNA, 15 nt, Brucella suis 1330
cuguucagccgcagc

SEQ ID NO: 2479807 - RNA, 22 nt, Brucella suis 1330
cuguuccaaaagucguccugug

SEQ ID NO: 2479808 - RNA, 16 nt, Brucella suis 1330
cuguuccacaccugca

SEQ ID NO: 2479809 - RNA, 23 nt, Brucella suis 1330
cuguucgaugccauucacuugcg

SEQ ID NO: 2479810 - RNA, 18 nt, Brucella suis 1330
cuguuucauaaacgcggg

SEQ ID NO: 2479811 - RNA, 17 nt, Brucella suis 1330
cuguuucgaggcccagg

SEQ ID NO: 2479812 - RNA, 18 nt, Brucella suis 1330
cuguuucgcauugcccac

SEQ ID NO: 2479813 - RNA, 13 nt, Brucella suis 1330
cuguuuggucuca

SEQ ID NO: 2479814 - RNA, 17 nt, Brucella suis 1330
cuuaaucccuuacucca

SEQ ID NO: 2479815 - RNA, 17 nt, Brucella suis 1330
cuuaauugcuuuccugc

SEQ ID NO: 2479816 - RNA, 20 nt, Brucella suis 1330
cuuacaaguauuucauggaa

SEQ ID NO: 2479817 - RNA, 23 nt, Brucella suis 1330
cuuagagaccuugaugauagaau

SEQ ID NO: 2479818 - RNA, 15 nt, Brucella suis 1330
cuuagauaagcgcgu

SEQ ID NO: 2479819 - RNA, 13 nt, Brucella suis 1330
cuuauccagccgc

SEQ ID NO: 2479820 - RNA, 16 nt, Brucella suis 1330
cuuaucggggcggcgu

SEQ ID NO: 2479821 - RNA, 19 nt, Brucella suis 1330
cuuaugaucgccgcccuug

SEQ ID NO: 2479822 - RNA, 20 nt, Brucella suis 1330
cuuauuccccuauucccuua

SEQ ID NO: 2479823 - RNA, 20 nt, Brucella suis 1330
cuuauuccugcggcuucugg

SEQ ID NO: 2479824 - RNA, 13 nt, Brucella suis 1330
cuucaagcgcaag

SEQ ID NO: 2479825 - RNA, 18 nt, Brucella suis 1330
cuucaagcgcaagcugug

SEQ ID NO: 2479826 - RNA, 22 nt, Brucella suis 1330
cuucaagcucgacccagcuaag

SEQ ID NO: 2479827 - RNA, 15 nt, Brucella suis 1330
cuucacaugcuugcc

SEQ ID NO: 2479828 - RNA, 20 nt, Brucella suis 1330
cuucacaugcuugccgaccu

SEQ ID NO: 2479829 - RNA, 14 nt, Brucella suis 1330
cuucacccacgcca

SEQ ID NO: 2479830 - RNA, 16 nt, Brucella suis 1330
cuucagccagaaucug

SEQ ID NO: 2479831 - RNA, 13 nt, Brucella suis 1330
cuucagccauuca

SEQ ID NO: 2479832 - RNA, 17 nt, Brucella suis 1330
cuucagcgugaugcccg

SEQ ID NO: 2479833 - RNA, 16 nt, Brucella suis 1330
cuucaggcccuugccg

SEQ ID NO: 2479834 - RNA, 13 nt, Brucella suis 1330
cuucaggcggcgc

SEQ ID NO: 2479835 - RNA, 21 nt, Brucella suis 1330
cuucagggacgagcggcaggc

SEQ ID NO: 2479836 - RNA, 19 nt, Brucella suis 1330
cuucagucuggauuccuuc

SEQ ID NO: 2479837 - RNA, 20 nt, Brucella suis 1330
cuucaucgcggcagccgccg

SEQ ID NO: 2479838 - RNA, 16 nt, Brucella suis 1330
cuucaugaaacagggu

SEQ ID NO: 2479839 - RNA, 20 nt, Brucella suis 1330
cuucauucaaucugcauaau

SEQ ID NO: 2479840 - RNA, 20 nt, Brucella suis 1330
cuuccacgcggauaucggcg

SEQ ID NO: 2479841 - RNA, 13 nt, Brucella suis 1330
cuuccagaaugcg

SEQ ID NO: 2479842 - RNA, 16 nt, Brucella suis 1330
cuuccagagccucggc

SEQ ID NO: 2479843 - RNA, 16 nt, Brucella suis 1330
cuuccagcaggcgcgc

SEQ ID NO: 2479844 - RNA, 23 nt, Brucella suis 1330
cuuccaguggaagcacauggcgg

SEQ ID NO: 2479845 - RNA, 21 nt, Brucella suis 1330
cuuggccaugaugccgacaag

SEQ ID NO: 2479846 - RNA, 16 nt, Brucella suis 1330
cuuggccucuuccagg

SEQ ID NO: 2479847 - RNA, 14 nt, Brucella suis 1330
cuuggcuuccagcg

SEQ ID NO: 2479848 - RNA, 17 nt, Brucella suis 1330
cuuggcuuccagcguca

SEQ ID NO: 2479849 - RNA, 13 nt, Brucella suis 1330
cuugggagcggcg

SEQ ID NO: 2479850 - RNA, 19 nt, Brucella suis 1330
cuugggauucucgaacagg

SEQ ID NO: 2479851 - RNA, 20 nt, Brucella suis 1330
cuugggauucucgaacaggu

SEQ ID NO: 2479852 - RNA, 18 nt, Brucella suis 1330
cuugggcgcgucaacagg

SEQ ID NO: 2479853 - RNA, 22 nt, Brucella suis 1330
cuugguaaaggcgaguuuucaa

SEQ ID NO: 2479854 - RNA, 13 nt, Brucella suis 1330
cuugucagaagca

SEQ ID NO: 2479855 - RNA, 18 nt, Brucella suis 1330
cuugucgccugauagcau

SEQ ID NO: 2479856 - RNA, 17 nt, Brucella suis 1330
cuugucgcggccuugau

SEQ ID NO: 2479857 - RNA, 14 nt, Brucella suis 1330
cuuguguacccaaa

SEQ ID NO: 2479858 - RNA, 13 nt, Brucella suis 1330
cuuguuccagucg

SEQ ID NO: 2479859 - RNA, 23 nt, Brucella suis 1330
cuuuaaagcaggaucggcagcag

SEQ ID NO: 2479860 - RNA, 19 nt, Brucella suis 1330
cuuuaauugucggcgucca

SEQ ID NO: 2479861 - RNA, 23 nt, Brucella suis 1330
cuuuauauggcggucggcggcgu

SEQ ID NO: 2479862 - RNA, 22 nt, Brucella suis 1330
cuuuauggcucagagaagugag

SEQ ID NO: 2479863 - RNA, 16 nt, Brucella suis 1330
cuuucaagcggguaga

SEQ ID NO: 2479864 - RNA, 11 nt, Brucella suis 1330
cuuucacuuuu

SEQ ID NO: 2479865 - RNA, 19 nt, Brucella suis 1330
cuuucagaaagaaagcugu

SEQ ID NO: 2479866 - RNA, 21 nt, Brucella suis 1330
cuuuccaguacggcgcgcuga

SEQ ID NO: 2479867 - RNA, 14 nt, Brucella suis 1330
cuuuccaguuccau

SEQ ID NO: 2479868 - RNA, 15 nt, Brucella suis 1330
cuuuccauuccagcc

SEQ ID NO: 2479869 - RNA, 19 nt, Brucella suis 1330
cuuuccugcauaauuauug

SEQ ID NO: 2479870 - RNA, 13 nt, Brucella suis 1330
cuuucgacaaagg

SEQ ID NO: 2479871 - RNA, 17 nt, Brucella suis 1330
cuuucgauuuuugccag

SEQ ID NO: 2479872 - RNA, 20 nt, Brucella suis 1330
cuuucgcuuuaaagcuuaac

SEQ ID NO: 2479873 - RNA, 18 nt, Brucella suis 1330
cuuucggcggcaguuuca

SEQ ID NO: 2479874 - RNA, 14 nt, Brucella suis 1330
cuuucuaaaccgga

SEQ ID NO: 2479875 - RNA, 17 nt, Brucella suis 1330
cuuucugcuucuguugc

SEQ ID NO: 2479876 - RNA, 23 nt, Brucella suis 1330
cuuugauccgcuucuggauuugc

SEQ ID NO: 2479877 - RNA, 21 nt, Brucella suis 1330
cuuugcaccgcgccggaaggc

SEQ ID NO: 2479878 - RNA, 19 nt, Brucella suis 1330
cuuugcagaaccaggccgc

SEQ ID NO: 2479879 - RNA, 18 nt, Brucella suis 1330
cuuugccgcauaaagcac

SEQ ID NO: 2479880 - RNA, 22 nt, Brucella suis 1330
cuuugcggaggcggcugccuuu

SEQ ID NO: 2479881 - RNA, 19 nt, Brucella suis 1330
cuuugcggcggaugaaccc

SEQ ID NO: 2479882 - RNA, 17 nt, Brucella suis 1330
cuuugcuucacgcucgg

SEQ ID NO: 2479883 - RNA, 22 nt, Brucella suis 1330
cuuugcuucggccgacagaugc

SEQ ID NO: 2479884 - RNA, 15 nt, Brucella suis 1330
cuuugucauaucaga

SEQ ID NO: 2479885 - RNA, 22 nt, Brucella suis 1330
cuuuguuuugacgcgcaucuuu

SEQ ID NO: 2479886 - RNA, 15 nt, Brucella suis 1330
cuuuucauucugaau

SEQ ID NO: 2479887 - RNA, 21 nt, Brucella suis 1330
cuuuuccacagcaggcagcag

SEQ ID NO: 2479888 - RNA, 18 nt, Brucella suis 1330
cuuuuccaccggcccgcg

SEQ ID NO: 2479889 - RNA, 12 nt, Brucella suis 1330
cuuuuccagugc

SEQ ID NO: 2479890 - RNA, 13 nt, Brucella suis 1330
cuuuuccagugca

SEQ ID NO: 2479891 - RNA, 22 nt, Brucella suis 1330
cuuuuccagugcaaagcggcuu

SEQ ID NO: 2479892 - RNA, 14 nt, Brucella suis 1330
cuuuuccgcugcca

SEQ ID NO: 2479893 - RNA, 19 nt, Brucella suis 1330
cuuuucgcccgugccgcgu

SEQ ID NO: 2479894 - RNA, 22 nt, Brucella suis 1330
cuuuucggcaaggaugcugcca

SEQ ID NO: 2479895 - RNA, 17 nt, Brucella suis 1330
cuuuucggcggaaagga

SEQ ID NO: 2479896 - RNA, 12 nt, Brucella suis 1330
cuuuucggcuga

SEQ ID NO: 2479897 - RNA, 21 nt, Brucella suis 1330
cuuuucgggaugcgcuuuaaa

SEQ ID NO: 2479898 - RNA, 23 nt, Brucella suis 1330
cuuuugacggcccggugcagcgg

SEQ ID NO: 2479899 - RNA, 13 nt, Brucella suis 1330
cuuuugcgcucgg

SEQ ID NO: 2479900 - RNA, 17 nt, Brucella suis 1330
cuuuugcuggaucucua

SEQ ID NO: 2479901 - RNA, 21 nt, Brucella suis 1330
cuuuugggcgucgcgcaucau

SEQ ID NO: 2479902 - RNA, 19 nt, Brucella suis 1330
cuuuugugcucacacagaa

SEQ ID NO: 2479903 - RNA, 21 nt, Brucella suis 1330
cuuuuugacgcaaaagcucca

SEQ ID NO: 2479904 - RNA, 12 nt, Brucella suis 1330
gaaaaaaaugcg

SEQ ID NO: 2479905 - RNA, 13 nt, Brucella suis 1330
gaaaaaagcccgg

SEQ ID NO: 2479906 - RNA, 17 nt, Brucella suis 1330
gaaaaaaggucgcccga

SEQ ID NO: 2479907 - RNA, 20 nt, Brucella suis 1330
gaaaaaccccggcagccuuc

SEQ ID NO: 2479908 - RNA, 21 nt, Brucella suis 1330
gaaaaacccggccuuugcgcc

SEQ ID NO: 2479909 - RNA, 18 nt, Brucella suis 1330
gaaaaagcccggucucgc

SEQ ID NO: 2479910 - RNA, 14 nt, Brucella suis 1330
gaaaaagcccggug

SEQ ID NO: 2479911 - RNA, 15 nt, Brucella suis 1330
gaaaaagcccggugu

SEQ ID NO: 2479912 - RNA, 12 nt, Brucella suis 1330
gaaaacaucgga

SEQ ID NO: 2479913 - RNA, 15 nt, Brucella suis 1330
gaaaaccgcuucagc

SEQ ID NO: 2479914 - RNA, 21 nt, Brucella suis 1330
gaaaaccgguucccacuuucg

SEQ ID NO: 2479915 - RNA, 20 nt, Brucella suis 1330
gaaaacgccgaagccaggca

SEQ ID NO: 2479916 - RNA, 14 nt, Brucella suis 1330
gaaaacgccgccuu

SEQ ID NO: 2479917 - RNA, 22 nt, Brucella suis 1330
gaaaacggccaugcgcaugaac

SEQ ID NO: 2479918 - RNA, 23 nt, Brucella suis 1330
gaaaacggcugcaacaaaagaag

SEQ ID NO: 2479919 - RNA, 19 nt, Brucella suis 1330
gaaaacuugcugaaacgag

SEQ ID NO: 2479920 - RNA, 22 nt, Brucella suis 1330
gaaaagacgugucaaagccucg

SEQ ID NO: 2479921 - RNA, 19 nt, Brucella suis 1330
gaaaagcgcaguucgcgca

SEQ ID NO: 2479922 - RNA, 21 nt, Brucella suis 1330
gaaaagcucgcgucccgcacg

SEQ ID NO: 2479923 - RNA, 21 nt, Brucella suis 1330
gaaaaggccuguuccugcaug

SEQ ID NO: 2479924 - RNA, 14 nt, Brucella suis 1330
gaaaagggcaaggg

SEQ ID NO: 2479925 - RNA, 20 nt, Brucella suis 1330
gaaaagggcaagggccuggc

SEQ ID NO: 2479926 - RNA, 15 nt, Brucella suis 1330
gaaaaguccuuuccg

SEQ ID NO: 2479927 - RNA, 11 nt, Brucella suis 1330
gaaaagugcga

SEQ ID NO: 2479928 - RNA, 13 nt, Brucella suis 1330
gaaaagugcgaag

SEQ ID NO: 2479929 - RNA, 14 nt, Brucella suis 1330
gaaaauauagccgc

SEQ ID NO: 2479930 - RNA, 16 nt, Brucella suis 1330
gaaaauauagccgccu

SEQ ID NO: 2479931 - RNA, 14 nt, Brucella suis 1330
gaaaauaucugccg

SEQ ID NO: 2479932 - RNA, 13 nt, Brucella suis 1330
gaaaaugcagcgg

SEQ ID NO: 2479933 - RNA, 17 nt, Brucella suis 1330
gaaaaugccauggaaca

SEQ ID NO: 2479934 - RNA, 15 nt, Brucella suis 1330
gaaaauggcgcuagc

SEQ ID NO: 2479935 - RNA, 16 nt, Brucella suis 1330
gaaaauguucuaaagc

SEQ ID NO: 2479936 - RNA, 15 nt, Brucella suis 1330
gaaaccaaagcgucc

SEQ ID NO: 2479937 - RNA, 19 nt, Brucella suis 1330
gaaaccaucaacgggauga

SEQ ID NO: 2479938 - RNA, 12 nt, Brucella suis 1330
gaaaccaucgag

SEQ ID NO: 2479939 - RNA, 17 nt, Brucella suis 1330
gaaaccaucgagcauuu

SEQ ID NO: 2479940 - RNA, 14 nt, Brucella suis 1330
gaaaccccggcagc

SEQ ID NO: 2479941 - RNA, 15 nt, Brucella suis 1330
gaaaccuugccgcgu

SEQ ID NO: 2479942 - RNA, 18 nt, Brucella suis 1330
gaaacgagacaaggcaau

SEQ ID NO: 2479943 - RNA, 16 nt, Brucella suis 1330
gaaacgcuggaaguca

SEQ ID NO: 2479944 - RNA, 20 nt, Brucella suis 1330
gaaacggccaagcaggagau

SEQ ID NO: 2479945 - RNA, 20 nt, Brucella suis 1330
gaaacggccagggcuggcuc

SEQ ID NO: 2479946 - RNA, 16 nt, Brucella suis 1330
gaaacgggaccaagcc

SEQ ID NO: 2479947 - RNA, 22 nt, Brucella suis 1330
gaaagaaagcugucgcgcccgc

SEQ ID NO: 2479948 - RNA, 17 nt, Brucella suis 1330
gaaagacucgaacaggc

SEQ ID NO: 2479949 - RNA, 16 nt, Brucella suis 1330
gaaagaucagccagcc

SEQ ID NO: 2479950 - RNA, 18 nt, Brucella suis 1330
gaaagaucagccagccga

SEQ ID NO: 2479951 - RNA, 17 nt, Brucella suis 1330
gaaagauggucaagagc

SEQ ID NO: 2479952 - RNA, 15 nt, Brucella suis 1330
gaaagcacaaagaac

SEQ ID NO: 2479953 - RNA, 19 nt, Brucella suis 1330
gaaagcacaaagaacaagc

SEQ ID NO: 2479954 - RNA, 23 nt, Brucella suis 1330
gaaagccagaaccaccagagcaa

SEQ ID NO: 2479955 - RNA, 14 nt, Brucella suis 1330
gaaagcccggcugg

SEQ ID NO: 2479956 - RNA, 21 nt, Brucella suis 1330
gaaagcccugcgucgggugaa

SEQ ID NO: 2479957 - RNA, 19 nt, Brucella suis 1330
gaaagccucgaucacccga

SEQ ID NO: 2479958 - RNA, 20 nt, Brucella suis 1330
gaaagccucgaucacccgau

SEQ ID NO: 2479959 - RNA, 14 nt, Brucella suis 1330
gaaagccuuuucga

SEQ ID NO: 2479960 - RNA, 20 nt, Brucella suis 1330
gaaagcguaaaccucccugu

SEQ ID NO: 2479961 - RNA, 16 nt, Brucella suis 1330
gaaggccucaucgauc

SEQ ID NO: 2479962 - RNA, 19 nt, Brucella suis 1330
gaaggccucaucgaucacg

SEQ ID NO: 2479963 - RNA, 18 nt, Brucella suis 1330
gaaggccucgaaauagcc

SEQ ID NO: 2479964 - RNA, 17 nt, Brucella suis 1330
gaaggcgggaaggcaau

SEQ ID NO: 2479965 - RNA, 22 nt, Brucella suis 1330
gaaggcguuggccgcggccggu

SEQ ID NO: 2479966 - RNA, 20 nt, Brucella suis 1330
gaagggcggguucaugauga

SEQ ID NO: 2479967 - RNA, 15 nt, Brucella suis 1330
gaagggcugagggaa

SEQ ID NO: 2479968 - RNA, 21 nt, Brucella suis 1330
gaagguaagcuuugcaccgcg

SEQ ID NO: 2479969 - RNA, 14 nt, Brucella suis 1330
gaagguuucagccu

SEQ ID NO: 2479970 - RNA, 11 nt, Brucella suis 1330
gaagguuuuuc

SEQ ID NO: 2479971 - RNA, 15 nt, Brucella suis 1330
gaagugaaaccagcg

SEQ ID NO: 2479972 - RNA, 19 nt, Brucella suis 1330
gaagugagcgcaaggcuuc

SEQ ID NO: 2479973 - RNA, 20 nt, Brucella suis 1330
gaagugagcgcaaggcuucg

SEQ ID NO: 2479974 - RNA, 19 nt, Brucella suis 1330
gaagugaucucggccuggu

SEQ ID NO: 2479975 - RNA, 16 nt, Brucella suis 1330
gaagugcauaugauga

SEQ ID NO: 2479976 - RNA, 13 nt, Brucella suis 1330
gaaguuuuccugc

SEQ ID NO: 2479977 - RNA, 17 nt, Brucella suis 1330
gaauagaccaucgaaag

SEQ ID NO: 2479978 - RNA, 13 nt, Brucella suis 1330
gaauagaccaugc

SEQ ID NO: 2479979 - RNA, 20 nt, Brucella suis 1330
gaauagaugaugaagaaaag

SEQ ID NO: 2479980 - RNA, 15 nt, Brucella suis 1330
gaauaggagccggcc

SEQ ID NO: 2479981 - RNA, 21 nt, Brucella suis 1330
gaauagggaaacggccagggc

SEQ ID NO: 2479982 - RNA, 14 nt, Brucella suis 1330
gaauagggcaugga

SEQ ID NO: 2479983 - RNA, 20 nt, Brucella suis 1330
gaauauagccgaugcagaug

SEQ ID NO: 2479984 - RNA, 19 nt, Brucella suis 1330
gaauaucgaucaaggccgu

SEQ ID NO: 2479985 - RNA, 20 nt, Brucella suis 1330
gaauaucuacagacuagaca

SEQ ID NO: 2479986 - RNA, 18 nt, Brucella suis 1330
gaauaucuucgagcguga

SEQ ID NO: 2479987 - RNA, 17 nt, Brucella suis 1330
gaaucagaccgaugcuc

SEQ ID NO: 2479988 - RNA, 21 nt, Brucella suis 1330
gaaucagcaaguuuaucggcc

SEQ ID NO: 2479989 - RNA, 23 nt, Brucella suis 1330
gaauccacguuuggagcggcggu

SEQ ID NO: 2479990 - RNA, 21 nt, Brucella suis 1330
gaaucccggcuguuacauaug

SEQ ID NO: 2479991 - RNA, 22 nt, Brucella suis 1330
gaaucccggugaggggccaaag

SEQ ID NO: 2479992 - RNA, 13 nt, Brucella suis 1330
gaauccgcgacgc

SEQ ID NO: 2479993 - RNA, 21 nt, Brucella suis 1330
gaaucugccuugucagaagca

SEQ ID NO: 2479994 - RNA, 12 nt, Brucella suis 1330
gaaugaaucaga

SEQ ID NO: 2479995 - RNA, 21 nt, Brucella suis 1330
gaaugccagauaaccugcgcg

SEQ ID NO: 2479996 - RNA, 17 nt, Brucella suis 1330
gaaugcccuugagaagc

SEQ ID NO: 2479997 - RNA, 21 nt, Brucella suis 1330
gaaugccgauuugaccauauu

SEQ ID NO: 2479998 - RNA, 18 nt, Brucella suis 1330
gaauggagcauuuccagc

SEQ ID NO: 2479999 - RNA, 18 nt, Brucella suis 1330
gaauggcaagcagcaaaa

SEQ ID NO: 2480000 - RNA, 16 nt, Brucella suis 1330
gaauggcuugcuggag

SEQ ID NO: 2480001 - RNA, 17 nt, Brucella suis 1330
gaauggucugcgccagu

SEQ ID NO: 2480002 - RNA, 22 nt, Brucella suis 1330
gaaugugcuuaguuguuuucuu

SEQ ID NO: 2480003 - RNA, 15 nt, Brucella suis 1330
gaauucauccgccuu

SEQ ID NO: 2480004 - RNA, 19 nt, Brucella suis 1330
gaauuuccgcuccugguuc

SEQ ID NO: 2480005 - RNA, 13 nt, Brucella suis 1330
gacaaaaaacacc

SEQ ID NO: 2480006 - RNA, 17 nt, Brucella suis 1330
gacaaaaaacaccgcgc

SEQ ID NO: 2480007 - RNA, 16 nt, Brucella suis 1330
gacaaagaucaucgcc

SEQ ID NO: 2480008 - RNA, 17 nt, Brucella suis 1330
gacaaaggcccgcgcaa

SEQ ID NO: 2480009 - RNA, 16 nt, Brucella suis 1330
gacaaaggugcugucg

SEQ ID NO: 2480010 - RNA, 21 nt, Brucella suis 1330
gacaaccacgcuugcgcccgc

SEQ ID NO: 2480011 - RNA, 18 nt, Brucella suis 1330
gacaaccgcgccgcuggu

SEQ ID NO: 2480012 - RNA, 22 nt, Brucella suis 1330
gacaaccgcgccgcuggugcga

SEQ ID NO: 2480013 - RNA, 17 nt, Brucella suis 1330
gacaacgggugcgcugc

SEQ ID NO: 2480014 - RNA, 18 nt, Brucella suis 1330
gacaagccgcuccgcacc

SEQ ID NO: 2480015 - RNA, 22 nt, Brucella suis 1330
gacaagcguccgucgcgugagg

SEQ ID NO: 2480016 - RNA, 15 nt, Brucella suis 1330
gacaagcgugagcuu

SEQ ID NO: 2480017 - RNA, 16 nt, Brucella suis 1330
gacaagcgugagcuuc

SEQ ID NO: 2480018 - RNA, 17 nt, Brucella suis 1330
gacaaggcaaugccgga

SEQ ID NO: 2480019 - RNA, 21 nt, Brucella suis 1330
gacaaguccuaaaacaccggc

SEQ ID NO: 2480020 - RNA, 15 nt, Brucella suis 1330
gacaaucaggccgau

SEQ ID NO: 2480021 - RNA, 19 nt, Brucella suis 1330
gacaaucaggccgauccug

SEQ ID NO: 2480022 - RNA, 21 nt, Brucella suis 1330
gacaaugaagcaaaggucggg

SEQ ID NO: 2480023 - RNA, 16 nt, Brucella suis 1330
gacaaugguuauacuc

SEQ ID NO: 2480024 - RNA, 18 nt, Brucella suis 1330
gacaccugcggcgccaga

SEQ ID NO: 2480025 - RNA, 16 nt, Brucella suis 1330
gacaccuucggccagc

SEQ ID NO: 2480026 - RNA, 17 nt, Brucella suis 1330
gacaccuucggccagcg

SEQ ID NO: 2480027 - RNA, 18 nt, Brucella suis 1330
gacacguccgggaagcag

SEQ ID NO: 2480028 - RNA, 21 nt, Brucella suis 1330
gacagaauuuggaaguuuucc

SEQ ID NO: 2480029 - RNA, 14 nt, Brucella suis 1330
gacagacuggaaug

SEQ ID NO: 2480030 - RNA, 15 nt, Brucella suis 1330
gacagauugcuaaau

SEQ ID NO: 2480031 - RNA, 15 nt, Brucella suis 1330
gacaggaacaucaua

SEQ ID NO: 2480032 - RNA, 18 nt, Brucella suis 1330
gacagggcaagcgccugc

SEQ ID NO: 2480033 - RNA, 19 nt, Brucella suis 1330
gacaguuggauagaccacc

SEQ ID NO: 2480034 - RNA, 12 nt, Brucella suis 1330
gacauagccgau

SEQ ID NO: 2480035 - RNA, 19 nt, Brucella suis 1330
gacauauugcccugcuggu

SEQ ID NO: 2480036 - RNA, 18 nt, Brucella suis 1330
gacaucaucaaggaaaaa

SEQ ID NO: 2480037 - RNA, 23 nt, Brucella suis 1330
gacaucaucaaggaaaaaaccgg

SEQ ID NO: 2480038 - RNA, 21 nt, Brucella suis 1330
gacaucgguggugccgaaggc

SEQ ID NO: 2480039 - RNA, 16 nt, Brucella suis 1330
gacaugccaagagccg

SEQ ID NO: 2480040 - RNA, 20 nt, Brucella suis 1330
gacauggcuuccggcguggu

SEQ ID NO: 2480041 - RNA, 13 nt, Brucella suis 1330
gacauggggcgag

SEQ ID NO: 2480042 - RNA, 20 nt, Brucella suis 1330
gaccaaacagccccgcaaua

SEQ ID NO: 2480043 - RNA, 21 nt, Brucella suis 1330
gaccaacuucgggggaaugcg

SEQ ID NO: 2480044 - RNA, 15 nt, Brucella suis 1330
gaccaagcccguacc

SEQ ID NO: 2480045 - RNA, 21 nt, Brucella suis 1330
gaccacauugccccacggauc

SEQ ID NO: 2480046 - RNA, 15 nt, Brucella suis 1330
gaccaccaggccgga

SEQ ID NO: 2480047 - RNA, 22 nt, Brucella suis 1330
gaccaccggccugagccauauc

SEQ ID NO: 2480048 - RNA, 13 nt, Brucella suis 1330
gaccacgccgagg

SEQ ID NO: 2480049 - RNA, 17 nt, Brucella suis 1330
gaccagccuugcccugg

SEQ ID NO: 2480050 - RNA, 16 nt, Brucella suis 1330
gaccagcgcauggcau

SEQ ID NO: 2480051 - RNA, 23 nt, Brucella suis 1330
gaccagcgcauggcauggcuuga

SEQ ID NO: 2480052 - RNA, 18 nt, Brucella suis 1330
gaccaggcccauuggaaa

SEQ ID NO: 2480053 - RNA, 17 nt, Brucella suis 1330
gaccaguaaggcgggcg

SEQ ID NO: 2480054 - RNA, 21 nt, Brucella suis 1330
gaccaguuccguguugaaaag

SEQ ID NO: 2480055 - RNA, 20 nt, Brucella suis 1330
gaccauauugcugggcaagu

SEQ ID NO: 2480056 - RNA, 14 nt, Brucella suis 1330
gaccaugacgccgc

SEQ ID NO: 2480057 - RNA, 10 nt, Brucella suis 1330
gaccauuucc

SEQ ID NO: 2480058 - RNA, 17 nt, Brucella suis 1330
gacccagccaagcgcca

SEQ ID NO: 2480059 - RNA, 20 nt, Brucella suis 1330
gacccgcccuucaucaccuu

SEQ ID NO: 2480060 - RNA, 18 nt, Brucella suis 1330
gacccgucaaugccaucc

SEQ ID NO: 2480061 - RNA, 16 nt, Brucella suis 1330
gaccgaauugaucuug

SEQ ID NO: 2480062 - RNA, 15 nt, Brucella suis 1330
gaccgagggccuguu

SEQ ID NO: 2480063 - RNA, 12 nt, Brucella suis 1330
gaccgcaacagg

SEQ ID NO: 2480064 - RNA, 17 nt, Brucella suis 1330
gaccgcccccucgcaac

SEQ ID NO: 2480065 - RNA, 22 nt, Brucella suis 1330
gaccgccucgacagcacugcca

SEQ ID NO: 2480066 - RNA, 18 nt, Brucella suis 1330
gaccgccuuuuccagugc

SEQ ID NO: 2480067 - RNA, 18 nt, Brucella suis 1330
gaccgcgaggaagccugc

SEQ ID NO: 2480068 - RNA, 19 nt, Brucella suis 1330
gaccgcggguucccugugg

SEQ ID NO: 2480069 - RNA, 12 nt, Brucella suis 1330
gaccggccaccc

SEQ ID NO: 2480070 - RNA, 17 nt, Brucella suis 1330
gaccggcgaaaaggcga

SEQ ID NO: 2480071 - RNA, 18 nt, Brucella suis 1330
gaccggcgaaaaggcgau

SEQ ID NO: 2480072 - RNA, 21 nt, Brucella suis 1330
gaccgggcuucuuguugaaag

SEQ ID NO: 2480073 - RNA, 13 nt, Brucella suis 1330
gaccgugccgcuu

SEQ ID NO: 2480074 - RNA, 16 nt, Brucella suis 1330
gaccgugccgcuucca

SEQ ID NO: 2480075 - RNA, 15 nt, Brucella suis 1330
gaccguugcgcggcg

SEQ ID NO: 2480076 - RNA, 20 nt, Brucella suis 1330
gaccucauuugccaccugca

SEQ ID NO: 2480077 - RNA, 15 nt, Brucella suis 1330
gagcggcagcagcca

SEQ ID NO: 2480078 - RNA, 12 nt, Brucella suis 1330
gagcggcaggcc

SEQ ID NO: 2480079 - RNA, 15 nt, Brucella suis 1330
gagcggcaggccgca

SEQ ID NO: 2480080 - RNA, 18 nt, Brucella suis 1330
gagcggggcccgaaagca

SEQ ID NO: 2480081 - RNA, 21 nt, Brucella suis 1330
gagcggucgacagugaaaucg

SEQ ID NO: 2480082 - RNA, 12 nt, Brucella suis 1330
gagcgguuccaa

SEQ ID NO: 2480083 - RNA, 22 nt, Brucella suis 1330
gagcgguuucaaaggagccgcu

SEQ ID NO: 2480084 - RNA, 17 nt, Brucella suis 1330
gagcguacaccgaccag

SEQ ID NO: 2480085 - RNA, 20 nt, Brucella suis 1330
gagcgucaggccgaugacgg

SEQ ID NO: 2480086 - RNA, 18 nt, Brucella suis 1330
gagcguccgagcggcagc

SEQ ID NO: 2480087 - RNA, 16 nt, Brucella suis 1330
gagcgugaucucaucc

SEQ ID NO: 2480088 - RNA, 19 nt, Brucella suis 1330
gagcuacgggugcuugccu

SEQ ID NO: 2480089 - RNA, 14 nt, Brucella suis 1330
gagcuaucagccgc

SEQ ID NO: 2480090 - RNA, 16 nt, Brucella suis 1330
gagcugcaucgcaggc

SEQ ID NO: 2480091 - RNA, 14 nt, Brucella suis 1330
gagcugcuggguga

SEQ ID NO: 2480092 - RNA, 13 nt, Brucella suis 1330
gagcugguuuuuc

SEQ ID NO: 2480093 - RNA, 14 nt, Brucella suis 1330
gagcuugcaaugag

SEQ ID NO: 2480094 - RNA, 16 nt, Brucella suis 1330
gaggaaguggaagcac

SEQ ID NO: 2480095 - RNA, 14 nt, Brucella suis 1330
gaggacaaggccuu

SEQ ID NO: 2480096 - RNA, 14 nt, Brucella suis 1330
gaggacgauggaag

SEQ ID NO: 2480097 - RNA, 15 nt, Brucella suis 1330
gaggauagcguaaaa

SEQ ID NO: 2480098 - RNA, 18 nt, Brucella suis 1330
gaggaucgaccaggaugu

SEQ ID NO: 2480099 - RNA, 22 nt, Brucella suis 1330
gaggcauugaggaucgaccagg

SEQ ID NO: 2480100 - RNA, 15 nt, Brucella suis 1330
gaggcauugcgcggc

SEQ ID NO: 2480101 - RNA, 20 nt, Brucella suis 1330
gaggccauuuugacccugcc

SEQ ID NO: 2480102 - RNA, 23 nt, Brucella suis 1330
gaggccgauaagugccgcgccga

SEQ ID NO: 2480103 - RNA, 20 nt, Brucella suis 1330
gaggccgcgcgcgcgcagga

SEQ ID NO: 2480104 - RNA, 21 nt, Brucella suis 1330
gaggccgcgcgcgcgcaggau

SEQ ID NO: 2480105 - RNA, 21 nt, Brucella suis 1330
gaggccugauagcggaaacca

SEQ ID NO: 2480106 - RNA, 18 nt, Brucella suis 1330
gaggcgaauggauugcgg

SEQ ID NO: 2480107 - RNA, 20 nt, Brucella suis 1330
gaggcggcauaaggccccca

SEQ ID NO: 2480108 - RNA, 15 nt, Brucella suis 1330
gaggcggccggagcg

SEQ ID NO: 2480109 - RNA, 15 nt, Brucella suis 1330
gaggcguuccgccuc

SEQ ID NO: 2480110 - RNA, 14 nt, Brucella suis 1330
gagggacggcucgg

SEQ ID NO: 2480111 - RNA, 14 nt, Brucella suis 1330
gagggagagaacac

SEQ ID NO: 2480112 - RNA, 17 nt, Brucella suis 1330
gagggcgcagcagcgca

SEQ ID NO: 2480113 - RNA, 22 nt, Brucella suis 1330
gagggcgggcaugggcaccugg

SEQ ID NO: 2480114 - RNA, 14 nt, Brucella suis 1330
gagggcgggcggcc

SEQ ID NO: 2480115 - RNA, 15 nt, Brucella suis 1330
gagguccaccacacc

SEQ ID NO: 2480116 - RNA, 13 nt, Brucella suis 1330
gaggucgagaucg

SEQ ID NO: 2480117 - RNA, 18 nt, Brucella suis 1330
gaggugcgggccggugga

SEQ ID NO: 2480118 - RNA, 21 nt, Brucella suis 1330
gagguucuugagguugagcug

SEQ ID NO: 2480119 - RNA, 20 nt, Brucella suis 1330
gaguggacgguugcugaggg

SEQ ID NO: 2480120 - RNA, 12 nt, Brucella suis 1330
gaguuggcccgc

SEQ ID NO: 2480121 - RNA, 19 nt, Brucella suis 1330
gaguuuuucggccaguuca

SEQ ID NO: 2480122 - RNA, 20 nt, Brucella suis 1330
gauaaagaugcgcgccagcc

SEQ ID NO: 2480123 - RNA, 18 nt, Brucella suis 1330
gauaaagccuguccuugu

SEQ ID NO: 2480124 - RNA, 18 nt, Brucella suis 1330
gauaacgcgacaaaacaa

SEQ ID NO: 2480125 - RNA, 14 nt, Brucella suis 1330
gauaagacauggcu

SEQ ID NO: 2480126 - RNA, 17 nt, Brucella suis 1330
gauaagauugcggcuga

SEQ ID NO: 2480127 - RNA, 20 nt, Brucella suis 1330
gauaaggcggcguuuuccau

SEQ ID NO: 2480128 - RNA, 18 nt, Brucella suis 1330
gauaauagaugagcuggu

SEQ ID NO: 2480129 - RNA, 19 nt, Brucella suis 1330
gauaaucggacagauugcu

SEQ ID NO: 2480130 - RNA, 15 nt, Brucella suis 1330
gauaaucuggcuggu

SEQ ID NO: 2480131 - RNA, 18 nt, Brucella suis 1330
gauaaugcgacaaaacaa

SEQ ID NO: 2480132 - RNA, 14 nt, Brucella suis 1330
gauaaugggcgcag

SEQ ID NO: 2480133 - RNA, 18 nt, Brucella suis 1330
gauaauugaucggcugga

SEQ ID NO: 2480134 - RNA, 13 nt, Brucella suis 1330
gauaccaaggccg

SEQ ID NO: 2480135 - RNA, 14 nt, Brucella suis 1330
gauaccaaggccga

SEQ ID NO: 2480136 - RNA, 15 nt, Brucella suis 1330
gauacugcgcggugc

SEQ ID NO: 2480137 - RNA, 15 nt, Brucella suis 1330
gauacuguagaaaau

SEQ ID NO: 2480138 - RNA, 14 nt, Brucella suis 1330
gauagaaccaccgc

SEQ ID NO: 2480139 - RNA, 14 nt, Brucella suis 1330
gauagagaacauau

SEQ ID NO: 2480140 - RNA, 15 nt, Brucella suis 1330
gauagagggccgaau

SEQ ID NO: 2480141 - RNA, 18 nt, Brucella suis 1330
gauagagggccgaaucgc

SEQ ID NO: 2480142 - RNA, 19 nt, Brucella suis 1330
gauagagguaggacugugg

SEQ ID NO: 2480143 - RNA, 19 nt, Brucella suis 1330
gauagauauuucuuccaga

SEQ ID NO: 2480144 - RNA, 15 nt, Brucella suis 1330
gauagcgcccgccuc

SEQ ID NO: 2480145 - RNA, 17 nt, Brucella suis 1330
gauaggcccaggccucu

SEQ ID NO: 2480146 - RNA, 21 nt, Brucella suis 1330
gauagggcaauuggcccccaa

SEQ ID NO: 2480147 - RNA, 15 nt, Brucella suis 1330
gauaggugagcggca

SEQ ID NO: 2480148 - RNA, 14 nt, Brucella suis 1330
gauauagagcagca

SEQ ID NO: 2480149 - RNA, 17 nt, Brucella suis 1330
gauaucaugcucgucgg

SEQ ID NO: 2480150 - RNA, 22 nt, Brucella suis 1330
gauauccaccuggccgccgccg

SEQ ID NO: 2480151 - RNA, 18 nt, Brucella suis 1330
gauauccauaucuuucca

SEQ ID NO: 2480152 - RNA, 19 nt, Brucella suis 1330
gauauccauuguggagcag

SEQ ID NO: 2480153 - RNA, 20 nt, Brucella suis 1330
gauauccggcacggccacgc

SEQ ID NO: 2480154 - RNA, 19 nt, Brucella suis 1330
gauaucgccugaaaccguc

SEQ ID NO: 2480155 - RNA, 20 nt, Brucella suis 1330
gauaucgccugcuuccuuuu

SEQ ID NO: 2480156 - RNA, 22 nt, Brucella suis 1330
gauaucggacuggauuucgagc

SEQ ID NO: 2480157 - RNA, 21 nt, Brucella suis 1330
gauaucugcaacaccaucgag

SEQ ID NO: 2480158 - RNA, 22 nt, Brucella suis 1330
gauauggcccagaaccugcccg

SEQ ID NO: 2480159 - RNA, 14 nt, Brucella suis 1330
gauauucgccgccu

SEQ ID NO: 2480160 - RNA, 16 nt, Brucella suis 1330
gauauucggccagcaa

SEQ ID NO: 2480161 - RNA, 18 nt, Brucella suis 1330
gauauuucucgcgccaga

SEQ ID NO: 2480162 - RNA, 21 nt, Brucella suis 1330
gaucaacgcuuugaccgccgc

SEQ ID NO: 2480163 - RNA, 22 nt, Brucella suis 1330
gaucaacgcuuugaccgccgcg

SEQ ID NO: 2480164 - RNA, 11 nt, Brucella suis 1330
gaucaauuccu

SEQ ID NO: 2480165 - RNA, 19 nt, Brucella suis 1330
gaucacaacgccgucagcc

SEQ ID NO: 2480166 - RNA, 23 nt, Brucella suis 1330
gaucacaacgccgucagccccgu

SEQ ID NO: 2480167 - RNA, 15 nt, Brucella suis 1330
gaucacagccgcgcc

SEQ ID NO: 2480168 - RNA, 16 nt, Brucella suis 1330
gaucacagccgcgcca

SEQ ID NO: 2480169 - RNA, 22 nt, Brucella suis 1330
gaucaccgcagucaugcccaua

SEQ ID NO: 2480170 - RNA, 23 nt, Brucella suis 1330
gaucagcaccaucgaggaauagg

SEQ ID NO: 2480171 - RNA, 13 nt, Brucella suis 1330
gaucagccacauu

SEQ ID NO: 2480172 - RNA, 13 nt, Brucella suis 1330
gaucagcgcgccg

SEQ ID NO: 2480173 - RNA, 16 nt, Brucella suis 1330
gaucagcguccauccg

SEQ ID NO: 2480174 - RNA, 21 nt, Brucella suis 1330
gaucagcguccauccggcggc

SEQ ID NO: 2480175 - RNA, 13 nt, Brucella suis 1330
gaucagggaacgg

SEQ ID NO: 2480176 - RNA, 18 nt, Brucella suis 1330
gaucagguugaugccggg

SEQ ID NO: 2480177 - RNA, 22 nt, Brucella suis 1330
gaucagguuucgacaagcuuca

SEQ ID NO: 2480178 - RNA, 13 nt, Brucella suis 1330
gaucagugccacc

SEQ ID NO: 2480179 - RNA, 17 nt, Brucella suis 1330
gaucauauaggugccga

SEQ ID NO: 2480180 - RNA, 14 nt, Brucella suis 1330
gaucaucagcggcg

SEQ ID NO: 2480181 - RNA, 23 nt, Brucella suis 1330
gaucauccauuccucaagauaca

SEQ ID NO: 2480182 - RNA, 18 nt, Brucella suis 1330
gaucauugccccaaggcg

SEQ ID NO: 2480183 - RNA, 23 nt, Brucella suis 1330
gauccaauauugccuuccccaua

SEQ ID NO: 2480184 - RNA, 15 nt, Brucella suis 1330
gauccagaucuuccu

SEQ ID NO: 2480185 - RNA, 20 nt, Brucella suis 1330
gaucccgcuucgaugcgcug

SEQ ID NO: 2480186 - RNA, 22 nt, Brucella suis 1330
gaucccgcuucgaugcgcugga

SEQ ID NO: 2480187 - RNA, 21 nt, Brucella suis 1330
gauccgccaaucagaaugcgu

SEQ ID NO: 2480188 - RNA, 20 nt, Brucella suis 1330
gauccggcgggcuuuucauu

SEQ ID NO: 2480189 - RNA, 23 nt, Brucella suis 1330
gauccugcgcccugucagaaagu

SEQ ID NO: 2480190 - RNA, 15 nt, Brucella suis 1330
gauccuguagacgaa

SEQ ID NO: 2480191 - RNA, 22 nt, Brucella suis 1330
gaucgaagggcugagggaaaca

SEQ ID NO: 2480192 - RNA, 14 nt, Brucella suis 1330
gaucgacagccggu

SEQ ID NO: 2480193 - RNA, 14 nt, Brucella suis 1330
gauuggauuugacg

SEQ ID NO: 2480194 - RNA, 20 nt, Brucella suis 1330
gauuggauuugacguuugaa

SEQ ID NO: 2480195 - RNA, 14 nt, Brucella suis 1330
gauugggcgaugau

SEQ ID NO: 2480196 - RNA, 14 nt, Brucella suis 1330
gauugggcgcgcua

SEQ ID NO: 2480197 - RNA, 14 nt, Brucella suis 1330
gauugggcggcggc

SEQ ID NO: 2480198 - RNA, 21 nt, Brucella suis 1330
gauuguccguccugaugccgu

SEQ ID NO: 2480199 - RNA, 14 nt, Brucella suis 1330
gauuuaaaacuuaa

SEQ ID NO: 2480200 - RNA, 16 nt, Brucella suis 1330
gauuuacguuuucguc

SEQ ID NO: 2480201 - RNA, 16 nt, Brucella suis 1330
gauuucacccuuggcg

SEQ ID NO: 2480202 - RNA, 19 nt, Brucella suis 1330
gauuucaccgggaaucuug

SEQ ID NO: 2480203 - RNA, 22 nt, Brucella suis 1330
gauuucauccagcguuaccuug

SEQ ID NO: 2480204 - RNA, 12 nt, Brucella suis 1330
gauuucgagcug

SEQ ID NO: 2480205 - RNA, 16 nt, Brucella suis 1330
gauuucggcaaaggcg

SEQ ID NO: 2480206 - RNA, 15 nt, Brucella suis 1330
gauuucggcgugcag

SEQ ID NO: 2480207 - RNA, 17 nt, Brucella suis 1330
gauuucugauccugcuu

SEQ ID NO: 2480208 - RNA, 15 nt, Brucella suis 1330
gauuugauccaugcg

SEQ ID NO: 2480209 - RNA, 12 nt, Brucella suis 1330
gauuuuucuuug

SEQ ID NO: 2480210 - RNA, 14 nt, Brucella suis 1330
gauuuuugccagau

SEQ ID NO: 2480211 - RNA, 12 nt, Brucella suis 1330
gcaaaaagcggc

SEQ ID NO: 2480212 - RNA, 18 nt, Brucella suis 1330
gcaaaagugagaaacggu

SEQ ID NO: 2480213 - RNA, 12 nt, Brucella suis 1330
gcaaaagugcga

SEQ ID NO: 2480214 - RNA, 18 nt, Brucella suis 1330
gcaaaaguggcgcgugcc

SEQ ID NO: 2480215 - RNA, 24 nt, Brucella suis 1330
gcaaaccuccgacaccagccguuc

SEQ ID NO: 2480216 - RNA, 11 nt, Brucella suis 1330
gcaaagagaac

SEQ ID NO: 2480217 - RNA, 20 nt, Brucella suis 1330
gcaaagcuuuggaaccggcu

SEQ ID NO: 2480218 - RNA, 17 nt, Brucella suis 1330
gcaaaggccggguuuuu

SEQ ID NO: 2480219 - RNA, 18 nt, Brucella suis 1330
gcaaaggccggguuuuuc

SEQ ID NO: 2480220 - RNA, 14 nt, Brucella suis 1330
gcaaaggucgggug

SEQ ID NO: 2480221 - RNA, 22 nt, Brucella suis 1330
gcaaaugccgaagcccauggca

SEQ ID NO: 2480222 - RNA, 20 nt, Brucella suis 1330
gcaacacgccgccgcgcggc

SEQ ID NO: 2480223 - RNA, 18 nt, Brucella suis 1330
gcaacagggcgaaaagcc

SEQ ID NO: 2480224 - RNA, 22 nt, Brucella suis 1330
gcaacagggcgaaaagccgccu

SEQ ID NO: 2480225 - RNA, 19 nt, Brucella suis 1330
gcaaccaugcguuuuacuc

SEQ ID NO: 2480226 - RNA, 16 nt, Brucella suis 1330
gcaacccauuuucaug

SEQ ID NO: 2480227 - RNA, 17 nt, Brucella suis 1330
gcaacgaauacagugac

SEQ ID NO: 2480228 - RNA, 16 nt, Brucella suis 1330
gcaacgcgcccgccac

SEQ ID NO: 2480229 - RNA, 20 nt, Brucella suis 1330
gcaacgcucucguguuaucu

SEQ ID NO: 2480230 - RNA, 15 nt, Brucella suis 1330
gcaacgggcgagggc

SEQ ID NO: 2480231 - RNA, 15 nt, Brucella suis 1330
gcaacucauggaagu

SEQ ID NO: 2480232 - RNA, 19 nt, Brucella suis 1330
gcaacugaucgagauaagc

SEQ ID NO: 2480233 - RNA, 15 nt, Brucella suis 1330
gcaacuuccuugccg

SEQ ID NO: 2480234 - RNA, 16 nt, Brucella suis 1330
gcaagauuuuggcgaa

SEQ ID NO: 2480235 - RNA, 19 nt, Brucella suis 1330
gcaagcauuccgggccgca

SEQ ID NO: 2480236 - RNA, 16 nt, Brucella suis 1330
gcaagcccgcugcgcc

SEQ ID NO: 2480237 - RNA, 21 nt, Brucella suis 1330
gcaagccgcggcgcgaccugc

SEQ ID NO: 2480238 - RNA, 23 nt, Brucella suis 1330
gcaagccgcggcgcgaccugcuc

SEQ ID NO: 2480239 - RNA, 22 nt, Brucella suis 1330
gcaagcgcgauggcguugcggc

SEQ ID NO: 2480240 - RNA, 22 nt, Brucella suis 1330
gcaagcgcggucagcucgucca

SEQ ID NO: 2480241 - RNA, 14 nt, Brucella suis 1330
gcaagcgucuucug

SEQ ID NO: 2480242 - RNA, 21 nt, Brucella suis 1330
gcaagcucgccauccuugaac

SEQ ID NO: 2480243 - RNA, 20 nt, Brucella suis 1330
gcaagcuggaaggccaggcc

SEQ ID NO: 2480244 - RNA, 15 nt, Brucella suis 1330
gcaaggagcgagcuu

SEQ ID NO: 2480245 - RNA, 13 nt, Brucella suis 1330
gcaaggcgcgccc

SEQ ID NO: 2480246 - RNA, 14 nt, Brucella suis 1330
gcaaggcggcugga

SEQ ID NO: 2480247 - RNA, 16 nt, Brucella suis 1330
gcaagggcaagcagaa

SEQ ID NO: 2480248 - RNA, 16 nt, Brucella suis 1330
gcaagggcuggcucua

SEQ ID NO: 2480249 - RNA, 22 nt, Brucella suis 1330
gcaaggggcggaacaggcagca

SEQ ID NO: 2480250 - RNA, 13 nt, Brucella suis 1330
gcaaguggcgcug

SEQ ID NO: 2480251 - RNA, 22 nt, Brucella suis 1330
gcaaguggcgcugacgcuugau

SEQ ID NO: 2480252 - RNA, 15 nt, Brucella suis 1330
gcaagugugcagaca

SEQ ID NO: 2480253 - RNA, 22 nt, Brucella suis 1330
gcaagugugcagacaggccagu

SEQ ID NO: 2480254 - RNA, 18 nt, Brucella suis 1330
gcaagugugcgcgcgcca

SEQ ID NO: 2480255 - RNA, 24 nt, Brucella suis 1330
gcaagugugcgcgcgccaucggca

SEQ ID NO: 2480256 - RNA, 18 nt, Brucella suis 1330
gcaauaauuaugcaggaa

SEQ ID NO: 2480257 - RNA, 14 nt, Brucella suis 1330
gcaauaccaagcgc

SEQ ID NO: 2480258 - RNA, 21 nt, Brucella suis 1330
gcaauagaccaccaggccgga

SEQ ID NO: 2480259 - RNA, 20 nt, Brucella suis 1330
gcaauauauacacgcagacg

SEQ ID NO: 2480260 - RNA, 15 nt, Brucella suis 1330
gcaauaucgauccag

SEQ ID NO: 2480261 - RNA, 17 nt, Brucella suis 1330
gcaauaugcgccuugcg

SEQ ID NO: 2480262 - RNA, 18 nt, Brucella suis 1330
gcaauaugcgccuugcgc

SEQ ID NO: 2480263 - RNA, 23 nt, Brucella suis 1330
gcaauaugcgccuugcgccgcag

SEQ ID NO: 2480264 - RNA, 15 nt, Brucella suis 1330
gcaaucacgcggcgc

SEQ ID NO: 2480265 - RNA, 23 nt, Brucella suis 1330
gcaaucagaucgguaugggcaau

SEQ ID NO: 2480266 - RNA, 19 nt, Brucella suis 1330
gcaauccccggaccacgca

SEQ ID NO: 2480267 - RNA, 19 nt, Brucella suis 1330
gcaaucccgaaaaguugac

SEQ ID NO: 2480268 - RNA, 17 nt, Brucella suis 1330
gcaaucgccaccggcgg

SEQ ID NO: 2480269 - RNA, 20 nt, Brucella suis 1330
gcaaucugguccacgcccuu

SEQ ID NO: 2480270 - RNA, 14 nt, Brucella suis 1330
gcaaugagcgcgcu

SEQ ID NO: 2480271 - RNA, 19 nt, Brucella suis 1330
gcaaugauagcuggaaaaa

SEQ ID NO: 2480272 - RNA, 22 nt, Brucella suis 1330
gcaaugauagcuggaaaaaauc

SEQ ID NO: 2480273 - RNA, 17 nt, Brucella suis 1330
gcaaugcaccgauggcc

SEQ ID NO: 2480274 - RNA, 19 nt, Brucella suis 1330
gcaaugcgccgugcagggu

SEQ ID NO: 2480275 - RNA, 15 nt, Brucella suis 1330
gcaauggccgcauga

SEQ ID NO: 2480276 - RNA, 13 nt, Brucella suis 1330
gcaauggccuugc

SEQ ID NO: 2480277 - RNA, 15 nt, Brucella suis 1330
gcaauggccuugccg

SEQ ID NO: 2480278 - RNA, 18 nt, Brucella suis 1330
gcaauggccuugccgauc

SEQ ID NO: 2480279 - RNA, 21 nt, Brucella suis 1330
gcaauggcgggccauuuccaa

SEQ ID NO: 2480280 - RNA, 20 nt, Brucella suis 1330
gcaauggcugucaaugcagc

SEQ ID NO: 2480281 - RNA, 21 nt, Brucella suis 1330
gcaaugugcgggcuucuucca

SEQ ID NO: 2480282 - RNA, 23 nt, Brucella suis 1330
gcaaugugcgggcuucuuccagu

SEQ ID NO: 2480283 - RNA, 23 nt, Brucella suis 1330
gcaaugugcuggcggccaagcgc

SEQ ID NO: 2480284 - RNA, 16 nt, Brucella suis 1330
gcaauuccugcgccac

SEQ ID NO: 2480285 - RNA, 15 nt, Brucella suis 1330
gcaauucgauugucc

SEQ ID NO: 2480286 - RNA, 21 nt, Brucella suis 1330
gcaauugaccgcuaucgcugc

SEQ ID NO: 2480287 - RNA, 18 nt, Brucella suis 1330
gcaauugccgcugccggu

SEQ ID NO: 2480288 - RNA, 18 nt, Brucella suis 1330
gcaauugcgcaaggcccu

SEQ ID NO: 2480289 - RNA, 20 nt, Brucella suis 1330
gcacaagaacagccgccccg

SEQ ID NO: 2480290 - RNA, 13 nt, Brucella suis 1330
gcacaagcugcgu

SEQ ID NO: 2480291 - RNA, 22 nt, Brucella suis 1330
gcacaagcuugauaaggccguu

SEQ ID NO: 2480292 - RNA, 14 nt, Brucella suis 1330
gcacacggucaugc

SEQ ID NO: 2480293 - RNA, 21 nt, Brucella suis 1330
gcacagccagaaagaagauga

SEQ ID NO: 2480294 - RNA, 17 nt, Brucella suis 1330
gcacauaaaacgcgccg

SEQ ID NO: 2480295 - RNA, 15 nt, Brucella suis 1330
gcacauaucagcccg

SEQ ID NO: 2480296 - RNA, 17 nt, Brucella suis 1330
gcacaucaucggucagg

SEQ ID NO: 2480297 - RNA, 14 nt, Brucella suis 1330
gcacaugagcgcgg

SEQ ID NO: 2480298 - RNA, 14 nt, Brucella suis 1330
gcacauggcggccu

SEQ ID NO: 2480299 - RNA, 13 nt, Brucella suis 1330
gcaccagcgcgcc

SEQ ID NO: 2480300 - RNA, 15 nt, Brucella suis 1330
gcaccagcgcgccga

SEQ ID NO: 2480301 - RNA, 17 nt, Brucella suis 1330
gcaccagcgcgccgauc

SEQ ID NO: 2480302 - RNA, 19 nt, Brucella suis 1330
gcaccagcggcacgccgcc

SEQ ID NO: 2480303 - RNA, 20 nt, Brucella suis 1330
gcaccagcggcacgccgccc

SEQ ID NO: 2480304 - RNA, 19 nt, Brucella suis 1330
gcaccaucaucguggcggc

SEQ ID NO: 2480305 - RNA, 17 nt, Brucella suis 1330
gcaccauucugcccaga

SEQ ID NO: 2480306 - RNA, 17 nt, Brucella suis 1330
gcacccacugcccgccu

SEQ ID NO: 2480307 - RNA, 13 nt, Brucella suis 1330
gcaccccaugaga

SEQ ID NO: 2480308 - RNA, 23 nt, Brucella suis 1330
gcaccccaugagaaggcaagccc

SEQ ID NO: 2480309 - RNA, 21 nt, Brucella suis 1330
gcagucaggccgaccgcaaug

SEQ ID NO: 2480310 - RNA, 13 nt, Brucella suis 1330
gcaguccggcagc

SEQ ID NO: 2480311 - RNA, 15 nt, Brucella suis 1330
gcaguccggcagccg

SEQ ID NO: 2480312 - RNA, 14 nt, Brucella suis 1330
gcagugaaagccgc

SEQ ID NO: 2480313 - RNA, 14 nt, Brucella suis 1330
gcagugcaggacug

SEQ ID NO: 2480314 - RNA, 13 nt, Brucella suis 1330
gcaguuccugcgc

SEQ ID NO: 2480315 - RNA, 15 nt, Brucella suis 1330
gcaguuucaccaugg

SEQ ID NO: 2480316 - RNA, 17 nt, Brucella suis 1330
gcaguuucaccauggcc

SEQ ID NO: 2480317 - RNA, 12 nt, Brucella suis 1330
gcauaaaggccg

SEQ ID NO: 2480318 - RNA, 22 nt, Brucella suis 1330
gcauaaucggcaucggaaaggu

SEQ ID NO: 2480319 - RNA, 16 nt, Brucella suis 1330
gcauagccggcaugga

SEQ ID NO: 2480320 - RNA, 16 nt, Brucella suis 1330
gcauaggaaucagcaa

SEQ ID NO: 2480321 - RNA, 20 nt, Brucella suis 1330
gcauaggaaucagcaaguuu

SEQ ID NO: 2480322 - RNA, 23 nt, Brucella suis 1330
gcauauagguguuggucaugcgc

SEQ ID NO: 2480323 - RNA, 22 nt, Brucella suis 1330
gcauauccggaccgaaggccag

SEQ ID NO: 2480324 - RNA, 19 nt, Brucella suis 1330
gcauaucuuccagagcggg

SEQ ID NO: 2480325 - RNA, 15 nt, Brucella suis 1330
gcauauguuccugcg

SEQ ID NO: 2480326 - RNA, 15 nt, Brucella suis 1330
gcauauugcuugucg

SEQ ID NO: 2480327 - RNA, 21 nt, Brucella suis 1330
gcaucaaccuuuucggcaagg

SEQ ID NO: 2480328 - RNA, 18 nt, Brucella suis 1330
gcaucaauccuucaugcc

SEQ ID NO: 2480329 - RNA, 16 nt, Brucella suis 1330
gcaucacagucacgcc

SEQ ID NO: 2480330 - RNA, 12 nt, Brucella suis 1330
gcaucacuggca

SEQ ID NO: 2480331 - RNA, 18 nt, Brucella suis 1330
gcaucagaaauuugcggg

SEQ ID NO: 2480332 - RNA, 17 nt, Brucella suis 1330
gcaucagccucccuuca

SEQ ID NO: 2480333 - RNA, 22 nt, Brucella suis 1330
gcaucagucgaauuucagcagg

SEQ ID NO: 2480334 - RNA, 19 nt, Brucella suis 1330
gcaucaugcggucguccuc

SEQ ID NO: 2480335 - RNA, 16 nt, Brucella suis 1330
gcaucaugucauggcc

SEQ ID NO: 2480336 - RNA, 16 nt, Brucella suis 1330
gcauccacucggcggc

SEQ ID NO: 2480337 - RNA, 19 nt, Brucella suis 1330
gcauccacucggcggcauc

SEQ ID NO: 2480338 - RNA, 21 nt, Brucella suis 1330
gcauccacucggcggcaucgc

SEQ ID NO: 2480339 - RNA, 23 nt, Brucella suis 1330
gcauccagaacuucgccaagccc

SEQ ID NO: 2480340 - RNA, 12 nt, Brucella suis 1330
gcauccagcacu

SEQ ID NO: 2480341 - RNA, 12 nt, Brucella suis 1330
gcaucccugucg

SEQ ID NO: 2480342 - RNA, 21 nt, Brucella suis 1330
gcauccgaaaugcgcggcggc

SEQ ID NO: 2480343 - RNA, 22 nt, Brucella suis 1330
gcauccgaaaugcgcggcggca

SEQ ID NO: 2480344 - RNA, 20 nt, Brucella suis 1330
gcauccugcucggcgcggcg

SEQ ID NO: 2480345 - RNA, 14 nt, Brucella suis 1330
gcauccuugucggc

SEQ ID NO: 2480346 - RNA, 14 nt, Brucella suis 1330
gcaucgaaugccgc

SEQ ID NO: 2480347 - RNA, 15 nt, Brucella suis 1330
gcaucgaaugccgca

SEQ ID NO: 2480348 - RNA, 13 nt, Brucella suis 1330
gcaucgaccagcc

SEQ ID NO: 2480349 - RNA, 18 nt, Brucella suis 1330
gcaucgagaaaagcgcaa

SEQ ID NO: 2480350 - RNA, 12 nt, Brucella suis 1330
gcaucgagcugg

SEQ ID NO: 2480351 - RNA, 13 nt, Brucella suis 1330
gcaucgcccccuu

SEQ ID NO: 2480352 - RNA, 11 nt, Brucella suis 1330
gcaucgccgcc

SEQ ID NO: 2480353 - RNA, 14 nt, Brucella suis 1330
gcaucgccgccagc

SEQ ID NO: 2480354 - RNA, 20 nt, Brucella suis 1330
gcaucgcgaggcuauuuauu

SEQ ID NO: 2480355 - RNA, 21 nt, Brucella suis 1330
gcaucggccugacggugcagc

SEQ ID NO: 2480356 - RNA, 14 nt, Brucella suis 1330
gcaucggcggugca

SEQ ID NO: 2480357 - RNA, 20 nt, Brucella suis 1330
gcaucggcuugggaagauca

SEQ ID NO: 2480358 - RNA, 23 nt, Brucella suis 1330
gcaucgggaucaaugaucuggcu

SEQ ID NO: 2480359 - RNA, 16 nt, Brucella suis 1330
gcaucgggcgcugucc

SEQ ID NO: 2480360 - RNA, 20 nt, Brucella suis 1330
gcaucggucagcacgcccgu

SEQ ID NO: 2480361 - RNA, 18 nt, Brucella suis 1330
gcaucgguggcauugccc

SEQ ID NO: 2480362 - RNA, 16 nt, Brucella suis 1330
gcaucguaaucgccgg

SEQ ID NO: 2480363 - RNA, 19 nt, Brucella suis 1330
gcaucgucaaucacgccac

SEQ ID NO: 2480364 - RNA, 22 nt, Brucella suis 1330
gcaucucuuccuaauggaugac

SEQ ID NO: 2480365 - RNA, 18 nt, Brucella suis 1330
gcaucugaaaaagcccgg

SEQ ID NO: 2480366 - RNA, 18 nt, Brucella suis 1330
gcaucugauuugaaaagc

SEQ ID NO: 2480367 - RNA, 14 nt, Brucella suis 1330
gcaucuguucugcc

SEQ ID NO: 2480368 - RNA, 17 nt, Brucella suis 1330
gcaucuugccaagcuca

SEQ ID NO: 2480369 - RNA, 15 nt, Brucella suis 1330
gcaucuuuuccgaaa

SEQ ID NO: 2480370 - RNA, 20 nt, Brucella suis 1330
gcaucuuuuccgaaaaccgu

SEQ ID NO: 2480371 - RNA, 15 nt, Brucella suis 1330
gcaugaaaacgccgc

SEQ ID NO: 2480372 - RNA, 21 nt, Brucella suis 1330
gcaugaacucgccauaauauu

SEQ ID NO: 2480373 - RNA, 18 nt, Brucella suis 1330
gcaugacaccuucggcca

SEQ ID NO: 2480374 - RNA, 17 nt, Brucella suis 1330
gcaugauccgcuccaga

SEQ ID NO: 2480375 - RNA, 23 nt, Brucella suis 1330
gcaugaucgugagcgagcgcaca

SEQ ID NO: 2480376 - RNA, 20 nt, Brucella suis 1330
gcaugaugccgacgaaagcc

SEQ ID NO: 2480377 - RNA, 14 nt, Brucella suis 1330
gcauggaccacgcg

SEQ ID NO: 2480378 - RNA, 14 nt, Brucella suis 1330
gcauggcagccgau

SEQ ID NO: 2480379 - RNA, 15 nt, Brucella suis 1330
gcauggccccggagc

SEQ ID NO: 2480380 - RNA, 19 nt, Brucella suis 1330
gcauggccucaagugccgc

SEQ ID NO: 2480381 - RNA, 22 nt, Brucella suis 1330
gcauggccucaagugccgccuu

SEQ ID NO: 2480382 - RNA, 14 nt, Brucella suis 1330
gcaugggcaagaca

SEQ ID NO: 2480383 - RNA, 21 nt, Brucella suis 1330
gcaugguucuggaaucgagau

SEQ ID NO: 2480384 - RNA, 18 nt, Brucella suis 1330
gcaugucauccgaaacca

SEQ ID NO: 2480385 - RNA, 22 nt, Brucella suis 1330
gcauguuucgauucgcccggcc

SEQ ID NO: 2480386 - RNA, 15 nt, Brucella suis 1330
gcauucaggcggccu

SEQ ID NO: 2480387 - RNA, 16 nt, Brucella suis 1330
gcauuccccgcccgcg

SEQ ID NO: 2480388 - RNA, 20 nt, Brucella suis 1330
gcauucccuucgcgccgccu

SEQ ID NO: 2480389 - RNA, 13 nt, Brucella suis 1330
gcauucugccggu

SEQ ID NO: 2480390 - RNA, 21 nt, Brucella suis 1330
gcauucugccgguucugcaug

SEQ ID NO: 2480391 - RNA, 14 nt, Brucella suis 1330
gcauugaaaggcag

SEQ ID NO: 2480392 - RNA, 20 nt, Brucella suis 1330
gcauugacaagcgugagcuu

SEQ ID NO: 2480393 - RNA, 18 nt, Brucella suis 1330
gcauugccgagcuugcgg

SEQ ID NO: 2480394 - RNA, 21 nt, Brucella suis 1330
gcauuggcgauuuucugcaca

SEQ ID NO: 2480395 - RNA, 16 nt, Brucella suis 1330
gcauuguggugcgcau

SEQ ID NO: 2480396 - RNA, 12 nt, Brucella suis 1330
gcauuuccagca

SEQ ID NO: 2480397 - RNA, 22 nt, Brucella suis 1330
gcauuuuucgccgcgcacuggc

SEQ ID NO: 2480398 - RNA, 21 nt, Brucella suis 1330
gccaaaaaucgagggguuuuu

SEQ ID NO: 2480399 - RNA, 13 nt, Brucella suis 1330
gccaaaagauucc

SEQ ID NO: 2480400 - RNA, 20 nt, Brucella suis 1330
gccaaaaugauuucgcaaug

SEQ ID NO: 2480401 - RNA, 20 nt, Brucella suis 1330
gccaaccaaagaaaaaagcc

SEQ ID NO: 2480402 - RNA, 19 nt, Brucella suis 1330
gccaaccauauuggcggca

SEQ ID NO: 2480403 - RNA, 20 nt, Brucella suis 1330
gccaaccguaucauccggcg

SEQ ID NO: 2480404 - RNA, 21 nt, Brucella suis 1330
gccaacgccggcaccgccccg

SEQ ID NO: 2480405 - RNA, 19 nt, Brucella suis 1330
gccaagaagaacacagccc

SEQ ID NO: 2480406 - RNA, 16 nt, Brucella suis 1330
gccaagacuaugcgcc

SEQ ID NO: 2480407 - RNA, 17 nt, Brucella suis 1330
gccaagacuaugcgcca

SEQ ID NO: 2480408 - RNA, 18 nt, Brucella suis 1330
gccaagaucgacaaagcc

SEQ ID NO: 2480409 - RNA, 14 nt, Brucella suis 1330
gccaagcgccacgc

SEQ ID NO: 2480410 - RNA, 12 nt, Brucella suis 1330
gccaagcgccag

SEQ ID NO: 2480411 - RNA, 17 nt, Brucella suis 1330
gccaagcggaucgcguc

SEQ ID NO: 2480412 - RNA, 20 nt, Brucella suis 1330
gccaagcuugaucgccgcac

SEQ ID NO: 2480413 - RNA, 17 nt, Brucella suis 1330
gccaagcuuuugcagcc

SEQ ID NO: 2480414 - RNA, 19 nt, Brucella suis 1330
gccaagcuuuugcagccgu

SEQ ID NO: 2480415 - RNA, 12 nt, Brucella suis 1330
gccaaggcugcg

SEQ ID NO: 2480416 - RNA, 16 nt, Brucella suis 1330
gccaaggcugcgcgca

SEQ ID NO: 2480417 - RNA, 18 nt, Brucella suis 1330
gccaagggccgccgaagc

SEQ ID NO: 2480418 - RNA, 22 nt, Brucella suis 1330
gccaagugcggucugcuugccg

SEQ ID NO: 2480419 - RNA, 12 nt, Brucella suis 1330
gccaauaccgug

SEQ ID NO: 2480420 - RNA, 19 nt, Brucella suis 1330
gccaauccaggucagcggc

SEQ ID NO: 2480421 - RNA, 21 nt, Brucella suis 1330
gccaauccccucaccuugccg

SEQ ID NO: 2480422 - RNA, 15 nt, Brucella suis 1330
gccaaugacauggca

SEQ ID NO: 2480423 - RNA, 22 nt, Brucella suis 1330
gccaauuccgccggggcaggcu

SEQ ID NO: 2480424 - RNA, 13 nt, Brucella suis 1330
gccaccacggcgc

SEQ ID NO: 2480425 - RNA, 17 nt, Brucella suis 1330
gcccaccgaagccacga

SEQ ID NO: 2480426 - RNA, 16 nt, Brucella suis 1330
gcccacgcccagcgcg

SEQ ID NO: 2480427 - RNA, 18 nt, Brucella suis 1330
gcccacgcccgacaaaga

SEQ ID NO: 2480428 - RNA, 20 nt, Brucella suis 1330
gcccacggucgagugcggcc

SEQ ID NO: 2480429 - RNA, 18 nt, Brucella suis 1330
gcccagaaccgaggcaau

SEQ ID NO: 2480430 - RNA, 20 nt, Brucella suis 1330
gcccagaccgucaaaacgcc

SEQ ID NO: 2480431 - RNA, 17 nt, Brucella suis 1330
gcccagauguuccugcg

SEQ ID NO: 2480432 - RNA, 14 nt, Brucella suis 1330
gcccagcaccgcgc

SEQ ID NO: 2480433 - RNA, 13 nt, Brucella suis 1330
gcccagcgcggca

SEQ ID NO: 2480434 - RNA, 19 nt, Brucella suis 1330
gcccaggccucugccucca

SEQ ID NO: 2480435 - RNA, 23 nt, Brucella suis 1330
gcccaggccucugccuccauggc

SEQ ID NO: 2480436 - RNA, 22 nt, Brucella suis 1330
gcccauaaggcggaugcgcggc

SEQ ID NO: 2480437 - RNA, 23 nt, Brucella suis 1330
gcccauaaggcggaugcgcggcg

SEQ ID NO: 2480438 - RNA, 23 nt, Brucella suis 1330
gcccauaccgcgccaaggcugcg

SEQ ID NO: 2480439 - RNA, 16 nt, Brucella suis 1330
gcccauacgcgcggca

SEQ ID NO: 2480440 - RNA, 22 nt, Brucella suis 1330
gcccauauguauggcaaaaggc

SEQ ID NO: 2480441 - RNA, 17 nt, Brucella suis 1330
gcccaucccggaaggaa

SEQ ID NO: 2480442 - RNA, 18 nt, Brucella suis 1330
gcccaucccggaaggaau

SEQ ID NO: 2480443 - RNA, 20 nt, Brucella suis 1330
gcccauggacuuuucagccu

SEQ ID NO: 2480444 - RNA, 16 nt, Brucella suis 1330
gcccauguccgccuga

SEQ ID NO: 2480445 - RNA, 16 nt, Brucella suis 1330
gcccauugcccgcccg

SEQ ID NO: 2480446 - RNA, 17 nt, Brucella suis 1330
gcccauugcccgcccgu

SEQ ID NO: 2480447 - RNA, 22 nt, Brucella suis 1330
gcccauuggaaauuauagccgc

SEQ ID NO: 2480448 - RNA, 19 nt, Brucella suis 1330
gccccaagaucagccacau

SEQ ID NO: 2480449 - RNA, 22 nt, Brucella suis 1330
gccccaggaacggcagguaaga

SEQ ID NO: 2480450 - RNA, 15 nt, Brucella suis 1330
gccccauaaagcugg

SEQ ID NO: 2480451 - RNA, 20 nt, Brucella suis 1330
gccccauguuuaugaaaaca

SEQ ID NO: 2480452 - RNA, 13 nt, Brucella suis 1330
gcccccacaacug

SEQ ID NO: 2480453 - RNA, 18 nt, Brucella suis 1330
gcccccagaaggcgcggc

SEQ ID NO: 2480454 - RNA, 14 nt, Brucella suis 1330
gcccccucgcaacc

SEQ ID NO: 2480455 - RNA, 19 nt, Brucella suis 1330
gcccccuguuucugcugga

SEQ ID NO: 2480456 - RNA, 14 nt, Brucella suis 1330
gccccgauuuuggc

SEQ ID NO: 2480457 - RNA, 14 nt, Brucella suis 1330
gccccgccagaaaa

SEQ ID NO: 2480458 - RNA, 21 nt, Brucella suis 1330
gccccgcgugaugagccgcuu

SEQ ID NO: 2480459 - RNA, 22 nt, Brucella suis 1330
gccccgcgugaugagccgcuuc

SEQ ID NO: 2480460 - RNA, 17 nt, Brucella suis 1330
gccccgcugaggcggcc

SEQ ID NO: 2480461 - RNA, 16 nt, Brucella suis 1330
gccccggcaucacugg

SEQ ID NO: 2480462 - RNA, 16 nt, Brucella suis 1330
gccccuaaagccgcuc

SEQ ID NO: 2480463 - RNA, 14 nt, Brucella suis 1330
gccccuugccgucg

SEQ ID NO: 2480464 - RNA, 14 nt, Brucella suis 1330
gcccgaaagcagac

SEQ ID NO: 2480465 - RNA, 17 nt, Brucella suis 1330
gcccgaacaauuugcgg

SEQ ID NO: 2480466 - RNA, 18 nt, Brucella suis 1330
gcccgaagcgcaaagccc

SEQ ID NO: 2480467 - RNA, 16 nt, Brucella suis 1330
gcccgacaaagaucau

SEQ ID NO: 2480468 - RNA, 24 nt, Brucella suis 1330
gcccgaugaucuguucagccgcag

SEQ ID NO: 2480469 - RNA, 20 nt, Brucella suis 1330
gcccgcacccuauuccccua

SEQ ID NO: 2480470 - RNA, 20 nt, Brucella suis 1330
gcccgcauagccaucgccga

SEQ ID NO: 2480471 - RNA, 22 nt, Brucella suis 1330
gcccgcauggucgaugccgccg

SEQ ID NO: 2480472 - RNA, 23 nt, Brucella suis 1330
gcccgcauggucgaugccgccga

SEQ ID NO: 2480473 - RNA, 14 nt, Brucella suis 1330
gcccgcccgccgca

SEQ ID NO: 2480474 - RNA, 14 nt, Brucella suis 1330
gcccgcccggcauc

SEQ ID NO: 2480475 - RNA, 11 nt, Brucella suis 1330
gcccgccgaaa

SEQ ID NO: 2480476 - RNA, 23 nt, Brucella suis 1330
gcccgccgcaagcucugucggcu

SEQ ID NO: 2480477 - RNA, 15 nt, Brucella suis 1330
gcccgccgcgacgau

SEQ ID NO: 2480478 - RNA, 13 nt, Brucella suis 1330
gcccgccggggcc

SEQ ID NO: 2480479 - RNA, 21 nt, Brucella suis 1330
gcccgccucgaccgcaacagg

SEQ ID NO: 2480480 - RNA, 14 nt, Brucella suis 1330
gcccgccuuggaaa

SEQ ID NO: 2480481 - RNA, 15 nt, Brucella suis 1330
gcccgccuuugccgc

SEQ ID NO: 2480482 - RNA, 17 nt, Brucella suis 1330
gcccgccuuugccgcaa

SEQ ID NO: 2480483 - RNA, 23 nt, Brucella suis 1330
gcccgcgccggucuccucagcua

SEQ ID NO: 2480484 - RNA, 19 nt, Brucella suis 1330
gcccgcuuuuacgcgccgc

SEQ ID NO: 2480485 - RNA, 21 nt, Brucella suis 1330
gcccggaagcgaaaugccgau

SEQ ID NO: 2480486 - RNA, 21 nt, Brucella suis 1330
gcccggaagcgcaaggcggcg

SEQ ID NO: 2480487 - RNA, 17 nt, Brucella suis 1330
gcccggauugaccgaau

SEQ ID NO: 2480488 - RNA, 22 nt, Brucella suis 1330
gcccggcauggccugcgcgcgc

SEQ ID NO: 2480489 - RNA, 16 nt, Brucella suis 1330
gcccggccuuuucggc

SEQ ID NO: 2480490 - RNA, 22 nt, Brucella suis 1330
gcccggcggugaagaagcgcca

SEQ ID NO: 2480491 - RNA, 23 nt, Brucella suis 1330
gcccggcggugaagaagcgccag

SEQ ID NO: 2480492 - RNA, 11 nt, Brucella suis 1330
gcccggcugga

SEQ ID NO: 2480493 - RNA, 13 nt, Brucella suis 1330
gcccggcuggaau

SEQ ID NO: 2480494 - RNA, 18 nt, Brucella suis 1330
gcccggucacccgcacgc

SEQ ID NO: 2480495 - RNA, 23 nt, Brucella suis 1330
gcccggucacccgcacgccgugc

SEQ ID NO: 2480496 - RNA, 13 nt, Brucella suis 1330
gcccggucggguu

SEQ ID NO: 2480497 - RNA, 17 nt, Brucella suis 1330
gcccggucucgcgaccg

SEQ ID NO: 2480498 - RNA, 13 nt, Brucella suis 1330
gcccggugcagcg

SEQ ID NO: 2480499 - RNA, 15 nt, Brucella suis 1330
gcccgucaccgcggc

SEQ ID NO: 2480500 - RNA, 23 nt, Brucella suis 1330
gcccgucacuucaaguuucggau

SEQ ID NO: 2480501 - RNA, 22 nt, Brucella suis 1330
gcccgucccccaacgugcggug

SEQ ID NO: 2480502 - RNA, 18 nt, Brucella suis 1330
gcccguccucaucgccgg

SEQ ID NO: 2480503 - RNA, 16 nt, Brucella suis 1330
gcccgucgaccagcgc

SEQ ID NO: 2480504 - RNA, 19 nt, Brucella suis 1330
gcccgucgaccagcgcaug

SEQ ID NO: 2480505 - RNA, 13 nt, Brucella suis 1330
gcccgucgcaggc

SEQ ID NO: 2480506 - RNA, 17 nt, Brucella suis 1330
gcccgucuuccuccgca

SEQ ID NO: 2480507 - RNA, 15 nt, Brucella suis 1330
gcccgugacaagugg

SEQ ID NO: 2480508 - RNA, 13 nt, Brucella suis 1330
gcccguugccgau

SEQ ID NO: 2480509 - RNA, 18 nt, Brucella suis 1330
gcccucgcgccaauagga

SEQ ID NO: 2480510 - RNA, 17 nt, Brucella suis 1330
gcccucgcggaaaagcu

SEQ ID NO: 2480511 - RNA, 13 nt, Brucella suis 1330
gcccugaaacacu

SEQ ID NO: 2480512 - RNA, 13 nt, Brucella suis 1330
gcccugaaauguc

SEQ ID NO: 2480513 - RNA, 18 nt, Brucella suis 1330
gcccugacucugaccuuc

SEQ ID NO: 2480514 - RNA, 20 nt, Brucella suis 1330
gcccugacucugaccuuccu

SEQ ID NO: 2480515 - RNA, 21 nt, Brucella suis 1330
gcccugacucugaccuuccug

SEQ ID NO: 2480516 - RNA, 22 nt, Brucella suis 1330
gcccugacucugaccuuccuga

SEQ ID NO: 2480517 - RNA, 18 nt, Brucella suis 1330
gcccugcuucacaugcuu

SEQ ID NO: 2480518 - RNA, 16 nt, Brucella suis 1330
gcccuggaaagaagcg

SEQ ID NO: 2480519 - RNA, 21 nt, Brucella suis 1330
gcccuggauaucuuccgcaag

SEQ ID NO: 2480520 - RNA, 17 nt, Brucella suis 1330
gcccuggggcaugacau

SEQ ID NO: 2480521 - RNA, 15 nt, Brucella suis 1330
gcccugucagaaagu

SEQ ID NO: 2480522 - RNA, 23 nt, Brucella suis 1330
gcccugucagaaagucugcuucc

SEQ ID NO: 2480523 - RNA, 15 nt, Brucella suis 1330
gcccuucaucaagcu

SEQ ID NO: 2480524 - RNA, 20 nt, Brucella suis 1330
gcccuuccacugcaaggaag

SEQ ID NO: 2480525 - RNA, 16 nt, Brucella suis 1330
gcccuuccgggccgca

SEQ ID NO: 2480526 - RNA, 14 nt, Brucella suis 1330
gcccuucgcagcua

SEQ ID NO: 2480527 - RNA, 18 nt, Brucella suis 1330
gcccuugagagccagauc

SEQ ID NO: 2480528 - RNA, 13 nt, Brucella suis 1330
gcccuugcgcacc

SEQ ID NO: 2480529 - RNA, 17 nt, Brucella suis 1330
gcccuuggcgcucauga

SEQ ID NO: 2480530 - RNA, 16 nt, Brucella suis 1330
gcccuuuaucagcgau

SEQ ID NO: 2480531 - RNA, 13 nt, Brucella suis 1330
gcccuuuuccgcu

SEQ ID NO: 2480532 - RNA, 16 nt, Brucella suis 1330
gcccuuuuugaagcca

SEQ ID NO: 2480533 - RNA, 13 nt, Brucella suis 1330
gccgaaaagccgc

SEQ ID NO: 2480534 - RNA, 16 nt, Brucella suis 1330
gccgaaaaucggcacu

SEQ ID NO: 2480535 - RNA, 16 nt, Brucella suis 1330
gccgaaaauggugaug

SEQ ID NO: 2480536 - RNA, 14 nt, Brucella suis 1330
gccgaacccgccga

SEQ ID NO: 2480537 - RNA, 17 nt, Brucella suis 1330
gccgaaccgggccgcau

SEQ ID NO: 2480538 - RNA, 14 nt, Brucella suis 1330
gccgaagccaggca

SEQ ID NO: 2480539 - RNA, 22 nt, Brucella suis 1330
gccgaagcugcgcgaaccagau

SEQ ID NO: 2480540 - RNA, 18 nt, Brucella suis 1330
gccgaaggaugcaagccg

SEQ ID NO: 2480541 - RNA, 20 nt, Brucella suis 1330
gccgucgggaccaccggccu

SEQ ID NO: 2480542 - RNA, 14 nt, Brucella suis 1330
gccgugaccagcgc

SEQ ID NO: 2480543 - RNA, 16 nt, Brucella suis 1330
gccgugcccgacugaa

SEQ ID NO: 2480544 - RNA, 22 nt, Brucella suis 1330
gccgugggcaagaucauccggc

SEQ ID NO: 2480545 - RNA, 18 nt, Brucella suis 1330
gccguuccucuuccucaa

SEQ ID NO: 2480546 - RNA, 19 nt, Brucella suis 1330
gccguucuuggccaugaug

SEQ ID NO: 2480547 - RNA, 15 nt, Brucella suis 1330
gccguugagcuguuu

SEQ ID NO: 2480548 - RNA, 22 nt, Brucella suis 1330
gccguuuucaucaaauuugaug

SEQ ID NO: 2480549 - RNA, 22 nt, Brucella suis 1330
gccuaccaaggcccgccucgac

SEQ ID NO: 2480550 - RNA, 15 nt, Brucella suis 1330
gccuaccccucccuc

SEQ ID NO: 2480551 - RNA, 15 nt, Brucella suis 1330
gccucaagugccgcc

SEQ ID NO: 2480552 - RNA, 21 nt, Brucella suis 1330
gccucaauggucacggccaca

SEQ ID NO: 2480553 - RNA, 16 nt, Brucella suis 1330
gccucacccuccaccg

SEQ ID NO: 2480554 - RNA, 15 nt, Brucella suis 1330
gccucauggcggcgc

SEQ ID NO: 2480555 - RNA, 17 nt, Brucella suis 1330
gccucccugcgcgcgcc

SEQ ID NO: 2480556 - RNA, 14 nt, Brucella suis 1330
gccucgcgcccggu

SEQ ID NO: 2480557 - RNA, 13 nt, Brucella suis 1330
gccucggcaucgc

SEQ ID NO: 2480558 - RNA, 22 nt, Brucella suis 1330
gccucguuugcacuuucaagcg

SEQ ID NO: 2480559 - RNA, 17 nt, Brucella suis 1330
gccucugucaccugacg

SEQ ID NO: 2480560 - RNA, 12 nt, Brucella suis 1330
gccucuuccagg

SEQ ID NO: 2480561 - RNA, 18 nt, Brucella suis 1330
gccugaaacaaggccgag

SEQ ID NO: 2480562 - RNA, 14 nt, Brucella suis 1330
gccugaaacagcau

SEQ ID NO: 2480563 - RNA, 17 nt, Brucella suis 1330
gccugaaaccgucacgc

SEQ ID NO: 2480564 - RNA, 18 nt, Brucella suis 1330
gccugaaagcugcuggcg

SEQ ID NO: 2480565 - RNA, 16 nt, Brucella suis 1330
gccugaaccggcgagc

SEQ ID NO: 2480566 - RNA, 14 nt, Brucella suis 1330
gccugaaugaaaac

SEQ ID NO: 2480567 - RNA, 16 nt, Brucella suis 1330
gccugaaugaaaacga

SEQ ID NO: 2480568 - RNA, 13 nt, Brucella suis 1330
gccugaaugcaau

SEQ ID NO: 2480569 - RNA, 21 nt, Brucella suis 1330
gccugacccggccuuugcgcc

SEQ ID NO: 2480570 - RNA, 22 nt, Brucella suis 1330
gccugaccggccacccagcccg

SEQ ID NO: 2480571 - RNA, 14 nt, Brucella suis 1330
gccugacuggcggc

SEQ ID NO: 2480572 - RNA, 22 nt, Brucella suis 1330
gccugcaacugcaaggcaucgc

SEQ ID NO: 2480573 - RNA, 21 nt, Brucella suis 1330
gccugcacaucaccauugccc

SEQ ID NO: 2480574 - RNA, 20 nt, Brucella suis 1330
gccugcaccggcccaaaggc

SEQ ID NO: 2480575 - RNA, 21 nt, Brucella suis 1330
gccugcaccggcccaaaggcc

SEQ ID NO: 2480576 - RNA, 22 nt, Brucella suis 1330
gccugcaccggcccaaaggccg

SEQ ID NO: 2480577 - RNA, 23 nt, Brucella suis 1330
gccugcagccggaagaacagcgc

SEQ ID NO: 2480578 - RNA, 13 nt, Brucella suis 1330
gccugcaugggca

SEQ ID NO: 2480579 - RNA, 13 nt, Brucella suis 1330
gccugccaugccg

SEQ ID NO: 2480580 - RNA, 13 nt, Brucella suis 1330
gccugccuucuuc

SEQ ID NO: 2480581 - RNA, 13 nt, Brucella suis 1330
gccugcgcauggg

SEQ ID NO: 2480582 - RNA, 22 nt, Brucella suis 1330
gccugcgccagcgauugcgcau

SEQ ID NO: 2480583 - RNA, 21 nt, Brucella suis 1330
gccugcgccaguuuucgcggc

SEQ ID NO: 2480584 - RNA, 23 nt, Brucella suis 1330
gccugcuacaaaaaacaacagca

SEQ ID NO: 2480585 - RNA, 16 nt, Brucella suis 1330
gccugcugcauccugc

SEQ ID NO: 2480586 - RNA, 17 nt, Brucella suis 1330
gccugcugcauccugcu

SEQ ID NO: 2480587 - RNA, 18 nt, Brucella suis 1330
gccugcugcauccugcuc

SEQ ID NO: 2480588 - RNA, 17 nt, Brucella suis 1330
gccugcugcauuuucug

SEQ ID NO: 2480589 - RNA, 16 nt, Brucella suis 1330
gccugcugccaugucu

SEQ ID NO: 2480590 - RNA, 23 nt, Brucella suis 1330
gccugcuuccuuuucggcuuccu

SEQ ID NO: 2480591 - RNA, 13 nt, Brucella suis 1330
gccuggaugacau

SEQ ID NO: 2480592 - RNA, 14 nt, Brucella suis 1330
gccuggaugacauc

SEQ ID NO: 2480593 - RNA, 12 nt, Brucella suis 1330
gccuggcccggc

SEQ ID NO: 2480594 - RNA, 15 nt, Brucella suis 1330
gccuggcccggcugu

SEQ ID NO: 2480595 - RNA, 18 nt, Brucella suis 1330
gccuggccgauuuccgcu

SEQ ID NO: 2480596 - RNA, 14 nt, Brucella suis 1330
gccugggcuuucaa

SEQ ID NO: 2480597 - RNA, 16 nt, Brucella suis 1330
gccugggugaggcugg

SEQ ID NO: 2480598 - RNA, 22 nt, Brucella suis 1330
gccugggugaggcuggcgccgc

SEQ ID NO: 2480599 - RNA, 17 nt, Brucella suis 1330
gccuggucuagccgcgc

SEQ ID NO: 2480600 - RNA, 14 nt, Brucella suis 1330
gccugguuucacag

SEQ ID NO: 2480601 - RNA, 15 nt, Brucella suis 1330
gccugguuucacagg

SEQ ID NO: 2480602 - RNA, 21 nt, Brucella suis 1330
gccugguuucacaggccgguu

SEQ ID NO: 2480603 - RNA, 13 nt, Brucella suis 1330
gccuguccgccug

SEQ ID NO: 2480604 - RNA, 15 nt, Brucella suis 1330
gccuguccgccugcc

SEQ ID NO: 2480605 - RNA, 18 nt, Brucella suis 1330
gccugugccaaugacaug

SEQ ID NO: 2480606 - RNA, 23 nt, Brucella suis 1330
gccugugcuucccggaauguauc

SEQ ID NO: 2480607 - RNA, 17 nt, Brucella suis 1330
gccuguguggcccugau

SEQ ID NO: 2480608 - RNA, 15 nt, Brucella suis 1330
gccuguuccugcaug

SEQ ID NO: 2480609 - RNA, 20 nt, Brucella suis 1330
gccuguuccuugaggccgcg

SEQ ID NO: 2480610 - RNA, 18 nt, Brucella suis 1330
gccuguucuucggccaug

SEQ ID NO: 2480611 - RNA, 18 nt, Brucella suis 1330
gccuguugcgaggaaaag

SEQ ID NO: 2480612 - RNA, 24 nt, Brucella suis 1330
gccuguuucaguuuguugaaacag

SEQ ID NO: 2480613 - RNA, 18 nt, Brucella suis 1330
gccuguuuccggguuuuu

SEQ ID NO: 2480614 - RNA, 19 nt, Brucella suis 1330
gccuuagagaccuugauga

SEQ ID NO: 2480615 - RNA, 19 nt, Brucella suis 1330
gccuuauaggcgcgcgccu

SEQ ID NO: 2480616 - RNA, 17 nt, Brucella suis 1330
gccuuaucggggcggcg

SEQ ID NO: 2480617 - RNA, 14 nt, Brucella suis 1330
gccuucaaaacgca

SEQ ID NO: 2480618 - RNA, 18 nt, Brucella suis 1330
gccuucagcacauccugc

SEQ ID NO: 2480619 - RNA, 22 nt, Brucella suis 1330
gccuucagcacauccugcaccg

SEQ ID NO: 2480620 - RNA, 17 nt, Brucella suis 1330
gccuucauucuuucaga

SEQ ID NO: 2480621 - RNA, 14 nt, Brucella suis 1330
gccuucauugcggc

SEQ ID NO: 2480622 - RNA, 16 nt, Brucella suis 1330
gccuucauugcggcca

SEQ ID NO: 2480623 - RNA, 18 nt, Brucella suis 1330
gccuucccgccagccguc

SEQ ID NO: 2480624 - RNA, 18 nt, Brucella suis 1330
gccuuccuucauacaagu

SEQ ID NO: 2480625 - RNA, 14 nt, Brucella suis 1330
gccuucgcgccagg

SEQ ID NO: 2480626 - RNA, 15 nt, Brucella suis 1330
gccuucggcaccaca

SEQ ID NO: 2480627 - RNA, 19 nt, Brucella suis 1330
gccuucggcugcuuccggc

SEQ ID NO: 2480628 - RNA, 14 nt, Brucella suis 1330
gccuugaaaccaaa

SEQ ID NO: 2480629 - RNA, 18 nt, Brucella suis 1330
gccuugacggagagaggg

SEQ ID NO: 2480630 - RNA, 22 nt, Brucella suis 1330
gccuugagaucguaggcuuucc

SEQ ID NO: 2480631 - RNA, 14 nt, Brucella suis 1330
gccuugagaugagc

SEQ ID NO: 2480632 - RNA, 19 nt, Brucella suis 1330
gccuugagggcagcgguca

SEQ ID NO: 2480633 - RNA, 12 nt, Brucella suis 1330
gccuugccaaaa

SEQ ID NO: 2480634 - RNA, 19 nt, Brucella suis 1330
gccuugccugccggucccg

SEQ ID NO: 2480635 - RNA, 17 nt, Brucella suis 1330
gccuugcgauuuccuug

SEQ ID NO: 2480636 - RNA, 12 nt, Brucella suis 1330
gccuugcgccgc

SEQ ID NO: 2480637 - RNA, 15 nt, Brucella suis 1330
gccuugcggcggcgu

SEQ ID NO: 2480638 - RNA, 12 nt, Brucella suis 1330
gccuugcuugaa

SEQ ID NO: 2480639 - RNA, 17 nt, Brucella suis 1330
gccuuggaauggcgcac

SEQ ID NO: 2480640 - RNA, 15 nt, Brucella suis 1330
gccuuggaugccgca

SEQ ID NO: 2480641 - RNA, 21 nt, Brucella suis 1330
gccuuggcuuccagcgucagg

SEQ ID NO: 2480642 - RNA, 18 nt, Brucella suis 1330
gccuuuaccgccggggcu

SEQ ID NO: 2480643 - RNA, 17 nt, Brucella suis 1330
gccuuucaggucgucuu

SEQ ID NO: 2480644 - RNA, 21 nt, Brucella suis 1330
gccuuucaggucgucuuucag

SEQ ID NO: 2480645 - RNA, 12 nt, Brucella suis 1330
gccuuugcuuca

SEQ ID NO: 2480646 - RNA, 12 nt, Brucella suis 1330
gccuuuuccagu

SEQ ID NO: 2480647 - RNA, 20 nt, Brucella suis 1330
gccuuuuggccgcucgcugc

SEQ ID NO: 2480648 - RNA, 13 nt, Brucella suis 1330
gcgaaaaccugcu

SEQ ID NO: 2480649 - RNA, 13 nt, Brucella suis 1330
gcgaaaagccgcc

SEQ ID NO: 2480650 - RNA, 15 nt, Brucella suis 1330
gcgaaaaugauagcu

SEQ ID NO: 2480651 - RNA, 18 nt, Brucella suis 1330
gcgaaaaugauagcugca

SEQ ID NO: 2480652 - RNA, 17 nt, Brucella suis 1330
gcgaaaccauggagcgc

SEQ ID NO: 2480653 - RNA, 21 nt, Brucella suis 1330
gcgaaaccggaacgccuaagg

SEQ ID NO: 2480654 - RNA, 19 nt, Brucella suis 1330
gcgaaacggagaaaacgcc

SEQ ID NO: 2480655 - RNA, 12 nt, Brucella suis 1330
gcgaaagcaccc

SEQ ID NO: 2480656 - RNA, 16 nt, Brucella suis 1330
gcgaaagcacccgcuu

SEQ ID NO: 2480657 - RNA, 13 nt, Brucella suis 1330
gcgaaagcgauga

SEQ ID NO: 2480658 - RNA, 20 nt, Brucella suis 1330
gcgcaucgacaaucuccccu

SEQ ID NO: 2480659 - RNA, 14 nt, Brucella suis 1330
gcgcaucgccaccg

SEQ ID NO: 2480660 - RNA, 17 nt, Brucella suis 1330
gcgcaucggccagcuga

SEQ ID NO: 2480661 - RNA, 19 nt, Brucella suis 1330
gcgcaucgggcgcacaagc

SEQ ID NO: 2480662 - RNA, 14 nt, Brucella suis 1330
gcgcaucuuuuccg

SEQ ID NO: 2480663 - RNA, 14 nt, Brucella suis 1330
gcgcauggcagcaa

SEQ ID NO: 2480664 - RNA, 20 nt, Brucella suis 1330
gcgcauggguggugcccggu

SEQ ID NO: 2480665 - RNA, 17 nt, Brucella suis 1330
gcgcauucaggcggccu

SEQ ID NO: 2480666 - RNA, 22 nt, Brucella suis 1330
gcgcauucgggucacccggcgc

SEQ ID NO: 2480667 - RNA, 12 nt, Brucella suis 1330
gcgcauuuuccg

SEQ ID NO: 2480668 - RNA, 14 nt, Brucella suis 1330
gcgccaaggcugcg

SEQ ID NO: 2480669 - RNA, 16 nt, Brucella suis 1330
gcgccaauccagguca

SEQ ID NO: 2480670 - RNA, 18 nt, Brucella suis 1330
gcgccagacaaggcgcgg

SEQ ID NO: 2480671 - RNA, 19 nt, Brucella suis 1330
gcgccagaucaugggcggc

SEQ ID NO: 2480672 - RNA, 15 nt, Brucella suis 1330
gcgccagaugcgcaa

SEQ ID NO: 2480673 - RNA, 15 nt, Brucella suis 1330
gcgccagcacucugc

SEQ ID NO: 2480674 - RNA, 18 nt, Brucella suis 1330
gcgccagccgccagcagg

SEQ ID NO: 2480675 - RNA, 12 nt, Brucella suis 1330
gcgccagcgcgg

SEQ ID NO: 2480676 - RNA, 20 nt, Brucella suis 1330
gcgccagucauugacggcag

SEQ ID NO: 2480677 - RNA, 23 nt, Brucella suis 1330
gcgccagucauugacggcagccu

SEQ ID NO: 2480678 - RNA, 15 nt, Brucella suis 1330
gcgccagugcgccac

SEQ ID NO: 2480679 - RNA, 22 nt, Brucella suis 1330
gcgccauaaccucgacggcggc

SEQ ID NO: 2480680 - RNA, 15 nt, Brucella suis 1330
gcgccaugccauccu

SEQ ID NO: 2480681 - RNA, 23 nt, Brucella suis 1330
gcgccaugccauccucgccaagc

SEQ ID NO: 2480682 - RNA, 18 nt, Brucella suis 1330
gcgcccacgugagagguc

SEQ ID NO: 2480683 - RNA, 13 nt, Brucella suis 1330
gcgcccaggcgcc

SEQ ID NO: 2480684 - RNA, 14 nt, Brucella suis 1330
gcgcccaggcgccc

SEQ ID NO: 2480685 - RNA, 15 nt, Brucella suis 1330
gcgcccgcccgccgc

SEQ ID NO: 2480686 - RNA, 20 nt, Brucella suis 1330
gcgcccgucaccggcuggca

SEQ ID NO: 2480687 - RNA, 14 nt, Brucella suis 1330
gcgcccuccaccgc

SEQ ID NO: 2480688 - RNA, 14 nt, Brucella suis 1330
gcgcccucgcgcuc

SEQ ID NO: 2480689 - RNA, 21 nt, Brucella suis 1330
gcgcccuugccggauaucgcc

SEQ ID NO: 2480690 - RNA, 16 nt, Brucella suis 1330
gcgccgaaaaucggca

SEQ ID NO: 2480691 - RNA, 14 nt, Brucella suis 1330
gcgccgaacagcgc

SEQ ID NO: 2480692 - RNA, 16 nt, Brucella suis 1330
gcgccgaaccgggccg

SEQ ID NO: 2480693 - RNA, 14 nt, Brucella suis 1330
gcgccgauaccaag

SEQ ID NO: 2480694 - RNA, 16 nt, Brucella suis 1330
gcgccgauaccaaggc

SEQ ID NO: 2480695 - RNA, 17 nt, Brucella suis 1330
gcgccgaucacgaccuu

SEQ ID NO: 2480696 - RNA, 14 nt, Brucella suis 1330
gcgccgaugaggcc

SEQ ID NO: 2480697 - RNA, 15 nt, Brucella suis 1330
gcgccgcacgcgcga

SEQ ID NO: 2480698 - RNA, 20 nt, Brucella suis 1330
gcgccgcacgcgcgaaacca

SEQ ID NO: 2480699 - RNA, 14 nt, Brucella suis 1330
gcgccgcauggcgg

SEQ ID NO: 2480700 - RNA, 18 nt, Brucella suis 1330
gcgccgccaagggccgcc

SEQ ID NO: 2480701 - RNA, 13 nt, Brucella suis 1330
gcgccgccauggc

SEQ ID NO: 2480702 - RNA, 12 nt, Brucella suis 1330
gcgccgcuggug

SEQ ID NO: 2480703 - RNA, 17 nt, Brucella suis 1330
gcgccgcuugccagcac

SEQ ID NO: 2480704 - RNA, 14 nt, Brucella suis 1330
gcgccggaaacacc

SEQ ID NO: 2480705 - RNA, 21 nt, Brucella suis 1330
gcgccggaagauggagcggcu

SEQ ID NO: 2480706 - RNA, 16 nt, Brucella suis 1330
gcgccggaaugggccu

SEQ ID NO: 2480707 - RNA, 17 nt, Brucella suis 1330
gcgccggaaugggccug

SEQ ID NO: 2480708 - RNA, 18 nt, Brucella suis 1330
gcgccggaaugggccuga

SEQ ID NO: 2480709 - RNA, 21 nt, Brucella suis 1330
gcgccggggccaaaggcggcu

SEQ ID NO: 2480710 - RNA, 17 nt, Brucella suis 1330
gcgccggucuccucagc

SEQ ID NO: 2480711 - RNA, 19 nt, Brucella suis 1330
gcgccguaauggcgcggcu

SEQ ID NO: 2480712 - RNA, 15 nt, Brucella suis 1330
gcgccgucgccgacc

SEQ ID NO: 2480713 - RNA, 23 nt, Brucella suis 1330
gcgccguuuucgugugcuugccg

SEQ ID NO: 2480714 - RNA, 20 nt, Brucella suis 1330
gcgccuacgcggggaaauca

SEQ ID NO: 2480715 - RNA, 13 nt, Brucella suis 1330
gcgccuggcgcug

SEQ ID NO: 2480716 - RNA, 15 nt, Brucella suis 1330
gcgccugggcuuuca

SEQ ID NO: 2480717 - RNA, 15 nt, Brucella suis 1330
gcgccuguccgccug

SEQ ID NO: 2480718 - RNA, 19 nt, Brucella suis 1330
gcgccuucauucuuucaga

SEQ ID NO: 2480719 - RNA, 21 nt, Brucella suis 1330
gcgccuuggacaccucgccga

SEQ ID NO: 2480720 - RNA, 23 nt, Brucella suis 1330
gcgccuuuucuucauccaguucg

SEQ ID NO: 2480721 - RNA, 22 nt, Brucella suis 1330
gcgcgaacaugccugccgcagc

SEQ ID NO: 2480722 - RNA, 23 nt, Brucella suis 1330
gcgcgaacaugccugccgcagcc

SEQ ID NO: 2480723 - RNA, 15 nt, Brucella suis 1330
gcgcgaccugcucga

SEQ ID NO: 2480724 - RNA, 14 nt, Brucella suis 1330
gcgcgacgaucagg

SEQ ID NO: 2480725 - RNA, 14 nt, Brucella suis 1330
gcgcgaggcggcug

SEQ ID NO: 2480726 - RNA, 19 nt, Brucella suis 1330
gcgcgauggcguugcggcg

SEQ ID NO: 2480727 - RNA, 21 nt, Brucella suis 1330
gcgcgcaaaccaggaccgcga

SEQ ID NO: 2480728 - RNA, 20 nt, Brucella suis 1330
gcgcgcauuucauggcgguc

SEQ ID NO: 2480729 - RNA, 15 nt, Brucella suis 1330
gcgcgcccggcggcu

SEQ ID NO: 2480730 - RNA, 19 nt, Brucella suis 1330
gcgcgcccgucaccggcug

SEQ ID NO: 2480731 - RNA, 17 nt, Brucella suis 1330
gcgcgcccugcagggcg

SEQ ID NO: 2480732 - RNA, 15 nt, Brucella suis 1330
gcgcgccgaaaaucg

SEQ ID NO: 2480733 - RNA, 14 nt, Brucella suis 1330
gcgcgccgaugggc

SEQ ID NO: 2480734 - RNA, 14 nt, Brucella suis 1330
gcgcgcgccgccau

SEQ ID NO: 2480735 - RNA, 12 nt, Brucella suis 1330
gcgcgcgcggcu

SEQ ID NO: 2480736 - RNA, 17 nt, Brucella suis 1330
gcgcgcgugagcgcgca

SEQ ID NO: 2480737 - RNA, 16 nt, Brucella suis 1330
gcgcgcuaugcguggu

SEQ ID NO: 2480738 - RNA, 19 nt, Brucella suis 1330
gcgcggaucguacggcccu

SEQ ID NO: 2480739 - RNA, 14 nt, Brucella suis 1330
gcgcggcgcauggc

SEQ ID NO: 2480740 - RNA, 14 nt, Brucella suis 1330
gcgcggcgcuucau

SEQ ID NO: 2480741 - RNA, 16 nt, Brucella suis 1330
gcgcggcggcaacggg

SEQ ID NO: 2480742 - RNA, 22 nt, Brucella suis 1330
gcgcgggcuuuccagcccccuu

SEQ ID NO: 2480743 - RNA, 16 nt, Brucella suis 1330
gcgcggugcugcaccg

SEQ ID NO: 2480744 - RNA, 18 nt, Brucella suis 1330
gcgcguaucgacaccgcc

SEQ ID NO: 2480745 - RNA, 14 nt, Brucella suis 1330
gcgcgugagcgcgc

SEQ ID NO: 2480746 - RNA, 23 nt, Brucella suis 1330
gcgcguuuuuauuugaacaaaga

SEQ ID NO: 2480747 - RNA, 16 nt, Brucella suis 1330
gcgcuaaaaagcgcgc

SEQ ID NO: 2480748 - RNA, 16 nt, Brucella suis 1330
gcgcuagcgaugauga

SEQ ID NO: 2480749 - RNA, 13 nt, Brucella suis 1330
gcgcuccaugcgg

SEQ ID NO: 2480750 - RNA, 20 nt, Brucella suis 1330
gcgcucgaccgcaccucugg

SEQ ID NO: 2480751 - RNA, 17 nt, Brucella suis 1330
gcgcucggugccgcgcg

SEQ ID NO: 2480752 - RNA, 22 nt, Brucella suis 1330
gcgcucgucgccucauggcggc

SEQ ID NO: 2480753 - RNA, 18 nt, Brucella suis 1330
gcgcucuaaccauuuguu

SEQ ID NO: 2480754 - RNA, 19 nt, Brucella suis 1330
gcgcucuaaccauuuguuu

SEQ ID NO: 2480755 - RNA, 16 nt, Brucella suis 1330
gcgcugaagcggccua

SEQ ID NO: 2480756 - RNA, 21 nt, Brucella suis 1330
gcgcugaugugucgaaaacuc

SEQ ID NO: 2480757 - RNA, 16 nt, Brucella suis 1330
gcgcugauugggcggc

SEQ ID NO: 2480758 - RNA, 17 nt, Brucella suis 1330
gcgcugcgaaggcccuu

SEQ ID NO: 2480759 - RNA, 15 nt, Brucella suis 1330
gcgcugucgccuguu

SEQ ID NO: 2480760 - RNA, 23 nt, Brucella suis 1330
gcgcuuaugugaagauuucuugc

SEQ ID NO: 2480761 - RNA, 14 nt, Brucella suis 1330
gcgcuugccgccgg

SEQ ID NO: 2480762 - RNA, 12 nt, Brucella suis 1330
gcgcuugcgacc

SEQ ID NO: 2480763 - RNA, 20 nt, Brucella suis 1330
gcgcuuggcaaaaggcgcaa

SEQ ID NO: 2480764 - RNA, 13 nt, Brucella suis 1330
gcgcuuuccccgg

SEQ ID NO: 2480765 - RNA, 17 nt, Brucella suis 1330
gcgcuuugcaagcggca

SEQ ID NO: 2480766 - RNA, 16 nt, Brucella suis 1330
gcggaaaacggcugca

SEQ ID NO: 2480767 - RNA, 22 nt, Brucella suis 1330
gcggaaaauguuccgcaccgca

SEQ ID NO: 2480768 - RNA, 19 nt, Brucella suis 1330
gcggaaaccaguggccuuc

SEQ ID NO: 2480769 - RNA, 14 nt, Brucella suis 1330
gcggaaacccgacc

SEQ ID NO: 2480770 - RNA, 22 nt, Brucella suis 1330
gcggaaacgauuguuuucggca

SEQ ID NO: 2480771 - RNA, 17 nt, Brucella suis 1330
gcggaacacgccgccau

SEQ ID NO: 2480772 - RNA, 18 nt, Brucella suis 1330
gcggaacccacgcacggu

SEQ ID NO: 2480773 - RNA, 16 nt, Brucella suis 1330
gcggaagcgaggggaa

SEQ ID NO: 2480774 - RNA, 19 nt, Brucella suis 1330
gcggaauucauccgccuug

SEQ ID NO: 2480775 - RNA, 15 nt, Brucella suis 1330
gcguccauccggcgg

SEQ ID NO: 2480776 - RNA, 16 nt, Brucella suis 1330
gcguccauccggcggc

SEQ ID NO: 2480777 - RNA, 16 nt, Brucella suis 1330
gcgucccgcacgcagg

SEQ ID NO: 2480778 - RNA, 21 nt, Brucella suis 1330
gcguccgacaugggccgggcg

SEQ ID NO: 2480779 - RNA, 16 nt, Brucella suis 1330
gcguccgagcggcagc

SEQ ID NO: 2480780 - RNA, 13 nt, Brucella suis 1330
gcgucgcaccgga

SEQ ID NO: 2480781 - RNA, 19 nt, Brucella suis 1330
gcgucugccggagcgacca

SEQ ID NO: 2480782 - RNA, 17 nt, Brucella suis 1330
gcgucuucugagaaaaa

SEQ ID NO: 2480783 - RNA, 12 nt, Brucella suis 1330
gcgugaccagcc

SEQ ID NO: 2480784 - RNA, 23 nt, Brucella suis 1330
gcgugauaggcgacacggccgau

SEQ ID NO: 2480785 - RNA, 14 nt, Brucella suis 1330
gcgugaugagccgc

SEQ ID NO: 2480786 - RNA, 15 nt, Brucella suis 1330
gcgugaugcgcaggc

SEQ ID NO: 2480787 - RNA, 18 nt, Brucella suis 1330
gcgugaugcgcaggcgcu

SEQ ID NO: 2480788 - RNA, 20 nt, Brucella suis 1330
gcgugaugcgcaggcgcucg

SEQ ID NO: 2480789 - RNA, 16 nt, Brucella suis 1330
gcgugcaggcugccca

SEQ ID NO: 2480790 - RNA, 22 nt, Brucella suis 1330
gcgugccagcauugcgccguug

SEQ ID NO: 2480791 - RNA, 14 nt, Brucella suis 1330
gcgugcggucgccg

SEQ ID NO: 2480792 - RNA, 15 nt, Brucella suis 1330
gcguggucauggcca

SEQ ID NO: 2480793 - RNA, 22 nt, Brucella suis 1330
gcgugguccagccagccgaaau

SEQ ID NO: 2480794 - RNA, 22 nt, Brucella suis 1330
gcguggugagcuugcgcagcgc

SEQ ID NO: 2480795 - RNA, 14 nt, Brucella suis 1330
gcguguagccgcga

SEQ ID NO: 2480796 - RNA, 20 nt, Brucella suis 1330
gcguguuugcggccuuugcg

SEQ ID NO: 2480797 - RNA, 13 nt, Brucella suis 1330
gcguucacauuga

SEQ ID NO: 2480798 - RNA, 16 nt, Brucella suis 1330
gcguucagccaccgac

SEQ ID NO: 2480799 - RNA, 20 nt, Brucella suis 1330
gcguucgucaaugcgcgccc

SEQ ID NO: 2480800 - RNA, 18 nt, Brucella suis 1330
gcguucugaaaccgcagg

SEQ ID NO: 2480801 - RNA, 21 nt, Brucella suis 1330
gcguucugaaaccgcaggcgu

SEQ ID NO: 2480802 - RNA, 19 nt, Brucella suis 1330
gcguugcaagauccucgcc

SEQ ID NO: 2480803 - RNA, 16 nt, Brucella suis 1330
gcguugcggccgggcc

SEQ ID NO: 2480804 - RNA, 13 nt, Brucella suis 1330
gcguugcuggaac

SEQ ID NO: 2480805 - RNA, 21 nt, Brucella suis 1330
gcguuggaaaaugcgacaaaa

SEQ ID NO: 2480806 - RNA, 17 nt, Brucella suis 1330
gcguuggccgcggccgg

SEQ ID NO: 2480807 - RNA, 13 nt, Brucella suis 1330
gcguuuuccauga

SEQ ID NO: 2480808 - RNA, 13 nt, Brucella suis 1330
gcuaaaaagcgcg

SEQ ID NO: 2480809 - RNA, 18 nt, Brucella suis 1330
gcuacccauucauuucaa

SEQ ID NO: 2480810 - RNA, 15 nt, Brucella suis 1330
gcuacgauuuucgug

SEQ ID NO: 2480811 - RNA, 11 nt, Brucella suis 1330
gcuacugacaa

SEQ ID NO: 2480812 - RNA, 21 nt, Brucella suis 1330
gcuacugacaaaccucgggca

SEQ ID NO: 2480813 - RNA, 19 nt, Brucella suis 1330
gcuaucaacgcugcaacaa

SEQ ID NO: 2480814 - RNA, 18 nt, Brucella suis 1330
gcuaucacccgauaaacc

SEQ ID NO: 2480815 - RNA, 20 nt, Brucella suis 1330
gcuaucacguuggggcgccg

SEQ ID NO: 2480816 - RNA, 17 nt, Brucella suis 1330
gcuaucgcugcuuuacc

SEQ ID NO: 2480817 - RNA, 17 nt, Brucella suis 1330
gcuaugcgcaauugcgc

SEQ ID NO: 2480818 - RNA, 22 nt, Brucella suis 1330
gcuaugcgcaauugcgcgccug

SEQ ID NO: 2480819 - RNA, 18 nt, Brucella suis 1330
gcuaugcgguuucagcgc

SEQ ID NO: 2480820 - RNA, 19 nt, Brucella suis 1330
gcuaugcgguuucagcgcc

SEQ ID NO: 2480821 - RNA, 22 nt, Brucella suis 1330
gcuaugcucuugcggcuugaaa

SEQ ID NO: 2480822 - RNA, 21 nt, Brucella suis 1330
gcuauuugaguuuuucuucca

SEQ ID NO: 2480823 - RNA, 18 nt, Brucella suis 1330
gcucaagcuccagcgugc

SEQ ID NO: 2480824 - RNA, 13 nt, Brucella suis 1330
gcucaaggccugu

SEQ ID NO: 2480825 - RNA, 17 nt, Brucella suis 1330
gcucaauacuggguuga

SEQ ID NO: 2480826 - RNA, 13 nt, Brucella suis 1330
gcucaaucgccgc

SEQ ID NO: 2480827 - RNA, 15 nt, Brucella suis 1330
gcucaaugccgcauu

SEQ ID NO: 2480828 - RNA, 15 nt, Brucella suis 1330
gcucaccaaaaggcg

SEQ ID NO: 2480829 - RNA, 22 nt, Brucella suis 1330
gcucaccacauaggugcgcgga

SEQ ID NO: 2480830 - RNA, 21 nt, Brucella suis 1330
gcucaccuuuuccaccggccc

SEQ ID NO: 2480831 - RNA, 21 nt, Brucella suis 1330
gcucaggcugaguuuuccgcu

SEQ ID NO: 2480832 - RNA, 18 nt, Brucella suis 1330
gcucauauggaugccgcc

SEQ ID NO: 2480833 - RNA, 12 nt, Brucella suis 1330
gcucauccucca

SEQ ID NO: 2480834 - RNA, 13 nt, Brucella suis 1330
gcucaugcgggug

SEQ ID NO: 2480835 - RNA, 13 nt, Brucella suis 1330
gcucauggucacg

SEQ ID NO: 2480836 - RNA, 23 nt, Brucella suis 1330
gcucauucuguaaacugccgcgu

SEQ ID NO: 2480837 - RNA, 18 nt, Brucella suis 1330
gcuccacacgaacagcag

SEQ ID NO: 2480838 - RNA, 19 nt, Brucella suis 1330
gcuccacacgaacagcagc

SEQ ID NO: 2480839 - RNA, 21 nt, Brucella suis 1330
gcuccacauccacccgcgaca

SEQ ID NO: 2480840 - RNA, 22 nt, Brucella suis 1330
gcuccaccaccccuuccuugcc

SEQ ID NO: 2480841 - RNA, 21 nt, Brucella suis 1330
gcuccagaucgugaucuucgg

SEQ ID NO: 2480842 - RNA, 14 nt, Brucella suis 1330
gcuccagauugcgg

SEQ ID NO: 2480843 - RNA, 18 nt, Brucella suis 1330
gcuccagauugcgggcaa

SEQ ID NO: 2480844 - RNA, 20 nt, Brucella suis 1330
gcuccagauugcgggcaagc

SEQ ID NO: 2480845 - RNA, 22 nt, Brucella suis 1330
gcuccagauugcgggcaagcau

SEQ ID NO: 2480846 - RNA, 18 nt, Brucella suis 1330
gcuccagcccuuuccuga

SEQ ID NO: 2480847 - RNA, 20 nt, Brucella suis 1330
gcuccagccgagcgccagau

SEQ ID NO: 2480848 - RNA, 10 nt, Brucella suis 1330
gcuccagcuc

SEQ ID NO: 2480849 - RNA, 22 nt, Brucella suis 1330
gcuccagggugccgucgcgcuc

SEQ ID NO: 2480850 - RNA, 17 nt, Brucella suis 1330
gcuccagucgaggcagc

SEQ ID NO: 2480851 - RNA, 19 nt, Brucella suis 1330
gcucccgaaggauuuucca

SEQ ID NO: 2480852 - RNA, 13 nt, Brucella suis 1330
gcucccgccugca

SEQ ID NO: 2480853 - RNA, 14 nt, Brucella suis 1330
gcuccgccacuucg

SEQ ID NO: 2480854 - RNA, 16 nt, Brucella suis 1330
gcuccgcccuggcggc

SEQ ID NO: 2480855 - RNA, 15 nt, Brucella suis 1330
gcuccugcaugugcg

SEQ ID NO: 2480856 - RNA, 22 nt, Brucella suis 1330
gcuccugcgucgcauccagaac

SEQ ID NO: 2480857 - RNA, 16 nt, Brucella suis 1330
gcuccugguucaucag

SEQ ID NO: 2480858 - RNA, 18 nt, Brucella suis 1330
gcuccuuaaccuuuuucc

SEQ ID NO: 2480859 - RNA, 12 nt, Brucella suis 1330
gcucgaaaaugc

SEQ ID NO: 2480860 - RNA, 23 nt, Brucella suis 1330
gcucgaaaaugcucuaggaaaac

SEQ ID NO: 2480861 - RNA, 22 nt, Brucella suis 1330
gcucgaaugccucgaucuggcg

SEQ ID NO: 2480862 - RNA, 21 nt, Brucella suis 1330
gcucgacgcuuuccaccggcu

SEQ ID NO: 2480863 - RNA, 15 nt, Brucella suis 1330
gcucgcccagaaaca

SEQ ID NO: 2480864 - RNA, 19 nt, Brucella suis 1330
gcucggcgaugaagcgggc

SEQ ID NO: 2480865 - RNA, 22 nt, Brucella suis 1330
gcucggcgcggcguucggcaag

SEQ ID NO: 2480866 - RNA, 21 nt, Brucella suis 1330
gcucggcggcgguaccgaaga

SEQ ID NO: 2480867 - RNA, 19 nt, Brucella suis 1330
gcucguccaugagcgcacc

SEQ ID NO: 2480868 - RNA, 19 nt, Brucella suis 1330
gcucguccggccagccgac

SEQ ID NO: 2480869 - RNA, 22 nt, Brucella suis 1330
gcucgucgccucauggcggcgc

SEQ ID NO: 2480870 - RNA, 20 nt, Brucella suis 1330
gcucuaauuuuaugcuggca

SEQ ID NO: 2480871 - RNA, 16 nt, Brucella suis 1330
gcucuaguugcgcuga

SEQ ID NO: 2480872 - RNA, 17 nt, Brucella suis 1330
gcucuauacgaugcaga

SEQ ID NO: 2480873 - RNA, 14 nt, Brucella suis 1330
gcucuauccagcug

SEQ ID NO: 2480874 - RNA, 23 nt, Brucella suis 1330
gcucuaucguuguugaagagccu

SEQ ID NO: 2480875 - RNA, 14 nt, Brucella suis 1330
gcucuauuucggcg

SEQ ID NO: 2480876 - RNA, 18 nt, Brucella suis 1330
gcucucacgcgcagcagc

SEQ ID NO: 2480877 - RNA, 22 nt, Brucella suis 1330
gcucuccggcaaaacggcaggc

SEQ ID NO: 2480878 - RNA, 19 nt, Brucella suis 1330
gcucucgcauugagcgccc

SEQ ID NO: 2480879 - RNA, 17 nt, Brucella suis 1330
gcucuuaaaaugccgcc

SEQ ID NO: 2480880 - RNA, 19 nt, Brucella suis 1330
gcucuuaaaaugccgccca

SEQ ID NO: 2480881 - RNA, 18 nt, Brucella suis 1330
gcucuucggggcggccuu

SEQ ID NO: 2480882 - RNA, 21 nt, Brucella suis 1330
gcugaaacgagacaaggcaau

SEQ ID NO: 2480883 - RNA, 13 nt, Brucella suis 1330
gcugaacauggcu

SEQ ID NO: 2480884 - RNA, 18 nt, Brucella suis 1330
gcugaagcggccuaccau

SEQ ID NO: 2480885 - RNA, 16 nt, Brucella suis 1330
gcugagcagauaggcg

SEQ ID NO: 2480886 - RNA, 22 nt, Brucella suis 1330
gcugagcagauaggcguugaug

SEQ ID NO: 2480887 - RNA, 20 nt, Brucella suis 1330
gcugaggcggccggagcgca

SEQ ID NO: 2480888 - RNA, 22 nt, Brucella suis 1330
gcugagggaaacacucugccug

SEQ ID NO: 2480889 - RNA, 15 nt, Brucella suis 1330
gcugaucggcgcagg

SEQ ID NO: 2480890 - RNA, 18 nt, Brucella suis 1330
gcugaucggcgcaggggc

SEQ ID NO: 2480891 - RNA, 17 nt, Brucella suis 1330
ggaaaaaauccgcaaug

SEQ ID NO: 2480892 - RNA, 14 nt, Brucella suis 1330
ggaaaaacccggcc

SEQ ID NO: 2480893 - RNA, 23 nt, Brucella suis 1330
ggaaaagcucgcgucccgcacgc

SEQ ID NO: 2480894 - RNA, 15 nt, Brucella suis 1330
ggaaacacucugccu

SEQ ID NO: 2480895 - RNA, 12 nt, Brucella suis 1330
ggaaacggccag

SEQ ID NO: 2480896 - RNA, 20 nt, Brucella suis 1330
ggaaacggcgcaucauccug

SEQ ID NO: 2480897 - RNA, 15 nt, Brucella suis 1330
ggaaacucucacagc

SEQ ID NO: 2480898 - RNA, 20 nt, Brucella suis 1330
ggaaaggucuuccgggacaa

SEQ ID NO: 2480899 - RNA, 17 nt, Brucella suis 1330
ggaaagguguccuccag

SEQ ID NO: 2480900 - RNA, 23 nt, Brucella suis 1330
ggaaauaucgccgacgauuucuu

SEQ ID NO: 2480901 - RNA, 16 nt, Brucella suis 1330
ggaaaucaguccacug

SEQ ID NO: 2480902 - RNA, 16 nt, Brucella suis 1330
ggaaauuuaucgucac

SEQ ID NO: 2480903 - RNA, 20 nt, Brucella suis 1330
ggaacaauuccagccgggcu

SEQ ID NO: 2480904 - RNA, 15 nt, Brucella suis 1330
ggaacaggcccagca

SEQ ID NO: 2480905 - RNA, 19 nt, Brucella suis 1330
ggaacauauaaagcaaagg

SEQ ID NO: 2480906 - RNA, 22 nt, Brucella suis 1330
ggaacauauaaagcaaaggccc

SEQ ID NO: 2480907 - RNA, 23 nt, Brucella suis 1330
ggaaccagcgugcagccugaaca

SEQ ID NO: 2480908 - RNA, 21 nt, Brucella suis 1330
ggaaccggcugucccugcggg

SEQ ID NO: 2480909 - RNA, 16 nt, Brucella suis 1330
ggaacgcaucgagcug

SEQ ID NO: 2480910 - RNA, 24 nt, Brucella suis 1330
ggaagaucauaaaccgaaaggcgu

SEQ ID NO: 2480911 - RNA, 19 nt, Brucella suis 1330
ggaagauccccagccagaa

SEQ ID NO: 2480912 - RNA, 21 nt, Brucella suis 1330
ggaagauccccagccagaacc

SEQ ID NO: 2480913 - RNA, 18 nt, Brucella suis 1330
ggaagcgcaaaacagcgc

SEQ ID NO: 2480914 - RNA, 14 nt, Brucella suis 1330
ggaagcgcgcguga

SEQ ID NO: 2480915 - RNA, 22 nt, Brucella suis 1330
ggaaggaaagccguuucgauca

SEQ ID NO: 2480916 - RNA, 15 nt, Brucella suis 1330
ggaaggcgagcaggc

SEQ ID NO: 2480917 - RNA, 21 nt, Brucella suis 1330
ggaauagaccaucgaaagccc

SEQ ID NO: 2480918 - RNA, 14 nt, Brucella suis 1330
ggaaucagaccacu

SEQ ID NO: 2480919 - RNA, 21 nt, Brucella suis 1330
ggaaucuaagcggaaaacggc

SEQ ID NO: 2480920 - RNA, 19 nt, Brucella suis 1330
ggaaugcgcuugcccgcau

SEQ ID NO: 2480921 - RNA, 19 nt, Brucella suis 1330
ggaauggucuggguuucgu

SEQ ID NO: 2480922 - RNA, 23 nt, Brucella suis 1330
ggaauuucuaaaaugaaaagccc

SEQ ID NO: 2480923 - RNA, 18 nt, Brucella suis 1330
ggacauaaaccgaugacg

SEQ ID NO: 2480924 - RNA, 19 nt, Brucella suis 1330
ggaccaccggccugagcca

SEQ ID NO: 2480925 - RNA, 19 nt, Brucella suis 1330
ggaccacgcagggucgcga

SEQ ID NO: 2480926 - RNA, 21 nt, Brucella suis 1330
ggaccauauccaucugcuccu

SEQ ID NO: 2480927 - RNA, 17 nt, Brucella suis 1330
ggaccauuucgggcgcg

SEQ ID NO: 2480928 - RNA, 18 nt, Brucella suis 1330
ggaccggcgaaaaggcga

SEQ ID NO: 2480929 - RNA, 14 nt, Brucella suis 1330
ggacgaccauggcg

SEQ ID NO: 2480930 - RNA, 17 nt, Brucella suis 1330
ggacgaucuggaaggcc

SEQ ID NO: 2480931 - RNA, 13 nt, Brucella suis 1330
ggacgcagccuuu

SEQ ID NO: 2480932 - RNA, 16 nt, Brucella suis 1330
ggacgguugcugaggg

SEQ ID NO: 2480933 - RNA, 20 nt, Brucella suis 1330
ggacuucuucaccagccuug

SEQ ID NO: 2480934 - RNA, 14 nt, Brucella suis 1330
ggagaaaagauggg

SEQ ID NO: 2480935 - RNA, 16 nt, Brucella suis 1330
ggagacuguuccgccc

SEQ ID NO: 2480936 - RNA, 15 nt, Brucella suis 1330
ggagauacgcuucau

SEQ ID NO: 2480937 - RNA, 14 nt, Brucella suis 1330
ggagccgaagcgca

SEQ ID NO: 2480938 - RNA, 16 nt, Brucella suis 1330
ggagccgccguaaugg

SEQ ID NO: 2480939 - RNA, 13 nt, Brucella suis 1330
ggagccggaaaau

SEQ ID NO: 2480940 - RNA, 22 nt, Brucella suis 1330
ggagccucaucggcgggccagg

SEQ ID NO: 2480941 - RNA, 19 nt, Brucella suis 1330
ggagcgcguuuugaucuga

SEQ ID NO: 2480942 - RNA, 13 nt, Brucella suis 1330
ggagcggaaaggc

SEQ ID NO: 2480943 - RNA, 22 nt, Brucella suis 1330
ggagcguccgagcggcagcggc

SEQ ID NO: 2480944 - RNA, 22 nt, Brucella suis 1330
ggaggagagcaugaucgcccgc

SEQ ID NO: 2480945 - RNA, 16 nt, Brucella suis 1330
ggauaaagccuguccu

SEQ ID NO: 2480946 - RNA, 20 nt, Brucella suis 1330
ggauaacgcgacaaaacaaa

SEQ ID NO: 2480947 - RNA, 15 nt, Brucella suis 1330
ggauaaugcgacaaa

SEQ ID NO: 2480948 - RNA, 17 nt, Brucella suis 1330
ggauacgucacccgccu

SEQ ID NO: 2480949 - RNA, 18 nt, Brucella suis 1330
ggauagagaacauauccu

SEQ ID NO: 2480950 - RNA, 19 nt, Brucella suis 1330
ggauagcguaaaacgcacc

SEQ ID NO: 2480951 - RNA, 13 nt, Brucella suis 1330
ggauaucgccaga

SEQ ID NO: 2480952 - RNA, 15 nt, Brucella suis 1330
ggaucagaagugcug

SEQ ID NO: 2480953 - RNA, 15 nt, Brucella suis 1330
ggaucagucgacaau

SEQ ID NO: 2480954 - RNA, 13 nt, Brucella suis 1330
ggaucauauuugc

SEQ ID NO: 2480955 - RNA, 14 nt, Brucella suis 1330
ggaucgaaaggcuc

SEQ ID NO: 2480956 - RNA, 22 nt, Brucella suis 1330
ggaucgaggccgaacgaggcga

SEQ ID NO: 2480957 - RNA, 13 nt, Brucella suis 1330
ggaucggcagcag

SEQ ID NO: 2480958 - RNA, 17 nt, Brucella suis 1330
ggaucggcagcgaaccg

SEQ ID NO: 2480959 - RNA, 22 nt, Brucella suis 1330
ggaugaucgguacggaaagggc

SEQ ID NO: 2480960 - RNA, 21 nt, Brucella suis 1330
ggaugcccuucguguccggcg

SEQ ID NO: 2480961 - RNA, 20 nt, Brucella suis 1330
ggaugcgcucuaugcagcau

SEQ ID NO: 2480962 - RNA, 21 nt, Brucella suis 1330
ggaugcgcuuuaaagcaggau

SEQ ID NO: 2480963 - RNA, 20 nt, Brucella suis 1330
ggauggaauaucgcucauau

SEQ ID NO: 2480964 - RNA, 18 nt, Brucella suis 1330
ggauucgaaccucugacc

SEQ ID NO: 2480965 - RNA, 19 nt, Brucella suis 1330
ggauugccgccaugcccgu

SEQ ID NO: 2480966 - RNA, 16 nt, Brucella suis 1330
ggauugcuauugaaug

SEQ ID NO: 2480967 - RNA, 10 nt, Brucella suis 1330
ggauuuccac

SEQ ID NO: 2480968 - RNA, 21 nt, Brucella suis 1330
ggauuuuagagcgcaucccga

SEQ ID NO: 2480969 - RNA, 14 nt, Brucella suis 1330
ggcaaaacggcagg

SEQ ID NO: 2480970 - RNA, 17 nt, Brucella suis 1330
ggcaaaacggcaggcau

SEQ ID NO: 2480971 - RNA, 16 nt, Brucella suis 1330
ggcaaaaggcgcaaug

SEQ ID NO: 2480972 - RNA, 22 nt, Brucella suis 1330
ggcaaaaucgagugcggccugc

SEQ ID NO: 2480973 - RNA, 15 nt, Brucella suis 1330
ggcaaacggauugcc

SEQ ID NO: 2480974 - RNA, 17 nt, Brucella suis 1330
ggcaaaggcuccggcau

SEQ ID NO: 2480975 - RNA, 15 nt, Brucella suis 1330
ggcaaaucaggcagg

SEQ ID NO: 2480976 - RNA, 18 nt, Brucella suis 1330
ggcaacaagagggcgcag

SEQ ID NO: 2480977 - RNA, 13 nt, Brucella suis 1330
ggcaacacggcgc

SEQ ID NO: 2480978 - RNA, 11 nt, Brucella suis 1330
ggcaacgccga

SEQ ID NO: 2480979 - RNA, 21 nt, Brucella suis 1330
ggcaagauagccccagcccgc

SEQ ID NO: 2480980 - RNA, 20 nt, Brucella suis 1330
ggcaagaucauccggcucau

SEQ ID NO: 2480981 - RNA, 18 nt, Brucella suis 1330
ggcaagauggcugcccgc

SEQ ID NO: 2480982 - RNA, 13 nt, Brucella suis 1330
ggcaagcaggcgc

SEQ ID NO: 2480983 - RNA, 16 nt, Brucella suis 1330
ggcaagcaggcgcaac

SEQ ID NO: 2480984 - RNA, 17 nt, Brucella suis 1330
ggcaagccccagcacga

SEQ ID NO: 2480985 - RNA, 13 nt, Brucella suis 1330
ggcaagcgccugc

SEQ ID NO: 2480986 - RNA, 15 nt, Brucella suis 1330
ggcaagcuuuucacg

SEQ ID NO: 2480987 - RNA, 22 nt, Brucella suis 1330
ggcaagcuuuucacgcgagcgc

SEQ ID NO: 2480988 - RNA, 18 nt, Brucella suis 1330
ggcaaggagcgagcuugc

SEQ ID NO: 2480989 - RNA, 16 nt, Brucella suis 1330
ggcaaggccacgcacg

SEQ ID NO: 2480990 - RNA, 19 nt, Brucella suis 1330
ggcaaggccgcgcuccaga

SEQ ID NO: 2480991 - RNA, 14 nt, Brucella suis 1330
ggcaagggcaagca

SEQ ID NO: 2480992 - RNA, 15 nt, Brucella suis 1330
ggcaagggcaagcag

SEQ ID NO: 2480993 - RNA, 18 nt, Brucella suis 1330
ggcaagugugcagacagg

SEQ ID NO: 2480994 - RNA, 16 nt, Brucella suis 1330
ggcaaucagcacggca

SEQ ID NO: 2480995 - RNA, 17 nt, Brucella suis 1330
ggcaauccuguucaagc

SEQ ID NO: 2480996 - RNA, 14 nt, Brucella suis 1330
ggcaauccuuucca

SEQ ID NO: 2480997 - RNA, 22 nt, Brucella suis 1330
ggcaaucuugaccuggccagcc

SEQ ID NO: 2480998 - RNA, 12 nt, Brucella suis 1330
ggcaaugcgcuu

SEQ ID NO: 2480999 - RNA, 14 nt, Brucella suis 1330
ggcaauggccgcau

SEQ ID NO: 2481000 - RNA, 15 nt, Brucella suis 1330
ggcacaaagcggccc

SEQ ID NO: 2481001 - RNA, 15 nt, Brucella suis 1330
ggcacccacugcccg

SEQ ID NO: 2481002 - RNA, 15 nt, Brucella suis 1330
ggcaccgaccgggcu

SEQ ID NO: 2481003 - RNA, 17 nt, Brucella suis 1330
ggcaccgcaaagagaac

SEQ ID NO: 2481004 - RNA, 15 nt, Brucella suis 1330
ggcacgaaaagcagg

SEQ ID NO: 2481005 - RNA, 13 nt, Brucella suis 1330
ggcacgaacagau

SEQ ID NO: 2481006 - RNA, 20 nt, Brucella suis 1330
ggcacgauaugggucugcga

SEQ ID NO: 2481007 - RNA, 19 nt, Brucella suis 1330
ggcagacggacuucuucac

SEQ ID NO: 2481008 - RNA, 10 nt, Brucella suis 1330
ggccugaacc

SEQ ID NO: 2481009 - RNA, 13 nt, Brucella suis 1330
ggccugaaugcaa

SEQ ID NO: 2481010 - RNA, 19 nt, Brucella suis 1330
ggccugagccauaucgggg

SEQ ID NO: 2481011 - RNA, 18 nt, Brucella suis 1330
ggccugcgcgcgcauggc

SEQ ID NO: 2481012 - RNA, 11 nt, Brucella suis 1330
ggccugugcuu

SEQ ID NO: 2481013 - RNA, 16 nt, Brucella suis 1330
ggccuguuccugcaug

SEQ ID NO: 2481014 - RNA, 18 nt, Brucella suis 1330
ggccuuccuugacgcuga

SEQ ID NO: 2481015 - RNA, 15 nt, Brucella suis 1330
ggccuugcggcggcg

SEQ ID NO: 2481016 - RNA, 17 nt, Brucella suis 1330
ggccuugcggcggcguu

SEQ ID NO: 2481017 - RNA, 23 nt, Brucella suis 1330
ggccuuguguuucaccagaugcu

SEQ ID NO: 2481018 - RNA, 16 nt, Brucella suis 1330
ggccuuugcgccgggu

SEQ ID NO: 2481019 - RNA, 23 nt, Brucella suis 1330
ggccuuugcggcggaugaacccg

SEQ ID NO: 2481020 - RNA, 16 nt, Brucella suis 1330
ggcgaaaagccgccuc

SEQ ID NO: 2481021 - RNA, 20 nt, Brucella suis 1330
ggcgacacggccgaucgcca

SEQ ID NO: 2481022 - RNA, 11 nt, Brucella suis 1330
ggcgacccagc

SEQ ID NO: 2481023 - RNA, 16 nt, Brucella suis 1330
ggcgacgcgcucgucg

SEQ ID NO: 2481024 - RNA, 20 nt, Brucella suis 1330
ggcgacuggcagggcuucau

SEQ ID NO: 2481025 - RNA, 21 nt, Brucella suis 1330
ggcgagaauugcaucgcgguu

SEQ ID NO: 2481026 - RNA, 17 nt, Brucella suis 1330
ggcgagacagacuggaa

SEQ ID NO: 2481027 - RNA, 14 nt, Brucella suis 1330
ggcgagaucgucug

SEQ ID NO: 2481028 - RNA, 13 nt, Brucella suis 1330
ggcgagcgccagc

SEQ ID NO: 2481029 - RNA, 13 nt, Brucella suis 1330
ggcgagcgcgcca

SEQ ID NO: 2481030 - RNA, 23 nt, Brucella suis 1330
ggcgagcgcgccacggauuucca

SEQ ID NO: 2481031 - RNA, 14 nt, Brucella suis 1330
ggcgagcgcgcuua

SEQ ID NO: 2481032 - RNA, 15 nt, Brucella suis 1330
ggcgagcgcgcuuau

SEQ ID NO: 2481033 - RNA, 16 nt, Brucella suis 1330
ggcgaggaaaaucgac

SEQ ID NO: 2481034 - RNA, 16 nt, Brucella suis 1330
ggcgaggagcguucca

SEQ ID NO: 2481035 - RNA, 19 nt, Brucella suis 1330
ggcgagggcgggcggccag

SEQ ID NO: 2481036 - RNA, 17 nt, Brucella suis 1330
ggcgaggucucccggca

SEQ ID NO: 2481037 - RNA, 20 nt, Brucella suis 1330
ggcgaguugccacgcgccgc

SEQ ID NO: 2481038 - RNA, 23 nt, Brucella suis 1330
ggcgaguugccacgcgccgccau

SEQ ID NO: 2481039 - RNA, 24 nt, Brucella suis 1330
ggcgaguugccacgcgccgccauc

SEQ ID NO: 2481040 - RNA, 18 nt, Brucella suis 1330
ggcgauaaagaugcgcgc

SEQ ID NO: 2481041 - RNA, 15 nt, Brucella suis 1330
ggcgauccaauauug

SEQ ID NO: 2481042 - RNA, 13 nt, Brucella suis 1330
ggcgaugagcgcc

SEQ ID NO: 2481043 - RNA, 13 nt, Brucella suis 1330
ggcgaugcccauc

SEQ ID NO: 2481044 - RNA, 13 nt, Brucella suis 1330
ggcgcaaaggccg

SEQ ID NO: 2481045 - RNA, 15 nt, Brucella suis 1330
ggcgcaaaggccggg

SEQ ID NO: 2481046 - RNA, 16 nt, Brucella suis 1330
ggcgcaaaggccgggu

SEQ ID NO: 2481047 - RNA, 18 nt, Brucella suis 1330
ggcgcaaggucucgacag

SEQ ID NO: 2481048 - RNA, 21 nt, Brucella suis 1330
ggcgcaaucggcacucuggcc

SEQ ID NO: 2481049 - RNA, 20 nt, Brucella suis 1330
ggcgcaaugugcuggcggcc

SEQ ID NO: 2481050 - RNA, 17 nt, Brucella suis 1330
ggcgcacccgaaaggau

SEQ ID NO: 2481051 - RNA, 15 nt, Brucella suis 1330
ggcgcaguuucgcag

SEQ ID NO: 2481052 - RNA, 17 nt, Brucella suis 1330
ggcgcauucaggcggcc

SEQ ID NO: 2481053 - RNA, 16 nt, Brucella suis 1330
ggcgcauucggccgcc

SEQ ID NO: 2481054 - RNA, 17 nt, Brucella suis 1330
ggcgccagcgcggauca

SEQ ID NO: 2481055 - RNA, 23 nt, Brucella suis 1330
ggcgcccaccauauuugccgcca

SEQ ID NO: 2481056 - RNA, 22 nt, Brucella suis 1330
ggcgccgucgggaccaccggcc

SEQ ID NO: 2481057 - RNA, 20 nt, Brucella suis 1330
ggcgccugguuaugcggaug

SEQ ID NO: 2481058 - RNA, 18 nt, Brucella suis 1330
ggcgcgaaaccggaacgc

SEQ ID NO: 2481059 - RNA, 13 nt, Brucella suis 1330
ggcgcgaccugcu

SEQ ID NO: 2481060 - RNA, 22 nt, Brucella suis 1330
ggcgcgacuguuucgaggccca

SEQ ID NO: 2481061 - RNA, 19 nt, Brucella suis 1330
ggcgcgagcacgccgcuca

SEQ ID NO: 2481062 - RNA, 17 nt, Brucella suis 1330
ggcgcgaggcggcugcg

SEQ ID NO: 2481063 - RNA, 11 nt, Brucella suis 1330
ggcgcgcgccu

SEQ ID NO: 2481064 - RNA, 23 nt, Brucella suis 1330
ggcgcgcuaugcgugguccagcc

SEQ ID NO: 2481065 - RNA, 14 nt, Brucella suis 1330
ggcgcgcugaagcc

SEQ ID NO: 2481066 - RNA, 13 nt, Brucella suis 1330
ggcgcgcugcaau

SEQ ID NO: 2481067 - RNA, 12 nt, Brucella suis 1330
ggcgcggcagga

SEQ ID NO: 2481068 - RNA, 23 nt, Brucella suis 1330
ggcgcggcaggaucgccagaagc

SEQ ID NO: 2481069 - RNA, 19 nt, Brucella suis 1330
ggcgcgugugcauaggauu

SEQ ID NO: 2481070 - RNA, 12 nt, Brucella suis 1330
ggcgcuccaugc

SEQ ID NO: 2481071 - RNA, 23 nt, Brucella suis 1330
ggcgcucgaccgcaccucuggau

SEQ ID NO: 2481072 - RNA, 15 nt, Brucella suis 1330
ggcgcucuaauccuu

SEQ ID NO: 2481073 - RNA, 21 nt, Brucella suis 1330
ggcgcugcucgcgcaaggcuu

SEQ ID NO: 2481074 - RNA, 16 nt, Brucella suis 1330
ggcgcuggccuugcca

SEQ ID NO: 2481075 - RNA, 15 nt, Brucella suis 1330
ggcgcuuuauuccuu

SEQ ID NO: 2481076 - RNA, 15 nt, Brucella suis 1330
ggcgcuuuugcgcuc

SEQ ID NO: 2481077 - RNA, 20 nt, Brucella suis 1330
ggcgcuuuuucacgcgggcg

SEQ ID NO: 2481078 - RNA, 22 nt, Brucella suis 1330
ggcggaaaggauuuccuguccc

SEQ ID NO: 2481079 - RNA, 17 nt, Brucella suis 1330
ggcggaacaggcagcau

SEQ ID NO: 2481080 - RNA, 20 nt, Brucella suis 1330
ggcggaaggcugagugagcc

SEQ ID NO: 2481081 - RNA, 20 nt, Brucella suis 1330
ggcggaauucauccgccuug

SEQ ID NO: 2481082 - RNA, 18 nt, Brucella suis 1330
ggcggauauucgccgccu

SEQ ID NO: 2481083 - RNA, 14 nt, Brucella suis 1330
ggcggaucggcagg

SEQ ID NO: 2481084 - RNA, 15 nt, Brucella suis 1330
ggcggaucggcagga

SEQ ID NO: 2481085 - RNA, 16 nt, Brucella suis 1330
ggcggaucggcaggau

SEQ ID NO: 2481086 - RNA, 15 nt, Brucella suis 1330
ggcggaugcgcggcg

SEQ ID NO: 2481087 - RNA, 18 nt, Brucella suis 1330
ggcggaugcgcggcgcca

SEQ ID NO: 2481088 - RNA, 23 nt, Brucella suis 1330
ggcggcaaaaagcggcgucagca

SEQ ID NO: 2481089 - RNA, 15 nt, Brucella suis 1330
ggcggcagaauaucu

SEQ ID NO: 2481090 - RNA, 16 nt, Brucella suis 1330
ggcggcaggcagacau

SEQ ID NO: 2481091 - RNA, 14 nt, Brucella suis 1330
ggcggccggagcgc

SEQ ID NO: 2481092 - RNA, 21 nt, Brucella suis 1330
ggcggccuugaugcggcggcg

SEQ ID NO: 2481093 - RNA, 19 nt, Brucella suis 1330
ggcggccuuggaggcggca

SEQ ID NO: 2481094 - RNA, 14 nt, Brucella suis 1330
ggcggcgcggcggc

SEQ ID NO: 2481095 - RNA, 14 nt, Brucella suis 1330
ggcggcgcucgacc

SEQ ID NO: 2481096 - RNA, 13 nt, Brucella suis 1330
ggcggcggccggg

SEQ ID NO: 2481097 - RNA, 15 nt, Brucella suis 1330
ggcggcggccgggcg

SEQ ID NO: 2481098 - RNA, 14 nt, Brucella suis 1330
ggcggcgugggcug

SEQ ID NO: 2481099 - RNA, 18 nt, Brucella suis 1330
ggcggcguuucgccccgu

SEQ ID NO: 2481100 - RNA, 19 nt, Brucella suis 1330
ggcggcuuccucggcggcg

SEQ ID NO: 2481101 - RNA, 17 nt, Brucella suis 1330
ggcggcuuucgccgccc

SEQ ID NO: 2481102 - RNA, 13 nt, Brucella suis 1330
ggcggggagcagg

SEQ ID NO: 2481103 - RNA, 13 nt, Brucella suis 1330
ggcggggcagggg

SEQ ID NO: 2481104 - RNA, 15 nt, Brucella suis 1330
ggcggguagccgcca

SEQ ID NO: 2481105 - RNA, 17 nt, Brucella suis 1330
ggcggucacguccagaa

SEQ ID NO: 2481106 - RNA, 12 nt, Brucella suis 1330
ggcggucggcgg

SEQ ID NO: 2481107 - RNA, 14 nt, Brucella suis 1330
ggcggucggcggcg

SEQ ID NO: 2481108 - RNA, 21 nt, Brucella suis 1330
ggcggugguuucccuugaaga

SEQ ID NO: 2481109 - RNA, 17 nt, Brucella suis 1330
ggcgguguuucggucca

SEQ ID NO: 2481110 - RNA, 15 nt, Brucella suis 1330
ggcgguugugcgccc

SEQ ID NO: 2481111 - RNA, 19 nt, Brucella suis 1330
ggcgguuugcgaccaugag

SEQ ID NO: 2481112 - RNA, 18 nt, Brucella suis 1330
ggcgguuuugagcugcug

SEQ ID NO: 2481113 - RNA, 19 nt, Brucella suis 1330
ggcgguuuugagcugcugg

SEQ ID NO: 2481114 - RNA, 19 nt, Brucella suis 1330
ggcguagauagcgucagca

SEQ ID NO: 2481115 - RNA, 19 nt, Brucella suis 1330
ggcguccccaucgaaaccg

SEQ ID NO: 2481116 - RNA, 21 nt, Brucella suis 1330
ggcguccccaucgaaaccggc

SEQ ID NO: 2481117 - RNA, 16 nt, Brucella suis 1330
ggcgucggauaacgcg

SEQ ID NO: 2481118 - RNA, 13 nt, Brucella suis 1330
ggcgugccgggcg

SEQ ID NO: 2481119 - RNA, 15 nt, Brucella suis 1330
ggcguggaaagcugg

SEQ ID NO: 2481120 - RNA, 16 nt, Brucella suis 1330
ggcguucccagacaug

SEQ ID NO: 2481121 - RNA, 17 nt, Brucella suis 1330
ggcguuuccaaugcacu

SEQ ID NO: 2481122 - RNA, 16 nt, Brucella suis 1330
ggcucauccuccacga

SEQ ID NO: 2481123 - RNA, 19 nt, Brucella suis 1330
ggcucgcgugauaggcgac

SEQ ID NO: 2481124 - RNA, 13 nt, Brucella suis 1330
ggcucgcucgacu

SEQ ID NO: 2481125 - RNA, 20 nt, Brucella suis 1330
ggucgacggguugcgaccgg

SEQ ID NO: 2481126 - RNA, 22 nt, Brucella suis 1330
ggucgagcgccuguccgccugc

SEQ ID NO: 2481127 - RNA, 15 nt, Brucella suis 1330
ggucgaugccgccga

SEQ ID NO: 2481128 - RNA, 16 nt, Brucella suis 1330
ggucggaaagaugguc

SEQ ID NO: 2481129 - RNA, 16 nt, Brucella suis 1330
ggucggcuugccgacc

SEQ ID NO: 2481130 - RNA, 19 nt, Brucella suis 1330
ggucgugauguugcgggug

SEQ ID NO: 2481131 - RNA, 14 nt, Brucella suis 1330
ggucucgaagauca

SEQ ID NO: 2481132 - RNA, 13 nt, Brucella suis 1330
ggucugcgacggc

SEQ ID NO: 2481133 - RNA, 14 nt, Brucella suis 1330
ggucuucauggcuu

SEQ ID NO: 2481134 - RNA, 14 nt, Brucella suis 1330
ggucuugccggccu

SEQ ID NO: 2481135 - RNA, 22 nt, Brucella suis 1330
ggugaaaauaucugccgugucg

SEQ ID NO: 2481136 - RNA, 14 nt, Brucella suis 1330
ggugaacuggcaag

SEQ ID NO: 2481137 - RNA, 22 nt, Brucella suis 1330
ggugagcuugcgcagcgccgca

SEQ ID NO: 2481138 - RNA, 15 nt, Brucella suis 1330
ggugaugcgcccguu

SEQ ID NO: 2481139 - RNA, 18 nt, Brucella suis 1330
ggugauguuugcgaaccg

SEQ ID NO: 2481140 - RNA, 19 nt, Brucella suis 1330
ggugcagucuucggccggg

SEQ ID NO: 2481141 - RNA, 14 nt, Brucella suis 1330
ggugccaagaagaa

SEQ ID NO: 2481142 - RNA, 22 nt, Brucella suis 1330
ggugccaagaagaagagccugc

SEQ ID NO: 2481143 - RNA, 22 nt, Brucella suis 1330
ggugccaucaagcgucaugcca

SEQ ID NO: 2481144 - RNA, 13 nt, Brucella suis 1330
ggugcccagagcg

SEQ ID NO: 2481145 - RNA, 15 nt, Brucella suis 1330
ggugcccugcugcuu

SEQ ID NO: 2481146 - RNA, 14 nt, Brucella suis 1330
ggugccgaaggccu

SEQ ID NO: 2481147 - RNA, 21 nt, Brucella suis 1330
ggugccugacuggcggccaag

SEQ ID NO: 2481148 - RNA, 15 nt, Brucella suis 1330
ggugcgagcaggcuu

SEQ ID NO: 2481149 - RNA, 22 nt, Brucella suis 1330
ggugcgagcaggcuuucggccu

SEQ ID NO: 2481150 - RNA, 19 nt, Brucella suis 1330
ggugcugccauggcaguga

SEQ ID NO: 2481151 - RNA, 18 nt, Brucella suis 1330
ggugcugucgcccagaac

SEQ ID NO: 2481152 - RNA, 15 nt, Brucella suis 1330
gguggcauugcccau

SEQ ID NO: 2481153 - RNA, 17 nt, Brucella suis 1330
gguggcugcccgccgca

SEQ ID NO: 2481154 - RNA, 12 nt, Brucella suis 1330
gguggcugggcc

SEQ ID NO: 2481155 - RNA, 15 nt, Brucella suis 1330
gguggcugggcccca

SEQ ID NO: 2481156 - RNA, 19 nt, Brucella suis 1330
gguggugcgcagggucugc

SEQ ID NO: 2481157 - RNA, 20 nt, Brucella suis 1330
ggugguucaggcuacagguc

SEQ ID NO: 2481158 - RNA, 19 nt, Brucella suis 1330
ggugucauagaccaugacg

SEQ ID NO: 2481159 - RNA, 21 nt, Brucella suis 1330
ggugucauagaccaugacgcc

SEQ ID NO: 2481160 - RNA, 13 nt, Brucella suis 1330
gguguccugccgg

SEQ ID NO: 2481161 - RNA, 13 nt, Brucella suis 1330
ggugugagugcgc

SEQ ID NO: 2481162 - RNA, 17 nt, Brucella suis 1330
gguguuugcgacgggcg

SEQ ID NO: 2481163 - RNA, 18 nt, Brucella suis 1330
gguuacuugcgcuuugca

SEQ ID NO: 2481164 - RNA, 18 nt, Brucella suis 1330
gguuagcgacuucggguc

SEQ ID NO: 2481165 - RNA, 16 nt, Brucella suis 1330
gguucagcccugcaca

SEQ ID NO: 2481166 - RNA, 15 nt, Brucella suis 1330
gguucagccgcuccg

SEQ ID NO: 2481167 - RNA, 15 nt, Brucella suis 1330
gguucgggcauugug

SEQ ID NO: 2481168 - RNA, 19 nt, Brucella suis 1330
gguucgggcauuguggugc

SEQ ID NO: 2481169 - RNA, 23 nt, Brucella suis 1330
gguucuugagguugagcugcucg

SEQ ID NO: 2481170 - RNA, 22 nt, Brucella suis 1330
gguugcaggcgcaggcccugca

SEQ ID NO: 2481171 - RNA, 14 nt, Brucella suis 1330
gguugccuugccca

SEQ ID NO: 2481172 - RNA, 17 nt, Brucella suis 1330
gguugcgcggccagcca

SEQ ID NO: 2481173 - RNA, 22 nt, Brucella suis 1330
gguuggauaauugaucggcugg

SEQ ID NO: 2481174 - RNA, 13 nt, Brucella suis 1330
gguuugaaaaugu

SEQ ID NO: 2481175 - RNA, 22 nt, Brucella suis 1330
gguuuucggaaaagaugcgcgu

SEQ ID NO: 2481176 - RNA, 21 nt, Brucella suis 1330
gguuuugcguuggaaaaugcg

SEQ ID NO: 2481177 - RNA, 21 nt, Brucella suis 1330
gguuuuggcaucagucgaauu

SEQ ID NO: 2481178 - RNA, 17 nt, Brucella suis 1330
gguuuugggaaacaugc

SEQ ID NO: 2481179 - RNA, 13 nt, Brucella suis 1330
gguuuuuccaaaa

SEQ ID NO: 2481180 - RNA, 20 nt, Brucella suis 1330
guaaaacgcaccgugcucca

SEQ ID NO: 2481181 - RNA, 22 nt, Brucella suis 1330
guaaaacgcaccgugcuccaga

SEQ ID NO: 2481182 - RNA, 15 nt, Brucella suis 1330
guaaagcgcgccauc

SEQ ID NO: 2481183 - RNA, 21 nt, Brucella suis 1330
guaaauccuccagauugaucc

SEQ ID NO: 2481184 - RNA, 23 nt, Brucella suis 1330
guaaccgccaccuucggguuuuu

SEQ ID NO: 2481185 - RNA, 15 nt, Brucella suis 1330
guaacgacgaacgau

SEQ ID NO: 2481186 - RNA, 11 nt, Brucella suis 1330
guaagagcaga

SEQ ID NO: 2481187 - RNA, 17 nt, Brucella suis 1330
guaagcgaccaccaccg

SEQ ID NO: 2481188 - RNA, 20 nt, Brucella suis 1330
guaagcgccuuugccgcgcg

SEQ ID NO: 2481189 - RNA, 19 nt, Brucella suis 1330
guaaguucauaaggcaauu

SEQ ID NO: 2481190 - RNA, 15 nt, Brucella suis 1330
guaauauugaagccg

SEQ ID NO: 2481191 - RNA, 15 nt, Brucella suis 1330
guaaucagcgucagc

SEQ ID NO: 2481192 - RNA, 17 nt, Brucella suis 1330
guaauucccgcagcaug

SEQ ID NO: 2481193 - RNA, 17 nt, Brucella suis 1330
guaccgacaugccaaga

SEQ ID NO: 2481194 - RNA, 13 nt, Brucella suis 1330
guacggaaagggc

SEQ ID NO: 2481195 - RNA, 13 nt, Brucella suis 1330
guacggcccucga

SEQ ID NO: 2481196 - RNA, 22 nt, Brucella suis 1330
guacugcaauccggcgugaucg

SEQ ID NO: 2481197 - RNA, 23 nt, Brucella suis 1330
guagaaagcgucauaggcagcga

SEQ ID NO: 2481198 - RNA, 15 nt, Brucella suis 1330
guagaagacaaagcc

SEQ ID NO: 2481199 - RNA, 14 nt, Brucella suis 1330
guagcagcaacagg

SEQ ID NO: 2481200 - RNA, 15 nt, Brucella suis 1330
guagcgcauggcagc

SEQ ID NO: 2481201 - RNA, 13 nt, Brucella suis 1330
guagcuucugggu

SEQ ID NO: 2481202 - RNA, 16 nt, Brucella suis 1330
guagggcaguagggca

SEQ ID NO: 2481203 - RNA, 19 nt, Brucella suis 1330
guagggcaguagggcagua

SEQ ID NO: 2481204 - RNA, 19 nt, Brucella suis 1330
guauagacauucugcacgu

SEQ ID NO: 2481205 - RNA, 13 nt, Brucella suis 1330
guauccaccagac

SEQ ID NO: 2481206 - RNA, 15 nt, Brucella suis 1330
guauccccggcaaag

SEQ ID NO: 2481207 - RNA, 21 nt, Brucella suis 1330
guaucgaagcgggaccauaaa

SEQ ID NO: 2481208 - RNA, 9 nt, Brucella suis 1330
guaucggcg

SEQ ID NO: 2481209 - RNA, 22 nt, Brucella suis 1330
guaucggcggcaagcgcgugga

SEQ ID NO: 2481210 - RNA, 15 nt, Brucella suis 1330
guaucgugcagaagu

SEQ ID NO: 2481211 - RNA, 21 nt, Brucella suis 1330
guauucuuccagaaugcgccg

SEQ ID NO: 2481212 - RNA, 18 nt, Brucella suis 1330
guauuucaaugcugcauc

SEQ ID NO: 2481213 - RNA, 19 nt, Brucella suis 1330
guauuuguuuugccgcauu

SEQ ID NO: 2481214 - RNA, 17 nt, Brucella suis 1330
gucaaaaagggcuuccu

SEQ ID NO: 2481215 - RNA, 14 nt, Brucella suis 1330
gucaaaacgccccg

SEQ ID NO: 2481216 - RNA, 21 nt, Brucella suis 1330
gucaaaauggccucagauuca

SEQ ID NO: 2481217 - RNA, 16 nt, Brucella suis 1330
gucaagacaagagccg

SEQ ID NO: 2481218 - RNA, 18 nt, Brucella suis 1330
gucacauaaagcguggcg

SEQ ID NO: 2481219 - RNA, 23 nt, Brucella suis 1330
gucacccgcgucgucugcauccu

SEQ ID NO: 2481220 - RNA, 19 nt, Brucella suis 1330
gucacgauggcccagcggu

SEQ ID NO: 2481221 - RNA, 18 nt, Brucella suis 1330
gucacgcagcguguagcc

SEQ ID NO: 2481222 - RNA, 21 nt, Brucella suis 1330
gucacgcgcguugcggccggg

SEQ ID NO: 2481223 - RNA, 14 nt, Brucella suis 1330
gucacgcuccgcca

SEQ ID NO: 2481224 - RNA, 16 nt, Brucella suis 1330
gucacgcuccgccacu

SEQ ID NO: 2481225 - RNA, 23 nt, Brucella suis 1330
gucacggaguguagcgcagccug

SEQ ID NO: 2481226 - RNA, 14 nt, Brucella suis 1330
gucacugagaacuu

SEQ ID NO: 2481227 - RNA, 22 nt, Brucella suis 1330
gucagaaagucugcuuccgcau

SEQ ID NO: 2481228 - RNA, 23 nt, Brucella suis 1330
gucagcaaaauggugcugccaug

SEQ ID NO: 2481229 - RNA, 21 nt, Brucella suis 1330
gucagcgaaaccaucgcacca

SEQ ID NO: 2481230 - RNA, 14 nt, Brucella suis 1330
gucagcgcaaagcc

SEQ ID NO: 2481231 - RNA, 17 nt, Brucella suis 1330
gucagcgcaaagccugc

SEQ ID NO: 2481232 - RNA, 19 nt, Brucella suis 1330
gucagcuuuccggcuucca

SEQ ID NO: 2481233 - RNA, 16 nt, Brucella suis 1330
gucaggauauuucggc

SEQ ID NO: 2481234 - RNA, 20 nt, Brucella suis 1330
gucaggccaagugcggucug

SEQ ID NO: 2481235 - RNA, 16 nt, Brucella suis 1330
gucaggcccagaugca

SEQ ID NO: 2481236 - RNA, 16 nt, Brucella suis 1330
gucagggaaaugcgga

SEQ ID NO: 2481237 - RNA, 17 nt, Brucella suis 1330
gucagggaaaugcggau

SEQ ID NO: 2481238 - RNA, 16 nt, Brucella suis 1330
gucagggcauugccga

SEQ ID NO: 2481239 - RNA, 19 nt, Brucella suis 1330
gucaguucgucggccagau

SEQ ID NO: 2481240 - RNA, 15 nt, Brucella suis 1330
gucauauucggccuu

SEQ ID NO: 2481241 - RNA, 16 nt, Brucella suis 1330
gugccagaauguugag

SEQ ID NO: 2481242 - RNA, 16 nt, Brucella suis 1330
gugccagaucggcaag

SEQ ID NO: 2481243 - RNA, 15 nt, Brucella suis 1330
gugccauagacgcgc

SEQ ID NO: 2481244 - RNA, 13 nt, Brucella suis 1330
gugcccggcaaca

SEQ ID NO: 2481245 - RNA, 15 nt, Brucella suis 1330
gugccgagaaugcga

SEQ ID NO: 2481246 - RNA, 16 nt, Brucella suis 1330
gugccgccaucggcaa

SEQ ID NO: 2481247 - RNA, 19 nt, Brucella suis 1330
gugccgccgugaaaauaag

SEQ ID NO: 2481248 - RNA, 12 nt, Brucella suis 1330
gugccgcgccga

SEQ ID NO: 2481249 - RNA, 15 nt, Brucella suis 1330
gugccgcgccgauga

SEQ ID NO: 2481250 - RNA, 22 nt, Brucella suis 1330
gugccguaucacgccgcgacuc

SEQ ID NO: 2481251 - RNA, 21 nt, Brucella suis 1330
gugccugacuggcggccaagc

SEQ ID NO: 2481252 - RNA, 22 nt, Brucella suis 1330
gugccugacuggcggccaagcg

SEQ ID NO: 2481253 - RNA, 20 nt, Brucella suis 1330
gugccuggcgaaaacggcca

SEQ ID NO: 2481254 - RNA, 17 nt, Brucella suis 1330
gugccuuaugucaugga

SEQ ID NO: 2481255 - RNA, 22 nt, Brucella suis 1330
gugccuucgaugaccaccgcga

SEQ ID NO: 2481256 - RNA, 20 nt, Brucella suis 1330
gugcgaauguauagcgauga

SEQ ID NO: 2481257 - RNA, 15 nt, Brucella suis 1330
gugcgacgaggccug

SEQ ID NO: 2481258 - RNA, 22 nt, Brucella suis 1330
gugcgagcaggcuuucggccug

SEQ ID NO: 2481259 - RNA, 13 nt, Brucella suis 1330
gugcgccaccgcg

SEQ ID NO: 2481260 - RNA, 16 nt, Brucella suis 1330
gugcggcugcaaaugg

SEQ ID NO: 2481261 - RNA, 16 nt, Brucella suis 1330
gugcgggcuucuucca

SEQ ID NO: 2481262 - RNA, 23 nt, Brucella suis 1330
gugcgggguugaucucauuucgg

SEQ ID NO: 2481263 - RNA, 16 nt, Brucella suis 1330
gugcugauugccguga

SEQ ID NO: 2481264 - RNA, 12 nt, Brucella suis 1330
gugcugccaugg

SEQ ID NO: 2481265 - RNA, 13 nt, Brucella suis 1330
gugcugcugcaau

SEQ ID NO: 2481266 - RNA, 15 nt, Brucella suis 1330
gugcuggccguggca

SEQ ID NO: 2481267 - RNA, 14 nt, Brucella suis 1330
gugcuggugaaaga

SEQ ID NO: 2481268 - RNA, 15 nt, Brucella suis 1330
gugcugucgcccaga

SEQ ID NO: 2481269 - RNA, 17 nt, Brucella suis 1330
guggaaggcgagcaggc

SEQ ID NO: 2481270 - RNA, 14 nt, Brucella suis 1330
guggacgguugcug

SEQ ID NO: 2481271 - RNA, 14 nt, Brucella suis 1330
guggagcaccgccc

SEQ ID NO: 2481272 - RNA, 20 nt, Brucella suis 1330
guggaucggcgucaggccga

SEQ ID NO: 2481273 - RNA, 11 nt, Brucella suis 1330
guggcaaugac

SEQ ID NO: 2481274 - RNA, 19 nt, Brucella suis 1330
guggcaugggagcaccgca

SEQ ID NO: 2481275 - RNA, 21 nt, Brucella suis 1330
guggccgaugauauugcccau

SEQ ID NO: 2481276 - RNA, 12 nt, Brucella suis 1330
guggccuucagc

SEQ ID NO: 2481277 - RNA, 11 nt, Brucella suis 1330
guggccuuccu

SEQ ID NO: 2481278 - RNA, 17 nt, Brucella suis 1330
guggcggauugcagcgg

SEQ ID NO: 2481279 - RNA, 20 nt, Brucella suis 1330
guggcggcaaaaagcggcgu

SEQ ID NO: 2481280 - RNA, 23 nt, Brucella suis 1330
guggcugcaaucaccagagacag

SEQ ID NO: 2481281 - RNA, 16 nt, Brucella suis 1330
guggcugcccgccgca

SEQ ID NO: 2481282 - RNA, 16 nt, Brucella suis 1330
guggcuuuuccggcgg

SEQ ID NO: 2481283 - RNA, 23 nt, Brucella suis 1330
gugggccucaagcggcuccacca

SEQ ID NO: 2481284 - RNA, 20 nt, Brucella suis 1330
guggguuugagcguggcucg

SEQ ID NO: 2481285 - RNA, 14 nt, Brucella suis 1330
guggucauggccac

SEQ ID NO: 2481286 - RNA, 23 nt, Brucella suis 1330
guggucgccucuucauccggcag

SEQ ID NO: 2481287 - RNA, 18 nt, Brucella suis 1330
guggucugggcgaugagc

SEQ ID NO: 2481288 - RNA, 23 nt, Brucella suis 1330
guggucugggcgaugagcgccau

SEQ ID NO: 2481289 - RNA, 23 nt, Brucella suis 1330
guggucuuugugauuccaacauu

SEQ ID NO: 2481290 - RNA, 15 nt, Brucella suis 1330
guguaggugccgaga

SEQ ID NO: 2481291 - RNA, 22 nt, Brucella suis 1330
guguauccaccagacgauuuuc

SEQ ID NO: 2481292 - RNA, 13 nt, Brucella suis 1330
gugucauaaaaaa

SEQ ID NO: 2481293 - RNA, 21 nt, Brucella suis 1330
gugucauagccgaugguccac

SEQ ID NO: 2481294 - RNA, 19 nt, Brucella suis 1330
gugucgauugccugugcgg

SEQ ID NO: 2481295 - RNA, 12 nt, Brucella suis 1330
guguugaccaca

SEQ ID NO: 2481296 - RNA, 12 nt, Brucella suis 1330
guguuucaccag

SEQ ID NO: 2481297 - RNA, 21 nt, Brucella suis 1330
guuaaaauggaaucgcuggaa

SEQ ID NO: 2481298 - RNA, 17 nt, Brucella suis 1330
guuaauuccacgcgccg

SEQ ID NO: 2481299 - RNA, 22 nt, Brucella suis 1330
guuacauaugcuguuucaaacg

SEQ ID NO: 2481300 - RNA, 14 nt, Brucella suis 1330
guuauucccacagu

SEQ ID NO: 2481301 - RNA, 22 nt, Brucella suis 1330
guucaagcaguaugauuugucg

SEQ ID NO: 2481302 - RNA, 13 nt, Brucella suis 1330
guucaaggcugcu

SEQ ID NO: 2481303 - RNA, 23 nt, Brucella suis 1330
guucaauucacccuuggccggaa

SEQ ID NO: 2481304 - RNA, 19 nt, Brucella suis 1330
guucacauugacguugaug

SEQ ID NO: 2481305 - RNA, 22 nt, Brucella suis 1330
guucacauuucaugaaaaugcc

SEQ ID NO: 2481306 - RNA, 13 nt, Brucella suis 1330
guucaccgcaacg

SEQ ID NO: 2481307 - RNA, 17 nt, Brucella suis 1330
guucacgcgccauguug

SEQ ID NO: 2481308 - RNA, 15 nt, Brucella suis 1330
guucaggccggccuu

SEQ ID NO: 2481309 - RNA, 15 nt, Brucella suis 1330
guucaggugcgacuu

SEQ ID NO: 2481310 - RNA, 12 nt, Brucella suis 1330
guucaugccgga

SEQ ID NO: 2481311 - RNA, 18 nt, Brucella suis 1330
guucauuuuuagaagauc

SEQ ID NO: 2481312 - RNA, 19 nt, Brucella suis 1330
guuccagacuuccagaagc

SEQ ID NO: 2481313 - RNA, 16 nt, Brucella suis 1330
guuccagggcgcgcca

SEQ ID NO: 2481314 - RNA, 15 nt, Brucella suis 1330
guuccgaauacaagc

SEQ ID NO: 2481315 - RNA, 21 nt, Brucella suis 1330
guuccgcaccgcacuggggac

SEQ ID NO: 2481316 - RNA, 19 nt, Brucella suis 1330
guuccgcccgaauugcggc

SEQ ID NO: 2481317 - RNA, 18 nt, Brucella suis 1330
guuccgccugugggaaga

SEQ ID NO: 2481318 - RNA, 14 nt, Brucella suis 1330
guuccgugaaucug

SEQ ID NO: 2481319 - RNA, 22 nt, Brucella suis 1330
guuccgugccgauuucggcgug

SEQ ID NO: 2481320 - RNA, 18 nt, Brucella suis 1330
guuccugcggaaugcccu

SEQ ID NO: 2481321 - RNA, 21 nt, Brucella suis 1330
guuccuugaggccgcgcgcgc

SEQ ID NO: 2481322 - RNA, 19 nt, Brucella suis 1330
guuccuuuuccacacgaac

SEQ ID NO: 2481323 - RNA, 14 nt, Brucella suis 1330
guucgaucgguggc

SEQ ID NO: 2481324 - RNA, 15 nt, Brucella suis 1330
guucgcaauuccggc

SEQ ID NO: 2481325 - RNA, 16 nt, Brucella suis 1330
guucgcgcaucgggcg

SEQ ID NO: 2481326 - RNA, 18 nt, Brucella suis 1330
guucgggcauuguggugc

SEQ ID NO: 2481327 - RNA, 19 nt, Brucella suis 1330
guucguagcugcuuugcug

SEQ ID NO: 2481328 - RNA, 17 nt, Brucella suis 1330
guucguggcggggcagg

SEQ ID NO: 2481329 - RNA, 14 nt, Brucella suis 1330
guucguugaacugc

SEQ ID NO: 2481330 - RNA, 22 nt, Brucella suis 1330
guucguugaacugcaucacagu

SEQ ID NO: 2481331 - RNA, 13 nt, Brucella suis 1330
guucuuccgccag

SEQ ID NO: 2481332 - RNA, 18 nt, Brucella suis 1330
guucuugagguugagcug

SEQ ID NO: 2481333 - RNA, 21 nt, Brucella suis 1330
guucuugagguugagcugcuc

SEQ ID NO: 2481334 - RNA, 22 nt, Brucella suis 1330
guugaacuugcccgcauagcca

SEQ ID NO: 2481335 - RNA, 21 nt, Brucella suis 1330
guugaagcugucgccagcgcc

SEQ ID NO: 2481336 - RNA, 21 nt, Brucella suis 1330
guugacgaucaccuguggcug

SEQ ID NO: 2481337 - RNA, 19 nt, Brucella suis 1330
guugagccgcgccaugcca

SEQ ID NO: 2481338 - RNA, 15 nt, Brucella suis 1330
guugaggauuuccac

SEQ ID NO: 2481339 - RNA, 19 nt, Brucella suis 1330
guugaucgaggcaaaugcc

SEQ ID NO: 2481340 - RNA, 17 nt, Brucella suis 1330
guugaucucauuucggc

SEQ ID NO: 2481341 - RNA, 19 nt, Brucella suis 1330
guugcaagauccucgccuu

SEQ ID NO: 2481342 - RNA, 21 nt, Brucella suis 1330
guugcacgcacaucggaaagc

SEQ ID NO: 2481343 - RNA, 17 nt, Brucella suis 1330
guugcacuccggcugga

SEQ ID NO: 2481344 - RNA, 17 nt, Brucella suis 1330
guugccacgcgccgcca

SEQ ID NO: 2481345 - RNA, 19 nt, Brucella suis 1330
guugccgaucagcaucgcc

SEQ ID NO: 2481346 - RNA, 15 nt, Brucella suis 1330
guugccuucaucggc

SEQ ID NO: 2481347 - RNA, 17 nt, Brucella suis 1330
guugccuugcccauggu

SEQ ID NO: 2481348 - RNA, 13 nt, Brucella suis 1330
guugccuugcugg

SEQ ID NO: 2481349 - RNA, 17 nt, Brucella suis 1330
guugcgccaccacggcg

SEQ ID NO: 2481350 - RNA, 17 nt, Brucella suis 1330
guugcuccagcccuuuc

SEQ ID NO: 2481351 - RNA, 17 nt, Brucella suis 1330
guugcuggaacaucugc

SEQ ID NO: 2481352 - RNA, 13 nt, Brucella suis 1330
guuggaaaaugcg

SEQ ID NO: 2481353 - RNA, 15 nt, Brucella suis 1330
guuggaaacggcgca

SEQ ID NO: 2481354 - RNA, 13 nt, Brucella suis 1330
guuggagccgcuc

SEQ ID NO: 2481355 - RNA, 21 nt, Brucella suis 1330
guuggauagaccaccgcacgg

SEQ ID NO: 2481356 - RNA, 16 nt, Brucella suis 1330
guugugccugccgcgc

SEQ ID NO: 2481357 - RNA, 19 nt, Brucella suis 1330
uaggagcgugucuugccca

SEQ ID NO: 2481358 - RNA, 16 nt, Brucella suis 1330
uaggcaacaucgccuu

SEQ ID NO: 2481359 - RNA, 17 nt, Brucella suis 1330
uaggcauuuuccuuucu

SEQ ID NO: 2481360 - RNA, 15 nt, Brucella suis 1330
uaggcccaggccucu

SEQ ID NO: 2481361 - RNA, 16 nt, Brucella suis 1330
uaggcgcggcguggaa

SEQ ID NO: 2481362 - RNA, 18 nt, Brucella suis 1330
uaggcuucggccgcuugc

SEQ ID NO: 2481363 - RNA, 17 nt, Brucella suis 1330
uagggcaaggagcgagc

SEQ ID NO: 2481364 - RNA, 14 nt, Brucella suis 1330
uaggggccaaggcc

SEQ ID NO: 2481365 - RNA, 19 nt, Brucella suis 1330
uaggggccaaggccccaga

SEQ ID NO: 2481366 - RNA, 17 nt, Brucella suis 1330
uaggggucuucucuccg

SEQ ID NO: 2481367 - RNA, 17 nt, Brucella suis 1330
uaggugagcggcaggcc

SEQ ID NO: 2481368 - RNA, 20 nt, Brucella suis 1330
uaggugcgcggacgggcagg

SEQ ID NO: 2481369 - RNA, 23 nt, Brucella suis 1330
uaggugcgcggacgggcaggcag

SEQ ID NO: 2481370 - RNA, 14 nt, Brucella suis 1330
uagucaguuccugc

SEQ ID NO: 2481371 - RNA, 16 nt, Brucella suis 1330
uagucgaaaaaagaau

SEQ ID NO: 2481372 - RNA, 21 nt, Brucella suis 1330
uaguucaggccggccuugauc

SEQ ID NO: 2481373 - RNA, 17 nt, Brucella suis 1330
uauaagcggcucucaaa

SEQ ID NO: 2481374 - RNA, 13 nt, Brucella suis 1330
uauagagcagcac

SEQ ID NO: 2481375 - RNA, 14 nt, Brucella suis 1330
uauaugcaccagcg

SEQ ID NO: 2481376 - RNA, 16 nt, Brucella suis 1330
uaucaacgcugcaaca

SEQ ID NO: 2481377 - RNA, 17 nt, Brucella suis 1330
uaucaagccgguuugcu

SEQ ID NO: 2481378 - RNA, 17 nt, Brucella suis 1330
uaucaccagaccggcaa

SEQ ID NO: 2481379 - RNA, 14 nt, Brucella suis 1330
uaucacgcuugccc

SEQ ID NO: 2481380 - RNA, 22 nt, Brucella suis 1330
uaucacguaggggucuucucuc

SEQ ID NO: 2481381 - RNA, 19 nt, Brucella suis 1330
uaucagacgguccgccgga

SEQ ID NO: 2481382 - RNA, 11 nt, Brucella suis 1330
uauccacgccc

SEQ ID NO: 2481383 - RNA, 12 nt, Brucella suis 1330
uauccacgcccu

SEQ ID NO: 2481384 - RNA, 14 nt, Brucella suis 1330
uauccaggugcagu

SEQ ID NO: 2481385 - RNA, 15 nt, Brucella suis 1330
uauccauaucuuucc

SEQ ID NO: 2481386 - RNA, 20 nt, Brucella suis 1330
uauccgccaccgguuuucau

SEQ ID NO: 2481387 - RNA, 13 nt, Brucella suis 1330
uauccggcugggu

SEQ ID NO: 2481388 - RNA, 15 nt, Brucella suis 1330
uaucgagauugggcg

SEQ ID NO: 2481389 - RNA, 20 nt, Brucella suis 1330
uaucgcgaagauaagcggca

SEQ ID NO: 2481390 - RNA, 15 nt, Brucella suis 1330
uaucgcggaucggca

SEQ ID NO: 2481391 - RNA, 22 nt, Brucella suis 1330
uaucggauucuuaugccagaua

SEQ ID NO: 2481392 - RNA, 14 nt, Brucella suis 1330
uaucggucacagcg

SEQ ID NO: 2481393 - RNA, 22 nt, Brucella suis 1330
uaucugcgcgugcacgcgggcc

SEQ ID NO: 2481394 - RNA, 23 nt, Brucella suis 1330
uaucuuccgacccgucaaugcca

SEQ ID NO: 2481395 - RNA, 19 nt, Brucella suis 1330
uaugcagcguguuggccca

SEQ ID NO: 2481396 - RNA, 23 nt, Brucella suis 1330
uaugccagauaugcagcguguug

SEQ ID NO: 2481397 - RNA, 20 nt, Brucella suis 1330
uaugccgacgcgcucggcaa

SEQ ID NO: 2481398 - RNA, 11 nt, Brucella suis 1330
uauggcaaaag

SEQ ID NO: 2481399 - RNA, 22 nt, Brucella suis 1330
uauggcacaagaacagccgccc

SEQ ID NO: 2481400 - RNA, 19 nt, Brucella suis 1330
uauggcgcaaugccugcac

SEQ ID NO: 2481401 - RNA, 18 nt, Brucella suis 1330
uaugggcgguauugcugc

SEQ ID NO: 2481402 - RNA, 16 nt, Brucella suis 1330
uaugugucauaaaaaa

SEQ ID NO: 2481403 - RNA, 16 nt, Brucella suis 1330
uauucaggaucuuucc

SEQ ID NO: 2481404 - RNA, 22 nt, Brucella suis 1330
uauucaucguugcggcuugcca

SEQ ID NO: 2481405 - RNA, 10 nt, Brucella suis 1330
uauuccccua

SEQ ID NO: 2481406 - RNA, 16 nt, Brucella suis 1330
uauuccccuauucccc

SEQ ID NO: 2481407 - RNA, 13 nt, Brucella suis 1330
uauuccuuugauc

SEQ ID NO: 2481408 - RNA, 15 nt, Brucella suis 1330
uauucggccuugacg

SEQ ID NO: 2481409 - RNA, 21 nt, Brucella suis 1330
uauucggcgaccgccuuuucc

SEQ ID NO: 2481410 - RNA, 17 nt, Brucella suis 1330
uauugcccggaucaucc

SEQ ID NO: 2481411 - RNA, 23 nt, Brucella suis 1330
uauuucggcggaaccauggcugc

SEQ ID NO: 2481412 - RNA, 22 nt, Brucella suis 1330
uauuucugaugaacggcuauau

SEQ ID NO: 2481413 - RNA, 15 nt, Brucella suis 1330
agcgacuuccagugg

SEQ ID NO: 2481414 - RNA, 15 nt, Brucella suis 1330
agcgagaaugaggcc

SEQ ID NO: 2481415 - RNA, 20 nt, Brucella suis 1330
agcgagcgcacauaaaacgc

SEQ ID NO: 2481416 - RNA, 17 nt, Brucella suis 1330
agcgagcuugcaaugag

SEQ ID NO: 2481417 - RNA, 21 nt, Brucella suis 1330
agcgagcuugcaaugagcgcg

SEQ ID NO: 2481418 - RNA, 22 nt, Brucella suis 1330
agcgauaauccgauuaucgcga

SEQ ID NO: 2481419 - RNA, 17 nt, Brucella suis 1330
agcgaugauagcgcccg

SEQ ID NO: 2481420 - RNA, 19 nt, Brucella suis 1330
agcgaugccguggcgaaga

SEQ ID NO: 2481421 - RNA, 20 nt, Brucella suis 1330
agcgauggcgacgcgcucgu

SEQ ID NO: 2481422 - RNA, 17 nt, Brucella suis 1330
agcgauuccauuuuaac

SEQ ID NO: 2481423 - RNA, 16 nt, Brucella suis 1330
agcgauucgcgauccu

SEQ ID NO: 2481424 - RNA, 21 nt, Brucella suis 1330
agcgauuggcuucaaucagga

SEQ ID NO: 2481425 - RNA, 15 nt, Brucella suis 1330
agcgcaaaacagcgc

SEQ ID NO: 2481426 - RNA, 17 nt, Brucella suis 1330
agcgcaaagcgcgcgcc

SEQ ID NO: 2481427 - RNA, 21 nt, Brucella suis 1330
agcgcacauaaaacgcgccga

SEQ ID NO: 2481428 - RNA, 14 nt, Brucella suis 1330
agcgcacgcaggca

SEQ ID NO: 2481429 - RNA, 19 nt, Brucella suis 1330
agcgcacgcaggcaucaau

SEQ ID NO: 2481430 - RNA, 22 nt, Brucella suis 1330
agcgcaggcgcgaucaugccca

SEQ ID NO: 2481431 - RNA, 15 nt, Brucella suis 1330
agcgcauaaaggccg

SEQ ID NO: 2481432 - RNA, 15 nt, Brucella suis 1330
agcgcaucccgaaaa

SEQ ID NO: 2481433 - RNA, 19 nt, Brucella suis 1330
agcgcauccgccugcgcau

SEQ ID NO: 2481434 - RNA, 23 nt, Brucella suis 1330
agcgcaucgacaaucuccccuuc

SEQ ID NO: 2481435 - RNA, 12 nt, Brucella suis 1330
agcgcaucgcca

SEQ ID NO: 2481436 - RNA, 14 nt, Brucella suis 1330
agcgcaucgccacc

SEQ ID NO: 2481437 - RNA, 14 nt, Brucella suis 1330
agcgcaucgucuuc

SEQ ID NO: 2481438 - RNA, 16 nt, Brucella suis 1330
agcgcauggcagcaaa

SEQ ID NO: 2481439 - RNA, 14 nt, Brucella suis 1330
agcgcauuggcgac

SEQ ID NO: 2481440 - RNA, 14 nt, Brucella suis 1330
agcgccacgccuuc

SEQ ID NO: 2481441 - RNA, 13 nt, Brucella suis 1330
agcgccagauaaa

SEQ ID NO: 2481442 - RNA, 22 nt, Brucella suis 1330
agcgcccgaugaucuguucagc

SEQ ID NO: 2481443 - RNA, 19 nt, Brucella suis 1330
agcgcccgguggacaugaa

SEQ ID NO: 2481444 - RNA, 15 nt, Brucella suis 1330
agcgcccuugccgga

SEQ ID NO: 2481445 - RNA, 18 nt, Brucella suis 1330
agcgccgcauaauccuca

SEQ ID NO: 2481446 - RNA, 17 nt, Brucella suis 1330
agcgccggaaugggccu

SEQ ID NO: 2481447 - RNA, 22 nt, Brucella suis 1330
agcgccggaaugggccugauga

SEQ ID NO: 2481448 - RNA, 22 nt, Brucella suis 1330
agcgccggggccaaaggcggcu

SEQ ID NO: 2481449 - RNA, 21 nt, Brucella suis 1330
agcgccuacgcggggaaauca

SEQ ID NO: 2481450 - RNA, 19 nt, Brucella suis 1330
agcgccugcugccaugucu

SEQ ID NO: 2481451 - RNA, 18 nt, Brucella suis 1330
agcgccuuugccgcgcga

SEQ ID NO: 2481452 - RNA, 20 nt, Brucella suis 1330
agcgcgaagaccuucuggaa

SEQ ID NO: 2481453 - RNA, 23 nt, Brucella suis 1330
agcgcgaagaccuucuggaagcg

SEQ ID NO: 2481454 - RNA, 17 nt, Brucella suis 1330
agcgcgaaggacagaag

SEQ ID NO: 2481455 - RNA, 14 nt, Brucella suis 1330
agcgcgccacggau

SEQ ID NO: 2481456 - RNA, 23 nt, Brucella suis 1330
agcgcgcccaaucucgauaucgg

SEQ ID NO: 2481457 - RNA, 17 nt, Brucella suis 1330
agcgcgcgugagcgcgc

SEQ ID NO: 2481458 - RNA, 16 nt, Brucella suis 1330
agcgcggaaugacaug

SEQ ID NO: 2481459 - RNA, 17 nt, Brucella suis 1330
agcgcggaaugacaugg

SEQ ID NO: 2481460 - RNA, 17 nt, Brucella suis 1330
agcgcggagaugauggc

SEQ ID NO: 2481461 - RNA, 17 nt, Brucella suis 1330
agcgcggcaaugcgcuu

SEQ ID NO: 2481462 - RNA, 20 nt, Brucella suis 1330
agcgcggccuaccccucccu

SEQ ID NO: 2481463 - RNA, 21 nt, Brucella suis 1330
agcgcguucacguaggcgcgg

SEQ ID NO: 2481464 - RNA, 16 nt, Brucella suis 1330
agcgcguugccuugcu

SEQ ID NO: 2481465 - RNA, 15 nt, Brucella suis 1330
agcggaaaacggcug

SEQ ID NO: 2481466 - RNA, 20 nt, Brucella suis 1330
agcggaaccaucaucuucac

SEQ ID NO: 2481467 - RNA, 21 nt, Brucella suis 1330
agcggauaguucaaggcugcu

SEQ ID NO: 2481468 - RNA, 17 nt, Brucella suis 1330
agcggauauucggcguu

SEQ ID NO: 2481469 - RNA, 17 nt, Brucella suis 1330
agcggaucagcgcgccg

SEQ ID NO: 2481470 - RNA, 22 nt, Brucella suis 1330
agcggaucgcgucccuugccgc

SEQ ID NO: 2481471 - RNA, 23 nt, Brucella suis 1330
agcggaucgugagguucuugagg

SEQ ID NO: 2481472 - RNA, 12 nt, Brucella suis 1330
agcggcacauga

SEQ ID NO: 2481473 - RNA, 15 nt, Brucella suis 1330
agcggcacauucuug

SEQ ID NO: 2481474 - RNA, 20 nt, Brucella suis 1330
agcggcacguaaucgcguuc

SEQ ID NO: 2481475 - RNA, 15 nt, Brucella suis 1330
agcggcacuucgccg

SEQ ID NO: 2481476 - RNA, 21 nt, Brucella suis 1330
agcggcagaccugcgcaauga

SEQ ID NO: 2481477 - RNA, 13 nt, Brucella suis 1330
agcggcaggccgc

SEQ ID NO: 2481478 - RNA, 20 nt, Brucella suis 1330
agcggccggauuuugccuuc

SEQ ID NO: 2481479 - RNA, 20 nt, Brucella suis 1330
agcggcgcgaugcgaaacgg

SEQ ID NO: 2481480 - RNA, 12 nt, Brucella suis 1330
agcggcgcggca

SEQ ID NO: 2481481 - RNA, 18 nt, Brucella suis 1330
agcggcggguagccgcca

SEQ ID NO: 2481482 - RNA, 16 nt, Brucella suis 1330
agcggcgggugccgcg

SEQ ID NO: 2481483 - RNA, 15 nt, Brucella suis 1330
agcggcgugccgggc

SEQ ID NO: 2481484 - RNA, 20 nt, Brucella suis 1330
agcggcuccaccaccucgcc

SEQ ID NO: 2481485 - RNA, 14 nt, Brucella suis 1330
agcggcucgaccgu

SEQ ID NO: 2481486 - RNA, 22 nt, Brucella suis 1330
agcggcuucagaucgcgcggcg

SEQ ID NO: 2481487 - RNA, 22 nt, Brucella suis 1330
aggcggcccuuuucuauugaac

SEQ ID NO: 2481488 - RNA, 13 nt, Brucella suis 1330
aggcggcgcucga

SEQ ID NO: 2481489 - RNA, 12 nt, Brucella suis 1330
aggcgggaaggc

SEQ ID NO: 2481490 - RNA, 15 nt, Brucella suis 1330
aggcucggcaaaggg

SEQ ID NO: 2481491 - RNA, 13 nt, Brucella suis 1330
aggcugagugagc

SEQ ID NO: 2481492 - RNA, 18 nt, Brucella suis 1330
aggcugaguuuuccgcuu

SEQ ID NO: 2481493 - RNA, 17 nt, Brucella suis 1330
aggcugccgggguuuuu

SEQ ID NO: 2481494 - RNA, 21 nt, Brucella suis 1330
aggcugcugcacuugcgccaa

SEQ ID NO: 2481495 - RNA, 15 nt, Brucella suis 1330
aggcuggcaucgcca

SEQ ID NO: 2481496 - RNA, 15 nt, Brucella suis 1330
aggcuggccaugcgg

SEQ ID NO: 2481497 - RNA, 14 nt, Brucella suis 1330
aggcuggcgccgcc

SEQ ID NO: 2481498 - RNA, 14 nt, Brucella suis 1330
aggcuguccggcuc

SEQ ID NO: 2481499 - RNA, 21 nt, Brucella suis 1330
aggcuuccgaaucgcuguugg

SEQ ID NO: 2481500 - RNA, 13 nt, Brucella suis 1330
aggcuucggccgc

SEQ ID NO: 2481501 - RNA, 15 nt, Brucella suis 1330
agggaacugcggauc

SEQ ID NO: 2481502 - RNA, 22 nt, Brucella suis 1330
agggaaucgcgcaauucaugcc

SEQ ID NO: 2481503 - RNA, 13 nt, Brucella suis 1330
agggaaugggauc

SEQ ID NO: 2481504 - RNA, 14 nt, Brucella suis 1330
agggauaaagccug

SEQ ID NO: 2481505 - RNA, 21 nt, Brucella suis 1330
agggauugcgcaagugcugca

SEQ ID NO: 2481506 - RNA, 14 nt, Brucella suis 1330
agggcaaggcgcgc

SEQ ID NO: 2481507 - RNA, 16 nt, Brucella suis 1330
agggcaguagggcagu

SEQ ID NO: 2481508 - RNA, 14 nt, Brucella suis 1330
agggcauugccgag

SEQ ID NO: 2481509 - RNA, 21 nt, Brucella suis 1330
agggccacuccguugccgaga

SEQ ID NO: 2481510 - RNA, 13 nt, Brucella suis 1330
agggccagaagau

SEQ ID NO: 2481511 - RNA, 18 nt, Brucella suis 1330
agggccagaucgcgcgcg

SEQ ID NO: 2481512 - RNA, 15 nt, Brucella suis 1330
agggccgaugccgau

SEQ ID NO: 2481513 - RNA, 17 nt, Brucella suis 1330
agggccgcaucggaagg

SEQ ID NO: 2481514 - RNA, 11 nt, Brucella suis 1330
agggccgccga

SEQ ID NO: 2481515 - RNA, 15 nt, Brucella suis 1330
agggccgcucaaggc

SEQ ID NO: 2481516 - RNA, 20 nt, Brucella suis 1330
agggccgguuucccggcccu

SEQ ID NO: 2481517 - RNA, 21 nt, Brucella suis 1330
agggccgguuucccggcccuu

SEQ ID NO: 2481518 - RNA, 12 nt, Brucella suis 1330
agggcgcgccag

SEQ ID NO: 2481519 - RNA, 17 nt, Brucella suis 1330
agggcggcaagcugcuc

SEQ ID NO: 2481520 - RNA, 20 nt, Brucella suis 1330
agggcggcuuucgccgcccu

SEQ ID NO: 2481521 - RNA, 15 nt, Brucella suis 1330
agggcgggcggccag

SEQ ID NO: 2481522 - RNA, 19 nt, Brucella suis 1330
agggcgggcggccaggaca

SEQ ID NO: 2481523 - RNA, 16 nt, Brucella suis 1330
agggcguaaucagcgu

SEQ ID NO: 2481524 - RNA, 17 nt, Brucella suis 1330
agggcguauccggcccc

SEQ ID NO: 2481525 - RNA, 13 nt, Brucella suis 1330
agggcugagggaa

SEQ ID NO: 2481526 - RNA, 22 nt, Brucella suis 1330
agggcugccgcacagcaucaug

SEQ ID NO: 2481527 - RNA, 17 nt, Brucella suis 1330
aggggaacgacgcgcua

SEQ ID NO: 2481528 - RNA, 13 nt, Brucella suis 1330
aggggaugggggc

SEQ ID NO: 2481529 - RNA, 15 nt, Brucella suis 1330
aggggugcaaagcuu

SEQ ID NO: 2481530 - RNA, 21 nt, Brucella suis 1330
agggguuuuucaucaaucuga

SEQ ID NO: 2481531 - RNA, 23 nt, Brucella suis 1330
aggguaagcgccuuugccgcgcg

SEQ ID NO: 2481532 - RNA, 12 nt, Brucella suis 1330
agggucgcgacc

SEQ ID NO: 2481533 - RNA, 17 nt, Brucella suis 1330
agggucgcgaccuucuu

SEQ ID NO: 2481534 - RNA, 22 nt, Brucella suis 1330
agguacuggcaauaaaaggcaa

SEQ ID NO: 2481535 - RNA, 19 nt, Brucella suis 1330
aggucaaaaagggcuuccu

SEQ ID NO: 2481536 - RNA, 20 nt, Brucella suis 1330
aggucacgcccaugaucgcg

SEQ ID NO: 2481537 - RNA, 17 nt, Brucella suis 1330
aggucagaagaccaaac

SEQ ID NO: 2481538 - RNA, 15 nt, Brucella suis 1330
aggucgucuuucagu

SEQ ID NO: 2481539 - RNA, 14 nt, Brucella suis 1330
aggucgugcauuug

SEQ ID NO: 2481540 - RNA, 17 nt, Brucella suis 1330
aggucgugcuauagcca

SEQ ID NO: 2481541 - RNA, 17 nt, Brucella suis 1330
aggucuuccgggacaau

SEQ ID NO: 2481542 - RNA, 13 nt, Brucella suis 1330
aggucuuucugcu

SEQ ID NO: 2481543 - RNA, 17 nt, Brucella suis 1330
aggugaaggccugcuuc

SEQ ID NO: 2481544 - RNA, 15 nt, Brucella suis 1330
aggugagcggcaggc

SEQ ID NO: 2481545 - RNA, 16 nt, Brucella suis 1330
aggugcagucuucggc

SEQ ID NO: 2481546 - RNA, 18 nt, Brucella suis 1330
agguggcugcccgccgca

SEQ ID NO: 2481547 - RNA, 18 nt, Brucella suis 1330
agguguuucgcgcaaugg

SEQ ID NO: 2481548 - RNA, 19 nt, Brucella suis 1330
agguuacauggacgcgguu

SEQ ID NO: 2481549 - RNA, 16 nt, Brucella suis 1330
agguugagcugcucgg

SEQ ID NO: 2481550 - RNA, 16 nt, Brucella suis 1330
agguugaugccgggca

SEQ ID NO: 2481551 - RNA, 21 nt, Brucella suis 1330
agguuuccggcugccuuggca

SEQ ID NO: 2481552 - RNA, 17 nt, Brucella suis 1330
agguuuuacgggcggca

SEQ ID NO: 2481553 - RNA, 21 nt, Brucella suis 1330
aguaaagucugauagcaaggc

SEQ ID NO: 2481554 - RNA, 19 nt, Brucella suis 1330
aguaagggaaaaaaucacc

SEQ ID NO: 2481555 - RNA, 15 nt, Brucella suis 1330
aguaggccccgucau

SEQ ID NO: 2481556 - RNA, 22 nt, Brucella suis 1330
aguagggcaguagggcagugaa

SEQ ID NO: 2481557 - RNA, 20 nt, Brucella suis 1330
aguagggcagugaagaauau

SEQ ID NO: 2481558 - RNA, 15 nt, Brucella suis 1330
agucacgccaucagc

SEQ ID NO: 2481559 - RNA, 13 nt, Brucella suis 1330
agucaucaccgcg

SEQ ID NO: 2481560 - RNA, 14 nt, Brucella suis 1330
aguccacuggacug

SEQ ID NO: 2481561 - RNA, 20 nt, Brucella suis 1330
agucccauuggucugucucc

SEQ ID NO: 2481562 - RNA, 15 nt, Brucella suis 1330
aguccccgugccgga

SEQ ID NO: 2481563 - RNA, 20 nt, Brucella suis 1330
aguccucggcaauccccgga

SEQ ID NO: 2481564 - RNA, 17 nt, Brucella suis 1330
aguccugaaaccauacc

SEQ ID NO: 2481565 - RNA, 14 nt, Brucella suis 1330
agucgaauuucagc

SEQ ID NO: 2481566 - RNA, 14 nt, Brucella suis 1330
agucgacaauguca

SEQ ID NO: 2481567 - RNA, 12 nt, Brucella suis 1330
agucgaggaagc

SEQ ID NO: 2481568 - RNA, 18 nt, Brucella suis 1330
agucgauguucggguaga

SEQ ID NO: 2481569 - RNA, 18 nt, Brucella suis 1330
agucgcccacgguuuuug

SEQ ID NO: 2481570 - RNA, 19 nt, Brucella suis 1330
agucgccgaaauuggccgc

SEQ ID NO: 2481571 - RNA, 14 nt, Brucella suis 1330
agucggcaaggcgg

SEQ ID NO: 2481572 - RNA, 16 nt, Brucella suis 1330
agucggcaaggcggcu

SEQ ID NO: 2481573 - RNA, 21 nt, Brucella suis 1330
agucuggaacguguugagauc

SEQ ID NO: 2481574 - RNA, 15 nt, Brucella suis 1330
agucuucggccgggc

SEQ ID NO: 2481575 - RNA, 19 nt, Brucella suis 1330
agucuucuugugaacaugg

SEQ ID NO: 2481576 - RNA, 16 nt, Brucella suis 1330
agucuugcguuaaaga

SEQ ID NO: 2481577 - RNA, 13 nt, Brucella suis 1330
agugaagcgaaga

SEQ ID NO: 2481578 - RNA, 15 nt, Brucella suis 1330
agugaccagcgccga

SEQ ID NO: 2481579 - RNA, 21 nt, Brucella suis 1330
agugagccuuccguugcagcc

SEQ ID NO: 2481580 - RNA, 21 nt, Brucella suis 1330
agugcauaugaugaacgucaa

SEQ ID NO: 2481581 - RNA, 13 nt, Brucella suis 1330
agugccaccagau

SEQ ID NO: 2481582 - RNA, 23 nt, Brucella suis 1330
agugccgccaucggcaaaggcuc

SEQ ID NO: 2481583 - RNA, 13 nt, Brucella suis 1330
agugccgcgccga

SEQ ID NO: 2481584 - RNA, 13 nt, Brucella suis 1330
agugcgcacauug

SEQ ID NO: 2481585 - RNA, 24 nt, Brucella suis 1330
agugcgccaccgcgaaagccagaa

SEQ ID NO: 2481586 - RNA, 23 nt, Brucella suis 1330
agugcugaaaaggcuggccaugc

SEQ ID NO: 2481587 - RNA, 18 nt, Brucella suis 1330
aguggaucgacauauuug

SEQ ID NO: 2481588 - RNA, 22 nt, Brucella suis 1330
aguggaucuuugaaaccggcca

SEQ ID NO: 2481589 - RNA, 20 nt, Brucella suis 1330
aguggcaugggagcaccgca

SEQ ID NO: 2481590 - RNA, 18 nt, Brucella suis 1330
aguggucugggcgaugag

SEQ ID NO: 2481591 - RNA, 22 nt, Brucella suis 1330
aguguccacgcgcuugaggcuc

SEQ ID NO: 2481592 - RNA, 22 nt, Brucella suis 1330
agugucgaccggcggcaggcag

SEQ ID NO: 2481593 - RNA, 22 nt, Brucella suis 1330
agugugcagacaggccagucgc

SEQ ID NO: 2481594 - RNA, 17 nt, Brucella suis 1330
aguuaaugccuuugcug

SEQ ID NO: 2481595 - RNA, 17 nt, Brucella suis 1330
aguucaaggcugcugca

SEQ ID NO: 2481596 - RNA, 22 nt, Brucella suis 1330
aguucauccguucgaucggugg

SEQ ID NO: 2481597 - RNA, 12 nt, Brucella suis 1330
aguuccauccau

SEQ ID NO: 2481598 - RNA, 13 nt, Brucella suis 1330
aguuccggcccgc

SEQ ID NO: 2481599 - RNA, 17 nt, Brucella suis 1330
aguuccggcggaaagcg

SEQ ID NO: 2481600 - RNA, 18 nt, Brucella suis 1330
aguuccggcggaaagcgc

SEQ ID NO: 2481601 - RNA, 22 nt, Brucella suis 1330
aguuccugcgcgaacacgauga

SEQ ID NO: 2481602 - RNA, 12 nt, Brucella suis 1330
aguuccuucuug

SEQ ID NO: 2481603 - RNA, 12 nt, Brucella suis 1330
aguucgcccguc

SEQ ID NO: 2481604 - RNA, 23 nt, Brucella suis 1330
aucacgcggcgcaaagcccagcc

SEQ ID NO: 2481605 - RNA, 18 nt, Brucella suis 1330
aucacggccauugcccaa

SEQ ID NO: 2481606 - RNA, 21 nt, Brucella suis 1330
aucacggccauugcccaaaag

SEQ ID NO: 2481607 - RNA, 23 nt, Brucella suis 1330
aucacgucggucaaugccaccgc

SEQ ID NO: 2481608 - RNA, 16 nt, Brucella suis 1330
aucagaaaucagucca

SEQ ID NO: 2481609 - RNA, 17 nt, Brucella suis 1330
aucagaagugcugcugc

SEQ ID NO: 2481610 - RNA, 20 nt, Brucella suis 1330
aucagaagugcugcugcaau

SEQ ID NO: 2481611 - RNA, 21 nt, Brucella suis 1330
aucagaagugcugcugcaauc

SEQ ID NO: 2481612 - RNA, 15 nt, Brucella suis 1330
aucagauagccggug

SEQ ID NO: 2481613 - RNA, 16 nt, Brucella suis 1330
aucagcauuaugcggc

SEQ ID NO: 2481614 - RNA, 12 nt, Brucella suis 1330
aucagccagccg

SEQ ID NO: 2481615 - RNA, 15 nt, Brucella suis 1330
aucagccagccgaca

SEQ ID NO: 2481616 - RNA, 18 nt, Brucella suis 1330
aucagcgcgccggucuuc

SEQ ID NO: 2481617 - RNA, 15 nt, Brucella suis 1330
aucagcuugccgcca

SEQ ID NO: 2481618 - RNA, 10 nt, Brucella suis 1330
aucagcuugg

SEQ ID NO: 2481619 - RNA, 14 nt, Brucella suis 1330
aucaggauuuggga

SEQ ID NO: 2481620 - RNA, 19 nt, Brucella suis 1330
aucaggauuugggaucggc

SEQ ID NO: 2481621 - RNA, 20 nt, Brucella suis 1330
aucaggucgagcgccugucc

SEQ ID NO: 2481622 - RNA, 14 nt, Brucella suis 1330
aucagguugaugcc

SEQ ID NO: 2481623 - RNA, 20 nt, Brucella suis 1330
aucaguacgccgccuuccca

SEQ ID NO: 2481624 - RNA, 18 nt, Brucella suis 1330
aucagucgaauuucagca

SEQ ID NO: 2481625 - RNA, 16 nt, Brucella suis 1330
aucagugccaccagau

SEQ ID NO: 2481626 - RNA, 20 nt, Brucella suis 1330
aucauaacagaugcgggacu

SEQ ID NO: 2481627 - RNA, 19 nt, Brucella suis 1330
aucaucaaugugcccugcg

SEQ ID NO: 2481628 - RNA, 14 nt, Brucella suis 1330
aucauccggcucau

SEQ ID NO: 2481629 - RNA, 16 nt, Brucella suis 1330
aucaucugccaaccau

SEQ ID NO: 2481630 - RNA, 19 nt, Brucella suis 1330
aucaugcucgucggaaaua

SEQ ID NO: 2481631 - RNA, 19 nt, Brucella suis 1330
aucauugccccaaggcgca

SEQ ID NO: 2481632 - RNA, 16 nt, Brucella suis 1330
aucauuggauagaugg

SEQ ID NO: 2481633 - RNA, 21 nt, Brucella suis 1330
aucauuggcguugagccgcgc

SEQ ID NO: 2481634 - RNA, 14 nt, Brucella suis 1330
aucauuuauuuuag

SEQ ID NO: 2481635 - RNA, 14 nt, Brucella suis 1330
auccaccgcgcuga

SEQ ID NO: 2481636 - RNA, 13 nt, Brucella suis 1330
auccacgcccuga

SEQ ID NO: 2481637 - RNA, 14 nt, Brucella suis 1330
auccagaucuuccu

SEQ ID NO: 2481638 - RNA, 14 nt, Brucella suis 1330
auccagcacuucca

SEQ ID NO: 2481639 - RNA, 14 nt, Brucella suis 1330
auccagcagauccg

SEQ ID NO: 2481640 - RNA, 18 nt, Brucella suis 1330
auccagcuugcagugcag

SEQ ID NO: 2481641 - RNA, 16 nt, Brucella suis 1330
auccaggugcagucuu

SEQ ID NO: 2481642 - RNA, 23 nt, Brucella suis 1330
auccaggugcagucuucggccgg

SEQ ID NO: 2481643 - RNA, 19 nt, Brucella suis 1330
auccaguugucgccgggcu

SEQ ID NO: 2481644 - RNA, 20 nt, Brucella suis 1330
auccauagcgaauggcaauu

SEQ ID NO: 2481645 - RNA, 15 nt, Brucella suis 1330
auccauaucuuucca

SEQ ID NO: 2481646 - RNA, 19 nt, Brucella suis 1330
auccauaugcagcggcacu

SEQ ID NO: 2481647 - RNA, 15 nt, Brucella suis 1330
auccaugagcagcgg

SEQ ID NO: 2481648 - RNA, 19 nt, Brucella suis 1330
auccauuccucaagauaca

SEQ ID NO: 2481649 - RNA, 21 nt, Brucella suis 1330
aucccgccccuaaaggcucug

SEQ ID NO: 2481650 - RNA, 19 nt, Brucella suis 1330
aucccucaaaacgcugcca

SEQ ID NO: 2481651 - RNA, 15 nt, Brucella suis 1330
aucccuuacuccauu

SEQ ID NO: 2481652 - RNA, 12 nt, Brucella suis 1330
auccgacgcauc

SEQ ID NO: 2481653 - RNA, 17 nt, Brucella suis 1330
auccgaggcgcgcagca

SEQ ID NO: 2481654 - RNA, 22 nt, Brucella suis 1330
auccgaucggcgcucuaauccu

SEQ ID NO: 2481655 - RNA, 19 nt, Brucella suis 1330
auccgcaauacgccuggcc

SEQ ID NO: 2481656 - RNA, 21 nt, Brucella suis 1330
auccgcauucccuugaaauca

SEQ ID NO: 2481657 - RNA, 17 nt, Brucella suis 1330
auccgccaaucagaaug

SEQ ID NO: 2481658 - RNA, 17 nt, Brucella suis 1330
auccgccaccgcgccgg

SEQ ID NO: 2481659 - RNA, 15 nt, Brucella suis 1330
auccgccaccgguuu

SEQ ID NO: 2481660 - RNA, 17 nt, Brucella suis 1330
auccgccaccgguuuuc

SEQ ID NO: 2481661 - RNA, 18 nt, Brucella suis 1330
auccgccaccgguuuuca

SEQ ID NO: 2481662 - RNA, 20 nt, Brucella suis 1330
auccgccaccgguuuucauc

SEQ ID NO: 2481663 - RNA, 18 nt, Brucella suis 1330
auccgccgaacccgccga

SEQ ID NO: 2481664 - RNA, 19 nt, Brucella suis 1330
auccgcugacugcgccauc

SEQ ID NO: 2481665 - RNA, 19 nt, Brucella suis 1330
auccggccccuuucgcauc

SEQ ID NO: 2481666 - RNA, 19 nt, Brucella suis 1330
auccggcguggugcccgcc

SEQ ID NO: 2481667 - RNA, 15 nt, Brucella suis 1330
auccgguaagcgucg

SEQ ID NO: 2481668 - RNA, 22 nt, Brucella suis 1330
auccucaacgaccauuuccgca

SEQ ID NO: 2481669 - RNA, 17 nt, Brucella suis 1330
auccucaagcaucuuga

SEQ ID NO: 2481670 - RNA, 20 nt, Brucella suis 1330
auccucaagcaucuugauuu

SEQ ID NO: 2481671 - RNA, 12 nt, Brucella suis 1330
auccucccaugc

SEQ ID NO: 2481672 - RNA, 13 nt, Brucella suis 1330
auccuccugcgcc

SEQ ID NO: 2481673 - RNA, 18 nt, Brucella suis 1330
auccugcucggcgcggcg

SEQ ID NO: 2481674 - RNA, 23 nt, Brucella suis 1330
auccugcugcgcggcauugguga

SEQ ID NO: 2481675 - RNA, 16 nt, Brucella suis 1330
auccugcuucgaucag

SEQ ID NO: 2481676 - RNA, 14 nt, Brucella suis 1330
auccuguagacgaa

SEQ ID NO: 2481677 - RNA, 22 nt, Brucella suis 1330
auccuguagacgaacucgaugc

SEQ ID NO: 2481678 - RNA, 15 nt, Brucella suis 1330
auccuguucaagcag

SEQ ID NO: 2481679 - RNA, 17 nt, Brucella suis 1330
auccuugucggcaucgg

SEQ ID NO: 2481680 - RNA, 22 nt, Brucella suis 1330
auccuugucggcaucggucuug

SEQ ID NO: 2481681 - RNA, 23 nt, Brucella suis 1330
auccuugucggcaucggucuugc

SEQ ID NO: 2481682 - RNA, 16 nt, Brucella suis 1330
auccuuuccaguucca

SEQ ID NO: 2481683 - RNA, 22 nt, Brucella suis 1330
aucgaagcgggaucagaaauca

SEQ ID NO: 2481684 - RNA, 17 nt, Brucella suis 1330
aucgaauagggcaugga

SEQ ID NO: 2481685 - RNA, 12 nt, Brucella suis 1330
aucgacaaaggu

SEQ ID NO: 2481686 - RNA, 18 nt, Brucella suis 1330
aucgacaaucuccccuuc

SEQ ID NO: 2481687 - RNA, 23 nt, Brucella suis 1330
aucgacauauuugucgccgacuu

SEQ ID NO: 2481688 - RNA, 20 nt, Brucella suis 1330
aucgagcgcgaaggacagaa

SEQ ID NO: 2481689 - RNA, 23 nt, Brucella suis 1330
aucgaggaauuuccgcuccuggu

SEQ ID NO: 2481690 - RNA, 15 nt, Brucella suis 1330
aucgaugagaucguu

SEQ ID NO: 2481691 - RNA, 23 nt, Brucella suis 1330
aucgauuucguccagaucggccu

SEQ ID NO: 2481692 - RNA, 19 nt, Brucella suis 1330
aucgauuugcgcaccagau

SEQ ID NO: 2481693 - RNA, 13 nt, Brucella suis 1330
aucgcacgauagc

SEQ ID NO: 2481694 - RNA, 19 nt, Brucella suis 1330
aucgcacgauagccgcgga

SEQ ID NO: 2481695 - RNA, 21 nt, Brucella suis 1330
aucgcaggcuuuauuccauca

SEQ ID NO: 2481696 - RNA, 15 nt, Brucella suis 1330
aucgcauccaguccg

SEQ ID NO: 2481697 - RNA, 13 nt, Brucella suis 1330
aucgccaauuccg

SEQ ID NO: 2481698 - RNA, 16 nt, Brucella suis 1330
aucgccaauuccgccg

SEQ ID NO: 2481699 - RNA, 18 nt, Brucella suis 1330
aucgccaguuucauuucc

SEQ ID NO: 2481700 - RNA, 21 nt, Brucella suis 1330
aucgcccacgaggaucggcac

SEQ ID NO: 2481701 - RNA, 13 nt, Brucella suis 1330
aucgcccgccgcg

SEQ ID NO: 2481702 - RNA, 22 nt, Brucella suis 1330
aucgccgcgcgggcuugaacaa

SEQ ID NO: 2481703 - RNA, 17 nt, Brucella suis 1330
aucgccgggccuugcca

SEQ ID NO: 2481704 - RNA, 14 nt, Brucella suis 1330
aucgccugaaugaa

SEQ ID NO: 2481705 - RNA, 14 nt, Brucella suis 1330
aucgccugcuuccu

SEQ ID NO: 2481706 - RNA, 22 nt, Brucella suis 1330
aucgcgaagaagaauacgcagc

SEQ ID NO: 2481707 - RNA, 17 nt, Brucella suis 1330
aucgcgauaauauugaa

SEQ ID NO: 2481708 - RNA, 23 nt, Brucella suis 1330
aucgcgcaggacuucacccgcca

SEQ ID NO: 2481709 - RNA, 20 nt, Brucella suis 1330
aucgcgccgucgccgaccgc

SEQ ID NO: 2481710 - RNA, 17 nt, Brucella suis 1330
aucgcgcggcgaaacgc

SEQ ID NO: 2481711 - RNA, 13 nt, Brucella suis 1330
aucgcgcugcucg

SEQ ID NO: 2481712 - RNA, 17 nt, Brucella suis 1330
aucgcggcagccgccgc

SEQ ID NO: 2481713 - RNA, 19 nt, Brucella suis 1330
aucgcuauuuggcacucau

SEQ ID NO: 2481714 - RNA, 17 nt, Brucella suis 1330
aucgcucaccuuuucca

SEQ ID NO: 2481715 - RNA, 24 nt, Brucella suis 1330
aucgcucauauggaugccgccgca

SEQ ID NO: 2481716 - RNA, 19 nt, Brucella suis 1330
aucgcucgaaggcagccgu

SEQ ID NO: 2481717 - RNA, 12 nt, Brucella suis 1330
aucgcuggaacc

SEQ ID NO: 2481718 - RNA, 19 nt, Brucella suis 1330
aucgcuggaaggaaugggc

SEQ ID NO: 2481719 - RNA, 17 nt, Brucella suis 1330
aucgcuuucgagcggau

SEQ ID NO: 2481720 - RNA, 21 nt, Brucella suis 1330
augccguuuucaucaaauuug

SEQ ID NO: 2481721 - RNA, 18 nt, Brucella suis 1330
augccuucccgccagccg

SEQ ID NO: 2481722 - RNA, 22 nt, Brucella suis 1330
augccuugauccagucggcaag

SEQ ID NO: 2481723 - RNA, 14 nt, Brucella suis 1330
augccuuucagguc

SEQ ID NO: 2481724 - RNA, 14 nt, Brucella suis 1330
augcgacaaaacaa

SEQ ID NO: 2481725 - RNA, 19 nt, Brucella suis 1330
augcgauccuuguucuugg

SEQ ID NO: 2481726 - RNA, 15 nt, Brucella suis 1330
augcgcaaccaaaac

SEQ ID NO: 2481727 - RNA, 19 nt, Brucella suis 1330
augcgcaugaagcgcggcg

SEQ ID NO: 2481728 - RNA, 20 nt, Brucella suis 1330
augcgccacuucccgcgccu

SEQ ID NO: 2481729 - RNA, 17 nt, Brucella suis 1330
augcgccuugcgccgca

SEQ ID NO: 2481730 - RNA, 17 nt, Brucella suis 1330
augcgcgccagccgcca

SEQ ID NO: 2481731 - RNA, 13 nt, Brucella suis 1330
augcgcgcccggc

SEQ ID NO: 2481732 - RNA, 14 nt, Brucella suis 1330
augcgcgcccggcg

SEQ ID NO: 2481733 - RNA, 16 nt, Brucella suis 1330
augcgcggcgccagcg

SEQ ID NO: 2481734 - RNA, 20 nt, Brucella suis 1330
augcgcggcggcaacgggcg

SEQ ID NO: 2481735 - RNA, 17 nt, Brucella suis 1330
augcgcucccggucuuc

SEQ ID NO: 2481736 - RNA, 20 nt, Brucella suis 1330
augcgcuucgcgcaggccgc

SEQ ID NO: 2481737 - RNA, 23 nt, Brucella suis 1330
augcgcuucgcgcaggccgcggc

SEQ ID NO: 2481738 - RNA, 20 nt, Brucella suis 1330
augcgcuuuaaagcaggauc

SEQ ID NO: 2481739 - RNA, 18 nt, Brucella suis 1330
augcggaacacgccgcca

SEQ ID NO: 2481740 - RNA, 20 nt, Brucella suis 1330
augcggaucguaucgccaau

SEQ ID NO: 2481741 - RNA, 14 nt, Brucella suis 1330
augcggcggcgcgc

SEQ ID NO: 2481742 - RNA, 17 nt, Brucella suis 1330
augcggcggugaaaaua

SEQ ID NO: 2481743 - RNA, 17 nt, Brucella suis 1330
augcggggcgacgcugc

SEQ ID NO: 2481744 - RNA, 19 nt, Brucella suis 1330
augcguaaaaauaaagaaa

SEQ ID NO: 2481745 - RNA, 19 nt, Brucella suis 1330
augcguaccauaggcgcgc

SEQ ID NO: 2481746 - RNA, 23 nt, Brucella suis 1330
augcguccgacaugggccgggcg

SEQ ID NO: 2481747 - RNA, 16 nt, Brucella suis 1330
augcgucgauggccgg

SEQ ID NO: 2481748 - RNA, 20 nt, Brucella suis 1330
augcgugguccagccagccg

SEQ ID NO: 2481749 - RNA, 22 nt, Brucella suis 1330
augcguucucaagagcccgccg

SEQ ID NO: 2481750 - RNA, 23 nt, Brucella suis 1330
augcguucucaagagcccgccga

SEQ ID NO: 2481751 - RNA, 16 nt, Brucella suis 1330
augcguugaaugcaga

SEQ ID NO: 2481752 - RNA, 18 nt, Brucella suis 1330
augcguugcuggaacauc

SEQ ID NO: 2481753 - RNA, 19 nt, Brucella suis 1330
augcguuuucgagccaaaa

SEQ ID NO: 2481754 - RNA, 14 nt, Brucella suis 1330
augcucuuucugga

SEQ ID NO: 2481755 - RNA, 15 nt, Brucella suis 1330
auggaaaaacccggc

SEQ ID NO: 2481756 - RNA, 16 nt, Brucella suis 1330
auggaaaaacccggcc

SEQ ID NO: 2481757 - RNA, 18 nt, Brucella suis 1330
auggaaagagccuguuca

SEQ ID NO: 2481758 - RNA, 15 nt, Brucella suis 1330
auggaaauagcacau

SEQ ID NO: 2481759 - RNA, 16 nt, Brucella suis 1330
auggaaauagcacaua

SEQ ID NO: 2481760 - RNA, 16 nt, Brucella suis 1330
auggaaggaaagccca

SEQ ID NO: 2481761 - RNA, 11 nt, Brucella suis 1330
auggaauaucg

SEQ ID NO: 2481762 - RNA, 18 nt, Brucella suis 1330
auggaaucgcuggaaccg

SEQ ID NO: 2481763 - RNA, 16 nt, Brucella suis 1330
auggacugaaugcaga

SEQ ID NO: 2481764 - RNA, 13 nt, Brucella suis 1330
auggagcauuucc

SEQ ID NO: 2481765 - RNA, 16 nt, Brucella suis 1330
auggauugcgggcaug

SEQ ID NO: 2481766 - RNA, 17 nt, Brucella suis 1330
auggauugcgggcauga

SEQ ID NO: 2481767 - RNA, 14 nt, Brucella suis 1330
auggcaaucuccau

SEQ ID NO: 2481768 - RNA, 17 nt, Brucella suis 1330
auggcaaucuccaucgu

SEQ ID NO: 2481769 - RNA, 16 nt, Brucella suis 1330
auggcacaagaacagc

SEQ ID NO: 2481770 - RNA, 14 nt, Brucella suis 1330
auggcacgcacaag

SEQ ID NO: 2481771 - RNA, 15 nt, Brucella suis 1330
auggcauuggcugcu

SEQ ID NO: 2481772 - RNA, 23 nt, Brucella suis 1330
auggccacgacagggcgcugcga

SEQ ID NO: 2481773 - RNA, 16 nt, Brucella suis 1330
auggccacgcaaucuu

SEQ ID NO: 2481774 - RNA, 19 nt, Brucella suis 1330
auggcccagaaccugcccg

SEQ ID NO: 2481775 - RNA, 14 nt, Brucella suis 1330
auggcccugucagc

SEQ ID NO: 2481776 - RNA, 15 nt, Brucella suis 1330
auggccgccccggcg

SEQ ID NO: 2481777 - RNA, 14 nt, Brucella suis 1330
auggccugcgcgcg

SEQ ID NO: 2481778 - RNA, 14 nt, Brucella suis 1330
auggccugcugcau

SEQ ID NO: 2481779 - RNA, 18 nt, Brucella suis 1330
auggccugcugcauuuuc

SEQ ID NO: 2481780 - RNA, 22 nt, Brucella suis 1330
auggccugcugcauuuucugca

SEQ ID NO: 2481781 - RNA, 15 nt, Brucella suis 1330
auggcgaaaucgcca

SEQ ID NO: 2481782 - RNA, 16 nt, Brucella suis 1330
auggcgaaaucgccac

SEQ ID NO: 2481783 - RNA, 17 nt, Brucella suis 1330
auggcgagcuggaaacg

SEQ ID NO: 2481784 - RNA, 23 nt, Brucella suis 1330
auggcgauaauaauuggcaagcg

SEQ ID NO: 2481785 - RNA, 12 nt, Brucella suis 1330
auggcgccgcau

SEQ ID NO: 2481786 - RNA, 12 nt, Brucella suis 1330
auggcgcgcgcg

SEQ ID NO: 2481787 - RNA, 14 nt, Brucella suis 1330
auggcggcgcucgg

SEQ ID NO: 2481788 - RNA, 21 nt, Brucella suis 1330
auggcgggccaugccugcgaa

SEQ ID NO: 2481789 - RNA, 16 nt, Brucella suis 1330
auggcgggccauuucc

SEQ ID NO: 2481790 - RNA, 23 nt, Brucella suis 1330
auggcgggccauuuccaaugccu

SEQ ID NO: 2481791 - RNA, 21 nt, Brucella suis 1330
auggcgguaaugcuggccacc

SEQ ID NO: 2481792 - RNA, 17 nt, Brucella suis 1330
auggcguccccaucgaa

SEQ ID NO: 2481793 - RNA, 13 nt, Brucella suis 1330
auggcgugccgaa

SEQ ID NO: 2481794 - RNA, 16 nt, Brucella suis 1330
auggcucagagaagug

SEQ ID NO: 2481795 - RNA, 21 nt, Brucella suis 1330
auggcucagcuucgggaagug

SEQ ID NO: 2481796 - RNA, 13 nt, Brucella suis 1330
auggcugcccgcg

SEQ ID NO: 2481797 - RNA, 17 nt, Brucella suis 1330
auggcugcccgcgccgg

SEQ ID NO: 2481798 - RNA, 17 nt, Brucella suis 1330
auggcugcgauggaugu

SEQ ID NO: 2481799 - RNA, 22 nt, Brucella suis 1330
auggcuggaaauuuaucgucac

SEQ ID NO: 2481800 - RNA, 14 nt, Brucella suis 1330
augggcaagacaga

SEQ ID NO: 2481801 - RNA, 15 nt, Brucella suis 1330
augggcgagccgagc

SEQ ID NO: 2481802 - RNA, 14 nt, Brucella suis 1330
augggcgcaccgca

SEQ ID NO: 2481803 - RNA, 13 nt, Brucella suis 1330
augggcggccacg

SEQ ID NO: 2481804 - RNA, 17 nt, Brucella suis 1330
augggcggccacggcau

SEQ ID NO: 2481805 - RNA, 13 nt, Brucella suis 1330
augggggccgggc

SEQ ID NO: 2481806 - RNA, 19 nt, Brucella suis 1330
auggguaccuuccagcaug

SEQ ID NO: 2481807 - RNA, 12 nt, Brucella suis 1330
auggucaagagc

SEQ ID NO: 2481808 - RNA, 19 nt, Brucella suis 1330
augguccgcaccauucugc

SEQ ID NO: 2481809 - RNA, 21 nt, Brucella suis 1330
auggucugcgccaguuccuga

SEQ ID NO: 2481810 - RNA, 20 nt, Brucella suis 1330
auggugccagcgucggcggu

SEQ ID NO: 2481811 - RNA, 16 nt, Brucella suis 1330
auggugcggaacaaug

SEQ ID NO: 2481812 - RNA, 16 nt, Brucella suis 1330
auggugcugccauggc

SEQ ID NO: 2481813 - RNA, 21 nt, Brucella suis 1330
auggugcugccauggcaguga

SEQ ID NO: 2481814 - RNA, 22 nt, Brucella suis 1330
augguggugguagcgcccggug

SEQ ID NO: 2481815 - RNA, 15 nt, Brucella suis 1330
auggugugcaaugca

SEQ ID NO: 2481816 - RNA, 24 nt, Brucella suis 1330
augguuucggcgucugccggagcg

SEQ ID NO: 2481817 - RNA, 19 nt, Brucella suis 1330
auguccggcgcgcugcaau

SEQ ID NO: 2481818 - RNA, 22 nt, Brucella suis 1330
augugccaccagcacacagcca

SEQ ID NO: 2481819 - RNA, 20 nt, Brucella suis 1330
augugccguaucacgccgcg

SEQ ID NO: 2481820 - RNA, 22 nt, Brucella suis 1330
augugcgggcuucuuccaguuc

SEQ ID NO: 2481821 - RNA, 16 nt, Brucella suis 1330
augugcggugagaaga

SEQ ID NO: 2481822 - RNA, 16 nt, Brucella suis 1330
augugucauaaaaaac

SEQ ID NO: 2481823 - RNA, 19 nt, Brucella suis 1330
auguucaaggcugcucaga

SEQ ID NO: 2481824 - RNA, 12 nt, Brucella suis 1330
auguucuucccc

SEQ ID NO: 2481825 - RNA, 16 nt, Brucella suis 1330
auguucuuccccguca

SEQ ID NO: 2481826 - RNA, 16 nt, Brucella suis 1330
auguugauggaaggcg

SEQ ID NO: 2481827 - RNA, 22 nt, Brucella suis 1330
auguuugguuuuagaagcuuuu

SEQ ID NO: 2481828 - RNA, 16 nt, Brucella suis 1330
auuaaacuaccaucug

SEQ ID NO: 2481829 - RNA, 18 nt, Brucella suis 1330
auuaagccgggcggcgcg

SEQ ID NO: 2481830 - RNA, 12 nt, Brucella suis 1330
auuaaucaaaaa

SEQ ID NO: 2481831 - RNA, 21 nt, Brucella suis 1330
auuacaaaaauggaaaaaccc

SEQ ID NO: 2481832 - RNA, 22 nt, Brucella suis 1330
auuagagcgccgaucugauuca

SEQ ID NO: 2481833 - RNA, 14 nt, Brucella suis 1330
auuagauacauaua

SEQ ID NO: 2481834 - RNA, 20 nt, Brucella suis 1330
auuauccgacgcaucgaagc

SEQ ID NO: 2481835 - RNA, 18 nt, Brucella suis 1330
auuauccugaaaauacuc

SEQ ID NO: 2481836 - RNA, 15 nt, Brucella suis 1330
caaagcgcggaauga

SEQ ID NO: 2481837 - RNA, 21 nt, Brucella suis 1330
caaagcgcguuucauugucga

SEQ ID NO: 2481838 - RNA, 20 nt, Brucella suis 1330
caaagcggaucagcgcgccg

SEQ ID NO: 2481839 - RNA, 17 nt, Brucella suis 1330
caaagcuuuccagcgga

SEQ ID NO: 2481840 - RNA, 21 nt, Brucella suis 1330
caaaggaaagauccuucacau

SEQ ID NO: 2481841 - RNA, 18 nt, Brucella suis 1330
caaaggagcauggcucug

SEQ ID NO: 2481842 - RNA, 12 nt, Brucella suis 1330
caaaggagccgc

SEQ ID NO: 2481843 - RNA, 15 nt, Brucella suis 1330
caaauaucggauucu

SEQ ID NO: 2481844 - RNA, 13 nt, Brucella suis 1330
caaaucagcuugg

SEQ ID NO: 2481845 - RNA, 19 nt, Brucella suis 1330
caaaugccgaagcccaugg

SEQ ID NO: 2481846 - RNA, 17 nt, Brucella suis 1330
caaauguuggaaucaga

SEQ ID NO: 2481847 - RNA, 19 nt, Brucella suis 1330
caaauucauugaaauauuc

SEQ ID NO: 2481848 - RNA, 21 nt, Brucella suis 1330
caaauucauugaaauauuccg

SEQ ID NO: 2481849 - RNA, 12 nt, Brucella suis 1330
caaauucauugu

SEQ ID NO: 2481850 - RNA, 14 nt, Brucella suis 1330
caacaaaugcaaau

SEQ ID NO: 2481851 - RNA, 18 nt, Brucella suis 1330
caacaaaugcaaaugccg

SEQ ID NO: 2481852 - RNA, 18 nt, Brucella suis 1330
caacaccaauagcugcgg

SEQ ID NO: 2481853 - RNA, 15 nt, Brucella suis 1330
caacacgcgcuccag

SEQ ID NO: 2481854 - RNA, 15 nt, Brucella suis 1330
caacacggcgcuuga

SEQ ID NO: 2481855 - RNA, 19 nt, Brucella suis 1330
caacagggcgaaaagccgc

SEQ ID NO: 2481856 - RNA, 21 nt, Brucella suis 1330
caacagggcgaaaagccgccu

SEQ ID NO: 2481857 - RNA, 17 nt, Brucella suis 1330
caacaucgccugaggca

SEQ ID NO: 2481858 - RNA, 21 nt, Brucella suis 1330
caacauggugaugcgaauuuc

SEQ ID NO: 2481859 - RNA, 16 nt, Brucella suis 1330
caacauuugcucaacg

SEQ ID NO: 2481860 - RNA, 16 nt, Brucella suis 1330
caaccaaaacauacuc

SEQ ID NO: 2481861 - RNA, 17 nt, Brucella suis 1330
caaccagcgacagggua

SEQ ID NO: 2481862 - RNA, 16 nt, Brucella suis 1330
caaccauugaucuucu

SEQ ID NO: 2481863 - RNA, 13 nt, Brucella suis 1330
caacccauuuuca

SEQ ID NO: 2481864 - RNA, 19 nt, Brucella suis 1330
caacccauuuucaugggua

SEQ ID NO: 2481865 - RNA, 17 nt, Brucella suis 1330
caaccccgcacggucau

SEQ ID NO: 2481866 - RNA, 19 nt, Brucella suis 1330
caacccgaugagccaaacu

SEQ ID NO: 2481867 - RNA, 16 nt, Brucella suis 1330
caaccggcucgcucga

SEQ ID NO: 2481868 - RNA, 15 nt, Brucella suis 1330
caaccuggcugcacc

SEQ ID NO: 2481869 - RNA, 19 nt, Brucella suis 1330
caacgauaaugggcgcagu

SEQ ID NO: 2481870 - RNA, 21 nt, Brucella suis 1330
caacgaugacccagccaagcg

SEQ ID NO: 2481871 - RNA, 22 nt, Brucella suis 1330
caacgaugacccagccaagcgc

SEQ ID NO: 2481872 - RNA, 15 nt, Brucella suis 1330
caacgccguggcggc

SEQ ID NO: 2481873 - RNA, 15 nt, Brucella suis 1330
caacgcugcaacaaa

SEQ ID NO: 2481874 - RNA, 22 nt, Brucella suis 1330
caacgcugcaacaaaugcaaau

SEQ ID NO: 2481875 - RNA, 18 nt, Brucella suis 1330
caacgcuuugaccgccgc

SEQ ID NO: 2481876 - RNA, 17 nt, Brucella suis 1330
caacgggugcgcugcca

SEQ ID NO: 2481877 - RNA, 17 nt, Brucella suis 1330
caacgguucguccuuga

SEQ ID NO: 2481878 - RNA, 18 nt, Brucella suis 1330
caacuggcgcagcagcac

SEQ ID NO: 2481879 - RNA, 18 nt, Brucella suis 1330
caacuucgggggaaugcg

SEQ ID NO: 2481880 - RNA, 21 nt, Brucella suis 1330
caacuucuuuguucugcagca

SEQ ID NO: 2481881 - RNA, 18 nt, Brucella suis 1330
caagaaagaucagccagc

SEQ ID NO: 2481882 - RNA, 23 nt, Brucella suis 1330
caagaaagaucagccagccgaca

SEQ ID NO: 2481883 - RNA, 17 nt, Brucella suis 1330
caagaacagccgccccg

SEQ ID NO: 2481884 - RNA, 21 nt, Brucella suis 1330
caagaagcaagugugaaagca

SEQ ID NO: 2481885 - RNA, 19 nt, Brucella suis 1330
caagaauaggagccggcca

SEQ ID NO: 2481886 - RNA, 17 nt, Brucella suis 1330
caagacuuuccauccag

SEQ ID NO: 2481887 - RNA, 14 nt, Brucella suis 1330
caagauacaaaaaa

SEQ ID NO: 2481888 - RNA, 15 nt, Brucella suis 1330
caagauacaaaaaau

SEQ ID NO: 2481889 - RNA, 18 nt, Brucella suis 1330
caagauacaaaaaauccc

SEQ ID NO: 2481890 - RNA, 22 nt, Brucella suis 1330
caagauagccccagcccgcccc

SEQ ID NO: 2481891 - RNA, 15 nt, Brucella suis 1330
caagauagcccggca

SEQ ID NO: 2481892 - RNA, 14 nt, Brucella suis 1330
caagaucagccaca

SEQ ID NO: 2481893 - RNA, 18 nt, Brucella suis 1330
caagaucggacgggcaga

SEQ ID NO: 2481894 - RNA, 17 nt, Brucella suis 1330
caagaugcuugaggauc

SEQ ID NO: 2481895 - RNA, 15 nt, Brucella suis 1330
caagcagggcauggg

SEQ ID NO: 2481896 - RNA, 12 nt, Brucella suis 1330
caagccaaagcc

SEQ ID NO: 2481897 - RNA, 13 nt, Brucella suis 1330
caagccaaagccc

SEQ ID NO: 2481898 - RNA, 17 nt, Brucella suis 1330
caagccaguccuugccc

SEQ ID NO: 2481899 - RNA, 19 nt, Brucella suis 1330
caagcccuuccacugcaag

SEQ ID NO: 2481900 - RNA, 19 nt, Brucella suis 1330
caagcgcauccagccggcg

SEQ ID NO: 2481901 - RNA, 19 nt, Brucella suis 1330
caagcgcaucgaaagccgu

SEQ ID NO: 2481902 - RNA, 22 nt, Brucella suis 1330
caagcgccagaaagacauuuuc

SEQ ID NO: 2481903 - RNA, 20 nt, Brucella suis 1330
caagcggauaguucaaggcu

SEQ ID NO: 2481904 - RNA, 16 nt, Brucella suis 1330
caagcggcgucaggcc

SEQ ID NO: 2481905 - RNA, 21 nt, Brucella suis 1330
caagcggcuucagaucgcgcg

SEQ ID NO: 2481906 - RNA, 14 nt, Brucella suis 1330
caagcgucuucuga

SEQ ID NO: 2481907 - RNA, 15 nt, Brucella suis 1330
caagcgucuucugag

SEQ ID NO: 2481908 - RNA, 19 nt, Brucella suis 1330
caagcgucuucugagaaaa

SEQ ID NO: 2481909 - RNA, 22 nt, Brucella suis 1330
caagcucgacccagcuaaggcc

SEQ ID NO: 2481910 - RNA, 15 nt, Brucella suis 1330
caagcucguuccaga

SEQ ID NO: 2481911 - RNA, 19 nt, Brucella suis 1330
caagcuggaaggccaggcc

SEQ ID NO: 2481912 - RNA, 20 nt, Brucella suis 1330
caagcuugaucgccgcacgg

SEQ ID NO: 2481913 - RNA, 17 nt, Brucella suis 1330
caagcuuuugcagccgu

SEQ ID NO: 2481914 - RNA, 14 nt, Brucella suis 1330
caaggaaaaaaccg

SEQ ID NO: 2481915 - RNA, 17 nt, Brucella suis 1330
caaggagcgagcuugca

SEQ ID NO: 2481916 - RNA, 21 nt, Brucella suis 1330
caaggagcgagcuugcaauga

SEQ ID NO: 2481917 - RNA, 19 nt, Brucella suis 1330
caaggaugugagcgaauau

SEQ ID NO: 2481918 - RNA, 17 nt, Brucella suis 1330
caaggccccagaucagc

SEQ ID NO: 2481919 - RNA, 17 nt, Brucella suis 1330
caaggcccucgcggauc

SEQ ID NO: 2481920 - RNA, 20 nt, Brucella suis 1330
caaggcccucgcggaucagc

SEQ ID NO: 2481921 - RNA, 16 nt, Brucella suis 1330
caaggccgagcgccgc

SEQ ID NO: 2481922 - RNA, 19 nt, Brucella suis 1330
caaggccgauggcgaucac

SEQ ID NO: 2481923 - RNA, 15 nt, Brucella suis 1330
caaggccggaagcgc

SEQ ID NO: 2481924 - RNA, 15 nt, Brucella suis 1330
caaggccguuauuuc

SEQ ID NO: 2481925 - RNA, 21 nt, Brucella suis 1330
caaggcgcagauagccuuuca

SEQ ID NO: 2481926 - RNA, 18 nt, Brucella suis 1330
caaggcgcgggaugacgc

SEQ ID NO: 2481927 - RNA, 19 nt, Brucella suis 1330
caaggcggcuggaacgagc

SEQ ID NO: 2481928 - RNA, 13 nt, Brucella suis 1330
caagggcaagcag

SEQ ID NO: 2481929 - RNA, 18 nt, Brucella suis 1330
caagggccgcaucggaag

SEQ ID NO: 2481930 - RNA, 14 nt, Brucella suis 1330
caagggcuggcucu

SEQ ID NO: 2481931 - RNA, 14 nt, Brucella suis 1330
caaguggcuuuuca

SEQ ID NO: 2481932 - RNA, 19 nt, Brucella suis 1330
caagugugaaagcacaaag

SEQ ID NO: 2481933 - RNA, 20 nt, Brucella suis 1330
caagugugaaagcacaaaga

SEQ ID NO: 2481934 - RNA, 15 nt, Brucella suis 1330
caagugugcagacag

SEQ ID NO: 2481935 - RNA, 21 nt, Brucella suis 1330
caaguucaugccugucaaaac

SEQ ID NO: 2481936 - RNA, 15 nt, Brucella suis 1330
caauaaugcagcgcc

SEQ ID NO: 2481937 - RNA, 17 nt, Brucella suis 1330
caauaggacgaaauuug

SEQ ID NO: 2481938 - RNA, 14 nt, Brucella suis 1330
caauaucgcgccgg

SEQ ID NO: 2481939 - RNA, 15 nt, Brucella suis 1330
caauaucgcgccggg

SEQ ID NO: 2481940 - RNA, 17 nt, Brucella suis 1330
caauaucggcgaugccc

SEQ ID NO: 2481941 - RNA, 19 nt, Brucella suis 1330
caauaugcgccuugcgccg

SEQ ID NO: 2481942 - RNA, 19 nt, Brucella suis 1330
caaucaccagagacagugg

SEQ ID NO: 2481943 - RNA, 23 nt, Brucella suis 1330
caaucacgccacugcccuggaua

SEQ ID NO: 2481944 - RNA, 16 nt, Brucella suis 1330
caaucacggcaaucag

SEQ ID NO: 2481945 - RNA, 20 nt, Brucella suis 1330
caaucacggcaaucagcacg

SEQ ID NO: 2481946 - RNA, 22 nt, Brucella suis 1330
caaucagcacggcaaucagauc

SEQ ID NO: 2481947 - RNA, 18 nt, Brucella suis 1330
caaucagggaaaagccgc

SEQ ID NO: 2481948 - RNA, 16 nt, Brucella suis 1330
caaucagggauagaau

SEQ ID NO: 2481949 - RNA, 17 nt, Brucella suis 1330
caauccccucaccuugc

SEQ ID NO: 2481950 - RNA, 18 nt, Brucella suis 1330
caauccccucaccuugcc

SEQ ID NO: 2481951 - RNA, 14 nt, Brucella suis 1330
caauccggcagcuu

SEQ ID NO: 2481952 - RNA, 18 nt, Brucella suis 1330
caccuugccgggcgggca

SEQ ID NO: 2481953 - RNA, 15 nt, Brucella suis 1330
caccuuguugccauu

SEQ ID NO: 2481954 - RNA, 20 nt, Brucella suis 1330
cacgaaaagcaggaucaggg

SEQ ID NO: 2481955 - RNA, 16 nt, Brucella suis 1330
cacgaacagaucgcca

SEQ ID NO: 2481956 - RNA, 15 nt, Brucella suis 1330
cacgaacagcagcag

SEQ ID NO: 2481957 - RNA, 16 nt, Brucella suis 1330
cacgaacagcagcagg

SEQ ID NO: 2481958 - RNA, 18 nt, Brucella suis 1330
cacgaccagcgcaaugcc

SEQ ID NO: 2481959 - RNA, 17 nt, Brucella suis 1330
cacgagaaccgcgccgg

SEQ ID NO: 2481960 - RNA, 21 nt, Brucella suis 1330
cacgagaucaauacgcucgca

SEQ ID NO: 2481961 - RNA, 14 nt, Brucella suis 1330
cacgauggaaggaa

SEQ ID NO: 2481962 - RNA, 19 nt, Brucella suis 1330
cacgauggccgaaccgucc

SEQ ID NO: 2481963 - RNA, 18 nt, Brucella suis 1330
cacgauuuccgcgacauc

SEQ ID NO: 2481964 - RNA, 23 nt, Brucella suis 1330
cacgauuuccgcgacaucaucaa

SEQ ID NO: 2481965 - RNA, 18 nt, Brucella suis 1330
cacgauuucgcccacgcc

SEQ ID NO: 2481966 - RNA, 17 nt, Brucella suis 1330
cacgcacggucuugccg

SEQ ID NO: 2481967 - RNA, 18 nt, Brucella suis 1330
cacgcagggucgcgaccu

SEQ ID NO: 2481968 - RNA, 15 nt, Brucella suis 1330
cacgccacugcccug

SEQ ID NO: 2481969 - RNA, 13 nt, Brucella suis 1330
cacgccagccgcg

SEQ ID NO: 2481970 - RNA, 22 nt, Brucella suis 1330
cacgccagccgcgaucacagcc

SEQ ID NO: 2481971 - RNA, 19 nt, Brucella suis 1330
cacgcccaugaucgcgcca

SEQ ID NO: 2481972 - RNA, 12 nt, Brucella suis 1330
cacgccgccaua

SEQ ID NO: 2481973 - RNA, 17 nt, Brucella suis 1330
cacgccgccgcgcggca

SEQ ID NO: 2481974 - RNA, 14 nt, Brucella suis 1330
cacgccggaacacc

SEQ ID NO: 2481975 - RNA, 15 nt, Brucella suis 1330
cacgccggaacaccu

SEQ ID NO: 2481976 - RNA, 14 nt, Brucella suis 1330
cacgcgccauguug

SEQ ID NO: 2481977 - RNA, 13 nt, Brucella suis 1330
cacgcgccgacaa

SEQ ID NO: 2481978 - RNA, 15 nt, Brucella suis 1330
cacgcgccgacaaaa

SEQ ID NO: 2481979 - RNA, 18 nt, Brucella suis 1330
cacgcgcgaaaccaugga

SEQ ID NO: 2481980 - RNA, 19 nt, Brucella suis 1330
cacgcgcgaaaccauggag

SEQ ID NO: 2481981 - RNA, 23 nt, Brucella suis 1330
cacgcgcuuguaggugaucguau

SEQ ID NO: 2481982 - RNA, 17 nt, Brucella suis 1330
cacgcuccacacgaaca

SEQ ID NO: 2481983 - RNA, 19 nt, Brucella suis 1330
cacgcucgcauagccgaua

SEQ ID NO: 2481984 - RNA, 22 nt, Brucella suis 1330
cacgcucggcggaagcgacgau

SEQ ID NO: 2481985 - RNA, 20 nt, Brucella suis 1330
cacggauuuccaccacgcgc

SEQ ID NO: 2481986 - RNA, 15 nt, Brucella suis 1330
cacggcaaucagauc

SEQ ID NO: 2481987 - RNA, 22 nt, Brucella suis 1330
cacggcagaguggacgguugcu

SEQ ID NO: 2481988 - RNA, 14 nt, Brucella suis 1330
cacggcgcaggcag

SEQ ID NO: 2481989 - RNA, 16 nt, Brucella suis 1330
cacggcgcaggcaggg

SEQ ID NO: 2481990 - RNA, 19 nt, Brucella suis 1330
cacgggcuuugccgcauaa

SEQ ID NO: 2481991 - RNA, 13 nt, Brucella suis 1330
cacggucagauca

SEQ ID NO: 2481992 - RNA, 18 nt, Brucella suis 1330
cacgucggacuucugcuu

SEQ ID NO: 2481993 - RNA, 18 nt, Brucella suis 1330
cacgucguggccagccgc

SEQ ID NO: 2481994 - RNA, 14 nt, Brucella suis 1330
cacguuggggcgcc

SEQ ID NO: 2481995 - RNA, 12 nt, Brucella suis 1330
cacguuggggga

SEQ ID NO: 2481996 - RNA, 15 nt, Brucella suis 1330
cacguuugacagccu

SEQ ID NO: 2481997 - RNA, 16 nt, Brucella suis 1330
cacuacgucaacagcc

SEQ ID NO: 2481998 - RNA, 21 nt, Brucella suis 1330
cacuauucaaacggcaucauu

SEQ ID NO: 2481999 - RNA, 16 nt, Brucella suis 1330
cacucauuaucagcau

SEQ ID NO: 2482000 - RNA, 19 nt, Brucella suis 1330
cacucccgcaucuccucaa

SEQ ID NO: 2482001 - RNA, 13 nt, Brucella suis 1330
cacucugccaggc

SEQ ID NO: 2482002 - RNA, 19 nt, Brucella suis 1330
cacugcaaaaaauaccagu

SEQ ID NO: 2482003 - RNA, 22 nt, Brucella suis 1330
cacugcaaggaaggucagaaga

SEQ ID NO: 2482004 - RNA, 21 nt, Brucella suis 1330
cacuggaaauauucgggcggc

SEQ ID NO: 2482005 - RNA, 20 nt, Brucella suis 1330
cacuggcauuauuccgccug

SEQ ID NO: 2482006 - RNA, 17 nt, Brucella suis 1330
cacugggcgacccagcc

SEQ ID NO: 2482007 - RNA, 23 nt, Brucella suis 1330
cacuggggauacgugcaagagca

SEQ ID NO: 2482008 - RNA, 14 nt, Brucella suis 1330
cacuuacaaaugca

SEQ ID NO: 2482009 - RNA, 12 nt, Brucella suis 1330
cacuuccagaua

SEQ ID NO: 2482010 - RNA, 21 nt, Brucella suis 1330
cacuucgaucgacccgccaug

SEQ ID NO: 2482011 - RNA, 14 nt, Brucella suis 1330
cacuugcgauuuga

SEQ ID NO: 2482012 - RNA, 18 nt, Brucella suis 1330
cagaaagaaagcugucgc

SEQ ID NO: 2482013 - RNA, 17 nt, Brucella suis 1330
cagaaauccacuacaac

SEQ ID NO: 2482014 - RNA, 18 nt, Brucella suis 1330
cagaaauccauagcgaau

SEQ ID NO: 2482015 - RNA, 16 nt, Brucella suis 1330
cagaacacgcgcaccg

SEQ ID NO: 2482016 - RNA, 21 nt, Brucella suis 1330
cagaaccugcccgucuuccuc

SEQ ID NO: 2482017 - RNA, 16 nt, Brucella suis 1330
cagaacucgauugaca

SEQ ID NO: 2482018 - RNA, 17 nt, Brucella suis 1330
cagaacuucgccaagcc

SEQ ID NO: 2482019 - RNA, 18 nt, Brucella suis 1330
cagaacuucgccaagccc

SEQ ID NO: 2482020 - RNA, 23 nt, Brucella suis 1330
cagaagaucgucggcaagcugga

SEQ ID NO: 2482021 - RNA, 23 nt, Brucella suis 1330
cagaagauugaugauaggcugcu

SEQ ID NO: 2482022 - RNA, 22 nt, Brucella suis 1330
cagaagcaccagcgcgccgauc

SEQ ID NO: 2482023 - RNA, 14 nt, Brucella suis 1330
cagaagccgcuugc

SEQ ID NO: 2482024 - RNA, 14 nt, Brucella suis 1330
cagaaggaugaucg

SEQ ID NO: 2482025 - RNA, 14 nt, Brucella suis 1330
cagaaggcgcggca

SEQ ID NO: 2482026 - RNA, 16 nt, Brucella suis 1330
cagaaggcgggaaggc

SEQ ID NO: 2482027 - RNA, 17 nt, Brucella suis 1330
cagaaggcgggaaggca

SEQ ID NO: 2482028 - RNA, 20 nt, Brucella suis 1330
cagaagguacuggcaauaaa

SEQ ID NO: 2482029 - RNA, 13 nt, Brucella suis 1330
cagaagugcugcu

SEQ ID NO: 2482030 - RNA, 15 nt, Brucella suis 1330
cagaaugagcuugcg

SEQ ID NO: 2482031 - RNA, 14 nt, Brucella suis 1330
cagaaugcgccgga

SEQ ID NO: 2482032 - RNA, 20 nt, Brucella suis 1330
cagaauggcgauaucaccaa

SEQ ID NO: 2482033 - RNA, 21 nt, Brucella suis 1330
cagaauuuggaaguuuuccug

SEQ ID NO: 2482034 - RNA, 19 nt, Brucella suis 1330
cagacauggaagaugacgc

SEQ ID NO: 2482035 - RNA, 20 nt, Brucella suis 1330
cagacauggccuuugcagaa

SEQ ID NO: 2482036 - RNA, 16 nt, Brucella suis 1330
cagaccaucggcaaca

SEQ ID NO: 2482037 - RNA, 19 nt, Brucella suis 1330
cagaccaucggcaacaaga

SEQ ID NO: 2482038 - RNA, 14 nt, Brucella suis 1330
cagaccgaugcucu

SEQ ID NO: 2482039 - RNA, 15 nt, Brucella suis 1330
cagaccugcaccgcg

SEQ ID NO: 2482040 - RNA, 13 nt, Brucella suis 1330
cagacgcagcgca

SEQ ID NO: 2482041 - RNA, 16 nt, Brucella suis 1330
cagacgcuggugacau

SEQ ID NO: 2482042 - RNA, 15 nt, Brucella suis 1330
cagacgugaccgccu

SEQ ID NO: 2482043 - RNA, 22 nt, Brucella suis 1330
cagacuagacaaagcgguuugc

SEQ ID NO: 2482044 - RNA, 14 nt, Brucella suis 1330
cagagacaggaaaa

SEQ ID NO: 2482045 - RNA, 14 nt, Brucella suis 1330
cagagcaaauacac

SEQ ID NO: 2482046 - RNA, 18 nt, Brucella suis 1330
cagagccuguuccaaaag

SEQ ID NO: 2482047 - RNA, 22 nt, Brucella suis 1330
cagagcgauuucuggagccgcu

SEQ ID NO: 2482048 - RNA, 16 nt, Brucella suis 1330
cagagcgguuccgguu

SEQ ID NO: 2482049 - RNA, 17 nt, Brucella suis 1330
cagagcgguuccgguua

SEQ ID NO: 2482050 - RNA, 13 nt, Brucella suis 1330
cagauaaaaagga

SEQ ID NO: 2482051 - RNA, 13 nt, Brucella suis 1330
cagauaaagcagg

SEQ ID NO: 2482052 - RNA, 10 nt, Brucella suis 1330
cagauaagau

SEQ ID NO: 2482053 - RNA, 21 nt, Brucella suis 1330
cagauagccggugcugucgcc

SEQ ID NO: 2482054 - RNA, 19 nt, Brucella suis 1330
cagauaggcguugaugacg

SEQ ID NO: 2482055 - RNA, 12 nt, Brucella suis 1330
cagaucaucgca

SEQ ID NO: 2482056 - RNA, 19 nt, Brucella suis 1330
cagaucaucgucaugcaga

SEQ ID NO: 2482057 - RNA, 21 nt, Brucella suis 1330
cagaucaugauuagccguuaa

SEQ ID NO: 2482058 - RNA, 22 nt, Brucella suis 1330
cagaucccguuuugagaugacg

SEQ ID NO: 2482059 - RNA, 22 nt, Brucella suis 1330
cagaucgaaaugcgcucuagac

SEQ ID NO: 2482060 - RNA, 14 nt, Brucella suis 1330
cagaucgacgcaga

SEQ ID NO: 2482061 - RNA, 15 nt, Brucella suis 1330
cagaucgacgcagaa

SEQ ID NO: 2482062 - RNA, 16 nt, Brucella suis 1330
cagaucgccaagcgca

SEQ ID NO: 2482063 - RNA, 16 nt, Brucella suis 1330
cagaucgcgcgcggcc

SEQ ID NO: 2482064 - RNA, 15 nt, Brucella suis 1330
cagaucgcgcggcga

SEQ ID NO: 2482065 - RNA, 20 nt, Brucella suis 1330
cagaucgcgcggcgaaacgc

SEQ ID NO: 2482066 - RNA, 20 nt, Brucella suis 1330
cagaucggccuugaucggca

SEQ ID NO: 2482067 - RNA, 20 nt, Brucella suis 1330
cagaugaucauaacagaugc

SEQ ID NO: 2482068 - RNA, 14 nt, Brucella suis 1330
cagaugcaccauca

SEQ ID NO: 2482069 - RNA, 17 nt, Brucella suis 1330
caggaccggcgaaaagg

SEQ ID NO: 2482070 - RNA, 18 nt, Brucella suis 1330
caggaccggcgaaaaggc

SEQ ID NO: 2482071 - RNA, 23 nt, Brucella suis 1330
caggaccguuuggaugugcagcg

SEQ ID NO: 2482072 - RNA, 13 nt, Brucella suis 1330
caggagcgcgauc

SEQ ID NO: 2482073 - RNA, 12 nt, Brucella suis 1330
caggagcggaag

SEQ ID NO: 2482074 - RNA, 17 nt, Brucella suis 1330
caggaggccaaaaagcg

SEQ ID NO: 2482075 - RNA, 18 nt, Brucella suis 1330
caggauaaccuucuggaa

SEQ ID NO: 2482076 - RNA, 13 nt, Brucella suis 1330
caggaucgacagc

SEQ ID NO: 2482077 - RNA, 15 nt, Brucella suis 1330
caggaucgacagccg

SEQ ID NO: 2482078 - RNA, 16 nt, Brucella suis 1330
caggaucgccagaagc

SEQ ID NO: 2482079 - RNA, 17 nt, Brucella suis 1330
caggaucuuccaucugg

SEQ ID NO: 2482080 - RNA, 13 nt, Brucella suis 1330
caggaucuuucca

SEQ ID NO: 2482081 - RNA, 14 nt, Brucella suis 1330
caggaucuuuccaa

SEQ ID NO: 2482082 - RNA, 14 nt, Brucella suis 1330
caggcacacccggc

SEQ ID NO: 2482083 - RNA, 22 nt, Brucella suis 1330
caggcacucuccucugccugcu

SEQ ID NO: 2482084 - RNA, 23 nt, Brucella suis 1330
caggcacucuccucugccugcug

SEQ ID NO: 2482085 - RNA, 19 nt, Brucella suis 1330
caggcagacggacuucuuc

SEQ ID NO: 2482086 - RNA, 22 nt, Brucella suis 1330
caggccagucgcugccccauau

SEQ ID NO: 2482087 - RNA, 17 nt, Brucella suis 1330
caggccauucccgccuc

SEQ ID NO: 2482088 - RNA, 22 nt, Brucella suis 1330
caggccauucccgccucagccg

SEQ ID NO: 2482089 - RNA, 13 nt, Brucella suis 1330
caggcccaccgug

SEQ ID NO: 2482090 - RNA, 21 nt, Brucella suis 1330
caggcccuugccggccgagaa

SEQ ID NO: 2482091 - RNA, 19 nt, Brucella suis 1330
caggccgauccugcgcccu

SEQ ID NO: 2482092 - RNA, 15 nt, Brucella suis 1330
caggccgcggcaucc

SEQ ID NO: 2482093 - RNA, 23 nt, Brucella suis 1330
caggccgcggcaucccugucgcc

SEQ ID NO: 2482094 - RNA, 17 nt, Brucella suis 1330
caggccgguaagcccug

SEQ ID NO: 2482095 - RNA, 17 nt, Brucella suis 1330
caggccucugccuccau

SEQ ID NO: 2482096 - RNA, 14 nt, Brucella suis 1330
caggcgagcaugga

SEQ ID NO: 2482097 - RNA, 20 nt, Brucella suis 1330
caggcgaucaacgcuuugac

SEQ ID NO: 2482098 - RNA, 20 nt, Brucella suis 1330
caggcgauccaauauugccu

SEQ ID NO: 2482099 - RNA, 14 nt, Brucella suis 1330
caggcgccagccca

SEQ ID NO: 2482100 - RNA, 21 nt, Brucella suis 1330
caggcgcgcagcaaccaucau

SEQ ID NO: 2482101 - RNA, 22 nt, Brucella suis 1330
caggcgcucuuuccgcgcaucg

SEQ ID NO: 2482102 - RNA, 14 nt, Brucella suis 1330
caggcggccugacc

SEQ ID NO: 2482103 - RNA, 20 nt, Brucella suis 1330
caggcguucccagacaugga

SEQ ID NO: 2482104 - RNA, 15 nt, Brucella suis 1330
caggcucccgccugc

SEQ ID NO: 2482105 - RNA, 20 nt, Brucella suis 1330
caggcucccgccugcaauga

SEQ ID NO: 2482106 - RNA, 14 nt, Brucella suis 1330
caggcucugaaacu

SEQ ID NO: 2482107 - RNA, 16 nt, Brucella suis 1330
caggcugcccaugccc

SEQ ID NO: 2482108 - RNA, 22 nt, Brucella suis 1330
caggcuuuauuccaucagccgg

SEQ ID NO: 2482109 - RNA, 17 nt, Brucella suis 1330
caggcuuuccgacaggg

SEQ ID NO: 2482110 - RNA, 20 nt, Brucella suis 1330
caggcuuuccgacagggcaa

SEQ ID NO: 2482111 - RNA, 17 nt, Brucella suis 1330
cagggaaaagccgcgcu

SEQ ID NO: 2482112 - RNA, 20 nt, Brucella suis 1330
cagggaaaagccgcgcucca

SEQ ID NO: 2482113 - RNA, 15 nt, Brucella suis 1330
cagggacgagcggca

SEQ ID NO: 2482114 - RNA, 17 nt, Brucella suis 1330
cagggacgagcggcagg

SEQ ID NO: 2482115 - RNA, 18 nt, Brucella suis 1330
cagggauugcgcaagugc

SEQ ID NO: 2482116 - RNA, 22 nt, Brucella suis 1330
cagggauugcgcaagugcugca

SEQ ID NO: 2482117 - RNA, 15 nt, Brucella suis 1330
cagggcaauccuuuc

SEQ ID NO: 2482118 - RNA, 13 nt, Brucella suis 1330
cagggcauugccg

SEQ ID NO: 2482119 - RNA, 14 nt, Brucella suis 1330
cagggccagaucgc

SEQ ID NO: 2482120 - RNA, 19 nt, Brucella suis 1330
cagggccagaucgcgcgcg

SEQ ID NO: 2482121 - RNA, 19 nt, Brucella suis 1330
cagggcggaucgugacccg

SEQ ID NO: 2482122 - RNA, 18 nt, Brucella suis 1330
cagggcuucaugauggaa

SEQ ID NO: 2482123 - RNA, 20 nt, Brucella suis 1330
cagggcuucaugauggaaga

SEQ ID NO: 2482124 - RNA, 16 nt, Brucella suis 1330
cagggcuugcuugcca

SEQ ID NO: 2482125 - RNA, 17 nt, Brucella suis 1330
caggggugcaaagcuuu

SEQ ID NO: 2482126 - RNA, 18 nt, Brucella suis 1330
caggucagcggcggauaa

SEQ ID NO: 2482127 - RNA, 19 nt, Brucella suis 1330
caggucgagcgccuguccg

SEQ ID NO: 2482128 - RNA, 22 nt, Brucella suis 1330
caggucgagcgccuguccgccu

SEQ ID NO: 2482129 - RNA, 15 nt, Brucella suis 1330
caggucggcauugau

SEQ ID NO: 2482130 - RNA, 15 nt, Brucella suis 1330
caggugccaucaagc

SEQ ID NO: 2482131 - RNA, 15 nt, Brucella suis 1330
cagguggaucggcgu

SEQ ID NO: 2482132 - RNA, 16 nt, Brucella suis 1330
cagguggcugcccgcc

SEQ ID NO: 2482133 - RNA, 18 nt, Brucella suis 1330
cagguggcugcccgccgc

SEQ ID NO: 2482134 - RNA, 12 nt, Brucella suis 1330
cagguuccgccg

SEQ ID NO: 2482135 - RNA, 18 nt, Brucella suis 1330
cagguuuccggacgcgca

SEQ ID NO: 2482136 - RNA, 17 nt, Brucella suis 1330
cagguuuccggcugccu

SEQ ID NO: 2482137 - RNA, 18 nt, Brucella suis 1330
caguacggcgcgcugaag

SEQ ID NO: 2482138 - RNA, 18 nt, Brucella suis 1330
caguagggcaguagggca

SEQ ID NO: 2482139 - RNA, 19 nt, Brucella suis 1330
caguagggcaguagggcag

SEQ ID NO: 2482140 - RNA, 20 nt, Brucella suis 1330
caguagggcaguagggcagu

SEQ ID NO: 2482141 - RNA, 21 nt, Brucella suis 1330
caguagggcaguagggcagua

SEQ ID NO: 2482142 - RNA, 16 nt, Brucella suis 1330
caguaucggcaguuuc

SEQ ID NO: 2482143 - RNA, 14 nt, Brucella suis 1330
cagucacgccauca

SEQ ID NO: 2482144 - RNA, 17 nt, Brucella suis 1330
cagucacgguugccuug

SEQ ID NO: 2482145 - RNA, 19 nt, Brucella suis 1330
cagucaggauauuucggca

SEQ ID NO: 2482146 - RNA, 16 nt, Brucella suis 1330
cagucauggcgcacgg

SEQ ID NO: 2482147 - RNA, 18 nt, Brucella suis 1330
caguccgauaucgagauu

SEQ ID NO: 2482148 - RNA, 23 nt, Brucella suis 1330
caguccuugaccgcuaugucgau

SEQ ID NO: 2482149 - RNA, 21 nt, Brucella suis 1330
cagucgcgguuugcaagccgc

SEQ ID NO: 2482150 - RNA, 18 nt, Brucella suis 1330
cagucuucuugugaacau

SEQ ID NO: 2482151 - RNA, 21 nt, Brucella suis 1330
cagugagcagaagaaagggcg

SEQ ID NO: 2482152 - RNA, 15 nt, Brucella suis 1330
cagugccaccagaug

SEQ ID NO: 2482153 - RNA, 17 nt, Brucella suis 1330
cagugccgccaucggca

SEQ ID NO: 2482154 - RNA, 14 nt, Brucella suis 1330
cagugcgccaccgc

SEQ ID NO: 2482155 - RNA, 13 nt, Brucella suis 1330
cagugcggcaugg

SEQ ID NO: 2482156 - RNA, 19 nt, Brucella suis 1330
cagugcugaaaaggcuggc

SEQ ID NO: 2482157 - RNA, 21 nt, Brucella suis 1330
caguggcaugggagcaccgca

SEQ ID NO: 2482158 - RNA, 15 nt, Brucella suis 1330
caguuccacgaucug

SEQ ID NO: 2482159 - RNA, 15 nt, Brucella suis 1330
caguuccggcccgcg

SEQ ID NO: 2482160 - RNA, 18 nt, Brucella suis 1330
caguuccggcggaaagcg

SEQ ID NO: 2482161 - RNA, 22 nt, Brucella suis 1330
caguucgguguuggucugcggc

SEQ ID NO: 2482162 - RNA, 19 nt, Brucella suis 1330
caguucguggcggggcagg

SEQ ID NO: 2482163 - RNA, 23 nt, Brucella suis 1330
caguugucgccgggcugcuucuc

SEQ ID NO: 2482164 - RNA, 22 nt, Brucella suis 1330
caguuuauucauuggcggcaga

SEQ ID NO: 2482165 - RNA, 15 nt, Brucella suis 1330
caguuucaccauggc

SEQ ID NO: 2482166 - RNA, 13 nt, Brucella suis 1330
caguuucugccgc

SEQ ID NO: 2482167 - RNA, 23 nt, Brucella suis 1330
caguuucuuguaucuugcggguu

SEQ ID NO: 2482168 - RNA, 17 nt, Brucella suis 1330
caguuuguugaaacagg

SEQ ID NO: 2482169 - RNA, 19 nt, Brucella suis 1330
cauaaagauuguaauccau

SEQ ID NO: 2482170 - RNA, 20 nt, Brucella suis 1330
cauaaagcacagccagaaag

SEQ ID NO: 2482171 - RNA, 13 nt, Brucella suis 1330
cauaaagcaccau

SEQ ID NO: 2482172 - RNA, 16 nt, Brucella suis 1330
cauaaaugcccuuccu

SEQ ID NO: 2482173 - RNA, 13 nt, Brucella suis 1330
cauaacagaugcg

SEQ ID NO: 2482174 - RNA, 23 nt, Brucella suis 1330
cauaaccucgacggcggccuugg

SEQ ID NO: 2482175 - RNA, 13 nt, Brucella suis 1330
cauaagccccggc

SEQ ID NO: 2482176 - RNA, 20 nt, Brucella suis 1330
cauaagccggcaugaaugug

SEQ ID NO: 2482177 - RNA, 21 nt, Brucella suis 1330
cauaaggcggaugcgcggcgc

SEQ ID NO: 2482178 - RNA, 22 nt, Brucella suis 1330
cauaaggcggaugcgcggcgcc

SEQ ID NO: 2482179 - RNA, 12 nt, Brucella suis 1330
cauaaucagccu

SEQ ID NO: 2482180 - RNA, 12 nt, Brucella suis 1330
cauaauccucac

SEQ ID NO: 2482181 - RNA, 17 nt, Brucella suis 1330
cauaaugcauggaggca

SEQ ID NO: 2482182 - RNA, 21 nt, Brucella suis 1330
cauaauugguguagaagacaa

SEQ ID NO: 2482183 - RNA, 17 nt, Brucella suis 1330
cauaccgucgaggaaaa

SEQ ID NO: 2482184 - RNA, 18 nt, Brucella suis 1330
cauagaccaugacgccgc

SEQ ID NO: 2482185 - RNA, 22 nt, Brucella suis 1330
caugcgcaaccaaaacauacuc

SEQ ID NO: 2482186 - RNA, 19 nt, Brucella suis 1330
caugcgccagagcauuuuc

SEQ ID NO: 2482187 - RNA, 16 nt, Brucella suis 1330
caugcggccagccuau

SEQ ID NO: 2482188 - RNA, 16 nt, Brucella suis 1330
caugcgguaaucagcg

SEQ ID NO: 2482189 - RNA, 20 nt, Brucella suis 1330
caugcugaaaucgcugaucg

SEQ ID NO: 2482190 - RNA, 16 nt, Brucella suis 1330
cauggaaaugcaggug

SEQ ID NO: 2482191 - RNA, 17 nt, Brucella suis 1330
cauggaagaugacgccc

SEQ ID NO: 2482192 - RNA, 14 nt, Brucella suis 1330
cauggaagccgaca

SEQ ID NO: 2482193 - RNA, 20 nt, Brucella suis 1330
cauggaagccgacagaagau

SEQ ID NO: 2482194 - RNA, 17 nt, Brucella suis 1330
cauggaagggcggguuc

SEQ ID NO: 2482195 - RNA, 22 nt, Brucella suis 1330
cauggaagggcggguucaugau

SEQ ID NO: 2482196 - RNA, 20 nt, Brucella suis 1330
cauggaagugaauuucggcg

SEQ ID NO: 2482197 - RNA, 15 nt, Brucella suis 1330
cauggacuuuucagc

SEQ ID NO: 2482198 - RNA, 22 nt, Brucella suis 1330
cauggagauacgcuucaucgca

SEQ ID NO: 2482199 - RNA, 12 nt, Brucella suis 1330
cauggaggcaag

SEQ ID NO: 2482200 - RNA, 15 nt, Brucella suis 1330
cauggauggaauauc

SEQ ID NO: 2482201 - RNA, 15 nt, Brucella suis 1330
cauggcagccgauca

SEQ ID NO: 2482202 - RNA, 18 nt, Brucella suis 1330
cauggccacgccagccgc

SEQ ID NO: 2482203 - RNA, 17 nt, Brucella suis 1330
cauggccgaaaauauca

SEQ ID NO: 2482204 - RNA, 16 nt, Brucella suis 1330
cauggccucaagugcc

SEQ ID NO: 2482205 - RNA, 18 nt, Brucella suis 1330
cauggcgcacggcauuca

SEQ ID NO: 2482206 - RNA, 18 nt, Brucella suis 1330
cauggcggaacccacgca

SEQ ID NO: 2482207 - RNA, 21 nt, Brucella suis 1330
cauggcggucgagcuuuccau

SEQ ID NO: 2482208 - RNA, 14 nt, Brucella suis 1330
cauggcuugaagcg

SEQ ID NO: 2482209 - RNA, 19 nt, Brucella suis 1330
caugggcgcgugugcauag

SEQ ID NO: 2482210 - RNA, 23 nt, Brucella suis 1330
caugggcggccacggcauccgca

SEQ ID NO: 2482211 - RNA, 14 nt, Brucella suis 1330
caugggcggcggcc

SEQ ID NO: 2482212 - RNA, 18 nt, Brucella suis 1330
caugggcgugaucggccg

SEQ ID NO: 2482213 - RNA, 16 nt, Brucella suis 1330
cauggguggccgccac

SEQ ID NO: 2482214 - RNA, 17 nt, Brucella suis 1330
cauggguggugcccggu

SEQ ID NO: 2482215 - RNA, 22 nt, Brucella suis 1330
caugguccgcaccauucugccc

SEQ ID NO: 2482216 - RNA, 15 nt, Brucella suis 1330
cauggucgaugccgc

SEQ ID NO: 2482217 - RNA, 18 nt, Brucella suis 1330
cauggucgaugccgccga

SEQ ID NO: 2482218 - RNA, 20 nt, Brucella suis 1330
cauggucgaugccgccgaaa

SEQ ID NO: 2482219 - RNA, 15 nt, Brucella suis 1330
cauggugccagcguc

SEQ ID NO: 2482220 - RNA, 19 nt, Brucella suis 1330
cauggugucauagaccaug

SEQ ID NO: 2482221 - RNA, 18 nt, Brucella suis 1330
caugguuugcagcaauuc

SEQ ID NO: 2482222 - RNA, 16 nt, Brucella suis 1330
cauguaccuuaaagua

SEQ ID NO: 2482223 - RNA, 24 nt, Brucella suis 1330
caugucauuugcgaccauggcgca

SEQ ID NO: 2482224 - RNA, 15 nt, Brucella suis 1330
cauguuucaaaaguu

SEQ ID NO: 2482225 - RNA, 21 nt, Brucella suis 1330
cauuaaagccauacgacaaua

SEQ ID NO: 2482226 - RNA, 18 nt, Brucella suis 1330
cauuaauggcaucgguuu

SEQ ID NO: 2482227 - RNA, 21 nt, Brucella suis 1330
cauuacaaaaauggaaaaacc

SEQ ID NO: 2482228 - RNA, 16 nt, Brucella suis 1330
cauucaaagaucgcgu

SEQ ID NO: 2482229 - RNA, 19 nt, Brucella suis 1330
cauucaagcggcaugucau

SEQ ID NO: 2482230 - RNA, 18 nt, Brucella suis 1330
cauucaucguauucggau

SEQ ID NO: 2482231 - RNA, 16 nt, Brucella suis 1330
cauucauuucaaacaa

SEQ ID NO: 2482232 - RNA, 11 nt, Brucella suis 1330
cauuccagaag

SEQ ID NO: 2482233 - RNA, 16 nt, Brucella suis 1330
cauucccgccucagcc

SEQ ID NO: 2482234 - RNA, 23 nt, Brucella suis 1330
cauucccuugaaaucauugcgca

SEQ ID NO: 2482235 - RNA, 14 nt, Brucella suis 1330
cauucuguaaggcc

SEQ ID NO: 2482236 - RNA, 13 nt, Brucella suis 1330
cauugaaaggcag

SEQ ID NO: 2482237 - RNA, 22 nt, Brucella suis 1330
cauugaacccgccaccagaccg

SEQ ID NO: 2482238 - RNA, 17 nt, Brucella suis 1330
cauugaacgccuuuuuc

SEQ ID NO: 2482239 - RNA, 15 nt, Brucella suis 1330
cauugacggcagccu

SEQ ID NO: 2482240 - RNA, 23 nt, Brucella suis 1330
cauugacguugauguugauggaa

SEQ ID NO: 2482241 - RNA, 13 nt, Brucella suis 1330
cauugaguuucau

SEQ ID NO: 2482242 - RNA, 22 nt, Brucella suis 1330
cauugaucaacccgucuucauu

SEQ ID NO: 2482243 - RNA, 20 nt, Brucella suis 1330
cauugcacauagguugaucc

SEQ ID NO: 2482244 - RNA, 13 nt, Brucella suis 1330
cauugccaaggag

SEQ ID NO: 2482245 - RNA, 14 nt, Brucella suis 1330
cauugcccauggac

SEQ ID NO: 2482246 - RNA, 24 nt, Brucella suis 1330
cauugcccgcccgucuucggcgca

SEQ ID NO: 2482247 - RNA, 18 nt, Brucella suis 1330
cauugccgguugcuucca

SEQ ID NO: 2482248 - RNA, 23 nt, Brucella suis 1330
cauugcgcauuacggccagccgg

SEQ ID NO: 2482249 - RNA, 15 nt, Brucella suis 1330
cauugcggccaagcg

SEQ ID NO: 2482250 - RNA, 15 nt, Brucella suis 1330
cauuggaaacgccgu

SEQ ID NO: 2482251 - RNA, 22 nt, Brucella suis 1330
cauuggaaauuauagccgccaa

SEQ ID NO: 2482252 - RNA, 14 nt, Brucella suis 1330
cauuggcgauuuuc

SEQ ID NO: 2482253 - RNA, 16 nt, Brucella suis 1330
cauuggcguugagccg

SEQ ID NO: 2482254 - RNA, 17 nt, Brucella suis 1330
cauugucccaauauagc

SEQ ID NO: 2482255 - RNA, 20 nt, Brucella suis 1330
cauugucgcauccaugagca

SEQ ID NO: 2482256 - RNA, 20 nt, Brucella suis 1330
cauuucaaacaacgcugcgu

SEQ ID NO: 2482257 - RNA, 15 nt, Brucella suis 1330
cauuuccagcaaaag

SEQ ID NO: 2482258 - RNA, 16 nt, Brucella suis 1330
cauuuccagcaaaagu

SEQ ID NO: 2482259 - RNA, 18 nt, Brucella suis 1330
cauuugacguccggcuuc

SEQ ID NO: 2482260 - RNA, 19 nt, Brucella suis 1330
cauuuucgagccaaaaaug

SEQ ID NO: 2482261 - RNA, 12 nt, Brucella suis 1330
cauuuucuccac

SEQ ID NO: 2482262 - RNA, 23 nt, Brucella suis 1330
ccaaaagcgcgccgaaaaucggc

SEQ ID NO: 2482263 - RNA, 19 nt, Brucella suis 1330
ccaaaaggcgugaaccaca

SEQ ID NO: 2482264 - RNA, 11 nt, Brucella suis 1330
ccaaaagugcg

SEQ ID NO: 2482265 - RNA, 19 nt, Brucella suis 1330
ccaaaagugcgaagcgccu

SEQ ID NO: 2482266 - RNA, 22 nt, Brucella suis 1330
ccaaagauacgguucacgccau

SEQ ID NO: 2482267 - RNA, 17 nt, Brucella suis 1330
ccaaaggucggcggcgu

SEQ ID NO: 2482268 - RNA, 22 nt, Brucella suis 1330
ccaaccauugaucuucuugcau

SEQ ID NO: 2482269 - RNA, 23 nt, Brucella suis 1330
ccaacccuuuuccgcaccgccga

SEQ ID NO: 2482270 - RNA, 14 nt, Brucella suis 1330
ccaacucuuuccug

SEQ ID NO: 2482271 - RNA, 23 nt, Brucella suis 1330
ccaacuucuuuguucugcagcaa

SEQ ID NO: 2482272 - RNA, 15 nt, Brucella suis 1330
ccaagaccgccgcga

SEQ ID NO: 2482273 - RNA, 21 nt, Brucella suis 1330
ccaagacuuuccauccagucg

SEQ ID NO: 2482274 - RNA, 22 nt, Brucella suis 1330
ccaagacuuuccauccagucga

SEQ ID NO: 2482275 - RNA, 17 nt, Brucella suis 1330
ccaagagccgcugaacc

SEQ ID NO: 2482276 - RNA, 20 nt, Brucella suis 1330
ccaagcccguaccaacccuu

SEQ ID NO: 2482277 - RNA, 13 nt, Brucella suis 1330
ccaagcccuucca

SEQ ID NO: 2482278 - RNA, 19 nt, Brucella suis 1330
ccaagcgucuugcgcucca

SEQ ID NO: 2482279 - RNA, 22 nt, Brucella suis 1330
ccaagcgucuugcgcuccacca

SEQ ID NO: 2482280 - RNA, 20 nt, Brucella suis 1330
ccaagcuugaucgccgcacg

SEQ ID NO: 2482281 - RNA, 16 nt, Brucella suis 1330
ccaaggccccagauca

SEQ ID NO: 2482282 - RNA, 22 nt, Brucella suis 1330
ccaaggucggcucaucgcgcug

SEQ ID NO: 2482283 - RNA, 23 nt, Brucella suis 1330
ccaagugcggucugcuugccgcc

SEQ ID NO: 2482284 - RNA, 16 nt, Brucella suis 1330
ccaauauugcaggcga

SEQ ID NO: 2482285 - RNA, 16 nt, Brucella suis 1330
ccaauccccucaccuu

SEQ ID NO: 2482286 - RNA, 14 nt, Brucella suis 1330
ccaaugcggucgca

SEQ ID NO: 2482287 - RNA, 19 nt, Brucella suis 1330
ccaaugcucgaugguccag

SEQ ID NO: 2482288 - RNA, 20 nt, Brucella suis 1330
ccaaugcucgaugguccagu

SEQ ID NO: 2482289 - RNA, 16 nt, Brucella suis 1330
ccacaagcaucugcuc

SEQ ID NO: 2482290 - RNA, 13 nt, Brucella suis 1330
ccacaagguccug

SEQ ID NO: 2482291 - RNA, 15 nt, Brucella suis 1330
ccacaccaucgcccg

SEQ ID NO: 2482292 - RNA, 15 nt, Brucella suis 1330
ccacacgaacagcag

SEQ ID NO: 2482293 - RNA, 18 nt, Brucella suis 1330
ccacacugauuuucaaaa

SEQ ID NO: 2482294 - RNA, 10 nt, Brucella suis 1330
ccacagccuu

SEQ ID NO: 2482295 - RNA, 15 nt, Brucella suis 1330
ccacagugaccagcg

SEQ ID NO: 2482296 - RNA, 16 nt, Brucella suis 1330
ccacauaaucgcccuc

SEQ ID NO: 2482297 - RNA, 20 nt, Brucella suis 1330
ccacauccgccaccgcgccg

SEQ ID NO: 2482298 - RNA, 14 nt, Brucella suis 1330
ccacaugaacuggc

SEQ ID NO: 2482299 - RNA, 22 nt, Brucella suis 1330
ccacaugaacuggcggaugaag

SEQ ID NO: 2482300 - RNA, 18 nt, Brucella suis 1330
ccacauugccuucgcgcc

SEQ ID NO: 2482301 - RNA, 13 nt, Brucella suis 1330
ccagcuugcgcac

SEQ ID NO: 2482302 - RNA, 14 nt, Brucella suis 1330
ccaggaacggcagg

SEQ ID NO: 2482303 - RNA, 18 nt, Brucella suis 1330
ccaggaccgcgaggaagc

SEQ ID NO: 2482304 - RNA, 21 nt, Brucella suis 1330
ccaggaugugucggccagagc

SEQ ID NO: 2482305 - RNA, 16 nt, Brucella suis 1330
ccaggcaucauuggcg

SEQ ID NO: 2482306 - RNA, 19 nt, Brucella suis 1330
ccaggccccgaugcggcug

SEQ ID NO: 2482307 - RNA, 23 nt, Brucella suis 1330
ccaggccgggcuuuggaggaacc

SEQ ID NO: 2482308 - RNA, 13 nt, Brucella suis 1330
ccagggcgcgcca

SEQ ID NO: 2482309 - RNA, 18 nt, Brucella suis 1330
ccagguaucgugcagaag

SEQ ID NO: 2482310 - RNA, 14 nt, Brucella suis 1330
ccagguggcugccc

SEQ ID NO: 2482311 - RNA, 19 nt, Brucella suis 1330
ccagguggcugcccgccgc

SEQ ID NO: 2482312 - RNA, 17 nt, Brucella suis 1330
ccagguugcgccgauau

SEQ ID NO: 2482313 - RNA, 13 nt, Brucella suis 1330
ccagucauggcgc

SEQ ID NO: 2482314 - RNA, 19 nt, Brucella suis 1330
ccagucauugacggcagcc

SEQ ID NO: 2482315 - RNA, 17 nt, Brucella suis 1330
ccagucgaggcagccac

SEQ ID NO: 2482316 - RNA, 22 nt, Brucella suis 1330
ccagucgaucagugggucccag

SEQ ID NO: 2482317 - RNA, 23 nt, Brucella suis 1330
ccagucgaucagugggucccagu

SEQ ID NO: 2482318 - RNA, 16 nt, Brucella suis 1330
ccagucgcugccccau

SEQ ID NO: 2482319 - RNA, 13 nt, Brucella suis 1330
ccagucggcaagg

SEQ ID NO: 2482320 - RNA, 21 nt, Brucella suis 1330
ccagugcauuggaaacgccgu

SEQ ID NO: 2482321 - RNA, 16 nt, Brucella suis 1330
ccaguggacugauuuc

SEQ ID NO: 2482322 - RNA, 20 nt, Brucella suis 1330
ccagugugaccacugcaucg

SEQ ID NO: 2482323 - RNA, 17 nt, Brucella suis 1330
ccaguuccugaaacacc

SEQ ID NO: 2482324 - RNA, 21 nt, Brucella suis 1330
ccaguuuauucauuggcggca

SEQ ID NO: 2482325 - RNA, 21 nt, Brucella suis 1330
ccaguuucugaaugcgccgcc

SEQ ID NO: 2482326 - RNA, 15 nt, Brucella suis 1330
ccauaccgcgccaag

SEQ ID NO: 2482327 - RNA, 14 nt, Brucella suis 1330
ccauagaacagcaa

SEQ ID NO: 2482328 - RNA, 14 nt, Brucella suis 1330
ccauagcucgacgc

SEQ ID NO: 2482329 - RNA, 13 nt, Brucella suis 1330
ccauauccucugu

SEQ ID NO: 2482330 - RNA, 19 nt, Brucella suis 1330
ccauauccucugugacugc

SEQ ID NO: 2482331 - RNA, 18 nt, Brucella suis 1330
ccauaucuucgcccugaa

SEQ ID NO: 2482332 - RNA, 14 nt, Brucella suis 1330
ccauaucuuuccau

SEQ ID NO: 2482333 - RNA, 18 nt, Brucella suis 1330
ccauaugacgcgguccca

SEQ ID NO: 2482334 - RNA, 16 nt, Brucella suis 1330
ccauauucguccacga

SEQ ID NO: 2482335 - RNA, 20 nt, Brucella suis 1330
ccaucaccgaaauccaggcg

SEQ ID NO: 2482336 - RNA, 16 nt, Brucella suis 1330
ccaucaggucgagcgc

SEQ ID NO: 2482337 - RNA, 14 nt, Brucella suis 1330
ccauccacaaaaac

SEQ ID NO: 2482338 - RNA, 17 nt, Brucella suis 1330
ccaucccggaaggaaug

SEQ ID NO: 2482339 - RNA, 12 nt, Brucella suis 1330
ccauccgccccg

SEQ ID NO: 2482340 - RNA, 13 nt, Brucella suis 1330
ccauccucgccaa

SEQ ID NO: 2482341 - RNA, 12 nt, Brucella suis 1330
ccauccucgguu

SEQ ID NO: 2482342 - RNA, 12 nt, Brucella suis 1330
ccaucgaaaccg

SEQ ID NO: 2482343 - RNA, 14 nt, Brucella suis 1330
ccaucgaaaccggc

SEQ ID NO: 2482344 - RNA, 15 nt, Brucella suis 1330
ccaucgaggaauagg

SEQ ID NO: 2482345 - RNA, 14 nt, Brucella suis 1330
ccaucgcccgccgc

SEQ ID NO: 2482346 - RNA, 23 nt, Brucella suis 1330
ccaucgucauugcgauccagcgc

SEQ ID NO: 2482347 - RNA, 17 nt, Brucella suis 1330
ccaucguuggauugcca

SEQ ID NO: 2482348 - RNA, 22 nt, Brucella suis 1330
ccaucucgcccaggaauucguc

SEQ ID NO: 2482349 - RNA, 13 nt, Brucella suis 1330
ccaucugccguca

SEQ ID NO: 2482350 - RNA, 12 nt, Brucella suis 1330
ccaucuuccuca

SEQ ID NO: 2482351 - RNA, 18 nt, Brucella suis 1330
ccaucuuccucacccuuc

SEQ ID NO: 2482352 - RNA, 23 nt, Brucella suis 1330
ccaugaagaucaauucccuggcu

SEQ ID NO: 2482353 - RNA, 14 nt, Brucella suis 1330
ccaugacgccgcuc

SEQ ID NO: 2482354 - RNA, 17 nt, Brucella suis 1330
ccaugacgccgcuccag

SEQ ID NO: 2482355 - RNA, 14 nt, Brucella suis 1330
ccaugacggcccgg

SEQ ID NO: 2482356 - RNA, 21 nt, Brucella suis 1330
ccaugagaaggcaagccccag

SEQ ID NO: 2482357 - RNA, 15 nt, Brucella suis 1330
ccaugagcuucaaca

SEQ ID NO: 2482358 - RNA, 14 nt, Brucella suis 1330
ccaugaugccgaca

SEQ ID NO: 2482359 - RNA, 17 nt, Brucella suis 1330
ccaugaugccgacaagc

SEQ ID NO: 2482360 - RNA, 18 nt, Brucella suis 1330
ccaugcaguuccauccau

SEQ ID NO: 2482361 - RNA, 19 nt, Brucella suis 1330
ccaugcccaugcaguucca

SEQ ID NO: 2482362 - RNA, 12 nt, Brucella suis 1330
ccaugcccggcg

SEQ ID NO: 2482363 - RNA, 17 nt, Brucella suis 1330
ccaugccuucccgccag

SEQ ID NO: 2482364 - RNA, 16 nt, Brucella suis 1330
ccaugccuuucagguc

SEQ ID NO: 2482365 - RNA, 19 nt, Brucella suis 1330
ccaugcgcaaccaaaacau

SEQ ID NO: 2482366 - RNA, 20 nt, Brucella suis 1330
ccaugcgcaaccaaaacaua

SEQ ID NO: 2482367 - RNA, 17 nt, Brucella suis 1330
ccaugcggcuccaguuc

SEQ ID NO: 2482368 - RNA, 12 nt, Brucella suis 1330
ccauggcuucaa

SEQ ID NO: 2482369 - RNA, 13 nt, Brucella suis 1330
ccauggcuucaag

SEQ ID NO: 2482370 - RNA, 20 nt, Brucella suis 1330
ccauggucaggccaagugcg

SEQ ID NO: 2482371 - RNA, 20 nt, Brucella suis 1330
ccauggugucauagaccaug

SEQ ID NO: 2482372 - RNA, 23 nt, Brucella suis 1330
ccauguugggguuggccugaacc

SEQ ID NO: 2482373 - RNA, 21 nt, Brucella suis 1330
ccauuaaucaaaaacaaucuc

SEQ ID NO: 2482374 - RNA, 21 nt, Brucella suis 1330
ccauuaguaucggcagccuug

SEQ ID NO: 2482375 - RNA, 15 nt, Brucella suis 1330
ccauucaaccgugcg

SEQ ID NO: 2482376 - RNA, 15 nt, Brucella suis 1330
ccauucugucggcgc

SEQ ID NO: 2482377 - RNA, 23 nt, Brucella suis 1330
ccauugacggagccggacgugac

SEQ ID NO: 2482378 - RNA, 23 nt, Brucella suis 1330
ccauugccgguugcuuccaugcc

SEQ ID NO: 2482379 - RNA, 20 nt, Brucella suis 1330
ccauuggaaauuauagccgc

SEQ ID NO: 2482380 - RNA, 14 nt, Brucella suis 1330
ccauuucagguucu

SEQ ID NO: 2482381 - RNA, 17 nt, Brucella suis 1330
ccauuucagguucucga

SEQ ID NO: 2482382 - RNA, 13 nt, Brucella suis 1330
cccaacccaucaa

SEQ ID NO: 2482383 - RNA, 17 nt, Brucella suis 1330
cccacccgaaggacugg

SEQ ID NO: 2482384 - RNA, 17 nt, Brucella suis 1330
cccaccgaagccacgaa

SEQ ID NO: 2482385 - RNA, 20 nt, Brucella suis 1330
cccacgaaacagaaagggcg

SEQ ID NO: 2482386 - RNA, 12 nt, Brucella suis 1330
cccacgcccagc

SEQ ID NO: 2482387 - RNA, 13 nt, Brucella suis 1330
cccagaaccugcc

SEQ ID NO: 2482388 - RNA, 14 nt, Brucella suis 1330
cccagaaccugccc

SEQ ID NO: 2482389 - RNA, 16 nt, Brucella suis 1330
cccagaaggcgcggca

SEQ ID NO: 2482390 - RNA, 20 nt, Brucella suis 1330
cccagaccgucaaaacgcca

SEQ ID NO: 2482391 - RNA, 16 nt, Brucella suis 1330
cccagaguucaaggcc

SEQ ID NO: 2482392 - RNA, 12 nt, Brucella suis 1330
cccagaugcagc

SEQ ID NO: 2482393 - RNA, 17 nt, Brucella suis 1330
cccagaugcagcggcgc

SEQ ID NO: 2482394 - RNA, 18 nt, Brucella suis 1330
cccagaugcagcggcgca

SEQ ID NO: 2482395 - RNA, 20 nt, Brucella suis 1330
cccagccaagcgccacgcgg

SEQ ID NO: 2482396 - RNA, 12 nt, Brucella suis 1330
cccaggaacggc

SEQ ID NO: 2482397 - RNA, 16 nt, Brucella suis 1330
cccagggaaucgcgca

SEQ ID NO: 2482398 - RNA, 14 nt, Brucella suis 1330
cccauaccgcgcca

SEQ ID NO: 2482399 - RNA, 20 nt, Brucella suis 1330
cccauauguauggcaaaagg

SEQ ID NO: 2482400 - RNA, 15 nt, Brucella suis 1330
cccaugacagcaacc

SEQ ID NO: 2482401 - RNA, 14 nt, Brucella suis 1330
cccaugccuuucag

SEQ ID NO: 2482402 - RNA, 16 nt, Brucella suis 1330
cccauggacuuuucag

SEQ ID NO: 2482403 - RNA, 15 nt, Brucella suis 1330
cccauggcauaccga

SEQ ID NO: 2482404 - RNA, 20 nt, Brucella suis 1330
cccauucaugcaccuucgcu

SEQ ID NO: 2482405 - RNA, 22 nt, Brucella suis 1330
ccccaccgucaaucgcaucugc

SEQ ID NO: 2482406 - RNA, 20 nt, Brucella suis 1330
ccccagaaggcgcggcagcu

SEQ ID NO: 2482407 - RNA, 17 nt, Brucella suis 1330
ccccagaucagcgucca

SEQ ID NO: 2482408 - RNA, 12 nt, Brucella suis 1330
ccccagccagaa

SEQ ID NO: 2482409 - RNA, 15 nt, Brucella suis 1330
ccccagccagaaccg

SEQ ID NO: 2482410 - RNA, 18 nt, Brucella suis 1330
ccccaguucguugugcca

SEQ ID NO: 2482411 - RNA, 14 nt, Brucella suis 1330
ccccauguuuauga

SEQ ID NO: 2482412 - RNA, 15 nt, Brucella suis 1330
ccccauugcaucgcc

SEQ ID NO: 2482413 - RNA, 20 nt, Brucella suis 1330
cccccagaaggcgcggcagc

SEQ ID NO: 2482414 - RNA, 21 nt, Brucella suis 1330
cccccagaaggcgcggcagcu

SEQ ID NO: 2482415 - RNA, 21 nt, Brucella suis 1330
cccccggcaguuucugccgcg

SEQ ID NO: 2482416 - RNA, 20 nt, Brucella suis 1330
cccccuugauaggcgcgccc

SEQ ID NO: 2482417 - RNA, 11 nt, Brucella suis 1330
ccccgcacggu

SEQ ID NO: 2482418 - RNA, 10 nt, Brucella suis 1330
aaaaaacacc

SEQ ID NO: 2482419 - RNA, 18 nt, Brucella suis 1330
aaaaaagcgcggagcaac

SEQ ID NO: 2482420 - RNA, 22 nt, Brucella suis 1330
aaaaaaggaugaugaccugacu

SEQ ID NO: 2482421 - RNA, 21 nt, Brucella suis 1330
aaaaaaucucgguuaucauuu

SEQ ID NO: 2482422 - RNA, 16 nt, Brucella suis 1330
aaaaagcccggucucg

SEQ ID NO: 2482423 - RNA, 14 nt, Brucella suis 1330
aaaaagcgcgcgca

SEQ ID NO: 2482424 - RNA, 18 nt, Brucella suis 1330
aaaaagggcuuccugcaa

SEQ ID NO: 2482425 - RNA, 19 nt, Brucella suis 1330
aaaaaucccggaauuugca

SEQ ID NO: 2482426 - RNA, 17 nt, Brucella suis 1330
aaaaaucgcgcggcuua

SEQ ID NO: 2482427 - RNA, 15 nt, Brucella suis 1330
aaaaauggaaaaacc

SEQ ID NO: 2482428 - RNA, 17 nt, Brucella suis 1330
aaaacauuaaccaauca

SEQ ID NO: 2482429 - RNA, 20 nt, Brucella suis 1330
aaaacccggcgcaaaggccg

SEQ ID NO: 2482430 - RNA, 23 nt, Brucella suis 1330
aaaaccgguucccacuuucggga

SEQ ID NO: 2482431 - RNA, 17 nt, Brucella suis 1330
aaaacgaggccgaccag

SEQ ID NO: 2482432 - RNA, 17 nt, Brucella suis 1330
aacacgaugauggccgg

SEQ ID NO: 2482433 - RNA, 12 nt, Brucella suis 1330
aacacgccgacg

SEQ ID NO: 2482434 - RNA, 15 nt, Brucella suis 1330
aacacggcgcuugau

SEQ ID NO: 2482435 - RNA, 14 nt, Brucella suis 1330
aacacuucgaucga

SEQ ID NO: 2482436 - RNA, 21 nt, Brucella suis 1330
aacagcaagcccagaaaucca

SEQ ID NO: 2482437 - RNA, 22 nt, Brucella suis 1330
aacagcaguaccgacaugccaa

SEQ ID NO: 2482438 - RNA, 23 nt, Brucella suis 1330
aacagcccgaacaauuugcgggc

SEQ ID NO: 2482439 - RNA, 15 nt, Brucella suis 1330
aacagccuuggcuuc

SEQ ID NO: 2482440 - RNA, 18 nt, Brucella suis 1330
aacagcgcgaacaugccu

SEQ ID NO: 2482441 - RNA, 20 nt, Brucella suis 1330
aacagcguuuccaugcggua

SEQ ID NO: 2482442 - RNA, 18 nt, Brucella suis 1330
aacaggcagcaugaacca

SEQ ID NO: 2482443 - RNA, 15 nt, Brucella suis 1330
aacagguugcgccac

SEQ ID NO: 2482444 - RNA, 12 nt, Brucella suis 1330
aacagugccgcc

SEQ ID NO: 2482445 - RNA, 12 nt, Brucella suis 1330
aacauacugccu

SEQ ID NO: 2482446 - RNA, 22 nt, Brucella suis 1330
aacauauaaagcaaaggccccg

SEQ ID NO: 2482447 - RNA, 21 nt, Brucella suis 1330
aacaugcacauccucggcccu

SEQ ID NO: 2482448 - RNA, 22 nt, Brucella suis 1330
aacaugccugccgcagccaggg

SEQ ID NO: 2482449 - RNA, 20 nt, Brucella suis 1330
aacauggacugaaugcagau

SEQ ID NO: 2482450 - RNA, 22 nt, Brucella suis 1330
aacauggugaugcgaauuucau

SEQ ID NO: 2482451 - RNA, 15 nt, Brucella suis 1330
aaccacgguggcuca

SEQ ID NO: 2482452 - RNA, 15 nt, Brucella suis 1330
aaccagcgacagggu

SEQ ID NO: 2482453 - RNA, 23 nt, Brucella suis 1330
aaccagcgacaggguaagcgccu

SEQ ID NO: 2482454 - RNA, 19 nt, Brucella suis 1330
aaccagcggccaucuucca

SEQ ID NO: 2482455 - RNA, 14 nt, Brucella suis 1330
aaccaggccgcggg

SEQ ID NO: 2482456 - RNA, 14 nt, Brucella suis 1330
aaccaguugaagcu

SEQ ID NO: 2482457 - RNA, 12 nt, Brucella suis 1330
aaccaugcguuu

SEQ ID NO: 2482458 - RNA, 23 nt, Brucella suis 1330
aaccccaguucguugugccagaa

SEQ ID NO: 2482459 - RNA, 13 nt, Brucella suis 1330
aaccccggcagcc

SEQ ID NO: 2482460 - RNA, 16 nt, Brucella suis 1330
aaccccggcagccuuc

SEQ ID NO: 2482461 - RNA, 23 nt, Brucella suis 1330
aaccccggcagccuucgcugccg

SEQ ID NO: 2482462 - RNA, 16 nt, Brucella suis 1330
aaccgaagaaugcgca

SEQ ID NO: 2482463 - RNA, 13 nt, Brucella suis 1330
aaccgagcagccg

SEQ ID NO: 2482464 - RNA, 24 nt, Brucella suis 1330
aaccgagcagccgcgaacgauugg

SEQ ID NO: 2482465 - RNA, 17 nt, Brucella suis 1330
aaccgcgcguaucggca

SEQ ID NO: 2482466 - RNA, 22 nt, Brucella suis 1330
aaccgcuucagccauucauggc

SEQ ID NO: 2482467 - RNA, 20 nt, Brucella suis 1330
aaccggaacgccuaaggcgc

SEQ ID NO: 2482468 - RNA, 12 nt, Brucella suis 1330
aaccggaagcgc

SEQ ID NO: 2482469 - RNA, 22 nt, Brucella suis 1330
aaccggcccacccaccgccugc

SEQ ID NO: 2482470 - RNA, 13 nt, Brucella suis 1330
aaccggcgaugag

SEQ ID NO: 2482471 - RNA, 22 nt, Brucella suis 1330
aaccggcgggcuugaugcgcca

SEQ ID NO: 2482472 - RNA, 19 nt, Brucella suis 1330
aaccguccgguugcaggcg

SEQ ID NO: 2482473 - RNA, 22 nt, Brucella suis 1330
aaccguguucgcacaagaagca

SEQ ID NO: 2482474 - RNA, 19 nt, Brucella suis 1330
aaccguuucacacuuuucg

SEQ ID NO: 2482475 - RNA, 20 nt, Brucella suis 1330
aaccuccgguucaugccgga

SEQ ID NO: 2482476 - RNA, 15 nt, Brucella suis 1330
aaccucgggcagggu

SEQ ID NO: 2482477 - RNA, 19 nt, Brucella suis 1330
aaccugcccgucgcaggcg

SEQ ID NO: 2482478 - RNA, 19 nt, Brucella suis 1330
aaccugcucauaaacgcug

SEQ ID NO: 2482479 - RNA, 14 nt, Brucella suis 1330
aaccuuugaaauaa

SEQ ID NO: 2482480 - RNA, 21 nt, Brucella suis 1330
aacgacuuuggccgucucuga

SEQ ID NO: 2482481 - RNA, 22 nt, Brucella suis 1330
aacgacuuuggccgucucugaa

SEQ ID NO: 2482482 - RNA, 16 nt, Brucella suis 1330
aacgagacaaggcaau

SEQ ID NO: 2482483 - RNA, 19 nt, Brucella suis 1330
aacgcaauggagcaggaag

SEQ ID NO: 2482484 - RNA, 19 nt, Brucella suis 1330
aacgcaccgggcuuuuuga

SEQ ID NO: 2482485 - RNA, 13 nt, Brucella suis 1330
aacgcagcaucac

SEQ ID NO: 2482486 - RNA, 17 nt, Brucella suis 1330
aacgcauagagccacga

SEQ ID NO: 2482487 - RNA, 19 nt, Brucella suis 1330
aacgcccuucaaaccaucc

SEQ ID NO: 2482488 - RNA, 13 nt, Brucella suis 1330
aacgccgaagcca

SEQ ID NO: 2482489 - RNA, 14 nt, Brucella suis 1330
aacgccgaagcuug

SEQ ID NO: 2482490 - RNA, 16 nt, Brucella suis 1330
aacgcggguggaugga

SEQ ID NO: 2482491 - RNA, 12 nt, Brucella suis 1330
aacgcugcaaca

SEQ ID NO: 2482492 - RNA, 13 nt, Brucella suis 1330
aacgcugcaacaa

SEQ ID NO: 2482493 - RNA, 14 nt, Brucella suis 1330
aacgcugcaacaaa

SEQ ID NO: 2482494 - RNA, 18 nt, Brucella suis 1330
aacgcugcaacaaaugca

SEQ ID NO: 2482495 - RNA, 19 nt, Brucella suis 1330
aacgcuuugaccgccgcga

SEQ ID NO: 2482496 - RNA, 22 nt, Brucella suis 1330
aacggauugccgagaucaccca

SEQ ID NO: 2482497 - RNA, 14 nt, Brucella suis 1330
aacggccaagcagg

SEQ ID NO: 2482498 - RNA, 15 nt, Brucella suis 1330
aacggccaagcagga

SEQ ID NO: 2482499 - RNA, 14 nt, Brucella suis 1330
aacggccaugcgca

SEQ ID NO: 2482500 - RNA, 18 nt, Brucella suis 1330
aacggcccaugagcuuca

SEQ ID NO: 2482501 - RNA, 19 nt, Brucella suis 1330
aacggcccaugagcuucaa

SEQ ID NO: 2482502 - RNA, 23 nt, Brucella suis 1330
aacgguggccuuccuucauacaa

SEQ ID NO: 2482503 - RNA, 21 nt, Brucella suis 1330
aacgguuuucggaaaagaugc

SEQ ID NO: 2482504 - RNA, 20 nt, Brucella suis 1330
aacguacaccgaggccgcca

SEQ ID NO: 2482505 - RNA, 17 nt, Brucella suis 1330
aacuaccaucugccguc

SEQ ID NO: 2482506 - RNA, 12 nt, Brucella suis 1330
aacucgucgggu

SEQ ID NO: 2482507 - RNA, 13 nt, Brucella suis 1330
aacucucacagcc

SEQ ID NO: 2482508 - RNA, 19 nt, Brucella suis 1330
aacugaaaaaggccgggaa

SEQ ID NO: 2482509 - RNA, 16 nt, Brucella suis 1330
aacugcaucacaguca

SEQ ID NO: 2482510 - RNA, 19 nt, Brucella suis 1330
aacugccuuuuacagcgua

SEQ ID NO: 2482511 - RNA, 23 nt, Brucella suis 1330
aacuggauccggcgaauggcuug

SEQ ID NO: 2482512 - RNA, 13 nt, Brucella suis 1330
aacuggcggauga

SEQ ID NO: 2482513 - RNA, 19 nt, Brucella suis 1330
aacuggcggaugaagaaga

SEQ ID NO: 2482514 - RNA, 23 nt, Brucella suis 1330
aacuuccgguauaugcaccagcg

SEQ ID NO: 2482515 - RNA, 14 nt, Brucella suis 1330
aagaacagcgcgaa

SEQ ID NO: 2482516 - RNA, 12 nt, Brucella suis 1330
aagaacggcagg

SEQ ID NO: 2482517 - RNA, 22 nt, Brucella suis 1330
aagaagaugagcgacaggaaca

SEQ ID NO: 2482518 - RNA, 21 nt, Brucella suis 1330
aagaagcgcgggguguugcuc

SEQ ID NO: 2482519 - RNA, 16 nt, Brucella suis 1330
aagaaggcgacgagac

SEQ ID NO: 2482520 - RNA, 22 nt, Brucella suis 1330
aagaauucccggcugagcagau

SEQ ID NO: 2482521 - RNA, 18 nt, Brucella suis 1330
aagacauuuucgccgggg

SEQ ID NO: 2482522 - RNA, 22 nt, Brucella suis 1330
aagaccagcaggaagaaggcga

SEQ ID NO: 2482523 - RNA, 15 nt, Brucella suis 1330
aagaccuggaacggg

SEQ ID NO: 2482524 - RNA, 15 nt, Brucella suis 1330
aagacgaucuuuucc

SEQ ID NO: 2482525 - RNA, 14 nt, Brucella suis 1330
aagacgcgcaacac

SEQ ID NO: 2482526 - RNA, 21 nt, Brucella suis 1330
aagagagugaugcagauaaaa

SEQ ID NO: 2482527 - RNA, 12 nt, Brucella suis 1330
aagagcgcucgc

SEQ ID NO: 2482528 - RNA, 20 nt, Brucella suis 1330
aagagcggcguugaugucgu

SEQ ID NO: 2482529 - RNA, 17 nt, Brucella suis 1330
aagaggaacgacuuugg

SEQ ID NO: 2482530 - RNA, 17 nt, Brucella suis 1330
aagauaaucagcagaag

SEQ ID NO: 2482531 - RNA, 14 nt, Brucella suis 1330
aagaucagccagcc

SEQ ID NO: 2482532 - RNA, 14 nt, Brucella suis 1330
aagaucaucgccgu

SEQ ID NO: 2482533 - RNA, 17 nt, Brucella suis 1330
aagaucgacaaagccug

SEQ ID NO: 2482534 - RNA, 17 nt, Brucella suis 1330
aagaugcgcgccagccg

SEQ ID NO: 2482535 - RNA, 15 nt, Brucella suis 1330
aagaugcuugaggau

SEQ ID NO: 2482536 - RNA, 19 nt, Brucella suis 1330
aagauggagcggcugaugc

SEQ ID NO: 2482537 - RNA, 22 nt, Brucella suis 1330
aagcaaaggccccggaacauau

SEQ ID NO: 2482538 - RNA, 22 nt, Brucella suis 1330
aagcaaaggucgggugccagau

SEQ ID NO: 2482539 - RNA, 13 nt, Brucella suis 1330
aagcaacagggcg

SEQ ID NO: 2482540 - RNA, 23 nt, Brucella suis 1330
aagcaagcacuacgucaacagcc

SEQ ID NO: 2482541 - RNA, 21 nt, Brucella suis 1330
aagcaccagcgcgccgaucac

SEQ ID NO: 2482542 - RNA, 17 nt, Brucella suis 1330
aagcaccaugagcgccg

SEQ ID NO: 2482543 - RNA, 14 nt, Brucella suis 1330
aagcacccgcuugg

SEQ ID NO: 2482544 - RNA, 13 nt, Brucella suis 1330
aagcaccgaucac

SEQ ID NO: 2482545 - RNA, 16 nt, Brucella suis 1330
aagcacuacgucaaca

SEQ ID NO: 2482546 - RNA, 20 nt, Brucella suis 1330
aagcaggcauuggcggauga

SEQ ID NO: 2482547 - RNA, 24 nt, Brucella suis 1330
aagcaguuccugcgcgaacacgau

SEQ ID NO: 2482548 - RNA, 14 nt, Brucella suis 1330
aaucagcagaagga

SEQ ID NO: 2482549 - RNA, 15 nt, Brucella suis 1330
aaucagcgucagcgc

SEQ ID NO: 2482550 - RNA, 19 nt, Brucella suis 1330
aaucaggcaggcgaaucuc

SEQ ID NO: 2482551 - RNA, 16 nt, Brucella suis 1330
aaucagggaaaagccg

SEQ ID NO: 2482552 - RNA, 17 nt, Brucella suis 1330
aauccacuacaaccggc

SEQ ID NO: 2482553 - RNA, 23 nt, Brucella suis 1330
aauccauuagauacauauacuua

SEQ ID NO: 2482554 - RNA, 13 nt, Brucella suis 1330
aauccccucaccu

SEQ ID NO: 2482555 - RNA, 15 nt, Brucella suis 1330
aaucccgaaaaguug

SEQ ID NO: 2482556 - RNA, 14 nt, Brucella suis 1330
aaucccuuacucca

SEQ ID NO: 2482557 - RNA, 17 nt, Brucella suis 1330
aaucccuuacuccauua

SEQ ID NO: 2482558 - RNA, 20 nt, Brucella suis 1330
aauccgauuaucgcgaagaa

SEQ ID NO: 2482559 - RNA, 16 nt, Brucella suis 1330
aauccgcaauggcccg

SEQ ID NO: 2482560 - RNA, 23 nt, Brucella suis 1330
aauccggcgugaucgggaaauaa

SEQ ID NO: 2482561 - RNA, 19 nt, Brucella suis 1330
aauccucgaucuugucgcc

SEQ ID NO: 2482562 - RNA, 20 nt, Brucella suis 1330
aauccuggugcgcagcucgg

SEQ ID NO: 2482563 - RNA, 17 nt, Brucella suis 1330
aauccuuccugauuuac

SEQ ID NO: 2482564 - RNA, 15 nt, Brucella suis 1330
aaucgagaucgcgcg

SEQ ID NO: 2482565 - RNA, 16 nt, Brucella suis 1330
aaucgagggguuuuuc

SEQ ID NO: 2482566 - RNA, 15 nt, Brucella suis 1330
aaucgauuucgucca

SEQ ID NO: 2482567 - RNA, 18 nt, Brucella suis 1330
aaucgccaccggcggcgc

SEQ ID NO: 2482568 - RNA, 12 nt, Brucella suis 1330
aaucgcgcggcu

SEQ ID NO: 2482569 - RNA, 13 nt, Brucella suis 1330
aaucgcuucacgc

SEQ ID NO: 2482570 - RNA, 22 nt, Brucella suis 1330
aaucggcacuucgccaaagaua

SEQ ID NO: 2482571 - RNA, 14 nt, Brucella suis 1330
aaucguaucgccaa

SEQ ID NO: 2482572 - RNA, 18 nt, Brucella suis 1330
aaucguggucgccucuuc

SEQ ID NO: 2482573 - RNA, 15 nt, Brucella suis 1330
aaucguguccacaug

SEQ ID NO: 2482574 - RNA, 13 nt, Brucella suis 1330
aaucucacacugc

SEQ ID NO: 2482575 - RNA, 14 nt, Brucella suis 1330
aaucuccaucguug

SEQ ID NO: 2482576 - RNA, 14 nt, Brucella suis 1330
aaucuccccuuccu

SEQ ID NO: 2482577 - RNA, 18 nt, Brucella suis 1330
aaucugacccggcgcaaa

SEQ ID NO: 2482578 - RNA, 20 nt, Brucella suis 1330
aaucugcgcugcccucuuga

SEQ ID NO: 2482579 - RNA, 22 nt, Brucella suis 1330
aaucugcucguccggccagccg

SEQ ID NO: 2482580 - RNA, 23 nt, Brucella suis 1330
aaucuggagugcacggccaugaa

SEQ ID NO: 2482581 - RNA, 15 nt, Brucella suis 1330
aaucuguucacauuu

SEQ ID NO: 2482582 - RNA, 19 nt, Brucella suis 1330
aaucuugacguuauuuccg

SEQ ID NO: 2482583 - RNA, 19 nt, Brucella suis 1330
aaucuugcccucgccgccg

SEQ ID NO: 2482584 - RNA, 12 nt, Brucella suis 1330
aaugaaucagac

SEQ ID NO: 2482585 - RNA, 11 nt, Brucella suis 1330
aaugagcgcgc

SEQ ID NO: 2482586 - RNA, 19 nt, Brucella suis 1330
aaugauagcuggaaaaaau

SEQ ID NO: 2482587 - RNA, 14 nt, Brucella suis 1330
aaugaucuggcgcg

SEQ ID NO: 2482588 - RNA, 13 nt, Brucella suis 1330
aaugcaaaugccg

SEQ ID NO: 2482589 - RNA, 21 nt, Brucella suis 1330
aaugcaccccaugagaaggca

SEQ ID NO: 2482590 - RNA, 23 nt, Brucella suis 1330
aaugcacccggcaccgcaaagag

SEQ ID NO: 2482591 - RNA, 14 nt, Brucella suis 1330
aaugcagccagagc

SEQ ID NO: 2482592 - RNA, 20 nt, Brucella suis 1330
aaugcagcggguucauuuuc

SEQ ID NO: 2482593 - RNA, 15 nt, Brucella suis 1330
aaugcaggcgcggca

SEQ ID NO: 2482594 - RNA, 17 nt, Brucella suis 1330
aaugcauggaggcaagc

SEQ ID NO: 2482595 - RNA, 21 nt, Brucella suis 1330
aaugccaagugaagcgaagaa

SEQ ID NO: 2482596 - RNA, 17 nt, Brucella suis 1330
aaugccacccuuugugc

SEQ ID NO: 2482597 - RNA, 23 nt, Brucella suis 1330
aaugccccgcaccgacaaaaaca

SEQ ID NO: 2482598 - RNA, 18 nt, Brucella suis 1330
aaugccggcgaucuuuuc

SEQ ID NO: 2482599 - RNA, 21 nt, Brucella suis 1330
aaugccgugaagugaaaccag

SEQ ID NO: 2482600 - RNA, 19 nt, Brucella suis 1330
aaugccguucuuggccaug

SEQ ID NO: 2482601 - RNA, 19 nt, Brucella suis 1330
aaugccuggcucaaacccg

SEQ ID NO: 2482602 - RNA, 12 nt, Brucella suis 1330
aaugcgccgcca

SEQ ID NO: 2482603 - RNA, 21 nt, Brucella suis 1330
aaugcgcuucuuccuucggca

SEQ ID NO: 2482604 - RNA, 18 nt, Brucella suis 1330
aaugcggggcuuuucauu

SEQ ID NO: 2482605 - RNA, 14 nt, Brucella suis 1330
aauggagcauuucc

SEQ ID NO: 2482606 - RNA, 14 nt, Brucella suis 1330
aauggcaagcagca

SEQ ID NO: 2482607 - RNA, 18 nt, Brucella suis 1330
aauggcaagcagcaaaac

SEQ ID NO: 2482608 - RNA, 13 nt, Brucella suis 1330
aauggcccuguca

SEQ ID NO: 2482609 - RNA, 16 nt, Brucella suis 1330
aauggcgcgcgcggcu

SEQ ID NO: 2482610 - RNA, 18 nt, Brucella suis 1330
aauggcgcuagcgaugau

SEQ ID NO: 2482611 - RNA, 16 nt, Brucella suis 1330
aauggcuuccagcagg

SEQ ID NO: 2482612 - RNA, 15 nt, Brucella suis 1330
aauggggggcaggca

SEQ ID NO: 2482613 - RNA, 21 nt, Brucella suis 1330
aauggucacggccacaugguc

SEQ ID NO: 2482614 - RNA, 22 nt, Brucella suis 1330
aaugucaguugaucgcgauaau

SEQ ID NO: 2482615 - RNA, 14 nt, Brucella suis 1330
aaugugaaggcgcu

SEQ ID NO: 2482616 - RNA, 23 nt, Brucella suis 1330
aaugugcccuugagagccagauc

SEQ ID NO: 2482617 - RNA, 16 nt, Brucella suis 1330
aaugugccgcugcacc

SEQ ID NO: 2482618 - RNA, 17 nt, Brucella suis 1330
aaugugccugaaacaag

SEQ ID NO: 2482619 - RNA, 17 nt, Brucella suis 1330
aauuauugcgcuaucag

SEQ ID NO: 2482620 - RNA, 19 nt, Brucella suis 1330
aauuccugcgccaccugca

SEQ ID NO: 2482621 - RNA, 22 nt, Brucella suis 1330
aauugguguagaagacaaagcc

SEQ ID NO: 2482622 - RNA, 13 nt, Brucella suis 1330
aauuguuccagcc

SEQ ID NO: 2482623 - RNA, 13 nt, Brucella suis 1330
aauuugauggugc

SEQ ID NO: 2482624 - RNA, 16 nt, Brucella suis 1330
aauuuguaguucaggc

SEQ ID NO: 2482625 - RNA, 15 nt, Brucella suis 1330
acaaaagaagauuuc

SEQ ID NO: 2482626 - RNA, 16 nt, Brucella suis 1330
acaaagaaguuggggg

SEQ ID NO: 2482627 - RNA, 10 nt, Brucella suis 1330
acaaagauga

SEQ ID NO: 2482628 - RNA, 18 nt, Brucella suis 1330
acaaagcccgucucgucg

SEQ ID NO: 2482629 - RNA, 16 nt, Brucella suis 1330
acaaaucagcuuggca

SEQ ID NO: 2482630 - RNA, 17 nt, Brucella suis 1330
acaacagcaguaccgac

SEQ ID NO: 2482631 - RNA, 16 nt, Brucella suis 1330
acaaccgcgccgcugg

SEQ ID NO: 2482632 - RNA, 16 nt, Brucella suis 1330
acaacgcugcguggga

SEQ ID NO: 2482633 - RNA, 22 nt, Brucella suis 1330
acaacgcugcgugggaaaccgc

SEQ ID NO: 2482634 - RNA, 17 nt, Brucella suis 1330
acaagacggaucagcga

SEQ ID NO: 2482635 - RNA, 18 nt, Brucella suis 1330
acaagagccgcucuggac

SEQ ID NO: 2482636 - RNA, 20 nt, Brucella suis 1330
acaagagggcgcagcagcgc

SEQ ID NO: 2482637 - RNA, 14 nt, Brucella suis 1330
acaagaucgucacu

SEQ ID NO: 2482638 - RNA, 16 nt, Brucella suis 1330
acaagcuucaggcucu

SEQ ID NO: 2482639 - RNA, 21 nt, Brucella suis 1330
acaagcuucaggcucuugucg

SEQ ID NO: 2482640 - RNA, 18 nt, Brucella suis 1330
acaagcuugauaaggccg

SEQ ID NO: 2482641 - RNA, 20 nt, Brucella suis 1330
acaaguccuaaaacaccggc

SEQ ID NO: 2482642 - RNA, 22 nt, Brucella suis 1330
acaauauuguucgacuugaaga

SEQ ID NO: 2482643 - RNA, 16 nt, Brucella suis 1330
acaaucuccggcgcgg

SEQ ID NO: 2482644 - RNA, 18 nt, Brucella suis 1330
acaaugaagcaaaggucg

SEQ ID NO: 2482645 - RNA, 13 nt, Brucella suis 1330
acaaugccuugag

SEQ ID NO: 2482646 - RNA, 11 nt, Brucella suis 1330
acaauggccgu

SEQ ID NO: 2482647 - RNA, 14 nt, Brucella suis 1330
acaauuccagccgg

SEQ ID NO: 2482648 - RNA, 19 nt, Brucella suis 1330
acacaaucgccggaaccgc

SEQ ID NO: 2482649 - RNA, 16 nt, Brucella suis 1330
acaccaaaagagcgcu

SEQ ID NO: 2482650 - RNA, 18 nt, Brucella suis 1330
acaccgaacugggcggcc

SEQ ID NO: 2482651 - RNA, 23 nt, Brucella suis 1330
acaccgaccggcacccacugccc

SEQ ID NO: 2482652 - RNA, 14 nt, Brucella suis 1330
acaccuucggccag

SEQ ID NO: 2482653 - RNA, 23 nt, Brucella suis 1330
acaccuucggccagcgcaaagcg

SEQ ID NO: 2482654 - RNA, 13 nt, Brucella suis 1330
acacgaacagcag

SEQ ID NO: 2482655 - RNA, 20 nt, Brucella suis 1330
acacgccgccgcgcggcagc

SEQ ID NO: 2482656 - RNA, 16 nt, Brucella suis 1330
acacggccgaucgcca

SEQ ID NO: 2482657 - RNA, 17 nt, Brucella suis 1330
acacggccgaucgccag

SEQ ID NO: 2482658 - RNA, 18 nt, Brucella suis 1330
acacgguuccaccggcug

SEQ ID NO: 2482659 - RNA, 16 nt, Brucella suis 1330
acacucugccugcccu

SEQ ID NO: 2482660 - RNA, 13 nt, Brucella suis 1330
acacuucgaucga

SEQ ID NO: 2482661 - RNA, 17 nt, Brucella suis 1330
acacuuuucgggaugcg

SEQ ID NO: 2482662 - RNA, 15 nt, Brucella suis 1330
acagaaccaucggaa

SEQ ID NO: 2482663 - RNA, 13 nt, Brucella suis 1330
acagaagcaccag

SEQ ID NO: 2482664 - RNA, 16 nt, Brucella suis 1330
acagaagguuacuugc

SEQ ID NO: 2482665 - RNA, 21 nt, Brucella suis 1330
accgaacugggcggccagcuc

SEQ ID NO: 2482666 - RNA, 21 nt, Brucella suis 1330
accgaagccacgaagcgguug

SEQ ID NO: 2482667 - RNA, 18 nt, Brucella suis 1330
accgaauccacguuugga

SEQ ID NO: 2482668 - RNA, 20 nt, Brucella suis 1330
accgaaugaaccggcucugc

SEQ ID NO: 2482669 - RNA, 22 nt, Brucella suis 1330
accgaauugaucuugagcuuca

SEQ ID NO: 2482670 - RNA, 19 nt, Brucella suis 1330
accgacacguccgggaagc

SEQ ID NO: 2482671 - RNA, 15 nt, Brucella suis 1330
accgagcagaaugcc

SEQ ID NO: 2482672 - RNA, 22 nt, Brucella suis 1330
accgagcagaaugccacaaggu

SEQ ID NO: 2482673 - RNA, 14 nt, Brucella suis 1330
accgaggcaaugaa

SEQ ID NO: 2482674 - RNA, 15 nt, Brucella suis 1330
accgaggccgccacc

SEQ ID NO: 2482675 - RNA, 16 nt, Brucella suis 1330
accgauaccggaucgc

SEQ ID NO: 2482676 - RNA, 12 nt, Brucella suis 1330
accgauccgcaa

SEQ ID NO: 2482677 - RNA, 18 nt, Brucella suis 1330
accgaucgugccgccuuc

SEQ ID NO: 2482678 - RNA, 14 nt, Brucella suis 1330
accgaugacgagcc

SEQ ID NO: 2482679 - RNA, 19 nt, Brucella suis 1330
accgaugacgagccucgcc

SEQ ID NO: 2482680 - RNA, 14 nt, Brucella suis 1330
accgcaaagagaac

SEQ ID NO: 2482681 - RNA, 17 nt, Brucella suis 1330
accgcauggaaacgcug

SEQ ID NO: 2482682 - RNA, 15 nt, Brucella suis 1330
accgccggcgccgcc

SEQ ID NO: 2482683 - RNA, 16 nt, Brucella suis 1330
accgccggcgccgcca

SEQ ID NO: 2482684 - RNA, 15 nt, Brucella suis 1330
accgccugccagccc

SEQ ID NO: 2482685 - RNA, 14 nt, Brucella suis 1330
accgccugcgcgca

SEQ ID NO: 2482686 - RNA, 12 nt, Brucella suis 1330
accgccuguccg

SEQ ID NO: 2482687 - RNA, 15 nt, Brucella suis 1330
accgccuuuuccagu

SEQ ID NO: 2482688 - RNA, 18 nt, Brucella suis 1330
accgcgaaagcacccgcu

SEQ ID NO: 2482689 - RNA, 17 nt, Brucella suis 1330
accgcgaaagccagaac

SEQ ID NO: 2482690 - RNA, 21 nt, Brucella suis 1330
accgcgaggaagccugcaccg

SEQ ID NO: 2482691 - RNA, 19 nt, Brucella suis 1330
accgcgcaauaaugcagcg

SEQ ID NO: 2482692 - RNA, 23 nt, Brucella suis 1330
accgcgcaauugcgcaaggcccu

SEQ ID NO: 2482693 - RNA, 21 nt, Brucella suis 1330
accgcgccaaggcugcgcgca

SEQ ID NO: 2482694 - RNA, 15 nt, Brucella suis 1330
accgcgccggaaggc

SEQ ID NO: 2482695 - RNA, 16 nt, Brucella suis 1330
accgcgccggaaggcg

SEQ ID NO: 2482696 - RNA, 12 nt, Brucella suis 1330
accgcgcggcgu

SEQ ID NO: 2482697 - RNA, 17 nt, Brucella suis 1330
accgcgcguaucggcaa

SEQ ID NO: 2482698 - RNA, 22 nt, Brucella suis 1330
accgcucaccacauaggugcgc

SEQ ID NO: 2482699 - RNA, 17 nt, Brucella suis 1330
accggcacccacugccc

SEQ ID NO: 2482700 - RNA, 12 nt, Brucella suis 1330
accggcauggau

SEQ ID NO: 2482701 - RNA, 16 nt, Brucella suis 1330
accggcauugagccgc

SEQ ID NO: 2482702 - RNA, 20 nt, Brucella suis 1330
accggcauugagccgcgcgg

SEQ ID NO: 2482703 - RNA, 17 nt, Brucella suis 1330
accggccacccagcccg

SEQ ID NO: 2482704 - RNA, 16 nt, Brucella suis 1330
accggccauaugaacg

SEQ ID NO: 2482705 - RNA, 20 nt, Brucella suis 1330
accggccauaugaacgcuga

SEQ ID NO: 2482706 - RNA, 18 nt, Brucella suis 1330
accggcccaaaggccgcg

SEQ ID NO: 2482707 - RNA, 20 nt, Brucella suis 1330
accggcccaaaggccgcgcc

SEQ ID NO: 2482708 - RNA, 19 nt, Brucella suis 1330
accggcccacccaccgccu

SEQ ID NO: 2482709 - RNA, 23 nt, Brucella suis 1330
accggccuugauguccggcgcgc

SEQ ID NO: 2482710 - RNA, 12 nt, Brucella suis 1330
accggcgaaaag

SEQ ID NO: 2482711 - RNA, 14 nt, Brucella suis 1330
accggcgaaaaggc

SEQ ID NO: 2482712 - RNA, 12 nt, Brucella suis 1330
accggcgggagc

SEQ ID NO: 2482713 - RNA, 15 nt, Brucella suis 1330
accggcucugcggaa

SEQ ID NO: 2482714 - RNA, 15 nt, Brucella suis 1330
accggcuggcacaaa

SEQ ID NO: 2482715 - RNA, 13 nt, Brucella suis 1330
accggcugggccu

SEQ ID NO: 2482716 - RNA, 19 nt, Brucella suis 1330
accggcugggccuuguuuu

SEQ ID NO: 2482717 - RNA, 15 nt, Brucella suis 1330
accgggcuucuuguu

SEQ ID NO: 2482718 - RNA, 18 nt, Brucella suis 1330
accgucaaucgcaucugc

SEQ ID NO: 2482719 - RNA, 18 nt, Brucella suis 1330
accguugcauauuccaca

SEQ ID NO: 2482720 - RNA, 22 nt, Brucella suis 1330
accguuuggaugugcagcgugc

SEQ ID NO: 2482721 - RNA, 20 nt, Brucella suis 1330
accuaaaccuuugaaauaau

SEQ ID NO: 2482722 - RNA, 21 nt, Brucella suis 1330
accuaaaccuuugaaauaauu

SEQ ID NO: 2482723 - RNA, 17 nt, Brucella suis 1330
accucaggaugagggag

SEQ ID NO: 2482724 - RNA, 13 nt, Brucella suis 1330
accucauuugcca

SEQ ID NO: 2482725 - RNA, 17 nt, Brucella suis 1330
accucauuugccaccug

SEQ ID NO: 2482726 - RNA, 20 nt, Brucella suis 1330
accuccacgcucaacacucu

SEQ ID NO: 2482727 - RNA, 13 nt, Brucella suis 1330
accucgaaaacau

SEQ ID NO: 2482728 - RNA, 16 nt, Brucella suis 1330
accugauccagaagcc

SEQ ID NO: 2482729 - RNA, 24 nt, Brucella suis 1330
accugauccagaagccgcuugcau

SEQ ID NO: 2482730 - RNA, 21 nt, Brucella suis 1330
accugccaucaccagccccca

SEQ ID NO: 2482731 - RNA, 17 nt, Brucella suis 1330
accugcccgcacccuau

SEQ ID NO: 2482732 - RNA, 21 nt, Brucella suis 1330
accugcccgucuuccuccgca

SEQ ID NO: 2482733 - RNA, 21 nt, Brucella suis 1330
accugcggcgccagaugcgca

SEQ ID NO: 2482734 - RNA, 12 nt, Brucella suis 1330
accuggccagcc

SEQ ID NO: 2482735 - RNA, 13 nt, Brucella suis 1330
accuggccagcca

SEQ ID NO: 2482736 - RNA, 21 nt, Brucella suis 1330
accugggccacggcgaaagcu

SEQ ID NO: 2482737 - RNA, 21 nt, Brucella suis 1330
accuuaaaguacacuccgcuc

SEQ ID NO: 2482738 - RNA, 17 nt, Brucella suis 1330
accuuccgggcaauauc

SEQ ID NO: 2482739 - RNA, 15 nt, Brucella suis 1330
accuucuggaaaagu

SEQ ID NO: 2482740 - RNA, 14 nt, Brucella suis 1330
accuucuggaagcg

SEQ ID NO: 2482741 - RNA, 15 nt, Brucella suis 1330
accuucuuggagccg

SEQ ID NO: 2482742 - RNA, 13 nt, Brucella suis 1330
accuugccgggcg

SEQ ID NO: 2482743 - RNA, 19 nt, Brucella suis 1330
accuugggguggucccaaa

SEQ ID NO: 2482744 - RNA, 18 nt, Brucella suis 1330
acgaaagccuuuucgaua

SEQ ID NO: 2482745 - RNA, 22 nt, Brucella suis 1330
acgaaaugaacaucggcgcgcu

SEQ ID NO: 2482746 - RNA, 20 nt, Brucella suis 1330
acgaaaugggggccacgggc

SEQ ID NO: 2482747 - RNA, 13 nt, Brucella suis 1330
acgaacagcagca

SEQ ID NO: 2482748 - RNA, 17 nt, Brucella suis 1330
acgaaccccgcaucaug

SEQ ID NO: 2482749 - RNA, 20 nt, Brucella suis 1330
acgaaccgaaaccgugacau

SEQ ID NO: 2482750 - RNA, 15 nt, Brucella suis 1330
acgaacucgaugccu

SEQ ID NO: 2482751 - RNA, 14 nt, Brucella suis 1330
acgacauagauucc

SEQ ID NO: 2482752 - RNA, 16 nt, Brucella suis 1330
acgaccagcgcaaugc

SEQ ID NO: 2482753 - RNA, 19 nt, Brucella suis 1330
acgacccguuugaagagcu

SEQ ID NO: 2482754 - RNA, 12 nt, Brucella suis 1330
acgacugaaaua

SEQ ID NO: 2482755 - RNA, 14 nt, Brucella suis 1330
acgacugaaauaau

SEQ ID NO: 2482756 - RNA, 14 nt, Brucella suis 1330
acgacuuuggccgu

SEQ ID NO: 2482757 - RNA, 19 nt, Brucella suis 1330
acgagaucaauacgcucgc

SEQ ID NO: 2482758 - RNA, 15 nt, Brucella suis 1330
acgagauugccgcca

SEQ ID NO: 2482759 - RNA, 17 nt, Brucella suis 1330
acgagcgcacgcaggca

SEQ ID NO: 2482760 - RNA, 16 nt, Brucella suis 1330
acgaggccgaccagaa

SEQ ID NO: 2482761 - RNA, 17 nt, Brucella suis 1330
acgaggccgaccagaac

SEQ ID NO: 2482762 - RNA, 17 nt, Brucella suis 1330
acgauaccgagaacggc

SEQ ID NO: 2482763 - RNA, 20 nt, Brucella suis 1330
acgauagacgcggcggcaau

SEQ ID NO: 2482764 - RNA, 16 nt, Brucella suis 1330
acgaucgagcgaacgg

SEQ ID NO: 2482765 - RNA, 15 nt, Brucella suis 1330
acgaucuccaguaaa

SEQ ID NO: 2482766 - RNA, 13 nt, Brucella suis 1330
acgaugacccagc

SEQ ID NO: 2482767 - RNA, 20 nt, Brucella suis 1330
acgaugauggccgggaaugc

SEQ ID NO: 2482768 - RNA, 16 nt, Brucella suis 1330
acgaugcgcagccgcg

SEQ ID NO: 2482769 - RNA, 17 nt, Brucella suis 1330
acgauggaaggaaagcc

SEQ ID NO: 2482770 - RNA, 14 nt, Brucella suis 1330
acgauggcccagcg

SEQ ID NO: 2482771 - RNA, 13 nt, Brucella suis 1330
acgcaaggcggcu

SEQ ID NO: 2482772 - RNA, 17 nt, Brucella suis 1330
acgcaaggcggcuggaa

SEQ ID NO: 2482773 - RNA, 12 nt, Brucella suis 1330
acgcaaucucaa

SEQ ID NO: 2482774 - RNA, 15 nt, Brucella suis 1330
acgcaauggagcagg

SEQ ID NO: 2482775 - RNA, 16 nt, Brucella suis 1330
acgcaauggagcagga

SEQ ID NO: 2482776 - RNA, 21 nt, Brucella suis 1330
acgcaaugugcgggcuucuuc

SEQ ID NO: 2482777 - RNA, 23 nt, Brucella suis 1330
acgcaaugugcgggcuucuucca

SEQ ID NO: 2482778 - RNA, 14 nt, Brucella suis 1330
acgcaccaagaccg

SEQ ID NO: 2482779 - RNA, 20 nt, Brucella suis 1330
acgcacggucuugccggccu

SEQ ID NO: 2482780 - RNA, 19 nt, Brucella suis 1330
acgcagcguguagccgcga

SEQ ID NO: 2482781 - RNA, 15 nt, Brucella suis 1330
acgcaggacaagccg

SEQ ID NO: 2482782 - RNA, 14 nt, Brucella suis 1330
acuucuucaccagc

SEQ ID NO: 2482783 - RNA, 15 nt, Brucella suis 1330
acuucuucaccagcc

SEQ ID NO: 2482784 - RNA, 20 nt, Brucella suis 1330
acuucuuuauggcucagaga

SEQ ID NO: 2482785 - RNA, 19 nt, Brucella suis 1330
acuugaagagccgcaggca

SEQ ID NO: 2482786 - RNA, 22 nt, Brucella suis 1330
acuugguugccagcaauugcuu

SEQ ID NO: 2482787 - RNA, 20 nt, Brucella suis 1330
acuugucgcuacguggcuug

SEQ ID NO: 2482788 - RNA, 15 nt, Brucella suis 1330
acuuucaagcgggua

SEQ ID NO: 2482789 - RNA, 20 nt, Brucella suis 1330
acuuuuggcucgaaaaugcu

SEQ ID NO: 2482790 - RNA, 16 nt, Brucella suis 1330
agaaaacgccgaagcc

SEQ ID NO: 2482791 - RNA, 18 nt, Brucella suis 1330
agaaaagugccagcguuc

SEQ ID NO: 2482792 - RNA, 15 nt, Brucella suis 1330
agaaaccccggcagc

SEQ ID NO: 2482793 - RNA, 23 nt, Brucella suis 1330
agaaacgguuuugcguuggaaaa

SEQ ID NO: 2482794 - RNA, 11 nt, Brucella suis 1330
agaaagcguca

SEQ ID NO: 2482795 - RNA, 21 nt, Brucella suis 1330
agaaauagggccagacauaga

SEQ ID NO: 2482796 - RNA, 14 nt, Brucella suis 1330
agaacacagccccu

SEQ ID NO: 2482797 - RNA, 15 nt, Brucella suis 1330
agaacacagccccuu

SEQ ID NO: 2482798 - RNA, 23 nt, Brucella suis 1330
agaacagcgcgaacaugccugcc

SEQ ID NO: 2482799 - RNA, 19 nt, Brucella suis 1330
agaacauauccgucugauc

SEQ ID NO: 2482800 - RNA, 19 nt, Brucella suis 1330
agaaccaccagagcaaaaa

SEQ ID NO: 2482801 - RNA, 13 nt, Brucella suis 1330
agaaccaucggaa

SEQ ID NO: 2482802 - RNA, 17 nt, Brucella suis 1330
agaaccgaggcaaugaa

SEQ ID NO: 2482803 - RNA, 14 nt, Brucella suis 1330
agaaccgauuaaaa

SEQ ID NO: 2482804 - RNA, 23 nt, Brucella suis 1330
agaacggcaggaucuuccaucug

SEQ ID NO: 2482805 - RNA, 20 nt, Brucella suis 1330
agaagacggcggguggcagc

SEQ ID NO: 2482806 - RNA, 22 nt, Brucella suis 1330
agaagacggcggguggcagcga

SEQ ID NO: 2482807 - RNA, 15 nt, Brucella suis 1330
agaagagccugccgu

SEQ ID NO: 2482808 - RNA, 22 nt, Brucella suis 1330
agaagaucgucggcaagcugga

SEQ ID NO: 2482809 - RNA, 22 nt, Brucella suis 1330
agaaggcgacgagaccugccau

SEQ ID NO: 2482810 - RNA, 22 nt, Brucella suis 1330
agaagguuacuugcgcuuugca

SEQ ID NO: 2482811 - RNA, 21 nt, Brucella suis 1330
agaagucgauguucggguaga

SEQ ID NO: 2482812 - RNA, 20 nt, Brucella suis 1330
agaaguuucagcgcauuggc

SEQ ID NO: 2482813 - RNA, 21 nt, Brucella suis 1330
agaauacgguccugcaaaccg

SEQ ID NO: 2482814 - RNA, 15 nt, Brucella suis 1330
agaauauccggcuca

SEQ ID NO: 2482815 - RNA, 22 nt, Brucella suis 1330
agaaucugcgcgucgagcaaug

SEQ ID NO: 2482816 - RNA, 14 nt, Brucella suis 1330
agaaugcaccgccg

SEQ ID NO: 2482817 - RNA, 19 nt, Brucella suis 1330
agaaugccguucuuggcca

SEQ ID NO: 2482818 - RNA, 17 nt, Brucella suis 1330
agaauggagcauuucca

SEQ ID NO: 2482819 - RNA, 20 nt, Brucella suis 1330
agaauucauguucgagauau

SEQ ID NO: 2482820 - RNA, 20 nt, Brucella suis 1330
agaauuuggaaguuuuccug

SEQ ID NO: 2482821 - RNA, 14 nt, Brucella suis 1330
agacauauugcccu

SEQ ID NO: 2482822 - RNA, 17 nt, Brucella suis 1330
agacauggguggcgccc

SEQ ID NO: 2482823 - RNA, 14 nt, Brucella suis 1330
agaccagcaggaag

SEQ ID NO: 2482824 - RNA, 15 nt, Brucella suis 1330
agaccagcaggaaga

SEQ ID NO: 2482825 - RNA, 21 nt, Brucella suis 1330
agaccagcaggaagaaggcga

SEQ ID NO: 2482826 - RNA, 16 nt, Brucella suis 1330
agaccaucgaaagccc

SEQ ID NO: 2482827 - RNA, 22 nt, Brucella suis 1330
agaccaugacgccgcuccagcc

SEQ ID NO: 2482828 - RNA, 13 nt, Brucella suis 1330
agaccccgccuga

SEQ ID NO: 2482829 - RNA, 19 nt, Brucella suis 1330
agaccgaucgugccgccuu

SEQ ID NO: 2482830 - RNA, 16 nt, Brucella suis 1330
agaccgucaaaacgcc

SEQ ID NO: 2482831 - RNA, 22 nt, Brucella suis 1330
agaccugcaccgcgugaagaau

SEQ ID NO: 2482832 - RNA, 16 nt, Brucella suis 1330
agacgccauccaugug

SEQ ID NO: 2482833 - RNA, 22 nt, Brucella suis 1330
agacgccauccauguggaaggc

SEQ ID NO: 2482834 - RNA, 23 nt, Brucella suis 1330
agacgccauccauguggaaggcg

SEQ ID NO: 2482835 - RNA, 17 nt, Brucella suis 1330
agacgcgcagacgcagc

SEQ ID NO: 2482836 - RNA, 21 nt, Brucella suis 1330
agacggacuucuucaccagcc

SEQ ID NO: 2482837 - RNA, 21 nt, Brucella suis 1330
agacggcggguggcagcgauu

SEQ ID NO: 2482838 - RNA, 16 nt, Brucella suis 1330
agacgugaccgccugg

SEQ ID NO: 2482839 - RNA, 23 nt, Brucella suis 1330
agacucgaacaggcccaccgugc

SEQ ID NO: 2482840 - RNA, 17 nt, Brucella suis 1330
agacucuuuucgcccgu

SEQ ID NO: 2482841 - RNA, 12 nt, Brucella suis 1330
agacuucagcca

SEQ ID NO: 2482842 - RNA, 13 nt, Brucella suis 1330
agagacaggaaaa

SEQ ID NO: 2482843 - RNA, 20 nt, Brucella suis 1330
agagacaggaaaagccccau

SEQ ID NO: 2482844 - RNA, 18 nt, Brucella suis 1330
agagauuucaccacgcca

SEQ ID NO: 2482845 - RNA, 15 nt, Brucella suis 1330
agagcauuuccagca

SEQ ID NO: 2482846 - RNA, 18 nt, Brucella suis 1330
agagcauuuccagcaaaa

SEQ ID NO: 2482847 - RNA, 17 nt, Brucella suis 1330
agagccccaggaacggc

SEQ ID NO: 2482848 - RNA, 17 nt, Brucella suis 1330
agagccgcaggcacugg

SEQ ID NO: 2482849 - RNA, 19 nt, Brucella suis 1330
agagccuuuuccacagcag

SEQ ID NO: 2482850 - RNA, 14 nt, Brucella suis 1330
agagcgauccgcca

SEQ ID NO: 2482851 - RNA, 13 nt, Brucella suis 1330
agagcgccgaucu

SEQ ID NO: 2482852 - RNA, 11 nt, Brucella suis 1330
agagcgguucc

SEQ ID NO: 2482853 - RNA, 13 nt, Brucella suis 1330
agagcuucuuuuc

SEQ ID NO: 2482854 - RNA, 20 nt, Brucella suis 1330
agagggauuuucguugcuuc

SEQ ID NO: 2482855 - RNA, 21 nt, Brucella suis 1330
agagggauuuucguugcuucc

SEQ ID NO: 2482856 - RNA, 14 nt, Brucella suis 1330
agagugaugcagau

SEQ ID NO: 2482857 - RNA, 14 nt, Brucella suis 1330
agauaaucagcaga

SEQ ID NO: 2482858 - RNA, 23 nt, Brucella suis 1330
agauaggcguugaugacgaaaaa

SEQ ID NO: 2482859 - RNA, 18 nt, Brucella suis 1330
agauaucgagcgccagau

SEQ ID NO: 2482860 - RNA, 15 nt, Brucella suis 1330
agauauuucuuccag

SEQ ID NO: 2482861 - RNA, 21 nt, Brucella suis 1330
agaucaaccccgcacggucau

SEQ ID NO: 2482862 - RNA, 20 nt, Brucella suis 1330
agaucagagcgguuucgguu

SEQ ID NO: 2482863 - RNA, 10 nt, Brucella suis 1330
agaucagcca

SEQ ID NO: 2482864 - RNA, 14 nt, Brucella suis 1330
agauccaccgcgcu

SEQ ID NO: 2482865 - RNA, 23 nt, Brucella suis 1330
agaucgauggugcggaacaaugc

SEQ ID NO: 2482866 - RNA, 20 nt, Brucella suis 1330
agaucgcgcgcaacgcaaug

SEQ ID NO: 2482867 - RNA, 16 nt, Brucella suis 1330
agaucggaugcuccac

SEQ ID NO: 2482868 - RNA, 13 nt, Brucella suis 1330
agaucggcgaggu

SEQ ID NO: 2482869 - RNA, 18 nt, Brucella suis 1330
agaucgugaucuucggca

SEQ ID NO: 2482870 - RNA, 20 nt, Brucella suis 1330
agaucgugaucuucggcauc

SEQ ID NO: 2482871 - RNA, 19 nt, Brucella suis 1330
agaucgugggccucaagcg

SEQ ID NO: 2482872 - RNA, 16 nt, Brucella suis 1330
agaucgugucauagcc

SEQ ID NO: 2482873 - RNA, 17 nt, Brucella suis 1330
agaucugcaucccgaaa

SEQ ID NO: 2482874 - RNA, 20 nt, Brucella suis 1330
agaucugcaucccgaaaagu

SEQ ID NO: 2482875 - RNA, 17 nt, Brucella suis 1330
agaucuguaucccgaaa

SEQ ID NO: 2482876 - RNA, 18 nt, Brucella suis 1330
agaugacgcccagcgaau

SEQ ID NO: 2482877 - RNA, 18 nt, Brucella suis 1330
agaugagcgacaggaaca

SEQ ID NO: 2482878 - RNA, 14 nt, Brucella suis 1330
agaugagcugguuu

SEQ ID NO: 2482879 - RNA, 17 nt, Brucella suis 1330
agaugagcugguuuuuc

SEQ ID NO: 2482880 - RNA, 22 nt, Brucella suis 1330
agaugagguccaccacaccauc

SEQ ID NO: 2482881 - RNA, 16 nt, Brucella suis 1330
agaugaugaagaaaag

SEQ ID NO: 2482882 - RNA, 15 nt, Brucella suis 1330
agaugcccgcuuucc

SEQ ID NO: 2482883 - RNA, 14 nt, Brucella suis 1330
agaugcgccgggca

SEQ ID NO: 2482884 - RNA, 18 nt, Brucella suis 1330
agaugcgcgcaaggaaag

SEQ ID NO: 2482885 - RNA, 17 nt, Brucella suis 1330
agaugcgcgccagccgc

SEQ ID NO: 2482886 - RNA, 23 nt, Brucella suis 1330
agaugcgcguagggcagaucugu

SEQ ID NO: 2482887 - RNA, 22 nt, Brucella suis 1330
agaugcgcgucaaaacaaagga

SEQ ID NO: 2482888 - RNA, 18 nt, Brucella suis 1330
agaugcugaacaagcaga

SEQ ID NO: 2482889 - RNA, 20 nt, Brucella suis 1330
agauggaaagagccuguuca

SEQ ID NO: 2482890 - RNA, 22 nt, Brucella suis 1330
agauguuccugcggugugaagc

SEQ ID NO: 2482891 - RNA, 15 nt, Brucella suis 1330
agauucaaaacauga

SEQ ID NO: 2482892 - RNA, 15 nt, Brucella suis 1330
agauuccgaauagau

SEQ ID NO: 2482893 - RNA, 16 nt, Brucella suis 1330
agauugaacccggccu

SEQ ID NO: 2482894 - RNA, 14 nt, Brucella suis 1330
agauugcaaacgaa

SEQ ID NO: 2482895 - RNA, 16 nt, Brucella suis 1330
agauugggcagcagau

SEQ ID NO: 2482896 - RNA, 14 nt, Brucella suis 1330
agauugggcgcgcu

SEQ ID NO: 2482897 - RNA, 22 nt, Brucella suis 1330
agauuguaauccauggccacga

SEQ ID NO: 2482898 - RNA, 14 nt, Brucella suis 1330
agccgcuccggcgu

SEQ ID NO: 2482899 - RNA, 18 nt, Brucella suis 1330
agccgcugaaccacugau

SEQ ID NO: 2482900 - RNA, 18 nt, Brucella suis 1330
agccgcuucugcucacca

SEQ ID NO: 2482901 - RNA, 22 nt, Brucella suis 1330
agccgcuugcauuccagaaggu

SEQ ID NO: 2482902 - RNA, 14 nt, Brucella suis 1330
agccggagcauucc

SEQ ID NO: 2482903 - RNA, 22 nt, Brucella suis 1330
agccggccacgaaaugggggcc

SEQ ID NO: 2482904 - RNA, 17 nt, Brucella suis 1330
agccgggcuuuccugca

SEQ ID NO: 2482905 - RNA, 17 nt, Brucella suis 1330
agccggguuuuuuaugc

SEQ ID NO: 2482906 - RNA, 18 nt, Brucella suis 1330
agccgguaauauugaagc

SEQ ID NO: 2482907 - RNA, 21 nt, Brucella suis 1330
agccggugcugucgcccagaa

SEQ ID NO: 2482908 - RNA, 21 nt, Brucella suis 1330
agccguaccggcaucagccuu

SEQ ID NO: 2482909 - RNA, 16 nt, Brucella suis 1330
agccucccuucauuca

SEQ ID NO: 2482910 - RNA, 20 nt, Brucella suis 1330
agccuccugugcauugccaa

SEQ ID NO: 2482911 - RNA, 20 nt, Brucella suis 1330
agccucgauaaucuggcugg

SEQ ID NO: 2482912 - RNA, 12 nt, Brucella suis 1330
agccugaacagc

SEQ ID NO: 2482913 - RNA, 15 nt, Brucella suis 1330
agccugaacagcguu

SEQ ID NO: 2482914 - RNA, 15 nt, Brucella suis 1330
agccugacccggccu

SEQ ID NO: 2482915 - RNA, 17 nt, Brucella suis 1330
agccugcaccggcccaa

SEQ ID NO: 2482916 - RNA, 22 nt, Brucella suis 1330
agccugcaucauaggcccaggc

SEQ ID NO: 2482917 - RNA, 18 nt, Brucella suis 1330
agccuggaugacaucggc

SEQ ID NO: 2482918 - RNA, 17 nt, Brucella suis 1330
agccuguuuggucucaa

SEQ ID NO: 2482919 - RNA, 16 nt, Brucella suis 1330
agccuucauugcggcc

SEQ ID NO: 2482920 - RNA, 20 nt, Brucella suis 1330
agccuucccgggagaaaaga

SEQ ID NO: 2482921 - RNA, 21 nt, Brucella suis 1330
agccuuccguugcagcccaac

SEQ ID NO: 2482922 - RNA, 23 nt, Brucella suis 1330
agccuugagauccgcaucggccu

SEQ ID NO: 2482923 - RNA, 14 nt, Brucella suis 1330
agccuuggcccuuu

SEQ ID NO: 2482924 - RNA, 14 nt, Brucella suis 1330
agccuuucugccag

SEQ ID NO: 2482925 - RNA, 17 nt, Brucella suis 1330
agccuuuucgauaacga

SEQ ID NO: 2482926 - RNA, 23 nt, Brucella suis 1330
agccuuuuugacgcaaaagcucc

SEQ ID NO: 2482927 - RNA, 21 nt, Brucella suis 1330
agcgaaauaaucguaucgcca

SEQ ID NO: 2482928 - RNA, 14 nt, Brucella suis 1330
agcgaagcgaugac

SEQ ID NO: 2482929 - RNA, 23 nt, Brucella suis 1330
agcgaaggcugccgggguuuuuc

SEQ ID NO: 2482930 - RNA, 20 nt, Brucella suis 1330
agcgaauagggaaacggcca

SEQ ID NO: 2482931 - RNA, 15 nt, Brucella suis 1330
agcgaauaugcgggg

SEQ ID NO: 2482932 - RNA, 16 nt, Brucella suis 1330
agcgacaggaacauca

SEQ ID NO: 2482933 - RNA, 17 nt, Brucella suis 1330
agcgacauauucuuccg

SEQ ID NO: 2482934 - RNA, 17 nt, Brucella suis 1330
agcgaccagcaacgcgc

SEQ ID NO: 2482935 - RNA, 16 nt, Brucella suis 1330
agcgacgacaugaagg

SEQ ID NO: 2482936 - RNA, 16 nt, Brucella suis 1330
agcgacguagggcgcg

SEQ ID NO: 2482937 - RNA, 22 nt, Brucella suis 1330
agcgacucuacgcugaucgcaa

SEQ ID NO: 2482938 - RNA, 23 nt, Brucella suis 1330
cguugaggcgggggcgcuuuauu

SEQ ID NO: 2482939 - RNA, 13 nt, Brucella suis 1330
cguugaugacgaa

SEQ ID NO: 2482940 - RNA, 15 nt, Brucella suis 1330
cguugcaagauccuc

SEQ ID NO: 2482941 - RNA, 14 nt, Brucella suis 1330
cguugcccaugucc

SEQ ID NO: 2482942 - RNA, 19 nt, Brucella suis 1330
cguugccgagaaugaccac

SEQ ID NO: 2482943 - RNA, 18 nt, Brucella suis 1330
cguugccgaucagcaucg

SEQ ID NO: 2482944 - RNA, 18 nt, Brucella suis 1330
cguugcgaucuucugcuc

SEQ ID NO: 2482945 - RNA, 22 nt, Brucella suis 1330
cguugcgaugagccucaauggc

SEQ ID NO: 2482946 - RNA, 13 nt, Brucella suis 1330
cguugcgcggcgg

SEQ ID NO: 2482947 - RNA, 17 nt, Brucella suis 1330
cguugcuuucggcggca

SEQ ID NO: 2482948 - RNA, 17 nt, Brucella suis 1330
cucuaacuauucguuuu

SEQ ID NO: 2482949 - RNA, 13 nt, Brucella suis 1330
cucuauuucggcg

SEQ ID NO: 2482950 - RNA, 15 nt, Brucella suis 1330
cucucaaaaagguua

SEQ ID NO: 2482951 - RNA, 15 nt, Brucella suis 1330
cucucacgcgcagca

SEQ ID NO: 2482952 - RNA, 17 nt, Brucella suis 1330
cucucacgcgcagcagc

SEQ ID NO: 2482953 - RNA, 20 nt, Brucella suis 1330
cucucgucgagaagcaucag

SEQ ID NO: 2482954 - RNA, 18 nt, Brucella suis 1330
cucugaaccggcgggcuu

SEQ ID NO: 2482955 - RNA, 22 nt, Brucella suis 1330
cucugaucuaguggagcaccgc

SEQ ID NO: 2482956 - RNA, 14 nt, Brucella suis 1330
cucugcgccagccu

SEQ ID NO: 2482957 - RNA, 19 nt, Brucella suis 1330
cucugcggaaagcccggcc

SEQ ID NO: 2482958 - RNA, 16 nt, Brucella suis 1330
cucuuccaggagagcc

SEQ ID NO: 2482959 - RNA, 14 nt, Brucella suis 1330
cucuuccggcgucu

SEQ ID NO: 2482960 - RNA, 19 nt, Brucella suis 1330
cucuucggggcggccuuuu

SEQ ID NO: 2482961 - RNA, 13 nt, Brucella suis 1330
cucuucugcaucg

SEQ ID NO: 2482962 - RNA, 15 nt, Brucella suis 1330
cugaaaaaggccggg

SEQ ID NO: 2482963 - RNA, 18 nt, Brucella suis 1330
cugaaaaaggccgggaaa

SEQ ID NO: 2482964 - RNA, 13 nt, Brucella suis 1330
cugaaaagcccgc

SEQ ID NO: 2482965 - RNA, 18 nt, Brucella suis 1330
cugaaacgagacaaggca

SEQ ID NO: 2482966 - RNA, 20 nt, Brucella suis 1330
cugaaacgggaccaagcccg

SEQ ID NO: 2482967 - RNA, 15 nt, Brucella suis 1330
cugaaacuugugcgu

SEQ ID NO: 2482968 - RNA, 12 nt, Brucella suis 1330
cugaaagcugcu

SEQ ID NO: 2482969 - RNA, 13 nt, Brucella suis 1330
cugaaaucucuca

SEQ ID NO: 2482970 - RNA, 19 nt, Brucella suis 1330
cugaaaucugcgccgguuu

SEQ ID NO: 2482971 - RNA, 20 nt, Brucella suis 1330
cugaacauggcugcaacacc

SEQ ID NO: 2482972 - RNA, 14 nt, Brucella suis 1330
cugaaccacuuccg

SEQ ID NO: 2482973 - RNA, 12 nt, Brucella suis 1330
cugaaccggcga

SEQ ID NO: 2482974 - RNA, 18 nt, Brucella suis 1330
cugaacggaucuugcgca

SEQ ID NO: 2482975 - RNA, 17 nt, Brucella suis 1330
cugaagaagcuucacau

SEQ ID NO: 2482976 - RNA, 16 nt, Brucella suis 1330
cugaaggcucggcaaa

SEQ ID NO: 2482977 - RNA, 22 nt, Brucella suis 1330
cugaaugcgccgccagcauggc

SEQ ID NO: 2482978 - RNA, 22 nt, Brucella suis 1330
cugaccagccuugcccuggcuc

SEQ ID NO: 2482979 - RNA, 23 nt, Brucella suis 1330
cugaccagccuugcccuggcucu

SEQ ID NO: 2482980 - RNA, 19 nt, Brucella suis 1330
cugacccauggccugcugc

SEQ ID NO: 2482981 - RNA, 16 nt, Brucella suis 1330
cugacccccagauucg

SEQ ID NO: 2482982 - RNA, 22 nt, Brucella suis 1330
cugacccggccuuugcgccggg

SEQ ID NO: 2482983 - RNA, 21 nt, Brucella suis 1330
cugaccguuucgauauccugg

SEQ ID NO: 2482984 - RNA, 15 nt, Brucella suis 1330
cugacggaguugaac

SEQ ID NO: 2482985 - RNA, 18 nt, Brucella suis 1330
cugacggcgcagcgacuu

SEQ ID NO: 2482986 - RNA, 16 nt, Brucella suis 1330
cugacuggcggccaag

SEQ ID NO: 2482987 - RNA, 18 nt, Brucella suis 1330
cugacuggcggccaagcg

SEQ ID NO: 2482988 - RNA, 13 nt, Brucella suis 1330
cugagaaaaaaau

SEQ ID NO: 2482989 - RNA, 21 nt, Brucella suis 1330
cugagcaauagagucgccgaa

SEQ ID NO: 2482990 - RNA, 21 nt, Brucella suis 1330
cugagcuacgggugcuugccu

SEQ ID NO: 2482991 - RNA, 22 nt, Brucella suis 1330
cugaggccauuuugacccugcc

SEQ ID NO: 2482992 - RNA, 20 nt, Brucella suis 1330
cugagggaaacacucugccu

SEQ ID NO: 2482993 - RNA, 22 nt, Brucella suis 1330
cugagggaaacacucugccugc

SEQ ID NO: 2482994 - RNA, 22 nt, Brucella suis 1330
cugagggguaaauccuccagau

SEQ ID NO: 2482995 - RNA, 23 nt, Brucella suis 1330
cugauagaugcgauccuuguucu

SEQ ID NO: 2482996 - RNA, 16 nt, Brucella suis 1330
cugauaugcgcaugaa

SEQ ID NO: 2482997 - RNA, 22 nt, Brucella suis 1330
cugauauugugucagcgggcaa

SEQ ID NO: 2482998 - RNA, 20 nt, Brucella suis 1330
cugaucgcaagcaggcauug

SEQ ID NO: 2482999 - RNA, 13 nt, Brucella suis 1330
cugaugauuuccc

SEQ ID NO: 2483000 - RNA, 23 nt, Brucella suis 1330
cugaugguuagcgacuucggguc

SEQ ID NO: 2483001 - RNA, 12 nt, Brucella suis 1330
cugauucaauca

SEQ ID NO: 2483002 - RNA, 22 nt, Brucella suis 1330
cugauucuaucgccuggcauug

SEQ ID NO: 2483003 - RNA, 20 nt, Brucella suis 1330
cugauugcaggucuuucugc

SEQ ID NO: 2483004 - RNA, 16 nt, Brucella suis 1330
cugauuugaaaagccc

SEQ ID NO: 2483005 - RNA, 13 nt, Brucella suis 1330
cugcaaaccggcu

SEQ ID NO: 2483006 - RNA, 15 nt, Brucella suis 1330
cugcaacaaaagaag

SEQ ID NO: 2483007 - RNA, 14 nt, Brucella suis 1330
cugcaagauaggcc

SEQ ID NO: 2483008 - RNA, 19 nt, Brucella suis 1330
cugcaagauaggcccaggc

SEQ ID NO: 2483009 - RNA, 12 nt, Brucella suis 1330
cugcaagcgcga

SEQ ID NO: 2483010 - RNA, 16 nt, Brucella suis 1330
cugcaagcgcgacaag

SEQ ID NO: 2483011 - RNA, 14 nt, Brucella suis 1330
cugcaaucaccaga

SEQ ID NO: 2483012 - RNA, 16 nt, Brucella suis 1330
cugcaaucaccagaga

SEQ ID NO: 2483013 - RNA, 21 nt, Brucella suis 1330
cugcaaucaccagagacagug

SEQ ID NO: 2483014 - RNA, 17 nt, Brucella suis 1330
cugcaauccacaggaga

SEQ ID NO: 2483015 - RNA, 15 nt, Brucella suis 1330
cugcacacccuugau

SEQ ID NO: 2483016 - RNA, 14 nt, Brucella suis 1330
cugcacagccugga

SEQ ID NO: 2483017 - RNA, 19 nt, Brucella suis 1330
cugcacagccuggaugaca

SEQ ID NO: 2483018 - RNA, 14 nt, Brucella suis 1330
cugcaccggcccaa

SEQ ID NO: 2483019 - RNA, 15 nt, Brucella suis 1330
cugcaccggccuugu

SEQ ID NO: 2483020 - RNA, 14 nt, Brucella suis 1330
cugcaccggcuucc

SEQ ID NO: 2483021 - RNA, 23 nt, Brucella suis 1330
cugcagccggaagaacagcgcga

SEQ ID NO: 2483022 - RNA, 22 nt, Brucella suis 1330
cugcauauuaagccgggcggcg

SEQ ID NO: 2483023 - RNA, 20 nt, Brucella suis 1330
cugcaucacagucacgccau

SEQ ID NO: 2483024 - RNA, 18 nt, Brucella suis 1330
cugcaucauaggcccagg

SEQ ID NO: 2483025 - RNA, 21 nt, Brucella suis 1330
cugcaucaugucauggccgcc

SEQ ID NO: 2483026 - RNA, 13 nt, Brucella suis 1330
cugcauccagcgg

SEQ ID NO: 2483027 - RNA, 14 nt, Brucella suis 1330
cugcauccagcggu

SEQ ID NO: 2483028 - RNA, 15 nt, Brucella suis 1330
cugcauccagcggug

SEQ ID NO: 2483029 - RNA, 16 nt, Brucella suis 1330
cugcaucgcgaggcua

SEQ ID NO: 2483030 - RNA, 20 nt, Brucella suis 1330
cugcaucggcuugggaagau

SEQ ID NO: 2483031 - RNA, 21 nt, Brucella suis 1330
cugcaugugcggugagaagaa

SEQ ID NO: 2483032 - RNA, 12 nt, Brucella suis 1330
cugcauuggcga

SEQ ID NO: 2483033 - RNA, 19 nt, Brucella suis 1330
cugcauuggcgauuuucug

SEQ ID NO: 2483034 - RNA, 15 nt, Brucella suis 1330
cugccaaccauugau

SEQ ID NO: 2483035 - RNA, 17 nt, Brucella suis 1330
cugccaaccauugaucu

SEQ ID NO: 2483036 - RNA, 18 nt, Brucella suis 1330
cugccaucaccagccccc

SEQ ID NO: 2483037 - RNA, 14 nt, Brucella suis 1330
cugccauccgcccc

SEQ ID NO: 2483038 - RNA, 13 nt, Brucella suis 1330
cugcccgucuucc

SEQ ID NO: 2483039 - RNA, 15 nt, Brucella suis 1330
cugccgcaauccugg

SEQ ID NO: 2483040 - RNA, 13 nt, Brucella suis 1330
cugccgcacagca

SEQ ID NO: 2483041 - RNA, 13 nt, Brucella suis 1330
cugccgcagccag

SEQ ID NO: 2483042 - RNA, 14 nt, Brucella suis 1330
cugccgcagccagg

SEQ ID NO: 2483043 - RNA, 21 nt, Brucella suis 1330
cugccggauuauaccggcgug

SEQ ID NO: 2483044 - RNA, 17 nt, Brucella suis 1330
cugccggugccggcagg

SEQ ID NO: 2483045 - RNA, 19 nt, Brucella suis 1330
cugccuucuucauauccuc

SEQ ID NO: 2483046 - RNA, 18 nt, Brucella suis 1330
cugccuugucagaagcaa

SEQ ID NO: 2483047 - RNA, 16 nt, Brucella suis 1330
cugcgaaggcccuuca

SEQ ID NO: 2483048 - RNA, 18 nt, Brucella suis 1330
cugcgacgagaugcgcuu

SEQ ID NO: 2483049 - RNA, 17 nt, Brucella suis 1330
cugcgaggauuucaggu

SEQ ID NO: 2483050 - RNA, 23 nt, Brucella suis 1330
cugcgaggauuucagguggcgga

SEQ ID NO: 2483051 - RNA, 19 nt, Brucella suis 1330
cugcgcaccgguauugccc

SEQ ID NO: 2483052 - RNA, 17 nt, Brucella suis 1330
cugcgccagccuugcga

SEQ ID NO: 2483053 - RNA, 20 nt, Brucella suis 1330
cugcgccaguuuucgcggca

SEQ ID NO: 2483054 - RNA, 22 nt, Brucella suis 1330
cugcgccaguuuucgcggcaga

SEQ ID NO: 2483055 - RNA, 15 nt, Brucella suis 1330
cugcgcccgcgccgc

SEQ ID NO: 2483056 - RNA, 16 nt, Brucella suis 1330
cugcgccggaaacacc

SEQ ID NO: 2483057 - RNA, 22 nt, Brucella suis 1330
cugcgccguaguagcuaaugua

SEQ ID NO: 2483058 - RNA, 21 nt, Brucella suis 1330
cugcgcgaauagcgagaucga

SEQ ID NO: 2483059 - RNA, 23 nt, Brucella suis 1330
cugcgcgcaaaccaggaccgcga

SEQ ID NO: 2483060 - RNA, 16 nt, Brucella suis 1330
cugcgcgcgcauggcg

SEQ ID NO: 2483061 - RNA, 11 nt, Brucella suis 1330
cugcgcgcgcg

SEQ ID NO: 2483062 - RNA, 22 nt, Brucella suis 1330
cugcgcgcgcguggucauggcc

SEQ ID NO: 2483063 - RNA, 20 nt, Brucella suis 1330
cugcggcaacggcgcuggcc

SEQ ID NO: 2483064 - RNA, 14 nt, Brucella suis 1330
cuuccaguuccuuc

SEQ ID NO: 2483065 - RNA, 17 nt, Brucella suis 1330
cuuccaguuccuucuug

SEQ ID NO: 2483066 - RNA, 18 nt, Brucella suis 1330
cuuccaguuucugaaugc

SEQ ID NO: 2483067 - RNA, 21 nt, Brucella suis 1330
cuuccaugcccaucaaccgug

SEQ ID NO: 2483068 - RNA, 23 nt, Brucella suis 1330
cuuccccgucagcuuggaaagcu

SEQ ID NO: 2483069 - RNA, 23 nt, Brucella suis 1330
cuucccgcccguccucaucgccg

SEQ ID NO: 2483070 - RNA, 16 nt, Brucella suis 1330
cuucccgcgccucacc

SEQ ID NO: 2483071 - RNA, 22 nt, Brucella suis 1330
cuucccggauugggucaacgcc

SEQ ID NO: 2483072 - RNA, 16 nt, Brucella suis 1330
cuuccgagaaccgauu

SEQ ID NO: 2483073 - RNA, 19 nt, Brucella suis 1330
cuuccgcaagccaguccuu

SEQ ID NO: 2483074 - RNA, 22 nt, Brucella suis 1330
cuuccgcaagccaguccuugcc

SEQ ID NO: 2483075 - RNA, 23 nt, Brucella suis 1330
cuuccgcaucguaaucgccgggc

SEQ ID NO: 2483076 - RNA, 19 nt, Brucella suis 1330
cuuccgccuuggcgaagcu

SEQ ID NO: 2483077 - RNA, 17 nt, Brucella suis 1330
cuuccggcagaccggau

SEQ ID NO: 2483078 - RNA, 21 nt, Brucella suis 1330
cuuccggcagaccggaucgcg

SEQ ID NO: 2483079 - RNA, 17 nt, Brucella suis 1330
cuuccggccguuauucc

SEQ ID NO: 2483080 - RNA, 13 nt, Brucella suis 1330
cuuccgggaauuc

SEQ ID NO: 2483081 - RNA, 15 nt, Brucella suis 1330
cuuccgucagggccg

SEQ ID NO: 2483082 - RNA, 19 nt, Brucella suis 1330
cuuccguggcaaugacggc

SEQ ID NO: 2483083 - RNA, 21 nt, Brucella suis 1330
cuuccguugcagcccaaccca

SEQ ID NO: 2483084 - RNA, 14 nt, Brucella suis 1330
cuuccucgccgugc

SEQ ID NO: 2483085 - RNA, 19 nt, Brucella suis 1330
cuuccucguccuugaacuc

SEQ ID NO: 2483086 - RNA, 23 nt, Brucella suis 1330
cuuccugacccauggccugcugc

SEQ ID NO: 2483087 - RNA, 13 nt, Brucella suis 1330
cuuccugcgaugc

SEQ ID NO: 2483088 - RNA, 19 nt, Brucella suis 1330
cuuccugcgaugcgccagc

SEQ ID NO: 2483089 - RNA, 15 nt, Brucella suis 1330
cuuccugcggcagcg

SEQ ID NO: 2483090 - RNA, 19 nt, Brucella suis 1330
cuuccuguccgacauccau

SEQ ID NO: 2483091 - RNA, 17 nt, Brucella suis 1330
cuucgacaaccgcgccg

SEQ ID NO: 2483092 - RNA, 18 nt, Brucella suis 1330
cuucgacaaccgcgccgc

SEQ ID NO: 2483093 - RNA, 17 nt, Brucella suis 1330
cuucgacguggagcagg

SEQ ID NO: 2483094 - RNA, 14 nt, Brucella suis 1330
cuucgaguucgcca

SEQ ID NO: 2483095 - RNA, 14 nt, Brucella suis 1330
cuucgcagcuaugu

SEQ ID NO: 2483096 - RNA, 22 nt, Brucella suis 1330
cuucgccgagaugggcaaauuc

SEQ ID NO: 2483097 - RNA, 14 nt, Brucella suis 1330
cuucgcgcaggccg

SEQ ID NO: 2483098 - RNA, 19 nt, Brucella suis 1330
cuucgcgccgccuucaaaa

SEQ ID NO: 2483099 - RNA, 18 nt, Brucella suis 1330
cuucgcgggcaauggccg

SEQ ID NO: 2483100 - RNA, 18 nt, Brucella suis 1330
cuucgcuccgcaccucag

SEQ ID NO: 2483101 - RNA, 14 nt, Brucella suis 1330
cuucggaagaaaga

SEQ ID NO: 2483102 - RNA, 17 nt, Brucella suis 1330
cuucggcaagggcaagc

SEQ ID NO: 2483103 - RNA, 20 nt, Brucella suis 1330
cuucggcaagggcaagcaga

SEQ ID NO: 2483104 - RNA, 17 nt, Brucella suis 1330
cuucggcauggcagccg

SEQ ID NO: 2483105 - RNA, 14 nt, Brucella suis 1330
cuucggccagcgca

SEQ ID NO: 2483106 - RNA, 17 nt, Brucella suis 1330
cuucguaaagcgcgcca

SEQ ID NO: 2483107 - RNA, 17 nt, Brucella suis 1330
cuucguccucgcgccag

SEQ ID NO: 2483108 - RNA, 15 nt, Brucella suis 1330
cuucgugcaaaccuc

SEQ ID NO: 2483109 - RNA, 20 nt, Brucella suis 1330
cuucuccaaagggugcgagc

SEQ ID NO: 2483110 - RNA, 12 nt, Brucella suis 1330
cuucucgaacug

SEQ ID NO: 2483111 - RNA, 15 nt, Brucella suis 1330
cuucucuugccgccg

SEQ ID NO: 2483112 - RNA, 20 nt, Brucella suis 1330
cuucucuugccgccgcuucc

SEQ ID NO: 2483113 - RNA, 21 nt, Brucella suis 1330
cuucucuugccgccgcuucca

SEQ ID NO: 2483114 - RNA, 13 nt, Brucella suis 1330
cuucugcuugcag

SEQ ID NO: 2483115 - RNA, 14 nt, Brucella suis 1330
cuucuggauuugcu

SEQ ID NO: 2483116 - RNA, 22 nt, Brucella suis 1330
cuucugguugcuauaagcaaca

SEQ ID NO: 2483117 - RNA, 23 nt, Brucella suis 1330
cuucuguuaucccucaaaacgcu

SEQ ID NO: 2483118 - RNA, 20 nt, Brucella suis 1330
cuucuuccaguuucugaaug

SEQ ID NO: 2483119 - RNA, 20 nt, Brucella suis 1330
cuucuugccuucaucggcaa

SEQ ID NO: 2483120 - RNA, 19 nt, Brucella suis 1330
cuucuuuguucugcagcaa

SEQ ID NO: 2483121 - RNA, 15 nt, Brucella suis 1330
cuugaacaucagaag

SEQ ID NO: 2483122 - RNA, 15 nt, Brucella suis 1330
cuugaaccuccacgc

SEQ ID NO: 2483123 - RNA, 16 nt, Brucella suis 1330
cuugaagagccgcagg

SEQ ID NO: 2483124 - RNA, 13 nt, Brucella suis 1330
cuugaagcaaggc

SEQ ID NO: 2483125 - RNA, 12 nt, Brucella suis 1330
cuugaagcugcc

SEQ ID NO: 2483126 - RNA, 18 nt, Brucella suis 1330
cuugaagcugccgcggcu

SEQ ID NO: 2483127 - RNA, 15 nt, Brucella suis 1330
cuugaagucaucacc

SEQ ID NO: 2483128 - RNA, 14 nt, Brucella suis 1330
cuugaagucauccc

SEQ ID NO: 2483129 - RNA, 15 nt, Brucella suis 1330
cuugaccagauagcc

SEQ ID NO: 2483130 - RNA, 22 nt, Brucella suis 1330
cuugagauauccauaucuuucc

SEQ ID NO: 2483131 - RNA, 20 nt, Brucella suis 1330
cuugagauccgcaucggccu

SEQ ID NO: 2483132 - RNA, 18 nt, Brucella suis 1330
cuugagaucguaggcuuu

SEQ ID NO: 2483133 - RNA, 21 nt, Brucella suis 1330
cuugagcguuccgcgauauuu

SEQ ID NO: 2483134 - RNA, 20 nt, Brucella suis 1330
cuugagcuucaucuucuugg

SEQ ID NO: 2483135 - RNA, 21 nt, Brucella suis 1330
cuugagggcgagggccucgau

SEQ ID NO: 2483136 - RNA, 15 nt, Brucella suis 1330
cuugauagcgccgga

SEQ ID NO: 2483137 - RNA, 23 nt, Brucella suis 1330
cuugaucgauuugcgcaccagau

SEQ ID NO: 2483138 - RNA, 17 nt, Brucella suis 1330
cuugaucugcuccaucg

SEQ ID NO: 2483139 - RNA, 19 nt, Brucella suis 1330
cuugaucugcuccaucgca

SEQ ID NO: 2483140 - RNA, 18 nt, Brucella suis 1330
cuugaucuggguaaagcg

SEQ ID NO: 2483141 - RNA, 17 nt, Brucella suis 1330
cuugaugauagaauaaa

SEQ ID NO: 2483142 - RNA, 24 nt, Brucella suis 1330
cuugcaacauugauguguccggcg

SEQ ID NO: 2483143 - RNA, 22 nt, Brucella suis 1330
cuugcagaugagcggcagcagc

SEQ ID NO: 2483144 - RNA, 24 nt, Brucella suis 1330
cuugcagugcaggacuggacauaa

SEQ ID NO: 2483145 - RNA, 16 nt, Brucella suis 1330
cuugcauuccagaagg

SEQ ID NO: 2483146 - RNA, 15 nt, Brucella suis 1330
cuugccagucuugcg

SEQ ID NO: 2483147 - RNA, 23 nt, Brucella suis 1330
cuugccauggccgaacggguggc

SEQ ID NO: 2483148 - RNA, 17 nt, Brucella suis 1330
cuugccauuuuccgugg

SEQ ID NO: 2483149 - RNA, 22 nt, Brucella suis 1330
cuugcccgcauagccaucgccg

SEQ ID NO: 2483150 - RNA, 14 nt, Brucella suis 1330
cuugccgaaaagcc

SEQ ID NO: 2483151 - RNA, 19 nt, Brucella suis 1330
cuugccgaccuccccccgc

SEQ ID NO: 2483152 - RNA, 16 nt, Brucella suis 1330
cuugccgccgcuucca

SEQ ID NO: 2483153 - RNA, 18 nt, Brucella suis 1330
cuugccgccuuucaugcc

SEQ ID NO: 2483154 - RNA, 21 nt, Brucella suis 1330
cuugccgcguuccacgucuuc

SEQ ID NO: 2483155 - RNA, 22 nt, Brucella suis 1330
cuugccggccugaaacagcaua

SEQ ID NO: 2483156 - RNA, 18 nt, Brucella suis 1330
cuugccgggcgggcagca

SEQ ID NO: 2483157 - RNA, 16 nt, Brucella suis 1330
cuugccgucggcgccg

SEQ ID NO: 2483158 - RNA, 17 nt, Brucella suis 1330
cuugccguuggcaucca

SEQ ID NO: 2483159 - RNA, 15 nt, Brucella suis 1330
cuugccucguccggu

SEQ ID NO: 2483160 - RNA, 18 nt, Brucella suis 1330
cuugccuuuuggccgcuc

SEQ ID NO: 2483161 - RNA, 15 nt, Brucella suis 1330
cuugcgaaccaucac

SEQ ID NO: 2483162 - RNA, 14 nt, Brucella suis 1330
cuugcgauuuccuu

SEQ ID NO: 2483163 - RNA, 17 nt, Brucella suis 1330
cuugcgccaaucgccgc

SEQ ID NO: 2483164 - RNA, 17 nt, Brucella suis 1330
cuugcgcccgcgguuuc

SEQ ID NO: 2483165 - RNA, 17 nt, Brucella suis 1330
cuugcgccgcaggaacg

SEQ ID NO: 2483166 - RNA, 15 nt, Brucella suis 1330
cuugcgcgcuggaug

SEQ ID NO: 2483167 - RNA, 23 nt, Brucella suis 1330
cuugcgcuccaccagcaugaucg

SEQ ID NO: 2483168 - RNA, 18 nt, Brucella suis 1330
cuugcgcugauucuggau

SEQ ID NO: 2483169 - RNA, 16 nt, Brucella suis 1330
cuugcgcuuugcaagc

SEQ ID NO: 2483170 - RNA, 19 nt, Brucella suis 1330
cuugcggcgauaacugaau

SEQ ID NO: 2483171 - RNA, 22 nt, Brucella suis 1330
cuugcucauggcuuccugcguc

SEQ ID NO: 2483172 - RNA, 19 nt, Brucella suis 1330
cuugcugaaacgagacaag

SEQ ID NO: 2483173 - RNA, 21 nt, Brucella suis 1330
cuugcuguaaccgccaccuuc

SEQ ID NO: 2483174 - RNA, 21 nt, Brucella suis 1330
cuuggauacgucacccgccuu

SEQ ID NO: 2483175 - RNA, 16 nt, Brucella suis 1330
cuuggcaaucuugacc

SEQ ID NO: 2483176 - RNA, 19 nt, Brucella suis 1330
cuuggcacguugcgccugg

SEQ ID NO: 2483177 - RNA, 21 nt, Brucella suis 1330
cuuggcaucaaccuuuucggc

SEQ ID NO: 2483178 - RNA, 15 nt, Brucella suis 1330
cuuggccaugaugcc

SEQ ID NO: 2483179 - RNA, 18 nt, Brucella suis 1330
gaaaggaugacggcuuca

SEQ ID NO: 2483180 - RNA, 22 nt, Brucella suis 1330
gaaaggccgaggcaaccgccuc

SEQ ID NO: 2483181 - RNA, 18 nt, Brucella suis 1330
gaaaggugaaggccugcu

SEQ ID NO: 2483182 - RNA, 17 nt, Brucella suis 1330
gaaagguguccuccagc

SEQ ID NO: 2483183 - RNA, 16 nt, Brucella suis 1330
gaaagucugcuuccgc

SEQ ID NO: 2483184 - RNA, 19 nt, Brucella suis 1330
gaaauaauagucgaaaaaa

SEQ ID NO: 2483185 - RNA, 20 nt, Brucella suis 1330
gaaauaauagucgaaaaaag

SEQ ID NO: 2483186 - RNA, 21 nt, Brucella suis 1330
gaaauaauagucgaaaaaaga

SEQ ID NO: 2483187 - RNA, 22 nt, Brucella suis 1330
gaaauagcacauaucagcccgc

SEQ ID NO: 2483188 - RNA, 18 nt, Brucella suis 1330
gaaauagcgguugcagcc

SEQ ID NO: 2483189 - RNA, 22 nt, Brucella suis 1330
gaaaucaguccaguggacugau

SEQ ID NO: 2483190 - RNA, 18 nt, Brucella suis 1330
gaaauccacuacaaccgg

SEQ ID NO: 2483191 - RNA, 20 nt, Brucella suis 1330
gaaauccguuucggaaagcg

SEQ ID NO: 2483192 - RNA, 22 nt, Brucella suis 1330
gaaauccuggaacaggcccagc

SEQ ID NO: 2483193 - RNA, 19 nt, Brucella suis 1330
gaaaucuugagcguuauaa

SEQ ID NO: 2483194 - RNA, 12 nt, Brucella suis 1330
gaaaugaaagcc

SEQ ID NO: 2483195 - RNA, 22 nt, Brucella suis 1330
gaaaugaaagccgagcugcaag

SEQ ID NO: 2483196 - RNA, 17 nt, Brucella suis 1330
gaaaugaacaucggcgc

SEQ ID NO: 2483197 - RNA, 15 nt, Brucella suis 1330
gaaaugcgcucgaug

SEQ ID NO: 2483198 - RNA, 22 nt, Brucella suis 1330
gaaauuggccgcugccugcaca

SEQ ID NO: 2483199 - RNA, 22 nt, Brucella suis 1330
gaacaaacuuauccagccgccg

SEQ ID NO: 2483200 - RNA, 14 nt, Brucella suis 1330
gaacaaagaugaau

SEQ ID NO: 2483201 - RNA, 14 nt, Brucella suis 1330
gaacaacacaacac

SEQ ID NO: 2483202 - RNA, 13 nt, Brucella suis 1330
gaacaagcagaug

SEQ ID NO: 2483203 - RNA, 13 nt, Brucella suis 1330
gaacacagccccu

SEQ ID NO: 2483204 - RNA, 14 nt, Brucella suis 1330
gaacacgaugaugg

SEQ ID NO: 2483205 - RNA, 21 nt, Brucella suis 1330
gaacacgaugauggccgggaa

SEQ ID NO: 2483206 - RNA, 14 nt, Brucella suis 1330
gaacacgccgacgc

SEQ ID NO: 2483207 - RNA, 19 nt, Brucella suis 1330
gaacacgccgacgcggcag

SEQ ID NO: 2483208 - RNA, 18 nt, Brucella suis 1330
gaacaggcccaccgugcc

SEQ ID NO: 2483209 - RNA, 12 nt, Brucella suis 1330
gaacaggucuga

SEQ ID NO: 2483210 - RNA, 20 nt, Brucella suis 1330
gaacaggucugacgggauga

SEQ ID NO: 2483211 - RNA, 17 nt, Brucella suis 1330
gaacaguuugagcauga

SEQ ID NO: 2483212 - RNA, 22 nt, Brucella suis 1330
gaacauauccugaaacuugugc

SEQ ID NO: 2483213 - RNA, 13 nt, Brucella suis 1330
gaacaugcgccac

SEQ ID NO: 2483214 - RNA, 12 nt, Brucella suis 1330
gaacauggaaaa

SEQ ID NO: 2483215 - RNA, 17 nt, Brucella suis 1330
gaaccaccagagcaaaa

SEQ ID NO: 2483216 - RNA, 22 nt, Brucella suis 1330
gaaccagcggccaucuuccagu

SEQ ID NO: 2483217 - RNA, 13 nt, Brucella suis 1330
gaaccauguaauc

SEQ ID NO: 2483218 - RNA, 13 nt, Brucella suis 1330
gaacccgccacca

SEQ ID NO: 2483219 - RNA, 16 nt, Brucella suis 1330
gaaccgaggcaaugaa

SEQ ID NO: 2483220 - RNA, 20 nt, Brucella suis 1330
gaaccgcucuaucucuuugu

SEQ ID NO: 2483221 - RNA, 23 nt, Brucella suis 1330
gaaccggcgggcuugaugcgcca

SEQ ID NO: 2483222 - RNA, 21 nt, Brucella suis 1330
gaaccggcucugcggaaagcc

SEQ ID NO: 2483223 - RNA, 23 nt, Brucella suis 1330
gaaccgggcccuucucgacagcc

SEQ ID NO: 2483224 - RNA, 13 nt, Brucella suis 1330
gaaccgggccgca

SEQ ID NO: 2483225 - RNA, 17 nt, Brucella suis 1330
gaaccggggcagggcag

SEQ ID NO: 2483226 - RNA, 21 nt, Brucella suis 1330
gaaccgucgccagcucgccgg

SEQ ID NO: 2483227 - RNA, 21 nt, Brucella suis 1330
gaaccguguucgcacaagaag

SEQ ID NO: 2483228 - RNA, 11 nt, Brucella suis 1330
gaaccuccacg

SEQ ID NO: 2483229 - RNA, 12 nt, Brucella suis 1330
gaaccuccacgc

SEQ ID NO: 2483230 - RNA, 18 nt, Brucella suis 1330
gaacgcacugcaagauag

SEQ ID NO: 2483231 - RNA, 18 nt, Brucella suis 1330
gaacgcauagagccacga

SEQ ID NO: 2483232 - RNA, 15 nt, Brucella suis 1330
gaacgcaucgagcug

SEQ ID NO: 2483233 - RNA, 15 nt, Brucella suis 1330
gaacgccgccggaaa

SEQ ID NO: 2483234 - RNA, 17 nt, Brucella suis 1330
gaacgccuuuuucacug

SEQ ID NO: 2483235 - RNA, 19 nt, Brucella suis 1330
gaacgccuuuuucacugca

SEQ ID NO: 2483236 - RNA, 16 nt, Brucella suis 1330
gaacgcgccuuuucuu

SEQ ID NO: 2483237 - RNA, 15 nt, Brucella suis 1330
gaacgcugaaugcgg

SEQ ID NO: 2483238 - RNA, 13 nt, Brucella suis 1330
gaacggcggcggc

SEQ ID NO: 2483239 - RNA, 22 nt, Brucella suis 1330
gaacggcggugguuucccuuga

SEQ ID NO: 2483240 - RNA, 19 nt, Brucella suis 1330
gaacggcuauauuuucggu

SEQ ID NO: 2483241 - RNA, 21 nt, Brucella suis 1330
gaacguacaccgaggccgcca

SEQ ID NO: 2483242 - RNA, 17 nt, Brucella suis 1330
gaacuggaugacaguuu

SEQ ID NO: 2483243 - RNA, 19 nt, Brucella suis 1330
gaacuggcaagugugcaga

SEQ ID NO: 2483244 - RNA, 15 nt, Brucella suis 1330
gaacugggcggccag

SEQ ID NO: 2483245 - RNA, 19 nt, Brucella suis 1330
gaacugggcggccagcucc

SEQ ID NO: 2483246 - RNA, 18 nt, Brucella suis 1330
gaacugguucagccgcuc

SEQ ID NO: 2483247 - RNA, 14 nt, Brucella suis 1330
gaacuucgccaagc

SEQ ID NO: 2483248 - RNA, 18 nt, Brucella suis 1330
gaacuuugugccgccgcu

SEQ ID NO: 2483249 - RNA, 18 nt, Brucella suis 1330
gaagaaaaguccgggcac

SEQ ID NO: 2483250 - RNA, 16 nt, Brucella suis 1330
gaagaagauaaucagc

SEQ ID NO: 2483251 - RNA, 21 nt, Brucella suis 1330
gaagaagauaaucagcagaag

SEQ ID NO: 2483252 - RNA, 17 nt, Brucella suis 1330
gaagaagcuucacaucc

SEQ ID NO: 2483253 - RNA, 21 nt, Brucella suis 1330
gaagaauauggucgcugcggc

SEQ ID NO: 2483254 - RNA, 16 nt, Brucella suis 1330
gaagaauggcaagcag

SEQ ID NO: 2483255 - RNA, 16 nt, Brucella suis 1330
gaagaccaaacagccc

SEQ ID NO: 2483256 - RNA, 14 nt, Brucella suis 1330
gaagaccuucugga

SEQ ID NO: 2483257 - RNA, 17 nt, Brucella suis 1330
gaagaccuucuggaagc

SEQ ID NO: 2483258 - RNA, 15 nt, Brucella suis 1330
gaagacgaucuuuuc

SEQ ID NO: 2483259 - RNA, 18 nt, Brucella suis 1330
gaagagacuguucuuugc

SEQ ID NO: 2483260 - RNA, 19 nt, Brucella suis 1330
gaagagacuguucuuugca

SEQ ID NO: 2483261 - RNA, 16 nt, Brucella suis 1330
gaagagccgcaggcac

SEQ ID NO: 2483262 - RNA, 15 nt, Brucella suis 1330
gaagagccuuuucca

SEQ ID NO: 2483263 - RNA, 15 nt, Brucella suis 1330
gaagauaaucgaugu

SEQ ID NO: 2483264 - RNA, 19 nt, Brucella suis 1330
gaagaucaauucccuggcu

SEQ ID NO: 2483265 - RNA, 20 nt, Brucella suis 1330
gaagaucgucggcaagcugg

SEQ ID NO: 2483266 - RNA, 21 nt, Brucella suis 1330
gaagauugaugauaggcugcu

SEQ ID NO: 2483267 - RNA, 22 nt, Brucella suis 1330
gaagauuucuugcagaugcccg

SEQ ID NO: 2483268 - RNA, 23 nt, Brucella suis 1330
gaagcaagugugaaagcacaaag

SEQ ID NO: 2483269 - RNA, 22 nt, Brucella suis 1330
gaagcaaucgacaauugcccac

SEQ ID NO: 2483270 - RNA, 14 nt, Brucella suis 1330
gaagcaccagcgcg

SEQ ID NO: 2483271 - RNA, 18 nt, Brucella suis 1330
gaagcauauguuccugcg

SEQ ID NO: 2483272 - RNA, 11 nt, Brucella suis 1330
gaagcccagcg

SEQ ID NO: 2483273 - RNA, 13 nt, Brucella suis 1330
gaagcccagcgcc

SEQ ID NO: 2483274 - RNA, 14 nt, Brucella suis 1330
gaagccgauccgca

SEQ ID NO: 2483275 - RNA, 16 nt, Brucella suis 1330
gaagccgauccgcagu

SEQ ID NO: 2483276 - RNA, 16 nt, Brucella suis 1330
gaagcgaagaacagaa

SEQ ID NO: 2483277 - RNA, 18 nt, Brucella suis 1330
gaagcgaagaacagaagc

SEQ ID NO: 2483278 - RNA, 19 nt, Brucella suis 1330
gaagcgaagaacagaagca

SEQ ID NO: 2483279 - RNA, 17 nt, Brucella suis 1330
gaagcgcaaggcggcgc

SEQ ID NO: 2483280 - RNA, 13 nt, Brucella suis 1330
gaagcgccagaga

SEQ ID NO: 2483281 - RNA, 15 nt, Brucella suis 1330
gaagcgccgauaccg

SEQ ID NO: 2483282 - RNA, 19 nt, Brucella suis 1330
gaagcgccuuugcggggga

SEQ ID NO: 2483283 - RNA, 16 nt, Brucella suis 1330
gaagcggauuugagga

SEQ ID NO: 2483284 - RNA, 22 nt, Brucella suis 1330
gaagcggcauuggccgaagccg

SEQ ID NO: 2483285 - RNA, 13 nt, Brucella suis 1330
gaagcgguuuugc

SEQ ID NO: 2483286 - RNA, 21 nt, Brucella suis 1330
gaagcucgacaucaagcgggc

SEQ ID NO: 2483287 - RNA, 15 nt, Brucella suis 1330
gaagcugccgcggcu

SEQ ID NO: 2483288 - RNA, 19 nt, Brucella suis 1330
gaagcugcgcgaaccagau

SEQ ID NO: 2483289 - RNA, 18 nt, Brucella suis 1330
gaagcugucgccagcgcc

SEQ ID NO: 2483290 - RNA, 20 nt, Brucella suis 1330
gaagcuucacauccuucacu

SEQ ID NO: 2483291 - RNA, 17 nt, Brucella suis 1330
gaaggaauccgguucgc

SEQ ID NO: 2483292 - RNA, 23 nt, Brucella suis 1330
gaaggacaagacuuccucgccgu

SEQ ID NO: 2483293 - RNA, 15 nt, Brucella suis 1330
gaaggcaagcaggcg

SEQ ID NO: 2483294 - RNA, 17 nt, Brucella suis 1330
gaaggcaagccccagca

SEQ ID NO: 2483295 - RNA, 17 nt, Brucella suis 1330
gaccucgucaaaaccgu

SEQ ID NO: 2483296 - RNA, 21 nt, Brucella suis 1330
gaccugcaccgcgugaagaau

SEQ ID NO: 2483297 - RNA, 18 nt, Brucella suis 1330
gaccugccaucaccagcc

SEQ ID NO: 2483298 - RNA, 19 nt, Brucella suis 1330
gaccugcuucuugccuuca

SEQ ID NO: 2483299 - RNA, 21 nt, Brucella suis 1330
gaccuuccugacccauggccu

SEQ ID NO: 2483300 - RNA, 21 nt, Brucella suis 1330
gaccuuggcaaucuugaccug

SEQ ID NO: 2483301 - RNA, 14 nt, Brucella suis 1330
gacgaaagccacgc

SEQ ID NO: 2483302 - RNA, 12 nt, Brucella suis 1330
gacgaccauggc

SEQ ID NO: 2483303 - RNA, 20 nt, Brucella suis 1330
gacgagaccugccaucacca

SEQ ID NO: 2483304 - RNA, 14 nt, Brucella suis 1330
gacgagaugcgcuu

SEQ ID NO: 2483305 - RNA, 22 nt, Brucella suis 1330
gacgagaugcgcuuuccgggcu

SEQ ID NO: 2483306 - RNA, 19 nt, Brucella suis 1330
gacgagcgcacgcaggcau

SEQ ID NO: 2483307 - RNA, 18 nt, Brucella suis 1330
gacgagcggcaggccgaa

SEQ ID NO: 2483308 - RNA, 16 nt, Brucella suis 1330
gacgaucaccuguggc

SEQ ID NO: 2483309 - RNA, 19 nt, Brucella suis 1330
gacgaucaccuguggcugu

SEQ ID NO: 2483310 - RNA, 23 nt, Brucella suis 1330
gacgaucaggaauacgcccugca

SEQ ID NO: 2483311 - RNA, 17 nt, Brucella suis 1330
gacgauuuucgccaagc

SEQ ID NO: 2483312 - RNA, 23 nt, Brucella suis 1330
gacgcccagcgaauagaccaugc

SEQ ID NO: 2483313 - RNA, 19 nt, Brucella suis 1330
gacgcgcagacgcagcgca

SEQ ID NO: 2483314 - RNA, 13 nt, Brucella suis 1330
gacgcgcauuuuc

SEQ ID NO: 2483315 - RNA, 13 nt, Brucella suis 1330
gacgcggucccac

SEQ ID NO: 2483316 - RNA, 19 nt, Brucella suis 1330
gacgcugcaacacgccgcc

SEQ ID NO: 2483317 - RNA, 21 nt, Brucella suis 1330
gacgcuuggcaccgccugcgc

SEQ ID NO: 2483318 - RNA, 15 nt, Brucella suis 1330
gacggacgccugcca

SEQ ID NO: 2483319 - RNA, 21 nt, Brucella suis 1330
gacggacgccugccauccgcc

SEQ ID NO: 2483320 - RNA, 23 nt, Brucella suis 1330
gacggacuucuucaccagccuug

SEQ ID NO: 2483321 - RNA, 17 nt, Brucella suis 1330
gacggagcguccgagcg

SEQ ID NO: 2483322 - RNA, 17 nt, Brucella suis 1330
gacggaugaggccugau

SEQ ID NO: 2483323 - RNA, 23 nt, Brucella suis 1330
gacggauggcauggaccacgcgc

SEQ ID NO: 2483324 - RNA, 21 nt, Brucella suis 1330
gacggccacauaaucgcccuc

SEQ ID NO: 2483325 - RNA, 18 nt, Brucella suis 1330
gacggcgcggcgcauggc

SEQ ID NO: 2483326 - RNA, 15 nt, Brucella suis 1330
gacggcgugaugcgc

SEQ ID NO: 2483327 - RNA, 20 nt, Brucella suis 1330
gacggcuguuuucgaggcca

SEQ ID NO: 2483328 - RNA, 21 nt, Brucella suis 1330
gacggcuguuuucgaggccau

SEQ ID NO: 2483329 - RNA, 14 nt, Brucella suis 1330
gacgggacgcaggc

SEQ ID NO: 2483330 - RNA, 22 nt, Brucella suis 1330
gacggggauugcuauugaaugc

SEQ ID NO: 2483331 - RNA, 22 nt, Brucella suis 1330
gacgguaucauaaaugccggcg

SEQ ID NO: 2483332 - RNA, 18 nt, Brucella suis 1330
gacggucgaagccacggc

SEQ ID NO: 2483333 - RNA, 19 nt, Brucella suis 1330
gacggucgaagccacggcg

SEQ ID NO: 2483334 - RNA, 20 nt, Brucella suis 1330
gacguagggcgcgagcacgc

SEQ ID NO: 2483335 - RNA, 16 nt, Brucella suis 1330
gacgugucaaagccuc

SEQ ID NO: 2483336 - RNA, 15 nt, Brucella suis 1330
gacuauuuccaucgc

SEQ ID NO: 2483337 - RNA, 13 nt, Brucella suis 1330
gacucgaacaggc

SEQ ID NO: 2483338 - RNA, 16 nt, Brucella suis 1330
gacugaacgaaugcgu

SEQ ID NO: 2483339 - RNA, 15 nt, Brucella suis 1330
gacugauuuccccgc

SEQ ID NO: 2483340 - RNA, 24 nt, Brucella suis 1330
gacugcggcaacggcgcuggccuu

SEQ ID NO: 2483341 - RNA, 17 nt, Brucella suis 1330
gacugucaccgccagca

SEQ ID NO: 2483342 - RNA, 17 nt, Brucella suis 1330
gacuuauuccgugccuu

SEQ ID NO: 2483343 - RNA, 14 nt, Brucella suis 1330
gacuucagccagaa

SEQ ID NO: 2483344 - RNA, 12 nt, Brucella suis 1330
gacuucaucgcg

SEQ ID NO: 2483345 - RNA, 18 nt, Brucella suis 1330
gacuuccaguggaagcac

SEQ ID NO: 2483346 - RNA, 18 nt, Brucella suis 1330
gacuuccgggaauuccug

SEQ ID NO: 2483347 - RNA, 18 nt, Brucella suis 1330
gacuugaagagccgcagg

SEQ ID NO: 2483348 - RNA, 20 nt, Brucella suis 1330
gacuugaagagccgcaggca

SEQ ID NO: 2483349 - RNA, 18 nt, Brucella suis 1330
gacuuuaauugucggcgu

SEQ ID NO: 2483350 - RNA, 15 nt, Brucella suis 1330
gacuuuccauccagu

SEQ ID NO: 2483351 - RNA, 19 nt, Brucella suis 1330
gacuuuucagccucggaaa

SEQ ID NO: 2483352 - RNA, 22 nt, Brucella suis 1330
gagaaccgauuaaaaaaggaug

SEQ ID NO: 2483353 - RNA, 22 nt, Brucella suis 1330
gagaacggcggcggcgaugccu

SEQ ID NO: 2483354 - RNA, 17 nt, Brucella suis 1330
gagaacuucggcauggc

SEQ ID NO: 2483355 - RNA, 22 nt, Brucella suis 1330
gagaaucuugcccucgccgccg

SEQ ID NO: 2483356 - RNA, 20 nt, Brucella suis 1330
gagaaugaccacgccgagga

SEQ ID NO: 2483357 - RNA, 20 nt, Brucella suis 1330
gagaauggagcauuuccagc

SEQ ID NO: 2483358 - RNA, 19 nt, Brucella suis 1330
gagaccagcgcauucugcu

SEQ ID NO: 2483359 - RNA, 18 nt, Brucella suis 1330
gagaccugccaucaccag

SEQ ID NO: 2483360 - RNA, 20 nt, Brucella suis 1330
gagagcaugaucgcccgccc

SEQ ID NO: 2483361 - RNA, 18 nt, Brucella suis 1330
gagaucguaggcuuuccc

SEQ ID NO: 2483362 - RNA, 15 nt, Brucella suis 1330
gagaugcgcuuuccg

SEQ ID NO: 2483363 - RNA, 11 nt, Brucella suis 1330
gagauugccgc

SEQ ID NO: 2483364 - RNA, 15 nt, Brucella suis 1330
gagauugggcagcag

SEQ ID NO: 2483365 - RNA, 17 nt, Brucella suis 1330
gagauugggcagcagau

SEQ ID NO: 2483366 - RNA, 19 nt, Brucella suis 1330
gagcaccgcccguccccca

SEQ ID NO: 2483367 - RNA, 14 nt, Brucella suis 1330
gagcagcaccggcg

SEQ ID NO: 2483368 - RNA, 20 nt, Brucella suis 1330
gagcagcaucuugccaagcu

SEQ ID NO: 2483369 - RNA, 16 nt, Brucella suis 1330
gagcaggcaggccgcc

SEQ ID NO: 2483370 - RNA, 22 nt, Brucella suis 1330
gagcaggcucccgccugcaaug

SEQ ID NO: 2483371 - RNA, 13 nt, Brucella suis 1330
gagcaucccuccc

SEQ ID NO: 2483372 - RNA, 19 nt, Brucella suis 1330
gagcaucgaucugaaugaa

SEQ ID NO: 2483373 - RNA, 18 nt, Brucella suis 1330
gagcaugaucgcccgccc

SEQ ID NO: 2483374 - RNA, 21 nt, Brucella suis 1330
gagcaugaucgcccgcccggc

SEQ ID NO: 2483375 - RNA, 14 nt, Brucella suis 1330
gagcauggaucgcc

SEQ ID NO: 2483376 - RNA, 16 nt, Brucella suis 1330
gagcauggccugcgca

SEQ ID NO: 2483377 - RNA, 16 nt, Brucella suis 1330
gagcauggucacgucg

SEQ ID NO: 2483378 - RNA, 20 nt, Brucella suis 1330
gagcauucccuucgcgccgc

SEQ ID NO: 2483379 - RNA, 17 nt, Brucella suis 1330
gagccaaaaaugugaaa

SEQ ID NO: 2483380 - RNA, 13 nt, Brucella suis 1330
gagccaaaagugc

SEQ ID NO: 2483381 - RNA, 22 nt, Brucella suis 1330
gagccaaaagugugaaacgccu

SEQ ID NO: 2483382 - RNA, 17 nt, Brucella suis 1330
gagccacgagaaaaugg

SEQ ID NO: 2483383 - RNA, 19 nt, Brucella suis 1330
gagccauaucggggcgucc

SEQ ID NO: 2483384 - RNA, 18 nt, Brucella suis 1330
gagccauuauucucccag

SEQ ID NO: 2483385 - RNA, 20 nt, Brucella suis 1330
gagccauuauucucccagag

SEQ ID NO: 2483386 - RNA, 16 nt, Brucella suis 1330
gagccccaggaacggc

SEQ ID NO: 2483387 - RNA, 20 nt, Brucella suis 1330
gagccgaaccggggcagggc

SEQ ID NO: 2483388 - RNA, 15 nt, Brucella suis 1330
gagccgaauuccgcc

SEQ ID NO: 2483389 - RNA, 21 nt, Brucella suis 1330
gagccgcgccaugccauccuc

SEQ ID NO: 2483390 - RNA, 13 nt, Brucella suis 1330
gagccgcugcgca

SEQ ID NO: 2483391 - RNA, 14 nt, Brucella suis 1330
gagccgcuucugcu

SEQ ID NO: 2483392 - RNA, 22 nt, Brucella suis 1330
gagccucaucggcgggccaggu

SEQ ID NO: 2483393 - RNA, 21 nt, Brucella suis 1330
gagccuucauugcggccaagc

SEQ ID NO: 2483394 - RNA, 22 nt, Brucella suis 1330
gagccuucauugcggccaagcg

SEQ ID NO: 2483395 - RNA, 20 nt, Brucella suis 1330
gagccuuccguugcagccca

SEQ ID NO: 2483396 - RNA, 12 nt, Brucella suis 1330
gagccuuugcuu

SEQ ID NO: 2483397 - RNA, 19 nt, Brucella suis 1330
gagccuuugcuucacgcuc

SEQ ID NO: 2483398 - RNA, 13 nt, Brucella suis 1330
gagcgaccagcaa

SEQ ID NO: 2483399 - RNA, 15 nt, Brucella suis 1330
gagcgauuucuggag

SEQ ID NO: 2483400 - RNA, 13 nt, Brucella suis 1330
gagcgcaucccga

SEQ ID NO: 2483401 - RNA, 14 nt, Brucella suis 1330
gagcgcauccgccu

SEQ ID NO: 2483402 - RNA, 21 nt, Brucella suis 1330
gagcgccagauaaagcaggau

SEQ ID NO: 2483403 - RNA, 22 nt, Brucella suis 1330
gagcgccguuuucgugugcuug

SEQ ID NO: 2483404 - RNA, 21 nt, Brucella suis 1330
gagcgcgccacggauuuccac

SEQ ID NO: 2483405 - RNA, 13 nt, Brucella suis 1330
gagcggaagagga

SEQ ID NO: 2483406 - RNA, 20 nt, Brucella suis 1330
gagcggaagaggacaaggcc

SEQ ID NO: 2483407 - RNA, 20 nt, Brucella suis 1330
gagcggauggaccggcuggu

SEQ ID NO: 2483408 - RNA, 17 nt, Brucella suis 1330
gagcggcacaugaaaua

SEQ ID NO: 2483409 - RNA, 13 nt, Brucella suis 1330
gagcggcagcagc

SEQ ID NO: 2483410 - RNA, 14 nt, Brucella suis 1330
gagcggcagcagcc

SEQ ID NO: 2483411 - RNA, 18 nt, Brucella suis 1330
gaucgacagcggaagcgc

SEQ ID NO: 2483412 - RNA, 14 nt, Brucella suis 1330
gaucgacauauuug

SEQ ID NO: 2483413 - RNA, 22 nt, Brucella suis 1330
gaucgagccgacaucgcgcuug

SEQ ID NO: 2483414 - RNA, 22 nt, Brucella suis 1330
gaucgaugcgcuccugaaccgg

SEQ ID NO: 2483415 - RNA, 14 nt, Brucella suis 1330
gaucgauguucuuu

SEQ ID NO: 2483416 - RNA, 15 nt, Brucella suis 1330
gaucgccagaagcgu

SEQ ID NO: 2483417 - RNA, 16 nt, Brucella suis 1330
gaucgcccgcccggca

SEQ ID NO: 2483418 - RNA, 20 nt, Brucella suis 1330
gaucgccuuucaccagagcc

SEQ ID NO: 2483419 - RNA, 16 nt, Brucella suis 1330
gaucgcgucccuugcc

SEQ ID NO: 2483420 - RNA, 15 nt, Brucella suis 1330
gaucggccauuucgg

SEQ ID NO: 2483421 - RNA, 15 nt, Brucella suis 1330
gaucgggaaauaaac

SEQ ID NO: 2483422 - RNA, 23 nt, Brucella suis 1330
gaucgggucgaucaucagcggcg

SEQ ID NO: 2483423 - RNA, 20 nt, Brucella suis 1330
gaucgguucgccgcuugcgc

SEQ ID NO: 2483424 - RNA, 18 nt, Brucella suis 1330
gaucguagaucgcccggu

SEQ ID NO: 2483425 - RNA, 21 nt, Brucella suis 1330
gaucguauccccggcaaagac

SEQ ID NO: 2483426 - RNA, 14 nt, Brucella suis 1330
gaucgucuugcaug

SEQ ID NO: 2483427 - RNA, 15 nt, Brucella suis 1330
gaucgugagguucuu

SEQ ID NO: 2483428 - RNA, 15 nt, Brucella suis 1330
gaucgugaucuucgg

SEQ ID NO: 2483429 - RNA, 17 nt, Brucella suis 1330
gaucgugccggaauggc

SEQ ID NO: 2483430 - RNA, 16 nt, Brucella suis 1330
gaucucauuucggcug

SEQ ID NO: 2483431 - RNA, 16 nt, Brucella suis 1330
gaucucggagcggccg

SEQ ID NO: 2483432 - RNA, 14 nt, Brucella suis 1330
gaucugauugccgu

SEQ ID NO: 2483433 - RNA, 12 nt, Brucella suis 1330
gaucugcauccc

SEQ ID NO: 2483434 - RNA, 15 nt, Brucella suis 1330
gaucuggcggaugau

SEQ ID NO: 2483435 - RNA, 18 nt, Brucella suis 1330
gaucuggcugagauaaac

SEQ ID NO: 2483436 - RNA, 23 nt, Brucella suis 1330
gaucuguucagccgcagccgcca

SEQ ID NO: 2483437 - RNA, 18 nt, Brucella suis 1330
gaucuuccaucuggccgc

SEQ ID NO: 2483438 - RNA, 20 nt, Brucella suis 1330
gaucuucgaucauuuccuuc

SEQ ID NO: 2483439 - RNA, 18 nt, Brucella suis 1330
gaucuucggcaucagaaa

SEQ ID NO: 2483440 - RNA, 23 nt, Brucella suis 1330
gaucuucggcaucagaaauuugc

SEQ ID NO: 2483441 - RNA, 18 nt, Brucella suis 1330
gaucuugcguugcgauau

SEQ ID NO: 2483442 - RNA, 16 nt, Brucella suis 1330
gaucuugucgccgaaa

SEQ ID NO: 2483443 - RNA, 19 nt, Brucella suis 1330
gaugaacccgcucccccca

SEQ ID NO: 2483444 - RNA, 22 nt, Brucella suis 1330
gaugaagaagauaaucagcaga

SEQ ID NO: 2483445 - RNA, 14 nt, Brucella suis 1330
gaugaagcgccgau

SEQ ID NO: 2483446 - RNA, 14 nt, Brucella suis 1330
gaugaaugccgaag

SEQ ID NO: 2483447 - RNA, 18 nt, Brucella suis 1330
gaugaauggggggcaggc

SEQ ID NO: 2483448 - RNA, 22 nt, Brucella suis 1330
gaugacgaaaugaacaucggcg

SEQ ID NO: 2483449 - RNA, 13 nt, Brucella suis 1330
gaugacgccgcuu

SEQ ID NO: 2483450 - RNA, 14 nt, Brucella suis 1330
gaugacggcgcggc

SEQ ID NO: 2483451 - RNA, 16 nt, Brucella suis 1330
gaugacggcgcggcgc

SEQ ID NO: 2483452 - RNA, 23 nt, Brucella suis 1330
gaugacggcuucaacgccguggc

SEQ ID NO: 2483453 - RNA, 18 nt, Brucella suis 1330
gaugacuucgguuuccac

SEQ ID NO: 2483454 - RNA, 17 nt, Brucella suis 1330
gaugagcaggcgaucca

SEQ ID NO: 2483455 - RNA, 17 nt, Brucella suis 1330
gaugagcgccauuuccc

SEQ ID NO: 2483456 - RNA, 18 nt, Brucella suis 1330
gaugagcuaucagccgcc

SEQ ID NO: 2483457 - RNA, 21 nt, Brucella suis 1330
gaugagcuaucagccgcccgc

SEQ ID NO: 2483458 - RNA, 21 nt, Brucella suis 1330
gaugagcugguuuuucaccau

SEQ ID NO: 2483459 - RNA, 22 nt, Brucella suis 1330
gaugauaucgccuucgcgcacc

SEQ ID NO: 2483460 - RNA, 13 nt, Brucella suis 1330
gaugaucgccagc

SEQ ID NO: 2483461 - RNA, 21 nt, Brucella suis 1330
gaugaucgguacggaaagggc

SEQ ID NO: 2483462 - RNA, 23 nt, Brucella suis 1330
gaugaugcuugccucguccgguu

SEQ ID NO: 2483463 - RNA, 11 nt, Brucella suis 1330
gaugauuuccc

SEQ ID NO: 2483464 - RNA, 16 nt, Brucella suis 1330
gaugcaaaaccgguuc

SEQ ID NO: 2483465 - RNA, 15 nt, Brucella suis 1330
gaugcaaugcaccga

SEQ ID NO: 2483466 - RNA, 22 nt, Brucella suis 1330
gaugcaaugcaccgauggccag

SEQ ID NO: 2483467 - RNA, 14 nt, Brucella suis 1330
gaugccgacaagca

SEQ ID NO: 2483468 - RNA, 19 nt, Brucella suis 1330
gaugccgauacuguagaaa

SEQ ID NO: 2483469 - RNA, 17 nt, Brucella suis 1330
gaugccgggcacgaaaa

SEQ ID NO: 2483470 - RNA, 22 nt, Brucella suis 1330
gaugccugccaugccgaaggcg

SEQ ID NO: 2483471 - RNA, 19 nt, Brucella suis 1330
gaugcgaaacggagaaaac

SEQ ID NO: 2483472 - RNA, 17 nt, Brucella suis 1330
gaugcgccagcgaugau

SEQ ID NO: 2483473 - RNA, 11 nt, Brucella suis 1330
gaugcgccagu

SEQ ID NO: 2483474 - RNA, 21 nt, Brucella suis 1330
gaugcgcgccagccgccagca

SEQ ID NO: 2483475 - RNA, 22 nt, Brucella suis 1330
gaugcgcucuaauuuuaugcug

SEQ ID NO: 2483476 - RNA, 17 nt, Brucella suis 1330
gaugcgcuuuaaagcag

SEQ ID NO: 2483477 - RNA, 17 nt, Brucella suis 1330
gaugcggaugacuucgg

SEQ ID NO: 2483478 - RNA, 13 nt, Brucella suis 1330
gaugcguuggaaa

SEQ ID NO: 2483479 - RNA, 23 nt, Brucella suis 1330
gaugcuugccucguccgguuuuc

SEQ ID NO: 2483480 - RNA, 22 nt, Brucella suis 1330
gauggaacggaaaaugcccggc

SEQ ID NO: 2483481 - RNA, 17 nt, Brucella suis 1330
gauggaagacauugcca

SEQ ID NO: 2483482 - RNA, 15 nt, Brucella suis 1330
gauggaaggaaagcc

SEQ ID NO: 2483483 - RNA, 23 nt, Brucella suis 1330
gauggaauaucgcucauauggau

SEQ ID NO: 2483484 - RNA, 12 nt, Brucella suis 1330
gauggagcggcu

SEQ ID NO: 2483485 - RNA, 19 nt, Brucella suis 1330
gauggcagaccccaucagc

SEQ ID NO: 2483486 - RNA, 15 nt, Brucella suis 1330
gauggcauggaccac

SEQ ID NO: 2483487 - RNA, 14 nt, Brucella suis 1330
gauggccgaaccgu

SEQ ID NO: 2483488 - RNA, 17 nt, Brucella suis 1330
gauggccgggaaugcgg

SEQ ID NO: 2483489 - RNA, 15 nt, Brucella suis 1330
gauggcgacgcgcuc

SEQ ID NO: 2483490 - RNA, 21 nt, Brucella suis 1330
gauggcgguuuccaucgaauc

SEQ ID NO: 2483491 - RNA, 20 nt, Brucella suis 1330
gauggcguucgucaaugcgc

SEQ ID NO: 2483492 - RNA, 16 nt, Brucella suis 1330
gauggcugcccgcgcc

SEQ ID NO: 2483493 - RNA, 20 nt, Brucella suis 1330
gauggcugcccgcgccgguc

SEQ ID NO: 2483494 - RNA, 18 nt, Brucella suis 1330
gaugggccggucuucccg

SEQ ID NO: 2483495 - RNA, 15 nt, Brucella suis 1330
gauggguaucgguca

SEQ ID NO: 2483496 - RNA, 17 nt, Brucella suis 1330
gaugguccagucuucau

SEQ ID NO: 2483497 - RNA, 15 nt, Brucella suis 1330
gaugucgauuucacc

SEQ ID NO: 2483498 - RNA, 23 nt, Brucella suis 1330
gaugucgccgcucaugcgguaga

SEQ ID NO: 2483499 - RNA, 21 nt, Brucella suis 1330
gaugugagcgaauaugcgggg

SEQ ID NO: 2483500 - RNA, 19 nt, Brucella suis 1330
gaugugcagcgugccgugu

SEQ ID NO: 2483501 - RNA, 13 nt, Brucella suis 1330
gauguguccggcg

SEQ ID NO: 2483502 - RNA, 12 nt, Brucella suis 1330
gaugugucggcc

SEQ ID NO: 2483503 - RNA, 17 nt, Brucella suis 1330
gauguugauggaaggcg

SEQ ID NO: 2483504 - RNA, 15 nt, Brucella suis 1330
gauuagagcgccgau

SEQ ID NO: 2483505 - RNA, 23 nt, Brucella suis 1330
gauuaugcuauagagcgccgauc

SEQ ID NO: 2483506 - RNA, 17 nt, Brucella suis 1330
gauuaugcuuuaaaagc

SEQ ID NO: 2483507 - RNA, 15 nt, Brucella suis 1330
gauuccaacauuugc

SEQ ID NO: 2483508 - RNA, 20 nt, Brucella suis 1330
gauuccaacauuugcucaac

SEQ ID NO: 2483509 - RNA, 21 nt, Brucella suis 1330
gauucccuuuuccgcaaaaau

SEQ ID NO: 2483510 - RNA, 16 nt, Brucella suis 1330
gauucgaaccucugac

SEQ ID NO: 2483511 - RNA, 22 nt, Brucella suis 1330
gauucgaaccucugacccccag

SEQ ID NO: 2483512 - RNA, 22 nt, Brucella suis 1330
gauucgaccuugaaaucgcgcu

SEQ ID NO: 2483513 - RNA, 19 nt, Brucella suis 1330
gauugaauccgaucggcgc

SEQ ID NO: 2483514 - RNA, 14 nt, Brucella suis 1330
gauugacgccccca

SEQ ID NO: 2483515 - RNA, 21 nt, Brucella suis 1330
gauugaucgcaagccaaagcc

SEQ ID NO: 2483516 - RNA, 15 nt, Brucella suis 1330
gauugcccauugccc

SEQ ID NO: 2483517 - RNA, 21 nt, Brucella suis 1330
gauugccccgccauaaagcac

SEQ ID NO: 2483518 - RNA, 21 nt, Brucella suis 1330
gauugccgcgcgcggcuucca

SEQ ID NO: 2483519 - RNA, 21 nt, Brucella suis 1330
gauugccgugguaugccagcc

SEQ ID NO: 2483520 - RNA, 18 nt, Brucella suis 1330
gauugccugugcggcggc

SEQ ID NO: 2483521 - RNA, 18 nt, Brucella suis 1330
gauugcgcaagugcugca

SEQ ID NO: 2483522 - RNA, 19 nt, Brucella suis 1330
gauugcggcugauaugcgc

SEQ ID NO: 2483523 - RNA, 16 nt, Brucella suis 1330
gauugcgggcaagcau

SEQ ID NO: 2483524 - RNA, 15 nt, Brucella suis 1330
gauugcuaaaugcaa

SEQ ID NO: 2483525 - RNA, 16 nt, Brucella suis 1330
gauugcuaaaugcaag

SEQ ID NO: 2483526 - RNA, 17 nt, Brucella suis 1330
gauugcuauugaaugcc

SEQ ID NO: 2483527 - RNA, 14 nt, Brucella suis 1330
gcacccuauucccc

SEQ ID NO: 2483528 - RNA, 19 nt, Brucella suis 1330
gcaccgaaggcaagcaggc

SEQ ID NO: 2483529 - RNA, 18 nt, Brucella suis 1330
gcaccgaccgggcuugca

SEQ ID NO: 2483530 - RNA, 22 nt, Brucella suis 1330
gcaccgauauagagcagcaccg

SEQ ID NO: 2483531 - RNA, 15 nt, Brucella suis 1330
gcaccgauccgcaac

SEQ ID NO: 2483532 - RNA, 16 nt, Brucella suis 1330
gcaccgcaaagagaac

SEQ ID NO: 2483533 - RNA, 13 nt, Brucella suis 1330
gcaccgcacuggg

SEQ ID NO: 2483534 - RNA, 14 nt, Brucella suis 1330
gcaccgcccguccc

SEQ ID NO: 2483535 - RNA, 16 nt, Brucella suis 1330
gcaccgccugcgcgca

SEQ ID NO: 2483536 - RNA, 20 nt, Brucella suis 1330
gcaccgccugcgcgcauuuc

SEQ ID NO: 2483537 - RNA, 13 nt, Brucella suis 1330
gcaccgcgccgga

SEQ ID NO: 2483538 - RNA, 13 nt, Brucella suis 1330
gcaccggccuuga

SEQ ID NO: 2483539 - RNA, 19 nt, Brucella suis 1330
gcaccgggccgucaaaagg

SEQ ID NO: 2483540 - RNA, 13 nt, Brucella suis 1330
gcaccucaggaug

SEQ ID NO: 2483541 - RNA, 22 nt, Brucella suis 1330
gcacgaacagaucgccaagcgc

SEQ ID NO: 2483542 - RNA, 16 nt, Brucella suis 1330
gcacgaccagaagccc

SEQ ID NO: 2483543 - RNA, 18 nt, Brucella suis 1330
gcacgaccagaagcccgc

SEQ ID NO: 2483544 - RNA, 18 nt, Brucella suis 1330
gcacgaucgguucgccgc

SEQ ID NO: 2483545 - RNA, 19 nt, Brucella suis 1330
gcacgaucgguucgccgcu

SEQ ID NO: 2483546 - RNA, 16 nt, Brucella suis 1330
gcacgaugcgcagccg

SEQ ID NO: 2483547 - RNA, 19 nt, Brucella suis 1330
gcacgcaggcaucaaugaa

SEQ ID NO: 2483548 - RNA, 14 nt, Brucella suis 1330
gcacgccugccgcg

SEQ ID NO: 2483549 - RNA, 15 nt, Brucella suis 1330
gcacgccugccgcgc

SEQ ID NO: 2483550 - RNA, 19 nt, Brucella suis 1330
gcacgcgcgaaaccaugga

SEQ ID NO: 2483551 - RNA, 19 nt, Brucella suis 1330
gcacgcuuggccucuucca

SEQ ID NO: 2483552 - RNA, 12 nt, Brucella suis 1330
gcacggcggcuu

SEQ ID NO: 2483553 - RNA, 14 nt, Brucella suis 1330
gcacgucaucaucg

SEQ ID NO: 2483554 - RNA, 17 nt, Brucella suis 1330
gcacgucaucaucgucu

SEQ ID NO: 2483555 - RNA, 21 nt, Brucella suis 1330
gcacgucaucaucgucuucaa

SEQ ID NO: 2483556 - RNA, 17 nt, Brucella suis 1330
gcacguugcgccuggcg

SEQ ID NO: 2483557 - RNA, 16 nt, Brucella suis 1330
gcacucuccucugccu

SEQ ID NO: 2483558 - RNA, 14 nt, Brucella suis 1330
gcacugccaccauc

SEQ ID NO: 2483559 - RNA, 13 nt, Brucella suis 1330
gcacuuccagaua

SEQ ID NO: 2483560 - RNA, 18 nt, Brucella suis 1330
gcacuuucaagcggguag

SEQ ID NO: 2483561 - RNA, 16 nt, Brucella suis 1330
gcacuuuggcaacaag

SEQ ID NO: 2483562 - RNA, 18 nt, Brucella suis 1330
gcacuuuugcuggaaaug

SEQ ID NO: 2483563 - RNA, 19 nt, Brucella suis 1330
gcagaagaaagggcgcggu

SEQ ID NO: 2483564 - RNA, 18 nt, Brucella suis 1330
gcagaaguuucagcgcau

SEQ ID NO: 2483565 - RNA, 13 nt, Brucella suis 1330
gcagaaugagcuu

SEQ ID NO: 2483566 - RNA, 18 nt, Brucella suis 1330
gcagaauuucagcuuccc

SEQ ID NO: 2483567 - RNA, 18 nt, Brucella suis 1330
gcagacacgcuuuuucgc

SEQ ID NO: 2483568 - RNA, 20 nt, Brucella suis 1330
gcagacacgcuuuuucgccu

SEQ ID NO: 2483569 - RNA, 13 nt, Brucella suis 1330
gcagacaggccag

SEQ ID NO: 2483570 - RNA, 17 nt, Brucella suis 1330
gcagacgggacgcaggc

SEQ ID NO: 2483571 - RNA, 20 nt, Brucella suis 1330
gcagacgggacgcaggcgga

SEQ ID NO: 2483572 - RNA, 21 nt, Brucella suis 1330
gcagacgggacgcaggcggau

SEQ ID NO: 2483573 - RNA, 17 nt, Brucella suis 1330
gcagacgugaccgccug

SEQ ID NO: 2483574 - RNA, 23 nt, Brucella suis 1330
gcagaggauaacauggccgucuu

SEQ ID NO: 2483575 - RNA, 19 nt, Brucella suis 1330
gcagauaaaaaggaugaau

SEQ ID NO: 2483576 - RNA, 17 nt, Brucella suis 1330
gcagauaaagcgcaagc

SEQ ID NO: 2483577 - RNA, 18 nt, Brucella suis 1330
gcagaucaucgucaugca

SEQ ID NO: 2483578 - RNA, 22 nt, Brucella suis 1330
gcagaucgcauccaguccgcaa

SEQ ID NO: 2483579 - RNA, 20 nt, Brucella suis 1330
gcagaugagcggcagcagcc

SEQ ID NO: 2483580 - RNA, 19 nt, Brucella suis 1330
gcagaugcccgcuuucccg

SEQ ID NO: 2483581 - RNA, 17 nt, Brucella suis 1330
gcagcaauuccugcgcc

SEQ ID NO: 2483582 - RNA, 18 nt, Brucella suis 1330
gcagcaauuccugcgcca

SEQ ID NO: 2483583 - RNA, 19 nt, Brucella suis 1330
gcagcaccggcggaaggcu

SEQ ID NO: 2483584 - RNA, 20 nt, Brucella suis 1330
gcagcaccggcggaaggcug

SEQ ID NO: 2483585 - RNA, 14 nt, Brucella suis 1330
gcagcagcaucgcc

SEQ ID NO: 2483586 - RNA, 16 nt, Brucella suis 1330
gcagcagcaucgccgc

SEQ ID NO: 2483587 - RNA, 16 nt, Brucella suis 1330
gcagcaggcagacgaa

SEQ ID NO: 2483588 - RNA, 18 nt, Brucella suis 1330
gcagcaucacaugggcau

SEQ ID NO: 2483589 - RNA, 15 nt, Brucella suis 1330
gcagcaucgccgcca

SEQ ID NO: 2483590 - RNA, 16 nt, Brucella suis 1330
gcagcaugaucgccac

SEQ ID NO: 2483591 - RNA, 13 nt, Brucella suis 1330
gcagccacggcag

SEQ ID NO: 2483592 - RNA, 12 nt, Brucella suis 1330
gcagccagggau

SEQ ID NO: 2483593 - RNA, 21 nt, Brucella suis 1330
gcagcccggacaggcggcgac

SEQ ID NO: 2483594 - RNA, 17 nt, Brucella suis 1330
gcagccgcgucagccgg

SEQ ID NO: 2483595 - RNA, 20 nt, Brucella suis 1330
gcagccgugaaacagugccg

SEQ ID NO: 2483596 - RNA, 15 nt, Brucella suis 1330
gcagccugaacagcg

SEQ ID NO: 2483597 - RNA, 17 nt, Brucella suis 1330
gcagccuugagcugguc

SEQ ID NO: 2483598 - RNA, 16 nt, Brucella suis 1330
gcagcgauauccggca

SEQ ID NO: 2483599 - RNA, 18 nt, Brucella suis 1330
gcagcgauauccggcacg

SEQ ID NO: 2483600 - RNA, 22 nt, Brucella suis 1330
gcagcgcauuuucauugccggg

SEQ ID NO: 2483601 - RNA, 12 nt, Brucella suis 1330
gcagcgccgcgc

SEQ ID NO: 2483602 - RNA, 14 nt, Brucella suis 1330
gcagcgccgcgccc

SEQ ID NO: 2483603 - RNA, 14 nt, Brucella suis 1330
gcagcggcgcgcca

SEQ ID NO: 2483604 - RNA, 16 nt, Brucella suis 1330
gcagcggucacagaag

SEQ ID NO: 2483605 - RNA, 16 nt, Brucella suis 1330
gcagcguauucaggga

SEQ ID NO: 2483606 - RNA, 16 nt, Brucella suis 1330
gcagcgucacaaaaca

SEQ ID NO: 2483607 - RNA, 17 nt, Brucella suis 1330
gcagcgucaccgugcgc

SEQ ID NO: 2483608 - RNA, 23 nt, Brucella suis 1330
gcagcguuuugucauggccggau

SEQ ID NO: 2483609 - RNA, 17 nt, Brucella suis 1330
gcagcuaugcgccacac

SEQ ID NO: 2483610 - RNA, 14 nt, Brucella suis 1330
gcagcucggcuuca

SEQ ID NO: 2483611 - RNA, 20 nt, Brucella suis 1330
gcagcucuauugcccggcgg

SEQ ID NO: 2483612 - RNA, 17 nt, Brucella suis 1330
gcagcuucgagcgccuu

SEQ ID NO: 2483613 - RNA, 11 nt, Brucella suis 1330
gcagcuugucg

SEQ ID NO: 2483614 - RNA, 14 nt, Brucella suis 1330
gcaggacaagccgc

SEQ ID NO: 2483615 - RNA, 20 nt, Brucella suis 1330
gcaggagauaggcaacaggc

SEQ ID NO: 2483616 - RNA, 14 nt, Brucella suis 1330
gcaggagcgcgauc

SEQ ID NO: 2483617 - RNA, 13 nt, Brucella suis 1330
gcaggaggccaaa

SEQ ID NO: 2483618 - RNA, 15 nt, Brucella suis 1330
gcaggaucagggcca

SEQ ID NO: 2483619 - RNA, 18 nt, Brucella suis 1330
gcaggaucagggccacuc

SEQ ID NO: 2483620 - RNA, 16 nt, Brucella suis 1330
gcaggaucggcagcag

SEQ ID NO: 2483621 - RNA, 18 nt, Brucella suis 1330
gcaggaucggcagcagcg

SEQ ID NO: 2483622 - RNA, 13 nt, Brucella suis 1330
gcaggaucuucca

SEQ ID NO: 2483623 - RNA, 17 nt, Brucella suis 1330
gcaggcacuggucggga

SEQ ID NO: 2483624 - RNA, 18 nt, Brucella suis 1330
gcaggcaggccgccuggg

SEQ ID NO: 2483625 - RNA, 18 nt, Brucella suis 1330
gcaggccauucccgccuc

SEQ ID NO: 2483626 - RNA, 19 nt, Brucella suis 1330
gcaggccgaaggaugcaag

SEQ ID NO: 2483627 - RNA, 18 nt, Brucella suis 1330
gcaggccgguaagcccug

SEQ ID NO: 2483628 - RNA, 17 nt, Brucella suis 1330
gcaggccgugaagauug

SEQ ID NO: 2483629 - RNA, 18 nt, Brucella suis 1330
gcaggcgcaggcccugca

SEQ ID NO: 2483630 - RNA, 19 nt, Brucella suis 1330
gcaggcgcgaucaugccca

SEQ ID NO: 2483631 - RNA, 20 nt, Brucella suis 1330
gcaggcggaagggccggucg

SEQ ID NO: 2483632 - RNA, 20 nt, Brucella suis 1330
gcaggcggauauucgccgcc

SEQ ID NO: 2483633 - RNA, 21 nt, Brucella suis 1330
gcaggcggauauucgccgccu

SEQ ID NO: 2483634 - RNA, 14 nt, Brucella suis 1330
gcaggcucccgccu

SEQ ID NO: 2483635 - RNA, 13 nt, Brucella suis 1330
gcaggcucugaaa

SEQ ID NO: 2483636 - RNA, 21 nt, Brucella suis 1330
gcagggcauggguggccgcca

SEQ ID NO: 2483637 - RNA, 21 nt, Brucella suis 1330
gcagggcuucaugauggaaga

SEQ ID NO: 2483638 - RNA, 16 nt, Brucella suis 1330
gcaggggcagcgcgcg

SEQ ID NO: 2483639 - RNA, 17 nt, Brucella suis 1330
gcaggggugcaaagcuu

SEQ ID NO: 2483640 - RNA, 20 nt, Brucella suis 1330
gcagggucugcgccagauca

SEQ ID NO: 2483641 - RNA, 18 nt, Brucella suis 1330
gcagguuccaguccagcg

SEQ ID NO: 2483642 - RNA, 19 nt, Brucella suis 1330
gcaguaucgucguccagcc

SEQ ID NO: 2483643 - RNA, 15 nt, Brucella suis 1330
gcagucagcaccgua

SEQ ID NO: 2483644 - RNA, 19 nt, Brucella suis 1330
gccaccgcgaucaguucgc

SEQ ID NO: 2483645 - RNA, 13 nt, Brucella suis 1330
gccaccggcggcg

SEQ ID NO: 2483646 - RNA, 19 nt, Brucella suis 1330
gccaccguugcauauucca

SEQ ID NO: 2483647 - RNA, 22 nt, Brucella suis 1330
gccacgagaaaauggcgcuagc

SEQ ID NO: 2483648 - RNA, 13 nt, Brucella suis 1330
gccacgaggaaga

SEQ ID NO: 2483649 - RNA, 21 nt, Brucella suis 1330
gccacgauagacgcggcggca

SEQ ID NO: 2483650 - RNA, 19 nt, Brucella suis 1330
gccacgaugccugccggug

SEQ ID NO: 2483651 - RNA, 21 nt, Brucella suis 1330
gccacgaugccugccggugca

SEQ ID NO: 2483652 - RNA, 16 nt, Brucella suis 1330
gccacgccuucaaagc

SEQ ID NO: 2483653 - RNA, 19 nt, Brucella suis 1330
gccacgccuucaaagcgcg

SEQ ID NO: 2483654 - RNA, 13 nt, Brucella suis 1330
gccacgcgccgcc

SEQ ID NO: 2483655 - RNA, 16 nt, Brucella suis 1330
gccacgcgccgccauc

SEQ ID NO: 2483656 - RNA, 14 nt, Brucella suis 1330
gccacggauuucca

SEQ ID NO: 2483657 - RNA, 21 nt, Brucella suis 1330
gccacggcgaaagcugccgcg

SEQ ID NO: 2483658 - RNA, 22 nt, Brucella suis 1330
gccacggcgaaagcugccgcga

SEQ ID NO: 2483659 - RNA, 15 nt, Brucella suis 1330
gccacggcuuucggu

SEQ ID NO: 2483660 - RNA, 14 nt, Brucella suis 1330
gccacugcccugga

SEQ ID NO: 2483661 - RNA, 15 nt, Brucella suis 1330
gccacuucgcgggca

SEQ ID NO: 2483662 - RNA, 23 nt, Brucella suis 1330
gccacuucgcgggcaauggccgc

SEQ ID NO: 2483663 - RNA, 14 nt, Brucella suis 1330
gccagaaaaaccgu

SEQ ID NO: 2483664 - RNA, 12 nt, Brucella suis 1330
gccagaaaaugc

SEQ ID NO: 2483665 - RNA, 15 nt, Brucella suis 1330
gccagaaaaugcagc

SEQ ID NO: 2483666 - RNA, 18 nt, Brucella suis 1330
gccagaaccaccagagca

SEQ ID NO: 2483667 - RNA, 16 nt, Brucella suis 1330
gccagaaccgcaucga

SEQ ID NO: 2483668 - RNA, 22 nt, Brucella suis 1330
gccagaagguuucagccuccug

SEQ ID NO: 2483669 - RNA, 16 nt, Brucella suis 1330
gccagaaucugcgcgu

SEQ ID NO: 2483670 - RNA, 15 nt, Brucella suis 1330
gccagagacaucaga

SEQ ID NO: 2483671 - RNA, 19 nt, Brucella suis 1330
gccagagcauuuucgccgc

SEQ ID NO: 2483672 - RNA, 22 nt, Brucella suis 1330
gccagagcauuuucgccgcagc

SEQ ID NO: 2483673 - RNA, 22 nt, Brucella suis 1330
gccagagcggcauauugcggcg

SEQ ID NO: 2483674 - RNA, 17 nt, Brucella suis 1330
gccagauaaagcaggau

SEQ ID NO: 2483675 - RNA, 14 nt, Brucella suis 1330
gccagauaaccugc

SEQ ID NO: 2483676 - RNA, 21 nt, Brucella suis 1330
gccagaucaugggcggccacg

SEQ ID NO: 2483677 - RNA, 23 nt, Brucella suis 1330
gccagaucccguuuugagaugac

SEQ ID NO: 2483678 - RNA, 21 nt, Brucella suis 1330
gccagauccgcugacugcgcc

SEQ ID NO: 2483679 - RNA, 23 nt, Brucella suis 1330
gccagauccgcugacugcgccau

SEQ ID NO: 2483680 - RNA, 17 nt, Brucella suis 1330
gccagaucgauggugcg

SEQ ID NO: 2483681 - RNA, 14 nt, Brucella suis 1330
gccagaucgcgcgc

SEQ ID NO: 2483682 - RNA, 18 nt, Brucella suis 1330
gccagaucgcgcgcggcc

SEQ ID NO: 2483683 - RNA, 21 nt, Brucella suis 1330
gccagaugugccaccagcaca

SEQ ID NO: 2483684 - RNA, 22 nt, Brucella suis 1330
gccagcaauugcugggcuuccu

SEQ ID NO: 2483685 - RNA, 21 nt, Brucella suis 1330
gccagcaccagcggcacgccg

SEQ ID NO: 2483686 - RNA, 21 nt, Brucella suis 1330
gccagcagaaccgcuuuccau

SEQ ID NO: 2483687 - RNA, 15 nt, Brucella suis 1330
gccagcaggccggcg

SEQ ID NO: 2483688 - RNA, 16 nt, Brucella suis 1330
gccagcaggccggcga

SEQ ID NO: 2483689 - RNA, 14 nt, Brucella suis 1330
gccagccagcgcau

SEQ ID NO: 2483690 - RNA, 21 nt, Brucella suis 1330
gccagccauuucagcggcgau

SEQ ID NO: 2483691 - RNA, 12 nt, Brucella suis 1330
gccagcccgcuu

SEQ ID NO: 2483692 - RNA, 21 nt, Brucella suis 1330
gccagccgcaaucagccagaa

SEQ ID NO: 2483693 - RNA, 21 nt, Brucella suis 1330
gccagccgcgaucacagccgc

SEQ ID NO: 2483694 - RNA, 14 nt, Brucella suis 1330
gccagcgauugcgc

SEQ ID NO: 2483695 - RNA, 16 nt, Brucella suis 1330
gccagcgcaaagcgcg

SEQ ID NO: 2483696 - RNA, 19 nt, Brucella suis 1330
gccagcgcaaagcgcgcgc

SEQ ID NO: 2483697 - RNA, 20 nt, Brucella suis 1330
gccagcggcagaccugcgca

SEQ ID NO: 2483698 - RNA, 21 nt, Brucella suis 1330
gccagcggcagaccugcgcaa

SEQ ID NO: 2483699 - RNA, 22 nt, Brucella suis 1330
gccagcggugacgaucuggaac

SEQ ID NO: 2483700 - RNA, 17 nt, Brucella suis 1330
gccagcggugcccuuuc

SEQ ID NO: 2483701 - RNA, 16 nt, Brucella suis 1330
gccagcgucggcgguc

SEQ ID NO: 2483702 - RNA, 17 nt, Brucella suis 1330
gccagcuugaaaagccg

SEQ ID NO: 2483703 - RNA, 14 nt, Brucella suis 1330
gccaggacaacggg

SEQ ID NO: 2483704 - RNA, 19 nt, Brucella suis 1330
gccaggcaaaugcuccuuc

SEQ ID NO: 2483705 - RNA, 17 nt, Brucella suis 1330
gccaggccgauugccga

SEQ ID NO: 2483706 - RNA, 19 nt, Brucella suis 1330
gccagguggcugcccgccg

SEQ ID NO: 2483707 - RNA, 21 nt, Brucella suis 1330
gccagucauugacggcagccu

SEQ ID NO: 2483708 - RNA, 20 nt, Brucella suis 1330
gccagugcauuggaaacgcc

SEQ ID NO: 2483709 - RNA, 15 nt, Brucella suis 1330
gccagugcgccaccg

SEQ ID NO: 2483710 - RNA, 18 nt, Brucella suis 1330
gccagugcgccaccgcga

SEQ ID NO: 2483711 - RNA, 23 nt, Brucella suis 1330
gccagugcgccaccgcgaaagcc

SEQ ID NO: 2483712 - RNA, 20 nt, Brucella suis 1330
gccagugucgaccggcggca

SEQ ID NO: 2483713 - RNA, 13 nt, Brucella suis 1330
gccaguuucauuu

SEQ ID NO: 2483714 - RNA, 16 nt, Brucella suis 1330
gccauaaagcaccaug

SEQ ID NO: 2483715 - RNA, 16 nt, Brucella suis 1330
gccauaaaucgacggg

SEQ ID NO: 2483716 - RNA, 22 nt, Brucella suis 1330
gccauaagccggcaugaaugug

SEQ ID NO: 2483717 - RNA, 14 nt, Brucella suis 1330
gccauacacgcggc

SEQ ID NO: 2483718 - RNA, 15 nt, Brucella suis 1330
gccauagacgcgcag

SEQ ID NO: 2483719 - RNA, 17 nt, Brucella suis 1330
gccauagacgcgcagac

SEQ ID NO: 2483720 - RNA, 23 nt, Brucella suis 1330
gccauagcgcagaaugagcuugc

SEQ ID NO: 2483721 - RNA, 13 nt, Brucella suis 1330
gccauauccgcca

SEQ ID NO: 2483722 - RNA, 18 nt, Brucella suis 1330
gccauauugggagcgcag

SEQ ID NO: 2483723 - RNA, 19 nt, Brucella suis 1330
gccauauugggagcgcagu

SEQ ID NO: 2483724 - RNA, 20 nt, Brucella suis 1330
gccauauuuuguuaucaagc

SEQ ID NO: 2483725 - RNA, 17 nt, Brucella suis 1330
gccaucaagcgucaugc

SEQ ID NO: 2483726 - RNA, 16 nt, Brucella suis 1330
gccauccacaaaaacc

SEQ ID NO: 2483727 - RNA, 13 nt, Brucella suis 1330
gccauccgccccg

SEQ ID NO: 2483728 - RNA, 17 nt, Brucella suis 1330
gccaucggcaaaggcuc

SEQ ID NO: 2483729 - RNA, 16 nt, Brucella suis 1330
gccaucggcacggcgu

SEQ ID NO: 2483730 - RNA, 13 nt, Brucella suis 1330
gccaucuuccuca

SEQ ID NO: 2483731 - RNA, 20 nt, Brucella suis 1330
gccaucuuccucacccuuca

SEQ ID NO: 2483732 - RNA, 21 nt, Brucella suis 1330
gccaucuuucuugaagucauc

SEQ ID NO: 2483733 - RNA, 16 nt, Brucella suis 1330
gccaugaaacccgcga

SEQ ID NO: 2483734 - RNA, 22 nt, Brucella suis 1330
gccaugaaagaacggcccgcau

SEQ ID NO: 2483735 - RNA, 21 nt, Brucella suis 1330
gccaugaugccgacaagcagc

SEQ ID NO: 2483736 - RNA, 18 nt, Brucella suis 1330
gccaugccauccucgcca

SEQ ID NO: 2483737 - RNA, 14 nt, Brucella suis 1330
gccaugcccaugca

SEQ ID NO: 2483738 - RNA, 20 nt, Brucella suis 1330
gccaugccuucccgccagcc

SEQ ID NO: 2483739 - RNA, 16 nt, Brucella suis 1330
gccaugcggccagccu

SEQ ID NO: 2483740 - RNA, 18 nt, Brucella suis 1330
gccauggccgaaaauauc

SEQ ID NO: 2483741 - RNA, 13 nt, Brucella suis 1330
gccauguuggggu

SEQ ID NO: 2483742 - RNA, 17 nt, Brucella suis 1330
gccauuauucucccaga

SEQ ID NO: 2483743 - RNA, 22 nt, Brucella suis 1330
gccauucacuugcgauuugaca

SEQ ID NO: 2483744 - RNA, 16 nt, Brucella suis 1330
gccauucuccgcagcc

SEQ ID NO: 2483745 - RNA, 16 nt, Brucella suis 1330
gccauugaccgccucg

SEQ ID NO: 2483746 - RNA, 18 nt, Brucella suis 1330
gccauugcccaaaagcgc

SEQ ID NO: 2483747 - RNA, 12 nt, Brucella suis 1330
gccauugccgcg

SEQ ID NO: 2483748 - RNA, 14 nt, Brucella suis 1330
gccauuuccaaugc

SEQ ID NO: 2483749 - RNA, 18 nt, Brucella suis 1330
gccauuucggaucggcgc

SEQ ID NO: 2483750 - RNA, 11 nt, Brucella suis 1330
gccauuuucau

SEQ ID NO: 2483751 - RNA, 17 nt, Brucella suis 1330
gcccaaaagcgcgccga

SEQ ID NO: 2483752 - RNA, 18 nt, Brucella suis 1330
gcccaaaggccgcgccga

SEQ ID NO: 2483753 - RNA, 22 nt, Brucella suis 1330
gcccaagacaagaugagcaggc

SEQ ID NO: 2483754 - RNA, 20 nt, Brucella suis 1330
gcccacauagggccuuuccg

SEQ ID NO: 2483755 - RNA, 23 nt, Brucella suis 1330
gcccacauagggccuuuccggcg

SEQ ID NO: 2483756 - RNA, 17 nt, Brucella suis 1330
gcccacccaccgccugc

SEQ ID NO: 2483757 - RNA, 18 nt, Brucella suis 1330
gcccacccaccgccugca

SEQ ID NO: 2483758 - RNA, 20 nt, Brucella suis 1330
gcccacccaccgccugcagc

SEQ ID NO: 2483759 - RNA, 15 nt, Brucella suis 1330
gcccaccgaagccac

SEQ ID NO: 2483760 - RNA, 15 nt, Brucella suis 1330
gccgaccagaacgau

SEQ ID NO: 2483761 - RNA, 14 nt, Brucella suis 1330
gccgacgcgcguga

SEQ ID NO: 2483762 - RNA, 22 nt, Brucella suis 1330
gccgagaaugaccacgccgagg

SEQ ID NO: 2483763 - RNA, 17 nt, Brucella suis 1330
gccgagaucacccagaa

SEQ ID NO: 2483764 - RNA, 18 nt, Brucella suis 1330
gccgagauugggcagcag

SEQ ID NO: 2483765 - RNA, 22 nt, Brucella suis 1330
gccgagcauggccugcgcaccg

SEQ ID NO: 2483766 - RNA, 20 nt, Brucella suis 1330
gccgagcgaacgcuccugca

SEQ ID NO: 2483767 - RNA, 17 nt, Brucella suis 1330
gccgagcgccgccgcga

SEQ ID NO: 2483768 - RNA, 16 nt, Brucella suis 1330
gccgagcuugcggcgg

SEQ ID NO: 2483769 - RNA, 20 nt, Brucella suis 1330
gccgaggaauuucagcgaag

SEQ ID NO: 2483770 - RNA, 19 nt, Brucella suis 1330
gccgaggaggggacgcagc

SEQ ID NO: 2483771 - RNA, 14 nt, Brucella suis 1330
gccgauauccucga

SEQ ID NO: 2483772 - RNA, 15 nt, Brucella suis 1330
gccgauaugccgacg

SEQ ID NO: 2483773 - RNA, 18 nt, Brucella suis 1330
gccgauaugccgacgcgc

SEQ ID NO: 2483774 - RNA, 21 nt, Brucella suis 1330
gccgauauucgaugaucugcg

SEQ ID NO: 2483775 - RNA, 20 nt, Brucella suis 1330
gccgaucagcaucgcccccu

SEQ ID NO: 2483776 - RNA, 17 nt, Brucella suis 1330
gccgaucaucgccugaa

SEQ ID NO: 2483777 - RNA, 13 nt, Brucella suis 1330
gccgauccugcgc

SEQ ID NO: 2483778 - RNA, 19 nt, Brucella suis 1330
gccgaugacggcgcggcgc

SEQ ID NO: 2483779 - RNA, 16 nt, Brucella suis 1330
gccgaugauauugccc

SEQ ID NO: 2483780 - RNA, 14 nt, Brucella suis 1330
gccgaugauuucau

SEQ ID NO: 2483781 - RNA, 21 nt, Brucella suis 1330
gccgaugggccggucuucccg

SEQ ID NO: 2483782 - RNA, 22 nt, Brucella suis 1330
gccgaugggccggucuucccgc

SEQ ID NO: 2483783 - RNA, 16 nt, Brucella suis 1330
gccgcaaagcgaacgc

SEQ ID NO: 2483784 - RNA, 15 nt, Brucella suis 1330
gccgcaaaggcaggc

SEQ ID NO: 2483785 - RNA, 23 nt, Brucella suis 1330
gccgcaagcgugagaccagcgca

SEQ ID NO: 2483786 - RNA, 19 nt, Brucella suis 1330
gccgcaagcuggaaccagc

SEQ ID NO: 2483787 - RNA, 23 nt, Brucella suis 1330
gccgcaagcuggaaccagcgugc

SEQ ID NO: 2483788 - RNA, 14 nt, Brucella suis 1330
gccgcaauugccgc

SEQ ID NO: 2483789 - RNA, 23 nt, Brucella suis 1330
gccgcagcccggacaggcggcga

SEQ ID NO: 2483790 - RNA, 14 nt, Brucella suis 1330
gccgcagccgccau

SEQ ID NO: 2483791 - RNA, 11 nt, Brucella suis 1330
gccgcaggcac

SEQ ID NO: 2483792 - RNA, 20 nt, Brucella suis 1330
gccgcauaaagcacagccag

SEQ ID NO: 2483793 - RNA, 19 nt, Brucella suis 1330
gccgcaucggaagggcaag

SEQ ID NO: 2483794 - RNA, 23 nt, Brucella suis 1330
gccgcaugaacaugcgccacuuc

SEQ ID NO: 2483795 - RNA, 19 nt, Brucella suis 1330
gccgcaugauaggcaacau

SEQ ID NO: 2483796 - RNA, 23 nt, Brucella suis 1330
gccgcauggcggcacccgcaacc

SEQ ID NO: 2483797 - RNA, 17 nt, Brucella suis 1330
gccgccaagccagcccg

SEQ ID NO: 2483798 - RNA, 14 nt, Brucella suis 1330
gccgccacccaugu

SEQ ID NO: 2483799 - RNA, 12 nt, Brucella suis 1330
gccgccagaaaa

SEQ ID NO: 2483800 - RNA, 16 nt, Brucella suis 1330
gccgccagcauggcgu

SEQ ID NO: 2483801 - RNA, 15 nt, Brucella suis 1330
gccgccaggcaaaug

SEQ ID NO: 2483802 - RNA, 12 nt, Brucella suis 1330
gccgccauggcc

SEQ ID NO: 2483803 - RNA, 20 nt, Brucella suis 1330
gccgccauggucgcgcacca

SEQ ID NO: 2483804 - RNA, 15 nt, Brucella suis 1330
gccgcccgacagaau

SEQ ID NO: 2483805 - RNA, 16 nt, Brucella suis 1330
gccgcccgacagaaug

SEQ ID NO: 2483806 - RNA, 15 nt, Brucella suis 1330
gccgcccuugcgcac

SEQ ID NO: 2483807 - RNA, 11 nt, Brucella suis 1330
gccgccgcaga

SEQ ID NO: 2483808 - RNA, 16 nt, Brucella suis 1330
gccgccucugucaccu

SEQ ID NO: 2483809 - RNA, 17 nt, Brucella suis 1330
gccgccugccuucuuca

SEQ ID NO: 2483810 - RNA, 18 nt, Brucella suis 1330
gccgccuucaaaacgcag

SEQ ID NO: 2483811 - RNA, 19 nt, Brucella suis 1330
gccgccuucaaaacgcagc

SEQ ID NO: 2483812 - RNA, 19 nt, Brucella suis 1330
gccgcgaaaaccggcuggc

SEQ ID NO: 2483813 - RNA, 22 nt, Brucella suis 1330
gccgcgaucacggccauugccc

SEQ ID NO: 2483814 - RNA, 19 nt, Brucella suis 1330
gccgcgauugcaucggcag

SEQ ID NO: 2483815 - RNA, 17 nt, Brucella suis 1330
gccgcgcaaguuccgca

SEQ ID NO: 2483816 - RNA, 18 nt, Brucella suis 1330
gccgcgcaaguuccgcau

SEQ ID NO: 2483817 - RNA, 13 nt, Brucella suis 1330
gccgcgcacuggc

SEQ ID NO: 2483818 - RNA, 15 nt, Brucella suis 1330
gccgcgccaauccag

SEQ ID NO: 2483819 - RNA, 13 nt, Brucella suis 1330
gccgcgcccacca

SEQ ID NO: 2483820 - RNA, 13 nt, Brucella suis 1330
gccgcgcgcggcu

SEQ ID NO: 2483821 - RNA, 19 nt, Brucella suis 1330
gccgcgcgcggcuuccagc

SEQ ID NO: 2483822 - RNA, 22 nt, Brucella suis 1330
gccgcgcgcggcuuccagcgcc

SEQ ID NO: 2483823 - RNA, 23 nt, Brucella suis 1330
gccgcgcgcggcuuccagcgccu

SEQ ID NO: 2483824 - RNA, 14 nt, Brucella suis 1330
gccgcgcggcagcg

SEQ ID NO: 2483825 - RNA, 12 nt, Brucella suis 1330
gccgcgcgggcu

SEQ ID NO: 2483826 - RNA, 16 nt, Brucella suis 1330
gccgcggcgcgaccug

SEQ ID NO: 2483827 - RNA, 20 nt, Brucella suis 1330
gccgcgugaaaagcacacgg

SEQ ID NO: 2483828 - RNA, 15 nt, Brucella suis 1330
gccgcgugggcgcga

SEQ ID NO: 2483829 - RNA, 13 nt, Brucella suis 1330
gccgcuauuugag

SEQ ID NO: 2483830 - RNA, 17 nt, Brucella suis 1330
gccgcucaugcgguaga

SEQ ID NO: 2483831 - RNA, 13 nt, Brucella suis 1330
gccgcugccugca

SEQ ID NO: 2483832 - RNA, 12 nt, Brucella suis 1330
gccgcugcgcag

SEQ ID NO: 2483833 - RNA, 17 nt, Brucella suis 1330
gccgcuucugcucacca

SEQ ID NO: 2483834 - RNA, 15 nt, Brucella suis 1330
gccgcuuugcggagg

SEQ ID NO: 2483835 - RNA, 23 nt, Brucella suis 1330
gccgcuuugcggaggcggcugcc

SEQ ID NO: 2483836 - RNA, 22 nt, Brucella suis 1330
gccggaaacaccgccuguccgg

SEQ ID NO: 2483837 - RNA, 12 nt, Brucella suis 1330
gccggaaacacg

SEQ ID NO: 2483838 - RNA, 18 nt, Brucella suis 1330
gccggaaacacggauaga

SEQ ID NO: 2483839 - RNA, 21 nt, Brucella suis 1330
gccggaaagguguccuccagc

SEQ ID NO: 2483840 - RNA, 18 nt, Brucella suis 1330
gccggaauaucauccagu

SEQ ID NO: 2483841 - RNA, 12 nt, Brucella suis 1330
gccggaccgugc

SEQ ID NO: 2483842 - RNA, 20 nt, Brucella suis 1330
gccggacgugacaucaagcc

SEQ ID NO: 2483843 - RNA, 22 nt, Brucella suis 1330
gccggauagggcguaaucagcg

SEQ ID NO: 2483844 - RNA, 13 nt, Brucella suis 1330
gccggcaggcugu

SEQ ID NO: 2483845 - RNA, 19 nt, Brucella suis 1330
gccggcaugaaugugccug

SEQ ID NO: 2483846 - RNA, 22 nt, Brucella suis 1330
gccggccuuugcgcgccuguuu

SEQ ID NO: 2483847 - RNA, 21 nt, Brucella suis 1330
gccggcgagggcgggcauggg

SEQ ID NO: 2483848 - RNA, 15 nt, Brucella suis 1330
gccggcgaucuuuuc

SEQ ID NO: 2483849 - RNA, 13 nt, Brucella suis 1330
gccggcgcagcgc

SEQ ID NO: 2483850 - RNA, 12 nt, Brucella suis 1330
gccggcgccgcc

SEQ ID NO: 2483851 - RNA, 17 nt, Brucella suis 1330
gccggcgccuuguucuu

SEQ ID NO: 2483852 - RNA, 18 nt, Brucella suis 1330
gccggcgccuuguucuuu

SEQ ID NO: 2483853 - RNA, 21 nt, Brucella suis 1330
gccggcucauggucacgcgcc

SEQ ID NO: 2483854 - RNA, 23 nt, Brucella suis 1330
gccggcuuccacgcgcuugcgau

SEQ ID NO: 2483855 - RNA, 16 nt, Brucella suis 1330
gccgggauuuucggcc

SEQ ID NO: 2483856 - RNA, 20 nt, Brucella suis 1330
gccgggcacgaaaagcagga

SEQ ID NO: 2483857 - RNA, 17 nt, Brucella suis 1330
gccgggcaucgcucgaa

SEQ ID NO: 2483858 - RNA, 16 nt, Brucella suis 1330
gccgggccaacgccgg

SEQ ID NO: 2483859 - RNA, 13 nt, Brucella suis 1330
gccgggcgcgcgc

SEQ ID NO: 2483860 - RNA, 15 nt, Brucella suis 1330
gccgggcgggcagca

SEQ ID NO: 2483861 - RNA, 14 nt, Brucella suis 1330
gccgggcuuuccug

SEQ ID NO: 2483862 - RNA, 20 nt, Brucella suis 1330
gccggggaagggucacuucc

SEQ ID NO: 2483863 - RNA, 13 nt, Brucella suis 1330
gccggggccggau

SEQ ID NO: 2483864 - RNA, 15 nt, Brucella suis 1330
gccggggccggaugc

SEQ ID NO: 2483865 - RNA, 21 nt, Brucella suis 1330
gccggggggaauggcgcgcgc

SEQ ID NO: 2483866 - RNA, 23 nt, Brucella suis 1330
gccgggucuucauagaccccgcc

SEQ ID NO: 2483867 - RNA, 15 nt, Brucella suis 1330
gccgguauccagcag

SEQ ID NO: 2483868 - RNA, 23 nt, Brucella suis 1330
gccggucaaaacgccccggcaug

SEQ ID NO: 2483869 - RNA, 12 nt, Brucella suis 1330
gccgguccagau

SEQ ID NO: 2483870 - RNA, 17 nt, Brucella suis 1330
gccgguuucgacuucgu

SEQ ID NO: 2483871 - RNA, 17 nt, Brucella suis 1330
gccguaucacgccgcga

SEQ ID NO: 2483872 - RNA, 14 nt, Brucella suis 1330
gccgucaaaggaaa

SEQ ID NO: 2483873 - RNA, 16 nt, Brucella suis 1330
gccgucgaagcgcugc

SEQ ID NO: 2483874 - RNA, 14 nt, Brucella suis 1330
gccgucgagcagca

SEQ ID NO: 2483875 - RNA, 18 nt, Brucella suis 1330
gccgucgggaccaccggc

SEQ ID NO: 2483876 - RNA, 19 nt, Brucella suis 1330
gccgucgggaccaccggcc

SEQ ID NO: 2483877 - RNA, 21 nt, Brucella suis 1330
gcgaaauaaucguaucgccaa

SEQ ID NO: 2483878 - RNA, 13 nt, Brucella suis 1330
gcgaaaucgccac

SEQ ID NO: 2483879 - RNA, 17 nt, Brucella suis 1330
gcgaaaucgccacgauc

SEQ ID NO: 2483880 - RNA, 16 nt, Brucella suis 1330
gcgaaaugcgcgcggc

SEQ ID NO: 2483881 - RNA, 17 nt, Brucella suis 1330
gcgaaaugcgcgcggca

SEQ ID NO: 2483882 - RNA, 20 nt, Brucella suis 1330
gcgaacaugccugccgcagc

SEQ ID NO: 2483883 - RNA, 19 nt, Brucella suis 1330
gcgaacgauugggcgauga

SEQ ID NO: 2483884 - RNA, 21 nt, Brucella suis 1330
gcgaagaacagaagcaccagc

SEQ ID NO: 2483885 - RNA, 23 nt, Brucella suis 1330
gcgaagcgaugacggagcguccg

SEQ ID NO: 2483886 - RNA, 14 nt, Brucella suis 1330
gcgaagcgguuuuc

SEQ ID NO: 2483887 - RNA, 20 nt, Brucella suis 1330
gcgaagcucaucggguucug

SEQ ID NO: 2483888 - RNA, 13 nt, Brucella suis 1330
gcgaaggcccuuc

SEQ ID NO: 2483889 - RNA, 18 nt, Brucella suis 1330
gcgaauagaccaugccgc

SEQ ID NO: 2483890 - RNA, 24 nt, Brucella suis 1330
gcgaauagaccaugccgccagccg

SEQ ID NO: 2483891 - RNA, 14 nt, Brucella suis 1330
gcgaauuccacgau

SEQ ID NO: 2483892 - RNA, 16 nt, Brucella suis 1330
gcgaauuucaucgccc

SEQ ID NO: 2483893 - RNA, 16 nt, Brucella suis 1330
gcgacaaaacaaaugg

SEQ ID NO: 2483894 - RNA, 15 nt, Brucella suis 1330
gcgacacggccgauc

SEQ ID NO: 2483895 - RNA, 20 nt, Brucella suis 1330
gcgacacggccgaucgccag

SEQ ID NO: 2483896 - RNA, 13 nt, Brucella suis 1330
gcgacagcggcgc

SEQ ID NO: 2483897 - RNA, 17 nt, Brucella suis 1330
gcgacaggguaagcgcc

SEQ ID NO: 2483898 - RNA, 15 nt, Brucella suis 1330
gcgacauagccgauc

SEQ ID NO: 2483899 - RNA, 16 nt, Brucella suis 1330
gcgacauagccgaucu

SEQ ID NO: 2483900 - RNA, 16 nt, Brucella suis 1330
gcgacauugaggcugu

SEQ ID NO: 2483901 - RNA, 20 nt, Brucella suis 1330
gcgaccaccauggaggcgcu

SEQ ID NO: 2483902 - RNA, 13 nt, Brucella suis 1330
gcgacccgcgccc

SEQ ID NO: 2483903 - RNA, 14 nt, Brucella suis 1330
gcgacgagaccugc

SEQ ID NO: 2483904 - RNA, 16 nt, Brucella suis 1330
gcgacgagaugcgcuu

SEQ ID NO: 2483905 - RNA, 20 nt, Brucella suis 1330
gcgacgagaugcgcuuuccg

SEQ ID NO: 2483906 - RNA, 15 nt, Brucella suis 1330
gcgacgaggccugaa

SEQ ID NO: 2483907 - RNA, 16 nt, Brucella suis 1330
gcgacgauaucgccug

SEQ ID NO: 2483908 - RNA, 21 nt, Brucella suis 1330
gcgacgauaucgccugcuucc

SEQ ID NO: 2483909 - RNA, 23 nt, Brucella suis 1330
gcgacgauaucgccugcuuccuu

SEQ ID NO: 2483910 - RNA, 20 nt, Brucella suis 1330
gcgacgaucaggaauacgcc

SEQ ID NO: 2483911 - RNA, 13 nt, Brucella suis 1330
gcgacgcgcucgu

SEQ ID NO: 2483912 - RNA, 19 nt, Brucella suis 1330
gcgacggaaacgagcgcgc

SEQ ID NO: 2483913 - RNA, 19 nt, Brucella suis 1330
gcgacugucaccgccagca

SEQ ID NO: 2483914 - RNA, 22 nt, Brucella suis 1330
gcgacugucaccgccagcagaa

SEQ ID NO: 2483915 - RNA, 17 nt, Brucella suis 1330
gcgacuucgggucggug

SEQ ID NO: 2483916 - RNA, 18 nt, Brucella suis 1330
gcgagaacuucccgcccg

SEQ ID NO: 2483917 - RNA, 17 nt, Brucella suis 1330
gcgagccgagcggcgca

SEQ ID NO: 2483918 - RNA, 21 nt, Brucella suis 1330
gcgagcguuuccggccuggcg

SEQ ID NO: 2483919 - RNA, 23 nt, Brucella suis 1330
gcgagcuugcaaugagcgcgcuu

SEQ ID NO: 2483920 - RNA, 14 nt, Brucella suis 1330
gcgaggaagccugc

SEQ ID NO: 2483921 - RNA, 15 nt, Brucella suis 1330
gcgaggaagccugca

SEQ ID NO: 2483922 - RNA, 22 nt, Brucella suis 1330
gcgaggggaugggggccgggcg

SEQ ID NO: 2483923 - RNA, 17 nt, Brucella suis 1330
gcgaggucucccggcac

SEQ ID NO: 2483924 - RNA, 14 nt, Brucella suis 1330
gcgauagcuuucua

SEQ ID NO: 2483925 - RNA, 18 nt, Brucella suis 1330
gcgauaguguccacgcgc

SEQ ID NO: 2483926 - RNA, 21 nt, Brucella suis 1330
gcgaucaacgcuuugaccgcc

SEQ ID NO: 2483927 - RNA, 19 nt, Brucella suis 1330
gcgaucacggccauugccc

SEQ ID NO: 2483928 - RNA, 14 nt, Brucella suis 1330
gcgaucagcgcaag

SEQ ID NO: 2483929 - RNA, 22 nt, Brucella suis 1330
gcgaucagguugaugccgggca

SEQ ID NO: 2483930 - RNA, 12 nt, Brucella suis 1330
gcgaucaucgca

SEQ ID NO: 2483931 - RNA, 14 nt, Brucella suis 1330
gcgaucaugcccac

SEQ ID NO: 2483932 - RNA, 12 nt, Brucella suis 1330
gcgauccagcgc

SEQ ID NO: 2483933 - RNA, 20 nt, Brucella suis 1330
gcgaucuucugcucggcgag

SEQ ID NO: 2483934 - RNA, 12 nt, Brucella suis 1330
gcgaucuuuucg

SEQ ID NO: 2483935 - RNA, 22 nt, Brucella suis 1330
gcgaucuuuucgcuuguuacau

SEQ ID NO: 2483936 - RNA, 17 nt, Brucella suis 1330
gcgaugaagaccuggaa

SEQ ID NO: 2483937 - RNA, 17 nt, Brucella suis 1330
gcgaugagggccgugac

SEQ ID NO: 2483938 - RNA, 19 nt, Brucella suis 1330
gcgaugauagcgcccgccu

SEQ ID NO: 2483939 - RNA, 17 nt, Brucella suis 1330
gcgaugccugccaugcc

SEQ ID NO: 2483940 - RNA, 22 nt, Brucella suis 1330
gcgauggaccauauccaucugc

SEQ ID NO: 2483941 - RNA, 16 nt, Brucella suis 1330
gcgauggcgccgcaug

SEQ ID NO: 2483942 - RNA, 19 nt, Brucella suis 1330
gcgauuguaaaucugcgau

SEQ ID NO: 2483943 - RNA, 17 nt, Brucella suis 1330
gcgauuuccuugccgcu

SEQ ID NO: 2483944 - RNA, 19 nt, Brucella suis 1330
gcgauuucgccuucgccga

SEQ ID NO: 2483945 - RNA, 23 nt, Brucella suis 1330
gcgcaaaacgcuugacgaaacgc

SEQ ID NO: 2483946 - RNA, 17 nt, Brucella suis 1330
gcgcaaaaucugcucgu

SEQ ID NO: 2483947 - RNA, 20 nt, Brucella suis 1330
gcgcaaaaucugcucguccg

SEQ ID NO: 2483948 - RNA, 14 nt, Brucella suis 1330
gcgcaaacucgucg

SEQ ID NO: 2483949 - RNA, 17 nt, Brucella suis 1330
gcgcaaagcccagccgu

SEQ ID NO: 2483950 - RNA, 15 nt, Brucella suis 1330
gcgcaaagcccgccg

SEQ ID NO: 2483951 - RNA, 13 nt, Brucella suis 1330
gcgcaaagcgcgc

SEQ ID NO: 2483952 - RNA, 13 nt, Brucella suis 1330
gcgcaaaggccgg

SEQ ID NO: 2483953 - RNA, 19 nt, Brucella suis 1330
gcgcaacacgcgcuccagc

SEQ ID NO: 2483954 - RNA, 13 nt, Brucella suis 1330
gcgcaaggcccuc

SEQ ID NO: 2483955 - RNA, 16 nt, Brucella suis 1330
gcgcaaggucucgaca

SEQ ID NO: 2483956 - RNA, 21 nt, Brucella suis 1330
gcgcaauaaugcagcgccgcg

SEQ ID NO: 2483957 - RNA, 19 nt, Brucella suis 1330
gcgcaauaauuaugcagga

SEQ ID NO: 2483958 - RNA, 15 nt, Brucella suis 1330
gcgcaaugcccucuu

SEQ ID NO: 2483959 - RNA, 16 nt, Brucella suis 1330
gcgcaauggccuugcc

SEQ ID NO: 2483960 - RNA, 13 nt, Brucella suis 1330
gcgcaauggcugu

SEQ ID NO: 2483961 - RNA, 15 nt, Brucella suis 1330
gcgcaauucaugccc

SEQ ID NO: 2483962 - RNA, 18 nt, Brucella suis 1330
gcgcaauugcgcaaggcc

SEQ ID NO: 2483963 - RNA, 16 nt, Brucella suis 1330
gcgcaauugcgcgccu

SEQ ID NO: 2483964 - RNA, 23 nt, Brucella suis 1330
gcgcacaccgaacugggcggcca

SEQ ID NO: 2483965 - RNA, 20 nt, Brucella suis 1330
gcgcacauaaaacgcgccga

SEQ ID NO: 2483966 - RNA, 20 nt, Brucella suis 1330
gcgcacauauuugccauagc

SEQ ID NO: 2483967 - RNA, 23 nt, Brucella suis 1330
gcgcaccauucuugcgcccucca

SEQ ID NO: 2483968 - RNA, 16 nt, Brucella suis 1330
gcgcaccgcacgcaag

SEQ ID NO: 2483969 - RNA, 16 nt, Brucella suis 1330
gcgcaccgguauugcc

SEQ ID NO: 2483970 - RNA, 15 nt, Brucella suis 1330
gcgcaccugacggcg

SEQ ID NO: 2483971 - RNA, 22 nt, Brucella suis 1330
gcgcacgaccagaagcccgcgc

SEQ ID NO: 2483972 - RNA, 17 nt, Brucella suis 1330
gcgcacgccugccgcgc

SEQ ID NO: 2483973 - RNA, 14 nt, Brucella suis 1330
gcgcacguccggca

SEQ ID NO: 2483974 - RNA, 23 nt, Brucella suis 1330
gcgcagaagauugaugauaggcu

SEQ ID NO: 2483975 - RNA, 11 nt, Brucella suis 1330
gcgcagaaggc

SEQ ID NO: 2483976 - RNA, 16 nt, Brucella suis 1330
gcgcagaucaucguca

SEQ ID NO: 2483977 - RNA, 14 nt, Brucella suis 1330
gcgcagcaaagccc

SEQ ID NO: 2483978 - RNA, 14 nt, Brucella suis 1330
gcgcagcagcgcaa

SEQ ID NO: 2483979 - RNA, 17 nt, Brucella suis 1330
gcgcagccgcgucagcc

SEQ ID NO: 2483980 - RNA, 11 nt, Brucella suis 1330
gcgcagcgaca

SEQ ID NO: 2483981 - RNA, 17 nt, Brucella suis 1330
gcgcagcgacagcggcg

SEQ ID NO: 2483982 - RNA, 12 nt, Brucella suis 1330
gcgcagcgccgc

SEQ ID NO: 2483983 - RNA, 15 nt, Brucella suis 1330
gcgcagcgccgcaua

SEQ ID NO: 2483984 - RNA, 13 nt, Brucella suis 1330
gcgcagcggcagc

SEQ ID NO: 2483985 - RNA, 14 nt, Brucella suis 1330
gcgcaggccgcggc

SEQ ID NO: 2483986 - RNA, 17 nt, Brucella suis 1330
gcgcaggccgcggcauc

SEQ ID NO: 2483987 - RNA, 15 nt, Brucella suis 1330
gcgcaguuucgcagc

SEQ ID NO: 2483988 - RNA, 23 nt, Brucella suis 1330
gcgcaguuucgcagccaagaucg

SEQ ID NO: 2483989 - RNA, 15 nt, Brucella suis 1330
gcgcauaaaggccga

SEQ ID NO: 2483990 - RNA, 17 nt, Brucella suis 1330
gcgcauaucgcgcgacc

SEQ ID NO: 2483991 - RNA, 22 nt, Brucella suis 1330
gcgcaucauccugagcuugucg

SEQ ID NO: 2483992 - RNA, 15 nt, Brucella suis 1330
gcgcauccgccugcg

SEQ ID NO: 2483993 - RNA, 12 nt, Brucella suis 1330
gcgcaucgaaag

SEQ ID NO: 2483994 - RNA, 19 nt, Brucella suis 1330
gcggacgggguuucgccgg

SEQ ID NO: 2483995 - RNA, 15 nt, Brucella suis 1330
gcggagaugauggcg

SEQ ID NO: 2483996 - RNA, 19 nt, Brucella suis 1330
gcggagcaacaccccgcgc

SEQ ID NO: 2483997 - RNA, 23 nt, Brucella suis 1330
gcggagccucaucggcgggccag

SEQ ID NO: 2483998 - RNA, 15 nt, Brucella suis 1330
gcggagcguccggcg

SEQ ID NO: 2483999 - RNA, 20 nt, Brucella suis 1330
gcggagcguccggcgcgguc

SEQ ID NO: 2484000 - RNA, 17 nt, Brucella suis 1330
gcggauaaacgcuuccu

SEQ ID NO: 2484001 - RNA, 16 nt, Brucella suis 1330
gcggauacccaugcga

SEQ ID NO: 2484002 - RNA, 19 nt, Brucella suis 1330
gcggauaguucaaggcugc

SEQ ID NO: 2484003 - RNA, 20 nt, Brucella suis 1330
gcggauaguucaaggcugcu

SEQ ID NO: 2484004 - RNA, 14 nt, Brucella suis 1330
gcggaucagcgcgc

SEQ ID NO: 2484005 - RNA, 18 nt, Brucella suis 1330
gcggaucagcuugccgcc

SEQ ID NO: 2484006 - RNA, 22 nt, Brucella suis 1330
gcggaucagcuugccgccaauc

SEQ ID NO: 2484007 - RNA, 20 nt, Brucella suis 1330
gcggaucggcaggauagucu

SEQ ID NO: 2484008 - RNA, 23 nt, Brucella suis 1330
gcggaucggcuucaauccgaaau

SEQ ID NO: 2484009 - RNA, 14 nt, Brucella suis 1330
gcggaucgggcgca

SEQ ID NO: 2484010 - RNA, 16 nt, Brucella suis 1330
gcggaucgggcgcagc

SEQ ID NO: 2484011 - RNA, 20 nt, Brucella suis 1330
gcggaucguaucgccaaugc

SEQ ID NO: 2484012 - RNA, 14 nt, Brucella suis 1330
gcggaugaacccgc

SEQ ID NO: 2484013 - RNA, 16 nt, Brucella suis 1330
gcggaugauguugcga

SEQ ID NO: 2484014 - RNA, 14 nt, Brucella suis 1330
gcggaugcgcggcg

SEQ ID NO: 2484015 - RNA, 15 nt, Brucella suis 1330
gcggaugcgcggcgc

SEQ ID NO: 2484016 - RNA, 23 nt, Brucella suis 1330
gcggauuugaggauugccgccgc

SEQ ID NO: 2484017 - RNA, 14 nt, Brucella suis 1330
gcggcaaaggccgc

SEQ ID NO: 2484018 - RNA, 14 nt, Brucella suis 1330
gcggcaacggcgcu

SEQ ID NO: 2484019 - RNA, 21 nt, Brucella suis 1330
gcggcaagauaagcgccguug

SEQ ID NO: 2484020 - RNA, 22 nt, Brucella suis 1330
gcggcaagauagccccagcccg

SEQ ID NO: 2484021 - RNA, 16 nt, Brucella suis 1330
gcggcaagcgcgugga

SEQ ID NO: 2484022 - RNA, 16 nt, Brucella suis 1330
gcggcacgaugcgcag

SEQ ID NO: 2484023 - RNA, 14 nt, Brucella suis 1330
gcggcacgccgccc

SEQ ID NO: 2484024 - RNA, 15 nt, Brucella suis 1330
gcggcacgccgccca

SEQ ID NO: 2484025 - RNA, 19 nt, Brucella suis 1330
gcggcagauaaagcgcaag

SEQ ID NO: 2484026 - RNA, 17 nt, Brucella suis 1330
gcggcagcggaccgcaa

SEQ ID NO: 2484027 - RNA, 14 nt, Brucella suis 1330
gcggcagcggcauc

SEQ ID NO: 2484028 - RNA, 17 nt, Brucella suis 1330
gcggcaggccgcaaagc

SEQ ID NO: 2484029 - RNA, 19 nt, Brucella suis 1330
gcggcaggugccaucaagc

SEQ ID NO: 2484030 - RNA, 22 nt, Brucella suis 1330
gcggcaguuucaccauggccgc

SEQ ID NO: 2484031 - RNA, 17 nt, Brucella suis 1330
gcggcauauugcggcgg

SEQ ID NO: 2484032 - RNA, 18 nt, Brucella suis 1330
gcggcauauugcggcgga

SEQ ID NO: 2484033 - RNA, 16 nt, Brucella suis 1330
gcggcaugaaagcgca

SEQ ID NO: 2484034 - RNA, 20 nt, Brucella suis 1330
gcggcauggcguagaaauag

SEQ ID NO: 2484035 - RNA, 17 nt, Brucella suis 1330
gcggcaugggccgcacg

SEQ ID NO: 2484036 - RNA, 16 nt, Brucella suis 1330
gcggccaacgccacga

SEQ ID NO: 2484037 - RNA, 14 nt, Brucella suis 1330
gcggccaagcgcau

SEQ ID NO: 2484038 - RNA, 15 nt, Brucella suis 1330
gcggccaagcgccag

SEQ ID NO: 2484039 - RNA, 17 nt, Brucella suis 1330
gcggccacggcauccgc

SEQ ID NO: 2484040 - RNA, 13 nt, Brucella suis 1330
gcggccagccagc

SEQ ID NO: 2484041 - RNA, 18 nt, Brucella suis 1330
gcggcccgauuccuccgg

SEQ ID NO: 2484042 - RNA, 15 nt, Brucella suis 1330
gcggccugaccggcc

SEQ ID NO: 2484043 - RNA, 16 nt, Brucella suis 1330
gcggcgaacgagcggc

SEQ ID NO: 2484044 - RNA, 15 nt, Brucella suis 1330
gcggcgcauggccuc

SEQ ID NO: 2484045 - RNA, 19 nt, Brucella suis 1330
gcggcgcauucggccgccu

SEQ ID NO: 2484046 - RNA, 14 nt, Brucella suis 1330
gcggcgccaaccau

SEQ ID NO: 2484047 - RNA, 13 nt, Brucella suis 1330
gcggcgccagcgc

SEQ ID NO: 2484048 - RNA, 16 nt, Brucella suis 1330
gcggcgcgcaaguucg

SEQ ID NO: 2484049 - RNA, 13 nt, Brucella suis 1330
gcggcgcgccaaa

SEQ ID NO: 2484050 - RNA, 13 nt, Brucella suis 1330
gcggcgcggcggc

SEQ ID NO: 2484051 - RNA, 14 nt, Brucella suis 1330
gcggcggccgggcg

SEQ ID NO: 2484052 - RNA, 22 nt, Brucella suis 1330
gcggcggcgcgcaaguucgagc

SEQ ID NO: 2484053 - RNA, 19 nt, Brucella suis 1330
gcggcggcguuccagcuuc

SEQ ID NO: 2484054 - RNA, 17 nt, Brucella suis 1330
gcggcggguagccgcca

SEQ ID NO: 2484055 - RNA, 16 nt, Brucella suis 1330
gcggcgggugccgcgc

SEQ ID NO: 2484056 - RNA, 18 nt, Brucella suis 1330
gcggcgguucggcugccu

SEQ ID NO: 2484057 - RNA, 21 nt, Brucella suis 1330
gcggcgguucggcugccuugg

SEQ ID NO: 2484058 - RNA, 19 nt, Brucella suis 1330
gcggcgguuuugagcugcu

SEQ ID NO: 2484059 - RNA, 15 nt, Brucella suis 1330
gcggcgugccgggcg

SEQ ID NO: 2484060 - RNA, 16 nt, Brucella suis 1330
gcggcguuuuccauga

SEQ ID NO: 2484061 - RNA, 17 nt, Brucella suis 1330
gcggcugauaugcgcau

SEQ ID NO: 2484062 - RNA, 15 nt, Brucella suis 1330
gcggcuggaacgagc

SEQ ID NO: 2484063 - RNA, 23 nt, Brucella suis 1330
gcggcuggaacgagcuccccggc

SEQ ID NO: 2484064 - RNA, 13 nt, Brucella suis 1330
gcggcuggcuucu

SEQ ID NO: 2484065 - RNA, 18 nt, Brucella suis 1330
gcggcuucagaucgcgcg

SEQ ID NO: 2484066 - RNA, 20 nt, Brucella suis 1330
gcggcuucagaucgcgcggc

SEQ ID NO: 2484067 - RNA, 12 nt, Brucella suis 1330
gcggcuuccucg

SEQ ID NO: 2484068 - RNA, 23 nt, Brucella suis 1330
gcggcuucgaucguuucgccaug

SEQ ID NO: 2484069 - RNA, 16 nt, Brucella suis 1330
gcggcuuucgccgccc

SEQ ID NO: 2484070 - RNA, 23 nt, Brucella suis 1330
gcgggaauagcaacuuccuugcc

SEQ ID NO: 2484071 - RNA, 20 nt, Brucella suis 1330
gcgggagauguguaggcugg

SEQ ID NO: 2484072 - RNA, 20 nt, Brucella suis 1330
gcgggaugacgccgggcaug

SEQ ID NO: 2484073 - RNA, 11 nt, Brucella suis 1330
gcgggcaagca

SEQ ID NO: 2484074 - RNA, 23 nt, Brucella suis 1330
gcgggcaauggccgcaugaacau

SEQ ID NO: 2484075 - RNA, 21 nt, Brucella suis 1330
gcgggcagcacugaaacggga

SEQ ID NO: 2484076 - RNA, 22 nt, Brucella suis 1330
gcgggcaugaaaacgccgcggc

SEQ ID NO: 2484077 - RNA, 23 nt, Brucella suis 1330
gcgggcaugaaaacgccgcggcg

SEQ ID NO: 2484078 - RNA, 21 nt, Brucella suis 1330
gcgggcauugcggauacccau

SEQ ID NO: 2484079 - RNA, 19 nt, Brucella suis 1330
gcgggccaugguuucggcg

SEQ ID NO: 2484080 - RNA, 23 nt, Brucella suis 1330
gcgggcgaucaucaucaccggca

SEQ ID NO: 2484081 - RNA, 12 nt, Brucella suis 1330
gcgggcggcggc

SEQ ID NO: 2484082 - RNA, 13 nt, Brucella suis 1330
gcgggcggcggcu

SEQ ID NO: 2484083 - RNA, 14 nt, Brucella suis 1330
gcgggcggcggcuc

SEQ ID NO: 2484084 - RNA, 15 nt, Brucella suis 1330
gcgggcuucuuccag

SEQ ID NO: 2484085 - RNA, 14 nt, Brucella suis 1330
gcggggcgacgcug

SEQ ID NO: 2484086 - RNA, 13 nt, Brucella suis 1330
gcgggggcccaga

SEQ ID NO: 2484087 - RNA, 20 nt, Brucella suis 1330
gcgggguucguccucaauca

SEQ ID NO: 2484088 - RNA, 15 nt, Brucella suis 1330
gcggguagccgccau

SEQ ID NO: 2484089 - RNA, 23 nt, Brucella suis 1330
gcgguaauaacgacgcccgcccc

SEQ ID NO: 2484090 - RNA, 21 nt, Brucella suis 1330
gcggucgaaaccuuguugaca

SEQ ID NO: 2484091 - RNA, 13 nt, Brucella suis 1330
gcggucgccgccc

SEQ ID NO: 2484092 - RNA, 13 nt, Brucella suis 1330
gcggucggcggcg

SEQ ID NO: 2484093 - RNA, 15 nt, Brucella suis 1330
gcggucucgguucgc

SEQ ID NO: 2484094 - RNA, 15 nt, Brucella suis 1330
gcggugcugcaccgu

SEQ ID NO: 2484095 - RNA, 20 nt, Brucella suis 1330
gcgguuccgguuaaaacgga

SEQ ID NO: 2484096 - RNA, 18 nt, Brucella suis 1330
gcgguuccugauugaaga

SEQ ID NO: 2484097 - RNA, 14 nt, Brucella suis 1330
gcgguuuugagcug

SEQ ID NO: 2484098 - RNA, 21 nt, Brucella suis 1330
gcguaaucagcgucagcgcaa

SEQ ID NO: 2484099 - RNA, 18 nt, Brucella suis 1330
gcguacaacaucgccuga

SEQ ID NO: 2484100 - RNA, 17 nt, Brucella suis 1330
gcguaccauaggcgcgc

SEQ ID NO: 2484101 - RNA, 18 nt, Brucella suis 1330
gcguagaaauagggccag

SEQ ID NO: 2484102 - RNA, 16 nt, Brucella suis 1330
gcguagagugcuuccu

SEQ ID NO: 2484103 - RNA, 19 nt, Brucella suis 1330
gcguauuuucgagccaaaa

SEQ ID NO: 2484104 - RNA, 14 nt, Brucella suis 1330
gcgucaacaggcug

SEQ ID NO: 2484105 - RNA, 12 nt, Brucella suis 1330
gcgucacggcga

SEQ ID NO: 2484106 - RNA, 19 nt, Brucella suis 1330
gcgucacgucauaggcaau

SEQ ID NO: 2484107 - RNA, 17 nt, Brucella suis 1330
gcgucagcgcaaagccu

SEQ ID NO: 2484108 - RNA, 20 nt, Brucella suis 1330
gcgucagcuugucgagcggc

SEQ ID NO: 2484109 - RNA, 17 nt, Brucella suis 1330
gcgucagggcauugccg

SEQ ID NO: 2484110 - RNA, 21 nt, Brucella suis 1330
gcgucagggcgaggaaaaucg

SEQ ID NO: 2484111 - RNA, 13 nt, Brucella suis 1330
gcugaugagccgc

SEQ ID NO: 2484112 - RNA, 20 nt, Brucella suis 1330
gcugauucuggauuucaucc

SEQ ID NO: 2484113 - RNA, 21 nt, Brucella suis 1330
gcugauucuggauuucaucca

SEQ ID NO: 2484114 - RNA, 17 nt, Brucella suis 1330
gcugcaaagggugcaag

SEQ ID NO: 2484115 - RNA, 19 nt, Brucella suis 1330
gcugcaaagggugcaagcg

SEQ ID NO: 2484116 - RNA, 12 nt, Brucella suis 1330
gcugcaacaaaa

SEQ ID NO: 2484117 - RNA, 16 nt, Brucella suis 1330
gcugcaacaaaaugcc

SEQ ID NO: 2484118 - RNA, 18 nt, Brucella suis 1330
gcugcaacaaaaugccca

SEQ ID NO: 2484119 - RNA, 23 nt, Brucella suis 1330
gcugcauccugcucggcgcggcg

SEQ ID NO: 2484120 - RNA, 13 nt, Brucella suis 1330
gcugccagccgcg

SEQ ID NO: 2484121 - RNA, 13 nt, Brucella suis 1330
gcugccauugccg

SEQ ID NO: 2484122 - RNA, 18 nt, Brucella suis 1330
gcugccccauaugacgcg

SEQ ID NO: 2484123 - RNA, 15 nt, Brucella suis 1330
gcugcccgccgcaag

SEQ ID NO: 2484124 - RNA, 19 nt, Brucella suis 1330
gcugccgauggugacgguc

SEQ ID NO: 2484125 - RNA, 19 nt, Brucella suis 1330
gcugccgcacagcaucaug

SEQ ID NO: 2484126 - RNA, 14 nt, Brucella suis 1330
gcugccugcggugc

SEQ ID NO: 2484127 - RNA, 18 nt, Brucella suis 1330
gcugcgagaacacgccga

SEQ ID NO: 2484128 - RNA, 14 nt, Brucella suis 1330
gcugcgcgaugcgg

SEQ ID NO: 2484129 - RNA, 17 nt, Brucella suis 1330
gcugcggaucuucgauc

SEQ ID NO: 2484130 - RNA, 15 nt, Brucella suis 1330
gcugcggccaugcgc

SEQ ID NO: 2484131 - RNA, 21 nt, Brucella suis 1330
gcugcgguagcgcauggcagc

SEQ ID NO: 2484132 - RNA, 13 nt, Brucella suis 1330
gcugcgugcugcu

SEQ ID NO: 2484133 - RNA, 18 nt, Brucella suis 1330
gcugcgugggaaaccgcg

SEQ ID NO: 2484134 - RNA, 14 nt, Brucella suis 1330
gcugcucgcgcaag

SEQ ID NO: 2484135 - RNA, 14 nt, Brucella suis 1330
gcugcuggccgucg

SEQ ID NO: 2484136 - RNA, 20 nt, Brucella suis 1330
gcugcuguagcagcaacagg

SEQ ID NO: 2484137 - RNA, 22 nt, Brucella suis 1330
gcugcuuccacaggcgccagcc

SEQ ID NO: 2484138 - RNA, 13 nt, Brucella suis 1330
gcugcuuuaccac

SEQ ID NO: 2484139 - RNA, 15 nt, Brucella suis 1330
gcuggaaaugcucua

SEQ ID NO: 2484140 - RNA, 21 nt, Brucella suis 1330
gcuggaacaauuccagccggg

SEQ ID NO: 2484141 - RNA, 22 nt, Brucella suis 1330
gcuggaugaucuuugucggguc

SEQ ID NO: 2484142 - RNA, 14 nt, Brucella suis 1330
gcuggcacaaagcg

SEQ ID NO: 2484143 - RNA, 16 nt, Brucella suis 1330
gcuggcacaaagcggc

SEQ ID NO: 2484144 - RNA, 13 nt, Brucella suis 1330
gcuggcaucgcca

SEQ ID NO: 2484145 - RNA, 23 nt, Brucella suis 1330
gcuggcaucgccaauuccgccgg

SEQ ID NO: 2484146 - RNA, 21 nt, Brucella suis 1330
gcuggccaugcgggcacgcuc

SEQ ID NO: 2484147 - RNA, 13 nt, Brucella suis 1330
gcuggcgccgccg

SEQ ID NO: 2484148 - RNA, 14 nt, Brucella suis 1330
gcuggcgccgccgc

SEQ ID NO: 2484149 - RNA, 15 nt, Brucella suis 1330
gcuggcgccgccgcu

SEQ ID NO: 2484150 - RNA, 15 nt, Brucella suis 1330
gcuggcggccaagcg

SEQ ID NO: 2484151 - RNA, 22 nt, Brucella suis 1330
gcuggcuucucuugccgccgcu

SEQ ID NO: 2484152 - RNA, 14 nt, Brucella suis 1330
gcugguuggccaga

SEQ ID NO: 2484153 - RNA, 14 nt, Brucella suis 1330
gcugguuuaagccu

SEQ ID NO: 2484154 - RNA, 16 nt, Brucella suis 1330
gcuguaaccgccaccu

SEQ ID NO: 2484155 - RNA, 21 nt, Brucella suis 1330
gcuguaaccgccaccuucggg

SEQ ID NO: 2484156 - RNA, 16 nt, Brucella suis 1330
gcuguagcagcaacag

SEQ ID NO: 2484157 - RNA, 14 nt, Brucella suis 1330
gcugucgccagcgc

SEQ ID NO: 2484158 - RNA, 14 nt, Brucella suis 1330
gcugucgcccagaa

SEQ ID NO: 2484159 - RNA, 16 nt, Brucella suis 1330
gcugucguuccaauuc

SEQ ID NO: 2484160 - RNA, 15 nt, Brucella suis 1330
gcuguugcgcccgcc

SEQ ID NO: 2484161 - RNA, 16 nt, Brucella suis 1330
gcuuaguuguuuucuu

SEQ ID NO: 2484162 - RNA, 17 nt, Brucella suis 1330
gcuuaucaaggccgggc

SEQ ID NO: 2484163 - RNA, 13 nt, Brucella suis 1330
gcuucaacaugca

SEQ ID NO: 2484164 - RNA, 17 nt, Brucella suis 1330
gcuucacauccuucacu

SEQ ID NO: 2484165 - RNA, 20 nt, Brucella suis 1330
gcuucagccauucauggcug

SEQ ID NO: 2484166 - RNA, 18 nt, Brucella suis 1330
gcuucaggucggcauuga

SEQ ID NO: 2484167 - RNA, 13 nt, Brucella suis 1330
gcuucaucgcggc

SEQ ID NO: 2484168 - RNA, 16 nt, Brucella suis 1330
gcuucaucuucuuggu

SEQ ID NO: 2484169 - RNA, 21 nt, Brucella suis 1330
gcuucaugauagagggccgaa

SEQ ID NO: 2484170 - RNA, 21 nt, Brucella suis 1330
gcuucaugggcuugaucuggg

SEQ ID NO: 2484171 - RNA, 21 nt, Brucella suis 1330
gcuuccacgcggauaucggcg

SEQ ID NO: 2484172 - RNA, 17 nt, Brucella suis 1330
gcuuccagcaggcgcgc

SEQ ID NO: 2484173 - RNA, 17 nt, Brucella suis 1330
gcuuccagcgccucaua

SEQ ID NO: 2484174 - RNA, 18 nt, Brucella suis 1330
gcuuccggcguggugagc

SEQ ID NO: 2484175 - RNA, 17 nt, Brucella suis 1330
gcuuccgucagggccga

SEQ ID NO: 2484176 - RNA, 20 nt, Brucella suis 1330
gcuuccuugcgcuugcgaug

SEQ ID NO: 2484177 - RNA, 14 nt, Brucella suis 1330
gcuuccuuuucggc

SEQ ID NO: 2484178 - RNA, 14 nt, Brucella suis 1330
gcuucgagcgccuu

SEQ ID NO: 2484179 - RNA, 23 nt, Brucella suis 1330
gcuucgaggaaccagagugccuu

SEQ ID NO: 2484180 - RNA, 17 nt, Brucella suis 1330
gcuucgcaccuuccaca

SEQ ID NO: 2484181 - RNA, 20 nt, Brucella suis 1330
gcuucgcgcaggccgcggca

SEQ ID NO: 2484182 - RNA, 18 nt, Brucella suis 1330
gcuucgcuccgcaccuca

SEQ ID NO: 2484183 - RNA, 13 nt, Brucella suis 1330
gcuucucccaaag

SEQ ID NO: 2484184 - RNA, 15 nt, Brucella suis 1330
gcuucucccaaagcg

SEQ ID NO: 2484185 - RNA, 12 nt, Brucella suis 1330
gcuucuuccagu

SEQ ID NO: 2484186 - RNA, 20 nt, Brucella suis 1330
gcuucuuccaguuccuucuu

SEQ ID NO: 2484187 - RNA, 18 nt, Brucella suis 1330
gcuucuuccuucggcaag

SEQ ID NO: 2484188 - RNA, 14 nt, Brucella suis 1330
gcuugaacaaaacc

SEQ ID NO: 2484189 - RNA, 15 nt, Brucella suis 1330
gcuugaacccgccga

SEQ ID NO: 2484190 - RNA, 16 nt, Brucella suis 1330
gcuugaaccuccacgc

SEQ ID NO: 2484191 - RNA, 17 nt, Brucella suis 1330
gcuugaagcugccgcgg

SEQ ID NO: 2484192 - RNA, 21 nt, Brucella suis 1330
gcuugagaaccgaacgcgccu

SEQ ID NO: 2484193 - RNA, 19 nt, Brucella suis 1330
gcuugagcguuacuucggc

SEQ ID NO: 2484194 - RNA, 13 nt, Brucella suis 1330
gcuugaugcgcca

SEQ ID NO: 2484195 - RNA, 21 nt, Brucella suis 1330
gcuugauggcgagcuggaaac

SEQ ID NO: 2484196 - RNA, 19 nt, Brucella suis 1330
gcuugcaugguucuggaau

SEQ ID NO: 2484197 - RNA, 20 nt, Brucella suis 1330
gcuugccagaugugccacca

SEQ ID NO: 2484198 - RNA, 19 nt, Brucella suis 1330
gcuugccgaaaagccgcgc

SEQ ID NO: 2484199 - RNA, 22 nt, Brucella suis 1330
gcuugccgaccuccccccgcgu

SEQ ID NO: 2484200 - RNA, 17 nt, Brucella suis 1330
gcuugccgaccuugagc

SEQ ID NO: 2484201 - RNA, 23 nt, Brucella suis 1330
gcuugccggaaagguguccucca

SEQ ID NO: 2484202 - RNA, 19 nt, Brucella suis 1330
gcuugccguuggcauccac

SEQ ID NO: 2484203 - RNA, 15 nt, Brucella suis 1330
gcuugcgcccgcggu

SEQ ID NO: 2484204 - RNA, 12 nt, Brucella suis 1330
gcuugcuugcca

SEQ ID NO: 2484205 - RNA, 15 nt, Brucella suis 1330
gcuugcuuugcccuu

SEQ ID NO: 2484206 - RNA, 22 nt, Brucella suis 1330
gcuuggcaccgccugcgcgcau

SEQ ID NO: 2484207 - RNA, 15 nt, Brucella suis 1330
gcuugucgcggccuu

SEQ ID NO: 2484208 - RNA, 16 nt, Brucella suis 1330
gcuuuaugcaaggccg

SEQ ID NO: 2484209 - RNA, 20 nt, Brucella suis 1330
gcuuuaugcgggugguggcg

SEQ ID NO: 2484210 - RNA, 20 nt, Brucella suis 1330
gcuuucaaauucggcuauaa

SEQ ID NO: 2484211 - RNA, 12 nt, Brucella suis 1330
gcuuucaaugcu

SEQ ID NO: 2484212 - RNA, 17 nt, Brucella suis 1330
gcuuucaauggccgcgc

SEQ ID NO: 2484213 - RNA, 18 nt, Brucella suis 1330
gcuuucaucgccuguucc

SEQ ID NO: 2484214 - RNA, 20 nt, Brucella suis 1330
gcuuuccagcgggcgcgacu

SEQ ID NO: 2484215 - RNA, 22 nt, Brucella suis 1330
gcuuuccgacagggcaagcgcc

SEQ ID NO: 2484216 - RNA, 18 nt, Brucella suis 1330
gcuuucgauuuuugccag

SEQ ID NO: 2484217 - RNA, 13 nt, Brucella suis 1330
gcuuucgccgccc

SEQ ID NO: 2484218 - RNA, 14 nt, Brucella suis 1330
gcuuucuuccagcu

SEQ ID NO: 2484219 - RNA, 16 nt, Brucella suis 1330
gcuuugaccgccgcga

SEQ ID NO: 2484220 - RNA, 18 nt, Brucella suis 1330
gcuuugcggaggcggcug

SEQ ID NO: 2484221 - RNA, 16 nt, Brucella suis 1330
gcuuuggaggaaccaa

SEQ ID NO: 2484222 - RNA, 21 nt, Brucella suis 1330
gcuuuucauuuuccucauaaa

SEQ ID NO: 2484223 - RNA, 12 nt, Brucella suis 1330
gcuuuucccaau

SEQ ID NO: 2484224 - RNA, 22 nt, Brucella suis 1330
gcuuuugcagccgugaaacagu

SEQ ID NO: 2484225 - RNA, 20 nt, Brucella suis 1330
gcuuuuuauccucccaugca

SEQ ID NO: 2484226 - RNA, 18 nt, Brucella suis 1330
gcuuuuuuuaugccgcgu

SEQ ID NO: 2484227 - RNA, 18 nt, Brucella suis 1330
ggaaaaaaccggcgauga

SEQ ID NO: 2484228 - RNA, 21 nt, Brucella suis 1330
ggcagcacugucgaugagacc

SEQ ID NO: 2484229 - RNA, 16 nt, Brucella suis 1330
ggcagcaugaucgcca

SEQ ID NO: 2484230 - RNA, 14 nt, Brucella suis 1330
ggcagccgccgccg

SEQ ID NO: 2484231 - RNA, 17 nt, Brucella suis 1330
ggcagcgacccgcgccc

SEQ ID NO: 2484232 - RNA, 12 nt, Brucella suis 1330
ggcagcggcagg

SEQ ID NO: 2484233 - RNA, 14 nt, Brucella suis 1330
ggcagcggcgcgcc

SEQ ID NO: 2484234 - RNA, 15 nt, Brucella suis 1330
ggcagcggcgcgcca

SEQ ID NO: 2484235 - RNA, 19 nt, Brucella suis 1330
ggcagcggcgcgccaaaag

SEQ ID NO: 2484236 - RNA, 15 nt, Brucella suis 1330
ggcagcggcgugccg

SEQ ID NO: 2484237 - RNA, 14 nt, Brucella suis 1330
ggcaggagccggaa

SEQ ID NO: 2484238 - RNA, 13 nt, Brucella suis 1330
ggcaggagcgcga

SEQ ID NO: 2484239 - RNA, 12 nt, Brucella suis 1330
ggcaggaggcca

SEQ ID NO: 2484240 - RNA, 19 nt, Brucella suis 1330
ggcaggaucgccagaagcg

SEQ ID NO: 2484241 - RNA, 18 nt, Brucella suis 1330
ggcaggcacacccggcgu

SEQ ID NO: 2484242 - RNA, 18 nt, Brucella suis 1330
ggcaggccgccugggaga

SEQ ID NO: 2484243 - RNA, 20 nt, Brucella suis 1330
ggcagguaagagcagauccu

SEQ ID NO: 2484244 - RNA, 19 nt, Brucella suis 1330
ggcagguuccaguccagcg

SEQ ID NO: 2484245 - RNA, 14 nt, Brucella suis 1330
ggcaguagggcagu

SEQ ID NO: 2484246 - RNA, 17 nt, Brucella suis 1330
ggcaguccccgugccgg

SEQ ID NO: 2484247 - RNA, 14 nt, Brucella suis 1330
ggcaguccggcagc

SEQ ID NO: 2484248 - RNA, 16 nt, Brucella suis 1330
ggcaguccggcagcac

SEQ ID NO: 2484249 - RNA, 19 nt, Brucella suis 1330
ggcagugcgagcgugaagg

SEQ ID NO: 2484250 - RNA, 19 nt, Brucella suis 1330
ggcauagccggcauggauu

SEQ ID NO: 2484251 - RNA, 13 nt, Brucella suis 1330
ggcaucaaacugg

SEQ ID NO: 2484252 - RNA, 13 nt, Brucella suis 1330
ggcauccuugccg

SEQ ID NO: 2484253 - RNA, 18 nt, Brucella suis 1330
ggcauccuugucggcauc

SEQ ID NO: 2484254 - RNA, 20 nt, Brucella suis 1330
ggcaucgcucaccuuuucca

SEQ ID NO: 2484255 - RNA, 17 nt, Brucella suis 1330
ggcaucggugcgcggcg

SEQ ID NO: 2484256 - RNA, 19 nt, Brucella suis 1330
ggcauggaucaacgcaggc

SEQ ID NO: 2484257 - RNA, 14 nt, Brucella suis 1330
ggcauggauuucca

SEQ ID NO: 2484258 - RNA, 19 nt, Brucella suis 1330
ggcaugggcaacccggcgg

SEQ ID NO: 2484259 - RNA, 22 nt, Brucella suis 1330
ggcauguugcccaucgcgcuug

SEQ ID NO: 2484260 - RNA, 14 nt, Brucella suis 1330
ggcauugcgcggca

SEQ ID NO: 2484261 - RNA, 14 nt, Brucella suis 1330
ggcauuguggugcg

SEQ ID NO: 2484262 - RNA, 18 nt, Brucella suis 1330
ggcauuguggugcgcauc

SEQ ID NO: 2484263 - RNA, 18 nt, Brucella suis 1330
ggccaaaggucggcggcg

SEQ ID NO: 2484264 - RNA, 14 nt, Brucella suis 1330
ggccaacgccacga

SEQ ID NO: 2484265 - RNA, 15 nt, Brucella suis 1330
ggccaacgccggcac

SEQ ID NO: 2484266 - RNA, 19 nt, Brucella suis 1330
ggccaagaucgacaaagcc

SEQ ID NO: 2484267 - RNA, 21 nt, Brucella suis 1330
ggccaagaucgacaaagccug

SEQ ID NO: 2484268 - RNA, 22 nt, Brucella suis 1330
ggccaagcggaucgcgucccuu

SEQ ID NO: 2484269 - RNA, 23 nt, Brucella suis 1330
ggccaaggccccagaucagcguc

SEQ ID NO: 2484270 - RNA, 18 nt, Brucella suis 1330
ggccacgacagggcgcug

SEQ ID NO: 2484271 - RNA, 17 nt, Brucella suis 1330
ggccacgauagacgcgg

SEQ ID NO: 2484272 - RNA, 21 nt, Brucella suis 1330
ggccacgauagacgcggcggc

SEQ ID NO: 2484273 - RNA, 15 nt, Brucella suis 1330
ggccacgccagccgc

SEQ ID NO: 2484274 - RNA, 20 nt, Brucella suis 1330
ggccagaucgcgcgcggccc

SEQ ID NO: 2484275 - RNA, 22 nt, Brucella suis 1330
ggccagauugcgccuaccaagg

SEQ ID NO: 2484276 - RNA, 13 nt, Brucella suis 1330
ggccagccagcgc

SEQ ID NO: 2484277 - RNA, 14 nt, Brucella suis 1330
ggccagccagcgca

SEQ ID NO: 2484278 - RNA, 15 nt, Brucella suis 1330
ggccagccagcgcau

SEQ ID NO: 2484279 - RNA, 20 nt, Brucella suis 1330
ggccagccagcgcauaaagg

SEQ ID NO: 2484280 - RNA, 21 nt, Brucella suis 1330
ggccagccgcaaugagcccgc

SEQ ID NO: 2484281 - RNA, 22 nt, Brucella suis 1330
ggccagccgcaaugagcccgcg

SEQ ID NO: 2484282 - RNA, 17 nt, Brucella suis 1330
ggccaggccgauugccg

SEQ ID NO: 2484283 - RNA, 17 nt, Brucella suis 1330
ggccaguggccgaagcc

SEQ ID NO: 2484284 - RNA, 15 nt, Brucella suis 1330
ggccaguucagcggc

SEQ ID NO: 2484285 - RNA, 18 nt, Brucella suis 1330
ggccaguuuggcugugcu

SEQ ID NO: 2484286 - RNA, 12 nt, Brucella suis 1330
ggccauagcccc

SEQ ID NO: 2484287 - RNA, 22 nt, Brucella suis 1330
ggccaugaugccgacaagcagc

SEQ ID NO: 2484288 - RNA, 15 nt, Brucella suis 1330
ggccauggcuucaag

SEQ ID NO: 2484289 - RNA, 17 nt, Brucella suis 1330
ggccauggcuucaagcg

SEQ ID NO: 2484290 - RNA, 17 nt, Brucella suis 1330
ggccauuucggcuucca

SEQ ID NO: 2484291 - RNA, 21 nt, Brucella suis 1330
ggccauuucggcuuccagcag

SEQ ID NO: 2484292 - RNA, 20 nt, Brucella suis 1330
ggcccaaaggccgcgccgau

SEQ ID NO: 2484293 - RNA, 17 nt, Brucella suis 1330
ggcccagaaccugcccg

SEQ ID NO: 2484294 - RNA, 19 nt, Brucella suis 1330
ggcccagaaccugcccguc

SEQ ID NO: 2484295 - RNA, 14 nt, Brucella suis 1330
ggcccagauguucc

SEQ ID NO: 2484296 - RNA, 20 nt, Brucella suis 1330
ggcccagcaugucauccgaa

SEQ ID NO: 2484297 - RNA, 11 nt, Brucella suis 1330
ggcccaggccu

SEQ ID NO: 2484298 - RNA, 19 nt, Brucella suis 1330
ggcccaggccucugccucc

SEQ ID NO: 2484299 - RNA, 15 nt, Brucella suis 1330
ggcccauaccgcgcc

SEQ ID NO: 2484300 - RNA, 15 nt, Brucella suis 1330
ggcccaugagcuuca

SEQ ID NO: 2484301 - RNA, 22 nt, Brucella suis 1330
ggcccccagaaggcgcggcagc

SEQ ID NO: 2484302 - RNA, 17 nt, Brucella suis 1330
ggccccuaaagccgcuc

SEQ ID NO: 2484303 - RNA, 15 nt, Brucella suis 1330
ggcccgaaagcagac

SEQ ID NO: 2484304 - RNA, 14 nt, Brucella suis 1330
ggcccgcgugcacg

SEQ ID NO: 2484305 - RNA, 23 nt, Brucella suis 1330
ggcccggucacccgcacgccgug

SEQ ID NO: 2484306 - RNA, 20 nt, Brucella suis 1330
ggcccgguccgcgcucgucg

SEQ ID NO: 2484307 - RNA, 15 nt, Brucella suis 1330
ggcccuggaaagaag

SEQ ID NO: 2484308 - RNA, 16 nt, Brucella suis 1330
ggcccuggaaagaagc

SEQ ID NO: 2484309 - RNA, 18 nt, Brucella suis 1330
ggcccuggaaagaagcga

SEQ ID NO: 2484310 - RNA, 20 nt, Brucella suis 1330
ggcccuggaaagaagcgaaa

SEQ ID NO: 2484311 - RNA, 18 nt, Brucella suis 1330
ggcccuucagggacgagc

SEQ ID NO: 2484312 - RNA, 16 nt, Brucella suis 1330
ggccgaauagcgcauc

SEQ ID NO: 2484313 - RNA, 16 nt, Brucella suis 1330
ggccgacagaugcgca

SEQ ID NO: 2484314 - RNA, 22 nt, Brucella suis 1330
ggccgagcgcaucggccagcug

SEQ ID NO: 2484315 - RNA, 18 nt, Brucella suis 1330
ggccgaugacggcgcggc

SEQ ID NO: 2484316 - RNA, 17 nt, Brucella suis 1330
ggccgauugccgagccg

SEQ ID NO: 2484317 - RNA, 12 nt, Brucella suis 1330
ggccgauuuccg

SEQ ID NO: 2484318 - RNA, 22 nt, Brucella suis 1330
ggccgcaaagcgaacgcacugc

SEQ ID NO: 2484319 - RNA, 14 nt, Brucella suis 1330
ggccgcaucggaag

SEQ ID NO: 2484320 - RNA, 21 nt, Brucella suis 1330
ggccgcaugauccgcuccaga

SEQ ID NO: 2484321 - RNA, 16 nt, Brucella suis 1330
ggccgccgucgcggcu

SEQ ID NO: 2484322 - RNA, 13 nt, Brucella suis 1330
ggccgcgccgauc

SEQ ID NO: 2484323 - RNA, 14 nt, Brucella suis 1330
ggccgcgcuccaga

SEQ ID NO: 2484324 - RNA, 19 nt, Brucella suis 1330
ggccgcgugaaaagcacac

SEQ ID NO: 2484325 - RNA, 16 nt, Brucella suis 1330
ggccgcucgcugcggc

SEQ ID NO: 2484326 - RNA, 17 nt, Brucella suis 1330
ggccgcucuucggggcg

SEQ ID NO: 2484327 - RNA, 18 nt, Brucella suis 1330
ggccgcuugcgacaccug

SEQ ID NO: 2484328 - RNA, 17 nt, Brucella suis 1330
ggccgcuuugcggaggc

SEQ ID NO: 2484329 - RNA, 22 nt, Brucella suis 1330
ggccggaaaucuuggcuaucac

SEQ ID NO: 2484330 - RNA, 16 nt, Brucella suis 1330
ggccggaagcgcgcgu

SEQ ID NO: 2484331 - RNA, 18 nt, Brucella suis 1330
ggccggaagcgcgcguga

SEQ ID NO: 2484332 - RNA, 24 nt, Brucella suis 1330
ggccggagcgcagaucggcgagcg

SEQ ID NO: 2484333 - RNA, 14 nt, Brucella suis 1330
ggccggcugcggcg

SEQ ID NO: 2484334 - RNA, 22 nt, Brucella suis 1330
ggccgggaggcacgucccgccc

SEQ ID NO: 2484335 - RNA, 23 nt, Brucella suis 1330
ggccgguaaaauuggcagcgccg

SEQ ID NO: 2484336 - RNA, 20 nt, Brucella suis 1330
ggccgguaagcccugucagc

SEQ ID NO: 2484337 - RNA, 17 nt, Brucella suis 1330
ggccgucuucgcccgac

SEQ ID NO: 2484338 - RNA, 17 nt, Brucella suis 1330
ggccguuacgaugacaa

SEQ ID NO: 2484339 - RNA, 21 nt, Brucella suis 1330
ggccguuccgccgaucugcac

SEQ ID NO: 2484340 - RNA, 20 nt, Brucella suis 1330
ggccguugcuuucggcggca

SEQ ID NO: 2484341 - RNA, 15 nt, Brucella suis 1330
ggccuaccauauccu

SEQ ID NO: 2484342 - RNA, 21 nt, Brucella suis 1330
ggccuauccucaaaaaccgga

SEQ ID NO: 2484343 - RNA, 13 nt, Brucella suis 1330
ggccugaaacagc

SEQ ID NO: 2484344 - RNA, 22 nt, Brucella suis 1330
ggcucugcggaaagcccggccu

SEQ ID NO: 2484345 - RNA, 22 nt, Brucella suis 1330
ggcucuugggagcggcgccaac

SEQ ID NO: 2484346 - RNA, 15 nt, Brucella suis 1330
ggcugagggaaacac

SEQ ID NO: 2484347 - RNA, 16 nt, Brucella suis 1330
ggcugagggaaacacu

SEQ ID NO: 2484348 - RNA, 15 nt, Brucella suis 1330
ggcugcaaauggcaa

SEQ ID NO: 2484349 - RNA, 15 nt, Brucella suis 1330
ggcugcaacaaaaga

SEQ ID NO: 2484350 - RNA, 18 nt, Brucella suis 1330
ggcugcaucggcuuggga

SEQ ID NO: 2484351 - RNA, 20 nt, Brucella suis 1330
ggcugccaugugcagccggg

SEQ ID NO: 2484352 - RNA, 18 nt, Brucella suis 1330
ggcugcccaugcccgcca

SEQ ID NO: 2484353 - RNA, 13 nt, Brucella suis 1330
ggcugcccgccgc

SEQ ID NO: 2484354 - RNA, 14 nt, Brucella suis 1330
ggcugcccgccgca

SEQ ID NO: 2484355 - RNA, 20 nt, Brucella suis 1330
ggcugcccgcgccggucucc

SEQ ID NO: 2484356 - RNA, 16 nt, Brucella suis 1330
ggcugccgcgugggcg

SEQ ID NO: 2484357 - RNA, 19 nt, Brucella suis 1330
ggcugcguuucggcggcuu

SEQ ID NO: 2484358 - RNA, 17 nt, Brucella suis 1330
ggcuggucuggcgaggc

SEQ ID NO: 2484359 - RNA, 17 nt, Brucella suis 1330
ggcugucaaugcagcgu

SEQ ID NO: 2484360 - RNA, 14 nt, Brucella suis 1330
ggcugugcgagcuu

SEQ ID NO: 2484361 - RNA, 20 nt, Brucella suis 1330
ggcuguguaaaaguggaacc

SEQ ID NO: 2484362 - RNA, 15 nt, Brucella suis 1330
ggcuguuggccggca

SEQ ID NO: 2484363 - RNA, 23 nt, Brucella suis 1330
ggcuguuuuccugcccggcauca

SEQ ID NO: 2484364 - RNA, 18 nt, Brucella suis 1330
ggcuguuuucgaggccau

SEQ ID NO: 2484365 - RNA, 20 nt, Brucella suis 1330
ggcuucagaucgcgcggcga

SEQ ID NO: 2484366 - RNA, 21 nt, Brucella suis 1330
ggcuuccagcaggcgcgcagc

SEQ ID NO: 2484367 - RNA, 11 nt, Brucella suis 1330
ggcuucuucca

SEQ ID NO: 2484368 - RNA, 12 nt, Brucella suis 1330
ggcuucuuccag

SEQ ID NO: 2484369 - RNA, 13 nt, Brucella suis 1330
ggcuugauagcgc

SEQ ID NO: 2484370 - RNA, 17 nt, Brucella suis 1330
ggcuugccaccacgaug

SEQ ID NO: 2484371 - RNA, 21 nt, Brucella suis 1330
ggcuugccagaugugccacca

SEQ ID NO: 2484372 - RNA, 21 nt, Brucella suis 1330
ggcuugccgaccuccccccgc

SEQ ID NO: 2484373 - RNA, 18 nt, Brucella suis 1330
ggcuugccgcguuccacg

SEQ ID NO: 2484374 - RNA, 17 nt, Brucella suis 1330
ggcuuucucguuuucau

SEQ ID NO: 2484375 - RNA, 15 nt, Brucella suis 1330
ggcuuugugaaagcg

SEQ ID NO: 2484376 - RNA, 16 nt, Brucella suis 1330
ggcuuuucauucugaa

SEQ ID NO: 2484377 - RNA, 16 nt, Brucella suis 1330
ggcuuuuccggcggcg

SEQ ID NO: 2484378 - RNA, 18 nt, Brucella suis 1330
ggcuuuuccggcggcggc

SEQ ID NO: 2484379 - RNA, 18 nt, Brucella suis 1330
ggcuuuuuauccucccau

SEQ ID NO: 2484380 - RNA, 21 nt, Brucella suis 1330
gggaacaauaggcgcgggcau

SEQ ID NO: 2484381 - RNA, 14 nt, Brucella suis 1330
gggaaccgguuuuc

SEQ ID NO: 2484382 - RNA, 13 nt, Brucella suis 1330
gggaagcccagcg

SEQ ID NO: 2484383 - RNA, 18 nt, Brucella suis 1330
gggaagugcauaugauga

SEQ ID NO: 2484384 - RNA, 17 nt, Brucella suis 1330
gggaauggcgcgcgcgg

SEQ ID NO: 2484385 - RNA, 21 nt, Brucella suis 1330
gggacaaucuugcgcagcgca

SEQ ID NO: 2484386 - RNA, 16 nt, Brucella suis 1330
gggacgagcggcaggc

SEQ ID NO: 2484387 - RNA, 18 nt, Brucella suis 1330
gggagaaaagaugggcgc

SEQ ID NO: 2484388 - RNA, 15 nt, Brucella suis 1330
gggagagaacacaga

SEQ ID NO: 2484389 - RNA, 13 nt, Brucella suis 1330
gggagcagcucua

SEQ ID NO: 2484390 - RNA, 22 nt, Brucella suis 1330
gggaucagaagugcugcugcaa

SEQ ID NO: 2484391 - RNA, 11 nt, Brucella suis 1330
gggaucgagcc

SEQ ID NO: 2484392 - RNA, 21 nt, Brucella suis 1330
gggauugcgcaagugcugcaa

SEQ ID NO: 2484393 - RNA, 21 nt, Brucella suis 1330
gggcaaaaucgagugcggccu

SEQ ID NO: 2484394 - RNA, 22 nt, Brucella suis 1330
gggcaagcauuccgggccgcac

SEQ ID NO: 2484395 - RNA, 12 nt, Brucella suis 1330
gggcaagggccu

SEQ ID NO: 2484396 - RNA, 14 nt, Brucella suis 1330
gggcaauagaagga

SEQ ID NO: 2484397 - RNA, 17 nt, Brucella suis 1330
gggcaauuggcccccaa

SEQ ID NO: 2484398 - RNA, 13 nt, Brucella suis 1330
gggcagcggcgcg

SEQ ID NO: 2484399 - RNA, 16 nt, Brucella suis 1330
gggcagcuugucgaaa

SEQ ID NO: 2484400 - RNA, 14 nt, Brucella suis 1330
gggcaguagggcag

SEQ ID NO: 2484401 - RNA, 16 nt, Brucella suis 1330
gggcaguagggcagua

SEQ ID NO: 2484402 - RNA, 21 nt, Brucella suis 1330
gggcauguugcccaucgcgcu

SEQ ID NO: 2484403 - RNA, 22 nt, Brucella suis 1330
gggcauucgaugaacaggagcg

SEQ ID NO: 2484404 - RNA, 17 nt, Brucella suis 1330
gggcauugucguccagg

SEQ ID NO: 2484405 - RNA, 20 nt, Brucella suis 1330
gggccaacgccggcaccgcc

SEQ ID NO: 2484406 - RNA, 19 nt, Brucella suis 1330
gggccagguaucgugcaga

SEQ ID NO: 2484407 - RNA, 19 nt, Brucella suis 1330
gggccaucuuccucacccu

SEQ ID NO: 2484408 - RNA, 21 nt, Brucella suis 1330
gggcccuuaugaucgccgccc

SEQ ID NO: 2484409 - RNA, 20 nt, Brucella suis 1330
gggccgcaugauccgcucca

SEQ ID NO: 2484410 - RNA, 14 nt, Brucella suis 1330
gggccgcucaaggc

SEQ ID NO: 2484411 - RNA, 16 nt, Brucella suis 1330
gggccggaugcgcgga

SEQ ID NO: 2484412 - RNA, 15 nt, Brucella suis 1330
gggccgggaaaucug

SEQ ID NO: 2484413 - RNA, 19 nt, Brucella suis 1330
gggccgggaaaucugcgcg

SEQ ID NO: 2484414 - RNA, 21 nt, Brucella suis 1330
gggccucaagcggcuccacca

SEQ ID NO: 2484415 - RNA, 18 nt, Brucella suis 1330
gggccuugccaaaaugau

SEQ ID NO: 2484416 - RNA, 19 nt, Brucella suis 1330
gggccuuguuuucugccgg

SEQ ID NO: 2484417 - RNA, 15 nt, Brucella suis 1330
gggccuuuccggcgg

SEQ ID NO: 2484418 - RNA, 16 nt, Brucella suis 1330
gggcgagggcgggcgg

SEQ ID NO: 2484419 - RNA, 20 nt, Brucella suis 1330
gggcgcuuuauuccuuugau

SEQ ID NO: 2484420 - RNA, 12 nt, Brucella suis 1330
gggcggccagga

SEQ ID NO: 2484421 - RNA, 15 nt, Brucella suis 1330
gggcggcgcggcggc

SEQ ID NO: 2484422 - RNA, 15 nt, Brucella suis 1330
gggcggcggccgggc

SEQ ID NO: 2484423 - RNA, 16 nt, Brucella suis 1330
gggcggcguuuugcuu

SEQ ID NO: 2484424 - RNA, 12 nt, Brucella suis 1330
gggcgggcggcc

SEQ ID NO: 2484425 - RNA, 18 nt, Brucella suis 1330
gggcgguauugcugccgg

SEQ ID NO: 2484426 - RNA, 19 nt, Brucella suis 1330
gggcgucgcgcaucauugg

SEQ ID NO: 2484427 - RNA, 18 nt, Brucella suis 1330
gggcuucaugauggaaga

SEQ ID NO: 2484428 - RNA, 14 nt, Brucella suis 1330
gggcuucuuccagu

SEQ ID NO: 2484429 - RNA, 22 nt, Brucella suis 1330
gggcuuggcuugccgcguucca

SEQ ID NO: 2484430 - RNA, 13 nt, Brucella suis 1330
ggggacgcagccu

SEQ ID NO: 2484431 - RNA, 13 nt, Brucella suis 1330
ggggacgggcggu

SEQ ID NO: 2484432 - RNA, 15 nt, Brucella suis 1330
ggggagcaggcaggc

SEQ ID NO: 2484433 - RNA, 18 nt, Brucella suis 1330
ggggcaagaaaaaagguc

SEQ ID NO: 2484434 - RNA, 11 nt, Brucella suis 1330
ggggcaggggu

SEQ ID NO: 2484435 - RNA, 13 nt, Brucella suis 1330
ggggcaugacauc

SEQ ID NO: 2484436 - RNA, 16 nt, Brucella suis 1330
ggggccugaaugcaau

SEQ ID NO: 2484437 - RNA, 13 nt, Brucella suis 1330
ggggcgacgcugc

SEQ ID NO: 2484438 - RNA, 15 nt, Brucella suis 1330
ggggcgacgcugcaa

SEQ ID NO: 2484439 - RNA, 19 nt, Brucella suis 1330
ggggcguccgccaccgccg

SEQ ID NO: 2484440 - RNA, 20 nt, Brucella suis 1330
gggguaaauccuccagauug

SEQ ID NO: 2484441 - RNA, 16 nt, Brucella suis 1330
ggguacgaaccacggc

SEQ ID NO: 2484442 - RNA, 17 nt, Brucella suis 1330
ggguagagcuucuuuuc

SEQ ID NO: 2484443 - RNA, 22 nt, Brucella suis 1330
gggucacgcgcguugcggccgg

SEQ ID NO: 2484444 - RNA, 20 nt, Brucella suis 1330
ggguccagucaaugccguga

SEQ ID NO: 2484445 - RNA, 18 nt, Brucella suis 1330
gggugagguuugcgacgg

SEQ ID NO: 2484446 - RNA, 23 nt, Brucella suis 1330
gggugcaagcgcaaagcuuucca

SEQ ID NO: 2484447 - RNA, 18 nt, Brucella suis 1330
ggguucccuguggagaga

SEQ ID NO: 2484448 - RNA, 12 nt, Brucella suis 1330
ggguugccuucg

SEQ ID NO: 2484449 - RNA, 12 nt, Brucella suis 1330
ggguuucuuuug

SEQ ID NO: 2484450 - RNA, 17 nt, Brucella suis 1330
gguaacgauauccggcu

SEQ ID NO: 2484451 - RNA, 21 nt, Brucella suis 1330
gguaacgaugauauaggcgca

SEQ ID NO: 2484452 - RNA, 24 nt, Brucella suis 1330
gguaacgaugauauaggcgcaauc

SEQ ID NO: 2484453 - RNA, 16 nt, Brucella suis 1330
gguauagacauucugc

SEQ ID NO: 2484454 - RNA, 16 nt, Brucella suis 1330
ggucaaaacgccccgg

SEQ ID NO: 2484455 - RNA, 20 nt, Brucella suis 1330
ggucacgcgcguugcggccg

SEQ ID NO: 2484456 - RNA, 17 nt, Brucella suis 1330
ggucagaucaucugcca

SEQ ID NO: 2484457 - RNA, 21 nt, Brucella suis 1330
ggucagaucaucugccaacca

SEQ ID NO: 2484458 - RNA, 20 nt, Brucella suis 1330
ggucaguggcaugggagcac

SEQ ID NO: 2484459 - RNA, 21 nt, Brucella suis 1330
gguccagcgaugccguggcga

SEQ ID NO: 2484460 - RNA, 15 nt, Brucella suis 1330
gguccccgccgccga

SEQ ID NO: 2484461 - RNA, 13 nt, Brucella suis 1330
gucaugcgcggca

SEQ ID NO: 2484462 - RNA, 15 nt, Brucella suis 1330
gucaugcgcggcaug

SEQ ID NO: 2484463 - RNA, 16 nt, Brucella suis 1330
gucauggccacgccag

SEQ ID NO: 2484464 - RNA, 19 nt, Brucella suis 1330
gucauggccacgccagccg

SEQ ID NO: 2484465 - RNA, 11 nt, Brucella suis 1330
gucauggcgca

SEQ ID NO: 2484466 - RNA, 17 nt, Brucella suis 1330
gucauuuuugacaagcc

SEQ ID NO: 2484467 - RNA, 17 nt, Brucella suis 1330
guccaccaccucgccaa

SEQ ID NO: 2484468 - RNA, 15 nt, Brucella suis 1330
guccagaucggccuu

SEQ ID NO: 2484469 - RNA, 16 nt, Brucella suis 1330
guccagccaggugcug

SEQ ID NO: 2484470 - RNA, 15 nt, Brucella suis 1330
guccagucaaugccg

SEQ ID NO: 2484471 - RNA, 16 nt, Brucella suis 1330
guccagucuucaucga

SEQ ID NO: 2484472 - RNA, 20 nt, Brucella suis 1330
guccaguggacugauuuccc

SEQ ID NO: 2484473 - RNA, 15 nt, Brucella suis 1330
guccauccggcggcg

SEQ ID NO: 2484474 - RNA, 21 nt, Brucella suis 1330
gucccgcccgucgaccagcgc

SEQ ID NO: 2484475 - RNA, 20 nt, Brucella suis 1330
gucccgugucggagccggcc

SEQ ID NO: 2484476 - RNA, 21 nt, Brucella suis 1330
gucccucggggcggucugaaa

SEQ ID NO: 2484477 - RNA, 14 nt, Brucella suis 1330
gucccuugccgccu

SEQ ID NO: 2484478 - RNA, 20 nt, Brucella suis 1330
guccgacauccaucggcuca

SEQ ID NO: 2484479 - RNA, 22 nt, Brucella suis 1330
guccgcaaggaugugagcgaau

SEQ ID NO: 2484480 - RNA, 23 nt, Brucella suis 1330
guccgcaaucgccaccggcggcg

SEQ ID NO: 2484481 - RNA, 21 nt, Brucella suis 1330
guccgcaccauucugcccaga

SEQ ID NO: 2484482 - RNA, 15 nt, Brucella suis 1330
guccgccaccgccgg

SEQ ID NO: 2484483 - RNA, 14 nt, Brucella suis 1330
guccggccugcgcc

SEQ ID NO: 2484484 - RNA, 19 nt, Brucella suis 1330
guccggccugcgccagcga

SEQ ID NO: 2484485 - RNA, 17 nt, Brucella suis 1330
guccgggaagcaguucc

SEQ ID NO: 2484486 - RNA, 17 nt, Brucella suis 1330
guccgguccccgccgcc

SEQ ID NO: 2484487 - RNA, 23 nt, Brucella suis 1330
guccgguuuucugguuuccgcca

SEQ ID NO: 2484488 - RNA, 17 nt, Brucella suis 1330
guccguaauaaccgagg

SEQ ID NO: 2484489 - RNA, 14 nt, Brucella suis 1330
guccugccagcggc

SEQ ID NO: 2484490 - RNA, 15 nt, Brucella suis 1330
guccuggcgcacguc

SEQ ID NO: 2484491 - RNA, 20 nt, Brucella suis 1330
gucgaaaagcuugcccguca

SEQ ID NO: 2484492 - RNA, 13 nt, Brucella suis 1330
gucgaaaccuugu

SEQ ID NO: 2484493 - RNA, 14 nt, Brucella suis 1330
gucgaaggaucgaa

SEQ ID NO: 2484494 - RNA, 20 nt, Brucella suis 1330
gucgaaggaucgaagggcug

SEQ ID NO: 2484495 - RNA, 23 nt, Brucella suis 1330
gucgaauaucuugaagccuuccg

SEQ ID NO: 2484496 - RNA, 15 nt, Brucella suis 1330
gucgacaaugaagca

SEQ ID NO: 2484497 - RNA, 14 nt, Brucella suis 1330
gucgaccggcggca

SEQ ID NO: 2484498 - RNA, 13 nt, Brucella suis 1330
gucgagaauggca

SEQ ID NO: 2484499 - RNA, 19 nt, Brucella suis 1330
gucgagcagcaucuugcca

SEQ ID NO: 2484500 - RNA, 15 nt, Brucella suis 1330
gucgagcuuuccauc

SEQ ID NO: 2484501 - RNA, 13 nt, Brucella suis 1330
gucgaggcagcca

SEQ ID NO: 2484502 - RNA, 20 nt, Brucella suis 1330
gucgagggcaccggccuuga

SEQ ID NO: 2484503 - RNA, 14 nt, Brucella suis 1330
gucgaucaugcgga

SEQ ID NO: 2484504 - RNA, 12 nt, Brucella suis 1330
gucgccagcgcc

SEQ ID NO: 2484505 - RNA, 13 nt, Brucella suis 1330
gucgccagcgccg

SEQ ID NO: 2484506 - RNA, 14 nt, Brucella suis 1330
gucgccagcgccgg

SEQ ID NO: 2484507 - RNA, 17 nt, Brucella suis 1330
gucgcccauuuucucca

SEQ ID NO: 2484508 - RNA, 17 nt, Brucella suis 1330
gucgccgaaaagcgccu

SEQ ID NO: 2484509 - RNA, 22 nt, Brucella suis 1330
gucgccugauagcauauaggug

SEQ ID NO: 2484510 - RNA, 19 nt, Brucella suis 1330
gucgcgaccuucuugccau

SEQ ID NO: 2484511 - RNA, 12 nt, Brucella suis 1330
gucgcgcccgca

SEQ ID NO: 2484512 - RNA, 17 nt, Brucella suis 1330
gucgcggccuugauccg

SEQ ID NO: 2484513 - RNA, 21 nt, Brucella suis 1330
gucgcggcucccguugccggg

SEQ ID NO: 2484514 - RNA, 19 nt, Brucella suis 1330
gucgcgguuugcaagccgc

SEQ ID NO: 2484515 - RNA, 22 nt, Brucella suis 1330
gucgcgguuugcaagccgcggc

SEQ ID NO: 2484516 - RNA, 23 nt, Brucella suis 1330
gucgcgguuugcaagccgcggcg

SEQ ID NO: 2484517 - RNA, 15 nt, Brucella suis 1330
gucgcuaccaugcgg

SEQ ID NO: 2484518 - RNA, 21 nt, Brucella suis 1330
gucgcuacguggcuugaagcu

SEQ ID NO: 2484519 - RNA, 15 nt, Brucella suis 1330
gucgcuauuuuucuc

SEQ ID NO: 2484520 - RNA, 21 nt, Brucella suis 1330
gucggaaauaucgccgacgau

SEQ ID NO: 2484521 - RNA, 16 nt, Brucella suis 1330
gucggagguucgaauc

SEQ ID NO: 2484522 - RNA, 16 nt, Brucella suis 1330
gucggcaaggcggcuc

SEQ ID NO: 2484523 - RNA, 21 nt, Brucella suis 1330
gucggccagagcuucgccgcc

SEQ ID NO: 2484524 - RNA, 16 nt, Brucella suis 1330
gucggccaguuuggcu

SEQ ID NO: 2484525 - RNA, 20 nt, Brucella suis 1330
gucggcgaauuccacgauga

SEQ ID NO: 2484526 - RNA, 13 nt, Brucella suis 1330
gucggcgccgucg

SEQ ID NO: 2484527 - RNA, 13 nt, Brucella suis 1330
gucggcgcugcuc

SEQ ID NO: 2484528 - RNA, 18 nt, Brucella suis 1330
gucggcggcgugggcugc

SEQ ID NO: 2484529 - RNA, 14 nt, Brucella suis 1330
gucgggaagcccag

SEQ ID NO: 2484530 - RNA, 23 nt, Brucella suis 1330
gucgggugccagaucggcaagcg

SEQ ID NO: 2484531 - RNA, 19 nt, Brucella suis 1330
gucguccugugcggcugca

SEQ ID NO: 2484532 - RNA, 15 nt, Brucella suis 1330
gucgucuagcgccau

SEQ ID NO: 2484533 - RNA, 14 nt, Brucella suis 1330
gucgucuuucaguu

SEQ ID NO: 2484534 - RNA, 14 nt, Brucella suis 1330
gucgugacggccgg

SEQ ID NO: 2484535 - RNA, 16 nt, Brucella suis 1330
gucgugacggccggaa

SEQ ID NO: 2484536 - RNA, 15 nt, Brucella suis 1330
gucguucaccgcaac

SEQ ID NO: 2484537 - RNA, 18 nt, Brucella suis 1330
gucguugccgccgcgcgu

SEQ ID NO: 2484538 - RNA, 14 nt, Brucella suis 1330
gucguuucgccgcc

SEQ ID NO: 2484539 - RNA, 21 nt, Brucella suis 1330
gucucgacaguccagcuuucc

SEQ ID NO: 2484540 - RNA, 19 nt, Brucella suis 1330
gucucgccguucgccacgu

SEQ ID NO: 2484541 - RNA, 16 nt, Brucella suis 1330
gucucgcgaccgggcu

SEQ ID NO: 2484542 - RNA, 12 nt, Brucella suis 1330
gucugcgccaga

SEQ ID NO: 2484543 - RNA, 13 nt, Brucella suis 1330
gucugcuugccgc

SEQ ID NO: 2484544 - RNA, 14 nt, Brucella suis 1330
gucugcuugccgcc

SEQ ID NO: 2484545 - RNA, 15 nt, Brucella suis 1330
gucugcuugccgccg

SEQ ID NO: 2484546 - RNA, 21 nt, Brucella suis 1330
gucuggccugaagccgguucg

SEQ ID NO: 2484547 - RNA, 19 nt, Brucella suis 1330
gucugggcgaugagcgcca

SEQ ID NO: 2484548 - RNA, 20 nt, Brucella suis 1330
gucugggcgaugagcgccau

SEQ ID NO: 2484549 - RNA, 22 nt, Brucella suis 1330
gucuucauagaccccgccugag

SEQ ID NO: 2484550 - RNA, 18 nt, Brucella suis 1330
gucuucaucgauaugcgc

SEQ ID NO: 2484551 - RNA, 20 nt, Brucella suis 1330
gucuucgcccgacugcacgu

SEQ ID NO: 2484552 - RNA, 12 nt, Brucella suis 1330
gucuucgcccgg

SEQ ID NO: 2484553 - RNA, 18 nt, Brucella suis 1330
gucuucugagaaaaaaau

SEQ ID NO: 2484554 - RNA, 22 nt, Brucella suis 1330
gucuucugagaaaaaaaugcgc

SEQ ID NO: 2484555 - RNA, 17 nt, Brucella suis 1330
gucuugcgcuccaccag

SEQ ID NO: 2484556 - RNA, 12 nt, Brucella suis 1330
gucuugcucaug

SEQ ID NO: 2484557 - RNA, 16 nt, Brucella suis 1330
gucuuuuccgaugcgg

SEQ ID NO: 2484558 - RNA, 14 nt, Brucella suis 1330
gugaaacagugccg

SEQ ID NO: 2484559 - RNA, 19 nt, Brucella suis 1330
gugaaacggccaagcagga

SEQ ID NO: 2484560 - RNA, 23 nt, Brucella suis 1330
gugaaauauuuauccgcggcggu

SEQ ID NO: 2484561 - RNA, 15 nt, Brucella suis 1330
gugaagcggauuuua

SEQ ID NO: 2484562 - RNA, 20 nt, Brucella suis 1330
gugaauuucggcgacuggca

SEQ ID NO: 2484563 - RNA, 14 nt, Brucella suis 1330
gugacaucaagccc

SEQ ID NO: 2484564 - RNA, 15 nt, Brucella suis 1330
gugaccagagagcgg

SEQ ID NO: 2484565 - RNA, 14 nt, Brucella suis 1330
gugaccagccccug

SEQ ID NO: 2484566 - RNA, 16 nt, Brucella suis 1330
gugagcauggcaaggc

SEQ ID NO: 2484567 - RNA, 16 nt, Brucella suis 1330
gugagcauggucacgu

SEQ ID NO: 2484568 - RNA, 17 nt, Brucella suis 1330
gugagcggcaggccgca

SEQ ID NO: 2484569 - RNA, 14 nt, Brucella suis 1330
gugauauugcagac

SEQ ID NO: 2484570 - RNA, 23 nt, Brucella suis 1330
gugaucagggcaaucugcgcugc

SEQ ID NO: 2484571 - RNA, 18 nt, Brucella suis 1330
gugauuugauccaugcgc

SEQ ID NO: 2484572 - RNA, 22 nt, Brucella suis 1330
gugcacggccaugaagaucaau

SEQ ID NO: 2484573 - RNA, 16 nt, Brucella suis 1330
gugcagaugcgaggga

SEQ ID NO: 2484574 - RNA, 13 nt, Brucella suis 1330
gugcauuccccgc

SEQ ID NO: 2484575 - RNA, 18 nt, Brucella suis 1330
gugcauuuuuccagaccu

SEQ ID NO: 2484576 - RNA, 17 nt, Brucella suis 1330
gugccaagaagaagagc

SEQ ID NO: 2484577 - RNA, 16 nt, Brucella suis 1330
gugccaccagcacaca

SEQ ID NO: 2484578 - RNA, 18 nt, Brucella suis 1330
guuuacuuuucauuaaag

SEQ ID NO: 2484579 - RNA, 19 nt, Brucella suis 1330
guuuauucauuggcggcag

SEQ ID NO: 2484580 - RNA, 15 nt, Brucella suis 1330
guuucaagaucggac

SEQ ID NO: 2484581 - RNA, 15 nt, Brucella suis 1330
guuucaagcucccaa

SEQ ID NO: 2484582 - RNA, 18 nt, Brucella suis 1330
guuucagccuccugugca

SEQ ID NO: 2484583 - RNA, 20 nt, Brucella suis 1330
guuuccggacgcgcagauau

SEQ ID NO: 2484584 - RNA, 23 nt, Brucella suis 1330
guuuccugaacggcgugcgcugu

SEQ ID NO: 2484585 - RNA, 18 nt, Brucella suis 1330
guuucgacaagcuucagg

SEQ ID NO: 2484586 - RNA, 23 nt, Brucella suis 1330
guuucgauauccuggccuuccuu

SEQ ID NO: 2484587 - RNA, 16 nt, Brucella suis 1330
guuucgccccguugca

SEQ ID NO: 2484588 - RNA, 22 nt, Brucella suis 1330
guuucgcgcaauggcugucaau

SEQ ID NO: 2484589 - RNA, 15 nt, Brucella suis 1330
guuucggguggccuu

SEQ ID NO: 2484590 - RNA, 13 nt, Brucella suis 1330
guuucugccgcgc

SEQ ID NO: 2484591 - RNA, 18 nt, Brucella suis 1330
guuugacgcccauuucac

SEQ ID NO: 2484592 - RNA, 13 nt, Brucella suis 1330
guuugaucagccg

SEQ ID NO: 2484593 - RNA, 16 nt, Brucella suis 1330
guuugcauagggcagu

SEQ ID NO: 2484594 - RNA, 21 nt, Brucella suis 1330
guuugcgacgggcgagcgcca

SEQ ID NO: 2484595 - RNA, 15 nt, Brucella suis 1330
guuuguugaaacagg

SEQ ID NO: 2484596 - RNA, 13 nt, Brucella suis 1330
guuuucaaacuuc

SEQ ID NO: 2484597 - RNA, 11 nt, Brucella suis 1330
guuuucaccag

SEQ ID NO: 2484598 - RNA, 21 nt, Brucella suis 1330
guuuuccgcaaucaagaucga

SEQ ID NO: 2484599 - RNA, 17 nt, Brucella suis 1330
guuuucgggaugcgcuc

SEQ ID NO: 2484600 - RNA, 23 nt, Brucella suis 1330
guuuugcguaggauaaugcgaca

SEQ ID NO: 2484601 - RNA, 16 nt, Brucella suis 1330
guuuugcguuggaaaa

SEQ ID NO: 2484602 - RNA, 15 nt, Brucella suis 1330
guuuuggaaagaaau

SEQ ID NO: 2484603 - RNA, 13 nt, Brucella suis 1330
guuuuggcaucag

SEQ ID NO: 2484604 - RNA, 24 nt, Brucella suis 1330
guuuugucauggccggaucggcca

SEQ ID NO: 2484605 - RNA, 18 nt, Brucella suis 1330
guuuuucuuuguccagaa

SEQ ID NO: 2484606 - RNA, 15 nt, Brucella suis 1330
guuuuuuaccgcccu

SEQ ID NO: 2484607 - RNA, 12 nt, Brucella suis 1330
guuuuuuuugau

SEQ ID NO: 2484608 - RNA, 17 nt, Brucella suis 1330
uaaaaauaaagaaauag

SEQ ID NO: 2484609 - RNA, 22 nt, Brucella suis 1330
uaaaaauccauuagauacauau

SEQ ID NO: 2484610 - RNA, 23 nt, Brucella suis 1330
uaaaacgcgccgauaccaaggcc

SEQ ID NO: 2484611 - RNA, 15 nt, Brucella suis 1330
uaaaaggcaaagccg

SEQ ID NO: 2484612 - RNA, 23 nt, Brucella suis 1330
uaaaccgaaaggcguugcacaua

SEQ ID NO: 2484613 - RNA, 16 nt, Brucella suis 1330
uaaaccuuugaaauaa

SEQ ID NO: 2484614 - RNA, 20 nt, Brucella suis 1330
uaaagcacagccagaaagaa

SEQ ID NO: 2484615 - RNA, 14 nt, Brucella suis 1330
uaaagccgcuccau

SEQ ID NO: 2484616 - RNA, 21 nt, Brucella suis 1330
uaaagccgcuccauucccauu

SEQ ID NO: 2484617 - RNA, 13 nt, Brucella suis 1330
uaaagccuguccu

SEQ ID NO: 2484618 - RNA, 22 nt, Brucella suis 1330
uaaagcgguuccuguuuuaaca

SEQ ID NO: 2484619 - RNA, 21 nt, Brucella suis 1330
uaaagcugguugcgcggccag

SEQ ID NO: 2484620 - RNA, 18 nt, Brucella suis 1330
uaaagcuuaacccaacca

SEQ ID NO: 2484621 - RNA, 17 nt, Brucella suis 1330
uaaaggcgaguuuucaa

SEQ ID NO: 2484622 - RNA, 22 nt, Brucella suis 1330
uaaaguaucucucgccugcaua

SEQ ID NO: 2484623 - RNA, 22 nt, Brucella suis 1330
uaaaugcacccggcaccgcaaa

SEQ ID NO: 2484624 - RNA, 15 nt, Brucella suis 1330
uaaaugcccuuccuu

SEQ ID NO: 2484625 - RNA, 17 nt, Brucella suis 1330
uaacagcguucaacucc

SEQ ID NO: 2484626 - RNA, 18 nt, Brucella suis 1330
uaacaggaacgccgccgg

SEQ ID NO: 2484627 - RNA, 18 nt, Brucella suis 1330
uaacauacugccuuacug

SEQ ID NO: 2484628 - RNA, 23 nt, Brucella suis 1330
uaaccgaagaaugcgcagccguc

SEQ ID NO: 2484629 - RNA, 17 nt, Brucella suis 1330
uaaccgucuugaacaga

SEQ ID NO: 2484630 - RNA, 17 nt, Brucella suis 1330
uaacggugcgcccgcga

SEQ ID NO: 2484631 - RNA, 21 nt, Brucella suis 1330
uaagaugcgcgcaaggaaaga

SEQ ID NO: 2484632 - RNA, 16 nt, Brucella suis 1330
uaagccccggcaucac

SEQ ID NO: 2484633 - RNA, 15 nt, Brucella suis 1330
uaagcggcucucaaa

SEQ ID NO: 2484634 - RNA, 18 nt, Brucella suis 1330
uaagcugauaaaacgaau

SEQ ID NO: 2484635 - RNA, 11 nt, Brucella suis 1330
uaagcuuugca

SEQ ID NO: 2484636 - RNA, 17 nt, Brucella suis 1330
uaagcuuugcaccgcgc

SEQ ID NO: 2484637 - RNA, 17 nt, Brucella suis 1330
uaaucaaaagaaaccuu

SEQ ID NO: 2484638 - RNA, 18 nt, Brucella suis 1330
uaaucaaaagaaaccuug

SEQ ID NO: 2484639 - RNA, 23 nt, Brucella suis 1330
uaaucagcgucagcgcaaagccu

SEQ ID NO: 2484640 - RNA, 20 nt, Brucella suis 1330
uaauccacauucauaaccga

SEQ ID NO: 2484641 - RNA, 15 nt, Brucella suis 1330
uaauccauggccacg

SEQ ID NO: 2484642 - RNA, 15 nt, Brucella suis 1330
uaaucgccgggccuu

SEQ ID NO: 2484643 - RNA, 22 nt, Brucella suis 1330
uaaucgccgggccuugccaaaa

SEQ ID NO: 2484644 - RNA, 16 nt, Brucella suis 1330
uaaugccccgcaccga

SEQ ID NO: 2484645 - RNA, 22 nt, Brucella suis 1330
uaaugccccgcaccgacaaaaa

SEQ ID NO: 2484646 - RNA, 18 nt, Brucella suis 1330
uaaugcgaacaguuucaa

SEQ ID NO: 2484647 - RNA, 22 nt, Brucella suis 1330
uaauuccacgcgccgacaaaaa

SEQ ID NO: 2484648 - RNA, 16 nt, Brucella suis 1330
uaauugucaggaaaaa

SEQ ID NO: 2484649 - RNA, 14 nt, Brucella suis 1330
uaauugucggcguc

SEQ ID NO: 2484650 - RNA, 13 nt, Brucella suis 1330
uacaaguggcuuu

SEQ ID NO: 2484651 - RNA, 12 nt, Brucella suis 1330
uacacgcggcau

SEQ ID NO: 2484652 - RNA, 15 nt, Brucella suis 1330
uaccccucccucacc

SEQ ID NO: 2484653 - RNA, 21 nt, Brucella suis 1330
uaccgacggucggaauaucga

SEQ ID NO: 2484654 - RNA, 15 nt, Brucella suis 1330
uaccggcgugaucuc

SEQ ID NO: 2484655 - RNA, 18 nt, Brucella suis 1330
uaccucguucaacgagaa

SEQ ID NO: 2484656 - RNA, 14 nt, Brucella suis 1330
uacgcagcgucgca

SEQ ID NO: 2484657 - RNA, 17 nt, Brucella suis 1330
uacgcagcgucgcagac

SEQ ID NO: 2484658 - RNA, 16 nt, Brucella suis 1330
uacgccccgugaucuu

SEQ ID NO: 2484659 - RNA, 17 nt, Brucella suis 1330
uacgcucgcacaucggg

SEQ ID NO: 2484660 - RNA, 12 nt, Brucella suis 1330
uacgcugcccuu

SEQ ID NO: 2484661 - RNA, 18 nt, Brucella suis 1330
uacggcccucgaccgcca

SEQ ID NO: 2484662 - RNA, 15 nt, Brucella suis 1330
uacggugacaugggg

SEQ ID NO: 2484663 - RNA, 15 nt, Brucella suis 1330
uacgugcuaugcucu

SEQ ID NO: 2484664 - RNA, 21 nt, Brucella suis 1330
uacuccccuacucccuuauuc

SEQ ID NO: 2484665 - RNA, 15 nt, Brucella suis 1330
uagaacagcaagccc

SEQ ID NO: 2484666 - RNA, 20 nt, Brucella suis 1330
uagaccgucuggccugaagc

SEQ ID NO: 2484667 - RNA, 14 nt, Brucella suis 1330
uagacuucagccag

SEQ ID NO: 2484668 - RNA, 16 nt, Brucella suis 1330
uagagaacauauccug

SEQ ID NO: 2484669 - RNA, 13 nt, Brucella suis 1330
uagagaccuugau

SEQ ID NO: 2484670 - RNA, 15 nt, Brucella suis 1330
uagagcauuuccagc

SEQ ID NO: 2484671 - RNA, 17 nt, Brucella suis 1330
uagagcauuuccagcaa

SEQ ID NO: 2484672 - RNA, 14 nt, Brucella suis 1330
uagagcgcguuucg

SEQ ID NO: 2484673 - RNA, 15 nt, Brucella suis 1330
uagauaaacgcacca

SEQ ID NO: 2484674 - RNA, 15 nt, Brucella suis 1330
uagcaacuuccuugc

SEQ ID NO: 2484675 - RNA, 15 nt, Brucella suis 1330
uagcauugaaaggca

SEQ ID NO: 2484676 - RNA, 16 nt, Brucella suis 1330
uagccccagcccgccc

SEQ ID NO: 2484677 - RNA, 13 nt, Brucella suis 1330
uagccgccaagcc

SEQ ID NO: 2484678 - RNA, 19 nt, Brucella suis 1330
uagccgccaagccagcccg

SEQ ID NO: 2484679 - RNA, 15 nt, Brucella suis 1330
uagccgccugccuuc

SEQ ID NO: 2484680 - RNA, 23 nt, Brucella suis 1330
uagccguuaacggcguccuucag

SEQ ID NO: 2484681 - RNA, 16 nt, Brucella suis 1330
uagccuccauucaagc

SEQ ID NO: 2484682 - RNA, 17 nt, Brucella suis 1330
uagccugcaagcgcgac

SEQ ID NO: 2484683 - RNA, 19 nt, Brucella suis 1330
uagccuuucaccaauggcg

SEQ ID NO: 2484684 - RNA, 18 nt, Brucella suis 1330
uagcgcagaaugagcuug

SEQ ID NO: 2484685 - RNA, 22 nt, Brucella suis 1330
uagcgcagaaugagcuugcgcc

SEQ ID NO: 2484686 - RNA, 15 nt, Brucella suis 1330
uagcgcauggcagca

SEQ ID NO: 2484687 - RNA, 21 nt, Brucella suis 1330
uagcggcccgauuccuccggc

SEQ ID NO: 2484688 - RNA, 16 nt, Brucella suis 1330
uagcggcgaguugcca

SEQ ID NO: 2484689 - RNA, 22 nt, Brucella suis 1330
uagcggcgcggcaggaucgcca

SEQ ID NO: 2484690 - RNA, 20 nt, Brucella suis 1330
uagcggugcuggccguggca

SEQ ID NO: 2484691 - RNA, 14 nt, Brucella suis 1330
uagcugcuuugcug

SEQ ID NO: 2484692 - RNA, 14 nt, Brucella suis 1330
uagcuucuggguga

SEQ ID NO: 2484693 - RNA, 20 nt, Brucella suis 1330
uaggaaagaguucgcccguc

SEQ ID NO: 2484694 - RNA, 21 nt, Brucella suis 1330
ccgagcauggccugcgcaccg

SEQ ID NO: 2484695 - RNA, 21 nt, Brucella suis 1330
ccgagcggucgacagugaaau

SEQ ID NO: 2484696 - RNA, 18 nt, Brucella suis 1330
ccgagcuugcggcggauu

SEQ ID NO: 2484697 - RNA, 18 nt, Brucella suis 1330
ccgaggacuucauggcag

SEQ ID NO: 2484698 - RNA, 13 nt, Brucella suis 1330
ccgaggccgccac

SEQ ID NO: 2484699 - RNA, 12 nt, Brucella suis 1330
ccgaggcgcgca

SEQ ID NO: 2484700 - RNA, 17 nt, Brucella suis 1330
ccgaggcugaugcagca

SEQ ID NO: 2484701 - RNA, 21 nt, Brucella suis 1330
ccgaggggaacgacgcgcuaa

SEQ ID NO: 2484702 - RNA, 15 nt, Brucella suis 1330
ccgaggucgccaaga

SEQ ID NO: 2484703 - RNA, 19 nt, Brucella suis 1330
ccgauaaugcgaacaguuu

SEQ ID NO: 2484704 - RNA, 16 nt, Brucella suis 1330
ccgauacuguagaaaa

SEQ ID NO: 2484705 - RNA, 20 nt, Brucella suis 1330
ccgaucaggcaguccccgug

SEQ ID NO: 2484706 - RNA, 23 nt, Brucella suis 1330
ccgauccugcgcccugucagaaa

SEQ ID NO: 2484707 - RNA, 14 nt, Brucella suis 1330
ccgaugcagaugcc

SEQ ID NO: 2484708 - RNA, 15 nt, Brucella suis 1330
ccgauggcgaucacg

SEQ ID NO: 2484709 - RNA, 22 nt, Brucella suis 1330
ccgaugugauauccaccuggcc

SEQ ID NO: 2484710 - RNA, 18 nt, Brucella suis 1330
ccgauucauuauucguca

SEQ ID NO: 2484711 - RNA, 16 nt, Brucella suis 1330
ccgauugcggcguggg

SEQ ID NO: 2484712 - RNA, 13 nt, Brucella suis 1330
ccgcaaagagaac

SEQ ID NO: 2484713 - RNA, 18 nt, Brucella suis 1330
ccgcaaagagaaccaccu

SEQ ID NO: 2484714 - RNA, 19 nt, Brucella suis 1330
ccgcaaagagaaccaccuu

SEQ ID NO: 2484715 - RNA, 16 nt, Brucella suis 1330
ccgcaaaggcaggcac

SEQ ID NO: 2484716 - RNA, 12 nt, Brucella suis 1330
ccgcaaccagcg

SEQ ID NO: 2484717 - RNA, 13 nt, Brucella suis 1330
ccgcaauaacgaa

SEQ ID NO: 2484718 - RNA, 17 nt, Brucella suis 1330
ccgcaccgccgaucagg

SEQ ID NO: 2484719 - RNA, 15 nt, Brucella suis 1330
ccgcaccucuggaug

SEQ ID NO: 2484720 - RNA, 16 nt, Brucella suis 1330
ccgcacgcaaggcggc

SEQ ID NO: 2484721 - RNA, 13 nt, Brucella suis 1330
ccgcagcccggac

SEQ ID NO: 2484722 - RNA, 12 nt, Brucella suis 1330
ccgcagccgcca

SEQ ID NO: 2484723 - RNA, 13 nt, Brucella suis 1330
ccgcagccgccau

SEQ ID NO: 2484724 - RNA, 20 nt, Brucella suis 1330
ccgcaggaacgcaucgagcu

SEQ ID NO: 2484725 - RNA, 17 nt, Brucella suis 1330
ccgcagucaugcccaua

SEQ ID NO: 2484726 - RNA, 17 nt, Brucella suis 1330
ccgcauaaagcacagcc

SEQ ID NO: 2484727 - RNA, 19 nt, Brucella suis 1330
ccgcauaaagcacagccag

SEQ ID NO: 2484728 - RNA, 15 nt, Brucella suis 1330
ccgcauaggcuuuca

SEQ ID NO: 2484729 - RNA, 17 nt, Brucella suis 1330
ccgcauccgaaaugcgc

SEQ ID NO: 2484730 - RNA, 18 nt, Brucella suis 1330
ccgcaucggaagggcaag

SEQ ID NO: 2484731 - RNA, 12 nt, Brucella suis 1330
ccgcaucggccu

SEQ ID NO: 2484732 - RNA, 13 nt, Brucella suis 1330
ccgcaucggccug

SEQ ID NO: 2484733 - RNA, 18 nt, Brucella suis 1330
ccgcaucguaaucgccgg

SEQ ID NO: 2484734 - RNA, 22 nt, Brucella suis 1330
ccgcaucguaaucgccgggccu

SEQ ID NO: 2484735 - RNA, 19 nt, Brucella suis 1330
ccgcauugaugaagccaag

SEQ ID NO: 2484736 - RNA, 16 nt, Brucella suis 1330
ccgccaauccccucac

SEQ ID NO: 2484737 - RNA, 18 nt, Brucella suis 1330
ccgccagauccgcugacu

SEQ ID NO: 2484738 - RNA, 14 nt, Brucella suis 1330
ccgccagcauggcg

SEQ ID NO: 2484739 - RNA, 23 nt, Brucella suis 1330
ccgccagccgcaaucagccagaa

SEQ ID NO: 2484740 - RNA, 21 nt, Brucella suis 1330
ccgccaucaggucgagcgccu

SEQ ID NO: 2484741 - RNA, 14 nt, Brucella suis 1330
ccgccaugcccguc

SEQ ID NO: 2484742 - RNA, 19 nt, Brucella suis 1330
ccgccaugcccgucagcgc

SEQ ID NO: 2484743 - RNA, 16 nt, Brucella suis 1330
ccgcccgaauugcggc

SEQ ID NO: 2484744 - RNA, 13 nt, Brucella suis 1330
ccgcccgccgcaa

SEQ ID NO: 2484745 - RNA, 21 nt, Brucella suis 1330
ccgcccggaucaaaccggcca

SEQ ID NO: 2484746 - RNA, 17 nt, Brucella suis 1330
ccgcccgucuucggcgc

SEQ ID NO: 2484747 - RNA, 21 nt, Brucella suis 1330
ccgcccuggcggcgugcaggc

SEQ ID NO: 2484748 - RNA, 16 nt, Brucella suis 1330
ccgcccuugcgcaccg

SEQ ID NO: 2484749 - RNA, 21 nt, Brucella suis 1330
ccgcccuugcgcaccgcacgc

SEQ ID NO: 2484750 - RNA, 15 nt, Brucella suis 1330
ccgccgaaagccucg

SEQ ID NO: 2484751 - RNA, 15 nt, Brucella suis 1330
ccgccgaagcugcgc

SEQ ID NO: 2484752 - RNA, 20 nt, Brucella suis 1330
ccgccgcagaccacccggcc

SEQ ID NO: 2484753 - RNA, 12 nt, Brucella suis 1330
ccgccucccugc

SEQ ID NO: 2484754 - RNA, 13 nt, Brucella suis 1330
ccgccugcaauga

SEQ ID NO: 2484755 - RNA, 16 nt, Brucella suis 1330
ccgccugccagcccgc

SEQ ID NO: 2484756 - RNA, 15 nt, Brucella suis 1330
ccgccuggcccggcu

SEQ ID NO: 2484757 - RNA, 21 nt, Brucella suis 1330
ccgccuucaaaacgcagcauc

SEQ ID NO: 2484758 - RNA, 18 nt, Brucella suis 1330
ccgccuucgagaaccagc

SEQ ID NO: 2484759 - RNA, 17 nt, Brucella suis 1330
ccgccuucggcugcuuc

SEQ ID NO: 2484760 - RNA, 11 nt, Brucella suis 1330
ccgcgaaaaag

SEQ ID NO: 2484761 - RNA, 14 nt, Brucella suis 1330
ccgcgaaaaagccg

SEQ ID NO: 2484762 - RNA, 19 nt, Brucella suis 1330
ccgcgaacgauugggcgau

SEQ ID NO: 2484763 - RNA, 14 nt, Brucella suis 1330
ccgcgacacgucaa

SEQ ID NO: 2484764 - RNA, 14 nt, Brucella suis 1330
ccgcgacaucauca

SEQ ID NO: 2484765 - RNA, 19 nt, Brucella suis 1330
ccgcgacaucaucaaggaa

SEQ ID NO: 2484766 - RNA, 15 nt, Brucella suis 1330
ccgcgacgaugggcg

SEQ ID NO: 2484767 - RNA, 12 nt, Brucella suis 1330
ccgcgacgccgc

SEQ ID NO: 2484768 - RNA, 19 nt, Brucella suis 1330
ccgcgaggaagccugcacc

SEQ ID NO: 2484769 - RNA, 17 nt, Brucella suis 1330
ccgcgauaucgucgcgc

SEQ ID NO: 2484770 - RNA, 21 nt, Brucella suis 1330
ccgcgaucacagccgcgccaa

SEQ ID NO: 2484771 - RNA, 14 nt, Brucella suis 1330
ccgcgaucaguucg

SEQ ID NO: 2484772 - RNA, 22 nt, Brucella suis 1330
ccgcgccaauccaggucagcgg

SEQ ID NO: 2484773 - RNA, 15 nt, Brucella suis 1330
ccgcgccaugccauc

SEQ ID NO: 2484774 - RNA, 21 nt, Brucella suis 1330
ccgcgccaugccauccucgcc

SEQ ID NO: 2484775 - RNA, 22 nt, Brucella suis 1330
ccgcgccaugccauccucgcca

SEQ ID NO: 2484776 - RNA, 13 nt, Brucella suis 1330
ccgcgcccuggcu

SEQ ID NO: 2484777 - RNA, 14 nt, Brucella suis 1330
ccgcgccgaucauc

SEQ ID NO: 2484778 - RNA, 18 nt, Brucella suis 1330
ccgcgccggaaggcgggg

SEQ ID NO: 2484779 - RNA, 17 nt, Brucella suis 1330
ccgcgccucacccucca

SEQ ID NO: 2484780 - RNA, 20 nt, Brucella suis 1330
ccgcgcggucaguggaucga

SEQ ID NO: 2484781 - RNA, 21 nt, Brucella suis 1330
ccgcgcguaucuucaagcucg

SEQ ID NO: 2484782 - RNA, 17 nt, Brucella suis 1330
ccgcgcugaagcggccu

SEQ ID NO: 2484783 - RNA, 15 nt, Brucella suis 1330
ccgcgcuucuucauu

SEQ ID NO: 2484784 - RNA, 17 nt, Brucella suis 1330
ccgcggaugacgccgcu

SEQ ID NO: 2484785 - RNA, 22 nt, Brucella suis 1330
ccgcggccggucaagaggaacg

SEQ ID NO: 2484786 - RNA, 18 nt, Brucella suis 1330
ccgcggguucccugugga

SEQ ID NO: 2484787 - RNA, 12 nt, Brucella suis 1330
ccgcguccuuuu

SEQ ID NO: 2484788 - RNA, 15 nt, Brucella suis 1330
ccgcgugaaaagcac

SEQ ID NO: 2484789 - RNA, 17 nt, Brucella suis 1330
ccgcgugaaaagcacac

SEQ ID NO: 2484790 - RNA, 18 nt, Brucella suis 1330
ccgcgugaagaauggcaa

SEQ ID NO: 2484791 - RNA, 21 nt, Brucella suis 1330
ccgcgugaagaauggcaagca

SEQ ID NO: 2484792 - RNA, 17 nt, Brucella suis 1330
ccgcguugcccaugucc

SEQ ID NO: 2484793 - RNA, 13 nt, Brucella suis 1330
ccgcucaccacau

SEQ ID NO: 2484794 - RNA, 21 nt, Brucella suis 1330
ccgcuccagccgagcgccaga

SEQ ID NO: 2484795 - RNA, 11 nt, Brucella suis 1330
ccgcuccuggu

SEQ ID NO: 2484796 - RNA, 16 nt, Brucella suis 1330
ccgcucgcccuccgga

SEQ ID NO: 2484797 - RNA, 15 nt, Brucella suis 1330
ccgcucgcgcaucgc

SEQ ID NO: 2484798 - RNA, 19 nt, Brucella suis 1330
ccgcucucggcuccggauc

SEQ ID NO: 2484799 - RNA, 22 nt, Brucella suis 1330
ccgcucugaucuaguggagcac

SEQ ID NO: 2484800 - RNA, 24 nt, Brucella suis 1330
ccgcugaggcggccggagcgcaga

SEQ ID NO: 2484801 - RNA, 15 nt, Brucella suis 1330
ccgcugcaccgggcc

SEQ ID NO: 2484802 - RNA, 14 nt, Brucella suis 1330
ccgcugccagcuac

SEQ ID NO: 2484803 - RNA, 12 nt, Brucella suis 1330
ccgcugcgccgc

SEQ ID NO: 2484804 - RNA, 20 nt, Brucella suis 1330
ccgcuggugcgauccaccau

SEQ ID NO: 2484805 - RNA, 21 nt, Brucella suis 1330
ccgcuuccagcauccgcucgc

SEQ ID NO: 2484806 - RNA, 18 nt, Brucella suis 1330
ccgcuucgcugcgguagc

SEQ ID NO: 2484807 - RNA, 14 nt, Brucella suis 1330
ccgcuucugcucac

SEQ ID NO: 2484808 - RNA, 15 nt, Brucella suis 1330
ccgcuucuggauuug

SEQ ID NO: 2484809 - RNA, 21 nt, Brucella suis 1330
ccgcuuuucauguuuucccag

SEQ ID NO: 2484810 - RNA, 13 nt, Brucella suis 1330
ccggaaacaccgc

SEQ ID NO: 2484811 - RNA, 16 nt, Brucella suis 1330
ccuccugugcauugcc

SEQ ID NO: 2484812 - RNA, 15 nt, Brucella suis 1330
ccucgaagucgccag

SEQ ID NO: 2484813 - RNA, 20 nt, Brucella suis 1330
ccucgaagucgccagcggug

SEQ ID NO: 2484814 - RNA, 18 nt, Brucella suis 1330
ccucgaauuccaccgccu

SEQ ID NO: 2484815 - RNA, 22 nt, Brucella suis 1330
ccucgacagcacugccaccauc

SEQ ID NO: 2484816 - RNA, 14 nt, Brucella suis 1330
ccucgaccgccacc

SEQ ID NO: 2484817 - RNA, 22 nt, Brucella suis 1330
ccucgaucacccgaucaccgca

SEQ ID NO: 2484818 - RNA, 19 nt, Brucella suis 1330
ccucgaucacgaaagucug

SEQ ID NO: 2484819 - RNA, 14 nt, Brucella suis 1330
ccucgaucggugca

SEQ ID NO: 2484820 - RNA, 13 nt, Brucella suis 1330
ccucgauuuuugg

SEQ ID NO: 2484821 - RNA, 17 nt, Brucella suis 1330
ccucgcccugcuucaca

SEQ ID NO: 2484822 - RNA, 19 nt, Brucella suis 1330
ccucgcgauugcgcuccug

SEQ ID NO: 2484823 - RNA, 20 nt, Brucella suis 1330
ccucgcgccagacaaggcgc

SEQ ID NO: 2484824 - RNA, 19 nt, Brucella suis 1330
ccucgcggaucagcuugcc

SEQ ID NO: 2484825 - RNA, 20 nt, Brucella suis 1330
ccucggaaaaguccuuuccg

SEQ ID NO: 2484826 - RNA, 18 nt, Brucella suis 1330
ccucggcccuggaaagaa

SEQ ID NO: 2484827 - RNA, 20 nt, Brucella suis 1330
ccucgggcagggucaaaaug

SEQ ID NO: 2484828 - RNA, 18 nt, Brucella suis 1330
ccucgggcagugaaagcc

SEQ ID NO: 2484829 - RNA, 14 nt, Brucella suis 1330
ccucggugcagccg

SEQ ID NO: 2484830 - RNA, 14 nt, Brucella suis 1330
ccucgucaaaaccg

SEQ ID NO: 2484831 - RNA, 12 nt, Brucella suis 1330
ccucgucggcga

SEQ ID NO: 2484832 - RNA, 19 nt, Brucella suis 1330
ccucguggaucgacaggcg

SEQ ID NO: 2484833 - RNA, 14 nt, Brucella suis 1330
ccucguuugcacuu

SEQ ID NO: 2484834 - RNA, 21 nt, Brucella suis 1330
ccucuaaucgcgagcagcgcg

SEQ ID NO: 2484835 - RNA, 23 nt, Brucella suis 1330
ccucugccuccauggcgucccca

SEQ ID NO: 2484836 - RNA, 21 nt, Brucella suis 1330
ccucuucguccucgcgccaga

SEQ ID NO: 2484837 - RNA, 14 nt, Brucella suis 1330
ccugacccauggcc

SEQ ID NO: 2484838 - RNA, 21 nt, Brucella suis 1330
ccugacccggccuuugcgccg

SEQ ID NO: 2484839 - RNA, 18 nt, Brucella suis 1330
ccugaccggccacccagc

SEQ ID NO: 2484840 - RNA, 22 nt, Brucella suis 1330
ccugaccggccacccagcccga

SEQ ID NO: 2484841 - RNA, 16 nt, Brucella suis 1330
ccugagaucgaugcgc

SEQ ID NO: 2484842 - RNA, 15 nt, Brucella suis 1330
ccugauccagaagcc

SEQ ID NO: 2484843 - RNA, 21 nt, Brucella suis 1330
ccugaugccguuuucaucaaa

SEQ ID NO: 2484844 - RNA, 13 nt, Brucella suis 1330
ccugcacaucacc

SEQ ID NO: 2484845 - RNA, 19 nt, Brucella suis 1330
ccugcaccggcccaaaggc

SEQ ID NO: 2484846 - RNA, 17 nt, Brucella suis 1330
ccugcacgucaccauau

SEQ ID NO: 2484847 - RNA, 21 nt, Brucella suis 1330
ccugcauaucgauaucaugcu

SEQ ID NO: 2484848 - RNA, 15 nt, Brucella suis 1330
ccugccagcggcaga

SEQ ID NO: 2484849 - RNA, 20 nt, Brucella suis 1330
ccugccaucaccagccccca

SEQ ID NO: 2484850 - RNA, 21 nt, Brucella suis 1330
ccugccaucaccagcccccag

SEQ ID NO: 2484851 - RNA, 16 nt, Brucella suis 1330
ccugccaugccgccaa

SEQ ID NO: 2484852 - RNA, 16 nt, Brucella suis 1330
ccugcccgucuuccuc

SEQ ID NO: 2484853 - RNA, 22 nt, Brucella suis 1330
ccugccgcgccgaaccgggccg

SEQ ID NO: 2484854 - RNA, 14 nt, Brucella suis 1330
ccugcgaugcgcca

SEQ ID NO: 2484855 - RNA, 22 nt, Brucella suis 1330
ccugcgaugcgccagcgaugau

SEQ ID NO: 2484856 - RNA, 21 nt, Brucella suis 1330
ccugcgccagcgauugcgcau

SEQ ID NO: 2484857 - RNA, 13 nt, Brucella suis 1330
ccugcgcccauuc

SEQ ID NO: 2484858 - RNA, 19 nt, Brucella suis 1330
ccugcgcccauucaaugcc

SEQ ID NO: 2484859 - RNA, 19 nt, Brucella suis 1330
ccugcggaaugcccuggau

SEQ ID NO: 2484860 - RNA, 16 nt, Brucella suis 1330
ccugcggcaguucguu

SEQ ID NO: 2484861 - RNA, 19 nt, Brucella suis 1330
ccugcgucgcauccagaac

SEQ ID NO: 2484862 - RNA, 17 nt, Brucella suis 1330
ccugcugcgcggcauug

SEQ ID NO: 2484863 - RNA, 17 nt, Brucella suis 1330
ccugcugcuucgcaaaa

SEQ ID NO: 2484864 - RNA, 20 nt, Brucella suis 1330
ccugcuucaucgcggcagcc

SEQ ID NO: 2484865 - RNA, 22 nt, Brucella suis 1330
ccugcuucaucgcggcagccgc

SEQ ID NO: 2484866 - RNA, 12 nt, Brucella suis 1330
ccugcuuccuuu

SEQ ID NO: 2484867 - RNA, 14 nt, Brucella suis 1330
ccuggaugcggaac

SEQ ID NO: 2484868 - RNA, 16 nt, Brucella suis 1330
ccuggccgccgccgaa

SEQ ID NO: 2484869 - RNA, 12 nt, Brucella suis 1330
ccuggccggcgc

SEQ ID NO: 2484870 - RNA, 22 nt, Brucella suis 1330
ccuggcgaaaacggccaugcgc

SEQ ID NO: 2484871 - RNA, 12 nt, Brucella suis 1330
ccuggcuuuucu

SEQ ID NO: 2484872 - RNA, 22 nt, Brucella suis 1330
ccuguagacgaacucgaugccu

SEQ ID NO: 2484873 - RNA, 18 nt, Brucella suis 1330
ccugucagcgccgcccag

SEQ ID NO: 2484874 - RNA, 13 nt, Brucella suis 1330
ccugucccuucuu

SEQ ID NO: 2484875 - RNA, 20 nt, Brucella suis 1330
ccugucuuuuccgcugccag

SEQ ID NO: 2484876 - RNA, 19 nt, Brucella suis 1330
ccuguggagagaggaagca

SEQ ID NO: 2484877 - RNA, 23 nt, Brucella suis 1330
ccuguggcuguuucgcauugccc

SEQ ID NO: 2484878 - RNA, 17 nt, Brucella suis 1330
ccuuaaccuuuuuccug

SEQ ID NO: 2484879 - RNA, 15 nt, Brucella suis 1330
ccuuauaggcgcgcg

SEQ ID NO: 2484880 - RNA, 14 nt, Brucella suis 1330
ccuuauccugaugg

SEQ ID NO: 2484881 - RNA, 15 nt, Brucella suis 1330
ccuucaacagcccga

SEQ ID NO: 2484882 - RNA, 16 nt, Brucella suis 1330
ccuucacauauugugc

SEQ ID NO: 2484883 - RNA, 15 nt, Brucella suis 1330
ccuucaggccgucga

SEQ ID NO: 2484884 - RNA, 19 nt, Brucella suis 1330
ccuuccguugcagcccaac

SEQ ID NO: 2484885 - RNA, 16 nt, Brucella suis 1330
ccuuccugacccaugg

SEQ ID NO: 2484886 - RNA, 13 nt, Brucella suis 1330
ccuuccugauuua

SEQ ID NO: 2484887 - RNA, 21 nt, Brucella suis 1330
ccuuccugcggcagcgacccg

SEQ ID NO: 2484888 - RNA, 20 nt, Brucella suis 1330
ccuucgaguucgccagcacc

SEQ ID NO: 2484889 - RNA, 12 nt, Brucella suis 1330
ccuucgcgccag

SEQ ID NO: 2484890 - RNA, 19 nt, Brucella suis 1330
ccuucgcgccaggcuucgg

SEQ ID NO: 2484891 - RNA, 15 nt, Brucella suis 1330
ccuucggagcgcguu

SEQ ID NO: 2484892 - RNA, 13 nt, Brucella suis 1330
ccuucggcugcuu

SEQ ID NO: 2484893 - RNA, 17 nt, Brucella suis 1330
ccuucuggaaaagugca

SEQ ID NO: 2484894 - RNA, 19 nt, Brucella suis 1330
ccuugaaaccaaagcgucc

SEQ ID NO: 2484895 - RNA, 17 nt, Brucella suis 1330
ccuugaaaucauugcgc

SEQ ID NO: 2484896 - RNA, 15 nt, Brucella suis 1330
ccuugaacuugucgc

SEQ ID NO: 2484897 - RNA, 22 nt, Brucella suis 1330
ccuugacggagagagggccgcu

SEQ ID NO: 2484898 - RNA, 22 nt, Brucella suis 1330
ccuugauccgucacggucagau

SEQ ID NO: 2484899 - RNA, 22 nt, Brucella suis 1330
ccuugaucguauagcccugauc

SEQ ID NO: 2484900 - RNA, 17 nt, Brucella suis 1330
ccuugaugauagaauaa

SEQ ID NO: 2484901 - RNA, 17 nt, Brucella suis 1330
ccuugcagaugagcggc

SEQ ID NO: 2484902 - RNA, 22 nt, Brucella suis 1330
ccuugccaucuucacccacgcc

SEQ ID NO: 2484903 - RNA, 14 nt, Brucella suis 1330
ccuugccccggcac

SEQ ID NO: 2484904 - RNA, 18 nt, Brucella suis 1330
ccuugccccggcaccgcg

SEQ ID NO: 2484905 - RNA, 21 nt, Brucella suis 1330
ccuugccccggcaccgcgcaa

SEQ ID NO: 2484906 - RNA, 18 nt, Brucella suis 1330
ccuugccgccuuucaugc

SEQ ID NO: 2484907 - RNA, 20 nt, Brucella suis 1330
ccuugccgucaacagccuug

SEQ ID NO: 2484908 - RNA, 17 nt, Brucella suis 1330
ccuugccgucaccauuc

SEQ ID NO: 2484909 - RNA, 22 nt, Brucella suis 1330
ccuugccgucggcgccgucguu

SEQ ID NO: 2484910 - RNA, 18 nt, Brucella suis 1330
ccuugcgauuuccuugcc

SEQ ID NO: 2484911 - RNA, 20 nt, Brucella suis 1330
ccuugcgcaccgcacgcaag

SEQ ID NO: 2484912 - RNA, 18 nt, Brucella suis 1330
ccuugcggauaucgcugg

SEQ ID NO: 2484913 - RNA, 17 nt, Brucella suis 1330
ccuugcgguugcaacga

SEQ ID NO: 2484914 - RNA, 22 nt, Brucella suis 1330
ccuugcuggucguuugccucgg

SEQ ID NO: 2484915 - RNA, 14 nt, Brucella suis 1330
ccuugcuugaagca

SEQ ID NO: 2484916 - RNA, 22 nt, Brucella suis 1330
ccuuggcaucaaccuuuucggc

SEQ ID NO: 2484917 - RNA, 12 nt, Brucella suis 1330
ccuuggcuucca

SEQ ID NO: 2484918 - RNA, 23 nt, Brucella suis 1330
ccuugugaucgccacucuugugg

SEQ ID NO: 2484919 - RNA, 15 nt, Brucella suis 1330
ccuuucaccaauggc

SEQ ID NO: 2484920 - RNA, 20 nt, Brucella suis 1330
ccuuuccggcggcggcgcca

SEQ ID NO: 2484921 - RNA, 22 nt, Brucella suis 1330
ccuuuucagcggagauuucacc

SEQ ID NO: 2484922 - RNA, 13 nt, Brucella suis 1330
ccuuuuccgcacc

SEQ ID NO: 2484923 - RNA, 18 nt, Brucella suis 1330
ccuuuucggcuuccuugc

SEQ ID NO: 2484924 - RNA, 13 nt, Brucella suis 1330
ccuuuucuucauc

SEQ ID NO: 2484925 - RNA, 16 nt, Brucella suis 1330
ccuuuucuucauccag

SEQ ID NO: 2484926 - RNA, 12 nt, Brucella suis 1330
cgaaaaaagaau

SEQ ID NO: 2484927 - RNA, 22 nt, Brucella suis 1330
cgagaucgaccgccuugagauc

SEQ ID NO: 2484928 - RNA, 12 nt, Brucella suis 1330
cgagaucgucug

SEQ ID NO: 2484929 - RNA, 16 nt, Brucella suis 1330
cgagauugggcgcgcu

SEQ ID NO: 2484930 - RNA, 20 nt, Brucella suis 1330
cgagcaaugcgccgugcagg

SEQ ID NO: 2484931 - RNA, 14 nt, Brucella suis 1330
cgagcagcaucuug

SEQ ID NO: 2484932 - RNA, 16 nt, Brucella suis 1330
cgagcaggcggucgcu

SEQ ID NO: 2484933 - RNA, 18 nt, Brucella suis 1330
cgagccgacaucgcgcuu

SEQ ID NO: 2484934 - RNA, 14 nt, Brucella suis 1330
cgagcgcagcggca

SEQ ID NO: 2484935 - RNA, 17 nt, Brucella suis 1330
cgagcgcaucggccagc

SEQ ID NO: 2484936 - RNA, 22 nt, Brucella suis 1330
cgagcgcgcuuaugaucuggcc

SEQ ID NO: 2484937 - RNA, 17 nt, Brucella suis 1330
cgagcggaagaggacaa

SEQ ID NO: 2484938 - RNA, 14 nt, Brucella suis 1330
cgagcggcaggccg

SEQ ID NO: 2484939 - RNA, 23 nt, Brucella suis 1330
cgagcggcauggcguagaaauag

SEQ ID NO: 2484940 - RNA, 19 nt, Brucella suis 1330
cgagcgugaucucauccac

SEQ ID NO: 2484941 - RNA, 18 nt, Brucella suis 1330
cgagcugacgaauaauga

SEQ ID NO: 2484942 - RNA, 17 nt, Brucella suis 1330
cgaggaaaaagcccgcc

SEQ ID NO: 2484943 - RNA, 22 nt, Brucella suis 1330
cgaggaaaaagcccgccacgag

SEQ ID NO: 2484944 - RNA, 18 nt, Brucella suis 1330
cgaggaaauugacgccau

SEQ ID NO: 2484945 - RNA, 18 nt, Brucella suis 1330
cgaggaauuucagcgaag

SEQ ID NO: 2484946 - RNA, 22 nt, Brucella suis 1330
cgaggaauuucagcgaagcgau

SEQ ID NO: 2484947 - RNA, 12 nt, Brucella suis 1330
cgaggaucggca

SEQ ID NO: 2484948 - RNA, 15 nt, Brucella suis 1330
cgaggcagccacggc

SEQ ID NO: 2484949 - RNA, 12 nt, Brucella suis 1330
cgagggguuuuu

SEQ ID NO: 2484950 - RNA, 20 nt, Brucella suis 1330
cgagggugaaaccguggaaa

SEQ ID NO: 2484951 - RNA, 20 nt, Brucella suis 1330
cgaggucucccggcacgacc

SEQ ID NO: 2484952 - RNA, 17 nt, Brucella suis 1330
cgaguaucuggcgauaa

SEQ ID NO: 2484953 - RNA, 13 nt, Brucella suis 1330
cgagugugcauuc

SEQ ID NO: 2484954 - RNA, 20 nt, Brucella suis 1330
cgauaaagaugcgcgccagc

SEQ ID NO: 2484955 - RNA, 23 nt, Brucella suis 1330
cgauaagcucgauaagauugcgg

SEQ ID NO: 2484956 - RNA, 22 nt, Brucella suis 1330
cgauacagcccaugacagcaac

SEQ ID NO: 2484957 - RNA, 16 nt, Brucella suis 1330
cgauaccgacggucgg

SEQ ID NO: 2484958 - RNA, 15 nt, Brucella suis 1330
cgauauagagcagca

SEQ ID NO: 2484959 - RNA, 18 nt, Brucella suis 1330
cgauaucaccaauauugc

SEQ ID NO: 2484960 - RNA, 19 nt, Brucella suis 1330
cgauauccucgaaagcgca

SEQ ID NO: 2484961 - RNA, 13 nt, Brucella suis 1330
cgauauccuggcc

SEQ ID NO: 2484962 - RNA, 21 nt, Brucella suis 1330
cgauauccuggccuuccuuga

SEQ ID NO: 2484963 - RNA, 15 nt, Brucella suis 1330
cgauaucgagcacga

SEQ ID NO: 2484964 - RNA, 18 nt, Brucella suis 1330
cgauaucggcauguuucg

SEQ ID NO: 2484965 - RNA, 15 nt, Brucella suis 1330
cgaucaaacccucau

SEQ ID NO: 2484966 - RNA, 12 nt, Brucella suis 1330
cgaucaccagcc

SEQ ID NO: 2484967 - RNA, 16 nt, Brucella suis 1330
cgaucaccucgcccug

SEQ ID NO: 2484968 - RNA, 18 nt, Brucella suis 1330
cgaucacgaaagucugga

SEQ ID NO: 2484969 - RNA, 21 nt, Brucella suis 1330
cgaucacgaccuucuuggagc

SEQ ID NO: 2484970 - RNA, 20 nt, Brucella suis 1330
cgaucacggccauugcccaa

SEQ ID NO: 2484971 - RNA, 11 nt, Brucella suis 1330
cgaucaucaau

SEQ ID NO: 2484972 - RNA, 17 nt, Brucella suis 1330
cgaucaucagcggcggg

SEQ ID NO: 2484973 - RNA, 19 nt, Brucella suis 1330
cgaucaucaucaccggcag

SEQ ID NO: 2484974 - RNA, 21 nt, Brucella suis 1330
cgaucauugccccaaggcgca

SEQ ID NO: 2484975 - RNA, 12 nt, Brucella suis 1330
cgauccaccauc

SEQ ID NO: 2484976 - RNA, 21 nt, Brucella suis 1330
cgauccaguugucgccgggcu

SEQ ID NO: 2484977 - RNA, 20 nt, Brucella suis 1330
cgauccugcugcgcggcauu

SEQ ID NO: 2484978 - RNA, 13 nt, Brucella suis 1330
cgaucgacccgcc

SEQ ID NO: 2484979 - RNA, 17 nt, Brucella suis 1330
cgaucgguggcugcaau

SEQ ID NO: 2484980 - RNA, 18 nt, Brucella suis 1330
cgaucgugucgcgauggc

SEQ ID NO: 2484981 - RNA, 15 nt, Brucella suis 1330
cgaucugagaaagcu

SEQ ID NO: 2484982 - RNA, 13 nt, Brucella suis 1330
cgaucuggaacag

SEQ ID NO: 2484983 - RNA, 14 nt, Brucella suis 1330
cgaucuggccgaua

SEQ ID NO: 2484984 - RNA, 18 nt, Brucella suis 1330
cgaugaagaccuggaacg

SEQ ID NO: 2484985 - RNA, 23 nt, Brucella suis 1330
cgaugaccaccgcgaaagcaccc

SEQ ID NO: 2484986 - RNA, 21 nt, Brucella suis 1330
cgaugacgagccucgcccugc

SEQ ID NO: 2484987 - RNA, 15 nt, Brucella suis 1330
cgaugacggagcguc

SEQ ID NO: 2484988 - RNA, 19 nt, Brucella suis 1330
cgaugacggcgcggcgcau

SEQ ID NO: 2484989 - RNA, 15 nt, Brucella suis 1330
cgaugacuuccggga

SEQ ID NO: 2484990 - RNA, 18 nt, Brucella suis 1330
cgaugacuuccgggaauu

SEQ ID NO: 2484991 - RNA, 22 nt, Brucella suis 1330
cgaugaggccgguaauaacuuc

SEQ ID NO: 2484992 - RNA, 18 nt, Brucella suis 1330
cgaugauauucggccagc

SEQ ID NO: 2484993 - RNA, 14 nt, Brucella suis 1330
cgaugaucugcgug

SEQ ID NO: 2484994 - RNA, 21 nt, Brucella suis 1330
cgaugaucuguucagccgcag

SEQ ID NO: 2484995 - RNA, 12 nt, Brucella suis 1330
cgaugaugaucc

SEQ ID NO: 2484996 - RNA, 18 nt, Brucella suis 1330
cgaugaugaugacggcga

SEQ ID NO: 2484997 - RNA, 19 nt, Brucella suis 1330
cgaugccugccaugccgaa

SEQ ID NO: 2484998 - RNA, 13 nt, Brucella suis 1330
cgaugccugccgg

SEQ ID NO: 2484999 - RNA, 13 nt, Brucella suis 1330
cgaugcgaaacgg

SEQ ID NO: 2485000 - RNA, 19 nt, Brucella suis 1330
cgauggaaggaaagcccag

SEQ ID NO: 2485001 - RNA, 22 nt, Brucella suis 1330
cgauggccgaaccguccgguug

SEQ ID NO: 2485002 - RNA, 16 nt, Brucella suis 1330
cgauggcgaucacgaa

SEQ ID NO: 2485003 - RNA, 21 nt, Brucella suis 1330
cgauggcguucgucaaugcgc

SEQ ID NO: 2485004 - RNA, 22 nt, Brucella suis 1330
cgauuaccggaacaaguuccuu

SEQ ID NO: 2485005 - RNA, 22 nt, Brucella suis 1330
cgauugccccgccauaaagcac

SEQ ID NO: 2485006 - RNA, 16 nt, Brucella suis 1330
cgauugcgcauugaca

SEQ ID NO: 2485007 - RNA, 16 nt, Brucella suis 1330
cgauugucccgccaug

SEQ ID NO: 2485008 - RNA, 16 nt, Brucella suis 1330
cgauugucgagccgca

SEQ ID NO: 2485009 - RNA, 17 nt, Brucella suis 1330
cgauugucgagccgcaa

SEQ ID NO: 2485010 - RNA, 22 nt, Brucella suis 1330
cgauugugaccagagagcggau

SEQ ID NO: 2485011 - RNA, 21 nt, Brucella suis 1330
cgauuguuuccagagcgguuc

SEQ ID NO: 2485012 - RNA, 18 nt, Brucella suis 1330
cgauuugcgcaccagauu

SEQ ID NO: 2485013 - RNA, 17 nt, Brucella suis 1330
cgcaaaagagaaacccc

SEQ ID NO: 2485014 - RNA, 12 nt, Brucella suis 1330
cgcaaagagaac

SEQ ID NO: 2485015 - RNA, 21 nt, Brucella suis 1330
cgcaaagcgaacgcacugcaa

SEQ ID NO: 2485016 - RNA, 19 nt, Brucella suis 1330
cgcaaaggcaggcacaccc

SEQ ID NO: 2485017 - RNA, 18 nt, Brucella suis 1330
cgcaaaggccggguuuuu

SEQ ID NO: 2485018 - RNA, 19 nt, Brucella suis 1330
cgcaaaucgucggccaguu

SEQ ID NO: 2485019 - RNA, 21 nt, Brucella suis 1330
cgcaacaagacggaucagcga

SEQ ID NO: 2485020 - RNA, 15 nt, Brucella suis 1330
cgcaaccaaaacaua

SEQ ID NO: 2485021 - RNA, 15 nt, Brucella suis 1330
cgcaaccaugcguuu

SEQ ID NO: 2485022 - RNA, 14 nt, Brucella suis 1330
cgcaaccggcgggc

SEQ ID NO: 2485023 - RNA, 19 nt, Brucella suis 1330
cgcaaccgguucagcccug

SEQ ID NO: 2485024 - RNA, 21 nt, Brucella suis 1330
cgcaacgcaauggagcaggaa

SEQ ID NO: 2485025 - RNA, 16 nt, Brucella suis 1330
cgcaacucauggaagu

SEQ ID NO: 2485026 - RNA, 21 nt, Brucella suis 1330
cgcaagacccaauccgccaac

SEQ ID NO: 2485027 - RNA, 17 nt, Brucella suis 1330
cgcaagccaaagcccgu

SEQ ID NO: 2485028 - RNA, 21 nt, Brucella suis 1330
cgcaagccaguccuugcccuc

SEQ ID NO: 2485029 - RNA, 18 nt, Brucella suis 1330
cgcaagcggcucgaccgu

SEQ ID NO: 2485030 - RNA, 15 nt, Brucella suis 1330
cgcaagcuggaacca

SEQ ID NO: 2485031 - RNA, 13 nt, Brucella suis 1330
cgcaaggcggcgc

SEQ ID NO: 2485032 - RNA, 15 nt, Brucella suis 1330
cgcaagggccgcauc

SEQ ID NO: 2485033 - RNA, 16 nt, Brucella suis 1330
cgcaagggccgcaucg

SEQ ID NO: 2485034 - RNA, 21 nt, Brucella suis 1330
cgcaaguuccgcauugaugaa

SEQ ID NO: 2485035 - RNA, 14 nt, Brucella suis 1330
cgcaauaaugcagc

SEQ ID NO: 2485036 - RNA, 19 nt, Brucella suis 1330
cgcaauaauuaugcaggaa

SEQ ID NO: 2485037 - RNA, 15 nt, Brucella suis 1330
cgcaaugagcccgcg

SEQ ID NO: 2485038 - RNA, 14 nt, Brucella suis 1330
cgcaauggccuugc

SEQ ID NO: 2485039 - RNA, 19 nt, Brucella suis 1330
cgcaauggcugucaaugca

SEQ ID NO: 2485040 - RNA, 21 nt, Brucella suis 1330
cgcaauggcugucaaugcagc

SEQ ID NO: 2485041 - RNA, 23 nt, Brucella suis 1330
cgcaauucaugcccuauaccgcc

SEQ ID NO: 2485042 - RNA, 20 nt, Brucella suis 1330
cgcaauuccggcaucgcugg

SEQ ID NO: 2485043 - RNA, 14 nt, Brucella suis 1330
cgcccgucucgcag

SEQ ID NO: 2485044 - RNA, 17 nt, Brucella suis 1330
cgcccgucuucggcgca

SEQ ID NO: 2485045 - RNA, 14 nt, Brucella suis 1330
cgcccgugccgcgu

SEQ ID NO: 2485046 - RNA, 15 nt, Brucella suis 1330
cgcccgugccgcguu

SEQ ID NO: 2485047 - RNA, 21 nt, Brucella suis 1330
cgcccgugccgcguucagcca

SEQ ID NO: 2485048 - RNA, 13 nt, Brucella suis 1330
cgcccuccaccgc

SEQ ID NO: 2485049 - RNA, 20 nt, Brucella suis 1330
cgcccucgaucagcaccauc

SEQ ID NO: 2485050 - RNA, 22 nt, Brucella suis 1330
cgcccugcacaucaucggucag

SEQ ID NO: 2485051 - RNA, 16 nt, Brucella suis 1330
cgcccuggcggcgugc

SEQ ID NO: 2485052 - RNA, 15 nt, Brucella suis 1330
cgccgaaaagcgccu

SEQ ID NO: 2485053 - RNA, 19 nt, Brucella suis 1330
cgccgaaaaucggcacuuc

SEQ ID NO: 2485054 - RNA, 15 nt, Brucella suis 1330
cgccgaaacgcccga

SEQ ID NO: 2485055 - RNA, 14 nt, Brucella suis 1330
cgccgaagccaggc

SEQ ID NO: 2485056 - RNA, 21 nt, Brucella suis 1330
cgccgacaaaaaacaccgcgc

SEQ ID NO: 2485057 - RNA, 18 nt, Brucella suis 1330
cgccgacgauuucuucca

SEQ ID NO: 2485058 - RNA, 21 nt, Brucella suis 1330
cgccgagauugggcagcagau

SEQ ID NO: 2485059 - RNA, 19 nt, Brucella suis 1330
cgccgaucaggaccggcga

SEQ ID NO: 2485060 - RNA, 13 nt, Brucella suis 1330
cgccgauccggcg

SEQ ID NO: 2485061 - RNA, 15 nt, Brucella suis 1330
cgccgcaaccggcgg

SEQ ID NO: 2485062 - RNA, 14 nt, Brucella suis 1330
cgccgcacuuacaa

SEQ ID NO: 2485063 - RNA, 18 nt, Brucella suis 1330
cgccgcagaccacccggc

SEQ ID NO: 2485064 - RNA, 20 nt, Brucella suis 1330
cgccgcauggcggcacccgc

SEQ ID NO: 2485065 - RNA, 19 nt, Brucella suis 1330
cgccgccaagggccgccga

SEQ ID NO: 2485066 - RNA, 24 nt, Brucella suis 1330
cgccgccauggucgcgcaccagcu

SEQ ID NO: 2485067 - RNA, 20 nt, Brucella suis 1330
cgccgcccaggaccgcgcag

SEQ ID NO: 2485068 - RNA, 21 nt, Brucella suis 1330
cgccgcccaggaccgcgcaga

SEQ ID NO: 2485069 - RNA, 12 nt, Brucella suis 1330
cgccgccgcgac

SEQ ID NO: 2485070 - RNA, 15 nt, Brucella suis 1330
cgccgccgcgcggca

SEQ ID NO: 2485071 - RNA, 22 nt, Brucella suis 1330
cgccgccuccucgauugccucg

SEQ ID NO: 2485072 - RNA, 22 nt, Brucella suis 1330
cgccgccuucaaaacgcagcau

SEQ ID NO: 2485073 - RNA, 23 nt, Brucella suis 1330
cgccgccuucaaaacgcagcauc

SEQ ID NO: 2485074 - RNA, 17 nt, Brucella suis 1330
cgccgcgacauagccga

SEQ ID NO: 2485075 - RNA, 16 nt, Brucella suis 1330
cgccgcgacgaugggc

SEQ ID NO: 2485076 - RNA, 21 nt, Brucella suis 1330
cgccgcgauugcaucggcagc

SEQ ID NO: 2485077 - RNA, 13 nt, Brucella suis 1330
cgccgcgcacugg

SEQ ID NO: 2485078 - RNA, 19 nt, Brucella suis 1330
cgccgcgcacuggcagcau

SEQ ID NO: 2485079 - RNA, 23 nt, Brucella suis 1330
cgccgcuuccagcgaaacggcag

SEQ ID NO: 2485080 - RNA, 21 nt, Brucella suis 1330
cgccgcuuucuuccagcuugc

SEQ ID NO: 2485081 - RNA, 12 nt, Brucella suis 1330
cgccggaaacgg

SEQ ID NO: 2485082 - RNA, 15 nt, Brucella suis 1330
cgccggaaugggccu

SEQ ID NO: 2485083 - RNA, 20 nt, Brucella suis 1330
cgccggaccgugccgcuucc

SEQ ID NO: 2485084 - RNA, 14 nt, Brucella suis 1330
cgccggcgccgcca

SEQ ID NO: 2485085 - RNA, 23 nt, Brucella suis 1330
cgccgggaaauuucagccaugcc

SEQ ID NO: 2485086 - RNA, 19 nt, Brucella suis 1330
cgccgggccuugccaaaau

SEQ ID NO: 2485087 - RNA, 22 nt, Brucella suis 1330
cgccgggcuuucucguuuucau

SEQ ID NO: 2485088 - RNA, 16 nt, Brucella suis 1330
cgccggggcaggcucc

SEQ ID NO: 2485089 - RNA, 15 nt, Brucella suis 1330
cgccggggccggaug

SEQ ID NO: 2485090 - RNA, 18 nt, Brucella suis 1330
cgccggggccggaugcgc

SEQ ID NO: 2485091 - RNA, 17 nt, Brucella suis 1330
cgccgguuuuccgucug

SEQ ID NO: 2485092 - RNA, 19 nt, Brucella suis 1330
cgccgucgagcagcaucuu

SEQ ID NO: 2485093 - RNA, 23 nt, Brucella suis 1330
cgccgucgggaccaccggccuga

SEQ ID NO: 2485094 - RNA, 24 nt, Brucella suis 1330
cgccgugcgccugaggccggacgc

SEQ ID NO: 2485095 - RNA, 23 nt, Brucella suis 1330
cgccgugggcguguuugcggccu

SEQ ID NO: 2485096 - RNA, 14 nt, Brucella suis 1330
cgccguugaagcug

SEQ ID NO: 2485097 - RNA, 20 nt, Brucella suis 1330
cgccucaauggucacggcca

SEQ ID NO: 2485098 - RNA, 21 nt, Brucella suis 1330
cgccucaauggucacggccac

SEQ ID NO: 2485099 - RNA, 14 nt, Brucella suis 1330
cgccugaaaccguc

SEQ ID NO: 2485100 - RNA, 16 nt, Brucella suis 1330
cgccugaucgucaggc

SEQ ID NO: 2485101 - RNA, 21 nt, Brucella suis 1330
cgccugaucgucaggcgcauu

SEQ ID NO: 2485102 - RNA, 16 nt, Brucella suis 1330
cgccugcaauggaaaa

SEQ ID NO: 2485103 - RNA, 14 nt, Brucella suis 1330
cgccugcaccaugg

SEQ ID NO: 2485104 - RNA, 13 nt, Brucella suis 1330
cgccugcagccgg

SEQ ID NO: 2485105 - RNA, 16 nt, Brucella suis 1330
cgccugccagcccgcu

SEQ ID NO: 2485106 - RNA, 17 nt, Brucella suis 1330
cgccugccauccgcccc

SEQ ID NO: 2485107 - RNA, 18 nt, Brucella suis 1330
cgccugccauccgccccg

SEQ ID NO: 2485108 - RNA, 19 nt, Brucella suis 1330
cgccugccauccgccccga

SEQ ID NO: 2485109 - RNA, 15 nt, Brucella suis 1330
cgccugccaugccgc

SEQ ID NO: 2485110 - RNA, 17 nt, Brucella suis 1330
cgccugccaugccgcca

SEQ ID NO: 2485111 - RNA, 15 nt, Brucella suis 1330
cgccugccgcgcggg

SEQ ID NO: 2485112 - RNA, 12 nt, Brucella suis 1330
cgccugcugcca

SEQ ID NO: 2485113 - RNA, 23 nt, Brucella suis 1330
cgccugcuuccuuuucggcuucc

SEQ ID NO: 2485114 - RNA, 13 nt, Brucella suis 1330
cgccuggccggcg

SEQ ID NO: 2485115 - RNA, 19 nt, Brucella suis 1330
cgccugggcuuucaaagga

SEQ ID NO: 2485116 - RNA, 23 nt, Brucella suis 1330
cgccuguucaucggggaaggugg

SEQ ID NO: 2485117 - RNA, 19 nt, Brucella suis 1330
cgccuucagcgugaugccc

SEQ ID NO: 2485118 - RNA, 22 nt, Brucella suis 1330
cgccuucgagaaccagcggcca

SEQ ID NO: 2485119 - RNA, 22 nt, Brucella suis 1330
cgccuugagaucguaggcuuuc

SEQ ID NO: 2485120 - RNA, 12 nt, Brucella suis 1330
cgccuugcgccg

SEQ ID NO: 2485121 - RNA, 14 nt, Brucella suis 1330
cgccuugcgccgca

SEQ ID NO: 2485122 - RNA, 13 nt, Brucella suis 1330
cgccuugcuugaa

SEQ ID NO: 2485123 - RNA, 18 nt, Brucella suis 1330
cgccuuuaccgccggggc

SEQ ID NO: 2485124 - RNA, 13 nt, Brucella suis 1330
cgccuuugccgcg

SEQ ID NO: 2485125 - RNA, 15 nt, Brucella suis 1330
cgccuuuugcggggc

SEQ ID NO: 2485126 - RNA, 22 nt, Brucella suis 1330
cgcgaaaccauggagcgcaucc

SEQ ID NO: 2485127 - RNA, 21 nt, Brucella suis 1330
cgcgaaacgccuuauaggcgc

SEQ ID NO: 2485128 - RNA, 22 nt, Brucella suis 1330
cgcgaagaccuucuggaagcgc

SEQ ID NO: 2485129 - RNA, 13 nt, Brucella suis 1330
cgcgacgccgccc

SEQ ID NO: 2485130 - RNA, 22 nt, Brucella suis 1330
cgcgacguaaagcgugagccgg

SEQ ID NO: 2485131 - RNA, 19 nt, Brucella suis 1330
cgcgacugucaccgccagc

SEQ ID NO: 2485132 - RNA, 20 nt, Brucella suis 1330
cgcgagcggacggauggcau

SEQ ID NO: 2485133 - RNA, 19 nt, Brucella suis 1330
cgcgauaauauugaaacgc

SEQ ID NO: 2485134 - RNA, 14 nt, Brucella suis 1330
cgcgauaggugacg

SEQ ID NO: 2485135 - RNA, 14 nt, Brucella suis 1330
cgcgaucacggcca

SEQ ID NO: 2485136 - RNA, 19 nt, Brucella suis 1330
cgcgaucuuacgaccaagc

SEQ ID NO: 2485137 - RNA, 20 nt, Brucella suis 1330
cgcgcaaaagagaaaccccg

SEQ ID NO: 2485138 - RNA, 17 nt, Brucella suis 1330
cgcgcaaaaucugcucg

SEQ ID NO: 2485139 - RNA, 20 nt, Brucella suis 1330
cgcgcaacacgcgcuccagc

SEQ ID NO: 2485140 - RNA, 19 nt, Brucella suis 1330
cgcgcaauaaugcagcgcc

SEQ ID NO: 2485141 - RNA, 21 nt, Brucella suis 1330
cgcgcaauaaugcagcgccgc

SEQ ID NO: 2485142 - RNA, 20 nt, Brucella suis 1330
cgcgcacaggcucgggcagc

SEQ ID NO: 2485143 - RNA, 16 nt, Brucella suis 1330
cgcgcaccugacggcg

SEQ ID NO: 2485144 - RNA, 19 nt, Brucella suis 1330
cgcgcagacgcagcgcauu

SEQ ID NO: 2485145 - RNA, 15 nt, Brucella suis 1330
cgcgcagauauggcg

SEQ ID NO: 2485146 - RNA, 14 nt, Brucella suis 1330
cgcgcagcaaagcc

SEQ ID NO: 2485147 - RNA, 15 nt, Brucella suis 1330
cgcgcaggccgcggc

SEQ ID NO: 2485148 - RNA, 14 nt, Brucella suis 1330
cgcgcaucgcgcgc

SEQ ID NO: 2485149 - RNA, 15 nt, Brucella suis 1330
cgcgcaucgggcgca

SEQ ID NO: 2485150 - RNA, 17 nt, Brucella suis 1330
cgcgcauugacgcgcac

SEQ ID NO: 2485151 - RNA, 17 nt, Brucella suis 1330
cgcgccaaacugcaccg

SEQ ID NO: 2485152 - RNA, 19 nt, Brucella suis 1330
cgcgccagacaaggcgcgg

SEQ ID NO: 2485153 - RNA, 18 nt, Brucella suis 1330
cgcgccagcacucugcca

SEQ ID NO: 2485154 - RNA, 18 nt, Brucella suis 1330
cgcgccagugcgccaccg

SEQ ID NO: 2485155 - RNA, 17 nt, Brucella suis 1330
cgcgccauaaaucgacg

SEQ ID NO: 2485156 - RNA, 18 nt, Brucella suis 1330
cgcgccauaaccucgacg

SEQ ID NO: 2485157 - RNA, 15 nt, Brucella suis 1330
cgcgccaugcacccg

SEQ ID NO: 2485158 - RNA, 18 nt, Brucella suis 1330
cgcgccaugccauccucg

SEQ ID NO: 2485159 - RNA, 23 nt, Brucella suis 1330
cggaaaagcgcaguucgcgcauc

SEQ ID NO: 2485160 - RNA, 19 nt, Brucella suis 1330
cggaaaagcucgcgucccg

SEQ ID NO: 2485161 - RNA, 15 nt, Brucella suis 1330
cggaaaaugcccggc

SEQ ID NO: 2485162 - RNA, 18 nt, Brucella suis 1330
cggaaaaugcccggcgcg

SEQ ID NO: 2485163 - RNA, 14 nt, Brucella suis 1330
cggaaacccgacca

SEQ ID NO: 2485164 - RNA, 17 nt, Brucella suis 1330
cggaaacgggcuugucg

SEQ ID NO: 2485165 - RNA, 12 nt, Brucella suis 1330
cggaaagcgcgg

SEQ ID NO: 2485166 - RNA, 21 nt, Brucella suis 1330
cggaaagggcugcguuucggc

SEQ ID NO: 2485167 - RNA, 19 nt, Brucella suis 1330
cggaaagguguccuccagc

SEQ ID NO: 2485168 - RNA, 14 nt, Brucella suis 1330
cggaaccaaggucu

SEQ ID NO: 2485169 - RNA, 18 nt, Brucella suis 1330
cggaacgcugaucgccuu

SEQ ID NO: 2485170 - RNA, 16 nt, Brucella suis 1330
cggaacggauaacgcg

SEQ ID NO: 2485171 - RNA, 16 nt, Brucella suis 1330
cggaagcgaaaugccg

SEQ ID NO: 2485172 - RNA, 20 nt, Brucella suis 1330
cggaagcgauuggcuucaau

SEQ ID NO: 2485173 - RNA, 15 nt, Brucella suis 1330
cggaagcgcaaggcg

SEQ ID NO: 2485174 - RNA, 17 nt, Brucella suis 1330
cggaagggcaaggcgcg

SEQ ID NO: 2485175 - RNA, 16 nt, Brucella suis 1330
cggaagguuuuucggu

SEQ ID NO: 2485176 - RNA, 18 nt, Brucella suis 1330
cggaagguuuuucgguuu

SEQ ID NO: 2485177 - RNA, 18 nt, Brucella suis 1330
cggaauagaugagcagua

SEQ ID NO: 2485178 - RNA, 16 nt, Brucella suis 1330
cggaauaucgaucaag

SEQ ID NO: 2485179 - RNA, 23 nt, Brucella suis 1330
cggaaugcccuggaugcggaaca

SEQ ID NO: 2485180 - RNA, 17 nt, Brucella suis 1330
cggaauucauccgccuu

SEQ ID NO: 2485181 - RNA, 21 nt, Brucella suis 1330
cggacaagcucgcguuccagc

SEQ ID NO: 2485182 - RNA, 23 nt, Brucella suis 1330
cggaccgugccgcuuccagcauc

SEQ ID NO: 2485183 - RNA, 15 nt, Brucella suis 1330
cggacgaccauggcg

SEQ ID NO: 2485184 - RNA, 14 nt, Brucella suis 1330
cggacggauggcau

SEQ ID NO: 2485185 - RNA, 19 nt, Brucella suis 1330
cggacugaaacugaugaug

SEQ ID NO: 2485186 - RNA, 15 nt, Brucella suis 1330
cggagaaaacgccga

SEQ ID NO: 2485187 - RNA, 19 nt, Brucella suis 1330
cggagccggccuuugcgcg

SEQ ID NO: 2485188 - RNA, 21 nt, Brucella suis 1330
cggagccucaucggcgggcca

SEQ ID NO: 2485189 - RNA, 19 nt, Brucella suis 1330
cggagcgaccagcaacgcg

SEQ ID NO: 2485190 - RNA, 18 nt, Brucella suis 1330
cggagcguccgagcggca

SEQ ID NO: 2485191 - RNA, 11 nt, Brucella suis 1330
cggaggcuucc

SEQ ID NO: 2485192 - RNA, 18 nt, Brucella suis 1330
cggagguucgaauccucu

SEQ ID NO: 2485193 - RNA, 18 nt, Brucella suis 1330
cggaguuuuucggccagu

SEQ ID NO: 2485194 - RNA, 16 nt, Brucella suis 1330
cggauaagaugcgcgc

SEQ ID NO: 2485195 - RNA, 16 nt, Brucella suis 1330
cggauaucggcgcgga

SEQ ID NO: 2485196 - RNA, 16 nt, Brucella suis 1330
cggauauucgccgccu

SEQ ID NO: 2485197 - RNA, 17 nt, Brucella suis 1330
cggaucauccauuccuc

SEQ ID NO: 2485198 - RNA, 22 nt, Brucella suis 1330
cggaucauccuugaugcccagc

SEQ ID NO: 2485199 - RNA, 15 nt, Brucella suis 1330
cggaucggaaacgcg

SEQ ID NO: 2485200 - RNA, 13 nt, Brucella suis 1330
cggaucggcaagc

SEQ ID NO: 2485201 - RNA, 21 nt, Brucella suis 1330
cggaucggcagcgaaccgucc

SEQ ID NO: 2485202 - RNA, 15 nt, Brucella suis 1330
cggaucggccagaua

SEQ ID NO: 2485203 - RNA, 16 nt, Brucella suis 1330
cggaucguacggcccu

SEQ ID NO: 2485204 - RNA, 23 nt, Brucella suis 1330
cggaucgugacccgcccuucauc

SEQ ID NO: 2485205 - RNA, 21 nt, Brucella suis 1330
cggaucgugagguucuugagg

SEQ ID NO: 2485206 - RNA, 21 nt, Brucella suis 1330
cggaucuugcgcacauaugcg

SEQ ID NO: 2485207 - RNA, 21 nt, Brucella suis 1330
cggaugacuucgguuuccaca

SEQ ID NO: 2485208 - RNA, 16 nt, Brucella suis 1330
cggaugauugcauuug

SEQ ID NO: 2485209 - RNA, 23 nt, Brucella suis 1330
cggaugcgaccucgucaaaaccg

SEQ ID NO: 2485210 - RNA, 19 nt, Brucella suis 1330
cggaugcggaaacccgacc

SEQ ID NO: 2485211 - RNA, 16 nt, Brucella suis 1330
cggauggaccggcugg

SEQ ID NO: 2485212 - RNA, 21 nt, Brucella suis 1330
cggauggguaucggucacagc

SEQ ID NO: 2485213 - RNA, 20 nt, Brucella suis 1330
cggcaaaaagcggcgucagc

SEQ ID NO: 2485214 - RNA, 22 nt, Brucella suis 1330
cggcaaaugucacgcucgucgg

SEQ ID NO: 2485215 - RNA, 14 nt, Brucella suis 1330
cggcaacggcgcug

SEQ ID NO: 2485216 - RNA, 14 nt, Brucella suis 1330
cggcaacgggcgag

SEQ ID NO: 2485217 - RNA, 17 nt, Brucella suis 1330
cggcaagauagccccag

SEQ ID NO: 2485218 - RNA, 12 nt, Brucella suis 1330
cggcaagcugcu

SEQ ID NO: 2485219 - RNA, 22 nt, Brucella suis 1330
cggcaagcuggaaggccaggcc

SEQ ID NO: 2485220 - RNA, 19 nt, Brucella suis 1330
cggcaaggccgcgcuccag

SEQ ID NO: 2485221 - RNA, 21 nt, Brucella suis 1330
cggcaaggccgcgcuccagau

SEQ ID NO: 2485222 - RNA, 13 nt, Brucella suis 1330
cggcaagggcaag

SEQ ID NO: 2485223 - RNA, 16 nt, Brucella suis 1330
cggcaaucagaucggu

SEQ ID NO: 2485224 - RNA, 15 nt, Brucella suis 1330
cggcaaucgagacgg

SEQ ID NO: 2485225 - RNA, 22 nt, Brucella suis 1330
cggcaaucgcuucacgcggcug

SEQ ID NO: 2485226 - RNA, 23 nt, Brucella suis 1330
cggcaauggcgggccauuuccaa

SEQ ID NO: 2485227 - RNA, 19 nt, Brucella suis 1330
cggcaaugucgcaaagcgu

SEQ ID NO: 2485228 - RNA, 19 nt, Brucella suis 1330
cggcacccccggcaguuuc

SEQ ID NO: 2485229 - RNA, 18 nt, Brucella suis 1330
cggcaccgcaaagagaac

SEQ ID NO: 2485230 - RNA, 13 nt, Brucella suis 1330
cggcaccgcgcaa

SEQ ID NO: 2485231 - RNA, 20 nt, Brucella suis 1330
cggcacgaacagaucgccaa

SEQ ID NO: 2485232 - RNA, 17 nt, Brucella suis 1330
cggcacgaugcgcagcc

SEQ ID NO: 2485233 - RNA, 13 nt, Brucella suis 1330
cggcacgccgccc

SEQ ID NO: 2485234 - RNA, 18 nt, Brucella suis 1330
cggcacggccacgcgcag

SEQ ID NO: 2485235 - RNA, 13 nt, Brucella suis 1330
cggcacucgaaaa

SEQ ID NO: 2485236 - RNA, 19 nt, Brucella suis 1330
cggcagaccggaucgcgcg

SEQ ID NO: 2485237 - RNA, 19 nt, Brucella suis 1330
cggcagacgugaccgccug

SEQ ID NO: 2485238 - RNA, 15 nt, Brucella suis 1330
cggcagaguggacgg

SEQ ID NO: 2485239 - RNA, 13 nt, Brucella suis 1330
cggcagcccgaca

SEQ ID NO: 2485240 - RNA, 15 nt, Brucella suis 1330
cggcagccgaaagca

SEQ ID NO: 2485241 - RNA, 19 nt, Brucella suis 1330
cggcagccucgacacgccg

SEQ ID NO: 2485242 - RNA, 19 nt, Brucella suis 1330
cggcagcgaaccguccacg

SEQ ID NO: 2485243 - RNA, 17 nt, Brucella suis 1330
cggcagcgaaggcugcc

SEQ ID NO: 2485244 - RNA, 14 nt, Brucella suis 1330
cggcaggaucgcca

SEQ ID NO: 2485245 - RNA, 19 nt, Brucella suis 1330
cggcaggaucgccagaagc

SEQ ID NO: 2485246 - RNA, 15 nt, Brucella suis 1330
cggcaggcauucaga

SEQ ID NO: 2485247 - RNA, 19 nt, Brucella suis 1330
cggcaggugccaucaagcg

SEQ ID NO: 2485248 - RNA, 21 nt, Brucella suis 1330
cggcaggugccaucaagcguc

SEQ ID NO: 2485249 - RNA, 21 nt, Brucella suis 1330
cggcaguuucaccauggccgc

SEQ ID NO: 2485250 - RNA, 13 nt, Brucella suis 1330
cggcauaaauguc

SEQ ID NO: 2485251 - RNA, 14 nt, Brucella suis 1330
cggcauauugcggc

SEQ ID NO: 2485252 - RNA, 22 nt, Brucella suis 1330
cggcaucaaacuggauccggcg

SEQ ID NO: 2485253 - RNA, 20 nt, Brucella suis 1330
cggcauccgaggcgcgcagc

SEQ ID NO: 2485254 - RNA, 21 nt, Brucella suis 1330
cggcauccgaggcgcgcagca

SEQ ID NO: 2485255 - RNA, 17 nt, Brucella suis 1330
cggcaucgagaaaagcg

SEQ ID NO: 2485256 - RNA, 16 nt, Brucella suis 1330
cggcaucggaacccca

SEQ ID NO: 2485257 - RNA, 22 nt, Brucella suis 1330
cggcauguaaaacuccgcgcga

SEQ ID NO: 2485258 - RNA, 23 nt, Brucella suis 1330
cggcauguaaaacuccgcgcgaa

SEQ ID NO: 2485259 - RNA, 16 nt, Brucella suis 1330
cggcaugucauuugcg

SEQ ID NO: 2485260 - RNA, 15 nt, Brucella suis 1330
cggcauugagccgcg

SEQ ID NO: 2485261 - RNA, 17 nt, Brucella suis 1330
cggcauugccugugcca

SEQ ID NO: 2485262 - RNA, 15 nt, Brucella suis 1330
cggccaagcggaucg

SEQ ID NO: 2485263 - RNA, 15 nt, Brucella suis 1330
cggccacaagcgccg

SEQ ID NO: 2485264 - RNA, 16 nt, Brucella suis 1330
cggccacccagcccga

SEQ ID NO: 2485265 - RNA, 19 nt, Brucella suis 1330
cggccagaauauccggcuc

SEQ ID NO: 2485266 - RNA, 18 nt, Brucella suis 1330
cggccagccuauaucgcg

SEQ ID NO: 2485267 - RNA, 17 nt, Brucella suis 1330
cggccagcuugaaaagc

SEQ ID NO: 2485268 - RNA, 20 nt, Brucella suis 1330
cggccaguuuggcugugcug

SEQ ID NO: 2485269 - RNA, 22 nt, Brucella suis 1330
cggccaucuuccaguuccgagc

SEQ ID NO: 2485270 - RNA, 15 nt, Brucella suis 1330
cggccaugcccaugc

SEQ ID NO: 2485271 - RNA, 14 nt, Brucella suis 1330
cggccaugcgcaug

SEQ ID NO: 2485272 - RNA, 19 nt, Brucella suis 1330
cggccaugcguugcuggaa

SEQ ID NO: 2485273 - RNA, 14 nt, Brucella suis 1330
cggccauuucaggu

SEQ ID NO: 2485274 - RNA, 20 nt, Brucella suis 1330
cggccauuucggcuuccagc

SEQ ID NO: 2485275 - RNA, 19 nt, Brucella suis 1330
cgggcgcaaccuggcugca

SEQ ID NO: 2485276 - RNA, 16 nt, Brucella suis 1330
cgggcgcuccagccgg

SEQ ID NO: 2485277 - RNA, 20 nt, Brucella suis 1330
cgggcggaucggcaggauag

SEQ ID NO: 2485278 - RNA, 14 nt, Brucella suis 1330
cgggcggcaaauag

SEQ ID NO: 2485279 - RNA, 15 nt, Brucella suis 1330
cgggcggcagcggac

SEQ ID NO: 2485280 - RNA, 14 nt, Brucella suis 1330
cgggcggcuugcca

SEQ ID NO: 2485281 - RNA, 15 nt, Brucella suis 1330
cgggcggcuugccag

SEQ ID NO: 2485282 - RNA, 19 nt, Brucella suis 1330
cgggcgugccucaggaucg

SEQ ID NO: 2485283 - RNA, 22 nt, Brucella suis 1330
cgggcuguuggccggcagcggu

SEQ ID NO: 2485284 - RNA, 19 nt, Brucella suis 1330
cgggcuucugcgcccgcgc

SEQ ID NO: 2485285 - RNA, 15 nt, Brucella suis 1330
cgggcuucuuccagu

SEQ ID NO: 2485286 - RNA, 19 nt, Brucella suis 1330
cgggcuuuuugaaggggcg

SEQ ID NO: 2485287 - RNA, 16 nt, Brucella suis 1330
cggggaaaucagucca

SEQ ID NO: 2485288 - RNA, 20 nt, Brucella suis 1330
cggggcaagaaaaaaggucg

SEQ ID NO: 2485289 - RNA, 18 nt, Brucella suis 1330
cggggcgacgcugcaaca

SEQ ID NO: 2485290 - RNA, 12 nt, Brucella suis 1330
cggggcggacgg

SEQ ID NO: 2485291 - RNA, 13 nt, Brucella suis 1330
cggggcggacggg

SEQ ID NO: 2485292 - RNA, 16 nt, Brucella suis 1330
cggggcguccgccacc

SEQ ID NO: 2485293 - RNA, 19 nt, Brucella suis 1330
cggggcguccgccaccgcc

SEQ ID NO: 2485294 - RNA, 18 nt, Brucella suis 1330
cggggcuguagcgcgcac

SEQ ID NO: 2485295 - RNA, 19 nt, Brucella suis 1330
cggggggaauggcgcgcgc

SEQ ID NO: 2485296 - RNA, 16 nt, Brucella suis 1330
cgggguguacaacaac

SEQ ID NO: 2485297 - RNA, 23 nt, Brucella suis 1330
cgggguugaucucauuucggcug

SEQ ID NO: 2485298 - RNA, 15 nt, Brucella suis 1330
cgggguuucuucauu

SEQ ID NO: 2485299 - RNA, 13 nt, Brucella suis 1330
cgggucgagaaug

SEQ ID NO: 2485300 - RNA, 21 nt, Brucella suis 1330
cgggugccagaucggcaagcg

SEQ ID NO: 2485301 - RNA, 20 nt, Brucella suis 1330
cggguugcaccgcucucggc

SEQ ID NO: 2485302 - RNA, 15 nt, Brucella suis 1330
cggguuuuggcauca

SEQ ID NO: 2485303 - RNA, 14 nt, Brucella suis 1330
cgguaccgaagagc

SEQ ID NO: 2485304 - RNA, 16 nt, Brucella suis 1330
cgguacggaaagggcu

SEQ ID NO: 2485305 - RNA, 21 nt, Brucella suis 1330
cgguauucuugcgaaccauca

SEQ ID NO: 2485306 - RNA, 15 nt, Brucella suis 1330
cggucacccgcacgc

SEQ ID NO: 2485307 - RNA, 17 nt, Brucella suis 1330
cggucagucgcccacgg

SEQ ID NO: 2485308 - RNA, 17 nt, Brucella suis 1330
cggucaguucgucggcc

SEQ ID NO: 2485309 - RNA, 17 nt, Brucella suis 1330
cgguccaccacaugcuc

SEQ ID NO: 2485310 - RNA, 11 nt, Brucella suis 1330
cgguccgccgg

SEQ ID NO: 2485311 - RNA, 22 nt, Brucella suis 1330
cggucgaagcggcgcgaugcga

SEQ ID NO: 2485312 - RNA, 15 nt, Brucella suis 1330
cggucgcaggcgcuc

SEQ ID NO: 2485313 - RNA, 13 nt, Brucella suis 1330
cggucgcuugccu

SEQ ID NO: 2485314 - RNA, 22 nt, Brucella suis 1330
cggucggcauauuugaggcauu

SEQ ID NO: 2485315 - RNA, 14 nt, Brucella suis 1330
cggucggccucgcc

SEQ ID NO: 2485316 - RNA, 12 nt, Brucella suis 1330
cggucgggaagc

SEQ ID NO: 2485317 - RNA, 13 nt, Brucella suis 1330
cggucgggaagcc

SEQ ID NO: 2485318 - RNA, 17 nt, Brucella suis 1330
cggucgggaagcccagc

SEQ ID NO: 2485319 - RNA, 15 nt, Brucella suis 1330
cggucucgcgaccgg

SEQ ID NO: 2485320 - RNA, 14 nt, Brucella suis 1330
cggucugaaaucag

SEQ ID NO: 2485321 - RNA, 20 nt, Brucella suis 1330
cggucugucauuugcggcag

SEQ ID NO: 2485322 - RNA, 15 nt, Brucella suis 1330
cggucuugagccggg

SEQ ID NO: 2485323 - RNA, 23 nt, Brucella suis 1330
cggucuugccggccugaaacagc

SEQ ID NO: 2485324 - RNA, 13 nt, Brucella suis 1330
cggucuugcgcuu

SEQ ID NO: 2485325 - RNA, 23 nt, Brucella suis 1330
cggucuugcgcuugcgaccacca

SEQ ID NO: 2485326 - RNA, 20 nt, Brucella suis 1330
cggugaagaagcgccagcuu

SEQ ID NO: 2485327 - RNA, 19 nt, Brucella suis 1330
cggugaagacauggcgggc

SEQ ID NO: 2485328 - RNA, 16 nt, Brucella suis 1330
cggugacggcggcaga

SEQ ID NO: 2485329 - RNA, 19 nt, Brucella suis 1330
cggugaucggcgugccauu

SEQ ID NO: 2485330 - RNA, 20 nt, Brucella suis 1330
cggugcacgaauugcacggu

SEQ ID NO: 2485331 - RNA, 19 nt, Brucella suis 1330
cggugcauuuuuccagacc

SEQ ID NO: 2485332 - RNA, 18 nt, Brucella suis 1330
cggugccgcgcgguacgg

SEQ ID NO: 2485333 - RNA, 21 nt, Brucella suis 1330
cggugcgcccgcgauagguga

SEQ ID NO: 2485334 - RNA, 18 nt, Brucella suis 1330
cggugcggauuacgagac

SEQ ID NO: 2485335 - RNA, 19 nt, Brucella suis 1330
cggugcucugcgcccaggc

SEQ ID NO: 2485336 - RNA, 13 nt, Brucella suis 1330
cgguggcauugcc

SEQ ID NO: 2485337 - RNA, 14 nt, Brucella suis 1330
cgguggcauugccc

SEQ ID NO: 2485338 - RNA, 21 nt, Brucella suis 1330
cgguggcauugcccauggacu

SEQ ID NO: 2485339 - RNA, 13 nt, Brucella suis 1330
cgguggccuugcc

SEQ ID NO: 2485340 - RNA, 20 nt, Brucella suis 1330
cggugguuucccuugaagaa

SEQ ID NO: 2485341 - RNA, 17 nt, Brucella suis 1330
cgguguuucgguccaca

SEQ ID NO: 2485342 - RNA, 23 nt, Brucella suis 1330
cgguuauggcgugccgaaaaugg

SEQ ID NO: 2485343 - RNA, 21 nt, Brucella suis 1330
cgguuaugggcgguauugcug

SEQ ID NO: 2485344 - RNA, 23 nt, Brucella suis 1330
cgguuccaccggcuguguaaaag

SEQ ID NO: 2485345 - RNA, 22 nt, Brucella suis 1330
cgguucgcccaugccgcaggau

SEQ ID NO: 2485346 - RNA, 23 nt, Brucella suis 1330
cgguucgggcauuguggugcgca

SEQ ID NO: 2485347 - RNA, 16 nt, Brucella suis 1330
cgguucguccuugacg

SEQ ID NO: 2485348 - RNA, 21 nt, Brucella suis 1330
cgguucgugaagccgcuucaa

SEQ ID NO: 2485349 - RNA, 17 nt, Brucella suis 1330
cgguugaggauuuccac

SEQ ID NO: 2485350 - RNA, 17 nt, Brucella suis 1330
cgguugcagccgccaga

SEQ ID NO: 2485351 - RNA, 18 nt, Brucella suis 1330
cgguugcaggcgcaggcc

SEQ ID NO: 2485352 - RNA, 22 nt, Brucella suis 1330
cgguugcgccgguguagagcug

SEQ ID NO: 2485353 - RNA, 22 nt, Brucella suis 1330
cgguuuccacauccgccaccgc

SEQ ID NO: 2485354 - RNA, 14 nt, Brucella suis 1330
cguaaaacgcaccg

SEQ ID NO: 2485355 - RNA, 23 nt, Brucella suis 1330
cguaaagaucgauguucuuuauc

SEQ ID NO: 2485356 - RNA, 23 nt, Brucella suis 1330
cguaaauauucaggaucuuucca

SEQ ID NO: 2485357 - RNA, 14 nt, Brucella suis 1330
cguaaucgccgggc

SEQ ID NO: 2485358 - RNA, 15 nt, Brucella suis 1330
cguaauggcgcggcu

SEQ ID NO: 2485359 - RNA, 16 nt, Brucella suis 1330
cguacaacaucgccug

SEQ ID NO: 2485360 - RNA, 19 nt, Brucella suis 1330
cguagggcgcgagcacgcc

SEQ ID NO: 2485361 - RNA, 14 nt, Brucella suis 1330
cguagucuggugcu

SEQ ID NO: 2485362 - RNA, 19 nt, Brucella suis 1330
cguauccaggugcagucuu

SEQ ID NO: 2485363 - RNA, 21 nt, Brucella suis 1330
cguaucgccaaagaccagcag

SEQ ID NO: 2485364 - RNA, 23 nt, Brucella suis 1330
cguaucgccaaugcccugcugca

SEQ ID NO: 2485365 - RNA, 14 nt, Brucella suis 1330
cguaucuucaagcu

SEQ ID NO: 2485366 - RNA, 22 nt, Brucella suis 1330
cguauugccguugagaaucgca

SEQ ID NO: 2485367 - RNA, 15 nt, Brucella suis 1330
cgucaaaacaaaaga

SEQ ID NO: 2485368 - RNA, 20 nt, Brucella suis 1330
cgucaaaggaaaagcuggca

SEQ ID NO: 2485369 - RNA, 14 nt, Brucella suis 1330
cgucaacaggcugu

SEQ ID NO: 2485370 - RNA, 14 nt, Brucella suis 1330
cgucaacggcaagg

SEQ ID NO: 2485371 - RNA, 22 nt, Brucella suis 1330
cgucaaucacgccacugcccug

SEQ ID NO: 2485372 - RNA, 23 nt, Brucella suis 1330
cgucaaucacgccacugcccugg

SEQ ID NO: 2485373 - RNA, 23 nt, Brucella suis 1330
cgucaaugccauccguaucggcg

SEQ ID NO: 2485374 - RNA, 17 nt, Brucella suis 1330
cgucaaugcgcgcccgu

SEQ ID NO: 2485375 - RNA, 13 nt, Brucella suis 1330
cgucacagauuca

SEQ ID NO: 2485376 - RNA, 17 nt, Brucella suis 1330
cgucacagauucaaaac

SEQ ID NO: 2485377 - RNA, 18 nt, Brucella suis 1330
cgucacauaaagcguggc

SEQ ID NO: 2485378 - RNA, 14 nt, Brucella suis 1330
cgucaccgugcgca

SEQ ID NO: 2485379 - RNA, 14 nt, Brucella suis 1330
cgucacugcaaaaa

SEQ ID NO: 2485380 - RNA, 15 nt, Brucella suis 1330
cgucacugcaaaaaa

SEQ ID NO: 2485381 - RNA, 13 nt, Brucella suis 1330
cgucagaaccgga

SEQ ID NO: 2485382 - RNA, 13 nt, Brucella suis 1330
cgucagcaccgcu

SEQ ID NO: 2485383 - RNA, 20 nt, Brucella suis 1330
cgucagccgguucuuuuccu

SEQ ID NO: 2485384 - RNA, 14 nt, Brucella suis 1330
cgucagcgcgccgu

SEQ ID NO: 2485385 - RNA, 15 nt, Brucella suis 1330
cgucaggccgagcgc

SEQ ID NO: 2485386 - RNA, 19 nt, Brucella suis 1330
cgucaggccgagcgcaucg

SEQ ID NO: 2485387 - RNA, 15 nt, Brucella suis 1330
cgucagggaaaugcg

SEQ ID NO: 2485388 - RNA, 18 nt, Brucella suis 1330
cgucauaggcaauaccaa

SEQ ID NO: 2485389 - RNA, 23 nt, Brucella suis 1330
cgucauaggcaauaccaagcgca

SEQ ID NO: 2485390 - RNA, 21 nt, Brucella suis 1330
cgucaucgccaccauggccgc

SEQ ID NO: 2485391 - RNA, 16 nt, Brucella suis 1330
uauuucuuccagacag

SEQ ID NO: 2485392 - RNA, 18 nt, Brucella suis 1330
uauuuuuacaaaaaaauc

SEQ ID NO: 2485393 - RNA, 19 nt, Brucella suis 1330
ucaaaaaccggagccgccg

SEQ ID NO: 2485394 - RNA, 23 nt, Brucella suis 1330
ucaaaaagggcuuccugcaaaag

SEQ ID NO: 2485395 - RNA, 22 nt, Brucella suis 1330
ucaaaacgccauagaacagcaa

SEQ ID NO: 2485396 - RNA, 15 nt, Brucella suis 1330
ucaaaagaaaccuug

SEQ ID NO: 2485397 - RNA, 14 nt, Brucella suis 1330
ucaaaccggccaug

SEQ ID NO: 2485398 - RNA, 16 nt, Brucella suis 1330
ucaaacggcaucauug

SEQ ID NO: 2485399 - RNA, 13 nt, Brucella suis 1330
ucaaaggaaagau

SEQ ID NO: 2485400 - RNA, 20 nt, Brucella suis 1330
ucaaaggagccgcugcgcag

SEQ ID NO: 2485401 - RNA, 19 nt, Brucella suis 1330
ucaaccauauaaagcuuga

SEQ ID NO: 2485402 - RNA, 22 nt, Brucella suis 1330
ucaacgccguggcggcuggcuu

SEQ ID NO: 2485403 - RNA, 12 nt, Brucella suis 1330
ucaagacaagag

SEQ ID NO: 2485404 - RNA, 18 nt, Brucella suis 1330
ucaagaugcuugaggauc

SEQ ID NO: 2485405 - RNA, 21 nt, Brucella suis 1330
ucaagcacgcugagaagcuug

SEQ ID NO: 2485406 - RNA, 23 nt, Brucella suis 1330
ucaagcggcgucaggccaaagcc

SEQ ID NO: 2485407 - RNA, 16 nt, Brucella suis 1330
ucaaggccuguuccac

SEQ ID NO: 2485408 - RNA, 17 nt, Brucella suis 1330
ucaaggccuguuccaca

SEQ ID NO: 2485409 - RNA, 19 nt, Brucella suis 1330
ucaaggccuguuccacacc

SEQ ID NO: 2485410 - RNA, 14 nt, Brucella suis 1330
ucaaggcugcugca

SEQ ID NO: 2485411 - RNA, 14 nt, Brucella suis 1330
ucaagugccgccuu

SEQ ID NO: 2485412 - RNA, 13 nt, Brucella suis 1330
ucaauacccaugc

SEQ ID NO: 2485413 - RNA, 12 nt, Brucella suis 1330
ucaaugccaucc

SEQ ID NO: 2485414 - RNA, 18 nt, Brucella suis 1330
ucaaugcgaaaaagcggc

SEQ ID NO: 2485415 - RNA, 17 nt, Brucella suis 1330
ucaaugcugcaucgcga

SEQ ID NO: 2485416 - RNA, 16 nt, Brucella suis 1330
ucaaugcuggccugug

SEQ ID NO: 2485417 - RNA, 13 nt, Brucella suis 1330
ucaauggccgcgc

SEQ ID NO: 2485418 - RNA, 16 nt, Brucella suis 1330
ucaauucccuggcuuu

SEQ ID NO: 2485419 - RNA, 15 nt, Brucella suis 1330
ucacaaaacagacgc

SEQ ID NO: 2485420 - RNA, 19 nt, Brucella suis 1330
ucacaacgccgucagcccc

SEQ ID NO: 2485421 - RNA, 19 nt, Brucella suis 1330
ucacaaugugaaugaaaaa

SEQ ID NO: 2485422 - RNA, 22 nt, Brucella suis 1330
ucacacuuuuggcucgaaaaug

SEQ ID NO: 2485423 - RNA, 15 nt, Brucella suis 1330
ucacagauucaaaac

SEQ ID NO: 2485424 - RNA, 18 nt, Brucella suis 1330
ucacaucgagacggcgcu

SEQ ID NO: 2485425 - RNA, 21 nt, Brucella suis 1330
ucacauuucaugaaaaugcca

SEQ ID NO: 2485426 - RNA, 21 nt, Brucella suis 1330
ucaccacaucggcggaaaagc

SEQ ID NO: 2485427 - RNA, 20 nt, Brucella suis 1330
ucaccacgauuucgcccacg

SEQ ID NO: 2485428 - RNA, 19 nt, Brucella suis 1330
ucaccacgccaucuucgac

SEQ ID NO: 2485429 - RNA, 19 nt, Brucella suis 1330
ucaccagcccccagaugaa

SEQ ID NO: 2485430 - RNA, 20 nt, Brucella suis 1330
ucaccagccccgccagaaaa

SEQ ID NO: 2485431 - RNA, 22 nt, Brucella suis 1330
ucaccagccccgccagaaaaac

SEQ ID NO: 2485432 - RNA, 23 nt, Brucella suis 1330
ucaccagccccgccagaaaaacc

SEQ ID NO: 2485433 - RNA, 12 nt, Brucella suis 1330
ucaccauucaca

SEQ ID NO: 2485434 - RNA, 16 nt, Brucella suis 1330
ucacccgccuugcaga

SEQ ID NO: 2485435 - RNA, 12 nt, Brucella suis 1330
ucacccuccacc

SEQ ID NO: 2485436 - RNA, 20 nt, Brucella suis 1330
ucacccucggugccaagaag

SEQ ID NO: 2485437 - RNA, 20 nt, Brucella suis 1330
ucacccuuggcgacggccag

SEQ ID NO: 2485438 - RNA, 22 nt, Brucella suis 1330
ucaccucgcccugcuucacaug

SEQ ID NO: 2485439 - RNA, 14 nt, Brucella suis 1330
ucacgccacugccc

SEQ ID NO: 2485440 - RNA, 18 nt, Brucella suis 1330
ucacgccggcaucaaacu

SEQ ID NO: 2485441 - RNA, 17 nt, Brucella suis 1330
ucacgcgagcgcagcgg

SEQ ID NO: 2485442 - RNA, 16 nt, Brucella suis 1330
ucacgcgcagcagcau

SEQ ID NO: 2485443 - RNA, 22 nt, Brucella suis 1330
ucacgcggcugcucgacaugca

SEQ ID NO: 2485444 - RNA, 19 nt, Brucella suis 1330
ucacggaacgucacagauu

SEQ ID NO: 2485445 - RNA, 18 nt, Brucella suis 1330
ucacggucggauaauaga

SEQ ID NO: 2485446 - RNA, 14 nt, Brucella suis 1330
ucacgucauaggca

SEQ ID NO: 2485447 - RNA, 18 nt, Brucella suis 1330
ucacuccgaccauuuccc

SEQ ID NO: 2485448 - RNA, 19 nt, Brucella suis 1330
ucacuccgaccauuucccg

SEQ ID NO: 2485449 - RNA, 18 nt, Brucella suis 1330
ucacugcaaaaaauacca

SEQ ID NO: 2485450 - RNA, 15 nt, Brucella suis 1330
uccagcuucggaaga

SEQ ID NO: 2485451 - RNA, 23 nt, Brucella suis 1330
uccaggagagccuuugcuucacg

SEQ ID NO: 2485452 - RNA, 20 nt, Brucella suis 1330
uccagguauagauaucgagc

SEQ ID NO: 2485453 - RNA, 15 nt, Brucella suis 1330
uccaguaaagucuga

SEQ ID NO: 2485454 - RNA, 23 nt, Brucella suis 1330
uccaguacggcgcgcugaagccg

SEQ ID NO: 2485455 - RNA, 20 nt, Brucella suis 1330
uccagucaggauauuucggc

SEQ ID NO: 2485456 - RNA, 18 nt, Brucella suis 1330
uccagugcaaagcggcuu

SEQ ID NO: 2485457 - RNA, 15 nt, Brucella suis 1330
uccaguggaagcaca

SEQ ID NO: 2485458 - RNA, 22 nt, Brucella suis 1330
uccaguggaagcacauggcggc

SEQ ID NO: 2485459 - RNA, 22 nt, Brucella suis 1330
uccauccggcggcgcccaccau

SEQ ID NO: 2485460 - RNA, 14 nt, Brucella suis 1330
uccaucggcgagga

SEQ ID NO: 2485461 - RNA, 18 nt, Brucella suis 1330
uccaugaaagccacaacg

SEQ ID NO: 2485462 - RNA, 21 nt, Brucella suis 1330
uccaugaaagccacaacgcug

SEQ ID NO: 2485463 - RNA, 23 nt, Brucella suis 1330
uccaugacgcgggugaggcuuuc

SEQ ID NO: 2485464 - RNA, 17 nt, Brucella suis 1330
uccaugagcagcggcaa

SEQ ID NO: 2485465 - RNA, 21 nt, Brucella suis 1330
uccaugagcagcggcaaaaaa

SEQ ID NO: 2485466 - RNA, 17 nt, Brucella suis 1330
uccaugagcgcaccauu

SEQ ID NO: 2485467 - RNA, 16 nt, Brucella suis 1330
uccaugcccggcgcga

SEQ ID NO: 2485468 - RNA, 12 nt, Brucella suis 1330
uccauuccucaa

SEQ ID NO: 2485469 - RNA, 20 nt, Brucella suis 1330
uccauuccucaagauacaaa

SEQ ID NO: 2485470 - RNA, 19 nt, Brucella suis 1330
uccauugccgguugcuucc

SEQ ID NO: 2485471 - RNA, 11 nt, Brucella suis 1330
ucccaugcagg

SEQ ID NO: 2485472 - RNA, 19 nt, Brucella suis 1330
uccccaaaguggaaagcgg

SEQ ID NO: 2485473 - RNA, 21 nt, Brucella suis 1330
uccccauacguccagccaggu

SEQ ID NO: 2485474 - RNA, 19 nt, Brucella suis 1330
uccccaucgaaaccggcau

SEQ ID NO: 2485475 - RNA, 19 nt, Brucella suis 1330
uccccauugcaucgccaag

SEQ ID NO: 2485476 - RNA, 18 nt, Brucella suis 1330
uccccgcccgcggccaca

SEQ ID NO: 2485477 - RNA, 12 nt, Brucella suis 1330
uccccgccgccg

SEQ ID NO: 2485478 - RNA, 18 nt, Brucella suis 1330
uccccggcaaagaccggc

SEQ ID NO: 2485479 - RNA, 18 nt, Brucella suis 1330
uccccgggcagcggcgcg

SEQ ID NO: 2485480 - RNA, 20 nt, Brucella suis 1330
uccccuaaaucacucccgca

SEQ ID NO: 2485481 - RNA, 15 nt, Brucella suis 1330
uccccuacucccuua

SEQ ID NO: 2485482 - RNA, 16 nt, Brucella suis 1330
uccccuauuccccuau

SEQ ID NO: 2485483 - RNA, 23 nt, Brucella suis 1330
ucccgauaaugcgaacaguuuca

SEQ ID NO: 2485484 - RNA, 19 nt, Brucella suis 1330
ucccggcccuuuuucaugc

SEQ ID NO: 2485485 - RNA, 23 nt, Brucella suis 1330
ucccgucagcuuuucaccggcau

SEQ ID NO: 2485486 - RNA, 20 nt, Brucella suis 1330
ucccgugucggagccggccu

SEQ ID NO: 2485487 - RNA, 19 nt, Brucella suis 1330
ucccuaucgaggcggcauc

SEQ ID NO: 2485488 - RNA, 18 nt, Brucella suis 1330
ucccucaaaacgcugcca

SEQ ID NO: 2485489 - RNA, 21 nt, Brucella suis 1330
ucccuguggagagaggaagca

SEQ ID NO: 2485490 - RNA, 22 nt, Brucella suis 1330
ucccuuaacauacugccuuacu

SEQ ID NO: 2485491 - RNA, 16 nt, Brucella suis 1330
ucccuucuugcucuca

SEQ ID NO: 2485492 - RNA, 12 nt, Brucella suis 1330
ucccuugccgcc

SEQ ID NO: 2485493 - RNA, 15 nt, Brucella suis 1330
uccgaaaaccgcuuc

SEQ ID NO: 2485494 - RNA, 15 nt, Brucella suis 1330
uccgaauacaagccc

SEQ ID NO: 2485495 - RNA, 20 nt, Brucella suis 1330
uccgaauuugcugccugcgg

SEQ ID NO: 2485496 - RNA, 12 nt, Brucella suis 1330
uccgacaccagc

SEQ ID NO: 2485497 - RNA, 17 nt, Brucella suis 1330
uccgagcggcagcggcg

SEQ ID NO: 2485498 - RNA, 19 nt, Brucella suis 1330
uccgaggcgcgcagcagcg

SEQ ID NO: 2485499 - RNA, 21 nt, Brucella suis 1330
uccgcaauacgccuggccggc

SEQ ID NO: 2485500 - RNA, 14 nt, Brucella suis 1330
uccgcaaucgccac

SEQ ID NO: 2485501 - RNA, 15 nt, Brucella suis 1330
uccgcaccgcacugg

SEQ ID NO: 2485502 - RNA, 14 nt, Brucella suis 1330
uccgcaccggcaug

SEQ ID NO: 2485503 - RNA, 20 nt, Brucella suis 1330
uccgcauaagccccggcauc

SEQ ID NO: 2485504 - RNA, 22 nt, Brucella suis 1330
uccgccaccgccggcgccgcca

SEQ ID NO: 2485505 - RNA, 15 nt, Brucella suis 1330
uccgccaccgcgccg

SEQ ID NO: 2485506 - RNA, 17 nt, Brucella suis 1330
uccgccgaucugcacgg

SEQ ID NO: 2485507 - RNA, 16 nt, Brucella suis 1330
uccgccggggcaggcu

SEQ ID NO: 2485508 - RNA, 18 nt, Brucella suis 1330
uccgccggggcaggcucc

SEQ ID NO: 2485509 - RNA, 23 nt, Brucella suis 1330
uccgccugaucgucaggcgcauu

SEQ ID NO: 2485510 - RNA, 23 nt, Brucella suis 1330
uccgccuucgagaaccagcggcc

SEQ ID NO: 2485511 - RNA, 15 nt, Brucella suis 1330
agcgggaauagccga

SEQ ID NO: 2485512 - RNA, 17 nt, Brucella suis 1330
agcgguuuugcguagga

SEQ ID NO: 2485513 - RNA, 16 nt, Brucella suis 1330
agcguaaguucauaag

SEQ ID NO: 2485514 - RNA, 20 nt, Brucella suis 1330
agcguacaccgaccagcgca

SEQ ID NO: 2485515 - RNA, 17 nt, Brucella suis 1330
agcguauucagggacag

SEQ ID NO: 2485516 - RNA, 20 nt, Brucella suis 1330
agcgucacaaaacagacgcc

SEQ ID NO: 2485517 - RNA, 19 nt, Brucella suis 1330
agcgucagcgcaaagccug

SEQ ID NO: 2485518 - RNA, 22 nt, Brucella suis 1330
agcgucagcgcaaagccugcua

SEQ ID NO: 2485519 - RNA, 16 nt, Brucella suis 1330
agcguccauccggcgg

SEQ ID NO: 2485520 - RNA, 17 nt, Brucella suis 1330
agcgucuguacauacau

SEQ ID NO: 2485521 - RNA, 14 nt, Brucella suis 1330
agcgucuucugaga

SEQ ID NO: 2485522 - RNA, 17 nt, Brucella suis 1330
agcgugaccagccccug

SEQ ID NO: 2485523 - RNA, 13 nt, Brucella suis 1330
agcgugcagccug

SEQ ID NO: 2485524 - RNA, 20 nt, Brucella suis 1330
agcgugcuuccggguuuugu

SEQ ID NO: 2485525 - RNA, 18 nt, Brucella suis 1330
agcguggcuuuuccggcg

SEQ ID NO: 2485526 - RNA, 14 nt, Brucella suis 1330
agcgugucuugccc

SEQ ID NO: 2485527 - RNA, 15 nt, Brucella suis 1330
agcgugucuugccca

SEQ ID NO: 2485528 - RNA, 18 nt, Brucella suis 1330
agcgugucuugcccagaa

SEQ ID NO: 2485529 - RNA, 13 nt, Brucella suis 1330
agcuaaaguaucu

SEQ ID NO: 2485530 - RNA, 14 nt, Brucella suis 1330
agcuccggguucuc

SEQ ID NO: 2485531 - RNA, 12 nt, Brucella suis 1330
agcucgaaacau

SEQ ID NO: 2485532 - RNA, 21 nt, Brucella suis 1330
agcucgaaacauucggggcuu

SEQ ID NO: 2485533 - RNA, 12 nt, Brucella suis 1330
agcucgaaaucc

SEQ ID NO: 2485534 - RNA, 22 nt, Brucella suis 1330
agcucgauaagauugcggcuga

SEQ ID NO: 2485535 - RNA, 21 nt, Brucella suis 1330
agcucguccaugagcgcacca

SEQ ID NO: 2485536 - RNA, 14 nt, Brucella suis 1330
agcugagcuacggg

SEQ ID NO: 2485537 - RNA, 19 nt, Brucella suis 1330
agcugccgcgaaaaagccg

SEQ ID NO: 2485538 - RNA, 18 nt, Brucella suis 1330
agcugcuggcggguccag

SEQ ID NO: 2485539 - RNA, 22 nt, Brucella suis 1330
agcuggaaccagcgugcagccu

SEQ ID NO: 2485540 - RNA, 14 nt, Brucella suis 1330
agcuggaaggccag

SEQ ID NO: 2485541 - RNA, 15 nt, Brucella suis 1330
agcuggaaggccagg

SEQ ID NO: 2485542 - RNA, 16 nt, Brucella suis 1330
agcuggcauccagcac

SEQ ID NO: 2485543 - RNA, 17 nt, Brucella suis 1330
agcuggcauccagcacu

SEQ ID NO: 2485544 - RNA, 20 nt, Brucella suis 1330
agcugguuuuucaccaucuc

SEQ ID NO: 2485545 - RNA, 20 nt, Brucella suis 1330
agcuguugcagccgucccuc

SEQ ID NO: 2485546 - RNA, 16 nt, Brucella suis 1330
agcuucacauccuuca

SEQ ID NO: 2485547 - RNA, 14 nt, Brucella suis 1330
agcuucaggcucuu

SEQ ID NO: 2485548 - RNA, 20 nt, Brucella suis 1330
agcuucauaucguugccgau

SEQ ID NO: 2485549 - RNA, 19 nt, Brucella suis 1330
agcuuccgucagggccgau

SEQ ID NO: 2485550 - RNA, 15 nt, Brucella suis 1330
agcuucggaagaaag

SEQ ID NO: 2485551 - RNA, 23 nt, Brucella suis 1330
agcuucggaagaaagauggucaa

SEQ ID NO: 2485552 - RNA, 17 nt, Brucella suis 1330
agcuugaccagauagcc

SEQ ID NO: 2485553 - RNA, 16 nt, Brucella suis 1330
agcuugagaaccgaac

SEQ ID NO: 2485554 - RNA, 16 nt, Brucella suis 1330
agcuugcagugcagga

SEQ ID NO: 2485555 - RNA, 16 nt, Brucella suis 1330
agcuugcccaucucga

SEQ ID NO: 2485556 - RNA, 13 nt, Brucella suis 1330
agcuugcccguca

SEQ ID NO: 2485557 - RNA, 19 nt, Brucella suis 1330
agcuugcccucgccuucca

SEQ ID NO: 2485558 - RNA, 19 nt, Brucella suis 1330
agcuugcgcacacggcgca

SEQ ID NO: 2485559 - RNA, 21 nt, Brucella suis 1330
agcuugcgcacacggcgcagg

SEQ ID NO: 2485560 - RNA, 19 nt, Brucella suis 1330
agcuugcggcggauuucau

SEQ ID NO: 2485561 - RNA, 13 nt, Brucella suis 1330
agcuuggaaagcu

SEQ ID NO: 2485562 - RNA, 14 nt, Brucella suis 1330
agcuuggaaagcug

SEQ ID NO: 2485563 - RNA, 20 nt, Brucella suis 1330
agcuuuccaucgucauugcg

SEQ ID NO: 2485564 - RNA, 13 nt, Brucella suis 1330
agcuuuuuauuaa

SEQ ID NO: 2485565 - RNA, 21 nt, Brucella suis 1330
agcuuuuuauuaaauggcuuc

SEQ ID NO: 2485566 - RNA, 23 nt, Brucella suis 1330
aggaaaaagcccgccacgaggaa

SEQ ID NO: 2485567 - RNA, 14 nt, Brucella suis 1330
aggaaauugacgcc

SEQ ID NO: 2485568 - RNA, 14 nt, Brucella suis 1330
aggaaccaaggcag

SEQ ID NO: 2485569 - RNA, 19 nt, Brucella suis 1330
aggaacucgcccaccgaag

SEQ ID NO: 2485570 - RNA, 23 nt, Brucella suis 1330
aggaagaaggcgacgagaccugc

SEQ ID NO: 2485571 - RNA, 13 nt, Brucella suis 1330
aggaagagaaucu

SEQ ID NO: 2485572 - RNA, 19 nt, Brucella suis 1330
aggaagagaaucuugcccu

SEQ ID NO: 2485573 - RNA, 17 nt, Brucella suis 1330
aggaagccugcaccggc

SEQ ID NO: 2485574 - RNA, 20 nt, Brucella suis 1330
aggaaucauuuucucaagau

SEQ ID NO: 2485575 - RNA, 22 nt, Brucella suis 1330
aggaauuucagcgaagcgauga

SEQ ID NO: 2485576 - RNA, 15 nt, Brucella suis 1330
aggacauucaaagau

SEQ ID NO: 2485577 - RNA, 15 nt, Brucella suis 1330
aggacggugaacauu

SEQ ID NO: 2485578 - RNA, 16 nt, Brucella suis 1330
aggagcggaagcauau

SEQ ID NO: 2485579 - RNA, 20 nt, Brucella suis 1330
aggagcgugucuugcccaga

SEQ ID NO: 2485580 - RNA, 15 nt, Brucella suis 1330
aggaucgaagggcug

SEQ ID NO: 2485581 - RNA, 16 nt, Brucella suis 1330
aggaucgaagggcuga

SEQ ID NO: 2485582 - RNA, 16 nt, Brucella suis 1330
aggaucggcagcagcg

SEQ ID NO: 2485583 - RNA, 22 nt, Brucella suis 1330
aggaugaaugccgaagccaggu

SEQ ID NO: 2485584 - RNA, 12 nt, Brucella suis 1330
aggaugcugcca

SEQ ID NO: 2485585 - RNA, 17 nt, Brucella suis 1330
aggauucgaaccucuga

SEQ ID NO: 2485586 - RNA, 18 nt, Brucella suis 1330
aggauucgaaccucugac

SEQ ID NO: 2485587 - RNA, 18 nt, Brucella suis 1330
aggauugccgccgcacuu

SEQ ID NO: 2485588 - RNA, 19 nt, Brucella suis 1330
aggauuugcccgguuuucg

SEQ ID NO: 2485589 - RNA, 20 nt, Brucella suis 1330
aggcaaagccgaaugccagu

SEQ ID NO: 2485590 - RNA, 16 nt, Brucella suis 1330
aggcaacaucgccuug

SEQ ID NO: 2485591 - RNA, 21 nt, Brucella suis 1330
aggcacuggucgggauugucg

SEQ ID NO: 2485592 - RNA, 16 nt, Brucella suis 1330
aggcagacauggccuu

SEQ ID NO: 2485593 - RNA, 17 nt, Brucella suis 1330
aggcagccgugagcaug

SEQ ID NO: 2485594 - RNA, 22 nt, Brucella suis 1330
aggcagccgugagcauggcaag

SEQ ID NO: 2485595 - RNA, 12 nt, Brucella suis 1330
aggcagggagga

SEQ ID NO: 2485596 - RNA, 19 nt, Brucella suis 1330
aggcauaauaggcaucggc

SEQ ID NO: 2485597 - RNA, 18 nt, Brucella suis 1330
aggccagucgcugcccca

SEQ ID NO: 2485598 - RNA, 20 nt, Brucella suis 1330
aggccauucccgccucagcc

SEQ ID NO: 2485599 - RNA, 22 nt, Brucella suis 1330
aggccccgucauucaucagcac

SEQ ID NO: 2485600 - RNA, 18 nt, Brucella suis 1330
aggcccggugcaaucggc

SEQ ID NO: 2485601 - RNA, 21 nt, Brucella suis 1330
aggcccuucagggacgagcgg

SEQ ID NO: 2485602 - RNA, 13 nt, Brucella suis 1330
aggccgaccgcaa

SEQ ID NO: 2485603 - RNA, 14 nt, Brucella suis 1330
aggccgagcgccgc

SEQ ID NO: 2485604 - RNA, 17 nt, Brucella suis 1330
aggccgagcgccgccgc

SEQ ID NO: 2485605 - RNA, 22 nt, Brucella suis 1330
aggccgaggcaaccgccucggc

SEQ ID NO: 2485606 - RNA, 18 nt, Brucella suis 1330
aggccgcgaucacggcca

SEQ ID NO: 2485607 - RNA, 13 nt, Brucella suis 1330
aggccgcgccgau

SEQ ID NO: 2485608 - RNA, 19 nt, Brucella suis 1330
aggccgcucuucggggcgg

SEQ ID NO: 2485609 - RNA, 16 nt, Brucella suis 1330
aggccggacgcuucaa

SEQ ID NO: 2485610 - RNA, 13 nt, Brucella suis 1330
aggccgggucagg

SEQ ID NO: 2485611 - RNA, 21 nt, Brucella suis 1330
aggccgguaagcccugucagc

SEQ ID NO: 2485612 - RNA, 20 nt, Brucella suis 1330
aggccgguaauaacuuccgg

SEQ ID NO: 2485613 - RNA, 18 nt, Brucella suis 1330
aggccguuacucggccgc

SEQ ID NO: 2485614 - RNA, 16 nt, Brucella suis 1330
aggccucaucgaucac

SEQ ID NO: 2485615 - RNA, 20 nt, Brucella suis 1330
aggccucgaaauagccgacc

SEQ ID NO: 2485616 - RNA, 16 nt, Brucella suis 1330
aggccugauagcggaa

SEQ ID NO: 2485617 - RNA, 13 nt, Brucella suis 1330
aggccuucuuccc

SEQ ID NO: 2485618 - RNA, 20 nt, Brucella suis 1330
aggcgaaauauuggcuaaaa

SEQ ID NO: 2485619 - RNA, 13 nt, Brucella suis 1330
aggcgaaugaucu

SEQ ID NO: 2485620 - RNA, 21 nt, Brucella suis 1330
aggcgacacggccgaucgcca

SEQ ID NO: 2485621 - RNA, 22 nt, Brucella suis 1330
aggcgaguuuucaaaccaaaaa

SEQ ID NO: 2485622 - RNA, 12 nt, Brucella suis 1330
aggcgcaggccc

SEQ ID NO: 2485623 - RNA, 14 nt, Brucella suis 1330
aggcgccagcacuu

SEQ ID NO: 2485624 - RNA, 12 nt, Brucella suis 1330
aggcgcgcgccu

SEQ ID NO: 2485625 - RNA, 14 nt, Brucella suis 1330
aggcgcggcgugga

SEQ ID NO: 2485626 - RNA, 16 nt, Brucella suis 1330
aggcggauauucgccg

SEQ ID NO: 2485627 - RNA, 15 nt, Brucella suis 1330
aggcggaugcgcggc

SEQ ID NO: 2485628 - RNA, 19 nt, Brucella suis 1330
aguugaaaagggcaagggc

SEQ ID NO: 2485629 - RNA, 17 nt, Brucella suis 1330
aguugccacgcgccgcc

SEQ ID NO: 2485630 - RNA, 20 nt, Brucella suis 1330
aguugcuccagcccuuuccu

SEQ ID NO: 2485631 - RNA, 17 nt, Brucella suis 1330
aguuggucguccaacuu

SEQ ID NO: 2485632 - RNA, 17 nt, Brucella suis 1330
aguugugccugccgcgc

SEQ ID NO: 2485633 - RNA, 14 nt, Brucella suis 1330
aguuuauucauugg

SEQ ID NO: 2485634 - RNA, 13 nt, Brucella suis 1330
aguuuccagccuu

SEQ ID NO: 2485635 - RNA, 22 nt, Brucella suis 1330
aguuucggaucggcaagcuuga

SEQ ID NO: 2485636 - RNA, 23 nt, Brucella suis 1330
aguuuggcuaaagauaccagauc

SEQ ID NO: 2485637 - RNA, 20 nt, Brucella suis 1330
aguuuggcugugcugguaaa

SEQ ID NO: 2485638 - RNA, 14 nt, Brucella suis 1330
aguuuguugaaaca

SEQ ID NO: 2485639 - RNA, 20 nt, Brucella suis 1330
aguuuguugaaacaggccuu

SEQ ID NO: 2485640 - RNA, 18 nt, Brucella suis 1330
auaaaaaggaugaaugcc

SEQ ID NO: 2485641 - RNA, 16 nt, Brucella suis 1330
auaaacagcguuucca

SEQ ID NO: 2485642 - RNA, 15 nt, Brucella suis 1330
auaaacccgccccca

SEQ ID NO: 2485643 - RNA, 14 nt, Brucella suis 1330
auaaagcaccauga

SEQ ID NO: 2485644 - RNA, 19 nt, Brucella suis 1330
auaaagcaggaucgacagc

SEQ ID NO: 2485645 - RNA, 18 nt, Brucella suis 1330
auaaagcugguugcgcgg

SEQ ID NO: 2485646 - RNA, 14 nt, Brucella suis 1330
auaacgacgcccgc

SEQ ID NO: 2485647 - RNA, 16 nt, Brucella suis 1330
auaacgcuugcagagc

SEQ ID NO: 2485648 - RNA, 20 nt, Brucella suis 1330
auaacgcuugcagagcgcau

SEQ ID NO: 2485649 - RNA, 15 nt, Brucella suis 1330
auaagcaacagggcg

SEQ ID NO: 2485650 - RNA, 20 nt, Brucella suis 1330
auaagccgccucaaugguca

SEQ ID NO: 2485651 - RNA, 23 nt, Brucella suis 1330
auaagcgccauaggucgugcauu

SEQ ID NO: 2485652 - RNA, 16 nt, Brucella suis 1330
auaauagucgaaaaaa

SEQ ID NO: 2485653 - RNA, 13 nt, Brucella suis 1330
auaaucagcagaa

SEQ ID NO: 2485654 - RNA, 11 nt, Brucella suis 1330
auaaucagccu

SEQ ID NO: 2485655 - RNA, 15 nt, Brucella suis 1330
auaaucguaucgcca

SEQ ID NO: 2485656 - RNA, 19 nt, Brucella suis 1330
auaaucguaucgccaaaga

SEQ ID NO: 2485657 - RNA, 13 nt, Brucella suis 1330
auaaugcauggag

SEQ ID NO: 2485658 - RNA, 14 nt, Brucella suis 1330
auacaaaaaauccc

SEQ ID NO: 2485659 - RNA, 13 nt, Brucella suis 1330
auacaagcccaag

SEQ ID NO: 2485660 - RNA, 22 nt, Brucella suis 1330
auacaugaugaucgccagcacg

SEQ ID NO: 2485661 - RNA, 17 nt, Brucella suis 1330
auacaugcagaucgcau

SEQ ID NO: 2485662 - RNA, 16 nt, Brucella suis 1330
auacauggcguaggca

SEQ ID NO: 2485663 - RNA, 23 nt, Brucella suis 1330
auaccagaucaagcgcucagcuu

SEQ ID NO: 2485664 - RNA, 16 nt, Brucella suis 1330
auacccaugccuuuca

SEQ ID NO: 2485665 - RNA, 18 nt, Brucella suis 1330
auaccgcaccgauccgca

SEQ ID NO: 2485666 - RNA, 16 nt, Brucella suis 1330
auaccgucgaggaaaa

SEQ ID NO: 2485667 - RNA, 15 nt, Brucella suis 1330
auaccgugaucaggg

SEQ ID NO: 2485668 - RNA, 20 nt, Brucella suis 1330
auacgaccaacccuuuuuca

SEQ ID NO: 2485669 - RNA, 22 nt, Brucella suis 1330
auacgguccugcaaaccggcug

SEQ ID NO: 2485670 - RNA, 17 nt, Brucella suis 1330
auacuccccuacucccu

SEQ ID NO: 2485671 - RNA, 12 nt, Brucella suis 1330
auacugccuuac

SEQ ID NO: 2485672 - RNA, 11 nt, Brucella suis 1330
auacugcgcgc

SEQ ID NO: 2485673 - RNA, 17 nt, Brucella suis 1330
auacuggguugaacggu

SEQ ID NO: 2485674 - RNA, 17 nt, Brucella suis 1330
auagaaggaauccgguu

SEQ ID NO: 2485675 - RNA, 17 nt, Brucella suis 1330
auagacaucgaacgugg

SEQ ID NO: 2485676 - RNA, 12 nt, Brucella suis 1330
auagaccaugcc

SEQ ID NO: 2485677 - RNA, 14 nt, Brucella suis 1330
auagaccaugccgc

SEQ ID NO: 2485678 - RNA, 19 nt, Brucella suis 1330
auagaccaugccgccagcc

SEQ ID NO: 2485679 - RNA, 23 nt, Brucella suis 1330
auagacgcgcagacgcagcgcau

SEQ ID NO: 2485680 - RNA, 17 nt, Brucella suis 1330
auagacggcguuuccaa

SEQ ID NO: 2485681 - RNA, 17 nt, Brucella suis 1330
auagagcagcaccggcg

SEQ ID NO: 2485682 - RNA, 14 nt, Brucella suis 1330
auagagccacgaga

SEQ ID NO: 2485683 - RNA, 19 nt, Brucella suis 1330
auagagccacgagaaaaug

SEQ ID NO: 2485684 - RNA, 22 nt, Brucella suis 1330
auagaggaacucgcccaccgaa

SEQ ID NO: 2485685 - RNA, 14 nt, Brucella suis 1330
auagauaaacgcac

SEQ ID NO: 2485686 - RNA, 19 nt, Brucella suis 1330
auagauguucuuccccguc

SEQ ID NO: 2485687 - RNA, 13 nt, Brucella suis 1330
auagauuccagau

SEQ ID NO: 2485688 - RNA, 19 nt, Brucella suis 1330
auagccacccugaugccgg

SEQ ID NO: 2485689 - RNA, 12 nt, Brucella suis 1330
auagcccggcag

SEQ ID NO: 2485690 - RNA, 13 nt, Brucella suis 1330
auagcccugaucg

SEQ ID NO: 2485691 - RNA, 20 nt, Brucella suis 1330
auagccgagauagacaugcg

SEQ ID NO: 2485692 - RNA, 19 nt, Brucella suis 1330
auagccgaucuggcugaga

SEQ ID NO: 2485693 - RNA, 14 nt, Brucella suis 1330
auagccugcaagcg

SEQ ID NO: 2485694 - RNA, 17 nt, Brucella suis 1330
auagcgcgcccaaucuc

SEQ ID NO: 2485695 - RNA, 19 nt, Brucella suis 1330
auagcgguugcagccgcca

SEQ ID NO: 2485696 - RNA, 18 nt, Brucella suis 1330
auagcucgacgcuuucca

SEQ ID NO: 2485697 - RNA, 18 nt, Brucella suis 1330
auagcuuaugcgcgcccg

SEQ ID NO: 2485698 - RNA, 17 nt, Brucella suis 1330
auaggcaacaggcguca

SEQ ID NO: 2485699 - RNA, 23 nt, Brucella suis 1330
auaggcacccuugguugcgcgcc

SEQ ID NO: 2485700 - RNA, 14 nt, Brucella suis 1330
auaggccguuccgc

SEQ ID NO: 2485701 - RNA, 22 nt, Brucella suis 1330
auaggccucggugcagccgaac

SEQ ID NO: 2485702 - RNA, 20 nt, Brucella suis 1330
auaggcgcgcgcaagggccg

SEQ ID NO: 2485703 - RNA, 16 nt, Brucella suis 1330
auaggcgcgcgccucg

SEQ ID NO: 2485704 - RNA, 16 nt, Brucella suis 1330
auaggcguugaugacg

SEQ ID NO: 2485705 - RNA, 18 nt, Brucella suis 1330
auagggaaacggccaggg

SEQ ID NO: 2485706 - RNA, 13 nt, Brucella suis 1330
auagucaguuccu

SEQ ID NO: 2485707 - RNA, 15 nt, Brucella suis 1330
auagucggcaaccau

SEQ ID NO: 2485708 - RNA, 18 nt, Brucella suis 1330
auagucggcaaccaucuu

SEQ ID NO: 2485709 - RNA, 14 nt, Brucella suis 1330
auagugaagccacg

SEQ ID NO: 2485710 - RNA, 15 nt, Brucella suis 1330
auaguuggagcgguu

SEQ ID NO: 2485711 - RNA, 14 nt, Brucella suis 1330
auauaaagcaaagg

SEQ ID NO: 2485712 - RNA, 19 nt, Brucella suis 1330
auaucacgcuugcccgcgc

SEQ ID NO: 2485713 - RNA, 13 nt, Brucella suis 1330
auauccagcuugc

SEQ ID NO: 2485714 - RNA, 22 nt, Brucella suis 1330
auauccggcacggccacgcgca

SEQ ID NO: 2485715 - RNA, 18 nt, Brucella suis 1330
auauccucugugacugcg

SEQ ID NO: 2485716 - RNA, 21 nt, Brucella suis 1330
auaucgccagaauggcgauau

SEQ ID NO: 2485717 - RNA, 22 nt, Brucella suis 1330
auaucgccgacgauuucuucca

SEQ ID NO: 2485718 - RNA, 18 nt, Brucella suis 1330
auaucgccugcuuccuuu

SEQ ID NO: 2485719 - RNA, 14 nt, Brucella suis 1330
auaucuucgcccug

SEQ ID NO: 2485720 - RNA, 17 nt, Brucella suis 1330
auauggucgcugcggcc

SEQ ID NO: 2485721 - RNA, 13 nt, Brucella suis 1330
auauguuccugcg

SEQ ID NO: 2485722 - RNA, 18 nt, Brucella suis 1330
auauucaggaucuuucca

SEQ ID NO: 2485723 - RNA, 15 nt, Brucella suis 1330
auauucgucggucag

SEQ ID NO: 2485724 - RNA, 18 nt, Brucella suis 1330
auauugagagauuucacc

SEQ ID NO: 2485725 - RNA, 19 nt, Brucella suis 1330
auauugcgcauaucgcgcg

SEQ ID NO: 2485726 - RNA, 19 nt, Brucella suis 1330
auauuugccgccagaaaau

SEQ ID NO: 2485727 - RNA, 18 nt, Brucella suis 1330
auauuuuguuaucaagcc

SEQ ID NO: 2485728 - RNA, 16 nt, Brucella suis 1330
aucaaaagaaaccuug

SEQ ID NO: 2485729 - RNA, 23 nt, Brucella suis 1330
aucaaaagaaaccuugccgcguc

SEQ ID NO: 2485730 - RNA, 11 nt, Brucella suis 1330
aucaaaccggc

SEQ ID NO: 2485731 - RNA, 21 nt, Brucella suis 1330
aucaacccgucuucauugacc

SEQ ID NO: 2485732 - RNA, 13 nt, Brucella suis 1330
aucaaccucgcgg

SEQ ID NO: 2485733 - RNA, 15 nt, Brucella suis 1330
aucaacgcuuugacc

SEQ ID NO: 2485734 - RNA, 21 nt, Brucella suis 1330
aucaacgcuuugaccgccgcg

SEQ ID NO: 2485735 - RNA, 19 nt, Brucella suis 1330
aucaagaaugugccgcugc

SEQ ID NO: 2485736 - RNA, 16 nt, Brucella suis 1330
aucaagcgucaugcca

SEQ ID NO: 2485737 - RNA, 22 nt, Brucella suis 1330
aucaauacgcucgcacaucggg

SEQ ID NO: 2485738 - RNA, 16 nt, Brucella suis 1330
aucaauccuucaugcc

SEQ ID NO: 2485739 - RNA, 19 nt, Brucella suis 1330
aucaaugcaccccaugaga

SEQ ID NO: 2485740 - RNA, 18 nt, Brucella suis 1330
aucaaugugcccugcgcg

SEQ ID NO: 2485741 - RNA, 17 nt, Brucella suis 1330
aucacagccgcgccaau

SEQ ID NO: 2485742 - RNA, 15 nt, Brucella suis 1330
aucaccaauauugca

SEQ ID NO: 2485743 - RNA, 21 nt, Brucella suis 1330
aucaccauuuucgcacgcgca

SEQ ID NO: 2485744 - RNA, 20 nt, Brucella suis 1330
aucacccgauaaacccgccc

SEQ ID NO: 2485745 - RNA, 19 nt, Brucella suis 1330
aucggaagggcaaggcgcg

SEQ ID NO: 2485746 - RNA, 15 nt, Brucella suis 1330
aucggaaucaaaacc

SEQ ID NO: 2485747 - RNA, 14 nt, Brucella suis 1330
aucggacuggauuu

SEQ ID NO: 2485748 - RNA, 18 nt, Brucella suis 1330
aucggcaagcgcaauggc

SEQ ID NO: 2485749 - RNA, 20 nt, Brucella suis 1330
aucggcacuucgccaaagau

SEQ ID NO: 2485750 - RNA, 17 nt, Brucella suis 1330
aucggcagcuuuggcgc

SEQ ID NO: 2485751 - RNA, 22 nt, Brucella suis 1330
aucggcagcuuuggcgccgucg

SEQ ID NO: 2485752 - RNA, 18 nt, Brucella suis 1330
aucggccauuucggcuuc

SEQ ID NO: 2485753 - RNA, 20 nt, Brucella suis 1330
aucggccugaugcaaugcgu

SEQ ID NO: 2485754 - RNA, 22 nt, Brucella suis 1330
aucggcgauauggcgcaaugcc

SEQ ID NO: 2485755 - RNA, 15 nt, Brucella suis 1330
aucggcgaugcccau

SEQ ID NO: 2485756 - RNA, 15 nt, Brucella suis 1330
aucggcgggccaggu

SEQ ID NO: 2485757 - RNA, 19 nt, Brucella suis 1330
aucggguacgaaccacggc

SEQ ID NO: 2485758 - RNA, 21 nt, Brucella suis 1330
aucggguguuugcgacgggcg

SEQ ID NO: 2485759 - RNA, 15 nt, Brucella suis 1330
aucgguacggaaagg

SEQ ID NO: 2485760 - RNA, 15 nt, Brucella suis 1330
aucgguggugccgaa

SEQ ID NO: 2485761 - RNA, 20 nt, Brucella suis 1330
aucgguggugccgaaggccu

SEQ ID NO: 2485762 - RNA, 17 nt, Brucella suis 1330
aucguaaucgccgggcc

SEQ ID NO: 2485763 - RNA, 21 nt, Brucella suis 1330
aucguaucgccaaagaccagc

SEQ ID NO: 2485764 - RNA, 20 nt, Brucella suis 1330
aucgucaaucacgccacugc

SEQ ID NO: 2485765 - RNA, 11 nt, Brucella suis 1330
aucgucacuga

SEQ ID NO: 2485766 - RNA, 15 nt, Brucella suis 1330
aucgucagcaccgcu

SEQ ID NO: 2485767 - RNA, 17 nt, Brucella suis 1330
aucgucggccaguucag

SEQ ID NO: 2485768 - RNA, 18 nt, Brucella suis 1330
aucgucguccagcccugc

SEQ ID NO: 2485769 - RNA, 22 nt, Brucella suis 1330
aucgugagcgagcgcacauaaa

SEQ ID NO: 2485770 - RNA, 22 nt, Brucella suis 1330
aucgugcagaaguuucagcgca

SEQ ID NO: 2485771 - RNA, 20 nt, Brucella suis 1330
aucgugccgccgugaaaaua

SEQ ID NO: 2485772 - RNA, 18 nt, Brucella suis 1330
aucgugccggaauggcca

SEQ ID NO: 2485773 - RNA, 16 nt, Brucella suis 1330
aucguggcggcaaaaa

SEQ ID NO: 2485774 - RNA, 19 nt, Brucella suis 1330
aucguugaaggcguuggcc

SEQ ID NO: 2485775 - RNA, 22 nt, Brucella suis 1330
aucguuuuguugcacuccggcu

SEQ ID NO: 2485776 - RNA, 19 nt, Brucella suis 1330
aucuaguggagcaccgccc

SEQ ID NO: 2485777 - RNA, 19 nt, Brucella suis 1330
aucucacacugcaaaacug

SEQ ID NO: 2485778 - RNA, 20 nt, Brucella suis 1330
aucucaccggaagguuuuuc

SEQ ID NO: 2485779 - RNA, 16 nt, Brucella suis 1330
aucucaugauggcccu

SEQ ID NO: 2485780 - RNA, 11 nt, Brucella suis 1330
aucuccggcgc

SEQ ID NO: 2485781 - RNA, 21 nt, Brucella suis 1330
aucucguucacaaucuugcca

SEQ ID NO: 2485782 - RNA, 13 nt, Brucella suis 1330
aucugaaugaauc

SEQ ID NO: 2485783 - RNA, 22 nt, Brucella suis 1330
aucugacccggcgcaaaggccg

SEQ ID NO: 2485784 - RNA, 17 nt, Brucella suis 1330
aucugcaacaccaucga

SEQ ID NO: 2485785 - RNA, 15 nt, Brucella suis 1330
aucugcgcgcgcgca

SEQ ID NO: 2485786 - RNA, 22 nt, Brucella suis 1330
aucugcgcgucgagcaaugcgc

SEQ ID NO: 2485787 - RNA, 22 nt, Brucella suis 1330
aucugcggcggcgucagcuugu

SEQ ID NO: 2485788 - RNA, 22 nt, Brucella suis 1330
aucugcuugguuuccgccagca

SEQ ID NO: 2485789 - RNA, 16 nt, Brucella suis 1330
aucuggaacaguucca

SEQ ID NO: 2485790 - RNA, 18 nt, Brucella suis 1330
aucuggagugcacggcca

SEQ ID NO: 2485791 - RNA, 23 nt, Brucella suis 1330
aucuggcgcgcgaacgggaacaa

SEQ ID NO: 2485792 - RNA, 16 nt, Brucella suis 1330
aucuggcugagauaaa

SEQ ID NO: 2485793 - RNA, 16 nt, Brucella suis 1330
aucuguaucccgaaaa

SEQ ID NO: 2485794 - RNA, 22 nt, Brucella suis 1330
aucuguucauguuuugaaucug

SEQ ID NO: 2485795 - RNA, 23 nt, Brucella suis 1330
aucuuauaaaaaggccgcucuuc

SEQ ID NO: 2485796 - RNA, 16 nt, Brucella suis 1330
aucuucgaucauuucc

SEQ ID NO: 2485797 - RNA, 19 nt, Brucella suis 1330
aucuucgcccugaaacacu

SEQ ID NO: 2485798 - RNA, 18 nt, Brucella suis 1330
aucuucggcaucagaaau

SEQ ID NO: 2485799 - RNA, 21 nt, Brucella suis 1330
aucuucggcaucagaaauuug

SEQ ID NO: 2485800 - RNA, 22 nt, Brucella suis 1330
aucuucucgaacugguucagcc

SEQ ID NO: 2485801 - RNA, 20 nt, Brucella suis 1330
aucuucuuccaguuucugaa

SEQ ID NO: 2485802 - RNA, 13 nt, Brucella suis 1330
aucuucuugcauu

SEQ ID NO: 2485803 - RNA, 19 nt, Brucella suis 1330
aucuugaccuggccagcca

SEQ ID NO: 2485804 - RNA, 20 nt, Brucella suis 1330
aucuugcgcagcgcaggcgc

SEQ ID NO: 2485805 - RNA, 16 nt, Brucella suis 1330
aucuugcugaugagcc

SEQ ID NO: 2485806 - RNA, 12 nt, Brucella suis 1330
augaaaaacccc

SEQ ID NO: 2485807 - RNA, 18 nt, Brucella suis 1330
augaaagaacggcccgca

SEQ ID NO: 2485808 - RNA, 22 nt, Brucella suis 1330
augaacagaucggaaucaaaac

SEQ ID NO: 2485809 - RNA, 21 nt, Brucella suis 1330
augaagaagauaaucagcaga

SEQ ID NO: 2485810 - RNA, 14 nt, Brucella suis 1330
augaagaccuggaa

SEQ ID NO: 2485811 - RNA, 16 nt, Brucella suis 1330
augaagaccuggaacg

SEQ ID NO: 2485812 - RNA, 19 nt, Brucella suis 1330
augaagcaaaggucgggug

SEQ ID NO: 2485813 - RNA, 19 nt, Brucella suis 1330
augaagcgcggcggccacu

SEQ ID NO: 2485814 - RNA, 21 nt, Brucella suis 1330
augaagcgggccgcuugcuug

SEQ ID NO: 2485815 - RNA, 14 nt, Brucella suis 1330
augaagguaagcuu

SEQ ID NO: 2485816 - RNA, 15 nt, Brucella suis 1330
augaaugccgaagcc

SEQ ID NO: 2485817 - RNA, 18 nt, Brucella suis 1330
augacgccgggcauggaa

SEQ ID NO: 2485818 - RNA, 14 nt, Brucella suis 1330
augacggcgcggcg

SEQ ID NO: 2485819 - RNA, 16 nt, Brucella suis 1330
augagaaggcaagccc

SEQ ID NO: 2485820 - RNA, 14 nt, Brucella suis 1330
augagcagcggcaa

SEQ ID NO: 2485821 - RNA, 21 nt, Brucella suis 1330
augagccgcuucugcucacca

SEQ ID NO: 2485822 - RNA, 12 nt, Brucella suis 1330
augagccgcuug

SEQ ID NO: 2485823 - RNA, 11 nt, Brucella suis 1330
augagccucaa

SEQ ID NO: 2485824 - RNA, 18 nt, Brucella suis 1330
augagcuugcgcccgccg

SEQ ID NO: 2485825 - RNA, 19 nt, Brucella suis 1330
augagcuugcgcccgccga

SEQ ID NO: 2485826 - RNA, 22 nt, Brucella suis 1330
augaggucggucagucgcccac

SEQ ID NO: 2485827 - RNA, 21 nt, Brucella suis 1330
augauaggcaacaucgccuug

SEQ ID NO: 2485828 - RNA, 23 nt, Brucella suis 1330
augauauaggcgcaaucggcacu

SEQ ID NO: 2485829 - RNA, 14 nt, Brucella suis 1330
augauggcccuugu

SEQ ID NO: 2485830 - RNA, 23 nt, Brucella suis 1330
augauggccgggaaugcggaagc

SEQ ID NO: 2485831 - RNA, 19 nt, Brucella suis 1330
augauugucugcgugauau

SEQ ID NO: 2485832 - RNA, 22 nt, Brucella suis 1330
augauuuccucagcgguaaagg

SEQ ID NO: 2485833 - RNA, 23 nt, Brucella suis 1330
augcaaaaagggaggcaucagcc

SEQ ID NO: 2485834 - RNA, 20 nt, Brucella suis 1330
augcaagccggucugucauu

SEQ ID NO: 2485835 - RNA, 23 nt, Brucella suis 1330
augcaccccaugagaaggcaagc

SEQ ID NO: 2485836 - RNA, 13 nt, Brucella suis 1330
augcaccuucgcu

SEQ ID NO: 2485837 - RNA, 19 nt, Brucella suis 1330
augcagacaaguccuaaaa

SEQ ID NO: 2485838 - RNA, 23 nt, Brucella suis 1330
augcagcggcgcacucaucaaaa

SEQ ID NO: 2485839 - RNA, 12 nt, Brucella suis 1330
augcagcggguu

SEQ ID NO: 2485840 - RNA, 22 nt, Brucella suis 1330
augcaggccgugaagauugcuu

SEQ ID NO: 2485841 - RNA, 15 nt, Brucella suis 1330
augcaguuccaucca

SEQ ID NO: 2485842 - RNA, 19 nt, Brucella suis 1330
augcaguuccauccauuga

SEQ ID NO: 2485843 - RNA, 15 nt, Brucella suis 1330
augcauggaggcaag

SEQ ID NO: 2485844 - RNA, 19 nt, Brucella suis 1330
augcauuuuucgccgcgca

SEQ ID NO: 2485845 - RNA, 23 nt, Brucella suis 1330
augcccacaucgccuugcagaua

SEQ ID NO: 2485846 - RNA, 15 nt, Brucella suis 1330
augcccagcucgccg

SEQ ID NO: 2485847 - RNA, 22 nt, Brucella suis 1330
augcccaugcaguuccauccau

SEQ ID NO: 2485848 - RNA, 14 nt, Brucella suis 1330
augcccgcuuuccc

SEQ ID NO: 2485849 - RNA, 19 nt, Brucella suis 1330
augcccggcgcgaccgcgu

SEQ ID NO: 2485850 - RNA, 22 nt, Brucella suis 1330
augcccggcgcgaccgcguuca

SEQ ID NO: 2485851 - RNA, 19 nt, Brucella suis 1330
augccgauacuguagaaaa

SEQ ID NO: 2485852 - RNA, 16 nt, Brucella suis 1330
augccgauaucggcau

SEQ ID NO: 2485853 - RNA, 22 nt, Brucella suis 1330
augccgcaugauaggcaacauc

SEQ ID NO: 2485854 - RNA, 16 nt, Brucella suis 1330
augccgccaaggccgg

SEQ ID NO: 2485855 - RNA, 13 nt, Brucella suis 1330
augccggaugcgg
